United States Patent 7,888,497 (BIOINFORMATICALLY DETECTABLE GROUP OF NOVEL REGULATORY OLIGONUCLEOTIDES AND USES THEREOF) - sequence listing, part 141

SEQ ID NO: 5978657 - DNA, 19 bp, Homo sapiens
caaagccctgcctctgtgt

SEQ ID NO: 5978658 - DNA, 12 bp, Homo sapiens
caaagccctgtc

SEQ ID NO: 5978659 - DNA, 14 bp, Homo sapiens
caaagccctgtcct

SEQ ID NO: 5978660 - DNA, 16 bp, Homo sapiens
caaagccggcctgaga

SEQ ID NO: 5978661 - DNA, 17 bp, Homo sapiens
caaagcctcctccagcc

SEQ ID NO: 5978662 - DNA, 21 bp, Homo sapiens
caaagcctcttcaaaaagcag

SEQ ID NO: 5978663 - DNA, 14 bp, Homo sapiens
caaagcctgaggac

SEQ ID NO: 5978664 - DNA, 14 bp, Homo sapiens
caaagcctggccta

SEQ ID NO: 5978665 - DNA, 17 bp, Homo sapiens
caaagcctgtcccagga

SEQ ID NO: 5978666 - DNA, 18 bp, Homo sapiens
caaagcctgtcccaggac

SEQ ID NO: 5978667 - DNA, 22 bp, Homo sapiens
caaagcctgttcatggcagatg

SEQ ID NO: 5978668 - DNA, 18 bp, Homo sapiens
caaagccttaagcaaatt

SEQ ID NO: 5978669 - DNA, 16 bp, Homo sapiens
caaagccttctcccta

SEQ ID NO: 5978670 - DNA, 17 bp, Homo sapiens
caaagccttgtgtctac

SEQ ID NO: 5978671 - DNA, 23 bp, Homo sapiens
caaagccttgtgtctacagagaa

SEQ ID NO: 5978672 - DNA, 14 bp, Homo sapiens
caaagcgaatttta

SEQ ID NO: 5978673 - DNA, 15 bp, Homo sapiens
caaagcgacagattc

SEQ ID NO: 5978674 - DNA, 19 bp, Homo sapiens
caaagcgagatcccatctc

SEQ ID NO: 5978675 - DNA, 16 bp, Homo sapiens
caaagcgcccacccag

SEQ ID NO: 5978676 - DNA, 12 bp, Homo sapiens
caaagcggctct

SEQ ID NO: 5978677 - DNA, 22 bp, Homo sapiens
caaagcgggacgccgcaggtgt

SEQ ID NO: 5978678 - DNA, 17 bp, Homo sapiens
caaagcggtccctgtcc

SEQ ID NO: 5978679 - DNA, 20 bp, Homo sapiens
caaagctaaaaaattgttaa

SEQ ID NO: 5978680 - DNA, 21 bp, Homo sapiens
caaagctaaatacatggaaat

SEQ ID NO: 5978681 - DNA, 21 bp, Homo sapiens
caaagctaggaaaggcagaaa

SEQ ID NO: 5978682 - DNA, 13 bp, Homo sapiens
caaagctaggatg

SEQ ID NO: 5978683 - DNA, 16 bp, Homo sapiens
caaagctaggcctggc

SEQ ID NO: 5978684 - DNA, 17 bp, Homo sapiens
caaagctaggcctggcc

SEQ ID NO: 5978685 - DNA, 21 bp, Homo sapiens
caaagctatatgttgtaactt

SEQ ID NO: 5978686 - DNA, 12 bp, Homo sapiens
caaagctattta

SEQ ID NO: 5978687 - DNA, 18 bp, Homo sapiens
caaagctatttaagtgga

SEQ ID NO: 5978688 - DNA, 21 bp, Homo sapiens
caaagctcaagatgacagctc

SEQ ID NO: 5978689 - DNA, 22 bp, Homo sapiens
caaagctcaagatgacagctct

SEQ ID NO: 5978690 - DNA, 20 bp, Homo sapiens
caaagctccttaaagttctg

SEQ ID NO: 5978691 - DNA, 20 bp, Homo sapiens
caaagctcgggtctccctcc

SEQ ID NO: 5978692 - DNA, 19 bp, Homo sapiens
caaagctctgaattcaggt

SEQ ID NO: 5978693 - DNA, 21 bp, Homo sapiens
caaagctctgaattcaggtcc

SEQ ID NO: 5978694 - DNA, 22 bp, Homo sapiens
caaagctctgaattcaggtccc

SEQ ID NO: 5978695 - DNA, 22 bp, Homo sapiens
caaagctgaaaatgtgtataca

SEQ ID NO: 5978696 - DNA, 22 bp, Homo sapiens
caaagctgaagccgccaggacc

SEQ ID NO: 5978697 - DNA, 15 bp, Homo sapiens
caaagctgaatattt

SEQ ID NO: 5978698 - DNA, 21 bp, Homo sapiens
caaagctgagttacttgtctg

SEQ ID NO: 5978699 - DNA, 19 bp, Homo sapiens
caaagctgatgacaacttc

SEQ ID NO: 5978700 - DNA, 15 bp, Homo sapiens
caaagctgcccactg

SEQ ID NO: 5978701 - DNA, 20 bp, Homo sapiens
caaagctgcccactgtttct

SEQ ID NO: 5978702 - DNA, 23 bp, Homo sapiens
caaagctgcctgtgccatgccca

SEQ ID NO: 5978703 - DNA, 17 bp, Homo sapiens
caaagctgctaaatctc

SEQ ID NO: 5978704 - DNA, 23 bp, Homo sapiens
caaagctgctaaatctcctattt

SEQ ID NO: 5978705 - DNA, 14 bp, Homo sapiens
caaagctgctgggc

SEQ ID NO: 5978706 - DNA, 16 bp, Homo sapiens
caaagctgctgggcca

SEQ ID NO: 5978707 - DNA, 17 bp, Homo sapiens
caaagctgctttcttct

SEQ ID NO: 5978708 - DNA, 20 bp, Homo sapiens
caaagctgctttcttctctg

SEQ ID NO: 5978709 - DNA, 22 bp, Homo sapiens
caaagctgctttcttctctgcc

SEQ ID NO: 5978710 - DNA, 18 bp, Homo sapiens
caaagctgtcactcacaa

SEQ ID NO: 5978711 - DNA, 12 bp, Homo sapiens
caaagctgttaa

SEQ ID NO: 5978712 - DNA, 13 bp, Homo sapiens
caaagctgttaaa

SEQ ID NO: 5978713 - DNA, 18 bp, Homo sapiens
caaagctgttcttcctgg

SEQ ID NO: 5978714 - DNA, 16 bp, Homo sapiens
caaagcttagcaggag

SEQ ID NO: 5978715 - DNA, 17 bp, Homo sapiens
caaagcttagcaggaga

SEQ ID NO: 5978716 - DNA, 18 bp, Homo sapiens
caaagcttagcaggagag

SEQ ID NO: 5978717 - DNA, 22 bp, Homo sapiens
caaagcttagcaggagaggaga

SEQ ID NO: 5978718 - DNA, 20 bp, Homo sapiens
caaagcttccattccacatc

SEQ ID NO: 5978719 - DNA, 18 bp, Homo sapiens
caaagcttcgtcttgtgt

SEQ ID NO: 5978720 - DNA, 21 bp, Homo sapiens
caaagcttggaagagcctgca

SEQ ID NO: 5978721 - DNA, 19 bp, Homo sapiens
caaagcttggagggaagcc

SEQ ID NO: 5978722 - DNA, 15 bp, Homo sapiens
caaagcttgtgaaaa

SEQ ID NO: 5978723 - DNA, 16 bp, Homo sapiens
caaagctttcctgccc

SEQ ID NO: 5978724 - DNA, 23 bp, Homo sapiens
caaagctttcctgtttccagggt

SEQ ID NO: 5978725 - DNA, 13 bp, Homo sapiens
caaagctttgcta

SEQ ID NO: 5978726 - DNA, 18 bp, Homo sapiens
caaagctttgctacaaat

SEQ ID NO: 5978727 - DNA, 19 bp, Homo sapiens
caaagctttgctacaaatt

SEQ ID NO: 5978728 - DNA, 21 bp, Homo sapiens
caaagctttgctacaaattta

SEQ ID NO: 5978729 - DNA, 17 bp, Homo sapiens
caaagcttttgcatatt

SEQ ID NO: 5978730 - DNA, 19 bp, Homo sapiens
caaagcttttgcctgcaag

SEQ ID NO: 5978731 - DNA, 20 bp, Homo sapiens
caaagcttttgcctgcaaga

SEQ ID NO: 5978732 - DNA, 17 bp, Homo sapiens
caaagcttttgtaaaat

SEQ ID NO: 5978733 - DNA, 22 bp, Homo sapiens
caaaggaaaaagcacaagaagc

SEQ ID NO: 5978734 - DNA, 21 bp, Homo sapiens
caaaggaaaacacctttattt

SEQ ID NO: 5978735 - DNA, 19 bp, Homo sapiens
caaaggaaaactcttggcc

SEQ ID NO: 5978736 - DNA, 22 bp, Homo sapiens
caaaggaaaactcttggcctct

SEQ ID NO: 5978737 - DNA, 13 bp, Homo sapiens
caaaggaaaataa

SEQ ID NO: 5978738 - DNA, 17 bp, Homo sapiens
caaaggaaaatgtctgt

SEQ ID NO: 5978739 - DNA, 20 bp, Homo sapiens
caaaggaaaccaaaggaatc

SEQ ID NO: 5978740 - DNA, 18 bp, Homo sapiens
caaaggaaactttgcaga

SEQ ID NO: 5978741 - DNA, 16 bp, Homo sapiens
caaaggaacactgaca

SEQ ID NO: 5978742 - DNA, 19 bp, Homo sapiens
caaaggaacattgtgtcta

SEQ ID NO: 5978743 - DNA, 22 bp, Homo sapiens
caaaggaagacttggcccagga

SEQ ID NO: 5978744 - DNA, 18 bp, Homo sapiens
caaaggaagtagcaggcc

SEQ ID NO: 5978745 - DNA, 16 bp, Homo sapiens
caaaggaagtctagga

SEQ ID NO: 5978746 - DNA, 19 bp, Homo sapiens
caaaggaagtgccccctcc

SEQ ID NO: 5978747 - DNA, 19 bp, Homo sapiens
caaaggaatctccagtttt

SEQ ID NO: 5978748 - DNA, 21 bp, Homo sapiens
caaaggaatggaggctctaat

SEQ ID NO: 5978749 - DNA, 21 bp, Homo sapiens
caaaggaatttgcatccagca

SEQ ID NO: 5978750 - DNA, 18 bp, Homo sapiens
caaaggacattatgtgtg

SEQ ID NO: 5978751 - DNA, 16 bp, Homo sapiens
caaaggacgcactgag

SEQ ID NO: 5978752 - DNA, 18 bp, Homo sapiens
caaaggacgcactgagca

SEQ ID NO: 5978753 - DNA, 18 bp, Homo sapiens
caaaggactgacctgccc

SEQ ID NO: 5978754 - DNA, 18 bp, Homo sapiens
caaaggacttgacttgca

SEQ ID NO: 5978755 - DNA, 19 bp, Homo sapiens
caaaggagaaaaaaaacct

SEQ ID NO: 5978756 - DNA, 21 bp, Homo sapiens
caaaggagacaaagcaggagt

SEQ ID NO: 5978757 - DNA, 20 bp, Homo sapiens
caaaggagagtcacagaaca

SEQ ID NO: 5978758 - DNA, 12 bp, Homo sapiens
caaaggagcctg

SEQ ID NO: 5978759 - DNA, 14 bp, Homo sapiens
caaaggagcctgtg

SEQ ID NO: 5978760 - DNA, 23 bp, Homo sapiens
cacactccttccccttgtccctg

SEQ ID NO: 5978761 - DNA, 16 bp, Homo sapiens
cacactcgcccgccca

SEQ ID NO: 5978762 - DNA, 18 bp, Homo sapiens
cacactcgtctttccctt

SEQ ID NO: 5978763 - DNA, 21 bp, Homo sapiens
cacactctcatgtccccttcc

SEQ ID NO: 5978764 - DNA, 21 bp, Homo sapiens
cacactctctgcagcccagcc

SEQ ID NO: 5978765 - DNA, 23 bp, Homo sapiens
cacactctctgcagcccagccta

SEQ ID NO: 5978766 - DNA, 12 bp, Homo sapiens
cacactctgacg

SEQ ID NO: 5978767 - DNA, 19 bp, Homo sapiens
cacactgaaacctcttcgg

SEQ ID NO: 5978768 - DNA, 12 bp, Homo sapiens
cacactgaaatt

SEQ ID NO: 5978769 - DNA, 13 bp, Homo sapiens
cacactgaagaag

SEQ ID NO: 5978770 - DNA, 18 bp, Homo sapiens
cacactgacataatgtag

SEQ ID NO: 5978771 - DNA, 13 bp, Homo sapiens
cacactgaccaca

SEQ ID NO: 5978772 - DNA, 17 bp, Homo sapiens
cacactgaccacactgt

SEQ ID NO: 5978773 - DNA, 14 bp, Homo sapiens
cacactgagctggg

SEQ ID NO: 5978774 - DNA, 16 bp, Homo sapiens
cacactgaggcaggga

SEQ ID NO: 5978775 - DNA, 18 bp, Homo sapiens
cacactgaggcagggaag

SEQ ID NO: 5978776 - DNA, 17 bp, Homo sapiens
cacactgagttctatca

SEQ ID NO: 5978777 - DNA, 18 bp, Homo sapiens
cacactgagttgcacata

SEQ ID NO: 5978778 - DNA, 21 bp, Homo sapiens
cacactgatacataaaaatta

SEQ ID NO: 5978779 - DNA, 20 bp, Homo sapiens
cacactgatgggctggggca

SEQ ID NO: 5978780 - DNA, 14 bp, Homo sapiens
cacactgcaacagg

SEQ ID NO: 5978781 - DNA, 17 bp, Homo sapiens
cacactgcaacaggaac

SEQ ID NO: 5978782 - DNA, 17 bp, Homo sapiens
cacactgcaagagcctt

SEQ ID NO: 5978783 - DNA, 19 bp, Homo sapiens
cacactgcaagagccttgg

SEQ ID NO: 5978784 - DNA, 12 bp, Homo sapiens
cacactgcacaa

SEQ ID NO: 5978785 - DNA, 19 bp, Homo sapiens
cacactgcagggaggagtg

SEQ ID NO: 5978786 - DNA, 18 bp, Homo sapiens
cacactgcagggctgctg

SEQ ID NO: 5978787 - DNA, 11 bp, Homo sapiens
cacactgccaa

SEQ ID NO: 5978788 - DNA, 18 bp, Homo sapiens
cacactgccaaataaaca

SEQ ID NO: 5978789 - DNA, 22 bp, Homo sapiens
cacactgccaaataaacagcta

SEQ ID NO: 5978790 - DNA, 17 bp, Homo sapiens
cacactgccagaagaga

SEQ ID NO: 5978791 - DNA, 18 bp, Homo sapiens
cacactgccctctgccac

SEQ ID NO: 5978792 - DNA, 19 bp, Homo sapiens
cacactgccctctgccact

SEQ ID NO: 5978793 - DNA, 14 bp, Homo sapiens
cacactgcctccca

SEQ ID NO: 5978794 - DNA, 20 bp, Homo sapiens
cacactgcgcaggtctcttc

SEQ ID NO: 5978795 - DNA, 22 bp, Homo sapiens
cacactgcgcaggtctcttctg

SEQ ID NO: 5978796 - DNA, 23 bp, Homo sapiens
cacactgcgcaggtctcttctgg

SEQ ID NO: 5978797 - DNA, 23 bp, Homo sapiens
cacactgctaaatttacgtatat

SEQ ID NO: 5978798 - DNA, 12 bp, Homo sapiens
cacactgctggg

SEQ ID NO: 5978799 - DNA, 14 bp, Homo sapiens
cacactgctgtcct

SEQ ID NO: 5978800 - DNA, 15 bp, Homo sapiens
cacactgctgtcctc

SEQ ID NO: 5978801 - DNA, 21 bp, Homo sapiens
cacactgcttggcccttcaag

SEQ ID NO: 5978802 - DNA, 19 bp, Homo sapiens
cacactggaggagcacaca

SEQ ID NO: 5978803 - DNA, 18 bp, Homo sapiens
cacactggcgtctggact

SEQ ID NO: 5978804 - DNA, 15 bp, Homo sapiens
cacactggctcaccc

SEQ ID NO: 5978805 - DNA, 16 bp, Homo sapiens
cacactggctcaccca

SEQ ID NO: 5978806 - DNA, 19 bp, Homo sapiens
cacactgggacttgcaaaa

SEQ ID NO: 5978807 - DNA, 23 bp, Homo sapiens
cacactgggcctggagccctggg

SEQ ID NO: 5978808 - DNA, 19 bp, Homo sapiens
cacactggggtgccgcctg

SEQ ID NO: 5978809 - DNA, 16 bp, Homo sapiens
cacactggtcacaggc

SEQ ID NO: 5978810 - DNA, 23 bp, Homo sapiens
cacactggtgtggattaacctgc

SEQ ID NO: 5978811 - DNA, 18 bp, Homo sapiens
cacactggttctcaatga

SEQ ID NO: 5978812 - DNA, 17 bp, Homo sapiens
cacactgtaaacccctg

SEQ ID NO: 5978813 - DNA, 15 bp, Homo sapiens
cacactgtaaatatg

SEQ ID NO: 5978814 - DNA, 22 bp, Homo sapiens
cacactgtcatgcttcatcatt

SEQ ID NO: 5978815 - DNA, 15 bp, Homo sapiens
cacactgtctggggc

SEQ ID NO: 5978816 - DNA, 16 bp, Homo sapiens
cacactgtctggggcc

SEQ ID NO: 5978817 - DNA, 14 bp, Homo sapiens
cacactgtcttccc

SEQ ID NO: 5978818 - DNA, 12 bp, Homo sapiens
cacactgtgaca

SEQ ID NO: 5978819 - DNA, 17 bp, Homo sapiens
cacactgtgcagaccca

SEQ ID NO: 5978820 - DNA, 17 bp, Homo sapiens
cacactgtggaacacta

SEQ ID NO: 5978821 - DNA, 16 bp, Homo sapiens
cacactgtgtcctggt

SEQ ID NO: 5978822 - DNA, 23 bp, Homo sapiens
cacactgtgtgggggacggcttc

SEQ ID NO: 5978823 - DNA, 17 bp, Homo sapiens
cacactgtttttcatac

SEQ ID NO: 5978824 - DNA, 12 bp, Homo sapiens
cacacttagctg

SEQ ID NO: 5978825 - DNA, 21 bp, Homo sapiens
cacacttatattttatgaaca

SEQ ID NO: 5978826 - DNA, 17 bp, Homo sapiens
cacacttatttatgaat

SEQ ID NO: 5978827 - DNA, 13 bp, Homo sapiens
cacacttcaaact

SEQ ID NO: 5978828 - DNA, 18 bp, Homo sapiens
cacacttcaaactacttt

SEQ ID NO: 5978829 - DNA, 12 bp, Homo sapiens
cacacttcaaat

SEQ ID NO: 5978830 - DNA, 17 bp, Homo sapiens
cacacttcaggctcttc

SEQ ID NO: 5978831 - DNA, 22 bp, Homo sapiens
cacacttccacccccagctcct

SEQ ID NO: 5978832 - DNA, 20 bp, Homo sapiens
cacacttcccacccccaggc

SEQ ID NO: 5978833 - DNA, 15 bp, Homo sapiens
cacacttccccatct

SEQ ID NO: 5978834 - DNA, 12 bp, Homo sapiens
cacacttcccct

SEQ ID NO: 5978835 - DNA, 23 bp, Homo sapiens
cacacttccccttgggatgggca

SEQ ID NO: 5978836 - DNA, 13 bp, Homo sapiens
cacacttccctgg

SEQ ID NO: 5978837 - DNA, 13 bp, Homo sapiens
cacacttcctgtc

SEQ ID NO: 5978838 - DNA, 19 bp, Homo sapiens
cacacttcctgtccagaga

SEQ ID NO: 5978839 - DNA, 14 bp, Homo sapiens
cacacttctcagga

SEQ ID NO: 5978840 - DNA, 17 bp, Homo sapiens
cacacttctcaggacac

SEQ ID NO: 5978841 - DNA, 23 bp, Homo sapiens
cacacttctcaggacacaggcct

SEQ ID NO: 5978842 - DNA, 22 bp, Homo sapiens
cacacttcttgaaacagcctgg

SEQ ID NO: 5978843 - DNA, 16 bp, Homo sapiens
cacacttgaaaccttt

SEQ ID NO: 5978844 - DNA, 19 bp, Homo sapiens
cacacttgcaaatgaatgc

SEQ ID NO: 5978845 - DNA, 19 bp, Homo sapiens
cacacttgggagcagtcct

SEQ ID NO: 5978846 - DNA, 19 bp, Homo sapiens
cacacttgggcgctctgcc

SEQ ID NO: 5978847 - DNA, 21 bp, Homo sapiens
cacacttgggcgctctgccct

SEQ ID NO: 5978848 - DNA, 14 bp, Homo sapiens
cacacttgggctgg

SEQ ID NO: 5978849 - DNA, 14 bp, Homo sapiens
cacacttgtgccag

SEQ ID NO: 5978850 - DNA, 15 bp, Homo sapiens
cacacttgtgccagc

SEQ ID NO: 5978851 - DNA, 16 bp, Homo sapiens
cacacttgtgtgccac

SEQ ID NO: 5978852 - DNA, 16 bp, Homo sapiens
cacacttgttccagct

SEQ ID NO: 5978853 - DNA, 12 bp, Homo sapiens
cacacttgtttc

SEQ ID NO: 5978854 - DNA, 14 bp, Homo sapiens
cacacttgttttct

SEQ ID NO: 5978855 - DNA, 14 bp, Homo sapiens
cacactttcactgg

SEQ ID NO: 5978856 - DNA, 15 bp, Homo sapiens
cacactttccatctc

SEQ ID NO: 5978857 - DNA, 12 bp, Homo sapiens
cacactttctga

SEQ ID NO: 5978858 - DNA, 13 bp, Homo sapiens
cacactttctgac

SEQ ID NO: 5978859 - DNA, 15 bp, Homo sapiens
cacactttctggcaa

SEQ ID NO: 5978860 - DNA, 14 bp, Homo sapiens
cacactttgaagca

SEQ ID NO: 5978861 - DNA, 19 bp, Homo sapiens
cacactttgaagcaaatac

SEQ ID NO: 5978862 - DNA, 19 bp, Homo sapiens
cacactttggcccagggtg

SEQ ID NO: 5978863 - DNA, 15 bp, Homo sapiens
cacacttttccacat

SEQ ID NO: 5978864 - DNA, 20 bp, Homo sapiens
cacactttttttcctctttc

SEQ ID NO: 5978865 - DNA, 13 bp, Homo sapiens
cacagaaaaagca

SEQ ID NO: 5978866 - DNA, 14 bp, Homo sapiens
cacagaaaaagcat

SEQ ID NO: 5978867 - DNA, 14 bp, Homo sapiens
cacagaaaaccgag

SEQ ID NO: 5978868 - DNA, 15 bp, Homo sapiens
cacagaaaactagaa

SEQ ID NO: 5978869 - DNA, 23 bp, Homo sapiens
cacagaaaagaaagttcatgctt

SEQ ID NO: 5978870 - DNA, 16 bp, Homo sapiens
cacagaaaatatactg

SEQ ID NO: 5978871 - DNA, 19 bp, Homo sapiens
cacagaaaatatactgtaa

SEQ ID NO: 5978872 - DNA, 23 bp, Homo sapiens
cacagaaaatggaagacagctct

SEQ ID NO: 5978873 - DNA, 18 bp, Homo sapiens
cacagaaaatgtaaactg

SEQ ID NO: 5978874 - DNA, 12 bp, Homo sapiens
cacagaaaattt

SEQ ID NO: 5978875 - DNA, 11 bp, Homo sapiens
cacagaaacac

SEQ ID NO: 5978876 - DNA, 18 bp, Homo sapiens
cacagaaacacaatattt

SEQ ID NO: 5978877 - DNA, 19 bp, Homo sapiens
cacagaaacactgcctttt

SEQ ID NO: 5978878 - DNA, 16 bp, Homo sapiens
cacagaaaccaatttt

SEQ ID NO: 5978879 - DNA, 12 bp, Homo sapiens
cacagaaacctt

SEQ ID NO: 5978880 - DNA, 18 bp, Homo sapiens
cacagaaagactgagctc

SEQ ID NO: 5978881 - DNA, 14 bp, Homo sapiens
cacagaaagagagc

SEQ ID NO: 5978882 - DNA, 15 bp, Homo sapiens
cacagaaagagagca

SEQ ID NO: 5978883 - DNA, 21 bp, Homo sapiens
cacagaaagctccttccagac

SEQ ID NO: 5978884 - DNA, 20 bp, Homo sapiens
cacagaaaggccactcagga

SEQ ID NO: 5978885 - DNA, 15 bp, Homo sapiens
cacagaaatatatat

SEQ ID NO: 5978886 - DNA, 21 bp, Homo sapiens
cacagaaatatatatacatat

SEQ ID NO: 5978887 - DNA, 21 bp, Homo sapiens
cacagaaatcacagtcaatgg

SEQ ID NO: 5978888 - DNA, 17 bp, Homo sapiens
cacagaaatcagaggag

SEQ ID NO: 5978889 - DNA, 14 bp, Homo sapiens
cacagaaatctgaa

SEQ ID NO: 5978890 - DNA, 22 bp, Homo sapiens
cacagaaatgagatcaggctct

SEQ ID NO: 5978891 - DNA, 18 bp, Homo sapiens
cacagaaatgctgctggc

SEQ ID NO: 5978892 - DNA, 21 bp, Homo sapiens
cacagaaatgctgctggccaa

SEQ ID NO: 5978893 - DNA, 14 bp, Homo sapiens
cacagaacaagcca

SEQ ID NO: 5978894 - DNA, 13 bp, Homo sapiens
cacagaacccttg

SEQ ID NO: 5978895 - DNA, 19 bp, Homo sapiens
cacagaaccttcaacccag

SEQ ID NO: 5978896 - DNA, 21 bp, Homo sapiens
cacagaaccttcaacccagtg

SEQ ID NO: 5978897 - DNA, 16 bp, Homo sapiens
cacagaacctttgtca

SEQ ID NO: 5978898 - DNA, 19 bp, Homo sapiens
cacagaactggcaggagcc

SEQ ID NO: 5978899 - DNA, 23 bp, Homo sapiens
cacagaagcctaggaggactggg

SEQ ID NO: 5978900 - DNA, 18 bp, Homo sapiens
cacagaaggaatctgtgc

SEQ ID NO: 5978901 - DNA, 20 bp, Homo sapiens
cacagaaggaatctgtgcag

SEQ ID NO: 5978902 - DNA, 18 bp, Homo sapiens
cacagaaggggactgcca

SEQ ID NO: 5978903 - DNA, 18 bp, Homo sapiens
cacagaaggtgaactttg

SEQ ID NO: 5978904 - DNA, 22 bp, Homo sapiens
cacagaagtccctaggagggaa

SEQ ID NO: 5978905 - DNA, 16 bp, Homo sapiens
cacagaatatttttat

SEQ ID NO: 5978906 - DNA, 19 bp, Homo sapiens
cacagaatcatatgattct

SEQ ID NO: 5978907 - DNA, 15 bp, Homo sapiens
cacagaatctccatt

SEQ ID NO: 5978908 - DNA, 17 bp, Homo sapiens
cacagaatgctcagggt

SEQ ID NO: 5978909 - DNA, 15 bp, Homo sapiens
cacagacaagcagcc

SEQ ID NO: 5978910 - DNA, 20 bp, Homo sapiens
cacagacaagggggatgttg

SEQ ID NO: 5978911 - DNA, 16 bp, Homo sapiens
cacagacaattctaat

SEQ ID NO: 5978912 - DNA, 12 bp, Homo sapiens
cacagacacaca

SEQ ID NO: 5978913 - DNA, 18 bp, Homo sapiens
cacagacacacacacgca

SEQ ID NO: 5978914 - DNA, 13 bp, Homo sapiens
cacagacactcct

SEQ ID NO: 5978915 - DNA, 16 bp, Homo sapiens
cacagacactcctggg

SEQ ID NO: 5978916 - DNA, 22 bp, Homo sapiens
cacagacaggacccctgcagtt

SEQ ID NO: 5978917 - DNA, 21 bp, Homo sapiens
cacagacaggttttcacataa

SEQ ID NO: 5978918 - DNA, 22 bp, Homo sapiens
cacagacaggttttcacataaa

SEQ ID NO: 5978919 - DNA, 21 bp, Homo sapiens
cacagacatactaaccagcag

SEQ ID NO: 5978920 - DNA, 16 bp, Homo sapiens
cacagacatctttcaa

SEQ ID NO: 5978921 - DNA, 22 bp, Homo sapiens
cacagaccaagtccaagcccgt

SEQ ID NO: 5978922 - DNA, 14 bp, Homo sapiens
cacagacccacaca

SEQ ID NO: 5978923 - DNA, 17 bp, Homo sapiens
cacagaccccagctggg

SEQ ID NO: 5978924 - DNA, 14 bp, Homo sapiens
cacagacccctagg

SEQ ID NO: 5978925 - DNA, 12 bp, Homo sapiens
cacagacccctc

SEQ ID NO: 5978926 - DNA, 15 bp, Homo sapiens
cacagacccctgggg

SEQ ID NO: 5978927 - DNA, 17 bp, Homo sapiens
cacagacccctggggga

SEQ ID NO: 5978928 - DNA, 13 bp, Homo sapiens
cacagaccctgcc

SEQ ID NO: 5978929 - DNA, 19 bp, Homo sapiens
cacagaccctgcccacccc

SEQ ID NO: 5978930 - DNA, 18 bp, Homo sapiens
cacagaccctgccctgtg

SEQ ID NO: 5978931 - DNA, 20 bp, Homo sapiens
cacagaccctgccctgtggg

SEQ ID NO: 5978932 - DNA, 15 bp, Homo sapiens
cacagacctcagaga

SEQ ID NO: 5978933 - DNA, 17 bp, Homo sapiens
cacagacctcagagatg

SEQ ID NO: 5978934 - DNA, 17 bp, Homo sapiens
cacagacctctgcttgg

SEQ ID NO: 5978935 - DNA, 18 bp, Homo sapiens
cacagacctctgcttgga

SEQ ID NO: 5978936 - DNA, 13 bp, Homo sapiens
cacagacctgcag

SEQ ID NO: 5978937 - DNA, 14 bp, Homo sapiens
cacagacctgcagt

SEQ ID NO: 5978938 - DNA, 16 bp, Homo sapiens
cacagacctgcagtga

SEQ ID NO: 5978939 - DNA, 18 bp, Homo sapiens
cacagacctgcagtgagg

SEQ ID NO: 5978940 - DNA, 23 bp, Homo sapiens
cacagacctgcagtgaggggccc

SEQ ID NO: 5978941 - DNA, 14 bp, Homo sapiens
cacagacctggagc

SEQ ID NO: 5978942 - DNA, 15 bp, Homo sapiens
cacagacctggagcc

SEQ ID NO: 5978943 - DNA, 20 bp, Homo sapiens
cacagacctggagcccctgg

SEQ ID NO: 5978944 - DNA, 15 bp, Homo sapiens
cacagacgccacctg

SEQ ID NO: 5978945 - DNA, 23 bp, Homo sapiens
cacagacggaagggtaaacaata

SEQ ID NO: 5978946 - DNA, 21 bp, Homo sapiens
cacagacgggcacacagactg

SEQ ID NO: 5978947 - DNA, 16 bp, Homo sapiens
cacagacgtccctcca

SEQ ID NO: 5978948 - DNA, 21 bp, Homo sapiens
cacagacgttaggcatttcct

SEQ ID NO: 5978949 - DNA, 21 bp, Homo sapiens
cacagactacagccagaagcc

SEQ ID NO: 5978950 - DNA, 23 bp, Homo sapiens
cacagactcatcctgaacagcat

SEQ ID NO: 5978951 - DNA, 13 bp, Homo sapiens
cacagactccctc

SEQ ID NO: 5978952 - DNA, 18 bp, Homo sapiens
cacagactccctcccctg

SEQ ID NO: 5978953 - DNA, 15 bp, Homo sapiens
cacagactccggcct

SEQ ID NO: 5978954 - DNA, 22 bp, Homo sapiens
cacagactccggcctgtaatca

SEQ ID NO: 5978955 - DNA, 16 bp, Homo sapiens
cacagactctgctagt

SEQ ID NO: 5978956 - DNA, 20 bp, Homo sapiens
cacagactctgtgagattct

SEQ ID NO: 5978957 - DNA, 15 bp, Homo sapiens
cacagactcttccac

SEQ ID NO: 5978958 - DNA, 18 bp, Homo sapiens
cacagactcttccaccag

SEQ ID NO: 5978959 - DNA, 23 bp, Homo sapiens
cacagactcttccaccagagcag

SEQ ID NO: 5978960 - DNA, 23 bp, Homo sapiens
cacagactgaactcgcagggaat

SEQ ID NO: 5978961 - DNA, 12 bp, Homo sapiens
cacagactgccc

SEQ ID NO: 5978962 - DNA, 18 bp, Homo sapiens
cacagactgccccagcca

SEQ ID NO: 5978963 - DNA, 19 bp, Homo sapiens
cacagactgctgtcttact

SEQ ID NO: 5978964 - DNA, 13 bp, Homo sapiens
cacagactggaga

SEQ ID NO: 5978965 - DNA, 14 bp, Homo sapiens
cacagactggcaat

SEQ ID NO: 5978966 - DNA, 15 bp, Homo sapiens
cacagactggcaata

SEQ ID NO: 5978967 - DNA, 17 bp, Homo sapiens
cacagactggcaataaa

SEQ ID NO: 5978968 - DNA, 13 bp, Homo sapiens
cacagactgttcc

SEQ ID NO: 5978969 - DNA, 21 bp, Homo sapiens
cacagactgttccctccaagg

SEQ ID NO: 5978970 - DNA, 22 bp, Homo sapiens
cacagactgttgtccctgcact

SEQ ID NO: 5978971 - DNA, 21 bp, Homo sapiens
cacagacttcacacagcacct

SEQ ID NO: 5978972 - DNA, 15 bp, Homo sapiens
cacagacttgcactg

SEQ ID NO: 5978973 - DNA, 20 bp, Homo sapiens
cacagacttgcactgaagcc

SEQ ID NO: 5978974 - DNA, 22 bp, Homo sapiens
cacagacttgcactgaagccgg

SEQ ID NO: 5978975 - DNA, 20 bp, Homo sapiens
cacagactttagctttctga

SEQ ID NO: 5978976 - DNA, 17 bp, Homo sapiens
cacagactttctgtgac

SEQ ID NO: 5978977 - DNA, 21 bp, Homo sapiens
cacagagaaagtacttctcca

SEQ ID NO: 5978978 - DNA, 14 bp, Homo sapiens
cacagagaaataca

SEQ ID NO: 5978979 - DNA, 17 bp, Homo sapiens
cacagagaaatacaaaa

SEQ ID NO: 5978980 - DNA, 18 bp, Homo sapiens
cacagagaaatacaaaat

SEQ ID NO: 5978981 - DNA, 18 bp, Homo sapiens
cacagagaacctgagttc

SEQ ID NO: 5978982 - DNA, 14 bp, Homo sapiens
cacagagaagacaa

SEQ ID NO: 5978983 - DNA, 22 bp, Homo sapiens
cacagagaagacaaaattagca

SEQ ID NO: 5978984 - DNA, 19 bp, Homo sapiens
cacagagaagctcctgcta

SEQ ID NO: 5978985 - DNA, 11 bp, Homo sapiens
cacagagaagg

SEQ ID NO: 5978986 - DNA, 15 bp, Homo sapiens
cacagagacggtctg

SEQ ID NO: 5978987 - DNA, 14 bp, Homo sapiens
cacagagactgttt

SEQ ID NO: 5978988 - DNA, 10 bp, Homo sapiens
cacagagaga

SEQ ID NO: 5978989 - DNA, 12 bp, Homo sapiens
cacagagaggga

SEQ ID NO: 5978990 - DNA, 22 bp, Homo sapiens
cacagagagggacacatgcccc

SEQ ID NO: 5978991 - DNA, 23 bp, Homo sapiens
cacagagagggacacatgcccct

SEQ ID NO: 5978992 - DNA, 22 bp, Homo sapiens
cacagagagggggccacctccc

SEQ ID NO: 5978993 - DNA, 12 bp, Homo sapiens
cacagagatatg

SEQ ID NO: 5978994 - DNA, 13 bp, Homo sapiens
cacagagatgcat

SEQ ID NO: 5978995 - DNA, 14 bp, Homo sapiens
cacagagatgtcca

SEQ ID NO: 5978996 - DNA, 17 bp, Homo sapiens
cacagagattctgaact

SEQ ID NO: 5978997 - DNA, 18 bp, Homo sapiens
cacagagattctggatct

SEQ ID NO: 5978998 - DNA, 14 bp, Homo sapiens
cacagagcacgcct

SEQ ID NO: 5978999 - DNA, 16 bp, Homo sapiens
cacagagcacgcctgc

SEQ ID NO: 5979000 - DNA, 18 bp, Homo sapiens
cacagagcacgcctgcca

SEQ ID NO: 5979001 - DNA, 21 bp, Homo sapiens
cacagagcactaggttcaatt

SEQ ID NO: 5979002 - DNA, 14 bp, Homo sapiens
cacagagcaggact

SEQ ID NO: 5979003 - DNA, 22 bp, Homo sapiens
cacagagcatccgtctcccctc

SEQ ID NO: 5979004 - DNA, 15 bp, Homo sapiens
cacagagccactctt

SEQ ID NO: 5979005 - DNA, 17 bp, Homo sapiens
cacagagccactcttca

SEQ ID NO: 5979006 - DNA, 15 bp, Homo sapiens
cacagagccctgagg

SEQ ID NO: 5979007 - DNA, 20 bp, Homo sapiens
cacagagccctgaggggctg

SEQ ID NO: 5979008 - DNA, 23 bp, Homo sapiens
cacagagccctgaggggctgggc

SEQ ID NO: 5979009 - DNA, 19 bp, Homo sapiens
cacagagcctgaatttgta

SEQ ID NO: 5979010 - DNA, 23 bp, Homo sapiens
cacagagcctgaatttgtaagca

SEQ ID NO: 5979011 - DNA, 12 bp, Homo sapiens
cacagagcctgc

SEQ ID NO: 5979012 - DNA, 21 bp, Homo sapiens
cacagagcctgcctcagctgc

SEQ ID NO: 5979013 - DNA, 14 bp, Homo sapiens
cacagagcctggct

SEQ ID NO: 5979014 - DNA, 18 bp, Homo sapiens
cacagagcctggctttgg

SEQ ID NO: 5979015 - DNA, 22 bp, Homo sapiens
cacagagcgcctcacctgcatc

SEQ ID NO: 5979016 - DNA, 19 bp, Homo sapiens
cacagagcgtccttccccc

SEQ ID NO: 5979017 - DNA, 17 bp, Homo sapiens
cacagagctctccagct

SEQ ID NO: 5979018 - DNA, 15 bp, Homo sapiens
cacagaggaagagca

SEQ ID NO: 5979019 - DNA, 19 bp, Homo sapiens
cacagaggacacagagaag

SEQ ID NO: 5979020 - DNA, 17 bp, Homo sapiens
cacagaggagtgcagcc

SEQ ID NO: 5979021 - DNA, 11 bp, Homo sapiens
cacagaggcag

SEQ ID NO: 5979022 - DNA, 19 bp, Homo sapiens
cacagaggcagctgtgtgg

SEQ ID NO: 5979023 - DNA, 12 bp, Homo sapiens
cacagaggcagt

SEQ ID NO: 5979024 - DNA, 18 bp, Homo sapiens
cacagaggcagtggcagc

SEQ ID NO: 5979025 - DNA, 19 bp, Homo sapiens
cacagaggcagtggcagca

SEQ ID NO: 5979026 - DNA, 18 bp, Homo sapiens
cacagaggccccacctga

SEQ ID NO: 5979027 - DNA, 12 bp, Homo sapiens
cacagaggctgt

SEQ ID NO: 5979028 - DNA, 23 bp, Homo sapiens
cacagagggaagtttaaaaccca

SEQ ID NO: 5979029 - DNA, 16 bp, Homo sapiens
cacagagggcgctcct

SEQ ID NO: 5979030 - DNA, 18 bp, Homo sapiens
cacagagggcgctcctgt

SEQ ID NO: 5979031 - DNA, 17 bp, Homo sapiens
cacagagggctgtgtct

SEQ ID NO: 5979032 - DNA, 19 bp, Homo sapiens
cacagaggtcaggaagcag

SEQ ID NO: 5979033 - DNA, 15 bp, Homo sapiens
cacagagtcaaggcc

SEQ ID NO: 5979034 - DNA, 19 bp, Homo sapiens
cacagagtcaaggcctgct

SEQ ID NO: 5979035 - DNA, 21 bp, Homo sapiens
cacagagtcaaggcctgctcc

SEQ ID NO: 5979036 - DNA, 18 bp, Homo sapiens
cacagagtcgatgctcaa

SEQ ID NO: 5979037 - DNA, 17 bp, Homo sapiens
cacagagtgagactcca

SEQ ID NO: 5979038 - DNA, 13 bp, Homo sapiens
cacagagtgagcc

SEQ ID NO: 5979039 - DNA, 18 bp, Homo sapiens
cacagagtgagccagtga

SEQ ID NO: 5979040 - DNA, 21 bp, Homo sapiens
cacagagtgccatccctgaga

SEQ ID NO: 5979041 - DNA, 17 bp, Homo sapiens
cacagagtgctggactg

SEQ ID NO: 5979042 - DNA, 15 bp, Homo sapiens
cacagagtgtagcca

SEQ ID NO: 5979043 - DNA, 18 bp, Homo sapiens
cacagagtttgtagtaaa

SEQ ID NO: 5979044 - DNA, 21 bp, Homo sapiens
cacagagtttttcaggagaga

SEQ ID NO: 5979045 - DNA, 15 bp, Homo sapiens
cacagataaaaagtg

SEQ ID NO: 5979046 - DNA, 14 bp, Homo sapiens
cacagataacataa

SEQ ID NO: 5979047 - DNA, 19 bp, Homo sapiens
cacagataagcctgaaaca

SEQ ID NO: 5979048 - DNA, 18 bp, Homo sapiens
cacagatagacctttttt

SEQ ID NO: 5979049 - DNA, 23 bp, Homo sapiens
cacagatatactttgtggaccaa

SEQ ID NO: 5979050 - DNA, 20 bp, Homo sapiens
cacagatatagttccgcacc

SEQ ID NO: 5979051 - DNA, 22 bp, Homo sapiens
cacagatatgcacacacatgga

SEQ ID NO: 5979052 - DNA, 18 bp, Homo sapiens
cacagatatttccatttc

SEQ ID NO: 5979053 - DNA, 17 bp, Homo sapiens
cacagatcagttttcct

SEQ ID NO: 5979054 - DNA, 19 bp, Homo sapiens
cacagatcccactggaaga

SEQ ID NO: 5979055 - DNA, 22 bp, Homo sapiens
cacagatcccggggagctgtga

SEQ ID NO: 5979056 - DNA, 18 bp, Homo sapiens
cacagatcgcatttccta

SEQ ID NO: 5979057 - DNA, 19 bp, Homo sapiens
cacagatcgcatttcctaa

SEQ ID NO: 5979058 - DNA, 20 bp, Homo sapiens
cacagatcgcatttcctaag

SEQ ID NO: 5979059 - DNA, 12 bp, Homo sapiens
cacagatctgga

SEQ ID NO: 5979060 - DNA, 17 bp, Homo sapiens
cacagatgaaacacaaa

SEQ ID NO: 5979061 - DNA, 17 bp, Homo sapiens
cacagatgaccaaagtc

SEQ ID NO: 5979062 - DNA, 18 bp, Homo sapiens
cacagatgcacacacaga

SEQ ID NO: 5979063 - DNA, 19 bp, Homo sapiens
cacagatgcatatagacac

SEQ ID NO: 5979064 - DNA, 14 bp, Homo sapiens
cacagatgccatgg

SEQ ID NO: 5979065 - DNA, 20 bp, Homo sapiens
cacagatgccatggcctgtg

SEQ ID NO: 5979066 - DNA, 13 bp, Homo sapiens
cacagatgctcca

SEQ ID NO: 5979067 - DNA, 13 bp, Homo sapiens
cacagatgctggc

SEQ ID NO: 5979068 - DNA, 17 bp, Homo sapiens
cacagatgctggcctct

SEQ ID NO: 5979069 - DNA, 20 bp, Homo sapiens
cacagatgctggcctcttgg

SEQ ID NO: 5979070 - DNA, 22 bp, Homo sapiens
cacagatggaagaagttttaac

SEQ ID NO: 5979071 - DNA, 19 bp, Homo sapiens
cacagatggatttgcctgt

SEQ ID NO: 5979072 - DNA, 22 bp, Homo sapiens
cacagatggcacctgtggccag

SEQ ID NO: 5979073 - DNA, 13 bp, Homo sapiens
cacagatgggcaa

SEQ ID NO: 5979074 - DNA, 20 bp, Homo sapiens
cacagatgggtattaaactt

SEQ ID NO: 5979075 - DNA, 18 bp, Homo sapiens
cacagatgggtgcttgga

SEQ ID NO: 5979076 - DNA, 20 bp, Homo sapiens
cacagatgggtgcttggagg

SEQ ID NO: 5979077 - DNA, 16 bp, Homo sapiens
cacagatggtcacaca

SEQ ID NO: 5979078 - DNA, 15 bp, Homo sapiens
cacagatgtctctgg

SEQ ID NO: 5979079 - DNA, 23 bp, Homo sapiens
cacagatgtgcccagagtagccc

SEQ ID NO: 5979080 - DNA, 19 bp, Homo sapiens
cacagatgttcccccatct

SEQ ID NO: 5979081 - DNA, 22 bp, Homo sapiens
cacagattatgttcctgctgta

SEQ ID NO: 5979082 - DNA, 15 bp, Homo sapiens
cacagattcccaggc

SEQ ID NO: 5979083 - DNA, 19 bp, Homo sapiens
cacagattcccaggccagg

SEQ ID NO: 5979084 - DNA, 16 bp, Homo sapiens
cacagattgaagaatc

SEQ ID NO: 5979085 - DNA, 22 bp, Homo sapiens
cacagattgaagaatctgcccc

SEQ ID NO: 5979086 - DNA, 23 bp, Homo sapiens
cacagattgaagaatctgcccct

SEQ ID NO: 5979087 - DNA, 13 bp, Homo sapiens
cacagattggcca

SEQ ID NO: 5979088 - DNA, 14 bp, Homo sapiens
cacagattgtttct

SEQ ID NO: 5979089 - DNA, 14 bp, Homo sapiens
cacagatttccaaa

SEQ ID NO: 5979090 - DNA, 16 bp, Homo sapiens
cacagatttgagctca

SEQ ID NO: 5979091 - DNA, 17 bp, Homo sapiens
cacagatttgagctcag

SEQ ID NO: 5979092 - DNA, 14 bp, Homo sapiens
cacagatttgtgcc

SEQ ID NO: 5979093 - DNA, 22 bp, Homo sapiens
cacagatttgtgcccattccta

SEQ ID NO: 5979094 - DNA, 12 bp, Homo sapiens
cacagattttta

SEQ ID NO: 5979095 - DNA, 16 bp, Homo sapiens
cacagatttttacact

SEQ ID NO: 5979096 - DNA, 18 bp, Homo sapiens
cacagatttttacactaa

SEQ ID NO: 5979097 - DNA, 21 bp, Homo sapiens
cacagatttttacactaatat

SEQ ID NO: 5979098 - DNA, 18 bp, Homo sapiens
cacagatttttgggctcc

SEQ ID NO: 5979099 - DNA, 22 bp, Homo sapiens
cacagatttttgggctccactc

SEQ ID NO: 5979100 - DNA, 17 bp, Homo sapiens
cacagattttttcttta

SEQ ID NO: 5979101 - DNA, 16 bp, Homo sapiens
cacagatttttttgta

SEQ ID NO: 5979102 - DNA, 18 bp, Homo sapiens
cacagatttttttgtaag

SEQ ID NO: 5979103 - DNA, 17 bp, Homo sapiens
cacagcaaccccaggct

SEQ ID NO: 5979104 - DNA, 18 bp, Homo sapiens
cacagcaaccccaggctg

SEQ ID NO: 5979105 - DNA, 23 bp, Homo sapiens
cacagcaaggaaatgtcctgcat

SEQ ID NO: 5979106 - DNA, 22 bp, Homo sapiens
cacagcaaggaggctggctggg

SEQ ID NO: 5979107 - DNA, 15 bp, Homo sapiens
cacagcaaggcacct

SEQ ID NO: 5979108 - DNA, 16 bp, Homo sapiens
cacagcaaggctgtcg

SEQ ID NO: 5979109 - DNA, 20 bp, Homo sapiens
cacagcaagtacagcggctc

SEQ ID NO: 5979110 - DNA, 21 bp, Homo sapiens
cacagcaagtacagcggctcc

SEQ ID NO: 5979111 - DNA, 17 bp, Homo sapiens
cacagcacaaccggtcc

SEQ ID NO: 5979112 - DNA, 15 bp, Homo sapiens
cacagcacaccagcc

SEQ ID NO: 5979113 - DNA, 19 bp, Homo sapiens
cacagcacaccagccgctg

SEQ ID NO: 5979114 - DNA, 15 bp, Homo sapiens
cacagcacagccaac

SEQ ID NO: 5979115 - DNA, 23 bp, Homo sapiens
cacagcacatgctggccagcctg

SEQ ID NO: 5979116 - DNA, 17 bp, Homo sapiens
cacagcaccaaaggctc

SEQ ID NO: 5979117 - DNA, 16 bp, Homo sapiens
caaaggagcctgtgaa

SEQ ID NO: 5979118 - DNA, 23 bp, Homo sapiens
caaaggagcctgtgaacccagga

SEQ ID NO: 5979119 - DNA, 15 bp, Homo sapiens
caaaggagccttgat

SEQ ID NO: 5979120 - DNA, 17 bp, Homo sapiens
caaaggagctcgaagga

SEQ ID NO: 5979121 - DNA, 19 bp, Homo sapiens
caaaggagctcgaaggata

SEQ ID NO: 5979122 - DNA, 16 bp, Homo sapiens
caaaggagctttctca

SEQ ID NO: 5979123 - DNA, 17 bp, Homo sapiens
caaaggagctttctcaa

SEQ ID NO: 5979124 - DNA, 17 bp, Homo sapiens
caaaggagtgcatggcc

SEQ ID NO: 5979125 - DNA, 19 bp, Homo sapiens
caaaggagtgcatggccac

SEQ ID NO: 5979126 - DNA, 15 bp, Homo sapiens
caaaggataaatttt

SEQ ID NO: 5979127 - DNA, 16 bp, Homo sapiens
caaaggatgggggaaa

SEQ ID NO: 5979128 - DNA, 14 bp, Homo sapiens
caaaggatgtgttt

SEQ ID NO: 5979129 - DNA, 15 bp, Homo sapiens
caaaggcaagcactt

SEQ ID NO: 5979130 - DNA, 23 bp, Homo sapiens
caaaggcaagttaagagaaactt

SEQ ID NO: 5979131 - DNA, 13 bp, Homo sapiens
caaaggcagaaag

SEQ ID NO: 5979132 - DNA, 16 bp, Homo sapiens
caaaggcagaggaatt

SEQ ID NO: 5979133 - DNA, 17 bp, Homo sapiens
caaaggcagcaaggcag

SEQ ID NO: 5979134 - DNA, 21 bp, Homo sapiens
caaaggcagcaaggcagtgag

SEQ ID NO: 5979135 - DNA, 19 bp, Homo sapiens
caaaggcagctaagataga

SEQ ID NO: 5979136 - DNA, 21 bp, Homo sapiens
caaaggcagctaagatagaaa

SEQ ID NO: 5979137 - DNA, 18 bp, Homo sapiens
caaaggcagctgtgtctg

SEQ ID NO: 5979138 - DNA, 20 bp, Homo sapiens
caaaggcagctgtgtctgag

SEQ ID NO: 5979139 - DNA, 21 bp, Homo sapiens
caaaggcagctgtgtctgagc

SEQ ID NO: 5979140 - DNA, 22 bp, Homo sapiens
caaaggcagctgtgtctgagcc

SEQ ID NO: 5979141 - DNA, 14 bp, Homo sapiens
caaaggcagggcca

SEQ ID NO: 5979142 - DNA, 21 bp, Homo sapiens
caaaggcatcccagcctgggg

SEQ ID NO: 5979143 - DNA, 14 bp, Homo sapiens
caaaggcatgctgg

SEQ ID NO: 5979144 - DNA, 16 bp, Homo sapiens
caaaggcatgctggag

SEQ ID NO: 5979145 - DNA, 21 bp, Homo sapiens
caaaggcattataaaaagaat

SEQ ID NO: 5979146 - DNA, 17 bp, Homo sapiens
caaaggccacaggcagt

SEQ ID NO: 5979147 - DNA, 20 bp, Homo sapiens
caaaggccacaggcagtcca

SEQ ID NO: 5979148 - DNA, 21 bp, Homo sapiens
caaaggccagacctgcagacg

SEQ ID NO: 5979149 - DNA, 22 bp, Homo sapiens
caaaggccagacctgcagacgc

SEQ ID NO: 5979150 - DNA, 14 bp, Homo sapiens
caaaggccagcggt

SEQ ID NO: 5979151 - DNA, 16 bp, Homo sapiens
caaaggccagcggtga

SEQ ID NO: 5979152 - DNA, 20 bp, Homo sapiens
caaaggccagcggtgaccag

SEQ ID NO: 5979153 - DNA, 18 bp, Homo sapiens
caaaggccagtggaagaa

SEQ ID NO: 5979154 - DNA, 19 bp, Homo sapiens
caaaggccatggagagctg

SEQ ID NO: 5979155 - DNA, 20 bp, Homo sapiens
caaaggccatggagagctgg

SEQ ID NO: 5979156 - DNA, 11 bp, Homo sapiens
caaaggcccag

SEQ ID NO: 5979157 - DNA, 12 bp, Homo sapiens
caaaggcccaga

SEQ ID NO: 5979158 - DNA, 13 bp, Homo sapiens
caaaggcccaggg

SEQ ID NO: 5979159 - DNA, 15 bp, Homo sapiens
caaaggcccagggag

SEQ ID NO: 5979160 - DNA, 20 bp, Homo sapiens
caaaggccctaccagaggga

SEQ ID NO: 5979161 - DNA, 12 bp, Homo sapiens
caaaggccctgg

SEQ ID NO: 5979162 - DNA, 17 bp, Homo sapiens
caaaggctcctgagaca

SEQ ID NO: 5979163 - DNA, 22 bp, Homo sapiens
caaaggctgacagactcactgg

SEQ ID NO: 5979164 - DNA, 17 bp, Homo sapiens
caaaggctgacattcac

SEQ ID NO: 5979165 - DNA, 19 bp, Homo sapiens
caaaggctgacattcactg

SEQ ID NO: 5979166 - DNA, 14 bp, Homo sapiens
caaaggctgagaac

SEQ ID NO: 5979167 - DNA, 16 bp, Homo sapiens
caaagggaaaaaagag

SEQ ID NO: 5979168 - DNA, 15 bp, Homo sapiens
caaagggaaatatca

SEQ ID NO: 5979169 - DNA, 17 bp, Homo sapiens
caaagggaagtgaggcc

SEQ ID NO: 5979170 - DNA, 20 bp, Homo sapiens
caaagggaagtgaggcccaa

SEQ ID NO: 5979171 - DNA, 22 bp, Homo sapiens
caaagggaatactcacattttg

SEQ ID NO: 5979172 - DNA, 22 bp, Homo sapiens
caaagggaccaggggagaggca

SEQ ID NO: 5979173 - DNA, 13 bp, Homo sapiens
caaagggactttg

SEQ ID NO: 5979174 - DNA, 22 bp, Homo sapiens
caaagggagcactgggttgact

SEQ ID NO: 5979175 - DNA, 15 bp, Homo sapiens
caaagggagcagaac

SEQ ID NO: 5979176 - DNA, 15 bp, Homo sapiens
caaagggagggagca

SEQ ID NO: 5979177 - DNA, 16 bp, Homo sapiens
caaagggagggagcaa

SEQ ID NO: 5979178 - DNA, 21 bp, Homo sapiens
caaagggagggtggcagagac

SEQ ID NO: 5979179 - DNA, 18 bp, Homo sapiens
caaagggagtctgccagg

SEQ ID NO: 5979180 - DNA, 21 bp, Homo sapiens
caaagggcacagcatctgtag

SEQ ID NO: 5979181 - DNA, 23 bp, Homo sapiens
caaagggcacagcatctgtagtc

SEQ ID NO: 5979182 - DNA, 20 bp, Homo sapiens
caaagggcagccctccactt

SEQ ID NO: 5979183 - DNA, 14 bp, Homo sapiens
caaagggcaggcct

SEQ ID NO: 5979184 - DNA, 15 bp, Homo sapiens
caaagggcaggcctg

SEQ ID NO: 5979185 - DNA, 16 bp, Homo sapiens
caaagggcagtaaagt

SEQ ID NO: 5979186 - DNA, 12 bp, Homo sapiens
caaagggcccag

SEQ ID NO: 5979187 - DNA, 14 bp, Homo sapiens
caaagggcccagat

SEQ ID NO: 5979188 - DNA, 21 bp, Homo sapiens
caaagggcctgcccagacaag

SEQ ID NO: 5979189 - DNA, 17 bp, Homo sapiens
caaagggcgggcctgtt

SEQ ID NO: 5979190 - DNA, 19 bp, Homo sapiens
caaagggctgccttgctgt

SEQ ID NO: 5979191 - DNA, 18 bp, Homo sapiens
caaaggggacagctgtgt

SEQ ID NO: 5979192 - DNA, 18 bp, Homo sapiens
caaaggggacaggcctca

SEQ ID NO: 5979193 - DNA, 17 bp, Homo sapiens
caaaggggacctggaag

SEQ ID NO: 5979194 - DNA, 18 bp, Homo sapiens
caaaggggagaagggcca

SEQ ID NO: 5979195 - DNA, 19 bp, Homo sapiens
caaaggggagaagggccag

SEQ ID NO: 5979196 - DNA, 23 bp, Homo sapiens
caaaggggagaagggccagccct

SEQ ID NO: 5979197 - DNA, 13 bp, Homo sapiens
caaaggggagcca

SEQ ID NO: 5979198 - DNA, 22 bp, Homo sapiens
caaaggggaggcatcagtgtcc

SEQ ID NO: 5979199 - DNA, 19 bp, Homo sapiens
caaaggggatcataaagtt

SEQ ID NO: 5979200 - DNA, 11 bp, Homo sapiens
caaaggggctg

SEQ ID NO: 5979201 - DNA, 16 bp, Homo sapiens
caaaggggctgctggg

SEQ ID NO: 5979202 - DNA, 14 bp, Homo sapiens
caaaggggggaggt

SEQ ID NO: 5979203 - DNA, 15 bp, Homo sapiens
caaagggtaaattat

SEQ ID NO: 5979204 - DNA, 16 bp, Homo sapiens
caaagggtaaattata

SEQ ID NO: 5979205 - DNA, 19 bp, Homo sapiens
caaagggtaaattataaat

SEQ ID NO: 5979206 - DNA, 21 bp, Homo sapiens
caaagggtaaattataaatgt

SEQ ID NO: 5979207 - DNA, 24 bp, Homo sapiens
caaagggtacttccactgatggaa

SEQ ID NO: 5979208 - DNA, 21 bp, Homo sapiens
caaagggtctatcttgtaaat

SEQ ID NO: 5979209 - DNA, 13 bp, Homo sapiens
caaagggtgctag

SEQ ID NO: 5979210 - DNA, 14 bp, Homo sapiens
caaaggtacttgga

SEQ ID NO: 5979211 - DNA, 14 bp, Homo sapiens
caaaggtataattt

SEQ ID NO: 5979212 - DNA, 16 bp, Homo sapiens
caaaggtcaatgtcaa

SEQ ID NO: 5979213 - DNA, 21 bp, Homo sapiens
caaaggtcgggacagctgtgc

SEQ ID NO: 5979214 - DNA, 13 bp, Homo sapiens
caaaggtgaagga

SEQ ID NO: 5979215 - DNA, 20 bp, Homo sapiens
caaaggtgatatggttttat

SEQ ID NO: 5979216 - DNA, 17 bp, Homo sapiens
caaaggtgcactccaga

SEQ ID NO: 5979217 - DNA, 14 bp, Homo sapiens
caaaggtgcctcat

SEQ ID NO: 5979218 - DNA, 17 bp, Homo sapiens
caaaggtgctaattaat

SEQ ID NO: 5979219 - DNA, 13 bp, Homo sapiens
caaaggtggaata

SEQ ID NO: 5979220 - DNA, 20 bp, Homo sapiens
caaaggtggaataaacatta

SEQ ID NO: 5979221 - DNA, 14 bp, Homo sapiens
caaaggtggctctc

SEQ ID NO: 5979222 - DNA, 16 bp, Homo sapiens
caaaggtgtgcaaact

SEQ ID NO: 5979223 - DNA, 18 bp, Homo sapiens
caaaggttcagaaaatta

SEQ ID NO: 5979224 - DNA, 21 bp, Homo sapiens
caaaggttctaggtttcaaag

SEQ ID NO: 5979225 - DNA, 16 bp, Homo sapiens
caaaggttgtacatag

SEQ ID NO: 5979226 - DNA, 21 bp, Homo sapiens
caaaggtttgaagacacagcc

SEQ ID NO: 5979227 - DNA, 19 bp, Homo sapiens
caaaggttttcctcttcta

SEQ ID NO: 5979228 - DNA, 14 bp, Homo sapiens
caaagtaaaaataa

SEQ ID NO: 5979229 - DNA, 16 bp, Homo sapiens
caaagtaaaacttgct

SEQ ID NO: 5979230 - DNA, 18 bp, Homo sapiens
caaagtaaaacttgctgc

SEQ ID NO: 5979231 - DNA, 14 bp, Homo sapiens
caaagtaaaagaaa

SEQ ID NO: 5979232 - DNA, 18 bp, Homo sapiens
caaagtaaaagtagtgtt

SEQ ID NO: 5979233 - DNA, 12 bp, Homo sapiens
caaagtaaaatg

SEQ ID NO: 5979234 - DNA, 14 bp, Homo sapiens
caaagtaaaatgaa

SEQ ID NO: 5979235 - DNA, 20 bp, Homo sapiens
caaagtaaataaaagtacaa

SEQ ID NO: 5979236 - DNA, 23 bp, Homo sapiens
caaagtaaatacaagactgttgt

SEQ ID NO: 5979237 - DNA, 16 bp, Homo sapiens
caaagtaatctactgt

SEQ ID NO: 5979238 - DNA, 20 bp, Homo sapiens
caaagtaatttggaaattag

SEQ ID NO: 5979239 - DNA, 15 bp, Homo sapiens
caaagtacaaaattg

SEQ ID NO: 5979240 - DNA, 15 bp, Homo sapiens
caaagtacagaattt

SEQ ID NO: 5979241 - DNA, 16 bp, Homo sapiens
caaagtacagaatttg

SEQ ID NO: 5979242 - DNA, 21 bp, Homo sapiens
caaagtacaggtactttgtct

SEQ ID NO: 5979243 - DNA, 14 bp, Homo sapiens
caaagtacattgta

SEQ ID NO: 5979244 - DNA, 20 bp, Homo sapiens
caaagtacattgtaaaataa

SEQ ID NO: 5979245 - DNA, 20 bp, Homo sapiens
caaagtaccacactgagttc

SEQ ID NO: 5979246 - DNA, 16 bp, Homo sapiens
caaagtactagctaaa

SEQ ID NO: 5979247 - DNA, 17 bp, Homo sapiens
caaagtactgtaagaat

SEQ ID NO: 5979248 - DNA, 22 bp, Homo sapiens
caaagtactgtaagaataattt

SEQ ID NO: 5979249 - DNA, 22 bp, Homo sapiens
caaagtagaaactactaatttt

SEQ ID NO: 5979250 - DNA, 21 bp, Homo sapiens
caaagtagaatctcttttctg

SEQ ID NO: 5979251 - DNA, 17 bp, Homo sapiens
caaagtagatcatgcat

SEQ ID NO: 5979252 - DNA, 15 bp, Homo sapiens
caaagtagtcctggc

SEQ ID NO: 5979253 - DNA, 19 bp, Homo sapiens
caaagtagtcctggcagct

SEQ ID NO: 5979254 - DNA, 20 bp, Homo sapiens
caaagtagtcctggcagctg

SEQ ID NO: 5979255 - DNA, 18 bp, Homo sapiens
caaagtataaatttgtgt

SEQ ID NO: 5979256 - DNA, 21 bp, Homo sapiens
caaagtataaatttgtgtaat

SEQ ID NO: 5979257 - DNA, 19 bp, Homo sapiens
caaagtataacaattaaaa

SEQ ID NO: 5979258 - DNA, 13 bp, Homo sapiens
caaagtataacca

SEQ ID NO: 5979259 - DNA, 15 bp, Homo sapiens
caaagtataatcttt

SEQ ID NO: 5979260 - DNA, 14 bp, Homo sapiens
caaagtatcaaaga

SEQ ID NO: 5979261 - DNA, 16 bp, Homo sapiens
caaagtatcaaagaaa

SEQ ID NO: 5979262 - DNA, 19 bp, Homo sapiens
caaagtatcaggacgagaa

SEQ ID NO: 5979263 - DNA, 21 bp, Homo sapiens
caaagtatccctactgtaatt

SEQ ID NO: 5979264 - DNA, 13 bp, Homo sapiens
caaagtatgccag

SEQ ID NO: 5979265 - DNA, 15 bp, Homo sapiens
caaagtattaagcat

SEQ ID NO: 5979266 - DNA, 23 bp, Homo sapiens
caaagtattaatgtacagagtgg

SEQ ID NO: 5979267 - DNA, 15 bp, Homo sapiens
caaagtattgtaaat

SEQ ID NO: 5979268 - DNA, 20 bp, Homo sapiens
caaagtattgtaaattatat

SEQ ID NO: 5979269 - DNA, 22 bp, Homo sapiens
caaagtattgtaaattatattt

SEQ ID NO: 5979270 - DNA, 17 bp, Homo sapiens
caaagtcacaggaagaa

SEQ ID NO: 5979271 - DNA, 16 bp, Homo sapiens
caaagtcacttcccca

SEQ ID NO: 5979272 - DNA, 22 bp, Homo sapiens
caaagtcaggaatcatcaggaa

SEQ ID NO: 5979273 - DNA, 23 bp, Homo sapiens
caaagtcataattgcattgactt

SEQ ID NO: 5979274 - DNA, 16 bp, Homo sapiens
caaagtcatgtcagaa

SEQ ID NO: 5979275 - DNA, 20 bp, Homo sapiens
caaagtcatgtcagaaggag

SEQ ID NO: 5979276 - DNA, 20 bp, Homo sapiens
caaagtccaactacagccaa

SEQ ID NO: 5979277 - DNA, 13 bp, Homo sapiens
caaagtccacaca

SEQ ID NO: 5979278 - DNA, 17 bp, Homo sapiens
caaagtccacacaaaga

SEQ ID NO: 5979279 - DNA, 22 bp, Homo sapiens
caaagtccccctcctcagccag

SEQ ID NO: 5979280 - DNA, 21 bp, Homo sapiens
caaagtcccttcctgcttcct

SEQ ID NO: 5979281 - DNA, 16 bp, Homo sapiens
caaagtcctcctttca

SEQ ID NO: 5979282 - DNA, 16 bp, Homo sapiens
caaagtcctctgctcc

SEQ ID NO: 5979283 - DNA, 14 bp, Homo sapiens
caaagtcctttttt

SEQ ID NO: 5979284 - DNA, 20 bp, Homo sapiens
caaagtcgccagtcactgct

SEQ ID NO: 5979285 - DNA, 16 bp, Homo sapiens
caaagtctaaagttta

SEQ ID NO: 5979286 - DNA, 19 bp, Homo sapiens
caaagtctaaagtttacag

SEQ ID NO: 5979287 - DNA, 13 bp, Homo sapiens
caaagtctccaga

SEQ ID NO: 5979288 - DNA, 20 bp, Homo sapiens
caaagtctccagaagaaaat

SEQ ID NO: 5979289 - DNA, 13 bp, Homo sapiens
caaagtctccagc

SEQ ID NO: 5979290 - DNA, 12 bp, Homo sapiens
caaagtctctaa

SEQ ID NO: 5979291 - DNA, 15 bp, Homo sapiens
caaagtctctaattc

SEQ ID NO: 5979292 - DNA, 19 bp, Homo sapiens
caaagtctgccgcccacct

SEQ ID NO: 5979293 - DNA, 18 bp, Homo sapiens
caaagtctgggaaattct

SEQ ID NO: 5979294 - DNA, 23 bp, Homo sapiens
caaagtctgggaaattctatatg

SEQ ID NO: 5979295 - DNA, 19 bp, Homo sapiens
cacagcaccagaatgtata

SEQ ID NO: 5979296 - DNA, 13 bp, Homo sapiens
cacagcacccact

SEQ ID NO: 5979297 - DNA, 17 bp, Homo sapiens
cacagcacccaggctcc

SEQ ID NO: 5979298 - DNA, 18 bp, Homo sapiens
cacagcacccaggctcca

SEQ ID NO: 5979299 - DNA, 19 bp, Homo sapiens
cacagcacccaggctccat

SEQ ID NO: 5979300 - DNA, 20 bp, Homo sapiens
cacagcacccaggctccatg

SEQ ID NO: 5979301 - DNA, 20 bp, Homo sapiens
cacagcaccgggggagaggg

SEQ ID NO: 5979302 - DNA, 24 bp, Homo sapiens
cacagcaccgggggagagggacac

SEQ ID NO: 5979303 - DNA, 20 bp, Homo sapiens
cacagcacgggggccaagga

SEQ ID NO: 5979304 - DNA, 14 bp, Homo sapiens
cacagcactgcctg

SEQ ID NO: 5979305 - DNA, 16 bp, Homo sapiens
cacagcactgcctgcc

SEQ ID NO: 5979306 - DNA, 18 bp, Homo sapiens
cacagcactgcctgccaa

SEQ ID NO: 5979307 - DNA, 19 bp, Homo sapiens
cacagcactgcctgccaag

SEQ ID NO: 5979308 - DNA, 21 bp, Homo sapiens
cacagcacttgagtaaaatac

SEQ ID NO: 5979309 - DNA, 15 bp, Homo sapiens
cacagcagaatgaag

SEQ ID NO: 5979310 - DNA, 21 bp, Homo sapiens
cacagcagaatgaagacctaa

SEQ ID NO: 5979311 - DNA, 15 bp, Homo sapiens
cacagcagacaccat

SEQ ID NO: 5979312 - DNA, 12 bp, Homo sapiens
cacagcagagca

SEQ ID NO: 5979313 - DNA, 13 bp, Homo sapiens
cacagcagcactg

SEQ ID NO: 5979314 - DNA, 23 bp, Homo sapiens
cacagcagcagaacaagtgcctc

SEQ ID NO: 5979315 - DNA, 18 bp, Homo sapiens
cacagcagccccaggaga

SEQ ID NO: 5979316 - DNA, 18 bp, Homo sapiens
cacagcagccccccagca

SEQ ID NO: 5979317 - DNA, 20 bp, Homo sapiens
cacagcagccccccagcact

SEQ ID NO: 5979318 - DNA, 12 bp, Homo sapiens
cacagcagcctg

SEQ ID NO: 5979319 - DNA, 23 bp, Homo sapiens
cacagcagctgcaggggcctctg

SEQ ID NO: 5979320 - DNA, 18 bp, Homo sapiens
cacagcagcttcaccaga

SEQ ID NO: 5979321 - DNA, 21 bp, Homo sapiens
cacagcagcttcaccagagca

SEQ ID NO: 5979322 - DNA, 14 bp, Homo sapiens
cacagcaggacctg

SEQ ID NO: 5979323 - DNA, 16 bp, Homo sapiens
cacagcaggctgccag

SEQ ID NO: 5979324 - DNA, 17 bp, Homo sapiens
cacagcaggctgccagt

SEQ ID NO: 5979325 - DNA, 19 bp, Homo sapiens
cacagcaggctgccagtgc

SEQ ID NO: 5979326 - DNA, 21 bp, Homo sapiens
cacagcaggctgccagtgcct

SEQ ID NO: 5979327 - DNA, 19 bp, Homo sapiens
cacagcagggccttctgcc

SEQ ID NO: 5979328 - DNA, 20 bp, Homo sapiens
cacagcagggccttctgcct

SEQ ID NO: 5979329 - DNA, 13 bp, Homo sapiens
cacagcaggtcct

SEQ ID NO: 5979330 - DNA, 18 bp, Homo sapiens
cacagcagtacttgctca

SEQ ID NO: 5979331 - DNA, 18 bp, Homo sapiens
cacagcagtcacaggccc

SEQ ID NO: 5979332 - DNA, 20 bp, Homo sapiens
cacagcagtcacaggcccag

SEQ ID NO: 5979333 - DNA, 16 bp, Homo sapiens
cacagcagtgagactg

SEQ ID NO: 5979334 - DNA, 18 bp, Homo sapiens
cacagcagtgtcacagac

SEQ ID NO: 5979335 - DNA, 15 bp, Homo sapiens
cacagcagtgtcccc

SEQ ID NO: 5979336 - DNA, 22 bp, Homo sapiens
cacagcagtgtgaatagcctgg

SEQ ID NO: 5979337 - DNA, 22 bp, Homo sapiens
cacagcagttgaaaagactcca

SEQ ID NO: 5979338 - DNA, 15 bp, Homo sapiens
cacagcatcagctca

SEQ ID NO: 5979339 - DNA, 14 bp, Homo sapiens
cacagcatctcagc

SEQ ID NO: 5979340 - DNA, 15 bp, Homo sapiens
cacagcatgaacctt

SEQ ID NO: 5979341 - DNA, 21 bp, Homo sapiens
cacagcatgaggcaaaaatgt

SEQ ID NO: 5979342 - DNA, 20 bp, Homo sapiens
cacagcatgcatttagcatg

SEQ ID NO: 5979343 - DNA, 21 bp, Homo sapiens
cacagcatgcatttagcatga

SEQ ID NO: 5979344 - DNA, 20 bp, Homo sapiens
cacagcatgggtccagaaga

SEQ ID NO: 5979345 - DNA, 21 bp, Homo sapiens
cacagcatgggtccagaagac

SEQ ID NO: 5979346 - DNA, 21 bp, Homo sapiens
cacagcatgtgcaatatgcca

SEQ ID NO: 5979347 - DNA, 14 bp, Homo sapiens
cacagcatgtgcca

SEQ ID NO: 5979348 - DNA, 16 bp, Homo sapiens
cacagcattgtatatg

SEQ ID NO: 5979349 - DNA, 16 bp, Homo sapiens
cacagccaaatttaaa

SEQ ID NO: 5979350 - DNA, 22 bp, Homo sapiens
cacagccaacacgcacctgcct

SEQ ID NO: 5979351 - DNA, 14 bp, Homo sapiens
cacagccaagccca

SEQ ID NO: 5979352 - DNA, 14 bp, Homo sapiens
cacagccaatctcc

SEQ ID NO: 5979353 - DNA, 20 bp, Homo sapiens
cacagccacacacacagaaa

SEQ ID NO: 5979354 - DNA, 16 bp, Homo sapiens
cacagccaccacctgg

SEQ ID NO: 5979355 - DNA, 17 bp, Homo sapiens
cacagccaccacctgga

SEQ ID NO: 5979356 - DNA, 18 bp, Homo sapiens
cacagccacctccgccag

SEQ ID NO: 5979357 - DNA, 23 bp, Homo sapiens
cacagccacctccgccagacccc

SEQ ID NO: 5979358 - DNA, 20 bp, Homo sapiens
cacagccagacttgcttcct

SEQ ID NO: 5979359 - DNA, 11 bp, Homo sapiens
cacagccagag

SEQ ID NO: 5979360 - DNA, 13 bp, Homo sapiens
cacagccagccca

SEQ ID NO: 5979361 - DNA, 16 bp, Homo sapiens
cacagccaggtgcctt

SEQ ID NO: 5979362 - DNA, 11 bp, Homo sapiens
cacagccatag

SEQ ID NO: 5979363 - DNA, 15 bp, Homo sapiens
cacagccatagcaga

SEQ ID NO: 5979364 - DNA, 13 bp, Homo sapiens
cacagccatccca

SEQ ID NO: 5979365 - DNA, 23 bp, Homo sapiens
cacagccattcatctgggctggc

SEQ ID NO: 5979366 - DNA, 14 bp, Homo sapiens
cacagcccaaccag

SEQ ID NO: 5979367 - DNA, 19 bp, Homo sapiens
cacagcccaaccaggaggg

SEQ ID NO: 5979368 - DNA, 14 bp, Homo sapiens
cacagcccaccctc

SEQ ID NO: 5979369 - DNA, 22 bp, Homo sapiens
cacagcccacggggatcacagc

SEQ ID NO: 5979370 - DNA, 14 bp, Homo sapiens
cacagcccacgtcc

SEQ ID NO: 5979371 - DNA, 17 bp, Homo sapiens
cacagcccagaaccaca

SEQ ID NO: 5979372 - DNA, 13 bp, Homo sapiens
cacagcccagaag

SEQ ID NO: 5979373 - DNA, 15 bp, Homo sapiens
cacagcccagaaggc

SEQ ID NO: 5979374 - DNA, 16 bp, Homo sapiens
cacagcccagaaggcc

SEQ ID NO: 5979375 - DNA, 15 bp, Homo sapiens
cacagcccagagact

SEQ ID NO: 5979376 - DNA, 16 bp, Homo sapiens
cacagcccagagactg

SEQ ID NO: 5979377 - DNA, 12 bp, Homo sapiens
cacagcccagcc

SEQ ID NO: 5979378 - DNA, 14 bp, Homo sapiens
cacagcccagcccg

SEQ ID NO: 5979379 - DNA, 15 bp, Homo sapiens
cacagcccagcttgg

SEQ ID NO: 5979380 - DNA, 21 bp, Homo sapiens
cacagcccaggcctccagctc

SEQ ID NO: 5979381 - DNA, 15 bp, Homo sapiens
cacagcccagggcct

SEQ ID NO: 5979382 - DNA, 14 bp, Homo sapiens
cacagccccacagc

SEQ ID NO: 5979383 - DNA, 18 bp, Homo sapiens
cacagccccacagcaccc

SEQ ID NO: 5979384 - DNA, 20 bp, Homo sapiens
cacagccccacagcacccag

SEQ ID NO: 5979385 - DNA, 22 bp, Homo sapiens
cacagccccacccttgtccctc

SEQ ID NO: 5979386 - DNA, 15 bp, Homo sapiens
cacagccccatggac

SEQ ID NO: 5979387 - DNA, 22 bp, Homo sapiens
cacagcccccaccccagcacag

SEQ ID NO: 5979388 - DNA, 19 bp, Homo sapiens
cacagcccccttgccctcc

SEQ ID NO: 5979389 - DNA, 22 bp, Homo sapiens
cacagcccctatagcactgagc

SEQ ID NO: 5979390 - DNA, 14 bp, Homo sapiens
cacagcccctggag

SEQ ID NO: 5979391 - DNA, 16 bp, Homo sapiens
cacagcccctggagcc

SEQ ID NO: 5979392 - DNA, 21 bp, Homo sapiens
cacagcccgcatgcagcagct

SEQ ID NO: 5979393 - DNA, 23 bp, Homo sapiens
cacagccctagtatgaaagctgg

SEQ ID NO: 5979394 - DNA, 14 bp, Homo sapiens
cacagccctcccgc

SEQ ID NO: 5979395 - DNA, 15 bp, Homo sapiens
cacagccctcccgcc

SEQ ID NO: 5979396 - DNA, 17 bp, Homo sapiens
cacagccctcccgcccc

SEQ ID NO: 5979397 - DNA, 18 bp, Homo sapiens
cacagccctcccgcccct

SEQ ID NO: 5979398 - DNA, 10 bp, Homo sapiens
cacagccctg

SEQ ID NO: 5979399 - DNA, 13 bp, Homo sapiens
cacagccctgaga

SEQ ID NO: 5979400 - DNA, 18 bp, Homo sapiens
cacagccctgagtgtccc

SEQ ID NO: 5979401 - DNA, 19 bp, Homo sapiens
cacagccctgagtgtccca

SEQ ID NO: 5979402 - DNA, 22 bp, Homo sapiens
cacagccctgagtgtcccaagc

SEQ ID NO: 5979403 - DNA, 13 bp, Homo sapiens
cacagccctggaa

SEQ ID NO: 5979404 - DNA, 12 bp, Homo sapiens
cacagccctggg

SEQ ID NO: 5979405 - DNA, 17 bp, Homo sapiens
cacagccctgggagggg

SEQ ID NO: 5979406 - DNA, 11 bp, Homo sapiens
cacagccctgt

SEQ ID NO: 5979407 - DNA, 13 bp, Homo sapiens
cacagccctgtca

SEQ ID NO: 5979408 - DNA, 14 bp, Homo sapiens
cacagccctgtcag

SEQ ID NO: 5979409 - DNA, 23 bp, Homo sapiens
cacagccctgtcagtgcagcccg

SEQ ID NO: 5979410 - DNA, 20 bp, Homo sapiens
cacagccggggcctgcctag

SEQ ID NO: 5979411 - DNA, 13 bp, Homo sapiens
cacagcctagcac

SEQ ID NO: 5979412 - DNA, 17 bp, Homo sapiens
cacagcctcacccctgc

SEQ ID NO: 5979413 - DNA, 21 bp, Homo sapiens
cacagcctcacccctgcccct

SEQ ID NO: 5979414 - DNA, 16 bp, Homo sapiens
cacagcctccaagtca

SEQ ID NO: 5979415 - DNA, 18 bp, Homo sapiens
cacagcctccccacccag

SEQ ID NO: 5979416 - DNA, 14 bp, Homo sapiens
cacagcctcccctg

SEQ ID NO: 5979417 - DNA, 20 bp, Homo sapiens
cacagcctcccctgccaggg

SEQ ID NO: 5979418 - DNA, 14 bp, Homo sapiens
cacagcctcccctt

SEQ ID NO: 5979419 - DNA, 19 bp, Homo sapiens
cacagcctccctgagcctg

SEQ ID NO: 5979420 - DNA, 21 bp, Homo sapiens
cacagcctccctgagcctgca

SEQ ID NO: 5979421 - DNA, 23 bp, Homo sapiens
cacagcctcctctgtctgccctt

SEQ ID NO: 5979422 - DNA, 22 bp, Homo sapiens
cacagcctcggggatggggagg

SEQ ID NO: 5979423 - DNA, 14 bp, Homo sapiens
cacagcctctccct

SEQ ID NO: 5979424 - DNA, 15 bp, Homo sapiens
cacagcctctggctc

SEQ ID NO: 5979425 - DNA, 16 bp, Homo sapiens
cacagcctctggctcc

SEQ ID NO: 5979426 - DNA, 15 bp, Homo sapiens
cacagcctcttcctc

SEQ ID NO: 5979427 - DNA, 12 bp, Homo sapiens
cacagcctgctg

SEQ ID NO: 5979428 - DNA, 14 bp, Homo sapiens
cacagcctgctggc

SEQ ID NO: 5979429 - DNA, 15 bp, Homo sapiens
cacagcctgctggca

SEQ ID NO: 5979430 - DNA, 17 bp, Homo sapiens
cacagcctgctggcagg

SEQ ID NO: 5979431 - DNA, 18 bp, Homo sapiens
cacagcctgctggcaggg

SEQ ID NO: 5979432 - DNA, 21 bp, Homo sapiens
cacagcctgctggcagggcca

SEQ ID NO: 5979433 - DNA, 22 bp, Homo sapiens
cacagcctgctggcagggccag

SEQ ID NO: 5979434 - DNA, 13 bp, Homo sapiens
cacagcctggact

SEQ ID NO: 5979435 - DNA, 19 bp, Homo sapiens
cacagcctggcctcccctg

SEQ ID NO: 5979436 - DNA, 20 bp, Homo sapiens
cacagcctggcctcccctgc

SEQ ID NO: 5979437 - DNA, 20 bp, Homo sapiens
cacagcctgggaccagggca

SEQ ID NO: 5979438 - DNA, 12 bp, Homo sapiens
cacagcctgggc

SEQ ID NO: 5979439 - DNA, 16 bp, Homo sapiens
cacagcctgtccctgg

SEQ ID NO: 5979440 - DNA, 15 bp, Homo sapiens
cacagcctgtcttgt

SEQ ID NO: 5979441 - DNA, 18 bp, Homo sapiens
cacagcctgtgtgcagtg

SEQ ID NO: 5979442 - DNA, 13 bp, Homo sapiens
cacagccttccct

SEQ ID NO: 5979443 - DNA, 18 bp, Homo sapiens
cacagccttccctctgca

SEQ ID NO: 5979444 - DNA, 15 bp, Homo sapiens
cacagccttccttct

SEQ ID NO: 5979445 - DNA, 19 bp, Homo sapiens
cacagccttgcagcggctc

SEQ ID NO: 5979446 - DNA, 13 bp, Homo sapiens
cacagccttggct

SEQ ID NO: 5979447 - DNA, 19 bp, Homo sapiens
cacagcctttcgttctgct

SEQ ID NO: 5979448 - DNA, 14 bp, Homo sapiens
cacagcctttctgt

SEQ ID NO: 5979449 - DNA, 20 bp, Homo sapiens
cacagcctttgcgctctggg

SEQ ID NO: 5979450 - DNA, 14 bp, Homo sapiens
cacagcgagcctgt

SEQ ID NO: 5979451 - DNA, 15 bp, Homo sapiens
cacagcgagcctgtg

SEQ ID NO: 5979452 - DNA, 19 bp, Homo sapiens
cacagcgagcctgtgcctt

SEQ ID NO: 5979453 - DNA, 23 bp, Homo sapiens
cacagcgagcctgtgccttcctc

SEQ ID NO: 5979454 - DNA, 15 bp, Homo sapiens
cacagcgagggcagc

SEQ ID NO: 5979455 - DNA, 17 bp, Homo sapiens
cacagcgagggcagctg

SEQ ID NO: 5979456 - DNA, 18 bp, Homo sapiens
cacagcgagggcagctgc

SEQ ID NO: 5979457 - DNA, 19 bp, Homo sapiens
cacagcgagggcagctgct

SEQ ID NO: 5979458 - DNA, 19 bp, Homo sapiens
cacagcgctggccgggacc

SEQ ID NO: 5979459 - DNA, 17 bp, Homo sapiens
cacagcggaggagacca

SEQ ID NO: 5979460 - DNA, 21 bp, Homo sapiens
cacagcggaggtgtggagccg

SEQ ID NO: 5979461 - DNA, 16 bp, Homo sapiens
cacagcggcccctgca

SEQ ID NO: 5979462 - DNA, 20 bp, Homo sapiens
cacagcggggccccagggct

SEQ ID NO: 5979463 - DNA, 23 bp, Homo sapiens
cacagcgtcattttgaatcatca

SEQ ID NO: 5979464 - DNA, 14 bp, Homo sapiens
cacagcgtccctgg

SEQ ID NO: 5979465 - DNA, 19 bp, Homo sapiens
cacagcgtccctggcgcag

SEQ ID NO: 5979466 - DNA, 22 bp, Homo sapiens
cacagcgtccctggcgcaggtg

SEQ ID NO: 5979467 - DNA, 15 bp, Homo sapiens
cacagcgtctgctca

SEQ ID NO: 5979468 - DNA, 16 bp, Homo sapiens
cacagcgtctgctcat

SEQ ID NO: 5979469 - DNA, 13 bp, Homo sapiens
cacagcgtgctgg

SEQ ID NO: 5979470 - DNA, 20 bp, Homo sapiens
cacagctaacacacagctcc

SEQ ID NO: 5979471 - DNA, 15 bp, Homo sapiens
cacagctaacatgga

SEQ ID NO: 5979472 - DNA, 14 bp, Homo sapiens
cacagctaatattc

SEQ ID NO: 5979473 - DNA, 16 bp, Homo sapiens
cacagctacaacccta

SEQ ID NO: 5979474 - DNA, 15 bp, Homo sapiens
cacagctacctgaga

SEQ ID NO: 5979475 - DNA, 20 bp, Homo sapiens
caaagtcttaaaataactta

SEQ ID NO: 5979476 - DNA, 20 bp, Homo sapiens
caaagtgaaattagtatttt

SEQ ID NO: 5979477 - DNA, 21 bp, Homo sapiens
caaagtgaaattagtattttg

SEQ ID NO: 5979478 - DNA, 23 bp, Homo sapiens
caaagtgaaattagtattttgag

SEQ ID NO: 5979479 - DNA, 21 bp, Homo sapiens
caaagtgagaaaatgcctcaa

SEQ ID NO: 5979480 - DNA, 20 bp, Homo sapiens
caaagtgagaaattatgaaa

SEQ ID NO: 5979481 - DNA, 13 bp, Homo sapiens
caaagtgataaat

SEQ ID NO: 5979482 - DNA, 15 bp, Homo sapiens
caaagtgatagaaaa

SEQ ID NO: 5979483 - DNA, 15 bp, Homo sapiens
caaagtgcacctcaa

SEQ ID NO: 5979484 - DNA, 16 bp, Homo sapiens
caaagtgcagcccttc

SEQ ID NO: 5979485 - DNA, 19 bp, Homo sapiens
caaagtgcagcccttcctc

SEQ ID NO: 5979486 - DNA, 22 bp, Homo sapiens
caaagtgcagcccttcctcctg

SEQ ID NO: 5979487 - DNA, 23 bp, Homo sapiens
caaagtgcagcccttcctcctga

SEQ ID NO: 5979488 - DNA, 15 bp, Homo sapiens
caaagtgcatgtcac

SEQ ID NO: 5979489 - DNA, 16 bp, Homo sapiens
caaagtgccaaagaaa

SEQ ID NO: 5979490 - DNA, 16 bp, Homo sapiens
caaagtgccactcatt

SEQ ID NO: 5979491 - DNA, 22 bp, Homo sapiens
caaagtgccactcattcctgta

SEQ ID NO: 5979492 - DNA, 13 bp, Homo sapiens
caaagtgcctggg

SEQ ID NO: 5979493 - DNA, 16 bp, Homo sapiens
caaagtgcctgggctc

SEQ ID NO: 5979494 - DNA, 17 bp, Homo sapiens
caaagtgccttctgagc

SEQ ID NO: 5979495 - DNA, 18 bp, Homo sapiens
caaagtgccttgctcatt

SEQ ID NO: 5979496 - DNA, 17 bp, Homo sapiens
caaagtgcgtgtgtgta

SEQ ID NO: 5979497 - DNA, 15 bp, Homo sapiens
caaagtgctgagatt

SEQ ID NO: 5979498 - DNA, 16 bp, Homo sapiens
caaagtgctgagatta

SEQ ID NO: 5979499 - DNA, 11 bp, Homo sapiens
caaagtgctgg

SEQ ID NO: 5979500 - DNA, 15 bp, Homo sapiens
caaagtgctgggatt

SEQ ID NO: 5979501 - DNA, 14 bp, Homo sapiens
caaagtgctgtacc

SEQ ID NO: 5979502 - DNA, 14 bp, Homo sapiens
caaagtgcttcctt

SEQ ID NO: 5979503 - DNA, 16 bp, Homo sapiens
caaagtgcttcctttt

SEQ ID NO: 5979504 - DNA, 17 bp, Homo sapiens
caaagtggaaggaaaga

SEQ ID NO: 5979505 - DNA, 23 bp, Homo sapiens
caaagtggaaggaaagatgctca

SEQ ID NO: 5979506 - DNA, 15 bp, Homo sapiens
caaagtggaattaaa

SEQ ID NO: 5979507 - DNA, 18 bp, Homo sapiens
caaagtggagctgggagg

SEQ ID NO: 5979508 - DNA, 13 bp, Homo sapiens
caaagtggcaaaa

SEQ ID NO: 5979509 - DNA, 14 bp, Homo sapiens
caaagtggggaggg

SEQ ID NO: 5979510 - DNA, 20 bp, Homo sapiens
caaagtggggggtggacaca

SEQ ID NO: 5979511 - DNA, 21 bp, Homo sapiens
caaagtgggtactttctgaaa

SEQ ID NO: 5979512 - DNA, 16 bp, Homo sapiens
caaagtgggtgtgtgg

SEQ ID NO: 5979513 - DNA, 20 bp, Homo sapiens
caaagtgggtgtgtggcctc

SEQ ID NO: 5979514 - DNA, 22 bp, Homo sapiens
caaagtgggtgtgtggcctccc

SEQ ID NO: 5979515 - DNA, 20 bp, Homo sapiens
caaagtggtaaatactgtga

SEQ ID NO: 5979516 - DNA, 17 bp, Homo sapiens
caaagtggtgagaggca

SEQ ID NO: 5979517 - DNA, 19 bp, Homo sapiens
caaagtgtacaattttcat

SEQ ID NO: 5979518 - DNA, 14 bp, Homo sapiens
caaagtgtatattt

SEQ ID NO: 5979519 - DNA, 17 bp, Homo sapiens
caaagtgtatatttatt

SEQ ID NO: 5979520 - DNA, 23 bp, Homo sapiens
caaagtgtattttataaaattaa

SEQ ID NO: 5979521 - DNA, 16 bp, Homo sapiens
caaagtgtcactccat

SEQ ID NO: 5979522 - DNA, 13 bp, Homo sapiens
caaagtgtctcat

SEQ ID NO: 5979523 - DNA, 22 bp, Homo sapiens
caaagtgtctcattctcagagt

SEQ ID NO: 5979524 - DNA, 17 bp, Homo sapiens
caaagtgtgtattaaaa

SEQ ID NO: 5979525 - DNA, 19 bp, Homo sapiens
caaagtgttaggattacag

SEQ ID NO: 5979526 - DNA, 17 bp, Homo sapiens
caaagtgttgctgtggc

SEQ ID NO: 5979527 - DNA, 19 bp, Homo sapiens
caaagtgttgtgttcctgg

SEQ ID NO: 5979528 - DNA, 20 bp, Homo sapiens
caaagtgttgtgttcctggc

SEQ ID NO: 5979529 - DNA, 17 bp, Homo sapiens
caaagttaaaagtaaaa

SEQ ID NO: 5979530 - DNA, 21 bp, Homo sapiens
caaagttaattgtatttatgt

SEQ ID NO: 5979531 - DNA, 18 bp, Homo sapiens
caaagttactggctcttt

SEQ ID NO: 5979532 - DNA, 14 bp, Homo sapiens
caaagttagagaac

SEQ ID NO: 5979533 - DNA, 16 bp, Homo sapiens
caaagttagttcagta

SEQ ID NO: 5979534 - DNA, 19 bp, Homo sapiens
caaagttatattcacagtt

SEQ ID NO: 5979535 - DNA, 14 bp, Homo sapiens
caaagttatattta

SEQ ID NO: 5979536 - DNA, 16 bp, Homo sapiens
caaagttatcttaaat

SEQ ID NO: 5979537 - DNA, 13 bp, Homo sapiens
caaagttcaactt

SEQ ID NO: 5979538 - DNA, 17 bp, Homo sapiens
caaagttcactgtttat

SEQ ID NO: 5979539 - DNA, 16 bp, Homo sapiens
caaagttccaaaatgc

SEQ ID NO: 5979540 - DNA, 21 bp, Homo sapiens
caaagttccagttttgttttg

SEQ ID NO: 5979541 - DNA, 20 bp, Homo sapiens
caaagttccctacttcctgt

SEQ ID NO: 5979542 - DNA, 21 bp, Homo sapiens
caaagttccctacttcctgtg

SEQ ID NO: 5979543 - DNA, 22 bp, Homo sapiens
caaagttccctacttcctgtga

SEQ ID NO: 5979544 - DNA, 20 bp, Homo sapiens
caaagttctaataatttcta

SEQ ID NO: 5979545 - DNA, 21 bp, Homo sapiens
caaagttctaataatttctaa

SEQ ID NO: 5979546 - DNA, 15 bp, Homo sapiens
caaagttctcagagc

SEQ ID NO: 5979547 - DNA, 20 bp, Homo sapiens
caaagttctcagagctctcg

SEQ ID NO: 5979548 - DNA, 17 bp, Homo sapiens
caaagttctctgtggca

SEQ ID NO: 5979549 - DNA, 15 bp, Homo sapiens
caaagttctgtgttt

SEQ ID NO: 5979550 - DNA, 14 bp, Homo sapiens
caaagttgcctaaa

SEQ ID NO: 5979551 - DNA, 19 bp, Homo sapiens
caaagttgcctaaatccat

SEQ ID NO: 5979552 - DNA, 23 bp, Homo sapiens
caaagttgctcaccgactcacct

SEQ ID NO: 5979553 - DNA, 14 bp, Homo sapiens
caaagtttctgttg

SEQ ID NO: 5979554 - DNA, 17 bp, Homo sapiens
caaagtttgacaggaac

SEQ ID NO: 5979555 - DNA, 19 bp, Homo sapiens
caaagtttgacaggaacct

SEQ ID NO: 5979556 - DNA, 20 bp, Homo sapiens
caaagttttcatgtgctcag

SEQ ID NO: 5979557 - DNA, 13 bp, Homo sapiens
caaagttttcctt

SEQ ID NO: 5979558 - DNA, 15 bp, Homo sapiens
caaagttttcctttg

SEQ ID NO: 5979559 - DNA, 17 bp, Homo sapiens
caaagttttgaaaagct

SEQ ID NO: 5979560 - DNA, 18 bp, Homo sapiens
caaagttttgaaaagcta

SEQ ID NO: 5979561 - DNA, 14 bp, Homo sapiens
caaagttttgctgt

SEQ ID NO: 5979562 - DNA, 17 bp, Homo sapiens
caaagtttttacagtgt

SEQ ID NO: 5979563 - DNA, 21 bp, Homo sapiens
caaataaaaactaaattgtaa

SEQ ID NO: 5979564 - DNA, 22 bp, Homo sapiens
caaataaaaactaaattgtaaa

SEQ ID NO: 5979565 - DNA, 17 bp, Homo sapiens
caaataaaacagtgaaa

SEQ ID NO: 5979566 - DNA, 23 bp, Homo sapiens
caaataaaacagtgaaagccctg

SEQ ID NO: 5979567 - DNA, 23 bp, Homo sapiens
caaataaaacataatagaatttc

SEQ ID NO: 5979568 - DNA, 21 bp, Homo sapiens
caaataaaacatggccagcaa

SEQ ID NO: 5979569 - DNA, 10 bp, Homo sapiens
caaataaaat

SEQ ID NO: 5979570 - DNA, 17 bp, Homo sapiens
caaataaaatgtttaca

SEQ ID NO: 5979571 - DNA, 18 bp, Homo sapiens
caaataaaatgtttacat

SEQ ID NO: 5979572 - DNA, 20 bp, Homo sapiens
caaataaaatgtttacattt

SEQ ID NO: 5979573 - DNA, 22 bp, Homo sapiens
caaataaaatgtttacattttc

SEQ ID NO: 5979574 - DNA, 17 bp, Homo sapiens
caaataaaattccctaa

SEQ ID NO: 5979575 - DNA, 21 bp, Homo sapiens
caaataaaattccctaaagcc

SEQ ID NO: 5979576 - DNA, 18 bp, Homo sapiens
caaataaaattggcacca

SEQ ID NO: 5979577 - DNA, 21 bp, Homo sapiens
caaataaacaactatggctgt

SEQ ID NO: 5979578 - DNA, 13 bp, Homo sapiens
caaataaacactg

SEQ ID NO: 5979579 - DNA, 18 bp, Homo sapiens
caaataaacagctattta

SEQ ID NO: 5979580 - DNA, 18 bp, Homo sapiens
caaataaacctgaggcag

SEQ ID NO: 5979581 - DNA, 14 bp, Homo sapiens
caaataaaccttgt

SEQ ID NO: 5979582 - DNA, 16 bp, Homo sapiens
caaataaactagtctg

SEQ ID NO: 5979583 - DNA, 20 bp, Homo sapiens
caaataaactgactttttcc

SEQ ID NO: 5979584 - DNA, 16 bp, Homo sapiens
caaataaacttacaga

SEQ ID NO: 5979585 - DNA, 14 bp, Homo sapiens
caaataaagaaatt

SEQ ID NO: 5979586 - DNA, 15 bp, Homo sapiens
caaataaagaaattt

SEQ ID NO: 5979587 - DNA, 17 bp, Homo sapiens
caaataaagcagtcatg

SEQ ID NO: 5979588 - DNA, 20 bp, Homo sapiens
caaataaagcctgctctccc

SEQ ID NO: 5979589 - DNA, 11 bp, Homo sapiens
caaataaagtc

SEQ ID NO: 5979590 - DNA, 17 bp, Homo sapiens
caaataaagtcccaggt

SEQ ID NO: 5979591 - DNA, 12 bp, Homo sapiens
caaataaagtct

SEQ ID NO: 5979592 - DNA, 19 bp, Homo sapiens
caaataaagttaaaagtaa

SEQ ID NO: 5979593 - DNA, 17 bp, Homo sapiens
caaataaataattttca

SEQ ID NO: 5979594 - DNA, 22 bp, Homo sapiens
caaataaatgattatattcaca

SEQ ID NO: 5979595 - DNA, 12 bp, Homo sapiens
caaataaatgtg

SEQ ID NO: 5979596 - DNA, 19 bp, Homo sapiens
caaataaatgtgtaaatgt

SEQ ID NO: 5979597 - DNA, 15 bp, Homo sapiens
caaataaatgtttcc

SEQ ID NO: 5979598 - DNA, 19 bp, Homo sapiens
caaataaattcaataaaaa

SEQ ID NO: 5979599 - DNA, 14 bp, Homo sapiens
caaataaattggaa

SEQ ID NO: 5979600 - DNA, 14 bp, Homo sapiens
caaataaatttata

SEQ ID NO: 5979601 - DNA, 19 bp, Homo sapiens
caaataaatttataacaat

SEQ ID NO: 5979602 - DNA, 14 bp, Homo sapiens
caaataaatttctg

SEQ ID NO: 5979603 - DNA, 22 bp, Homo sapiens
caaataaccaacccttccctga

SEQ ID NO: 5979604 - DNA, 13 bp, Homo sapiens
caaataaccctga

SEQ ID NO: 5979605 - DNA, 17 bp, Homo sapiens
caaataactaaggaata

SEQ ID NO: 5979606 - DNA, 20 bp, Homo sapiens
caaataactaaggaatatat

SEQ ID NO: 5979607 - DNA, 23 bp, Homo sapiens
caaataacttacaagactgtaaa

SEQ ID NO: 5979608 - DNA, 15 bp, Homo sapiens
caaataacttcagtc

SEQ ID NO: 5979609 - DNA, 17 bp, Homo sapiens
caaataacttcagtcct

SEQ ID NO: 5979610 - DNA, 13 bp, Homo sapiens
caaataagacagt

SEQ ID NO: 5979611 - DNA, 12 bp, Homo sapiens
caaataagactt

SEQ ID NO: 5979612 - DNA, 21 bp, Homo sapiens
caaataagatatttttcagct

SEQ ID NO: 5979613 - DNA, 19 bp, Homo sapiens
caaataagcactcctttaa

SEQ ID NO: 5979614 - DNA, 16 bp, Homo sapiens
caaataaggatttgtt

SEQ ID NO: 5979615 - DNA, 17 bp, Homo sapiens
caaataagggaataaaa

SEQ ID NO: 5979616 - DNA, 14 bp, Homo sapiens
caaataagtaatat

SEQ ID NO: 5979617 - DNA, 22 bp, Homo sapiens
caaataagtcaaaataatctga

SEQ ID NO: 5979618 - DNA, 13 bp, Homo sapiens
caaataagtgtat

SEQ ID NO: 5979619 - DNA, 18 bp, Homo sapiens
caaataagtgtattttga

SEQ ID NO: 5979620 - DNA, 20 bp, Homo sapiens
caaataagtgtattttgaaa

SEQ ID NO: 5979621 - DNA, 21 bp, Homo sapiens
caaataagtgtattttgaaat

SEQ ID NO: 5979622 - DNA, 15 bp, Homo sapiens
caaataagtttttgc

SEQ ID NO: 5979623 - DNA, 19 bp, Homo sapiens
caaataataataataacaa

SEQ ID NO: 5979624 - DNA, 11 bp, Homo sapiens
caaataatatt

SEQ ID NO: 5979625 - DNA, 20 bp, Homo sapiens
caaataatattactctatga

SEQ ID NO: 5979626 - DNA, 21 bp, Homo sapiens
caaataatattactctatgat

SEQ ID NO: 5979627 - DNA, 14 bp, Homo sapiens
caaataatattcat

SEQ ID NO: 5979628 - DNA, 17 bp, Homo sapiens
caaataatattgccttg

SEQ ID NO: 5979629 - DNA, 22 bp, Homo sapiens
caaataatccattccaaaatac

SEQ ID NO: 5979630 - DNA, 24 bp, Homo sapiens
caaataatccattccaaaatacaa

SEQ ID NO: 5979631 - DNA, 23 bp, Homo sapiens
caaataatgatcgaaaaaataat

SEQ ID NO: 5979632 - DNA, 19 bp, Homo sapiens
caaataatgcttttctaat

SEQ ID NO: 5979633 - DNA, 21 bp, Homo sapiens
caaataatggacttttttcta

SEQ ID NO: 5979634 - DNA, 12 bp, Homo sapiens
caaataatttaa

SEQ ID NO: 5979635 - DNA, 15 bp, Homo sapiens
caaataatttaagtt

SEQ ID NO: 5979636 - DNA, 20 bp, Homo sapiens
caaataatttttcacttcaa

SEQ ID NO: 5979637 - DNA, 22 bp, Homo sapiens
caaataattttttgcagtcttt

SEQ ID NO: 5979638 - DNA, 15 bp, Homo sapiens
caaatacaaaatgat

SEQ ID NO: 5979639 - DNA, 14 bp, Homo sapiens
caaatacaaagtaa

SEQ ID NO: 5979640 - DNA, 19 bp, Homo sapiens
caaatacaaagtaaataca

SEQ ID NO: 5979641 - DNA, 20 bp, Homo sapiens
caaatacaaagtggaaactt

SEQ ID NO: 5979642 - DNA, 16 bp, Homo sapiens
caaatacacatacata

SEQ ID NO: 5979643 - DNA, 20 bp, Homo sapiens
caaatacacatacatatata

SEQ ID NO: 5979644 - DNA, 21 bp, Homo sapiens
caaatacacatacatatatac

SEQ ID NO: 5979645 - DNA, 15 bp, Homo sapiens
caaatacacatttca

SEQ ID NO: 5979646 - DNA, 14 bp, Homo sapiens
caaataccagagca

SEQ ID NO: 5979647 - DNA, 15 bp, Homo sapiens
caaataccagagcac

SEQ ID NO: 5979648 - DNA, 12 bp, Homo sapiens
caaatacctcaa

SEQ ID NO: 5979649 - DNA, 20 bp, Homo sapiens
caaatacctcaatttttgtt

SEQ ID NO: 5979650 - DNA, 22 bp, Homo sapiens
caaatacctccattaaatggtc

SEQ ID NO: 5979651 - DNA, 21 bp, Homo sapiens
caaatacgtgggcattcaaat

SEQ ID NO: 5979652 - DNA, 16 bp, Homo sapiens
caaatactaaaaagaa

SEQ ID NO: 5979653 - DNA, 22 bp, Homo sapiens
cacagctactcagtggggctgg

SEQ ID NO: 5979654 - DNA, 20 bp, Homo sapiens
cacagctacttggtttgtgt

SEQ ID NO: 5979655 - DNA, 21 bp, Homo sapiens
cacagctagtgaagaccagag

SEQ ID NO: 5979656 - DNA, 13 bp, Homo sapiens
cacagctcagctg

SEQ ID NO: 5979657 - DNA, 14 bp, Homo sapiens
cacagctcagctgc

SEQ ID NO: 5979658 - DNA, 15 bp, Homo sapiens
cacagctcagctgcc

SEQ ID NO: 5979659 - DNA, 19 bp, Homo sapiens
cacagctcagctgcccatc

SEQ ID NO: 5979660 - DNA, 16 bp, Homo sapiens
cacagctcaggaacta

SEQ ID NO: 5979661 - DNA, 15 bp, Homo sapiens
cacagctcccacccc

SEQ ID NO: 5979662 - DNA, 19 bp, Homo sapiens
cacagctcccaccccaccc

SEQ ID NO: 5979663 - DNA, 14 bp, Homo sapiens
cacagctccctgcc

SEQ ID NO: 5979664 - DNA, 20 bp, Homo sapiens
cacagctccgagctgtagga

SEQ ID NO: 5979665 - DNA, 10 bp, Homo sapiens
cacagctcct

SEQ ID NO: 5979666 - DNA, 16 bp, Homo sapiens
cacagctcctcccctg

SEQ ID NO: 5979667 - DNA, 22 bp, Homo sapiens
cacagctcctcccctgccgcct

SEQ ID NO: 5979668 - DNA, 12 bp, Homo sapiens
cacagctcctcg

SEQ ID NO: 5979669 - DNA, 21 bp, Homo sapiens
cacagctccttttccagagca

SEQ ID NO: 5979670 - DNA, 14 bp, Homo sapiens
cacagctctcactg

SEQ ID NO: 5979671 - DNA, 17 bp, Homo sapiens
cacagctctcactggcc

SEQ ID NO: 5979672 - DNA, 19 bp, Homo sapiens
cacagctctcactggccag

SEQ ID NO: 5979673 - DNA, 21 bp, Homo sapiens
cacagctctccggtctctctc

SEQ ID NO: 5979674 - DNA, 12 bp, Homo sapiens
cacagctctgct

SEQ ID NO: 5979675 - DNA, 13 bp, Homo sapiens
cacagctctgggc

SEQ ID NO: 5979676 - DNA, 14 bp, Homo sapiens
cacagctctgggcc

SEQ ID NO: 5979677 - DNA, 18 bp, Homo sapiens
cacagctctgggcctctt

SEQ ID NO: 5979678 - DNA, 14 bp, Homo sapiens
cacagctctgtcct

SEQ ID NO: 5979679 - DNA, 16 bp, Homo sapiens
cacagctctgtcctgg

SEQ ID NO: 5979680 - DNA, 19 bp, Homo sapiens
cacagctctgtcctgggag

SEQ ID NO: 5979681 - DNA, 10 bp, Homo sapiens
cacagctctt

SEQ ID NO: 5979682 - DNA, 11 bp, Homo sapiens
cacagctcttc

SEQ ID NO: 5979683 - DNA, 16 bp, Homo sapiens
cacagctcttcacacc

SEQ ID NO: 5979684 - DNA, 20 bp, Homo sapiens
cacagctcttcattccattg

SEQ ID NO: 5979685 - DNA, 19 bp, Homo sapiens
cacagctcttccagggcag

SEQ ID NO: 5979686 - DNA, 15 bp, Homo sapiens
cacagctcttctcca

SEQ ID NO: 5979687 - DNA, 13 bp, Homo sapiens
cacagctcttctt

SEQ ID NO: 5979688 - DNA, 16 bp, Homo sapiens
cacagctcttgtttgg

SEQ ID NO: 5979689 - DNA, 22 bp, Homo sapiens
cacagctgcagccaaccccatc

SEQ ID NO: 5979690 - DNA, 22 bp, Homo sapiens
cacagctgcagcccatcctccc

SEQ ID NO: 5979691 - DNA, 15 bp, Homo sapiens
cacagctgcagctgg

SEQ ID NO: 5979692 - DNA, 16 bp, Homo sapiens
cacagctgcagctggg

SEQ ID NO: 5979693 - DNA, 17 bp, Homo sapiens
cacagctgcagctgggc

SEQ ID NO: 5979694 - DNA, 18 bp, Homo sapiens
cacagctgcagctgggcc

SEQ ID NO: 5979695 - DNA, 16 bp, Homo sapiens
cacagctgcaggccac

SEQ ID NO: 5979696 - DNA, 16 bp, Homo sapiens
cacagctgccctgctg

SEQ ID NO: 5979697 - DNA, 17 bp, Homo sapiens
cacagctgccctgctgc

SEQ ID NO: 5979698 - DNA, 20 bp, Homo sapiens
cacagctgccctgctgccac

SEQ ID NO: 5979699 - DNA, 12 bp, Homo sapiens
cacagctgcctc

SEQ ID NO: 5979700 - DNA, 13 bp, Homo sapiens
cacagctgcctcc

SEQ ID NO: 5979701 - DNA, 12 bp, Homo sapiens
cacagctgctca

SEQ ID NO: 5979702 - DNA, 20 bp, Homo sapiens
cacagctgctgaagaggcaa

SEQ ID NO: 5979703 - DNA, 15 bp, Homo sapiens
cacagctgctggaga

SEQ ID NO: 5979704 - DNA, 22 bp, Homo sapiens
cacagctgctggagaataaatt

SEQ ID NO: 5979705 - DNA, 20 bp, Homo sapiens
cacagctgctggagactcct

SEQ ID NO: 5979706 - DNA, 18 bp, Homo sapiens
cacagctgctggccaggg

SEQ ID NO: 5979707 - DNA, 16 bp, Homo sapiens
cacagctgctgttctc

SEQ ID NO: 5979708 - DNA, 13 bp, Homo sapiens
cacagctgcttgt

SEQ ID NO: 5979709 - DNA, 20 bp, Homo sapiens
cacagctgctttctgttgtc

SEQ ID NO: 5979710 - DNA, 15 bp, Homo sapiens
cacagctggccacca

SEQ ID NO: 5979711 - DNA, 14 bp, Homo sapiens
cacagctggcctcc

SEQ ID NO: 5979712 - DNA, 16 bp, Homo sapiens
cacagctggcctggtt

SEQ ID NO: 5979713 - DNA, 13 bp, Homo sapiens
cacagctggctct

SEQ ID NO: 5979714 - DNA, 15 bp, Homo sapiens
cacagctgggagcct

SEQ ID NO: 5979715 - DNA, 14 bp, Homo sapiens
cacagctgggcaaa

SEQ ID NO: 5979716 - DNA, 14 bp, Homo sapiens
cacagctgggctgt

SEQ ID NO: 5979717 - DNA, 16 bp, Homo sapiens
cacagctggggccggt

SEQ ID NO: 5979718 - DNA, 11 bp, Homo sapiens
cacagctgtct

SEQ ID NO: 5979719 - DNA, 12 bp, Homo sapiens
cacagctgtctg

SEQ ID NO: 5979720 - DNA, 17 bp, Homo sapiens
cacagctgtctgccagg

SEQ ID NO: 5979721 - DNA, 22 bp, Homo sapiens
cacagctgttcttctgttctgc

SEQ ID NO: 5979722 - DNA, 19 bp, Homo sapiens
cacagctgtttcctcacgt

SEQ ID NO: 5979723 - DNA, 21 bp, Homo sapiens
cacagctgtttgaaatgttta

SEQ ID NO: 5979724 - DNA, 17 bp, Homo sapiens
cacagcttagatttcat

SEQ ID NO: 5979725 - DNA, 19 bp, Homo sapiens
cacagcttagatttcatag

SEQ ID NO: 5979726 - DNA, 21 bp, Homo sapiens
cacagcttcatttcctgtgtc

SEQ ID NO: 5979727 - DNA, 14 bp, Homo sapiens
cacagcttcccctc

SEQ ID NO: 5979728 - DNA, 11 bp, Homo sapiens
cacagcttcct

SEQ ID NO: 5979729 - DNA, 12 bp, Homo sapiens
cacagcttcctg

SEQ ID NO: 5979730 - DNA, 15 bp, Homo sapiens
cacagcttcctgagg

SEQ ID NO: 5979731 - DNA, 21 bp, Homo sapiens
cacagcttcctgtccccatct

SEQ ID NO: 5979732 - DNA, 12 bp, Homo sapiens
cacagcttcttc

SEQ ID NO: 5979733 - DNA, 18 bp, Homo sapiens
cacagcttgacctgaggc

SEQ ID NO: 5979734 - DNA, 23 bp, Homo sapiens
cacagcttgtctcttgcctgcca

SEQ ID NO: 5979735 - DNA, 14 bp, Homo sapiens
cacagcttgttttg

SEQ ID NO: 5979736 - DNA, 16 bp, Homo sapiens
cacagcttgttttgga

SEQ ID NO: 5979737 - DNA, 19 bp, Homo sapiens
cacagctttcctgggtctg

SEQ ID NO: 5979738 - DNA, 21 bp, Homo sapiens
cacagcttttagtacccacct

SEQ ID NO: 5979739 - DNA, 14 bp, Homo sapiens
cacagcttttccaa

SEQ ID NO: 5979740 - DNA, 15 bp, Homo sapiens
cacagcttttccaaa

SEQ ID NO: 5979741 - DNA, 16 bp, Homo sapiens
cacaggaaaaataaac

SEQ ID NO: 5979742 - DNA, 17 bp, Homo sapiens
cacaggaaaaataaacg

SEQ ID NO: 5979743 - DNA, 18 bp, Homo sapiens
cacaggaaaaataaacgt

SEQ ID NO: 5979744 - DNA, 22 bp, Homo sapiens
cacaggaaaatgtatccagagg

SEQ ID NO: 5979745 - DNA, 12 bp, Homo sapiens
cacaggaaacaa

SEQ ID NO: 5979746 - DNA, 16 bp, Homo sapiens
cacaggaacggccctg

SEQ ID NO: 5979747 - DNA, 15 bp, Homo sapiens
cacaggaagaaagca

SEQ ID NO: 5979748 - DNA, 23 bp, Homo sapiens
cacaggaagaatgggctgcagaa

SEQ ID NO: 5979749 - DNA, 22 bp, Homo sapiens
cacaggaagccgcctagtgcag

SEQ ID NO: 5979750 - DNA, 16 bp, Homo sapiens
cacaggaagctcagcc

SEQ ID NO: 5979751 - DNA, 18 bp, Homo sapiens
cacaggaagctcagcctt

SEQ ID NO: 5979752 - DNA, 15 bp, Homo sapiens
cacaggaaggaaaca

SEQ ID NO: 5979753 - DNA, 19 bp, Homo sapiens
cacaggaagtttggagcct

SEQ ID NO: 5979754 - DNA, 17 bp, Homo sapiens
cacaggaattctcaaga

SEQ ID NO: 5979755 - DNA, 17 bp, Homo sapiens
cacaggacacagtcaga

SEQ ID NO: 5979756 - DNA, 23 bp, Homo sapiens
cacaggacacctggccgcctcca

SEQ ID NO: 5979757 - DNA, 19 bp, Homo sapiens
cacaggacacgaaggctgc

SEQ ID NO: 5979758 - DNA, 15 bp, Homo sapiens
cacaggacagcggga

SEQ ID NO: 5979759 - DNA, 19 bp, Homo sapiens
cacaggacaggggttcctt

SEQ ID NO: 5979760 - DNA, 22 bp, Homo sapiens
cacaggaccacctcctctgcca

SEQ ID NO: 5979761 - DNA, 22 bp, Homo sapiens
cacaggacccagaaaaaaagcc

SEQ ID NO: 5979762 - DNA, 15 bp, Homo sapiens
cacaggaccctcgcc

SEQ ID NO: 5979763 - DNA, 17 bp, Homo sapiens
cacaggacgaatgcata

SEQ ID NO: 5979764 - DNA, 21 bp, Homo sapiens
cacaggacgaatgcatattca

SEQ ID NO: 5979765 - DNA, 23 bp, Homo sapiens
cacaggacgatttcactgacact

SEQ ID NO: 5979766 - DNA, 16 bp, Homo sapiens
cacaggactctgcctc

SEQ ID NO: 5979767 - DNA, 18 bp, Homo sapiens
cacaggactgagccctct

SEQ ID NO: 5979768 - DNA, 21 bp, Homo sapiens
cacaggagacactgtgctata

SEQ ID NO: 5979769 - DNA, 15 bp, Homo sapiens
cacaggagagactgg

SEQ ID NO: 5979770 - DNA, 17 bp, Homo sapiens
cacaggagagcacccac

SEQ ID NO: 5979771 - DNA, 22 bp, Homo sapiens
cacaggagcaatcacaggaaaa

SEQ ID NO: 5979772 - DNA, 14 bp, Homo sapiens
cacaggagcagaca

SEQ ID NO: 5979773 - DNA, 15 bp, Homo sapiens
cacaggagcatttgg

SEQ ID NO: 5979774 - DNA, 17 bp, Homo sapiens
cacaggagccgcagagg

SEQ ID NO: 5979775 - DNA, 19 bp, Homo sapiens
cacaggagccgcagaggcc

SEQ ID NO: 5979776 - DNA, 16 bp, Homo sapiens
cacaggagcgtgtcct

SEQ ID NO: 5979777 - DNA, 14 bp, Homo sapiens
cacaggagctacct

SEQ ID NO: 5979778 - DNA, 18 bp, Homo sapiens
cacaggagctacctgtgt

SEQ ID NO: 5979779 - DNA, 20 bp, Homo sapiens
cacaggagctacctgtgtgg

SEQ ID NO: 5979780 - DNA, 21 bp, Homo sapiens
cacaggagctccctttttgaa

SEQ ID NO: 5979781 - DNA, 17 bp, Homo sapiens
cacaggagctgccatgt

SEQ ID NO: 5979782 - DNA, 15 bp, Homo sapiens
cacaggaggcaagca

SEQ ID NO: 5979783 - DNA, 15 bp, Homo sapiens
cacaggaggccagtg

SEQ ID NO: 5979784 - DNA, 17 bp, Homo sapiens
cacaggaggccagtggg

SEQ ID NO: 5979785 - DNA, 18 bp, Homo sapiens
cacaggaggccagtgggc

SEQ ID NO: 5979786 - DNA, 20 bp, Homo sapiens
cacaggagggagagaactta

SEQ ID NO: 5979787 - DNA, 19 bp, Homo sapiens
cacaggagggagggggaag

SEQ ID NO: 5979788 - DNA, 14 bp, Homo sapiens
cacaggagggccag

SEQ ID NO: 5979789 - DNA, 17 bp, Homo sapiens
cacaggagggtaatttt

SEQ ID NO: 5979790 - DNA, 20 bp, Homo sapiens
cacaggagtcttcagaccca

SEQ ID NO: 5979791 - DNA, 20 bp, Homo sapiens
cacaggagttgtgagccctc

SEQ ID NO: 5979792 - DNA, 15 bp, Homo sapiens
cacaggataaagtta

SEQ ID NO: 5979793 - DNA, 22 bp, Homo sapiens
cacaggatattaaacgtgtaaa

SEQ ID NO: 5979794 - DNA, 12 bp, Homo sapiens
cacaggatcagt

SEQ ID NO: 5979795 - DNA, 13 bp, Homo sapiens
cacaggatcctgg

SEQ ID NO: 5979796 - DNA, 17 bp, Homo sapiens
cacaggatcctggcctg

SEQ ID NO: 5979797 - DNA, 18 bp, Homo sapiens
cacaggatcctggcctga

SEQ ID NO: 5979798 - DNA, 22 bp, Homo sapiens
cacaggatgaactagccatgac

SEQ ID NO: 5979799 - DNA, 16 bp, Homo sapiens
cacaggatgaaggcaa

SEQ ID NO: 5979800 - DNA, 13 bp, Homo sapiens
cacaggatgccag

SEQ ID NO: 5979801 - DNA, 17 bp, Homo sapiens
cacaggatgccagcccc

SEQ ID NO: 5979802 - DNA, 19 bp, Homo sapiens
cacaggatgccagcccctg

SEQ ID NO: 5979803 - DNA, 20 bp, Homo sapiens
cacaggatgccagcccctgc

SEQ ID NO: 5979804 - DNA, 21 bp, Homo sapiens
cacaggatgccagcccctgcc

SEQ ID NO: 5979805 - DNA, 22 bp, Homo sapiens
cacaggatgccagcccctgcct

SEQ ID NO: 5979806 - DNA, 20 bp, Homo sapiens
cacaggatggtctctgccat

SEQ ID NO: 5979807 - DNA, 16 bp, Homo sapiens
cacaggcaaaatcctt

SEQ ID NO: 5979808 - DNA, 12 bp, Homo sapiens
cacaggcaaaga

SEQ ID NO: 5979809 - DNA, 14 bp, Homo sapiens
cacaggcaacatta

SEQ ID NO: 5979810 - DNA, 13 bp, Homo sapiens
cacaggcaactga

SEQ ID NO: 5979811 - DNA, 14 bp, Homo sapiens
cacaggcaactgag

SEQ ID NO: 5979812 - DNA, 18 bp, Homo sapiens
cacaggcaactgaggcag

SEQ ID NO: 5979813 - DNA, 20 bp, Homo sapiens
cacaggcaactgaggcagac

SEQ ID NO: 5979814 - DNA, 22 bp, Homo sapiens
cacaggcaatgactgcgcagag

SEQ ID NO: 5979815 - DNA, 20 bp, Homo sapiens
cacaggcacacaggtctcat

SEQ ID NO: 5979816 - DNA, 17 bp, Homo sapiens
cacaggcacattaactg

SEQ ID NO: 5979817 - DNA, 20 bp, Homo sapiens
cacaggcacattaactgttg

SEQ ID NO: 5979818 - DNA, 17 bp, Homo sapiens
cacaggcacgggtccct

SEQ ID NO: 5979819 - DNA, 21 bp, Homo sapiens
cacaggcactgaacaggctgg

SEQ ID NO: 5979820 - DNA, 22 bp, Homo sapiens
cacaggcactgaacaggctggg

SEQ ID NO: 5979821 - DNA, 10 bp, Homo sapiens
cacaggcagc

SEQ ID NO: 5979822 - DNA, 23 bp, Homo sapiens
cacaggcagcaaggtcatggtct

SEQ ID NO: 5979823 - DNA, 11 bp, Homo sapiens
cacaggcagcc

SEQ ID NO: 5979824 - DNA, 17 bp, Homo sapiens
cacaggcagccagccgt

SEQ ID NO: 5979825 - DNA, 19 bp, Homo sapiens
cacaggcagccagccgtgg

SEQ ID NO: 5979826 - DNA, 15 bp, Homo sapiens
cacaggcagccagtg

SEQ ID NO: 5979827 - DNA, 14 bp, Homo sapiens
cacaggcagctctg

SEQ ID NO: 5979828 - DNA, 18 bp, Homo sapiens
cacaggcagctctgagcc

SEQ ID NO: 5979829 - DNA, 15 bp, Homo sapiens
cacaggcagctttct

SEQ ID NO: 5979830 - DNA, 20 bp, Homo sapiens
cacaggcaggaagagagaga

SEQ ID NO: 5979831 - DNA, 12 bp, Homo sapiens
cacaggcagggc

SEQ ID NO: 5979832 - DNA, 13 bp, Homo sapiens
cacaggcagggca

SEQ ID NO: 5979833 - DNA, 18 bp, Homo sapiens
cacaggcagggcaggacc

SEQ ID NO: 5979834 - DNA, 21 bp, Homo sapiens
caaatactaaaaagaagtgct

SEQ ID NO: 5979835 - DNA, 16 bp, Homo sapiens
caaatactaatgaaaa

SEQ ID NO: 5979836 - DNA, 15 bp, Homo sapiens
caaatactcatgtgt

SEQ ID NO: 5979837 - DNA, 23 bp, Homo sapiens
caaatactcattttaggaaaaaa

SEQ ID NO: 5979838 - DNA, 14 bp, Homo sapiens
caaatactccaagc

SEQ ID NO: 5979839 - DNA, 19 bp, Homo sapiens
caaatactccaagcttcaa

SEQ ID NO: 5979840 - DNA, 14 bp, Homo sapiens
caaatactcttagg

SEQ ID NO: 5979841 - DNA, 18 bp, Homo sapiens
caaatactgaaatattag

SEQ ID NO: 5979842 - DNA, 12 bp, Homo sapiens
caaatactgatt

SEQ ID NO: 5979843 - DNA, 24 bp, Homo sapiens
caaatactgcttagcattttgcat

SEQ ID NO: 5979844 - DNA, 18 bp, Homo sapiens
caaatacttcaaatcata

SEQ ID NO: 5979845 - DNA, 19 bp, Homo sapiens
caaatactttaaaggaaaa

SEQ ID NO: 5979846 - DNA, 13 bp, Homo sapiens
caaatagaaaaca

SEQ ID NO: 5979847 - DNA, 17 bp, Homo sapiens
caaatagaaaacaggaa

SEQ ID NO: 5979848 - DNA, 16 bp, Homo sapiens
caaatagaaaatggtc

SEQ ID NO: 5979849 - DNA, 13 bp, Homo sapiens
caaatagaacaag

SEQ ID NO: 5979850 - DNA, 22 bp, Homo sapiens
caaatagaagcttcttgctcct

SEQ ID NO: 5979851 - DNA, 23 bp, Homo sapiens
caaatagaagcttcttgctcctg

SEQ ID NO: 5979852 - DNA, 21 bp, Homo sapiens
caaatagagtttttatatttg

SEQ ID NO: 5979853 - DNA, 19 bp, Homo sapiens
caaatagattcagagaaat

SEQ ID NO: 5979854 - DNA, 14 bp, Homo sapiens
caaatagatttttg

SEQ ID NO: 5979855 - DNA, 16 bp, Homo sapiens
caaatagatttttgat

SEQ ID NO: 5979856 - DNA, 19 bp, Homo sapiens
caaatagatttttgattca

SEQ ID NO: 5979857 - DNA, 19 bp, Homo sapiens
caaatagatttttgttttt

SEQ ID NO: 5979858 - DNA, 13 bp, Homo sapiens
caaatagcaaatg

SEQ ID NO: 5979859 - DNA, 17 bp, Homo sapiens
caaatagccagtgctag

SEQ ID NO: 5979860 - DNA, 14 bp, Homo sapiens
caaatagccccaga

SEQ ID NO: 5979861 - DNA, 20 bp, Homo sapiens
caaatagcctctcctttgta

SEQ ID NO: 5979862 - DNA, 22 bp, Homo sapiens
caaatagcttttcacttcttaa

SEQ ID NO: 5979863 - DNA, 15 bp, Homo sapiens
caaataggaggaaaa

SEQ ID NO: 5979864 - DNA, 23 bp, Homo sapiens
caaataggatgtactgttgaaaa

SEQ ID NO: 5979865 - DNA, 19 bp, Homo sapiens
caaataggattaaacacac

SEQ ID NO: 5979866 - DNA, 17 bp, Homo sapiens
caaataggctattaaaa

SEQ ID NO: 5979867 - DNA, 23 bp, Homo sapiens
caaataggctattaaaaaagtct

SEQ ID NO: 5979868 - DNA, 16 bp, Homo sapiens
caaatagggcaaagaa

SEQ ID NO: 5979869 - DNA, 11 bp, Homo sapiens
caaataggtag

SEQ ID NO: 5979870 - DNA, 13 bp, Homo sapiens
caaataggtagag

SEQ ID NO: 5979871 - DNA, 22 bp, Homo sapiens
caaatagtagagtatcagttgc

SEQ ID NO: 5979872 - DNA, 23 bp, Homo sapiens
caaatagtaggctaaaaacattt

SEQ ID NO: 5979873 - DNA, 12 bp, Homo sapiens
caaatagtgtga

SEQ ID NO: 5979874 - DNA, 19 bp, Homo sapiens
caaatagtgttgatcagat

SEQ ID NO: 5979875 - DNA, 13 bp, Homo sapiens
caaatagttgcat

SEQ ID NO: 5979876 - DNA, 19 bp, Homo sapiens
caaatagttgcatagcagt

SEQ ID NO: 5979877 - DNA, 14 bp, Homo sapiens
caaatataaacttg

SEQ ID NO: 5979878 - DNA, 16 bp, Homo sapiens
caaatataaatcttaa

SEQ ID NO: 5979879 - DNA, 17 bp, Homo sapiens
caaatatacattttcta

SEQ ID NO: 5979880 - DNA, 19 bp, Homo sapiens
caaatatacattttctaaa

SEQ ID NO: 5979881 - DNA, 13 bp, Homo sapiens
caaatatactcat

SEQ ID NO: 5979882 - DNA, 17 bp, Homo sapiens
caaatatactcatttgg

SEQ ID NO: 5979883 - DNA, 12 bp, Homo sapiens
caaatatagaaa

SEQ ID NO: 5979884 - DNA, 14 bp, Homo sapiens
caaatatagaaagt

SEQ ID NO: 5979885 - DNA, 14 bp, Homo sapiens
caaatatagttgaa

SEQ ID NO: 5979886 - DNA, 19 bp, Homo sapiens
caaatatatgtatatatat

SEQ ID NO: 5979887 - DNA, 17 bp, Homo sapiens
caaatatattctctttg

SEQ ID NO: 5979888 - DNA, 14 bp, Homo sapiens
caaatatattgtta

SEQ ID NO: 5979889 - DNA, 15 bp, Homo sapiens
caaatatattgttaa

SEQ ID NO: 5979890 - DNA, 18 bp, Homo sapiens
caaatatatttaggccag

SEQ ID NO: 5979891 - DNA, 15 bp, Homo sapiens
caaatatcaaataaa

SEQ ID NO: 5979892 - DNA, 20 bp, Homo sapiens
caaatatcctccactttcag

SEQ ID NO: 5979893 - DNA, 17 bp, Homo sapiens
caaatatcttgtgttgt

SEQ ID NO: 5979894 - DNA, 22 bp, Homo sapiens
caaatatcttgtgttgtccttt

SEQ ID NO: 5979895 - DNA, 16 bp, Homo sapiens
caaatatgaaaaatgt

SEQ ID NO: 5979896 - DNA, 22 bp, Homo sapiens
caaatatgaaaaatgtaaatac

SEQ ID NO: 5979897 - DNA, 17 bp, Homo sapiens
caaatatgattctcctc

SEQ ID NO: 5979898 - DNA, 22 bp, Homo sapiens
caaatatgattctcctctccca

SEQ ID NO: 5979899 - DNA, 13 bp, Homo sapiens
caaatatgcaaag

SEQ ID NO: 5979900 - DNA, 16 bp, Homo sapiens
caaatatgcaaagcac

SEQ ID NO: 5979901 - DNA, 13 bp, Homo sapiens
caaatatgcactt

SEQ ID NO: 5979902 - DNA, 14 bp, Homo sapiens
caaatatgcacttt

SEQ ID NO: 5979903 - DNA, 15 bp, Homo sapiens
caaatatgcactttc

SEQ ID NO: 5979904 - DNA, 20 bp, Homo sapiens
caaatatgcactttccctag

SEQ ID NO: 5979905 - DNA, 17 bp, Homo sapiens
caaatatgctaatttgg

SEQ ID NO: 5979906 - DNA, 22 bp, Homo sapiens
caaatatgctgttatgtccaga

SEQ ID NO: 5979907 - DNA, 15 bp, Homo sapiens
caaatatgtaaactt

SEQ ID NO: 5979908 - DNA, 20 bp, Homo sapiens
caaatatgtagaatgtaata

SEQ ID NO: 5979909 - DNA, 13 bp, Homo sapiens
caaatatgtcctg

SEQ ID NO: 5979910 - DNA, 14 bp, Homo sapiens
caaatatgtcctgg

SEQ ID NO: 5979911 - DNA, 15 bp, Homo sapiens
caaatatgtcctggg

SEQ ID NO: 5979912 - DNA, 17 bp, Homo sapiens
caaatatgtcctggggt

SEQ ID NO: 5979913 - DNA, 21 bp, Homo sapiens
caaatatgttaaagtttaagt

SEQ ID NO: 5979914 - DNA, 14 bp, Homo sapiens
caaatattaaaatt

SEQ ID NO: 5979915 - DNA, 22 bp, Homo sapiens
caaatattaaagattctcttta

SEQ ID NO: 5979916 - DNA, 14 bp, Homo sapiens
caaatattacaaca

SEQ ID NO: 5979917 - DNA, 16 bp, Homo sapiens
caaatattagatgtga

SEQ ID NO: 5979918 - DNA, 17 bp, Homo sapiens
caaatattagatgtgat

SEQ ID NO: 5979919 - DNA, 19 bp, Homo sapiens
caaatattagatgtgattt

SEQ ID NO: 5979920 - DNA, 23 bp, Homo sapiens
caaatattagatgtgatttaata

SEQ ID NO: 5979921 - DNA, 19 bp, Homo sapiens
caaatattagcaaagaagc

SEQ ID NO: 5979922 - DNA, 15 bp, Homo sapiens
caaatattagccaaa

SEQ ID NO: 5979923 - DNA, 21 bp, Homo sapiens
caaatattattcaagtgcctc

SEQ ID NO: 5979924 - DNA, 12 bp, Homo sapiens
caaatattattt

SEQ ID NO: 5979925 - DNA, 15 bp, Homo sapiens
caaatattcagaata

SEQ ID NO: 5979926 - DNA, 16 bp, Homo sapiens
caaatattcattttga

SEQ ID NO: 5979927 - DNA, 20 bp, Homo sapiens
caaatattctaaaaaagata

SEQ ID NO: 5979928 - DNA, 17 bp, Homo sapiens
caaatattgatctgtat

SEQ ID NO: 5979929 - DNA, 17 bp, Homo sapiens
caaatattgcttggact

SEQ ID NO: 5979930 - DNA, 21 bp, Homo sapiens
caaatattgttaccatgaaga

SEQ ID NO: 5979931 - DNA, 19 bp, Homo sapiens
caaatattgttcttcccat

SEQ ID NO: 5979932 - DNA, 22 bp, Homo sapiens
caaatattgttgacaactgtga

SEQ ID NO: 5979933 - DNA, 21 bp, Homo sapiens
caaatatttagatgtaatttt

SEQ ID NO: 5979934 - DNA, 21 bp, Homo sapiens
caaatatttatgacctcaaca

SEQ ID NO: 5979935 - DNA, 17 bp, Homo sapiens
caaatatttgatcactt

SEQ ID NO: 5979936 - DNA, 23 bp, Homo sapiens
caaatattttagaagctaatgta

SEQ ID NO: 5979937 - DNA, 21 bp, Homo sapiens
caaatattttgtcactgctgt

SEQ ID NO: 5979938 - DNA, 13 bp, Homo sapiens
caaatcaaaataa

SEQ ID NO: 5979939 - DNA, 14 bp, Homo sapiens
caaatcaaaataaa

SEQ ID NO: 5979940 - DNA, 19 bp, Homo sapiens
caaatcaaacacaacacaa

SEQ ID NO: 5979941 - DNA, 15 bp, Homo sapiens
caaatcaaagcagat

SEQ ID NO: 5979942 - DNA, 14 bp, Homo sapiens
caaatcaacagaag

SEQ ID NO: 5979943 - DNA, 19 bp, Homo sapiens
caaatcaacagaagcattt

SEQ ID NO: 5979944 - DNA, 19 bp, Homo sapiens
caaatcaaccccagactca

SEQ ID NO: 5979945 - DNA, 22 bp, Homo sapiens
caaatcaaccccagactcaaac

SEQ ID NO: 5979946 - DNA, 19 bp, Homo sapiens
caaatcaagagcattgctt

SEQ ID NO: 5979947 - DNA, 15 bp, Homo sapiens
caaatcaagcttcag

SEQ ID NO: 5979948 - DNA, 14 bp, Homo sapiens
caaatcaaggatct

SEQ ID NO: 5979949 - DNA, 21 bp, Homo sapiens
caaatcaagtttccaagcaaa

SEQ ID NO: 5979950 - DNA, 23 bp, Homo sapiens
caaatcaagtttccaagcaaatg

SEQ ID NO: 5979951 - DNA, 14 bp, Homo sapiens
caaatcaatacact

SEQ ID NO: 5979952 - DNA, 21 bp, Homo sapiens
caaatcacaaggatttctcta

SEQ ID NO: 5979953 - DNA, 15 bp, Homo sapiens
caaatcacacctctg

SEQ ID NO: 5979954 - DNA, 16 bp, Homo sapiens
caaatcacacctctgg

SEQ ID NO: 5979955 - DNA, 18 bp, Homo sapiens
caaatcacacctctgggc

SEQ ID NO: 5979956 - DNA, 15 bp, Homo sapiens
caaatcacatatttt

SEQ ID NO: 5979957 - DNA, 19 bp, Homo sapiens
caaatcacatattttaaaa

SEQ ID NO: 5979958 - DNA, 17 bp, Homo sapiens
caaatcactctgcaatg

SEQ ID NO: 5979959 - DNA, 15 bp, Homo sapiens
caaatcactgaactt

SEQ ID NO: 5979960 - DNA, 13 bp, Homo sapiens
caaatcagaaaac

SEQ ID NO: 5979961 - DNA, 16 bp, Homo sapiens
caaatcaggggccaga

SEQ ID NO: 5979962 - DNA, 13 bp, Homo sapiens
caaatcaggtaaa

SEQ ID NO: 5979963 - DNA, 19 bp, Homo sapiens
caaatcagtatattttctg

SEQ ID NO: 5979964 - DNA, 21 bp, Homo sapiens
caaatcagtatattttctgta

SEQ ID NO: 5979965 - DNA, 23 bp, Homo sapiens
caaatcagtcagtgcaaatgtca

SEQ ID NO: 5979966 - DNA, 13 bp, Homo sapiens
caaatcagtctca

SEQ ID NO: 5979967 - DNA, 18 bp, Homo sapiens
caaatcagtcttccttgt

SEQ ID NO: 5979968 - DNA, 15 bp, Homo sapiens
caaatcagtgatcta

SEQ ID NO: 5979969 - DNA, 22 bp, Homo sapiens
caaatcagtgatctatgtttgt

SEQ ID NO: 5979970 - DNA, 16 bp, Homo sapiens
caaatcagttagtttt

SEQ ID NO: 5979971 - DNA, 15 bp, Homo sapiens
caaatcataatgtat

SEQ ID NO: 5979972 - DNA, 14 bp, Homo sapiens
caaatcatcctgaa

SEQ ID NO: 5979973 - DNA, 22 bp, Homo sapiens
caaatcatgttttttctgcaat

SEQ ID NO: 5979974 - DNA, 18 bp, Homo sapiens
caaatcatttgtttaaaa

SEQ ID NO: 5979975 - DNA, 14 bp, Homo sapiens
caaatcattttgat

SEQ ID NO: 5979976 - DNA, 20 bp, Homo sapiens
caaatcattttgatgtatta

SEQ ID NO: 5979977 - DNA, 22 bp, Homo sapiens
caaatcattttgatgtattatt

SEQ ID NO: 5979978 - DNA, 15 bp, Homo sapiens
caaatccacaagcca

SEQ ID NO: 5979979 - DNA, 17 bp, Homo sapiens
caaatccactgacagat

SEQ ID NO: 5979980 - DNA, 14 bp, Homo sapiens
caaatccaggaccc

SEQ ID NO: 5979981 - DNA, 17 bp, Homo sapiens
caaatccaggaccctgc

SEQ ID NO: 5979982 - DNA, 20 bp, Homo sapiens
caaatccaggaccctgccag

SEQ ID NO: 5979983 - DNA, 21 bp, Homo sapiens
caaatccaggaccctgccagg

SEQ ID NO: 5979984 - DNA, 17 bp, Homo sapiens
caaatccaggactttgt

SEQ ID NO: 5979985 - DNA, 10 bp, Homo sapiens
caaatccagt

SEQ ID NO: 5979986 - DNA, 15 bp, Homo sapiens
caaatccagtgtgca

SEQ ID NO: 5979987 - DNA, 22 bp, Homo sapiens
caaatccatagcacaagataaa

SEQ ID NO: 5979988 - DNA, 16 bp, Homo sapiens
caaatccatccagaat

SEQ ID NO: 5979989 - DNA, 16 bp, Homo sapiens
caaatccatgtgtccc

SEQ ID NO: 5979990 - DNA, 19 bp, Homo sapiens
caaatcccttttatctatt

SEQ ID NO: 5979991 - DNA, 18 bp, Homo sapiens
caaatccgctctcttcct

SEQ ID NO: 5979992 - DNA, 21 bp, Homo sapiens
caaatcctatgtgattttaac

SEQ ID NO: 5979993 - DNA, 13 bp, Homo sapiens
caaatcctctcca

SEQ ID NO: 5979994 - DNA, 21 bp, Homo sapiens
caaatcctctgttttctctct

SEQ ID NO: 5979995 - DNA, 12 bp, Homo sapiens
caaatcctcttt

SEQ ID NO: 5979996 - DNA, 19 bp, Homo sapiens
caaatcctggaaggacaca

SEQ ID NO: 5979997 - DNA, 23 bp, Homo sapiens
caaatcctggaaggacacagtga

SEQ ID NO: 5979998 - DNA, 22 bp, Homo sapiens
caaatcctgggcatccccagcc

SEQ ID NO: 5979999 - DNA, 21 bp, Homo sapiens
caaatccttagatctggcatg

SEQ ID NO: 5980000 - DNA, 17 bp, Homo sapiens
caaatccttattgttca

SEQ ID NO: 5980001 - DNA, 18 bp, Homo sapiens
caaatccttccaaaaatt

SEQ ID NO: 5980002 - DNA, 14 bp, Homo sapiens
caaatccttggagt

SEQ ID NO: 5980003 - DNA, 19 bp, Homo sapiens
caaatcgatggcctggcct

SEQ ID NO: 5980004 - DNA, 20 bp, Homo sapiens
caaatcgatggcctggcctt

SEQ ID NO: 5980005 - DNA, 16 bp, Homo sapiens
caaatcgatttagtaa

SEQ ID NO: 5980006 - DNA, 16 bp, Homo sapiens
caaatcgtttatttca

SEQ ID NO: 5980007 - DNA, 18 bp, Homo sapiens
caaatctaatctcttatt

SEQ ID NO: 5980008 - DNA, 18 bp, Homo sapiens
caaatctaccactgtatg

SEQ ID NO: 5980009 - DNA, 17 bp, Homo sapiens
caaatctactgagccac

SEQ ID NO: 5980010 - DNA, 18 bp, Homo sapiens
caaatctactgagccacg

SEQ ID NO: 5980011 - DNA, 20 bp, Homo sapiens
caaatctactgagccacgga

SEQ ID NO: 5980012 - DNA, 17 bp, Homo sapiens
caaatctagaatttagt

SEQ ID NO: 5980013 - DNA, 19 bp, Homo sapiens
cacaggcagggcaggacca

SEQ ID NO: 5980014 - DNA, 22 bp, Homo sapiens
cacaggcagggcaggaccagcc

SEQ ID NO: 5980015 - DNA, 20 bp, Homo sapiens
cacaggcagggcctggctcc

SEQ ID NO: 5980016 - DNA, 12 bp, Homo sapiens
cacaggcaggta

SEQ ID NO: 5980017 - DNA, 16 bp, Homo sapiens
cacaggcaggtactgt

SEQ ID NO: 5980018 - DNA, 15 bp, Homo sapiens
cacaggcaggtccag

SEQ ID NO: 5980019 - DNA, 19 bp, Homo sapiens
cacaggcaggtccagggtt

SEQ ID NO: 5980020 - DNA, 20 bp, Homo sapiens
cacaggcagtccaggcctct

SEQ ID NO: 5980021 - DNA, 22 bp, Homo sapiens
cacaggcagtccaggcctctct

SEQ ID NO: 5980022 - DNA, 13 bp, Homo sapiens
cacaggcagtgca

SEQ ID NO: 5980023 - DNA, 23 bp, Homo sapiens
cacaggcagtgcatgtgaagcat

SEQ ID NO: 5980024 - DNA, 20 bp, Homo sapiens
cacaggcagttacttctgag

SEQ ID NO: 5980025 - DNA, 17 bp, Homo sapiens
cacaggcatagagtgac

SEQ ID NO: 5980026 - DNA, 17 bp, Homo sapiens
cacaggcatttcctggg

SEQ ID NO: 5980027 - DNA, 19 bp, Homo sapiens
cacaggcatttcctgggtg

SEQ ID NO: 5980028 - DNA, 20 bp, Homo sapiens
cacaggcatttcctgggtgg

SEQ ID NO: 5980029 - DNA, 18 bp, Homo sapiens
cacaggccaaatccttgg

SEQ ID NO: 5980030 - DNA, 18 bp, Homo sapiens
cacaggccaccctgtgca

SEQ ID NO: 5980031 - DNA, 12 bp, Homo sapiens
cacaggccactg

SEQ ID NO: 5980032 - DNA, 18 bp, Homo sapiens
cacaggccacttgctcag

SEQ ID NO: 5980033 - DNA, 13 bp, Homo sapiens
cacaggccagatg

SEQ ID NO: 5980034 - DNA, 14 bp, Homo sapiens
cacaggccagcccc

SEQ ID NO: 5980035 - DNA, 14 bp, Homo sapiens
cacaggccagcctt

SEQ ID NO: 5980036 - DNA, 20 bp, Homo sapiens
cacaggccaggggatctggg

SEQ ID NO: 5980037 - DNA, 18 bp, Homo sapiens
cacaggccattatgcctg

SEQ ID NO: 5980038 - DNA, 21 bp, Homo sapiens
cacaggcccccttgagtgggg

SEQ ID NO: 5980039 - DNA, 23 bp, Homo sapiens
cacaggcccgccctctgcctcct

SEQ ID NO: 5980040 - DNA, 16 bp, Homo sapiens
cacaggcccggctcca

SEQ ID NO: 5980041 - DNA, 13 bp, Homo sapiens
cacaggccctccc

SEQ ID NO: 5980042 - DNA, 16 bp, Homo sapiens
cacaggcccttcctct

SEQ ID NO: 5980043 - DNA, 18 bp, Homo sapiens
cacaggcccttcctctcc

SEQ ID NO: 5980044 - DNA, 21 bp, Homo sapiens
cacaggcccttcctctccact

SEQ ID NO: 5980045 - DNA, 18 bp, Homo sapiens
cacaggccctttcctcag

SEQ ID NO: 5980046 - DNA, 20 bp, Homo sapiens
cacaggccctttcctcaggc

SEQ ID NO: 5980047 - DNA, 12 bp, Homo sapiens
cacaggcctccc

SEQ ID NO: 5980048 - DNA, 13 bp, Homo sapiens
cacaggcctccct

SEQ ID NO: 5980049 - DNA, 16 bp, Homo sapiens
cacaggcctctgcctg

SEQ ID NO: 5980050 - DNA, 18 bp, Homo sapiens
cacaggcctctgcctgct

SEQ ID NO: 5980051 - DNA, 23 bp, Homo sapiens
cacaggcctgagatttcatctgc

SEQ ID NO: 5980052 - DNA, 20 bp, Homo sapiens
cacaggcctggcccagccag

SEQ ID NO: 5980053 - DNA, 22 bp, Homo sapiens
cacaggcctggcccagccagca

SEQ ID NO: 5980054 - DNA, 14 bp, Homo sapiens
cacaggcctggcct

SEQ ID NO: 5980055 - DNA, 15 bp, Homo sapiens
cacaggcctggcctc

SEQ ID NO: 5980056 - DNA, 21 bp, Homo sapiens
cacaggcctgtgtagctgtga

SEQ ID NO: 5980057 - DNA, 23 bp, Homo sapiens
cacaggcctgtgtagctgtgacc

SEQ ID NO: 5980058 - DNA, 20 bp, Homo sapiens
cacaggccttctgtggggct

SEQ ID NO: 5980059 - DNA, 13 bp, Homo sapiens
cacaggctcagca

SEQ ID NO: 5980060 - DNA, 19 bp, Homo sapiens
cacaggctcaggcaggggc

SEQ ID NO: 5980061 - DNA, 21 bp, Homo sapiens
cacaggctgaaatatccaccc

SEQ ID NO: 5980062 - DNA, 17 bp, Homo sapiens
cacaggctgagaactcg

SEQ ID NO: 5980063 - DNA, 17 bp, Homo sapiens
cacaggctgagtgcagg

SEQ ID NO: 5980064 - DNA, 21 bp, Homo sapiens
cacaggctgagtgcaggccca

SEQ ID NO: 5980065 - DNA, 20 bp, Homo sapiens
cacaggctgccccacccctc

SEQ ID NO: 5980066 - DNA, 14 bp, Homo sapiens
cacaggctgccgct

SEQ ID NO: 5980067 - DNA, 13 bp, Homo sapiens
cacaggctgggct

SEQ ID NO: 5980068 - DNA, 14 bp, Homo sapiens
cacaggctggtgtg

SEQ ID NO: 5980069 - DNA, 14 bp, Homo sapiens
cacaggctgtgcct

SEQ ID NO: 5980070 - DNA, 21 bp, Homo sapiens
cacaggcttacgctgctctcc

SEQ ID NO: 5980071 - DNA, 22 bp, Homo sapiens
cacaggcttatttttaaaataa

SEQ ID NO: 5980072 - DNA, 18 bp, Homo sapiens
cacaggcttctgagcagc

SEQ ID NO: 5980073 - DNA, 23 bp, Homo sapiens
cacagggaaagcatttaggagaa

SEQ ID NO: 5980074 - DNA, 16 bp, Homo sapiens
cacagggaaatgtgta

SEQ ID NO: 5980075 - DNA, 16 bp, Homo sapiens
cacagggaagggcttg

SEQ ID NO: 5980076 - DNA, 17 bp, Homo sapiens
cacagggaatggccaca

SEQ ID NO: 5980077 - DNA, 20 bp, Homo sapiens
cacagggaatggccacaaac

SEQ ID NO: 5980078 - DNA, 23 bp, Homo sapiens
cacagggaatggccacaaacctg

SEQ ID NO: 5980079 - DNA, 11 bp, Homo sapiens
cacagggacca

SEQ ID NO: 5980080 - DNA, 23 bp, Homo sapiens
cacagggaccagggccaccgcag

SEQ ID NO: 5980081 - DNA, 17 bp, Homo sapiens
cacagggacgacccggg

SEQ ID NO: 5980082 - DNA, 15 bp, Homo sapiens
cacagggagctccgt

SEQ ID NO: 5980083 - DNA, 21 bp, Homo sapiens
cacagggaggggatgatgact

SEQ ID NO: 5980084 - DNA, 20 bp, Homo sapiens
cacagggattctcacaatag

SEQ ID NO: 5980085 - DNA, 23 bp, Homo sapiens
cacagggcaaaatcgccataggc

SEQ ID NO: 5980086 - DNA, 17 bp, Homo sapiens
cacagggcaaggacaca

SEQ ID NO: 5980087 - DNA, 15 bp, Homo sapiens
cacagggcaccagag

SEQ ID NO: 5980088 - DNA, 16 bp, Homo sapiens
cacagggcaccagagg

SEQ ID NO: 5980089 - DNA, 17 bp, Homo sapiens
cacagggcagagccggg

SEQ ID NO: 5980090 - DNA, 19 bp, Homo sapiens
cacagggcagctgggccca

SEQ ID NO: 5980091 - DNA, 13 bp, Homo sapiens
cacagggcagggg

SEQ ID NO: 5980092 - DNA, 20 bp, Homo sapiens
cacagggcatgccccggcca

SEQ ID NO: 5980093 - DNA, 18 bp, Homo sapiens
cacagggcatgcctggcc

SEQ ID NO: 5980094 - DNA, 19 bp, Homo sapiens
cacagggccccagaaggca

SEQ ID NO: 5980095 - DNA, 22 bp, Homo sapiens
cacagggcccggccacacccag

SEQ ID NO: 5980096 - DNA, 14 bp, Homo sapiens
cacagggcctgact

SEQ ID NO: 5980097 - DNA, 14 bp, Homo sapiens
cacagggcctggcc

SEQ ID NO: 5980098 - DNA, 23 bp, Homo sapiens
cacagggcggtaccttgtgccca

SEQ ID NO: 5980099 - DNA, 13 bp, Homo sapiens
cacagggctaaga

SEQ ID NO: 5980100 - DNA, 16 bp, Homo sapiens
cacagggctcacaggg

SEQ ID NO: 5980101 - DNA, 23 bp, Homo sapiens
cacagggctctttgatggaccca

SEQ ID NO: 5980102 - DNA, 20 bp, Homo sapiens
cacagggcttgttttccaaa

SEQ ID NO: 5980103 - DNA, 19 bp, Homo sapiens
cacaggggaaaagaggagt

SEQ ID NO: 5980104 - DNA, 18 bp, Homo sapiens
cacaggggaaggaaataa

SEQ ID NO: 5980105 - DNA, 22 bp, Homo sapiens
cacaggggaaggaaataacatt

SEQ ID NO: 5980106 - DNA, 16 bp, Homo sapiens
cacaggggacacagct

SEQ ID NO: 5980107 - DNA, 16 bp, Homo sapiens
cacaggggacactgaa

SEQ ID NO: 5980108 - DNA, 17 bp, Homo sapiens
cacaggggacactgaac

SEQ ID NO: 5980109 - DNA, 22 bp, Homo sapiens
cacaggggcaaagaactgcccc

SEQ ID NO: 5980110 - DNA, 18 bp, Homo sapiens
cacaggggcaggcctggg

SEQ ID NO: 5980111 - DNA, 23 bp, Homo sapiens
cacaggggccaccacctttggct

SEQ ID NO: 5980112 - DNA, 18 bp, Homo sapiens
cacaggggccctgtacag

SEQ ID NO: 5980113 - DNA, 12 bp, Homo sapiens
cacaggggcctt

SEQ ID NO: 5980114 - DNA, 15 bp, Homo sapiens
cacaggggcggggca

SEQ ID NO: 5980115 - DNA, 19 bp, Homo sapiens
cacaggggcggggcaggaa

SEQ ID NO: 5980116 - DNA, 19 bp, Homo sapiens
cacagggggattctgagca

SEQ ID NO: 5980117 - DNA, 17 bp, Homo sapiens
cacagggtcccacagcc

SEQ ID NO: 5980118 - DNA, 21 bp, Homo sapiens
cacagggtccccgagtgccta

SEQ ID NO: 5980119 - DNA, 13 bp, Homo sapiens
cacagggtctgcc

SEQ ID NO: 5980120 - DNA, 17 bp, Homo sapiens
cacagggtctgcctcca

SEQ ID NO: 5980121 - DNA, 21 bp, Homo sapiens
cacagggtctgcctccagcca

SEQ ID NO: 5980122 - DNA, 16 bp, Homo sapiens
cacagggtctgctctt

SEQ ID NO: 5980123 - DNA, 14 bp, Homo sapiens
cacagggtgagcac

SEQ ID NO: 5980124 - DNA, 19 bp, Homo sapiens
cacagggtgagcactctgg

SEQ ID NO: 5980125 - DNA, 23 bp, Homo sapiens
cacagggtgagggccacctccac

SEQ ID NO: 5980126 - DNA, 15 bp, Homo sapiens
cacagggtgttggaa

SEQ ID NO: 5980127 - DNA, 23 bp, Homo sapiens
cacagggttgggcccagatctgg

SEQ ID NO: 5980128 - DNA, 22 bp, Homo sapiens
cacagggtttggcccaagtttc

SEQ ID NO: 5980129 - DNA, 16 bp, Homo sapiens
cacagggttttgtatt

SEQ ID NO: 5980130 - DNA, 16 bp, Homo sapiens
cacaggtacagcaaca

SEQ ID NO: 5980131 - DNA, 18 bp, Homo sapiens
cacaggtacagcaacagg

SEQ ID NO: 5980132 - DNA, 22 bp, Homo sapiens
cacaggtagcacagattttgaa

SEQ ID NO: 5980133 - DNA, 13 bp, Homo sapiens
cacaggtcaggct

SEQ ID NO: 5980134 - DNA, 14 bp, Homo sapiens
cacaggtcaggcta

SEQ ID NO: 5980135 - DNA, 17 bp, Homo sapiens
cacaggtcagggctcag

SEQ ID NO: 5980136 - DNA, 21 bp, Homo sapiens
cacaggtcagggctcagagtg

SEQ ID NO: 5980137 - DNA, 21 bp, Homo sapiens
cacaggtcaggggtgacacag

SEQ ID NO: 5980138 - DNA, 22 bp, Homo sapiens
cacaggtcaggggtgacacaga

SEQ ID NO: 5980139 - DNA, 13 bp, Homo sapiens
cacaggtccaagg

SEQ ID NO: 5980140 - DNA, 14 bp, Homo sapiens
cacaggtccaagga

SEQ ID NO: 5980141 - DNA, 15 bp, Homo sapiens
cacaggtccaaggac

SEQ ID NO: 5980142 - DNA, 16 bp, Homo sapiens
cacaggtccaaggaca

SEQ ID NO: 5980143 - DNA, 14 bp, Homo sapiens
cacaggtcccacct

SEQ ID NO: 5980144 - DNA, 21 bp, Homo sapiens
cacaggtcccacctccagccc

SEQ ID NO: 5980145 - DNA, 22 bp, Homo sapiens
cacaggtcccacctccagcccg

SEQ ID NO: 5980146 - DNA, 21 bp, Homo sapiens
cacaggtctcattgcttctga

SEQ ID NO: 5980147 - DNA, 17 bp, Homo sapiens
cacaggtgaggggcagg

SEQ ID NO: 5980148 - DNA, 15 bp, Homo sapiens
cacaggtgcccgcca

SEQ ID NO: 5980149 - DNA, 23 bp, Homo sapiens
cacaggtgccgccagctgccgca

SEQ ID NO: 5980150 - DNA, 21 bp, Homo sapiens
cacaggtgcgggaccatctga

SEQ ID NO: 5980151 - DNA, 17 bp, Homo sapiens
cacaggtggggactggg

SEQ ID NO: 5980152 - DNA, 13 bp, Homo sapiens
cacaggtgtaaat

SEQ ID NO: 5980153 - DNA, 14 bp, Homo sapiens
cacaggtgtcccca

SEQ ID NO: 5980154 - DNA, 20 bp, Homo sapiens
cacaggtgtccccagcccac

SEQ ID NO: 5980155 - DNA, 13 bp, Homo sapiens
cacaggtgtggga

SEQ ID NO: 5980156 - DNA, 16 bp, Homo sapiens
cacaggtgttccgtgg

SEQ ID NO: 5980157 - DNA, 14 bp, Homo sapiens
cacaggtgttgatt

SEQ ID NO: 5980158 - DNA, 15 bp, Homo sapiens
cacaggtgtttatac

SEQ ID NO: 5980159 - DNA, 16 bp, Homo sapiens
cacaggttcacccagc

SEQ ID NO: 5980160 - DNA, 19 bp, Homo sapiens
cacaggttcatgccaccat

SEQ ID NO: 5980161 - DNA, 20 bp, Homo sapiens
cacaggttccatagaactaa

SEQ ID NO: 5980162 - DNA, 18 bp, Homo sapiens
cacaggttggaagagaat

SEQ ID NO: 5980163 - DNA, 21 bp, Homo sapiens
cacaggttggaagagaatcac

SEQ ID NO: 5980164 - DNA, 15 bp, Homo sapiens
cacaggtttaaggct

SEQ ID NO: 5980165 - DNA, 20 bp, Homo sapiens
cacaggtttagttgactaat

SEQ ID NO: 5980166 - DNA, 24 bp, Homo sapiens
cacaggtttccccaaggcctctca

SEQ ID NO: 5980167 - DNA, 15 bp, Homo sapiens
cacaggtttgtttct

SEQ ID NO: 5980168 - DNA, 19 bp, Homo sapiens
cacaggttttagcattgtc

SEQ ID NO: 5980169 - DNA, 15 bp, Homo sapiens
cacagtaaaattaac

SEQ ID NO: 5980170 - DNA, 19 bp, Homo sapiens
cacagtaagataggttctg

SEQ ID NO: 5980171 - DNA, 20 bp, Homo sapiens
cacagtaatatgaaagccac

SEQ ID NO: 5980172 - DNA, 22 bp, Homo sapiens
cacagtaatctttcggtctcct

SEQ ID NO: 5980173 - DNA, 13 bp, Homo sapiens
cacagtacatatg

SEQ ID NO: 5980174 - DNA, 19 bp, Homo sapiens
cacagtacgaacctacagt

SEQ ID NO: 5980175 - DNA, 22 bp, Homo sapiens
cacagtactcactttttccaaa

SEQ ID NO: 5980176 - DNA, 17 bp, Homo sapiens
cacagtactttattgta

SEQ ID NO: 5980177 - DNA, 21 bp, Homo sapiens
cacagtactttattgtacaga

SEQ ID NO: 5980178 - DNA, 15 bp, Homo sapiens
cacagtactttccag

SEQ ID NO: 5980179 - DNA, 15 bp, Homo sapiens
cacagtagagccagc

SEQ ID NO: 5980180 - DNA, 21 bp, Homo sapiens
cacagtaggtcccggccagct

SEQ ID NO: 5980181 - DNA, 21 bp, Homo sapiens
cacagtagtgttctgttcact

SEQ ID NO: 5980182 - DNA, 13 bp, Homo sapiens
cacagtatctgct

SEQ ID NO: 5980183 - DNA, 14 bp, Homo sapiens
cacagtatctgctg

SEQ ID NO: 5980184 - DNA, 15 bp, Homo sapiens
cacagtatctgctgt

SEQ ID NO: 5980185 - DNA, 18 bp, Homo sapiens
cacagtatctgctgttct

SEQ ID NO: 5980186 - DNA, 21 bp, Homo sapiens
cacagtatctgctgttcttca

SEQ ID NO: 5980187 - DNA, 16 bp, Homo sapiens
cacagtattacttctg

SEQ ID NO: 5980188 - DNA, 18 bp, Homo sapiens
cacagtattacttctgct

SEQ ID NO: 5980189 - DNA, 21 bp, Homo sapiens
cacagtattacttctgctaca

SEQ ID NO: 5980190 - DNA, 15 bp, Homo sapiens
caaatctataaatat

SEQ ID NO: 5980191 - DNA, 19 bp, Homo sapiens
caaatctatattaaagtgt

SEQ ID NO: 5980192 - DNA, 20 bp, Homo sapiens
caaatctatattaaagtgtt

SEQ ID NO: 5980193 - DNA, 24 bp, Homo sapiens
caaatctattacttttgcaaactg

SEQ ID NO: 5980194 - DNA, 13 bp, Homo sapiens
caaatctattcag

SEQ ID NO: 5980195 - DNA, 17 bp, Homo sapiens
caaatctatttaattag

SEQ ID NO: 5980196 - DNA, 23 bp, Homo sapiens
caaatctatttaattaggaaaaa

SEQ ID NO: 5980197 - DNA, 11 bp, Homo sapiens
caaatctcagc

SEQ ID NO: 5980198 - DNA, 13 bp, Homo sapiens
caaatctcagcaa

SEQ ID NO: 5980199 - DNA, 20 bp, Homo sapiens
caaatctcagcaaagctaca

SEQ ID NO: 5980200 - DNA, 20 bp, Homo sapiens
caaatctcatacacaactgt

SEQ ID NO: 5980201 - DNA, 15 bp, Homo sapiens
caaatctctgttact

SEQ ID NO: 5980202 - DNA, 14 bp, Homo sapiens
caaatctgacatat

SEQ ID NO: 5980203 - DNA, 13 bp, Homo sapiens
caaatctgacttt

SEQ ID NO: 5980204 - DNA, 16 bp, Homo sapiens
caaatctgatggcctt

SEQ ID NO: 5980205 - DNA, 17 bp, Homo sapiens
caaatctgatttcatta

SEQ ID NO: 5980206 - DNA, 21 bp, Homo sapiens
caaatctgcctattgcagctg

SEQ ID NO: 5980207 - DNA, 17 bp, Homo sapiens
caaatctgctttcatcc

SEQ ID NO: 5980208 - DNA, 13 bp, Homo sapiens
caaatctggaagc

SEQ ID NO: 5980209 - DNA, 14 bp, Homo sapiens
caaatctgtaatta

SEQ ID NO: 5980210 - DNA, 12 bp, Homo sapiens
caaatctgtata

SEQ ID NO: 5980211 - DNA, 19 bp, Homo sapiens
caaatctgtataaatgtct

SEQ ID NO: 5980212 - DNA, 19 bp, Homo sapiens
caaatctgtcctctgtagt

SEQ ID NO: 5980213 - DNA, 12 bp, Homo sapiens
caaatctgtcta

SEQ ID NO: 5980214 - DNA, 13 bp, Homo sapiens
caaatctgtctgc

SEQ ID NO: 5980215 - DNA, 19 bp, Homo sapiens
caaatctgtgctacactgg

SEQ ID NO: 5980216 - DNA, 15 bp, Homo sapiens
caaatctgtgctctt

SEQ ID NO: 5980217 - DNA, 18 bp, Homo sapiens
caaatctgtgctctttca

SEQ ID NO: 5980218 - DNA, 12 bp, Homo sapiens
caaatcttcctc

SEQ ID NO: 5980219 - DNA, 22 bp, Homo sapiens
caaatcttcctggtcgaaagtt

SEQ ID NO: 5980220 - DNA, 19 bp, Homo sapiens
caaatcttgaaattaagaa

SEQ ID NO: 5980221 - DNA, 18 bp, Homo sapiens
caaatcttgaatttctgc

SEQ ID NO: 5980222 - DNA, 22 bp, Homo sapiens
caaatcttggttgatgccaaaa

SEQ ID NO: 5980223 - DNA, 22 bp, Homo sapiens
caaatcttgttattgaagtgtt

SEQ ID NO: 5980224 - DNA, 23 bp, Homo sapiens
caaatcttgtttacaaaatattc

SEQ ID NO: 5980225 - DNA, 21 bp, Homo sapiens
caaatgaaagagaaaatatat

SEQ ID NO: 5980226 - DNA, 15 bp, Homo sapiens
caaatgaaagcataa

SEQ ID NO: 5980227 - DNA, 19 bp, Homo sapiens
caaatgaaatatatttaaa

SEQ ID NO: 5980228 - DNA, 18 bp, Homo sapiens
caaatgaacttttacaga

SEQ ID NO: 5980229 - DNA, 19 bp, Homo sapiens
caaatgaagacaaaacata

SEQ ID NO: 5980230 - DNA, 22 bp, Homo sapiens
caaatgaagattcagcagtgtc

SEQ ID NO: 5980231 - DNA, 13 bp, Homo sapiens
caaatgaatcatt

SEQ ID NO: 5980232 - DNA, 15 bp, Homo sapiens
caaatgaatcattgt

SEQ ID NO: 5980233 - DNA, 12 bp, Homo sapiens
caaatgaatgag

SEQ ID NO: 5980234 - DNA, 22 bp, Homo sapiens
caaatgaatgattaaattatga

SEQ ID NO: 5980235 - DNA, 22 bp, Homo sapiens
caaatgaatgttgtctgtttgt

SEQ ID NO: 5980236 - DNA, 19 bp, Homo sapiens
caaatgaattctttaagga

SEQ ID NO: 5980237 - DNA, 18 bp, Homo sapiens
caaatgaatttatcattt

SEQ ID NO: 5980238 - DNA, 20 bp, Homo sapiens
caaatgaatttatcatttta

SEQ ID NO: 5980239 - DNA, 21 bp, Homo sapiens
caaatgaattttccacgcagt

SEQ ID NO: 5980240 - DNA, 18 bp, Homo sapiens
caaatgacagatcttttt

SEQ ID NO: 5980241 - DNA, 19 bp, Homo sapiens
caaatgacagattctgaca

SEQ ID NO: 5980242 - DNA, 16 bp, Homo sapiens
caaatgacagatttct

SEQ ID NO: 5980243 - DNA, 14 bp, Homo sapiens
caaatgacatgcac

SEQ ID NO: 5980244 - DNA, 16 bp, Homo sapiens
caaatgacatgcactg

SEQ ID NO: 5980245 - DNA, 17 bp, Homo sapiens
caaatgacatgcactga

SEQ ID NO: 5980246 - DNA, 17 bp, Homo sapiens
caaatgacccaaagacc

SEQ ID NO: 5980247 - DNA, 21 bp, Homo sapiens
caaatgaccgagccctggaga

SEQ ID NO: 5980248 - DNA, 11 bp, Homo sapiens
caaatgactac

SEQ ID NO: 5980249 - DNA, 14 bp, Homo sapiens
caaatgactttatt

SEQ ID NO: 5980250 - DNA, 20 bp, Homo sapiens
caaatgactttattatttat

SEQ ID NO: 5980251 - DNA, 17 bp, Homo sapiens
caaatgagacagcagtc

SEQ ID NO: 5980252 - DNA, 22 bp, Homo sapiens
caaatgagatgtatgcccaaag

SEQ ID NO: 5980253 - DNA, 16 bp, Homo sapiens
caaatgagcattagct

SEQ ID NO: 5980254 - DNA, 20 bp, Homo sapiens
caaatgagctctgaaatctt

SEQ ID NO: 5980255 - DNA, 14 bp, Homo sapiens
caaatgagtaacat

SEQ ID NO: 5980256 - DNA, 21 bp, Homo sapiens
caaatgagtttaaaaaaataa

SEQ ID NO: 5980257 - DNA, 23 bp, Homo sapiens
caaatgagtttaaaaaaataaca

SEQ ID NO: 5980258 - DNA, 17 bp, Homo sapiens
caaatgatagaaacaga

SEQ ID NO: 5980259 - DNA, 18 bp, Homo sapiens
caaatgatcctcccacct

SEQ ID NO: 5980260 - DNA, 14 bp, Homo sapiens
caaatgatccttcc

SEQ ID NO: 5980261 - DNA, 23 bp, Homo sapiens
caaatgatctagttcagaaggaa

SEQ ID NO: 5980262 - DNA, 21 bp, Homo sapiens
caaatgatgtgcctgcttcag

SEQ ID NO: 5980263 - DNA, 21 bp, Homo sapiens
caaatgattgcttttaaaatt

SEQ ID NO: 5980264 - DNA, 14 bp, Homo sapiens
caaatgatttcata

SEQ ID NO: 5980265 - DNA, 21 bp, Homo sapiens
caaatgcaaaaactctttgag

SEQ ID NO: 5980266 - DNA, 14 bp, Homo sapiens
caaatgcaaaatta

SEQ ID NO: 5980267 - DNA, 12 bp, Homo sapiens
caaatgcaaatt

SEQ ID NO: 5980268 - DNA, 15 bp, Homo sapiens
caaatgcaatttgat

SEQ ID NO: 5980269 - DNA, 18 bp, Homo sapiens
caaatgcacaagctcaga

SEQ ID NO: 5980270 - DNA, 16 bp, Homo sapiens
caaatgcagaatactt

SEQ ID NO: 5980271 - DNA, 14 bp, Homo sapiens
caaatgcagacaca

SEQ ID NO: 5980272 - DNA, 16 bp, Homo sapiens
caaatgcagacacaca

SEQ ID NO: 5980273 - DNA, 12 bp, Homo sapiens
caaatgcagctt

SEQ ID NO: 5980274 - DNA, 13 bp, Homo sapiens
caaatgcagcttt

SEQ ID NO: 5980275 - DNA, 16 bp, Homo sapiens
caaatgcatctttgat

SEQ ID NO: 5980276 - DNA, 18 bp, Homo sapiens
caaatgcatggtgcagtt

SEQ ID NO: 5980277 - DNA, 21 bp, Homo sapiens
caaatgccaaacactagctct

SEQ ID NO: 5980278 - DNA, 21 bp, Homo sapiens
caaatgccaactgttggaatt

SEQ ID NO: 5980279 - DNA, 16 bp, Homo sapiens
caaatgccagggcccg

SEQ ID NO: 5980280 - DNA, 12 bp, Homo sapiens
caaatgcctctg

SEQ ID NO: 5980281 - DNA, 15 bp, Homo sapiens
caaatgcctctgcct

SEQ ID NO: 5980282 - DNA, 14 bp, Homo sapiens
caaatgcctgccaa

SEQ ID NO: 5980283 - DNA, 23 bp, Homo sapiens
caaatgcctgttgtatttatgga

SEQ ID NO: 5980284 - DNA, 19 bp, Homo sapiens
caaatgccttaaaatggaa

SEQ ID NO: 5980285 - DNA, 12 bp, Homo sapiens
caaatgcctttt

SEQ ID NO: 5980286 - DNA, 16 bp, Homo sapiens
caaatgcgaacactat

SEQ ID NO: 5980287 - DNA, 15 bp, Homo sapiens
caaatgctaatgtca

SEQ ID NO: 5980288 - DNA, 15 bp, Homo sapiens
caaatgctactcagt

SEQ ID NO: 5980289 - DNA, 17 bp, Homo sapiens
caaatgctattaaagtg

SEQ ID NO: 5980290 - DNA, 18 bp, Homo sapiens
caaatgctctctcttctt

SEQ ID NO: 5980291 - DNA, 22 bp, Homo sapiens
caaatgctctctcttcttatta

SEQ ID NO: 5980292 - DNA, 22 bp, Homo sapiens
caaatgctctgtcttcaatgat

SEQ ID NO: 5980293 - DNA, 21 bp, Homo sapiens
caaatgctgacccatgcaata

SEQ ID NO: 5980294 - DNA, 18 bp, Homo sapiens
caaatgctgcgcccttcc

SEQ ID NO: 5980295 - DNA, 13 bp, Homo sapiens
caaatgctggggc

SEQ ID NO: 5980296 - DNA, 17 bp, Homo sapiens
caaatgctggggcaggg

SEQ ID NO: 5980297 - DNA, 22 bp, Homo sapiens
caaatgctggggtcatataaaa

SEQ ID NO: 5980298 - DNA, 13 bp, Homo sapiens
caaatgctgtctc

SEQ ID NO: 5980299 - DNA, 20 bp, Homo sapiens
caaatgctgtggttcactgc

SEQ ID NO: 5980300 - DNA, 14 bp, Homo sapiens
caaatgctttgtga

SEQ ID NO: 5980301 - DNA, 19 bp, Homo sapiens
caaatgcttttccaaccca

SEQ ID NO: 5980302 - DNA, 18 bp, Homo sapiens
caaatgctttttgtttta

SEQ ID NO: 5980303 - DNA, 22 bp, Homo sapiens
caaatgctttttgttttatttt

SEQ ID NO: 5980304 - DNA, 15 bp, Homo sapiens
caaatggaaaatgta

SEQ ID NO: 5980305 - DNA, 14 bp, Homo sapiens
caaatggaaaggag

SEQ ID NO: 5980306 - DNA, 21 bp, Homo sapiens
caaatggaaaggagaggaaag

SEQ ID NO: 5980307 - DNA, 20 bp, Homo sapiens
caaatggaaatgggcagagc

SEQ ID NO: 5980308 - DNA, 15 bp, Homo sapiens
caaatggaagacaca

SEQ ID NO: 5980309 - DNA, 14 bp, Homo sapiens
caaatggactggcc

SEQ ID NO: 5980310 - DNA, 12 bp, Homo sapiens
caaatggactgt

SEQ ID NO: 5980311 - DNA, 18 bp, Homo sapiens
caaatggagaagctgcag

SEQ ID NO: 5980312 - DNA, 22 bp, Homo sapiens
caaatggatgacacatttaatg

SEQ ID NO: 5980313 - DNA, 22 bp, Homo sapiens
caaatggattttgggagtgact

SEQ ID NO: 5980314 - DNA, 22 bp, Homo sapiens
caaatggcagcagttccatgaa

SEQ ID NO: 5980315 - DNA, 22 bp, Homo sapiens
caaatggcattgggctgagtaa

SEQ ID NO: 5980316 - DNA, 24 bp, Homo sapiens
caaatggccagttttctggtagga

SEQ ID NO: 5980317 - DNA, 18 bp, Homo sapiens
caaatggcgtctggaagt

SEQ ID NO: 5980318 - DNA, 21 bp, Homo sapiens
caaatggcgtctggaagtcca

SEQ ID NO: 5980319 - DNA, 22 bp, Homo sapiens
caaatggcgtctggaagtccaa

SEQ ID NO: 5980320 - DNA, 14 bp, Homo sapiens
caaatggctgcttt

SEQ ID NO: 5980321 - DNA, 20 bp, Homo sapiens
caaatgggactgatgtcatc

SEQ ID NO: 5980322 - DNA, 17 bp, Homo sapiens
caaatgggagctgagca

SEQ ID NO: 5980323 - DNA, 19 bp, Homo sapiens
caaatgggatggtatgtga

SEQ ID NO: 5980324 - DNA, 16 bp, Homo sapiens
caaatggggccagatc

SEQ ID NO: 5980325 - DNA, 23 bp, Homo sapiens
caaatggggccagatccagcctg

SEQ ID NO: 5980326 - DNA, 22 bp, Homo sapiens
caaatggggtttcacaaatagt

SEQ ID NO: 5980327 - DNA, 21 bp, Homo sapiens
caaatgggttaatcctgaatt

SEQ ID NO: 5980328 - DNA, 13 bp, Homo sapiens
caaatggtacaaa

SEQ ID NO: 5980329 - DNA, 15 bp, Homo sapiens
caaatggtaggcatt

SEQ ID NO: 5980330 - DNA, 22 bp, Homo sapiens
caaatggtggaggattgctgcc

SEQ ID NO: 5980331 - DNA, 22 bp, Homo sapiens
caaatggtggttgtttcttcca

SEQ ID NO: 5980332 - DNA, 18 bp, Homo sapiens
caaatggtgtcatggctg

SEQ ID NO: 5980333 - DNA, 13 bp, Homo sapiens
caaatggttctta

SEQ ID NO: 5980334 - DNA, 15 bp, Homo sapiens
caaatggttcttact

SEQ ID NO: 5980335 - DNA, 13 bp, Homo sapiens
caaatgtaaaata

SEQ ID NO: 5980336 - DNA, 16 bp, Homo sapiens
caaatgtaaaatattt

SEQ ID NO: 5980337 - DNA, 17 bp, Homo sapiens
caaatgtaaaatattta

SEQ ID NO: 5980338 - DNA, 18 bp, Homo sapiens
caaatgtaaaatatttat

SEQ ID NO: 5980339 - DNA, 13 bp, Homo sapiens
caaatgtaaaatt

SEQ ID NO: 5980340 - DNA, 17 bp, Homo sapiens
caaatgtaaacattttc

SEQ ID NO: 5980341 - DNA, 13 bp, Homo sapiens
caaatgtaaagtc

SEQ ID NO: 5980342 - DNA, 13 bp, Homo sapiens
caaatgtaaatca

SEQ ID NO: 5980343 - DNA, 14 bp, Homo sapiens
caaatgtaaatcaa

SEQ ID NO: 5980344 - DNA, 23 bp, Homo sapiens
caaatgtacatctcccctttgct

SEQ ID NO: 5980345 - DNA, 14 bp, Homo sapiens
caaatgtattaatg

SEQ ID NO: 5980346 - DNA, 13 bp, Homo sapiens
caaatgtattgat

SEQ ID NO: 5980347 - DNA, 17 bp, Homo sapiens
caaatgtattgattaca

SEQ ID NO: 5980348 - DNA, 12 bp, Homo sapiens
caaatgtatttt

SEQ ID NO: 5980349 - DNA, 19 bp, Homo sapiens
caaatgtcagatacaatgt

SEQ ID NO: 5980350 - DNA, 17 bp, Homo sapiens
caaatgtcagcttaaaa

SEQ ID NO: 5980351 - DNA, 21 bp, Homo sapiens
caaatgtcattatgtagaaat

SEQ ID NO: 5980352 - DNA, 13 bp, Homo sapiens
caaatgtcattgt

SEQ ID NO: 5980353 - DNA, 15 bp, Homo sapiens
caaatgtcattgtct

SEQ ID NO: 5980354 - DNA, 16 bp, Homo sapiens
caaatgtcatttcata

SEQ ID NO: 5980355 - DNA, 18 bp, Homo sapiens
caaatgtcatttcataca

SEQ ID NO: 5980356 - DNA, 21 bp, Homo sapiens
caaatgtcatttcatacaaat

SEQ ID NO: 5980357 - DNA, 23 bp, Homo sapiens
caaatgtccaagcatcagcaaga

SEQ ID NO: 5980358 - DNA, 15 bp, Homo sapiens
caaatgtcctcagag

SEQ ID NO: 5980359 - DNA, 16 bp, Homo sapiens
caaatgtcctttctca

SEQ ID NO: 5980360 - DNA, 20 bp, Homo sapiens
caaatgtcctttctcagagg

SEQ ID NO: 5980361 - DNA, 20 bp, Homo sapiens
caaatgtcggggttggggtg

SEQ ID NO: 5980362 - DNA, 22 bp, Homo sapiens
caaatgtcggggttggggtggg

SEQ ID NO: 5980363 - DNA, 18 bp, Homo sapiens
caaatgtcttaaagggaa

SEQ ID NO: 5980364 - DNA, 13 bp, Homo sapiens
caaatgtcttcca

SEQ ID NO: 5980365 - DNA, 15 bp, Homo sapiens
caaatgtcttcctgg

SEQ ID NO: 5980366 - DNA, 24 bp, Homo sapiens
caaatgtcttttagaagatagatg

SEQ ID NO: 5980367 - DNA, 13 bp, Homo sapiens
caaatgtgaaaga

SEQ ID NO: 5980368 - DNA, 17 bp, Homo sapiens
caaatgtgaagatgcat

SEQ ID NO: 5980369 - DNA, 13 bp, Homo sapiens
cacagtattatct

SEQ ID NO: 5980370 - DNA, 23 bp, Homo sapiens
cacagtattatttctccatcccc

SEQ ID NO: 5980371 - DNA, 20 bp, Homo sapiens
cacagtattcgtgaataagt

SEQ ID NO: 5980372 - DNA, 19 bp, Homo sapiens
cacagtattgctcacccag

SEQ ID NO: 5980373 - DNA, 14 bp, Homo sapiens
cacagtattgtaga

SEQ ID NO: 5980374 - DNA, 18 bp, Homo sapiens
cacagtattgtagaaagc

SEQ ID NO: 5980375 - DNA, 15 bp, Homo sapiens
cacagtatttaacat

SEQ ID NO: 5980376 - DNA, 17 bp, Homo sapiens
cacagtcaaaataattc

SEQ ID NO: 5980377 - DNA, 19 bp, Homo sapiens
cacagtcaaatttacattt

SEQ ID NO: 5980378 - DNA, 16 bp, Homo sapiens
cacagtcactgatgta

SEQ ID NO: 5980379 - DNA, 14 bp, Homo sapiens
cacagtcactggat

SEQ ID NO: 5980380 - DNA, 19 bp, Homo sapiens
cacagtcacttgggagctg

SEQ ID NO: 5980381 - DNA, 20 bp, Homo sapiens
cacagtcagcatgcttccca

SEQ ID NO: 5980382 - DNA, 22 bp, Homo sapiens
cacagtcagcatgcttcccaga

SEQ ID NO: 5980383 - DNA, 14 bp, Homo sapiens
cacagtcaggttga

SEQ ID NO: 5980384 - DNA, 17 bp, Homo sapiens
cacagtcaggttgaaga

SEQ ID NO: 5980385 - DNA, 16 bp, Homo sapiens
cacagtcatgtgtcag

SEQ ID NO: 5980386 - DNA, 20 bp, Homo sapiens
cacagtcattcacatcactg

SEQ ID NO: 5980387 - DNA, 19 bp, Homo sapiens
cacagtccagacccaagtc

SEQ ID NO: 5980388 - DNA, 13 bp, Homo sapiens
cacagtccaggaa

SEQ ID NO: 5980389 - DNA, 11 bp, Homo sapiens
cacagtcccag

SEQ ID NO: 5980390 - DNA, 16 bp, Homo sapiens
cacagtccccagactc

SEQ ID NO: 5980391 - DNA, 19 bp, Homo sapiens
cacagtcccccacccacct

SEQ ID NO: 5980392 - DNA, 14 bp, Homo sapiens
cacagtcctcacag

SEQ ID NO: 5980393 - DNA, 21 bp, Homo sapiens
cacagtccttaccagcagagc

SEQ ID NO: 5980394 - DNA, 16 bp, Homo sapiens
cacagtctaattttta

SEQ ID NO: 5980395 - DNA, 15 bp, Homo sapiens
cacagtctatttttt

SEQ ID NO: 5980396 - DNA, 17 bp, Homo sapiens
cacagtctcagtccaga

SEQ ID NO: 5980397 - DNA, 19 bp, Homo sapiens
cacagtctcagtccagatg

SEQ ID NO: 5980398 - DNA, 21 bp, Homo sapiens
cacagtctcagtccagatgcc

SEQ ID NO: 5980399 - DNA, 15 bp, Homo sapiens
cacagtctcagttct

SEQ ID NO: 5980400 - DNA, 14 bp, Homo sapiens
cacagtctctctct

SEQ ID NO: 5980401 - DNA, 14 bp, Homo sapiens
cacagtctctggga

SEQ ID NO: 5980402 - DNA, 16 bp, Homo sapiens
cacagtcttcccagca

SEQ ID NO: 5980403 - DNA, 23 bp, Homo sapiens
cacagtcttgtgaactttgaatg

SEQ ID NO: 5980404 - DNA, 22 bp, Homo sapiens
cacagtgaaggctgtccttacc

SEQ ID NO: 5980405 - DNA, 20 bp, Homo sapiens
cacagtgaatgtgtgtatgt

SEQ ID NO: 5980406 - DNA, 15 bp, Homo sapiens
cacagtgacactgga

SEQ ID NO: 5980407 - DNA, 16 bp, Homo sapiens
cacagtgacagtcact

SEQ ID NO: 5980408 - DNA, 20 bp, Homo sapiens
cacagtgactcgggctcctg

SEQ ID NO: 5980409 - DNA, 21 bp, Homo sapiens
cacagtgactcgggctcctgt

SEQ ID NO: 5980410 - DNA, 22 bp, Homo sapiens
cacagtgactcgggctcctgtg

SEQ ID NO: 5980411 - DNA, 23 bp, Homo sapiens
cacagtgactcgggctcctgtgc

SEQ ID NO: 5980412 - DNA, 17 bp, Homo sapiens
cacagtgactgggccct

SEQ ID NO: 5980413 - DNA, 18 bp, Homo sapiens
cacagtgactgggccctg

SEQ ID NO: 5980414 - DNA, 20 bp, Homo sapiens
cacagtgactgggccctgtc

SEQ ID NO: 5980415 - DNA, 22 bp, Homo sapiens
cacagtgactgggccctgtcca

SEQ ID NO: 5980416 - DNA, 16 bp, Homo sapiens
cacagtgacttctgag

SEQ ID NO: 5980417 - DNA, 17 bp, Homo sapiens
cacagtgacttctgaga

SEQ ID NO: 5980418 - DNA, 19 bp, Homo sapiens
cacagtgagactgtacata

SEQ ID NO: 5980419 - DNA, 21 bp, Homo sapiens
cacagtgagactgtacataat

SEQ ID NO: 5980420 - DNA, 23 bp, Homo sapiens
cacagtgagaggggagggctcct

SEQ ID NO: 5980421 - DNA, 21 bp, Homo sapiens
cacagtgagagtactcacttt

SEQ ID NO: 5980422 - DNA, 15 bp, Homo sapiens
cacagtgagctgatg

SEQ ID NO: 5980423 - DNA, 18 bp, Homo sapiens
cacagtgagtcgaggaca

SEQ ID NO: 5980424 - DNA, 21 bp, Homo sapiens
cacagtgagtcgaggacaggg

SEQ ID NO: 5980425 - DNA, 17 bp, Homo sapiens
cacagtgataccagttc

SEQ ID NO: 5980426 - DNA, 18 bp, Homo sapiens
cacagtgatatatttcta

SEQ ID NO: 5980427 - DNA, 23 bp, Homo sapiens
cacagtgatgccgggcgccagga

SEQ ID NO: 5980428 - DNA, 11 bp, Homo sapiens
cacagtgattt

SEQ ID NO: 5980429 - DNA, 16 bp, Homo sapiens
cacagtgcagcttgca

SEQ ID NO: 5980430 - DNA, 12 bp, Homo sapiens
cacagtgcagtt

SEQ ID NO: 5980431 - DNA, 14 bp, Homo sapiens
cacagtgcatctca

SEQ ID NO: 5980432 - DNA, 18 bp, Homo sapiens
cacagtgcattatgtaca

SEQ ID NO: 5980433 - DNA, 18 bp, Homo sapiens
cacagtgccaccaagctc

SEQ ID NO: 5980434 - DNA, 16 bp, Homo sapiens
cacagtgccccagtgg

SEQ ID NO: 5980435 - DNA, 13 bp, Homo sapiens
cacagtgccccct

SEQ ID NO: 5980436 - DNA, 12 bp, Homo sapiens
cacagtgcctga

SEQ ID NO: 5980437 - DNA, 16 bp, Homo sapiens
cacagtgcctggccca

SEQ ID NO: 5980438 - DNA, 17 bp, Homo sapiens
cacagtgcctgtacagg

SEQ ID NO: 5980439 - DNA, 20 bp, Homo sapiens
cacagtgcctgtacaggaag

SEQ ID NO: 5980440 - DNA, 16 bp, Homo sapiens
cacagtgctcttttct

SEQ ID NO: 5980441 - DNA, 11 bp, Homo sapiens
cacagtgctgc

SEQ ID NO: 5980442 - DNA, 13 bp, Homo sapiens
cacagtgctgccc

SEQ ID NO: 5980443 - DNA, 19 bp, Homo sapiens
cacagtgctgccccttgca

SEQ ID NO: 5980444 - DNA, 12 bp, Homo sapiens
cacagtgctgct

SEQ ID NO: 5980445 - DNA, 13 bp, Homo sapiens
cacagtgctgctt

SEQ ID NO: 5980446 - DNA, 15 bp, Homo sapiens
cacagtgctgcttct

SEQ ID NO: 5980447 - DNA, 22 bp, Homo sapiens
cacagtgctttccgtggcactg

SEQ ID NO: 5980448 - DNA, 13 bp, Homo sapiens
cacagtggaacca

SEQ ID NO: 5980449 - DNA, 17 bp, Homo sapiens
cacagtggactcagcag

SEQ ID NO: 5980450 - DNA, 21 bp, Homo sapiens
cacagtggactcagcagtgac

SEQ ID NO: 5980451 - DNA, 16 bp, Homo sapiens
cacagtggagagggct

SEQ ID NO: 5980452 - DNA, 22 bp, Homo sapiens
cacagtggatggacggacaaga

SEQ ID NO: 5980453 - DNA, 20 bp, Homo sapiens
cacagtggcgagaggagagg

SEQ ID NO: 5980454 - DNA, 20 bp, Homo sapiens
cacagtggcgggcccactca

SEQ ID NO: 5980455 - DNA, 15 bp, Homo sapiens
cacagtggctcacgc

SEQ ID NO: 5980456 - DNA, 13 bp, Homo sapiens
cacagtgggaact

SEQ ID NO: 5980457 - DNA, 14 bp, Homo sapiens
cacagtgggaactc

SEQ ID NO: 5980458 - DNA, 19 bp, Homo sapiens
cacagtgggaactctgaca

SEQ ID NO: 5980459 - DNA, 17 bp, Homo sapiens
cacagtgggaagatttt

SEQ ID NO: 5980460 - DNA, 14 bp, Homo sapiens
cacagtgggagcca

SEQ ID NO: 5980461 - DNA, 14 bp, Homo sapiens
cacagtgggagctg

SEQ ID NO: 5980462 - DNA, 17 bp, Homo sapiens
cacagtgggagctgagc

SEQ ID NO: 5980463 - DNA, 19 bp, Homo sapiens
cacagtgggagctgagctg

SEQ ID NO: 5980464 - DNA, 15 bp, Homo sapiens
cacagtgggccggcc

SEQ ID NO: 5980465 - DNA, 20 bp, Homo sapiens
cacagtgggcctgtgtgtgt

SEQ ID NO: 5980466 - DNA, 14 bp, Homo sapiens
cacagtgggcggct

SEQ ID NO: 5980467 - DNA, 16 bp, Homo sapiens
cacagtgggcggcttc

SEQ ID NO: 5980468 - DNA, 17 bp, Homo sapiens
cacagtggggctgcagg

SEQ ID NO: 5980469 - DNA, 22 bp, Homo sapiens
cacagtggggctgcaggcaggc

SEQ ID NO: 5980470 - DNA, 17 bp, Homo sapiens
cacagtgggtggcacct

SEQ ID NO: 5980471 - DNA, 18 bp, Homo sapiens
cacagtgggtggcacctc

SEQ ID NO: 5980472 - DNA, 18 bp, Homo sapiens
cacagtggtgaccccctt

SEQ ID NO: 5980473 - DNA, 17 bp, Homo sapiens
cacagtggtggcagggc

SEQ ID NO: 5980474 - DNA, 23 bp, Homo sapiens
cacagtggtggcagggcctagct

SEQ ID NO: 5980475 - DNA, 16 bp, Homo sapiens
cacagtggttcctggc

SEQ ID NO: 5980476 - DNA, 18 bp, Homo sapiens
cacagtgtaccattaaaa

SEQ ID NO: 5980477 - DNA, 21 bp, Homo sapiens
cacagtgtaccattaaaatat

SEQ ID NO: 5980478 - DNA, 18 bp, Homo sapiens
cacagtgtcactggtcag

SEQ ID NO: 5980479 - DNA, 16 bp, Homo sapiens
cacagtgtctgggctg

SEQ ID NO: 5980480 - DNA, 20 bp, Homo sapiens
cacagtgtctgggctgactg

SEQ ID NO: 5980481 - DNA, 15 bp, Homo sapiens
cacagtgtctgtaaa

SEQ ID NO: 5980482 - DNA, 16 bp, Homo sapiens
cacagtgtctgtaaat

SEQ ID NO: 5980483 - DNA, 23 bp, Homo sapiens
cacagtgtgaagacactgtgcag

SEQ ID NO: 5980484 - DNA, 22 bp, Homo sapiens
cacagtgtgaataaagtgctgc

SEQ ID NO: 5980485 - DNA, 14 bp, Homo sapiens
cacagtgtgagccc

SEQ ID NO: 5980486 - DNA, 14 bp, Homo sapiens
cacagtgtgatttt

SEQ ID NO: 5980487 - DNA, 12 bp, Homo sapiens
cacagtgtgtga

SEQ ID NO: 5980488 - DNA, 23 bp, Homo sapiens
cacagtgtgtggtcaacatttct

SEQ ID NO: 5980489 - DNA, 17 bp, Homo sapiens
cacagtgttatgctctg

SEQ ID NO: 5980490 - DNA, 14 bp, Homo sapiens
cacagtgttgccca

SEQ ID NO: 5980491 - DNA, 16 bp, Homo sapiens
cacagtgttggaggtt

SEQ ID NO: 5980492 - DNA, 17 bp, Homo sapiens
cacagtgttggcgagag

SEQ ID NO: 5980493 - DNA, 15 bp, Homo sapiens
cacagtgtttcaatt

SEQ ID NO: 5980494 - DNA, 20 bp, Homo sapiens
cacagtgtttcaattctgta

SEQ ID NO: 5980495 - DNA, 17 bp, Homo sapiens
cacagtgtttcctgagt

SEQ ID NO: 5980496 - DNA, 23 bp, Homo sapiens
cacagtgtttcctgagtagcagt

SEQ ID NO: 5980497 - DNA, 17 bp, Homo sapiens
cacagttatcttagctg

SEQ ID NO: 5980498 - DNA, 19 bp, Homo sapiens
cacagttattaattaaaga

SEQ ID NO: 5980499 - DNA, 20 bp, Homo sapiens
cacagttcagtggcagggct

SEQ ID NO: 5980500 - DNA, 14 bp, Homo sapiens
cacagttcatttaa

SEQ ID NO: 5980501 - DNA, 22 bp, Homo sapiens
cacagttccctttatttcacat

SEQ ID NO: 5980502 - DNA, 16 bp, Homo sapiens
cacagttctatttgct

SEQ ID NO: 5980503 - DNA, 14 bp, Homo sapiens
cacagttctctcct

SEQ ID NO: 5980504 - DNA, 20 bp, Homo sapiens
cacagttcttaatacaggag

SEQ ID NO: 5980505 - DNA, 23 bp, Homo sapiens
cacagttcttaatacaggagacc

SEQ ID NO: 5980506 - DNA, 18 bp, Homo sapiens
cacagttcttggtgactg

SEQ ID NO: 5980507 - DNA, 22 bp, Homo sapiens
cacagttcttggtgactgtccc

SEQ ID NO: 5980508 - DNA, 19 bp, Homo sapiens
cacagttctttgggccaga

SEQ ID NO: 5980509 - DNA, 20 bp, Homo sapiens
cacagttctttgggccagac

SEQ ID NO: 5980510 - DNA, 19 bp, Homo sapiens
cacagttgaccctattttt

SEQ ID NO: 5980511 - DNA, 20 bp, Homo sapiens
cacagttgaccctatttttt

SEQ ID NO: 5980512 - DNA, 22 bp, Homo sapiens
cacagttggctggatgaaattt

SEQ ID NO: 5980513 - DNA, 21 bp, Homo sapiens
cacagttggtggggtcctgcc

SEQ ID NO: 5980514 - DNA, 17 bp, Homo sapiens
cacagttgtaccattca

SEQ ID NO: 5980515 - DNA, 13 bp, Homo sapiens
cacagttgtgttc

SEQ ID NO: 5980516 - DNA, 20 bp, Homo sapiens
cacagttgtgttcatgctga

SEQ ID NO: 5980517 - DNA, 23 bp, Homo sapiens
cacagttgtgttcctgacactca

SEQ ID NO: 5980518 - DNA, 23 bp, Homo sapiens
cacagttgttgaatgactgaccc

SEQ ID NO: 5980519 - DNA, 13 bp, Homo sapiens
cacagtttagaac

SEQ ID NO: 5980520 - DNA, 16 bp, Homo sapiens
cacagtttagaacaga

SEQ ID NO: 5980521 - DNA, 13 bp, Homo sapiens
cacagtttcaggc

SEQ ID NO: 5980522 - DNA, 18 bp, Homo sapiens
cacagtttcaggctttta

SEQ ID NO: 5980523 - DNA, 19 bp, Homo sapiens
cacagtttcttccattccc

SEQ ID NO: 5980524 - DNA, 14 bp, Homo sapiens
cacagtttcttctg

SEQ ID NO: 5980525 - DNA, 18 bp, Homo sapiens
cacagtttcttctgtaaa

SEQ ID NO: 5980526 - DNA, 15 bp, Homo sapiens
cacagtttgaaataa

SEQ ID NO: 5980527 - DNA, 23 bp, Homo sapiens
cacagtttgcaatcttatgttga

SEQ ID NO: 5980528 - DNA, 13 bp, Homo sapiens
cacagttttaata

SEQ ID NO: 5980529 - DNA, 21 bp, Homo sapiens
cacagttttagttggtgctga

SEQ ID NO: 5980530 - DNA, 21 bp, Homo sapiens
cacagttttctggctggagcc

SEQ ID NO: 5980531 - DNA, 21 bp, Homo sapiens
cacagttttgaaagaaaaata

SEQ ID NO: 5980532 - DNA, 22 bp, Homo sapiens
cacagttttgaaagaaaaatac

SEQ ID NO: 5980533 - DNA, 19 bp, Homo sapiens
cacagttttggttgcttta

SEQ ID NO: 5980534 - DNA, 23 bp, Homo sapiens
cacagtttttggttcctcttttc

SEQ ID NO: 5980535 - DNA, 21 bp, Homo sapiens
cacagtttttgtaaagccctt

SEQ ID NO: 5980536 - DNA, 23 bp, Homo sapiens
cacataaaaaagaagcactttga

SEQ ID NO: 5980537 - DNA, 14 bp, Homo sapiens
cacataaaagaaga

SEQ ID NO: 5980538 - DNA, 22 bp, Homo sapiens
cacataaacaattcatgccttt

SEQ ID NO: 5980539 - DNA, 21 bp, Homo sapiens
cacataaacacttctccttaa

SEQ ID NO: 5980540 - DNA, 22 bp, Homo sapiens
cacataaacacttctccttaac

SEQ ID NO: 5980541 - DNA, 12 bp, Homo sapiens
cacataaaccaa

SEQ ID NO: 5980542 - DNA, 13 bp, Homo sapiens
cacataaaggtat

SEQ ID NO: 5980543 - DNA, 19 bp, Homo sapiens
cacataaatctgtctgatt

SEQ ID NO: 5980544 - DNA, 16 bp, Homo sapiens
cacataaatgaaagaa

SEQ ID NO: 5980545 - DNA, 15 bp, Homo sapiens
cacataaatgcagcc

SEQ ID NO: 5980546 - DNA, 18 bp, Homo sapiens
cacataaatgcagcccat

SEQ ID NO: 5980547 - DNA, 18 bp, Homo sapiens
cacataacaaagggcagc

SEQ ID NO: 5980548 - DNA, 12 bp, Homo sapiens
cacataagcata

SEQ ID NO: 5980549 - DNA, 21 bp, Homo sapiens
cacataagccaaaactgagca

SEQ ID NO: 5980550 - DNA, 19 bp, Homo sapiens
cacataagctcagaatcca

SEQ ID NO: 5980551 - DNA, 22 bp, Homo sapiens
cacataaggacgtgtgtaaata

SEQ ID NO: 5980552 - DNA, 22 bp, Homo sapiens
cacataattcaggaagcagctt

SEQ ID NO: 5980553 - DNA, 22 bp, Homo sapiens
cacatacaaaaaaaatctttaa

SEQ ID NO: 5980554 - DNA, 22 bp, Homo sapiens
cacatacaacacaaagagaaaa

SEQ ID NO: 5980555 - DNA, 16 bp, Homo sapiens
cacatacaatttgcac

SEQ ID NO: 5980556 - DNA, 17 bp, Homo sapiens
cacatacacacacacgc

SEQ ID NO: 5980557 - DNA, 15 bp, Homo sapiens
cacatacacacatat

SEQ ID NO: 5980558 - DNA, 13 bp, Homo sapiens
cacatacactgca

SEQ ID NO: 5980559 - DNA, 15 bp, Homo sapiens
cacatacagaaagaa

SEQ ID NO: 5980560 - DNA, 14 bp, Homo sapiens
cacatacagatggt

SEQ ID NO: 5980561 - DNA, 16 bp, Homo sapiens
cacatacaggtgctca

SEQ ID NO: 5980562 - DNA, 13 bp, Homo sapiens
cacatacagtttt

SEQ ID NO: 5980563 - DNA, 14 bp, Homo sapiens
cacatacagtttta

SEQ ID NO: 5980564 - DNA, 16 bp, Homo sapiens
cacatacagttttatg

SEQ ID NO: 5980565 - DNA, 17 bp, Homo sapiens
cacatacagttttatgc

SEQ ID NO: 5980566 - DNA, 23 bp, Homo sapiens
cacatacagttttatgctctttt

SEQ ID NO: 5980567 - DNA, 12 bp, Homo sapiens
cacatacataca

SEQ ID NO: 5980568 - DNA, 13 bp, Homo sapiens
cacatacatacac

SEQ ID NO: 5980569 - DNA, 15 bp, Homo sapiens
cacatacatacatac

SEQ ID NO: 5980570 - DNA, 17 bp, Homo sapiens
cacatacatagatcttc

SEQ ID NO: 5980571 - DNA, 12 bp, Homo sapiens
cacatacattaa

SEQ ID NO: 5980572 - DNA, 15 bp, Homo sapiens
cacatacattaaaac

SEQ ID NO: 5980573 - DNA, 17 bp, Homo sapiens
cacatacattaaaacta

SEQ ID NO: 5980574 - DNA, 21 bp, Homo sapiens
cacataccaactcaacttttt

SEQ ID NO: 5980575 - DNA, 13 bp, Homo sapiens
cacataccctccc

SEQ ID NO: 5980576 - DNA, 16 bp, Homo sapiens
cacataccctgacctg

SEQ ID NO: 5980577 - DNA, 18 bp, Homo sapiens
cacataccctgacctggc

SEQ ID NO: 5980578 - DNA, 14 bp, Homo sapiens
cacatacctctctg

SEQ ID NO: 5980579 - DNA, 18 bp, Homo sapiens
cacatacggcagacctct

SEQ ID NO: 5980580 - DNA, 18 bp, Homo sapiens
cacatacgtgcacagggt

SEQ ID NO: 5980581 - DNA, 19 bp, Homo sapiens
cacatactacctagaagta

SEQ ID NO: 5980582 - DNA, 15 bp, Homo sapiens
cacatactagaaagc

SEQ ID NO: 5980583 - DNA, 16 bp, Homo sapiens
cacatacttgagactg

SEQ ID NO: 5980584 - DNA, 16 bp, Homo sapiens
cacatagactgtgcgc

SEQ ID NO: 5980585 - DNA, 14 bp, Homo sapiens
cacatagagatatg

SEQ ID NO: 5980586 - DNA, 15 bp, Homo sapiens
cacatagagatcatc

SEQ ID NO: 5980587 - DNA, 13 bp, Homo sapiens
cacatagagcttt

SEQ ID NO: 5980588 - DNA, 16 bp, Homo sapiens
cacatagattcacctg

SEQ ID NO: 5980589 - DNA, 22 bp, Homo sapiens
cacatagattcacctgtaaaac

SEQ ID NO: 5980590 - DNA, 13 bp, Homo sapiens
cacatagatttct

SEQ ID NO: 5980591 - DNA, 17 bp, Homo sapiens
cacatagcataggctgg

SEQ ID NO: 5980592 - DNA, 20 bp, Homo sapiens
cacatagcataggctgggga

SEQ ID NO: 5980593 - DNA, 20 bp, Homo sapiens
cacatagcccacttacattt

SEQ ID NO: 5980594 - DNA, 13 bp, Homo sapiens
cacatagccctgt

SEQ ID NO: 5980595 - DNA, 14 bp, Homo sapiens
cacatagcttgcct

SEQ ID NO: 5980596 - DNA, 18 bp, Homo sapiens
cacataggaaacttttga

SEQ ID NO: 5980597 - DNA, 20 bp, Homo sapiens
cacataggctggtggccttg

SEQ ID NO: 5980598 - DNA, 21 bp, Homo sapiens
cacatagtgatggttcccctg

SEQ ID NO: 5980599 - DNA, 15 bp, Homo sapiens
cacatagtgtcctgc

SEQ ID NO: 5980600 - DNA, 18 bp, Homo sapiens
cacatagtgtcctgccca

SEQ ID NO: 5980601 - DNA, 20 bp, Homo sapiens
cacatagttctccagttgta

SEQ ID NO: 5980602 - DNA, 14 bp, Homo sapiens
cacatagtttcttt

SEQ ID NO: 5980603 - DNA, 15 bp, Homo sapiens
cacatataaaaacaa

SEQ ID NO: 5980604 - DNA, 14 bp, Homo sapiens
cacatataaacaca

SEQ ID NO: 5980605 - DNA, 21 bp, Homo sapiens
cacatataaacatcacacaca

SEQ ID NO: 5980606 - DNA, 14 bp, Homo sapiens
cacatataacactt

SEQ ID NO: 5980607 - DNA, 22 bp, Homo sapiens
cacatataagttgagaaggtgc

SEQ ID NO: 5980608 - DNA, 16 bp, Homo sapiens
cacatatacacacaca

SEQ ID NO: 5980609 - DNA, 14 bp, Homo sapiens
cacatatacatata

SEQ ID NO: 5980610 - DNA, 16 bp, Homo sapiens
cacatatacatatata

SEQ ID NO: 5980611 - DNA, 21 bp, Homo sapiens
cacatatacatctagcacagc

SEQ ID NO: 5980612 - DNA, 23 bp, Homo sapiens
cacatatacatctagcacagctg

SEQ ID NO: 5980613 - DNA, 14 bp, Homo sapiens
cacatatacattat

SEQ ID NO: 5980614 - DNA, 14 bp, Homo sapiens
cacatatacctata

SEQ ID NO: 5980615 - DNA, 22 bp, Homo sapiens
cacatatacctataatgtgtgt

SEQ ID NO: 5980616 - DNA, 23 bp, Homo sapiens
cacatatacctataatgtgtgta

SEQ ID NO: 5980617 - DNA, 12 bp, Homo sapiens
cacatatatgta

SEQ ID NO: 5980618 - DNA, 14 bp, Homo sapiens
cacatatatgtata

SEQ ID NO: 5980619 - DNA, 17 bp, Homo sapiens
cacatatattttttaca

SEQ ID NO: 5980620 - DNA, 19 bp, Homo sapiens
cacatatccaggcaccagg

SEQ ID NO: 5980621 - DNA, 23 bp, Homo sapiens
cacatatctagtatgaaattata

SEQ ID NO: 5980622 - DNA, 20 bp, Homo sapiens
cacatatgataaaaaagtgt

SEQ ID NO: 5980623 - DNA, 18 bp, Homo sapiens
cacatatgcaccttgtgt

SEQ ID NO: 5980624 - DNA, 22 bp, Homo sapiens
cacatatgcaccttgtgtctgt

SEQ ID NO: 5980625 - DNA, 14 bp, Homo sapiens
cacatatggcacaa

SEQ ID NO: 5980626 - DNA, 13 bp, Homo sapiens
cacatatgtctta

SEQ ID NO: 5980627 - DNA, 21 bp, Homo sapiens
cacatatgtcttactacttta

SEQ ID NO: 5980628 - DNA, 13 bp, Homo sapiens
cacatattgattt

SEQ ID NO: 5980629 - DNA, 13 bp, Homo sapiens
cacatatttcaca

SEQ ID NO: 5980630 - DNA, 16 bp, Homo sapiens
cacatatttgaagggt

SEQ ID NO: 5980631 - DNA, 23 bp, Homo sapiens
cacatatttgaagggtctttctc

SEQ ID NO: 5980632 - DNA, 17 bp, Homo sapiens
cacatattttaaaattt

SEQ ID NO: 5980633 - DNA, 14 bp, Homo sapiens
cacatatttttcca

SEQ ID NO: 5980634 - DNA, 13 bp, Homo sapiens
cacatcaaagagg

SEQ ID NO: 5980635 - DNA, 18 bp, Homo sapiens
cacatcaagcatcattgt

SEQ ID NO: 5980636 - DNA, 22 bp, Homo sapiens
cacatcaagcatgcaataatgt

SEQ ID NO: 5980637 - DNA, 17 bp, Homo sapiens
cacatcaataaatactt

SEQ ID NO: 5980638 - DNA, 16 bp, Homo sapiens
cacatcacaatattca

SEQ ID NO: 5980639 - DNA, 13 bp, Homo sapiens
cacatcacattcc

SEQ ID NO: 5980640 - DNA, 16 bp, Homo sapiens
cacatcacatttaaat

SEQ ID NO: 5980641 - DNA, 18 bp, Homo sapiens
cacatcacctctttgccc

SEQ ID NO: 5980642 - DNA, 23 bp, Homo sapiens
cacatcactattgggcccccagg

SEQ ID NO: 5980643 - DNA, 18 bp, Homo sapiens
cacatcagcacgatttct

SEQ ID NO: 5980644 - DNA, 21 bp, Homo sapiens
cacatcagcacgatttctgtt

SEQ ID NO: 5980645 - DNA, 16 bp, Homo sapiens
cacatcagcatgtttt

SEQ ID NO: 5980646 - DNA, 18 bp, Homo sapiens
cacatcagcatgttttct

SEQ ID NO: 5980647 - DNA, 12 bp, Homo sapiens
cacatcagcccc

SEQ ID NO: 5980648 - DNA, 16 bp, Homo sapiens
cacatcagccccacag

SEQ ID NO: 5980649 - DNA, 20 bp, Homo sapiens
cacatcagccccacaggact

SEQ ID NO: 5980650 - DNA, 18 bp, Homo sapiens
cacatcagctagcaaaag

SEQ ID NO: 5980651 - DNA, 14 bp, Homo sapiens
cacatcaggaaaga

SEQ ID NO: 5980652 - DNA, 21 bp, Homo sapiens
cacatcagggcggcctcccag

SEQ ID NO: 5980653 - DNA, 19 bp, Homo sapiens
cacatcataaacaaagagt

SEQ ID NO: 5980654 - DNA, 22 bp, Homo sapiens
cacatcatagataaagctgatt

SEQ ID NO: 5980655 - DNA, 19 bp, Homo sapiens
cacatcatctgtaagctgt

SEQ ID NO: 5980656 - DNA, 21 bp, Homo sapiens
cacatcatctttatctcctgg

SEQ ID NO: 5980657 - DNA, 16 bp, Homo sapiens
cacatcatgagccttc

SEQ ID NO: 5980658 - DNA, 14 bp, Homo sapiens
cacatcattggaat

SEQ ID NO: 5980659 - DNA, 13 bp, Homo sapiens
cacatcatttggg

SEQ ID NO: 5980660 - DNA, 13 bp, Homo sapiens
cacatccaaacat

SEQ ID NO: 5980661 - DNA, 18 bp, Homo sapiens
cacatccaactccagcaa

SEQ ID NO: 5980662 - DNA, 21 bp, Homo sapiens
cacatccaccaaactcctgcc

SEQ ID NO: 5980663 - DNA, 16 bp, Homo sapiens
cacatccaccccagcc

SEQ ID NO: 5980664 - DNA, 19 bp, Homo sapiens
cacatccagctgcccctcc

SEQ ID NO: 5980665 - DNA, 18 bp, Homo sapiens
cacatccaggcaatggcc

SEQ ID NO: 5980666 - DNA, 21 bp, Homo sapiens
cacatccaggcaatggcctaa

SEQ ID NO: 5980667 - DNA, 19 bp, Homo sapiens
cacatccatcagcacccca

SEQ ID NO: 5980668 - DNA, 13 bp, Homo sapiens
cacatccatctac

SEQ ID NO: 5980669 - DNA, 13 bp, Homo sapiens
cacatccattcca

SEQ ID NO: 5980670 - DNA, 13 bp, Homo sapiens
cacatccattccc

SEQ ID NO: 5980671 - DNA, 13 bp, Homo sapiens
cacatcccacccc

SEQ ID NO: 5980672 - DNA, 13 bp, Homo sapiens
cacatcccactgg

SEQ ID NO: 5980673 - DNA, 14 bp, Homo sapiens
cacatcccagcagc

SEQ ID NO: 5980674 - DNA, 16 bp, Homo sapiens
cacatcccagcagccc

SEQ ID NO: 5980675 - DNA, 16 bp, Homo sapiens
cacatcccatgttgaa

SEQ ID NO: 5980676 - DNA, 15 bp, Homo sapiens
cacatccccaccctc

SEQ ID NO: 5980677 - DNA, 20 bp, Homo sapiens
cacatccccaccctcccctc

SEQ ID NO: 5980678 - DNA, 23 bp, Homo sapiens
cacatccccaccctcccctctcc

SEQ ID NO: 5980679 - DNA, 14 bp, Homo sapiens
cacatccccacctt

SEQ ID NO: 5980680 - DNA, 14 bp, Homo sapiens
cacatccccagaat

SEQ ID NO: 5980681 - DNA, 16 bp, Homo sapiens
cacatccccagagccc

SEQ ID NO: 5980682 - DNA, 22 bp, Homo sapiens
cacatccccagagcccagctct

SEQ ID NO: 5980683 - DNA, 22 bp, Homo sapiens
cacatcccccgtgtattcagga

SEQ ID NO: 5980684 - DNA, 19 bp, Homo sapiens
cacatcccggcctcttcca

SEQ ID NO: 5980685 - DNA, 21 bp, Homo sapiens
cacatccctatagaccactgg

SEQ ID NO: 5980686 - DNA, 12 bp, Homo sapiens
cacatccctcta

SEQ ID NO: 5980687 - DNA, 15 bp, Homo sapiens
cacatccctctcctc

SEQ ID NO: 5980688 - DNA, 14 bp, Homo sapiens
cacatccctgggcc

SEQ ID NO: 5980689 - DNA, 15 bp, Homo sapiens
cacatccctgggcct

SEQ ID NO: 5980690 - DNA, 16 bp, Homo sapiens
cacatccctgggcctg

SEQ ID NO: 5980691 - DNA, 17 bp, Homo sapiens
cacatccctgggcctgc

SEQ ID NO: 5980692 - DNA, 18 bp, Homo sapiens
cacatccctgggcctgct

SEQ ID NO: 5980693 - DNA, 21 bp, Homo sapiens
cacatccctgggcctgctgct

SEQ ID NO: 5980694 - DNA, 17 bp, Homo sapiens
cacatcctcagaaagtg

SEQ ID NO: 5980695 - DNA, 22 bp, Homo sapiens
cacatcctccacgttctgctca

SEQ ID NO: 5980696 - DNA, 14 bp, Homo sapiens
cacatcctccgtcc

SEQ ID NO: 5980697 - DNA, 12 bp, Homo sapiens
cacatcctcctg

SEQ ID NO: 5980698 - DNA, 14 bp, Homo sapiens
cacatcctgtgtca

SEQ ID NO: 5980699 - DNA, 16 bp, Homo sapiens
cacatccttctcactg

SEQ ID NO: 5980700 - DNA, 17 bp, Homo sapiens
cacatccttctcactgc

SEQ ID NO: 5980701 - DNA, 21 bp, Homo sapiens
cacatccttcttggcttcctg

SEQ ID NO: 5980702 - DNA, 22 bp, Homo sapiens
cacatccttcttggcttcctgg

SEQ ID NO: 5980703 - DNA, 23 bp, Homo sapiens
cacatccttcttggcttcctggc

SEQ ID NO: 5980704 - DNA, 19 bp, Homo sapiens
cacatccttgactttttag

SEQ ID NO: 5980705 - DNA, 19 bp, Homo sapiens
cacatcgcagattctccct

SEQ ID NO: 5980706 - DNA, 23 bp, Homo sapiens
cacatcgccagccctgggcctgg

SEQ ID NO: 5980707 - DNA, 19 bp, Homo sapiens
cacatcgttgccgcagcgg

SEQ ID NO: 5980708 - DNA, 13 bp, Homo sapiens
cacatcgttttgg

SEQ ID NO: 5980709 - DNA, 15 bp, Homo sapiens
cacatcgttttgggg

SEQ ID NO: 5980710 - DNA, 18 bp, Homo sapiens
cacatctaaagctttatc

SEQ ID NO: 5980711 - DNA, 23 bp, Homo sapiens
cacatctaaagctttatctttgt

SEQ ID NO: 5980712 - DNA, 22 bp, Homo sapiens
cacatctaaattgatcattcat

SEQ ID NO: 5980713 - DNA, 13 bp, Homo sapiens
cacatctaagcct

SEQ ID NO: 5980714 - DNA, 14 bp, Homo sapiens
cacatctaagcctg

SEQ ID NO: 5980715 - DNA, 22 bp, Homo sapiens
cacatctaagcctgaaggggcg

SEQ ID NO: 5980716 - DNA, 16 bp, Homo sapiens
cacatctaatgtctct

SEQ ID NO: 5980717 - DNA, 15 bp, Homo sapiens
cacatctaattaaat

SEQ ID NO: 5980718 - DNA, 21 bp, Homo sapiens
cacatctatccacactgtcaa

SEQ ID NO: 5980719 - DNA, 13 bp, Homo sapiens
cacatctcacctc

SEQ ID NO: 5980720 - DNA, 15 bp, Homo sapiens
cacatctcacctccg

SEQ ID NO: 5980721 - DNA, 12 bp, Homo sapiens
cacatctcactt

SEQ ID NO: 5980722 - DNA, 14 bp, Homo sapiens
cacatctcacttca

SEQ ID NO: 5980723 - DNA, 23 bp, Homo sapiens
cacatctcacttcagttgtggcc

SEQ ID NO: 5980724 - DNA, 21 bp, Homo sapiens
cacatctcagggaactgaccc

SEQ ID NO: 5980725 - DNA, 22 bp, Homo sapiens
cacatctcctccatactcagga

SEQ ID NO: 5980726 - DNA, 13 bp, Homo sapiens
cacatctctctgc

SEQ ID NO: 5980727 - DNA, 21 bp, Homo sapiens
cacatctctgaaagcacagga

SEQ ID NO: 5980728 - DNA, 22 bp, Homo sapiens
cacatctgaatctccttgttgt

SEQ ID NO: 5980729 - DNA, 18 bp, Homo sapiens
cacatctgcacactctct

SEQ ID NO: 5980730 - DNA, 15 bp, Homo sapiens
cacatctgccagacc

SEQ ID NO: 5980731 - DNA, 13 bp, Homo sapiens
cacatctgcctta

SEQ ID NO: 5980732 - DNA, 15 bp, Homo sapiens
cacatctgctctagg

SEQ ID NO: 5980733 - DNA, 14 bp, Homo sapiens
cacatctggccctg

SEQ ID NO: 5980734 - DNA, 16 bp, Homo sapiens
cacatctggccctgac

SEQ ID NO: 5980735 - DNA, 13 bp, Homo sapiens
cacatctggctgc

SEQ ID NO: 5980736 - DNA, 21 bp, Homo sapiens
cacatctggctgcacaggctg

SEQ ID NO: 5980737 - DNA, 24 bp, Homo sapiens
cacatctgtaatcctagctacttg

SEQ ID NO: 5980738 - DNA, 20 bp, Homo sapiens
cacatctgtatatcagctct

SEQ ID NO: 5980739 - DNA, 13 bp, Homo sapiens
cacatctgtcctc

SEQ ID NO: 5980740 - DNA, 14 bp, Homo sapiens
cacatctgtcctca

SEQ ID NO: 5980741 - DNA, 18 bp, Homo sapiens
cacatctgtcctgacaga

SEQ ID NO: 5980742 - DNA, 19 bp, Homo sapiens
cacatctgtgtctctggaa

SEQ ID NO: 5980743 - DNA, 16 bp, Homo sapiens
cacatctgtgtcttgt

SEQ ID NO: 5980744 - DNA, 14 bp, Homo sapiens
cacatcttaaaagt

SEQ ID NO: 5980745 - DNA, 16 bp, Homo sapiens
cacatcttaaaagtgt

SEQ ID NO: 5980746 - DNA, 15 bp, Homo sapiens
cacatcttaattaag

SEQ ID NO: 5980747 - DNA, 15 bp, Homo sapiens
cacatcttacctctc

SEQ ID NO: 5980748 - DNA, 13 bp, Homo sapiens
cacatcttcaggc

SEQ ID NO: 5980749 - DNA, 14 bp, Homo sapiens
cacatcttcatgtg

SEQ ID NO: 5980750 - DNA, 18 bp, Homo sapiens
cacatcttcatgtggaca

SEQ ID NO: 5980751 - DNA, 16 bp, Homo sapiens
cacatcttctcagtgt

SEQ ID NO: 5980752 - DNA, 12 bp, Homo sapiens
cacatcttgaaa

SEQ ID NO: 5980753 - DNA, 16 bp, Homo sapiens
cacatcttgaaaatgc

SEQ ID NO: 5980754 - DNA, 18 bp, Homo sapiens
cacatcttgaaaatgcca

SEQ ID NO: 5980755 - DNA, 12 bp, Homo sapiens
cacatcttgctc

SEQ ID NO: 5980756 - DNA, 14 bp, Homo sapiens
cacatcttgctctg

SEQ ID NO: 5980757 - DNA, 15 bp, Homo sapiens
cacatcttgctctgc

SEQ ID NO: 5980758 - DNA, 18 bp, Homo sapiens
cacatcttgctctgctga

SEQ ID NO: 5980759 - DNA, 13 bp, Homo sapiens
cacatcttgtctt

SEQ ID NO: 5980760 - DNA, 20 bp, Homo sapiens
cacatctttaacttagtatt

SEQ ID NO: 5980761 - DNA, 12 bp, Homo sapiens
cacatctttcac

SEQ ID NO: 5980762 - DNA, 19 bp, Homo sapiens
cacatctttcacacttcca

SEQ ID NO: 5980763 - DNA, 21 bp, Homo sapiens
cacatctttcacacttccacc

SEQ ID NO: 5980764 - DNA, 15 bp, Homo sapiens
cacatgaacagcttg

SEQ ID NO: 5980765 - DNA, 22 bp, Homo sapiens
cacatgaaccatccttcccatg

SEQ ID NO: 5980766 - DNA, 14 bp, Homo sapiens
cacatgaagaaata

SEQ ID NO: 5980767 - DNA, 22 bp, Homo sapiens
cacatgaagaaatactgcactt

SEQ ID NO: 5980768 - DNA, 21 bp, Homo sapiens
cacatgaaggagacagcagca

SEQ ID NO: 5980769 - DNA, 16 bp, Homo sapiens
cacatgaagtccaagc

SEQ ID NO: 5980770 - DNA, 17 bp, Homo sapiens
cacatgaagtccaagca

SEQ ID NO: 5980771 - DNA, 14 bp, Homo sapiens
cacatgaataattt

SEQ ID NO: 5980772 - DNA, 16 bp, Homo sapiens
cacatgaataatttca

SEQ ID NO: 5980773 - DNA, 15 bp, Homo sapiens
cacatgaatgcagtc

SEQ ID NO: 5980774 - DNA, 17 bp, Homo sapiens
cacatgacatccacatg

SEQ ID NO: 5980775 - DNA, 19 bp, Homo sapiens
cacatgacatttgtcctgc

SEQ ID NO: 5980776 - DNA, 21 bp, Homo sapiens
cacatgacgccagataaaatg

SEQ ID NO: 5980777 - DNA, 20 bp, Homo sapiens
cacatgacttattatgcata

SEQ ID NO: 5980778 - DNA, 16 bp, Homo sapiens
cacatgagaagtgata

SEQ ID NO: 5980779 - DNA, 18 bp, Homo sapiens
cacatgagcatcaggcca

SEQ ID NO: 5980780 - DNA, 18 bp, Homo sapiens
cacatgagctatttccat

SEQ ID NO: 5980781 - DNA, 20 bp, Homo sapiens
cacatgaggagggtgccctc

SEQ ID NO: 5980782 - DNA, 22 bp, Homo sapiens
cacatgaggccatctcaggaga

SEQ ID NO: 5980783 - DNA, 15 bp, Homo sapiens
cacatgagtcccagt

SEQ ID NO: 5980784 - DNA, 14 bp, Homo sapiens
cacatgattctcct

SEQ ID NO: 5980785 - DNA, 19 bp, Homo sapiens
cacatgattgtataagcat

SEQ ID NO: 5980786 - DNA, 14 bp, Homo sapiens
cacatgatttcaca

SEQ ID NO: 5980787 - DNA, 20 bp, Homo sapiens
cacatgcaaggtcatttttt

SEQ ID NO: 5980788 - DNA, 13 bp, Homo sapiens
cacatgcacacac

SEQ ID NO: 5980789 - DNA, 14 bp, Homo sapiens
cacatgcacacaca

SEQ ID NO: 5980790 - DNA, 20 bp, Homo sapiens
cacatgcaccacgcccggct

SEQ ID NO: 5980791 - DNA, 20 bp, Homo sapiens
cacatgcacttttgggcctt

SEQ ID NO: 5980792 - DNA, 14 bp, Homo sapiens
cacatgcatacaca

SEQ ID NO: 5980793 - DNA, 18 bp, Homo sapiens
cacatgcatcatcagcct

SEQ ID NO: 5980794 - DNA, 18 bp, Homo sapiens
cacatgcatgtctgccta

SEQ ID NO: 5980795 - DNA, 20 bp, Homo sapiens
cacatgcatgtctgcctatg

SEQ ID NO: 5980796 - DNA, 13 bp, Homo sapiens
cacatgccactgc

SEQ ID NO: 5980797 - DNA, 19 bp, Homo sapiens
cacatgccaggggcctttg

SEQ ID NO: 5980798 - DNA, 14 bp, Homo sapiens
cacatgccccatcc

SEQ ID NO: 5980799 - DNA, 21 bp, Homo sapiens
cacatgccccatcccatgctg

SEQ ID NO: 5980800 - DNA, 12 bp, Homo sapiens
cacatgcccctc

SEQ ID NO: 5980801 - DNA, 17 bp, Homo sapiens
cacatgcccctccccca

SEQ ID NO: 5980802 - DNA, 19 bp, Homo sapiens
cacatgcccctcttagaag

SEQ ID NO: 5980803 - DNA, 13 bp, Homo sapiens
cacatgcccgctg

SEQ ID NO: 5980804 - DNA, 16 bp, Homo sapiens
cacatgccctcctgga

SEQ ID NO: 5980805 - DNA, 20 bp, Homo sapiens
cacatgccgcccccagcagc

SEQ ID NO: 5980806 - DNA, 13 bp, Homo sapiens
cacatgcctctct

SEQ ID NO: 5980807 - DNA, 13 bp, Homo sapiens
cacatgcctctgt

SEQ ID NO: 5980808 - DNA, 14 bp, Homo sapiens
cacatgcctgcgcc

SEQ ID NO: 5980809 - DNA, 15 bp, Homo sapiens
cacatgccttctaaa

SEQ ID NO: 5980810 - DNA, 13 bp, Homo sapiens
cacatgcgcactc

SEQ ID NO: 5980811 - DNA, 18 bp, Homo sapiens
cacatgcgctcctggctt

SEQ ID NO: 5980812 - DNA, 23 bp, Homo sapiens
cacatgcgctcctggcttttaaa

SEQ ID NO: 5980813 - DNA, 18 bp, Homo sapiens
cacatgcgggctcgccca

SEQ ID NO: 5980814 - DNA, 15 bp, Homo sapiens
cacatgctatgttct

SEQ ID NO: 5980815 - DNA, 15 bp, Homo sapiens
cacatgctattgtct

SEQ ID NO: 5980816 - DNA, 23 bp, Homo sapiens
cacatgctctaagaagctcgttt

SEQ ID NO: 5980817 - DNA, 14 bp, Homo sapiens
cacatgctgcctgg

SEQ ID NO: 5980818 - DNA, 21 bp, Homo sapiens
cacatgctgcctggcacagac

SEQ ID NO: 5980819 - DNA, 19 bp, Homo sapiens
cacatgctggacaggtctg

SEQ ID NO: 5980820 - DNA, 14 bp, Homo sapiens
cacatgctggccag

SEQ ID NO: 5980821 - DNA, 14 bp, Homo sapiens
cacatgctggctcc

SEQ ID NO: 5980822 - DNA, 17 bp, Homo sapiens
cacatgctgtctggccc

SEQ ID NO: 5980823 - DNA, 20 bp, Homo sapiens
cacatgctgttggcctcaag

SEQ ID NO: 5980824 - DNA, 12 bp, Homo sapiens
cacatgcttcaa

SEQ ID NO: 5980825 - DNA, 20 bp, Homo sapiens
cacatgcttgaatggagctg

SEQ ID NO: 5980826 - DNA, 21 bp, Homo sapiens
cacatgcttgatggtttatgt

SEQ ID NO: 5980827 - DNA, 18 bp, Homo sapiens
cacatgcttttcttccta

SEQ ID NO: 5980828 - DNA, 11 bp, Homo sapiens
cacatggaaaa

SEQ ID NO: 5980829 - DNA, 20 bp, Homo sapiens
cacatggaaaaaaaaaaaac

SEQ ID NO: 5980830 - DNA, 16 bp, Homo sapiens
cacatggaacttaaaa

SEQ ID NO: 5980831 - DNA, 17 bp, Homo sapiens
cacatggaaggtgatgg

SEQ ID NO: 5980832 - DNA, 17 bp, Homo sapiens
cacatggaatgagggtt

SEQ ID NO: 5980833 - DNA, 20 bp, Homo sapiens
cacatggagccccctctgcc

SEQ ID NO: 5980834 - DNA, 12 bp, Homo sapiens
cacatggagctc

SEQ ID NO: 5980835 - DNA, 14 bp, Homo sapiens
cacatggaggagac

SEQ ID NO: 5980836 - DNA, 20 bp, Homo sapiens
cacatggattttggcagggc

SEQ ID NO: 5980837 - DNA, 20 bp, Homo sapiens
cacatggcaaggggtctcct

SEQ ID NO: 5980838 - DNA, 11 bp, Homo sapiens
cacatggcaga

SEQ ID NO: 5980839 - DNA, 15 bp, Homo sapiens
cacatggcagatgat

SEQ ID NO: 5980840 - DNA, 14 bp, Homo sapiens
cacatggcatgttt

SEQ ID NO: 5980841 - DNA, 19 bp, Homo sapiens
cacatggccatagaggccc

SEQ ID NO: 5980842 - DNA, 20 bp, Homo sapiens
cacatggccatagaggccca

SEQ ID NO: 5980843 - DNA, 23 bp, Homo sapiens
cacatggccgctgcccacgtccc

SEQ ID NO: 5980844 - DNA, 13 bp, Homo sapiens
cacatggcctgag

SEQ ID NO: 5980845 - DNA, 18 bp, Homo sapiens
cacatggctatgttttag

SEQ ID NO: 5980846 - DNA, 14 bp, Homo sapiens
cacatggctggggg

SEQ ID NO: 5980847 - DNA, 23 bp, Homo sapiens
cacatggctgggggagggactgc

SEQ ID NO: 5980848 - DNA, 18 bp, Homo sapiens
cacatggcttcctaaatg

SEQ ID NO: 5980849 - DNA, 14 bp, Homo sapiens
cacatgggacctgg

SEQ ID NO: 5980850 - DNA, 15 bp, Homo sapiens
cacatgggacctggc

SEQ ID NO: 5980851 - DNA, 22 bp, Homo sapiens
cacatgggagcagtccatgcat

SEQ ID NO: 5980852 - DNA, 15 bp, Homo sapiens
cacatgggcagccca

SEQ ID NO: 5980853 - DNA, 19 bp, Homo sapiens
cacatgggcttgtgacatt

SEQ ID NO: 5980854 - DNA, 22 bp, Homo sapiens
cacatggggcctggcccacgcc

SEQ ID NO: 5980855 - DNA, 15 bp, Homo sapiens
cacatgggggagaga

SEQ ID NO: 5980856 - DNA, 16 bp, Homo sapiens
cacatggggttcctgg

SEQ ID NO: 5980857 - DNA, 17 bp, Homo sapiens
cacatggggttcctggt

SEQ ID NO: 5980858 - DNA, 18 bp, Homo sapiens
cacatggggttcctggtt

SEQ ID NO: 5980859 - DNA, 22 bp, Homo sapiens
cacatggtccatttcatgtgat

SEQ ID NO: 5980860 - DNA, 20 bp, Homo sapiens
cacatggtgctacgcctgca

SEQ ID NO: 5980861 - DNA, 17 bp, Homo sapiens
cacatggtgtctcccaa

SEQ ID NO: 5980862 - DNA, 13 bp, Homo sapiens
cacatgtaaaata

SEQ ID NO: 5980863 - DNA, 14 bp, Homo sapiens
cacatgtaaaatat

SEQ ID NO: 5980864 - DNA, 18 bp, Homo sapiens
cacatgtaaaatatgtaa

SEQ ID NO: 5980865 - DNA, 14 bp, Homo sapiens
cacatgtacatatg

SEQ ID NO: 5980866 - DNA, 21 bp, Homo sapiens
cacatgtattctgttggccag

SEQ ID NO: 5980867 - DNA, 19 bp, Homo sapiens
cacatgtcaccgtggacct

SEQ ID NO: 5980868 - DNA, 22 bp, Homo sapiens
cacatgtcaccgtggaccttcc

SEQ ID NO: 5980869 - DNA, 21 bp, Homo sapiens
cacatgtcagcaagtcctaag

SEQ ID NO: 5980870 - DNA, 20 bp, Homo sapiens
cacatgtcagtaccttcaaa

SEQ ID NO: 5980871 - DNA, 21 bp, Homo sapiens
cacatgtccaagaagcccagg

SEQ ID NO: 5980872 - DNA, 17 bp, Homo sapiens
cacatgtccttgtgtgt

SEQ ID NO: 5980873 - DNA, 16 bp, Homo sapiens
cacatgtctgtcctca

SEQ ID NO: 5980874 - DNA, 20 bp, Homo sapiens
cacatgtctgtcctcagagc

SEQ ID NO: 5980875 - DNA, 23 bp, Homo sapiens
cacatgtcttaatgaagtttgaa

SEQ ID NO: 5980876 - DNA, 14 bp, Homo sapiens
cacatgtgaaaacc

SEQ ID NO: 5980877 - DNA, 22 bp, Homo sapiens
cacatgtgagcatgtcacttcc

SEQ ID NO: 5980878 - DNA, 14 bp, Homo sapiens
cacatgtgcacatg

SEQ ID NO: 5980879 - DNA, 17 bp, Homo sapiens
cacatgtgcacatgcac

SEQ ID NO: 5980880 - DNA, 19 bp, Homo sapiens
cacatgtgccactgttcag

SEQ ID NO: 5980881 - DNA, 15 bp, Homo sapiens
cacatgtgccctgcc

SEQ ID NO: 5980882 - DNA, 17 bp, Homo sapiens
cacatgtgccctgcctt

SEQ ID NO: 5980883 - DNA, 20 bp, Homo sapiens
cacatgtgctgatgtttaca

SEQ ID NO: 5980884 - DNA, 17 bp, Homo sapiens
cacatgtggctccccct

SEQ ID NO: 5980885 - DNA, 12 bp, Homo sapiens
cacatgtgtggt

SEQ ID NO: 5980886 - DNA, 19 bp, Homo sapiens
cacatgttactgcttcatt

SEQ ID NO: 5980887 - DNA, 12 bp, Homo sapiens
cacatgttcata

SEQ ID NO: 5980888 - DNA, 13 bp, Homo sapiens
cacatgttctaat

SEQ ID NO: 5980889 - DNA, 16 bp, Homo sapiens
cacatgttgttctcat

SEQ ID NO: 5980890 - DNA, 14 bp, Homo sapiens
cacatgtttatatt

SEQ ID NO: 5980891 - DNA, 16 bp, Homo sapiens
cacatgtttattcatg

SEQ ID NO: 5980892 - DNA, 12 bp, Homo sapiens
cacatgtttcct

SEQ ID NO: 5980893 - DNA, 14 bp, Homo sapiens
cacatgtttcctct

SEQ ID NO: 5980894 - DNA, 15 bp, Homo sapiens
cacatgttttctctg

SEQ ID NO: 5980895 - DNA, 19 bp, Homo sapiens
cacattaaaaaatgaaata

SEQ ID NO: 5980896 - DNA, 16 bp, Homo sapiens
cacattaaaaaggaaa

SEQ ID NO: 5980897 - DNA, 16 bp, Homo sapiens
cacattaaagaagacc

SEQ ID NO: 5980898 - DNA, 20 bp, Homo sapiens
cacattaaagaagacctgag

SEQ ID NO: 5980899 - DNA, 15 bp, Homo sapiens
cacattaaatgactc

SEQ ID NO: 5980900 - DNA, 13 bp, Homo sapiens
cacattaaattga

SEQ ID NO: 5980901 - DNA, 18 bp, Homo sapiens
cacattaacattttgagc

SEQ ID NO: 5980902 - DNA, 15 bp, Homo sapiens
cacattaactccctc

SEQ ID NO: 5980903 - DNA, 24 bp, Homo sapiens
cacattaactccctccaccagcct

SEQ ID NO: 5980904 - DNA, 23 bp, Homo sapiens
cacattaagccttccacactcac

SEQ ID NO: 5980905 - DNA, 17 bp, Homo sapiens
cacattaagtggctttt

SEQ ID NO: 5980906 - DNA, 14 bp, Homo sapiens
cacattaataaaca

SEQ ID NO: 5980907 - DNA, 23 bp, Homo sapiens
caaatgtgcaatttgtaaatatt

SEQ ID NO: 5980908 - DNA, 17 bp, Homo sapiens
caaatgtgccatactaa

SEQ ID NO: 5980909 - DNA, 20 bp, Homo sapiens
caaatgtggccaagcctatc

SEQ ID NO: 5980910 - DNA, 18 bp, Homo sapiens
caaatgtggctgtaaaac

SEQ ID NO: 5980911 - DNA, 17 bp, Homo sapiens
caaatgtgtacacctgc

SEQ ID NO: 5980912 - DNA, 20 bp, Homo sapiens
caaatgtgtacatggcagag

SEQ ID NO: 5980913 - DNA, 21 bp, Homo sapiens
caaatgtgtataaactgctgt

SEQ ID NO: 5980914 - DNA, 17 bp, Homo sapiens
caaatgtgtataatttt

SEQ ID NO: 5980915 - DNA, 17 bp, Homo sapiens
caaatgtgtatttttgt

SEQ ID NO: 5980916 - DNA, 14 bp, Homo sapiens
caaatgtgtcagaa

SEQ ID NO: 5980917 - DNA, 21 bp, Homo sapiens
caaatgtgtcttgtattatca

SEQ ID NO: 5980918 - DNA, 18 bp, Homo sapiens
caaatgtgtgttcctgct

SEQ ID NO: 5980919 - DNA, 15 bp, Homo sapiens
caaatgttaaaatgt

SEQ ID NO: 5980920 - DNA, 19 bp, Homo sapiens
caaatgttaaaatgtgttg

SEQ ID NO: 5980921 - DNA, 15 bp, Homo sapiens
caaatgttaacagag

SEQ ID NO: 5980922 - DNA, 16 bp, Homo sapiens
caaatgttacaaaaaa

SEQ ID NO: 5980923 - DNA, 17 bp, Homo sapiens
caaatgttacagtttat

SEQ ID NO: 5980924 - DNA, 15 bp, Homo sapiens
caaatgttacatagt

SEQ ID NO: 5980925 - DNA, 23 bp, Homo sapiens
caaatgttagacttgtgtgcatg

SEQ ID NO: 5980926 - DNA, 20 bp, Homo sapiens
caaatgttcatatttattga

SEQ ID NO: 5980927 - DNA, 19 bp, Homo sapiens
caaatgttctaagtttcta

SEQ ID NO: 5980928 - DNA, 13 bp, Homo sapiens
caaatgttgacct

SEQ ID NO: 5980929 - DNA, 17 bp, Homo sapiens
caaatgttgtcctgtta

SEQ ID NO: 5980930 - DNA, 15 bp, Homo sapiens
caaatgtttaatcat

SEQ ID NO: 5980931 - DNA, 17 bp, Homo sapiens
caaatgtttacagggag

SEQ ID NO: 5980932 - DNA, 15 bp, Homo sapiens
caaatgtttacattt

SEQ ID NO: 5980933 - DNA, 16 bp, Homo sapiens
caaatgtttatttaaa

SEQ ID NO: 5980934 - DNA, 14 bp, Homo sapiens
caaatgtttatttt

SEQ ID NO: 5980935 - DNA, 13 bp, Homo sapiens
caaatgtttcctt

SEQ ID NO: 5980936 - DNA, 14 bp, Homo sapiens
caaatgtttcctta

SEQ ID NO: 5980937 - DNA, 15 bp, Homo sapiens
caaatgtttccttaa

SEQ ID NO: 5980938 - DNA, 11 bp, Homo sapiens
caaatgtttct

SEQ ID NO: 5980939 - DNA, 15 bp, Homo sapiens
caaatgttttctgca

SEQ ID NO: 5980940 - DNA, 17 bp, Homo sapiens
caaatgttttgaaatga

SEQ ID NO: 5980941 - DNA, 15 bp, Homo sapiens
caaatgttttgacat

SEQ ID NO: 5980942 - DNA, 21 bp, Homo sapiens
caaattaaaaaaaaattgtat

SEQ ID NO: 5980943 - DNA, 14 bp, Homo sapiens
caaattaaaaagat

SEQ ID NO: 5980944 - DNA, 18 bp, Homo sapiens
caaattaaaaagattctt

SEQ ID NO: 5980945 - DNA, 23 bp, Homo sapiens
caaattaaaaagattctttttct

SEQ ID NO: 5980946 - DNA, 15 bp, Homo sapiens
caaattaaaacaaat

SEQ ID NO: 5980947 - DNA, 19 bp, Homo sapiens
caaattaaaacaaatatac

SEQ ID NO: 5980948 - DNA, 20 bp, Homo sapiens
caaattaaaacatatttcat

SEQ ID NO: 5980949 - DNA, 21 bp, Homo sapiens
caaattaaaacatatttcatt

SEQ ID NO: 5980950 - DNA, 20 bp, Homo sapiens
caaattaaagtgctgtttag

SEQ ID NO: 5980951 - DNA, 15 bp, Homo sapiens
caaattaaataaatt

SEQ ID NO: 5980952 - DNA, 18 bp, Homo sapiens
caaattaactaaggaaat

SEQ ID NO: 5980953 - DNA, 18 bp, Homo sapiens
caaattaagatggtaaga

SEQ ID NO: 5980954 - DNA, 16 bp, Homo sapiens
caaattaataatctta

SEQ ID NO: 5980955 - DNA, 14 bp, Homo sapiens
caaattaatacaat

SEQ ID NO: 5980956 - DNA, 17 bp, Homo sapiens
caaattaatatttgtgc

SEQ ID NO: 5980957 - DNA, 12 bp, Homo sapiens
caaattaatctt

SEQ ID NO: 5980958 - DNA, 13 bp, Homo sapiens
caaattaatcttt

SEQ ID NO: 5980959 - DNA, 15 bp, Homo sapiens
caaattaatctttta

SEQ ID NO: 5980960 - DNA, 20 bp, Homo sapiens
caaattaattggcagcagat

SEQ ID NO: 5980961 - DNA, 12 bp, Homo sapiens
caaattaattgt

SEQ ID NO: 5980962 - DNA, 16 bp, Homo sapiens
caaattaattgtgtga

SEQ ID NO: 5980963 - DNA, 13 bp, Homo sapiens
caaattaatttta

SEQ ID NO: 5980964 - DNA, 23 bp, Homo sapiens
caaattacaaaaggctcgtttgg

SEQ ID NO: 5980965 - DNA, 14 bp, Homo sapiens
caaattacaagtat

SEQ ID NO: 5980966 - DNA, 21 bp, Homo sapiens
caaattacaagtattcagttc

SEQ ID NO: 5980967 - DNA, 13 bp, Homo sapiens
caaattaccaaat

SEQ ID NO: 5980968 - DNA, 16 bp, Homo sapiens
caaattactctttctc

SEQ ID NO: 5980969 - DNA, 19 bp, Homo sapiens
caaattactctttctccat

SEQ ID NO: 5980970 - DNA, 15 bp, Homo sapiens
caaattactgataaa

SEQ ID NO: 5980971 - DNA, 21 bp, Homo sapiens
caaattactttgtgaatagaa

SEQ ID NO: 5980972 - DNA, 11 bp, Homo sapiens
caaattagaaa

SEQ ID NO: 5980973 - DNA, 13 bp, Homo sapiens
caaattagaaaat

SEQ ID NO: 5980974 - DNA, 22 bp, Homo sapiens
caaattagaaaatgttatttaa

SEQ ID NO: 5980975 - DNA, 12 bp, Homo sapiens
caaattagaaac

SEQ ID NO: 5980976 - DNA, 17 bp, Homo sapiens
caaattagaatagaact

SEQ ID NO: 5980977 - DNA, 23 bp, Homo sapiens
caaattagcaggtgcaccttctg

SEQ ID NO: 5980978 - DNA, 17 bp, Homo sapiens
caaattaggaagtgttt

SEQ ID NO: 5980979 - DNA, 15 bp, Homo sapiens
caaattagggcaatt

SEQ ID NO: 5980980 - DNA, 20 bp, Homo sapiens
caaattaggttttgtacaat

SEQ ID NO: 5980981 - DNA, 15 bp, Homo sapiens
caaattagttatata

SEQ ID NO: 5980982 - DNA, 13 bp, Homo sapiens
caaattataaaaa

SEQ ID NO: 5980983 - DNA, 19 bp, Homo sapiens
caaattataaaaagccact

SEQ ID NO: 5980984 - DNA, 24 bp, Homo sapiens
caaattataagagacagacacttg

SEQ ID NO: 5980985 - DNA, 19 bp, Homo sapiens
caaattataagggccctgc

SEQ ID NO: 5980986 - DNA, 14 bp, Homo sapiens
caaattatagaaac

SEQ ID NO: 5980987 - DNA, 23 bp, Homo sapiens
caaattatagaaacaatactgtt

SEQ ID NO: 5980988 - DNA, 17 bp, Homo sapiens
caaattatatgctaatt

SEQ ID NO: 5980989 - DNA, 22 bp, Homo sapiens
caaattatatgctaattaaata

SEQ ID NO: 5980990 - DNA, 18 bp, Homo sapiens
caaattatcaagctaata

SEQ ID NO: 5980991 - DNA, 20 bp, Homo sapiens
caaattatcaagctaataaa

SEQ ID NO: 5980992 - DNA, 21 bp, Homo sapiens
caaattatcaagctaataaaa

SEQ ID NO: 5980993 - DNA, 13 bp, Homo sapiens
caaattatcttga

SEQ ID NO: 5980994 - DNA, 21 bp, Homo sapiens
caaattatgctaagaattttt

SEQ ID NO: 5980995 - DNA, 15 bp, Homo sapiens
caaattattaatgaa

SEQ ID NO: 5980996 - DNA, 15 bp, Homo sapiens
caaattattaattgt

SEQ ID NO: 5980997 - DNA, 17 bp, Homo sapiens
caaattattaattgtcc

SEQ ID NO: 5980998 - DNA, 14 bp, Homo sapiens
caaattattctagt

SEQ ID NO: 5980999 - DNA, 16 bp, Homo sapiens
caaattattctagtca

SEQ ID NO: 5981000 - DNA, 17 bp, Homo sapiens
caaattattctagtcaa

SEQ ID NO: 5981001 - DNA, 15 bp, Homo sapiens
caaattatttattac

SEQ ID NO: 5981002 - DNA, 17 bp, Homo sapiens
caaattatttattactt

SEQ ID NO: 5981003 - DNA, 15 bp, Homo sapiens
caaattatttgtgta

SEQ ID NO: 5981004 - DNA, 14 bp, Homo sapiens
caaattattttaat

SEQ ID NO: 5981005 - DNA, 23 bp, Homo sapiens
caaattattttaatattttgtat

SEQ ID NO: 5981006 - DNA, 15 bp, Homo sapiens
caaattcaaaagtaa

SEQ ID NO: 5981007 - DNA, 13 bp, Homo sapiens
caaattcaaagaa

SEQ ID NO: 5981008 - DNA, 20 bp, Homo sapiens
caaattcaagagcctcccct

SEQ ID NO: 5981009 - DNA, 21 bp, Homo sapiens
caaattcaagagcctcccctg

SEQ ID NO: 5981010 - DNA, 22 bp, Homo sapiens
caaattcaagagctagaaaaat

SEQ ID NO: 5981011 - DNA, 14 bp, Homo sapiens
caaattcaaggcct

SEQ ID NO: 5981012 - DNA, 18 bp, Homo sapiens
caaattcaaggccttcca

SEQ ID NO: 5981013 - DNA, 16 bp, Homo sapiens
caaattcagctctgat

SEQ ID NO: 5981014 - DNA, 18 bp, Homo sapiens
caaattcagtggacattt

SEQ ID NO: 5981015 - DNA, 15 bp, Homo sapiens
caaattcagtttcat

SEQ ID NO: 5981016 - DNA, 18 bp, Homo sapiens
caaattcagtttcataaa

SEQ ID NO: 5981017 - DNA, 20 bp, Homo sapiens
caaattcagtttcataaaag

SEQ ID NO: 5981018 - DNA, 15 bp, Homo sapiens
caaattcatataaaa

SEQ ID NO: 5981019 - DNA, 19 bp, Homo sapiens
caaattcattcccttctct

SEQ ID NO: 5981020 - DNA, 23 bp, Homo sapiens
caaattcattcccttctctcagc

SEQ ID NO: 5981021 - DNA, 14 bp, Homo sapiens
caaattcattttta

SEQ ID NO: 5981022 - DNA, 15 bp, Homo sapiens
caaattcatttttaa

SEQ ID NO: 5981023 - DNA, 15 bp, Homo sapiens
caaattccatcacat

SEQ ID NO: 5981024 - DNA, 21 bp, Homo sapiens
caaattcccagatttgaagac

SEQ ID NO: 5981025 - DNA, 14 bp, Homo sapiens
caaattcctgcaaa

SEQ ID NO: 5981026 - DNA, 23 bp, Homo sapiens
caaattcctttcagagttttact

SEQ ID NO: 5981027 - DNA, 15 bp, Homo sapiens
caaattctactttaa

SEQ ID NO: 5981028 - DNA, 21 bp, Homo sapiens
caaattctcaacctaccaccc

SEQ ID NO: 5981029 - DNA, 15 bp, Homo sapiens
caaattctcctctct

SEQ ID NO: 5981030 - DNA, 18 bp, Homo sapiens
caaattctgattattaca

SEQ ID NO: 5981031 - DNA, 19 bp, Homo sapiens
caaattctgattattacaa

SEQ ID NO: 5981032 - DNA, 18 bp, Homo sapiens
caaattctgtctctggat

SEQ ID NO: 5981033 - DNA, 14 bp, Homo sapiens
caaattctgtctgg

SEQ ID NO: 5981034 - DNA, 16 bp, Homo sapiens
caaattcttgaataaa

SEQ ID NO: 5981035 - DNA, 16 bp, Homo sapiens
caaattctttagtact

SEQ ID NO: 5981036 - DNA, 23 bp, Homo sapiens
caaattcttttgaattgttacat

SEQ ID NO: 5981037 - DNA, 16 bp, Homo sapiens
caaattctttttttat

SEQ ID NO: 5981038 - DNA, 20 bp, Homo sapiens
caaattgaaagcttccatgt

SEQ ID NO: 5981039 - DNA, 14 bp, Homo sapiens
caaattgagataat

SEQ ID NO: 5981040 - DNA, 20 bp, Homo sapiens
caaattgatgggtgggctag

SEQ ID NO: 5981041 - DNA, 23 bp, Homo sapiens
caaattgattcaaatgttacaaa

SEQ ID NO: 5981042 - DNA, 18 bp, Homo sapiens
caaattgattgtctttcc

SEQ ID NO: 5981043 - DNA, 19 bp, Homo sapiens
caaattgattgtctttccc

SEQ ID NO: 5981044 - DNA, 14 bp, Homo sapiens
caaattgcactgaa

SEQ ID NO: 5981045 - DNA, 14 bp, Homo sapiens
caaattgccttcag

SEQ ID NO: 5981046 - DNA, 19 bp, Homo sapiens
caaattgccttcattttat

SEQ ID NO: 5981047 - DNA, 13 bp, Homo sapiens
caaattgctgaga

SEQ ID NO: 5981048 - DNA, 20 bp, Homo sapiens
caaattgcttactttggaat

SEQ ID NO: 5981049 - DNA, 19 bp, Homo sapiens
caaattgcttgaaagaaaa

SEQ ID NO: 5981050 - DNA, 21 bp, Homo sapiens
caaattggaatggaactactg

SEQ ID NO: 5981051 - DNA, 13 bp, Homo sapiens
caaattggagaaa

SEQ ID NO: 5981052 - DNA, 15 bp, Homo sapiens
caaattggagcaggg

SEQ ID NO: 5981053 - DNA, 17 bp, Homo sapiens
caaattgggatctgtct

SEQ ID NO: 5981054 - DNA, 20 bp, Homo sapiens
caaattgtaactacactaat

SEQ ID NO: 5981055 - DNA, 18 bp, Homo sapiens
caaattgtaattaataat

SEQ ID NO: 5981056 - DNA, 17 bp, Homo sapiens
caaattgtactagttgt

SEQ ID NO: 5981057 - DNA, 18 bp, Homo sapiens
caaattgtatctagtgca

SEQ ID NO: 5981058 - DNA, 22 bp, Homo sapiens
caaattgtatctagtgcagctg

SEQ ID NO: 5981059 - DNA, 21 bp, Homo sapiens
caaattgtcacctgcttctct

SEQ ID NO: 5981060 - DNA, 13 bp, Homo sapiens
caaattgtgaaat

SEQ ID NO: 5981061 - DNA, 15 bp, Homo sapiens
caaattgtgcaaaat

SEQ ID NO: 5981062 - DNA, 23 bp, Homo sapiens
caaattgtgcttctccccagaat

SEQ ID NO: 5981063 - DNA, 15 bp, Homo sapiens
caaatttaactttta

SEQ ID NO: 5981064 - DNA, 16 bp, Homo sapiens
caaatttacatttatc

SEQ ID NO: 5981065 - DNA, 20 bp, Homo sapiens
caaatttactttaaaaagaa

SEQ ID NO: 5981066 - DNA, 19 bp, Homo sapiens
caaatttagtttgttaaag

SEQ ID NO: 5981067 - DNA, 14 bp, Homo sapiens
caaatttataattt

SEQ ID NO: 5981068 - DNA, 13 bp, Homo sapiens
caaatttatcaaa

SEQ ID NO: 5981069 - DNA, 19 bp, Homo sapiens
caaatttatcaaagcatag

SEQ ID NO: 5981070 - DNA, 12 bp, Homo sapiens
caaatttatgca

SEQ ID NO: 5981071 - DNA, 15 bp, Homo sapiens
caaatttatgcattt

SEQ ID NO: 5981072 - DNA, 17 bp, Homo sapiens
caaatttatgcatttca

SEQ ID NO: 5981073 - DNA, 19 bp, Homo sapiens
caaatttatgcatttcatt

SEQ ID NO: 5981074 - DNA, 21 bp, Homo sapiens
caaatttatgcatttcattca

SEQ ID NO: 5981075 - DNA, 17 bp, Homo sapiens
caaatttcaaaagacat

SEQ ID NO: 5981076 - DNA, 11 bp, Homo sapiens
caaatttcaca

SEQ ID NO: 5981077 - DNA, 13 bp, Homo sapiens
caaatttcattgc

SEQ ID NO: 5981078 - DNA, 16 bp, Homo sapiens
caaatttcattgcact

SEQ ID NO: 5981079 - DNA, 21 bp, Homo sapiens
caaatttcattgcactttcct

SEQ ID NO: 5981080 - DNA, 16 bp, Homo sapiens
caaatttcatttcaca

SEQ ID NO: 5981081 - DNA, 20 bp, Homo sapiens
caaatttcatttcacatttt

SEQ ID NO: 5981082 - DNA, 14 bp, Homo sapiens
caaatttccctggg

SEQ ID NO: 5981083 - DNA, 23 bp, Homo sapiens
caaatttccctgggggcatcctg

SEQ ID NO: 5981084 - DNA, 19 bp, Homo sapiens
caaatttcctgtttgaaat

SEQ ID NO: 5981085 - DNA, 14 bp, Homo sapiens
caaatttctaaatc

SEQ ID NO: 5981086 - DNA, 19 bp, Homo sapiens
caaatttctataaatttaa

SEQ ID NO: 5981087 - DNA, 18 bp, Homo sapiens
cacattaatatttgctga

SEQ ID NO: 5981088 - DNA, 19 bp, Homo sapiens
cacattaatatttgctgac

SEQ ID NO: 5981089 - DNA, 15 bp, Homo sapiens
cacattaatctcaaa

SEQ ID NO: 5981090 - DNA, 19 bp, Homo sapiens
cacattaatctcaaagaga

SEQ ID NO: 5981091 - DNA, 18 bp, Homo sapiens
cacattaatggtctaaaa

SEQ ID NO: 5981092 - DNA, 22 bp, Homo sapiens
cacattaatggtctaaaaataa

SEQ ID NO: 5981093 - DNA, 14 bp, Homo sapiens
cacattaattaatt

SEQ ID NO: 5981094 - DNA, 15 bp, Homo sapiens
cacattaattaatta

SEQ ID NO: 5981095 - DNA, 18 bp, Homo sapiens
cacattaattaattaaag

SEQ ID NO: 5981096 - DNA, 23 bp, Homo sapiens
cacattaattagattttcttgca

SEQ ID NO: 5981097 - DNA, 20 bp, Homo sapiens
cacattacttgcacaagctt

SEQ ID NO: 5981098 - DNA, 15 bp, Homo sapiens
cacattagaaatatt

SEQ ID NO: 5981099 - DNA, 16 bp, Homo sapiens
cacattagataaatta

SEQ ID NO: 5981100 - DNA, 20 bp, Homo sapiens
cacattagattttattttac

SEQ ID NO: 5981101 - DNA, 15 bp, Homo sapiens
cacattaggctgttg

SEQ ID NO: 5981102 - DNA, 16 bp, Homo sapiens
cacattatagaaatta

SEQ ID NO: 5981103 - DNA, 22 bp, Homo sapiens
cacattatcactgaaaaaatgt

SEQ ID NO: 5981104 - DNA, 15 bp, Homo sapiens
cacattatcttctgg

SEQ ID NO: 5981105 - DNA, 14 bp, Homo sapiens
cacattatgtatct

SEQ ID NO: 5981106 - DNA, 14 bp, Homo sapiens
cacattatttgcat

SEQ ID NO: 5981107 - DNA, 17 bp, Homo sapiens
cacattcaaccctggag

SEQ ID NO: 5981108 - DNA, 17 bp, Homo sapiens
cacattcaggaagatga

SEQ ID NO: 5981109 - DNA, 23 bp, Homo sapiens
cacattcagggctattttttccc

SEQ ID NO: 5981110 - DNA, 15 bp, Homo sapiens
cacattcatgtacaa

SEQ ID NO: 5981111 - DNA, 15 bp, Homo sapiens
cacattccagccagg

SEQ ID NO: 5981112 - DNA, 15 bp, Homo sapiens
cacattccagggctg

SEQ ID NO: 5981113 - DNA, 17 bp, Homo sapiens
cacattccagggctggg

SEQ ID NO: 5981114 - DNA, 12 bp, Homo sapiens
cacattccatga

SEQ ID NO: 5981115 - DNA, 21 bp, Homo sapiens
cacattcccccaccagctgca

SEQ ID NO: 5981116 - DNA, 17 bp, Homo sapiens
cacattcccctggggac

SEQ ID NO: 5981117 - DNA, 16 bp, Homo sapiens
cacattccctctcatc

SEQ ID NO: 5981118 - DNA, 16 bp, Homo sapiens
cacattcctgaacagg

SEQ ID NO: 5981119 - DNA, 14 bp, Homo sapiens
cacattcctgaccc

SEQ ID NO: 5981120 - DNA, 20 bp, Homo sapiens
cacattcctgaccctcactt

SEQ ID NO: 5981121 - DNA, 21 bp, Homo sapiens
cacattcctggccccgggctc

SEQ ID NO: 5981122 - DNA, 18 bp, Homo sapiens
cacattccttgcctgcac

SEQ ID NO: 5981123 - DNA, 20 bp, Homo sapiens
cacattcgacataccccact

SEQ ID NO: 5981124 - DNA, 17 bp, Homo sapiens
cacattctacttcagct

SEQ ID NO: 5981125 - DNA, 20 bp, Homo sapiens
cacattctcacaattgtaaa

SEQ ID NO: 5981126 - DNA, 12 bp, Homo sapiens
cacattctccct

SEQ ID NO: 5981127 - DNA, 14 bp, Homo sapiens
cacattctcctgtg

SEQ ID NO: 5981128 - DNA, 19 bp, Homo sapiens
cacattctcctgtgcccct

SEQ ID NO: 5981129 - DNA, 13 bp, Homo sapiens
cacattctgcctt

SEQ ID NO: 5981130 - DNA, 14 bp, Homo sapiens
cacattctgctgcc

SEQ ID NO: 5981131 - DNA, 21 bp, Homo sapiens
cacattctgctgcccccagac

SEQ ID NO: 5981132 - DNA, 22 bp, Homo sapiens
cacattctgctgcccccagacc

SEQ ID NO: 5981133 - DNA, 21 bp, Homo sapiens
cacattctggctcagggaggt

SEQ ID NO: 5981134 - DNA, 17 bp, Homo sapiens
cacattcttaaaggaaa

SEQ ID NO: 5981135 - DNA, 16 bp, Homo sapiens
cacattcttataaata

SEQ ID NO: 5981136 - DNA, 16 bp, Homo sapiens
cacattcttcagtttt

SEQ ID NO: 5981137 - DNA, 13 bp, Homo sapiens
cacattcttggct

SEQ ID NO: 5981138 - DNA, 13 bp, Homo sapiens
cacattctttata

SEQ ID NO: 5981139 - DNA, 16 bp, Homo sapiens
cacattctttataaaa

SEQ ID NO: 5981140 - DNA, 13 bp, Homo sapiens
cacattgaaactg

SEQ ID NO: 5981141 - DNA, 17 bp, Homo sapiens
cacattgaaactgtatt

SEQ ID NO: 5981142 - DNA, 23 bp, Homo sapiens
cacattgaaactgtatttacttg

SEQ ID NO: 5981143 - DNA, 21 bp, Homo sapiens
cacattgaaatacttgaaaac

SEQ ID NO: 5981144 - DNA, 23 bp, Homo sapiens
cacattgaagaatgttagagtaa

SEQ ID NO: 5981145 - DNA, 23 bp, Homo sapiens
cacattgaatagtggaacatttt

SEQ ID NO: 5981146 - DNA, 14 bp, Homo sapiens
cacattgaatcatg

SEQ ID NO: 5981147 - DNA, 17 bp, Homo sapiens
cacattgcacacacagt

SEQ ID NO: 5981148 - DNA, 20 bp, Homo sapiens
cacattgcacacacagtctg

SEQ ID NO: 5981149 - DNA, 15 bp, Homo sapiens
cacattgcattctat

SEQ ID NO: 5981150 - DNA, 18 bp, Homo sapiens
cacattgcattctattgc

SEQ ID NO: 5981151 - DNA, 18 bp, Homo sapiens
cacattgccccatgagac

SEQ ID NO: 5981152 - DNA, 13 bp, Homo sapiens
cacattgcccctc

SEQ ID NO: 5981153 - DNA, 17 bp, Homo sapiens
cacattgcccctctgcc

SEQ ID NO: 5981154 - DNA, 18 bp, Homo sapiens
cacattgcccctctgcct

SEQ ID NO: 5981155 - DNA, 14 bp, Homo sapiens
cacattgccctgag

SEQ ID NO: 5981156 - DNA, 13 bp, Homo sapiens
cacattgccttct

SEQ ID NO: 5981157 - DNA, 16 bp, Homo sapiens
cacattgccttctgga

SEQ ID NO: 5981158 - DNA, 13 bp, Homo sapiens
cacattgctggct

SEQ ID NO: 5981159 - DNA, 15 bp, Homo sapiens
cacattgcttcatta

SEQ ID NO: 5981160 - DNA, 22 bp, Homo sapiens
cacattgcttcattaaaacaag

SEQ ID NO: 5981161 - DNA, 17 bp, Homo sapiens
cacattggaccagatga

SEQ ID NO: 5981162 - DNA, 21 bp, Homo sapiens
cacattgggtggggctcctgg

SEQ ID NO: 5981163 - DNA, 21 bp, Homo sapiens
cacattggtctatctactggc

SEQ ID NO: 5981164 - DNA, 23 bp, Homo sapiens
cacattgtagcctaatattcatg

SEQ ID NO: 5981165 - DNA, 12 bp, Homo sapiens
cacattgtgcag

SEQ ID NO: 5981166 - DNA, 13 bp, Homo sapiens
cacatttaaaaca

SEQ ID NO: 5981167 - DNA, 14 bp, Homo sapiens
cacatttaaaacat

SEQ ID NO: 5981168 - DNA, 16 bp, Homo sapiens
cacatttaagagacag

SEQ ID NO: 5981169 - DNA, 13 bp, Homo sapiens
cacatttaaggat

SEQ ID NO: 5981170 - DNA, 20 bp, Homo sapiens
cacatttacactagaggcca

SEQ ID NO: 5981171 - DNA, 12 bp, Homo sapiens
cacatttacata

SEQ ID NO: 5981172 - DNA, 18 bp, Homo sapiens
cacatttaccctttggcc

SEQ ID NO: 5981173 - DNA, 18 bp, Homo sapiens
cacatttacctcgaggct

SEQ ID NO: 5981174 - DNA, 21 bp, Homo sapiens
cacatttacctcgaggctctt

SEQ ID NO: 5981175 - DNA, 19 bp, Homo sapiens
cacatttactagctgtgca

SEQ ID NO: 5981176 - DNA, 14 bp, Homo sapiens
cacatttatatata

SEQ ID NO: 5981177 - DNA, 18 bp, Homo sapiens
cacatttatatatatatg

SEQ ID NO: 5981178 - DNA, 17 bp, Homo sapiens
cacatttattctgctca

SEQ ID NO: 5981179 - DNA, 16 bp, Homo sapiens
cacatttcacattgaa

SEQ ID NO: 5981180 - DNA, 16 bp, Homo sapiens
cacatttcactgtctg

SEQ ID NO: 5981181 - DNA, 17 bp, Homo sapiens
cacatttcactgtctgt

SEQ ID NO: 5981182 - DNA, 16 bp, Homo sapiens
cacatttcatagccta

SEQ ID NO: 5981183 - DNA, 13 bp, Homo sapiens
cacatttcatcta

SEQ ID NO: 5981184 - DNA, 11 bp, Homo sapiens
cacatttccat

SEQ ID NO: 5981185 - DNA, 13 bp, Homo sapiens
cacatttctaaaa

SEQ ID NO: 5981186 - DNA, 15 bp, Homo sapiens
cacatttctaagcct

SEQ ID NO: 5981187 - DNA, 16 bp, Homo sapiens
cacatttctaagcctt

SEQ ID NO: 5981188 - DNA, 17 bp, Homo sapiens
cacatttctaagccttt

SEQ ID NO: 5981189 - DNA, 18 bp, Homo sapiens
cacatttctcaacaaggc

SEQ ID NO: 5981190 - DNA, 12 bp, Homo sapiens
cacatttctgat

SEQ ID NO: 5981191 - DNA, 13 bp, Homo sapiens
cacatttctgcca

SEQ ID NO: 5981192 - DNA, 14 bp, Homo sapiens
cacatttctggatt

SEQ ID NO: 5981193 - DNA, 20 bp, Homo sapiens
cacatttctggccatttaac

SEQ ID NO: 5981194 - DNA, 12 bp, Homo sapiens
cacatttcttaa

SEQ ID NO: 5981195 - DNA, 17 bp, Homo sapiens
cacatttcttaaaacac

SEQ ID NO: 5981196 - DNA, 19 bp, Homo sapiens
cacatttcttaaaacacat

SEQ ID NO: 5981197 - DNA, 21 bp, Homo sapiens
cacatttcttaaaacacatga

SEQ ID NO: 5981198 - DNA, 15 bp, Homo sapiens
cacatttctttgcat

SEQ ID NO: 5981199 - DNA, 19 bp, Homo sapiens
cacatttctttgcattcca

SEQ ID NO: 5981200 - DNA, 16 bp, Homo sapiens
cacatttgaattcatt

SEQ ID NO: 5981201 - DNA, 17 bp, Homo sapiens
cacatttgatgtacatg

SEQ ID NO: 5981202 - DNA, 21 bp, Homo sapiens
cacatttgctactgttgtaag

SEQ ID NO: 5981203 - DNA, 16 bp, Homo sapiens
cacatttggaatactt

SEQ ID NO: 5981204 - DNA, 17 bp, Homo sapiens
cacatttggaatacttt

SEQ ID NO: 5981205 - DNA, 19 bp, Homo sapiens
cacatttggaatacttttt

SEQ ID NO: 5981206 - DNA, 19 bp, Homo sapiens
cacatttgggatgttcctt

SEQ ID NO: 5981207 - DNA, 17 bp, Homo sapiens
cacatttgggctcaggg

SEQ ID NO: 5981208 - DNA, 18 bp, Homo sapiens
cacatttgggctcagggt

SEQ ID NO: 5981209 - DNA, 20 bp, Homo sapiens
cacatttgtatgtgtgtaga

SEQ ID NO: 5981210 - DNA, 20 bp, Homo sapiens
cacatttgtcactgaataat

SEQ ID NO: 5981211 - DNA, 19 bp, Homo sapiens
cacatttgtcagtattttt

SEQ ID NO: 5981212 - DNA, 23 bp, Homo sapiens
cacatttgtcttctttctgtctt

SEQ ID NO: 5981213 - DNA, 18 bp, Homo sapiens
cacatttgtgaactcaaa

SEQ ID NO: 5981214 - DNA, 14 bp, Homo sapiens
cacatttgtgcata

SEQ ID NO: 5981215 - DNA, 19 bp, Homo sapiens
cacatttgtgcataaattt

SEQ ID NO: 5981216 - DNA, 20 bp, Homo sapiens
cacatttgttcatgagtgga

SEQ ID NO: 5981217 - DNA, 13 bp, Homo sapiens
cacattttaagtg

SEQ ID NO: 5981218 - DNA, 21 bp, Homo sapiens
cacattttattaaacacaggg

SEQ ID NO: 5981219 - DNA, 22 bp, Homo sapiens
cacattttattaaacacaggga

SEQ ID NO: 5981220 - DNA, 13 bp, Homo sapiens
cacattttcttta

SEQ ID NO: 5981221 - DNA, 15 bp, Homo sapiens
cacattttgctttat

SEQ ID NO: 5981222 - DNA, 14 bp, Homo sapiens
cacattttgtaaat

SEQ ID NO: 5981223 - DNA, 18 bp, Homo sapiens
cacattttgtaaatctgt

SEQ ID NO: 5981224 - DNA, 20 bp, Homo sapiens
cacattttgtaaatctgtac

SEQ ID NO: 5981225 - DNA, 20 bp, Homo sapiens
cacattttgtacaaagatat

SEQ ID NO: 5981226 - DNA, 19 bp, Homo sapiens
cacattttgtatggagtta

SEQ ID NO: 5981227 - DNA, 19 bp, Homo sapiens
cacattttgtggctgttga

SEQ ID NO: 5981228 - DNA, 21 bp, Homo sapiens
cacatttttatacctgtttaa

SEQ ID NO: 5981229 - DNA, 17 bp, Homo sapiens
cacatttttgcacagat

SEQ ID NO: 5981230 - DNA, 20 bp, Homo sapiens
cacatttttgcacagattat

SEQ ID NO: 5981231 - DNA, 19 bp, Homo sapiens
cacatttttggatttctgt

SEQ ID NO: 5981232 - DNA, 13 bp, Homo sapiens
cacatttttgtaa

SEQ ID NO: 5981233 - DNA, 21 bp, Homo sapiens
cacatttttttctatgcataa

SEQ ID NO: 5981234 - DNA, 19 bp, Homo sapiens
cacatttttttttttaatt

SEQ ID NO: 5981235 - DNA, 18 bp, Homo sapiens
caccaaaaaaatacttga

SEQ ID NO: 5981236 - DNA, 19 bp, Homo sapiens
caccaaaaaaatccagaaa

SEQ ID NO: 5981237 - DNA, 14 bp, Homo sapiens
caccaaaaaatatc

SEQ ID NO: 5981238 - DNA, 22 bp, Homo sapiens
caccaaaaaatctatagtttga

SEQ ID NO: 5981239 - DNA, 14 bp, Homo sapiens
caccaaaaacctat

SEQ ID NO: 5981240 - DNA, 23 bp, Homo sapiens
caccaaaaccaaacttgttcatt

SEQ ID NO: 5981241 - DNA, 19 bp, Homo sapiens
caccaaaactatcctgatt

SEQ ID NO: 5981242 - DNA, 20 bp, Homo sapiens
caccaaaagtgctccccaaa

SEQ ID NO: 5981243 - DNA, 17 bp, Homo sapiens
caccaaaattatagctt

SEQ ID NO: 5981244 - DNA, 18 bp, Homo sapiens
caccaaaattatagcttt

SEQ ID NO: 5981245 - DNA, 16 bp, Homo sapiens
caccaaacatactaga

SEQ ID NO: 5981246 - DNA, 16 bp, Homo sapiens
caccaaactgcacaca

SEQ ID NO: 5981247 - DNA, 21 bp, Homo sapiens
caccaaactgcacacacagct

SEQ ID NO: 5981248 - DNA, 13 bp, Homo sapiens
caccaaactgcct

SEQ ID NO: 5981249 - DNA, 21 bp, Homo sapiens
caccaaagaattgtaggcagt

SEQ ID NO: 5981250 - DNA, 17 bp, Homo sapiens
caccaaagatctgctcc

SEQ ID NO: 5981251 - DNA, 19 bp, Homo sapiens
caccaaagatctgctcctc

SEQ ID NO: 5981252 - DNA, 15 bp, Homo sapiens
caccaaagatgcagc

SEQ ID NO: 5981253 - DNA, 13 bp, Homo sapiens
caccaaagctgcc

SEQ ID NO: 5981254 - DNA, 14 bp, Homo sapiens
caccaaagctgccc

SEQ ID NO: 5981255 - DNA, 18 bp, Homo sapiens
caccaaagctgcccactg

SEQ ID NO: 5981256 - DNA, 12 bp, Homo sapiens
caccaaagttct

SEQ ID NO: 5981257 - DNA, 20 bp, Homo sapiens
caccaaatacaattcaaatg

SEQ ID NO: 5981258 - DNA, 23 bp, Homo sapiens
caccaaatagcttttcacttctt

SEQ ID NO: 5981259 - DNA, 11 bp, Homo sapiens
caccaaatagg

SEQ ID NO: 5981260 - DNA, 13 bp, Homo sapiens
caccaaatatttt

SEQ ID NO: 5981261 - DNA, 16 bp, Homo sapiens
caccaaatattttcaa

SEQ ID NO: 5981262 - DNA, 18 bp, Homo sapiens
caccaaatcatcctgaat

SEQ ID NO: 5981263 - DNA, 15 bp, Homo sapiens
caccaaatctgtcta

SEQ ID NO: 5981264 - DNA, 19 bp, Homo sapiens
caccaaatctgtctagaat

SEQ ID NO: 5981265 - DNA, 17 bp, Homo sapiens
caccaaatgcctctgcc

SEQ ID NO: 5981266 - DNA, 22 bp, Homo sapiens
caccaaattcatgtacagcatg

SEQ ID NO: 5981267 - DNA, 19 bp, Homo sapiens
caaatttctctgttccata

SEQ ID NO: 5981268 - DNA, 11 bp, Homo sapiens
caaatttgatg

SEQ ID NO: 5981269 - DNA, 19 bp, Homo sapiens
caaatttgatgatgttaaa

SEQ ID NO: 5981270 - DNA, 23 bp, Homo sapiens
caaatttgccaccactagagctg

SEQ ID NO: 5981271 - DNA, 21 bp, Homo sapiens
caaatttggccttaagaactg

SEQ ID NO: 5981272 - DNA, 22 bp, Homo sapiens
caaatttggccttaagaactgt

SEQ ID NO: 5981273 - DNA, 19 bp, Homo sapiens
caaatttgtacctctaagt

SEQ ID NO: 5981274 - DNA, 17 bp, Homo sapiens
caaatttgtcttgcctt

SEQ ID NO: 5981275 - DNA, 14 bp, Homo sapiens
caaatttgtgaact

SEQ ID NO: 5981276 - DNA, 11 bp, Homo sapiens
caaatttgtgt

SEQ ID NO: 5981277 - DNA, 17 bp, Homo sapiens
caaattttaatttttgc

SEQ ID NO: 5981278 - DNA, 17 bp, Homo sapiens
caaattttatttgtagg

SEQ ID NO: 5981279 - DNA, 21 bp, Homo sapiens
caaattttcactgctgctcct

SEQ ID NO: 5981280 - DNA, 23 bp, Homo sapiens
caaattttcccagtgaataaata

SEQ ID NO: 5981281 - DNA, 13 bp, Homo sapiens
caaattttctggt

SEQ ID NO: 5981282 - DNA, 21 bp, Homo sapiens
caaattttgatgccaagaaag

SEQ ID NO: 5981283 - DNA, 13 bp, Homo sapiens
caaattttgcatt

SEQ ID NO: 5981284 - DNA, 18 bp, Homo sapiens
caaattttgcatttagtt

SEQ ID NO: 5981285 - DNA, 21 bp, Homo sapiens
caaattttgccagagaaacta

SEQ ID NO: 5981286 - DNA, 14 bp, Homo sapiens
caaatttttactca

SEQ ID NO: 5981287 - DNA, 22 bp, Homo sapiens
caaatttttactcaggctttct

SEQ ID NO: 5981288 - DNA, 23 bp, Homo sapiens
caaatttttactcaggctttcta

SEQ ID NO: 5981289 - DNA, 23 bp, Homo sapiens
caaatttttattttttagtgcat

SEQ ID NO: 5981290 - DNA, 20 bp, Homo sapiens
caaatttttctgctttaaaa

SEQ ID NO: 5981291 - DNA, 19 bp, Homo sapiens
caaatttttctgggaagaa

SEQ ID NO: 5981292 - DNA, 19 bp, Homo sapiens
caaattttttaaaagagac

SEQ ID NO: 5981293 - DNA, 23 bp, Homo sapiens
caaattttttgactttttttgta

SEQ ID NO: 5981294 - DNA, 21 bp, Homo sapiens
caaatttttttgtatttttag

SEQ ID NO: 5981295 - DNA, 13 bp, Homo sapiens
caacaaaaacaaa

SEQ ID NO: 5981296 - DNA, 13 bp, Homo sapiens
caacaaaaagaca

SEQ ID NO: 5981297 - DNA, 16 bp, Homo sapiens
caacaaaaatgtgggt

SEQ ID NO: 5981298 - DNA, 14 bp, Homo sapiens
caacaaaagaagcc

SEQ ID NO: 5981299 - DNA, 15 bp, Homo sapiens
caacaaaagaatttt

SEQ ID NO: 5981300 - DNA, 19 bp, Homo sapiens
caacaaaagggagaacatg

SEQ ID NO: 5981301 - DNA, 14 bp, Homo sapiens
caacaaaatcaatt

SEQ ID NO: 5981302 - DNA, 19 bp, Homo sapiens
caacaaaatcatggcttag

SEQ ID NO: 5981303 - DNA, 15 bp, Homo sapiens
caacaaaatccatgt

SEQ ID NO: 5981304 - DNA, 13 bp, Homo sapiens
caacaaacactgt

SEQ ID NO: 5981305 - DNA, 15 bp, Homo sapiens
caacaaacactgtga

SEQ ID NO: 5981306 - DNA, 12 bp, Homo sapiens
caacaaacagtg

SEQ ID NO: 5981307 - DNA, 16 bp, Homo sapiens
caacaaactgcacatg

SEQ ID NO: 5981308 - DNA, 17 bp, Homo sapiens
caacaaactgcacatga

SEQ ID NO: 5981309 - DNA, 15 bp, Homo sapiens
caacaaagacatgct

SEQ ID NO: 5981310 - DNA, 16 bp, Homo sapiens
caacaaagaggacacc

SEQ ID NO: 5981311 - DNA, 17 bp, Homo sapiens
caacaaagaggattaga

SEQ ID NO: 5981312 - DNA, 22 bp, Homo sapiens
caacaaagcatgctcagtattg

SEQ ID NO: 5981313 - DNA, 12 bp, Homo sapiens
caacaaagctgt

SEQ ID NO: 5981314 - DNA, 16 bp, Homo sapiens
caacaaagctgttgat

SEQ ID NO: 5981315 - DNA, 18 bp, Homo sapiens
caacaaaggcaagttaag

SEQ ID NO: 5981316 - DNA, 18 bp, Homo sapiens
caacaaagtgctttttca

SEQ ID NO: 5981317 - DNA, 14 bp, Homo sapiens
caacaaataattta

SEQ ID NO: 5981318 - DNA, 22 bp, Homo sapiens
caacaaatattcactggcccct

SEQ ID NO: 5981319 - DNA, 19 bp, Homo sapiens
caacaaattaggttttgta

SEQ ID NO: 5981320 - DNA, 15 bp, Homo sapiens
caacaaatttcattg

SEQ ID NO: 5981321 - DNA, 17 bp, Homo sapiens
caacaaatttcattgca

SEQ ID NO: 5981322 - DNA, 20 bp, Homo sapiens
caacaaatttcattgcactt

SEQ ID NO: 5981323 - DNA, 21 bp, Homo sapiens
caacaaatttcattgcacttt

SEQ ID NO: 5981324 - DNA, 15 bp, Homo sapiens
caacaacaaaccaaa

SEQ ID NO: 5981325 - DNA, 12 bp, Homo sapiens
caacaacaacaa

SEQ ID NO: 5981326 - DNA, 15 bp, Homo sapiens
caacaacaacaataa

SEQ ID NO: 5981327 - DNA, 12 bp, Homo sapiens
caacaacaataa

SEQ ID NO: 5981328 - DNA, 16 bp, Homo sapiens
caacaacaataacaac

SEQ ID NO: 5981329 - DNA, 15 bp, Homo sapiens
caacaacaattggta

SEQ ID NO: 5981330 - DNA, 15 bp, Homo sapiens
caacaacagaacaac

SEQ ID NO: 5981331 - DNA, 17 bp, Homo sapiens
caacaacagtcagccag

SEQ ID NO: 5981332 - DNA, 13 bp, Homo sapiens
caacaacatccat

SEQ ID NO: 5981333 - DNA, 13 bp, Homo sapiens
caacaacatgaaa

SEQ ID NO: 5981334 - DNA, 21 bp, Homo sapiens
caacaacatgtataatatttt

SEQ ID NO: 5981335 - DNA, 22 bp, Homo sapiens
caacaacatgtataatattttt

SEQ ID NO: 5981336 - DNA, 17 bp, Homo sapiens
caacaaccacagtgcca

SEQ ID NO: 5981337 - DNA, 19 bp, Homo sapiens
caacaaccaccaccacaat

SEQ ID NO: 5981338 - DNA, 18 bp, Homo sapiens
caacaacctcaactgcct

SEQ ID NO: 5981339 - DNA, 19 bp, Homo sapiens
caacaacctcaactgccta

SEQ ID NO: 5981340 - DNA, 23 bp, Homo sapiens
caacaacgtgagagaaagagaga

SEQ ID NO: 5981341 - DNA, 14 bp, Homo sapiens
caacaactctgcct

SEQ ID NO: 5981342 - DNA, 19 bp, Homo sapiens
caacaactgtcagaataaa

SEQ ID NO: 5981343 - DNA, 15 bp, Homo sapiens
caacaactgtccctc

SEQ ID NO: 5981344 - DNA, 14 bp, Homo sapiens
caacaacttaatgt

SEQ ID NO: 5981345 - DNA, 15 bp, Homo sapiens
caacaacttaatgtg

SEQ ID NO: 5981346 - DNA, 18 bp, Homo sapiens
caacaacttactaaatct

SEQ ID NO: 5981347 - DNA, 21 bp, Homo sapiens
caacaacttttccctcactgt

SEQ ID NO: 5981348 - DNA, 15 bp, Homo sapiens
caacaagaaactgtc

SEQ ID NO: 5981349 - DNA, 11 bp, Homo sapiens
caacaagaaca

SEQ ID NO: 5981350 - DNA, 14 bp, Homo sapiens
caacaagaaccact

SEQ ID NO: 5981351 - DNA, 14 bp, Homo sapiens
caacaagaagaaac

SEQ ID NO: 5981352 - DNA, 14 bp, Homo sapiens
caacaagaagaaat

SEQ ID NO: 5981353 - DNA, 19 bp, Homo sapiens
caacaagaagaaatatgaa

SEQ ID NO: 5981354 - DNA, 23 bp, Homo sapiens
caacaagaagaaatatgaaattc

SEQ ID NO: 5981355 - DNA, 20 bp, Homo sapiens
caacaagaagggactgagag

SEQ ID NO: 5981356 - DNA, 12 bp, Homo sapiens
caacaagaatgc

SEQ ID NO: 5981357 - DNA, 13 bp, Homo sapiens
caacaagaatgca

SEQ ID NO: 5981358 - DNA, 18 bp, Homo sapiens
caacaagccctgcttttg

SEQ ID NO: 5981359 - DNA, 14 bp, Homo sapiens
caacaagctatttt

SEQ ID NO: 5981360 - DNA, 16 bp, Homo sapiens
caacaaggaaactttc

SEQ ID NO: 5981361 - DNA, 16 bp, Homo sapiens
caacaaggcaaaaaca

SEQ ID NO: 5981362 - DNA, 18 bp, Homo sapiens
caacaagggcagtggagg

SEQ ID NO: 5981363 - DNA, 20 bp, Homo sapiens
caacaagggtccgtggacca

SEQ ID NO: 5981364 - DNA, 15 bp, Homo sapiens
caacaaggtatacct

SEQ ID NO: 5981365 - DNA, 16 bp, Homo sapiens
caacaaggtgcacaga

SEQ ID NO: 5981366 - DNA, 19 bp, Homo sapiens
caacaaggttatatgaata

SEQ ID NO: 5981367 - DNA, 15 bp, Homo sapiens
caacaagttgaagaa

SEQ ID NO: 5981368 - DNA, 18 bp, Homo sapiens
caacaagttgaagaagct

SEQ ID NO: 5981369 - DNA, 13 bp, Homo sapiens
caacaagttgcct

SEQ ID NO: 5981370 - DNA, 22 bp, Homo sapiens
caacaagttgtttcaaacagca

SEQ ID NO: 5981371 - DNA, 14 bp, Homo sapiens
caacaataaaaaaa

SEQ ID NO: 5981372 - DNA, 17 bp, Homo sapiens
caacaataaaaaaaaac

SEQ ID NO: 5981373 - DNA, 14 bp, Homo sapiens
caacaataaaacat

SEQ ID NO: 5981374 - DNA, 13 bp, Homo sapiens
caacaataaaata

SEQ ID NO: 5981375 - DNA, 16 bp, Homo sapiens
caacaataaaatagca

SEQ ID NO: 5981376 - DNA, 20 bp, Homo sapiens
caacaataaacaggaatttt

SEQ ID NO: 5981377 - DNA, 15 bp, Homo sapiens
caacaataacaacaa

SEQ ID NO: 5981378 - DNA, 14 bp, Homo sapiens
caacaatacaacaa

SEQ ID NO: 5981379 - DNA, 18 bp, Homo sapiens
caacaatacaacaagaac

SEQ ID NO: 5981380 - DNA, 19 bp, Homo sapiens
caacaatacaacaagaaca

SEQ ID NO: 5981381 - DNA, 15 bp, Homo sapiens
caacaatcctagtgc

SEQ ID NO: 5981382 - DNA, 13 bp, Homo sapiens
caacaatctggag

SEQ ID NO: 5981383 - DNA, 21 bp, Homo sapiens
caacaatgattaatcagctgt

SEQ ID NO: 5981384 - DNA, 12 bp, Homo sapiens
caacaatgcaaa

SEQ ID NO: 5981385 - DNA, 13 bp, Homo sapiens
caacaatgctttg

SEQ ID NO: 5981386 - DNA, 18 bp, Homo sapiens
caacaatggggtgggccc

SEQ ID NO: 5981387 - DNA, 17 bp, Homo sapiens
caacaatggtttacatg

SEQ ID NO: 5981388 - DNA, 12 bp, Homo sapiens
caacaattagag

SEQ ID NO: 5981389 - DNA, 18 bp, Homo sapiens
caacaattagaggaattt

SEQ ID NO: 5981390 - DNA, 13 bp, Homo sapiens
caacaattctaaa

SEQ ID NO: 5981391 - DNA, 15 bp, Homo sapiens
caacaattggagggt

SEQ ID NO: 5981392 - DNA, 20 bp, Homo sapiens
caacaattggtgtcattttc

SEQ ID NO: 5981393 - DNA, 13 bp, Homo sapiens
caacaatttctac

SEQ ID NO: 5981394 - DNA, 18 bp, Homo sapiens
caacaatttctactttga

SEQ ID NO: 5981395 - DNA, 19 bp, Homo sapiens
caacaatttctactttgaa

SEQ ID NO: 5981396 - DNA, 21 bp, Homo sapiens
caacaatttgggcttcctgtt

SEQ ID NO: 5981397 - DNA, 12 bp, Homo sapiens
caacaattttca

SEQ ID NO: 5981398 - DNA, 18 bp, Homo sapiens
caacaattttcagatttg

SEQ ID NO: 5981399 - DNA, 19 bp, Homo sapiens
caacaattttcagatttgc

SEQ ID NO: 5981400 - DNA, 13 bp, Homo sapiens
caacacaaactgg

SEQ ID NO: 5981401 - DNA, 14 bp, Homo sapiens
caacacaaagacac

SEQ ID NO: 5981402 - DNA, 15 bp, Homo sapiens
caacacaaagacatg

SEQ ID NO: 5981403 - DNA, 21 bp, Homo sapiens
caacacaaagacatggaaggt

SEQ ID NO: 5981404 - DNA, 12 bp, Homo sapiens
caacacaaagag

SEQ ID NO: 5981405 - DNA, 22 bp, Homo sapiens
caacacaaagagaaaaagaaat

SEQ ID NO: 5981406 - DNA, 18 bp, Homo sapiens
caacacaacatttgtgtc

SEQ ID NO: 5981407 - DNA, 12 bp, Homo sapiens
caacacaagaaa

SEQ ID NO: 5981408 - DNA, 21 bp, Homo sapiens
caacacaagacaccttttgta

SEQ ID NO: 5981409 - DNA, 17 bp, Homo sapiens
caacacaagcaccccag

SEQ ID NO: 5981410 - DNA, 14 bp, Homo sapiens
caacacaaggtggg

SEQ ID NO: 5981411 - DNA, 16 bp, Homo sapiens
caacacaataacacta

SEQ ID NO: 5981412 - DNA, 18 bp, Homo sapiens
caacacaatgttattcgt

SEQ ID NO: 5981413 - DNA, 22 bp, Homo sapiens
caacacacacaacgtaaaaata

SEQ ID NO: 5981414 - DNA, 14 bp, Homo sapiens
caacacacacactc

SEQ ID NO: 5981415 - DNA, 15 bp, Homo sapiens
caacacacacatgct

SEQ ID NO: 5981416 - DNA, 23 bp, Homo sapiens
caacacacacatgcttccctttc

SEQ ID NO: 5981417 - DNA, 16 bp, Homo sapiens
caacacacctggtgaa

SEQ ID NO: 5981418 - DNA, 15 bp, Homo sapiens
caacacactgcctta

SEQ ID NO: 5981419 - DNA, 15 bp, Homo sapiens
caacacagcctgggc

SEQ ID NO: 5981420 - DNA, 19 bp, Homo sapiens
caacacagcttgtctcttg

SEQ ID NO: 5981421 - DNA, 22 bp, Homo sapiens
caacacatcaggaaagagagca

SEQ ID NO: 5981422 - DNA, 20 bp, Homo sapiens
caacacatgtgggagaggag

SEQ ID NO: 5981423 - DNA, 21 bp, Homo sapiens
caacacattacttgcacaagc

SEQ ID NO: 5981424 - DNA, 17 bp, Homo sapiens
caacacattgaaactgt

SEQ ID NO: 5981425 - DNA, 13 bp, Homo sapiens
caacacatttcac

SEQ ID NO: 5981426 - DNA, 18 bp, Homo sapiens
caacacatttcacttttc

SEQ ID NO: 5981427 - DNA, 17 bp, Homo sapiens
caacaccaaaaaatatc

SEQ ID NO: 5981428 - DNA, 13 bp, Homo sapiens
caacaccaagcac

SEQ ID NO: 5981429 - DNA, 15 bp, Homo sapiens
caacaccaagcacag

SEQ ID NO: 5981430 - DNA, 22 bp, Homo sapiens
caacaccaagcacagcagcctg

SEQ ID NO: 5981431 - DNA, 13 bp, Homo sapiens
caacaccacagac

SEQ ID NO: 5981432 - DNA, 17 bp, Homo sapiens
caacaccacagacacac

SEQ ID NO: 5981433 - DNA, 13 bp, Homo sapiens
caacaccacccct

SEQ ID NO: 5981434 - DNA, 13 bp, Homo sapiens
caacaccagaaag

SEQ ID NO: 5981435 - DNA, 17 bp, Homo sapiens
caacaccagcccctgcc

SEQ ID NO: 5981436 - DNA, 18 bp, Homo sapiens
caacaccagcccctgccc

SEQ ID NO: 5981437 - DNA, 18 bp, Homo sapiens
caacaccatcacagcttg

SEQ ID NO: 5981438 - DNA, 22 bp, Homo sapiens
caacaccatcacagcttgtttt

SEQ ID NO: 5981439 - DNA, 16 bp, Homo sapiens
caacacccatctgttt

SEQ ID NO: 5981440 - DNA, 16 bp, Homo sapiens
caacacccatttttcc

SEQ ID NO: 5981441 - DNA, 18 bp, Homo sapiens
caacaccccacaggaggg

SEQ ID NO: 5981442 - DNA, 21 bp, Homo sapiens
caacacccccgacggcctcca

SEQ ID NO: 5981443 - DNA, 17 bp, Homo sapiens
caacaccccgcctgcct

SEQ ID NO: 5981444 - DNA, 18 bp, Homo sapiens
caacaccccgcctgcctc

SEQ ID NO: 5981445 - DNA, 21 bp, Homo sapiens
caacaccctgcttctcccggg

SEQ ID NO: 5981446 - DNA, 12 bp, Homo sapiens
caacacctcctc

SEQ ID NO: 5981447 - DNA, 13 bp, Homo sapiens
caacacctcctcc

SEQ ID NO: 5981448 - DNA, 23 bp, Homo sapiens
caccaaattgctgagatgtttag

SEQ ID NO: 5981449 - DNA, 21 bp, Homo sapiens
caccaaattgttatttgcact

SEQ ID NO: 5981450 - DNA, 20 bp, Homo sapiens
caccaacaacagtcagccag

SEQ ID NO: 5981451 - DNA, 15 bp, Homo sapiens
caccaacaccacggt

SEQ ID NO: 5981452 - DNA, 22 bp, Homo sapiens
caccaacatcccattgccctgg

SEQ ID NO: 5981453 - DNA, 15 bp, Homo sapiens
caccaaccagacagc

SEQ ID NO: 5981454 - DNA, 23 bp, Homo sapiens
caccaaccagacagcacagggca

SEQ ID NO: 5981455 - DNA, 15 bp, Homo sapiens
caccaaccaggcctt

SEQ ID NO: 5981456 - DNA, 19 bp, Homo sapiens
caccaacccatcagaagga

SEQ ID NO: 5981457 - DNA, 16 bp, Homo sapiens
caccaaccccgcggcc

SEQ ID NO: 5981458 - DNA, 13 bp, Homo sapiens
caccaaccctcag

SEQ ID NO: 5981459 - DNA, 18 bp, Homo sapiens
caccaacctcactgccct

SEQ ID NO: 5981460 - DNA, 12 bp, Homo sapiens
caccaacctcca

SEQ ID NO: 5981461 - DNA, 18 bp, Homo sapiens
caccaacctccagactca

SEQ ID NO: 5981462 - DNA, 19 bp, Homo sapiens
caccaacctccagactcag

SEQ ID NO: 5981463 - DNA, 20 bp, Homo sapiens
caccaacctccagactcagc

SEQ ID NO: 5981464 - DNA, 22 bp, Homo sapiens
caccaacctccagactcagcag

SEQ ID NO: 5981465 - DNA, 19 bp, Homo sapiens
caccaactcctagttctag

SEQ ID NO: 5981466 - DNA, 15 bp, Homo sapiens
caccaactctgcact

SEQ ID NO: 5981467 - DNA, 18 bp, Homo sapiens
caccaactctgcactcca

SEQ ID NO: 5981468 - DNA, 19 bp, Homo sapiens
caccaactctgcactccat

SEQ ID NO: 5981469 - DNA, 20 bp, Homo sapiens
caccaactctgcactccatg

SEQ ID NO: 5981470 - DNA, 18 bp, Homo sapiens
caccaactgaattaaact

SEQ ID NO: 5981471 - DNA, 19 bp, Homo sapiens
caccaactggccctcttct

SEQ ID NO: 5981472 - DNA, 13 bp, Homo sapiens
caccaacttgcca

SEQ ID NO: 5981473 - DNA, 14 bp, Homo sapiens
caccaactttttcc

SEQ ID NO: 5981474 - DNA, 13 bp, Homo sapiens
caccaagaaacca

SEQ ID NO: 5981475 - DNA, 15 bp, Homo sapiens
caccaagaaaccact

SEQ ID NO: 5981476 - DNA, 15 bp, Homo sapiens
caccaagaaagcagg

SEQ ID NO: 5981477 - DNA, 13 bp, Homo sapiens
caccaagaagcaa

SEQ ID NO: 5981478 - DNA, 13 bp, Homo sapiens
caccaagaagggg

SEQ ID NO: 5981479 - DNA, 15 bp, Homo sapiens
caccaagaaggggct

SEQ ID NO: 5981480 - DNA, 15 bp, Homo sapiens
caccaagacagtgct

SEQ ID NO: 5981481 - DNA, 18 bp, Homo sapiens
caccaagagtagcacctt

SEQ ID NO: 5981482 - DNA, 16 bp, Homo sapiens
caccaagcacagcagc

SEQ ID NO: 5981483 - DNA, 23 bp, Homo sapiens
caccaagcagtggcctttttctg

SEQ ID NO: 5981484 - DNA, 13 bp, Homo sapiens
caccaagcccaca

SEQ ID NO: 5981485 - DNA, 14 bp, Homo sapiens
caccaagcccacag

SEQ ID NO: 5981486 - DNA, 23 bp, Homo sapiens
caccaagcccacaggtgtcccca

SEQ ID NO: 5981487 - DNA, 23 bp, Homo sapiens
caccaagcccgaccgggccaggc

SEQ ID NO: 5981488 - DNA, 20 bp, Homo sapiens
caccaagcccgcctccagca

SEQ ID NO: 5981489 - DNA, 17 bp, Homo sapiens
caccaagccctgcaaat

SEQ ID NO: 5981490 - DNA, 22 bp, Homo sapiens
caccaagcctggtcagcccaaa

SEQ ID NO: 5981491 - DNA, 16 bp, Homo sapiens
caccaagctcaaagcg

SEQ ID NO: 5981492 - DNA, 18 bp, Homo sapiens
caccaagctcacacctgt

SEQ ID NO: 5981493 - DNA, 16 bp, Homo sapiens
caccaagctcaccctt

SEQ ID NO: 5981494 - DNA, 16 bp, Homo sapiens
caccaagctgtgccac

SEQ ID NO: 5981495 - DNA, 14 bp, Homo sapiens
caccaagctgttcc

SEQ ID NO: 5981496 - DNA, 12 bp, Homo sapiens
caccaaggaaac

SEQ ID NO: 5981497 - DNA, 16 bp, Homo sapiens
caccaaggcagtgcat

SEQ ID NO: 5981498 - DNA, 21 bp, Homo sapiens
caccaaggcagtgcatgcatg

SEQ ID NO: 5981499 - DNA, 22 bp, Homo sapiens
caccaaggcagtgcatgcatgt

SEQ ID NO: 5981500 - DNA, 16 bp, Homo sapiens
caccaaggctgcctgc

SEQ ID NO: 5981501 - DNA, 18 bp, Homo sapiens
caccaaggctgcctgccc

SEQ ID NO: 5981502 - DNA, 16 bp, Homo sapiens
caccaagggacaggag

SEQ ID NO: 5981503 - DNA, 14 bp, Homo sapiens
caccaagggatctg

SEQ ID NO: 5981504 - DNA, 10 bp, Homo sapiens
caccaagggc

SEQ ID NO: 5981505 - DNA, 18 bp, Homo sapiens
caccaagggcgcaagagt

SEQ ID NO: 5981506 - DNA, 23 bp, Homo sapiens
caccaagggcgcaagagtagcgg

SEQ ID NO: 5981507 - DNA, 15 bp, Homo sapiens
caccaagggtatctg

SEQ ID NO: 5981508 - DNA, 22 bp, Homo sapiens
caccaaggtctcacactcctcc

SEQ ID NO: 5981509 - DNA, 14 bp, Homo sapiens
caccaaggtcttca

SEQ ID NO: 5981510 - DNA, 17 bp, Homo sapiens
caccaagtaaatctatc

SEQ ID NO: 5981511 - DNA, 13 bp, Homo sapiens
caccaagtaaatt

SEQ ID NO: 5981512 - DNA, 15 bp, Homo sapiens
caccaagtacagcct

SEQ ID NO: 5981513 - DNA, 18 bp, Homo sapiens
caccaagtacagccttca

SEQ ID NO: 5981514 - DNA, 22 bp, Homo sapiens
caccaagtattaaactgtaaat

SEQ ID NO: 5981515 - DNA, 18 bp, Homo sapiens
caccaagtccccttctgt

SEQ ID NO: 5981516 - DNA, 22 bp, Homo sapiens
caccaagtctaaaaagacctgg

SEQ ID NO: 5981517 - DNA, 22 bp, Homo sapiens
caccaagtgcgggtccggcagc

SEQ ID NO: 5981518 - DNA, 22 bp, Homo sapiens
caccaagttggaacatccttgg

SEQ ID NO: 5981519 - DNA, 11 bp, Homo sapiens
caccaataaag

SEQ ID NO: 5981520 - DNA, 15 bp, Homo sapiens
caccaataaaggagg

SEQ ID NO: 5981521 - DNA, 17 bp, Homo sapiens
caccaataaaggaggaa

SEQ ID NO: 5981522 - DNA, 20 bp, Homo sapiens
caccaataaaggaggaatca

SEQ ID NO: 5981523 - DNA, 20 bp, Homo sapiens
caccaataaatcagaccatg

SEQ ID NO: 5981524 - DNA, 14 bp, Homo sapiens
caccaataaatgtt

SEQ ID NO: 5981525 - DNA, 21 bp, Homo sapiens
caccaataatggggcagacac

SEQ ID NO: 5981526 - DNA, 23 bp, Homo sapiens
caccaataatggggcagacacaa

SEQ ID NO: 5981527 - DNA, 14 bp, Homo sapiens
caccaatacaaatt

SEQ ID NO: 5981528 - DNA, 21 bp, Homo sapiens
caccaatatcatgtgtagata

SEQ ID NO: 5981529 - DNA, 15 bp, Homo sapiens
caccaatcagagagc

SEQ ID NO: 5981530 - DNA, 15 bp, Homo sapiens
caccaatctgccctt

SEQ ID NO: 5981531 - DNA, 18 bp, Homo sapiens
caccaatcttactttgta

SEQ ID NO: 5981532 - DNA, 16 bp, Homo sapiens
caccaatgaaaacatg

SEQ ID NO: 5981533 - DNA, 21 bp, Homo sapiens
caccaatgaaaacatgtacta

SEQ ID NO: 5981534 - DNA, 16 bp, Homo sapiens
caccaatgcccagcag

SEQ ID NO: 5981535 - DNA, 17 bp, Homo sapiens
caccaatgcccagcagg

SEQ ID NO: 5981536 - DNA, 15 bp, Homo sapiens
caccaattaaaaacc

SEQ ID NO: 5981537 - DNA, 17 bp, Homo sapiens
caccaattaaaaacctt

SEQ ID NO: 5981538 - DNA, 16 bp, Homo sapiens
caccaattatcatctt

SEQ ID NO: 5981539 - DNA, 21 bp, Homo sapiens
caccaattggataaagcagct

SEQ ID NO: 5981540 - DNA, 17 bp, Homo sapiens
caccacaaaaagagaag

SEQ ID NO: 5981541 - DNA, 12 bp, Homo sapiens
caccacaaaata

SEQ ID NO: 5981542 - DNA, 16 bp, Homo sapiens
caccacaagagctcct

SEQ ID NO: 5981543 - DNA, 14 bp, Homo sapiens
caccacaattctcc

SEQ ID NO: 5981544 - DNA, 12 bp, Homo sapiens
caccacacacaa

SEQ ID NO: 5981545 - DNA, 18 bp, Homo sapiens
caccacacacaacagcca

SEQ ID NO: 5981546 - DNA, 19 bp, Homo sapiens
caccacacacacccttccc

SEQ ID NO: 5981547 - DNA, 14 bp, Homo sapiens
caccacacagtcac

SEQ ID NO: 5981548 - DNA, 19 bp, Homo sapiens
caccacacatcccagccca

SEQ ID NO: 5981549 - DNA, 13 bp, Homo sapiens
caccacaccaaat

SEQ ID NO: 5981550 - DNA, 14 bp, Homo sapiens
caccacacccagcc

SEQ ID NO: 5981551 - DNA, 17 bp, Homo sapiens
caccacacccagcctca

SEQ ID NO: 5981552 - DNA, 18 bp, Homo sapiens
caccacacccagcctcag

SEQ ID NO: 5981553 - DNA, 15 bp, Homo sapiens
caccacacccaggtc

SEQ ID NO: 5981554 - DNA, 14 bp, Homo sapiens
caccacacctggct

SEQ ID NO: 5981555 - DNA, 15 bp, Homo sapiens
caccacacctggctt

SEQ ID NO: 5981556 - DNA, 22 bp, Homo sapiens
caccacactaaaacattgtcta

SEQ ID NO: 5981557 - DNA, 13 bp, Homo sapiens
caccacactgacc

SEQ ID NO: 5981558 - DNA, 18 bp, Homo sapiens
caccacacttgttttctt

SEQ ID NO: 5981559 - DNA, 15 bp, Homo sapiens
caccacagacacaca

SEQ ID NO: 5981560 - DNA, 19 bp, Homo sapiens
caccacagacacacacacg

SEQ ID NO: 5981561 - DNA, 17 bp, Homo sapiens
caccacagacgccacct

SEQ ID NO: 5981562 - DNA, 15 bp, Homo sapiens
caccacagcctcccc

SEQ ID NO: 5981563 - DNA, 20 bp, Homo sapiens
caccacagcttatggcatct

SEQ ID NO: 5981564 - DNA, 15 bp, Homo sapiens
caccacaggctgcct

SEQ ID NO: 5981565 - DNA, 17 bp, Homo sapiens
caccacatagcatgctt

SEQ ID NO: 5981566 - DNA, 20 bp, Homo sapiens
caccacatagcatgcttcct

SEQ ID NO: 5981567 - DNA, 20 bp, Homo sapiens
caccacatcccttcatatca

SEQ ID NO: 5981568 - DNA, 21 bp, Homo sapiens
caccacatcctccgtccagcc

SEQ ID NO: 5981569 - DNA, 19 bp, Homo sapiens
caccacatctgccagacct

SEQ ID NO: 5981570 - DNA, 15 bp, Homo sapiens
caccacatgctattg

SEQ ID NO: 5981571 - DNA, 21 bp, Homo sapiens
caccacattctgtctctgctt

SEQ ID NO: 5981572 - DNA, 16 bp, Homo sapiens
caccaccacacccctg

SEQ ID NO: 5981573 - DNA, 14 bp, Homo sapiens
caccaccacactac

SEQ ID NO: 5981574 - DNA, 18 bp, Homo sapiens
caccaccacactacacag

SEQ ID NO: 5981575 - DNA, 14 bp, Homo sapiens
caccaccaccccta

SEQ ID NO: 5981576 - DNA, 21 bp, Homo sapiens
caccaccacgcagccgccgcc

SEQ ID NO: 5981577 - DNA, 15 bp, Homo sapiens
caccaccagccagcg

SEQ ID NO: 5981578 - DNA, 11 bp, Homo sapiens
caccaccagga

SEQ ID NO: 5981579 - DNA, 21 bp, Homo sapiens
caccaccaggagcagcagcca

SEQ ID NO: 5981580 - DNA, 20 bp, Homo sapiens
caccaccagggctccaggag

SEQ ID NO: 5981581 - DNA, 18 bp, Homo sapiens
caccaccagggtggacca

SEQ ID NO: 5981582 - DNA, 24 bp, Homo sapiens
caccaccagggtggaccaggcctg

SEQ ID NO: 5981583 - DNA, 13 bp, Homo sapiens
caccaccatgccc

SEQ ID NO: 5981584 - DNA, 13 bp, Homo sapiens
caccaccatttaa

SEQ ID NO: 5981585 - DNA, 14 bp, Homo sapiens
caccaccatttaat

SEQ ID NO: 5981586 - DNA, 15 bp, Homo sapiens
caccaccatttaatt

SEQ ID NO: 5981587 - DNA, 12 bp, Homo sapiens
caccacccaccc

SEQ ID NO: 5981588 - DNA, 19 bp, Homo sapiens
caccacccagcccttcctt

SEQ ID NO: 5981589 - DNA, 23 bp, Homo sapiens
caccacccagcccttccttgggc

SEQ ID NO: 5981590 - DNA, 18 bp, Homo sapiens
caccaccccaacaaacca

SEQ ID NO: 5981591 - DNA, 12 bp, Homo sapiens
caccaccccacc

SEQ ID NO: 5981592 - DNA, 17 bp, Homo sapiens
caccaccccacccacct

SEQ ID NO: 5981593 - DNA, 23 bp, Homo sapiens
caccaccccacccacctttgcag

SEQ ID NO: 5981594 - DNA, 21 bp, Homo sapiens
caccaccccagctgctcccct

SEQ ID NO: 5981595 - DNA, 14 bp, Homo sapiens
caccacccccacga

SEQ ID NO: 5981596 - DNA, 13 bp, Homo sapiens
caccacccccagt

SEQ ID NO: 5981597 - DNA, 19 bp, Homo sapiens
caccacccccagtcccccc

SEQ ID NO: 5981598 - DNA, 15 bp, Homo sapiens
caccaccccccactc

SEQ ID NO: 5981599 - DNA, 18 bp, Homo sapiens
caccaccccccactctgt

SEQ ID NO: 5981600 - DNA, 21 bp, Homo sapiens
caccacccctaaagtgccagg

SEQ ID NO: 5981601 - DNA, 18 bp, Homo sapiens
caccacccctccctctgc

SEQ ID NO: 5981602 - DNA, 23 bp, Homo sapiens
caccacccctccctctgctctca

SEQ ID NO: 5981603 - DNA, 22 bp, Homo sapiens
caccaccctagtcccttcccct

SEQ ID NO: 5981604 - DNA, 16 bp, Homo sapiens
caccaccctcaggtgc

SEQ ID NO: 5981605 - DNA, 15 bp, Homo sapiens
caccaccctgtcttc

SEQ ID NO: 5981606 - DNA, 18 bp, Homo sapiens
caccaccctgtcttcctc

SEQ ID NO: 5981607 - DNA, 18 bp, Homo sapiens
caccaccctttgctgact

SEQ ID NO: 5981608 - DNA, 23 bp, Homo sapiens
caccaccgaatatattactgatt

SEQ ID NO: 5981609 - DNA, 19 bp, Homo sapiens
caccaccgagctctgtggg

SEQ ID NO: 5981610 - DNA, 22 bp, Homo sapiens
caccaccgcctctggccgccac

SEQ ID NO: 5981611 - DNA, 23 bp, Homo sapiens
caccacctaggccactcctccaa

SEQ ID NO: 5981612 - DNA, 19 bp, Homo sapiens
caccacctatatccagaag

SEQ ID NO: 5981613 - DNA, 17 bp, Homo sapiens
caccacctcactcctgt

SEQ ID NO: 5981614 - DNA, 14 bp, Homo sapiens
caccacctctttgg

SEQ ID NO: 5981615 - DNA, 23 bp, Homo sapiens
caccacctgcccggcccaggagc

SEQ ID NO: 5981616 - DNA, 12 bp, Homo sapiens
caccacctgctc

SEQ ID NO: 5981617 - DNA, 14 bp, Homo sapiens
caccacctgctcac

SEQ ID NO: 5981618 - DNA, 20 bp, Homo sapiens
caccacctggatggatctgc

SEQ ID NO: 5981619 - DNA, 21 bp, Homo sapiens
caccacctggatggatctgct

SEQ ID NO: 5981620 - DNA, 19 bp, Homo sapiens
caccaccttatacatcact

SEQ ID NO: 5981621 - DNA, 22 bp, Homo sapiens
caccaccttatacatcacttcc

SEQ ID NO: 5981622 - DNA, 23 bp, Homo sapiens
caccaccttatacatcacttcct

SEQ ID NO: 5981623 - DNA, 14 bp, Homo sapiens
caccaccttcccag

SEQ ID NO: 5981624 - DNA, 15 bp, Homo sapiens
caccaccttcccagc

SEQ ID NO: 5981625 - DNA, 16 bp, Homo sapiens
caccaccttcccagct

SEQ ID NO: 5981626 - DNA, 19 bp, Homo sapiens
caccaccttggactcctcc

SEQ ID NO: 5981627 - DNA, 20 bp, Homo sapiens
caacacctcctcctgctgct

SEQ ID NO: 5981628 - DNA, 22 bp, Homo sapiens
caacacctctgcacaagctgca

SEQ ID NO: 5981629 - DNA, 16 bp, Homo sapiens
caacaccttcctcctg

SEQ ID NO: 5981630 - DNA, 20 bp, Homo sapiens
caacaccttgtttccctctc

SEQ ID NO: 5981631 - DNA, 15 bp, Homo sapiens
caacacgagcaggct

SEQ ID NO: 5981632 - DNA, 19 bp, Homo sapiens
caacacgcacctgcctcag

SEQ ID NO: 5981633 - DNA, 13 bp, Homo sapiens
caacacgttacta

SEQ ID NO: 5981634 - DNA, 17 bp, Homo sapiens
caacactatataaataa

SEQ ID NO: 5981635 - DNA, 14 bp, Homo sapiens
caacactcaagtct

SEQ ID NO: 5981636 - DNA, 22 bp, Homo sapiens
caacactcattgacctgaggcc

SEQ ID NO: 5981637 - DNA, 13 bp, Homo sapiens
caacactccaggc

SEQ ID NO: 5981638 - DNA, 16 bp, Homo sapiens
caacactccaggccct

SEQ ID NO: 5981639 - DNA, 18 bp, Homo sapiens
caacactccggtcagccc

SEQ ID NO: 5981640 - DNA, 22 bp, Homo sapiens
caacactccggtcagcccctgg

SEQ ID NO: 5981641 - DNA, 20 bp, Homo sapiens
caacactcttcttgagcaga

SEQ ID NO: 5981642 - DNA, 21 bp, Homo sapiens
caacactgaacctctggctag

SEQ ID NO: 5981643 - DNA, 14 bp, Homo sapiens
caacactgagcaag

SEQ ID NO: 5981644 - DNA, 21 bp, Homo sapiens
caacactgatcccccagatgc

SEQ ID NO: 5981645 - DNA, 13 bp, Homo sapiens
caacactgatgtg

SEQ ID NO: 5981646 - DNA, 15 bp, Homo sapiens
caacactgcaggaca

SEQ ID NO: 5981647 - DNA, 18 bp, Homo sapiens
caacactgccagaagtgt

SEQ ID NO: 5981648 - DNA, 21 bp, Homo sapiens
caacactgccagaagtgtgtt

SEQ ID NO: 5981649 - DNA, 15 bp, Homo sapiens
caacactgctgtcca

SEQ ID NO: 5981650 - DNA, 22 bp, Homo sapiens
caacactgtagtaaataatgct

SEQ ID NO: 5981651 - DNA, 18 bp, Homo sapiens
caacactgtgccctggtg

SEQ ID NO: 5981652 - DNA, 22 bp, Homo sapiens
caacactgtgccctggtggaga

SEQ ID NO: 5981653 - DNA, 17 bp, Homo sapiens
caacacttaagtctcag

SEQ ID NO: 5981654 - DNA, 15 bp, Homo sapiens
caacacttaatcatt

SEQ ID NO: 5981655 - DNA, 19 bp, Homo sapiens
caacacttcagactgcaag

SEQ ID NO: 5981656 - DNA, 16 bp, Homo sapiens
caacacttcattttca

SEQ ID NO: 5981657 - DNA, 21 bp, Homo sapiens
caacacttgtgttgctttctg

SEQ ID NO: 5981658 - DNA, 15 bp, Homo sapiens
caacactttaatggg

SEQ ID NO: 5981659 - DNA, 19 bp, Homo sapiens
caacactttccctctctgg

SEQ ID NO: 5981660 - DNA, 10 bp, Homo sapiens
caacagaaaa

SEQ ID NO: 5981661 - DNA, 21 bp, Homo sapiens
caacagaaaaacaatcttatt

SEQ ID NO: 5981662 - DNA, 13 bp, Homo sapiens
caacagaaacctt

SEQ ID NO: 5981663 - DNA, 12 bp, Homo sapiens
caacagaaagag

SEQ ID NO: 5981664 - DNA, 15 bp, Homo sapiens
caacagaaagaggga

SEQ ID NO: 5981665 - DNA, 12 bp, Homo sapiens
caacagaacaac

SEQ ID NO: 5981666 - DNA, 16 bp, Homo sapiens
caacagaacaacaaca

SEQ ID NO: 5981667 - DNA, 19 bp, Homo sapiens
caacagaacaacaacaaag

SEQ ID NO: 5981668 - DNA, 13 bp, Homo sapiens
caacagaacatat

SEQ ID NO: 5981669 - DNA, 15 bp, Homo sapiens
caacagaagcatttg

SEQ ID NO: 5981670 - DNA, 23 bp, Homo sapiens
caacagaagtcatgaagcccaag

SEQ ID NO: 5981671 - DNA, 14 bp, Homo sapiens
caacagaataaagc

SEQ ID NO: 5981672 - DNA, 15 bp, Homo sapiens
caacagaataaagca

SEQ ID NO: 5981673 - DNA, 16 bp, Homo sapiens
caacagaataatgcat

SEQ ID NO: 5981674 - DNA, 15 bp, Homo sapiens
caacagaatgaaaaa

SEQ ID NO: 5981675 - DNA, 17 bp, Homo sapiens
caacagaattaaaatgt

SEQ ID NO: 5981676 - DNA, 15 bp, Homo sapiens
caacagaattgttct

SEQ ID NO: 5981677 - DNA, 16 bp, Homo sapiens
caacagacctaagaaa

SEQ ID NO: 5981678 - DNA, 16 bp, Homo sapiens
caacagagagaaaaag

SEQ ID NO: 5981679 - DNA, 15 bp, Homo sapiens
caacagagagggaga

SEQ ID NO: 5981680 - DNA, 16 bp, Homo sapiens
caacagagaggggcag

SEQ ID NO: 5981681 - DNA, 17 bp, Homo sapiens
caacagagaggggcagg

SEQ ID NO: 5981682 - DNA, 21 bp, Homo sapiens
caacagagatgccatgatatc

SEQ ID NO: 5981683 - DNA, 14 bp, Homo sapiens
caacagagcaagac

SEQ ID NO: 5981684 - DNA, 19 bp, Homo sapiens
caacagagtgagaccctgt

SEQ ID NO: 5981685 - DNA, 13 bp, Homo sapiens
caacagagtggac

SEQ ID NO: 5981686 - DNA, 17 bp, Homo sapiens
caacagatcaatttgta

SEQ ID NO: 5981687 - DNA, 17 bp, Homo sapiens
caacagatctggaacct

SEQ ID NO: 5981688 - DNA, 15 bp, Homo sapiens
caacagatgcttttc

SEQ ID NO: 5981689 - DNA, 20 bp, Homo sapiens
caacagattcagaatgagaa

SEQ ID NO: 5981690 - DNA, 20 bp, Homo sapiens
caacagattggattttatgt

SEQ ID NO: 5981691 - DNA, 23 bp, Homo sapiens
caacagattggattttatgttga

SEQ ID NO: 5981692 - DNA, 14 bp, Homo sapiens
caacagatttaaag

SEQ ID NO: 5981693 - DNA, 15 bp, Homo sapiens
caacagatttaaaga

SEQ ID NO: 5981694 - DNA, 23 bp, Homo sapiens
caacagatttctaagttaaatca

SEQ ID NO: 5981695 - DNA, 20 bp, Homo sapiens
caacagatttgtgaactcag

SEQ ID NO: 5981696 - DNA, 15 bp, Homo sapiens
caacagcaaacaggt

SEQ ID NO: 5981697 - DNA, 14 bp, Homo sapiens
caacagcaaaccct

SEQ ID NO: 5981698 - DNA, 17 bp, Homo sapiens
caacagcaaaggaacta

SEQ ID NO: 5981699 - DNA, 15 bp, Homo sapiens
caacagcaacaacaa

SEQ ID NO: 5981700 - DNA, 22 bp, Homo sapiens
caacagcaagaaataaatcaga

SEQ ID NO: 5981701 - DNA, 15 bp, Homo sapiens
caacagcaagtgttt

SEQ ID NO: 5981702 - DNA, 20 bp, Homo sapiens
caacagcacacaggcagcca

SEQ ID NO: 5981703 - DNA, 12 bp, Homo sapiens
caacagcactgg

SEQ ID NO: 5981704 - DNA, 22 bp, Homo sapiens
caacagcactggctctctccag

SEQ ID NO: 5981705 - DNA, 23 bp, Homo sapiens
caacagcacttgcttgcggaact

SEQ ID NO: 5981706 - DNA, 15 bp, Homo sapiens
caacagcaggaggca

SEQ ID NO: 5981707 - DNA, 18 bp, Homo sapiens
caacagcaggaggcacag

SEQ ID NO: 5981708 - DNA, 13 bp, Homo sapiens
caacagcagtctc

SEQ ID NO: 5981709 - DNA, 14 bp, Homo sapiens
caacagccaagacc

SEQ ID NO: 5981710 - DNA, 24 bp, Homo sapiens
caacagccataataataatttgca

SEQ ID NO: 5981711 - DNA, 20 bp, Homo sapiens
caacagcccagcaagaagga

SEQ ID NO: 5981712 - DNA, 21 bp, Homo sapiens
caacagcccagcaagaaggag

SEQ ID NO: 5981713 - DNA, 21 bp, Homo sapiens
caacagcccaggcatctcctt

SEQ ID NO: 5981714 - DNA, 16 bp, Homo sapiens
caacagccctgcctga

SEQ ID NO: 5981715 - DNA, 15 bp, Homo sapiens
caacagcctcacttg

SEQ ID NO: 5981716 - DNA, 15 bp, Homo sapiens
caacagcctctgtgg

SEQ ID NO: 5981717 - DNA, 12 bp, Homo sapiens
caacagcgccca

SEQ ID NO: 5981718 - DNA, 17 bp, Homo sapiens
caacagcgtggcttaga

SEQ ID NO: 5981719 - DNA, 15 bp, Homo sapiens
caacagcgttcctag

SEQ ID NO: 5981720 - DNA, 14 bp, Homo sapiens
caacagctacaaca

SEQ ID NO: 5981721 - DNA, 22 bp, Homo sapiens
caacagctcaagtcttccctga

SEQ ID NO: 5981722 - DNA, 22 bp, Homo sapiens
caacagctctcgttctccttcc

SEQ ID NO: 5981723 - DNA, 14 bp, Homo sapiens
caacagctgaagca

SEQ ID NO: 5981724 - DNA, 23 bp, Homo sapiens
caacagctggtgccctgctttca

SEQ ID NO: 5981725 - DNA, 23 bp, Homo sapiens
caacagcttcttgcttgtaaaaa

SEQ ID NO: 5981726 - DNA, 14 bp, Homo sapiens
caacaggaactgtg

SEQ ID NO: 5981727 - DNA, 17 bp, Homo sapiens
caacaggaatctcagag

SEQ ID NO: 5981728 - DNA, 21 bp, Homo sapiens
caacaggaatctcagagacag

SEQ ID NO: 5981729 - DNA, 16 bp, Homo sapiens
caacaggacagagttc

SEQ ID NO: 5981730 - DNA, 18 bp, Homo sapiens
caacaggacagagttcac

SEQ ID NO: 5981731 - DNA, 21 bp, Homo sapiens
caacaggacagagttcacagg

SEQ ID NO: 5981732 - DNA, 16 bp, Homo sapiens
caacaggaccaggagc

SEQ ID NO: 5981733 - DNA, 19 bp, Homo sapiens
caacaggagaatggggttc

SEQ ID NO: 5981734 - DNA, 15 bp, Homo sapiens
caacaggagagacag

SEQ ID NO: 5981735 - DNA, 15 bp, Homo sapiens
caacaggagagagat

SEQ ID NO: 5981736 - DNA, 15 bp, Homo sapiens
caacaggagctggga

SEQ ID NO: 5981737 - DNA, 15 bp, Homo sapiens
caacaggaggacaat

SEQ ID NO: 5981738 - DNA, 23 bp, Homo sapiens
caacaggaggacaattcatgaac

SEQ ID NO: 5981739 - DNA, 23 bp, Homo sapiens
caacaggaggctttttcagtgat

SEQ ID NO: 5981740 - DNA, 22 bp, Homo sapiens
caacaggagtcagtctctttct

SEQ ID NO: 5981741 - DNA, 14 bp, Homo sapiens
caacaggcacctct

SEQ ID NO: 5981742 - DNA, 18 bp, Homo sapiens
caacaggcaggggcccac

SEQ ID NO: 5981743 - DNA, 13 bp, Homo sapiens
caacaggcccagg

SEQ ID NO: 5981744 - DNA, 16 bp, Homo sapiens
caacaggcccagggag

SEQ ID NO: 5981745 - DNA, 21 bp, Homo sapiens
caacaggcgtgggatcagatt

SEQ ID NO: 5981746 - DNA, 17 bp, Homo sapiens
caacaggctgggcttca

SEQ ID NO: 5981747 - DNA, 23 bp, Homo sapiens
caacaggctgttctgcactgaaa

SEQ ID NO: 5981748 - DNA, 16 bp, Homo sapiens
caacagggcttctctt

SEQ ID NO: 5981749 - DNA, 20 bp, Homo sapiens
caacaggggaggaaaaaaga

SEQ ID NO: 5981750 - DNA, 21 bp, Homo sapiens
caacagggtagatttctcttg

SEQ ID NO: 5981751 - DNA, 23 bp, Homo sapiens
caacagggtagatttctcttggg

SEQ ID NO: 5981752 - DNA, 15 bp, Homo sapiens
caacaggtaaacaca

SEQ ID NO: 5981753 - DNA, 21 bp, Homo sapiens
caacaggttttcaccatagcc

SEQ ID NO: 5981754 - DNA, 19 bp, Homo sapiens
caacaggttttcctgaaga

SEQ ID NO: 5981755 - DNA, 15 bp, Homo sapiens
caacagtaaaccact

SEQ ID NO: 5981756 - DNA, 11 bp, Homo sapiens
caacagtaaca

SEQ ID NO: 5981757 - DNA, 21 bp, Homo sapiens
caacagtaatctatgtgtttc

SEQ ID NO: 5981758 - DNA, 23 bp, Homo sapiens
caacagtaattattatttaactc

SEQ ID NO: 5981759 - DNA, 22 bp, Homo sapiens
caacagtacctgaaggattatt

SEQ ID NO: 5981760 - DNA, 20 bp, Homo sapiens
caacagtagcataggaccct

SEQ ID NO: 5981761 - DNA, 14 bp, Homo sapiens
caacagtcaaaaca

SEQ ID NO: 5981762 - DNA, 18 bp, Homo sapiens
caacagtcaaaacagaga

SEQ ID NO: 5981763 - DNA, 14 bp, Homo sapiens
caacagtcagccag

SEQ ID NO: 5981764 - DNA, 12 bp, Homo sapiens
caacagtcatgt

SEQ ID NO: 5981765 - DNA, 14 bp, Homo sapiens
caacagtcatgttt

SEQ ID NO: 5981766 - DNA, 12 bp, Homo sapiens
caacagtcttgc

SEQ ID NO: 5981767 - DNA, 13 bp, Homo sapiens
caacagtcttgct

SEQ ID NO: 5981768 - DNA, 21 bp, Homo sapiens
caacagtgaacagcttcactt

SEQ ID NO: 5981769 - DNA, 11 bp, Homo sapiens
caacagtgagt

SEQ ID NO: 5981770 - DNA, 17 bp, Homo sapiens
caacagtggggaagagt

SEQ ID NO: 5981771 - DNA, 16 bp, Homo sapiens
caacagtgtgaagtta

SEQ ID NO: 5981772 - DNA, 17 bp, Homo sapiens
caacagtgtgaagttag

SEQ ID NO: 5981773 - DNA, 19 bp, Homo sapiens
caacagtgtgaagttagaa

SEQ ID NO: 5981774 - DNA, 21 bp, Homo sapiens
caacagtgtgaagttagaatt

SEQ ID NO: 5981775 - DNA, 20 bp, Homo sapiens
caacagtttaatgaagatct

SEQ ID NO: 5981776 - DNA, 20 bp, Homo sapiens
caacagtttatttttattat

SEQ ID NO: 5981777 - DNA, 12 bp, Homo sapiens
caacagtttctc

SEQ ID NO: 5981778 - DNA, 13 bp, Homo sapiens
caacagttttcct

SEQ ID NO: 5981779 - DNA, 22 bp, Homo sapiens
caacagttttcctatgctttga

SEQ ID NO: 5981780 - DNA, 13 bp, Homo sapiens
caacataaaactc

SEQ ID NO: 5981781 - DNA, 16 bp, Homo sapiens
caacataaaattaaaa

SEQ ID NO: 5981782 - DNA, 17 bp, Homo sapiens
caacataaaattaaaat

SEQ ID NO: 5981783 - DNA, 18 bp, Homo sapiens
caacataacccacttgtc

SEQ ID NO: 5981784 - DNA, 17 bp, Homo sapiens
caacataactcaagtct

SEQ ID NO: 5981785 - DNA, 16 bp, Homo sapiens
caacataattcttcct

SEQ ID NO: 5981786 - DNA, 17 bp, Homo sapiens
caacataattcttcctt

SEQ ID NO: 5981787 - DNA, 13 bp, Homo sapiens
caacatacaattt

SEQ ID NO: 5981788 - DNA, 22 bp, Homo sapiens
caacatacattggttttgaaat

SEQ ID NO: 5981789 - DNA, 19 bp, Homo sapiens
caacatacccttctttaaa

SEQ ID NO: 5981790 - DNA, 22 bp, Homo sapiens
caacatacgggaagtttatttc

SEQ ID NO: 5981791 - DNA, 14 bp, Homo sapiens
caacatactcccat

SEQ ID NO: 5981792 - DNA, 19 bp, Homo sapiens
caacatactcccatctgtg

SEQ ID NO: 5981793 - DNA, 19 bp, Homo sapiens
caacatagtgagacactgt

SEQ ID NO: 5981794 - DNA, 13 bp, Homo sapiens
caacatataaaat

SEQ ID NO: 5981795 - DNA, 14 bp, Homo sapiens
caacatataaaata

SEQ ID NO: 5981796 - DNA, 14 bp, Homo sapiens
caacatataaagta

SEQ ID NO: 5981797 - DNA, 15 bp, Homo sapiens
caacatatcattttt

SEQ ID NO: 5981798 - DNA, 19 bp, Homo sapiens
caacatcaaaacttaagat

SEQ ID NO: 5981799 - DNA, 15 bp, Homo sapiens
caacatcaagaaaac

SEQ ID NO: 5981800 - DNA, 13 bp, Homo sapiens
caacatcaatgtt

SEQ ID NO: 5981801 - DNA, 19 bp, Homo sapiens
caacatcacacagtatact

SEQ ID NO: 5981802 - DNA, 22 bp, Homo sapiens
caacatcactaatttggctttc

SEQ ID NO: 5981803 - DNA, 14 bp, Homo sapiens
caacatcagcttga

SEQ ID NO: 5981804 - DNA, 20 bp, Homo sapiens
caacatcagctttctaatgt

SEQ ID NO: 5981805 - DNA, 13 bp, Homo sapiens
caacatccactct

SEQ ID NO: 5981806 - DNA, 19 bp, Homo sapiens
caccacgatgacgcctctg

SEQ ID NO: 5981807 - DNA, 20 bp, Homo sapiens
caccacgatgacgcctctgg

SEQ ID NO: 5981808 - DNA, 22 bp, Homo sapiens
caccacgatgtggccctggcct

SEQ ID NO: 5981809 - DNA, 16 bp, Homo sapiens
caccacgattctccca

SEQ ID NO: 5981810 - DNA, 15 bp, Homo sapiens
caccacgcccggcta

SEQ ID NO: 5981811 - DNA, 22 bp, Homo sapiens
caccacgcccggctaatgtttg

SEQ ID NO: 5981812 - DNA, 13 bp, Homo sapiens
caccacgcctggc

SEQ ID NO: 5981813 - DNA, 21 bp, Homo sapiens
caccacggcattatgatccct

SEQ ID NO: 5981814 - DNA, 16 bp, Homo sapiens
caccacggcgtttttt

SEQ ID NO: 5981815 - DNA, 22 bp, Homo sapiens
caccacgggacatcacagggtg

SEQ ID NO: 5981816 - DNA, 15 bp, Homo sapiens
caccacggtggtcac

SEQ ID NO: 5981817 - DNA, 18 bp, Homo sapiens
caccacgtctgccaggcc

SEQ ID NO: 5981818 - DNA, 20 bp, Homo sapiens
caccacgtctggctccctgc

SEQ ID NO: 5981819 - DNA, 18 bp, Homo sapiens
caccacgtggggccatgc

SEQ ID NO: 5981820 - DNA, 21 bp, Homo sapiens
caccactaaccatccccaact

SEQ ID NO: 5981821 - DNA, 20 bp, Homo sapiens
caccactacagtaagctggt

SEQ ID NO: 5981822 - DNA, 16 bp, Homo sapiens
caccactacattctgt

SEQ ID NO: 5981823 - DNA, 16 bp, Homo sapiens
caccactaccagccag

SEQ ID NO: 5981824 - DNA, 14 bp, Homo sapiens
caccactagagctg

SEQ ID NO: 5981825 - DNA, 18 bp, Homo sapiens
caccactagcctcagggg

SEQ ID NO: 5981826 - DNA, 13 bp, Homo sapiens
caccactataaaa

SEQ ID NO: 5981827 - DNA, 23 bp, Homo sapiens
caccactatctccgttccatctg

SEQ ID NO: 5981828 - DNA, 15 bp, Homo sapiens
caccactcaggccac

SEQ ID NO: 5981829 - DNA, 13 bp, Homo sapiens
caccactcagtgc

SEQ ID NO: 5981830 - DNA, 13 bp, Homo sapiens
caccactccattc

SEQ ID NO: 5981831 - DNA, 15 bp, Homo sapiens
caccactccattccc

SEQ ID NO: 5981832 - DNA, 16 bp, Homo sapiens
caccactccattccca

SEQ ID NO: 5981833 - DNA, 18 bp, Homo sapiens
caccactccccaacccct

SEQ ID NO: 5981834 - DNA, 11 bp, Homo sapiens
caccactcctc

SEQ ID NO: 5981835 - DNA, 16 bp, Homo sapiens
caccactcctctccct

SEQ ID NO: 5981836 - DNA, 19 bp, Homo sapiens
caccactcctgccagcccg

SEQ ID NO: 5981837 - DNA, 15 bp, Homo sapiens
caccactcctgcctg

SEQ ID NO: 5981838 - DNA, 13 bp, Homo sapiens
caccactctcagg

SEQ ID NO: 5981839 - DNA, 24 bp, Homo sapiens
caccactctcaggaccaccctgcc

SEQ ID NO: 5981840 - DNA, 19 bp, Homo sapiens
caccactctggcagccaca

SEQ ID NO: 5981841 - DNA, 16 bp, Homo sapiens
caccactctgggcaca

SEQ ID NO: 5981842 - DNA, 18 bp, Homo sapiens
caccactgagctctgcct

SEQ ID NO: 5981843 - DNA, 21 bp, Homo sapiens
caccactgatatcatggggag

SEQ ID NO: 5981844 - DNA, 15 bp, Homo sapiens
caccactgcactcca

SEQ ID NO: 5981845 - DNA, 20 bp, Homo sapiens
caccactgcactccagcctg

SEQ ID NO: 5981846 - DNA, 21 bp, Homo sapiens
caccactgcactccagcctgg

SEQ ID NO: 5981847 - DNA, 13 bp, Homo sapiens
caccactgcagcc

SEQ ID NO: 5981848 - DNA, 15 bp, Homo sapiens
caccactgccctgcc

SEQ ID NO: 5981849 - DNA, 17 bp, Homo sapiens
caccactgccctgcctg

SEQ ID NO: 5981850 - DNA, 21 bp, Homo sapiens
caccactgccctgcctgccca

SEQ ID NO: 5981851 - DNA, 22 bp, Homo sapiens
caccactgccctgcctgcccac

SEQ ID NO: 5981852 - DNA, 14 bp, Homo sapiens
caccactgctgagg

SEQ ID NO: 5981853 - DNA, 19 bp, Homo sapiens
caccactgcttcccactgg

SEQ ID NO: 5981854 - DNA, 15 bp, Homo sapiens
caccactggccacca

SEQ ID NO: 5981855 - DNA, 20 bp, Homo sapiens
caccactggccaccaggctg

SEQ ID NO: 5981856 - DNA, 21 bp, Homo sapiens
caccactggccaccaggctgg

SEQ ID NO: 5981857 - DNA, 15 bp, Homo sapiens
caccactgggaacca

SEQ ID NO: 5981858 - DNA, 14 bp, Homo sapiens
caccactgtcccta

SEQ ID NO: 5981859 - DNA, 15 bp, Homo sapiens
caccactgtccctac

SEQ ID NO: 5981860 - DNA, 15 bp, Homo sapiens
caccactgtgtccca

SEQ ID NO: 5981861 - DNA, 17 bp, Homo sapiens
caccactgtgtcccagt

SEQ ID NO: 5981862 - DNA, 19 bp, Homo sapiens
caccactgtgtcccagtgt

SEQ ID NO: 5981863 - DNA, 16 bp, Homo sapiens
caccacttgacagact

SEQ ID NO: 5981864 - DNA, 22 bp, Homo sapiens
caccacttggagatctttgctt

SEQ ID NO: 5981865 - DNA, 22 bp, Homo sapiens
caccactttgtctctgagaaca

SEQ ID NO: 5981866 - DNA, 21 bp, Homo sapiens
caccagaaatatcgctgatgc

SEQ ID NO: 5981867 - DNA, 23 bp, Homo sapiens
caccagaaatatcgctgatgcag

SEQ ID NO: 5981868 - DNA, 17 bp, Homo sapiens
caccagaaattccagta

SEQ ID NO: 5981869 - DNA, 19 bp, Homo sapiens
caccagaacgcaccccact

SEQ ID NO: 5981870 - DNA, 21 bp, Homo sapiens
caccagaacgcaccccactgg

SEQ ID NO: 5981871 - DNA, 15 bp, Homo sapiens
caccagaagcccaga

SEQ ID NO: 5981872 - DNA, 16 bp, Homo sapiens
caccagaagcccagaa

SEQ ID NO: 5981873 - DNA, 16 bp, Homo sapiens
caccagaagtgccatg

SEQ ID NO: 5981874 - DNA, 12 bp, Homo sapiens
caccagaataaa

SEQ ID NO: 5981875 - DNA, 13 bp, Homo sapiens
caccagaattagt

SEQ ID NO: 5981876 - DNA, 18 bp, Homo sapiens
caccagaattagtcctca

SEQ ID NO: 5981877 - DNA, 16 bp, Homo sapiens
caccagacatcaccct

SEQ ID NO: 5981878 - DNA, 17 bp, Homo sapiens
caccagacatcaccctt

SEQ ID NO: 5981879 - DNA, 20 bp, Homo sapiens
caccagacatcaccctttgc

SEQ ID NO: 5981880 - DNA, 20 bp, Homo sapiens
caccagacccacctggagcc

SEQ ID NO: 5981881 - DNA, 22 bp, Homo sapiens
caccagacccacctggagcccg

SEQ ID NO: 5981882 - DNA, 17 bp, Homo sapiens
caccagacggggctgga

SEQ ID NO: 5981883 - DNA, 16 bp, Homo sapiens
caccagagaccgtcct

SEQ ID NO: 5981884 - DNA, 21 bp, Homo sapiens
caccagagagggactgacacc

SEQ ID NO: 5981885 - DNA, 20 bp, Homo sapiens
caccagagcaggggctgctg

SEQ ID NO: 5981886 - DNA, 14 bp, Homo sapiens
caccagagcccatg

SEQ ID NO: 5981887 - DNA, 19 bp, Homo sapiens
caccagagcccatgctcaa

SEQ ID NO: 5981888 - DNA, 14 bp, Homo sapiens
caccagagctgcct

SEQ ID NO: 5981889 - DNA, 16 bp, Homo sapiens
caccagagctgcctcc

SEQ ID NO: 5981890 - DNA, 18 bp, Homo sapiens
caccagagctgcctcccc

SEQ ID NO: 5981891 - DNA, 17 bp, Homo sapiens
caccagagcttctctgg

SEQ ID NO: 5981892 - DNA, 20 bp, Homo sapiens
caccagagcttctctgggct

SEQ ID NO: 5981893 - DNA, 13 bp, Homo sapiens
caccagaggccga

SEQ ID NO: 5981894 - DNA, 20 bp, Homo sapiens
caccagaggctgcagaaggc

SEQ ID NO: 5981895 - DNA, 20 bp, Homo sapiens
caccagagtcttaagggtca

SEQ ID NO: 5981896 - DNA, 12 bp, Homo sapiens
caccagagtgaa

SEQ ID NO: 5981897 - DNA, 23 bp, Homo sapiens
caccagagtgaaagggctatggc

SEQ ID NO: 5981898 - DNA, 16 bp, Homo sapiens
caccagatagcagagg

SEQ ID NO: 5981899 - DNA, 14 bp, Homo sapiens
caccagatgagaat

SEQ ID NO: 5981900 - DNA, 13 bp, Homo sapiens
caccagatgctga

SEQ ID NO: 5981901 - DNA, 23 bp, Homo sapiens
caccagatgctgaaaatgtcctt

SEQ ID NO: 5981902 - DNA, 23 bp, Homo sapiens
caccagatgcttttgtgagaaag

SEQ ID NO: 5981903 - DNA, 14 bp, Homo sapiens
caccagcaacatct

SEQ ID NO: 5981904 - DNA, 17 bp, Homo sapiens
caccagcaacatctcga

SEQ ID NO: 5981905 - DNA, 18 bp, Homo sapiens
caccagcaatgccctgcc

SEQ ID NO: 5981906 - DNA, 21 bp, Homo sapiens
caccagcaatgccctgccttg

SEQ ID NO: 5981907 - DNA, 11 bp, Homo sapiens
caccagcacca

SEQ ID NO: 5981908 - DNA, 12 bp, Homo sapiens
caccagcagcac

SEQ ID NO: 5981909 - DNA, 15 bp, Homo sapiens
caccagcagcacaat

SEQ ID NO: 5981910 - DNA, 18 bp, Homo sapiens
caccagcagcacaattct

SEQ ID NO: 5981911 - DNA, 23 bp, Homo sapiens
caccagcagcacaattctgtccc

SEQ ID NO: 5981912 - DNA, 14 bp, Homo sapiens
caccagcagcagaa

SEQ ID NO: 5981913 - DNA, 19 bp, Homo sapiens
caccagcatcacctgcctg

SEQ ID NO: 5981914 - DNA, 20 bp, Homo sapiens
caccagcatcacctgcctgt

SEQ ID NO: 5981915 - DNA, 15 bp, Homo sapiens
caccagcatccacct

SEQ ID NO: 5981916 - DNA, 20 bp, Homo sapiens
caccagcatccaccttggct

SEQ ID NO: 5981917 - DNA, 14 bp, Homo sapiens
caccagcatgtcac

SEQ ID NO: 5981918 - DNA, 15 bp, Homo sapiens
caccagcattccttt

SEQ ID NO: 5981919 - DNA, 18 bp, Homo sapiens
caccagccacagcctccc

SEQ ID NO: 5981920 - DNA, 18 bp, Homo sapiens
caccagccacctcatccc

SEQ ID NO: 5981921 - DNA, 12 bp, Homo sapiens
caccagccagcc

SEQ ID NO: 5981922 - DNA, 15 bp, Homo sapiens
caccagccagccctg

SEQ ID NO: 5981923 - DNA, 14 bp, Homo sapiens
caccagccaggctc

SEQ ID NO: 5981924 - DNA, 18 bp, Homo sapiens
caccagccaggctctgtg

SEQ ID NO: 5981925 - DNA, 14 bp, Homo sapiens
caccagcccagaag

SEQ ID NO: 5981926 - DNA, 10 bp, Homo sapiens
caccagcccc

SEQ ID NO: 5981927 - DNA, 22 bp, Homo sapiens
caccagccccactgccagcagc

SEQ ID NO: 5981928 - DNA, 18 bp, Homo sapiens
caccagccccagtgccca

SEQ ID NO: 5981929 - DNA, 22 bp, Homo sapiens
caccagccccagtgcccacagg

SEQ ID NO: 5981930 - DNA, 19 bp, Homo sapiens
caccagccccggccttgct

SEQ ID NO: 5981931 - DNA, 22 bp, Homo sapiens
caccagcccctccccagactct

SEQ ID NO: 5981932 - DNA, 16 bp, Homo sapiens
caccagcccctgcccc

SEQ ID NO: 5981933 - DNA, 17 bp, Homo sapiens
caccagcccctgcccca

SEQ ID NO: 5981934 - DNA, 18 bp, Homo sapiens
caccagcccgcaactctc

SEQ ID NO: 5981935 - DNA, 22 bp, Homo sapiens
caccagcccgcaactctccagc

SEQ ID NO: 5981936 - DNA, 18 bp, Homo sapiens
caccagcccggcctgctc

SEQ ID NO: 5981937 - DNA, 20 bp, Homo sapiens
caccagccctagctgtccca

SEQ ID NO: 5981938 - DNA, 15 bp, Homo sapiens
caccagccctgagcc

SEQ ID NO: 5981939 - DNA, 23 bp, Homo sapiens
caccagccctgctgcttcctaac

SEQ ID NO: 5981940 - DNA, 14 bp, Homo sapiens
caccagcccttccc

SEQ ID NO: 5981941 - DNA, 15 bp, Homo sapiens
caccagccgccccag

SEQ ID NO: 5981942 - DNA, 13 bp, Homo sapiens
caccagccgctgc

SEQ ID NO: 5981943 - DNA, 18 bp, Homo sapiens
caccagcctagcctggct

SEQ ID NO: 5981944 - DNA, 15 bp, Homo sapiens
caccagcctcagtgc

SEQ ID NO: 5981945 - DNA, 15 bp, Homo sapiens
caccagcctcctggg

SEQ ID NO: 5981946 - DNA, 15 bp, Homo sapiens
caccagcctgctgac

SEQ ID NO: 5981947 - DNA, 22 bp, Homo sapiens
caccagcctgctgacagacact

SEQ ID NO: 5981948 - DNA, 23 bp, Homo sapiens
caccagcctgctgacagacacta

SEQ ID NO: 5981949 - DNA, 15 bp, Homo sapiens
caccagccttgctct

SEQ ID NO: 5981950 - DNA, 18 bp, Homo sapiens
caccagccttgctctctt

SEQ ID NO: 5981951 - DNA, 22 bp, Homo sapiens
caccagcctttctcccaggcca

SEQ ID NO: 5981952 - DNA, 14 bp, Homo sapiens
caccagcgccccca

SEQ ID NO: 5981953 - DNA, 20 bp, Homo sapiens
caccagcgcccccactcctc

SEQ ID NO: 5981954 - DNA, 16 bp, Homo sapiens
caccagcgcccccaga

SEQ ID NO: 5981955 - DNA, 23 bp, Homo sapiens
caccagcggccttgaagaggcag

SEQ ID NO: 5981956 - DNA, 16 bp, Homo sapiens
caccagcgttcccttc

SEQ ID NO: 5981957 - DNA, 22 bp, Homo sapiens
caccagcgttcccttctccccc

SEQ ID NO: 5981958 - DNA, 21 bp, Homo sapiens
caccagcgtttgaggggctgg

SEQ ID NO: 5981959 - DNA, 21 bp, Homo sapiens
caccagctagaaagtggcaga

SEQ ID NO: 5981960 - DNA, 14 bp, Homo sapiens
caccagctatctgt

SEQ ID NO: 5981961 - DNA, 20 bp, Homo sapiens
caccagctccactggcctgc

SEQ ID NO: 5981962 - DNA, 15 bp, Homo sapiens
caccagctctgtggc

SEQ ID NO: 5981963 - DNA, 17 bp, Homo sapiens
caccagctctgtggcct

SEQ ID NO: 5981964 - DNA, 22 bp, Homo sapiens
caccagctctgtggcctgtgtc

SEQ ID NO: 5981965 - DNA, 11 bp, Homo sapiens
caccagctgca

SEQ ID NO: 5981966 - DNA, 12 bp, Homo sapiens
caccagctgcaa

SEQ ID NO: 5981967 - DNA, 14 bp, Homo sapiens
caccagctgcagcc

SEQ ID NO: 5981968 - DNA, 12 bp, Homo sapiens
caccagctgcct

SEQ ID NO: 5981969 - DNA, 16 bp, Homo sapiens
caccagctgcctcttc

SEQ ID NO: 5981970 - DNA, 23 bp, Homo sapiens
caccagctgcctctttgctgctt

SEQ ID NO: 5981971 - DNA, 13 bp, Homo sapiens
caccagctgctct

SEQ ID NO: 5981972 - DNA, 14 bp, Homo sapiens
caccagctgctctg

SEQ ID NO: 5981973 - DNA, 15 bp, Homo sapiens
caccagctgctctgc

SEQ ID NO: 5981974 - DNA, 17 bp, Homo sapiens
caccagctgctctgccc

SEQ ID NO: 5981975 - DNA, 18 bp, Homo sapiens
caccagctgctctgcccc

SEQ ID NO: 5981976 - DNA, 16 bp, Homo sapiens
caccagctgctgtgcc

SEQ ID NO: 5981977 - DNA, 20 bp, Homo sapiens
caccagctgctgtgccccac

SEQ ID NO: 5981978 - DNA, 13 bp, Homo sapiens
caccagctggctc

SEQ ID NO: 5981979 - DNA, 19 bp, Homo sapiens
caccagctggctctgcagc

SEQ ID NO: 5981980 - DNA, 20 bp, Homo sapiens
caccagctggctctgcagca

SEQ ID NO: 5981981 - DNA, 14 bp, Homo sapiens
caccagctgtgtcc

SEQ ID NO: 5981982 - DNA, 20 bp, Homo sapiens
caccagcttcactctctccg

SEQ ID NO: 5981983 - DNA, 17 bp, Homo sapiens
caccagcttctccaggc

SEQ ID NO: 5981984 - DNA, 19 bp, Homo sapiens
caccagcttctccaggctc

SEQ ID NO: 5981985 - DNA, 13 bp, Homo sapiens
caacatccactgt

SEQ ID NO: 5981986 - DNA, 18 bp, Homo sapiens
caacatcctgccagcccc

SEQ ID NO: 5981987 - DNA, 13 bp, Homo sapiens
caacatctagcaa

SEQ ID NO: 5981988 - DNA, 17 bp, Homo sapiens
caacatctccagctgga

SEQ ID NO: 5981989 - DNA, 13 bp, Homo sapiens
caacatctctgaa

SEQ ID NO: 5981990 - DNA, 14 bp, Homo sapiens
caacatctctgaat

SEQ ID NO: 5981991 - DNA, 12 bp, Homo sapiens
caacatctgaga

SEQ ID NO: 5981992 - DNA, 21 bp, Homo sapiens
caacatcttacttgtcctttg

SEQ ID NO: 5981993 - DNA, 18 bp, Homo sapiens
caacatctttctttttaa

SEQ ID NO: 5981994 - DNA, 13 bp, Homo sapiens
caacatcttttct

SEQ ID NO: 5981995 - DNA, 20 bp, Homo sapiens
caacatcttttgataattgt

SEQ ID NO: 5981996 - DNA, 15 bp, Homo sapiens
caacatgaaactgcc

SEQ ID NO: 5981997 - DNA, 17 bp, Homo sapiens
caacatgaaactgccta

SEQ ID NO: 5981998 - DNA, 17 bp, Homo sapiens
caacatgaatttttatg

SEQ ID NO: 5981999 - DNA, 15 bp, Homo sapiens
caacatgaggacaga

SEQ ID NO: 5982000 - DNA, 20 bp, Homo sapiens
caacatgaggacagaaggac

SEQ ID NO: 5982001 - DNA, 19 bp, Homo sapiens
caacatgaggccactggag

SEQ ID NO: 5982002 - DNA, 15 bp, Homo sapiens
caacatgagtcaaga

SEQ ID NO: 5982003 - DNA, 17 bp, Homo sapiens
caacatgatacctggat

SEQ ID NO: 5982004 - DNA, 22 bp, Homo sapiens
caacatgatccccgtctctgcc

SEQ ID NO: 5982005 - DNA, 23 bp, Homo sapiens
caacatgatccccgtctctgccc

SEQ ID NO: 5982006 - DNA, 12 bp, Homo sapiens
caacatgcacat

SEQ ID NO: 5982007 - DNA, 18 bp, Homo sapiens
caacatgcatatgatata

SEQ ID NO: 5982008 - DNA, 20 bp, Homo sapiens
caacatgcatatgatatata

SEQ ID NO: 5982009 - DNA, 13 bp, Homo sapiens
caacatggagaaa

SEQ ID NO: 5982010 - DNA, 22 bp, Homo sapiens
caacatggagaaaccctgtctc

SEQ ID NO: 5982011 - DNA, 23 bp, Homo sapiens
caacatggagaaaccctgtctct

SEQ ID NO: 5982012 - DNA, 17 bp, Homo sapiens
caacatggatgtgttgc

SEQ ID NO: 5982013 - DNA, 15 bp, Homo sapiens
caacatggcaattgc

SEQ ID NO: 5982014 - DNA, 18 bp, Homo sapiens
caacatggcgaaaccccg

SEQ ID NO: 5982015 - DNA, 21 bp, Homo sapiens
caacatggctacttgctttga

SEQ ID NO: 5982016 - DNA, 16 bp, Homo sapiens
caacatggcttctcct

SEQ ID NO: 5982017 - DNA, 22 bp, Homo sapiens
caacatggcttctcctttggca

SEQ ID NO: 5982018 - DNA, 12 bp, Homo sapiens
caacatgggagg

SEQ ID NO: 5982019 - DNA, 14 bp, Homo sapiens
caacatgggaggga

SEQ ID NO: 5982020 - DNA, 12 bp, Homo sapiens
caacatggtcct

SEQ ID NO: 5982021 - DNA, 15 bp, Homo sapiens
caacatggtgtctgg

SEQ ID NO: 5982022 - DNA, 23 bp, Homo sapiens
caacatgtagggcaagaggatga

SEQ ID NO: 5982023 - DNA, 17 bp, Homo sapiens
caacatgtataatattt

SEQ ID NO: 5982024 - DNA, 17 bp, Homo sapiens
caacatgtatctgtcta

SEQ ID NO: 5982025 - DNA, 22 bp, Homo sapiens
caacatgtatctgtctactttc

SEQ ID NO: 5982026 - DNA, 23 bp, Homo sapiens
caacatgtatctgtctactttct

SEQ ID NO: 5982027 - DNA, 15 bp, Homo sapiens
caacatgtatgtgga

SEQ ID NO: 5982028 - DNA, 21 bp, Homo sapiens
caacatgtggctcctcccagc

SEQ ID NO: 5982029 - DNA, 12 bp, Homo sapiens
caacatgtgtga

SEQ ID NO: 5982030 - DNA, 17 bp, Homo sapiens
caacatgttactgacca

SEQ ID NO: 5982031 - DNA, 23 bp, Homo sapiens
caacatgttatttgtaatagatg

SEQ ID NO: 5982032 - DNA, 23 bp, Homo sapiens
caacatgttctaccgtggatttg

SEQ ID NO: 5982033 - DNA, 20 bp, Homo sapiens
caacattaaaacaatattgt

SEQ ID NO: 5982034 - DNA, 21 bp, Homo sapiens
caacattacagggaatgcctg

SEQ ID NO: 5982035 - DNA, 16 bp, Homo sapiens
caacattaggagtaac

SEQ ID NO: 5982036 - DNA, 24 bp, Homo sapiens
caacattatcctgtgtgattacag

SEQ ID NO: 5982037 - DNA, 16 bp, Homo sapiens
caacattatgatctaa

SEQ ID NO: 5982038 - DNA, 23 bp, Homo sapiens
caacattatgatctaataaactt

SEQ ID NO: 5982039 - DNA, 19 bp, Homo sapiens
caacattcaaaagcacaaa

SEQ ID NO: 5982040 - DNA, 16 bp, Homo sapiens
caacattccagggttg

SEQ ID NO: 5982041 - DNA, 21 bp, Homo sapiens
caacattcctttcttgtgccc

SEQ ID NO: 5982042 - DNA, 16 bp, Homo sapiens
caacattgaatatcag

SEQ ID NO: 5982043 - DNA, 15 bp, Homo sapiens
caacattgcctattt

SEQ ID NO: 5982044 - DNA, 10 bp, Homo sapiens
caacattgtg

SEQ ID NO: 5982045 - DNA, 16 bp, Homo sapiens
caacattgtgatgtat

SEQ ID NO: 5982046 - DNA, 18 bp, Homo sapiens
caacattgttcattcttg

SEQ ID NO: 5982047 - DNA, 23 bp, Homo sapiens
caacatttacagtccttcaaaat

SEQ ID NO: 5982048 - DNA, 21 bp, Homo sapiens
caacatttatatattgtctgt

SEQ ID NO: 5982049 - DNA, 23 bp, Homo sapiens
caacatttatgacctaagtcagg

SEQ ID NO: 5982050 - DNA, 17 bp, Homo sapiens
caacatttctcaataat

SEQ ID NO: 5982051 - DNA, 23 bp, Homo sapiens
caacatttctgccaggtttgtta

SEQ ID NO: 5982052 - DNA, 18 bp, Homo sapiens
caacatttctgtatactg

SEQ ID NO: 5982053 - DNA, 22 bp, Homo sapiens
caacatttctgtatactgtaaa

SEQ ID NO: 5982054 - DNA, 23 bp, Homo sapiens
caacatttgtgcagaaatttgaa

SEQ ID NO: 5982055 - DNA, 14 bp, Homo sapiens
caacattttcttga

SEQ ID NO: 5982056 - DNA, 17 bp, Homo sapiens
caacattttcttgaatt

SEQ ID NO: 5982057 - DNA, 19 bp, Homo sapiens
caacattttcttgaatttt

SEQ ID NO: 5982058 - DNA, 20 bp, Homo sapiens
caacattttgagaacaaaga

SEQ ID NO: 5982059 - DNA, 17 bp, Homo sapiens
caacatttttgtacatt

SEQ ID NO: 5982060 - DNA, 18 bp, Homo sapiens
caacatttttgtacatta

SEQ ID NO: 5982061 - DNA, 19 bp, Homo sapiens
caacatttttgtacattat

SEQ ID NO: 5982062 - DNA, 14 bp, Homo sapiens
caaccaaaagggaa

SEQ ID NO: 5982063 - DNA, 19 bp, Homo sapiens
caaccaaaagggaaaaaat

SEQ ID NO: 5982064 - DNA, 21 bp, Homo sapiens
caaccaaaagggaaaaaataa

SEQ ID NO: 5982065 - DNA, 10 bp, Homo sapiens
caaccaaagt

SEQ ID NO: 5982066 - DNA, 18 bp, Homo sapiens
caaccaaagttagttcag

SEQ ID NO: 5982067 - DNA, 16 bp, Homo sapiens
caaccaaccaaccaac

SEQ ID NO: 5982068 - DNA, 14 bp, Homo sapiens
caaccaaccacaaa

SEQ ID NO: 5982069 - DNA, 19 bp, Homo sapiens
caaccaactgccccagggg

SEQ ID NO: 5982070 - DNA, 19 bp, Homo sapiens
caaccaactgtaatgcagg

SEQ ID NO: 5982071 - DNA, 16 bp, Homo sapiens
caaccaactttccccc

SEQ ID NO: 5982072 - DNA, 22 bp, Homo sapiens
caaccaagaatgttatgtgcaa

SEQ ID NO: 5982073 - DNA, 22 bp, Homo sapiens
caaccaagaggatttcttcaaa

SEQ ID NO: 5982074 - DNA, 14 bp, Homo sapiens
caaccaaggaagga

SEQ ID NO: 5982075 - DNA, 20 bp, Homo sapiens
caaccaagtcatgtgcattt

SEQ ID NO: 5982076 - DNA, 11 bp, Homo sapiens
caaccaataaa

SEQ ID NO: 5982077 - DNA, 13 bp, Homo sapiens
caaccaataaaag

SEQ ID NO: 5982078 - DNA, 14 bp, Homo sapiens
caaccaataaaagt

SEQ ID NO: 5982079 - DNA, 22 bp, Homo sapiens
caaccaatgcacacagtagggc

SEQ ID NO: 5982080 - DNA, 20 bp, Homo sapiens
caaccaatttacactgccat

SEQ ID NO: 5982081 - DNA, 13 bp, Homo sapiens
caaccacaaaact

SEQ ID NO: 5982082 - DNA, 17 bp, Homo sapiens
caaccacacacacctgt

SEQ ID NO: 5982083 - DNA, 14 bp, Homo sapiens
caaccacacccaca

SEQ ID NO: 5982084 - DNA, 15 bp, Homo sapiens
caaccacactgcttg

SEQ ID NO: 5982085 - DNA, 16 bp, Homo sapiens
caaccacactgcttgg

SEQ ID NO: 5982086 - DNA, 13 bp, Homo sapiens
caaccacagagaa

SEQ ID NO: 5982087 - DNA, 18 bp, Homo sapiens
caaccacatgtcccagat

SEQ ID NO: 5982088 - DNA, 21 bp, Homo sapiens
caaccaccaccttatacatca

SEQ ID NO: 5982089 - DNA, 14 bp, Homo sapiens
caaccaccatggat

SEQ ID NO: 5982090 - DNA, 20 bp, Homo sapiens
caaccaccgctccccagccc

SEQ ID NO: 5982091 - DNA, 15 bp, Homo sapiens
caaccacctctggcc

SEQ ID NO: 5982092 - DNA, 16 bp, Homo sapiens
caaccacgcaggaagc

SEQ ID NO: 5982093 - DNA, 16 bp, Homo sapiens
caaccacgtggagaaa

SEQ ID NO: 5982094 - DNA, 17 bp, Homo sapiens
caaccactaaagtatag

SEQ ID NO: 5982095 - DNA, 14 bp, Homo sapiens
caaccactctgtgg

SEQ ID NO: 5982096 - DNA, 18 bp, Homo sapiens
caaccactgcgaccacaa

SEQ ID NO: 5982097 - DNA, 22 bp, Homo sapiens
caaccactggtctgtagggatt

SEQ ID NO: 5982098 - DNA, 19 bp, Homo sapiens
caaccactgtaaaatgaaa

SEQ ID NO: 5982099 - DNA, 21 bp, Homo sapiens
caaccactgtaaaatgaaatt

SEQ ID NO: 5982100 - DNA, 14 bp, Homo sapiens
caaccactgtgcca

SEQ ID NO: 5982101 - DNA, 17 bp, Homo sapiens
caaccactgtgccactg

SEQ ID NO: 5982102 - DNA, 14 bp, Homo sapiens
caaccactgtggcg

SEQ ID NO: 5982103 - DNA, 22 bp, Homo sapiens
caaccactgtggcgttctgctg

SEQ ID NO: 5982104 - DNA, 23 bp, Homo sapiens
caaccactttctcaggcttctca

SEQ ID NO: 5982105 - DNA, 21 bp, Homo sapiens
caaccagaaacaatgtgtcta

SEQ ID NO: 5982106 - DNA, 23 bp, Homo sapiens
caaccagaaacacccctctgtct

SEQ ID NO: 5982107 - DNA, 14 bp, Homo sapiens
caaccagaaaggga

SEQ ID NO: 5982108 - DNA, 20 bp, Homo sapiens
caaccagaactttctgtcct

SEQ ID NO: 5982109 - DNA, 12 bp, Homo sapiens
caaccagacaga

SEQ ID NO: 5982110 - DNA, 13 bp, Homo sapiens
caaccagacagag

SEQ ID NO: 5982111 - DNA, 13 bp, Homo sapiens
caaccagacagat

SEQ ID NO: 5982112 - DNA, 14 bp, Homo sapiens
caaccagactttga

SEQ ID NO: 5982113 - DNA, 16 bp, Homo sapiens
caaccagagcactgta

SEQ ID NO: 5982114 - DNA, 20 bp, Homo sapiens
caaccagagcactgtatacc

SEQ ID NO: 5982115 - DNA, 11 bp, Homo sapiens
caaccagagcc

SEQ ID NO: 5982116 - DNA, 21 bp, Homo sapiens
caaccagataaagaactaaat

SEQ ID NO: 5982117 - DNA, 20 bp, Homo sapiens
caaccagataacataccttt

SEQ ID NO: 5982118 - DNA, 20 bp, Homo sapiens
caaccagattgtcagctcct

SEQ ID NO: 5982119 - DNA, 18 bp, Homo sapiens
caaccagatttattttaa

SEQ ID NO: 5982120 - DNA, 18 bp, Homo sapiens
caaccagcattttactac

SEQ ID NO: 5982121 - DNA, 18 bp, Homo sapiens
caaccagccacacagagc

SEQ ID NO: 5982122 - DNA, 12 bp, Homo sapiens
caaccagccagc

SEQ ID NO: 5982123 - DNA, 16 bp, Homo sapiens
caaccagccagcgtcc

SEQ ID NO: 5982124 - DNA, 22 bp, Homo sapiens
caaccagcccgacagtgccatc

SEQ ID NO: 5982125 - DNA, 17 bp, Homo sapiens
caaccagctaagaaaag

SEQ ID NO: 5982126 - DNA, 13 bp, Homo sapiens
caaccaggaagaa

SEQ ID NO: 5982127 - DNA, 14 bp, Homo sapiens
caaccaggacccag

SEQ ID NO: 5982128 - DNA, 15 bp, Homo sapiens
caaccaggacccagg

SEQ ID NO: 5982129 - DNA, 20 bp, Homo sapiens
caaccaggagctgatggcag

SEQ ID NO: 5982130 - DNA, 19 bp, Homo sapiens
caaccaggcacctcttcct

SEQ ID NO: 5982131 - DNA, 13 bp, Homo sapiens
caaccaggcagag

SEQ ID NO: 5982132 - DNA, 14 bp, Homo sapiens
caaccaggcagctg

SEQ ID NO: 5982133 - DNA, 16 bp, Homo sapiens
caaccaggccctgcca

SEQ ID NO: 5982134 - DNA, 18 bp, Homo sapiens
caaccaggccttcatcct

SEQ ID NO: 5982135 - DNA, 22 bp, Homo sapiens
caaccaggccttcatcctcctc

SEQ ID NO: 5982136 - DNA, 19 bp, Homo sapiens
caaccaggctacagttgat

SEQ ID NO: 5982137 - DNA, 22 bp, Homo sapiens
caaccagggattgtttctgttt

SEQ ID NO: 5982138 - DNA, 12 bp, Homo sapiens
caaccagtgcca

SEQ ID NO: 5982139 - DNA, 17 bp, Homo sapiens
caaccagtgccaaggac

SEQ ID NO: 5982140 - DNA, 13 bp, Homo sapiens
caaccatacttta

SEQ ID NO: 5982141 - DNA, 15 bp, Homo sapiens
caaccatactttata

SEQ ID NO: 5982142 - DNA, 14 bp, Homo sapiens
caaccatagaactg

SEQ ID NO: 5982143 - DNA, 15 bp, Homo sapiens
caaccatcaatggaa

SEQ ID NO: 5982144 - DNA, 19 bp, Homo sapiens
caaccatcaatggaaacag

SEQ ID NO: 5982145 - DNA, 23 bp, Homo sapiens
caaccatcagaccaccagcaaat

SEQ ID NO: 5982146 - DNA, 14 bp, Homo sapiens
caaccatcatgtgt

SEQ ID NO: 5982147 - DNA, 17 bp, Homo sapiens
caaccatcatgtgtaga

SEQ ID NO: 5982148 - DNA, 14 bp, Homo sapiens
caaccatccaatta

SEQ ID NO: 5982149 - DNA, 14 bp, Homo sapiens
caaccatccctgcc

SEQ ID NO: 5982150 - DNA, 13 bp, Homo sapiens
caaccatcgcttt

SEQ ID NO: 5982151 - DNA, 14 bp, Homo sapiens
caaccatgacctca

SEQ ID NO: 5982152 - DNA, 19 bp, Homo sapiens
caaccatgcaaattgtgaa

SEQ ID NO: 5982153 - DNA, 14 bp, Homo sapiens
caaccatgtcattt

SEQ ID NO: 5982154 - DNA, 19 bp, Homo sapiens
caaccattcatctttcctt

SEQ ID NO: 5982155 - DNA, 22 bp, Homo sapiens
caaccattcatctttcctttgc

SEQ ID NO: 5982156 - DNA, 14 bp, Homo sapiens
caaccattccagac

SEQ ID NO: 5982157 - DNA, 16 bp, Homo sapiens
caaccattccagactg

SEQ ID NO: 5982158 - DNA, 21 bp, Homo sapiens
caaccatttttagaaggaaaa

SEQ ID NO: 5982159 - DNA, 20 bp, Homo sapiens
caaccattttttgttctgtg

SEQ ID NO: 5982160 - DNA, 16 bp, Homo sapiens
caacccaaacctggag

SEQ ID NO: 5982161 - DNA, 12 bp, Homo sapiens
caacccaaagta

SEQ ID NO: 5982162 - DNA, 15 bp, Homo sapiens
caacccaaggactga

SEQ ID NO: 5982163 - DNA, 15 bp, Homo sapiens
caacccaatccctct

SEQ ID NO: 5982164 - DNA, 17 bp, Homo sapiens
caccagcttctttctcg

SEQ ID NO: 5982165 - DNA, 22 bp, Homo sapiens
caccagcttctttctcggtggc

SEQ ID NO: 5982166 - DNA, 15 bp, Homo sapiens
caccagcttgcttct

SEQ ID NO: 5982167 - DNA, 17 bp, Homo sapiens
caccaggaacctcttca

SEQ ID NO: 5982168 - DNA, 16 bp, Homo sapiens
caccaggaagaaggcc

SEQ ID NO: 5982169 - DNA, 19 bp, Homo sapiens
caccaggaagaaggcccgg

SEQ ID NO: 5982170 - DNA, 19 bp, Homo sapiens
caccaggaagcacaggtcc

SEQ ID NO: 5982171 - DNA, 17 bp, Homo sapiens
caccaggaatgttaaag

SEQ ID NO: 5982172 - DNA, 17 bp, Homo sapiens
caccaggactttaatct

SEQ ID NO: 5982173 - DNA, 19 bp, Homo sapiens
caccaggagaaccactaca

SEQ ID NO: 5982174 - DNA, 17 bp, Homo sapiens
caccaggagcacctgga

SEQ ID NO: 5982175 - DNA, 20 bp, Homo sapiens
caccaggagcacctggaccc

SEQ ID NO: 5982176 - DNA, 14 bp, Homo sapiens
caccaggagcagca

SEQ ID NO: 5982177 - DNA, 20 bp, Homo sapiens
caccaggagcagcagccagc

SEQ ID NO: 5982178 - DNA, 17 bp, Homo sapiens
caccaggcaaccaggaa

SEQ ID NO: 5982179 - DNA, 16 bp, Homo sapiens
caccaggcaagaaaag

SEQ ID NO: 5982180 - DNA, 23 bp, Homo sapiens
caccaggcacctcacagaaatga

SEQ ID NO: 5982181 - DNA, 19 bp, Homo sapiens
caccaggcacgaacccacc

SEQ ID NO: 5982182 - DNA, 21 bp, Homo sapiens
caccaggcacgaacccacctg

SEQ ID NO: 5982183 - DNA, 23 bp, Homo sapiens
caccaggcacgaacccacctgct

SEQ ID NO: 5982184 - DNA, 15 bp, Homo sapiens
caccaggcagcctct

SEQ ID NO: 5982185 - DNA, 19 bp, Homo sapiens
caccaggcagctccagctg

SEQ ID NO: 5982186 - DNA, 15 bp, Homo sapiens
caccaggccacctcc

SEQ ID NO: 5982187 - DNA, 16 bp, Homo sapiens
caccaggccagctcag

SEQ ID NO: 5982188 - DNA, 18 bp, Homo sapiens
caccaggccagctcagga

SEQ ID NO: 5982189 - DNA, 15 bp, Homo sapiens
caccaggccatcagc

SEQ ID NO: 5982190 - DNA, 13 bp, Homo sapiens
caccaggcccacg

SEQ ID NO: 5982191 - DNA, 14 bp, Homo sapiens
caccaggcccacga

SEQ ID NO: 5982192 - DNA, 23 bp, Homo sapiens
caccaggcccacgaggagcagca

SEQ ID NO: 5982193 - DNA, 23 bp, Homo sapiens
caccaggccgggcttgggccctg

SEQ ID NO: 5982194 - DNA, 14 bp, Homo sapiens
caccaggcctggcc

SEQ ID NO: 5982195 - DNA, 19 bp, Homo sapiens
caccaggcctggcctctgg

SEQ ID NO: 5982196 - DNA, 24 bp, Homo sapiens
caccaggcctggcctctgggcagt

SEQ ID NO: 5982197 - DNA, 21 bp, Homo sapiens
caccaggctgctcagggctgg

SEQ ID NO: 5982198 - DNA, 15 bp, Homo sapiens
caccaggctggcgca

SEQ ID NO: 5982199 - DNA, 17 bp, Homo sapiens
caccaggctggcgcagc

SEQ ID NO: 5982200 - DNA, 20 bp, Homo sapiens
caccaggctggcgcagccaa

SEQ ID NO: 5982201 - DNA, 16 bp, Homo sapiens
caccaggctgtgggcc

SEQ ID NO: 5982202 - DNA, 20 bp, Homo sapiens
caccaggcttgcctgcaggc

SEQ ID NO: 5982203 - DNA, 13 bp, Homo sapiens
caccagggaaggg

SEQ ID NO: 5982204 - DNA, 18 bp, Homo sapiens
caccagggaaggggacaa

SEQ ID NO: 5982205 - DNA, 21 bp, Homo sapiens
caccagggaaggggacaagga

SEQ ID NO: 5982206 - DNA, 19 bp, Homo sapiens
caccagggaccagcccagc

SEQ ID NO: 5982207 - DNA, 16 bp, Homo sapiens
caccagggactgcagc

SEQ ID NO: 5982208 - DNA, 15 bp, Homo sapiens
caccagggagaggcc

SEQ ID NO: 5982209 - DNA, 23 bp, Homo sapiens
caccagggagaggcctcggctgt

SEQ ID NO: 5982210 - DNA, 19 bp, Homo sapiens
caccagggagatgtctaga

SEQ ID NO: 5982211 - DNA, 23 bp, Homo sapiens
caccagggagcttcctggctctg

SEQ ID NO: 5982212 - DNA, 22 bp, Homo sapiens
caccagggatcacagaccacag

SEQ ID NO: 5982213 - DNA, 23 bp, Homo sapiens
caccagggatcacagaccacagg

SEQ ID NO: 5982214 - DNA, 23 bp, Homo sapiens
caccagggcaactcttggaagaa

SEQ ID NO: 5982215 - DNA, 16 bp, Homo sapiens
caccagggcatctctg

SEQ ID NO: 5982216 - DNA, 20 bp, Homo sapiens
caccagggcatctctgggct

SEQ ID NO: 5982217 - DNA, 16 bp, Homo sapiens
caccagggccagagca

SEQ ID NO: 5982218 - DNA, 18 bp, Homo sapiens
caccagggcctggctggg

SEQ ID NO: 5982219 - DNA, 18 bp, Homo sapiens
caccagggcgctgggaag

SEQ ID NO: 5982220 - DNA, 19 bp, Homo sapiens
caccagggcgctgggaagg

SEQ ID NO: 5982221 - DNA, 15 bp, Homo sapiens
caccagggctcagct

SEQ ID NO: 5982222 - DNA, 16 bp, Homo sapiens
caccagggctcagctc

SEQ ID NO: 5982223 - DNA, 17 bp, Homo sapiens
caccagggctcagctcc

SEQ ID NO: 5982224 - DNA, 19 bp, Homo sapiens
caccagggctccaggagcc

SEQ ID NO: 5982225 - DNA, 17 bp, Homo sapiens
caccaggggaggagcct

SEQ ID NO: 5982226 - DNA, 12 bp, Homo sapiens
caccaggggcag

SEQ ID NO: 5982227 - DNA, 20 bp, Homo sapiens
caccaggggcaggcacagca

SEQ ID NO: 5982228 - DNA, 21 bp, Homo sapiens
caccaggggcaggcacagcac

SEQ ID NO: 5982229 - DNA, 16 bp, Homo sapiens
caccagggtcccagga

SEQ ID NO: 5982230 - DNA, 21 bp, Homo sapiens
caccagggtccgcaccagctg

SEQ ID NO: 5982231 - DNA, 15 bp, Homo sapiens
caccagggtggacca

SEQ ID NO: 5982232 - DNA, 23 bp, Homo sapiens
caccagggtttagtttgcattta

SEQ ID NO: 5982233 - DNA, 16 bp, Homo sapiens
caccaggtagaacaca

SEQ ID NO: 5982234 - DNA, 18 bp, Homo sapiens
caccaggtcctgtgagca

SEQ ID NO: 5982235 - DNA, 18 bp, Homo sapiens
caccaggtctcaaggttc

SEQ ID NO: 5982236 - DNA, 22 bp, Homo sapiens
caccaggtctcccgggaagcca

SEQ ID NO: 5982237 - DNA, 14 bp, Homo sapiens
caccaggtgcatct

SEQ ID NO: 5982238 - DNA, 21 bp, Homo sapiens
caccaggtgttaaaaaccatt

SEQ ID NO: 5982239 - DNA, 15 bp, Homo sapiens
caccaggttaaaatt

SEQ ID NO: 5982240 - DNA, 17 bp, Homo sapiens
caccaggttgggaacat

SEQ ID NO: 5982241 - DNA, 21 bp, Homo sapiens
caccagtcacctcgtctccct

SEQ ID NO: 5982242 - DNA, 15 bp, Homo sapiens
caccagtcactgtcc

SEQ ID NO: 5982243 - DNA, 21 bp, Homo sapiens
caccagtcagggacagcagcc

SEQ ID NO: 5982244 - DNA, 16 bp, Homo sapiens
caccagtctcacccac

SEQ ID NO: 5982245 - DNA, 17 bp, Homo sapiens
caccagtctcacccact

SEQ ID NO: 5982246 - DNA, 23 bp, Homo sapiens
caccagtctgtaaaatacatgta

SEQ ID NO: 5982247 - DNA, 15 bp, Homo sapiens
caccagtgacctgga

SEQ ID NO: 5982248 - DNA, 14 bp, Homo sapiens
caccagtgcaagca

SEQ ID NO: 5982249 - DNA, 19 bp, Homo sapiens
caccagtgcatcacatctg

SEQ ID NO: 5982250 - DNA, 21 bp, Homo sapiens
caccagtgcatcacatctgca

SEQ ID NO: 5982251 - DNA, 11 bp, Homo sapiens
caccagtgcct

SEQ ID NO: 5982252 - DNA, 12 bp, Homo sapiens
caccagtgcctc

SEQ ID NO: 5982253 - DNA, 13 bp, Homo sapiens
caccagtgcctct

SEQ ID NO: 5982254 - DNA, 17 bp, Homo sapiens
caccagtgcctctccct

SEQ ID NO: 5982255 - DNA, 20 bp, Homo sapiens
caccagtggacctagcctgg

SEQ ID NO: 5982256 - DNA, 21 bp, Homo sapiens
caccagtggacctagcctgga

SEQ ID NO: 5982257 - DNA, 15 bp, Homo sapiens
caccagtggcctttc

SEQ ID NO: 5982258 - DNA, 21 bp, Homo sapiens
caccagtgtagcatcttcctc

SEQ ID NO: 5982259 - DNA, 22 bp, Homo sapiens
caccagtgtagcatcttcctct

SEQ ID NO: 5982260 - DNA, 23 bp, Homo sapiens
caccagtgtagcatcttcctctg

SEQ ID NO: 5982261 - DNA, 14 bp, Homo sapiens
caccagtgtcccct

SEQ ID NO: 5982262 - DNA, 23 bp, Homo sapiens
caccagtgtcctcccctcaagga

SEQ ID NO: 5982263 - DNA, 20 bp, Homo sapiens
caccagtgtcgtgtctgctg

SEQ ID NO: 5982264 - DNA, 22 bp, Homo sapiens
caccagtgtgacaggaaagatt

SEQ ID NO: 5982265 - DNA, 13 bp, Homo sapiens
caccagtgtgtgg

SEQ ID NO: 5982266 - DNA, 16 bp, Homo sapiens
caccagtgtgtggggg

SEQ ID NO: 5982267 - DNA, 23 bp, Homo sapiens
caccagtgttcctgaagctgctg

SEQ ID NO: 5982268 - DNA, 19 bp, Homo sapiens
caccagttacttgtgttca

SEQ ID NO: 5982269 - DNA, 20 bp, Homo sapiens
caccagttctcatgggtggc

SEQ ID NO: 5982270 - DNA, 16 bp, Homo sapiens
caccagttgcccagat

SEQ ID NO: 5982271 - DNA, 11 bp, Homo sapiens
caccagtttac

SEQ ID NO: 5982272 - DNA, 18 bp, Homo sapiens
caccataagctactgcca

SEQ ID NO: 5982273 - DNA, 22 bp, Homo sapiens
caccataatgagatgtgagcct

SEQ ID NO: 5982274 - DNA, 23 bp, Homo sapiens
caccatacgagcacctccagcct

SEQ ID NO: 5982275 - DNA, 19 bp, Homo sapiens
caccatactccttgcttcc

SEQ ID NO: 5982276 - DNA, 20 bp, Homo sapiens
caccatagaagaacagcaga

SEQ ID NO: 5982277 - DNA, 17 bp, Homo sapiens
caccataggtagaatgt

SEQ ID NO: 5982278 - DNA, 18 bp, Homo sapiens
caccataggtcaccttta

SEQ ID NO: 5982279 - DNA, 14 bp, Homo sapiens
caccatagtcaatc

SEQ ID NO: 5982280 - DNA, 17 bp, Homo sapiens
caccatagtgtcacaga

SEQ ID NO: 5982281 - DNA, 18 bp, Homo sapiens
caccatagttttgtttaa

SEQ ID NO: 5982282 - DNA, 19 bp, Homo sapiens
caccatagttttgtttaat

SEQ ID NO: 5982283 - DNA, 19 bp, Homo sapiens
caccatatgaattgtacag

SEQ ID NO: 5982284 - DNA, 20 bp, Homo sapiens
caccatatgaattgtacaga

SEQ ID NO: 5982285 - DNA, 16 bp, Homo sapiens
caccatattcagtgct

SEQ ID NO: 5982286 - DNA, 21 bp, Homo sapiens
caccatattcagtgctgtggc

SEQ ID NO: 5982287 - DNA, 21 bp, Homo sapiens
caccatattggccagtctggt

SEQ ID NO: 5982288 - DNA, 13 bp, Homo sapiens
caccatcaagcca

SEQ ID NO: 5982289 - DNA, 14 bp, Homo sapiens
caccatcaagccac

SEQ ID NO: 5982290 - DNA, 16 bp, Homo sapiens
caccatcaagccacca

SEQ ID NO: 5982291 - DNA, 19 bp, Homo sapiens
caccatcaagccaccaaca

SEQ ID NO: 5982292 - DNA, 21 bp, Homo sapiens
caccatcacagcttgttttgg

SEQ ID NO: 5982293 - DNA, 19 bp, Homo sapiens
caccatcaccacgcagaga

SEQ ID NO: 5982294 - DNA, 19 bp, Homo sapiens
caccatcaccctctgggca

SEQ ID NO: 5982295 - DNA, 20 bp, Homo sapiens
caccatcaccctctgggcag

SEQ ID NO: 5982296 - DNA, 18 bp, Homo sapiens
caccatcatgtctggcta

SEQ ID NO: 5982297 - DNA, 18 bp, Homo sapiens
caccatcattaagaataa

SEQ ID NO: 5982298 - DNA, 21 bp, Homo sapiens
caccatccaacagacctggtg

SEQ ID NO: 5982299 - DNA, 18 bp, Homo sapiens
caccatccaccttccctt

SEQ ID NO: 5982300 - DNA, 20 bp, Homo sapiens
caccatccaccttcccttct

SEQ ID NO: 5982301 - DNA, 13 bp, Homo sapiens
caccatccagctc

SEQ ID NO: 5982302 - DNA, 15 bp, Homo sapiens
caccatccagctccc

SEQ ID NO: 5982303 - DNA, 17 bp, Homo sapiens
caccatccagctcccca

SEQ ID NO: 5982304 - DNA, 18 bp, Homo sapiens
caccatccagctccccag

SEQ ID NO: 5982305 - DNA, 15 bp, Homo sapiens
caccatccagtgggc

SEQ ID NO: 5982306 - DNA, 18 bp, Homo sapiens
caccatccagtgggcccg

SEQ ID NO: 5982307 - DNA, 13 bp, Homo sapiens
caccatcccctcc

SEQ ID NO: 5982308 - DNA, 18 bp, Homo sapiens
caccatccgccagggccc

SEQ ID NO: 5982309 - DNA, 22 bp, Homo sapiens
caccatcctcagaggctgagcc

SEQ ID NO: 5982310 - DNA, 14 bp, Homo sapiens
caccatcctgagcc

SEQ ID NO: 5982311 - DNA, 23 bp, Homo sapiens
caccatccttccatcctgaggac

SEQ ID NO: 5982312 - DNA, 17 bp, Homo sapiens
caccatcgctggcccct

SEQ ID NO: 5982313 - DNA, 14 bp, Homo sapiens
caccatctcaggcc

SEQ ID NO: 5982314 - DNA, 20 bp, Homo sapiens
caccatctcaggccacctgc

SEQ ID NO: 5982315 - DNA, 21 bp, Homo sapiens
caccatctcaggccacctgcc

SEQ ID NO: 5982316 - DNA, 13 bp, Homo sapiens
caccatctcttca

SEQ ID NO: 5982317 - DNA, 19 bp, Homo sapiens
caccatctcttcattcaaa

SEQ ID NO: 5982318 - DNA, 10 bp, Homo sapiens
caccatctgc

SEQ ID NO: 5982319 - DNA, 13 bp, Homo sapiens
caccatctgcttg

SEQ ID NO: 5982320 - DNA, 18 bp, Homo sapiens
caccatctggagtcttcc

SEQ ID NO: 5982321 - DNA, 19 bp, Homo sapiens
caccatctggcccaggctg

SEQ ID NO: 5982322 - DNA, 21 bp, Homo sapiens
caccatctggcccaggctggc

SEQ ID NO: 5982323 - DNA, 22 bp, Homo sapiens
caccatctggcccaggctggcc

SEQ ID NO: 5982324 - DNA, 23 bp, Homo sapiens
caccatcttaagagatgcctcat

SEQ ID NO: 5982325 - DNA, 18 bp, Homo sapiens
caccatcttggccaggct

SEQ ID NO: 5982326 - DNA, 14 bp, Homo sapiens
caccatctttctga

SEQ ID NO: 5982327 - DNA, 17 bp, Homo sapiens
caccatctttgtcaaac

SEQ ID NO: 5982328 - DNA, 12 bp, Homo sapiens
caccatctttta

SEQ ID NO: 5982329 - DNA, 11 bp, Homo sapiens
caccatgaaac

SEQ ID NO: 5982330 - DNA, 15 bp, Homo sapiens
caccatgaccccttc

SEQ ID NO: 5982331 - DNA, 18 bp, Homo sapiens
caccatgaccccttctct

SEQ ID NO: 5982332 - DNA, 20 bp, Homo sapiens
caccatgaccccttctctct

SEQ ID NO: 5982333 - DNA, 22 bp, Homo sapiens
caccatgactggctaattttct

SEQ ID NO: 5982334 - DNA, 15 bp, Homo sapiens
caccatgatggccag

SEQ ID NO: 5982335 - DNA, 18 bp, Homo sapiens
caccatgatgtgaagagt

SEQ ID NO: 5982336 - DNA, 19 bp, Homo sapiens
caccatgattcctttaaca

SEQ ID NO: 5982337 - DNA, 13 bp, Homo sapiens
caccatgatttaa

SEQ ID NO: 5982338 - DNA, 22 bp, Homo sapiens
caccatgcaaatgtcttccagg

SEQ ID NO: 5982339 - DNA, 14 bp, Homo sapiens
caccatgcactcac

SEQ ID NO: 5982340 - DNA, 21 bp, Homo sapiens
caacccaatccctctccactc

SEQ ID NO: 5982341 - DNA, 18 bp, Homo sapiens
caacccaatctggctggt

SEQ ID NO: 5982342 - DNA, 20 bp, Homo sapiens
caacccacaccgtcttcctt

SEQ ID NO: 5982343 - DNA, 13 bp, Homo sapiens
caacccacagctc

SEQ ID NO: 5982344 - DNA, 15 bp, Homo sapiens
caacccacagctcag

SEQ ID NO: 5982345 - DNA, 19 bp, Homo sapiens
caacccacagctcagctgc

SEQ ID NO: 5982346 - DNA, 23 bp, Homo sapiens
caacccaccacaacaagcaagtg

SEQ ID NO: 5982347 - DNA, 18 bp, Homo sapiens
caacccacctctggccct

SEQ ID NO: 5982348 - DNA, 13 bp, Homo sapiens
caacccactgccc

SEQ ID NO: 5982349 - DNA, 18 bp, Homo sapiens
caacccactgtcttgcag

SEQ ID NO: 5982350 - DNA, 22 bp, Homo sapiens
caacccactgtcttgcagtgga

SEQ ID NO: 5982351 - DNA, 11 bp, Homo sapiens
caacccagccg

SEQ ID NO: 5982352 - DNA, 21 bp, Homo sapiens
caacccagccgtcgtctccct

SEQ ID NO: 5982353 - DNA, 12 bp, Homo sapiens
caacccaggaat

SEQ ID NO: 5982354 - DNA, 22 bp, Homo sapiens
caacccaggagcatccacctcc

SEQ ID NO: 5982355 - DNA, 22 bp, Homo sapiens
caacccaggtgttgtccgtgtc

SEQ ID NO: 5982356 - DNA, 19 bp, Homo sapiens
caacccagtgggtctggga

SEQ ID NO: 5982357 - DNA, 19 bp, Homo sapiens
caacccatctacccctgga

SEQ ID NO: 5982358 - DNA, 20 bp, Homo sapiens
caacccatctacccctggat

SEQ ID NO: 5982359 - DNA, 15 bp, Homo sapiens
caacccatgcatggc

SEQ ID NO: 5982360 - DNA, 20 bp, Homo sapiens
caacccatgcatggcctccc

SEQ ID NO: 5982361 - DNA, 22 bp, Homo sapiens
caacccatgcatggcctcccag

SEQ ID NO: 5982362 - DNA, 15 bp, Homo sapiens
caacccatgcccctg

SEQ ID NO: 5982363 - DNA, 19 bp, Homo sapiens
caacccatgcccctgacag

SEQ ID NO: 5982364 - DNA, 14 bp, Homo sapiens
caacccatgccctg

SEQ ID NO: 5982365 - DNA, 16 bp, Homo sapiens
caacccatgccctgcc

SEQ ID NO: 5982366 - DNA, 15 bp, Homo sapiens
caacccattagccat

SEQ ID NO: 5982367 - DNA, 17 bp, Homo sapiens
caaccccaagccagccc

SEQ ID NO: 5982368 - DNA, 21 bp, Homo sapiens
caaccccacaagcaccactct

SEQ ID NO: 5982369 - DNA, 22 bp, Homo sapiens
caaccccacaagcaccactctg

SEQ ID NO: 5982370 - DNA, 16 bp, Homo sapiens
caaccccacccagctc

SEQ ID NO: 5982371 - DNA, 18 bp, Homo sapiens
caaccccacccagctcca

SEQ ID NO: 5982372 - DNA, 16 bp, Homo sapiens
caaccccagacactgg

SEQ ID NO: 5982373 - DNA, 19 bp, Homo sapiens
caaccccagcagtcctggg

SEQ ID NO: 5982374 - DNA, 12 bp, Homo sapiens
caaccccagccg

SEQ ID NO: 5982375 - DNA, 14 bp, Homo sapiens
caaccccagccgct

SEQ ID NO: 5982376 - DNA, 15 bp, Homo sapiens
caaccccagccgctc

SEQ ID NO: 5982377 - DNA, 12 bp, Homo sapiens
caaccccagctg

SEQ ID NO: 5982378 - DNA, 13 bp, Homo sapiens
caaccccagctgg

SEQ ID NO: 5982379 - DNA, 14 bp, Homo sapiens
caaccccagctggc

SEQ ID NO: 5982380 - DNA, 17 bp, Homo sapiens
caaccccagctggcctc

SEQ ID NO: 5982381 - DNA, 18 bp, Homo sapiens
caaccccagctggcctct

SEQ ID NO: 5982382 - DNA, 17 bp, Homo sapiens
caaccccagttctgctc

SEQ ID NO: 5982383 - DNA, 19 bp, Homo sapiens
caaccccagttctgctcct

SEQ ID NO: 5982384 - DNA, 20 bp, Homo sapiens
caaccccagttctgctcctc

SEQ ID NO: 5982385 - DNA, 14 bp, Homo sapiens
caaccccatcatat

SEQ ID NO: 5982386 - DNA, 14 bp, Homo sapiens
caacccccacccca

SEQ ID NO: 5982387 - DNA, 12 bp, Homo sapiens
caacccccaccg

SEQ ID NO: 5982388 - DNA, 12 bp, Homo sapiens
caacccccagag

SEQ ID NO: 5982389 - DNA, 14 bp, Homo sapiens
caacccccagaggt

SEQ ID NO: 5982390 - DNA, 17 bp, Homo sapiens
caacccccagaggtggc

SEQ ID NO: 5982391 - DNA, 19 bp, Homo sapiens
caacccccagaggtggccc

SEQ ID NO: 5982392 - DNA, 15 bp, Homo sapiens
caacccccagccccc

SEQ ID NO: 5982393 - DNA, 14 bp, Homo sapiens
caacccccagcctg

SEQ ID NO: 5982394 - DNA, 17 bp, Homo sapiens
caacccccagcctgcta

SEQ ID NO: 5982395 - DNA, 14 bp, Homo sapiens
caacccccagctcc

SEQ ID NO: 5982396 - DNA, 16 bp, Homo sapiens
caacccccagctcccg

SEQ ID NO: 5982397 - DNA, 18 bp, Homo sapiens
caacccccagctcccgct

SEQ ID NO: 5982398 - DNA, 12 bp, Homo sapiens
caacccccatct

SEQ ID NO: 5982399 - DNA, 17 bp, Homo sapiens
caacccccatctcccta

SEQ ID NO: 5982400 - DNA, 21 bp, Homo sapiens
caacccccattctcatctgca

SEQ ID NO: 5982401 - DNA, 21 bp, Homo sapiens
caaccccccaagaccatccct

SEQ ID NO: 5982402 - DNA, 16 bp, Homo sapiens
caaccccccacctgcc

SEQ ID NO: 5982403 - DNA, 15 bp, Homo sapiens
caaccccccagcact

SEQ ID NO: 5982404 - DNA, 20 bp, Homo sapiens
caaccccccagcactgagga

SEQ ID NO: 5982405 - DNA, 19 bp, Homo sapiens
caaccccccagctcgctgg

SEQ ID NO: 5982406 - DNA, 13 bp, Homo sapiens
caacccccctccc

SEQ ID NO: 5982407 - DNA, 16 bp, Homo sapiens
caacccccctcccaga

SEQ ID NO: 5982408 - DNA, 18 bp, Homo sapiens
caacccccctcccagaca

SEQ ID NO: 5982409 - DNA, 15 bp, Homo sapiens
caacccccctcctgc

SEQ ID NO: 5982410 - DNA, 18 bp, Homo sapiens
caacccccctcctgctcc

SEQ ID NO: 5982411 - DNA, 13 bp, Homo sapiens
caaccccctcgga

SEQ ID NO: 5982412 - DNA, 13 bp, Homo sapiens
caaccccctgcaa

SEQ ID NO: 5982413 - DNA, 17 bp, Homo sapiens
caaccccgcggcccaga

SEQ ID NO: 5982414 - DNA, 22 bp, Homo sapiens
caacccctaatcgccctgagct

SEQ ID NO: 5982415 - DNA, 13 bp, Homo sapiens
caacccctccccc

SEQ ID NO: 5982416 - DNA, 14 bp, Homo sapiens
caacccctcctccc

SEQ ID NO: 5982417 - DNA, 19 bp, Homo sapiens
caacccctcctccctcaga

SEQ ID NO: 5982418 - DNA, 20 bp, Homo sapiens
caacccctcctccctcagac

SEQ ID NO: 5982419 - DNA, 21 bp, Homo sapiens
caacccctcctccctcagact

SEQ ID NO: 5982420 - DNA, 19 bp, Homo sapiens
caacccctccttccccaga

SEQ ID NO: 5982421 - DNA, 21 bp, Homo sapiens
caacccctcgcccagtcccag

SEQ ID NO: 5982422 - DNA, 22 bp, Homo sapiens
caacccctcgcccagtcccagc

SEQ ID NO: 5982423 - DNA, 23 bp, Homo sapiens
caacccctcgcccagtcccagca

SEQ ID NO: 5982424 - DNA, 15 bp, Homo sapiens
caacccctctccagg

SEQ ID NO: 5982425 - DNA, 19 bp, Homo sapiens
caacccctctccaggcctg

SEQ ID NO: 5982426 - DNA, 22 bp, Homo sapiens
caacccctgacctaccccagcc

SEQ ID NO: 5982427 - DNA, 21 bp, Homo sapiens
caacccctgcagctcctctgc

SEQ ID NO: 5982428 - DNA, 12 bp, Homo sapiens
caacccctggac

SEQ ID NO: 5982429 - DNA, 22 bp, Homo sapiens
caacccctgtacccagctcctt

SEQ ID NO: 5982430 - DNA, 16 bp, Homo sapiens
caacccctgtggagcc

SEQ ID NO: 5982431 - DNA, 22 bp, Homo sapiens
caacccctgtggagcccgcacc

SEQ ID NO: 5982432 - DNA, 20 bp, Homo sapiens
caaccccttaagccctggcc

SEQ ID NO: 5982433 - DNA, 19 bp, Homo sapiens
caacccgctgcttccaggt

SEQ ID NO: 5982434 - DNA, 23 bp, Homo sapiens
caacccgtgccaagtccaggtcc

SEQ ID NO: 5982435 - DNA, 17 bp, Homo sapiens
caacccgtgcccctggg

SEQ ID NO: 5982436 - DNA, 16 bp, Homo sapiens
caacccgtggaggctg

SEQ ID NO: 5982437 - DNA, 14 bp, Homo sapiens
caaccctattcatt

SEQ ID NO: 5982438 - DNA, 14 bp, Homo sapiens
caaccctcagcctt

SEQ ID NO: 5982439 - DNA, 16 bp, Homo sapiens
caaccctcagccttga

SEQ ID NO: 5982440 - DNA, 11 bp, Homo sapiens
caaccctcagg

SEQ ID NO: 5982441 - DNA, 12 bp, Homo sapiens
caaccctcaggg

SEQ ID NO: 5982442 - DNA, 13 bp, Homo sapiens
caaccctcagggc

SEQ ID NO: 5982443 - DNA, 12 bp, Homo sapiens
caaccctcatca

SEQ ID NO: 5982444 - DNA, 13 bp, Homo sapiens
caaccctcccggg

SEQ ID NO: 5982445 - DNA, 14 bp, Homo sapiens
caaccctccctcag

SEQ ID NO: 5982446 - DNA, 22 bp, Homo sapiens
caaccctgcaaaggactgtttt

SEQ ID NO: 5982447 - DNA, 11 bp, Homo sapiens
caaccctgccc

SEQ ID NO: 5982448 - DNA, 15 bp, Homo sapiens
caaccctgcccctgc

SEQ ID NO: 5982449 - DNA, 16 bp, Homo sapiens
caaccctgcccctgcc

SEQ ID NO: 5982450 - DNA, 22 bp, Homo sapiens
caaccctgcccctgccccgtca

SEQ ID NO: 5982451 - DNA, 17 bp, Homo sapiens
caaccctgccctgcacc

SEQ ID NO: 5982452 - DNA, 18 bp, Homo sapiens
caaccctgccctgcacct

SEQ ID NO: 5982453 - DNA, 11 bp, Homo sapiens
caaccctgcct

SEQ ID NO: 5982454 - DNA, 17 bp, Homo sapiens
caaccctggcacccagg

SEQ ID NO: 5982455 - DNA, 13 bp, Homo sapiens
caaccctggcctc

SEQ ID NO: 5982456 - DNA, 17 bp, Homo sapiens
caaccctgggctgggga

SEQ ID NO: 5982457 - DNA, 11 bp, Homo sapiens
caaccctgtct

SEQ ID NO: 5982458 - DNA, 12 bp, Homo sapiens
caaccctgtctg

SEQ ID NO: 5982459 - DNA, 12 bp, Homo sapiens
caaccctgtggg

SEQ ID NO: 5982460 - DNA, 13 bp, Homo sapiens
caaccctgtgggc

SEQ ID NO: 5982461 - DNA, 19 bp, Homo sapiens
caaccctgttgctacatca

SEQ ID NO: 5982462 - DNA, 13 bp, Homo sapiens
caaccctgtttcc

SEQ ID NO: 5982463 - DNA, 17 bp, Homo sapiens
caaccctgtttcctgag

SEQ ID NO: 5982464 - DNA, 22 bp, Homo sapiens
caacccttaccccttagcctcc

SEQ ID NO: 5982465 - DNA, 12 bp, Homo sapiens
caacccttcccc

SEQ ID NO: 5982466 - DNA, 13 bp, Homo sapiens
caacccttcccca

SEQ ID NO: 5982467 - DNA, 18 bp, Homo sapiens
caacccttccctcacctt

SEQ ID NO: 5982468 - DNA, 20 bp, Homo sapiens
caacccttctcctcttgtaa

SEQ ID NO: 5982469 - DNA, 19 bp, Homo sapiens
caacccttcttcatgttca

SEQ ID NO: 5982470 - DNA, 15 bp, Homo sapiens
caacccttgctgctg

SEQ ID NO: 5982471 - DNA, 17 bp, Homo sapiens
caacccttgctgctgcc

SEQ ID NO: 5982472 - DNA, 19 bp, Homo sapiens
caaccgaacatgaccaaaa

SEQ ID NO: 5982473 - DNA, 20 bp, Homo sapiens
caaccgaacatgaccaaaaa

SEQ ID NO: 5982474 - DNA, 20 bp, Homo sapiens
caaccgacagctcttacttt

SEQ ID NO: 5982475 - DNA, 18 bp, Homo sapiens
caaccgacaggccctggc

SEQ ID NO: 5982476 - DNA, 17 bp, Homo sapiens
caaccgcctcaaaatgt

SEQ ID NO: 5982477 - DNA, 13 bp, Homo sapiens
caaccggctttgt

SEQ ID NO: 5982478 - DNA, 20 bp, Homo sapiens
caaccggggagcccccgccc

SEQ ID NO: 5982479 - DNA, 13 bp, Homo sapiens
caaccggtccctt

SEQ ID NO: 5982480 - DNA, 20 bp, Homo sapiens
caaccgtcctgctgtccctg

SEQ ID NO: 5982481 - DNA, 21 bp, Homo sapiens
caaccgtggcccttcctggac

SEQ ID NO: 5982482 - DNA, 23 bp, Homo sapiens
caaccgtggcccttcctggacag

SEQ ID NO: 5982483 - DNA, 20 bp, Homo sapiens
caacctaacacattaaatgt

SEQ ID NO: 5982484 - DNA, 18 bp, Homo sapiens
caacctaacccctttcct

SEQ ID NO: 5982485 - DNA, 14 bp, Homo sapiens
caacctaacctgtg

SEQ ID NO: 5982486 - DNA, 16 bp, Homo sapiens
caacctaacctgtgtc

SEQ ID NO: 5982487 - DNA, 14 bp, Homo sapiens
caacctaagcaaca

SEQ ID NO: 5982488 - DNA, 19 bp, Homo sapiens
caacctacagtggagggag

SEQ ID NO: 5982489 - DNA, 18 bp, Homo sapiens
caacctaccaccccttcc

SEQ ID NO: 5982490 - DNA, 21 bp, Homo sapiens
caacctaccaccccttcctgt

SEQ ID NO: 5982491 - DNA, 14 bp, Homo sapiens
caacctagaatgtc

SEQ ID NO: 5982492 - DNA, 19 bp, Homo sapiens
caacctagccaacatggtg

SEQ ID NO: 5982493 - DNA, 22 bp, Homo sapiens
caacctatcatttattctgctt

SEQ ID NO: 5982494 - DNA, 23 bp, Homo sapiens
caacctattaaaatacattttaa

SEQ ID NO: 5982495 - DNA, 15 bp, Homo sapiens
caacctattttgaag

SEQ ID NO: 5982496 - DNA, 16 bp, Homo sapiens
caacctcaatgccctg

SEQ ID NO: 5982497 - DNA, 19 bp, Homo sapiens
caacctcaatgccctgcca

SEQ ID NO: 5982498 - DNA, 14 bp, Homo sapiens
caacctcaccaaac

SEQ ID NO: 5982499 - DNA, 16 bp, Homo sapiens
caacctcaccttcctg

SEQ ID NO: 5982500 - DNA, 16 bp, Homo sapiens
caacctcactgccctc

SEQ ID NO: 5982501 - DNA, 21 bp, Homo sapiens
caacctcactgccctccctcg

SEQ ID NO: 5982502 - DNA, 23 bp, Homo sapiens
caacctcactgccctccctcggc

SEQ ID NO: 5982503 - DNA, 14 bp, Homo sapiens
caacctcagaggca

SEQ ID NO: 5982504 - DNA, 17 bp, Homo sapiens
caacctcagggctccca

SEQ ID NO: 5982505 - DNA, 14 bp, Homo sapiens
caacctcattgaca

SEQ ID NO: 5982506 - DNA, 15 bp, Homo sapiens
caacctccacctccc

SEQ ID NO: 5982507 - DNA, 16 bp, Homo sapiens
caacctccacctcctg

SEQ ID NO: 5982508 - DNA, 17 bp, Homo sapiens
caacctccacctcctgg

SEQ ID NO: 5982509 - DNA, 20 bp, Homo sapiens
caacctccacctcctgggtt

SEQ ID NO: 5982510 - DNA, 14 bp, Homo sapiens
caacctccagactc

SEQ ID NO: 5982511 - DNA, 16 bp, Homo sapiens
caacctcccaacccag

SEQ ID NO: 5982512 - DNA, 17 bp, Homo sapiens
caacctcccaacccaga

SEQ ID NO: 5982513 - DNA, 23 bp, Homo sapiens
caacctccccgcagagctccctt

SEQ ID NO: 5982514 - DNA, 19 bp, Homo sapiens
caacctcccctggtcctgc

SEQ ID NO: 5982515 - DNA, 13 bp, Homo sapiens
caacctccctctt

SEQ ID NO: 5982516 - DNA, 17 bp, Homo sapiens
caacctccctcttgttt

SEQ ID NO: 5982517 - DNA, 19 bp, Homo sapiens
caacctccctcttgttttg

SEQ ID NO: 5982518 - DNA, 20 bp, Homo sapiens
caacctccgcctcctgggtt

SEQ ID NO: 5982519 - DNA, 20 bp, Homo sapiens
caacctccgccttccgggtt

SEQ ID NO: 5982520 - DNA, 18 bp, Homo sapiens
caccatgcactcacccct

SEQ ID NO: 5982521 - DNA, 13 bp, Homo sapiens
caccatgcagccc

SEQ ID NO: 5982522 - DNA, 21 bp, Homo sapiens
caccatgcccagctaattttt

SEQ ID NO: 5982523 - DNA, 17 bp, Homo sapiens
caccatgcgctgctcaa

SEQ ID NO: 5982524 - DNA, 22 bp, Homo sapiens
caccatgcgctgctcaacctct

SEQ ID NO: 5982525 - DNA, 12 bp, Homo sapiens
caccatgctctc

SEQ ID NO: 5982526 - DNA, 14 bp, Homo sapiens
caccatgcttccag

SEQ ID NO: 5982527 - DNA, 18 bp, Homo sapiens
caccatgcttgcctgaag

SEQ ID NO: 5982528 - DNA, 13 bp, Homo sapiens
caccatggagacg

SEQ ID NO: 5982529 - DNA, 15 bp, Homo sapiens
caccatggaggcagg

SEQ ID NO: 5982530 - DNA, 22 bp, Homo sapiens
caccatggaggcaggctccccc

SEQ ID NO: 5982531 - DNA, 22 bp, Homo sapiens
caccatggcatgcgccaccatg

SEQ ID NO: 5982532 - DNA, 23 bp, Homo sapiens
caccatggcatgcgccaccatgc

SEQ ID NO: 5982533 - DNA, 20 bp, Homo sapiens
caccatggctaaggcaccag

SEQ ID NO: 5982534 - DNA, 15 bp, Homo sapiens
caccatgggaaactg

SEQ ID NO: 5982535 - DNA, 22 bp, Homo sapiens
caccatgggaggtggggcctca

SEQ ID NO: 5982536 - DNA, 16 bp, Homo sapiens
caccatgggattaata

SEQ ID NO: 5982537 - DNA, 14 bp, Homo sapiens
caccatggtcatca

SEQ ID NO: 5982538 - DNA, 22 bp, Homo sapiens
caccatggtcatcaccaccctt

SEQ ID NO: 5982539 - DNA, 20 bp, Homo sapiens
caccatggtgactgccacat

SEQ ID NO: 5982540 - DNA, 23 bp, Homo sapiens
caccatggtgactgccacataat

SEQ ID NO: 5982541 - DNA, 16 bp, Homo sapiens
caccatggtgtgtcat

SEQ ID NO: 5982542 - DNA, 18 bp, Homo sapiens
caccatgtaaaacaaaaa

SEQ ID NO: 5982543 - DNA, 13 bp, Homo sapiens
caccatgtattca

SEQ ID NO: 5982544 - DNA, 20 bp, Homo sapiens
caccatgtattcatccagag

SEQ ID NO: 5982545 - DNA, 17 bp, Homo sapiens
caccatgttagccagga

SEQ ID NO: 5982546 - DNA, 18 bp, Homo sapiens
caccatgttagccaggat

SEQ ID NO: 5982547 - DNA, 19 bp, Homo sapiens
caccatgttagccaggatg

SEQ ID NO: 5982548 - DNA, 15 bp, Homo sapiens
caccatgttagcctt

SEQ ID NO: 5982549 - DNA, 19 bp, Homo sapiens
caccatgttggccaggctg

SEQ ID NO: 5982550 - DNA, 20 bp, Homo sapiens
caccatgttggccaggctgg

SEQ ID NO: 5982551 - DNA, 23 bp, Homo sapiens
caccatgttggccaggctgttct

SEQ ID NO: 5982552 - DNA, 17 bp, Homo sapiens
caccatgttggcctctt

SEQ ID NO: 5982553 - DNA, 20 bp, Homo sapiens
caccatgttggcctcttcag

SEQ ID NO: 5982554 - DNA, 18 bp, Homo sapiens
caccatgtttgagctcag

SEQ ID NO: 5982555 - DNA, 14 bp, Homo sapiens
caccattataatga

SEQ ID NO: 5982556 - DNA, 18 bp, Homo sapiens
caccattataatgaattt

SEQ ID NO: 5982557 - DNA, 22 bp, Homo sapiens
caccattataatgaatttagtg

SEQ ID NO: 5982558 - DNA, 14 bp, Homo sapiens
caccattatgctgg

SEQ ID NO: 5982559 - DNA, 15 bp, Homo sapiens
caccattcaggaacc

SEQ ID NO: 5982560 - DNA, 14 bp, Homo sapiens
caccattcctgcct

SEQ ID NO: 5982561 - DNA, 23 bp, Homo sapiens
caccattcctggaaaccacagtc

SEQ ID NO: 5982562 - DNA, 22 bp, Homo sapiens
caccattcgtacataatactga

SEQ ID NO: 5982563 - DNA, 16 bp, Homo sapiens
caccattctcctgcct

SEQ ID NO: 5982564 - DNA, 24 bp, Homo sapiens
caccattctcctgcctcaccctcc

SEQ ID NO: 5982565 - DNA, 15 bp, Homo sapiens
caccattctccttcc

SEQ ID NO: 5982566 - DNA, 15 bp, Homo sapiens
caccattctgcattt

SEQ ID NO: 5982567 - DNA, 19 bp, Homo sapiens
caccattgcatgaattcac

SEQ ID NO: 5982568 - DNA, 20 bp, Homo sapiens
caccattgtgaagcacctac

SEQ ID NO: 5982569 - DNA, 13 bp, Homo sapiens
caccattgttcat

SEQ ID NO: 5982570 - DNA, 17 bp, Homo sapiens
caccatttaaaaatgtt

SEQ ID NO: 5982571 - DNA, 20 bp, Homo sapiens
caccatttaatcatttccag

SEQ ID NO: 5982572 - DNA, 12 bp, Homo sapiens
caccatttaatt

SEQ ID NO: 5982573 - DNA, 15 bp, Homo sapiens
caccatttaatttca

SEQ ID NO: 5982574 - DNA, 15 bp, Homo sapiens
caccatttccccagg

SEQ ID NO: 5982575 - DNA, 20 bp, Homo sapiens
caccatttccccagggcacg

SEQ ID NO: 5982576 - DNA, 16 bp, Homo sapiens
caccatttcccctgtg

SEQ ID NO: 5982577 - DNA, 18 bp, Homo sapiens
caccatttcccctgtggt

SEQ ID NO: 5982578 - DNA, 19 bp, Homo sapiens
caccatttcccctgtggtt

SEQ ID NO: 5982579 - DNA, 21 bp, Homo sapiens
caccatttctgggggccgcag

SEQ ID NO: 5982580 - DNA, 20 bp, Homo sapiens
caccattttaagtccctgtc

SEQ ID NO: 5982581 - DNA, 13 bp, Homo sapiens
caccattttgtca

SEQ ID NO: 5982582 - DNA, 22 bp, Homo sapiens
cacccaaaacacgcacaccctg

SEQ ID NO: 5982583 - DNA, 14 bp, Homo sapiens
cacccaaaagtcaa

SEQ ID NO: 5982584 - DNA, 14 bp, Homo sapiens
cacccaaacacttc

SEQ ID NO: 5982585 - DNA, 16 bp, Homo sapiens
cacccaaaccccttcc

SEQ ID NO: 5982586 - DNA, 19 bp, Homo sapiens
cacccaaaccccttcccac

SEQ ID NO: 5982587 - DNA, 20 bp, Homo sapiens
cacccaaaccggcaggtgcg

SEQ ID NO: 5982588 - DNA, 17 bp, Homo sapiens
cacccaaagcatggact

SEQ ID NO: 5982589 - DNA, 16 bp, Homo sapiens
cacccaaagcctgtcc

SEQ ID NO: 5982590 - DNA, 20 bp, Homo sapiens
cacccaaagcctgtcccagg

SEQ ID NO: 5982591 - DNA, 12 bp, Homo sapiens
cacccaaagctg

SEQ ID NO: 5982592 - DNA, 22 bp, Homo sapiens
cacccaaatcacatctcacctc

SEQ ID NO: 5982593 - DNA, 20 bp, Homo sapiens
cacccaacagctcagagatg

SEQ ID NO: 5982594 - DNA, 15 bp, Homo sapiens
cacccaaccccaagc

SEQ ID NO: 5982595 - DNA, 22 bp, Homo sapiens
cacccaaccctatctcctgaca

SEQ ID NO: 5982596 - DNA, 14 bp, Homo sapiens
cacccaagagagga

SEQ ID NO: 5982597 - DNA, 16 bp, Homo sapiens
cacccaagagggctgc

SEQ ID NO: 5982598 - DNA, 16 bp, Homo sapiens
cacccaagcaaggcca

SEQ ID NO: 5982599 - DNA, 23 bp, Homo sapiens
cacccaagcacaaactgtcgtct

SEQ ID NO: 5982600 - DNA, 16 bp, Homo sapiens
cacccaagcaggaggc

SEQ ID NO: 5982601 - DNA, 14 bp, Homo sapiens
cacccaagccacaa

SEQ ID NO: 5982602 - DNA, 15 bp, Homo sapiens
cacccaagccacaag

SEQ ID NO: 5982603 - DNA, 22 bp, Homo sapiens
cacccaagcctgatccagcctt

SEQ ID NO: 5982604 - DNA, 14 bp, Homo sapiens
cacccaagcctgct

SEQ ID NO: 5982605 - DNA, 13 bp, Homo sapiens
cacccaagcttgg

SEQ ID NO: 5982606 - DNA, 14 bp, Homo sapiens
cacccaagcttggc

SEQ ID NO: 5982607 - DNA, 20 bp, Homo sapiens
cacccaaggattctgttctg

SEQ ID NO: 5982608 - DNA, 13 bp, Homo sapiens
cacccaagggcct

SEQ ID NO: 5982609 - DNA, 15 bp, Homo sapiens
cacccaaggggcccg

SEQ ID NO: 5982610 - DNA, 21 bp, Homo sapiens
cacccaagtgccaagacacag

SEQ ID NO: 5982611 - DNA, 20 bp, Homo sapiens
cacccaagtggcccccaccc

SEQ ID NO: 5982612 - DNA, 22 bp, Homo sapiens
cacccaagtggcccccaccctc

SEQ ID NO: 5982613 - DNA, 14 bp, Homo sapiens
cacccaatcccagt

SEQ ID NO: 5982614 - DNA, 17 bp, Homo sapiens
cacccaatcccagttct

SEQ ID NO: 5982615 - DNA, 23 bp, Homo sapiens
cacccaatcccagttcttcctgc

SEQ ID NO: 5982616 - DNA, 14 bp, Homo sapiens
cacccaatgaatga

SEQ ID NO: 5982617 - DNA, 15 bp, Homo sapiens
cacccaatgctgctc

SEQ ID NO: 5982618 - DNA, 17 bp, Homo sapiens
cacccaatgctgctcca

SEQ ID NO: 5982619 - DNA, 16 bp, Homo sapiens
cacccaattcaaaaca

SEQ ID NO: 5982620 - DNA, 17 bp, Homo sapiens
cacccaattcaaaacat

SEQ ID NO: 5982621 - DNA, 19 bp, Homo sapiens
cacccaattttaaaaaata

SEQ ID NO: 5982622 - DNA, 17 bp, Homo sapiens
cacccacaaactccagg

SEQ ID NO: 5982623 - DNA, 21 bp, Homo sapiens
cacccacaagaactcctccca

SEQ ID NO: 5982624 - DNA, 13 bp, Homo sapiens
cacccacaagccc

SEQ ID NO: 5982625 - DNA, 18 bp, Homo sapiens
cacccacaatcccaccta

SEQ ID NO: 5982626 - DNA, 15 bp, Homo sapiens
cacccacacagctgc

SEQ ID NO: 5982627 - DNA, 13 bp, Homo sapiens
cacccacagcacc

SEQ ID NO: 5982628 - DNA, 15 bp, Homo sapiens
cacccacagccatag

SEQ ID NO: 5982629 - DNA, 16 bp, Homo sapiens
cacccacagccataga

SEQ ID NO: 5982630 - DNA, 21 bp, Homo sapiens
cacccacatatcttacagcca

SEQ ID NO: 5982631 - DNA, 11 bp, Homo sapiens
cacccacatga

SEQ ID NO: 5982632 - DNA, 13 bp, Homo sapiens
cacccacatgact

SEQ ID NO: 5982633 - DNA, 13 bp, Homo sapiens
cacccacatgtga

SEQ ID NO: 5982634 - DNA, 15 bp, Homo sapiens
cacccaccaaatgcc

SEQ ID NO: 5982635 - DNA, 21 bp, Homo sapiens
cacccaccaaatgcctctgcc

SEQ ID NO: 5982636 - DNA, 18 bp, Homo sapiens
cacccaccaaccctcagg

SEQ ID NO: 5982637 - DNA, 19 bp, Homo sapiens
cacccaccagctccacaca

SEQ ID NO: 5982638 - DNA, 22 bp, Homo sapiens
cacccaccatcatgtctggcta

SEQ ID NO: 5982639 - DNA, 14 bp, Homo sapiens
cacccacccagcac

SEQ ID NO: 5982640 - DNA, 12 bp, Homo sapiens
cacccaccccac

SEQ ID NO: 5982641 - DNA, 12 bp, Homo sapiens
cacccaccccca

SEQ ID NO: 5982642 - DNA, 15 bp, Homo sapiens
cacccacccccaggc

SEQ ID NO: 5982643 - DNA, 16 bp, Homo sapiens
cacccacccccaggcc

SEQ ID NO: 5982644 - DNA, 18 bp, Homo sapiens
cacccacccccaggcctc

SEQ ID NO: 5982645 - DNA, 19 bp, Homo sapiens
cacccacccccaggcctcc

SEQ ID NO: 5982646 - DNA, 18 bp, Homo sapiens
cacccaccccctctggag

SEQ ID NO: 5982647 - DNA, 19 bp, Homo sapiens
cacccaccccctctggaga

SEQ ID NO: 5982648 - DNA, 19 bp, Homo sapiens
cacccaccccctgcctggt

SEQ ID NO: 5982649 - DNA, 17 bp, Homo sapiens
cacccacccctcctggg

SEQ ID NO: 5982650 - DNA, 12 bp, Homo sapiens
cacccacccctg

SEQ ID NO: 5982651 - DNA, 16 bp, Homo sapiens
cacccacccctgcaca

SEQ ID NO: 5982652 - DNA, 13 bp, Homo sapiens
cacccaccctggg

SEQ ID NO: 5982653 - DNA, 13 bp, Homo sapiens
cacccaccctgtg

SEQ ID NO: 5982654 - DNA, 16 bp, Homo sapiens
cacccaccctgtgcca

SEQ ID NO: 5982655 - DNA, 22 bp, Homo sapiens
cacccacccttctcccctgccc

SEQ ID NO: 5982656 - DNA, 15 bp, Homo sapiens
cacccaccctttttt

SEQ ID NO: 5982657 - DNA, 20 bp, Homo sapiens
cacccaccgtccgccctgct

SEQ ID NO: 5982658 - DNA, 23 bp, Homo sapiens
cacccaccgtccgccctgctcct

SEQ ID NO: 5982659 - DNA, 20 bp, Homo sapiens
cacccaccgtctcggccctg

SEQ ID NO: 5982660 - DNA, 14 bp, Homo sapiens
cacccacctcagcc

SEQ ID NO: 5982661 - DNA, 17 bp, Homo sapiens
cacccacctcagcctcc

SEQ ID NO: 5982662 - DNA, 12 bp, Homo sapiens
cacccacctcca

SEQ ID NO: 5982663 - DNA, 13 bp, Homo sapiens
cacccacctccac

SEQ ID NO: 5982664 - DNA, 18 bp, Homo sapiens
cacccacctccacccagc

SEQ ID NO: 5982665 - DNA, 14 bp, Homo sapiens
cacccacctccctg

SEQ ID NO: 5982666 - DNA, 16 bp, Homo sapiens
cacccacctccctgcc

SEQ ID NO: 5982667 - DNA, 18 bp, Homo sapiens
cacccacctccctgcctc

SEQ ID NO: 5982668 - DNA, 17 bp, Homo sapiens
cacccacctcctgcggc

SEQ ID NO: 5982669 - DNA, 13 bp, Homo sapiens
cacccacctgctg

SEQ ID NO: 5982670 - DNA, 14 bp, Homo sapiens
cacccacctgctgc

SEQ ID NO: 5982671 - DNA, 22 bp, Homo sapiens
cacccacctgttttctgaaaca

SEQ ID NO: 5982672 - DNA, 15 bp, Homo sapiens
cacccacctttgcag

SEQ ID NO: 5982673 - DNA, 23 bp, Homo sapiens
cacccacgcatacacacatgccc

SEQ ID NO: 5982674 - DNA, 19 bp, Homo sapiens
cacccacgtggagacagct

SEQ ID NO: 5982675 - DNA, 17 bp, Homo sapiens
cacccactaccatacag

SEQ ID NO: 5982676 - DNA, 14 bp, Homo sapiens
cacccactagccct

SEQ ID NO: 5982677 - DNA, 13 bp, Homo sapiens
cacccactcacca

SEQ ID NO: 5982678 - DNA, 15 bp, Homo sapiens
cacccactcaccagg

SEQ ID NO: 5982679 - DNA, 12 bp, Homo sapiens
cacccactcagc

SEQ ID NO: 5982680 - DNA, 13 bp, Homo sapiens
cacccactcagga

SEQ ID NO: 5982681 - DNA, 14 bp, Homo sapiens
cacccactcaggat

SEQ ID NO: 5982682 - DNA, 16 bp, Homo sapiens
cacccactcaggattg

SEQ ID NO: 5982683 - DNA, 12 bp, Homo sapiens
cacccactccct

SEQ ID NO: 5982684 - DNA, 14 bp, Homo sapiens
cacccactccttta

SEQ ID NO: 5982685 - DNA, 16 bp, Homo sapiens
cacccactctgcactg

SEQ ID NO: 5982686 - DNA, 15 bp, Homo sapiens
cacccactctggtgg

SEQ ID NO: 5982687 - DNA, 17 bp, Homo sapiens
cacccactctggtggcc

SEQ ID NO: 5982688 - DNA, 14 bp, Homo sapiens
cacccactggccag

SEQ ID NO: 5982689 - DNA, 18 bp, Homo sapiens
cacccactggccagtcct

SEQ ID NO: 5982690 - DNA, 19 bp, Homo sapiens
cacccactgtccgcctctg

SEQ ID NO: 5982691 - DNA, 22 bp, Homo sapiens
cacccacttagtccactctgag

SEQ ID NO: 5982692 - DNA, 15 bp, Homo sapiens
cacccacttgcctgt

SEQ ID NO: 5982693 - DNA, 16 bp, Homo sapiens
cacccacttgcctgtc

SEQ ID NO: 5982694 - DNA, 20 bp, Homo sapiens
cacccagaaattccttccca

SEQ ID NO: 5982695 - DNA, 20 bp, Homo sapiens
cacccagaagcagtaataat

SEQ ID NO: 5982696 - DNA, 11 bp, Homo sapiens
cacccagaagg

SEQ ID NO: 5982697 - DNA, 22 bp, Homo sapiens
cacccagacagctccctctgcc

SEQ ID NO: 5982698 - DNA, 23 bp, Homo sapiens
cacccagacataaaggaaaagac

SEQ ID NO: 5982699 - DNA, 13 bp, Homo sapiens
cacccagaccctc

SEQ ID NO: 5982700 - DNA, 17 bp, Homo sapiens
caacctccgtgctgggc

SEQ ID NO: 5982701 - DNA, 18 bp, Homo sapiens
caacctccgtgctgggct

SEQ ID NO: 5982702 - DNA, 11 bp, Homo sapiens
caacctcctgc

SEQ ID NO: 5982703 - DNA, 15 bp, Homo sapiens
caacctcctgctctg

SEQ ID NO: 5982704 - DNA, 16 bp, Homo sapiens
caacctcctgctctgg

SEQ ID NO: 5982705 - DNA, 20 bp, Homo sapiens
caacctcctgctctgggacg

SEQ ID NO: 5982706 - DNA, 14 bp, Homo sapiens
caacctcctgggct

SEQ ID NO: 5982707 - DNA, 13 bp, Homo sapiens
caacctcctgggt

SEQ ID NO: 5982708 - DNA, 14 bp, Homo sapiens
caacctcctgggtt

SEQ ID NO: 5982709 - DNA, 21 bp, Homo sapiens
caacctccttatctgctaact

SEQ ID NO: 5982710 - DNA, 17 bp, Homo sapiens
caacctcgctccaactc

SEQ ID NO: 5982711 - DNA, 21 bp, Homo sapiens
caacctcggcttgtgggctgg

SEQ ID NO: 5982712 - DNA, 24 bp, Homo sapiens
caacctcggcttgtgggctggtgc

SEQ ID NO: 5982713 - DNA, 19 bp, Homo sapiens
caacctctagaattttaag

SEQ ID NO: 5982714 - DNA, 21 bp, Homo sapiens
caacctctcggccccatcgcc

SEQ ID NO: 5982715 - DNA, 15 bp, Homo sapiens
caacctctctgatct

SEQ ID NO: 5982716 - DNA, 16 bp, Homo sapiens
caacctctgcctcctg

SEQ ID NO: 5982717 - DNA, 17 bp, Homo sapiens
caacctctgcttcccag

SEQ ID NO: 5982718 - DNA, 14 bp, Homo sapiens
caacctctgttccc

SEQ ID NO: 5982719 - DNA, 17 bp, Homo sapiens
caacctctgttccccac

SEQ ID NO: 5982720 - DNA, 19 bp, Homo sapiens
caacctctgttccccaccc

SEQ ID NO: 5982721 - DNA, 15 bp, Homo sapiens
caacctcttcagctg

SEQ ID NO: 5982722 - DNA, 16 bp, Homo sapiens
caacctcttcctcctg

SEQ ID NO: 5982723 - DNA, 15 bp, Homo sapiens
caacctcttggcctg

SEQ ID NO: 5982724 - DNA, 19 bp, Homo sapiens
caacctctttttcctcctg

SEQ ID NO: 5982725 - DNA, 15 bp, Homo sapiens
caacctgaaagacaa

SEQ ID NO: 5982726 - DNA, 16 bp, Homo sapiens
caacctgaaatttatt

SEQ ID NO: 5982727 - DNA, 12 bp, Homo sapiens
caacctgaacct

SEQ ID NO: 5982728 - DNA, 21 bp, Homo sapiens
caacctgaaggtcccctggca

SEQ ID NO: 5982729 - DNA, 21 bp, Homo sapiens
caacctgaatacccttttctg

SEQ ID NO: 5982730 - DNA, 17 bp, Homo sapiens
caacctgaatctttttt

SEQ ID NO: 5982731 - DNA, 16 bp, Homo sapiens
caacctgaattaaagt

SEQ ID NO: 5982732 - DNA, 18 bp, Homo sapiens
caacctgaattaaagtct

SEQ ID NO: 5982733 - DNA, 19 bp, Homo sapiens
caacctgaattaaagtcta

SEQ ID NO: 5982734 - DNA, 21 bp, Homo sapiens
caacctgaattaaagtctaca

SEQ ID NO: 5982735 - DNA, 16 bp, Homo sapiens
caacctgacagcaaac

SEQ ID NO: 5982736 - DNA, 20 bp, Homo sapiens
caacctgacagcaaacacag

SEQ ID NO: 5982737 - DNA, 23 bp, Homo sapiens
caacctgacagcaaacacagtca

SEQ ID NO: 5982738 - DNA, 15 bp, Homo sapiens
caacctgaccaacat

SEQ ID NO: 5982739 - DNA, 21 bp, Homo sapiens
caacctgacctaacctaggag

SEQ ID NO: 5982740 - DNA, 19 bp, Homo sapiens
caacctgatgccccttccc

SEQ ID NO: 5982741 - DNA, 23 bp, Homo sapiens
caacctgatgccccttccccaag

SEQ ID NO: 5982742 - DNA, 19 bp, Homo sapiens
caacctgattgtgtctctt

SEQ ID NO: 5982743 - DNA, 22 bp, Homo sapiens
caacctgcatagccggtgggtg

SEQ ID NO: 5982744 - DNA, 12 bp, Homo sapiens
caacctgcctgt

SEQ ID NO: 5982745 - DNA, 16 bp, Homo sapiens
caacctgcctgtgcat

SEQ ID NO: 5982746 - DNA, 21 bp, Homo sapiens
caacctgctctcctcttgcca

SEQ ID NO: 5982747 - DNA, 13 bp, Homo sapiens
caacctgctctgt

SEQ ID NO: 5982748 - DNA, 14 bp, Homo sapiens
caacctgctctgtc

SEQ ID NO: 5982749 - DNA, 16 bp, Homo sapiens
caacctgctctgtccc

SEQ ID NO: 5982750 - DNA, 17 bp, Homo sapiens
caacctgctctgtcccc

SEQ ID NO: 5982751 - DNA, 19 bp, Homo sapiens
caacctgctctgtccccaa

SEQ ID NO: 5982752 - DNA, 20 bp, Homo sapiens
caacctgcttttttctgttt

SEQ ID NO: 5982753 - DNA, 17 bp, Homo sapiens
caacctggaaaataaat

SEQ ID NO: 5982754 - DNA, 22 bp, Homo sapiens
caacctggcataggactctttg

SEQ ID NO: 5982755 - DNA, 20 bp, Homo sapiens
caacctggctccctcccacc

SEQ ID NO: 5982756 - DNA, 22 bp, Homo sapiens
caacctggctccctcccaccca

SEQ ID NO: 5982757 - DNA, 16 bp, Homo sapiens
caacctgggtccaaat

SEQ ID NO: 5982758 - DNA, 16 bp, Homo sapiens
caacctggtcacagga

SEQ ID NO: 5982759 - DNA, 14 bp, Homo sapiens
caacctggtggcac

SEQ ID NO: 5982760 - DNA, 15 bp, Homo sapiens
caacctggtggcacc

SEQ ID NO: 5982761 - DNA, 17 bp, Homo sapiens
caacctggtggcaccag

SEQ ID NO: 5982762 - DNA, 12 bp, Homo sapiens
caacctgtaaat

SEQ ID NO: 5982763 - DNA, 13 bp, Homo sapiens
caacctgtaactg

SEQ ID NO: 5982764 - DNA, 16 bp, Homo sapiens
caacctgtaataaata

SEQ ID NO: 5982765 - DNA, 18 bp, Homo sapiens
caacctgtaataaatatg

SEQ ID NO: 5982766 - DNA, 19 bp, Homo sapiens
caacctgtggggtctgatg

SEQ ID NO: 5982767 - DNA, 18 bp, Homo sapiens
caacctgtgtgagagaat

SEQ ID NO: 5982768 - DNA, 15 bp, Homo sapiens
caacctgttcttaga

SEQ ID NO: 5982769 - DNA, 16 bp, Homo sapiens
caaccttaaaggccgt

SEQ ID NO: 5982770 - DNA, 15 bp, Homo sapiens
caaccttaccaaaaa

SEQ ID NO: 5982771 - DNA, 17 bp, Homo sapiens
caaccttagatgttcta

SEQ ID NO: 5982772 - DNA, 21 bp, Homo sapiens
caaccttcaaagaaacttgaa

SEQ ID NO: 5982773 - DNA, 14 bp, Homo sapiens
caaccttcaagtat

SEQ ID NO: 5982774 - DNA, 15 bp, Homo sapiens
caaccttcattttac

SEQ ID NO: 5982775 - DNA, 17 bp, Homo sapiens
caaccttcattttacat

SEQ ID NO: 5982776 - DNA, 20 bp, Homo sapiens
caaccttccaacttcctgtg

SEQ ID NO: 5982777 - DNA, 18 bp, Homo sapiens
caaccttctgccctcctg

SEQ ID NO: 5982778 - DNA, 20 bp, Homo sapiens
caaccttctgccctcctgcc

SEQ ID NO: 5982779 - DNA, 14 bp, Homo sapiens
caaccttgcatcca

SEQ ID NO: 5982780 - DNA, 16 bp, Homo sapiens
caaccttggccttctc

SEQ ID NO: 5982781 - DNA, 19 bp, Homo sapiens
caaccttggccttctcccc

SEQ ID NO: 5982782 - DNA, 14 bp, Homo sapiens
caaccttggcttgg

SEQ ID NO: 5982783 - DNA, 19 bp, Homo sapiens
caaccttgtactttacaat

SEQ ID NO: 5982784 - DNA, 17 bp, Homo sapiens
caaccttgtcccaagga

SEQ ID NO: 5982785 - DNA, 14 bp, Homo sapiens
caaccttgtttaat

SEQ ID NO: 5982786 - DNA, 13 bp, Homo sapiens
caacctttaaaat

SEQ ID NO: 5982787 - DNA, 16 bp, Homo sapiens
caacctttattctttt

SEQ ID NO: 5982788 - DNA, 18 bp, Homo sapiens
caacctttccctcacccc

SEQ ID NO: 5982789 - DNA, 12 bp, Homo sapiens
caacctttctga

SEQ ID NO: 5982790 - DNA, 19 bp, Homo sapiens
caacctttctgacatcagc

SEQ ID NO: 5982791 - DNA, 12 bp, Homo sapiens
caacctttctgt

SEQ ID NO: 5982792 - DNA, 20 bp, Homo sapiens
caacctttgtaagaaaacca

SEQ ID NO: 5982793 - DNA, 13 bp, Homo sapiens
caacctttgtgta

SEQ ID NO: 5982794 - DNA, 14 bp, Homo sapiens
caacctttgtgtaa

SEQ ID NO: 5982795 - DNA, 16 bp, Homo sapiens
caacctttgtgtaata

SEQ ID NO: 5982796 - DNA, 18 bp, Homo sapiens
caacctttgtgtggctcc

SEQ ID NO: 5982797 - DNA, 19 bp, Homo sapiens
caacctttgtgtggctcct

SEQ ID NO: 5982798 - DNA, 23 bp, Homo sapiens
caacctttgtgtggctcctggta

SEQ ID NO: 5982799 - DNA, 22 bp, Homo sapiens
caacgaaaagcacatccaggca

SEQ ID NO: 5982800 - DNA, 13 bp, Homo sapiens
caacgaagaaaaa

SEQ ID NO: 5982801 - DNA, 14 bp, Homo sapiens
caacgaagaaaaaa

SEQ ID NO: 5982802 - DNA, 18 bp, Homo sapiens
caacgactactttgctac

SEQ ID NO: 5982803 - DNA, 16 bp, Homo sapiens
caacgagcctcctcag

SEQ ID NO: 5982804 - DNA, 17 bp, Homo sapiens
caacgagccttttcacc

SEQ ID NO: 5982805 - DNA, 15 bp, Homo sapiens
caacgaggaagccct

SEQ ID NO: 5982806 - DNA, 16 bp, Homo sapiens
caacgataaaattaca

SEQ ID NO: 5982807 - DNA, 18 bp, Homo sapiens
caacgatcacaaatgact

SEQ ID NO: 5982808 - DNA, 17 bp, Homo sapiens
caacgatttctccatta

SEQ ID NO: 5982809 - DNA, 14 bp, Homo sapiens
caacgcacaggaaa

SEQ ID NO: 5982810 - DNA, 15 bp, Homo sapiens
caacgcagccctgct

SEQ ID NO: 5982811 - DNA, 22 bp, Homo sapiens
caacgcccctccaaacctccag

SEQ ID NO: 5982812 - DNA, 22 bp, Homo sapiens
caacgccgccttggccttgcag

SEQ ID NO: 5982813 - DNA, 14 bp, Homo sapiens
caacgccgtgggct

SEQ ID NO: 5982814 - DNA, 12 bp, Homo sapiens
caacgcctcctg

SEQ ID NO: 5982815 - DNA, 14 bp, Homo sapiens
caacgctattccag

SEQ ID NO: 5982816 - DNA, 17 bp, Homo sapiens
caacgctctaccctgca

SEQ ID NO: 5982817 - DNA, 18 bp, Homo sapiens
caacgctctaccctgcag

SEQ ID NO: 5982818 - DNA, 23 bp, Homo sapiens
caacgctctaccctgcagcttgg

SEQ ID NO: 5982819 - DNA, 20 bp, Homo sapiens
caacgctggagccgcttccc

SEQ ID NO: 5982820 - DNA, 21 bp, Homo sapiens
caacgcttaaaggtgtcttcc

SEQ ID NO: 5982821 - DNA, 23 bp, Homo sapiens
caacgcttgtagaactcactctg

SEQ ID NO: 5982822 - DNA, 21 bp, Homo sapiens
caacggagagcgcctgcccct

SEQ ID NO: 5982823 - DNA, 20 bp, Homo sapiens
caacggaggcctgcgaccct

SEQ ID NO: 5982824 - DNA, 20 bp, Homo sapiens
caacgggaccccctggccct

SEQ ID NO: 5982825 - DNA, 16 bp, Homo sapiens
caacggggggctcctg

SEQ ID NO: 5982826 - DNA, 20 bp, Homo sapiens
caacggggggctcctgccca

SEQ ID NO: 5982827 - DNA, 14 bp, Homo sapiens
caacggggtgggga

SEQ ID NO: 5982828 - DNA, 15 bp, Homo sapiens
caacggggtggggag

SEQ ID NO: 5982829 - DNA, 19 bp, Homo sapiens
caacggggtggggagggtg

SEQ ID NO: 5982830 - DNA, 14 bp, Homo sapiens
caacgggtctgtgg

SEQ ID NO: 5982831 - DNA, 14 bp, Homo sapiens
caacggtctggcag

SEQ ID NO: 5982832 - DNA, 17 bp, Homo sapiens
caacggtctggcagggc

SEQ ID NO: 5982833 - DNA, 18 bp, Homo sapiens
caacgtaatcaaatatgt

SEQ ID NO: 5982834 - DNA, 19 bp, Homo sapiens
caacgtcccctcaagcccc

SEQ ID NO: 5982835 - DNA, 20 bp, Homo sapiens
caacgtcccctcaagcccct

SEQ ID NO: 5982836 - DNA, 19 bp, Homo sapiens
caacgtcccctccgccgtg

SEQ ID NO: 5982837 - DNA, 14 bp, Homo sapiens
caacgtctttttgt

SEQ ID NO: 5982838 - DNA, 20 bp, Homo sapiens
caacgtgctctttgttttgt

SEQ ID NO: 5982839 - DNA, 12 bp, Homo sapiens
caacgtgctgct

SEQ ID NO: 5982840 - DNA, 23 bp, Homo sapiens
caacgtggctttttttttttccc

SEQ ID NO: 5982841 - DNA, 17 bp, Homo sapiens
caacgtggggcagcaca

SEQ ID NO: 5982842 - DNA, 21 bp, Homo sapiens
caacgtgtaaccagttataaa

SEQ ID NO: 5982843 - DNA, 19 bp, Homo sapiens
caacgtgtgtgtcagctgg

SEQ ID NO: 5982844 - DNA, 20 bp, Homo sapiens
caacgtgtgtgtcagctggt

SEQ ID NO: 5982845 - DNA, 12 bp, Homo sapiens
caacgtgttaat

SEQ ID NO: 5982846 - DNA, 18 bp, Homo sapiens
caacgttactcagggctc

SEQ ID NO: 5982847 - DNA, 22 bp, Homo sapiens
caacgttactcagggctcctcc

SEQ ID NO: 5982848 - DNA, 16 bp, Homo sapiens
caacgttcgatttcta

SEQ ID NO: 5982849 - DNA, 23 bp, Homo sapiens
caacgttcgatttctacctcagc

SEQ ID NO: 5982850 - DNA, 17 bp, Homo sapiens
caacgttgctatttcca

SEQ ID NO: 5982851 - DNA, 19 bp, Homo sapiens
caacgttggtatgataatg

SEQ ID NO: 5982852 - DNA, 15 bp, Homo sapiens
caactaaaaataaat

SEQ ID NO: 5982853 - DNA, 21 bp, Homo sapiens
caactaaagaatagtgcctca

SEQ ID NO: 5982854 - DNA, 22 bp, Homo sapiens
caactaaatgagattatatgtg

SEQ ID NO: 5982855 - DNA, 13 bp, Homo sapiens
caactaacaagaa

SEQ ID NO: 5982856 - DNA, 22 bp, Homo sapiens
caactaacaagaaactcacccc

SEQ ID NO: 5982857 - DNA, 16 bp, Homo sapiens
caactaacaatgcctt

SEQ ID NO: 5982858 - DNA, 20 bp, Homo sapiens
caactaactaaccacatttt

SEQ ID NO: 5982859 - DNA, 16 bp, Homo sapiens
caactaagcagtccct

SEQ ID NO: 5982860 - DNA, 16 bp, Homo sapiens
caactaaggacaaatt

SEQ ID NO: 5982861 - DNA, 17 bp, Homo sapiens
caactaaggacaaatta

SEQ ID NO: 5982862 - DNA, 23 bp, Homo sapiens
caactaagtagactttaattctt

SEQ ID NO: 5982863 - DNA, 14 bp, Homo sapiens
caactaagttaata

SEQ ID NO: 5982864 - DNA, 15 bp, Homo sapiens
caactaagttaataa

SEQ ID NO: 5982865 - DNA, 16 bp, Homo sapiens
caactaatcaagagtg

SEQ ID NO: 5982866 - DNA, 17 bp, Homo sapiens
caactaattcaataaaa

SEQ ID NO: 5982867 - DNA, 18 bp, Homo sapiens
caactaattttatttcta

SEQ ID NO: 5982868 - DNA, 16 bp, Homo sapiens
caactacaacttctcc

SEQ ID NO: 5982869 - DNA, 17 bp, Homo sapiens
caactacagccaaattg

SEQ ID NO: 5982870 - DNA, 17 bp, Homo sapiens
caactacattttaaaaa

SEQ ID NO: 5982871 - DNA, 16 bp, Homo sapiens
caactacccaaaacaa

SEQ ID NO: 5982872 - DNA, 20 bp, Homo sapiens
caactacccaaaacaagcct

SEQ ID NO: 5982873 - DNA, 21 bp, Homo sapiens
caactacctgagctaaataaa

SEQ ID NO: 5982874 - DNA, 22 bp, Homo sapiens
caactacggttgggagaatgag

SEQ ID NO: 5982875 - DNA, 13 bp, Homo sapiens
caactactaatag

SEQ ID NO: 5982876 - DNA, 15 bp, Homo sapiens
caactactaatagaa

SEQ ID NO: 5982877 - DNA, 19 bp, Homo sapiens
caactactacctgtaatga

SEQ ID NO: 5982878 - DNA, 20 bp, Homo sapiens
caactactagtgtgactcct

SEQ ID NO: 5982879 - DNA, 16 bp, Homo sapiens
cacccagaccctcctt

SEQ ID NO: 5982880 - DNA, 17 bp, Homo sapiens
cacccagaccctccttc

SEQ ID NO: 5982881 - DNA, 22 bp, Homo sapiens
cacccagacctgaatgcttctg

SEQ ID NO: 5982882 - DNA, 16 bp, Homo sapiens
cacccagacctgcctg

SEQ ID NO: 5982883 - DNA, 20 bp, Homo sapiens
cacccagactggaatgcagt

SEQ ID NO: 5982884 - DNA, 12 bp, Homo sapiens
cacccagagcac

SEQ ID NO: 5982885 - DNA, 15 bp, Homo sapiens
cacccagagcacagg

SEQ ID NO: 5982886 - DNA, 17 bp, Homo sapiens
cacccagagctgcctat

SEQ ID NO: 5982887 - DNA, 20 bp, Homo sapiens
cacccagagggtagggcagc

SEQ ID NO: 5982888 - DNA, 21 bp, Homo sapiens
cacccagagggtagggcagca

SEQ ID NO: 5982889 - DNA, 11 bp, Homo sapiens
cacccagaggt

SEQ ID NO: 5982890 - DNA, 13 bp, Homo sapiens
cacccagaggtct

SEQ ID NO: 5982891 - DNA, 18 bp, Homo sapiens
cacccagaggtctcccta

SEQ ID NO: 5982892 - DNA, 22 bp, Homo sapiens
cacccagaggtggccctcccag

SEQ ID NO: 5982893 - DNA, 21 bp, Homo sapiens
cacccagatgggggaaagcac

SEQ ID NO: 5982894 - DNA, 15 bp, Homo sapiens
cacccagcaaggcac

SEQ ID NO: 5982895 - DNA, 16 bp, Homo sapiens
cacccagcaatagaga

SEQ ID NO: 5982896 - DNA, 23 bp, Homo sapiens
cacccagcaccttgcagattttc

SEQ ID NO: 5982897 - DNA, 15 bp, Homo sapiens
cacccagcagcgccc

SEQ ID NO: 5982898 - DNA, 21 bp, Homo sapiens
cacccagcagcgcccgaggcc

SEQ ID NO: 5982899 - DNA, 12 bp, Homo sapiens
cacccagcaggc

SEQ ID NO: 5982900 - DNA, 18 bp, Homo sapiens
cacccagcatcaccagct

SEQ ID NO: 5982901 - DNA, 16 bp, Homo sapiens
cacccagccaggaggg

SEQ ID NO: 5982902 - DNA, 11 bp, Homo sapiens
cacccagccca

SEQ ID NO: 5982903 - DNA, 16 bp, Homo sapiens
cacccagcccagattg

SEQ ID NO: 5982904 - DNA, 12 bp, Homo sapiens
cacccagcccat

SEQ ID NO: 5982905 - DNA, 13 bp, Homo sapiens
cacccagcccatt

SEQ ID NO: 5982906 - DNA, 14 bp, Homo sapiens
cacccagccccagc

SEQ ID NO: 5982907 - DNA, 18 bp, Homo sapiens
cacccagccccagcgagt

SEQ ID NO: 5982908 - DNA, 23 bp, Homo sapiens
cacccagcccctctcccctctct

SEQ ID NO: 5982909 - DNA, 18 bp, Homo sapiens
cacccagccctggtctca

SEQ ID NO: 5982910 - DNA, 22 bp, Homo sapiens
cacccagccctggtctcagcag

SEQ ID NO: 5982911 - DNA, 13 bp, Homo sapiens
cacccagcccttc

SEQ ID NO: 5982912 - DNA, 19 bp, Homo sapiens
cacccagcccttccttggg

SEQ ID NO: 5982913 - DNA, 12 bp, Homo sapiens
cacccagcctca

SEQ ID NO: 5982914 - DNA, 14 bp, Homo sapiens
cacccagcctcagt

SEQ ID NO: 5982915 - DNA, 22 bp, Homo sapiens
cacccagcctcagtcctcccct

SEQ ID NO: 5982916 - DNA, 13 bp, Homo sapiens
cacccagcctgtc

SEQ ID NO: 5982917 - DNA, 14 bp, Homo sapiens
cacccagcctgtcc

SEQ ID NO: 5982918 - DNA, 17 bp, Homo sapiens
cacccagcctgtcccac

SEQ ID NO: 5982919 - DNA, 17 bp, Homo sapiens
cacccagctccaggccc

SEQ ID NO: 5982920 - DNA, 15 bp, Homo sapiens
cacccagctccaggg

SEQ ID NO: 5982921 - DNA, 15 bp, Homo sapiens
cacccagctggtcct

SEQ ID NO: 5982922 - DNA, 23 bp, Homo sapiens
cacccaggagccccgaggccttc

SEQ ID NO: 5982923 - DNA, 19 bp, Homo sapiens
cacccaggatgacccctgg

SEQ ID NO: 5982924 - DNA, 12 bp, Homo sapiens
cacccaggcaat

SEQ ID NO: 5982925 - DNA, 11 bp, Homo sapiens
cacccaggcag

SEQ ID NO: 5982926 - DNA, 16 bp, Homo sapiens
cacccaggcaggggct

SEQ ID NO: 5982927 - DNA, 15 bp, Homo sapiens
cacccaggcaggtgc

SEQ ID NO: 5982928 - DNA, 11 bp, Homo sapiens
cacccaggcct

SEQ ID NO: 5982929 - DNA, 15 bp, Homo sapiens
cacccaggcctccct

SEQ ID NO: 5982930 - DNA, 19 bp, Homo sapiens
cacccaggcctccctgcag

SEQ ID NO: 5982931 - DNA, 18 bp, Homo sapiens
cacccaggctgcactgca

SEQ ID NO: 5982932 - DNA, 20 bp, Homo sapiens
cacccaggctgcactgcagt

SEQ ID NO: 5982933 - DNA, 15 bp, Homo sapiens
cacccaggctggagt

SEQ ID NO: 5982934 - DNA, 20 bp, Homo sapiens
cacccaggctggagtgcagt

SEQ ID NO: 5982935 - DNA, 20 bp, Homo sapiens
cacccaggctggagtgcggt

SEQ ID NO: 5982936 - DNA, 11 bp, Homo sapiens
cacccagggaa

SEQ ID NO: 5982937 - DNA, 22 bp, Homo sapiens
cacccagggacactccaactct

SEQ ID NO: 5982938 - DNA, 14 bp, Homo sapiens
cacccagggagctg

SEQ ID NO: 5982939 - DNA, 16 bp, Homo sapiens
cacccagggcccggca

SEQ ID NO: 5982940 - DNA, 19 bp, Homo sapiens
cacccagggcccggcacag

SEQ ID NO: 5982941 - DNA, 21 bp, Homo sapiens
cacccaggggaaggccctgag

SEQ ID NO: 5982942 - DNA, 20 bp, Homo sapiens
cacccaggtgatttcctcta

SEQ ID NO: 5982943 - DNA, 23 bp, Homo sapiens
cacccaggtgatttcctctaaag

SEQ ID NO: 5982944 - DNA, 20 bp, Homo sapiens
cacccagtcacctccccaca

SEQ ID NO: 5982945 - DNA, 15 bp, Homo sapiens
cacccagtccccacc

SEQ ID NO: 5982946 - DNA, 20 bp, Homo sapiens
cacccagtcctctgcctcca

SEQ ID NO: 5982947 - DNA, 17 bp, Homo sapiens
cacccagtcctggccat

SEQ ID NO: 5982948 - DNA, 17 bp, Homo sapiens
cacccagtgagcactcc

SEQ ID NO: 5982949 - DNA, 23 bp, Homo sapiens
cacccagtgagcactcccaagtc

SEQ ID NO: 5982950 - DNA, 23 bp, Homo sapiens
cacccagtgccctctcccctcag

SEQ ID NO: 5982951 - DNA, 19 bp, Homo sapiens
cacccagtgctgccatgcc

SEQ ID NO: 5982952 - DNA, 23 bp, Homo sapiens
cacccagttggtgactgggaaag

SEQ ID NO: 5982953 - DNA, 15 bp, Homo sapiens
cacccataaacagta

SEQ ID NO: 5982954 - DNA, 16 bp, Homo sapiens
cacccataaacagtaa

SEQ ID NO: 5982955 - DNA, 17 bp, Homo sapiens
cacccataatcctttct

SEQ ID NO: 5982956 - DNA, 21 bp, Homo sapiens
cacccatcagtggagtccaga

SEQ ID NO: 5982957 - DNA, 11 bp, Homo sapiens
cacccatccta

SEQ ID NO: 5982958 - DNA, 23 bp, Homo sapiens
cacccatcctaccaatgcatgca

SEQ ID NO: 5982959 - DNA, 14 bp, Homo sapiens
cacccatcctagag

SEQ ID NO: 5982960 - DNA, 17 bp, Homo sapiens
cacccatcgtataagga

SEQ ID NO: 5982961 - DNA, 21 bp, Homo sapiens
cacccatcgtccaccccagtg

SEQ ID NO: 5982962 - DNA, 12 bp, Homo sapiens
cacccatctcca

SEQ ID NO: 5982963 - DNA, 18 bp, Homo sapiens
cacccatctgttttttgt

SEQ ID NO: 5982964 - DNA, 17 bp, Homo sapiens
cacccatcttcctgctg

SEQ ID NO: 5982965 - DNA, 19 bp, Homo sapiens
cacccatcttcctgctgct

SEQ ID NO: 5982966 - DNA, 22 bp, Homo sapiens
cacccatcttcctgctgctgta

SEQ ID NO: 5982967 - DNA, 18 bp, Homo sapiens
cacccatgaaagaaaact

SEQ ID NO: 5982968 - DNA, 20 bp, Homo sapiens
cacccatgacaatcaccttc

SEQ ID NO: 5982969 - DNA, 21 bp, Homo sapiens
cacccatgactgccccttgct

SEQ ID NO: 5982970 - DNA, 23 bp, Homo sapiens
cacccatgatactccactcccag

SEQ ID NO: 5982971 - DNA, 16 bp, Homo sapiens
cacccatgcacactca

SEQ ID NO: 5982972 - DNA, 16 bp, Homo sapiens
cacccatgcacagaac

SEQ ID NO: 5982973 - DNA, 19 bp, Homo sapiens
cacccatgcagctgctccc

SEQ ID NO: 5982974 - DNA, 11 bp, Homo sapiens
cacccatgcca

SEQ ID NO: 5982975 - DNA, 22 bp, Homo sapiens
cacccatgccccactctgctga

SEQ ID NO: 5982976 - DNA, 24 bp, Homo sapiens
cacccatggcctcagccctgctcc

SEQ ID NO: 5982977 - DNA, 17 bp, Homo sapiens
cacccatgtaaccactg

SEQ ID NO: 5982978 - DNA, 21 bp, Homo sapiens
cacccattcccccatgtggct

SEQ ID NO: 5982979 - DNA, 14 bp, Homo sapiens
cacccattcttccc

SEQ ID NO: 5982980 - DNA, 20 bp, Homo sapiens
cacccattgtctcattgcca

SEQ ID NO: 5982981 - DNA, 15 bp, Homo sapiens
cacccatttttcctt

SEQ ID NO: 5982982 - DNA, 23 bp, Homo sapiens
caccccaaaggggcctctccttt

SEQ ID NO: 5982983 - DNA, 19 bp, Homo sapiens
caccccaacaaactcctct

SEQ ID NO: 5982984 - DNA, 20 bp, Homo sapiens
caccccaacctgctctcctc

SEQ ID NO: 5982985 - DNA, 12 bp, Homo sapiens
caccccaactct

SEQ ID NO: 5982986 - DNA, 18 bp, Homo sapiens
caccccaactctccccag

SEQ ID NO: 5982987 - DNA, 13 bp, Homo sapiens
caccccaagggac

SEQ ID NO: 5982988 - DNA, 18 bp, Homo sapiens
caccccaagggacaaccc

SEQ ID NO: 5982989 - DNA, 15 bp, Homo sapiens
caccccaatccctgc

SEQ ID NO: 5982990 - DNA, 19 bp, Homo sapiens
caccccaatccctgccact

SEQ ID NO: 5982991 - DNA, 16 bp, Homo sapiens
caccccacaccccagc

SEQ ID NO: 5982992 - DNA, 16 bp, Homo sapiens
caccccacacctgcag

SEQ ID NO: 5982993 - DNA, 22 bp, Homo sapiens
caccccacacttgcagagctgc

SEQ ID NO: 5982994 - DNA, 15 bp, Homo sapiens
caccccacagaacct

SEQ ID NO: 5982995 - DNA, 11 bp, Homo sapiens
caccccacagc

SEQ ID NO: 5982996 - DNA, 16 bp, Homo sapiens
caccccacagctgggg

SEQ ID NO: 5982997 - DNA, 17 bp, Homo sapiens
caccccacagctggggc

SEQ ID NO: 5982998 - DNA, 15 bp, Homo sapiens
caccccacccacctt

SEQ ID NO: 5982999 - DNA, 20 bp, Homo sapiens
caccccacccacctttgcag

SEQ ID NO: 5983000 - DNA, 16 bp, Homo sapiens
caccccaccccacccc

SEQ ID NO: 5983001 - DNA, 16 bp, Homo sapiens
caccccaccctgcccc

SEQ ID NO: 5983002 - DNA, 13 bp, Homo sapiens
caccccacctgcg

SEQ ID NO: 5983003 - DNA, 15 bp, Homo sapiens
caccccacgccctgt

SEQ ID NO: 5983004 - DNA, 18 bp, Homo sapiens
caccccacgccttatccc

SEQ ID NO: 5983005 - DNA, 17 bp, Homo sapiens
caccccactcacagaga

SEQ ID NO: 5983006 - DNA, 12 bp, Homo sapiens
caccccactcca

SEQ ID NO: 5983007 - DNA, 13 bp, Homo sapiens
caccccactccag

SEQ ID NO: 5983008 - DNA, 15 bp, Homo sapiens
caccccactccagcc

SEQ ID NO: 5983009 - DNA, 14 bp, Homo sapiens
caccccactcctgt

SEQ ID NO: 5983010 - DNA, 13 bp, Homo sapiens
caccccactgaga

SEQ ID NO: 5983011 - DNA, 22 bp, Homo sapiens
caccccactgcaatcctgtctt

SEQ ID NO: 5983012 - DNA, 18 bp, Homo sapiens
caccccactggatcttca

SEQ ID NO: 5983013 - DNA, 17 bp, Homo sapiens
caccccactgggagagc

SEQ ID NO: 5983014 - DNA, 24 bp, Homo sapiens
caccccacttatccctctccataa

SEQ ID NO: 5983015 - DNA, 16 bp, Homo sapiens
caccccagaaatcact

SEQ ID NO: 5983016 - DNA, 19 bp, Homo sapiens
caccccagaaatcactgtg

SEQ ID NO: 5983017 - DNA, 18 bp, Homo sapiens
caccccagaatcccctgg

SEQ ID NO: 5983018 - DNA, 13 bp, Homo sapiens
caccccagacctc

SEQ ID NO: 5983019 - DNA, 15 bp, Homo sapiens
caccccagactccag

SEQ ID NO: 5983020 - DNA, 18 bp, Homo sapiens
caccccagactccaggcc

SEQ ID NO: 5983021 - DNA, 12 bp, Homo sapiens
caccccagagcc

SEQ ID NO: 5983022 - DNA, 18 bp, Homo sapiens
caccccagagccacacat

SEQ ID NO: 5983023 - DNA, 22 bp, Homo sapiens
caccccagagccacacatgggc

SEQ ID NO: 5983024 - DNA, 20 bp, Homo sapiens
caccccagaggacacaggca

SEQ ID NO: 5983025 - DNA, 11 bp, Homo sapiens
caccccagagt

SEQ ID NO: 5983026 - DNA, 12 bp, Homo sapiens
caccccagagtt

SEQ ID NO: 5983027 - DNA, 10 bp, Homo sapiens
caccccagca

SEQ ID NO: 5983028 - DNA, 16 bp, Homo sapiens
caccccagcaattatg

SEQ ID NO: 5983029 - DNA, 16 bp, Homo sapiens
caccccagcacagcca

SEQ ID NO: 5983030 - DNA, 20 bp, Homo sapiens
caccccagcacagccacctc

SEQ ID NO: 5983031 - DNA, 15 bp, Homo sapiens
caccccagcatcagc

SEQ ID NO: 5983032 - DNA, 19 bp, Homo sapiens
caccccagccccactgccc

SEQ ID NO: 5983033 - DNA, 23 bp, Homo sapiens
caccccagcccccacagccctgg

SEQ ID NO: 5983034 - DNA, 15 bp, Homo sapiens
caccccagcctcatt

SEQ ID NO: 5983035 - DNA, 13 bp, Homo sapiens
caccccagcctcg

SEQ ID NO: 5983036 - DNA, 11 bp, Homo sapiens
caccccagctc

SEQ ID NO: 5983037 - DNA, 18 bp, Homo sapiens
caccccagctccgacctc

SEQ ID NO: 5983038 - DNA, 20 bp, Homo sapiens
caccccagctgctcccctcc

SEQ ID NO: 5983039 - DNA, 20 bp, Homo sapiens
caccccaggaaaagcacaag

SEQ ID NO: 5983040 - DNA, 17 bp, Homo sapiens
caccccaggacagttta

SEQ ID NO: 5983041 - DNA, 18 bp, Homo sapiens
caccccaggacgccactc

SEQ ID NO: 5983042 - DNA, 18 bp, Homo sapiens
caccccaggcagctcctg

SEQ ID NO: 5983043 - DNA, 19 bp, Homo sapiens
caccccaggcagctcctgt

SEQ ID NO: 5983044 - DNA, 12 bp, Homo sapiens
caccccaggccc

SEQ ID NO: 5983045 - DNA, 19 bp, Homo sapiens
caccccaggccctgccaga

SEQ ID NO: 5983046 - DNA, 20 bp, Homo sapiens
caccccagggacagggccct

SEQ ID NO: 5983047 - DNA, 16 bp, Homo sapiens
caccccagggcagcca

SEQ ID NO: 5983048 - DNA, 16 bp, Homo sapiens
caccccagtccccggg

SEQ ID NO: 5983049 - DNA, 17 bp, Homo sapiens
caccccagtccccggga

SEQ ID NO: 5983050 - DNA, 17 bp, Homo sapiens
caccccagtgcacccac

SEQ ID NO: 5983051 - DNA, 23 bp, Homo sapiens
caccccagtgcggacccttccca

SEQ ID NO: 5983052 - DNA, 20 bp, Homo sapiens
caccccataataaccctgcc

SEQ ID NO: 5983053 - DNA, 21 bp, Homo sapiens
caccccataataaccctgcca

SEQ ID NO: 5983054 - DNA, 22 bp, Homo sapiens
caccccataataaccctgccag

SEQ ID NO: 5983055 - DNA, 19 bp, Homo sapiens
caccccataccagtcacct

SEQ ID NO: 5983056 - DNA, 22 bp, Homo sapiens
caccccataccagtcacctcct

SEQ ID NO: 5983057 - DNA, 12 bp, Homo sapiens
caccccatccag

SEQ ID NO: 5983058 - DNA, 14 bp, Homo sapiens
caccccatcccacc

SEQ ID NO: 5983059 - DNA, 22 bp, Homo sapiens
caactactcagctctcctgctg

SEQ ID NO: 5983060 - DNA, 15 bp, Homo sapiens
caactagacattacc

SEQ ID NO: 5983061 - DNA, 16 bp, Homo sapiens
caactagacattctgt

SEQ ID NO: 5983062 - DNA, 18 bp, Homo sapiens
caactagatcaaggagcc

SEQ ID NO: 5983063 - DNA, 19 bp, Homo sapiens
caactagatcaaggagccc

SEQ ID NO: 5983064 - DNA, 14 bp, Homo sapiens
caactagatttgtc

SEQ ID NO: 5983065 - DNA, 13 bp, Homo sapiens
caactagccaagg

SEQ ID NO: 5983066 - DNA, 15 bp, Homo sapiens
caactagctgggact

SEQ ID NO: 5983067 - DNA, 18 bp, Homo sapiens
caactatattatcatgca

SEQ ID NO: 5983068 - DNA, 20 bp, Homo sapiens
caactatattgcgagaaaca

SEQ ID NO: 5983069 - DNA, 21 bp, Homo sapiens
caactatcagactaagccagc

SEQ ID NO: 5983070 - DNA, 15 bp, Homo sapiens
caactatccaagtgt

SEQ ID NO: 5983071 - DNA, 22 bp, Homo sapiens
caactatgatatggtaaaagtt

SEQ ID NO: 5983072 - DNA, 17 bp, Homo sapiens
caactatgatttggaaa

SEQ ID NO: 5983073 - DNA, 22 bp, Homo sapiens
caactatgatttggaaaataaa

SEQ ID NO: 5983074 - DNA, 14 bp, Homo sapiens
caactatggcctgt

SEQ ID NO: 5983075 - DNA, 19 bp, Homo sapiens
caactattcttcatttaca

SEQ ID NO: 5983076 - DNA, 21 bp, Homo sapiens
caactatttattgactctggg

SEQ ID NO: 5983077 - DNA, 14 bp, Homo sapiens
caactatttcaata

SEQ ID NO: 5983078 - DNA, 18 bp, Homo sapiens
caactatttcaataagtg

SEQ ID NO: 5983079 - DNA, 18 bp, Homo sapiens
caactatttctttcatca

SEQ ID NO: 5983080 - DNA, 19 bp, Homo sapiens
caactatttctttcatcag

SEQ ID NO: 5983081 - DNA, 14 bp, Homo sapiens
caactattttcaga

SEQ ID NO: 5983082 - DNA, 21 bp, Homo sapiens
caactattttcagatgtgaac

SEQ ID NO: 5983083 - DNA, 15 bp, Homo sapiens
caactatttttccaa

SEQ ID NO: 5983084 - DNA, 17 bp, Homo sapiens
caactcacacctccttt

SEQ ID NO: 5983085 - DNA, 18 bp, Homo sapiens
caactcacacctcctttt

SEQ ID NO: 5983086 - DNA, 23 bp, Homo sapiens
caactcacacctccttttcttct

SEQ ID NO: 5983087 - DNA, 22 bp, Homo sapiens
caactcacccttggcccatccc

SEQ ID NO: 5983088 - DNA, 15 bp, Homo sapiens
caactcactcctttt

SEQ ID NO: 5983089 - DNA, 18 bp, Homo sapiens
caactcactccttttaaa

SEQ ID NO: 5983090 - DNA, 15 bp, Homo sapiens
caactcactgtgctc

SEQ ID NO: 5983091 - DNA, 16 bp, Homo sapiens
caactcactgtgctcc

SEQ ID NO: 5983092 - DNA, 17 bp, Homo sapiens
caactcactgtgctcct

SEQ ID NO: 5983093 - DNA, 23 bp, Homo sapiens
caactcagagaaaaatgctcccc

SEQ ID NO: 5983094 - DNA, 17 bp, Homo sapiens
caactcagagcacagcc

SEQ ID NO: 5983095 - DNA, 16 bp, Homo sapiens
caactcagcctgttcc

SEQ ID NO: 5983096 - DNA, 21 bp, Homo sapiens
caactcagcctgttccttcct

SEQ ID NO: 5983097 - DNA, 14 bp, Homo sapiens
caactcagcttcgg

SEQ ID NO: 5983098 - DNA, 20 bp, Homo sapiens
caactcatgaacaaaatgaa

SEQ ID NO: 5983099 - DNA, 18 bp, Homo sapiens
caactccaacatccactc

SEQ ID NO: 5983100 - DNA, 14 bp, Homo sapiens
caactccaacctct

SEQ ID NO: 5983101 - DNA, 17 bp, Homo sapiens
caactccaacctctcgg

SEQ ID NO: 5983102 - DNA, 20 bp, Homo sapiens
caactccaacctctcggccc

SEQ ID NO: 5983103 - DNA, 15 bp, Homo sapiens
caactccaacttcta

SEQ ID NO: 5983104 - DNA, 12 bp, Homo sapiens
caactccaaggc

SEQ ID NO: 5983105 - DNA, 13 bp, Homo sapiens
caactccaaggca

SEQ ID NO: 5983106 - DNA, 16 bp, Homo sapiens
caactccaaggcaaat

SEQ ID NO: 5983107 - DNA, 19 bp, Homo sapiens
caactccaaggcaaatgtc

SEQ ID NO: 5983108 - DNA, 18 bp, Homo sapiens
caactccaccctctgcga

SEQ ID NO: 5983109 - DNA, 22 bp, Homo sapiens
caactccacgaggtgaaaaata

SEQ ID NO: 5983110 - DNA, 11 bp, Homo sapiens
caactccagaa

SEQ ID NO: 5983111 - DNA, 22 bp, Homo sapiens
caactccagaagtggggctctg

SEQ ID NO: 5983112 - DNA, 13 bp, Homo sapiens
caactccagcaac

SEQ ID NO: 5983113 - DNA, 17 bp, Homo sapiens
caactccagcgtcctca

SEQ ID NO: 5983114 - DNA, 19 bp, Homo sapiens
caactccagcgtcctcagc

SEQ ID NO: 5983115 - DNA, 18 bp, Homo sapiens
caactccagctgagtcct

SEQ ID NO: 5983116 - DNA, 13 bp, Homo sapiens
caactccaggggc

SEQ ID NO: 5983117 - DNA, 22 bp, Homo sapiens
caactccagtactggagcttct

SEQ ID NO: 5983118 - DNA, 17 bp, Homo sapiens
caactccagtagcttgg

SEQ ID NO: 5983119 - DNA, 17 bp, Homo sapiens
caactccatactccact

SEQ ID NO: 5983120 - DNA, 13 bp, Homo sapiens
caactccatcaga

SEQ ID NO: 5983121 - DNA, 16 bp, Homo sapiens
caactccatgaccagg

SEQ ID NO: 5983122 - DNA, 18 bp, Homo sapiens
caactccatgaccaggcc

SEQ ID NO: 5983123 - DNA, 19 bp, Homo sapiens
caactccatgaccaggcca

SEQ ID NO: 5983124 - DNA, 24 bp, Homo sapiens
caactccatgaccaggccaccatc

SEQ ID NO: 5983125 - DNA, 11 bp, Homo sapiens
caactcccagc

SEQ ID NO: 5983126 - DNA, 19 bp, Homo sapiens
caactcccagccaccacca

SEQ ID NO: 5983127 - DNA, 13 bp, Homo sapiens
caactcccccacc

SEQ ID NO: 5983128 - DNA, 23 bp, Homo sapiens
caactcccggaggtgtcaccttc

SEQ ID NO: 5983129 - DNA, 14 bp, Homo sapiens
caactcccttctgc

SEQ ID NO: 5983130 - DNA, 15 bp, Homo sapiens
caactcccttgcacg

SEQ ID NO: 5983131 - DNA, 18 bp, Homo sapiens
caactccgtgtgcctggg

SEQ ID NO: 5983132 - DNA, 23 bp, Homo sapiens
caactcctagttctagaaaaaca

SEQ ID NO: 5983133 - DNA, 12 bp, Homo sapiens
caactcctcctt

SEQ ID NO: 5983134 - DNA, 12 bp, Homo sapiens
caactcctggct

SEQ ID NO: 5983135 - DNA, 14 bp, Homo sapiens
caactcctgttctt

SEQ ID NO: 5983136 - DNA, 22 bp, Homo sapiens
caactcctgttctttgggctca

SEQ ID NO: 5983137 - DNA, 18 bp, Homo sapiens
caactcctttcagccaca

SEQ ID NO: 5983138 - DNA, 19 bp, Homo sapiens
caactcctttcagccacat

SEQ ID NO: 5983139 - DNA, 18 bp, Homo sapiens
caactccttttactgcgt

SEQ ID NO: 5983140 - DNA, 20 bp, Homo sapiens
caactcgccctgtttggcat

SEQ ID NO: 5983141 - DNA, 19 bp, Homo sapiens
caactcgctttaggtcagc

SEQ ID NO: 5983142 - DNA, 17 bp, Homo sapiens
caactcgggggcgcctg

SEQ ID NO: 5983143 - DNA, 16 bp, Homo sapiens
caactcgtatagcatg

SEQ ID NO: 5983144 - DNA, 16 bp, Homo sapiens
caactcgtgacagcct

SEQ ID NO: 5983145 - DNA, 19 bp, Homo sapiens
caactcgtgacagcctctg

SEQ ID NO: 5983146 - DNA, 23 bp, Homo sapiens
caactctaaagtgctaataataa

SEQ ID NO: 5983147 - DNA, 13 bp, Homo sapiens
caactctagctgg

SEQ ID NO: 5983148 - DNA, 18 bp, Homo sapiens
caactctcactcctgaat

SEQ ID NO: 5983149 - DNA, 13 bp, Homo sapiens
caactctccactc

SEQ ID NO: 5983150 - DNA, 15 bp, Homo sapiens
caactctccactcca

SEQ ID NO: 5983151 - DNA, 13 bp, Homo sapiens
caactctccagcc

SEQ ID NO: 5983152 - DNA, 14 bp, Homo sapiens
caactctcccaaag

SEQ ID NO: 5983153 - DNA, 11 bp, Homo sapiens
caactctcccc

SEQ ID NO: 5983154 - DNA, 13 bp, Homo sapiens
caactctccccag

SEQ ID NO: 5983155 - DNA, 15 bp, Homo sapiens
caactctccccagtg

SEQ ID NO: 5983156 - DNA, 19 bp, Homo sapiens
caactctcctccagagtca

SEQ ID NO: 5983157 - DNA, 15 bp, Homo sapiens
caactctctcctgta

SEQ ID NO: 5983158 - DNA, 11 bp, Homo sapiens
caactctctct

SEQ ID NO: 5983159 - DNA, 13 bp, Homo sapiens
caactctctctgc

SEQ ID NO: 5983160 - DNA, 14 bp, Homo sapiens
caactctctctgcc

SEQ ID NO: 5983161 - DNA, 13 bp, Homo sapiens
caactctctctgt

SEQ ID NO: 5983162 - DNA, 21 bp, Homo sapiens
caactctcttattgcctcact

SEQ ID NO: 5983163 - DNA, 22 bp, Homo sapiens
caactctgaagagtatttgaaa

SEQ ID NO: 5983164 - DNA, 14 bp, Homo sapiens
caactctgccttta

SEQ ID NO: 5983165 - DNA, 22 bp, Homo sapiens
caactctggccttggttcctcc

SEQ ID NO: 5983166 - DNA, 16 bp, Homo sapiens
caactctggctccagg

SEQ ID NO: 5983167 - DNA, 13 bp, Homo sapiens
caactctgtgggg

SEQ ID NO: 5983168 - DNA, 18 bp, Homo sapiens
caactcttatttctttcc

SEQ ID NO: 5983169 - DNA, 22 bp, Homo sapiens
caactcttcattttgagtctca

SEQ ID NO: 5983170 - DNA, 17 bp, Homo sapiens
caactcttccacctctg

SEQ ID NO: 5983171 - DNA, 23 bp, Homo sapiens
caactcttccacctctggggaag

SEQ ID NO: 5983172 - DNA, 21 bp, Homo sapiens
caactcttccccctctcccag

SEQ ID NO: 5983173 - DNA, 20 bp, Homo sapiens
caactcttcctcccctctca

SEQ ID NO: 5983174 - DNA, 17 bp, Homo sapiens
caactcttgcaggtctc

SEQ ID NO: 5983175 - DNA, 14 bp, Homo sapiens
caactctttgagaa

SEQ ID NO: 5983176 - DNA, 15 bp, Homo sapiens
caactctttgagaaa

SEQ ID NO: 5983177 - DNA, 16 bp, Homo sapiens
caactctttgagaaac

SEQ ID NO: 5983178 - DNA, 15 bp, Homo sapiens
caactgaaagtgttt

SEQ ID NO: 5983179 - DNA, 17 bp, Homo sapiens
caactgaacaaaaaaat

SEQ ID NO: 5983180 - DNA, 13 bp, Homo sapiens
caactgaacgaca

SEQ ID NO: 5983181 - DNA, 16 bp, Homo sapiens
caactgaagccttctt

SEQ ID NO: 5983182 - DNA, 21 bp, Homo sapiens
caactgaaggctaaaaagcaa

SEQ ID NO: 5983183 - DNA, 23 bp, Homo sapiens
caactgaataaattcagtatttt

SEQ ID NO: 5983184 - DNA, 18 bp, Homo sapiens
caactgaatgaggtcagc

SEQ ID NO: 5983185 - DNA, 18 bp, Homo sapiens
caactgacaatatgattt

SEQ ID NO: 5983186 - DNA, 21 bp, Homo sapiens
caactgacaatatgattttaa

SEQ ID NO: 5983187 - DNA, 17 bp, Homo sapiens
caactgacactcccacc

SEQ ID NO: 5983188 - DNA, 18 bp, Homo sapiens
caactgacctgagcggca

SEQ ID NO: 5983189 - DNA, 14 bp, Homo sapiens
caactgactgactt

SEQ ID NO: 5983190 - DNA, 19 bp, Homo sapiens
caactgacttctgctaggt

SEQ ID NO: 5983191 - DNA, 19 bp, Homo sapiens
caactgagaagccaagcct

SEQ ID NO: 5983192 - DNA, 22 bp, Homo sapiens
caactgagaagccaagcctgga

SEQ ID NO: 5983193 - DNA, 19 bp, Homo sapiens
caactgagatgttaaaata

SEQ ID NO: 5983194 - DNA, 13 bp, Homo sapiens
caactgagccaaa

SEQ ID NO: 5983195 - DNA, 17 bp, Homo sapiens
caactgagccaaaaaca

SEQ ID NO: 5983196 - DNA, 14 bp, Homo sapiens
caactgaggcagac

SEQ ID NO: 5983197 - DNA, 22 bp, Homo sapiens
caactgaggcagacagcagctc

SEQ ID NO: 5983198 - DNA, 21 bp, Homo sapiens
caactgaggttcttgggatac

SEQ ID NO: 5983199 - DNA, 15 bp, Homo sapiens
caactgatcctgctc

SEQ ID NO: 5983200 - DNA, 17 bp, Homo sapiens
caactgattttgtatgt

SEQ ID NO: 5983201 - DNA, 21 bp, Homo sapiens
caactgcaaaaaaagcctcca

SEQ ID NO: 5983202 - DNA, 18 bp, Homo sapiens
caactgcacatgaaagtt

SEQ ID NO: 5983203 - DNA, 15 bp, Homo sapiens
caactgcataacctt

SEQ ID NO: 5983204 - DNA, 20 bp, Homo sapiens
caactgcatcaagatgtgac

SEQ ID NO: 5983205 - DNA, 16 bp, Homo sapiens
caactgcatccaggcc

SEQ ID NO: 5983206 - DNA, 15 bp, Homo sapiens
caactgccaaataaa

SEQ ID NO: 5983207 - DNA, 22 bp, Homo sapiens
caactgccaaataaaatgttta

SEQ ID NO: 5983208 - DNA, 18 bp, Homo sapiens
caactgccaggctgcctc

SEQ ID NO: 5983209 - DNA, 11 bp, Homo sapiens
caactgcccag

SEQ ID NO: 5983210 - DNA, 12 bp, Homo sapiens
caactgccccag

SEQ ID NO: 5983211 - DNA, 14 bp, Homo sapiens
caactgcccttcca

SEQ ID NO: 5983212 - DNA, 13 bp, Homo sapiens
caactgcctcagc

SEQ ID NO: 5983213 - DNA, 14 bp, Homo sapiens
caactgcctccttg

SEQ ID NO: 5983214 - DNA, 11 bp, Homo sapiens
caactgcctta

SEQ ID NO: 5983215 - DNA, 17 bp, Homo sapiens
caactgctcagctctgg

SEQ ID NO: 5983216 - DNA, 16 bp, Homo sapiens
caactgctccagcctc

SEQ ID NO: 5983217 - DNA, 18 bp, Homo sapiens
caactgctccagcctctg

SEQ ID NO: 5983218 - DNA, 15 bp, Homo sapiens
caactgctcccacct

SEQ ID NO: 5983219 - DNA, 18 bp, Homo sapiens
caactgctcccacctcct

SEQ ID NO: 5983220 - DNA, 19 bp, Homo sapiens
caactgctcccacctcctg

SEQ ID NO: 5983221 - DNA, 22 bp, Homo sapiens
caactgctcccacctcctgaca

SEQ ID NO: 5983222 - DNA, 21 bp, Homo sapiens
caactgctctcaaaatgtgaa

SEQ ID NO: 5983223 - DNA, 12 bp, Homo sapiens
caactgctctgc

SEQ ID NO: 5983224 - DNA, 15 bp, Homo sapiens
caactgctctgccca

SEQ ID NO: 5983225 - DNA, 22 bp, Homo sapiens
caactgctgcttaaaatgcaag

SEQ ID NO: 5983226 - DNA, 17 bp, Homo sapiens
caactgctggggagaca

SEQ ID NO: 5983227 - DNA, 19 bp, Homo sapiens
caactgctggggagacaaa

SEQ ID NO: 5983228 - DNA, 15 bp, Homo sapiens
caactgctggtgatt

SEQ ID NO: 5983229 - DNA, 15 bp, Homo sapiens
caactgctgtggccc

SEQ ID NO: 5983230 - DNA, 22 bp, Homo sapiens
caactgctgtggccccctgtcc

SEQ ID NO: 5983231 - DNA, 20 bp, Homo sapiens
caactgctgtttagtgaaca

SEQ ID NO: 5983232 - DNA, 16 bp, Homo sapiens
caactgctgttttatg

SEQ ID NO: 5983233 - DNA, 11 bp, Homo sapiens
caactgctttg

SEQ ID NO: 5983234 - DNA, 18 bp, Homo sapiens
caactggacaagatttcc

SEQ ID NO: 5983235 - DNA, 18 bp, Homo sapiens
caactggacatcacagca

SEQ ID NO: 5983236 - DNA, 22 bp, Homo sapiens
caactggactatagcagggctg

SEQ ID NO: 5983237 - DNA, 23 bp, Homo sapiens
caactggactatagcagggctgg

SEQ ID NO: 5983238 - DNA, 16 bp, Homo sapiens
caactggagttcctta

SEQ ID NO: 5983239 - DNA, 14 bp, Homo sapiens
caccccatccctgg

SEQ ID NO: 5983240 - DNA, 16 bp, Homo sapiens
caccccatccctggct

SEQ ID NO: 5983241 - DNA, 17 bp, Homo sapiens
caccccatccctggctg

SEQ ID NO: 5983242 - DNA, 23 bp, Homo sapiens
caccccatctttgctgccagctc

SEQ ID NO: 5983243 - DNA, 19 bp, Homo sapiens
caccccatgcacctcaggg

SEQ ID NO: 5983244 - DNA, 15 bp, Homo sapiens
caccccatgccaaag

SEQ ID NO: 5983245 - DNA, 15 bp, Homo sapiens
caccccatggccggc

SEQ ID NO: 5983246 - DNA, 19 bp, Homo sapiens
caccccattcccgcagtgg

SEQ ID NO: 5983247 - DNA, 16 bp, Homo sapiens
caccccattttctgtg

SEQ ID NO: 5983248 - DNA, 17 bp, Homo sapiens
cacccccaaacacaaaa

SEQ ID NO: 5983249 - DNA, 14 bp, Homo sapiens
cacccccaagcctg

SEQ ID NO: 5983250 - DNA, 15 bp, Homo sapiens
cacccccaagcctgg

SEQ ID NO: 5983251 - DNA, 11 bp, Homo sapiens
cacccccacca

SEQ ID NO: 5983252 - DNA, 11 bp, Homo sapiens
cacccccaccc

SEQ ID NO: 5983253 - DNA, 22 bp, Homo sapiens
cacccccacccaagggcctggc

SEQ ID NO: 5983254 - DNA, 17 bp, Homo sapiens
cacccccacccccagct

SEQ ID NO: 5983255 - DNA, 17 bp, Homo sapiens
cacccccacccccagtg

SEQ ID NO: 5983256 - DNA, 17 bp, Homo sapiens
cacccccacccctgtac

SEQ ID NO: 5983257 - DNA, 14 bp, Homo sapiens
cacccccactctgc

SEQ ID NO: 5983258 - DNA, 19 bp, Homo sapiens
cacccccactttcgcctcc

SEQ ID NO: 5983259 - DNA, 13 bp, Homo sapiens
cacccccagcaca

SEQ ID NO: 5983260 - DNA, 12 bp, Homo sapiens
cacccccagcca

SEQ ID NO: 5983261 - DNA, 21 bp, Homo sapiens
cacccccagccccgactccag

SEQ ID NO: 5983262 - DNA, 17 bp, Homo sapiens
cacccccagcctccccc

SEQ ID NO: 5983263 - DNA, 20 bp, Homo sapiens
cacccccagcctcccccagg

SEQ ID NO: 5983264 - DNA, 16 bp, Homo sapiens
cacccccagcctgggc

SEQ ID NO: 5983265 - DNA, 17 bp, Homo sapiens
cacccccagcctgggcc

SEQ ID NO: 5983266 - DNA, 18 bp, Homo sapiens
cacccccagcctgggcct

SEQ ID NO: 5983267 - DNA, 19 bp, Homo sapiens
cacccccagccttgcccag

SEQ ID NO: 5983268 - DNA, 12 bp, Homo sapiens
cacccccagctg

SEQ ID NO: 5983269 - DNA, 14 bp, Homo sapiens
cacccccaggacct

SEQ ID NO: 5983270 - DNA, 12 bp, Homo sapiens
cacccccaggcc

SEQ ID NO: 5983271 - DNA, 14 bp, Homo sapiens
cacccccaggcctc

SEQ ID NO: 5983272 - DNA, 15 bp, Homo sapiens
cacccccaggcctcc

SEQ ID NO: 5983273 - DNA, 17 bp, Homo sapiens
cacccccaggtcttcct

SEQ ID NO: 5983274 - DNA, 18 bp, Homo sapiens
cacccccagtctccaggg

SEQ ID NO: 5983275 - DNA, 13 bp, Homo sapiens
cacccccatccct

SEQ ID NO: 5983276 - DNA, 13 bp, Homo sapiens
cacccccatctct

SEQ ID NO: 5983277 - DNA, 17 bp, Homo sapiens
cacccccatctctccct

SEQ ID NO: 5983278 - DNA, 13 bp, Homo sapiens
cacccccatcttc

SEQ ID NO: 5983279 - DNA, 12 bp, Homo sapiens
cacccccatggc

SEQ ID NO: 5983280 - DNA, 14 bp, Homo sapiens
caccccccaagctg

SEQ ID NO: 5983281 - DNA, 12 bp, Homo sapiens
caccccccacac

SEQ ID NO: 5983282 - DNA, 15 bp, Homo sapiens
caccccccacacaca

SEQ ID NO: 5983283 - DNA, 22 bp, Homo sapiens
caccccccacgtctgtcctcct

SEQ ID NO: 5983284 - DNA, 13 bp, Homo sapiens
caccccccactca

SEQ ID NO: 5983285 - DNA, 16 bp, Homo sapiens
caccccccactctgtg

SEQ ID NO: 5983286 - DNA, 18 bp, Homo sapiens
caccccccagaacctgtc

SEQ ID NO: 5983287 - DNA, 20 bp, Homo sapiens
caccccccagaacctgtcct

SEQ ID NO: 5983288 - DNA, 18 bp, Homo sapiens
cacccccccaccccaggc

SEQ ID NO: 5983289 - DNA, 13 bp, Homo sapiens
cacccccccaggc

SEQ ID NO: 5983290 - DNA, 15 bp, Homo sapiens
cacccccccaggcct

SEQ ID NO: 5983291 - DNA, 16 bp, Homo sapiens
cacccccccaggcctc

SEQ ID NO: 5983292 - DNA, 15 bp, Homo sapiens
caccccccgccggca

SEQ ID NO: 5983293 - DNA, 21 bp, Homo sapiens
caccccccgccggcaggggcc

SEQ ID NO: 5983294 - DNA, 12 bp, Homo sapiens
cacccccctcat

SEQ ID NO: 5983295 - DNA, 12 bp, Homo sapiens
cacccccctcct

SEQ ID NO: 5983296 - DNA, 20 bp, Homo sapiens
cacccccctctctttctctg

SEQ ID NO: 5983297 - DNA, 15 bp, Homo sapiens
cacccccctctgctg

SEQ ID NO: 5983298 - DNA, 19 bp, Homo sapiens
cacccccctgtgcctgctg

SEQ ID NO: 5983299 - DNA, 20 bp, Homo sapiens
cacccccctgtgcctgctgg

SEQ ID NO: 5983300 - DNA, 18 bp, Homo sapiens
cacccccgacggcctcca

SEQ ID NO: 5983301 - DNA, 21 bp, Homo sapiens
cacccccgacggcctccagga

SEQ ID NO: 5983302 - DNA, 17 bp, Homo sapiens
cacccccgagcttgcct

SEQ ID NO: 5983303 - DNA, 19 bp, Homo sapiens
cacccccgagcttgcctca

SEQ ID NO: 5983304 - DNA, 18 bp, Homo sapiens
cacccccgatgggatggc

SEQ ID NO: 5983305 - DNA, 14 bp, Homo sapiens
cacccccgctggag

SEQ ID NO: 5983306 - DNA, 18 bp, Homo sapiens
cacccccgctttggttct

SEQ ID NO: 5983307 - DNA, 18 bp, Homo sapiens
cacccccggcagcagccc

SEQ ID NO: 5983308 - DNA, 15 bp, Homo sapiens
cacccccgggtgcct

SEQ ID NO: 5983309 - DNA, 18 bp, Homo sapiens
cacccccgttagcttcct

SEQ ID NO: 5983310 - DNA, 20 bp, Homo sapiens
caccccctcaagccaatccc

SEQ ID NO: 5983311 - DNA, 12 bp, Homo sapiens
caccccctcatt

SEQ ID NO: 5983312 - DNA, 16 bp, Homo sapiens
caccccctcattcccc

SEQ ID NO: 5983313 - DNA, 14 bp, Homo sapiens
caccccctccagct

SEQ ID NO: 5983314 - DNA, 13 bp, Homo sapiens
caccccctccccg

SEQ ID NO: 5983315 - DNA, 19 bp, Homo sapiens
caccccctccccgggcagc

SEQ ID NO: 5983316 - DNA, 13 bp, Homo sapiens
caccccctccctg

SEQ ID NO: 5983317 - DNA, 23 bp, Homo sapiens
caccccctccctggcctgttctg

SEQ ID NO: 5983318 - DNA, 14 bp, Homo sapiens
caccccctcctgct

SEQ ID NO: 5983319 - DNA, 16 bp, Homo sapiens
caccccctcctgctgc

SEQ ID NO: 5983320 - DNA, 14 bp, Homo sapiens
caccccctccttct

SEQ ID NO: 5983321 - DNA, 17 bp, Homo sapiens
caccccctctcctggag

SEQ ID NO: 5983322 - DNA, 19 bp, Homo sapiens
caccccctctcctggaggg

SEQ ID NO: 5983323 - DNA, 15 bp, Homo sapiens
caccccctgcccaca

SEQ ID NO: 5983324 - DNA, 16 bp, Homo sapiens
caccccctgccctgca

SEQ ID NO: 5983325 - DNA, 14 bp, Homo sapiens
caccccctgcctgg

SEQ ID NO: 5983326 - DNA, 12 bp, Homo sapiens
caccccctgggc

SEQ ID NO: 5983327 - DNA, 13 bp, Homo sapiens
caccccctgggca

SEQ ID NO: 5983328 - DNA, 16 bp, Homo sapiens
caccccctgggcagat

SEQ ID NO: 5983329 - DNA, 16 bp, Homo sapiens
caccccctgttccctg

SEQ ID NO: 5983330 - DNA, 17 bp, Homo sapiens
caccccctgttccctgt

SEQ ID NO: 5983331 - DNA, 13 bp, Homo sapiens
cacccccttccct

SEQ ID NO: 5983332 - DNA, 14 bp, Homo sapiens
cacccccttccctg

SEQ ID NO: 5983333 - DNA, 16 bp, Homo sapiens
cacccccttctctgct

SEQ ID NO: 5983334 - DNA, 22 bp, Homo sapiens
cacccccttctctgctccacca

SEQ ID NO: 5983335 - DNA, 15 bp, Homo sapiens
cacccccttggtgct

SEQ ID NO: 5983336 - DNA, 12 bp, Homo sapiens
caccccctttcc

SEQ ID NO: 5983337 - DNA, 12 bp, Homo sapiens
caccccctttgg

SEQ ID NO: 5983338 - DNA, 20 bp, Homo sapiens
caccccgaaatcagccccca

SEQ ID NO: 5983339 - DNA, 15 bp, Homo sapiens
caccccgagggctga

SEQ ID NO: 5983340 - DNA, 16 bp, Homo sapiens
caccccgcagtcactt

SEQ ID NO: 5983341 - DNA, 14 bp, Homo sapiens
caccccgccagcct

SEQ ID NO: 5983342 - DNA, 15 bp, Homo sapiens
caccccgccagccta

SEQ ID NO: 5983343 - DNA, 17 bp, Homo sapiens
caccccgcccctgcatg

SEQ ID NO: 5983344 - DNA, 20 bp, Homo sapiens
caccccgccgttccctgcgc

SEQ ID NO: 5983345 - DNA, 14 bp, Homo sapiens
caccccgcctctgg

SEQ ID NO: 5983346 - DNA, 14 bp, Homo sapiens
caccccgcctgcct

SEQ ID NO: 5983347 - DNA, 16 bp, Homo sapiens
caccccgcctgcctcc

SEQ ID NO: 5983348 - DNA, 21 bp, Homo sapiens
caccccgcctgcctcctggct

SEQ ID NO: 5983349 - DNA, 12 bp, Homo sapiens
caccccgctcac

SEQ ID NO: 5983350 - DNA, 14 bp, Homo sapiens
caccccgctcacgc

SEQ ID NO: 5983351 - DNA, 16 bp, Homo sapiens
caccccgctgcctggc

SEQ ID NO: 5983352 - DNA, 18 bp, Homo sapiens
caccccgctgcctggcgg

SEQ ID NO: 5983353 - DNA, 14 bp, Homo sapiens
caccccggcaggcc

SEQ ID NO: 5983354 - DNA, 20 bp, Homo sapiens
caccccggcaggccctgcag

SEQ ID NO: 5983355 - DNA, 14 bp, Homo sapiens
caccccggccacct

SEQ ID NO: 5983356 - DNA, 16 bp, Homo sapiens
caccccggccacctgc

SEQ ID NO: 5983357 - DNA, 15 bp, Homo sapiens
caccccggcctcagg

SEQ ID NO: 5983358 - DNA, 18 bp, Homo sapiens
caccccggcctcagggcg

SEQ ID NO: 5983359 - DNA, 15 bp, Homo sapiens
caccccgggctctct

SEQ ID NO: 5983360 - DNA, 19 bp, Homo sapiens
caccccggggaccctgtga

SEQ ID NO: 5983361 - DNA, 12 bp, Homo sapiens
caccccgtcccg

SEQ ID NO: 5983362 - DNA, 18 bp, Homo sapiens
caccccgtcccggccccg

SEQ ID NO: 5983363 - DNA, 19 bp, Homo sapiens
caccccgtcccggccccgc

SEQ ID NO: 5983364 - DNA, 13 bp, Homo sapiens
caccccgtcctga

SEQ ID NO: 5983365 - DNA, 23 bp, Homo sapiens
caccccgtctggggttcagcccc

SEQ ID NO: 5983366 - DNA, 14 bp, Homo sapiens
caccccgttcccag

SEQ ID NO: 5983367 - DNA, 16 bp, Homo sapiens
caccccgttcccagcg

SEQ ID NO: 5983368 - DNA, 19 bp, Homo sapiens
caccccgttcccagcgcat

SEQ ID NO: 5983369 - DNA, 19 bp, Homo sapiens
caccccgttgttgtccctg

SEQ ID NO: 5983370 - DNA, 23 bp, Homo sapiens
cacccctaaaagaaaccctgcac

SEQ ID NO: 5983371 - DNA, 17 bp, Homo sapiens
cacccctaaactccagg

SEQ ID NO: 5983372 - DNA, 14 bp, Homo sapiens
cacccctacacaca

SEQ ID NO: 5983373 - DNA, 16 bp, Homo sapiens
cacccctacagcctgc

SEQ ID NO: 5983374 - DNA, 12 bp, Homo sapiens
cacccctaccac

SEQ ID NO: 5983375 - DNA, 18 bp, Homo sapiens
cacccctagccaccagtg

SEQ ID NO: 5983376 - DNA, 20 bp, Homo sapiens
cacccctagccaccagtgtc

SEQ ID NO: 5983377 - DNA, 13 bp, Homo sapiens
cacccctagccct

SEQ ID NO: 5983378 - DNA, 15 bp, Homo sapiens
cacccctagccctgg

SEQ ID NO: 5983379 - DNA, 12 bp, Homo sapiens
cacccctaggac

SEQ ID NO: 5983380 - DNA, 19 bp, Homo sapiens
cacccctcaagccaggaga

SEQ ID NO: 5983381 - DNA, 12 bp, Homo sapiens
cacccctcactc

SEQ ID NO: 5983382 - DNA, 21 bp, Homo sapiens
cacccctcccacctctttctt

SEQ ID NO: 5983383 - DNA, 12 bp, Homo sapiens
cacccctcccat

SEQ ID NO: 5983384 - DNA, 13 bp, Homo sapiens
cacccctccccat

SEQ ID NO: 5983385 - DNA, 12 bp, Homo sapiens
cacccctcccct

SEQ ID NO: 5983386 - DNA, 15 bp, Homo sapiens
cacccctcccctgcc

SEQ ID NO: 5983387 - DNA, 14 bp, Homo sapiens
cacccctcccctgg

SEQ ID NO: 5983388 - DNA, 15 bp, Homo sapiens
cacccctcccctggg

SEQ ID NO: 5983389 - DNA, 16 bp, Homo sapiens
cacccctcccctggga

SEQ ID NO: 5983390 - DNA, 17 bp, Homo sapiens
cacccctccctccctct

SEQ ID NO: 5983391 - DNA, 19 bp, Homo sapiens
cacccctccctctgctctc

SEQ ID NO: 5983392 - DNA, 13 bp, Homo sapiens
cacccctccctgc

SEQ ID NO: 5983393 - DNA, 18 bp, Homo sapiens
cacccctccctgcttgca

SEQ ID NO: 5983394 - DNA, 23 bp, Homo sapiens
cacccctccctgcttgcacactt

SEQ ID NO: 5983395 - DNA, 18 bp, Homo sapiens
cacccctccctttctccc

SEQ ID NO: 5983396 - DNA, 20 bp, Homo sapiens
cacccctccgtgtggagcac

SEQ ID NO: 5983397 - DNA, 17 bp, Homo sapiens
cacccctcctccttgct

SEQ ID NO: 5983398 - DNA, 23 bp, Homo sapiens
cacccctcctctagctctggtgg

SEQ ID NO: 5983399 - DNA, 17 bp, Homo sapiens
cacccctcctgggccca

SEQ ID NO: 5983400 - DNA, 20 bp, Homo sapiens
cacccctcctgggcccaggc

SEQ ID NO: 5983401 - DNA, 17 bp, Homo sapiens
cacccctcgccaccttt

SEQ ID NO: 5983402 - DNA, 18 bp, Homo sapiens
cacccctcgccacctttc

SEQ ID NO: 5983403 - DNA, 18 bp, Homo sapiens
cacccctctcccccgccc

SEQ ID NO: 5983404 - DNA, 16 bp, Homo sapiens
cacccctctgccctca

SEQ ID NO: 5983405 - DNA, 14 bp, Homo sapiens
cacccctctgctgc

SEQ ID NO: 5983406 - DNA, 16 bp, Homo sapiens
cacccctctggcacct

SEQ ID NO: 5983407 - DNA, 13 bp, Homo sapiens
cacccctctgtct

SEQ ID NO: 5983408 - DNA, 22 bp, Homo sapiens
cacccctctgtctaggactgca

SEQ ID NO: 5983409 - DNA, 14 bp, Homo sapiens
cacccctcttcccc

SEQ ID NO: 5983410 - DNA, 19 bp, Homo sapiens
cacccctcttcccccttcc

SEQ ID NO: 5983411 - DNA, 21 bp, Homo sapiens
cacccctgagttgggcagcca

SEQ ID NO: 5983412 - DNA, 12 bp, Homo sapiens
cacccctgcact

SEQ ID NO: 5983413 - DNA, 13 bp, Homo sapiens
cacccctgcaggc

SEQ ID NO: 5983414 - DNA, 14 bp, Homo sapiens
cacccctgccactc

SEQ ID NO: 5983415 - DNA, 18 bp, Homo sapiens
cacccctgcccccagccc

SEQ ID NO: 5983416 - DNA, 21 bp, Homo sapiens
cacccctgcccctgtgggact

SEQ ID NO: 5983417 - DNA, 24 bp, Homo sapiens
cacccctgccctgggatgtccaca

SEQ ID NO: 5983418 - DNA, 12 bp, Homo sapiens
cacccctgcctc

SEQ ID NO: 5983419 - DNA, 22 bp, Homo sapiens
cacccctgcctcccgccccctt

SEQ ID NO: 5983420 - DNA, 10 bp, Homo sapiens
cacccctgct

SEQ ID NO: 5983421 - DNA, 16 bp, Homo sapiens
cacccctgggcaggcg

SEQ ID NO: 5983422 - DNA, 18 bp, Homo sapiens
cacccctggggctgagtc

SEQ ID NO: 5983423 - DNA, 19 bp, Homo sapiens
caactggatgcatcaagaa

SEQ ID NO: 5983424 - DNA, 11 bp, Homo sapiens
caactggatgt

SEQ ID NO: 5983425 - DNA, 15 bp, Homo sapiens
caactggccagccaa

SEQ ID NO: 5983426 - DNA, 14 bp, Homo sapiens
caactggccctctt

SEQ ID NO: 5983427 - DNA, 21 bp, Homo sapiens
caactggccctcttcttactt

SEQ ID NO: 5983428 - DNA, 20 bp, Homo sapiens
caactggcgaagcctgagca

SEQ ID NO: 5983429 - DNA, 21 bp, Homo sapiens
caactggcgaagcctgagcag

SEQ ID NO: 5983430 - DNA, 13 bp, Homo sapiens
caactggctggga

SEQ ID NO: 5983431 - DNA, 13 bp, Homo sapiens
caactggcttctg

SEQ ID NO: 5983432 - DNA, 19 bp, Homo sapiens
caactggcttctgtgcact

SEQ ID NO: 5983433 - DNA, 16 bp, Homo sapiens
caactggggaaaagga

SEQ ID NO: 5983434 - DNA, 23 bp, Homo sapiens
caactggggtgggtggggcagtg

SEQ ID NO: 5983435 - DNA, 21 bp, Homo sapiens
caactggggttgcgtctgagg

SEQ ID NO: 5983436 - DNA, 18 bp, Homo sapiens
caactggtatatatttag

SEQ ID NO: 5983437 - DNA, 19 bp, Homo sapiens
caactggtccactcagggc

SEQ ID NO: 5983438 - DNA, 16 bp, Homo sapiens
caactggttagtgtga

SEQ ID NO: 5983439 - DNA, 14 bp, Homo sapiens
caactgtaaagcaa

SEQ ID NO: 5983440 - DNA, 15 bp, Homo sapiens
caactgtaaagcaaa

SEQ ID NO: 5983441 - DNA, 23 bp, Homo sapiens
caactgtataccgtgtgctccag

SEQ ID NO: 5983442 - DNA, 15 bp, Homo sapiens
caactgtatatattc

SEQ ID NO: 5983443 - DNA, 15 bp, Homo sapiens
caactgtattaaaga

SEQ ID NO: 5983444 - DNA, 18 bp, Homo sapiens
caactgtattaaagaaaa

SEQ ID NO: 5983445 - DNA, 20 bp, Homo sapiens
caactgtattaaagaaaaat

SEQ ID NO: 5983446 - DNA, 17 bp, Homo sapiens
caactgtcaaatatgtt

SEQ ID NO: 5983447 - DNA, 18 bp, Homo sapiens
caactgtcagttcatcct

SEQ ID NO: 5983448 - DNA, 16 bp, Homo sapiens
caactgtcccaaggag

SEQ ID NO: 5983449 - DNA, 20 bp, Homo sapiens
caactgtcccaaggaggggg

SEQ ID NO: 5983450 - DNA, 17 bp, Homo sapiens
caactgtccctttgttt

SEQ ID NO: 5983451 - DNA, 20 bp, Homo sapiens
caactgtccctttgtttgaa

SEQ ID NO: 5983452 - DNA, 21 bp, Homo sapiens
caactgtctatttctgctgaa

SEQ ID NO: 5983453 - DNA, 21 bp, Homo sapiens
caactgtctcgatgcaatgaa

SEQ ID NO: 5983454 - DNA, 15 bp, Homo sapiens
caactgtcttcctca

SEQ ID NO: 5983455 - DNA, 12 bp, Homo sapiens
caactgtgactg

SEQ ID NO: 5983456 - DNA, 14 bp, Homo sapiens
caactgtgtagcat

SEQ ID NO: 5983457 - DNA, 18 bp, Homo sapiens
caactgttagctgggaag

SEQ ID NO: 5983458 - DNA, 14 bp, Homo sapiens
caactgttggaatt

SEQ ID NO: 5983459 - DNA, 19 bp, Homo sapiens
caactgttgtaactaggct

SEQ ID NO: 5983460 - DNA, 21 bp, Homo sapiens
caactgtttcagaaaacataa

SEQ ID NO: 5983461 - DNA, 16 bp, Homo sapiens
caactgtttgcactta

SEQ ID NO: 5983462 - DNA, 22 bp, Homo sapiens
caactgtttttgaagaagggaa

SEQ ID NO: 5983463 - DNA, 19 bp, Homo sapiens
caacttaaaaagtctgcat

SEQ ID NO: 5983464 - DNA, 15 bp, Homo sapiens
caacttaaatcactg

SEQ ID NO: 5983465 - DNA, 14 bp, Homo sapiens
caacttaacatggg

SEQ ID NO: 5983466 - DNA, 15 bp, Homo sapiens
caacttaacatgggc

SEQ ID NO: 5983467 - DNA, 20 bp, Homo sapiens
caacttaagtatttacaggg

SEQ ID NO: 5983468 - DNA, 15 bp, Homo sapiens
caacttaagtttaga

SEQ ID NO: 5983469 - DNA, 15 bp, Homo sapiens
caacttaataaaaac

SEQ ID NO: 5983470 - DNA, 14 bp, Homo sapiens
caacttaatgaaga

SEQ ID NO: 5983471 - DNA, 21 bp, Homo sapiens
caacttaatgttctgaataat

SEQ ID NO: 5983472 - DNA, 14 bp, Homo sapiens
caacttacaaaaac

SEQ ID NO: 5983473 - DNA, 18 bp, Homo sapiens
caacttacaaaaacactt

SEQ ID NO: 5983474 - DNA, 14 bp, Homo sapiens
caacttactactga

SEQ ID NO: 5983475 - DNA, 13 bp, Homo sapiens
caacttagctcag

SEQ ID NO: 5983476 - DNA, 17 bp, Homo sapiens
caacttagctcaggtgc

SEQ ID NO: 5983477 - DNA, 18 bp, Homo sapiens
caacttagctcaggtgcc

SEQ ID NO: 5983478 - DNA, 19 bp, Homo sapiens
caacttagctcaggtgcct

SEQ ID NO: 5983479 - DNA, 22 bp, Homo sapiens
caacttataattacaatgcaca

SEQ ID NO: 5983480 - DNA, 15 bp, Homo sapiens
caacttatttctgaa

SEQ ID NO: 5983481 - DNA, 16 bp, Homo sapiens
caacttcaagtgcatg

SEQ ID NO: 5983482 - DNA, 17 bp, Homo sapiens
caacttcaagtgcatgc

SEQ ID NO: 5983483 - DNA, 22 bp, Homo sapiens
caacttcaagtgcatgctctct

SEQ ID NO: 5983484 - DNA, 22 bp, Homo sapiens
caacttcaccaccccctgtccc

SEQ ID NO: 5983485 - DNA, 16 bp, Homo sapiens
caacttcagcagggga

SEQ ID NO: 5983486 - DNA, 17 bp, Homo sapiens
caacttcagtcctggga

SEQ ID NO: 5983487 - DNA, 20 bp, Homo sapiens
caacttcatataactgagat

SEQ ID NO: 5983488 - DNA, 19 bp, Homo sapiens
caacttcatcccagctgct

SEQ ID NO: 5983489 - DNA, 15 bp, Homo sapiens
caacttcccaggccg

SEQ ID NO: 5983490 - DNA, 23 bp, Homo sapiens
caacttcccagttcaggagtccc

SEQ ID NO: 5983491 - DNA, 22 bp, Homo sapiens
caacttcccctctaactggaca

SEQ ID NO: 5983492 - DNA, 23 bp, Homo sapiens
caacttcccctctaactggacag

SEQ ID NO: 5983493 - DNA, 24 bp, Homo sapiens
caacttcccctctaactggacagc

SEQ ID NO: 5983494 - DNA, 18 bp, Homo sapiens
caacttccctgttcttta

SEQ ID NO: 5983495 - DNA, 19 bp, Homo sapiens
caacttccgcctcctgtgt

SEQ ID NO: 5983496 - DNA, 15 bp, Homo sapiens
caacttccgctgagg

SEQ ID NO: 5983497 - DNA, 19 bp, Homo sapiens
caacttcctccttcactct

SEQ ID NO: 5983498 - DNA, 14 bp, Homo sapiens
caacttcctgtggc

SEQ ID NO: 5983499 - DNA, 17 bp, Homo sapiens
caacttcctgtggcctg

SEQ ID NO: 5983500 - DNA, 18 bp, Homo sapiens
caacttcctgtggcctga

SEQ ID NO: 5983501 - DNA, 19 bp, Homo sapiens
caacttcctgtggcctgaa

SEQ ID NO: 5983502 - DNA, 23 bp, Homo sapiens
caacttcctttgactttctgtgt

SEQ ID NO: 5983503 - DNA, 16 bp, Homo sapiens
caacttctaattgcca

SEQ ID NO: 5983504 - DNA, 19 bp, Homo sapiens
caacttctacttctgccct

SEQ ID NO: 5983505 - DNA, 23 bp, Homo sapiens
caacttctccatcctttctgcct

SEQ ID NO: 5983506 - DNA, 14 bp, Homo sapiens
caacttctcccacc

SEQ ID NO: 5983507 - DNA, 16 bp, Homo sapiens
caacttctcccacccc

SEQ ID NO: 5983508 - DNA, 19 bp, Homo sapiens
caacttctcttgctttcta

SEQ ID NO: 5983509 - DNA, 18 bp, Homo sapiens
caacttctgggcctctct

SEQ ID NO: 5983510 - DNA, 18 bp, Homo sapiens
caacttcttcctgtgaag

SEQ ID NO: 5983511 - DNA, 19 bp, Homo sapiens
caacttgaacttcacctgc

SEQ ID NO: 5983512 - DNA, 20 bp, Homo sapiens
caacttgaacttcacctgca

SEQ ID NO: 5983513 - DNA, 13 bp, Homo sapiens
caacttgaagaaa

SEQ ID NO: 5983514 - DNA, 14 bp, Homo sapiens
caacttgaagaaac

SEQ ID NO: 5983515 - DNA, 21 bp, Homo sapiens
caacttgaagattgtagcaat

SEQ ID NO: 5983516 - DNA, 22 bp, Homo sapiens
caacttgaaggattgcatcctg

SEQ ID NO: 5983517 - DNA, 16 bp, Homo sapiens
caacttgagatgtatg

SEQ ID NO: 5983518 - DNA, 22 bp, Homo sapiens
caacttgagcctgtgaccttgg

SEQ ID NO: 5983519 - DNA, 18 bp, Homo sapiens
caacttgagtctttgaag

SEQ ID NO: 5983520 - DNA, 18 bp, Homo sapiens
caacttgatgtcaagcaa

SEQ ID NO: 5983521 - DNA, 15 bp, Homo sapiens
caacttgattcttgt

SEQ ID NO: 5983522 - DNA, 12 bp, Homo sapiens
caacttgcaaaa

SEQ ID NO: 5983523 - DNA, 18 bp, Homo sapiens
caacttgcaaaatcagtt

SEQ ID NO: 5983524 - DNA, 20 bp, Homo sapiens
caacttgcaaaatcagtttt

SEQ ID NO: 5983525 - DNA, 22 bp, Homo sapiens
caacttgcatccaactccagga

SEQ ID NO: 5983526 - DNA, 16 bp, Homo sapiens
caacttgccaaaatgt

SEQ ID NO: 5983527 - DNA, 12 bp, Homo sapiens
caacttgccaca

SEQ ID NO: 5983528 - DNA, 16 bp, Homo sapiens
caacttgcctttgaag

SEQ ID NO: 5983529 - DNA, 19 bp, Homo sapiens
caacttgcctttgaagagt

SEQ ID NO: 5983530 - DNA, 14 bp, Homo sapiens
caacttgctccttt

SEQ ID NO: 5983531 - DNA, 14 bp, Homo sapiens
caacttgcttctaa

SEQ ID NO: 5983532 - DNA, 20 bp, Homo sapiens
caacttggaaaaagaaagaa

SEQ ID NO: 5983533 - DNA, 20 bp, Homo sapiens
caacttggcagctttttctg

SEQ ID NO: 5983534 - DNA, 15 bp, Homo sapiens
caacttggcatttct

SEQ ID NO: 5983535 - DNA, 18 bp, Homo sapiens
caacttggcttcctttct

SEQ ID NO: 5983536 - DNA, 16 bp, Homo sapiens
caacttgggttcttct

SEQ ID NO: 5983537 - DNA, 23 bp, Homo sapiens
caacttggttgtgaaccaactgc

SEQ ID NO: 5983538 - DNA, 22 bp, Homo sapiens
caacttgtaaatacaccacctc

SEQ ID NO: 5983539 - DNA, 16 bp, Homo sapiens
caacttgtaaatgtgg

SEQ ID NO: 5983540 - DNA, 19 bp, Homo sapiens
caacttgtacttgtttcat

SEQ ID NO: 5983541 - DNA, 23 bp, Homo sapiens
caacttgtattaaagacagaggc

SEQ ID NO: 5983542 - DNA, 18 bp, Homo sapiens
caacttgtcacccaaagc

SEQ ID NO: 5983543 - DNA, 24 bp, Homo sapiens
caacttgtcacccaaagcctgtcc

SEQ ID NO: 5983544 - DNA, 13 bp, Homo sapiens
caacttgtcctag

SEQ ID NO: 5983545 - DNA, 19 bp, Homo sapiens
caacttgtctttttctgga

SEQ ID NO: 5983546 - DNA, 22 bp, Homo sapiens
caacttgtctttttctggactg

SEQ ID NO: 5983547 - DNA, 21 bp, Homo sapiens
caacttgtgactttgagacta

SEQ ID NO: 5983548 - DNA, 14 bp, Homo sapiens
caacttgtgttcta

SEQ ID NO: 5983549 - DNA, 13 bp, Homo sapiens
caacttgttgtgg

SEQ ID NO: 5983550 - DNA, 17 bp, Homo sapiens
caacttgttgtggctct

SEQ ID NO: 5983551 - DNA, 15 bp, Homo sapiens
caactttaccataaa

SEQ ID NO: 5983552 - DNA, 22 bp, Homo sapiens
caactttaccataaagccttta

SEQ ID NO: 5983553 - DNA, 12 bp, Homo sapiens
caactttatacc

SEQ ID NO: 5983554 - DNA, 22 bp, Homo sapiens
caactttattttgaatgtacct

SEQ ID NO: 5983555 - DNA, 16 bp, Homo sapiens
caactttccaactttt

SEQ ID NO: 5983556 - DNA, 13 bp, Homo sapiens
caactttcccccc

SEQ ID NO: 5983557 - DNA, 22 bp, Homo sapiens
caactttcccttgccctgggct

SEQ ID NO: 5983558 - DNA, 15 bp, Homo sapiens
caactttctcttgta

SEQ ID NO: 5983559 - DNA, 16 bp, Homo sapiens
caactttctgtaaact

SEQ ID NO: 5983560 - DNA, 11 bp, Homo sapiens
caactttcttc

SEQ ID NO: 5983561 - DNA, 16 bp, Homo sapiens
caactttgaataaaga

SEQ ID NO: 5983562 - DNA, 22 bp, Homo sapiens
caactttgaataaagaatactt

SEQ ID NO: 5983563 - DNA, 12 bp, Homo sapiens
caactttgcaaa

SEQ ID NO: 5983564 - DNA, 18 bp, Homo sapiens
caactttggaatttgaag

SEQ ID NO: 5983565 - DNA, 23 bp, Homo sapiens
caactttgtcgtggttcttaaat

SEQ ID NO: 5983566 - DNA, 17 bp, Homo sapiens
caactttgtgctttcct

SEQ ID NO: 5983567 - DNA, 21 bp, Homo sapiens
caactttgtggatgtcttcct

SEQ ID NO: 5983568 - DNA, 22 bp, Homo sapiens
caactttgtggatgtcttcctt

SEQ ID NO: 5983569 - DNA, 13 bp, Homo sapiens
caacttttaaagc

SEQ ID NO: 5983570 - DNA, 21 bp, Homo sapiens
caacttttaaccaaacaatta

SEQ ID NO: 5983571 - DNA, 21 bp, Homo sapiens
caacttttaatgggatttcat

SEQ ID NO: 5983572 - DNA, 21 bp, Homo sapiens
caacttttaattactgttttc

SEQ ID NO: 5983573 - DNA, 19 bp, Homo sapiens
caacttttcaatgtgattc

SEQ ID NO: 5983574 - DNA, 23 bp, Homo sapiens
caacttttcaatgtgattcttct

SEQ ID NO: 5983575 - DNA, 17 bp, Homo sapiens
caacttttcatttttgc

SEQ ID NO: 5983576 - DNA, 13 bp, Homo sapiens
caacttttctatt

SEQ ID NO: 5983577 - DNA, 19 bp, Homo sapiens
caacttttgaaatttaaaa

SEQ ID NO: 5983578 - DNA, 22 bp, Homo sapiens
caacttttgacaatcaaagaaa

SEQ ID NO: 5983579 - DNA, 23 bp, Homo sapiens
caacttttgactaagaattttgt

SEQ ID NO: 5983580 - DNA, 20 bp, Homo sapiens
caacttttgtgtaatgaaaa

SEQ ID NO: 5983581 - DNA, 20 bp, Homo sapiens
caactttttaaagtaaatta

SEQ ID NO: 5983582 - DNA, 17 bp, Homo sapiens
caactttttattgcctt

SEQ ID NO: 5983583 - DNA, 18 bp, Homo sapiens
caactttttcattccctg

SEQ ID NO: 5983584 - DNA, 12 bp, Homo sapiens
caacttttttat

SEQ ID NO: 5983585 - DNA, 17 bp, Homo sapiens
caagaaaaaaaaatgcc

SEQ ID NO: 5983586 - DNA, 18 bp, Homo sapiens
caagaaaaaaaaatgcca

SEQ ID NO: 5983587 - DNA, 15 bp, Homo sapiens
caagaaaaaaaggga

SEQ ID NO: 5983588 - DNA, 17 bp, Homo sapiens
caagaaaaaagtacaga

SEQ ID NO: 5983589 - DNA, 23 bp, Homo sapiens
caagaaaaagaaaaaaaaagcat

SEQ ID NO: 5983590 - DNA, 15 bp, Homo sapiens
caagaaaacaggcac

SEQ ID NO: 5983591 - DNA, 23 bp, Homo sapiens
caagaaaacaggcactgccctgg

SEQ ID NO: 5983592 - DNA, 12 bp, Homo sapiens
caagaaaacata

SEQ ID NO: 5983593 - DNA, 19 bp, Homo sapiens
caagaaaacctgtttttaa

SEQ ID NO: 5983594 - DNA, 12 bp, Homo sapiens
caagaaaactca

SEQ ID NO: 5983595 - DNA, 20 bp, Homo sapiens
caagaaaactcaaagaatgt

SEQ ID NO: 5983596 - DNA, 14 bp, Homo sapiens
caagaaaactggaa

SEQ ID NO: 5983597 - DNA, 12 bp, Homo sapiens
caagaaaagagt

SEQ ID NO: 5983598 - DNA, 15 bp, Homo sapiens
caagaaaaggacaaa

SEQ ID NO: 5983599 - DNA, 15 bp, Homo sapiens
caagaaaaggcatgg

SEQ ID NO: 5983600 - DNA, 21 bp, Homo sapiens
cacccctggtggctgcaggca

SEQ ID NO: 5983601 - DNA, 22 bp, Homo sapiens
cacccctggtggctgcaggcac

SEQ ID NO: 5983602 - DNA, 23 bp, Homo sapiens
cacccctggtgtccctgcctggc

SEQ ID NO: 5983603 - DNA, 18 bp, Homo sapiens
cacccctggttctcatct

SEQ ID NO: 5983604 - DNA, 12 bp, Homo sapiens
cacccctgtagg

SEQ ID NO: 5983605 - DNA, 23 bp, Homo sapiens
cacccctgtcccacccacacagc

SEQ ID NO: 5983606 - DNA, 18 bp, Homo sapiens
cacccctgtcctcactgc

SEQ ID NO: 5983607 - DNA, 20 bp, Homo sapiens
cacccctgtcctcactgctc

SEQ ID NO: 5983608 - DNA, 21 bp, Homo sapiens
cacccctgtcctcactgctcc

SEQ ID NO: 5983609 - DNA, 13 bp, Homo sapiens
cacccctgtctct

SEQ ID NO: 5983610 - DNA, 13 bp, Homo sapiens
cacccctgtgctc

SEQ ID NO: 5983611 - DNA, 21 bp, Homo sapiens
cacccctgtgctccgtgcctc

SEQ ID NO: 5983612 - DNA, 22 bp, Homo sapiens
cacccctgtgctccgtgcctcc

SEQ ID NO: 5983613 - DNA, 13 bp, Homo sapiens
caccccttaggcc

SEQ ID NO: 5983614 - DNA, 11 bp, Homo sapiens
caccccttcca

SEQ ID NO: 5983615 - DNA, 15 bp, Homo sapiens
caccccttccccact

SEQ ID NO: 5983616 - DNA, 19 bp, Homo sapiens
caccccttccccaggccca

SEQ ID NO: 5983617 - DNA, 23 bp, Homo sapiens
caccccttccctataggaacagc

SEQ ID NO: 5983618 - DNA, 16 bp, Homo sapiens
caccccttcctgggca

SEQ ID NO: 5983619 - DNA, 19 bp, Homo sapiens
caccccttcctgggcacac

SEQ ID NO: 5983620 - DNA, 14 bp, Homo sapiens
caccccttcctgtc

SEQ ID NO: 5983621 - DNA, 16 bp, Homo sapiens
caccccttcctgtccc

SEQ ID NO: 5983622 - DNA, 22 bp, Homo sapiens
caccccttcctgtcccacctct

SEQ ID NO: 5983623 - DNA, 16 bp, Homo sapiens
caccccttcctgtctc

SEQ ID NO: 5983624 - DNA, 23 bp, Homo sapiens
caccccttcctgtctcactcttc

SEQ ID NO: 5983625 - DNA, 22 bp, Homo sapiens
caccccttcgacatgctgccag

SEQ ID NO: 5983626 - DNA, 13 bp, Homo sapiens
caccccttgctct

SEQ ID NO: 5983627 - DNA, 17 bp, Homo sapiens
caccccttggaggagag

SEQ ID NO: 5983628 - DNA, 21 bp, Homo sapiens
caccccttggaggagagagac

SEQ ID NO: 5983629 - DNA, 22 bp, Homo sapiens
caccccttggaggagagagacc

SEQ ID NO: 5983630 - DNA, 21 bp, Homo sapiens
caccccttgtttctgttgttc

SEQ ID NO: 5983631 - DNA, 23 bp, Homo sapiens
caccccttgtttctgttgttccc

SEQ ID NO: 5983632 - DNA, 14 bp, Homo sapiens
cacccgaaatgcca

SEQ ID NO: 5983633 - DNA, 18 bp, Homo sapiens
cacccgaaatgccacgtg

SEQ ID NO: 5983634 - DNA, 17 bp, Homo sapiens
cacccgacctctgactg

SEQ ID NO: 5983635 - DNA, 15 bp, Homo sapiens
cacccgacctggctg

SEQ ID NO: 5983636 - DNA, 12 bp, Homo sapiens
cacccgaggctg

SEQ ID NO: 5983637 - DNA, 16 bp, Homo sapiens
cacccgaggctgccca

SEQ ID NO: 5983638 - DNA, 17 bp, Homo sapiens
cacccgaggctgcccac

SEQ ID NO: 5983639 - DNA, 18 bp, Homo sapiens
cacccgaggctgcccact

SEQ ID NO: 5983640 - DNA, 15 bp, Homo sapiens
cacccgagtacctcc

SEQ ID NO: 5983641 - DNA, 16 bp, Homo sapiens
cacccgagtacctcca

SEQ ID NO: 5983642 - DNA, 19 bp, Homo sapiens
cacccgagttcctctgggt

SEQ ID NO: 5983643 - DNA, 13 bp, Homo sapiens
cacccgatgctgc

SEQ ID NO: 5983644 - DNA, 18 bp, Homo sapiens
cacccgatgctgctttcc

SEQ ID NO: 5983645 - DNA, 15 bp, Homo sapiens
cacccgcatgtacaa

SEQ ID NO: 5983646 - DNA, 19 bp, Homo sapiens
cacccgccagcacaccctt

SEQ ID NO: 5983647 - DNA, 13 bp, Homo sapiens
cacccgcccaccc

SEQ ID NO: 5983648 - DNA, 16 bp, Homo sapiens
cacccgccccagagac

SEQ ID NO: 5983649 - DNA, 18 bp, Homo sapiens
cacccgccccagagactg

SEQ ID NO: 5983650 - DNA, 19 bp, Homo sapiens
cacccgccccagagactgc

SEQ ID NO: 5983651 - DNA, 23 bp, Homo sapiens
cacccgccccagagactgcccac

SEQ ID NO: 5983652 - DNA, 19 bp, Homo sapiens
cacccgccccgccccctcc

SEQ ID NO: 5983653 - DNA, 18 bp, Homo sapiens
cacccgcccctggacttc

SEQ ID NO: 5983654 - DNA, 19 bp, Homo sapiens
cacccgcccgcccccgccc

SEQ ID NO: 5983655 - DNA, 20 bp, Homo sapiens
cacccgccgccactaggtgt

SEQ ID NO: 5983656 - DNA, 15 bp, Homo sapiens
cacccgcctccctct

SEQ ID NO: 5983657 - DNA, 21 bp, Homo sapiens
cacccgccttggcctcccaaa

SEQ ID NO: 5983658 - DNA, 19 bp, Homo sapiens
cacccgctaagagggaggg

SEQ ID NO: 5983659 - DNA, 14 bp, Homo sapiens
cacccgctgcccag

SEQ ID NO: 5983660 - DNA, 16 bp, Homo sapiens
cacccgctgcccagcc

SEQ ID NO: 5983661 - DNA, 17 bp, Homo sapiens
cacccgctgcccagccc

SEQ ID NO: 5983662 - DNA, 22 bp, Homo sapiens
cacccgctgcccagccctccca

SEQ ID NO: 5983663 - DNA, 17 bp, Homo sapiens
cacccgctgcccctccc

SEQ ID NO: 5983664 - DNA, 19 bp, Homo sapiens
cacccgctgcccctccccg

SEQ ID NO: 5983665 - DNA, 17 bp, Homo sapiens
cacccggatctccaggc

SEQ ID NO: 5983666 - DNA, 13 bp, Homo sapiens
cacccggcagccc

SEQ ID NO: 5983667 - DNA, 20 bp, Homo sapiens
cacccggcattctctgccca

SEQ ID NO: 5983668 - DNA, 14 bp, Homo sapiens
cacccggccacagc

SEQ ID NO: 5983669 - DNA, 16 bp, Homo sapiens
cacccggccacagctg

SEQ ID NO: 5983670 - DNA, 19 bp, Homo sapiens
cacccggccacagctgctg

SEQ ID NO: 5983671 - DNA, 13 bp, Homo sapiens
cacccggcccctg

SEQ ID NO: 5983672 - DNA, 17 bp, Homo sapiens
cacccggcccctgctgg

SEQ ID NO: 5983673 - DNA, 14 bp, Homo sapiens
cacccggcccggct

SEQ ID NO: 5983674 - DNA, 23 bp, Homo sapiens
cacccggcccggctgagccctgc

SEQ ID NO: 5983675 - DNA, 12 bp, Homo sapiens
cacccggcctct

SEQ ID NO: 5983676 - DNA, 22 bp, Homo sapiens
cacccggcctggatgccagctg

SEQ ID NO: 5983677 - DNA, 20 bp, Homo sapiens
cacccggctcgtgtatttat

SEQ ID NO: 5983678 - DNA, 13 bp, Homo sapiens
cacccgggctgcc

SEQ ID NO: 5983679 - DNA, 23 bp, Homo sapiens
cacccggggcctggacctatgca

SEQ ID NO: 5983680 - DNA, 22 bp, Homo sapiens
cacccggtcccctctgccccac

SEQ ID NO: 5983681 - DNA, 22 bp, Homo sapiens
cacccggtgacctctagccctg

SEQ ID NO: 5983682 - DNA, 21 bp, Homo sapiens
cacccggttaccttggccgtg

SEQ ID NO: 5983683 - DNA, 22 bp, Homo sapiens
cacccgtccccacacgagggcc

SEQ ID NO: 5983684 - DNA, 20 bp, Homo sapiens
cacccgtcctccctcagcct

SEQ ID NO: 5983685 - DNA, 23 bp, Homo sapiens
cacccgtcctccctcagcctccc

SEQ ID NO: 5983686 - DNA, 17 bp, Homo sapiens
cacccgtcctggggtgg

SEQ ID NO: 5983687 - DNA, 20 bp, Homo sapiens
cacccgtctctctgcccact

SEQ ID NO: 5983688 - DNA, 22 bp, Homo sapiens
cacccgtctgggaatcctggac

SEQ ID NO: 5983689 - DNA, 14 bp, Homo sapiens
cacccgtcttcaat

SEQ ID NO: 5983690 - DNA, 16 bp, Homo sapiens
cacccgttcaccttct

SEQ ID NO: 5983691 - DNA, 20 bp, Homo sapiens
cacccgttctgctggcctgg

SEQ ID NO: 5983692 - DNA, 15 bp, Homo sapiens
cacccgttgagtcct

SEQ ID NO: 5983693 - DNA, 17 bp, Homo sapiens
cacccgtttccaagcct

SEQ ID NO: 5983694 - DNA, 17 bp, Homo sapiens
caccctaaagtctcagg

SEQ ID NO: 5983695 - DNA, 14 bp, Homo sapiens
caccctaactcttg

SEQ ID NO: 5983696 - DNA, 15 bp, Homo sapiens
caccctaactcttgc

SEQ ID NO: 5983697 - DNA, 15 bp, Homo sapiens
caccctaagggcagc

SEQ ID NO: 5983698 - DNA, 22 bp, Homo sapiens
caccctaatttgcccttcagga

SEQ ID NO: 5983699 - DNA, 20 bp, Homo sapiens
caccctacaaacctgtattt

SEQ ID NO: 5983700 - DNA, 14 bp, Homo sapiens
caccctacagcaga

SEQ ID NO: 5983701 - DNA, 15 bp, Homo sapiens
caccctacagcagat

SEQ ID NO: 5983702 - DNA, 16 bp, Homo sapiens
caccctacctgtgcct

SEQ ID NO: 5983703 - DNA, 20 bp, Homo sapiens
caccctaccttccccagact

SEQ ID NO: 5983704 - DNA, 14 bp, Homo sapiens
caccctagcctaga

SEQ ID NO: 5983705 - DNA, 21 bp, Homo sapiens
caccctagctttatattttgt

SEQ ID NO: 5983706 - DNA, 16 bp, Homo sapiens
caccctagtcccttcc

SEQ ID NO: 5983707 - DNA, 21 bp, Homo sapiens
caccctatccctgtacagagt

SEQ ID NO: 5983708 - DNA, 12 bp, Homo sapiens
caccctattttc

SEQ ID NO: 5983709 - DNA, 20 bp, Homo sapiens
caccctcaaatgtcagagct

SEQ ID NO: 5983710 - DNA, 21 bp, Homo sapiens
caccctcaaatgtcagagcta

SEQ ID NO: 5983711 - DNA, 15 bp, Homo sapiens
caccctcacacacac

SEQ ID NO: 5983712 - DNA, 17 bp, Homo sapiens
caccctcacacacacag

SEQ ID NO: 5983713 - DNA, 20 bp, Homo sapiens
caccctcacacacacagctg

SEQ ID NO: 5983714 - DNA, 12 bp, Homo sapiens
caccctcacact

SEQ ID NO: 5983715 - DNA, 21 bp, Homo sapiens
caccctcaccccctcctggca

SEQ ID NO: 5983716 - DNA, 21 bp, Homo sapiens
caccctcactctgccagggca

SEQ ID NO: 5983717 - DNA, 17 bp, Homo sapiens
caccctcagcacccctt

SEQ ID NO: 5983718 - DNA, 15 bp, Homo sapiens
caccctcagctggcg

SEQ ID NO: 5983719 - DNA, 22 bp, Homo sapiens
caccctcagctggcggaacctg

SEQ ID NO: 5983720 - DNA, 22 bp, Homo sapiens
caccctcaggaacccaccctct

SEQ ID NO: 5983721 - DNA, 14 bp, Homo sapiens
caccctcaggcagg

SEQ ID NO: 5983722 - DNA, 14 bp, Homo sapiens
caccctcagggagc

SEQ ID NO: 5983723 - DNA, 13 bp, Homo sapiens
caccctcaggtgc

SEQ ID NO: 5983724 - DNA, 19 bp, Homo sapiens
caccctcataccatctgct

SEQ ID NO: 5983725 - DNA, 22 bp, Homo sapiens
caccctccaaacactgggctct

SEQ ID NO: 5983726 - DNA, 20 bp, Homo sapiens
caccctccacaaagcaaagg

SEQ ID NO: 5983727 - DNA, 22 bp, Homo sapiens
caccctccacaaagcaaaggca

SEQ ID NO: 5983728 - DNA, 11 bp, Homo sapiens
caccctccacc

SEQ ID NO: 5983729 - DNA, 13 bp, Homo sapiens
caccctccaccct

SEQ ID NO: 5983730 - DNA, 17 bp, Homo sapiens
caccctccaccctgtcc

SEQ ID NO: 5983731 - DNA, 13 bp, Homo sapiens
caccctccacctt

SEQ ID NO: 5983732 - DNA, 17 bp, Homo sapiens
caccctccaccttccat

SEQ ID NO: 5983733 - DNA, 15 bp, Homo sapiens
caccctccactctga

SEQ ID NO: 5983734 - DNA, 18 bp, Homo sapiens
caccctccactctgaggt

SEQ ID NO: 5983735 - DNA, 16 bp, Homo sapiens
caccctccagagacaa

SEQ ID NO: 5983736 - DNA, 22 bp, Homo sapiens
caccctccatgctcctcacctg

SEQ ID NO: 5983737 - DNA, 20 bp, Homo sapiens
caccctcccccagacacagc

SEQ ID NO: 5983738 - DNA, 17 bp, Homo sapiens
caccctcccctctcttg

SEQ ID NO: 5983739 - DNA, 23 bp, Homo sapiens
caccctcccctctcttgcacccg

SEQ ID NO: 5983740 - DNA, 21 bp, Homo sapiens
caccctccctagctctgaaat

SEQ ID NO: 5983741 - DNA, 20 bp, Homo sapiens
caccctccctccagggtcct

SEQ ID NO: 5983742 - DNA, 23 bp, Homo sapiens
caccctccctccgatccttcctc

SEQ ID NO: 5983743 - DNA, 14 bp, Homo sapiens
caccctccctgact

SEQ ID NO: 5983744 - DNA, 15 bp, Homo sapiens
caccctccctgactg

SEQ ID NO: 5983745 - DNA, 20 bp, Homo sapiens
caccctccctgactggcctg

SEQ ID NO: 5983746 - DNA, 15 bp, Homo sapiens
caccctccctggagt

SEQ ID NO: 5983747 - DNA, 21 bp, Homo sapiens
caccctcctagcctgctctgc

SEQ ID NO: 5983748 - DNA, 23 bp, Homo sapiens
caccctcctagcctgctctgcca

SEQ ID NO: 5983749 - DNA, 10 bp, Homo sapiens
caccctcctc

SEQ ID NO: 5983750 - DNA, 23 bp, Homo sapiens
caccctcctcacagacctctgct

SEQ ID NO: 5983751 - DNA, 20 bp, Homo sapiens
caccctcctcctcttcacca

SEQ ID NO: 5983752 - DNA, 21 bp, Homo sapiens
caccctcctcctcttcaccag

SEQ ID NO: 5983753 - DNA, 22 bp, Homo sapiens
caccctcctctagccatccctt

SEQ ID NO: 5983754 - DNA, 15 bp, Homo sapiens
caccctcctcttgga

SEQ ID NO: 5983755 - DNA, 18 bp, Homo sapiens
caccctcctcttggaatt

SEQ ID NO: 5983756 - DNA, 14 bp, Homo sapiens
caccctcctgagcc

SEQ ID NO: 5983757 - DNA, 15 bp, Homo sapiens
caccctcctgagcct

SEQ ID NO: 5983758 - DNA, 12 bp, Homo sapiens
caccctcctgcc

SEQ ID NO: 5983759 - DNA, 19 bp, Homo sapiens
caccctcctgccccacact

SEQ ID NO: 5983760 - DNA, 19 bp, Homo sapiens
caccctcctggcctcagac

SEQ ID NO: 5983761 - DNA, 20 bp, Homo sapiens
caccctcctgtcttcccagg

SEQ ID NO: 5983762 - DNA, 23 bp, Homo sapiens
caccctccttcccactcttctca

SEQ ID NO: 5983763 - DNA, 15 bp, Homo sapiens
caccctccttcccgc

SEQ ID NO: 5983764 - DNA, 18 bp, Homo sapiens
caccctccttgagactgg

SEQ ID NO: 5983765 - DNA, 16 bp, Homo sapiens
caccctcgaccacccc

SEQ ID NO: 5983766 - DNA, 14 bp, Homo sapiens
caccctcgctgcca

SEQ ID NO: 5983767 - DNA, 19 bp, Homo sapiens
caccctcgtggacacctgc

SEQ ID NO: 5983768 - DNA, 21 bp, Homo sapiens
caccctcgtggacacctgccc

SEQ ID NO: 5983769 - DNA, 13 bp, Homo sapiens
caccctctccatg

SEQ ID NO: 5983770 - DNA, 15 bp, Homo sapiens
caccctctccatgcc

SEQ ID NO: 5983771 - DNA, 15 bp, Homo sapiens
caccctctgcccagg

SEQ ID NO: 5983772 - DNA, 15 bp, Homo sapiens
caccctctgccccag

SEQ ID NO: 5983773 - DNA, 14 bp, Homo sapiens
caccctctgccgag

SEQ ID NO: 5983774 - DNA, 17 bp, Homo sapiens
caccctctgctgcacag

SEQ ID NO: 5983775 - DNA, 13 bp, Homo sapiens
caccctctggccg

SEQ ID NO: 5983776 - DNA, 13 bp, Homo sapiens
caccctctgggag

SEQ ID NO: 5983777 - DNA, 22 bp, Homo sapiens
caccctctgggcagctgtcatg

SEQ ID NO: 5983778 - DNA, 23 bp, Homo sapiens
caccctctgggggtcctctctga

SEQ ID NO: 5983779 - DNA, 13 bp, Homo sapiens
caccctctggtcc

SEQ ID NO: 5983780 - DNA, 13 bp, Homo sapiens
caccctctgtacc

SEQ ID NO: 5983781 - DNA, 18 bp, Homo sapiens
caccctctgtccccacga

SEQ ID NO: 5983782 - DNA, 13 bp, Homo sapiens
caccctctgtcct

SEQ ID NO: 5983783 - DNA, 14 bp, Homo sapiens
caccctcttcctac

SEQ ID NO: 5983784 - DNA, 21 bp, Homo sapiens
caccctcttcctactggtctc

SEQ ID NO: 5983785 - DNA, 21 bp, Homo sapiens
caccctgaacaaatcttgggt

SEQ ID NO: 5983786 - DNA, 14 bp, Homo sapiens
caccctgactgtgg

SEQ ID NO: 5983787 - DNA, 16 bp, Homo sapiens
caccctgactgtgggg

SEQ ID NO: 5983788 - DNA, 11 bp, Homo sapiens
caccctgagca

SEQ ID NO: 5983789 - DNA, 17 bp, Homo sapiens
caccctgagccccttcc

SEQ ID NO: 5983790 - DNA, 12 bp, Homo sapiens
caccctgagctc

SEQ ID NO: 5983791 - DNA, 17 bp, Homo sapiens
caccctgagctcgggga

SEQ ID NO: 5983792 - DNA, 15 bp, Homo sapiens
caccctgaggagtct

SEQ ID NO: 5983793 - DNA, 16 bp, Homo sapiens
caccctgaggagtctg

SEQ ID NO: 5983794 - DNA, 22 bp, Homo sapiens
caccctgaggagtgatgggcaa

SEQ ID NO: 5983795 - DNA, 17 bp, Homo sapiens
caccctgataggaagag

SEQ ID NO: 5983796 - DNA, 11 bp, Homo sapiens
caccctgcaag

SEQ ID NO: 5983797 - DNA, 17 bp, Homo sapiens
caccctgcaaggcccac

SEQ ID NO: 5983798 - DNA, 23 bp, Homo sapiens
caccctgcaaggcccacaggagg

SEQ ID NO: 5983799 - DNA, 19 bp, Homo sapiens
caccctgcacctcattcca

SEQ ID NO: 5983800 - DNA, 13 bp, Homo sapiens
caccctgcacctg

SEQ ID NO: 5983801 - DNA, 18 bp, Homo sapiens
caccctgcacctgctgcg

SEQ ID NO: 5983802 - DNA, 12 bp, Homo sapiens
caccctgcagag

SEQ ID NO: 5983803 - DNA, 13 bp, Homo sapiens
caccctgcagagc

SEQ ID NO: 5983804 - DNA, 13 bp, Homo sapiens
caccctgcagcca

SEQ ID NO: 5983805 - DNA, 16 bp, Homo sapiens
caccctgcaggcaggc

SEQ ID NO: 5983806 - DNA, 19 bp, Homo sapiens
caccctgcaggcaggcaga

SEQ ID NO: 5983807 - DNA, 19 bp, Homo sapiens
caccctgcattttcctctt

SEQ ID NO: 5983808 - DNA, 12 bp, Homo sapiens
caccctgccaag

SEQ ID NO: 5983809 - DNA, 22 bp, Homo sapiens
caccctgccaccctctgctgca

SEQ ID NO: 5983810 - DNA, 15 bp, Homo sapiens
caccctgcccacccc

SEQ ID NO: 5983811 - DNA, 17 bp, Homo sapiens
caccctgcccacccccg

SEQ ID NO: 5983812 - DNA, 20 bp, Homo sapiens
caccctgcccacccccggga

SEQ ID NO: 5983813 - DNA, 20 bp, Homo sapiens
caccctgccccaccccacct

SEQ ID NO: 5983814 - DNA, 22 bp, Homo sapiens
caccctgccccaccccacctcc

SEQ ID NO: 5983815 - DNA, 21 bp, Homo sapiens
caccctgccccccctaagaga

SEQ ID NO: 5983816 - DNA, 13 bp, Homo sapiens
caccctgccccta

SEQ ID NO: 5983817 - DNA, 17 bp, Homo sapiens
caccctgcccctcagag

SEQ ID NO: 5983818 - DNA, 21 bp, Homo sapiens
caccctgcccctttcttcccc

SEQ ID NO: 5983819 - DNA, 13 bp, Homo sapiens
caccctgcccgct

SEQ ID NO: 5983820 - DNA, 17 bp, Homo sapiens
caccctgccctgctgag

SEQ ID NO: 5983821 - DNA, 19 bp, Homo sapiens
caccctgccctgctgagca

SEQ ID NO: 5983822 - DNA, 14 bp, Homo sapiens
caccctgccctggc

SEQ ID NO: 5983823 - DNA, 17 bp, Homo sapiens
caccctgccctggccta

SEQ ID NO: 5983824 - DNA, 22 bp, Homo sapiens
caccctgcctctacccaaccag

SEQ ID NO: 5983825 - DNA, 12 bp, Homo sapiens
caccctgcctgc

SEQ ID NO: 5983826 - DNA, 13 bp, Homo sapiens
caccctgcctgcc

SEQ ID NO: 5983827 - DNA, 18 bp, Homo sapiens
caccctgcctgctgtgga

SEQ ID NO: 5983828 - DNA, 16 bp, Homo sapiens
caccctgcctgtggag

SEQ ID NO: 5983829 - DNA, 17 bp, Homo sapiens
caccctgcctgtggagg

SEQ ID NO: 5983830 - DNA, 12 bp, Homo sapiens
caccctgcctta

SEQ ID NO: 5983831 - DNA, 18 bp, Homo sapiens
caccctgccttatcttgc

SEQ ID NO: 5983832 - DNA, 16 bp, Homo sapiens
caccctgcgcctccag

SEQ ID NO: 5983833 - DNA, 17 bp, Homo sapiens
caccctgcgcctccaga

SEQ ID NO: 5983834 - DNA, 19 bp, Homo sapiens
caccctgcgcctccagagg

SEQ ID NO: 5983835 - DNA, 20 bp, Homo sapiens
caccctgcgcctccagaggt

SEQ ID NO: 5983836 - DNA, 17 bp, Homo sapiens
caccctgcgggccaggg

SEQ ID NO: 5983837 - DNA, 20 bp, Homo sapiens
caccctgcgggccagggtcc

SEQ ID NO: 5983838 - DNA, 13 bp, Homo sapiens
caccctgctgaga

SEQ ID NO: 5983839 - DNA, 15 bp, Homo sapiens
caccctgctgcacta

SEQ ID NO: 5983840 - DNA, 17 bp, Homo sapiens
caccctgctgctggtgc

SEQ ID NO: 5983841 - DNA, 20 bp, Homo sapiens
caccctgctgctggtgcaca

SEQ ID NO: 5983842 - DNA, 16 bp, Homo sapiens
caccctgcttctcccg

SEQ ID NO: 5983843 - DNA, 14 bp, Homo sapiens
caccctgcttctgc

SEQ ID NO: 5983844 - DNA, 20 bp, Homo sapiens
caccctgcttctgctgcctg

SEQ ID NO: 5983845 - DNA, 18 bp, Homo sapiens
caccctgcttggggcctg

SEQ ID NO: 5983846 - DNA, 22 bp, Homo sapiens
caccctgctttggcggcccggc

SEQ ID NO: 5983847 - DNA, 21 bp, Homo sapiens
caccctggaaccgggaagggt

SEQ ID NO: 5983848 - DNA, 14 bp, Homo sapiens
caccctggagtggc

SEQ ID NO: 5983849 - DNA, 17 bp, Homo sapiens
caccctggagtggcatg

SEQ ID NO: 5983850 - DNA, 15 bp, Homo sapiens
caccctggatttgca

SEQ ID NO: 5983851 - DNA, 15 bp, Homo sapiens
caccctggccccaac

SEQ ID NO: 5983852 - DNA, 16 bp, Homo sapiens
caccctggcccgcccc

SEQ ID NO: 5983853 - DNA, 12 bp, Homo sapiens
caccctggcctg

SEQ ID NO: 5983854 - DNA, 16 bp, Homo sapiens
caccctggcctgaact

SEQ ID NO: 5983855 - DNA, 21 bp, Homo sapiens
caccctggcctgaactgagga

SEQ ID NO: 5983856 - DNA, 17 bp, Homo sapiens
caccctgggagacagac

SEQ ID NO: 5983857 - DNA, 14 bp, Homo sapiens
caccctgggccctg

SEQ ID NO: 5983858 - DNA, 17 bp, Homo sapiens
caccctgggccctgggc

SEQ ID NO: 5983859 - DNA, 22 bp, Homo sapiens
caccctgggccctgggctggaa

SEQ ID NO: 5983860 - DNA, 15 bp, Homo sapiens
caccctgggcctccc

SEQ ID NO: 5983861 - DNA, 15 bp, Homo sapiens
caccctgggctccac

SEQ ID NO: 5983862 - DNA, 22 bp, Homo sapiens
caccctgggctccacacagcag

SEQ ID NO: 5983863 - DNA, 16 bp, Homo sapiens
caccctgggctctgtg

SEQ ID NO: 5983864 - DNA, 17 bp, Homo sapiens
caccctgggctctgtgg

SEQ ID NO: 5983865 - DNA, 21 bp, Homo sapiens
caccctgggctctgtgggctg

SEQ ID NO: 5983866 - DNA, 22 bp, Homo sapiens
caccctgggctctgtgggctgc

SEQ ID NO: 5983867 - DNA, 20 bp, Homo sapiens
caccctggggcctggacctg

SEQ ID NO: 5983868 - DNA, 15 bp, Homo sapiens
caccctggggctgct

SEQ ID NO: 5983869 - DNA, 18 bp, Homo sapiens
caccctgggtgccattcc

SEQ ID NO: 5983870 - DNA, 20 bp, Homo sapiens
caccctgggtttggcccctg

SEQ ID NO: 5983871 - DNA, 17 bp, Homo sapiens
caccctggtcctgactt

SEQ ID NO: 5983872 - DNA, 16 bp, Homo sapiens
caccctgtaatggttg

SEQ ID NO: 5983873 - DNA, 16 bp, Homo sapiens
caccctgtactgttct

SEQ ID NO: 5983874 - DNA, 17 bp, Homo sapiens
caccctgtactgttctg

SEQ ID NO: 5983875 - DNA, 21 bp, Homo sapiens
caccctgtagatgttctagga

SEQ ID NO: 5983876 - DNA, 13 bp, Homo sapiens
caccctgtcaagt

SEQ ID NO: 5983877 - DNA, 20 bp, Homo sapiens
caccctgtccaaactgccta

SEQ ID NO: 5983878 - DNA, 19 bp, Homo sapiens
caccctgtcccccagctct

SEQ ID NO: 5983879 - DNA, 14 bp, Homo sapiens
caccctgtcctgca

SEQ ID NO: 5983880 - DNA, 17 bp, Homo sapiens
caccctgtctaaaaaac

SEQ ID NO: 5983881 - DNA, 16 bp, Homo sapiens
caccctgtctgcaggc

SEQ ID NO: 5983882 - DNA, 14 bp, Homo sapiens
caccctgtctgccc

SEQ ID NO: 5983883 - DNA, 19 bp, Homo sapiens
caccctgtctgccccgccc

SEQ ID NO: 5983884 - DNA, 16 bp, Homo sapiens
caccctgtcttcctct

SEQ ID NO: 5983885 - DNA, 18 bp, Homo sapiens
caccctgtcttcctctgc

SEQ ID NO: 5983886 - DNA, 15 bp, Homo sapiens
caccctgtcttctta

SEQ ID NO: 5983887 - DNA, 11 bp, Homo sapiens
caccctgtgac

SEQ ID NO: 5983888 - DNA, 20 bp, Homo sapiens
caccctgtgatggggccctg

SEQ ID NO: 5983889 - DNA, 21 bp, Homo sapiens
caccctgtgatggggccctgc

SEQ ID NO: 5983890 - DNA, 15 bp, Homo sapiens
caccctgtgcagaag

SEQ ID NO: 5983891 - DNA, 17 bp, Homo sapiens
caccctgtggccctggc

SEQ ID NO: 5983892 - DNA, 20 bp, Homo sapiens
caccctgtggccctggctct

SEQ ID NO: 5983893 - DNA, 11 bp, Homo sapiens
caccctgtggg

SEQ ID NO: 5983894 - DNA, 12 bp, Homo sapiens
caccctgtggga

SEQ ID NO: 5983895 - DNA, 13 bp, Homo sapiens
caccctgtgggac

SEQ ID NO: 5983896 - DNA, 14 bp, Homo sapiens
caccctgtgggacc

SEQ ID NO: 5983897 - DNA, 19 bp, Homo sapiens
caccctgtttggattttta

SEQ ID NO: 5983898 - DNA, 18 bp, Homo sapiens
cacccttaacccaaggag

SEQ ID NO: 5983899 - DNA, 20 bp, Homo sapiens
cacccttaagctgtagagag

SEQ ID NO: 5983900 - DNA, 14 bp, Homo sapiens
cacccttaatcttc

SEQ ID NO: 5983901 - DNA, 20 bp, Homo sapiens
cacccttacttcctggcctc

SEQ ID NO: 5983902 - DNA, 15 bp, Homo sapiens
cacccttagaaaatg

SEQ ID NO: 5983903 - DNA, 19 bp, Homo sapiens
cacccttagcctccagcac

SEQ ID NO: 5983904 - DNA, 19 bp, Homo sapiens
cacccttccatctgattcc

SEQ ID NO: 5983905 - DNA, 10 bp, Homo sapiens
cacccttccc

SEQ ID NO: 5983906 - DNA, 13 bp, Homo sapiens
cacccttccccac

SEQ ID NO: 5983907 - DNA, 14 bp, Homo sapiens
cacccttccccact

SEQ ID NO: 5983908 - DNA, 17 bp, Homo sapiens
cacccttccccactccc

SEQ ID NO: 5983909 - DNA, 20 bp, Homo sapiens
cacccttcccggcccccggc

SEQ ID NO: 5983910 - DNA, 11 bp, Homo sapiens
cacccttccct

SEQ ID NO: 5983911 - DNA, 13 bp, Homo sapiens
cacccttccctct

SEQ ID NO: 5983912 - DNA, 17 bp, Homo sapiens
cacccttccctcttccc

SEQ ID NO: 5983913 - DNA, 21 bp, Homo sapiens
cacccttccctcttccctctc

SEQ ID NO: 5983914 - DNA, 14 bp, Homo sapiens
cacccttccctgtg

SEQ ID NO: 5983915 - DNA, 17 bp, Homo sapiens
cacccttcctggcccag

SEQ ID NO: 5983916 - DNA, 21 bp, Homo sapiens
cacccttcgcagttactggtt

SEQ ID NO: 5983917 - DNA, 23 bp, Homo sapiens
cacccttctcccactctcctagg

SEQ ID NO: 5983918 - DNA, 14 bp, Homo sapiens
cacccttctcccct

SEQ ID NO: 5983919 - DNA, 18 bp, Homo sapiens
cacccttctcccctgccc

SEQ ID NO: 5983920 - DNA, 13 bp, Homo sapiens
cacccttctcgga

SEQ ID NO: 5983921 - DNA, 16 bp, Homo sapiens
cacccttctttcctct

SEQ ID NO: 5983922 - DNA, 15 bp, Homo sapiens
cacccttcttttctc

SEQ ID NO: 5983923 - DNA, 14 bp, Homo sapiens
cacccttgcaccgt

SEQ ID NO: 5983924 - DNA, 23 bp, Homo sapiens
cacccttgcccaccccaccccca

SEQ ID NO: 5983925 - DNA, 14 bp, Homo sapiens
cacccttgcccggc

SEQ ID NO: 5983926 - DNA, 16 bp, Homo sapiens
cacccttggacttgag

SEQ ID NO: 5983927 - DNA, 20 bp, Homo sapiens
cacccttggagctctgagtt

SEQ ID NO: 5983928 - DNA, 21 bp, Homo sapiens
cacccttggaggctgtcttct

SEQ ID NO: 5983929 - DNA, 12 bp, Homo sapiens
cacccttggcct

SEQ ID NO: 5983930 - DNA, 16 bp, Homo sapiens
cacccttggtctcatg

SEQ ID NO: 5983931 - DNA, 16 bp, Homo sapiens
caccctttctgccagg

SEQ ID NO: 5983932 - DNA, 20 bp, Homo sapiens
caccctttgctgtgaggctg

SEQ ID NO: 5983933 - DNA, 22 bp, Homo sapiens
caccctttgctgtgaggctgtc

SEQ ID NO: 5983934 - DNA, 17 bp, Homo sapiens
caccctttggagaccag

SEQ ID NO: 5983935 - DNA, 21 bp, Homo sapiens
cacccttttccagctggatga

SEQ ID NO: 5983936 - DNA, 17 bp, Homo sapiens
caccgaagagccctgag

SEQ ID NO: 5983937 - DNA, 20 bp, Homo sapiens
caccgaagagccctgagctc

SEQ ID NO: 5983938 - DNA, 21 bp, Homo sapiens
caccgaagagccctgagctca

SEQ ID NO: 5983939 - DNA, 23 bp, Homo sapiens
caccgaagtggactggcccctgg

SEQ ID NO: 5983940 - DNA, 15 bp, Homo sapiens
caccgaatgaccagg

SEQ ID NO: 5983941 - DNA, 21 bp, Homo sapiens
caccgacaatctttgattact

SEQ ID NO: 5983942 - DNA, 15 bp, Homo sapiens
caccgaccaactcca

SEQ ID NO: 5983943 - DNA, 18 bp, Homo sapiens
caccgaccaactccagac

SEQ ID NO: 5983944 - DNA, 13 bp, Homo sapiens
caccgaccaactg

SEQ ID NO: 5983945 - DNA, 16 bp, Homo sapiens
caccgaccaactgccc

SEQ ID NO: 5983946 - DNA, 18 bp, Homo sapiens
caccgaccaactgcccta

SEQ ID NO: 5983947 - DNA, 13 bp, Homo sapiens
caccgaccccctt

SEQ ID NO: 5983948 - DNA, 14 bp, Homo sapiens
caccgaccccgggc

SEQ ID NO: 5983949 - DNA, 18 bp, Homo sapiens
caccgacccttcctggcc

SEQ ID NO: 5983950 - DNA, 15 bp, Homo sapiens
caccgactgcccagc

SEQ ID NO: 5983951 - DNA, 16 bp, Homo sapiens
caccgactgcccagcc

SEQ ID NO: 5983952 - DNA, 21 bp, Homo sapiens
caccgacttcaatttcccacc

SEQ ID NO: 5983953 - DNA, 19 bp, Homo sapiens
caccgagacggctggacct

SEQ ID NO: 5983954 - DNA, 14 bp, Homo sapiens
caccgagactcagc

SEQ ID NO: 5983955 - DNA, 21 bp, Homo sapiens
caccgagactcagcctctgct

SEQ ID NO: 5983956 - DNA, 13 bp, Homo sapiens
caccgagcagagg

SEQ ID NO: 5983957 - DNA, 11 bp, Homo sapiens
caccgagccag

SEQ ID NO: 5983958 - DNA, 18 bp, Homo sapiens
caagaaaatcaggtatta

SEQ ID NO: 5983959 - DNA, 16 bp, Homo sapiens
caagaaaatctttgtt

SEQ ID NO: 5983960 - DNA, 19 bp, Homo sapiens
caagaaaatggccagtgag

SEQ ID NO: 5983961 - DNA, 21 bp, Homo sapiens
caagaaacaatgtctggggac

SEQ ID NO: 5983962 - DNA, 16 bp, Homo sapiens
caagaaacactgcctg

SEQ ID NO: 5983963 - DNA, 18 bp, Homo sapiens
caagaaacagaagtagaa

SEQ ID NO: 5983964 - DNA, 12 bp, Homo sapiens
caagaaacagcc

SEQ ID NO: 5983965 - DNA, 14 bp, Homo sapiens
caagaaacagccag

SEQ ID NO: 5983966 - DNA, 15 bp, Homo sapiens
caagaaacagccagc

SEQ ID NO: 5983967 - DNA, 18 bp, Homo sapiens
caagaaacagccagcaag

SEQ ID NO: 5983968 - DNA, 19 bp, Homo sapiens
caagaaacgtgtcacactt

SEQ ID NO: 5983969 - DNA, 22 bp, Homo sapiens
caagaaactagtatctctggcc

SEQ ID NO: 5983970 - DNA, 17 bp, Homo sapiens
caagaaactcaccccca

SEQ ID NO: 5983971 - DNA, 21 bp, Homo sapiens
caagaaactttggaagcactt

SEQ ID NO: 5983972 - DNA, 15 bp, Homo sapiens
caagaaagaaacccg

SEQ ID NO: 5983973 - DNA, 18 bp, Homo sapiens
caagaaagaaatggcttt

SEQ ID NO: 5983974 - DNA, 23 bp, Homo sapiens
caagaaagaaatggcttttctta

SEQ ID NO: 5983975 - DNA, 17 bp, Homo sapiens
caagaaagaattcctgc

SEQ ID NO: 5983976 - DNA, 22 bp, Homo sapiens
caagaaagagggagggaaatct

SEQ ID NO: 5983977 - DNA, 14 bp, Homo sapiens
caagaaagatgtat

SEQ ID NO: 5983978 - DNA, 15 bp, Homo sapiens
caagaaagccagtct

SEQ ID NO: 5983979 - DNA, 17 bp, Homo sapiens
caagaaagctattccaa

SEQ ID NO: 5983980 - DNA, 20 bp, Homo sapiens
caagaaagctcactgtagct

SEQ ID NO: 5983981 - DNA, 16 bp, Homo sapiens
caagaaagctggtaaa

SEQ ID NO: 5983982 - DNA, 14 bp, Homo sapiens
caagaaagcttcct

SEQ ID NO: 5983983 - DNA, 15 bp, Homo sapiens
caagaaaggcagaca

SEQ ID NO: 5983984 - DNA, 16 bp, Homo sapiens
caagaaaggcagacac

SEQ ID NO: 5983985 - DNA, 17 bp, Homo sapiens
caagaaaggcagacaca

SEQ ID NO: 5983986 - DNA, 22 bp, Homo sapiens
caagaaagggccaggagatgga

SEQ ID NO: 5983987 - DNA, 15 bp, Homo sapiens
caagaaaggggaccc

SEQ ID NO: 5983988 - DNA, 19 bp, Homo sapiens
caagaaaggggacccaaga

SEQ ID NO: 5983989 - DNA, 20 bp, Homo sapiens
caagaaataaaaggaagcca

SEQ ID NO: 5983990 - DNA, 23 bp, Homo sapiens
caagaaataaattcacatcctca

SEQ ID NO: 5983991 - DNA, 18 bp, Homo sapiens
caagaaataagtttttgt

SEQ ID NO: 5983992 - DNA, 22 bp, Homo sapiens
caagaaatatactctcccagat

SEQ ID NO: 5983993 - DNA, 14 bp, Homo sapiens
caagaaatccctgt

SEQ ID NO: 5983994 - DNA, 15 bp, Homo sapiens
caagaaatccctgtt

SEQ ID NO: 5983995 - DNA, 15 bp, Homo sapiens
caagaaatgaaagca

SEQ ID NO: 5983996 - DNA, 17 bp, Homo sapiens
caagaaatgaaagcagg

SEQ ID NO: 5983997 - DNA, 18 bp, Homo sapiens
caagaaatgacagtcaaa

SEQ ID NO: 5983998 - DNA, 22 bp, Homo sapiens
caagaaatgacagtcaaaagat

SEQ ID NO: 5983999 - DNA, 17 bp, Homo sapiens
caagaaatgagtctgtt

SEQ ID NO: 5984000 - DNA, 10 bp, Homo sapiens
caagaaatgg

SEQ ID NO: 5984001 - DNA, 14 bp, Homo sapiens
caagaaattttaga

SEQ ID NO: 5984002 - DNA, 14 bp, Homo sapiens
caagaacaacaaca

SEQ ID NO: 5984003 - DNA, 18 bp, Homo sapiens
caagaacacaagaagacc

SEQ ID NO: 5984004 - DNA, 13 bp, Homo sapiens
caagaacagaagt

SEQ ID NO: 5984005 - DNA, 14 bp, Homo sapiens
caagaacagcaggc

SEQ ID NO: 5984006 - DNA, 21 bp, Homo sapiens
caagaacagcaggcccaccta

SEQ ID NO: 5984007 - DNA, 22 bp, Homo sapiens
caagaacaggacatagcacgaa

SEQ ID NO: 5984008 - DNA, 17 bp, Homo sapiens
caagaacatgatgggcc

SEQ ID NO: 5984009 - DNA, 19 bp, Homo sapiens
caagaactcatcactgtgg

SEQ ID NO: 5984010 - DNA, 15 bp, Homo sapiens
caagaactcattatt

SEQ ID NO: 5984011 - DNA, 15 bp, Homo sapiens
caagaactcctgaaa

SEQ ID NO: 5984012 - DNA, 19 bp, Homo sapiens
caagaactctaaccagtgt

SEQ ID NO: 5984013 - DNA, 19 bp, Homo sapiens
caagaactctgcacagcaa

SEQ ID NO: 5984014 - DNA, 20 bp, Homo sapiens
caagaactctgcacagcaac

SEQ ID NO: 5984015 - DNA, 13 bp, Homo sapiens
caagaactctggg

SEQ ID NO: 5984016 - DNA, 13 bp, Homo sapiens
caagaactgcatg

SEQ ID NO: 5984017 - DNA, 19 bp, Homo sapiens
caagaactgcatggaccta

SEQ ID NO: 5984018 - DNA, 12 bp, Homo sapiens
caagaacttgtt

SEQ ID NO: 5984019 - DNA, 14 bp, Homo sapiens
caagaacttgttta

SEQ ID NO: 5984020 - DNA, 15 bp, Homo sapiens
caagaacttgtttaa

SEQ ID NO: 5984021 - DNA, 11 bp, Homo sapiens
caagaagaaag

SEQ ID NO: 5984022 - DNA, 12 bp, Homo sapiens
caagaagaatat

SEQ ID NO: 5984023 - DNA, 17 bp, Homo sapiens
caagaagaatttgaaga

SEQ ID NO: 5984024 - DNA, 23 bp, Homo sapiens
caagaagacggattatctagaga

SEQ ID NO: 5984025 - DNA, 12 bp, Homo sapiens
caagaagatgaa

SEQ ID NO: 5984026 - DNA, 15 bp, Homo sapiens
caagaagattctaaa

SEQ ID NO: 5984027 - DNA, 18 bp, Homo sapiens
caagaagattctaaaaca

SEQ ID NO: 5984028 - DNA, 17 bp, Homo sapiens
caagaagcaaagttcaa

SEQ ID NO: 5984029 - DNA, 19 bp, Homo sapiens
caagaagcaattatttaaa

SEQ ID NO: 5984030 - DNA, 13 bp, Homo sapiens
caagaagcagtgg

SEQ ID NO: 5984031 - DNA, 23 bp, Homo sapiens
caagaagcattttgtaagttgaa

SEQ ID NO: 5984032 - DNA, 13 bp, Homo sapiens
caagaagccctcc

SEQ ID NO: 5984033 - DNA, 14 bp, Homo sapiens
caagaagccctcct

SEQ ID NO: 5984034 - DNA, 19 bp, Homo sapiens
caagaagccctccttgcca

SEQ ID NO: 5984035 - DNA, 20 bp, Homo sapiens
caagaagctgcttctgccca

SEQ ID NO: 5984036 - DNA, 21 bp, Homo sapiens
caagaagctgcttctgcccac

SEQ ID NO: 5984037 - DNA, 20 bp, Homo sapiens
caagaaggaaagatttgtga

SEQ ID NO: 5984038 - DNA, 12 bp, Homo sapiens
caagaaggaaga

SEQ ID NO: 5984039 - DNA, 23 bp, Homo sapiens
caagaaggaagatttgacgttgt

SEQ ID NO: 5984040 - DNA, 19 bp, Homo sapiens
caagaaggcaacttgaaga

SEQ ID NO: 5984041 - DNA, 17 bp, Homo sapiens
caagaaggccagcccac

SEQ ID NO: 5984042 - DNA, 12 bp, Homo sapiens
caagaaggctgg

SEQ ID NO: 5984043 - DNA, 13 bp, Homo sapiens
caagaagggactg

SEQ ID NO: 5984044 - DNA, 19 bp, Homo sapiens
caagaagggctgcatgatg

SEQ ID NO: 5984045 - DNA, 22 bp, Homo sapiens
caagaaggggtgtttattcttc

SEQ ID NO: 5984046 - DNA, 16 bp, Homo sapiens
caagaagtaatcagta

SEQ ID NO: 5984047 - DNA, 20 bp, Homo sapiens
caagaagtagcagtgtctgt

SEQ ID NO: 5984048 - DNA, 20 bp, Homo sapiens
caagaagtatttttttaatt

SEQ ID NO: 5984049 - DNA, 23 bp, Homo sapiens
caagaagtatttttttaatttct

SEQ ID NO: 5984050 - DNA, 16 bp, Homo sapiens
caagaagtgaggcctg

SEQ ID NO: 5984051 - DNA, 14 bp, Homo sapiens
caagaagtgggagt

SEQ ID NO: 5984052 - DNA, 22 bp, Homo sapiens
caagaagtgggagtgggagagg

SEQ ID NO: 5984053 - DNA, 16 bp, Homo sapiens
caagaagttaaaaaac

SEQ ID NO: 5984054 - DNA, 19 bp, Homo sapiens
caagaagttaaaaaacagc

SEQ ID NO: 5984055 - DNA, 18 bp, Homo sapiens
caagaataatcacgcttt

SEQ ID NO: 5984056 - DNA, 23 bp, Homo sapiens
caagaataattcaattttaaaga

SEQ ID NO: 5984057 - DNA, 16 bp, Homo sapiens
caagaataattttgga

SEQ ID NO: 5984058 - DNA, 17 bp, Homo sapiens
caagaatacagaaaatg

SEQ ID NO: 5984059 - DNA, 19 bp, Homo sapiens
caagaatagcatctgtaca

SEQ ID NO: 5984060 - DNA, 23 bp, Homo sapiens
caagaatagcatctgtacaaagg

SEQ ID NO: 5984061 - DNA, 22 bp, Homo sapiens
caagaatagttgtcagaatatg

SEQ ID NO: 5984062 - DNA, 18 bp, Homo sapiens
caagaatatcctttaaaa

SEQ ID NO: 5984063 - DNA, 15 bp, Homo sapiens
caagaatattgcaaa

SEQ ID NO: 5984064 - DNA, 23 bp, Homo sapiens
caagaatattgtatgttaaagca

SEQ ID NO: 5984065 - DNA, 19 bp, Homo sapiens
caagaatccacatttctaa

SEQ ID NO: 5984066 - DNA, 21 bp, Homo sapiens
caagaatccacatttctaaaa

SEQ ID NO: 5984067 - DNA, 14 bp, Homo sapiens
caagaatcctctgg

SEQ ID NO: 5984068 - DNA, 15 bp, Homo sapiens
caagaatcctctggg

SEQ ID NO: 5984069 - DNA, 21 bp, Homo sapiens
caagaatcggcatgtatactt

SEQ ID NO: 5984070 - DNA, 14 bp, Homo sapiens
caagaatctagaag

SEQ ID NO: 5984071 - DNA, 16 bp, Homo sapiens
caagaatctagaagat

SEQ ID NO: 5984072 - DNA, 18 bp, Homo sapiens
caagaatctagaagatgt

SEQ ID NO: 5984073 - DNA, 21 bp, Homo sapiens
caagaatgaaaaatataatgt

SEQ ID NO: 5984074 - DNA, 21 bp, Homo sapiens
caagaatgaaatgaatgattc

SEQ ID NO: 5984075 - DNA, 14 bp, Homo sapiens
caagaatgcattga

SEQ ID NO: 5984076 - DNA, 17 bp, Homo sapiens
caagaatgcattgatat

SEQ ID NO: 5984077 - DNA, 22 bp, Homo sapiens
caagaatgcattgatattgtga

SEQ ID NO: 5984078 - DNA, 14 bp, Homo sapiens
caagaatgctgaaa

SEQ ID NO: 5984079 - DNA, 19 bp, Homo sapiens
caagaatggaattttctga

SEQ ID NO: 5984080 - DNA, 13 bp, Homo sapiens
caagaatggatca

SEQ ID NO: 5984081 - DNA, 21 bp, Homo sapiens
caagaatggatcacaagatgg

SEQ ID NO: 5984082 - DNA, 21 bp, Homo sapiens
caagaatggggatcacagaga

SEQ ID NO: 5984083 - DNA, 13 bp, Homo sapiens
caagaatgtttca

SEQ ID NO: 5984084 - DNA, 15 bp, Homo sapiens
caagaatgtttcagt

SEQ ID NO: 5984085 - DNA, 12 bp, Homo sapiens
caagaattaaaa

SEQ ID NO: 5984086 - DNA, 16 bp, Homo sapiens
caagaattaaaactga

SEQ ID NO: 5984087 - DNA, 22 bp, Homo sapiens
caagaattaaaactgagtccat

SEQ ID NO: 5984088 - DNA, 18 bp, Homo sapiens
caagaattagaagtcttt

SEQ ID NO: 5984089 - DNA, 19 bp, Homo sapiens
caagaattctccaaaacaa

SEQ ID NO: 5984090 - DNA, 18 bp, Homo sapiens
caagaattcttatgctta

SEQ ID NO: 5984091 - DNA, 21 bp, Homo sapiens
caagaattggaagctgccctg

SEQ ID NO: 5984092 - DNA, 23 bp, Homo sapiens
caagaattgttacctgtcatttt

SEQ ID NO: 5984093 - DNA, 12 bp, Homo sapiens
caagaatttctg

SEQ ID NO: 5984094 - DNA, 18 bp, Homo sapiens
caagaatttctggaagaa

SEQ ID NO: 5984095 - DNA, 22 bp, Homo sapiens
caagaatttctggaagaaaggc

SEQ ID NO: 5984096 - DNA, 22 bp, Homo sapiens
caagaatttcttggtaagaagc

SEQ ID NO: 5984097 - DNA, 20 bp, Homo sapiens
caagaatttgacttggaaaa

SEQ ID NO: 5984098 - DNA, 18 bp, Homo sapiens
caagacaaactaaacttt

SEQ ID NO: 5984099 - DNA, 16 bp, Homo sapiens
caagacaacattgtaa

SEQ ID NO: 5984100 - DNA, 12 bp, Homo sapiens
caagacaagacc

SEQ ID NO: 5984101 - DNA, 14 bp, Homo sapiens
caagacaagagctg

SEQ ID NO: 5984102 - DNA, 15 bp, Homo sapiens
caagacaagagctgt

SEQ ID NO: 5984103 - DNA, 16 bp, Homo sapiens
caagacaagagctgtt

SEQ ID NO: 5984104 - DNA, 16 bp, Homo sapiens
caagacaagctcctcc

SEQ ID NO: 5984105 - DNA, 18 bp, Homo sapiens
caagacaagctcctccct

SEQ ID NO: 5984106 - DNA, 18 bp, Homo sapiens
caagacaaggctggcaaa

SEQ ID NO: 5984107 - DNA, 13 bp, Homo sapiens
caagacacagcag

SEQ ID NO: 5984108 - DNA, 12 bp, Homo sapiens
caagacacatcc

SEQ ID NO: 5984109 - DNA, 15 bp, Homo sapiens
caagacacatcccta

SEQ ID NO: 5984110 - DNA, 19 bp, Homo sapiens
caagacacatgctgaggtt

SEQ ID NO: 5984111 - DNA, 12 bp, Homo sapiens
caagacacccag

SEQ ID NO: 5984112 - DNA, 18 bp, Homo sapiens
caagacaccttcccagct

SEQ ID NO: 5984113 - DNA, 19 bp, Homo sapiens
caagacacgtggcctcgtg

SEQ ID NO: 5984114 - DNA, 14 bp, Homo sapiens
caagacacttcccc

SEQ ID NO: 5984115 - DNA, 20 bp, Homo sapiens
caagacacttccccttgtct

SEQ ID NO: 5984116 - DNA, 14 bp, Homo sapiens
caagacagaaaagt

SEQ ID NO: 5984117 - DNA, 17 bp, Homo sapiens
caagacagaaaagtgcc

SEQ ID NO: 5984118 - DNA, 20 bp, Homo sapiens
caagacagaaaagtgcctga

SEQ ID NO: 5984119 - DNA, 22 bp, Homo sapiens
caagacagaaaagtgcctgagc

SEQ ID NO: 5984120 - DNA, 21 bp, Homo sapiens
caagacagagacgcaggaatg

SEQ ID NO: 5984121 - DNA, 22 bp, Homo sapiens
caagacagagacgcaggaatgg

SEQ ID NO: 5984122 - DNA, 19 bp, Homo sapiens
caagacagatgagcaggag

SEQ ID NO: 5984123 - DNA, 21 bp, Homo sapiens
caagacagatgccccagagct

SEQ ID NO: 5984124 - DNA, 13 bp, Homo sapiens
caagacagatttt

SEQ ID NO: 5984125 - DNA, 22 bp, Homo sapiens
caagacagattttcggaacaca

SEQ ID NO: 5984126 - DNA, 20 bp, Homo sapiens
caagacagcagcagcctgca

SEQ ID NO: 5984127 - DNA, 21 bp, Homo sapiens
caagacagcagcagcctgcac

SEQ ID NO: 5984128 - DNA, 22 bp, Homo sapiens
caagacagtgagacagtctgga

SEQ ID NO: 5984129 - DNA, 18 bp, Homo sapiens
caagacagtgctgagatt

SEQ ID NO: 5984130 - DNA, 16 bp, Homo sapiens
caagacagtggcacta

SEQ ID NO: 5984131 - DNA, 22 bp, Homo sapiens
caagacagtggcactaaaatgt

SEQ ID NO: 5984132 - DNA, 14 bp, Homo sapiens
caagacagtggcag

SEQ ID NO: 5984133 - DNA, 19 bp, Homo sapiens
caagacagtggcagcaaag

SEQ ID NO: 5984134 - DNA, 19 bp, Homo sapiens
caagacagtgtcatggtgc

SEQ ID NO: 5984135 - DNA, 18 bp, Homo sapiens
caagacataatttaaaat

SEQ ID NO: 5984136 - DNA, 18 bp, Homo sapiens
caccgagcgggtgcaagc

SEQ ID NO: 5984137 - DNA, 14 bp, Homo sapiens
caccgagctctgtg

SEQ ID NO: 5984138 - DNA, 15 bp, Homo sapiens
caccgagctctgtgg

SEQ ID NO: 5984139 - DNA, 16 bp, Homo sapiens
caccgagctctgtggg

SEQ ID NO: 5984140 - DNA, 20 bp, Homo sapiens
caccgaggagccccagcccc

SEQ ID NO: 5984141 - DNA, 15 bp, Homo sapiens
caccgaggccagcga

SEQ ID NO: 5984142 - DNA, 17 bp, Homo sapiens
caccgagggcgaccccg

SEQ ID NO: 5984143 - DNA, 14 bp, Homo sapiens
caccgaggggcctt

SEQ ID NO: 5984144 - DNA, 19 bp, Homo sapiens
caccgatattagtcctaca

SEQ ID NO: 5984145 - DNA, 17 bp, Homo sapiens
caccgattcttccttgc

SEQ ID NO: 5984146 - DNA, 19 bp, Homo sapiens
caccgcagcgtcccccgcc

SEQ ID NO: 5984147 - DNA, 12 bp, Homo sapiens
caccgcagctgc

SEQ ID NO: 5984148 - DNA, 15 bp, Homo sapiens
caccgcagctgctgc

SEQ ID NO: 5984149 - DNA, 19 bp, Homo sapiens
caccgcagctgctgccact

SEQ ID NO: 5984150 - DNA, 13 bp, Homo sapiens
caccgcaggggac

SEQ ID NO: 5984151 - DNA, 16 bp, Homo sapiens
caccgcagtcaccacc

SEQ ID NO: 5984152 - DNA, 13 bp, Homo sapiens
caccgcagtcgtc

SEQ ID NO: 5984153 - DNA, 15 bp, Homo sapiens
caccgcatatgcatg

SEQ ID NO: 5984154 - DNA, 20 bp, Homo sapiens
caccgcatatgcatgccagg

SEQ ID NO: 5984155 - DNA, 16 bp, Homo sapiens
caccgcatcctcactg

SEQ ID NO: 5984156 - DNA, 19 bp, Homo sapiens
caccgcatcctcactgggc

SEQ ID NO: 5984157 - DNA, 16 bp, Homo sapiens
caccgcatgccccctc

SEQ ID NO: 5984158 - DNA, 22 bp, Homo sapiens
caccgcatgccccctcgtgcca

SEQ ID NO: 5984159 - DNA, 17 bp, Homo sapiens
caccgcattccaggggc

SEQ ID NO: 5984160 - DNA, 18 bp, Homo sapiens
caccgccacactggccgg

SEQ ID NO: 5984161 - DNA, 12 bp, Homo sapiens
caccgccacccc

SEQ ID NO: 5984162 - DNA, 14 bp, Homo sapiens
caccgccaccccac

SEQ ID NO: 5984163 - DNA, 17 bp, Homo sapiens
caccgccagccgccttc

SEQ ID NO: 5984164 - DNA, 16 bp, Homo sapiens
caccgccatcctctgc

SEQ ID NO: 5984165 - DNA, 13 bp, Homo sapiens
caccgccatggct

SEQ ID NO: 5984166 - DNA, 20 bp, Homo sapiens
caccgcccaacccccacctc

SEQ ID NO: 5984167 - DNA, 21 bp, Homo sapiens
caccgcccaacccccacctcc

SEQ ID NO: 5984168 - DNA, 22 bp, Homo sapiens
caccgcccacccacaccccgtc

SEQ ID NO: 5984169 - DNA, 14 bp, Homo sapiens
caccgcccccaccc

SEQ ID NO: 5984170 - DNA, 15 bp, Homo sapiens
caccgcccccacccc

SEQ ID NO: 5984171 - DNA, 16 bp, Homo sapiens
caccgcccccacccct

SEQ ID NO: 5984172 - DNA, 22 bp, Homo sapiens
caccgcccccaccccttcccca

SEQ ID NO: 5984173 - DNA, 15 bp, Homo sapiens
caccgcccctggccg

SEQ ID NO: 5984174 - DNA, 23 bp, Homo sapiens
caccgccctccctccccagctcc

SEQ ID NO: 5984175 - DNA, 14 bp, Homo sapiens
caccgccctcctcg

SEQ ID NO: 5984176 - DNA, 20 bp, Homo sapiens
caccgccctcctcgctgtgc

SEQ ID NO: 5984177 - DNA, 19 bp, Homo sapiens
caccgccgactttgtaccc

SEQ ID NO: 5984178 - DNA, 21 bp, Homo sapiens
caccgccgccaccctgcccct

SEQ ID NO: 5984179 - DNA, 16 bp, Homo sapiens
caccgccggctttcag

SEQ ID NO: 5984180 - DNA, 18 bp, Homo sapiens
caccgccggggtcctggg

SEQ ID NO: 5984181 - DNA, 20 bp, Homo sapiens
caccgccggggtcctgggag

SEQ ID NO: 5984182 - DNA, 21 bp, Homo sapiens
caccgccggggtcctgggagg

SEQ ID NO: 5984183 - DNA, 22 bp, Homo sapiens
caccgccggggtcctgggaggc

SEQ ID NO: 5984184 - DNA, 14 bp, Homo sapiens
caccgccgtcggaa

SEQ ID NO: 5984185 - DNA, 22 bp, Homo sapiens
caccgcctctggccgccacccc

SEQ ID NO: 5984186 - DNA, 17 bp, Homo sapiens
caccgcctgaaggcaca

SEQ ID NO: 5984187 - DNA, 14 bp, Homo sapiens
caccgcctgccccc

SEQ ID NO: 5984188 - DNA, 16 bp, Homo sapiens
caccgcctgcccccag

SEQ ID NO: 5984189 - DNA, 13 bp, Homo sapiens
caccgcctgccct

SEQ ID NO: 5984190 - DNA, 14 bp, Homo sapiens
caccgcctgccctc

SEQ ID NO: 5984191 - DNA, 19 bp, Homo sapiens
caccgcgcccagccaagaa

SEQ ID NO: 5984192 - DNA, 23 bp, Homo sapiens
caccgcgcccctctgcgccccag

SEQ ID NO: 5984193 - DNA, 16 bp, Homo sapiens
caccgcgcctggccca

SEQ ID NO: 5984194 - DNA, 15 bp, Homo sapiens
caccgcggccaggca

SEQ ID NO: 5984195 - DNA, 23 bp, Homo sapiens
caccgcggctggatgggggctct

SEQ ID NO: 5984196 - DNA, 22 bp, Homo sapiens
caccgctccccacagctttgca

SEQ ID NO: 5984197 - DNA, 14 bp, Homo sapiens
caccgctccccagc

SEQ ID NO: 5984198 - DNA, 17 bp, Homo sapiens
caccgctccccagccca

SEQ ID NO: 5984199 - DNA, 18 bp, Homo sapiens
caccgctccccagcccag

SEQ ID NO: 5984200 - DNA, 13 bp, Homo sapiens
caccgctgccagc

SEQ ID NO: 5984201 - DNA, 12 bp, Homo sapiens
caccgctgccta

SEQ ID NO: 5984202 - DNA, 22 bp, Homo sapiens
caccgctgcctaagtggctgct

SEQ ID NO: 5984203 - DNA, 23 bp, Homo sapiens
caccgctgccttttgctgctgct

SEQ ID NO: 5984204 - DNA, 14 bp, Homo sapiens
caccgctggctccg

SEQ ID NO: 5984205 - DNA, 20 bp, Homo sapiens
caccgctgggttctgactct

SEQ ID NO: 5984206 - DNA, 17 bp, Homo sapiens
caccgctggtccctgcc

SEQ ID NO: 5984207 - DNA, 21 bp, Homo sapiens
caccgctggtccctgccctcc

SEQ ID NO: 5984208 - DNA, 22 bp, Homo sapiens
caccgctggtccctgccctccc

SEQ ID NO: 5984209 - DNA, 23 bp, Homo sapiens
caccgctggtccctgccctcccc

SEQ ID NO: 5984210 - DNA, 22 bp, Homo sapiens
caccgcttccggctcctgtgct

SEQ ID NO: 5984211 - DNA, 16 bp, Homo sapiens
caccggaactgggctg

SEQ ID NO: 5984212 - DNA, 20 bp, Homo sapiens
caccggacgctggagaccct

SEQ ID NO: 5984213 - DNA, 16 bp, Homo sapiens
caccggcactcatgac

SEQ ID NO: 5984214 - DNA, 16 bp, Homo sapiens
caccggcatgctggcc

SEQ ID NO: 5984215 - DNA, 20 bp, Homo sapiens
caccggcatgctggcctgtg

SEQ ID NO: 5984216 - DNA, 14 bp, Homo sapiens
caccggcctcggcc

SEQ ID NO: 5984217 - DNA, 19 bp, Homo sapiens
caccggcctgtgggtctct

SEQ ID NO: 5984218 - DNA, 22 bp, Homo sapiens
caccggcctgtgggtctctgaa

SEQ ID NO: 5984219 - DNA, 15 bp, Homo sapiens
caccggcgctgcagg

SEQ ID NO: 5984220 - DNA, 20 bp, Homo sapiens
caccggctcaggagagggcc

SEQ ID NO: 5984221 - DNA, 17 bp, Homo sapiens
caccggctggcctggcc

SEQ ID NO: 5984222 - DNA, 18 bp, Homo sapiens
caccgggacagacctgga

SEQ ID NO: 5984223 - DNA, 15 bp, Homo sapiens
caccgggaccccctc

SEQ ID NO: 5984224 - DNA, 20 bp, Homo sapiens
caccgggaccccctcaccat

SEQ ID NO: 5984225 - DNA, 17 bp, Homo sapiens
caccgggagcctccccc

SEQ ID NO: 5984226 - DNA, 21 bp, Homo sapiens
caccgggagcctccccctcag

SEQ ID NO: 5984227 - DNA, 23 bp, Homo sapiens
caccgggcatgtctgcctggagt

SEQ ID NO: 5984228 - DNA, 24 bp, Homo sapiens
caccgggcatgtctgcctggagtg

SEQ ID NO: 5984229 - DNA, 14 bp, Homo sapiens
caccgggccactcc

SEQ ID NO: 5984230 - DNA, 21 bp, Homo sapiens
caccgggccactccttcctgc

SEQ ID NO: 5984231 - DNA, 15 bp, Homo sapiens
caccgggccctcctt

SEQ ID NO: 5984232 - DNA, 13 bp, Homo sapiens
caccgggcctgga

SEQ ID NO: 5984233 - DNA, 18 bp, Homo sapiens
caccgggcgcatgcctcc

SEQ ID NO: 5984234 - DNA, 21 bp, Homo sapiens
caccgggctgcaggtgctgct

SEQ ID NO: 5984235 - DNA, 20 bp, Homo sapiens
caccggggaacaatttctct

SEQ ID NO: 5984236 - DNA, 20 bp, Homo sapiens
caccggggacaggccgcagc

SEQ ID NO: 5984237 - DNA, 16 bp, Homo sapiens
caccggggcaagaggg

SEQ ID NO: 5984238 - DNA, 20 bp, Homo sapiens
caccggggcactggctgctc

SEQ ID NO: 5984239 - DNA, 14 bp, Homo sapiens
caccggggcctggg

SEQ ID NO: 5984240 - DNA, 22 bp, Homo sapiens
caccggggcctgggcaggaggg

SEQ ID NO: 5984241 - DNA, 14 bp, Homo sapiens
caccgggggagagg

SEQ ID NO: 5984242 - DNA, 14 bp, Homo sapiens
caccgggggtggct

SEQ ID NO: 5984243 - DNA, 18 bp, Homo sapiens
caccgggggtggctctgt

SEQ ID NO: 5984244 - DNA, 17 bp, Homo sapiens
caccggtccagctggcc

SEQ ID NO: 5984245 - DNA, 20 bp, Homo sapiens
caccggtgccaaacccagcc

SEQ ID NO: 5984246 - DNA, 19 bp, Homo sapiens
caccggttgcttctgggaa

SEQ ID NO: 5984247 - DNA, 19 bp, Homo sapiens
caccgtaaagtgagcatgc

SEQ ID NO: 5984248 - DNA, 14 bp, Homo sapiens
caccgtactgtgga

SEQ ID NO: 5984249 - DNA, 18 bp, Homo sapiens
caccgtagggcctgactc

SEQ ID NO: 5984250 - DNA, 19 bp, Homo sapiens
caccgtagggcctgactcc

SEQ ID NO: 5984251 - DNA, 14 bp, Homo sapiens
caccgtattcctct

SEQ ID NO: 5984252 - DNA, 19 bp, Homo sapiens
caccgtcaggtactcctgc

SEQ ID NO: 5984253 - DNA, 21 bp, Homo sapiens
caccgtcattgatggagcctg

SEQ ID NO: 5984254 - DNA, 15 bp, Homo sapiens
caccgtcccagggct

SEQ ID NO: 5984255 - DNA, 16 bp, Homo sapiens
caccgtcccctcccag

SEQ ID NO: 5984256 - DNA, 18 bp, Homo sapiens
caccgtcccgcacagtgg

SEQ ID NO: 5984257 - DNA, 16 bp, Homo sapiens
caccgtcccgccagtg

SEQ ID NO: 5984258 - DNA, 16 bp, Homo sapiens
caccgtccctcagtga

SEQ ID NO: 5984259 - DNA, 17 bp, Homo sapiens
caccgtcgaccaggaaa

SEQ ID NO: 5984260 - DNA, 19 bp, Homo sapiens
caccgtctcggccctgaac

SEQ ID NO: 5984261 - DNA, 13 bp, Homo sapiens
caccgtcttcctt

SEQ ID NO: 5984262 - DNA, 18 bp, Homo sapiens
caccgtgaaccagagggt

SEQ ID NO: 5984263 - DNA, 16 bp, Homo sapiens
caccgtgatggagagg

SEQ ID NO: 5984264 - DNA, 19 bp, Homo sapiens
caccgtgcagagctgcact

SEQ ID NO: 5984265 - DNA, 13 bp, Homo sapiens
caccgtgctgtct

SEQ ID NO: 5984266 - DNA, 16 bp, Homo sapiens
caccgtgctgtcttct

SEQ ID NO: 5984267 - DNA, 16 bp, Homo sapiens
caccgtggaccttcct

SEQ ID NO: 5984268 - DNA, 23 bp, Homo sapiens
caccgtggaccttcctgccacca

SEQ ID NO: 5984269 - DNA, 19 bp, Homo sapiens
caccgtggcagcttgctgg

SEQ ID NO: 5984270 - DNA, 13 bp, Homo sapiens
caccgtggcctgg

SEQ ID NO: 5984271 - DNA, 15 bp, Homo sapiens
caccgtggcctgggc

SEQ ID NO: 5984272 - DNA, 15 bp, Homo sapiens
caccgtgggcaggga

SEQ ID NO: 5984273 - DNA, 20 bp, Homo sapiens
caccgtgggcagtgccaccc

SEQ ID NO: 5984274 - DNA, 21 bp, Homo sapiens
caccgtgggccctcaagcttt

SEQ ID NO: 5984275 - DNA, 13 bp, Homo sapiens
caccgtgggctcc

SEQ ID NO: 5984276 - DNA, 15 bp, Homo sapiens
caccgtggggaaggg

SEQ ID NO: 5984277 - DNA, 15 bp, Homo sapiens
caccgtgtaaaccaa

SEQ ID NO: 5984278 - DNA, 12 bp, Homo sapiens
caccgtgtcctc

SEQ ID NO: 5984279 - DNA, 16 bp, Homo sapiens
caccgtgtcctcctct

SEQ ID NO: 5984280 - DNA, 19 bp, Homo sapiens
caccgtgtcctcctctgag

SEQ ID NO: 5984281 - DNA, 20 bp, Homo sapiens
caccgtgtcctcctctgagg

SEQ ID NO: 5984282 - DNA, 16 bp, Homo sapiens
caccgtgtgcctttcc

SEQ ID NO: 5984283 - DNA, 21 bp, Homo sapiens
caccgttaggattcaggcagc

SEQ ID NO: 5984284 - DNA, 18 bp, Homo sapiens
caccgttcaagcgccaga

SEQ ID NO: 5984285 - DNA, 13 bp, Homo sapiens
caccgttcagtca

SEQ ID NO: 5984286 - DNA, 22 bp, Homo sapiens
caccgttcgtacgcccaggaca

SEQ ID NO: 5984287 - DNA, 14 bp, Homo sapiens
caccgttgtctcat

SEQ ID NO: 5984288 - DNA, 22 bp, Homo sapiens
caccgtttcttcctgccagcag

SEQ ID NO: 5984289 - DNA, 21 bp, Homo sapiens
caccgtttgtcccccggggca

SEQ ID NO: 5984290 - DNA, 22 bp, Homo sapiens
cacctaaaaccagttttgctgc

SEQ ID NO: 5984291 - DNA, 19 bp, Homo sapiens
cacctaaaccctctgtgaa

SEQ ID NO: 5984292 - DNA, 20 bp, Homo sapiens
cacctaaaccctctgtgaaa

SEQ ID NO: 5984293 - DNA, 21 bp, Homo sapiens
cacctaaacttacatttaaaa

SEQ ID NO: 5984294 - DNA, 21 bp, Homo sapiens
cacctaaaggtgtatttaaac

SEQ ID NO: 5984295 - DNA, 17 bp, Homo sapiens
cacctaaccccagggca

SEQ ID NO: 5984296 - DNA, 22 bp, Homo sapiens
cacctaagcaatcactgggccc

SEQ ID NO: 5984297 - DNA, 20 bp, Homo sapiens
cacctaagcacttctagaat

SEQ ID NO: 5984298 - DNA, 22 bp, Homo sapiens
cacctaagcacttctagaatgt

SEQ ID NO: 5984299 - DNA, 19 bp, Homo sapiens
cacctaagggacatgtttt

SEQ ID NO: 5984300 - DNA, 15 bp, Homo sapiens
cacctaagtctctgt

SEQ ID NO: 5984301 - DNA, 12 bp, Homo sapiens
cacctaagtgac

SEQ ID NO: 5984302 - DNA, 20 bp, Homo sapiens
cacctaatccaggcagatcc

SEQ ID NO: 5984303 - DNA, 21 bp, Homo sapiens
cacctaatgtttatgagccag

SEQ ID NO: 5984304 - DNA, 17 bp, Homo sapiens
cacctacaaggagataa

SEQ ID NO: 5984305 - DNA, 21 bp, Homo sapiens
cacctacaaggagataagaaa

SEQ ID NO: 5984306 - DNA, 19 bp, Homo sapiens
cacctacacccctgtgctc

SEQ ID NO: 5984307 - DNA, 15 bp, Homo sapiens
cacctacaggactgg

SEQ ID NO: 5984308 - DNA, 18 bp, Homo sapiens
cacctacaggactgggcc

SEQ ID NO: 5984309 - DNA, 20 bp, Homo sapiens
cacctacagtgtacagtctt

SEQ ID NO: 5984310 - DNA, 17 bp, Homo sapiens
cacctaccaccagggcc

SEQ ID NO: 5984311 - DNA, 13 bp, Homo sapiens
cacctaccatgct

SEQ ID NO: 5984312 - DNA, 15 bp, Homo sapiens
cacctaccatgctgc

SEQ ID NO: 5984313 - DNA, 17 bp, Homo sapiens
cacctaccatgctgctt

SEQ ID NO: 5984314 - DNA, 15 bp, Homo sapiens
caagacatgtctgtt

SEQ ID NO: 5984315 - DNA, 16 bp, Homo sapiens
caagacatgtggaggg

SEQ ID NO: 5984316 - DNA, 15 bp, Homo sapiens
caagacattaaatct

SEQ ID NO: 5984317 - DNA, 16 bp, Homo sapiens
caagacatttctttct

SEQ ID NO: 5984318 - DNA, 19 bp, Homo sapiens
caagaccaccacttcgaaa

SEQ ID NO: 5984319 - DNA, 14 bp, Homo sapiens
caagaccacgtttc

SEQ ID NO: 5984320 - DNA, 16 bp, Homo sapiens
caagaccacgtttcta

SEQ ID NO: 5984321 - DNA, 17 bp, Homo sapiens
caagaccacgtttctaa

SEQ ID NO: 5984322 - DNA, 13 bp, Homo sapiens
caagaccagcctg

SEQ ID NO: 5984323 - DNA, 14 bp, Homo sapiens
caagaccagcctgg

SEQ ID NO: 5984324 - DNA, 16 bp, Homo sapiens
caagaccagcctgtcc

SEQ ID NO: 5984325 - DNA, 18 bp, Homo sapiens
caagaccaggctgcagcc

SEQ ID NO: 5984326 - DNA, 20 bp, Homo sapiens
caagaccatggggtggaagg

SEQ ID NO: 5984327 - DNA, 16 bp, Homo sapiens
caagacccaagtagct

SEQ ID NO: 5984328 - DNA, 13 bp, Homo sapiens
caagacccccagc

SEQ ID NO: 5984329 - DNA, 14 bp, Homo sapiens
caagacccccagca

SEQ ID NO: 5984330 - DNA, 18 bp, Homo sapiens
caagacccccatctctgc

SEQ ID NO: 5984331 - DNA, 20 bp, Homo sapiens
caagacccccatttgtccca

SEQ ID NO: 5984332 - DNA, 16 bp, Homo sapiens
caagacccctgctcct

SEQ ID NO: 5984333 - DNA, 15 bp, Homo sapiens
caagacccctgtctt

SEQ ID NO: 5984334 - DNA, 16 bp, Homo sapiens
caagaccctcccatgg

SEQ ID NO: 5984335 - DNA, 15 bp, Homo sapiens
caagaccctctcagg

SEQ ID NO: 5984336 - DNA, 17 bp, Homo sapiens
caagaccctctcaggct

SEQ ID NO: 5984337 - DNA, 13 bp, Homo sapiens
caagaccctgccc

SEQ ID NO: 5984338 - DNA, 13 bp, Homo sapiens
caagaccctgcct

SEQ ID NO: 5984339 - DNA, 15 bp, Homo sapiens
caagaccctgtctca

SEQ ID NO: 5984340 - DNA, 15 bp, Homo sapiens
caagaccctgtctct

SEQ ID NO: 5984341 - DNA, 15 bp, Homo sapiens
caagaccctgtgttc

SEQ ID NO: 5984342 - DNA, 19 bp, Homo sapiens
caagacccttgtggtccca

SEQ ID NO: 5984343 - DNA, 16 bp, Homo sapiens
caagaccgatcggcgg

SEQ ID NO: 5984344 - DNA, 16 bp, Homo sapiens
caagaccgccccaggg

SEQ ID NO: 5984345 - DNA, 20 bp, Homo sapiens
caagaccgccccagggctat

SEQ ID NO: 5984346 - DNA, 20 bp, Homo sapiens
caagacctagtcccctttcc

SEQ ID NO: 5984347 - DNA, 22 bp, Homo sapiens
caagacctagtcccctttcctc

SEQ ID NO: 5984348 - DNA, 16 bp, Homo sapiens
caagacctcagggcac

SEQ ID NO: 5984349 - DNA, 19 bp, Homo sapiens
caagacctcatctgcctgc

SEQ ID NO: 5984350 - DNA, 20 bp, Homo sapiens
caagacctcatctgtggagc

SEQ ID NO: 5984351 - DNA, 22 bp, Homo sapiens
caagacctcttccctctgggcc

SEQ ID NO: 5984352 - DNA, 13 bp, Homo sapiens
caagacctggtgt

SEQ ID NO: 5984353 - DNA, 14 bp, Homo sapiens
caagacctgttggt

SEQ ID NO: 5984354 - DNA, 14 bp, Homo sapiens
caagaccttctcct

SEQ ID NO: 5984355 - DNA, 17 bp, Homo sapiens
caagaccttctccttca

SEQ ID NO: 5984356 - DNA, 18 bp, Homo sapiens
caagaccttctccttcac

SEQ ID NO: 5984357 - DNA, 23 bp, Homo sapiens
caagaccttctccttcacctttg

SEQ ID NO: 5984358 - DNA, 15 bp, Homo sapiens
caagacgaggggcag

SEQ ID NO: 5984359 - DNA, 22 bp, Homo sapiens
caagacgaggggcagggaagga

SEQ ID NO: 5984360 - DNA, 18 bp, Homo sapiens
caagacgctgtgctgccc

SEQ ID NO: 5984361 - DNA, 20 bp, Homo sapiens
caagacgctgtgctgccctg

SEQ ID NO: 5984362 - DNA, 15 bp, Homo sapiens
caagacggaggaggg

SEQ ID NO: 5984363 - DNA, 18 bp, Homo sapiens
caagacggatccacagta

SEQ ID NO: 5984364 - DNA, 21 bp, Homo sapiens
caagacggggagtgagactcc

SEQ ID NO: 5984365 - DNA, 14 bp, Homo sapiens
caagacgtcctgga

SEQ ID NO: 5984366 - DNA, 22 bp, Homo sapiens
caagacgtcctggaatgaagca

SEQ ID NO: 5984367 - DNA, 14 bp, Homo sapiens
caagactatctaca

SEQ ID NO: 5984368 - DNA, 18 bp, Homo sapiens
caagactatctacaaaaa

SEQ ID NO: 5984369 - DNA, 14 bp, Homo sapiens
caagactccgtctc

SEQ ID NO: 5984370 - DNA, 18 bp, Homo sapiens
caagactcctcaggcagc

SEQ ID NO: 5984371 - DNA, 13 bp, Homo sapiens
caagactcctgca

SEQ ID NO: 5984372 - DNA, 21 bp, Homo sapiens
caagactctagagtccaaggt

SEQ ID NO: 5984373 - DNA, 14 bp, Homo sapiens
caagactctatgct

SEQ ID NO: 5984374 - DNA, 17 bp, Homo sapiens
caagactctatgctctg

SEQ ID NO: 5984375 - DNA, 19 bp, Homo sapiens
caagactctatgctctgga

SEQ ID NO: 5984376 - DNA, 17 bp, Homo sapiens
caagactctgccttaat

SEQ ID NO: 5984377 - DNA, 14 bp, Homo sapiens
caagactctgctct

SEQ ID NO: 5984378 - DNA, 15 bp, Homo sapiens
caagactctgctctc

SEQ ID NO: 5984379 - DNA, 22 bp, Homo sapiens
caagactctgtctaaaaaacaa

SEQ ID NO: 5984380 - DNA, 15 bp, Homo sapiens
caagactctgtctca

SEQ ID NO: 5984381 - DNA, 16 bp, Homo sapiens
caagactctgtctcaa

SEQ ID NO: 5984382 - DNA, 12 bp, Homo sapiens
caagactgaaga

SEQ ID NO: 5984383 - DNA, 18 bp, Homo sapiens
caagactgaagactgcac

SEQ ID NO: 5984384 - DNA, 20 bp, Homo sapiens
caagactgactggcaccaac

SEQ ID NO: 5984385 - DNA, 21 bp, Homo sapiens
caagactgactggcaccaaca

SEQ ID NO: 5984386 - DNA, 16 bp, Homo sapiens
caagactgcaaacttt

SEQ ID NO: 5984387 - DNA, 18 bp, Homo sapiens
caagactgcaaacttttt

SEQ ID NO: 5984388 - DNA, 19 bp, Homo sapiens
caagactgctgtggccagg

SEQ ID NO: 5984389 - DNA, 22 bp, Homo sapiens
caagactggaaggtggggacag

SEQ ID NO: 5984390 - DNA, 13 bp, Homo sapiens
caagactggccca

SEQ ID NO: 5984391 - DNA, 17 bp, Homo sapiens
caagactggcccagtgc

SEQ ID NO: 5984392 - DNA, 18 bp, Homo sapiens
caagactgttgctcaaat

SEQ ID NO: 5984393 - DNA, 22 bp, Homo sapiens
caagactgttgtgatcttgcat

SEQ ID NO: 5984394 - DNA, 19 bp, Homo sapiens
caagacttatggaacaggg

SEQ ID NO: 5984395 - DNA, 21 bp, Homo sapiens
caagacttctctttgcctcaa

SEQ ID NO: 5984396 - DNA, 18 bp, Homo sapiens
caagacttgaaggtgcct

SEQ ID NO: 5984397 - DNA, 17 bp, Homo sapiens
caagacttgacgcagcc

SEQ ID NO: 5984398 - DNA, 19 bp, Homo sapiens
caagacttgacgcagcccc

SEQ ID NO: 5984399 - DNA, 20 bp, Homo sapiens
caagacttggcaacagaagc

SEQ ID NO: 5984400 - DNA, 21 bp, Homo sapiens
caagacttggtgtcctttccc

SEQ ID NO: 5984401 - DNA, 22 bp, Homo sapiens
caagactttagcttttccttcc

SEQ ID NO: 5984402 - DNA, 12 bp, Homo sapiens
caagactttgat

SEQ ID NO: 5984403 - DNA, 19 bp, Homo sapiens
caagactttgatccttgga

SEQ ID NO: 5984404 - DNA, 22 bp, Homo sapiens
caagactttgatccttggaaac

SEQ ID NO: 5984405 - DNA, 20 bp, Homo sapiens
caagagaaaattcctagaaa

SEQ ID NO: 5984406 - DNA, 23 bp, Homo sapiens
caagagaaacaaataaactagtc

SEQ ID NO: 5984407 - DNA, 23 bp, Homo sapiens
caagagaaacattctttcctaaa

SEQ ID NO: 5984408 - DNA, 12 bp, Homo sapiens
caagagaaatga

SEQ ID NO: 5984409 - DNA, 19 bp, Homo sapiens
caagagaactaaagctgga

SEQ ID NO: 5984410 - DNA, 12 bp, Homo sapiens
caagagaagaaa

SEQ ID NO: 5984411 - DNA, 14 bp, Homo sapiens
caagagaagaaaaa

SEQ ID NO: 5984412 - DNA, 18 bp, Homo sapiens
caagagaagaaaaaatta

SEQ ID NO: 5984413 - DNA, 21 bp, Homo sapiens
caagagaagaaagtgaaagca

SEQ ID NO: 5984414 - DNA, 18 bp, Homo sapiens
caagagaagcattctcat

SEQ ID NO: 5984415 - DNA, 19 bp, Homo sapiens
caagagaaggggaagcact

SEQ ID NO: 5984416 - DNA, 22 bp, Homo sapiens
caagagaaggggacttctcttc

SEQ ID NO: 5984417 - DNA, 23 bp, Homo sapiens
caagagaaggtggacctggcagt

SEQ ID NO: 5984418 - DNA, 11 bp, Homo sapiens
caagagaatca

SEQ ID NO: 5984419 - DNA, 22 bp, Homo sapiens
caagagaattgcttgaacccag

SEQ ID NO: 5984420 - DNA, 16 bp, Homo sapiens
caagagacactccccc

SEQ ID NO: 5984421 - DNA, 21 bp, Homo sapiens
caagagacactcccccctcca

SEQ ID NO: 5984422 - DNA, 18 bp, Homo sapiens
caagagacagagccccca

SEQ ID NO: 5984423 - DNA, 13 bp, Homo sapiens
caagagacatgct

SEQ ID NO: 5984424 - DNA, 12 bp, Homo sapiens
caagagactctg

SEQ ID NO: 5984425 - DNA, 12 bp, Homo sapiens
caagagactgag

SEQ ID NO: 5984426 - DNA, 17 bp, Homo sapiens
caagagactgcttgaca

SEQ ID NO: 5984427 - DNA, 16 bp, Homo sapiens
caagagactttgtcac

SEQ ID NO: 5984428 - DNA, 17 bp, Homo sapiens
caagagactttgtcact

SEQ ID NO: 5984429 - DNA, 12 bp, Homo sapiens
caagagagaacc

SEQ ID NO: 5984430 - DNA, 19 bp, Homo sapiens
caagagagaacctaactgt

SEQ ID NO: 5984431 - DNA, 21 bp, Homo sapiens
caagagagaacctaactgtat

SEQ ID NO: 5984432 - DNA, 20 bp, Homo sapiens
caagagagacagcacaggca

SEQ ID NO: 5984433 - DNA, 19 bp, Homo sapiens
caagagagacattgcctcc

SEQ ID NO: 5984434 - DNA, 20 bp, Homo sapiens
caagagagacattgcctcca

SEQ ID NO: 5984435 - DNA, 21 bp, Homo sapiens
caagagagcagcgcccaggcc

SEQ ID NO: 5984436 - DNA, 13 bp, Homo sapiens
caagagaggaagg

SEQ ID NO: 5984437 - DNA, 18 bp, Homo sapiens
caagagaggaaggacccc

SEQ ID NO: 5984438 - DNA, 24 bp, Homo sapiens
caagagagggccatgcaattcatc

SEQ ID NO: 5984439 - DNA, 17 bp, Homo sapiens
caagagatagagaccat

SEQ ID NO: 5984440 - DNA, 12 bp, Homo sapiens
caagagatctac

SEQ ID NO: 5984441 - DNA, 16 bp, Homo sapiens
caagagatctacacat

SEQ ID NO: 5984442 - DNA, 17 bp, Homo sapiens
caagagatctacacatg

SEQ ID NO: 5984443 - DNA, 18 bp, Homo sapiens
caagagatctacacatgt

SEQ ID NO: 5984444 - DNA, 19 bp, Homo sapiens
caagagatctgtgtggctc

SEQ ID NO: 5984445 - DNA, 21 bp, Homo sapiens
caagagatgaacatctgggga

SEQ ID NO: 5984446 - DNA, 16 bp, Homo sapiens
caagagatgggaatga

SEQ ID NO: 5984447 - DNA, 16 bp, Homo sapiens
caagagatgggatgct

SEQ ID NO: 5984448 - DNA, 14 bp, Homo sapiens
caagagattgctaa

SEQ ID NO: 5984449 - DNA, 15 bp, Homo sapiens
caagagattgctaat

SEQ ID NO: 5984450 - DNA, 19 bp, Homo sapiens
caagagattgctaattgct

SEQ ID NO: 5984451 - DNA, 15 bp, Homo sapiens
caagagatttaatta

SEQ ID NO: 5984452 - DNA, 19 bp, Homo sapiens
caagagcaaaactccgtct

SEQ ID NO: 5984453 - DNA, 21 bp, Homo sapiens
caagagcaaaactccgtctca

SEQ ID NO: 5984454 - DNA, 17 bp, Homo sapiens
caagagcaatttacctg

SEQ ID NO: 5984455 - DNA, 22 bp, Homo sapiens
caagagcaatttacctggtact

SEQ ID NO: 5984456 - DNA, 16 bp, Homo sapiens
caagagcacacttggc

SEQ ID NO: 5984457 - DNA, 17 bp, Homo sapiens
caagagcagagtctggg

SEQ ID NO: 5984458 - DNA, 14 bp, Homo sapiens
caagagcagatact

SEQ ID NO: 5984459 - DNA, 14 bp, Homo sapiens
caagagcagcctgt

SEQ ID NO: 5984460 - DNA, 14 bp, Homo sapiens
caagagcaggaggt

SEQ ID NO: 5984461 - DNA, 18 bp, Homo sapiens
caagagcatcatgcctct

SEQ ID NO: 5984462 - DNA, 22 bp, Homo sapiens
caagagcatcatgcctctgagg

SEQ ID NO: 5984463 - DNA, 23 bp, Homo sapiens
caagagcatcatgcctctgaggc

SEQ ID NO: 5984464 - DNA, 21 bp, Homo sapiens
caagagccatgtagaagctgc

SEQ ID NO: 5984465 - DNA, 19 bp, Homo sapiens
caagagcccagcagggcct

SEQ ID NO: 5984466 - DNA, 14 bp, Homo sapiens
caagagcccaggcc

SEQ ID NO: 5984467 - DNA, 17 bp, Homo sapiens
caagagcccaggcctcc

SEQ ID NO: 5984468 - DNA, 12 bp, Homo sapiens
caagagccctgt

SEQ ID NO: 5984469 - DNA, 15 bp, Homo sapiens
caagagcccttccag

SEQ ID NO: 5984470 - DNA, 13 bp, Homo sapiens
caagagcctgaga

SEQ ID NO: 5984471 - DNA, 18 bp, Homo sapiens
caagagcctgagactgga

SEQ ID NO: 5984472 - DNA, 12 bp, Homo sapiens
caagagcctgat

SEQ ID NO: 5984473 - DNA, 20 bp, Homo sapiens
caagagcctgatctcttcct

SEQ ID NO: 5984474 - DNA, 22 bp, Homo sapiens
caagagcctgatctcttcctgt

SEQ ID NO: 5984475 - DNA, 16 bp, Homo sapiens
caagagccttaaaaca

SEQ ID NO: 5984476 - DNA, 22 bp, Homo sapiens
caagagccttggtgtccacctg

SEQ ID NO: 5984477 - DNA, 21 bp, Homo sapiens
caagagcgcaccattgcactc

SEQ ID NO: 5984478 - DNA, 19 bp, Homo sapiens
caagagctacataatttag

SEQ ID NO: 5984479 - DNA, 19 bp, Homo sapiens
caagagctactcccacagc

SEQ ID NO: 5984480 - DNA, 20 bp, Homo sapiens
caagagctactcccacagca

SEQ ID NO: 5984481 - DNA, 21 bp, Homo sapiens
caagagctactcccacagcag

SEQ ID NO: 5984482 - DNA, 15 bp, Homo sapiens
caagagctcaggaga

SEQ ID NO: 5984483 - DNA, 18 bp, Homo sapiens
caagagctgccctccttg

SEQ ID NO: 5984484 - DNA, 15 bp, Homo sapiens
caagagctgttatgc

SEQ ID NO: 5984485 - DNA, 18 bp, Homo sapiens
caagagctgttatgctgt

SEQ ID NO: 5984486 - DNA, 19 bp, Homo sapiens
caagagctgttatgctgtt

SEQ ID NO: 5984487 - DNA, 17 bp, Homo sapiens
caagagcttaacagtgt

SEQ ID NO: 5984488 - DNA, 20 bp, Homo sapiens
caagaggaaaaacagggaaa

SEQ ID NO: 5984489 - DNA, 19 bp, Homo sapiens
caagaggaaaggcgccccc

SEQ ID NO: 5984490 - DNA, 15 bp, Homo sapiens
caagaggaagagaga

SEQ ID NO: 5984491 - DNA, 22 bp, Homo sapiens
caagaggaaggggtgctgtgag

SEQ ID NO: 5984492 - DNA, 19 bp, Homo sapiens
caagaggaagttcagatct

SEQ ID NO: 5984493 - DNA, 13 bp, Homo sapiens
cacctacccagct

SEQ ID NO: 5984494 - DNA, 14 bp, Homo sapiens
cacctacccagctg

SEQ ID NO: 5984495 - DNA, 19 bp, Homo sapiens
cacctacccagctgatggg

SEQ ID NO: 5984496 - DNA, 19 bp, Homo sapiens
cacctaccccccaaaaaaa

SEQ ID NO: 5984497 - DNA, 19 bp, Homo sapiens
cacctaccttcaaagctga

SEQ ID NO: 5984498 - DNA, 17 bp, Homo sapiens
cacctactactcaattg

SEQ ID NO: 5984499 - DNA, 15 bp, Homo sapiens
cacctactctcaggt

SEQ ID NO: 5984500 - DNA, 17 bp, Homo sapiens
cacctactctcaggttt

SEQ ID NO: 5984501 - DNA, 14 bp, Homo sapiens
cacctactgcactt

SEQ ID NO: 5984502 - DNA, 20 bp, Homo sapiens
cacctactgcactttccccc

SEQ ID NO: 5984503 - DNA, 23 bp, Homo sapiens
cacctactgcactttcccccttc

SEQ ID NO: 5984504 - DNA, 22 bp, Homo sapiens
cacctacttttctttcctcaga

SEQ ID NO: 5984505 - DNA, 17 bp, Homo sapiens
cacctagaaacttgtta

SEQ ID NO: 5984506 - DNA, 23 bp, Homo sapiens
cacctagaacactaactcaccag

SEQ ID NO: 5984507 - DNA, 17 bp, Homo sapiens
cacctagagctccagtt

SEQ ID NO: 5984508 - DNA, 22 bp, Homo sapiens
cacctagcaacatatctctgcc

SEQ ID NO: 5984509 - DNA, 15 bp, Homo sapiens
cacctagcagcctca

SEQ ID NO: 5984510 - DNA, 15 bp, Homo sapiens
cacctagccagctgt

SEQ ID NO: 5984511 - DNA, 12 bp, Homo sapiens
cacctagcccag

SEQ ID NO: 5984512 - DNA, 19 bp, Homo sapiens
cacctagctgaatgttttt

SEQ ID NO: 5984513 - DNA, 22 bp, Homo sapiens
cacctagctgaatgtttttcta

SEQ ID NO: 5984514 - DNA, 23 bp, Homo sapiens
cacctagctgaatgtttttctaa

SEQ ID NO: 5984515 - DNA, 16 bp, Homo sapiens
cacctagctttattct

SEQ ID NO: 5984516 - DNA, 17 bp, Homo sapiens
cacctaggaagcctcag

SEQ ID NO: 5984517 - DNA, 18 bp, Homo sapiens
cacctaggaagcctcaga

SEQ ID NO: 5984518 - DNA, 17 bp, Homo sapiens
cacctaggccactcctc

SEQ ID NO: 5984519 - DNA, 18 bp, Homo sapiens
cacctaggccactcctcc

SEQ ID NO: 5984520 - DNA, 17 bp, Homo sapiens
cacctaggctagggtgg

SEQ ID NO: 5984521 - DNA, 19 bp, Homo sapiens
cacctaggctagggtgggg

SEQ ID NO: 5984522 - DNA, 16 bp, Homo sapiens
cacctagtaagtgcct

SEQ ID NO: 5984523 - DNA, 12 bp, Homo sapiens
cacctagtgccc

SEQ ID NO: 5984524 - DNA, 17 bp, Homo sapiens
cacctagtgcttccact

SEQ ID NO: 5984525 - DNA, 17 bp, Homo sapiens
cacctagtggctgtcca

SEQ ID NO: 5984526 - DNA, 21 bp, Homo sapiens
cacctagtggctgtccagtgc

SEQ ID NO: 5984527 - DNA, 23 bp, Homo sapiens
  misc_feature (7)..(7): n is a, c, g or t
  misc_feature (14)..(14): n is a, c, g or t
cacctanccccccnacccccagt

SEQ ID NO: 5984528 - DNA, 16 bp, Homo sapiens
cacctatagtcccagc

SEQ ID NO: 5984529 - DNA, 15 bp, Homo sapiens
cacctatcagagaag

SEQ ID NO: 5984530 - DNA, 19 bp, Homo sapiens
cacctatccaccaccccac

SEQ ID NO: 5984531 - DNA, 14 bp, Homo sapiens
cacctatctttggt

SEQ ID NO: 5984532 - DNA, 20 bp, Homo sapiens
cacctatgagatggccatgc

SEQ ID NO: 5984533 - DNA, 18 bp, Homo sapiens
cacctatgcctgtggtga

SEQ ID NO: 5984534 - DNA, 19 bp, Homo sapiens
cacctatgcctgtggtgaa

SEQ ID NO: 5984535 - DNA, 13 bp, Homo sapiens
cacctatggccca

SEQ ID NO: 5984536 - DNA, 16 bp, Homo sapiens
cacctatggcccagcc

SEQ ID NO: 5984537 - DNA, 20 bp, Homo sapiens
cacctatggcccagccactg

SEQ ID NO: 5984538 - DNA, 21 bp, Homo sapiens
cacctatggcccagccactgc

SEQ ID NO: 5984539 - DNA, 23 bp, Homo sapiens
cacctatggcccagccactgcag

SEQ ID NO: 5984540 - DNA, 23 bp, Homo sapiens
cacctatgtcatttcatttccta

SEQ ID NO: 5984541 - DNA, 15 bp, Homo sapiens
cacctatgtggcatg

SEQ ID NO: 5984542 - DNA, 15 bp, Homo sapiens
cacctattgaattac

SEQ ID NO: 5984543 - DNA, 14 bp, Homo sapiens
cacctatttaatgt

SEQ ID NO: 5984544 - DNA, 14 bp, Homo sapiens
cacctatttcaaaa

SEQ ID NO: 5984545 - DNA, 13 bp, Homo sapiens
cacctatttccat

SEQ ID NO: 5984546 - DNA, 23 bp, Homo sapiens
cacctcaaaataccatgccattt

SEQ ID NO: 5984547 - DNA, 15 bp, Homo sapiens
cacctcaagaccccc

SEQ ID NO: 5984548 - DNA, 16 bp, Homo sapiens
cacctcaaggtcagga

SEQ ID NO: 5984549 - DNA, 17 bp, Homo sapiens
cacctcaagtgcaagga

SEQ ID NO: 5984550 - DNA, 20 bp, Homo sapiens
cacctcaagtgcaaggacca

SEQ ID NO: 5984551 - DNA, 21 bp, Homo sapiens
cacctcaagtgcaaggaccaa

SEQ ID NO: 5984552 - DNA, 18 bp, Homo sapiens
cacctcaatatttactat

SEQ ID NO: 5984553 - DNA, 14 bp, Homo sapiens
cacctcacaactcc

SEQ ID NO: 5984554 - DNA, 14 bp, Homo sapiens
cacctcacactcct

SEQ ID NO: 5984555 - DNA, 17 bp, Homo sapiens
cacctcacactccttta

SEQ ID NO: 5984556 - DNA, 15 bp, Homo sapiens
cacctcaccaaggat

SEQ ID NO: 5984557 - DNA, 11 bp, Homo sapiens
cacctcacccg

SEQ ID NO: 5984558 - DNA, 14 bp, Homo sapiens
cacctcacgctctg

SEQ ID NO: 5984559 - DNA, 18 bp, Homo sapiens
cacctcacgctctggaca

SEQ ID NO: 5984560 - DNA, 15 bp, Homo sapiens
cacctcactagctcc

SEQ ID NO: 5984561 - DNA, 14 bp, Homo sapiens
cacctcactcagca

SEQ ID NO: 5984562 - DNA, 16 bp, Homo sapiens
cacctcactcagcacc

SEQ ID NO: 5984563 - DNA, 14 bp, Homo sapiens
cacctcactgtcat

SEQ ID NO: 5984564 - DNA, 16 bp, Homo sapiens
cacctcactgtcatct

SEQ ID NO: 5984565 - DNA, 18 bp, Homo sapiens
cacctcactgtcatctgc

SEQ ID NO: 5984566 - DNA, 20 bp, Homo sapiens
cacctcactgtcatctgcca

SEQ ID NO: 5984567 - DNA, 11 bp, Homo sapiens
cacctcagagc

SEQ ID NO: 5984568 - DNA, 23 bp, Homo sapiens
cacctcagagcagggccaaagca

SEQ ID NO: 5984569 - DNA, 13 bp, Homo sapiens
cacctcagagccc

SEQ ID NO: 5984570 - DNA, 15 bp, Homo sapiens
cacctcagagccccg

SEQ ID NO: 5984571 - DNA, 12 bp, Homo sapiens
cacctcagatgg

SEQ ID NO: 5984572 - DNA, 18 bp, Homo sapiens
cacctcagatggcagctt

SEQ ID NO: 5984573 - DNA, 21 bp, Homo sapiens
cacctcagatggcagctttta

SEQ ID NO: 5984574 - DNA, 10 bp, Homo sapiens
cacctcagcc

SEQ ID NO: 5984575 - DNA, 16 bp, Homo sapiens
cacctcagccccactg

SEQ ID NO: 5984576 - DNA, 21 bp, Homo sapiens
cacctcagccccactgacacc

SEQ ID NO: 5984577 - DNA, 12 bp, Homo sapiens
cacctcagcctc

SEQ ID NO: 5984578 - DNA, 13 bp, Homo sapiens
cacctcagcctcc

SEQ ID NO: 5984579 - DNA, 23 bp, Homo sapiens
cacctcagcctcccagagtgcta

SEQ ID NO: 5984580 - DNA, 21 bp, Homo sapiens
cacctcagcctggagaggcct

SEQ ID NO: 5984581 - DNA, 17 bp, Homo sapiens
cacctcaggaccccaga

SEQ ID NO: 5984582 - DNA, 19 bp, Homo sapiens
cacctcaggaccccagagg

SEQ ID NO: 5984583 - DNA, 23 bp, Homo sapiens
cacctcaggccaggtgcagtggc

SEQ ID NO: 5984584 - DNA, 12 bp, Homo sapiens
cacctcagggca

SEQ ID NO: 5984585 - DNA, 13 bp, Homo sapiens
cacctcagggcac

SEQ ID NO: 5984586 - DNA, 23 bp, Homo sapiens
cacctcagggcacgcaggaccag

SEQ ID NO: 5984587 - DNA, 13 bp, Homo sapiens
cacctcagggcca

SEQ ID NO: 5984588 - DNA, 14 bp, Homo sapiens
cacctcaggggaga

SEQ ID NO: 5984589 - DNA, 15 bp, Homo sapiens
cacctcaggtgactt

SEQ ID NO: 5984590 - DNA, 11 bp, Homo sapiens
cacctcagttc

SEQ ID NO: 5984591 - DNA, 19 bp, Homo sapiens
cacctcagttcccttggcc

SEQ ID NO: 5984592 - DNA, 21 bp, Homo sapiens
cacctcagttcccttggcctc

SEQ ID NO: 5984593 - DNA, 15 bp, Homo sapiens
cacctcatcactgga

SEQ ID NO: 5984594 - DNA, 21 bp, Homo sapiens
cacctcatccccaaccccctg

SEQ ID NO: 5984595 - DNA, 12 bp, Homo sapiens
cacctcatgccc

SEQ ID NO: 5984596 - DNA, 14 bp, Homo sapiens
cacctcatgcccac

SEQ ID NO: 5984597 - DNA, 18 bp, Homo sapiens
cacctcatgcccaccccc

SEQ ID NO: 5984598 - DNA, 19 bp, Homo sapiens
cacctcatgcccaccccct

SEQ ID NO: 5984599 - DNA, 21 bp, Homo sapiens
cacctcatgcccaccccctgc

SEQ ID NO: 5984600 - DNA, 16 bp, Homo sapiens
cacctcatgctagcct

SEQ ID NO: 5984601 - DNA, 11 bp, Homo sapiens
cacctcatgga

SEQ ID NO: 5984602 - DNA, 14 bp, Homo sapiens
cacctcatggaatt

SEQ ID NO: 5984603 - DNA, 17 bp, Homo sapiens
cacctcattccagtcaa

SEQ ID NO: 5984604 - DNA, 19 bp, Homo sapiens
cacctcattctgaaccctt

SEQ ID NO: 5984605 - DNA, 18 bp, Homo sapiens
cacctccaagcatttcat

SEQ ID NO: 5984606 - DNA, 19 bp, Homo sapiens
cacctccaagcatttcatg

SEQ ID NO: 5984607 - DNA, 14 bp, Homo sapiens
cacctccacccagc

SEQ ID NO: 5984608 - DNA, 15 bp, Homo sapiens
cacctccacccagcc

SEQ ID NO: 5984609 - DNA, 20 bp, Homo sapiens
cacctccacccagcccctgg

SEQ ID NO: 5984610 - DNA, 19 bp, Homo sapiens
cacctccacccccaagaaa

SEQ ID NO: 5984611 - DNA, 19 bp, Homo sapiens
cacctccacccccgccacg

SEQ ID NO: 5984612 - DNA, 23 bp, Homo sapiens
cacctccacccccgccacggcca

SEQ ID NO: 5984613 - DNA, 23 bp, Homo sapiens
cacctccaccgttcaagcgccag

SEQ ID NO: 5984614 - DNA, 15 bp, Homo sapiens
cacctccacctgtga

SEQ ID NO: 5984615 - DNA, 13 bp, Homo sapiens
cacctccacgcca

SEQ ID NO: 5984616 - DNA, 18 bp, Homo sapiens
cacctccacgccactgcc

SEQ ID NO: 5984617 - DNA, 15 bp, Homo sapiens
cacctccactcccac

SEQ ID NO: 5984618 - DNA, 12 bp, Homo sapiens
cacctccagccc

SEQ ID NO: 5984619 - DNA, 23 bp, Homo sapiens
cacctccagcccacagtgctcag

SEQ ID NO: 5984620 - DNA, 13 bp, Homo sapiens
cacctccagcctc

SEQ ID NO: 5984621 - DNA, 11 bp, Homo sapiens
cacctccaggc

SEQ ID NO: 5984622 - DNA, 18 bp, Homo sapiens
cacctccaggcctgttgc

SEQ ID NO: 5984623 - DNA, 12 bp, Homo sapiens
cacctccaggct

SEQ ID NO: 5984624 - DNA, 22 bp, Homo sapiens
cacctccaggttcaagtgattc

SEQ ID NO: 5984625 - DNA, 13 bp, Homo sapiens
cacctccatcccc

SEQ ID NO: 5984626 - DNA, 16 bp, Homo sapiens
cacctccatgtcatcc

SEQ ID NO: 5984627 - DNA, 16 bp, Homo sapiens
cacctcccaaggactt

SEQ ID NO: 5984628 - DNA, 12 bp, Homo sapiens
cacctcccaccc

SEQ ID NO: 5984629 - DNA, 15 bp, Homo sapiens
cacctcccaccccac

SEQ ID NO: 5984630 - DNA, 20 bp, Homo sapiens
cacctcccaccccactccag

SEQ ID NO: 5984631 - DNA, 16 bp, Homo sapiens
cacctcccactcctgc

SEQ ID NO: 5984632 - DNA, 20 bp, Homo sapiens
cacctcccactcctgctgca

SEQ ID NO: 5984633 - DNA, 13 bp, Homo sapiens
cacctcccagggc

SEQ ID NO: 5984634 - DNA, 23 bp, Homo sapiens
cacctcccaggggctccacctgt

SEQ ID NO: 5984635 - DNA, 14 bp, Homo sapiens
cacctcccatttct

SEQ ID NO: 5984636 - DNA, 11 bp, Homo sapiens
cacctccccac

SEQ ID NO: 5984637 - DNA, 18 bp, Homo sapiens
cacctccccacacacagg

SEQ ID NO: 5984638 - DNA, 13 bp, Homo sapiens
cacctccccacgc

SEQ ID NO: 5984639 - DNA, 17 bp, Homo sapiens
cacctccccacgccctc

SEQ ID NO: 5984640 - DNA, 19 bp, Homo sapiens
cacctccccacgccctccc

SEQ ID NO: 5984641 - DNA, 16 bp, Homo sapiens
cacctccccactccag

SEQ ID NO: 5984642 - DNA, 20 bp, Homo sapiens
cacctccccactccagcaga

SEQ ID NO: 5984643 - DNA, 16 bp, Homo sapiens
cacctccccagacagg

SEQ ID NO: 5984644 - DNA, 18 bp, Homo sapiens
cacctccccagacagggc

SEQ ID NO: 5984645 - DNA, 21 bp, Homo sapiens
cacctccccagacagggctcc

SEQ ID NO: 5984646 - DNA, 23 bp, Homo sapiens
cacctccccagacagggctccag

SEQ ID NO: 5984647 - DNA, 16 bp, Homo sapiens
cacctccccagagccc

SEQ ID NO: 5984648 - DNA, 23 bp, Homo sapiens
cacctccccagagccctgcagtc

SEQ ID NO: 5984649 - DNA, 14 bp, Homo sapiens
cacctccccagcat

SEQ ID NO: 5984650 - DNA, 19 bp, Homo sapiens
cacctcccccaaaccctgc

SEQ ID NO: 5984651 - DNA, 17 bp, Homo sapiens
cacctcccccactccca

SEQ ID NO: 5984652 - DNA, 14 bp, Homo sapiens
cacctcccccatct

SEQ ID NO: 5984653 - DNA, 22 bp, Homo sapiens
cacctccccccactgcaggccc

SEQ ID NO: 5984654 - DNA, 15 bp, Homo sapiens
cacctccccctcccc

SEQ ID NO: 5984655 - DNA, 19 bp, Homo sapiens
cacctccccctccccggcc

SEQ ID NO: 5984656 - DNA, 21 bp, Homo sapiens
cacctccccctccccggccac

SEQ ID NO: 5984657 - DNA, 23 bp, Homo sapiens
cacctccccctttcacactggat

SEQ ID NO: 5984658 - DNA, 17 bp, Homo sapiens
cacctccccgctctccc

SEQ ID NO: 5984659 - DNA, 19 bp, Homo sapiens
cacctcccctatccaccca

SEQ ID NO: 5984660 - DNA, 11 bp, Homo sapiens
cacctcccctc

SEQ ID NO: 5984661 - DNA, 16 bp, Homo sapiens
cacctccccttgccag

SEQ ID NO: 5984662 - DNA, 21 bp, Homo sapiens
cacctccctactcccctgggc

SEQ ID NO: 5984663 - DNA, 15 bp, Homo sapiens
cacctccctcaacct

SEQ ID NO: 5984664 - DNA, 21 bp, Homo sapiens
cacctccctcaacctcatcct

SEQ ID NO: 5984665 - DNA, 10 bp, Homo sapiens
cacctccctg

SEQ ID NO: 5984666 - DNA, 21 bp, Homo sapiens
cacctccctgccctgtcctcc

SEQ ID NO: 5984667 - DNA, 13 bp, Homo sapiens
cacctccctgcct

SEQ ID NO: 5984668 - DNA, 14 bp, Homo sapiens
cacctccctgcgcc

SEQ ID NO: 5984669 - DNA, 21 bp, Homo sapiens
cacctccctgcgcccttgagg

SEQ ID NO: 5984670 - DNA, 22 bp, Homo sapiens
cacctcccttcatcccagggta

SEQ ID NO: 5984671 - DNA, 23 bp, Homo sapiens
cacctcccttcatcccagggtat

SEQ ID NO: 5984672 - DNA, 12 bp, Homo sapiens
cacctcccttcc

SEQ ID NO: 5984673 - DNA, 13 bp, Homo sapiens
cacctcccttccc

SEQ ID NO: 5984674 - DNA, 14 bp, Homo sapiens
cacctcccttccca

SEQ ID NO: 5984675 - DNA, 16 bp, Homo sapiens
cacctcccttcccacc

SEQ ID NO: 5984676 - DNA, 18 bp, Homo sapiens
cacctccgagacagtcca

SEQ ID NO: 5984677 - DNA, 21 bp, Homo sapiens
cacctccgagacagtccagtg

SEQ ID NO: 5984678 - DNA, 20 bp, Homo sapiens
cacctccgagaggcagccag

SEQ ID NO: 5984679 - DNA, 16 bp, Homo sapiens
cacctccgccagaccc

SEQ ID NO: 5984680 - DNA, 14 bp, Homo sapiens
cacctccgccccag

SEQ ID NO: 5984681 - DNA, 15 bp, Homo sapiens
cacctccgccccaga

SEQ ID NO: 5984682 - DNA, 21 bp, Homo sapiens
cacctccgctgggaggaacct

SEQ ID NO: 5984683 - DNA, 18 bp, Homo sapiens
cacctccggctgcctagc

SEQ ID NO: 5984684 - DNA, 19 bp, Homo sapiens
cacctccgggttcaagcga

SEQ ID NO: 5984685 - DNA, 12 bp, Homo sapiens
cacctccgtggt

SEQ ID NO: 5984686 - DNA, 19 bp, Homo sapiens
cacctcctaaaaggcccag

SEQ ID NO: 5984687 - DNA, 20 bp, Homo sapiens
cacctcctaaaaggcccaga

SEQ ID NO: 5984688 - DNA, 13 bp, Homo sapiens
cacctcctaccct

SEQ ID NO: 5984689 - DNA, 11 bp, Homo sapiens
cacctcctcca

SEQ ID NO: 5984690 - DNA, 22 bp, Homo sapiens
cacctcctccactcactccagc

SEQ ID NO: 5984691 - DNA, 14 bp, Homo sapiens
cacctcctccccct

SEQ ID NO: 5984692 - DNA, 15 bp, Homo sapiens
cacctcctccgtggg

SEQ ID NO: 5984693 - DNA, 18 bp, Homo sapiens
cacctcctccgtgggcag

SEQ ID NO: 5984694 - DNA, 14 bp, Homo sapiens
cacctcctcctgct

SEQ ID NO: 5984695 - DNA, 19 bp, Homo sapiens
cacctcctcctgctgctca

SEQ ID NO: 5984696 - DNA, 20 bp, Homo sapiens
cacctcctcctgctgctcac

SEQ ID NO: 5984697 - DNA, 18 bp, Homo sapiens
cacctcctctcactcccc

SEQ ID NO: 5984698 - DNA, 14 bp, Homo sapiens
cacctcctctctgc

SEQ ID NO: 5984699 - DNA, 23 bp, Homo sapiens
cacctcctgagaaggcgaggaga

SEQ ID NO: 5984700 - DNA, 12 bp, Homo sapiens
cacctcctgagt

SEQ ID NO: 5984701 - DNA, 16 bp, Homo sapiens
cacctcctgcggctca

SEQ ID NO: 5984702 - DNA, 17 bp, Homo sapiens
cacctcctgcggctcag

SEQ ID NO: 5984703 - DNA, 19 bp, Homo sapiens
cacctcctgcggctcagcc

SEQ ID NO: 5984704 - DNA, 20 bp, Homo sapiens
cacctcctgcggctcagcct

SEQ ID NO: 5984705 - DNA, 13 bp, Homo sapiens
cacctcctgctcc

SEQ ID NO: 5984706 - DNA, 15 bp, Homo sapiens
cacctcctgctgggc

SEQ ID NO: 5984707 - DNA, 13 bp, Homo sapiens
cacctccttcccc

SEQ ID NO: 5984708 - DNA, 15 bp, Homo sapiens
cacctccttccccag

SEQ ID NO: 5984709 - DNA, 17 bp, Homo sapiens
cacctccttccccagct

SEQ ID NO: 5984710 - DNA, 19 bp, Homo sapiens
cacctccttccccagctcc

SEQ ID NO: 5984711 - DNA, 13 bp, Homo sapiens
cacctccttcctc

SEQ ID NO: 5984712 - DNA, 13 bp, Homo sapiens
cacctccttctgc

SEQ ID NO: 5984713 - DNA, 16 bp, Homo sapiens
cacctccttgctttgc

SEQ ID NO: 5984714 - DNA, 18 bp, Homo sapiens
cacctccttgctttgctg

SEQ ID NO: 5984715 - DNA, 14 bp, Homo sapiens
cacctccttttctt

SEQ ID NO: 5984716 - DNA, 15 bp, Homo sapiens
cacctcgaattttgt

SEQ ID NO: 5984717 - DNA, 20 bp, Homo sapiens
cacctcgaattttgttttct

SEQ ID NO: 5984718 - DNA, 15 bp, Homo sapiens
cacctcgagaagtaa

SEQ ID NO: 5984719 - DNA, 21 bp, Homo sapiens
cacctcgcggcgcagcccctg

SEQ ID NO: 5984720 - DNA, 12 bp, Homo sapiens
cacctcgctccc

SEQ ID NO: 5984721 - DNA, 13 bp, Homo sapiens
cacctcgctcccc

SEQ ID NO: 5984722 - DNA, 14 bp, Homo sapiens
cacctcgctgggct

SEQ ID NO: 5984723 - DNA, 17 bp, Homo sapiens
cacctcggagcatggtg

SEQ ID NO: 5984724 - DNA, 16 bp, Homo sapiens
cacctcggcacacact

SEQ ID NO: 5984725 - DNA, 19 bp, Homo sapiens
cacctcggcacacactgtg

SEQ ID NO: 5984726 - DNA, 17 bp, Homo sapiens
cacctcggccctccctg

SEQ ID NO: 5984727 - DNA, 20 bp, Homo sapiens
cacctcggccctccctgcgc

SEQ ID NO: 5984728 - DNA, 21 bp, Homo sapiens
cacctcggccctccctgcgct

SEQ ID NO: 5984729 - DNA, 15 bp, Homo sapiens
cacctcgtctccctg

SEQ ID NO: 5984730 - DNA, 21 bp, Homo sapiens
cacctcgttagggaagagaaa

SEQ ID NO: 5984731 - DNA, 20 bp, Homo sapiens
cacctctaacagcaccaaat

SEQ ID NO: 5984732 - DNA, 20 bp, Homo sapiens
cacctctaatagaggcagtg

SEQ ID NO: 5984733 - DNA, 14 bp, Homo sapiens
cacctctagcctta

SEQ ID NO: 5984734 - DNA, 21 bp, Homo sapiens
cacctctcaatattcaataaa

SEQ ID NO: 5984735 - DNA, 18 bp, Homo sapiens
cacctctcacgggccctg

SEQ ID NO: 5984736 - DNA, 19 bp, Homo sapiens
cacctctcacgggccctgc

SEQ ID NO: 5984737 - DNA, 20 bp, Homo sapiens
cacctctcacgggccctgcc

SEQ ID NO: 5984738 - DNA, 23 bp, Homo sapiens
cacctctcacgggccctgcccca

SEQ ID NO: 5984739 - DNA, 12 bp, Homo sapiens
cacctctccaag

SEQ ID NO: 5984740 - DNA, 16 bp, Homo sapiens
cacctctccaagggct

SEQ ID NO: 5984741 - DNA, 20 bp, Homo sapiens
cacctctccagctcctccca

SEQ ID NO: 5984742 - DNA, 15 bp, Homo sapiens
cacctctccaggtgc

SEQ ID NO: 5984743 - DNA, 21 bp, Homo sapiens
cacctctccaggtgctcattg

SEQ ID NO: 5984744 - DNA, 15 bp, Homo sapiens
cacctctcccagccc

SEQ ID NO: 5984745 - DNA, 23 bp, Homo sapiens
cacctctccctcaacaagggaga

SEQ ID NO: 5984746 - DNA, 14 bp, Homo sapiens
cacctctccctgca

SEQ ID NO: 5984747 - DNA, 17 bp, Homo sapiens
cacctctccctgcatcc

SEQ ID NO: 5984748 - DNA, 23 bp, Homo sapiens
cacctctccctgcatcctgaggc

SEQ ID NO: 5984749 - DNA, 13 bp, Homo sapiens
cacctctcccttg

SEQ ID NO: 5984750 - DNA, 17 bp, Homo sapiens
cacctctcccttggatt

SEQ ID NO: 5984751 - DNA, 16 bp, Homo sapiens
cacctctcctgccctg

SEQ ID NO: 5984752 - DNA, 17 bp, Homo sapiens
cacctctcctgccctgt

SEQ ID NO: 5984753 - DNA, 12 bp, Homo sapiens
cacctctctgtc

SEQ ID NO: 5984754 - DNA, 15 bp, Homo sapiens
cacctctctgtcttt

SEQ ID NO: 5984755 - DNA, 18 bp, Homo sapiens
cacctctctgtctttttc

SEQ ID NO: 5984756 - DNA, 21 bp, Homo sapiens
cacctctctgtctttttcctt

SEQ ID NO: 5984757 - DNA, 20 bp, Homo sapiens
cacctctcttctgcacagct

SEQ ID NO: 5984758 - DNA, 23 bp, Homo sapiens
cacctctcttttcctctctgtct

SEQ ID NO: 5984759 - DNA, 13 bp, Homo sapiens
cacctctgaggac

SEQ ID NO: 5984760 - DNA, 21 bp, Homo sapiens
cacctctgaggacagaggccg

SEQ ID NO: 5984761 - DNA, 19 bp, Homo sapiens
cacctctgcacaagctgca

SEQ ID NO: 5984762 - DNA, 13 bp, Homo sapiens
cacctctgccact

SEQ ID NO: 5984763 - DNA, 15 bp, Homo sapiens
cacctctgccactct

SEQ ID NO: 5984764 - DNA, 12 bp, Homo sapiens
cacctctgccag

SEQ ID NO: 5984765 - DNA, 13 bp, Homo sapiens
cacctctgccaga

SEQ ID NO: 5984766 - DNA, 12 bp, Homo sapiens
cacctctgcccc

SEQ ID NO: 5984767 - DNA, 14 bp, Homo sapiens
cacctctgcccctt

SEQ ID NO: 5984768 - DNA, 15 bp, Homo sapiens
cacctctgccccttg

SEQ ID NO: 5984769 - DNA, 21 bp, Homo sapiens
cacctctgccccttgggcctc

SEQ ID NO: 5984770 - DNA, 22 bp, Homo sapiens
cacctctgccccttgggcctcc

SEQ ID NO: 5984771 - DNA, 15 bp, Homo sapiens
cacctctgcccttcc

SEQ ID NO: 5984772 - DNA, 21 bp, Homo sapiens
cacctctgcccttcccctccc

SEQ ID NO: 5984773 - DNA, 13 bp, Homo sapiens
cacctctgcctca

SEQ ID NO: 5984774 - DNA, 14 bp, Homo sapiens
cacctctgcctcaa

SEQ ID NO: 5984775 - DNA, 16 bp, Homo sapiens
cacctctgctgcccac

SEQ ID NO: 5984776 - DNA, 12 bp, Homo sapiens
cacctctgcttt

SEQ ID NO: 5984777 - DNA, 13 bp, Homo sapiens
cacctctggactg

SEQ ID NO: 5984778 - DNA, 17 bp, Homo sapiens
cacctctggatccctgg

SEQ ID NO: 5984779 - DNA, 13 bp, Homo sapiens
cacctctggccaa

SEQ ID NO: 5984780 - DNA, 13 bp, Homo sapiens
cacctctggccct

SEQ ID NO: 5984781 - DNA, 18 bp, Homo sapiens
cacctctggccctgtgta

SEQ ID NO: 5984782 - DNA, 19 bp, Homo sapiens
cacctctggctagagccga

SEQ ID NO: 5984783 - DNA, 13 bp, Homo sapiens
cacctctggctgt

SEQ ID NO: 5984784 - DNA, 17 bp, Homo sapiens
cacctctggctttgtct

SEQ ID NO: 5984785 - DNA, 19 bp, Homo sapiens
cacctctggctttgtctct

SEQ ID NO: 5984786 - DNA, 16 bp, Homo sapiens
cacctctgggacccca

SEQ ID NO: 5984787 - DNA, 22 bp, Homo sapiens
cacctctgggaccccagctgct

SEQ ID NO: 5984788 - DNA, 20 bp, Homo sapiens
cacctctgggccaggttgga

SEQ ID NO: 5984789 - DNA, 14 bp, Homo sapiens
cacctctgggccct

SEQ ID NO: 5984790 - DNA, 22 bp, Homo sapiens
cacctctgggtccttggctccc

SEQ ID NO: 5984791 - DNA, 18 bp, Homo sapiens
cacctctggtccacacta

SEQ ID NO: 5984792 - DNA, 20 bp, Homo sapiens
cacctctggtccacactaga

SEQ ID NO: 5984793 - DNA, 13 bp, Homo sapiens
cacctctgtacag

SEQ ID NO: 5984794 - DNA, 13 bp, Homo sapiens
cacctctgtgacc

SEQ ID NO: 5984795 - DNA, 22 bp, Homo sapiens
cacctctgtgacccctccttgt

SEQ ID NO: 5984796 - DNA, 23 bp, Homo sapiens
cacctctgtgacccctccttgtc

SEQ ID NO: 5984797 - DNA, 20 bp, Homo sapiens
cacctctgtgacctcaggca

SEQ ID NO: 5984798 - DNA, 20 bp, Homo sapiens
cacctctgtggcattgaaat

SEQ ID NO: 5984799 - DNA, 12 bp, Homo sapiens
cacctctgtggg

SEQ ID NO: 5984800 - DNA, 23 bp, Homo sapiens
cacctctgtgggcactggtgggc

SEQ ID NO: 5984801 - DNA, 21 bp, Homo sapiens
cacctctgttaaggttgaact

SEQ ID NO: 5984802 - DNA, 23 bp, Homo sapiens
cacctctgttaaggttgaacttt

SEQ ID NO: 5984803 - DNA, 18 bp, Homo sapiens
cacctcttatgcacacct

SEQ ID NO: 5984804 - DNA, 12 bp, Homo sapiens
cacctcttccac

SEQ ID NO: 5984805 - DNA, 18 bp, Homo sapiens
cacctcttcccacaagaa

SEQ ID NO: 5984806 - DNA, 12 bp, Homo sapiens
cacctcttcctc

SEQ ID NO: 5984807 - DNA, 14 bp, Homo sapiens
cacctcttcctctg

SEQ ID NO: 5984808 - DNA, 16 bp, Homo sapiens
cacctcttccttccgc

SEQ ID NO: 5984809 - DNA, 18 bp, Homo sapiens
cacctcttctcttcctgt

SEQ ID NO: 5984810 - DNA, 15 bp, Homo sapiens
cacctcttctgccag

SEQ ID NO: 5984811 - DNA, 13 bp, Homo sapiens
cacctcttggctt

SEQ ID NO: 5984812 - DNA, 16 bp, Homo sapiens
cacctcttgtgctgag

SEQ ID NO: 5984813 - DNA, 16 bp, Homo sapiens
cacctctttaaccact

SEQ ID NO: 5984814 - DNA, 17 bp, Homo sapiens
cacctctttaaccactc

SEQ ID NO: 5984815 - DNA, 13 bp, Homo sapiens
cacctcttttcct

SEQ ID NO: 5984816 - DNA, 16 bp, Homo sapiens
cacctgaaaatgtgga

SEQ ID NO: 5984817 - DNA, 13 bp, Homo sapiens
cacctgaaacact

SEQ ID NO: 5984818 - DNA, 15 bp, Homo sapiens
cacctgaaacactgg

SEQ ID NO: 5984819 - DNA, 18 bp, Homo sapiens
cacctgaaacactggacc

SEQ ID NO: 5984820 - DNA, 22 bp, Homo sapiens
cacctgaaacactggacctggg

SEQ ID NO: 5984821 - DNA, 17 bp, Homo sapiens
cacctgaaagcctgtct

SEQ ID NO: 5984822 - DNA, 11 bp, Homo sapiens
cacctgaaatg

SEQ ID NO: 5984823 - DNA, 21 bp, Homo sapiens
cacctgaaattaatttgtgaa

SEQ ID NO: 5984824 - DNA, 17 bp, Homo sapiens
cacctgaaccccagagg

SEQ ID NO: 5984825 - DNA, 19 bp, Homo sapiens
cacctgaaccccagaggca

SEQ ID NO: 5984826 - DNA, 21 bp, Homo sapiens
cacctgaaccccagaggcaga

SEQ ID NO: 5984827 - DNA, 22 bp, Homo sapiens
cacctgaaccccatgggcttgg

SEQ ID NO: 5984828 - DNA, 13 bp, Homo sapiens
cacctgaagggtg

SEQ ID NO: 5984829 - DNA, 14 bp, Homo sapiens
cacctgaagggtgg

SEQ ID NO: 5984830 - DNA, 15 bp, Homo sapiens
cacctgaagggtgga

SEQ ID NO: 5984831 - DNA, 16 bp, Homo sapiens
cacctgaatcagctgg

SEQ ID NO: 5984832 - DNA, 22 bp, Homo sapiens
cacctgaattcgagacaggcag

SEQ ID NO: 5984833 - DNA, 17 bp, Homo sapiens
cacctgaatttgtatat

SEQ ID NO: 5984834 - DNA, 16 bp, Homo sapiens
cacctgacaacttctg

SEQ ID NO: 5984835 - DNA, 23 bp, Homo sapiens
cacctgacactaaccagagtcag

SEQ ID NO: 5984836 - DNA, 17 bp, Homo sapiens
cacctgacctcttgctg

SEQ ID NO: 5984837 - DNA, 22 bp, Homo sapiens
cacctgacctcttgctgccagc

SEQ ID NO: 5984838 - DNA, 17 bp, Homo sapiens
cacctgacgtcagtagt

SEQ ID NO: 5984839 - DNA, 15 bp, Homo sapiens
cacctgactctgaaa

SEQ ID NO: 5984840 - DNA, 20 bp, Homo sapiens
cacctgactctgaaatctga

SEQ ID NO: 5984841 - DNA, 17 bp, Homo sapiens
cacctgagaccctactg

SEQ ID NO: 5984842 - DNA, 16 bp, Homo sapiens
cacctgagcaggacct

SEQ ID NO: 5984843 - DNA, 21 bp, Homo sapiens
cacctgagcaggacctctgaa

SEQ ID NO: 5984844 - DNA, 17 bp, Homo sapiens
cacctgagcgctgtgga

SEQ ID NO: 5984845 - DNA, 18 bp, Homo sapiens
cacctgagcgctgtggac

SEQ ID NO: 5984846 - DNA, 10 bp, Homo sapiens
cacctgagct

SEQ ID NO: 5984847 - DNA, 18 bp, Homo sapiens
cacctgagctttggacac

SEQ ID NO: 5984848 - DNA, 21 bp, Homo sapiens
cacctgaggcccagcagagcc

SEQ ID NO: 5984849 - DNA, 14 bp, Homo sapiens
cacctgaggctcag

SEQ ID NO: 5984850 - DNA, 16 bp, Homo sapiens
cacctgaggctcagcc

SEQ ID NO: 5984851 - DNA, 17 bp, Homo sapiens
cacctgaggctgaggca

SEQ ID NO: 5984852 - DNA, 14 bp, Homo sapiens
cacctgagggggaa

SEQ ID NO: 5984853 - DNA, 18 bp, Homo sapiens
cacctgaggtgggcccag

SEQ ID NO: 5984854 - DNA, 17 bp, Homo sapiens
aaaggtgataaaatcat

SEQ ID NO: 5984855 - DNA, 14 bp, Homo sapiens
aaaggtgattaaat

SEQ ID NO: 5984856 - DNA, 15 bp, Homo sapiens
aaaggtgattgtcac

SEQ ID NO: 5984857 - DNA, 17 bp, Homo sapiens
aaaggtgcactccagac

SEQ ID NO: 5984858 - DNA, 18 bp, Homo sapiens
aaaggtgcactccagact

SEQ ID NO: 5984859 - DNA, 13 bp, Homo sapiens
aaaggtgccatgg

SEQ ID NO: 5984860 - DNA, 21 bp, Homo sapiens
aaaggtgcctgtgaggcaggg

SEQ ID NO: 5984861 - DNA, 11 bp, Homo sapiens
aaaggtgctca

SEQ ID NO: 5984862 - DNA, 21 bp, Homo sapiens
aaaggtgctcaaagatgtact

SEQ ID NO: 5984863 - DNA, 19 bp, Homo sapiens
aaaggtgctgatggccctc

SEQ ID NO: 5984864 - DNA, 19 bp, Homo sapiens
aaaggtggaataaacatta

SEQ ID NO: 5984865 - DNA, 13 bp, Homo sapiens
aaaggtggacttg

SEQ ID NO: 5984866 - DNA, 22 bp, Homo sapiens
aaaggtggagagggagatgtgt

SEQ ID NO: 5984867 - DNA, 19 bp, Homo sapiens
aaaggtggagtttctctgt

SEQ ID NO: 5984868 - DNA, 16 bp, Homo sapiens
aaaggtggcaatgctt

SEQ ID NO: 5984869 - DNA, 21 bp, Homo sapiens
aaaggtggccacaaattcttt

SEQ ID NO: 5984870 - DNA, 12 bp, Homo sapiens
aaaggtggcctg

SEQ ID NO: 5984871 - DNA, 16 bp, Homo sapiens
aaaggtggtaaattca

SEQ ID NO: 5984872 - DNA, 19 bp, Homo sapiens
aaaggtggtaaattcagac

SEQ ID NO: 5984873 - DNA, 17 bp, Homo sapiens
aaaggtggtatgtgtgt

SEQ ID NO: 5984874 - DNA, 22 bp, Homo sapiens
aaaggtggtatgtgtgtgtatg

SEQ ID NO: 5984875 - DNA, 15 bp, Homo sapiens
aaaggtgtaggctgg

SEQ ID NO: 5984876 - DNA, 13 bp, Homo sapiens
aaaggtgtattta

SEQ ID NO: 5984877 - DNA, 17 bp, Homo sapiens
aaaggtgtgagactggg

SEQ ID NO: 5984878 - DNA, 19 bp, Homo sapiens
aaaggtgtgagactgggaa

SEQ ID NO: 5984879 - DNA, 17 bp, Homo sapiens
aaaggtgtgaggagaga

SEQ ID NO: 5984880 - DNA, 13 bp, Homo sapiens
aaaggtgtgctgt

SEQ ID NO: 5984881 - DNA, 14 bp, Homo sapiens
aaaggtgtgtcaaa

SEQ ID NO: 5984882 - DNA, 15 bp, Homo sapiens
aaaggttaagccata

SEQ ID NO: 5984883 - DNA, 19 bp, Homo sapiens
aaaggttaatttttccttc

SEQ ID NO: 5984884 - DNA, 16 bp, Homo sapiens
aaaggttccattcagt

SEQ ID NO: 5984885 - DNA, 15 bp, Homo sapiens
aaaggttcttcatcc

SEQ ID NO: 5984886 - DNA, 21 bp, Homo sapiens
aaaggttcttcatccctttcc

SEQ ID NO: 5984887 - DNA, 19 bp, Homo sapiens
aaaggttcttcttgggagt

SEQ ID NO: 5984888 - DNA, 16 bp, Homo sapiens
aaaggttctttgtgta

SEQ ID NO: 5984889 - DNA, 17 bp, Homo sapiens
aaaggttgaataatata

SEQ ID NO: 5984890 - DNA, 16 bp, Homo sapiens
aaaggttgaattaatt

SEQ ID NO: 5984891 - DNA, 22 bp, Homo sapiens
aaaggttgtgttgcctgctgag

SEQ ID NO: 5984892 - DNA, 19 bp, Homo sapiens
aaaggttgttttgaaactg

SEQ ID NO: 5984893 - DNA, 14 bp, Homo sapiens
aaaggtttaaagtt

SEQ ID NO: 5984894 - DNA, 20 bp, Homo sapiens
aaaggtttaaatgaacaaga

SEQ ID NO: 5984895 - DNA, 22 bp, Homo sapiens
aaaggtttaaatgaacaagaga

SEQ ID NO: 5984896 - DNA, 15 bp, Homo sapiens
aaaggtttacagtga

SEQ ID NO: 5984897 - DNA, 21 bp, Homo sapiens
aaaggtttccactattataga

SEQ ID NO: 5984898 - DNA, 18 bp, Homo sapiens
aaaggtttggaaaactaa

SEQ ID NO: 5984899 - DNA, 17 bp, Homo sapiens
aaaggttttattttgta

SEQ ID NO: 5984900 - DNA, 22 bp, Homo sapiens
aaaggttttctctaacttctca

SEQ ID NO: 5984901 - DNA, 23 bp, Homo sapiens
aaaggttttggatcttgaatgtg

SEQ ID NO: 5984902 - DNA, 17 bp, Homo sapiens
aaaggttttgtattttt

SEQ ID NO: 5984903 - DNA, 23 bp, Homo sapiens
aaaggtttttaaagtaaatctct

SEQ ID NO: 5984904 - DNA, 14 bp, Homo sapiens
aaaggtttttgaaa

SEQ ID NO: 5984905 - DNA, 13 bp, Homo sapiens
aaagtaaaaagaa

SEQ ID NO: 5984906 - DNA, 18 bp, Homo sapiens
aaagtaaaaattgaactg

SEQ ID NO: 5984907 - DNA, 22 bp, Homo sapiens
aaagtaaaacagatttgttcat

SEQ ID NO: 5984908 - DNA, 23 bp, Homo sapiens
aaagtaaaacagatttgttcatt

SEQ ID NO: 5984909 - DNA, 19 bp, Homo sapiens
aaagtaaaagcagcataaa

SEQ ID NO: 5984910 - DNA, 18 bp, Homo sapiens
aaagtaaaagttatatct

SEQ ID NO: 5984911 - DNA, 14 bp, Homo sapiens
aaagtaaaatatgt

SEQ ID NO: 5984912 - DNA, 16 bp, Homo sapiens
aaagtaaaattgaagc

SEQ ID NO: 5984913 - DNA, 14 bp, Homo sapiens
aaagtaaagaggaa

SEQ ID NO: 5984914 - DNA, 17 bp, Homo sapiens
aaagtaaaggcctcctc

SEQ ID NO: 5984915 - DNA, 12 bp, Homo sapiens
aaagtaaataca

SEQ ID NO: 5984916 - DNA, 19 bp, Homo sapiens
aaagtaaatacaagactgt

SEQ ID NO: 5984917 - DNA, 22 bp, Homo sapiens
aaagtaaatacaagactgttgt

SEQ ID NO: 5984918 - DNA, 17 bp, Homo sapiens
aaagtaaatctcttttt

SEQ ID NO: 5984919 - DNA, 16 bp, Homo sapiens
aaagtaaatgctacct

SEQ ID NO: 5984920 - DNA, 15 bp, Homo sapiens
aaagtaaatgggagg

SEQ ID NO: 5984921 - DNA, 19 bp, Homo sapiens
aaagtaaattttacggaaa

SEQ ID NO: 5984922 - DNA, 15 bp, Homo sapiens
aaagtaacaaggtgt

SEQ ID NO: 5984923 - DNA, 14 bp, Homo sapiens
aaagtaacaatcta

SEQ ID NO: 5984924 - DNA, 13 bp, Homo sapiens
aaagtaagacatc

SEQ ID NO: 5984925 - DNA, 19 bp, Homo sapiens
aaagtaagcccttgaagat

SEQ ID NO: 5984926 - DNA, 19 bp, Homo sapiens
aaagtaagtaccactcagg

SEQ ID NO: 5984927 - DNA, 13 bp, Homo sapiens
aaagtaagttaat

SEQ ID NO: 5984928 - DNA, 13 bp, Homo sapiens
aaagtaataaaga

SEQ ID NO: 5984929 - DNA, 19 bp, Homo sapiens
aaagtaataaagagaaata

SEQ ID NO: 5984930 - DNA, 20 bp, Homo sapiens
aaagtaataaagagaaatat

SEQ ID NO: 5984931 - DNA, 15 bp, Homo sapiens
aaagtaatatttatt

SEQ ID NO: 5984932 - DNA, 15 bp, Homo sapiens
aaagtaatcacttaa

SEQ ID NO: 5984933 - DNA, 15 bp, Homo sapiens
aaagtaatctactgt

SEQ ID NO: 5984934 - DNA, 23 bp, Homo sapiens
aaagtaatgatttcttgataatt

SEQ ID NO: 5984935 - DNA, 12 bp, Homo sapiens
aaagtaatttac

SEQ ID NO: 5984936 - DNA, 13 bp, Homo sapiens
aaagtaatttcaa

SEQ ID NO: 5984937 - DNA, 15 bp, Homo sapiens
aaagtaatttcaaga

SEQ ID NO: 5984938 - DNA, 14 bp, Homo sapiens
aaagtaatttcttt

SEQ ID NO: 5984939 - DNA, 16 bp, Homo sapiens
aaagtaattttgtgaa

SEQ ID NO: 5984940 - DNA, 13 bp, Homo sapiens
aaagtaattttta

SEQ ID NO: 5984941 - DNA, 17 bp, Homo sapiens
aaagtacaatgtgtttt

SEQ ID NO: 5984942 - DNA, 15 bp, Homo sapiens
aaagtacactctgct

SEQ ID NO: 5984943 - DNA, 17 bp, Homo sapiens
aaagtacactctgctgt

SEQ ID NO: 5984944 - DNA, 20 bp, Homo sapiens
aaagtacactgtttcaaact

SEQ ID NO: 5984945 - DNA, 14 bp, Homo sapiens
aaagtacagaattt

SEQ ID NO: 5984946 - DNA, 14 bp, Homo sapiens
aaagtacagcctgg

SEQ ID NO: 5984947 - DNA, 16 bp, Homo sapiens
aaagtacaggtacttt

SEQ ID NO: 5984948 - DNA, 22 bp, Homo sapiens
aaagtacaggtactttgtctaa

SEQ ID NO: 5984949 - DNA, 13 bp, Homo sapiens
aaagtacatttaa

SEQ ID NO: 5984950 - DNA, 14 bp, Homo sapiens
aaagtacatttaat

SEQ ID NO: 5984951 - DNA, 15 bp, Homo sapiens
aaagtacatttaata

SEQ ID NO: 5984952 - DNA, 18 bp, Homo sapiens
aaagtacattttttgaaa

SEQ ID NO: 5984953 - DNA, 16 bp, Homo sapiens
aaagtaccctctttta

SEQ ID NO: 5984954 - DNA, 14 bp, Homo sapiens
aaagtactaaaact

SEQ ID NO: 5984955 - DNA, 19 bp, Homo sapiens
aaagtactaatagaacttg

SEQ ID NO: 5984956 - DNA, 14 bp, Homo sapiens
aaagtactagcaat

SEQ ID NO: 5984957 - DNA, 21 bp, Homo sapiens
aaagtactgagcagtgatatt

SEQ ID NO: 5984958 - DNA, 21 bp, Homo sapiens
aaagtacttctccaccctgct

SEQ ID NO: 5984959 - DNA, 15 bp, Homo sapiens
aaagtacttgtagtt

SEQ ID NO: 5984960 - DNA, 18 bp, Homo sapiens
aaagtactttaaaaagga

SEQ ID NO: 5984961 - DNA, 15 bp, Homo sapiens
aaagtactttcttat

SEQ ID NO: 5984962 - DNA, 22 bp, Homo sapiens
aaagtactttcttataaatttg

SEQ ID NO: 5984963 - DNA, 14 bp, Homo sapiens
aaagtagaaaaaaa

SEQ ID NO: 5984964 - DNA, 18 bp, Homo sapiens
aaagtagaagcatgtttg

SEQ ID NO: 5984965 - DNA, 19 bp, Homo sapiens
aaagtagaattatatctaa

SEQ ID NO: 5984966 - DNA, 13 bp, Homo sapiens
aaagtagacttgg

SEQ ID NO: 5984967 - DNA, 15 bp, Homo sapiens
aaagtagagaacagt

SEQ ID NO: 5984968 - DNA, 11 bp, Homo sapiens
aaagtagaggt

SEQ ID NO: 5984969 - DNA, 23 bp, Homo sapiens
aaagtagattaaaatatttgcct

SEQ ID NO: 5984970 - DNA, 19 bp, Homo sapiens
aaagtagattcatgaaaat

SEQ ID NO: 5984971 - DNA, 16 bp, Homo sapiens
aaagtagcaccaaata

SEQ ID NO: 5984972 - DNA, 13 bp, Homo sapiens
aaagtagcaggac

SEQ ID NO: 5984973 - DNA, 22 bp, Homo sapiens
aaagtagcagtcatcatctttt

SEQ ID NO: 5984974 - DNA, 13 bp, Homo sapiens
aaagtagctgcta

SEQ ID NO: 5984975 - DNA, 13 bp, Homo sapiens
aaagtaggaaaga

SEQ ID NO: 5984976 - DNA, 13 bp, Homo sapiens
aaagtaggctgcc

SEQ ID NO: 5984977 - DNA, 16 bp, Homo sapiens
aaagtaggtatacaaa

SEQ ID NO: 5984978 - DNA, 21 bp, Homo sapiens
aaagtagtaaaaattaaaaaa

SEQ ID NO: 5984979 - DNA, 19 bp, Homo sapiens
aaagtagtcctggcagctg

SEQ ID NO: 5984980 - DNA, 15 bp, Homo sapiens
aaagtagttatttta

SEQ ID NO: 5984981 - DNA, 15 bp, Homo sapiens
aaagtagttgattca

SEQ ID NO: 5984982 - DNA, 22 bp, Homo sapiens
aaagtagttggctagtactttg

SEQ ID NO: 5984983 - DNA, 22 bp, Homo sapiens
aaagtagttttattttaataca

SEQ ID NO: 5984984 - DNA, 20 bp, Homo sapiens
aaagtataaattcgctgtga

SEQ ID NO: 5984985 - DNA, 18 bp, Homo sapiens
aaagtataaatttgtgta

SEQ ID NO: 5984986 - DNA, 13 bp, Homo sapiens
aaagtatatatag

SEQ ID NO: 5984987 - DNA, 15 bp, Homo sapiens
aaagtatatattcta

SEQ ID NO: 5984988 - DNA, 23 bp, Homo sapiens
aaagtatattcaaaaattatatt

SEQ ID NO: 5984989 - DNA, 15 bp, Homo sapiens
aaagtatattttcct

SEQ ID NO: 5984990 - DNA, 22 bp, Homo sapiens
aaagtatcactctaaaaaacat

SEQ ID NO: 5984991 - DNA, 17 bp, Homo sapiens
aaagtatcacttttctg

SEQ ID NO: 5984992 - DNA, 16 bp, Homo sapiens
aaagtatcatgcattc

SEQ ID NO: 5984993 - DNA, 14 bp, Homo sapiens
aaagtatcatggaa

SEQ ID NO: 5984994 - DNA, 22 bp, Homo sapiens
aaagtatcatggaaatattatg

SEQ ID NO: 5984995 - DNA, 21 bp, Homo sapiens
aaagtatccctactgtaattt

SEQ ID NO: 5984996 - DNA, 21 bp, Homo sapiens
aaagtatcctgcttctgatat

SEQ ID NO: 5984997 - DNA, 20 bp, Homo sapiens
aaagtatcgggggctggggc

SEQ ID NO: 5984998 - DNA, 19 bp, Homo sapiens
aaagtatgcattattaaat

SEQ ID NO: 5984999 - DNA, 21 bp, Homo sapiens
aaagtatgccttcctgtttaa

SEQ ID NO: 5985000 - DNA, 19 bp, Homo sapiens
aaagtatgtattatttaca

SEQ ID NO: 5985001 - DNA, 14 bp, Homo sapiens
aaagtatgtgatat

SEQ ID NO: 5985002 - DNA, 17 bp, Homo sapiens
aaagtatgttagtgcaa

SEQ ID NO: 5985003 - DNA, 19 bp, Homo sapiens
aaagtatgttctaaccttt

SEQ ID NO: 5985004 - DNA, 12 bp, Homo sapiens
aaagtatgtttt

SEQ ID NO: 5985005 - DNA, 16 bp, Homo sapiens
aaagtatgtttttaca

SEQ ID NO: 5985006 - DNA, 18 bp, Homo sapiens
aaagtatgtttttacatt

SEQ ID NO: 5985007 - DNA, 18 bp, Homo sapiens
aaagtattaagcatatat

SEQ ID NO: 5985008 - DNA, 20 bp, Homo sapiens
aaagtattaagcatatattt

SEQ ID NO: 5985009 - DNA, 14 bp, Homo sapiens
aaagtattatcatt

SEQ ID NO: 5985010 - DNA, 22 bp, Homo sapiens
aaagtattatgtttcttcttgt

SEQ ID NO: 5985011 - DNA, 16 bp, Homo sapiens
aaagtattcagaaatt

SEQ ID NO: 5985012 - DNA, 21 bp, Homo sapiens
aaagtattcagaaattaaaat

SEQ ID NO: 5985013 - DNA, 20 bp, Homo sapiens
aaagtattccaccttaaatt

SEQ ID NO: 5985014 - DNA, 21 bp, Homo sapiens
aaagtattccaccttaaatta

SEQ ID NO: 5985015 - DNA, 16 bp, Homo sapiens
aaagtattctcttttc

SEQ ID NO: 5985016 - DNA, 12 bp, Homo sapiens
aaagtattcttc

SEQ ID NO: 5985017 - DNA, 22 bp, Homo sapiens
aaagtattcttctcttcctttt

SEQ ID NO: 5985018 - DNA, 14 bp, Homo sapiens
aaagtattcttctt

SEQ ID NO: 5985019 - DNA, 15 bp, Homo sapiens
aaagtattctttttc

SEQ ID NO: 5985020 - DNA, 14 bp, Homo sapiens
aaagtattggttac

SEQ ID NO: 5985021 - DNA, 13 bp, Homo sapiens
aaagtattgtaaa

SEQ ID NO: 5985022 - DNA, 20 bp, Homo sapiens
aaagtattgtaaattatatt

SEQ ID NO: 5985023 - DNA, 13 bp, Homo sapiens
aaagtattgtgaa

SEQ ID NO: 5985024 - DNA, 18 bp, Homo sapiens
aaagtattgtgtttatgc

SEQ ID NO: 5985025 - DNA, 20 bp, Homo sapiens
aaagtatttaattagtgcta

SEQ ID NO: 5985026 - DNA, 22 bp, Homo sapiens
aaagtatttactttttaaaaat

SEQ ID NO: 5985027 - DNA, 19 bp, Homo sapiens
aaagtatttataaaaatat

SEQ ID NO: 5985028 - DNA, 23 bp, Homo sapiens
aaagtatttataaaaatataaat

SEQ ID NO: 5985029 - DNA, 22 bp, Homo sapiens
aaagtatttgatgtacattaca

SEQ ID NO: 5985030 - DNA, 10 bp, Homo sapiens
aaagtatttt

SEQ ID NO: 5985031 - DNA, 14 bp, Homo sapiens
aaagtattttcctg

SEQ ID NO: 5985032 - DNA, 18 bp, Homo sapiens
aaagtattttgaagttta

SEQ ID NO: 5985033 - DNA, 21 bp, Homo sapiens
aaagtattttggggtatatta

SEQ ID NO: 5985034 - DNA, 23 bp, Homo sapiens
cacctgagtcaccctacctgtgc

SEQ ID NO: 5985035 - DNA, 15 bp, Homo sapiens
cacctgatctggccc

SEQ ID NO: 5985036 - DNA, 22 bp, Homo sapiens
cacctgatctggcccaagctgg

SEQ ID NO: 5985037 - DNA, 16 bp, Homo sapiens
cacctgatgtgtacat

SEQ ID NO: 5985038 - DNA, 16 bp, Homo sapiens
cacctgattcaactaa

SEQ ID NO: 5985039 - DNA, 17 bp, Homo sapiens
cacctgcaaagctctgt

SEQ ID NO: 5985040 - DNA, 14 bp, Homo sapiens
cacctgcaagcccc

SEQ ID NO: 5985041 - DNA, 17 bp, Homo sapiens
cacctgcaagccccagg

SEQ ID NO: 5985042 - DNA, 23 bp, Homo sapiens
cacctgcaagccccagggcctgg

SEQ ID NO: 5985043 - DNA, 14 bp, Homo sapiens
cacctgcaagtgcc

SEQ ID NO: 5985044 - DNA, 23 bp, Homo sapiens
cacctgcaatcccagcaccttag

SEQ ID NO: 5985045 - DNA, 14 bp, Homo sapiens
cacctgcacaaaca

SEQ ID NO: 5985046 - DNA, 18 bp, Homo sapiens
cacctgcacacccctgca

SEQ ID NO: 5985047 - DNA, 19 bp, Homo sapiens
cacctgcacacccctgcac

SEQ ID NO: 5985048 - DNA, 13 bp, Homo sapiens
cacctgcacactc

SEQ ID NO: 5985049 - DNA, 18 bp, Homo sapiens
cacctgcacactccatct

SEQ ID NO: 5985050 - DNA, 17 bp, Homo sapiens
cacctgcacagggccct

SEQ ID NO: 5985051 - DNA, 14 bp, Homo sapiens
cacctgcacccagg

SEQ ID NO: 5985052 - DNA, 16 bp, Homo sapiens
cacctgcacccaggtg

SEQ ID NO: 5985053 - DNA, 19 bp, Homo sapiens
cacctgcacctccccccac

SEQ ID NO: 5985054 - DNA, 22 bp, Homo sapiens
cacctgcacctccccccactgc

SEQ ID NO: 5985055 - DNA, 19 bp, Homo sapiens
cacctgcacgtgatctgct

SEQ ID NO: 5985056 - DNA, 21 bp, Homo sapiens
cacctgcactaacagagtggc

SEQ ID NO: 5985057 - DNA, 12 bp, Homo sapiens
cacctgcagaga

SEQ ID NO: 5985058 - DNA, 15 bp, Homo sapiens
cacctgcagccccag

SEQ ID NO: 5985059 - DNA, 19 bp, Homo sapiens
cacctgcagccccaggcct

SEQ ID NO: 5985060 - DNA, 16 bp, Homo sapiens
cacctgcagcctccct

SEQ ID NO: 5985061 - DNA, 19 bp, Homo sapiens
cacctgcagcctccctccg

SEQ ID NO: 5985062 - DNA, 17 bp, Homo sapiens
cacctgcagcgtctgag

SEQ ID NO: 5985063 - DNA, 18 bp, Homo sapiens
cacctgcagcgtctgagc

SEQ ID NO: 5985064 - DNA, 11 bp, Homo sapiens
cacctgcagct

SEQ ID NO: 5985065 - DNA, 15 bp, Homo sapiens
cacctgcagctccct

SEQ ID NO: 5985066 - DNA, 17 bp, Homo sapiens
cacctgcagggagcagc

SEQ ID NO: 5985067 - DNA, 15 bp, Homo sapiens
cacctgcagggctgc

SEQ ID NO: 5985068 - DNA, 14 bp, Homo sapiens
cacctgcaggtcac

SEQ ID NO: 5985069 - DNA, 14 bp, Homo sapiens
cacctgcagtgcca

SEQ ID NO: 5985070 - DNA, 21 bp, Homo sapiens
cacctgcagtgccagctccct

SEQ ID NO: 5985071 - DNA, 18 bp, Homo sapiens
cacctgcatcagcctctg

SEQ ID NO: 5985072 - DNA, 22 bp, Homo sapiens
cacctgcatccgtagttccctg

SEQ ID NO: 5985073 - DNA, 14 bp, Homo sapiens
cacctgcatcctct

SEQ ID NO: 5985074 - DNA, 16 bp, Homo sapiens
cacctgcatctggggc

SEQ ID NO: 5985075 - DNA, 17 bp, Homo sapiens
cacctgcatctggggcc

SEQ ID NO: 5985076 - DNA, 18 bp, Homo sapiens
cacctgccaccacacaca

SEQ ID NO: 5985077 - DNA, 15 bp, Homo sapiens
cacctgccaccccct

SEQ ID NO: 5985078 - DNA, 12 bp, Homo sapiens
cacctgccagcc

SEQ ID NO: 5985079 - DNA, 13 bp, Homo sapiens
cacctgccagcca

SEQ ID NO: 5985080 - DNA, 18 bp, Homo sapiens
cacctgccagccatcaca

SEQ ID NO: 5985081 - DNA, 15 bp, Homo sapiens
cacctgccagcctgg

SEQ ID NO: 5985082 - DNA, 21 bp, Homo sapiens
cacctgccagcggtttcctgg

SEQ ID NO: 5985083 - DNA, 19 bp, Homo sapiens
cacctgccaggcctccctc

SEQ ID NO: 5985084 - DNA, 13 bp, Homo sapiens
cacctgccaggct

SEQ ID NO: 5985085 - DNA, 12 bp, Homo sapiens
cacctgccaggg

SEQ ID NO: 5985086 - DNA, 13 bp, Homo sapiens
cacctgccaggga

SEQ ID NO: 5985087 - DNA, 15 bp, Homo sapiens
cacctgccagggccc

SEQ ID NO: 5985088 - DNA, 18 bp, Homo sapiens
cacctgcccaacctgctc

SEQ ID NO: 5985089 - DNA, 13 bp, Homo sapiens
cacctgcccagat

SEQ ID NO: 5985090 - DNA, 18 bp, Homo sapiens
cacctgcccatcacaggg

SEQ ID NO: 5985091 - DNA, 17 bp, Homo sapiens
cacctgccccagcactc

SEQ ID NO: 5985092 - DNA, 19 bp, Homo sapiens
cacctgccccagcgcggct

SEQ ID NO: 5985093 - DNA, 15 bp, Homo sapiens
cacctgccccaggct

SEQ ID NO: 5985094 - DNA, 17 bp, Homo sapiens
cacctgccccaggctca

SEQ ID NO: 5985095 - DNA, 18 bp, Homo sapiens
cacctgccccaggctcag

SEQ ID NO: 5985096 - DNA, 16 bp, Homo sapiens
cacctgcccccacagc

SEQ ID NO: 5985097 - DNA, 17 bp, Homo sapiens
cacctgcccccacagct

SEQ ID NO: 5985098 - DNA, 21 bp, Homo sapiens
cacctgccccctggtggacag

SEQ ID NO: 5985099 - DNA, 14 bp, Homo sapiens
cacctgcccctcaa

SEQ ID NO: 5985100 - DNA, 18 bp, Homo sapiens
cacctgcccggcccagga

SEQ ID NO: 5985101 - DNA, 18 bp, Homo sapiens
cacctgccctgccctgcc

SEQ ID NO: 5985102 - DNA, 19 bp, Homo sapiens
cacctgccctgccctgcca

SEQ ID NO: 5985103 - DNA, 18 bp, Homo sapiens
cacctgccgcatgctccc

SEQ ID NO: 5985104 - DNA, 20 bp, Homo sapiens
cacctgccgcatgctccctc

SEQ ID NO: 5985105 - DNA, 15 bp, Homo sapiens
cacctgccgctgctt

SEQ ID NO: 5985106 - DNA, 16 bp, Homo sapiens
cacctgccggctctgg

SEQ ID NO: 5985107 - DNA, 22 bp, Homo sapiens
cacctgccggctctgggctggc

SEQ ID NO: 5985108 - DNA, 13 bp, Homo sapiens
cacctgcctagct

SEQ ID NO: 5985109 - DNA, 22 bp, Homo sapiens
cacctgcctagctcttgggcct

SEQ ID NO: 5985110 - DNA, 18 bp, Homo sapiens
cacctgcctccaccagca

SEQ ID NO: 5985111 - DNA, 12 bp, Homo sapiens
cacctgcctccg

SEQ ID NO: 5985112 - DNA, 21 bp, Homo sapiens
cacctgcctccggcctgcact

SEQ ID NO: 5985113 - DNA, 20 bp, Homo sapiens
cacctgcctctaatctgagc

SEQ ID NO: 5985114 - DNA, 21 bp, Homo sapiens
cacctgcctctaatctgagct

SEQ ID NO: 5985115 - DNA, 13 bp, Homo sapiens
cacctgcctctga

SEQ ID NO: 5985116 - DNA, 15 bp, Homo sapiens
cacctgcctctgaac

SEQ ID NO: 5985117 - DNA, 12 bp, Homo sapiens
cacctgcctgac

SEQ ID NO: 5985118 - DNA, 17 bp, Homo sapiens
cacctgcctgcagagca

SEQ ID NO: 5985119 - DNA, 17 bp, Homo sapiens
cacctgcctgccccaca

SEQ ID NO: 5985120 - DNA, 19 bp, Homo sapiens
cacctgcctgccccacacg

SEQ ID NO: 5985121 - DNA, 20 bp, Homo sapiens
cacctgcctgcgtcttccgc

SEQ ID NO: 5985122 - DNA, 21 bp, Homo sapiens
cacctgcctgcgtcttccgcc

SEQ ID NO: 5985123 - DNA, 14 bp, Homo sapiens
cacctgcctggccg

SEQ ID NO: 5985124 - DNA, 19 bp, Homo sapiens
cacctgcctggccggccag

SEQ ID NO: 5985125 - DNA, 13 bp, Homo sapiens
cacctgcctggtg

SEQ ID NO: 5985126 - DNA, 14 bp, Homo sapiens
cacctgcctggtgc

SEQ ID NO: 5985127 - DNA, 16 bp, Homo sapiens
cacctgccttggcctc

SEQ ID NO: 5985128 - DNA, 19 bp, Homo sapiens
cacctgcgagaggtccctg

SEQ ID NO: 5985129 - DNA, 16 bp, Homo sapiens
cacctgcgcaagtgcc

SEQ ID NO: 5985130 - DNA, 19 bp, Homo sapiens
cacctgcgcaagtgcctgg

SEQ ID NO: 5985131 - DNA, 22 bp, Homo sapiens
cacctgcgcaagtgcctgggat

SEQ ID NO: 5985132 - DNA, 13 bp, Homo sapiens
cacctgcgcacag

SEQ ID NO: 5985133 - DNA, 20 bp, Homo sapiens
cacctgcgcacaggtgggag

SEQ ID NO: 5985134 - DNA, 16 bp, Homo sapiens
cacctgcgcagggccc

SEQ ID NO: 5985135 - DNA, 15 bp, Homo sapiens
cacctgcgcttcact

SEQ ID NO: 5985136 - DNA, 16 bp, Homo sapiens
cacctgcgcttctgct

SEQ ID NO: 5985137 - DNA, 13 bp, Homo sapiens
cacctgctcactg

SEQ ID NO: 5985138 - DNA, 16 bp, Homo sapiens
cacctgctcactggtc

SEQ ID NO: 5985139 - DNA, 12 bp, Homo sapiens
cacctgctccag

SEQ ID NO: 5985140 - DNA, 15 bp, Homo sapiens
cacctgctccagaag

SEQ ID NO: 5985141 - DNA, 22 bp, Homo sapiens
cacctgctcccagtcctgcctg

SEQ ID NO: 5985142 - DNA, 23 bp, Homo sapiens
cacctgctgagaaaacatgcctc

SEQ ID NO: 5985143 - DNA, 19 bp, Homo sapiens
cacctgctgcgtccccact

SEQ ID NO: 5985144 - DNA, 13 bp, Homo sapiens
cacctgctgctgc

SEQ ID NO: 5985145 - DNA, 11 bp, Homo sapiens
cacctgctgga

SEQ ID NO: 5985146 - DNA, 14 bp, Homo sapiens
cacctgctggcccc

SEQ ID NO: 5985147 - DNA, 15 bp, Homo sapiens
cacctgctggcccct

SEQ ID NO: 5985148 - DNA, 22 bp, Homo sapiens
cacctgctggttgttgccaggt

SEQ ID NO: 5985149 - DNA, 23 bp, Homo sapiens
cacctgctggttgttgccaggtt

SEQ ID NO: 5985150 - DNA, 23 bp, Homo sapiens
cacctgctgtctgggtggctcac

SEQ ID NO: 5985151 - DNA, 13 bp, Homo sapiens
cacctgcttcccc

SEQ ID NO: 5985152 - DNA, 15 bp, Homo sapiens
cacctgcttccccca

SEQ ID NO: 5985153 - DNA, 22 bp, Homo sapiens
cacctgcttcccccacttcacc

SEQ ID NO: 5985154 - DNA, 19 bp, Homo sapiens
cacctgcttctctgcccag

SEQ ID NO: 5985155 - DNA, 13 bp, Homo sapiens
cacctgcttctga

SEQ ID NO: 5985156 - DNA, 23 bp, Homo sapiens
cacctgcttgtgttgggccccag

SEQ ID NO: 5985157 - DNA, 15 bp, Homo sapiens
cacctgctttctcct

SEQ ID NO: 5985158 - DNA, 17 bp, Homo sapiens
cacctgctttctcctgg

SEQ ID NO: 5985159 - DNA, 16 bp, Homo sapiens
cacctggaaagccagg

SEQ ID NO: 5985160 - DNA, 17 bp, Homo sapiens
cacctggaaagccaggt

SEQ ID NO: 5985161 - DNA, 20 bp, Homo sapiens
cacctggaatatataaccag

SEQ ID NO: 5985162 - DNA, 15 bp, Homo sapiens
cacctggacccctgc

SEQ ID NO: 5985163 - DNA, 17 bp, Homo sapiens
cacctggacccctgcat

SEQ ID NO: 5985164 - DNA, 22 bp, Homo sapiens
cacctggagcccacagagtctg

SEQ ID NO: 5985165 - DNA, 21 bp, Homo sapiens
cacctggaggcaagagggagg

SEQ ID NO: 5985166 - DNA, 21 bp, Homo sapiens
cacctggatggatctgctcca

SEQ ID NO: 5985167 - DNA, 23 bp, Homo sapiens
cacctggatggatctgctccatg

SEQ ID NO: 5985168 - DNA, 16 bp, Homo sapiens
cacctggcaaaggacc

SEQ ID NO: 5985169 - DNA, 12 bp, Homo sapiens
cacctggcacat

SEQ ID NO: 5985170 - DNA, 19 bp, Homo sapiens
cacctggcagggctcacac

SEQ ID NO: 5985171 - DNA, 21 bp, Homo sapiens
cacctggcagggctcacactc

SEQ ID NO: 5985172 - DNA, 22 bp, Homo sapiens
cacctggcagggctcacactcc

SEQ ID NO: 5985173 - DNA, 23 bp, Homo sapiens
cacctggcatcgcaccattctga

SEQ ID NO: 5985174 - DNA, 20 bp, Homo sapiens
cacctggccacctgaggtgg

SEQ ID NO: 5985175 - DNA, 22 bp, Homo sapiens
cacctggccccatgtctctcag

SEQ ID NO: 5985176 - DNA, 15 bp, Homo sapiens
cacctggccctagtg

SEQ ID NO: 5985177 - DNA, 16 bp, Homo sapiens
cacctggccctctctg

SEQ ID NO: 5985178 - DNA, 12 bp, Homo sapiens
cacctggcctct

SEQ ID NO: 5985179 - DNA, 15 bp, Homo sapiens
cacctggcctctgca

SEQ ID NO: 5985180 - DNA, 19 bp, Homo sapiens
cacctggcctctgcactcc

SEQ ID NO: 5985181 - DNA, 20 bp, Homo sapiens
cacctggcctctgcactccc

SEQ ID NO: 5985182 - DNA, 19 bp, Homo sapiens
cacctggcctgctgggaac

SEQ ID NO: 5985183 - DNA, 14 bp, Homo sapiens
cacctggcctgggc

SEQ ID NO: 5985184 - DNA, 20 bp, Homo sapiens
cacctggccttaaagaggga

SEQ ID NO: 5985185 - DNA, 13 bp, Homo sapiens
cacctggctcccc

SEQ ID NO: 5985186 - DNA, 16 bp, Homo sapiens
cacctggctctcacct

SEQ ID NO: 5985187 - DNA, 12 bp, Homo sapiens
cacctggctctg

SEQ ID NO: 5985188 - DNA, 15 bp, Homo sapiens
cacctggctctgtgg

SEQ ID NO: 5985189 - DNA, 20 bp, Homo sapiens
cacctggctgaggttcctct

SEQ ID NO: 5985190 - DNA, 12 bp, Homo sapiens
cacctggctgcc

SEQ ID NO: 5985191 - DNA, 14 bp, Homo sapiens
cacctggcttccca

SEQ ID NO: 5985192 - DNA, 16 bp, Homo sapiens
cacctggcttcccagg

SEQ ID NO: 5985193 - DNA, 18 bp, Homo sapiens
cacctgggaaaacagagg

SEQ ID NO: 5985194 - DNA, 20 bp, Homo sapiens
cacctgggaacacagttctg

SEQ ID NO: 5985195 - DNA, 22 bp, Homo sapiens
cacctgggagaaggtctccaag

SEQ ID NO: 5985196 - DNA, 15 bp, Homo sapiens
cacctgggcacctgg

SEQ ID NO: 5985197 - DNA, 13 bp, Homo sapiens
cacctgggcagct

SEQ ID NO: 5985198 - DNA, 23 bp, Homo sapiens
cacctgggcagctcctccctgtg

SEQ ID NO: 5985199 - DNA, 20 bp, Homo sapiens
cacctgggccaaggactcca

SEQ ID NO: 5985200 - DNA, 18 bp, Homo sapiens
cacctgggccccactgga

SEQ ID NO: 5985201 - DNA, 21 bp, Homo sapiens
cacctgggccccactggacaa

SEQ ID NO: 5985202 - DNA, 21 bp, Homo sapiens
cacctgggcccgggcaggcca

SEQ ID NO: 5985203 - DNA, 23 bp, Homo sapiens
cacctgggcccgggcaggccagc

SEQ ID NO: 5985204 - DNA, 16 bp, Homo sapiens
cacctgggccctaggc

SEQ ID NO: 5985205 - DNA, 17 bp, Homo sapiens
cacctgggccctaggca

SEQ ID NO: 5985206 - DNA, 15 bp, Homo sapiens
cacctgggccctgga

SEQ ID NO: 5985207 - DNA, 18 bp, Homo sapiens
cacctgggccctggggcc

SEQ ID NO: 5985208 - DNA, 19 bp, Homo sapiens
cacctgggcctttcctgtg

SEQ ID NO: 5985209 - DNA, 18 bp, Homo sapiens
cacctgggcgtcatctgg

SEQ ID NO: 5985210 - DNA, 15 bp, Homo sapiens
cacctgggctgagga

SEQ ID NO: 5985211 - DNA, 14 bp, Homo sapiens
cacctgggctgggc

SEQ ID NO: 5985212 - DNA, 16 bp, Homo sapiens
cacctgggctttctgg

SEQ ID NO: 5985213 - DNA, 17 bp, Homo sapiens
cacctgggctttctgga

SEQ ID NO: 5985214 - DNA, 12 bp, Homo sapiens
aaagtatttttg

SEQ ID NO: 5985215 - DNA, 17 bp, Homo sapiens
aaagtatttttgaaaga

SEQ ID NO: 5985216 - DNA, 23 bp, Homo sapiens
aaagtatttttgattaacaatgt

SEQ ID NO: 5985217 - DNA, 16 bp, Homo sapiens
aaagtcaaaaaattat

SEQ ID NO: 5985218 - DNA, 18 bp, Homo sapiens
aaagtcaaaaggtgcctg

SEQ ID NO: 5985219 - DNA, 16 bp, Homo sapiens
aaagtcaaatgccaaa

SEQ ID NO: 5985220 - DNA, 21 bp, Homo sapiens
aaagtcaaatgccaaacacta

SEQ ID NO: 5985221 - DNA, 20 bp, Homo sapiens
aaagtcaagtctacctgcct

SEQ ID NO: 5985222 - DNA, 19 bp, Homo sapiens
aaagtcaataaaagagctg

SEQ ID NO: 5985223 - DNA, 22 bp, Homo sapiens
aaagtcaataaaagagctgtct

SEQ ID NO: 5985224 - DNA, 17 bp, Homo sapiens
aaagtcaatgttttcag

SEQ ID NO: 5985225 - DNA, 15 bp, Homo sapiens
aaagtcaattcatct

SEQ ID NO: 5985226 - DNA, 13 bp, Homo sapiens
aaagtcacacaga

SEQ ID NO: 5985227 - DNA, 13 bp, Homo sapiens
aaagtcacagtta

SEQ ID NO: 5985228 - DNA, 17 bp, Homo sapiens
aaagtcaccaaatagtg

SEQ ID NO: 5985229 - DNA, 20 bp, Homo sapiens
aaagtcaccattctgcattt

SEQ ID NO: 5985230 - DNA, 23 bp, Homo sapiens
aaagtcacccaaacacttctgct

SEQ ID NO: 5985231 - DNA, 21 bp, Homo sapiens
aaagtcacccagggacactcc

SEQ ID NO: 5985232 - DNA, 18 bp, Homo sapiens
aaagtcacctacaggact

SEQ ID NO: 5985233 - DNA, 22 bp, Homo sapiens
aaagtcacttactattgttgct

SEQ ID NO: 5985234 - DNA, 16 bp, Homo sapiens
aaagtcagaacaaatt

SEQ ID NO: 5985235 - DNA, 13 bp, Homo sapiens
aaagtcagaagtt

SEQ ID NO: 5985236 - DNA, 15 bp, Homo sapiens
aaagtcagaagtttt

SEQ ID NO: 5985237 - DNA, 13 bp, Homo sapiens
aaagtcagagaca

SEQ ID NO: 5985238 - DNA, 20 bp, Homo sapiens
aaagtcagagttaaaatata

SEQ ID NO: 5985239 - DNA, 20 bp, Homo sapiens
aaagtcagcattttcttaga

SEQ ID NO: 5985240 - DNA, 22 bp, Homo sapiens
aaagtcagtgttgaattttatt

SEQ ID NO: 5985241 - DNA, 15 bp, Homo sapiens
aaagtcataattgca

SEQ ID NO: 5985242 - DNA, 23 bp, Homo sapiens
aaagtcatgaagctcagtttggc

SEQ ID NO: 5985243 - DNA, 16 bp, Homo sapiens
aaagtcatgatgtttt

SEQ ID NO: 5985244 - DNA, 17 bp, Homo sapiens
aaagtcatgatgttttt

SEQ ID NO: 5985245 - DNA, 21 bp, Homo sapiens
aaagtcatgatgtttttaaaa

SEQ ID NO: 5985246 - DNA, 18 bp, Homo sapiens
aaagtcattaacaagaaa

SEQ ID NO: 5985247 - DNA, 17 bp, Homo sapiens
aaagtcattattcctgg

SEQ ID NO: 5985248 - DNA, 15 bp, Homo sapiens
aaagtcattggcttt

SEQ ID NO: 5985249 - DNA, 17 bp, Homo sapiens
aaagtcattggctttat

SEQ ID NO: 5985250 - DNA, 21 bp, Homo sapiens
aaagtcattggctttatcctc

SEQ ID NO: 5985251 - DNA, 12 bp, Homo sapiens
aaagtcatttaa

SEQ ID NO: 5985252 - DNA, 19 bp, Homo sapiens
aaagtccaattttaattta

SEQ ID NO: 5985253 - DNA, 23 bp, Homo sapiens
aaagtccaggctaattagaggat

SEQ ID NO: 5985254 - DNA, 21 bp, Homo sapiens
aaagtccataccttatatatg

SEQ ID NO: 5985255 - DNA, 15 bp, Homo sapiens
aaagtcccagttaag

SEQ ID NO: 5985256 - DNA, 18 bp, Homo sapiens
aaagtccccctcctcagc

SEQ ID NO: 5985257 - DNA, 20 bp, Homo sapiens
aaagtccccctcctcagcca

SEQ ID NO: 5985258 - DNA, 20 bp, Homo sapiens
aaagtccctccctgcctgag

SEQ ID NO: 5985259 - DNA, 22 bp, Homo sapiens
aaagtcctcctttcattaccct

SEQ ID NO: 5985260 - DNA, 15 bp, Homo sapiens
aaagtcctctgctcc

SEQ ID NO: 5985261 - DNA, 16 bp, Homo sapiens
aaagtcctctgctcca

SEQ ID NO: 5985262 - DNA, 23 bp, Homo sapiens
aaagtccttgcaagaatggagat

SEQ ID NO: 5985263 - DNA, 16 bp, Homo sapiens
aaagtcgttttccaaa

SEQ ID NO: 5985264 - DNA, 17 bp, Homo sapiens
aaagtctaaactgagct

SEQ ID NO: 5985265 - DNA, 16 bp, Homo sapiens
aaagtctaaactgtta

SEQ ID NO: 5985266 - DNA, 19 bp, Homo sapiens
aaagtctaaagtttacagt

SEQ ID NO: 5985267 - DNA, 15 bp, Homo sapiens
aaagtctaagcaaga

SEQ ID NO: 5985268 - DNA, 21 bp, Homo sapiens
aaagtctaagcaagatgtttt

SEQ ID NO: 5985269 - DNA, 16 bp, Homo sapiens
aaagtctatctaatga

SEQ ID NO: 5985270 - DNA, 13 bp, Homo sapiens
aaagtctatttta

SEQ ID NO: 5985271 - DNA, 21 bp, Homo sapiens
aaagtctatttttttaactga

SEQ ID NO: 5985272 - DNA, 23 bp, Homo sapiens
aaagtctatttttttaactgaaa

SEQ ID NO: 5985273 - DNA, 17 bp, Homo sapiens
aaagtctcacaggtagt

SEQ ID NO: 5985274 - DNA, 17 bp, Homo sapiens
aaagtctctatttaaat

SEQ ID NO: 5985275 - DNA, 21 bp, Homo sapiens
aaagtctctatttaaattctt

SEQ ID NO: 5985276 - DNA, 22 bp, Homo sapiens
aaagtctctggaatttgaaaca

SEQ ID NO: 5985277 - DNA, 12 bp, Homo sapiens
aaagtctcttgt

SEQ ID NO: 5985278 - DNA, 12 bp, Homo sapiens
aaagtctgagaa

SEQ ID NO: 5985279 - DNA, 14 bp, Homo sapiens
aaagtctgagaaat

SEQ ID NO: 5985280 - DNA, 16 bp, Homo sapiens
aaagtctgagaaatag

SEQ ID NO: 5985281 - DNA, 15 bp, Homo sapiens
aaagtctgagaaatt

SEQ ID NO: 5985282 - DNA, 13 bp, Homo sapiens
aaagtctgagtgg

SEQ ID NO: 5985283 - DNA, 11 bp, Homo sapiens
aaagtctgcaa

SEQ ID NO: 5985284 - DNA, 19 bp, Homo sapiens
aaagtctgcattacattcc

SEQ ID NO: 5985285 - DNA, 20 bp, Homo sapiens
aaagtctgggaaattctata

SEQ ID NO: 5985286 - DNA, 21 bp, Homo sapiens
aaagtctgtatggcatgacaa

SEQ ID NO: 5985287 - DNA, 21 bp, Homo sapiens
aaagtctgtcaggtttggttt

SEQ ID NO: 5985288 - DNA, 14 bp, Homo sapiens
aaagtctgtccttg

SEQ ID NO: 5985289 - DNA, 19 bp, Homo sapiens
aaagtctgtccttgaagga

SEQ ID NO: 5985290 - DNA, 17 bp, Homo sapiens
aaagtctgtctgcactg

SEQ ID NO: 5985291 - DNA, 22 bp, Homo sapiens
aaagtctgtgtgatgaactttc

SEQ ID NO: 5985292 - DNA, 14 bp, Homo sapiens
aaagtctgtttctg

SEQ ID NO: 5985293 - DNA, 19 bp, Homo sapiens
aaagtcttaacaacagctt

SEQ ID NO: 5985294 - DNA, 18 bp, Homo sapiens
aaagtcttctttcatgta

SEQ ID NO: 5985295 - DNA, 22 bp, Homo sapiens
aaagtcttgtgactagtgctga

SEQ ID NO: 5985296 - DNA, 23 bp, Homo sapiens
aaagtcttgtgactagtgctgaa

SEQ ID NO: 5985297 - DNA, 13 bp, Homo sapiens
aaagtcttttaaa

SEQ ID NO: 5985298 - DNA, 20 bp, Homo sapiens
aaagtcttttaaaaagtatt

SEQ ID NO: 5985299 - DNA, 21 bp, Homo sapiens
aaagtcttttaaaaagtattg

SEQ ID NO: 5985300 - DNA, 23 bp, Homo sapiens
aaagtgaaaaaaagaaacgaaaa

SEQ ID NO: 5985301 - DNA, 20 bp, Homo sapiens
aaagtgaaagtccagaaact

SEQ ID NO: 5985302 - DNA, 15 bp, Homo sapiens
aaagtgaaataatgt

SEQ ID NO: 5985303 - DNA, 17 bp, Homo sapiens
aaagtgaaataatgtgt

SEQ ID NO: 5985304 - DNA, 22 bp, Homo sapiens
aaagtgaacagattttattaat

SEQ ID NO: 5985305 - DNA, 14 bp, Homo sapiens
aaagtgaactttgt

SEQ ID NO: 5985306 - DNA, 13 bp, Homo sapiens
aaagtgaactttt

SEQ ID NO: 5985307 - DNA, 17 bp, Homo sapiens
aaagtgaacttttgtaa

SEQ ID NO: 5985308 - DNA, 18 bp, Homo sapiens
aaagtgaacttttgtaat

SEQ ID NO: 5985309 - DNA, 13 bp, Homo sapiens
aaagtgaagcaaa

SEQ ID NO: 5985310 - DNA, 19 bp, Homo sapiens
aaagtgaaggaaataaagg

SEQ ID NO: 5985311 - DNA, 16 bp, Homo sapiens
aaagtgaatgaaagat

SEQ ID NO: 5985312 - DNA, 19 bp, Homo sapiens
aaagtgaatttgaatgaaa

SEQ ID NO: 5985313 - DNA, 20 bp, Homo sapiens
aaagtgaatttgaatgaaaa

SEQ ID NO: 5985314 - DNA, 21 bp, Homo sapiens
aaagtgaatttgaatgaaaaa

SEQ ID NO: 5985315 - DNA, 22 bp, Homo sapiens
aaagtgacagagacccagatct

SEQ ID NO: 5985316 - DNA, 14 bp, Homo sapiens
aaagtgacagatgt

SEQ ID NO: 5985317 - DNA, 23 bp, Homo sapiens
aaagtgacagatgttatttttgt

SEQ ID NO: 5985318 - DNA, 23 bp, Homo sapiens
aaagtgacatgaaaattacaaca

SEQ ID NO: 5985319 - DNA, 22 bp, Homo sapiens
aaagtgacatttgctttcggta

SEQ ID NO: 5985320 - DNA, 20 bp, Homo sapiens
aaagtgactgtttggcttat

SEQ ID NO: 5985321 - DNA, 19 bp, Homo sapiens
aaagtgagaaaactgtgac

SEQ ID NO: 5985322 - DNA, 22 bp, Homo sapiens
aaagtgagaaagaaagtaaaaa

SEQ ID NO: 5985323 - DNA, 23 bp, Homo sapiens
aaagtgagactttgagggtgtat

SEQ ID NO: 5985324 - DNA, 14 bp, Homo sapiens
aaagtgagtactgt

SEQ ID NO: 5985325 - DNA, 15 bp, Homo sapiens
aaagtgatagaaatg

SEQ ID NO: 5985326 - DNA, 23 bp, Homo sapiens
aaagtgatcaataaaatgtgatt

SEQ ID NO: 5985327 - DNA, 21 bp, Homo sapiens
aaagtgatcctaaatatgaca

SEQ ID NO: 5985328 - DNA, 22 bp, Homo sapiens
aaagtgatctgtcccctctccc

SEQ ID NO: 5985329 - DNA, 15 bp, Homo sapiens
aaagtgatgaactgg

SEQ ID NO: 5985330 - DNA, 16 bp, Homo sapiens
aaagtgatgacatatt

SEQ ID NO: 5985331 - DNA, 22 bp, Homo sapiens
aaagtgatgtgatttatgcatt

SEQ ID NO: 5985332 - DNA, 21 bp, Homo sapiens
aaagtgattatctctttgatc

SEQ ID NO: 5985333 - DNA, 19 bp, Homo sapiens
aaagtgattgacttgactt

SEQ ID NO: 5985334 - DNA, 20 bp, Homo sapiens
aaagtgcaaacagaagtgca

SEQ ID NO: 5985335 - DNA, 21 bp, Homo sapiens
aaagtgcaaacagaagtgcat

SEQ ID NO: 5985336 - DNA, 13 bp, Homo sapiens
aaagtgcaaagct

SEQ ID NO: 5985337 - DNA, 18 bp, Homo sapiens
aaagtgcaaagtgccctc

SEQ ID NO: 5985338 - DNA, 14 bp, Homo sapiens
aaagtgcaagtcca

SEQ ID NO: 5985339 - DNA, 16 bp, Homo sapiens
aaagtgcaatgtcctg

SEQ ID NO: 5985340 - DNA, 14 bp, Homo sapiens
aaagtgcagccctt

SEQ ID NO: 5985341 - DNA, 15 bp, Homo sapiens
aaagtgcagcccttc

SEQ ID NO: 5985342 - DNA, 10 bp, Homo sapiens
aaagtgcagt

SEQ ID NO: 5985343 - DNA, 16 bp, Homo sapiens
aaagtgcagtcatttg

SEQ ID NO: 5985344 - DNA, 13 bp, Homo sapiens
aaagtgcatgtca

SEQ ID NO: 5985345 - DNA, 14 bp, Homo sapiens
aaagtgcatgtcac

SEQ ID NO: 5985346 - DNA, 20 bp, Homo sapiens
aaagtgcatgtcacatgcca

SEQ ID NO: 5985347 - DNA, 21 bp, Homo sapiens
aaagtgcatgtcacatgccac

SEQ ID NO: 5985348 - DNA, 15 bp, Homo sapiens
aaagtgcattatttt

SEQ ID NO: 5985349 - DNA, 13 bp, Homo sapiens
aaagtgcattcaa

SEQ ID NO: 5985350 - DNA, 22 bp, Homo sapiens
aaagtgcattcaaccttaccaa

SEQ ID NO: 5985351 - DNA, 19 bp, Homo sapiens
aaagtgccaaaataaagtc

SEQ ID NO: 5985352 - DNA, 13 bp, Homo sapiens
aaagtgccaaaga

SEQ ID NO: 5985353 - DNA, 14 bp, Homo sapiens
aaagtgccaaagaa

SEQ ID NO: 5985354 - DNA, 15 bp, Homo sapiens
aaagtgccactcatt

SEQ ID NO: 5985355 - DNA, 16 bp, Homo sapiens
aaagtgccagaaagtg

SEQ ID NO: 5985356 - DNA, 20 bp, Homo sapiens
aaagtgccatttcctgtctg

SEQ ID NO: 5985357 - DNA, 15 bp, Homo sapiens
aaagtgcctgggctc

SEQ ID NO: 5985358 - DNA, 22 bp, Homo sapiens
aaagtgcctgggctcagcctgg

SEQ ID NO: 5985359 - DNA, 23 bp, Homo sapiens
aaagtgcctgggctcagcctggt

SEQ ID NO: 5985360 - DNA, 12 bp, Homo sapiens
aaagtgccttct

SEQ ID NO: 5985361 - DNA, 13 bp, Homo sapiens
aaagtgctaaggt

SEQ ID NO: 5985362 - DNA, 20 bp, Homo sapiens
aaagtgctaaggttctaagg

SEQ ID NO: 5985363 - DNA, 23 bp, Homo sapiens
aaagtgctaaggttctaaggcct

SEQ ID NO: 5985364 - DNA, 17 bp, Homo sapiens
aaagtgctacttgagag

SEQ ID NO: 5985365 - DNA, 10 bp, Homo sapiens
aaagtgctgg

SEQ ID NO: 5985366 - DNA, 11 bp, Homo sapiens
aaagtgctggg

SEQ ID NO: 5985367 - DNA, 14 bp, Homo sapiens
aaagtgctgggatt

SEQ ID NO: 5985368 - DNA, 15 bp, Homo sapiens
aaagtgctgtttaga

SEQ ID NO: 5985369 - DNA, 20 bp, Homo sapiens
aaagtgcttagaaagttatt

SEQ ID NO: 5985370 - DNA, 22 bp, Homo sapiens
aaagtgcttcattctttgcagg

SEQ ID NO: 5985371 - DNA, 21 bp, Homo sapiens
aaagtgctttgctggagtcct

SEQ ID NO: 5985372 - DNA, 13 bp, Homo sapiens
aaagtggaaaaat

SEQ ID NO: 5985373 - DNA, 15 bp, Homo sapiens
aaagtggaagtatgt

SEQ ID NO: 5985374 - DNA, 22 bp, Homo sapiens
aaagtggacttctgaaaaatga

SEQ ID NO: 5985375 - DNA, 21 bp, Homo sapiens
aaagtggagttgttttaacag

SEQ ID NO: 5985376 - DNA, 15 bp, Homo sapiens
aaagtggattttcct

SEQ ID NO: 5985377 - DNA, 17 bp, Homo sapiens
aaagtggattttcctga

SEQ ID NO: 5985378 - DNA, 17 bp, Homo sapiens
aaagtggcaagaccaaa

SEQ ID NO: 5985379 - DNA, 18 bp, Homo sapiens
aaagtggcacctgtctgc

SEQ ID NO: 5985380 - DNA, 20 bp, Homo sapiens
aaagtggcatttctttatga

SEQ ID NO: 5985381 - DNA, 19 bp, Homo sapiens
aaagtggccaagaagcagt

SEQ ID NO: 5985382 - DNA, 16 bp, Homo sapiens
aaagtggcctctttgt

SEQ ID NO: 5985383 - DNA, 18 bp, Homo sapiens
aaagtggcgttgttcata

SEQ ID NO: 5985384 - DNA, 19 bp, Homo sapiens
aaagtggctaattcaattt

SEQ ID NO: 5985385 - DNA, 22 bp, Homo sapiens
aaagtggctaattcaatttatg

SEQ ID NO: 5985386 - DNA, 18 bp, Homo sapiens
aaagtggctgcggtgttt

SEQ ID NO: 5985387 - DNA, 17 bp, Homo sapiens
aaagtgggacctggtgg

SEQ ID NO: 5985388 - DNA, 21 bp, Homo sapiens
aaagtgggccctcatacacaa

SEQ ID NO: 5985389 - DNA, 17 bp, Homo sapiens
aaagtgggcttaatgga

SEQ ID NO: 5985390 - DNA, 17 bp, Homo sapiens
aaagtggggtacagtaa

SEQ ID NO: 5985391 - DNA, 14 bp, Homo sapiens
cacctggggagtgg

SEQ ID NO: 5985392 - DNA, 15 bp, Homo sapiens
cacctggggcagtca

SEQ ID NO: 5985393 - DNA, 14 bp, Homo sapiens
cacctggggctgct

SEQ ID NO: 5985394 - DNA, 15 bp, Homo sapiens
cacctggggctgctg

SEQ ID NO: 5985395 - DNA, 16 bp, Homo sapiens
cacctgggggcctggc

SEQ ID NO: 5985396 - DNA, 20 bp, Homo sapiens
cacctggggtctctctccct

SEQ ID NO: 5985397 - DNA, 21 bp, Homo sapiens
cacctggggtctctctcccta

SEQ ID NO: 5985398 - DNA, 16 bp, Homo sapiens
cacctgggtgtgctcc

SEQ ID NO: 5985399 - DNA, 17 bp, Homo sapiens
cacctgggtgtgctcca

SEQ ID NO: 5985400 - DNA, 18 bp, Homo sapiens
cacctgggtgtgctccag

SEQ ID NO: 5985401 - DNA, 22 bp, Homo sapiens
cacctggtacctggacggtgcg

SEQ ID NO: 5985402 - DNA, 18 bp, Homo sapiens
cacctggtactgacccag

SEQ ID NO: 5985403 - DNA, 17 bp, Homo sapiens
cacctggtcctccgcct

SEQ ID NO: 5985404 - DNA, 22 bp, Homo sapiens
cacctggtcctccgcctactgt

SEQ ID NO: 5985405 - DNA, 23 bp, Homo sapiens
cacctggtcgccaatccatgctc

SEQ ID NO: 5985406 - DNA, 20 bp, Homo sapiens
cacctggtgcgggcctggcc

SEQ ID NO: 5985407 - DNA, 18 bp, Homo sapiens
cacctggtggatacctgg

SEQ ID NO: 5985408 - DNA, 15 bp, Homo sapiens
cacctggtggccatg

SEQ ID NO: 5985409 - DNA, 17 bp, Homo sapiens
cacctggtggccatgct

SEQ ID NO: 5985410 - DNA, 21 bp, Homo sapiens
cacctggtggccatgctcctc

SEQ ID NO: 5985411 - DNA, 15 bp, Homo sapiens
cacctggtggccctg

SEQ ID NO: 5985412 - DNA, 11 bp, Homo sapiens
cacctggtggg

SEQ ID NO: 5985413 - DNA, 20 bp, Homo sapiens
cacctggttccggaatcctg

SEQ ID NO: 5985414 - DNA, 12 bp, Homo sapiens
cacctgtaatcc

SEQ ID NO: 5985415 - DNA, 20 bp, Homo sapiens
cacctgtaatcccagcactt

SEQ ID NO: 5985416 - DNA, 21 bp, Homo sapiens
cacctgtaatcccagctactt

SEQ ID NO: 5985417 - DNA, 17 bp, Homo sapiens
cacctgtaatctcagca

SEQ ID NO: 5985418 - DNA, 12 bp, Homo sapiens
cacctgtacagt

SEQ ID NO: 5985419 - DNA, 17 bp, Homo sapiens
cacctgtactcttccga

SEQ ID NO: 5985420 - DNA, 19 bp, Homo sapiens
cacctgtaggcagaggctg

SEQ ID NO: 5985421 - DNA, 17 bp, Homo sapiens
cacctgtagtcccagct

SEQ ID NO: 5985422 - DNA, 19 bp, Homo sapiens
cacctgtatatttctttta

SEQ ID NO: 5985423 - DNA, 17 bp, Homo sapiens
cacctgtcaccttttct

SEQ ID NO: 5985424 - DNA, 13 bp, Homo sapiens
cacctgtcccacc

SEQ ID NO: 5985425 - DNA, 14 bp, Homo sapiens
cacctgtccttctc

SEQ ID NO: 5985426 - DNA, 20 bp, Homo sapiens
cacctgtccttctcaggctg

SEQ ID NO: 5985427 - DNA, 18 bp, Homo sapiens
cacctgtcgcccagtgcc

SEQ ID NO: 5985428 - DNA, 20 bp, Homo sapiens
cacctgtcggtggctgcctt

SEQ ID NO: 5985429 - DNA, 18 bp, Homo sapiens
cacctgtctcagcctccc

SEQ ID NO: 5985430 - DNA, 13 bp, Homo sapiens
cacctgtctgtct

SEQ ID NO: 5985431 - DNA, 18 bp, Homo sapiens
cacctgtcttggcctccc

SEQ ID NO: 5985432 - DNA, 19 bp, Homo sapiens
cacctgtgagaaaggaaaa

SEQ ID NO: 5985433 - DNA, 19 bp, Homo sapiens
cacctgtgagtttaaagca

SEQ ID NO: 5985434 - DNA, 23 bp, Homo sapiens
cacctgtgcagcgaagcttagcg

SEQ ID NO: 5985435 - DNA, 16 bp, Homo sapiens
cacctgtgcagggccc

SEQ ID NO: 5985436 - DNA, 17 bp, Homo sapiens
cacctgtgcagggccct

SEQ ID NO: 5985437 - DNA, 22 bp, Homo sapiens
cacctgtgctacctctaacacc

SEQ ID NO: 5985438 - DNA, 16 bp, Homo sapiens
cacctgtgctgctgca

SEQ ID NO: 5985439 - DNA, 10 bp, Homo sapiens
cacctgtggg

SEQ ID NO: 5985440 - DNA, 15 bp, Homo sapiens
cacctgtggggcctg

SEQ ID NO: 5985441 - DNA, 12 bp, Homo sapiens
cacctgtgtcca

SEQ ID NO: 5985442 - DNA, 14 bp, Homo sapiens
cacctgtgtgttct

SEQ ID NO: 5985443 - DNA, 19 bp, Homo sapiens
cacctgtgtgttcttttga

SEQ ID NO: 5985444 - DNA, 23 bp, Homo sapiens
cacctgtgtgttcttttgataca

SEQ ID NO: 5985445 - DNA, 23 bp, Homo sapiens
cacctgttactaagtcaggagtg

SEQ ID NO: 5985446 - DNA, 19 bp, Homo sapiens
cacctgttgcttacaattt

SEQ ID NO: 5985447 - DNA, 19 bp, Homo sapiens
cacctgttgtgtgcctgac

SEQ ID NO: 5985448 - DNA, 11 bp, Homo sapiens
cacctgtttcc

SEQ ID NO: 5985449 - DNA, 16 bp, Homo sapiens
cacctgtttgaaacca

SEQ ID NO: 5985450 - DNA, 16 bp, Homo sapiens
cacctgttttctgaaa

SEQ ID NO: 5985451 - DNA, 20 bp, Homo sapiens
cacctgttttctgaaacaca

SEQ ID NO: 5985452 - DNA, 19 bp, Homo sapiens
cacctgtttttaagctgtt

SEQ ID NO: 5985453 - DNA, 21 bp, Homo sapiens
caccttaaaattagcatctgg

SEQ ID NO: 5985454 - DNA, 20 bp, Homo sapiens
caccttaaaggtcaaggaag

SEQ ID NO: 5985455 - DNA, 13 bp, Homo sapiens
caccttaaattaa

SEQ ID NO: 5985456 - DNA, 15 bp, Homo sapiens
caccttaaattaaac

SEQ ID NO: 5985457 - DNA, 22 bp, Homo sapiens
caccttaaattaaacaatttat

SEQ ID NO: 5985458 - DNA, 16 bp, Homo sapiens
caccttaactcagcca

SEQ ID NO: 5985459 - DNA, 15 bp, Homo sapiens
caccttaactggaga

SEQ ID NO: 5985460 - DNA, 21 bp, Homo sapiens
caccttaagaaagtgtctctg

SEQ ID NO: 5985461 - DNA, 18 bp, Homo sapiens
caccttaatattattggg

SEQ ID NO: 5985462 - DNA, 17 bp, Homo sapiens
caccttacaaagccagc

SEQ ID NO: 5985463 - DNA, 19 bp, Homo sapiens
caccttacaaagccagctc

SEQ ID NO: 5985464 - DNA, 15 bp, Homo sapiens
caccttacattccta

SEQ ID NO: 5985465 - DNA, 17 bp, Homo sapiens
caccttaccaactttct

SEQ ID NO: 5985466 - DNA, 19 bp, Homo sapiens
caccttaccaactttctgt

SEQ ID NO: 5985467 - DNA, 20 bp, Homo sapiens
caccttaccctactggctgt

SEQ ID NO: 5985468 - DNA, 21 bp, Homo sapiens
caccttagacagtccctgcca

SEQ ID NO: 5985469 - DNA, 19 bp, Homo sapiens
caccttagacggaggtgcc

SEQ ID NO: 5985470 - DNA, 16 bp, Homo sapiens
caccttagcagctctt

SEQ ID NO: 5985471 - DNA, 22 bp, Homo sapiens
caccttagcctgccctcctttc

SEQ ID NO: 5985472 - DNA, 13 bp, Homo sapiens
caccttagctggc

SEQ ID NO: 5985473 - DNA, 18 bp, Homo sapiens
caccttagggtggcttta

SEQ ID NO: 5985474 - DNA, 21 bp, Homo sapiens
caccttagggtggctttaatt

SEQ ID NO: 5985475 - DNA, 15 bp, Homo sapiens
caccttagtacttta

SEQ ID NO: 5985476 - DNA, 15 bp, Homo sapiens
caccttatatttacg

SEQ ID NO: 5985477 - DNA, 14 bp, Homo sapiens
caccttatgtatta

SEQ ID NO: 5985478 - DNA, 18 bp, Homo sapiens
caccttcaagcgctccag

SEQ ID NO: 5985479 - DNA, 19 bp, Homo sapiens
caccttcactctccagggt

SEQ ID NO: 5985480 - DNA, 20 bp, Homo sapiens
caccttcagaggctgaggtg

SEQ ID NO: 5985481 - DNA, 14 bp, Homo sapiens
caccttcagggctg

SEQ ID NO: 5985482 - DNA, 18 bp, Homo sapiens
caccttcagggctgagtt

SEQ ID NO: 5985483 - DNA, 23 bp, Homo sapiens
caccttcagtaacccccactgga

SEQ ID NO: 5985484 - DNA, 19 bp, Homo sapiens
caccttcagtgctggtggc

SEQ ID NO: 5985485 - DNA, 15 bp, Homo sapiens
caccttcatattggc

SEQ ID NO: 5985486 - DNA, 16 bp, Homo sapiens
caccttcatgattata

SEQ ID NO: 5985487 - DNA, 15 bp, Homo sapiens
caccttcattttgag

SEQ ID NO: 5985488 - DNA, 16 bp, Homo sapiens
caccttcattttgagg

SEQ ID NO: 5985489 - DNA, 15 bp, Homo sapiens
caccttccaaacaaa

SEQ ID NO: 5985490 - DNA, 15 bp, Homo sapiens
caccttccagctcct

SEQ ID NO: 5985491 - DNA, 15 bp, Homo sapiens
caccttccagtgagc

SEQ ID NO: 5985492 - DNA, 18 bp, Homo sapiens
caccttcccactttccca

SEQ ID NO: 5985493 - DNA, 21 bp, Homo sapiens
caccttcccagctctccctct

SEQ ID NO: 5985494 - DNA, 14 bp, Homo sapiens
caccttcccagctg

SEQ ID NO: 5985495 - DNA, 14 bp, Homo sapiens
caccttcccatgcc

SEQ ID NO: 5985496 - DNA, 14 bp, Homo sapiens
caccttccccagac

SEQ ID NO: 5985497 - DNA, 16 bp, Homo sapiens
caccttccccagactc

SEQ ID NO: 5985498 - DNA, 13 bp, Homo sapiens
caccttccccctt

SEQ ID NO: 5985499 - DNA, 24 bp, Homo sapiens
caccttcccctgaggacctttctg

SEQ ID NO: 5985500 - DNA, 13 bp, Homo sapiens
caccttcccttcc

SEQ ID NO: 5985501 - DNA, 14 bp, Homo sapiens
caccttcccttcct

SEQ ID NO: 5985502 - DNA, 17 bp, Homo sapiens
caccttcccttcctcag

SEQ ID NO: 5985503 - DNA, 18 bp, Homo sapiens
caccttcccttcctcagc

SEQ ID NO: 5985504 - DNA, 21 bp, Homo sapiens
caccttcccttctacaaggac

SEQ ID NO: 5985505 - DNA, 12 bp, Homo sapiens
caccttcccttg

SEQ ID NO: 5985506 - DNA, 14 bp, Homo sapiens
caccttcctcactt

SEQ ID NO: 5985507 - DNA, 20 bp, Homo sapiens
caccttcctcacttccatac

SEQ ID NO: 5985508 - DNA, 12 bp, Homo sapiens
caccttcctcct

SEQ ID NO: 5985509 - DNA, 16 bp, Homo sapiens
caccttcctcctgcag

SEQ ID NO: 5985510 - DNA, 14 bp, Homo sapiens
caccttcctcctgt

SEQ ID NO: 5985511 - DNA, 14 bp, Homo sapiens
caccttcctgactg

SEQ ID NO: 5985512 - DNA, 17 bp, Homo sapiens
caccttcctgactggga

SEQ ID NO: 5985513 - DNA, 18 bp, Homo sapiens
caccttcctgactgggaa

SEQ ID NO: 5985514 - DNA, 14 bp, Homo sapiens
caccttcctgccca

SEQ ID NO: 5985515 - DNA, 22 bp, Homo sapiens
caccttccttgcgaccaccaac

SEQ ID NO: 5985516 - DNA, 23 bp, Homo sapiens
caccttcggagaggacacttcaa

SEQ ID NO: 5985517 - DNA, 18 bp, Homo sapiens
caccttcgggcagtcctg

SEQ ID NO: 5985518 - DNA, 21 bp, Homo sapiens
caccttctatagcatcactta

SEQ ID NO: 5985519 - DNA, 20 bp, Homo sapiens
caccttctgacgcagcctga

SEQ ID NO: 5985520 - DNA, 21 bp, Homo sapiens
caccttctgacgcagcctgag

SEQ ID NO: 5985521 - DNA, 22 bp, Homo sapiens
caccttctgacgcagcctgaga

SEQ ID NO: 5985522 - DNA, 12 bp, Homo sapiens
caccttctgagt

SEQ ID NO: 5985523 - DNA, 17 bp, Homo sapiens
caccttctgtccccagc

SEQ ID NO: 5985524 - DNA, 13 bp, Homo sapiens
caccttctgtttt

SEQ ID NO: 5985525 - DNA, 17 bp, Homo sapiens
caccttcttaaaagaaa

SEQ ID NO: 5985526 - DNA, 15 bp, Homo sapiens
caccttcttggcttc

SEQ ID NO: 5985527 - DNA, 22 bp, Homo sapiens
caccttcttggcttctgggacc

SEQ ID NO: 5985528 - DNA, 20 bp, Homo sapiens
caccttcttgggactgctgt

SEQ ID NO: 5985529 - DNA, 13 bp, Homo sapiens
caccttctttgta

SEQ ID NO: 5985530 - DNA, 14 bp, Homo sapiens
caccttctttgtaa

SEQ ID NO: 5985531 - DNA, 16 bp, Homo sapiens
caccttgaacctgtca

SEQ ID NO: 5985532 - DNA, 22 bp, Homo sapiens
caccttgaagaacctctcactt

SEQ ID NO: 5985533 - DNA, 16 bp, Homo sapiens
caccttgacagggcac

SEQ ID NO: 5985534 - DNA, 19 bp, Homo sapiens
caccttgacagggcacacc

SEQ ID NO: 5985535 - DNA, 23 bp, Homo sapiens
caccttgacgtttcttctttcta

SEQ ID NO: 5985536 - DNA, 20 bp, Homo sapiens
caccttgagcactattctaa

SEQ ID NO: 5985537 - DNA, 16 bp, Homo sapiens
caccttgattttcttc

SEQ ID NO: 5985538 - DNA, 22 bp, Homo sapiens
caccttgcagaaggcaaggccc

SEQ ID NO: 5985539 - DNA, 24 bp, Homo sapiens
caccttgcagaaggcaaggccctg

SEQ ID NO: 5985540 - DNA, 13 bp, Homo sapiens
caccttgcagctc

SEQ ID NO: 5985541 - DNA, 18 bp, Homo sapiens
caccttgccaagctttct

SEQ ID NO: 5985542 - DNA, 18 bp, Homo sapiens
caccttgccaatggtgta

SEQ ID NO: 5985543 - DNA, 17 bp, Homo sapiens
caccttgccagggaggt

SEQ ID NO: 5985544 - DNA, 14 bp, Homo sapiens
caccttgccagggc

SEQ ID NO: 5985545 - DNA, 17 bp, Homo sapiens
caccttgccgagagagg

SEQ ID NO: 5985546 - DNA, 19 bp, Homo sapiens
caccttgccgagagaggcg

SEQ ID NO: 5985547 - DNA, 21 bp, Homo sapiens
caccttgctaacctaaaagac

SEQ ID NO: 5985548 - DNA, 13 bp, Homo sapiens
caccttgctgtgt

SEQ ID NO: 5985549 - DNA, 16 bp, Homo sapiens
caccttgcttttcagt

SEQ ID NO: 5985550 - DNA, 22 bp, Homo sapiens
caccttggacatcctcctccca

SEQ ID NO: 5985551 - DNA, 16 bp, Homo sapiens
caccttggaccctggt

SEQ ID NO: 5985552 - DNA, 15 bp, Homo sapiens
caccttggagcattt

SEQ ID NO: 5985553 - DNA, 23 bp, Homo sapiens
caccttggagcatttatgtagac

SEQ ID NO: 5985554 - DNA, 13 bp, Homo sapiens
caccttggagcct

SEQ ID NO: 5985555 - DNA, 13 bp, Homo sapiens
caccttggaggag

SEQ ID NO: 5985556 - DNA, 22 bp, Homo sapiens
caccttggaggccttccctggc

SEQ ID NO: 5985557 - DNA, 14 bp, Homo sapiens
caccttggcctccc

SEQ ID NO: 5985558 - DNA, 19 bp, Homo sapiens
caccttggctctgccagtg

SEQ ID NO: 5985559 - DNA, 16 bp, Homo sapiens
caccttggctgcaggg

SEQ ID NO: 5985560 - DNA, 17 bp, Homo sapiens
caccttgggctggggga

SEQ ID NO: 5985561 - DNA, 15 bp, Homo sapiens
caccttggggccttg

SEQ ID NO: 5985562 - DNA, 15 bp, Homo sapiens
caccttgggtctgtg

SEQ ID NO: 5985563 - DNA, 20 bp, Homo sapiens
caccttggtccctctcagat

SEQ ID NO: 5985564 - DNA, 14 bp, Homo sapiens
caccttggttcctg

SEQ ID NO: 5985565 - DNA, 21 bp, Homo sapiens
caccttgtaaccagtgcagaa

SEQ ID NO: 5985566 - DNA, 22 bp, Homo sapiens
caccttgtcatgtaccatcaat

SEQ ID NO: 5985567 - DNA, 15 bp, Homo sapiens
caccttgtcctggct

SEQ ID NO: 5985568 - DNA, 13 bp, Homo sapiens
caccttgtgcctg

SEQ ID NO: 5985569 - DNA, 16 bp, Homo sapiens
caccttgtgcctgggg

SEQ ID NO: 5985570 - DNA, 17 bp, Homo sapiens
caccttgtgtctgtaca

SEQ ID NO: 5985571 - DNA, 12 bp, Homo sapiens
caccttgttaca

SEQ ID NO: 5985572 - DNA, 13 bp, Homo sapiens
cacctttactgtg

SEQ ID NO: 5985573 - DNA, 20 bp, Homo sapiens
cacctttactgtgcttattt

SEQ ID NO: 5985574 - DNA, 17 bp, Homo sapiens
cacctttagaatattaa

SEQ ID NO: 5985575 - DNA, 16 bp, Homo sapiens
cacctttatgttttaa

SEQ ID NO: 5985576 - DNA, 14 bp, Homo sapiens
cacctttattaaaa

SEQ ID NO: 5985577 - DNA, 15 bp, Homo sapiens
cacctttattaaaat

SEQ ID NO: 5985578 - DNA, 14 bp, Homo sapiens
cacctttattttat

SEQ ID NO: 5985579 - DNA, 22 bp, Homo sapiens
cacctttcagataactgttatt

SEQ ID NO: 5985580 - DNA, 17 bp, Homo sapiens
cacctttcagcccacgt

SEQ ID NO: 5985581 - DNA, 17 bp, Homo sapiens
cacctttcccacctctc

SEQ ID NO: 5985582 - DNA, 23 bp, Homo sapiens
cacctttcccacctctctcccca

SEQ ID NO: 5985583 - DNA, 20 bp, Homo sapiens
cacctttccctaaagaccct

SEQ ID NO: 5985584 - DNA, 19 bp, Homo sapiens
cacctttcctcaaatgttg

SEQ ID NO: 5985585 - DNA, 19 bp, Homo sapiens
cacctttctccactgggtg

SEQ ID NO: 5985586 - DNA, 15 bp, Homo sapiens
cacctttctctgaga

SEQ ID NO: 5985587 - DNA, 19 bp, Homo sapiens
cacctttctctgttttatg

SEQ ID NO: 5985588 - DNA, 14 bp, Homo sapiens
cacctttctgggct

SEQ ID NO: 5985589 - DNA, 21 bp, Homo sapiens
cacctttctgggctttctcct

SEQ ID NO: 5985590 - DNA, 22 bp, Homo sapiens
cacctttctgggctttctcctg

SEQ ID NO: 5985591 - DNA, 14 bp, Homo sapiens
cacctttgaagaag

SEQ ID NO: 5985592 - DNA, 15 bp, Homo sapiens
cacctttgagagagg

SEQ ID NO: 5985593 - DNA, 23 bp, Homo sapiens
cacctttgagagagggggcactg

SEQ ID NO: 5985594 - DNA, 19 bp, Homo sapiens
cacctttgggatcagcctc

SEQ ID NO: 5985595 - DNA, 16 bp, Homo sapiens
cacctttggtgcagag

SEQ ID NO: 5985596 - DNA, 14 bp, Homo sapiens
cacctttgtagcac

SEQ ID NO: 5985597 - DNA, 20 bp, Homo sapiens
cacctttgtagcactcaggc

SEQ ID NO: 5985598 - DNA, 21 bp, Homo sapiens
cacctttgtagcactcaggct

SEQ ID NO: 5985599 - DNA, 17 bp, Homo sapiens
cacctttgtctggatgc

SEQ ID NO: 5985600 - DNA, 21 bp, Homo sapiens
cacctttgtctggatgcacac

SEQ ID NO: 5985601 - DNA, 22 bp, Homo sapiens
cacctttgtctggatgcacact

SEQ ID NO: 5985602 - DNA, 17 bp, Homo sapiens
cacctttgtgtattttt

SEQ ID NO: 5985603 - DNA, 19 bp, Homo sapiens
cacctttgtttctccccca

SEQ ID NO: 5985604 - DNA, 18 bp, Homo sapiens
caccttttaactcacctc

SEQ ID NO: 5985605 - DNA, 19 bp, Homo sapiens
caccttttaagttaatgaa

SEQ ID NO: 5985606 - DNA, 21 bp, Homo sapiens
caccttttaagttaatgaaat

SEQ ID NO: 5985607 - DNA, 23 bp, Homo sapiens
caccttttaagttaatgaaataa

SEQ ID NO: 5985608 - DNA, 15 bp, Homo sapiens
caccttttataccag

SEQ ID NO: 5985609 - DNA, 21 bp, Homo sapiens
caccttttcatggtctctgca

SEQ ID NO: 5985610 - DNA, 17 bp, Homo sapiens
caccttttcatgtacag

SEQ ID NO: 5985611 - DNA, 18 bp, Homo sapiens
caccttttcatgtacagc

SEQ ID NO: 5985612 - DNA, 20 bp, Homo sapiens
caccttttcatgtacagcat

SEQ ID NO: 5985613 - DNA, 16 bp, Homo sapiens
caccttttccaggagt

SEQ ID NO: 5985614 - DNA, 15 bp, Homo sapiens
caccttttccccagg

SEQ ID NO: 5985615 - DNA, 11 bp, Homo sapiens
caccttttcta

SEQ ID NO: 5985616 - DNA, 13 bp, Homo sapiens
caccttttctaaa

SEQ ID NO: 5985617 - DNA, 20 bp, Homo sapiens
caccttttctaaaaagtcaa

SEQ ID NO: 5985618 - DNA, 16 bp, Homo sapiens
caccttttctgtggct

SEQ ID NO: 5985619 - DNA, 22 bp, Homo sapiens
caccttttctgtggctggctct

SEQ ID NO: 5985620 - DNA, 18 bp, Homo sapiens
caccttttgtcaacggca

SEQ ID NO: 5985621 - DNA, 19 bp, Homo sapiens
cacctttttaaatcctaaa

SEQ ID NO: 5985622 - DNA, 19 bp, Homo sapiens
cacctttttcatacaaggc

SEQ ID NO: 5985623 - DNA, 15 bp, Homo sapiens
cacctttttgacttt

SEQ ID NO: 5985624 - DNA, 13 bp, Homo sapiens
cacgaaagagaga

SEQ ID NO: 5985625 - DNA, 14 bp, Homo sapiens
cacgaaagcacaca

SEQ ID NO: 5985626 - DNA, 13 bp, Homo sapiens
cacgaaatgttat

SEQ ID NO: 5985627 - DNA, 16 bp, Homo sapiens
cacgaaatgttatttt

SEQ ID NO: 5985628 - DNA, 17 bp, Homo sapiens
cacgaaatgttattttt

SEQ ID NO: 5985629 - DNA, 21 bp, Homo sapiens
cacgaacacgcatgcctcagc

SEQ ID NO: 5985630 - DNA, 14 bp, Homo sapiens
cacgaacccacctg

SEQ ID NO: 5985631 - DNA, 16 bp, Homo sapiens
cacgaacccacctgct

SEQ ID NO: 5985632 - DNA, 21 bp, Homo sapiens
cacgaacttgaaagttttcta

SEQ ID NO: 5985633 - DNA, 16 bp, Homo sapiens
cacgaagctatgagaa

SEQ ID NO: 5985634 - DNA, 22 bp, Homo sapiens
cacgaagctgtgaactcagagc

SEQ ID NO: 5985635 - DNA, 22 bp, Homo sapiens
cacgaatttggtgtggctgtat

SEQ ID NO: 5985636 - DNA, 21 bp, Homo sapiens
cacgaattttaaaacatggca

SEQ ID NO: 5985637 - DNA, 15 bp, Homo sapiens
cacgacactgcagcc

SEQ ID NO: 5985638 - DNA, 18 bp, Homo sapiens
cacgacagcacacacagt

SEQ ID NO: 5985639 - DNA, 17 bp, Homo sapiens
cacgacataagctggta

SEQ ID NO: 5985640 - DNA, 14 bp, Homo sapiens
cacgaccagcccct

SEQ ID NO: 5985641 - DNA, 15 bp, Homo sapiens
cacgaccagcccctt

SEQ ID NO: 5985642 - DNA, 14 bp, Homo sapiens
cacgacccctgcct

SEQ ID NO: 5985643 - DNA, 15 bp, Homo sapiens
cacgaccgccccagt

SEQ ID NO: 5985644 - DNA, 14 bp, Homo sapiens
cacgaccggggcca

SEQ ID NO: 5985645 - DNA, 17 bp, Homo sapiens
cacgacctaggcagtag

SEQ ID NO: 5985646 - DNA, 23 bp, Homo sapiens
cacgacctaggcagtaggccggt

SEQ ID NO: 5985647 - DNA, 19 bp, Homo sapiens
cacgacctcggctcactgc

SEQ ID NO: 5985648 - DNA, 15 bp, Homo sapiens
cacgacgctgcagag

SEQ ID NO: 5985649 - DNA, 17 bp, Homo sapiens
cacgactcttcctgcaa

SEQ ID NO: 5985650 - DNA, 19 bp, Homo sapiens
cacgactcttcctgcaaag

SEQ ID NO: 5985651 - DNA, 16 bp, Homo sapiens
cacgactgcccggcag

SEQ ID NO: 5985652 - DNA, 20 bp, Homo sapiens
cacgactgcgggagccagac

SEQ ID NO: 5985653 - DNA, 23 bp, Homo sapiens
cacgacttcttcggaggtggcag

SEQ ID NO: 5985654 - DNA, 16 bp, Homo sapiens
cacgagaccccggctt

SEQ ID NO: 5985655 - DNA, 14 bp, Homo sapiens
cacgagatttcttt

SEQ ID NO: 5985656 - DNA, 23 bp, Homo sapiens
cacgagatttcttttttatgtga

SEQ ID NO: 5985657 - DNA, 24 bp, Homo sapiens
cacgagatttcttttttatgtgat

SEQ ID NO: 5985658 - DNA, 19 bp, Homo sapiens
cacgagcaaacccagaggt

SEQ ID NO: 5985659 - DNA, 21 bp, Homo sapiens
cacgagcaaacccagaggtgg

SEQ ID NO: 5985660 - DNA, 23 bp, Homo sapiens
cacgagcacaatggtcttacatt

SEQ ID NO: 5985661 - DNA, 20 bp, Homo sapiens
cacgagcaggctactgtcag

SEQ ID NO: 5985662 - DNA, 13 bp, Homo sapiens
cacgagccacaag

SEQ ID NO: 5985663 - DNA, 14 bp, Homo sapiens
cacgagccacaagc

SEQ ID NO: 5985664 - DNA, 22 bp, Homo sapiens
cacgagccacaagctgcactgt

SEQ ID NO: 5985665 - DNA, 12 bp, Homo sapiens
cacgagccacct

SEQ ID NO: 5985666 - DNA, 14 bp, Homo sapiens
cacgagccttgcgc

SEQ ID NO: 5985667 - DNA, 21 bp, Homo sapiens
cacgaggaagcagcaattaat

SEQ ID NO: 5985668 - DNA, 15 bp, Homo sapiens
cacgaggagcagcag

SEQ ID NO: 5985669 - DNA, 17 bp, Homo sapiens
cacgaggagcttccagt

SEQ ID NO: 5985670 - DNA, 16 bp, Homo sapiens
cacgaggatggcctgg

SEQ ID NO: 5985671 - DNA, 20 bp, Homo sapiens
cacgaggccttcagaaaaga

SEQ ID NO: 5985672 - DNA, 20 bp, Homo sapiens
cacgaggctgattcctctca

SEQ ID NO: 5985673 - DNA, 17 bp, Homo sapiens
cacgagggccccgtggg

SEQ ID NO: 5985674 - DNA, 11 bp, Homo sapiens
cacgagggctg

SEQ ID NO: 5985675 - DNA, 12 bp, Homo sapiens
cacgagggctgg

SEQ ID NO: 5985676 - DNA, 13 bp, Homo sapiens
cacgagggctggc

SEQ ID NO: 5985677 - DNA, 21 bp, Homo sapiens
cacgagggctggctggcctca

SEQ ID NO: 5985678 - DNA, 16 bp, Homo sapiens
cacgaggggacccatg

SEQ ID NO: 5985679 - DNA, 19 bp, Homo sapiens
cacgaggggacccatgggg

SEQ ID NO: 5985680 - DNA, 22 bp, Homo sapiens
cacgaggtggtagctctgagcc

SEQ ID NO: 5985681 - DNA, 14 bp, Homo sapiens
cacgagtcacctgc

SEQ ID NO: 5985682 - DNA, 15 bp, Homo sapiens
cacgagtcacctgca

SEQ ID NO: 5985683 - DNA, 18 bp, Homo sapiens
cacgagtcacctgcaagc

SEQ ID NO: 5985684 - DNA, 18 bp, Homo sapiens
cacgagtcagtcgccttt

SEQ ID NO: 5985685 - DNA, 18 bp, Homo sapiens
cacgagtgtagtcccgga

SEQ ID NO: 5985686 - DNA, 14 bp, Homo sapiens
cacgagttccagac

SEQ ID NO: 5985687 - DNA, 16 bp, Homo sapiens
cacgatcccctccccc

SEQ ID NO: 5985688 - DNA, 20 bp, Homo sapiens
cacgatccgcaacccatgcc

SEQ ID NO: 5985689 - DNA, 15 bp, Homo sapiens
cacgatcctgccacc

SEQ ID NO: 5985690 - DNA, 13 bp, Homo sapiens
cacgatcggcctt

SEQ ID NO: 5985691 - DNA, 12 bp, Homo sapiens
cacgatgaaaaa

SEQ ID NO: 5985692 - DNA, 15 bp, Homo sapiens
cacgatgcatttaat

SEQ ID NO: 5985693 - DNA, 16 bp, Homo sapiens
cacgatggaatgtaaa

SEQ ID NO: 5985694 - DNA, 19 bp, Homo sapiens
cacgatggaatgtaaaata

SEQ ID NO: 5985695 - DNA, 21 bp, Homo sapiens
cacgatgtcaaggactcctgt

SEQ ID NO: 5985696 - DNA, 14 bp, Homo sapiens
cacgatgtggccct

SEQ ID NO: 5985697 - DNA, 15 bp, Homo sapiens
cacgatgtggccctg

SEQ ID NO: 5985698 - DNA, 13 bp, Homo sapiens
cacgattccagtg

SEQ ID NO: 5985699 - DNA, 14 bp, Homo sapiens
cacgattccagtgc

SEQ ID NO: 5985700 - DNA, 15 bp, Homo sapiens
cacgattccagtgca

SEQ ID NO: 5985701 - DNA, 13 bp, Homo sapiens
cacgattggagaa

SEQ ID NO: 5985702 - DNA, 16 bp, Homo sapiens
cacgatttctgtttag

SEQ ID NO: 5985703 - DNA, 16 bp, Homo sapiens
cacgattttcaagatt

SEQ ID NO: 5985704 - DNA, 17 bp, Homo sapiens
cacgattttctccagct

SEQ ID NO: 5985705 - DNA, 19 bp, Homo sapiens
cacgattttctccagctca

SEQ ID NO: 5985706 - DNA, 22 bp, Homo sapiens
cacgcaaaagcgactcccagct

SEQ ID NO: 5985707 - DNA, 20 bp, Homo sapiens
cacgcaaaccaacctttctg

SEQ ID NO: 5985708 - DNA, 18 bp, Homo sapiens
cacgcaactcacacctcc

SEQ ID NO: 5985709 - DNA, 21 bp, Homo sapiens
cacgcaactcacacctccttt

SEQ ID NO: 5985710 - DNA, 13 bp, Homo sapiens
cacgcaacttgaa

SEQ ID NO: 5985711 - DNA, 15 bp, Homo sapiens
cacgcaacttgaaat

SEQ ID NO: 5985712 - DNA, 12 bp, Homo sapiens
cacgcaagcctc

SEQ ID NO: 5985713 - DNA, 16 bp, Homo sapiens
cacgcaagcctcagcc

SEQ ID NO: 5985714 - DNA, 21 bp, Homo sapiens
cacgcaaggctgtgctcttcc

SEQ ID NO: 5985715 - DNA, 21 bp, Homo sapiens
cacgcaagggcatcaggcact

SEQ ID NO: 5985716 - DNA, 23 bp, Homo sapiens
cacgcaagggcatcaggcactgg

SEQ ID NO: 5985717 - DNA, 15 bp, Homo sapiens
cacgcaagtgtgtga

SEQ ID NO: 5985718 - DNA, 14 bp, Homo sapiens
cacgcacaaacaca

SEQ ID NO: 5985719 - DNA, 20 bp, Homo sapiens
cacgcacacacacatacaga

SEQ ID NO: 5985720 - DNA, 19 bp, Homo sapiens
cacgcacacatcttacctc

SEQ ID NO: 5985721 - DNA, 18 bp, Homo sapiens
cacgcacacgcacacatc

SEQ ID NO: 5985722 - DNA, 18 bp, Homo sapiens
cacgcacatatacacaca

SEQ ID NO: 5985723 - DNA, 23 bp, Homo sapiens
cacgcacatgccaatgcacgcac

SEQ ID NO: 5985724 - DNA, 13 bp, Homo sapiens
cacgcaccactgc

SEQ ID NO: 5985725 - DNA, 15 bp, Homo sapiens
cacgcaccactgctt

SEQ ID NO: 5985726 - DNA, 15 bp, Homo sapiens
cacgcacccacaccc

SEQ ID NO: 5985727 - DNA, 16 bp, Homo sapiens
cacgcacctccacgcc

SEQ ID NO: 5985728 - DNA, 15 bp, Homo sapiens
cacgcacctcccatc

SEQ ID NO: 5985729 - DNA, 20 bp, Homo sapiens
cacgcacgacgtcagcctct

SEQ ID NO: 5985730 - DNA, 13 bp, Homo sapiens
cacgcacgcacac

SEQ ID NO: 5985731 - DNA, 17 bp, Homo sapiens
cacgcacgcacacgcac

SEQ ID NO: 5985732 - DNA, 16 bp, Homo sapiens
cacgcactgcgcctgt

SEQ ID NO: 5985733 - DNA, 19 bp, Homo sapiens
cacgcactgcgcctgtcag

SEQ ID NO: 5985734 - DNA, 13 bp, Homo sapiens
cacgcactgggcc

SEQ ID NO: 5985735 - DNA, 15 bp, Homo sapiens
cacgcactgggccac

SEQ ID NO: 5985736 - DNA, 17 bp, Homo sapiens
cacgcacttcgggaggt

SEQ ID NO: 5985737 - DNA, 18 bp, Homo sapiens
cacgcacttgcctgttgg

SEQ ID NO: 5985738 - DNA, 24 bp, Homo sapiens
cacgcacttgcctgttggctgctg

SEQ ID NO: 5985739 - DNA, 12 bp, Homo sapiens
cacgcagacaca

SEQ ID NO: 5985740 - DNA, 14 bp, Homo sapiens
cacgcagacacaca

SEQ ID NO: 5985741 - DNA, 15 bp, Homo sapiens
cacgcagacacacac

SEQ ID NO: 5985742 - DNA, 21 bp, Homo sapiens
cacgcagacctgcagcgggca

SEQ ID NO: 5985743 - DNA, 21 bp, Homo sapiens
cacgcagagccccggagcacc

SEQ ID NO: 5985744 - DNA, 12 bp, Homo sapiens
cacgcagaggac

SEQ ID NO: 5985745 - DNA, 13 bp, Homo sapiens
cacgcagccagga

SEQ ID NO: 5985746 - DNA, 14 bp, Homo sapiens
cacgcagctggcag

SEQ ID NO: 5985747 - DNA, 20 bp, Homo sapiens
cacgcaggaactcccagcaa

SEQ ID NO: 5985748 - DNA, 19 bp, Homo sapiens
cacgcaggagcacacccag

SEQ ID NO: 5985749 - DNA, 22 bp, Homo sapiens
caagaggacaatctagctctcc

SEQ ID NO: 5985750 - DNA, 13 bp, Homo sapiens
caagaggacacaa

SEQ ID NO: 5985751 - DNA, 17 bp, Homo sapiens
caagaggattgtaaaat

SEQ ID NO: 5985752 - DNA, 21 bp, Homo sapiens
caagaggatttcttcaaatct

SEQ ID NO: 5985753 - DNA, 20 bp, Homo sapiens
caagaggcaagctgaaattt

SEQ ID NO: 5985754 - DNA, 13 bp, Homo sapiens
caagaggcccagg

SEQ ID NO: 5985755 - DNA, 17 bp, Homo sapiens
caagaggcccagggagc

SEQ ID NO: 5985756 - DNA, 21 bp, Homo sapiens
caagaggcctcatgcctgctg

SEQ ID NO: 5985757 - DNA, 22 bp, Homo sapiens
caagaggcctcatgcctgctga

SEQ ID NO: 5985758 - DNA, 23 bp, Homo sapiens
caagaggcctcatgcctgctgag

SEQ ID NO: 5985759 - DNA, 20 bp, Homo sapiens
caagaggcctttcttttaaa

SEQ ID NO: 5985760 - DNA, 17 bp, Homo sapiens
caagaggctagccccag

SEQ ID NO: 5985761 - DNA, 18 bp, Homo sapiens
caagaggctccctcctgt

SEQ ID NO: 5985762 - DNA, 11 bp, Homo sapiens
caagaggctga

SEQ ID NO: 5985763 - DNA, 22 bp, Homo sapiens
caagaggctggaaaagggctca

SEQ ID NO: 5985764 - DNA, 20 bp, Homo sapiens
caagaggctgttcccaccag

SEQ ID NO: 5985765 - DNA, 15 bp, Homo sapiens
caagagggaacaaaa

SEQ ID NO: 5985766 - DNA, 16 bp, Homo sapiens
caagagggaacaaaac

SEQ ID NO: 5985767 - DNA, 17 bp, Homo sapiens
caagagggacagagccc

SEQ ID NO: 5985768 - DNA, 21 bp, Homo sapiens
caagagggactgtatttctgt

SEQ ID NO: 5985769 - DNA, 18 bp, Homo sapiens
caagagggaggggacaga

SEQ ID NO: 5985770 - DNA, 19 bp, Homo sapiens
caagagggaggggacagag

SEQ ID NO: 5985771 - DNA, 13 bp, Homo sapiens
caagagggcaaag

SEQ ID NO: 5985772 - DNA, 20 bp, Homo sapiens
caagagggcaaagctgattt

SEQ ID NO: 5985773 - DNA, 17 bp, Homo sapiens
caagagggcactggtgg

SEQ ID NO: 5985774 - DNA, 18 bp, Homo sapiens
caagagggcactggtggc

SEQ ID NO: 5985775 - DNA, 19 bp, Homo sapiens
caagagggcactggtggcc

SEQ ID NO: 5985776 - DNA, 20 bp, Homo sapiens
caagagggcactggtggccc

SEQ ID NO: 5985777 - DNA, 12 bp, Homo sapiens
caagagggctgc

SEQ ID NO: 5985778 - DNA, 17 bp, Homo sapiens
caagagggctgcttccc

SEQ ID NO: 5985779 - DNA, 13 bp, Homo sapiens
caagaggggaaaa

SEQ ID NO: 5985780 - DNA, 16 bp, Homo sapiens
caagagggggacctgc

SEQ ID NO: 5985781 - DNA, 17 bp, Homo sapiens
caagagggggtggaggg

SEQ ID NO: 5985782 - DNA, 18 bp, Homo sapiens
caagagggggtggagggg

SEQ ID NO: 5985783 - DNA, 21 bp, Homo sapiens
caagagggtgacagcttcctt

SEQ ID NO: 5985784 - DNA, 18 bp, Homo sapiens
caagagggttcacacagc

SEQ ID NO: 5985785 - DNA, 14 bp, Homo sapiens
caagaggtctgagc

SEQ ID NO: 5985786 - DNA, 14 bp, Homo sapiens
caagaggtgaagtt

SEQ ID NO: 5985787 - DNA, 20 bp, Homo sapiens
caagaggtgcctgggaggag

SEQ ID NO: 5985788 - DNA, 22 bp, Homo sapiens
caagaggtgcctgggaggagtg

SEQ ID NO: 5985789 - DNA, 15 bp, Homo sapiens
caagaggtgggaggg

SEQ ID NO: 5985790 - DNA, 16 bp, Homo sapiens
caagaggtgggagggc

SEQ ID NO: 5985791 - DNA, 20 bp, Homo sapiens
caagaggtttggctcctgcc

SEQ ID NO: 5985792 - DNA, 22 bp, Homo sapiens
caagaggtttggctcctgccca

SEQ ID NO: 5985793 - DNA, 23 bp, Homo sapiens
caagaggtttggctcctgcccac

SEQ ID NO: 5985794 - DNA, 19 bp, Homo sapiens
caagaggtttttctccccg

SEQ ID NO: 5985795 - DNA, 20 bp, Homo sapiens
caagagtaactttactctgt

SEQ ID NO: 5985796 - DNA, 16 bp, Homo sapiens
caagagtaagcagtgt

SEQ ID NO: 5985797 - DNA, 12 bp, Homo sapiens
caagagtacagg

SEQ ID NO: 5985798 - DNA, 20 bp, Homo sapiens
caagagtacaggtcttcttt

SEQ ID NO: 5985799 - DNA, 18 bp, Homo sapiens
caagagtagcaccttcag

SEQ ID NO: 5985800 - DNA, 19 bp, Homo sapiens
caagagtagttatataatt

SEQ ID NO: 5985801 - DNA, 22 bp, Homo sapiens
caagagtagttatataattgtt

SEQ ID NO: 5985802 - DNA, 17 bp, Homo sapiens
caagagtatactttgta

SEQ ID NO: 5985803 - DNA, 16 bp, Homo sapiens
caagagtatgagaaat

SEQ ID NO: 5985804 - DNA, 17 bp, Homo sapiens
caagagtccggatttct

SEQ ID NO: 5985805 - DNA, 18 bp, Homo sapiens
caagagtccggatttcta

SEQ ID NO: 5985806 - DNA, 19 bp, Homo sapiens
caagagtccggatttctaa

SEQ ID NO: 5985807 - DNA, 22 bp, Homo sapiens
caagagtccggatttctaacag

SEQ ID NO: 5985808 - DNA, 13 bp, Homo sapiens
caagagtctctcc

SEQ ID NO: 5985809 - DNA, 16 bp, Homo sapiens
caagagtctctccagc

SEQ ID NO: 5985810 - DNA, 22 bp, Homo sapiens
caagagtgagactccacctcaa

SEQ ID NO: 5985811 - DNA, 23 bp, Homo sapiens
caagagtgatatactccaggact

SEQ ID NO: 5985812 - DNA, 18 bp, Homo sapiens
caagagtgatgggaaaga

SEQ ID NO: 5985813 - DNA, 16 bp, Homo sapiens
caagagtgattcttgc

SEQ ID NO: 5985814 - DNA, 16 bp, Homo sapiens
caagagtggccccacc

SEQ ID NO: 5985815 - DNA, 18 bp, Homo sapiens
caagagtggccccacctg

SEQ ID NO: 5985816 - DNA, 21 bp, Homo sapiens
caagagtggccccacctggcc

SEQ ID NO: 5985817 - DNA, 22 bp, Homo sapiens
caagagtggccccacctggccc

SEQ ID NO: 5985818 - DNA, 17 bp, Homo sapiens
caagagtggggggagga

SEQ ID NO: 5985819 - DNA, 22 bp, Homo sapiens
caagagttctttaggtgcctcc

SEQ ID NO: 5985820 - DNA, 24 bp, Homo sapiens
caagagttctttaggtgcctcctg

SEQ ID NO: 5985821 - DNA, 22 bp, Homo sapiens
caagagtttatttccaaataaa

SEQ ID NO: 5985822 - DNA, 24 bp, Homo sapiens
caagagtttcttgtaagccatcag

SEQ ID NO: 5985823 - DNA, 22 bp, Homo sapiens
caagagtttgttctgttctggg

SEQ ID NO: 5985824 - DNA, 15 bp, Homo sapiens
caagataaaaaacga

SEQ ID NO: 5985825 - DNA, 17 bp, Homo sapiens
caagataaaagaatggc

SEQ ID NO: 5985826 - DNA, 17 bp, Homo sapiens
caagataaagaaaaatg

SEQ ID NO: 5985827 - DNA, 14 bp, Homo sapiens
caagataaattgag

SEQ ID NO: 5985828 - DNA, 16 bp, Homo sapiens
caagataactgagaat

SEQ ID NO: 5985829 - DNA, 14 bp, Homo sapiens
caagataagcctga

SEQ ID NO: 5985830 - DNA, 23 bp, Homo sapiens
caagatacaggaaaaatgaaaat

SEQ ID NO: 5985831 - DNA, 13 bp, Homo sapiens
caagatacttttt

SEQ ID NO: 5985832 - DNA, 22 bp, Homo sapiens
caagatagctccttcatgcttt

SEQ ID NO: 5985833 - DNA, 18 bp, Homo sapiens
caagataggaccttgggc

SEQ ID NO: 5985834 - DNA, 17 bp, Homo sapiens
caagataggagttctct

SEQ ID NO: 5985835 - DNA, 20 bp, Homo sapiens
caagataggagttctctgat

SEQ ID NO: 5985836 - DNA, 21 bp, Homo sapiens
caagatatatgtgtatacata

SEQ ID NO: 5985837 - DNA, 22 bp, Homo sapiens
caagatattatgtataaaatgt

SEQ ID NO: 5985838 - DNA, 16 bp, Homo sapiens
caagatattgtacata

SEQ ID NO: 5985839 - DNA, 19 bp, Homo sapiens
caagatattgtacataaaa

SEQ ID NO: 5985840 - DNA, 17 bp, Homo sapiens
caagatcacataccaga

SEQ ID NO: 5985841 - DNA, 15 bp, Homo sapiens
caagatcattcagtg

SEQ ID NO: 5985842 - DNA, 22 bp, Homo sapiens
caagatccaaatgctgtgcaaa

SEQ ID NO: 5985843 - DNA, 17 bp, Homo sapiens
caagatccaggtggtcc

SEQ ID NO: 5985844 - DNA, 19 bp, Homo sapiens
caagatccatttgcctttc

SEQ ID NO: 5985845 - DNA, 20 bp, Homo sapiens
caagatccatttgcctttct

SEQ ID NO: 5985846 - DNA, 22 bp, Homo sapiens
caagatccatttgcctttctgg

SEQ ID NO: 5985847 - DNA, 22 bp, Homo sapiens
caagatcctcttgccacatctt

SEQ ID NO: 5985848 - DNA, 19 bp, Homo sapiens
caagatcctgtctttaagg

SEQ ID NO: 5985849 - DNA, 17 bp, Homo sapiens
caagatcgcaccactgc

SEQ ID NO: 5985850 - DNA, 15 bp, Homo sapiens
caagatcgctgtgct

SEQ ID NO: 5985851 - DNA, 22 bp, Homo sapiens
caagatcgctgtgctaggtctg

SEQ ID NO: 5985852 - DNA, 20 bp, Homo sapiens
caagatctgtgcagccccgc

SEQ ID NO: 5985853 - DNA, 18 bp, Homo sapiens
caagatcttcaaccatga

SEQ ID NO: 5985854 - DNA, 16 bp, Homo sapiens
caagatcttgtctcca

SEQ ID NO: 5985855 - DNA, 12 bp, Homo sapiens
caagatctttca

SEQ ID NO: 5985856 - DNA, 14 bp, Homo sapiens
caagatgaaataat

SEQ ID NO: 5985857 - DNA, 20 bp, Homo sapiens
caagatgaaattccatttgt

SEQ ID NO: 5985858 - DNA, 14 bp, Homo sapiens
caagatgacagctc

SEQ ID NO: 5985859 - DNA, 19 bp, Homo sapiens
caagatgacagctcttcta

SEQ ID NO: 5985860 - DNA, 23 bp, Homo sapiens
caagatgacagctcttctaagga

SEQ ID NO: 5985861 - DNA, 17 bp, Homo sapiens
caagatgactggggtgg

SEQ ID NO: 5985862 - DNA, 14 bp, Homo sapiens
caagatgagcctgg

SEQ ID NO: 5985863 - DNA, 13 bp, Homo sapiens
caagatgagctgt

SEQ ID NO: 5985864 - DNA, 19 bp, Homo sapiens
caagatgatccttcttaga

SEQ ID NO: 5985865 - DNA, 19 bp, Homo sapiens
caagatgcaaatgttttga

SEQ ID NO: 5985866 - DNA, 22 bp, Homo sapiens
caagatgcactcgctgtgattt

SEQ ID NO: 5985867 - DNA, 20 bp, Homo sapiens
caagatgccatctgtgtcct

SEQ ID NO: 5985868 - DNA, 16 bp, Homo sapiens
caagatgccccaggga

SEQ ID NO: 5985869 - DNA, 13 bp, Homo sapiens
caagatgccctca

SEQ ID NO: 5985870 - DNA, 21 bp, Homo sapiens
caagatgctacaatggaaacc

SEQ ID NO: 5985871 - DNA, 20 bp, Homo sapiens
caagatgcttttcaaactga

SEQ ID NO: 5985872 - DNA, 22 bp, Homo sapiens
caagatggaaaaaaaaaacaaa

SEQ ID NO: 5985873 - DNA, 15 bp, Homo sapiens
caagatggaaaataa

SEQ ID NO: 5985874 - DNA, 18 bp, Homo sapiens
caagatggacacgagcca

SEQ ID NO: 5985875 - DNA, 20 bp, Homo sapiens
caagatggagaggaagaaac

SEQ ID NO: 5985876 - DNA, 16 bp, Homo sapiens
caagatggattaaaga

SEQ ID NO: 5985877 - DNA, 19 bp, Homo sapiens
caagatggattaaagactt

SEQ ID NO: 5985878 - DNA, 19 bp, Homo sapiens
caagatggcgaccaccaaa

SEQ ID NO: 5985879 - DNA, 22 bp, Homo sapiens
caagatggctgctgcctgctca

SEQ ID NO: 5985880 - DNA, 18 bp, Homo sapiens
caagatggctggaaggag

SEQ ID NO: 5985881 - DNA, 13 bp, Homo sapiens
caagatgggacag

SEQ ID NO: 5985882 - DNA, 18 bp, Homo sapiens
caagatgggacagcaaca

SEQ ID NO: 5985883 - DNA, 17 bp, Homo sapiens
caagatgggcacatgag

SEQ ID NO: 5985884 - DNA, 17 bp, Homo sapiens
caagatgggcatctttt

SEQ ID NO: 5985885 - DNA, 20 bp, Homo sapiens
caagatgggcatcttttgta

SEQ ID NO: 5985886 - DNA, 22 bp, Homo sapiens
caagatggggagtgagaggctg

SEQ ID NO: 5985887 - DNA, 19 bp, Homo sapiens
caagatgggtcaagcaagc

SEQ ID NO: 5985888 - DNA, 13 bp, Homo sapiens
caagatgggtccc

SEQ ID NO: 5985889 - DNA, 23 bp, Homo sapiens
caagatgggtgattatgaaatgc

SEQ ID NO: 5985890 - DNA, 14 bp, Homo sapiens
caagatggtccatt

SEQ ID NO: 5985891 - DNA, 23 bp, Homo sapiens
caagatggtccatttgttcctgc

SEQ ID NO: 5985892 - DNA, 20 bp, Homo sapiens
caagatgtcccattgataat

SEQ ID NO: 5985893 - DNA, 12 bp, Homo sapiens
caagatgtgaat

SEQ ID NO: 5985894 - DNA, 18 bp, Homo sapiens
caagatgtgaattattga

SEQ ID NO: 5985895 - DNA, 22 bp, Homo sapiens
caagatgtgaattattgacact

SEQ ID NO: 5985896 - DNA, 23 bp, Homo sapiens
caagatgtgaattattgacactg

SEQ ID NO: 5985897 - DNA, 15 bp, Homo sapiens
caagatgttatatta

SEQ ID NO: 5985898 - DNA, 22 bp, Homo sapiens
caagatgttggggggccccacg

SEQ ID NO: 5985899 - DNA, 18 bp, Homo sapiens
caagatgtttatctgaca

SEQ ID NO: 5985900 - DNA, 17 bp, Homo sapiens
caagatgtttggacacc

SEQ ID NO: 5985901 - DNA, 18 bp, Homo sapiens
caagatgttttgtataaa

SEQ ID NO: 5985902 - DNA, 21 bp, Homo sapiens
caagatgttttgtataaaatc

SEQ ID NO: 5985903 - DNA, 16 bp, Homo sapiens
caagattaattaaaat

SEQ ID NO: 5985904 - DNA, 12 bp, Homo sapiens
caagattagaag

SEQ ID NO: 5985905 - DNA, 17 bp, Homo sapiens
caagattataatatttt

SEQ ID NO: 5985906 - DNA, 16 bp, Homo sapiens
caagattcccagagac

SEQ ID NO: 5985907 - DNA, 19 bp, Homo sapiens
caagattcccaggagttct

SEQ ID NO: 5985908 - DNA, 18 bp, Homo sapiens
caagattctaaagctcaa

SEQ ID NO: 5985909 - DNA, 12 bp, Homo sapiens
caagattctaga

SEQ ID NO: 5985910 - DNA, 17 bp, Homo sapiens
caagattctagatgatt

SEQ ID NO: 5985911 - DNA, 23 bp, Homo sapiens
caagattctgtgggcagctggct

SEQ ID NO: 5985912 - DNA, 12 bp, Homo sapiens
caagattgaaaa

SEQ ID NO: 5985913 - DNA, 19 bp, Homo sapiens
caagattgaaatttgaact

SEQ ID NO: 5985914 - DNA, 16 bp, Homo sapiens
caagattgagctctct

SEQ ID NO: 5985915 - DNA, 18 bp, Homo sapiens
caagattgcttaaaatag

SEQ ID NO: 5985916 - DNA, 21 bp, Homo sapiens
caagattgcttaaaatagcaa

SEQ ID NO: 5985917 - DNA, 17 bp, Homo sapiens
caagattggaaagacag

SEQ ID NO: 5985918 - DNA, 21 bp, Homo sapiens
caagattggtgtttttttcta

SEQ ID NO: 5985919 - DNA, 21 bp, Homo sapiens
caagatttccttaaaatctct

SEQ ID NO: 5985920 - DNA, 15 bp, Homo sapiens
caagatttgtaatta

SEQ ID NO: 5985921 - DNA, 18 bp, Homo sapiens
caagattttaaagacatg

SEQ ID NO: 5985922 - DNA, 17 bp, Homo sapiens
caagattttccacaaga

SEQ ID NO: 5985923 - DNA, 12 bp, Homo sapiens
caagattttcct

SEQ ID NO: 5985924 - DNA, 18 bp, Homo sapiens
caagattttcctcttgtg

SEQ ID NO: 5985925 - DNA, 20 bp, Homo sapiens
cacgcaggagcacacccagc

SEQ ID NO: 5985926 - DNA, 15 bp, Homo sapiens
cacgcaggcacagca

SEQ ID NO: 5985927 - DNA, 17 bp, Homo sapiens
cacgcaggcggccaggg

SEQ ID NO: 5985928 - DNA, 16 bp, Homo sapiens
cacgcaggcggggcag

SEQ ID NO: 5985929 - DNA, 16 bp, Homo sapiens
cacgcaggctgagtcc

SEQ ID NO: 5985930 - DNA, 19 bp, Homo sapiens
cacgcaggctgagtccaga

SEQ ID NO: 5985931 - DNA, 17 bp, Homo sapiens
cacgcagggccatccac

SEQ ID NO: 5985932 - DNA, 20 bp, Homo sapiens
cacgcagggccatccactgt

SEQ ID NO: 5985933 - DNA, 19 bp, Homo sapiens
cacgcaggggccctgagcc

SEQ ID NO: 5985934 - DNA, 22 bp, Homo sapiens
cacgcatgggcattgcagcctt

SEQ ID NO: 5985935 - DNA, 20 bp, Homo sapiens
cacgcatgtccctccaaggc

SEQ ID NO: 5985936 - DNA, 16 bp, Homo sapiens
cacgccaaccccagca

SEQ ID NO: 5985937 - DNA, 24 bp, Homo sapiens
cacgccaaccccagcagtcctggg

SEQ ID NO: 5985938 - DNA, 13 bp, Homo sapiens
cacgccacagccc

SEQ ID NO: 5985939 - DNA, 14 bp, Homo sapiens
cacgccacagccct

SEQ ID NO: 5985940 - DNA, 18 bp, Homo sapiens
cacgccaccgctgccttt

SEQ ID NO: 5985941 - DNA, 15 bp, Homo sapiens
cacgccactgcacta

SEQ ID NO: 5985942 - DNA, 15 bp, Homo sapiens
cacgccagctcctct

SEQ ID NO: 5985943 - DNA, 17 bp, Homo sapiens
cacgccagctggcccag

SEQ ID NO: 5985944 - DNA, 14 bp, Homo sapiens
cacgccattctcct

SEQ ID NO: 5985945 - DNA, 15 bp, Homo sapiens
cacgccattctcctg

SEQ ID NO: 5985946 - DNA, 21 bp, Homo sapiens
cacgccattctcctgcctcag

SEQ ID NO: 5985947 - DNA, 18 bp, Homo sapiens
cacgccattgcactccag

SEQ ID NO: 5985948 - DNA, 19 bp, Homo sapiens
cacgccattgcactccagc

SEQ ID NO: 5985949 - DNA, 23 bp, Homo sapiens
cacgccattgcactccagcctgg

SEQ ID NO: 5985950 - DNA, 20 bp, Homo sapiens
cacgccattgtactccagcc

SEQ ID NO: 5985951 - DNA, 23 bp, Homo sapiens
cacgccattgtactccagcctgg

SEQ ID NO: 5985952 - DNA, 19 bp, Homo sapiens
cacgcccaccagccttgct

SEQ ID NO: 5985953 - DNA, 21 bp, Homo sapiens
cacgcccaccagccttgctct

SEQ ID NO: 5985954 - DNA, 15 bp, Homo sapiens
cacgcccagcctcct

SEQ ID NO: 5985955 - DNA, 22 bp, Homo sapiens
cacgcccagcctcctcccacca

SEQ ID NO: 5985956 - DNA, 20 bp, Homo sapiens
cacgcccagctaatttttgt

SEQ ID NO: 5985957 - DNA, 14 bp, Homo sapiens
cacgcccatgtgtg

SEQ ID NO: 5985958 - DNA, 14 bp, Homo sapiens
cacgccccagcccg

SEQ ID NO: 5985959 - DNA, 18 bp, Homo sapiens
cacgccccagcccgacaa

SEQ ID NO: 5985960 - DNA, 15 bp, Homo sapiens
cacgcccccactggt

SEQ ID NO: 5985961 - DNA, 14 bp, Homo sapiens
cacgcccccaggaa

SEQ ID NO: 5985962 - DNA, 17 bp, Homo sapiens
cacgccccctgtgactt

SEQ ID NO: 5985963 - DNA, 22 bp, Homo sapiens
cacgcccgactctctccatcag

SEQ ID NO: 5985964 - DNA, 16 bp, Homo sapiens
cacgcccgtcctgcct

SEQ ID NO: 5985965 - DNA, 19 bp, Homo sapiens
cacgccctactccactgcc

SEQ ID NO: 5985966 - DNA, 13 bp, Homo sapiens
cacgccctcccct

SEQ ID NO: 5985967 - DNA, 16 bp, Homo sapiens
cacgccctcccctccc

SEQ ID NO: 5985968 - DNA, 24 bp, Homo sapiens
cacgccctcccctcccctgctgca

SEQ ID NO: 5985969 - DNA, 18 bp, Homo sapiens
cacgccctccctctccca

SEQ ID NO: 5985970 - DNA, 17 bp, Homo sapiens
cacgccctccctgctag

SEQ ID NO: 5985971 - DNA, 19 bp, Homo sapiens
cacgccctccctgctagca

SEQ ID NO: 5985972 - DNA, 13 bp, Homo sapiens
cacgccctcctcc

SEQ ID NO: 5985973 - DNA, 12 bp, Homo sapiens
cacgccctgggg

SEQ ID NO: 5985974 - DNA, 20 bp, Homo sapiens
cacgcccttcaatgctgcag

SEQ ID NO: 5985975 - DNA, 19 bp, Homo sapiens
cacgcccttggagccttcc

SEQ ID NO: 5985976 - DNA, 21 bp, Homo sapiens
cacgccgggagaagccacctt

SEQ ID NO: 5985977 - DNA, 23 bp, Homo sapiens
cacgccgggagaagccaccttcc

SEQ ID NO: 5985978 - DNA, 16 bp, Homo sapiens
cacgccggggctggcc

SEQ ID NO: 5985979 - DNA, 20 bp, Homo sapiens
cacgccggggctggccctgc

SEQ ID NO: 5985980 - DNA, 17 bp, Homo sapiens
cacgccgtaattctttc

SEQ ID NO: 5985981 - DNA, 18 bp, Homo sapiens
cacgccgtaattctttct

SEQ ID NO: 5985982 - DNA, 23 bp, Homo sapiens
cacgccgtaattctttctgtctc

SEQ ID NO: 5985983 - DNA, 15 bp, Homo sapiens
cacgcctagcctcac

SEQ ID NO: 5985984 - DNA, 22 bp, Homo sapiens
cacgcctatgatcccagcactt

SEQ ID NO: 5985985 - DNA, 22 bp, Homo sapiens
cacgcctatgccctgcccttcc

SEQ ID NO: 5985986 - DNA, 15 bp, Homo sapiens
cacgcctcccactgg

SEQ ID NO: 5985987 - DNA, 14 bp, Homo sapiens
cacgcctctcccca

SEQ ID NO: 5985988 - DNA, 21 bp, Homo sapiens
cacgcctctccctaggagaag

SEQ ID NO: 5985989 - DNA, 20 bp, Homo sapiens
cacgcctctctcagcccagg

SEQ ID NO: 5985990 - DNA, 13 bp, Homo sapiens
cacgcctgaaact

SEQ ID NO: 5985991 - DNA, 16 bp, Homo sapiens
cacgcctgaaactttg

SEQ ID NO: 5985992 - DNA, 13 bp, Homo sapiens
cacgcctgagcgt

SEQ ID NO: 5985993 - DNA, 14 bp, Homo sapiens
cacgcctgccatct

SEQ ID NO: 5985994 - DNA, 18 bp, Homo sapiens
cacgcctgccatcttctc

SEQ ID NO: 5985995 - DNA, 21 bp, Homo sapiens
cacgcctgcgatggtgctgca

SEQ ID NO: 5985996 - DNA, 12 bp, Homo sapiens
cacgcctggcta

SEQ ID NO: 5985997 - DNA, 16 bp, Homo sapiens
cacgcctggctaattt

SEQ ID NO: 5985998 - DNA, 12 bp, Homo sapiens
cacgcctgggtg

SEQ ID NO: 5985999 - DNA, 18 bp, Homo sapiens
cacgcctgtaatcccagc

SEQ ID NO: 5986000 - DNA, 20 bp, Homo sapiens
cacgcctgtaatcccagcac

SEQ ID NO: 5986001 - DNA, 21 bp, Homo sapiens
cacgcctgtaatcccagcagt

SEQ ID NO: 5986002 - DNA, 19 bp, Homo sapiens
cacgcctgtaatctcagct

SEQ ID NO: 5986003 - DNA, 18 bp, Homo sapiens
cacgcgacttctcaggac

SEQ ID NO: 5986004 - DNA, 20 bp, Homo sapiens
cacgcgacttctcaggacga

SEQ ID NO: 5986005 - DNA, 22 bp, Homo sapiens
cacgcgcgagtgtgctgtatgg

SEQ ID NO: 5986006 - DNA, 23 bp, Homo sapiens
cacgcgcgcacacacacacatac

SEQ ID NO: 5986007 - DNA, 18 bp, Homo sapiens
cacgcgctctccaccacc

SEQ ID NO: 5986008 - DNA, 13 bp, Homo sapiens
cacgcgcttccct

SEQ ID NO: 5986009 - DNA, 19 bp, Homo sapiens
cacgcggccacctcaccct

SEQ ID NO: 5986010 - DNA, 20 bp, Homo sapiens
cacgcggccttgtctgggtg

SEQ ID NO: 5986011 - DNA, 14 bp, Homo sapiens
cacgcggctgctgc

SEQ ID NO: 5986012 - DNA, 15 bp, Homo sapiens
cacgcggctgctgct

SEQ ID NO: 5986013 - DNA, 15 bp, Homo sapiens
cacgcgggggccttg

SEQ ID NO: 5986014 - DNA, 14 bp, Homo sapiens
cacgcgtatttaca

SEQ ID NO: 5986015 - DNA, 17 bp, Homo sapiens
cacgcgtccacatacac

SEQ ID NO: 5986016 - DNA, 16 bp, Homo sapiens
cacgcgtgcacacacc

SEQ ID NO: 5986017 - DNA, 21 bp, Homo sapiens
cacgcgtgcacacaccagagc

SEQ ID NO: 5986018 - DNA, 17 bp, Homo sapiens
cacgcgtgccgtggcac

SEQ ID NO: 5986019 - DNA, 12 bp, Homo sapiens
cacgctcaccca

SEQ ID NO: 5986020 - DNA, 13 bp, Homo sapiens
cacgctcacccag

SEQ ID NO: 5986021 - DNA, 13 bp, Homo sapiens
cacgctcagtgcc

SEQ ID NO: 5986022 - DNA, 14 bp, Homo sapiens
cacgctcagtgccc

SEQ ID NO: 5986023 - DNA, 13 bp, Homo sapiens
cacgctcatcttg

SEQ ID NO: 5986024 - DNA, 15 bp, Homo sapiens
cacgctcatgtcctg

SEQ ID NO: 5986025 - DNA, 20 bp, Homo sapiens
cacgctcatgtcctgtcctg

SEQ ID NO: 5986026 - DNA, 12 bp, Homo sapiens
cacgctccagct

SEQ ID NO: 5986027 - DNA, 12 bp, Homo sapiens
cacgctcccctc

SEQ ID NO: 5986028 - DNA, 21 bp, Homo sapiens
cacgctccctgacttctcccc

SEQ ID NO: 5986029 - DNA, 15 bp, Homo sapiens
cacgctcctgccctc

SEQ ID NO: 5986030 - DNA, 12 bp, Homo sapiens
cacgctcctttc

SEQ ID NO: 5986031 - DNA, 22 bp, Homo sapiens
cacgctcctttctgatcttcac

SEQ ID NO: 5986032 - DNA, 23 bp, Homo sapiens
cacgctcgcgggcagcgggccag

SEQ ID NO: 5986033 - DNA, 12 bp, Homo sapiens
cacgctcgctgc

SEQ ID NO: 5986034 - DNA, 17 bp, Homo sapiens
cacgctcgctgccatca

SEQ ID NO: 5986035 - DNA, 13 bp, Homo sapiens
cacgctctggtgc

SEQ ID NO: 5986036 - DNA, 19 bp, Homo sapiens
cacgctgacagcctcctag

SEQ ID NO: 5986037 - DNA, 19 bp, Homo sapiens
cacgctgactacagggccg

SEQ ID NO: 5986038 - DNA, 20 bp, Homo sapiens
cacgctgccatttccctgaa

SEQ ID NO: 5986039 - DNA, 23 bp, Homo sapiens
cacgctgccatttccctgaacag

SEQ ID NO: 5986040 - DNA, 13 bp, Homo sapiens
cacgctgcccagg

SEQ ID NO: 5986041 - DNA, 17 bp, Homo sapiens
cacgctgcccaggctct

SEQ ID NO: 5986042 - DNA, 19 bp, Homo sapiens
cacgctgcctcctcagcag

SEQ ID NO: 5986043 - DNA, 12 bp, Homo sapiens
cacgctgcctgg

SEQ ID NO: 5986044 - DNA, 14 bp, Homo sapiens
cacgctgcctggtc

SEQ ID NO: 5986045 - DNA, 22 bp, Homo sapiens
cacgctgcctggtctgtctgga

SEQ ID NO: 5986046 - DNA, 16 bp, Homo sapiens
cacgctgctctgcccc

SEQ ID NO: 5986047 - DNA, 20 bp, Homo sapiens
cacgctggaccttgaactgg

SEQ ID NO: 5986048 - DNA, 15 bp, Homo sapiens
cacgctggagtgcag

SEQ ID NO: 5986049 - DNA, 17 bp, Homo sapiens
cacgctggagtgcagtg

SEQ ID NO: 5986050 - DNA, 18 bp, Homo sapiens
cacgctggagtgcagtga

SEQ ID NO: 5986051 - DNA, 20 bp, Homo sapiens
cacgctggccttcgtctcca

SEQ ID NO: 5986052 - DNA, 17 bp, Homo sapiens
cacgctgggacacagac

SEQ ID NO: 5986053 - DNA, 12 bp, Homo sapiens
cacgctgggcct

SEQ ID NO: 5986054 - DNA, 14 bp, Homo sapiens
cacgctggggaaga

SEQ ID NO: 5986055 - DNA, 18 bp, Homo sapiens
cacgctggggctctctga

SEQ ID NO: 5986056 - DNA, 20 bp, Homo sapiens
cacgctggggctctctgaga

SEQ ID NO: 5986057 - DNA, 23 bp, Homo sapiens
cacgctgtcctctcgagcccaga

SEQ ID NO: 5986058 - DNA, 18 bp, Homo sapiens
cacgctgtctccagaccc

SEQ ID NO: 5986059 - DNA, 20 bp, Homo sapiens
cacgctgtctccagaccccc

SEQ ID NO: 5986060 - DNA, 16 bp, Homo sapiens
cacgctgtgggcaggt

SEQ ID NO: 5986061 - DNA, 20 bp, Homo sapiens
cacgcttagggtctgtcccg

SEQ ID NO: 5986062 - DNA, 14 bp, Homo sapiens
cacgcttcacagtg

SEQ ID NO: 5986063 - DNA, 14 bp, Homo sapiens
cacgcttctccgga

SEQ ID NO: 5986064 - DNA, 16 bp, Homo sapiens
cacgcttctgagcagg

SEQ ID NO: 5986065 - DNA, 17 bp, Homo sapiens
cacgcttctgagcaggg

SEQ ID NO: 5986066 - DNA, 19 bp, Homo sapiens
cacgcttgacaggacagca

SEQ ID NO: 5986067 - DNA, 15 bp, Homo sapiens
cacgctttgtttact

SEQ ID NO: 5986068 - DNA, 16 bp, Homo sapiens
cacgctttgtttactc

SEQ ID NO: 5986069 - DNA, 20 bp, Homo sapiens
cacggaaaatgccaatctct

SEQ ID NO: 5986070 - DNA, 16 bp, Homo sapiens
cacggaagagccttgc

SEQ ID NO: 5986071 - DNA, 20 bp, Homo sapiens
cacggaaggcgggctgagga

SEQ ID NO: 5986072 - DNA, 23 bp, Homo sapiens
cacggaccaaagggagtctgcca

SEQ ID NO: 5986073 - DNA, 18 bp, Homo sapiens
cacggaccactcgaggcc

SEQ ID NO: 5986074 - DNA, 15 bp, Homo sapiens
cacggaccctgtgtg

SEQ ID NO: 5986075 - DNA, 16 bp, Homo sapiens
cacggacgctggctcc

SEQ ID NO: 5986076 - DNA, 17 bp, Homo sapiens
cacggacgtttccatca

SEQ ID NO: 5986077 - DNA, 15 bp, Homo sapiens
cacggactctcccag

SEQ ID NO: 5986078 - DNA, 18 bp, Homo sapiens
cacggactctttgctgtt

SEQ ID NO: 5986079 - DNA, 18 bp, Homo sapiens
cacggagccactcctctg

SEQ ID NO: 5986080 - DNA, 23 bp, Homo sapiens
cacggagccactcctctgactca

SEQ ID NO: 5986081 - DNA, 19 bp, Homo sapiens
cacggagcccagccctccc

SEQ ID NO: 5986082 - DNA, 17 bp, Homo sapiens
cacggagcgggaggcag

SEQ ID NO: 5986083 - DNA, 15 bp, Homo sapiens
cacggagctcctggc

SEQ ID NO: 5986084 - DNA, 23 bp, Homo sapiens
cacggaggagttttggcagccag

SEQ ID NO: 5986085 - DNA, 19 bp, Homo sapiens
cacggaggatgatgccagt

SEQ ID NO: 5986086 - DNA, 16 bp, Homo sapiens
cacggaggccagacac

SEQ ID NO: 5986087 - DNA, 23 bp, Homo sapiens
cacggaggcctcgagcagagaga

SEQ ID NO: 5986088 - DNA, 16 bp, Homo sapiens
cacggagggaggcacc

SEQ ID NO: 5986089 - DNA, 23 bp, Homo sapiens
cacggagggggacggggctcagc

SEQ ID NO: 5986090 - DNA, 23 bp, Homo sapiens
cacggagtcgtggggtgtgctgg

SEQ ID NO: 5986091 - DNA, 19 bp, Homo sapiens
cacggagtgttggggctgg

SEQ ID NO: 5986092 - DNA, 23 bp, Homo sapiens
cacggagtgttggggctgggggc

SEQ ID NO: 5986093 - DNA, 19 bp, Homo sapiens
cacggagtttccatttgga

SEQ ID NO: 5986094 - DNA, 14 bp, Homo sapiens
cacggatctgagaa

SEQ ID NO: 5986095 - DNA, 19 bp, Homo sapiens
cacggatgcgtgggcagag

SEQ ID NO: 5986096 - DNA, 16 bp, Homo sapiens
cacggatggtgcatgg

SEQ ID NO: 5986097 - DNA, 17 bp, Homo sapiens
cacggatttagtcccac

SEQ ID NO: 5986098 - DNA, 13 bp, Homo sapiens
cacggcacagagc

SEQ ID NO: 5986099 - DNA, 13 bp, Homo sapiens
cacggcactccag

SEQ ID NO: 5986100 - DNA, 17 bp, Homo sapiens
cacggcagaccagaacg

SEQ ID NO: 5986101 - DNA, 22 bp, Homo sapiens
cacggcagccaccctgccatgg

SEQ ID NO: 5986102 - DNA, 12 bp, Homo sapiens
cacggcagcccc

SEQ ID NO: 5986103 - DNA, 19 bp, Homo sapiens
caagattttccttttttat

SEQ ID NO: 5986104 - DNA, 21 bp, Homo sapiens
caagattttccttttttatac

SEQ ID NO: 5986105 - DNA, 21 bp, Homo sapiens
caagattttttaattgtttaa

SEQ ID NO: 5986106 - DNA, 19 bp, Homo sapiens
caagattttttttgtaact

SEQ ID NO: 5986107 - DNA, 21 bp, Homo sapiens
caagattttttttttaagtga

SEQ ID NO: 5986108 - DNA, 16 bp, Homo sapiens
caagcaaaaggagaga

SEQ ID NO: 5986109 - DNA, 20 bp, Homo sapiens
caagcaaaatctaaaatgtt

SEQ ID NO: 5986110 - DNA, 18 bp, Homo sapiens
caagcaaacagggtggcc

SEQ ID NO: 5986111 - DNA, 23 bp, Homo sapiens
caagcaaacatcaaataaatttc

SEQ ID NO: 5986112 - DNA, 18 bp, Homo sapiens
caagcaaaccttctcagg

SEQ ID NO: 5986113 - DNA, 13 bp, Homo sapiens
caagcaaactgaa

SEQ ID NO: 5986114 - DNA, 20 bp, Homo sapiens
caagcaaagacagtttcttg

SEQ ID NO: 5986115 - DNA, 12 bp, Homo sapiens
caagcaaagcag

SEQ ID NO: 5986116 - DNA, 19 bp, Homo sapiens
caagcaaaggtgaagagac

SEQ ID NO: 5986117 - DNA, 20 bp, Homo sapiens
caagcaaatgcctgccaaat

SEQ ID NO: 5986118 - DNA, 14 bp, Homo sapiens
caagcaaatgttac

SEQ ID NO: 5986119 - DNA, 22 bp, Homo sapiens
caagcaacaaacctcactgaga

SEQ ID NO: 5986120 - DNA, 13 bp, Homo sapiens
caagcaacaagcc

SEQ ID NO: 5986121 - DNA, 18 bp, Homo sapiens
caagcaacaagctatttt

SEQ ID NO: 5986122 - DNA, 15 bp, Homo sapiens
caagcaacagcactt

SEQ ID NO: 5986123 - DNA, 23 bp, Homo sapiens
caagcaacagcactttctgtagt

SEQ ID NO: 5986124 - DNA, 14 bp, Homo sapiens
caagcaacagcctt

SEQ ID NO: 5986125 - DNA, 17 bp, Homo sapiens
caagcaacataaaacaa

SEQ ID NO: 5986126 - DNA, 18 bp, Homo sapiens
caagcaacattcttgtta

SEQ ID NO: 5986127 - DNA, 14 bp, Homo sapiens
caagcaagactgag

SEQ ID NO: 5986128 - DNA, 16 bp, Homo sapiens
caagcaagatgagctg

SEQ ID NO: 5986129 - DNA, 14 bp, Homo sapiens
caagcaagcagaca

SEQ ID NO: 5986130 - DNA, 18 bp, Homo sapiens
caagcaagtcccttcaga

SEQ ID NO: 5986131 - DNA, 12 bp, Homo sapiens
caagcaataatt

SEQ ID NO: 5986132 - DNA, 14 bp, Homo sapiens
caagcaataattag

SEQ ID NO: 5986133 - DNA, 18 bp, Homo sapiens
caagcaataattaggatc

SEQ ID NO: 5986134 - DNA, 14 bp, Homo sapiens
caagcaataattgt

SEQ ID NO: 5986135 - DNA, 15 bp, Homo sapiens
caagcaatcctcctg

SEQ ID NO: 5986136 - DNA, 22 bp, Homo sapiens
caagcaatccttctgccttggc

SEQ ID NO: 5986137 - DNA, 13 bp, Homo sapiens
caagcaatgcaag

SEQ ID NO: 5986138 - DNA, 20 bp, Homo sapiens
caagcaattagaagccatcc

SEQ ID NO: 5986139 - DNA, 20 bp, Homo sapiens
caagcacaatggtttcaaag

SEQ ID NO: 5986140 - DNA, 14 bp, Homo sapiens
caagcacagacatt

SEQ ID NO: 5986141 - DNA, 14 bp, Homo sapiens
caagcacagagcct

SEQ ID NO: 5986142 - DNA, 16 bp, Homo sapiens
caagcacagagcctgg

SEQ ID NO: 5986143 - DNA, 13 bp, Homo sapiens
caagcacatgtaa

SEQ ID NO: 5986144 - DNA, 17 bp, Homo sapiens
caagcaccaacctccag

SEQ ID NO: 5986145 - DNA, 20 bp, Homo sapiens
caagcaccaacctccagact

SEQ ID NO: 5986146 - DNA, 22 bp, Homo sapiens
caagcaccaccaaacacagtgt

SEQ ID NO: 5986147 - DNA, 14 bp, Homo sapiens
caagcaccactctg

SEQ ID NO: 5986148 - DNA, 14 bp, Homo sapiens
caagcaccaggaag

SEQ ID NO: 5986149 - DNA, 15 bp, Homo sapiens
caagcaccaggaagt

SEQ ID NO: 5986150 - DNA, 16 bp, Homo sapiens
caagcaccagggaaga

SEQ ID NO: 5986151 - DNA, 13 bp, Homo sapiens
caagcaccatccc

SEQ ID NO: 5986152 - DNA, 12 bp, Homo sapiens
caagcaccccag

SEQ ID NO: 5986153 - DNA, 17 bp, Homo sapiens
caagcaccccagacctc

SEQ ID NO: 5986154 - DNA, 18 bp, Homo sapiens
caagcaccctgttccctc

SEQ ID NO: 5986155 - DNA, 14 bp, Homo sapiens
caagcacctcctgc

SEQ ID NO: 5986156 - DNA, 18 bp, Homo sapiens
caagcacctcctgcctcg

SEQ ID NO: 5986157 - DNA, 12 bp, Homo sapiens
caagcacctgca

SEQ ID NO: 5986158 - DNA, 21 bp, Homo sapiens
caagcacctgggtgtgctcca

SEQ ID NO: 5986159 - DNA, 22 bp, Homo sapiens
caagcacctgggtgtgctccag

SEQ ID NO: 5986160 - DNA, 16 bp, Homo sapiens
caagcacgaggcctca

SEQ ID NO: 5986161 - DNA, 16 bp, Homo sapiens
caagcactaaaaagtg

SEQ ID NO: 5986162 - DNA, 17 bp, Homo sapiens
caagcactaaacaaaga

SEQ ID NO: 5986163 - DNA, 17 bp, Homo sapiens
caagcactagccttccc

SEQ ID NO: 5986164 - DNA, 18 bp, Homo sapiens
caagcactcgagaccatc

SEQ ID NO: 5986165 - DNA, 22 bp, Homo sapiens
caagcactcgagaccatcctgg

SEQ ID NO: 5986166 - DNA, 12 bp, Homo sapiens
caagcactgata

SEQ ID NO: 5986167 - DNA, 20 bp, Homo sapiens
caagcactgctcacgtctct

SEQ ID NO: 5986168 - DNA, 22 bp, Homo sapiens
caagcactgctcacgtctctgc

SEQ ID NO: 5986169 - DNA, 23 bp, Homo sapiens
caagcactgctcacgtctctgcc

SEQ ID NO: 5986170 - DNA, 16 bp, Homo sapiens
caagcacttcacagct

SEQ ID NO: 5986171 - DNA, 13 bp, Homo sapiens
caagcacttccca

SEQ ID NO: 5986172 - DNA, 19 bp, Homo sapiens
caagcacttcccaggatct

SEQ ID NO: 5986173 - DNA, 20 bp, Homo sapiens
caagcactttacgctgtctg

SEQ ID NO: 5986174 - DNA, 19 bp, Homo sapiens
caagcacttttcctgtctc

SEQ ID NO: 5986175 - DNA, 17 bp, Homo sapiens
caagcagaaaaattaaa

SEQ ID NO: 5986176 - DNA, 12 bp, Homo sapiens
caagcagaaaac

SEQ ID NO: 5986177 - DNA, 23 bp, Homo sapiens
caagcagacgtgagtgtgacttt

SEQ ID NO: 5986178 - DNA, 14 bp, Homo sapiens
caagcagactccag

SEQ ID NO: 5986179 - DNA, 20 bp, Homo sapiens
caagcagaggaccagggcct

SEQ ID NO: 5986180 - DNA, 17 bp, Homo sapiens
caagcagaggtggccag

SEQ ID NO: 5986181 - DNA, 19 bp, Homo sapiens
caagcagagtgattcaggg

SEQ ID NO: 5986182 - DNA, 16 bp, Homo sapiens
caagcagatactgctg

SEQ ID NO: 5986183 - DNA, 18 bp, Homo sapiens
caagcagatctcatctca

SEQ ID NO: 5986184 - DNA, 17 bp, Homo sapiens
caagcagatctgctttt

SEQ ID NO: 5986185 - DNA, 12 bp, Homo sapiens
caagcagattcg

SEQ ID NO: 5986186 - DNA, 21 bp, Homo sapiens
caagcagattggagaaaccct

SEQ ID NO: 5986187 - DNA, 12 bp, Homo sapiens
caagcagccaag

SEQ ID NO: 5986188 - DNA, 13 bp, Homo sapiens
caagcagccaagc

SEQ ID NO: 5986189 - DNA, 11 bp, Homo sapiens
caagcagccag

SEQ ID NO: 5986190 - DNA, 15 bp, Homo sapiens
caagcagccagccag

SEQ ID NO: 5986191 - DNA, 17 bp, Homo sapiens
caagcagccagccagtc

SEQ ID NO: 5986192 - DNA, 14 bp, Homo sapiens
caagcagcccttgc

SEQ ID NO: 5986193 - DNA, 15 bp, Homo sapiens
caagcagcccttgct

SEQ ID NO: 5986194 - DNA, 16 bp, Homo sapiens
caagcagccgcagcgc

SEQ ID NO: 5986195 - DNA, 16 bp, Homo sapiens
caagcagcctcctggg

SEQ ID NO: 5986196 - DNA, 16 bp, Homo sapiens
caagcagcctggagac

SEQ ID NO: 5986197 - DNA, 22 bp, Homo sapiens
caagcagcgaccgccccctcct

SEQ ID NO: 5986198 - DNA, 16 bp, Homo sapiens
caagcagctgaagaaa

SEQ ID NO: 5986199 - DNA, 22 bp, Homo sapiens
caagcagctggtcagtctttgc

SEQ ID NO: 5986200 - DNA, 18 bp, Homo sapiens
caagcagcttagagttgg

SEQ ID NO: 5986201 - DNA, 14 bp, Homo sapiens
caagcaggaagctc

SEQ ID NO: 5986202 - DNA, 16 bp, Homo sapiens
caagcaggaagctcag

SEQ ID NO: 5986203 - DNA, 17 bp, Homo sapiens
caagcaggaagctcaga

SEQ ID NO: 5986204 - DNA, 16 bp, Homo sapiens
caagcaggaattatgt

SEQ ID NO: 5986205 - DNA, 17 bp, Homo sapiens
caagcaggaattatgtc

SEQ ID NO: 5986206 - DNA, 17 bp, Homo sapiens
caagcaggacagtgctt

SEQ ID NO: 5986207 - DNA, 18 bp, Homo sapiens
caagcaggacctggcatc

SEQ ID NO: 5986208 - DNA, 19 bp, Homo sapiens
caagcaggagacgacaggc

SEQ ID NO: 5986209 - DNA, 15 bp, Homo sapiens
caagcaggatggctg

SEQ ID NO: 5986210 - DNA, 13 bp, Homo sapiens
caagcaggcactg

SEQ ID NO: 5986211 - DNA, 14 bp, Homo sapiens
caagcaggcactgt

SEQ ID NO: 5986212 - DNA, 19 bp, Homo sapiens
caagcaggcgctgtgctat

SEQ ID NO: 5986213 - DNA, 18 bp, Homo sapiens
caagcaggctcaacataa

SEQ ID NO: 5986214 - DNA, 19 bp, Homo sapiens
caagcagggaaagctccac

SEQ ID NO: 5986215 - DNA, 23 bp, Homo sapiens
caagcagggaaagctccacggtg

SEQ ID NO: 5986216 - DNA, 12 bp, Homo sapiens
caagcaggggtc

SEQ ID NO: 5986217 - DNA, 16 bp, Homo sapiens
caagcagtagacaagc

SEQ ID NO: 5986218 - DNA, 12 bp, Homo sapiens
caagcagtccct

SEQ ID NO: 5986219 - DNA, 18 bp, Homo sapiens
caagcagtctacccacct

SEQ ID NO: 5986220 - DNA, 19 bp, Homo sapiens
caagcagtctaccctgtcc

SEQ ID NO: 5986221 - DNA, 20 bp, Homo sapiens
caagcagtctaccctgtcct

SEQ ID NO: 5986222 - DNA, 22 bp, Homo sapiens
caagcagtctaccctgtccttt

SEQ ID NO: 5986223 - DNA, 16 bp, Homo sapiens
caagcagtgcctgcct

SEQ ID NO: 5986224 - DNA, 16 bp, Homo sapiens
caagcagtttcaataa

SEQ ID NO: 5986225 - DNA, 22 bp, Homo sapiens
caagcagtttcaataaagtttg

SEQ ID NO: 5986226 - DNA, 21 bp, Homo sapiens
caagcataccaacacgagcag

SEQ ID NO: 5986227 - DNA, 15 bp, Homo sapiens
caagcatattggaaa

SEQ ID NO: 5986228 - DNA, 15 bp, Homo sapiens
caagcatcacttttt

SEQ ID NO: 5986229 - DNA, 16 bp, Homo sapiens
caagcatcagcaagac

SEQ ID NO: 5986230 - DNA, 18 bp, Homo sapiens
caagcatcagtagctgag

SEQ ID NO: 5986231 - DNA, 17 bp, Homo sapiens
caagcatcatggatcaa

SEQ ID NO: 5986232 - DNA, 15 bp, Homo sapiens
caagcatcctcagaa

SEQ ID NO: 5986233 - DNA, 13 bp, Homo sapiens
caagcatctcctg

SEQ ID NO: 5986234 - DNA, 15 bp, Homo sapiens
caagcatctcctgag

SEQ ID NO: 5986235 - DNA, 17 bp, Homo sapiens
caagcatgcagctttgc

SEQ ID NO: 5986236 - DNA, 14 bp, Homo sapiens
caagcatgccccac

SEQ ID NO: 5986237 - DNA, 21 bp, Homo sapiens
caagcatggctattttatatt

SEQ ID NO: 5986238 - DNA, 23 bp, Homo sapiens
caagcatgggggaccccttccca

SEQ ID NO: 5986239 - DNA, 22 bp, Homo sapiens
caagcatggtcccacatccctg

SEQ ID NO: 5986240 - DNA, 21 bp, Homo sapiens
caagcatgtatttttgtcaat

SEQ ID NO: 5986241 - DNA, 14 bp, Homo sapiens
caagcatgtctctc

SEQ ID NO: 5986242 - DNA, 18 bp, Homo sapiens
caagcatgtctctctgcc

SEQ ID NO: 5986243 - DNA, 20 bp, Homo sapiens
caagcatgtttaaaacaaat

SEQ ID NO: 5986244 - DNA, 15 bp, Homo sapiens
caagcattactttaa

SEQ ID NO: 5986245 - DNA, 17 bp, Homo sapiens
caagcattcagaagaaa

SEQ ID NO: 5986246 - DNA, 15 bp, Homo sapiens
caagcattccttagc

SEQ ID NO: 5986247 - DNA, 21 bp, Homo sapiens
caagcattccttagcagctca

SEQ ID NO: 5986248 - DNA, 22 bp, Homo sapiens
caagcattccttagcagctcag

SEQ ID NO: 5986249 - DNA, 16 bp, Homo sapiens
caagcatttagatgta

SEQ ID NO: 5986250 - DNA, 12 bp, Homo sapiens
caagcatttcat

SEQ ID NO: 5986251 - DNA, 19 bp, Homo sapiens
caagcatttcatgaaaaag

SEQ ID NO: 5986252 - DNA, 16 bp, Homo sapiens
caagcatttgccctgt

SEQ ID NO: 5986253 - DNA, 14 bp, Homo sapiens
caagcatttttcca

SEQ ID NO: 5986254 - DNA, 20 bp, Homo sapiens
caagccaaaagtccctccct

SEQ ID NO: 5986255 - DNA, 15 bp, Homo sapiens
caagccaaacattct

SEQ ID NO: 5986256 - DNA, 21 bp, Homo sapiens
caagccaaacattcttatttt

SEQ ID NO: 5986257 - DNA, 16 bp, Homo sapiens
caagccaaagagcctc

SEQ ID NO: 5986258 - DNA, 20 bp, Homo sapiens
caagccaaagagcctcccac

SEQ ID NO: 5986259 - DNA, 21 bp, Homo sapiens
caagccaaagagcctcccacc

SEQ ID NO: 5986260 - DNA, 13 bp, Homo sapiens
caagccaagcagc

SEQ ID NO: 5986261 - DNA, 21 bp, Homo sapiens
caagccaagcagccaagctcc

SEQ ID NO: 5986262 - DNA, 22 bp, Homo sapiens
caagccaatcccctccttgggc

SEQ ID NO: 5986263 - DNA, 11 bp, Homo sapiens
caagccacaga

SEQ ID NO: 5986264 - DNA, 13 bp, Homo sapiens
caagccacagaag

SEQ ID NO: 5986265 - DNA, 19 bp, Homo sapiens
caagccacagaagccagga

SEQ ID NO: 5986266 - DNA, 13 bp, Homo sapiens
caagccacagcct

SEQ ID NO: 5986267 - DNA, 22 bp, Homo sapiens
caagccaccaaattacctaggc

SEQ ID NO: 5986268 - DNA, 18 bp, Homo sapiens
caagccaccgcagctgct

SEQ ID NO: 5986269 - DNA, 22 bp, Homo sapiens
caagccaccgcagctgctgcca

SEQ ID NO: 5986270 - DNA, 17 bp, Homo sapiens
caagccacgcctgcgat

SEQ ID NO: 5986271 - DNA, 23 bp, Homo sapiens
caagccactagcccactccccag

SEQ ID NO: 5986272 - DNA, 13 bp, Homo sapiens
caagccagagccg

SEQ ID NO: 5986273 - DNA, 15 bp, Homo sapiens
caagccagaggctgg

SEQ ID NO: 5986274 - DNA, 22 bp, Homo sapiens
caagccagccccctccagctca

SEQ ID NO: 5986275 - DNA, 14 bp, Homo sapiens
caagccagctgcct

SEQ ID NO: 5986276 - DNA, 17 bp, Homo sapiens
caagccagctgcctagg

SEQ ID NO: 5986277 - DNA, 20 bp, Homo sapiens
caagccagcttcctgtgcag

SEQ ID NO: 5986278 - DNA, 22 bp, Homo sapiens
caagccaggagaagacccctgc

SEQ ID NO: 5986279 - DNA, 22 bp, Homo sapiens
caagccaggccctctctgcagt

SEQ ID NO: 5986280 - DNA, 13 bp, Homo sapiens
caagccaggctca

SEQ ID NO: 5986281 - DNA, 19 bp, Homo sapiens
caagccaggctcactcaca

SEQ ID NO: 5986282 - DNA, 23 bp, Homo sapiens
caagccagggatggggccacagc

SEQ ID NO: 5986283 - DNA, 17 bp, Homo sapiens
cacggcagcccccccct

SEQ ID NO: 5986284 - DNA, 23 bp, Homo sapiens
cacggcagcccccccctcaaggg

SEQ ID NO: 5986285 - DNA, 16 bp, Homo sapiens
cacggcagcctcaacc

SEQ ID NO: 5986286 - DNA, 20 bp, Homo sapiens
cacggcagcctcaacctccc

SEQ ID NO: 5986287 - DNA, 11 bp, Homo sapiens
cacggcagctt

SEQ ID NO: 5986288 - DNA, 19 bp, Homo sapiens
cacggcagcttgagcctgt

SEQ ID NO: 5986289 - DNA, 20 bp, Homo sapiens
cacggcaggacaacgaggaa

SEQ ID NO: 5986290 - DNA, 22 bp, Homo sapiens
cacggcaggacaacgaggaagc

SEQ ID NO: 5986291 - DNA, 22 bp, Homo sapiens
cacggcaggcgtgtggcagcca

SEQ ID NO: 5986292 - DNA, 22 bp, Homo sapiens
cacggcatcgcatccgtcctgg

SEQ ID NO: 5986293 - DNA, 20 bp, Homo sapiens
cacggccacacagctgccgg

SEQ ID NO: 5986294 - DNA, 22 bp, Homo sapiens
cacggccacccacccttctccc

SEQ ID NO: 5986295 - DNA, 15 bp, Homo sapiens
cacggccacccgccc

SEQ ID NO: 5986296 - DNA, 16 bp, Homo sapiens
cacggccacccgcccc

SEQ ID NO: 5986297 - DNA, 13 bp, Homo sapiens
cacggccaccctc

SEQ ID NO: 5986298 - DNA, 15 bp, Homo sapiens
cacggccaccctcct

SEQ ID NO: 5986299 - DNA, 19 bp, Homo sapiens
cacggccactgcagtcacc

SEQ ID NO: 5986300 - DNA, 13 bp, Homo sapiens
cacggccagaagt

SEQ ID NO: 5986301 - DNA, 17 bp, Homo sapiens
cacggccaggccagagg

SEQ ID NO: 5986302 - DNA, 23 bp, Homo sapiens
cacggccatgagggctggagacc

SEQ ID NO: 5986303 - DNA, 15 bp, Homo sapiens
cacggccccgggtcc

SEQ ID NO: 5986304 - DNA, 19 bp, Homo sapiens
cacggccccgggtccagga

SEQ ID NO: 5986305 - DNA, 18 bp, Homo sapiens
cacggcccggcccctcac

SEQ ID NO: 5986306 - DNA, 15 bp, Homo sapiens
cacggccctcctggg

SEQ ID NO: 5986307 - DNA, 15 bp, Homo sapiens
cacggccctccttct

SEQ ID NO: 5986308 - DNA, 20 bp, Homo sapiens
cacggccctccttcttttcc

SEQ ID NO: 5986309 - DNA, 14 bp, Homo sapiens
cacggccctgcccc

SEQ ID NO: 5986310 - DNA, 17 bp, Homo sapiens
cacggccgctccagggg

SEQ ID NO: 5986311 - DNA, 16 bp, Homo sapiens
cacggccgtccctgac

SEQ ID NO: 5986312 - DNA, 12 bp, Homo sapiens
cacggcctggca

SEQ ID NO: 5986313 - DNA, 19 bp, Homo sapiens
cacggcctggcatgcagct

SEQ ID NO: 5986314 - DNA, 18 bp, Homo sapiens
cacggcgggatcctccac

SEQ ID NO: 5986315 - DNA, 23 bp, Homo sapiens
cacggcgggatcctccacagaga

SEQ ID NO: 5986316 - DNA, 17 bp, Homo sapiens
cacggcgtttttttaca

SEQ ID NO: 5986317 - DNA, 20 bp, Homo sapiens
cacggctaagaggctgctga

SEQ ID NO: 5986318 - DNA, 20 bp, Homo sapiens
cacggctcactgcagcctca

SEQ ID NO: 5986319 - DNA, 17 bp, Homo sapiens
cacggctcccccaggcc

SEQ ID NO: 5986320 - DNA, 19 bp, Homo sapiens
cacggctcccccaggcctg

SEQ ID NO: 5986321 - DNA, 23 bp, Homo sapiens
cacggctcccccaggcctgagct

SEQ ID NO: 5986322 - DNA, 22 bp, Homo sapiens
cacggctccgagggcggccagg

SEQ ID NO: 5986323 - DNA, 20 bp, Homo sapiens
cacggctctgtccccagcct

SEQ ID NO: 5986324 - DNA, 14 bp, Homo sapiens
cacggctctgtgcc

SEQ ID NO: 5986325 - DNA, 16 bp, Homo sapiens
cacggctctgtgcccg

SEQ ID NO: 5986326 - DNA, 13 bp, Homo sapiens
cacggctgagcct

SEQ ID NO: 5986327 - DNA, 23 bp, Homo sapiens
cacggctgagccttcagagtacg

SEQ ID NO: 5986328 - DNA, 18 bp, Homo sapiens
cacggctgcacctgcagg

SEQ ID NO: 5986329 - DNA, 20 bp, Homo sapiens
cacggctgcacctgcaggga

SEQ ID NO: 5986330 - DNA, 23 bp, Homo sapiens
cacggctgcctgacactgagccc

SEQ ID NO: 5986331 - DNA, 14 bp, Homo sapiens
cacggctgctcggc

SEQ ID NO: 5986332 - DNA, 13 bp, Homo sapiens
cacggctgctgag

SEQ ID NO: 5986333 - DNA, 20 bp, Homo sapiens
cacggctggtcactctgccc

SEQ ID NO: 5986334 - DNA, 22 bp, Homo sapiens
cacggctggtcactctgccctc

SEQ ID NO: 5986335 - DNA, 20 bp, Homo sapiens
cacggctgtccctcatggag

SEQ ID NO: 5986336 - DNA, 13 bp, Homo sapiens
cacggcttcactg

SEQ ID NO: 5986337 - DNA, 16 bp, Homo sapiens
cacggcttcactgacc

SEQ ID NO: 5986338 - DNA, 17 bp, Homo sapiens
cacggcttcactgacca

SEQ ID NO: 5986339 - DNA, 18 bp, Homo sapiens
cacggcttcactgaccag

SEQ ID NO: 5986340 - DNA, 23 bp, Homo sapiens
cacggcttttggtgaatttgttt

SEQ ID NO: 5986341 - DNA, 18 bp, Homo sapiens
cacgggacatcacagggt

SEQ ID NO: 5986342 - DNA, 16 bp, Homo sapiens
cacgggaccactccag

SEQ ID NO: 5986343 - DNA, 15 bp, Homo sapiens
cacgggagagcgcca

SEQ ID NO: 5986344 - DNA, 13 bp, Homo sapiens
cacgggaggaatc

SEQ ID NO: 5986345 - DNA, 23 bp, Homo sapiens
cacgggaggaatcttttactgtg

SEQ ID NO: 5986346 - DNA, 16 bp, Homo sapiens
cacgggcacagctgct

SEQ ID NO: 5986347 - DNA, 22 bp, Homo sapiens
cacgggcagcctggctcccagg

SEQ ID NO: 5986348 - DNA, 20 bp, Homo sapiens
cacgggcccgctcaacctct

SEQ ID NO: 5986349 - DNA, 15 bp, Homo sapiens
cacgggccctccctc

SEQ ID NO: 5986350 - DNA, 16 bp, Homo sapiens
cacgggccggccagct

SEQ ID NO: 5986351 - DNA, 17 bp, Homo sapiens
cacgggcctgtccacag

SEQ ID NO: 5986352 - DNA, 19 bp, Homo sapiens
cacgggcggtcctgcacag

SEQ ID NO: 5986353 - DNA, 18 bp, Homo sapiens
cacggggaccactgggcc

SEQ ID NO: 5986354 - DNA, 16 bp, Homo sapiens
cacggggatcacagcg

SEQ ID NO: 5986355 - DNA, 16 bp, Homo sapiens
cacggggcaaagctgc

SEQ ID NO: 5986356 - DNA, 18 bp, Homo sapiens
cacggggcaaagctgctg

SEQ ID NO: 5986357 - DNA, 19 bp, Homo sapiens
cacggggcagttagagcag

SEQ ID NO: 5986358 - DNA, 15 bp, Homo sapiens
cacgggggcagtgtg

SEQ ID NO: 5986359 - DNA, 14 bp, Homo sapiens
cacgggggcggcag

SEQ ID NO: 5986360 - DNA, 15 bp, Homo sapiens
cacggggtattttag

SEQ ID NO: 5986361 - DNA, 19 bp, Homo sapiens
cacggggtcgggggaggag

SEQ ID NO: 5986362 - DNA, 22 bp, Homo sapiens
cacggggtcgggggaggagcac

SEQ ID NO: 5986363 - DNA, 14 bp, Homo sapiens
cacgggtggtcccc

SEQ ID NO: 5986364 - DNA, 15 bp, Homo sapiens
cacgggtggtccccg

SEQ ID NO: 5986365 - DNA, 18 bp, Homo sapiens
cacgggtgtcacggccag

SEQ ID NO: 5986366 - DNA, 20 bp, Homo sapiens
cacgggtgtcacggccaggc

SEQ ID NO: 5986367 - DNA, 17 bp, Homo sapiens
cacggtatttatagaga

SEQ ID NO: 5986368 - DNA, 16 bp, Homo sapiens
cacggtcccccaggag

SEQ ID NO: 5986369 - DNA, 17 bp, Homo sapiens
cacggtcccccaggagg

SEQ ID NO: 5986370 - DNA, 22 bp, Homo sapiens
cacggtcccccaggaggcagct

SEQ ID NO: 5986371 - DNA, 21 bp, Homo sapiens
cacggtcgccacctggcattc

SEQ ID NO: 5986372 - DNA, 15 bp, Homo sapiens
cacggtgaaatccag

SEQ ID NO: 5986373 - DNA, 16 bp, Homo sapiens
cacggtgaaatccagg

SEQ ID NO: 5986374 - DNA, 23 bp, Homo sapiens
cacggtgaatggctttgtataga

SEQ ID NO: 5986375 - DNA, 20 bp, Homo sapiens
cacggtgacacaggtcaggg

SEQ ID NO: 5986376 - DNA, 17 bp, Homo sapiens
cacggtgccttttttca

SEQ ID NO: 5986377 - DNA, 14 bp, Homo sapiens
cacggtgcgtggct

SEQ ID NO: 5986378 - DNA, 21 bp, Homo sapiens
cacggtgcgtggctgtggcac

SEQ ID NO: 5986379 - DNA, 23 bp, Homo sapiens
cacggtggacttagctctgagga

SEQ ID NO: 5986380 - DNA, 19 bp, Homo sapiens
cacggtgtggggggtgccc

SEQ ID NO: 5986381 - DNA, 22 bp, Homo sapiens
cacggtgtggggggtgccccac

SEQ ID NO: 5986382 - DNA, 17 bp, Homo sapiens
cacggttcaatggtaga

SEQ ID NO: 5986383 - DNA, 15 bp, Homo sapiens
cacggttgcctgagg

SEQ ID NO: 5986384 - DNA, 23 bp, Homo sapiens
cacggtttatcctcttggtgtct

SEQ ID NO: 5986385 - DNA, 21 bp, Homo sapiens
cacggtttcgaagtcattaaa

SEQ ID NO: 5986386 - DNA, 17 bp, Homo sapiens
cacggtttgaagcctgg

SEQ ID NO: 5986387 - DNA, 15 bp, Homo sapiens
cacggtttgtgagag

SEQ ID NO: 5986388 - DNA, 12 bp, Homo sapiens
cacgtaaatatt

SEQ ID NO: 5986389 - DNA, 20 bp, Homo sapiens
cacgtaagttaataagcaaa

SEQ ID NO: 5986390 - DNA, 17 bp, Homo sapiens
cacgtaatcctcctgag

SEQ ID NO: 5986391 - DNA, 21 bp, Homo sapiens
cacgtacaaaactctgtataa

SEQ ID NO: 5986392 - DNA, 18 bp, Homo sapiens
cacgtacacacacataca

SEQ ID NO: 5986393 - DNA, 14 bp, Homo sapiens
cacgtaccaagcca

SEQ ID NO: 5986394 - DNA, 21 bp, Homo sapiens
cacgtaccaagccaccgcagc

SEQ ID NO: 5986395 - DNA, 23 bp, Homo sapiens
cacgtagcaaatcgtacattgtg

SEQ ID NO: 5986396 - DNA, 15 bp, Homo sapiens
cacgtagggggcagg

SEQ ID NO: 5986397 - DNA, 16 bp, Homo sapiens
cacgtagggggctctg

SEQ ID NO: 5986398 - DNA, 17 bp, Homo sapiens
cacgtagggggctctgg

SEQ ID NO: 5986399 - DNA, 18 bp, Homo sapiens
cacgtaggttccccagag

SEQ ID NO: 5986400 - DNA, 20 bp, Homo sapiens
cacgtagtagggtcaggcca

SEQ ID NO: 5986401 - DNA, 15 bp, Homo sapiens
cacgtattgctgtgt

SEQ ID NO: 5986402 - DNA, 19 bp, Homo sapiens
cacgtatttcacagagcac

SEQ ID NO: 5986403 - DNA, 20 bp, Homo sapiens
cacgtatttcacagagcacg

SEQ ID NO: 5986404 - DNA, 16 bp, Homo sapiens
cacgtcaccctcctga

SEQ ID NO: 5986405 - DNA, 18 bp, Homo sapiens
cacgtcaccctcctgagc

SEQ ID NO: 5986406 - DNA, 19 bp, Homo sapiens
cacgtcaccctcctgagcc

SEQ ID NO: 5986407 - DNA, 20 bp, Homo sapiens
cacgtcaccctcctgagcct

SEQ ID NO: 5986408 - DNA, 21 bp, Homo sapiens
cacgtcaggcctggcctcatc

SEQ ID NO: 5986409 - DNA, 23 bp, Homo sapiens
cacgtcattaaggttatgcactg

SEQ ID NO: 5986410 - DNA, 17 bp, Homo sapiens
cacgtccactcccaagc

SEQ ID NO: 5986411 - DNA, 19 bp, Homo sapiens
cacgtcccaccccacctct

SEQ ID NO: 5986412 - DNA, 12 bp, Homo sapiens
cacgtcccagca

SEQ ID NO: 5986413 - DNA, 17 bp, Homo sapiens
cacgtccccctggggct

SEQ ID NO: 5986414 - DNA, 16 bp, Homo sapiens
cacgtcccgctgcctc

SEQ ID NO: 5986415 - DNA, 18 bp, Homo sapiens
cacgtcccgctgcctcct

SEQ ID NO: 5986416 - DNA, 19 bp, Homo sapiens
cacgtccctcgagctctgt

SEQ ID NO: 5986417 - DNA, 23 bp, Homo sapiens
cacgtccctcgagctctgtagcc

SEQ ID NO: 5986418 - DNA, 19 bp, Homo sapiens
cacgtcctccaccggtgcc

SEQ ID NO: 5986419 - DNA, 14 bp, Homo sapiens
cacgtcctgggtgc

SEQ ID NO: 5986420 - DNA, 14 bp, Homo sapiens
cacgtcctgtcagt

SEQ ID NO: 5986421 - DNA, 19 bp, Homo sapiens
cacgtcgcccgctgagctg

SEQ ID NO: 5986422 - DNA, 16 bp, Homo sapiens
cacgtcgttctaatta

SEQ ID NO: 5986423 - DNA, 22 bp, Homo sapiens
cacgtctcctcctcgaagccat

SEQ ID NO: 5986424 - DNA, 11 bp, Homo sapiens
cacgtctctct

SEQ ID NO: 5986425 - DNA, 16 bp, Homo sapiens
cacgtctctctgcctg

SEQ ID NO: 5986426 - DNA, 20 bp, Homo sapiens
cacgtctctctgcctgctgg

SEQ ID NO: 5986427 - DNA, 13 bp, Homo sapiens
cacgtctctgccg

SEQ ID NO: 5986428 - DNA, 20 bp, Homo sapiens
cacgtctctgccgcctgcgt

SEQ ID NO: 5986429 - DNA, 14 bp, Homo sapiens
cacgtctgccaggc

SEQ ID NO: 5986430 - DNA, 15 bp, Homo sapiens
cacgtctgccaggcc

SEQ ID NO: 5986431 - DNA, 16 bp, Homo sapiens
cacgtctgccaggccc

SEQ ID NO: 5986432 - DNA, 20 bp, Homo sapiens
cacgtctgccaggcccatct

SEQ ID NO: 5986433 - DNA, 22 bp, Homo sapiens
cacgtctggccaggcactgcct

SEQ ID NO: 5986434 - DNA, 20 bp, Homo sapiens
cacgtctggctccctgcccc

SEQ ID NO: 5986435 - DNA, 21 bp, Homo sapiens
cacgtctggctccctgcccct

SEQ ID NO: 5986436 - DNA, 20 bp, Homo sapiens
cacgtctgtgctctgtcctt

SEQ ID NO: 5986437 - DNA, 15 bp, Homo sapiens
cacgtcttccttctg

SEQ ID NO: 5986438 - DNA, 23 bp, Homo sapiens
cacgtcttccttctgcctgagct

SEQ ID NO: 5986439 - DNA, 16 bp, Homo sapiens
cacgtcttggtgcctt

SEQ ID NO: 5986440 - DNA, 17 bp, Homo sapiens
cacgtcttggtgccttt

SEQ ID NO: 5986441 - DNA, 14 bp, Homo sapiens
cacgtgaaatattt

SEQ ID NO: 5986442 - DNA, 20 bp, Homo sapiens
cacgtgaaatatttaagtat

SEQ ID NO: 5986443 - DNA, 23 bp, Homo sapiens
cacgtgaaatatttaagtatata

SEQ ID NO: 5986444 - DNA, 20 bp, Homo sapiens
cacgtgaaatttgcctctgt

SEQ ID NO: 5986445 - DNA, 15 bp, Homo sapiens
cacgtgacactgtgg

SEQ ID NO: 5986446 - DNA, 14 bp, Homo sapiens
cacgtgacaggctc

SEQ ID NO: 5986447 - DNA, 15 bp, Homo sapiens
cacgtgacaggctcg

SEQ ID NO: 5986448 - DNA, 15 bp, Homo sapiens
cacgtgaccagcccc

SEQ ID NO: 5986449 - DNA, 18 bp, Homo sapiens
cacgtgaccctgtgcccc

SEQ ID NO: 5986450 - DNA, 23 bp, Homo sapiens
cacgtgaccctgtgccccgcctc

SEQ ID NO: 5986451 - DNA, 21 bp, Homo sapiens
cacgtgagaatccctggcaaa

SEQ ID NO: 5986452 - DNA, 18 bp, Homo sapiens
cacgtgaggcccctgtgc

SEQ ID NO: 5986453 - DNA, 16 bp, Homo sapiens
cacgtgcaaggactcc

SEQ ID NO: 5986454 - DNA, 13 bp, Homo sapiens
cacgtgcacacac

SEQ ID NO: 5986455 - DNA, 16 bp, Homo sapiens
cacgtgcagcacctgt

SEQ ID NO: 5986456 - DNA, 22 bp, Homo sapiens
cacgtgcagcacctgtcacctt

SEQ ID NO: 5986457 - DNA, 16 bp, Homo sapiens
cacgtgcagctcaagg

SEQ ID NO: 5986458 - DNA, 13 bp, Homo sapiens
cacgtgcaggaca

SEQ ID NO: 5986459 - DNA, 18 bp, Homo sapiens
cacgtgcaggacagctct

SEQ ID NO: 5986460 - DNA, 24 bp, Homo sapiens
caagccagggatggggccacagcc

SEQ ID NO: 5986461 - DNA, 11 bp, Homo sapiens
caagccagggc

SEQ ID NO: 5986462 - DNA, 15 bp, Homo sapiens
caagccagggcccag

SEQ ID NO: 5986463 - DNA, 16 bp, Homo sapiens
caagccagggcccaga

SEQ ID NO: 5986464 - DNA, 23 bp, Homo sapiens
caagccagggcccagagcccttg

SEQ ID NO: 5986465 - DNA, 18 bp, Homo sapiens
caagccagggtgtgtctc

SEQ ID NO: 5986466 - DNA, 18 bp, Homo sapiens
caagccagggttccagac

SEQ ID NO: 5986467 - DNA, 20 bp, Homo sapiens
caagccagggttccagacag

SEQ ID NO: 5986468 - DNA, 23 bp, Homo sapiens
caagccagtcatggaatcttgct

SEQ ID NO: 5986469 - DNA, 14 bp, Homo sapiens
caagccataaacca

SEQ ID NO: 5986470 - DNA, 17 bp, Homo sapiens
caagccataacgtgccc

SEQ ID NO: 5986471 - DNA, 19 bp, Homo sapiens
caagccataacgtgccccc

SEQ ID NO: 5986472 - DNA, 13 bp, Homo sapiens
caagccatcacag

SEQ ID NO: 5986473 - DNA, 14 bp, Homo sapiens
caagccatcacagg

SEQ ID NO: 5986474 - DNA, 23 bp, Homo sapiens
caagccatcttcccgcctcagcc

SEQ ID NO: 5986475 - DNA, 19 bp, Homo sapiens
caagccatggcatgctcct

SEQ ID NO: 5986476 - DNA, 16 bp, Homo sapiens
caagccattctgcctc

SEQ ID NO: 5986477 - DNA, 21 bp, Homo sapiens
caagccattctgcctcagcct

SEQ ID NO: 5986478 - DNA, 17 bp, Homo sapiens
caagcccaaatttaatt

SEQ ID NO: 5986479 - DNA, 23 bp, Homo sapiens
caagcccacaggtgtccccagcc

SEQ ID NO: 5986480 - DNA, 13 bp, Homo sapiens
caagcccaccagg

SEQ ID NO: 5986481 - DNA, 15 bp, Homo sapiens
caagcccaccctggg

SEQ ID NO: 5986482 - DNA, 15 bp, Homo sapiens
caagcccacgtcagg

SEQ ID NO: 5986483 - DNA, 21 bp, Homo sapiens
caagcccagcctatctctctt

SEQ ID NO: 5986484 - DNA, 12 bp, Homo sapiens
caagcccaggac

SEQ ID NO: 5986485 - DNA, 15 bp, Homo sapiens
caagcccaggccacc

SEQ ID NO: 5986486 - DNA, 16 bp, Homo sapiens
caagcccaggctggag

SEQ ID NO: 5986487 - DNA, 13 bp, Homo sapiens
caagcccaggctt

SEQ ID NO: 5986488 - DNA, 18 bp, Homo sapiens
caagcccaggcttcctgg

SEQ ID NO: 5986489 - DNA, 22 bp, Homo sapiens
caagcccaggtgccagcctgag

SEQ ID NO: 5986490 - DNA, 18 bp, Homo sapiens
caagccccaactttctta

SEQ ID NO: 5986491 - DNA, 18 bp, Homo sapiens
caagccccacagttctta

SEQ ID NO: 5986492 - DNA, 13 bp, Homo sapiens
caagccccagcag

SEQ ID NO: 5986493 - DNA, 17 bp, Homo sapiens
caagccccaggcaggct

SEQ ID NO: 5986494 - DNA, 16 bp, Homo sapiens
caagccccagggcctg

SEQ ID NO: 5986495 - DNA, 18 bp, Homo sapiens
caagccccagggcctggg

SEQ ID NO: 5986496 - DNA, 16 bp, Homo sapiens
caagccccatcctgcc

SEQ ID NO: 5986497 - DNA, 21 bp, Homo sapiens
caagccccattcacggcctgg

SEQ ID NO: 5986498 - DNA, 17 bp, Homo sapiens
caagccccatttcctca

SEQ ID NO: 5986499 - DNA, 18 bp, Homo sapiens
caagcccccccttccact

SEQ ID NO: 5986500 - DNA, 14 bp, Homo sapiens
caagcccctcagcc

SEQ ID NO: 5986501 - DNA, 17 bp, Homo sapiens
caagcccctcagccctt

SEQ ID NO: 5986502 - DNA, 20 bp, Homo sapiens
caagcccctcagcccttgcc

SEQ ID NO: 5986503 - DNA, 18 bp, Homo sapiens
caagcccctgcccatctg

SEQ ID NO: 5986504 - DNA, 21 bp, Homo sapiens
caagcccctgccctggggaga

SEQ ID NO: 5986505 - DNA, 22 bp, Homo sapiens
caagcccctgccctggggagaa

SEQ ID NO: 5986506 - DNA, 21 bp, Homo sapiens
caagcccctgctccagaagat

SEQ ID NO: 5986507 - DNA, 12 bp, Homo sapiens
caagcccctgtc

SEQ ID NO: 5986508 - DNA, 13 bp, Homo sapiens
caagcccctgtct

SEQ ID NO: 5986509 - DNA, 14 bp, Homo sapiens
caagccccttctct

SEQ ID NO: 5986510 - DNA, 17 bp, Homo sapiens
caagccccttctctcaa

SEQ ID NO: 5986511 - DNA, 18 bp, Homo sapiens
caagccccttctctcaat

SEQ ID NO: 5986512 - DNA, 19 bp, Homo sapiens
caagccctaagcctgtccc

SEQ ID NO: 5986513 - DNA, 22 bp, Homo sapiens
caagccctaagcctgtccccag

SEQ ID NO: 5986514 - DNA, 13 bp, Homo sapiens
caagccctcagct

SEQ ID NO: 5986515 - DNA, 15 bp, Homo sapiens
caagccctcctttgg

SEQ ID NO: 5986516 - DNA, 20 bp, Homo sapiens
caagccctgaggcctgaggc

SEQ ID NO: 5986517 - DNA, 21 bp, Homo sapiens
caagccctgaggcctgaggcc

SEQ ID NO: 5986518 - DNA, 14 bp, Homo sapiens
caagccctgcaaat

SEQ ID NO: 5986519 - DNA, 22 bp, Homo sapiens
caagccctgcccctcctgtaca

SEQ ID NO: 5986520 - DNA, 21 bp, Homo sapiens
caagccctggagccaactgct

SEQ ID NO: 5986521 - DNA, 11 bp, Homo sapiens
caagccctggc

SEQ ID NO: 5986522 - DNA, 13 bp, Homo sapiens
caagccctggcaa

SEQ ID NO: 5986523 - DNA, 18 bp, Homo sapiens
caagcccttccctctgtt

SEQ ID NO: 5986524 - DNA, 19 bp, Homo sapiens
caagcccttccctctgttg

SEQ ID NO: 5986525 - DNA, 19 bp, Homo sapiens
caagccctttgctgttcgc

SEQ ID NO: 5986526 - DNA, 21 bp, Homo sapiens
caagccgaccttccctccgcc

SEQ ID NO: 5986527 - DNA, 19 bp, Homo sapiens
caagccgcaagctctcagc

SEQ ID NO: 5986528 - DNA, 17 bp, Homo sapiens
caagccggcagaaatag

SEQ ID NO: 5986529 - DNA, 16 bp, Homo sapiens
caagccggcccaaccc

SEQ ID NO: 5986530 - DNA, 17 bp, Homo sapiens
caagccgtaggacccag

SEQ ID NO: 5986531 - DNA, 14 bp, Homo sapiens
caagccgtggcttc

SEQ ID NO: 5986532 - DNA, 17 bp, Homo sapiens
caagccgtggcttcccg

SEQ ID NO: 5986533 - DNA, 18 bp, Homo sapiens
caagccgtggcttcccgc

SEQ ID NO: 5986534 - DNA, 16 bp, Homo sapiens
caagcctaggccgccc

SEQ ID NO: 5986535 - DNA, 23 bp, Homo sapiens
caagcctatggagtgaaattatt

SEQ ID NO: 5986536 - DNA, 13 bp, Homo sapiens
caagcctcagcca

SEQ ID NO: 5986537 - DNA, 22 bp, Homo sapiens
caagcctcagccactcccaggg

SEQ ID NO: 5986538 - DNA, 17 bp, Homo sapiens
caagcctcatattttct

SEQ ID NO: 5986539 - DNA, 19 bp, Homo sapiens
caagcctcatattttctgt

SEQ ID NO: 5986540 - DNA, 19 bp, Homo sapiens
caagcctcgaggtgccttc

SEQ ID NO: 5986541 - DNA, 15 bp, Homo sapiens
caagcctctgcccca

SEQ ID NO: 5986542 - DNA, 18 bp, Homo sapiens
caagcctctgccccaagg

SEQ ID NO: 5986543 - DNA, 18 bp, Homo sapiens
caagcctcttattccagg

SEQ ID NO: 5986544 - DNA, 19 bp, Homo sapiens
caagcctcttattccagga

SEQ ID NO: 5986545 - DNA, 14 bp, Homo sapiens
caagcctcttctga

SEQ ID NO: 5986546 - DNA, 18 bp, Homo sapiens
caagcctgaaagtaattt

SEQ ID NO: 5986547 - DNA, 17 bp, Homo sapiens
caagcctgagggaaagg

SEQ ID NO: 5986548 - DNA, 16 bp, Homo sapiens
caagcctgagggagga

SEQ ID NO: 5986549 - DNA, 22 bp, Homo sapiens
caagcctgcagtcatcttgacc

SEQ ID NO: 5986550 - DNA, 21 bp, Homo sapiens
caagcctgccccggccactct

SEQ ID NO: 5986551 - DNA, 12 bp, Homo sapiens
caagcctgcctc

SEQ ID NO: 5986552 - DNA, 20 bp, Homo sapiens
caagcctgctggctgcggcc

SEQ ID NO: 5986553 - DNA, 10 bp, Homo sapiens
caagcctgga

SEQ ID NO: 5986554 - DNA, 12 bp, Homo sapiens
caagcctggagc

SEQ ID NO: 5986555 - DNA, 17 bp, Homo sapiens
caagcctggagcccctg

SEQ ID NO: 5986556 - DNA, 20 bp, Homo sapiens
caagcctggagtaggcctgg

SEQ ID NO: 5986557 - DNA, 16 bp, Homo sapiens
caagcctggcacccac

SEQ ID NO: 5986558 - DNA, 13 bp, Homo sapiens
caagcctggcagg

SEQ ID NO: 5986559 - DNA, 13 bp, Homo sapiens
caagcctggccca

SEQ ID NO: 5986560 - DNA, 13 bp, Homo sapiens
caagcctggccct

SEQ ID NO: 5986561 - DNA, 18 bp, Homo sapiens
caagcctgggccactggc

SEQ ID NO: 5986562 - DNA, 22 bp, Homo sapiens
caagcctgggccactggcatct

SEQ ID NO: 5986563 - DNA, 12 bp, Homo sapiens
caagcctggtct

SEQ ID NO: 5986564 - DNA, 13 bp, Homo sapiens
caagcctggtctc

SEQ ID NO: 5986565 - DNA, 15 bp, Homo sapiens
caagcctggtctcct

SEQ ID NO: 5986566 - DNA, 19 bp, Homo sapiens
caagcctggtctcctccca

SEQ ID NO: 5986567 - DNA, 21 bp, Homo sapiens
caagcctgtaatcccagctac

SEQ ID NO: 5986568 - DNA, 14 bp, Homo sapiens
caagcctgtccatt

SEQ ID NO: 5986569 - DNA, 14 bp, Homo sapiens
caagcctgtctgag

SEQ ID NO: 5986570 - DNA, 21 bp, Homo sapiens
caagcctgtgcaaaaaaatta

SEQ ID NO: 5986571 - DNA, 13 bp, Homo sapiens
caagcctgtggga

SEQ ID NO: 5986572 - DNA, 16 bp, Homo sapiens
caagccttaaactgta

SEQ ID NO: 5986573 - DNA, 16 bp, Homo sapiens
caagccttactcacct

SEQ ID NO: 5986574 - DNA, 18 bp, Homo sapiens
caagccttactcacctct

SEQ ID NO: 5986575 - DNA, 23 bp, Homo sapiens
caagccttcagccacagggagcc

SEQ ID NO: 5986576 - DNA, 19 bp, Homo sapiens
caagccttccagggatttg

SEQ ID NO: 5986577 - DNA, 20 bp, Homo sapiens
caagccttggctcgttctct

SEQ ID NO: 5986578 - DNA, 20 bp, Homo sapiens
caagcgacacaggctgccgc

SEQ ID NO: 5986579 - DNA, 20 bp, Homo sapiens
caagcgaccgaggccctccc

SEQ ID NO: 5986580 - DNA, 23 bp, Homo sapiens
caagcgactctcctgcctcagcc

SEQ ID NO: 5986581 - DNA, 22 bp, Homo sapiens
caagcgatccctcccctcagcc

SEQ ID NO: 5986582 - DNA, 19 bp, Homo sapiens
caagcgattctcctgcctc

SEQ ID NO: 5986583 - DNA, 17 bp, Homo sapiens
caagcgattcttctgct

SEQ ID NO: 5986584 - DNA, 15 bp, Homo sapiens
caagcgcagggagga

SEQ ID NO: 5986585 - DNA, 16 bp, Homo sapiens
caagcgcagggaggat

SEQ ID NO: 5986586 - DNA, 20 bp, Homo sapiens
caagcgcagggaggatgcca

SEQ ID NO: 5986587 - DNA, 23 bp, Homo sapiens
caagcgcagggaggatgccacag

SEQ ID NO: 5986588 - DNA, 15 bp, Homo sapiens
caagcgccctggccc

SEQ ID NO: 5986589 - DNA, 18 bp, Homo sapiens
caagcgccctggccccca

SEQ ID NO: 5986590 - DNA, 23 bp, Homo sapiens
caagcgccctggcccccacatgg

SEQ ID NO: 5986591 - DNA, 13 bp, Homo sapiens
caagcgcctggct

SEQ ID NO: 5986592 - DNA, 13 bp, Homo sapiens
caagcgctccagg

SEQ ID NO: 5986593 - DNA, 15 bp, Homo sapiens
caagcgctccagggc

SEQ ID NO: 5986594 - DNA, 16 bp, Homo sapiens
caagcgctcccagcct

SEQ ID NO: 5986595 - DNA, 19 bp, Homo sapiens
caagcgctcccagcctgcc

SEQ ID NO: 5986596 - DNA, 22 bp, Homo sapiens
caagcgctcccagcctgccctc

SEQ ID NO: 5986597 - DNA, 13 bp, Homo sapiens
caagcggccctga

SEQ ID NO: 5986598 - DNA, 16 bp, Homo sapiens
caagcggccctgtgtg

SEQ ID NO: 5986599 - DNA, 19 bp, Homo sapiens
caagcggctcaagaataaa

SEQ ID NO: 5986600 - DNA, 16 bp, Homo sapiens
caagcgggggcgtggc

SEQ ID NO: 5986601 - DNA, 18 bp, Homo sapiens
caagcgggtggctctggg

SEQ ID NO: 5986602 - DNA, 12 bp, Homo sapiens
caagcggtgcct

SEQ ID NO: 5986603 - DNA, 22 bp, Homo sapiens
caagcgtcacttctcctgctgc

SEQ ID NO: 5986604 - DNA, 21 bp, Homo sapiens
caagcgtctgggcaagaggaa

SEQ ID NO: 5986605 - DNA, 17 bp, Homo sapiens
caagcgtgagccactgc

SEQ ID NO: 5986606 - DNA, 23 bp, Homo sapiens
caagcgtgctgcctctcttctgt

SEQ ID NO: 5986607 - DNA, 14 bp, Homo sapiens
caagcgtgttctca

SEQ ID NO: 5986608 - DNA, 14 bp, Homo sapiens
caagcgttcctggc

SEQ ID NO: 5986609 - DNA, 18 bp, Homo sapiens
caagcgttcctggccttc

SEQ ID NO: 5986610 - DNA, 19 bp, Homo sapiens
caagcgttcctggccttct

SEQ ID NO: 5986611 - DNA, 22 bp, Homo sapiens
caagctaaccttatcctgcatt

SEQ ID NO: 5986612 - DNA, 14 bp, Homo sapiens
caagctaagcactg

SEQ ID NO: 5986613 - DNA, 22 bp, Homo sapiens
caagctaagcactgccactggg

SEQ ID NO: 5986614 - DNA, 14 bp, Homo sapiens
caagctaagctgca

SEQ ID NO: 5986615 - DNA, 19 bp, Homo sapiens
caagctaataaaatatcat

SEQ ID NO: 5986616 - DNA, 16 bp, Homo sapiens
caagctaatctgcctg

SEQ ID NO: 5986617 - DNA, 16 bp, Homo sapiens
caagctaatttctaat

SEQ ID NO: 5986618 - DNA, 13 bp, Homo sapiens
caagctacatatg

SEQ ID NO: 5986619 - DNA, 16 bp, Homo sapiens
caagctagaacctgga

SEQ ID NO: 5986620 - DNA, 18 bp, Homo sapiens
caagctagaacctggagg

SEQ ID NO: 5986621 - DNA, 15 bp, Homo sapiens
caagctagactgtgt

SEQ ID NO: 5986622 - DNA, 16 bp, Homo sapiens
caagctagactgtgtc

SEQ ID NO: 5986623 - DNA, 17 bp, Homo sapiens
caagctagactgtgtct

SEQ ID NO: 5986624 - DNA, 14 bp, Homo sapiens
caagctaggaaaga

SEQ ID NO: 5986625 - DNA, 15 bp, Homo sapiens
caagctaggccccag

SEQ ID NO: 5986626 - DNA, 16 bp, Homo sapiens
caagctaggccccaga

SEQ ID NO: 5986627 - DNA, 20 bp, Homo sapiens
caagctaggccccagaggcc

SEQ ID NO: 5986628 - DNA, 21 bp, Homo sapiens
caagctaggccccagaggccc

SEQ ID NO: 5986629 - DNA, 22 bp, Homo sapiens
caagctaggccccagaggccct

SEQ ID NO: 5986630 - DNA, 15 bp, Homo sapiens
caagctatcctggct

SEQ ID NO: 5986631 - DNA, 17 bp, Homo sapiens
caagctatctaaagttt

SEQ ID NO: 5986632 - DNA, 22 bp, Homo sapiens
caagctatgagggtccccggga

SEQ ID NO: 5986633 - DNA, 17 bp, Homo sapiens
caagctattcctttccc

SEQ ID NO: 5986634 - DNA, 19 bp, Homo sapiens
caagctattcctttccctt

SEQ ID NO: 5986635 - DNA, 16 bp, Homo sapiens
caagctcacacctgtc

SEQ ID NO: 5986636 - DNA, 17 bp, Homo sapiens
caagctcacacctgtcc

SEQ ID NO: 5986637 - DNA, 12 bp, Homo sapiens
caagctcaccct

SEQ ID NO: 5986638 - DNA, 18 bp, Homo sapiens
caagctcacttgctttag

SEQ ID NO: 5986639 - DNA, 16 bp, Homo sapiens
cacgtgccaggcccgg

SEQ ID NO: 5986640 - DNA, 23 bp, Homo sapiens
cacgtgccattgtctttcctccc

SEQ ID NO: 5986641 - DNA, 13 bp, Homo sapiens
cacgtgcctgtgg

SEQ ID NO: 5986642 - DNA, 18 bp, Homo sapiens
cacgtgcctgtgggcctg

SEQ ID NO: 5986643 - DNA, 21 bp, Homo sapiens
cacgtgcctgtgggcctggga

SEQ ID NO: 5986644 - DNA, 17 bp, Homo sapiens
cacgtgctcgcagcctg

SEQ ID NO: 5986645 - DNA, 19 bp, Homo sapiens
cacgtgctcgcagcctggc

SEQ ID NO: 5986646 - DNA, 15 bp, Homo sapiens
cacgtgctggagagt

SEQ ID NO: 5986647 - DNA, 19 bp, Homo sapiens
cacgtggactctgtgctca

SEQ ID NO: 5986648 - DNA, 15 bp, Homo sapiens
cacgtggagacagct

SEQ ID NO: 5986649 - DNA, 22 bp, Homo sapiens
cacgtggagagaagttgccctc

SEQ ID NO: 5986650 - DNA, 23 bp, Homo sapiens
cacgtggagagctggtgcccgga

SEQ ID NO: 5986651 - DNA, 20 bp, Homo sapiens
cacgtggaggaatgctcccc

SEQ ID NO: 5986652 - DNA, 17 bp, Homo sapiens
cacgtggccaggagcca

SEQ ID NO: 5986653 - DNA, 13 bp, Homo sapiens
cacgtggcctctt

SEQ ID NO: 5986654 - DNA, 12 bp, Homo sapiens
cacgtggctggc

SEQ ID NO: 5986655 - DNA, 15 bp, Homo sapiens
cacgtgggaaccccc

SEQ ID NO: 5986656 - DNA, 21 bp, Homo sapiens
cacgtgggaacccccctccca

SEQ ID NO: 5986657 - DNA, 14 bp, Homo sapiens
cacgtgggcctccc

SEQ ID NO: 5986658 - DNA, 15 bp, Homo sapiens
cacgtgggcctccca

SEQ ID NO: 5986659 - DNA, 16 bp, Homo sapiens
cacgtgggctcccctc

SEQ ID NO: 5986660 - DNA, 13 bp, Homo sapiens
cacgtggggccca

SEQ ID NO: 5986661 - DNA, 14 bp, Homo sapiens
cacgtggggcccac

SEQ ID NO: 5986662 - DNA, 20 bp, Homo sapiens
cacgtggggcccactgctcg

SEQ ID NO: 5986663 - DNA, 16 bp, Homo sapiens
cacgtggtcctaatct

SEQ ID NO: 5986664 - DNA, 19 bp, Homo sapiens
cacgtggtcctaatcttct

SEQ ID NO: 5986665 - DNA, 19 bp, Homo sapiens
cacgtggtggcccagctcc

SEQ ID NO: 5986666 - DNA, 20 bp, Homo sapiens
cacgtgtaactgtcagccgg

SEQ ID NO: 5986667 - DNA, 19 bp, Homo sapiens
cacgtgtatagtatctgta

SEQ ID NO: 5986668 - DNA, 23 bp, Homo sapiens
cacgtgtatatgaggatgtatgt

SEQ ID NO: 5986669 - DNA, 20 bp, Homo sapiens
cacgtgtccttaacacctga

SEQ ID NO: 5986670 - DNA, 15 bp, Homo sapiens
cacgtgtggcctccg

SEQ ID NO: 5986671 - DNA, 19 bp, Homo sapiens
cacgtgtgggccgtggctt

SEQ ID NO: 5986672 - DNA, 12 bp, Homo sapiens
cacgtgtgtatg

SEQ ID NO: 5986673 - DNA, 12 bp, Homo sapiens
cacgtgtgtgac

SEQ ID NO: 5986674 - DNA, 22 bp, Homo sapiens
cacgtgttttattcctgtatgt

SEQ ID NO: 5986675 - DNA, 15 bp, Homo sapiens
cacgtgtttttgtat

SEQ ID NO: 5986676 - DNA, 13 bp, Homo sapiens
cacgttatggtgt

SEQ ID NO: 5986677 - DNA, 15 bp, Homo sapiens
cacgttcagggaggg

SEQ ID NO: 5986678 - DNA, 19 bp, Homo sapiens
cacgttcagggaggggccg

SEQ ID NO: 5986679 - DNA, 16 bp, Homo sapiens
cacgttcataaccaac

SEQ ID NO: 5986680 - DNA, 15 bp, Homo sapiens
cacgttctagtgaaa

SEQ ID NO: 5986681 - DNA, 14 bp, Homo sapiens
cacgttgccagggg

SEQ ID NO: 5986682 - DNA, 16 bp, Homo sapiens
cacgttgcctctactt

SEQ ID NO: 5986683 - DNA, 13 bp, Homo sapiens
cacgttgctgcca

SEQ ID NO: 5986684 - DNA, 21 bp, Homo sapiens
cacgttggggtgatttaatcc

SEQ ID NO: 5986685 - DNA, 14 bp, Homo sapiens
cacgttgtccctga

SEQ ID NO: 5986686 - DNA, 16 bp, Homo sapiens
cacgtttaatcccagc

SEQ ID NO: 5986687 - DNA, 17 bp, Homo sapiens
cacgtttaatcccagca

SEQ ID NO: 5986688 - DNA, 19 bp, Homo sapiens
cacgtttaatcccagcact

SEQ ID NO: 5986689 - DNA, 19 bp, Homo sapiens
cacgtttagaaatgatttc

SEQ ID NO: 5986690 - DNA, 18 bp, Homo sapiens
cacgtttcaacctctcta

SEQ ID NO: 5986691 - DNA, 12 bp, Homo sapiens
cacgtttctaaa

SEQ ID NO: 5986692 - DNA, 14 bp, Homo sapiens
cacgtttctaaagg

SEQ ID NO: 5986693 - DNA, 23 bp, Homo sapiens
cacgtttgatttcttcctgcaga

SEQ ID NO: 5986694 - DNA, 17 bp, Homo sapiens
cacgtttggtttgcgca

SEQ ID NO: 5986695 - DNA, 14 bp, Homo sapiens
cacgttttgaaata

SEQ ID NO: 5986696 - DNA, 22 bp, Homo sapiens
cactaaaaatattgtttctgca

SEQ ID NO: 5986697 - DNA, 19 bp, Homo sapiens
cactaaaacaagaggacac

SEQ ID NO: 5986698 - DNA, 14 bp, Homo sapiens
cactaaaagcatga

SEQ ID NO: 5986699 - DNA, 22 bp, Homo sapiens
cactaaaagtgtgtgaaaccta

SEQ ID NO: 5986700 - DNA, 17 bp, Homo sapiens
cactaaaatccacccag

SEQ ID NO: 5986701 - DNA, 19 bp, Homo sapiens
cactaaaatccacccagcc

SEQ ID NO: 5986702 - DNA, 14 bp, Homo sapiens
cactaaaatttaaa

SEQ ID NO: 5986703 - DNA, 19 bp, Homo sapiens
cactaaaccacttctctgc

SEQ ID NO: 5986704 - DNA, 12 bp, Homo sapiens
cactaaactctg

SEQ ID NO: 5986705 - DNA, 15 bp, Homo sapiens
cactaaactctgggg

SEQ ID NO: 5986706 - DNA, 15 bp, Homo sapiens
cactaaactttattt

SEQ ID NO: 5986707 - DNA, 22 bp, Homo sapiens
cactaaagagctaggaaagagt

SEQ ID NO: 5986708 - DNA, 21 bp, Homo sapiens
cactaaagcatgaaatgtgaa

SEQ ID NO: 5986709 - DNA, 16 bp, Homo sapiens
cactaaagccagcctg

SEQ ID NO: 5986710 - DNA, 17 bp, Homo sapiens
cactaaagccagcctga

SEQ ID NO: 5986711 - DNA, 17 bp, Homo sapiens
cactaaagtatagagaa

SEQ ID NO: 5986712 - DNA, 22 bp, Homo sapiens
cactaaagtatagagaaaagtg

SEQ ID NO: 5986713 - DNA, 22 bp, Homo sapiens
cactaaagtgtcaaggtgtgga

SEQ ID NO: 5986714 - DNA, 17 bp, Homo sapiens
cactaaatatctagtgc

SEQ ID NO: 5986715 - DNA, 11 bp, Homo sapiens
cactaaatgtt

SEQ ID NO: 5986716 - DNA, 19 bp, Homo sapiens
cactaaatgttaaagatgt

SEQ ID NO: 5986717 - DNA, 23 bp, Homo sapiens
cactaaatgttaaagatgtagca

SEQ ID NO: 5986718 - DNA, 21 bp, Homo sapiens
cactaaattagtttaaaatga

SEQ ID NO: 5986719 - DNA, 15 bp, Homo sapiens
cactaaatttctcag

SEQ ID NO: 5986720 - DNA, 15 bp, Homo sapiens
cactaacaaaatttg

SEQ ID NO: 5986721 - DNA, 18 bp, Homo sapiens
cactaacaaaatttgaat

SEQ ID NO: 5986722 - DNA, 23 bp, Homo sapiens
cactaacactttagttatattca

SEQ ID NO: 5986723 - DNA, 14 bp, Homo sapiens
cactaacagagtgg

SEQ ID NO: 5986724 - DNA, 19 bp, Homo sapiens
cactaacatcaatggcttt

SEQ ID NO: 5986725 - DNA, 22 bp, Homo sapiens
cactaacattgtgactttgctt

SEQ ID NO: 5986726 - DNA, 13 bp, Homo sapiens
cactaacatttcc

SEQ ID NO: 5986727 - DNA, 17 bp, Homo sapiens
cactaaccaatgccttt

SEQ ID NO: 5986728 - DNA, 17 bp, Homo sapiens
cactaaccatccccaac

SEQ ID NO: 5986729 - DNA, 20 bp, Homo sapiens
cactaaccatccccaactcc

SEQ ID NO: 5986730 - DNA, 15 bp, Homo sapiens
cactaaccccagctg

SEQ ID NO: 5986731 - DNA, 13 bp, Homo sapiens
cactaacctgacc

SEQ ID NO: 5986732 - DNA, 15 bp, Homo sapiens
cactaacctgtagaa

SEQ ID NO: 5986733 - DNA, 19 bp, Homo sapiens
cactaacgacttcagggca

SEQ ID NO: 5986734 - DNA, 21 bp, Homo sapiens
cactaacggttgagttttgac

SEQ ID NO: 5986735 - DNA, 20 bp, Homo sapiens
cactaactagagcagccctg

SEQ ID NO: 5986736 - DNA, 18 bp, Homo sapiens
cactaactcaccagcccc

SEQ ID NO: 5986737 - DNA, 19 bp, Homo sapiens
cactaactcaccagcccca

SEQ ID NO: 5986738 - DNA, 20 bp, Homo sapiens
cactaactgggaggacattc

SEQ ID NO: 5986739 - DNA, 17 bp, Homo sapiens
cactaagaaaatagcaa

SEQ ID NO: 5986740 - DNA, 12 bp, Homo sapiens
cactaagaaaga

SEQ ID NO: 5986741 - DNA, 15 bp, Homo sapiens
cactaagaaagaaag

SEQ ID NO: 5986742 - DNA, 17 bp, Homo sapiens
cactaagaaagaaagga

SEQ ID NO: 5986743 - DNA, 20 bp, Homo sapiens
cactaagaaagaaaggaaag

SEQ ID NO: 5986744 - DNA, 13 bp, Homo sapiens
cactaagaacaaa

SEQ ID NO: 5986745 - DNA, 20 bp, Homo sapiens
cactaagaacaaaagaagca

SEQ ID NO: 5986746 - DNA, 22 bp, Homo sapiens
cactaagacaagaacattctct

SEQ ID NO: 5986747 - DNA, 17 bp, Homo sapiens
cactaagactgcttcta

SEQ ID NO: 5986748 - DNA, 14 bp, Homo sapiens
cactaagcagagga

SEQ ID NO: 5986749 - DNA, 18 bp, Homo sapiens
cactaagcagaggagggg

SEQ ID NO: 5986750 - DNA, 17 bp, Homo sapiens
cactaagctctctgggc

SEQ ID NO: 5986751 - DNA, 17 bp, Homo sapiens
cactaagctttctcctt

SEQ ID NO: 5986752 - DNA, 20 bp, Homo sapiens
cactaagctttctcctttga

SEQ ID NO: 5986753 - DNA, 13 bp, Homo sapiens
cactaaggggccc

SEQ ID NO: 5986754 - DNA, 19 bp, Homo sapiens
cactaaggtggacagcaga

SEQ ID NO: 5986755 - DNA, 17 bp, Homo sapiens
cactaaggtgtgctctg

SEQ ID NO: 5986756 - DNA, 18 bp, Homo sapiens
cactaaggtgtgctctga

SEQ ID NO: 5986757 - DNA, 23 bp, Homo sapiens
cactaagtagaataaagaaaaac

SEQ ID NO: 5986758 - DNA, 21 bp, Homo sapiens
cactaagtcatggtcctggct

SEQ ID NO: 5986759 - DNA, 22 bp, Homo sapiens
cactaagtctcttttttacaaa

SEQ ID NO: 5986760 - DNA, 14 bp, Homo sapiens
cactaataaagtgc

SEQ ID NO: 5986761 - DNA, 21 bp, Homo sapiens
cactaatatatggacctagct

SEQ ID NO: 5986762 - DNA, 19 bp, Homo sapiens
cactaatatatttaaaaat

SEQ ID NO: 5986763 - DNA, 20 bp, Homo sapiens
cactaatatatttaaaaata

SEQ ID NO: 5986764 - DNA, 13 bp, Homo sapiens
cactaatcaatac

SEQ ID NO: 5986765 - DNA, 15 bp, Homo sapiens
cactaatcacaaact

SEQ ID NO: 5986766 - DNA, 20 bp, Homo sapiens
cactaatccattatccttta

SEQ ID NO: 5986767 - DNA, 18 bp, Homo sapiens
cactaatgttagaattga

SEQ ID NO: 5986768 - DNA, 18 bp, Homo sapiens
cactaattctgcatctgg

SEQ ID NO: 5986769 - DNA, 12 bp, Homo sapiens
cactaattctgt

SEQ ID NO: 5986770 - DNA, 23 bp, Homo sapiens
cactaattggtacttttaaaaac

SEQ ID NO: 5986771 - DNA, 17 bp, Homo sapiens
cactaatttcttcttta

SEQ ID NO: 5986772 - DNA, 19 bp, Homo sapiens
cactaatttcttctttaga

SEQ ID NO: 5986773 - DNA, 15 bp, Homo sapiens
cactaatttgtcact

SEQ ID NO: 5986774 - DNA, 21 bp, Homo sapiens
cactaattttagtattcattc

SEQ ID NO: 5986775 - DNA, 18 bp, Homo sapiens
cactaattttgttttaaa

SEQ ID NO: 5986776 - DNA, 23 bp, Homo sapiens
cactaattttgttttaaactgtg

SEQ ID NO: 5986777 - DNA, 16 bp, Homo sapiens
cactacaaaaagaaga

SEQ ID NO: 5986778 - DNA, 18 bp, Homo sapiens
cactacaaaaagaagagt

SEQ ID NO: 5986779 - DNA, 17 bp, Homo sapiens
cactacaacattagaat

SEQ ID NO: 5986780 - DNA, 13 bp, Homo sapiens
cactacaacctcc

SEQ ID NO: 5986781 - DNA, 15 bp, Homo sapiens
cactacaccacacac

SEQ ID NO: 5986782 - DNA, 17 bp, Homo sapiens
cactacaccacacacaa

SEQ ID NO: 5986783 - DNA, 15 bp, Homo sapiens
cactacacccagcaa

SEQ ID NO: 5986784 - DNA, 18 bp, Homo sapiens
cactacacccagcaatag

SEQ ID NO: 5986785 - DNA, 15 bp, Homo sapiens
cactacacgcaccca

SEQ ID NO: 5986786 - DNA, 19 bp, Homo sapiens
cactacactccagcctgag

SEQ ID NO: 5986787 - DNA, 19 bp, Homo sapiens
cactacagagcagctcccc

SEQ ID NO: 5986788 - DNA, 22 bp, Homo sapiens
cactacaggtgaaggctctcac

SEQ ID NO: 5986789 - DNA, 15 bp, Homo sapiens
cactacagtaagctg

SEQ ID NO: 5986790 - DNA, 17 bp, Homo sapiens
cactacataaactgact

SEQ ID NO: 5986791 - DNA, 16 bp, Homo sapiens
cactacataatctctg

SEQ ID NO: 5986792 - DNA, 17 bp, Homo sapiens
cactacataatctctgg

SEQ ID NO: 5986793 - DNA, 20 bp, Homo sapiens
cactacataatctctggaaa

SEQ ID NO: 5986794 - DNA, 23 bp, Homo sapiens
cactacatgcagcccatgcccac

SEQ ID NO: 5986795 - DNA, 21 bp, Homo sapiens
cactacatgggccagcccttg

SEQ ID NO: 5986796 - DNA, 23 bp, Homo sapiens
cactacatgggccagcccttgct

SEQ ID NO: 5986797 - DNA, 19 bp, Homo sapiens
cactacatgtggtttatag

SEQ ID NO: 5986798 - DNA, 15 bp, Homo sapiens
cactacattctgtta

SEQ ID NO: 5986799 - DNA, 19 bp, Homo sapiens
cactacattttttctaata

SEQ ID NO: 5986800 - DNA, 14 bp, Homo sapiens
cactaccaaaagac

SEQ ID NO: 5986801 - DNA, 15 bp, Homo sapiens
cactaccaaaagaca

SEQ ID NO: 5986802 - DNA, 22 bp, Homo sapiens
cactaccaaaggacacttatcc

SEQ ID NO: 5986803 - DNA, 21 bp, Homo sapiens
cactaccacgccaagctaatt

SEQ ID NO: 5986804 - DNA, 21 bp, Homo sapiens
cactaccatacagacagcaca

SEQ ID NO: 5986805 - DNA, 14 bp, Homo sapiens
cactaccccacacc

SEQ ID NO: 5986806 - DNA, 18 bp, Homo sapiens
cactaccccacaccagcc

SEQ ID NO: 5986807 - DNA, 19 bp, Homo sapiens
cactaccccatatacacct

SEQ ID NO: 5986808 - DNA, 20 bp, Homo sapiens
cactacccgatttgtttatt

SEQ ID NO: 5986809 - DNA, 13 bp, Homo sapiens
cactaccctgaga

SEQ ID NO: 5986810 - DNA, 18 bp, Homo sapiens
cactaccctgattcttga

SEQ ID NO: 5986811 - DNA, 14 bp, Homo sapiens
cactacccttctcc

SEQ ID NO: 5986812 - DNA, 17 bp, Homo sapiens
cactacccttctccttt

SEQ ID NO: 5986813 - DNA, 18 bp, Homo sapiens
cactacccttctcctttc

SEQ ID NO: 5986814 - DNA, 21 bp, Homo sapiens
cactacccttctcctttcctt

SEQ ID NO: 5986815 - DNA, 20 bp, Homo sapiens
cactaccgtggaccacctag

SEQ ID NO: 5986816 - DNA, 16 bp, Homo sapiens
cactacctcctcaggg

SEQ ID NO: 5986817 - DNA, 15 bp, Homo sapiens
cactacctgaacatt

SEQ ID NO: 5986818 - DNA, 19 bp, Homo sapiens
cactacctgccatgcatac

SEQ ID NO: 5986819 - DNA, 20 bp, Homo sapiens
cactaccttctgacctcccc

SEQ ID NO: 5986820 - DNA, 23 bp, Homo sapiens
cactacggaatagttggctagga

SEQ ID NO: 5986821 - DNA, 19 bp, Homo sapiens
cactactaaaagtttagaa

SEQ ID NO: 5986822 - DNA, 22 bp, Homo sapiens
cactactaaaagtttagaactt

SEQ ID NO: 5986823 - DNA, 23 bp, Homo sapiens
cactactaaaagtttagaacttg

SEQ ID NO: 5986824 - DNA, 13 bp, Homo sapiens
cactactacctct

SEQ ID NO: 5986825 - DNA, 14 bp, Homo sapiens
cactactcagcatg

SEQ ID NO: 5986826 - DNA, 19 bp, Homo sapiens
cactactcctctgcagtgc

SEQ ID NO: 5986827 - DNA, 14 bp, Homo sapiens
cactactctgtgcc

SEQ ID NO: 5986828 - DNA, 13 bp, Homo sapiens
cactactgacatg

SEQ ID NO: 5986829 - DNA, 12 bp, Homo sapiens
cactactgcagc

SEQ ID NO: 5986830 - DNA, 13 bp, Homo sapiens
cactactgcagca

SEQ ID NO: 5986831 - DNA, 16 bp, Homo sapiens
cactactgcagcacct

SEQ ID NO: 5986832 - DNA, 16 bp, Homo sapiens
cactactgcatttata

SEQ ID NO: 5986833 - DNA, 14 bp, Homo sapiens
cactactgggtgtc

SEQ ID NO: 5986834 - DNA, 17 bp, Homo sapiens
cactactgtatgtaata

SEQ ID NO: 5986835 - DNA, 17 bp, Homo sapiens
cactactgtatttcatt

SEQ ID NO: 5986836 - DNA, 23 bp, Homo sapiens
cactactgtatttcattatctgt

SEQ ID NO: 5986837 - DNA, 12 bp, Homo sapiens
cactacttactt

SEQ ID NO: 5986838 - DNA, 13 bp, Homo sapiens
cactagaagaaaa

SEQ ID NO: 5986839 - DNA, 13 bp, Homo sapiens
cactagaatgaga

SEQ ID NO: 5986840 - DNA, 18 bp, Homo sapiens
cactagaatggataaaat

SEQ ID NO: 5986841 - DNA, 17 bp, Homo sapiens
cactagaattcatgtga

SEQ ID NO: 5986842 - DNA, 17 bp, Homo sapiens
cactagacaagccagaa

SEQ ID NO: 5986843 - DNA, 21 bp, Homo sapiens
cactagacaagccagaacttg

SEQ ID NO: 5986844 - DNA, 12 bp, Homo sapiens
cactagagaaaa

SEQ ID NO: 5986845 - DNA, 16 bp, Homo sapiens
cactagagaatgcaca

SEQ ID NO: 5986846 - DNA, 23 bp, Homo sapiens
cactagagaatgcacagatatac

SEQ ID NO: 5986847 - DNA, 20 bp, Homo sapiens
cactagagacaaatctttaa

SEQ ID NO: 5986848 - DNA, 13 bp, Homo sapiens
cactagagctggg

SEQ ID NO: 5986849 - DNA, 15 bp, Homo sapiens
cactagagctgggaa

SEQ ID NO: 5986850 - DNA, 16 bp, Homo sapiens
cactagaggccaggga

SEQ ID NO: 5986851 - DNA, 12 bp, Homo sapiens
cactagagggcc

SEQ ID NO: 5986852 - DNA, 14 bp, Homo sapiens
cactagagggccca

SEQ ID NO: 5986853 - DNA, 22 bp, Homo sapiens
cactagagtcacccccccaggc

SEQ ID NO: 5986854 - DNA, 23 bp, Homo sapiens
cactagagtcacccccccaggcc

SEQ ID NO: 5986855 - DNA, 23 bp, Homo sapiens
cactagcatagaatagcgacagg

SEQ ID NO: 5986856 - DNA, 12 bp, Homo sapiens
cactagccaaac

SEQ ID NO: 5986857 - DNA, 14 bp, Homo sapiens
cactagccaaacct

SEQ ID NO: 5986858 - DNA, 19 bp, Homo sapiens
cactagccaaacctcacca

SEQ ID NO: 5986859 - DNA, 22 bp, Homo sapiens
cactagccaaacctcaccaact

SEQ ID NO: 5986860 - DNA, 16 bp, Homo sapiens
cactagccagacactc

SEQ ID NO: 5986861 - DNA, 17 bp, Homo sapiens
cactagcctctccagga

SEQ ID NO: 5986862 - DNA, 15 bp, Homo sapiens
cactagccttcccag

SEQ ID NO: 5986863 - DNA, 18 bp, Homo sapiens
cactagccttcccagctt

SEQ ID NO: 5986864 - DNA, 19 bp, Homo sapiens
cactagccttcccagcttc

SEQ ID NO: 5986865 - DNA, 17 bp, Homo sapiens
cactagcctttggctct

SEQ ID NO: 5986866 - DNA, 17 bp, Homo sapiens
cactagctaagcaagcc

SEQ ID NO: 5986867 - DNA, 13 bp, Homo sapiens
cactagctagatg

SEQ ID NO: 5986868 - DNA, 13 bp, Homo sapiens
cactagctcccca

SEQ ID NO: 5986869 - DNA, 17 bp, Homo sapiens
cactagctccccaatcc

SEQ ID NO: 5986870 - DNA, 16 bp, Homo sapiens
cactaggaaacgtgtt

SEQ ID NO: 5986871 - DNA, 20 bp, Homo sapiens
cactaggaatcccagaggtg

SEQ ID NO: 5986872 - DNA, 16 bp, Homo sapiens
cactaggactctgagg

SEQ ID NO: 5986873 - DNA, 18 bp, Homo sapiens
cactaggatcccactggc

SEQ ID NO: 5986874 - DNA, 17 bp, Homo sapiens
cactaggcccagaccca

SEQ ID NO: 5986875 - DNA, 17 bp, Homo sapiens
cactaggcccccacttg

SEQ ID NO: 5986876 - DNA, 21 bp, Homo sapiens
cactaggcccccacttgcctc

SEQ ID NO: 5986877 - DNA, 22 bp, Homo sapiens
cactaggcccccacttgcctct

SEQ ID NO: 5986878 - DNA, 16 bp, Homo sapiens
cactaggccctggtct

SEQ ID NO: 5986879 - DNA, 20 bp, Homo sapiens
cactaggccctggtctggct

SEQ ID NO: 5986880 - DNA, 23 bp, Homo sapiens
cactaggcctgaaatgacatttc

SEQ ID NO: 5986881 - DNA, 15 bp, Homo sapiens
cactaggctgggtgc

SEQ ID NO: 5986882 - DNA, 20 bp, Homo sapiens
cactagggcagggacaggat

SEQ ID NO: 5986883 - DNA, 21 bp, Homo sapiens
cactagggcagggacaggata

SEQ ID NO: 5986884 - DNA, 18 bp, Homo sapiens
cactagggccttggaaat

SEQ ID NO: 5986885 - DNA, 16 bp, Homo sapiens
cactagggctgagggg

SEQ ID NO: 5986886 - DNA, 23 bp, Homo sapiens
cactagggctgaggggcctgcgc

SEQ ID NO: 5986887 - DNA, 20 bp, Homo sapiens
cactaggggatataggagag

SEQ ID NO: 5986888 - DNA, 16 bp, Homo sapiens
cactaggtaggcttct

SEQ ID NO: 5986889 - DNA, 14 bp, Homo sapiens
cactaggtgtcccc

SEQ ID NO: 5986890 - DNA, 21 bp, Homo sapiens
cactaggtgtccccaacgtcc

SEQ ID NO: 5986891 - DNA, 22 bp, Homo sapiens
cactaggtgtccccaacgtccc

SEQ ID NO: 5986892 - DNA, 17 bp, Homo sapiens
cactaggttcaattccc

SEQ ID NO: 5986893 - DNA, 17 bp, Homo sapiens
cactagtaagtaattat

SEQ ID NO: 5986894 - DNA, 16 bp, Homo sapiens
cactagtagagcaaag

SEQ ID NO: 5986895 - DNA, 20 bp, Homo sapiens
cactagtagctgttttgaat

SEQ ID NO: 5986896 - DNA, 16 bp, Homo sapiens
cactagtcaagaaaaa

SEQ ID NO: 5986897 - DNA, 19 bp, Homo sapiens
cactagtcaagaaaaatat

SEQ ID NO: 5986898 - DNA, 22 bp, Homo sapiens
cactagtcaccgacagcggcct

SEQ ID NO: 5986899 - DNA, 12 bp, Homo sapiens
cactagtctgtg

SEQ ID NO: 5986900 - DNA, 15 bp, Homo sapiens
cactagtctgtgtgc

SEQ ID NO: 5986901 - DNA, 14 bp, Homo sapiens
cactagtggaaagt

SEQ ID NO: 5986902 - DNA, 22 bp, Homo sapiens
cactagtggaaagtcaggctag

SEQ ID NO: 5986903 - DNA, 18 bp, Homo sapiens
cactagtgtcaggccccc

SEQ ID NO: 5986904 - DNA, 14 bp, Homo sapiens
cactagttcagagg

SEQ ID NO: 5986905 - DNA, 20 bp, Homo sapiens
cactagttcagaggaagcac

SEQ ID NO: 5986906 - DNA, 22 bp, Homo sapiens
cactagttcagaggaagcacat

SEQ ID NO: 5986907 - DNA, 15 bp, Homo sapiens
cactagtttatgcta

SEQ ID NO: 5986908 - DNA, 23 bp, Homo sapiens
cactataaccatcagttactggt

SEQ ID NO: 5986909 - DNA, 17 bp, Homo sapiens
cactataatgtgaaatg

SEQ ID NO: 5986910 - DNA, 22 bp, Homo sapiens
cactatacaggctgggaagtgt

SEQ ID NO: 5986911 - DNA, 21 bp, Homo sapiens
cactatagcctaggtgacaga

SEQ ID NO: 5986912 - DNA, 16 bp, Homo sapiens
cactatatatatttct

SEQ ID NO: 5986913 - DNA, 19 bp, Homo sapiens
cactatatctgtatataaa

SEQ ID NO: 5986914 - DNA, 16 bp, Homo sapiens
cactatatttgtatat

SEQ ID NO: 5986915 - DNA, 14 bp, Homo sapiens
cactatatttttgg

SEQ ID NO: 5986916 - DNA, 13 bp, Homo sapiens
cactatcatagtt

SEQ ID NO: 5986917 - DNA, 18 bp, Homo sapiens
cactatccatgcaccaaa

SEQ ID NO: 5986918 - DNA, 22 bp, Homo sapiens
cactatctagggagccctgggc

SEQ ID NO: 5986919 - DNA, 19 bp, Homo sapiens
cactatctccgttccatct

SEQ ID NO: 5986920 - DNA, 14 bp, Homo sapiens
cactatcttcacaa

SEQ ID NO: 5986921 - DNA, 14 bp, Homo sapiens
cactatctttctga

SEQ ID NO: 5986922 - DNA, 19 bp, Homo sapiens
cactatctttctgataaca

SEQ ID NO: 5986923 - DNA, 17 bp, Homo sapiens
cactatgaagctacctc

SEQ ID NO: 5986924 - DNA, 12 bp, Homo sapiens
cactatgcattt

SEQ ID NO: 5986925 - DNA, 15 bp, Homo sapiens
cactatgctatttct

SEQ ID NO: 5986926 - DNA, 17 bp, Homo sapiens
cactatgctgctatgga

SEQ ID NO: 5986927 - DNA, 20 bp, Homo sapiens
cactatgggaagctctgtgt

SEQ ID NO: 5986928 - DNA, 17 bp, Homo sapiens
cactatgggtgagcata

SEQ ID NO: 5986929 - DNA, 19 bp, Homo sapiens
cactatggtatgctggcca

SEQ ID NO: 5986930 - DNA, 22 bp, Homo sapiens
cactatggtatgctggccagca

SEQ ID NO: 5986931 - DNA, 15 bp, Homo sapiens
cactatggtgccaat

SEQ ID NO: 5986932 - DNA, 22 bp, Homo sapiens
cactatggtgccaatggaacct

SEQ ID NO: 5986933 - DNA, 18 bp, Homo sapiens
cactatggtttgttgcct

SEQ ID NO: 5986934 - DNA, 20 bp, Homo sapiens
cactatgtgtgttgtttcca

SEQ ID NO: 5986935 - DNA, 17 bp, Homo sapiens
cactatgttgcccaggc

SEQ ID NO: 5986936 - DNA, 19 bp, Homo sapiens
cactatgttgcccaggcag

SEQ ID NO: 5986937 - DNA, 19 bp, Homo sapiens
cactatgttgcccaggctg

SEQ ID NO: 5986938 - DNA, 14 bp, Homo sapiens
cactatgtttctca

SEQ ID NO: 5986939 - DNA, 15 bp, Homo sapiens
cactattacagtatt

SEQ ID NO: 5986940 - DNA, 17 bp, Homo sapiens
cactattacttgaactt

SEQ ID NO: 5986941 - DNA, 12 bp, Homo sapiens
cactattagaga

SEQ ID NO: 5986942 - DNA, 15 bp, Homo sapiens
cactattagagaaac

SEQ ID NO: 5986943 - DNA, 14 bp, Homo sapiens
cactattatagaaa

SEQ ID NO: 5986944 - DNA, 19 bp, Homo sapiens
cactattatagaaattctg

SEQ ID NO: 5986945 - DNA, 15 bp, Homo sapiens
cactattatttccta

SEQ ID NO: 5986946 - DNA, 13 bp, Homo sapiens
cactattgaaaaa

SEQ ID NO: 5986947 - DNA, 17 bp, Homo sapiens
cactattgcattgttca

SEQ ID NO: 5986948 - DNA, 22 bp, Homo sapiens
cactattggctgggagtggtgg

SEQ ID NO: 5986949 - DNA, 14 bp, Homo sapiens
cactatttccacat

SEQ ID NO: 5986950 - DNA, 14 bp, Homo sapiens
cactatttccttta

SEQ ID NO: 5986951 - DNA, 14 bp, Homo sapiens
cactattttcaaag

SEQ ID NO: 5986952 - DNA, 13 bp, Homo sapiens
cactattttcaga

SEQ ID NO: 5986953 - DNA, 16 bp, Homo sapiens
cactattttcagaatc

SEQ ID NO: 5986954 - DNA, 17 bp, Homo sapiens
cactatttttatttata

SEQ ID NO: 5986955 - DNA, 22 bp, Homo sapiens
cactatttttattttcttatgt

SEQ ID NO: 5986956 - DNA, 15 bp, Homo sapiens
cactcaaaagctggg

SEQ ID NO: 5986957 - DNA, 21 bp, Homo sapiens
cactcaaagagggtgagggcc

SEQ ID NO: 5986958 - DNA, 15 bp, Homo sapiens
cactcaaaggccaga

SEQ ID NO: 5986959 - DNA, 20 bp, Homo sapiens
cactcaaaggccagacctgc

SEQ ID NO: 5986960 - DNA, 22 bp, Homo sapiens
cactcaaaggccagacctgcag

SEQ ID NO: 5986961 - DNA, 23 bp, Homo sapiens
cactcaaaggccagacctgcaga

SEQ ID NO: 5986962 - DNA, 16 bp, Homo sapiens
cactcaaatcaagaaa

SEQ ID NO: 5986963 - DNA, 16 bp, Homo sapiens
cactcaaatcttaaga

SEQ ID NO: 5986964 - DNA, 22 bp, Homo sapiens
cactcaacaatggttgaatgaa

SEQ ID NO: 5986965 - DNA, 20 bp, Homo sapiens
cactcaaccatgacctcacc

SEQ ID NO: 5986966 - DNA, 14 bp, Homo sapiens
cactcaagaagcag

SEQ ID NO: 5986967 - DNA, 19 bp, Homo sapiens
cactcaagaagcaggctac

SEQ ID NO: 5986968 - DNA, 14 bp, Homo sapiens
cactcaagaccaaa

SEQ ID NO: 5986969 - DNA, 16 bp, Homo sapiens
cactcaagactatgtt

SEQ ID NO: 5986970 - DNA, 18 bp, Homo sapiens
cactcaagagcccttcca

SEQ ID NO: 5986971 - DNA, 22 bp, Homo sapiens
cactcaagcaacaagcctcaaa

SEQ ID NO: 5986972 - DNA, 13 bp, Homo sapiens
cactcaagcactg

SEQ ID NO: 5986973 - DNA, 14 bp, Homo sapiens
cactcaagcactga

SEQ ID NO: 5986974 - DNA, 18 bp, Homo sapiens
cactcaagccaagcagcc

SEQ ID NO: 5986975 - DNA, 21 bp, Homo sapiens
cactcaaggaaaagatgtgct

SEQ ID NO: 5986976 - DNA, 19 bp, Homo sapiens
cactcaaggacaggagcct

SEQ ID NO: 5986977 - DNA, 14 bp, Homo sapiens
cactcaagtgccat

SEQ ID NO: 5986978 - DNA, 18 bp, Homo sapiens
cactcaagtgccattcat

SEQ ID NO: 5986979 - DNA, 18 bp, Homo sapiens
cactcaagttcaaggacc

SEQ ID NO: 5986980 - DNA, 19 bp, Homo sapiens
cactcaagttcaaggacca

SEQ ID NO: 5986981 - DNA, 17 bp, Homo sapiens
cactcaagttgtttaac

SEQ ID NO: 5986982 - DNA, 20 bp, Homo sapiens
cactcacaatttaaaatatt

SEQ ID NO: 5986983 - DNA, 18 bp, Homo sapiens
cactcacacagccaggtg

SEQ ID NO: 5986984 - DNA, 15 bp, Homo sapiens
cactcacactggcca

SEQ ID NO: 5986985 - DNA, 23 bp, Homo sapiens
cactcacagacctggagcccctg

SEQ ID NO: 5986986 - DNA, 15 bp, Homo sapiens
cactcacagagtcaa

SEQ ID NO: 5986987 - DNA, 20 bp, Homo sapiens
cactcacagagtcaaggcct

SEQ ID NO: 5986988 - DNA, 18 bp, Homo sapiens
cactcacagggagctggc

SEQ ID NO: 5986989 - DNA, 21 bp, Homo sapiens
cactcacatagccaactctcc

SEQ ID NO: 5986990 - DNA, 23 bp, Homo sapiens
cactcacatagccaactctccca

SEQ ID NO: 5986991 - DNA, 19 bp, Homo sapiens
cactcacatgccgccccca

SEQ ID NO: 5986992 - DNA, 19 bp, Homo sapiens
cactcacatttattctgct

SEQ ID NO: 5986993 - DNA, 19 bp, Homo sapiens
cactcaccacaagctgagc

SEQ ID NO: 5986994 - DNA, 22 bp, Homo sapiens
cactcaccacaagctgagcagg

SEQ ID NO: 5986995 - DNA, 17 bp, Homo sapiens
caagctcagaaggctct

SEQ ID NO: 5986996 - DNA, 21 bp, Homo sapiens
caagctcagaggcgcactgtg

SEQ ID NO: 5986997 - DNA, 21 bp, Homo sapiens
caagctcagcacaatctgtaa

SEQ ID NO: 5986998 - DNA, 16 bp, Homo sapiens
caagctcaggaccagg

SEQ ID NO: 5986999 - DNA, 16 bp, Homo sapiens
caagctcatagcacat

SEQ ID NO: 5987000 - DNA, 19 bp, Homo sapiens
caagctcatagcacatgtt

SEQ ID NO: 5987001 - DNA, 16 bp, Homo sapiens
caagctcatccctgga

SEQ ID NO: 5987002 - DNA, 15 bp, Homo sapiens
caagctcatctattt

SEQ ID NO: 5987003 - DNA, 17 bp, Homo sapiens
caagctcatctatttgg

SEQ ID NO: 5987004 - DNA, 16 bp, Homo sapiens
caagctcatgtcatta

SEQ ID NO: 5987005 - DNA, 12 bp, Homo sapiens
caagctccaagc

SEQ ID NO: 5987006 - DNA, 21 bp, Homo sapiens
caagctccaagctcccaggca

SEQ ID NO: 5987007 - DNA, 21 bp, Homo sapiens
caagctccatctccactccag

SEQ ID NO: 5987008 - DNA, 13 bp, Homo sapiens
caagctcccaagg

SEQ ID NO: 5987009 - DNA, 18 bp, Homo sapiens
caagctcccaagggatgg

SEQ ID NO: 5987010 - DNA, 17 bp, Homo sapiens
caagctcccaggcattc

SEQ ID NO: 5987011 - DNA, 14 bp, Homo sapiens
caagctcccaggcc

SEQ ID NO: 5987012 - DNA, 15 bp, Homo sapiens
caagctccctggagc

SEQ ID NO: 5987013 - DNA, 12 bp, Homo sapiens
caagctcctccc

SEQ ID NO: 5987014 - DNA, 14 bp, Homo sapiens
caagctcctccctt

SEQ ID NO: 5987015 - DNA, 16 bp, Homo sapiens
caagctcctcccttga

SEQ ID NO: 5987016 - DNA, 14 bp, Homo sapiens
caagctcctcctcc

SEQ ID NO: 5987017 - DNA, 22 bp, Homo sapiens
caagctcctcctccctgcatct

SEQ ID NO: 5987018 - DNA, 20 bp, Homo sapiens
caagctcctcctcggaaccg

SEQ ID NO: 5987019 - DNA, 17 bp, Homo sapiens
caagctctgagggaaag

SEQ ID NO: 5987020 - DNA, 14 bp, Homo sapiens
caagctctgccctg

SEQ ID NO: 5987021 - DNA, 14 bp, Homo sapiens
caagctctgcctcc

SEQ ID NO: 5987022 - DNA, 13 bp, Homo sapiens
caagctctgggga

SEQ ID NO: 5987023 - DNA, 19 bp, Homo sapiens
caagctctggggatgggtg

SEQ ID NO: 5987024 - DNA, 13 bp, Homo sapiens
caagctcttccct

SEQ ID NO: 5987025 - DNA, 21 bp, Homo sapiens
caagctcttcccttgctcatg

SEQ ID NO: 5987026 - DNA, 13 bp, Homo sapiens
caagctcttctcc

SEQ ID NO: 5987027 - DNA, 16 bp, Homo sapiens
caagctcttctcctca

SEQ ID NO: 5987028 - DNA, 18 bp, Homo sapiens
caagctcttgccccactc

SEQ ID NO: 5987029 - DNA, 14 bp, Homo sapiens
caagctcttgtttc

SEQ ID NO: 5987030 - DNA, 13 bp, Homo sapiens
caagctgaaattt

SEQ ID NO: 5987031 - DNA, 20 bp, Homo sapiens
caagctgaaattttagaaat

SEQ ID NO: 5987032 - DNA, 12 bp, Homo sapiens
caagctgaagct

SEQ ID NO: 5987033 - DNA, 20 bp, Homo sapiens
caagctgaagtgaaggagaa

SEQ ID NO: 5987034 - DNA, 21 bp, Homo sapiens
caagctgaagtgaaggagaaa

SEQ ID NO: 5987035 - DNA, 12 bp, Homo sapiens
caagctgagaaa

SEQ ID NO: 5987036 - DNA, 12 bp, Homo sapiens
caagctgagcag

SEQ ID NO: 5987037 - DNA, 14 bp, Homo sapiens
caagctgagcagga

SEQ ID NO: 5987038 - DNA, 19 bp, Homo sapiens
caagctgaggtgcccagga

SEQ ID NO: 5987039 - DNA, 19 bp, Homo sapiens
caagctgatgtttgtactt

SEQ ID NO: 5987040 - DNA, 20 bp, Homo sapiens
caagctgcaccctcaggcag

SEQ ID NO: 5987041 - DNA, 21 bp, Homo sapiens
caagctgcaccctcaggcagg

SEQ ID NO: 5987042 - DNA, 10 bp, Homo sapiens
caagctgcag

SEQ ID NO: 5987043 - DNA, 15 bp, Homo sapiens
caagctgcctccctg

SEQ ID NO: 5987044 - DNA, 16 bp, Homo sapiens
caagctgcctctgggc

SEQ ID NO: 5987045 - DNA, 22 bp, Homo sapiens
caagctgcgggctccctggcag

SEQ ID NO: 5987046 - DNA, 23 bp, Homo sapiens
caagctgcgggctccctggcagg

SEQ ID NO: 5987047 - DNA, 16 bp, Homo sapiens
caagctgctctgagcc

SEQ ID NO: 5987048 - DNA, 13 bp, Homo sapiens
caagctgctgccg

SEQ ID NO: 5987049 - DNA, 14 bp, Homo sapiens
caagctgctgtggc

SEQ ID NO: 5987050 - DNA, 12 bp, Homo sapiens
caagctggatgc

SEQ ID NO: 5987051 - DNA, 17 bp, Homo sapiens
caagctggcaggagggt

SEQ ID NO: 5987052 - DNA, 22 bp, Homo sapiens
caagctggccaaagtcacttcc

SEQ ID NO: 5987053 - DNA, 16 bp, Homo sapiens
caagctggccgtggag

SEQ ID NO: 5987054 - DNA, 18 bp, Homo sapiens
caagctggccgtggagtc

SEQ ID NO: 5987055 - DNA, 12 bp, Homo sapiens
caagctggcctc

SEQ ID NO: 5987056 - DNA, 13 bp, Homo sapiens
caagctggcttct

SEQ ID NO: 5987057 - DNA, 16 bp, Homo sapiens
caagctgggaacttct

SEQ ID NO: 5987058 - DNA, 18 bp, Homo sapiens
caagctgggccccagccc

SEQ ID NO: 5987059 - DNA, 17 bp, Homo sapiens
caagctggtcccactca

SEQ ID NO: 5987060 - DNA, 20 bp, Homo sapiens
caagctgtagataacagcaa

SEQ ID NO: 5987061 - DNA, 17 bp, Homo sapiens
caagctgtccagagaaa

SEQ ID NO: 5987062 - DNA, 12 bp, Homo sapiens
caagctgtcccc

SEQ ID NO: 5987063 - DNA, 16 bp, Homo sapiens
caagctgtcccctctg

SEQ ID NO: 5987064 - DNA, 20 bp, Homo sapiens
caagctgtcccctctgtcat

SEQ ID NO: 5987065 - DNA, 15 bp, Homo sapiens
caagctgtccctgca

SEQ ID NO: 5987066 - DNA, 17 bp, Homo sapiens
caagctgtccctgcagg

SEQ ID NO: 5987067 - DNA, 14 bp, Homo sapiens
caagctgtgagaca

SEQ ID NO: 5987068 - DNA, 22 bp, Homo sapiens
caagctgtgagacagtgggaaa

SEQ ID NO: 5987069 - DNA, 14 bp, Homo sapiens
caagctgtgccacc

SEQ ID NO: 5987070 - DNA, 15 bp, Homo sapiens
caagctgtgccaccc

SEQ ID NO: 5987071 - DNA, 16 bp, Homo sapiens
caagctgtgccaccct

SEQ ID NO: 5987072 - DNA, 12 bp, Homo sapiens
caagctgtgctg

SEQ ID NO: 5987073 - DNA, 15 bp, Homo sapiens
caagctgtgctggga

SEQ ID NO: 5987074 - DNA, 18 bp, Homo sapiens
caagctgtggcagccgtc

SEQ ID NO: 5987075 - DNA, 22 bp, Homo sapiens
caagctgttatttcttccctgc

SEQ ID NO: 5987076 - DNA, 17 bp, Homo sapiens
caagctgttgaccaggc

SEQ ID NO: 5987077 - DNA, 22 bp, Homo sapiens
caagcttaaccaaggctccaat

SEQ ID NO: 5987078 - DNA, 19 bp, Homo sapiens
caagcttaaggagaggaga

SEQ ID NO: 5987079 - DNA, 22 bp, Homo sapiens
caagcttaatagccctccccct

SEQ ID NO: 5987080 - DNA, 19 bp, Homo sapiens
caagcttagtcctgggaga

SEQ ID NO: 5987081 - DNA, 18 bp, Homo sapiens
caagcttcaaagccatat

SEQ ID NO: 5987082 - DNA, 17 bp, Homo sapiens
caagcttcaagtgatat

SEQ ID NO: 5987083 - DNA, 19 bp, Homo sapiens
caagcttcaatatttttct

SEQ ID NO: 5987084 - DNA, 20 bp, Homo sapiens
caagcttcagagcctagcca

SEQ ID NO: 5987085 - DNA, 12 bp, Homo sapiens
caagcttcagtt

SEQ ID NO: 5987086 - DNA, 22 bp, Homo sapiens
caagcttcagtttcctggtctg

SEQ ID NO: 5987087 - DNA, 19 bp, Homo sapiens
caagcttccctccatcccc

SEQ ID NO: 5987088 - DNA, 14 bp, Homo sapiens
caagcttcctgtgc

SEQ ID NO: 5987089 - DNA, 19 bp, Homo sapiens
caagcttcctgtgccctca

SEQ ID NO: 5987090 - DNA, 24 bp, Homo sapiens
caagcttcctgtgccctcacccca

SEQ ID NO: 5987091 - DNA, 16 bp, Homo sapiens
caagcttctctgttct

SEQ ID NO: 5987092 - DNA, 20 bp, Homo sapiens
caagcttctgccttctggaa

SEQ ID NO: 5987093 - DNA, 17 bp, Homo sapiens
caagcttctgtcctgcc

SEQ ID NO: 5987094 - DNA, 14 bp, Homo sapiens
caagcttcttgctg

SEQ ID NO: 5987095 - DNA, 13 bp, Homo sapiens
caagcttctttta

SEQ ID NO: 5987096 - DNA, 18 bp, Homo sapiens
caagcttggtcaaacttt

SEQ ID NO: 5987097 - DNA, 19 bp, Homo sapiens
caagcttggtcaaactttt

SEQ ID NO: 5987098 - DNA, 21 bp, Homo sapiens
caagcttgtatatacatatta

SEQ ID NO: 5987099 - DNA, 22 bp, Homo sapiens
caagcttgtgtgggcccaacag

SEQ ID NO: 5987100 - DNA, 14 bp, Homo sapiens
caagcttgtttccc

SEQ ID NO: 5987101 - DNA, 13 bp, Homo sapiens
caagctttaaatt

SEQ ID NO: 5987102 - DNA, 16 bp, Homo sapiens
caagctttaacagact

SEQ ID NO: 5987103 - DNA, 14 bp, Homo sapiens
caagctttaggtaa

SEQ ID NO: 5987104 - DNA, 22 bp, Homo sapiens
caagctttcttctacaaccaga

SEQ ID NO: 5987105 - DNA, 22 bp, Homo sapiens
caagctttgaatacccccagag

SEQ ID NO: 5987106 - DNA, 23 bp, Homo sapiens
caagctttgaatacccccagaga

SEQ ID NO: 5987107 - DNA, 23 bp, Homo sapiens
caagctttgaggctctgtcactg

SEQ ID NO: 5987108 - DNA, 18 bp, Homo sapiens
caagctttgagtgggaca

SEQ ID NO: 5987109 - DNA, 20 bp, Homo sapiens
caagctttgatttagattga

SEQ ID NO: 5987110 - DNA, 21 bp, Homo sapiens
caagctttgctccttcagttc

SEQ ID NO: 5987111 - DNA, 22 bp, Homo sapiens
caagctttgctccttcagttct

SEQ ID NO: 5987112 - DNA, 23 bp, Homo sapiens
caagctttgctccttcagttctg

SEQ ID NO: 5987113 - DNA, 15 bp, Homo sapiens
caagcttttcctaat

SEQ ID NO: 5987114 - DNA, 16 bp, Homo sapiens
caagcttttcctttct

SEQ ID NO: 5987115 - DNA, 16 bp, Homo sapiens
caaggaaaaagaaaat

SEQ ID NO: 5987116 - DNA, 17 bp, Homo sapiens
caaggaaaaagaaaata

SEQ ID NO: 5987117 - DNA, 16 bp, Homo sapiens
caaggaaaactgcatg

SEQ ID NO: 5987118 - DNA, 14 bp, Homo sapiens
caaggaaaaggagg

SEQ ID NO: 5987119 - DNA, 22 bp, Homo sapiens
caaggaaaatctatatttgtct

SEQ ID NO: 5987120 - DNA, 15 bp, Homo sapiens
caaggaaaattgaaa

SEQ ID NO: 5987121 - DNA, 17 bp, Homo sapiens
caaggaaaattgaaagt

SEQ ID NO: 5987122 - DNA, 16 bp, Homo sapiens
caaggaaacaggctcc

SEQ ID NO: 5987123 - DNA, 17 bp, Homo sapiens
caaggaaaccacagctg

SEQ ID NO: 5987124 - DNA, 22 bp, Homo sapiens
caaggaaaccacagctgctgga

SEQ ID NO: 5987125 - DNA, 13 bp, Homo sapiens
caaggaaactttc

SEQ ID NO: 5987126 - DNA, 20 bp, Homo sapiens
caaggaaaggctcatttaaa

SEQ ID NO: 5987127 - DNA, 18 bp, Homo sapiens
caaggaaattcctcagca

SEQ ID NO: 5987128 - DNA, 12 bp, Homo sapiens
caaggaacaaga

SEQ ID NO: 5987129 - DNA, 15 bp, Homo sapiens
caaggaacaagagaa

SEQ ID NO: 5987130 - DNA, 19 bp, Homo sapiens
caaggaaccctcaggccac

SEQ ID NO: 5987131 - DNA, 19 bp, Homo sapiens
caaggaacctaattgaaat

SEQ ID NO: 5987132 - DNA, 23 bp, Homo sapiens
caaggaacctaattgaaatttaa

SEQ ID NO: 5987133 - DNA, 22 bp, Homo sapiens
caaggaactaatttcttctcct

SEQ ID NO: 5987134 - DNA, 21 bp, Homo sapiens
caaggaactttccccagatca

SEQ ID NO: 5987135 - DNA, 11 bp, Homo sapiens
caaggaagaaa

SEQ ID NO: 5987136 - DNA, 15 bp, Homo sapiens
caaggaagaagaaat

SEQ ID NO: 5987137 - DNA, 19 bp, Homo sapiens
caaggaagaagaaatcttt

SEQ ID NO: 5987138 - DNA, 14 bp, Homo sapiens
caaggaagagccag

SEQ ID NO: 5987139 - DNA, 11 bp, Homo sapiens
caaggaagcag

SEQ ID NO: 5987140 - DNA, 12 bp, Homo sapiens
caaggaagcaga

SEQ ID NO: 5987141 - DNA, 13 bp, Homo sapiens
caaggaaggaaaa

SEQ ID NO: 5987142 - DNA, 17 bp, Homo sapiens
caaggaaggaaaagaaa

SEQ ID NO: 5987143 - DNA, 14 bp, Homo sapiens
caaggaaggaaaca

SEQ ID NO: 5987144 - DNA, 17 bp, Homo sapiens
caaggaaggaaagaaag

SEQ ID NO: 5987145 - DNA, 17 bp, Homo sapiens
caaggaaggacatttcc

SEQ ID NO: 5987146 - DNA, 12 bp, Homo sapiens
caaggaaggagc

SEQ ID NO: 5987147 - DNA, 13 bp, Homo sapiens
caaggaaggagcc

SEQ ID NO: 5987148 - DNA, 20 bp, Homo sapiens
caaggaagggatgtatttgt

SEQ ID NO: 5987149 - DNA, 19 bp, Homo sapiens
caaggaagtaagggagtca

SEQ ID NO: 5987150 - DNA, 16 bp, Homo sapiens
caaggaagtagaaaca

SEQ ID NO: 5987151 - DNA, 19 bp, Homo sapiens
caaggaagtagaaacaaaa

SEQ ID NO: 5987152 - DNA, 19 bp, Homo sapiens
caaggaagtctgtgtctac

SEQ ID NO: 5987153 - DNA, 18 bp, Homo sapiens
caaggaagtcttcaaatt

SEQ ID NO: 5987154 - DNA, 16 bp, Homo sapiens
caaggaatcctctggg

SEQ ID NO: 5987155 - DNA, 21 bp, Homo sapiens
caaggaatgcctgtgccaata

SEQ ID NO: 5987156 - DNA, 16 bp, Homo sapiens
caaggaatgtgtccaa

SEQ ID NO: 5987157 - DNA, 21 bp, Homo sapiens
caaggaatgttatcagtatta

SEQ ID NO: 5987158 - DNA, 22 bp, Homo sapiens
caaggaatttaaaactgttatt

SEQ ID NO: 5987159 - DNA, 22 bp, Homo sapiens
caaggaatttccctgtgtggat

SEQ ID NO: 5987160 - DNA, 11 bp, Homo sapiens
caaggacaaag

SEQ ID NO: 5987161 - DNA, 17 bp, Homo sapiens
caaggacaaagtctcca

SEQ ID NO: 5987162 - DNA, 19 bp, Homo sapiens
caaggacaaagtctccagc

SEQ ID NO: 5987163 - DNA, 18 bp, Homo sapiens
caaggacaacctgcccct

SEQ ID NO: 5987164 - DNA, 18 bp, Homo sapiens
caaggacagaaggctcct

SEQ ID NO: 5987165 - DNA, 18 bp, Homo sapiens
caaggacagacagcaggc

SEQ ID NO: 5987166 - DNA, 17 bp, Homo sapiens
caaggacaggagcctgg

SEQ ID NO: 5987167 - DNA, 18 bp, Homo sapiens
caaggacaggagcctggt

SEQ ID NO: 5987168 - DNA, 15 bp, Homo sapiens
caaggacagggctga

SEQ ID NO: 5987169 - DNA, 22 bp, Homo sapiens
caaggacagggctgagcgtgga

SEQ ID NO: 5987170 - DNA, 21 bp, Homo sapiens
caaggacagggctggctcctc

SEQ ID NO: 5987171 - DNA, 17 bp, Homo sapiens
caaggacagttcagaga

SEQ ID NO: 5987172 - DNA, 21 bp, Homo sapiens
caaggacagttcagagatcag

SEQ ID NO: 5987173 - DNA, 22 bp, Homo sapiens
caaggacattcactgctgattt

SEQ ID NO: 5987174 - DNA, 12 bp, Homo sapiens
caaggacattgc

SEQ ID NO: 5987175 - DNA, 20 bp, Homo sapiens
cactcaccactaccagccag

SEQ ID NO: 5987176 - DNA, 12 bp, Homo sapiens
cactcaccaggg

SEQ ID NO: 5987177 - DNA, 21 bp, Homo sapiens
cactcaccagtgtcccctcca

SEQ ID NO: 5987178 - DNA, 12 bp, Homo sapiens
cactcaccattt

SEQ ID NO: 5987179 - DNA, 22 bp, Homo sapiens
cactcacccatgtgccaaggtg

SEQ ID NO: 5987180 - DNA, 18 bp, Homo sapiens
cactcaccccagcctcat

SEQ ID NO: 5987181 - DNA, 16 bp, Homo sapiens
cactcaccccctttgc

SEQ ID NO: 5987182 - DNA, 21 bp, Homo sapiens
cactcaccccctttgctgtga

SEQ ID NO: 5987183 - DNA, 19 bp, Homo sapiens
cactcacccctagccctgg

SEQ ID NO: 5987184 - DNA, 20 bp, Homo sapiens
cactcacccctagccctggt

SEQ ID NO: 5987185 - DNA, 20 bp, Homo sapiens
cactcacccttcctggccca

SEQ ID NO: 5987186 - DNA, 14 bp, Homo sapiens
cactcacctctaac

SEQ ID NO: 5987187 - DNA, 22 bp, Homo sapiens
cactcactaggcccccacttgc

SEQ ID NO: 5987188 - DNA, 13 bp, Homo sapiens
cactcactcactc

SEQ ID NO: 5987189 - DNA, 14 bp, Homo sapiens
cactcactcactcc

SEQ ID NO: 5987190 - DNA, 18 bp, Homo sapiens
cactcactcactccaaga

SEQ ID NO: 5987191 - DNA, 19 bp, Homo sapiens
cactcactcactccaagac

SEQ ID NO: 5987192 - DNA, 17 bp, Homo sapiens
cactcactcactcccca

SEQ ID NO: 5987193 - DNA, 12 bp, Homo sapiens
cactcactcctg

SEQ ID NO: 5987194 - DNA, 15 bp, Homo sapiens
cactcactgaggcca

SEQ ID NO: 5987195 - DNA, 15 bp, Homo sapiens
cactcactgcatttg

SEQ ID NO: 5987196 - DNA, 13 bp, Homo sapiens
cactcactgccaa

SEQ ID NO: 5987197 - DNA, 14 bp, Homo sapiens
cactcactgcctgc

SEQ ID NO: 5987198 - DNA, 18 bp, Homo sapiens
cactcactgcctgcagct

SEQ ID NO: 5987199 - DNA, 15 bp, Homo sapiens
cactcactggcatct

SEQ ID NO: 5987200 - DNA, 15 bp, Homo sapiens
cactcactgtttata

SEQ ID NO: 5987201 - DNA, 18 bp, Homo sapiens
cactcacttaattctcat

SEQ ID NO: 5987202 - DNA, 21 bp, Homo sapiens
cactcagaaaagaaaaccatt

SEQ ID NO: 5987203 - DNA, 21 bp, Homo sapiens
cactcagaaaagacgcaccag

SEQ ID NO: 5987204 - DNA, 22 bp, Homo sapiens
cactcagaagacactgatgggc

SEQ ID NO: 5987205 - DNA, 16 bp, Homo sapiens
cactcagagacatgca

SEQ ID NO: 5987206 - DNA, 21 bp, Homo sapiens
cactcagagcagtctgtgact

SEQ ID NO: 5987207 - DNA, 17 bp, Homo sapiens
cactcagaggcccccag

SEQ ID NO: 5987208 - DNA, 18 bp, Homo sapiens
cactcagaggcccccagt

SEQ ID NO: 5987209 - DNA, 22 bp, Homo sapiens
cactcagagggaggagtttttc

SEQ ID NO: 5987210 - DNA, 14 bp, Homo sapiens
cactcagatttaag

SEQ ID NO: 5987211 - DNA, 13 bp, Homo sapiens
cactcagcaccac

SEQ ID NO: 5987212 - DNA, 18 bp, Homo sapiens
cactcagcaccactcaag

SEQ ID NO: 5987213 - DNA, 21 bp, Homo sapiens
cactcagcacccccttctctg

SEQ ID NO: 5987214 - DNA, 13 bp, Homo sapiens
cactcagcactct

SEQ ID NO: 5987215 - DNA, 14 bp, Homo sapiens
cactcagcagcccc

SEQ ID NO: 5987216 - DNA, 23 bp, Homo sapiens
cactcagcatccccaaccgtgca

SEQ ID NO: 5987217 - DNA, 22 bp, Homo sapiens
cactcagccacaaagcccccca

SEQ ID NO: 5987218 - DNA, 14 bp, Homo sapiens
cactcagccacacc

SEQ ID NO: 5987219 - DNA, 17 bp, Homo sapiens
cactcagccacacccca

SEQ ID NO: 5987220 - DNA, 18 bp, Homo sapiens
cactcagccaccctgagt

SEQ ID NO: 5987221 - DNA, 21 bp, Homo sapiens
cactcagccactgtcacaggc

SEQ ID NO: 5987222 - DNA, 22 bp, Homo sapiens
cactcagccactgtcacaggca

SEQ ID NO: 5987223 - DNA, 19 bp, Homo sapiens
cactcagccatttccccct

SEQ ID NO: 5987224 - DNA, 11 bp, Homo sapiens
cactcagcccc

SEQ ID NO: 5987225 - DNA, 22 bp, Homo sapiens
cactcagcccctacccctgccc

SEQ ID NO: 5987226 - DNA, 15 bp, Homo sapiens
cactcagccgtgggc

SEQ ID NO: 5987227 - DNA, 16 bp, Homo sapiens
cactcagccgtgggcc

SEQ ID NO: 5987228 - DNA, 22 bp, Homo sapiens
cactcagctcttggctccactg

SEQ ID NO: 5987229 - DNA, 22 bp, Homo sapiens
cactcagctgagaaggccagcc

SEQ ID NO: 5987230 - DNA, 20 bp, Homo sapiens
cactcagctgtcctgcagca

SEQ ID NO: 5987231 - DNA, 20 bp, Homo sapiens
cactcagcttaattctcctt

SEQ ID NO: 5987232 - DNA, 19 bp, Homo sapiens
cactcagcttcctacccac

SEQ ID NO: 5987233 - DNA, 23 bp, Homo sapiens
cactcaggaaccctggagacaga

SEQ ID NO: 5987234 - DNA, 12 bp, Homo sapiens
cactcaggagca

SEQ ID NO: 5987235 - DNA, 21 bp, Homo sapiens
cactcaggagcacagccatag

SEQ ID NO: 5987236 - DNA, 23 bp, Homo sapiens
cactcaggagcacagccatagca

SEQ ID NO: 5987237 - DNA, 19 bp, Homo sapiens
cactcaggccaacaagcca

SEQ ID NO: 5987238 - DNA, 13 bp, Homo sapiens
cactcaggccaca

SEQ ID NO: 5987239 - DNA, 18 bp, Homo sapiens
cactcaggcctgtgccca

SEQ ID NO: 5987240 - DNA, 20 bp, Homo sapiens
cactcaggcctgtgcccact

SEQ ID NO: 5987241 - DNA, 12 bp, Homo sapiens
cactcaggctgg

SEQ ID NO: 5987242 - DNA, 20 bp, Homo sapiens
cactcaggctggagtacagt

SEQ ID NO: 5987243 - DNA, 12 bp, Homo sapiens
cactcagggcag

SEQ ID NO: 5987244 - DNA, 14 bp, Homo sapiens
cactcagggcagct

SEQ ID NO: 5987245 - DNA, 18 bp, Homo sapiens
cactcagggcagctgcct

SEQ ID NO: 5987246 - DNA, 20 bp, Homo sapiens
cactcagggcagctgcctgg

SEQ ID NO: 5987247 - DNA, 22 bp, Homo sapiens
cactcagggcagctgcctggcc

SEQ ID NO: 5987248 - DNA, 17 bp, Homo sapiens
cactcagggctgccact

SEQ ID NO: 5987249 - DNA, 13 bp, Homo sapiens
cactcagggctgg

SEQ ID NO: 5987250 - DNA, 15 bp, Homo sapiens
cactcagggctggcc

SEQ ID NO: 5987251 - DNA, 16 bp, Homo sapiens
cactcagggctggccc

SEQ ID NO: 5987252 - DNA, 17 bp, Homo sapiens
cactcagggctggcccg

SEQ ID NO: 5987253 - DNA, 21 bp, Homo sapiens
cactcagggctggggccaaga

SEQ ID NO: 5987254 - DNA, 17 bp, Homo sapiens
cactcaggtacttggta

SEQ ID NO: 5987255 - DNA, 15 bp, Homo sapiens
cactcagtctcttcc

SEQ ID NO: 5987256 - DNA, 14 bp, Homo sapiens
cactcagtgagcct

SEQ ID NO: 5987257 - DNA, 22 bp, Homo sapiens
cactcagtgagcctcctgtgcc

SEQ ID NO: 5987258 - DNA, 22 bp, Homo sapiens
cactcagtgaggccgcccggca

SEQ ID NO: 5987259 - DNA, 19 bp, Homo sapiens
cactcagtgggctgtttct

SEQ ID NO: 5987260 - DNA, 20 bp, Homo sapiens
cactcagtgggctgtttctg

SEQ ID NO: 5987261 - DNA, 21 bp, Homo sapiens
cactcagtttcacaagtgagc

SEQ ID NO: 5987262 - DNA, 22 bp, Homo sapiens
cactcatacatatgtagaaaca

SEQ ID NO: 5987263 - DNA, 15 bp, Homo sapiens
cactcatagggtgct

SEQ ID NO: 5987264 - DNA, 16 bp, Homo sapiens
cactcatagggtgctc

SEQ ID NO: 5987265 - DNA, 20 bp, Homo sapiens
cactcatcactaaacagaga

SEQ ID NO: 5987266 - DNA, 24 bp, Homo sapiens
cactcatctactgaatgacctctc

SEQ ID NO: 5987267 - DNA, 19 bp, Homo sapiens
cactcatgacggcctgcct

SEQ ID NO: 5987268 - DNA, 18 bp, Homo sapiens
cactcatgcattgtcctc

SEQ ID NO: 5987269 - DNA, 18 bp, Homo sapiens
cactcatgcggcccagcc

SEQ ID NO: 5987270 - DNA, 20 bp, Homo sapiens
cactcatgcggcccagccat

SEQ ID NO: 5987271 - DNA, 22 bp, Homo sapiens
cactcatgtgactctttccaac

SEQ ID NO: 5987272 - DNA, 16 bp, Homo sapiens
cactcatgtggactgg

SEQ ID NO: 5987273 - DNA, 20 bp, Homo sapiens
cactcattgacctgaggccc

SEQ ID NO: 5987274 - DNA, 21 bp, Homo sapiens
cactcattgcagatcccagcc

SEQ ID NO: 5987275 - DNA, 19 bp, Homo sapiens
cactcattgctgagcctct

SEQ ID NO: 5987276 - DNA, 21 bp, Homo sapiens
cactcattgctgagcctctgc

SEQ ID NO: 5987277 - DNA, 23 bp, Homo sapiens
cactcatttacgtaaaaagatat

SEQ ID NO: 5987278 - DNA, 12 bp, Homo sapiens
cactcatttcat

SEQ ID NO: 5987279 - DNA, 14 bp, Homo sapiens
cactcatttcatct

SEQ ID NO: 5987280 - DNA, 16 bp, Homo sapiens
cactcatttcatctca

SEQ ID NO: 5987281 - DNA, 17 bp, Homo sapiens
cactcatttcatctcat

SEQ ID NO: 5987282 - DNA, 22 bp, Homo sapiens
cactcatttcatctcatttaag

SEQ ID NO: 5987283 - DNA, 20 bp, Homo sapiens
cactccaaaccttactctga

SEQ ID NO: 5987284 - DNA, 23 bp, Homo sapiens
cactccaaaccttactctgagct

SEQ ID NO: 5987285 - DNA, 11 bp, Homo sapiens
cactccaaact

SEQ ID NO: 5987286 - DNA, 12 bp, Homo sapiens
cactccaaactc

SEQ ID NO: 5987287 - DNA, 15 bp, Homo sapiens
cactccaaagagaaa

SEQ ID NO: 5987288 - DNA, 21 bp, Homo sapiens
cactccaacctaacctgtgtc

SEQ ID NO: 5987289 - DNA, 14 bp, Homo sapiens
cactccaagccccc

SEQ ID NO: 5987290 - DNA, 18 bp, Homo sapiens
cactccaagccccctggc

SEQ ID NO: 5987291 - DNA, 14 bp, Homo sapiens
cactccaagtgccc

SEQ ID NO: 5987292 - DNA, 21 bp, Homo sapiens
cactccaattaaggattttat

SEQ ID NO: 5987293 - DNA, 13 bp, Homo sapiens
cactccacacatc

SEQ ID NO: 5987294 - DNA, 23 bp, Homo sapiens
cactccacaccagtaataaaaag

SEQ ID NO: 5987295 - DNA, 14 bp, Homo sapiens
cactccacactggc

SEQ ID NO: 5987296 - DNA, 13 bp, Homo sapiens
cactccacagtgt

SEQ ID NO: 5987297 - DNA, 22 bp, Homo sapiens
cactccacataaggggtttagt

SEQ ID NO: 5987298 - DNA, 18 bp, Homo sapiens
cactccacatctgcatca

SEQ ID NO: 5987299 - DNA, 18 bp, Homo sapiens
cactccaccacccaaaag

SEQ ID NO: 5987300 - DNA, 20 bp, Homo sapiens
cactccaccatcactcactc

SEQ ID NO: 5987301 - DNA, 19 bp, Homo sapiens
cactccaccccctccagct

SEQ ID NO: 5987302 - DNA, 12 bp, Homo sapiens
cactccaccctc

SEQ ID NO: 5987303 - DNA, 15 bp, Homo sapiens
cactccaccctgtta

SEQ ID NO: 5987304 - DNA, 16 bp, Homo sapiens
cactccaccctgttag

SEQ ID NO: 5987305 - DNA, 17 bp, Homo sapiens
cactccacctccaccca

SEQ ID NO: 5987306 - DNA, 13 bp, Homo sapiens
cactccactcccc

SEQ ID NO: 5987307 - DNA, 23 bp, Homo sapiens
cactccacttgaagcacttaagt

SEQ ID NO: 5987308 - DNA, 22 bp, Homo sapiens
cactccacttggacatgggccc

SEQ ID NO: 5987309 - DNA, 10 bp, Homo sapiens
cactccagac

SEQ ID NO: 5987310 - DNA, 14 bp, Homo sapiens
cactccagacccct

SEQ ID NO: 5987311 - DNA, 13 bp, Homo sapiens
cactccagactct

SEQ ID NO: 5987312 - DNA, 17 bp, Homo sapiens
cactccagactctgggg

SEQ ID NO: 5987313 - DNA, 12 bp, Homo sapiens
cactccagagaa

SEQ ID NO: 5987314 - DNA, 11 bp, Homo sapiens
cactccagcag

SEQ ID NO: 5987315 - DNA, 12 bp, Homo sapiens
cactccagcaga

SEQ ID NO: 5987316 - DNA, 23 bp, Homo sapiens
cactccagcagataaggccgagc

SEQ ID NO: 5987317 - DNA, 14 bp, Homo sapiens
cactccagccctgt

SEQ ID NO: 5987318 - DNA, 16 bp, Homo sapiens
cactccagccctgtcc

SEQ ID NO: 5987319 - DNA, 11 bp, Homo sapiens
cactccagcct

SEQ ID NO: 5987320 - DNA, 23 bp, Homo sapiens
cactccagcctgagcgacagtga

SEQ ID NO: 5987321 - DNA, 14 bp, Homo sapiens
cactccagcctggg

SEQ ID NO: 5987322 - DNA, 16 bp, Homo sapiens
cactccagcctgggcg

SEQ ID NO: 5987323 - DNA, 23 bp, Homo sapiens
cactccagcctgggcgacagagc

SEQ ID NO: 5987324 - DNA, 11 bp, Homo sapiens
cactccagctg

SEQ ID NO: 5987325 - DNA, 12 bp, Homo sapiens
cactccagctga

SEQ ID NO: 5987326 - DNA, 15 bp, Homo sapiens
cactccaggccctgc

SEQ ID NO: 5987327 - DNA, 13 bp, Homo sapiens
cactccaggcctc

SEQ ID NO: 5987328 - DNA, 17 bp, Homo sapiens
cactccagtagctcctg

SEQ ID NO: 5987329 - DNA, 18 bp, Homo sapiens
cactccagtccactcctg

SEQ ID NO: 5987330 - DNA, 20 bp, Homo sapiens
cactccagtcctgccaccac

SEQ ID NO: 5987331 - DNA, 13 bp, Homo sapiens
cactccagtgcca

SEQ ID NO: 5987332 - DNA, 17 bp, Homo sapiens
cactccagtgccagcaa

SEQ ID NO: 5987333 - DNA, 20 bp, Homo sapiens
cactccagttttctcctctg

SEQ ID NO: 5987334 - DNA, 14 bp, Homo sapiens
cactccataaaaag

SEQ ID NO: 5987335 - DNA, 13 bp, Homo sapiens
cactccatctcct

SEQ ID NO: 5987336 - DNA, 14 bp, Homo sapiens
cactccatctcctg

SEQ ID NO: 5987337 - DNA, 17 bp, Homo sapiens
cactccatctcctgctc

SEQ ID NO: 5987338 - DNA, 21 bp, Homo sapiens
cactccatgcttagtcactgc

SEQ ID NO: 5987339 - DNA, 14 bp, Homo sapiens
cactccatggccac

SEQ ID NO: 5987340 - DNA, 15 bp, Homo sapiens
cactccattcccaac

SEQ ID NO: 5987341 - DNA, 14 bp, Homo sapiens
cactccattctcag

SEQ ID NO: 5987342 - DNA, 19 bp, Homo sapiens
cactccattctcagcccct

SEQ ID NO: 5987343 - DNA, 20 bp, Homo sapiens
cactcccaaatgaaaacccc

SEQ ID NO: 5987344 - DNA, 19 bp, Homo sapiens
cactcccaagggacagcaa

SEQ ID NO: 5987345 - DNA, 23 bp, Homo sapiens
cactcccaagggacagcaagtga

SEQ ID NO: 5987346 - DNA, 19 bp, Homo sapiens
cactcccaaggttggagcc

SEQ ID NO: 5987347 - DNA, 12 bp, Homo sapiens
cactcccaccac

SEQ ID NO: 5987348 - DNA, 15 bp, Homo sapiens
cactcccacccagtc

SEQ ID NO: 5987349 - DNA, 15 bp, Homo sapiens
cactcccacctcacc

SEQ ID NO: 5987350 - DNA, 17 bp, Homo sapiens
cactcccacctcacccg

SEQ ID NO: 5987351 - DNA, 23 bp, Homo sapiens
cactcccacctgacacaccaggc

SEQ ID NO: 5987352 - DNA, 18 bp, Homo sapiens
cactcccacctgcatctg

SEQ ID NO: 5987353 - DNA, 22 bp, Homo sapiens
cactcccacctgcatctggggc

SEQ ID NO: 5987354 - DNA, 17 bp, Homo sapiens
cactcccactgccagga

SEQ ID NO: 5987355 - DNA, 13 bp, Homo sapiens
cactcccacttcc

SEQ ID NO: 5987356 - DNA, 15 bp, Homo sapiens
cactcccacttccct

SEQ ID NO: 5987357 - DNA, 19 bp, Homo sapiens
cactcccagcactcccctt

SEQ ID NO: 5987358 - DNA, 12 bp, Homo sapiens
cactcccagcat

SEQ ID NO: 5987359 - DNA, 13 bp, Homo sapiens
cactcccaggatg

SEQ ID NO: 5987360 - DNA, 12 bp, Homo sapiens
cactcccagggc

SEQ ID NO: 5987361 - DNA, 14 bp, Homo sapiens
cactcccagggccc

SEQ ID NO: 5987362 - DNA, 20 bp, Homo sapiens
cactcccaggtgagaattca

SEQ ID NO: 5987363 - DNA, 14 bp, Homo sapiens
cactcccatctcct

SEQ ID NO: 5987364 - DNA, 16 bp, Homo sapiens
cactcccatctcctta

SEQ ID NO: 5987365 - DNA, 22 bp, Homo sapiens
cactcccatctccttacctctg

SEQ ID NO: 5987366 - DNA, 19 bp, Homo sapiens
cactcccatggctctgggc

SEQ ID NO: 5987367 - DNA, 18 bp, Homo sapiens
cactccccaacccctctc

SEQ ID NO: 5987368 - DNA, 16 bp, Homo sapiens
cactccccactccccc

SEQ ID NO: 5987369 - DNA, 18 bp, Homo sapiens
cactccccagagctgtgc

SEQ ID NO: 5987370 - DNA, 22 bp, Homo sapiens
cactccccagccagcctggctg

SEQ ID NO: 5987371 - DNA, 14 bp, Homo sapiens
cactccccagggag

SEQ ID NO: 5987372 - DNA, 19 bp, Homo sapiens
cactccccagggagctctg

SEQ ID NO: 5987373 - DNA, 22 bp, Homo sapiens
cactccccagggagctctgggg

SEQ ID NO: 5987374 - DNA, 14 bp, Homo sapiens
cactccccagtgct

SEQ ID NO: 5987375 - DNA, 19 bp, Homo sapiens
cactcccccaggagcagct

SEQ ID NO: 5987376 - DNA, 15 bp, Homo sapiens
cactccccccatcct

SEQ ID NO: 5987377 - DNA, 13 bp, Homo sapiens
cactcccccctcc

SEQ ID NO: 5987378 - DNA, 16 bp, Homo sapiens
cactcccccctccatt

SEQ ID NO: 5987379 - DNA, 21 bp, Homo sapiens
cactccccctaaacccctgtc

SEQ ID NO: 5987380 - DNA, 21 bp, Homo sapiens
cactcccccttcccttggagg

SEQ ID NO: 5987381 - DNA, 23 bp, Homo sapiens
cactcccccttcccttggaggga

SEQ ID NO: 5987382 - DNA, 20 bp, Homo sapiens
cactccccgccttagagcct

SEQ ID NO: 5987383 - DNA, 14 bp, Homo sapiens
cactccccgcggtt

SEQ ID NO: 5987384 - DNA, 12 bp, Homo sapiens
cactcccctcac

SEQ ID NO: 5987385 - DNA, 22 bp, Homo sapiens
cactcccctcacacacaccccc

SEQ ID NO: 5987386 - DNA, 20 bp, Homo sapiens
cactcccctctcctcccctt

SEQ ID NO: 5987387 - DNA, 23 bp, Homo sapiens
cactcccctctcctccccttcct

SEQ ID NO: 5987388 - DNA, 13 bp, Homo sapiens
cactcccctgcac

SEQ ID NO: 5987389 - DNA, 14 bp, Homo sapiens
cactcccctgcact

SEQ ID NO: 5987390 - DNA, 14 bp, Homo sapiens
cactcccctgctgg

SEQ ID NO: 5987391 - DNA, 15 bp, Homo sapiens
cactcccctgctggg

SEQ ID NO: 5987392 - DNA, 13 bp, Homo sapiens
cactcccgaaagc

SEQ ID NO: 5987393 - DNA, 19 bp, Homo sapiens
cactcccgaaagcctttcc

SEQ ID NO: 5987394 - DNA, 21 bp, Homo sapiens
cactcccgctgagcccactct

SEQ ID NO: 5987395 - DNA, 17 bp, Homo sapiens
cactcccgctgcacaca

SEQ ID NO: 5987396 - DNA, 21 bp, Homo sapiens
cactcccggcctaggcacctc

SEQ ID NO: 5987397 - DNA, 17 bp, Homo sapiens
cactcccgggatgggtg

SEQ ID NO: 5987398 - DNA, 17 bp, Homo sapiens
cactccctaagaaaccc

SEQ ID NO: 5987399 - DNA, 21 bp, Homo sapiens
cactccctaagaaaccccagg

SEQ ID NO: 5987400 - DNA, 14 bp, Homo sapiens
cactccctaattta

SEQ ID NO: 5987401 - DNA, 20 bp, Homo sapiens
cactccctaatttatgtgct

SEQ ID NO: 5987402 - DNA, 13 bp, Homo sapiens
cactccctaccca

SEQ ID NO: 5987403 - DNA, 20 bp, Homo sapiens
cactccctccagcacaaaca

SEQ ID NO: 5987404 - DNA, 13 bp, Homo sapiens
cactccctcccag

SEQ ID NO: 5987405 - DNA, 14 bp, Homo sapiens
cactccctcttggt

SEQ ID NO: 5987406 - DNA, 12 bp, Homo sapiens
cactccctgagc

SEQ ID NO: 5987407 - DNA, 17 bp, Homo sapiens
cactccctgcaacctga

SEQ ID NO: 5987408 - DNA, 18 bp, Homo sapiens
cactccctgccaactcca

SEQ ID NO: 5987409 - DNA, 20 bp, Homo sapiens
cactccctgccaccgtcaca

SEQ ID NO: 5987410 - DNA, 23 bp, Homo sapiens
cactccctgccaccgtcacacag

SEQ ID NO: 5987411 - DNA, 14 bp, Homo sapiens
cactccctggcctt

SEQ ID NO: 5987412 - DNA, 14 bp, Homo sapiens
cactccctgtccat

SEQ ID NO: 5987413 - DNA, 23 bp, Homo sapiens
cactccctgtccatccccagttg

SEQ ID NO: 5987414 - DNA, 13 bp, Homo sapiens
cactccctgtctg

SEQ ID NO: 5987415 - DNA, 19 bp, Homo sapiens
cactcccttcccataagct

SEQ ID NO: 5987416 - DNA, 22 bp, Homo sapiens
cactcccttcccatgacccagg

SEQ ID NO: 5987417 - DNA, 23 bp, Homo sapiens
cactcccttctacctgccactca

SEQ ID NO: 5987418 - DNA, 18 bp, Homo sapiens
cactcccttgctggcccc

SEQ ID NO: 5987419 - DNA, 22 bp, Homo sapiens
cactcccttgctggccccagcc

SEQ ID NO: 5987420 - DNA, 21 bp, Homo sapiens
cactcccttggtggcaagagc

SEQ ID NO: 5987421 - DNA, 21 bp, Homo sapiens
cactccctttgcgtcaggagc

SEQ ID NO: 5987422 - DNA, 21 bp, Homo sapiens
cactccctttgtggactttat

SEQ ID NO: 5987423 - DNA, 16 bp, Homo sapiens
cactccgactccccct

SEQ ID NO: 5987424 - DNA, 18 bp, Homo sapiens
cactccgactccccctcc

SEQ ID NO: 5987425 - DNA, 19 bp, Homo sapiens
cactccgagaggtgggcca

SEQ ID NO: 5987426 - DNA, 14 bp, Homo sapiens
cactccgccagcca

SEQ ID NO: 5987427 - DNA, 17 bp, Homo sapiens
cactccgcgccgatgcc

SEQ ID NO: 5987428 - DNA, 18 bp, Homo sapiens
cactccggccctccagag

SEQ ID NO: 5987429 - DNA, 17 bp, Homo sapiens
cactccgggtcaagttg

SEQ ID NO: 5987430 - DNA, 23 bp, Homo sapiens
cactcctaatcaagagtctctcc

SEQ ID NO: 5987431 - DNA, 14 bp, Homo sapiens
cactcctacctggt

SEQ ID NO: 5987432 - DNA, 21 bp, Homo sapiens
cactcctagagaacgcagccc

SEQ ID NO: 5987433 - DNA, 17 bp, Homo sapiens
cactcctaggacatgtt

SEQ ID NO: 5987434 - DNA, 17 bp, Homo sapiens
cactcctaggagagcca

SEQ ID NO: 5987435 - DNA, 22 bp, Homo sapiens
cactcctatccccaggccaggt

SEQ ID NO: 5987436 - DNA, 23 bp, Homo sapiens
cactcctatgtactatccccaaa

SEQ ID NO: 5987437 - DNA, 16 bp, Homo sapiens
cactcctcaagacttt

SEQ ID NO: 5987438 - DNA, 14 bp, Homo sapiens
cactcctcactgcc

SEQ ID NO: 5987439 - DNA, 20 bp, Homo sapiens
cactcctcaggaacagaaca

SEQ ID NO: 5987440 - DNA, 13 bp, Homo sapiens
cactcctcagggc

SEQ ID NO: 5987441 - DNA, 14 bp, Homo sapiens
cactcctcccaact

SEQ ID NO: 5987442 - DNA, 18 bp, Homo sapiens
cactcctcctagccaccc

SEQ ID NO: 5987443 - DNA, 11 bp, Homo sapiens
cactcctcctc

SEQ ID NO: 5987444 - DNA, 21 bp, Homo sapiens
cactcctcctcctttctttgc

SEQ ID NO: 5987445 - DNA, 15 bp, Homo sapiens
cactcctcctgccag

SEQ ID NO: 5987446 - DNA, 19 bp, Homo sapiens
cactcctcctgccagctct

SEQ ID NO: 5987447 - DNA, 10 bp, Homo sapiens
cactcctcta

SEQ ID NO: 5987448 - DNA, 22 bp, Homo sapiens
cactcctctactcttacagagc

SEQ ID NO: 5987449 - DNA, 18 bp, Homo sapiens
cactcctctatcatgcaa

SEQ ID NO: 5987450 - DNA, 14 bp, Homo sapiens
cactcctctccacc

SEQ ID NO: 5987451 - DNA, 17 bp, Homo sapiens
cactcctctccaccaga

SEQ ID NO: 5987452 - DNA, 14 bp, Homo sapiens
cactcctctgctga

SEQ ID NO: 5987453 - DNA, 16 bp, Homo sapiens
cactcctctgctgacc

SEQ ID NO: 5987454 - DNA, 18 bp, Homo sapiens
cactcctctgctgacctg

SEQ ID NO: 5987455 - DNA, 21 bp, Homo sapiens
cactcctctgctgacctgctg

SEQ ID NO: 5987456 - DNA, 22 bp, Homo sapiens
cactcctctgctgacctgctga

SEQ ID NO: 5987457 - DNA, 21 bp, Homo sapiens
cactcctctgtctctgctctt

SEQ ID NO: 5987458 - DNA, 13 bp, Homo sapiens
cactcctgacccc

SEQ ID NO: 5987459 - DNA, 21 bp, Homo sapiens
cactcctgacccctctcctca

SEQ ID NO: 5987460 - DNA, 22 bp, Homo sapiens
cactcctgacccctctcctcaa

SEQ ID NO: 5987461 - DNA, 13 bp, Homo sapiens
cactcctgccaag

SEQ ID NO: 5987462 - DNA, 13 bp, Homo sapiens
cactcctgcctcc

SEQ ID NO: 5987463 - DNA, 21 bp, Homo sapiens
cactcctgcctccgctggctt

SEQ ID NO: 5987464 - DNA, 14 bp, Homo sapiens
cactcctgcctgcc

SEQ ID NO: 5987465 - DNA, 14 bp, Homo sapiens
cactcctgctctgc

SEQ ID NO: 5987466 - DNA, 13 bp, Homo sapiens
cactcctgctgca

SEQ ID NO: 5987467 - DNA, 14 bp, Homo sapiens
cactcctgctgcac

SEQ ID NO: 5987468 - DNA, 13 bp, Homo sapiens
cactcctgctgta

SEQ ID NO: 5987469 - DNA, 16 bp, Homo sapiens
cactcctgctgtgccc

SEQ ID NO: 5987470 - DNA, 11 bp, Homo sapiens
cactcctgctt

SEQ ID NO: 5987471 - DNA, 21 bp, Homo sapiens
cactcctgcttctctcagcca

SEQ ID NO: 5987472 - DNA, 11 bp, Homo sapiens
cactcctggag

SEQ ID NO: 5987473 - DNA, 21 bp, Homo sapiens
cactcctgggctctgaacaca

SEQ ID NO: 5987474 - DNA, 15 bp, Homo sapiens
cactcctgtccctgt

SEQ ID NO: 5987475 - DNA, 22 bp, Homo sapiens
cactcctgtccctgtagctcag

SEQ ID NO: 5987476 - DNA, 23 bp, Homo sapiens
cactcctgtccctgtagctcagt

SEQ ID NO: 5987477 - DNA, 18 bp, Homo sapiens
cactcctgtctcttggga

SEQ ID NO: 5987478 - DNA, 18 bp, Homo sapiens
cactcctgttacttacct

SEQ ID NO: 5987479 - DNA, 14 bp, Homo sapiens
cactccttcacaga

SEQ ID NO: 5987480 - DNA, 14 bp, Homo sapiens
cactccttccatct

SEQ ID NO: 5987481 - DNA, 21 bp, Homo sapiens
cactccttccatctcttcctt

SEQ ID NO: 5987482 - DNA, 17 bp, Homo sapiens
cactccttcccaaatct

SEQ ID NO: 5987483 - DNA, 12 bp, Homo sapiens
cactccttcccc

SEQ ID NO: 5987484 - DNA, 22 bp, Homo sapiens
cactccttccccttgtccctgg

SEQ ID NO: 5987485 - DNA, 15 bp, Homo sapiens
cactccttcctgccc

SEQ ID NO: 5987486 - DNA, 19 bp, Homo sapiens
cactccttccttcaggact

SEQ ID NO: 5987487 - DNA, 11 bp, Homo sapiens
cactccttgca

SEQ ID NO: 5987488 - DNA, 18 bp, Homo sapiens
cactcctttatctgtaat

SEQ ID NO: 5987489 - DNA, 15 bp, Homo sapiens
cactcgaactcggga

SEQ ID NO: 5987490 - DNA, 17 bp, Homo sapiens
cactcgagaccatcctg

SEQ ID NO: 5987491 - DNA, 20 bp, Homo sapiens
cactcgccatctcctgggcc

SEQ ID NO: 5987492 - DNA, 16 bp, Homo sapiens
cactcgccatttcctc

SEQ ID NO: 5987493 - DNA, 22 bp, Homo sapiens
cactcgccatttcctcacgtgc

SEQ ID NO: 5987494 - DNA, 13 bp, Homo sapiens
cactcgccttctg

SEQ ID NO: 5987495 - DNA, 14 bp, Homo sapiens
cactcgcgtgttcc

SEQ ID NO: 5987496 - DNA, 16 bp, Homo sapiens
cactcgctagcagtgg

SEQ ID NO: 5987497 - DNA, 22 bp, Homo sapiens
cactcgggaggctgagacagga

SEQ ID NO: 5987498 - DNA, 19 bp, Homo sapiens
cactcgggttaagaaatac

SEQ ID NO: 5987499 - DNA, 21 bp, Homo sapiens
cactcgggtttctctgtggct

SEQ ID NO: 5987500 - DNA, 20 bp, Homo sapiens
cactcggtcccagttttgtt

SEQ ID NO: 5987501 - DNA, 20 bp, Homo sapiens
cactcgtaggggatgtggag

SEQ ID NO: 5987502 - DNA, 13 bp, Homo sapiens
cactcgtctcccc

SEQ ID NO: 5987503 - DNA, 14 bp, Homo sapiens
cactcgtctccccc

SEQ ID NO: 5987504 - DNA, 18 bp, Homo sapiens
cactcgtggtgaggctga

SEQ ID NO: 5987505 - DNA, 22 bp, Homo sapiens
cactcgtgtgcaacagacaagt

SEQ ID NO: 5987506 - DNA, 15 bp, Homo sapiens
cactctaaaaaacat

SEQ ID NO: 5987507 - DNA, 19 bp, Homo sapiens
cactctaaaaaacattttt

SEQ ID NO: 5987508 - DNA, 14 bp, Homo sapiens
cactctaaactgca

SEQ ID NO: 5987509 - DNA, 13 bp, Homo sapiens
cactctaaagcaa

SEQ ID NO: 5987510 - DNA, 16 bp, Homo sapiens
cactctaagatgttat

SEQ ID NO: 5987511 - DNA, 18 bp, Homo sapiens
cactctaagatgttatat

SEQ ID NO: 5987512 - DNA, 15 bp, Homo sapiens
cactctaagtcatgt

SEQ ID NO: 5987513 - DNA, 18 bp, Homo sapiens
cactctaagtcatgtatg

SEQ ID NO: 5987514 - DNA, 13 bp, Homo sapiens
cactctaatataa

SEQ ID NO: 5987515 - DNA, 18 bp, Homo sapiens
cactctacagactcccac

SEQ ID NO: 5987516 - DNA, 18 bp, Homo sapiens
cactctaccagtgcaggc

SEQ ID NO: 5987517 - DNA, 19 bp, Homo sapiens
cactctaccctcccacccc

SEQ ID NO: 5987518 - DNA, 13 bp, Homo sapiens
cactctactgccc

SEQ ID NO: 5987519 - DNA, 15 bp, Homo sapiens
cactctactgcccca

SEQ ID NO: 5987520 - DNA, 11 bp, Homo sapiens
cactctagatt

SEQ ID NO: 5987521 - DNA, 15 bp, Homo sapiens
cactctagggcagtg

SEQ ID NO: 5987522 - DNA, 19 bp, Homo sapiens
cactctaggggtcaggctc

SEQ ID NO: 5987523 - DNA, 23 bp, Homo sapiens
cactctagtgacttcctggtgag

SEQ ID NO: 5987524 - DNA, 19 bp, Homo sapiens
cactctagtgataaatcgg

SEQ ID NO: 5987525 - DNA, 16 bp, Homo sapiens
cactctagttctagat

SEQ ID NO: 5987526 - DNA, 18 bp, Homo sapiens
cactctagttctagatga

SEQ ID NO: 5987527 - DNA, 13 bp, Homo sapiens
cactctataacaa

SEQ ID NO: 5987528 - DNA, 15 bp, Homo sapiens
cactctatatgtagt

SEQ ID NO: 5987529 - DNA, 14 bp, Homo sapiens
cactctcaccccaa

SEQ ID NO: 5987530 - DNA, 14 bp, Homo sapiens
cactctcacccccc

SEQ ID NO: 5987531 - DNA, 13 bp, Homo sapiens
cactctcagagac

SEQ ID NO: 5987532 - DNA, 12 bp, Homo sapiens
cactctcagagt

SEQ ID NO: 5987533 - DNA, 19 bp, Homo sapiens
cactctcagagtgttttga

SEQ ID NO: 5987534 - DNA, 13 bp, Homo sapiens
caaggacattgcc

SEQ ID NO: 5987535 - DNA, 23 bp, Homo sapiens
caaggacattgtatgcagggagc

SEQ ID NO: 5987536 - DNA, 22 bp, Homo sapiens
caaggaccaaagggggccctgg

SEQ ID NO: 5987537 - DNA, 20 bp, Homo sapiens
caaggaccaacaagggcagt

SEQ ID NO: 5987538 - DNA, 21 bp, Homo sapiens
caaggaccaacaagggcagtg

SEQ ID NO: 5987539 - DNA, 16 bp, Homo sapiens
caaggaccaagagcaa

SEQ ID NO: 5987540 - DNA, 13 bp, Homo sapiens
caaggaccaggac

SEQ ID NO: 5987541 - DNA, 15 bp, Homo sapiens
caaggaccaggactc

SEQ ID NO: 5987542 - DNA, 14 bp, Homo sapiens
caaggacccagccc

SEQ ID NO: 5987543 - DNA, 15 bp, Homo sapiens
caaggacccagccct

SEQ ID NO: 5987544 - DNA, 16 bp, Homo sapiens
caaggacccagccctc

SEQ ID NO: 5987545 - DNA, 18 bp, Homo sapiens
caaggacccaggcgctgc

SEQ ID NO: 5987546 - DNA, 14 bp, Homo sapiens
caaggacccctcac

SEQ ID NO: 5987547 - DNA, 20 bp, Homo sapiens
caaggaccctgttttccaca

SEQ ID NO: 5987548 - DNA, 16 bp, Homo sapiens
caaggacctgcctccc

SEQ ID NO: 5987549 - DNA, 21 bp, Homo sapiens
caaggacgctggctactgtct

SEQ ID NO: 5987550 - DNA, 15 bp, Homo sapiens
caaggacgttaaagg

SEQ ID NO: 5987551 - DNA, 15 bp, Homo sapiens
caaggactaaggcct

SEQ ID NO: 5987552 - DNA, 21 bp, Homo sapiens
caaggactagggtcctgggga

SEQ ID NO: 5987553 - DNA, 15 bp, Homo sapiens
caaggactcagatga

SEQ ID NO: 5987554 - DNA, 14 bp, Homo sapiens
caaggactcccgga

SEQ ID NO: 5987555 - DNA, 16 bp, Homo sapiens
caaggactctggcctc

SEQ ID NO: 5987556 - DNA, 14 bp, Homo sapiens
caaggactggtaaa

SEQ ID NO: 5987557 - DNA, 18 bp, Homo sapiens
caaggacttccacatttt

SEQ ID NO: 5987558 - DNA, 21 bp, Homo sapiens
caaggacttcctgtccagctc

SEQ ID NO: 5987559 - DNA, 18 bp, Homo sapiens
caaggacttgaaagcatc

SEQ ID NO: 5987560 - DNA, 20 bp, Homo sapiens
caaggacttgaaagcatcca

SEQ ID NO: 5987561 - DNA, 22 bp, Homo sapiens
caaggactttccaaatccagga

SEQ ID NO: 5987562 - DNA, 14 bp, Homo sapiens
caaggactttccag

SEQ ID NO: 5987563 - DNA, 20 bp, Homo sapiens
caaggactttccagtgagga

SEQ ID NO: 5987564 - DNA, 19 bp, Homo sapiens
caaggagaaacagagacag

SEQ ID NO: 5987565 - DNA, 15 bp, Homo sapiens
caaggagaacaaata

SEQ ID NO: 5987566 - DNA, 17 bp, Homo sapiens
caaggagagcggaggag

SEQ ID NO: 5987567 - DNA, 15 bp, Homo sapiens
caaggagaggaggca

SEQ ID NO: 5987568 - DNA, 18 bp, Homo sapiens
caaggagaggagttcttt

SEQ ID NO: 5987569 - DNA, 19 bp, Homo sapiens
caaggagaggagttctttg

SEQ ID NO: 5987570 - DNA, 22 bp, Homo sapiens
caaggagaggagttctttggct

SEQ ID NO: 5987571 - DNA, 21 bp, Homo sapiens
caaggagatttcttagttcat

SEQ ID NO: 5987572 - DNA, 16 bp, Homo sapiens
caaggagcacaggtcc

SEQ ID NO: 5987573 - DNA, 12 bp, Homo sapiens
caaggagcagag

SEQ ID NO: 5987574 - DNA, 14 bp, Homo sapiens
caaggagccaaaca

SEQ ID NO: 5987575 - DNA, 17 bp, Homo sapiens
caaggagctcaccctgc

SEQ ID NO: 5987576 - DNA, 22 bp, Homo sapiens
caaggagctcaccctgcccgct

SEQ ID NO: 5987577 - DNA, 13 bp, Homo sapiens
caaggagctgaga

SEQ ID NO: 5987578 - DNA, 20 bp, Homo sapiens
caaggagctgagaatagaag

SEQ ID NO: 5987579 - DNA, 19 bp, Homo sapiens
caaggagctgatttccagg

SEQ ID NO: 5987580 - DNA, 23 bp, Homo sapiens
caaggagctgatttccaggcccc

SEQ ID NO: 5987581 - DNA, 13 bp, Homo sapiens
caaggagctgcta

SEQ ID NO: 5987582 - DNA, 15 bp, Homo sapiens
caaggagcttaccca

SEQ ID NO: 5987583 - DNA, 21 bp, Homo sapiens
caaggagcttacccaagctgt

SEQ ID NO: 5987584 - DNA, 18 bp, Homo sapiens
caaggagctttcttgttt

SEQ ID NO: 5987585 - DNA, 21 bp, Homo sapiens
caaggagctttcttgtttctt

SEQ ID NO: 5987586 - DNA, 12 bp, Homo sapiens
caaggaggaaaa

SEQ ID NO: 5987587 - DNA, 21 bp, Homo sapiens
caaggaggaaataactaagag

SEQ ID NO: 5987588 - DNA, 22 bp, Homo sapiens
caaggaggaaataactaagaga

SEQ ID NO: 5987589 - DNA, 15 bp, Homo sapiens
caaggaggaggagtc

SEQ ID NO: 5987590 - DNA, 12 bp, Homo sapiens
caaggaggcctg

SEQ ID NO: 5987591 - DNA, 19 bp, Homo sapiens
caaggaggctggctggggc

SEQ ID NO: 5987592 - DNA, 22 bp, Homo sapiens
caaggaggctggctggggccta

SEQ ID NO: 5987593 - DNA, 17 bp, Homo sapiens
caaggagggcctctggt

SEQ ID NO: 5987594 - DNA, 16 bp, Homo sapiens
caaggaggggccagtg

SEQ ID NO: 5987595 - DNA, 18 bp, Homo sapiens
caaggaggtcccaggaag

SEQ ID NO: 5987596 - DNA, 18 bp, Homo sapiens
caaggaggtggtgaattt

SEQ ID NO: 5987597 - DNA, 22 bp, Homo sapiens
caaggaggtggtgaatttttaa

SEQ ID NO: 5987598 - DNA, 18 bp, Homo sapiens
caaggagtaagtacaaat

SEQ ID NO: 5987599 - DNA, 16 bp, Homo sapiens
caaggagtcactgaga

SEQ ID NO: 5987600 - DNA, 17 bp, Homo sapiens
caaggagtcactgagac

SEQ ID NO: 5987601 - DNA, 16 bp, Homo sapiens
caaggagtcagacatt

SEQ ID NO: 5987602 - DNA, 22 bp, Homo sapiens
caaggagtcttctaatgtaaat

SEQ ID NO: 5987603 - DNA, 14 bp, Homo sapiens
caaggagtgtaaaa

SEQ ID NO: 5987604 - DNA, 19 bp, Homo sapiens
caaggagttccatgaagac

SEQ ID NO: 5987605 - DNA, 14 bp, Homo sapiens
caaggagttctctt

SEQ ID NO: 5987606 - DNA, 22 bp, Homo sapiens
caaggagtttaaatgagactag

SEQ ID NO: 5987607 - DNA, 24 bp, Homo sapiens
caaggagtttgagaccagcttagc

SEQ ID NO: 5987608 - DNA, 20 bp, Homo sapiens
caaggatacccggtggcttc

SEQ ID NO: 5987609 - DNA, 22 bp, Homo sapiens
caaggatacccggtggcttctg

SEQ ID NO: 5987610 - DNA, 17 bp, Homo sapiens
caaggatagatgctggc

SEQ ID NO: 5987611 - DNA, 17 bp, Homo sapiens
caaggatcaggctgctg

SEQ ID NO: 5987612 - DNA, 18 bp, Homo sapiens
caaggatcaggctgctgg

SEQ ID NO: 5987613 - DNA, 14 bp, Homo sapiens
caaggatcctctcc

SEQ ID NO: 5987614 - DNA, 15 bp, Homo sapiens
caaggatcctgagcc

SEQ ID NO: 5987615 - DNA, 22 bp, Homo sapiens
caaggatcggactctgcccctg

SEQ ID NO: 5987616 - DNA, 22 bp, Homo sapiens
caaggatcttttggacctggct

SEQ ID NO: 5987617 - DNA, 18 bp, Homo sapiens
caaggatgccttagcatg

SEQ ID NO: 5987618 - DNA, 19 bp, Homo sapiens
caaggatgggccatctggg

SEQ ID NO: 5987619 - DNA, 18 bp, Homo sapiens
caaggatggtggggcccc

SEQ ID NO: 5987620 - DNA, 23 bp, Homo sapiens
caaggatggtggggcccccagca

SEQ ID NO: 5987621 - DNA, 15 bp, Homo sapiens
caaggattacagaaa

SEQ ID NO: 5987622 - DNA, 22 bp, Homo sapiens
caaggattctgttctgcaactc

SEQ ID NO: 5987623 - DNA, 23 bp, Homo sapiens
caaggattctgttctgcaactcc

SEQ ID NO: 5987624 - DNA, 15 bp, Homo sapiens
caaggattgaaaatt

SEQ ID NO: 5987625 - DNA, 16 bp, Homo sapiens
caaggattttcatgtt

SEQ ID NO: 5987626 - DNA, 14 bp, Homo sapiens
caaggatttttcca

SEQ ID NO: 5987627 - DNA, 22 bp, Homo sapiens
caaggatttttccatgtgtggt

SEQ ID NO: 5987628 - DNA, 18 bp, Homo sapiens
caaggattttttaaaaat

SEQ ID NO: 5987629 - DNA, 14 bp, Homo sapiens
caaggcaaaaacaa

SEQ ID NO: 5987630 - DNA, 15 bp, Homo sapiens
caaggcaaaaacaaa

SEQ ID NO: 5987631 - DNA, 21 bp, Homo sapiens
caaggcaaaccctgttcaggc

SEQ ID NO: 5987632 - DNA, 18 bp, Homo sapiens
caaggcaaagtaaaatta

SEQ ID NO: 5987633 - DNA, 20 bp, Homo sapiens
caaggcaaatgtccaagcat

SEQ ID NO: 5987634 - DNA, 13 bp, Homo sapiens
caaggcaaggggt

SEQ ID NO: 5987635 - DNA, 21 bp, Homo sapiens
caaggcaaggggtgcctggga

SEQ ID NO: 5987636 - DNA, 16 bp, Homo sapiens
caaggcaatgatatgg

SEQ ID NO: 5987637 - DNA, 21 bp, Homo sapiens
caaggcacattgaaatacttg

SEQ ID NO: 5987638 - DNA, 16 bp, Homo sapiens
caaggcaccagcaaat

SEQ ID NO: 5987639 - DNA, 19 bp, Homo sapiens
caaggcacctgcaggttgg

SEQ ID NO: 5987640 - DNA, 14 bp, Homo sapiens
caaggcactctaga

SEQ ID NO: 5987641 - DNA, 16 bp, Homo sapiens
caaggcactctagatt

SEQ ID NO: 5987642 - DNA, 17 bp, Homo sapiens
caaggcactctagattc

SEQ ID NO: 5987643 - DNA, 14 bp, Homo sapiens
caaggcactgagcg

SEQ ID NO: 5987644 - DNA, 15 bp, Homo sapiens
caaggcactgcctga

SEQ ID NO: 5987645 - DNA, 14 bp, Homo sapiens
caaggcacttgtca

SEQ ID NO: 5987646 - DNA, 22 bp, Homo sapiens
caaggcagaagcttggaggagg

SEQ ID NO: 5987647 - DNA, 18 bp, Homo sapiens
caaggcagaaggccagga

SEQ ID NO: 5987648 - DNA, 13 bp, Homo sapiens
caaggcagagcct

SEQ ID NO: 5987649 - DNA, 14 bp, Homo sapiens
caaggcagaggcct

SEQ ID NO: 5987650 - DNA, 16 bp, Homo sapiens
caaggcagcaaggccc

SEQ ID NO: 5987651 - DNA, 13 bp, Homo sapiens
caaggcagccgtg

SEQ ID NO: 5987652 - DNA, 13 bp, Homo sapiens
caaggcagcctcc

SEQ ID NO: 5987653 - DNA, 19 bp, Homo sapiens
caaggcagcctccagagcc

SEQ ID NO: 5987654 - DNA, 21 bp, Homo sapiens
caaggcagcctccagagccag

SEQ ID NO: 5987655 - DNA, 24 bp, Homo sapiens
caaggcagcctccagagccagcct

SEQ ID NO: 5987656 - DNA, 16 bp, Homo sapiens
caaggcagcgacccca

SEQ ID NO: 5987657 - DNA, 21 bp, Homo sapiens
caaggcagcgaccccaggacc

SEQ ID NO: 5987658 - DNA, 23 bp, Homo sapiens
caaggcaggaggagctgataatg

SEQ ID NO: 5987659 - DNA, 16 bp, Homo sapiens
caaggcaggcctttcc

SEQ ID NO: 5987660 - DNA, 16 bp, Homo sapiens
caaggcagggaaagga

SEQ ID NO: 5987661 - DNA, 15 bp, Homo sapiens
caaggcaggtgcctc

SEQ ID NO: 5987662 - DNA, 17 bp, Homo sapiens
caaggcaggtgcctcca

SEQ ID NO: 5987663 - DNA, 18 bp, Homo sapiens
caaggcaggtgcctccag

SEQ ID NO: 5987664 - DNA, 22 bp, Homo sapiens
caaggcaggtgcctccaggtgt

SEQ ID NO: 5987665 - DNA, 23 bp, Homo sapiens
caaggcaggtgcctccaggtgtg

SEQ ID NO: 5987666 - DNA, 18 bp, Homo sapiens
caaggcaggttggatggg

SEQ ID NO: 5987667 - DNA, 16 bp, Homo sapiens
caaggcagtgcatgca

SEQ ID NO: 5987668 - DNA, 18 bp, Homo sapiens
caaggcatccccagtgcc

SEQ ID NO: 5987669 - DNA, 20 bp, Homo sapiens
caaggcattcagcagtttct

SEQ ID NO: 5987670 - DNA, 16 bp, Homo sapiens
caaggcattctcccag

SEQ ID NO: 5987671 - DNA, 15 bp, Homo sapiens
caaggccaaaggaag

SEQ ID NO: 5987672 - DNA, 21 bp, Homo sapiens
caaggccaaaggaagcacatg

SEQ ID NO: 5987673 - DNA, 15 bp, Homo sapiens
caaggccacaaaaac

SEQ ID NO: 5987674 - DNA, 16 bp, Homo sapiens
caaggccacaaaaaca

SEQ ID NO: 5987675 - DNA, 17 bp, Homo sapiens
caaggccacaaaaacaa

SEQ ID NO: 5987676 - DNA, 18 bp, Homo sapiens
caaggccacagggagctc

SEQ ID NO: 5987677 - DNA, 18 bp, Homo sapiens
caaggccacctctgcctc

SEQ ID NO: 5987678 - DNA, 19 bp, Homo sapiens
caaggccacctctgcctct

SEQ ID NO: 5987679 - DNA, 22 bp, Homo sapiens
caaggccacctcttcctggccg

SEQ ID NO: 5987680 - DNA, 18 bp, Homo sapiens
caaggccaccttggagga

SEQ ID NO: 5987681 - DNA, 19 bp, Homo sapiens
caaggccaccttggaggag

SEQ ID NO: 5987682 - DNA, 20 bp, Homo sapiens
caaggccagagtggcctggc

SEQ ID NO: 5987683 - DNA, 23 bp, Homo sapiens
caaggccagcaaggtggagtgga

SEQ ID NO: 5987684 - DNA, 14 bp, Homo sapiens
caaggccagcccac

SEQ ID NO: 5987685 - DNA, 20 bp, Homo sapiens
caaggccatattttaaaaaa

SEQ ID NO: 5987686 - DNA, 14 bp, Homo sapiens
caaggccatctggg

SEQ ID NO: 5987687 - DNA, 17 bp, Homo sapiens
caaggccatctgggctc

SEQ ID NO: 5987688 - DNA, 15 bp, Homo sapiens
caaggcccacaggag

SEQ ID NO: 5987689 - DNA, 16 bp, Homo sapiens
caaggcccagaagcct

SEQ ID NO: 5987690 - DNA, 14 bp, Homo sapiens
caaggcccagacct

SEQ ID NO: 5987691 - DNA, 19 bp, Homo sapiens
caaggcccagacctggcct

SEQ ID NO: 5987692 - DNA, 16 bp, Homo sapiens
caaggcccagccctgg

SEQ ID NO: 5987693 - DNA, 13 bp, Homo sapiens
caaggcccagcta

SEQ ID NO: 5987694 - DNA, 21 bp, Homo sapiens
caaggccccagagactcagag

SEQ ID NO: 5987695 - DNA, 14 bp, Homo sapiens
caaggcccgagcag

SEQ ID NO: 5987696 - DNA, 16 bp, Homo sapiens
caaggcccgagcagct

SEQ ID NO: 5987697 - DNA, 18 bp, Homo sapiens
caaggcccgagcagctga

SEQ ID NO: 5987698 - DNA, 23 bp, Homo sapiens
caaggccctcggagctggctgtg

SEQ ID NO: 5987699 - DNA, 20 bp, Homo sapiens
caaggccctctatttctctc

SEQ ID NO: 5987700 - DNA, 14 bp, Homo sapiens
caaggccctgcatc

SEQ ID NO: 5987701 - DNA, 14 bp, Homo sapiens
caaggccctgccct

SEQ ID NO: 5987702 - DNA, 17 bp, Homo sapiens
caaggccctgctgccca

SEQ ID NO: 5987703 - DNA, 22 bp, Homo sapiens
caaggccctgctgcccaatctc

SEQ ID NO: 5987704 - DNA, 13 bp, Homo sapiens
caaggccctgctt

SEQ ID NO: 5987705 - DNA, 20 bp, Homo sapiens
caaggccctgctttttttct

SEQ ID NO: 5987706 - DNA, 20 bp, Homo sapiens
caaggccctgtcccagcaga

SEQ ID NO: 5987707 - DNA, 15 bp, Homo sapiens
caaggccctgtctct

SEQ ID NO: 5987708 - DNA, 22 bp, Homo sapiens
caaggcccttacacccttgtcc

SEQ ID NO: 5987709 - DNA, 17 bp, Homo sapiens
caaggccctttaacttg

SEQ ID NO: 5987710 - DNA, 13 bp, Homo sapiens
caaggccctttcc

SEQ ID NO: 5987711 - DNA, 19 bp, Homo sapiens
caaggccctttcctttgga

SEQ ID NO: 5987712 - DNA, 19 bp, Homo sapiens
cactctcaggaccaccctg

SEQ ID NO: 5987713 - DNA, 21 bp, Homo sapiens
cactctcaggaccaccctgcc

SEQ ID NO: 5987714 - DNA, 19 bp, Homo sapiens
cactctcatcaccccagag

SEQ ID NO: 5987715 - DNA, 23 bp, Homo sapiens
cactctcatcaccccagaggcct

SEQ ID NO: 5987716 - DNA, 17 bp, Homo sapiens
cactctcatgtcccctt

SEQ ID NO: 5987717 - DNA, 13 bp, Homo sapiens
cactctcccagag

SEQ ID NO: 5987718 - DNA, 16 bp, Homo sapiens
cactctcccagaggct

SEQ ID NO: 5987719 - DNA, 20 bp, Homo sapiens
cactctcccagaggctcctg

SEQ ID NO: 5987720 - DNA, 14 bp, Homo sapiens
cactctccccacac

SEQ ID NO: 5987721 - DNA, 21 bp, Homo sapiens
cactctccccacactaacctg

SEQ ID NO: 5987722 - DNA, 14 bp, Homo sapiens
cactctcccctccc

SEQ ID NO: 5987723 - DNA, 16 bp, Homo sapiens
cactctcccctccctc

SEQ ID NO: 5987724 - DNA, 13 bp, Homo sapiens
cactctcctgagg

SEQ ID NO: 5987725 - DNA, 14 bp, Homo sapiens
cactctcctgagga

SEQ ID NO: 5987726 - DNA, 16 bp, Homo sapiens
cactctcctgggcccc

SEQ ID NO: 5987727 - DNA, 18 bp, Homo sapiens
cactctcctgggcccctc

SEQ ID NO: 5987728 - DNA, 23 bp, Homo sapiens
cactctccttcgtgtctctccca

SEQ ID NO: 5987729 - DNA, 17 bp, Homo sapiens
cactctccttgctaccc

SEQ ID NO: 5987730 - DNA, 17 bp, Homo sapiens
cactctcgagttaaaga

SEQ ID NO: 5987731 - DNA, 20 bp, Homo sapiens
cactctcgcacacacagtga

SEQ ID NO: 5987732 - DNA, 15 bp, Homo sapiens
cactctcggggccct

SEQ ID NO: 5987733 - DNA, 17 bp, Homo sapiens
cactctcggggcccttg

SEQ ID NO: 5987734 - DNA, 19 bp, Homo sapiens
cactctctaaatcttcctt

SEQ ID NO: 5987735 - DNA, 15 bp, Homo sapiens
cactctctaccagat

SEQ ID NO: 5987736 - DNA, 13 bp, Homo sapiens
cactctctcaccc

SEQ ID NO: 5987737 - DNA, 16 bp, Homo sapiens
cactctctcacccacc

SEQ ID NO: 5987738 - DNA, 14 bp, Homo sapiens
cactctctctctgt

SEQ ID NO: 5987739 - DNA, 14 bp, Homo sapiens
cactctctcttgtt

SEQ ID NO: 5987740 - DNA, 14 bp, Homo sapiens
cactctctgaagat

SEQ ID NO: 5987741 - DNA, 16 bp, Homo sapiens
cactctctgcagccca

SEQ ID NO: 5987742 - DNA, 14 bp, Homo sapiens
cactctctgcagtc

SEQ ID NO: 5987743 - DNA, 21 bp, Homo sapiens
cactctctgcagtcctccggg

SEQ ID NO: 5987744 - DNA, 21 bp, Homo sapiens
cactctctgccattctgtgca

SEQ ID NO: 5987745 - DNA, 22 bp, Homo sapiens
cactctctgccattctgtgcag

SEQ ID NO: 5987746 - DNA, 23 bp, Homo sapiens
cactctctgcccctaaagatggg

SEQ ID NO: 5987747 - DNA, 14 bp, Homo sapiens
cactctctggaagc

SEQ ID NO: 5987748 - DNA, 13 bp, Homo sapiens
cactctctgggac

SEQ ID NO: 5987749 - DNA, 14 bp, Homo sapiens
cactctctgggact

SEQ ID NO: 5987750 - DNA, 21 bp, Homo sapiens
cactctctgggactctcctcc

SEQ ID NO: 5987751 - DNA, 15 bp, Homo sapiens
cactctctgtacaaa

SEQ ID NO: 5987752 - DNA, 16 bp, Homo sapiens
cactctctgtacaaaa

SEQ ID NO: 5987753 - DNA, 21 bp, Homo sapiens
cactctctgtacaaaaacaaa

SEQ ID NO: 5987754 - DNA, 17 bp, Homo sapiens
cactctcttccctttcc

SEQ ID NO: 5987755 - DNA, 16 bp, Homo sapiens
cactctcttcctttca

SEQ ID NO: 5987756 - DNA, 16 bp, Homo sapiens
cactctcttctccatt

SEQ ID NO: 5987757 - DNA, 22 bp, Homo sapiens
cactctcttctccattccctag

SEQ ID NO: 5987758 - DNA, 15 bp, Homo sapiens
cactctgacaagctg

SEQ ID NO: 5987759 - DNA, 18 bp, Homo sapiens
cactctgacaagctggcc

SEQ ID NO: 5987760 - DNA, 15 bp, Homo sapiens
cactctgaccgggct

SEQ ID NO: 5987761 - DNA, 19 bp, Homo sapiens
cactctgaccttattactg

SEQ ID NO: 5987762 - DNA, 23 bp, Homo sapiens
cactctgagactcgcgacaatgc

SEQ ID NO: 5987763 - DNA, 14 bp, Homo sapiens
cactctgaggtctc

SEQ ID NO: 5987764 - DNA, 21 bp, Homo sapiens
cactctgagtcacaggtgtgg

SEQ ID NO: 5987765 - DNA, 23 bp, Homo sapiens
cactctgagtttaccatttgtaa

SEQ ID NO: 5987766 - DNA, 20 bp, Homo sapiens
cactctgattcacctcttcc

SEQ ID NO: 5987767 - DNA, 15 bp, Homo sapiens
cactctgcaagaaga

SEQ ID NO: 5987768 - DNA, 13 bp, Homo sapiens
cactctgccaggg

SEQ ID NO: 5987769 - DNA, 15 bp, Homo sapiens
cactctgccagggca

SEQ ID NO: 5987770 - DNA, 19 bp, Homo sapiens
cactctgccagggcagtgc

SEQ ID NO: 5987771 - DNA, 12 bp, Homo sapiens
cactctgccccc

SEQ ID NO: 5987772 - DNA, 13 bp, Homo sapiens
cactctgccccca

SEQ ID NO: 5987773 - DNA, 23 bp, Homo sapiens
cactctgccccccccccccatct

SEQ ID NO: 5987774 - DNA, 17 bp, Homo sapiens
cactctgccctctgctg

SEQ ID NO: 5987775 - DNA, 21 bp, Homo sapiens
cactctgccctctgctgctgc

SEQ ID NO: 5987776 - DNA, 12 bp, Homo sapiens
cactctgcctct

SEQ ID NO: 5987777 - DNA, 15 bp, Homo sapiens
cactctgcctctgcc

SEQ ID NO: 5987778 - DNA, 13 bp, Homo sapiens
cactctgcctgcc

SEQ ID NO: 5987779 - DNA, 17 bp, Homo sapiens
cactctgcctggccttg

SEQ ID NO: 5987780 - DNA, 19 bp, Homo sapiens
cactctgcggcccgggccg

SEQ ID NO: 5987781 - DNA, 13 bp, Homo sapiens
cactctgctccca

SEQ ID NO: 5987782 - DNA, 12 bp, Homo sapiens
cactctgctctg

SEQ ID NO: 5987783 - DNA, 14 bp, Homo sapiens
cactctgctctgat

SEQ ID NO: 5987784 - DNA, 16 bp, Homo sapiens
cactctgctctgcaca

SEQ ID NO: 5987785 - DNA, 16 bp, Homo sapiens
cactctgctgaggcca

SEQ ID NO: 5987786 - DNA, 21 bp, Homo sapiens
cactctgctgaggccagagga

SEQ ID NO: 5987787 - DNA, 11 bp, Homo sapiens
cactctgctgg

SEQ ID NO: 5987788 - DNA, 12 bp, Homo sapiens
cactctgctgtt

SEQ ID NO: 5987789 - DNA, 16 bp, Homo sapiens
cactctgcttctctga

SEQ ID NO: 5987790 - DNA, 13 bp, Homo sapiens
cactctgcttctt

SEQ ID NO: 5987791 - DNA, 15 bp, Homo sapiens
cactctgctttgcat

SEQ ID NO: 5987792 - DNA, 13 bp, Homo sapiens
cactctggactcc

SEQ ID NO: 5987793 - DNA, 14 bp, Homo sapiens
cactctggcagcac

SEQ ID NO: 5987794 - DNA, 22 bp, Homo sapiens
cactctggcagcaccgcctctt

SEQ ID NO: 5987795 - DNA, 15 bp, Homo sapiens
cactctggcagccac

SEQ ID NO: 5987796 - DNA, 15 bp, Homo sapiens
cactctggcagcctc

SEQ ID NO: 5987797 - DNA, 13 bp, Homo sapiens
cactctggcagct

SEQ ID NO: 5987798 - DNA, 14 bp, Homo sapiens
cactctggcagctc

SEQ ID NO: 5987799 - DNA, 13 bp, Homo sapiens
cactctggcctca

SEQ ID NO: 5987800 - DNA, 23 bp, Homo sapiens
cactctggcttcaaaaagccaca

SEQ ID NO: 5987801 - DNA, 20 bp, Homo sapiens
cactctgggcctggggaccc

SEQ ID NO: 5987802 - DNA, 14 bp, Homo sapiens
cactctgggctcca

SEQ ID NO: 5987803 - DNA, 16 bp, Homo sapiens
cactctgggctccaga

SEQ ID NO: 5987804 - DNA, 19 bp, Homo sapiens
cactctggggtgggagggt

SEQ ID NO: 5987805 - DNA, 23 bp, Homo sapiens
cactctggtccctttaaagagca

SEQ ID NO: 5987806 - DNA, 15 bp, Homo sapiens
cactctggtggccac

SEQ ID NO: 5987807 - DNA, 20 bp, Homo sapiens
cactctgtaatagttcagta

SEQ ID NO: 5987808 - DNA, 23 bp, Homo sapiens
cactctgtaattgaatattattc

SEQ ID NO: 5987809 - DNA, 17 bp, Homo sapiens
cactctgtatctatgca

SEQ ID NO: 5987810 - DNA, 23 bp, Homo sapiens
cactctgtcagccagccgccctg

SEQ ID NO: 5987811 - DNA, 22 bp, Homo sapiens
cactctgtccctgtccttccct

SEQ ID NO: 5987812 - DNA, 22 bp, Homo sapiens
cactctgtcgctcaggctggag

SEQ ID NO: 5987813 - DNA, 13 bp, Homo sapiens
cactctgtgccca

SEQ ID NO: 5987814 - DNA, 19 bp, Homo sapiens
cactctgtggccagcctgg

SEQ ID NO: 5987815 - DNA, 21 bp, Homo sapiens
cactctgtggccagcctggca

SEQ ID NO: 5987816 - DNA, 22 bp, Homo sapiens
cactctgtggccagcctggcat

SEQ ID NO: 5987817 - DNA, 19 bp, Homo sapiens
cactctgttcattcctcca

SEQ ID NO: 5987818 - DNA, 21 bp, Homo sapiens
cactctgttcattcctccagg

SEQ ID NO: 5987819 - DNA, 19 bp, Homo sapiens
cactctgttgaccaggctg

SEQ ID NO: 5987820 - DNA, 15 bp, Homo sapiens
cactctgtttgctca

SEQ ID NO: 5987821 - DNA, 17 bp, Homo sapiens
cactctgtttgctcacc

SEQ ID NO: 5987822 - DNA, 15 bp, Homo sapiens
cactcttaaacagca

SEQ ID NO: 5987823 - DNA, 16 bp, Homo sapiens
cactcttaagcttccg

SEQ ID NO: 5987824 - DNA, 18 bp, Homo sapiens
cactcttaggtatgtatg

SEQ ID NO: 5987825 - DNA, 21 bp, Homo sapiens
cactcttatcttacaactccc

SEQ ID NO: 5987826 - DNA, 18 bp, Homo sapiens
cactcttatgctgtaccc

SEQ ID NO: 5987827 - DNA, 21 bp, Homo sapiens
cactcttattgcccacgctgg

SEQ ID NO: 5987828 - DNA, 22 bp, Homo sapiens
cactcttattgcccacgctgga

SEQ ID NO: 5987829 - DNA, 20 bp, Homo sapiens
cactcttcagtgactcctgc

SEQ ID NO: 5987830 - DNA, 11 bp, Homo sapiens
cactcttccaa

SEQ ID NO: 5987831 - DNA, 14 bp, Homo sapiens
cactcttcctgagt

SEQ ID NO: 5987832 - DNA, 17 bp, Homo sapiens
cactcttctccattccc

SEQ ID NO: 5987833 - DNA, 21 bp, Homo sapiens
cactcttctctccaaggaaat

SEQ ID NO: 5987834 - DNA, 15 bp, Homo sapiens
cactcttctctcctt

SEQ ID NO: 5987835 - DNA, 14 bp, Homo sapiens
cactcttctgtctt

SEQ ID NO: 5987836 - DNA, 18 bp, Homo sapiens
cactcttctgtcttgtcc

SEQ ID NO: 5987837 - DNA, 20 bp, Homo sapiens
cactcttcttgagcagaccg

SEQ ID NO: 5987838 - DNA, 17 bp, Homo sapiens
cactcttgaaaaatgca

SEQ ID NO: 5987839 - DNA, 23 bp, Homo sapiens
cactcttgaagaggaggccgcct

SEQ ID NO: 5987840 - DNA, 15 bp, Homo sapiens
cactcttgatctctc

SEQ ID NO: 5987841 - DNA, 16 bp, Homo sapiens
cactcttgatctctct

SEQ ID NO: 5987842 - DNA, 17 bp, Homo sapiens
cactcttggagcctgca

SEQ ID NO: 5987843 - DNA, 22 bp, Homo sapiens
cactcttggagcctgcagagct

SEQ ID NO: 5987844 - DNA, 14 bp, Homo sapiens
cactcttggctcgt

SEQ ID NO: 5987845 - DNA, 17 bp, Homo sapiens
cactcttgtacaaaaga

SEQ ID NO: 5987846 - DNA, 22 bp, Homo sapiens
cactcttgtggatgttttaatt

SEQ ID NO: 5987847 - DNA, 22 bp, Homo sapiens
cactcttgttgaagtgctgttt

SEQ ID NO: 5987848 - DNA, 23 bp, Homo sapiens
cactctttcccccaaatcttcct

SEQ ID NO: 5987849 - DNA, 12 bp, Homo sapiens
cactctttgcta

SEQ ID NO: 5987850 - DNA, 20 bp, Homo sapiens
cactctttgctacaataaat

SEQ ID NO: 5987851 - DNA, 12 bp, Homo sapiens
cactctttgtaa

SEQ ID NO: 5987852 - DNA, 15 bp, Homo sapiens
cactcttttgatggt

SEQ ID NO: 5987853 - DNA, 16 bp, Homo sapiens
cactcttttgctgtgc

SEQ ID NO: 5987854 - DNA, 14 bp, Homo sapiens
cactgaaaaaatac

SEQ ID NO: 5987855 - DNA, 16 bp, Homo sapiens
cactgaaaaaatatat

SEQ ID NO: 5987856 - DNA, 15 bp, Homo sapiens
cactgaaaaaatgta

SEQ ID NO: 5987857 - DNA, 20 bp, Homo sapiens
cactgaaaaatctaagtgat

SEQ ID NO: 5987858 - DNA, 16 bp, Homo sapiens
cactgaaaacatctgg

SEQ ID NO: 5987859 - DNA, 17 bp, Homo sapiens
cactgaaaacttagcca

SEQ ID NO: 5987860 - DNA, 16 bp, Homo sapiens
cactgaaaagcagcct

SEQ ID NO: 5987861 - DNA, 22 bp, Homo sapiens
cactgaaaaggttcttcatccc

SEQ ID NO: 5987862 - DNA, 16 bp, Homo sapiens
cactgaaacattattt

SEQ ID NO: 5987863 - DNA, 15 bp, Homo sapiens
cactgaaacctctgt

SEQ ID NO: 5987864 - DNA, 18 bp, Homo sapiens
cactgaaacctctgttct

SEQ ID NO: 5987865 - DNA, 14 bp, Homo sapiens
cactgaaacctgag

SEQ ID NO: 5987866 - DNA, 21 bp, Homo sapiens
cactgaaacttcaagcaccag

SEQ ID NO: 5987867 - DNA, 17 bp, Homo sapiens
cactgaaaggaaaaatg

SEQ ID NO: 5987868 - DNA, 19 bp, Homo sapiens
cactgaaagttttgtaaaa

SEQ ID NO: 5987869 - DNA, 23 bp, Homo sapiens
cactgaaagttttgtaaaagaaa

SEQ ID NO: 5987870 - DNA, 23 bp, Homo sapiens
cactgaaataaccgtaaaggttt

SEQ ID NO: 5987871 - DNA, 20 bp, Homo sapiens
cactgaaatatacacacagc

SEQ ID NO: 5987872 - DNA, 16 bp, Homo sapiens
cactgaaatgtttgga

SEQ ID NO: 5987873 - DNA, 15 bp, Homo sapiens
cactgaaattctaaa

SEQ ID NO: 5987874 - DNA, 12 bp, Homo sapiens
cactgaacaaaa

SEQ ID NO: 5987875 - DNA, 21 bp, Homo sapiens
cactgaacaaaacctacacac

SEQ ID NO: 5987876 - DNA, 18 bp, Homo sapiens
cactgaacaggctggggc

SEQ ID NO: 5987877 - DNA, 21 bp, Homo sapiens
cactgaacaggctggggcctt

SEQ ID NO: 5987878 - DNA, 21 bp, Homo sapiens
cactgaacatgcctagtccaa

SEQ ID NO: 5987879 - DNA, 15 bp, Homo sapiens
cactgaacatgctca

SEQ ID NO: 5987880 - DNA, 15 bp, Homo sapiens
cactgaactccaccg

SEQ ID NO: 5987881 - DNA, 16 bp, Homo sapiens
cactgaactcctattt

SEQ ID NO: 5987882 - DNA, 15 bp, Homo sapiens
cactgaactgctttt

SEQ ID NO: 5987883 - DNA, 18 bp, Homo sapiens
cactgaacttttcaaaat

SEQ ID NO: 5987884 - DNA, 11 bp, Homo sapiens
cactgaagaag

SEQ ID NO: 5987885 - DNA, 23 bp, Homo sapiens
cactgaagaagcaccaatcatga

SEQ ID NO: 5987886 - DNA, 21 bp, Homo sapiens
cactgaagaagtcactgaaca

SEQ ID NO: 5987887 - DNA, 18 bp, Homo sapiens
cactgaagagctcttggc

SEQ ID NO: 5987888 - DNA, 11 bp, Homo sapiens
cactgaagagg

SEQ ID NO: 5987889 - DNA, 16 bp, Homo sapiens
cactgaagatagaaga

SEQ ID NO: 5987890 - DNA, 17 bp, Homo sapiens
cactgaagatagaagaa

SEQ ID NO: 5987891 - DNA, 16 bp, Homo sapiens
caaggccgaagctctg

SEQ ID NO: 5987892 - DNA, 20 bp, Homo sapiens
caaggccgaagctctggctg

SEQ ID NO: 5987893 - DNA, 21 bp, Homo sapiens
caaggccgaagctctggctga

SEQ ID NO: 5987894 - DNA, 16 bp, Homo sapiens
caaggccgagggccag

SEQ ID NO: 5987895 - DNA, 15 bp, Homo sapiens
caaggccgccagcgt

SEQ ID NO: 5987896 - DNA, 15 bp, Homo sapiens
caaggccgcccacct

SEQ ID NO: 5987897 - DNA, 15 bp, Homo sapiens
caaggccgcggccca

SEQ ID NO: 5987898 - DNA, 17 bp, Homo sapiens
caaggccgcggcccaga

SEQ ID NO: 5987899 - DNA, 20 bp, Homo sapiens
caaggccgctgttcacccac

SEQ ID NO: 5987900 - DNA, 22 bp, Homo sapiens
caaggccgctgttcacccacag

SEQ ID NO: 5987901 - DNA, 20 bp, Homo sapiens
caaggccggagacccacagc

SEQ ID NO: 5987902 - DNA, 21 bp, Homo sapiens
caaggccggagacccacagcc

SEQ ID NO: 5987903 - DNA, 16 bp, Homo sapiens
caaggcctaccccagt

SEQ ID NO: 5987904 - DNA, 19 bp, Homo sapiens
caaggcctaccccagttcc

SEQ ID NO: 5987905 - DNA, 22 bp, Homo sapiens
caaggcctaccccagttcctag

SEQ ID NO: 5987906 - DNA, 24 bp, Homo sapiens
caaggcctaccccagttcctagca

SEQ ID NO: 5987907 - DNA, 14 bp, Homo sapiens
caaggcctaggacc

SEQ ID NO: 5987908 - DNA, 13 bp, Homo sapiens
caaggcctatgcc

SEQ ID NO: 5987909 - DNA, 21 bp, Homo sapiens
caaggcctatgccacctgcag

SEQ ID NO: 5987910 - DNA, 17 bp, Homo sapiens
caaggcctcaggagagc

SEQ ID NO: 5987911 - DNA, 14 bp, Homo sapiens
caaggcctcccaca

SEQ ID NO: 5987912 - DNA, 18 bp, Homo sapiens
caaggcctcccacagtga

SEQ ID NO: 5987913 - DNA, 21 bp, Homo sapiens
caaggcctcgctcttgacaga

SEQ ID NO: 5987914 - DNA, 11 bp, Homo sapiens
caaggcctctc

SEQ ID NO: 5987915 - DNA, 17 bp, Homo sapiens
caaggcctctcacccca

SEQ ID NO: 5987916 - DNA, 14 bp, Homo sapiens
caaggcctctcaga

SEQ ID NO: 5987917 - DNA, 13 bp, Homo sapiens
caaggcctctctc

SEQ ID NO: 5987918 - DNA, 14 bp, Homo sapiens
caaggcctctctct

SEQ ID NO: 5987919 - DNA, 15 bp, Homo sapiens
caaggcctctctctg

SEQ ID NO: 5987920 - DNA, 18 bp, Homo sapiens
caaggcctctctctgcct

SEQ ID NO: 5987921 - DNA, 16 bp, Homo sapiens
caaggcctgctccctg

SEQ ID NO: 5987922 - DNA, 16 bp, Homo sapiens
caaggcctgcttgact

SEQ ID NO: 5987923 - DNA, 12 bp, Homo sapiens
caaggcctggtc

SEQ ID NO: 5987924 - DNA, 16 bp, Homo sapiens
caaggcctggtctggg

SEQ ID NO: 5987925 - DNA, 17 bp, Homo sapiens
caaggcctgtccctggc

SEQ ID NO: 5987926 - DNA, 12 bp, Homo sapiens
caaggccttaag

SEQ ID NO: 5987927 - DNA, 18 bp, Homo sapiens
caaggccttcccctggca

SEQ ID NO: 5987928 - DNA, 21 bp, Homo sapiens
caaggccttcccctggcactg

SEQ ID NO: 5987929 - DNA, 14 bp, Homo sapiens
caaggccttctcct

SEQ ID NO: 5987930 - DNA, 18 bp, Homo sapiens
caaggccttgcctggcct

SEQ ID NO: 5987931 - DNA, 19 bp, Homo sapiens
caaggccttggtggagcag

SEQ ID NO: 5987932 - DNA, 20 bp, Homo sapiens
caaggccttggtggagcagc

SEQ ID NO: 5987933 - DNA, 21 bp, Homo sapiens
caaggccttggtggagcagcc

SEQ ID NO: 5987934 - DNA, 15 bp, Homo sapiens
caaggcggcccctcc

SEQ ID NO: 5987935 - DNA, 22 bp, Homo sapiens
caaggcggtggacttgaacttt

SEQ ID NO: 5987936 - DNA, 18 bp, Homo sapiens
caaggctaacatcccact

SEQ ID NO: 5987937 - DNA, 16 bp, Homo sapiens
caaggctaattggaaa

SEQ ID NO: 5987938 - DNA, 19 bp, Homo sapiens
caaggctagatcatgaaga

SEQ ID NO: 5987939 - DNA, 13 bp, Homo sapiens
caaggctcacatg

SEQ ID NO: 5987940 - DNA, 14 bp, Homo sapiens
caaggctctcccct

SEQ ID NO: 5987941 - DNA, 15 bp, Homo sapiens
caaggctctcccctc

SEQ ID NO: 5987942 - DNA, 17 bp, Homo sapiens
caaggctctcccctctc

SEQ ID NO: 5987943 - DNA, 21 bp, Homo sapiens
caaggctcttctccttggagg

SEQ ID NO: 5987944 - DNA, 13 bp, Homo sapiens
caaggctcttctt

SEQ ID NO: 5987945 - DNA, 15 bp, Homo sapiens
caaggctcttcttcc

SEQ ID NO: 5987946 - DNA, 20 bp, Homo sapiens
caaggctgaccaagagagaa

SEQ ID NO: 5987947 - DNA, 11 bp, Homo sapiens
caaggctgact

SEQ ID NO: 5987948 - DNA, 23 bp, Homo sapiens
caaggctgataatatgacaaaca

SEQ ID NO: 5987949 - DNA, 17 bp, Homo sapiens
caaggctgcagtgagcc

SEQ ID NO: 5987950 - DNA, 17 bp, Homo sapiens
caaggctgccagacatg

SEQ ID NO: 5987951 - DNA, 22 bp, Homo sapiens
caaggctgccagacatggacct

SEQ ID NO: 5987952 - DNA, 16 bp, Homo sapiens
caaggctgccggctgc

SEQ ID NO: 5987953 - DNA, 17 bp, Homo sapiens
caaggctgccggctgca

SEQ ID NO: 5987954 - DNA, 12 bp, Homo sapiens
caaggctgcctg

SEQ ID NO: 5987955 - DNA, 13 bp, Homo sapiens
caaggctgcctgc

SEQ ID NO: 5987956 - DNA, 14 bp, Homo sapiens
caaggctgcctgga

SEQ ID NO: 5987957 - DNA, 18 bp, Homo sapiens
caaggctgcctggagaaa

SEQ ID NO: 5987958 - DNA, 14 bp, Homo sapiens
caaggctgcgtctg

SEQ ID NO: 5987959 - DNA, 17 bp, Homo sapiens
caaggctgcgtctggag

SEQ ID NO: 5987960 - DNA, 18 bp, Homo sapiens
caaggctgcgtctggagg

SEQ ID NO: 5987961 - DNA, 15 bp, Homo sapiens
caaggctgctaagtg

SEQ ID NO: 5987962 - DNA, 19 bp, Homo sapiens
caaggctgctaagtggaag

SEQ ID NO: 5987963 - DNA, 16 bp, Homo sapiens
caaggctgctcagagg

SEQ ID NO: 5987964 - DNA, 22 bp, Homo sapiens
caaggctgggcacctctagtgc

SEQ ID NO: 5987965 - DNA, 13 bp, Homo sapiens
caaggctggggca

SEQ ID NO: 5987966 - DNA, 16 bp, Homo sapiens
caaggctggggcatgg

SEQ ID NO: 5987967 - DNA, 21 bp, Homo sapiens
caaggctgtcaattacaggaa

SEQ ID NO: 5987968 - DNA, 23 bp, Homo sapiens
caaggctgtcttctcccagagca

SEQ ID NO: 5987969 - DNA, 15 bp, Homo sapiens
caaggctgtgcatct

SEQ ID NO: 5987970 - DNA, 14 bp, Homo sapiens
caaggctgtgccag

SEQ ID NO: 5987971 - DNA, 18 bp, Homo sapiens
caaggctgtgccaggctg

SEQ ID NO: 5987972 - DNA, 19 bp, Homo sapiens
caaggctgtgccaggctgg

SEQ ID NO: 5987973 - DNA, 18 bp, Homo sapiens
caaggctgtgctccctgg

SEQ ID NO: 5987974 - DNA, 14 bp, Homo sapiens
caaggctgtgctct

SEQ ID NO: 5987975 - DNA, 21 bp, Homo sapiens
caaggctgtgctcttcctctg

SEQ ID NO: 5987976 - DNA, 15 bp, Homo sapiens
caaggctgtggacca

SEQ ID NO: 5987977 - DNA, 20 bp, Homo sapiens
caaggctgtggaccatggag

SEQ ID NO: 5987978 - DNA, 18 bp, Homo sapiens
caaggcttagaccctcat

SEQ ID NO: 5987979 - DNA, 19 bp, Homo sapiens
caaggcttagaccctcatg

SEQ ID NO: 5987980 - DNA, 14 bp, Homo sapiens
caaggcttatctct

SEQ ID NO: 5987981 - DNA, 13 bp, Homo sapiens
caaggcttattta

SEQ ID NO: 5987982 - DNA, 16 bp, Homo sapiens
caaggcttgctgcaga

SEQ ID NO: 5987983 - DNA, 21 bp, Homo sapiens
caagggaaaaatttttatgta

SEQ ID NO: 5987984 - DNA, 16 bp, Homo sapiens
caagggaaaagtctct

SEQ ID NO: 5987985 - DNA, 17 bp, Homo sapiens
caagggaaaggcaagct

SEQ ID NO: 5987986 - DNA, 20 bp, Homo sapiens
caagggaagaaacactctta

SEQ ID NO: 5987987 - DNA, 13 bp, Homo sapiens
caagggaagagat

SEQ ID NO: 5987988 - DNA, 20 bp, Homo sapiens
caagggaaggggcctccctc

SEQ ID NO: 5987989 - DNA, 23 bp, Homo sapiens
caagggaatttcttcaactccct

SEQ ID NO: 5987990 - DNA, 13 bp, Homo sapiens
caagggacagcaa

SEQ ID NO: 5987991 - DNA, 18 bp, Homo sapiens
caagggacaggtgggcct

SEQ ID NO: 5987992 - DNA, 19 bp, Homo sapiens
caagggacaggtgggcctg

SEQ ID NO: 5987993 - DNA, 22 bp, Homo sapiens
caagggaccaggtttgcaggag

SEQ ID NO: 5987994 - DNA, 22 bp, Homo sapiens
caagggactagtgagtcagcac

SEQ ID NO: 5987995 - DNA, 18 bp, Homo sapiens
caagggactgaggcaagc

SEQ ID NO: 5987996 - DNA, 14 bp, Homo sapiens
caagggagagacct

SEQ ID NO: 5987997 - DNA, 10 bp, Homo sapiens
caagggaggc

SEQ ID NO: 5987998 - DNA, 16 bp, Homo sapiens
caagggaggcagtggc

SEQ ID NO: 5987999 - DNA, 16 bp, Homo sapiens
caagggaggcccagcg

SEQ ID NO: 5988000 - DNA, 14 bp, Homo sapiens
caagggaggctgct

SEQ ID NO: 5988001 - DNA, 17 bp, Homo sapiens
caagggaggctgctgct

SEQ ID NO: 5988002 - DNA, 18 bp, Homo sapiens
caagggagggaagggcca

SEQ ID NO: 5988003 - DNA, 22 bp, Homo sapiens
caagggagggaagggccaccct

SEQ ID NO: 5988004 - DNA, 17 bp, Homo sapiens
caagggatctggtccta

SEQ ID NO: 5988005 - DNA, 21 bp, Homo sapiens
caagggatctggtcctaccca

SEQ ID NO: 5988006 - DNA, 16 bp, Homo sapiens
caagggatggcaccac

SEQ ID NO: 5988007 - DNA, 19 bp, Homo sapiens
caagggcacaaactgcagc

SEQ ID NO: 5988008 - DNA, 20 bp, Homo sapiens
caagggcactgtgatacagt

SEQ ID NO: 5988009 - DNA, 11 bp, Homo sapiens
caagggcagct

SEQ ID NO: 5988010 - DNA, 16 bp, Homo sapiens
caagggcagtggaaga

SEQ ID NO: 5988011 - DNA, 16 bp, Homo sapiens
caagggcataaagtaa

SEQ ID NO: 5988012 - DNA, 16 bp, Homo sapiens
caagggcatcaggcac

SEQ ID NO: 5988013 - DNA, 20 bp, Homo sapiens
caagggcatcatcctcagca

SEQ ID NO: 5988014 - DNA, 23 bp, Homo sapiens
caagggcatcatcctcagcagca

SEQ ID NO: 5988015 - DNA, 14 bp, Homo sapiens
caagggccatgctg

SEQ ID NO: 5988016 - DNA, 13 bp, Homo sapiens
caagggcccagac

SEQ ID NO: 5988017 - DNA, 13 bp, Homo sapiens
caagggcccagag

SEQ ID NO: 5988018 - DNA, 15 bp, Homo sapiens
caagggcccagagtg

SEQ ID NO: 5988019 - DNA, 16 bp, Homo sapiens
caagggccccaggggc

SEQ ID NO: 5988020 - DNA, 17 bp, Homo sapiens
caagggccccaggggca

SEQ ID NO: 5988021 - DNA, 23 bp, Homo sapiens
caagggccccaggggcagcaagg

SEQ ID NO: 5988022 - DNA, 13 bp, Homo sapiens
caagggccctggc

SEQ ID NO: 5988023 - DNA, 18 bp, Homo sapiens
caagggccctggcacccc

SEQ ID NO: 5988024 - DNA, 21 bp, Homo sapiens
caagggccgtgcccttgccct

SEQ ID NO: 5988025 - DNA, 12 bp, Homo sapiens
caagggcctgga

SEQ ID NO: 5988026 - DNA, 14 bp, Homo sapiens
caagggcctggcct

SEQ ID NO: 5988027 - DNA, 15 bp, Homo sapiens
caagggcctggcctg

SEQ ID NO: 5988028 - DNA, 16 bp, Homo sapiens
caagggcgcaagagta

SEQ ID NO: 5988029 - DNA, 19 bp, Homo sapiens
caagggcggcctttcccac

SEQ ID NO: 5988030 - DNA, 13 bp, Homo sapiens
caagggctccagc

SEQ ID NO: 5988031 - DNA, 14 bp, Homo sapiens
caagggctccagca

SEQ ID NO: 5988032 - DNA, 19 bp, Homo sapiens
caagggctccagcatccag

SEQ ID NO: 5988033 - DNA, 21 bp, Homo sapiens
caagggctgcaatgccctcat

SEQ ID NO: 5988034 - DNA, 19 bp, Homo sapiens
caagggcttctgcaccctc

SEQ ID NO: 5988035 - DNA, 21 bp, Homo sapiens
caagggcttctgcaccctcca

SEQ ID NO: 5988036 - DNA, 23 bp, Homo sapiens
caagggcttgatggtgacagctg

SEQ ID NO: 5988037 - DNA, 13 bp, Homo sapiens
caagggctttcct

SEQ ID NO: 5988038 - DNA, 21 bp, Homo sapiens
caagggctttcctgtgccagg

SEQ ID NO: 5988039 - DNA, 20 bp, Homo sapiens
caagggctttgttttgcaca

SEQ ID NO: 5988040 - DNA, 23 bp, Homo sapiens
caaggggaatgtttgcctctgcc

SEQ ID NO: 5988041 - DNA, 15 bp, Homo sapiens
caaggggacttgtgc

SEQ ID NO: 5988042 - DNA, 14 bp, Homo sapiens
caaggggcagccag

SEQ ID NO: 5988043 - DNA, 16 bp, Homo sapiens
caaggggcagccagcc

SEQ ID NO: 5988044 - DNA, 20 bp, Homo sapiens
caaggggcagccagccctgg

SEQ ID NO: 5988045 - DNA, 18 bp, Homo sapiens
caaggggcccaaattctt

SEQ ID NO: 5988046 - DNA, 15 bp, Homo sapiens
caaggggcccagtgc

SEQ ID NO: 5988047 - DNA, 14 bp, Homo sapiens
caaggggcctgagc

SEQ ID NO: 5988048 - DNA, 21 bp, Homo sapiens
caaggggcctgagcagtcctt

SEQ ID NO: 5988049 - DNA, 20 bp, Homo sapiens
caaggggctgcgctagcagc

SEQ ID NO: 5988050 - DNA, 18 bp, Homo sapiens
caaggggctgcttctggg

SEQ ID NO: 5988051 - DNA, 13 bp, Homo sapiens
caaggggctggaa

SEQ ID NO: 5988052 - DNA, 18 bp, Homo sapiens
caaggggcttcgttttca

SEQ ID NO: 5988053 - DNA, 15 bp, Homo sapiens
caagggggcagaggg

SEQ ID NO: 5988054 - DNA, 17 bp, Homo sapiens
caagggggcagagggct

SEQ ID NO: 5988055 - DNA, 13 bp, Homo sapiens
caagggggcccaa

SEQ ID NO: 5988056 - DNA, 17 bp, Homo sapiens
caagggggctgctgctc

SEQ ID NO: 5988057 - DNA, 12 bp, Homo sapiens
caagggggtgac

SEQ ID NO: 5988058 - DNA, 14 bp, Homo sapiens
caagggggtgactg

SEQ ID NO: 5988059 - DNA, 21 bp, Homo sapiens
caagggggtgtcatctgagga

SEQ ID NO: 5988060 - DNA, 18 bp, Homo sapiens
caaggggtctgctcctgt

SEQ ID NO: 5988061 - DNA, 21 bp, Homo sapiens
caaggggtctgctcctgtggc

SEQ ID NO: 5988062 - DNA, 13 bp, Homo sapiens
caaggggtggaag

SEQ ID NO: 5988063 - DNA, 14 bp, Homo sapiens
caaggggtggaagg

SEQ ID NO: 5988064 - DNA, 20 bp, Homo sapiens
caaggggtggaagggcagga

SEQ ID NO: 5988065 - DNA, 22 bp, Homo sapiens
caaggggtggaagggcaggagc

SEQ ID NO: 5988066 - DNA, 17 bp, Homo sapiens
caaggggtggccgggca

SEQ ID NO: 5988067 - DNA, 21 bp, Homo sapiens
caaggggttcccactggctcc

SEQ ID NO: 5988068 - DNA, 22 bp, Homo sapiens
caaggggttcccactggctcct

SEQ ID NO: 5988069 - DNA, 17 bp, Homo sapiens
caaggggtttctgtttc

SEQ ID NO: 5988070 - DNA, 22 bp, Homo sapiens
caagggtaatcttgggtttcta

SEQ ID NO: 5988071 - DNA, 11 bp, Homo sapiens
cactgaagccc

SEQ ID NO: 5988072 - DNA, 19 bp, Homo sapiens
cactgaagccggacagctg

SEQ ID NO: 5988073 - DNA, 20 bp, Homo sapiens
cactgaagccggacagctgc

SEQ ID NO: 5988074 - DNA, 13 bp, Homo sapiens
cactgaagctggg

SEQ ID NO: 5988075 - DNA, 14 bp, Homo sapiens
cactgaaggacctg

SEQ ID NO: 5988076 - DNA, 20 bp, Homo sapiens
cactgaaggacctgagctgg

SEQ ID NO: 5988077 - DNA, 23 bp, Homo sapiens
cactgaaggacctgagctggcca

SEQ ID NO: 5988078 - DNA, 21 bp, Homo sapiens
cactgaaggattaatgaaaac

SEQ ID NO: 5988079 - DNA, 18 bp, Homo sapiens
cactgaaggcctggccca

SEQ ID NO: 5988080 - DNA, 17 bp, Homo sapiens
cactgaagtcagttctc

SEQ ID NO: 5988081 - DNA, 15 bp, Homo sapiens
cactgaagtggccct

SEQ ID NO: 5988082 - DNA, 16 bp, Homo sapiens
cactgaagttgtctga

SEQ ID NO: 5988083 - DNA, 23 bp, Homo sapiens
cactgaagttgtctgaaggtaat

SEQ ID NO: 5988084 - DNA, 17 bp, Homo sapiens
cactgaagtttttgaaa

SEQ ID NO: 5988085 - DNA, 20 bp, Homo sapiens
cactgaataaagcacgtgca

SEQ ID NO: 5988086 - DNA, 21 bp, Homo sapiens
cactgaatatcaactctgaaa

SEQ ID NO: 5988087 - DNA, 13 bp, Homo sapiens
cactgaatattta

SEQ ID NO: 5988088 - DNA, 14 bp, Homo sapiens
cactgaatctgtac

SEQ ID NO: 5988089 - DNA, 16 bp, Homo sapiens
cactgaatctgtacag

SEQ ID NO: 5988090 - DNA, 16 bp, Homo sapiens
cactgaatggaaataa

SEQ ID NO: 5988091 - DNA, 20 bp, Homo sapiens
cactgaatggctgacctgac

SEQ ID NO: 5988092 - DNA, 18 bp, Homo sapiens
cactgaattcactccagt

SEQ ID NO: 5988093 - DNA, 17 bp, Homo sapiens
cactgaattccattttt

SEQ ID NO: 5988094 - DNA, 12 bp, Homo sapiens
cactgaattgaa

SEQ ID NO: 5988095 - DNA, 13 bp, Homo sapiens
cactgaatttata

SEQ ID NO: 5988096 - DNA, 14 bp, Homo sapiens
cactgaatttataa

SEQ ID NO: 5988097 - DNA, 14 bp, Homo sapiens
cactgaattttgga

SEQ ID NO: 5988098 - DNA, 21 bp, Homo sapiens
cactgacaaacgtccccagcg

SEQ ID NO: 5988099 - DNA, 23 bp, Homo sapiens
cactgacaaacgtccccagcggt

SEQ ID NO: 5988100 - DNA, 19 bp, Homo sapiens
cactgacaaagtcatcccc

SEQ ID NO: 5988101 - DNA, 22 bp, Homo sapiens
cactgacacaaaagaagaaata

SEQ ID NO: 5988102 - DNA, 18 bp, Homo sapiens
cactgacacccagtgtcc

SEQ ID NO: 5988103 - DNA, 24 bp, Homo sapiens
cactgacaccctggtcctgacttc

SEQ ID NO: 5988104 - DNA, 21 bp, Homo sapiens
cactgacacctttgcaggcat

SEQ ID NO: 5988105 - DNA, 23 bp, Homo sapiens
cactgacactggtattcctgcct

SEQ ID NO: 5988106 - DNA, 17 bp, Homo sapiens
cactgacagatttccat

SEQ ID NO: 5988107 - DNA, 22 bp, Homo sapiens
cactgacagatttccatcctag

SEQ ID NO: 5988108 - DNA, 12 bp, Homo sapiens
cactgacagcct

SEQ ID NO: 5988109 - DNA, 20 bp, Homo sapiens
cactgacagcctccaccttg

SEQ ID NO: 5988110 - DNA, 15 bp, Homo sapiens
cactgacagcctccc

SEQ ID NO: 5988111 - DNA, 16 bp, Homo sapiens
cactgacagcctccca

SEQ ID NO: 5988112 - DNA, 17 bp, Homo sapiens
cactgacatgtttcaca

SEQ ID NO: 5988113 - DNA, 13 bp, Homo sapiens
cactgaccagaac

SEQ ID NO: 5988114 - DNA, 15 bp, Homo sapiens
cactgaccagaacta

SEQ ID NO: 5988115 - DNA, 14 bp, Homo sapiens
cactgaccagcggc

SEQ ID NO: 5988116 - DNA, 20 bp, Homo sapiens
cactgaccagcggctgctca

SEQ ID NO: 5988117 - DNA, 14 bp, Homo sapiens
cactgaccaggccc

SEQ ID NO: 5988118 - DNA, 16 bp, Homo sapiens
cactgaccatccactc

SEQ ID NO: 5988119 - DNA, 15 bp, Homo sapiens
cactgacccacctgc

SEQ ID NO: 5988120 - DNA, 17 bp, Homo sapiens
cactgaccccccccatt

SEQ ID NO: 5988121 - DNA, 19 bp, Homo sapiens
cactgacccttccagacat

SEQ ID NO: 5988122 - DNA, 19 bp, Homo sapiens
cactgaccggtgcttttat

SEQ ID NO: 5988123 - DNA, 15 bp, Homo sapiens
cactgacctcaccgg

SEQ ID NO: 5988124 - DNA, 13 bp, Homo sapiens
cactgacctgccc

SEQ ID NO: 5988125 - DNA, 23 bp, Homo sapiens
cactgacctgcccatgtccagag

SEQ ID NO: 5988126 - DNA, 20 bp, Homo sapiens
cactgacctgctccgccagg

SEQ ID NO: 5988127 - DNA, 22 bp, Homo sapiens
cactgacctgctccgccaggaa

SEQ ID NO: 5988128 - DNA, 14 bp, Homo sapiens
cactgacctggaag

SEQ ID NO: 5988129 - DNA, 20 bp, Homo sapiens
cactgacctggaagagctgg

SEQ ID NO: 5988130 - DNA, 19 bp, Homo sapiens
cactgacctggttgtccag

SEQ ID NO: 5988131 - DNA, 20 bp, Homo sapiens
cactgacctggttgtccagg

SEQ ID NO: 5988132 - DNA, 22 bp, Homo sapiens
cactgacctgtcatgcccccct

SEQ ID NO: 5988133 - DNA, 23 bp, Homo sapiens
cactgacctgtcatgcccccctc

SEQ ID NO: 5988134 - DNA, 19 bp, Homo sapiens
cactgactatttgacaata

SEQ ID NO: 5988135 - DNA, 11 bp, Homo sapiens
cactgactgtg

SEQ ID NO: 5988136 - DNA, 15 bp, Homo sapiens
cactgacttctaagt

SEQ ID NO: 5988137 - DNA, 20 bp, Homo sapiens
cactgacttctaagtaaaac

SEQ ID NO: 5988138 - DNA, 21 bp, Homo sapiens
cactgacttctaagtaaaacc

SEQ ID NO: 5988139 - DNA, 13 bp, Homo sapiens
cactgacttgctg

SEQ ID NO: 5988140 - DNA, 15 bp, Homo sapiens
cactgagaagatggc

SEQ ID NO: 5988141 - DNA, 19 bp, Homo sapiens
cactgagaagatggcactg

SEQ ID NO: 5988142 - DNA, 23 bp, Homo sapiens
cactgagaagatggcactgtcca

SEQ ID NO: 5988143 - DNA, 13 bp, Homo sapiens
cactgagacagcc

SEQ ID NO: 5988144 - DNA, 19 bp, Homo sapiens
cactgagacagcccgggct

SEQ ID NO: 5988145 - DNA, 22 bp, Homo sapiens
cactgagacagcccgggctctg

SEQ ID NO: 5988146 - DNA, 23 bp, Homo sapiens
cactgagacagcccgggctctgc

SEQ ID NO: 5988147 - DNA, 15 bp, Homo sapiens
cactgagaccaaggc

SEQ ID NO: 5988148 - DNA, 23 bp, Homo sapiens
cactgagaccccaggctgttagg

SEQ ID NO: 5988149 - DNA, 22 bp, Homo sapiens
cactgagactttcccctctcgc

SEQ ID NO: 5988150 - DNA, 18 bp, Homo sapiens
cactgagagagcgcagcc

SEQ ID NO: 5988151 - DNA, 21 bp, Homo sapiens
cactgagagcctttttgaaag

SEQ ID NO: 5988152 - DNA, 14 bp, Homo sapiens
cactgagagcgaga

SEQ ID NO: 5988153 - DNA, 19 bp, Homo sapiens
cactgagagcgagatggga

SEQ ID NO: 5988154 - DNA, 15 bp, Homo sapiens
cactgagagctgcct

SEQ ID NO: 5988155 - DNA, 16 bp, Homo sapiens
cactgagagctgctcc

SEQ ID NO: 5988156 - DNA, 22 bp, Homo sapiens
cactgagaggacagagagaaat

SEQ ID NO: 5988157 - DNA, 19 bp, Homo sapiens
cactgagataccagcgagg

SEQ ID NO: 5988158 - DNA, 23 bp, Homo sapiens
cactgagataccagcgaggaggc

SEQ ID NO: 5988159 - DNA, 23 bp, Homo sapiens
cactgagatattgggacacacat

SEQ ID NO: 5988160 - DNA, 20 bp, Homo sapiens
cactgagcaacgctattcca

SEQ ID NO: 5988161 - DNA, 16 bp, Homo sapiens
cactgagcacagtcag

SEQ ID NO: 5988162 - DNA, 18 bp, Homo sapiens
cactgagcacagtcaggg

SEQ ID NO: 5988163 - DNA, 13 bp, Homo sapiens
cactgagcactgt

SEQ ID NO: 5988164 - DNA, 13 bp, Homo sapiens
cactgagcatcac

SEQ ID NO: 5988165 - DNA, 16 bp, Homo sapiens
cactgagccagtcttt

SEQ ID NO: 5988166 - DNA, 11 bp, Homo sapiens
cactgagccat

SEQ ID NO: 5988167 - DNA, 21 bp, Homo sapiens
cactgagccatcatttcctgg

SEQ ID NO: 5988168 - DNA, 14 bp, Homo sapiens
cactgagccccccc

SEQ ID NO: 5988169 - DNA, 15 bp, Homo sapiens
cactgagcctggccc

SEQ ID NO: 5988170 - DNA, 14 bp, Homo sapiens
cactgagctcccca

SEQ ID NO: 5988171 - DNA, 15 bp, Homo sapiens
cactgagctctgcct

SEQ ID NO: 5988172 - DNA, 16 bp, Homo sapiens
cactgagctctgcctc

SEQ ID NO: 5988173 - DNA, 13 bp, Homo sapiens
cactgagctggct

SEQ ID NO: 5988174 - DNA, 15 bp, Homo sapiens
cactgagctggctga

SEQ ID NO: 5988175 - DNA, 17 bp, Homo sapiens
cactgagctggctgact

SEQ ID NO: 5988176 - DNA, 21 bp, Homo sapiens
cactgagctggctgactaagc

SEQ ID NO: 5988177 - DNA, 13 bp, Homo sapiens
cactgagctgggt

SEQ ID NO: 5988178 - DNA, 14 bp, Homo sapiens
cactgagctgggtg

SEQ ID NO: 5988179 - DNA, 22 bp, Homo sapiens
cactgagctgtgacccagaggg

SEQ ID NO: 5988180 - DNA, 16 bp, Homo sapiens
cactgagcttctgaga

SEQ ID NO: 5988181 - DNA, 13 bp, Homo sapiens
cactgaggaagaa

SEQ ID NO: 5988182 - DNA, 14 bp, Homo sapiens
cactgaggacacag

SEQ ID NO: 5988183 - DNA, 20 bp, Homo sapiens
cactgaggagacagaaagcc

SEQ ID NO: 5988184 - DNA, 15 bp, Homo sapiens
cactgaggcagcctt

SEQ ID NO: 5988185 - DNA, 17 bp, Homo sapiens
cactgaggcagccttgg

SEQ ID NO: 5988186 - DNA, 17 bp, Homo sapiens
cactgaggcagggaagt

SEQ ID NO: 5988187 - DNA, 18 bp, Homo sapiens
cactgaggcagggaagtc

SEQ ID NO: 5988188 - DNA, 17 bp, Homo sapiens
cactgaggccatcaggg

SEQ ID NO: 5988189 - DNA, 21 bp, Homo sapiens
cactgaggccatcagggccct

SEQ ID NO: 5988190 - DNA, 22 bp, Homo sapiens
cactgaggccatcagggccctg

SEQ ID NO: 5988191 - DNA, 19 bp, Homo sapiens
cactgaggcctgagaccca

SEQ ID NO: 5988192 - DNA, 18 bp, Homo sapiens
cactgaggcgctcgctcc

SEQ ID NO: 5988193 - DNA, 18 bp, Homo sapiens
cactgaggggccagggag

SEQ ID NO: 5988194 - DNA, 20 bp, Homo sapiens
cactgaggggtggcacggga

SEQ ID NO: 5988195 - DNA, 13 bp, Homo sapiens
cactgagggtctg

SEQ ID NO: 5988196 - DNA, 21 bp, Homo sapiens
cactgagggtggcactcaact

SEQ ID NO: 5988197 - DNA, 21 bp, Homo sapiens
cactgagtacaaatgtgtgac

SEQ ID NO: 5988198 - DNA, 13 bp, Homo sapiens
cactgagtgaaat

SEQ ID NO: 5988199 - DNA, 17 bp, Homo sapiens
cactgagtgaaatatta

SEQ ID NO: 5988200 - DNA, 14 bp, Homo sapiens
cactgagtgaagga

SEQ ID NO: 5988201 - DNA, 17 bp, Homo sapiens
cactgagtgaggagtgg

SEQ ID NO: 5988202 - DNA, 21 bp, Homo sapiens
cactgagtgatactttaagtt

SEQ ID NO: 5988203 - DNA, 19 bp, Homo sapiens
cactgagtgcctactcttt

SEQ ID NO: 5988204 - DNA, 21 bp, Homo sapiens
cactgagttgggcaaaaccca

SEQ ID NO: 5988205 - DNA, 15 bp, Homo sapiens
cactgagtttctatt

SEQ ID NO: 5988206 - DNA, 16 bp, Homo sapiens
cactgagtttctattt

SEQ ID NO: 5988207 - DNA, 21 bp, Homo sapiens
cactgagttttccatggcagg

SEQ ID NO: 5988208 - DNA, 22 bp, Homo sapiens
cactgagttttccatggcagga

SEQ ID NO: 5988209 - DNA, 17 bp, Homo sapiens
cactgataatatgtttg

SEQ ID NO: 5988210 - DNA, 17 bp, Homo sapiens
cactgatacataaaaat

SEQ ID NO: 5988211 - DNA, 16 bp, Homo sapiens
cactgatatatttaaa

SEQ ID NO: 5988212 - DNA, 22 bp, Homo sapiens
cactgatatcacgggcccgctc

SEQ ID NO: 5988213 - DNA, 19 bp, Homo sapiens
cactgatattttacctctt

SEQ ID NO: 5988214 - DNA, 21 bp, Homo sapiens
cactgatgagtttcactgtac

SEQ ID NO: 5988215 - DNA, 22 bp, Homo sapiens
cactgatgcaaggattacagaa

SEQ ID NO: 5988216 - DNA, 19 bp, Homo sapiens
cactgatgctgcccctcat

SEQ ID NO: 5988217 - DNA, 15 bp, Homo sapiens
cactgatggctcaag

SEQ ID NO: 5988218 - DNA, 20 bp, Homo sapiens
cactgatggctcaagacaag

SEQ ID NO: 5988219 - DNA, 20 bp, Homo sapiens
cactgatgggaataaaagta

SEQ ID NO: 5988220 - DNA, 24 bp, Homo sapiens
cactgatgggcaacccccagcctg

SEQ ID NO: 5988221 - DNA, 17 bp, Homo sapiens
cactgatgggctggggc

SEQ ID NO: 5988222 - DNA, 19 bp, Homo sapiens
cactgatgggctggggcag

SEQ ID NO: 5988223 - DNA, 16 bp, Homo sapiens
cactgatgtccctcct

SEQ ID NO: 5988224 - DNA, 17 bp, Homo sapiens
cactgatgtgactttta

SEQ ID NO: 5988225 - DNA, 21 bp, Homo sapiens
cactgattacttttgggaggg

SEQ ID NO: 5988226 - DNA, 14 bp, Homo sapiens
cactgattccctct

SEQ ID NO: 5988227 - DNA, 19 bp, Homo sapiens
cactgatttcacaacagat

SEQ ID NO: 5988228 - DNA, 21 bp, Homo sapiens
cactgatttcacaacagatca

SEQ ID NO: 5988229 - DNA, 14 bp, Homo sapiens
cactgatttggaga

SEQ ID NO: 5988230 - DNA, 15 bp, Homo sapiens
cactgattttgtaaa

SEQ ID NO: 5988231 - DNA, 16 bp, Homo sapiens
cactgattttgtaaag

SEQ ID NO: 5988232 - DNA, 22 bp, Homo sapiens
cactgcaaaaccaggttttgtt

SEQ ID NO: 5988233 - DNA, 17 bp, Homo sapiens
cactgcaaacaataaac

SEQ ID NO: 5988234 - DNA, 21 bp, Homo sapiens
cactgcaaacaataaacatcc

SEQ ID NO: 5988235 - DNA, 16 bp, Homo sapiens
cactgcaaataaagcc

SEQ ID NO: 5988236 - DNA, 18 bp, Homo sapiens
cactgcaaataaagcctt

SEQ ID NO: 5988237 - DNA, 15 bp, Homo sapiens
cactgcaaatctccg

SEQ ID NO: 5988238 - DNA, 20 bp, Homo sapiens
cactgcaacctcacctcccg

SEQ ID NO: 5988239 - DNA, 20 bp, Homo sapiens
cactgcaacctccaactccc

SEQ ID NO: 5988240 - DNA, 21 bp, Homo sapiens
cactgcaacctccacctccca

SEQ ID NO: 5988241 - DNA, 23 bp, Homo sapiens
cactgcaacctccacctcccagg

SEQ ID NO: 5988242 - DNA, 23 bp, Homo sapiens
cactgcaacctccacctccgggt

SEQ ID NO: 5988243 - DNA, 14 bp, Homo sapiens
cactgcaacctccg

SEQ ID NO: 5988244 - DNA, 19 bp, Homo sapiens
cactgcaacctccgcctct

SEQ ID NO: 5988245 - DNA, 15 bp, Homo sapiens
cactgcaacctctgc

SEQ ID NO: 5988246 - DNA, 17 bp, Homo sapiens
cactgcaacctctgcct

SEQ ID NO: 5988247 - DNA, 21 bp, Homo sapiens
cactgcaacctcttcctcctg

SEQ ID NO: 5988248 - DNA, 16 bp, Homo sapiens
caagggtacagatccc

SEQ ID NO: 5988249 - DNA, 22 bp, Homo sapiens
caagggtacagatccccagccc

SEQ ID NO: 5988250 - DNA, 15 bp, Homo sapiens
caagggtagggtctg

SEQ ID NO: 5988251 - DNA, 19 bp, Homo sapiens
caagggtagggtgggcctt

SEQ ID NO: 5988252 - DNA, 18 bp, Homo sapiens
caagggtatgggaagcca

SEQ ID NO: 5988253 - DNA, 19 bp, Homo sapiens
caagggtatgggaagccat

SEQ ID NO: 5988254 - DNA, 11 bp, Homo sapiens
caagggtcagg

SEQ ID NO: 5988255 - DNA, 13 bp, Homo sapiens
caagggtccagaa

SEQ ID NO: 5988256 - DNA, 13 bp, Homo sapiens
caagggtctcctt

SEQ ID NO: 5988257 - DNA, 18 bp, Homo sapiens
caagggtgcttgtggtca

SEQ ID NO: 5988258 - DNA, 17 bp, Homo sapiens
caagggtggcaggtcac

SEQ ID NO: 5988259 - DNA, 19 bp, Homo sapiens
caagggttcagagactcag

SEQ ID NO: 5988260 - DNA, 16 bp, Homo sapiens
caagggttgagagcca

SEQ ID NO: 5988261 - DNA, 15 bp, Homo sapiens
caagggttgcttctg

SEQ ID NO: 5988262 - DNA, 20 bp, Homo sapiens
caagggttggaggcaatgtg

SEQ ID NO: 5988263 - DNA, 17 bp, Homo sapiens
caagggttttccaggtg

SEQ ID NO: 5988264 - DNA, 16 bp, Homo sapiens
caaggtaaaattctaa

SEQ ID NO: 5988265 - DNA, 11 bp, Homo sapiens
caaggtaacaa

SEQ ID NO: 5988266 - DNA, 22 bp, Homo sapiens
caaggtaatttcttgtgcctct

SEQ ID NO: 5988267 - DNA, 18 bp, Homo sapiens
caaggtacagctgtatat

SEQ ID NO: 5988268 - DNA, 17 bp, Homo sapiens
caaggtaccgatttctg

SEQ ID NO: 5988269 - DNA, 13 bp, Homo sapiens
caaggtacctagg

SEQ ID NO: 5988270 - DNA, 14 bp, Homo sapiens
caaggtactctggt

SEQ ID NO: 5988271 - DNA, 16 bp, Homo sapiens
caaggtagccatccca

SEQ ID NO: 5988272 - DNA, 21 bp, Homo sapiens
caaggtagccctggccagagg

SEQ ID NO: 5988273 - DNA, 23 bp, Homo sapiens
caaggtagggtaggcagcctgag

SEQ ID NO: 5988274 - DNA, 14 bp, Homo sapiens
caaggtataataaa

SEQ ID NO: 5988275 - DNA, 20 bp, Homo sapiens
caaggtatacacccagttct

SEQ ID NO: 5988276 - DNA, 16 bp, Homo sapiens
caaggtatacctcagt

SEQ ID NO: 5988277 - DNA, 16 bp, Homo sapiens
caaggtcaaagttctg

SEQ ID NO: 5988278 - DNA, 23 bp, Homo sapiens
caaggtcaatgacacccctggcc

SEQ ID NO: 5988279 - DNA, 14 bp, Homo sapiens
caaggtcaccaaac

SEQ ID NO: 5988280 - DNA, 20 bp, Homo sapiens
caaggtcacctgggctgtga

SEQ ID NO: 5988281 - DNA, 19 bp, Homo sapiens
caaggtcactgtttcctgg

SEQ ID NO: 5988282 - DNA, 20 bp, Homo sapiens
caaggtcacttaaagggtct

SEQ ID NO: 5988283 - DNA, 22 bp, Homo sapiens
caaggtcagggaggggcaacca

SEQ ID NO: 5988284 - DNA, 14 bp, Homo sapiens
caaggtcatgaagg

SEQ ID NO: 5988285 - DNA, 19 bp, Homo sapiens
caaggtcatggccacactg

SEQ ID NO: 5988286 - DNA, 23 bp, Homo sapiens
caaggtcatggccacactgtgac

SEQ ID NO: 5988287 - DNA, 14 bp, Homo sapiens
caaggtcatttttt

SEQ ID NO: 5988288 - DNA, 20 bp, Homo sapiens
caaggtcattttttttaaga

SEQ ID NO: 5988289 - DNA, 21 bp, Homo sapiens
caaggtccactccctgctcca

SEQ ID NO: 5988290 - DNA, 23 bp, Homo sapiens
caaggtccactccctgctccacg

SEQ ID NO: 5988291 - DNA, 14 bp, Homo sapiens
caaggtccccccac

SEQ ID NO: 5988292 - DNA, 15 bp, Homo sapiens
caaggtcccctccac

SEQ ID NO: 5988293 - DNA, 21 bp, Homo sapiens
caaggtctaggtggaggtggg

SEQ ID NO: 5988294 - DNA, 21 bp, Homo sapiens
caaggtctccttactctgagc

SEQ ID NO: 5988295 - DNA, 20 bp, Homo sapiens
caaggtctgagccacagcag

SEQ ID NO: 5988296 - DNA, 21 bp, Homo sapiens
caaggtctgagccacagcagc

SEQ ID NO: 5988297 - DNA, 13 bp, Homo sapiens
caaggtctgcttt

SEQ ID NO: 5988298 - DNA, 14 bp, Homo sapiens
caaggtctgctttt

SEQ ID NO: 5988299 - DNA, 13 bp, Homo sapiens
caaggtctttaaa

SEQ ID NO: 5988300 - DNA, 23 bp, Homo sapiens
caaggtgaaacgactcaaaatga

SEQ ID NO: 5988301 - DNA, 18 bp, Homo sapiens
caaggtgaaatgaagcaa

SEQ ID NO: 5988302 - DNA, 23 bp, Homo sapiens
caaggtgaagcacatacggcaga

SEQ ID NO: 5988303 - DNA, 14 bp, Homo sapiens
caaggtgacagaag

SEQ ID NO: 5988304 - DNA, 16 bp, Homo sapiens
caaggtgagagaggta

SEQ ID NO: 5988305 - DNA, 21 bp, Homo sapiens
caaggtgaggtgaactccagg

SEQ ID NO: 5988306 - DNA, 15 bp, Homo sapiens
caaggtgataggaaa

SEQ ID NO: 5988307 - DNA, 16 bp, Homo sapiens
caaggtgataggaaaa

SEQ ID NO: 5988308 - DNA, 15 bp, Homo sapiens
caaggtgcacagacc

SEQ ID NO: 5988309 - DNA, 21 bp, Homo sapiens
caaggtgcacagacctcagag

SEQ ID NO: 5988310 - DNA, 22 bp, Homo sapiens
caaggtgcacctgccccaggct

SEQ ID NO: 5988311 - DNA, 14 bp, Homo sapiens
caaggtgcaggcag

SEQ ID NO: 5988312 - DNA, 22 bp, Homo sapiens
caaggtgcatatagaaaacaaa

SEQ ID NO: 5988313 - DNA, 21 bp, Homo sapiens
caaggtgccaccaccctgccc

SEQ ID NO: 5988314 - DNA, 21 bp, Homo sapiens
caaggtgcggaccggagcggc

SEQ ID NO: 5988315 - DNA, 11 bp, Homo sapiens
caaggtgctaa

SEQ ID NO: 5988316 - DNA, 13 bp, Homo sapiens
caaggtgctaaca

SEQ ID NO: 5988317 - DNA, 11 bp, Homo sapiens
caaggtgctca

SEQ ID NO: 5988318 - DNA, 13 bp, Homo sapiens
caaggtgctcaga

SEQ ID NO: 5988319 - DNA, 19 bp, Homo sapiens
caaggtgctcttgaacctg

SEQ ID NO: 5988320 - DNA, 23 bp, Homo sapiens
caaggtgctgttgtcattgcttt

SEQ ID NO: 5988321 - DNA, 13 bp, Homo sapiens
caaggtggagtgg

SEQ ID NO: 5988322 - DNA, 12 bp, Homo sapiens
caaggtggcaga

SEQ ID NO: 5988323 - DNA, 23 bp, Homo sapiens
caaggtggcagatgtcttccctg

SEQ ID NO: 5988324 - DNA, 14 bp, Homo sapiens
caaggtggcccgga

SEQ ID NO: 5988325 - DNA, 21 bp, Homo sapiens
caaggtggcctttgtgctgcg

SEQ ID NO: 5988326 - DNA, 19 bp, Homo sapiens
caaggtggctccagcacca

SEQ ID NO: 5988327 - DNA, 21 bp, Homo sapiens
caaggtgggctgagccctggc

SEQ ID NO: 5988328 - DNA, 24 bp, Homo sapiens
caaggtgggctgagccctggcagg

SEQ ID NO: 5988329 - DNA, 19 bp, Homo sapiens
caaggtggggattgcccct

SEQ ID NO: 5988330 - DNA, 21 bp, Homo sapiens
caaggtgggggagcctggagc

SEQ ID NO: 5988331 - DNA, 22 bp, Homo sapiens
caaggtgggggagcctggagcc

SEQ ID NO: 5988332 - DNA, 23 bp, Homo sapiens
caaggtgggggtcaggctacagg

SEQ ID NO: 5988333 - DNA, 20 bp, Homo sapiens
caaggtgggtgattcctccc

SEQ ID NO: 5988334 - DNA, 24 bp, Homo sapiens
caaggtgggtgattcctcccagga

SEQ ID NO: 5988335 - DNA, 17 bp, Homo sapiens
caaggtgggttccaggg

SEQ ID NO: 5988336 - DNA, 20 bp, Homo sapiens
caaggtgggttccagggact

SEQ ID NO: 5988337 - DNA, 17 bp, Homo sapiens
caaggtggtcagtaaat

SEQ ID NO: 5988338 - DNA, 20 bp, Homo sapiens
caaggtggtctgctcgggcc

SEQ ID NO: 5988339 - DNA, 17 bp, Homo sapiens
caaggtggtcttggaga

SEQ ID NO: 5988340 - DNA, 19 bp, Homo sapiens
caaggtggtcttggagagg

SEQ ID NO: 5988341 - DNA, 20 bp, Homo sapiens
caaggtggtcttggagagga

SEQ ID NO: 5988342 - DNA, 21 bp, Homo sapiens
caaggtggtcttggagaggag

SEQ ID NO: 5988343 - DNA, 13 bp, Homo sapiens
caaggtgtccagg

SEQ ID NO: 5988344 - DNA, 13 bp, Homo sapiens
caaggtgtccctg

SEQ ID NO: 5988345 - DNA, 15 bp, Homo sapiens
caaggtgtcctacag

SEQ ID NO: 5988346 - DNA, 18 bp, Homo sapiens
caaggtgtcctacagaaa

SEQ ID NO: 5988347 - DNA, 20 bp, Homo sapiens
caaggtgtcctacagaaaaa

SEQ ID NO: 5988348 - DNA, 15 bp, Homo sapiens
caaggtgtgatggtc

SEQ ID NO: 5988349 - DNA, 15 bp, Homo sapiens
caaggtgtgcagtgg

SEQ ID NO: 5988350 - DNA, 16 bp, Homo sapiens
caaggtgtttctctgt

SEQ ID NO: 5988351 - DNA, 16 bp, Homo sapiens
caaggttactgggagt

SEQ ID NO: 5988352 - DNA, 17 bp, Homo sapiens
caaggttcagtctgaat

SEQ ID NO: 5988353 - DNA, 17 bp, Homo sapiens
caaggttccacagagta

SEQ ID NO: 5988354 - DNA, 18 bp, Homo sapiens
caaggttccacagagtaa

SEQ ID NO: 5988355 - DNA, 21 bp, Homo sapiens
caaggttccagaggccctagg

SEQ ID NO: 5988356 - DNA, 19 bp, Homo sapiens
caaggttccctctgagaat

SEQ ID NO: 5988357 - DNA, 21 bp, Homo sapiens
caaggttctgggtgcaggagc

SEQ ID NO: 5988358 - DNA, 15 bp, Homo sapiens
caaggttcttctaaa

SEQ ID NO: 5988359 - DNA, 14 bp, Homo sapiens
caaggttgcacagc

SEQ ID NO: 5988360 - DNA, 22 bp, Homo sapiens
caaggttggcaccccagctacc

SEQ ID NO: 5988361 - DNA, 16 bp, Homo sapiens
caaggttggttgctaa

SEQ ID NO: 5988362 - DNA, 22 bp, Homo sapiens
caaggtttaaagagtctagatt

SEQ ID NO: 5988363 - DNA, 17 bp, Homo sapiens
caaggtttaagttatta

SEQ ID NO: 5988364 - DNA, 13 bp, Homo sapiens
caaggtttataaa

SEQ ID NO: 5988365 - DNA, 16 bp, Homo sapiens
caaggtttataaagca

SEQ ID NO: 5988366 - DNA, 17 bp, Homo sapiens
caaggtttataaagcag

SEQ ID NO: 5988367 - DNA, 22 bp, Homo sapiens
caaggtttataaagcagattac

SEQ ID NO: 5988368 - DNA, 16 bp, Homo sapiens
caaggtttgagtccct

SEQ ID NO: 5988369 - DNA, 18 bp, Homo sapiens
caaggtttgagtccctcc

SEQ ID NO: 5988370 - DNA, 13 bp, Homo sapiens
caaggttttaggt

SEQ ID NO: 5988371 - DNA, 18 bp, Homo sapiens
caaggttttaggttctaa

SEQ ID NO: 5988372 - DNA, 20 bp, Homo sapiens
caaggttttaggttctaaag

SEQ ID NO: 5988373 - DNA, 18 bp, Homo sapiens
caagtaaaacaaatgaaa

SEQ ID NO: 5988374 - DNA, 15 bp, Homo sapiens
caagtaaaagaaaag

SEQ ID NO: 5988375 - DNA, 13 bp, Homo sapiens
caagtaaaatatt

SEQ ID NO: 5988376 - DNA, 13 bp, Homo sapiens
caagtaaacattc

SEQ ID NO: 5988377 - DNA, 17 bp, Homo sapiens
caagtaaatctatctct

SEQ ID NO: 5988378 - DNA, 21 bp, Homo sapiens
caagtaaatttgtataaataa

SEQ ID NO: 5988379 - DNA, 17 bp, Homo sapiens
caagtaacaaaaataaa

SEQ ID NO: 5988380 - DNA, 12 bp, Homo sapiens
caagtaacactt

SEQ ID NO: 5988381 - DNA, 13 bp, Homo sapiens
caagtaacacttt

SEQ ID NO: 5988382 - DNA, 15 bp, Homo sapiens
caagtaagaaataat

SEQ ID NO: 5988383 - DNA, 17 bp, Homo sapiens
caagtaagacatctcaa

SEQ ID NO: 5988384 - DNA, 21 bp, Homo sapiens
caagtaagagactcagcctgc

SEQ ID NO: 5988385 - DNA, 16 bp, Homo sapiens
caagtaagaggctgga

SEQ ID NO: 5988386 - DNA, 17 bp, Homo sapiens
caagtaagagtggtggc

SEQ ID NO: 5988387 - DNA, 15 bp, Homo sapiens
caagtaaggctttta

SEQ ID NO: 5988388 - DNA, 16 bp, Homo sapiens
caagtaataaaacaat

SEQ ID NO: 5988389 - DNA, 15 bp, Homo sapiens
caagtaatacaaact

SEQ ID NO: 5988390 - DNA, 17 bp, Homo sapiens
caagtaatcctgcacag

SEQ ID NO: 5988391 - DNA, 15 bp, Homo sapiens
caagtaatgaatttt

SEQ ID NO: 5988392 - DNA, 23 bp, Homo sapiens
caagtaatggaggtcccagccct

SEQ ID NO: 5988393 - DNA, 23 bp, Homo sapiens
caagtaattgtgaaaaagttaaa

SEQ ID NO: 5988394 - DNA, 14 bp, Homo sapiens
caagtaatttcagt

SEQ ID NO: 5988395 - DNA, 18 bp, Homo sapiens
caagtaattttcatatta

SEQ ID NO: 5988396 - DNA, 24 bp, Homo sapiens
caagtacaaccacacccacactca

SEQ ID NO: 5988397 - DNA, 18 bp, Homo sapiens
caagtaccaatgctgttg

SEQ ID NO: 5988398 - DNA, 14 bp, Homo sapiens
caagtaccaccaag

SEQ ID NO: 5988399 - DNA, 15 bp, Homo sapiens
caagtactacatttt

SEQ ID NO: 5988400 - DNA, 13 bp, Homo sapiens
caagtactgctgt

SEQ ID NO: 5988401 - DNA, 21 bp, Homo sapiens
caagtacttaactatctgttc

SEQ ID NO: 5988402 - DNA, 16 bp, Homo sapiens
caagtagaatctcagt

SEQ ID NO: 5988403 - DNA, 17 bp, Homo sapiens
caagtagactactgttc

SEQ ID NO: 5988404 - DNA, 17 bp, Homo sapiens
caagtagagatgaagtt

SEQ ID NO: 5988405 - DNA, 13 bp, Homo sapiens
caagtagataaat

SEQ ID NO: 5988406 - DNA, 17 bp, Homo sapiens
caagtagataaatattt

SEQ ID NO: 5988407 - DNA, 20 bp, Homo sapiens
caagtagatcatggcagcat

SEQ ID NO: 5988408 - DNA, 18 bp, Homo sapiens
caagtagatgcctgaact

SEQ ID NO: 5988409 - DNA, 20 bp, Homo sapiens
caagtagatgcctgaacttg

SEQ ID NO: 5988410 - DNA, 21 bp, Homo sapiens
caagtagattgatctaaggca

SEQ ID NO: 5988411 - DNA, 16 bp, Homo sapiens
caagtagcacatggtt

SEQ ID NO: 5988412 - DNA, 14 bp, Homo sapiens
caagtagctggctg

SEQ ID NO: 5988413 - DNA, 16 bp, Homo sapiens
caagtagctggctgta

SEQ ID NO: 5988414 - DNA, 21 bp, Homo sapiens
caagtagctgggaccacaggc

SEQ ID NO: 5988415 - DNA, 14 bp, Homo sapiens
caagtagctgggat

SEQ ID NO: 5988416 - DNA, 19 bp, Homo sapiens
caagtagctgggattttaa

SEQ ID NO: 5988417 - DNA, 13 bp, Homo sapiens
caagtaggagaca

SEQ ID NO: 5988418 - DNA, 21 bp, Homo sapiens
caagtagggtttagccgggcc

SEQ ID NO: 5988419 - DNA, 14 bp, Homo sapiens
caagtataaacttt

SEQ ID NO: 5988420 - DNA, 12 bp, Homo sapiens
caagtataatta

SEQ ID NO: 5988421 - DNA, 13 bp, Homo sapiens
caagtatagaaaa

SEQ ID NO: 5988422 - DNA, 19 bp, Homo sapiens
caagtatagaaaatcttca

SEQ ID NO: 5988423 - DNA, 13 bp, Homo sapiens
caagtatataaag

SEQ ID NO: 5988424 - DNA, 15 bp, Homo sapiens
caagtatataaagtt

SEQ ID NO: 5988425 - DNA, 20 bp, Homo sapiens
caagtatataatatgtcacc

SEQ ID NO: 5988426 - DNA, 23 bp, Homo sapiens
cactgcaacctcttcctcctggt

SEQ ID NO: 5988427 - DNA, 17 bp, Homo sapiens
cactgcaacttctgcct

SEQ ID NO: 5988428 - DNA, 17 bp, Homo sapiens
cactgcaacttgtgaac

SEQ ID NO: 5988429 - DNA, 13 bp, Homo sapiens
cactgcaagagcc

SEQ ID NO: 5988430 - DNA, 15 bp, Homo sapiens
cactgcaagagcctt

SEQ ID NO: 5988431 - DNA, 16 bp, Homo sapiens
cactgcaagagccttg

SEQ ID NO: 5988432 - DNA, 16 bp, Homo sapiens
cactgcaagctctgcc

SEQ ID NO: 5988433 - DNA, 20 bp, Homo sapiens
cactgcaagctctgcctccc

SEQ ID NO: 5988434 - DNA, 22 bp, Homo sapiens
cactgcaagtccttttgtaaag

SEQ ID NO: 5988435 - DNA, 18 bp, Homo sapiens
cactgcaatcatatgtga

SEQ ID NO: 5988436 - DNA, 23 bp, Homo sapiens
cactgcacaataactcctcccag

SEQ ID NO: 5988437 - DNA, 22 bp, Homo sapiens
cactgcacacacctcagaggct

SEQ ID NO: 5988438 - DNA, 23 bp, Homo sapiens
cactgcacagaagacagcagcaa

SEQ ID NO: 5988439 - DNA, 16 bp, Homo sapiens
cactgcacagagctct

SEQ ID NO: 5988440 - DNA, 18 bp, Homo sapiens
cactgcacataatttgca

SEQ ID NO: 5988441 - DNA, 13 bp, Homo sapiens
cactgcacatctt

SEQ ID NO: 5988442 - DNA, 19 bp, Homo sapiens
cactgcacccccctgtgcc

SEQ ID NO: 5988443 - DNA, 21 bp, Homo sapiens
cactgcacccccctgtgcctg

SEQ ID NO: 5988444 - DNA, 24 bp, Homo sapiens
cactgcacccccctgtgcctgctg

SEQ ID NO: 5988445 - DNA, 15 bp, Homo sapiens
cactgcaccccctcc

SEQ ID NO: 5988446 - DNA, 18 bp, Homo sapiens
cactgcaccccctcctgc

SEQ ID NO: 5988447 - DNA, 21 bp, Homo sapiens
cactgcaccctccacaggagc

SEQ ID NO: 5988448 - DNA, 18 bp, Homo sapiens
cactgcaccgcctcaggg

SEQ ID NO: 5988449 - DNA, 14 bp, Homo sapiens
cactgcaccgggcc

SEQ ID NO: 5988450 - DNA, 15 bp, Homo sapiens
cactgcaccgggcca

SEQ ID NO: 5988451 - DNA, 16 bp, Homo sapiens
cactgcaccgggccac

SEQ ID NO: 5988452 - DNA, 16 bp, Homo sapiens
cactgcacctgcccag

SEQ ID NO: 5988453 - DNA, 20 bp, Homo sapiens
cactgcacctgcccagctcc

SEQ ID NO: 5988454 - DNA, 17 bp, Homo sapiens
cactgcacgttttcatc

SEQ ID NO: 5988455 - DNA, 18 bp, Homo sapiens
cactgcactatagcctag

SEQ ID NO: 5988456 - DNA, 19 bp, Homo sapiens
cactgcactatagcctagg

SEQ ID NO: 5988457 - DNA, 13 bp, Homo sapiens
cactgcactccag

SEQ ID NO: 5988458 - DNA, 16 bp, Homo sapiens
cactgcactccagcct

SEQ ID NO: 5988459 - DNA, 24 bp, Homo sapiens
cactgcactccagcctgagtgaca

SEQ ID NO: 5988460 - DNA, 18 bp, Homo sapiens
cactgcactccagcctgg

SEQ ID NO: 5988461 - DNA, 20 bp, Homo sapiens
cactgcactccagcctgggc

SEQ ID NO: 5988462 - DNA, 15 bp, Homo sapiens
cactgcactccaggc

SEQ ID NO: 5988463 - DNA, 18 bp, Homo sapiens
cactgcactctagccgga

SEQ ID NO: 5988464 - DNA, 14 bp, Homo sapiens
cactgcactgttca

SEQ ID NO: 5988465 - DNA, 21 bp, Homo sapiens
cactgcactttccaatgccac

SEQ ID NO: 5988466 - DNA, 13 bp, Homo sapiens
cactgcactttgt

SEQ ID NO: 5988467 - DNA, 20 bp, Homo sapiens
cactgcactttgtttagaaa

SEQ ID NO: 5988468 - DNA, 17 bp, Homo sapiens
cactgcagaaaccttta

SEQ ID NO: 5988469 - DNA, 21 bp, Homo sapiens
cactgcagaagacagtatggc

SEQ ID NO: 5988470 - DNA, 19 bp, Homo sapiens
cactgcagagatggtggtg

SEQ ID NO: 5988471 - DNA, 22 bp, Homo sapiens
cactgcagatagccagacacat

SEQ ID NO: 5988472 - DNA, 13 bp, Homo sapiens
cactgcagcacag

SEQ ID NO: 5988473 - DNA, 17 bp, Homo sapiens
cactgcagcagaaaggc

SEQ ID NO: 5988474 - DNA, 12 bp, Homo sapiens
cactgcagccca

SEQ ID NO: 5988475 - DNA, 21 bp, Homo sapiens
cactgcagcctcatactcctg

SEQ ID NO: 5988476 - DNA, 22 bp, Homo sapiens
cactgcagcctccgcttccctg

SEQ ID NO: 5988477 - DNA, 13 bp, Homo sapiens
cactgcagcctcg

SEQ ID NO: 5988478 - DNA, 14 bp, Homo sapiens
cactgcagcctttc

SEQ ID NO: 5988479 - DNA, 18 bp, Homo sapiens
cactgcagcgcgctcctg

SEQ ID NO: 5988480 - DNA, 16 bp, Homo sapiens
cactgcaggccccgct

SEQ ID NO: 5988481 - DNA, 15 bp, Homo sapiens
cactgcagggaggag

SEQ ID NO: 5988482 - DNA, 17 bp, Homo sapiens
cactgcaggtggcctcc

SEQ ID NO: 5988483 - DNA, 22 bp, Homo sapiens
cactgcaggtggcctccctcca

SEQ ID NO: 5988484 - DNA, 23 bp, Homo sapiens
cactgcaggtggcctccctccag

SEQ ID NO: 5988485 - DNA, 22 bp, Homo sapiens
cactgcagtcacccctgtctgc

SEQ ID NO: 5988486 - DNA, 16 bp, Homo sapiens
cactgcagtcttattt

SEQ ID NO: 5988487 - DNA, 18 bp, Homo sapiens
cactgcagtcttatttcc

SEQ ID NO: 5988488 - DNA, 15 bp, Homo sapiens
cactgcagtgatggc

SEQ ID NO: 5988489 - DNA, 15 bp, Homo sapiens
cactgcagttattta

SEQ ID NO: 5988490 - DNA, 12 bp, Homo sapiens
cactgcatccta

SEQ ID NO: 5988491 - DNA, 22 bp, Homo sapiens
cactgcatctttctcttcccat

SEQ ID NO: 5988492 - DNA, 17 bp, Homo sapiens
cactgcattatcttgct

SEQ ID NO: 5988493 - DNA, 19 bp, Homo sapiens
cactgcattattctctttt

SEQ ID NO: 5988494 - DNA, 16 bp, Homo sapiens
cactgcattcctgtgc

SEQ ID NO: 5988495 - DNA, 18 bp, Homo sapiens
cactgcattcctgtgccc

SEQ ID NO: 5988496 - DNA, 19 bp, Homo sapiens
cactgcatttgcctgcttc

SEQ ID NO: 5988497 - DNA, 14 bp, Homo sapiens
cactgccaacccct

SEQ ID NO: 5988498 - DNA, 17 bp, Homo sapiens
cactgccaagagccgac

SEQ ID NO: 5988499 - DNA, 21 bp, Homo sapiens
cactgccaagccaaccctgga

SEQ ID NO: 5988500 - DNA, 15 bp, Homo sapiens
cactgccaagcttcc

SEQ ID NO: 5988501 - DNA, 18 bp, Homo sapiens
cactgccaagcttcctgt

SEQ ID NO: 5988502 - DNA, 16 bp, Homo sapiens
cactgccaatgctgta

SEQ ID NO: 5988503 - DNA, 15 bp, Homo sapiens
cactgccacaccctc

SEQ ID NO: 5988504 - DNA, 22 bp, Homo sapiens
cactgccaccagcaatgccctg

SEQ ID NO: 5988505 - DNA, 17 bp, Homo sapiens
cactgccactccagtcc

SEQ ID NO: 5988506 - DNA, 18 bp, Homo sapiens
cactgccactccagtcct

SEQ ID NO: 5988507 - DNA, 20 bp, Homo sapiens
cactgccactccagtcctgc

SEQ ID NO: 5988508 - DNA, 19 bp, Homo sapiens
cactgccactttgcacatt

SEQ ID NO: 5988509 - DNA, 22 bp, Homo sapiens
cactgccactttgcacattttg

SEQ ID NO: 5988510 - DNA, 22 bp, Homo sapiens
cactgccagaagagaattcagt

SEQ ID NO: 5988511 - DNA, 20 bp, Homo sapiens
cactgccagaagtgtgtttt

SEQ ID NO: 5988512 - DNA, 12 bp, Homo sapiens
cactgccagagc

SEQ ID NO: 5988513 - DNA, 14 bp, Homo sapiens
cactgccagagcta

SEQ ID NO: 5988514 - DNA, 20 bp, Homo sapiens
cactgccagcagcagcaggt

SEQ ID NO: 5988515 - DNA, 15 bp, Homo sapiens
cactgccagcagctg

SEQ ID NO: 5988516 - DNA, 12 bp, Homo sapiens
cactgccagccg

SEQ ID NO: 5988517 - DNA, 22 bp, Homo sapiens
cactgccaggagggacaaagga

SEQ ID NO: 5988518 - DNA, 18 bp, Homo sapiens
cactgccaggcacctggc

SEQ ID NO: 5988519 - DNA, 13 bp, Homo sapiens
cactgccaggcca

SEQ ID NO: 5988520 - DNA, 14 bp, Homo sapiens
cactgccaggccag

SEQ ID NO: 5988521 - DNA, 21 bp, Homo sapiens
cactgccaggccagcctccga

SEQ ID NO: 5988522 - DNA, 17 bp, Homo sapiens
cactgccataacttgtt

SEQ ID NO: 5988523 - DNA, 20 bp, Homo sapiens
cactgccatattgtgtaatt

SEQ ID NO: 5988524 - DNA, 20 bp, Homo sapiens
cactgccatcaaactgtaaa

SEQ ID NO: 5988525 - DNA, 16 bp, Homo sapiens
cactgccatcttagtt

SEQ ID NO: 5988526 - DNA, 21 bp, Homo sapiens
cactgccatgatagctggggc

SEQ ID NO: 5988527 - DNA, 22 bp, Homo sapiens
cactgccatgcaccaggactgg

SEQ ID NO: 5988528 - DNA, 19 bp, Homo sapiens
cactgccatgcagggcctc

SEQ ID NO: 5988529 - DNA, 15 bp, Homo sapiens
cactgccatgtcagg

SEQ ID NO: 5988530 - DNA, 20 bp, Homo sapiens
cactgccatttcctcctggg

SEQ ID NO: 5988531 - DNA, 19 bp, Homo sapiens
cactgcccacatgggacct

SEQ ID NO: 5988532 - DNA, 14 bp, Homo sapiens
cactgcccaccaaa

SEQ ID NO: 5988533 - DNA, 15 bp, Homo sapiens
cactgcccaccccct

SEQ ID NO: 5988534 - DNA, 13 bp, Homo sapiens
cactgcccatccc

SEQ ID NO: 5988535 - DNA, 14 bp, Homo sapiens
cactgcccatccca

SEQ ID NO: 5988536 - DNA, 14 bp, Homo sapiens
cactgccccacatg

SEQ ID NO: 5988537 - DNA, 15 bp, Homo sapiens
cactgccccaccagc

SEQ ID NO: 5988538 - DNA, 21 bp, Homo sapiens
cactgcccccagctcttctcc

SEQ ID NO: 5988539 - DNA, 14 bp, Homo sapiens
cactgccccccgag

SEQ ID NO: 5988540 - DNA, 21 bp, Homo sapiens
cactgccccccgaggctgcta

SEQ ID NO: 5988541 - DNA, 17 bp, Homo sapiens
cactgccccctgcttgg

SEQ ID NO: 5988542 - DNA, 20 bp, Homo sapiens
cactgccccgtgtgaatgta

SEQ ID NO: 5988543 - DNA, 21 bp, Homo sapiens
cactgccccgtgtgaatgtag

SEQ ID NO: 5988544 - DNA, 18 bp, Homo sapiens
cactgcccgagctggtgc

SEQ ID NO: 5988545 - DNA, 16 bp, Homo sapiens
cactgccctccagggc

SEQ ID NO: 5988546 - DNA, 17 bp, Homo sapiens
cactgccctccagggcc

SEQ ID NO: 5988547 - DNA, 21 bp, Homo sapiens
cactgccctccagggccagga

SEQ ID NO: 5988548 - DNA, 14 bp, Homo sapiens
cactgccctccgcc

SEQ ID NO: 5988549 - DNA, 21 bp, Homo sapiens
cactgccctccgcccttccct

SEQ ID NO: 5988550 - DNA, 15 bp, Homo sapiens
cactgccctctccac

SEQ ID NO: 5988551 - DNA, 18 bp, Homo sapiens
cactgccctctccacacc

SEQ ID NO: 5988552 - DNA, 21 bp, Homo sapiens
cactgccctctccacacccat

SEQ ID NO: 5988553 - DNA, 12 bp, Homo sapiens
cactgccctgcc

SEQ ID NO: 5988554 - DNA, 20 bp, Homo sapiens
cactgccctgcctgcccact

SEQ ID NO: 5988555 - DNA, 13 bp, Homo sapiens
cactgccctggca

SEQ ID NO: 5988556 - DNA, 13 bp, Homo sapiens
cactgcccttctc

SEQ ID NO: 5988557 - DNA, 18 bp, Homo sapiens
cactgccgacatcagcat

SEQ ID NO: 5988558 - DNA, 22 bp, Homo sapiens
cactgccgacatccctccccca

SEQ ID NO: 5988559 - DNA, 14 bp, Homo sapiens
cactgccgcctcct

SEQ ID NO: 5988560 - DNA, 12 bp, Homo sapiens
cactgccgctgc

SEQ ID NO: 5988561 - DNA, 19 bp, Homo sapiens
cactgcctaaaattttaga

SEQ ID NO: 5988562 - DNA, 22 bp, Homo sapiens
cactgcctaggaggctggccaa

SEQ ID NO: 5988563 - DNA, 21 bp, Homo sapiens
cactgcctagtcgggacttgt

SEQ ID NO: 5988564 - DNA, 13 bp, Homo sapiens
cactgcctcaggt

SEQ ID NO: 5988565 - DNA, 14 bp, Homo sapiens
cactgcctcaggtt

SEQ ID NO: 5988566 - DNA, 15 bp, Homo sapiens
cactgcctcctccct

SEQ ID NO: 5988567 - DNA, 22 bp, Homo sapiens
cactgcctcctccctggctgca

SEQ ID NO: 5988568 - DNA, 23 bp, Homo sapiens
cactgcctcctccctggctgcag

SEQ ID NO: 5988569 - DNA, 10 bp, Homo sapiens
cactgcctct

SEQ ID NO: 5988570 - DNA, 16 bp, Homo sapiens
cactgcctctatgccc

SEQ ID NO: 5988571 - DNA, 20 bp, Homo sapiens
cactgcctctatgccctgca

SEQ ID NO: 5988572 - DNA, 14 bp, Homo sapiens
cactgcctctccct

SEQ ID NO: 5988573 - DNA, 22 bp, Homo sapiens
cactgcctctcggtgacctccg

SEQ ID NO: 5988574 - DNA, 12 bp, Homo sapiens
cactgcctctgc

SEQ ID NO: 5988575 - DNA, 23 bp, Homo sapiens
cactgcctctgccttagaggagc

SEQ ID NO: 5988576 - DNA, 16 bp, Homo sapiens
cactgcctcttcctcc

SEQ ID NO: 5988577 - DNA, 14 bp, Homo sapiens
cactgcctgacatt

SEQ ID NO: 5988578 - DNA, 13 bp, Homo sapiens
cactgcctgcaga

SEQ ID NO: 5988579 - DNA, 23 bp, Homo sapiens
cactgcctgcagctgagattcca

SEQ ID NO: 5988580 - DNA, 12 bp, Homo sapiens
cactgcctgcca

SEQ ID NO: 5988581 - DNA, 13 bp, Homo sapiens
cactgcctgccaa

SEQ ID NO: 5988582 - DNA, 14 bp, Homo sapiens
cactgcctgcccac

SEQ ID NO: 5988583 - DNA, 15 bp, Homo sapiens
cactgcctgcccacc

SEQ ID NO: 5988584 - DNA, 14 bp, Homo sapiens
cactgcctgcctcc

SEQ ID NO: 5988585 - DNA, 14 bp, Homo sapiens
cactgcctgcctta

SEQ ID NO: 5988586 - DNA, 13 bp, Homo sapiens
cactgcctgctcc

SEQ ID NO: 5988587 - DNA, 17 bp, Homo sapiens
cactgcctggaggatag

SEQ ID NO: 5988588 - DNA, 15 bp, Homo sapiens
cactgcctgggctga

SEQ ID NO: 5988589 - DNA, 19 bp, Homo sapiens
cactgcctgggctgacccc

SEQ ID NO: 5988590 - DNA, 16 bp, Homo sapiens
cactgcctgtatactt

SEQ ID NO: 5988591 - DNA, 23 bp, Homo sapiens
cactgcctgtatactttagtatg

SEQ ID NO: 5988592 - DNA, 18 bp, Homo sapiens
cactgccttaccttcact

SEQ ID NO: 5988593 - DNA, 17 bp, Homo sapiens
cactgccttattacata

SEQ ID NO: 5988594 - DNA, 14 bp, Homo sapiens
cactgccttggccc

SEQ ID NO: 5988595 - DNA, 21 bp, Homo sapiens
cactgccttggcccctccctc

SEQ ID NO: 5988596 - DNA, 14 bp, Homo sapiens
cactgcctttgctg

SEQ ID NO: 5988597 - DNA, 21 bp, Homo sapiens
cactgcctttgctgccttctg

SEQ ID NO: 5988598 - DNA, 22 bp, Homo sapiens
cactgcgaagaccctcttgccc

SEQ ID NO: 5988599 - DNA, 16 bp, Homo sapiens
cactgcgcaggtctct

SEQ ID NO: 5988600 - DNA, 20 bp, Homo sapiens
cactgcgcaggtctcttctg

SEQ ID NO: 5988601 - DNA, 22 bp, Homo sapiens
cactgcgcaggtctcttctggg

SEQ ID NO: 5988602 - DNA, 16 bp, Homo sapiens
cactgcgccacctgct

SEQ ID NO: 5988603 - DNA, 12 bp, Homo sapiens
cactgcgccccg

SEQ ID NO: 5988604 - DNA, 23 bp, Homo sapiens
caagtatatacttttaaattatg

SEQ ID NO: 5988605 - DNA, 20 bp, Homo sapiens
caagtatcatctaaatatta

SEQ ID NO: 5988606 - DNA, 21 bp, Homo sapiens
caagtatcatctaaatattat

SEQ ID NO: 5988607 - DNA, 16 bp, Homo sapiens
caagtatccaattcag

SEQ ID NO: 5988608 - DNA, 14 bp, Homo sapiens
caagtatctaactc

SEQ ID NO: 5988609 - DNA, 19 bp, Homo sapiens
caagtatctaactcttctg

SEQ ID NO: 5988610 - DNA, 15 bp, Homo sapiens
caagtatcttctatt

SEQ ID NO: 5988611 - DNA, 15 bp, Homo sapiens
caagtatgccttaag

SEQ ID NO: 5988612 - DNA, 20 bp, Homo sapiens
caagtatgccttaagcagaa

SEQ ID NO: 5988613 - DNA, 22 bp, Homo sapiens
caagtatgccttaagcagaaca

SEQ ID NO: 5988614 - DNA, 23 bp, Homo sapiens
caagtatgccttaagcagaacaa

SEQ ID NO: 5988615 - DNA, 20 bp, Homo sapiens
caagtatggtaggggagggc

SEQ ID NO: 5988616 - DNA, 18 bp, Homo sapiens
caagtattaagcagttca

SEQ ID NO: 5988617 - DNA, 17 bp, Homo sapiens
caagtattactaaattg

SEQ ID NO: 5988618 - DNA, 19 bp, Homo sapiens
caagtattactaaattgac

SEQ ID NO: 5988619 - DNA, 20 bp, Homo sapiens
caagtattaggggtaatata

SEQ ID NO: 5988620 - DNA, 17 bp, Homo sapiens
caagtattatattttat

SEQ ID NO: 5988621 - DNA, 18 bp, Homo sapiens
caagtattatattttatt

SEQ ID NO: 5988622 - DNA, 13 bp, Homo sapiens
caagtattcagtt

SEQ ID NO: 5988623 - DNA, 24 bp, Homo sapiens
caagtattcagttccaatacttca

SEQ ID NO: 5988624 - DNA, 14 bp, Homo sapiens
caagtattctgcct

SEQ ID NO: 5988625 - DNA, 15 bp, Homo sapiens
caagtattctgcctt

SEQ ID NO: 5988626 - DNA, 19 bp, Homo sapiens
caagtattgttaatgaata

SEQ ID NO: 5988627 - DNA, 15 bp, Homo sapiens
caagtatttggctat

SEQ ID NO: 5988628 - DNA, 19 bp, Homo sapiens
caagtatttgggaagtgaa

SEQ ID NO: 5988629 - DNA, 16 bp, Homo sapiens
caagtatttttaatta

SEQ ID NO: 5988630 - DNA, 23 bp, Homo sapiens
caagtcaaaatatttttaaaaga

SEQ ID NO: 5988631 - DNA, 19 bp, Homo sapiens
caagtcaaacagtgtggct

SEQ ID NO: 5988632 - DNA, 14 bp, Homo sapiens
caagtcaaattaat

SEQ ID NO: 5988633 - DNA, 16 bp, Homo sapiens
caagtcaaattaataa

SEQ ID NO: 5988634 - DNA, 17 bp, Homo sapiens
caagtcaacactcttct

SEQ ID NO: 5988635 - DNA, 17 bp, Homo sapiens
caagtcaagtgaaaaag

SEQ ID NO: 5988636 - DNA, 12 bp, Homo sapiens
caagtcacaaag

SEQ ID NO: 5988637 - DNA, 16 bp, Homo sapiens
caagtcacaaaggaat

SEQ ID NO: 5988638 - DNA, 19 bp, Homo sapiens
caagtcacaaaggaatgga

SEQ ID NO: 5988639 - DNA, 13 bp, Homo sapiens
caagtcacacagc

SEQ ID NO: 5988640 - DNA, 13 bp, Homo sapiens
caagtcacagctg

SEQ ID NO: 5988641 - DNA, 17 bp, Homo sapiens
caagtcacagctgcagc

SEQ ID NO: 5988642 - DNA, 18 bp, Homo sapiens
caagtcacatgcgtaaac

SEQ ID NO: 5988643 - DNA, 12 bp, Homo sapiens
caagtcactaaa

SEQ ID NO: 5988644 - DNA, 17 bp, Homo sapiens
caagtcactagaagtcc

SEQ ID NO: 5988645 - DNA, 22 bp, Homo sapiens
caagtcactagaagtcctgctg

SEQ ID NO: 5988646 - DNA, 22 bp, Homo sapiens
caagtcagaggatggccagtgt

SEQ ID NO: 5988647 - DNA, 23 bp, Homo sapiens
caagtcagaggatggccagtgtc

SEQ ID NO: 5988648 - DNA, 19 bp, Homo sapiens
caagtcaggcccttatttt

SEQ ID NO: 5988649 - DNA, 13 bp, Homo sapiens
caagtcagtttct

SEQ ID NO: 5988650 - DNA, 20 bp, Homo sapiens
caagtcatagccataaatga

SEQ ID NO: 5988651 - DNA, 20 bp, Homo sapiens
caagtcatggagaatctgct

SEQ ID NO: 5988652 - DNA, 19 bp, Homo sapiens
caagtcatgggagaagagg

SEQ ID NO: 5988653 - DNA, 18 bp, Homo sapiens
caagtcatggtcacagta

SEQ ID NO: 5988654 - DNA, 14 bp, Homo sapiens
caagtcatgtaaat

SEQ ID NO: 5988655 - DNA, 18 bp, Homo sapiens
caagtcatttcaaaatat

SEQ ID NO: 5988656 - DNA, 12 bp, Homo sapiens
caagtcatttta

SEQ ID NO: 5988657 - DNA, 12 bp, Homo sapiens
caagtcattttt

SEQ ID NO: 5988658 - DNA, 17 bp, Homo sapiens
caagtcatttttgtatt

SEQ ID NO: 5988659 - DNA, 17 bp, Homo sapiens
caagtccacagtggaac

SEQ ID NO: 5988660 - DNA, 21 bp, Homo sapiens
caagtccaccccaattaactg

SEQ ID NO: 5988661 - DNA, 21 bp, Homo sapiens
caagtccagatttacactggg

SEQ ID NO: 5988662 - DNA, 22 bp, Homo sapiens
caagtccagctgggaagccctt

SEQ ID NO: 5988663 - DNA, 22 bp, Homo sapiens
caagtccatgttattctctcac

SEQ ID NO: 5988664 - DNA, 13 bp, Homo sapiens
caagtcccaccct

SEQ ID NO: 5988665 - DNA, 22 bp, Homo sapiens
caagtcccaccggttgcttctg

SEQ ID NO: 5988666 - DNA, 23 bp, Homo sapiens
caagtcccaccggttgcttctgg

SEQ ID NO: 5988667 - DNA, 19 bp, Homo sapiens
caagtcccagggagctctg

SEQ ID NO: 5988668 - DNA, 14 bp, Homo sapiens
caagtccccaagat

SEQ ID NO: 5988669 - DNA, 22 bp, Homo sapiens
caagtccccagcccctcaaccc

SEQ ID NO: 5988670 - DNA, 13 bp, Homo sapiens
caagtcccccagc

SEQ ID NO: 5988671 - DNA, 17 bp, Homo sapiens
caagtcccgaggcagca

SEQ ID NO: 5988672 - DNA, 18 bp, Homo sapiens
caagtccctgactctctg

SEQ ID NO: 5988673 - DNA, 23 bp, Homo sapiens
caagtccctgactctctgtgacc

SEQ ID NO: 5988674 - DNA, 20 bp, Homo sapiens
caagtccctgtaattgttgt

SEQ ID NO: 5988675 - DNA, 19 bp, Homo sapiens
caagtccctgttttctgag

SEQ ID NO: 5988676 - DNA, 17 bp, Homo sapiens
caagtcccttgttttgt

SEQ ID NO: 5988677 - DNA, 16 bp, Homo sapiens
caagtccgcagaagcc

SEQ ID NO: 5988678 - DNA, 19 bp, Homo sapiens
caagtcctatcctaaataa

SEQ ID NO: 5988679 - DNA, 15 bp, Homo sapiens
caagtcctccctctc

SEQ ID NO: 5988680 - DNA, 15 bp, Homo sapiens
caagtcctcctagaa

SEQ ID NO: 5988681 - DNA, 16 bp, Homo sapiens
caagtcctcgcccccc

SEQ ID NO: 5988682 - DNA, 21 bp, Homo sapiens
caagtcctcgccccccgcccg

SEQ ID NO: 5988683 - DNA, 14 bp, Homo sapiens
caagtcctgcagtc

SEQ ID NO: 5988684 - DNA, 14 bp, Homo sapiens
caagtcctgccttt

SEQ ID NO: 5988685 - DNA, 19 bp, Homo sapiens
caagtcctgctcctttctg

SEQ ID NO: 5988686 - DNA, 17 bp, Homo sapiens
caagtcctggctacatc

SEQ ID NO: 5988687 - DNA, 22 bp, Homo sapiens
caagtcctggctacatcccagc

SEQ ID NO: 5988688 - DNA, 15 bp, Homo sapiens
caagtcctgtgaatt

SEQ ID NO: 5988689 - DNA, 18 bp, Homo sapiens
caagtcctgtgaatttct

SEQ ID NO: 5988690 - DNA, 22 bp, Homo sapiens
caagtccttacctcttccggag

SEQ ID NO: 5988691 - DNA, 23 bp, Homo sapiens
caagtccttacctcttccggaga

SEQ ID NO: 5988692 - DNA, 18 bp, Homo sapiens
caagtccttgacctctat

SEQ ID NO: 5988693 - DNA, 21 bp, Homo sapiens
caagtccttgacctctataaa

SEQ ID NO: 5988694 - DNA, 24 bp, Homo sapiens
caagtcctttatctgcacctagaa

SEQ ID NO: 5988695 - DNA, 15 bp, Homo sapiens
caagtctacagagtg

SEQ ID NO: 5988696 - DNA, 16 bp, Homo sapiens
caagtctagctttcct

SEQ ID NO: 5988697 - DNA, 15 bp, Homo sapiens
caagtctagtcttct

SEQ ID NO: 5988698 - DNA, 18 bp, Homo sapiens
caagtctcacatattcat

SEQ ID NO: 5988699 - DNA, 16 bp, Homo sapiens
caagtctcagtggctt

SEQ ID NO: 5988700 - DNA, 17 bp, Homo sapiens
caagtctccttcccctt

SEQ ID NO: 5988701 - DNA, 19 bp, Homo sapiens
caagtctctctaagacaaa

SEQ ID NO: 5988702 - DNA, 20 bp, Homo sapiens
caagtctctctaagacaaat

SEQ ID NO: 5988703 - DNA, 15 bp, Homo sapiens
caagtctctctgtga

SEQ ID NO: 5988704 - DNA, 16 bp, Homo sapiens
caagtctctctgtgaa

SEQ ID NO: 5988705 - DNA, 18 bp, Homo sapiens
caagtctctgctggccca

SEQ ID NO: 5988706 - DNA, 21 bp, Homo sapiens
caagtctgcatttcatattat

SEQ ID NO: 5988707 - DNA, 22 bp, Homo sapiens
caagtctgcatttcatattatt

SEQ ID NO: 5988708 - DNA, 13 bp, Homo sapiens
caagtctggatct

SEQ ID NO: 5988709 - DNA, 18 bp, Homo sapiens
caagtctggatctgggac

SEQ ID NO: 5988710 - DNA, 11 bp, Homo sapiens
caagtctggca

SEQ ID NO: 5988711 - DNA, 18 bp, Homo sapiens
caagtctggcaccatgtt

SEQ ID NO: 5988712 - DNA, 11 bp, Homo sapiens
caagtctgtga

SEQ ID NO: 5988713 - DNA, 13 bp, Homo sapiens
caagtctgtgagt

SEQ ID NO: 5988714 - DNA, 23 bp, Homo sapiens
caagtctgtgagtgcgtctgagg

SEQ ID NO: 5988715 - DNA, 20 bp, Homo sapiens
caagtctgtttactgcaagg

SEQ ID NO: 5988716 - DNA, 13 bp, Homo sapiens
caagtcttcctga

SEQ ID NO: 5988717 - DNA, 16 bp, Homo sapiens
caagtcttgctgtgct

SEQ ID NO: 5988718 - DNA, 17 bp, Homo sapiens
caagtcttgctgtgctt

SEQ ID NO: 5988719 - DNA, 23 bp, Homo sapiens
caagtcttgggtctgaatttatt

SEQ ID NO: 5988720 - DNA, 22 bp, Homo sapiens
caagtctttaggtctttgtaag

SEQ ID NO: 5988721 - DNA, 22 bp, Homo sapiens
caagtctttctcctctttgaga

SEQ ID NO: 5988722 - DNA, 19 bp, Homo sapiens
caagtctttctctttccct

SEQ ID NO: 5988723 - DNA, 22 bp, Homo sapiens
caagtctttgagatgcttctgg

SEQ ID NO: 5988724 - DNA, 22 bp, Homo sapiens
caagtgaaaaaggaggaagaga

SEQ ID NO: 5988725 - DNA, 19 bp, Homo sapiens
caagtgaaaactgatttcc

SEQ ID NO: 5988726 - DNA, 17 bp, Homo sapiens
caagtgaaaccagcttc

SEQ ID NO: 5988727 - DNA, 13 bp, Homo sapiens
caagtgaaattat

SEQ ID NO: 5988728 - DNA, 20 bp, Homo sapiens
caagtgaaattattttggag

SEQ ID NO: 5988729 - DNA, 16 bp, Homo sapiens
caagtgaacaaaataa

SEQ ID NO: 5988730 - DNA, 17 bp, Homo sapiens
caagtgaacttgggagg

SEQ ID NO: 5988731 - DNA, 22 bp, Homo sapiens
caagtgaagaacactactgcta

SEQ ID NO: 5988732 - DNA, 15 bp, Homo sapiens
caagtgaagaatcta

SEQ ID NO: 5988733 - DNA, 16 bp, Homo sapiens
caagtgacatctcttt

SEQ ID NO: 5988734 - DNA, 20 bp, Homo sapiens
caagtgacccagctcttctc

SEQ ID NO: 5988735 - DNA, 18 bp, Homo sapiens
caagtgaccccagggcct

SEQ ID NO: 5988736 - DNA, 20 bp, Homo sapiens
caagtgaccccagggcctgt

SEQ ID NO: 5988737 - DNA, 23 bp, Homo sapiens
caagtgaccccagggcctgtctc

SEQ ID NO: 5988738 - DNA, 22 bp, Homo sapiens
caagtgaccgacaaaattccag

SEQ ID NO: 5988739 - DNA, 19 bp, Homo sapiens
caagtgaccgactcattta

SEQ ID NO: 5988740 - DNA, 19 bp, Homo sapiens
caagtgactgtatctgtgt

SEQ ID NO: 5988741 - DNA, 23 bp, Homo sapiens
caagtgagaaagacatctgagga

SEQ ID NO: 5988742 - DNA, 14 bp, Homo sapiens
caagtgagaccctg

SEQ ID NO: 5988743 - DNA, 14 bp, Homo sapiens
caagtgagagctgg

SEQ ID NO: 5988744 - DNA, 13 bp, Homo sapiens
caagtgagagggg

SEQ ID NO: 5988745 - DNA, 16 bp, Homo sapiens
caagtgagcaaacctg

SEQ ID NO: 5988746 - DNA, 13 bp, Homo sapiens
caagtgagcactg

SEQ ID NO: 5988747 - DNA, 14 bp, Homo sapiens
caagtgagcagaga

SEQ ID NO: 5988748 - DNA, 19 bp, Homo sapiens
caagtgagcagatgggaca

SEQ ID NO: 5988749 - DNA, 14 bp, Homo sapiens
caagtgaggcaaga

SEQ ID NO: 5988750 - DNA, 16 bp, Homo sapiens
caagtgaggcaagaga

SEQ ID NO: 5988751 - DNA, 18 bp, Homo sapiens
caagtgaggcaagagaaa

SEQ ID NO: 5988752 - DNA, 19 bp, Homo sapiens
caagtgaggcaagagaaat

SEQ ID NO: 5988753 - DNA, 22 bp, Homo sapiens
caagtgaggccggagaggagtt

SEQ ID NO: 5988754 - DNA, 18 bp, Homo sapiens
caagtgagtctctctggg

SEQ ID NO: 5988755 - DNA, 22 bp, Homo sapiens
caagtgagtctggtggaggagc

SEQ ID NO: 5988756 - DNA, 16 bp, Homo sapiens
caagtgatatatgtat

SEQ ID NO: 5988757 - DNA, 17 bp, Homo sapiens
caagtgatatatgtatt

SEQ ID NO: 5988758 - DNA, 19 bp, Homo sapiens
caagtgatatatgtattta

SEQ ID NO: 5988759 - DNA, 21 bp, Homo sapiens
caagtgatatcacctctcttc

SEQ ID NO: 5988760 - DNA, 18 bp, Homo sapiens
caagtgatcctcctgtct

SEQ ID NO: 5988761 - DNA, 20 bp, Homo sapiens
caagtgatcgccaccccccc

SEQ ID NO: 5988762 - DNA, 14 bp, Homo sapiens
caagtgatctttca

SEQ ID NO: 5988763 - DNA, 16 bp, Homo sapiens
caagtgatgtgtttac

SEQ ID NO: 5988764 - DNA, 20 bp, Homo sapiens
caagtgattgacaactgaag

SEQ ID NO: 5988765 - DNA, 21 bp, Homo sapiens
caagtgattgacaactgaaga

SEQ ID NO: 5988766 - DNA, 22 bp, Homo sapiens
caagtgattgacaactgaagag

SEQ ID NO: 5988767 - DNA, 19 bp, Homo sapiens
caagtgattgggacagagg

SEQ ID NO: 5988768 - DNA, 16 bp, Homo sapiens
caagtgcaatagatta

SEQ ID NO: 5988769 - DNA, 17 bp, Homo sapiens
caagtgcagagttcaga

SEQ ID NO: 5988770 - DNA, 14 bp, Homo sapiens
caagtgcaggctgg

SEQ ID NO: 5988771 - DNA, 18 bp, Homo sapiens
caagtgcatttctgggcc

SEQ ID NO: 5988772 - DNA, 19 bp, Homo sapiens
caagtgcatttctgggcct

SEQ ID NO: 5988773 - DNA, 17 bp, Homo sapiens
caagtgcatttttctta

SEQ ID NO: 5988774 - DNA, 12 bp, Homo sapiens
caagtgccaaac

SEQ ID NO: 5988775 - DNA, 18 bp, Homo sapiens
caagtgccaaacagagta

SEQ ID NO: 5988776 - DNA, 22 bp, Homo sapiens
caagtgccactgcccgagctgg

SEQ ID NO: 5988777 - DNA, 14 bp, Homo sapiens
caagtgccagaggt

SEQ ID NO: 5988778 - DNA, 19 bp, Homo sapiens
caagtgccagaggtgggca

SEQ ID NO: 5988779 - DNA, 22 bp, Homo sapiens
caagtgccagaggtgggcaggt

SEQ ID NO: 5988780 - DNA, 21 bp, Homo sapiens
caagtgccccaccactcccca

SEQ ID NO: 5988781 - DNA, 21 bp, Homo sapiens
cactgcgcccggcccaagaga

SEQ ID NO: 5988782 - DNA, 18 bp, Homo sapiens
cactgcggaagccaaagg

SEQ ID NO: 5988783 - DNA, 19 bp, Homo sapiens
cactgcggaagccaaaggc

SEQ ID NO: 5988784 - DNA, 21 bp, Homo sapiens
cactgcggagaaccttgtgcc

SEQ ID NO: 5988785 - DNA, 20 bp, Homo sapiens
cactgcggggcttggctgag

SEQ ID NO: 5988786 - DNA, 15 bp, Homo sapiens
cactgctaaggctgc

SEQ ID NO: 5988787 - DNA, 19 bp, Homo sapiens
cactgctaaggctgctggc

SEQ ID NO: 5988788 - DNA, 14 bp, Homo sapiens
cactgctaataaat

SEQ ID NO: 5988789 - DNA, 19 bp, Homo sapiens
cactgctaataaatgacca

SEQ ID NO: 5988790 - DNA, 20 bp, Homo sapiens
cactgctaataaatgaccag

SEQ ID NO: 5988791 - DNA, 16 bp, Homo sapiens
cactgctacacttctg

SEQ ID NO: 5988792 - DNA, 14 bp, Homo sapiens
cactgctacatgtg

SEQ ID NO: 5988793 - DNA, 21 bp, Homo sapiens
cactgctagagacgctgatcc

SEQ ID NO: 5988794 - DNA, 23 bp, Homo sapiens
cactgctaggtgggccagcccct

SEQ ID NO: 5988795 - DNA, 15 bp, Homo sapiens
cactgctatgccatt

SEQ ID NO: 5988796 - DNA, 20 bp, Homo sapiens
cactgctcacgtctctgccg

SEQ ID NO: 5988797 - DNA, 22 bp, Homo sapiens
cactgctcacgtctctgccgcc

SEQ ID NO: 5988798 - DNA, 23 bp, Homo sapiens
cactgctcattgtataagccccg

SEQ ID NO: 5988799 - DNA, 19 bp, Homo sapiens
cactgctccaagggacagg

SEQ ID NO: 5988800 - DNA, 18 bp, Homo sapiens
cactgctccctaccccag

SEQ ID NO: 5988801 - DNA, 22 bp, Homo sapiens
cactgctccctaccccagggcc

SEQ ID NO: 5988802 - DNA, 21 bp, Homo sapiens
cactgctcgtggactgtgctg

SEQ ID NO: 5988803 - DNA, 15 bp, Homo sapiens
cactgctctaacagc

SEQ ID NO: 5988804 - DNA, 12 bp, Homo sapiens
cactgctctgcc

SEQ ID NO: 5988805 - DNA, 19 bp, Homo sapiens
cactgctgaaaaagaaaaa

SEQ ID NO: 5988806 - DNA, 21 bp, Homo sapiens
cactgctgaaaaagaaaaaaa

SEQ ID NO: 5988807 - DNA, 23 bp, Homo sapiens
cactgctgaagatgcccctgctc

SEQ ID NO: 5988808 - DNA, 15 bp, Homo sapiens
cactgctgagctggc

SEQ ID NO: 5988809 - DNA, 13 bp, Homo sapiens
cactgctgaggag

SEQ ID NO: 5988810 - DNA, 14 bp, Homo sapiens
cactgctgaggagt

SEQ ID NO: 5988811 - DNA, 23 bp, Homo sapiens
cactgctgaggagtctgaggact

SEQ ID NO: 5988812 - DNA, 18 bp, Homo sapiens
cactgctgatcgtagaaa

SEQ ID NO: 5988813 - DNA, 17 bp, Homo sapiens
cactgctgcaaggcctt

SEQ ID NO: 5988814 - DNA, 14 bp, Homo sapiens
cactgctgcaccag

SEQ ID NO: 5988815 - DNA, 17 bp, Homo sapiens
cactgctgcatgttgtt

SEQ ID NO: 5988816 - DNA, 16 bp, Homo sapiens
cactgctgctgccttt

SEQ ID NO: 5988817 - DNA, 12 bp, Homo sapiens
cactgctggctg

SEQ ID NO: 5988818 - DNA, 22 bp, Homo sapiens
cactgctggctgcagcggcagg

SEQ ID NO: 5988819 - DNA, 15 bp, Homo sapiens
cactgctggctgcct

SEQ ID NO: 5988820 - DNA, 16 bp, Homo sapiens
cactgctggctgcctt

SEQ ID NO: 5988821 - DNA, 21 bp, Homo sapiens
cactgctggctgccttagaac

SEQ ID NO: 5988822 - DNA, 13 bp, Homo sapiens
cactgctgggaag

SEQ ID NO: 5988823 - DNA, 13 bp, Homo sapiens
cactgctggggag

SEQ ID NO: 5988824 - DNA, 22 bp, Homo sapiens
cactgctggggaggagaggact

SEQ ID NO: 5988825 - DNA, 18 bp, Homo sapiens
cactgctggggagtccct

SEQ ID NO: 5988826 - DNA, 13 bp, Homo sapiens
cactgctgggtgg

SEQ ID NO: 5988827 - DNA, 14 bp, Homo sapiens
cactgctgggtggc

SEQ ID NO: 5988828 - DNA, 19 bp, Homo sapiens
cactgctgggtggcccatc

SEQ ID NO: 5988829 - DNA, 13 bp, Homo sapiens
cactgctggtgcc

SEQ ID NO: 5988830 - DNA, 14 bp, Homo sapiens
cactgctggtgcca

SEQ ID NO: 5988831 - DNA, 16 bp, Homo sapiens
cactgctggtgccagg

SEQ ID NO: 5988832 - DNA, 21 bp, Homo sapiens
cactgctggtgccagggtggg

SEQ ID NO: 5988833 - DNA, 21 bp, Homo sapiens
cactgctggtgtttatgtgaa

SEQ ID NO: 5988834 - DNA, 14 bp, Homo sapiens
cactgctgtaccca

SEQ ID NO: 5988835 - DNA, 16 bp, Homo sapiens
cactgctgtacccaga

SEQ ID NO: 5988836 - DNA, 17 bp, Homo sapiens
cactgctgtacccagat

SEQ ID NO: 5988837 - DNA, 12 bp, Homo sapiens
cactgctgtcag

SEQ ID NO: 5988838 - DNA, 15 bp, Homo sapiens
cactgctgtcctctc

SEQ ID NO: 5988839 - DNA, 21 bp, Homo sapiens
cactgctgtcctctccccctt

SEQ ID NO: 5988840 - DNA, 11 bp, Homo sapiens
cactgctgtga

SEQ ID NO: 5988841 - DNA, 19 bp, Homo sapiens
cactgctgtgagtgcgcct

SEQ ID NO: 5988842 - DNA, 21 bp, Homo sapiens
cactgctgtgagtgcgcctca

SEQ ID NO: 5988843 - DNA, 22 bp, Homo sapiens
cactgctgtgagtgcgcctcac

SEQ ID NO: 5988844 - DNA, 16 bp, Homo sapiens
cactgctgttcctgct

SEQ ID NO: 5988845 - DNA, 21 bp, Homo sapiens
cactgctgttcctgctccatg

SEQ ID NO: 5988846 - DNA, 13 bp, Homo sapiens
cactgcttaactt

SEQ ID NO: 5988847 - DNA, 16 bp, Homo sapiens
cactgcttccagtgag

SEQ ID NO: 5988848 - DNA, 19 bp, Homo sapiens
cactgcttccagtgaggct

SEQ ID NO: 5988849 - DNA, 17 bp, Homo sapiens
cactgcttccatttaat

SEQ ID NO: 5988850 - DNA, 12 bp, Homo sapiens
cactgcttccca

SEQ ID NO: 5988851 - DNA, 20 bp, Homo sapiens
cactgcttctcggccagccc

SEQ ID NO: 5988852 - DNA, 19 bp, Homo sapiens
cactgcttgaggaggggca

SEQ ID NO: 5988853 - DNA, 20 bp, Homo sapiens
cactgcttgaggaggggcac

SEQ ID NO: 5988854 - DNA, 22 bp, Homo sapiens
cactgcttgaggaggggcacct

SEQ ID NO: 5988855 - DNA, 23 bp, Homo sapiens
cactgcttgaggaggggcacctg

SEQ ID NO: 5988856 - DNA, 12 bp, Homo sapiens
cactgctttgca

SEQ ID NO: 5988857 - DNA, 13 bp, Homo sapiens
cactgcttttccc

SEQ ID NO: 5988858 - DNA, 21 bp, Homo sapiens
cactgcttttccctttgtgag

SEQ ID NO: 5988859 - DNA, 19 bp, Homo sapiens
cactgctttttccttagct

SEQ ID NO: 5988860 - DNA, 16 bp, Homo sapiens
cactggaaaacataga

SEQ ID NO: 5988861 - DNA, 13 bp, Homo sapiens
cactggaaaggaa

SEQ ID NO: 5988862 - DNA, 22 bp, Homo sapiens
cactggaaattgaaataaagat

SEQ ID NO: 5988863 - DNA, 14 bp, Homo sapiens
cactggaacctccc

SEQ ID NO: 5988864 - DNA, 19 bp, Homo sapiens
cactggaactcagtgtgac

SEQ ID NO: 5988865 - DNA, 15 bp, Homo sapiens
cactggaaggagcac

SEQ ID NO: 5988866 - DNA, 18 bp, Homo sapiens
cactggaagggtccggct

SEQ ID NO: 5988867 - DNA, 12 bp, Homo sapiens
cactggaatata

SEQ ID NO: 5988868 - DNA, 14 bp, Homo sapiens
cactggaatccagt

SEQ ID NO: 5988869 - DNA, 16 bp, Homo sapiens
cactggacaacactga

SEQ ID NO: 5988870 - DNA, 23 bp, Homo sapiens
cactggacaacactgattcctgg

SEQ ID NO: 5988871 - DNA, 12 bp, Homo sapiens
cactggacagac

SEQ ID NO: 5988872 - DNA, 14 bp, Homo sapiens
cactggacagaccc

SEQ ID NO: 5988873 - DNA, 18 bp, Homo sapiens
cactggacagacccaggt

SEQ ID NO: 5988874 - DNA, 12 bp, Homo sapiens
cactggacagca

SEQ ID NO: 5988875 - DNA, 18 bp, Homo sapiens
cactggaccaggtcctgc

SEQ ID NO: 5988876 - DNA, 15 bp, Homo sapiens
cactggaccccactg

SEQ ID NO: 5988877 - DNA, 17 bp, Homo sapiens
cactggaccccactggc

SEQ ID NO: 5988878 - DNA, 15 bp, Homo sapiens
cactggaccccagca

SEQ ID NO: 5988879 - DNA, 17 bp, Homo sapiens
cactggaccccagcaag

SEQ ID NO: 5988880 - DNA, 17 bp, Homo sapiens
cactggacctgggggta

SEQ ID NO: 5988881 - DNA, 16 bp, Homo sapiens
cactggactccggccc

SEQ ID NO: 5988882 - DNA, 17 bp, Homo sapiens
cactggactgacctggt

SEQ ID NO: 5988883 - DNA, 16 bp, Homo sapiens
cactggactgcatggg

SEQ ID NO: 5988884 - DNA, 23 bp, Homo sapiens
cactggactgcatggggaggcag

SEQ ID NO: 5988885 - DNA, 23 bp, Homo sapiens
cactggagaagaatatcaaataa

SEQ ID NO: 5988886 - DNA, 22 bp, Homo sapiens
cactggagaccggaattgagag

SEQ ID NO: 5988887 - DNA, 12 bp, Homo sapiens
cactggagcatg

SEQ ID NO: 5988888 - DNA, 16 bp, Homo sapiens
cactggagcatgcaga

SEQ ID NO: 5988889 - DNA, 16 bp, Homo sapiens
cactggagccacaggc

SEQ ID NO: 5988890 - DNA, 18 bp, Homo sapiens
cactggagcgtgtactac

SEQ ID NO: 5988891 - DNA, 16 bp, Homo sapiens
cactggagctgggagg

SEQ ID NO: 5988892 - DNA, 16 bp, Homo sapiens
cactggaggagagaag

SEQ ID NO: 5988893 - DNA, 14 bp, Homo sapiens
cactggaggagcag

SEQ ID NO: 5988894 - DNA, 15 bp, Homo sapiens
cactggaggagcagc

SEQ ID NO: 5988895 - DNA, 18 bp, Homo sapiens
cactggaggcctctgcaa

SEQ ID NO: 5988896 - DNA, 22 bp, Homo sapiens
cactggaggcctctgcaagatt

SEQ ID NO: 5988897 - DNA, 15 bp, Homo sapiens
cactggaggggccca

SEQ ID NO: 5988898 - DNA, 18 bp, Homo sapiens
cactggaggggcccaccc

SEQ ID NO: 5988899 - DNA, 18 bp, Homo sapiens
cactggaggttgaagcca

SEQ ID NO: 5988900 - DNA, 15 bp, Homo sapiens
cactggagtctctct

SEQ ID NO: 5988901 - DNA, 22 bp, Homo sapiens
cactggagtcttgcaagaccca

SEQ ID NO: 5988902 - DNA, 23 bp, Homo sapiens
cactggagtgcagggaggagagg

SEQ ID NO: 5988903 - DNA, 20 bp, Homo sapiens
cactggagtggctcgccagg

SEQ ID NO: 5988904 - DNA, 22 bp, Homo sapiens
cactggagtggctcgccaggcc

SEQ ID NO: 5988905 - DNA, 22 bp, Homo sapiens
cactggagtggtaacaagagga

SEQ ID NO: 5988906 - DNA, 21 bp, Homo sapiens
cactggatcaagttcagccac

SEQ ID NO: 5988907 - DNA, 14 bp, Homo sapiens
cactggatccatcc

SEQ ID NO: 5988908 - DNA, 13 bp, Homo sapiens
cactggatcctgc

SEQ ID NO: 5988909 - DNA, 15 bp, Homo sapiens
cactggatcctgctg

SEQ ID NO: 5988910 - DNA, 17 bp, Homo sapiens
cactggatcctgctgct

SEQ ID NO: 5988911 - DNA, 21 bp, Homo sapiens
cactggatgggctgcagcaga

SEQ ID NO: 5988912 - DNA, 14 bp, Homo sapiens
cactggatgtttct

SEQ ID NO: 5988913 - DNA, 21 bp, Homo sapiens
cactggcaaacagggcctctg

SEQ ID NO: 5988914 - DNA, 18 bp, Homo sapiens
cactggcaatggtagttt

SEQ ID NO: 5988915 - DNA, 18 bp, Homo sapiens
cactggcacttgcctgct

SEQ ID NO: 5988916 - DNA, 19 bp, Homo sapiens
cactggcacttgcctgctg

SEQ ID NO: 5988917 - DNA, 23 bp, Homo sapiens
cactggcagagaggtaaagggtg

SEQ ID NO: 5988918 - DNA, 13 bp, Homo sapiens
cactggcagagca

SEQ ID NO: 5988919 - DNA, 22 bp, Homo sapiens
cactggcagagcacagcccacg

SEQ ID NO: 5988920 - DNA, 13 bp, Homo sapiens
cactggcagcccc

SEQ ID NO: 5988921 - DNA, 19 bp, Homo sapiens
cactggcagccccagcacc

SEQ ID NO: 5988922 - DNA, 20 bp, Homo sapiens
cactggcaggatcacagctc

SEQ ID NO: 5988923 - DNA, 22 bp, Homo sapiens
cactggcaggtgtgggatctgg

SEQ ID NO: 5988924 - DNA, 20 bp, Homo sapiens
cactggcatagccctcctga

SEQ ID NO: 5988925 - DNA, 17 bp, Homo sapiens
cactggcatcgcagctt

SEQ ID NO: 5988926 - DNA, 17 bp, Homo sapiens
cactggcatctccctga

SEQ ID NO: 5988927 - DNA, 20 bp, Homo sapiens
cactggcatctccctgacct

SEQ ID NO: 5988928 - DNA, 19 bp, Homo sapiens
cactggcatctctggagtg

SEQ ID NO: 5988929 - DNA, 21 bp, Homo sapiens
cactggcatttttagctcctt

SEQ ID NO: 5988930 - DNA, 17 bp, Homo sapiens
cactggccacagttgtt

SEQ ID NO: 5988931 - DNA, 16 bp, Homo sapiens
cactggccaccaggct

SEQ ID NO: 5988932 - DNA, 24 bp, Homo sapiens
cactggccaccaggctggcgcagc

SEQ ID NO: 5988933 - DNA, 20 bp, Homo sapiens
cactggccacccctccccag

SEQ ID NO: 5988934 - DNA, 11 bp, Homo sapiens
cactggccaga

SEQ ID NO: 5988935 - DNA, 16 bp, Homo sapiens
cactggccagagaggg

SEQ ID NO: 5988936 - DNA, 17 bp, Homo sapiens
cactggccagagagggc

SEQ ID NO: 5988937 - DNA, 18 bp, Homo sapiens
cactggccagagagggcc

SEQ ID NO: 5988938 - DNA, 17 bp, Homo sapiens
cactggccagctctggc

SEQ ID NO: 5988939 - DNA, 13 bp, Homo sapiens
cactggccccacc

SEQ ID NO: 5988940 - DNA, 16 bp, Homo sapiens
cactggccccaccctc

SEQ ID NO: 5988941 - DNA, 22 bp, Homo sapiens
cactggcccctagaatcagcct

SEQ ID NO: 5988942 - DNA, 18 bp, Homo sapiens
cactggcccctggcctgc

SEQ ID NO: 5988943 - DNA, 13 bp, Homo sapiens
cactggccctggg

SEQ ID NO: 5988944 - DNA, 20 bp, Homo sapiens
cactggccggagtcagtgcc

SEQ ID NO: 5988945 - DNA, 23 bp, Homo sapiens
cactggccggcccacgtcctggg

SEQ ID NO: 5988946 - DNA, 16 bp, Homo sapiens
cactggcctacccctt

SEQ ID NO: 5988947 - DNA, 19 bp, Homo sapiens
cactggcctctccccagga

SEQ ID NO: 5988948 - DNA, 18 bp, Homo sapiens
cactggcctgccatgcca

SEQ ID NO: 5988949 - DNA, 13 bp, Homo sapiens
cactggcctgggt

SEQ ID NO: 5988950 - DNA, 21 bp, Homo sapiens
cactggcctgttctgtaggag

SEQ ID NO: 5988951 - DNA, 20 bp, Homo sapiens
cactggccttctgatgaaat

SEQ ID NO: 5988952 - DNA, 21 bp, Homo sapiens
cactggccttctgatgaaatg

SEQ ID NO: 5988953 - DNA, 11 bp, Homo sapiens
cactggccttg

SEQ ID NO: 5988954 - DNA, 20 bp, Homo sapiens
cactggccttgcctccagga

SEQ ID NO: 5988955 - DNA, 19 bp, Homo sapiens
cactggcgaggtgcggcca

SEQ ID NO: 5988956 - DNA, 14 bp, Homo sapiens
cactggcgccttct

SEQ ID NO: 5988957 - DNA, 16 bp, Homo sapiens
cactggcgccttctcg

SEQ ID NO: 5988958 - DNA, 20 bp, Homo sapiens
cactggcggtcaagtgtgga

SEQ ID NO: 5988959 - DNA, 18 bp, Homo sapiens
caagtgcccgccctgccc

SEQ ID NO: 5988960 - DNA, 18 bp, Homo sapiens
caagtgcctcttgttgca

SEQ ID NO: 5988961 - DNA, 13 bp, Homo sapiens
caagtgcctggga

SEQ ID NO: 5988962 - DNA, 20 bp, Homo sapiens
caagtgccttttgctgcgca

SEQ ID NO: 5988963 - DNA, 14 bp, Homo sapiens
caagtgcgtgactg

SEQ ID NO: 5988964 - DNA, 15 bp, Homo sapiens
caagtgctatgccaa

SEQ ID NO: 5988965 - DNA, 14 bp, Homo sapiens
caagtgctatttca

SEQ ID NO: 5988966 - DNA, 19 bp, Homo sapiens
caagtgctcaagcagcaaa

SEQ ID NO: 5988967 - DNA, 21 bp, Homo sapiens
caagtgctcaagcagcaaaat

SEQ ID NO: 5988968 - DNA, 23 bp, Homo sapiens
caagtgctcagggaaatggcctt

SEQ ID NO: 5988969 - DNA, 16 bp, Homo sapiens
caagtgctgaacagtg

SEQ ID NO: 5988970 - DNA, 22 bp, Homo sapiens
caagtgctgcacaaaagcagat

SEQ ID NO: 5988971 - DNA, 13 bp, Homo sapiens
caagtgctggagt

SEQ ID NO: 5988972 - DNA, 14 bp, Homo sapiens
caagtgctggccca

SEQ ID NO: 5988973 - DNA, 14 bp, Homo sapiens
caagtgctgtgcaa

SEQ ID NO: 5988974 - DNA, 21 bp, Homo sapiens
caagtgctgtttgggcaggag

SEQ ID NO: 5988975 - DNA, 22 bp, Homo sapiens
caagtggaagccactggaccac

SEQ ID NO: 5988976 - DNA, 22 bp, Homo sapiens
caagtggaccttaggccttcct

SEQ ID NO: 5988977 - DNA, 23 bp, Homo sapiens
caagtggaccttaggccttcctc

SEQ ID NO: 5988978 - DNA, 14 bp, Homo sapiens
caagtggacggcag

SEQ ID NO: 5988979 - DNA, 17 bp, Homo sapiens
caagtggacgtgggctc

SEQ ID NO: 5988980 - DNA, 19 bp, Homo sapiens
caagtggacgttaggccag

SEQ ID NO: 5988981 - DNA, 21 bp, Homo sapiens
caagtggacgttaggccaggc

SEQ ID NO: 5988982 - DNA, 22 bp, Homo sapiens
caagtggacgttaggccaggcc

SEQ ID NO: 5988983 - DNA, 15 bp, Homo sapiens
caagtggacttggag

SEQ ID NO: 5988984 - DNA, 14 bp, Homo sapiens
caagtggagggggt

SEQ ID NO: 5988985 - DNA, 21 bp, Homo sapiens
caagtggatattttcttaaaa

SEQ ID NO: 5988986 - DNA, 23 bp, Homo sapiens
caagtggatattttcttaaaacc

SEQ ID NO: 5988987 - DNA, 15 bp, Homo sapiens
caagtggatgggaat

SEQ ID NO: 5988988 - DNA, 21 bp, Homo sapiens
caagtggatgggaatttgtca

SEQ ID NO: 5988989 - DNA, 18 bp, Homo sapiens
caagtggcagagcttgga

SEQ ID NO: 5988990 - DNA, 17 bp, Homo sapiens
caagtggcatgtgctgt

SEQ ID NO: 5988991 - DNA, 19 bp, Homo sapiens
caagtggctaagtgtccat

SEQ ID NO: 5988992 - DNA, 15 bp, Homo sapiens
caagtggctccccac

SEQ ID NO: 5988993 - DNA, 17 bp, Homo sapiens
caagtggctccccacct

SEQ ID NO: 5988994 - DNA, 20 bp, Homo sapiens
caagtggctccccacctgga

SEQ ID NO: 5988995 - DNA, 22 bp, Homo sapiens
caagtggctccccacctggaca

SEQ ID NO: 5988996 - DNA, 16 bp, Homo sapiens
caagtggctcttggga

SEQ ID NO: 5988997 - DNA, 19 bp, Homo sapiens
caagtgggagagcccgtgg

SEQ ID NO: 5988998 - DNA, 17 bp, Homo sapiens
caagtgggatctgtcac

SEQ ID NO: 5988999 - DNA, 22 bp, Homo sapiens
caagtgggcagtcaccacccag

SEQ ID NO: 5989000 - DNA, 19 bp, Homo sapiens
caagtgggctggtattctc

SEQ ID NO: 5989001 - DNA, 21 bp, Homo sapiens
caagtggggatggggcctccc

SEQ ID NO: 5989002 - DNA, 22 bp, Homo sapiens
caagtggggatggggcctccct

SEQ ID NO: 5989003 - DNA, 12 bp, Homo sapiens
caagtggggctg

SEQ ID NO: 5989004 - DNA, 13 bp, Homo sapiens
caagtgggggcag

SEQ ID NO: 5989005 - DNA, 17 bp, Homo sapiens
caagtggggtgctggga

SEQ ID NO: 5989006 - DNA, 19 bp, Homo sapiens
caagtggggtgctgggagg

SEQ ID NO: 5989007 - DNA, 21 bp, Homo sapiens
caagtggggtgctgggaggag

SEQ ID NO: 5989008 - DNA, 17 bp, Homo sapiens
caagtggtaatttttgt

SEQ ID NO: 5989009 - DNA, 19 bp, Homo sapiens
caagtggtaatttttgtac

SEQ ID NO: 5989010 - DNA, 16 bp, Homo sapiens
caagtggtattttcca

SEQ ID NO: 5989011 - DNA, 17 bp, Homo sapiens
caagtggtgtttattgc

SEQ ID NO: 5989012 - DNA, 17 bp, Homo sapiens
caagtggttaagaatgt

SEQ ID NO: 5989013 - DNA, 19 bp, Homo sapiens
caagtggtttccacatgct

SEQ ID NO: 5989014 - DNA, 16 bp, Homo sapiens
caagtgtaaaaagatg

SEQ ID NO: 5989015 - DNA, 15 bp, Homo sapiens
caagtgtaaaatatt

SEQ ID NO: 5989016 - DNA, 15 bp, Homo sapiens
caagtgtacatttga

SEQ ID NO: 5989017 - DNA, 18 bp, Homo sapiens
caagtgtatatcagaaaa

SEQ ID NO: 5989018 - DNA, 14 bp, Homo sapiens
caagtgtattattt

SEQ ID NO: 5989019 - DNA, 13 bp, Homo sapiens
caagtgtatttta

SEQ ID NO: 5989020 - DNA, 15 bp, Homo sapiens
caagtgtattttaaa

SEQ ID NO: 5989021 - DNA, 16 bp, Homo sapiens
caagtgtattttaaaa

SEQ ID NO: 5989022 - DNA, 21 bp, Homo sapiens
caagtgtcacctccttcccca

SEQ ID NO: 5989023 - DNA, 22 bp, Homo sapiens
caagtgtcacctccttccccag

SEQ ID NO: 5989024 - DNA, 18 bp, Homo sapiens
caagtgtccccagaccct

SEQ ID NO: 5989025 - DNA, 11 bp, Homo sapiens
caagtgtcctg

SEQ ID NO: 5989026 - DNA, 12 bp, Homo sapiens
caagtgtcctgc

SEQ ID NO: 5989027 - DNA, 13 bp, Homo sapiens
caagtgtctggag

SEQ ID NO: 5989028 - DNA, 15 bp, Homo sapiens
caagtgtctggagcg

SEQ ID NO: 5989029 - DNA, 13 bp, Homo sapiens
caagtgtcttcca

SEQ ID NO: 5989030 - DNA, 18 bp, Homo sapiens
caagtgtgaccccactgc

SEQ ID NO: 5989031 - DNA, 23 bp, Homo sapiens
caagtgtgagccaccgcgcctgg

SEQ ID NO: 5989032 - DNA, 21 bp, Homo sapiens
caagtgtgcatattgtacact

SEQ ID NO: 5989033 - DNA, 23 bp, Homo sapiens
caagtgtgcatattgtacacttt

SEQ ID NO: 5989034 - DNA, 16 bp, Homo sapiens
caagtgtgcctgctat

SEQ ID NO: 5989035 - DNA, 16 bp, Homo sapiens
caagtgtgctaaaaat

SEQ ID NO: 5989036 - DNA, 19 bp, Homo sapiens
caagtgtgctaaaaatgag

SEQ ID NO: 5989037 - DNA, 19 bp, Homo sapiens
caagtgtgctttagcttga

SEQ ID NO: 5989038 - DNA, 17 bp, Homo sapiens
caagtgtgtctcctgtg

SEQ ID NO: 5989039 - DNA, 14 bp, Homo sapiens
caagtgtgtgcaca

SEQ ID NO: 5989040 - DNA, 21 bp, Homo sapiens
caagtgtgtgcacatgtgtgc

SEQ ID NO: 5989041 - DNA, 22 bp, Homo sapiens
caagtgtgtgccaccatgcctc

SEQ ID NO: 5989042 - DNA, 14 bp, Homo sapiens
caagtgtgtgtgca

SEQ ID NO: 5989043 - DNA, 23 bp, Homo sapiens
caagtgtgttgggaattgcatgc

SEQ ID NO: 5989044 - DNA, 17 bp, Homo sapiens
caagtgttacctaacaa

SEQ ID NO: 5989045 - DNA, 22 bp, Homo sapiens
caagtgttacctaacaatgttt

SEQ ID NO: 5989046 - DNA, 18 bp, Homo sapiens
caagtgttcactgctcct

SEQ ID NO: 5989047 - DNA, 21 bp, Homo sapiens
caagtgttcttaggtttactg

SEQ ID NO: 5989048 - DNA, 24 bp, Homo sapiens
caagtgttcttaggtttactgtga

SEQ ID NO: 5989049 - DNA, 19 bp, Homo sapiens
caagtgttgttttttaagt

SEQ ID NO: 5989050 - DNA, 16 bp, Homo sapiens
caagtgtttctagtaa

SEQ ID NO: 5989051 - DNA, 18 bp, Homo sapiens
caagtgtttctgttctgg

SEQ ID NO: 5989052 - DNA, 21 bp, Homo sapiens
caagtgtttgaagtctgctca

SEQ ID NO: 5989053 - DNA, 21 bp, Homo sapiens
caagtgttttagatgttacta

SEQ ID NO: 5989054 - DNA, 15 bp, Homo sapiens
caagtgttttggaaa

SEQ ID NO: 5989055 - DNA, 16 bp, Homo sapiens
caagtgttttggagaa

SEQ ID NO: 5989056 - DNA, 13 bp, Homo sapiens
caagttaaatgta

SEQ ID NO: 5989057 - DNA, 21 bp, Homo sapiens
caagttaagagaaactttata

SEQ ID NO: 5989058 - DNA, 13 bp, Homo sapiens
caagttaagattc

SEQ ID NO: 5989059 - DNA, 20 bp, Homo sapiens
caagttacagctgtgacaat

SEQ ID NO: 5989060 - DNA, 18 bp, Homo sapiens
caagttacatacatttaa

SEQ ID NO: 5989061 - DNA, 20 bp, Homo sapiens
caagttacatccgctttatg

SEQ ID NO: 5989062 - DNA, 16 bp, Homo sapiens
caagttaccaatgtaa

SEQ ID NO: 5989063 - DNA, 22 bp, Homo sapiens
caagttaccaatgtaacactgg

SEQ ID NO: 5989064 - DNA, 19 bp, Homo sapiens
caagttagctcaggaggct

SEQ ID NO: 5989065 - DNA, 17 bp, Homo sapiens
caagttagtttctcata

SEQ ID NO: 5989066 - DNA, 16 bp, Homo sapiens
caagttataaatcaat

SEQ ID NO: 5989067 - DNA, 16 bp, Homo sapiens
caagttatacccaacc

SEQ ID NO: 5989068 - DNA, 20 bp, Homo sapiens
caagttatattgaatatatc

SEQ ID NO: 5989069 - DNA, 17 bp, Homo sapiens
caagttattaaaaatgt

SEQ ID NO: 5989070 - DNA, 23 bp, Homo sapiens
caagttattaatcttatgtgttt

SEQ ID NO: 5989071 - DNA, 21 bp, Homo sapiens
caagttattaatttcttcaca

SEQ ID NO: 5989072 - DNA, 19 bp, Homo sapiens
caagttattcaaatttgta

SEQ ID NO: 5989073 - DNA, 12 bp, Homo sapiens
caagttattcag

SEQ ID NO: 5989074 - DNA, 15 bp, Homo sapiens
caagttattcagaaa

SEQ ID NO: 5989075 - DNA, 16 bp, Homo sapiens
caagttattctcttca

SEQ ID NO: 5989076 - DNA, 12 bp, Homo sapiens
caagttattgta

SEQ ID NO: 5989077 - DNA, 20 bp, Homo sapiens
caagttattgtacagctgtt

SEQ ID NO: 5989078 - DNA, 15 bp, Homo sapiens
caagttattttattt

SEQ ID NO: 5989079 - DNA, 22 bp, Homo sapiens
caagttcaagctctaaattgat

SEQ ID NO: 5989080 - DNA, 10 bp, Homo sapiens
caagttcaat

SEQ ID NO: 5989081 - DNA, 12 bp, Homo sapiens
caagttcaatct

SEQ ID NO: 5989082 - DNA, 17 bp, Homo sapiens
caagttcagggaagcag

SEQ ID NO: 5989083 - DNA, 22 bp, Homo sapiens
caagttcagggaagcaggcaga

SEQ ID NO: 5989084 - DNA, 17 bp, Homo sapiens
caagttcatagtttctg

SEQ ID NO: 5989085 - DNA, 17 bp, Homo sapiens
caagttcatgcagctgt

SEQ ID NO: 5989086 - DNA, 21 bp, Homo sapiens
caagttcattttaaatgaagg

SEQ ID NO: 5989087 - DNA, 12 bp, Homo sapiens
caagttccaaat

SEQ ID NO: 5989088 - DNA, 22 bp, Homo sapiens
caagttccatgggatacaacct

SEQ ID NO: 5989089 - DNA, 16 bp, Homo sapiens
caagttccctcctgca

SEQ ID NO: 5989090 - DNA, 17 bp, Homo sapiens
caagttccctcctgcag

SEQ ID NO: 5989091 - DNA, 16 bp, Homo sapiens
caagttccgtctcctc

SEQ ID NO: 5989092 - DNA, 20 bp, Homo sapiens
caagttccgtctcctctcca

SEQ ID NO: 5989093 - DNA, 21 bp, Homo sapiens
caagttcctctaacttggctc

SEQ ID NO: 5989094 - DNA, 21 bp, Homo sapiens
caagttcctctagtgccctcc

SEQ ID NO: 5989095 - DNA, 18 bp, Homo sapiens
caagttcctgcactccag

SEQ ID NO: 5989096 - DNA, 20 bp, Homo sapiens
caagttcctgcactccagaa

SEQ ID NO: 5989097 - DNA, 15 bp, Homo sapiens
caagttcgtctgttg

SEQ ID NO: 5989098 - DNA, 16 bp, Homo sapiens
caagttcgtctgttgt

SEQ ID NO: 5989099 - DNA, 19 bp, Homo sapiens
caagttctagagaagaggc

SEQ ID NO: 5989100 - DNA, 13 bp, Homo sapiens
caagttctattta

SEQ ID NO: 5989101 - DNA, 19 bp, Homo sapiens
caagttctggcaagagcag

SEQ ID NO: 5989102 - DNA, 17 bp, Homo sapiens
caagttcttcacctcta

SEQ ID NO: 5989103 - DNA, 19 bp, Homo sapiens
caagttcttcacctctatc

SEQ ID NO: 5989104 - DNA, 17 bp, Homo sapiens
caagttgaagactttgt

SEQ ID NO: 5989105 - DNA, 13 bp, Homo sapiens
caagttgagattt

SEQ ID NO: 5989106 - DNA, 19 bp, Homo sapiens
caagttgaggacttcttgc

SEQ ID NO: 5989107 - DNA, 13 bp, Homo sapiens
caagttgaggaga

SEQ ID NO: 5989108 - DNA, 17 bp, Homo sapiens
caagttgatcatgcagg

SEQ ID NO: 5989109 - DNA, 19 bp, Homo sapiens
caagttgcagtcagaagat

SEQ ID NO: 5989110 - DNA, 20 bp, Homo sapiens
caagttgcagtgagcagggt

SEQ ID NO: 5989111 - DNA, 12 bp, Homo sapiens
caagttgctctg

SEQ ID NO: 5989112 - DNA, 19 bp, Homo sapiens
caagttgctttgttacaat

SEQ ID NO: 5989113 - DNA, 22 bp, Homo sapiens
caagttggaagggaccccagat

SEQ ID NO: 5989114 - DNA, 18 bp, Homo sapiens
caagttggatgcggccat

SEQ ID NO: 5989115 - DNA, 16 bp, Homo sapiens
caagttggtcttactt

SEQ ID NO: 5989116 - DNA, 22 bp, Homo sapiens
caagttgtcagctttttgatcc

SEQ ID NO: 5989117 - DNA, 13 bp, Homo sapiens
caagttgtgtgct

SEQ ID NO: 5989118 - DNA, 15 bp, Homo sapiens
caagttgtgtgctat

SEQ ID NO: 5989119 - DNA, 15 bp, Homo sapiens
caagttgttaaaaca

SEQ ID NO: 5989120 - DNA, 16 bp, Homo sapiens
caagttgttaaaacat

SEQ ID NO: 5989121 - DNA, 16 bp, Homo sapiens
caagttgttattgttg

SEQ ID NO: 5989122 - DNA, 21 bp, Homo sapiens
caagttgttccttaagtcaga

SEQ ID NO: 5989123 - DNA, 19 bp, Homo sapiens
caagttgttcgggccaagg

SEQ ID NO: 5989124 - DNA, 16 bp, Homo sapiens
caagttgttgactgtg

SEQ ID NO: 5989125 - DNA, 12 bp, Homo sapiens
caagttgtttaa

SEQ ID NO: 5989126 - DNA, 23 bp, Homo sapiens
caagttgtttaactgtgcatgtg

SEQ ID NO: 5989127 - DNA, 13 bp, Homo sapiens
caagttgtttatg

SEQ ID NO: 5989128 - DNA, 18 bp, Homo sapiens
caagttgtttatgtatca

SEQ ID NO: 5989129 - DNA, 21 bp, Homo sapiens
caagttgtttgagaaattaag

SEQ ID NO: 5989130 - DNA, 15 bp, Homo sapiens
caagtttaaaaatat

SEQ ID NO: 5989131 - DNA, 20 bp, Homo sapiens
caagtttaaaagccatgtat

SEQ ID NO: 5989132 - DNA, 15 bp, Homo sapiens
caagtttacacttca

SEQ ID NO: 5989133 - DNA, 22 bp, Homo sapiens
caagtttatcagtaaataactg

SEQ ID NO: 5989134 - DNA, 17 bp, Homo sapiens
caagtttatttctctct

SEQ ID NO: 5989135 - DNA, 14 bp, Homo sapiens
caagtttcagacag

SEQ ID NO: 5989136 - DNA, 15 bp, Homo sapiens
caagtttcagagtca

SEQ ID NO: 5989137 - DNA, 16 bp, Homo sapiens
cactggctaaagataa

SEQ ID NO: 5989138 - DNA, 15 bp, Homo sapiens
cactggctcacccag

SEQ ID NO: 5989139 - DNA, 18 bp, Homo sapiens
cactggctcacccagtcc

SEQ ID NO: 5989140 - DNA, 15 bp, Homo sapiens
cactggctcatgccc

SEQ ID NO: 5989141 - DNA, 16 bp, Homo sapiens
cactggctcatgcccc

SEQ ID NO: 5989142 - DNA, 18 bp, Homo sapiens
cactggctccatgattct

SEQ ID NO: 5989143 - DNA, 22 bp, Homo sapiens
cactggctccatgattctctga

SEQ ID NO: 5989144 - DNA, 23 bp, Homo sapiens
cactggctccatgattctctgag

SEQ ID NO: 5989145 - DNA, 16 bp, Homo sapiens
cactggctcctccagc

SEQ ID NO: 5989146 - DNA, 17 bp, Homo sapiens
cactggctcctccagca

SEQ ID NO: 5989147 - DNA, 20 bp, Homo sapiens
cactggctcctccagcaaga

SEQ ID NO: 5989148 - DNA, 15 bp, Homo sapiens
cactggctcctccca

SEQ ID NO: 5989149 - DNA, 20 bp, Homo sapiens
cactggctcctcccagcaca

SEQ ID NO: 5989150 - DNA, 22 bp, Homo sapiens
cactggctcctcccagcacagg

SEQ ID NO: 5989151 - DNA, 24 bp, Homo sapiens
cactggctcctcccagcacaggca

SEQ ID NO: 5989152 - DNA, 18 bp, Homo sapiens
cactggctcctggaccta

SEQ ID NO: 5989153 - DNA, 17 bp, Homo sapiens
cactggctctccaagtg

SEQ ID NO: 5989154 - DNA, 19 bp, Homo sapiens
cactggctctccaagtgcc

SEQ ID NO: 5989155 - DNA, 14 bp, Homo sapiens
cactggctctcctg

SEQ ID NO: 5989156 - DNA, 17 bp, Homo sapiens
cactggctctcctggcc

SEQ ID NO: 5989157 - DNA, 14 bp, Homo sapiens
cactggctctggga

SEQ ID NO: 5989158 - DNA, 15 bp, Homo sapiens
cactggctctgggac

SEQ ID NO: 5989159 - DNA, 14 bp, Homo sapiens
cactggctgagaat

SEQ ID NO: 5989160 - DNA, 23 bp, Homo sapiens
cactggctgagaatctgggggtg

SEQ ID NO: 5989161 - DNA, 21 bp, Homo sapiens
cactggctgagcggatgcatc

SEQ ID NO: 5989162 - DNA, 15 bp, Homo sapiens
cactggctgccagct

SEQ ID NO: 5989163 - DNA, 16 bp, Homo sapiens
cactggctgcctccac

SEQ ID NO: 5989164 - DNA, 17 bp, Homo sapiens
cactggctgcctccact

SEQ ID NO: 5989165 - DNA, 21 bp, Homo sapiens
cactggctgcctccactccca

SEQ ID NO: 5989166 - DNA, 22 bp, Homo sapiens
cactggctgcctccactcccac

SEQ ID NO: 5989167 - DNA, 20 bp, Homo sapiens
cactggctggggcagagggg

SEQ ID NO: 5989168 - DNA, 22 bp, Homo sapiens
cactggctgtcagtatgacatt

SEQ ID NO: 5989169 - DNA, 14 bp, Homo sapiens
cactggctgtgcct

SEQ ID NO: 5989170 - DNA, 21 bp, Homo sapiens
cactggctgtgcctcccccgc

SEQ ID NO: 5989171 - DNA, 13 bp, Homo sapiens
cactggctgtggg

SEQ ID NO: 5989172 - DNA, 17 bp, Homo sapiens
cactggctgtgggctcc

SEQ ID NO: 5989173 - DNA, 18 bp, Homo sapiens
cactggctgtgggctccc

SEQ ID NO: 5989174 - DNA, 20 bp, Homo sapiens
cactggctgtgggctccctt

SEQ ID NO: 5989175 - DNA, 15 bp, Homo sapiens
cactggcttccatca

SEQ ID NO: 5989176 - DNA, 20 bp, Homo sapiens
cactggcttgaaggactgca

SEQ ID NO: 5989177 - DNA, 13 bp, Homo sapiens
cactggctttggg

SEQ ID NO: 5989178 - DNA, 18 bp, Homo sapiens
cactgggaaacagaggct

SEQ ID NO: 5989179 - DNA, 19 bp, Homo sapiens
cactgggaagaagcaaggg

SEQ ID NO: 5989180 - DNA, 20 bp, Homo sapiens
cactgggaagctcccacccc

SEQ ID NO: 5989181 - DNA, 14 bp, Homo sapiens
cactgggaagctgg

SEQ ID NO: 5989182 - DNA, 14 bp, Homo sapiens
cactgggaaggaaa

SEQ ID NO: 5989183 - DNA, 15 bp, Homo sapiens
cactgggaaggaaac

SEQ ID NO: 5989184 - DNA, 20 bp, Homo sapiens
cactgggaaggaaacaaatg

SEQ ID NO: 5989185 - DNA, 15 bp, Homo sapiens
cactgggacagctgg

SEQ ID NO: 5989186 - DNA, 17 bp, Homo sapiens
cactgggacagctggct

SEQ ID NO: 5989187 - DNA, 18 bp, Homo sapiens
cactgggacagctggctg

SEQ ID NO: 5989188 - DNA, 19 bp, Homo sapiens
cactgggagaaatgaaaaa

SEQ ID NO: 5989189 - DNA, 15 bp, Homo sapiens
cactgggagaagaga

SEQ ID NO: 5989190 - DNA, 18 bp, Homo sapiens
cactgggagaagagaacc

SEQ ID NO: 5989191 - DNA, 20 bp, Homo sapiens
cactgggagaggtgccagca

SEQ ID NO: 5989192 - DNA, 15 bp, Homo sapiens
cactgggagagtcct

SEQ ID NO: 5989193 - DNA, 11 bp, Homo sapiens
cactgggagca

SEQ ID NO: 5989194 - DNA, 17 bp, Homo sapiens
cactgggaggcagggct

SEQ ID NO: 5989195 - DNA, 14 bp, Homo sapiens
cactgggaggccag

SEQ ID NO: 5989196 - DNA, 14 bp, Homo sapiens
cactgggaggggga

SEQ ID NO: 5989197 - DNA, 17 bp, Homo sapiens
cactgggagggggtggg

SEQ ID NO: 5989198 - DNA, 22 bp, Homo sapiens
cactgggatcacaggtgtcagc

SEQ ID NO: 5989199 - DNA, 22 bp, Homo sapiens
cactgggatgagccgctgtgag

SEQ ID NO: 5989200 - DNA, 15 bp, Homo sapiens
cactgggcacctgcg

SEQ ID NO: 5989201 - DNA, 20 bp, Homo sapiens
cactgggcacctgcgcacag

SEQ ID NO: 5989202 - DNA, 16 bp, Homo sapiens
cactgggcagcaaggc

SEQ ID NO: 5989203 - DNA, 16 bp, Homo sapiens
cactgggcaggttcct

SEQ ID NO: 5989204 - DNA, 21 bp, Homo sapiens
cactgggcaggttcctggggc

SEQ ID NO: 5989205 - DNA, 22 bp, Homo sapiens
cactgggcaggttcctggggcc

SEQ ID NO: 5989206 - DNA, 20 bp, Homo sapiens
cactgggccagccctgcagc

SEQ ID NO: 5989207 - DNA, 14 bp, Homo sapiens
cactgggccagtca

SEQ ID NO: 5989208 - DNA, 10 bp, Homo sapiens
cactgggccc

SEQ ID NO: 5989209 - DNA, 15 bp, Homo sapiens
cactgggcccagagg

SEQ ID NO: 5989210 - DNA, 19 bp, Homo sapiens
cactgggcccagaggagag

SEQ ID NO: 5989211 - DNA, 20 bp, Homo sapiens
cactgggccccattctccct

SEQ ID NO: 5989212 - DNA, 13 bp, Homo sapiens
cactgggcccctc

SEQ ID NO: 5989213 - DNA, 17 bp, Homo sapiens
cactgggcccctcaggg

SEQ ID NO: 5989214 - DNA, 17 bp, Homo sapiens
cactgggcccctgtccc

SEQ ID NO: 5989215 - DNA, 18 bp, Homo sapiens
cactgggcccctgtcccc

SEQ ID NO: 5989216 - DNA, 19 bp, Homo sapiens
cactgggcccctgtcccca

SEQ ID NO: 5989217 - DNA, 17 bp, Homo sapiens
cactgggcccgagcctg

SEQ ID NO: 5989218 - DNA, 19 bp, Homo sapiens
cactgggcccgagcctgaa

SEQ ID NO: 5989219 - DNA, 13 bp, Homo sapiens
cactgggccctgg

SEQ ID NO: 5989220 - DNA, 22 bp, Homo sapiens
cactgggccctggggctgccct

SEQ ID NO: 5989221 - DNA, 21 bp, Homo sapiens
cactgggccggcagcctggtt

SEQ ID NO: 5989222 - DNA, 13 bp, Homo sapiens
cactgggcctgct

SEQ ID NO: 5989223 - DNA, 13 bp, Homo sapiens
cactgggcctgga

SEQ ID NO: 5989224 - DNA, 15 bp, Homo sapiens
cactgggcctggagc

SEQ ID NO: 5989225 - DNA, 16 bp, Homo sapiens
cactgggcctttccag

SEQ ID NO: 5989226 - DNA, 20 bp, Homo sapiens
cactgggcgtctgactccct

SEQ ID NO: 5989227 - DNA, 12 bp, Homo sapiens
cactgggctctg

SEQ ID NO: 5989228 - DNA, 13 bp, Homo sapiens
cactgggctgggt

SEQ ID NO: 5989229 - DNA, 14 bp, Homo sapiens
cactgggctgggtt

SEQ ID NO: 5989230 - DNA, 22 bp, Homo sapiens
cactgggcttggggaccagagc

SEQ ID NO: 5989231 - DNA, 16 bp, Homo sapiens
cactggggaatgctcc

SEQ ID NO: 5989232 - DNA, 20 bp, Homo sapiens
cactggggaatgctcccagc

SEQ ID NO: 5989233 - DNA, 18 bp, Homo sapiens
cactggggactttattta

SEQ ID NO: 5989234 - DNA, 18 bp, Homo sapiens
cactggggatggtggcac

SEQ ID NO: 5989235 - DNA, 21 bp, Homo sapiens
cactggggcagacaataaacc

SEQ ID NO: 5989236 - DNA, 21 bp, Homo sapiens
cactggggcagatgtctcccc

SEQ ID NO: 5989237 - DNA, 19 bp, Homo sapiens
cactggggccccgggttca

SEQ ID NO: 5989238 - DNA, 14 bp, Homo sapiens
cactggggcctaca

SEQ ID NO: 5989239 - DNA, 17 bp, Homo sapiens
cactggggcgtttccta

SEQ ID NO: 5989240 - DNA, 13 bp, Homo sapiens
cactggggctggc

SEQ ID NO: 5989241 - DNA, 16 bp, Homo sapiens
cactggggctggcaca

SEQ ID NO: 5989242 - DNA, 20 bp, Homo sapiens
cactgggggaacagatgcta

SEQ ID NO: 5989243 - DNA, 20 bp, Homo sapiens
cactgggggacactgtggca

SEQ ID NO: 5989244 - DNA, 22 bp, Homo sapiens
cactgggggacactgtggcagc

SEQ ID NO: 5989245 - DNA, 15 bp, Homo sapiens
cactgggggagggga

SEQ ID NO: 5989246 - DNA, 14 bp, Homo sapiens
cactgggggctttg

SEQ ID NO: 5989247 - DNA, 18 bp, Homo sapiens
cactggggtaccacatgg

SEQ ID NO: 5989248 - DNA, 19 bp, Homo sapiens
cactggggtcctggggcct

SEQ ID NO: 5989249 - DNA, 15 bp, Homo sapiens
cactggggtctgttt

SEQ ID NO: 5989250 - DNA, 13 bp, Homo sapiens
cactggggtgccg

SEQ ID NO: 5989251 - DNA, 20 bp, Homo sapiens
cactggggtgccgcctgccc

SEQ ID NO: 5989252 - DNA, 19 bp, Homo sapiens
cactggggtgccttcactg

SEQ ID NO: 5989253 - DNA, 16 bp, Homo sapiens
cactggggtgggaggg

SEQ ID NO: 5989254 - DNA, 13 bp, Homo sapiens
cactggggtgggg

SEQ ID NO: 5989255 - DNA, 20 bp, Homo sapiens
cactggggtttgggggcttc

SEQ ID NO: 5989256 - DNA, 21 bp, Homo sapiens
cactgggtacccaagtgaagg

SEQ ID NO: 5989257 - DNA, 19 bp, Homo sapiens
cactgggtctcactcctga

SEQ ID NO: 5989258 - DNA, 20 bp, Homo sapiens
cactgggtctcactcctgag

SEQ ID NO: 5989259 - DNA, 18 bp, Homo sapiens
cactgggtgcgtctccag

SEQ ID NO: 5989260 - DNA, 19 bp, Homo sapiens
cactgggtggggtgaggac

SEQ ID NO: 5989261 - DNA, 18 bp, Homo sapiens
cactgggtgtaaacacat

SEQ ID NO: 5989262 - DNA, 19 bp, Homo sapiens
cactgggtgtggcctggct

SEQ ID NO: 5989263 - DNA, 18 bp, Homo sapiens
cactgggtgttgatctta

SEQ ID NO: 5989264 - DNA, 23 bp, Homo sapiens
cactgggtttggcaaaactcagg

SEQ ID NO: 5989265 - DNA, 14 bp, Homo sapiens
cactggtaaatgtt

SEQ ID NO: 5989266 - DNA, 22 bp, Homo sapiens
cactggtacccgcccttccgag

SEQ ID NO: 5989267 - DNA, 21 bp, Homo sapiens
cactggtacttagagtttctg

SEQ ID NO: 5989268 - DNA, 19 bp, Homo sapiens
cactggtaggttgggacac

SEQ ID NO: 5989269 - DNA, 17 bp, Homo sapiens
cactggtattcctgcct

SEQ ID NO: 5989270 - DNA, 19 bp, Homo sapiens
cactggtattcctgcctcc

SEQ ID NO: 5989271 - DNA, 14 bp, Homo sapiens
cactggtatttata

SEQ ID NO: 5989272 - DNA, 16 bp, Homo sapiens
cactggtatttatatt

SEQ ID NO: 5989273 - DNA, 19 bp, Homo sapiens
cactggtatttatatttca

SEQ ID NO: 5989274 - DNA, 23 bp, Homo sapiens
cactggtcacggatttgtgtctg

SEQ ID NO: 5989275 - DNA, 17 bp, Homo sapiens
cactggtcagggcagtg

SEQ ID NO: 5989276 - DNA, 19 bp, Homo sapiens
cactggtcagggcagtggc

SEQ ID NO: 5989277 - DNA, 20 bp, Homo sapiens
cactggtccaggtcttcagt

SEQ ID NO: 5989278 - DNA, 16 bp, Homo sapiens
cactggtctacactgg

SEQ ID NO: 5989279 - DNA, 20 bp, Homo sapiens
cactggtctctaagtgtaaa

SEQ ID NO: 5989280 - DNA, 15 bp, Homo sapiens
cactggtctgctgtc

SEQ ID NO: 5989281 - DNA, 16 bp, Homo sapiens
cactggtgcatttaaa

SEQ ID NO: 5989282 - DNA, 21 bp, Homo sapiens
cactggtgcatttaaaatgga

SEQ ID NO: 5989283 - DNA, 20 bp, Homo sapiens
cactggtgccaaaaccaggc

SEQ ID NO: 5989284 - DNA, 13 bp, Homo sapiens
cactggtggcccg

SEQ ID NO: 5989285 - DNA, 22 bp, Homo sapiens
cactggtggcccgacagcctgg

SEQ ID NO: 5989286 - DNA, 15 bp, Homo sapiens
cactggtgggcagct

SEQ ID NO: 5989287 - DNA, 22 bp, Homo sapiens
cactggtggggataggccagcc

SEQ ID NO: 5989288 - DNA, 23 bp, Homo sapiens
cactggtggggataggccagccg

SEQ ID NO: 5989289 - DNA, 16 bp, Homo sapiens
cactggtgtatctcag

SEQ ID NO: 5989290 - DNA, 19 bp, Homo sapiens
cactggtgtgacctgaggg

SEQ ID NO: 5989291 - DNA, 23 bp, Homo sapiens
cactggtgtgagggcccctgcct

SEQ ID NO: 5989292 - DNA, 22 bp, Homo sapiens
cactggtgtgtccctctgcctt

SEQ ID NO: 5989293 - DNA, 22 bp, Homo sapiens
cactggttcttcttggtctcag

SEQ ID NO: 5989294 - DNA, 15 bp, Homo sapiens
cactggttgcactta

SEQ ID NO: 5989295 - DNA, 20 bp, Homo sapiens
cactggttgcacttatgatt

SEQ ID NO: 5989296 - DNA, 15 bp, Homo sapiens
cactggtttctcaga

SEQ ID NO: 5989297 - DNA, 16 bp, Homo sapiens
cactggtttgccaggc

SEQ ID NO: 5989298 - DNA, 14 bp, Homo sapiens
cactggtttggttc

SEQ ID NO: 5989299 - DNA, 18 bp, Homo sapiens
cactggtttgttccctgt

SEQ ID NO: 5989300 - DNA, 18 bp, Homo sapiens
cactggtttgtttctcaa

SEQ ID NO: 5989301 - DNA, 13 bp, Homo sapiens
cactggttttaaa

SEQ ID NO: 5989302 - DNA, 16 bp, Homo sapiens
cactggttttacacag

SEQ ID NO: 5989303 - DNA, 15 bp, Homo sapiens
cactggttttactta

SEQ ID NO: 5989304 - DNA, 16 bp, Homo sapiens
cactgtaaaatagttt

SEQ ID NO: 5989305 - DNA, 13 bp, Homo sapiens
cactgtaaaatga

SEQ ID NO: 5989306 - DNA, 16 bp, Homo sapiens
cactgtaaaatgaaat

SEQ ID NO: 5989307 - DNA, 18 bp, Homo sapiens
cactgtaaaatgaaatta

SEQ ID NO: 5989308 - DNA, 15 bp, Homo sapiens
cactgtaaacccctg

SEQ ID NO: 5989309 - DNA, 13 bp, Homo sapiens
cactgtaaatatc

SEQ ID NO: 5989310 - DNA, 18 bp, Homo sapiens
cactgtaaatatccctcc

SEQ ID NO: 5989311 - DNA, 22 bp, Homo sapiens
cactgtaaatatccctcccctc

SEQ ID NO: 5989312 - DNA, 17 bp, Homo sapiens
cactgtaaatttaatag

SEQ ID NO: 5989313 - DNA, 18 bp, Homo sapiens
cactgtaaatttaataga

SEQ ID NO: 5989314 - DNA, 15 bp, Homo sapiens
cactgtaacatttac

SEQ ID NO: 5989315 - DNA, 17 bp, Homo sapiens
caagtttcagtaatagc

SEQ ID NO: 5989316 - DNA, 21 bp, Homo sapiens
caagtttcagtaatagctgaa

SEQ ID NO: 5989317 - DNA, 16 bp, Homo sapiens
caagtttccatagcaa

SEQ ID NO: 5989318 - DNA, 17 bp, Homo sapiens
caagtttccatagcaac

SEQ ID NO: 5989319 - DNA, 22 bp, Homo sapiens
caagtttctagctagaaatatg

SEQ ID NO: 5989320 - DNA, 22 bp, Homo sapiens
caagtttctgtttcaaagcaca

SEQ ID NO: 5989321 - DNA, 15 bp, Homo sapiens
caagtttgaacaggc

SEQ ID NO: 5989322 - DNA, 11 bp, Homo sapiens
caagtttgcta

SEQ ID NO: 5989323 - DNA, 14 bp, Homo sapiens
caagtttgctaaaa

SEQ ID NO: 5989324 - DNA, 12 bp, Homo sapiens
caagtttgctgc

SEQ ID NO: 5989325 - DNA, 21 bp, Homo sapiens
caagtttgctgcaacccaagt

SEQ ID NO: 5989326 - DNA, 22 bp, Homo sapiens
caagttttaaacccaaaatata

SEQ ID NO: 5989327 - DNA, 22 bp, Homo sapiens
caagttttaggacaaacagctc

SEQ ID NO: 5989328 - DNA, 16 bp, Homo sapiens
caagttttccctgaag

SEQ ID NO: 5989329 - DNA, 21 bp, Homo sapiens
caagttttggcagccatgata

SEQ ID NO: 5989330 - DNA, 13 bp, Homo sapiens
caagttttgtata

SEQ ID NO: 5989331 - DNA, 14 bp, Homo sapiens
caagttttgtataa

SEQ ID NO: 5989332 - DNA, 17 bp, Homo sapiens
caagttttgtataaata

SEQ ID NO: 5989333 - DNA, 11 bp, Homo sapiens
caagttttgtg

SEQ ID NO: 5989334 - DNA, 17 bp, Homo sapiens
caagttttgtgaaattt

SEQ ID NO: 5989335 - DNA, 19 bp, Homo sapiens
caagttttgtgaaattttt

SEQ ID NO: 5989336 - DNA, 20 bp, Homo sapiens
caagttttgtgaaatttttc

SEQ ID NO: 5989337 - DNA, 21 bp, Homo sapiens
caagttttgtgaaatttttca

SEQ ID NO: 5989338 - DNA, 21 bp, Homo sapiens
caagttttgtttcctcattga

SEQ ID NO: 5989339 - DNA, 13 bp, Homo sapiens
caagtttttatag

SEQ ID NO: 5989340 - DNA, 21 bp, Homo sapiens
caagtttttatagttattaaa

SEQ ID NO: 5989341 - DNA, 13 bp, Homo sapiens
caagtttttcaga

SEQ ID NO: 5989342 - DNA, 17 bp, Homo sapiens
caagtttttcagaaagt

SEQ ID NO: 5989343 - DNA, 21 bp, Homo sapiens
caagtttttcatactgtacac

SEQ ID NO: 5989344 - DNA, 23 bp, Homo sapiens
caagtttttcatactgtacacat

SEQ ID NO: 5989345 - DNA, 20 bp, Homo sapiens
caagtttttctctcaaatga

SEQ ID NO: 5989346 - DNA, 17 bp, Homo sapiens
caagtttttttgttcat

SEQ ID NO: 5989347 - DNA, 17 bp, Homo sapiens
caataaaaaacaaatat

SEQ ID NO: 5989348 - DNA, 14 bp, Homo sapiens
caataaaaaagtga

SEQ ID NO: 5989349 - DNA, 22 bp, Homo sapiens
caataaaaacattttgaagtgt

SEQ ID NO: 5989350 - DNA, 13 bp, Homo sapiens
caataaaaagaaa

SEQ ID NO: 5989351 - DNA, 15 bp, Homo sapiens
caataaaaagttcag

SEQ ID NO: 5989352 - DNA, 20 bp, Homo sapiens
caataaaaagttcagagttc

SEQ ID NO: 5989353 - DNA, 18 bp, Homo sapiens
caataaaaatctttgatt

SEQ ID NO: 5989354 - DNA, 17 bp, Homo sapiens
caataaaaatggctcag

SEQ ID NO: 5989355 - DNA, 22 bp, Homo sapiens
caataaaaatggctcagatgcc

SEQ ID NO: 5989356 - DNA, 13 bp, Homo sapiens
caataaaacaaga

SEQ ID NO: 5989357 - DNA, 13 bp, Homo sapiens
caataaaacattc

SEQ ID NO: 5989358 - DNA, 16 bp, Homo sapiens
caataaaaccaagcct

SEQ ID NO: 5989359 - DNA, 17 bp, Homo sapiens
caataaaaccaagcctc

SEQ ID NO: 5989360 - DNA, 13 bp, Homo sapiens
caataaaactgat

SEQ ID NO: 5989361 - DNA, 18 bp, Homo sapiens
caataaaagagctttatc

SEQ ID NO: 5989362 - DNA, 11 bp, Homo sapiens
caataaaagat

SEQ ID NO: 5989363 - DNA, 14 bp, Homo sapiens
caataaaagccaga

SEQ ID NO: 5989364 - DNA, 14 bp, Homo sapiens
caataaaagcccag

SEQ ID NO: 5989365 - DNA, 15 bp, Homo sapiens
caataaaagcccagg

SEQ ID NO: 5989366 - DNA, 16 bp, Homo sapiens
caataaaagcccagga

SEQ ID NO: 5989367 - DNA, 12 bp, Homo sapiens
caataaaagctt

SEQ ID NO: 5989368 - DNA, 12 bp, Homo sapiens
caataaaagtga

SEQ ID NO: 5989369 - DNA, 20 bp, Homo sapiens
caataaaagttttctccaac

SEQ ID NO: 5989370 - DNA, 17 bp, Homo sapiens
caataaaatagtattga

SEQ ID NO: 5989371 - DNA, 15 bp, Homo sapiens
caataaaatcatgta

SEQ ID NO: 5989372 - DNA, 20 bp, Homo sapiens
caataaaatcttgaaaatgc

SEQ ID NO: 5989373 - DNA, 15 bp, Homo sapiens
caataaaatgggttt

SEQ ID NO: 5989374 - DNA, 18 bp, Homo sapiens
caataaaatggttcatat

SEQ ID NO: 5989375 - DNA, 12 bp, Homo sapiens
caataaaatgta

SEQ ID NO: 5989376 - DNA, 22 bp, Homo sapiens
caataaaatgtgatttttctga

SEQ ID NO: 5989377 - DNA, 18 bp, Homo sapiens
caataaaattatttgcag

SEQ ID NO: 5989378 - DNA, 18 bp, Homo sapiens
caataaaattctgtaatt

SEQ ID NO: 5989379 - DNA, 11 bp, Homo sapiens
caataaaattt

SEQ ID NO: 5989380 - DNA, 15 bp, Homo sapiens
caataaaattttcaa

SEQ ID NO: 5989381 - DNA, 20 bp, Homo sapiens
caataaaatttttttggtct

SEQ ID NO: 5989382 - DNA, 18 bp, Homo sapiens
caataaaattttttttca

SEQ ID NO: 5989383 - DNA, 22 bp, Homo sapiens
caataaaattttttttcatgtt

SEQ ID NO: 5989384 - DNA, 16 bp, Homo sapiens
caataaacaacagctg

SEQ ID NO: 5989385 - DNA, 21 bp, Homo sapiens
caataaacaacagctgaagca

SEQ ID NO: 5989386 - DNA, 15 bp, Homo sapiens
caataaacagctccc

SEQ ID NO: 5989387 - DNA, 12 bp, Homo sapiens
caataaacagga

SEQ ID NO: 5989388 - DNA, 16 bp, Homo sapiens
caataaacaggaattt

SEQ ID NO: 5989389 - DNA, 12 bp, Homo sapiens
caataaacagtc

SEQ ID NO: 5989390 - DNA, 14 bp, Homo sapiens
caataaacagtcac

SEQ ID NO: 5989391 - DNA, 18 bp, Homo sapiens
caataaacagtcactgga

SEQ ID NO: 5989392 - DNA, 14 bp, Homo sapiens
caataaacatcctt

SEQ ID NO: 5989393 - DNA, 19 bp, Homo sapiens
caataaacatttcatttcc

SEQ ID NO: 5989394 - DNA, 20 bp, Homo sapiens
caataaaccaaacccagcca

SEQ ID NO: 5989395 - DNA, 21 bp, Homo sapiens
caataaaccaaacccagccac

SEQ ID NO: 5989396 - DNA, 19 bp, Homo sapiens
caataaaccaatgaacgaa

SEQ ID NO: 5989397 - DNA, 14 bp, Homo sapiens
caataaaccacaag

SEQ ID NO: 5989398 - DNA, 19 bp, Homo sapiens
caataaaccacaagcatct

SEQ ID NO: 5989399 - DNA, 13 bp, Homo sapiens
caataaaccaggt

SEQ ID NO: 5989400 - DNA, 12 bp, Homo sapiens
caataaaccagt

SEQ ID NO: 5989401 - DNA, 16 bp, Homo sapiens
caataaacgatttaat

SEQ ID NO: 5989402 - DNA, 17 bp, Homo sapiens
caataaacgatttaatt

SEQ ID NO: 5989403 - DNA, 18 bp, Homo sapiens
caataaacgcattatcag

SEQ ID NO: 5989404 - DNA, 14 bp, Homo sapiens
caataaactggtat

SEQ ID NO: 5989405 - DNA, 20 bp, Homo sapiens
caataaacttagaggaaaat

SEQ ID NO: 5989406 - DNA, 22 bp, Homo sapiens
caataaacttagaggaaaatga

SEQ ID NO: 5989407 - DNA, 17 bp, Homo sapiens
caataaacttgtaggac

SEQ ID NO: 5989408 - DNA, 14 bp, Homo sapiens
caataaagagctca

SEQ ID NO: 5989409 - DNA, 20 bp, Homo sapiens
caataaagagtaaatatact

SEQ ID NO: 5989410 - DNA, 22 bp, Homo sapiens
caataaagagtaaatatacttg

SEQ ID NO: 5989411 - DNA, 16 bp, Homo sapiens
caataaagatttttca

SEQ ID NO: 5989412 - DNA, 11 bp, Homo sapiens
caataaagcag

SEQ ID NO: 5989413 - DNA, 15 bp, Homo sapiens
caataaagcagagcc

SEQ ID NO: 5989414 - DNA, 18 bp, Homo sapiens
caataaagcagagccaag

SEQ ID NO: 5989415 - DNA, 19 bp, Homo sapiens
caataaagcagagccaagg

SEQ ID NO: 5989416 - DNA, 22 bp, Homo sapiens
caataaagcagcctcattctga

SEQ ID NO: 5989417 - DNA, 22 bp, Homo sapiens
caataaagcagttaatttatat

SEQ ID NO: 5989418 - DNA, 18 bp, Homo sapiens
caataaagcattttgcaa

SEQ ID NO: 5989419 - DNA, 11 bp, Homo sapiens
caataaagcct

SEQ ID NO: 5989420 - DNA, 12 bp, Homo sapiens
caataaagcctt

SEQ ID NO: 5989421 - DNA, 13 bp, Homo sapiens
caataaagccttt

SEQ ID NO: 5989422 - DNA, 16 bp, Homo sapiens
caataaagccttttaa

SEQ ID NO: 5989423 - DNA, 11 bp, Homo sapiens
caataaagctg

SEQ ID NO: 5989424 - DNA, 17 bp, Homo sapiens
caataaagctgctgaga

SEQ ID NO: 5989425 - DNA, 22 bp, Homo sapiens
caataaagctggacaagaagct

SEQ ID NO: 5989426 - DNA, 12 bp, Homo sapiens
caataaaggaac

SEQ ID NO: 5989427 - DNA, 17 bp, Homo sapiens
caataaaggagaagaga

SEQ ID NO: 5989428 - DNA, 18 bp, Homo sapiens
caataaaggcagctgcct

SEQ ID NO: 5989429 - DNA, 22 bp, Homo sapiens
caataaagggagaatggtgctg

SEQ ID NO: 5989430 - DNA, 18 bp, Homo sapiens
caataaagtataatgttt

SEQ ID NO: 5989431 - DNA, 16 bp, Homo sapiens
caataaagtatctaca

SEQ ID NO: 5989432 - DNA, 16 bp, Homo sapiens
caataaagtatttaat

SEQ ID NO: 5989433 - DNA, 16 bp, Homo sapiens
caataaagtcctcttc

SEQ ID NO: 5989434 - DNA, 20 bp, Homo sapiens
caataaagtgacaaaagctc

SEQ ID NO: 5989435 - DNA, 16 bp, Homo sapiens
caataaagtgatctgt

SEQ ID NO: 5989436 - DNA, 13 bp, Homo sapiens
caataaagttgtt

SEQ ID NO: 5989437 - DNA, 15 bp, Homo sapiens
caataaagttgttgc

SEQ ID NO: 5989438 - DNA, 18 bp, Homo sapiens
caataaagtttgatcttc

SEQ ID NO: 5989439 - DNA, 21 bp, Homo sapiens
caataaagtttgatcttcctc

SEQ ID NO: 5989440 - DNA, 18 bp, Homo sapiens
caataaagtttgtacact

SEQ ID NO: 5989441 - DNA, 16 bp, Homo sapiens
caataaataaatgttt

SEQ ID NO: 5989442 - DNA, 20 bp, Homo sapiens
caataaataaatgttttagt

SEQ ID NO: 5989443 - DNA, 18 bp, Homo sapiens
caataaataacacttgtc

SEQ ID NO: 5989444 - DNA, 12 bp, Homo sapiens
caataaataata

SEQ ID NO: 5989445 - DNA, 13 bp, Homo sapiens
caataaatagaca

SEQ ID NO: 5989446 - DNA, 21 bp, Homo sapiens
caataaatatacttctgctgt

SEQ ID NO: 5989447 - DNA, 13 bp, Homo sapiens
caataaatattct

SEQ ID NO: 5989448 - DNA, 14 bp, Homo sapiens
caataaatccacac

SEQ ID NO: 5989449 - DNA, 18 bp, Homo sapiens
caataaatctgacccagt

SEQ ID NO: 5989450 - DNA, 13 bp, Homo sapiens
caataaatgaaga

SEQ ID NO: 5989451 - DNA, 15 bp, Homo sapiens
caataaatgaagatt

SEQ ID NO: 5989452 - DNA, 15 bp, Homo sapiens
caataaatgccctct

SEQ ID NO: 5989453 - DNA, 11 bp, Homo sapiens
caataaatgct

SEQ ID NO: 5989454 - DNA, 12 bp, Homo sapiens
caataaatgctc

SEQ ID NO: 5989455 - DNA, 14 bp, Homo sapiens
caataaatgctgaa

SEQ ID NO: 5989456 - DNA, 17 bp, Homo sapiens
caataaatgctgaatga

SEQ ID NO: 5989457 - DNA, 14 bp, Homo sapiens
caataaatggccag

SEQ ID NO: 5989458 - DNA, 15 bp, Homo sapiens
caataaatggctgta

SEQ ID NO: 5989459 - DNA, 16 bp, Homo sapiens
caataaatgtctgttg

SEQ ID NO: 5989460 - DNA, 19 bp, Homo sapiens
caataaatgttttaatgct

SEQ ID NO: 5989461 - DNA, 15 bp, Homo sapiens
caataaattctaaat

SEQ ID NO: 5989462 - DNA, 15 bp, Homo sapiens
caataaattgctaat

SEQ ID NO: 5989463 - DNA, 20 bp, Homo sapiens
caataaattgttttttaatt

SEQ ID NO: 5989464 - DNA, 17 bp, Homo sapiens
caataaatttatatact

SEQ ID NO: 5989465 - DNA, 13 bp, Homo sapiens
caataaatttgct

SEQ ID NO: 5989466 - DNA, 18 bp, Homo sapiens
caataaattttgaaaagt

SEQ ID NO: 5989467 - DNA, 18 bp, Homo sapiens
caataacaaaacgaaact

SEQ ID NO: 5989468 - DNA, 19 bp, Homo sapiens
caataacaaaacgaaacta

SEQ ID NO: 5989469 - DNA, 11 bp, Homo sapiens
caataacaaag

SEQ ID NO: 5989470 - DNA, 13 bp, Homo sapiens
caataacaaagca

SEQ ID NO: 5989471 - DNA, 20 bp, Homo sapiens
caataacaaagcacataact

SEQ ID NO: 5989472 - DNA, 12 bp, Homo sapiens
caataacaacaa

SEQ ID NO: 5989473 - DNA, 18 bp, Homo sapiens
caataacaagcatgcata

SEQ ID NO: 5989474 - DNA, 17 bp, Homo sapiens
caataacactaaaattt

SEQ ID NO: 5989475 - DNA, 16 bp, Homo sapiens
caataacactatattt

SEQ ID NO: 5989476 - DNA, 18 bp, Homo sapiens
caataacactatatttat

SEQ ID NO: 5989477 - DNA, 16 bp, Homo sapiens
caataacactgtattt

SEQ ID NO: 5989478 - DNA, 17 bp, Homo sapiens
caataacactgtatttt

SEQ ID NO: 5989479 - DNA, 17 bp, Homo sapiens
caataacagatggtgct

SEQ ID NO: 5989480 - DNA, 12 bp, Homo sapiens
caataacagctg

SEQ ID NO: 5989481 - DNA, 13 bp, Homo sapiens
caataacagctgc

SEQ ID NO: 5989482 - DNA, 17 bp, Homo sapiens
caataaccaagtttatt

SEQ ID NO: 5989483 - DNA, 13 bp, Homo sapiens
caataacccagtt

SEQ ID NO: 5989484 - DNA, 19 bp, Homo sapiens
caataacccagttactttt

SEQ ID NO: 5989485 - DNA, 21 bp, Homo sapiens
caataactactgtgttcctgg

SEQ ID NO: 5989486 - DNA, 21 bp, Homo sapiens
caataactagtaataccaaag

SEQ ID NO: 5989487 - DNA, 17 bp, Homo sapiens
caataactccaagcaga

SEQ ID NO: 5989488 - DNA, 18 bp, Homo sapiens
caataactccaagcagac

SEQ ID NO: 5989489 - DNA, 16 bp, Homo sapiens
caataactcctcccag

SEQ ID NO: 5989490 - DNA, 21 bp, Homo sapiens
caataactcggtgtgtggccg

SEQ ID NO: 5989491 - DNA, 16 bp, Homo sapiens
caataactctgatttt

SEQ ID NO: 5989492 - DNA, 16 bp, Homo sapiens
caataactgaaaatga

SEQ ID NO: 5989493 - DNA, 17 bp, Homo sapiens
caataacttcagagaag

SEQ ID NO: 5989494 - DNA, 12 bp, Homo sapiens
caataacttcta

SEQ ID NO: 5989495 - DNA, 13 bp, Homo sapiens
caataacttctat

SEQ ID NO: 5989496 - DNA, 16 bp, Homo sapiens
caataacttctatatt

SEQ ID NO: 5989497 - DNA, 13 bp, Homo sapiens
cactgtaacctca

SEQ ID NO: 5989498 - DNA, 22 bp, Homo sapiens
cactgtaacctcagtctacccc

SEQ ID NO: 5989499 - DNA, 22 bp, Homo sapiens
cactgtaagactcattccctag

SEQ ID NO: 5989500 - DNA, 19 bp, Homo sapiens
cactgtaagctttgttctg

SEQ ID NO: 5989501 - DNA, 22 bp, Homo sapiens
cactgtaagcttttaagaaaaa

SEQ ID NO: 5989502 - DNA, 15 bp, Homo sapiens
cactgtaagtttatt

SEQ ID NO: 5989503 - DNA, 14 bp, Homo sapiens
cactgtaatatctt

SEQ ID NO: 5989504 - DNA, 11 bp, Homo sapiens
cactgtaatga

SEQ ID NO: 5989505 - DNA, 16 bp, Homo sapiens
cactgtaattaaaact

SEQ ID NO: 5989506 - DNA, 21 bp, Homo sapiens
cactgtacaaatgacactgca

SEQ ID NO: 5989507 - DNA, 20 bp, Homo sapiens
cactgtacaaggtacccctt

SEQ ID NO: 5989508 - DNA, 11 bp, Homo sapiens
cactgtacata

SEQ ID NO: 5989509 - DNA, 20 bp, Homo sapiens
cactgtacccagtctcaaag

SEQ ID NO: 5989510 - DNA, 13 bp, Homo sapiens
cactgtactgcat

SEQ ID NO: 5989511 - DNA, 19 bp, Homo sapiens
cactgtacttgctcttgat

SEQ ID NO: 5989512 - DNA, 18 bp, Homo sapiens
cactgtagaatgatttca

SEQ ID NO: 5989513 - DNA, 21 bp, Homo sapiens
cactgtagcattacagtgggt

SEQ ID NO: 5989514 - DNA, 19 bp, Homo sapiens
cactgtagccttagtgtca

SEQ ID NO: 5989515 - DNA, 11 bp, Homo sapiens
cactgtagcta

SEQ ID NO: 5989516 - DNA, 15 bp, Homo sapiens
cactgtagctacatt

SEQ ID NO: 5989517 - DNA, 22 bp, Homo sapiens
cactgtagtaaataatgctttg

SEQ ID NO: 5989518 - DNA, 18 bp, Homo sapiens
cactgtagttctaagact

SEQ ID NO: 5989519 - DNA, 20 bp, Homo sapiens
cactgtagttctaagactca

SEQ ID NO: 5989520 - DNA, 22 bp, Homo sapiens
cactgtagtttttgaaaattat

SEQ ID NO: 5989521 - DNA, 23 bp, Homo sapiens
cactgtagtttttgaaaattatg

SEQ ID NO: 5989522 - DNA, 13 bp, Homo sapiens
cactgtataaata

SEQ ID NO: 5989523 - DNA, 14 bp, Homo sapiens
cactgtataaatag

SEQ ID NO: 5989524 - DNA, 21 bp, Homo sapiens
cactgtataaataggagagga

SEQ ID NO: 5989525 - DNA, 22 bp, Homo sapiens
cactgtataccccgtgaagcat

SEQ ID NO: 5989526 - DNA, 18 bp, Homo sapiens
cactgtatagtaatcatt

SEQ ID NO: 5989527 - DNA, 17 bp, Homo sapiens
cactgtatataaacata

SEQ ID NO: 5989528 - DNA, 16 bp, Homo sapiens
cactgtatatgtaaat

SEQ ID NO: 5989529 - DNA, 19 bp, Homo sapiens
cactgtatctaaaaaataa

SEQ ID NO: 5989530 - DNA, 22 bp, Homo sapiens
cactgtatctaaaaaataactg

SEQ ID NO: 5989531 - DNA, 16 bp, Homo sapiens
cactgtattgctcctc

SEQ ID NO: 5989532 - DNA, 11 bp, Homo sapiens
cactgtatttt

SEQ ID NO: 5989533 - DNA, 16 bp, Homo sapiens
cactgtattttaatgt

SEQ ID NO: 5989534 - DNA, 16 bp, Homo sapiens
cactgtcactttgctc

SEQ ID NO: 5989535 - DNA, 23 bp, Homo sapiens
cactgtcagagctgttggcctcg

SEQ ID NO: 5989536 - DNA, 22 bp, Homo sapiens
cactgtcagcagggactgtaaa

SEQ ID NO: 5989537 - DNA, 20 bp, Homo sapiens
cactgtcagccctcactgtc

SEQ ID NO: 5989538 - DNA, 14 bp, Homo sapiens
cactgtcaggcctc

SEQ ID NO: 5989539 - DNA, 18 bp, Homo sapiens
cactgtcaggcctctgag

SEQ ID NO: 5989540 - DNA, 13 bp, Homo sapiens
cactgtcagtccc

SEQ ID NO: 5989541 - DNA, 20 bp, Homo sapiens
cactgtcataatctctttcc

SEQ ID NO: 5989542 - DNA, 13 bp, Homo sapiens
cactgtcatctgc

SEQ ID NO: 5989543 - DNA, 14 bp, Homo sapiens
cactgtcatctgcc

SEQ ID NO: 5989544 - DNA, 15 bp, Homo sapiens
cactgtcatctgcca

SEQ ID NO: 5989545 - DNA, 16 bp, Homo sapiens
cactgtcatctgccag

SEQ ID NO: 5989546 - DNA, 21 bp, Homo sapiens
cactgtcatgcccagcttgga

SEQ ID NO: 5989547 - DNA, 21 bp, Homo sapiens
cactgtccaatatgaaaaccg

SEQ ID NO: 5989548 - DNA, 13 bp, Homo sapiens
cactgtccaccac

SEQ ID NO: 5989549 - DNA, 13 bp, Homo sapiens
cactgtccagagt

SEQ ID NO: 5989550 - DNA, 15 bp, Homo sapiens
cactgtccagggccc

SEQ ID NO: 5989551 - DNA, 16 bp, Homo sapiens
cactgtccagggccca

SEQ ID NO: 5989552 - DNA, 20 bp, Homo sapiens
cactgtcccccaagaaacta

SEQ ID NO: 5989553 - DNA, 14 bp, Homo sapiens
cactgtccccctac

SEQ ID NO: 5989554 - DNA, 23 bp, Homo sapiens
cactgtccctaccactgagccct

SEQ ID NO: 5989555 - DNA, 23 bp, Homo sapiens
cactgtccctcaaatgacccaaa

SEQ ID NO: 5989556 - DNA, 15 bp, Homo sapiens
cactgtccctcctgg

SEQ ID NO: 5989557 - DNA, 18 bp, Homo sapiens
cactgtccctctttggca

SEQ ID NO: 5989558 - DNA, 22 bp, Homo sapiens
cactgtccctctttggcagttg

SEQ ID NO: 5989559 - DNA, 13 bp, Homo sapiens
cactgtccctgtc

SEQ ID NO: 5989560 - DNA, 18 bp, Homo sapiens
cactgtccgcctctgccc

SEQ ID NO: 5989561 - DNA, 14 bp, Homo sapiens
cactgtccgctgtc

SEQ ID NO: 5989562 - DNA, 17 bp, Homo sapiens
cactgtccgctgtctcc

SEQ ID NO: 5989563 - DNA, 20 bp, Homo sapiens
cactgtccgctgtctccctc

SEQ ID NO: 5989564 - DNA, 23 bp, Homo sapiens
cactgtccgctgtctccctcctg

SEQ ID NO: 5989565 - DNA, 17 bp, Homo sapiens
cactgtcctccaagcca

SEQ ID NO: 5989566 - DNA, 12 bp, Homo sapiens
cactgtcctgct

SEQ ID NO: 5989567 - DNA, 13 bp, Homo sapiens
cactgtcctgctc

SEQ ID NO: 5989568 - DNA, 21 bp, Homo sapiens
cactgtcctgctccacagtgt

SEQ ID NO: 5989569 - DNA, 13 bp, Homo sapiens
cactgtcctgggc

SEQ ID NO: 5989570 - DNA, 17 bp, Homo sapiens
cactgtccttccctgcc

SEQ ID NO: 5989571 - DNA, 19 bp, Homo sapiens
cactgtccttccctgccac

SEQ ID NO: 5989572 - DNA, 14 bp, Homo sapiens
cactgtcctttctc

SEQ ID NO: 5989573 - DNA, 19 bp, Homo sapiens
cactgtcgcccaggctgga

SEQ ID NO: 5989574 - DNA, 21 bp, Homo sapiens
cactgtctatttaagtgcaat

SEQ ID NO: 5989575 - DNA, 13 bp, Homo sapiens
cactgtctcaact

SEQ ID NO: 5989576 - DNA, 12 bp, Homo sapiens
cactgtctcagt

SEQ ID NO: 5989577 - DNA, 14 bp, Homo sapiens
cactgtctgaagca

SEQ ID NO: 5989578 - DNA, 18 bp, Homo sapiens
cactgtctgagagtttag

SEQ ID NO: 5989579 - DNA, 12 bp, Homo sapiens
cactgtctgcgt

SEQ ID NO: 5989580 - DNA, 13 bp, Homo sapiens
cactgtctggggc

SEQ ID NO: 5989581 - DNA, 11 bp, Homo sapiens
cactgtctgta

SEQ ID NO: 5989582 - DNA, 15 bp, Homo sapiens
cactgtctgtaccta

SEQ ID NO: 5989583 - DNA, 14 bp, Homo sapiens
cactgtctgttctg

SEQ ID NO: 5989584 - DNA, 18 bp, Homo sapiens
cactgtcttactcaagat

SEQ ID NO: 5989585 - DNA, 17 bp, Homo sapiens
cactgtcttgcagtgga

SEQ ID NO: 5989586 - DNA, 13 bp, Homo sapiens
cactgtcttttaa

SEQ ID NO: 5989587 - DNA, 16 bp, Homo sapiens
cactgtcttttaaaaa

SEQ ID NO: 5989588 - DNA, 20 bp, Homo sapiens
cactgtcttttaaaaaacaa

SEQ ID NO: 5989589 - DNA, 19 bp, Homo sapiens
cactgtgaaatttcatgat

SEQ ID NO: 5989590 - DNA, 22 bp, Homo sapiens
cactgtgaaccggctcccaccc

SEQ ID NO: 5989591 - DNA, 15 bp, Homo sapiens
cactgtgaactattt

SEQ ID NO: 5989592 - DNA, 19 bp, Homo sapiens
cactgtgaagacccagcag

SEQ ID NO: 5989593 - DNA, 20 bp, Homo sapiens
cactgtgaagacccagcagg

SEQ ID NO: 5989594 - DNA, 17 bp, Homo sapiens
cactgtgaatcctggca

SEQ ID NO: 5989595 - DNA, 18 bp, Homo sapiens
cactgtgaatcctggcaa

SEQ ID NO: 5989596 - DNA, 16 bp, Homo sapiens
cactgtgacacactac

SEQ ID NO: 5989597 - DNA, 22 bp, Homo sapiens
cactgtgacaccagaataatga

SEQ ID NO: 5989598 - DNA, 16 bp, Homo sapiens
cactgtgaccctgggt

SEQ ID NO: 5989599 - DNA, 18 bp, Homo sapiens
cactgtgacctgctcctg

SEQ ID NO: 5989600 - DNA, 19 bp, Homo sapiens
cactgtgagagttgtctct

SEQ ID NO: 5989601 - DNA, 21 bp, Homo sapiens
cactgtgagagttgtctctgt

SEQ ID NO: 5989602 - DNA, 17 bp, Homo sapiens
cactgtgaggggaaggc

SEQ ID NO: 5989603 - DNA, 16 bp, Homo sapiens
cactgtgatacagttt

SEQ ID NO: 5989604 - DNA, 19 bp, Homo sapiens
cactgtgatcaatattttt

SEQ ID NO: 5989605 - DNA, 21 bp, Homo sapiens
cactgtgattttgccctcctg

SEQ ID NO: 5989606 - DNA, 22 bp, Homo sapiens
cactgtgattttgccctcctgc

SEQ ID NO: 5989607 - DNA, 16 bp, Homo sapiens
cactgtgcaccaggca

SEQ ID NO: 5989608 - DNA, 13 bp, Homo sapiens
cactgtgcaggcc

SEQ ID NO: 5989609 - DNA, 18 bp, Homo sapiens
cactgtgcaggcccaggc

SEQ ID NO: 5989610 - DNA, 20 bp, Homo sapiens
cactgtgcaggcccaggcag

SEQ ID NO: 5989611 - DNA, 14 bp, Homo sapiens
cactgtgccatgtg

SEQ ID NO: 5989612 - DNA, 12 bp, Homo sapiens
cactgtgcccca

SEQ ID NO: 5989613 - DNA, 16 bp, Homo sapiens
cactgtgccctggtgg

SEQ ID NO: 5989614 - DNA, 20 bp, Homo sapiens
cactgtgcctcagagaccag

SEQ ID NO: 5989615 - DNA, 16 bp, Homo sapiens
cactgtgccttttccc

SEQ ID NO: 5989616 - DNA, 20 bp, Homo sapiens
cactgtgcgttttagagtat

SEQ ID NO: 5989617 - DNA, 18 bp, Homo sapiens
cactgtgctccaacctga

SEQ ID NO: 5989618 - DNA, 15 bp, Homo sapiens
cactgtgctgagtct

SEQ ID NO: 5989619 - DNA, 19 bp, Homo sapiens
cactgtgcttattttgttt

SEQ ID NO: 5989620 - DNA, 19 bp, Homo sapiens
cactgtgcttcgagccaac

SEQ ID NO: 5989621 - DNA, 21 bp, Homo sapiens
cactgtgcttgctcctaagca

SEQ ID NO: 5989622 - DNA, 15 bp, Homo sapiens
cactgtggaacacta

SEQ ID NO: 5989623 - DNA, 21 bp, Homo sapiens
cactgtggaactgccaccttg

SEQ ID NO: 5989624 - DNA, 20 bp, Homo sapiens
cactgtggaagtccctcaga

SEQ ID NO: 5989625 - DNA, 13 bp, Homo sapiens
cactgtggcagca

SEQ ID NO: 5989626 - DNA, 17 bp, Homo sapiens
cactgtggccacagccc

SEQ ID NO: 5989627 - DNA, 20 bp, Homo sapiens
cactgtggccacagccccct

SEQ ID NO: 5989628 - DNA, 16 bp, Homo sapiens
cactgtggccaggcct

SEQ ID NO: 5989629 - DNA, 12 bp, Homo sapiens
cactgtggcctt

SEQ ID NO: 5989630 - DNA, 17 bp, Homo sapiens
cactgtgggaaggccag

SEQ ID NO: 5989631 - DNA, 20 bp, Homo sapiens
cactgtgggaaggccagctg

SEQ ID NO: 5989632 - DNA, 21 bp, Homo sapiens
cactgtgggaaggccagctgc

SEQ ID NO: 5989633 - DNA, 20 bp, Homo sapiens
cactgtggggaaacaatttt

SEQ ID NO: 5989634 - DNA, 20 bp, Homo sapiens
cactgtggggcaagcctgag

SEQ ID NO: 5989635 - DNA, 18 bp, Homo sapiens
cactgtgggggctggtcc

SEQ ID NO: 5989636 - DNA, 22 bp, Homo sapiens
cactgtgggtagacacacatga

SEQ ID NO: 5989637 - DNA, 12 bp, Homo sapiens
cactgtgggtgt

SEQ ID NO: 5989638 - DNA, 20 bp, Homo sapiens
cactgtggtaaatgccacac

SEQ ID NO: 5989639 - DNA, 12 bp, Homo sapiens
cactgtggtcag

SEQ ID NO: 5989640 - DNA, 13 bp, Homo sapiens
cactgtggtcagg

SEQ ID NO: 5989641 - DNA, 22 bp, Homo sapiens
cactgtggtcgtcaactttcct

SEQ ID NO: 5989642 - DNA, 14 bp, Homo sapiens
cactgtggtgtctg

SEQ ID NO: 5989643 - DNA, 15 bp, Homo sapiens
cactgtggtgtctgt

SEQ ID NO: 5989644 - DNA, 20 bp, Homo sapiens
cactgtggttgcaaaaccca

SEQ ID NO: 5989645 - DNA, 22 bp, Homo sapiens
cactgtgtaaccagcagtcaca

SEQ ID NO: 5989646 - DNA, 15 bp, Homo sapiens
cactgtgtataggaa

SEQ ID NO: 5989647 - DNA, 13 bp, Homo sapiens
cactgtgtatatt

SEQ ID NO: 5989648 - DNA, 14 bp, Homo sapiens
cactgtgtatattt

SEQ ID NO: 5989649 - DNA, 16 bp, Homo sapiens
cactgtgtatatttga

SEQ ID NO: 5989650 - DNA, 13 bp, Homo sapiens
cactgtgtcacat

SEQ ID NO: 5989651 - DNA, 16 bp, Homo sapiens
cactgtgtcccagtgt

SEQ ID NO: 5989652 - DNA, 17 bp, Homo sapiens
cactgtgtcccagtgtc

SEQ ID NO: 5989653 - DNA, 17 bp, Homo sapiens
cactgtgtcctggtgct

SEQ ID NO: 5989654 - DNA, 12 bp, Homo sapiens
cactgtgtgaat

SEQ ID NO: 5989655 - DNA, 13 bp, Homo sapiens
cactgtgtgcctt

SEQ ID NO: 5989656 - DNA, 16 bp, Homo sapiens
cactgtgtgccttctg

SEQ ID NO: 5989657 - DNA, 15 bp, Homo sapiens
cactgtgtgctattt

SEQ ID NO: 5989658 - DNA, 18 bp, Homo sapiens
cactgtgtgctgactgaa

SEQ ID NO: 5989659 - DNA, 19 bp, Homo sapiens
cactgtgtgtttgggaagg

SEQ ID NO: 5989660 - DNA, 16 bp, Homo sapiens
cactgtgttactgctt

SEQ ID NO: 5989661 - DNA, 15 bp, Homo sapiens
cactgtgttgcccag

SEQ ID NO: 5989662 - DNA, 19 bp, Homo sapiens
cactgtgttgcccaggctg

SEQ ID NO: 5989663 - DNA, 15 bp, Homo sapiens
cactgtgtttctgtg

SEQ ID NO: 5989664 - DNA, 19 bp, Homo sapiens
cactgtgtttctgtgctcc

SEQ ID NO: 5989665 - DNA, 22 bp, Homo sapiens
cactgtgtttctgtgctccaag

SEQ ID NO: 5989666 - DNA, 18 bp, Homo sapiens
cactgttaatacacagta

SEQ ID NO: 5989667 - DNA, 17 bp, Homo sapiens
cactgttactccacagc

SEQ ID NO: 5989668 - DNA, 21 bp, Homo sapiens
cactgttactttttagtcttt

SEQ ID NO: 5989669 - DNA, 13 bp, Homo sapiens
cactgttagaaca

SEQ ID NO: 5989670 - DNA, 14 bp, Homo sapiens
cactgttagaacac

SEQ ID NO: 5989671 - DNA, 20 bp, Homo sapiens
cactgttagaacactatttt

SEQ ID NO: 5989672 - DNA, 23 bp, Homo sapiens
cactgttagaacactattttcag

SEQ ID NO: 5989673 - DNA, 22 bp, Homo sapiens
cactgttataaattttgtacat

SEQ ID NO: 5989674 - DNA, 15 bp, Homo sapiens
cactgttcagcggag

SEQ ID NO: 5989675 - DNA, 22 bp, Homo sapiens
cactgttcaggagtccaaacct

SEQ ID NO: 5989676 - DNA, 18 bp, Homo sapiens
caataacttctatatttt

SEQ ID NO: 5989677 - DNA, 18 bp, Homo sapiens
caataacttctatgttgg

SEQ ID NO: 5989678 - DNA, 13 bp, Homo sapiens
caataacttctga

SEQ ID NO: 5989679 - DNA, 16 bp, Homo sapiens
caataacttctgacct

SEQ ID NO: 5989680 - DNA, 14 bp, Homo sapiens
caataagaaacagt

SEQ ID NO: 5989681 - DNA, 15 bp, Homo sapiens
caataagaaacagtt

SEQ ID NO: 5989682 - DNA, 22 bp, Homo sapiens
caataagaaacagtttaacaga

SEQ ID NO: 5989683 - DNA, 13 bp, Homo sapiens
caataagaaatga

SEQ ID NO: 5989684 - DNA, 17 bp, Homo sapiens
caataagaaatgaacaa

SEQ ID NO: 5989685 - DNA, 21 bp, Homo sapiens
caataagaaatgaacaaaaga

SEQ ID NO: 5989686 - DNA, 20 bp, Homo sapiens
caataagaatttagggagaa

SEQ ID NO: 5989687 - DNA, 20 bp, Homo sapiens
caataagagtctccttctct

SEQ ID NO: 5989688 - DNA, 20 bp, Homo sapiens
caataagattggtgttcgtt

SEQ ID NO: 5989689 - DNA, 19 bp, Homo sapiens
caataagcatcaaactctt

SEQ ID NO: 5989690 - DNA, 22 bp, Homo sapiens
caataagctggactagtgtcct

SEQ ID NO: 5989691 - DNA, 21 bp, Homo sapiens
caataaggatttattctcaga

SEQ ID NO: 5989692 - DNA, 23 bp, Homo sapiens
caataaggtcaagggaaaacccc

SEQ ID NO: 5989693 - DNA, 18 bp, Homo sapiens
caataaggtcaatgccag

SEQ ID NO: 5989694 - DNA, 21 bp, Homo sapiens
caataagtacttatctttatt

SEQ ID NO: 5989695 - DNA, 21 bp, Homo sapiens
caataagtgtgtggtagaaac

SEQ ID NO: 5989696 - DNA, 23 bp, Homo sapiens
caataagtgtgtggtagaaacaa

SEQ ID NO: 5989697 - DNA, 20 bp, Homo sapiens
caataagtgttgtaccatat

SEQ ID NO: 5989698 - DNA, 12 bp, Homo sapiens
caataagttact

SEQ ID NO: 5989699 - DNA, 16 bp, Homo sapiens
caataagttcattaaa

SEQ ID NO: 5989700 - DNA, 21 bp, Homo sapiens
caataagtttgaacctttttt

SEQ ID NO: 5989701 - DNA, 24 bp, Homo sapiens
caataataaaaaatattcttgtca

SEQ ID NO: 5989702 - DNA, 13 bp, Homo sapiens
caataataaagac

SEQ ID NO: 5989703 - DNA, 13 bp, Homo sapiens
caataataaagat

SEQ ID NO: 5989704 - DNA, 15 bp, Homo sapiens
caataataaagatgt

SEQ ID NO: 5989705 - DNA, 20 bp, Homo sapiens
caataataaagatgtgaaaa

SEQ ID NO: 5989706 - DNA, 16 bp, Homo sapiens
caataataattaaaga

SEQ ID NO: 5989707 - DNA, 23 bp, Homo sapiens
caataatagctagctattactgc

SEQ ID NO: 5989708 - DNA, 21 bp, Homo sapiens
caataatataataatagttat

SEQ ID NO: 5989709 - DNA, 16 bp, Homo sapiens
caataatatattttct

SEQ ID NO: 5989710 - DNA, 17 bp, Homo sapiens
caataatatcaaaacaa

SEQ ID NO: 5989711 - DNA, 21 bp, Homo sapiens
caataatattgttgtataatt

SEQ ID NO: 5989712 - DNA, 23 bp, Homo sapiens
caataatattgttgtataatttc

SEQ ID NO: 5989713 - DNA, 17 bp, Homo sapiens
caataatatttcaagtg

SEQ ID NO: 5989714 - DNA, 13 bp, Homo sapiens
caataatcagaaa

SEQ ID NO: 5989715 - DNA, 17 bp, Homo sapiens
caataatctctatttga

SEQ ID NO: 5989716 - DNA, 14 bp, Homo sapiens
caataatgaataat

SEQ ID NO: 5989717 - DNA, 18 bp, Homo sapiens
caataatgatcaaagttt

SEQ ID NO: 5989718 - DNA, 11 bp, Homo sapiens
caataatgcag

SEQ ID NO: 5989719 - DNA, 13 bp, Homo sapiens
caataatgcagta

SEQ ID NO: 5989720 - DNA, 17 bp, Homo sapiens
caataatgcagtatggt

SEQ ID NO: 5989721 - DNA, 16 bp, Homo sapiens
caataatggaaaaaaa

SEQ ID NO: 5989722 - DNA, 23 bp, Homo sapiens
caataatggaaaaaaaaaaaaga

SEQ ID NO: 5989723 - DNA, 19 bp, Homo sapiens
caataatggggcagacaca

SEQ ID NO: 5989724 - DNA, 18 bp, Homo sapiens
caataatggtcccatcca

SEQ ID NO: 5989725 - DNA, 19 bp, Homo sapiens
caataatggtcccatccag

SEQ ID NO: 5989726 - DNA, 23 bp, Homo sapiens
caataatggtcccatccaggcag

SEQ ID NO: 5989727 - DNA, 17 bp, Homo sapiens
caataatgtaatttagt

SEQ ID NO: 5989728 - DNA, 20 bp, Homo sapiens
caataatgtgcaaattttgc

SEQ ID NO: 5989729 - DNA, 22 bp, Homo sapiens
caataatgtgcaaattttgcat

SEQ ID NO: 5989730 - DNA, 17 bp, Homo sapiens
caataattaggatctat

SEQ ID NO: 5989731 - DNA, 20 bp, Homo sapiens
caataattaggatctatgca

SEQ ID NO: 5989732 - DNA, 14 bp, Homo sapiens
caataattcatcaa

SEQ ID NO: 5989733 - DNA, 15 bp, Homo sapiens
caataattgtggaga

SEQ ID NO: 5989734 - DNA, 22 bp, Homo sapiens
caataattgtggagaggagaga

SEQ ID NO: 5989735 - DNA, 15 bp, Homo sapiens
caataattgtttcca

SEQ ID NO: 5989736 - DNA, 22 bp, Homo sapiens
caataatttaaatattttttaa

SEQ ID NO: 5989737 - DNA, 22 bp, Homo sapiens
caataatttcaggttttgtaaa

SEQ ID NO: 5989738 - DNA, 18 bp, Homo sapiens
caataatttgtacaatgg

SEQ ID NO: 5989739 - DNA, 20 bp, Homo sapiens
caataattttcctgtgacac

SEQ ID NO: 5989740 - DNA, 13 bp, Homo sapiens
caatacaaaatgt

SEQ ID NO: 5989741 - DNA, 22 bp, Homo sapiens
caatacaaattgaggacttaat

SEQ ID NO: 5989742 - DNA, 15 bp, Homo sapiens
caatacaacaagaac

SEQ ID NO: 5989743 - DNA, 19 bp, Homo sapiens
caatacaccttccccaccc

SEQ ID NO: 5989744 - DNA, 17 bp, Homo sapiens
caatacactagttgttt

SEQ ID NO: 5989745 - DNA, 17 bp, Homo sapiens
caatacagaattgactg

SEQ ID NO: 5989746 - DNA, 15 bp, Homo sapiens
caatacagatatatt

SEQ ID NO: 5989747 - DNA, 14 bp, Homo sapiens
caatacagcttcat

SEQ ID NO: 5989748 - DNA, 12 bp, Homo sapiens
caatacagggag

SEQ ID NO: 5989749 - DNA, 13 bp, Homo sapiens
caatacagggagg

SEQ ID NO: 5989750 - DNA, 18 bp, Homo sapiens
caatacagtacaggcagc

SEQ ID NO: 5989751 - DNA, 21 bp, Homo sapiens
caatacagtattatagacaaa

SEQ ID NO: 5989752 - DNA, 21 bp, Homo sapiens
caatacatatatctacacata

SEQ ID NO: 5989753 - DNA, 23 bp, Homo sapiens
caatacattgaacacatttcctt

SEQ ID NO: 5989754 - DNA, 13 bp, Homo sapiens
caatacatttgta

SEQ ID NO: 5989755 - DNA, 16 bp, Homo sapiens
caatacatttgtattt

SEQ ID NO: 5989756 - DNA, 17 bp, Homo sapiens
caataccagatcactca

SEQ ID NO: 5989757 - DNA, 21 bp, Homo sapiens
caatacccctagtatctggct

SEQ ID NO: 5989758 - DNA, 23 bp, Homo sapiens
caatacccctagtatctggctgg

SEQ ID NO: 5989759 - DNA, 15 bp, Homo sapiens
caataccctactgtg

SEQ ID NO: 5989760 - DNA, 20 bp, Homo sapiens
caataccctagaagaaaacc

SEQ ID NO: 5989761 - DNA, 19 bp, Homo sapiens
caataccctgtaaaaatac

SEQ ID NO: 5989762 - DNA, 13 bp, Homo sapiens
caatacccttggc

SEQ ID NO: 5989763 - DNA, 17 bp, Homo sapiens
caataccgctcagtatt

SEQ ID NO: 5989764 - DNA, 14 bp, Homo sapiens
caatacctcttgga

SEQ ID NO: 5989765 - DNA, 19 bp, Homo sapiens
caatacctggcctcattta

SEQ ID NO: 5989766 - DNA, 14 bp, Homo sapiens
caatacctgtacta

SEQ ID NO: 5989767 - DNA, 13 bp, Homo sapiens
caataccttcaag

SEQ ID NO: 5989768 - DNA, 17 bp, Homo sapiens
caataccttttttttca

SEQ ID NO: 5989769 - DNA, 18 bp, Homo sapiens
caatactaattgagaaac

SEQ ID NO: 5989770 - DNA, 15 bp, Homo sapiens
caatactactgtaaa

SEQ ID NO: 5989771 - DNA, 17 bp, Homo sapiens
caatactactgtaaatg

SEQ ID NO: 5989772 - DNA, 14 bp, Homo sapiens
caatactaggaagt

SEQ ID NO: 5989773 - DNA, 23 bp, Homo sapiens
caatactaggaagtaaagtgaag

SEQ ID NO: 5989774 - DNA, 18 bp, Homo sapiens
caatactcataatgtgaa

SEQ ID NO: 5989775 - DNA, 13 bp, Homo sapiens
caatactcccttt

SEQ ID NO: 5989776 - DNA, 13 bp, Homo sapiens
caatactctctga

SEQ ID NO: 5989777 - DNA, 23 bp, Homo sapiens
caatactgagtgcctgcagcatc

SEQ ID NO: 5989778 - DNA, 20 bp, Homo sapiens
caatactgttgcccttttcc

SEQ ID NO: 5989779 - DNA, 21 bp, Homo sapiens
caatacttacatatctgactt

SEQ ID NO: 5989780 - DNA, 16 bp, Homo sapiens
caatacttaggaggct

SEQ ID NO: 5989781 - DNA, 14 bp, Homo sapiens
caatacttcatgat

SEQ ID NO: 5989782 - DNA, 17 bp, Homo sapiens
caatacttttgtccaat

SEQ ID NO: 5989783 - DNA, 22 bp, Homo sapiens
caatacttttgtccaatgtggt

SEQ ID NO: 5989784 - DNA, 12 bp, Homo sapiens
caatagaaacaa

SEQ ID NO: 5989785 - DNA, 13 bp, Homo sapiens
caatagaaagcaa

SEQ ID NO: 5989786 - DNA, 12 bp, Homo sapiens
caatagaatggg

SEQ ID NO: 5989787 - DNA, 13 bp, Homo sapiens
caatagacagaaa

SEQ ID NO: 5989788 - DNA, 22 bp, Homo sapiens
caatagactgaagagaccacag

SEQ ID NO: 5989789 - DNA, 23 bp, Homo sapiens
caatagactgtacttattttcca

SEQ ID NO: 5989790 - DNA, 16 bp, Homo sapiens
caatagagactgtaga

SEQ ID NO: 5989791 - DNA, 22 bp, Homo sapiens
caatagagactgtagattgctt

SEQ ID NO: 5989792 - DNA, 22 bp, Homo sapiens
caatagagggccacggggaggc

SEQ ID NO: 5989793 - DNA, 19 bp, Homo sapiens
caatagatatttacctttt

SEQ ID NO: 5989794 - DNA, 18 bp, Homo sapiens
caatagattactgatgtg

SEQ ID NO: 5989795 - DNA, 19 bp, Homo sapiens
caatagcaacgtagcttct

SEQ ID NO: 5989796 - DNA, 17 bp, Homo sapiens
caatagcacatatggaa

SEQ ID NO: 5989797 - DNA, 23 bp, Homo sapiens
caatagcactttcattgccagtg

SEQ ID NO: 5989798 - DNA, 19 bp, Homo sapiens
caatagcagttataacaga

SEQ ID NO: 5989799 - DNA, 21 bp, Homo sapiens
caatagcagttataacagatg

SEQ ID NO: 5989800 - DNA, 16 bp, Homo sapiens
caatagcattgttctt

SEQ ID NO: 5989801 - DNA, 21 bp, Homo sapiens
caatagcccaggatatatttt

SEQ ID NO: 5989802 - DNA, 15 bp, Homo sapiens
caatagcctgaattt

SEQ ID NO: 5989803 - DNA, 18 bp, Homo sapiens
caatagcgtgtgtagata

SEQ ID NO: 5989804 - DNA, 17 bp, Homo sapiens
caatagctattgcatgt

SEQ ID NO: 5989805 - DNA, 21 bp, Homo sapiens
caatagctattgcatgtaaaa

SEQ ID NO: 5989806 - DNA, 16 bp, Homo sapiens
caatagctccaagctg

SEQ ID NO: 5989807 - DNA, 19 bp, Homo sapiens
caatagctccaagctgtta

SEQ ID NO: 5989808 - DNA, 21 bp, Homo sapiens
caatagctccaagctgttaaa

SEQ ID NO: 5989809 - DNA, 18 bp, Homo sapiens
caatagctttaccctcag

SEQ ID NO: 5989810 - DNA, 23 bp, Homo sapiens
caatagctttaccctcaggcata

SEQ ID NO: 5989811 - DNA, 13 bp, Homo sapiens
caataggaaaaac

SEQ ID NO: 5989812 - DNA, 14 bp, Homo sapiens
caataggaaaaact

SEQ ID NO: 5989813 - DNA, 18 bp, Homo sapiens
caataggaaaaactgatt

SEQ ID NO: 5989814 - DNA, 21 bp, Homo sapiens
caataggaaaaactgattttt

SEQ ID NO: 5989815 - DNA, 13 bp, Homo sapiens
caataggaaagca

SEQ ID NO: 5989816 - DNA, 19 bp, Homo sapiens
caataggcaaaagtgtaac

SEQ ID NO: 5989817 - DNA, 23 bp, Homo sapiens
caataggcaaaggggggaaggga

SEQ ID NO: 5989818 - DNA, 17 bp, Homo sapiens
caataggcaaattaatc

SEQ ID NO: 5989819 - DNA, 22 bp, Homo sapiens
caataggcagactgggtttcta

SEQ ID NO: 5989820 - DNA, 14 bp, Homo sapiens
caataggcttagtg

SEQ ID NO: 5989821 - DNA, 17 bp, Homo sapiens
caatagggctaaatgtt

SEQ ID NO: 5989822 - DNA, 15 bp, Homo sapiens
caatagggttaaatg

SEQ ID NO: 5989823 - DNA, 19 bp, Homo sapiens
caataggtggaaagagaaa

SEQ ID NO: 5989824 - DNA, 17 bp, Homo sapiens
caataggtttgtaaaat

SEQ ID NO: 5989825 - DNA, 19 bp, Homo sapiens
caatagtattaactattag

SEQ ID NO: 5989826 - DNA, 18 bp, Homo sapiens
caatagtatttctccttt

SEQ ID NO: 5989827 - DNA, 22 bp, Homo sapiens
caatagtatttctcctttgcaa

SEQ ID NO: 5989828 - DNA, 16 bp, Homo sapiens
caatagtcatatgtga

SEQ ID NO: 5989829 - DNA, 19 bp, Homo sapiens
caatagtcattaaaaacat

SEQ ID NO: 5989830 - DNA, 17 bp, Homo sapiens
caatagtccccatcagc

SEQ ID NO: 5989831 - DNA, 20 bp, Homo sapiens
caatagtgcaacatctctga

SEQ ID NO: 5989832 - DNA, 21 bp, Homo sapiens
caatagtgcaacatctctgaa

SEQ ID NO: 5989833 - DNA, 20 bp, Homo sapiens
caatagtgcaactgttttga

SEQ ID NO: 5989834 - DNA, 15 bp, Homo sapiens
caatagttcttaaaa

SEQ ID NO: 5989835 - DNA, 18 bp, Homo sapiens
caatagttttagattatt

SEQ ID NO: 5989836 - DNA, 16 bp, Homo sapiens
caatagttttttactt

SEQ ID NO: 5989837 - DNA, 17 bp, Homo sapiens
caatataaaaatgtgaa

SEQ ID NO: 5989838 - DNA, 20 bp, Homo sapiens
caatataaaactgtacttca

SEQ ID NO: 5989839 - DNA, 22 bp, Homo sapiens
caatataaaactgtacttcact

SEQ ID NO: 5989840 - DNA, 21 bp, Homo sapiens
caatataaccaatgtttaaaa

SEQ ID NO: 5989841 - DNA, 23 bp, Homo sapiens
caatataactatgtggctgaaaa

SEQ ID NO: 5989842 - DNA, 14 bp, Homo sapiens
caatataagaagca

SEQ ID NO: 5989843 - DNA, 22 bp, Homo sapiens
caatataagcataaaagatcac

SEQ ID NO: 5989844 - DNA, 21 bp, Homo sapiens
caatataatctttgaatttct

SEQ ID NO: 5989845 - DNA, 22 bp, Homo sapiens
caatatacaactgtaaagcaaa

SEQ ID NO: 5989846 - DNA, 15 bp, Homo sapiens
caatataccatgaca

SEQ ID NO: 5989847 - DNA, 17 bp, Homo sapiens
caatatacgaaaagcca

SEQ ID NO: 5989848 - DNA, 20 bp, Homo sapiens
caatatagttttttctttcc

SEQ ID NO: 5989849 - DNA, 20 bp, Homo sapiens
caatatataaaaatatatat

SEQ ID NO: 5989850 - DNA, 20 bp, Homo sapiens
caatatatagctggcaagaa

SEQ ID NO: 5989851 - DNA, 13 bp, Homo sapiens
caatatatattat

SEQ ID NO: 5989852 - DNA, 19 bp, Homo sapiens
cactgttcatgctggcgag

SEQ ID NO: 5989853 - DNA, 20 bp, Homo sapiens
cactgttccagcctgccctc

SEQ ID NO: 5989854 - DNA, 17 bp, Homo sapiens
cactgttccccctgtgc

SEQ ID NO: 5989855 - DNA, 20 bp, Homo sapiens
cactgttccctctggcttcc

SEQ ID NO: 5989856 - DNA, 15 bp, Homo sapiens
cactgttctctgccc

SEQ ID NO: 5989857 - DNA, 19 bp, Homo sapiens
cactgttctgattatgtaa

SEQ ID NO: 5989858 - DNA, 14 bp, Homo sapiens
cactgttctgcaaa

SEQ ID NO: 5989859 - DNA, 13 bp, Homo sapiens
cactgttgaattt

SEQ ID NO: 5989860 - DNA, 17 bp, Homo sapiens
cactgttgaattttctc

SEQ ID NO: 5989861 - DNA, 16 bp, Homo sapiens
cactgttgagccccag

SEQ ID NO: 5989862 - DNA, 17 bp, Homo sapiens
cactgttgagccccagt

SEQ ID NO: 5989863 - DNA, 23 bp, Homo sapiens
cactgttgagccccagtgctgga

SEQ ID NO: 5989864 - DNA, 23 bp, Homo sapiens
cactgttgagttctgattgtgtt

SEQ ID NO: 5989865 - DNA, 14 bp, Homo sapiens
cactgttgatgtat

SEQ ID NO: 5989866 - DNA, 20 bp, Homo sapiens
cactgttgcagtggcctggc

SEQ ID NO: 5989867 - DNA, 23 bp, Homo sapiens
cactgttgcccaggctggcgtgc

SEQ ID NO: 5989868 - DNA, 16 bp, Homo sapiens
cactgttgccttttaa

SEQ ID NO: 5989869 - DNA, 23 bp, Homo sapiens
cactgttgccttttaaaacctct

SEQ ID NO: 5989870 - DNA, 23 bp, Homo sapiens
cactgttggaatgtatgctaatt

SEQ ID NO: 5989871 - DNA, 22 bp, Homo sapiens
cactgttgggtgggtgggccct

SEQ ID NO: 5989872 - DNA, 22 bp, Homo sapiens
cactgttggtgttcggagctct

SEQ ID NO: 5989873 - DNA, 17 bp, Homo sapiens
cactgtttacaagaaaa

SEQ ID NO: 5989874 - DNA, 19 bp, Homo sapiens
cactgtttatacactgtgt

SEQ ID NO: 5989875 - DNA, 21 bp, Homo sapiens
cactgtttatacactgtgtaa

SEQ ID NO: 5989876 - DNA, 22 bp, Homo sapiens
cactgtttcactactcagcatg

SEQ ID NO: 5989877 - DNA, 17 bp, Homo sapiens
cactgtttcatctcagc

SEQ ID NO: 5989878 - DNA, 18 bp, Homo sapiens
cactgtttcatgagccca

SEQ ID NO: 5989879 - DNA, 15 bp, Homo sapiens
cactgtttccatgtt

SEQ ID NO: 5989880 - DNA, 13 bp, Homo sapiens
cactgtttcctga

SEQ ID NO: 5989881 - DNA, 14 bp, Homo sapiens
cactgtttcctggg

SEQ ID NO: 5989882 - DNA, 15 bp, Homo sapiens
cactgtttcctgggc

SEQ ID NO: 5989883 - DNA, 14 bp, Homo sapiens
cactgtttctctgc

SEQ ID NO: 5989884 - DNA, 15 bp, Homo sapiens
cactgtttcttgctt

SEQ ID NO: 5989885 - DNA, 23 bp, Homo sapiens
cactgtttgtttttaaaaagcaa

SEQ ID NO: 5989886 - DNA, 18 bp, Homo sapiens
cactgttttatctctgtg

SEQ ID NO: 5989887 - DNA, 20 bp, Homo sapiens
cactgtttttattccttcca

SEQ ID NO: 5989888 - DNA, 16 bp, Homo sapiens
cacttaaaacacgttt

SEQ ID NO: 5989889 - DNA, 13 bp, Homo sapiens
cacttaaaagatg

SEQ ID NO: 5989890 - DNA, 23 bp, Homo sapiens
cacttaaacaatgtcctctttga

SEQ ID NO: 5989891 - DNA, 21 bp, Homo sapiens
cacttaaacgaagagttccct

SEQ ID NO: 5989892 - DNA, 17 bp, Homo sapiens
cacttaaacttgcacat

SEQ ID NO: 5989893 - DNA, 18 bp, Homo sapiens
cacttaaacttgcacatt

SEQ ID NO: 5989894 - DNA, 21 bp, Homo sapiens
cacttaaactttgtcacttct

SEQ ID NO: 5989895 - DNA, 12 bp, Homo sapiens
cacttaaagttt

SEQ ID NO: 5989896 - DNA, 21 bp, Homo sapiens
cacttaacattcctaaaatgc

SEQ ID NO: 5989897 - DNA, 21 bp, Homo sapiens
cacttaagactgtgtattcta

SEQ ID NO: 5989898 - DNA, 15 bp, Homo sapiens
cacttaagagaatat

SEQ ID NO: 5989899 - DNA, 12 bp, Homo sapiens
cacttaagcctg

SEQ ID NO: 5989900 - DNA, 18 bp, Homo sapiens
cacttaagtcttccttaa

SEQ ID NO: 5989901 - DNA, 16 bp, Homo sapiens
cacttaagtgcacttt

SEQ ID NO: 5989902 - DNA, 18 bp, Homo sapiens
cacttaagtgcacttttt

SEQ ID NO: 5989903 - DNA, 19 bp, Homo sapiens
cacttaagtgcactttttt

SEQ ID NO: 5989904 - DNA, 16 bp, Homo sapiens
cacttaatagcaacag

SEQ ID NO: 5989905 - DNA, 21 bp, Homo sapiens
cacttaatagcaacagagcac

SEQ ID NO: 5989906 - DNA, 21 bp, Homo sapiens
cacttaatattagcttgctta

SEQ ID NO: 5989907 - DNA, 13 bp, Homo sapiens
cacttaatcattt

SEQ ID NO: 5989908 - DNA, 11 bp, Homo sapiens
cacttaatctt

SEQ ID NO: 5989909 - DNA, 13 bp, Homo sapiens
cacttaatcttct

SEQ ID NO: 5989910 - DNA, 14 bp, Homo sapiens
cacttaatcttctc

SEQ ID NO: 5989911 - DNA, 20 bp, Homo sapiens
cacttaatcttctctcttga

SEQ ID NO: 5989912 - DNA, 12 bp, Homo sapiens
cacttaatgaac

SEQ ID NO: 5989913 - DNA, 21 bp, Homo sapiens
cacttaattacagttaaagaa

SEQ ID NO: 5989914 - DNA, 17 bp, Homo sapiens
cacttaatttgaaatct

SEQ ID NO: 5989915 - DNA, 18 bp, Homo sapiens
cacttaatttgtaaactt

SEQ ID NO: 5989916 - DNA, 17 bp, Homo sapiens
cacttacaagaaaggcc

SEQ ID NO: 5989917 - DNA, 18 bp, Homo sapiens
cacttacaagtaatgaat

SEQ ID NO: 5989918 - DNA, 17 bp, Homo sapiens
cacttacagttaggatt

SEQ ID NO: 5989919 - DNA, 14 bp, Homo sapiens
cacttacatttttg

SEQ ID NO: 5989920 - DNA, 18 bp, Homo sapiens
cacttaccctgggctgga

SEQ ID NO: 5989921 - DNA, 13 bp, Homo sapiens
cacttacctgctt

SEQ ID NO: 5989922 - DNA, 17 bp, Homo sapiens
cacttacctgcttgagc

SEQ ID NO: 5989923 - DNA, 13 bp, Homo sapiens
cacttaccttcaa

SEQ ID NO: 5989924 - DNA, 17 bp, Homo sapiens
cacttacgtttgtcctt

SEQ ID NO: 5989925 - DNA, 14 bp, Homo sapiens
cacttactcttaca

SEQ ID NO: 5989926 - DNA, 19 bp, Homo sapiens
cacttactgtaagacatta

SEQ ID NO: 5989927 - DNA, 15 bp, Homo sapiens
cacttactgtttctg

SEQ ID NO: 5989928 - DNA, 20 bp, Homo sapiens
cacttactgtttctgtcagg

SEQ ID NO: 5989929 - DNA, 22 bp, Homo sapiens
cacttacttcgtgcgcaacaac

SEQ ID NO: 5989930 - DNA, 15 bp, Homo sapiens
cacttacttgggagg

SEQ ID NO: 5989931 - DNA, 21 bp, Homo sapiens
cacttactttttctggtctct

SEQ ID NO: 5989932 - DNA, 16 bp, Homo sapiens
cacttagacctgccag

SEQ ID NO: 5989933 - DNA, 17 bp, Homo sapiens
cacttagacctgccagc

SEQ ID NO: 5989934 - DNA, 17 bp, Homo sapiens
cacttagccattgaaat

SEQ ID NO: 5989935 - DNA, 23 bp, Homo sapiens
cacttagcccaagaggtctgagc

SEQ ID NO: 5989936 - DNA, 15 bp, Homo sapiens
cacttagccgcaccc

SEQ ID NO: 5989937 - DNA, 17 bp, Homo sapiens
cacttagccgcaccctg

SEQ ID NO: 5989938 - DNA, 23 bp, Homo sapiens
cacttagggagtgtgccttgggc

SEQ ID NO: 5989939 - DNA, 17 bp, Homo sapiens
cacttaggttttgtcca

SEQ ID NO: 5989940 - DNA, 13 bp, Homo sapiens
cacttagtatttt

SEQ ID NO: 5989941 - DNA, 20 bp, Homo sapiens
cacttagtattttaaaaaat

SEQ ID NO: 5989942 - DNA, 13 bp, Homo sapiens
cacttagtccact

SEQ ID NO: 5989943 - DNA, 21 bp, Homo sapiens
cacttagtgatcatttaaaaa

SEQ ID NO: 5989944 - DNA, 14 bp, Homo sapiens
cacttatagcctct

SEQ ID NO: 5989945 - DNA, 14 bp, Homo sapiens
cacttatattttat

SEQ ID NO: 5989946 - DNA, 15 bp, Homo sapiens
cacttatcagcatga

SEQ ID NO: 5989947 - DNA, 17 bp, Homo sapiens
cacttatcagcatgaag

SEQ ID NO: 5989948 - DNA, 14 bp, Homo sapiens
cacttatcttctgg

SEQ ID NO: 5989949 - DNA, 17 bp, Homo sapiens
cacttatcttctggatt

SEQ ID NO: 5989950 - DNA, 20 bp, Homo sapiens
cacttatgctgctgtgaatt

SEQ ID NO: 5989951 - DNA, 22 bp, Homo sapiens
cacttatgtacttgatactgaa

SEQ ID NO: 5989952 - DNA, 23 bp, Homo sapiens
cacttatgttactggtgtccagc

SEQ ID NO: 5989953 - DNA, 16 bp, Homo sapiens
cacttattattaataa

SEQ ID NO: 5989954 - DNA, 15 bp, Homo sapiens
cacttattgaatata

SEQ ID NO: 5989955 - DNA, 15 bp, Homo sapiens
cacttattgtcccct

SEQ ID NO: 5989956 - DNA, 14 bp, Homo sapiens
cacttatttatgaa

SEQ ID NO: 5989957 - DNA, 15 bp, Homo sapiens
cacttatttatgaat

SEQ ID NO: 5989958 - DNA, 21 bp, Homo sapiens
cacttatttattgttgccttt

SEQ ID NO: 5989959 - DNA, 22 bp, Homo sapiens
cacttatttattgttgcctttt

SEQ ID NO: 5989960 - DNA, 12 bp, Homo sapiens
cacttatttcac

SEQ ID NO: 5989961 - DNA, 19 bp, Homo sapiens
cacttatttcactatcttc

SEQ ID NO: 5989962 - DNA, 21 bp, Homo sapiens
cacttatttcactatcttctt

SEQ ID NO: 5989963 - DNA, 13 bp, Homo sapiens
cacttatttctaa

SEQ ID NO: 5989964 - DNA, 15 bp, Homo sapiens
cacttatttctaaat

SEQ ID NO: 5989965 - DNA, 22 bp, Homo sapiens
cacttattttacacagcaattt

SEQ ID NO: 5989966 - DNA, 20 bp, Homo sapiens
cacttattttttaatgtgag

SEQ ID NO: 5989967 - DNA, 13 bp, Homo sapiens
cacttcaaaacaa

SEQ ID NO: 5989968 - DNA, 21 bp, Homo sapiens
cacttcaaacatgccctcagg

SEQ ID NO: 5989969 - DNA, 13 bp, Homo sapiens
cacttcaaccccc

SEQ ID NO: 5989970 - DNA, 20 bp, Homo sapiens
cacttcaacccccagctaat

SEQ ID NO: 5989971 - DNA, 13 bp, Homo sapiens
cacttcaagcaaa

SEQ ID NO: 5989972 - DNA, 21 bp, Homo sapiens
cacttcaagcaaagacagttt

SEQ ID NO: 5989973 - DNA, 15 bp, Homo sapiens
cacttcaatgcacat

SEQ ID NO: 5989974 - DNA, 18 bp, Homo sapiens
cacttcacacacaggcaa

SEQ ID NO: 5989975 - DNA, 19 bp, Homo sapiens
cacttcacagagtgtgctg

SEQ ID NO: 5989976 - DNA, 14 bp, Homo sapiens
cacttcacccccaa

SEQ ID NO: 5989977 - DNA, 18 bp, Homo sapiens
cacttcacccccaacttc

SEQ ID NO: 5989978 - DNA, 16 bp, Homo sapiens
cacttcaccttctgta

SEQ ID NO: 5989979 - DNA, 12 bp, Homo sapiens
cacttcactgtg

SEQ ID NO: 5989980 - DNA, 19 bp, Homo sapiens
cacttcagacacaggaaaa

SEQ ID NO: 5989981 - DNA, 19 bp, Homo sapiens
cacttcagagtagagggct

SEQ ID NO: 5989982 - DNA, 12 bp, Homo sapiens
cacttcagatct

SEQ ID NO: 5989983 - DNA, 13 bp, Homo sapiens
cacttcaggagcc

SEQ ID NO: 5989984 - DNA, 16 bp, Homo sapiens
cacttcaggctcttct

SEQ ID NO: 5989985 - DNA, 19 bp, Homo sapiens
cacttcaggtatacctcac

SEQ ID NO: 5989986 - DNA, 13 bp, Homo sapiens
cacttcaggtccg

SEQ ID NO: 5989987 - DNA, 15 bp, Homo sapiens
cacttcatacttcta

SEQ ID NO: 5989988 - DNA, 16 bp, Homo sapiens
cacttcatagatgaga

SEQ ID NO: 5989989 - DNA, 18 bp, Homo sapiens
cacttcatcaatcaaata

SEQ ID NO: 5989990 - DNA, 13 bp, Homo sapiens
cacttcatcttct

SEQ ID NO: 5989991 - DNA, 15 bp, Homo sapiens
cacttcatgcccact

SEQ ID NO: 5989992 - DNA, 21 bp, Homo sapiens
cacttcattccagcagctgca

SEQ ID NO: 5989993 - DNA, 14 bp, Homo sapiens
cacttcattcttta

SEQ ID NO: 5989994 - DNA, 16 bp, Homo sapiens
cacttcattctttata

SEQ ID NO: 5989995 - DNA, 16 bp, Homo sapiens
cacttcattgagagtt

SEQ ID NO: 5989996 - DNA, 22 bp, Homo sapiens
cacttcattgagagttttgtct

SEQ ID NO: 5989997 - DNA, 16 bp, Homo sapiens
cacttcattgttttaa

SEQ ID NO: 5989998 - DNA, 16 bp, Homo sapiens
cacttccaccagcctg

SEQ ID NO: 5989999 - DNA, 16 bp, Homo sapiens
cacttccagagccaga

SEQ ID NO: 5990000 - DNA, 19 bp, Homo sapiens
cacttccaggagcccagag

SEQ ID NO: 5990001 - DNA, 17 bp, Homo sapiens
cacttccaggggaacct

SEQ ID NO: 5990002 - DNA, 14 bp, Homo sapiens
cacttccagtctgg

SEQ ID NO: 5990003 - DNA, 17 bp, Homo sapiens
cacttccattgtattgt

SEQ ID NO: 5990004 - DNA, 14 bp, Homo sapiens
cacttccattgttt

SEQ ID NO: 5990005 - DNA, 12 bp, Homo sapiens
cacttcccatct

SEQ ID NO: 5990006 - DNA, 15 bp, Homo sapiens
cacttcccatctcca

SEQ ID NO: 5990007 - DNA, 17 bp, Homo sapiens
cacttccccatctgtgt

SEQ ID NO: 5990008 - DNA, 19 bp, Homo sapiens
cacttccccatctgtgtgt

SEQ ID NO: 5990009 - DNA, 14 bp, Homo sapiens
cacttccccatctt

SEQ ID NO: 5990010 - DNA, 14 bp, Homo sapiens
cacttccccctctt

SEQ ID NO: 5990011 - DNA, 19 bp, Homo sapiens
cacttccccctcttcagca

SEQ ID NO: 5990012 - DNA, 21 bp, Homo sapiens
cacttccccctcttcttctga

SEQ ID NO: 5990013 - DNA, 19 bp, Homo sapiens
cacttcccctccaagaccc

SEQ ID NO: 5990014 - DNA, 13 bp, Homo sapiens
cacttccccttgt

SEQ ID NO: 5990015 - DNA, 16 bp, Homo sapiens
cacttccctacatgga

SEQ ID NO: 5990016 - DNA, 14 bp, Homo sapiens
cacttccctctgtt

SEQ ID NO: 5990017 - DNA, 18 bp, Homo sapiens
cacttccctctgtttctc

SEQ ID NO: 5990018 - DNA, 18 bp, Homo sapiens
cacttccctgcttaaatt

SEQ ID NO: 5990019 - DNA, 23 bp, Homo sapiens
cacttccctgcttttctcccaga

SEQ ID NO: 5990020 - DNA, 13 bp, Homo sapiens
cacttccctggcg

SEQ ID NO: 5990021 - DNA, 15 bp, Homo sapiens
cacttccctgggaac

SEQ ID NO: 5990022 - DNA, 22 bp, Homo sapiens
cacttccctgggaactcatcct

SEQ ID NO: 5990023 - DNA, 20 bp, Homo sapiens
cacttcctaagttcccttct

SEQ ID NO: 5990024 - DNA, 15 bp, Homo sapiens
cacttcctccacagt

SEQ ID NO: 5990025 - DNA, 15 bp, Homo sapiens
cacttcctcccctcg

SEQ ID NO: 5990026 - DNA, 20 bp, Homo sapiens
cacttcctcctacctgggga

SEQ ID NO: 5990027 - DNA, 21 bp, Homo sapiens
cacttcctcctacctggggac

SEQ ID NO: 5990028 - DNA, 22 bp, Homo sapiens
cacttcctctccacaggagcct

SEQ ID NO: 5990029 - DNA, 16 bp, Homo sapiens
cacttcctgaggcctc

SEQ ID NO: 5990030 - DNA, 14 bp, Homo sapiens
cacttcctgcccca

SEQ ID NO: 5990031 - DNA, 17 bp, Homo sapiens
cacttcctgctacagga

SEQ ID NO: 5990032 - DNA, 17 bp, Homo sapiens
caatatatattatatat

SEQ ID NO: 5990033 - DNA, 19 bp, Homo sapiens
caatatatctaaattgaat

SEQ ID NO: 5990034 - DNA, 20 bp, Homo sapiens
caatatatctaaattgaata

SEQ ID NO: 5990035 - DNA, 17 bp, Homo sapiens
caatatatgatatataa

SEQ ID NO: 5990036 - DNA, 19 bp, Homo sapiens
caatatatgatatataaac

SEQ ID NO: 5990037 - DNA, 18 bp, Homo sapiens
caatatattaccagcaag

SEQ ID NO: 5990038 - DNA, 20 bp, Homo sapiens
caatatattgaacttttgta

SEQ ID NO: 5990039 - DNA, 12 bp, Homo sapiens
caatatatttgt

SEQ ID NO: 5990040 - DNA, 13 bp, Homo sapiens
caatatattttgt

SEQ ID NO: 5990041 - DNA, 16 bp, Homo sapiens
caatatattttgtatg

SEQ ID NO: 5990042 - DNA, 22 bp, Homo sapiens
caatatattttgtatgcaagca

SEQ ID NO: 5990043 - DNA, 14 bp, Homo sapiens
caatatcaacaaca

SEQ ID NO: 5990044 - DNA, 15 bp, Homo sapiens
caatatcaatatggt

SEQ ID NO: 5990045 - DNA, 21 bp, Homo sapiens
caatatcagctttgataattg

SEQ ID NO: 5990046 - DNA, 23 bp, Homo sapiens
caatatcatatcatcacattgag

SEQ ID NO: 5990047 - DNA, 23 bp, Homo sapiens
caatatcatccccaaatgtgtct

SEQ ID NO: 5990048 - DNA, 19 bp, Homo sapiens
caatatcatgtcttgtgca

SEQ ID NO: 5990049 - DNA, 15 bp, Homo sapiens
caatatcatgtgatt

SEQ ID NO: 5990050 - DNA, 18 bp, Homo sapiens
caatatcattttcctggg

SEQ ID NO: 5990051 - DNA, 20 bp, Homo sapiens
caatatccaattttaaaatg

SEQ ID NO: 5990052 - DNA, 17 bp, Homo sapiens
caatatcccttacttta

SEQ ID NO: 5990053 - DNA, 20 bp, Homo sapiens
caatatcctaataaaaaggt

SEQ ID NO: 5990054 - DNA, 13 bp, Homo sapiens
caatatcctcgct

SEQ ID NO: 5990055 - DNA, 19 bp, Homo sapiens
caatatcctcgctcccggg

SEQ ID NO: 5990056 - DNA, 20 bp, Homo sapiens
caatatcctttgcctcaagg

SEQ ID NO: 5990057 - DNA, 21 bp, Homo sapiens
caatatcgtacctgtccctcc

SEQ ID NO: 5990058 - DNA, 15 bp, Homo sapiens
caatatctaatatat

SEQ ID NO: 5990059 - DNA, 19 bp, Homo sapiens
caatatcttgcttgaactt

SEQ ID NO: 5990060 - DNA, 13 bp, Homo sapiens
caatatgaagtta

SEQ ID NO: 5990061 - DNA, 12 bp, Homo sapiens
caatatgacaca

SEQ ID NO: 5990062 - DNA, 21 bp, Homo sapiens
caatatgacacagcttgtgaa

SEQ ID NO: 5990063 - DNA, 23 bp, Homo sapiens
caatatgacacagcttgtgaatg

SEQ ID NO: 5990064 - DNA, 10 bp, Homo sapiens
caatatgagg

SEQ ID NO: 5990065 - DNA, 19 bp, Homo sapiens
caatatgaggggactgcat

SEQ ID NO: 5990066 - DNA, 17 bp, Homo sapiens
caatatgagtaatgttt

SEQ ID NO: 5990067 - DNA, 17 bp, Homo sapiens
caatatgcaagcagctt

SEQ ID NO: 5990068 - DNA, 16 bp, Homo sapiens
caatatgcaatcactg

SEQ ID NO: 5990069 - DNA, 12 bp, Homo sapiens
caatatgcttta

SEQ ID NO: 5990070 - DNA, 13 bp, Homo sapiens
caatatgctttac

SEQ ID NO: 5990071 - DNA, 19 bp, Homo sapiens
caatatggacatgtaaaaa

SEQ ID NO: 5990072 - DNA, 20 bp, Homo sapiens
caatatggagaggattgctt

SEQ ID NO: 5990073 - DNA, 22 bp, Homo sapiens
caatatgggaggaacaaagaca

SEQ ID NO: 5990074 - DNA, 17 bp, Homo sapiens
caatatggggcattaat

SEQ ID NO: 5990075 - DNA, 18 bp, Homo sapiens
caatatgggggccttttg

SEQ ID NO: 5990076 - DNA, 18 bp, Homo sapiens
caatatggtggccctggg

SEQ ID NO: 5990077 - DNA, 15 bp, Homo sapiens
caatatgtaaatagt

SEQ ID NO: 5990078 - DNA, 16 bp, Homo sapiens
caatatgtaacatgtc

SEQ ID NO: 5990079 - DNA, 20 bp, Homo sapiens
caatatgtagccttttatcc

SEQ ID NO: 5990080 - DNA, 12 bp, Homo sapiens
caatatgtatat

SEQ ID NO: 5990081 - DNA, 14 bp, Homo sapiens
caatatgtatgctt

SEQ ID NO: 5990082 - DNA, 15 bp, Homo sapiens
caatatgtatgcttt

SEQ ID NO: 5990083 - DNA, 22 bp, Homo sapiens
caatatgtatgctttttaccta

SEQ ID NO: 5990084 - DNA, 22 bp, Homo sapiens
caatatgtattaatattcattg

SEQ ID NO: 5990085 - DNA, 14 bp, Homo sapiens
caatatgtattgta

SEQ ID NO: 5990086 - DNA, 16 bp, Homo sapiens
caatatgtattgtaaa

SEQ ID NO: 5990087 - DNA, 17 bp, Homo sapiens
caatatgtgatttttgt

SEQ ID NO: 5990088 - DNA, 17 bp, Homo sapiens
caatatgtgtttacttt

SEQ ID NO: 5990089 - DNA, 14 bp, Homo sapiens
caatattaaataca

SEQ ID NO: 5990090 - DNA, 21 bp, Homo sapiens
caatattaaatacagacacta

SEQ ID NO: 5990091 - DNA, 23 bp, Homo sapiens
caatattaaatacagacactaag

SEQ ID NO: 5990092 - DNA, 14 bp, Homo sapiens
caatattaaatctg

SEQ ID NO: 5990093 - DNA, 23 bp, Homo sapiens
caatattaaatgactttttgaat

SEQ ID NO: 5990094 - DNA, 20 bp, Homo sapiens
caatattaacacgctgcctg

SEQ ID NO: 5990095 - DNA, 24 bp, Homo sapiens
caatattaacctaatcaccatgta

SEQ ID NO: 5990096 - DNA, 23 bp, Homo sapiens
caatattaatgcctttaaagtat

SEQ ID NO: 5990097 - DNA, 16 bp, Homo sapiens
caatattaattataat

SEQ ID NO: 5990098 - DNA, 20 bp, Homo sapiens
caatattaattataataaag

SEQ ID NO: 5990099 - DNA, 19 bp, Homo sapiens
caatattaccttaagattt

SEQ ID NO: 5990100 - DNA, 13 bp, Homo sapiens
caatattataatt

SEQ ID NO: 5990101 - DNA, 14 bp, Homo sapiens
caatattataattt

SEQ ID NO: 5990102 - DNA, 13 bp, Homo sapiens
caatattatgaaa

SEQ ID NO: 5990103 - DNA, 18 bp, Homo sapiens
caatattatgaaatttca

SEQ ID NO: 5990104 - DNA, 21 bp, Homo sapiens
caatattatgaaatttcactt

SEQ ID NO: 5990105 - DNA, 21 bp, Homo sapiens
caatattcctgaatgaaatat

SEQ ID NO: 5990106 - DNA, 12 bp, Homo sapiens
caatattctctg

SEQ ID NO: 5990107 - DNA, 17 bp, Homo sapiens
caatattctctgtacat

SEQ ID NO: 5990108 - DNA, 21 bp, Homo sapiens
caatattgaatttttcctatg

SEQ ID NO: 5990109 - DNA, 17 bp, Homo sapiens
caatattgacatttgta

SEQ ID NO: 5990110 - DNA, 14 bp, Homo sapiens
caatattgactttg

SEQ ID NO: 5990111 - DNA, 16 bp, Homo sapiens
caatattgattgggaa

SEQ ID NO: 5990112 - DNA, 20 bp, Homo sapiens
caatattgattgggaaaaca

SEQ ID NO: 5990113 - DNA, 16 bp, Homo sapiens
caatattgcctgtgct

SEQ ID NO: 5990114 - DNA, 20 bp, Homo sapiens
caatattgctagaggtggca

SEQ ID NO: 5990115 - DNA, 21 bp, Homo sapiens
caatattgctagaggtggcat

SEQ ID NO: 5990116 - DNA, 20 bp, Homo sapiens
caatattggtgtactgtaat

SEQ ID NO: 5990117 - DNA, 12 bp, Homo sapiens
caatattgtaat

SEQ ID NO: 5990118 - DNA, 23 bp, Homo sapiens
caatattgtaatcctagcacttt

SEQ ID NO: 5990119 - DNA, 18 bp, Homo sapiens
caatattgtacagttttt

SEQ ID NO: 5990120 - DNA, 12 bp, Homo sapiens
caatattgtata

SEQ ID NO: 5990121 - DNA, 16 bp, Homo sapiens
caatattgtcattcct

SEQ ID NO: 5990122 - DNA, 16 bp, Homo sapiens
caatattgtctccctt

SEQ ID NO: 5990123 - DNA, 13 bp, Homo sapiens
caatatttaaaca

SEQ ID NO: 5990124 - DNA, 14 bp, Homo sapiens
caatatttaaacat

SEQ ID NO: 5990125 - DNA, 21 bp, Homo sapiens
caatatttactatttcaatac

SEQ ID NO: 5990126 - DNA, 17 bp, Homo sapiens
caatatttactcatcag

SEQ ID NO: 5990127 - DNA, 14 bp, Homo sapiens
caatatttagaaaa

SEQ ID NO: 5990128 - DNA, 14 bp, Homo sapiens
caatatttatggat

SEQ ID NO: 5990129 - DNA, 16 bp, Homo sapiens
caatatttattgtatt

SEQ ID NO: 5990130 - DNA, 12 bp, Homo sapiens
caatatttcaga

SEQ ID NO: 5990131 - DNA, 14 bp, Homo sapiens
caatatttcctcat

SEQ ID NO: 5990132 - DNA, 19 bp, Homo sapiens
caatatttgaattttaaat

SEQ ID NO: 5990133 - DNA, 18 bp, Homo sapiens
caatatttgctaaacatt

SEQ ID NO: 5990134 - DNA, 14 bp, Homo sapiens
caatatttgtagaa

SEQ ID NO: 5990135 - DNA, 16 bp, Homo sapiens
caatatttgttactgt

SEQ ID NO: 5990136 - DNA, 13 bp, Homo sapiens
caatattttaagc

SEQ ID NO: 5990137 - DNA, 14 bp, Homo sapiens
caatattttaagca

SEQ ID NO: 5990138 - DNA, 16 bp, Homo sapiens
caatattttaagcatt

SEQ ID NO: 5990139 - DNA, 17 bp, Homo sapiens
caatattttaagcatta

SEQ ID NO: 5990140 - DNA, 15 bp, Homo sapiens
caatattttatggtt

SEQ ID NO: 5990141 - DNA, 17 bp, Homo sapiens
caatattttatggttat

SEQ ID NO: 5990142 - DNA, 14 bp, Homo sapiens
caatattttcagaa

SEQ ID NO: 5990143 - DNA, 11 bp, Homo sapiens
caatattttcc

SEQ ID NO: 5990144 - DNA, 15 bp, Homo sapiens
caatattttgccttt

SEQ ID NO: 5990145 - DNA, 22 bp, Homo sapiens
caatcaaactttcagctttttt

SEQ ID NO: 5990146 - DNA, 14 bp, Homo sapiens
caatcaaagaatta

SEQ ID NO: 5990147 - DNA, 17 bp, Homo sapiens
caatcaaagcacttgga

SEQ ID NO: 5990148 - DNA, 15 bp, Homo sapiens
caatcaaagctacct

SEQ ID NO: 5990149 - DNA, 18 bp, Homo sapiens
caatcaaaggaaaatagt

SEQ ID NO: 5990150 - DNA, 23 bp, Homo sapiens
caatcaaataagtatttataata

SEQ ID NO: 5990151 - DNA, 14 bp, Homo sapiens
caatcaaatatatt

SEQ ID NO: 5990152 - DNA, 15 bp, Homo sapiens
caatcaaatattttt

SEQ ID NO: 5990153 - DNA, 14 bp, Homo sapiens
caatcaacactacc

SEQ ID NO: 5990154 - DNA, 16 bp, Homo sapiens
caatcaaccaaagtta

SEQ ID NO: 5990155 - DNA, 18 bp, Homo sapiens
caatcaaccaaagttagt

SEQ ID NO: 5990156 - DNA, 19 bp, Homo sapiens
caatcaaccaaagttagtt

SEQ ID NO: 5990157 - DNA, 23 bp, Homo sapiens
caatcaaccaaagttagttcagt

SEQ ID NO: 5990158 - DNA, 23 bp, Homo sapiens
caatcaacctgcacttcatatct

SEQ ID NO: 5990159 - DNA, 19 bp, Homo sapiens
caatcaaggttataatttt

SEQ ID NO: 5990160 - DNA, 20 bp, Homo sapiens
caatcaataaaaaacaaata

SEQ ID NO: 5990161 - DNA, 21 bp, Homo sapiens
caatcaataaacagcaggtga

SEQ ID NO: 5990162 - DNA, 21 bp, Homo sapiens
caatcaataacagccgctcca

SEQ ID NO: 5990163 - DNA, 11 bp, Homo sapiens
caatcaataat

SEQ ID NO: 5990164 - DNA, 16 bp, Homo sapiens
caatcaataatagcta

SEQ ID NO: 5990165 - DNA, 16 bp, Homo sapiens
caatcaatggtgcaaa

SEQ ID NO: 5990166 - DNA, 19 bp, Homo sapiens
caatcaatggtgcaaaaaa

SEQ ID NO: 5990167 - DNA, 20 bp, Homo sapiens
caatcaatggtgcaaaaaaa

SEQ ID NO: 5990168 - DNA, 15 bp, Homo sapiens
caatcaatttaaatg

SEQ ID NO: 5990169 - DNA, 16 bp, Homo sapiens
caatcaatttaaatgt

SEQ ID NO: 5990170 - DNA, 20 bp, Homo sapiens
caatcaatttaaatgtttac

SEQ ID NO: 5990171 - DNA, 14 bp, Homo sapiens
caatcacaaaggct

SEQ ID NO: 5990172 - DNA, 18 bp, Homo sapiens
caatcacactacacatca

SEQ ID NO: 5990173 - DNA, 19 bp, Homo sapiens
caatcacactacacatcac

SEQ ID NO: 5990174 - DNA, 13 bp, Homo sapiens
caatcacccccag

SEQ ID NO: 5990175 - DNA, 15 bp, Homo sapiens
caatcacccccagga

SEQ ID NO: 5990176 - DNA, 21 bp, Homo sapiens
caatcacgagatcttccttcc

SEQ ID NO: 5990177 - DNA, 22 bp, Homo sapiens
caatcacgggcggtcctgcaca

SEQ ID NO: 5990178 - DNA, 19 bp, Homo sapiens
caatcactaaactttattt

SEQ ID NO: 5990179 - DNA, 20 bp, Homo sapiens
caatcactaaactttatttg

SEQ ID NO: 5990180 - DNA, 18 bp, Homo sapiens
caatcactagtcaagaaa

SEQ ID NO: 5990181 - DNA, 20 bp, Homo sapiens
caatcactagtcaagaaaaa

SEQ ID NO: 5990182 - DNA, 22 bp, Homo sapiens
caatcactagtcaagaaaaata

SEQ ID NO: 5990183 - DNA, 15 bp, Homo sapiens
caatcactattctta

SEQ ID NO: 5990184 - DNA, 18 bp, Homo sapiens
caatcactattcttaagc

SEQ ID NO: 5990185 - DNA, 19 bp, Homo sapiens
caatcactattcttaagca

SEQ ID NO: 5990186 - DNA, 21 bp, Homo sapiens
caatcactattcttaagcact

SEQ ID NO: 5990187 - DNA, 22 bp, Homo sapiens
caatcactattcttaagcactt

SEQ ID NO: 5990188 - DNA, 16 bp, Homo sapiens
caatcactgagtttgt

SEQ ID NO: 5990189 - DNA, 20 bp, Homo sapiens
caatcactgggcccagagga

SEQ ID NO: 5990190 - DNA, 15 bp, Homo sapiens
caatcactgtcctcc

SEQ ID NO: 5990191 - DNA, 22 bp, Homo sapiens
caatcactgtgcttaatttaaa

SEQ ID NO: 5990192 - DNA, 21 bp, Homo sapiens
caatcagagaccaggccctgg

SEQ ID NO: 5990193 - DNA, 16 bp, Homo sapiens
caatcagagagcctag

SEQ ID NO: 5990194 - DNA, 23 bp, Homo sapiens
caatcagagctccagtttgcatt

SEQ ID NO: 5990195 - DNA, 16 bp, Homo sapiens
caatcagcactgaaaa

SEQ ID NO: 5990196 - DNA, 16 bp, Homo sapiens
caatcagctccttcct

SEQ ID NO: 5990197 - DNA, 17 bp, Homo sapiens
caatcagctccttttcc

SEQ ID NO: 5990198 - DNA, 11 bp, Homo sapiens
caatcagctgc

SEQ ID NO: 5990199 - DNA, 18 bp, Homo sapiens
caatcagctgctttgtta

SEQ ID NO: 5990200 - DNA, 15 bp, Homo sapiens
caatcaggattttaa

SEQ ID NO: 5990201 - DNA, 23 bp, Homo sapiens
caatcagtagacctgattttcaa

SEQ ID NO: 5990202 - DNA, 22 bp, Homo sapiens
caatcagtagcttaagaaaaaa

SEQ ID NO: 5990203 - DNA, 16 bp, Homo sapiens
caatcagtataattct

SEQ ID NO: 5990204 - DNA, 19 bp, Homo sapiens
caatcagtataattctgta

SEQ ID NO: 5990205 - DNA, 19 bp, Homo sapiens
caatcagtatgtattcttt

SEQ ID NO: 5990206 - DNA, 17 bp, Homo sapiens
caatcatagagaaacct

SEQ ID NO: 5990207 - DNA, 13 bp, Homo sapiens
caatcatatttaa

SEQ ID NO: 5990208 - DNA, 19 bp, Homo sapiens
caatcatctgtgtgaaaat

SEQ ID NO: 5990209 - DNA, 17 bp, Homo sapiens
caatcatgaaatatgca

SEQ ID NO: 5990210 - DNA, 12 bp, Homo sapiens
cacttcctgtcc

SEQ ID NO: 5990211 - DNA, 13 bp, Homo sapiens
cacttcctgtcca

SEQ ID NO: 5990212 - DNA, 14 bp, Homo sapiens
cacttcctgtgcca

SEQ ID NO: 5990213 - DNA, 18 bp, Homo sapiens
cacttcctgttttaagca

SEQ ID NO: 5990214 - DNA, 23 bp, Homo sapiens
cacttccttaacagctgtattat

SEQ ID NO: 5990215 - DNA, 15 bp, Homo sapiens
cacttcctttcctac

SEQ ID NO: 5990216 - DNA, 17 bp, Homo sapiens
cacttcctttcctactg

SEQ ID NO: 5990217 - DNA, 23 bp, Homo sapiens
cacttcctttgcccttcctcctg

SEQ ID NO: 5990218 - DNA, 17 bp, Homo sapiens
cacttcctttgtgttta

SEQ ID NO: 5990219 - DNA, 18 bp, Homo sapiens
cacttcgaaattctgagt

SEQ ID NO: 5990220 - DNA, 14 bp, Homo sapiens
cacttcgcacacac

SEQ ID NO: 5990221 - DNA, 23 bp, Homo sapiens
cacttcgcaccggagtgtctgga

SEQ ID NO: 5990222 - DNA, 14 bp, Homo sapiens
cacttcgctcttga

SEQ ID NO: 5990223 - DNA, 16 bp, Homo sapiens
cacttcggataatttt

SEQ ID NO: 5990224 - DNA, 21 bp, Homo sapiens
cacttcggccaggtcacacga

SEQ ID NO: 5990225 - DNA, 21 bp, Homo sapiens
cacttcgggaggtcgaggcag

SEQ ID NO: 5990226 - DNA, 17 bp, Homo sapiens
cacttctaaatgaagtg

SEQ ID NO: 5990227 - DNA, 18 bp, Homo sapiens
cacttctaaatgaagtgc

SEQ ID NO: 5990228 - DNA, 12 bp, Homo sapiens
cacttctaaatt

SEQ ID NO: 5990229 - DNA, 17 bp, Homo sapiens
cacttctaactccactg

SEQ ID NO: 5990230 - DNA, 23 bp, Homo sapiens
cacttctaactccactggctcca

SEQ ID NO: 5990231 - DNA, 19 bp, Homo sapiens
cacttctaagaaaagccta

SEQ ID NO: 5990232 - DNA, 22 bp, Homo sapiens
cacttctaataactgcagtgtt

SEQ ID NO: 5990233 - DNA, 20 bp, Homo sapiens
cacttctagatctcagccat

SEQ ID NO: 5990234 - DNA, 21 bp, Homo sapiens
cacttctagatctcagccatt

SEQ ID NO: 5990235 - DNA, 20 bp, Homo sapiens
cacttctagggtatgggaaa

SEQ ID NO: 5990236 - DNA, 16 bp, Homo sapiens
cacttctatttaatgc

SEQ ID NO: 5990237 - DNA, 16 bp, Homo sapiens
cacttctatttagcca

SEQ ID NO: 5990238 - DNA, 21 bp, Homo sapiens
cacttctcacatcttatgcta

SEQ ID NO: 5990239 - DNA, 15 bp, Homo sapiens
cacttctcaggaaat

SEQ ID NO: 5990240 - DNA, 13 bp, Homo sapiens
cacttctcaggac

SEQ ID NO: 5990241 - DNA, 14 bp, Homo sapiens
cacttctcaggaca

SEQ ID NO: 5990242 - DNA, 20 bp, Homo sapiens
cacttctcatcacacacatg

SEQ ID NO: 5990243 - DNA, 21 bp, Homo sapiens
cacttctcatcacacacatgg

SEQ ID NO: 5990244 - DNA, 13 bp, Homo sapiens
cacttctccccgc

SEQ ID NO: 5990245 - DNA, 20 bp, Homo sapiens
cacttctcctgctgctcctg

SEQ ID NO: 5990246 - DNA, 20 bp, Homo sapiens
cacttctctactctggaagt

SEQ ID NO: 5990247 - DNA, 15 bp, Homo sapiens
cacttctctgctgcc

SEQ ID NO: 5990248 - DNA, 18 bp, Homo sapiens
cacttctctgctgcctct

SEQ ID NO: 5990249 - DNA, 13 bp, Homo sapiens
cacttctctgtta

SEQ ID NO: 5990250 - DNA, 21 bp, Homo sapiens
cacttctcttaaacttgtgaa

SEQ ID NO: 5990251 - DNA, 13 bp, Homo sapiens
cacttctcttcct

SEQ ID NO: 5990252 - DNA, 17 bp, Homo sapiens
cacttctgacagcctca

SEQ ID NO: 5990253 - DNA, 22 bp, Homo sapiens
cacttctgccatattctgttgg

SEQ ID NO: 5990254 - DNA, 19 bp, Homo sapiens
cacttctgccatgagcaga

SEQ ID NO: 5990255 - DNA, 23 bp, Homo sapiens
cacttctgcgggctccctcctct

SEQ ID NO: 5990256 - DNA, 15 bp, Homo sapiens
cacttctgctttcac

SEQ ID NO: 5990257 - DNA, 23 bp, Homo sapiens
cacttctggatatagctaggtga

SEQ ID NO: 5990258 - DNA, 13 bp, Homo sapiens
cacttctggcatg

SEQ ID NO: 5990259 - DNA, 20 bp, Homo sapiens
cacttctggccacatcagcc

SEQ ID NO: 5990260 - DNA, 22 bp, Homo sapiens
cacttctggccacatcagcccc

SEQ ID NO: 5990261 - DNA, 12 bp, Homo sapiens
cacttctggctt

SEQ ID NO: 5990262 - DNA, 18 bp, Homo sapiens
cacttctgggcttcatct

SEQ ID NO: 5990263 - DNA, 15 bp, Homo sapiens
cacttctggggccag

SEQ ID NO: 5990264 - DNA, 18 bp, Homo sapiens
cacttctgggtggggcag

SEQ ID NO: 5990265 - DNA, 13 bp, Homo sapiens
cacttctggtata

SEQ ID NO: 5990266 - DNA, 19 bp, Homo sapiens
cacttctggtcaatcaaca

SEQ ID NO: 5990267 - DNA, 17 bp, Homo sapiens
cacttctggtcccctgt

SEQ ID NO: 5990268 - DNA, 19 bp, Homo sapiens
cacttctggtcccctgtgg

SEQ ID NO: 5990269 - DNA, 24 bp, Homo sapiens
cacttctgtctcctgtcttcagag

SEQ ID NO: 5990270 - DNA, 14 bp, Homo sapiens
cacttctgttccag

SEQ ID NO: 5990271 - DNA, 23 bp, Homo sapiens
cacttcttaaggacagtgttcaa

SEQ ID NO: 5990272 - DNA, 17 bp, Homo sapiens
cacttcttaatgctttc

SEQ ID NO: 5990273 - DNA, 20 bp, Homo sapiens
cacttcttcacctcttccac

SEQ ID NO: 5990274 - DNA, 12 bp, Homo sapiens
cacttcttcctt

SEQ ID NO: 5990275 - DNA, 17 bp, Homo sapiens
cacttcttcctttctct

SEQ ID NO: 5990276 - DNA, 19 bp, Homo sapiens
cacttcttcctttctcttt

SEQ ID NO: 5990277 - DNA, 17 bp, Homo sapiens
cacttcttgaaacagcc

SEQ ID NO: 5990278 - DNA, 15 bp, Homo sapiens
cacttcttggttcct

SEQ ID NO: 5990279 - DNA, 20 bp, Homo sapiens
cacttcttggttcctgggat

SEQ ID NO: 5990280 - DNA, 21 bp, Homo sapiens
cacttcttggttcctgggatg

SEQ ID NO: 5990281 - DNA, 15 bp, Homo sapiens
cacttctttatactc

SEQ ID NO: 5990282 - DNA, 16 bp, Homo sapiens
cacttctttatactct

SEQ ID NO: 5990283 - DNA, 23 bp, Homo sapiens
cacttctttatactctcttccct

SEQ ID NO: 5990284 - DNA, 15 bp, Homo sapiens
cacttcttttataac

SEQ ID NO: 5990285 - DNA, 13 bp, Homo sapiens
cacttcttttcca

SEQ ID NO: 5990286 - DNA, 20 bp, Homo sapiens
cacttcttttccaaaaatac

SEQ ID NO: 5990287 - DNA, 12 bp, Homo sapiens
cacttgaaaagt

SEQ ID NO: 5990288 - DNA, 22 bp, Homo sapiens
cacttgaaacttggttcccaga

SEQ ID NO: 5990289 - DNA, 23 bp, Homo sapiens
cacttgaaacttggttcccagaa

SEQ ID NO: 5990290 - DNA, 17 bp, Homo sapiens
cacttgaacaaaatctg

SEQ ID NO: 5990291 - DNA, 18 bp, Homo sapiens
cacttgaacaaaatctgt

SEQ ID NO: 5990292 - DNA, 20 bp, Homo sapiens
cacttgaacccgggaggcag

SEQ ID NO: 5990293 - DNA, 23 bp, Homo sapiens
cacttgaacccgggaggcagagg

SEQ ID NO: 5990294 - DNA, 19 bp, Homo sapiens
cacttgaagccatctaaag

SEQ ID NO: 5990295 - DNA, 23 bp, Homo sapiens
cacttgacagactgtagcttctc

SEQ ID NO: 5990296 - DNA, 14 bp, Homo sapiens
cacttgacattcct

SEQ ID NO: 5990297 - DNA, 20 bp, Homo sapiens
cacttgaccgggagacagag

SEQ ID NO: 5990298 - DNA, 22 bp, Homo sapiens
cacttgaccttctgtcgtcccc

SEQ ID NO: 5990299 - DNA, 21 bp, Homo sapiens
cacttgagaaccagtctcctc

SEQ ID NO: 5990300 - DNA, 19 bp, Homo sapiens
cacttgagccccggaggtc

SEQ ID NO: 5990301 - DNA, 13 bp, Homo sapiens
cacttgagcctat

SEQ ID NO: 5990302 - DNA, 14 bp, Homo sapiens
cacttgaggaggag

SEQ ID NO: 5990303 - DNA, 22 bp, Homo sapiens
cacttgaggaggagctggcctg

SEQ ID NO: 5990304 - DNA, 21 bp, Homo sapiens
cacttgaggccaggactttga

SEQ ID NO: 5990305 - DNA, 15 bp, Homo sapiens
cacttgaggcctgat

SEQ ID NO: 5990306 - DNA, 17 bp, Homo sapiens
cacttgaggcctgatct

SEQ ID NO: 5990307 - DNA, 17 bp, Homo sapiens
cacttgagttggctgtg

SEQ ID NO: 5990308 - DNA, 14 bp, Homo sapiens
cacttgatatttat

SEQ ID NO: 5990309 - DNA, 19 bp, Homo sapiens
cacttgatatttattagtg

SEQ ID NO: 5990310 - DNA, 19 bp, Homo sapiens
cacttgatgacccccaacc

SEQ ID NO: 5990311 - DNA, 20 bp, Homo sapiens
cacttgatgtgatgtggcag

SEQ ID NO: 5990312 - DNA, 21 bp, Homo sapiens
cacttgatgtgatgtggcagg

SEQ ID NO: 5990313 - DNA, 15 bp, Homo sapiens
cacttgattcaggag

SEQ ID NO: 5990314 - DNA, 17 bp, Homo sapiens
cacttgattcaggaggt

SEQ ID NO: 5990315 - DNA, 13 bp, Homo sapiens
cacttgcaaatga

SEQ ID NO: 5990316 - DNA, 15 bp, Homo sapiens
cacttgcaaatgaat

SEQ ID NO: 5990317 - DNA, 23 bp, Homo sapiens
cacttgcacgcccatgtgtgagt

SEQ ID NO: 5990318 - DNA, 15 bp, Homo sapiens
cacttgcactgtgct

SEQ ID NO: 5990319 - DNA, 18 bp, Homo sapiens
cacttgcagactctacag

SEQ ID NO: 5990320 - DNA, 19 bp, Homo sapiens
cacttgcagactctacaga

SEQ ID NO: 5990321 - DNA, 20 bp, Homo sapiens
cacttgcagaggagcccagt

SEQ ID NO: 5990322 - DNA, 22 bp, Homo sapiens
cacttgcagaggagcccagtgg

SEQ ID NO: 5990323 - DNA, 21 bp, Homo sapiens
cacttgcaggggtccctgcta

SEQ ID NO: 5990324 - DNA, 13 bp, Homo sapiens
cacttgcatctgt

SEQ ID NO: 5990325 - DNA, 19 bp, Homo sapiens
cacttgccattgccaggag

SEQ ID NO: 5990326 - DNA, 21 bp, Homo sapiens
cacttgccattgccaggagat

SEQ ID NO: 5990327 - DNA, 16 bp, Homo sapiens
cacttgccctgtgttc

SEQ ID NO: 5990328 - DNA, 21 bp, Homo sapiens
cacttgccctgtgttctttcc

SEQ ID NO: 5990329 - DNA, 22 bp, Homo sapiens
cacttgcctatgatactgtctc

SEQ ID NO: 5990330 - DNA, 13 bp, Homo sapiens
cacttgcctggaa

SEQ ID NO: 5990331 - DNA, 22 bp, Homo sapiens
cacttgcggatattctggactg

SEQ ID NO: 5990332 - DNA, 15 bp, Homo sapiens
cacttgcgtcctgca

SEQ ID NO: 5990333 - DNA, 20 bp, Homo sapiens
cacttgcgtcctgcagagga

SEQ ID NO: 5990334 - DNA, 23 bp, Homo sapiens
cacttgctcagacgagacaccct

SEQ ID NO: 5990335 - DNA, 22 bp, Homo sapiens
cacttgctcatgccctgccaag

SEQ ID NO: 5990336 - DNA, 11 bp, Homo sapiens
cacttgctgag

SEQ ID NO: 5990337 - DNA, 16 bp, Homo sapiens
cacttgctgagtgaag

SEQ ID NO: 5990338 - DNA, 22 bp, Homo sapiens
cacttgctgctttttctgcgct

SEQ ID NO: 5990339 - DNA, 12 bp, Homo sapiens
cacttgcttctt

SEQ ID NO: 5990340 - DNA, 13 bp, Homo sapiens
cacttgcttgctg

SEQ ID NO: 5990341 - DNA, 14 bp, Homo sapiens
cacttggagcccgt

SEQ ID NO: 5990342 - DNA, 15 bp, Homo sapiens
cacttggagcccgtg

SEQ ID NO: 5990343 - DNA, 20 bp, Homo sapiens
cacttggatttcatttgtaa

SEQ ID NO: 5990344 - DNA, 11 bp, Homo sapiens
cacttggccaa

SEQ ID NO: 5990345 - DNA, 18 bp, Homo sapiens
cacttggccaagcaggga

SEQ ID NO: 5990346 - DNA, 20 bp, Homo sapiens
cacttggccaagcagggagg

SEQ ID NO: 5990347 - DNA, 21 bp, Homo sapiens
cacttggccagttttctgttc

SEQ ID NO: 5990348 - DNA, 19 bp, Homo sapiens
cacttggcccaagtggcag

SEQ ID NO: 5990349 - DNA, 22 bp, Homo sapiens
cacttggcccaagtggcagagc

SEQ ID NO: 5990350 - DNA, 13 bp, Homo sapiens
cacttggcccaga

SEQ ID NO: 5990351 - DNA, 17 bp, Homo sapiens
cacttggcctcagctgg

SEQ ID NO: 5990352 - DNA, 16 bp, Homo sapiens
cacttggcctctggat

SEQ ID NO: 5990353 - DNA, 23 bp, Homo sapiens
cacttggctgcataaatgtggta

SEQ ID NO: 5990354 - DNA, 14 bp, Homo sapiens
cacttggctgtctg

SEQ ID NO: 5990355 - DNA, 15 bp, Homo sapiens
cacttggctgtctga

SEQ ID NO: 5990356 - DNA, 13 bp, Homo sapiens
cacttgggagctg

SEQ ID NO: 5990357 - DNA, 15 bp, Homo sapiens
cacttgggagctgct

SEQ ID NO: 5990358 - DNA, 16 bp, Homo sapiens
cacttgggcccaggag

SEQ ID NO: 5990359 - DNA, 20 bp, Homo sapiens
cacttgggcgctctgccctc

SEQ ID NO: 5990360 - DNA, 14 bp, Homo sapiens
cacttgggctctct

SEQ ID NO: 5990361 - DNA, 15 bp, Homo sapiens
cacttgggctggcac

SEQ ID NO: 5990362 - DNA, 23 bp, Homo sapiens
cacttgggctggcacccactgga

SEQ ID NO: 5990363 - DNA, 20 bp, Homo sapiens
cacttggggcaccttgctcc

SEQ ID NO: 5990364 - DNA, 20 bp, Homo sapiens
cacttgggggttcaggcccg

SEQ ID NO: 5990365 - DNA, 15 bp, Homo sapiens
cacttgggtgtggct

SEQ ID NO: 5990366 - DNA, 22 bp, Homo sapiens
cacttgggtgtggctcctctgt

SEQ ID NO: 5990367 - DNA, 15 bp, Homo sapiens
cacttggtaattgta

SEQ ID NO: 5990368 - DNA, 18 bp, Homo sapiens
cacttggtctgccaggcc

SEQ ID NO: 5990369 - DNA, 17 bp, Homo sapiens
cacttggtctgtgagat

SEQ ID NO: 5990370 - DNA, 22 bp, Homo sapiens
cacttggtgcataagcacagaa

SEQ ID NO: 5990371 - DNA, 14 bp, Homo sapiens
cacttggtgctgcg

SEQ ID NO: 5990372 - DNA, 15 bp, Homo sapiens
cacttggtgctgctt

SEQ ID NO: 5990373 - DNA, 14 bp, Homo sapiens
cacttggtgtactg

SEQ ID NO: 5990374 - DNA, 20 bp, Homo sapiens
cacttggtttttggctcttt

SEQ ID NO: 5990375 - DNA, 12 bp, Homo sapiens
cacttgtaaggg

SEQ ID NO: 5990376 - DNA, 15 bp, Homo sapiens
cacttgtagatttga

SEQ ID NO: 5990377 - DNA, 17 bp, Homo sapiens
cacttgtaggtttctct

SEQ ID NO: 5990378 - DNA, 21 bp, Homo sapiens
cacttgtaggtttctctgcct

SEQ ID NO: 5990379 - DNA, 22 bp, Homo sapiens
cacttgtaggtttctctgcctc

SEQ ID NO: 5990380 - DNA, 15 bp, Homo sapiens
cacttgtataaatgt

SEQ ID NO: 5990381 - DNA, 20 bp, Homo sapiens
cacttgtataaatgtatata

SEQ ID NO: 5990382 - DNA, 21 bp, Homo sapiens
cacttgtatatacgcatctat

SEQ ID NO: 5990383 - DNA, 17 bp, Homo sapiens
cacttgtcaaagaaggt

SEQ ID NO: 5990384 - DNA, 20 bp, Homo sapiens
cacttgtcactgacacaaag

SEQ ID NO: 5990385 - DNA, 22 bp, Homo sapiens
cacttgtcactgacacaaagga

SEQ ID NO: 5990386 - DNA, 15 bp, Homo sapiens
cacttgtccagctga

SEQ ID NO: 5990387 - DNA, 17 bp, Homo sapiens
caatcatgaacagctct

SEQ ID NO: 5990388 - DNA, 18 bp, Homo sapiens
caatcatgaacagctctg

SEQ ID NO: 5990389 - DNA, 21 bp, Homo sapiens
caatcatgaacagctctgaga

SEQ ID NO: 5990390 - DNA, 22 bp, Homo sapiens
caatcatggtcaagttcccaac

SEQ ID NO: 5990391 - DNA, 15 bp, Homo sapiens
caatcatgtgccaga

SEQ ID NO: 5990392 - DNA, 17 bp, Homo sapiens
caatcattgaagtatat

SEQ ID NO: 5990393 - DNA, 15 bp, Homo sapiens
caatcattgtacagt

SEQ ID NO: 5990394 - DNA, 21 bp, Homo sapiens
caatcattgtacagtttgttt

SEQ ID NO: 5990395 - DNA, 20 bp, Homo sapiens
caatcattgtcagagatgtt

SEQ ID NO: 5990396 - DNA, 21 bp, Homo sapiens
caatcattgtcagagatgttt

SEQ ID NO: 5990397 - DNA, 13 bp, Homo sapiens
caatcatttctca

SEQ ID NO: 5990398 - DNA, 14 bp, Homo sapiens
caatcattttaaga

SEQ ID NO: 5990399 - DNA, 22 bp, Homo sapiens
caatcattttatataaagaaaa

SEQ ID NO: 5990400 - DNA, 13 bp, Homo sapiens
caatcattttatg

SEQ ID NO: 5990401 - DNA, 13 bp, Homo sapiens
caatcattttcta

SEQ ID NO: 5990402 - DNA, 22 bp, Homo sapiens
caatcattttggaggctttgtt

SEQ ID NO: 5990403 - DNA, 16 bp, Homo sapiens
caatcattttgggaaa

SEQ ID NO: 5990404 - DNA, 18 bp, Homo sapiens
caatccaaattccctctg

SEQ ID NO: 5990405 - DNA, 18 bp, Homo sapiens
caatccaacccatgcatg

SEQ ID NO: 5990406 - DNA, 12 bp, Homo sapiens
caatccaccttc

SEQ ID NO: 5990407 - DNA, 13 bp, Homo sapiens
caatccagccttc

SEQ ID NO: 5990408 - DNA, 17 bp, Homo sapiens
caatccagcggttctca

SEQ ID NO: 5990409 - DNA, 22 bp, Homo sapiens
caatccaggcccggtgaggcca

SEQ ID NO: 5990410 - DNA, 21 bp, Homo sapiens
caatccaggtacgcacagaca

SEQ ID NO: 5990411 - DNA, 20 bp, Homo sapiens
caatccagtggacttcgcag

SEQ ID NO: 5990412 - DNA, 16 bp, Homo sapiens
caatccatcagtgcca

SEQ ID NO: 5990413 - DNA, 15 bp, Homo sapiens
caatccatccatgta

SEQ ID NO: 5990414 - DNA, 16 bp, Homo sapiens
caatccatgcttcact

SEQ ID NO: 5990415 - DNA, 21 bp, Homo sapiens
caatccatgttagtttttact

SEQ ID NO: 5990416 - DNA, 23 bp, Homo sapiens
caatccattcacaagcctcctgt

SEQ ID NO: 5990417 - DNA, 21 bp, Homo sapiens
caatccatttggcagaactgc

SEQ ID NO: 5990418 - DNA, 23 bp, Homo sapiens
caatccatttggcagaactgctg

SEQ ID NO: 5990419 - DNA, 17 bp, Homo sapiens
caatcccaaagcgctcg

SEQ ID NO: 5990420 - DNA, 14 bp, Homo sapiens
caatcccaattctg

SEQ ID NO: 5990421 - DNA, 15 bp, Homo sapiens
caatcccaattctgt

SEQ ID NO: 5990422 - DNA, 16 bp, Homo sapiens
caatcccaccaaccct

SEQ ID NO: 5990423 - DNA, 15 bp, Homo sapiens
caatcccagcaggag

SEQ ID NO: 5990424 - DNA, 21 bp, Homo sapiens
caatcccagttcttcctgcaa

SEQ ID NO: 5990425 - DNA, 14 bp, Homo sapiens
caatccccactcct

SEQ ID NO: 5990426 - DNA, 12 bp, Homo sapiens
caatccccatca

SEQ ID NO: 5990427 - DNA, 13 bp, Homo sapiens
caatccccatcag

SEQ ID NO: 5990428 - DNA, 21 bp, Homo sapiens
caatcccctcattcaggaaaa

SEQ ID NO: 5990429 - DNA, 11 bp, Homo sapiens
caatccctcaa

SEQ ID NO: 5990430 - DNA, 12 bp, Homo sapiens
caatccctcaaa

SEQ ID NO: 5990431 - DNA, 13 bp, Homo sapiens
caatccctctcca

SEQ ID NO: 5990432 - DNA, 14 bp, Homo sapiens
caatccctctccac

SEQ ID NO: 5990433 - DNA, 16 bp, Homo sapiens
caatccctctccactc

SEQ ID NO: 5990434 - DNA, 11 bp, Homo sapiens
caatccctgac

SEQ ID NO: 5990435 - DNA, 14 bp, Homo sapiens
caatccctgccact

SEQ ID NO: 5990436 - DNA, 18 bp, Homo sapiens
caatccctgccactgggc

SEQ ID NO: 5990437 - DNA, 23 bp, Homo sapiens
caatccctgccactgggctctgg

SEQ ID NO: 5990438 - DNA, 12 bp, Homo sapiens
caatccctgggg

SEQ ID NO: 5990439 - DNA, 14 bp, Homo sapiens
caatccctggggct

SEQ ID NO: 5990440 - DNA, 18 bp, Homo sapiens
caatcccttctccactta

SEQ ID NO: 5990441 - DNA, 14 bp, Homo sapiens
caatccctttgcaa

SEQ ID NO: 5990442 - DNA, 15 bp, Homo sapiens
caatccgagcagtgg

SEQ ID NO: 5990443 - DNA, 21 bp, Homo sapiens
caatcctaatttctcctccct

SEQ ID NO: 5990444 - DNA, 20 bp, Homo sapiens
caatcctagaaccaagcttc

SEQ ID NO: 5990445 - DNA, 17 bp, Homo sapiens
caatcctaggtagggtt

SEQ ID NO: 5990446 - DNA, 12 bp, Homo sapiens
caatcctatgca

SEQ ID NO: 5990447 - DNA, 14 bp, Homo sapiens
caatcctatgcatg

SEQ ID NO: 5990448 - DNA, 22 bp, Homo sapiens
caatcctatgcatggtttcagc

SEQ ID NO: 5990449 - DNA, 21 bp, Homo sapiens
caatcctatgtcatttctact

SEQ ID NO: 5990450 - DNA, 14 bp, Homo sapiens
caatcctatgtttt

SEQ ID NO: 5990451 - DNA, 20 bp, Homo sapiens
caatcctcaaacatggaaga

SEQ ID NO: 5990452 - DNA, 17 bp, Homo sapiens
caatcctcactgggtgg

SEQ ID NO: 5990453 - DNA, 11 bp, Homo sapiens
caatcctcagg

SEQ ID NO: 5990454 - DNA, 13 bp, Homo sapiens
caatcctccccac

SEQ ID NO: 5990455 - DNA, 19 bp, Homo sapiens
caatcctccccgctctgcc

SEQ ID NO: 5990456 - DNA, 14 bp, Homo sapiens
caatcctccctgga

SEQ ID NO: 5990457 - DNA, 15 bp, Homo sapiens
caatcctccctggag

SEQ ID NO: 5990458 - DNA, 17 bp, Homo sapiens
caatcctccctggagaa

SEQ ID NO: 5990459 - DNA, 19 bp, Homo sapiens
caatcctccctggagaagg

SEQ ID NO: 5990460 - DNA, 18 bp, Homo sapiens
caatcctgattcctctct

SEQ ID NO: 5990461 - DNA, 11 bp, Homo sapiens
caatcctgccc

SEQ ID NO: 5990462 - DNA, 20 bp, Homo sapiens
caatcctgcccccagccatg

SEQ ID NO: 5990463 - DNA, 22 bp, Homo sapiens
caatcctgtaggcacaaaacca

SEQ ID NO: 5990464 - DNA, 20 bp, Homo sapiens
caatcctgttactctgtccc

SEQ ID NO: 5990465 - DNA, 12 bp, Homo sapiens
caatccttacaa

SEQ ID NO: 5990466 - DNA, 17 bp, Homo sapiens
caatccttacaaatgat

SEQ ID NO: 5990467 - DNA, 20 bp, Homo sapiens
caatccttacaaatgattgc

SEQ ID NO: 5990468 - DNA, 19 bp, Homo sapiens
caatccttccctgctcttg

SEQ ID NO: 5990469 - DNA, 14 bp, Homo sapiens
caatcctttattat

SEQ ID NO: 5990470 - DNA, 16 bp, Homo sapiens
caatcctttctgccca

SEQ ID NO: 5990471 - DNA, 20 bp, Homo sapiens
caatcgacatcctagcccca

SEQ ID NO: 5990472 - DNA, 20 bp, Homo sapiens
caatcgactgggtttatgtc

SEQ ID NO: 5990473 - DNA, 14 bp, Homo sapiens
caatcgcatcccgg

SEQ ID NO: 5990474 - DNA, 21 bp, Homo sapiens
caatcgcatcccggctgaccc

SEQ ID NO: 5990475 - DNA, 19 bp, Homo sapiens
caatcgggagtagcaagga

SEQ ID NO: 5990476 - DNA, 12 bp, Homo sapiens
caatctaaaaaa

SEQ ID NO: 5990477 - DNA, 17 bp, Homo sapiens
caatctaaaacaattcc

SEQ ID NO: 5990478 - DNA, 18 bp, Homo sapiens
caatctaaattaaaaaag

SEQ ID NO: 5990479 - DNA, 21 bp, Homo sapiens
caatctaaattaaaaaagaaa

SEQ ID NO: 5990480 - DNA, 19 bp, Homo sapiens
caatctaacaataatattt

SEQ ID NO: 5990481 - DNA, 20 bp, Homo sapiens
caatctaaccacatcaatat

SEQ ID NO: 5990482 - DNA, 12 bp, Homo sapiens
caatctaatttt

SEQ ID NO: 5990483 - DNA, 16 bp, Homo sapiens
caatctacactgcctt

SEQ ID NO: 5990484 - DNA, 17 bp, Homo sapiens
caatctacactgcctta

SEQ ID NO: 5990485 - DNA, 14 bp, Homo sapiens
caatctactggaaa

SEQ ID NO: 5990486 - DNA, 15 bp, Homo sapiens
caatctactggaaat

SEQ ID NO: 5990487 - DNA, 19 bp, Homo sapiens
caatctatggcttatttct

SEQ ID NO: 5990488 - DNA, 20 bp, Homo sapiens
caatctattaatagctgcct

SEQ ID NO: 5990489 - DNA, 22 bp, Homo sapiens
caatctattaatagctgcctta

SEQ ID NO: 5990490 - DNA, 13 bp, Homo sapiens
caatctattctca

SEQ ID NO: 5990491 - DNA, 21 bp, Homo sapiens
caatctatttaaaaaactgta

SEQ ID NO: 5990492 - DNA, 15 bp, Homo sapiens
caatctcacacagct

SEQ ID NO: 5990493 - DNA, 14 bp, Homo sapiens
caatctccagggct

SEQ ID NO: 5990494 - DNA, 17 bp, Homo sapiens
caatctccagggctcca

SEQ ID NO: 5990495 - DNA, 18 bp, Homo sapiens
caatctccagggctgccc

SEQ ID NO: 5990496 - DNA, 20 bp, Homo sapiens
caatctccagggctgcccct

SEQ ID NO: 5990497 - DNA, 14 bp, Homo sapiens
caatctccatgtgt

SEQ ID NO: 5990498 - DNA, 14 bp, Homo sapiens
caatctcccctcaa

SEQ ID NO: 5990499 - DNA, 21 bp, Homo sapiens
caatctcgtatagaagtcttc

SEQ ID NO: 5990500 - DNA, 18 bp, Homo sapiens
caatctcgtttagtgcca

SEQ ID NO: 5990501 - DNA, 12 bp, Homo sapiens
caatctctctct

SEQ ID NO: 5990502 - DNA, 15 bp, Homo sapiens
caatctctctctgtg

SEQ ID NO: 5990503 - DNA, 16 bp, Homo sapiens
caatctctctctgtgt

SEQ ID NO: 5990504 - DNA, 11 bp, Homo sapiens
caatctctgac

SEQ ID NO: 5990505 - DNA, 18 bp, Homo sapiens
caatctctggaaaaataa

SEQ ID NO: 5990506 - DNA, 21 bp, Homo sapiens
caatctcttaaattgggttca

SEQ ID NO: 5990507 - DNA, 15 bp, Homo sapiens
caatctcttcattat

SEQ ID NO: 5990508 - DNA, 17 bp, Homo sapiens
caatctctttttgtttg

SEQ ID NO: 5990509 - DNA, 19 bp, Homo sapiens
caatctgacattctcagga

SEQ ID NO: 5990510 - DNA, 11 bp, Homo sapiens
caatctgagca

SEQ ID NO: 5990511 - DNA, 22 bp, Homo sapiens
caatctgagcaaacaccagtga

SEQ ID NO: 5990512 - DNA, 23 bp, Homo sapiens
caatctgagcaaacaccagtgag

SEQ ID NO: 5990513 - DNA, 19 bp, Homo sapiens
caatctgcaagtcccaggg

SEQ ID NO: 5990514 - DNA, 15 bp, Homo sapiens
caatctgcagccatt

SEQ ID NO: 5990515 - DNA, 11 bp, Homo sapiens
caatctggaaa

SEQ ID NO: 5990516 - DNA, 19 bp, Homo sapiens
caatctggcccttacacac

SEQ ID NO: 5990517 - DNA, 23 bp, Homo sapiens
caatctggcccttacacactcag

SEQ ID NO: 5990518 - DNA, 17 bp, Homo sapiens
caatctggctggtaaat

SEQ ID NO: 5990519 - DNA, 18 bp, Homo sapiens
caatctggctggtaaatg

SEQ ID NO: 5990520 - DNA, 19 bp, Homo sapiens
caatctggcttagtgccac

SEQ ID NO: 5990521 - DNA, 20 bp, Homo sapiens
caatctggcttagtgccacc

SEQ ID NO: 5990522 - DNA, 18 bp, Homo sapiens
caatctgggactttcact

SEQ ID NO: 5990523 - DNA, 12 bp, Homo sapiens
caatctgtaaac

SEQ ID NO: 5990524 - DNA, 15 bp, Homo sapiens
caatctgtaaactgt

SEQ ID NO: 5990525 - DNA, 16 bp, Homo sapiens
caatctgtatctttga

SEQ ID NO: 5990526 - DNA, 22 bp, Homo sapiens
caatctgtccagacaagccctg

SEQ ID NO: 5990527 - DNA, 12 bp, Homo sapiens
caatctgtcttt

SEQ ID NO: 5990528 - DNA, 16 bp, Homo sapiens
caatctgtgagaagtt

SEQ ID NO: 5990529 - DNA, 23 bp, Homo sapiens
caatctgtgatgacattccctgc

SEQ ID NO: 5990530 - DNA, 12 bp, Homo sapiens
caatctgtgggc

SEQ ID NO: 5990531 - DNA, 17 bp, Homo sapiens
caatctgtgtaagaaaa

SEQ ID NO: 5990532 - DNA, 12 bp, Homo sapiens
caatctgttcta

SEQ ID NO: 5990533 - DNA, 13 bp, Homo sapiens
caatctgttctac

SEQ ID NO: 5990534 - DNA, 20 bp, Homo sapiens
caatctgttttggctttatg

SEQ ID NO: 5990535 - DNA, 20 bp, Homo sapiens
caatcttaaacataataaat

SEQ ID NO: 5990536 - DNA, 16 bp, Homo sapiens
caatcttaagagcttg

SEQ ID NO: 5990537 - DNA, 21 bp, Homo sapiens
caatcttaccagatgctactg

SEQ ID NO: 5990538 - DNA, 15 bp, Homo sapiens
caatcttactttgta

SEQ ID NO: 5990539 - DNA, 16 bp, Homo sapiens
caatcttactttgtaa

SEQ ID NO: 5990540 - DNA, 23 bp, Homo sapiens
caatcttactttgtaaattctga

SEQ ID NO: 5990541 - DNA, 12 bp, Homo sapiens
caatcttatgtt

SEQ ID NO: 5990542 - DNA, 12 bp, Homo sapiens
caatcttattac

SEQ ID NO: 5990543 - DNA, 18 bp, Homo sapiens
caatcttattactgagag

SEQ ID NO: 5990544 - DNA, 16 bp, Homo sapiens
caatcttattccgagc

SEQ ID NO: 5990545 - DNA, 17 bp, Homo sapiens
caatcttgcatgtaacg

SEQ ID NO: 5990546 - DNA, 18 bp, Homo sapiens
caatcttgcatgtaacgc

SEQ ID NO: 5990547 - DNA, 22 bp, Homo sapiens
caatcttgccgtcactattcat

SEQ ID NO: 5990548 - DNA, 16 bp, Homo sapiens
caatcttgctgtgaaa

SEQ ID NO: 5990549 - DNA, 18 bp, Homo sapiens
caatcttgctttgtgtat

SEQ ID NO: 5990550 - DNA, 20 bp, Homo sapiens
caatcttggagctgcttgga

SEQ ID NO: 5990551 - DNA, 15 bp, Homo sapiens
caatcttgttactgc

SEQ ID NO: 5990552 - DNA, 17 bp, Homo sapiens
caatcttgtttatagca

SEQ ID NO: 5990553 - DNA, 15 bp, Homo sapiens
caatctttaaaccaa

SEQ ID NO: 5990554 - DNA, 22 bp, Homo sapiens
caatctttaaaccaattgctgc

SEQ ID NO: 5990555 - DNA, 22 bp, Homo sapiens
caatctttcatgtcttgtcata

SEQ ID NO: 5990556 - DNA, 18 bp, Homo sapiens
caatctttccttgtctct

SEQ ID NO: 5990557 - DNA, 21 bp, Homo sapiens
caatctttctatataaaatgt

SEQ ID NO: 5990558 - DNA, 12 bp, Homo sapiens
caatctttgaaa

SEQ ID NO: 5990559 - DNA, 14 bp, Homo sapiens
caatctttgaaata

SEQ ID NO: 5990560 - DNA, 19 bp, Homo sapiens
caatctttgcctttatctc

SEQ ID NO: 5990561 - DNA, 12 bp, Homo sapiens
caatcttttaaa

SEQ ID NO: 5990562 - DNA, 21 bp, Homo sapiens
caatgaaaaatagtgtctttg

SEQ ID NO: 5990563 - DNA, 13 bp, Homo sapiens
caatgaaaacaaa

SEQ ID NO: 5990564 - DNA, 15 bp, Homo sapiens
caatgaaaacaaaat

SEQ ID NO: 5990565 - DNA, 15 bp, Homo sapiens
caatgaaaacatgta

SEQ ID NO: 5990566 - DNA, 16 bp, Homo sapiens
caatgaaaacatgtac

SEQ ID NO: 5990567 - DNA, 16 bp, Homo sapiens
caatgaaaactctttg

SEQ ID NO: 5990568 - DNA, 22 bp, Homo sapiens
cacttgtccattgcgttatttt

SEQ ID NO: 5990569 - DNA, 19 bp, Homo sapiens
cacttgtcccactatctgg

SEQ ID NO: 5990570 - DNA, 23 bp, Homo sapiens
cacttgtccccaaatccgaacct

SEQ ID NO: 5990571 - DNA, 17 bp, Homo sapiens
cacttgtctcaggactc

SEQ ID NO: 5990572 - DNA, 19 bp, Homo sapiens
cacttgtctcattttaatg

SEQ ID NO: 5990573 - DNA, 17 bp, Homo sapiens
cacttgtctcctttctg

SEQ ID NO: 5990574 - DNA, 21 bp, Homo sapiens
cacttgtctcctttctgactg

SEQ ID NO: 5990575 - DNA, 14 bp, Homo sapiens
cacttgtcttgctc

SEQ ID NO: 5990576 - DNA, 15 bp, Homo sapiens
cacttgtcttgctct

SEQ ID NO: 5990577 - DNA, 11 bp, Homo sapiens
cacttgtgaat

SEQ ID NO: 5990578 - DNA, 17 bp, Homo sapiens
cacttgtgacttttgct

SEQ ID NO: 5990579 - DNA, 21 bp, Homo sapiens
cacttgtgacttttgctttaa

SEQ ID NO: 5990580 - DNA, 13 bp, Homo sapiens
cacttgtgccagc

SEQ ID NO: 5990581 - DNA, 19 bp, Homo sapiens
cacttgtgctttgctcttg

SEQ ID NO: 5990582 - DNA, 20 bp, Homo sapiens
cacttgtgctttgctcttgt

SEQ ID NO: 5990583 - DNA, 17 bp, Homo sapiens
cacttgtggcagcttcc

SEQ ID NO: 5990584 - DNA, 15 bp, Homo sapiens
cacttgtgggtcctg

SEQ ID NO: 5990585 - DNA, 17 bp, Homo sapiens
cacttgtgggtcctggg

SEQ ID NO: 5990586 - DNA, 18 bp, Homo sapiens
cacttgtgggtcctgggg

SEQ ID NO: 5990587 - DNA, 18 bp, Homo sapiens
cacttgtgtcaaccacta

SEQ ID NO: 5990588 - DNA, 19 bp, Homo sapiens
cacttgtgtcaaccactaa

SEQ ID NO: 5990589 - DNA, 22 bp, Homo sapiens
cacttgtgtcaaccactaaagt

SEQ ID NO: 5990590 - DNA, 15 bp, Homo sapiens
cacttgtgtgtgggc

SEQ ID NO: 5990591 - DNA, 17 bp, Homo sapiens
cacttgtgtgtgggctg

SEQ ID NO: 5990592 - DNA, 23 bp, Homo sapiens
cacttgtgtgtgggctgtgagtg

SEQ ID NO: 5990593 - DNA, 16 bp, Homo sapiens
cacttgtgttgctttc

SEQ ID NO: 5990594 - DNA, 18 bp, Homo sapiens
cacttgtgttgctttctg

SEQ ID NO: 5990595 - DNA, 22 bp, Homo sapiens
cacttgtgttgctttctgactg

SEQ ID NO: 5990596 - DNA, 22 bp, Homo sapiens
cacttgtgtttgtatataaatg

SEQ ID NO: 5990597 - DNA, 17 bp, Homo sapiens
cacttgtgttttgcaag

SEQ ID NO: 5990598 - DNA, 22 bp, Homo sapiens
cacttgtgttttgcaagccaga

SEQ ID NO: 5990599 - DNA, 19 bp, Homo sapiens
cacttgttgattaatggaa

SEQ ID NO: 5990600 - DNA, 13 bp, Homo sapiens
cacttgtttgcac

SEQ ID NO: 5990601 - DNA, 13 bp, Homo sapiens
cactttaaactta

SEQ ID NO: 5990602 - DNA, 21 bp, Homo sapiens
cactttaaagaggctgtgtgg

SEQ ID NO: 5990603 - DNA, 19 bp, Homo sapiens
cactttaaagcaattgcat

SEQ ID NO: 5990604 - DNA, 21 bp, Homo sapiens
cactttaacacagtgtctggc

SEQ ID NO: 5990605 - DNA, 20 bp, Homo sapiens
cactttaaccctctcttccc

SEQ ID NO: 5990606 - DNA, 19 bp, Homo sapiens
cactttaattgaagaactg

SEQ ID NO: 5990607 - DNA, 24 bp, Homo sapiens
cactttaattgaagaactgcactt

SEQ ID NO: 5990608 - DNA, 22 bp, Homo sapiens
cactttacaatgttcatcccat

SEQ ID NO: 5990609 - DNA, 16 bp, Homo sapiens
cactttacacaagaat

SEQ ID NO: 5990610 - DNA, 19 bp, Homo sapiens
cactttacacaagaatcta

SEQ ID NO: 5990611 - DNA, 20 bp, Homo sapiens
cactttacagttctggagga

SEQ ID NO: 5990612 - DNA, 16 bp, Homo sapiens
cactttacataggatt

SEQ ID NO: 5990613 - DNA, 14 bp, Homo sapiens
cactttacattctt

SEQ ID NO: 5990614 - DNA, 19 bp, Homo sapiens
cactttacccacctagaac

SEQ ID NO: 5990615 - DNA, 20 bp, Homo sapiens
cactttacccacctagaaca

SEQ ID NO: 5990616 - DNA, 16 bp, Homo sapiens
cactttacctgcaggc

SEQ ID NO: 5990617 - DNA, 19 bp, Homo sapiens
cactttacctgcaggctcc

SEQ ID NO: 5990618 - DNA, 14 bp, Homo sapiens
cactttactttcaa

SEQ ID NO: 5990619 - DNA, 18 bp, Homo sapiens
cactttagaaggttgtat

SEQ ID NO: 5990620 - DNA, 23 bp, Homo sapiens
cactttagacatttttgtgccat

SEQ ID NO: 5990621 - DNA, 21 bp, Homo sapiens
cactttagatgctgatgattt

SEQ ID NO: 5990622 - DNA, 15 bp, Homo sapiens
cactttagggctgta

SEQ ID NO: 5990623 - DNA, 21 bp, Homo sapiens
cactttagtgattgcttttat

SEQ ID NO: 5990624 - DNA, 13 bp, Homo sapiens
cactttatcttgg

SEQ ID NO: 5990625 - DNA, 21 bp, Homo sapiens
cactttatgccggatgtgctt

SEQ ID NO: 5990626 - DNA, 22 bp, Homo sapiens
cactttatgccggatgtgcttt

SEQ ID NO: 5990627 - DNA, 19 bp, Homo sapiens
cactttattacaagatctt

SEQ ID NO: 5990628 - DNA, 13 bp, Homo sapiens
cactttattgcta

SEQ ID NO: 5990629 - DNA, 17 bp, Homo sapiens
cactttattgtagaaaa

SEQ ID NO: 5990630 - DNA, 17 bp, Homo sapiens
cactttatttacttcgt

SEQ ID NO: 5990631 - DNA, 12 bp, Homo sapiens
cactttcaaaac

SEQ ID NO: 5990632 - DNA, 14 bp, Homo sapiens
cactttcaagctgc

SEQ ID NO: 5990633 - DNA, 17 bp, Homo sapiens
cactttcaagctgcact

SEQ ID NO: 5990634 - DNA, 18 bp, Homo sapiens
cactttcaagctgcactg

SEQ ID NO: 5990635 - DNA, 19 bp, Homo sapiens
cactttcaagctgcactga

SEQ ID NO: 5990636 - DNA, 15 bp, Homo sapiens
cactttcactgggga

SEQ ID NO: 5990637 - DNA, 20 bp, Homo sapiens
cactttcatctgagctttta

SEQ ID NO: 5990638 - DNA, 16 bp, Homo sapiens
cactttcattgccagt

SEQ ID NO: 5990639 - DNA, 20 bp, Homo sapiens
cactttcattgccagtgtct

SEQ ID NO: 5990640 - DNA, 14 bp, Homo sapiens
cactttccaagtca

SEQ ID NO: 5990641 - DNA, 23 bp, Homo sapiens
cactttccactccctgcttagga

SEQ ID NO: 5990642 - DNA, 18 bp, Homo sapiens
cactttccacttccagag

SEQ ID NO: 5990643 - DNA, 17 bp, Homo sapiens
cactttccacttcttcc

SEQ ID NO: 5990644 - DNA, 18 bp, Homo sapiens
cactttccacttcttcct

SEQ ID NO: 5990645 - DNA, 22 bp, Homo sapiens
cactttccacttcttcctttct

SEQ ID NO: 5990646 - DNA, 13 bp, Homo sapiens
cactttccatctc

SEQ ID NO: 5990647 - DNA, 13 bp, Homo sapiens
cactttcccaccc

SEQ ID NO: 5990648 - DNA, 18 bp, Homo sapiens
cactttcccccttcccgc

SEQ ID NO: 5990649 - DNA, 19 bp, Homo sapiens
cactttcccttcccctgtg

SEQ ID NO: 5990650 - DNA, 17 bp, Homo sapiens
cactttcctacaaaatg

SEQ ID NO: 5990651 - DNA, 18 bp, Homo sapiens
cactttcctacaaaatgg

SEQ ID NO: 5990652 - DNA, 19 bp, Homo sapiens
cactttcctacaaaatgga

SEQ ID NO: 5990653 - DNA, 17 bp, Homo sapiens
cactttcctagttctta

SEQ ID NO: 5990654 - DNA, 12 bp, Homo sapiens
cactttcctcag

SEQ ID NO: 5990655 - DNA, 15 bp, Homo sapiens
cactttcctcagttg

SEQ ID NO: 5990656 - DNA, 16 bp, Homo sapiens
cactttcctctctctc

SEQ ID NO: 5990657 - DNA, 15 bp, Homo sapiens
cactttcctgagctg

SEQ ID NO: 5990658 - DNA, 21 bp, Homo sapiens
cactttcctgagctgtcgctg

SEQ ID NO: 5990659 - DNA, 18 bp, Homo sapiens
cactttccttctctgtaa

SEQ ID NO: 5990660 - DNA, 15 bp, Homo sapiens
cactttcctttcaat

SEQ ID NO: 5990661 - DNA, 16 bp, Homo sapiens
cactttcgcctcctcc

SEQ ID NO: 5990662 - DNA, 16 bp, Homo sapiens
cactttctaatgtttc

SEQ ID NO: 5990663 - DNA, 20 bp, Homo sapiens
cactttctatcctctgtaaa

SEQ ID NO: 5990664 - DNA, 23 bp, Homo sapiens
cactttctcctggtgtttttctc

SEQ ID NO: 5990665 - DNA, 23 bp, Homo sapiens
cactttctcggtccactcttgtt

SEQ ID NO: 5990666 - DNA, 13 bp, Homo sapiens
cactttctctctt

SEQ ID NO: 5990667 - DNA, 12 bp, Homo sapiens
cactttctcttc

SEQ ID NO: 5990668 - DNA, 22 bp, Homo sapiens
cactttctcttcttgtttctcc

SEQ ID NO: 5990669 - DNA, 13 bp, Homo sapiens
cactttctggcaa

SEQ ID NO: 5990670 - DNA, 23 bp, Homo sapiens
cactttcttttttttctatttca

SEQ ID NO: 5990671 - DNA, 12 bp, Homo sapiens
cactttgaaaag

SEQ ID NO: 5990672 - DNA, 14 bp, Homo sapiens
cactttgaaaagtt

SEQ ID NO: 5990673 - DNA, 16 bp, Homo sapiens
cactttgaaaatattt

SEQ ID NO: 5990674 - DNA, 17 bp, Homo sapiens
cactttgaaaatatttc

SEQ ID NO: 5990675 - DNA, 16 bp, Homo sapiens
cactttgaaatacctc

SEQ ID NO: 5990676 - DNA, 21 bp, Homo sapiens
cactttgaaatacctcatgtt

SEQ ID NO: 5990677 - DNA, 20 bp, Homo sapiens
cactttgaaatgtgtttctg

SEQ ID NO: 5990678 - DNA, 21 bp, Homo sapiens
cactttgaactactagaaaat

SEQ ID NO: 5990679 - DNA, 20 bp, Homo sapiens
cactttgaactcctcaaggg

SEQ ID NO: 5990680 - DNA, 21 bp, Homo sapiens
cactttgaaggtaataaatac

SEQ ID NO: 5990681 - DNA, 17 bp, Homo sapiens
cactttgagcctgggaa

SEQ ID NO: 5990682 - DNA, 18 bp, Homo sapiens
cactttgagcctgggaaa

SEQ ID NO: 5990683 - DNA, 18 bp, Homo sapiens
cactttgcacattttgat

SEQ ID NO: 5990684 - DNA, 12 bp, Homo sapiens
cactttgcataa

SEQ ID NO: 5990685 - DNA, 16 bp, Homo sapiens
cactttgcctcctgtg

SEQ ID NO: 5990686 - DNA, 19 bp, Homo sapiens
cactttgcttaagatgcta

SEQ ID NO: 5990687 - DNA, 20 bp, Homo sapiens
cactttggatttcatcagac

SEQ ID NO: 5990688 - DNA, 23 bp, Homo sapiens
cactttggcttataattctttca

SEQ ID NO: 5990689 - DNA, 12 bp, Homo sapiens
cactttgggagg

SEQ ID NO: 5990690 - DNA, 14 bp, Homo sapiens
cactttgggaggcc

SEQ ID NO: 5990691 - DNA, 23 bp, Homo sapiens
cactttgggaggccaaggagggc

SEQ ID NO: 5990692 - DNA, 16 bp, Homo sapiens
cactttgggaggctga

SEQ ID NO: 5990693 - DNA, 13 bp, Homo sapiens
cactttggggaac

SEQ ID NO: 5990694 - DNA, 23 bp, Homo sapiens
cactttggtctccatttttccca

SEQ ID NO: 5990695 - DNA, 19 bp, Homo sapiens
cactttggttttgctgaga

SEQ ID NO: 5990696 - DNA, 13 bp, Homo sapiens
cactttgtaaata

SEQ ID NO: 5990697 - DNA, 13 bp, Homo sapiens
cactttgtaaatt

SEQ ID NO: 5990698 - DNA, 17 bp, Homo sapiens
cactttgtaatttttgc

SEQ ID NO: 5990699 - DNA, 16 bp, Homo sapiens
cactttgtataaattt

SEQ ID NO: 5990700 - DNA, 22 bp, Homo sapiens
cactttgtataaatttttaagt

SEQ ID NO: 5990701 - DNA, 15 bp, Homo sapiens
cactttgtattactt

SEQ ID NO: 5990702 - DNA, 17 bp, Homo sapiens
cactttgtattctctgt

SEQ ID NO: 5990703 - DNA, 20 bp, Homo sapiens
cactttgtattctctgtcca

SEQ ID NO: 5990704 - DNA, 15 bp, Homo sapiens
cactttgtctgtaca

SEQ ID NO: 5990705 - DNA, 16 bp, Homo sapiens
cactttgtctgtacat

SEQ ID NO: 5990706 - DNA, 16 bp, Homo sapiens
cactttgtgagtattc

SEQ ID NO: 5990707 - DNA, 20 bp, Homo sapiens
cactttgttagaaagtgctt

SEQ ID NO: 5990708 - DNA, 14 bp, Homo sapiens
cactttgttctggc

SEQ ID NO: 5990709 - DNA, 14 bp, Homo sapiens
cactttgttcttta

SEQ ID NO: 5990710 - DNA, 14 bp, Homo sapiens
cactttgttgcaag

SEQ ID NO: 5990711 - DNA, 19 bp, Homo sapiens
cactttgttggcccttcca

SEQ ID NO: 5990712 - DNA, 23 bp, Homo sapiens
cactttgttggcccttccagtgg

SEQ ID NO: 5990713 - DNA, 16 bp, Homo sapiens
cactttgtttagaaaa

SEQ ID NO: 5990714 - DNA, 17 bp, Homo sapiens
cactttgtttatgcata

SEQ ID NO: 5990715 - DNA, 16 bp, Homo sapiens
cacttttaaaaaacaa

SEQ ID NO: 5990716 - DNA, 23 bp, Homo sapiens
cacttttaacaaaaaaggaaaat

SEQ ID NO: 5990717 - DNA, 17 bp, Homo sapiens
cacttttaataaacttt

SEQ ID NO: 5990718 - DNA, 15 bp, Homo sapiens
cacttttagaaatgc

SEQ ID NO: 5990719 - DNA, 17 bp, Homo sapiens
cacttttatatttgaaa

SEQ ID NO: 5990720 - DNA, 13 bp, Homo sapiens
cacttttatgttt

SEQ ID NO: 5990721 - DNA, 18 bp, Homo sapiens
cacttttatttagcacca

SEQ ID NO: 5990722 - DNA, 14 bp, Homo sapiens
cacttttcacttgt

SEQ ID NO: 5990723 - DNA, 17 bp, Homo sapiens
cacttttcatatcattt

SEQ ID NO: 5990724 - DNA, 18 bp, Homo sapiens
cacttttcattgcaaagt

SEQ ID NO: 5990725 - DNA, 16 bp, Homo sapiens
cacttttccagtattt

SEQ ID NO: 5990726 - DNA, 16 bp, Homo sapiens
cacttttcctccctca

SEQ ID NO: 5990727 - DNA, 15 bp, Homo sapiens
cacttttctcatctg

SEQ ID NO: 5990728 - DNA, 17 bp, Homo sapiens
cacttttgacaaaggca

SEQ ID NO: 5990729 - DNA, 18 bp, Homo sapiens
cacttttgacaaaggcaa

SEQ ID NO: 5990730 - DNA, 15 bp, Homo sapiens
cacttttgagacttt

SEQ ID NO: 5990731 - DNA, 13 bp, Homo sapiens
cacttttgccaat

SEQ ID NO: 5990732 - DNA, 16 bp, Homo sapiens
cacttttgctctgcag

SEQ ID NO: 5990733 - DNA, 23 bp, Homo sapiens
cacttttgggaggtccaggcagg

SEQ ID NO: 5990734 - DNA, 21 bp, Homo sapiens
cacttttgttaacagtatttc

SEQ ID NO: 5990735 - DNA, 22 bp, Homo sapiens
cacttttgttattccatcaata

SEQ ID NO: 5990736 - DNA, 20 bp, Homo sapiens
cacttttgttgcccaggctg

SEQ ID NO: 5990737 - DNA, 20 bp, Homo sapiens
cactttttaaaaaactttct

SEQ ID NO: 5990738 - DNA, 17 bp, Homo sapiens
cactttttacagcagca

SEQ ID NO: 5990739 - DNA, 19 bp, Homo sapiens
cactttttcatttgcctat

SEQ ID NO: 5990740 - DNA, 21 bp, Homo sapiens
cactttttccagaatttgaat

SEQ ID NO: 5990741 - DNA, 16 bp, Homo sapiens
cactttttccatttct

SEQ ID NO: 5990742 - DNA, 18 bp, Homo sapiens
cactttttcccctgcaat

SEQ ID NO: 5990743 - DNA, 19 bp, Homo sapiens
cactttttccttactgtgc

SEQ ID NO: 5990744 - DNA, 18 bp, Homo sapiens
cactttttccttctgaaa

SEQ ID NO: 5990745 - DNA, 17 bp, Homo sapiens
cactttttctctttcca

SEQ ID NO: 5990746 - DNA, 19 bp, Homo sapiens
caatgaaaagaaaatgtgc

SEQ ID NO: 5990747 - DNA, 12 bp, Homo sapiens
caatgaaaagtc

SEQ ID NO: 5990748 - DNA, 16 bp, Homo sapiens
caatgaaaattttaag

SEQ ID NO: 5990749 - DNA, 15 bp, Homo sapiens
caatgaaacaacaga

SEQ ID NO: 5990750 - DNA, 15 bp, Homo sapiens
caatgaaaccaaagc

SEQ ID NO: 5990751 - DNA, 14 bp, Homo sapiens
caatgaaagtcaaa

SEQ ID NO: 5990752 - DNA, 16 bp, Homo sapiens
caatgaaagtcaaatt

SEQ ID NO: 5990753 - DNA, 19 bp, Homo sapiens
caatgaaagtcaaatttac

SEQ ID NO: 5990754 - DNA, 23 bp, Homo sapiens
caatgaaatacacaagtaaacat

SEQ ID NO: 5990755 - DNA, 18 bp, Homo sapiens
caatgaaatactccagca

SEQ ID NO: 5990756 - DNA, 19 bp, Homo sapiens
caatgaaatattgctgtat

SEQ ID NO: 5990757 - DNA, 21 bp, Homo sapiens
caatgaaatgaattaaagtgg

SEQ ID NO: 5990758 - DNA, 21 bp, Homo sapiens
caatgaaatgctctcctttcc

SEQ ID NO: 5990759 - DNA, 15 bp, Homo sapiens
caatgaaatgcttgt

SEQ ID NO: 5990760 - DNA, 18 bp, Homo sapiens
caatgaacacttataagt

SEQ ID NO: 5990761 - DNA, 13 bp, Homo sapiens
caatgaacagctc

SEQ ID NO: 5990762 - DNA, 17 bp, Homo sapiens
caatgaacatccctttt

SEQ ID NO: 5990763 - DNA, 15 bp, Homo sapiens
caatgaaccataaat

SEQ ID NO: 5990764 - DNA, 16 bp, Homo sapiens
caatgaaccataaatt

SEQ ID NO: 5990765 - DNA, 17 bp, Homo sapiens
caatgaaccataaattc

SEQ ID NO: 5990766 - DNA, 13 bp, Homo sapiens
caatgaaccccca

SEQ ID NO: 5990767 - DNA, 19 bp, Homo sapiens
caatgaactgcttttcctc

SEQ ID NO: 5990768 - DNA, 20 bp, Homo sapiens
caatgaactgcttttcctca

SEQ ID NO: 5990769 - DNA, 12 bp, Homo sapiens
caatgaagaaga

SEQ ID NO: 5990770 - DNA, 16 bp, Homo sapiens
caatgaagaagtttct

SEQ ID NO: 5990771 - DNA, 15 bp, Homo sapiens
caatgaagataaatg

SEQ ID NO: 5990772 - DNA, 19 bp, Homo sapiens
caatgaagataaatgcttt

SEQ ID NO: 5990773 - DNA, 10 bp, Homo sapiens
caatgaagga

SEQ ID NO: 5990774 - DNA, 22 bp, Homo sapiens
caatgaaggctgaatcaaagac

SEQ ID NO: 5990775 - DNA, 21 bp, Homo sapiens
caatgaagttgaaaatcatag

SEQ ID NO: 5990776 - DNA, 17 bp, Homo sapiens
caatgaatccccgaccc

SEQ ID NO: 5990777 - DNA, 20 bp, Homo sapiens
caatgaatgtatattttgtg

SEQ ID NO: 5990778 - DNA, 16 bp, Homo sapiens
caatgaattaagaaag

SEQ ID NO: 5990779 - DNA, 15 bp, Homo sapiens
caatgaattcttcaa

SEQ ID NO: 5990780 - DNA, 23 bp, Homo sapiens
caatgaattttataatctgcagc

SEQ ID NO: 5990781 - DNA, 14 bp, Homo sapiens
caatgacaaagcag

SEQ ID NO: 5990782 - DNA, 16 bp, Homo sapiens
caatgacaagatgttc

SEQ ID NO: 5990783 - DNA, 14 bp, Homo sapiens
caatgacacagtct

SEQ ID NO: 5990784 - DNA, 20 bp, Homo sapiens
caatgacagggatgccaaca

SEQ ID NO: 5990785 - DNA, 23 bp, Homo sapiens
caatgacataaccaatttgtaat

SEQ ID NO: 5990786 - DNA, 21 bp, Homo sapiens
caatgacatccagaaagctga

SEQ ID NO: 5990787 - DNA, 16 bp, Homo sapiens
caatgacatctcaggg

SEQ ID NO: 5990788 - DNA, 15 bp, Homo sapiens
caatgacatgaattt

SEQ ID NO: 5990789 - DNA, 13 bp, Homo sapiens
caatgaccagcag

SEQ ID NO: 5990790 - DNA, 15 bp, Homo sapiens
caatgacctgtattt

SEQ ID NO: 5990791 - DNA, 13 bp, Homo sapiens
caatgacctttca

SEQ ID NO: 5990792 - DNA, 19 bp, Homo sapiens
caatgactagtcacctggg

SEQ ID NO: 5990793 - DNA, 20 bp, Homo sapiens
caatgactagtcacctgggg

SEQ ID NO: 5990794 - DNA, 22 bp, Homo sapiens
caatgactgcgcagagtggatt

SEQ ID NO: 5990795 - DNA, 17 bp, Homo sapiens
caatgactgtgctactg

SEQ ID NO: 5990796 - DNA, 19 bp, Homo sapiens
caatgactgtggagttcca

SEQ ID NO: 5990797 - DNA, 18 bp, Homo sapiens
caatgacttactgtacat

SEQ ID NO: 5990798 - DNA, 19 bp, Homo sapiens
caatgacttctaatttata

SEQ ID NO: 5990799 - DNA, 16 bp, Homo sapiens
caatgacttttaaaga

SEQ ID NO: 5990800 - DNA, 17 bp, Homo sapiens
caatgacttttaaagat

SEQ ID NO: 5990801 - DNA, 21 bp, Homo sapiens
caatgacttttaaagatttag

SEQ ID NO: 5990802 - DNA, 15 bp, Homo sapiens
caatgactttttatt

SEQ ID NO: 5990803 - DNA, 17 bp, Homo sapiens
caatgagacttgccttc

SEQ ID NO: 5990804 - DNA, 13 bp, Homo sapiens
caatgagctgtat

SEQ ID NO: 5990805 - DNA, 15 bp, Homo sapiens
caatgagctttctga

SEQ ID NO: 5990806 - DNA, 16 bp, Homo sapiens
caatgagctttctgaa

SEQ ID NO: 5990807 - DNA, 20 bp, Homo sapiens
caatgagctttctgaacagc

SEQ ID NO: 5990808 - DNA, 16 bp, Homo sapiens
caatgagtgtgccaga

SEQ ID NO: 5990809 - DNA, 20 bp, Homo sapiens
caatgataaatttaaatgac

SEQ ID NO: 5990810 - DNA, 23 bp, Homo sapiens
caatgatacccaacagtttattt

SEQ ID NO: 5990811 - DNA, 16 bp, Homo sapiens
caatgatataggaaaa

SEQ ID NO: 5990812 - DNA, 21 bp, Homo sapiens
caatgatataggaaaatacat

SEQ ID NO: 5990813 - DNA, 16 bp, Homo sapiens
caatgatcaaattttg

SEQ ID NO: 5990814 - DNA, 19 bp, Homo sapiens
caatgatcctgtattcaga

SEQ ID NO: 5990815 - DNA, 16 bp, Homo sapiens
caatgatctaggttta

SEQ ID NO: 5990816 - DNA, 21 bp, Homo sapiens
caatgatgaatgagaatctac

SEQ ID NO: 5990817 - DNA, 21 bp, Homo sapiens
caatgatgacccactaaagag

SEQ ID NO: 5990818 - DNA, 21 bp, Homo sapiens
caatgatgattaaacacctga

SEQ ID NO: 5990819 - DNA, 13 bp, Homo sapiens
caatgatgctatt

SEQ ID NO: 5990820 - DNA, 17 bp, Homo sapiens
caatgatgctatttgca

SEQ ID NO: 5990821 - DNA, 20 bp, Homo sapiens
caatgatgcttactacagaa

SEQ ID NO: 5990822 - DNA, 13 bp, Homo sapiens
caatgatggtaaa

SEQ ID NO: 5990823 - DNA, 20 bp, Homo sapiens
caatgatgtgagtacccagg

SEQ ID NO: 5990824 - DNA, 13 bp, Homo sapiens
caatgattaatca

SEQ ID NO: 5990825 - DNA, 21 bp, Homo sapiens
caatgattaggaatcattctg

SEQ ID NO: 5990826 - DNA, 14 bp, Homo sapiens
caatgattccagac

SEQ ID NO: 5990827 - DNA, 15 bp, Homo sapiens
caatgatttggccag

SEQ ID NO: 5990828 - DNA, 18 bp, Homo sapiens
caatgatttggccaggcc

SEQ ID NO: 5990829 - DNA, 15 bp, Homo sapiens
caatgatttgtaaag

SEQ ID NO: 5990830 - DNA, 14 bp, Homo sapiens
caatgcaaaagcca

SEQ ID NO: 5990831 - DNA, 21 bp, Homo sapiens
caatgcaaatagtagacattt

SEQ ID NO: 5990832 - DNA, 20 bp, Homo sapiens
caatgcaaccaactatccaa

SEQ ID NO: 5990833 - DNA, 15 bp, Homo sapiens
caatgcaacttttaa

SEQ ID NO: 5990834 - DNA, 23 bp, Homo sapiens
caatgcaagagtgattgcagctt

SEQ ID NO: 5990835 - DNA, 16 bp, Homo sapiens
caatgcaatgaaaaca

SEQ ID NO: 5990836 - DNA, 17 bp, Homo sapiens
caatgcaatgaaaacaa

SEQ ID NO: 5990837 - DNA, 18 bp, Homo sapiens
caatgcaatgaaaacaaa

SEQ ID NO: 5990838 - DNA, 16 bp, Homo sapiens
caatgcaattcaatgc

SEQ ID NO: 5990839 - DNA, 16 bp, Homo sapiens
caatgcacacaaaaca

SEQ ID NO: 5990840 - DNA, 13 bp, Homo sapiens
caatgcagaactc

SEQ ID NO: 5990841 - DNA, 16 bp, Homo sapiens
caatgcagatgccaga

SEQ ID NO: 5990842 - DNA, 18 bp, Homo sapiens
caatgcagcaaggccctg

SEQ ID NO: 5990843 - DNA, 22 bp, Homo sapiens
caatgcagcaaggccctgctgc

SEQ ID NO: 5990844 - DNA, 15 bp, Homo sapiens
caatgcagtcagtgt

SEQ ID NO: 5990845 - DNA, 21 bp, Homo sapiens
caatgcagtcagtgtttcttt

SEQ ID NO: 5990846 - DNA, 17 bp, Homo sapiens
caatgcagttgtctctg

SEQ ID NO: 5990847 - DNA, 19 bp, Homo sapiens
caatgcagttgtctctgtt

SEQ ID NO: 5990848 - DNA, 20 bp, Homo sapiens
caatgcagttgtctctgttt

SEQ ID NO: 5990849 - DNA, 23 bp, Homo sapiens
caatgcatacaataaaagagctt

SEQ ID NO: 5990850 - DNA, 17 bp, Homo sapiens
caatgcatagagccctg

SEQ ID NO: 5990851 - DNA, 19 bp, Homo sapiens
caatgcatagagccctggc

SEQ ID NO: 5990852 - DNA, 20 bp, Homo sapiens
caatgcatagagccctggcc

SEQ ID NO: 5990853 - DNA, 14 bp, Homo sapiens
caatgcatatctgt

SEQ ID NO: 5990854 - DNA, 16 bp, Homo sapiens
caatgcatgcagccac

SEQ ID NO: 5990855 - DNA, 18 bp, Homo sapiens
caatgcattggcctctgt

SEQ ID NO: 5990856 - DNA, 15 bp, Homo sapiens
caatgcatttaaaat

SEQ ID NO: 5990857 - DNA, 17 bp, Homo sapiens
caatgcatttaaaatac

SEQ ID NO: 5990858 - DNA, 22 bp, Homo sapiens
caatgcatttttaagaatttat

SEQ ID NO: 5990859 - DNA, 22 bp, Homo sapiens
caatgccaaaaaaagacagggc

SEQ ID NO: 5990860 - DNA, 19 bp, Homo sapiens
caatgccaagtcactcttt

SEQ ID NO: 5990861 - DNA, 20 bp, Homo sapiens
caatgccaagtcactctttt

SEQ ID NO: 5990862 - DNA, 15 bp, Homo sapiens
caatgccacagacaa

SEQ ID NO: 5990863 - DNA, 18 bp, Homo sapiens
caatgccacagccaagcc

SEQ ID NO: 5990864 - DNA, 16 bp, Homo sapiens
caatgccacagccctg

SEQ ID NO: 5990865 - DNA, 22 bp, Homo sapiens
caatgccacagccctgtcagca

SEQ ID NO: 5990866 - DNA, 23 bp, Homo sapiens
caatgccatcagcccctgggaac

SEQ ID NO: 5990867 - DNA, 14 bp, Homo sapiens
caatgccatcatct

SEQ ID NO: 5990868 - DNA, 16 bp, Homo sapiens
caatgccatgaacaaa

SEQ ID NO: 5990869 - DNA, 18 bp, Homo sapiens
caatgccatgaacaaatt

SEQ ID NO: 5990870 - DNA, 20 bp, Homo sapiens
caatgccatgactgctcagg

SEQ ID NO: 5990871 - DNA, 21 bp, Homo sapiens
caatgccatgactgctcaggc

SEQ ID NO: 5990872 - DNA, 18 bp, Homo sapiens
caatgccatttcagtggc

SEQ ID NO: 5990873 - DNA, 15 bp, Homo sapiens
caatgcccagtaaaa

SEQ ID NO: 5990874 - DNA, 16 bp, Homo sapiens
caatgcccagtaaaat

SEQ ID NO: 5990875 - DNA, 23 bp, Homo sapiens
caatgcccagtaaaatttcagga

SEQ ID NO: 5990876 - DNA, 13 bp, Homo sapiens
caatgccccctcc

SEQ ID NO: 5990877 - DNA, 16 bp, Homo sapiens
caatgccccctcccct

SEQ ID NO: 5990878 - DNA, 19 bp, Homo sapiens
caatgccccctcccctcct

SEQ ID NO: 5990879 - DNA, 20 bp, Homo sapiens
caatgccccctcccctcctt

SEQ ID NO: 5990880 - DNA, 20 bp, Homo sapiens
caatgccctaattagggcat

SEQ ID NO: 5990881 - DNA, 17 bp, Homo sapiens
caatgccctacctgcct

SEQ ID NO: 5990882 - DNA, 18 bp, Homo sapiens
caatgccctacctgcctg

SEQ ID NO: 5990883 - DNA, 12 bp, Homo sapiens
caatgccctgcc

SEQ ID NO: 5990884 - DNA, 16 bp, Homo sapiens
caatgccctgccttgc

SEQ ID NO: 5990885 - DNA, 18 bp, Homo sapiens
caatgccctgccttgctg

SEQ ID NO: 5990886 - DNA, 16 bp, Homo sapiens
caatgccctgctggcc

SEQ ID NO: 5990887 - DNA, 17 bp, Homo sapiens
caatgccgcaacatata

SEQ ID NO: 5990888 - DNA, 19 bp, Homo sapiens
caatgccgccgtgtttcct

SEQ ID NO: 5990889 - DNA, 17 bp, Homo sapiens
caatgccgcctgtcaat

SEQ ID NO: 5990890 - DNA, 16 bp, Homo sapiens
caatgcctataaaatg

SEQ ID NO: 5990891 - DNA, 20 bp, Homo sapiens
caatgcctattgtaatatag

SEQ ID NO: 5990892 - DNA, 19 bp, Homo sapiens
caatgcctcacgagatttg

SEQ ID NO: 5990893 - DNA, 16 bp, Homo sapiens
caatgcctcttgtctt

SEQ ID NO: 5990894 - DNA, 20 bp, Homo sapiens
caatgcctcttgtcttccta

SEQ ID NO: 5990895 - DNA, 17 bp, Homo sapiens
caatgccttgacaacag

SEQ ID NO: 5990896 - DNA, 14 bp, Homo sapiens
caatgcctttttag

SEQ ID NO: 5990897 - DNA, 22 bp, Homo sapiens
caatgcctttttagatgtattt

SEQ ID NO: 5990898 - DNA, 17 bp, Homo sapiens
caatgcgacaagtagtt

SEQ ID NO: 5990899 - DNA, 15 bp, Homo sapiens
caatgcgtcttgtga

SEQ ID NO: 5990900 - DNA, 21 bp, Homo sapiens
caatgctagcacaatattcct

SEQ ID NO: 5990901 - DNA, 19 bp, Homo sapiens
caatgctatggactgcaca

SEQ ID NO: 5990902 - DNA, 20 bp, Homo sapiens
caatgctatttttgttttta

SEQ ID NO: 5990903 - DNA, 20 bp, Homo sapiens
caatgctcaaacacccaagt

SEQ ID NO: 5990904 - DNA, 17 bp, Homo sapiens
caatgctcaggtgctgg

SEQ ID NO: 5990905 - DNA, 15 bp, Homo sapiens
caatgctctggagtg

SEQ ID NO: 5990906 - DNA, 13 bp, Homo sapiens
caatgctgatgtc

SEQ ID NO: 5990907 - DNA, 16 bp, Homo sapiens
caatgctgatttggtg

SEQ ID NO: 5990908 - DNA, 21 bp, Homo sapiens
caatgctgatttggtgaccaa

SEQ ID NO: 5990909 - DNA, 15 bp, Homo sapiens
caatgctgccatgcc

SEQ ID NO: 5990910 - DNA, 17 bp, Homo sapiens
caatgctgcctgggagc

SEQ ID NO: 5990911 - DNA, 16 bp, Homo sapiens
caatgctggagaaaaa

SEQ ID NO: 5990912 - DNA, 22 bp, Homo sapiens
caatgctggctgttggctgggg

SEQ ID NO: 5990913 - DNA, 18 bp, Homo sapiens
caatgctgtacctggctg

SEQ ID NO: 5990914 - DNA, 13 bp, Homo sapiens
caatgctgtactt

SEQ ID NO: 5990915 - DNA, 23 bp, Homo sapiens
caatgctgtattttaaaagaatg

SEQ ID NO: 5990916 - DNA, 16 bp, Homo sapiens
caatgctgtgaataaa

SEQ ID NO: 5990917 - DNA, 22 bp, Homo sapiens
caatgctgtgccctaaagtgta

SEQ ID NO: 5990918 - DNA, 11 bp, Homo sapiens
caatgcttaaa

SEQ ID NO: 5990919 - DNA, 16 bp, Homo sapiens
caatgcttaaactaaa

SEQ ID NO: 5990920 - DNA, 20 bp, Homo sapiens
caatgcttctctcatagtgt

SEQ ID NO: 5990921 - DNA, 13 bp, Homo sapiens
caatgcttctgcc

SEQ ID NO: 5990922 - DNA, 19 bp, Homo sapiens
caatgcttctgcctcagct

SEQ ID NO: 5990923 - DNA, 15 bp, Homo sapiens
caatgcttctgtagc

SEQ ID NO: 5990924 - DNA, 21 bp, Homo sapiens
cactttttctgtctttatgta

SEQ ID NO: 5990925 - DNA, 20 bp, Homo sapiens
cactttttctttacaaacaa

SEQ ID NO: 5990926 - DNA, 19 bp, Homo sapiens
cactttttgaactaagaaa

SEQ ID NO: 5990927 - DNA, 14 bp, Homo sapiens
cactttttgcagct

SEQ ID NO: 5990928 - DNA, 19 bp, Homo sapiens
cactttttggaattgtctt

SEQ ID NO: 5990929 - DNA, 21 bp, Homo sapiens
cactttttggtaatatatata

SEQ ID NO: 5990930 - DNA, 23 bp, Homo sapiens
cactttttgtattttttccttaa

SEQ ID NO: 5990931 - DNA, 13 bp, Homo sapiens
cacttttttataa

SEQ ID NO: 5990932 - DNA, 21 bp, Homo sapiens
cacttttttggggatatgctt

SEQ ID NO: 5990933 - DNA, 17 bp, Homo sapiens
cactttttttaaccatt

SEQ ID NO: 5990934 - DNA, 17 bp, Homo sapiens
cactttttttctttttc

SEQ ID NO: 5990935 - DNA, 20 bp, Homo sapiens
cagaaaaaaaagaaaaaagt

SEQ ID NO: 5990936 - DNA, 20 bp, Homo sapiens
cagaaaaaaagagtgaaaaa

SEQ ID NO: 5990937 - DNA, 20 bp, Homo sapiens
cagaaaaaaagcccaacaca

SEQ ID NO: 5990938 - DNA, 14 bp, Homo sapiens
cagaaaaaaataac

SEQ ID NO: 5990939 - DNA, 15 bp, Homo sapiens
cagaaaaaaataact

SEQ ID NO: 5990940 - DNA, 19 bp, Homo sapiens
cagaaaaaaataactattt

SEQ ID NO: 5990941 - DNA, 19 bp, Homo sapiens
cagaaaaaaggactgtata

SEQ ID NO: 5990942 - DNA, 20 bp, Homo sapiens
cagaaaaaatgtctgtaaat

SEQ ID NO: 5990943 - DNA, 11 bp, Homo sapiens
cagaaaaacaa

SEQ ID NO: 5990944 - DNA, 12 bp, Homo sapiens
cagaaaaacaaa

SEQ ID NO: 5990945 - DNA, 16 bp, Homo sapiens
cagaaaaacaataaga

SEQ ID NO: 5990946 - DNA, 20 bp, Homo sapiens
cagaaaaacaatcttattcc

SEQ ID NO: 5990947 - DNA, 21 bp, Homo sapiens
cagaaaaagaaatgaacataa

SEQ ID NO: 5990948 - DNA, 19 bp, Homo sapiens
cagaaaaagaatgtgtctt

SEQ ID NO: 5990949 - DNA, 14 bp, Homo sapiens
cagaaaaagatctt

SEQ ID NO: 5990950 - DNA, 22 bp, Homo sapiens
cagaaaaataagtcaaaaggaa

SEQ ID NO: 5990951 - DNA, 13 bp, Homo sapiens
cagaaaaatactt

SEQ ID NO: 5990952 - DNA, 19 bp, Homo sapiens
cagaaaaatgaaaagcaat

SEQ ID NO: 5990953 - DNA, 18 bp, Homo sapiens
cagaaaaatgaaatttaa

SEQ ID NO: 5990954 - DNA, 14 bp, Homo sapiens
cagaaaaattaaat

SEQ ID NO: 5990955 - DNA, 15 bp, Homo sapiens
cagaaaaattaaatt

SEQ ID NO: 5990956 - DNA, 19 bp, Homo sapiens
cagaaaaattgaactacag

SEQ ID NO: 5990957 - DNA, 16 bp, Homo sapiens
cagaaaacaacaaaaa

SEQ ID NO: 5990958 - DNA, 17 bp, Homo sapiens
cagaaaacaacaaaaaa

SEQ ID NO: 5990959 - DNA, 16 bp, Homo sapiens
cagaaaacagaaaaaa

SEQ ID NO: 5990960 - DNA, 20 bp, Homo sapiens
cagaaaacagaaaaaaaaca

SEQ ID NO: 5990961 - DNA, 19 bp, Homo sapiens
cagaaaacagagcctgcct

SEQ ID NO: 5990962 - DNA, 15 bp, Homo sapiens
cagaaaacagggtct

SEQ ID NO: 5990963 - DNA, 21 bp, Homo sapiens
cagaaaacccacggtttttct

SEQ ID NO: 5990964 - DNA, 17 bp, Homo sapiens
cagaaaacccttgggcc

SEQ ID NO: 5990965 - DNA, 22 bp, Homo sapiens
cagaaaacccttgggccagaag

SEQ ID NO: 5990966 - DNA, 15 bp, Homo sapiens
cagaaaacctccagt

SEQ ID NO: 5990967 - DNA, 21 bp, Homo sapiens
cagaaaacctctcctgacccc

SEQ ID NO: 5990968 - DNA, 22 bp, Homo sapiens
cagaaaacctctcctgacccct

SEQ ID NO: 5990969 - DNA, 16 bp, Homo sapiens
cagaaaacgggaagcg

SEQ ID NO: 5990970 - DNA, 18 bp, Homo sapiens
cagaaaactaaaaaggaa

SEQ ID NO: 5990971 - DNA, 13 bp, Homo sapiens
cagaaaactagaa

SEQ ID NO: 5990972 - DNA, 16 bp, Homo sapiens
cagaaaagaaaaccat

SEQ ID NO: 5990973 - DNA, 16 bp, Homo sapiens
cagaaaagaaagctgc

SEQ ID NO: 5990974 - DNA, 21 bp, Homo sapiens
cagaaaagaaagttcatgctt

SEQ ID NO: 5990975 - DNA, 15 bp, Homo sapiens
cagaaaagagaagaa

SEQ ID NO: 5990976 - DNA, 16 bp, Homo sapiens
cagaaaagagaagaaa

SEQ ID NO: 5990977 - DNA, 17 bp, Homo sapiens
cagaaaagagaagaaag

SEQ ID NO: 5990978 - DNA, 18 bp, Homo sapiens
cagaaaagagaagaaaga

SEQ ID NO: 5990979 - DNA, 19 bp, Homo sapiens
cagaaaagaggagaccctg

SEQ ID NO: 5990980 - DNA, 20 bp, Homo sapiens
cagaaaagaggagaccctgg

SEQ ID NO: 5990981 - DNA, 16 bp, Homo sapiens
cagaaaagatgaattt

SEQ ID NO: 5990982 - DNA, 11 bp, Homo sapiens
cagaaaagcac

SEQ ID NO: 5990983 - DNA, 15 bp, Homo sapiens
cagaaaagcacctgc

SEQ ID NO: 5990984 - DNA, 19 bp, Homo sapiens
cagaaaagcacctgccgac

SEQ ID NO: 5990985 - DNA, 14 bp, Homo sapiens
cagaaaaggacaga

SEQ ID NO: 5990986 - DNA, 23 bp, Homo sapiens
cagaaaaggagtggccacagcac

SEQ ID NO: 5990987 - DNA, 13 bp, Homo sapiens
cagaaaaggcagc

SEQ ID NO: 5990988 - DNA, 15 bp, Homo sapiens
cagaaaaggcagcca

SEQ ID NO: 5990989 - DNA, 16 bp, Homo sapiens
cagaaaaggcagccag

SEQ ID NO: 5990990 - DNA, 19 bp, Homo sapiens
cagaaaaggcagccagatc

SEQ ID NO: 5990991 - DNA, 21 bp, Homo sapiens
cagaaaaggcagccagatccc

SEQ ID NO: 5990992 - DNA, 22 bp, Homo sapiens
cagaaaagggagctaaattgaa

SEQ ID NO: 5990993 - DNA, 20 bp, Homo sapiens
cagaaaagtaattttgtcac

SEQ ID NO: 5990994 - DNA, 17 bp, Homo sapiens
cagaaaagtagaattat

SEQ ID NO: 5990995 - DNA, 21 bp, Homo sapiens
cagaaaagtagaattatatct

SEQ ID NO: 5990996 - DNA, 10 bp, Homo sapiens
cagaaaagtg

SEQ ID NO: 5990997 - DNA, 17 bp, Homo sapiens
cagaaaagtgcaaagtt

SEQ ID NO: 5990998 - DNA, 15 bp, Homo sapiens
cagaaaagtgcctga

SEQ ID NO: 5990999 - DNA, 17 bp, Homo sapiens
cagaaaagtgcctgagc

SEQ ID NO: 5991000 - DNA, 12 bp, Homo sapiens
cagaaaagtgct

SEQ ID NO: 5991001 - DNA, 13 bp, Homo sapiens
cagaaaagtgctt

SEQ ID NO: 5991002 - DNA, 22 bp, Homo sapiens
cagaaaagttgaattttacatg

SEQ ID NO: 5991003 - DNA, 21 bp, Homo sapiens
cagaaaataaaatattcactc

SEQ ID NO: 5991004 - DNA, 22 bp, Homo sapiens
cagaaaataaaatattcactct

SEQ ID NO: 5991005 - DNA, 23 bp, Homo sapiens
cagaaaataaggcacccatctgt

SEQ ID NO: 5991006 - DNA, 22 bp, Homo sapiens
cagaaaatagggtggacagaag

SEQ ID NO: 5991007 - DNA, 18 bp, Homo sapiens
cagaaaatataaatgcat

SEQ ID NO: 5991008 - DNA, 21 bp, Homo sapiens
cagaaaatataaatgcatgat

SEQ ID NO: 5991009 - DNA, 17 bp, Homo sapiens
cagaaaatatactgtaa

SEQ ID NO: 5991010 - DNA, 18 bp, Homo sapiens
cagaaaatatactgtaaa

SEQ ID NO: 5991011 - DNA, 20 bp, Homo sapiens
cagaaaatatgtattaacac

SEQ ID NO: 5991012 - DNA, 21 bp, Homo sapiens
cagaaaatatgtattaacact

SEQ ID NO: 5991013 - DNA, 17 bp, Homo sapiens
cagaaaatatttaatat

SEQ ID NO: 5991014 - DNA, 20 bp, Homo sapiens
cagaaaatatttaatatcaa

SEQ ID NO: 5991015 - DNA, 17 bp, Homo sapiens
cagaaaatgaaatccgt

SEQ ID NO: 5991016 - DNA, 16 bp, Homo sapiens
cagaaaatggaagaca

SEQ ID NO: 5991017 - DNA, 23 bp, Homo sapiens
cagaaaatggaagacagctctta

SEQ ID NO: 5991018 - DNA, 19 bp, Homo sapiens
cagaaaatggggcttgccc

SEQ ID NO: 5991019 - DNA, 18 bp, Homo sapiens
cagaaaatgttgagaatc

SEQ ID NO: 5991020 - DNA, 13 bp, Homo sapiens
cagaaaattaaac

SEQ ID NO: 5991021 - DNA, 16 bp, Homo sapiens
cagaaaattccctggg

SEQ ID NO: 5991022 - DNA, 17 bp, Homo sapiens
cagaaaattccctgggg

SEQ ID NO: 5991023 - DNA, 18 bp, Homo sapiens
cagaaaattccctggggt

SEQ ID NO: 5991024 - DNA, 13 bp, Homo sapiens
cagaaaattctgt

SEQ ID NO: 5991025 - DNA, 14 bp, Homo sapiens
cagaaaattctgtg

SEQ ID NO: 5991026 - DNA, 14 bp, Homo sapiens
cagaaaatttaact

SEQ ID NO: 5991027 - DNA, 13 bp, Homo sapiens
cagaaaatttttg

SEQ ID NO: 5991028 - DNA, 23 bp, Homo sapiens
cagaaaatttttgtctttcatgg

SEQ ID NO: 5991029 - DNA, 15 bp, Homo sapiens
cagaaacaaaatgaa

SEQ ID NO: 5991030 - DNA, 16 bp, Homo sapiens
cagaaacaaaatgaaa

SEQ ID NO: 5991031 - DNA, 19 bp, Homo sapiens
cagaaacaaaatgaaaaaa

SEQ ID NO: 5991032 - DNA, 20 bp, Homo sapiens
cagaaacaaaatgaaaaaaa

SEQ ID NO: 5991033 - DNA, 13 bp, Homo sapiens
cagaaacaactgc

SEQ ID NO: 5991034 - DNA, 17 bp, Homo sapiens
cagaaacaatgacatcc

SEQ ID NO: 5991035 - DNA, 15 bp, Homo sapiens
cagaaacaatgtgtc

SEQ ID NO: 5991036 - DNA, 14 bp, Homo sapiens
cagaaacacaaacg

SEQ ID NO: 5991037 - DNA, 22 bp, Homo sapiens
cagaaacacaaccactcaccag

SEQ ID NO: 5991038 - DNA, 18 bp, Homo sapiens
cagaaacacccctctgtc

SEQ ID NO: 5991039 - DNA, 21 bp, Homo sapiens
cagaaacaccctcacactggg

SEQ ID NO: 5991040 - DNA, 23 bp, Homo sapiens
cagaaacaccctcacactgggac

SEQ ID NO: 5991041 - DNA, 13 bp, Homo sapiens
cagaaacactgcc

SEQ ID NO: 5991042 - DNA, 23 bp, Homo sapiens
cagaaacagatttggtgaatttg

SEQ ID NO: 5991043 - DNA, 21 bp, Homo sapiens
cagaaacagctgcttctcccc

SEQ ID NO: 5991044 - DNA, 13 bp, Homo sapiens
cagaaacaggacc

SEQ ID NO: 5991045 - DNA, 15 bp, Homo sapiens
cagaaacagggcagc

SEQ ID NO: 5991046 - DNA, 22 bp, Homo sapiens
cagaaacatcagttactctgaa

SEQ ID NO: 5991047 - DNA, 13 bp, Homo sapiens
cagaaacatcatg

SEQ ID NO: 5991048 - DNA, 22 bp, Homo sapiens
cagaaaccaagtctacttcact

SEQ ID NO: 5991049 - DNA, 13 bp, Homo sapiens
cagaaaccagtta

SEQ ID NO: 5991050 - DNA, 20 bp, Homo sapiens
cagaaaccattgttcagaag

SEQ ID NO: 5991051 - DNA, 13 bp, Homo sapiens
cagaaacccccag

SEQ ID NO: 5991052 - DNA, 16 bp, Homo sapiens
cagaaacccccaggag

SEQ ID NO: 5991053 - DNA, 18 bp, Homo sapiens
cagaaacccccaggagga

SEQ ID NO: 5991054 - DNA, 19 bp, Homo sapiens
cagaaacccggcttcctgt

SEQ ID NO: 5991055 - DNA, 19 bp, Homo sapiens
cagaaacccttcagtgcta

SEQ ID NO: 5991056 - DNA, 20 bp, Homo sapiens
cagaaacctatctcagggag

SEQ ID NO: 5991057 - DNA, 18 bp, Homo sapiens
cagaaaccttcctgctga

SEQ ID NO: 5991058 - DNA, 11 bp, Homo sapiens
cagaaaccttg

SEQ ID NO: 5991059 - DNA, 20 bp, Homo sapiens
cagaaaccttgtttgtttta

SEQ ID NO: 5991060 - DNA, 11 bp, Homo sapiens
cagaaaccttt

SEQ ID NO: 5991061 - DNA, 17 bp, Homo sapiens
cagaaaccttttatttt

SEQ ID NO: 5991062 - DNA, 12 bp, Homo sapiens
cagaaactagaa

SEQ ID NO: 5991063 - DNA, 22 bp, Homo sapiens
cagaaactcaaccatcaatgga

SEQ ID NO: 5991064 - DNA, 17 bp, Homo sapiens
cagaaactcccctgggg

SEQ ID NO: 5991065 - DNA, 14 bp, Homo sapiens
cagaaactcctgtt

SEQ ID NO: 5991066 - DNA, 20 bp, Homo sapiens
cagaaactcgatgaatgtgt

SEQ ID NO: 5991067 - DNA, 17 bp, Homo sapiens
cagaaactgaaccaaca

SEQ ID NO: 5991068 - DNA, 14 bp, Homo sapiens
cagaaactgatgcc

SEQ ID NO: 5991069 - DNA, 19 bp, Homo sapiens
cagaaactggattaaaaca

SEQ ID NO: 5991070 - DNA, 22 bp, Homo sapiens
cagaaactggattaaaacaatt

SEQ ID NO: 5991071 - DNA, 13 bp, Homo sapiens
cagaaacttctca

SEQ ID NO: 5991072 - DNA, 16 bp, Homo sapiens
cagaaactttttctaa

SEQ ID NO: 5991073 - DNA, 19 bp, Homo sapiens
cagaaagaactttaaagct

SEQ ID NO: 5991074 - DNA, 24 bp, Homo sapiens
cagaaagaagtggggacagagcag

SEQ ID NO: 5991075 - DNA, 13 bp, Homo sapiens
cagaaagaccctg

SEQ ID NO: 5991076 - DNA, 20 bp, Homo sapiens
cagaaagagctctccagaag

SEQ ID NO: 5991077 - DNA, 13 bp, Homo sapiens
cagaaagaggaat

SEQ ID NO: 5991078 - DNA, 21 bp, Homo sapiens
cagaaagaggaataaaatgat

SEQ ID NO: 5991079 - DNA, 15 bp, Homo sapiens
cagaaagaggtctcc

SEQ ID NO: 5991080 - DNA, 23 bp, Homo sapiens
cagaaagaggtctccccatcccc

SEQ ID NO: 5991081 - DNA, 11 bp, Homo sapiens
cagaaagagtt

SEQ ID NO: 5991082 - DNA, 9 bp, Homo sapiens
cagaaagat

SEQ ID NO: 5991083 - DNA, 22 bp, Homo sapiens
cagaaagattctagctattatt

SEQ ID NO: 5991084 - DNA, 16 bp, Homo sapiens
cagaaagatttggaaa

SEQ ID NO: 5991085 - DNA, 20 bp, Homo sapiens
cagaaagcaaatcagacaca

SEQ ID NO: 5991086 - DNA, 18 bp, Homo sapiens
cagaaagcagaacagtga

SEQ ID NO: 5991087 - DNA, 17 bp, Homo sapiens
cagaaagcagaggctgg

SEQ ID NO: 5991088 - DNA, 22 bp, Homo sapiens
cagaaagcagaggctggcctca

SEQ ID NO: 5991089 - DNA, 21 bp, Homo sapiens
cagaaagcaggagcagctgtg

SEQ ID NO: 5991090 - DNA, 16 bp, Homo sapiens
cagaaagcagttctga

SEQ ID NO: 5991091 - DNA, 17 bp, Homo sapiens
cagaaagcagttctgat

SEQ ID NO: 5991092 - DNA, 23 bp, Homo sapiens
cagaaagcagttgagacaagaaa

SEQ ID NO: 5991093 - DNA, 16 bp, Homo sapiens
cagaaagcattacatt

SEQ ID NO: 5991094 - DNA, 22 bp, Homo sapiens
cagaaagccccacccaggccag

SEQ ID NO: 5991095 - DNA, 16 bp, Homo sapiens
cagaaagcctatcaaa

SEQ ID NO: 5991096 - DNA, 18 bp, Homo sapiens
cagaaagcctcctctgga

SEQ ID NO: 5991097 - DNA, 22 bp, Homo sapiens
cagaaagcctcctctggagaat

SEQ ID NO: 5991098 - DNA, 19 bp, Homo sapiens
cagaaagcctgggtgacat

SEQ ID NO: 5991099 - DNA, 18 bp, Homo sapiens
cagaaagctctacatttg

SEQ ID NO: 5991100 - DNA, 17 bp, Homo sapiens
cagaaagcttcaaatta

SEQ ID NO: 5991101 - DNA, 20 bp, Homo sapiens
cagaaagctttatatgtaat

SEQ ID NO: 5991102 - DNA, 17 bp, Homo sapiens
caatgcttctgtagctt

SEQ ID NO: 5991103 - DNA, 20 bp, Homo sapiens
caatgcttctgtagcttcta

SEQ ID NO: 5991104 - DNA, 22 bp, Homo sapiens
caatgcttcttttagtcagaaa

SEQ ID NO: 5991105 - DNA, 14 bp, Homo sapiens
caatgcttgcatgg

SEQ ID NO: 5991106 - DNA, 16 bp, Homo sapiens
caatgcttgcatggag

SEQ ID NO: 5991107 - DNA, 13 bp, Homo sapiens
caatgcttgtaga

SEQ ID NO: 5991108 - DNA, 18 bp, Homo sapiens
caatgctttatttgtaaa

SEQ ID NO: 5991109 - DNA, 19 bp, Homo sapiens
caatgctttctactcattt

SEQ ID NO: 5991110 - DNA, 19 bp, Homo sapiens
caatgctttgggaggccaa

SEQ ID NO: 5991111 - DNA, 21 bp, Homo sapiens
caatgcttttatatggcccag

SEQ ID NO: 5991112 - DNA, 20 bp, Homo sapiens
caatggaaaacctgggggat

SEQ ID NO: 5991113 - DNA, 17 bp, Homo sapiens
caatggaaactgaatgc

SEQ ID NO: 5991114 - DNA, 17 bp, Homo sapiens
caatggaagaaatggct

SEQ ID NO: 5991115 - DNA, 20 bp, Homo sapiens
caatggaagaagaaaggact

SEQ ID NO: 5991116 - DNA, 14 bp, Homo sapiens
caatggaagatttg

SEQ ID NO: 5991117 - DNA, 14 bp, Homo sapiens
caatggaatataaa

SEQ ID NO: 5991118 - DNA, 19 bp, Homo sapiens
caatggaatataaatatca

SEQ ID NO: 5991119 - DNA, 19 bp, Homo sapiens
caatggacaagcagtggat

SEQ ID NO: 5991120 - DNA, 21 bp, Homo sapiens
caatggacctctcagcagaaa

SEQ ID NO: 5991121 - DNA, 22 bp, Homo sapiens
caatggagaaaatgaatggaca

SEQ ID NO: 5991122 - DNA, 19 bp, Homo sapiens
caatggatttgatgctgtt

SEQ ID NO: 5991123 - DNA, 22 bp, Homo sapiens
caatggatttgatgctgtttga

SEQ ID NO: 5991124 - DNA, 18 bp, Homo sapiens
caatggcacgatctcagc

SEQ ID NO: 5991125 - DNA, 14 bp, Homo sapiens
caatggcagatgta

SEQ ID NO: 5991126 - DNA, 23 bp, Homo sapiens
caatggcagcattcccaccaaca

SEQ ID NO: 5991127 - DNA, 12 bp, Homo sapiens
caatggcagcct

SEQ ID NO: 5991128 - DNA, 15 bp, Homo sapiens
caatggcagccttgg

SEQ ID NO: 5991129 - DNA, 14 bp, Homo sapiens
caatggcagctaga

SEQ ID NO: 5991130 - DNA, 18 bp, Homo sapiens
caatggcaggttttacac

SEQ ID NO: 5991131 - DNA, 13 bp, Homo sapiens
caatggcatgggt

SEQ ID NO: 5991132 - DNA, 14 bp, Homo sapiens
caatggccagagcc

SEQ ID NO: 5991133 - DNA, 15 bp, Homo sapiens
caatggccagagcct

SEQ ID NO: 5991134 - DNA, 16 bp, Homo sapiens
caatggccagagcctc

SEQ ID NO: 5991135 - DNA, 19 bp, Homo sapiens
caatggccagagcctctgg

SEQ ID NO: 5991136 - DNA, 15 bp, Homo sapiens
caatggccagcccag

SEQ ID NO: 5991137 - DNA, 16 bp, Homo sapiens
caatggccagcccaga

SEQ ID NO: 5991138 - DNA, 18 bp, Homo sapiens
caatggccagcccagatg

SEQ ID NO: 5991139 - DNA, 14 bp, Homo sapiens
caatggccaggggc

SEQ ID NO: 5991140 - DNA, 15 bp, Homo sapiens
caatggcccgacatt

SEQ ID NO: 5991141 - DNA, 23 bp, Homo sapiens
caatggccttttgctacgtgcct

SEQ ID NO: 5991142 - DNA, 20 bp, Homo sapiens
caatggcgcagtgcctctgg

SEQ ID NO: 5991143 - DNA, 15 bp, Homo sapiens
caatggcgcctgctc

SEQ ID NO: 5991144 - DNA, 12 bp, Homo sapiens
caatggcgctgt

SEQ ID NO: 5991145 - DNA, 17 bp, Homo sapiens
caatggctaattcccag

SEQ ID NO: 5991146 - DNA, 23 bp, Homo sapiens
caatggctaattcccagagtgtg

SEQ ID NO: 5991147 - DNA, 17 bp, Homo sapiens
caatggctattaacaat

SEQ ID NO: 5991148 - DNA, 13 bp, Homo sapiens
caatggctgggag

SEQ ID NO: 5991149 - DNA, 14 bp, Homo sapiens
caatggctgtaaac

SEQ ID NO: 5991150 - DNA, 18 bp, Homo sapiens
caatggcttactccagga

SEQ ID NO: 5991151 - DNA, 18 bp, Homo sapiens
caatgggaaaagagtctc

SEQ ID NO: 5991152 - DNA, 20 bp, Homo sapiens
caatgggaagactcaggagt

SEQ ID NO: 5991153 - DNA, 21 bp, Homo sapiens
caatgggaagactcaggagtc

SEQ ID NO: 5991154 - DNA, 16 bp, Homo sapiens
caatgggaagcaggga

SEQ ID NO: 5991155 - DNA, 15 bp, Homo sapiens
caatgggaccgtgcc

SEQ ID NO: 5991156 - DNA, 13 bp, Homo sapiens
caatgggactgga

SEQ ID NO: 5991157 - DNA, 22 bp, Homo sapiens
caatgggactggagtcagatga

SEQ ID NO: 5991158 - DNA, 21 bp, Homo sapiens
caatgggagctgaggccacac

SEQ ID NO: 5991159 - DNA, 24 bp, Homo sapiens
caatgggagggggctccatggagg

SEQ ID NO: 5991160 - DNA, 18 bp, Homo sapiens
caatgggattttctagtt

SEQ ID NO: 5991161 - DNA, 16 bp, Homo sapiens
caatgggcagctatcc

SEQ ID NO: 5991162 - DNA, 14 bp, Homo sapiens
caatgggctagagg

SEQ ID NO: 5991163 - DNA, 16 bp, Homo sapiens
caatgggctcttccaa

SEQ ID NO: 5991164 - DNA, 13 bp, Homo sapiens
caatggggagagg

SEQ ID NO: 5991165 - DNA, 14 bp, Homo sapiens
caatggggccagca

SEQ ID NO: 5991166 - DNA, 16 bp, Homo sapiens
caatggggccagcact

SEQ ID NO: 5991167 - DNA, 16 bp, Homo sapiens
caatggggctggtttt

SEQ ID NO: 5991168 - DNA, 20 bp, Homo sapiens
caatggggctggttttgctt

SEQ ID NO: 5991169 - DNA, 17 bp, Homo sapiens
caatggggtccacttcc

SEQ ID NO: 5991170 - DNA, 17 bp, Homo sapiens
caatgggtaaataaatg

SEQ ID NO: 5991171 - DNA, 19 bp, Homo sapiens
caatgggtaaataaatgct

SEQ ID NO: 5991172 - DNA, 11 bp, Homo sapiens
caatgggtaag

SEQ ID NO: 5991173 - DNA, 18 bp, Homo sapiens
caatgggtaagggaggga

SEQ ID NO: 5991174 - DNA, 19 bp, Homo sapiens
caatgggtaagggagggaa

SEQ ID NO: 5991175 - DNA, 22 bp, Homo sapiens
caatgggtcttagctctttctc

SEQ ID NO: 5991176 - DNA, 21 bp, Homo sapiens
caatgggtttgccaagccctt

SEQ ID NO: 5991177 - DNA, 19 bp, Homo sapiens
caatgggttttaattttca

SEQ ID NO: 5991178 - DNA, 15 bp, Homo sapiens
caatggtaattataa

SEQ ID NO: 5991179 - DNA, 22 bp, Homo sapiens
caatggtactctaatcagtcct

SEQ ID NO: 5991180 - DNA, 19 bp, Homo sapiens
caatggtagctctgaaggg

SEQ ID NO: 5991181 - DNA, 22 bp, Homo sapiens
caatggtagctctgaagggagg

SEQ ID NO: 5991182 - DNA, 16 bp, Homo sapiens
caatggtagtttctgt

SEQ ID NO: 5991183 - DNA, 16 bp, Homo sapiens
caatggtcctgacttt

SEQ ID NO: 5991184 - DNA, 19 bp, Homo sapiens
caatggtgatcctctattt

SEQ ID NO: 5991185 - DNA, 20 bp, Homo sapiens
caatggtgatcctctatttt

SEQ ID NO: 5991186 - DNA, 22 bp, Homo sapiens
caatggtgcaaaaaaaaactta

SEQ ID NO: 5991187 - DNA, 23 bp, Homo sapiens
caatggtgcaaaaaaaaacttaa

SEQ ID NO: 5991188 - DNA, 19 bp, Homo sapiens
caatggtgctataataaat

SEQ ID NO: 5991189 - DNA, 14 bp, Homo sapiens
caatggtgcttccc

SEQ ID NO: 5991190 - DNA, 15 bp, Homo sapiens
caatggtgcttcccc

SEQ ID NO: 5991191 - DNA, 17 bp, Homo sapiens
caatggtgcttccccca

SEQ ID NO: 5991192 - DNA, 16 bp, Homo sapiens
caatggtgcttggagg

SEQ ID NO: 5991193 - DNA, 18 bp, Homo sapiens
caatggtgcttggagggg

SEQ ID NO: 5991194 - DNA, 19 bp, Homo sapiens
caatggtgtagctgtcctc

SEQ ID NO: 5991195 - DNA, 21 bp, Homo sapiens
caatggtgtagctgtcctctc

SEQ ID NO: 5991196 - DNA, 21 bp, Homo sapiens
caatggtgtggtgaatgtgtg

SEQ ID NO: 5991197 - DNA, 21 bp, Homo sapiens
caatggtgttatttgaaactt

SEQ ID NO: 5991198 - DNA, 22 bp, Homo sapiens
caatggtgttcaccatcggcag

SEQ ID NO: 5991199 - DNA, 19 bp, Homo sapiens
caatggtgtttttcttgta

SEQ ID NO: 5991200 - DNA, 22 bp, Homo sapiens
caatggtgtttttcttgtaaat

SEQ ID NO: 5991201 - DNA, 18 bp, Homo sapiens
caatggtttacatgaaca

SEQ ID NO: 5991202 - DNA, 13 bp, Homo sapiens
caatggtttattc

SEQ ID NO: 5991203 - DNA, 18 bp, Homo sapiens
caatggtttattcccaag

SEQ ID NO: 5991204 - DNA, 18 bp, Homo sapiens
caatggtttgcaaggaag

SEQ ID NO: 5991205 - DNA, 18 bp, Homo sapiens
caatggttttcttgtgtg

SEQ ID NO: 5991206 - DNA, 16 bp, Homo sapiens
caatggtttttaaatt

SEQ ID NO: 5991207 - DNA, 20 bp, Homo sapiens
caatgtaaaaatacactaat

SEQ ID NO: 5991208 - DNA, 14 bp, Homo sapiens
caatgtaaaaatgg

SEQ ID NO: 5991209 - DNA, 14 bp, Homo sapiens
caatgtaaatattt

SEQ ID NO: 5991210 - DNA, 17 bp, Homo sapiens
caatgtaaatattttaa

SEQ ID NO: 5991211 - DNA, 19 bp, Homo sapiens
caatgtaaatattttaaag

SEQ ID NO: 5991212 - DNA, 21 bp, Homo sapiens
caatgtaataaaaagcctctt

SEQ ID NO: 5991213 - DNA, 23 bp, Homo sapiens
caatgtaatagaagcttaaaata

SEQ ID NO: 5991214 - DNA, 18 bp, Homo sapiens
caatgtaattaaactgtt

SEQ ID NO: 5991215 - DNA, 12 bp, Homo sapiens
caatgtacaatt

SEQ ID NO: 5991216 - DNA, 19 bp, Homo sapiens
caatgtacaattatgtctc

SEQ ID NO: 5991217 - DNA, 22 bp, Homo sapiens
caatgtacaggaagtagttcta

SEQ ID NO: 5991218 - DNA, 18 bp, Homo sapiens
caatgtaccatgttgccc

SEQ ID NO: 5991219 - DNA, 20 bp, Homo sapiens
caatgtaccatgttgcccag

SEQ ID NO: 5991220 - DNA, 17 bp, Homo sapiens
caatgtacccaccgggc

SEQ ID NO: 5991221 - DNA, 22 bp, Homo sapiens
caatgtacccaccgggccactc

SEQ ID NO: 5991222 - DNA, 14 bp, Homo sapiens
caatgtactgtatt

SEQ ID NO: 5991223 - DNA, 18 bp, Homo sapiens
caatgtataaagattgta

SEQ ID NO: 5991224 - DNA, 11 bp, Homo sapiens
caatgtatctt

SEQ ID NO: 5991225 - DNA, 18 bp, Homo sapiens
caatgtatctttattaaa

SEQ ID NO: 5991226 - DNA, 18 bp, Homo sapiens
caatgtatgtaatttgtt

SEQ ID NO: 5991227 - DNA, 16 bp, Homo sapiens
caatgtatgtacaata

SEQ ID NO: 5991228 - DNA, 17 bp, Homo sapiens
caatgtatgtgtggctg

SEQ ID NO: 5991229 - DNA, 18 bp, Homo sapiens
caatgtatttatttaaaa

SEQ ID NO: 5991230 - DNA, 12 bp, Homo sapiens
caatgtattttg

SEQ ID NO: 5991231 - DNA, 17 bp, Homo sapiens
caatgtattttggaaga

SEQ ID NO: 5991232 - DNA, 18 bp, Homo sapiens
caatgtcacaacctctct

SEQ ID NO: 5991233 - DNA, 21 bp, Homo sapiens
caatgtcacaacctctctgat

SEQ ID NO: 5991234 - DNA, 14 bp, Homo sapiens
caatgtcagcatca

SEQ ID NO: 5991235 - DNA, 18 bp, Homo sapiens
caatgtcagcatcaagcc

SEQ ID NO: 5991236 - DNA, 15 bp, Homo sapiens
caatgtcagcctttg

SEQ ID NO: 5991237 - DNA, 19 bp, Homo sapiens
caatgtcaggaacagaagg

SEQ ID NO: 5991238 - DNA, 21 bp, Homo sapiens
caatgtcatatactgccatgt

SEQ ID NO: 5991239 - DNA, 17 bp, Homo sapiens
caatgtcatttttaaaa

SEQ ID NO: 5991240 - DNA, 23 bp, Homo sapiens
caatgtccacctgtgagaaagga

SEQ ID NO: 5991241 - DNA, 14 bp, Homo sapiens
caatgtccaggtca

SEQ ID NO: 5991242 - DNA, 21 bp, Homo sapiens
caatgtcccttgcacagccca

SEQ ID NO: 5991243 - DNA, 17 bp, Homo sapiens
caatgtctaaaaacatt

SEQ ID NO: 5991244 - DNA, 16 bp, Homo sapiens
caatgtctcccacacc

SEQ ID NO: 5991245 - DNA, 22 bp, Homo sapiens
caatgtctcccacacccaccct

SEQ ID NO: 5991246 - DNA, 18 bp, Homo sapiens
caatgtctgcagccctga

SEQ ID NO: 5991247 - DNA, 19 bp, Homo sapiens
caatgtctgcagccctgag

SEQ ID NO: 5991248 - DNA, 16 bp, Homo sapiens
caatgtctggagacca

SEQ ID NO: 5991249 - DNA, 15 bp, Homo sapiens
caatgtctggggaca

SEQ ID NO: 5991250 - DNA, 14 bp, Homo sapiens
caatgtctgtgcta

SEQ ID NO: 5991251 - DNA, 15 bp, Homo sapiens
caatgtctgttgaac

SEQ ID NO: 5991252 - DNA, 11 bp, Homo sapiens
caatgtcttga

SEQ ID NO: 5991253 - DNA, 19 bp, Homo sapiens
caatgtcttggtacttgct

SEQ ID NO: 5991254 - DNA, 22 bp, Homo sapiens
caatgtcttttgacaggtgcct

SEQ ID NO: 5991255 - DNA, 18 bp, Homo sapiens
caatgtgaaaaatgtgtc

SEQ ID NO: 5991256 - DNA, 14 bp, Homo sapiens
caatgtgaaactga

SEQ ID NO: 5991257 - DNA, 19 bp, Homo sapiens
caatgtgaactttattaaa

SEQ ID NO: 5991258 - DNA, 21 bp, Homo sapiens
caatgtgaagttcatcttgca

SEQ ID NO: 5991259 - DNA, 19 bp, Homo sapiens
caatgtgaatcagacccta

SEQ ID NO: 5991260 - DNA, 14 bp, Homo sapiens
caatgtgacattta

SEQ ID NO: 5991261 - DNA, 15 bp, Homo sapiens
caatgtgacatttac

SEQ ID NO: 5991262 - DNA, 13 bp, Homo sapiens
caatgtgaccagg

SEQ ID NO: 5991263 - DNA, 23 bp, Homo sapiens
caatgtgactgaaacaaaatgtt

SEQ ID NO: 5991264 - DNA, 16 bp, Homo sapiens
caatgtgactttgaaa

SEQ ID NO: 5991265 - DNA, 16 bp, Homo sapiens
caatgtgatatgtgta

SEQ ID NO: 5991266 - DNA, 16 bp, Homo sapiens
caatgtgatctatgtt

SEQ ID NO: 5991267 - DNA, 16 bp, Homo sapiens
caatgtgattcttcta

SEQ ID NO: 5991268 - DNA, 15 bp, Homo sapiens
caatgtgattttgta

SEQ ID NO: 5991269 - DNA, 15 bp, Homo sapiens
caatgtgcagactga

SEQ ID NO: 5991270 - DNA, 12 bp, Homo sapiens
caatgtgcagtg

SEQ ID NO: 5991271 - DNA, 16 bp, Homo sapiens
caatgtgcccagtcat

SEQ ID NO: 5991272 - DNA, 11 bp, Homo sapiens
caatgtgccct

SEQ ID NO: 5991273 - DNA, 16 bp, Homo sapiens
caatgtgctactgatt

SEQ ID NO: 5991274 - DNA, 22 bp, Homo sapiens
caatgtggaaaaaatattttaa

SEQ ID NO: 5991275 - DNA, 16 bp, Homo sapiens
caatgtggaattacat

SEQ ID NO: 5991276 - DNA, 20 bp, Homo sapiens
caatgtggaattacataaca

SEQ ID NO: 5991277 - DNA, 20 bp, Homo sapiens
caatgtggagcagcagccac

SEQ ID NO: 5991278 - DNA, 20 bp, Homo sapiens
caatgtggagtctccctctg

SEQ ID NO: 5991279 - DNA, 21 bp, Homo sapiens
caatgtggtggcaataaatgt

SEQ ID NO: 5991280 - DNA, 15 bp, Homo sapiens
cagaaaggaaaacct

SEQ ID NO: 5991281 - DNA, 12 bp, Homo sapiens
cagaaaggagag

SEQ ID NO: 5991282 - DNA, 12 bp, Homo sapiens
cagaaaggagat

SEQ ID NO: 5991283 - DNA, 16 bp, Homo sapiens
cagaaaggatatttaa

SEQ ID NO: 5991284 - DNA, 22 bp, Homo sapiens
cagaaaggatatttaagaaaat

SEQ ID NO: 5991285 - DNA, 12 bp, Homo sapiens
cagaaaggattt

SEQ ID NO: 5991286 - DNA, 20 bp, Homo sapiens
cagaaaggcactaatgatgt

SEQ ID NO: 5991287 - DNA, 22 bp, Homo sapiens
cagaaaggcaggtttcatttct

SEQ ID NO: 5991288 - DNA, 14 bp, Homo sapiens
cagaaaggctctga

SEQ ID NO: 5991289 - DNA, 14 bp, Homo sapiens
cagaaaggctgcaa

SEQ ID NO: 5991290 - DNA, 22 bp, Homo sapiens
cagaaagggagcagagaaggcc

SEQ ID NO: 5991291 - DNA, 17 bp, Homo sapiens
cagaaagggagggctct

SEQ ID NO: 5991292 - DNA, 17 bp, Homo sapiens
cagaaagggcaacaata

SEQ ID NO: 5991293 - DNA, 16 bp, Homo sapiens
cagaaagggcagcccc

SEQ ID NO: 5991294 - DNA, 18 bp, Homo sapiens
cagaaagggcagcccctc

SEQ ID NO: 5991295 - DNA, 19 bp, Homo sapiens
cagaaagggcagcccctcc

SEQ ID NO: 5991296 - DNA, 20 bp, Homo sapiens
cagaaagggcagcccctccc

SEQ ID NO: 5991297 - DNA, 22 bp, Homo sapiens
cagaaagggcagcccctcccca

SEQ ID NO: 5991298 - DNA, 15 bp, Homo sapiens
cagaaagggcagctt

SEQ ID NO: 5991299 - DNA, 16 bp, Homo sapiens
cagaaagggcagcttc

SEQ ID NO: 5991300 - DNA, 15 bp, Homo sapiens
cagaaagtatatact

SEQ ID NO: 5991301 - DNA, 19 bp, Homo sapiens
cagaaagtcaccaggactt

SEQ ID NO: 5991302 - DNA, 21 bp, Homo sapiens
cagaaagtcattccttctttt

SEQ ID NO: 5991303 - DNA, 16 bp, Homo sapiens
cagaaagtcccccctc

SEQ ID NO: 5991304 - DNA, 18 bp, Homo sapiens
cagaaagtcccccctcgc

SEQ ID NO: 5991305 - DNA, 19 bp, Homo sapiens
cagaaagtgataagtgcag

SEQ ID NO: 5991306 - DNA, 14 bp, Homo sapiens
cagaaagtgcctga

SEQ ID NO: 5991307 - DNA, 19 bp, Homo sapiens
cagaaagtgcctgacacac

SEQ ID NO: 5991308 - DNA, 23 bp, Homo sapiens
cagaaagtgcctgacacactaac

SEQ ID NO: 5991309 - DNA, 15 bp, Homo sapiens
cagaaagtgcctttc

SEQ ID NO: 5991310 - DNA, 16 bp, Homo sapiens
cagaaagtgcctttca

SEQ ID NO: 5991311 - DNA, 19 bp, Homo sapiens
cagaaagtgcctttcagga

SEQ ID NO: 5991312 - DNA, 23 bp, Homo sapiens
cagaaagtgcctttcaggatcta

SEQ ID NO: 5991313 - DNA, 17 bp, Homo sapiens
cagaaagtggtgctcag

SEQ ID NO: 5991314 - DNA, 16 bp, Homo sapiens
cagaaagtgtgcttta

SEQ ID NO: 5991315 - DNA, 22 bp, Homo sapiens
cagaaagtgtgctttatgctga

SEQ ID NO: 5991316 - DNA, 17 bp, Homo sapiens
cagaaagttcaacttcc

SEQ ID NO: 5991317 - DNA, 22 bp, Homo sapiens
cagaaagttcaacttccaaagg

SEQ ID NO: 5991318 - DNA, 23 bp, Homo sapiens
cagaaagttggaaaggaaaaaag

SEQ ID NO: 5991319 - DNA, 21 bp, Homo sapiens
cagaaagttgtgtaggcacca

SEQ ID NO: 5991320 - DNA, 19 bp, Homo sapiens
cagaaagtttgtaaaaata

SEQ ID NO: 5991321 - DNA, 20 bp, Homo sapiens
cagaaagtttgtaaaaatat

SEQ ID NO: 5991322 - DNA, 12 bp, Homo sapiens
cagaaataaaat

SEQ ID NO: 5991323 - DNA, 20 bp, Homo sapiens
cagaaataaagttggtgaca

SEQ ID NO: 5991324 - DNA, 15 bp, Homo sapiens
cagaaataaatcaca

SEQ ID NO: 5991325 - DNA, 15 bp, Homo sapiens
cagaaataataaaaa

SEQ ID NO: 5991326 - DNA, 14 bp, Homo sapiens
cagaaatacaaaaa

SEQ ID NO: 5991327 - DNA, 20 bp, Homo sapiens
cagaaatacagattttgata

SEQ ID NO: 5991328 - DNA, 16 bp, Homo sapiens
cagaaatacatatttc

SEQ ID NO: 5991329 - DNA, 19 bp, Homo sapiens
cagaaatacatatttccaa

SEQ ID NO: 5991330 - DNA, 18 bp, Homo sapiens
cagaaatacatcatatgt

SEQ ID NO: 5991331 - DNA, 19 bp, Homo sapiens
cagaaatacatcatatgtt

SEQ ID NO: 5991332 - DNA, 22 bp, Homo sapiens
cagaaataccaaaattatttca

SEQ ID NO: 5991333 - DNA, 16 bp, Homo sapiens
cagaaatacctgtcta

SEQ ID NO: 5991334 - DNA, 14 bp, Homo sapiens
cagaaatactactg

SEQ ID NO: 5991335 - DNA, 16 bp, Homo sapiens
cagaaatactgctctg

SEQ ID NO: 5991336 - DNA, 15 bp, Homo sapiens
cagaaatagttgtct

SEQ ID NO: 5991337 - DNA, 16 bp, Homo sapiens
cagaaatagttgtctg

SEQ ID NO: 5991338 - DNA, 15 bp, Homo sapiens
cagaaatataaacac

SEQ ID NO: 5991339 - DNA, 20 bp, Homo sapiens
cagaaatataacacattttt

SEQ ID NO: 5991340 - DNA, 16 bp, Homo sapiens
cagaaatatatataca

SEQ ID NO: 5991341 - DNA, 17 bp, Homo sapiens
cagaaatatatatacat

SEQ ID NO: 5991342 - DNA, 19 bp, Homo sapiens
cagaaatatatatacatat

SEQ ID NO: 5991343 - DNA, 20 bp, Homo sapiens
cagaaatatatatacatatg

SEQ ID NO: 5991344 - DNA, 20 bp, Homo sapiens
cagaaatatattatgaaaat

SEQ ID NO: 5991345 - DNA, 15 bp, Homo sapiens
cagaaatatgattga

SEQ ID NO: 5991346 - DNA, 18 bp, Homo sapiens
cagaaatatttagtatct

SEQ ID NO: 5991347 - DNA, 14 bp, Homo sapiens
cagaaatatttgct

SEQ ID NO: 5991348 - DNA, 21 bp, Homo sapiens
cagaaatatttgtgacaaaaa

SEQ ID NO: 5991349 - DNA, 14 bp, Homo sapiens
cagaaatcactgtg

SEQ ID NO: 5991350 - DNA, 16 bp, Homo sapiens
cagaaatcactgtgaa

SEQ ID NO: 5991351 - DNA, 16 bp, Homo sapiens
cagaaatcagaggaga

SEQ ID NO: 5991352 - DNA, 18 bp, Homo sapiens
cagaaatcggttgctgtt

SEQ ID NO: 5991353 - DNA, 14 bp, Homo sapiens
cagaaatctgagga

SEQ ID NO: 5991354 - DNA, 21 bp, Homo sapiens
cagaaatgaggagacacacct

SEQ ID NO: 5991355 - DNA, 23 bp, Homo sapiens
cagaaatgaggccatggactctg

SEQ ID NO: 5991356 - DNA, 12 bp, Homo sapiens
cagaaatgcaaa

SEQ ID NO: 5991357 - DNA, 20 bp, Homo sapiens
cagaaatgccaaaaatgtgc

SEQ ID NO: 5991358 - DNA, 19 bp, Homo sapiens
cagaaatgccgctgtgtcc

SEQ ID NO: 5991359 - DNA, 23 bp, Homo sapiens
cagaaatgccgctgtgtccccgc

SEQ ID NO: 5991360 - DNA, 17 bp, Homo sapiens
cagaaatgctgcctgcc

SEQ ID NO: 5991361 - DNA, 15 bp, Homo sapiens
cagaaatgctgctgg

SEQ ID NO: 5991362 - DNA, 17 bp, Homo sapiens
cagaaatggaaagcaga

SEQ ID NO: 5991363 - DNA, 23 bp, Homo sapiens
cagaaatgggcagttctcccagg

SEQ ID NO: 5991364 - DNA, 13 bp, Homo sapiens
cagaaatgtaaat

SEQ ID NO: 5991365 - DNA, 15 bp, Homo sapiens
cagaaatgtaaatgt

SEQ ID NO: 5991366 - DNA, 23 bp, Homo sapiens
cagaaatgtacaactttttacct

SEQ ID NO: 5991367 - DNA, 23 bp, Homo sapiens
cagaaatgtatggcatgtgtagt

SEQ ID NO: 5991368 - DNA, 21 bp, Homo sapiens
cagaaatgtctaaatgctgaa

SEQ ID NO: 5991369 - DNA, 11 bp, Homo sapiens
cagaaatgtgc

SEQ ID NO: 5991370 - DNA, 18 bp, Homo sapiens
cagaaatgtgctgcaaag

SEQ ID NO: 5991371 - DNA, 19 bp, Homo sapiens
cagaaatgtgctgcaaaga

SEQ ID NO: 5991372 - DNA, 17 bp, Homo sapiens
cagaaatgtgttatcac

SEQ ID NO: 5991373 - DNA, 19 bp, Homo sapiens
cagaaatgtttatggaaat

SEQ ID NO: 5991374 - DNA, 20 bp, Homo sapiens
cagaaatgtttctgtgtcat

SEQ ID NO: 5991375 - DNA, 18 bp, Homo sapiens
cagaaatgtttttaacac

SEQ ID NO: 5991376 - DNA, 12 bp, Homo sapiens
cagaaattaaaa

SEQ ID NO: 5991377 - DNA, 21 bp, Homo sapiens
cagaaattaaaatattatttg

SEQ ID NO: 5991378 - DNA, 18 bp, Homo sapiens
cagaaattattgggctct

SEQ ID NO: 5991379 - DNA, 17 bp, Homo sapiens
cagaaattattggtata

SEQ ID NO: 5991380 - DNA, 21 bp, Homo sapiens
cagaaattccaactcctgatg

SEQ ID NO: 5991381 - DNA, 20 bp, Homo sapiens
cagaaattccagtaaatcct

SEQ ID NO: 5991382 - DNA, 13 bp, Homo sapiens
cagaaattcgccc

SEQ ID NO: 5991383 - DNA, 14 bp, Homo sapiens
cagaaattctcaaa

SEQ ID NO: 5991384 - DNA, 18 bp, Homo sapiens
cagaaattctggcccagc

SEQ ID NO: 5991385 - DNA, 20 bp, Homo sapiens
cagaaattctggcccagcca

SEQ ID NO: 5991386 - DNA, 17 bp, Homo sapiens
cagaaattctgttttta

SEQ ID NO: 5991387 - DNA, 18 bp, Homo sapiens
cagaaattctgtttttaa

SEQ ID NO: 5991388 - DNA, 12 bp, Homo sapiens
cagaaattcttc

SEQ ID NO: 5991389 - DNA, 17 bp, Homo sapiens
cagaaattcttcaattt

SEQ ID NO: 5991390 - DNA, 12 bp, Homo sapiens
cagaaattgcaa

SEQ ID NO: 5991391 - DNA, 20 bp, Homo sapiens
cagaaattggtaccttgcac

SEQ ID NO: 5991392 - DNA, 17 bp, Homo sapiens
cagaaatttaattcaga

SEQ ID NO: 5991393 - DNA, 21 bp, Homo sapiens
cagaaatttaccacaaaagca

SEQ ID NO: 5991394 - DNA, 12 bp, Homo sapiens
cagaaattttct

SEQ ID NO: 5991395 - DNA, 14 bp, Homo sapiens
cagaaattttctac

SEQ ID NO: 5991396 - DNA, 14 bp, Homo sapiens
cagaacaaaaagaa

SEQ ID NO: 5991397 - DNA, 16 bp, Homo sapiens
cagaacaaaaagaaat

SEQ ID NO: 5991398 - DNA, 15 bp, Homo sapiens
cagaacaaaacttct

SEQ ID NO: 5991399 - DNA, 20 bp, Homo sapiens
cagaacaaacctctatatgt

SEQ ID NO: 5991400 - DNA, 12 bp, Homo sapiens
cagaacaaatgt

SEQ ID NO: 5991401 - DNA, 14 bp, Homo sapiens
cagaacaaatgtgt

SEQ ID NO: 5991402 - DNA, 18 bp, Homo sapiens
cagaacaaatgtgttttt

SEQ ID NO: 5991403 - DNA, 14 bp, Homo sapiens
cagaacaacaacaa

SEQ ID NO: 5991404 - DNA, 14 bp, Homo sapiens
cagaacacaaatgt

SEQ ID NO: 5991405 - DNA, 20 bp, Homo sapiens
cagaacacactttttttcct

SEQ ID NO: 5991406 - DNA, 15 bp, Homo sapiens
cagaacacataattc

SEQ ID NO: 5991407 - DNA, 12 bp, Homo sapiens
cagaacacctgg

SEQ ID NO: 5991408 - DNA, 15 bp, Homo sapiens
cagaacacctggccg

SEQ ID NO: 5991409 - DNA, 13 bp, Homo sapiens
cagaacactaacc

SEQ ID NO: 5991410 - DNA, 15 bp, Homo sapiens
cagaacactaacctg

SEQ ID NO: 5991411 - DNA, 20 bp, Homo sapiens
cagaacactgggtagtagct

SEQ ID NO: 5991412 - DNA, 16 bp, Homo sapiens
cagaacagagggccag

SEQ ID NO: 5991413 - DNA, 19 bp, Homo sapiens
cagaacagatgctgagcca

SEQ ID NO: 5991414 - DNA, 21 bp, Homo sapiens
cagaacagcagaggttctttt

SEQ ID NO: 5991415 - DNA, 20 bp, Homo sapiens
cagaacagccctcggcctcc

SEQ ID NO: 5991416 - DNA, 13 bp, Homo sapiens
cagaacagctgaa

SEQ ID NO: 5991417 - DNA, 20 bp, Homo sapiens
cagaacagctgttgactcta

SEQ ID NO: 5991418 - DNA, 16 bp, Homo sapiens
cagaacagcttcaggt

SEQ ID NO: 5991419 - DNA, 17 bp, Homo sapiens
cagaacagcttcaggtt

SEQ ID NO: 5991420 - DNA, 23 bp, Homo sapiens
cagaacaggaggtgtgaatgcac

SEQ ID NO: 5991421 - DNA, 12 bp, Homo sapiens
cagaacagggtc

SEQ ID NO: 5991422 - DNA, 13 bp, Homo sapiens
cagaacaggtagt

SEQ ID NO: 5991423 - DNA, 20 bp, Homo sapiens
cagaacaggtgttggtgaca

SEQ ID NO: 5991424 - DNA, 14 bp, Homo sapiens
cagaacagtaaagt

SEQ ID NO: 5991425 - DNA, 21 bp, Homo sapiens
cagaacagtaaagttaaaacg

SEQ ID NO: 5991426 - DNA, 22 bp, Homo sapiens
cagaacagtgaaaggtattgca

SEQ ID NO: 5991427 - DNA, 18 bp, Homo sapiens
cagaacagtgattaccag

SEQ ID NO: 5991428 - DNA, 17 bp, Homo sapiens
cagaacagtgtttgatt

SEQ ID NO: 5991429 - DNA, 22 bp, Homo sapiens
cagaacagttaagcagccgcca

SEQ ID NO: 5991430 - DNA, 16 bp, Homo sapiens
cagaacagtttgtaca

SEQ ID NO: 5991431 - DNA, 22 bp, Homo sapiens
cagaacatactgattgggaggt

SEQ ID NO: 5991432 - DNA, 16 bp, Homo sapiens
cagaacatagacagaa

SEQ ID NO: 5991433 - DNA, 16 bp, Homo sapiens
cagaacatcattagaa

SEQ ID NO: 5991434 - DNA, 18 bp, Homo sapiens
cagaacatcgatatgtat

SEQ ID NO: 5991435 - DNA, 19 bp, Homo sapiens
cagaacatcgatatgtata

SEQ ID NO: 5991436 - DNA, 19 bp, Homo sapiens
cagaacatgagtgctgatg

SEQ ID NO: 5991437 - DNA, 14 bp, Homo sapiens
cagaacatgttaag

SEQ ID NO: 5991438 - DNA, 17 bp, Homo sapiens
cagaacattcagctctg

SEQ ID NO: 5991439 - DNA, 20 bp, Homo sapiens
cagaacattcagctctggag

SEQ ID NO: 5991440 - DNA, 21 bp, Homo sapiens
cagaacattcagctctggaga

SEQ ID NO: 5991441 - DNA, 23 bp, Homo sapiens
cagaacattcgaatctctgcccc

SEQ ID NO: 5991442 - DNA, 12 bp, Homo sapiens
cagaacatttct

SEQ ID NO: 5991443 - DNA, 15 bp, Homo sapiens
cagaacatttctcat

SEQ ID NO: 5991444 - DNA, 14 bp, Homo sapiens
cagaaccaaatctt

SEQ ID NO: 5991445 - DNA, 21 bp, Homo sapiens
cagaaccaacgggtctgtggg

SEQ ID NO: 5991446 - DNA, 15 bp, Homo sapiens
cagaaccaattattt

SEQ ID NO: 5991447 - DNA, 13 bp, Homo sapiens
cagaaccaattca

SEQ ID NO: 5991448 - DNA, 16 bp, Homo sapiens
cagaaccacaaacaat

SEQ ID NO: 5991449 - DNA, 16 bp, Homo sapiens
cagaaccacacttgaa

SEQ ID NO: 5991450 - DNA, 21 bp, Homo sapiens
cagaaccacacttgaaacctt

SEQ ID NO: 5991451 - DNA, 22 bp, Homo sapiens
cagaaccacacttgaaaccttt

SEQ ID NO: 5991452 - DNA, 20 bp, Homo sapiens
cagaaccaccccggccccct

SEQ ID NO: 5991453 - DNA, 15 bp, Homo sapiens
cagaaccagagggca

SEQ ID NO: 5991454 - DNA, 13 bp, Homo sapiens
cagaaccagcact

SEQ ID NO: 5991455 - DNA, 14 bp, Homo sapiens
cagaaccagcacta

SEQ ID NO: 5991456 - DNA, 14 bp, Homo sapiens
cagaaccagcactc

SEQ ID NO: 5991457 - DNA, 23 bp, Homo sapiens
cagaaccagcactcccagggccc

SEQ ID NO: 5991458 - DNA, 22 bp, Homo sapiens
cagaaccatttaagagactctt

SEQ ID NO: 5991459 - DNA, 16 bp, Homo sapiens
caatgtgtataaacaa

SEQ ID NO: 5991460 - DNA, 17 bp, Homo sapiens
caatgtgtataaattgt

SEQ ID NO: 5991461 - DNA, 12 bp, Homo sapiens
caatgtgtgtat

SEQ ID NO: 5991462 - DNA, 17 bp, Homo sapiens
caatgtgtgtatatgga

SEQ ID NO: 5991463 - DNA, 18 bp, Homo sapiens
caatgtgtgtatatggac

SEQ ID NO: 5991464 - DNA, 22 bp, Homo sapiens
caatgtgtgtatgttaatatct

SEQ ID NO: 5991465 - DNA, 14 bp, Homo sapiens
caatgtgtttttct

SEQ ID NO: 5991466 - DNA, 17 bp, Homo sapiens
caatgtgtttttctcca

SEQ ID NO: 5991467 - DNA, 13 bp, Homo sapiens
caatgttaaatct

SEQ ID NO: 5991468 - DNA, 16 bp, Homo sapiens
caatgttaaggaaact

SEQ ID NO: 5991469 - DNA, 24 bp, Homo sapiens
caatgttaaggaaactcttatctc

SEQ ID NO: 5991470 - DNA, 12 bp, Homo sapiens
caatgttaatca

SEQ ID NO: 5991471 - DNA, 15 bp, Homo sapiens
caatgttagcctcaa

SEQ ID NO: 5991472 - DNA, 19 bp, Homo sapiens
caatgttcaggagagtaaa

SEQ ID NO: 5991473 - DNA, 21 bp, Homo sapiens
caatgttcaggagagtaaaaa

SEQ ID NO: 5991474 - DNA, 18 bp, Homo sapiens
caatgttcattgtaatgt

SEQ ID NO: 5991475 - DNA, 22 bp, Homo sapiens
caatgttcattgtaatgttact

SEQ ID NO: 5991476 - DNA, 14 bp, Homo sapiens
caatgttccaggaa

SEQ ID NO: 5991477 - DNA, 14 bp, Homo sapiens
caatgttctctctt

SEQ ID NO: 5991478 - DNA, 18 bp, Homo sapiens
caatgttctgttgtaaag

SEQ ID NO: 5991479 - DNA, 16 bp, Homo sapiens
caatgttctttatata

SEQ ID NO: 5991480 - DNA, 18 bp, Homo sapiens
caatgttctttatataca

SEQ ID NO: 5991481 - DNA, 20 bp, Homo sapiens
caatgttgctagttttttgc

SEQ ID NO: 5991482 - DNA, 21 bp, Homo sapiens
caatgttggagcagcaggcct

SEQ ID NO: 5991483 - DNA, 18 bp, Homo sapiens
caatgttggcctgtcaga

SEQ ID NO: 5991484 - DNA, 22 bp, Homo sapiens
caatgttggctagtctgtgcct

SEQ ID NO: 5991485 - DNA, 22 bp, Homo sapiens
caatgttggttttttataaagt

SEQ ID NO: 5991486 - DNA, 13 bp, Homo sapiens
caatgttgtgatt

SEQ ID NO: 5991487 - DNA, 17 bp, Homo sapiens
caatgttgtgtgttgca

SEQ ID NO: 5991488 - DNA, 19 bp, Homo sapiens
caatgttgtgtgttgcact

SEQ ID NO: 5991489 - DNA, 21 bp, Homo sapiens
caatgttgttcaccagtgctt

SEQ ID NO: 5991490 - DNA, 22 bp, Homo sapiens
caatgttgttcaccagtgcttg

SEQ ID NO: 5991491 - DNA, 23 bp, Homo sapiens
caatgtttatgcaaggaaggaaa

SEQ ID NO: 5991492 - DNA, 21 bp, Homo sapiens
caatgtttattgggcaataaa

SEQ ID NO: 5991493 - DNA, 22 bp, Homo sapiens
caatgtttattgggcaataaaa

SEQ ID NO: 5991494 - DNA, 19 bp, Homo sapiens
caatgtttcttcatttctc

SEQ ID NO: 5991495 - DNA, 14 bp, Homo sapiens
caatgtttgatgtc

SEQ ID NO: 5991496 - DNA, 15 bp, Homo sapiens
caatgtttgatgtcc

SEQ ID NO: 5991497 - DNA, 22 bp, Homo sapiens
caatgtttgggatattaaaaca

SEQ ID NO: 5991498 - DNA, 23 bp, Homo sapiens
caatgtttgggatattaaaacac

SEQ ID NO: 5991499 - DNA, 19 bp, Homo sapiens
caatgtttgggggaaaaaa

SEQ ID NO: 5991500 - DNA, 13 bp, Homo sapiens
caatgttttcctt

SEQ ID NO: 5991501 - DNA, 18 bp, Homo sapiens
caatgtttttaaaaatct

SEQ ID NO: 5991502 - DNA, 18 bp, Homo sapiens
caatgttttttatacttc

SEQ ID NO: 5991503 - DNA, 22 bp, Homo sapiens
caattaaaaaaaattaaaacca

SEQ ID NO: 5991504 - DNA, 21 bp, Homo sapiens
caattaaaaacgaaaacctga

SEQ ID NO: 5991505 - DNA, 19 bp, Homo sapiens
caattaaaaagttgggaaa

SEQ ID NO: 5991506 - DNA, 12 bp, Homo sapiens
caattaaaatac

SEQ ID NO: 5991507 - DNA, 12 bp, Homo sapiens
caattaaaatat

SEQ ID NO: 5991508 - DNA, 13 bp, Homo sapiens
caattaaaatata

SEQ ID NO: 5991509 - DNA, 15 bp, Homo sapiens
caattaaaatatata

SEQ ID NO: 5991510 - DNA, 14 bp, Homo sapiens
caattaaaattaag

SEQ ID NO: 5991511 - DNA, 20 bp, Homo sapiens
caattaaaattaaggtctgg

SEQ ID NO: 5991512 - DNA, 13 bp, Homo sapiens
caattaaacagct

SEQ ID NO: 5991513 - DNA, 17 bp, Homo sapiens
caattaaaccgcatgtg

SEQ ID NO: 5991514 - DNA, 12 bp, Homo sapiens
caattaaacgga

SEQ ID NO: 5991515 - DNA, 15 bp, Homo sapiens
caattaaacggatta

SEQ ID NO: 5991516 - DNA, 16 bp, Homo sapiens
caattaaacggattat

SEQ ID NO: 5991517 - DNA, 17 bp, Homo sapiens
caattaaacggattatt

SEQ ID NO: 5991518 - DNA, 18 bp, Homo sapiens
caattaaacggattattt

SEQ ID NO: 5991519 - DNA, 20 bp, Homo sapiens
caattaaacggattattttt

SEQ ID NO: 5991520 - DNA, 19 bp, Homo sapiens
caattaaacttccaaagaa

SEQ ID NO: 5991521 - DNA, 15 bp, Homo sapiens
caattaaagaaataa

SEQ ID NO: 5991522 - DNA, 18 bp, Homo sapiens
caattaaagacatttaaa

SEQ ID NO: 5991523 - DNA, 14 bp, Homo sapiens
caattaaaggcaaa

SEQ ID NO: 5991524 - DNA, 15 bp, Homo sapiens
caattaaatttattt

SEQ ID NO: 5991525 - DNA, 17 bp, Homo sapiens
caattaacatacatcat

SEQ ID NO: 5991526 - DNA, 23 bp, Homo sapiens
caattaacatacatcattccaca

SEQ ID NO: 5991527 - DNA, 14 bp, Homo sapiens
caattaacatatat

SEQ ID NO: 5991528 - DNA, 22 bp, Homo sapiens
caattaaggattttatgcttta

SEQ ID NO: 5991529 - DNA, 23 bp, Homo sapiens
caattaaggattttatgctttaa

SEQ ID NO: 5991530 - DNA, 23 bp, Homo sapiens
caattaagttacaattacatctc

SEQ ID NO: 5991531 - DNA, 22 bp, Homo sapiens
caattaataatgtttataagct

SEQ ID NO: 5991532 - DNA, 22 bp, Homo sapiens
caattaatagtttgtctatttt

SEQ ID NO: 5991533 - DNA, 19 bp, Homo sapiens
caattaatggaaaactgtt

SEQ ID NO: 5991534 - DNA, 23 bp, Homo sapiens
caattaattgctattgtgttatt

SEQ ID NO: 5991535 - DNA, 13 bp, Homo sapiens
caattaatttttt

SEQ ID NO: 5991536 - DNA, 22 bp, Homo sapiens
caattaatttttttattgttta

SEQ ID NO: 5991537 - DNA, 12 bp, Homo sapiens
caattacagagg

SEQ ID NO: 5991538 - DNA, 17 bp, Homo sapiens
caattacagggtgactc

SEQ ID NO: 5991539 - DNA, 22 bp, Homo sapiens
caattacagggtgactcacagc

SEQ ID NO: 5991540 - DNA, 15 bp, Homo sapiens
caattacatgtttgg

SEQ ID NO: 5991541 - DNA, 21 bp, Homo sapiens
caattacggtgtacagtttaa

SEQ ID NO: 5991542 - DNA, 18 bp, Homo sapiens
caattactacaaatggat

SEQ ID NO: 5991543 - DNA, 17 bp, Homo sapiens
caattactggtccaaaa

SEQ ID NO: 5991544 - DNA, 16 bp, Homo sapiens
caattactgtgagaac

SEQ ID NO: 5991545 - DNA, 16 bp, Homo sapiens
caattacttattttag

SEQ ID NO: 5991546 - DNA, 21 bp, Homo sapiens
caattagaaatattaaagatt

SEQ ID NO: 5991547 - DNA, 17 bp, Homo sapiens
caattagacttgaaata

SEQ ID NO: 5991548 - DNA, 16 bp, Homo sapiens
caattagatagaaaag

SEQ ID NO: 5991549 - DNA, 20 bp, Homo sapiens
caattagatctaaacagtta

SEQ ID NO: 5991550 - DNA, 22 bp, Homo sapiens
caattagatctaaacagttatt

SEQ ID NO: 5991551 - DNA, 14 bp, Homo sapiens
caattagcattctg

SEQ ID NO: 5991552 - DNA, 19 bp, Homo sapiens
caattagcctcatagttat

SEQ ID NO: 5991553 - DNA, 22 bp, Homo sapiens
caattaggaagtgtaacagctg

SEQ ID NO: 5991554 - DNA, 23 bp, Homo sapiens
caattaggcagactctttatgct

SEQ ID NO: 5991555 - DNA, 22 bp, Homo sapiens
caattaggtctgcattttctca

SEQ ID NO: 5991556 - DNA, 23 bp, Homo sapiens
caattaggtctgcattttctcag

SEQ ID NO: 5991557 - DNA, 18 bp, Homo sapiens
caattagtaacattcatg

SEQ ID NO: 5991558 - DNA, 13 bp, Homo sapiens
caattagtacagt

SEQ ID NO: 5991559 - DNA, 18 bp, Homo sapiens
caattagtggtcataaaa

SEQ ID NO: 5991560 - DNA, 13 bp, Homo sapiens
caattagtttcct

SEQ ID NO: 5991561 - DNA, 21 bp, Homo sapiens
caattataacttattagcagt

SEQ ID NO: 5991562 - DNA, 15 bp, Homo sapiens
caattataattgtaa

SEQ ID NO: 5991563 - DNA, 20 bp, Homo sapiens
caattatatttttgtaaata

SEQ ID NO: 5991564 - DNA, 14 bp, Homo sapiens
caattatcaaaaaa

SEQ ID NO: 5991565 - DNA, 17 bp, Homo sapiens
caattatcaaaaaacag

SEQ ID NO: 5991566 - DNA, 19 bp, Homo sapiens
caattatcaaaaaacagaa

SEQ ID NO: 5991567 - DNA, 22 bp, Homo sapiens
caattatctgattaagcattct

SEQ ID NO: 5991568 - DNA, 18 bp, Homo sapiens
caattatgaaaaaatgtt

SEQ ID NO: 5991569 - DNA, 20 bp, Homo sapiens
caattatgaaaaaatgttca

SEQ ID NO: 5991570 - DNA, 23 bp, Homo sapiens
caattatgaaaaaatgttcaaat

SEQ ID NO: 5991571 - DNA, 16 bp, Homo sapiens
caattatgaagattta

SEQ ID NO: 5991572 - DNA, 22 bp, Homo sapiens
caattatgcactggccacccaa

SEQ ID NO: 5991573 - DNA, 15 bp, Homo sapiens
caattatgtctcttg

SEQ ID NO: 5991574 - DNA, 22 bp, Homo sapiens
caattatgtgacaacctttgtg

SEQ ID NO: 5991575 - DNA, 23 bp, Homo sapiens
caattatgtgacaacctttgtgt

SEQ ID NO: 5991576 - DNA, 14 bp, Homo sapiens
caattatgtgcaaa

SEQ ID NO: 5991577 - DNA, 15 bp, Homo sapiens
caattatgttaaact

SEQ ID NO: 5991578 - DNA, 15 bp, Homo sapiens
caattattacattta

SEQ ID NO: 5991579 - DNA, 14 bp, Homo sapiens
caattattgatata

SEQ ID NO: 5991580 - DNA, 18 bp, Homo sapiens
caattattgtacactaac

SEQ ID NO: 5991581 - DNA, 19 bp, Homo sapiens
caattattgtacactaaca

SEQ ID NO: 5991582 - DNA, 17 bp, Homo sapiens
caattattgttacacat

SEQ ID NO: 5991583 - DNA, 23 bp, Homo sapiens
caattattgttacacattaagta

SEQ ID NO: 5991584 - DNA, 14 bp, Homo sapiens
caattatttaaaga

SEQ ID NO: 5991585 - DNA, 18 bp, Homo sapiens
caattatttaaagaaagt

SEQ ID NO: 5991586 - DNA, 23 bp, Homo sapiens
caattatttatttcatgtcttta

SEQ ID NO: 5991587 - DNA, 16 bp, Homo sapiens
caattatttgcatatt

SEQ ID NO: 5991588 - DNA, 23 bp, Homo sapiens
caattatttgcatattttgagaa

SEQ ID NO: 5991589 - DNA, 12 bp, Homo sapiens
caattattttgg

SEQ ID NO: 5991590 - DNA, 15 bp, Homo sapiens
caattcaaaaatgta

SEQ ID NO: 5991591 - DNA, 17 bp, Homo sapiens
caattcaaaagttccaa

SEQ ID NO: 5991592 - DNA, 16 bp, Homo sapiens
caattcaaacaattca

SEQ ID NO: 5991593 - DNA, 21 bp, Homo sapiens
caattcaaacaattcaatcaa

SEQ ID NO: 5991594 - DNA, 14 bp, Homo sapiens
caattcaaatgctt

SEQ ID NO: 5991595 - DNA, 14 bp, Homo sapiens
caattcaacactcc

SEQ ID NO: 5991596 - DNA, 18 bp, Homo sapiens
caattcaagctgagaaaa

SEQ ID NO: 5991597 - DNA, 17 bp, Homo sapiens
caattcaatacaaacaa

SEQ ID NO: 5991598 - DNA, 12 bp, Homo sapiens
caattcaatgca

SEQ ID NO: 5991599 - DNA, 20 bp, Homo sapiens
caattcacagcctttctgaa

SEQ ID NO: 5991600 - DNA, 20 bp, Homo sapiens
caattcacatctaacctcat

SEQ ID NO: 5991601 - DNA, 15 bp, Homo sapiens
caattcacccactcc

SEQ ID NO: 5991602 - DNA, 20 bp, Homo sapiens
caattcacttcattgaccaa

SEQ ID NO: 5991603 - DNA, 23 bp, Homo sapiens
caattcagagaatagcagtttca

SEQ ID NO: 5991604 - DNA, 12 bp, Homo sapiens
caattcagaggc

SEQ ID NO: 5991605 - DNA, 20 bp, Homo sapiens
caattcaggactggctcacc

SEQ ID NO: 5991606 - DNA, 19 bp, Homo sapiens
caattcagtgacttaatat

SEQ ID NO: 5991607 - DNA, 21 bp, Homo sapiens
caattcagtgctgtacttgat

SEQ ID NO: 5991608 - DNA, 13 bp, Homo sapiens
caattcagtggtc

SEQ ID NO: 5991609 - DNA, 22 bp, Homo sapiens
caattcagttttagtttcaaaa

SEQ ID NO: 5991610 - DNA, 23 bp, Homo sapiens
caattcagttttagtttcaaaat

SEQ ID NO: 5991611 - DNA, 23 bp, Homo sapiens
caattcataactaatgaattgaa

SEQ ID NO: 5991612 - DNA, 19 bp, Homo sapiens
caattcatggttcaagtat

SEQ ID NO: 5991613 - DNA, 23 bp, Homo sapiens
caattcatgtaacagttgtgtca

SEQ ID NO: 5991614 - DNA, 16 bp, Homo sapiens
caattcattaataaaa

SEQ ID NO: 5991615 - DNA, 15 bp, Homo sapiens
caattcattggctcc

SEQ ID NO: 5991616 - DNA, 16 bp, Homo sapiens
caattcattggctcct

SEQ ID NO: 5991617 - DNA, 17 bp, Homo sapiens
caattcattggctcctg

SEQ ID NO: 5991618 - DNA, 11 bp, Homo sapiens
caattcattgt

SEQ ID NO: 5991619 - DNA, 14 bp, Homo sapiens
caattcattgtgta

SEQ ID NO: 5991620 - DNA, 20 bp, Homo sapiens
caattcattgttaaaaaaca

SEQ ID NO: 5991621 - DNA, 21 bp, Homo sapiens
caattcattgttaaaaaacaa

SEQ ID NO: 5991622 - DNA, 14 bp, Homo sapiens
caattcatttcact

SEQ ID NO: 5991623 - DNA, 15 bp, Homo sapiens
caattccaaaggaat

SEQ ID NO: 5991624 - DNA, 19 bp, Homo sapiens
caattccaacagtttaatg

SEQ ID NO: 5991625 - DNA, 22 bp, Homo sapiens
caattccaacagtttaatgaag

SEQ ID NO: 5991626 - DNA, 14 bp, Homo sapiens
caattccaagaaaa

SEQ ID NO: 5991627 - DNA, 22 bp, Homo sapiens
caattccaatttcaaaatgtct

SEQ ID NO: 5991628 - DNA, 19 bp, Homo sapiens
caattccacagtctctggg

SEQ ID NO: 5991629 - DNA, 11 bp, Homo sapiens
caattccactg

SEQ ID NO: 5991630 - DNA, 14 bp, Homo sapiens
caattccaggctga

SEQ ID NO: 5991631 - DNA, 20 bp, Homo sapiens
caattccaggctgagccatg

SEQ ID NO: 5991632 - DNA, 21 bp, Homo sapiens
caattccaggctgagccatga

SEQ ID NO: 5991633 - DNA, 18 bp, Homo sapiens
caattcccacctatgagt

SEQ ID NO: 5991634 - DNA, 12 bp, Homo sapiens
caattcccctct

SEQ ID NO: 5991635 - DNA, 13 bp, Homo sapiens
caattcccctctg

SEQ ID NO: 5991636 - DNA, 16 bp, Homo sapiens
cagaaccatttcaccc

SEQ ID NO: 5991637 - DNA, 14 bp, Homo sapiens
cagaacccacagta

SEQ ID NO: 5991638 - DNA, 16 bp, Homo sapiens
cagaacccacagtgag

SEQ ID NO: 5991639 - DNA, 15 bp, Homo sapiens
cagaacccagggctc

SEQ ID NO: 5991640 - DNA, 22 bp, Homo sapiens
cagaacccagggctctgcccca

SEQ ID NO: 5991641 - DNA, 15 bp, Homo sapiens
cagaaccccaactcc

SEQ ID NO: 5991642 - DNA, 17 bp, Homo sapiens
cagaaccccaactccca

SEQ ID NO: 5991643 - DNA, 20 bp, Homo sapiens
cagaaccccaactcccagcc

SEQ ID NO: 5991644 - DNA, 22 bp, Homo sapiens
cagaacccccaggtggcctgcg

SEQ ID NO: 5991645 - DNA, 15 bp, Homo sapiens
cagaaccctgccatg

SEQ ID NO: 5991646 - DNA, 18 bp, Homo sapiens
cagaaccctgccatggaa

SEQ ID NO: 5991647 - DNA, 19 bp, Homo sapiens
cagaacccttggcttgccc

SEQ ID NO: 5991648 - DNA, 19 bp, Homo sapiens
cagaaccggtcccagcctg

SEQ ID NO: 5991649 - DNA, 21 bp, Homo sapiens
cagaaccggtcccagcctggg

SEQ ID NO: 5991650 - DNA, 21 bp, Homo sapiens
cagaacctactgttcctttca

SEQ ID NO: 5991651 - DNA, 14 bp, Homo sapiens
cagaacctaggagg

SEQ ID NO: 5991652 - DNA, 15 bp, Homo sapiens
cagaacctaggagga

SEQ ID NO: 5991653 - DNA, 14 bp, Homo sapiens
cagaacctcagcat

SEQ ID NO: 5991654 - DNA, 22 bp, Homo sapiens
cagaacctctaagtgctgctgt

SEQ ID NO: 5991655 - DNA, 15 bp, Homo sapiens
cagaacctcttcccc

SEQ ID NO: 5991656 - DNA, 16 bp, Homo sapiens
cagaacctcttcccca

SEQ ID NO: 5991657 - DNA, 13 bp, Homo sapiens
cagaacctgagct

SEQ ID NO: 5991658 - DNA, 14 bp, Homo sapiens
cagaacctgagcta

SEQ ID NO: 5991659 - DNA, 14 bp, Homo sapiens
cagaacctgagggc

SEQ ID NO: 5991660 - DNA, 19 bp, Homo sapiens
cagaacctgcacacaggac

SEQ ID NO: 5991661 - DNA, 14 bp, Homo sapiens
cagaacctgtcctt

SEQ ID NO: 5991662 - DNA, 19 bp, Homo sapiens
cagaaccttactggcactg

SEQ ID NO: 5991663 - DNA, 17 bp, Homo sapiens
cagaaccttcaacccag

SEQ ID NO: 5991664 - DNA, 21 bp, Homo sapiens
cagaaccttcccgtctgattg

SEQ ID NO: 5991665 - DNA, 12 bp, Homo sapiens
cagaaccttctt

SEQ ID NO: 5991666 - DNA, 15 bp, Homo sapiens
cagaacctttggaca

SEQ ID NO: 5991667 - DNA, 20 bp, Homo sapiens
cagaacctttggacaagagg

SEQ ID NO: 5991668 - DNA, 15 bp, Homo sapiens
cagaacgatgcctgc

SEQ ID NO: 5991669 - DNA, 18 bp, Homo sapiens
cagaacgatgcctgcagg

SEQ ID NO: 5991670 - DNA, 16 bp, Homo sapiens
cagaacgcaccccact

SEQ ID NO: 5991671 - DNA, 15 bp, Homo sapiens
cagaacgcatgcagg

SEQ ID NO: 5991672 - DNA, 14 bp, Homo sapiens
cagaacgccctgtg

SEQ ID NO: 5991673 - DNA, 14 bp, Homo sapiens
cagaacgggcctcc

SEQ ID NO: 5991674 - DNA, 16 bp, Homo sapiens
cagaacgtagtgagcc

SEQ ID NO: 5991675 - DNA, 17 bp, Homo sapiens
cagaacgtatttagcca

SEQ ID NO: 5991676 - DNA, 20 bp, Homo sapiens
cagaactaaactcatttata

SEQ ID NO: 5991677 - DNA, 17 bp, Homo sapiens
cagaactaaatgttcta

SEQ ID NO: 5991678 - DNA, 14 bp, Homo sapiens
cagaactaaatttt

SEQ ID NO: 5991679 - DNA, 17 bp, Homo sapiens
cagaactaccaaaatga

SEQ ID NO: 5991680 - DNA, 17 bp, Homo sapiens
cagaactaccaggtggc

SEQ ID NO: 5991681 - DNA, 22 bp, Homo sapiens
cagaactataacattcaatttg

SEQ ID NO: 5991682 - DNA, 18 bp, Homo sapiens
cagaactatttaaaataa

SEQ ID NO: 5991683 - DNA, 21 bp, Homo sapiens
cagaactcaaatggggccaga

SEQ ID NO: 5991684 - DNA, 15 bp, Homo sapiens
cagaactcactgggg

SEQ ID NO: 5991685 - DNA, 18 bp, Homo sapiens
cagaactcactggggcct

SEQ ID NO: 5991686 - DNA, 16 bp, Homo sapiens
cagaactcagccttaa

SEQ ID NO: 5991687 - DNA, 21 bp, Homo sapiens
cagaactcattctatccccaa

SEQ ID NO: 5991688 - DNA, 14 bp, Homo sapiens
cagaactcccttca

SEQ ID NO: 5991689 - DNA, 13 bp, Homo sapiens
cagaactcctacc

SEQ ID NO: 5991690 - DNA, 19 bp, Homo sapiens
cagaactcctccaaagcat

SEQ ID NO: 5991691 - DNA, 19 bp, Homo sapiens
cagaactcgatgcactgac

SEQ ID NO: 5991692 - DNA, 18 bp, Homo sapiens
cagaactcggtgtcccca

SEQ ID NO: 5991693 - DNA, 19 bp, Homo sapiens
cagaactcggtgtccccac

SEQ ID NO: 5991694 - DNA, 18 bp, Homo sapiens
cagaactcgttaaagcaa

SEQ ID NO: 5991695 - DNA, 13 bp, Homo sapiens
cagaactctcaga

SEQ ID NO: 5991696 - DNA, 22 bp, Homo sapiens
cagaactctctgtcttctctcc

SEQ ID NO: 5991697 - DNA, 22 bp, Homo sapiens
cagaactcttcctccaaggaca

SEQ ID NO: 5991698 - DNA, 17 bp, Homo sapiens
cagaactcttcctcctc

SEQ ID NO: 5991699 - DNA, 18 bp, Homo sapiens
cagaactgaagccacttg

SEQ ID NO: 5991700 - DNA, 20 bp, Homo sapiens
cagaactgaagccacttggc

SEQ ID NO: 5991701 - DNA, 16 bp, Homo sapiens
cagaactgagctcctc

SEQ ID NO: 5991702 - DNA, 19 bp, Homo sapiens
cagaactgaggtcactggg

SEQ ID NO: 5991703 - DNA, 22 bp, Homo sapiens
cagaactgccattattttctgt

SEQ ID NO: 5991704 - DNA, 13 bp, Homo sapiens
cagaactgccctt

SEQ ID NO: 5991705 - DNA, 17 bp, Homo sapiens
cagaactgcccttgctg

SEQ ID NO: 5991706 - DNA, 22 bp, Homo sapiens
cagaactgcccttgctgcccgc

SEQ ID NO: 5991707 - DNA, 17 bp, Homo sapiens
cagaactggcaggagcc

SEQ ID NO: 5991708 - DNA, 17 bp, Homo sapiens
cagaactggctgggccc

SEQ ID NO: 5991709 - DNA, 18 bp, Homo sapiens
cagaactgggaaaacagt

SEQ ID NO: 5991710 - DNA, 23 bp, Homo sapiens
cagaactgtccacatctgcctcc

SEQ ID NO: 5991711 - DNA, 17 bp, Homo sapiens
cagaactgtcttagtca

SEQ ID NO: 5991712 - DNA, 16 bp, Homo sapiens
cagaactgtgagagaa

SEQ ID NO: 5991713 - DNA, 16 bp, Homo sapiens
cagaactgtgccacaa

SEQ ID NO: 5991714 - DNA, 17 bp, Homo sapiens
cagaactgttggctgct

SEQ ID NO: 5991715 - DNA, 18 bp, Homo sapiens
cagaactgttggctgctc

SEQ ID NO: 5991716 - DNA, 16 bp, Homo sapiens
cagaacttcatctgcc

SEQ ID NO: 5991717 - DNA, 18 bp, Homo sapiens
cagaacttcatctgccac

SEQ ID NO: 5991718 - DNA, 15 bp, Homo sapiens
cagaacttccctgat

SEQ ID NO: 5991719 - DNA, 17 bp, Homo sapiens
cagaacttgaagggtta

SEQ ID NO: 5991720 - DNA, 16 bp, Homo sapiens
cagaacttgaatgtgt

SEQ ID NO: 5991721 - DNA, 14 bp, Homo sapiens
cagaacttgctgct

SEQ ID NO: 5991722 - DNA, 20 bp, Homo sapiens
cagaacttgctgctgtcttg

SEQ ID NO: 5991723 - DNA, 14 bp, Homo sapiens
cagaactttctctt

SEQ ID NO: 5991724 - DNA, 18 bp, Homo sapiens
cagaactttctcttttga

SEQ ID NO: 5991725 - DNA, 19 bp, Homo sapiens
cagaactttctcttttgaa

SEQ ID NO: 5991726 - DNA, 21 bp, Homo sapiens
cagaagaaaaggaaatgaaca

SEQ ID NO: 5991727 - DNA, 12 bp, Homo sapiens
cagaagaaaata

SEQ ID NO: 5991728 - DNA, 14 bp, Homo sapiens
cagaagaaaataat

SEQ ID NO: 5991729 - DNA, 19 bp, Homo sapiens
cagaagaaaatagaattga

SEQ ID NO: 5991730 - DNA, 14 bp, Homo sapiens
cagaagaaaattct

SEQ ID NO: 5991731 - DNA, 13 bp, Homo sapiens
cagaagaaaattt

SEQ ID NO: 5991732 - DNA, 18 bp, Homo sapiens
cagaagaaactcctggat

SEQ ID NO: 5991733 - DNA, 18 bp, Homo sapiens
cagaagaaagatggaaat

SEQ ID NO: 5991734 - DNA, 15 bp, Homo sapiens
cagaagaaaggaaca

SEQ ID NO: 5991735 - DNA, 17 bp, Homo sapiens
cagaagaaataaatata

SEQ ID NO: 5991736 - DNA, 18 bp, Homo sapiens
cagaagaaattatttaat

SEQ ID NO: 5991737 - DNA, 19 bp, Homo sapiens
cagaagaagacagcaaaaa

SEQ ID NO: 5991738 - DNA, 14 bp, Homo sapiens
cagaagaagagaag

SEQ ID NO: 5991739 - DNA, 20 bp, Homo sapiens
cagaagaagagaagctgctg

SEQ ID NO: 5991740 - DNA, 16 bp, Homo sapiens
cagaagaagctcctga

SEQ ID NO: 5991741 - DNA, 18 bp, Homo sapiens
cagaagaagctcctgaat

SEQ ID NO: 5991742 - DNA, 15 bp, Homo sapiens
cagaagaaggcagca

SEQ ID NO: 5991743 - DNA, 19 bp, Homo sapiens
cagaagaagtgggagcagc

SEQ ID NO: 5991744 - DNA, 23 bp, Homo sapiens
cagaagaagtgggagcagcttct

SEQ ID NO: 5991745 - DNA, 17 bp, Homo sapiens
cagaagaatattcagga

SEQ ID NO: 5991746 - DNA, 17 bp, Homo sapiens
cagaagaatcttcctgg

SEQ ID NO: 5991747 - DNA, 18 bp, Homo sapiens
cagaagaatcttcctggc

SEQ ID NO: 5991748 - DNA, 21 bp, Homo sapiens
cagaagaatcttcctggcaca

SEQ ID NO: 5991749 - DNA, 17 bp, Homo sapiens
cagaagaattgaaccca

SEQ ID NO: 5991750 - DNA, 22 bp, Homo sapiens
cagaagaattgaacccaggagg

SEQ ID NO: 5991751 - DNA, 13 bp, Homo sapiens
cagaagaatttaa

SEQ ID NO: 5991752 - DNA, 15 bp, Homo sapiens
cagaagacaaaggcc

SEQ ID NO: 5991753 - DNA, 17 bp, Homo sapiens
cagaagacaaaggccca

SEQ ID NO: 5991754 - DNA, 19 bp, Homo sapiens
cagaagacacatgtggaga

SEQ ID NO: 5991755 - DNA, 17 bp, Homo sapiens
cagaagacaccagagca

SEQ ID NO: 5991756 - DNA, 17 bp, Homo sapiens
cagaagacacgtgtttt

SEQ ID NO: 5991757 - DNA, 15 bp, Homo sapiens
cagaagacactaatt

SEQ ID NO: 5991758 - DNA, 15 bp, Homo sapiens
cagaagaccccactt

SEQ ID NO: 5991759 - DNA, 18 bp, Homo sapiens
cagaagacctccctgtga

SEQ ID NO: 5991760 - DNA, 22 bp, Homo sapiens
cagaagacgtggtctagaccag

SEQ ID NO: 5991761 - DNA, 21 bp, Homo sapiens
cagaagactagaggccagggc

SEQ ID NO: 5991762 - DNA, 18 bp, Homo sapiens
cagaagactatttaccag

SEQ ID NO: 5991763 - DNA, 23 bp, Homo sapiens
cagaagactatttaccagggacc

SEQ ID NO: 5991764 - DNA, 14 bp, Homo sapiens
cagaagactctcca

SEQ ID NO: 5991765 - DNA, 22 bp, Homo sapiens
cagaagactctccactgacctg

SEQ ID NO: 5991766 - DNA, 23 bp, Homo sapiens
cagaagactctccactgacctgg

SEQ ID NO: 5991767 - DNA, 18 bp, Homo sapiens
cagaagacttcccagctt

SEQ ID NO: 5991768 - DNA, 21 bp, Homo sapiens
cagaagagaaaggactcagtg

SEQ ID NO: 5991769 - DNA, 22 bp, Homo sapiens
cagaagagaaaggactcagtgt

SEQ ID NO: 5991770 - DNA, 16 bp, Homo sapiens
cagaagagaaatacag

SEQ ID NO: 5991771 - DNA, 21 bp, Homo sapiens
cagaagagaaatacagctggc

SEQ ID NO: 5991772 - DNA, 11 bp, Homo sapiens
cagaagagact

SEQ ID NO: 5991773 - DNA, 16 bp, Homo sapiens
cagaagagaggggaag

SEQ ID NO: 5991774 - DNA, 20 bp, Homo sapiens
cagaagagatgggcttgttt

SEQ ID NO: 5991775 - DNA, 17 bp, Homo sapiens
cagaagaggggcagctt

SEQ ID NO: 5991776 - DNA, 22 bp, Homo sapiens
cagaagaggggcagctttttca

SEQ ID NO: 5991777 - DNA, 14 bp, Homo sapiens
cagaagagggggag

SEQ ID NO: 5991778 - DNA, 16 bp, Homo sapiens
cagaagagtcaaagta

SEQ ID NO: 5991779 - DNA, 15 bp, Homo sapiens
cagaagatgaacaga

SEQ ID NO: 5991780 - DNA, 18 bp, Homo sapiens
cagaagatgaacagactg

SEQ ID NO: 5991781 - DNA, 17 bp, Homo sapiens
cagaagatgccagcttc

SEQ ID NO: 5991782 - DNA, 22 bp, Homo sapiens
cagaagatgtattcagagccac

SEQ ID NO: 5991783 - DNA, 14 bp, Homo sapiens
cagaagatgtgaaa

SEQ ID NO: 5991784 - DNA, 19 bp, Homo sapiens
cagaagattaagacagaga

SEQ ID NO: 5991785 - DNA, 20 bp, Homo sapiens
cagaagattacaaaagcaat

SEQ ID NO: 5991786 - DNA, 18 bp, Homo sapiens
cagaagattgggccgcct

SEQ ID NO: 5991787 - DNA, 16 bp, Homo sapiens
cagaagcaagccagac

SEQ ID NO: 5991788 - DNA, 19 bp, Homo sapiens
cagaagcaaggaagtaagg

SEQ ID NO: 5991789 - DNA, 20 bp, Homo sapiens
cagaagcaaggaagtaaggg

SEQ ID NO: 5991790 - DNA, 18 bp, Homo sapiens
cagaagcaaggtctcaga

SEQ ID NO: 5991791 - DNA, 11 bp, Homo sapiens
cagaagcacaa

SEQ ID NO: 5991792 - DNA, 14 bp, Homo sapiens
cagaagcagagatg

SEQ ID NO: 5991793 - DNA, 15 bp, Homo sapiens
cagaagcagaggcta

SEQ ID NO: 5991794 - DNA, 21 bp, Homo sapiens
cagaagcagcagctagaaaga

SEQ ID NO: 5991795 - DNA, 14 bp, Homo sapiens
cagaagcagcccct

SEQ ID NO: 5991796 - DNA, 19 bp, Homo sapiens
cagaagcagcccctcgagg

SEQ ID NO: 5991797 - DNA, 21 bp, Homo sapiens
cagaagcagcccctcgaggcc

SEQ ID NO: 5991798 - DNA, 24 bp, Homo sapiens
cagaagcagcccctcgaggcctac

SEQ ID NO: 5991799 - DNA, 23 bp, Homo sapiens
cagaagcagcttcttttgtctcc

SEQ ID NO: 5991800 - DNA, 13 bp, Homo sapiens
cagaagcaggagt

SEQ ID NO: 5991801 - DNA, 14 bp, Homo sapiens
cagaagcaggatag

SEQ ID NO: 5991802 - DNA, 15 bp, Homo sapiens
cagaagcaggctgga

SEQ ID NO: 5991803 - DNA, 20 bp, Homo sapiens
cagaagcagggtaccctttg

SEQ ID NO: 5991804 - DNA, 18 bp, Homo sapiens
cagaagcaggttcttgat

SEQ ID NO: 5991805 - DNA, 23 bp, Homo sapiens
cagaagcagtgtgagcagggctg

SEQ ID NO: 5991806 - DNA, 19 bp, Homo sapiens
cagaagcatattttgctgg

SEQ ID NO: 5991807 - DNA, 20 bp, Homo sapiens
cagaagcatattttgctggt

SEQ ID NO: 5991808 - DNA, 18 bp, Homo sapiens
cagaagcattgcctggac

SEQ ID NO: 5991809 - DNA, 21 bp, Homo sapiens
cagaagcattgcctggactga

SEQ ID NO: 5991810 - DNA, 13 bp, Homo sapiens
cagaagcatttgt

SEQ ID NO: 5991811 - DNA, 20 bp, Homo sapiens
cagaagcatttgtattttgt

SEQ ID NO: 5991812 - DNA, 21 bp, Homo sapiens
cagaagcatttgtattttgtg

SEQ ID NO: 5991813 - DNA, 22 bp, Homo sapiens
cagaagcatttgtattttgtgt

SEQ ID NO: 5991814 - DNA, 17 bp, Homo sapiens
caattcccctctgctgc

SEQ ID NO: 5991815 - DNA, 24 bp, Homo sapiens
caattcccgggcccttcagtccct

SEQ ID NO: 5991816 - DNA, 16 bp, Homo sapiens
caattccctctctcag

SEQ ID NO: 5991817 - DNA, 23 bp, Homo sapiens
caattccctctctcagcacagcc

SEQ ID NO: 5991818 - DNA, 18 bp, Homo sapiens
caattcctagataaaaag

SEQ ID NO: 5991819 - DNA, 22 bp, Homo sapiens
caattcctagataaaaagatgg

SEQ ID NO: 5991820 - DNA, 13 bp, Homo sapiens
caattcctccaga

SEQ ID NO: 5991821 - DNA, 17 bp, Homo sapiens
caattcctccagagaca

SEQ ID NO: 5991822 - DNA, 21 bp, Homo sapiens
caattcctccagagacactga

SEQ ID NO: 5991823 - DNA, 14 bp, Homo sapiens
caattcctctgata

SEQ ID NO: 5991824 - DNA, 16 bp, Homo sapiens
caattcctctgataat

SEQ ID NO: 5991825 - DNA, 14 bp, Homo sapiens
caattcctctggga

SEQ ID NO: 5991826 - DNA, 18 bp, Homo sapiens
caattcctgtccttcaca

SEQ ID NO: 5991827 - DNA, 15 bp, Homo sapiens
caattcggggcctgc

SEQ ID NO: 5991828 - DNA, 16 bp, Homo sapiens
caattcggggcctgct

SEQ ID NO: 5991829 - DNA, 17 bp, Homo sapiens
caattcggggcctgctg

SEQ ID NO: 5991830 - DNA, 20 bp, Homo sapiens
caattctaaatccgacttga

SEQ ID NO: 5991831 - DNA, 18 bp, Homo sapiens
caattctaatggtaactt

SEQ ID NO: 5991832 - DNA, 19 bp, Homo sapiens
caattctacagtttcttac

SEQ ID NO: 5991833 - DNA, 17 bp, Homo sapiens
caattctacccagagcc

SEQ ID NO: 5991834 - DNA, 23 bp, Homo sapiens
caattctcatttgtcacacactt

SEQ ID NO: 5991835 - DNA, 20 bp, Homo sapiens
caattctcccgggactctgc

SEQ ID NO: 5991836 - DNA, 17 bp, Homo sapiens
caattctcctgcctttg

SEQ ID NO: 5991837 - DNA, 20 bp, Homo sapiens
caattctcctgcctttgcct

SEQ ID NO: 5991838 - DNA, 21 bp, Homo sapiens
caattctcctgcctttgcctc

SEQ ID NO: 5991839 - DNA, 17 bp, Homo sapiens
caattctcgagcttggg

SEQ ID NO: 5991840 - DNA, 17 bp, Homo sapiens
caattctcgattctttg

SEQ ID NO: 5991841 - DNA, 12 bp, Homo sapiens
caattctgactg

SEQ ID NO: 5991842 - DNA, 14 bp, Homo sapiens
caattctgactgtc

SEQ ID NO: 5991843 - DNA, 16 bp, Homo sapiens
caattctgactgtcca

SEQ ID NO: 5991844 - DNA, 12 bp, Homo sapiens
caattctgatga

SEQ ID NO: 5991845 - DNA, 14 bp, Homo sapiens
caattctggaagct

SEQ ID NO: 5991846 - DNA, 11 bp, Homo sapiens
caattctgtat

SEQ ID NO: 5991847 - DNA, 23 bp, Homo sapiens
caattctgtccctgtccctgccc

SEQ ID NO: 5991848 - DNA, 19 bp, Homo sapiens
caattctgtgtggtatatt

SEQ ID NO: 5991849 - DNA, 21 bp, Homo sapiens
caattcttccctatctttgcc

SEQ ID NO: 5991850 - DNA, 19 bp, Homo sapiens
caattctttatacaacagt

SEQ ID NO: 5991851 - DNA, 19 bp, Homo sapiens
caattcttttaactgttgt

SEQ ID NO: 5991852 - DNA, 14 bp, Homo sapiens
caattgaagcatga

SEQ ID NO: 5991853 - DNA, 23 bp, Homo sapiens
caattgaagtaaaatgtggcagg

SEQ ID NO: 5991854 - DNA, 15 bp, Homo sapiens
caattgaagtaaact

SEQ ID NO: 5991855 - DNA, 18 bp, Homo sapiens
caattgaagtaaactttt

SEQ ID NO: 5991856 - DNA, 21 bp, Homo sapiens
caattgaattaaattaggaat

SEQ ID NO: 5991857 - DNA, 14 bp, Homo sapiens
caattgacaaatga

SEQ ID NO: 5991858 - DNA, 16 bp, Homo sapiens
caattgacaaatgatg

SEQ ID NO: 5991859 - DNA, 19 bp, Homo sapiens
caattgactgtcactgttc

SEQ ID NO: 5991860 - DNA, 17 bp, Homo sapiens
caattgacttcctccaa

SEQ ID NO: 5991861 - DNA, 21 bp, Homo sapiens
caattgagggcattagtactt

SEQ ID NO: 5991862 - DNA, 15 bp, Homo sapiens
caattgagtaattct

SEQ ID NO: 5991863 - DNA, 20 bp, Homo sapiens
caattgagttaaatcagtaa

SEQ ID NO: 5991864 - DNA, 20 bp, Homo sapiens
caattgatacttcaggtgct

SEQ ID NO: 5991865 - DNA, 14 bp, Homo sapiens
caattgatatttct

SEQ ID NO: 5991866 - DNA, 21 bp, Homo sapiens
caattgatctctttttatcgc

SEQ ID NO: 5991867 - DNA, 19 bp, Homo sapiens
caattgatgtgattatttt

SEQ ID NO: 5991868 - DNA, 23 bp, Homo sapiens
caattgatgttttacgtgcaaac

SEQ ID NO: 5991869 - DNA, 23 bp, Homo sapiens
caattgcacgcggagtgagtttt

SEQ ID NO: 5991870 - DNA, 18 bp, Homo sapiens
caattgcagatgccaaaa

SEQ ID NO: 5991871 - DNA, 17 bp, Homo sapiens
caattgcatctcccaga

SEQ ID NO: 5991872 - DNA, 19 bp, Homo sapiens
caattgccctgccaggctg

SEQ ID NO: 5991873 - DNA, 18 bp, Homo sapiens
caattgcgaccttaattt

SEQ ID NO: 5991874 - DNA, 13 bp, Homo sapiens
caattgctcccat

SEQ ID NO: 5991875 - DNA, 17 bp, Homo sapiens
caattgctcttctccac

SEQ ID NO: 5991876 - DNA, 14 bp, Homo sapiens
caattgctgcatct

SEQ ID NO: 5991877 - DNA, 14 bp, Homo sapiens
caattgcttgagca

SEQ ID NO: 5991878 - DNA, 15 bp, Homo sapiens
caattgcttgagcat

SEQ ID NO: 5991879 - DNA, 22 bp, Homo sapiens
caattgctttgtcatatagctg

SEQ ID NO: 5991880 - DNA, 21 bp, Homo sapiens
caattgctttgtgacttcttc

SEQ ID NO: 5991881 - DNA, 20 bp, Homo sapiens
caattggatacgacaacttg

SEQ ID NO: 5991882 - DNA, 16 bp, Homo sapiens
caattggcccaacact

SEQ ID NO: 5991883 - DNA, 13 bp, Homo sapiens
caattggctcctc

SEQ ID NO: 5991884 - DNA, 18 bp, Homo sapiens
caattggctcctccatct

SEQ ID NO: 5991885 - DNA, 14 bp, Homo sapiens
caattggggcggag

SEQ ID NO: 5991886 - DNA, 17 bp, Homo sapiens
caattggtggtaacagt

SEQ ID NO: 5991887 - DNA, 16 bp, Homo sapiens
caattggttaatcttt

SEQ ID NO: 5991888 - DNA, 15 bp, Homo sapiens
caattggttgtatat

SEQ ID NO: 5991889 - DNA, 21 bp, Homo sapiens
caattgtaaacagaaattgca

SEQ ID NO: 5991890 - DNA, 21 bp, Homo sapiens
caattgtagatgaacatctct

SEQ ID NO: 5991891 - DNA, 16 bp, Homo sapiens
caattgtatatatatg

SEQ ID NO: 5991892 - DNA, 18 bp, Homo sapiens
caattgtatatatatgtg

SEQ ID NO: 5991893 - DNA, 19 bp, Homo sapiens
caattgtatatatatgtga

SEQ ID NO: 5991894 - DNA, 14 bp, Homo sapiens
caattgtattttat

SEQ ID NO: 5991895 - DNA, 15 bp, Homo sapiens
caattgtattttata

SEQ ID NO: 5991896 - DNA, 16 bp, Homo sapiens
caattgtcatttataa

SEQ ID NO: 5991897 - DNA, 13 bp, Homo sapiens
caattgtcttaaa

SEQ ID NO: 5991898 - DNA, 18 bp, Homo sapiens
caattgtgaaaatgaata

SEQ ID NO: 5991899 - DNA, 18 bp, Homo sapiens
caattgtgagaattactg

SEQ ID NO: 5991900 - DNA, 19 bp, Homo sapiens
caattgtgggatgtcctct

SEQ ID NO: 5991901 - DNA, 18 bp, Homo sapiens
caattgtgtctgtggtcc

SEQ ID NO: 5991902 - DNA, 13 bp, Homo sapiens
caattgtgtgaat

SEQ ID NO: 5991903 - DNA, 18 bp, Homo sapiens
caattgttacaagtgttc

SEQ ID NO: 5991904 - DNA, 20 bp, Homo sapiens
caattgttacaagtgttctt

SEQ ID NO: 5991905 - DNA, 19 bp, Homo sapiens
caattgttcttaaaaccaa

SEQ ID NO: 5991906 - DNA, 23 bp, Homo sapiens
caattgttgacagttctgaagaa

SEQ ID NO: 5991907 - DNA, 13 bp, Homo sapiens
caattgttgacta

SEQ ID NO: 5991908 - DNA, 19 bp, Homo sapiens
caattgtttaagaatcatg

SEQ ID NO: 5991909 - DNA, 20 bp, Homo sapiens
caattgtttaagaatcatgg

SEQ ID NO: 5991910 - DNA, 17 bp, Homo sapiens
caattgtttatatggat

SEQ ID NO: 5991911 - DNA, 17 bp, Homo sapiens
caattgtttttgttgtg

SEQ ID NO: 5991912 - DNA, 12 bp, Homo sapiens
caatttaaaatt

SEQ ID NO: 5991913 - DNA, 17 bp, Homo sapiens
caatttaaacaccagtc

SEQ ID NO: 5991914 - DNA, 15 bp, Homo sapiens
caatttaaacccatt

SEQ ID NO: 5991915 - DNA, 15 bp, Homo sapiens
caatttaaaggaaag

SEQ ID NO: 5991916 - DNA, 15 bp, Homo sapiens
caatttaaatgttta

SEQ ID NO: 5991917 - DNA, 23 bp, Homo sapiens
caatttaagtgttggaaaaaatt

SEQ ID NO: 5991918 - DNA, 13 bp, Homo sapiens
caatttaattcct

SEQ ID NO: 5991919 - DNA, 20 bp, Homo sapiens
caatttaattcttatttctg

SEQ ID NO: 5991920 - DNA, 23 bp, Homo sapiens
caatttaattcttatttctgtgt

SEQ ID NO: 5991921 - DNA, 13 bp, Homo sapiens
caatttactttta

SEQ ID NO: 5991922 - DNA, 21 bp, Homo sapiens
caatttagcaaactgatgctg

SEQ ID NO: 5991923 - DNA, 18 bp, Homo sapiens
caatttaggaatgctcaa

SEQ ID NO: 5991924 - DNA, 17 bp, Homo sapiens
caatttagttgttgtag

SEQ ID NO: 5991925 - DNA, 16 bp, Homo sapiens
caatttatacctagca

SEQ ID NO: 5991926 - DNA, 14 bp, Homo sapiens
caatttatatcttt

SEQ ID NO: 5991927 - DNA, 19 bp, Homo sapiens
caatttatatctttatgca

SEQ ID NO: 5991928 - DNA, 22 bp, Homo sapiens
caatttatggaagccagggctt

SEQ ID NO: 5991929 - DNA, 23 bp, Homo sapiens
caatttattaaaatgattgtaaa

SEQ ID NO: 5991930 - DNA, 17 bp, Homo sapiens
caatttattcaagaaaa

SEQ ID NO: 5991931 - DNA, 15 bp, Homo sapiens
caatttattctgata

SEQ ID NO: 5991932 - DNA, 23 bp, Homo sapiens
caatttatttgaatgatttttct

SEQ ID NO: 5991933 - DNA, 12 bp, Homo sapiens
caatttcaaaat

SEQ ID NO: 5991934 - DNA, 17 bp, Homo sapiens
caatttcaaaatgcatg

SEQ ID NO: 5991935 - DNA, 18 bp, Homo sapiens
caatttcaaacttttgaa

SEQ ID NO: 5991936 - DNA, 19 bp, Homo sapiens
caatttcaaacttttgaaa

SEQ ID NO: 5991937 - DNA, 20 bp, Homo sapiens
caatttcaaacttttgaaag

SEQ ID NO: 5991938 - DNA, 18 bp, Homo sapiens
caatttcaaagaaaacag

SEQ ID NO: 5991939 - DNA, 17 bp, Homo sapiens
caatttcaaattactct

SEQ ID NO: 5991940 - DNA, 13 bp, Homo sapiens
caatttcacagag

SEQ ID NO: 5991941 - DNA, 15 bp, Homo sapiens
caatttcagaaacta

SEQ ID NO: 5991942 - DNA, 19 bp, Homo sapiens
caatttcaggaatttaatt

SEQ ID NO: 5991943 - DNA, 13 bp, Homo sapiens
caatttcccaccc

SEQ ID NO: 5991944 - DNA, 20 bp, Homo sapiens
caatttcccctctgtgtcct

SEQ ID NO: 5991945 - DNA, 21 bp, Homo sapiens
caatttcctctccactgctgg

SEQ ID NO: 5991946 - DNA, 13 bp, Homo sapiens
caatttcctggcc

SEQ ID NO: 5991947 - DNA, 16 bp, Homo sapiens
caatttcctttatatt

SEQ ID NO: 5991948 - DNA, 20 bp, Homo sapiens
caatttctaatgtttactat

SEQ ID NO: 5991949 - DNA, 20 bp, Homo sapiens
caatttctactttgaagtca

SEQ ID NO: 5991950 - DNA, 22 bp, Homo sapiens
caatttctagtacctgtgactc

SEQ ID NO: 5991951 - DNA, 16 bp, Homo sapiens
caatttctccaaagct

SEQ ID NO: 5991952 - DNA, 12 bp, Homo sapiens
caatttctcccc

SEQ ID NO: 5991953 - DNA, 15 bp, Homo sapiens
caatttctccccagg

SEQ ID NO: 5991954 - DNA, 22 bp, Homo sapiens
caatttctcccgaatcctgagg

SEQ ID NO: 5991955 - DNA, 16 bp, Homo sapiens
caatttctctgcacac

SEQ ID NO: 5991956 - DNA, 22 bp, Homo sapiens
caatttctctgcacacaagagg

SEQ ID NO: 5991957 - DNA, 18 bp, Homo sapiens
caatttctgtacatttgc

SEQ ID NO: 5991958 - DNA, 15 bp, Homo sapiens
caatttctgtgttgc

SEQ ID NO: 5991959 - DNA, 14 bp, Homo sapiens
caatttcttccttc

SEQ ID NO: 5991960 - DNA, 23 bp, Homo sapiens
caatttcttctaataaagtcatt

SEQ ID NO: 5991961 - DNA, 17 bp, Homo sapiens
caatttcttctgtagct

SEQ ID NO: 5991962 - DNA, 17 bp, Homo sapiens
caatttcttggtattat

SEQ ID NO: 5991963 - DNA, 18 bp, Homo sapiens
caatttctttaaaaaaga

SEQ ID NO: 5991964 - DNA, 20 bp, Homo sapiens
caatttgaagtaacttattt

SEQ ID NO: 5991965 - DNA, 24 bp, Homo sapiens
caatttgaagtaacttatttgact

SEQ ID NO: 5991966 - DNA, 15 bp, Homo sapiens
caatttgagactgaa

SEQ ID NO: 5991967 - DNA, 18 bp, Homo sapiens
caatttgagactgaaatt

SEQ ID NO: 5991968 - DNA, 17 bp, Homo sapiens
caatttgagcaattcat

SEQ ID NO: 5991969 - DNA, 18 bp, Homo sapiens
caatttgagcaattcatt

SEQ ID NO: 5991970 - DNA, 19 bp, Homo sapiens
caatttgagcaattcattt

SEQ ID NO: 5991971 - DNA, 13 bp, Homo sapiens
caatttgataatc

SEQ ID NO: 5991972 - DNA, 15 bp, Homo sapiens
caatttgatacataa

SEQ ID NO: 5991973 - DNA, 20 bp, Homo sapiens
caatttgatacataataaaa

SEQ ID NO: 5991974 - DNA, 22 bp, Homo sapiens
caatttgatacataataaaaaa

SEQ ID NO: 5991975 - DNA, 13 bp, Homo sapiens
caatttgatgtgg

SEQ ID NO: 5991976 - DNA, 16 bp, Homo sapiens
caatttgcaccagttt

SEQ ID NO: 5991977 - DNA, 20 bp, Homo sapiens
caatttgcactaaatcagag

SEQ ID NO: 5991978 - DNA, 20 bp, Homo sapiens
caatttgccttaggaagtga

SEQ ID NO: 5991979 - DNA, 19 bp, Homo sapiens
caatttgctatttacaaat

SEQ ID NO: 5991980 - DNA, 16 bp, Homo sapiens
caatttgggagatata

SEQ ID NO: 5991981 - DNA, 17 bp, Homo sapiens
caatttgggcttcctgt

SEQ ID NO: 5991982 - DNA, 19 bp, Homo sapiens
caatttgggggacatgcta

SEQ ID NO: 5991983 - DNA, 22 bp, Homo sapiens
caatttgggtttgttggtcaca

SEQ ID NO: 5991984 - DNA, 19 bp, Homo sapiens
caatttggtcttagcttta

SEQ ID NO: 5991985 - DNA, 23 bp, Homo sapiens
caatttgtaaaaacagcattgct

SEQ ID NO: 5991986 - DNA, 15 bp, Homo sapiens
caatttgtaaatatt

SEQ ID NO: 5991987 - DNA, 12 bp, Homo sapiens
caatttgtaagt

SEQ ID NO: 5991988 - DNA, 14 bp, Homo sapiens
caatttgtatatca

SEQ ID NO: 5991989 - DNA, 19 bp, Homo sapiens
caatttgtatatcatgaaa

SEQ ID NO: 5991990 - DNA, 14 bp, Homo sapiens
caatttgtctccta

SEQ ID NO: 5991991 - DNA, 22 bp, Homo sapiens
caatttgtctggactagaaaat

SEQ ID NO: 5991992 - DNA, 21 bp, Homo sapiens
cagaagccaagctccctggag

SEQ ID NO: 5991993 - DNA, 19 bp, Homo sapiens
cagaagccaagggaagaca

SEQ ID NO: 5991994 - DNA, 23 bp, Homo sapiens
cagaagccaatctacaatctctt

SEQ ID NO: 5991995 - DNA, 12 bp, Homo sapiens
cagaagccagaa

SEQ ID NO: 5991996 - DNA, 21 bp, Homo sapiens
cagaagccagagggtgggagg

SEQ ID NO: 5991997 - DNA, 19 bp, Homo sapiens
cagaagccagtctgcgtca

SEQ ID NO: 5991998 - DNA, 12 bp, Homo sapiens
cagaagcccaga

SEQ ID NO: 5991999 - DNA, 23 bp, Homo sapiens
cagaagcccatggagcagggatg

SEQ ID NO: 5992000 - DNA, 19 bp, Homo sapiens
cagaagcccatgtcttctg

SEQ ID NO: 5992001 - DNA, 23 bp, Homo sapiens
cagaagcccatgtcttctgctgt

SEQ ID NO: 5992002 - DNA, 17 bp, Homo sapiens
cagaagcccattaaaat

SEQ ID NO: 5992003 - DNA, 11 bp, Homo sapiens
cagaagcccca

SEQ ID NO: 5992004 - DNA, 20 bp, Homo sapiens
cagaagccccaactgtgatc

SEQ ID NO: 5992005 - DNA, 10 bp, Homo sapiens
cagaagcctc

SEQ ID NO: 5992006 - DNA, 20 bp, Homo sapiens
cagaagcctcactgcaagca

SEQ ID NO: 5992007 - DNA, 16 bp, Homo sapiens
cagaagcctccaagca

SEQ ID NO: 5992008 - DNA, 21 bp, Homo sapiens
cagaagcctccaagcacagag

SEQ ID NO: 5992009 - DNA, 18 bp, Homo sapiens
cagaagcctccccagctc

SEQ ID NO: 5992010 - DNA, 15 bp, Homo sapiens
cagaagcctcctgtt

SEQ ID NO: 5992011 - DNA, 13 bp, Homo sapiens
cagaagcctctgg

SEQ ID NO: 5992012 - DNA, 15 bp, Homo sapiens
cagaagcctctggct

SEQ ID NO: 5992013 - DNA, 16 bp, Homo sapiens
cagaagcctctgggtc

SEQ ID NO: 5992014 - DNA, 12 bp, Homo sapiens
cagaagcctggg

SEQ ID NO: 5992015 - DNA, 14 bp, Homo sapiens
cagaagcctggggg

SEQ ID NO: 5992016 - DNA, 22 bp, Homo sapiens
cagaagcctgggggcctggctg

SEQ ID NO: 5992017 - DNA, 21 bp, Homo sapiens
cagaagccttggaaccagccc

SEQ ID NO: 5992018 - DNA, 14 bp, Homo sapiens
cagaagctattttt

SEQ ID NO: 5992019 - DNA, 18 bp, Homo sapiens
cagaagctcaaggctgca

SEQ ID NO: 5992020 - DNA, 16 bp, Homo sapiens
cagaagctcccccagc

SEQ ID NO: 5992021 - DNA, 23 bp, Homo sapiens
cagaagctcccccagcaaagccc

SEQ ID NO: 5992022 - DNA, 19 bp, Homo sapiens
cagaagctgagcaccaggg

SEQ ID NO: 5992023 - DNA, 11 bp, Homo sapiens
cagaagctgat

SEQ ID NO: 5992024 - DNA, 21 bp, Homo sapiens
cagaagctgcagctggtctgt

SEQ ID NO: 5992025 - DNA, 12 bp, Homo sapiens
cagaagctgctc

SEQ ID NO: 5992026 - DNA, 16 bp, Homo sapiens
cagaagctgctccttt

SEQ ID NO: 5992027 - DNA, 14 bp, Homo sapiens
cagaagctgggaac

SEQ ID NO: 5992028 - DNA, 16 bp, Homo sapiens
cagaagctgtactttt

SEQ ID NO: 5992029 - DNA, 19 bp, Homo sapiens
cagaagctgttgggagaaa

SEQ ID NO: 5992030 - DNA, 14 bp, Homo sapiens
cagaagcttcagaa

SEQ ID NO: 5992031 - DNA, 22 bp, Homo sapiens
cagaagcttggcatgacctcat

SEQ ID NO: 5992032 - DNA, 16 bp, Homo sapiens
cagaaggaaaccgaaa

SEQ ID NO: 5992033 - DNA, 14 bp, Homo sapiens
cagaaggaaagaag

SEQ ID NO: 5992034 - DNA, 23 bp, Homo sapiens
cagaaggaaagaagggggccctg

SEQ ID NO: 5992035 - DNA, 15 bp, Homo sapiens
cagaaggaaatgatg

SEQ ID NO: 5992036 - DNA, 15 bp, Homo sapiens
cagaaggaacccggt

SEQ ID NO: 5992037 - DNA, 20 bp, Homo sapiens
cagaaggaacccggtcccag

SEQ ID NO: 5992038 - DNA, 12 bp, Homo sapiens
cagaaggaagct

SEQ ID NO: 5992039 - DNA, 22 bp, Homo sapiens
cagaaggaaggagccagctccc

SEQ ID NO: 5992040 - DNA, 15 bp, Homo sapiens
cagaaggaaggagga

SEQ ID NO: 5992041 - DNA, 13 bp, Homo sapiens
cagaaggaaggat

SEQ ID NO: 5992042 - DNA, 22 bp, Homo sapiens
cagaaggaaggcagggaggagg

SEQ ID NO: 5992043 - DNA, 18 bp, Homo sapiens
cagaaggaatctgtgcag

SEQ ID NO: 5992044 - DNA, 17 bp, Homo sapiens
cagaaggaatcttctca

SEQ ID NO: 5992045 - DNA, 14 bp, Homo sapiens
cagaaggacctcct

SEQ ID NO: 5992046 - DNA, 23 bp, Homo sapiens
cagaaggagaaggaaaaagaaag

SEQ ID NO: 5992047 - DNA, 14 bp, Homo sapiens
cagaaggagacaga

SEQ ID NO: 5992048 - DNA, 15 bp, Homo sapiens
cagaaggagacagaa

SEQ ID NO: 5992049 - DNA, 17 bp, Homo sapiens
cagaaggagacaggcag

SEQ ID NO: 5992050 - DNA, 22 bp, Homo sapiens
cagaaggagacaggcagagctg

SEQ ID NO: 5992051 - DNA, 14 bp, Homo sapiens
cagaaggagagtga

SEQ ID NO: 5992052 - DNA, 16 bp, Homo sapiens
cagaaggagcaggccc

SEQ ID NO: 5992053 - DNA, 19 bp, Homo sapiens
cagaaggagcaggccctgg

SEQ ID NO: 5992054 - DNA, 20 bp, Homo sapiens
cagaaggaggaagggactgg

SEQ ID NO: 5992055 - DNA, 14 bp, Homo sapiens
cagaaggaggggga

SEQ ID NO: 5992056 - DNA, 17 bp, Homo sapiens
cagaaggcaaggccctg

SEQ ID NO: 5992057 - DNA, 19 bp, Homo sapiens
cagaaggcaaggccctgcc

SEQ ID NO: 5992058 - DNA, 20 bp, Homo sapiens
cagaaggcaggaccatgagg

SEQ ID NO: 5992059 - DNA, 15 bp, Homo sapiens
cagaaggccacaggc

SEQ ID NO: 5992060 - DNA, 11 bp, Homo sapiens
cagaaggccag

SEQ ID NO: 5992061 - DNA, 20 bp, Homo sapiens
cagaaggccagaaaaggcag

SEQ ID NO: 5992062 - DNA, 23 bp, Homo sapiens
cagaaggccaggagtaagcccaa

SEQ ID NO: 5992063 - DNA, 12 bp, Homo sapiens
cagaaggcccca

SEQ ID NO: 5992064 - DNA, 12 bp, Homo sapiens
cagaaggccctt

SEQ ID NO: 5992065 - DNA, 14 bp, Homo sapiens
cagaaggcctcact

SEQ ID NO: 5992066 - DNA, 17 bp, Homo sapiens
cagaaggccttgaagaa

SEQ ID NO: 5992067 - DNA, 18 bp, Homo sapiens
cagaaggccttgccttgt

SEQ ID NO: 5992068 - DNA, 15 bp, Homo sapiens
cagaaggctcctgcc

SEQ ID NO: 5992069 - DNA, 16 bp, Homo sapiens
cagaaggctcctgccc

SEQ ID NO: 5992070 - DNA, 19 bp, Homo sapiens
cagaaggctcctgccccca

SEQ ID NO: 5992071 - DNA, 12 bp, Homo sapiens
cagaaggctctt

SEQ ID NO: 5992072 - DNA, 17 bp, Homo sapiens
cagaaggctcttctgac

SEQ ID NO: 5992073 - DNA, 11 bp, Homo sapiens
cagaaggctgg

SEQ ID NO: 5992074 - DNA, 16 bp, Homo sapiens
cagaaggcttttttaa

SEQ ID NO: 5992075 - DNA, 19 bp, Homo sapiens
cagaagggaaatttcaata

SEQ ID NO: 5992076 - DNA, 15 bp, Homo sapiens
cagaagggaattgct

SEQ ID NO: 5992077 - DNA, 18 bp, Homo sapiens
cagaagggaattgctcag

SEQ ID NO: 5992078 - DNA, 10 bp, Homo sapiens
cagaagggag

SEQ ID NO: 5992079 - DNA, 12 bp, Homo sapiens
cagaagggagca

SEQ ID NO: 5992080 - DNA, 21 bp, Homo sapiens
cagaagggagctagccagagg

SEQ ID NO: 5992081 - DNA, 21 bp, Homo sapiens
cagaagggagctggctccagc

SEQ ID NO: 5992082 - DNA, 12 bp, Homo sapiens
cagaagggaggc

SEQ ID NO: 5992083 - DNA, 15 bp, Homo sapiens
cagaagggaggctgg

SEQ ID NO: 5992084 - DNA, 21 bp, Homo sapiens
cagaagggagggcagagctgg

SEQ ID NO: 5992085 - DNA, 23 bp, Homo sapiens
cagaagggagggcagagctggtg

SEQ ID NO: 5992086 - DNA, 21 bp, Homo sapiens
cagaagggagttgctcactca

SEQ ID NO: 5992087 - DNA, 12 bp, Homo sapiens
cagaagggcttc

SEQ ID NO: 5992088 - DNA, 15 bp, Homo sapiens
cagaaggggactgcc

SEQ ID NO: 5992089 - DNA, 22 bp, Homo sapiens
cagaaggggactgccacctccc

SEQ ID NO: 5992090 - DNA, 17 bp, Homo sapiens
cagaaggggatgggaaa

SEQ ID NO: 5992091 - DNA, 18 bp, Homo sapiens
cagaaggggatgggaaat

SEQ ID NO: 5992092 - DNA, 21 bp, Homo sapiens
cagaaggggcacgcctgccca

SEQ ID NO: 5992093 - DNA, 15 bp, Homo sapiens
cagaagggggccatg

SEQ ID NO: 5992094 - DNA, 18 bp, Homo sapiens
cagaagggggccatgagg

SEQ ID NO: 5992095 - DNA, 22 bp, Homo sapiens
cagaaggggtttggtctgggac

SEQ ID NO: 5992096 - DNA, 22 bp, Homo sapiens
cagaaggtatacctgggaagat

SEQ ID NO: 5992097 - DNA, 16 bp, Homo sapiens
cagaaggtatcagtta

SEQ ID NO: 5992098 - DNA, 17 bp, Homo sapiens
cagaaggtatttttgaa

SEQ ID NO: 5992099 - DNA, 20 bp, Homo sapiens
cagaaggtattttttaactc

SEQ ID NO: 5992100 - DNA, 20 bp, Homo sapiens
cagaaggtgaactttgtgct

SEQ ID NO: 5992101 - DNA, 23 bp, Homo sapiens
cagaaggttggtggggggtccag

SEQ ID NO: 5992102 - DNA, 16 bp, Homo sapiens
cagaagtaactcccac

SEQ ID NO: 5992103 - DNA, 20 bp, Homo sapiens
cagaagtaactcccactcct

SEQ ID NO: 5992104 - DNA, 16 bp, Homo sapiens
cagaagtaacttattt

SEQ ID NO: 5992105 - DNA, 19 bp, Homo sapiens
cagaagtaacttattttgt

SEQ ID NO: 5992106 - DNA, 13 bp, Homo sapiens
cagaagtaagcct

SEQ ID NO: 5992107 - DNA, 15 bp, Homo sapiens
cagaagtaccagact

SEQ ID NO: 5992108 - DNA, 17 bp, Homo sapiens
cagaagtactggcatca

SEQ ID NO: 5992109 - DNA, 16 bp, Homo sapiens
cagaagtagctttgca

SEQ ID NO: 5992110 - DNA, 15 bp, Homo sapiens
cagaagtaggaagga

SEQ ID NO: 5992111 - DNA, 17 bp, Homo sapiens
cagaagtatcaagccat

SEQ ID NO: 5992112 - DNA, 17 bp, Homo sapiens
cagaagtattgtttaca

SEQ ID NO: 5992113 - DNA, 20 bp, Homo sapiens
cagaagtcacacattacaaa

SEQ ID NO: 5992114 - DNA, 22 bp, Homo sapiens
cagaagtcactcaattgttttt

SEQ ID NO: 5992115 - DNA, 22 bp, Homo sapiens
cagaagtcagcccgaatgcctg

SEQ ID NO: 5992116 - DNA, 16 bp, Homo sapiens
cagaagtcatcttgct

SEQ ID NO: 5992117 - DNA, 17 bp, Homo sapiens
cagaagtcatcttgcta

SEQ ID NO: 5992118 - DNA, 20 bp, Homo sapiens
cagaagtcatcttgctacca

SEQ ID NO: 5992119 - DNA, 18 bp, Homo sapiens
cagaagtcatgaagccca

SEQ ID NO: 5992120 - DNA, 19 bp, Homo sapiens
cagaagtcatgaagcccaa

SEQ ID NO: 5992121 - DNA, 15 bp, Homo sapiens
cagaagtccacagga

SEQ ID NO: 5992122 - DNA, 21 bp, Homo sapiens
cagaagtccctaggagggaag

SEQ ID NO: 5992123 - DNA, 23 bp, Homo sapiens
cagaagtcctccctcctgcaggc

SEQ ID NO: 5992124 - DNA, 22 bp, Homo sapiens
cagaagtctagttttataggca

SEQ ID NO: 5992125 - DNA, 17 bp, Homo sapiens
cagaagtctttcagcaa

SEQ ID NO: 5992126 - DNA, 13 bp, Homo sapiens
cagaagtgaaaat

SEQ ID NO: 5992127 - DNA, 13 bp, Homo sapiens
cagaagtgactga

SEQ ID NO: 5992128 - DNA, 21 bp, Homo sapiens
cagaagtgagcccccccctta

SEQ ID NO: 5992129 - DNA, 15 bp, Homo sapiens
cagaagtgaggatga

SEQ ID NO: 5992130 - DNA, 14 bp, Homo sapiens
cagaagtgctcttt

SEQ ID NO: 5992131 - DNA, 14 bp, Homo sapiens
cagaagtggagctg

SEQ ID NO: 5992132 - DNA, 15 bp, Homo sapiens
cagaagtggagctgg

SEQ ID NO: 5992133 - DNA, 13 bp, Homo sapiens
cagaagtggcagg

SEQ ID NO: 5992134 - DNA, 21 bp, Homo sapiens
cagaagtggcaggaggacagg

SEQ ID NO: 5992135 - DNA, 19 bp, Homo sapiens
cagaagtggggctctggga

SEQ ID NO: 5992136 - DNA, 16 bp, Homo sapiens
cagaagtgtcaccctg

SEQ ID NO: 5992137 - DNA, 11 bp, Homo sapiens
cagaagtgtga

SEQ ID NO: 5992138 - DNA, 19 bp, Homo sapiens
cagaagtgtttcagatttt

SEQ ID NO: 5992139 - DNA, 17 bp, Homo sapiens
cagaagttgggggaaag

SEQ ID NO: 5992140 - DNA, 16 bp, Homo sapiens
cagaagttgtgaaact

SEQ ID NO: 5992141 - DNA, 21 bp, Homo sapiens
cagaagttgtggatttcagtt

SEQ ID NO: 5992142 - DNA, 17 bp, Homo sapiens
cagaagttgttagtgat

SEQ ID NO: 5992143 - DNA, 22 bp, Homo sapiens
cagaagtttaaatattaagcat

SEQ ID NO: 5992144 - DNA, 15 bp, Homo sapiens
cagaagtttctcagc

SEQ ID NO: 5992145 - DNA, 20 bp, Homo sapiens
cagaagtttctgccgcagcc

SEQ ID NO: 5992146 - DNA, 13 bp, Homo sapiens
cagaagtttgcat

SEQ ID NO: 5992147 - DNA, 16 bp, Homo sapiens
cagaagtttgcttctt

SEQ ID NO: 5992148 - DNA, 19 bp, Homo sapiens
cagaagtttgtcaagtcaa

SEQ ID NO: 5992149 - DNA, 23 bp, Homo sapiens
cagaataaaagttcctctccctt

SEQ ID NO: 5992150 - DNA, 20 bp, Homo sapiens
cagaataaaccggatcctgt

SEQ ID NO: 5992151 - DNA, 14 bp, Homo sapiens
cagaataaagaaca

SEQ ID NO: 5992152 - DNA, 15 bp, Homo sapiens
cagaataaagaacat

SEQ ID NO: 5992153 - DNA, 14 bp, Homo sapiens
cagaataaagcaat

SEQ ID NO: 5992154 - DNA, 17 bp, Homo sapiens
cagaataaagcaatttt

SEQ ID NO: 5992155 - DNA, 16 bp, Homo sapiens
cagaataaagcagcct

SEQ ID NO: 5992156 - DNA, 18 bp, Homo sapiens
cagaataaagcagcctga

SEQ ID NO: 5992157 - DNA, 22 bp, Homo sapiens
cagaataaagttctgagtgttt

SEQ ID NO: 5992158 - DNA, 16 bp, Homo sapiens
cagaataaatgtttta

SEQ ID NO: 5992159 - DNA, 19 bp, Homo sapiens
cagaataaatgttttacaa

SEQ ID NO: 5992160 - DNA, 20 bp, Homo sapiens
cagaataaatgttttacaac

SEQ ID NO: 5992161 - DNA, 19 bp, Homo sapiens
cagaataaattgatccttt

SEQ ID NO: 5992162 - DNA, 19 bp, Homo sapiens
cagaataactacctcctca

SEQ ID NO: 5992163 - DNA, 21 bp, Homo sapiens
cagaataactacctcctcact

SEQ ID NO: 5992164 - DNA, 20 bp, Homo sapiens
cagaataaggcaggcattga

SEQ ID NO: 5992165 - DNA, 13 bp, Homo sapiens
cagaataagtgct

SEQ ID NO: 5992166 - DNA, 16 bp, Homo sapiens
cagaataagtgctgtt

SEQ ID NO: 5992167 - DNA, 17 bp, Homo sapiens
cagaataagtgctgttt

SEQ ID NO: 5992168 - DNA, 20 bp, Homo sapiens
cagaataatcaaatacattt

SEQ ID NO: 5992169 - DNA, 14 bp, Homo sapiens
cagaataatcctgt

SEQ ID NO: 5992170 - DNA, 16 bp, Homo sapiens
cagaataatcctgttt

SEQ ID NO: 5992171 - DNA, 12 bp, Homo sapiens
caatttgtcttt

SEQ ID NO: 5992172 - DNA, 22 bp, Homo sapiens
caatttgttcatcctattgttg

SEQ ID NO: 5992173 - DNA, 17 bp, Homo sapiens
caatttgtttaaagaat

SEQ ID NO: 5992174 - DNA, 18 bp, Homo sapiens
caatttgtttaaagaata

SEQ ID NO: 5992175 - DNA, 16 bp, Homo sapiens
caatttgtttttgcat

SEQ ID NO: 5992176 - DNA, 14 bp, Homo sapiens
caattttaaaaaat

SEQ ID NO: 5992177 - DNA, 16 bp, Homo sapiens
caattttaaaaaataa

SEQ ID NO: 5992178 - DNA, 18 bp, Homo sapiens
caattttaaaaaataaca

SEQ ID NO: 5992179 - DNA, 20 bp, Homo sapiens
caattttaaaatgaaatgca

SEQ ID NO: 5992180 - DNA, 24 bp, Homo sapiens
caattttaaaatgaaatgcatttt

SEQ ID NO: 5992181 - DNA, 13 bp, Homo sapiens
caattttaaacat

SEQ ID NO: 5992182 - DNA, 13 bp, Homo sapiens
caattttaaagac

SEQ ID NO: 5992183 - DNA, 12 bp, Homo sapiens
caattttaaagt

SEQ ID NO: 5992184 - DNA, 21 bp, Homo sapiens
caattttaaagttcttatttt

SEQ ID NO: 5992185 - DNA, 22 bp, Homo sapiens
caattttaaggcatatttaaca

SEQ ID NO: 5992186 - DNA, 13 bp, Homo sapiens
caattttaatgat

SEQ ID NO: 5992187 - DNA, 23 bp, Homo sapiens
caattttaatgatggtgttaaag

SEQ ID NO: 5992188 - DNA, 18 bp, Homo sapiens
caattttaatttagtaaa

SEQ ID NO: 5992189 - DNA, 22 bp, Homo sapiens
caattttaatttagtaaatgtt

SEQ ID NO: 5992190 - DNA, 19 bp, Homo sapiens
caattttacctattctgaa

SEQ ID NO: 5992191 - DNA, 14 bp, Homo sapiens
caattttactgtga

SEQ ID NO: 5992192 - DNA, 15 bp, Homo sapiens
caattttactgtgaa

SEQ ID NO: 5992193 - DNA, 17 bp, Homo sapiens
caattttagtcttgctg

SEQ ID NO: 5992194 - DNA, 23 bp, Homo sapiens
caattttagtcttgctgtttctt

SEQ ID NO: 5992195 - DNA, 22 bp, Homo sapiens
caattttataaggacttcctga

SEQ ID NO: 5992196 - DNA, 21 bp, Homo sapiens
caattttatccctcacctgta

SEQ ID NO: 5992197 - DNA, 14 bp, Homo sapiens
caattttcactgtg

SEQ ID NO: 5992198 - DNA, 16 bp, Homo sapiens
caattttcagatttgc

SEQ ID NO: 5992199 - DNA, 21 bp, Homo sapiens
caattttccttcagatatttt

SEQ ID NO: 5992200 - DNA, 13 bp, Homo sapiens
caattttccttga

SEQ ID NO: 5992201 - DNA, 20 bp, Homo sapiens
caattttctatttaaaaaat

SEQ ID NO: 5992202 - DNA, 14 bp, Homo sapiens
caattttctgtaag

SEQ ID NO: 5992203 - DNA, 19 bp, Homo sapiens
caattttctgtaatctttt

SEQ ID NO: 5992204 - DNA, 13 bp, Homo sapiens
caattttgatctt

SEQ ID NO: 5992205 - DNA, 11 bp, Homo sapiens
caattttgtcc

SEQ ID NO: 5992206 - DNA, 17 bp, Homo sapiens
caattttgtcttaagtg

SEQ ID NO: 5992207 - DNA, 22 bp, Homo sapiens
caattttgtcttaagtgtttct

SEQ ID NO: 5992208 - DNA, 23 bp, Homo sapiens
caattttgtcttaagtgtttctc

SEQ ID NO: 5992209 - DNA, 13 bp, Homo sapiens
caattttgtttct

SEQ ID NO: 5992210 - DNA, 13 bp, Homo sapiens
caatttttaaact

SEQ ID NO: 5992211 - DNA, 12 bp, Homo sapiens
caatttttaatg

SEQ ID NO: 5992212 - DNA, 22 bp, Homo sapiens
caatttttacacaaacctgaaa

SEQ ID NO: 5992213 - DNA, 13 bp, Homo sapiens
caatttttactca

SEQ ID NO: 5992214 - DNA, 16 bp, Homo sapiens
caatttttatacatat

SEQ ID NO: 5992215 - DNA, 18 bp, Homo sapiens
caatttttatacatatca

SEQ ID NO: 5992216 - DNA, 20 bp, Homo sapiens
caatttttatacatatcaga

SEQ ID NO: 5992217 - DNA, 19 bp, Homo sapiens
caatttttcccagtatttt

SEQ ID NO: 5992218 - DNA, 18 bp, Homo sapiens
caatttttctgcactgag

SEQ ID NO: 5992219 - DNA, 10 bp, Homo sapiens
caatttttga

SEQ ID NO: 5992220 - DNA, 15 bp, Homo sapiens
caatttttgccttca

SEQ ID NO: 5992221 - DNA, 18 bp, Homo sapiens
caatttttggttgaataa

SEQ ID NO: 5992222 - DNA, 18 bp, Homo sapiens
caatttttgtacttttag

SEQ ID NO: 5992223 - DNA, 16 bp, Homo sapiens
caatttttgtctcaga

SEQ ID NO: 5992224 - DNA, 13 bp, Homo sapiens
caattttttcaaa

SEQ ID NO: 5992225 - DNA, 18 bp, Homo sapiens
caattttttgttcttcag

SEQ ID NO: 5992226 - DNA, 15 bp, Homo sapiens
caattttttttaatt

SEQ ID NO: 5992227 - DNA, 16 bp, Homo sapiens
caattttttttcaaat

SEQ ID NO: 5992228 - DNA, 18 bp, Homo sapiens
caattttttttcaaatgt

SEQ ID NO: 5992229 - DNA, 18 bp, Homo sapiens
caattttttttccgtaaa

SEQ ID NO: 5992230 - DNA, 21 bp, Homo sapiens
caattttttttccgtaaatgt

SEQ ID NO: 5992231 - DNA, 22 bp, Homo sapiens
caattttttttctgaacaaaag

SEQ ID NO: 5992232 - DNA, 23 bp, Homo sapiens
caattttttttctgaacaaaagc

SEQ ID NO: 5992233 - DNA, 21 bp, Homo sapiens
caattttttttttcctcttca

SEQ ID NO: 5992234 - DNA, 22 bp, Homo sapiens
cacaaaaaaagttgaaggcctt

SEQ ID NO: 5992235 - DNA, 12 bp, Homo sapiens
cacaaaaaagaa

SEQ ID NO: 5992236 - DNA, 13 bp, Homo sapiens
cacaaaaaagaag

SEQ ID NO: 5992237 - DNA, 22 bp, Homo sapiens
cacaaaaagaaagctgtgaaat

SEQ ID NO: 5992238 - DNA, 22 bp, Homo sapiens
cacaaaaaggagcgggcagggc

SEQ ID NO: 5992239 - DNA, 20 bp, Homo sapiens
cacaaaaaggcaaatattga

SEQ ID NO: 5992240 - DNA, 12 bp, Homo sapiens
cacaaaaatgaa

SEQ ID NO: 5992241 - DNA, 15 bp, Homo sapiens
cacaaaaatgttcac

SEQ ID NO: 5992242 - DNA, 14 bp, Homo sapiens
cacaaaaatgttga

SEQ ID NO: 5992243 - DNA, 16 bp, Homo sapiens
cacaaaacaacagcaa

SEQ ID NO: 5992244 - DNA, 13 bp, Homo sapiens
cacaaaacagcct

SEQ ID NO: 5992245 - DNA, 18 bp, Homo sapiens
cacaaaacattcatgtaa

SEQ ID NO: 5992246 - DNA, 21 bp, Homo sapiens
cacaaaacattcatgtaactc

SEQ ID NO: 5992247 - DNA, 21 bp, Homo sapiens
cacaaaacctgtattactgaa

SEQ ID NO: 5992248 - DNA, 23 bp, Homo sapiens
cacaaaactccgcccccagccta

SEQ ID NO: 5992249 - DNA, 12 bp, Homo sapiens
cacaaaactttg

SEQ ID NO: 5992250 - DNA, 22 bp, Homo sapiens
cacaaaagaagaaataaataat

SEQ ID NO: 5992251 - DNA, 17 bp, Homo sapiens
cacaaaagacaagcatt

SEQ ID NO: 5992252 - DNA, 18 bp, Homo sapiens
cacaaaagctgtgtctct

SEQ ID NO: 5992253 - DNA, 22 bp, Homo sapiens
cacaaaaggctggatgtgcttt

SEQ ID NO: 5992254 - DNA, 18 bp, Homo sapiens
cacaaaaggttcttctgg

SEQ ID NO: 5992255 - DNA, 11 bp, Homo sapiens
cacaaaagttg

SEQ ID NO: 5992256 - DNA, 21 bp, Homo sapiens
cacaaaatccatgggcagtat

SEQ ID NO: 5992257 - DNA, 15 bp, Homo sapiens
cacaaaatctgtcca

SEQ ID NO: 5992258 - DNA, 17 bp, Homo sapiens
cacaaaatgataatcaa

SEQ ID NO: 5992259 - DNA, 16 bp, Homo sapiens
cacaaaatgtcacaat

SEQ ID NO: 5992260 - DNA, 21 bp, Homo sapiens
cacaaaattagaaaggacaac

SEQ ID NO: 5992261 - DNA, 20 bp, Homo sapiens
cacaaaattcgacctgattt

SEQ ID NO: 5992262 - DNA, 16 bp, Homo sapiens
cacaaaattgggaaag

SEQ ID NO: 5992263 - DNA, 18 bp, Homo sapiens
cacaaacaaacaagctag

SEQ ID NO: 5992264 - DNA, 12 bp, Homo sapiens
cacaaacacaca

SEQ ID NO: 5992265 - DNA, 14 bp, Homo sapiens
cacaaacacacaca

SEQ ID NO: 5992266 - DNA, 21 bp, Homo sapiens
cacaaacacattgttattttc

SEQ ID NO: 5992267 - DNA, 23 bp, Homo sapiens
cacaaacacattgttattttcag

SEQ ID NO: 5992268 - DNA, 14 bp, Homo sapiens
cacaaacagaggcc

SEQ ID NO: 5992269 - DNA, 13 bp, Homo sapiens
cacaaacatagac

SEQ ID NO: 5992270 - DNA, 19 bp, Homo sapiens
cacaaacatatgtatcttt

SEQ ID NO: 5992271 - DNA, 15 bp, Homo sapiens
cacaaacattgctgc

SEQ ID NO: 5992272 - DNA, 13 bp, Homo sapiens
cacaaacattttt

SEQ ID NO: 5992273 - DNA, 20 bp, Homo sapiens
cacaaaccacaactgacaca

SEQ ID NO: 5992274 - DNA, 15 bp, Homo sapiens
cacaaaccagcctgg

SEQ ID NO: 5992275 - DNA, 13 bp, Homo sapiens
cacaaaccctgct

SEQ ID NO: 5992276 - DNA, 14 bp, Homo sapiens
cacaaaccctgggg

SEQ ID NO: 5992277 - DNA, 18 bp, Homo sapiens
cacaaacctactgcccac

SEQ ID NO: 5992278 - DNA, 13 bp, Homo sapiens
cacaaacctgcct

SEQ ID NO: 5992279 - DNA, 14 bp, Homo sapiens
cacaaacggagccc

SEQ ID NO: 5992280 - DNA, 20 bp, Homo sapiens
cacaaactatggtgtgctta

SEQ ID NO: 5992281 - DNA, 13 bp, Homo sapiens
cacaaactcacca

SEQ ID NO: 5992282 - DNA, 13 bp, Homo sapiens
cacaaactccagg

SEQ ID NO: 5992283 - DNA, 14 bp, Homo sapiens
cacaaactccaggc

SEQ ID NO: 5992284 - DNA, 16 bp, Homo sapiens
cacaaactccaggctg

SEQ ID NO: 5992285 - DNA, 17 bp, Homo sapiens
cacaaactccaggctgg

SEQ ID NO: 5992286 - DNA, 14 bp, Homo sapiens
cacaaactgtaaat

SEQ ID NO: 5992287 - DNA, 17 bp, Homo sapiens
cacaaactgtgaaaata

SEQ ID NO: 5992288 - DNA, 21 bp, Homo sapiens
cacaaactgtgaaaatagtgt

SEQ ID NO: 5992289 - DNA, 23 bp, Homo sapiens
cacaaactttcaagtattatatt

SEQ ID NO: 5992290 - DNA, 19 bp, Homo sapiens
cacaaagaacttgctgctg

SEQ ID NO: 5992291 - DNA, 13 bp, Homo sapiens
cacaaagaagaaa

SEQ ID NO: 5992292 - DNA, 15 bp, Homo sapiens
cacaaagacatggaa

SEQ ID NO: 5992293 - DNA, 19 bp, Homo sapiens
cacaaagaccaaaatgaaa

SEQ ID NO: 5992294 - DNA, 20 bp, Homo sapiens
cacaaagaccctggctttca

SEQ ID NO: 5992295 - DNA, 20 bp, Homo sapiens
cacaaagagaaaaagaaatg

SEQ ID NO: 5992296 - DNA, 13 bp, Homo sapiens
cacaaagagacca

SEQ ID NO: 5992297 - DNA, 17 bp, Homo sapiens
cacaaagagaccagggg

SEQ ID NO: 5992298 - DNA, 14 bp, Homo sapiens
cacaaagcaaaggc

SEQ ID NO: 5992299 - DNA, 15 bp, Homo sapiens
cacaaagcaaaggca

SEQ ID NO: 5992300 - DNA, 17 bp, Homo sapiens
cacaaagcaaaggcagt

SEQ ID NO: 5992301 - DNA, 22 bp, Homo sapiens
cacaaagcacagtttgaacaaa

SEQ ID NO: 5992302 - DNA, 18 bp, Homo sapiens
cacaaagcccttccatgt

SEQ ID NO: 5992303 - DNA, 13 bp, Homo sapiens
cacaaagccttat

SEQ ID NO: 5992304 - DNA, 20 bp, Homo sapiens
cacaaagccttatcaagtgt

SEQ ID NO: 5992305 - DNA, 18 bp, Homo sapiens
cacaaagctatttaagtg

SEQ ID NO: 5992306 - DNA, 22 bp, Homo sapiens
cacaaagctatttaagtggact

SEQ ID NO: 5992307 - DNA, 18 bp, Homo sapiens
cacaaagctcaagatgac

SEQ ID NO: 5992308 - DNA, 13 bp, Homo sapiens
cacaaagcttcta

SEQ ID NO: 5992309 - DNA, 19 bp, Homo sapiens
cacaaagctttcttttcta

SEQ ID NO: 5992310 - DNA, 18 bp, Homo sapiens
cacaaaggacctcagctg

SEQ ID NO: 5992311 - DNA, 20 bp, Homo sapiens
cacaaaggatttgatgcttt

SEQ ID NO: 5992312 - DNA, 21 bp, Homo sapiens
cacaaaggatttgatgctttt

SEQ ID NO: 5992313 - DNA, 19 bp, Homo sapiens
cacaaaggcatgctggagt

SEQ ID NO: 5992314 - DNA, 17 bp, Homo sapiens
cacaaaggccaaactgc

SEQ ID NO: 5992315 - DNA, 18 bp, Homo sapiens
cacaaaggccaaactgct

SEQ ID NO: 5992316 - DNA, 19 bp, Homo sapiens
cacaaaggctgacattcac

SEQ ID NO: 5992317 - DNA, 20 bp, Homo sapiens
cacaaagggacacacagtga

SEQ ID NO: 5992318 - DNA, 14 bp, Homo sapiens
cacaaagggcaggc

SEQ ID NO: 5992319 - DNA, 16 bp, Homo sapiens
cacaaaggtataattt

SEQ ID NO: 5992320 - DNA, 17 bp, Homo sapiens
cacaaaggtcacaggca

SEQ ID NO: 5992321 - DNA, 17 bp, Homo sapiens
cacaaagtcagcaggga

SEQ ID NO: 5992322 - DNA, 16 bp, Homo sapiens
cacaaagttctcagag

SEQ ID NO: 5992323 - DNA, 17 bp, Homo sapiens
cacaaagttctcagagc

SEQ ID NO: 5992324 - DNA, 21 bp, Homo sapiens
cacaaataacagctttcttat

SEQ ID NO: 5992325 - DNA, 22 bp, Homo sapiens
cacaaataacagctttcttatt

SEQ ID NO: 5992326 - DNA, 12 bp, Homo sapiens
cacaaatacatt

SEQ ID NO: 5992327 - DNA, 21 bp, Homo sapiens
cacaaatagttatcttttaat

SEQ ID NO: 5992328 - DNA, 17 bp, Homo sapiens
cacaaatattaaaaagt

SEQ ID NO: 5992329 - DNA, 20 bp, Homo sapiens
cacaaatattaaaaagtctt

SEQ ID NO: 5992330 - DNA, 14 bp, Homo sapiens
cacaaatattattt

SEQ ID NO: 5992331 - DNA, 21 bp, Homo sapiens
cacaaatatttattttctttc

SEQ ID NO: 5992332 - DNA, 20 bp, Homo sapiens
cacaaatctatattaaagtg

SEQ ID NO: 5992333 - DNA, 21 bp, Homo sapiens
cacaaatctatattaaagtgt

SEQ ID NO: 5992334 - DNA, 23 bp, Homo sapiens
cacaaatctatattaaagtgtta

SEQ ID NO: 5992335 - DNA, 15 bp, Homo sapiens
cacaaatgactttat

SEQ ID NO: 5992336 - DNA, 14 bp, Homo sapiens
cacaaatgatgttt

SEQ ID NO: 5992337 - DNA, 17 bp, Homo sapiens
cacaaatgcagacacac

SEQ ID NO: 5992338 - DNA, 17 bp, Homo sapiens
cacaaatgcagtatata

SEQ ID NO: 5992339 - DNA, 17 bp, Homo sapiens
cacaaatgtcctcagag

SEQ ID NO: 5992340 - DNA, 14 bp, Homo sapiens
cacaaatgtggagt

SEQ ID NO: 5992341 - DNA, 13 bp, Homo sapiens
cacaaattagtta

SEQ ID NO: 5992342 - DNA, 17 bp, Homo sapiens
cacaaattattaatgaa

SEQ ID NO: 5992343 - DNA, 17 bp, Homo sapiens
cacaaattgaagcatgt

SEQ ID NO: 5992344 - DNA, 11 bp, Homo sapiens
cacaacaaaag

SEQ ID NO: 5992345 - DNA, 19 bp, Homo sapiens
cacaacaaaaggaagactg

SEQ ID NO: 5992346 - DNA, 15 bp, Homo sapiens
cacaacacaagaaaa

SEQ ID NO: 5992347 - DNA, 16 bp, Homo sapiens
cacaacagaataaagc

SEQ ID NO: 5992348 - DNA, 17 bp, Homo sapiens
cacaacagaataaagca

SEQ ID NO: 5992349 - DNA, 23 bp, Homo sapiens
cacaacagaataaagcagcctga

SEQ ID NO: 5992350 - DNA, 17 bp, Homo sapiens
cagaataatctttgggt

SEQ ID NO: 5992351 - DNA, 14 bp, Homo sapiens
cagaataatgaatg

SEQ ID NO: 5992352 - DNA, 23 bp, Homo sapiens
cagaataatgaatggactcaaac

SEQ ID NO: 5992353 - DNA, 15 bp, Homo sapiens
cagaataatggaaac

SEQ ID NO: 5992354 - DNA, 14 bp, Homo sapiens
cagaatacacttaa

SEQ ID NO: 5992355 - DNA, 17 bp, Homo sapiens
cagaatacggaagagca

SEQ ID NO: 5992356 - DNA, 20 bp, Homo sapiens
cagaatactagccagagctc

SEQ ID NO: 5992357 - DNA, 12 bp, Homo sapiens
cagaatactggt

SEQ ID NO: 5992358 - DNA, 15 bp, Homo sapiens
cagaatactggtctc

SEQ ID NO: 5992359 - DNA, 22 bp, Homo sapiens
cagaatactgttaaaggaaaaa

SEQ ID NO: 5992360 - DNA, 16 bp, Homo sapiens
cagaatagaatacatt

SEQ ID NO: 5992361 - DNA, 21 bp, Homo sapiens
cagaatagccacatttggaat

SEQ ID NO: 5992362 - DNA, 22 bp, Homo sapiens
cagaatagctgttttgtgtata

SEQ ID NO: 5992363 - DNA, 18 bp, Homo sapiens
cagaatagcttatgccta

SEQ ID NO: 5992364 - DNA, 16 bp, Homo sapiens
cagaataggaaaacat

SEQ ID NO: 5992365 - DNA, 18 bp, Homo sapiens
cagaataggaaaacattg

SEQ ID NO: 5992366 - DNA, 13 bp, Homo sapiens
cagaataggaaga

SEQ ID NO: 5992367 - DNA, 18 bp, Homo sapiens
cagaataggaagatatgc

SEQ ID NO: 5992368 - DNA, 23 bp, Homo sapiens
cagaatagggtggcagaagtgtc

SEQ ID NO: 5992369 - DNA, 21 bp, Homo sapiens
cagaatagttattctctaaga

SEQ ID NO: 5992370 - DNA, 21 bp, Homo sapiens
cagaatagtttacacactgtg

SEQ ID NO: 5992371 - DNA, 22 bp, Homo sapiens
cagaatataaaaactcctgggc

SEQ ID NO: 5992372 - DNA, 15 bp, Homo sapiens
cagaatataacatgt

SEQ ID NO: 5992373 - DNA, 20 bp, Homo sapiens
cagaatataacatgtaaaat

SEQ ID NO: 5992374 - DNA, 19 bp, Homo sapiens
cagaatataggataagaaa

SEQ ID NO: 5992375 - DNA, 20 bp, Homo sapiens
cagaatatcaaggaaaactg

SEQ ID NO: 5992376 - DNA, 19 bp, Homo sapiens
cagaatatgttgctttgaa

SEQ ID NO: 5992377 - DNA, 20 bp, Homo sapiens
cagaatatgttgctttgaaa

SEQ ID NO: 5992378 - DNA, 18 bp, Homo sapiens
cagaatatgtttcaaact

SEQ ID NO: 5992379 - DNA, 13 bp, Homo sapiens
cagaatattaaat

SEQ ID NO: 5992380 - DNA, 17 bp, Homo sapiens
cagaatattaagcacat

SEQ ID NO: 5992381 - DNA, 19 bp, Homo sapiens
cagaatattaagcacatta

SEQ ID NO: 5992382 - DNA, 22 bp, Homo sapiens
cagaatattctgtaaacctaat

SEQ ID NO: 5992383 - DNA, 20 bp, Homo sapiens
cagaatattgacaagctagg

SEQ ID NO: 5992384 - DNA, 21 bp, Homo sapiens
cagaatatttatccttcacca

SEQ ID NO: 5992385 - DNA, 19 bp, Homo sapiens
cagaatatttctattgaat

SEQ ID NO: 5992386 - DNA, 13 bp, Homo sapiens
cagaatattttta

SEQ ID NO: 5992387 - DNA, 21 bp, Homo sapiens
cagaatcaaagcaatgcattt

SEQ ID NO: 5992388 - DNA, 23 bp, Homo sapiens
cagaatcaaagcaatgcattttg

SEQ ID NO: 5992389 - DNA, 14 bp, Homo sapiens
cagaatcataattt

SEQ ID NO: 5992390 - DNA, 21 bp, Homo sapiens
cagaatcatatgattctgctt

SEQ ID NO: 5992391 - DNA, 15 bp, Homo sapiens
cagaatcatggagaa

SEQ ID NO: 5992392 - DNA, 20 bp, Homo sapiens
cagaatcatggagaaaatgg

SEQ ID NO: 5992393 - DNA, 14 bp, Homo sapiens
cagaatccaaagat

SEQ ID NO: 5992394 - DNA, 19 bp, Homo sapiens
cagaatccataaatgtgtt

SEQ ID NO: 5992395 - DNA, 20 bp, Homo sapiens
cagaatccataaatgtgttc

SEQ ID NO: 5992396 - DNA, 21 bp, Homo sapiens
cagaatcccaaataaaaccca

SEQ ID NO: 5992397 - DNA, 14 bp, Homo sapiens
cagaatcccagccg

SEQ ID NO: 5992398 - DNA, 19 bp, Homo sapiens
cagaatccccaagtgcctg

SEQ ID NO: 5992399 - DNA, 17 bp, Homo sapiens
cagaatcccctggggag

SEQ ID NO: 5992400 - DNA, 13 bp, Homo sapiens
cagaatcccttaa

SEQ ID NO: 5992401 - DNA, 15 bp, Homo sapiens
cagaatcctggccct

SEQ ID NO: 5992402 - DNA, 21 bp, Homo sapiens
cagaatcctggccctctgtgt

SEQ ID NO: 5992403 - DNA, 21 bp, Homo sapiens
cagaatcctgggcccccagag

SEQ ID NO: 5992404 - DNA, 21 bp, Homo sapiens
cagaatccttggctgaattaa

SEQ ID NO: 5992405 - DNA, 23 bp, Homo sapiens
cagaatcgctccaccttgcagct

SEQ ID NO: 5992406 - DNA, 17 bp, Homo sapiens
cagaatctaaacgtggt

SEQ ID NO: 5992407 - DNA, 16 bp, Homo sapiens
cagaatctaaagccag

SEQ ID NO: 5992408 - DNA, 17 bp, Homo sapiens
cagaatctcattactgc

SEQ ID NO: 5992409 - DNA, 21 bp, Homo sapiens
cagaatctcattactgcttca

SEQ ID NO: 5992410 - DNA, 14 bp, Homo sapiens
cagaatctccatcc

SEQ ID NO: 5992411 - DNA, 15 bp, Homo sapiens
cagaatctctatgta

SEQ ID NO: 5992412 - DNA, 19 bp, Homo sapiens
cagaatctctatgtatatt

SEQ ID NO: 5992413 - DNA, 23 bp, Homo sapiens
cagaatctctctactcagatgac

SEQ ID NO: 5992414 - DNA, 16 bp, Homo sapiens
cagaatctctgaattt

SEQ ID NO: 5992415 - DNA, 21 bp, Homo sapiens
cagaatctctgcctagaatct

SEQ ID NO: 5992416 - DNA, 16 bp, Homo sapiens
cagaatctgaatgtaa

SEQ ID NO: 5992417 - DNA, 16 bp, Homo sapiens
cagaatctgctgttgc

SEQ ID NO: 5992418 - DNA, 17 bp, Homo sapiens
cagaatctgctgttgcc

SEQ ID NO: 5992419 - DNA, 18 bp, Homo sapiens
cagaatctgctgttgcca

SEQ ID NO: 5992420 - DNA, 22 bp, Homo sapiens
cagaatctgctgttgccatagc

SEQ ID NO: 5992421 - DNA, 23 bp, Homo sapiens
cagaatctgctgttgccatagcc

SEQ ID NO: 5992422 - DNA, 18 bp, Homo sapiens
cagaatctgtatgattct

SEQ ID NO: 5992423 - DNA, 19 bp, Homo sapiens
cagaatcttcgtcctgccc

SEQ ID NO: 5992424 - DNA, 21 bp, Homo sapiens
cagaatcttgactttctgatt

SEQ ID NO: 5992425 - DNA, 22 bp, Homo sapiens
cagaatcttgtccaagttgttt

SEQ ID NO: 5992426 - DNA, 20 bp, Homo sapiens
cagaatcttgttttgaaaat

SEQ ID NO: 5992427 - DNA, 21 bp, Homo sapiens
cagaatctttccttcctctca

SEQ ID NO: 5992428 - DNA, 15 bp, Homo sapiens
cagaatcttttcaat

SEQ ID NO: 5992429 - DNA, 14 bp, Homo sapiens
cagaatgaaaaatg

SEQ ID NO: 5992430 - DNA, 15 bp, Homo sapiens
cagaatgaaaaatga

SEQ ID NO: 5992431 - DNA, 16 bp, Homo sapiens
cagaatgaaaaatgaa

SEQ ID NO: 5992432 - DNA, 23 bp, Homo sapiens
cagaatgaaaaatgaaagatgat

SEQ ID NO: 5992433 - DNA, 22 bp, Homo sapiens
cagaatgaacccatagggagct

SEQ ID NO: 5992434 - DNA, 18 bp, Homo sapiens
cagaatgaaccctcctcc

SEQ ID NO: 5992435 - DNA, 19 bp, Homo sapiens
cagaatgaaccctcctcct

SEQ ID NO: 5992436 - DNA, 18 bp, Homo sapiens
cagaatgactgacaaaga

SEQ ID NO: 5992437 - DNA, 14 bp, Homo sapiens
cagaatgagatgat

SEQ ID NO: 5992438 - DNA, 13 bp, Homo sapiens
cagaatgagcagt

SEQ ID NO: 5992439 - DNA, 16 bp, Homo sapiens
cagaatgagtgcttca

SEQ ID NO: 5992440 - DNA, 22 bp, Homo sapiens
cagaatgatgcaggttcaggtc

SEQ ID NO: 5992441 - DNA, 15 bp, Homo sapiens
cagaatgatgccaaa

SEQ ID NO: 5992442 - DNA, 20 bp, Homo sapiens
cagaatgcaaccaagtcaca

SEQ ID NO: 5992443 - DNA, 22 bp, Homo sapiens
cagaatgcacattggaagctcc

SEQ ID NO: 5992444 - DNA, 17 bp, Homo sapiens
cagaatgccatattttt

SEQ ID NO: 5992445 - DNA, 17 bp, Homo sapiens
cagaatgctagctctga

SEQ ID NO: 5992446 - DNA, 21 bp, Homo sapiens
cagaatgctagctctgagcca

SEQ ID NO: 5992447 - DNA, 12 bp, Homo sapiens
cagaatgctcag

SEQ ID NO: 5992448 - DNA, 13 bp, Homo sapiens
cagaatgctcagg

SEQ ID NO: 5992449 - DNA, 15 bp, Homo sapiens
cagaatgctcttcta

SEQ ID NO: 5992450 - DNA, 16 bp, Homo sapiens
cagaatgctgtacatc

SEQ ID NO: 5992451 - DNA, 17 bp, Homo sapiens
cagaatgctgtacatct

SEQ ID NO: 5992452 - DNA, 21 bp, Homo sapiens
cagaatgctgtacatctattt

SEQ ID NO: 5992453 - DNA, 12 bp, Homo sapiens
cagaatgctgtt

SEQ ID NO: 5992454 - DNA, 16 bp, Homo sapiens
cagaatgctgttttaa

SEQ ID NO: 5992455 - DNA, 18 bp, Homo sapiens
cagaatgctgttttaaaa

SEQ ID NO: 5992456 - DNA, 16 bp, Homo sapiens
cagaatgcttctcttt

SEQ ID NO: 5992457 - DNA, 13 bp, Homo sapiens
cagaatggaaaaa

SEQ ID NO: 5992458 - DNA, 14 bp, Homo sapiens
cagaatggaaaaat

SEQ ID NO: 5992459 - DNA, 22 bp, Homo sapiens
cagaatggaaaaatccttgaag

SEQ ID NO: 5992460 - DNA, 15 bp, Homo sapiens
cagaatggaaagaaa

SEQ ID NO: 5992461 - DNA, 23 bp, Homo sapiens
cagaatggaactcaagctggttt

SEQ ID NO: 5992462 - DNA, 15 bp, Homo sapiens
cagaatggaagagag

SEQ ID NO: 5992463 - DNA, 20 bp, Homo sapiens
cagaatggaatccatctgtc

SEQ ID NO: 5992464 - DNA, 16 bp, Homo sapiens
cagaatggaatgctct

SEQ ID NO: 5992465 - DNA, 20 bp, Homo sapiens
cagaatggaatgctctggtc

SEQ ID NO: 5992466 - DNA, 17 bp, Homo sapiens
cagaatggagaaagtaa

SEQ ID NO: 5992467 - DNA, 20 bp, Homo sapiens
cagaatggagaaagtaagtc

SEQ ID NO: 5992468 - DNA, 17 bp, Homo sapiens
cagaatggcagtcctgg

SEQ ID NO: 5992469 - DNA, 18 bp, Homo sapiens
cagaatggcagtcctgga

SEQ ID NO: 5992470 - DNA, 21 bp, Homo sapiens
cagaatggctatcaaaagaaa

SEQ ID NO: 5992471 - DNA, 16 bp, Homo sapiens
cagaatggctgtcctt

SEQ ID NO: 5992472 - DNA, 19 bp, Homo sapiens
cagaatggtgggctccaga

SEQ ID NO: 5992473 - DNA, 20 bp, Homo sapiens
cagaatggtgggctccagag

SEQ ID NO: 5992474 - DNA, 22 bp, Homo sapiens
cagaatgtaagaaaacaaaatc

SEQ ID NO: 5992475 - DNA, 19 bp, Homo sapiens
cagaatgtaagtgggccca

SEQ ID NO: 5992476 - DNA, 12 bp, Homo sapiens
cagaatgtatct

SEQ ID NO: 5992477 - DNA, 14 bp, Homo sapiens
cagaatgtatctgt

SEQ ID NO: 5992478 - DNA, 17 bp, Homo sapiens
cagaatgtatctgtgaa

SEQ ID NO: 5992479 - DNA, 18 bp, Homo sapiens
cagaatgtatctgtgaag

SEQ ID NO: 5992480 - DNA, 21 bp, Homo sapiens
cagaatgtgataaggaaatca

SEQ ID NO: 5992481 - DNA, 15 bp, Homo sapiens
cagaatgtgctgcct

SEQ ID NO: 5992482 - DNA, 16 bp, Homo sapiens
cagaatgtgctgcctt

SEQ ID NO: 5992483 - DNA, 18 bp, Homo sapiens
cagaatgtgttcttttct

SEQ ID NO: 5992484 - DNA, 21 bp, Homo sapiens
cagaatgttaatttattttgc

SEQ ID NO: 5992485 - DNA, 22 bp, Homo sapiens
cagaatgttgattacagtgcag

SEQ ID NO: 5992486 - DNA, 18 bp, Homo sapiens
cagaatgttgtacttgaa

SEQ ID NO: 5992487 - DNA, 19 bp, Homo sapiens
cagaatgtttcctgtggaa

SEQ ID NO: 5992488 - DNA, 20 bp, Homo sapiens
cagaatgtttcctgtggaaa

SEQ ID NO: 5992489 - DNA, 21 bp, Homo sapiens
cagaatgtttcctgtggaaat

SEQ ID NO: 5992490 - DNA, 17 bp, Homo sapiens
cagaatgtttttaaaat

SEQ ID NO: 5992491 - DNA, 17 bp, Homo sapiens
cagaattaaacttttaa

SEQ ID NO: 5992492 - DNA, 23 bp, Homo sapiens
cagaattaaacttttaattcatt

SEQ ID NO: 5992493 - DNA, 18 bp, Homo sapiens
cagaattaactataacaa

SEQ ID NO: 5992494 - DNA, 19 bp, Homo sapiens
cagaattaactataacaat

SEQ ID NO: 5992495 - DNA, 21 bp, Homo sapiens
cagaattacaggaaatgcaaa

SEQ ID NO: 5992496 - DNA, 21 bp, Homo sapiens
cagaattacccttcctcatct

SEQ ID NO: 5992497 - DNA, 23 bp, Homo sapiens
cagaattactgtaactgattaca

SEQ ID NO: 5992498 - DNA, 14 bp, Homo sapiens
cagaattatacagt

SEQ ID NO: 5992499 - DNA, 16 bp, Homo sapiens
cagaattatccattac

SEQ ID NO: 5992500 - DNA, 17 bp, Homo sapiens
cagaattatccattacg

SEQ ID NO: 5992501 - DNA, 20 bp, Homo sapiens
cagaattatgatggaagaca

SEQ ID NO: 5992502 - DNA, 21 bp, Homo sapiens
cagaattatgatggaagacag

SEQ ID NO: 5992503 - DNA, 22 bp, Homo sapiens
cagaattattcatagctgtata

SEQ ID NO: 5992504 - DNA, 21 bp, Homo sapiens
cagaattatttttaaaaagaa

SEQ ID NO: 5992505 - DNA, 14 bp, Homo sapiens
cagaattcccttga

SEQ ID NO: 5992506 - DNA, 21 bp, Homo sapiens
cagaattcccttgaattgtgt

SEQ ID NO: 5992507 - DNA, 22 bp, Homo sapiens
cagaattcccttgaattgtgta

SEQ ID NO: 5992508 - DNA, 19 bp, Homo sapiens
cagaattcggtgtgctgcc

SEQ ID NO: 5992509 - DNA, 19 bp, Homo sapiens
cagaattctaggcagcacc

SEQ ID NO: 5992510 - DNA, 22 bp, Homo sapiens
cagaattctcccagcgttaaca

SEQ ID NO: 5992511 - DNA, 16 bp, Homo sapiens
cagaattgaaacactt

SEQ ID NO: 5992512 - DNA, 17 bp, Homo sapiens
cagaattgaaacacttt

SEQ ID NO: 5992513 - DNA, 21 bp, Homo sapiens
cagaattgaaacacttttttg

SEQ ID NO: 5992514 - DNA, 16 bp, Homo sapiens
cagaattgaaggagaa

SEQ ID NO: 5992515 - DNA, 13 bp, Homo sapiens
cagaattggaaaa

SEQ ID NO: 5992516 - DNA, 14 bp, Homo sapiens
cagaattggcataa

SEQ ID NO: 5992517 - DNA, 20 bp, Homo sapiens
cagaattggtaaaaacagca

SEQ ID NO: 5992518 - DNA, 21 bp, Homo sapiens
cagaattgtatctcatactgt

SEQ ID NO: 5992519 - DNA, 14 bp, Homo sapiens
cagaattgtcctca

SEQ ID NO: 5992520 - DNA, 12 bp, Homo sapiens
cagaattgttct

SEQ ID NO: 5992521 - DNA, 22 bp, Homo sapiens
cagaatttaccatcatctctga

SEQ ID NO: 5992522 - DNA, 17 bp, Homo sapiens
cagaatttatctccctt

SEQ ID NO: 5992523 - DNA, 22 bp, Homo sapiens
cagaatttccactgtaattaaa

SEQ ID NO: 5992524 - DNA, 17 bp, Homo sapiens
cagaatttcccaaagca

SEQ ID NO: 5992525 - DNA, 11 bp, Homo sapiens
cacaacagatt

SEQ ID NO: 5992526 - DNA, 13 bp, Homo sapiens
cacaacagcagtc

SEQ ID NO: 5992527 - DNA, 13 bp, Homo sapiens
cacaacagccctg

SEQ ID NO: 5992528 - DNA, 23 bp, Homo sapiens
cacaacagcctgacaacatttct

SEQ ID NO: 5992529 - DNA, 13 bp, Homo sapiens
cacaacaggcatt

SEQ ID NO: 5992530 - DNA, 23 bp, Homo sapiens
cacaacataaggagaatgtatct

SEQ ID NO: 5992531 - DNA, 13 bp, Homo sapiens
cacaacatttatt

SEQ ID NO: 5992532 - DNA, 19 bp, Homo sapiens
cacaacatttgcagatgtt

SEQ ID NO: 5992533 - DNA, 18 bp, Homo sapiens
cacaaccaccattcagtc

SEQ ID NO: 5992534 - DNA, 23 bp, Homo sapiens
cacaaccagaggtggcaggagaa

SEQ ID NO: 5992535 - DNA, 14 bp, Homo sapiens
cacaaccagccaca

SEQ ID NO: 5992536 - DNA, 17 bp, Homo sapiens
cacaaccagccacacag

SEQ ID NO: 5992537 - DNA, 14 bp, Homo sapiens
cacaaccaggaaga

SEQ ID NO: 5992538 - DNA, 20 bp, Homo sapiens
cacaacccatctacccctgg

SEQ ID NO: 5992539 - DNA, 14 bp, Homo sapiens
cacaacccccagct

SEQ ID NO: 5992540 - DNA, 15 bp, Homo sapiens
cacaacccccagctc

SEQ ID NO: 5992541 - DNA, 17 bp, Homo sapiens
cacaacccccagctccc

SEQ ID NO: 5992542 - DNA, 16 bp, Homo sapiens
cacaacctcaccaaac

SEQ ID NO: 5992543 - DNA, 18 bp, Homo sapiens
cacaacctcaccaaacta

SEQ ID NO: 5992544 - DNA, 22 bp, Homo sapiens
cacaacctccacctcctgggtt

SEQ ID NO: 5992545 - DNA, 15 bp, Homo sapiens
cacaacctgcatctt

SEQ ID NO: 5992546 - DNA, 19 bp, Homo sapiens
cacaaccttcggctccggg

SEQ ID NO: 5992547 - DNA, 19 bp, Homo sapiens
cacaaccttctgtggctca

SEQ ID NO: 5992548 - DNA, 23 bp, Homo sapiens
cacaaccttctgtggctcacaga

SEQ ID NO: 5992549 - DNA, 22 bp, Homo sapiens
cacaacgctctaccctgcagct

SEQ ID NO: 5992550 - DNA, 14 bp, Homo sapiens
cacaacgtcccctc

SEQ ID NO: 5992551 - DNA, 16 bp, Homo sapiens
cacaacgtcccctcaa

SEQ ID NO: 5992552 - DNA, 18 bp, Homo sapiens
cacaactaacaatgcctt

SEQ ID NO: 5992553 - DNA, 23 bp, Homo sapiens
cacaactaacaatgccttgttgt

SEQ ID NO: 5992554 - DNA, 20 bp, Homo sapiens
cacaactaataggacctcaa

SEQ ID NO: 5992555 - DNA, 17 bp, Homo sapiens
cacaactactagtgtga

SEQ ID NO: 5992556 - DNA, 12 bp, Homo sapiens
cacaactaggac

SEQ ID NO: 5992557 - DNA, 16 bp, Homo sapiens
cacaactaggacctca

SEQ ID NO: 5992558 - DNA, 22 bp, Homo sapiens
cacaactcagtctgtgggagct

SEQ ID NO: 5992559 - DNA, 22 bp, Homo sapiens
cacaactccactgtctttaaaa

SEQ ID NO: 5992560 - DNA, 22 bp, Homo sapiens
cacaactcccttaaggtctcca

SEQ ID NO: 5992561 - DNA, 17 bp, Homo sapiens
cacaactcccttgcacg

SEQ ID NO: 5992562 - DNA, 14 bp, Homo sapiens
cacaactctccaaa

SEQ ID NO: 5992563 - DNA, 13 bp, Homo sapiens
cacaactgacaca

SEQ ID NO: 5992564 - DNA, 18 bp, Homo sapiens
cacaactgacacaggaaa

SEQ ID NO: 5992565 - DNA, 15 bp, Homo sapiens
cacaactggaagctt

SEQ ID NO: 5992566 - DNA, 14 bp, Homo sapiens
cacaactgtggata

SEQ ID NO: 5992567 - DNA, 18 bp, Homo sapiens
cacaactgtggataaatt

SEQ ID NO: 5992568 - DNA, 19 bp, Homo sapiens
cacaactgtggataaattt

SEQ ID NO: 5992569 - DNA, 22 bp, Homo sapiens
cacaactgtgtgattaaaaggt

SEQ ID NO: 5992570 - DNA, 23 bp, Homo sapiens
cacaacttaaaaagtctgcatta

SEQ ID NO: 5992571 - DNA, 13 bp, Homo sapiens
cacaacttcagca

SEQ ID NO: 5992572 - DNA, 17 bp, Homo sapiens
cacaacttcagcagggg

SEQ ID NO: 5992573 - DNA, 19 bp, Homo sapiens
cacaacttcccattaaaaa

SEQ ID NO: 5992574 - DNA, 12 bp, Homo sapiens
cacaagaaaaag

SEQ ID NO: 5992575 - DNA, 14 bp, Homo sapiens
cacaagaaaaagat

SEQ ID NO: 5992576 - DNA, 17 bp, Homo sapiens
cacaagaaactttggaa

SEQ ID NO: 5992577 - DNA, 11 bp, Homo sapiens
cacaagaaatc

SEQ ID NO: 5992578 - DNA, 18 bp, Homo sapiens
cacaagaaatgaaagcag

SEQ ID NO: 5992579 - DNA, 20 bp, Homo sapiens
cacaagaaatgaaagcaggg

SEQ ID NO: 5992580 - DNA, 12 bp, Homo sapiens
cacaagaaattt

SEQ ID NO: 5992581 - DNA, 14 bp, Homo sapiens
cacaagaaatttga

SEQ ID NO: 5992582 - DNA, 20 bp, Homo sapiens
cacaagaaggggtgtttatt

SEQ ID NO: 5992583 - DNA, 21 bp, Homo sapiens
cacaagacatttctttctgtt

SEQ ID NO: 5992584 - DNA, 20 bp, Homo sapiens
cacaagacccaagtagctgc

SEQ ID NO: 5992585 - DNA, 14 bp, Homo sapiens
cacaagacccttgt

SEQ ID NO: 5992586 - DNA, 20 bp, Homo sapiens
cacaagactgacgccagggt

SEQ ID NO: 5992587 - DNA, 19 bp, Homo sapiens
cacaagactggcagtccaa

SEQ ID NO: 5992588 - DNA, 15 bp, Homo sapiens
cacaagactggccca

SEQ ID NO: 5992589 - DNA, 17 bp, Homo sapiens
cacaagaggaagagaga

SEQ ID NO: 5992590 - DNA, 13 bp, Homo sapiens
cacaagataaatt

SEQ ID NO: 5992591 - DNA, 16 bp, Homo sapiens
cacaagatccaggcag

SEQ ID NO: 5992592 - DNA, 18 bp, Homo sapiens
cacaagatccgtggtttg

SEQ ID NO: 5992593 - DNA, 18 bp, Homo sapiens
cacaagatgccccaggga

SEQ ID NO: 5992594 - DNA, 19 bp, Homo sapiens
cacaagatgccccagggat

SEQ ID NO: 5992595 - DNA, 18 bp, Homo sapiens
cacaagatggaatttatc

SEQ ID NO: 5992596 - DNA, 22 bp, Homo sapiens
cacaagatggaatttatcaaac

SEQ ID NO: 5992597 - DNA, 15 bp, Homo sapiens
cacaagattcccaga

SEQ ID NO: 5992598 - DNA, 16 bp, Homo sapiens
cacaagattcccagag

SEQ ID NO: 5992599 - DNA, 22 bp, Homo sapiens
cacaagattggtgtttttttct

SEQ ID NO: 5992600 - DNA, 22 bp, Homo sapiens
cacaagcaaaaaaaaaaaaaag

SEQ ID NO: 5992601 - DNA, 22 bp, Homo sapiens
cacaagcaataattaggatcta

SEQ ID NO: 5992602 - DNA, 14 bp, Homo sapiens
cacaagcacaaagc

SEQ ID NO: 5992603 - DNA, 23 bp, Homo sapiens
cacaagcaccactctgggcacaa

SEQ ID NO: 5992604 - DNA, 19 bp, Homo sapiens
cacaagcaccccagacctc

SEQ ID NO: 5992605 - DNA, 12 bp, Homo sapiens
cacaagcagggc

SEQ ID NO: 5992606 - DNA, 14 bp, Homo sapiens
cacaagcagggcac

SEQ ID NO: 5992607 - DNA, 16 bp, Homo sapiens
cacaagcattccttag

SEQ ID NO: 5992608 - DNA, 19 bp, Homo sapiens
cacaagcattccttagcag

SEQ ID NO: 5992609 - DNA, 21 bp, Homo sapiens
cacaagccacaagtcttccag

SEQ ID NO: 5992610 - DNA, 17 bp, Homo sapiens
cacaagccacagaagcc

SEQ ID NO: 5992611 - DNA, 21 bp, Homo sapiens
cacaagcccgtgacagatgcc

SEQ ID NO: 5992612 - DNA, 12 bp, Homo sapiens
cacaagcctgag

SEQ ID NO: 5992613 - DNA, 13 bp, Homo sapiens
cacaagcctgagg

SEQ ID NO: 5992614 - DNA, 17 bp, Homo sapiens
cacaagccttactcacc

SEQ ID NO: 5992615 - DNA, 21 bp, Homo sapiens
cacaagccttactcacctctc

SEQ ID NO: 5992616 - DNA, 14 bp, Homo sapiens
cacaagcgctccca

SEQ ID NO: 5992617 - DNA, 17 bp, Homo sapiens
cacaagcgctcccagcc

SEQ ID NO: 5992618 - DNA, 20 bp, Homo sapiens
cacaagcgctcccagcctgc

SEQ ID NO: 5992619 - DNA, 20 bp, Homo sapiens
cacaagctaggccaatgaag

SEQ ID NO: 5992620 - DNA, 13 bp, Homo sapiens
cacaagctccaag

SEQ ID NO: 5992621 - DNA, 18 bp, Homo sapiens
cacaagctccaagctccc

SEQ ID NO: 5992622 - DNA, 15 bp, Homo sapiens
cacaagctccctggt

SEQ ID NO: 5992623 - DNA, 17 bp, Homo sapiens
cacaagctccctggtga

SEQ ID NO: 5992624 - DNA, 13 bp, Homo sapiens
cacaagctcctta

SEQ ID NO: 5992625 - DNA, 23 bp, Homo sapiens
cacaagctctcgggactagctgc

SEQ ID NO: 5992626 - DNA, 12 bp, Homo sapiens
cacaagctgagc

SEQ ID NO: 5992627 - DNA, 15 bp, Homo sapiens
cacaagctgagcagg

SEQ ID NO: 5992628 - DNA, 11 bp, Homo sapiens
cacaagctgca

SEQ ID NO: 5992629 - DNA, 14 bp, Homo sapiens
cacaagctgcactg

SEQ ID NO: 5992630 - DNA, 17 bp, Homo sapiens
cacaagctgcactgtga

SEQ ID NO: 5992631 - DNA, 19 bp, Homo sapiens
cacaagctgcactgtgaac

SEQ ID NO: 5992632 - DNA, 13 bp, Homo sapiens
cacaagctggaag

SEQ ID NO: 5992633 - DNA, 22 bp, Homo sapiens
cacaagcttgtatatacatatt

SEQ ID NO: 5992634 - DNA, 16 bp, Homo sapiens
cacaaggaaccctcag

SEQ ID NO: 5992635 - DNA, 18 bp, Homo sapiens
cacaaggaaccctcaggc

SEQ ID NO: 5992636 - DNA, 20 bp, Homo sapiens
cacaaggaaccctcaggcca

SEQ ID NO: 5992637 - DNA, 15 bp, Homo sapiens
cacaaggaagaaatt

SEQ ID NO: 5992638 - DNA, 12 bp, Homo sapiens
cacaaggacttc

SEQ ID NO: 5992639 - DNA, 23 bp, Homo sapiens
cacaaggagctttcttgtttctt

SEQ ID NO: 5992640 - DNA, 18 bp, Homo sapiens
cacaaggatagatgctgg

SEQ ID NO: 5992641 - DNA, 21 bp, Homo sapiens
cacaaggatagatgctggccc

SEQ ID NO: 5992642 - DNA, 18 bp, Homo sapiens
cacaaggcagcaaggccc

SEQ ID NO: 5992643 - DNA, 17 bp, Homo sapiens
cacaaggccagaaaaag

SEQ ID NO: 5992644 - DNA, 19 bp, Homo sapiens
cacaaggccagaaaaagaa

SEQ ID NO: 5992645 - DNA, 22 bp, Homo sapiens
cacaaggccagaaaaagaagaa

SEQ ID NO: 5992646 - DNA, 17 bp, Homo sapiens
cacaaggcccagccctg

SEQ ID NO: 5992647 - DNA, 14 bp, Homo sapiens
cacaaggcccagga

SEQ ID NO: 5992648 - DNA, 18 bp, Homo sapiens
cacaaggcctggtctggg

SEQ ID NO: 5992649 - DNA, 12 bp, Homo sapiens
cacaaggcctta

SEQ ID NO: 5992650 - DNA, 18 bp, Homo sapiens
cacaaggctccaagacct

SEQ ID NO: 5992651 - DNA, 12 bp, Homo sapiens
cacaaggctggc

SEQ ID NO: 5992652 - DNA, 15 bp, Homo sapiens
cacaaggctggccag

SEQ ID NO: 5992653 - DNA, 20 bp, Homo sapiens
cacaagggactgaggcaagc

SEQ ID NO: 5992654 - DNA, 22 bp, Homo sapiens
cacaagggatataaaatgaaag

SEQ ID NO: 5992655 - DNA, 16 bp, Homo sapiens
cacaaggtcatggcca

SEQ ID NO: 5992656 - DNA, 17 bp, Homo sapiens
cacaaggtcatggccac

SEQ ID NO: 5992657 - DNA, 23 bp, Homo sapiens
cacaaggtccactccctgctcca

SEQ ID NO: 5992658 - DNA, 20 bp, Homo sapiens
cacaaggtggcagcaagcaa

SEQ ID NO: 5992659 - DNA, 21 bp, Homo sapiens
cacaagtagatgcctgaactt

SEQ ID NO: 5992660 - DNA, 22 bp, Homo sapiens
cacaagtagatgcctgaacttg

SEQ ID NO: 5992661 - DNA, 17 bp, Homo sapiens
cacaagtagattgatct

SEQ ID NO: 5992662 - DNA, 18 bp, Homo sapiens
cacaagtagcctctggga

SEQ ID NO: 5992663 - DNA, 19 bp, Homo sapiens
cacaagtatatacttttaa

SEQ ID NO: 5992664 - DNA, 16 bp, Homo sapiens
cacaagtctaaacaat

SEQ ID NO: 5992665 - DNA, 17 bp, Homo sapiens
cacaagtctttccagag

SEQ ID NO: 5992666 - DNA, 15 bp, Homo sapiens
cacaagtgaatcttt

SEQ ID NO: 5992667 - DNA, 18 bp, Homo sapiens
cacaagtgaatctttctc

SEQ ID NO: 5992668 - DNA, 20 bp, Homo sapiens
cacaagtgaatctttctcct

SEQ ID NO: 5992669 - DNA, 21 bp, Homo sapiens
cacaagtgaatctttctcctg

SEQ ID NO: 5992670 - DNA, 22 bp, Homo sapiens
cacaagtgccactgcccgagct

SEQ ID NO: 5992671 - DNA, 18 bp, Homo sapiens
cacaagtgggtaccccca

SEQ ID NO: 5992672 - DNA, 20 bp, Homo sapiens
cacaagtggtggtaaccctg

SEQ ID NO: 5992673 - DNA, 12 bp, Homo sapiens
cacaagtggtgt

SEQ ID NO: 5992674 - DNA, 17 bp, Homo sapiens
cacaagtgtgtggcccc

SEQ ID NO: 5992675 - DNA, 17 bp, Homo sapiens
cacaagttccagctggt

SEQ ID NO: 5992676 - DNA, 18 bp, Homo sapiens
cacaagttccctggagaa

SEQ ID NO: 5992677 - DNA, 19 bp, Homo sapiens
cacaagttccctggagaaa

SEQ ID NO: 5992678 - DNA, 19 bp, Homo sapiens
cacaagttctttcccagcc

SEQ ID NO: 5992679 - DNA, 21 bp, Homo sapiens
cacaagttctttcccagcctc

SEQ ID NO: 5992680 - DNA, 17 bp, Homo sapiens
cacaagtttttttgttc

SEQ ID NO: 5992681 - DNA, 19 bp, Homo sapiens
cacaagtttttttgttcat

SEQ ID NO: 5992682 - DNA, 23 bp, Homo sapiens
cacaataaaaccaagcctctgga

SEQ ID NO: 5992683 - DNA, 11 bp, Homo sapiens
cacaataaatg

SEQ ID NO: 5992684 - DNA, 22 bp, Homo sapiens
cacaataaatggccagtgctgc

SEQ ID NO: 5992685 - DNA, 20 bp, Homo sapiens
cacaataaatgtattcaaat

SEQ ID NO: 5992686 - DNA, 19 bp, Homo sapiens
cacaataacactaaaattt

SEQ ID NO: 5992687 - DNA, 21 bp, Homo sapiens
cacaataacactaaaatttta

SEQ ID NO: 5992688 - DNA, 17 bp, Homo sapiens
cacaataactcctccca

SEQ ID NO: 5992689 - DNA, 13 bp, Homo sapiens
cacaatacaataa

SEQ ID NO: 5992690 - DNA, 20 bp, Homo sapiens
cacaatagccgatatcagaa

SEQ ID NO: 5992691 - DNA, 20 bp, Homo sapiens
cacaataggatcccccttct

SEQ ID NO: 5992692 - DNA, 22 bp, Homo sapiens
cacaatatatttttactgcttt

SEQ ID NO: 5992693 - DNA, 16 bp, Homo sapiens
cacaatattcagtggt

SEQ ID NO: 5992694 - DNA, 18 bp, Homo sapiens
cacaatatttcttttgtt

SEQ ID NO: 5992695 - DNA, 11 bp, Homo sapiens
cacaatatttt

SEQ ID NO: 5992696 - DNA, 19 bp, Homo sapiens
cacaatcagtttatcctga

SEQ ID NO: 5992697 - DNA, 18 bp, Homo sapiens
cacaatcatcttctccca

SEQ ID NO: 5992698 - DNA, 18 bp, Homo sapiens
cacaatcccacctagccc

SEQ ID NO: 5992699 - DNA, 21 bp, Homo sapiens
cacaatcccacctagcccagg

SEQ ID NO: 5992700 - DNA, 19 bp, Homo sapiens
cacaatctacactgcctta

SEQ ID NO: 5992701 - DNA, 17 bp, Homo sapiens
cacaatctcacacagct

SEQ ID NO: 5992702 - DNA, 24 bp, Homo sapiens
cacaatctcggcccgctgcagcct

SEQ ID NO: 5992703 - DNA, 19 bp, Homo sapiens
cagaatttcccaaagcagt

SEQ ID NO: 5992704 - DNA, 15 bp, Homo sapiens
cagaatttgaatatt

SEQ ID NO: 5992705 - DNA, 16 bp, Homo sapiens
cagaatttgagaacct

SEQ ID NO: 5992706 - DNA, 16 bp, Homo sapiens
cagaatttggaaatcc

SEQ ID NO: 5992707 - DNA, 24 bp, Homo sapiens
cagaattttaatgtgaagacattt

SEQ ID NO: 5992708 - DNA, 12 bp, Homo sapiens
cagaattttacc

SEQ ID NO: 5992709 - DNA, 20 bp, Homo sapiens
cagaattttatactttccct

SEQ ID NO: 5992710 - DNA, 22 bp, Homo sapiens
cagaattttctggcctttcatg

SEQ ID NO: 5992711 - DNA, 22 bp, Homo sapiens
cagaattttggaaaaatgtcac

SEQ ID NO: 5992712 - DNA, 14 bp, Homo sapiens
cagaattttgtata

SEQ ID NO: 5992713 - DNA, 16 bp, Homo sapiens
cagaatttttaactgt

SEQ ID NO: 5992714 - DNA, 18 bp, Homo sapiens
cagaatttttaactgtac

SEQ ID NO: 5992715 - DNA, 17 bp, Homo sapiens
cagaatttttaatgact

SEQ ID NO: 5992716 - DNA, 21 bp, Homo sapiens
cagaatttttaatgacttttt

SEQ ID NO: 5992717 - DNA, 12 bp, Homo sapiens
cagaatttttcc

SEQ ID NO: 5992718 - DNA, 21 bp, Homo sapiens
cagaatttttccctccactcc

SEQ ID NO: 5992719 - DNA, 15 bp, Homo sapiens
cagaattttttttgt

SEQ ID NO: 5992720 - DNA, 18 bp, Homo sapiens
cagaattttttttgttgt

SEQ ID NO: 5992721 - DNA, 19 bp, Homo sapiens
cagacaaaaaaatttaaaa

SEQ ID NO: 5992722 - DNA, 11 bp, Homo sapiens
cagacaaaatg

SEQ ID NO: 5992723 - DNA, 23 bp, Homo sapiens
cagacaaagatgtcttaacctca

SEQ ID NO: 5992724 - DNA, 17 bp, Homo sapiens
cagacaaagccctgtcc

SEQ ID NO: 5992725 - DNA, 18 bp, Homo sapiens
cagacaaagccctgtcct

SEQ ID NO: 5992726 - DNA, 22 bp, Homo sapiens
cagacaaataggagtgagtgta

SEQ ID NO: 5992727 - DNA, 23 bp, Homo sapiens
cagacaaattcattcccttctct

SEQ ID NO: 5992728 - DNA, 16 bp, Homo sapiens
cagacaaatttaaagg

SEQ ID NO: 5992729 - DNA, 17 bp, Homo sapiens
cagacaacaccttcctc

SEQ ID NO: 5992730 - DNA, 21 bp, Homo sapiens
cagacaacaccttcctcctgc

SEQ ID NO: 5992731 - DNA, 22 bp, Homo sapiens
cagacaacaccttcctcctgca

SEQ ID NO: 5992732 - DNA, 18 bp, Homo sapiens
cagacaacagcccaggca

SEQ ID NO: 5992733 - DNA, 11 bp, Homo sapiens
cagacaacatt

SEQ ID NO: 5992734 - DNA, 22 bp, Homo sapiens
cagacaacattatgatctaata

SEQ ID NO: 5992735 - DNA, 17 bp, Homo sapiens
cagacaaccttgtccca

SEQ ID NO: 5992736 - DNA, 22 bp, Homo sapiens
cagacaacttctgtttcttctc

SEQ ID NO: 5992737 - DNA, 13 bp, Homo sapiens
cagacaagacaga

SEQ ID NO: 5992738 - DNA, 17 bp, Homo sapiens
cagacaagagctgctgt

SEQ ID NO: 5992739 - DNA, 22 bp, Homo sapiens
cagacaagattttttaattgtt

SEQ ID NO: 5992740 - DNA, 13 bp, Homo sapiens
cagacaagcacta

SEQ ID NO: 5992741 - DNA, 20 bp, Homo sapiens
cagacaagcagcccttgctt

SEQ ID NO: 5992742 - DNA, 17 bp, Homo sapiens
cagacaagccctgcttg

SEQ ID NO: 5992743 - DNA, 23 bp, Homo sapiens
cagacaaggagagcggaggagga

SEQ ID NO: 5992744 - DNA, 13 bp, Homo sapiens
cagacaaggagga

SEQ ID NO: 5992745 - DNA, 12 bp, Homo sapiens
cagacaaggcag

SEQ ID NO: 5992746 - DNA, 17 bp, Homo sapiens
cagacaaggcaggcctg

SEQ ID NO: 5992747 - DNA, 23 bp, Homo sapiens
cagacaaggcaggcctgaggcag

SEQ ID NO: 5992748 - DNA, 16 bp, Homo sapiens
cagacaagtaatcact

SEQ ID NO: 5992749 - DNA, 19 bp, Homo sapiens
cagacaagtcttgctgtgc

SEQ ID NO: 5992750 - DNA, 20 bp, Homo sapiens
cagacaagtcttgctgtgct

SEQ ID NO: 5992751 - DNA, 20 bp, Homo sapiens
cagacaagtgttttggaaag

SEQ ID NO: 5992752 - DNA, 20 bp, Homo sapiens
cagacaataaaccctcagag

SEQ ID NO: 5992753 - DNA, 22 bp, Homo sapiens
cagacaatatgtgagtgccttt

SEQ ID NO: 5992754 - DNA, 18 bp, Homo sapiens
cagacaatccactctcag

SEQ ID NO: 5992755 - DNA, 15 bp, Homo sapiens
cagacaatcttctgt

SEQ ID NO: 5992756 - DNA, 14 bp, Homo sapiens
cagacaattagaaa

SEQ ID NO: 5992757 - DNA, 22 bp, Homo sapiens
cagacaattctaatggtaactt

SEQ ID NO: 5992758 - DNA, 23 bp, Homo sapiens
cagacaattctaatggtaacttt

SEQ ID NO: 5992759 - DNA, 13 bp, Homo sapiens
cagacacaaacaa

SEQ ID NO: 5992760 - DNA, 20 bp, Homo sapiens
cagacacaacccaataggag

SEQ ID NO: 5992761 - DNA, 17 bp, Homo sapiens
cagacacaatatgtatg

SEQ ID NO: 5992762 - DNA, 18 bp, Homo sapiens
cagacacaatatgtatgc

SEQ ID NO: 5992763 - DNA, 19 bp, Homo sapiens
cagacacaatatgtatgct

SEQ ID NO: 5992764 - DNA, 12 bp, Homo sapiens
cagacacaatta

SEQ ID NO: 5992765 - DNA, 20 bp, Homo sapiens
cagacacacaaaatgtcaca

SEQ ID NO: 5992766 - DNA, 15 bp, Homo sapiens
cagacacacacacac

SEQ ID NO: 5992767 - DNA, 22 bp, Homo sapiens
cagacacacacacacacacaaa

SEQ ID NO: 5992768 - DNA, 15 bp, Homo sapiens
cagacacacacacgc

SEQ ID NO: 5992769 - DNA, 17 bp, Homo sapiens
cagacacacacacgcac

SEQ ID NO: 5992770 - DNA, 22 bp, Homo sapiens
cagacacacacacgcacgcaca

SEQ ID NO: 5992771 - DNA, 13 bp, Homo sapiens
cagacacacacat

SEQ ID NO: 5992772 - DNA, 15 bp, Homo sapiens
cagacacacacatat

SEQ ID NO: 5992773 - DNA, 19 bp, Homo sapiens
cagacacacacatatatac

SEQ ID NO: 5992774 - DNA, 12 bp, Homo sapiens
cagacacacact

SEQ ID NO: 5992775 - DNA, 20 bp, Homo sapiens
cagacacacactggctcctg

SEQ ID NO: 5992776 - DNA, 22 bp, Homo sapiens
cagacacacactggctcctgga

SEQ ID NO: 5992777 - DNA, 15 bp, Homo sapiens
cagacacacagcctc

SEQ ID NO: 5992778 - DNA, 13 bp, Homo sapiens
cagacacaccccc

SEQ ID NO: 5992779 - DNA, 23 bp, Homo sapiens
cagacacaccgcggccaggcacc

SEQ ID NO: 5992780 - DNA, 16 bp, Homo sapiens
cagacacacggggcac

SEQ ID NO: 5992781 - DNA, 23 bp, Homo sapiens
cagacacacggggcacccagccc

SEQ ID NO: 5992782 - DNA, 14 bp, Homo sapiens
cagacacagaagag

SEQ ID NO: 5992783 - DNA, 22 bp, Homo sapiens
cagacacagactggcaataaac

SEQ ID NO: 5992784 - DNA, 11 bp, Homo sapiens
cagacacagag

SEQ ID NO: 5992785 - DNA, 17 bp, Homo sapiens
cagacacagctcttcca

SEQ ID NO: 5992786 - DNA, 20 bp, Homo sapiens
cagacacagctcttccaggg

SEQ ID NO: 5992787 - DNA, 17 bp, Homo sapiens
cagacacaggaaaaata

SEQ ID NO: 5992788 - DNA, 21 bp, Homo sapiens
cagacacaggaaaaataaacg

SEQ ID NO: 5992789 - DNA, 13 bp, Homo sapiens
cagacacaggccc

SEQ ID NO: 5992790 - DNA, 18 bp, Homo sapiens
cagacacaggccctccct

SEQ ID NO: 5992791 - DNA, 14 bp, Homo sapiens
cagacacaggccgt

SEQ ID NO: 5992792 - DNA, 13 bp, Homo sapiens
cagacacatgggc

SEQ ID NO: 5992793 - DNA, 16 bp, Homo sapiens
cagacacatgggcttg

SEQ ID NO: 5992794 - DNA, 17 bp, Homo sapiens
cagacacatgtccaaga

SEQ ID NO: 5992795 - DNA, 14 bp, Homo sapiens
cagacaccacagac

SEQ ID NO: 5992796 - DNA, 19 bp, Homo sapiens
cagacaccacagcctcccc

SEQ ID NO: 5992797 - DNA, 13 bp, Homo sapiens
cagacaccatcac

SEQ ID NO: 5992798 - DNA, 14 bp, Homo sapiens
cagacaccatcacc

SEQ ID NO: 5992799 - DNA, 12 bp, Homo sapiens
cagacaccatgt

SEQ ID NO: 5992800 - DNA, 16 bp, Homo sapiens
cagacaccatgtgcaa

SEQ ID NO: 5992801 - DNA, 14 bp, Homo sapiens
cagacacccaggac

SEQ ID NO: 5992802 - DNA, 15 bp, Homo sapiens
cagacacccaggact

SEQ ID NO: 5992803 - DNA, 14 bp, Homo sapiens
cagacaccctcaac

SEQ ID NO: 5992804 - DNA, 15 bp, Homo sapiens
cagacacctaacccc

SEQ ID NO: 5992805 - DNA, 18 bp, Homo sapiens
cagacacctaaccccagg

SEQ ID NO: 5992806 - DNA, 10 bp, Homo sapiens
cagacacctc

SEQ ID NO: 5992807 - DNA, 12 bp, Homo sapiens
cagacacctccc

SEQ ID NO: 5992808 - DNA, 14 bp, Homo sapiens
cagacacctccccc

SEQ ID NO: 5992809 - DNA, 17 bp, Homo sapiens
cagacacctccccctac

SEQ ID NO: 5992810 - DNA, 18 bp, Homo sapiens
cagacacctccccctacc

SEQ ID NO: 5992811 - DNA, 14 bp, Homo sapiens
cagacacctggact

SEQ ID NO: 5992812 - DNA, 15 bp, Homo sapiens
cagacacctggactg

SEQ ID NO: 5992813 - DNA, 16 bp, Homo sapiens
cagacacctggactga

SEQ ID NO: 5992814 - DNA, 19 bp, Homo sapiens
cagacacctggactgagcc

SEQ ID NO: 5992815 - DNA, 15 bp, Homo sapiens
cagacacctgtgcac

SEQ ID NO: 5992816 - DNA, 18 bp, Homo sapiens
cagacacctgtgcacccc

SEQ ID NO: 5992817 - DNA, 24 bp, Homo sapiens
cagacacctgtgcaccccatgagt

SEQ ID NO: 5992818 - DNA, 22 bp, Homo sapiens
cagacacctgttcacagaaaaa

SEQ ID NO: 5992819 - DNA, 20 bp, Homo sapiens
cagacaccttgacagggcac

SEQ ID NO: 5992820 - DNA, 14 bp, Homo sapiens
cagacaccttggac

SEQ ID NO: 5992821 - DNA, 19 bp, Homo sapiens
cagacacgagccacctcac

SEQ ID NO: 5992822 - DNA, 20 bp, Homo sapiens
cagacacgcacttctggggc

SEQ ID NO: 5992823 - DNA, 19 bp, Homo sapiens
cagacacgccttcccctca

SEQ ID NO: 5992824 - DNA, 23 bp, Homo sapiens
cagacacgctcgcgggcagcggg

SEQ ID NO: 5992825 - DNA, 17 bp, Homo sapiens
cagacacggatctgaga

SEQ ID NO: 5992826 - DNA, 16 bp, Homo sapiens
cagacacgttctgatt

SEQ ID NO: 5992827 - DNA, 17 bp, Homo sapiens
cagacactaaatgcaga

SEQ ID NO: 5992828 - DNA, 16 bp, Homo sapiens
cagacactaactttgt

SEQ ID NO: 5992829 - DNA, 21 bp, Homo sapiens
cagacactaagttatagtata

SEQ ID NO: 5992830 - DNA, 16 bp, Homo sapiens
cagacactacattacc

SEQ ID NO: 5992831 - DNA, 13 bp, Homo sapiens
cagacactacccc

SEQ ID NO: 5992832 - DNA, 13 bp, Homo sapiens
cagacactcaaga

SEQ ID NO: 5992833 - DNA, 16 bp, Homo sapiens
cagacactcaagagcc

SEQ ID NO: 5992834 - DNA, 12 bp, Homo sapiens
cagacactctgc

SEQ ID NO: 5992835 - DNA, 16 bp, Homo sapiens
cagacactctgctctg

SEQ ID NO: 5992836 - DNA, 13 bp, Homo sapiens
cagacactctggc

SEQ ID NO: 5992837 - DNA, 13 bp, Homo sapiens
cagacactgagct

SEQ ID NO: 5992838 - DNA, 21 bp, Homo sapiens
cagacactgccgacatcagca

SEQ ID NO: 5992839 - DNA, 22 bp, Homo sapiens
cagacactgccgacatcagcat

SEQ ID NO: 5992840 - DNA, 14 bp, Homo sapiens
cagacactgtaaaa

SEQ ID NO: 5992841 - DNA, 22 bp, Homo sapiens
cagacactgttgcaaaggtagg

SEQ ID NO: 5992842 - DNA, 22 bp, Homo sapiens
cagacacttcatggaccaagaa

SEQ ID NO: 5992843 - DNA, 18 bp, Homo sapiens
cagacagaaagagacaca

SEQ ID NO: 5992844 - DNA, 19 bp, Homo sapiens
cagacagaaagagacacac

SEQ ID NO: 5992845 - DNA, 14 bp, Homo sapiens
cagacagacacaca

SEQ ID NO: 5992846 - DNA, 23 bp, Homo sapiens
cagacagacctcaagggacaggg

SEQ ID NO: 5992847 - DNA, 13 bp, Homo sapiens
cagacagagactt

SEQ ID NO: 5992848 - DNA, 17 bp, Homo sapiens
cagacagagatcagaat

SEQ ID NO: 5992849 - DNA, 14 bp, Homo sapiens
cagacagagccctg

SEQ ID NO: 5992850 - DNA, 14 bp, Homo sapiens
cagacagaggatga

SEQ ID NO: 5992851 - DNA, 19 bp, Homo sapiens
cagacagaggatgagctct

SEQ ID NO: 5992852 - DNA, 13 bp, Homo sapiens
cagacagagggga

SEQ ID NO: 5992853 - DNA, 12 bp, Homo sapiens
cagacagataca

SEQ ID NO: 5992854 - DNA, 17 bp, Homo sapiens
cagacagatctggaatg

SEQ ID NO: 5992855 - DNA, 17 bp, Homo sapiens
cagacagatgaggcttt

SEQ ID NO: 5992856 - DNA, 13 bp, Homo sapiens
cagacagcaagga

SEQ ID NO: 5992857 - DNA, 17 bp, Homo sapiens
cagacagcaaggtgtgg

SEQ ID NO: 5992858 - DNA, 14 bp, Homo sapiens
cagacagcacaggg

SEQ ID NO: 5992859 - DNA, 11 bp, Homo sapiens
cagacagcagc

SEQ ID NO: 5992860 - DNA, 18 bp, Homo sapiens
cagacagcagctcaggca

SEQ ID NO: 5992861 - DNA, 19 bp, Homo sapiens
cagacagcagctcaggcac

SEQ ID NO: 5992862 - DNA, 13 bp, Homo sapiens
cagacagcagctg

SEQ ID NO: 5992863 - DNA, 15 bp, Homo sapiens
cagacagcagctgga

SEQ ID NO: 5992864 - DNA, 19 bp, Homo sapiens
cagacagcagctggacttg

SEQ ID NO: 5992865 - DNA, 15 bp, Homo sapiens
cagacagcaggcagc

SEQ ID NO: 5992866 - DNA, 17 bp, Homo sapiens
cagacagcaggcagcgc

SEQ ID NO: 5992867 - DNA, 15 bp, Homo sapiens
cagacagcagtgtga

SEQ ID NO: 5992868 - DNA, 23 bp, Homo sapiens
cagacagcatgactggacagcgg

SEQ ID NO: 5992869 - DNA, 20 bp, Homo sapiens
cagacagccatgcgtggcca

SEQ ID NO: 5992870 - DNA, 15 bp, Homo sapiens
cagacagccccctgc

SEQ ID NO: 5992871 - DNA, 15 bp, Homo sapiens
cagacagccctggca

SEQ ID NO: 5992872 - DNA, 19 bp, Homo sapiens
cagacagctgctcagagcc

SEQ ID NO: 5992873 - DNA, 23 bp, Homo sapiens
cagacagctgctcagagccaagg

SEQ ID NO: 5992874 - DNA, 22 bp, Homo sapiens
cagacagcttacaggagccagc

SEQ ID NO: 5992875 - DNA, 15 bp, Homo sapiens
cagacaggaaaggga

SEQ ID NO: 5992876 - DNA, 20 bp, Homo sapiens
cagacaggaaagggaaggcc

SEQ ID NO: 5992877 - DNA, 15 bp, Homo sapiens
cagacaggaaggaag

SEQ ID NO: 5992878 - DNA, 13 bp, Homo sapiens
cagacaggaccag

SEQ ID NO: 5992879 - DNA, 15 bp, Homo sapiens
cagacaggaccaggg

SEQ ID NO: 5992880 - DNA, 15 bp, Homo sapiens
cagacaggaggagtg

SEQ ID NO: 5992881 - DNA, 20 bp, Homo sapiens
cagacaggccatgtgagcca

SEQ ID NO: 5992882 - DNA, 20 bp, Homo sapiens
cagacaggccccgtgaggca

SEQ ID NO: 5992883 - DNA, 19 bp, Homo sapiens
cacaatctcggctcactgc

SEQ ID NO: 5992884 - DNA, 23 bp, Homo sapiens
cacaatctcggctcactgcatcc

SEQ ID NO: 5992885 - DNA, 17 bp, Homo sapiens
cacaatctgagcacgct

SEQ ID NO: 5992886 - DNA, 23 bp, Homo sapiens
cacaatcttggggctgatgaaga

SEQ ID NO: 5992887 - DNA, 21 bp, Homo sapiens
cacaatctttccttgtctctc

SEQ ID NO: 5992888 - DNA, 22 bp, Homo sapiens
cacaatctttccttgtctctca

SEQ ID NO: 5992889 - DNA, 13 bp, Homo sapiens
cacaatgaatgta

SEQ ID NO: 5992890 - DNA, 16 bp, Homo sapiens
cacaatgacagaaatg

SEQ ID NO: 5992891 - DNA, 20 bp, Homo sapiens
cacaatgatgattaaacacc

SEQ ID NO: 5992892 - DNA, 22 bp, Homo sapiens
cacaatgatgattaaacacctg

SEQ ID NO: 5992893 - DNA, 20 bp, Homo sapiens
cacaatgcataatgtcttta

SEQ ID NO: 5992894 - DNA, 21 bp, Homo sapiens
cacaatgcatgtgctgtctcc

SEQ ID NO: 5992895 - DNA, 16 bp, Homo sapiens
cacaatgcctctccca

SEQ ID NO: 5992896 - DNA, 16 bp, Homo sapiens
cacaatgctattgaaa

SEQ ID NO: 5992897 - DNA, 17 bp, Homo sapiens
cacaatggaaactttag

SEQ ID NO: 5992898 - DNA, 18 bp, Homo sapiens
cacaatggagtgggagat

SEQ ID NO: 5992899 - DNA, 13 bp, Homo sapiens
cacaatggcacct

SEQ ID NO: 5992900 - DNA, 20 bp, Homo sapiens
cacaatggctaattcccaga

SEQ ID NO: 5992901 - DNA, 21 bp, Homo sapiens
cacaatggctaattcccagag

SEQ ID NO: 5992902 - DNA, 22 bp, Homo sapiens
cacaatggctgggagggggccc

SEQ ID NO: 5992903 - DNA, 21 bp, Homo sapiens
cacaatggtagctctgaaggg

SEQ ID NO: 5992904 - DNA, 14 bp, Homo sapiens
cacaatgtactata

SEQ ID NO: 5992905 - DNA, 14 bp, Homo sapiens
cacaatgtcttggt

SEQ ID NO: 5992906 - DNA, 13 bp, Homo sapiens
cacaatgtgaaac

SEQ ID NO: 5992907 - DNA, 17 bp, Homo sapiens
cacaatgttgcactgaa

SEQ ID NO: 5992908 - DNA, 17 bp, Homo sapiens
cacaatgttggagcagc

SEQ ID NO: 5992909 - DNA, 20 bp, Homo sapiens
cacaatgttggagcagcagg

SEQ ID NO: 5992910 - DNA, 21 bp, Homo sapiens
cacaatgttggagcagcaggc

SEQ ID NO: 5992911 - DNA, 23 bp, Homo sapiens
cacaatgttggagcagcaggcct

SEQ ID NO: 5992912 - DNA, 17 bp, Homo sapiens
cacaatgtttcttcatt

SEQ ID NO: 5992913 - DNA, 19 bp, Homo sapiens
cacaattaattcatccctt

SEQ ID NO: 5992914 - DNA, 13 bp, Homo sapiens
cacaattagagaa

SEQ ID NO: 5992915 - DNA, 18 bp, Homo sapiens
cacaattattggcaaagt

SEQ ID NO: 5992916 - DNA, 17 bp, Homo sapiens
cacaattatttatttca

SEQ ID NO: 5992917 - DNA, 12 bp, Homo sapiens
cacaattcattg

SEQ ID NO: 5992918 - DNA, 13 bp, Homo sapiens
cacaattcattgt

SEQ ID NO: 5992919 - DNA, 13 bp, Homo sapiens
cacaattctgtcc

SEQ ID NO: 5992920 - DNA, 17 bp, Homo sapiens
cacaattctgtccctgt

SEQ ID NO: 5992921 - DNA, 20 bp, Homo sapiens
cacaattctgtccctgtccc

SEQ ID NO: 5992922 - DNA, 17 bp, Homo sapiens
cacaattgaacttccag

SEQ ID NO: 5992923 - DNA, 23 bp, Homo sapiens
cacaattgaacttccaggaaagt

SEQ ID NO: 5992924 - DNA, 19 bp, Homo sapiens
cacaattgatacttcaggt

SEQ ID NO: 5992925 - DNA, 23 bp, Homo sapiens
cacaattgatacttcaggtgctt

SEQ ID NO: 5992926 - DNA, 15 bp, Homo sapiens
cacaattgttgacta

SEQ ID NO: 5992927 - DNA, 21 bp, Homo sapiens
cacaattgttgactaaaatgc

SEQ ID NO: 5992928 - DNA, 15 bp, Homo sapiens
cacaatttaaaatat

SEQ ID NO: 5992929 - DNA, 17 bp, Homo sapiens
cacaatttaaaatattt

SEQ ID NO: 5992930 - DNA, 13 bp, Homo sapiens
cacaatttagaaa

SEQ ID NO: 5992931 - DNA, 16 bp, Homo sapiens
cacaatttagaaaaca

SEQ ID NO: 5992932 - DNA, 17 bp, Homo sapiens
cacaatttcatttccag

SEQ ID NO: 5992933 - DNA, 15 bp, Homo sapiens
cacaatttctttaaa

SEQ ID NO: 5992934 - DNA, 21 bp, Homo sapiens
cacaatttctttaaaaaagaa

SEQ ID NO: 5992935 - DNA, 13 bp, Homo sapiens
cacaatttgcact

SEQ ID NO: 5992936 - DNA, 19 bp, Homo sapiens
cacaatttgttgaatctca

SEQ ID NO: 5992937 - DNA, 20 bp, Homo sapiens
cacaattttcactttttctg

SEQ ID NO: 5992938 - DNA, 16 bp, Homo sapiens
cacaattttcctgtgg

SEQ ID NO: 5992939 - DNA, 20 bp, Homo sapiens
cacaattttctgtgccaaag

SEQ ID NO: 5992940 - DNA, 13 bp, Homo sapiens
cacaattttgtct

SEQ ID NO: 5992941 - DNA, 14 bp, Homo sapiens
cacacaaaacaaca

SEQ ID NO: 5992942 - DNA, 21 bp, Homo sapiens
cacacaaaatgtacccagtat

SEQ ID NO: 5992943 - DNA, 18 bp, Homo sapiens
cacacaaaccttctgcct

SEQ ID NO: 5992944 - DNA, 20 bp, Homo sapiens
cacacaaagactccttgtgg

SEQ ID NO: 5992945 - DNA, 18 bp, Homo sapiens
cacacaaagattttctaa

SEQ ID NO: 5992946 - DNA, 17 bp, Homo sapiens
cacacaaaggcatgctg

SEQ ID NO: 5992947 - DNA, 18 bp, Homo sapiens
cacacaaataacaagaat

SEQ ID NO: 5992948 - DNA, 22 bp, Homo sapiens
cacacaaatattgcttggacta

SEQ ID NO: 5992949 - DNA, 22 bp, Homo sapiens
cacacaaatgcagacacacaac

SEQ ID NO: 5992950 - DNA, 16 bp, Homo sapiens
cacacaacaccaggac

SEQ ID NO: 5992951 - DNA, 16 bp, Homo sapiens
cacacaacatcaagaa

SEQ ID NO: 5992952 - DNA, 17 bp, Homo sapiens
cacacaacgattatagt

SEQ ID NO: 5992953 - DNA, 18 bp, Homo sapiens
cacacaagaagaagggca

SEQ ID NO: 5992954 - DNA, 14 bp, Homo sapiens
cacacaagacagca

SEQ ID NO: 5992955 - DNA, 16 bp, Homo sapiens
cacacaagacagcaga

SEQ ID NO: 5992956 - DNA, 12 bp, Homo sapiens
cacacaagcagt

SEQ ID NO: 5992957 - DNA, 13 bp, Homo sapiens
cacacaagctcct

SEQ ID NO: 5992958 - DNA, 13 bp, Homo sapiens
cacacaaggctgg

SEQ ID NO: 5992959 - DNA, 16 bp, Homo sapiens
cacacaagggaagtgg

SEQ ID NO: 5992960 - DNA, 16 bp, Homo sapiens
cacacaaggggccctt

SEQ ID NO: 5992961 - DNA, 19 bp, Homo sapiens
cacacaaggggcccttgga

SEQ ID NO: 5992962 - DNA, 23 bp, Homo sapiens
cacacaagtaagagactcagcct

SEQ ID NO: 5992963 - DNA, 19 bp, Homo sapiens
cacacaattatttatttca

SEQ ID NO: 5992964 - DNA, 20 bp, Homo sapiens
cacacaattcattggctcct

SEQ ID NO: 5992965 - DNA, 14 bp, Homo sapiens
cacacacaaaactt

SEQ ID NO: 5992966 - DNA, 19 bp, Homo sapiens
cacacacaaaagggaaccc

SEQ ID NO: 5992967 - DNA, 15 bp, Homo sapiens
cacacacaaaataaa

SEQ ID NO: 5992968 - DNA, 13 bp, Homo sapiens
cacacacaaacct

SEQ ID NO: 5992969 - DNA, 18 bp, Homo sapiens
cacacacaaatattgctt

SEQ ID NO: 5992970 - DNA, 13 bp, Homo sapiens
cacacacaaatgc

SEQ ID NO: 5992971 - DNA, 14 bp, Homo sapiens
cacacacaaatgca

SEQ ID NO: 5992972 - DNA, 15 bp, Homo sapiens
cacacacaacaaaaa

SEQ ID NO: 5992973 - DNA, 16 bp, Homo sapiens
cacacacaacagccaa

SEQ ID NO: 5992974 - DNA, 10 bp, Homo sapiens
cacacacaca

SEQ ID NO: 5992975 - DNA, 13 bp, Homo sapiens
cacacacacaaaa

SEQ ID NO: 5992976 - DNA, 15 bp, Homo sapiens
cacacacacaaacct

SEQ ID NO: 5992977 - DNA, 15 bp, Homo sapiens
cacacacacaaatgc

SEQ ID NO: 5992978 - DNA, 12 bp, Homo sapiens
cacacacacaag

SEQ ID NO: 5992979 - DNA, 14 bp, Homo sapiens
cacacacacacaaa

SEQ ID NO: 5992980 - DNA, 16 bp, Homo sapiens
cacacacacacacaca

SEQ ID NO: 5992981 - DNA, 16 bp, Homo sapiens
cacacacacacacact

SEQ ID NO: 5992982 - DNA, 15 bp, Homo sapiens
cacacacacacacag

SEQ ID NO: 5992983 - DNA, 16 bp, Homo sapiens
cacacacacacacata

SEQ ID NO: 5992984 - DNA, 14 bp, Homo sapiens
cacacacacacact

SEQ ID NO: 5992985 - DNA, 15 bp, Homo sapiens
cacacacacacactg

SEQ ID NO: 5992986 - DNA, 14 bp, Homo sapiens
cacacacacacagc

SEQ ID NO: 5992987 - DNA, 16 bp, Homo sapiens
cacacacacacagcca

SEQ ID NO: 5992988 - DNA, 16 bp, Homo sapiens
cacacacacacaggag

SEQ ID NO: 5992989 - DNA, 14 bp, Homo sapiens
cacacacacacatc

SEQ ID NO: 5992990 - DNA, 15 bp, Homo sapiens
cacacacacacgcac

SEQ ID NO: 5992991 - DNA, 16 bp, Homo sapiens
cacacacacacgcaga

SEQ ID NO: 5992992 - DNA, 11 bp, Homo sapiens
cacacacacag

SEQ ID NO: 5992993 - DNA, 14 bp, Homo sapiens
cacacacacagcca

SEQ ID NO: 5992994 - DNA, 15 bp, Homo sapiens
cacacacacagccac

SEQ ID NO: 5992995 - DNA, 12 bp, Homo sapiens
cacacacacagg

SEQ ID NO: 5992996 - DNA, 13 bp, Homo sapiens
cacacacacatat

SEQ ID NO: 5992997 - DNA, 16 bp, Homo sapiens
cacacacacatatatg

SEQ ID NO: 5992998 - DNA, 15 bp, Homo sapiens
cacacacacatgcat

SEQ ID NO: 5992999 - DNA, 13 bp, Homo sapiens
cacacacacccgc

SEQ ID NO: 5993000 - DNA, 13 bp, Homo sapiens
cacacacacgcag

SEQ ID NO: 5993001 - DNA, 14 bp, Homo sapiens
cacacacacgcaga

SEQ ID NO: 5993002 - DNA, 14 bp, Homo sapiens
cacacacactcact

SEQ ID NO: 5993003 - DNA, 11 bp, Homo sapiens
cacacacagaa

SEQ ID NO: 5993004 - DNA, 14 bp, Homo sapiens
cacacacagaaaat

SEQ ID NO: 5993005 - DNA, 16 bp, Homo sapiens
cacacacagaaaatat

SEQ ID NO: 5993006 - DNA, 20 bp, Homo sapiens
cacacacagaaaatatactg

SEQ ID NO: 5993007 - DNA, 21 bp, Homo sapiens
cacacacagaaaatatactgt

SEQ ID NO: 5993008 - DNA, 14 bp, Homo sapiens
cacacacagcagct

SEQ ID NO: 5993009 - DNA, 15 bp, Homo sapiens
cacacacagcagctc

SEQ ID NO: 5993010 - DNA, 18 bp, Homo sapiens
cacacacagcagctccaa

SEQ ID NO: 5993011 - DNA, 13 bp, Homo sapiens
cacacacagcctg

SEQ ID NO: 5993012 - DNA, 11 bp, Homo sapiens
cacacacagct

SEQ ID NO: 5993013 - DNA, 13 bp, Homo sapiens
cacacacagctcc

SEQ ID NO: 5993014 - DNA, 12 bp, Homo sapiens
cacacacagctt

SEQ ID NO: 5993015 - DNA, 21 bp, Homo sapiens
cacacacaggcaactgaggca

SEQ ID NO: 5993016 - DNA, 12 bp, Homo sapiens
cacacacaggcc

SEQ ID NO: 5993017 - DNA, 13 bp, Homo sapiens
cacacacaggtgg

SEQ ID NO: 5993018 - DNA, 14 bp, Homo sapiens
cacacacaggtggg

SEQ ID NO: 5993019 - DNA, 13 bp, Homo sapiens
cacacacagtccc

SEQ ID NO: 5993020 - DNA, 11 bp, Homo sapiens
cacacacatac

SEQ ID NO: 5993021 - DNA, 13 bp, Homo sapiens
cacacacatacag

SEQ ID NO: 5993022 - DNA, 13 bp, Homo sapiens
cacacacatagat

SEQ ID NO: 5993023 - DNA, 11 bp, Homo sapiens
cacacacatat

SEQ ID NO: 5993024 - DNA, 15 bp, Homo sapiens
cacacaccagagccc

SEQ ID NO: 5993025 - DNA, 20 bp, Homo sapiens
cacacaccagagcccacctt

SEQ ID NO: 5993026 - DNA, 20 bp, Homo sapiens
cacacaccagtttacaggaa

SEQ ID NO: 5993027 - DNA, 13 bp, Homo sapiens
cacacacccaggc

SEQ ID NO: 5993028 - DNA, 16 bp, Homo sapiens
cacacacccaggccca

SEQ ID NO: 5993029 - DNA, 13 bp, Homo sapiens
cacacaccccaat

SEQ ID NO: 5993030 - DNA, 14 bp, Homo sapiens
cacacacccctccg

SEQ ID NO: 5993031 - DNA, 14 bp, Homo sapiens
cacacaccctgagc

SEQ ID NO: 5993032 - DNA, 15 bp, Homo sapiens
cacacaccctgaggt

SEQ ID NO: 5993033 - DNA, 14 bp, Homo sapiens
cacacacccttccc

SEQ ID NO: 5993034 - DNA, 15 bp, Homo sapiens
cacacacccttcccc

SEQ ID NO: 5993035 - DNA, 13 bp, Homo sapiens
cacacacctcatg

SEQ ID NO: 5993036 - DNA, 23 bp, Homo sapiens
cacacacctccgagacagtccag

SEQ ID NO: 5993037 - DNA, 13 bp, Homo sapiens
cacacacctctgc

SEQ ID NO: 5993038 - DNA, 15 bp, Homo sapiens
cacacacctgggtgg

SEQ ID NO: 5993039 - DNA, 11 bp, Homo sapiens
cacacacctgt

SEQ ID NO: 5993040 - DNA, 15 bp, Homo sapiens
cacacacctgtagtc

SEQ ID NO: 5993041 - DNA, 15 bp, Homo sapiens
cacacacctgtctgt

SEQ ID NO: 5993042 - DNA, 16 bp, Homo sapiens
cacacacctgtctgtg

SEQ ID NO: 5993043 - DNA, 18 bp, Homo sapiens
cacacacctgtctgtgca

SEQ ID NO: 5993044 - DNA, 14 bp, Homo sapiens
cacacacgcacata

SEQ ID NO: 5993045 - DNA, 15 bp, Homo sapiens
cacacacgcacgcac

SEQ ID NO: 5993046 - DNA, 17 bp, Homo sapiens
cacacacgcacgcacac

SEQ ID NO: 5993047 - DNA, 19 bp, Homo sapiens
cacacacgcacgcacacac

SEQ ID NO: 5993048 - DNA, 15 bp, Homo sapiens
cacacacgcacggct

SEQ ID NO: 5993049 - DNA, 15 bp, Homo sapiens
cacacacgccagctc

SEQ ID NO: 5993050 - DNA, 20 bp, Homo sapiens
cacacacgcgcgcgcacaca

SEQ ID NO: 5993051 - DNA, 17 bp, Homo sapiens
cacacacgcgtgcacac

SEQ ID NO: 5993052 - DNA, 18 bp, Homo sapiens
cacacacgctccctggaa

SEQ ID NO: 5993053 - DNA, 20 bp, Homo sapiens
cacacacgctccctggaagc

SEQ ID NO: 5993054 - DNA, 13 bp, Homo sapiens
cacacactcacca

SEQ ID NO: 5993055 - DNA, 14 bp, Homo sapiens
cacacactccctgc

SEQ ID NO: 5993056 - DNA, 15 bp, Homo sapiens
cacacactccctgct

SEQ ID NO: 5993057 - DNA, 14 bp, Homo sapiens
cacacactccttcc

SEQ ID NO: 5993058 - DNA, 13 bp, Homo sapiens
cacacactggctc

SEQ ID NO: 5993059 - DNA, 20 bp, Homo sapiens
cacacactggctcctggacc

SEQ ID NO: 5993060 - DNA, 22 bp, Homo sapiens
cacacactggctcctggaccta

SEQ ID NO: 5993061 - DNA, 21 bp, Homo sapiens
cacacactgtctggggcccca

SEQ ID NO: 5993062 - DNA, 11 bp, Homo sapiens
cacacactgtg

SEQ ID NO: 5993063 - DNA, 13 bp, Homo sapiens
cacacactgtgcc

SEQ ID NO: 5993064 - DNA, 12 bp, Homo sapiens
cacacactgttt

SEQ ID NO: 5993065 - DNA, 16 bp, Homo sapiens
cacacactttctcttc

SEQ ID NO: 5993066 - DNA, 12 bp, Homo sapiens
cacacacttttg

SEQ ID NO: 5993067 - DNA, 14 bp, Homo sapiens
cacacagaaaatat

SEQ ID NO: 5993068 - DNA, 15 bp, Homo sapiens
cagacaggccctccc

SEQ ID NO: 5993069 - DNA, 20 bp, Homo sapiens
cagacaggccctccctgtct

SEQ ID NO: 5993070 - DNA, 19 bp, Homo sapiens
cagacaggctacaaagcag

SEQ ID NO: 5993071 - DNA, 21 bp, Homo sapiens
cagacaggctacaaagcagag

SEQ ID NO: 5993072 - DNA, 20 bp, Homo sapiens
cagacaggctcttagcagct

SEQ ID NO: 5993073 - DNA, 12 bp, Homo sapiens
cagacagggctc

SEQ ID NO: 5993074 - DNA, 13 bp, Homo sapiens
cagacagggctcc

SEQ ID NO: 5993075 - DNA, 16 bp, Homo sapiens
cagacagggctccagc

SEQ ID NO: 5993076 - DNA, 18 bp, Homo sapiens
cagacagggggccagaac

SEQ ID NO: 5993077 - DNA, 20 bp, Homo sapiens
cagacagggtctgaaggact

SEQ ID NO: 5993078 - DNA, 22 bp, Homo sapiens
cagacagggtgggcttcctgcc

SEQ ID NO: 5993079 - DNA, 19 bp, Homo sapiens
cagacagggtggggcttag

SEQ ID NO: 5993080 - DNA, 18 bp, Homo sapiens
cagacagggttcattgaa

SEQ ID NO: 5993081 - DNA, 19 bp, Homo sapiens
cagacaggtaaatgggcag

SEQ ID NO: 5993082 - DNA, 16 bp, Homo sapiens
cagacaggtccctccc

SEQ ID NO: 5993083 - DNA, 16 bp, Homo sapiens
cagacaggtgggagat

SEQ ID NO: 5993084 - DNA, 17 bp, Homo sapiens
cagacaggtgggagatg

SEQ ID NO: 5993085 - DNA, 18 bp, Homo sapiens
cagacaggttttcacata

SEQ ID NO: 5993086 - DNA, 21 bp, Homo sapiens
cagacaggttttcacataaat

SEQ ID NO: 5993087 - DNA, 17 bp, Homo sapiens
cagacagtcaaggagat

SEQ ID NO: 5993088 - DNA, 22 bp, Homo sapiens
cagacagtggatatgacccaca

SEQ ID NO: 5993089 - DNA, 15 bp, Homo sapiens
cagacagtgtcagag

SEQ ID NO: 5993090 - DNA, 11 bp, Homo sapiens
cagacataaag

SEQ ID NO: 5993091 - DNA, 15 bp, Homo sapiens
cagacataaagccat

SEQ ID NO: 5993092 - DNA, 22 bp, Homo sapiens
cagacataaagccatgtttcct

SEQ ID NO: 5993093 - DNA, 17 bp, Homo sapiens
cagacatacatagacat

SEQ ID NO: 5993094 - DNA, 16 bp, Homo sapiens
cagacatacttttcct

SEQ ID NO: 5993095 - DNA, 22 bp, Homo sapiens
cagacatagaagagccaagagt

SEQ ID NO: 5993096 - DNA, 16 bp, Homo sapiens
cagacatatccaaagg

SEQ ID NO: 5993097 - DNA, 18 bp, Homo sapiens
cagacatatgggatattc

SEQ ID NO: 5993098 - DNA, 17 bp, Homo sapiens
cagacatcaagtgccag

SEQ ID NO: 5993099 - DNA, 22 bp, Homo sapiens
cagacatccaaactaaaaggaa

SEQ ID NO: 5993100 - DNA, 18 bp, Homo sapiens
cagacatccttgcagttt

SEQ ID NO: 5993101 - DNA, 20 bp, Homo sapiens
cagacatctccagtgtgcca

SEQ ID NO: 5993102 - DNA, 15 bp, Homo sapiens
cagacatctctgcac

SEQ ID NO: 5993103 - DNA, 17 bp, Homo sapiens
cagacatctctgcaccc

SEQ ID NO: 5993104 - DNA, 16 bp, Homo sapiens
cagacatctctggagc

SEQ ID NO: 5993105 - DNA, 17 bp, Homo sapiens
cagacatgaaataaaga

SEQ ID NO: 5993106 - DNA, 21 bp, Homo sapiens
cagacatgaaataaagaattt

SEQ ID NO: 5993107 - DNA, 19 bp, Homo sapiens
cagacatgaaatgtacatg

SEQ ID NO: 5993108 - DNA, 23 bp, Homo sapiens
cagacatgctctttttttaagtg

SEQ ID NO: 5993109 - DNA, 16 bp, Homo sapiens
cagacatgctgcccac

SEQ ID NO: 5993110 - DNA, 17 bp, Homo sapiens
cagacatgctgcccacc

SEQ ID NO: 5993111 - DNA, 18 bp, Homo sapiens
cagacatgctgcccaccc

SEQ ID NO: 5993112 - DNA, 14 bp, Homo sapiens
cagacatggagatg

SEQ ID NO: 5993113 - DNA, 22 bp, Homo sapiens
cagacatgttttccgtgaaaac

SEQ ID NO: 5993114 - DNA, 16 bp, Homo sapiens
cagacattaaataatc

SEQ ID NO: 5993115 - DNA, 16 bp, Homo sapiens
cagacattctgccagg

SEQ ID NO: 5993116 - DNA, 22 bp, Homo sapiens
cagacattgagtttacttataa

SEQ ID NO: 5993117 - DNA, 14 bp, Homo sapiens
cagacattggcacc

SEQ ID NO: 5993118 - DNA, 13 bp, Homo sapiens
cagacattgtatt

SEQ ID NO: 5993119 - DNA, 14 bp, Homo sapiens
cagacattgtcagc

SEQ ID NO: 5993120 - DNA, 15 bp, Homo sapiens
cagacattgtcagca

SEQ ID NO: 5993121 - DNA, 21 bp, Homo sapiens
cagacattgttacaaggacat

SEQ ID NO: 5993122 - DNA, 13 bp, Homo sapiens
cagacatttatct

SEQ ID NO: 5993123 - DNA, 12 bp, Homo sapiens
cagacatttctt

SEQ ID NO: 5993124 - DNA, 21 bp, Homo sapiens
cagacattttcactggaagat

SEQ ID NO: 5993125 - DNA, 20 bp, Homo sapiens
cagacattttcctcacaccc

SEQ ID NO: 5993126 - DNA, 19 bp, Homo sapiens
cagacatttttggaaattt

SEQ ID NO: 5993127 - DNA, 15 bp, Homo sapiens
cagaccaaccctggg

SEQ ID NO: 5993128 - DNA, 16 bp, Homo sapiens
cagaccaaccctggga

SEQ ID NO: 5993129 - DNA, 21 bp, Homo sapiens
cagaccaacgttactcagggc

SEQ ID NO: 5993130 - DNA, 18 bp, Homo sapiens
cagaccaactctctcctg

SEQ ID NO: 5993131 - DNA, 17 bp, Homo sapiens
cagaccaaggcagggcc

SEQ ID NO: 5993132 - DNA, 19 bp, Homo sapiens
cagaccaaggcagggccca

SEQ ID NO: 5993133 - DNA, 23 bp, Homo sapiens
cagaccaaggcagggcccagcat

SEQ ID NO: 5993134 - DNA, 16 bp, Homo sapiens
cagaccaagtccaagc

SEQ ID NO: 5993135 - DNA, 17 bp, Homo sapiens
cagaccaagtccaagcc

SEQ ID NO: 5993136 - DNA, 14 bp, Homo sapiens
cagaccacaaaact

SEQ ID NO: 5993137 - DNA, 20 bp, Homo sapiens
cagaccacactctgcctggc

SEQ ID NO: 5993138 - DNA, 15 bp, Homo sapiens
cagaccacaggaaga

SEQ ID NO: 5993139 - DNA, 15 bp, Homo sapiens
cagaccacatgcccc

SEQ ID NO: 5993140 - DNA, 19 bp, Homo sapiens
cagaccaccccgcctgccc

SEQ ID NO: 5993141 - DNA, 19 bp, Homo sapiens
cagaccacctccctgccct

SEQ ID NO: 5993142 - DNA, 16 bp, Homo sapiens
cagaccacctgccagc

SEQ ID NO: 5993143 - DNA, 20 bp, Homo sapiens
cagaccacctgccagccatc

SEQ ID NO: 5993144 - DNA, 21 bp, Homo sapiens
cagaccacctgccagccatca

SEQ ID NO: 5993145 - DNA, 22 bp, Homo sapiens
cagaccacctgccagccatcac

SEQ ID NO: 5993146 - DNA, 17 bp, Homo sapiens
cagaccacctgcttctg

SEQ ID NO: 5993147 - DNA, 18 bp, Homo sapiens
cagaccacgcccctgcct

SEQ ID NO: 5993148 - DNA, 22 bp, Homo sapiens
cagaccacgcccgtcctgcctg

SEQ ID NO: 5993149 - DNA, 13 bp, Homo sapiens
cagaccacttgcc

SEQ ID NO: 5993150 - DNA, 18 bp, Homo sapiens
cagaccacttgccacgct

SEQ ID NO: 5993151 - DNA, 12 bp, Homo sapiens
cagaccagagct

SEQ ID NO: 5993152 - DNA, 13 bp, Homo sapiens
cagaccagagctc

SEQ ID NO: 5993153 - DNA, 15 bp, Homo sapiens
cagaccagagctctg

SEQ ID NO: 5993154 - DNA, 22 bp, Homo sapiens
cagaccagcagcaatctgtctt

SEQ ID NO: 5993155 - DNA, 21 bp, Homo sapiens
cagaccagcatagttctgcaa

SEQ ID NO: 5993156 - DNA, 13 bp, Homo sapiens
cagaccaggaaag

SEQ ID NO: 5993157 - DNA, 16 bp, Homo sapiens
cagaccaggaaaggct

SEQ ID NO: 5993158 - DNA, 17 bp, Homo sapiens
cagaccaggaaaggctt

SEQ ID NO: 5993159 - DNA, 18 bp, Homo sapiens
cagaccaggaaggaagag

SEQ ID NO: 5993160 - DNA, 12 bp, Homo sapiens
cagaccaggcct

SEQ ID NO: 5993161 - DNA, 14 bp, Homo sapiens
cagaccaggccttt

SEQ ID NO: 5993162 - DNA, 13 bp, Homo sapiens
cagaccagtagtg

SEQ ID NO: 5993163 - DNA, 17 bp, Homo sapiens
cagaccagtagtgacca

SEQ ID NO: 5993164 - DNA, 18 bp, Homo sapiens
cagaccagtagtgaccaa

SEQ ID NO: 5993165 - DNA, 19 bp, Homo sapiens
cagaccagtagtgaccaat

SEQ ID NO: 5993166 - DNA, 20 bp, Homo sapiens
cagaccagtagtgaccaatc

SEQ ID NO: 5993167 - DNA, 17 bp, Homo sapiens
cagaccagtgaccccag

SEQ ID NO: 5993168 - DNA, 20 bp, Homo sapiens
cagaccagtgaccccagaaa

SEQ ID NO: 5993169 - DNA, 16 bp, Homo sapiens
cagaccatatttttaa

SEQ ID NO: 5993170 - DNA, 15 bp, Homo sapiens
cagaccatctccagc

SEQ ID NO: 5993171 - DNA, 14 bp, Homo sapiens
cagaccatggacac

SEQ ID NO: 5993172 - DNA, 22 bp, Homo sapiens
cagaccatggacactacaccca

SEQ ID NO: 5993173 - DNA, 19 bp, Homo sapiens
cagaccattggggctccca

SEQ ID NO: 5993174 - DNA, 21 bp, Homo sapiens
cagaccattggggctcccagc

SEQ ID NO: 5993175 - DNA, 22 bp, Homo sapiens
cagaccattggggctcccagcc

SEQ ID NO: 5993176 - DNA, 16 bp, Homo sapiens
cagaccattgtcttcc

SEQ ID NO: 5993177 - DNA, 22 bp, Homo sapiens
cagacccaacccatgcccctga

SEQ ID NO: 5993178 - DNA, 22 bp, Homo sapiens
cagacccaactcgcctgtggac

SEQ ID NO: 5993179 - DNA, 15 bp, Homo sapiens
cagacccacacatgt

SEQ ID NO: 5993180 - DNA, 15 bp, Homo sapiens
cagacccacccccag

SEQ ID NO: 5993181 - DNA, 17 bp, Homo sapiens
cagacccacccccagcc

SEQ ID NO: 5993182 - DNA, 13 bp, Homo sapiens
cagacccacctgg

SEQ ID NO: 5993183 - DNA, 21 bp, Homo sapiens
cagacccacctggagcccgct

SEQ ID NO: 5993184 - DNA, 15 bp, Homo sapiens
cagacccagaggccc

SEQ ID NO: 5993185 - DNA, 22 bp, Homo sapiens
cagacccagaggccctgaagcc

SEQ ID NO: 5993186 - DNA, 14 bp, Homo sapiens
cagacccagaggtc

SEQ ID NO: 5993187 - DNA, 20 bp, Homo sapiens
cagacccagaggtccaggtc

SEQ ID NO: 5993188 - DNA, 15 bp, Homo sapiens
cagacccagcttaga

SEQ ID NO: 5993189 - DNA, 11 bp, Homo sapiens
cagacccagga

SEQ ID NO: 5993190 - DNA, 21 bp, Homo sapiens
cagacccaggggtccaggccc

SEQ ID NO: 5993191 - DNA, 14 bp, Homo sapiens
cagacccagggtgg

SEQ ID NO: 5993192 - DNA, 19 bp, Homo sapiens
cagacccaggtcttccaga

SEQ ID NO: 5993193 - DNA, 13 bp, Homo sapiens
cagacccagtccc

SEQ ID NO: 5993194 - DNA, 17 bp, Homo sapiens
cagacccagtcccacac

SEQ ID NO: 5993195 - DNA, 22 bp, Homo sapiens
cagaccccaccctacgctcatc

SEQ ID NO: 5993196 - DNA, 23 bp, Homo sapiens
cagaccccaccctgtctgcaggc

SEQ ID NO: 5993197 - DNA, 18 bp, Homo sapiens
cagaccccacgctgacca

SEQ ID NO: 5993198 - DNA, 18 bp, Homo sapiens
cagaccccagaactagaa

SEQ ID NO: 5993199 - DNA, 15 bp, Homo sapiens
cagaccccagcggct

SEQ ID NO: 5993200 - DNA, 13 bp, Homo sapiens
cagaccccagctg

SEQ ID NO: 5993201 - DNA, 17 bp, Homo sapiens
cagaccccatccagcca

SEQ ID NO: 5993202 - DNA, 20 bp, Homo sapiens
cagaccccatccagccaggg

SEQ ID NO: 5993203 - DNA, 14 bp, Homo sapiens
cagacccccacccc

SEQ ID NO: 5993204 - DNA, 17 bp, Homo sapiens
cagacccccaccccttc

SEQ ID NO: 5993205 - DNA, 20 bp, Homo sapiens
cagacccccaccccttcccc

SEQ ID NO: 5993206 - DNA, 22 bp, Homo sapiens
cagacccccaccccttccccac

SEQ ID NO: 5993207 - DNA, 23 bp, Homo sapiens
cagacccccaccccttccccact

SEQ ID NO: 5993208 - DNA, 13 bp, Homo sapiens
cagacccccactc

SEQ ID NO: 5993209 - DNA, 17 bp, Homo sapiens
cagacccccagcaaccc

SEQ ID NO: 5993210 - DNA, 15 bp, Homo sapiens
cagacccccagtgta

SEQ ID NO: 5993211 - DNA, 14 bp, Homo sapiens
cagaccccccagcc

SEQ ID NO: 5993212 - DNA, 13 bp, Homo sapiens
cagaccccctgag

SEQ ID NO: 5993213 - DNA, 15 bp, Homo sapiens
cagaccccctggaga

SEQ ID NO: 5993214 - DNA, 19 bp, Homo sapiens
cagaccccgacaccggcca

SEQ ID NO: 5993215 - DNA, 16 bp, Homo sapiens
cagaccccgagccacc

SEQ ID NO: 5993216 - DNA, 20 bp, Homo sapiens
cagaccccgcagcacgcctc

SEQ ID NO: 5993217 - DNA, 13 bp, Homo sapiens
cagaccccgcccc

SEQ ID NO: 5993218 - DNA, 15 bp, Homo sapiens
cagaccccgtggctc

SEQ ID NO: 5993219 - DNA, 18 bp, Homo sapiens
cagaccccgtggctctgg

SEQ ID NO: 5993220 - DNA, 19 bp, Homo sapiens
cagaccccgtggctctggg

SEQ ID NO: 5993221 - DNA, 22 bp, Homo sapiens
cagaccccgtggctctgggaga

SEQ ID NO: 5993222 - DNA, 15 bp, Homo sapiens
cagacccctaccctt

SEQ ID NO: 5993223 - DNA, 14 bp, Homo sapiens
cagacccctaggga

SEQ ID NO: 5993224 - DNA, 14 bp, Homo sapiens
cagacccctcagcc

SEQ ID NO: 5993225 - DNA, 17 bp, Homo sapiens
cagacccctcagcccca

SEQ ID NO: 5993226 - DNA, 18 bp, Homo sapiens
cagacccctcagccccag

SEQ ID NO: 5993227 - DNA, 12 bp, Homo sapiens
cagacccctgcc

SEQ ID NO: 5993228 - DNA, 22 bp, Homo sapiens
cagacccctggcttttcactgc

SEQ ID NO: 5993229 - DNA, 12 bp, Homo sapiens
cagacccctggg

SEQ ID NO: 5993230 - DNA, 14 bp, Homo sapiens
cagacccctgggag

SEQ ID NO: 5993231 - DNA, 15 bp, Homo sapiens
cagacccctggggga

SEQ ID NO: 5993232 - DNA, 24 bp, Homo sapiens
cagacccctgggggaggcttccag

SEQ ID NO: 5993233 - DNA, 13 bp, Homo sapiens
cagacccctgtgg

SEQ ID NO: 5993234 - DNA, 17 bp, Homo sapiens
cagacccctgtggcaga

SEQ ID NO: 5993235 - DNA, 16 bp, Homo sapiens
cagaccccttcagcca

SEQ ID NO: 5993236 - DNA, 15 bp, Homo sapiens
cagaccccttggctt

SEQ ID NO: 5993237 - DNA, 18 bp, Homo sapiens
cagaccctaccccaccac

SEQ ID NO: 5993238 - DNA, 21 bp, Homo sapiens
cagaccctccttccccacccc

SEQ ID NO: 5993239 - DNA, 22 bp, Homo sapiens
cagaccctccttccccacccca

SEQ ID NO: 5993240 - DNA, 14 bp, Homo sapiens
cagaccctctgccg

SEQ ID NO: 5993241 - DNA, 14 bp, Homo sapiens
cagaccctgcccac

SEQ ID NO: 5993242 - DNA, 14 bp, Homo sapiens
cagaccctgccctg

SEQ ID NO: 5993243 - DNA, 17 bp, Homo sapiens
cagaccctgccctgtgg

SEQ ID NO: 5993244 - DNA, 17 bp, Homo sapiens
cagaccctgcttaggat

SEQ ID NO: 5993245 - DNA, 13 bp, Homo sapiens
cagaccctggacc

SEQ ID NO: 5993246 - DNA, 14 bp, Homo sapiens
cagaccctggagga

SEQ ID NO: 5993247 - DNA, 14 bp, Homo sapiens
cacacagaaatata

SEQ ID NO: 5993248 - DNA, 22 bp, Homo sapiens
cacacagaactggcaggagcct

SEQ ID NO: 5993249 - DNA, 14 bp, Homo sapiens
cacacagaccacca

SEQ ID NO: 5993250 - DNA, 22 bp, Homo sapiens
cacacagacccctcgcaactgt

SEQ ID NO: 5993251 - DNA, 21 bp, Homo sapiens
cacacagaccgcgcccctggg

SEQ ID NO: 5993252 - DNA, 18 bp, Homo sapiens
cacacagagattctggat

SEQ ID NO: 5993253 - DNA, 16 bp, Homo sapiens
cacacagagcctgcct

SEQ ID NO: 5993254 - DNA, 22 bp, Homo sapiens
cacacagaggaagagcaggcac

SEQ ID NO: 5993255 - DNA, 15 bp, Homo sapiens
cacacagaggacctc

SEQ ID NO: 5993256 - DNA, 20 bp, Homo sapiens
cacacagagtggtctttctg

SEQ ID NO: 5993257 - DNA, 16 bp, Homo sapiens
cacacagatacacaca

SEQ ID NO: 5993258 - DNA, 17 bp, Homo sapiens
cacacagatacacacac

SEQ ID NO: 5993259 - DNA, 18 bp, Homo sapiens
cacacagatacacacaca

SEQ ID NO: 5993260 - DNA, 19 bp, Homo sapiens
cacacagatcccctggaaa

SEQ ID NO: 5993261 - DNA, 19 bp, Homo sapiens
cacacagcaagtcagggtt

SEQ ID NO: 5993262 - DNA, 15 bp, Homo sapiens
cacacagcagcagtt

SEQ ID NO: 5993263 - DNA, 21 bp, Homo sapiens
cacacagcagccccccagcac

SEQ ID NO: 5993264 - DNA, 14 bp, Homo sapiens
cacacagcagctcc

SEQ ID NO: 5993265 - DNA, 10 bp, Homo sapiens
cacacagcca

SEQ ID NO: 5993266 - DNA, 12 bp, Homo sapiens
cacacagccaca

SEQ ID NO: 5993267 - DNA, 13 bp, Homo sapiens
cacacagccacac

SEQ ID NO: 5993268 - DNA, 14 bp, Homo sapiens
cacacagccacaca

SEQ ID NO: 5993269 - DNA, 15 bp, Homo sapiens
cacacagccacacac

SEQ ID NO: 5993270 - DNA, 18 bp, Homo sapiens
cacacagccacttagcag

SEQ ID NO: 5993271 - DNA, 14 bp, Homo sapiens
cacacagccaggtg

SEQ ID NO: 5993272 - DNA, 13 bp, Homo sapiens
cacacagcccaga

SEQ ID NO: 5993273 - DNA, 13 bp, Homo sapiens
cacacagcctcta

SEQ ID NO: 5993274 - DNA, 18 bp, Homo sapiens
cacacagcctctaagcgt

SEQ ID NO: 5993275 - DNA, 21 bp, Homo sapiens
cacacagcctggcctcccctg

SEQ ID NO: 5993276 - DNA, 17 bp, Homo sapiens
cacacagcctttctgta

SEQ ID NO: 5993277 - DNA, 19 bp, Homo sapiens
cacacagcggctgcctcct

SEQ ID NO: 5993278 - DNA, 12 bp, Homo sapiens
cacacagctctg

SEQ ID NO: 5993279 - DNA, 17 bp, Homo sapiens
cacacagctctgtcctg

SEQ ID NO: 5993280 - DNA, 13 bp, Homo sapiens
cacacagctgccc

SEQ ID NO: 5993281 - DNA, 14 bp, Homo sapiens
cacacagctgccct

SEQ ID NO: 5993282 - DNA, 22 bp, Homo sapiens
cacacagcttttagtacccacc

SEQ ID NO: 5993283 - DNA, 20 bp, Homo sapiens
cacacaggacccccttcccc

SEQ ID NO: 5993284 - DNA, 17 bp, Homo sapiens
cacacaggagaaaatgc

SEQ ID NO: 5993285 - DNA, 21 bp, Homo sapiens
cacacaggagtcctttctttt

SEQ ID NO: 5993286 - DNA, 13 bp, Homo sapiens
cacacaggcaact

SEQ ID NO: 5993287 - DNA, 14 bp, Homo sapiens
cacacaggcagcca

SEQ ID NO: 5993288 - DNA, 17 bp, Homo sapiens
cacacaggcagccagcc

SEQ ID NO: 5993289 - DNA, 19 bp, Homo sapiens
cacacaggcagccagccgt

SEQ ID NO: 5993290 - DNA, 12 bp, Homo sapiens
cacacaggcagg

SEQ ID NO: 5993291 - DNA, 13 bp, Homo sapiens
cacacaggcaggg

SEQ ID NO: 5993292 - DNA, 21 bp, Homo sapiens
cacacaggcctggcccagcca

SEQ ID NO: 5993293 - DNA, 14 bp, Homo sapiens
cacacaggccttct

SEQ ID NO: 5993294 - DNA, 16 bp, Homo sapiens
cacacaggccttctgt

SEQ ID NO: 5993295 - DNA, 12 bp, Homo sapiens
cacacagggcac

SEQ ID NO: 5993296 - DNA, 12 bp, Homo sapiens
cacacagggctc

SEQ ID NO: 5993297 - DNA, 19 bp, Homo sapiens
cacacagggctcacagggc

SEQ ID NO: 5993298 - DNA, 20 bp, Homo sapiens
cacacagggctcacagggca

SEQ ID NO: 5993299 - DNA, 23 bp, Homo sapiens
cacacagggtctgcaaggtcttt

SEQ ID NO: 5993300 - DNA, 17 bp, Homo sapiens
cacacaggtacagcaac

SEQ ID NO: 5993301 - DNA, 18 bp, Homo sapiens
cacacaggtacagcaaca

SEQ ID NO: 5993302 - DNA, 21 bp, Homo sapiens
cacacaggtggggactgggca

SEQ ID NO: 5993303 - DNA, 22 bp, Homo sapiens
cacacaggtggggactgggcac

SEQ ID NO: 5993304 - DNA, 20 bp, Homo sapiens
cacacaggtggtgtcactgt

SEQ ID NO: 5993305 - DNA, 12 bp, Homo sapiens
cacacagtattc

SEQ ID NO: 5993306 - DNA, 14 bp, Homo sapiens
cacacagtattttt

SEQ ID NO: 5993307 - DNA, 12 bp, Homo sapiens
cacacagtccca

SEQ ID NO: 5993308 - DNA, 19 bp, Homo sapiens
cacacagtccccagactca

SEQ ID NO: 5993309 - DNA, 13 bp, Homo sapiens
cacacagtgacaa

SEQ ID NO: 5993310 - DNA, 14 bp, Homo sapiens
cacacagtgaccaa

SEQ ID NO: 5993311 - DNA, 18 bp, Homo sapiens
cacacagtgctcaaggcc

SEQ ID NO: 5993312 - DNA, 12 bp, Homo sapiens
cacacagtggcc

SEQ ID NO: 5993313 - DNA, 22 bp, Homo sapiens
cacacagtgggccggccccagg

SEQ ID NO: 5993314 - DNA, 23 bp, Homo sapiens
cacacagtgggccggccccaggc

SEQ ID NO: 5993315 - DNA, 18 bp, Homo sapiens
cacacagtttaaaaaatc

SEQ ID NO: 5993316 - DNA, 13 bp, Homo sapiens
cacacataaagga

SEQ ID NO: 5993317 - DNA, 12 bp, Homo sapiens
cacacatacaca

SEQ ID NO: 5993318 - DNA, 14 bp, Homo sapiens
cacacatacacaca

SEQ ID NO: 5993319 - DNA, 20 bp, Homo sapiens
cacacatacgtgcacagggt

SEQ ID NO: 5993320 - DNA, 22 bp, Homo sapiens
cacacatagattaatggcactg

SEQ ID NO: 5993321 - DNA, 23 bp, Homo sapiens
cacacatagattaatggcactga

SEQ ID NO: 5993322 - DNA, 19 bp, Homo sapiens
cacacatatacatatatat

SEQ ID NO: 5993323 - DNA, 11 bp, Homo sapiens
cacacatatat

SEQ ID NO: 5993324 - DNA, 19 bp, Homo sapiens
cacacatatatacatacgc

SEQ ID NO: 5993325 - DNA, 11 bp, Homo sapiens
cacacatattc

SEQ ID NO: 5993326 - DNA, 13 bp, Homo sapiens
cacacatcaaaaa

SEQ ID NO: 5993327 - DNA, 15 bp, Homo sapiens
cacacatcagtgcac

SEQ ID NO: 5993328 - DNA, 21 bp, Homo sapiens
cacacatcatctgtaagctgt

SEQ ID NO: 5993329 - DNA, 14 bp, Homo sapiens
cacacatcccagcc

SEQ ID NO: 5993330 - DNA, 15 bp, Homo sapiens
cacacatcccaggag

SEQ ID NO: 5993331 - DNA, 15 bp, Homo sapiens
cacacatcctgtcag

SEQ ID NO: 5993332 - DNA, 19 bp, Homo sapiens
cacacatctgggtgccctg

SEQ ID NO: 5993333 - DNA, 21 bp, Homo sapiens
cacacatctgtaatcctagct

SEQ ID NO: 5993334 - DNA, 19 bp, Homo sapiens
cacacatgacgcaccagtt

SEQ ID NO: 5993335 - DNA, 20 bp, Homo sapiens
cacacatgacgcaccagtta

SEQ ID NO: 5993336 - DNA, 21 bp, Homo sapiens
cacacatgagcatcaggccag

SEQ ID NO: 5993337 - DNA, 17 bp, Homo sapiens
cacacatgcatacacac

SEQ ID NO: 5993338 - DNA, 15 bp, Homo sapiens
cacacatgccctcct

SEQ ID NO: 5993339 - DNA, 13 bp, Homo sapiens
cacacatggctta

SEQ ID NO: 5993340 - DNA, 14 bp, Homo sapiens
cacacattcacgca

SEQ ID NO: 5993341 - DNA, 15 bp, Homo sapiens
cacacattccagcca

SEQ ID NO: 5993342 - DNA, 16 bp, Homo sapiens
cacacattccagccag

SEQ ID NO: 5993343 - DNA, 17 bp, Homo sapiens
cacacattccagccagg

SEQ ID NO: 5993344 - DNA, 18 bp, Homo sapiens
cacacattccagccaggc

SEQ ID NO: 5993345 - DNA, 17 bp, Homo sapiens
cacacattccagggctg

SEQ ID NO: 5993346 - DNA, 19 bp, Homo sapiens
cacacattcccccaccagc

SEQ ID NO: 5993347 - DNA, 13 bp, Homo sapiens
cacacattgctgt

SEQ ID NO: 5993348 - DNA, 15 bp, Homo sapiens
cacacattggccgct

SEQ ID NO: 5993349 - DNA, 20 bp, Homo sapiens
cacacattgtgcttggcccc

SEQ ID NO: 5993350 - DNA, 16 bp, Homo sapiens
cacacatttcactgtc

SEQ ID NO: 5993351 - DNA, 19 bp, Homo sapiens
cacacatttcactgtctgt

SEQ ID NO: 5993352 - DNA, 13 bp, Homo sapiens
cacacatttgcct

SEQ ID NO: 5993353 - DNA, 10 bp, Homo sapiens
cacacatttt

SEQ ID NO: 5993354 - DNA, 11 bp, Homo sapiens
cacacattttt

SEQ ID NO: 5993355 - DNA, 20 bp, Homo sapiens
cacacattttttaaatgcac

SEQ ID NO: 5993356 - DNA, 15 bp, Homo sapiens
cacaccaaccaggcc

SEQ ID NO: 5993357 - DNA, 22 bp, Homo sapiens
cacaccaagctgtgccaccctg

SEQ ID NO: 5993358 - DNA, 23 bp, Homo sapiens
cacaccaagctgtgccaccctgg

SEQ ID NO: 5993359 - DNA, 12 bp, Homo sapiens
cacaccaaggcc

SEQ ID NO: 5993360 - DNA, 15 bp, Homo sapiens
cacaccaaggccctg

SEQ ID NO: 5993361 - DNA, 22 bp, Homo sapiens
cacaccaaggccctgcatctgt

SEQ ID NO: 5993362 - DNA, 15 bp, Homo sapiens
cacaccaatcagaga

SEQ ID NO: 5993363 - DNA, 16 bp, Homo sapiens
cacaccaatcagagag

SEQ ID NO: 5993364 - DNA, 20 bp, Homo sapiens
cacaccaatcagagagccta

SEQ ID NO: 5993365 - DNA, 22 bp, Homo sapiens
cacaccaatcagagagcctaga

SEQ ID NO: 5993366 - DNA, 16 bp, Homo sapiens
cacaccacaattctcc

SEQ ID NO: 5993367 - DNA, 13 bp, Homo sapiens
cacaccaccctcc

SEQ ID NO: 5993368 - DNA, 15 bp, Homo sapiens
cacaccacgcccagc

SEQ ID NO: 5993369 - DNA, 22 bp, Homo sapiens
cacaccacgtccttattggaat

SEQ ID NO: 5993370 - DNA, 14 bp, Homo sapiens
cacaccactagcct

SEQ ID NO: 5993371 - DNA, 19 bp, Homo sapiens
cacaccagaagtgccatgc

SEQ ID NO: 5993372 - DNA, 22 bp, Homo sapiens
cacaccagaagtgccatgctca

SEQ ID NO: 5993373 - DNA, 13 bp, Homo sapiens
cacaccagagaac

SEQ ID NO: 5993374 - DNA, 21 bp, Homo sapiens
cacaccagagcccaccttggc

SEQ ID NO: 5993375 - DNA, 12 bp, Homo sapiens
cacaccagccat

SEQ ID NO: 5993376 - DNA, 12 bp, Homo sapiens
cacaccagccct

SEQ ID NO: 5993377 - DNA, 14 bp, Homo sapiens
cacaccagccctgg

SEQ ID NO: 5993378 - DNA, 15 bp, Homo sapiens
cacaccagccctggt

SEQ ID NO: 5993379 - DNA, 14 bp, Homo sapiens
cacaccagcctcct

SEQ ID NO: 5993380 - DNA, 22 bp, Homo sapiens
cacaccagccttggtgccacca

SEQ ID NO: 5993381 - DNA, 21 bp, Homo sapiens
cacaccaggctgtgggcctca

SEQ ID NO: 5993382 - DNA, 18 bp, Homo sapiens
cacaccagggcaactctt

SEQ ID NO: 5993383 - DNA, 18 bp, Homo sapiens
cacaccagggccagcctc

SEQ ID NO: 5993384 - DNA, 20 bp, Homo sapiens
cacaccagggccagcctcta

SEQ ID NO: 5993385 - DNA, 15 bp, Homo sapiens
cacaccagtgcaagc

SEQ ID NO: 5993386 - DNA, 22 bp, Homo sapiens
cacaccagttgaactgcaggaa

SEQ ID NO: 5993387 - DNA, 15 bp, Homo sapiens
cacaccagttttgag

SEQ ID NO: 5993388 - DNA, 15 bp, Homo sapiens
cacaccataagctac

SEQ ID NO: 5993389 - DNA, 17 bp, Homo sapiens
cacaccatcaccctctg

SEQ ID NO: 5993390 - DNA, 22 bp, Homo sapiens
cacaccatctggcccaggctgg

SEQ ID NO: 5993391 - DNA, 23 bp, Homo sapiens
cacaccatctggcccaggctggc

SEQ ID NO: 5993392 - DNA, 17 bp, Homo sapiens
cacaccattctcctgcc

SEQ ID NO: 5993393 - DNA, 22 bp, Homo sapiens
cacaccattctcctgcctcagc

SEQ ID NO: 5993394 - DNA, 19 bp, Homo sapiens
cacaccattgcatgaattc

SEQ ID NO: 5993395 - DNA, 21 bp, Homo sapiens
cacaccattttgtaaatgaaa

SEQ ID NO: 5993396 - DNA, 22 bp, Homo sapiens
cacacccaaagctgagcctgca

SEQ ID NO: 5993397 - DNA, 14 bp, Homo sapiens
cacacccaccccct

SEQ ID NO: 5993398 - DNA, 21 bp, Homo sapiens
cacacccaccccctgcctggt

SEQ ID NO: 5993399 - DNA, 13 bp, Homo sapiens
cacacccaccctt

SEQ ID NO: 5993400 - DNA, 14 bp, Homo sapiens
cacacccaccgtcc

SEQ ID NO: 5993401 - DNA, 16 bp, Homo sapiens
cacacccacctctgcc

SEQ ID NO: 5993402 - DNA, 15 bp, Homo sapiens
cacacccacctgctg

SEQ ID NO: 5993403 - DNA, 14 bp, Homo sapiens
cacacccactcagc

SEQ ID NO: 5993404 - DNA, 13 bp, Homo sapiens
cacacccactccc

SEQ ID NO: 5993405 - DNA, 22 bp, Homo sapiens
cacacccagagggtagggcagc

SEQ ID NO: 5993406 - DNA, 23 bp, Homo sapiens
cacacccagagggtagggcagca

SEQ ID NO: 5993407 - DNA, 13 bp, Homo sapiens
cacacccagccca

SEQ ID NO: 5993408 - DNA, 14 bp, Homo sapiens
cacacccagcctca

SEQ ID NO: 5993409 - DNA, 19 bp, Homo sapiens
cacacccagcctcagtcct

SEQ ID NO: 5993410 - DNA, 14 bp, Homo sapiens
cacacccagcctgt

SEQ ID NO: 5993411 - DNA, 23 bp, Homo sapiens
cacacccaggcacttaagcacaa

SEQ ID NO: 5993412 - DNA, 22 bp, Homo sapiens
cacacccaggcccatgccaagg

SEQ ID NO: 5993413 - DNA, 15 bp, Homo sapiens
cacacccaggtctct

SEQ ID NO: 5993414 - DNA, 22 bp, Homo sapiens
cacacccaggtctcttcctttg

SEQ ID NO: 5993415 - DNA, 23 bp, Homo sapiens
cacacccaggtgatttcctctaa

SEQ ID NO: 5993416 - DNA, 16 bp, Homo sapiens
cacacccatggcctca

SEQ ID NO: 5993417 - DNA, 15 bp, Homo sapiens
cacaccccaacatgc

SEQ ID NO: 5993418 - DNA, 13 bp, Homo sapiens
cacaccccacacc

SEQ ID NO: 5993419 - DNA, 13 bp, Homo sapiens
cacaccccacctg

SEQ ID NO: 5993420 - DNA, 19 bp, Homo sapiens
cacaccccacctgcgcttc

SEQ ID NO: 5993421 - DNA, 14 bp, Homo sapiens
cacaccccagactc

SEQ ID NO: 5993422 - DNA, 18 bp, Homo sapiens
cacaccccagactccagg

SEQ ID NO: 5993423 - DNA, 19 bp, Homo sapiens
cacaccccagactccaggc

SEQ ID NO: 5993424 - DNA, 20 bp, Homo sapiens
cacaccccagactccaggcc

SEQ ID NO: 5993425 - DNA, 13 bp, Homo sapiens
cacaccccagccc

SEQ ID NO: 5993426 - DNA, 13 bp, Homo sapiens
cacacccccagag

SEQ ID NO: 5993427 - DNA, 18 bp, Homo sapiens
cacaccccgtctgcccct

SEQ ID NO: 5993428 - DNA, 14 bp, Homo sapiens
cagaccctggaggc

SEQ ID NO: 5993429 - DNA, 22 bp, Homo sapiens
cagaccctggaggccccaaccc

SEQ ID NO: 5993430 - DNA, 23 bp, Homo sapiens
cagacccttcttgcctgctgggc

SEQ ID NO: 5993431 - DNA, 21 bp, Homo sapiens
cagacccttgaagatgtagct

SEQ ID NO: 5993432 - DNA, 13 bp, Homo sapiens
cagaccgcgcccc

SEQ ID NO: 5993433 - DNA, 20 bp, Homo sapiens
cagaccgcgcccctgggact

SEQ ID NO: 5993434 - DNA, 15 bp, Homo sapiens
cagaccgggcccccc

SEQ ID NO: 5993435 - DNA, 18 bp, Homo sapiens
cagaccgggggccagaca

SEQ ID NO: 5993436 - DNA, 20 bp, Homo sapiens
cagaccgggggccagacaca

SEQ ID NO: 5993437 - DNA, 23 bp, Homo sapiens
cagaccggggtggagtcagggct

SEQ ID NO: 5993438 - DNA, 17 bp, Homo sapiens
cagacctaaagcaagcc

SEQ ID NO: 5993439 - DNA, 18 bp, Homo sapiens
cagacctaaagcaagcct

SEQ ID NO: 5993440 - DNA, 15 bp, Homo sapiens
cagacctaagccctg

SEQ ID NO: 5993441 - DNA, 15 bp, Homo sapiens
cagacctaatatcat

SEQ ID NO: 5993442 - DNA, 17 bp, Homo sapiens
cagacctaatatcattt

SEQ ID NO: 5993443 - DNA, 20 bp, Homo sapiens
cagacctagggatcctgaga

SEQ ID NO: 5993444 - DNA, 19 bp, Homo sapiens
cagacctcaagggacaggg

SEQ ID NO: 5993445 - DNA, 14 bp, Homo sapiens
cagacctcacacct

SEQ ID NO: 5993446 - DNA, 15 bp, Homo sapiens
cagacctcacctcca

SEQ ID NO: 5993447 - DNA, 14 bp, Homo sapiens
cagacctcagagat

SEQ ID NO: 5993448 - DNA, 13 bp, Homo sapiens
cagacctcatgcc

SEQ ID NO: 5993449 - DNA, 22 bp, Homo sapiens
cagacctccagattattttcta

SEQ ID NO: 5993450 - DNA, 23 bp, Homo sapiens
cagacctccccagcccctagccc

SEQ ID NO: 5993451 - DNA, 19 bp, Homo sapiens
cagacctctgaatgtccca

SEQ ID NO: 5993452 - DNA, 21 bp, Homo sapiens
cagacctctgaatgtcccaga

SEQ ID NO: 5993453 - DNA, 22 bp, Homo sapiens
cagacctctgaatgtcccagag

SEQ ID NO: 5993454 - DNA, 23 bp, Homo sapiens
cagacctctgaatgtcccagagg

SEQ ID NO: 5993455 - DNA, 16 bp, Homo sapiens
cagacctctgatccct

SEQ ID NO: 5993456 - DNA, 14 bp, Homo sapiens
cagacctctgcttg

SEQ ID NO: 5993457 - DNA, 13 bp, Homo sapiens
cagacctctggat

SEQ ID NO: 5993458 - DNA, 17 bp, Homo sapiens
cagacctgaatgcttct

SEQ ID NO: 5993459 - DNA, 21 bp, Homo sapiens
cagacctgacaccgtccctca

SEQ ID NO: 5993460 - DNA, 13 bp, Homo sapiens
cagacctgagcgg

SEQ ID NO: 5993461 - DNA, 21 bp, Homo sapiens
cagacctgagcgggagtcagg

SEQ ID NO: 5993462 - DNA, 22 bp, Homo sapiens
cagacctgagctccccaccacc

SEQ ID NO: 5993463 - DNA, 12 bp, Homo sapiens
cagacctgcagt

SEQ ID NO: 5993464 - DNA, 13 bp, Homo sapiens
cagacctgcagtg

SEQ ID NO: 5993465 - DNA, 15 bp, Homo sapiens
cagacctgcagtgag

SEQ ID NO: 5993466 - DNA, 20 bp, Homo sapiens
cagacctgcagtgaggggcc

SEQ ID NO: 5993467 - DNA, 23 bp, Homo sapiens
cagacctgcagtgaggggccctc

SEQ ID NO: 5993468 - DNA, 18 bp, Homo sapiens
cagacctgcatggtcaag

SEQ ID NO: 5993469 - DNA, 15 bp, Homo sapiens
cagacctgcattgaa

SEQ ID NO: 5993470 - DNA, 14 bp, Homo sapiens
cagacctgcccctc

SEQ ID NO: 5993471 - DNA, 18 bp, Homo sapiens
cagacctgcccctccctc

SEQ ID NO: 5993472 - DNA, 17 bp, Homo sapiens
cagacctgcctgtctcc

SEQ ID NO: 5993473 - DNA, 23 bp, Homo sapiens
cagacctgcttcctgaaataaac

SEQ ID NO: 5993474 - DNA, 12 bp, Homo sapiens
cagacctggaca

SEQ ID NO: 5993475 - DNA, 12 bp, Homo sapiens
cagacctggagc

SEQ ID NO: 5993476 - DNA, 13 bp, Homo sapiens
cagacctggagcc

SEQ ID NO: 5993477 - DNA, 21 bp, Homo sapiens
cagacctggagcccctgggtg

SEQ ID NO: 5993478 - DNA, 22 bp, Homo sapiens
cagacctggagcccctgggtgg

SEQ ID NO: 5993479 - DNA, 21 bp, Homo sapiens
cagacctggagcttcagccag

SEQ ID NO: 5993480 - DNA, 12 bp, Homo sapiens
cagacctggctc

SEQ ID NO: 5993481 - DNA, 13 bp, Homo sapiens
cagacctggctct

SEQ ID NO: 5993482 - DNA, 20 bp, Homo sapiens
cagacctggctctcagagga

SEQ ID NO: 5993483 - DNA, 13 bp, Homo sapiens
cagacctggctgg

SEQ ID NO: 5993484 - DNA, 17 bp, Homo sapiens
cagacctggctgggcct

SEQ ID NO: 5993485 - DNA, 13 bp, Homo sapiens
cagacctgggact

SEQ ID NO: 5993486 - DNA, 14 bp, Homo sapiens
cagacctgggccct

SEQ ID NO: 5993487 - DNA, 17 bp, Homo sapiens
cagacctgggccctggt

SEQ ID NO: 5993488 - DNA, 15 bp, Homo sapiens
cagacctggtgctct

SEQ ID NO: 5993489 - DNA, 15 bp, Homo sapiens
cagacctgtcaccct

SEQ ID NO: 5993490 - DNA, 20 bp, Homo sapiens
cagacctgtcgtctctccca

SEQ ID NO: 5993491 - DNA, 22 bp, Homo sapiens
cagacctgtcgtctctcccacc

SEQ ID NO: 5993492 - DNA, 13 bp, Homo sapiens
cagacctgtcttc

SEQ ID NO: 5993493 - DNA, 19 bp, Homo sapiens
cagacctgttagcagacag

SEQ ID NO: 5993494 - DNA, 19 bp, Homo sapiens
cagaccttaagacactgtg

SEQ ID NO: 5993495 - DNA, 16 bp, Homo sapiens
cagaccttcacagatg

SEQ ID NO: 5993496 - DNA, 18 bp, Homo sapiens
cagacctttactgatact

SEQ ID NO: 5993497 - DNA, 15 bp, Homo sapiens
cagacgagacaccct

SEQ ID NO: 5993498 - DNA, 15 bp, Homo sapiens
cagacgaggggcttc

SEQ ID NO: 5993499 - DNA, 22 bp, Homo sapiens
cagacgcaagaggtttcagcat

SEQ ID NO: 5993500 - DNA, 20 bp, Homo sapiens
cagacgcatagactgaggta

SEQ ID NO: 5993501 - DNA, 15 bp, Homo sapiens
cagacgccacctggc

SEQ ID NO: 5993502 - DNA, 14 bp, Homo sapiens
cagacgccaggcac

SEQ ID NO: 5993503 - DNA, 22 bp, Homo sapiens
cagacgccaggcaccacagcct

SEQ ID NO: 5993504 - DNA, 23 bp, Homo sapiens
cagacgccaggcaccacagcctc

SEQ ID NO: 5993505 - DNA, 14 bp, Homo sapiens
cagacgcctggctg

SEQ ID NO: 5993506 - DNA, 16 bp, Homo sapiens
cagacgcctggctgct

SEQ ID NO: 5993507 - DNA, 17 bp, Homo sapiens
cagacgcctggctgctg

SEQ ID NO: 5993508 - DNA, 15 bp, Homo sapiens
cagacgccttactgg

SEQ ID NO: 5993509 - DNA, 22 bp, Homo sapiens
cagacgctcattcagcatctga

SEQ ID NO: 5993510 - DNA, 17 bp, Homo sapiens
cagacgcttgcgccgag

SEQ ID NO: 5993511 - DNA, 12 bp, Homo sapiens
cagacggacggg

SEQ ID NO: 5993512 - DNA, 22 bp, Homo sapiens
cagacggatgcccattcctgcc

SEQ ID NO: 5993513 - DNA, 15 bp, Homo sapiens
cagacggcacccacc

SEQ ID NO: 5993514 - DNA, 18 bp, Homo sapiens
cagacggcccgccgtgcc

SEQ ID NO: 5993515 - DNA, 19 bp, Homo sapiens
cagacggcccgccgtgcct

SEQ ID NO: 5993516 - DNA, 23 bp, Homo sapiens
cagacggccggccggacctctga

SEQ ID NO: 5993517 - DNA, 14 bp, Homo sapiens
cagacggcctaggg

SEQ ID NO: 5993518 - DNA, 15 bp, Homo sapiens
cagacggcctagggg

SEQ ID NO: 5993519 - DNA, 18 bp, Homo sapiens
cagacggcctaggggtgg

SEQ ID NO: 5993520 - DNA, 20 bp, Homo sapiens
cagacggcggccaggcacag

SEQ ID NO: 5993521 - DNA, 21 bp, Homo sapiens
cagacggcggccaggcacagg

SEQ ID NO: 5993522 - DNA, 21 bp, Homo sapiens
cagacgggaatgcctaggtcc

SEQ ID NO: 5993523 - DNA, 21 bp, Homo sapiens
cagacgggcaagaagctgctt

SEQ ID NO: 5993524 - DNA, 15 bp, Homo sapiens
cagacgggcacagac

SEQ ID NO: 5993525 - DNA, 17 bp, Homo sapiens
cagacgggctgagagga

SEQ ID NO: 5993526 - DNA, 19 bp, Homo sapiens
cagacgggtctgagactga

SEQ ID NO: 5993527 - DNA, 19 bp, Homo sapiens
cagacggttcaccagcctc

SEQ ID NO: 5993528 - DNA, 17 bp, Homo sapiens
cagacgtaggggagggg

SEQ ID NO: 5993529 - DNA, 15 bp, Homo sapiens
cagacgtcaggccct

SEQ ID NO: 5993530 - DNA, 19 bp, Homo sapiens
cagacgtccatagctcctc

SEQ ID NO: 5993531 - DNA, 20 bp, Homo sapiens
cagacgtccatagctcctct

SEQ ID NO: 5993532 - DNA, 23 bp, Homo sapiens
cagacgtcgtacccagccatgtg

SEQ ID NO: 5993533 - DNA, 15 bp, Homo sapiens
cagacgtctcaagac

SEQ ID NO: 5993534 - DNA, 18 bp, Homo sapiens
cagacgtctggccctggc

SEQ ID NO: 5993535 - DNA, 17 bp, Homo sapiens
cagacgtgagtgtgact

SEQ ID NO: 5993536 - DNA, 20 bp, Homo sapiens
cagacgtgagtgtgactttt

SEQ ID NO: 5993537 - DNA, 16 bp, Homo sapiens
cagacgtggtggctca

SEQ ID NO: 5993538 - DNA, 24 bp, Homo sapiens
cagacgtggtggctcacacctgca

SEQ ID NO: 5993539 - DNA, 19 bp, Homo sapiens
cagacgttaggcatttcct

SEQ ID NO: 5993540 - DNA, 16 bp, Homo sapiens
cagacgttgcctgaga

SEQ ID NO: 5993541 - DNA, 20 bp, Homo sapiens
cagacgttttttctgcacaa

SEQ ID NO: 5993542 - DNA, 14 bp, Homo sapiens
cagactaagccagc

SEQ ID NO: 5993543 - DNA, 21 bp, Homo sapiens
cagactaagccagcaccggac

SEQ ID NO: 5993544 - DNA, 13 bp, Homo sapiens
cagactacagcca

SEQ ID NO: 5993545 - DNA, 15 bp, Homo sapiens
cagactactattttc

SEQ ID NO: 5993546 - DNA, 20 bp, Homo sapiens
cagactactattttcttttt

SEQ ID NO: 5993547 - DNA, 20 bp, Homo sapiens
cagactagagaataattttt

SEQ ID NO: 5993548 - DNA, 21 bp, Homo sapiens
cagactagatggacctgcctg

SEQ ID NO: 5993549 - DNA, 15 bp, Homo sapiens
cagactagtatcaag

SEQ ID NO: 5993550 - DNA, 18 bp, Homo sapiens
cagactatccattttaca

SEQ ID NO: 5993551 - DNA, 20 bp, Homo sapiens
cagactatccattttacact

SEQ ID NO: 5993552 - DNA, 23 bp, Homo sapiens
cagactatcgtaacctggtgcct

SEQ ID NO: 5993553 - DNA, 15 bp, Homo sapiens
cagactattccctag

SEQ ID NO: 5993554 - DNA, 19 bp, Homo sapiens
cagactatttaacttgagg

SEQ ID NO: 5993555 - DNA, 22 bp, Homo sapiens
cagactatttttagattttctt

SEQ ID NO: 5993556 - DNA, 17 bp, Homo sapiens
cagactcaaactcaagg

SEQ ID NO: 5993557 - DNA, 14 bp, Homo sapiens
cagactcaataaaa

SEQ ID NO: 5993558 - DNA, 20 bp, Homo sapiens
cagactcacaacctgaacct

SEQ ID NO: 5993559 - DNA, 15 bp, Homo sapiens
cagactcacttgcca

SEQ ID NO: 5993560 - DNA, 13 bp, Homo sapiens
cagactcagagct

SEQ ID NO: 5993561 - DNA, 17 bp, Homo sapiens
cagactcagaggtccag

SEQ ID NO: 5993562 - DNA, 13 bp, Homo sapiens
cagactcagctcc

SEQ ID NO: 5993563 - DNA, 15 bp, Homo sapiens
cagactcagctctga

SEQ ID NO: 5993564 - DNA, 15 bp, Homo sapiens
cagactcagctgcta

SEQ ID NO: 5993565 - DNA, 15 bp, Homo sapiens
cagactcaggttcca

SEQ ID NO: 5993566 - DNA, 18 bp, Homo sapiens
cagactcaggttccagaa

SEQ ID NO: 5993567 - DNA, 19 bp, Homo sapiens
cagactcaggttccagaac

SEQ ID NO: 5993568 - DNA, 17 bp, Homo sapiens
cagactcagtttgtcag

SEQ ID NO: 5993569 - DNA, 18 bp, Homo sapiens
cagactcagtttgtcaga

SEQ ID NO: 5993570 - DNA, 18 bp, Homo sapiens
cagactccaatggggcca

SEQ ID NO: 5993571 - DNA, 22 bp, Homo sapiens
cagactccaatggggccagcac

SEQ ID NO: 5993572 - DNA, 15 bp, Homo sapiens
cagactccagcccct

SEQ ID NO: 5993573 - DNA, 16 bp, Homo sapiens
cagactccagctgtga

SEQ ID NO: 5993574 - DNA, 18 bp, Homo sapiens
cagactccagctgtgaag

SEQ ID NO: 5993575 - DNA, 13 bp, Homo sapiens
cagactccaggcc

SEQ ID NO: 5993576 - DNA, 16 bp, Homo sapiens
cagactccatctcttc

SEQ ID NO: 5993577 - DNA, 20 bp, Homo sapiens
cagactccatctcttctgca

SEQ ID NO: 5993578 - DNA, 22 bp, Homo sapiens
cagactccatctcttctgcaag

SEQ ID NO: 5993579 - DNA, 14 bp, Homo sapiens
cagactcccattcc

SEQ ID NO: 5993580 - DNA, 18 bp, Homo sapiens
cagactcccattcctgaa

SEQ ID NO: 5993581 - DNA, 14 bp, Homo sapiens
cagactccgccctc

SEQ ID NO: 5993582 - DNA, 17 bp, Homo sapiens
cagactccgcctgaggc

SEQ ID NO: 5993583 - DNA, 12 bp, Homo sapiens
cagactcctcca

SEQ ID NO: 5993584 - DNA, 23 bp, Homo sapiens
cagactcctgactgtctcccggg

SEQ ID NO: 5993585 - DNA, 16 bp, Homo sapiens
cagactcctgaggaca

SEQ ID NO: 5993586 - DNA, 20 bp, Homo sapiens
cagactcctgaggacagctg

SEQ ID NO: 5993587 - DNA, 13 bp, Homo sapiens
cagactcctgctc

SEQ ID NO: 5993588 - DNA, 14 bp, Homo sapiens
cagactcctggctt

SEQ ID NO: 5993589 - DNA, 17 bp, Homo sapiens
cagactcctggcttcat

SEQ ID NO: 5993590 - DNA, 17 bp, Homo sapiens
cagactcctttcctctg

SEQ ID NO: 5993591 - DNA, 17 bp, Homo sapiens
cagactcgagagggctg

SEQ ID NO: 5993592 - DNA, 22 bp, Homo sapiens
cagactcgagagggctgagccc

SEQ ID NO: 5993593 - DNA, 23 bp, Homo sapiens
cagactcggaatctattttctca

SEQ ID NO: 5993594 - DNA, 19 bp, Homo sapiens
cagactctaaacacacaag

SEQ ID NO: 5993595 - DNA, 14 bp, Homo sapiens
cagactctaagaaa

SEQ ID NO: 5993596 - DNA, 19 bp, Homo sapiens
cagactctacagaggccat

SEQ ID NO: 5993597 - DNA, 23 bp, Homo sapiens
cagactctacagaggccatgggc

SEQ ID NO: 5993598 - DNA, 14 bp, Homo sapiens
cagactctaggtta

SEQ ID NO: 5993599 - DNA, 17 bp, Homo sapiens
cagactctctcctctct

SEQ ID NO: 5993600 - DNA, 17 bp, Homo sapiens
cagactctctgtgaacc

SEQ ID NO: 5993601 - DNA, 18 bp, Homo sapiens
cagactctgagctgctca

SEQ ID NO: 5993602 - DNA, 21 bp, Homo sapiens
cagactctgagctgctcaccg

SEQ ID NO: 5993603 - DNA, 12 bp, Homo sapiens
cagactctgcct

SEQ ID NO: 5993604 - DNA, 13 bp, Homo sapiens
cagactctgccta

SEQ ID NO: 5993605 - DNA, 21 bp, Homo sapiens
cagactctgcctcctggtttc

SEQ ID NO: 5993606 - DNA, 19 bp, Homo sapiens
cacaccccgtctgcccctt

SEQ ID NO: 5993607 - DNA, 21 bp, Homo sapiens
cacaccccgtctgccccttga

SEQ ID NO: 5993608 - DNA, 17 bp, Homo sapiens
cacacccctgccggcct

SEQ ID NO: 5993609 - DNA, 20 bp, Homo sapiens
cacacccctggggctgagtc

SEQ ID NO: 5993610 - DNA, 18 bp, Homo sapiens
cacacccgaagtcctgtc

SEQ ID NO: 5993611 - DNA, 19 bp, Homo sapiens
cacacccgaagtcctgtca

SEQ ID NO: 5993612 - DNA, 22 bp, Homo sapiens
cacacccgaagtcctgtcactg

SEQ ID NO: 5993613 - DNA, 20 bp, Homo sapiens
cacacccggctccccctgct

SEQ ID NO: 5993614 - DNA, 15 bp, Homo sapiens
cacaccctacagcag

SEQ ID NO: 5993615 - DNA, 18 bp, Homo sapiens
cacaccctacagcagatc

SEQ ID NO: 5993616 - DNA, 20 bp, Homo sapiens
cacaccctacagcagatcca

SEQ ID NO: 5993617 - DNA, 23 bp, Homo sapiens
cacaccctacagcagatccacct

SEQ ID NO: 5993618 - DNA, 19 bp, Homo sapiens
cacaccctcactctgccag

SEQ ID NO: 5993619 - DNA, 13 bp, Homo sapiens
cacaccctccagc

SEQ ID NO: 5993620 - DNA, 18 bp, Homo sapiens
cacaccctctcccaggac

SEQ ID NO: 5993621 - DNA, 14 bp, Homo sapiens
cacaccctctgtgc

SEQ ID NO: 5993622 - DNA, 16 bp, Homo sapiens
cacaccctctgtgctt

SEQ ID NO: 5993623 - DNA, 11 bp, Homo sapiens
cacaccctgca

SEQ ID NO: 5993624 - DNA, 12 bp, Homo sapiens
cacaccctgcaa

SEQ ID NO: 5993625 - DNA, 13 bp, Homo sapiens
cacaccctgcaag

SEQ ID NO: 5993626 - DNA, 12 bp, Homo sapiens
cacaccctgccc

SEQ ID NO: 5993627 - DNA, 12 bp, Homo sapiens
cacaccctgcct

SEQ ID NO: 5993628 - DNA, 17 bp, Homo sapiens
cacaccctgggccacgc

SEQ ID NO: 5993629 - DNA, 12 bp, Homo sapiens
cacacccttccc

SEQ ID NO: 5993630 - DNA, 13 bp, Homo sapiens
cacacccttcccc

SEQ ID NO: 5993631 - DNA, 18 bp, Homo sapiens
cacaccgcaccgggctgg

SEQ ID NO: 5993632 - DNA, 19 bp, Homo sapiens
cacaccgcaccgggctggc

SEQ ID NO: 5993633 - DNA, 22 bp, Homo sapiens
cacaccgccagcagcgcgcagg

SEQ ID NO: 5993634 - DNA, 18 bp, Homo sapiens
cacaccgccatcctctgc

SEQ ID NO: 5993635 - DNA, 13 bp, Homo sapiens
cacaccgcggcca

SEQ ID NO: 5993636 - DNA, 14 bp, Homo sapiens
cacaccgcggccag

SEQ ID NO: 5993637 - DNA, 24 bp, Homo sapiens
cacaccgcggccaggcacccatgt

SEQ ID NO: 5993638 - DNA, 17 bp, Homo sapiens
cacaccgcgtcccagct

SEQ ID NO: 5993639 - DNA, 18 bp, Homo sapiens
cacaccgcgtcccagctc

SEQ ID NO: 5993640 - DNA, 15 bp, Homo sapiens
cacaccgctggctcc

SEQ ID NO: 5993641 - DNA, 14 bp, Homo sapiens
cacaccgctggtcc

SEQ ID NO: 5993642 - DNA, 15 bp, Homo sapiens
cacaccggcactgtg

SEQ ID NO: 5993643 - DNA, 18 bp, Homo sapiens
cacaccggcactgtgcac

SEQ ID NO: 5993644 - DNA, 19 bp, Homo sapiens
cacaccgtccctctccccg

SEQ ID NO: 5993645 - DNA, 20 bp, Homo sapiens
cacacctaaattaacaaatt

SEQ ID NO: 5993646 - DNA, 23 bp, Homo sapiens
cacacctaagggacatgttttga

SEQ ID NO: 5993647 - DNA, 14 bp, Homo sapiens
cacacctagcgtca

SEQ ID NO: 5993648 - DNA, 15 bp, Homo sapiens
cacacctcagtggga

SEQ ID NO: 5993649 - DNA, 13 bp, Homo sapiens
cacacctcagttc

SEQ ID NO: 5993650 - DNA, 18 bp, Homo sapiens
cacacctcagttcccttg

SEQ ID NO: 5993651 - DNA, 22 bp, Homo sapiens
cacacctcagttcccttggcct

SEQ ID NO: 5993652 - DNA, 12 bp, Homo sapiens
cacacctccaca

SEQ ID NO: 5993653 - DNA, 15 bp, Homo sapiens
cacacctccacccgt

SEQ ID NO: 5993654 - DNA, 15 bp, Homo sapiens
cacacctcccttcat

SEQ ID NO: 5993655 - DNA, 16 bp, Homo sapiens
cacacctcctcccact

SEQ ID NO: 5993656 - DNA, 14 bp, Homo sapiens
cacacctcctgcct

SEQ ID NO: 5993657 - DNA, 14 bp, Homo sapiens
cacacctccttttc

SEQ ID NO: 5993658 - DNA, 13 bp, Homo sapiens
cacacctctgcca

SEQ ID NO: 5993659 - DNA, 14 bp, Homo sapiens
cacacctctgccac

SEQ ID NO: 5993660 - DNA, 13 bp, Homo sapiens
cacacctctgccc

SEQ ID NO: 5993661 - DNA, 15 bp, Homo sapiens
cacacctctgcccct

SEQ ID NO: 5993662 - DNA, 12 bp, Homo sapiens
cacacctctggc

SEQ ID NO: 5993663 - DNA, 17 bp, Homo sapiens
cacacctgaacttgcct

SEQ ID NO: 5993664 - DNA, 18 bp, Homo sapiens
cacacctgaatcagctgg

SEQ ID NO: 5993665 - DNA, 15 bp, Homo sapiens
cacacctgacaaatg

SEQ ID NO: 5993666 - DNA, 16 bp, Homo sapiens
cacacctgactctgaa

SEQ ID NO: 5993667 - DNA, 16 bp, Homo sapiens
cacacctgagaatgtg

SEQ ID NO: 5993668 - DNA, 17 bp, Homo sapiens
cacacctgagccagcct

SEQ ID NO: 5993669 - DNA, 21 bp, Homo sapiens
cacacctgcaatcccagcacc

SEQ ID NO: 5993670 - DNA, 12 bp, Homo sapiens
cacacctgcagt

SEQ ID NO: 5993671 - DNA, 13 bp, Homo sapiens
cacacctgcagtg

SEQ ID NO: 5993672 - DNA, 15 bp, Homo sapiens
cacacctgcctctga

SEQ ID NO: 5993673 - DNA, 18 bp, Homo sapiens
cacacctgcctctgaact

SEQ ID NO: 5993674 - DNA, 13 bp, Homo sapiens
cacacctggccag

SEQ ID NO: 5993675 - DNA, 18 bp, Homo sapiens
cacacctggtctgttttc

SEQ ID NO: 5993676 - DNA, 16 bp, Homo sapiens
cacacctgtagtccca

SEQ ID NO: 5993677 - DNA, 15 bp, Homo sapiens
cacaccttacaaagc

SEQ ID NO: 5993678 - DNA, 20 bp, Homo sapiens
cacaccttacaaagccagct

SEQ ID NO: 5993679 - DNA, 16 bp, Homo sapiens
cacaccttccagggcc

SEQ ID NO: 5993680 - DNA, 12 bp, Homo sapiens
cacaccttgcag

SEQ ID NO: 5993681 - DNA, 14 bp, Homo sapiens
cacaccttgcagaa

SEQ ID NO: 5993682 - DNA, 14 bp, Homo sapiens
cacacctttattca

SEQ ID NO: 5993683 - DNA, 17 bp, Homo sapiens
cacacctttattcagaa

SEQ ID NO: 5993684 - DNA, 18 bp, Homo sapiens
cacacctttattcagaac

SEQ ID NO: 5993685 - DNA, 16 bp, Homo sapiens
cacaccttttccccag

SEQ ID NO: 5993686 - DNA, 18 bp, Homo sapiens
cacaccttttccccagga

SEQ ID NO: 5993687 - DNA, 22 bp, Homo sapiens
cacacgactgcaacatacaggt

SEQ ID NO: 5993688 - DNA, 19 bp, Homo sapiens
cacacgagcaaacccagag

SEQ ID NO: 5993689 - DNA, 11 bp, Homo sapiens
cacacgatgca

SEQ ID NO: 5993690 - DNA, 13 bp, Homo sapiens
cacacgatgcatt

SEQ ID NO: 5993691 - DNA, 20 bp, Homo sapiens
cacacgatgcatttaataaa

SEQ ID NO: 5993692 - DNA, 21 bp, Homo sapiens
cacacgatgcatttaataaag

SEQ ID NO: 5993693 - DNA, 20 bp, Homo sapiens
cacacgatgttgtcaaggat

SEQ ID NO: 5993694 - DNA, 14 bp, Homo sapiens
cacacgcacataga

SEQ ID NO: 5993695 - DNA, 17 bp, Homo sapiens
cacacgcacgcacacac

SEQ ID NO: 5993696 - DNA, 19 bp, Homo sapiens
cacacgcacgcacacacac

SEQ ID NO: 5993697 - DNA, 17 bp, Homo sapiens
cacacgcactggtgcca

SEQ ID NO: 5993698 - DNA, 13 bp, Homo sapiens
cacacgcagacac

SEQ ID NO: 5993699 - DNA, 19 bp, Homo sapiens
cacacgcaggaactcccag

SEQ ID NO: 5993700 - DNA, 14 bp, Homo sapiens
cacacgcatgggca

SEQ ID NO: 5993701 - DNA, 14 bp, Homo sapiens
cacacgccaatgca

SEQ ID NO: 5993702 - DNA, 12 bp, Homo sapiens
cacacgccaccc

SEQ ID NO: 5993703 - DNA, 15 bp, Homo sapiens
cacacgccagctcct

SEQ ID NO: 5993704 - DNA, 18 bp, Homo sapiens
cacacgccggggctggcc

SEQ ID NO: 5993705 - DNA, 12 bp, Homo sapiens
cacacgcctgta

SEQ ID NO: 5993706 - DNA, 21 bp, Homo sapiens
cacacgcctgtaatctcagct

SEQ ID NO: 5993707 - DNA, 18 bp, Homo sapiens
cacacgcgcgcacacaca

SEQ ID NO: 5993708 - DNA, 22 bp, Homo sapiens
cacacgctcctccctctgaggc

SEQ ID NO: 5993709 - DNA, 17 bp, Homo sapiens
cacacgctgcccaggct

SEQ ID NO: 5993710 - DNA, 16 bp, Homo sapiens
cacacgctgctctgcc

SEQ ID NO: 5993711 - DNA, 19 bp, Homo sapiens
cacacgctgctctgcccca

SEQ ID NO: 5993712 - DNA, 19 bp, Homo sapiens
cacacggactcccgggcca

SEQ ID NO: 5993713 - DNA, 17 bp, Homo sapiens
cacacggagaggccact

SEQ ID NO: 5993714 - DNA, 18 bp, Homo sapiens
cacacggagaggccactg

SEQ ID NO: 5993715 - DNA, 21 bp, Homo sapiens
cacacggaggcatctgcaccc

SEQ ID NO: 5993716 - DNA, 13 bp, Homo sapiens
cacacggaggcca

SEQ ID NO: 5993717 - DNA, 16 bp, Homo sapiens
cacacggaggccagac

SEQ ID NO: 5993718 - DNA, 14 bp, Homo sapiens
cacacggcagcccc

SEQ ID NO: 5993719 - DNA, 20 bp, Homo sapiens
cacacggcagcccccccctc

SEQ ID NO: 5993720 - DNA, 13 bp, Homo sapiens
cacacggccctgc

SEQ ID NO: 5993721 - DNA, 17 bp, Homo sapiens
cacacggccctgcccca

SEQ ID NO: 5993722 - DNA, 12 bp, Homo sapiens
cacacggctccc

SEQ ID NO: 5993723 - DNA, 15 bp, Homo sapiens
cacacggctccccca

SEQ ID NO: 5993724 - DNA, 19 bp, Homo sapiens
cacacggctcccccaggcc

SEQ ID NO: 5993725 - DNA, 20 bp, Homo sapiens
cacacggctggtcactctgc

SEQ ID NO: 5993726 - DNA, 21 bp, Homo sapiens
cacacggctggtcactctgcc

SEQ ID NO: 5993727 - DNA, 16 bp, Homo sapiens
cacacgggcctctgct

SEQ ID NO: 5993728 - DNA, 19 bp, Homo sapiens
cacacggggcacccagccc

SEQ ID NO: 5993729 - DNA, 22 bp, Homo sapiens
cacacggggcacccagcccaac

SEQ ID NO: 5993730 - DNA, 19 bp, Homo sapiens
cacacggtttgaagcctgg

SEQ ID NO: 5993731 - DNA, 17 bp, Homo sapiens
cacacgtaccttcatgt

SEQ ID NO: 5993732 - DNA, 20 bp, Homo sapiens
cacacgtcatttcttagcta

SEQ ID NO: 5993733 - DNA, 16 bp, Homo sapiens
cacacgtgcaatttgt

SEQ ID NO: 5993734 - DNA, 21 bp, Homo sapiens
cacacgtgctcgcagcctggc

SEQ ID NO: 5993735 - DNA, 20 bp, Homo sapiens
cacacgtggtgacctcacac

SEQ ID NO: 5993736 - DNA, 20 bp, Homo sapiens
cacacgtgtgatgtatgttg

SEQ ID NO: 5993737 - DNA, 18 bp, Homo sapiens
cacacgttgacgggccgc

SEQ ID NO: 5993738 - DNA, 20 bp, Homo sapiens
cacacgtttaatcccagcac

SEQ ID NO: 5993739 - DNA, 21 bp, Homo sapiens
cacacgtttaatcccagcact

SEQ ID NO: 5993740 - DNA, 13 bp, Homo sapiens
cacactaaaattt

SEQ ID NO: 5993741 - DNA, 14 bp, Homo sapiens
cacactaaaattta

SEQ ID NO: 5993742 - DNA, 17 bp, Homo sapiens
cacactaaaatttaatt

SEQ ID NO: 5993743 - DNA, 21 bp, Homo sapiens
cacactaaacatatgaatgca

SEQ ID NO: 5993744 - DNA, 14 bp, Homo sapiens
cacactaacatcaa

SEQ ID NO: 5993745 - DNA, 19 bp, Homo sapiens
cacactaaccaagctgagt

SEQ ID NO: 5993746 - DNA, 23 bp, Homo sapiens
cacactacaccacacacaacagc

SEQ ID NO: 5993747 - DNA, 22 bp, Homo sapiens
cacactaccgaatgtgtcttta

SEQ ID NO: 5993748 - DNA, 18 bp, Homo sapiens
cacactactacctcttaa

SEQ ID NO: 5993749 - DNA, 13 bp, Homo sapiens
cacactagaaaga

SEQ ID NO: 5993750 - DNA, 23 bp, Homo sapiens
cacactagcatagagaatgtgtt

SEQ ID NO: 5993751 - DNA, 17 bp, Homo sapiens
cacactagcctctccag

SEQ ID NO: 5993752 - DNA, 19 bp, Homo sapiens
cacactagggactatcagg

SEQ ID NO: 5993753 - DNA, 21 bp, Homo sapiens
cacactagggactatcaggta

SEQ ID NO: 5993754 - DNA, 20 bp, Homo sapiens
cacactataaggctgagggc

SEQ ID NO: 5993755 - DNA, 19 bp, Homo sapiens
cacactatcaacactgcag

SEQ ID NO: 5993756 - DNA, 21 bp, Homo sapiens
cacactatgcacagagcccaa

SEQ ID NO: 5993757 - DNA, 20 bp, Homo sapiens
cacactatgtgtgttgtttc

SEQ ID NO: 5993758 - DNA, 20 bp, Homo sapiens
cacactattaccatgagaag

SEQ ID NO: 5993759 - DNA, 17 bp, Homo sapiens
cacactcaaggacagga

SEQ ID NO: 5993760 - DNA, 14 bp, Homo sapiens
cacactcaccattt

SEQ ID NO: 5993761 - DNA, 18 bp, Homo sapiens
cacactcaccccagcctc

SEQ ID NO: 5993762 - DNA, 19 bp, Homo sapiens
cacactcaccccagcctca

SEQ ID NO: 5993763 - DNA, 19 bp, Homo sapiens
cacactcactcctgagacc

SEQ ID NO: 5993764 - DNA, 15 bp, Homo sapiens
cacactcagaaaatt

SEQ ID NO: 5993765 - DNA, 22 bp, Homo sapiens
cacactcagaaaattccctggg

SEQ ID NO: 5993766 - DNA, 23 bp, Homo sapiens
cacactcagaaaattccctgggg

SEQ ID NO: 5993767 - DNA, 14 bp, Homo sapiens
cacactcagaaaga

SEQ ID NO: 5993768 - DNA, 20 bp, Homo sapiens
cacactcagatcctcctcat

SEQ ID NO: 5993769 - DNA, 13 bp, Homo sapiens
cacactcagcagc

SEQ ID NO: 5993770 - DNA, 15 bp, Homo sapiens
cacactcagcagccc

SEQ ID NO: 5993771 - DNA, 14 bp, Homo sapiens
cacactcagccaca

SEQ ID NO: 5993772 - DNA, 21 bp, Homo sapiens
cacactcagccacaaagcccc

SEQ ID NO: 5993773 - DNA, 13 bp, Homo sapiens
cacactcaggcct

SEQ ID NO: 5993774 - DNA, 14 bp, Homo sapiens
cacactcaggcctg

SEQ ID NO: 5993775 - DNA, 19 bp, Homo sapiens
cacactcaggcctgtgccc

SEQ ID NO: 5993776 - DNA, 22 bp, Homo sapiens
cacactcaggcctgtgcccact

SEQ ID NO: 5993777 - DNA, 16 bp, Homo sapiens
cacactcagttctgct

SEQ ID NO: 5993778 - DNA, 21 bp, Homo sapiens
cacactcatacacatgtgcac

SEQ ID NO: 5993779 - DNA, 19 bp, Homo sapiens
cacactcatgcacacagat

SEQ ID NO: 5993780 - DNA, 12 bp, Homo sapiens
cacactccactc

SEQ ID NO: 5993781 - DNA, 13 bp, Homo sapiens
cacactccactga

SEQ ID NO: 5993782 - DNA, 13 bp, Homo sapiens
cacactccagaat

SEQ ID NO: 5993783 - DNA, 14 bp, Homo sapiens
cacactccagctgg

SEQ ID NO: 5993784 - DNA, 14 bp, Homo sapiens
cacactccaggcct

SEQ ID NO: 5993785 - DNA, 16 bp, Homo sapiens
cacactccccgcctgt

SEQ ID NO: 5993786 - DNA, 17 bp, Homo sapiens
cacactcccctgcactg

SEQ ID NO: 5993787 - DNA, 22 bp, Homo sapiens
cagactctgtgagattctaaat

SEQ ID NO: 5993788 - DNA, 14 bp, Homo sapiens
cagactcttcacag

SEQ ID NO: 5993789 - DNA, 15 bp, Homo sapiens
cagactctttatgct

SEQ ID NO: 5993790 - DNA, 18 bp, Homo sapiens
cagactctttatgcttgc

SEQ ID NO: 5993791 - DNA, 19 bp, Homo sapiens
cagactctttatgcttgca

SEQ ID NO: 5993792 - DNA, 22 bp, Homo sapiens
cagactctttcgatacccagga

SEQ ID NO: 5993793 - DNA, 19 bp, Homo sapiens
cagactgaaacgccttgca

SEQ ID NO: 5993794 - DNA, 19 bp, Homo sapiens
cagactgagctctccaggc

SEQ ID NO: 5993795 - DNA, 23 bp, Homo sapiens
cagactgagctctccaggccagg

SEQ ID NO: 5993796 - DNA, 19 bp, Homo sapiens
cagactgatagacaccata

SEQ ID NO: 5993797 - DNA, 17 bp, Homo sapiens
cagactgatcaggacct

SEQ ID NO: 5993798 - DNA, 14 bp, Homo sapiens
cagactgatgagca

SEQ ID NO: 5993799 - DNA, 16 bp, Homo sapiens
cagactgatgagcaca

SEQ ID NO: 5993800 - DNA, 17 bp, Homo sapiens
cagactgatgagcacat

SEQ ID NO: 5993801 - DNA, 19 bp, Homo sapiens
cagactgatgagcacatct

SEQ ID NO: 5993802 - DNA, 22 bp, Homo sapiens
cagactgatggcgattccctct

SEQ ID NO: 5993803 - DNA, 13 bp, Homo sapiens
cagactgcagaca

SEQ ID NO: 5993804 - DNA, 21 bp, Homo sapiens
cagactgcagacattctcaaa

SEQ ID NO: 5993805 - DNA, 12 bp, Homo sapiens
cagactgccaaa

SEQ ID NO: 5993806 - DNA, 16 bp, Homo sapiens
cagactgccccagcca

SEQ ID NO: 5993807 - DNA, 22 bp, Homo sapiens
cagactgccccagccaacgaga

SEQ ID NO: 5993808 - DNA, 12 bp, Homo sapiens
cagactgcctta

SEQ ID NO: 5993809 - DNA, 22 bp, Homo sapiens
cagactgccttatattattttc

SEQ ID NO: 5993810 - DNA, 18 bp, Homo sapiens
cagactgcgatttgtccc

SEQ ID NO: 5993811 - DNA, 19 bp, Homo sapiens
cagactgctagtgttctgt

SEQ ID NO: 5993812 - DNA, 20 bp, Homo sapiens
cagactgcttccaattttct

SEQ ID NO: 5993813 - DNA, 12 bp, Homo sapiens
cagactgcttgg

SEQ ID NO: 5993814 - DNA, 17 bp, Homo sapiens
cagactggaagacactt

SEQ ID NO: 5993815 - DNA, 17 bp, Homo sapiens
cagactggaagcacagc

SEQ ID NO: 5993816 - DNA, 20 bp, Homo sapiens
cagactggaggtcgaagcaa

SEQ ID NO: 5993817 - DNA, 16 bp, Homo sapiens
cagactggagtgcagt

SEQ ID NO: 5993818 - DNA, 19 bp, Homo sapiens
cagactggatagtccgtct

SEQ ID NO: 5993819 - DNA, 16 bp, Homo sapiens
cagactggcaataaac

SEQ ID NO: 5993820 - DNA, 17 bp, Homo sapiens
cagactggcaataaact

SEQ ID NO: 5993821 - DNA, 18 bp, Homo sapiens
cagactggcaataaactc

SEQ ID NO: 5993822 - DNA, 20 bp, Homo sapiens
cagactggcaataaactcct

SEQ ID NO: 5993823 - DNA, 23 bp, Homo sapiens
cagactggcacagttttctgaga

SEQ ID NO: 5993824 - DNA, 16 bp, Homo sapiens
cagactggccgggcag

SEQ ID NO: 5993825 - DNA, 17 bp, Homo sapiens
cagactggccgggcagg

SEQ ID NO: 5993826 - DNA, 19 bp, Homo sapiens
cagactggccgggcaggcg

SEQ ID NO: 5993827 - DNA, 21 bp, Homo sapiens
cagactggctgcacagcccaa

SEQ ID NO: 5993828 - DNA, 18 bp, Homo sapiens
cagactgggaacccctcc

SEQ ID NO: 5993829 - DNA, 14 bp, Homo sapiens
cagactgggcccag

SEQ ID NO: 5993830 - DNA, 22 bp, Homo sapiens
cagactgggcccaggcaggtct

SEQ ID NO: 5993831 - DNA, 20 bp, Homo sapiens
cagactgggtttctagccca

SEQ ID NO: 5993832 - DNA, 18 bp, Homo sapiens
cagactggtgttaatgag

SEQ ID NO: 5993833 - DNA, 21 bp, Homo sapiens
cagactggtgttaatgagtat

SEQ ID NO: 5993834 - DNA, 22 bp, Homo sapiens
cagactgtaagatgttgtttta

SEQ ID NO: 5993835 - DNA, 19 bp, Homo sapiens
cagactgtcaggcaagccc

SEQ ID NO: 5993836 - DNA, 17 bp, Homo sapiens
cagactgtctccacggc

SEQ ID NO: 5993837 - DNA, 22 bp, Homo sapiens
cagactgtgtaaaaagagagct

SEQ ID NO: 5993838 - DNA, 21 bp, Homo sapiens
cagactgtgtttcgtgaactg

SEQ ID NO: 5993839 - DNA, 23 bp, Homo sapiens
cagactgttagaaaatggacact

SEQ ID NO: 5993840 - DNA, 12 bp, Homo sapiens
cagactgtttta

SEQ ID NO: 5993841 - DNA, 23 bp, Homo sapiens
cagactgttttactgttttaatt

SEQ ID NO: 5993842 - DNA, 12 bp, Homo sapiens
cagacttcaaga

SEQ ID NO: 5993843 - DNA, 15 bp, Homo sapiens
cagacttcaccaaat

SEQ ID NO: 5993844 - DNA, 14 bp, Homo sapiens
cagacttcccagct

SEQ ID NO: 5993845 - DNA, 20 bp, Homo sapiens
cagacttcccagctaggaag

SEQ ID NO: 5993846 - DNA, 20 bp, Homo sapiens
cagacttcgctattcccagg

SEQ ID NO: 5993847 - DNA, 22 bp, Homo sapiens
cagacttcgctattcccaggca

SEQ ID NO: 5993848 - DNA, 17 bp, Homo sapiens
cagacttctaaaataaa

SEQ ID NO: 5993849 - DNA, 19 bp, Homo sapiens
cagacttctaaaataaatg

SEQ ID NO: 5993850 - DNA, 22 bp, Homo sapiens
cagacttctggaaggctggctg

SEQ ID NO: 5993851 - DNA, 14 bp, Homo sapiens
cagacttctggcct

SEQ ID NO: 5993852 - DNA, 21 bp, Homo sapiens
cagacttctggcctaggaccc

SEQ ID NO: 5993853 - DNA, 19 bp, Homo sapiens
cagacttgccatgtgactc

SEQ ID NO: 5993854 - DNA, 21 bp, Homo sapiens
cagacttgccatgtgactctg

SEQ ID NO: 5993855 - DNA, 15 bp, Homo sapiens
cagacttgcggccac

SEQ ID NO: 5993856 - DNA, 14 bp, Homo sapiens
cagacttggctcag

SEQ ID NO: 5993857 - DNA, 15 bp, Homo sapiens
cagacttgtatattc

SEQ ID NO: 5993858 - DNA, 17 bp, Homo sapiens
cagacttgtttcctgtg

SEQ ID NO: 5993859 - DNA, 21 bp, Homo sapiens
cagactttacatgacacagct

SEQ ID NO: 5993860 - DNA, 15 bp, Homo sapiens
cagactttagtgccc

SEQ ID NO: 5993861 - DNA, 19 bp, Homo sapiens
cagactttagtgccctgcc

SEQ ID NO: 5993862 - DNA, 23 bp, Homo sapiens
cagactttagtgccctgccccct

SEQ ID NO: 5993863 - DNA, 22 bp, Homo sapiens
cagactttcagccgactcagca

SEQ ID NO: 5993864 - DNA, 20 bp, Homo sapiens
cagactttctacacctgttg

SEQ ID NO: 5993865 - DNA, 15 bp, Homo sapiens
cagactttctttttc

SEQ ID NO: 5993866 - DNA, 23 bp, Homo sapiens
cagactttctttttctacatgtg

SEQ ID NO: 5993867 - DNA, 13 bp, Homo sapiens
cagactttgagcc

SEQ ID NO: 5993868 - DNA, 21 bp, Homo sapiens
cagactttgagcctgcatctt

SEQ ID NO: 5993869 - DNA, 14 bp, Homo sapiens
cagactttgctgca

SEQ ID NO: 5993870 - DNA, 16 bp, Homo sapiens
cagactttggacagtg

SEQ ID NO: 5993871 - DNA, 21 bp, Homo sapiens
cagactttggacagtggcctc

SEQ ID NO: 5993872 - DNA, 22 bp, Homo sapiens
cagactttggacagtggcctct

SEQ ID NO: 5993873 - DNA, 17 bp, Homo sapiens
cagacttttaaagactt

SEQ ID NO: 5993874 - DNA, 20 bp, Homo sapiens
cagactttttttaaatagta

SEQ ID NO: 5993875 - DNA, 18 bp, Homo sapiens
cagagaaaaatgctcccc

SEQ ID NO: 5993876 - DNA, 20 bp, Homo sapiens
cagagaaaaatgctccccac

SEQ ID NO: 5993877 - DNA, 15 bp, Homo sapiens
cagagaaaacacacg

SEQ ID NO: 5993878 - DNA, 13 bp, Homo sapiens
cagagaaaacact

SEQ ID NO: 5993879 - DNA, 21 bp, Homo sapiens
cagagaaaacccggagcaagc

SEQ ID NO: 5993880 - DNA, 18 bp, Homo sapiens
cagagaaaatcaaagcag

SEQ ID NO: 5993881 - DNA, 19 bp, Homo sapiens
cagagaaaatcaaagcagt

SEQ ID NO: 5993882 - DNA, 23 bp, Homo sapiens
cagagaaaatgagaaaggacaga

SEQ ID NO: 5993883 - DNA, 13 bp, Homo sapiens
cagagaaaattaa

SEQ ID NO: 5993884 - DNA, 16 bp, Homo sapiens
cagagaaacagacaga

SEQ ID NO: 5993885 - DNA, 13 bp, Homo sapiens
cagagaaaccagc

SEQ ID NO: 5993886 - DNA, 23 bp, Homo sapiens
cagagaaaccagcttccttcaga

SEQ ID NO: 5993887 - DNA, 17 bp, Homo sapiens
cagagaaacgcgctcct

SEQ ID NO: 5993888 - DNA, 19 bp, Homo sapiens
cagagaaacttaagcaaag

SEQ ID NO: 5993889 - DNA, 18 bp, Homo sapiens
cagagaaagaaaaggcaa

SEQ ID NO: 5993890 - DNA, 15 bp, Homo sapiens
cagagaaagaagaga

SEQ ID NO: 5993891 - DNA, 18 bp, Homo sapiens
cagagaaagaagagacag

SEQ ID NO: 5993892 - DNA, 19 bp, Homo sapiens
cagagaaagaagagacagg

SEQ ID NO: 5993893 - DNA, 13 bp, Homo sapiens
cagagaaagagga

SEQ ID NO: 5993894 - DNA, 18 bp, Homo sapiens
cagagaaagaggaagctt

SEQ ID NO: 5993895 - DNA, 13 bp, Homo sapiens
cagagaaagcaaa

SEQ ID NO: 5993896 - DNA, 17 bp, Homo sapiens
cagagaaaggcaaggga

SEQ ID NO: 5993897 - DNA, 18 bp, Homo sapiens
cagagaaaggggagccca

SEQ ID NO: 5993898 - DNA, 19 bp, Homo sapiens
cagagaaaggggagcccac

SEQ ID NO: 5993899 - DNA, 17 bp, Homo sapiens
cagagaaatacaaaata

SEQ ID NO: 5993900 - DNA, 20 bp, Homo sapiens
cagagaaatctaagctgtgt

SEQ ID NO: 5993901 - DNA, 20 bp, Homo sapiens
cagagaaatgccccagtgtt

SEQ ID NO: 5993902 - DNA, 16 bp, Homo sapiens
cagagaaatgtgaagg

SEQ ID NO: 5993903 - DNA, 18 bp, Homo sapiens
cagagaaatgtgaagggt

SEQ ID NO: 5993904 - DNA, 21 bp, Homo sapiens
cagagaaatgtgaagggtggg

SEQ ID NO: 5993905 - DNA, 15 bp, Homo sapiens
cagagaaattctgtg

SEQ ID NO: 5993906 - DNA, 21 bp, Homo sapiens
cagagaacaatcactattctt

SEQ ID NO: 5993907 - DNA, 22 bp, Homo sapiens
cagagaacaatcactattctta

SEQ ID NO: 5993908 - DNA, 22 bp, Homo sapiens
cagagaacagaactggaggcag

SEQ ID NO: 5993909 - DNA, 15 bp, Homo sapiens
cagagaacagtcatg

SEQ ID NO: 5993910 - DNA, 16 bp, Homo sapiens
cagagaaccattccca

SEQ ID NO: 5993911 - DNA, 23 bp, Homo sapiens
cagagaaccattcccaagccatg

SEQ ID NO: 5993912 - DNA, 16 bp, Homo sapiens
cagagaacccagccca

SEQ ID NO: 5993913 - DNA, 14 bp, Homo sapiens
cagagaacctgctc

SEQ ID NO: 5993914 - DNA, 21 bp, Homo sapiens
cagagaactaacactatttta

SEQ ID NO: 5993915 - DNA, 22 bp, Homo sapiens
cagagaactaacactattttat

SEQ ID NO: 5993916 - DNA, 15 bp, Homo sapiens
cagagaactcataaa

SEQ ID NO: 5993917 - DNA, 14 bp, Homo sapiens
cagagaactgcaga

SEQ ID NO: 5993918 - DNA, 15 bp, Homo sapiens
cagagaactgcagac

SEQ ID NO: 5993919 - DNA, 16 bp, Homo sapiens
cagagaactgtctttc

SEQ ID NO: 5993920 - DNA, 15 bp, Homo sapiens
cagagaactttattt

SEQ ID NO: 5993921 - DNA, 13 bp, Homo sapiens
cagagaagaaaga

SEQ ID NO: 5993922 - DNA, 19 bp, Homo sapiens
cagagaagaaagaacggaa

SEQ ID NO: 5993923 - DNA, 19 bp, Homo sapiens
cagagaagaccttctagtg

SEQ ID NO: 5993924 - DNA, 13 bp, Homo sapiens
cagagaagcagac

SEQ ID NO: 5993925 - DNA, 23 bp, Homo sapiens
cagagaagccccgcacgggctgt

SEQ ID NO: 5993926 - DNA, 15 bp, Homo sapiens
cagagaagccccttc

SEQ ID NO: 5993927 - DNA, 18 bp, Homo sapiens
cagagaagccccttcccc

SEQ ID NO: 5993928 - DNA, 11 bp, Homo sapiens
cagagaagcct

SEQ ID NO: 5993929 - DNA, 22 bp, Homo sapiens
cagagaagcctcagtccctccc

SEQ ID NO: 5993930 - DNA, 12 bp, Homo sapiens
cagagaagcctt

SEQ ID NO: 5993931 - DNA, 19 bp, Homo sapiens
cagagaagccttcaagctc

SEQ ID NO: 5993932 - DNA, 22 bp, Homo sapiens
cagagaagccttcaagctctga

SEQ ID NO: 5993933 - DNA, 17 bp, Homo sapiens
cagagaagctcctgcta

SEQ ID NO: 5993934 - DNA, 18 bp, Homo sapiens
cagagaagctcctgctac

SEQ ID NO: 5993935 - DNA, 15 bp, Homo sapiens
cagagaagctgggga

SEQ ID NO: 5993936 - DNA, 21 bp, Homo sapiens
cagagaagctggggaggagct

SEQ ID NO: 5993937 - DNA, 22 bp, Homo sapiens
cagagaaggaaaagactgaatc

SEQ ID NO: 5993938 - DNA, 14 bp, Homo sapiens
cagagaaggaatgt

SEQ ID NO: 5993939 - DNA, 22 bp, Homo sapiens
cagagaaggatgtccgttccag

SEQ ID NO: 5993940 - DNA, 16 bp, Homo sapiens
cagagaaggcagcagg

SEQ ID NO: 5993941 - DNA, 13 bp, Homo sapiens
cagagaaggcagg

SEQ ID NO: 5993942 - DNA, 20 bp, Homo sapiens
cagagaaggcaggaatgtgt

SEQ ID NO: 5993943 - DNA, 18 bp, Homo sapiens
cagagaaggccaggggct

SEQ ID NO: 5993944 - DNA, 15 bp, Homo sapiens
cagagaaggcctctt

SEQ ID NO: 5993945 - DNA, 17 bp, Homo sapiens
cagagaaggctatgtaa

SEQ ID NO: 5993946 - DNA, 14 bp, Homo sapiens
cagagaaggcttcc

SEQ ID NO: 5993947 - DNA, 14 bp, Homo sapiens
cagagaagggaaga

SEQ ID NO: 5993948 - DNA, 22 bp, Homo sapiens
cagagaagggaagaaggggcca

SEQ ID NO: 5993949 - DNA, 21 bp, Homo sapiens
cagagaagggcaggagaggaa

SEQ ID NO: 5993950 - DNA, 18 bp, Homo sapiens
cagagaagggcataaaac

SEQ ID NO: 5993951 - DNA, 22 bp, Homo sapiens
cagagaagggcataaaacagct

SEQ ID NO: 5993952 - DNA, 20 bp, Homo sapiens
cagagaagggctcctgcagg

SEQ ID NO: 5993953 - DNA, 23 bp, Homo sapiens
cagagaaggtagattttaagaat

SEQ ID NO: 5993954 - DNA, 13 bp, Homo sapiens
cagagaagtcaca

SEQ ID NO: 5993955 - DNA, 19 bp, Homo sapiens
cagagaagtcacagggcag

SEQ ID NO: 5993956 - DNA, 20 bp, Homo sapiens
cagagaagtcacagggcagt

SEQ ID NO: 5993957 - DNA, 12 bp, Homo sapiens
cagagaagtcag

SEQ ID NO: 5993958 - DNA, 21 bp, Homo sapiens
cagagaagtcagttggagaaa

SEQ ID NO: 5993959 - DNA, 20 bp, Homo sapiens
cagagaagtgacagggaagc

SEQ ID NO: 5993960 - DNA, 12 bp, Homo sapiens
cagagaataaaa

SEQ ID NO: 5993961 - DNA, 18 bp, Homo sapiens
cagagaataaaaggacca

SEQ ID NO: 5993962 - DNA, 15 bp, Homo sapiens
cagagaataaacatc

SEQ ID NO: 5993963 - DNA, 12 bp, Homo sapiens
cacactccctgc

SEQ ID NO: 5993964 - DNA, 13 bp, Homo sapiens
cacactccctgct

SEQ ID NO: 5993965 - DNA, 15 bp, Homo sapiens
cacactccctgcttg

SEQ ID NO: 5993966 - DNA, 23 bp, Homo sapiens
cacactccctgcttgcaggaggc

SEQ ID NO: 5993967 - DNA, 12 bp, Homo sapiens
cacactcctggg

SEQ ID NO: 5993968 - DNA, 13 bp, Homo sapiens
cacactctctgca

SEQ ID NO: 5993969 - DNA, 22 bp, Homo sapiens
cacactctctgcagcccagcct

SEQ ID NO: 5993970 - DNA, 17 bp, Homo sapiens
cacactctcttctccat

SEQ ID NO: 5993971 - DNA, 14 bp, Homo sapiens
cacactctcttctt

SEQ ID NO: 5993972 - DNA, 20 bp, Homo sapiens
cacactctgagtctctgaat

SEQ ID NO: 5993973 - DNA, 18 bp, Homo sapiens
cacactgaaaagcagcct

SEQ ID NO: 5993974 - DNA, 23 bp, Homo sapiens
cacactgaaaaggaaaatgggaa

SEQ ID NO: 5993975 - DNA, 19 bp, Homo sapiens
cacactgaaaccaaaacat

SEQ ID NO: 5993976 - DNA, 18 bp, Homo sapiens
cacactgaaccgctacaa

SEQ ID NO: 5993977 - DNA, 14 bp, Homo sapiens
cacactgaagaagc

SEQ ID NO: 5993978 - DNA, 23 bp, Homo sapiens
cacactgaccaagtgctggccca

SEQ ID NO: 5993979 - DNA, 22 bp, Homo sapiens
cacactgagctgggcaccacag

SEQ ID NO: 5993980 - DNA, 17 bp, Homo sapiens
cacactgagtttgaaca

SEQ ID NO: 5993981 - DNA, 23 bp, Homo sapiens
cacactgatgggctggggcaggg

SEQ ID NO: 5993982 - DNA, 21 bp, Homo sapiens
cacactgcaagagccttggtg

SEQ ID NO: 5993983 - DNA, 14 bp, Homo sapiens
cacactgcacatct

SEQ ID NO: 5993984 - DNA, 14 bp, Homo sapiens
cacactgcagggct

SEQ ID NO: 5993985 - DNA, 14 bp, Homo sapiens
cacactgccttatt

SEQ ID NO: 5993986 - DNA, 21 bp, Homo sapiens
cacactgccttattacataac

SEQ ID NO: 5993987 - DNA, 19 bp, Homo sapiens
cacactgcggtgtctgcag

SEQ ID NO: 5993988 - DNA, 18 bp, Homo sapiens
cacactgctaaatttacg

SEQ ID NO: 5993989 - DNA, 23 bp, Homo sapiens
cacactgctaggtgggccagccc

SEQ ID NO: 5993990 - DNA, 13 bp, Homo sapiens
cacactgctggga

SEQ ID NO: 5993991 - DNA, 14 bp, Homo sapiens
cacactgctgggaa

SEQ ID NO: 5993992 - DNA, 16 bp, Homo sapiens
cacactgctgtcctct

SEQ ID NO: 5993993 - DNA, 17 bp, Homo sapiens
cacactgctgtcctctc

SEQ ID NO: 5993994 - DNA, 22 bp, Homo sapiens
cacactgctgtcctctccccct

SEQ ID NO: 5993995 - DNA, 22 bp, Homo sapiens
cacactgcttctcggaggccag

SEQ ID NO: 5993996 - DNA, 16 bp, Homo sapiens
cacactgcttggccct

SEQ ID NO: 5993997 - DNA, 23 bp, Homo sapiens
cacactggaaattgaaataaaga

SEQ ID NO: 5993998 - DNA, 17 bp, Homo sapiens
cacactggaccccactg

SEQ ID NO: 5993999 - DNA, 13 bp, Homo sapiens
cacactggactcc

SEQ ID NO: 5994000 - DNA, 20 bp, Homo sapiens
cacactggactccgaggtgg

SEQ ID NO: 5994001 - DNA, 13 bp, Homo sapiens
cacactggccaca

SEQ ID NO: 5994002 - DNA, 14 bp, Homo sapiens
cacactggcgtctg

SEQ ID NO: 5994003 - DNA, 15 bp, Homo sapiens
cacactgggcctgga

SEQ ID NO: 5994004 - DNA, 20 bp, Homo sapiens
cacactgggtgcgtctccag

SEQ ID NO: 5994005 - DNA, 18 bp, Homo sapiens
cacactggtacttagagt

SEQ ID NO: 5994006 - DNA, 14 bp, Homo sapiens
cacactggttctca

SEQ ID NO: 5994007 - DNA, 15 bp, Homo sapiens
cacactggttctcaa

SEQ ID NO: 5994008 - DNA, 20 bp, Homo sapiens
cacactggttctcaatgaaa

SEQ ID NO: 5994009 - DNA, 19 bp, Homo sapiens
cacactggtttgccaggcc

SEQ ID NO: 5994010 - DNA, 11 bp, Homo sapiens
cacactgtaaa

SEQ ID NO: 5994011 - DNA, 12 bp, Homo sapiens
cacactgtaaat

SEQ ID NO: 5994012 - DNA, 14 bp, Homo sapiens
cacactgtaaatat

SEQ ID NO: 5994013 - DNA, 21 bp, Homo sapiens
cacactgtaaatatccacaga

SEQ ID NO: 5994014 - DNA, 22 bp, Homo sapiens
cacactgtaaatatccacagac

SEQ ID NO: 5994015 - DNA, 16 bp, Homo sapiens
cacactgtcagagctg

SEQ ID NO: 5994016 - DNA, 20 bp, Homo sapiens
cacactgtcatgcttcatca

SEQ ID NO: 5994017 - DNA, 21 bp, Homo sapiens
cacactgtcatgcttcatcat

SEQ ID NO: 5994018 - DNA, 23 bp, Homo sapiens
cacactgtgattttgccctcctg

SEQ ID NO: 5994019 - DNA, 15 bp, Homo sapiens
cacactgtgctttct

SEQ ID NO: 5994020 - DNA, 17 bp, Homo sapiens
cacactgtggccaggcc

SEQ ID NO: 5994021 - DNA, 18 bp, Homo sapiens
cacactgtggccaggcct

SEQ ID NO: 5994022 - DNA, 18 bp, Homo sapiens
cacactgtggcctgatca

SEQ ID NO: 5994023 - DNA, 19 bp, Homo sapiens
cacactgtggtgtctcttg

SEQ ID NO: 5994024 - DNA, 23 bp, Homo sapiens
cacactgtgtcctggtgctctct

SEQ ID NO: 5994025 - DNA, 22 bp, Homo sapiens
cacactgtgtgaggctgtgtct

SEQ ID NO: 5994026 - DNA, 23 bp, Homo sapiens
cacactgtgtgaggctgtgtctc

SEQ ID NO: 5994027 - DNA, 15 bp, Homo sapiens
cacactgttactcca

SEQ ID NO: 5994028 - DNA, 16 bp, Homo sapiens
cacactgttactccac

SEQ ID NO: 5994029 - DNA, 14 bp, Homo sapiens
cacacttacttttt

SEQ ID NO: 5994030 - DNA, 15 bp, Homo sapiens
cacacttagaatact

SEQ ID NO: 5994031 - DNA, 16 bp, Homo sapiens
cacacttagctggaga

SEQ ID NO: 5994032 - DNA, 15 bp, Homo sapiens
cacacttatatttta

SEQ ID NO: 5994033 - DNA, 18 bp, Homo sapiens
cacacttatattttatga

SEQ ID NO: 5994034 - DNA, 21 bp, Homo sapiens
cacacttcactaaagtgtcat

SEQ ID NO: 5994035 - DNA, 14 bp, Homo sapiens
cacacttcaggctc

SEQ ID NO: 5994036 - DNA, 21 bp, Homo sapiens
cacacttcaggctcttctcct

SEQ ID NO: 5994037 - DNA, 16 bp, Homo sapiens
cacacttccaccagcc

SEQ ID NO: 5994038 - DNA, 14 bp, Homo sapiens
cacacttccagaca

SEQ ID NO: 5994039 - DNA, 15 bp, Homo sapiens
cacacttcccacccc

SEQ ID NO: 5994040 - DNA, 19 bp, Homo sapiens
cacacttcccacccccagg

SEQ ID NO: 5994041 - DNA, 17 bp, Homo sapiens
cacacttccccatcttt

SEQ ID NO: 5994042 - DNA, 12 bp, Homo sapiens
cacacttccctg

SEQ ID NO: 5994043 - DNA, 15 bp, Homo sapiens
cacacttccctggcg

SEQ ID NO: 5994044 - DNA, 23 bp, Homo sapiens
cacacttcctgtccagagagaga

SEQ ID NO: 5994045 - DNA, 17 bp, Homo sapiens
cacacttcgctcttgag

SEQ ID NO: 5994046 - DNA, 18 bp, Homo sapiens
cacacttcgctcttgagg

SEQ ID NO: 5994047 - DNA, 15 bp, Homo sapiens
cacacttctgtgaga

SEQ ID NO: 5994048 - DNA, 22 bp, Homo sapiens
cacacttctgtgagacccccac

SEQ ID NO: 5994049 - DNA, 21 bp, Homo sapiens
cacacttgacatcaactgcat

SEQ ID NO: 5994050 - DNA, 17 bp, Homo sapiens
cacacttgagaggatga

SEQ ID NO: 5994051 - DNA, 19 bp, Homo sapiens
cacacttgagaggatgaat

SEQ ID NO: 5994052 - DNA, 14 bp, Homo sapiens
cacacttgcaaatg

SEQ ID NO: 5994053 - DNA, 16 bp, Homo sapiens
cacacttgcaaatgaa

SEQ ID NO: 5994054 - DNA, 21 bp, Homo sapiens
cacacttgcatacatatatat

SEQ ID NO: 5994055 - DNA, 14 bp, Homo sapiens
cacacttgctgggg

SEQ ID NO: 5994056 - DNA, 22 bp, Homo sapiens
cacacttgtacccacaggtgag

SEQ ID NO: 5994057 - DNA, 17 bp, Homo sapiens
cacacttgtcggctcca

SEQ ID NO: 5994058 - DNA, 23 bp, Homo sapiens
cacacttgtcggctccagtcccc

SEQ ID NO: 5994059 - DNA, 13 bp, Homo sapiens
cacacttgtgcca

SEQ ID NO: 5994060 - DNA, 19 bp, Homo sapiens
cacacttgtgtgtgggctg

SEQ ID NO: 5994061 - DNA, 18 bp, Homo sapiens
cacacttgttccagctct

SEQ ID NO: 5994062 - DNA, 18 bp, Homo sapiens
cacactttcatgcagtgc

SEQ ID NO: 5994063 - DNA, 12 bp, Homo sapiens
cacactttccat

SEQ ID NO: 5994064 - DNA, 19 bp, Homo sapiens
cacactttccatctctgcc

SEQ ID NO: 5994065 - DNA, 21 bp, Homo sapiens
cacactttccatctctgcctg

SEQ ID NO: 5994066 - DNA, 22 bp, Homo sapiens
cacactttccatctctgcctgt

SEQ ID NO: 5994067 - DNA, 17 bp, Homo sapiens
cacactttggtaccaga

SEQ ID NO: 5994068 - DNA, 17 bp, Homo sapiens
cacactttttaagaaat

SEQ ID NO: 5994069 - DNA, 16 bp, Homo sapiens
cacactttttatttaa

SEQ ID NO: 5994070 - DNA, 14 bp, Homo sapiens
cacagaaaaaaatg

SEQ ID NO: 5994071 - DNA, 19 bp, Homo sapiens
cacagaaaaaggatgtttt

SEQ ID NO: 5994072 - DNA, 14 bp, Homo sapiens
cacagaaaactaga

SEQ ID NO: 5994073 - DNA, 13 bp, Homo sapiens
cacagaaaatata

SEQ ID NO: 5994074 - DNA, 14 bp, Homo sapiens
cacagaaaatatac

SEQ ID NO: 5994075 - DNA, 15 bp, Homo sapiens
cacagaaaatatact

SEQ ID NO: 5994076 - DNA, 22 bp, Homo sapiens
cacagaaaatatactgtaaaga

SEQ ID NO: 5994077 - DNA, 20 bp, Homo sapiens
cacagaaaatggaagacagc

SEQ ID NO: 5994078 - DNA, 22 bp, Homo sapiens
cacagaaaatggaagacagctc

SEQ ID NO: 5994079 - DNA, 19 bp, Homo sapiens
cacagaaaattcttctcca

SEQ ID NO: 5994080 - DNA, 21 bp, Homo sapiens
cacagaaacacaatattttgt

SEQ ID NO: 5994081 - DNA, 20 bp, Homo sapiens
cacagaaacactgccttttt

SEQ ID NO: 5994082 - DNA, 14 bp, Homo sapiens
cacagaaaccctgt

SEQ ID NO: 5994083 - DNA, 19 bp, Homo sapiens
cacagaaacctctactaaa

SEQ ID NO: 5994084 - DNA, 20 bp, Homo sapiens
cacagaaacggtctttatga

SEQ ID NO: 5994085 - DNA, 13 bp, Homo sapiens
cacagaaagagag

SEQ ID NO: 5994086 - DNA, 18 bp, Homo sapiens
cacagaaagagagcactg

SEQ ID NO: 5994087 - DNA, 23 bp, Homo sapiens
cacagaaagccaggagcagccct

SEQ ID NO: 5994088 - DNA, 12 bp, Homo sapiens
cacagaaagcct

SEQ ID NO: 5994089 - DNA, 18 bp, Homo sapiens
cacagaaagcctatcaaa

SEQ ID NO: 5994090 - DNA, 23 bp, Homo sapiens
cacagaaagcctatcaaagacct

SEQ ID NO: 5994091 - DNA, 23 bp, Homo sapiens
cacagaaagctagatatgcctta

SEQ ID NO: 5994092 - DNA, 19 bp, Homo sapiens
cacagaaaggcaggtttca

SEQ ID NO: 5994093 - DNA, 18 bp, Homo sapiens
cacagaaagggcagcttc

SEQ ID NO: 5994094 - DNA, 12 bp, Homo sapiens
cacagaaatata

SEQ ID NO: 5994095 - DNA, 23 bp, Homo sapiens
cacagaaatatatatacatatgt

SEQ ID NO: 5994096 - DNA, 13 bp, Homo sapiens
cacagaaatgctg

SEQ ID NO: 5994097 - DNA, 14 bp, Homo sapiens
cacagaaatgctgc

SEQ ID NO: 5994098 - DNA, 16 bp, Homo sapiens
cacagaaatgctgctg

SEQ ID NO: 5994099 - DNA, 17 bp, Homo sapiens
cacagaaatgctgctgg

SEQ ID NO: 5994100 - DNA, 12 bp, Homo sapiens
cacagaaattat

SEQ ID NO: 5994101 - DNA, 11 bp, Homo sapiens
cacagaacagg

SEQ ID NO: 5994102 - DNA, 18 bp, Homo sapiens
cacagaacaggaactaga

SEQ ID NO: 5994103 - DNA, 22 bp, Homo sapiens
cacagaaccttcaacccagtgg

SEQ ID NO: 5994104 - DNA, 17 bp, Homo sapiens
cacagaacctttgtcaa

SEQ ID NO: 5994105 - DNA, 20 bp, Homo sapiens
cacagaagacacgtgttttt

SEQ ID NO: 5994106 - DNA, 19 bp, Homo sapiens
cacagaagacttcccagct

SEQ ID NO: 5994107 - DNA, 15 bp, Homo sapiens
cacagaagaggagtc

SEQ ID NO: 5994108 - DNA, 13 bp, Homo sapiens
cacagaagatgaa

SEQ ID NO: 5994109 - DNA, 16 bp, Homo sapiens
cacagaagcacatgca

SEQ ID NO: 5994110 - DNA, 18 bp, Homo sapiens
cacagaagccaggagcaa

SEQ ID NO: 5994111 - DNA, 22 bp, Homo sapiens
cacagaaggaaggagccagctc

SEQ ID NO: 5994112 - DNA, 19 bp, Homo sapiens
cacagaaggaatctgtgca

SEQ ID NO: 5994113 - DNA, 12 bp, Homo sapiens
cacagaagggga

SEQ ID NO: 5994114 - DNA, 21 bp, Homo sapiens
cacagaagtccctaggaggga

SEQ ID NO: 5994115 - DNA, 12 bp, Homo sapiens
cacagaagtcct

SEQ ID NO: 5994116 - DNA, 15 bp, Homo sapiens
cacagaatagtttac

SEQ ID NO: 5994117 - DNA, 16 bp, Homo sapiens
cacagaatagtttaca

SEQ ID NO: 5994118 - DNA, 12 bp, Homo sapiens
cacagaatatag

SEQ ID NO: 5994119 - DNA, 19 bp, Homo sapiens
cacagaatgcaaccaagtc

SEQ ID NO: 5994120 - DNA, 23 bp, Homo sapiens
cacagaatttgtatgtattttca

SEQ ID NO: 5994121 - DNA, 19 bp, Homo sapiens
cacagacacaatatgtatg

SEQ ID NO: 5994122 - DNA, 14 bp, Homo sapiens
cacagacacacaca

SEQ ID NO: 5994123 - DNA, 15 bp, Homo sapiens
cacagacacacacac

SEQ ID NO: 5994124 - DNA, 22 bp, Homo sapiens
cacagacacacacacgcacgca

SEQ ID NO: 5994125 - DNA, 21 bp, Homo sapiens
cacagacacgctcgcgggcag

SEQ ID NO: 5994126 - DNA, 22 bp, Homo sapiens
cacagacacgctcgcgggcagc

SEQ ID NO: 5994127 - DNA, 14 bp, Homo sapiens
cacagacagatccc

SEQ ID NO: 5994128 - DNA, 20 bp, Homo sapiens
cacagacagatcccatccat

SEQ ID NO: 5994129 - DNA, 10 bp, Homo sapiens
cacagacagg

SEQ ID NO: 5994130 - DNA, 13 bp, Homo sapiens
cacagacaggacc

SEQ ID NO: 5994131 - DNA, 17 bp, Homo sapiens
cacagacaggacccctg

SEQ ID NO: 5994132 - DNA, 19 bp, Homo sapiens
cacagacagggtcaaagtg

SEQ ID NO: 5994133 - DNA, 13 bp, Homo sapiens
cacagacaggttt

SEQ ID NO: 5994134 - DNA, 18 bp, Homo sapiens
cacagacatactaaccag

SEQ ID NO: 5994135 - DNA, 18 bp, Homo sapiens
cacagacattctgccagg

SEQ ID NO: 5994136 - DNA, 17 bp, Homo sapiens
cacagacattttgtgtg

SEQ ID NO: 5994137 - DNA, 17 bp, Homo sapiens
cacagaccacaggaaga

SEQ ID NO: 5994138 - DNA, 21 bp, Homo sapiens
cacagacccaggacccccgag

SEQ ID NO: 5994139 - DNA, 13 bp, Homo sapiens
cacagacccctcc

SEQ ID NO: 5994140 - DNA, 14 bp, Homo sapiens
cacagacccctccc

SEQ ID NO: 5994141 - DNA, 16 bp, Homo sapiens
cacagacccctgggag

SEQ ID NO: 5994142 - DNA, 20 bp, Homo sapiens
cagagaatagatcagtattt

SEQ ID NO: 5994143 - DNA, 19 bp, Homo sapiens
cagagaatataacatgaaa

SEQ ID NO: 5994144 - DNA, 18 bp, Homo sapiens
cagagaatatcaagatga

SEQ ID NO: 5994145 - DNA, 17 bp, Homo sapiens
cagagaatcagggcagg

SEQ ID NO: 5994146 - DNA, 19 bp, Homo sapiens
cagagaatcatacttagca

SEQ ID NO: 5994147 - DNA, 19 bp, Homo sapiens
cagagaatgaaagggccca

SEQ ID NO: 5994148 - DNA, 20 bp, Homo sapiens
cagagaatgaaagggcccag

SEQ ID NO: 5994149 - DNA, 18 bp, Homo sapiens
cagagaatggctgggtca

SEQ ID NO: 5994150 - DNA, 19 bp, Homo sapiens
cagagaatggctgggtcag

SEQ ID NO: 5994151 - DNA, 19 bp, Homo sapiens
cagagaatgttagccatga

SEQ ID NO: 5994152 - DNA, 20 bp, Homo sapiens
cagagaattactatttactt

SEQ ID NO: 5994153 - DNA, 13 bp, Homo sapiens
cagagaatttcta

SEQ ID NO: 5994154 - DNA, 16 bp, Homo sapiens
cagagaatttctacca

SEQ ID NO: 5994155 - DNA, 12 bp, Homo sapiens
cagagacaaaat

SEQ ID NO: 5994156 - DNA, 20 bp, Homo sapiens
cagagacaaaatatttccca

SEQ ID NO: 5994157 - DNA, 14 bp, Homo sapiens
cagagacaacaggt

SEQ ID NO: 5994158 - DNA, 20 bp, Homo sapiens
cagagacaagaaaggcagac

SEQ ID NO: 5994159 - DNA, 16 bp, Homo sapiens
cagagacaagcagagt

SEQ ID NO: 5994160 - DNA, 13 bp, Homo sapiens
cagagacaaggag

SEQ ID NO: 5994161 - DNA, 17 bp, Homo sapiens
cagagacaatcacgggc

SEQ ID NO: 5994162 - DNA, 13 bp, Homo sapiens
cagagacacctgc

SEQ ID NO: 5994163 - DNA, 14 bp, Homo sapiens
cagagacacctgca

SEQ ID NO: 5994164 - DNA, 18 bp, Homo sapiens
cagagacacctgcacctc

SEQ ID NO: 5994165 - DNA, 21 bp, Homo sapiens
cagagacactgttgataaaaa

SEQ ID NO: 5994166 - DNA, 22 bp, Homo sapiens
cagagacactgttgataaaaac

SEQ ID NO: 5994167 - DNA, 14 bp, Homo sapiens
cagagacactttgt

SEQ ID NO: 5994168 - DNA, 13 bp, Homo sapiens
cagagacagagag

SEQ ID NO: 5994169 - DNA, 15 bp, Homo sapiens
cagagacagagagag

SEQ ID NO: 5994170 - DNA, 16 bp, Homo sapiens
cagagacagagagaga

SEQ ID NO: 5994171 - DNA, 22 bp, Homo sapiens
cagagacagaggatgtggcctg

SEQ ID NO: 5994172 - DNA, 16 bp, Homo sapiens
cagagacagatacctc

SEQ ID NO: 5994173 - DNA, 20 bp, Homo sapiens
cagagacagatacctccaac

SEQ ID NO: 5994174 - DNA, 14 bp, Homo sapiens
cagagacagctgat

SEQ ID NO: 5994175 - DNA, 13 bp, Homo sapiens
cagagacaggaaa

SEQ ID NO: 5994176 - DNA, 14 bp, Homo sapiens
cagagacaggtggc

SEQ ID NO: 5994177 - DNA, 15 bp, Homo sapiens
cagagacatacttga

SEQ ID NO: 5994178 - DNA, 16 bp, Homo sapiens
cagagacatacttgaa

SEQ ID NO: 5994179 - DNA, 16 bp, Homo sapiens
cagagacatgcagaga

SEQ ID NO: 5994180 - DNA, 18 bp, Homo sapiens
cagagacatgcagagatt

SEQ ID NO: 5994181 - DNA, 20 bp, Homo sapiens
cagagacatgggcctcccac

SEQ ID NO: 5994182 - DNA, 17 bp, Homo sapiens
cagagacattcatttag

SEQ ID NO: 5994183 - DNA, 19 bp, Homo sapiens
cagagacattcctccgagc

SEQ ID NO: 5994184 - DNA, 23 bp, Homo sapiens
cagagaccaagatggcccatcct

SEQ ID NO: 5994185 - DNA, 22 bp, Homo sapiens
cagagaccaccgcgcccctctg

SEQ ID NO: 5994186 - DNA, 13 bp, Homo sapiens
cagagaccagcac

SEQ ID NO: 5994187 - DNA, 16 bp, Homo sapiens
cagagaccagcactca

SEQ ID NO: 5994188 - DNA, 16 bp, Homo sapiens
cagagaccaggctgtg

SEQ ID NO: 5994189 - DNA, 18 bp, Homo sapiens
cagagaccataagagaaa

SEQ ID NO: 5994190 - DNA, 21 bp, Homo sapiens
cagagaccataagagaaacct

SEQ ID NO: 5994191 - DNA, 13 bp, Homo sapiens
cagagaccatccc

SEQ ID NO: 5994192 - DNA, 18 bp, Homo sapiens
cagagaccatccctgaag

SEQ ID NO: 5994193 - DNA, 14 bp, Homo sapiens
cagagaccattgca

SEQ ID NO: 5994194 - DNA, 21 bp, Homo sapiens
cagagacccagatctcatgga

SEQ ID NO: 5994195 - DNA, 14 bp, Homo sapiens
cagagaccccagga

SEQ ID NO: 5994196 - DNA, 14 bp, Homo sapiens
cagagacccctcaa

SEQ ID NO: 5994197 - DNA, 22 bp, Homo sapiens
cagagaccccttcctttcctct

SEQ ID NO: 5994198 - DNA, 15 bp, Homo sapiens
cagagaccctctgcc

SEQ ID NO: 5994199 - DNA, 20 bp, Homo sapiens
cagagaccctctgccaccag

SEQ ID NO: 5994200 - DNA, 17 bp, Homo sapiens
cagagaccctggttttt

SEQ ID NO: 5994201 - DNA, 13 bp, Homo sapiens
cagagaccgtcct

SEQ ID NO: 5994202 - DNA, 18 bp, Homo sapiens
cagagaccgtcctcaccc

SEQ ID NO: 5994203 - DNA, 19 bp, Homo sapiens
cagagaccgtcctcacccc

SEQ ID NO: 5994204 - DNA, 17 bp, Homo sapiens
cagagacctccctgttc

SEQ ID NO: 5994205 - DNA, 18 bp, Homo sapiens
cagagacctcctgcctcc

SEQ ID NO: 5994206 - DNA, 15 bp, Homo sapiens
cagagacctgaagtg

SEQ ID NO: 5994207 - DNA, 18 bp, Homo sapiens
cagagacctgaggcagat

SEQ ID NO: 5994208 - DNA, 16 bp, Homo sapiens
cagagacctgctccag

SEQ ID NO: 5994209 - DNA, 10 bp, Homo sapiens
cagagacctt

SEQ ID NO: 5994210 - DNA, 23 bp, Homo sapiens
cagagaccttgcgaccatgtgta

SEQ ID NO: 5994211 - DNA, 17 bp, Homo sapiens
cagagacctttgcccac

SEQ ID NO: 5994212 - DNA, 15 bp, Homo sapiens
cagagacgcaaggga

SEQ ID NO: 5994213 - DNA, 18 bp, Homo sapiens
cagagacgcaagggagaa

SEQ ID NO: 5994214 - DNA, 21 bp, Homo sapiens
cagagacgcaagggagaagaa

SEQ ID NO: 5994215 - DNA, 15 bp, Homo sapiens
cagagacgcaggaat

SEQ ID NO: 5994216 - DNA, 17 bp, Homo sapiens
cagagacgcaggaatgg

SEQ ID NO: 5994217 - DNA, 13 bp, Homo sapiens
cagagacgcccag

SEQ ID NO: 5994218 - DNA, 13 bp, Homo sapiens
cagagacggcaga

SEQ ID NO: 5994219 - DNA, 16 bp, Homo sapiens
cagagacggcagcccc

SEQ ID NO: 5994220 - DNA, 17 bp, Homo sapiens
cagagactcagcgctcc

SEQ ID NO: 5994221 - DNA, 21 bp, Homo sapiens
cagagactcagcgctcctcct

SEQ ID NO: 5994222 - DNA, 22 bp, Homo sapiens
cagagactcagcgctcctcctg

SEQ ID NO: 5994223 - DNA, 19 bp, Homo sapiens
cagagactcagggccccag

SEQ ID NO: 5994224 - DNA, 21 bp, Homo sapiens
cagagactcagggccccagca

SEQ ID NO: 5994225 - DNA, 21 bp, Homo sapiens
cagagactcatttcacagcct

SEQ ID NO: 5994226 - DNA, 17 bp, Homo sapiens
cagagactcccaggagt

SEQ ID NO: 5994227 - DNA, 21 bp, Homo sapiens
cagagactcctgcaggcagcc

SEQ ID NO: 5994228 - DNA, 22 bp, Homo sapiens
cagagactcgagtccccatgat

SEQ ID NO: 5994229 - DNA, 12 bp, Homo sapiens
cagagactctat

SEQ ID NO: 5994230 - DNA, 16 bp, Homo sapiens
cagagactctatttta

SEQ ID NO: 5994231 - DNA, 18 bp, Homo sapiens
cagagactctattttaat

SEQ ID NO: 5994232 - DNA, 21 bp, Homo sapiens
cagagactctggaagcccccc

SEQ ID NO: 5994233 - DNA, 15 bp, Homo sapiens
cagagactgcaagct

SEQ ID NO: 5994234 - DNA, 12 bp, Homo sapiens
cagagactgccc

SEQ ID NO: 5994235 - DNA, 14 bp, Homo sapiens
cagagactgcccac

SEQ ID NO: 5994236 - DNA, 15 bp, Homo sapiens
cagagactgcccacc

SEQ ID NO: 5994237 - DNA, 18 bp, Homo sapiens
cagagactgcccaccctg

SEQ ID NO: 5994238 - DNA, 13 bp, Homo sapiens
cagagactgccct

SEQ ID NO: 5994239 - DNA, 14 bp, Homo sapiens
cagagactggcagc

SEQ ID NO: 5994240 - DNA, 16 bp, Homo sapiens
cagagactggcatttt

SEQ ID NO: 5994241 - DNA, 19 bp, Homo sapiens
cagagactggggcctggac

SEQ ID NO: 5994242 - DNA, 21 bp, Homo sapiens
cagagactgtccctgaaacct

SEQ ID NO: 5994243 - DNA, 19 bp, Homo sapiens
cagagactgtttgaatctt

SEQ ID NO: 5994244 - DNA, 18 bp, Homo sapiens
cagagacttgggacattg

SEQ ID NO: 5994245 - DNA, 17 bp, Homo sapiens
cagagagaaaaagagag

SEQ ID NO: 5994246 - DNA, 23 bp, Homo sapiens
cagagagaaaaagagagagcagg

SEQ ID NO: 5994247 - DNA, 18 bp, Homo sapiens
cagagagaaatcaggcct

SEQ ID NO: 5994248 - DNA, 19 bp, Homo sapiens
cagagagaagagccccact

SEQ ID NO: 5994249 - DNA, 21 bp, Homo sapiens
cagagagaagagccccactct

SEQ ID NO: 5994250 - DNA, 22 bp, Homo sapiens
cagagagaagagccccactctc

SEQ ID NO: 5994251 - DNA, 14 bp, Homo sapiens
cagagagaagcctg

SEQ ID NO: 5994252 - DNA, 22 bp, Homo sapiens
cagagagaatgagagcgacaca

SEQ ID NO: 5994253 - DNA, 18 bp, Homo sapiens
cagagagacccgggaagg

SEQ ID NO: 5994254 - DNA, 21 bp, Homo sapiens
cagagagacccgggaaggaag

SEQ ID NO: 5994255 - DNA, 16 bp, Homo sapiens
cagagagaccctgcaa

SEQ ID NO: 5994256 - DNA, 17 bp, Homo sapiens
cagagagaccctgccaa

SEQ ID NO: 5994257 - DNA, 16 bp, Homo sapiens
cagagagacccttgtg

SEQ ID NO: 5994258 - DNA, 20 bp, Homo sapiens
cagagagacctcatcctgct

SEQ ID NO: 5994259 - DNA, 24 bp, Homo sapiens
cagagagagaagtgcccctgctgc

SEQ ID NO: 5994260 - DNA, 17 bp, Homo sapiens
cagagagagacagagac

SEQ ID NO: 5994261 - DNA, 15 bp, Homo sapiens
cagagagagagaaag

SEQ ID NO: 5994262 - DNA, 22 bp, Homo sapiens
cagagagagagaatggatcctc

SEQ ID NO: 5994263 - DNA, 16 bp, Homo sapiens
cagagagagagagaga

SEQ ID NO: 5994264 - DNA, 23 bp, Homo sapiens
cagagagagagagagagaaagag

SEQ ID NO: 5994265 - DNA, 18 bp, Homo sapiens
cagagagagcaaggaagc

SEQ ID NO: 5994266 - DNA, 13 bp, Homo sapiens
cagagagagccag

SEQ ID NO: 5994267 - DNA, 14 bp, Homo sapiens
cagagagagccaga

SEQ ID NO: 5994268 - DNA, 16 bp, Homo sapiens
cagagagaggcgtcct

SEQ ID NO: 5994269 - DNA, 20 bp, Homo sapiens
cagagagaggcgtcctggtg

SEQ ID NO: 5994270 - DNA, 12 bp, Homo sapiens
cagagagagggg

SEQ ID NO: 5994271 - DNA, 22 bp, Homo sapiens
cagagagaggggagaagcctgg

SEQ ID NO: 5994272 - DNA, 20 bp, Homo sapiens
cagagagaggggcctgcagg

SEQ ID NO: 5994273 - DNA, 20 bp, Homo sapiens
cagagagatcttcccataat

SEQ ID NO: 5994274 - DNA, 13 bp, Homo sapiens
cagagagcaaaca

SEQ ID NO: 5994275 - DNA, 16 bp, Homo sapiens
cagagagcaaaggaga

SEQ ID NO: 5994276 - DNA, 15 bp, Homo sapiens
cagagagcaaggcat

SEQ ID NO: 5994277 - DNA, 13 bp, Homo sapiens
cagagagcaggca

SEQ ID NO: 5994278 - DNA, 18 bp, Homo sapiens
cagagagcaggcaggggc

SEQ ID NO: 5994279 - DNA, 17 bp, Homo sapiens
cagagagcaggggagct

SEQ ID NO: 5994280 - DNA, 21 bp, Homo sapiens
cagagagcaggggagcttggg

SEQ ID NO: 5994281 - DNA, 22 bp, Homo sapiens
cagagagcaggggagcttggga

SEQ ID NO: 5994282 - DNA, 20 bp, Homo sapiens
cagagagcctggtgctgctg

SEQ ID NO: 5994283 - DNA, 18 bp, Homo sapiens
cagagagcggtctcaggc

SEQ ID NO: 5994284 - DNA, 17 bp, Homo sapiens
cagagagctcctccctg

SEQ ID NO: 5994285 - DNA, 17 bp, Homo sapiens
cagagagctgaagtact

SEQ ID NO: 5994286 - DNA, 12 bp, Homo sapiens
cagagagctggt

SEQ ID NO: 5994287 - DNA, 16 bp, Homo sapiens
cagagagcttcaacta

SEQ ID NO: 5994288 - DNA, 15 bp, Homo sapiens
cagagaggaatcaga

SEQ ID NO: 5994289 - DNA, 16 bp, Homo sapiens
cagagaggacaaaata

SEQ ID NO: 5994290 - DNA, 13 bp, Homo sapiens
cagagaggagaaa

SEQ ID NO: 5994291 - DNA, 16 bp, Homo sapiens
cagagaggagaaacac

SEQ ID NO: 5994292 - DNA, 22 bp, Homo sapiens
cagagaggagaaacacatcttc

SEQ ID NO: 5994293 - DNA, 15 bp, Homo sapiens
cagagaggagcacct

SEQ ID NO: 5994294 - DNA, 13 bp, Homo sapiens
cagagaggagggg

SEQ ID NO: 5994295 - DNA, 17 bp, Homo sapiens
cagagaggagtcagaga

SEQ ID NO: 5994296 - DNA, 17 bp, Homo sapiens
cagagaggatacattta

SEQ ID NO: 5994297 - DNA, 14 bp, Homo sapiens
cagagaggctggat

SEQ ID NO: 5994298 - DNA, 17 bp, Homo sapiens
cagagagggaaaaggca

SEQ ID NO: 5994299 - DNA, 22 bp, Homo sapiens
cagagagggaaaaggcaggtgc

SEQ ID NO: 5994300 - DNA, 20 bp, Homo sapiens
cagagagggaagatgacctg

SEQ ID NO: 5994301 - DNA, 23 bp, Homo sapiens
cagagagggaagatgacctgccc

SEQ ID NO: 5994302 - DNA, 19 bp, Homo sapiens
cagagagggaagctgaggc

SEQ ID NO: 5994303 - DNA, 21 bp, Homo sapiens
cagagagggaagctgaggccc

SEQ ID NO: 5994304 - DNA, 14 bp, Homo sapiens
cagagagggcaggc

SEQ ID NO: 5994305 - DNA, 16 bp, Homo sapiens
cagagagggcaggcat

SEQ ID NO: 5994306 - DNA, 14 bp, Homo sapiens
cagagagggcccag

SEQ ID NO: 5994307 - DNA, 17 bp, Homo sapiens
cagagagggcccagctg

SEQ ID NO: 5994308 - DNA, 21 bp, Homo sapiens
cagagaggggaggtgggagga

SEQ ID NO: 5994309 - DNA, 23 bp, Homo sapiens
cagagaggggcagggaaggagac

SEQ ID NO: 5994310 - DNA, 19 bp, Homo sapiens
cagagagggtcactggggg

SEQ ID NO: 5994311 - DNA, 18 bp, Homo sapiens
cagagagggtgacaagat

SEQ ID NO: 5994312 - DNA, 13 bp, Homo sapiens
cagagagggtggg

SEQ ID NO: 5994313 - DNA, 17 bp, Homo sapiens
cagagagggtggtgacc

SEQ ID NO: 5994314 - DNA, 20 bp, Homo sapiens
cagagagggtggtgacctct

SEQ ID NO: 5994315 - DNA, 17 bp, Homo sapiens
cagagaggtaaagggtg

SEQ ID NO: 5994316 - DNA, 22 bp, Homo sapiens
cagagaggtagcactctcagag

SEQ ID NO: 5994317 - DNA, 19 bp, Homo sapiens
cagagaggtcaagcccagg

SEQ ID NO: 5994318 - DNA, 15 bp, Homo sapiens
cagagaggtggccac

SEQ ID NO: 5994319 - DNA, 18 bp, Homo sapiens
cagagaggtttgcagtcc

SEQ ID NO: 5994320 - DNA, 23 bp, Homo sapiens
cagagagtacactgtgtctctat

SEQ ID NO: 5994321 - DNA, 16 bp, Homo sapiens
cacagacccctggggg

SEQ ID NO: 5994322 - DNA, 16 bp, Homo sapiens
cacagaccctgcccac

SEQ ID NO: 5994323 - DNA, 23 bp, Homo sapiens
cacagaccctgcccaccccatcc

SEQ ID NO: 5994324 - DNA, 16 bp, Homo sapiens
cacagaccctgccctg

SEQ ID NO: 5994325 - DNA, 20 bp, Homo sapiens
cacagaccgccgtctaactc

SEQ ID NO: 5994326 - DNA, 19 bp, Homo sapiens
cacagaccgcgcccctggg

SEQ ID NO: 5994327 - DNA, 20 bp, Homo sapiens
cacagaccgcgcccctggga

SEQ ID NO: 5994328 - DNA, 16 bp, Homo sapiens
cacagacctcagagat

SEQ ID NO: 5994329 - DNA, 14 bp, Homo sapiens
cacagacctgctct

SEQ ID NO: 5994330 - DNA, 22 bp, Homo sapiens
cacagacctgctctggacactt

SEQ ID NO: 5994331 - DNA, 19 bp, Homo sapiens
cacagacgccttactggca

SEQ ID NO: 5994332 - DNA, 17 bp, Homo sapiens
cacagacggaggaagcc

SEQ ID NO: 5994333 - DNA, 22 bp, Homo sapiens
cacagacggaggactggaactg

SEQ ID NO: 5994334 - DNA, 17 bp, Homo sapiens
cacagactacagccaga

SEQ ID NO: 5994335 - DNA, 19 bp, Homo sapiens
cacagactacagccagaag

SEQ ID NO: 5994336 - DNA, 18 bp, Homo sapiens
cacagactcaaatgctca

SEQ ID NO: 5994337 - DNA, 20 bp, Homo sapiens
cacagactcaatgtgctctg

SEQ ID NO: 5994338 - DNA, 21 bp, Homo sapiens
cacagactcatcctgaacagc

SEQ ID NO: 5994339 - DNA, 15 bp, Homo sapiens
cacagactccctccc

SEQ ID NO: 5994340 - DNA, 11 bp, Homo sapiens
cacagactctg

SEQ ID NO: 5994341 - DNA, 19 bp, Homo sapiens
cacagactcttacgtggag

SEQ ID NO: 5994342 - DNA, 16 bp, Homo sapiens
cacagactcttccacc

SEQ ID NO: 5994343 - DNA, 20 bp, Homo sapiens
cacagactcttccaccagag

SEQ ID NO: 5994344 - DNA, 16 bp, Homo sapiens
cacagactgccccagc

SEQ ID NO: 5994345 - DNA, 17 bp, Homo sapiens
cacagactgctgtctta

SEQ ID NO: 5994346 - DNA, 20 bp, Homo sapiens
cacagactggagacaatgca

SEQ ID NO: 5994347 - DNA, 20 bp, Homo sapiens
cacagactggcaataaactc

SEQ ID NO: 5994348 - DNA, 19 bp, Homo sapiens
cacagactggttttgcaac

SEQ ID NO: 5994349 - DNA, 20 bp, Homo sapiens
cacagactgttccctccaag

SEQ ID NO: 5994350 - DNA, 23 bp, Homo sapiens
cacagactgttgtccctgcactc

SEQ ID NO: 5994351 - DNA, 16 bp, Homo sapiens
cacagacttctggaag

SEQ ID NO: 5994352 - DNA, 20 bp, Homo sapiens
cacagacttctggaaggctg

SEQ ID NO: 5994353 - DNA, 21 bp, Homo sapiens
cacagacttctggaaggctgg

SEQ ID NO: 5994354 - DNA, 22 bp, Homo sapiens
cacagacttctggaaggctggc

SEQ ID NO: 5994355 - DNA, 23 bp, Homo sapiens
cacagacttctggaaggctggct

SEQ ID NO: 5994356 - DNA, 14 bp, Homo sapiens
cacagactttctgt

SEQ ID NO: 5994357 - DNA, 19 bp, Homo sapiens
cacagagaaagtacttctc

SEQ ID NO: 5994358 - DNA, 17 bp, Homo sapiens
cacagagaagacaaaat

SEQ ID NO: 5994359 - DNA, 15 bp, Homo sapiens
cacagagaagctcct

SEQ ID NO: 5994360 - DNA, 23 bp, Homo sapiens
cacagagaagtttgtagccaggt

SEQ ID NO: 5994361 - DNA, 14 bp, Homo sapiens
cacagagacacagg

SEQ ID NO: 5994362 - DNA, 18 bp, Homo sapiens
cacagagacacagggcat

SEQ ID NO: 5994363 - DNA, 24 bp, Homo sapiens
cacagagacatgggagtggggagc

SEQ ID NO: 5994364 - DNA, 21 bp, Homo sapiens
cacagagacattcctccgagc

SEQ ID NO: 5994365 - DNA, 10 bp, Homo sapiens
cacagagacc

SEQ ID NO: 5994366 - DNA, 14 bp, Homo sapiens
cacagagacccccg

SEQ ID NO: 5994367 - DNA, 23 bp, Homo sapiens
cacagagacccccggaacaagcc

SEQ ID NO: 5994368 - DNA, 19 bp, Homo sapiens
cacagagacccccgtgcca

SEQ ID NO: 5994369 - DNA, 21 bp, Homo sapiens
cacagagactgtttgaatctt

SEQ ID NO: 5994370 - DNA, 18 bp, Homo sapiens
cacagagagacagacttg

SEQ ID NO: 5994371 - DNA, 14 bp, Homo sapiens
cacagagagagtca

SEQ ID NO: 5994372 - DNA, 13 bp, Homo sapiens
cacagagaggagg

SEQ ID NO: 5994373 - DNA, 18 bp, Homo sapiens
cacagagagggagagcag

SEQ ID NO: 5994374 - DNA, 19 bp, Homo sapiens
cacagagagggagagcaga

SEQ ID NO: 5994375 - DNA, 22 bp, Homo sapiens
cacagagagggagagcagagaa

SEQ ID NO: 5994376 - DNA, 23 bp, Homo sapiens
cacagagagggagagcagagaaa

SEQ ID NO: 5994377 - DNA, 16 bp, Homo sapiens
cacagagagtcccact

SEQ ID NO: 5994378 - DNA, 16 bp, Homo sapiens
cacagagatatgcaca

SEQ ID NO: 5994379 - DNA, 16 bp, Homo sapiens
cacagagattctggat

SEQ ID NO: 5994380 - DNA, 22 bp, Homo sapiens
cacagagattctggatctcctg

SEQ ID NO: 5994381 - DNA, 16 bp, Homo sapiens
cacagagcaaaagagg

SEQ ID NO: 5994382 - DNA, 19 bp, Homo sapiens
cacagagcaagtcctcact

SEQ ID NO: 5994383 - DNA, 21 bp, Homo sapiens
cacagagcaagtcctcactct

SEQ ID NO: 5994384 - DNA, 18 bp, Homo sapiens
cacagagcacacttattt

SEQ ID NO: 5994385 - DNA, 17 bp, Homo sapiens
cacagagcacgcctgcc

SEQ ID NO: 5994386 - DNA, 19 bp, Homo sapiens
cacagagcatggcctccag

SEQ ID NO: 5994387 - DNA, 20 bp, Homo sapiens
cacagagccaaattggtaga

SEQ ID NO: 5994388 - DNA, 15 bp, Homo sapiens
cacagagcctgcctc

SEQ ID NO: 5994389 - DNA, 23 bp, Homo sapiens
cacagagcgcctcacctgcatcc

SEQ ID NO: 5994390 - DNA, 14 bp, Homo sapiens
cacagagcggggac

SEQ ID NO: 5994391 - DNA, 23 bp, Homo sapiens
cacagagctaactgggttacagt

SEQ ID NO: 5994392 - DNA, 16 bp, Homo sapiens
cacagagctctccagc

SEQ ID NO: 5994393 - DNA, 21 bp, Homo sapiens
cacagagctgctattaaatta

SEQ ID NO: 5994394 - DNA, 15 bp, Homo sapiens
cacagaggacacaga

SEQ ID NO: 5994395 - DNA, 19 bp, Homo sapiens
cacagaggacagcttcccc

SEQ ID NO: 5994396 - DNA, 13 bp, Homo sapiens
cacagaggacctc

SEQ ID NO: 5994397 - DNA, 21 bp, Homo sapiens
cacagaggcagcccgcacacc

SEQ ID NO: 5994398 - DNA, 16 bp, Homo sapiens
cacagaggcagtagga

SEQ ID NO: 5994399 - DNA, 17 bp, Homo sapiens
cacagaggcagtggcag

SEQ ID NO: 5994400 - DNA, 15 bp, Homo sapiens
cacagaggccccacc

SEQ ID NO: 5994401 - DNA, 15 bp, Homo sapiens
cacagaggcctgact

SEQ ID NO: 5994402 - DNA, 13 bp, Homo sapiens
cacagaggctgcc

SEQ ID NO: 5994403 - DNA, 15 bp, Homo sapiens
cacagaggctggcac

SEQ ID NO: 5994404 - DNA, 16 bp, Homo sapiens
cacagaggctggcact

SEQ ID NO: 5994405 - DNA, 13 bp, Homo sapiens
cacagagggcgct

SEQ ID NO: 5994406 - DNA, 16 bp, Homo sapiens
cacagagggcgtgtgc

SEQ ID NO: 5994407 - DNA, 23 bp, Homo sapiens
cacagaggtagtctcactgcttg

SEQ ID NO: 5994408 - DNA, 19 bp, Homo sapiens
cacagaggtctttcagctc

SEQ ID NO: 5994409 - DNA, 15 bp, Homo sapiens
cacagagtaagacat

SEQ ID NO: 5994410 - DNA, 16 bp, Homo sapiens
cacagagtaagacatt

SEQ ID NO: 5994411 - DNA, 17 bp, Homo sapiens
cacagagtaagacattg

SEQ ID NO: 5994412 - DNA, 16 bp, Homo sapiens
cacagagtataaataa

SEQ ID NO: 5994413 - DNA, 20 bp, Homo sapiens
cacagagtcaaggcctgctc

SEQ ID NO: 5994414 - DNA, 12 bp, Homo sapiens
cacagagtgaga

SEQ ID NO: 5994415 - DNA, 18 bp, Homo sapiens
cacagagtgccatccctg

SEQ ID NO: 5994416 - DNA, 20 bp, Homo sapiens
cacagagtggagccctcagt

SEQ ID NO: 5994417 - DNA, 18 bp, Homo sapiens
cacagagtggtctttctg

SEQ ID NO: 5994418 - DNA, 19 bp, Homo sapiens
cacagagtgtgctgctatt

SEQ ID NO: 5994419 - DNA, 16 bp, Homo sapiens
cacagagttgttacat

SEQ ID NO: 5994420 - DNA, 22 bp, Homo sapiens
cacagataactgaaaattattt

SEQ ID NO: 5994421 - DNA, 13 bp, Homo sapiens
cacagatacctca

SEQ ID NO: 5994422 - DNA, 21 bp, Homo sapiens
cacagatacctcatcatccac

SEQ ID NO: 5994423 - DNA, 18 bp, Homo sapiens
cacagatatacacatgga

SEQ ID NO: 5994424 - DNA, 19 bp, Homo sapiens
cacagatatatacacacag

SEQ ID NO: 5994425 - DNA, 23 bp, Homo sapiens
cacagatatatacacacagtgga

SEQ ID NO: 5994426 - DNA, 18 bp, Homo sapiens
cacagatatctttttcat

SEQ ID NO: 5994427 - DNA, 18 bp, Homo sapiens
cacagatatgcacacaca

SEQ ID NO: 5994428 - DNA, 14 bp, Homo sapiens
cacagatatttcca

SEQ ID NO: 5994429 - DNA, 15 bp, Homo sapiens
cacagatcaagtgaa

SEQ ID NO: 5994430 - DNA, 11 bp, Homo sapiens
cacagatcatg

SEQ ID NO: 5994431 - DNA, 10 bp, Homo sapiens
cacagatcca

SEQ ID NO: 5994432 - DNA, 16 bp, Homo sapiens
cacagatcccctggaa

SEQ ID NO: 5994433 - DNA, 13 bp, Homo sapiens
cacagatctcttg

SEQ ID NO: 5994434 - DNA, 18 bp, Homo sapiens
cacagatctggaggacgt

SEQ ID NO: 5994435 - DNA, 17 bp, Homo sapiens
cacagatgacaaattat

SEQ ID NO: 5994436 - DNA, 16 bp, Homo sapiens
cacagatgaggagcag

SEQ ID NO: 5994437 - DNA, 14 bp, Homo sapiens
cacagatgaggccc

SEQ ID NO: 5994438 - DNA, 16 bp, Homo sapiens
cacagatgaggccccc

SEQ ID NO: 5994439 - DNA, 17 bp, Homo sapiens
cacagatgaggcccccg

SEQ ID NO: 5994440 - DNA, 16 bp, Homo sapiens
cacagatgcacacaca

SEQ ID NO: 5994441 - DNA, 20 bp, Homo sapiens
cacagatgcatatagacaca

SEQ ID NO: 5994442 - DNA, 15 bp, Homo sapiens
cacagatgccatggc

SEQ ID NO: 5994443 - DNA, 16 bp, Homo sapiens
cacagatgctggcctc

SEQ ID NO: 5994444 - DNA, 18 bp, Homo sapiens
cacagatgctggcctctt

SEQ ID NO: 5994445 - DNA, 21 bp, Homo sapiens
cacagatgctggcctcttggc

SEQ ID NO: 5994446 - DNA, 12 bp, Homo sapiens
cacagatggatt

SEQ ID NO: 5994447 - DNA, 23 bp, Homo sapiens
cacagatggatttgcctgtgcca

SEQ ID NO: 5994448 - DNA, 13 bp, Homo sapiens
cacagatggccag

SEQ ID NO: 5994449 - DNA, 14 bp, Homo sapiens
cacagatggccagc

SEQ ID NO: 5994450 - DNA, 22 bp, Homo sapiens
cacagatgggtattaaacttgt

SEQ ID NO: 5994451 - DNA, 14 bp, Homo sapiens
cacagatgggtgct

SEQ ID NO: 5994452 - DNA, 20 bp, Homo sapiens
cacagatggtcacacagaga

SEQ ID NO: 5994453 - DNA, 15 bp, Homo sapiens
cacagatgtaattat

SEQ ID NO: 5994454 - DNA, 17 bp, Homo sapiens
cacagatgtctctgggg

SEQ ID NO: 5994455 - DNA, 22 bp, Homo sapiens
cacagatgtgggctttgatttc

SEQ ID NO: 5994456 - DNA, 16 bp, Homo sapiens
cacagatgtgtctggg

SEQ ID NO: 5994457 - DNA, 23 bp, Homo sapiens
cacagatgttcggtttttttcct

SEQ ID NO: 5994458 - DNA, 20 bp, Homo sapiens
cacagattatgttcctgctg

SEQ ID NO: 5994459 - DNA, 16 bp, Homo sapiens
cacagattcaagtgca

SEQ ID NO: 5994460 - DNA, 16 bp, Homo sapiens
cacagattcccaggcc

SEQ ID NO: 5994461 - DNA, 18 bp, Homo sapiens
cacagattcccaggccag

SEQ ID NO: 5994462 - DNA, 24 bp, Homo sapiens
cacagattcccaggccagggctgg

SEQ ID NO: 5994463 - DNA, 14 bp, Homo sapiens
cacagattgaagaa

SEQ ID NO: 5994464 - DNA, 22 bp, Homo sapiens
cacagattgtttctatacaaat

SEQ ID NO: 5994465 - DNA, 22 bp, Homo sapiens
cacagatttcggtcataaagaa

SEQ ID NO: 5994466 - DNA, 22 bp, Homo sapiens
cacagatttgagctcagccctg

SEQ ID NO: 5994467 - DNA, 12 bp, Homo sapiens
cacagattttaa

SEQ ID NO: 5994468 - DNA, 15 bp, Homo sapiens
cacagattttaattg

SEQ ID NO: 5994469 - DNA, 18 bp, Homo sapiens
cacagattttaattgtca

SEQ ID NO: 5994470 - DNA, 19 bp, Homo sapiens
cacagattttaattgtcat

SEQ ID NO: 5994471 - DNA, 14 bp, Homo sapiens
cacagatttttaca

SEQ ID NO: 5994472 - DNA, 19 bp, Homo sapiens
cacagattttttctttaaa

SEQ ID NO: 5994473 - DNA, 21 bp, Homo sapiens
cacagattttttctttaaata

SEQ ID NO: 5994474 - DNA, 17 bp, Homo sapiens
cacagatttttttgtaa

SEQ ID NO: 5994475 - DNA, 16 bp, Homo sapiens
cacagcaacattttct

SEQ ID NO: 5994476 - DNA, 20 bp, Homo sapiens
cacagcaacattttcttgaa

SEQ ID NO: 5994477 - DNA, 18 bp, Homo sapiens
cacagcaactgacctgag

SEQ ID NO: 5994478 - DNA, 13 bp, Homo sapiens
cacagcaagccat

SEQ ID NO: 5994479 - DNA, 22 bp, Homo sapiens
cacagcaagccggccccccctc

SEQ ID NO: 5994480 - DNA, 16 bp, Homo sapiens
cacagcaaggaggctg

SEQ ID NO: 5994481 - DNA, 19 bp, Homo sapiens
cacagcaaggcacctgcag

SEQ ID NO: 5994482 - DNA, 14 bp, Homo sapiens
cacagcaaggctgt

SEQ ID NO: 5994483 - DNA, 19 bp, Homo sapiens
cacagcaagtacagcggct

SEQ ID NO: 5994484 - DNA, 17 bp, Homo sapiens
cacagcaatatttaaca

SEQ ID NO: 5994485 - DNA, 16 bp, Homo sapiens
cacagcaattcctcag

SEQ ID NO: 5994486 - DNA, 18 bp, Homo sapiens
cacagcaattcctcaggc

SEQ ID NO: 5994487 - DNA, 20 bp, Homo sapiens
cacagcacaaacacacctct

SEQ ID NO: 5994488 - DNA, 18 bp, Homo sapiens
cacagcacaaccggtccc

SEQ ID NO: 5994489 - DNA, 21 bp, Homo sapiens
cacagcacaccagccgctgca

SEQ ID NO: 5994490 - DNA, 15 bp, Homo sapiens
cacagcacactcagc

SEQ ID NO: 5994491 - DNA, 17 bp, Homo sapiens
cacagcacagctccctg

SEQ ID NO: 5994492 - DNA, 15 bp, Homo sapiens
cacagcacatttgtt

SEQ ID NO: 5994493 - DNA, 21 bp, Homo sapiens
cacagcacccaggctccatgg

SEQ ID NO: 5994494 - DNA, 22 bp, Homo sapiens
cacagcacccaggctccatggg

SEQ ID NO: 5994495 - DNA, 15 bp, Homo sapiens
cacagcaccctatat

SEQ ID NO: 5994496 - DNA, 21 bp, Homo sapiens
cacagcacctcctctctgctg

SEQ ID NO: 5994497 - DNA, 20 bp, Homo sapiens
cacagcagaatgaagaccta

SEQ ID NO: 5994498 - DNA, 15 bp, Homo sapiens
cagagagtacagact

SEQ ID NO: 5994499 - DNA, 17 bp, Homo sapiens
cagagagtccaatttat

SEQ ID NO: 5994500 - DNA, 15 bp, Homo sapiens
cagagagtcctctgg

SEQ ID NO: 5994501 - DNA, 16 bp, Homo sapiens
cagagagtcctctgga

SEQ ID NO: 5994502 - DNA, 19 bp, Homo sapiens
cagagagtcctctggatgg

SEQ ID NO: 5994503 - DNA, 12 bp, Homo sapiens
cagagagtggag

SEQ ID NO: 5994504 - DNA, 19 bp, Homo sapiens
cagagagtggagagagcag

SEQ ID NO: 5994505 - DNA, 20 bp, Homo sapiens
cagagagtggagagagcagg

SEQ ID NO: 5994506 - DNA, 14 bp, Homo sapiens
cagagagtggctcc

SEQ ID NO: 5994507 - DNA, 18 bp, Homo sapiens
cagagagtggctcctccc

SEQ ID NO: 5994508 - DNA, 12 bp, Homo sapiens
cagagagttctg

SEQ ID NO: 5994509 - DNA, 20 bp, Homo sapiens
cagagataaaccaataaatc

SEQ ID NO: 5994510 - DNA, 16 bp, Homo sapiens
cagagataaataaaag

SEQ ID NO: 5994511 - DNA, 14 bp, Homo sapiens
cagagatataaatg

SEQ ID NO: 5994512 - DNA, 15 bp, Homo sapiens
cagagatcaggatca

SEQ ID NO: 5994513 - DNA, 18 bp, Homo sapiens
cagagatcaggatcagct

SEQ ID NO: 5994514 - DNA, 19 bp, Homo sapiens
cagagatcaggatcagctt

SEQ ID NO: 5994515 - DNA, 21 bp, Homo sapiens
cagagatccaaaagaagcccc

SEQ ID NO: 5994516 - DNA, 23 bp, Homo sapiens
cagagatccaaaagaagccccca

SEQ ID NO: 5994517 - DNA, 22 bp, Homo sapiens
cagagatcctacttctctgagt

SEQ ID NO: 5994518 - DNA, 17 bp, Homo sapiens
cagagatcgacagacag

SEQ ID NO: 5994519 - DNA, 18 bp, Homo sapiens
cagagatcgacagacagc

SEQ ID NO: 5994520 - DNA, 20 bp, Homo sapiens
cagagatctgcaggctgcct

SEQ ID NO: 5994521 - DNA, 16 bp, Homo sapiens
cagagatctgggaggt

SEQ ID NO: 5994522 - DNA, 17 bp, Homo sapiens
cagagatgagtgtctgg

SEQ ID NO: 5994523 - DNA, 20 bp, Homo sapiens
cagagatgcaccaccaagcc

SEQ ID NO: 5994524 - DNA, 15 bp, Homo sapiens
cagagatgccagccc

SEQ ID NO: 5994525 - DNA, 13 bp, Homo sapiens
cagagatgcctcc

SEQ ID NO: 5994526 - DNA, 16 bp, Homo sapiens
cagagatgcctccacc

SEQ ID NO: 5994527 - DNA, 18 bp, Homo sapiens
cagagatgcctccaccgc

SEQ ID NO: 5994528 - DNA, 15 bp, Homo sapiens
cagagatgcctccct

SEQ ID NO: 5994529 - DNA, 16 bp, Homo sapiens
cagagatggacagaga

SEQ ID NO: 5994530 - DNA, 18 bp, Homo sapiens
cagagatggacagagaac

SEQ ID NO: 5994531 - DNA, 21 bp, Homo sapiens
cagagatggaggttctctcgg

SEQ ID NO: 5994532 - DNA, 14 bp, Homo sapiens
cagagatggcagag

SEQ ID NO: 5994533 - DNA, 15 bp, Homo sapiens
cagagatgggactgg

SEQ ID NO: 5994534 - DNA, 19 bp, Homo sapiens
cagagatgggactgggagg

SEQ ID NO: 5994535 - DNA, 23 bp, Homo sapiens
cagagatgggactgggagggccc

SEQ ID NO: 5994536 - DNA, 21 bp, Homo sapiens
cagagatggtgtgttctgcaa

SEQ ID NO: 5994537 - DNA, 16 bp, Homo sapiens
cagagatgtgcaccca

SEQ ID NO: 5994538 - DNA, 19 bp, Homo sapiens
cagagatgtgcccccaccc

SEQ ID NO: 5994539 - DNA, 14 bp, Homo sapiens
cagagattcatttt

SEQ ID NO: 5994540 - DNA, 19 bp, Homo sapiens
cagagattcattttctaga

SEQ ID NO: 5994541 - DNA, 16 bp, Homo sapiens
cagagattcccaagcc

SEQ ID NO: 5994542 - DNA, 16 bp, Homo sapiens
cagagattctgaacta

SEQ ID NO: 5994543 - DNA, 14 bp, Homo sapiens
cagagattctggat

SEQ ID NO: 5994544 - DNA, 15 bp, Homo sapiens
cagagattctggatc

SEQ ID NO: 5994545 - DNA, 19 bp, Homo sapiens
cagagatttatataaatgt

SEQ ID NO: 5994546 - DNA, 18 bp, Homo sapiens
cagagatttcctccatgg

SEQ ID NO: 5994547 - DNA, 23 bp, Homo sapiens
cagagatttggtaactcatttgg

SEQ ID NO: 5994548 - DNA, 14 bp, Homo sapiens
cagagcaaaaatgt

SEQ ID NO: 5994549 - DNA, 20 bp, Homo sapiens
cagagcaaaaatgtaaaaaa

SEQ ID NO: 5994550 - DNA, 22 bp, Homo sapiens
cagagcaaaaatgtaaaaaaca

SEQ ID NO: 5994551 - DNA, 16 bp, Homo sapiens
cagagcaaaataattt

SEQ ID NO: 5994552 - DNA, 19 bp, Homo sapiens
cagagcaaaatgctcttgt

SEQ ID NO: 5994553 - DNA, 21 bp, Homo sapiens
cagagcaaaatgctcttgtcc

SEQ ID NO: 5994554 - DNA, 16 bp, Homo sapiens
cagagcaaacagaaaa

SEQ ID NO: 5994555 - DNA, 16 bp, Homo sapiens
cagagcaaagcgccca

SEQ ID NO: 5994556 - DNA, 18 bp, Homo sapiens
cagagcaaagcgcccacc

SEQ ID NO: 5994557 - DNA, 22 bp, Homo sapiens
cagagcaaagcgcccacccagg

SEQ ID NO: 5994558 - DNA, 17 bp, Homo sapiens
cagagcaaccagaagga

SEQ ID NO: 5994559 - DNA, 15 bp, Homo sapiens
cagagcaacccctgg

SEQ ID NO: 5994560 - DNA, 15 bp, Homo sapiens
cagagcaacctctca

SEQ ID NO: 5994561 - DNA, 22 bp, Homo sapiens
cagagcaacgaccagggccgag

SEQ ID NO: 5994562 - DNA, 20 bp, Homo sapiens
cagagcaagaccctgtctca

SEQ ID NO: 5994563 - DNA, 14 bp, Homo sapiens
cagagcaagactcc

SEQ ID NO: 5994564 - DNA, 20 bp, Homo sapiens
cagagcaagactccatttca

SEQ ID NO: 5994565 - DNA, 17 bp, Homo sapiens
cagagcaagactccgtc

SEQ ID NO: 5994566 - DNA, 19 bp, Homo sapiens
cagagcaagactctgtctc

SEQ ID NO: 5994567 - DNA, 14 bp, Homo sapiens
cagagcaagccttt

SEQ ID NO: 5994568 - DNA, 15 bp, Homo sapiens
cagagcaagcctttg

SEQ ID NO: 5994569 - DNA, 21 bp, Homo sapiens
cagagcaagcgaaagagcaaa

SEQ ID NO: 5994570 - DNA, 15 bp, Homo sapiens
cagagcaagtctgca

SEQ ID NO: 5994571 - DNA, 17 bp, Homo sapiens
cagagcaagtctgcagg

SEQ ID NO: 5994572 - DNA, 13 bp, Homo sapiens
cagagcaataaca

SEQ ID NO: 5994573 - DNA, 23 bp, Homo sapiens
cagagcaataacactatatttat

SEQ ID NO: 5994574 - DNA, 17 bp, Homo sapiens
cagagcaattccaggct

SEQ ID NO: 5994575 - DNA, 19 bp, Homo sapiens
cagagcaattccaggctga

SEQ ID NO: 5994576 - DNA, 17 bp, Homo sapiens
cagagcacacaggtaca

SEQ ID NO: 5994577 - DNA, 15 bp, Homo sapiens
cagagcacacttatt

SEQ ID NO: 5994578 - DNA, 17 bp, Homo sapiens
cagagcacacttattta

SEQ ID NO: 5994579 - DNA, 16 bp, Homo sapiens
cagagcacagaggtag

SEQ ID NO: 5994580 - DNA, 17 bp, Homo sapiens
cagagcacagccaatct

SEQ ID NO: 5994581 - DNA, 15 bp, Homo sapiens
cagagcacaggagct

SEQ ID NO: 5994582 - DNA, 22 bp, Homo sapiens
cagagcacaggagctgccatgt

SEQ ID NO: 5994583 - DNA, 20 bp, Homo sapiens
cagagcaccccctgctccac

SEQ ID NO: 5994584 - DNA, 15 bp, Homo sapiens
cagagcacctcagga

SEQ ID NO: 5994585 - DNA, 17 bp, Homo sapiens
cagagcacctcaggacc

SEQ ID NO: 5994586 - DNA, 19 bp, Homo sapiens
cagagcacctgctgtctgg

SEQ ID NO: 5994587 - DNA, 18 bp, Homo sapiens
cagagcaccttagacagt

SEQ ID NO: 5994588 - DNA, 23 bp, Homo sapiens
cagagcacctttgcacaggatgc

SEQ ID NO: 5994589 - DNA, 17 bp, Homo sapiens
cagagcacgcctgccat

SEQ ID NO: 5994590 - DNA, 20 bp, Homo sapiens
cagagcactgggttgcaggg

SEQ ID NO: 5994591 - DNA, 22 bp, Homo sapiens
cagagcactttagcagatgtgg

SEQ ID NO: 5994592 - DNA, 15 bp, Homo sapiens
cagagcagacaggct

SEQ ID NO: 5994593 - DNA, 11 bp, Homo sapiens
cagagcagaga

SEQ ID NO: 5994594 - DNA, 13 bp, Homo sapiens
cagagcagagacc

SEQ ID NO: 5994595 - DNA, 14 bp, Homo sapiens
cagagcagagacca

SEQ ID NO: 5994596 - DNA, 21 bp, Homo sapiens
cagagcagagaccatccctga

SEQ ID NO: 5994597 - DNA, 21 bp, Homo sapiens
cagagcagagcaaatgaggga

SEQ ID NO: 5994598 - DNA, 22 bp, Homo sapiens
cagagcagatcagtctttgtca

SEQ ID NO: 5994599 - DNA, 21 bp, Homo sapiens
cagagcagatggcagatgcac

SEQ ID NO: 5994600 - DNA, 20 bp, Homo sapiens
cagagcagcacaaagaaaca

SEQ ID NO: 5994601 - DNA, 19 bp, Homo sapiens
cagagcagcagcacctttc

SEQ ID NO: 5994602 - DNA, 13 bp, Homo sapiens
cagagcagcagtg

SEQ ID NO: 5994603 - DNA, 14 bp, Homo sapiens
cagagcagctaact

SEQ ID NO: 5994604 - DNA, 15 bp, Homo sapiens
cagagcagctagctc

SEQ ID NO: 5994605 - DNA, 14 bp, Homo sapiens
cagagcagctccac

SEQ ID NO: 5994606 - DNA, 22 bp, Homo sapiens
cagagcagctccaccactgtgc

SEQ ID NO: 5994607 - DNA, 14 bp, Homo sapiens
cagagcagctcccc

SEQ ID NO: 5994608 - DNA, 13 bp, Homo sapiens
cagagcaggaagc

SEQ ID NO: 5994609 - DNA, 21 bp, Homo sapiens
cagagcaggaagcattcagag

SEQ ID NO: 5994610 - DNA, 14 bp, Homo sapiens
cagagcaggacctc

SEQ ID NO: 5994611 - DNA, 14 bp, Homo sapiens
cagagcaggactgc

SEQ ID NO: 5994612 - DNA, 19 bp, Homo sapiens
cagagcaggagactggcaa

SEQ ID NO: 5994613 - DNA, 23 bp, Homo sapiens
cagagcaggagcatcctctgctg

SEQ ID NO: 5994614 - DNA, 14 bp, Homo sapiens
cagagcaggagccc

SEQ ID NO: 5994615 - DNA, 15 bp, Homo sapiens
cagagcaggagcccc

SEQ ID NO: 5994616 - DNA, 22 bp, Homo sapiens
cagagcaggaggcagggctctg

SEQ ID NO: 5994617 - DNA, 17 bp, Homo sapiens
cagagcaggaggcccct

SEQ ID NO: 5994618 - DNA, 23 bp, Homo sapiens
cagagcaggaggcccctggccca

SEQ ID NO: 5994619 - DNA, 13 bp, Homo sapiens
cagagcaggcaat

SEQ ID NO: 5994620 - DNA, 18 bp, Homo sapiens
cagagcaggccacgctca

SEQ ID NO: 5994621 - DNA, 20 bp, Homo sapiens
cagagcaggccacgctcagg

SEQ ID NO: 5994622 - DNA, 16 bp, Homo sapiens
cagagcaggctttgtg

SEQ ID NO: 5994623 - DNA, 19 bp, Homo sapiens
cagagcaggctttgtgaga

SEQ ID NO: 5994624 - DNA, 23 bp, Homo sapiens
cagagcaggggctgctgggggct

SEQ ID NO: 5994625 - DNA, 22 bp, Homo sapiens
cagagcagggggacctaggctc

SEQ ID NO: 5994626 - DNA, 18 bp, Homo sapiens
cagagcaggtctgcaggc

SEQ ID NO: 5994627 - DNA, 21 bp, Homo sapiens
cagagcaggtctgcaggccac

SEQ ID NO: 5994628 - DNA, 18 bp, Homo sapiens
cagagcagtctaaacaga

SEQ ID NO: 5994629 - DNA, 21 bp, Homo sapiens
cagagcagtctaaacagagtc

SEQ ID NO: 5994630 - DNA, 12 bp, Homo sapiens
cagagcagtctg

SEQ ID NO: 5994631 - DNA, 21 bp, Homo sapiens
cagagcagtgggcctggccag

SEQ ID NO: 5994632 - DNA, 19 bp, Homo sapiens
cagagcagttgagaggaca

SEQ ID NO: 5994633 - DNA, 14 bp, Homo sapiens
cagagcatacaaca

SEQ ID NO: 5994634 - DNA, 20 bp, Homo sapiens
cagagcatacaacagagggg

SEQ ID NO: 5994635 - DNA, 16 bp, Homo sapiens
cagagcatctgcccca

SEQ ID NO: 5994636 - DNA, 15 bp, Homo sapiens
cagagcatctggctg

SEQ ID NO: 5994637 - DNA, 18 bp, Homo sapiens
cagagcatgttggacacc

SEQ ID NO: 5994638 - DNA, 19 bp, Homo sapiens
cagagcattacgtgagcca

SEQ ID NO: 5994639 - DNA, 21 bp, Homo sapiens
cagagcattacgtgagccagg

SEQ ID NO: 5994640 - DNA, 19 bp, Homo sapiens
cagagcattccagtcaggc

SEQ ID NO: 5994641 - DNA, 20 bp, Homo sapiens
cagagcattccagtcaggct

SEQ ID NO: 5994642 - DNA, 22 bp, Homo sapiens
cagagcattccagtcaggctct

SEQ ID NO: 5994643 - DNA, 15 bp, Homo sapiens
cagagcatttaagag

SEQ ID NO: 5994644 - DNA, 20 bp, Homo sapiens
cagagcattttttatgatat

SEQ ID NO: 5994645 - DNA, 11 bp, Homo sapiens
cagagccaacc

SEQ ID NO: 5994646 - DNA, 13 bp, Homo sapiens
cagagccaacctg

SEQ ID NO: 5994647 - DNA, 15 bp, Homo sapiens
cagagccaacctgga

SEQ ID NO: 5994648 - DNA, 19 bp, Homo sapiens
cagagccaacctggacttc

SEQ ID NO: 5994649 - DNA, 23 bp, Homo sapiens
cagagccaacctggacttcctgt

SEQ ID NO: 5994650 - DNA, 17 bp, Homo sapiens
cagagccaagcactgct

SEQ ID NO: 5994651 - DNA, 14 bp, Homo sapiens
cagagccaaggcca

SEQ ID NO: 5994652 - DNA, 20 bp, Homo sapiens
cagagccaaggggcttcagg

SEQ ID NO: 5994653 - DNA, 13 bp, Homo sapiens
cagagccaagtcc

SEQ ID NO: 5994654 - DNA, 21 bp, Homo sapiens
cagagccaagtcctccctctc

SEQ ID NO: 5994655 - DNA, 15 bp, Homo sapiens
cagagccacacatgg

SEQ ID NO: 5994656 - DNA, 13 bp, Homo sapiens
cagagccacagaa

SEQ ID NO: 5994657 - DNA, 14 bp, Homo sapiens
cagagccacagggt

SEQ ID NO: 5994658 - DNA, 21 bp, Homo sapiens
cagagccacagggtctgcctc

SEQ ID NO: 5994659 - DNA, 24 bp, Homo sapiens
cagagccacagggtctgcctccag

SEQ ID NO: 5994660 - DNA, 17 bp, Homo sapiens
cagagccaccagggcac

SEQ ID NO: 5994661 - DNA, 14 bp, Homo sapiens
cagagccacctgga

SEQ ID NO: 5994662 - DNA, 14 bp, Homo sapiens
cagagccagaggca

SEQ ID NO: 5994663 - DNA, 20 bp, Homo sapiens
cagagccagatgcaggacag

SEQ ID NO: 5994664 - DNA, 13 bp, Homo sapiens
cagagccagcctg

SEQ ID NO: 5994665 - DNA, 14 bp, Homo sapiens
cagagccagcctgg

SEQ ID NO: 5994666 - DNA, 21 bp, Homo sapiens
cagagccagcctggctctgcc

SEQ ID NO: 5994667 - DNA, 17 bp, Homo sapiens
cagagccagcctgggac

SEQ ID NO: 5994668 - DNA, 23 bp, Homo sapiens
cagagccagcctgggactcccag

SEQ ID NO: 5994669 - DNA, 21 bp, Homo sapiens
cagagccaggaagatccccca

SEQ ID NO: 5994670 - DNA, 23 bp, Homo sapiens
cagagccaggaagatcccccaga

SEQ ID NO: 5994671 - DNA, 13 bp, Homo sapiens
cagagccaggaga

SEQ ID NO: 5994672 - DNA, 16 bp, Homo sapiens
cagagccaggagaagc

SEQ ID NO: 5994673 - DNA, 20 bp, Homo sapiens
cagagccaggagaagctcag

SEQ ID NO: 5994674 - DNA, 19 bp, Homo sapiens
cagagccaggctgttggaa

SEQ ID NO: 5994675 - DNA, 12 bp, Homo sapiens
cagagccagggc

SEQ ID NO: 5994676 - DNA, 15 bp, Homo sapiens
cacagcagcactgca

SEQ ID NO: 5994677 - DNA, 15 bp, Homo sapiens
cacagcagcattttt

SEQ ID NO: 5994678 - DNA, 11 bp, Homo sapiens
cacagcagccc

SEQ ID NO: 5994679 - DNA, 15 bp, Homo sapiens
cacagcagcccccca

SEQ ID NO: 5994680 - DNA, 14 bp, Homo sapiens
cacagcagcctggg

SEQ ID NO: 5994681 - DNA, 13 bp, Homo sapiens
cacagcagctcca

SEQ ID NO: 5994682 - DNA, 15 bp, Homo sapiens
cacagcagctccaac

SEQ ID NO: 5994683 - DNA, 23 bp, Homo sapiens
cacagcagctccaacctggaggc

SEQ ID NO: 5994684 - DNA, 16 bp, Homo sapiens
cacagcagctgaacag

SEQ ID NO: 5994685 - DNA, 22 bp, Homo sapiens
cacagcagcttcaccagagcat

SEQ ID NO: 5994686 - DNA, 21 bp, Homo sapiens
cacagcaggatgctaatggaa

SEQ ID NO: 5994687 - DNA, 19 bp, Homo sapiens
cacagcaggggctggccca

SEQ ID NO: 5994688 - DNA, 19 bp, Homo sapiens
cacagcagtatgaatgatg

SEQ ID NO: 5994689 - DNA, 13 bp, Homo sapiens
cacagcagtattg

SEQ ID NO: 5994690 - DNA, 14 bp, Homo sapiens
cacagcagtcacag

SEQ ID NO: 5994691 - DNA, 16 bp, Homo sapiens
cacagcagtcacaggc

SEQ ID NO: 5994692 - DNA, 22 bp, Homo sapiens
cacagcagtcacaggcccagga

SEQ ID NO: 5994693 - DNA, 14 bp, Homo sapiens
cacagcagtgtccc

SEQ ID NO: 5994694 - DNA, 13 bp, Homo sapiens
cacagcagtgtga

SEQ ID NO: 5994695 - DNA, 21 bp, Homo sapiens
cacagcagttgaaaagactcc

SEQ ID NO: 5994696 - DNA, 15 bp, Homo sapiens
cacagcatctcagct

SEQ ID NO: 5994697 - DNA, 17 bp, Homo sapiens
cacagcatctctatgaa

SEQ ID NO: 5994698 - DNA, 14 bp, Homo sapiens
cacagcatgcagac

SEQ ID NO: 5994699 - DNA, 13 bp, Homo sapiens
cacagcatgcatt

SEQ ID NO: 5994700 - DNA, 18 bp, Homo sapiens
cacagcatgcatttagca

SEQ ID NO: 5994701 - DNA, 14 bp, Homo sapiens
cacagcatgcctta

SEQ ID NO: 5994702 - DNA, 16 bp, Homo sapiens
cacagcatgtgcaata

SEQ ID NO: 5994703 - DNA, 13 bp, Homo sapiens
cacagcatgtgta

SEQ ID NO: 5994704 - DNA, 18 bp, Homo sapiens
cacagcatttgctttcct

SEQ ID NO: 5994705 - DNA, 18 bp, Homo sapiens
cacagccaacgagacaca

SEQ ID NO: 5994706 - DNA, 12 bp, Homo sapiens
cacagccaagcc

SEQ ID NO: 5994707 - DNA, 13 bp, Homo sapiens
cacagccaagccc

SEQ ID NO: 5994708 - DNA, 14 bp, Homo sapiens
cacagccacacaca

SEQ ID NO: 5994709 - DNA, 17 bp, Homo sapiens
cacagccacacacacag

SEQ ID NO: 5994710 - DNA, 21 bp, Homo sapiens
cacagccacacacacagaaaa

SEQ ID NO: 5994711 - DNA, 18 bp, Homo sapiens
cacagccacacctggact

SEQ ID NO: 5994712 - DNA, 15 bp, Homo sapiens
cacagccacccgtgg

SEQ ID NO: 5994713 - DNA, 22 bp, Homo sapiens
cacagccacccgtggggtgctg

SEQ ID NO: 5994714 - DNA, 14 bp, Homo sapiens
cacagccacctccg

SEQ ID NO: 5994715 - DNA, 21 bp, Homo sapiens
cacagccacctccgccagacc

SEQ ID NO: 5994716 - DNA, 16 bp, Homo sapiens
cacagccagaaccccg

SEQ ID NO: 5994717 - DNA, 17 bp, Homo sapiens
cacagccagactggcac

SEQ ID NO: 5994718 - DNA, 18 bp, Homo sapiens
cacagccagactggcaca

SEQ ID NO: 5994719 - DNA, 12 bp, Homo sapiens
cacagccagagg

SEQ ID NO: 5994720 - DNA, 17 bp, Homo sapiens
cacagccagcacctggc

SEQ ID NO: 5994721 - DNA, 20 bp, Homo sapiens
cacagccagcacctggcatc

SEQ ID NO: 5994722 - DNA, 12 bp, Homo sapiens
cacagccagccc

SEQ ID NO: 5994723 - DNA, 22 bp, Homo sapiens
cacagccagcccaaaccttggg

SEQ ID NO: 5994724 - DNA, 14 bp, Homo sapiens
cacagccagcccag

SEQ ID NO: 5994725 - DNA, 15 bp, Homo sapiens
cacagccagcccagc

SEQ ID NO: 5994726 - DNA, 18 bp, Homo sapiens
cacagccaggggagcaga

SEQ ID NO: 5994727 - DNA, 22 bp, Homo sapiens
cacagccagggggatgccactc

SEQ ID NO: 5994728 - DNA, 23 bp, Homo sapiens
cacagccagtttagagaaataca

SEQ ID NO: 5994729 - DNA, 17 bp, Homo sapiens
cacagccatagcagacg

SEQ ID NO: 5994730 - DNA, 16 bp, Homo sapiens
cacagccatcccagcc

SEQ ID NO: 5994731 - DNA, 22 bp, Homo sapiens
cacagccatcccagccttggca

SEQ ID NO: 5994732 - DNA, 16 bp, Homo sapiens
cacagcccaaccagga

SEQ ID NO: 5994733 - DNA, 23 bp, Homo sapiens
cacagcccaagaggactgagact

SEQ ID NO: 5994734 - DNA, 16 bp, Homo sapiens
cacagcccaccctctg

SEQ ID NO: 5994735 - DNA, 11 bp, Homo sapiens
cacagcccaga

SEQ ID NO: 5994736 - DNA, 15 bp, Homo sapiens
cacagcccagaacca

SEQ ID NO: 5994737 - DNA, 14 bp, Homo sapiens
cacagcccagaagg

SEQ ID NO: 5994738 - DNA, 17 bp, Homo sapiens
cacagcccagagactga

SEQ ID NO: 5994739 - DNA, 16 bp, Homo sapiens
cacagcccagccacgg

SEQ ID NO: 5994740 - DNA, 22 bp, Homo sapiens
cacagcccaggcctccagctca

SEQ ID NO: 5994741 - DNA, 16 bp, Homo sapiens
cacagccccaacctcc

SEQ ID NO: 5994742 - DNA, 14 bp, Homo sapiens
cacagccccaccct

SEQ ID NO: 5994743 - DNA, 18 bp, Homo sapiens
cacagccccacccttgtc

SEQ ID NO: 5994744 - DNA, 20 bp, Homo sapiens
cacagcccccaccccagcac

SEQ ID NO: 5994745 - DNA, 14 bp, Homo sapiens
cacagcccccttgc

SEQ ID NO: 5994746 - DNA, 17 bp, Homo sapiens
cacagcccccttgccct

SEQ ID NO: 5994747 - DNA, 22 bp, Homo sapiens
cacagcccccttgccctccgcc

SEQ ID NO: 5994748 - DNA, 12 bp, Homo sapiens
cacagccccgat

SEQ ID NO: 5994749 - DNA, 23 bp, Homo sapiens
cacagccccgatgattcttaaca

SEQ ID NO: 5994750 - DNA, 17 bp, Homo sapiens
cacagcccctcaaagac

SEQ ID NO: 5994751 - DNA, 20 bp, Homo sapiens
cacagcccctcaaagacttt

SEQ ID NO: 5994752 - DNA, 17 bp, Homo sapiens
cacagcccctggagcct

SEQ ID NO: 5994753 - DNA, 13 bp, Homo sapiens
cacagcccctggc

SEQ ID NO: 5994754 - DNA, 17 bp, Homo sapiens
cacagcccctggcactg

SEQ ID NO: 5994755 - DNA, 20 bp, Homo sapiens
cacagcccctggcactgcag

SEQ ID NO: 5994756 - DNA, 21 bp, Homo sapiens
cacagcccctggcactgcagg

SEQ ID NO: 5994757 - DNA, 15 bp, Homo sapiens
cacagcccgcatgca

SEQ ID NO: 5994758 - DNA, 17 bp, Homo sapiens
cacagcccgcatgcagc

SEQ ID NO: 5994759 - DNA, 23 bp, Homo sapiens
cacagcccgcatgcagcagcttg

SEQ ID NO: 5994760 - DNA, 13 bp, Homo sapiens
cacagccctgaaa

SEQ ID NO: 5994761 - DNA, 14 bp, Homo sapiens
cacagccctgaaac

SEQ ID NO: 5994762 - DNA, 11 bp, Homo sapiens
cacagccctgg

SEQ ID NO: 5994763 - DNA, 12 bp, Homo sapiens
cacagccctgtc

SEQ ID NO: 5994764 - DNA, 23 bp, Homo sapiens
cacagcccttatgcggttaattt

SEQ ID NO: 5994765 - DNA, 21 bp, Homo sapiens
cacagccgattcacctgagca

SEQ ID NO: 5994766 - DNA, 21 bp, Homo sapiens
cacagccgcagcctccctctg

SEQ ID NO: 5994767 - DNA, 21 bp, Homo sapiens
cacagccgcgggccaggaggc

SEQ ID NO: 5994768 - DNA, 22 bp, Homo sapiens
cacagccggggcctgcctagca

SEQ ID NO: 5994769 - DNA, 19 bp, Homo sapiens
cacagccggtcagaggagc

SEQ ID NO: 5994770 - DNA, 20 bp, Homo sapiens
cacagcctagcacagcagct

SEQ ID NO: 5994771 - DNA, 15 bp, Homo sapiens
cacagcctaggacca

SEQ ID NO: 5994772 - DNA, 23 bp, Homo sapiens
cacagcctaggaccagttttgta

SEQ ID NO: 5994773 - DNA, 13 bp, Homo sapiens
cacagcctcaccc

SEQ ID NO: 5994774 - DNA, 20 bp, Homo sapiens
cacagcctcacccctgcagg

SEQ ID NO: 5994775 - DNA, 22 bp, Homo sapiens
cacagcctcacccctgcaggcg

SEQ ID NO: 5994776 - DNA, 22 bp, Homo sapiens
cacagcctcacccctgcccctg

SEQ ID NO: 5994777 - DNA, 17 bp, Homo sapiens
cacagcctcatcagtat

SEQ ID NO: 5994778 - DNA, 13 bp, Homo sapiens
cacagcctccagg

SEQ ID NO: 5994779 - DNA, 11 bp, Homo sapiens
cacagcctccc

SEQ ID NO: 5994780 - DNA, 12 bp, Homo sapiens
cacagcctcccc

SEQ ID NO: 5994781 - DNA, 14 bp, Homo sapiens
cacagcctcccccg

SEQ ID NO: 5994782 - DNA, 16 bp, Homo sapiens
cacagcctccccttcc

SEQ ID NO: 5994783 - DNA, 19 bp, Homo sapiens
cacagcctccccttcccag

SEQ ID NO: 5994784 - DNA, 20 bp, Homo sapiens
cacagcctccccttcccaga

SEQ ID NO: 5994785 - DNA, 23 bp, Homo sapiens
cacagcctccccttcccagaccc

SEQ ID NO: 5994786 - DNA, 17 bp, Homo sapiens
cacagcctccgcggact

SEQ ID NO: 5994787 - DNA, 20 bp, Homo sapiens
cacagcctcctctgtctgcc

SEQ ID NO: 5994788 - DNA, 17 bp, Homo sapiens
cacagcctcggggatgg

SEQ ID NO: 5994789 - DNA, 23 bp, Homo sapiens
cacagcctcggggatggggaggg

SEQ ID NO: 5994790 - DNA, 13 bp, Homo sapiens
cacagcctctccc

SEQ ID NO: 5994791 - DNA, 15 bp, Homo sapiens
cacagcctctccctt

SEQ ID NO: 5994792 - DNA, 15 bp, Homo sapiens
cacagcctctgaccc

SEQ ID NO: 5994793 - DNA, 17 bp, Homo sapiens
cacagcctctggctcca

SEQ ID NO: 5994794 - DNA, 20 bp, Homo sapiens
cacagcctctggctccacac

SEQ ID NO: 5994795 - DNA, 21 bp, Homo sapiens
cacagcctcttagatgcagtt

SEQ ID NO: 5994796 - DNA, 22 bp, Homo sapiens
cacagcctgcacttgggggctc

SEQ ID NO: 5994797 - DNA, 16 bp, Homo sapiens
cacagcctgctggcag

SEQ ID NO: 5994798 - DNA, 23 bp, Homo sapiens
cacagcctgctggcagggccagg

SEQ ID NO: 5994799 - DNA, 12 bp, Homo sapiens
cacagcctggcc

SEQ ID NO: 5994800 - DNA, 22 bp, Homo sapiens
cacagcctggcctcccctgcgg

SEQ ID NO: 5994801 - DNA, 23 bp, Homo sapiens
cacagcctggcctcccctgcgga

SEQ ID NO: 5994802 - DNA, 17 bp, Homo sapiens
cacagcctgtccctggg

SEQ ID NO: 5994803 - DNA, 16 bp, Homo sapiens
cacagcctgtcttgtc

SEQ ID NO: 5994804 - DNA, 23 bp, Homo sapiens
cacagccttccctctgcattgac

SEQ ID NO: 5994805 - DNA, 12 bp, Homo sapiens
cacagccttcct

SEQ ID NO: 5994806 - DNA, 16 bp, Homo sapiens
cacagccttccttctg

SEQ ID NO: 5994807 - DNA, 13 bp, Homo sapiens
cacagccttcgga

SEQ ID NO: 5994808 - DNA, 19 bp, Homo sapiens
cacagccttctaaattccc

SEQ ID NO: 5994809 - DNA, 21 bp, Homo sapiens
cacagccttgcagcggctcct

SEQ ID NO: 5994810 - DNA, 23 bp, Homo sapiens
cacagccttgcagcggctcctgc

SEQ ID NO: 5994811 - DNA, 15 bp, Homo sapiens
cacagcctttctgta

SEQ ID NO: 5994812 - DNA, 16 bp, Homo sapiens
cacagcctttctgtat

SEQ ID NO: 5994813 - DNA, 15 bp, Homo sapiens
cacagcgagaaaact

SEQ ID NO: 5994814 - DNA, 17 bp, Homo sapiens
cacagcgagactccgtc

SEQ ID NO: 5994815 - DNA, 20 bp, Homo sapiens
cacagcgagcctgtgccttc

SEQ ID NO: 5994816 - DNA, 14 bp, Homo sapiens
cacagcgagggcag

SEQ ID NO: 5994817 - DNA, 18 bp, Homo sapiens
cacagcgctgagcatggg

SEQ ID NO: 5994818 - DNA, 14 bp, Homo sapiens
cacagcggcccctg

SEQ ID NO: 5994819 - DNA, 15 bp, Homo sapiens
cacagcgtccctagc

SEQ ID NO: 5994820 - DNA, 15 bp, Homo sapiens
cacagcgtccctggc

SEQ ID NO: 5994821 - DNA, 19 bp, Homo sapiens
cacagcgtcctgtccacac

SEQ ID NO: 5994822 - DNA, 14 bp, Homo sapiens
cacagcgtgctggc

SEQ ID NO: 5994823 - DNA, 15 bp, Homo sapiens
cacagctacctcttc

SEQ ID NO: 5994824 - DNA, 16 bp, Homo sapiens
cacagctacctgagac

SEQ ID NO: 5994825 - DNA, 23 bp, Homo sapiens
cacagctactcagtggggctggc

SEQ ID NO: 5994826 - DNA, 17 bp, Homo sapiens
cacagctaggcatgcct

SEQ ID NO: 5994827 - DNA, 20 bp, Homo sapiens
cacagctaggcatgcctggg

SEQ ID NO: 5994828 - DNA, 15 bp, Homo sapiens
cacagctcaactcgg

SEQ ID NO: 5994829 - DNA, 14 bp, Homo sapiens
cacagctcacggca

SEQ ID NO: 5994830 - DNA, 15 bp, Homo sapiens
cacagctcacggcag

SEQ ID NO: 5994831 - DNA, 15 bp, Homo sapiens
cacagctcactgcag

SEQ ID NO: 5994832 - DNA, 16 bp, Homo sapiens
cacagctcagctgccc

SEQ ID NO: 5994833 - DNA, 17 bp, Homo sapiens
cacagctcagctgccca

SEQ ID NO: 5994834 - DNA, 13 bp, Homo sapiens
cacagctcaggag

SEQ ID NO: 5994835 - DNA, 16 bp, Homo sapiens
cacagctccaggacac

SEQ ID NO: 5994836 - DNA, 16 bp, Homo sapiens
cacagctcccacccca

SEQ ID NO: 5994837 - DNA, 22 bp, Homo sapiens
cacagctcccaccccaccccct

SEQ ID NO: 5994838 - DNA, 13 bp, Homo sapiens
cacagctcccggc

SEQ ID NO: 5994839 - DNA, 16 bp, Homo sapiens
cacagctccctgccaa

SEQ ID NO: 5994840 - DNA, 13 bp, Homo sapiens
cacagctcccttc

SEQ ID NO: 5994841 - DNA, 16 bp, Homo sapiens
cacagctcccttctgt

SEQ ID NO: 5994842 - DNA, 17 bp, Homo sapiens
cacagctccgagctgta

SEQ ID NO: 5994843 - DNA, 12 bp, Homo sapiens
cacagctcctcc

SEQ ID NO: 5994844 - DNA, 13 bp, Homo sapiens
cacagctcctccc

SEQ ID NO: 5994845 - DNA, 15 bp, Homo sapiens
cacagctcctcccac

SEQ ID NO: 5994846 - DNA, 20 bp, Homo sapiens
cacagctcctcgctgcgtct

SEQ ID NO: 5994847 - DNA, 16 bp, Homo sapiens
cacagctcctgccagg

SEQ ID NO: 5994848 - DNA, 17 bp, Homo sapiens
cacagctcctgccaggg

SEQ ID NO: 5994849 - DNA, 22 bp, Homo sapiens
cacagctccttttccagagcat

SEQ ID NO: 5994850 - DNA, 14 bp, Homo sapiens
cacagctctgctgg

SEQ ID NO: 5994851 - DNA, 15 bp, Homo sapiens
cacagctctgctgga

SEQ ID NO: 5994852 - DNA, 20 bp, Homo sapiens
cacagctctgggcctctttt

SEQ ID NO: 5994853 - DNA, 16 bp, Homo sapiens
cacagctctgtagaaa

SEQ ID NO: 5994854 - DNA, 15 bp, Homo sapiens
cacagctctgtcctg

SEQ ID NO: 5994855 - DNA, 18 bp, Homo sapiens
cacagctctgtcctggga

SEQ ID NO: 5994856 - DNA, 17 bp, Homo sapiens
cagagccagggctgtcc

SEQ ID NO: 5994857 - DNA, 19 bp, Homo sapiens
cagagccagggctgtcctt

SEQ ID NO: 5994858 - DNA, 18 bp, Homo sapiens
cagagccatccaccctga

SEQ ID NO: 5994859 - DNA, 15 bp, Homo sapiens
cagagccatctgcga

SEQ ID NO: 5994860 - DNA, 19 bp, Homo sapiens
cagagccatgccaggctgc

SEQ ID NO: 5994861 - DNA, 11 bp, Homo sapiens
cagagccatgg

SEQ ID NO: 5994862 - DNA, 14 bp, Homo sapiens
cagagccatgggcc

SEQ ID NO: 5994863 - DNA, 15 bp, Homo sapiens
cagagccatgggcct

SEQ ID NO: 5994864 - DNA, 23 bp, Homo sapiens
cagagccatgggcctgggcctgc

SEQ ID NO: 5994865 - DNA, 20 bp, Homo sapiens
cagagccatgtcttctccct

SEQ ID NO: 5994866 - DNA, 19 bp, Homo sapiens
cagagccattcccttggaa

SEQ ID NO: 5994867 - DNA, 21 bp, Homo sapiens
cagagcccaaggtcagggagg

SEQ ID NO: 5994868 - DNA, 15 bp, Homo sapiens
cagagcccaagtgcc

SEQ ID NO: 5994869 - DNA, 21 bp, Homo sapiens
cagagcccaagtgccatccca

SEQ ID NO: 5994870 - DNA, 16 bp, Homo sapiens
cagagcccaccagcca

SEQ ID NO: 5994871 - DNA, 23 bp, Homo sapiens
cagagcccaccagccagccctgg

SEQ ID NO: 5994872 - DNA, 17 bp, Homo sapiens
cagagcccacgccccca

SEQ ID NO: 5994873 - DNA, 19 bp, Homo sapiens
cagagcccactccatctgg

SEQ ID NO: 5994874 - DNA, 14 bp, Homo sapiens
cagagcccagaccc

SEQ ID NO: 5994875 - DNA, 15 bp, Homo sapiens
cagagcccagcatcc

SEQ ID NO: 5994876 - DNA, 14 bp, Homo sapiens
cagagcccagccca

SEQ ID NO: 5994877 - DNA, 15 bp, Homo sapiens
cagagcccagcccag

SEQ ID NO: 5994878 - DNA, 13 bp, Homo sapiens
cagagcccagctc

SEQ ID NO: 5994879 - DNA, 21 bp, Homo sapiens
cagagcccagctcttgctctc

SEQ ID NO: 5994880 - DNA, 23 bp, Homo sapiens
cagagcccaggaattctcacagg

SEQ ID NO: 5994881 - DNA, 13 bp, Homo sapiens
cagagcccaggct

SEQ ID NO: 5994882 - DNA, 17 bp, Homo sapiens
cagagcccaggctcggc

SEQ ID NO: 5994883 - DNA, 22 bp, Homo sapiens
cagagcccatgctcaaccactg

SEQ ID NO: 5994884 - DNA, 13 bp, Homo sapiens
cagagccccacag

SEQ ID NO: 5994885 - DNA, 20 bp, Homo sapiens
cagagccccaccctcagatg

SEQ ID NO: 5994886 - DNA, 15 bp, Homo sapiens
cagagccccacgctg

SEQ ID NO: 5994887 - DNA, 16 bp, Homo sapiens
cagagcccccaagcct

SEQ ID NO: 5994888 - DNA, 17 bp, Homo sapiens
cagagcccccaagcctc

SEQ ID NO: 5994889 - DNA, 18 bp, Homo sapiens
cagagcccccaagcctct

SEQ ID NO: 5994890 - DNA, 22 bp, Homo sapiens
cagagcccccaagcctctgccc

SEQ ID NO: 5994891 - DNA, 14 bp, Homo sapiens
cagagcccccaagg

SEQ ID NO: 5994892 - DNA, 14 bp, Homo sapiens
cagagcccccagga

SEQ ID NO: 5994893 - DNA, 18 bp, Homo sapiens
cagagcccccaggaagcc

SEQ ID NO: 5994894 - DNA, 14 bp, Homo sapiens
cagagccccggagc

SEQ ID NO: 5994895 - DNA, 16 bp, Homo sapiens
cagagcccctacagca

SEQ ID NO: 5994896 - DNA, 17 bp, Homo sapiens
cagagcccctcatgcca

SEQ ID NO: 5994897 - DNA, 16 bp, Homo sapiens
cagagcccctcctcca

SEQ ID NO: 5994898 - DNA, 21 bp, Homo sapiens
cagagcccctcctccagcccc

SEQ ID NO: 5994899 - DNA, 19 bp, Homo sapiens
cagagcccggtgggtccgc

SEQ ID NO: 5994900 - DNA, 14 bp, Homo sapiens
cagagccctccagg

SEQ ID NO: 5994901 - DNA, 17 bp, Homo sapiens
cagagccctctgagccg

SEQ ID NO: 5994902 - DNA, 23 bp, Homo sapiens
cagagccctgaggggctgggctg

SEQ ID NO: 5994903 - DNA, 14 bp, Homo sapiens
cagagccctgctcc

SEQ ID NO: 5994904 - DNA, 14 bp, Homo sapiens
cagagccctggctg

SEQ ID NO: 5994905 - DNA, 15 bp, Homo sapiens
cagagccctggctgg

SEQ ID NO: 5994906 - DNA, 19 bp, Homo sapiens
cagagccctggctgggttc

SEQ ID NO: 5994907 - DNA, 18 bp, Homo sapiens
cagagcccttcactgcca

SEQ ID NO: 5994908 - DNA, 13 bp, Homo sapiens
cagagcccttgac

SEQ ID NO: 5994909 - DNA, 20 bp, Homo sapiens
cagagcccttgactgtacag

SEQ ID NO: 5994910 - DNA, 17 bp, Homo sapiens
cagagccgcaccctggc

SEQ ID NO: 5994911 - DNA, 19 bp, Homo sapiens
cagagccgcaccctggctg

SEQ ID NO: 5994912 - DNA, 12 bp, Homo sapiens
cagagccgccac

SEQ ID NO: 5994913 - DNA, 23 bp, Homo sapiens
cagagccgccccgtgtcccccca

SEQ ID NO: 5994914 - DNA, 23 bp, Homo sapiens
cagagccggcatccttgcctgtc

SEQ ID NO: 5994915 - DNA, 18 bp, Homo sapiens
cagagccggcccgcctct

SEQ ID NO: 5994916 - DNA, 15 bp, Homo sapiens
cagagccggccgcct

SEQ ID NO: 5994917 - DNA, 18 bp, Homo sapiens
cagagccggtttccgtgg

SEQ ID NO: 5994918 - DNA, 18 bp, Homo sapiens
cagagccgttcctgggac

SEQ ID NO: 5994919 - DNA, 18 bp, Homo sapiens
cagagcctaccttcacca

SEQ ID NO: 5994920 - DNA, 21 bp, Homo sapiens
cagagcctaccttcaccacct

SEQ ID NO: 5994921 - DNA, 19 bp, Homo sapiens
cagagcctagccacctccc

SEQ ID NO: 5994922 - DNA, 21 bp, Homo sapiens
cagagcctagccacctcccac

SEQ ID NO: 5994923 - DNA, 11 bp, Homo sapiens
cagagcctcag

SEQ ID NO: 5994924 - DNA, 10 bp, Homo sapiens
cagagcctcc

SEQ ID NO: 5994925 - DNA, 18 bp, Homo sapiens
cagagcctccctcagcca

SEQ ID NO: 5994926 - DNA, 14 bp, Homo sapiens
cagagcctcctggg

SEQ ID NO: 5994927 - DNA, 16 bp, Homo sapiens
cagagcctcgctctgt

SEQ ID NO: 5994928 - DNA, 11 bp, Homo sapiens
cagagcctctg

SEQ ID NO: 5994929 - DNA, 14 bp, Homo sapiens
cagagcctctgaga

SEQ ID NO: 5994930 - DNA, 20 bp, Homo sapiens
cagagcctctgagatgatgc

SEQ ID NO: 5994931 - DNA, 16 bp, Homo sapiens
cagagcctctgctgga

SEQ ID NO: 5994932 - DNA, 18 bp, Homo sapiens
cagagcctctggcccctc

SEQ ID NO: 5994933 - DNA, 16 bp, Homo sapiens
cagagcctgacctgag

SEQ ID NO: 5994934 - DNA, 18 bp, Homo sapiens
cagagcctgacgctcagc

SEQ ID NO: 5994935 - DNA, 20 bp, Homo sapiens
cagagcctgacgctcagccc

SEQ ID NO: 5994936 - DNA, 21 bp, Homo sapiens
cagagcctgacgctcagcccc

SEQ ID NO: 5994937 - DNA, 22 bp, Homo sapiens
cagagcctgcagggtgacctgc

SEQ ID NO: 5994938 - DNA, 17 bp, Homo sapiens
cagagcctgccccagcg

SEQ ID NO: 5994939 - DNA, 13 bp, Homo sapiens
cagagcctggctt

SEQ ID NO: 5994940 - DNA, 12 bp, Homo sapiens
cagagcctgggg

SEQ ID NO: 5994941 - DNA, 19 bp, Homo sapiens
cagagcctggggtgggtgt

SEQ ID NO: 5994942 - DNA, 19 bp, Homo sapiens
cagagcctggggtgttctc

SEQ ID NO: 5994943 - DNA, 11 bp, Homo sapiens
cagagcctggt

SEQ ID NO: 5994944 - DNA, 19 bp, Homo sapiens
cagagcctggtagagacta

SEQ ID NO: 5994945 - DNA, 22 bp, Homo sapiens
cagagcctggtagagactaggg

SEQ ID NO: 5994946 - DNA, 13 bp, Homo sapiens
cagagcctgtccc

SEQ ID NO: 5994947 - DNA, 23 bp, Homo sapiens
cagagcctgtccccgccttccct

SEQ ID NO: 5994948 - DNA, 22 bp, Homo sapiens
cagagcctgtctttcagcattc

SEQ ID NO: 5994949 - DNA, 13 bp, Homo sapiens
cagagcctgtggc

SEQ ID NO: 5994950 - DNA, 17 bp, Homo sapiens
cagagcctgttttaaaa

SEQ ID NO: 5994951 - DNA, 18 bp, Homo sapiens
cagagccttcaagtgcca

SEQ ID NO: 5994952 - DNA, 19 bp, Homo sapiens
cagagccttcaagtgccaa

SEQ ID NO: 5994953 - DNA, 19 bp, Homo sapiens
cagagccttctcagaagca

SEQ ID NO: 5994954 - DNA, 20 bp, Homo sapiens
cagagccttctcagaagcac

SEQ ID NO: 5994955 - DNA, 15 bp, Homo sapiens
cagagccttctcctg

SEQ ID NO: 5994956 - DNA, 13 bp, Homo sapiens
cagagccttgaga

SEQ ID NO: 5994957 - DNA, 15 bp, Homo sapiens
cagagccttggagga

SEQ ID NO: 5994958 - DNA, 20 bp, Homo sapiens
cagagccttttacccctgca

SEQ ID NO: 5994959 - DNA, 20 bp, Homo sapiens
cagagcgagactccatctct

SEQ ID NO: 5994960 - DNA, 20 bp, Homo sapiens
cagagcgagactctgtctca

SEQ ID NO: 5994961 - DNA, 20 bp, Homo sapiens
cagagcgaggaaaggatttt

SEQ ID NO: 5994962 - DNA, 16 bp, Homo sapiens
cagagcgatgtgttct

SEQ ID NO: 5994963 - DNA, 15 bp, Homo sapiens
cagagcgcacaggga

SEQ ID NO: 5994964 - DNA, 13 bp, Homo sapiens
cagagcgcagccc

SEQ ID NO: 5994965 - DNA, 19 bp, Homo sapiens
cagagcgcagcccccacgc

SEQ ID NO: 5994966 - DNA, 21 bp, Homo sapiens
cagagcgccaggaagccagag

SEQ ID NO: 5994967 - DNA, 14 bp, Homo sapiens
cagagcgcccctcc

SEQ ID NO: 5994968 - DNA, 15 bp, Homo sapiens
cagagcgcctcacct

SEQ ID NO: 5994969 - DNA, 19 bp, Homo sapiens
cagagcgcctcacctgcat

SEQ ID NO: 5994970 - DNA, 21 bp, Homo sapiens
cagagcgcctcacctgcatcc

SEQ ID NO: 5994971 - DNA, 23 bp, Homo sapiens
cagagcgcctcacctgcatcctc

SEQ ID NO: 5994972 - DNA, 19 bp, Homo sapiens
cagagcggaggctgtgtgc

SEQ ID NO: 5994973 - DNA, 21 bp, Homo sapiens
cagagcggatgggcacacaca

SEQ ID NO: 5994974 - DNA, 13 bp, Homo sapiens
cagagcgggagtg

SEQ ID NO: 5994975 - DNA, 14 bp, Homo sapiens
cagagcgggcctct

SEQ ID NO: 5994976 - DNA, 15 bp, Homo sapiens
cagagcgggcctctt

SEQ ID NO: 5994977 - DNA, 16 bp, Homo sapiens
cagagcgggcctcttc

SEQ ID NO: 5994978 - DNA, 21 bp, Homo sapiens
cagagcgggcctcttccctca

SEQ ID NO: 5994979 - DNA, 23 bp, Homo sapiens
cagagcgggcctcttccctcagt

SEQ ID NO: 5994980 - DNA, 19 bp, Homo sapiens
cagagcggggaggtgcctg

SEQ ID NO: 5994981 - DNA, 22 bp, Homo sapiens
cagagcggggtcccctctgtgc

SEQ ID NO: 5994982 - DNA, 18 bp, Homo sapiens
cagagcgggtaaagtgca

SEQ ID NO: 5994983 - DNA, 22 bp, Homo sapiens
cagagcggtatctctggcacca

SEQ ID NO: 5994984 - DNA, 14 bp, Homo sapiens
cagagcgtccttgg

SEQ ID NO: 5994985 - DNA, 18 bp, Homo sapiens
cagagcgttagaggggcc

SEQ ID NO: 5994986 - DNA, 19 bp, Homo sapiens
cagagcgttagaggggcca

SEQ ID NO: 5994987 - DNA, 19 bp, Homo sapiens
cagagctaaactccttcct

SEQ ID NO: 5994988 - DNA, 22 bp, Homo sapiens
cagagctaaactccttcctggc

SEQ ID NO: 5994989 - DNA, 17 bp, Homo sapiens
cagagctaaggccaatg

SEQ ID NO: 5994990 - DNA, 19 bp, Homo sapiens
cagagctaaggccaatggg

SEQ ID NO: 5994991 - DNA, 12 bp, Homo sapiens
cagagctagagg

SEQ ID NO: 5994992 - DNA, 14 bp, Homo sapiens
cagagctaggcccc

SEQ ID NO: 5994993 - DNA, 16 bp, Homo sapiens
cagagctagggctgct

SEQ ID NO: 5994994 - DNA, 19 bp, Homo sapiens
cagagctagggctgctgct

SEQ ID NO: 5994995 - DNA, 21 bp, Homo sapiens
cagagctagggctgctgcttc

SEQ ID NO: 5994996 - DNA, 16 bp, Homo sapiens
cagagctatcattatg

SEQ ID NO: 5994997 - DNA, 16 bp, Homo sapiens
cagagctatggtgagg

SEQ ID NO: 5994998 - DNA, 20 bp, Homo sapiens
cagagctcatcccccctgct

SEQ ID NO: 5994999 - DNA, 24 bp, Homo sapiens
cagagctcatcccccctgctgccc

SEQ ID NO: 5995000 - DNA, 16 bp, Homo sapiens
cagagctccacagaag

SEQ ID NO: 5995001 - DNA, 13 bp, Homo sapiens
cagagctcccagg

SEQ ID NO: 5995002 - DNA, 16 bp, Homo sapiens
cagagctcccaggacg

SEQ ID NO: 5995003 - DNA, 17 bp, Homo sapiens
cagagctcccttcctga

SEQ ID NO: 5995004 - DNA, 20 bp, Homo sapiens
cagagctctccagctccaag

SEQ ID NO: 5995005 - DNA, 18 bp, Homo sapiens
cagagctctcccctcctg

SEQ ID NO: 5995006 - DNA, 17 bp, Homo sapiens
cagagctctctctacag

SEQ ID NO: 5995007 - DNA, 18 bp, Homo sapiens
cagagctctctctacaga

SEQ ID NO: 5995008 - DNA, 21 bp, Homo sapiens
cagagctctgacccacagcct

SEQ ID NO: 5995009 - DNA, 15 bp, Homo sapiens
cagagctctggagcc

SEQ ID NO: 5995010 - DNA, 19 bp, Homo sapiens
cagagctctggagccacct

SEQ ID NO: 5995011 - DNA, 21 bp, Homo sapiens
cagagctctttgatcgctttt

SEQ ID NO: 5995012 - DNA, 17 bp, Homo sapiens
cagagctgacgggaggc

SEQ ID NO: 5995013 - DNA, 22 bp, Homo sapiens
cagagctgacgggaggccccag

SEQ ID NO: 5995014 - DNA, 23 bp, Homo sapiens
cagagctgacgggaggccccagc

SEQ ID NO: 5995015 - DNA, 20 bp, Homo sapiens
cagagctgaggatttcctgg

SEQ ID NO: 5995016 - DNA, 22 bp, Homo sapiens
cagagctgagggccctgtggag

SEQ ID NO: 5995017 - DNA, 11 bp, Homo sapiens
cagagctgagt

SEQ ID NO: 5995018 - DNA, 22 bp, Homo sapiens
cagagctgagtggcagccgcct

SEQ ID NO: 5995019 - DNA, 23 bp, Homo sapiens
cagagctgagtggcagccgcctc

SEQ ID NO: 5995020 - DNA, 18 bp, Homo sapiens
cagagctgagttgggggt

SEQ ID NO: 5995021 - DNA, 20 bp, Homo sapiens
cagagctgatggagaaggaa

SEQ ID NO: 5995022 - DNA, 16 bp, Homo sapiens
cagagctgcacttggc

SEQ ID NO: 5995023 - DNA, 21 bp, Homo sapiens
cagagctgcacttggcctcag

SEQ ID NO: 5995024 - DNA, 23 bp, Homo sapiens
cagagctgcacttggcctcagct

SEQ ID NO: 5995025 - DNA, 12 bp, Homo sapiens
cagagctgcaga

SEQ ID NO: 5995026 - DNA, 21 bp, Homo sapiens
cagagctgcagaaccagtccc

SEQ ID NO: 5995027 - DNA, 14 bp, Homo sapiens
cagagctgcagcca

SEQ ID NO: 5995028 - DNA, 12 bp, Homo sapiens
cagagctgccag

SEQ ID NO: 5995029 - DNA, 13 bp, Homo sapiens
cagagctgccctc

SEQ ID NO: 5995030 - DNA, 20 bp, Homo sapiens
cagagctgccctctcctggg

SEQ ID NO: 5995031 - DNA, 23 bp, Homo sapiens
cagagctgccctctcctgggcag

SEQ ID NO: 5995032 - DNA, 12 bp, Homo sapiens
cagagctgcctc

SEQ ID NO: 5995033 - DNA, 20 bp, Homo sapiens
cagagctgcctccccaatcc

SEQ ID NO: 5995034 - DNA, 24 bp, Homo sapiens
cagagctgcgggctgagggcatct

SEQ ID NO: 5995035 - DNA, 14 bp, Homo sapiens
cagagctgctgagc

SEQ ID NO: 5995036 - DNA, 15 bp, Homo sapiens
cagagctgctgagca

SEQ ID NO: 5995037 - DNA, 15 bp, Homo sapiens
cagagctgctgcaca

SEQ ID NO: 5995038 - DNA, 16 bp, Homo sapiens
cagagctgctggaggt

SEQ ID NO: 5995039 - DNA, 17 bp, Homo sapiens
cagagctgctggaggtg

SEQ ID NO: 5995040 - DNA, 13 bp, Homo sapiens
cagagctgcttct

SEQ ID NO: 5995041 - DNA, 9 bp, Homo sapiens
cagagctgg

SEQ ID NO: 5995042 - DNA, 13 bp, Homo sapiens
cagagctggaaca

SEQ ID NO: 5995043 - DNA, 18 bp, Homo sapiens
cagagctggaaggcaggg

SEQ ID NO: 5995044 - DNA, 21 bp, Homo sapiens
cagagctggagcccccagcag

SEQ ID NO: 5995045 - DNA, 16 bp, Homo sapiens
cagagctggatgctga

SEQ ID NO: 5995046 - DNA, 21 bp, Homo sapiens
cagagctggattcaattcctg

SEQ ID NO: 5995047 - DNA, 21 bp, Homo sapiens
cagagctggcagcctccagtg

SEQ ID NO: 5995048 - DNA, 12 bp, Homo sapiens
cagagctggcct

SEQ ID NO: 5995049 - DNA, 23 bp, Homo sapiens
cagagctggcgactgcagctgca

SEQ ID NO: 5995050 - DNA, 19 bp, Homo sapiens
cagagctggcgctcagcag

SEQ ID NO: 5995051 - DNA, 17 bp, Homo sapiens
cagagctggctctgagc

SEQ ID NO: 5995052 - DNA, 17 bp, Homo sapiens
cagagctggctgtcttc

SEQ ID NO: 5995053 - DNA, 14 bp, Homo sapiens
cagagctgggaggc

SEQ ID NO: 5995054 - DNA, 20 bp, Homo sapiens
cagagctgggaggcatggcc

SEQ ID NO: 5995055 - DNA, 23 bp, Homo sapiens
cagagctgggaggcatggccctg

SEQ ID NO: 5995056 - DNA, 11 bp, Homo sapiens
cagagctgggc

SEQ ID NO: 5995057 - DNA, 13 bp, Homo sapiens
cagagctggggct

SEQ ID NO: 5995058 - DNA, 19 bp, Homo sapiens
cagagctggggctgccagc

SEQ ID NO: 5995059 - DNA, 16 bp, Homo sapiens
cagagctggggggaag

SEQ ID NO: 5995060 - DNA, 13 bp, Homo sapiens
cagagctgggtga

SEQ ID NO: 5995061 - DNA, 11 bp, Homo sapiens
cagagctggtg

SEQ ID NO: 5995062 - DNA, 12 bp, Homo sapiens
cagagctggtgc

SEQ ID NO: 5995063 - DNA, 20 bp, Homo sapiens
cagagctggtgcggctggcc

SEQ ID NO: 5995064 - DNA, 17 bp, Homo sapiens
cagagctggtggaccca

SEQ ID NO: 5995065 - DNA, 20 bp, Homo sapiens
cagagctggtggacccaggg

SEQ ID NO: 5995066 - DNA, 22 bp, Homo sapiens
cagagctgtcctcctggcacct

SEQ ID NO: 5995067 - DNA, 12 bp, Homo sapiens
cagagctgtgcc

SEQ ID NO: 5995068 - DNA, 18 bp, Homo sapiens
cagagctgtgcctgctca

SEQ ID NO: 5995069 - DNA, 21 bp, Homo sapiens
cagagctgtgcctgctcagca

SEQ ID NO: 5995070 - DNA, 22 bp, Homo sapiens
cagagctgtgcctgctcagcag

SEQ ID NO: 5995071 - DNA, 22 bp, Homo sapiens
cagagctgtggactttgttcac

SEQ ID NO: 5995072 - DNA, 15 bp, Homo sapiens
cagagctgtggagga

SEQ ID NO: 5995073 - DNA, 15 bp, Homo sapiens
cagagctgttataaa

SEQ ID NO: 5995074 - DNA, 16 bp, Homo sapiens
cagagctgttggcctc

SEQ ID NO: 5995075 - DNA, 19 bp, Homo sapiens
cagagctgttggcctcgcc

SEQ ID NO: 5995076 - DNA, 23 bp, Homo sapiens
cagagctgttggcctcgcctggg

SEQ ID NO: 5995077 - DNA, 15 bp, Homo sapiens
cagagcttcccagga

SEQ ID NO: 5995078 - DNA, 14 bp, Homo sapiens
cagagcttccctga

SEQ ID NO: 5995079 - DNA, 17 bp, Homo sapiens
cagagcttcctggggac

SEQ ID NO: 5995080 - DNA, 19 bp, Homo sapiens
cagagcttcctggggacca

SEQ ID NO: 5995081 - DNA, 16 bp, Homo sapiens
cagagcttctcctgac

SEQ ID NO: 5995082 - DNA, 21 bp, Homo sapiens
cagagcttctcctgaccaggg

SEQ ID NO: 5995083 - DNA, 22 bp, Homo sapiens
cagagcttctcctgaccagggc

SEQ ID NO: 5995084 - DNA, 14 bp, Homo sapiens
cagagcttctctgg

SEQ ID NO: 5995085 - DNA, 16 bp, Homo sapiens
cagagcttctctgggc

SEQ ID NO: 5995086 - DNA, 21 bp, Homo sapiens
cagagcttctctgggctgaat

SEQ ID NO: 5995087 - DNA, 23 bp, Homo sapiens
cagagcttctctgggctgaatgt

SEQ ID NO: 5995088 - DNA, 15 bp, Homo sapiens
cagagcttgaagcct

SEQ ID NO: 5995089 - DNA, 19 bp, Homo sapiens
cagagcttggactggatgc

SEQ ID NO: 5995090 - DNA, 21 bp, Homo sapiens
cagagcttgtagccctggatg

SEQ ID NO: 5995091 - DNA, 14 bp, Homo sapiens
cagagcttgtggaa

SEQ ID NO: 5995092 - DNA, 21 bp, Homo sapiens
cagagcttgtggtggggcagg

SEQ ID NO: 5995093 - DNA, 22 bp, Homo sapiens
cagagcttgtggtggggcagga

SEQ ID NO: 5995094 - DNA, 19 bp, Homo sapiens
cagagctttaaaagtatct

SEQ ID NO: 5995095 - DNA, 20 bp, Homo sapiens
cagagctttcttttgtatta

SEQ ID NO: 5995096 - DNA, 21 bp, Homo sapiens
cagagctttcttttgtattaa

SEQ ID NO: 5995097 - DNA, 14 bp, Homo sapiens
cagagctttgtcac

SEQ ID NO: 5995098 - DNA, 19 bp, Homo sapiens
cagagctttgtcacttgcc

SEQ ID NO: 5995099 - DNA, 22 bp, Homo sapiens
cagagctttgtcacttgccaca

SEQ ID NO: 5995100 - DNA, 14 bp, Homo sapiens
cagagcttttcaga

SEQ ID NO: 5995101 - DNA, 17 bp, Homo sapiens
cagagcttttgcatttc

SEQ ID NO: 5995102 - DNA, 18 bp, Homo sapiens
cagagcttttgcatttcc

SEQ ID NO: 5995103 - DNA, 20 bp, Homo sapiens
cagaggaaaaatgggagcca

SEQ ID NO: 5995104 - DNA, 23 bp, Homo sapiens
cagaggaaacaatatttataaag

SEQ ID NO: 5995105 - DNA, 19 bp, Homo sapiens
cagaggaaagcaaaggaga

SEQ ID NO: 5995106 - DNA, 19 bp, Homo sapiens
cagaggaaagggctggctc

SEQ ID NO: 5995107 - DNA, 21 bp, Homo sapiens
cagaggaaagggctggctccc

SEQ ID NO: 5995108 - DNA, 14 bp, Homo sapiens
cagaggaaatctgt

SEQ ID NO: 5995109 - DNA, 19 bp, Homo sapiens
cagaggaaccagcactcca

SEQ ID NO: 5995110 - DNA, 16 bp, Homo sapiens
cagaggaacccccacc

SEQ ID NO: 5995111 - DNA, 19 bp, Homo sapiens
cagaggaagaaacctggaa

SEQ ID NO: 5995112 - DNA, 13 bp, Homo sapiens
cagaggaagcaca

SEQ ID NO: 5995113 - DNA, 14 bp, Homo sapiens
cagaggaagcacat

SEQ ID NO: 5995114 - DNA, 13 bp, Homo sapiens
cagaggaaggaaa

SEQ ID NO: 5995115 - DNA, 18 bp, Homo sapiens
cagaggaagggaggcctg

SEQ ID NO: 5995116 - DNA, 16 bp, Homo sapiens
cagaggaaggggccag

SEQ ID NO: 5995117 - DNA, 16 bp, Homo sapiens
cagaggaatcctggca

SEQ ID NO: 5995118 - DNA, 21 bp, Homo sapiens
cagaggaatgatgggcttttg

SEQ ID NO: 5995119 - DNA, 23 bp, Homo sapiens
cagaggaattgattgtcagccac

SEQ ID NO: 5995120 - DNA, 20 bp, Homo sapiens
cagaggacaaggaagtgggg

SEQ ID NO: 5995121 - DNA, 14 bp, Homo sapiens
cagaggacagctct

SEQ ID NO: 5995122 - DNA, 15 bp, Homo sapiens
cagaggacagctctg

SEQ ID NO: 5995123 - DNA, 22 bp, Homo sapiens
cagaggacagtgctgaccccag

SEQ ID NO: 5995124 - DNA, 16 bp, Homo sapiens
cagaggacatcacctg

SEQ ID NO: 5995125 - DNA, 18 bp, Homo sapiens
cagaggaccacagtgggt

SEQ ID NO: 5995126 - DNA, 21 bp, Homo sapiens
cagaggaccacagtgggtggc

SEQ ID NO: 5995127 - DNA, 13 bp, Homo sapiens
cagaggaccagca

SEQ ID NO: 5995128 - DNA, 16 bp, Homo sapiens
cagaggaccagcacac

SEQ ID NO: 5995129 - DNA, 16 bp, Homo sapiens
cagaggaccccagggt

SEQ ID NO: 5995130 - DNA, 12 bp, Homo sapiens
cagaggaccctt

SEQ ID NO: 5995131 - DNA, 12 bp, Homo sapiens
cagaggacctct

SEQ ID NO: 5995132 - DNA, 14 bp, Homo sapiens
cagaggacctgtat

SEQ ID NO: 5995133 - DNA, 21 bp, Homo sapiens
cagaggacctgtatttaagca

SEQ ID NO: 5995134 - DNA, 14 bp, Homo sapiens
cagaggacgcacgc

SEQ ID NO: 5995135 - DNA, 21 bp, Homo sapiens
cagaggactctgcttaaacaa

SEQ ID NO: 5995136 - DNA, 22 bp, Homo sapiens
cagaggactctgcttaaacaaa

SEQ ID NO: 5995137 - DNA, 20 bp, Homo sapiens
cagaggagaacttgctgcct

SEQ ID NO: 5995138 - DNA, 12 bp, Homo sapiens
cagaggagaaga

SEQ ID NO: 5995139 - DNA, 13 bp, Homo sapiens
cagaggagagagg

SEQ ID NO: 5995140 - DNA, 19 bp, Homo sapiens
cagaggagagaggaccccc

SEQ ID NO: 5995141 - DNA, 18 bp, Homo sapiens
cagaggagagctgctggg

SEQ ID NO: 5995142 - DNA, 13 bp, Homo sapiens
cagaggagaggag

SEQ ID NO: 5995143 - DNA, 16 bp, Homo sapiens
cagaggagaggagaca

SEQ ID NO: 5995144 - DNA, 17 bp, Homo sapiens
cagaggagaggagacag

SEQ ID NO: 5995145 - DNA, 19 bp, Homo sapiens
cagaggagaggagacagac

SEQ ID NO: 5995146 - DNA, 16 bp, Homo sapiens
cagaggagcagctctc

SEQ ID NO: 5995147 - DNA, 19 bp, Homo sapiens
cagaggagccaccagttct

SEQ ID NO: 5995148 - DNA, 18 bp, Homo sapiens
cagaggagccacctgggc

SEQ ID NO: 5995149 - DNA, 21 bp, Homo sapiens
cagaggagccacctgggctgg

SEQ ID NO: 5995150 - DNA, 13 bp, Homo sapiens
cagaggagcccag

SEQ ID NO: 5995151 - DNA, 18 bp, Homo sapiens
cagaggagcccagtgggc

SEQ ID NO: 5995152 - DNA, 22 bp, Homo sapiens
cagaggagcccagtgggctgca

SEQ ID NO: 5995153 - DNA, 23 bp, Homo sapiens
cagaggagcccagtgggctgcac

SEQ ID NO: 5995154 - DNA, 15 bp, Homo sapiens
cagaggagccttttt

SEQ ID NO: 5995155 - DNA, 22 bp, Homo sapiens
cagaggagcctttttaaaacac

SEQ ID NO: 5995156 - DNA, 14 bp, Homo sapiens
cagaggagctctac

SEQ ID NO: 5995157 - DNA, 22 bp, Homo sapiens
cagaggagctctaccctgctcc

SEQ ID NO: 5995158 - DNA, 21 bp, Homo sapiens
cagaggagctgggagccgggc

SEQ ID NO: 5995159 - DNA, 14 bp, Homo sapiens
cagaggaggcctca

SEQ ID NO: 5995160 - DNA, 19 bp, Homo sapiens
cagaggagggatagagacg

SEQ ID NO: 5995161 - DNA, 15 bp, Homo sapiens
cagaggagggcagag

SEQ ID NO: 5995162 - DNA, 22 bp, Homo sapiens
cagaggagggcagcagaagggg

SEQ ID NO: 5995163 - DNA, 16 bp, Homo sapiens
cagaggaggggaaagt

SEQ ID NO: 5995164 - DNA, 19 bp, Homo sapiens
cagaggaggggacttgtag

SEQ ID NO: 5995165 - DNA, 13 bp, Homo sapiens
cagaggaggggcc

SEQ ID NO: 5995166 - DNA, 14 bp, Homo sapiens
cagaggaggggccg

SEQ ID NO: 5995167 - DNA, 20 bp, Homo sapiens
cagaggaggggccgctgcca

SEQ ID NO: 5995168 - DNA, 13 bp, Homo sapiens
cagaggaggtcag

SEQ ID NO: 5995169 - DNA, 23 bp, Homo sapiens
cagaggagtaaataattggaaaa

SEQ ID NO: 5995170 - DNA, 17 bp, Homo sapiens
cagaggagtacaggtga

SEQ ID NO: 5995171 - DNA, 19 bp, Homo sapiens
cagaggagtccagggcggg

SEQ ID NO: 5995172 - DNA, 20 bp, Homo sapiens
cagaggagtgcagccttctc

SEQ ID NO: 5995173 - DNA, 15 bp, Homo sapiens
cagaggatgcctttt

SEQ ID NO: 5995174 - DNA, 17 bp, Homo sapiens
cagaggatgccttttct

SEQ ID NO: 5995175 - DNA, 22 bp, Homo sapiens
cagaggatgccttttctgtgat

SEQ ID NO: 5995176 - DNA, 15 bp, Homo sapiens
cagaggatgctcttt

SEQ ID NO: 5995177 - DNA, 20 bp, Homo sapiens
cagaggatgctctttcccag

SEQ ID NO: 5995178 - DNA, 22 bp, Homo sapiens
cagaggatgctgacatcatttg

SEQ ID NO: 5995179 - DNA, 16 bp, Homo sapiens
cagaggatggccagtg

SEQ ID NO: 5995180 - DNA, 17 bp, Homo sapiens
cagaggatggccagtgt

SEQ ID NO: 5995181 - DNA, 18 bp, Homo sapiens
cagaggatgtggcctggt

SEQ ID NO: 5995182 - DNA, 16 bp, Homo sapiens
cagaggcaaggatggt

SEQ ID NO: 5995183 - DNA, 17 bp, Homo sapiens
cagaggcagaaccctgg

SEQ ID NO: 5995184 - DNA, 13 bp, Homo sapiens
cagaggcagcccc

SEQ ID NO: 5995185 - DNA, 14 bp, Homo sapiens
cagaggcagcccca

SEQ ID NO: 5995186 - DNA, 15 bp, Homo sapiens
cagaggcagccccat

SEQ ID NO: 5995187 - DNA, 20 bp, Homo sapiens
cagaggcagccccattctgc

SEQ ID NO: 5995188 - DNA, 23 bp, Homo sapiens
cagaggcagctgtgtgggctgca

SEQ ID NO: 5995189 - DNA, 17 bp, Homo sapiens
cagaggcagtacctggg

SEQ ID NO: 5995190 - DNA, 21 bp, Homo sapiens
cagaggcagtacctgggcaag

SEQ ID NO: 5995191 - DNA, 15 bp, Homo sapiens
cagaggcagtggcag

SEQ ID NO: 5995192 - DNA, 18 bp, Homo sapiens
cagaggcatttgagcagc

SEQ ID NO: 5995193 - DNA, 21 bp, Homo sapiens
cagaggcatttgagcagctga

SEQ ID NO: 5995194 - DNA, 14 bp, Homo sapiens
cagaggccaacact

SEQ ID NO: 5995195 - DNA, 17 bp, Homo sapiens
cagaggccaaggactga

SEQ ID NO: 5995196 - DNA, 22 bp, Homo sapiens
cagaggccacactttctgggaa

SEQ ID NO: 5995197 - DNA, 20 bp, Homo sapiens
cagaggccagaggcccccag

SEQ ID NO: 5995198 - DNA, 14 bp, Homo sapiens
cagaggccaggaat

SEQ ID NO: 5995199 - DNA, 14 bp, Homo sapiens
cagaggccaggatg

SEQ ID NO: 5995200 - DNA, 21 bp, Homo sapiens
cagaggccaggatgcctgagc

SEQ ID NO: 5995201 - DNA, 23 bp, Homo sapiens
cagaggccaggatgcctgagccc

SEQ ID NO: 5995202 - DNA, 16 bp, Homo sapiens
cagaggccatgggcct

SEQ ID NO: 5995203 - DNA, 20 bp, Homo sapiens
cagaggcccacattggaaga

SEQ ID NO: 5995204 - DNA, 14 bp, Homo sapiens
cagaggcccagcca

SEQ ID NO: 5995205 - DNA, 16 bp, Homo sapiens
cagaggcccaggctgc

SEQ ID NO: 5995206 - DNA, 20 bp, Homo sapiens
cagaggcccattagttgaga

SEQ ID NO: 5995207 - DNA, 16 bp, Homo sapiens
cagaggccccacctga

SEQ ID NO: 5995208 - DNA, 18 bp, Homo sapiens
cagaggccccacctgaag

SEQ ID NO: 5995209 - DNA, 21 bp, Homo sapiens
cagaggccccacctgaagggt

SEQ ID NO: 5995210 - DNA, 23 bp, Homo sapiens
cagaggccccacctgaagggtgg

SEQ ID NO: 5995211 - DNA, 13 bp, Homo sapiens
cagaggccccagc

SEQ ID NO: 5995212 - DNA, 14 bp, Homo sapiens
cacagctctgtgtt

SEQ ID NO: 5995213 - DNA, 13 bp, Homo sapiens
cacagctcttcat

SEQ ID NO: 5995214 - DNA, 14 bp, Homo sapiens
cacagctcttcatt

SEQ ID NO: 5995215 - DNA, 14 bp, Homo sapiens
cacagctcttctcc

SEQ ID NO: 5995216 - DNA, 19 bp, Homo sapiens
cacagctcttctccaggct

SEQ ID NO: 5995217 - DNA, 14 bp, Homo sapiens
cacagctctttaac

SEQ ID NO: 5995218 - DNA, 15 bp, Homo sapiens
cacagctgaagagca

SEQ ID NO: 5995219 - DNA, 18 bp, Homo sapiens
cacagctgagagactttt

SEQ ID NO: 5995220 - DNA, 17 bp, Homo sapiens
cacagctgagctggcct

SEQ ID NO: 5995221 - DNA, 16 bp, Homo sapiens
cacagctgaggaccct

SEQ ID NO: 5995222 - DNA, 19 bp, Homo sapiens
cacagctgcagagacagag

SEQ ID NO: 5995223 - DNA, 15 bp, Homo sapiens
cacagctgcagccca

SEQ ID NO: 5995224 - DNA, 16 bp, Homo sapiens
cacagctgcagcccat

SEQ ID NO: 5995225 - DNA, 14 bp, Homo sapiens
cacagctgcagctg

SEQ ID NO: 5995226 - DNA, 15 bp, Homo sapiens
cacagctgcagctga

SEQ ID NO: 5995227 - DNA, 21 bp, Homo sapiens
cacagctgcagctgggcccca

SEQ ID NO: 5995228 - DNA, 12 bp, Homo sapiens
cacagctgccct

SEQ ID NO: 5995229 - DNA, 13 bp, Homo sapiens
cacagctgcccta

SEQ ID NO: 5995230 - DNA, 15 bp, Homo sapiens
cacagctgccctagc

SEQ ID NO: 5995231 - DNA, 22 bp, Homo sapiens
cacagctgccctagctgacccc

SEQ ID NO: 5995232 - DNA, 22 bp, Homo sapiens
cacagctgccctgctgccacag

SEQ ID NO: 5995233 - DNA, 21 bp, Homo sapiens
cacagctgccggtcgcccttt

SEQ ID NO: 5995234 - DNA, 14 bp, Homo sapiens
cacagctgcctccg

SEQ ID NO: 5995235 - DNA, 17 bp, Homo sapiens
cacagctgcctccgggc

SEQ ID NO: 5995236 - DNA, 15 bp, Homo sapiens
cacagctgcctcttc

SEQ ID NO: 5995237 - DNA, 15 bp, Homo sapiens
cacagctgctgaaga

SEQ ID NO: 5995238 - DNA, 12 bp, Homo sapiens
cacagctgctgg

SEQ ID NO: 5995239 - DNA, 14 bp, Homo sapiens
cacagctgctggag

SEQ ID NO: 5995240 - DNA, 16 bp, Homo sapiens
cacagctgctggagaa

SEQ ID NO: 5995241 - DNA, 16 bp, Homo sapiens
cacagctgctggccag

SEQ ID NO: 5995242 - DNA, 19 bp, Homo sapiens
cacagctgctgtgccagga

SEQ ID NO: 5995243 - DNA, 21 bp, Homo sapiens
cacagctgctgttctcaggac

SEQ ID NO: 5995244 - DNA, 24 bp, Homo sapiens
cacagctgctgttctcaggacagc

SEQ ID NO: 5995245 - DNA, 22 bp, Homo sapiens
cacagctgcttgtcctgctctc

SEQ ID NO: 5995246 - DNA, 14 bp, Homo sapiens
cacagctgctttct

SEQ ID NO: 5995247 - DNA, 23 bp, Homo sapiens
cacagctggaaagttgggcccct

SEQ ID NO: 5995248 - DNA, 12 bp, Homo sapiens
cacagctggaga

SEQ ID NO: 5995249 - DNA, 13 bp, Homo sapiens
cacagctggagaa

SEQ ID NO: 5995250 - DNA, 12 bp, Homo sapiens
cacagctggatc

SEQ ID NO: 5995251 - DNA, 13 bp, Homo sapiens
cacagctggatct

SEQ ID NO: 5995252 - DNA, 13 bp, Homo sapiens
cacagctgggagc

SEQ ID NO: 5995253 - DNA, 17 bp, Homo sapiens
cacagctgggagcctgg

SEQ ID NO: 5995254 - DNA, 13 bp, Homo sapiens
cacagctgggcaa

SEQ ID NO: 5995255 - DNA, 14 bp, Homo sapiens
cacagctgggcagg

SEQ ID NO: 5995256 - DNA, 18 bp, Homo sapiens
cacagctgggcagggtga

SEQ ID NO: 5995257 - DNA, 18 bp, Homo sapiens
cacagctgggcatgccat

SEQ ID NO: 5995258 - DNA, 19 bp, Homo sapiens
cacagctgggcatgccatg

SEQ ID NO: 5995259 - DNA, 23 bp, Homo sapiens
cacagctgggcatgccatgtctg

SEQ ID NO: 5995260 - DNA, 15 bp, Homo sapiens
cacagctgggctgtg

SEQ ID NO: 5995261 - DNA, 12 bp, Homo sapiens
cacagctggggc

SEQ ID NO: 5995262 - DNA, 20 bp, Homo sapiens
cacagctgtatagctgcttc

SEQ ID NO: 5995263 - DNA, 13 bp, Homo sapiens
cacagctgtctgc

SEQ ID NO: 5995264 - DNA, 15 bp, Homo sapiens
cacagctgtctgcca

SEQ ID NO: 5995265 - DNA, 19 bp, Homo sapiens
cacagctgtctgccaggca

SEQ ID NO: 5995266 - DNA, 20 bp, Homo sapiens
cacagctgtctgccaggcac

SEQ ID NO: 5995267 - DNA, 18 bp, Homo sapiens
cacagctgtgaggacaga

SEQ ID NO: 5995268 - DNA, 22 bp, Homo sapiens
cacagctgtggtgaggttgggc

SEQ ID NO: 5995269 - DNA, 17 bp, Homo sapiens
cacagctgttcttctgt

SEQ ID NO: 5995270 - DNA, 17 bp, Homo sapiens
cacagctgtttgaaatg

SEQ ID NO: 5995271 - DNA, 18 bp, Homo sapiens
cacagcttaacaatgcaa

SEQ ID NO: 5995272 - DNA, 14 bp, Homo sapiens
cacagcttcagcca

SEQ ID NO: 5995273 - DNA, 19 bp, Homo sapiens
cacagcttcagccaggagc

SEQ ID NO: 5995274 - DNA, 15 bp, Homo sapiens
cacagcttcccctct

SEQ ID NO: 5995275 - DNA, 17 bp, Homo sapiens
cacagcttcctgagggc

SEQ ID NO: 5995276 - DNA, 15 bp, Homo sapiens
cacagcttcctgtcc

SEQ ID NO: 5995277 - DNA, 16 bp, Homo sapiens
cacagcttcttctgcc

SEQ ID NO: 5995278 - DNA, 19 bp, Homo sapiens
cacagcttgacctgaggct

SEQ ID NO: 5995279 - DNA, 12 bp, Homo sapiens
cacagcttgggg

SEQ ID NO: 5995280 - DNA, 18 bp, Homo sapiens
cacagcttggggccatcg

SEQ ID NO: 5995281 - DNA, 23 bp, Homo sapiens
cacagcttgggtcaggttcttgc

SEQ ID NO: 5995282 - DNA, 13 bp, Homo sapiens
cacagcttgtctc

SEQ ID NO: 5995283 - DNA, 18 bp, Homo sapiens
cacagcttgtctcttgcc

SEQ ID NO: 5995284 - DNA, 15 bp, Homo sapiens
cacagctttgaggaa

SEQ ID NO: 5995285 - DNA, 21 bp, Homo sapiens
cacagctttgaggaacatgca

SEQ ID NO: 5995286 - DNA, 17 bp, Homo sapiens
cacagcttttcttgata

SEQ ID NO: 5995287 - DNA, 12 bp, Homo sapiens
cacagcttttgc

SEQ ID NO: 5995288 - DNA, 19 bp, Homo sapiens
cacagcttttgtatagaaa

SEQ ID NO: 5995289 - DNA, 21 bp, Homo sapiens
cacagcttttgtatagaaaat

SEQ ID NO: 5995290 - DNA, 22 bp, Homo sapiens
cacaggaaaaataaacgtggat

SEQ ID NO: 5995291 - DNA, 12 bp, Homo sapiens
cacaggaaaagg

SEQ ID NO: 5995292 - DNA, 22 bp, Homo sapiens
cacaggaaatgggaaaaaactt

SEQ ID NO: 5995293 - DNA, 20 bp, Homo sapiens
cacaggaaccacaagactgc

SEQ ID NO: 5995294 - DNA, 15 bp, Homo sapiens
cacaggaaccctaaa

SEQ ID NO: 5995295 - DNA, 20 bp, Homo sapiens
cacaggaacgcacagatcat

SEQ ID NO: 5995296 - DNA, 21 bp, Homo sapiens
cacaggaacgcacagatcatg

SEQ ID NO: 5995297 - DNA, 17 bp, Homo sapiens
cacaggaacggccctgc

SEQ ID NO: 5995298 - DNA, 15 bp, Homo sapiens
cacaggaactctgtg

SEQ ID NO: 5995299 - DNA, 22 bp, Homo sapiens
cacaggaactctgtgtgagaga

SEQ ID NO: 5995300 - DNA, 20 bp, Homo sapiens
cacaggaagatgggaggtgg

SEQ ID NO: 5995301 - DNA, 22 bp, Homo sapiens
cacaggaagatgggaggtggaa

SEQ ID NO: 5995302 - DNA, 23 bp, Homo sapiens
cacaggaaggaggggagagacag

SEQ ID NO: 5995303 - DNA, 15 bp, Homo sapiens
cacaggaagtagagg

SEQ ID NO: 5995304 - DNA, 21 bp, Homo sapiens
cacaggacacctggccgcctc

SEQ ID NO: 5995305 - DNA, 17 bp, Homo sapiens
cacaggacacgaaggct

SEQ ID NO: 5995306 - DNA, 18 bp, Homo sapiens
cacaggacacgaaggctg

SEQ ID NO: 5995307 - DNA, 20 bp, Homo sapiens
cacaggacacgaaggctgcc

SEQ ID NO: 5995308 - DNA, 13 bp, Homo sapiens
cacaggacagcgg

SEQ ID NO: 5995309 - DNA, 23 bp, Homo sapiens
cacaggacaggaaagtggcacct

SEQ ID NO: 5995310 - DNA, 22 bp, Homo sapiens
cacaggacatgcggtagccagc

SEQ ID NO: 5995311 - DNA, 24 bp, Homo sapiens
cacaggaccacctcctctgccagc

SEQ ID NO: 5995312 - DNA, 13 bp, Homo sapiens
cacaggaccgttt

SEQ ID NO: 5995313 - DNA, 19 bp, Homo sapiens
cacaggacgaatgcatatt

SEQ ID NO: 5995314 - DNA, 20 bp, Homo sapiens
cacaggacgaatgcatattc

SEQ ID NO: 5995315 - DNA, 16 bp, Homo sapiens
cacaggactctgcaga

SEQ ID NO: 5995316 - DNA, 17 bp, Homo sapiens
cacaggactctgcagat

SEQ ID NO: 5995317 - DNA, 19 bp, Homo sapiens
cacaggactgagccctctc

SEQ ID NO: 5995318 - DNA, 18 bp, Homo sapiens
cacaggagaaaatgcaat

SEQ ID NO: 5995319 - DNA, 15 bp, Homo sapiens
cacaggagaccaccc

SEQ ID NO: 5995320 - DNA, 16 bp, Homo sapiens
cacaggagaccacccc

SEQ ID NO: 5995321 - DNA, 17 bp, Homo sapiens
cacaggagaccaccccc

SEQ ID NO: 5995322 - DNA, 18 bp, Homo sapiens
cacaggagaccacccccg

SEQ ID NO: 5995323 - DNA, 22 bp, Homo sapiens
cacaggagaccacccccgagct

SEQ ID NO: 5995324 - DNA, 19 bp, Homo sapiens
cacaggagagcacccacag

SEQ ID NO: 5995325 - DNA, 20 bp, Homo sapiens
cacaggagagcacccacagc

SEQ ID NO: 5995326 - DNA, 18 bp, Homo sapiens
cacaggagcaatcacagg

SEQ ID NO: 5995327 - DNA, 19 bp, Homo sapiens
cacaggagcaatcacagga

SEQ ID NO: 5995328 - DNA, 14 bp, Homo sapiens
cacaggagccctgc

SEQ ID NO: 5995329 - DNA, 21 bp, Homo sapiens
cacaggagccgcagaggcccg

SEQ ID NO: 5995330 - DNA, 15 bp, Homo sapiens
cacaggagcgtgtac

SEQ ID NO: 5995331 - DNA, 21 bp, Homo sapiens
cacaggagcgtgtactacccc

SEQ ID NO: 5995332 - DNA, 18 bp, Homo sapiens
cacaggagcgtgtcctat

SEQ ID NO: 5995333 - DNA, 22 bp, Homo sapiens
cacaggagcgtgtcctatcccc

SEQ ID NO: 5995334 - DNA, 15 bp, Homo sapiens
cacaggagctccctt

SEQ ID NO: 5995335 - DNA, 17 bp, Homo sapiens
cacaggagctccctttt

SEQ ID NO: 5995336 - DNA, 18 bp, Homo sapiens
cacaggagctcccttttt

SEQ ID NO: 5995337 - DNA, 22 bp, Homo sapiens
cacaggagctccctttttgaat

SEQ ID NO: 5995338 - DNA, 15 bp, Homo sapiens
cacaggaggcaggca

SEQ ID NO: 5995339 - DNA, 21 bp, Homo sapiens
cacaggaggcaggcatggccc

SEQ ID NO: 5995340 - DNA, 13 bp, Homo sapiens
cacaggaggccag

SEQ ID NO: 5995341 - DNA, 13 bp, Homo sapiens
cacaggagggcca

SEQ ID NO: 5995342 - DNA, 22 bp, Homo sapiens
cacaggagggcggcctccttct

SEQ ID NO: 5995343 - DNA, 22 bp, Homo sapiens
cacaggagggggtcgtggagag

SEQ ID NO: 5995344 - DNA, 23 bp, Homo sapiens
cacaggagggggtcgtggagagc

SEQ ID NO: 5995345 - DNA, 22 bp, Homo sapiens
cacaggagtcctttcttttgaa

SEQ ID NO: 5995346 - DNA, 16 bp, Homo sapiens
cacaggagtgtcctct

SEQ ID NO: 5995347 - DNA, 22 bp, Homo sapiens
cacaggagtgtcctcttccctc

SEQ ID NO: 5995348 - DNA, 21 bp, Homo sapiens
cacaggatattaaacgtgtaa

SEQ ID NO: 5995349 - DNA, 23 bp, Homo sapiens
cacaggatcctattctcaccagg

SEQ ID NO: 5995350 - DNA, 24 bp, Homo sapiens
cacaggatcctattctcaccagga

SEQ ID NO: 5995351 - DNA, 15 bp, Homo sapiens
cacaggatcctggcc

SEQ ID NO: 5995352 - DNA, 16 bp, Homo sapiens
cacaggatgaagcatt

SEQ ID NO: 5995353 - DNA, 14 bp, Homo sapiens
cacaggatgcatat

SEQ ID NO: 5995354 - DNA, 18 bp, Homo sapiens
cacaggatgccagcccct

SEQ ID NO: 5995355 - DNA, 24 bp, Homo sapiens
cacaggatgccagcccctgcctgg

SEQ ID NO: 5995356 - DNA, 16 bp, Homo sapiens
cacaggatgctgtgtt

SEQ ID NO: 5995357 - DNA, 21 bp, Homo sapiens
cacaggatggcaggaggcatc

SEQ ID NO: 5995358 - DNA, 19 bp, Homo sapiens
cacaggatggtctctgcca

SEQ ID NO: 5995359 - DNA, 18 bp, Homo sapiens
cacaggcaaagaggtgct

SEQ ID NO: 5995360 - DNA, 22 bp, Homo sapiens
cacaggcaaagaggtgctgctt

SEQ ID NO: 5995361 - DNA, 20 bp, Homo sapiens
cacaggcaacattacaaaca

SEQ ID NO: 5995362 - DNA, 22 bp, Homo sapiens
cacaggcaactgaggcagacag

SEQ ID NO: 5995363 - DNA, 23 bp, Homo sapiens
cacaggcaactgaggcagacagc

SEQ ID NO: 5995364 - DNA, 15 bp, Homo sapiens
cacaggcagccagcc

SEQ ID NO: 5995365 - DNA, 20 bp, Homo sapiens
cacaggcagccagccgtggc

SEQ ID NO: 5995366 - DNA, 19 bp, Homo sapiens
cacaggcagccagtgccct

SEQ ID NO: 5995367 - DNA, 19 bp, Homo sapiens
cacaggcagctctgagccg

SEQ ID NO: 5995368 - DNA, 13 bp, Homo sapiens
cacaggcagcttt

SEQ ID NO: 5995369 - DNA, 19 bp, Homo sapiens
cacaggcaggaagagagag

SEQ ID NO: 5995370 - DNA, 15 bp, Homo sapiens
cacaggcagggcctg

SEQ ID NO: 5995371 - DNA, 21 bp, Homo sapiens
cacaggcagggcctggctcca

SEQ ID NO: 5995372 - DNA, 22 bp, Homo sapiens
cacaggcagggcctggctccag

SEQ ID NO: 5995373 - DNA, 22 bp, Homo sapiens
cacaggcaggtcacagaaaggc

SEQ ID NO: 5995374 - DNA, 16 bp, Homo sapiens
cacaggcagtgcatgt

SEQ ID NO: 5995375 - DNA, 18 bp, Homo sapiens
cacaggcagtgcatgtga

SEQ ID NO: 5995376 - DNA, 18 bp, Homo sapiens
cacaggcatctacacagc

SEQ ID NO: 5995377 - DNA, 20 bp, Homo sapiens
cacaggcatctacacagcct

SEQ ID NO: 5995378 - DNA, 15 bp, Homo sapiens
cacaggcatttcctg

SEQ ID NO: 5995379 - DNA, 16 bp, Homo sapiens
cacaggcatttcctgg

SEQ ID NO: 5995380 - DNA, 18 bp, Homo sapiens
cacaggcatttcctgggt

SEQ ID NO: 5995381 - DNA, 13 bp, Homo sapiens
cacaggccacacg

SEQ ID NO: 5995382 - DNA, 20 bp, Homo sapiens
cacaggccacacgctgccca

SEQ ID NO: 5995383 - DNA, 15 bp, Homo sapiens
cacaggccaccctgt

SEQ ID NO: 5995384 - DNA, 16 bp, Homo sapiens
cacaggccaccctgtg

SEQ ID NO: 5995385 - DNA, 12 bp, Homo sapiens
cacaggccagcc

SEQ ID NO: 5995386 - DNA, 15 bp, Homo sapiens
cacaggccagcccca

SEQ ID NO: 5995387 - DNA, 16 bp, Homo sapiens
cacaggccagccccat

SEQ ID NO: 5995388 - DNA, 17 bp, Homo sapiens
cacaggccagccccatc

SEQ ID NO: 5995389 - DNA, 18 bp, Homo sapiens
cacaggccagccccatct

SEQ ID NO: 5995390 - DNA, 16 bp, Homo sapiens
cagaggccccagcctc

SEQ ID NO: 5995391 - DNA, 19 bp, Homo sapiens
cagaggcccccagcccagg

SEQ ID NO: 5995392 - DNA, 18 bp, Homo sapiens
cagaggcccccagtgggg

SEQ ID NO: 5995393 - DNA, 20 bp, Homo sapiens
cagaggcccccagtggggac

SEQ ID NO: 5995394 - DNA, 23 bp, Homo sapiens
cagaggcccccagtggggacagg

SEQ ID NO: 5995395 - DNA, 14 bp, Homo sapiens
cagaggccctaggc

SEQ ID NO: 5995396 - DNA, 18 bp, Homo sapiens
cagaggccctaggcggga

SEQ ID NO: 5995397 - DNA, 14 bp, Homo sapiens
cagaggccctgaag

SEQ ID NO: 5995398 - DNA, 17 bp, Homo sapiens
cagaggccctgaagcct

SEQ ID NO: 5995399 - DNA, 13 bp, Homo sapiens
cagaggccctgcc

SEQ ID NO: 5995400 - DNA, 17 bp, Homo sapiens
cagaggccctgccacgt

SEQ ID NO: 5995401 - DNA, 16 bp, Homo sapiens
cagaggccctgccccc

SEQ ID NO: 5995402 - DNA, 12 bp, Homo sapiens
cagaggccctgg

SEQ ID NO: 5995403 - DNA, 17 bp, Homo sapiens
cagaggccctggaggga

SEQ ID NO: 5995404 - DNA, 19 bp, Homo sapiens
cagaggccgaaggtgcctc

SEQ ID NO: 5995405 - DNA, 20 bp, Homo sapiens
cagaggccgaaggtgcctca

SEQ ID NO: 5995406 - DNA, 16 bp, Homo sapiens
cagaggcctataatga

SEQ ID NO: 5995407 - DNA, 23 bp, Homo sapiens
cagaggcctcccccagccaggac

SEQ ID NO: 5995408 - DNA, 13 bp, Homo sapiens
cagaggcctcctg

SEQ ID NO: 5995409 - DNA, 21 bp, Homo sapiens
cagaggcctcctgtggcctgc

SEQ ID NO: 5995410 - DNA, 14 bp, Homo sapiens
cagaggcctgactg

SEQ ID NO: 5995411 - DNA, 14 bp, Homo sapiens
cagaggcctgagga

SEQ ID NO: 5995412 - DNA, 16 bp, Homo sapiens
cagaggcctgcagggc

SEQ ID NO: 5995413 - DNA, 17 bp, Homo sapiens
cagaggcctgcagggcc

SEQ ID NO: 5995414 - DNA, 16 bp, Homo sapiens
cagaggcctgctgcca

SEQ ID NO: 5995415 - DNA, 11 bp, Homo sapiens
cagaggcctgg

SEQ ID NO: 5995416 - DNA, 21 bp, Homo sapiens
cagaggcctggcatcttctgg

SEQ ID NO: 5995417 - DNA, 19 bp, Homo sapiens
cagaggcctgggctgggaa

SEQ ID NO: 5995418 - DNA, 12 bp, Homo sapiens
cagaggcctggt

SEQ ID NO: 5995419 - DNA, 14 bp, Homo sapiens
cagaggcctggtgc

SEQ ID NO: 5995420 - DNA, 12 bp, Homo sapiens
cagaggccttgt

SEQ ID NO: 5995421 - DNA, 18 bp, Homo sapiens
cagaggcgaggggacagc

SEQ ID NO: 5995422 - DNA, 17 bp, Homo sapiens
cagaggcgcactgtgac

SEQ ID NO: 5995423 - DNA, 16 bp, Homo sapiens
cagaggcggaaacctt

SEQ ID NO: 5995424 - DNA, 17 bp, Homo sapiens
cagaggcggaaaccttg

SEQ ID NO: 5995425 - DNA, 23 bp, Homo sapiens
cagaggcggaaaccttgcagcat

SEQ ID NO: 5995426 - DNA, 13 bp, Homo sapiens
cagaggcggctct

SEQ ID NO: 5995427 - DNA, 15 bp, Homo sapiens
cagaggcggctctgg

SEQ ID NO: 5995428 - DNA, 22 bp, Homo sapiens
cagaggcgtactacccagctct

SEQ ID NO: 5995429 - DNA, 17 bp, Homo sapiens
cagaggctaagatgaga

SEQ ID NO: 5995430 - DNA, 16 bp, Homo sapiens
cagaggctactcttga

SEQ ID NO: 5995431 - DNA, 23 bp, Homo sapiens
cagaggctagtctcttctcagag

SEQ ID NO: 5995432 - DNA, 20 bp, Homo sapiens
cagaggctattattttcact

SEQ ID NO: 5995433 - DNA, 21 bp, Homo sapiens
cagaggctcctctcaggctgg

SEQ ID NO: 5995434 - DNA, 15 bp, Homo sapiens
cagaggctcctggag

SEQ ID NO: 5995435 - DNA, 21 bp, Homo sapiens
cagaggctcgaggggctcagg

SEQ ID NO: 5995436 - DNA, 16 bp, Homo sapiens
cagaggctgagcagga

SEQ ID NO: 5995437 - DNA, 13 bp, Homo sapiens
cagaggctgagcc

SEQ ID NO: 5995438 - DNA, 20 bp, Homo sapiens
cagaggctgagccctgtacc

SEQ ID NO: 5995439 - DNA, 15 bp, Homo sapiens
cagaggctgcaggac

SEQ ID NO: 5995440 - DNA, 13 bp, Homo sapiens
cagaggctgcctc

SEQ ID NO: 5995441 - DNA, 23 bp, Homo sapiens
cagaggctgcctctcccatcact

SEQ ID NO: 5995442 - DNA, 17 bp, Homo sapiens
cagaggctggaggcagg

SEQ ID NO: 5995443 - DNA, 19 bp, Homo sapiens
cagaggctggaggcagggc

SEQ ID NO: 5995444 - DNA, 20 bp, Homo sapiens
cagaggctggaggcagggcc

SEQ ID NO: 5995445 - DNA, 15 bp, Homo sapiens
cagaggctggcactg

SEQ ID NO: 5995446 - DNA, 14 bp, Homo sapiens
cagaggctgggagc

SEQ ID NO: 5995447 - DNA, 21 bp, Homo sapiens
cagaggctgggagcatagcag

SEQ ID NO: 5995448 - DNA, 22 bp, Homo sapiens
cagaggctgggagcatagcaga

SEQ ID NO: 5995449 - DNA, 13 bp, Homo sapiens
cagaggctgggtt

SEQ ID NO: 5995450 - DNA, 12 bp, Homo sapiens
cagaggctgtgg

SEQ ID NO: 5995451 - DNA, 16 bp, Homo sapiens
cagaggcttttccagt

SEQ ID NO: 5995452 - DNA, 18 bp, Homo sapiens
cagaggcttttccagtgt

SEQ ID NO: 5995453 - DNA, 19 bp, Homo sapiens
cagagggaaactcagatgt

SEQ ID NO: 5995454 - DNA, 18 bp, Homo sapiens
cagagggaaggggcctac

SEQ ID NO: 5995455 - DNA, 20 bp, Homo sapiens
cagagggaaggggcctacac

SEQ ID NO: 5995456 - DNA, 21 bp, Homo sapiens
cagagggaagtttaaaaccca

SEQ ID NO: 5995457 - DNA, 17 bp, Homo sapiens
cagagggaatgttccct

SEQ ID NO: 5995458 - DNA, 20 bp, Homo sapiens
cagagggacaaccagaaggc

SEQ ID NO: 5995459 - DNA, 19 bp, Homo sapiens
cagagggacagtgggctat

SEQ ID NO: 5995460 - DNA, 14 bp, Homo sapiens
cagagggaccagct

SEQ ID NO: 5995461 - DNA, 15 bp, Homo sapiens
cagagggaccagctg

SEQ ID NO: 5995462 - DNA, 14 bp, Homo sapiens
cagagggactggac

SEQ ID NO: 5995463 - DNA, 16 bp, Homo sapiens
cagagggactggacag

SEQ ID NO: 5995464 - DNA, 21 bp, Homo sapiens
cagagggactggacagccagg

SEQ ID NO: 5995465 - DNA, 21 bp, Homo sapiens
cagagggactgtcagctgagc

SEQ ID NO: 5995466 - DNA, 22 bp, Homo sapiens
cagagggactgtcagctgagct

SEQ ID NO: 5995467 - DNA, 17 bp, Homo sapiens
cagagggacttgagcca

SEQ ID NO: 5995468 - DNA, 15 bp, Homo sapiens
cagagggagaatcca

SEQ ID NO: 5995469 - DNA, 22 bp, Homo sapiens
cagagggagacagggctgctcc

SEQ ID NO: 5995470 - DNA, 20 bp, Homo sapiens
cagagggagacggccctgct

SEQ ID NO: 5995471 - DNA, 15 bp, Homo sapiens
cagagggaggacctg

SEQ ID NO: 5995472 - DNA, 21 bp, Homo sapiens
cagagggaggagtttttctta

SEQ ID NO: 5995473 - DNA, 18 bp, Homo sapiens
cagagggagtgacagagg

SEQ ID NO: 5995474 - DNA, 19 bp, Homo sapiens
cagagggagtgacagaggc

SEQ ID NO: 5995475 - DNA, 22 bp, Homo sapiens
cagagggagtgacagaggcagc

SEQ ID NO: 5995476 - DNA, 16 bp, Homo sapiens
cagagggataacccaa

SEQ ID NO: 5995477 - DNA, 18 bp, Homo sapiens
cagagggataacccaaac

SEQ ID NO: 5995478 - DNA, 19 bp, Homo sapiens
cagagggatgaaatgccaa

SEQ ID NO: 5995479 - DNA, 18 bp, Homo sapiens
cagagggatgggagagtc

SEQ ID NO: 5995480 - DNA, 17 bp, Homo sapiens
cagagggcacatgaaca

SEQ ID NO: 5995481 - DNA, 20 bp, Homo sapiens
cagagggcacatgaacagct

SEQ ID NO: 5995482 - DNA, 14 bp, Homo sapiens
cagagggcactctg

SEQ ID NO: 5995483 - DNA, 15 bp, Homo sapiens
cagagggcagtggcc

SEQ ID NO: 5995484 - DNA, 14 bp, Homo sapiens
cagagggcatgctg

SEQ ID NO: 5995485 - DNA, 16 bp, Homo sapiens
cagagggccaagagag

SEQ ID NO: 5995486 - DNA, 17 bp, Homo sapiens
cagagggccaagagaga

SEQ ID NO: 5995487 - DNA, 12 bp, Homo sapiens
cagagggccaga

SEQ ID NO: 5995488 - DNA, 13 bp, Homo sapiens
cagagggcccagg

SEQ ID NO: 5995489 - DNA, 15 bp, Homo sapiens
cagagggcccaggca

SEQ ID NO: 5995490 - DNA, 16 bp, Homo sapiens
cagagggcccaggcag

SEQ ID NO: 5995491 - DNA, 21 bp, Homo sapiens
cagagggcccctcactggctg

SEQ ID NO: 5995492 - DNA, 15 bp, Homo sapiens
cagagggcgctcctg

SEQ ID NO: 5995493 - DNA, 13 bp, Homo sapiens
cagagggctaggg

SEQ ID NO: 5995494 - DNA, 14 bp, Homo sapiens
cagagggctggagg

SEQ ID NO: 5995495 - DNA, 15 bp, Homo sapiens
cagagggctggaggc

SEQ ID NO: 5995496 - DNA, 13 bp, Homo sapiens
cagagggctttca

SEQ ID NO: 5995497 - DNA, 14 bp, Homo sapiens
cagagggctttcag

SEQ ID NO: 5995498 - DNA, 16 bp, Homo sapiens
cagaggggacgctgag

SEQ ID NO: 5995499 - DNA, 14 bp, Homo sapiens
cagaggggagagga

SEQ ID NO: 5995500 - DNA, 17 bp, Homo sapiens
cagaggggagaggaagc

SEQ ID NO: 5995501 - DNA, 18 bp, Homo sapiens
cagaggggagaggaagca

SEQ ID NO: 5995502 - DNA, 18 bp, Homo sapiens
cagaggggagcagcggct

SEQ ID NO: 5995503 - DNA, 22 bp, Homo sapiens
cagaggggagcagcggctctgg

SEQ ID NO: 5995504 - DNA, 16 bp, Homo sapiens
cagaggggcagaggcc

SEQ ID NO: 5995505 - DNA, 18 bp, Homo sapiens
cagaggggcagccgctag

SEQ ID NO: 5995506 - DNA, 16 bp, Homo sapiens
cagaggggcaggccct

SEQ ID NO: 5995507 - DNA, 20 bp, Homo sapiens
cagaggggcaggccctgcac

SEQ ID NO: 5995508 - DNA, 22 bp, Homo sapiens
cagaggggcaggccctgcactg

SEQ ID NO: 5995509 - DNA, 17 bp, Homo sapiens
cagaggggcaggggagt

SEQ ID NO: 5995510 - DNA, 18 bp, Homo sapiens
cagaggggcaggggagtg

SEQ ID NO: 5995511 - DNA, 14 bp, Homo sapiens
cagaggggccagct

SEQ ID NO: 5995512 - DNA, 16 bp, Homo sapiens
cagaggggccaggccc

SEQ ID NO: 5995513 - DNA, 17 bp, Homo sapiens
cagaggggccaggccca

SEQ ID NO: 5995514 - DNA, 21 bp, Homo sapiens
cagaggggccaggcccaggca

SEQ ID NO: 5995515 - DNA, 23 bp, Homo sapiens
cagaggggccccggtcctggccc

SEQ ID NO: 5995516 - DNA, 17 bp, Homo sapiens
cagaggggcctcatctt

SEQ ID NO: 5995517 - DNA, 17 bp, Homo sapiens
cagaggggcctgccacc

SEQ ID NO: 5995518 - DNA, 20 bp, Homo sapiens
cagaggggcctgccacctgg

SEQ ID NO: 5995519 - DNA, 18 bp, Homo sapiens
cagaggggcggggccagg

SEQ ID NO: 5995520 - DNA, 19 bp, Homo sapiens
cagaggggctttctggaga

SEQ ID NO: 5995521 - DNA, 17 bp, Homo sapiens
cagagggggactgctgc

SEQ ID NO: 5995522 - DNA, 15 bp, Homo sapiens
cagagggggccagag

SEQ ID NO: 5995523 - DNA, 19 bp, Homo sapiens
cagagggggccagagggac

SEQ ID NO: 5995524 - DNA, 17 bp, Homo sapiens
cagagggggtggcctcc

SEQ ID NO: 5995525 - DNA, 19 bp, Homo sapiens
cagagggggtggcctccca

SEQ ID NO: 5995526 - DNA, 22 bp, Homo sapiens
cagagggggtggcctcccaact

SEQ ID NO: 5995527 - DNA, 19 bp, Homo sapiens
cagaggggtaagagaggat

SEQ ID NO: 5995528 - DNA, 23 bp, Homo sapiens
cagaggggtgggttcctcttccc

SEQ ID NO: 5995529 - DNA, 20 bp, Homo sapiens
cagagggtagggcagcagat

SEQ ID NO: 5995530 - DNA, 13 bp, Homo sapiens
cagagggtcacag

SEQ ID NO: 5995531 - DNA, 21 bp, Homo sapiens
cagagggtcccattgtgcaga

SEQ ID NO: 5995532 - DNA, 16 bp, Homo sapiens
cagagggtccctaggt

SEQ ID NO: 5995533 - DNA, 14 bp, Homo sapiens
cagagggtggagat

SEQ ID NO: 5995534 - DNA, 17 bp, Homo sapiens
cagagggtgggaggggc

SEQ ID NO: 5995535 - DNA, 17 bp, Homo sapiens
cagagggtgtcgtcctg

SEQ ID NO: 5995536 - DNA, 21 bp, Homo sapiens
cagagggtgtcgtcctgcagt

SEQ ID NO: 5995537 - DNA, 16 bp, Homo sapiens
cagagggttaggagtg

SEQ ID NO: 5995538 - DNA, 18 bp, Homo sapiens
cagagggttgctggtcct

SEQ ID NO: 5995539 - DNA, 22 bp, Homo sapiens
cagagggttgtactattgttta

SEQ ID NO: 5995540 - DNA, 17 bp, Homo sapiens
cagagggtttgtgccca

SEQ ID NO: 5995541 - DNA, 17 bp, Homo sapiens
cagaggtaaaaaaaaga

SEQ ID NO: 5995542 - DNA, 18 bp, Homo sapiens
cagaggtaaaaaaaagaa

SEQ ID NO: 5995543 - DNA, 19 bp, Homo sapiens
cagaggtaaaaaaaagaag

SEQ ID NO: 5995544 - DNA, 21 bp, Homo sapiens
cagaggtaaaagtgtgagcag

SEQ ID NO: 5995545 - DNA, 18 bp, Homo sapiens
cagaggtaacagaacagc

SEQ ID NO: 5995546 - DNA, 20 bp, Homo sapiens
cagaggtaacagaacagctt

SEQ ID NO: 5995547 - DNA, 22 bp, Homo sapiens
cagaggtaacagaacagcttca

SEQ ID NO: 5995548 - DNA, 23 bp, Homo sapiens
cagaggtaacagaacagcttcag

SEQ ID NO: 5995549 - DNA, 15 bp, Homo sapiens
cagaggtaccctggg

SEQ ID NO: 5995550 - DNA, 17 bp, Homo sapiens
cagaggtaccctgggtg

SEQ ID NO: 5995551 - DNA, 22 bp, Homo sapiens
cagaggtattaaaactaaattt

SEQ ID NO: 5995552 - DNA, 21 bp, Homo sapiens
cagaggtcatcccttcctcct

SEQ ID NO: 5995553 - DNA, 21 bp, Homo sapiens
cagaggtccaggtcccagccc

SEQ ID NO: 5995554 - DNA, 16 bp, Homo sapiens
cagaggtcccagcccc

SEQ ID NO: 5995555 - DNA, 17 bp, Homo sapiens
cagaggtcccagcccca

SEQ ID NO: 5995556 - DNA, 22 bp, Homo sapiens
cagaggtcccagccccaggcct

SEQ ID NO: 5995557 - DNA, 14 bp, Homo sapiens
cagaggtcccctga

SEQ ID NO: 5995558 - DNA, 14 bp, Homo sapiens
cagaggtcgcagct

SEQ ID NO: 5995559 - DNA, 16 bp, Homo sapiens
cagaggtcgcagctac

SEQ ID NO: 5995560 - DNA, 17 bp, Homo sapiens
cagaggtcgcagctacc

SEQ ID NO: 5995561 - DNA, 19 bp, Homo sapiens
cagaggtctcatctcccag

SEQ ID NO: 5995562 - DNA, 14 bp, Homo sapiens
cagaggtctcccta

SEQ ID NO: 5995563 - DNA, 19 bp, Homo sapiens
cagaggtcttcagggctct

SEQ ID NO: 5995564 - DNA, 21 bp, Homo sapiens
cagaggtgagaactcagaaga

SEQ ID NO: 5995565 - DNA, 22 bp, Homo sapiens
cagaggtgagaactcagaagag

SEQ ID NO: 5995566 - DNA, 14 bp, Homo sapiens
cagaggtgagcaga

SEQ ID NO: 5995567 - DNA, 15 bp, Homo sapiens
cagaggtgagcagag

SEQ ID NO: 5995568 - DNA, 23 bp, Homo sapiens
cacaggccagccccatcttggtc

SEQ ID NO: 5995569 - DNA, 21 bp, Homo sapiens
cacaggccattatgcctggct

SEQ ID NO: 5995570 - DNA, 14 bp, Homo sapiens
cacaggcccagaag

SEQ ID NO: 5995571 - DNA, 17 bp, Homo sapiens
cacaggcccaggaaggc

SEQ ID NO: 5995572 - DNA, 17 bp, Homo sapiens
cacaggccccccgcagc

SEQ ID NO: 5995573 - DNA, 19 bp, Homo sapiens
cacaggccccccgcagcac

SEQ ID NO: 5995574 - DNA, 22 bp, Homo sapiens
cacaggcccccttgagtggggt

SEQ ID NO: 5995575 - DNA, 17 bp, Homo sapiens
cacaggcccggctccag

SEQ ID NO: 5995576 - DNA, 18 bp, Homo sapiens
cacaggcccggctccagg

SEQ ID NO: 5995577 - DNA, 17 bp, Homo sapiens
cacaggccctggagaag

SEQ ID NO: 5995578 - DNA, 13 bp, Homo sapiens
cacaggccctggg

SEQ ID NO: 5995579 - DNA, 17 bp, Homo sapiens
cacaggccctggggagc

SEQ ID NO: 5995580 - DNA, 19 bp, Homo sapiens
cacaggcccttcctctcca

SEQ ID NO: 5995581 - DNA, 23 bp, Homo sapiens
cacaggcccttcctctccactgc

SEQ ID NO: 5995582 - DNA, 15 bp, Homo sapiens
cacaggcccttgggg

SEQ ID NO: 5995583 - DNA, 16 bp, Homo sapiens
cacaggcccttggggt

SEQ ID NO: 5995584 - DNA, 17 bp, Homo sapiens
cacaggcccttggggtt

SEQ ID NO: 5995585 - DNA, 23 bp, Homo sapiens
cacaggccctttcctcaggcaag

SEQ ID NO: 5995586 - DNA, 22 bp, Homo sapiens
cacaggccgtgggacccaggct

SEQ ID NO: 5995587 - DNA, 11 bp, Homo sapiens
cacaggcctcc

SEQ ID NO: 5995588 - DNA, 14 bp, Homo sapiens
cacaggcctccctg

SEQ ID NO: 5995589 - DNA, 15 bp, Homo sapiens
cacaggcctccctgt

SEQ ID NO: 5995590 - DNA, 16 bp, Homo sapiens
cacaggcctccctgtt

SEQ ID NO: 5995591 - DNA, 13 bp, Homo sapiens
cacaggcctctct

SEQ ID NO: 5995592 - DNA, 23 bp, Homo sapiens
cacaggcctctcttttccccgcc

SEQ ID NO: 5995593 - DNA, 14 bp, Homo sapiens
cacaggcctctgcc

SEQ ID NO: 5995594 - DNA, 19 bp, Homo sapiens
cacaggcctctgcctgctg

SEQ ID NO: 5995595 - DNA, 23 bp, Homo sapiens
cacaggcctctgcctgctgggga

SEQ ID NO: 5995596 - DNA, 13 bp, Homo sapiens
cacaggcctgaga

SEQ ID NO: 5995597 - DNA, 15 bp, Homo sapiens
cacaggcctgagatt

SEQ ID NO: 5995598 - DNA, 19 bp, Homo sapiens
cacaggcctgagatttcat

SEQ ID NO: 5995599 - DNA, 22 bp, Homo sapiens
cacaggcctgagatttcatctg

SEQ ID NO: 5995600 - DNA, 16 bp, Homo sapiens
cacaggcctggcccag

SEQ ID NO: 5995601 - DNA, 18 bp, Homo sapiens
cacaggcctgtgtagctg

SEQ ID NO: 5995602 - DNA, 14 bp, Homo sapiens
cacaggccttctgt

SEQ ID NO: 5995603 - DNA, 19 bp, Homo sapiens
cacaggccttctgtggggc

SEQ ID NO: 5995604 - DNA, 14 bp, Homo sapiens
cacaggctagatcc

SEQ ID NO: 5995605 - DNA, 22 bp, Homo sapiens
cacaggctatcaacatgttatt

SEQ ID NO: 5995606 - DNA, 14 bp, Homo sapiens
cacaggctcagcat

SEQ ID NO: 5995607 - DNA, 14 bp, Homo sapiens
cacaggctcaggca

SEQ ID NO: 5995608 - DNA, 19 bp, Homo sapiens
cacaggctccaaactggag

SEQ ID NO: 5995609 - DNA, 14 bp, Homo sapiens
cacaggctgagtgc

SEQ ID NO: 5995610 - DNA, 18 bp, Homo sapiens
cacaggctgagtgcaggc

SEQ ID NO: 5995611 - DNA, 20 bp, Homo sapiens
cacaggctgagtgcaggccc

SEQ ID NO: 5995612 - DNA, 14 bp, Homo sapiens
cacaggctgcccca

SEQ ID NO: 5995613 - DNA, 12 bp, Homo sapiens
cacaggctgggt

SEQ ID NO: 5995614 - DNA, 17 bp, Homo sapiens
cacaggctgtgccttgg

SEQ ID NO: 5995615 - DNA, 19 bp, Homo sapiens
cacaggcttagggacagga

SEQ ID NO: 5995616 - DNA, 22 bp, Homo sapiens
cacaggcttagggacaggaccc

SEQ ID NO: 5995617 - DNA, 14 bp, Homo sapiens
cacaggcttgctgt

SEQ ID NO: 5995618 - DNA, 20 bp, Homo sapiens
cacagggaaaattgccccat

SEQ ID NO: 5995619 - DNA, 17 bp, Homo sapiens
cacagggaaatgtgtat

SEQ ID NO: 5995620 - DNA, 19 bp, Homo sapiens
cacagggaagagctcccct

SEQ ID NO: 5995621 - DNA, 22 bp, Homo sapiens
cacagggaagctcacacatcct

SEQ ID NO: 5995622 - DNA, 17 bp, Homo sapiens
cacagggaagggcttgg

SEQ ID NO: 5995623 - DNA, 18 bp, Homo sapiens
cacagggaagggcttggc

SEQ ID NO: 5995624 - DNA, 13 bp, Homo sapiens
cacagggaagtgg

SEQ ID NO: 5995625 - DNA, 14 bp, Homo sapiens
cacagggaatggcc

SEQ ID NO: 5995626 - DNA, 16 bp, Homo sapiens
cacagggacagatctg

SEQ ID NO: 5995627 - DNA, 12 bp, Homo sapiens
cacagggaccac

SEQ ID NO: 5995628 - DNA, 13 bp, Homo sapiens
cacagggaccaca

SEQ ID NO: 5995629 - DNA, 12 bp, Homo sapiens
cacagggaccag

SEQ ID NO: 5995630 - DNA, 16 bp, Homo sapiens
cacagggaccagggcc

SEQ ID NO: 5995631 - DNA, 11 bp, Homo sapiens
cacagggactg

SEQ ID NO: 5995632 - DNA, 14 bp, Homo sapiens
cacagggacttgaa

SEQ ID NO: 5995633 - DNA, 17 bp, Homo sapiens
cacagggacttgaagtt

SEQ ID NO: 5995634 - DNA, 19 bp, Homo sapiens
cacagggagccacacagag

SEQ ID NO: 5995635 - DNA, 14 bp, Homo sapiens
cacagggatgctgg

SEQ ID NO: 5995636 - DNA, 23 bp, Homo sapiens
cacagggatgctggtggctggtg

SEQ ID NO: 5995637 - DNA, 13 bp, Homo sapiens
cacagggcaccag

SEQ ID NO: 5995638 - DNA, 17 bp, Homo sapiens
cacagggcaccagaggc

SEQ ID NO: 5995639 - DNA, 19 bp, Homo sapiens
cacagggcactgactgata

SEQ ID NO: 5995640 - DNA, 18 bp, Homo sapiens
cacagggcagctgggccc

SEQ ID NO: 5995641 - DNA, 13 bp, Homo sapiens
cacagggcaggcc

SEQ ID NO: 5995642 - DNA, 14 bp, Homo sapiens
cacagggcaggcct

SEQ ID NO: 5995643 - DNA, 23 bp, Homo sapiens
cacagggcaggccttgctggggt

SEQ ID NO: 5995644 - DNA, 21 bp, Homo sapiens
cacagggcagtacctgagggt

SEQ ID NO: 5995645 - DNA, 17 bp, Homo sapiens
cacagggcatgcctggc

SEQ ID NO: 5995646 - DNA, 20 bp, Homo sapiens
cacagggcatgcctggcctg

SEQ ID NO: 5995647 - DNA, 18 bp, Homo sapiens
cacagggccagagggagc

SEQ ID NO: 5995648 - DNA, 13 bp, Homo sapiens
cacagggccctct

SEQ ID NO: 5995649 - DNA, 14 bp, Homo sapiens
cacagggccctctg

SEQ ID NO: 5995650 - DNA, 13 bp, Homo sapiens
cacagggcctcag

SEQ ID NO: 5995651 - DNA, 14 bp, Homo sapiens
cacagggcctcagt

SEQ ID NO: 5995652 - DNA, 15 bp, Homo sapiens
cacagggcctgactt

SEQ ID NO: 5995653 - DNA, 21 bp, Homo sapiens
cacagggcctgacttttacag

SEQ ID NO: 5995654 - DNA, 20 bp, Homo sapiens
cacagggcctgctattgcag

SEQ ID NO: 5995655 - DNA, 16 bp, Homo sapiens
cacagggcctggccca

SEQ ID NO: 5995656 - DNA, 21 bp, Homo sapiens
cacagggcctttggcaggtgc

SEQ ID NO: 5995657 - DNA, 13 bp, Homo sapiens
cacagggcgagac

SEQ ID NO: 5995658 - DNA, 12 bp, Homo sapiens
cacagggctcac

SEQ ID NO: 5995659 - DNA, 17 bp, Homo sapiens
cacagggctcacagggc

SEQ ID NO: 5995660 - DNA, 13 bp, Homo sapiens
cacagggctcttt

SEQ ID NO: 5995661 - DNA, 23 bp, Homo sapiens
cacagggcttggtggtggtagca

SEQ ID NO: 5995662 - DNA, 17 bp, Homo sapiens
cacaggggaaaagagga

SEQ ID NO: 5995663 - DNA, 18 bp, Homo sapiens
cacaggggaaaagaggag

SEQ ID NO: 5995664 - DNA, 17 bp, Homo sapiens
cacaggggaggtgatag

SEQ ID NO: 5995665 - DNA, 13 bp, Homo sapiens
cacaggggcaggc

SEQ ID NO: 5995666 - DNA, 14 bp, Homo sapiens
cacaggggcaggcc

SEQ ID NO: 5995667 - DNA, 16 bp, Homo sapiens
cacaggggcaggcctg

SEQ ID NO: 5995668 - DNA, 20 bp, Homo sapiens
cacaggggcaggcctgggac

SEQ ID NO: 5995669 - DNA, 13 bp, Homo sapiens
cacaggggccctg

SEQ ID NO: 5995670 - DNA, 14 bp, Homo sapiens
cacaggggcggggc

SEQ ID NO: 5995671 - DNA, 23 bp, Homo sapiens
cacaggggctatcccttctcaga

SEQ ID NO: 5995672 - DNA, 23 bp, Homo sapiens
cacagggggattctgagcagtgc

SEQ ID NO: 5995673 - DNA, 15 bp, Homo sapiens
cacagggtcccacag

SEQ ID NO: 5995674 - DNA, 18 bp, Homo sapiens
cacagggtcccacagcca

SEQ ID NO: 5995675 - DNA, 22 bp, Homo sapiens
cacagggtccccgagtgcctag

SEQ ID NO: 5995676 - DNA, 14 bp, Homo sapiens
cacagggtctgcct

SEQ ID NO: 5995677 - DNA, 20 bp, Homo sapiens
cacagggtctgcctccagcc

SEQ ID NO: 5995678 - DNA, 15 bp, Homo sapiens
cacagggtctgctct

SEQ ID NO: 5995679 - DNA, 19 bp, Homo sapiens
cacagggtctgctctttct

SEQ ID NO: 5995680 - DNA, 22 bp, Homo sapiens
cacagggtgggatgagcctctc

SEQ ID NO: 5995681 - DNA, 23 bp, Homo sapiens
cacagggtgggatgagcctctcc

SEQ ID NO: 5995682 - DNA, 17 bp, Homo sapiens
cacagggtgtggtatga

SEQ ID NO: 5995683 - DNA, 14 bp, Homo sapiens
cacagggttgggcc

SEQ ID NO: 5995684 - DNA, 18 bp, Homo sapiens
cacagggttgggcccaga

SEQ ID NO: 5995685 - DNA, 22 bp, Homo sapiens
cacagggttgggcccagatctg

SEQ ID NO: 5995686 - DNA, 19 bp, Homo sapiens
cacagggtttggcccaagt

SEQ ID NO: 5995687 - DNA, 15 bp, Homo sapiens
cacagggttttgtat

SEQ ID NO: 5995688 - DNA, 19 bp, Homo sapiens
cacaggtacagcaacagga

SEQ ID NO: 5995689 - DNA, 21 bp, Homo sapiens
cacaggtacagcaacaggaat

SEQ ID NO: 5995690 - DNA, 15 bp, Homo sapiens
cacaggtagcctatt

SEQ ID NO: 5995691 - DNA, 18 bp, Homo sapiens
cacaggtcaataaactta

SEQ ID NO: 5995692 - DNA, 14 bp, Homo sapiens
cacaggtcagggct

SEQ ID NO: 5995693 - DNA, 15 bp, Homo sapiens
cacaggtcagggctc

SEQ ID NO: 5995694 - DNA, 16 bp, Homo sapiens
cacaggtcagggctca

SEQ ID NO: 5995695 - DNA, 19 bp, Homo sapiens
cacaggtcaggggtgacac

SEQ ID NO: 5995696 - DNA, 23 bp, Homo sapiens
cacaggtcaggggtgacacagac

SEQ ID NO: 5995697 - DNA, 15 bp, Homo sapiens
cacaggtcccacctc

SEQ ID NO: 5995698 - DNA, 19 bp, Homo sapiens
cacaggtcccacctccagc

SEQ ID NO: 5995699 - DNA, 14 bp, Homo sapiens
cacaggtcctccat

SEQ ID NO: 5995700 - DNA, 18 bp, Homo sapiens
cacaggtcgggcgcagga

SEQ ID NO: 5995701 - DNA, 14 bp, Homo sapiens
cacaggtctctgtt

SEQ ID NO: 5995702 - DNA, 18 bp, Homo sapiens
cacaggtctctgtttagt

SEQ ID NO: 5995703 - DNA, 20 bp, Homo sapiens
cacaggtcttcactgcccag

SEQ ID NO: 5995704 - DNA, 15 bp, Homo sapiens
cacaggtcttgccca

SEQ ID NO: 5995705 - DNA, 13 bp, Homo sapiens
cacaggtgaaagt

SEQ ID NO: 5995706 - DNA, 14 bp, Homo sapiens
cacaggtgagaaag

SEQ ID NO: 5995707 - DNA, 16 bp, Homo sapiens
cacaggtgaggggcag

SEQ ID NO: 5995708 - DNA, 19 bp, Homo sapiens
cacaggtgaggggcaggac

SEQ ID NO: 5995709 - DNA, 19 bp, Homo sapiens
cacaggtgcaacagacttg

SEQ ID NO: 5995710 - DNA, 21 bp, Homo sapiens
cacaggtgccgccagctgccg

SEQ ID NO: 5995711 - DNA, 13 bp, Homo sapiens
cacaggtggccat

SEQ ID NO: 5995712 - DNA, 13 bp, Homo sapiens
cacaggtggggac

SEQ ID NO: 5995713 - DNA, 20 bp, Homo sapiens
cacaggtggggactgggcac

SEQ ID NO: 5995714 - DNA, 13 bp, Homo sapiens
cacaggtggtaca

SEQ ID NO: 5995715 - DNA, 18 bp, Homo sapiens
cacaggtggtgtcactgt

SEQ ID NO: 5995716 - DNA, 20 bp, Homo sapiens
cacaggtggtgtcactgtcc

SEQ ID NO: 5995717 - DNA, 21 bp, Homo sapiens
cacaggtggtgtcactgtccc

SEQ ID NO: 5995718 - DNA, 14 bp, Homo sapiens
cacaggtgtaaata

SEQ ID NO: 5995719 - DNA, 13 bp, Homo sapiens
cacaggtgtcagc

SEQ ID NO: 5995720 - DNA, 15 bp, Homo sapiens
cacaggtgtctgcct

SEQ ID NO: 5995721 - DNA, 16 bp, Homo sapiens
cacaggtgtctgccta

SEQ ID NO: 5995722 - DNA, 14 bp, Homo sapiens
cacaggtgtgagcc

SEQ ID NO: 5995723 - DNA, 19 bp, Homo sapiens
cacaggtgtgggatggaga

SEQ ID NO: 5995724 - DNA, 18 bp, Homo sapiens
cacaggtgttggaagcca

SEQ ID NO: 5995725 - DNA, 16 bp, Homo sapiens
cacaggttggaagaga

SEQ ID NO: 5995726 - DNA, 20 bp, Homo sapiens
cacaggttggaagagaatca

SEQ ID NO: 5995727 - DNA, 17 bp, Homo sapiens
cacaggtttgtttcttg

SEQ ID NO: 5995728 - DNA, 22 bp, Homo sapiens
cacaggttttaaggattctgca

SEQ ID NO: 5995729 - DNA, 15 bp, Homo sapiens
cacaggttttagcat

SEQ ID NO: 5995730 - DNA, 23 bp, Homo sapiens
cacaggttttagcattgtcttgt

SEQ ID NO: 5995731 - DNA, 13 bp, Homo sapiens
cacaggttttatg

SEQ ID NO: 5995732 - DNA, 17 bp, Homo sapiens
cacaggttttatgtgtt

SEQ ID NO: 5995733 - DNA, 20 bp, Homo sapiens
cacaggttttttcaatttat

SEQ ID NO: 5995734 - DNA, 20 bp, Homo sapiens
cacagtaaaaacttgtacta

SEQ ID NO: 5995735 - DNA, 21 bp, Homo sapiens
cacagtaaaaatggaaactat

SEQ ID NO: 5995736 - DNA, 13 bp, Homo sapiens
cacagtaaatatc

SEQ ID NO: 5995737 - DNA, 15 bp, Homo sapiens
cacagtaagcatgct

SEQ ID NO: 5995738 - DNA, 19 bp, Homo sapiens
cacagtaatgcaagcaaag

SEQ ID NO: 5995739 - DNA, 20 bp, Homo sapiens
cacagtacaataatgtactc

SEQ ID NO: 5995740 - DNA, 15 bp, Homo sapiens
cacagtacacacaaa

SEQ ID NO: 5995741 - DNA, 18 bp, Homo sapiens
cacagtacagcatgtgcc

SEQ ID NO: 5995742 - DNA, 19 bp, Homo sapiens
cacagtacagcatgtgcct

SEQ ID NO: 5995743 - DNA, 20 bp, Homo sapiens
cacagtacagcatgtgcctt

SEQ ID NO: 5995744 - DNA, 23 bp, Homo sapiens
cacagtacataatacacttgccc

SEQ ID NO: 5995745 - DNA, 15 bp, Homo sapiens
cacagtacatatgta

SEQ ID NO: 5995746 - DNA, 16 bp, Homo sapiens
cacagtacctaagact

SEQ ID NO: 5995747 - DNA, 14 bp, Homo sapiens
cacagtactcactt

SEQ ID NO: 5995748 - DNA, 17 bp, Homo sapiens
cagaggtgagcagagga

SEQ ID NO: 5995749 - DNA, 22 bp, Homo sapiens
cagaggtgattcttacatatga

SEQ ID NO: 5995750 - DNA, 16 bp, Homo sapiens
cagaggtggatactgg

SEQ ID NO: 5995751 - DNA, 18 bp, Homo sapiens
cagaggtggatgttatga

SEQ ID NO: 5995752 - DNA, 13 bp, Homo sapiens
cagaggtggccct

SEQ ID NO: 5995753 - DNA, 17 bp, Homo sapiens
cagaggtggccctccca

SEQ ID NO: 5995754 - DNA, 15 bp, Homo sapiens
cagaggtggcccttg

SEQ ID NO: 5995755 - DNA, 20 bp, Homo sapiens
cagaggtggctctggaatga

SEQ ID NO: 5995756 - DNA, 20 bp, Homo sapiens
cagaggtgggaggcccctgg

SEQ ID NO: 5995757 - DNA, 22 bp, Homo sapiens
cagaggtgggaggcccctggtg

SEQ ID NO: 5995758 - DNA, 20 bp, Homo sapiens
cagaggtgggatcctccctc

SEQ ID NO: 5995759 - DNA, 13 bp, Homo sapiens
cagaggtgggcag

SEQ ID NO: 5995760 - DNA, 14 bp, Homo sapiens
cagaggtgggcagg

SEQ ID NO: 5995761 - DNA, 21 bp, Homo sapiens
cagaggtggggaagagagcct

SEQ ID NO: 5995762 - DNA, 17 bp, Homo sapiens
cagaggtggggtgctgg

SEQ ID NO: 5995763 - DNA, 22 bp, Homo sapiens
cagaggtggggtgctggggctg

SEQ ID NO: 5995764 - DNA, 12 bp, Homo sapiens
cagaggtggtgg

SEQ ID NO: 5995765 - DNA, 14 bp, Homo sapiens
cagaggtgtacact

SEQ ID NO: 5995766 - DNA, 22 bp, Homo sapiens
cagaggtgtacactaacatttc

SEQ ID NO: 5995767 - DNA, 23 bp, Homo sapiens
cagaggttatctgcctggcctgg

SEQ ID NO: 5995768 - DNA, 18 bp, Homo sapiens
cagaggttgcagtgagct

SEQ ID NO: 5995769 - DNA, 17 bp, Homo sapiens
cagaggttgcagtgagt

SEQ ID NO: 5995770 - DNA, 18 bp, Homo sapiens
cagaggttgtagtgagcc

SEQ ID NO: 5995771 - DNA, 15 bp, Homo sapiens
cagaggtttcatttt

SEQ ID NO: 5995772 - DNA, 16 bp, Homo sapiens
cagaggtttctagggt

SEQ ID NO: 5995773 - DNA, 16 bp, Homo sapiens
cagaggtttgaaggag

SEQ ID NO: 5995774 - DNA, 17 bp, Homo sapiens
cagaggtttgctgacag

SEQ ID NO: 5995775 - DNA, 18 bp, Homo sapiens
cagaggtttgctgacagg

SEQ ID NO: 5995776 - DNA, 21 bp, Homo sapiens
cagagtaaaattacagaagaa

SEQ ID NO: 5995777 - DNA, 14 bp, Homo sapiens
cagagtaacaaaaa

SEQ ID NO: 5995778 - DNA, 13 bp, Homo sapiens
cagagtaagacat

SEQ ID NO: 5995779 - DNA, 14 bp, Homo sapiens
cagagtaagacatt

SEQ ID NO: 5995780 - DNA, 18 bp, Homo sapiens
cagagtacgtcctgcctg

SEQ ID NO: 5995781 - DNA, 21 bp, Homo sapiens
cagagtacgtcctgcctggca

SEQ ID NO: 5995782 - DNA, 22 bp, Homo sapiens
cagagtagccatgaggaggcag

SEQ ID NO: 5995783 - DNA, 22 bp, Homo sapiens
cagagtagctgcttcctggacg

SEQ ID NO: 5995784 - DNA, 21 bp, Homo sapiens
cagagtaggctattcctgaga

SEQ ID NO: 5995785 - DNA, 22 bp, Homo sapiens
cagagtaggggtctgtctttta

SEQ ID NO: 5995786 - DNA, 17 bp, Homo sapiens
cagagtaggtgggtctt

SEQ ID NO: 5995787 - DNA, 18 bp, Homo sapiens
cagagtataggatggatt

SEQ ID NO: 5995788 - DNA, 14 bp, Homo sapiens
cagagtatatatgt

SEQ ID NO: 5995789 - DNA, 22 bp, Homo sapiens
cagagtatctaatcctttaatg

SEQ ID NO: 5995790 - DNA, 21 bp, Homo sapiens
cagagtatgaacacctgggct

SEQ ID NO: 5995791 - DNA, 13 bp, Homo sapiens
cagagtatgacga

SEQ ID NO: 5995792 - DNA, 16 bp, Homo sapiens
cagagtatgagtgcaa

SEQ ID NO: 5995793 - DNA, 20 bp, Homo sapiens
cagagtatggagctcagaga

SEQ ID NO: 5995794 - DNA, 13 bp, Homo sapiens
cagagtatttgaa

SEQ ID NO: 5995795 - DNA, 18 bp, Homo sapiens
cagagtatttttgtattc

SEQ ID NO: 5995796 - DNA, 12 bp, Homo sapiens
cagagtcaacaa

SEQ ID NO: 5995797 - DNA, 17 bp, Homo sapiens
cagagtcaactgttccc

SEQ ID NO: 5995798 - DNA, 16 bp, Homo sapiens
cagagtcaaggcctgc

SEQ ID NO: 5995799 - DNA, 15 bp, Homo sapiens
cagagtcactcacac

SEQ ID NO: 5995800 - DNA, 20 bp, Homo sapiens
cagagtcagaagtttctgcc

SEQ ID NO: 5995801 - DNA, 19 bp, Homo sapiens
cagagtcagaggagaagag

SEQ ID NO: 5995802 - DNA, 13 bp, Homo sapiens
cagagtcagcaga

SEQ ID NO: 5995803 - DNA, 17 bp, Homo sapiens
cagagtcagccaggacc

SEQ ID NO: 5995804 - DNA, 18 bp, Homo sapiens
cagagtcagccaggacca

SEQ ID NO: 5995805 - DNA, 14 bp, Homo sapiens
cagagtccaggccc

SEQ ID NO: 5995806 - DNA, 17 bp, Homo sapiens
cagagtccagtgctctg

SEQ ID NO: 5995807 - DNA, 21 bp, Homo sapiens
cagagtccatttcccacatct

SEQ ID NO: 5995808 - DNA, 23 bp, Homo sapiens
cagagtcctgccgacggagccac

SEQ ID NO: 5995809 - DNA, 15 bp, Homo sapiens
cagagtcctggccct

SEQ ID NO: 5995810 - DNA, 14 bp, Homo sapiens
cagagtcctttcca

SEQ ID NO: 5995811 - DNA, 15 bp, Homo sapiens
cagagtcgctggcat

SEQ ID NO: 5995812 - DNA, 23 bp, Homo sapiens
cagagtcggaacggagaaaggtg

SEQ ID NO: 5995813 - DNA, 19 bp, Homo sapiens
cagagtctcactgttgccc

SEQ ID NO: 5995814 - DNA, 22 bp, Homo sapiens
cagagtctcactgttgcccagg

SEQ ID NO: 5995815 - DNA, 14 bp, Homo sapiens
cagagtctcccagt

SEQ ID NO: 5995816 - DNA, 16 bp, Homo sapiens
cagagtctcccagtgg

SEQ ID NO: 5995817 - DNA, 19 bp, Homo sapiens
cagagtctcccagtgggtg

SEQ ID NO: 5995818 - DNA, 15 bp, Homo sapiens
cagagtctcccgctg

SEQ ID NO: 5995819 - DNA, 19 bp, Homo sapiens
cagagtctcgctctgtcgc

SEQ ID NO: 5995820 - DNA, 16 bp, Homo sapiens
cagagtctgacaggaa

SEQ ID NO: 5995821 - DNA, 14 bp, Homo sapiens
cagagtctggagct

SEQ ID NO: 5995822 - DNA, 16 bp, Homo sapiens
cagagtctggcctgcc

SEQ ID NO: 5995823 - DNA, 14 bp, Homo sapiens
cagagtctgggcct

SEQ ID NO: 5995824 - DNA, 19 bp, Homo sapiens
cagagtctgggcctctgac

SEQ ID NO: 5995825 - DNA, 24 bp, Homo sapiens
cagagtctgggcctctgactctga

SEQ ID NO: 5995826 - DNA, 13 bp, Homo sapiens
cagagtctgtctc

SEQ ID NO: 5995827 - DNA, 14 bp, Homo sapiens
cagagtctgtctct

SEQ ID NO: 5995828 - DNA, 20 bp, Homo sapiens
cagagtctgtgtgtagccag

SEQ ID NO: 5995829 - DNA, 23 bp, Homo sapiens
cagagtcttgctctgttgcccaa

SEQ ID NO: 5995830 - DNA, 23 bp, Homo sapiens
cagagtgaaagggctatggcaag

SEQ ID NO: 5995831 - DNA, 17 bp, Homo sapiens
cagagtgaaataaaatg

SEQ ID NO: 5995832 - DNA, 15 bp, Homo sapiens
cagagtgaagaatct

SEQ ID NO: 5995833 - DNA, 17 bp, Homo sapiens
cagagtgaagagtgaag

SEQ ID NO: 5995834 - DNA, 16 bp, Homo sapiens
cagagtgaatcatcca

SEQ ID NO: 5995835 - DNA, 16 bp, Homo sapiens
cagagtgacagtcata

SEQ ID NO: 5995836 - DNA, 22 bp, Homo sapiens
cagagtgaccctcagctgtcac

SEQ ID NO: 5995837 - DNA, 18 bp, Homo sapiens
cagagtgactgacggctg

SEQ ID NO: 5995838 - DNA, 23 bp, Homo sapiens
cagagtgactgacggctgtgtat

SEQ ID NO: 5995839 - DNA, 15 bp, Homo sapiens
cagagtgagacccag

SEQ ID NO: 5995840 - DNA, 15 bp, Homo sapiens
cagagtgagaccctg

SEQ ID NO: 5995841 - DNA, 17 bp, Homo sapiens
cagagtgagactctgtc

SEQ ID NO: 5995842 - DNA, 21 bp, Homo sapiens
cagagtgagcaagggggccca

SEQ ID NO: 5995843 - DNA, 22 bp, Homo sapiens
cagagtgaggatgtgttttgca

SEQ ID NO: 5995844 - DNA, 20 bp, Homo sapiens
cagagtgagggggtaaagca

SEQ ID NO: 5995845 - DNA, 22 bp, Homo sapiens
cagagtgattcgggggctgacc

SEQ ID NO: 5995846 - DNA, 20 bp, Homo sapiens
cagagtgatttgtaaaacag

SEQ ID NO: 5995847 - DNA, 22 bp, Homo sapiens
cagagtgcaagaagtctggcca

SEQ ID NO: 5995848 - DNA, 20 bp, Homo sapiens
cagagtgcaagcccctgctc

SEQ ID NO: 5995849 - DNA, 16 bp, Homo sapiens
cagagtgcacagctgt

SEQ ID NO: 5995850 - DNA, 17 bp, Homo sapiens
cagagtgcacagctgtc

SEQ ID NO: 5995851 - DNA, 15 bp, Homo sapiens
cagagtgccatccct

SEQ ID NO: 5995852 - DNA, 18 bp, Homo sapiens
cagagtgccatccctgag

SEQ ID NO: 5995853 - DNA, 18 bp, Homo sapiens
cagagtgccccacctgcc

SEQ ID NO: 5995854 - DNA, 13 bp, Homo sapiens
cagagtgccctgg

SEQ ID NO: 5995855 - DNA, 15 bp, Homo sapiens
cagagtgctggactg

SEQ ID NO: 5995856 - DNA, 13 bp, Homo sapiens
cagagtgctggca

SEQ ID NO: 5995857 - DNA, 15 bp, Homo sapiens
cagagtgctggcact

SEQ ID NO: 5995858 - DNA, 18 bp, Homo sapiens
cagagtggaaactcagcc

SEQ ID NO: 5995859 - DNA, 20 bp, Homo sapiens
cagagtggaataagacagag

SEQ ID NO: 5995860 - DNA, 18 bp, Homo sapiens
cagagtggactgcattta

SEQ ID NO: 5995861 - DNA, 19 bp, Homo sapiens
cagagtggagttgaaactg

SEQ ID NO: 5995862 - DNA, 23 bp, Homo sapiens
cagagtggagttgaaactgctat

SEQ ID NO: 5995863 - DNA, 14 bp, Homo sapiens
cagagtggatctgg

SEQ ID NO: 5995864 - DNA, 19 bp, Homo sapiens
cagagtggatctggagtct

SEQ ID NO: 5995865 - DNA, 12 bp, Homo sapiens
cagagtggcagt

SEQ ID NO: 5995866 - DNA, 15 bp, Homo sapiens
cagagtggccacggc

SEQ ID NO: 5995867 - DNA, 17 bp, Homo sapiens
cagagtggccacggccc

SEQ ID NO: 5995868 - DNA, 20 bp, Homo sapiens
cagagtggccacggcccagg

SEQ ID NO: 5995869 - DNA, 17 bp, Homo sapiens
cagagtggcccctcacc

SEQ ID NO: 5995870 - DNA, 17 bp, Homo sapiens
cagagtggcctccctgc

SEQ ID NO: 5995871 - DNA, 23 bp, Homo sapiens
cagagtggcctccctgctgtgcc

SEQ ID NO: 5995872 - DNA, 16 bp, Homo sapiens
cagagtggcctggcca

SEQ ID NO: 5995873 - DNA, 22 bp, Homo sapiens
cagagtggcctggccaggagct

SEQ ID NO: 5995874 - DNA, 23 bp, Homo sapiens
cagagtggcctggccaggagctc

SEQ ID NO: 5995875 - DNA, 15 bp, Homo sapiens
cagagtggcctgtga

SEQ ID NO: 5995876 - DNA, 16 bp, Homo sapiens
cagagtggcctgtgag

SEQ ID NO: 5995877 - DNA, 18 bp, Homo sapiens
cagagtggcgtggcctcc

SEQ ID NO: 5995878 - DNA, 16 bp, Homo sapiens
cagagtggctcactgg

SEQ ID NO: 5995879 - DNA, 19 bp, Homo sapiens
cagagtgggacttggagag

SEQ ID NO: 5995880 - DNA, 21 bp, Homo sapiens
cagagtgggacttggagagca

SEQ ID NO: 5995881 - DNA, 21 bp, Homo sapiens
cagagtgggccccgggctgga

SEQ ID NO: 5995882 - DNA, 22 bp, Homo sapiens
cagagtgggccccgggctggag

SEQ ID NO: 5995883 - DNA, 23 bp, Homo sapiens
cagagtgggccccgggctggaga

SEQ ID NO: 5995884 - DNA, 15 bp, Homo sapiens
cagagtgggctttgg

SEQ ID NO: 5995885 - DNA, 22 bp, Homo sapiens
cagagtgggtcttggaccaggg

SEQ ID NO: 5995886 - DNA, 20 bp, Homo sapiens
cagagtggtcgagtgacaca

SEQ ID NO: 5995887 - DNA, 21 bp, Homo sapiens
cagagtggtctttctggagag

SEQ ID NO: 5995888 - DNA, 15 bp, Homo sapiens
cagagtgtacaaatt

SEQ ID NO: 5995889 - DNA, 16 bp, Homo sapiens
cagagtgtagaataat

SEQ ID NO: 5995890 - DNA, 19 bp, Homo sapiens
cagagtgtagggggccttg

SEQ ID NO: 5995891 - DNA, 12 bp, Homo sapiens
cagagtgtatgc

SEQ ID NO: 5995892 - DNA, 13 bp, Homo sapiens
cagagtgtatgca

SEQ ID NO: 5995893 - DNA, 14 bp, Homo sapiens
cagagtgtattaca

SEQ ID NO: 5995894 - DNA, 19 bp, Homo sapiens
cagagtgtatttttgtaat

SEQ ID NO: 5995895 - DNA, 14 bp, Homo sapiens
cagagtgtcccttt

SEQ ID NO: 5995896 - DNA, 12 bp, Homo sapiens
cagagtgtcctt

SEQ ID NO: 5995897 - DNA, 23 bp, Homo sapiens
cagagtgtccttcctctgtcctc

SEQ ID NO: 5995898 - DNA, 12 bp, Homo sapiens
cagagtgtgctg

SEQ ID NO: 5995899 - DNA, 15 bp, Homo sapiens
cagagtgtgctggag

SEQ ID NO: 5995900 - DNA, 14 bp, Homo sapiens
cagagtgtgttttt

SEQ ID NO: 5995901 - DNA, 21 bp, Homo sapiens
cagagtgtgtttttgcactgt

SEQ ID NO: 5995902 - DNA, 23 bp, Homo sapiens
cagagtgtgtttttgcactgtct

SEQ ID NO: 5995903 - DNA, 12 bp, Homo sapiens
cagagttaaaat

SEQ ID NO: 5995904 - DNA, 14 bp, Homo sapiens
cagagttaaaatgt

SEQ ID NO: 5995905 - DNA, 15 bp, Homo sapiens
cagagttaaaatgtt

SEQ ID NO: 5995906 - DNA, 16 bp, Homo sapiens
cagagttaaaatgttt

SEQ ID NO: 5995907 - DNA, 20 bp, Homo sapiens
cagagttaaaatgtttactg

SEQ ID NO: 5995908 - DNA, 19 bp, Homo sapiens
cagagttacagttctgtgg

SEQ ID NO: 5995909 - DNA, 21 bp, Homo sapiens
cagagttaggttgtctccagg

SEQ ID NO: 5995910 - DNA, 13 bp, Homo sapiens
cagagttcacagg

SEQ ID NO: 5995911 - DNA, 23 bp, Homo sapiens
cagagttcacaggaggccagtgg

SEQ ID NO: 5995912 - DNA, 12 bp, Homo sapiens
cagagttcacta

SEQ ID NO: 5995913 - DNA, 24 bp, Homo sapiens
cagagttccccatgcagacatgag

SEQ ID NO: 5995914 - DNA, 20 bp, Homo sapiens
cagagttctatactgtaaag

SEQ ID NO: 5995915 - DNA, 21 bp, Homo sapiens
cagagttctatactgtaaagc

SEQ ID NO: 5995916 - DNA, 16 bp, Homo sapiens
cagagttctgtgaaga

SEQ ID NO: 5995917 - DNA, 22 bp, Homo sapiens
cagagttcttaaagtttaaagt

SEQ ID NO: 5995918 - DNA, 17 bp, Homo sapiens
cagagttcttgcaccct

SEQ ID NO: 5995919 - DNA, 23 bp, Homo sapiens
cagagttctttttgaagtattta

SEQ ID NO: 5995920 - DNA, 17 bp, Homo sapiens
cagagttgaagacagag

SEQ ID NO: 5995921 - DNA, 19 bp, Homo sapiens
cagagttgactttcctccc

SEQ ID NO: 5995922 - DNA, 15 bp, Homo sapiens
cagagttgctgggag

SEQ ID NO: 5995923 - DNA, 20 bp, Homo sapiens
cagagttgctgggagctgaa

SEQ ID NO: 5995924 - DNA, 17 bp, Homo sapiens
cagagttgcttaatgaa

SEQ ID NO: 5995925 - DNA, 13 bp, Homo sapiens
cacagtactttat

SEQ ID NO: 5995926 - DNA, 16 bp, Homo sapiens
cacagtactttattgt

SEQ ID NO: 5995927 - DNA, 13 bp, Homo sapiens
cacagtagaactg

SEQ ID NO: 5995928 - DNA, 17 bp, Homo sapiens
cacagtaggaattggaa

SEQ ID NO: 5995929 - DNA, 16 bp, Homo sapiens
cacagtagtcttgatg

SEQ ID NO: 5995930 - DNA, 19 bp, Homo sapiens
cacagtagtgttgggtgga

SEQ ID NO: 5995931 - DNA, 16 bp, Homo sapiens
cacagtatctgctgtt

SEQ ID NO: 5995932 - DNA, 17 bp, Homo sapiens
cacagtattatgcctga

SEQ ID NO: 5995933 - DNA, 22 bp, Homo sapiens
cacagtattatttctccatccc

SEQ ID NO: 5995934 - DNA, 15 bp, Homo sapiens
cacagtattgtagaa

SEQ ID NO: 5995935 - DNA, 15 bp, Homo sapiens
cacagtattgttctt

SEQ ID NO: 5995936 - DNA, 14 bp, Homo sapiens
cacagtatttaaca

SEQ ID NO: 5995937 - DNA, 14 bp, Homo sapiens
cacagtcaaaataa

SEQ ID NO: 5995938 - DNA, 16 bp, Homo sapiens
cacagtcaaaataatt

SEQ ID NO: 5995939 - DNA, 19 bp, Homo sapiens
cacagtcaaggtcacttaa

SEQ ID NO: 5995940 - DNA, 17 bp, Homo sapiens
cacagtcacccctccct

SEQ ID NO: 5995941 - DNA, 22 bp, Homo sapiens
cacagtcaccttctcggcaact

SEQ ID NO: 5995942 - DNA, 20 bp, Homo sapiens
cacagtcacttgggagctgc

SEQ ID NO: 5995943 - DNA, 13 bp, Homo sapiens
cacagtcagcatg

SEQ ID NO: 5995944 - DNA, 18 bp, Homo sapiens
cacagtcagcatgcttcc

SEQ ID NO: 5995945 - DNA, 21 bp, Homo sapiens
cacagtcagcatgcttcccag

SEQ ID NO: 5995946 - DNA, 15 bp, Homo sapiens
cacagtcaggggctg

SEQ ID NO: 5995947 - DNA, 13 bp, Homo sapiens
cacagtcatacaa

SEQ ID NO: 5995948 - DNA, 15 bp, Homo sapiens
cacagtcatacaagt

SEQ ID NO: 5995949 - DNA, 14 bp, Homo sapiens
cacagtccagaccc

SEQ ID NO: 5995950 - DNA, 18 bp, Homo sapiens
cacagtccagacccaagt

SEQ ID NO: 5995951 - DNA, 16 bp, Homo sapiens
cacagtccaggaacaa

SEQ ID NO: 5995952 - DNA, 22 bp, Homo sapiens
cacagtccaggaacaagctaat

SEQ ID NO: 5995953 - DNA, 14 bp, Homo sapiens
cacagtcccccacc

SEQ ID NO: 5995954 - DNA, 13 bp, Homo sapiens
cacagtccctcac

SEQ ID NO: 5995955 - DNA, 17 bp, Homo sapiens
cacagtccctcacctcc

SEQ ID NO: 5995956 - DNA, 13 bp, Homo sapiens
cacagtccctcct

SEQ ID NO: 5995957 - DNA, 14 bp, Homo sapiens
cacagtccctcctg

SEQ ID NO: 5995958 - DNA, 13 bp, Homo sapiens
cacagtcctcaca

SEQ ID NO: 5995959 - DNA, 16 bp, Homo sapiens
cacagtcctcacagcc

SEQ ID NO: 5995960 - DNA, 13 bp, Homo sapiens
cacagtccttacc

SEQ ID NO: 5995961 - DNA, 22 bp, Homo sapiens
cacagtccttaccagcagagca

SEQ ID NO: 5995962 - DNA, 23 bp, Homo sapiens
cacagtccttaccagcagagcac

SEQ ID NO: 5995963 - DNA, 17 bp, Homo sapiens
cacagtctaatttttat

SEQ ID NO: 5995964 - DNA, 20 bp, Homo sapiens
cacagtctcagtccagatgc

SEQ ID NO: 5995965 - DNA, 13 bp, Homo sapiens
cacagtctcccat

SEQ ID NO: 5995966 - DNA, 18 bp, Homo sapiens
cacagtctccggcctctc

SEQ ID NO: 5995967 - DNA, 17 bp, Homo sapiens
cacagtctctccctggg

SEQ ID NO: 5995968 - DNA, 19 bp, Homo sapiens
cacagtctctccctggggt

SEQ ID NO: 5995969 - DNA, 14 bp, Homo sapiens
cacagtctggtgct

SEQ ID NO: 5995970 - DNA, 15 bp, Homo sapiens
cacagtcttttccta

SEQ ID NO: 5995971 - DNA, 15 bp, Homo sapiens
cacagtgaagcaaat

SEQ ID NO: 5995972 - DNA, 11 bp, Homo sapiens
cacagtgaccc

SEQ ID NO: 5995973 - DNA, 16 bp, Homo sapiens
cacagtgactgggccc

SEQ ID NO: 5995974 - DNA, 21 bp, Homo sapiens
cacagtgactgggccctgtcc

SEQ ID NO: 5995975 - DNA, 21 bp, Homo sapiens
cacagtgactttacaggaggt

SEQ ID NO: 5995976 - DNA, 16 bp, Homo sapiens
cacagtgagactgtac

SEQ ID NO: 5995977 - DNA, 20 bp, Homo sapiens
cacagtgagactgtacataa

SEQ ID NO: 5995978 - DNA, 17 bp, Homo sapiens
cacagtgagaggggagg

SEQ ID NO: 5995979 - DNA, 19 bp, Homo sapiens
cacagtgagggagatccca

SEQ ID NO: 5995980 - DNA, 16 bp, Homo sapiens
cacagtgataccagtt

SEQ ID NO: 5995981 - DNA, 15 bp, Homo sapiens
cacagtgatatattt

SEQ ID NO: 5995982 - DNA, 22 bp, Homo sapiens
cacagtgatatatttctatgtg

SEQ ID NO: 5995983 - DNA, 19 bp, Homo sapiens
cacagtgatgaatgtacta

SEQ ID NO: 5995984 - DNA, 14 bp, Homo sapiens
cacagtgatttttt

SEQ ID NO: 5995985 - DNA, 17 bp, Homo sapiens
cacagtgcactcagagc

SEQ ID NO: 5995986 - DNA, 20 bp, Homo sapiens
cacagtgcactcagagctgc

SEQ ID NO: 5995987 - DNA, 12 bp, Homo sapiens
cacagtgcagca

SEQ ID NO: 5995988 - DNA, 19 bp, Homo sapiens
cacagtgcagcaagcctgg

SEQ ID NO: 5995989 - DNA, 19 bp, Homo sapiens
cacagtgcagcttgcagtc

SEQ ID NO: 5995990 - DNA, 18 bp, Homo sapiens
cacagtgcatctcagccc

SEQ ID NO: 5995991 - DNA, 13 bp, Homo sapiens
cacagtgccacca

SEQ ID NO: 5995992 - DNA, 23 bp, Homo sapiens
cacagtgccaccaagctcacacc

SEQ ID NO: 5995993 - DNA, 13 bp, Homo sapiens
cacagtgccaccc

SEQ ID NO: 5995994 - DNA, 14 bp, Homo sapiens
cacagtgccaccca

SEQ ID NO: 5995995 - DNA, 19 bp, Homo sapiens
cacagtgccaggaaagagt

SEQ ID NO: 5995996 - DNA, 19 bp, Homo sapiens
cacagtgcctgatgggagt

SEQ ID NO: 5995997 - DNA, 14 bp, Homo sapiens
cacagtgctgcccc

SEQ ID NO: 5995998 - DNA, 22 bp, Homo sapiens
cacagtgctgccccttgcaagc

SEQ ID NO: 5995999 - DNA, 13 bp, Homo sapiens
cacagtgctgtct

SEQ ID NO: 5996000 - DNA, 18 bp, Homo sapiens
cacagtgcttacatatgt

SEQ ID NO: 5996001 - DNA, 19 bp, Homo sapiens
cacagtggaaccagcccag

SEQ ID NO: 5996002 - DNA, 20 bp, Homo sapiens
cacagtggacggaggtcccc

SEQ ID NO: 5996003 - DNA, 19 bp, Homo sapiens
cacagtggactcagcagtg

SEQ ID NO: 5996004 - DNA, 20 bp, Homo sapiens
cacagtggcacggagagaag

SEQ ID NO: 5996005 - DNA, 13 bp, Homo sapiens
cacagtggctcac

SEQ ID NO: 5996006 - DNA, 19 bp, Homo sapiens
cacagtggctcacacctgt

SEQ ID NO: 5996007 - DNA, 20 bp, Homo sapiens
cacagtggctcacacctgta

SEQ ID NO: 5996008 - DNA, 17 bp, Homo sapiens
cacagtggctcacgcct

SEQ ID NO: 5996009 - DNA, 13 bp, Homo sapiens
cacagtggcttct

SEQ ID NO: 5996010 - DNA, 13 bp, Homo sapiens
cacagtgggaaga

SEQ ID NO: 5996011 - DNA, 15 bp, Homo sapiens
cacagtgggaagaat

SEQ ID NO: 5996012 - DNA, 14 bp, Homo sapiens
cacagtggggccca

SEQ ID NO: 5996013 - DNA, 17 bp, Homo sapiens
cacagtggggcccatgg

SEQ ID NO: 5996014 - DNA, 15 bp, Homo sapiens
cacagtgggtggcac

SEQ ID NO: 5996015 - DNA, 23 bp, Homo sapiens
cacagtgggtggcacctcctgag

SEQ ID NO: 5996016 - DNA, 23 bp, Homo sapiens
cacagtggtactctgtgtctggc

SEQ ID NO: 5996017 - DNA, 13 bp, Homo sapiens
cacagtggtcagc

SEQ ID NO: 5996018 - DNA, 19 bp, Homo sapiens
cacagtggtcccatttata

SEQ ID NO: 5996019 - DNA, 14 bp, Homo sapiens
cacagtggtctgga

SEQ ID NO: 5996020 - DNA, 21 bp, Homo sapiens
cacagtgtaatccaggggtgt

SEQ ID NO: 5996021 - DNA, 17 bp, Homo sapiens
cacagtgtaccattaaa

SEQ ID NO: 5996022 - DNA, 13 bp, Homo sapiens
cacagtgtctggc

SEQ ID NO: 5996023 - DNA, 21 bp, Homo sapiens
cacagtgtctgggctgactgg

SEQ ID NO: 5996024 - DNA, 12 bp, Homo sapiens
cacagtgtctgt

SEQ ID NO: 5996025 - DNA, 16 bp, Homo sapiens
cacagtgtctgttcag

SEQ ID NO: 5996026 - DNA, 13 bp, Homo sapiens
cacagtgtgtttg

SEQ ID NO: 5996027 - DNA, 21 bp, Homo sapiens
cacagtgttccagctgcctgg

SEQ ID NO: 5996028 - DNA, 19 bp, Homo sapiens
cacagtgttgcccaggctg

SEQ ID NO: 5996029 - DNA, 15 bp, Homo sapiens
cacagtgttgtgccc

SEQ ID NO: 5996030 - DNA, 13 bp, Homo sapiens
cacagtgtttcct

SEQ ID NO: 5996031 - DNA, 21 bp, Homo sapiens
cacagtgtttttattgctcgc

SEQ ID NO: 5996032 - DNA, 22 bp, Homo sapiens
cacagtgtttttattgctcgcc

SEQ ID NO: 5996033 - DNA, 16 bp, Homo sapiens
cacagtgtttttgtaa

SEQ ID NO: 5996034 - DNA, 17 bp, Homo sapiens
cacagtgtttttgtaaa

SEQ ID NO: 5996035 - DNA, 19 bp, Homo sapiens
cacagtgtttttgtaaagt

SEQ ID NO: 5996036 - DNA, 18 bp, Homo sapiens
cacagttattaattaaag

SEQ ID NO: 5996037 - DNA, 13 bp, Homo sapiens
cacagttattaca

SEQ ID NO: 5996038 - DNA, 15 bp, Homo sapiens
cacagttattacata

SEQ ID NO: 5996039 - DNA, 18 bp, Homo sapiens
cacagttcaacataaaga

SEQ ID NO: 5996040 - DNA, 17 bp, Homo sapiens
cacagttcaattctcat

SEQ ID NO: 5996041 - DNA, 21 bp, Homo sapiens
cacagttcagtggcagggctc

SEQ ID NO: 5996042 - DNA, 19 bp, Homo sapiens
cacagttccacaattttgt

SEQ ID NO: 5996043 - DNA, 13 bp, Homo sapiens
cacagttccccta

SEQ ID NO: 5996044 - DNA, 19 bp, Homo sapiens
cacagttcctcgccctggg

SEQ ID NO: 5996045 - DNA, 19 bp, Homo sapiens
cacagttcgacctgcggct

SEQ ID NO: 5996046 - DNA, 17 bp, Homo sapiens
cacagttctatttgcta

SEQ ID NO: 5996047 - DNA, 20 bp, Homo sapiens
cacagttctggctataaact

SEQ ID NO: 5996048 - DNA, 23 bp, Homo sapiens
cacagttctttgggccagacatg

SEQ ID NO: 5996049 - DNA, 18 bp, Homo sapiens
cacagttgaagggagggg

SEQ ID NO: 5996050 - DNA, 23 bp, Homo sapiens
cacagttgaagggaggggctgtg

SEQ ID NO: 5996051 - DNA, 12 bp, Homo sapiens
cacagttgccac

SEQ ID NO: 5996052 - DNA, 23 bp, Homo sapiens
cacagttgccaccacctctgtgg

SEQ ID NO: 5996053 - DNA, 14 bp, Homo sapiens
cacagttggcactt

SEQ ID NO: 5996054 - DNA, 20 bp, Homo sapiens
cacagttgtctattctgagc

SEQ ID NO: 5996055 - DNA, 18 bp, Homo sapiens
cacagttgttgaatgact

SEQ ID NO: 5996056 - DNA, 20 bp, Homo sapiens
cacagtttagaacagaggga

SEQ ID NO: 5996057 - DNA, 16 bp, Homo sapiens
cacagtttcaggcttt

SEQ ID NO: 5996058 - DNA, 21 bp, Homo sapiens
cacagtttcctcatctgtcca

SEQ ID NO: 5996059 - DNA, 12 bp, Homo sapiens
cacagtttgaac

SEQ ID NO: 5996060 - DNA, 20 bp, Homo sapiens
cacagtttgagaccagcctg

SEQ ID NO: 5996061 - DNA, 13 bp, Homo sapiens
cacagtttgttca

SEQ ID NO: 5996062 - DNA, 15 bp, Homo sapiens
cacagtttgttcagt

SEQ ID NO: 5996063 - DNA, 19 bp, Homo sapiens
cacagttttaataagaaca

SEQ ID NO: 5996064 - DNA, 22 bp, Homo sapiens
cacagttttaataagaacagat

SEQ ID NO: 5996065 - DNA, 17 bp, Homo sapiens
cacagttttctgagaaa

SEQ ID NO: 5996066 - DNA, 19 bp, Homo sapiens
cacagttttctgagaaaga

SEQ ID NO: 5996067 - DNA, 20 bp, Homo sapiens
cacagttttctgagaaagac

SEQ ID NO: 5996068 - DNA, 17 bp, Homo sapiens
cacagttttgaaagaaa

SEQ ID NO: 5996069 - DNA, 14 bp, Homo sapiens
cacagttttgacct

SEQ ID NO: 5996070 - DNA, 17 bp, Homo sapiens
cacagtttttcctggaa

SEQ ID NO: 5996071 - DNA, 22 bp, Homo sapiens
cacagtttttgtaaagcccttg

SEQ ID NO: 5996072 - DNA, 20 bp, Homo sapiens
cacataaaaagaaatgtgaa

SEQ ID NO: 5996073 - DNA, 22 bp, Homo sapiens
cacataaactttataaattcat

SEQ ID NO: 5996074 - DNA, 12 bp, Homo sapiens
cacataaagaaa

SEQ ID NO: 5996075 - DNA, 14 bp, Homo sapiens
cacataaaggataa

SEQ ID NO: 5996076 - DNA, 18 bp, Homo sapiens
cacataaaggataaactt

SEQ ID NO: 5996077 - DNA, 18 bp, Homo sapiens
cacataaatctgtctgat

SEQ ID NO: 5996078 - DNA, 22 bp, Homo sapiens
cacataaatctgtctgattcta

SEQ ID NO: 5996079 - DNA, 15 bp, Homo sapiens
cacataaatgaaaga

SEQ ID NO: 5996080 - DNA, 17 bp, Homo sapiens
cacataaatgaaagaaa

SEQ ID NO: 5996081 - DNA, 20 bp, Homo sapiens
cacataaattatgagatttt

SEQ ID NO: 5996082 - DNA, 14 bp, Homo sapiens
cacataaattttaa

SEQ ID NO: 5996083 - DNA, 15 bp, Homo sapiens
cacataacaaagggc

SEQ ID NO: 5996084 - DNA, 13 bp, Homo sapiens
cacataacacaca

SEQ ID NO: 5996085 - DNA, 14 bp, Homo sapiens
cacataacacacat

SEQ ID NO: 5996086 - DNA, 23 bp, Homo sapiens
cacataaccctgtcacccacaga

SEQ ID NO: 5996087 - DNA, 13 bp, Homo sapiens
cacataactggat

SEQ ID NO: 5996088 - DNA, 14 bp, Homo sapiens
cacataactggatt

SEQ ID NO: 5996089 - DNA, 13 bp, Homo sapiens
cacataagaaaat

SEQ ID NO: 5996090 - DNA, 14 bp, Homo sapiens
cacataagaaggca

SEQ ID NO: 5996091 - DNA, 22 bp, Homo sapiens
cacataagccaaaactgagcat

SEQ ID NO: 5996092 - DNA, 22 bp, Homo sapiens
cacataataaacgatgttgtga

SEQ ID NO: 5996093 - DNA, 18 bp, Homo sapiens
cacataatacattccatc

SEQ ID NO: 5996094 - DNA, 22 bp, Homo sapiens
cacataatccacgctcatcttg

SEQ ID NO: 5996095 - DNA, 13 bp, Homo sapiens
cacataatgaatg

SEQ ID NO: 5996096 - DNA, 22 bp, Homo sapiens
cacataatgaggtccctctagc

SEQ ID NO: 5996097 - DNA, 22 bp, Homo sapiens
cacataattaaagtgtccattg

SEQ ID NO: 5996098 - DNA, 23 bp, Homo sapiens
cacataattcattaaaaacattt

SEQ ID NO: 5996099 - DNA, 23 bp, Homo sapiens
cacataatttgcataaagggccc

SEQ ID NO: 5996100 - DNA, 15 bp, Homo sapiens
cacatacaaaagaat

SEQ ID NO: 5996101 - DNA, 13 bp, Homo sapiens
cacatacaacaca

SEQ ID NO: 5996102 - DNA, 13 bp, Homo sapiens
cacatacaatttg

SEQ ID NO: 5996103 - DNA, 15 bp, Homo sapiens
cacatacacgaaaga

SEQ ID NO: 5996104 - DNA, 18 bp, Homo sapiens
cacatacagaaagaagca

SEQ ID NO: 5996105 - DNA, 13 bp, Homo sapiens
cagagttgtaaat

SEQ ID NO: 5996106 - DNA, 16 bp, Homo sapiens
cagagttgtaaatata

SEQ ID NO: 5996107 - DNA, 20 bp, Homo sapiens
cagagttgtaaatatataaa

SEQ ID NO: 5996108 - DNA, 23 bp, Homo sapiens
cagagttgtgcacatggcttagt

SEQ ID NO: 5996109 - DNA, 16 bp, Homo sapiens
cagagttgtgcatgcc

SEQ ID NO: 5996110 - DNA, 22 bp, Homo sapiens
cagagttgtgcatgcccctgag

SEQ ID NO: 5996111 - DNA, 14 bp, Homo sapiens
cagagttgttacat

SEQ ID NO: 5996112 - DNA, 15 bp, Homo sapiens
cagagttgttacatt

SEQ ID NO: 5996113 - DNA, 19 bp, Homo sapiens
cagagttgttacattttta

SEQ ID NO: 5996114 - DNA, 20 bp, Homo sapiens
cagagttgttctcaggggtg

SEQ ID NO: 5996115 - DNA, 15 bp, Homo sapiens
cagagtttgcctccc

SEQ ID NO: 5996116 - DNA, 16 bp, Homo sapiens
cagagtttgcctccct

SEQ ID NO: 5996117 - DNA, 21 bp, Homo sapiens
cagagtttgcctccctgcact

SEQ ID NO: 5996118 - DNA, 20 bp, Homo sapiens
cagagtttgccttcctttct

SEQ ID NO: 5996119 - DNA, 13 bp, Homo sapiens
cagagtttggata

SEQ ID NO: 5996120 - DNA, 22 bp, Homo sapiens
cagagtttggttaatcagtgtt

SEQ ID NO: 5996121 - DNA, 15 bp, Homo sapiens
cagagtttgtagtaa

SEQ ID NO: 5996122 - DNA, 14 bp, Homo sapiens
cagagtttgtgtgt

SEQ ID NO: 5996123 - DNA, 22 bp, Homo sapiens
cagagtttgtgtgttgtcttga

SEQ ID NO: 5996124 - DNA, 13 bp, Homo sapiens
cagagttttacta

SEQ ID NO: 5996125 - DNA, 14 bp, Homo sapiens
cagagttttcatta

SEQ ID NO: 5996126 - DNA, 22 bp, Homo sapiens
cagagttttcattaaatccttt

SEQ ID NO: 5996127 - DNA, 20 bp, Homo sapiens
cagataaaaacaatatatgt

SEQ ID NO: 5996128 - DNA, 14 bp, Homo sapiens
cagataaaatgttc

SEQ ID NO: 5996129 - DNA, 21 bp, Homo sapiens
cagataaacctagataaagag

SEQ ID NO: 5996130 - DNA, 14 bp, Homo sapiens
cagataaagacagc

SEQ ID NO: 5996131 - DNA, 16 bp, Homo sapiens
cagataaagacagctg

SEQ ID NO: 5996132 - DNA, 17 bp, Homo sapiens
cagataaagacagctga

SEQ ID NO: 5996133 - DNA, 12 bp, Homo sapiens
cagataaagatt

SEQ ID NO: 5996134 - DNA, 14 bp, Homo sapiens
cagataaatacatt

SEQ ID NO: 5996135 - DNA, 15 bp, Homo sapiens
cagataaatacattt

SEQ ID NO: 5996136 - DNA, 14 bp, Homo sapiens
cagataaatagaac

SEQ ID NO: 5996137 - DNA, 17 bp, Homo sapiens
cagataaatagaactat

SEQ ID NO: 5996138 - DNA, 15 bp, Homo sapiens
cagataaatttcaat

SEQ ID NO: 5996139 - DNA, 17 bp, Homo sapiens
cagataacaatgcagca

SEQ ID NO: 5996140 - DNA, 16 bp, Homo sapiens
cagataacataccttt

SEQ ID NO: 5996141 - DNA, 15 bp, Homo sapiens
cagataacatttgtg

SEQ ID NO: 5996142 - DNA, 20 bp, Homo sapiens
cagataacctaataattgta

SEQ ID NO: 5996143 - DNA, 22 bp, Homo sapiens
cagataactctctttccttgag

SEQ ID NO: 5996144 - DNA, 22 bp, Homo sapiens
cagataactgaaaattatttaa

SEQ ID NO: 5996145 - DNA, 20 bp, Homo sapiens
cagataactgaggaggggag

SEQ ID NO: 5996146 - DNA, 14 bp, Homo sapiens
cagataactgttat

SEQ ID NO: 5996147 - DNA, 15 bp, Homo sapiens
cagataacttagctt

SEQ ID NO: 5996148 - DNA, 15 bp, Homo sapiens
cagataacttcttta

SEQ ID NO: 5996149 - DNA, 20 bp, Homo sapiens
cagataacttttttgagtca

SEQ ID NO: 5996150 - DNA, 22 bp, Homo sapiens
cagataacttttttgagtcatt

SEQ ID NO: 5996151 - DNA, 19 bp, Homo sapiens
cagataaggccgagcccac

SEQ ID NO: 5996152 - DNA, 20 bp, Homo sapiens
cagataaggccgagcccaca

SEQ ID NO: 5996153 - DNA, 22 bp, Homo sapiens
cagataaggccgagcccacacc

SEQ ID NO: 5996154 - DNA, 22 bp, Homo sapiens
cagataaggtaaaatgccatga

SEQ ID NO: 5996155 - DNA, 22 bp, Homo sapiens
cagataagtaagagtactatta

SEQ ID NO: 5996156 - DNA, 15 bp, Homo sapiens
cagataagtgtaaat

SEQ ID NO: 5996157 - DNA, 18 bp, Homo sapiens
cagataagtgtaaataga

SEQ ID NO: 5996158 - DNA, 19 bp, Homo sapiens
cagataagtgtaaatagaa

SEQ ID NO: 5996159 - DNA, 19 bp, Homo sapiens
cagataagttggagcaggg

SEQ ID NO: 5996160 - DNA, 23 bp, Homo sapiens
cagataagttggagcaggggttg

SEQ ID NO: 5996161 - DNA, 16 bp, Homo sapiens
cagataatcagcctct

SEQ ID NO: 5996162 - DNA, 17 bp, Homo sapiens
cagataatcagcctctt

SEQ ID NO: 5996163 - DNA, 14 bp, Homo sapiens
cagataatcagtgt

SEQ ID NO: 5996164 - DNA, 17 bp, Homo sapiens
cagataatcggtgcagc

SEQ ID NO: 5996165 - DNA, 13 bp, Homo sapiens
cagataatgatgg

SEQ ID NO: 5996166 - DNA, 13 bp, Homo sapiens
cagataatggtaa

SEQ ID NO: 5996167 - DNA, 15 bp, Homo sapiens
cagataattcatttg

SEQ ID NO: 5996168 - DNA, 17 bp, Homo sapiens
cagataattcatttgta

SEQ ID NO: 5996169 - DNA, 20 bp, Homo sapiens
cagataattcatttgtattg

SEQ ID NO: 5996170 - DNA, 18 bp, Homo sapiens
cagataattctggaccag

SEQ ID NO: 5996171 - DNA, 13 bp, Homo sapiens
cagatacaatgta

SEQ ID NO: 5996172 - DNA, 22 bp, Homo sapiens
cagatacaggaaaagctgctga

SEQ ID NO: 5996173 - DNA, 16 bp, Homo sapiens
cagatacataggtctg

SEQ ID NO: 5996174 - DNA, 14 bp, Homo sapiens
cagatacatcactg

SEQ ID NO: 5996175 - DNA, 17 bp, Homo sapiens
cagatacattcatgagg

SEQ ID NO: 5996176 - DNA, 15 bp, Homo sapiens
cagatacatttccct

SEQ ID NO: 5996177 - DNA, 15 bp, Homo sapiens
cagataccaagcatg

SEQ ID NO: 5996178 - DNA, 13 bp, Homo sapiens
cagatacctcatc

SEQ ID NO: 5996179 - DNA, 19 bp, Homo sapiens
cagatacctccaaccctgc

SEQ ID NO: 5996180 - DNA, 20 bp, Homo sapiens
cagatacctccaaccctgcc

SEQ ID NO: 5996181 - DNA, 21 bp, Homo sapiens
cagatacctccaaccctgccg

SEQ ID NO: 5996182 - DNA, 15 bp, Homo sapiens
cagatacctgtgagg

SEQ ID NO: 5996183 - DNA, 17 bp, Homo sapiens
cagatacctgtgaggac

SEQ ID NO: 5996184 - DNA, 18 bp, Homo sapiens
cagatacctgtgaggact

SEQ ID NO: 5996185 - DNA, 19 bp, Homo sapiens
cagataccttatcttacaa

SEQ ID NO: 5996186 - DNA, 23 bp, Homo sapiens
cagataccttatcttacaatatt

SEQ ID NO: 5996187 - DNA, 18 bp, Homo sapiens
cagataccttgaaaggaa

SEQ ID NO: 5996188 - DNA, 16 bp, Homo sapiens
cagatactgaaacatt

SEQ ID NO: 5996189 - DNA, 14 bp, Homo sapiens
cagatactgctgtg

SEQ ID NO: 5996190 - DNA, 22 bp, Homo sapiens
cagatactggaagttttgcatt

SEQ ID NO: 5996191 - DNA, 14 bp, Homo sapiens
cagatacttattaa

SEQ ID NO: 5996192 - DNA, 17 bp, Homo sapiens
cagatacttgtgaacat

SEQ ID NO: 5996193 - DNA, 15 bp, Homo sapiens
cagatactttgaagt

SEQ ID NO: 5996194 - DNA, 21 bp, Homo sapiens
cagatactttgaagtgcagct

SEQ ID NO: 5996195 - DNA, 21 bp, Homo sapiens
cagatagaaaacagcccccac

SEQ ID NO: 5996196 - DNA, 16 bp, Homo sapiens
cagatagaaagcatta

SEQ ID NO: 5996197 - DNA, 19 bp, Homo sapiens
cagatagaatttggcccag

SEQ ID NO: 5996198 - DNA, 17 bp, Homo sapiens
cagatagacagtgctgc

SEQ ID NO: 5996199 - DNA, 19 bp, Homo sapiens
cagatagacagtgctgccc

SEQ ID NO: 5996200 - DNA, 13 bp, Homo sapiens
cagatagacctgt

SEQ ID NO: 5996201 - DNA, 12 bp, Homo sapiens
cagatagagata

SEQ ID NO: 5996202 - DNA, 15 bp, Homo sapiens
cagatagagatattt

SEQ ID NO: 5996203 - DNA, 21 bp, Homo sapiens
cagatagagatattttgggta

SEQ ID NO: 5996204 - DNA, 14 bp, Homo sapiens
cagatagagctggg

SEQ ID NO: 5996205 - DNA, 19 bp, Homo sapiens
cagatagatatatgctctg

SEQ ID NO: 5996206 - DNA, 19 bp, Homo sapiens
cagatagccagacacatgg

SEQ ID NO: 5996207 - DNA, 15 bp, Homo sapiens
cagatagcccaggag

SEQ ID NO: 5996208 - DNA, 14 bp, Homo sapiens
cagatagtcccagc

SEQ ID NO: 5996209 - DNA, 14 bp, Homo sapiens
cagatagtctcttt

SEQ ID NO: 5996210 - DNA, 14 bp, Homo sapiens
cagatagtgcctct

SEQ ID NO: 5996211 - DNA, 13 bp, Homo sapiens
cagatataaatac

SEQ ID NO: 5996212 - DNA, 22 bp, Homo sapiens
cagatataaatggctggttttt

SEQ ID NO: 5996213 - DNA, 17 bp, Homo sapiens
cagatataactgtcttg

SEQ ID NO: 5996214 - DNA, 13 bp, Homo sapiens
cagatataagatt

SEQ ID NO: 5996215 - DNA, 14 bp, Homo sapiens
cagatataagattt

SEQ ID NO: 5996216 - DNA, 20 bp, Homo sapiens
cagatatactggaacccttt

SEQ ID NO: 5996217 - DNA, 15 bp, Homo sapiens
cagatatactttgtg

SEQ ID NO: 5996218 - DNA, 18 bp, Homo sapiens
cagatatatttaagcctt

SEQ ID NO: 5996219 - DNA, 18 bp, Homo sapiens
cagatatattttctttct

SEQ ID NO: 5996220 - DNA, 13 bp, Homo sapiens
cagatatattttt

SEQ ID NO: 5996221 - DNA, 17 bp, Homo sapiens
cagatatccacataaat

SEQ ID NO: 5996222 - DNA, 19 bp, Homo sapiens
cagatatccacataaatgc

SEQ ID NO: 5996223 - DNA, 12 bp, Homo sapiens
cagatatctttt

SEQ ID NO: 5996224 - DNA, 18 bp, Homo sapiens
cagatatctttttcatta

SEQ ID NO: 5996225 - DNA, 18 bp, Homo sapiens
cagatatgaacagggccc

SEQ ID NO: 5996226 - DNA, 16 bp, Homo sapiens
cagatatgattcaaat

SEQ ID NO: 5996227 - DNA, 17 bp, Homo sapiens
cagatatgattcaaatg

SEQ ID NO: 5996228 - DNA, 21 bp, Homo sapiens
cagatatgtttttatttaaaa

SEQ ID NO: 5996229 - DNA, 14 bp, Homo sapiens
cagatattccagac

SEQ ID NO: 5996230 - DNA, 20 bp, Homo sapiens
cagatatttaaatttagtgc

SEQ ID NO: 5996231 - DNA, 12 bp, Homo sapiens
cagatatttata

SEQ ID NO: 5996232 - DNA, 16 bp, Homo sapiens
cagatatttatatttt

SEQ ID NO: 5996233 - DNA, 21 bp, Homo sapiens
cagatatttccatttcttcct

SEQ ID NO: 5996234 - DNA, 13 bp, Homo sapiens
cagatattttatc

SEQ ID NO: 5996235 - DNA, 12 bp, Homo sapiens
cagatattttca

SEQ ID NO: 5996236 - DNA, 23 bp, Homo sapiens
cagatatttttaacttaatggca

SEQ ID NO: 5996237 - DNA, 22 bp, Homo sapiens
cagatcaaagtatgtatgtttt

SEQ ID NO: 5996238 - DNA, 21 bp, Homo sapiens
cagatcaacagacctaagaaa

SEQ ID NO: 5996239 - DNA, 17 bp, Homo sapiens
cagatcaagcctgcctc

SEQ ID NO: 5996240 - DNA, 15 bp, Homo sapiens
cagatcaagctgtga

SEQ ID NO: 5996241 - DNA, 19 bp, Homo sapiens
cagatcaagctgtgagaca

SEQ ID NO: 5996242 - DNA, 19 bp, Homo sapiens
cagatcaagggcctatctt

SEQ ID NO: 5996243 - DNA, 14 bp, Homo sapiens
cagatcaatgacat

SEQ ID NO: 5996244 - DNA, 23 bp, Homo sapiens
cagatcaatggcgcagtgcctct

SEQ ID NO: 5996245 - DNA, 17 bp, Homo sapiens
cagatcacatgcccctc

SEQ ID NO: 5996246 - DNA, 17 bp, Homo sapiens
cagatcaccccagcctc

SEQ ID NO: 5996247 - DNA, 13 bp, Homo sapiens
cagatcacctgag

SEQ ID NO: 5996248 - DNA, 13 bp, Homo sapiens
cagatcactcctg

SEQ ID NO: 5996249 - DNA, 15 bp, Homo sapiens
cagatcactcctgga

SEQ ID NO: 5996250 - DNA, 13 bp, Homo sapiens
cagatcactgcca

SEQ ID NO: 5996251 - DNA, 23 bp, Homo sapiens
cagatcagaacatgaaatgccct

SEQ ID NO: 5996252 - DNA, 13 bp, Homo sapiens
cagatcagccaga

SEQ ID NO: 5996253 - DNA, 15 bp, Homo sapiens
cagatcagccagaag

SEQ ID NO: 5996254 - DNA, 23 bp, Homo sapiens
cagatcaggaaccagggcctccc

SEQ ID NO: 5996255 - DNA, 20 bp, Homo sapiens
cagatcatagatttctgatt

SEQ ID NO: 5996256 - DNA, 23 bp, Homo sapiens
cagatcatagatttctgatttta

SEQ ID NO: 5996257 - DNA, 21 bp, Homo sapiens
cagatcataggaagtggctgg

SEQ ID NO: 5996258 - DNA, 17 bp, Homo sapiens
cagatcatgccgccgca

SEQ ID NO: 5996259 - DNA, 22 bp, Homo sapiens
cagatcatgccgccgcagctgg

SEQ ID NO: 5996260 - DNA, 17 bp, Homo sapiens
cagatcatgttttggtg

SEQ ID NO: 5996261 - DNA, 19 bp, Homo sapiens
cagatcatgttttggtgaa

SEQ ID NO: 5996262 - DNA, 22 bp, Homo sapiens
cagatcattgtgaaattattca

SEQ ID NO: 5996263 - DNA, 15 bp, Homo sapiens
cagatccaagatgtt

SEQ ID NO: 5996264 - DNA, 16 bp, Homo sapiens
cagatccacctgcaca

SEQ ID NO: 5996265 - DNA, 17 bp, Homo sapiens
cagatccacctgcacaa

SEQ ID NO: 5996266 - DNA, 18 bp, Homo sapiens
cagatccacctgcacaaa

SEQ ID NO: 5996267 - DNA, 23 bp, Homo sapiens
cagatccagactgtaagatgttg

SEQ ID NO: 5996268 - DNA, 12 bp, Homo sapiens
cagatccagcct

SEQ ID NO: 5996269 - DNA, 14 bp, Homo sapiens
cagatccagcctgg

SEQ ID NO: 5996270 - DNA, 15 bp, Homo sapiens
cagatccagcctggg

SEQ ID NO: 5996271 - DNA, 15 bp, Homo sapiens
cagatccaggaacac

SEQ ID NO: 5996272 - DNA, 17 bp, Homo sapiens
cagatccaggaacacat

SEQ ID NO: 5996273 - DNA, 23 bp, Homo sapiens
cagatccaggaacacatgcacac

SEQ ID NO: 5996274 - DNA, 14 bp, Homo sapiens
cagatccagggaca

SEQ ID NO: 5996275 - DNA, 23 bp, Homo sapiens
cagatccagggacagaggcccca

SEQ ID NO: 5996276 - DNA, 22 bp, Homo sapiens
cagatccatccttttgcttcat

SEQ ID NO: 5996277 - DNA, 17 bp, Homo sapiens
cagatcccactggaaga

SEQ ID NO: 5996278 - DNA, 20 bp, Homo sapiens
cagatcccacttttgccaga

SEQ ID NO: 5996279 - DNA, 15 bp, Homo sapiens
cagatcccagcccac

SEQ ID NO: 5996280 - DNA, 19 bp, Homo sapiens
cagatcccagcccaccctg

SEQ ID NO: 5996281 - DNA, 23 bp, Homo sapiens
cagatcccagcccaccctgcccc

SEQ ID NO: 5996282 - DNA, 21 bp, Homo sapiens
cagatcccaggcccctggagg

SEQ ID NO: 5996283 - DNA, 12 bp, Homo sapiens
cagatcccaggg

SEQ ID NO: 5996284 - DNA, 21 bp, Homo sapiens
cacatacagaaagaagcagtt

SEQ ID NO: 5996285 - DNA, 14 bp, Homo sapiens
cacatacaggtgct

SEQ ID NO: 5996286 - DNA, 18 bp, Homo sapiens
cacatacaggtgctcaat

SEQ ID NO: 5996287 - DNA, 15 bp, Homo sapiens
cacatacataatggt

SEQ ID NO: 5996288 - DNA, 14 bp, Homo sapiens
cacatacatacata

SEQ ID NO: 5996289 - DNA, 16 bp, Homo sapiens
cacatacatacataca

SEQ ID NO: 5996290 - DNA, 15 bp, Homo sapiens
cacatacatatatac

SEQ ID NO: 5996291 - DNA, 11 bp, Homo sapiens
cacatacatta

SEQ ID NO: 5996292 - DNA, 14 bp, Homo sapiens
cacatacattaaaa

SEQ ID NO: 5996293 - DNA, 18 bp, Homo sapiens
cacatacattaaaactag

SEQ ID NO: 5996294 - DNA, 13 bp, Homo sapiens
cacataccaggtc

SEQ ID NO: 5996295 - DNA, 22 bp, Homo sapiens
cacataccctcttcatggatgg

SEQ ID NO: 5996296 - DNA, 15 bp, Homo sapiens
cacataccttcatgt

SEQ ID NO: 5996297 - DNA, 20 bp, Homo sapiens
cacatacgcaccacatctct

SEQ ID NO: 5996298 - DNA, 16 bp, Homo sapiens
cacatacgtgttagga

SEQ ID NO: 5996299 - DNA, 23 bp, Homo sapiens
cacatacgtgttaggaggctgca

SEQ ID NO: 5996300 - DNA, 18 bp, Homo sapiens
cacatactcatttttcat

SEQ ID NO: 5996301 - DNA, 21 bp, Homo sapiens
cacatagaaagtaaataaaag

SEQ ID NO: 5996302 - DNA, 23 bp, Homo sapiens
cacatagactttatgcaataaat

SEQ ID NO: 5996303 - DNA, 19 bp, Homo sapiens
cacatagagctttttaata

SEQ ID NO: 5996304 - DNA, 20 bp, Homo sapiens
cacatagagctttttaatag

SEQ ID NO: 5996305 - DNA, 23 bp, Homo sapiens
cacatagagctttttaatagcac

SEQ ID NO: 5996306 - DNA, 18 bp, Homo sapiens
cacatagatgttgtagaa

SEQ ID NO: 5996307 - DNA, 17 bp, Homo sapiens
cacatagattcacctgt

SEQ ID NO: 5996308 - DNA, 21 bp, Homo sapiens
cacatagcataggctggggac

SEQ ID NO: 5996309 - DNA, 22 bp, Homo sapiens
cacatagcatgcttcctttctc

SEQ ID NO: 5996310 - DNA, 18 bp, Homo sapiens
cacatagcatgtaatggt

SEQ ID NO: 5996311 - DNA, 14 bp, Homo sapiens
cacatagccctgtt

SEQ ID NO: 5996312 - DNA, 16 bp, Homo sapiens
cacatagctgtctaga

SEQ ID NO: 5996313 - DNA, 16 bp, Homo sapiens
cacataggaaactttt

SEQ ID NO: 5996314 - DNA, 19 bp, Homo sapiens
cacataggctctcaggtgc

SEQ ID NO: 5996315 - DNA, 21 bp, Homo sapiens
cacataggttagattctcatt

SEQ ID NO: 5996316 - DNA, 16 bp, Homo sapiens
cacatagtcctcaggg

SEQ ID NO: 5996317 - DNA, 16 bp, Homo sapiens
cacatagtgtcctgcc

SEQ ID NO: 5996318 - DNA, 17 bp, Homo sapiens
cacatagtgtcctgccc

SEQ ID NO: 5996319 - DNA, 22 bp, Homo sapiens
cacatagttctgcccaaattat

SEQ ID NO: 5996320 - DNA, 16 bp, Homo sapiens
cacatagtttcttttt

SEQ ID NO: 5996321 - DNA, 14 bp, Homo sapiens
cacatataaaaaca

SEQ ID NO: 5996322 - DNA, 16 bp, Homo sapiens
cacatataaacacagt

SEQ ID NO: 5996323 - DNA, 23 bp, Homo sapiens
cacatataaattgtcttaatgga

SEQ ID NO: 5996324 - DNA, 22 bp, Homo sapiens
cacatatacaaaagcaagactt

SEQ ID NO: 5996325 - DNA, 14 bp, Homo sapiens
cacatatacacaca

SEQ ID NO: 5996326 - DNA, 13 bp, Homo sapiens
cacatatacatat

SEQ ID NO: 5996327 - DNA, 19 bp, Homo sapiens
cacatatacattatttctg

SEQ ID NO: 5996328 - DNA, 14 bp, Homo sapiens
cacatatatacata

SEQ ID NO: 5996329 - DNA, 22 bp, Homo sapiens
cacatatatgtatacgcacgca

SEQ ID NO: 5996330 - DNA, 23 bp, Homo sapiens
cacatatatgtatacgcacgcac

SEQ ID NO: 5996331 - DNA, 19 bp, Homo sapiens
cacatatcaaatgcttgct

SEQ ID NO: 5996332 - DNA, 12 bp, Homo sapiens
cacatatctgtc

SEQ ID NO: 5996333 - DNA, 18 bp, Homo sapiens
cacatatgaacacagaca

SEQ ID NO: 5996334 - DNA, 13 bp, Homo sapiens
cacatatgagggg

SEQ ID NO: 5996335 - DNA, 19 bp, Homo sapiens
cacatatgcaccttgtgtc

SEQ ID NO: 5996336 - DNA, 20 bp, Homo sapiens
cacatatgcaccttgtgtct

SEQ ID NO: 5996337 - DNA, 21 bp, Homo sapiens
cacatatgcaccttgtgtctg

SEQ ID NO: 5996338 - DNA, 15 bp, Homo sapiens
cacatatggcacaac

SEQ ID NO: 5996339 - DNA, 16 bp, Homo sapiens
cacatatgggtgctgg

SEQ ID NO: 5996340 - DNA, 18 bp, Homo sapiens
cacatatgggtgctggca

SEQ ID NO: 5996341 - DNA, 23 bp, Homo sapiens
cacatattaagaatagtctctgg

SEQ ID NO: 5996342 - DNA, 19 bp, Homo sapiens
cacatattcaaatcagcaa

SEQ ID NO: 5996343 - DNA, 13 bp, Homo sapiens
cacatatttcaaa

SEQ ID NO: 5996344 - DNA, 14 bp, Homo sapiens
cacatatttcacat

SEQ ID NO: 5996345 - DNA, 14 bp, Homo sapiens
cacatattttaaaa

SEQ ID NO: 5996346 - DNA, 16 bp, Homo sapiens
cacatcaaatatttct

SEQ ID NO: 5996347 - DNA, 16 bp, Homo sapiens
cacatcaagcatcatt

SEQ ID NO: 5996348 - DNA, 17 bp, Homo sapiens
cacatcacaatattcag

SEQ ID NO: 5996349 - DNA, 18 bp, Homo sapiens
cacatcacacaagatttg

SEQ ID NO: 5996350 - DNA, 14 bp, Homo sapiens
cacatcacaccact

SEQ ID NO: 5996351 - DNA, 14 bp, Homo sapiens
cacatcaccaggtg

SEQ ID NO: 5996352 - DNA, 19 bp, Homo sapiens
cacatcacccttaccatgt

SEQ ID NO: 5996353 - DNA, 20 bp, Homo sapiens
cacatcactgagaagatggc

SEQ ID NO: 5996354 - DNA, 10 bp, Homo sapiens
cacatcagat

SEQ ID NO: 5996355 - DNA, 13 bp, Homo sapiens
cacatcagcaatt

SEQ ID NO: 5996356 - DNA, 21 bp, Homo sapiens
cacatcagcatgttttctgct

SEQ ID NO: 5996357 - DNA, 13 bp, Homo sapiens
cacatcagcccca

SEQ ID NO: 5996358 - DNA, 17 bp, Homo sapiens
cacatcagccccacagg

SEQ ID NO: 5996359 - DNA, 18 bp, Homo sapiens
cacatcagccccacagga

SEQ ID NO: 5996360 - DNA, 13 bp, Homo sapiens
cacatcagcttgc

SEQ ID NO: 5996361 - DNA, 16 bp, Homo sapiens
cacatcaggaaagaga

SEQ ID NO: 5996362 - DNA, 23 bp, Homo sapiens
cacatcagggcggcctcccaggt

SEQ ID NO: 5996363 - DNA, 16 bp, Homo sapiens
cacatcagtgaggagg

SEQ ID NO: 5996364 - DNA, 18 bp, Homo sapiens
cacatcagtgaggaggga

SEQ ID NO: 5996365 - DNA, 21 bp, Homo sapiens
cacatcataaggttttattca

SEQ ID NO: 5996366 - DNA, 14 bp, Homo sapiens
cacatcatctgtaa

SEQ ID NO: 5996367 - DNA, 15 bp, Homo sapiens
cacatcatctgtaag

SEQ ID NO: 5996368 - DNA, 20 bp, Homo sapiens
cacatcatctttatctcctg

SEQ ID NO: 5996369 - DNA, 22 bp, Homo sapiens
cacatcatctttatctcctggg

SEQ ID NO: 5996370 - DNA, 23 bp, Homo sapiens
cacatcatgtaatagtggctttc

SEQ ID NO: 5996371 - DNA, 14 bp, Homo sapiens
cacatcattcattc

SEQ ID NO: 5996372 - DNA, 20 bp, Homo sapiens
cacatccaacatttcctcag

SEQ ID NO: 5996373 - DNA, 21 bp, Homo sapiens
cacatccaacatttcctcagg

SEQ ID NO: 5996374 - DNA, 16 bp, Homo sapiens
cacatccaactccagc

SEQ ID NO: 5996375 - DNA, 15 bp, Homo sapiens
cacatccaactcctg

SEQ ID NO: 5996376 - DNA, 18 bp, Homo sapiens
cacatccacagtctcccc

SEQ ID NO: 5996377 - DNA, 19 bp, Homo sapiens
cacatccaccaaactcctg

SEQ ID NO: 5996378 - DNA, 22 bp, Homo sapiens
cacatccaccccggctccccct

SEQ ID NO: 5996379 - DNA, 13 bp, Homo sapiens
cacatccagcttg

SEQ ID NO: 5996380 - DNA, 19 bp, Homo sapiens
cacatccagcttgttgtcc

SEQ ID NO: 5996381 - DNA, 12 bp, Homo sapiens
cacatccatccc

SEQ ID NO: 5996382 - DNA, 16 bp, Homo sapiens
cacatccatccctcca

SEQ ID NO: 5996383 - DNA, 12 bp, Homo sapiens
cacatccatcta

SEQ ID NO: 5996384 - DNA, 17 bp, Homo sapiens
cacatccatctgaggct

SEQ ID NO: 5996385 - DNA, 22 bp, Homo sapiens
cacatccattccagagctgcag

SEQ ID NO: 5996386 - DNA, 21 bp, Homo sapiens
cacatccattcccaagaaatg

SEQ ID NO: 5996387 - DNA, 22 bp, Homo sapiens
cacatccattcccaagaaatgc

SEQ ID NO: 5996388 - DNA, 17 bp, Homo sapiens
cacatcccagcagccca

SEQ ID NO: 5996389 - DNA, 16 bp, Homo sapiens
cacatccccaagccca

SEQ ID NO: 5996390 - DNA, 18 bp, Homo sapiens
cacatccccaagcccacc

SEQ ID NO: 5996391 - DNA, 19 bp, Homo sapiens
cacatccccaagcccacca

SEQ ID NO: 5996392 - DNA, 19 bp, Homo sapiens
cacatccccaccttccaag

SEQ ID NO: 5996393 - DNA, 21 bp, Homo sapiens
cacatccccagaatccataaa

SEQ ID NO: 5996394 - DNA, 14 bp, Homo sapiens
cacatccccagagc

SEQ ID NO: 5996395 - DNA, 15 bp, Homo sapiens
cacatccccagagcc

SEQ ID NO: 5996396 - DNA, 14 bp, Homo sapiens
cacatccccagctg

SEQ ID NO: 5996397 - DNA, 14 bp, Homo sapiens
cacatcccggcctc

SEQ ID NO: 5996398 - DNA, 15 bp, Homo sapiens
cacatcccggcctct

SEQ ID NO: 5996399 - DNA, 12 bp, Homo sapiens
cacatccctctc

SEQ ID NO: 5996400 - DNA, 16 bp, Homo sapiens
cacatccctgccctcc

SEQ ID NO: 5996401 - DNA, 13 bp, Homo sapiens
cacatccctgggc

SEQ ID NO: 5996402 - DNA, 20 bp, Homo sapiens
cacatccctgggcctgctgc

SEQ ID NO: 5996403 - DNA, 22 bp, Homo sapiens
cacatccctgggcctgctgctg

SEQ ID NO: 5996404 - DNA, 21 bp, Homo sapiens
cacatccgccttttgtataca

SEQ ID NO: 5996405 - DNA, 22 bp, Homo sapiens
cacatccgcgtgtgcctgtgtg

SEQ ID NO: 5996406 - DNA, 20 bp, Homo sapiens
cacatccggaggagaagaag

SEQ ID NO: 5996407 - DNA, 16 bp, Homo sapiens
cacatcctaatagaaa

SEQ ID NO: 5996408 - DNA, 18 bp, Homo sapiens
cacatcctaatagaaaga

SEQ ID NO: 5996409 - DNA, 13 bp, Homo sapiens
cacatcctcagaa

SEQ ID NO: 5996410 - DNA, 16 bp, Homo sapiens
cacatcctcagaaagt

SEQ ID NO: 5996411 - DNA, 13 bp, Homo sapiens
cacatcctcctgc

SEQ ID NO: 5996412 - DNA, 14 bp, Homo sapiens
cacatcctcctgcc

SEQ ID NO: 5996413 - DNA, 20 bp, Homo sapiens
cacatcctcctgcccagctc

SEQ ID NO: 5996414 - DNA, 20 bp, Homo sapiens
cacatcctgggatccagtgt

SEQ ID NO: 5996415 - DNA, 13 bp, Homo sapiens
cacatcctgtgtc

SEQ ID NO: 5996416 - DNA, 20 bp, Homo sapiens
cacatccttctcactgccat

SEQ ID NO: 5996417 - DNA, 20 bp, Homo sapiens
cacatccttcttggcttcct

SEQ ID NO: 5996418 - DNA, 15 bp, Homo sapiens
cacatcgcacactgg

SEQ ID NO: 5996419 - DNA, 16 bp, Homo sapiens
cacatcgccagccctg

SEQ ID NO: 5996420 - DNA, 14 bp, Homo sapiens
cacatcgggctcac

SEQ ID NO: 5996421 - DNA, 16 bp, Homo sapiens
cacatcgggctcacct

SEQ ID NO: 5996422 - DNA, 19 bp, Homo sapiens
cacatctaaagctttatct

SEQ ID NO: 5996423 - DNA, 17 bp, Homo sapiens
cacatctaaattgatca

SEQ ID NO: 5996424 - DNA, 17 bp, Homo sapiens
cacatctaagcctgaag

SEQ ID NO: 5996425 - DNA, 20 bp, Homo sapiens
cacatctacatgccatgcct

SEQ ID NO: 5996426 - DNA, 23 bp, Homo sapiens
cacatctagtagttgttctgaaa

SEQ ID NO: 5996427 - DNA, 23 bp, Homo sapiens
cacatctcaacaggcctcagggc

SEQ ID NO: 5996428 - DNA, 14 bp, Homo sapiens
cacatctcacctcc

SEQ ID NO: 5996429 - DNA, 11 bp, Homo sapiens
cacatctccag

SEQ ID NO: 5996430 - DNA, 12 bp, Homo sapiens
cacatctccaga

SEQ ID NO: 5996431 - DNA, 13 bp, Homo sapiens
cacatctccagaa

SEQ ID NO: 5996432 - DNA, 12 bp, Homo sapiens
cacatctccctt

SEQ ID NO: 5996433 - DNA, 13 bp, Homo sapiens
cacatctcccttc

SEQ ID NO: 5996434 - DNA, 22 bp, Homo sapiens
cacatctcccttccacctcaca

SEQ ID NO: 5996435 - DNA, 18 bp, Homo sapiens
cacatctctgtcagtgtg

SEQ ID NO: 5996436 - DNA, 19 bp, Homo sapiens
cacatctctgtcagtgtga

SEQ ID NO: 5996437 - DNA, 19 bp, Homo sapiens
cacatctgaatctccttgt

SEQ ID NO: 5996438 - DNA, 16 bp, Homo sapiens
cacatctgccagacct

SEQ ID NO: 5996439 - DNA, 19 bp, Homo sapiens
cacatctgctggtgggtgg

SEQ ID NO: 5996440 - DNA, 22 bp, Homo sapiens
cacatctggccctgacttctgg

SEQ ID NO: 5996441 - DNA, 19 bp, Homo sapiens
cacatctggctgcacaggc

SEQ ID NO: 5996442 - DNA, 20 bp, Homo sapiens
cacatctggctgcacaggct

SEQ ID NO: 5996443 - DNA, 22 bp, Homo sapiens
cacatctggctgcacaggctga

SEQ ID NO: 5996444 - DNA, 19 bp, Homo sapiens
cacatctgggtgccctgaa

SEQ ID NO: 5996445 - DNA, 12 bp, Homo sapiens
cacatctgtata

SEQ ID NO: 5996446 - DNA, 21 bp, Homo sapiens
cacatctgtcctcaccctgtg

SEQ ID NO: 5996447 - DNA, 14 bp, Homo sapiens
cacatctgtcctga

SEQ ID NO: 5996448 - DNA, 21 bp, Homo sapiens
cacatctgtggagatgcccag

SEQ ID NO: 5996449 - DNA, 17 bp, Homo sapiens
cacatctgtgtcttgtt

SEQ ID NO: 5996450 - DNA, 23 bp, Homo sapiens
cacatctgtgtcttgtttggaat

SEQ ID NO: 5996451 - DNA, 23 bp, Homo sapiens
cacatcttaaagctaaaaatgaa

SEQ ID NO: 5996452 - DNA, 20 bp, Homo sapiens
cacatcttaaattcatttct

SEQ ID NO: 5996453 - DNA, 12 bp, Homo sapiens
cacatcttattt

SEQ ID NO: 5996454 - DNA, 15 bp, Homo sapiens
cacatcttatttatt

SEQ ID NO: 5996455 - DNA, 16 bp, Homo sapiens
cacatcttatttattt

SEQ ID NO: 5996456 - DNA, 12 bp, Homo sapiens
cacatcttctca

SEQ ID NO: 5996457 - DNA, 17 bp, Homo sapiens
cacatcttgaaaatgcc

SEQ ID NO: 5996458 - DNA, 20 bp, Homo sapiens
cacatcttgaaaatgccacc

SEQ ID NO: 5996459 - DNA, 17 bp, Homo sapiens
cacatcttgctctgcat

SEQ ID NO: 5996460 - DNA, 17 bp, Homo sapiens
cacatcttgctctgctg

SEQ ID NO: 5996461 - DNA, 19 bp, Homo sapiens
cacatcttgctctgctgac

SEQ ID NO: 5996462 - DNA, 21 bp, Homo sapiens
cacatcttgctctgctgacag

SEQ ID NO: 5996463 - DNA, 20 bp, Homo sapiens
cagatcccagggtacactct

SEQ ID NO: 5996464 - DNA, 14 bp, Homo sapiens
cagatcccatccat

SEQ ID NO: 5996465 - DNA, 20 bp, Homo sapiens
cagatccccagcccctcctc

SEQ ID NO: 5996466 - DNA, 15 bp, Homo sapiens
cagatccgcatgtgt

SEQ ID NO: 5996467 - DNA, 21 bp, Homo sapiens
cagatccgcatgtgtctgtat

SEQ ID NO: 5996468 - DNA, 18 bp, Homo sapiens
cagatcctactcttcctt

SEQ ID NO: 5996469 - DNA, 16 bp, Homo sapiens
cagatcctcctcattc

SEQ ID NO: 5996470 - DNA, 23 bp, Homo sapiens
cagatcctcttctcaaagctggg

SEQ ID NO: 5996471 - DNA, 14 bp, Homo sapiens
cagatcctgctgcc

SEQ ID NO: 5996472 - DNA, 23 bp, Homo sapiens
cagatcctgggtactgaaagcct

SEQ ID NO: 5996473 - DNA, 19 bp, Homo sapiens
cagatcctgtcccatgggc

SEQ ID NO: 5996474 - DNA, 15 bp, Homo sapiens
cagatccttagagaa

SEQ ID NO: 5996475 - DNA, 12 bp, Homo sapiens
cagatccttcca

SEQ ID NO: 5996476 - DNA, 15 bp, Homo sapiens
cagatccttgtttca

SEQ ID NO: 5996477 - DNA, 20 bp, Homo sapiens
cagatcctttttccatcatt

SEQ ID NO: 5996478 - DNA, 17 bp, Homo sapiens
cagatcgaaattggact

SEQ ID NO: 5996479 - DNA, 15 bp, Homo sapiens
cagatcgatcctgga

SEQ ID NO: 5996480 - DNA, 16 bp, Homo sapiens
cagatcgcatttccta

SEQ ID NO: 5996481 - DNA, 17 bp, Homo sapiens
cagatcgcatttcctaa

SEQ ID NO: 5996482 - DNA, 18 bp, Homo sapiens
cagatcgcatttcctaag

SEQ ID NO: 5996483 - DNA, 16 bp, Homo sapiens
cagatcggccacaggg

SEQ ID NO: 5996484 - DNA, 19 bp, Homo sapiens
cagatctaccccttactta

SEQ ID NO: 5996485 - DNA, 18 bp, Homo sapiens
cagatctagccaggcctc

SEQ ID NO: 5996486 - DNA, 20 bp, Homo sapiens
cagatctagccaggcctccc

SEQ ID NO: 5996487 - DNA, 20 bp, Homo sapiens
cagatctattgtttgttgca

SEQ ID NO: 5996488 - DNA, 18 bp, Homo sapiens
cagatctcatcagggtag

SEQ ID NO: 5996489 - DNA, 15 bp, Homo sapiens
cagatctcccactgc

SEQ ID NO: 5996490 - DNA, 15 bp, Homo sapiens
cagatctcgggactc

SEQ ID NO: 5996491 - DNA, 13 bp, Homo sapiens
cagatctctaatt

SEQ ID NO: 5996492 - DNA, 20 bp, Homo sapiens
cagatctctctctctctcct

SEQ ID NO: 5996493 - DNA, 24 bp, Homo sapiens
cagatctgacatgattccttcctg

SEQ ID NO: 5996494 - DNA, 15 bp, Homo sapiens
cagatctgcaccgcc

SEQ ID NO: 5996495 - DNA, 22 bp, Homo sapiens
cagatctgcactcctgtctctt

SEQ ID NO: 5996496 - DNA, 13 bp, Homo sapiens
cagatctgcactg

SEQ ID NO: 5996497 - DNA, 16 bp, Homo sapiens
cagatctgcctaagga

SEQ ID NO: 5996498 - DNA, 17 bp, Homo sapiens
cagatctgcctaaggac

SEQ ID NO: 5996499 - DNA, 20 bp, Homo sapiens
cagatctgcctaaggacttc

SEQ ID NO: 5996500 - DNA, 12 bp, Homo sapiens
cagatctgcctg

SEQ ID NO: 5996501 - DNA, 13 bp, Homo sapiens
cagatctgcctgg

SEQ ID NO: 5996502 - DNA, 17 bp, Homo sapiens
cagatctgcctgggcct

SEQ ID NO: 5996503 - DNA, 20 bp, Homo sapiens
cagatctgcctgggcctgtg

SEQ ID NO: 5996504 - DNA, 22 bp, Homo sapiens
cagatctgcctgggcctgtgca

SEQ ID NO: 5996505 - DNA, 23 bp, Homo sapiens
cagatctgcctgggcctgtgcag

SEQ ID NO: 5996506 - DNA, 19 bp, Homo sapiens
cagatctggaacctcagcc

SEQ ID NO: 5996507 - DNA, 23 bp, Homo sapiens
cagatctggaacctcagcctggc

SEQ ID NO: 5996508 - DNA, 20 bp, Homo sapiens
cagatctggatcgttatcta

SEQ ID NO: 5996509 - DNA, 17 bp, Homo sapiens
cagatctggtcccttgc

SEQ ID NO: 5996510 - DNA, 16 bp, Homo sapiens
cagatctggtttctaa

SEQ ID NO: 5996511 - DNA, 19 bp, Homo sapiens
cagatctgtcctgggggat

SEQ ID NO: 5996512 - DNA, 18 bp, Homo sapiens
cagatctgtctgatagga

SEQ ID NO: 5996513 - DNA, 20 bp, Homo sapiens
cagatctgtgccccatgcct

SEQ ID NO: 5996514 - DNA, 14 bp, Homo sapiens
cagatctgtgcctg

SEQ ID NO: 5996515 - DNA, 17 bp, Homo sapiens
cagatctgtgcctggga

SEQ ID NO: 5996516 - DNA, 15 bp, Homo sapiens
cagatcttaatataa

SEQ ID NO: 5996517 - DNA, 18 bp, Homo sapiens
cagatcttaatataaatt

SEQ ID NO: 5996518 - DNA, 12 bp, Homo sapiens
cagatcttacaa

SEQ ID NO: 5996519 - DNA, 22 bp, Homo sapiens
cagatcttccgtggtcagagtg

SEQ ID NO: 5996520 - DNA, 14 bp, Homo sapiens
cagatcttcttttg

SEQ ID NO: 5996521 - DNA, 23 bp, Homo sapiens
cagatcttgacagtatatttgaa

SEQ ID NO: 5996522 - DNA, 14 bp, Homo sapiens
cagatcttgcctcc

SEQ ID NO: 5996523 - DNA, 14 bp, Homo sapiens
cagatcttggactc

SEQ ID NO: 5996524 - DNA, 15 bp, Homo sapiens
cagatcttggactca

SEQ ID NO: 5996525 - DNA, 20 bp, Homo sapiens
cagatcttggactcatgagg

SEQ ID NO: 5996526 - DNA, 20 bp, Homo sapiens
cagatctttcagaaatataa

SEQ ID NO: 5996527 - DNA, 14 bp, Homo sapiens
cagatctttctctt

SEQ ID NO: 5996528 - DNA, 15 bp, Homo sapiens
cagatctttctcttc

SEQ ID NO: 5996529 - DNA, 15 bp, Homo sapiens
cagatctttttgtga

SEQ ID NO: 5996530 - DNA, 17 bp, Homo sapiens
cagatgaaaagaaaact

SEQ ID NO: 5996531 - DNA, 13 bp, Homo sapiens
cagatgaaaataa

SEQ ID NO: 5996532 - DNA, 14 bp, Homo sapiens
cagatgaaaataaa

SEQ ID NO: 5996533 - DNA, 15 bp, Homo sapiens
cagatgaaaatttga

SEQ ID NO: 5996534 - DNA, 20 bp, Homo sapiens
cagatgaaatgttctgttca

SEQ ID NO: 5996535 - DNA, 14 bp, Homo sapiens
cagatgaacatttc

SEQ ID NO: 5996536 - DNA, 20 bp, Homo sapiens
cagatgaactcttagaaatg

SEQ ID NO: 5996537 - DNA, 20 bp, Homo sapiens
cagatgaactgactgaagga

SEQ ID NO: 5996538 - DNA, 20 bp, Homo sapiens
cagatgaagaaggagcagaa

SEQ ID NO: 5996539 - DNA, 22 bp, Homo sapiens
cagatgaagtaactgaggctta

SEQ ID NO: 5996540 - DNA, 13 bp, Homo sapiens
cagatgaataaac

SEQ ID NO: 5996541 - DNA, 14 bp, Homo sapiens
cagatgaataaact

SEQ ID NO: 5996542 - DNA, 15 bp, Homo sapiens
cagatgaatgtattt

SEQ ID NO: 5996543 - DNA, 19 bp, Homo sapiens
cagatgaatgtatttattt

SEQ ID NO: 5996544 - DNA, 17 bp, Homo sapiens
cagatgaattgataaaa

SEQ ID NO: 5996545 - DNA, 17 bp, Homo sapiens
cagatgacaacagccgt

SEQ ID NO: 5996546 - DNA, 16 bp, Homo sapiens
cagatgacaagatggt

SEQ ID NO: 5996547 - DNA, 13 bp, Homo sapiens
cagatgacccctc

SEQ ID NO: 5996548 - DNA, 14 bp, Homo sapiens
cagatgacccctcc

SEQ ID NO: 5996549 - DNA, 18 bp, Homo sapiens
cagatgacccctgcccag

SEQ ID NO: 5996550 - DNA, 19 bp, Homo sapiens
cagatgacccctgcccaga

SEQ ID NO: 5996551 - DNA, 23 bp, Homo sapiens
cagatgacccctgcccagatcag

SEQ ID NO: 5996552 - DNA, 17 bp, Homo sapiens
cagatgaccgtgtacaa

SEQ ID NO: 5996553 - DNA, 18 bp, Homo sapiens
cagatgaccgtgtacaat

SEQ ID NO: 5996554 - DNA, 21 bp, Homo sapiens
cagatgacctcgtactcagga

SEQ ID NO: 5996555 - DNA, 22 bp, Homo sapiens
cagatgacctcgtactcaggag

SEQ ID NO: 5996556 - DNA, 23 bp, Homo sapiens
cagatgacctcgtactcaggagc

SEQ ID NO: 5996557 - DNA, 16 bp, Homo sapiens
cagatgactctctcca

SEQ ID NO: 5996558 - DNA, 14 bp, Homo sapiens
cagatgagaagtta

SEQ ID NO: 5996559 - DNA, 21 bp, Homo sapiens
cagatgagaagttaagcagcc

SEQ ID NO: 5996560 - DNA, 16 bp, Homo sapiens
cagatgagagtttctg

SEQ ID NO: 5996561 - DNA, 17 bp, Homo sapiens
cagatgagatccgggag

SEQ ID NO: 5996562 - DNA, 18 bp, Homo sapiens
cagatgagattccctctc

SEQ ID NO: 5996563 - DNA, 15 bp, Homo sapiens
cagatgagcaaggac

SEQ ID NO: 5996564 - DNA, 16 bp, Homo sapiens
cagatgagcaaggaca

SEQ ID NO: 5996565 - DNA, 17 bp, Homo sapiens
cagatgagcaaggacat

SEQ ID NO: 5996566 - DNA, 18 bp, Homo sapiens
cagatgagcaaggacatt

SEQ ID NO: 5996567 - DNA, 19 bp, Homo sapiens
cagatgagcaaggacattg

SEQ ID NO: 5996568 - DNA, 20 bp, Homo sapiens
cagatgagcaaggacattgc

SEQ ID NO: 5996569 - DNA, 20 bp, Homo sapiens
cagatgagcagaagctctcg

SEQ ID NO: 5996570 - DNA, 14 bp, Homo sapiens
cagatgagcaggag

SEQ ID NO: 5996571 - DNA, 16 bp, Homo sapiens
cagatgagcaggagct

SEQ ID NO: 5996572 - DNA, 22 bp, Homo sapiens
cagatgagcagtcacactgtta

SEQ ID NO: 5996573 - DNA, 12 bp, Homo sapiens
cagatgagctgt

SEQ ID NO: 5996574 - DNA, 22 bp, Homo sapiens
cagatgaggagcagctggggta

SEQ ID NO: 5996575 - DNA, 18 bp, Homo sapiens
cagatgaggcaaacagca

SEQ ID NO: 5996576 - DNA, 17 bp, Homo sapiens
cagatgaggccctgcac

SEQ ID NO: 5996577 - DNA, 18 bp, Homo sapiens
cagatgaggccctgcacc

SEQ ID NO: 5996578 - DNA, 19 bp, Homo sapiens
cagatgaggccctgcacct

SEQ ID NO: 5996579 - DNA, 16 bp, Homo sapiens
cagatgaggctttcca

SEQ ID NO: 5996580 - DNA, 13 bp, Homo sapiens
cagatgagggctg

SEQ ID NO: 5996581 - DNA, 15 bp, Homo sapiens
cagatgaggggccac

SEQ ID NO: 5996582 - DNA, 19 bp, Homo sapiens
cagatgaggtgaaaaggcc

SEQ ID NO: 5996583 - DNA, 16 bp, Homo sapiens
cagatgagtcctcggt

SEQ ID NO: 5996584 - DNA, 23 bp, Homo sapiens
cagatgatagtccaatttttact

SEQ ID NO: 5996585 - DNA, 22 bp, Homo sapiens
cagatgatccttgcacagacaa

SEQ ID NO: 5996586 - DNA, 23 bp, Homo sapiens
cagatgatgccaacctctggagc

SEQ ID NO: 5996587 - DNA, 15 bp, Homo sapiens
cagatgatgccagct

SEQ ID NO: 5996588 - DNA, 17 bp, Homo sapiens
cagatgatgctttggaa

SEQ ID NO: 5996589 - DNA, 13 bp, Homo sapiens
cagatgatggcca

SEQ ID NO: 5996590 - DNA, 19 bp, Homo sapiens
cagatgatggggtcagcag

SEQ ID NO: 5996591 - DNA, 19 bp, Homo sapiens
cagatgatgtaaaaatatg

SEQ ID NO: 5996592 - DNA, 19 bp, Homo sapiens
cagatgattcaaatatcaa

SEQ ID NO: 5996593 - DNA, 17 bp, Homo sapiens
cagatgattttcctccc

SEQ ID NO: 5996594 - DNA, 23 bp, Homo sapiens
cagatgcaaagaggcaagaggct

SEQ ID NO: 5996595 - DNA, 14 bp, Homo sapiens
cagatgcaagcaag

SEQ ID NO: 5996596 - DNA, 19 bp, Homo sapiens
cagatgcaattgctcccat

SEQ ID NO: 5996597 - DNA, 15 bp, Homo sapiens
cagatgcacacacag

SEQ ID NO: 5996598 - DNA, 17 bp, Homo sapiens
cagatgcacatgagctg

SEQ ID NO: 5996599 - DNA, 13 bp, Homo sapiens
cagatgcaccagc

SEQ ID NO: 5996600 - DNA, 16 bp, Homo sapiens
cagatgcaccagccct

SEQ ID NO: 5996601 - DNA, 16 bp, Homo sapiens
cagatgcagagagcca

SEQ ID NO: 5996602 - DNA, 23 bp, Homo sapiens
cagatgcagctcttcctggacag

SEQ ID NO: 5996603 - DNA, 21 bp, Homo sapiens
cagatgcagttttcaaattat

SEQ ID NO: 5996604 - DNA, 14 bp, Homo sapiens
cagatgccaacttc

SEQ ID NO: 5996605 - DNA, 16 bp, Homo sapiens
cagatgccacacctgc

SEQ ID NO: 5996606 - DNA, 18 bp, Homo sapiens
cagatgccagagcaaagg

SEQ ID NO: 5996607 - DNA, 14 bp, Homo sapiens
cagatgccagtgaa

SEQ ID NO: 5996608 - DNA, 15 bp, Homo sapiens
cagatgccagtgaag

SEQ ID NO: 5996609 - DNA, 22 bp, Homo sapiens
cagatgccatggcctgtgctgg

SEQ ID NO: 5996610 - DNA, 15 bp, Homo sapiens
cagatgcccagaggg

SEQ ID NO: 5996611 - DNA, 15 bp, Homo sapiens
cagatgccccagagc

SEQ ID NO: 5996612 - DNA, 16 bp, Homo sapiens
cagatgcccttgctgg

SEQ ID NO: 5996613 - DNA, 21 bp, Homo sapiens
cagatgcccttgctgggcctg

SEQ ID NO: 5996614 - DNA, 14 bp, Homo sapiens
cagatgccggagcc

SEQ ID NO: 5996615 - DNA, 17 bp, Homo sapiens
cagatgcctacttttgg

SEQ ID NO: 5996616 - DNA, 18 bp, Homo sapiens
cagatgcctacttttggc

SEQ ID NO: 5996617 - DNA, 13 bp, Homo sapiens
cagatgcctcccc

SEQ ID NO: 5996618 - DNA, 18 bp, Homo sapiens
cagatgcctcctctgtcc

SEQ ID NO: 5996619 - DNA, 14 bp, Homo sapiens
cagatgcctccttc

SEQ ID NO: 5996620 - DNA, 19 bp, Homo sapiens
cagatgcctgcttgataat

SEQ ID NO: 5996621 - DNA, 15 bp, Homo sapiens
cagatgcggggacag

SEQ ID NO: 5996622 - DNA, 16 bp, Homo sapiens
cagatgcggggacagg

SEQ ID NO: 5996623 - DNA, 21 bp, Homo sapiens
cagatgctaaaatccctggat

SEQ ID NO: 5996624 - DNA, 18 bp, Homo sapiens
cagatgctaataaactgt

SEQ ID NO: 5996625 - DNA, 23 bp, Homo sapiens
cagatgctagcgcgttgcctgtc

SEQ ID NO: 5996626 - DNA, 18 bp, Homo sapiens
cagatgctaggctgtctg

SEQ ID NO: 5996627 - DNA, 24 bp, Homo sapiens
cagatgctaggctgtctgcgaaga

SEQ ID NO: 5996628 - DNA, 16 bp, Homo sapiens
cagatgctccaagatt

SEQ ID NO: 5996629 - DNA, 18 bp, Homo sapiens
cagatgctccaagattct

SEQ ID NO: 5996630 - DNA, 13 bp, Homo sapiens
cagatgctctgag

SEQ ID NO: 5996631 - DNA, 12 bp, Homo sapiens
cagatgctgaat

SEQ ID NO: 5996632 - DNA, 13 bp, Homo sapiens
cagatgctgatgt

SEQ ID NO: 5996633 - DNA, 14 bp, Homo sapiens
cagatgctgatgtt

SEQ ID NO: 5996634 - DNA, 15 bp, Homo sapiens
cagatgctgatgttc

SEQ ID NO: 5996635 - DNA, 16 bp, Homo sapiens
cagatgctgctgaaga

SEQ ID NO: 5996636 - DNA, 17 bp, Homo sapiens
cagatgctgctgaagag

SEQ ID NO: 5996637 - DNA, 18 bp, Homo sapiens
cagatgctgctgaagaga

SEQ ID NO: 5996638 - DNA, 20 bp, Homo sapiens
cagatgctggcctcttggca

SEQ ID NO: 5996639 - DNA, 20 bp, Homo sapiens
cagatgctggtcatcctggg

SEQ ID NO: 5996640 - DNA, 22 bp, Homo sapiens
cagatgctggtcatcctgggca

SEQ ID NO: 5996641 - DNA, 23 bp, Homo sapiens
cagatgctggtcatcctgggcat

SEQ ID NO: 5996642 - DNA, 21 bp, Homo sapiens
cacatcttggctatgtaattc

SEQ ID NO: 5996643 - DNA, 16 bp, Homo sapiens
cacatctttactcagg

SEQ ID NO: 5996644 - DNA, 15 bp, Homo sapiens
cacatctttatctgt

SEQ ID NO: 5996645 - DNA, 15 bp, Homo sapiens
cacatctttcctgtc

SEQ ID NO: 5996646 - DNA, 18 bp, Homo sapiens
cacatcttttggtgatcg

SEQ ID NO: 5996647 - DNA, 15 bp, Homo sapiens
cacatgaaacattat

SEQ ID NO: 5996648 - DNA, 23 bp, Homo sapiens
cacatgaaacattattttaattg

SEQ ID NO: 5996649 - DNA, 21 bp, Homo sapiens
cacatgaaacctacacactgt

SEQ ID NO: 5996650 - DNA, 13 bp, Homo sapiens
cacatgaaagttt

SEQ ID NO: 5996651 - DNA, 18 bp, Homo sapiens
cacatgaacagcttgcca

SEQ ID NO: 5996652 - DNA, 23 bp, Homo sapiens
cacatgaaccatccttcccatga

SEQ ID NO: 5996653 - DNA, 21 bp, Homo sapiens
cacatgaacttagattttaca

SEQ ID NO: 5996654 - DNA, 13 bp, Homo sapiens
cacatgaagaaat

SEQ ID NO: 5996655 - DNA, 20 bp, Homo sapiens
cacatgaaggagacagcagc

SEQ ID NO: 5996656 - DNA, 14 bp, Homo sapiens
cacatgaatgcagt

SEQ ID NO: 5996657 - DNA, 23 bp, Homo sapiens
cacatgaatgcagtcatgcaaac

SEQ ID NO: 5996658 - DNA, 22 bp, Homo sapiens
cacatgaattattacagtgttt

SEQ ID NO: 5996659 - DNA, 16 bp, Homo sapiens
cacatgaatttctgcc

SEQ ID NO: 5996660 - DNA, 21 bp, Homo sapiens
cacatgacaactttgccagct

SEQ ID NO: 5996661 - DNA, 20 bp, Homo sapiens
cacatgacatccacatgcac

SEQ ID NO: 5996662 - DNA, 24 bp, Homo sapiens
cacatgacatccacatgcacatgt

SEQ ID NO: 5996663 - DNA, 13 bp, Homo sapiens
cacatgacctcca

SEQ ID NO: 5996664 - DNA, 14 bp, Homo sapiens
cacatgacctccat

SEQ ID NO: 5996665 - DNA, 18 bp, Homo sapiens
cacatgacctccatttcc

SEQ ID NO: 5996666 - DNA, 16 bp, Homo sapiens
cacatgagataatatg

SEQ ID NO: 5996667 - DNA, 21 bp, Homo sapiens
cacatgagatctaggtgagga

SEQ ID NO: 5996668 - DNA, 19 bp, Homo sapiens
cacatgagcatcaggccag

SEQ ID NO: 5996669 - DNA, 15 bp, Homo sapiens
cacatgaggccatct

SEQ ID NO: 5996670 - DNA, 21 bp, Homo sapiens
cacatgaggccatctcaggag

SEQ ID NO: 5996671 - DNA, 14 bp, Homo sapiens
cacatgagtcccag

SEQ ID NO: 5996672 - DNA, 18 bp, Homo sapiens
cacatgagtcccagtggg

SEQ ID NO: 5996673 - DNA, 12 bp, Homo sapiens
cacatgatcatg

SEQ ID NO: 5996674 - DNA, 15 bp, Homo sapiens
cacatgattgtataa

SEQ ID NO: 5996675 - DNA, 18 bp, Homo sapiens
cacatgattgtataagca

SEQ ID NO: 5996676 - DNA, 12 bp, Homo sapiens
cacatgatttca

SEQ ID NO: 5996677 - DNA, 16 bp, Homo sapiens
cacatgatttcacaaa

SEQ ID NO: 5996678 - DNA, 19 bp, Homo sapiens
cacatgatttcacaaatat

SEQ ID NO: 5996679 - DNA, 14 bp, Homo sapiens
cacatgatttgggc

SEQ ID NO: 5996680 - DNA, 17 bp, Homo sapiens
cacatgatttgggctct

SEQ ID NO: 5996681 - DNA, 14 bp, Homo sapiens
cacatgattttctt

SEQ ID NO: 5996682 - DNA, 17 bp, Homo sapiens
cacatgcaaggtcattt

SEQ ID NO: 5996683 - DNA, 15 bp, Homo sapiens
cacatgcacatgtat

SEQ ID NO: 5996684 - DNA, 16 bp, Homo sapiens
cacatgcactcagtgt

SEQ ID NO: 5996685 - DNA, 15 bp, Homo sapiens
cacatgcagaataat

SEQ ID NO: 5996686 - DNA, 15 bp, Homo sapiens
cacatgcatacacac

SEQ ID NO: 5996687 - DNA, 17 bp, Homo sapiens
cacatgcatacacacac

SEQ ID NO: 5996688 - DNA, 15 bp, Homo sapiens
cacatgcatggcatt

SEQ ID NO: 5996689 - DNA, 16 bp, Homo sapiens
cacatgcatgtctgcc

SEQ ID NO: 5996690 - DNA, 23 bp, Homo sapiens
cacatgcatgtctgcctatgcac

SEQ ID NO: 5996691 - DNA, 15 bp, Homo sapiens
cacatgccactatga

SEQ ID NO: 5996692 - DNA, 16 bp, Homo sapiens
cacatgccactgcctg

SEQ ID NO: 5996693 - DNA, 14 bp, Homo sapiens
cacatgccccaggc

SEQ ID NO: 5996694 - DNA, 17 bp, Homo sapiens
cacatgcccccacttcc

SEQ ID NO: 5996695 - DNA, 15 bp, Homo sapiens
cacatgcccctcccc

SEQ ID NO: 5996696 - DNA, 19 bp, Homo sapiens
cacatgcccctcccccagc

SEQ ID NO: 5996697 - DNA, 20 bp, Homo sapiens
cacatgcccctcccccagct

SEQ ID NO: 5996698 - DNA, 23 bp, Homo sapiens
cacatgcccctcccccagctgcg

SEQ ID NO: 5996699 - DNA, 23 bp, Homo sapiens
cacatgccccttggtcctggcag

SEQ ID NO: 5996700 - DNA, 19 bp, Homo sapiens
cacatgccctaatgtctgt

SEQ ID NO: 5996701 - DNA, 21 bp, Homo sapiens
cacatgccgcgggcggccagg

SEQ ID NO: 5996702 - DNA, 16 bp, Homo sapiens
cacatgcctatattat

SEQ ID NO: 5996703 - DNA, 19 bp, Homo sapiens
cacatgcctatattatcat

SEQ ID NO: 5996704 - DNA, 17 bp, Homo sapiens
cacatgcctctctcagg

SEQ ID NO: 5996705 - DNA, 20 bp, Homo sapiens
cacatgcctctctcaggcca

SEQ ID NO: 5996706 - DNA, 21 bp, Homo sapiens
cacatgcctgcgcctgctgcc

SEQ ID NO: 5996707 - DNA, 18 bp, Homo sapiens
cacatgcggagaacaaat

SEQ ID NO: 5996708 - DNA, 16 bp, Homo sapiens
cacatgcgtatatgtg

SEQ ID NO: 5996709 - DNA, 21 bp, Homo sapiens
cacatgcgtatatgtgcgtct

SEQ ID NO: 5996710 - DNA, 18 bp, Homo sapiens
cacatgctaaagccagga

SEQ ID NO: 5996711 - DNA, 21 bp, Homo sapiens
cacatgctatgttctgtcttc

SEQ ID NO: 5996712 - DNA, 22 bp, Homo sapiens
cacatgctcaatgactctctgg

SEQ ID NO: 5996713 - DNA, 20 bp, Homo sapiens
cacatgctcaggctactata

SEQ ID NO: 5996714 - DNA, 22 bp, Homo sapiens
cacatgctctgcagtcctggcc

SEQ ID NO: 5996715 - DNA, 19 bp, Homo sapiens
cacatgctgaggttttgaa

SEQ ID NO: 5996716 - DNA, 21 bp, Homo sapiens
cacatgctgaggttttgaata

SEQ ID NO: 5996717 - DNA, 21 bp, Homo sapiens
cacatgctgagtctcccaagg

SEQ ID NO: 5996718 - DNA, 22 bp, Homo sapiens
cacatgctgagtctcccaaggc

SEQ ID NO: 5996719 - DNA, 12 bp, Homo sapiens
cacatgctggcc

SEQ ID NO: 5996720 - DNA, 16 bp, Homo sapiens
cacatgctggccagcc

SEQ ID NO: 5996721 - DNA, 13 bp, Homo sapiens
cacatgctggctc

SEQ ID NO: 5996722 - DNA, 23 bp, Homo sapiens
cacatgcttagcttatctttctt

SEQ ID NO: 5996723 - DNA, 20 bp, Homo sapiens
cacatgcttccctttcctga

SEQ ID NO: 5996724 - DNA, 17 bp, Homo sapiens
cacatgctttgtttcca

SEQ ID NO: 5996725 - DNA, 14 bp, Homo sapiens
cacatggaaaaaaa

SEQ ID NO: 5996726 - DNA, 17 bp, Homo sapiens
cacatggaaacccatag

SEQ ID NO: 5996727 - DNA, 18 bp, Homo sapiens
cacatggaagcccaactg

SEQ ID NO: 5996728 - DNA, 23 bp, Homo sapiens
cacatggaaggcggcacagaggc

SEQ ID NO: 5996729 - DNA, 19 bp, Homo sapiens
cacatggaatctacatgtg

SEQ ID NO: 5996730 - DNA, 20 bp, Homo sapiens
cacatggaatctacatgtgt

SEQ ID NO: 5996731 - DNA, 19 bp, Homo sapiens
cacatggaatgagggtttg

SEQ ID NO: 5996732 - DNA, 23 bp, Homo sapiens
cacatggacagacttcacagcgt

SEQ ID NO: 5996733 - DNA, 21 bp, Homo sapiens
cacatggacccaagataaaag

SEQ ID NO: 5996734 - DNA, 23 bp, Homo sapiens
cacatggactttggaaaatattt

SEQ ID NO: 5996735 - DNA, 13 bp, Homo sapiens
cacatggagctct

SEQ ID NO: 5996736 - DNA, 17 bp, Homo sapiens
cacatggagctcttcca

SEQ ID NO: 5996737 - DNA, 21 bp, Homo sapiens
cacatggagtgcttctggaac

SEQ ID NO: 5996738 - DNA, 15 bp, Homo sapiens
cacatggatgagcac

SEQ ID NO: 5996739 - DNA, 21 bp, Homo sapiens
cacatggcacttggaagaaaa

SEQ ID NO: 5996740 - DNA, 21 bp, Homo sapiens
cacatggccatagaggcccag

SEQ ID NO: 5996741 - DNA, 23 bp, Homo sapiens
cacatggccatagaggcccaggc

SEQ ID NO: 5996742 - DNA, 17 bp, Homo sapiens
cacatggccatcttctt

SEQ ID NO: 5996743 - DNA, 21 bp, Homo sapiens
cacatggccatcttctttctt

SEQ ID NO: 5996744 - DNA, 15 bp, Homo sapiens
cacatggcctatgca

SEQ ID NO: 5996745 - DNA, 23 bp, Homo sapiens
cacatggcctgagcatccagacc

SEQ ID NO: 5996746 - DNA, 14 bp, Homo sapiens
cacatggcttcctc

SEQ ID NO: 5996747 - DNA, 18 bp, Homo sapiens
cacatggcttcctcctgc

SEQ ID NO: 5996748 - DNA, 19 bp, Homo sapiens
cacatggcttcctcctgcg

SEQ ID NO: 5996749 - DNA, 20 bp, Homo sapiens
cacatggcttcctcctgcgc

SEQ ID NO: 5996750 - DNA, 15 bp, Homo sapiens
cacatgggactggga

SEQ ID NO: 5996751 - DNA, 23 bp, Homo sapiens
cacatgggagcagtccatgcatg

SEQ ID NO: 5996752 - DNA, 14 bp, Homo sapiens
cacatgggcagccc

SEQ ID NO: 5996753 - DNA, 13 bp, Homo sapiens
cacatgggctggg

SEQ ID NO: 5996754 - DNA, 15 bp, Homo sapiens
cacatgggctggggg

SEQ ID NO: 5996755 - DNA, 16 bp, Homo sapiens
cacatgggctgggggc

SEQ ID NO: 5996756 - DNA, 20 bp, Homo sapiens
cacatggggctgggcagcta

SEQ ID NO: 5996757 - DNA, 16 bp, Homo sapiens
cacatgggtactgtct

SEQ ID NO: 5996758 - DNA, 22 bp, Homo sapiens
cacatgggtactgtctcggcag

SEQ ID NO: 5996759 - DNA, 14 bp, Homo sapiens
cacatggtaacatt

SEQ ID NO: 5996760 - DNA, 21 bp, Homo sapiens
cacatggtccatttcatgtga

SEQ ID NO: 5996761 - DNA, 22 bp, Homo sapiens
cacatggtgacttttgaaaaga

SEQ ID NO: 5996762 - DNA, 12 bp, Homo sapiens
cacatggtgatg

SEQ ID NO: 5996763 - DNA, 14 bp, Homo sapiens
cacatggtgtctcc

SEQ ID NO: 5996764 - DNA, 22 bp, Homo sapiens
cacatggtgtctcccaacatgg

SEQ ID NO: 5996765 - DNA, 19 bp, Homo sapiens
cacatggtttaaatatgaa

SEQ ID NO: 5996766 - DNA, 22 bp, Homo sapiens
cacatggtttaaatatgaatga

SEQ ID NO: 5996767 - DNA, 12 bp, Homo sapiens
cacatgtacata

SEQ ID NO: 5996768 - DNA, 23 bp, Homo sapiens
cacatgtacataaactgtcactc

SEQ ID NO: 5996769 - DNA, 17 bp, Homo sapiens
cacatgtatctatgcat

SEQ ID NO: 5996770 - DNA, 19 bp, Homo sapiens
cacatgtatgttttggtat

SEQ ID NO: 5996771 - DNA, 14 bp, Homo sapiens
cacatgtattctgt

SEQ ID NO: 5996772 - DNA, 21 bp, Homo sapiens
cacatgtattgctgtttttct

SEQ ID NO: 5996773 - DNA, 12 bp, Homo sapiens
cacatgtcaccg

SEQ ID NO: 5996774 - DNA, 20 bp, Homo sapiens
cacatgtcaccgtggacctt

SEQ ID NO: 5996775 - DNA, 23 bp, Homo sapiens
cacatgtcaccgtggaccttcct

SEQ ID NO: 5996776 - DNA, 19 bp, Homo sapiens
cacatgtcagccactgtga

SEQ ID NO: 5996777 - DNA, 21 bp, Homo sapiens
cacatgtcattgcccacttct

SEQ ID NO: 5996778 - DNA, 22 bp, Homo sapiens
cacatgtcattgcccacttctg

SEQ ID NO: 5996779 - DNA, 17 bp, Homo sapiens
cacatgtccaagaagcc

SEQ ID NO: 5996780 - DNA, 18 bp, Homo sapiens
cacatgtccaagaagccc

SEQ ID NO: 5996781 - DNA, 16 bp, Homo sapiens
cacatgtccagcacct

SEQ ID NO: 5996782 - DNA, 12 bp, Homo sapiens
cacatgtccagt

SEQ ID NO: 5996783 - DNA, 21 bp, Homo sapiens
cacatgtcccagatcgtctcc

SEQ ID NO: 5996784 - DNA, 21 bp, Homo sapiens
cacatgtctgtcctcagagca

SEQ ID NO: 5996785 - DNA, 22 bp, Homo sapiens
cacatgtctgtcctcagagcag

SEQ ID NO: 5996786 - DNA, 14 bp, Homo sapiens
cacatgtcttaatg

SEQ ID NO: 5996787 - DNA, 15 bp, Homo sapiens
cacatgtcttaatga

SEQ ID NO: 5996788 - DNA, 18 bp, Homo sapiens
cacatgtcttaatgaagt

SEQ ID NO: 5996789 - DNA, 18 bp, Homo sapiens
cacatgtgaaaagcttaa

SEQ ID NO: 5996790 - DNA, 13 bp, Homo sapiens
cacatgtgacaca

SEQ ID NO: 5996791 - DNA, 17 bp, Homo sapiens
cacatgtgccacacagt

SEQ ID NO: 5996792 - DNA, 16 bp, Homo sapiens
cacatgtgccctgcct

SEQ ID NO: 5996793 - DNA, 14 bp, Homo sapiens
cacatgtgctgccc

SEQ ID NO: 5996794 - DNA, 18 bp, Homo sapiens
cacatgtggagaaggtga

SEQ ID NO: 5996795 - DNA, 17 bp, Homo sapiens
cacatgtggccatggcc

SEQ ID NO: 5996796 - DNA, 20 bp, Homo sapiens
cacatgtggctccccctgaa

SEQ ID NO: 5996797 - DNA, 16 bp, Homo sapiens
cacatgtgtccatccc

SEQ ID NO: 5996798 - DNA, 19 bp, Homo sapiens
cacatgtgtccatcccagc

SEQ ID NO: 5996799 - DNA, 19 bp, Homo sapiens
cacatgtgtctgtgtggta

SEQ ID NO: 5996800 - DNA, 15 bp, Homo sapiens
cacatgtgttatcta

SEQ ID NO: 5996801 - DNA, 14 bp, Homo sapiens
cacatgttggagga

SEQ ID NO: 5996802 - DNA, 21 bp, Homo sapiens
cacatgtttagagttgcaatc

SEQ ID NO: 5996803 - DNA, 16 bp, Homo sapiens
cacatgttttacaaag

SEQ ID NO: 5996804 - DNA, 18 bp, Homo sapiens
cacatgttttcaaatgga

SEQ ID NO: 5996805 - DNA, 13 bp, Homo sapiens
cacatgtttttat

SEQ ID NO: 5996806 - DNA, 17 bp, Homo sapiens
cacattaaaaaggaaag

SEQ ID NO: 5996807 - DNA, 21 bp, Homo sapiens
cacattaaaagacaaatatgt

SEQ ID NO: 5996808 - DNA, 12 bp, Homo sapiens
cacattaaagaa

SEQ ID NO: 5996809 - DNA, 12 bp, Homo sapiens
cacattaaagta

SEQ ID NO: 5996810 - DNA, 13 bp, Homo sapiens
cacattaaatgac

SEQ ID NO: 5996811 - DNA, 20 bp, Homo sapiens
cacattaacattttgagcta

SEQ ID NO: 5996812 - DNA, 23 bp, Homo sapiens
cacattaacattttgagctattt

SEQ ID NO: 5996813 - DNA, 21 bp, Homo sapiens
cacattaacccccaaattcaa

SEQ ID NO: 5996814 - DNA, 22 bp, Homo sapiens
cacattaacccccaaattcaaa

SEQ ID NO: 5996815 - DNA, 13 bp, Homo sapiens
cacattaactcag

SEQ ID NO: 5996816 - DNA, 19 bp, Homo sapiens
cacattaactcaggcattt

SEQ ID NO: 5996817 - DNA, 16 bp, Homo sapiens
cacattaactccctcc

SEQ ID NO: 5996818 - DNA, 17 bp, Homo sapiens
cacattaactccctcca

SEQ ID NO: 5996819 - DNA, 14 bp, Homo sapiens
cagatgctggtgga

SEQ ID NO: 5996820 - DNA, 17 bp, Homo sapiens
cagatgctgtcattagt

SEQ ID NO: 5996821 - DNA, 22 bp, Homo sapiens
cagatgctgttgtgaagctaat

SEQ ID NO: 5996822 - DNA, 17 bp, Homo sapiens
cagatgcttctgggaga

SEQ ID NO: 5996823 - DNA, 20 bp, Homo sapiens
cagatgctttgcccaggctt

SEQ ID NO: 5996824 - DNA, 15 bp, Homo sapiens
cagatgcttttgcta

SEQ ID NO: 5996825 - DNA, 17 bp, Homo sapiens
cagatgcttttgtgaga

SEQ ID NO: 5996826 - DNA, 23 bp, Homo sapiens
cagatgcttttgtgagaaaggga

SEQ ID NO: 5996827 - DNA, 21 bp, Homo sapiens
cagatggaaaattcatttttt

SEQ ID NO: 5996828 - DNA, 20 bp, Homo sapiens
cagatggaaagaggtgaaaa

SEQ ID NO: 5996829 - DNA, 14 bp, Homo sapiens
cagatggaaaggag

SEQ ID NO: 5996830 - DNA, 17 bp, Homo sapiens
cagatggaaatattttg

SEQ ID NO: 5996831 - DNA, 18 bp, Homo sapiens
cagatggaaccgcaggaa

SEQ ID NO: 5996832 - DNA, 19 bp, Homo sapiens
cagatggaagagataaacg

SEQ ID NO: 5996833 - DNA, 21 bp, Homo sapiens
cagatggaagagataaacgac

SEQ ID NO: 5996834 - DNA, 21 bp, Homo sapiens
cagatggaagcttactctctg

SEQ ID NO: 5996835 - DNA, 17 bp, Homo sapiens
cagatggaatgctgtgt

SEQ ID NO: 5996836 - DNA, 13 bp, Homo sapiens
cagatggacactg

SEQ ID NO: 5996837 - DNA, 14 bp, Homo sapiens
cagatggacactgc

SEQ ID NO: 5996838 - DNA, 19 bp, Homo sapiens
cagatggacagcgatgagg

SEQ ID NO: 5996839 - DNA, 11 bp, Homo sapiens
cagatggacca

SEQ ID NO: 5996840 - DNA, 13 bp, Homo sapiens
cagatggaccaaa

SEQ ID NO: 5996841 - DNA, 14 bp, Homo sapiens
cagatggaccaaaa

SEQ ID NO: 5996842 - DNA, 21 bp, Homo sapiens
cagatggaccaaaagatgggt

SEQ ID NO: 5996843 - DNA, 18 bp, Homo sapiens
cagatggacgcaggccct

SEQ ID NO: 5996844 - DNA, 18 bp, Homo sapiens
cagatggactccagcctg

SEQ ID NO: 5996845 - DNA, 19 bp, Homo sapiens
cagatggactccagcctgc

SEQ ID NO: 5996846 - DNA, 16 bp, Homo sapiens
cagatggacttgaaaa

SEQ ID NO: 5996847 - DNA, 15 bp, Homo sapiens
cagatggagatcaga

SEQ ID NO: 5996848 - DNA, 18 bp, Homo sapiens
cagatggagcaaatgtcc

SEQ ID NO: 5996849 - DNA, 19 bp, Homo sapiens
cagatggaggttctcagag

SEQ ID NO: 5996850 - DNA, 11 bp, Homo sapiens
cagatggatgt

SEQ ID NO: 5996851 - DNA, 18 bp, Homo sapiens
cagatggatgtagataca

SEQ ID NO: 5996852 - DNA, 19 bp, Homo sapiens
cagatggatgtagatacag

SEQ ID NO: 5996853 - DNA, 23 bp, Homo sapiens
cagatggatgtagatacagatcc

SEQ ID NO: 5996854 - DNA, 21 bp, Homo sapiens
cagatggatttgcctgtgcca

SEQ ID NO: 5996855 - DNA, 22 bp, Homo sapiens
cagatggatttgcctgtgccac

SEQ ID NO: 5996856 - DNA, 17 bp, Homo sapiens
cagatggcaggctacag

SEQ ID NO: 5996857 - DNA, 14 bp, Homo sapiens
cagatggcagggct

SEQ ID NO: 5996858 - DNA, 19 bp, Homo sapiens
cagatggcagggctgagga

SEQ ID NO: 5996859 - DNA, 16 bp, Homo sapiens
cagatggcatgtgttt

SEQ ID NO: 5996860 - DNA, 16 bp, Homo sapiens
cagatggcccaaggga

SEQ ID NO: 5996861 - DNA, 22 bp, Homo sapiens
cagatggcccccagctggtgtc

SEQ ID NO: 5996862 - DNA, 17 bp, Homo sapiens
cagatggcccctccact

SEQ ID NO: 5996863 - DNA, 13 bp, Homo sapiens
cagatggcccgga

SEQ ID NO: 5996864 - DNA, 22 bp, Homo sapiens
cagatggcggtgatcagcagag

SEQ ID NO: 5996865 - DNA, 16 bp, Homo sapiens
cagatggctccctggg

SEQ ID NO: 5996866 - DNA, 17 bp, Homo sapiens
cagatggctccctgggc

SEQ ID NO: 5996867 - DNA, 22 bp, Homo sapiens
cagatggctccctgggctggca

SEQ ID NO: 5996868 - DNA, 19 bp, Homo sapiens
cagatggcttcggagggcc

SEQ ID NO: 5996869 - DNA, 18 bp, Homo sapiens
cagatggctttcagggca

SEQ ID NO: 5996870 - DNA, 21 bp, Homo sapiens
cagatgggaactgaattgtgt

SEQ ID NO: 5996871 - DNA, 20 bp, Homo sapiens
cagatgggaggaaagagagc

SEQ ID NO: 5996872 - DNA, 21 bp, Homo sapiens
cagatgggccacggctgagcc

SEQ ID NO: 5996873 - DNA, 17 bp, Homo sapiens
cagatggggcctgggct

SEQ ID NO: 5996874 - DNA, 23 bp, Homo sapiens
cagatgggggcctctctggaaga

SEQ ID NO: 5996875 - DNA, 22 bp, Homo sapiens
cagatggggtctgtgactggat

SEQ ID NO: 5996876 - DNA, 20 bp, Homo sapiens
cagatggtacggacttcctt

SEQ ID NO: 5996877 - DNA, 15 bp, Homo sapiens
cagatggtcatccag

SEQ ID NO: 5996878 - DNA, 16 bp, Homo sapiens
cagatggtgaagcatt

SEQ ID NO: 5996879 - DNA, 14 bp, Homo sapiens
cagatggtgtcatt

SEQ ID NO: 5996880 - DNA, 20 bp, Homo sapiens
cagatggttgtgtatgggta

SEQ ID NO: 5996881 - DNA, 22 bp, Homo sapiens
cagatggtttccacatttagat

SEQ ID NO: 5996882 - DNA, 22 bp, Homo sapiens
cagatggttttataatctgatt

SEQ ID NO: 5996883 - DNA, 20 bp, Homo sapiens
cagatgtaagaagcccgatc

SEQ ID NO: 5996884 - DNA, 12 bp, Homo sapiens
cagatgtaatgt

SEQ ID NO: 5996885 - DNA, 22 bp, Homo sapiens
cagatgtaatgttttctttgca

SEQ ID NO: 5996886 - DNA, 19 bp, Homo sapiens
cagatgtagatataaatat

SEQ ID NO: 5996887 - DNA, 17 bp, Homo sapiens
cagatgtattgactgta

SEQ ID NO: 5996888 - DNA, 17 bp, Homo sapiens
cagatgtcagcttccca

SEQ ID NO: 5996889 - DNA, 21 bp, Homo sapiens
cagatgtcagcttcccagcca

SEQ ID NO: 5996890 - DNA, 22 bp, Homo sapiens
cagatgtcagcttcccagccat

SEQ ID NO: 5996891 - DNA, 16 bp, Homo sapiens
cagatgtccatcagat

SEQ ID NO: 5996892 - DNA, 21 bp, Homo sapiens
cagatgtccatcagatgacaa

SEQ ID NO: 5996893 - DNA, 22 bp, Homo sapiens
cagatgtctctggggcagatcc

SEQ ID NO: 5996894 - DNA, 18 bp, Homo sapiens
cagatgtcttccctgggc

SEQ ID NO: 5996895 - DNA, 23 bp, Homo sapiens
cagatgtcttccctgggctgcca

SEQ ID NO: 5996896 - DNA, 16 bp, Homo sapiens
cagatgtcttctgcct

SEQ ID NO: 5996897 - DNA, 17 bp, Homo sapiens
cagatgtcttctgcctg

SEQ ID NO: 5996898 - DNA, 14 bp, Homo sapiens
cagatgtgaaccat

SEQ ID NO: 5996899 - DNA, 11 bp, Homo sapiens
cagatgtgaag

SEQ ID NO: 5996900 - DNA, 20 bp, Homo sapiens
cagatgtgagggcaccacca

SEQ ID NO: 5996901 - DNA, 14 bp, Homo sapiens
cagatgtgcaataa

SEQ ID NO: 5996902 - DNA, 21 bp, Homo sapiens
cagatgtgcaataatttgtac

SEQ ID NO: 5996903 - DNA, 19 bp, Homo sapiens
cagatgtgcagcagattgg

SEQ ID NO: 5996904 - DNA, 11 bp, Homo sapiens
cagatgtgcat

SEQ ID NO: 5996905 - DNA, 18 bp, Homo sapiens
cagatgtgcccagagtag

SEQ ID NO: 5996906 - DNA, 21 bp, Homo sapiens
cagatgtggacatgcacccgc

SEQ ID NO: 5996907 - DNA, 15 bp, Homo sapiens
cagatgtggagccag

SEQ ID NO: 5996908 - DNA, 18 bp, Homo sapiens
cagatgtggagccaggcg

SEQ ID NO: 5996909 - DNA, 20 bp, Homo sapiens
cagatgtggagtctgtgtct

SEQ ID NO: 5996910 - DNA, 12 bp, Homo sapiens
cagatgtggcta

SEQ ID NO: 5996911 - DNA, 18 bp, Homo sapiens
cagatgtgggctcagatc

SEQ ID NO: 5996912 - DNA, 20 bp, Homo sapiens
cagatgtgggctcagatcct

SEQ ID NO: 5996913 - DNA, 23 bp, Homo sapiens
cagatgtgggctcagatcctggg

SEQ ID NO: 5996914 - DNA, 20 bp, Homo sapiens
cagatgtgggctttgatttc

SEQ ID NO: 5996915 - DNA, 23 bp, Homo sapiens
cagatgtggggagggtgtctggg

SEQ ID NO: 5996916 - DNA, 21 bp, Homo sapiens
cagatgtggggctgagctggg

SEQ ID NO: 5996917 - DNA, 20 bp, Homo sapiens
cagatgtggtgatactgaga

SEQ ID NO: 5996918 - DNA, 22 bp, Homo sapiens
cagatgtgtctgggagagcctg

SEQ ID NO: 5996919 - DNA, 17 bp, Homo sapiens
cagatgttaaaataaat

SEQ ID NO: 5996920 - DNA, 18 bp, Homo sapiens
cagatgttaaaataaatg

SEQ ID NO: 5996921 - DNA, 17 bp, Homo sapiens
cagatgttaatttactt

SEQ ID NO: 5996922 - DNA, 19 bp, Homo sapiens
cagatgttatttttgtatt

SEQ ID NO: 5996923 - DNA, 21 bp, Homo sapiens
cagatgttatttttgtatttt

SEQ ID NO: 5996924 - DNA, 16 bp, Homo sapiens
cagatgttcaaatatt

SEQ ID NO: 5996925 - DNA, 15 bp, Homo sapiens
cagatgttcccggag

SEQ ID NO: 5996926 - DNA, 17 bp, Homo sapiens
cagatgttcccggagca

SEQ ID NO: 5996927 - DNA, 17 bp, Homo sapiens
cagatgttgaattcttt

SEQ ID NO: 5996928 - DNA, 18 bp, Homo sapiens
cagatgttgcttttgaaa

SEQ ID NO: 5996929 - DNA, 21 bp, Homo sapiens
cagatgttgcttttgaaaagt

SEQ ID NO: 5996930 - DNA, 16 bp, Homo sapiens
cagatgtttaaaacac

SEQ ID NO: 5996931 - DNA, 21 bp, Homo sapiens
cagatgtttcatcaatgcagt

SEQ ID NO: 5996932 - DNA, 17 bp, Homo sapiens
cagatgtttccaagatg

SEQ ID NO: 5996933 - DNA, 12 bp, Homo sapiens
cagatgtttctc

SEQ ID NO: 5996934 - DNA, 23 bp, Homo sapiens
cagatgtttctcattttaaacaa

SEQ ID NO: 5996935 - DNA, 14 bp, Homo sapiens
cagatgtttctttt

SEQ ID NO: 5996936 - DNA, 16 bp, Homo sapiens
cagatgtttgcctcat

SEQ ID NO: 5996937 - DNA, 21 bp, Homo sapiens
cagatgttttacgcaaggaag

SEQ ID NO: 5996938 - DNA, 23 bp, Homo sapiens
cagatgttttacgcaaggaagga

SEQ ID NO: 5996939 - DNA, 18 bp, Homo sapiens
cagatgttttacgtctgg

SEQ ID NO: 5996940 - DNA, 17 bp, Homo sapiens
cagatgttttagagata

SEQ ID NO: 5996941 - DNA, 23 bp, Homo sapiens
cagatgttttagagataaatatt

SEQ ID NO: 5996942 - DNA, 16 bp, Homo sapiens
cagatgttttccactg

SEQ ID NO: 5996943 - DNA, 13 bp, Homo sapiens
cagatgttttgat

SEQ ID NO: 5996944 - DNA, 14 bp, Homo sapiens
cagatgttttgatg

SEQ ID NO: 5996945 - DNA, 23 bp, Homo sapiens
cagatgttttggtcaagtagttt

SEQ ID NO: 5996946 - DNA, 19 bp, Homo sapiens
cagattaaacttcacctac

SEQ ID NO: 5996947 - DNA, 21 bp, Homo sapiens
cagattaaacttcacctacaa

SEQ ID NO: 5996948 - DNA, 15 bp, Homo sapiens
cagattaaatgaata

SEQ ID NO: 5996949 - DNA, 18 bp, Homo sapiens
cagattaaattacagctt

SEQ ID NO: 5996950 - DNA, 19 bp, Homo sapiens
cagattaaattacagcttt

SEQ ID NO: 5996951 - DNA, 13 bp, Homo sapiens
cagattacactga

SEQ ID NO: 5996952 - DNA, 19 bp, Homo sapiens
cagattacaggaatgaaga

SEQ ID NO: 5996953 - DNA, 17 bp, Homo sapiens
cagattacttcagggct

SEQ ID NO: 5996954 - DNA, 14 bp, Homo sapiens
cagattagacacta

SEQ ID NO: 5996955 - DNA, 16 bp, Homo sapiens
cagattaggacacagt

SEQ ID NO: 5996956 - DNA, 14 bp, Homo sapiens
cagattaggcctgg

SEQ ID NO: 5996957 - DNA, 17 bp, Homo sapiens
cagattaggcctggagt

SEQ ID NO: 5996958 - DNA, 15 bp, Homo sapiens
cagattataataaat

SEQ ID NO: 5996959 - DNA, 14 bp, Homo sapiens
cagattatgtatta

SEQ ID NO: 5996960 - DNA, 22 bp, Homo sapiens
cagattatgtattaacttgtag

SEQ ID NO: 5996961 - DNA, 13 bp, Homo sapiens
cagattatttgcc

SEQ ID NO: 5996962 - DNA, 19 bp, Homo sapiens
cagattattttctatattt

SEQ ID NO: 5996963 - DNA, 13 bp, Homo sapiens
cagattattttgg

SEQ ID NO: 5996964 - DNA, 16 bp, Homo sapiens
cagattattttggaaa

SEQ ID NO: 5996965 - DNA, 18 bp, Homo sapiens
cagattattttggaaagt

SEQ ID NO: 5996966 - DNA, 22 bp, Homo sapiens
cagattcactttgtttatgcat

SEQ ID NO: 5996967 - DNA, 21 bp, Homo sapiens
cagattcaggagctcagtttc

SEQ ID NO: 5996968 - DNA, 15 bp, Homo sapiens
cagattcaggccagc

SEQ ID NO: 5996969 - DNA, 17 bp, Homo sapiens
cagattcaggccagccc

SEQ ID NO: 5996970 - DNA, 18 bp, Homo sapiens
cagattcaggccagccca

SEQ ID NO: 5996971 - DNA, 19 bp, Homo sapiens
cagattcaggccagcccag

SEQ ID NO: 5996972 - DNA, 22 bp, Homo sapiens
cagattcaggccagcccagcca

SEQ ID NO: 5996973 - DNA, 22 bp, Homo sapiens
cagattcagggagaatgttgtt

SEQ ID NO: 5996974 - DNA, 14 bp, Homo sapiens
cagattcagtcttg

SEQ ID NO: 5996975 - DNA, 16 bp, Homo sapiens
cagattccaacatttc

SEQ ID NO: 5996976 - DNA, 15 bp, Homo sapiens
cagattccacaggac

SEQ ID NO: 5996977 - DNA, 12 bp, Homo sapiens
cagattcccaga

SEQ ID NO: 5996978 - DNA, 17 bp, Homo sapiens
cagattcccagagcaaa

SEQ ID NO: 5996979 - DNA, 21 bp, Homo sapiens
cagattcccagagcaaaataa

SEQ ID NO: 5996980 - DNA, 13 bp, Homo sapiens
cagattcccaggc

SEQ ID NO: 5996981 - DNA, 16 bp, Homo sapiens
cagattcccctgtgtc

SEQ ID NO: 5996982 - DNA, 17 bp, Homo sapiens
cagattcccctgtgtca

SEQ ID NO: 5996983 - DNA, 15 bp, Homo sapiens
cagattcctgggcct

SEQ ID NO: 5996984 - DNA, 18 bp, Homo sapiens
cagattcctgggcctgtc

SEQ ID NO: 5996985 - DNA, 13 bp, Homo sapiens
cagattccttccc

SEQ ID NO: 5996986 - DNA, 14 bp, Homo sapiens
cagattccttccca

SEQ ID NO: 5996987 - DNA, 21 bp, Homo sapiens
cagattcctttggccactgta

SEQ ID NO: 5996988 - DNA, 17 bp, Homo sapiens
cagattcctttgtatca

SEQ ID NO: 5996989 - DNA, 24 bp, Homo sapiens
cagattctagcacatcatggcagt

SEQ ID NO: 5996990 - DNA, 20 bp, Homo sapiens
cagattctaggacctgtgtc

SEQ ID NO: 5996991 - DNA, 16 bp, Homo sapiens
cagattctatattatt

SEQ ID NO: 5996992 - DNA, 13 bp, Homo sapiens
cagattctcttga

SEQ ID NO: 5996993 - DNA, 21 bp, Homo sapiens
cagattctgacatttatattt

SEQ ID NO: 5996994 - DNA, 20 bp, Homo sapiens
cagattctgagcaaaggccc

SEQ ID NO: 5996995 - DNA, 12 bp, Homo sapiens
cagattctgatg

SEQ ID NO: 5996996 - DNA, 23 bp, Homo sapiens
cacattaactccctccaccagcc

SEQ ID NO: 5996997 - DNA, 13 bp, Homo sapiens
cacattaactgtt

SEQ ID NO: 5996998 - DNA, 14 bp, Homo sapiens
cacattaactgttg

SEQ ID NO: 5996999 - DNA, 16 bp, Homo sapiens
cacattaatctcaaag

SEQ ID NO: 5997000 - DNA, 19 bp, Homo sapiens
cacattaattaattaaagc

SEQ ID NO: 5997001 - DNA, 21 bp, Homo sapiens
cacattaattagattttcttg

SEQ ID NO: 5997002 - DNA, 20 bp, Homo sapiens
cacattactagagttggcat

SEQ ID NO: 5997003 - DNA, 14 bp, Homo sapiens
cacattacttgcac

SEQ ID NO: 5997004 - DNA, 13 bp, Homo sapiens
cacattagaactt

SEQ ID NO: 5997005 - DNA, 15 bp, Homo sapiens
cacattagaattagt

SEQ ID NO: 5997006 - DNA, 23 bp, Homo sapiens
cacattagattttattttactat

SEQ ID NO: 5997007 - DNA, 16 bp, Homo sapiens
cacattagtgtgttgt

SEQ ID NO: 5997008 - DNA, 18 bp, Homo sapiens
cacattagtgtgttgtct

SEQ ID NO: 5997009 - DNA, 17 bp, Homo sapiens
cacattatagaaattac

SEQ ID NO: 5997010 - DNA, 20 bp, Homo sapiens
cacattatcactgaaaaaat

SEQ ID NO: 5997011 - DNA, 20 bp, Homo sapiens
cacattatcgggagcagtgt

SEQ ID NO: 5997012 - DNA, 23 bp, Homo sapiens
cacattatcgggagcagtgtctt

SEQ ID NO: 5997013 - DNA, 15 bp, Homo sapiens
cacattatgtatctt

SEQ ID NO: 5997014 - DNA, 19 bp, Homo sapiens
cacattcaaccctggagag

SEQ ID NO: 5997015 - DNA, 20 bp, Homo sapiens
cacattcaaccctggagagt

SEQ ID NO: 5997016 - DNA, 16 bp, Homo sapiens
cacattcaataagcat

SEQ ID NO: 5997017 - DNA, 15 bp, Homo sapiens
cacattcacaaagaa

SEQ ID NO: 5997018 - DNA, 16 bp, Homo sapiens
cacattcacaaagaaa

SEQ ID NO: 5997019 - DNA, 14 bp, Homo sapiens
cacattcatcctca

SEQ ID NO: 5997020 - DNA, 13 bp, Homo sapiens
cacattccagcca

SEQ ID NO: 5997021 - DNA, 17 bp, Homo sapiens
cacattccagccaggcc

SEQ ID NO: 5997022 - DNA, 19 bp, Homo sapiens
cacattccagccaggccca

SEQ ID NO: 5997023 - DNA, 23 bp, Homo sapiens
cacattccagccaggcccaggcc

SEQ ID NO: 5997024 - DNA, 14 bp, Homo sapiens
cacattccatgacg

SEQ ID NO: 5997025 - DNA, 20 bp, Homo sapiens
cacattcccatgaatatcaa

SEQ ID NO: 5997026 - DNA, 19 bp, Homo sapiens
cacattcccatggtggcct

SEQ ID NO: 5997027 - DNA, 13 bp, Homo sapiens
cacattccctctc

SEQ ID NO: 5997028 - DNA, 15 bp, Homo sapiens
cacattccctggccg

SEQ ID NO: 5997029 - DNA, 15 bp, Homo sapiens
cacattcctgaccct

SEQ ID NO: 5997030 - DNA, 16 bp, Homo sapiens
cacattcctgatgctt

SEQ ID NO: 5997031 - DNA, 14 bp, Homo sapiens
cacattcctggccc

SEQ ID NO: 5997032 - DNA, 19 bp, Homo sapiens
cacattccttgcctgcaca

SEQ ID NO: 5997033 - DNA, 20 bp, Homo sapiens
cacattcctttgggtatgtt

SEQ ID NO: 5997034 - DNA, 18 bp, Homo sapiens
cacattcggaccctgccc

SEQ ID NO: 5997035 - DNA, 13 bp, Homo sapiens
cacattctatttt

SEQ ID NO: 5997036 - DNA, 14 bp, Homo sapiens
cacattctgccttg

SEQ ID NO: 5997037 - DNA, 16 bp, Homo sapiens
cacattctgctgcccc

SEQ ID NO: 5997038 - DNA, 18 bp, Homo sapiens
cacattctgctgccccca

SEQ ID NO: 5997039 - DNA, 16 bp, Homo sapiens
cacattctggctcagg

SEQ ID NO: 5997040 - DNA, 23 bp, Homo sapiens
cacattctgtctctgcttggctt

SEQ ID NO: 5997041 - DNA, 22 bp, Homo sapiens
cacattcttaacacatgtcctt

SEQ ID NO: 5997042 - DNA, 21 bp, Homo sapiens
cacattcttaaggcaataaaa

SEQ ID NO: 5997043 - DNA, 21 bp, Homo sapiens
cacattctttataaaatgtat

SEQ ID NO: 5997044 - DNA, 13 bp, Homo sapiens
cacattgaagaat

SEQ ID NO: 5997045 - DNA, 22 bp, Homo sapiens
cacattgaccgcaactcacaca

SEQ ID NO: 5997046 - DNA, 17 bp, Homo sapiens
cacattgagctgtgcaa

SEQ ID NO: 5997047 - DNA, 23 bp, Homo sapiens
cacattgcattctattgccttct

SEQ ID NO: 5997048 - DNA, 21 bp, Homo sapiens
cacattgccagtgacatgaga

SEQ ID NO: 5997049 - DNA, 16 bp, Homo sapiens
cacattgcccctctgc

SEQ ID NO: 5997050 - DNA, 13 bp, Homo sapiens
cacattgcctcat

SEQ ID NO: 5997051 - DNA, 14 bp, Homo sapiens
cacattgcctcatt

SEQ ID NO: 5997052 - DNA, 15 bp, Homo sapiens
cacattgcctgttct

SEQ ID NO: 5997053 - DNA, 19 bp, Homo sapiens
cacattgcctgttctgctt

SEQ ID NO: 5997054 - DNA, 20 bp, Homo sapiens
cacattgcctgttctgcttc

SEQ ID NO: 5997055 - DNA, 21 bp, Homo sapiens
cacattgcctgttctgcttcg

SEQ ID NO: 5997056 - DNA, 22 bp, Homo sapiens
cacattgcctgttctgcttcga

SEQ ID NO: 5997057 - DNA, 16 bp, Homo sapiens
cacattgctggctgcc

SEQ ID NO: 5997058 - DNA, 20 bp, Homo sapiens
cacattgctgtgaacaggaa

SEQ ID NO: 5997059 - DNA, 13 bp, Homo sapiens
cacattgcttcat

SEQ ID NO: 5997060 - DNA, 18 bp, Homo sapiens
cacattgcttcattaaaa

SEQ ID NO: 5997061 - DNA, 18 bp, Homo sapiens
cacattggagatgtttag

SEQ ID NO: 5997062 - DNA, 23 bp, Homo sapiens
cacattgggtggggctcctggga

SEQ ID NO: 5997063 - DNA, 20 bp, Homo sapiens
cacattgtgtcacatcatga

SEQ ID NO: 5997064 - DNA, 20 bp, Homo sapiens
cacattgttattttcagtga

SEQ ID NO: 5997065 - DNA, 17 bp, Homo sapiens
cacattgttgttttttt

SEQ ID NO: 5997066 - DNA, 18 bp, Homo sapiens
cacattgtttgctgctat

SEQ ID NO: 5997067 - DNA, 16 bp, Homo sapiens
cacattgttttaaaaa

SEQ ID NO: 5997068 - DNA, 23 bp, Homo sapiens
cacattgttttccagaagcctcc

SEQ ID NO: 5997069 - DNA, 11 bp, Homo sapiens
cacatttaagg

SEQ ID NO: 5997070 - DNA, 14 bp, Homo sapiens
cacatttaaggatg

SEQ ID NO: 5997071 - DNA, 22 bp, Homo sapiens
cacatttaatgaacacaatttt

SEQ ID NO: 5997072 - DNA, 15 bp, Homo sapiens
cacatttacactaga

SEQ ID NO: 5997073 - DNA, 17 bp, Homo sapiens
cacatttactagctgtg

SEQ ID NO: 5997074 - DNA, 22 bp, Homo sapiens
cacatttagaaatgtttattga

SEQ ID NO: 5997075 - DNA, 23 bp, Homo sapiens
cacatttagaatttgaaaggaaa

SEQ ID NO: 5997076 - DNA, 17 bp, Homo sapiens
cacatttagtccaatga

SEQ ID NO: 5997077 - DNA, 19 bp, Homo sapiens
cacatttagtctctttatt

SEQ ID NO: 5997078 - DNA, 15 bp, Homo sapiens
cacatttatatatat

SEQ ID NO: 5997079 - DNA, 20 bp, Homo sapiens
cacatttatatatatatgta

SEQ ID NO: 5997080 - DNA, 20 bp, Homo sapiens
cacatttcatctaatttaat

SEQ ID NO: 5997081 - DNA, 12 bp, Homo sapiens
cacatttcatga

SEQ ID NO: 5997082 - DNA, 18 bp, Homo sapiens
cacatttccccagacctg

SEQ ID NO: 5997083 - DNA, 14 bp, Homo sapiens
cacatttcctctct

SEQ ID NO: 5997084 - DNA, 18 bp, Homo sapiens
cacatttctaatttgaat

SEQ ID NO: 5997085 - DNA, 19 bp, Homo sapiens
cacatttctgatcagaggt

SEQ ID NO: 5997086 - DNA, 12 bp, Homo sapiens
cacatttctgga

SEQ ID NO: 5997087 - DNA, 15 bp, Homo sapiens
cacatttctggattg

SEQ ID NO: 5997088 - DNA, 22 bp, Homo sapiens
cacatttcttaaaacacatgat

SEQ ID NO: 5997089 - DNA, 23 bp, Homo sapiens
cacatttcttaaaacacatgata

SEQ ID NO: 5997090 - DNA, 20 bp, Homo sapiens
cacatttgaaataaagtaat

SEQ ID NO: 5997091 - DNA, 20 bp, Homo sapiens
cacatttgatgtacatgtgt

SEQ ID NO: 5997092 - DNA, 19 bp, Homo sapiens
cacatttgccttcagtctt

SEQ ID NO: 5997093 - DNA, 19 bp, Homo sapiens
cacatttgctttttgtgat

SEQ ID NO: 5997094 - DNA, 21 bp, Homo sapiens
cacatttgctttttgtgatat

SEQ ID NO: 5997095 - DNA, 20 bp, Homo sapiens
cacatttgggatgttccttt

SEQ ID NO: 5997096 - DNA, 18 bp, Homo sapiens
cacatttggtaatgtttt

SEQ ID NO: 5997097 - DNA, 20 bp, Homo sapiens
cacatttgtgccgacactgt

SEQ ID NO: 5997098 - DNA, 15 bp, Homo sapiens
cacatttgttaatga

SEQ ID NO: 5997099 - DNA, 19 bp, Homo sapiens
cacatttgttaatgattct

SEQ ID NO: 5997100 - DNA, 20 bp, Homo sapiens
cacatttgttaatgattctt

SEQ ID NO: 5997101 - DNA, 19 bp, Homo sapiens
cacattttaaaaaatttgt

SEQ ID NO: 5997102 - DNA, 21 bp, Homo sapiens
cacattttaacagtacctgtg

SEQ ID NO: 5997103 - DNA, 20 bp, Homo sapiens
cacattttattttattatgc

SEQ ID NO: 5997104 - DNA, 14 bp, Homo sapiens
cacattttgacaca

SEQ ID NO: 5997105 - DNA, 21 bp, Homo sapiens
cacattttgcctttctcgtgg

SEQ ID NO: 5997106 - DNA, 16 bp, Homo sapiens
cacattttgctttata

SEQ ID NO: 5997107 - DNA, 19 bp, Homo sapiens
cacattttggttcttctca

SEQ ID NO: 5997108 - DNA, 16 bp, Homo sapiens
cacattttgtaaatct

SEQ ID NO: 5997109 - DNA, 13 bp, Homo sapiens
cacattttgtaat

SEQ ID NO: 5997110 - DNA, 15 bp, Homo sapiens
cacattttgtacatt

SEQ ID NO: 5997111 - DNA, 12 bp, Homo sapiens
cacattttgtat

SEQ ID NO: 5997112 - DNA, 17 bp, Homo sapiens
cacatttttaagatgca

SEQ ID NO: 5997113 - DNA, 14 bp, Homo sapiens
cacatttttcagat

SEQ ID NO: 5997114 - DNA, 18 bp, Homo sapiens
cacatttttcagatataa

SEQ ID NO: 5997115 - DNA, 17 bp, Homo sapiens
cacattttttaaatgca

SEQ ID NO: 5997116 - DNA, 17 bp, Homo sapiens
cacattttttaggaaat

SEQ ID NO: 5997117 - DNA, 12 bp, Homo sapiens
cacattttttat

SEQ ID NO: 5997118 - DNA, 18 bp, Homo sapiens
cacatttttttttttaat

SEQ ID NO: 5997119 - DNA, 21 bp, Homo sapiens
cacatttttttttttaatttt

SEQ ID NO: 5997120 - DNA, 20 bp, Homo sapiens
caccaaaaaaatccagaaac

SEQ ID NO: 5997121 - DNA, 12 bp, Homo sapiens
caccaaaaacaa

SEQ ID NO: 5997122 - DNA, 14 bp, Homo sapiens
caccaaaaccaaac

SEQ ID NO: 5997123 - DNA, 19 bp, Homo sapiens
caccaaaagttcatataat

SEQ ID NO: 5997124 - DNA, 12 bp, Homo sapiens
caccaaaataag

SEQ ID NO: 5997125 - DNA, 18 bp, Homo sapiens
caccaaaataagaaaaga

SEQ ID NO: 5997126 - DNA, 19 bp, Homo sapiens
caccaaaataagaaaagat

SEQ ID NO: 5997127 - DNA, 17 bp, Homo sapiens
caccaaacatttctgtg

SEQ ID NO: 5997128 - DNA, 14 bp, Homo sapiens
caccaaactgccaa

SEQ ID NO: 5997129 - DNA, 19 bp, Homo sapiens
caccaaactttatttttct

SEQ ID NO: 5997130 - DNA, 14 bp, Homo sapiens
caccaaagacatca

SEQ ID NO: 5997131 - DNA, 13 bp, Homo sapiens
caccaaagagaat

SEQ ID NO: 5997132 - DNA, 14 bp, Homo sapiens
caccaaagatgcag

SEQ ID NO: 5997133 - DNA, 17 bp, Homo sapiens
caccaaagatgcagccg

SEQ ID NO: 5997134 - DNA, 14 bp, Homo sapiens
caccaaagatgtcc

SEQ ID NO: 5997135 - DNA, 18 bp, Homo sapiens
caccaaaggagacatatc

SEQ ID NO: 5997136 - DNA, 22 bp, Homo sapiens
caccaaagggagagttccagag

SEQ ID NO: 5997137 - DNA, 14 bp, Homo sapiens
caccaaagttctaa

SEQ ID NO: 5997138 - DNA, 19 bp, Homo sapiens
caccaaatacaattcaaat

SEQ ID NO: 5997139 - DNA, 14 bp, Homo sapiens
caccaaatcaaaat

SEQ ID NO: 5997140 - DNA, 16 bp, Homo sapiens
caccaaatcaaaatct

SEQ ID NO: 5997141 - DNA, 14 bp, Homo sapiens
caccaaatcatcct

SEQ ID NO: 5997142 - DNA, 19 bp, Homo sapiens
caccaaatcatcctgaatc

SEQ ID NO: 5997143 - DNA, 17 bp, Homo sapiens
caccaacactgtaacat

SEQ ID NO: 5997144 - DNA, 17 bp, Homo sapiens
caccaacataaaacaaa

SEQ ID NO: 5997145 - DNA, 14 bp, Homo sapiens
caccaacatcccat

SEQ ID NO: 5997146 - DNA, 17 bp, Homo sapiens
caccaacatcccattgc

SEQ ID NO: 5997147 - DNA, 23 bp, Homo sapiens
caccaacatcccattgccctggt

SEQ ID NO: 5997148 - DNA, 20 bp, Homo sapiens
caccaaccagacagcacagg

SEQ ID NO: 5997149 - DNA, 14 bp, Homo sapiens
caccaaccaggcct

SEQ ID NO: 5997150 - DNA, 19 bp, Homo sapiens
caccaaccaggccttcatc

SEQ ID NO: 5997151 - DNA, 21 bp, Homo sapiens
caccaaccaggccttcatcct

SEQ ID NO: 5997152 - DNA, 13 bp, Homo sapiens
caccaacccagcc

SEQ ID NO: 5997153 - DNA, 17 bp, Homo sapiens
caccaacccagccgctg

SEQ ID NO: 5997154 - DNA, 20 bp, Homo sapiens
caccaacccagccgctgccc

SEQ ID NO: 5997155 - DNA, 13 bp, Homo sapiens
caccaacccagga

SEQ ID NO: 5997156 - DNA, 16 bp, Homo sapiens
caccaacccctgacct

SEQ ID NO: 5997157 - DNA, 14 bp, Homo sapiens
caccaaccctcagg

SEQ ID NO: 5997158 - DNA, 16 bp, Homo sapiens
caccaaccctcagggc

SEQ ID NO: 5997159 - DNA, 16 bp, Homo sapiens
caccaacctcactgcc

SEQ ID NO: 5997160 - DNA, 15 bp, Homo sapiens
caccaacctccagac

SEQ ID NO: 5997161 - DNA, 16 bp, Homo sapiens
caccaacctccagact

SEQ ID NO: 5997162 - DNA, 14 bp, Homo sapiens
caccaacgtctgtg

SEQ ID NO: 5997163 - DNA, 17 bp, Homo sapiens
caccaacgtctgtgcca

SEQ ID NO: 5997164 - DNA, 17 bp, Homo sapiens
caccaactctctctgcc

SEQ ID NO: 5997165 - DNA, 16 bp, Homo sapiens
caccaactctgcactc

SEQ ID NO: 5997166 - DNA, 14 bp, Homo sapiens
caccaactcttgca

SEQ ID NO: 5997167 - DNA, 18 bp, Homo sapiens
caccaactcttgcaggtc

SEQ ID NO: 5997168 - DNA, 17 bp, Homo sapiens
caccaactgctctcaaa

SEQ ID NO: 5997169 - DNA, 16 bp, Homo sapiens
caccaacttacaaaaa

SEQ ID NO: 5997170 - DNA, 19 bp, Homo sapiens
caccaagacttgaaggtgc

SEQ ID NO: 5997171 - DNA, 19 bp, Homo sapiens
caccaagagcagctgggaa

SEQ ID NO: 5997172 - DNA, 15 bp, Homo sapiens
caccaagagggtgga

SEQ ID NO: 5997173 - DNA, 17 bp, Homo sapiens
caccaagatgtctgtct

SEQ ID NO: 5997174 - DNA, 17 bp, Homo sapiens
caccaagcacagcagcc

SEQ ID NO: 5997175 - DNA, 17 bp, Homo sapiens
cagattctgcctctctg

SEQ ID NO: 5997176 - DNA, 16 bp, Homo sapiens
cagattcttccactgg

SEQ ID NO: 5997177 - DNA, 15 bp, Homo sapiens
cagattcttgcatcc

SEQ ID NO: 5997178 - DNA, 14 bp, Homo sapiens
cagattctttcctg

SEQ ID NO: 5997179 - DNA, 20 bp, Homo sapiens
cagattctttcctgaggctg

SEQ ID NO: 5997180 - DNA, 14 bp, Homo sapiens
cagattgaaaagtg

SEQ ID NO: 5997181 - DNA, 23 bp, Homo sapiens
cagattgaaaggacctcttctga

SEQ ID NO: 5997182 - DNA, 21 bp, Homo sapiens
cagattgaagaatctgcccct

SEQ ID NO: 5997183 - DNA, 20 bp, Homo sapiens
cagattgacctataaaacaa

SEQ ID NO: 5997184 - DNA, 22 bp, Homo sapiens
cagattgatagggagttttaaa

SEQ ID NO: 5997185 - DNA, 21 bp, Homo sapiens
cagattgcaacaggctgggct

SEQ ID NO: 5997186 - DNA, 15 bp, Homo sapiens
cagattgcatgtgac

SEQ ID NO: 5997187 - DNA, 16 bp, Homo sapiens
cagattgcatgtgact

SEQ ID NO: 5997188 - DNA, 18 bp, Homo sapiens
cagattgcatgtgactct

SEQ ID NO: 5997189 - DNA, 23 bp, Homo sapiens
cagattgcatgtgactctgaagc

SEQ ID NO: 5997190 - DNA, 15 bp, Homo sapiens
cagattgctacacac

SEQ ID NO: 5997191 - DNA, 17 bp, Homo sapiens
cagattgctacacacac

SEQ ID NO: 5997192 - DNA, 18 bp, Homo sapiens
cagattgctgaatcccat

SEQ ID NO: 5997193 - DNA, 15 bp, Homo sapiens
cagattgctgcttct

SEQ ID NO: 5997194 - DNA, 16 bp, Homo sapiens
cagattgctgggagga

SEQ ID NO: 5997195 - DNA, 17 bp, Homo sapiens
cagattgcttttgtgca

SEQ ID NO: 5997196 - DNA, 12 bp, Homo sapiens
cagattggaagg

SEQ ID NO: 5997197 - DNA, 21 bp, Homo sapiens
cagattggaaggagacacaga

SEQ ID NO: 5997198 - DNA, 23 bp, Homo sapiens
cagattggaatgttacatctgtc

SEQ ID NO: 5997199 - DNA, 18 bp, Homo sapiens
cagattggagaaaccctt

SEQ ID NO: 5997200 - DNA, 15 bp, Homo sapiens
cagattggattttat

SEQ ID NO: 5997201 - DNA, 21 bp, Homo sapiens
cagattggcacccctttctag

SEQ ID NO: 5997202 - DNA, 15 bp, Homo sapiens
cagattggccaatta

SEQ ID NO: 5997203 - DNA, 16 bp, Homo sapiens
cagattggccaattaa

SEQ ID NO: 5997204 - DNA, 17 bp, Homo sapiens
cagattggctcacactg

SEQ ID NO: 5997205 - DNA, 20 bp, Homo sapiens
cagattggctcacactgaga

SEQ ID NO: 5997206 - DNA, 22 bp, Homo sapiens
cagattggctcacactgagaat

SEQ ID NO: 5997207 - DNA, 21 bp, Homo sapiens
cagattgggcggggcttctct

SEQ ID NO: 5997208 - DNA, 13 bp, Homo sapiens
cagattgggctgg

SEQ ID NO: 5997209 - DNA, 16 bp, Homo sapiens
cagattgggctggctc

SEQ ID NO: 5997210 - DNA, 19 bp, Homo sapiens
cagattggggctagtttaa

SEQ ID NO: 5997211 - DNA, 22 bp, Homo sapiens
cagattggttcatgcctggggt

SEQ ID NO: 5997212 - DNA, 23 bp, Homo sapiens
cagattggttcatgcctggggtg

SEQ ID NO: 5997213 - DNA, 17 bp, Homo sapiens
cagattgtggaatgttg

SEQ ID NO: 5997214 - DNA, 18 bp, Homo sapiens
cagattgtggaatgttgg

SEQ ID NO: 5997215 - DNA, 20 bp, Homo sapiens
cagattgtggaatgttggat

SEQ ID NO: 5997216 - DNA, 21 bp, Homo sapiens
cagattgtggggtgcagctgg

SEQ ID NO: 5997217 - DNA, 13 bp, Homo sapiens
cagattgtgtaca

SEQ ID NO: 5997218 - DNA, 22 bp, Homo sapiens
cagattgttaagggcattttta

SEQ ID NO: 5997219 - DNA, 23 bp, Homo sapiens
cagattgttaagggcatttttat

SEQ ID NO: 5997220 - DNA, 14 bp, Homo sapiens
cagattgttatcta

SEQ ID NO: 5997221 - DNA, 16 bp, Homo sapiens
cagattgtttctatac

SEQ ID NO: 5997222 - DNA, 17 bp, Homo sapiens
cagattgtttctataca

SEQ ID NO: 5997223 - DNA, 19 bp, Homo sapiens
cagattgtttctatacaaa

SEQ ID NO: 5997224 - DNA, 14 bp, Homo sapiens
cagatttaaaacaa

SEQ ID NO: 5997225 - DNA, 22 bp, Homo sapiens
cagatttaacctgttatttcta

SEQ ID NO: 5997226 - DNA, 21 bp, Homo sapiens
cagatttaagccttacaaagg

SEQ ID NO: 5997227 - DNA, 13 bp, Homo sapiens
cagatttaataca

SEQ ID NO: 5997228 - DNA, 18 bp, Homo sapiens
cagatttacactgggaga

SEQ ID NO: 5997229 - DNA, 17 bp, Homo sapiens
cagatttactaaatcaa

SEQ ID NO: 5997230 - DNA, 20 bp, Homo sapiens
cagatttagtgaaagctaga

SEQ ID NO: 5997231 - DNA, 13 bp, Homo sapiens
cagatttatgcat

SEQ ID NO: 5997232 - DNA, 14 bp, Homo sapiens
cagatttatttgtt

SEQ ID NO: 5997233 - DNA, 22 bp, Homo sapiens
cagatttatttgtttgattttc

SEQ ID NO: 5997234 - DNA, 14 bp, Homo sapiens
cagatttattttaa

SEQ ID NO: 5997235 - DNA, 14 bp, Homo sapiens
cagatttcaaatta

SEQ ID NO: 5997236 - DNA, 19 bp, Homo sapiens
cagatttcactctccttgg

SEQ ID NO: 5997237 - DNA, 21 bp, Homo sapiens
cagatttcagtcttttcctgt

SEQ ID NO: 5997238 - DNA, 13 bp, Homo sapiens
cagatttccaaaa

SEQ ID NO: 5997239 - DNA, 15 bp, Homo sapiens
cagatttccacagag

SEQ ID NO: 5997240 - DNA, 14 bp, Homo sapiens
cagatttccagcct

SEQ ID NO: 5997241 - DNA, 15 bp, Homo sapiens
cagatttctgaggaa

SEQ ID NO: 5997242 - DNA, 13 bp, Homo sapiens
cagatttctggtt

SEQ ID NO: 5997243 - DNA, 16 bp, Homo sapiens
cagatttctggttgat

SEQ ID NO: 5997244 - DNA, 22 bp, Homo sapiens
cagatttctggttgatttgtaa

SEQ ID NO: 5997245 - DNA, 21 bp, Homo sapiens
cagatttcttaatgtctgtca

SEQ ID NO: 5997246 - DNA, 13 bp, Homo sapiens
cagatttgagctc

SEQ ID NO: 5997247 - DNA, 16 bp, Homo sapiens
cagatttgagctcagc

SEQ ID NO: 5997248 - DNA, 15 bp, Homo sapiens
cagatttgaggactg

SEQ ID NO: 5997249 - DNA, 20 bp, Homo sapiens
cagatttgaggactgaagct

SEQ ID NO: 5997250 - DNA, 21 bp, Homo sapiens
cagatttgaggactgaagctg

SEQ ID NO: 5997251 - DNA, 14 bp, Homo sapiens
cagatttgatattt

SEQ ID NO: 5997252 - DNA, 22 bp, Homo sapiens
cagatttgcaacagcaaattaa

SEQ ID NO: 5997253 - DNA, 17 bp, Homo sapiens
cagatttgcacaaaaag

SEQ ID NO: 5997254 - DNA, 12 bp, Homo sapiens
cagatttgcatt

SEQ ID NO: 5997255 - DNA, 22 bp, Homo sapiens
cagatttgggggaattaacaaa

SEQ ID NO: 5997256 - DNA, 13 bp, Homo sapiens
cagatttgtataa

SEQ ID NO: 5997257 - DNA, 14 bp, Homo sapiens
cagatttgtgaact

SEQ ID NO: 5997258 - DNA, 17 bp, Homo sapiens
cagatttgtgaactcag

SEQ ID NO: 5997259 - DNA, 13 bp, Homo sapiens
cagatttgtgccc

SEQ ID NO: 5997260 - DNA, 20 bp, Homo sapiens
cagatttgtgcccattccta

SEQ ID NO: 5997261 - DNA, 24 bp, Homo sapiens
cagatttgtggggacctcagcctg

SEQ ID NO: 5997262 - DNA, 13 bp, Homo sapiens
cagattttaaatt

SEQ ID NO: 5997263 - DNA, 18 bp, Homo sapiens
cagattttaattgtcatg

SEQ ID NO: 5997264 - DNA, 16 bp, Homo sapiens
cagattttacaaaaga

SEQ ID NO: 5997265 - DNA, 17 bp, Homo sapiens
cagattttacaaaagat

SEQ ID NO: 5997266 - DNA, 12 bp, Homo sapiens
cagattttagac

SEQ ID NO: 5997267 - DNA, 18 bp, Homo sapiens
cagattttaggaaatgaa

SEQ ID NO: 5997268 - DNA, 18 bp, Homo sapiens
cagattttatattttcta

SEQ ID NO: 5997269 - DNA, 18 bp, Homo sapiens
cagattttattatgtaaa

SEQ ID NO: 5997270 - DNA, 16 bp, Homo sapiens
cagattttatttgtaa

SEQ ID NO: 5997271 - DNA, 19 bp, Homo sapiens
cagattttcagcaaactct

SEQ ID NO: 5997272 - DNA, 12 bp, Homo sapiens
cagattttcctg

SEQ ID NO: 5997273 - DNA, 15 bp, Homo sapiens
cagattttctcctgt

SEQ ID NO: 5997274 - DNA, 20 bp, Homo sapiens
cagattttgataactgttta

SEQ ID NO: 5997275 - DNA, 18 bp, Homo sapiens
cagattttgatagcaaag

SEQ ID NO: 5997276 - DNA, 22 bp, Homo sapiens
cagatttttacactaatatatg

SEQ ID NO: 5997277 - DNA, 17 bp, Homo sapiens
cagatttttcggaggcc

SEQ ID NO: 5997278 - DNA, 22 bp, Homo sapiens
cagattttttacagctgcctgc

SEQ ID NO: 5997279 - DNA, 22 bp, Homo sapiens
cagattttttctttaaataaaa

SEQ ID NO: 5997280 - DNA, 23 bp, Homo sapiens
cagattttttgaaccatccactt

SEQ ID NO: 5997281 - DNA, 20 bp, Homo sapiens
cagattttttttggactgtt

SEQ ID NO: 5997282 - DNA, 20 bp, Homo sapiens
cagcaaaaaaagcaactttt

SEQ ID NO: 5997283 - DNA, 14 bp, Homo sapiens
cagcaaaacagatt

SEQ ID NO: 5997284 - DNA, 17 bp, Homo sapiens
cagcaaaaccattgctt

SEQ ID NO: 5997285 - DNA, 20 bp, Homo sapiens
cagcaaaaccattgcttcac

SEQ ID NO: 5997286 - DNA, 18 bp, Homo sapiens
cagcaaaagttctttctc

SEQ ID NO: 5997287 - DNA, 11 bp, Homo sapiens
cagcaaaatcc

SEQ ID NO: 5997288 - DNA, 13 bp, Homo sapiens
cagcaaaatccaa

SEQ ID NO: 5997289 - DNA, 21 bp, Homo sapiens
cagcaaaatccaaactgctgt

SEQ ID NO: 5997290 - DNA, 22 bp, Homo sapiens
cagcaaaatccttacttccagc

SEQ ID NO: 5997291 - DNA, 16 bp, Homo sapiens
cagcaaaatggaagca

SEQ ID NO: 5997292 - DNA, 18 bp, Homo sapiens
cagcaaaatggaagcaaa

SEQ ID NO: 5997293 - DNA, 12 bp, Homo sapiens
cagcaaacagct

SEQ ID NO: 5997294 - DNA, 14 bp, Homo sapiens
cagcaaacaggtgc

SEQ ID NO: 5997295 - DNA, 14 bp, Homo sapiens
cagcaaaccaagag

SEQ ID NO: 5997296 - DNA, 23 bp, Homo sapiens
cagcaaacccaaagatgttaaca

SEQ ID NO: 5997297 - DNA, 14 bp, Homo sapiens
cagcaaaccggggc

SEQ ID NO: 5997298 - DNA, 23 bp, Homo sapiens
cagcaaactaaccagcattccct

SEQ ID NO: 5997299 - DNA, 20 bp, Homo sapiens
cagcaaactgcgggaatact

SEQ ID NO: 5997300 - DNA, 11 bp, Homo sapiens
cagcaaagaat

SEQ ID NO: 5997301 - DNA, 23 bp, Homo sapiens
cagcaaagcaaatgttgggaaag

SEQ ID NO: 5997302 - DNA, 19 bp, Homo sapiens
cagcaaagcagcagtgtcc

SEQ ID NO: 5997303 - DNA, 18 bp, Homo sapiens
cagcaaagcagctgattc

SEQ ID NO: 5997304 - DNA, 23 bp, Homo sapiens
cagcaaagccccatgctggagcc

SEQ ID NO: 5997305 - DNA, 15 bp, Homo sapiens
cagcaaagcccccag

SEQ ID NO: 5997306 - DNA, 17 bp, Homo sapiens
cagcaaagcccccagag

SEQ ID NO: 5997307 - DNA, 18 bp, Homo sapiens
cagcaaagcccccagagc

SEQ ID NO: 5997308 - DNA, 16 bp, Homo sapiens
cagcaaagcctccagc

SEQ ID NO: 5997309 - DNA, 13 bp, Homo sapiens
cagcaaagctccc

SEQ ID NO: 5997310 - DNA, 23 bp, Homo sapiens
cagcaaaggaaactttgcagatg

SEQ ID NO: 5997311 - DNA, 13 bp, Homo sapiens
cagcaaaggaact

SEQ ID NO: 5997312 - DNA, 14 bp, Homo sapiens
cagcaaaggaagac

SEQ ID NO: 5997313 - DNA, 22 bp, Homo sapiens
cagcaaagggaccaggggagag

SEQ ID NO: 5997314 - DNA, 19 bp, Homo sapiens
cagcaaagtgtcagtgttg

SEQ ID NO: 5997315 - DNA, 14 bp, Homo sapiens
cagcaaatatttat

SEQ ID NO: 5997316 - DNA, 12 bp, Homo sapiens
cagcaaatcctc

SEQ ID NO: 5997317 - DNA, 13 bp, Homo sapiens
cagcaaatcctct

SEQ ID NO: 5997318 - DNA, 18 bp, Homo sapiens
cagcaaattaatgtgtaa

SEQ ID NO: 5997319 - DNA, 17 bp, Homo sapiens
cagcaaattaattggca

SEQ ID NO: 5997320 - DNA, 16 bp, Homo sapiens
cagcaaattccagatt

SEQ ID NO: 5997321 - DNA, 14 bp, Homo sapiens
cagcaaatttataa

SEQ ID NO: 5997322 - DNA, 23 bp, Homo sapiens
cagcaacaaaatcatggcttagg

SEQ ID NO: 5997323 - DNA, 17 bp, Homo sapiens
cagcaacaacaacagaa

SEQ ID NO: 5997324 - DNA, 20 bp, Homo sapiens
cagcaacaactgtcagttca

SEQ ID NO: 5997325 - DNA, 21 bp, Homo sapiens
cagcaacaactgtcagttcat

SEQ ID NO: 5997326 - DNA, 20 bp, Homo sapiens
cagcaacaagactgccaggt

SEQ ID NO: 5997327 - DNA, 20 bp, Homo sapiens
cagcaacacccaagtccacc

SEQ ID NO: 5997328 - DNA, 14 bp, Homo sapiens
cagcaacacctgcc

SEQ ID NO: 5997329 - DNA, 19 bp, Homo sapiens
cagcaacacgtcattgtgt

SEQ ID NO: 5997330 - DNA, 17 bp, Homo sapiens
cagcaacagaaaaatgg

SEQ ID NO: 5997331 - DNA, 19 bp, Homo sapiens
cagcaacaggaccaggagc

SEQ ID NO: 5997332 - DNA, 17 bp, Homo sapiens
cagcaacattttcttga

SEQ ID NO: 5997333 - DNA, 18 bp, Homo sapiens
cagcaaccagagcactgt

SEQ ID NO: 5997334 - DNA, 13 bp, Homo sapiens
cagcaaccccagg

SEQ ID NO: 5997335 - DNA, 17 bp, Homo sapiens
cagcaaccccaggctga

SEQ ID NO: 5997336 - DNA, 16 bp, Homo sapiens
cagcaaccctacagta

SEQ ID NO: 5997337 - DNA, 24 bp, Homo sapiens
cagcaacccttcctgctgctgcta

SEQ ID NO: 5997338 - DNA, 19 bp, Homo sapiens
cagcaacctgtaagactga

SEQ ID NO: 5997339 - DNA, 21 bp, Homo sapiens
cagcaacgatcacaaatgact

SEQ ID NO: 5997340 - DNA, 15 bp, Homo sapiens
cagcaacgcccctcc

SEQ ID NO: 5997341 - DNA, 11 bp, Homo sapiens
cagcaactccc

SEQ ID NO: 5997342 - DNA, 14 bp, Homo sapiens
cagcaactcccacg

SEQ ID NO: 5997343 - DNA, 15 bp, Homo sapiens
cagcaactgaagaca

SEQ ID NO: 5997344 - DNA, 12 bp, Homo sapiens
cagcaactgaat

SEQ ID NO: 5997345 - DNA, 20 bp, Homo sapiens
cagcaactgaataaatacct

SEQ ID NO: 5997346 - DNA, 14 bp, Homo sapiens
cagcaactgccctt

SEQ ID NO: 5997347 - DNA, 18 bp, Homo sapiens
cagcaactgcccttccag

SEQ ID NO: 5997348 - DNA, 20 bp, Homo sapiens
cagcaacttctagcatatag

SEQ ID NO: 5997349 - DNA, 17 bp, Homo sapiens
cagcaacttgtcctagc

SEQ ID NO: 5997350 - DNA, 23 bp, Homo sapiens
cagcaacttgtcctagcacagat

SEQ ID NO: 5997351 - DNA, 19 bp, Homo sapiens
cagcaacttgtctttttct

SEQ ID NO: 5997352 - DNA, 20 bp, Homo sapiens
cagcaacttgtctttttctg

SEQ ID NO: 5997353 - DNA, 18 bp, Homo sapiens
caccaagcacagcagcct

SEQ ID NO: 5997354 - DNA, 19 bp, Homo sapiens
caccaagcacagcagcctg

SEQ ID NO: 5997355 - DNA, 21 bp, Homo sapiens
caccaagcaggaaatgaaaat

SEQ ID NO: 5997356 - DNA, 14 bp, Homo sapiens
caccaagcagtggc

SEQ ID NO: 5997357 - DNA, 13 bp, Homo sapiens
caccaagccaagg

SEQ ID NO: 5997358 - DNA, 13 bp, Homo sapiens
caccaagcccagt

SEQ ID NO: 5997359 - DNA, 20 bp, Homo sapiens
caccaagcctggtcagccca

SEQ ID NO: 5997360 - DNA, 13 bp, Homo sapiens
caccaagccttga

SEQ ID NO: 5997361 - DNA, 16 bp, Homo sapiens
caccaagctaggtgct

SEQ ID NO: 5997362 - DNA, 13 bp, Homo sapiens
caccaagctcaaa

SEQ ID NO: 5997363 - DNA, 19 bp, Homo sapiens
caccaagctcacacctgtc

SEQ ID NO: 5997364 - DNA, 23 bp, Homo sapiens
caccaagctcacacctgtccttc

SEQ ID NO: 5997365 - DNA, 15 bp, Homo sapiens
caccaagctcaccct

SEQ ID NO: 5997366 - DNA, 22 bp, Homo sapiens
caccaagctgctctccttcact

SEQ ID NO: 5997367 - DNA, 13 bp, Homo sapiens
caccaagctgctg

SEQ ID NO: 5997368 - DNA, 15 bp, Homo sapiens
caccaagctgtgcca

SEQ ID NO: 5997369 - DNA, 20 bp, Homo sapiens
caccaaggaaacgctacctc

SEQ ID NO: 5997370 - DNA, 15 bp, Homo sapiens
caccaaggcagtgca

SEQ ID NO: 5997371 - DNA, 18 bp, Homo sapiens
caccaaggcagtgcatgc

SEQ ID NO: 5997372 - DNA, 20 bp, Homo sapiens
caccaaggcagtgcatgcat

SEQ ID NO: 5997373 - DNA, 18 bp, Homo sapiens
caccaaggccctgcatct

SEQ ID NO: 5997374 - DNA, 17 bp, Homo sapiens
caccaaggctgcctgcc

SEQ ID NO: 5997375 - DNA, 17 bp, Homo sapiens
caccaagggtatctgct

SEQ ID NO: 5997376 - DNA, 16 bp, Homo sapiens
caccaaggtctcacac

SEQ ID NO: 5997377 - DNA, 19 bp, Homo sapiens
caccaaggtctcacactcc

SEQ ID NO: 5997378 - DNA, 15 bp, Homo sapiens
caccaaggtggcttc

SEQ ID NO: 5997379 - DNA, 19 bp, Homo sapiens
caccaagtaaatctatctc

SEQ ID NO: 5997380 - DNA, 21 bp, Homo sapiens
caccaagtattaaactgtaaa

SEQ ID NO: 5997381 - DNA, 13 bp, Homo sapiens
caccaagtgcaat

SEQ ID NO: 5997382 - DNA, 16 bp, Homo sapiens
caccaagtgcgggtcc

SEQ ID NO: 5997383 - DNA, 21 bp, Homo sapiens
caccaagtgcgggtccggcag

SEQ ID NO: 5997384 - DNA, 13 bp, Homo sapiens
caccaagtggctg

SEQ ID NO: 5997385 - DNA, 21 bp, Homo sapiens
caccaagtggctgggtgccct

SEQ ID NO: 5997386 - DNA, 15 bp, Homo sapiens
caccaagttctcata

SEQ ID NO: 5997387 - DNA, 12 bp, Homo sapiens
caccaataaagg

SEQ ID NO: 5997388 - DNA, 13 bp, Homo sapiens
caccaataaagga

SEQ ID NO: 5997389 - DNA, 12 bp, Homo sapiens
caccaataactt

SEQ ID NO: 5997390 - DNA, 18 bp, Homo sapiens
caccaataacttcagaga

SEQ ID NO: 5997391 - DNA, 22 bp, Homo sapiens
caccaataacttcagagaagtc

SEQ ID NO: 5997392 - DNA, 22 bp, Homo sapiens
caccaatatcatgtgtagatat

SEQ ID NO: 5997393 - DNA, 23 bp, Homo sapiens
caccaatattaacacgctgcctg

SEQ ID NO: 5997394 - DNA, 17 bp, Homo sapiens
caccaatcagcactctg

SEQ ID NO: 5997395 - DNA, 15 bp, Homo sapiens
caccaatcccagggc

SEQ ID NO: 5997396 - DNA, 17 bp, Homo sapiens
caccaatcttgtttata

SEQ ID NO: 5997397 - DNA, 20 bp, Homo sapiens
caccaatcttgtttatagca

SEQ ID NO: 5997398 - DNA, 21 bp, Homo sapiens
caccaatcttgtttatagcaa

SEQ ID NO: 5997399 - DNA, 17 bp, Homo sapiens
caccaatggctgcatca

SEQ ID NO: 5997400 - DNA, 17 bp, Homo sapiens
caccaatgtacccaccg

SEQ ID NO: 5997401 - DNA, 22 bp, Homo sapiens
caccaatgtacccaccgggcca

SEQ ID NO: 5997402 - DNA, 18 bp, Homo sapiens
caccaattgattttaaac

SEQ ID NO: 5997403 - DNA, 18 bp, Homo sapiens
caccacaaacacagccct

SEQ ID NO: 5997404 - DNA, 19 bp, Homo sapiens
caccacaaacacagccctg

SEQ ID NO: 5997405 - DNA, 23 bp, Homo sapiens
caccacaactaacaatgccttgt

SEQ ID NO: 5997406 - DNA, 20 bp, Homo sapiens
caccacaagccaccttttgt

SEQ ID NO: 5997407 - DNA, 18 bp, Homo sapiens
caccacaagtatctaaat

SEQ ID NO: 5997408 - DNA, 15 bp, Homo sapiens
caccacacacaacag

SEQ ID NO: 5997409 - DNA, 12 bp, Homo sapiens
caccacacagtc

SEQ ID NO: 5997410 - DNA, 20 bp, Homo sapiens
caccacacagtcacccctcc

SEQ ID NO: 5997411 - DNA, 14 bp, Homo sapiens
caccacacataata

SEQ ID NO: 5997412 - DNA, 15 bp, Homo sapiens
caccacacatcccag

SEQ ID NO: 5997413 - DNA, 13 bp, Homo sapiens
caccacacccagc

SEQ ID NO: 5997414 - DNA, 17 bp, Homo sapiens
caccacacccagcccac

SEQ ID NO: 5997415 - DNA, 19 bp, Homo sapiens
caccacacccagcccactt

SEQ ID NO: 5997416 - DNA, 15 bp, Homo sapiens
caccacacccagcct

SEQ ID NO: 5997417 - DNA, 18 bp, Homo sapiens
caccacacccaggtctct

SEQ ID NO: 5997418 - DNA, 18 bp, Homo sapiens
caccacacccctgccggc

SEQ ID NO: 5997419 - DNA, 22 bp, Homo sapiens
caccacacgcaaaccaaccttt

SEQ ID NO: 5997420 - DNA, 13 bp, Homo sapiens
caccacactcagc

SEQ ID NO: 5997421 - DNA, 14 bp, Homo sapiens
caccacactcagcc

SEQ ID NO: 5997422 - DNA, 14 bp, Homo sapiens
caccacactgacca

SEQ ID NO: 5997423 - DNA, 15 bp, Homo sapiens
caccacactgaccac

SEQ ID NO: 5997424 - DNA, 16 bp, Homo sapiens
caccacactgaccaca

SEQ ID NO: 5997425 - DNA, 19 bp, Homo sapiens
caccacactgatccagccc

SEQ ID NO: 5997426 - DNA, 15 bp, Homo sapiens
caccacactgggtgc

SEQ ID NO: 5997427 - DNA, 21 bp, Homo sapiens
caccacagaagcttgtattat

SEQ ID NO: 5997428 - DNA, 12 bp, Homo sapiens
caccacagacac

SEQ ID NO: 5997429 - DNA, 16 bp, Homo sapiens
caccacagacacacac

SEQ ID NO: 5997430 - DNA, 21 bp, Homo sapiens
caccacagacacacacacgca

SEQ ID NO: 5997431 - DNA, 16 bp, Homo sapiens
caccacagcattgtgt

SEQ ID NO: 5997432 - DNA, 10 bp, Homo sapiens
caccacagcc

SEQ ID NO: 5997433 - DNA, 17 bp, Homo sapiens
caccacagccagcacct

SEQ ID NO: 5997434 - DNA, 18 bp, Homo sapiens
caccacagcctccccttc

SEQ ID NO: 5997435 - DNA, 20 bp, Homo sapiens
caccacagcctccccttccc

SEQ ID NO: 5997436 - DNA, 21 bp, Homo sapiens
caccacagcctccccttccca

SEQ ID NO: 5997437 - DNA, 21 bp, Homo sapiens
caccacaggccctttcctcag

SEQ ID NO: 5997438 - DNA, 23 bp, Homo sapiens
caccacaggccctttcctcaggc

SEQ ID NO: 5997439 - DNA, 12 bp, Homo sapiens
caccacaggctg

SEQ ID NO: 5997440 - DNA, 22 bp, Homo sapiens
caccacatagcatgcttccttt

SEQ ID NO: 5997441 - DNA, 18 bp, Homo sapiens
caccacatcctccgtcca

SEQ ID NO: 5997442 - DNA, 16 bp, Homo sapiens
caccacatcttgtctt

SEQ ID NO: 5997443 - DNA, 19 bp, Homo sapiens
caccacatcttgtcttttc

SEQ ID NO: 5997444 - DNA, 15 bp, Homo sapiens
caccacatgtgcaca

SEQ ID NO: 5997445 - DNA, 20 bp, Homo sapiens
caccacattctgtctctgct

SEQ ID NO: 5997446 - DNA, 13 bp, Homo sapiens
caccaccaagcca

SEQ ID NO: 5997447 - DNA, 13 bp, Homo sapiens
caccaccacaccc

SEQ ID NO: 5997448 - DNA, 14 bp, Homo sapiens
caccaccacacccc

SEQ ID NO: 5997449 - DNA, 13 bp, Homo sapiens
caccaccacctga

SEQ ID NO: 5997450 - DNA, 15 bp, Homo sapiens
caccaccacctgacg

SEQ ID NO: 5997451 - DNA, 18 bp, Homo sapiens
caccaccacggtggtcac

SEQ ID NO: 5997452 - DNA, 16 bp, Homo sapiens
caccaccactgtgtcc

SEQ ID NO: 5997453 - DNA, 15 bp, Homo sapiens
caccaccaggagcag

SEQ ID NO: 5997454 - DNA, 23 bp, Homo sapiens
caccaccaggagcagcagccagc

SEQ ID NO: 5997455 - DNA, 11 bp, Homo sapiens
caccaccaggg

SEQ ID NO: 5997456 - DNA, 13 bp, Homo sapiens
caccaccagggct

SEQ ID NO: 5997457 - DNA, 17 bp, Homo sapiens
caccaccagggctccag

SEQ ID NO: 5997458 - DNA, 22 bp, Homo sapiens
caccaccagggctccaggagcc

SEQ ID NO: 5997459 - DNA, 13 bp, Homo sapiens
caccaccagggtg

SEQ ID NO: 5997460 - DNA, 21 bp, Homo sapiens
caccaccagggtggaccaggc

SEQ ID NO: 5997461 - DNA, 13 bp, Homo sapiens
caccaccaggtct

SEQ ID NO: 5997462 - DNA, 15 bp, Homo sapiens
caccaccaggtctcc

SEQ ID NO: 5997463 - DNA, 12 bp, Homo sapiens
caccacccagcc

SEQ ID NO: 5997464 - DNA, 16 bp, Homo sapiens
caccaccccagctgct

SEQ ID NO: 5997465 - DNA, 20 bp, Homo sapiens
caccaccccccactctgtgc

SEQ ID NO: 5997466 - DNA, 22 bp, Homo sapiens
caccaccccccactctgtgcct

SEQ ID NO: 5997467 - DNA, 14 bp, Homo sapiens
caccaccccctcaa

SEQ ID NO: 5997468 - DNA, 18 bp, Homo sapiens
caccaccccctcaagccc

SEQ ID NO: 5997469 - DNA, 22 bp, Homo sapiens
caccaccccctcaagccccagc

SEQ ID NO: 5997470 - DNA, 17 bp, Homo sapiens
caccaccccctgtccca

SEQ ID NO: 5997471 - DNA, 20 bp, Homo sapiens
caccacccctccctctgctc

SEQ ID NO: 5997472 - DNA, 21 bp, Homo sapiens
caccacccctccctctgctct

SEQ ID NO: 5997473 - DNA, 22 bp, Homo sapiens
caccacccctccctctgctctc

SEQ ID NO: 5997474 - DNA, 17 bp, Homo sapiens
caccacccctgggcagc

SEQ ID NO: 5997475 - DNA, 16 bp, Homo sapiens
caccacccgaaatgcc

SEQ ID NO: 5997476 - DNA, 23 bp, Homo sapiens
caccacccgctttcttgctggtt

SEQ ID NO: 5997477 - DNA, 15 bp, Homo sapiens
caccaccctcaggtg

SEQ ID NO: 5997478 - DNA, 20 bp, Homo sapiens
caccaccctcaggtgcctcc

SEQ ID NO: 5997479 - DNA, 21 bp, Homo sapiens
caccaccctcccaccatgcgc

SEQ ID NO: 5997480 - DNA, 10 bp, Homo sapiens
caccaccctg

SEQ ID NO: 5997481 - DNA, 22 bp, Homo sapiens
caccaccctgccccccctaaga

SEQ ID NO: 5997482 - DNA, 13 bp, Homo sapiens
caccaccctggca

SEQ ID NO: 5997483 - DNA, 16 bp, Homo sapiens
caccaccgagctctgt

SEQ ID NO: 5997484 - DNA, 16 bp, Homo sapiens
caccaccgccctcctc

SEQ ID NO: 5997485 - DNA, 15 bp, Homo sapiens
caccaccgctcccgc

SEQ ID NO: 5997486 - DNA, 17 bp, Homo sapiens
caccaccggccccctcc

SEQ ID NO: 5997487 - DNA, 22 bp, Homo sapiens
caccaccgtgtcatgagagaat

SEQ ID NO: 5997488 - DNA, 16 bp, Homo sapiens
caccacctcactcctg

SEQ ID NO: 5997489 - DNA, 14 bp, Homo sapiens
caccacctccctca

SEQ ID NO: 5997490 - DNA, 13 bp, Homo sapiens
caccacctctgtg

SEQ ID NO: 5997491 - DNA, 16 bp, Homo sapiens
caccacctctgtgggc

SEQ ID NO: 5997492 - DNA, 20 bp, Homo sapiens
caccacctctttctacagcc

SEQ ID NO: 5997493 - DNA, 19 bp, Homo sapiens
caccacctgacggctgggg

SEQ ID NO: 5997494 - DNA, 21 bp, Homo sapiens
caccacctgcccggcccagga

SEQ ID NO: 5997495 - DNA, 22 bp, Homo sapiens
caccacctgcccggcccaggag

SEQ ID NO: 5997496 - DNA, 13 bp, Homo sapiens
caccacctgcctc

SEQ ID NO: 5997497 - DNA, 15 bp, Homo sapiens
caccacctgcctcta

SEQ ID NO: 5997498 - DNA, 18 bp, Homo sapiens
caccaccttggactcctc

SEQ ID NO: 5997499 - DNA, 23 bp, Homo sapiens
caccaccttggactcctcccaca

SEQ ID NO: 5997500 - DNA, 18 bp, Homo sapiens
caccacgatgtggccctg

SEQ ID NO: 5997501 - DNA, 21 bp, Homo sapiens
caccacgatgtggccctggcc

SEQ ID NO: 5997502 - DNA, 15 bp, Homo sapiens
caccacgcagccgcc

SEQ ID NO: 5997503 - DNA, 15 bp, Homo sapiens
caccacgctggagct

SEQ ID NO: 5997504 - DNA, 22 bp, Homo sapiens
caccacggaccaaagggagtct

SEQ ID NO: 5997505 - DNA, 17 bp, Homo sapiens
caccacggcattatgat

SEQ ID NO: 5997506 - DNA, 18 bp, Homo sapiens
caccacggccaccactgc

SEQ ID NO: 5997507 - DNA, 16 bp, Homo sapiens
caccacggccactggc

SEQ ID NO: 5997508 - DNA, 17 bp, Homo sapiens
caccacggtagtgcctg

SEQ ID NO: 5997509 - DNA, 15 bp, Homo sapiens
caccacgtcacttca

SEQ ID NO: 5997510 - DNA, 23 bp, Homo sapiens
caccacgtcgggcttccctggcc

SEQ ID NO: 5997511 - DNA, 14 bp, Homo sapiens
caccacgtctgcca

SEQ ID NO: 5997512 - DNA, 15 bp, Homo sapiens
caccacgtctgccag

SEQ ID NO: 5997513 - DNA, 16 bp, Homo sapiens
caccacgtctgccagg

SEQ ID NO: 5997514 - DNA, 17 bp, Homo sapiens
caccacgtctgccaggc

SEQ ID NO: 5997515 - DNA, 19 bp, Homo sapiens
caccacgtctgccaggccc

SEQ ID NO: 5997516 - DNA, 21 bp, Homo sapiens
caccacgtctgccaggcccat

SEQ ID NO: 5997517 - DNA, 21 bp, Homo sapiens
caccacgtctggctccctgcc

SEQ ID NO: 5997518 - DNA, 13 bp, Homo sapiens
caccactaaaaaa

SEQ ID NO: 5997519 - DNA, 17 bp, Homo sapiens
caccactaaccatcccc

SEQ ID NO: 5997520 - DNA, 19 bp, Homo sapiens
caccactaaccatccccaa

SEQ ID NO: 5997521 - DNA, 20 bp, Homo sapiens
caccactaaccatccccaac

SEQ ID NO: 5997522 - DNA, 22 bp, Homo sapiens
caccactacagtaagctggttt

SEQ ID NO: 5997523 - DNA, 18 bp, Homo sapiens
caccactacattctgtta

SEQ ID NO: 5997524 - DNA, 17 bp, Homo sapiens
caccactaccagccagc

SEQ ID NO: 5997525 - DNA, 13 bp, Homo sapiens
caccactagagct

SEQ ID NO: 5997526 - DNA, 15 bp, Homo sapiens
caccactagcctcag

SEQ ID NO: 5997527 - DNA, 21 bp, Homo sapiens
caccactaggaatcccagagg

SEQ ID NO: 5997528 - DNA, 20 bp, Homo sapiens
caccactaggactctgaggc

SEQ ID NO: 5997529 - DNA, 21 bp, Homo sapiens
caccactagggtcctggccct

SEQ ID NO: 5997530 - DNA, 23 bp, Homo sapiens
caccactagggtcctggccctct

SEQ ID NO: 5997531 - DNA, 14 bp, Homo sapiens
caccactataaaat

SEQ ID NO: 5997532 - DNA, 11 bp, Homo sapiens
cagcaagaaaa

SEQ ID NO: 5997533 - DNA, 13 bp, Homo sapiens
cagcaagaaaaaa

SEQ ID NO: 5997534 - DNA, 14 bp, Homo sapiens
cagcaagaaaaggg

SEQ ID NO: 5997535 - DNA, 22 bp, Homo sapiens
cagcaagaagatcctaaaacaa

SEQ ID NO: 5997536 - DNA, 16 bp, Homo sapiens
cagcaagaataaaaaa

SEQ ID NO: 5997537 - DNA, 23 bp, Homo sapiens
cagcaagacttctctttgcctca

SEQ ID NO: 5997538 - DNA, 17 bp, Homo sapiens
cagcaagagagaaccta

SEQ ID NO: 5997539 - DNA, 17 bp, Homo sapiens
cagcaagagcacaagag

SEQ ID NO: 5997540 - DNA, 21 bp, Homo sapiens
cagcaagaggaaggggtgctg

SEQ ID NO: 5997541 - DNA, 16 bp, Homo sapiens
cagcaagagtaagcag

SEQ ID NO: 5997542 - DNA, 17 bp, Homo sapiens
cagcaagatgtttcttg

SEQ ID NO: 5997543 - DNA, 22 bp, Homo sapiens
cagcaagatgtttcttgccttt

SEQ ID NO: 5997544 - DNA, 14 bp, Homo sapiens
cagcaagcgggagc

SEQ ID NO: 5997545 - DNA, 20 bp, Homo sapiens
cagcaagcgggagcccgtgg

SEQ ID NO: 5997546 - DNA, 20 bp, Homo sapiens
cagcaagctgcccagccctg

SEQ ID NO: 5997547 - DNA, 16 bp, Homo sapiens
cagcaaggcacaggct

SEQ ID NO: 5997548 - DNA, 15 bp, Homo sapiens
cagcaaggcacctgc

SEQ ID NO: 5997549 - DNA, 16 bp, Homo sapiens
cagcaaggcacctgca

SEQ ID NO: 5997550 - DNA, 23 bp, Homo sapiens
cagcaaggcacctgcaggttggg

SEQ ID NO: 5997551 - DNA, 12 bp, Homo sapiens
cagcaaggcagg

SEQ ID NO: 5997552 - DNA, 22 bp, Homo sapiens
cagcaaggcaggttggatggga

SEQ ID NO: 5997553 - DNA, 13 bp, Homo sapiens
cagcaaggccacc

SEQ ID NO: 5997554 - DNA, 15 bp, Homo sapiens
cagcaaggccacctc

SEQ ID NO: 5997555 - DNA, 19 bp, Homo sapiens
cagcaaggccctgctgccc

SEQ ID NO: 5997556 - DNA, 21 bp, Homo sapiens
cagcaaggcgcctgccttggg

SEQ ID NO: 5997557 - DNA, 20 bp, Homo sapiens
cagcaaggcgctaacttgct

SEQ ID NO: 5997558 - DNA, 12 bp, Homo sapiens
cagcaaggctgt

SEQ ID NO: 5997559 - DNA, 16 bp, Homo sapiens
cagcaaggggctctgc

SEQ ID NO: 5997560 - DNA, 17 bp, Homo sapiens
cagcaaggggctctgcc

SEQ ID NO: 5997561 - DNA, 13 bp, Homo sapiens
cagcaaggggctg

SEQ ID NO: 5997562 - DNA, 14 bp, Homo sapiens
cagcaaggtcatgg

SEQ ID NO: 5997563 - DNA, 14 bp, Homo sapiens
cagcaaggtggagt

SEQ ID NO: 5997564 - DNA, 18 bp, Homo sapiens
cagcaaggtgtggaggct

SEQ ID NO: 5997565 - DNA, 20 bp, Homo sapiens
cagcaagtcccagacaagga

SEQ ID NO: 5997566 - DNA, 15 bp, Homo sapiens
cagcaagtgagagct

SEQ ID NO: 5997567 - DNA, 17 bp, Homo sapiens
cagcaagtgagagctgg

SEQ ID NO: 5997568 - DNA, 16 bp, Homo sapiens
cagcaagtgagcagag

SEQ ID NO: 5997569 - DNA, 17 bp, Homo sapiens
cagcaagtgagcagaga

SEQ ID NO: 5997570 - DNA, 15 bp, Homo sapiens
cagcaagtgcccagt

SEQ ID NO: 5997571 - DNA, 16 bp, Homo sapiens
cagcaagtgcccagtg

SEQ ID NO: 5997572 - DNA, 14 bp, Homo sapiens
cagcaagtggtcct

SEQ ID NO: 5997573 - DNA, 23 bp, Homo sapiens
cagcaagtgtacagtatttacct

SEQ ID NO: 5997574 - DNA, 17 bp, Homo sapiens
cagcaagttcacatgga

SEQ ID NO: 5997575 - DNA, 13 bp, Homo sapiens
cagcaataagaaa

SEQ ID NO: 5997576 - DNA, 14 bp, Homo sapiens
cagcaataagaaat

SEQ ID NO: 5997577 - DNA, 21 bp, Homo sapiens
cagcaataagaaatgaacaaa

SEQ ID NO: 5997578 - DNA, 23 bp, Homo sapiens
cagcaataagaaatgaacaaaag

SEQ ID NO: 5997579 - DNA, 21 bp, Homo sapiens
cagcaataatatgtgagagga

SEQ ID NO: 5997580 - DNA, 20 bp, Homo sapiens
cagcaatactcatcagagca

SEQ ID NO: 5997581 - DNA, 19 bp, Homo sapiens
cagcaatatattaccagca

SEQ ID NO: 5997582 - DNA, 21 bp, Homo sapiens
cagcaatattgcctgtgcttc

SEQ ID NO: 5997583 - DNA, 13 bp, Homo sapiens
cagcaatatttaa

SEQ ID NO: 5997584 - DNA, 14 bp, Homo sapiens
cagcaatatttaac

SEQ ID NO: 5997585 - DNA, 17 bp, Homo sapiens
cagcaatatttaaggag

SEQ ID NO: 5997586 - DNA, 15 bp, Homo sapiens
cagcaatattttgta

SEQ ID NO: 5997587 - DNA, 14 bp, Homo sapiens
cagcaatcccactt

SEQ ID NO: 5997588 - DNA, 17 bp, Homo sapiens
cagcaatcccacttagc

SEQ ID NO: 5997589 - DNA, 22 bp, Homo sapiens
cagcaatcccacttagcaggga

SEQ ID NO: 5997590 - DNA, 21 bp, Homo sapiens
cagcaatctgcattttaacaa

SEQ ID NO: 5997591 - DNA, 18 bp, Homo sapiens
cagcaatgacatctcagg

SEQ ID NO: 5997592 - DNA, 21 bp, Homo sapiens
cagcaatgacatctcaggggc

SEQ ID NO: 5997593 - DNA, 22 bp, Homo sapiens
cagcaatgatgtccagaagaat

SEQ ID NO: 5997594 - DNA, 18 bp, Homo sapiens
cagcaatgcaatgtggaa

SEQ ID NO: 5997595 - DNA, 19 bp, Homo sapiens
cagcaatgccatttcagtg

SEQ ID NO: 5997596 - DNA, 19 bp, Homo sapiens
cagcaatgccccaaacttt

SEQ ID NO: 5997597 - DNA, 13 bp, Homo sapiens
cagcaatgccctg

SEQ ID NO: 5997598 - DNA, 21 bp, Homo sapiens
cagcaatgccctgccttgctg

SEQ ID NO: 5997599 - DNA, 22 bp, Homo sapiens
cagcaatgccctgccttgctgc

SEQ ID NO: 5997600 - DNA, 20 bp, Homo sapiens
cagcaatggcgctgtgcggc

SEQ ID NO: 5997601 - DNA, 22 bp, Homo sapiens
cagcaattacaacggagtcaaa

SEQ ID NO: 5997602 - DNA, 16 bp, Homo sapiens
cagcaattatgaaaat

SEQ ID NO: 5997603 - DNA, 19 bp, Homo sapiens
cagcaattcacgctgtctc

SEQ ID NO: 5997604 - DNA, 17 bp, Homo sapiens
cagcaattcagacccct

SEQ ID NO: 5997605 - DNA, 14 bp, Homo sapiens
cagcaatttaaatg

SEQ ID NO: 5997606 - DNA, 13 bp, Homo sapiens
cagcaatttctaa

SEQ ID NO: 5997607 - DNA, 11 bp, Homo sapiens
cagcacaaaca

SEQ ID NO: 5997608 - DNA, 15 bp, Homo sapiens
cagcacaaacacaag

SEQ ID NO: 5997609 - DNA, 20 bp, Homo sapiens
cagcacaaagaaacagcctt

SEQ ID NO: 5997610 - DNA, 21 bp, Homo sapiens
cagcacaaagcactggccttg

SEQ ID NO: 5997611 - DNA, 18 bp, Homo sapiens
cagcacaactcagtctgt

SEQ ID NO: 5997612 - DNA, 18 bp, Homo sapiens
cagcacaaggccttgcct

SEQ ID NO: 5997613 - DNA, 22 bp, Homo sapiens
cagcacaaggccttgcctggcc

SEQ ID NO: 5997614 - DNA, 14 bp, Homo sapiens
cagcacaagggcac

SEQ ID NO: 5997615 - DNA, 24 bp, Homo sapiens
cagcacaattatgtgtgaagctga

SEQ ID NO: 5997616 - DNA, 19 bp, Homo sapiens
cagcacaattctgtccctg

SEQ ID NO: 5997617 - DNA, 20 bp, Homo sapiens
cagcacaattctgtccctgt

SEQ ID NO: 5997618 - DNA, 23 bp, Homo sapiens
cagcacaattctgtccctgtccc

SEQ ID NO: 5997619 - DNA, 24 bp, Homo sapiens
cagcacaattctgtccctgtccct

SEQ ID NO: 5997620 - DNA, 22 bp, Homo sapiens
cagcacacacacataagcactg

SEQ ID NO: 5997621 - DNA, 16 bp, Homo sapiens
cagcacacacagtgga

SEQ ID NO: 5997622 - DNA, 19 bp, Homo sapiens
cagcacacaggcagccagc

SEQ ID NO: 5997623 - DNA, 14 bp, Homo sapiens
cagcacacagggca

SEQ ID NO: 5997624 - DNA, 18 bp, Homo sapiens
cagcacacagggcagtga

SEQ ID NO: 5997625 - DNA, 17 bp, Homo sapiens
cagcacaccaagtggct

SEQ ID NO: 5997626 - DNA, 22 bp, Homo sapiens
cagcacaccaagtggctgggtg

SEQ ID NO: 5997627 - DNA, 14 bp, Homo sapiens
cagcacaccagccg

SEQ ID NO: 5997628 - DNA, 15 bp, Homo sapiens
cagcacaccagccgc

SEQ ID NO: 5997629 - DNA, 19 bp, Homo sapiens
cagcacaccagccgctgca

SEQ ID NO: 5997630 - DNA, 13 bp, Homo sapiens
cagcacaccccaa

SEQ ID NO: 5997631 - DNA, 17 bp, Homo sapiens
cagcacaccccaaggga

SEQ ID NO: 5997632 - DNA, 13 bp, Homo sapiens
cagcacacctcag

SEQ ID NO: 5997633 - DNA, 15 bp, Homo sapiens
cagcacacctcagcc

SEQ ID NO: 5997634 - DNA, 16 bp, Homo sapiens
cagcacacctcagccc

SEQ ID NO: 5997635 - DNA, 21 bp, Homo sapiens
cagcacacctcagccccactg

SEQ ID NO: 5997636 - DNA, 23 bp, Homo sapiens
cagcacacctcagccccactgac

SEQ ID NO: 5997637 - DNA, 15 bp, Homo sapiens
cagcacacctctggg

SEQ ID NO: 5997638 - DNA, 13 bp, Homo sapiens
cagcacacctgtg

SEQ ID NO: 5997639 - DNA, 17 bp, Homo sapiens
cagcacacctgtgtcca

SEQ ID NO: 5997640 - DNA, 21 bp, Homo sapiens
cagcacacctgtgtccaagaa

SEQ ID NO: 5997641 - DNA, 14 bp, Homo sapiens
cagcacacggtgag

SEQ ID NO: 5997642 - DNA, 13 bp, Homo sapiens
cagcacactcagc

SEQ ID NO: 5997643 - DNA, 23 bp, Homo sapiens
cagcacagaaggaatctgtgcag

SEQ ID NO: 5997644 - DNA, 18 bp, Homo sapiens
cagcacagactgttccct

SEQ ID NO: 5997645 - DNA, 14 bp, Homo sapiens
cagcacagagaaga

SEQ ID NO: 5997646 - DNA, 11 bp, Homo sapiens
cagcacagcct

SEQ ID NO: 5997647 - DNA, 13 bp, Homo sapiens
cagcacagcctca

SEQ ID NO: 5997648 - DNA, 22 bp, Homo sapiens
cagcacagcctcttagatgcag

SEQ ID NO: 5997649 - DNA, 14 bp, Homo sapiens
cagcacagcctggg

SEQ ID NO: 5997650 - DNA, 20 bp, Homo sapiens
cagcacagctactcagatct

SEQ ID NO: 5997651 - DNA, 17 bp, Homo sapiens
cagcacagctccctgcc

SEQ ID NO: 5997652 - DNA, 18 bp, Homo sapiens
cagcacagctcctcccct

SEQ ID NO: 5997653 - DNA, 17 bp, Homo sapiens
cagcacagcttagattt

SEQ ID NO: 5997654 - DNA, 16 bp, Homo sapiens
cagcacagcttgacct

SEQ ID NO: 5997655 - DNA, 20 bp, Homo sapiens
cagcacagcttgacctgagg

SEQ ID NO: 5997656 - DNA, 13 bp, Homo sapiens
cagcacaggcagc

SEQ ID NO: 5997657 - DNA, 16 bp, Homo sapiens
cagcacaggcagcccc

SEQ ID NO: 5997658 - DNA, 18 bp, Homo sapiens
cagcacaggcagccccac

SEQ ID NO: 5997659 - DNA, 20 bp, Homo sapiens
cagcacaggggccccagatc

SEQ ID NO: 5997660 - DNA, 15 bp, Homo sapiens
cagcacagtacacac

SEQ ID NO: 5997661 - DNA, 16 bp, Homo sapiens
cagcacagtaggtccc

SEQ ID NO: 5997662 - DNA, 23 bp, Homo sapiens
cagcacagtaggtcccggccagc

SEQ ID NO: 5997663 - DNA, 20 bp, Homo sapiens
cagcacatagcactgggaac

SEQ ID NO: 5997664 - DNA, 18 bp, Homo sapiens
cagcacatatttgcatgg

SEQ ID NO: 5997665 - DNA, 23 bp, Homo sapiens
cagcacatatttgcatgggaggg

SEQ ID NO: 5997666 - DNA, 16 bp, Homo sapiens
cagcacatgcactact

SEQ ID NO: 5997667 - DNA, 18 bp, Homo sapiens
cagcacatgctggccagc

SEQ ID NO: 5997668 - DNA, 18 bp, Homo sapiens
cagcacatggccatagag

SEQ ID NO: 5997669 - DNA, 21 bp, Homo sapiens
cagcacatggccatagaggcc

SEQ ID NO: 5997670 - DNA, 22 bp, Homo sapiens
cagcacatggccatagaggccc

SEQ ID NO: 5997671 - DNA, 15 bp, Homo sapiens
cagcacattcgggac

SEQ ID NO: 5997672 - DNA, 19 bp, Homo sapiens
cagcacattgccctgaggg

SEQ ID NO: 5997673 - DNA, 16 bp, Homo sapiens
cagcacatttccgctg

SEQ ID NO: 5997674 - DNA, 19 bp, Homo sapiens
cagcacatttccgctgtcc

SEQ ID NO: 5997675 - DNA, 11 bp, Homo sapiens
cagcaccaaat

SEQ ID NO: 5997676 - DNA, 23 bp, Homo sapiens
cagcaccaaatcaaaatctctcc

SEQ ID NO: 5997677 - DNA, 18 bp, Homo sapiens
cagcaccaagagcagctg

SEQ ID NO: 5997678 - DNA, 14 bp, Homo sapiens
cagcaccacactgg

SEQ ID NO: 5997679 - DNA, 17 bp, Homo sapiens
cagcaccacactgggtg

SEQ ID NO: 5997680 - DNA, 22 bp, Homo sapiens
cagcaccacactgggtgcgtct

SEQ ID NO: 5997681 - DNA, 18 bp, Homo sapiens
cagcaccacattgcctca

SEQ ID NO: 5997682 - DNA, 15 bp, Homo sapiens
cagcaccaccaggtc

SEQ ID NO: 5997683 - DNA, 16 bp, Homo sapiens
cagcaccaccaggtct

SEQ ID NO: 5997684 - DNA, 16 bp, Homo sapiens
cagcaccaccatttaa

SEQ ID NO: 5997685 - DNA, 22 bp, Homo sapiens
cagcaccaccctagtcccttcc

SEQ ID NO: 5997686 - DNA, 17 bp, Homo sapiens
cagcaccaccctccttc

SEQ ID NO: 5997687 - DNA, 21 bp, Homo sapiens
cagcaccactcaagaccaaat

SEQ ID NO: 5997688 - DNA, 16 bp, Homo sapiens
cagcaccagcctgagc

SEQ ID NO: 5997689 - DNA, 21 bp, Homo sapiens
cagcaccatccgccagggccc

SEQ ID NO: 5997690 - DNA, 19 bp, Homo sapiens
cagcaccatctctcctcct

SEQ ID NO: 5997691 - DNA, 12 bp, Homo sapiens
cagcacccaccc

SEQ ID NO: 5997692 - DNA, 17 bp, Homo sapiens
cagcacccacccatgca

SEQ ID NO: 5997693 - DNA, 19 bp, Homo sapiens
cagcacccaggctccatgg

SEQ ID NO: 5997694 - DNA, 16 bp, Homo sapiens
cagcacccatgcccca

SEQ ID NO: 5997695 - DNA, 13 bp, Homo sapiens
cagcaccccactc

SEQ ID NO: 5997696 - DNA, 16 bp, Homo sapiens
cagcacccccacccac

SEQ ID NO: 5997697 - DNA, 17 bp, Homo sapiens
cagcacccccacccacc

SEQ ID NO: 5997698 - DNA, 18 bp, Homo sapiens
cagcacccccacccacct

SEQ ID NO: 5997699 - DNA, 19 bp, Homo sapiens
cagcacccccacccacctc

SEQ ID NO: 5997700 - DNA, 20 bp, Homo sapiens
cagcaccccctctcctggag

SEQ ID NO: 5997701 - DNA, 23 bp, Homo sapiens
cagcaccccgaagggagcatctg

SEQ ID NO: 5997702 - DNA, 20 bp, Homo sapiens
cagcacccctagcatgaact

SEQ ID NO: 5997703 - DNA, 13 bp, Homo sapiens
cagcaccccttcc

SEQ ID NO: 5997704 - DNA, 14 bp, Homo sapiens
cagcaccccttcca

SEQ ID NO: 5997705 - DNA, 15 bp, Homo sapiens
cagcaccccttccat

SEQ ID NO: 5997706 - DNA, 22 bp, Homo sapiens
cagcaccccttccatgtggaga

SEQ ID NO: 5997707 - DNA, 23 bp, Homo sapiens
cagcaccccttccatgtggagaa

SEQ ID NO: 5997708 - DNA, 16 bp, Homo sapiens
cagcacccgggctcag

SEQ ID NO: 5997709 - DNA, 11 bp, Homo sapiens
cagcaccctcc

SEQ ID NO: 5997710 - DNA, 18 bp, Homo sapiens
caccactcaaaggccaga

SEQ ID NO: 5997711 - DNA, 16 bp, Homo sapiens
caccactcaagaccaa

SEQ ID NO: 5997712 - DNA, 12 bp, Homo sapiens
caccactcaggc

SEQ ID NO: 5997713 - DNA, 13 bp, Homo sapiens
caccactcaggcc

SEQ ID NO: 5997714 - DNA, 14 bp, Homo sapiens
caccactcaggcca

SEQ ID NO: 5997715 - DNA, 20 bp, Homo sapiens
caccactccactcctccagc

SEQ ID NO: 5997716 - DNA, 13 bp, Homo sapiens
caccactcctctc

SEQ ID NO: 5997717 - DNA, 17 bp, Homo sapiens
caccactcctctccctt

SEQ ID NO: 5997718 - DNA, 12 bp, Homo sapiens
caccactcctgc

SEQ ID NO: 5997719 - DNA, 20 bp, Homo sapiens
caccactcctgccagcccgg

SEQ ID NO: 5997720 - DNA, 17 bp, Homo sapiens
caccactctcaggacca

SEQ ID NO: 5997721 - DNA, 18 bp, Homo sapiens
caccactctggcagccac

SEQ ID NO: 5997722 - DNA, 21 bp, Homo sapiens
caccactctggcagccacact

SEQ ID NO: 5997723 - DNA, 15 bp, Homo sapiens
caccactgacagatg

SEQ ID NO: 5997724 - DNA, 18 bp, Homo sapiens
caccactgacgtttctgg

SEQ ID NO: 5997725 - DNA, 19 bp, Homo sapiens
caccactgagctctgcctc

SEQ ID NO: 5997726 - DNA, 14 bp, Homo sapiens
caccactgcactcc

SEQ ID NO: 5997727 - DNA, 17 bp, Homo sapiens
caccactgcactccagc

SEQ ID NO: 5997728 - DNA, 18 bp, Homo sapiens
caccactgcactccagcc

SEQ ID NO: 5997729 - DNA, 12 bp, Homo sapiens
caccactgccaa

SEQ ID NO: 5997730 - DNA, 19 bp, Homo sapiens
caccactgccctgcctgcc

SEQ ID NO: 5997731 - DNA, 14 bp, Homo sapiens
caccactgcttccc

SEQ ID NO: 5997732 - DNA, 12 bp, Homo sapiens
caccactgggaa

SEQ ID NO: 5997733 - DNA, 13 bp, Homo sapiens
caccactgtccct

SEQ ID NO: 5997734 - DNA, 18 bp, Homo sapiens
caccactgtccctaccac

SEQ ID NO: 5997735 - DNA, 21 bp, Homo sapiens
caccactgtccctaccactga

SEQ ID NO: 5997736 - DNA, 23 bp, Homo sapiens
caccactgtccctaccactgagc

SEQ ID NO: 5997737 - DNA, 18 bp, Homo sapiens
caccactgtgctcaacca

SEQ ID NO: 5997738 - DNA, 13 bp, Homo sapiens
caccactgtgtcc

SEQ ID NO: 5997739 - DNA, 20 bp, Homo sapiens
caccactgtgtcccagtgtc

SEQ ID NO: 5997740 - DNA, 23 bp, Homo sapiens
caccactgtgtcccagtgtctgg

SEQ ID NO: 5997741 - DNA, 11 bp, Homo sapiens
caccacttaat

SEQ ID NO: 5997742 - DNA, 14 bp, Homo sapiens
caccacttaatctt

SEQ ID NO: 5997743 - DNA, 23 bp, Homo sapiens
caccacttatttattgttgcctt

SEQ ID NO: 5997744 - DNA, 20 bp, Homo sapiens
caccacttttggattttatg

SEQ ID NO: 5997745 - DNA, 16 bp, Homo sapiens
caccagaaattccagt

SEQ ID NO: 5997746 - DNA, 18 bp, Homo sapiens
caccagaacgcaccccac

SEQ ID NO: 5997747 - DNA, 20 bp, Homo sapiens
caccagaacgcaccccactg

SEQ ID NO: 5997748 - DNA, 17 bp, Homo sapiens
caccagaagcccagaat

SEQ ID NO: 5997749 - DNA, 17 bp, Homo sapiens
caccagaagctgttggg

SEQ ID NO: 5997750 - DNA, 14 bp, Homo sapiens
caccagaataatga

SEQ ID NO: 5997751 - DNA, 21 bp, Homo sapiens
caccagaattagtcctcacag

SEQ ID NO: 5997752 - DNA, 16 bp, Homo sapiens
caccagaatttctaag

SEQ ID NO: 5997753 - DNA, 14 bp, Homo sapiens
caccagacacccag

SEQ ID NO: 5997754 - DNA, 16 bp, Homo sapiens
caccagacacccagga

SEQ ID NO: 5997755 - DNA, 18 bp, Homo sapiens
caccagacacccaggact

SEQ ID NO: 5997756 - DNA, 17 bp, Homo sapiens
caccagacgtcaggccc

SEQ ID NO: 5997757 - DNA, 22 bp, Homo sapiens
caccagactgaagtaaacagct

SEQ ID NO: 5997758 - DNA, 19 bp, Homo sapiens
caccagagaccgtcctcac

SEQ ID NO: 5997759 - DNA, 20 bp, Homo sapiens
caccagagaccgtcctcacc

SEQ ID NO: 5997760 - DNA, 12 bp, Homo sapiens
caccagagcaga

SEQ ID NO: 5997761 - DNA, 16 bp, Homo sapiens
caccagagcagatgca

SEQ ID NO: 5997762 - DNA, 17 bp, Homo sapiens
caccagagcagatgcag

SEQ ID NO: 5997763 - DNA, 19 bp, Homo sapiens
caccagagcagatgcagag

SEQ ID NO: 5997764 - DNA, 18 bp, Homo sapiens
caccagagcaggggctgc

SEQ ID NO: 5997765 - DNA, 13 bp, Homo sapiens
caccagagcccat

SEQ ID NO: 5997766 - DNA, 16 bp, Homo sapiens
caccagagcctccctc

SEQ ID NO: 5997767 - DNA, 17 bp, Homo sapiens
caccagagcctccctca

SEQ ID NO: 5997768 - DNA, 18 bp, Homo sapiens
caccagagcctccctcag

SEQ ID NO: 5997769 - DNA, 20 bp, Homo sapiens
caccagagcctccctcagcc

SEQ ID NO: 5997770 - DNA, 22 bp, Homo sapiens
caccagagcctccctcagccac

SEQ ID NO: 5997771 - DNA, 12 bp, Homo sapiens
caccagagctgc

SEQ ID NO: 5997772 - DNA, 13 bp, Homo sapiens
caccagagctgcc

SEQ ID NO: 5997773 - DNA, 15 bp, Homo sapiens
caccagagctgcctc

SEQ ID NO: 5997774 - DNA, 15 bp, Homo sapiens
caccagagcttctct

SEQ ID NO: 5997775 - DNA, 11 bp, Homo sapiens
caccagaggcc

SEQ ID NO: 5997776 - DNA, 23 bp, Homo sapiens
caccagaggccgaaggtgcctca

SEQ ID NO: 5997777 - DNA, 16 bp, Homo sapiens
caccagaggctgcaga

SEQ ID NO: 5997778 - DNA, 23 bp, Homo sapiens
caccagaggctgcagaaggccaa

SEQ ID NO: 5997779 - DNA, 16 bp, Homo sapiens
caccagagtgtatgca

SEQ ID NO: 5997780 - DNA, 16 bp, Homo sapiens
caccagatgatgtccc

SEQ ID NO: 5997781 - DNA, 15 bp, Homo sapiens
caccagatgcttttg

SEQ ID NO: 5997782 - DNA, 20 bp, Homo sapiens
caccagatgcttttgtgaga

SEQ ID NO: 5997783 - DNA, 17 bp, Homo sapiens
caccagcaatgccctgc

SEQ ID NO: 5997784 - DNA, 19 bp, Homo sapiens
caccagcaatgccctgcct

SEQ ID NO: 5997785 - DNA, 10 bp, Homo sapiens
caccagcagc

SEQ ID NO: 5997786 - DNA, 11 bp, Homo sapiens
caccagcagca

SEQ ID NO: 5997787 - DNA, 22 bp, Homo sapiens
caccagcagcacaattctgtcc

SEQ ID NO: 5997788 - DNA, 14 bp, Homo sapiens
caccagcagcactg

SEQ ID NO: 5997789 - DNA, 15 bp, Homo sapiens
caccagcagcactgg

SEQ ID NO: 5997790 - DNA, 12 bp, Homo sapiens
caccagcaggca

SEQ ID NO: 5997791 - DNA, 16 bp, Homo sapiens
caccagcatgtcactc

SEQ ID NO: 5997792 - DNA, 21 bp, Homo sapiens
caccagcatgtcactcccaga

SEQ ID NO: 5997793 - DNA, 19 bp, Homo sapiens
caccagccacagcctcccc

SEQ ID NO: 5997794 - DNA, 16 bp, Homo sapiens
caccagccacctcttg

SEQ ID NO: 5997795 - DNA, 11 bp, Homo sapiens
caccagccagc

SEQ ID NO: 5997796 - DNA, 14 bp, Homo sapiens
caccagccagccct

SEQ ID NO: 5997797 - DNA, 19 bp, Homo sapiens
caccagccagccctggccc

SEQ ID NO: 5997798 - DNA, 19 bp, Homo sapiens
caccagccaggctctgtgc

SEQ ID NO: 5997799 - DNA, 22 bp, Homo sapiens
caccagcccatcgccacaaact

SEQ ID NO: 5997800 - DNA, 21 bp, Homo sapiens
caccagcccatggccctgtgc

SEQ ID NO: 5997801 - DNA, 14 bp, Homo sapiens
caccagccccactg

SEQ ID NO: 5997802 - DNA, 18 bp, Homo sapiens
caccagccccactgccag

SEQ ID NO: 5997803 - DNA, 21 bp, Homo sapiens
caccagccccactgccagcag

SEQ ID NO: 5997804 - DNA, 15 bp, Homo sapiens
caccagccccagcaa

SEQ ID NO: 5997805 - DNA, 16 bp, Homo sapiens
caccagccccagtgcc

SEQ ID NO: 5997806 - DNA, 21 bp, Homo sapiens
caccagccccagtgcccacag

SEQ ID NO: 5997807 - DNA, 18 bp, Homo sapiens
caccagcccccgccccag

SEQ ID NO: 5997808 - DNA, 22 bp, Homo sapiens
caccagcccccgccccagagtg

SEQ ID NO: 5997809 - DNA, 23 bp, Homo sapiens
caccagcccccgccccagagtgg

SEQ ID NO: 5997810 - DNA, 22 bp, Homo sapiens
caccagccccctggatgggcat

SEQ ID NO: 5997811 - DNA, 17 bp, Homo sapiens
caccagcccctccccag

SEQ ID NO: 5997812 - DNA, 15 bp, Homo sapiens
caccagcccctgccc

SEQ ID NO: 5997813 - DNA, 14 bp, Homo sapiens
caccagccctactc

SEQ ID NO: 5997814 - DNA, 18 bp, Homo sapiens
caccagccctagctgtcc

SEQ ID NO: 5997815 - DNA, 12 bp, Homo sapiens
caccagccctga

SEQ ID NO: 5997816 - DNA, 14 bp, Homo sapiens
caccagccctgagc

SEQ ID NO: 5997817 - DNA, 17 bp, Homo sapiens
caccagccctgctgctt

SEQ ID NO: 5997818 - DNA, 20 bp, Homo sapiens
caccagccctgctgcttcct

SEQ ID NO: 5997819 - DNA, 21 bp, Homo sapiens
caccagccctgctgcttccta

SEQ ID NO: 5997820 - DNA, 19 bp, Homo sapiens
caccagcccttagcaggga

SEQ ID NO: 5997821 - DNA, 19 bp, Homo sapiens
caccagcccttccctgctt

SEQ ID NO: 5997822 - DNA, 20 bp, Homo sapiens
caccagcccttccctgcttt

SEQ ID NO: 5997823 - DNA, 16 bp, Homo sapiens
caccagccgccccagc

SEQ ID NO: 5997824 - DNA, 18 bp, Homo sapiens
caccagccgccccagccc

SEQ ID NO: 5997825 - DNA, 20 bp, Homo sapiens
caccagccgccccagcccct

SEQ ID NO: 5997826 - DNA, 17 bp, Homo sapiens
caccagccgctgcaggg

SEQ ID NO: 5997827 - DNA, 21 bp, Homo sapiens
caccagccgctgcagggctcc

SEQ ID NO: 5997828 - DNA, 22 bp, Homo sapiens
caccagccgctgcagggctccc

SEQ ID NO: 5997829 - DNA, 16 bp, Homo sapiens
caccagccggggaaga

SEQ ID NO: 5997830 - DNA, 20 bp, Homo sapiens
caccagcctaagaagctctg

SEQ ID NO: 5997831 - DNA, 11 bp, Homo sapiens
caccagcctca

SEQ ID NO: 5997832 - DNA, 12 bp, Homo sapiens
caccagcctcag

SEQ ID NO: 5997833 - DNA, 14 bp, Homo sapiens
caccagcctcagtg

SEQ ID NO: 5997834 - DNA, 15 bp, Homo sapiens
caccagcctgactgc

SEQ ID NO: 5997835 - DNA, 18 bp, Homo sapiens
caccagcctgagccacag

SEQ ID NO: 5997836 - DNA, 20 bp, Homo sapiens
caccagcctgagccacagtg

SEQ ID NO: 5997837 - DNA, 14 bp, Homo sapiens
caccagcctgcact

SEQ ID NO: 5997838 - DNA, 14 bp, Homo sapiens
caccagcctgctga

SEQ ID NO: 5997839 - DNA, 16 bp, Homo sapiens
caccagccttgctctc

SEQ ID NO: 5997840 - DNA, 17 bp, Homo sapiens
caccagccttgctctct

SEQ ID NO: 5997841 - DNA, 20 bp, Homo sapiens
caccagccttgctctcttca

SEQ ID NO: 5997842 - DNA, 18 bp, Homo sapiens
caccagcgcccccactcc

SEQ ID NO: 5997843 - DNA, 23 bp, Homo sapiens
caccagcgcccccactcctcctc

SEQ ID NO: 5997844 - DNA, 18 bp, Homo sapiens
caccagcggcctggagtc

SEQ ID NO: 5997845 - DNA, 13 bp, Homo sapiens
caccagcggcctt

SEQ ID NO: 5997846 - DNA, 14 bp, Homo sapiens
caccagcgttccct

SEQ ID NO: 5997847 - DNA, 20 bp, Homo sapiens
caccagcgttcccttctccc

SEQ ID NO: 5997848 - DNA, 21 bp, Homo sapiens
caccagcgttcccttctcccc

SEQ ID NO: 5997849 - DNA, 19 bp, Homo sapiens
caccagcgtttgaggggct

SEQ ID NO: 5997850 - DNA, 20 bp, Homo sapiens
caccagctcagccccggcca

SEQ ID NO: 5997851 - DNA, 21 bp, Homo sapiens
caccagctcagccccggccac

SEQ ID NO: 5997852 - DNA, 23 bp, Homo sapiens
caccagctccacacattccagcc

SEQ ID NO: 5997853 - DNA, 13 bp, Homo sapiens
caccagctccact

SEQ ID NO: 5997854 - DNA, 12 bp, Homo sapiens
caccagctcctc

SEQ ID NO: 5997855 - DNA, 22 bp, Homo sapiens
caccagctcgtttttcagcacc

SEQ ID NO: 5997856 - DNA, 23 bp, Homo sapiens
caccagctcgtttttcagcaccc

SEQ ID NO: 5997857 - DNA, 22 bp, Homo sapiens
caccagctctgccgtctctgga

SEQ ID NO: 5997858 - DNA, 13 bp, Homo sapiens
caccagctctgtg

SEQ ID NO: 5997859 - DNA, 16 bp, Homo sapiens
caccagctctgtggcc

SEQ ID NO: 5997860 - DNA, 10 bp, Homo sapiens
caccagctgc

SEQ ID NO: 5997861 - DNA, 15 bp, Homo sapiens
caccagctgcaaagt

SEQ ID NO: 5997862 - DNA, 17 bp, Homo sapiens
caccagctgcaaagtgt

SEQ ID NO: 5997863 - DNA, 16 bp, Homo sapiens
caccagctgcagcccc

SEQ ID NO: 5997864 - DNA, 14 bp, Homo sapiens
caccagctgcctct

SEQ ID NO: 5997865 - DNA, 15 bp, Homo sapiens
caccagctgcctctt

SEQ ID NO: 5997866 - DNA, 17 bp, Homo sapiens
caccagctgcctcttct

SEQ ID NO: 5997867 - DNA, 11 bp, Homo sapiens
caccagctgct

SEQ ID NO: 5997868 - DNA, 14 bp, Homo sapiens
caccagctgctgtg

SEQ ID NO: 5997869 - DNA, 17 bp, Homo sapiens
caccagctggctctgca

SEQ ID NO: 5997870 - DNA, 14 bp, Homo sapiens
caccagctggtata

SEQ ID NO: 5997871 - DNA, 15 bp, Homo sapiens
caccagctgtgtcca

SEQ ID NO: 5997872 - DNA, 22 bp, Homo sapiens
caccagctgttctgtcccttgg

SEQ ID NO: 5997873 - DNA, 16 bp, Homo sapiens
caccagcttctccagg

SEQ ID NO: 5997874 - DNA, 19 bp, Homo sapiens
caccagcttctttctcggt

SEQ ID NO: 5997875 - DNA, 11 bp, Homo sapiens
caccaggaaga

SEQ ID NO: 5997876 - DNA, 18 bp, Homo sapiens
caccaggaagaaggcccg

SEQ ID NO: 5997877 - DNA, 18 bp, Homo sapiens
caccaggaagcacaggtc

SEQ ID NO: 5997878 - DNA, 13 bp, Homo sapiens
caccaggaagccg

SEQ ID NO: 5997879 - DNA, 23 bp, Homo sapiens
caccaggaatgttaaagtcagtg

SEQ ID NO: 5997880 - DNA, 14 bp, Homo sapiens
caccaggactgaaa

SEQ ID NO: 5997881 - DNA, 11 bp, Homo sapiens
caccaggactt

SEQ ID NO: 5997882 - DNA, 21 bp, Homo sapiens
caccaggacttggggtcagga

SEQ ID NO: 5997883 - DNA, 17 bp, Homo sapiens
caccaggagaaccacta

SEQ ID NO: 5997884 - DNA, 14 bp, Homo sapiens
caccaggagacaga

SEQ ID NO: 5997885 - DNA, 14 bp, Homo sapiens
caccaggagcacct

SEQ ID NO: 5997886 - DNA, 12 bp, Homo sapiens
caccaggagcag

SEQ ID NO: 5997887 - DNA, 13 bp, Homo sapiens
caccaggagcagc

SEQ ID NO: 5997888 - DNA, 17 bp, Homo sapiens
caccaggagcagcagcc

SEQ ID NO: 5997889 - DNA, 14 bp, Homo sapiens
caccaggatttata

SEQ ID NO: 5997890 - DNA, 24 bp, Homo sapiens
caccaggcacgaacccacctgctg

SEQ ID NO: 5997891 - DNA, 16 bp, Homo sapiens
cagcaccctctcctgg

SEQ ID NO: 5997892 - DNA, 13 bp, Homo sapiens
cagcaccctctgt

SEQ ID NO: 5997893 - DNA, 12 bp, Homo sapiens
cagcaccctgca

SEQ ID NO: 5997894 - DNA, 15 bp, Homo sapiens
cagcaccctgcagag

SEQ ID NO: 5997895 - DNA, 11 bp, Homo sapiens
cagcaccctgg

SEQ ID NO: 5997896 - DNA, 20 bp, Homo sapiens
cagcaccctgggtgccattc

SEQ ID NO: 5997897 - DNA, 19 bp, Homo sapiens
cagcaccctttcaccccca

SEQ ID NO: 5997898 - DNA, 19 bp, Homo sapiens
cagcaccggaccagcctgg

SEQ ID NO: 5997899 - DNA, 17 bp, Homo sapiens
cagcaccgtgccaaccc

SEQ ID NO: 5997900 - DNA, 20 bp, Homo sapiens
cagcaccgtgggccctcaag

SEQ ID NO: 5997901 - DNA, 20 bp, Homo sapiens
cagcacctacagtgtacagt

SEQ ID NO: 5997902 - DNA, 21 bp, Homo sapiens
cagcacctaggtggggcctgg

SEQ ID NO: 5997903 - DNA, 23 bp, Homo sapiens
cagcacctcacctgagacctcca

SEQ ID NO: 5997904 - DNA, 16 bp, Homo sapiens
cagcacctcagcctgc

SEQ ID NO: 5997905 - DNA, 14 bp, Homo sapiens
cagcacctccaggc

SEQ ID NO: 5997906 - DNA, 14 bp, Homo sapiens
cagcacctcctcag

SEQ ID NO: 5997907 - DNA, 16 bp, Homo sapiens
cagcacctcctcagcc

SEQ ID NO: 5997908 - DNA, 20 bp, Homo sapiens
cagcacctcctccgtgggca

SEQ ID NO: 5997909 - DNA, 18 bp, Homo sapiens
cagcacctcctctctgct

SEQ ID NO: 5997910 - DNA, 19 bp, Homo sapiens
cagcacctcctctctgctg

SEQ ID NO: 5997911 - DNA, 22 bp, Homo sapiens
cagcacctcctctctgctgggt

SEQ ID NO: 5997912 - DNA, 20 bp, Homo sapiens
cagcacctctcaggattgct

SEQ ID NO: 5997913 - DNA, 12 bp, Homo sapiens
cagcacctgcca

SEQ ID NO: 5997914 - DNA, 13 bp, Homo sapiens
cagcacctgccag

SEQ ID NO: 5997915 - DNA, 16 bp, Homo sapiens
cagcacctgccagggc

SEQ ID NO: 5997916 - DNA, 14 bp, Homo sapiens
cagcacctgctccc

SEQ ID NO: 5997917 - DNA, 13 bp, Homo sapiens
cagcacctggagc

SEQ ID NO: 5997918 - DNA, 17 bp, Homo sapiens
cagcacctggagcccac

SEQ ID NO: 5997919 - DNA, 13 bp, Homo sapiens
cagcacctgtctc

SEQ ID NO: 5997920 - DNA, 15 bp, Homo sapiens
cagcacctgtggctg

SEQ ID NO: 5997921 - DNA, 20 bp, Homo sapiens
cagcaccttaaaaattagaa

SEQ ID NO: 5997922 - DNA, 22 bp, Homo sapiens
cagcaccttcaagcgctccagg

SEQ ID NO: 5997923 - DNA, 18 bp, Homo sapiens
cagcaccttctttctgga

SEQ ID NO: 5997924 - DNA, 21 bp, Homo sapiens
cagcaccttctttctggactg

SEQ ID NO: 5997925 - DNA, 22 bp, Homo sapiens
cagcaccttctttctggactgg

SEQ ID NO: 5997926 - DNA, 20 bp, Homo sapiens
cagcaccttgcagattttct

SEQ ID NO: 5997927 - DNA, 14 bp, Homo sapiens
cagcaccttggccc

SEQ ID NO: 5997928 - DNA, 19 bp, Homo sapiens
cagcaccttgtgcctgggg

SEQ ID NO: 5997929 - DNA, 13 bp, Homo sapiens
cagcacctttctc

SEQ ID NO: 5997930 - DNA, 19 bp, Homo sapiens
cagcacctttctctgagaa

SEQ ID NO: 5997931 - DNA, 14 bp, Homo sapiens
cagcacctttgtaa

SEQ ID NO: 5997932 - DNA, 16 bp, Homo sapiens
cagcacgagcctgggc

SEQ ID NO: 5997933 - DNA, 14 bp, Homo sapiens
cagcacgatttctg

SEQ ID NO: 5997934 - DNA, 20 bp, Homo sapiens
cagcacgatttctgtttaga

SEQ ID NO: 5997935 - DNA, 18 bp, Homo sapiens
cagcacgcaggcggggca

SEQ ID NO: 5997936 - DNA, 19 bp, Homo sapiens
cagcacgcatgtccctcca

SEQ ID NO: 5997937 - DNA, 21 bp, Homo sapiens
cagcacgccaaccccagcagt

SEQ ID NO: 5997938 - DNA, 15 bp, Homo sapiens
cagcacgcctctccc

SEQ ID NO: 5997939 - DNA, 17 bp, Homo sapiens
cagcacgcctctcccca

SEQ ID NO: 5997940 - DNA, 20 bp, Homo sapiens
cagcacgcctctccccacct

SEQ ID NO: 5997941 - DNA, 23 bp, Homo sapiens
cagcacgcggccttgtctgggtg

SEQ ID NO: 5997942 - DNA, 17 bp, Homo sapiens
cagcacggcccggcccc

SEQ ID NO: 5997943 - DNA, 19 bp, Homo sapiens
cagcacggcccggcccctc

SEQ ID NO: 5997944 - DNA, 20 bp, Homo sapiens
cagcacggcccggcccctca

SEQ ID NO: 5997945 - DNA, 21 bp, Homo sapiens
cagcacggcccggcccctcac

SEQ ID NO: 5997946 - DNA, 23 bp, Homo sapiens
cagcacggcccggcccctcaccc

SEQ ID NO: 5997947 - DNA, 21 bp, Homo sapiens
cagcacgggcacagctgctgt

SEQ ID NO: 5997948 - DNA, 14 bp, Homo sapiens
cagcacgtctcaga

SEQ ID NO: 5997949 - DNA, 15 bp, Homo sapiens
cagcacgtgcagcca

SEQ ID NO: 5997950 - DNA, 22 bp, Homo sapiens
cagcacgttttctggcttctgc

SEQ ID NO: 5997951 - DNA, 17 bp, Homo sapiens
cagcactaaagcagtgg

SEQ ID NO: 5997952 - DNA, 20 bp, Homo sapiens
cagcactaaagcagtggaca

SEQ ID NO: 5997953 - DNA, 22 bp, Homo sapiens
cagcactaaggccgtgtctctg

SEQ ID NO: 5997954 - DNA, 18 bp, Homo sapiens
cagcactaattagtgtcc

SEQ ID NO: 5997955 - DNA, 20 bp, Homo sapiens
cagcactactgggtgtcatt

SEQ ID NO: 5997956 - DNA, 20 bp, Homo sapiens
cagcactacttacttagaga

SEQ ID NO: 5997957 - DNA, 21 bp, Homo sapiens
cagcactacttacttagagat

SEQ ID NO: 5997958 - DNA, 18 bp, Homo sapiens
cagcactagagtcacccc

SEQ ID NO: 5997959 - DNA, 20 bp, Homo sapiens
cagcactagagtcacccccc

SEQ ID NO: 5997960 - DNA, 17 bp, Homo sapiens
cagcactagccaaacct

SEQ ID NO: 5997961 - DNA, 19 bp, Homo sapiens
cagcactagtaaaggagga

SEQ ID NO: 5997962 - DNA, 19 bp, Homo sapiens
cagcactatgctttccttc

SEQ ID NO: 5997963 - DNA, 20 bp, Homo sapiens
cagcactatgctttccttct

SEQ ID NO: 5997964 - DNA, 22 bp, Homo sapiens
cagcactcaaccaacctccccg

SEQ ID NO: 5997965 - DNA, 22 bp, Homo sapiens
cagcactcacacaggaccccct

SEQ ID NO: 5997966 - DNA, 14 bp, Homo sapiens
cagcactcccaggg

SEQ ID NO: 5997967 - DNA, 15 bp, Homo sapiens
cagcactcccagggc

SEQ ID NO: 5997968 - DNA, 22 bp, Homo sapiens
cagcactccccagagctgtgcc

SEQ ID NO: 5997969 - DNA, 15 bp, Homo sapiens
cagcactccccttgc

SEQ ID NO: 5997970 - DNA, 13 bp, Homo sapiens
cagcactcccgct

SEQ ID NO: 5997971 - DNA, 19 bp, Homo sapiens
cagcactcccgctgcacac

SEQ ID NO: 5997972 - DNA, 22 bp, Homo sapiens
cagcactcccgctgcacacaga

SEQ ID NO: 5997973 - DNA, 17 bp, Homo sapiens
cagcactccgcatcacc

SEQ ID NO: 5997974 - DNA, 15 bp, Homo sapiens
cagcactcctcggca

SEQ ID NO: 5997975 - DNA, 17 bp, Homo sapiens
cagcactcctctgtctc

SEQ ID NO: 5997976 - DNA, 21 bp, Homo sapiens
cagcactctctaaatcttcct

SEQ ID NO: 5997977 - DNA, 15 bp, Homo sapiens
cagcactctggactc

SEQ ID NO: 5997978 - DNA, 12 bp, Homo sapiens
cagcactgaaaa

SEQ ID NO: 5997979 - DNA, 14 bp, Homo sapiens
cagcactgcctcct

SEQ ID NO: 5997980 - DNA, 15 bp, Homo sapiens
cagcactgcctcctg

SEQ ID NO: 5997981 - DNA, 16 bp, Homo sapiens
cagcactgcctcctgt

SEQ ID NO: 5997982 - DNA, 16 bp, Homo sapiens
cagcactgcctgccaa

SEQ ID NO: 5997983 - DNA, 17 bp, Homo sapiens
cagcactgcctgccaag

SEQ ID NO: 5997984 - DNA, 18 bp, Homo sapiens
cagcactgcctgccaagc

SEQ ID NO: 5997985 - DNA, 15 bp, Homo sapiens
cagcactgcctgctc

SEQ ID NO: 5997986 - DNA, 17 bp, Homo sapiens
cagcactgcctgctccc

SEQ ID NO: 5997987 - DNA, 20 bp, Homo sapiens
cagcactgctgcctcagctc

SEQ ID NO: 5997988 - DNA, 16 bp, Homo sapiens
cagcactgcttgagga

SEQ ID NO: 5997989 - DNA, 12 bp, Homo sapiens
cagcactggctc

SEQ ID NO: 5997990 - DNA, 17 bp, Homo sapiens
cagcactggctctctcc

SEQ ID NO: 5997991 - DNA, 21 bp, Homo sapiens
cagcactggctctctccagga

SEQ ID NO: 5997992 - DNA, 23 bp, Homo sapiens
cagcactggctctctccaggatc

SEQ ID NO: 5997993 - DNA, 17 bp, Homo sapiens
cagcactgggaagctgg

SEQ ID NO: 5997994 - DNA, 12 bp, Homo sapiens
cagcactgtccc

SEQ ID NO: 5997995 - DNA, 13 bp, Homo sapiens
cagcactgtccct

SEQ ID NO: 5997996 - DNA, 18 bp, Homo sapiens
cagcactgtcccttgcct

SEQ ID NO: 5997997 - DNA, 20 bp, Homo sapiens
cagcactgtcccttgcctca

SEQ ID NO: 5997998 - DNA, 15 bp, Homo sapiens
cagcactgtctcagt

SEQ ID NO: 5997999 - DNA, 22 bp, Homo sapiens
cagcactgtgaagacccagcag

SEQ ID NO: 5998000 - DNA, 12 bp, Homo sapiens
cagcactgtgag

SEQ ID NO: 5998001 - DNA, 15 bp, Homo sapiens
cagcacttcaaagaa

SEQ ID NO: 5998002 - DNA, 12 bp, Homo sapiens
cagcacttccat

SEQ ID NO: 5998003 - DNA, 15 bp, Homo sapiens
cagcacttggccctt

SEQ ID NO: 5998004 - DNA, 15 bp, Homo sapiens
cagcacttgtccagc

SEQ ID NO: 5998005 - DNA, 19 bp, Homo sapiens
cagcacttgtccagctgag

SEQ ID NO: 5998006 - DNA, 21 bp, Homo sapiens
cagcacttgtctcattttaat

SEQ ID NO: 5998007 - DNA, 23 bp, Homo sapiens
cagcacttgtctcattttaatgt

SEQ ID NO: 5998008 - DNA, 19 bp, Homo sapiens
cagcactttaaagaggctg

SEQ ID NO: 5998009 - DNA, 21 bp, Homo sapiens
cagcactttaaagaggctgtg

SEQ ID NO: 5998010 - DNA, 21 bp, Homo sapiens
cagcactttaaccctctcttc

SEQ ID NO: 5998011 - DNA, 24 bp, Homo sapiens
cagcactttaaccctctcttccct

SEQ ID NO: 5998012 - DNA, 14 bp, Homo sapiens
cagcactttagaat

SEQ ID NO: 5998013 - DNA, 22 bp, Homo sapiens
cagcactttagaatatgccttg

SEQ ID NO: 5998014 - DNA, 21 bp, Homo sapiens
cagcactttgagaggctgagg

SEQ ID NO: 5998015 - DNA, 17 bp, Homo sapiens
cagcactttgggaagct

SEQ ID NO: 5998016 - DNA, 23 bp, Homo sapiens
cagcactttgggaagctgaggca

SEQ ID NO: 5998017 - DNA, 18 bp, Homo sapiens
cagcactttgggaggcag

SEQ ID NO: 5998018 - DNA, 20 bp, Homo sapiens
cagcactttgggaggcaggg

SEQ ID NO: 5998019 - DNA, 23 bp, Homo sapiens
cagcactttgggaggctgaagtg

SEQ ID NO: 5998020 - DNA, 23 bp, Homo sapiens
cagcactttgggaggctgaggtg

SEQ ID NO: 5998021 - DNA, 17 bp, Homo sapiens
cagcactttttccttct

SEQ ID NO: 5998022 - DNA, 15 bp, Homo sapiens
cagcagaaaagtgct

SEQ ID NO: 5998023 - DNA, 18 bp, Homo sapiens
cagcagaaaagtgcttag

SEQ ID NO: 5998024 - DNA, 18 bp, Homo sapiens
cagcagaaacacacagtc

SEQ ID NO: 5998025 - DNA, 22 bp, Homo sapiens
cagcagaaacacacagtcacat

SEQ ID NO: 5998026 - DNA, 21 bp, Homo sapiens
cagcagaaacccccaggagga

SEQ ID NO: 5998027 - DNA, 16 bp, Homo sapiens
cagcagaaatgccccc

SEQ ID NO: 5998028 - DNA, 23 bp, Homo sapiens
cagcagaacaaactcagatctca

SEQ ID NO: 5998029 - DNA, 20 bp, Homo sapiens
cagcagaacaagtgcctcct

SEQ ID NO: 5998030 - DNA, 16 bp, Homo sapiens
cagcagaacagccatt

SEQ ID NO: 5998031 - DNA, 16 bp, Homo sapiens
cagcagaaccagcctc

SEQ ID NO: 5998032 - DNA, 17 bp, Homo sapiens
cagcagaaccagcctca

SEQ ID NO: 5998033 - DNA, 18 bp, Homo sapiens
cagcagaaccagcctcaa

SEQ ID NO: 5998034 - DNA, 18 bp, Homo sapiens
cagcagaacctgcacaca

SEQ ID NO: 5998035 - DNA, 19 bp, Homo sapiens
cagcagaacctgcacacag

SEQ ID NO: 5998036 - DNA, 15 bp, Homo sapiens
cagcagaaccttggc

SEQ ID NO: 5998037 - DNA, 24 bp, Homo sapiens
cagcagaagagggaggcttcctga

SEQ ID NO: 5998038 - DNA, 12 bp, Homo sapiens
cagcagaagcct

SEQ ID NO: 5998039 - DNA, 15 bp, Homo sapiens
cagcagaagcctcca

SEQ ID NO: 5998040 - DNA, 16 bp, Homo sapiens
cagcagaaggccttgc

SEQ ID NO: 5998041 - DNA, 17 bp, Homo sapiens
cagcagaagggggtggt

SEQ ID NO: 5998042 - DNA, 16 bp, Homo sapiens
cagcagaatgactctg

SEQ ID NO: 5998043 - DNA, 17 bp, Homo sapiens
cagcagaatgactctgg

SEQ ID NO: 5998044 - DNA, 16 bp, Homo sapiens
cagcagaatggaggca

SEQ ID NO: 5998045 - DNA, 13 bp, Homo sapiens
cagcagacacaca

SEQ ID NO: 5998046 - DNA, 21 bp, Homo sapiens
cagcagacaccattcattcca

SEQ ID NO: 5998047 - DNA, 19 bp, Homo sapiens
cagcagacatcaagctcaa

SEQ ID NO: 5998048 - DNA, 21 bp, Homo sapiens
cagcagacatcaagctcaagg

SEQ ID NO: 5998049 - DNA, 13 bp, Homo sapiens
cagcagacattgt

SEQ ID NO: 5998050 - DNA, 17 bp, Homo sapiens
cagcagacattgtcagc

SEQ ID NO: 5998051 - DNA, 23 bp, Homo sapiens
cagcagactcagctctgacattc

SEQ ID NO: 5998052 - DNA, 18 bp, Homo sapiens
cagcagactgatcaggac

SEQ ID NO: 5998053 - DNA, 12 bp, Homo sapiens
cagcagagagag

SEQ ID NO: 5998054 - DNA, 13 bp, Homo sapiens
cagcagagagaga

SEQ ID NO: 5998055 - DNA, 13 bp, Homo sapiens
cagcagagagccc

SEQ ID NO: 5998056 - DNA, 13 bp, Homo sapiens
cagcagagcatgt

SEQ ID NO: 5998057 - DNA, 14 bp, Homo sapiens
cagcagagccaggg

SEQ ID NO: 5998058 - DNA, 17 bp, Homo sapiens
cagcagagccagggcag

SEQ ID NO: 5998059 - DNA, 18 bp, Homo sapiens
cagcagagccagggcagg

SEQ ID NO: 5998060 - DNA, 21 bp, Homo sapiens
cagcagagccagggcagggcg

SEQ ID NO: 5998061 - DNA, 15 bp, Homo sapiens
cagcagagcccacca

SEQ ID NO: 5998062 - DNA, 19 bp, Homo sapiens
cagcagagccgttcctggg

SEQ ID NO: 5998063 - DNA, 14 bp, Homo sapiens
cagcagagcggggt

SEQ ID NO: 5998064 - DNA, 10 bp, Homo sapiens
cagcagagga

SEQ ID NO: 5998065 - DNA, 12 bp, Homo sapiens
cagcagaggcag

SEQ ID NO: 5998066 - DNA, 13 bp, Homo sapiens
cagcagaggcagg

SEQ ID NO: 5998067 - DNA, 22 bp, Homo sapiens
cagcagaggcaggaccagaagg

SEQ ID NO: 5998068 - DNA, 18 bp, Homo sapiens
cagcagaggcaggctggg

SEQ ID NO: 5998069 - DNA, 22 bp, Homo sapiens
caccaggccacctccccagcat

SEQ ID NO: 5998070 - DNA, 13 bp, Homo sapiens
caccaggccagct

SEQ ID NO: 5998071 - DNA, 19 bp, Homo sapiens
caccaggccagctcaggaa

SEQ ID NO: 5998072 - DNA, 13 bp, Homo sapiens
caccaggccgggc

SEQ ID NO: 5998073 - DNA, 21 bp, Homo sapiens
caccaggccgtcctcccgggc

SEQ ID NO: 5998074 - DNA, 18 bp, Homo sapiens
caccaggccgtgccttgt

SEQ ID NO: 5998075 - DNA, 19 bp, Homo sapiens
caccaggccgtgccttgtt

SEQ ID NO: 5998076 - DNA, 12 bp, Homo sapiens
caccaggcctgg

SEQ ID NO: 5998077 - DNA, 13 bp, Homo sapiens
caccaggcctggc

SEQ ID NO: 5998078 - DNA, 16 bp, Homo sapiens
caccaggcctggcctc

SEQ ID NO: 5998079 - DNA, 21 bp, Homo sapiens
caccaggcctggcctctgggc

SEQ ID NO: 5998080 - DNA, 22 bp, Homo sapiens
caccaggcctggcctctgggca

SEQ ID NO: 5998081 - DNA, 17 bp, Homo sapiens
caccaggcgctaattca

SEQ ID NO: 5998082 - DNA, 14 bp, Homo sapiens
caccaggctgctca

SEQ ID NO: 5998083 - DNA, 13 bp, Homo sapiens
caccaggctggcg

SEQ ID NO: 5998084 - DNA, 19 bp, Homo sapiens
caccaggctggcgcagcca

SEQ ID NO: 5998085 - DNA, 23 bp, Homo sapiens
caccaggctggcgcagccaaggc

SEQ ID NO: 5998086 - DNA, 17 bp, Homo sapiens
caccaggctgtgggcct

SEQ ID NO: 5998087 - DNA, 13 bp, Homo sapiens
caccagggaagaa

SEQ ID NO: 5998088 - DNA, 13 bp, Homo sapiens
caccagggaagat

SEQ ID NO: 5998089 - DNA, 23 bp, Homo sapiens
caccagggactcggcccagggcc

SEQ ID NO: 5998090 - DNA, 21 bp, Homo sapiens
caccagggagaggcctcggct

SEQ ID NO: 5998091 - DNA, 19 bp, Homo sapiens
caccagggagcttcctggc

SEQ ID NO: 5998092 - DNA, 22 bp, Homo sapiens
caccagggagcttcctggctct

SEQ ID NO: 5998093 - DNA, 17 bp, Homo sapiens
caccagggatcacagac

SEQ ID NO: 5998094 - DNA, 21 bp, Homo sapiens
caccagggatcacagaccaca

SEQ ID NO: 5998095 - DNA, 16 bp, Homo sapiens
caccagggcactgtct

SEQ ID NO: 5998096 - DNA, 17 bp, Homo sapiens
caccagggcatctctgg

SEQ ID NO: 5998097 - DNA, 23 bp, Homo sapiens
caccagggcatctctgggctgga

SEQ ID NO: 5998098 - DNA, 11 bp, Homo sapiens
caccagggcca

SEQ ID NO: 5998099 - DNA, 19 bp, Homo sapiens
caccagggccagagcagct

SEQ ID NO: 5998100 - DNA, 17 bp, Homo sapiens
caccagggccagcctct

SEQ ID NO: 5998101 - DNA, 18 bp, Homo sapiens
caccaggggaggagcctg

SEQ ID NO: 5998102 - DNA, 20 bp, Homo sapiens
caccaggggaggagcctgtg

SEQ ID NO: 5998103 - DNA, 19 bp, Homo sapiens
caccaggggcaggcacagc

SEQ ID NO: 5998104 - DNA, 22 bp, Homo sapiens
caccaggggtgctatgacatgc

SEQ ID NO: 5998105 - DNA, 22 bp, Homo sapiens
caccaggggtgctcacctctgc

SEQ ID NO: 5998106 - DNA, 23 bp, Homo sapiens
caccaggggtgctcacctctgcc

SEQ ID NO: 5998107 - DNA, 19 bp, Homo sapiens
caccagggtccgcaccagc

SEQ ID NO: 5998108 - DNA, 12 bp, Homo sapiens
caccaggtcctg

SEQ ID NO: 5998109 - DNA, 14 bp, Homo sapiens
caccaggtctcccg

SEQ ID NO: 5998110 - DNA, 16 bp, Homo sapiens
caccaggtgcatctgc

SEQ ID NO: 5998111 - DNA, 17 bp, Homo sapiens
caccaggtgcatgcatg

SEQ ID NO: 5998112 - DNA, 22 bp, Homo sapiens
caccaggtgcctttcaaattta

SEQ ID NO: 5998113 - DNA, 16 bp, Homo sapiens
caccagtaataaaaag

SEQ ID NO: 5998114 - DNA, 17 bp, Homo sapiens
caccagtaataaaaagc

SEQ ID NO: 5998115 - DNA, 18 bp, Homo sapiens
caccagtaataaaaagcc

SEQ ID NO: 5998116 - DNA, 20 bp, Homo sapiens
caccagtaataaaaagccac

SEQ ID NO: 5998117 - DNA, 16 bp, Homo sapiens
caccagtaattatgag

SEQ ID NO: 5998118 - DNA, 23 bp, Homo sapiens
caccagtcacatgacctgatcac

SEQ ID NO: 5998119 - DNA, 15 bp, Homo sapiens
caccagtcccatgct

SEQ ID NO: 5998120 - DNA, 17 bp, Homo sapiens
caccagtcccatgctgg

SEQ ID NO: 5998121 - DNA, 18 bp, Homo sapiens
caccagtcccatgctggc

SEQ ID NO: 5998122 - DNA, 20 bp, Homo sapiens
caccagtgaatgaaagtctt

SEQ ID NO: 5998123 - DNA, 14 bp, Homo sapiens
caccagtgacctgg

SEQ ID NO: 5998124 - DNA, 15 bp, Homo sapiens
caccagtgaggctct

SEQ ID NO: 5998125 - DNA, 20 bp, Homo sapiens
caccagtgcatcacatctgc

SEQ ID NO: 5998126 - DNA, 18 bp, Homo sapiens
caccagtgcctcagtgct

SEQ ID NO: 5998127 - DNA, 17 bp, Homo sapiens
caccagtgcttgcttgt

SEQ ID NO: 5998128 - DNA, 13 bp, Homo sapiens
caccagtggacct

SEQ ID NO: 5998129 - DNA, 15 bp, Homo sapiens
caccagtggcctcgt

SEQ ID NO: 5998130 - DNA, 21 bp, Homo sapiens
caccagtggcctttcagtgta

SEQ ID NO: 5998131 - DNA, 20 bp, Homo sapiens
caccagtgggactgtggtga

SEQ ID NO: 5998132 - DNA, 16 bp, Homo sapiens
caccagtgtcccctcc

SEQ ID NO: 5998133 - DNA, 18 bp, Homo sapiens
caccagtgtcccctccac

SEQ ID NO: 5998134 - DNA, 17 bp, Homo sapiens
caccagtgtcctcccct

SEQ ID NO: 5998135 - DNA, 18 bp, Homo sapiens
caccagtgtcctcccctc

SEQ ID NO: 5998136 - DNA, 19 bp, Homo sapiens
caccagtgtcctcccctca

SEQ ID NO: 5998137 - DNA, 23 bp, Homo sapiens
caccagtgtcgtgtctgctgttg

SEQ ID NO: 5998138 - DNA, 11 bp, Homo sapiens
caccagtgtta

SEQ ID NO: 5998139 - DNA, 15 bp, Homo sapiens
caccagtgttcctga

SEQ ID NO: 5998140 - DNA, 20 bp, Homo sapiens
caccagttacttgtgttcat

SEQ ID NO: 5998141 - DNA, 18 bp, Homo sapiens
caccagttcctttcaatg

SEQ ID NO: 5998142 - DNA, 17 bp, Homo sapiens
caccagttgaactgcag

SEQ ID NO: 5998143 - DNA, 15 bp, Homo sapiens
caccagttgctgctg

SEQ ID NO: 5998144 - DNA, 17 bp, Homo sapiens
caccagttgctgctgcc

SEQ ID NO: 5998145 - DNA, 15 bp, Homo sapiens
caccagtttacagga

SEQ ID NO: 5998146 - DNA, 20 bp, Homo sapiens
caccagttttatccataatg

SEQ ID NO: 5998147 - DNA, 21 bp, Homo sapiens
caccataaccaagaaatacta

SEQ ID NO: 5998148 - DNA, 19 bp, Homo sapiens
caccataagctactgccat

SEQ ID NO: 5998149 - DNA, 21 bp, Homo sapiens
caccataagctactgccatcc

SEQ ID NO: 5998150 - DNA, 17 bp, Homo sapiens
caccataatccctgtct

SEQ ID NO: 5998151 - DNA, 20 bp, Homo sapiens
caccataatccctgtcttct

SEQ ID NO: 5998152 - DNA, 18 bp, Homo sapiens
caccataatgagatgtga

SEQ ID NO: 5998153 - DNA, 13 bp, Homo sapiens
caccatagaagaa

SEQ ID NO: 5998154 - DNA, 21 bp, Homo sapiens
caccatagagaggcgctagag

SEQ ID NO: 5998155 - DNA, 13 bp, Homo sapiens
caccatagcctac

SEQ ID NO: 5998156 - DNA, 19 bp, Homo sapiens
caccatagtgtcacagaga

SEQ ID NO: 5998157 - DNA, 16 bp, Homo sapiens
caccatagtttacaat

SEQ ID NO: 5998158 - DNA, 23 bp, Homo sapiens
caccatagttttgtttaatttgc

SEQ ID NO: 5998159 - DNA, 14 bp, Homo sapiens
caccatatgaattg

SEQ ID NO: 5998160 - DNA, 12 bp, Homo sapiens
caccatatgcaa

SEQ ID NO: 5998161 - DNA, 15 bp, Homo sapiens
caccatatttgaatt

SEQ ID NO: 5998162 - DNA, 17 bp, Homo sapiens
caccatcaagccaccaa

SEQ ID NO: 5998163 - DNA, 15 bp, Homo sapiens
caccatcaatcctga

SEQ ID NO: 5998164 - DNA, 13 bp, Homo sapiens
caccatcaccacg

SEQ ID NO: 5998165 - DNA, 11 bp, Homo sapiens
caccatcattt

SEQ ID NO: 5998166 - DNA, 14 bp, Homo sapiens
caccatccaccctg

SEQ ID NO: 5998167 - DNA, 22 bp, Homo sapiens
caccatccagagaccaaataat

SEQ ID NO: 5998168 - DNA, 16 bp, Homo sapiens
caccatccagctcccc

SEQ ID NO: 5998169 - DNA, 13 bp, Homo sapiens
caccatccagtgg

SEQ ID NO: 5998170 - DNA, 11 bp, Homo sapiens
caccatccctg

SEQ ID NO: 5998171 - DNA, 16 bp, Homo sapiens
caccatccctgatggc

SEQ ID NO: 5998172 - DNA, 15 bp, Homo sapiens
caccatccctttttg

SEQ ID NO: 5998173 - DNA, 21 bp, Homo sapiens
caccatccctttttgaagtgt

SEQ ID NO: 5998174 - DNA, 12 bp, Homo sapiens
caccatcctcag

SEQ ID NO: 5998175 - DNA, 14 bp, Homo sapiens
caccatcctcagag

SEQ ID NO: 5998176 - DNA, 15 bp, Homo sapiens
caccatcctcagagg

SEQ ID NO: 5998177 - DNA, 13 bp, Homo sapiens
caccatcctgagc

SEQ ID NO: 5998178 - DNA, 17 bp, Homo sapiens
caccatcctgagccagg

SEQ ID NO: 5998179 - DNA, 15 bp, Homo sapiens
caccatcctgcagcc

SEQ ID NO: 5998180 - DNA, 21 bp, Homo sapiens
caccatcctgcagcctcctcc

SEQ ID NO: 5998181 - DNA, 14 bp, Homo sapiens
caccatccttccat

SEQ ID NO: 5998182 - DNA, 15 bp, Homo sapiens
caccatccttccatc

SEQ ID NO: 5998183 - DNA, 13 bp, Homo sapiens
caccatctcaggc

SEQ ID NO: 5998184 - DNA, 18 bp, Homo sapiens
caccatctcaggccacct

SEQ ID NO: 5998185 - DNA, 12 bp, Homo sapiens
caccatctcttc

SEQ ID NO: 5998186 - DNA, 18 bp, Homo sapiens
caccatctgattaaaaca

SEQ ID NO: 5998187 - DNA, 13 bp, Homo sapiens
caccatctgccaa

SEQ ID NO: 5998188 - DNA, 13 bp, Homo sapiens
caccatctggacg

SEQ ID NO: 5998189 - DNA, 18 bp, Homo sapiens
caccatctggacggggat

SEQ ID NO: 5998190 - DNA, 18 bp, Homo sapiens
caccatgatggggcccta

SEQ ID NO: 5998191 - DNA, 13 bp, Homo sapiens
caccatgcaaggg

SEQ ID NO: 5998192 - DNA, 21 bp, Homo sapiens
caccatgcactcacccctagc

SEQ ID NO: 5998193 - DNA, 19 bp, Homo sapiens
caccatgcactgtaaatat

SEQ ID NO: 5998194 - DNA, 21 bp, Homo sapiens
caccatgcagtgcccctagct

SEQ ID NO: 5998195 - DNA, 21 bp, Homo sapiens
caccatgccaggctaattttt

SEQ ID NO: 5998196 - DNA, 12 bp, Homo sapiens
caccatgcctgg

SEQ ID NO: 5998197 - DNA, 16 bp, Homo sapiens
caccatgcgctgctca

SEQ ID NO: 5998198 - DNA, 21 bp, Homo sapiens
caccatgctctctcacctgct

SEQ ID NO: 5998199 - DNA, 17 bp, Homo sapiens
caccatgctgctgggga

SEQ ID NO: 5998200 - DNA, 13 bp, Homo sapiens
caccatgctgggc

SEQ ID NO: 5998201 - DNA, 16 bp, Homo sapiens
caccatgcttgcctga

SEQ ID NO: 5998202 - DNA, 18 bp, Homo sapiens
caccatggaccagcccat

SEQ ID NO: 5998203 - DNA, 23 bp, Homo sapiens
caccatggagacgtggtgggact

SEQ ID NO: 5998204 - DNA, 14 bp, Homo sapiens
caccatggaggcag

SEQ ID NO: 5998205 - DNA, 23 bp, Homo sapiens
caccatggaggcaggctccccct

SEQ ID NO: 5998206 - DNA, 12 bp, Homo sapiens
caccatggccag

SEQ ID NO: 5998207 - DNA, 18 bp, Homo sapiens
caccatggccttgatgat

SEQ ID NO: 5998208 - DNA, 20 bp, Homo sapiens
caccatgggaggtggggcct

SEQ ID NO: 5998209 - DNA, 19 bp, Homo sapiens
caccatggtgactgccaca

SEQ ID NO: 5998210 - DNA, 16 bp, Homo sapiens
caccatgtaacaacca

SEQ ID NO: 5998211 - DNA, 17 bp, Homo sapiens
caccatgtaacaaccag

SEQ ID NO: 5998212 - DNA, 18 bp, Homo sapiens
caccatgtattcatccag

SEQ ID NO: 5998213 - DNA, 19 bp, Homo sapiens
caccatgtattcatccaga

SEQ ID NO: 5998214 - DNA, 15 bp, Homo sapiens
caccatgtattttgt

SEQ ID NO: 5998215 - DNA, 13 bp, Homo sapiens
caccatgtgaagt

SEQ ID NO: 5998216 - DNA, 15 bp, Homo sapiens
caccatgtgcaataa

SEQ ID NO: 5998217 - DNA, 22 bp, Homo sapiens
caccatgtttatttatttccag

SEQ ID NO: 5998218 - DNA, 14 bp, Homo sapiens
caccatgtttctaa

SEQ ID NO: 5998219 - DNA, 19 bp, Homo sapiens
caccatgtttgagctcaga

SEQ ID NO: 5998220 - DNA, 23 bp, Homo sapiens
caccatgtttgagctcagacccc

SEQ ID NO: 5998221 - DNA, 22 bp, Homo sapiens
caccattaaaagggattaccca

SEQ ID NO: 5998222 - DNA, 16 bp, Homo sapiens
caccattataatgaat

SEQ ID NO: 5998223 - DNA, 17 bp, Homo sapiens
caccattataatgaatt

SEQ ID NO: 5998224 - DNA, 21 bp, Homo sapiens
caccattatgctggtgtatgt

SEQ ID NO: 5998225 - DNA, 15 bp, Homo sapiens
caccattcaaacagg

SEQ ID NO: 5998226 - DNA, 20 bp, Homo sapiens
caccattcacatttgatgta

SEQ ID NO: 5998227 - DNA, 22 bp, Homo sapiens
caccattcagactttcagccga

SEQ ID NO: 5998228 - DNA, 20 bp, Homo sapiens
caccattccaagtctccacc

SEQ ID NO: 5998229 - DNA, 21 bp, Homo sapiens
caccattccacatccccacct

SEQ ID NO: 5998230 - DNA, 12 bp, Homo sapiens
caccattcctgc

SEQ ID NO: 5998231 - DNA, 13 bp, Homo sapiens
caccattcctgga

SEQ ID NO: 5998232 - DNA, 14 bp, Homo sapiens
caccattcctttaa

SEQ ID NO: 5998233 - DNA, 23 bp, Homo sapiens
caccattcgtacataatactgaa

SEQ ID NO: 5998234 - DNA, 15 bp, Homo sapiens
caccattctcctgcc

SEQ ID NO: 5998235 - DNA, 18 bp, Homo sapiens
caccattctcctgcctca

SEQ ID NO: 5998236 - DNA, 16 bp, Homo sapiens
caccattctgcattta

SEQ ID NO: 5998237 - DNA, 14 bp, Homo sapiens
caccattctttctt

SEQ ID NO: 5998238 - DNA, 15 bp, Homo sapiens
caccattgaactgta

SEQ ID NO: 5998239 - DNA, 14 bp, Homo sapiens
caccattgaaggct

SEQ ID NO: 5998240 - DNA, 22 bp, Homo sapiens
caccatttaatcatttccagca

SEQ ID NO: 5998241 - DNA, 20 bp, Homo sapiens
caccatttatgtgtagaatt

SEQ ID NO: 5998242 - DNA, 11 bp, Homo sapiens
caccatttcat

SEQ ID NO: 5998243 - DNA, 18 bp, Homo sapiens
caccatttggcatccctg

SEQ ID NO: 5998244 - DNA, 20 bp, Homo sapiens
caccatttggcatccctggg

SEQ ID NO: 5998245 - DNA, 21 bp, Homo sapiens
caccatttggcatccctgggc

SEQ ID NO: 5998246 - DNA, 23 bp, Homo sapiens
caccatttggcatccctgggcct

SEQ ID NO: 5998247 - DNA, 24 bp, Homo sapiens
caccatttggcatccctgggcctt

SEQ ID NO: 5998248 - DNA, 22 bp, Homo sapiens
cagcagaggcccagatattaga

SEQ ID NO: 5998249 - DNA, 22 bp, Homo sapiens
cagcagaggcgtactacccagc

SEQ ID NO: 5998250 - DNA, 18 bp, Homo sapiens
cagcagagggcgccacca

SEQ ID NO: 5998251 - DNA, 13 bp, Homo sapiens
cagcagaggtgag

SEQ ID NO: 5998252 - DNA, 22 bp, Homo sapiens
cagcagaggtgagaactcagaa

SEQ ID NO: 5998253 - DNA, 24 bp, Homo sapiens
cagcagaggtttgctgacaggtga

SEQ ID NO: 5998254 - DNA, 15 bp, Homo sapiens
cagcagagtgagggg

SEQ ID NO: 5998255 - DNA, 22 bp, Homo sapiens
cagcagagttgtcttaaattag

SEQ ID NO: 5998256 - DNA, 12 bp, Homo sapiens
cagcagatccac

SEQ ID NO: 5998257 - DNA, 15 bp, Homo sapiens
cagcagatcccagct

SEQ ID NO: 5998258 - DNA, 15 bp, Homo sapiens
cagcagatgccagtg

SEQ ID NO: 5998259 - DNA, 17 bp, Homo sapiens
cagcagatgccagtgaa

SEQ ID NO: 5998260 - DNA, 17 bp, Homo sapiens
cagcagatgctgttgtg

SEQ ID NO: 5998261 - DNA, 13 bp, Homo sapiens
cagcagatgttta

SEQ ID NO: 5998262 - DNA, 14 bp, Homo sapiens
cagcagattattca

SEQ ID NO: 5998263 - DNA, 15 bp, Homo sapiens
cagcagattattcac

SEQ ID NO: 5998264 - DNA, 19 bp, Homo sapiens
cagcagattattcactgat

SEQ ID NO: 5998265 - DNA, 16 bp, Homo sapiens
cagcagattggaagga

SEQ ID NO: 5998266 - DNA, 20 bp, Homo sapiens
cagcagattggaaggagaca

SEQ ID NO: 5998267 - DNA, 15 bp, Homo sapiens
cagcagcaaattttc

SEQ ID NO: 5998268 - DNA, 16 bp, Homo sapiens
cagcagcaacaactgt

SEQ ID NO: 5998269 - DNA, 18 bp, Homo sapiens
cagcagcaacaactgtca

SEQ ID NO: 5998270 - DNA, 17 bp, Homo sapiens
cagcagcaagaaaaaaa

SEQ ID NO: 5998271 - DNA, 20 bp, Homo sapiens
cagcagcaagaaaaaaaaat

SEQ ID NO: 5998272 - DNA, 16 bp, Homo sapiens
cagcagcaatctgtct

SEQ ID NO: 5998273 - DNA, 16 bp, Homo sapiens
cagcagcacaaacatt

SEQ ID NO: 5998274 - DNA, 16 bp, Homo sapiens
cagcagcacacctcag

SEQ ID NO: 5998275 - DNA, 19 bp, Homo sapiens
cagcagcaccaaccacagc

SEQ ID NO: 5998276 - DNA, 16 bp, Homo sapiens
cagcagcacctttctc

SEQ ID NO: 5998277 - DNA, 24 bp, Homo sapiens
cagcagcactcccgctgcacacag

SEQ ID NO: 5998278 - DNA, 15 bp, Homo sapiens
cagcagcactgcaga

SEQ ID NO: 5998279 - DNA, 15 bp, Homo sapiens
cagcagcagcagcag

SEQ ID NO: 5998280 - DNA, 16 bp, Homo sapiens
cagcagcagcaggtga

SEQ ID NO: 5998281 - DNA, 14 bp, Homo sapiens
cagcagcagccctg

SEQ ID NO: 5998282 - DNA, 14 bp, Homo sapiens
cagcagcagcctgc

SEQ ID NO: 5998283 - DNA, 21 bp, Homo sapiens
cagcagcagcctgcacctgcc

SEQ ID NO: 5998284 - DNA, 21 bp, Homo sapiens
cagcagcaggatgggctgagc

SEQ ID NO: 5998285 - DNA, 21 bp, Homo sapiens
cagcagcatagaacaggacct

SEQ ID NO: 5998286 - DNA, 23 bp, Homo sapiens
cagcagcatagaacaggacctct

SEQ ID NO: 5998287 - DNA, 11 bp, Homo sapiens
cagcagcatcc

SEQ ID NO: 5998288 - DNA, 13 bp, Homo sapiens
cagcagcatccca

SEQ ID NO: 5998289 - DNA, 14 bp, Homo sapiens
cagcagcatcccag

SEQ ID NO: 5998290 - DNA, 16 bp, Homo sapiens
cagcagcatcccagcc

SEQ ID NO: 5998291 - DNA, 20 bp, Homo sapiens
cagcagcatcccagccttga

SEQ ID NO: 5998292 - DNA, 12 bp, Homo sapiens
cagcagcatctc

SEQ ID NO: 5998293 - DNA, 22 bp, Homo sapiens
cagcagcatctctaccttctcc

SEQ ID NO: 5998294 - DNA, 21 bp, Homo sapiens
cagcagcatttttatttcaga

SEQ ID NO: 5998295 - DNA, 15 bp, Homo sapiens
cagcagccagcacca

SEQ ID NO: 5998296 - DNA, 18 bp, Homo sapiens
cagcagccagcaccacct

SEQ ID NO: 5998297 - DNA, 13 bp, Homo sapiens
cagcagccagcca

SEQ ID NO: 5998298 - DNA, 16 bp, Homo sapiens
cagcagccagccaaac

SEQ ID NO: 5998299 - DNA, 16 bp, Homo sapiens
cagcagccagccctgc

SEQ ID NO: 5998300 - DNA, 17 bp, Homo sapiens
cagcagccagccctgcc

SEQ ID NO: 5998301 - DNA, 18 bp, Homo sapiens
cagcagccagccctgcct

SEQ ID NO: 5998302 - DNA, 19 bp, Homo sapiens
cagcagccagccctgcctg

SEQ ID NO: 5998303 - DNA, 22 bp, Homo sapiens
cagcagccagccctgcctggag

SEQ ID NO: 5998304 - DNA, 15 bp, Homo sapiens
cagcagccagctcct

SEQ ID NO: 5998305 - DNA, 16 bp, Homo sapiens
cagcagccagctcctg

SEQ ID NO: 5998306 - DNA, 17 bp, Homo sapiens
cagcagccagctcctgg

SEQ ID NO: 5998307 - DNA, 14 bp, Homo sapiens
cagcagccagctct

SEQ ID NO: 5998308 - DNA, 20 bp, Homo sapiens
cagcagccagggacccccag

SEQ ID NO: 5998309 - DNA, 15 bp, Homo sapiens
cagcagccagtctca

SEQ ID NO: 5998310 - DNA, 21 bp, Homo sapiens
cagcagccagtctcagagacc

SEQ ID NO: 5998311 - DNA, 18 bp, Homo sapiens
cagcagccatcataggaa

SEQ ID NO: 5998312 - DNA, 13 bp, Homo sapiens
cagcagcccaagc

SEQ ID NO: 5998313 - DNA, 12 bp, Homo sapiens
cagcagcccagc

SEQ ID NO: 5998314 - DNA, 19 bp, Homo sapiens
cagcagcccagcttcctgg

SEQ ID NO: 5998315 - DNA, 21 bp, Homo sapiens
cagcagcccagcttcctggtg

SEQ ID NO: 5998316 - DNA, 11 bp, Homo sapiens
cagcagcccca

SEQ ID NO: 5998317 - DNA, 15 bp, Homo sapiens
cagcagccccacacc

SEQ ID NO: 5998318 - DNA, 15 bp, Homo sapiens
cagcagccccaggag

SEQ ID NO: 5998319 - DNA, 18 bp, Homo sapiens
cagcagccccaggagaag

SEQ ID NO: 5998320 - DNA, 21 bp, Homo sapiens
cagcagcccccactgcacccc

SEQ ID NO: 5998321 - DNA, 14 bp, Homo sapiens
cagcagccccccag

SEQ ID NO: 5998322 - DNA, 16 bp, Homo sapiens
cagcagccccctgccc

SEQ ID NO: 5998323 - DNA, 21 bp, Homo sapiens
cagcagccccgtctgcccacc

SEQ ID NO: 5998324 - DNA, 23 bp, Homo sapiens
cagcagccctaaggatctctcag

SEQ ID NO: 5998325 - DNA, 11 bp, Homo sapiens
cagcagccctc

SEQ ID NO: 5998326 - DNA, 13 bp, Homo sapiens
cagcagccctcaa

SEQ ID NO: 5998327 - DNA, 17 bp, Homo sapiens
cagcagccctcaacagg

SEQ ID NO: 5998328 - DNA, 18 bp, Homo sapiens
cagcagccctcaacaggc

SEQ ID NO: 5998329 - DNA, 12 bp, Homo sapiens
cagcagccctcc

SEQ ID NO: 5998330 - DNA, 19 bp, Homo sapiens
cagcagccctggcctgtgg

SEQ ID NO: 5998331 - DNA, 18 bp, Homo sapiens
cagcagcctccctgtcac

SEQ ID NO: 5998332 - DNA, 23 bp, Homo sapiens
cagcagcctcgcccctggcagag

SEQ ID NO: 5998333 - DNA, 13 bp, Homo sapiens
cagcagcctctga

SEQ ID NO: 5998334 - DNA, 16 bp, Homo sapiens
cagcagcctctgaagt

SEQ ID NO: 5998335 - DNA, 18 bp, Homo sapiens
cagcagcctctgaagttg

SEQ ID NO: 5998336 - DNA, 12 bp, Homo sapiens
cagcagcctgca

SEQ ID NO: 5998337 - DNA, 13 bp, Homo sapiens
cagcagcctgcac

SEQ ID NO: 5998338 - DNA, 22 bp, Homo sapiens
cagcagcctgcttcccacctcc

SEQ ID NO: 5998339 - DNA, 18 bp, Homo sapiens
cagcagcctggaccctgt

SEQ ID NO: 5998340 - DNA, 14 bp, Homo sapiens
cagcagcctgtatg

SEQ ID NO: 5998341 - DNA, 16 bp, Homo sapiens
cagcagcctgtatgtg

SEQ ID NO: 5998342 - DNA, 13 bp, Homo sapiens
cagcagccttcca

SEQ ID NO: 5998343 - DNA, 16 bp, Homo sapiens
cagcagcgcccgaggc

SEQ ID NO: 5998344 - DNA, 17 bp, Homo sapiens
cagcagcgcccgaggcc

SEQ ID NO: 5998345 - DNA, 21 bp, Homo sapiens
cagcagcgcgcaggcctgcgt

SEQ ID NO: 5998346 - DNA, 13 bp, Homo sapiens
cagcagcggccca

SEQ ID NO: 5998347 - DNA, 15 bp, Homo sapiens
cagcagcggcccaga

SEQ ID NO: 5998348 - DNA, 17 bp, Homo sapiens
cagcagcggcccagatt

SEQ ID NO: 5998349 - DNA, 23 bp, Homo sapiens
cagcagcgggggcggcccagcct

SEQ ID NO: 5998350 - DNA, 15 bp, Homo sapiens
cagcagcggtggcct

SEQ ID NO: 5998351 - DNA, 18 bp, Homo sapiens
cagcagctagagctcagt

SEQ ID NO: 5998352 - DNA, 16 bp, Homo sapiens
cagcagctaggactga

SEQ ID NO: 5998353 - DNA, 17 bp, Homo sapiens
cagcagctcaacctacc

SEQ ID NO: 5998354 - DNA, 20 bp, Homo sapiens
cagcagctcacaccctacct

SEQ ID NO: 5998355 - DNA, 14 bp, Homo sapiens
cagcagctcaccat

SEQ ID NO: 5998356 - DNA, 17 bp, Homo sapiens
cagcagctcagcctccc

SEQ ID NO: 5998357 - DNA, 12 bp, Homo sapiens
cagcagctcagg

SEQ ID NO: 5998358 - DNA, 13 bp, Homo sapiens
cagcagctcaggc

SEQ ID NO: 5998359 - DNA, 15 bp, Homo sapiens
cagcagctcaggcac

SEQ ID NO: 5998360 - DNA, 15 bp, Homo sapiens
cagcagctccaacct

SEQ ID NO: 5998361 - DNA, 19 bp, Homo sapiens
cagcagctccaacctggag

SEQ ID NO: 5998362 - DNA, 21 bp, Homo sapiens
cagcagctccaacctggaggc

SEQ ID NO: 5998363 - DNA, 18 bp, Homo sapiens
cagcagctccgcctggca

SEQ ID NO: 5998364 - DNA, 14 bp, Homo sapiens
cagcagctctgagc

SEQ ID NO: 5998365 - DNA, 22 bp, Homo sapiens
cagcagctctgagccagattac

SEQ ID NO: 5998366 - DNA, 22 bp, Homo sapiens
cagcagctctggctctgcctca

SEQ ID NO: 5998367 - DNA, 23 bp, Homo sapiens
cagcagctctggctctgcctcag

SEQ ID NO: 5998368 - DNA, 18 bp, Homo sapiens
cagcagctctgtccccac

SEQ ID NO: 5998369 - DNA, 20 bp, Homo sapiens
cagcagctgaacagccaaat

SEQ ID NO: 5998370 - DNA, 13 bp, Homo sapiens
cagcagctgaagc

SEQ ID NO: 5998371 - DNA, 21 bp, Homo sapiens
cagcagctgaagccagctccc

SEQ ID NO: 5998372 - DNA, 14 bp, Homo sapiens
cagcagctgaggcc

SEQ ID NO: 5998373 - DNA, 14 bp, Homo sapiens
cagcagctgatgct

SEQ ID NO: 5998374 - DNA, 17 bp, Homo sapiens
cagcagctgcaggggcc

SEQ ID NO: 5998375 - DNA, 14 bp, Homo sapiens
cagcagctgcctct

SEQ ID NO: 5998376 - DNA, 22 bp, Homo sapiens
cagcagctgcgggtctgaagga

SEQ ID NO: 5998377 - DNA, 14 bp, Homo sapiens
cagcagctggactg

SEQ ID NO: 5998378 - DNA, 13 bp, Homo sapiens
cagcagctgggcc

SEQ ID NO: 5998379 - DNA, 15 bp, Homo sapiens
cagcagctgggccgg

SEQ ID NO: 5998380 - DNA, 19 bp, Homo sapiens
cagcagctgggccggccag

SEQ ID NO: 5998381 - DNA, 11 bp, Homo sapiens
cagcagctggt

SEQ ID NO: 5998382 - DNA, 14 bp, Homo sapiens
cagcagctggtgcc

SEQ ID NO: 5998383 - DNA, 18 bp, Homo sapiens
cagcagctggtgccccac

SEQ ID NO: 5998384 - DNA, 19 bp, Homo sapiens
cagcagctggtgccccacc

SEQ ID NO: 5998385 - DNA, 18 bp, Homo sapiens
cagcagcttcaccagagc

SEQ ID NO: 5998386 - DNA, 13 bp, Homo sapiens
cagcagcttctcc

SEQ ID NO: 5998387 - DNA, 17 bp, Homo sapiens
cagcagcttctccagga

SEQ ID NO: 5998388 - DNA, 15 bp, Homo sapiens
cagcagcttggctga

SEQ ID NO: 5998389 - DNA, 16 bp, Homo sapiens
cagcagcttggctgag

SEQ ID NO: 5998390 - DNA, 21 bp, Homo sapiens
cagcagctttagaatcccagc

SEQ ID NO: 5998391 - DNA, 17 bp, Homo sapiens
cagcaggaacctgtact

SEQ ID NO: 5998392 - DNA, 18 bp, Homo sapiens
cagcaggaacctgtactg

SEQ ID NO: 5998393 - DNA, 16 bp, Homo sapiens
cagcaggaactctgga

SEQ ID NO: 5998394 - DNA, 13 bp, Homo sapiens
cagcaggaagcca

SEQ ID NO: 5998395 - DNA, 12 bp, Homo sapiens
cagcaggaaggg

SEQ ID NO: 5998396 - DNA, 11 bp, Homo sapiens
cagcaggaata

SEQ ID NO: 5998397 - DNA, 15 bp, Homo sapiens
cagcaggaataaaga

SEQ ID NO: 5998398 - DNA, 13 bp, Homo sapiens
cagcaggaggagt

SEQ ID NO: 5998399 - DNA, 17 bp, Homo sapiens
cagcaggaggagtggaa

SEQ ID NO: 5998400 - DNA, 23 bp, Homo sapiens
cagcaggaggcaagcgtgttctc

SEQ ID NO: 5998401 - DNA, 15 bp, Homo sapiens
cagcaggaggcacag

SEQ ID NO: 5998402 - DNA, 18 bp, Homo sapiens
cagcaggaggcacagcag

SEQ ID NO: 5998403 - DNA, 15 bp, Homo sapiens
cagcaggaggccagg

SEQ ID NO: 5998404 - DNA, 20 bp, Homo sapiens
cagcaggaggctagcaaagc

SEQ ID NO: 5998405 - DNA, 14 bp, Homo sapiens
cagcaggaggcttt

SEQ ID NO: 5998406 - DNA, 23 bp, Homo sapiens
cagcaggagggactctgtctggc

SEQ ID NO: 5998407 - DNA, 22 bp, Homo sapiens
cagcaggagtggtgcagacaga

SEQ ID NO: 5998408 - DNA, 22 bp, Homo sapiens
cagcaggatcgaagggttttta

SEQ ID NO: 5998409 - DNA, 14 bp, Homo sapiens
cagcaggatgccct

SEQ ID NO: 5998410 - DNA, 19 bp, Homo sapiens
cagcaggatgggctgagct

SEQ ID NO: 5998411 - DNA, 20 bp, Homo sapiens
cagcaggcacggcccgcagc

SEQ ID NO: 5998412 - DNA, 16 bp, Homo sapiens
cagcaggcagaggaga

SEQ ID NO: 5998413 - DNA, 15 bp, Homo sapiens
cagcaggcagagtgg

SEQ ID NO: 5998414 - DNA, 11 bp, Homo sapiens
cagcaggcagc

SEQ ID NO: 5998415 - DNA, 15 bp, Homo sapiens
cagcaggcagccttg

SEQ ID NO: 5998416 - DNA, 13 bp, Homo sapiens
cagcaggcagcgc

SEQ ID NO: 5998417 - DNA, 16 bp, Homo sapiens
cagcaggcagcgccaa

SEQ ID NO: 5998418 - DNA, 13 bp, Homo sapiens
cagcaggcaggca

SEQ ID NO: 5998419 - DNA, 18 bp, Homo sapiens
cagcaggcaggtggactg

SEQ ID NO: 5998420 - DNA, 24 bp, Homo sapiens
cagcaggcaggtggactgactgtg

SEQ ID NO: 5998421 - DNA, 17 bp, Homo sapiens
cagcaggcatggcttcc

SEQ ID NO: 5998422 - DNA, 19 bp, Homo sapiens
cagcaggccactagtgaca

SEQ ID NO: 5998423 - DNA, 17 bp, Homo sapiens
cagcaggccagagaaag

SEQ ID NO: 5998424 - DNA, 19 bp, Homo sapiens
cagcaggcccagcatgcag

SEQ ID NO: 5998425 - DNA, 14 bp, Homo sapiens
cagcaggcctccct

SEQ ID NO: 5998426 - DNA, 12 bp, Homo sapiens
cagcaggcctct

SEQ ID NO: 5998427 - DNA, 17 bp, Homo sapiens
cagcaggcctctgggac

SEQ ID NO: 5998428 - DNA, 21 bp, Homo sapiens
cagcaggcctctgggacccac

SEQ ID NO: 5998429 - DNA, 12 bp, Homo sapiens
cacccaaaacac

SEQ ID NO: 5998430 - DNA, 13 bp, Homo sapiens
cacccaaaacacg

SEQ ID NO: 5998431 - DNA, 19 bp, Homo sapiens
cacccaaacacttctgctt

SEQ ID NO: 5998432 - DNA, 20 bp, Homo sapiens
cacccaaacacttctgcttt

SEQ ID NO: 5998433 - DNA, 23 bp, Homo sapiens
cacccaaacacttctgctttcac

SEQ ID NO: 5998434 - DNA, 18 bp, Homo sapiens
cacccaaaccccttccca

SEQ ID NO: 5998435 - DNA, 21 bp, Homo sapiens
cacccaaaccccttcccacga

SEQ ID NO: 5998436 - DNA, 21 bp, Homo sapiens
cacccaaagcctgtcccagga

SEQ ID NO: 5998437 - DNA, 15 bp, Homo sapiens
cacccaaagctgagc

SEQ ID NO: 5998438 - DNA, 16 bp, Homo sapiens
cacccaaagctgagcc

SEQ ID NO: 5998439 - DNA, 17 bp, Homo sapiens
cacccaaaggtggcctg

SEQ ID NO: 5998440 - DNA, 21 bp, Homo sapiens
cacccaaaggtggcctgcggg

SEQ ID NO: 5998441 - DNA, 21 bp, Homo sapiens
cacccaaatcacatctcacct

SEQ ID NO: 5998442 - DNA, 23 bp, Homo sapiens
cacccaaatcacatctcacctcc

SEQ ID NO: 5998443 - DNA, 17 bp, Homo sapiens
cacccaacagctcagag

SEQ ID NO: 5998444 - DNA, 19 bp, Homo sapiens
cacccaacctgtccttact

SEQ ID NO: 5998445 - DNA, 14 bp, Homo sapiens
cacccaacgctcca

SEQ ID NO: 5998446 - DNA, 14 bp, Homo sapiens
cacccaacgtgatg

SEQ ID NO: 5998447 - DNA, 14 bp, Homo sapiens
cacccaactccaca

SEQ ID NO: 5998448 - DNA, 14 bp, Homo sapiens
cacccaacttcccc

SEQ ID NO: 5998449 - DNA, 20 bp, Homo sapiens
cacccaagacctcagggcac

SEQ ID NO: 5998450 - DNA, 16 bp, Homo sapiens
cacccaagatgaatta

SEQ ID NO: 5998451 - DNA, 15 bp, Homo sapiens
cacccaagccctcct

SEQ ID NO: 5998452 - DNA, 20 bp, Homo sapiens
cacccaagcctgctggctgc

SEQ ID NO: 5998453 - DNA, 15 bp, Homo sapiens
cacccaagcttggca

SEQ ID NO: 5998454 - DNA, 19 bp, Homo sapiens
cacccaagggcctggcctg

SEQ ID NO: 5998455 - DNA, 20 bp, Homo sapiens
cacccaagggcctggcctga

SEQ ID NO: 5998456 - DNA, 23 bp, Homo sapiens
cacccaagggcctggcctgagct

SEQ ID NO: 5998457 - DNA, 14 bp, Homo sapiens
cacccaagtccacc

SEQ ID NO: 5998458 - DNA, 22 bp, Homo sapiens
cacccaagtccaggcccaagga

SEQ ID NO: 5998459 - DNA, 19 bp, Homo sapiens
cacccaatcaagggaagaa

SEQ ID NO: 5998460 - DNA, 15 bp, Homo sapiens
cacccaattggccca

SEQ ID NO: 5998461 - DNA, 23 bp, Homo sapiens
cacccaattggcccaacactgtc

SEQ ID NO: 5998462 - DNA, 23 bp, Homo sapiens
cacccaattttaaaaaataacat

SEQ ID NO: 5998463 - DNA, 12 bp, Homo sapiens
cacccacaaact

SEQ ID NO: 5998464 - DNA, 13 bp, Homo sapiens
cacccacaaactc

SEQ ID NO: 5998465 - DNA, 16 bp, Homo sapiens
cacccacaaactccag

SEQ ID NO: 5998466 - DNA, 19 bp, Homo sapiens
cacccacaaactccaggct

SEQ ID NO: 5998467 - DNA, 16 bp, Homo sapiens
cacccacaaagaaaca

SEQ ID NO: 5998468 - DNA, 19 bp, Homo sapiens
cacccacaaccctctggaa

SEQ ID NO: 5998469 - DNA, 20 bp, Homo sapiens
cacccacaagaactcctccc

SEQ ID NO: 5998470 - DNA, 14 bp, Homo sapiens
cacccacaatccca

SEQ ID NO: 5998471 - DNA, 15 bp, Homo sapiens
cacccacacactcgc

SEQ ID NO: 5998472 - DNA, 21 bp, Homo sapiens
cacccacacactcgcccgccc

SEQ ID NO: 5998473 - DNA, 18 bp, Homo sapiens
cacccacacagctgccct

SEQ ID NO: 5998474 - DNA, 24 bp, Homo sapiens
cacccacacagctgccctagctga

SEQ ID NO: 5998475 - DNA, 21 bp, Homo sapiens
cacccacacaggtggccatca

SEQ ID NO: 5998476 - DNA, 15 bp, Homo sapiens
cacccacaccataag

SEQ ID NO: 5998477 - DNA, 19 bp, Homo sapiens
cacccacaccccgtctgcc

SEQ ID NO: 5998478 - DNA, 22 bp, Homo sapiens
cacccacaccccgtctgcccct

SEQ ID NO: 5998479 - DNA, 12 bp, Homo sapiens
cacccacaccct

SEQ ID NO: 5998480 - DNA, 13 bp, Homo sapiens
cacccacacccta

SEQ ID NO: 5998481 - DNA, 17 bp, Homo sapiens
cacccacaccctacagc

SEQ ID NO: 5998482 - DNA, 15 bp, Homo sapiens
cacccacaggcatgt

SEQ ID NO: 5998483 - DNA, 19 bp, Homo sapiens
cacccacatgtgacacata

SEQ ID NO: 5998484 - DNA, 16 bp, Homo sapiens
cacccaccaaccctca

SEQ ID NO: 5998485 - DNA, 17 bp, Homo sapiens
cacccaccactctcagg

SEQ ID NO: 5998486 - DNA, 13 bp, Homo sapiens
cacccaccaggcc

SEQ ID NO: 5998487 - DNA, 22 bp, Homo sapiens
cacccaccaggccagctcagga

SEQ ID NO: 5998488 - DNA, 15 bp, Homo sapiens
cacccaccagggcga

SEQ ID NO: 5998489 - DNA, 16 bp, Homo sapiens
cacccaccagggctca

SEQ ID NO: 5998490 - DNA, 20 bp, Homo sapiens
cacccaccatagggcatgat

SEQ ID NO: 5998491 - DNA, 17 bp, Homo sapiens
cacccacccacatatct

SEQ ID NO: 5998492 - DNA, 15 bp, Homo sapiens
cacccaccccaagct

SEQ ID NO: 5998493 - DNA, 16 bp, Homo sapiens
cacccaccccacagac

SEQ ID NO: 5998494 - DNA, 19 bp, Homo sapiens
cacccaccccacgcccgca

SEQ ID NO: 5998495 - DNA, 17 bp, Homo sapiens
cacccacccccaggcct

SEQ ID NO: 5998496 - DNA, 16 bp, Homo sapiens
cacccacccctcctgg

SEQ ID NO: 5998497 - DNA, 24 bp, Homo sapiens
cacccacccgccgcctcccacggc

SEQ ID NO: 5998498 - DNA, 13 bp, Homo sapiens
cacccaccctctg

SEQ ID NO: 5998499 - DNA, 14 bp, Homo sapiens
cacccaccctctgg

SEQ ID NO: 5998500 - DNA, 16 bp, Homo sapiens
cacccaccgtggagga

SEQ ID NO: 5998501 - DNA, 12 bp, Homo sapiens
cacccacctcag

SEQ ID NO: 5998502 - DNA, 13 bp, Homo sapiens
cacccacctcagc

SEQ ID NO: 5998503 - DNA, 16 bp, Homo sapiens
cacccacctccaccca

SEQ ID NO: 5998504 - DNA, 22 bp, Homo sapiens
cacccacctccacccagcccct

SEQ ID NO: 5998505 - DNA, 15 bp, Homo sapiens
cacccacctccctgc

SEQ ID NO: 5998506 - DNA, 19 bp, Homo sapiens
cacccacctcggcctccca

SEQ ID NO: 5998507 - DNA, 12 bp, Homo sapiens
cacccacctctg

SEQ ID NO: 5998508 - DNA, 17 bp, Homo sapiens
cacccacctctgggtcc

SEQ ID NO: 5998509 - DNA, 16 bp, Homo sapiens
cacccacctgctgctg

SEQ ID NO: 5998510 - DNA, 17 bp, Homo sapiens
cacccacctgctgctgt

SEQ ID NO: 5998511 - DNA, 20 bp, Homo sapiens
cacccacctgttttctgaaa

SEQ ID NO: 5998512 - DNA, 22 bp, Homo sapiens
cacccacctttgccacaaagct

SEQ ID NO: 5998513 - DNA, 21 bp, Homo sapiens
cacccacgcatacacacatgc

SEQ ID NO: 5998514 - DNA, 16 bp, Homo sapiens
cacccacgtgagagaa

SEQ ID NO: 5998515 - DNA, 16 bp, Homo sapiens
cacccactagccctct

SEQ ID NO: 5998516 - DNA, 20 bp, Homo sapiens
cacccactagccctctttct

SEQ ID NO: 5998517 - DNA, 15 bp, Homo sapiens
cacccactcagccat

SEQ ID NO: 5998518 - DNA, 14 bp, Homo sapiens
cacccactcagctc

SEQ ID NO: 5998519 - DNA, 22 bp, Homo sapiens
cacccactcccttccccataga

SEQ ID NO: 5998520 - DNA, 14 bp, Homo sapiens
cacccactctgcac

SEQ ID NO: 5998521 - DNA, 18 bp, Homo sapiens
cacccactctggtggcca

SEQ ID NO: 5998522 - DNA, 13 bp, Homo sapiens
cacccactggcca

SEQ ID NO: 5998523 - DNA, 15 bp, Homo sapiens
cacccactggccagt

SEQ ID NO: 5998524 - DNA, 15 bp, Homo sapiens
cacccacttctgcac

SEQ ID NO: 5998525 - DNA, 16 bp, Homo sapiens
cacccacttctgcact

SEQ ID NO: 5998526 - DNA, 16 bp, Homo sapiens
cacccagaaggaaccc

SEQ ID NO: 5998527 - DNA, 17 bp, Homo sapiens
cacccagaatccctcta

SEQ ID NO: 5998528 - DNA, 16 bp, Homo sapiens
cacccagacagctccc

SEQ ID NO: 5998529 - DNA, 15 bp, Homo sapiens
cacccagacataaag

SEQ ID NO: 5998530 - DNA, 20 bp, Homo sapiens
cacccagacataaaggaaaa

SEQ ID NO: 5998531 - DNA, 18 bp, Homo sapiens
cacccagaccctccttcc

SEQ ID NO: 5998532 - DNA, 18 bp, Homo sapiens
cacccagacctgcctgtc

SEQ ID NO: 5998533 - DNA, 11 bp, Homo sapiens
cacccagacta

SEQ ID NO: 5998534 - DNA, 17 bp, Homo sapiens
cacccagaggtctccct

SEQ ID NO: 5998535 - DNA, 17 bp, Homo sapiens
cacccagaggtggccct

SEQ ID NO: 5998536 - DNA, 18 bp, Homo sapiens
cacccagaggtggccctc

SEQ ID NO: 5998537 - DNA, 16 bp, Homo sapiens
cacccagagtagccat

SEQ ID NO: 5998538 - DNA, 17 bp, Homo sapiens
cacccagatcagactct

SEQ ID NO: 5998539 - DNA, 22 bp, Homo sapiens
cacccagatcaggaaccagggc

SEQ ID NO: 5998540 - DNA, 23 bp, Homo sapiens
cacccagatcaggaaccagggcc

SEQ ID NO: 5998541 - DNA, 17 bp, Homo sapiens
cacccagcaacacagag

SEQ ID NO: 5998542 - DNA, 22 bp, Homo sapiens
cacccagcaaggcacaggctcc

SEQ ID NO: 5998543 - DNA, 17 bp, Homo sapiens
cacccagcacccatgcc

SEQ ID NO: 5998544 - DNA, 12 bp, Homo sapiens
cacccagcagcg

SEQ ID NO: 5998545 - DNA, 13 bp, Homo sapiens
cacccagcaggca

SEQ ID NO: 5998546 - DNA, 15 bp, Homo sapiens
cacccagcaggcaga

SEQ ID NO: 5998547 - DNA, 19 bp, Homo sapiens
cacccagcaggcagagtgg

SEQ ID NO: 5998548 - DNA, 16 bp, Homo sapiens
cacccagccagctcct

SEQ ID NO: 5998549 - DNA, 17 bp, Homo sapiens
cacccagcccaaccggg

SEQ ID NO: 5998550 - DNA, 13 bp, Homo sapiens
cacccagcccaga

SEQ ID NO: 5998551 - DNA, 15 bp, Homo sapiens
cacccagcccattct

SEQ ID NO: 5998552 - DNA, 11 bp, Homo sapiens
cacccagcccc

SEQ ID NO: 5998553 - DNA, 13 bp, Homo sapiens
cacccagccctgg

SEQ ID NO: 5998554 - DNA, 14 bp, Homo sapiens
cacccagccctggt

SEQ ID NO: 5998555 - DNA, 12 bp, Homo sapiens
cacccagccctt

SEQ ID NO: 5998556 - DNA, 13 bp, Homo sapiens
cacccagcctcag

SEQ ID NO: 5998557 - DNA, 12 bp, Homo sapiens
cacccagcctgg

SEQ ID NO: 5998558 - DNA, 12 bp, Homo sapiens
cacccagctggt

SEQ ID NO: 5998559 - DNA, 16 bp, Homo sapiens
cacccagctggtcctg

SEQ ID NO: 5998560 - DNA, 14 bp, Homo sapiens
cacccaggaaggga

SEQ ID NO: 5998561 - DNA, 23 bp, Homo sapiens
cacccaggaagggagggagctga

SEQ ID NO: 5998562 - DNA, 16 bp, Homo sapiens
cacccaggacctctgg

SEQ ID NO: 5998563 - DNA, 20 bp, Homo sapiens
cacccaggagccccgaggcc

SEQ ID NO: 5998564 - DNA, 12 bp, Homo sapiens
cacccaggccag

SEQ ID NO: 5998565 - DNA, 12 bp, Homo sapiens
cacccaggccca

SEQ ID NO: 5998566 - DNA, 17 bp, Homo sapiens
cacccaggcccatgcca

SEQ ID NO: 5998567 - DNA, 13 bp, Homo sapiens
cacccaggcccga

SEQ ID NO: 5998568 - DNA, 21 bp, Homo sapiens
cacccaggcccgagcgcctgc

SEQ ID NO: 5998569 - DNA, 23 bp, Homo sapiens
cacccaggcccgagcgcctgcgt

SEQ ID NO: 5998570 - DNA, 21 bp, Homo sapiens
cacccaggcctatgttgatcc

SEQ ID NO: 5998571 - DNA, 16 bp, Homo sapiens
cacccaggcctccctg

SEQ ID NO: 5998572 - DNA, 14 bp, Homo sapiens
cacccaggctccat

SEQ ID NO: 5998573 - DNA, 21 bp, Homo sapiens
cacccaggctggaatgcagtg

SEQ ID NO: 5998574 - DNA, 20 bp, Homo sapiens
cacccaggctggactgcaat

SEQ ID NO: 5998575 - DNA, 20 bp, Homo sapiens
cacccaggctggagtgcaat

SEQ ID NO: 5998576 - DNA, 21 bp, Homo sapiens
cacccagggaactaggaaggc

SEQ ID NO: 5998577 - DNA, 24 bp, Homo sapiens
cacccagggctccctcctggagca

SEQ ID NO: 5998578 - DNA, 14 bp, Homo sapiens
cacccaggggcagc

SEQ ID NO: 5998579 - DNA, 19 bp, Homo sapiens
cacccaggtcccccgactg

SEQ ID NO: 5998580 - DNA, 22 bp, Homo sapiens
cacccaggtcccccgactgcct

SEQ ID NO: 5998581 - DNA, 18 bp, Homo sapiens
cacccaggtgatttcctc

SEQ ID NO: 5998582 - DNA, 17 bp, Homo sapiens
cacccagtagcccagag

SEQ ID NO: 5998583 - DNA, 23 bp, Homo sapiens
cacccagtcacctccccacatcg

SEQ ID NO: 5998584 - DNA, 16 bp, Homo sapiens
cacccagtccccaccc

SEQ ID NO: 5998585 - DNA, 14 bp, Homo sapiens
cacccagtcctctg

SEQ ID NO: 5998586 - DNA, 16 bp, Homo sapiens
cacccagtcctggcca

SEQ ID NO: 5998587 - DNA, 14 bp, Homo sapiens
cacccagtgctgcc

SEQ ID NO: 5998588 - DNA, 16 bp, Homo sapiens
cacccagtgctgccat

SEQ ID NO: 5998589 - DNA, 17 bp, Homo sapiens
cacccagtgctgccatg

SEQ ID NO: 5998590 - DNA, 23 bp, Homo sapiens
cacccagtgctgccatgccactg

SEQ ID NO: 5998591 - DNA, 14 bp, Homo sapiens
cacccagtgggaag

SEQ ID NO: 5998592 - DNA, 17 bp, Homo sapiens
cacccataaacagtaat

SEQ ID NO: 5998593 - DNA, 19 bp, Homo sapiens
cacccatagtgcttcacaa

SEQ ID NO: 5998594 - DNA, 13 bp, Homo sapiens
cacccatatcatg

SEQ ID NO: 5998595 - DNA, 23 bp, Homo sapiens
cacccatcagtggagtccagatg

SEQ ID NO: 5998596 - DNA, 18 bp, Homo sapiens
cacccatctgtctgccaa

SEQ ID NO: 5998597 - DNA, 13 bp, Homo sapiens
cacccatctgttt

SEQ ID NO: 5998598 - DNA, 15 bp, Homo sapiens
cacccatcttcctgc

SEQ ID NO: 5998599 - DNA, 15 bp, Homo sapiens
cacccatgaagacag

SEQ ID NO: 5998600 - DNA, 15 bp, Homo sapiens
cacccatgaatcaaa

SEQ ID NO: 5998601 - DNA, 19 bp, Homo sapiens
cacccatgcaagcagagga

SEQ ID NO: 5998602 - DNA, 14 bp, Homo sapiens
cacccatgcagctg

SEQ ID NO: 5998603 - DNA, 15 bp, Homo sapiens
cacccatgccagcgc

SEQ ID NO: 5998604 - DNA, 14 bp, Homo sapiens
cacccatgccatag

SEQ ID NO: 5998605 - DNA, 20 bp, Homo sapiens
cacccatgccccactctgct

SEQ ID NO: 5998606 - DNA, 21 bp, Homo sapiens
cacccatgcgccttcgtgcct

SEQ ID NO: 5998607 - DNA, 14 bp, Homo sapiens
cacccatggcctca

SEQ ID NO: 5998608 - DNA, 16 bp, Homo sapiens
cacccatggcctcagc

SEQ ID NO: 5998609 - DNA, 23 bp, Homo sapiens
cagcaggcctctgggacccacag

SEQ ID NO: 5998610 - DNA, 15 bp, Homo sapiens
cagcaggcctctggt

SEQ ID NO: 5998611 - DNA, 16 bp, Homo sapiens
cagcaggcctctggtt

SEQ ID NO: 5998612 - DNA, 20 bp, Homo sapiens
cagcaggcctctggttgcct

SEQ ID NO: 5998613 - DNA, 17 bp, Homo sapiens
cagcaggcgtgcctcgt

SEQ ID NO: 5998614 - DNA, 13 bp, Homo sapiens
cagcaggctcctc

SEQ ID NO: 5998615 - DNA, 17 bp, Homo sapiens
cagcaggctcctggctg

SEQ ID NO: 5998616 - DNA, 23 bp, Homo sapiens
cagcaggctcctggctgtgccca

SEQ ID NO: 5998617 - DNA, 15 bp, Homo sapiens
cagcaggctctcagg

SEQ ID NO: 5998618 - DNA, 19 bp, Homo sapiens
cagcaggctgccagtgcct

SEQ ID NO: 5998619 - DNA, 14 bp, Homo sapiens
cagcagggaagctc

SEQ ID NO: 5998620 - DNA, 19 bp, Homo sapiens
cagcagggaccgggcgcag

SEQ ID NO: 5998621 - DNA, 16 bp, Homo sapiens
cagcagggatgccctg

SEQ ID NO: 5998622 - DNA, 21 bp, Homo sapiens
cagcagggcatcttggaaaag

SEQ ID NO: 5998623 - DNA, 16 bp, Homo sapiens
cagcagggccactccc

SEQ ID NO: 5998624 - DNA, 11 bp, Homo sapiens
cagcagggcct

SEQ ID NO: 5998625 - DNA, 19 bp, Homo sapiens
cagcagggccttctgcctg

SEQ ID NO: 5998626 - DNA, 16 bp, Homo sapiens
cagcagggcgggccag

SEQ ID NO: 5998627 - DNA, 21 bp, Homo sapiens
cagcagggcgggccaggagaa

SEQ ID NO: 5998628 - DNA, 17 bp, Homo sapiens
cagcagggctgctgtga

SEQ ID NO: 5998629 - DNA, 14 bp, Homo sapiens
cagcagggctgggc

SEQ ID NO: 5998630 - DNA, 21 bp, Homo sapiens
cagcagggctggtcacctccc

SEQ ID NO: 5998631 - DNA, 22 bp, Homo sapiens
cagcagggctggtcacctccca

SEQ ID NO: 5998632 - DNA, 16 bp, Homo sapiens
cagcaggggaaagatt

SEQ ID NO: 5998633 - DNA, 20 bp, Homo sapiens
cagcaggggcagaaggagga

SEQ ID NO: 5998634 - DNA, 22 bp, Homo sapiens
cagcaggggggttgggttccag

SEQ ID NO: 5998635 - DNA, 18 bp, Homo sapiens
cagcaggggtgggaggct

SEQ ID NO: 5998636 - DNA, 20 bp, Homo sapiens
cagcagggtagtctggtttc

SEQ ID NO: 5998637 - DNA, 20 bp, Homo sapiens
cagcagggtcttttcatctg

SEQ ID NO: 5998638 - DNA, 16 bp, Homo sapiens
cagcagggtttgagca

SEQ ID NO: 5998639 - DNA, 20 bp, Homo sapiens
cagcaggtaggggcacagtg

SEQ ID NO: 5998640 - DNA, 22 bp, Homo sapiens
cagcaggtagtgggtgaatgtg

SEQ ID NO: 5998641 - DNA, 22 bp, Homo sapiens
cagcaggtcctccatcccaaca

SEQ ID NO: 5998642 - DNA, 20 bp, Homo sapiens
cagcaggtctagaagaacaa

SEQ ID NO: 5998643 - DNA, 21 bp, Homo sapiens
cagcaggtgattggaccaggc

SEQ ID NO: 5998644 - DNA, 19 bp, Homo sapiens
cagcaggtgcaagagacag

SEQ ID NO: 5998645 - DNA, 23 bp, Homo sapiens
cagcaggtgcaagagacagagcc

SEQ ID NO: 5998646 - DNA, 17 bp, Homo sapiens
cagcaggtgctgctacc

SEQ ID NO: 5998647 - DNA, 23 bp, Homo sapiens
cagcaggtgctgctaccctccct

SEQ ID NO: 5998648 - DNA, 16 bp, Homo sapiens
cagcaggtgctgggct

SEQ ID NO: 5998649 - DNA, 17 bp, Homo sapiens
cagcaggtgtgaccctg

SEQ ID NO: 5998650 - DNA, 18 bp, Homo sapiens
cagcaggtgtgaccctga

SEQ ID NO: 5998651 - DNA, 22 bp, Homo sapiens
cagcaggtgtgaccctgagggc

SEQ ID NO: 5998652 - DNA, 16 bp, Homo sapiens
cagcaggtgtggccaa

SEQ ID NO: 5998653 - DNA, 14 bp, Homo sapiens
cagcagtaagcagg

SEQ ID NO: 5998654 - DNA, 15 bp, Homo sapiens
cagcagtaagcaggc

SEQ ID NO: 5998655 - DNA, 21 bp, Homo sapiens
cagcagtaatttgtggcacta

SEQ ID NO: 5998656 - DNA, 17 bp, Homo sapiens
cagcagtaccatcccac

SEQ ID NO: 5998657 - DNA, 18 bp, Homo sapiens
cagcagtaccatcccact

SEQ ID NO: 5998658 - DNA, 22 bp, Homo sapiens
cagcagtaccatcccactgata

SEQ ID NO: 5998659 - DNA, 14 bp, Homo sapiens
cagcagtagacatt

SEQ ID NO: 5998660 - DNA, 13 bp, Homo sapiens
cagcagtagcttt

SEQ ID NO: 5998661 - DNA, 16 bp, Homo sapiens
cagcagtagtgagcca

SEQ ID NO: 5998662 - DNA, 15 bp, Homo sapiens
cagcagtcacaggcc

SEQ ID NO: 5998663 - DNA, 22 bp, Homo sapiens
cagcagtcacaggcccaggaag

SEQ ID NO: 5998664 - DNA, 14 bp, Homo sapiens
cagcagtcacaggt

SEQ ID NO: 5998665 - DNA, 21 bp, Homo sapiens
cagcagtcccagtattctcag

SEQ ID NO: 5998666 - DNA, 13 bp, Homo sapiens
cagcagtcctggg

SEQ ID NO: 5998667 - DNA, 16 bp, Homo sapiens
cagcagtcctgggccc

SEQ ID NO: 5998668 - DNA, 23 bp, Homo sapiens
cagcagtcctgggccccctggga

SEQ ID NO: 5998669 - DNA, 15 bp, Homo sapiens
cagcagtctccttca

SEQ ID NO: 5998670 - DNA, 20 bp, Homo sapiens
cagcagtctccttcagcacg

SEQ ID NO: 5998671 - DNA, 16 bp, Homo sapiens
cagcagtctctgcctt

SEQ ID NO: 5998672 - DNA, 17 bp, Homo sapiens
cagcagtctctgccttg

SEQ ID NO: 5998673 - DNA, 17 bp, Homo sapiens
cagcagtcttatgcttc

SEQ ID NO: 5998674 - DNA, 20 bp, Homo sapiens
cagcagtcttatgcttccag

SEQ ID NO: 5998675 - DNA, 21 bp, Homo sapiens
cagcagtcttatgcttccaga

SEQ ID NO: 5998676 - DNA, 23 bp, Homo sapiens
cagcagtgaaaacaagtgctggc

SEQ ID NO: 5998677 - DNA, 16 bp, Homo sapiens
cagcagtgagactggg

SEQ ID NO: 5998678 - DNA, 19 bp, Homo sapiens
cagcagtgagtctcttcag

SEQ ID NO: 5998679 - DNA, 21 bp, Homo sapiens
cagcagtgagtctcttcagaa

SEQ ID NO: 5998680 - DNA, 19 bp, Homo sapiens
cagcagtggagagtgttcc

SEQ ID NO: 5998681 - DNA, 14 bp, Homo sapiens
cagcagtggcagga

SEQ ID NO: 5998682 - DNA, 18 bp, Homo sapiens
cagcagtgggttcaggcc

SEQ ID NO: 5998683 - DNA, 12 bp, Homo sapiens
cagcagtgtcca

SEQ ID NO: 5998684 - DNA, 17 bp, Homo sapiens
cagcagtgtcccctgcc

SEQ ID NO: 5998685 - DNA, 20 bp, Homo sapiens
cagcagtgtcccctgcccca

SEQ ID NO: 5998686 - DNA, 22 bp, Homo sapiens
cagcagtgtctgttcttcattt

SEQ ID NO: 5998687 - DNA, 17 bp, Homo sapiens
cagcagtgtgaggccag

SEQ ID NO: 5998688 - DNA, 22 bp, Homo sapiens
cagcagtgtgaggccagggcag

SEQ ID NO: 5998689 - DNA, 16 bp, Homo sapiens
cagcagtgtgagggtg

SEQ ID NO: 5998690 - DNA, 17 bp, Homo sapiens
cagcagtgtggagaccc

SEQ ID NO: 5998691 - DNA, 19 bp, Homo sapiens
cagcagtgtggagaccctg

SEQ ID NO: 5998692 - DNA, 13 bp, Homo sapiens
cagcagtgttccc

SEQ ID NO: 5998693 - DNA, 17 bp, Homo sapiens
cagcagtgttccccatc

SEQ ID NO: 5998694 - DNA, 13 bp, Homo sapiens
cagcagtgttctc

SEQ ID NO: 5998695 - DNA, 19 bp, Homo sapiens
cagcagtgttgctcagctc

SEQ ID NO: 5998696 - DNA, 21 bp, Homo sapiens
cagcagtgttgctcagctcct

SEQ ID NO: 5998697 - DNA, 20 bp, Homo sapiens
cagcagtgtttaaaaaatga

SEQ ID NO: 5998698 - DNA, 21 bp, Homo sapiens
cagcagttcacaaaaaaatgt

SEQ ID NO: 5998699 - DNA, 20 bp, Homo sapiens
cagcagttcagagctgccct

SEQ ID NO: 5998700 - DNA, 17 bp, Homo sapiens
cagcagttccatgaaga

SEQ ID NO: 5998701 - DNA, 20 bp, Homo sapiens
cagcagttccatgaagacac

SEQ ID NO: 5998702 - DNA, 20 bp, Homo sapiens
cagcagttgaaaagactcca

SEQ ID NO: 5998703 - DNA, 22 bp, Homo sapiens
cagcagttgaggtggggtagtg

SEQ ID NO: 5998704 - DNA, 21 bp, Homo sapiens
cagcagttgctggtaaaatga

SEQ ID NO: 5998705 - DNA, 16 bp, Homo sapiens
cagcagttgtaaaatt

SEQ ID NO: 5998706 - DNA, 15 bp, Homo sapiens
cagcagttgttccag

SEQ ID NO: 5998707 - DNA, 21 bp, Homo sapiens
cagcagtttccagagagtgga

SEQ ID NO: 5998708 - DNA, 20 bp, Homo sapiens
cagcagtttgagcttgctgg

SEQ ID NO: 5998709 - DNA, 12 bp, Homo sapiens
cagcataaagaa

SEQ ID NO: 5998710 - DNA, 22 bp, Homo sapiens
cagcataacaaggtccaagata

SEQ ID NO: 5998711 - DNA, 14 bp, Homo sapiens
cagcataagggagc

SEQ ID NO: 5998712 - DNA, 23 bp, Homo sapiens
cagcataagtaaacaacatattt

SEQ ID NO: 5998713 - DNA, 13 bp, Homo sapiens
cagcataatactt

SEQ ID NO: 5998714 - DNA, 18 bp, Homo sapiens
cagcatacagagcaggcc

SEQ ID NO: 5998715 - DNA, 14 bp, Homo sapiens
cagcataccaatta

SEQ ID NO: 5998716 - DNA, 18 bp, Homo sapiens
cagcataccagttcttgc

SEQ ID NO: 5998717 - DNA, 14 bp, Homo sapiens
cagcataccttgga

SEQ ID NO: 5998718 - DNA, 19 bp, Homo sapiens
cagcatagaacaggacctc

SEQ ID NO: 5998719 - DNA, 15 bp, Homo sapiens
cagcatagcctgcct

SEQ ID NO: 5998720 - DNA, 21 bp, Homo sapiens
cagcatagggtcactttgcca

SEQ ID NO: 5998721 - DNA, 23 bp, Homo sapiens
cagcatagttctgcaataacagt

SEQ ID NO: 5998722 - DNA, 16 bp, Homo sapiens
cagcatatacaataat

SEQ ID NO: 5998723 - DNA, 17 bp, Homo sapiens
cagcatatacaataatg

SEQ ID NO: 5998724 - DNA, 15 bp, Homo sapiens
cagcatcaaaataca

SEQ ID NO: 5998725 - DNA, 13 bp, Homo sapiens
cagcatcaaacat

SEQ ID NO: 5998726 - DNA, 17 bp, Homo sapiens
cagcatcaaacatgaaa

SEQ ID NO: 5998727 - DNA, 17 bp, Homo sapiens
cagcatcaacctaggag

SEQ ID NO: 5998728 - DNA, 22 bp, Homo sapiens
cagcatcaagccccacagttct

SEQ ID NO: 5998729 - DNA, 19 bp, Homo sapiens
cagcatcactaaaccgata

SEQ ID NO: 5998730 - DNA, 14 bp, Homo sapiens
cagcatcactcccc

SEQ ID NO: 5998731 - DNA, 15 bp, Homo sapiens
cagcatcactcccca

SEQ ID NO: 5998732 - DNA, 19 bp, Homo sapiens
cagcatcactccccaagga

SEQ ID NO: 5998733 - DNA, 22 bp, Homo sapiens
cagcatcactccccaaggaaga

SEQ ID NO: 5998734 - DNA, 15 bp, Homo sapiens
cagcatcactggtat

SEQ ID NO: 5998735 - DNA, 22 bp, Homo sapiens
cagcatcactggtatgatgtat

SEQ ID NO: 5998736 - DNA, 13 bp, Homo sapiens
cagcatcagctca

SEQ ID NO: 5998737 - DNA, 13 bp, Homo sapiens
cagcatcagggtt

SEQ ID NO: 5998738 - DNA, 23 bp, Homo sapiens
cagcatcattttgcattcaaatt

SEQ ID NO: 5998739 - DNA, 17 bp, Homo sapiens
cagcatccagcctgtgt

SEQ ID NO: 5998740 - DNA, 18 bp, Homo sapiens
cagcatccagcctgtgtg

SEQ ID NO: 5998741 - DNA, 19 bp, Homo sapiens
cagcatccagtgtgagata

SEQ ID NO: 5998742 - DNA, 21 bp, Homo sapiens
cagcatcccacgatcggcctt

SEQ ID NO: 5998743 - DNA, 22 bp, Homo sapiens
cagcatcccagcctcagaagcc

SEQ ID NO: 5998744 - DNA, 19 bp, Homo sapiens
cagcatccccttgaactct

SEQ ID NO: 5998745 - DNA, 14 bp, Homo sapiens
cagcatccctggag

SEQ ID NO: 5998746 - DNA, 22 bp, Homo sapiens
cagcatccctggagcaggagcc

SEQ ID NO: 5998747 - DNA, 18 bp, Homo sapiens
cagcatcccttgaccagg

SEQ ID NO: 5998748 - DNA, 20 bp, Homo sapiens
cagcatccgcaggtgctggt

SEQ ID NO: 5998749 - DNA, 17 bp, Homo sapiens
cagcatcctggcacccg

SEQ ID NO: 5998750 - DNA, 22 bp, Homo sapiens
cagcatccttaagtatcagaaa

SEQ ID NO: 5998751 - DNA, 21 bp, Homo sapiens
cagcatcgcactctggcagca

SEQ ID NO: 5998752 - DNA, 22 bp, Homo sapiens
cagcatcggacaagacccccag

SEQ ID NO: 5998753 - DNA, 17 bp, Homo sapiens
cagcatcgtgtgggtcc

SEQ ID NO: 5998754 - DNA, 19 bp, Homo sapiens
cagcatcgtgtgggtccct

SEQ ID NO: 5998755 - DNA, 21 bp, Homo sapiens
cagcatctaaagcagcaggtc

SEQ ID NO: 5998756 - DNA, 19 bp, Homo sapiens
cagcatctactactctgtc

SEQ ID NO: 5998757 - DNA, 13 bp, Homo sapiens
cagcatctcagag

SEQ ID NO: 5998758 - DNA, 16 bp, Homo sapiens
cagcatctcagagtcc

SEQ ID NO: 5998759 - DNA, 13 bp, Homo sapiens
cagcatctcagct

SEQ ID NO: 5998760 - DNA, 17 bp, Homo sapiens
cagcatctccaagcagc

SEQ ID NO: 5998761 - DNA, 23 bp, Homo sapiens
cagcatctcccagcaagacctca

SEQ ID NO: 5998762 - DNA, 20 bp, Homo sapiens
cagcatctctaccttctccc

SEQ ID NO: 5998763 - DNA, 11 bp, Homo sapiens
cagcatctgac

SEQ ID NO: 5998764 - DNA, 14 bp, Homo sapiens
cagcatctgaccat

SEQ ID NO: 5998765 - DNA, 15 bp, Homo sapiens
cagcatctgaccatc

SEQ ID NO: 5998766 - DNA, 18 bp, Homo sapiens
cagcatctgaccatctgt

SEQ ID NO: 5998767 - DNA, 21 bp, Homo sapiens
cagcatctgaccatctgtgac

SEQ ID NO: 5998768 - DNA, 12 bp, Homo sapiens
cagcatctgctc

SEQ ID NO: 5998769 - DNA, 14 bp, Homo sapiens
cagcatctggctgt

SEQ ID NO: 5998770 - DNA, 15 bp, Homo sapiens
cagcatctggctgtc

SEQ ID NO: 5998771 - DNA, 23 bp, Homo sapiens
cagcatctggctgtctagaatgt

SEQ ID NO: 5998772 - DNA, 16 bp, Homo sapiens
cagcatctgggccttg

SEQ ID NO: 5998773 - DNA, 20 bp, Homo sapiens
cagcatctgggccttggcct

SEQ ID NO: 5998774 - DNA, 22 bp, Homo sapiens
cagcatctgggccttggcctgg

SEQ ID NO: 5998775 - DNA, 21 bp, Homo sapiens
cagcatctggtcttgtttcca

SEQ ID NO: 5998776 - DNA, 14 bp, Homo sapiens
cagcatcttctggt

SEQ ID NO: 5998777 - DNA, 15 bp, Homo sapiens
cagcatcttctggtt

SEQ ID NO: 5998778 - DNA, 20 bp, Homo sapiens
cagcatctttgcccttctgg

SEQ ID NO: 5998779 - DNA, 19 bp, Homo sapiens
cagcatcttttccatcctg

SEQ ID NO: 5998780 - DNA, 18 bp, Homo sapiens
cagcatgaataaaacact

SEQ ID NO: 5998781 - DNA, 20 bp, Homo sapiens
cagcatgaataaaacactca

SEQ ID NO: 5998782 - DNA, 22 bp, Homo sapiens
cagcatgaataaaacactcatc

SEQ ID NO: 5998783 - DNA, 15 bp, Homo sapiens
cagcatgacaaaaat

SEQ ID NO: 5998784 - DNA, 18 bp, Homo sapiens
cagcatgacaaaaataac

SEQ ID NO: 5998785 - DNA, 17 bp, Homo sapiens
cacccatggcctcagcc

SEQ ID NO: 5998786 - DNA, 19 bp, Homo sapiens
cacccatgggctctgacag

SEQ ID NO: 5998787 - DNA, 14 bp, Homo sapiens
cacccatggggagg

SEQ ID NO: 5998788 - DNA, 15 bp, Homo sapiens
cacccatggggagga

SEQ ID NO: 5998789 - DNA, 19 bp, Homo sapiens
cacccatgtaaccactgca

SEQ ID NO: 5998790 - DNA, 13 bp, Homo sapiens
cacccatgtgcca

SEQ ID NO: 5998791 - DNA, 14 bp, Homo sapiens
cacccatgtgggcg

SEQ ID NO: 5998792 - DNA, 14 bp, Homo sapiens
cacccattgtctca

SEQ ID NO: 5998793 - DNA, 18 bp, Homo sapiens
cacccattgtctcattgc

SEQ ID NO: 5998794 - DNA, 15 bp, Homo sapiens
cacccattttcacat

SEQ ID NO: 5998795 - DNA, 13 bp, Homo sapiens
caccccaaacccc

SEQ ID NO: 5998796 - DNA, 17 bp, Homo sapiens
caccccaaaccccagcc

SEQ ID NO: 5998797 - DNA, 17 bp, Homo sapiens
caccccaaacttccagg

SEQ ID NO: 5998798 - DNA, 17 bp, Homo sapiens
caccccaacacttccag

SEQ ID NO: 5998799 - DNA, 15 bp, Homo sapiens
caccccaaccactct

SEQ ID NO: 5998800 - DNA, 19 bp, Homo sapiens
caccccaactctccccagt

SEQ ID NO: 5998801 - DNA, 14 bp, Homo sapiens
caccccaactctgt

SEQ ID NO: 5998802 - DNA, 23 bp, Homo sapiens
caccccaagggacaaccccatca

SEQ ID NO: 5998803 - DNA, 22 bp, Homo sapiens
caccccaagtagtctgctcaca

SEQ ID NO: 5998804 - DNA, 17 bp, Homo sapiens
caccccaatccctgcca

SEQ ID NO: 5998805 - DNA, 15 bp, Homo sapiens
caccccaatcctccc

SEQ ID NO: 5998806 - DNA, 18 bp, Homo sapiens
caccccacaccccagccc

SEQ ID NO: 5998807 - DNA, 20 bp, Homo sapiens
caccccacaccccagcccac

SEQ ID NO: 5998808 - DNA, 12 bp, Homo sapiens
caccccacactt

SEQ ID NO: 5998809 - DNA, 13 bp, Homo sapiens
caccccacacttg

SEQ ID NO: 5998810 - DNA, 16 bp, Homo sapiens
caccccacagaacctt

SEQ ID NO: 5998811 - DNA, 12 bp, Homo sapiens
caccccacagct

SEQ ID NO: 5998812 - DNA, 13 bp, Homo sapiens
caccccacagctg

SEQ ID NO: 5998813 - DNA, 23 bp, Homo sapiens
caccccacattggacttccttgg

SEQ ID NO: 5998814 - DNA, 21 bp, Homo sapiens
caccccacccacttctgcact

SEQ ID NO: 5998815 - DNA, 13 bp, Homo sapiens
caccccaccctcc

SEQ ID NO: 5998816 - DNA, 15 bp, Homo sapiens
caccccaccctccct

SEQ ID NO: 5998817 - DNA, 13 bp, Homo sapiens
caccccacctcca

SEQ ID NO: 5998818 - DNA, 12 bp, Homo sapiens
caccccacctct

SEQ ID NO: 5998819 - DNA, 12 bp, Homo sapiens
caccccacctgc

SEQ ID NO: 5998820 - DNA, 14 bp, Homo sapiens
caccccactcacag

SEQ ID NO: 5998821 - DNA, 16 bp, Homo sapiens
caccccactccagccc

SEQ ID NO: 5998822 - DNA, 16 bp, Homo sapiens
caccccactcctgtca

SEQ ID NO: 5998823 - DNA, 20 bp, Homo sapiens
caccccactctacctcctta

SEQ ID NO: 5998824 - DNA, 19 bp, Homo sapiens
caccccactgagagctgct

SEQ ID NO: 5998825 - DNA, 21 bp, Homo sapiens
caccccactgagagctgctcc

SEQ ID NO: 5998826 - DNA, 17 bp, Homo sapiens
caccccacttcccatct

SEQ ID NO: 5998827 - DNA, 20 bp, Homo sapiens
caccccagaaatcactgtga

SEQ ID NO: 5998828 - DNA, 22 bp, Homo sapiens
caccccagaaatcactgtgaaa

SEQ ID NO: 5998829 - DNA, 19 bp, Homo sapiens
caccccagaatcccctggg

SEQ ID NO: 5998830 - DNA, 21 bp, Homo sapiens
caccccagacctcacctccat

SEQ ID NO: 5998831 - DNA, 13 bp, Homo sapiens
caccccagactcc

SEQ ID NO: 5998832 - DNA, 19 bp, Homo sapiens
caccccagactccaggccc

SEQ ID NO: 5998833 - DNA, 15 bp, Homo sapiens
caccccagagccaca

SEQ ID NO: 5998834 - DNA, 16 bp, Homo sapiens
caccccagagccacac

SEQ ID NO: 5998835 - DNA, 17 bp, Homo sapiens
caccccagagccacaca

SEQ ID NO: 5998836 - DNA, 19 bp, Homo sapiens
caccccagagccacacatg

SEQ ID NO: 5998837 - DNA, 22 bp, Homo sapiens
caccccagaggacacaggcagc

SEQ ID NO: 5998838 - DNA, 18 bp, Homo sapiens
caccccagcacagccacc

SEQ ID NO: 5998839 - DNA, 19 bp, Homo sapiens
caccccagcacagccacct

SEQ ID NO: 5998840 - DNA, 21 bp, Homo sapiens
caccccagcacagccacctcc

SEQ ID NO: 5998841 - DNA, 20 bp, Homo sapiens
caccccagcacagctcctcc

SEQ ID NO: 5998842 - DNA, 21 bp, Homo sapiens
caccccagcacagctcctccc

SEQ ID NO: 5998843 - DNA, 23 bp, Homo sapiens
caccccagcacagctcctcccct

SEQ ID NO: 5998844 - DNA, 17 bp, Homo sapiens
caccccagcattccagc

SEQ ID NO: 5998845 - DNA, 17 bp, Homo sapiens
caccccagcccccacag

SEQ ID NO: 5998846 - DNA, 19 bp, Homo sapiens
caccccagcccccacagcc

SEQ ID NO: 5998847 - DNA, 12 bp, Homo sapiens
caccccagcctc

SEQ ID NO: 5998848 - DNA, 18 bp, Homo sapiens
caccccagcctcgcctgt

SEQ ID NO: 5998849 - DNA, 12 bp, Homo sapiens
caccccagcgcc

SEQ ID NO: 5998850 - DNA, 13 bp, Homo sapiens
caccccagctccg

SEQ ID NO: 5998851 - DNA, 16 bp, Homo sapiens
caccccagctgctccc

SEQ ID NO: 5998852 - DNA, 19 bp, Homo sapiens
caccccagctgctcccctc

SEQ ID NO: 5998853 - DNA, 11 bp, Homo sapiens
caccccaggac

SEQ ID NO: 5998854 - DNA, 15 bp, Homo sapiens
caccccaggcagctc

SEQ ID NO: 5998855 - DNA, 17 bp, Homo sapiens
caccccaggcagctcct

SEQ ID NO: 5998856 - DNA, 12 bp, Homo sapiens
caccccagggtc

SEQ ID NO: 5998857 - DNA, 13 bp, Homo sapiens
caccccagtcacc

SEQ ID NO: 5998858 - DNA, 14 bp, Homo sapiens
caccccagtccccg

SEQ ID NO: 5998859 - DNA, 18 bp, Homo sapiens
caccccagtgcacccact

SEQ ID NO: 5998860 - DNA, 16 bp, Homo sapiens
caccccagtgcctgtc

SEQ ID NO: 5998861 - DNA, 24 bp, Homo sapiens
caccccagtgcggacccttcccag

SEQ ID NO: 5998862 - DNA, 20 bp, Homo sapiens
caccccataactacagagtc

SEQ ID NO: 5998863 - DNA, 19 bp, Homo sapiens
caccccataagccctgaga

SEQ ID NO: 5998864 - DNA, 21 bp, Homo sapiens
caccccataagccctgagact

SEQ ID NO: 5998865 - DNA, 23 bp, Homo sapiens
caccccataataaccctgccagt

SEQ ID NO: 5998866 - DNA, 18 bp, Homo sapiens
caccccataccagtcacc

SEQ ID NO: 5998867 - DNA, 22 bp, Homo sapiens
caccccatagtgaccggctgct

SEQ ID NO: 5998868 - DNA, 19 bp, Homo sapiens
caccccatgagctcggggt

SEQ ID NO: 5998869 - DNA, 12 bp, Homo sapiens
caccccatgcca

SEQ ID NO: 5998870 - DNA, 12 bp, Homo sapiens
caccccatgctg

SEQ ID NO: 5998871 - DNA, 14 bp, Homo sapiens
caccccatgctggc

SEQ ID NO: 5998872 - DNA, 22 bp, Homo sapiens
caccccatgtgggtgaccaggt

SEQ ID NO: 5998873 - DNA, 13 bp, Homo sapiens
caccccattcccg

SEQ ID NO: 5998874 - DNA, 17 bp, Homo sapiens
caccccattttctgtgg

SEQ ID NO: 5998875 - DNA, 17 bp, Homo sapiens
cacccccaacccccaga

SEQ ID NO: 5998876 - DNA, 18 bp, Homo sapiens
cacccccaacccccagag

SEQ ID NO: 5998877 - DNA, 14 bp, Homo sapiens
cacccccaacttca

SEQ ID NO: 5998878 - DNA, 12 bp, Homo sapiens
cacccccaagcc

SEQ ID NO: 5998879 - DNA, 16 bp, Homo sapiens
cacccccaagccacag

SEQ ID NO: 5998880 - DNA, 16 bp, Homo sapiens
cacccccaagcctggg

SEQ ID NO: 5998881 - DNA, 12 bp, Homo sapiens
cacccccaaggg

SEQ ID NO: 5998882 - DNA, 19 bp, Homo sapiens
cacccccaaggggcagtct

SEQ ID NO: 5998883 - DNA, 22 bp, Homo sapiens
cacccccaattaaacccagaac

SEQ ID NO: 5998884 - DNA, 18 bp, Homo sapiens
cacccccaattccttgag

SEQ ID NO: 5998885 - DNA, 21 bp, Homo sapiens
cacccccacaagctgtccctg

SEQ ID NO: 5998886 - DNA, 12 bp, Homo sapiens
cacccccacacc

SEQ ID NO: 5998887 - DNA, 12 bp, Homo sapiens
cacccccactgg

SEQ ID NO: 5998888 - DNA, 16 bp, Homo sapiens
cacccccactggtgag

SEQ ID NO: 5998889 - DNA, 12 bp, Homo sapiens
cacccccagaga

SEQ ID NO: 5998890 - DNA, 10 bp, Homo sapiens
cacccccagc

SEQ ID NO: 5998891 - DNA, 11 bp, Homo sapiens
cacccccagcc

SEQ ID NO: 5998892 - DNA, 14 bp, Homo sapiens
cacccccagccagg

SEQ ID NO: 5998893 - DNA, 15 bp, Homo sapiens
cacccccagccaggc

SEQ ID NO: 5998894 - DNA, 12 bp, Homo sapiens
cacccccagccc

SEQ ID NO: 5998895 - DNA, 15 bp, Homo sapiens
cacccccagccctgg

SEQ ID NO: 5998896 - DNA, 14 bp, Homo sapiens
cacccccagcctcc

SEQ ID NO: 5998897 - DNA, 16 bp, Homo sapiens
cacccccagcctcccc

SEQ ID NO: 5998898 - DNA, 14 bp, Homo sapiens
cacccccagcctgg

SEQ ID NO: 5998899 - DNA, 24 bp, Homo sapiens
cacccccagccttgcccagctttc

SEQ ID NO: 5998900 - DNA, 11 bp, Homo sapiens
cacccccagct

SEQ ID NO: 5998901 - DNA, 17 bp, Homo sapiens
cacccccagctgcttgt

SEQ ID NO: 5998902 - DNA, 20 bp, Homo sapiens
cacccccaggacctcttcag

SEQ ID NO: 5998903 - DNA, 17 bp, Homo sapiens
cacccccaggcctccta

SEQ ID NO: 5998904 - DNA, 18 bp, Homo sapiens
cacccccaggtcttcctg

SEQ ID NO: 5998905 - DNA, 13 bp, Homo sapiens
cacccccaggtgc

SEQ ID NO: 5998906 - DNA, 13 bp, Homo sapiens
cacccccatccac

SEQ ID NO: 5998907 - DNA, 20 bp, Homo sapiens
cacccccatcttccacctgt

SEQ ID NO: 5998908 - DNA, 13 bp, Homo sapiens
cacccccatgctg

SEQ ID NO: 5998909 - DNA, 16 bp, Homo sapiens
cacccccatgctgcct

SEQ ID NO: 5998910 - DNA, 17 bp, Homo sapiens
cacccccatgctgcctt

SEQ ID NO: 5998911 - DNA, 13 bp, Homo sapiens
caccccccacaca

SEQ ID NO: 5998912 - DNA, 16 bp, Homo sapiens
caccccccacacacac

SEQ ID NO: 5998913 - DNA, 13 bp, Homo sapiens
caccccccacact

SEQ ID NO: 5998914 - DNA, 18 bp, Homo sapiens
caccccccacactcactc

SEQ ID NO: 5998915 - DNA, 13 bp, Homo sapiens
caccccccagcac

SEQ ID NO: 5998916 - DNA, 15 bp, Homo sapiens
caccccccagcacag

SEQ ID NO: 5998917 - DNA, 14 bp, Homo sapiens
caccccccagcctc

SEQ ID NO: 5998918 - DNA, 23 bp, Homo sapiens
caccccccagtcgagccctgcag

SEQ ID NO: 5998919 - DNA, 13 bp, Homo sapiens
cacccccccaacc

SEQ ID NO: 5998920 - DNA, 16 bp, Homo sapiens
cacccccccaccccag

SEQ ID NO: 5998921 - DNA, 12 bp, Homo sapiens
cacccccccagg

SEQ ID NO: 5998922 - DNA, 17 bp, Homo sapiens
cacccccccaggcctcc

SEQ ID NO: 5998923 - DNA, 18 bp, Homo sapiens
caccccccgacctggctg

SEQ ID NO: 5998924 - DNA, 17 bp, Homo sapiens
cacccccctccccaact

SEQ ID NO: 5998925 - DNA, 17 bp, Homo sapiens
cacccccctcctccccc

SEQ ID NO: 5998926 - DNA, 13 bp, Homo sapiens
cacccccctgggc

SEQ ID NO: 5998927 - DNA, 13 bp, Homo sapiens
cacccccctgtgc

SEQ ID NO: 5998928 - DNA, 15 bp, Homo sapiens
cacccccctgtgcct

SEQ ID NO: 5998929 - DNA, 16 bp, Homo sapiens
cacccccctgttctaa

SEQ ID NO: 5998930 - DNA, 19 bp, Homo sapiens
cacccccgaccctgccctg

SEQ ID NO: 5998931 - DNA, 16 bp, Homo sapiens
cacccccgagcttgcc

SEQ ID NO: 5998932 - DNA, 18 bp, Homo sapiens
cacccccgcacccttaag

SEQ ID NO: 5998933 - DNA, 16 bp, Homo sapiens
cacccccgcctccctc

SEQ ID NO: 5998934 - DNA, 23 bp, Homo sapiens
cacccccgctttggttcttcaga

SEQ ID NO: 5998935 - DNA, 21 bp, Homo sapiens
cacccccggcagcagccccca

SEQ ID NO: 5998936 - DNA, 19 bp, Homo sapiens
cacccccgggatcctgccc

SEQ ID NO: 5998937 - DNA, 20 bp, Homo sapiens
cacccccgtcaccccgctct

SEQ ID NO: 5998938 - DNA, 21 bp, Homo sapiens
caccccctcaagccccagcag

SEQ ID NO: 5998939 - DNA, 13 bp, Homo sapiens
caccccctccagc

SEQ ID NO: 5998940 - DNA, 19 bp, Homo sapiens
caccccctccagctccagt

SEQ ID NO: 5998941 - DNA, 14 bp, Homo sapiens
caccccctcccacc

SEQ ID NO: 5998942 - DNA, 19 bp, Homo sapiens
caccccctcccacccccag

SEQ ID NO: 5998943 - DNA, 16 bp, Homo sapiens
caccccctccccaggg

SEQ ID NO: 5998944 - DNA, 15 bp, Homo sapiens
caccccctccccgcc

SEQ ID NO: 5998945 - DNA, 14 bp, Homo sapiens
caccccctccctgg

SEQ ID NO: 5998946 - DNA, 15 bp, Homo sapiens
caccccctcctcccc

SEQ ID NO: 5998947 - DNA, 20 bp, Homo sapiens
caccccctcctggcaatcaa

SEQ ID NO: 5998948 - DNA, 15 bp, Homo sapiens
caccccctctcctgg

SEQ ID NO: 5998949 - DNA, 21 bp, Homo sapiens
caccccctctggagaaggcct

SEQ ID NO: 5998950 - DNA, 22 bp, Homo sapiens
caccccctctggagaaggcctg

SEQ ID NO: 5998951 - DNA, 23 bp, Homo sapiens
caccccctctggagaaggcctgg

SEQ ID NO: 5998952 - DNA, 13 bp, Homo sapiens
caccccctgccca

SEQ ID NO: 5998953 - DNA, 13 bp, Homo sapiens
caccccctgccct

SEQ ID NO: 5998954 - DNA, 17 bp, Homo sapiens
caccccctgccctgcac

SEQ ID NO: 5998955 - DNA, 18 bp, Homo sapiens
caccccctgctccaccag

SEQ ID NO: 5998956 - DNA, 19 bp, Homo sapiens
caccccctgctccaccagc

SEQ ID NO: 5998957 - DNA, 12 bp, Homo sapiens
caccccctgctg

SEQ ID NO: 5998958 - DNA, 15 bp, Homo sapiens
caccccctgggcaga

SEQ ID NO: 5998959 - DNA, 23 bp, Homo sapiens
caccccctgtcccattctagatc

SEQ ID NO: 5998960 - DNA, 21 bp, Homo sapiens
cacccccttcagtgcccacca

SEQ ID NO: 5998961 - DNA, 16 bp, Homo sapiens
cacccccttccctggg

SEQ ID NO: 5998962 - DNA, 17 bp, Homo sapiens
cacccccttccctggga

SEQ ID NO: 5998963 - DNA, 18 bp, Homo sapiens
cacccccttccctgggag

SEQ ID NO: 5998964 - DNA, 18 bp, Homo sapiens
cacccccttctctgctcc

SEQ ID NO: 5998965 - DNA, 21 bp, Homo sapiens
cacccccttggtgctcgcctt

SEQ ID NO: 5998966 - DNA, 23 bp, Homo sapiens
caccccgaaatcagcccccagcc

SEQ ID NO: 5998967 - DNA, 21 bp, Homo sapiens
cagcatgacaaaaataacact

SEQ ID NO: 5998968 - DNA, 22 bp, Homo sapiens
cagcatgacaaaaataacactg

SEQ ID NO: 5998969 - DNA, 23 bp, Homo sapiens
cagcatgacaaaaataacactgt

SEQ ID NO: 5998970 - DNA, 16 bp, Homo sapiens
cagcatgactggacag

SEQ ID NO: 5998971 - DNA, 17 bp, Homo sapiens
cagcatgactggacagc

SEQ ID NO: 5998972 - DNA, 18 bp, Homo sapiens
cagcatgactggacagcg

SEQ ID NO: 5998973 - DNA, 19 bp, Homo sapiens
cagcatgactggacagcgg

SEQ ID NO: 5998974 - DNA, 22 bp, Homo sapiens
cagcatgagattgtacattttt

SEQ ID NO: 5998975 - DNA, 23 bp, Homo sapiens
cagcatgaggtgttgtgcatttg

SEQ ID NO: 5998976 - DNA, 18 bp, Homo sapiens
cagcatgatattttcaga

SEQ ID NO: 5998977 - DNA, 13 bp, Homo sapiens
cagcatgattctt

SEQ ID NO: 5998978 - DNA, 17 bp, Homo sapiens
cagcatgcaccacgggc

SEQ ID NO: 5998979 - DNA, 15 bp, Homo sapiens
cagcatgcccagatt

SEQ ID NO: 5998980 - DNA, 21 bp, Homo sapiens
cagcatgcttcccagagggag

SEQ ID NO: 5998981 - DNA, 14 bp, Homo sapiens
cagcatgcttgggc

SEQ ID NO: 5998982 - DNA, 23 bp, Homo sapiens
cagcatgcttgggctgacccagc

SEQ ID NO: 5998983 - DNA, 17 bp, Homo sapiens
cagcatggaaaaatggt

SEQ ID NO: 5998984 - DNA, 18 bp, Homo sapiens
cagcatggaaaaatggtt

SEQ ID NO: 5998985 - DNA, 17 bp, Homo sapiens
cagcatggatgaaacct

SEQ ID NO: 5998986 - DNA, 15 bp, Homo sapiens
cagcatggcactccc

SEQ ID NO: 5998987 - DNA, 12 bp, Homo sapiens
cagcatggcccg

SEQ ID NO: 5998988 - DNA, 17 bp, Homo sapiens
cagcatgggtccagaag

SEQ ID NO: 5998989 - DNA, 18 bp, Homo sapiens
cagcatgggtccagaaga

SEQ ID NO: 5998990 - DNA, 19 bp, Homo sapiens
cagcatgggtccagaagac

SEQ ID NO: 5998991 - DNA, 21 bp, Homo sapiens
cagcatgggtccttgatgcca

SEQ ID NO: 5998992 - DNA, 20 bp, Homo sapiens
cagcatggtccctgccttag

SEQ ID NO: 5998993 - DNA, 23 bp, Homo sapiens
cagcatggtccctgccttaggcc

SEQ ID NO: 5998994 - DNA, 15 bp, Homo sapiens
cagcatggttgcaga

SEQ ID NO: 5998995 - DNA, 13 bp, Homo sapiens
cagcatgtacaaa

SEQ ID NO: 5998996 - DNA, 20 bp, Homo sapiens
cagcatgtacggattttcag

SEQ ID NO: 5998997 - DNA, 21 bp, Homo sapiens
cagcatgtacggattttcagt

SEQ ID NO: 5998998 - DNA, 22 bp, Homo sapiens
cagcatgtacggattttcagtt

SEQ ID NO: 5998999 - DNA, 13 bp, Homo sapiens
cagcatgtagggc

SEQ ID NO: 5999000 - DNA, 14 bp, Homo sapiens
cagcatgtagggct

SEQ ID NO: 5999001 - DNA, 17 bp, Homo sapiens
cagcatgtcactcccag

SEQ ID NO: 5999002 - DNA, 12 bp, Homo sapiens
cagcatgtgcca

SEQ ID NO: 5999003 - DNA, 15 bp, Homo sapiens
cagcatgtgccaaga

SEQ ID NO: 5999004 - DNA, 22 bp, Homo sapiens
cagcatgtgctcagccccagac

SEQ ID NO: 5999005 - DNA, 19 bp, Homo sapiens
cagcatgtgggtgtcagtg

SEQ ID NO: 5999006 - DNA, 12 bp, Homo sapiens
cagcatgtgtgt

SEQ ID NO: 5999007 - DNA, 19 bp, Homo sapiens
cagcatgtgtgtgtctcta

SEQ ID NO: 5999008 - DNA, 21 bp, Homo sapiens
cagcatgtgtgtgtctctatc

SEQ ID NO: 5999009 - DNA, 23 bp, Homo sapiens
cagcatgtgttaatcttaatgta

SEQ ID NO: 5999010 - DNA, 17 bp, Homo sapiens
cagcatgttaactttat

SEQ ID NO: 5999011 - DNA, 14 bp, Homo sapiens
cagcatgttttctg

SEQ ID NO: 5999012 - DNA, 21 bp, Homo sapiens
cagcattaggcttttaagaaa

SEQ ID NO: 5999013 - DNA, 17 bp, Homo sapiens
cagcattattcctccag

SEQ ID NO: 5999014 - DNA, 18 bp, Homo sapiens
cagcattattcctccagg

SEQ ID NO: 5999015 - DNA, 14 bp, Homo sapiens
cagcattcaaaata

SEQ ID NO: 5999016 - DNA, 21 bp, Homo sapiens
cagcattcaaaatagttctat

SEQ ID NO: 5999017 - DNA, 13 bp, Homo sapiens
cagcattcagcac

SEQ ID NO: 5999018 - DNA, 14 bp, Homo sapiens
cagcattccagact

SEQ ID NO: 5999019 - DNA, 16 bp, Homo sapiens
cagcattccagacttc

SEQ ID NO: 5999020 - DNA, 12 bp, Homo sapiens
cagcattccagc

SEQ ID NO: 5999021 - DNA, 21 bp, Homo sapiens
cagcattccagcccctctggt

SEQ ID NO: 5999022 - DNA, 20 bp, Homo sapiens
cagcattccagctctgcccc

SEQ ID NO: 5999023 - DNA, 15 bp, Homo sapiens
cagcattccatgacc

SEQ ID NO: 5999024 - DNA, 23 bp, Homo sapiens
cagcattcccaattatcaaaaaa

SEQ ID NO: 5999025 - DNA, 13 bp, Homo sapiens
cagcattcctcca

SEQ ID NO: 5999026 - DNA, 14 bp, Homo sapiens
cagcattctcactc

SEQ ID NO: 5999027 - DNA, 15 bp, Homo sapiens
cagcattctcagcca

SEQ ID NO: 5999028 - DNA, 13 bp, Homo sapiens
cagcattctggag

SEQ ID NO: 5999029 - DNA, 19 bp, Homo sapiens
cagcattctggaggggaga

SEQ ID NO: 5999030 - DNA, 19 bp, Homo sapiens
cagcattcttgtcacaata

SEQ ID NO: 5999031 - DNA, 20 bp, Homo sapiens
cagcattcttgtcacaataa

SEQ ID NO: 5999032 - DNA, 22 bp, Homo sapiens
cagcattcttgtcacaataaat

SEQ ID NO: 5999033 - DNA, 14 bp, Homo sapiens
cagcattgaagaga

SEQ ID NO: 5999034 - DNA, 14 bp, Homo sapiens
cagcattgaagtat

SEQ ID NO: 5999035 - DNA, 17 bp, Homo sapiens
cagcattgatatttgtg

SEQ ID NO: 5999036 - DNA, 13 bp, Homo sapiens
cagcattggcctg

SEQ ID NO: 5999037 - DNA, 13 bp, Homo sapiens
cagcattgtaatt

SEQ ID NO: 5999038 - DNA, 16 bp, Homo sapiens
cagcattgtatatgtg

SEQ ID NO: 5999039 - DNA, 12 bp, Homo sapiens
cagcattgtctt

SEQ ID NO: 5999040 - DNA, 15 bp, Homo sapiens
cagcattgtctttgc

SEQ ID NO: 5999041 - DNA, 16 bp, Homo sapiens
cagcattgtctttgct

SEQ ID NO: 5999042 - DNA, 14 bp, Homo sapiens
cagcattgtgactt

SEQ ID NO: 5999043 - DNA, 16 bp, Homo sapiens
cagcattgtgtggaat

SEQ ID NO: 5999044 - DNA, 19 bp, Homo sapiens
cagcattgttgagctgtca

SEQ ID NO: 5999045 - DNA, 18 bp, Homo sapiens
cagcattgtttcaaaata

SEQ ID NO: 5999046 - DNA, 19 bp, Homo sapiens
cagcatttactatgcacaa

SEQ ID NO: 5999047 - DNA, 23 bp, Homo sapiens
cagcatttactatgcacaacaga

SEQ ID NO: 5999048 - DNA, 21 bp, Homo sapiens
cagcatttactatgccacaga

SEQ ID NO: 5999049 - DNA, 18 bp, Homo sapiens
cagcatttagctggccac

SEQ ID NO: 5999050 - DNA, 12 bp, Homo sapiens
cagcatttcaag

SEQ ID NO: 5999051 - DNA, 12 bp, Homo sapiens
cagcatttcact

SEQ ID NO: 5999052 - DNA, 13 bp, Homo sapiens
cagcatttcactt

SEQ ID NO: 5999053 - DNA, 20 bp, Homo sapiens
cagcatttccacaccaagca

SEQ ID NO: 5999054 - DNA, 21 bp, Homo sapiens
cagcatttccacaccaagcag

SEQ ID NO: 5999055 - DNA, 15 bp, Homo sapiens
cagcatttcctcagt

SEQ ID NO: 5999056 - DNA, 20 bp, Homo sapiens
cagcatttcctcagtctccc

SEQ ID NO: 5999057 - DNA, 15 bp, Homo sapiens
cagcatttccttcca

SEQ ID NO: 5999058 - DNA, 21 bp, Homo sapiens
cagcatttccttccagcccat

SEQ ID NO: 5999059 - DNA, 16 bp, Homo sapiens
cagcatttctgaagtg

SEQ ID NO: 5999060 - DNA, 16 bp, Homo sapiens
cagcatttcttttctg

SEQ ID NO: 5999061 - DNA, 20 bp, Homo sapiens
cagcatttgagagaaggtag

SEQ ID NO: 5999062 - DNA, 14 bp, Homo sapiens
cagcatttgataat

SEQ ID NO: 5999063 - DNA, 16 bp, Homo sapiens
cagcatttgatctgtt

SEQ ID NO: 5999064 - DNA, 13 bp, Homo sapiens
cagcatttgatga

SEQ ID NO: 5999065 - DNA, 17 bp, Homo sapiens
cagcatttgctttcctc

SEQ ID NO: 5999066 - DNA, 19 bp, Homo sapiens
cagcatttgctttcctctg

SEQ ID NO: 5999067 - DNA, 21 bp, Homo sapiens
cagcatttggttttacacagg

SEQ ID NO: 5999068 - DNA, 22 bp, Homo sapiens
cagcatttggttttacacagga

SEQ ID NO: 5999069 - DNA, 12 bp, Homo sapiens
cagcatttgtcc

SEQ ID NO: 5999070 - DNA, 16 bp, Homo sapiens
cagcatttgtccaccc

SEQ ID NO: 5999071 - DNA, 23 bp, Homo sapiens
cagcatttgtccttttgtgaaat

SEQ ID NO: 5999072 - DNA, 19 bp, Homo sapiens
cagcatttgttctttgcca

SEQ ID NO: 5999073 - DNA, 20 bp, Homo sapiens
cagcattttaaggttctcag

SEQ ID NO: 5999074 - DNA, 15 bp, Homo sapiens
cagcattttactact

SEQ ID NO: 5999075 - DNA, 23 bp, Homo sapiens
cagcattttactacttgttacct

SEQ ID NO: 5999076 - DNA, 18 bp, Homo sapiens
cagcattttactgattca

SEQ ID NO: 5999077 - DNA, 13 bp, Homo sapiens
cagcattttagaa

SEQ ID NO: 5999078 - DNA, 18 bp, Homo sapiens
cagcattttagaaactac

SEQ ID NO: 5999079 - DNA, 21 bp, Homo sapiens
cagcattttagaaactacaaa

SEQ ID NO: 5999080 - DNA, 15 bp, Homo sapiens
cagcattttcacatt

SEQ ID NO: 5999081 - DNA, 13 bp, Homo sapiens
cagcattttcctc

SEQ ID NO: 5999082 - DNA, 15 bp, Homo sapiens
cagcattttcctctg

SEQ ID NO: 5999083 - DNA, 19 bp, Homo sapiens
cagcatttttaattttcac

SEQ ID NO: 5999084 - DNA, 19 bp, Homo sapiens
cagcatttttctttagtca

SEQ ID NO: 5999085 - DNA, 13 bp, Homo sapiens
cagcattttttat

SEQ ID NO: 5999086 - DNA, 16 bp, Homo sapiens
cagccaaaaaggacca

SEQ ID NO: 5999087 - DNA, 12 bp, Homo sapiens
cagccaaacaca

SEQ ID NO: 5999088 - DNA, 19 bp, Homo sapiens
cagccaaacacacagaagg

SEQ ID NO: 5999089 - DNA, 16 bp, Homo sapiens
cagccaaacacagagc

SEQ ID NO: 5999090 - DNA, 20 bp, Homo sapiens
cagccaaacacataacaata

SEQ ID NO: 5999091 - DNA, 15 bp, Homo sapiens
cagccaaacagagcc

SEQ ID NO: 5999092 - DNA, 17 bp, Homo sapiens
cagccaaacagtatgat

SEQ ID NO: 5999093 - DNA, 19 bp, Homo sapiens
cagccaaacccatgaggca

SEQ ID NO: 5999094 - DNA, 16 bp, Homo sapiens
cagccaaaccctgtct

SEQ ID NO: 5999095 - DNA, 14 bp, Homo sapiens
cagccaaagaaact

SEQ ID NO: 5999096 - DNA, 17 bp, Homo sapiens
cagccaaagcatgccgt

SEQ ID NO: 5999097 - DNA, 15 bp, Homo sapiens
cagccaaagcctcct

SEQ ID NO: 5999098 - DNA, 15 bp, Homo sapiens
cagccaaaggggagc

SEQ ID NO: 5999099 - DNA, 17 bp, Homo sapiens
cagccaaaggggagcca

SEQ ID NO: 5999100 - DNA, 21 bp, Homo sapiens
cagccaaatccatcctgctct

SEQ ID NO: 5999101 - DNA, 15 bp, Homo sapiens
cagccaaatttcctg

SEQ ID NO: 5999102 - DNA, 21 bp, Homo sapiens
cagccaaatttcctgtttgaa

SEQ ID NO: 5999103 - DNA, 22 bp, Homo sapiens
cagccaacacgcacctgcctca

SEQ ID NO: 5999104 - DNA, 13 bp, Homo sapiens
cagccaacagcta

SEQ ID NO: 5999105 - DNA, 18 bp, Homo sapiens
cagccaacagctacaaca

SEQ ID NO: 5999106 - DNA, 15 bp, Homo sapiens
cagccaacccctgtg

SEQ ID NO: 5999107 - DNA, 16 bp, Homo sapiens
cagccaacccctgtgg

SEQ ID NO: 5999108 - DNA, 18 bp, Homo sapiens
cagccaacccctgtggag

SEQ ID NO: 5999109 - DNA, 20 bp, Homo sapiens
cagccaaccttacttacagc

SEQ ID NO: 5999110 - DNA, 16 bp, Homo sapiens
cagccaacgagacaca

SEQ ID NO: 5999111 - DNA, 20 bp, Homo sapiens
cagccaacgagacacattgc

SEQ ID NO: 5999112 - DNA, 22 bp, Homo sapiens
cagccaacgagacacattgcct

SEQ ID NO: 5999113 - DNA, 20 bp, Homo sapiens
cagccaacgagattgctgga

SEQ ID NO: 5999114 - DNA, 16 bp, Homo sapiens
cagccaactagcccct

SEQ ID NO: 5999115 - DNA, 17 bp, Homo sapiens
cagccaactagcccctg

SEQ ID NO: 5999116 - DNA, 20 bp, Homo sapiens
cagccaactagcccctgggg

SEQ ID NO: 5999117 - DNA, 14 bp, Homo sapiens
cagccaagagccat

SEQ ID NO: 5999118 - DNA, 23 bp, Homo sapiens
cagccaagatgatccttcttaga

SEQ ID NO: 5999119 - DNA, 16 bp, Homo sapiens
cagccaagattttcct

SEQ ID NO: 5999120 - DNA, 13 bp, Homo sapiens
cagccaagcacag

SEQ ID NO: 5999121 - DNA, 19 bp, Homo sapiens
cagccaagcacagtggtgg

SEQ ID NO: 5999122 - DNA, 15 bp, Homo sapiens
cagccaagcccaccc

SEQ ID NO: 5999123 - DNA, 13 bp, Homo sapiens
cagccaaggccga

SEQ ID NO: 5999124 - DNA, 21 bp, Homo sapiens
cagccaaggccgaagctctgg

SEQ ID NO: 5999125 - DNA, 16 bp, Homo sapiens
cagccaaggggctgcg

SEQ ID NO: 5999126 - DNA, 13 bp, Homo sapiens
cagccaagggtcc

SEQ ID NO: 5999127 - DNA, 17 bp, Homo sapiens
cagccaagggtcctcac

SEQ ID NO: 5999128 - DNA, 22 bp, Homo sapiens
cagccaagggtcctcacccctc

SEQ ID NO: 5999129 - DNA, 20 bp, Homo sapiens
cagccaaggtgctaaaagga

SEQ ID NO: 5999130 - DNA, 21 bp, Homo sapiens
cagccaaggtgctaaaaggaa

SEQ ID NO: 5999131 - DNA, 23 bp, Homo sapiens
cagccaaggttttataaggctga

SEQ ID NO: 5999132 - DNA, 17 bp, Homo sapiens
cagccaagtgcagagtt

SEQ ID NO: 5999133 - DNA, 17 bp, Homo sapiens
cagccaagtgccttccg

SEQ ID NO: 5999134 - DNA, 18 bp, Homo sapiens
cagccaagttgtgacagt

SEQ ID NO: 5999135 - DNA, 19 bp, Homo sapiens
cagccaataaacaccagtg

SEQ ID NO: 5999136 - DNA, 18 bp, Homo sapiens
cagccaatctccaggctc

SEQ ID NO: 5999137 - DNA, 16 bp, Homo sapiens
cagccaatctggacac

SEQ ID NO: 5999138 - DNA, 18 bp, Homo sapiens
cagccaatctggacactt

SEQ ID NO: 5999139 - DNA, 22 bp, Homo sapiens
cagccaatctggacacttcttt

SEQ ID NO: 5999140 - DNA, 17 bp, Homo sapiens
cagccaattatgttaaa

SEQ ID NO: 5999141 - DNA, 18 bp, Homo sapiens
cagccaattatgttaaac

SEQ ID NO: 5999142 - DNA, 13 bp, Homo sapiens
cagccaatttcaa

SEQ ID NO: 5999143 - DNA, 14 bp, Homo sapiens
cagccaatttcaaa

SEQ ID NO: 5999144 - DNA, 15 bp, Homo sapiens
cagccaatttcccgg

SEQ ID NO: 5999145 - DNA, 18 bp, Homo sapiens
cagccaatttgtctccta

SEQ ID NO: 5999146 - DNA, 20 bp, Homo sapiens
cagccacaaaactctgtcag

SEQ ID NO: 5999147 - DNA, 16 bp, Homo sapiens
cagccacaaagccccc

SEQ ID NO: 5999148 - DNA, 11 bp, Homo sapiens
cagccacacac

SEQ ID NO: 5999149 - DNA, 15 bp, Homo sapiens
cagccacacacacag

SEQ ID NO: 5999150 - DNA, 19 bp, Homo sapiens
cagccacacacacagaaaa

SEQ ID NO: 5999151 - DNA, 21 bp, Homo sapiens
cagccacacacacagaaaata

SEQ ID NO: 5999152 - DNA, 15 bp, Homo sapiens
cagccacacagagcc

SEQ ID NO: 5999153 - DNA, 22 bp, Homo sapiens
cagccacacagagcctgcctca

SEQ ID NO: 5999154 - DNA, 16 bp, Homo sapiens
cagccacacagtggcc

SEQ ID NO: 5999155 - DNA, 17 bp, Homo sapiens
cagccacacagtggccg

SEQ ID NO: 5999156 - DNA, 18 bp, Homo sapiens
cagccacacagtggccgg

SEQ ID NO: 5999157 - DNA, 19 bp, Homo sapiens
cagccacacagtggccggg

SEQ ID NO: 5999158 - DNA, 15 bp, Homo sapiens
cagccacacccaggc

SEQ ID NO: 5999159 - DNA, 16 bp, Homo sapiens
cagccacacgcaggcg

SEQ ID NO: 5999160 - DNA, 19 bp, Homo sapiens
cagccacacgcaggcggcc

SEQ ID NO: 5999161 - DNA, 22 bp, Homo sapiens
cagccacacgcaggcggccagg

SEQ ID NO: 5999162 - DNA, 23 bp, Homo sapiens
cagccacacgcaggcggccaggg

SEQ ID NO: 5999163 - DNA, 20 bp, Homo sapiens
cagccacacttctcaggaca

SEQ ID NO: 5999164 - DNA, 21 bp, Homo sapiens
cagccacacttctcaggacac

SEQ ID NO: 5999165 - DNA, 21 bp, Homo sapiens
cagccacagacccctgggagc

SEQ ID NO: 5999166 - DNA, 23 bp, Homo sapiens
cagccacagcctccccacccagg

SEQ ID NO: 5999167 - DNA, 17 bp, Homo sapiens
cagccacaggaccacct

SEQ ID NO: 5999168 - DNA, 14 bp, Homo sapiens
cagccacaggactg

SEQ ID NO: 5999169 - DNA, 15 bp, Homo sapiens
cagccacaggactga

SEQ ID NO: 5999170 - DNA, 22 bp, Homo sapiens
cagccacaggactgagccctct

SEQ ID NO: 5999171 - DNA, 24 bp, Homo sapiens
cagccacaggactgagccctctca

SEQ ID NO: 5999172 - DNA, 14 bp, Homo sapiens
cagccacaggccaa

SEQ ID NO: 5999173 - DNA, 22 bp, Homo sapiens
cagccacatcatctttatctcc

SEQ ID NO: 5999174 - DNA, 14 bp, Homo sapiens
cagccacatcccca

SEQ ID NO: 5999175 - DNA, 15 bp, Homo sapiens
cagccacatccccaa

SEQ ID NO: 5999176 - DNA, 17 bp, Homo sapiens
cagccacatccccaagc

SEQ ID NO: 5999177 - DNA, 19 bp, Homo sapiens
cagccacatgccccaggct

SEQ ID NO: 5999178 - DNA, 13 bp, Homo sapiens
cagccacatggcc

SEQ ID NO: 5999179 - DNA, 12 bp, Homo sapiens
cagccacatggg

SEQ ID NO: 5999180 - DNA, 15 bp, Homo sapiens
cagccacattcctga

SEQ ID NO: 5999181 - DNA, 17 bp, Homo sapiens
cagccacattcctgatg

SEQ ID NO: 5999182 - DNA, 19 bp, Homo sapiens
cagccacattcctgatgct

SEQ ID NO: 5999183 - DNA, 21 bp, Homo sapiens
cagccaccaaggctgcctgcc

SEQ ID NO: 5999184 - DNA, 14 bp, Homo sapiens
cagccaccaccact

SEQ ID NO: 5999185 - DNA, 20 bp, Homo sapiens
cagccaccaccactgtccct

SEQ ID NO: 5999186 - DNA, 17 bp, Homo sapiens
cagccaccaccctcagg

SEQ ID NO: 5999187 - DNA, 18 bp, Homo sapiens
cagccaccaccctcaggt

SEQ ID NO: 5999188 - DNA, 19 bp, Homo sapiens
cagccaccaccctcaggtg

SEQ ID NO: 5999189 - DNA, 21 bp, Homo sapiens
cagccaccaccctcaggtgcc

SEQ ID NO: 5999190 - DNA, 15 bp, Homo sapiens
cagccaccacctgga

SEQ ID NO: 5999191 - DNA, 13 bp, Homo sapiens
cagccaccagtgg

SEQ ID NO: 5999192 - DNA, 15 bp, Homo sapiens
cagccaccagtggac

SEQ ID NO: 5999193 - DNA, 17 bp, Homo sapiens
cagccaccagtggacct

SEQ ID NO: 5999194 - DNA, 23 bp, Homo sapiens
cagccaccagtggacctagcctg

SEQ ID NO: 5999195 - DNA, 17 bp, Homo sapiens
cagccaccatctggagt

SEQ ID NO: 5999196 - DNA, 17 bp, Homo sapiens
cagccaccccctccccc

SEQ ID NO: 5999197 - DNA, 12 bp, Homo sapiens
cagccacccctg

SEQ ID NO: 5999198 - DNA, 15 bp, Homo sapiens
cagccacccctgcca

SEQ ID NO: 5999199 - DNA, 16 bp, Homo sapiens
cagccacccctgccac

SEQ ID NO: 5999200 - DNA, 17 bp, Homo sapiens
cagccacccctgccact

SEQ ID NO: 5999201 - DNA, 14 bp, Homo sapiens
cagccaccctgagg

SEQ ID NO: 5999202 - DNA, 16 bp, Homo sapiens
cagccaccctgaggag

SEQ ID NO: 5999203 - DNA, 21 bp, Homo sapiens
cagccaccctgaggagtctga

SEQ ID NO: 5999204 - DNA, 16 bp, Homo sapiens
cagccaccctgagttg

SEQ ID NO: 5999205 - DNA, 15 bp, Homo sapiens
cagccaccctgccat

SEQ ID NO: 5999206 - DNA, 16 bp, Homo sapiens
cagccaccctgccatg

SEQ ID NO: 5999207 - DNA, 22 bp, Homo sapiens
cagccacccttggtctcatgcc

SEQ ID NO: 5999208 - DNA, 14 bp, Homo sapiens
cagccaccctttct

SEQ ID NO: 5999209 - DNA, 20 bp, Homo sapiens
cagccaccctttctggcacg

SEQ ID NO: 5999210 - DNA, 16 bp, Homo sapiens
cagccacctaaacggt

SEQ ID NO: 5999211 - DNA, 23 bp, Homo sapiens
cagccacctccacccccaagaaa

SEQ ID NO: 5999212 - DNA, 12 bp, Homo sapiens
cagccacctccc

SEQ ID NO: 5999213 - DNA, 16 bp, Homo sapiens
cagccacctcccaagg

SEQ ID NO: 5999214 - DNA, 18 bp, Homo sapiens
cagccacctcccaaggac

SEQ ID NO: 5999215 - DNA, 14 bp, Homo sapiens
cagccaccttcctg

SEQ ID NO: 5999216 - DNA, 15 bp, Homo sapiens
cagccacgaacacgc

SEQ ID NO: 5999217 - DNA, 19 bp, Homo sapiens
cagccacgaacagcccgcc

SEQ ID NO: 5999218 - DNA, 20 bp, Homo sapiens
cagccacgaccagccccttc

SEQ ID NO: 5999219 - DNA, 15 bp, Homo sapiens
cagccacgactgcca

SEQ ID NO: 5999220 - DNA, 18 bp, Homo sapiens
cagccacgaggtgcaaca

SEQ ID NO: 5999221 - DNA, 22 bp, Homo sapiens
cagccacgaggtggtagctctg

SEQ ID NO: 5999222 - DNA, 15 bp, Homo sapiens
cagccacgattggag

SEQ ID NO: 5999223 - DNA, 14 bp, Homo sapiens
cagccacggaggga

SEQ ID NO: 5999224 - DNA, 17 bp, Homo sapiens
cagccacggagggaggc

SEQ ID NO: 5999225 - DNA, 15 bp, Homo sapiens
cagccacggccaggc

SEQ ID NO: 5999226 - DNA, 16 bp, Homo sapiens
cagccacggccaggcc

SEQ ID NO: 5999227 - DNA, 17 bp, Homo sapiens
cagccacggccaggcca

SEQ ID NO: 5999228 - DNA, 18 bp, Homo sapiens
cagccacggccaggccag

SEQ ID NO: 5999229 - DNA, 21 bp, Homo sapiens
cagccacggggactcagccct

SEQ ID NO: 5999230 - DNA, 21 bp, Homo sapiens
cagccactccaagccccctgg

SEQ ID NO: 5999231 - DNA, 16 bp, Homo sapiens
cagccactcccagggg

SEQ ID NO: 5999232 - DNA, 17 bp, Homo sapiens
cagccactccccagcca

SEQ ID NO: 5999233 - DNA, 21 bp, Homo sapiens
cagccactcgggaggctgaga

SEQ ID NO: 5999234 - DNA, 19 bp, Homo sapiens
cagccactgcagcacagga

SEQ ID NO: 5999235 - DNA, 22 bp, Homo sapiens
cagccactgccaagcttcctgt

SEQ ID NO: 5999236 - DNA, 12 bp, Homo sapiens
cagccactggct

SEQ ID NO: 5999237 - DNA, 18 bp, Homo sapiens
cagccactgtcaccgagc

SEQ ID NO: 5999238 - DNA, 22 bp, Homo sapiens
cagccacttggtttttggctct

SEQ ID NO: 5999239 - DNA, 22 bp, Homo sapiens
cagccagaaagcactacaatca

SEQ ID NO: 5999240 - DNA, 23 bp, Homo sapiens
cagccagaacgtggctctgctgg

SEQ ID NO: 5999241 - DNA, 12 bp, Homo sapiens
cagccagaactc

SEQ ID NO: 5999242 - DNA, 23 bp, Homo sapiens
cagccagaccagattaaacttca

SEQ ID NO: 5999243 - DNA, 16 bp, Homo sapiens
cagccagacccagagc

SEQ ID NO: 5999244 - DNA, 14 bp, Homo sapiens
cagccagactggca

SEQ ID NO: 5999245 - DNA, 15 bp, Homo sapiens
cagccagacttgctt

SEQ ID NO: 5999246 - DNA, 11 bp, Homo sapiens
cagccagagct

SEQ ID NO: 5999247 - DNA, 12 bp, Homo sapiens
cagccagagctg

SEQ ID NO: 5999248 - DNA, 16 bp, Homo sapiens
cagccagagctgtgcc

SEQ ID NO: 5999249 - DNA, 20 bp, Homo sapiens
cagccagagctgtgcctgct

SEQ ID NO: 5999250 - DNA, 22 bp, Homo sapiens
cagccagaggagggcagaggga

SEQ ID NO: 5999251 - DNA, 15 bp, Homo sapiens
cagccagagttcctg

SEQ ID NO: 5999252 - DNA, 20 bp, Homo sapiens
cagccagagttcctgcggag

SEQ ID NO: 5999253 - DNA, 21 bp, Homo sapiens
cagccagagttcctgcggagt

SEQ ID NO: 5999254 - DNA, 19 bp, Homo sapiens
cagccagagtttgcctccc

SEQ ID NO: 5999255 - DNA, 22 bp, Homo sapiens
cagccagagtttgcctccctgc

SEQ ID NO: 5999256 - DNA, 14 bp, Homo sapiens
cagccagatcccca

SEQ ID NO: 5999257 - DNA, 21 bp, Homo sapiens
cagccagatccccagggcagc

SEQ ID NO: 5999258 - DNA, 23 bp, Homo sapiens
cagccagcaatgatgtccagaag

SEQ ID NO: 5999259 - DNA, 12 bp, Homo sapiens
cagccagcacca

SEQ ID NO: 5999260 - DNA, 17 bp, Homo sapiens
cagccagcagcagccca

SEQ ID NO: 5999261 - DNA, 12 bp, Homo sapiens
cagccagcagcc

SEQ ID NO: 5999262 - DNA, 17 bp, Homo sapiens
cagccagcagccagctc

SEQ ID NO: 5999263 - DNA, 21 bp, Homo sapiens
cagccagcagccagctctcag

SEQ ID NO: 5999264 - DNA, 11 bp, Homo sapiens
cagccagcagg

SEQ ID NO: 5999265 - DNA, 19 bp, Homo sapiens
cagccagcaggttctctcc

SEQ ID NO: 5999266 - DNA, 14 bp, Homo sapiens
cagccagcagttca

SEQ ID NO: 5999267 - DNA, 15 bp, Homo sapiens
cagccagcagttcag

SEQ ID NO: 5999268 - DNA, 21 bp, Homo sapiens
cagccagcagttcagagctgc

SEQ ID NO: 5999269 - DNA, 13 bp, Homo sapiens
cagccagccaccc

SEQ ID NO: 5999270 - DNA, 15 bp, Homo sapiens
cagccagccacccct

SEQ ID NO: 5999271 - DNA, 13 bp, Homo sapiens
cagccagccactc

SEQ ID NO: 5999272 - DNA, 15 bp, Homo sapiens
cagccagccaggaac

SEQ ID NO: 5999273 - DNA, 14 bp, Homo sapiens
cagccagccagtct

SEQ ID NO: 5999274 - DNA, 22 bp, Homo sapiens
cagccagccatcggaagagagg

SEQ ID NO: 5999275 - DNA, 12 bp, Homo sapiens
cagccagcccag

SEQ ID NO: 5999276 - DNA, 17 bp, Homo sapiens
cagccagcccagcccag

SEQ ID NO: 5999277 - DNA, 21 bp, Homo sapiens
cagccagcccatggcccccaa

SEQ ID NO: 5999278 - DNA, 23 bp, Homo sapiens
cagccagcccatggcccccaata

SEQ ID NO: 5999279 - DNA, 11 bp, Homo sapiens
cagccagccct

SEQ ID NO: 5999280 - DNA, 14 bp, Homo sapiens
cagccagccctgcc

SEQ ID NO: 5999281 - DNA, 16 bp, Homo sapiens
cagccagccctgcctg

SEQ ID NO: 5999282 - DNA, 18 bp, Homo sapiens
cagccagccctgcctgga

SEQ ID NO: 5999283 - DNA, 21 bp, Homo sapiens
cagccagccctgcctggagga

SEQ ID NO: 5999284 - DNA, 13 bp, Homo sapiens
cagccagccctgg

SEQ ID NO: 5999285 - DNA, 14 bp, Homo sapiens
cagccagccctgga

SEQ ID NO: 5999286 - DNA, 18 bp, Homo sapiens
cagccagccctggcccac

SEQ ID NO: 5999287 - DNA, 21 bp, Homo sapiens
cagccagccctggcttccaag

SEQ ID NO: 5999288 - DNA, 14 bp, Homo sapiens
cagccagcccttcc

SEQ ID NO: 5999289 - DNA, 21 bp, Homo sapiens
cagccagcccttcccaggcca

SEQ ID NO: 5999290 - DNA, 22 bp, Homo sapiens
cagccagcccttccctggcccc

SEQ ID NO: 5999291 - DNA, 14 bp, Homo sapiens
cagccagccgtgag

SEQ ID NO: 5999292 - DNA, 14 bp, Homo sapiens
cagccagcctcaga

SEQ ID NO: 5999293 - DNA, 12 bp, Homo sapiens
cagccagcctcc

SEQ ID NO: 5999294 - DNA, 15 bp, Homo sapiens
cagccagcctggctg

SEQ ID NO: 5999295 - DNA, 17 bp, Homo sapiens
cagccagccttccccac

SEQ ID NO: 5999296 - DNA, 15 bp, Homo sapiens
cagccagcgcaggcc

SEQ ID NO: 5999297 - DNA, 22 bp, Homo sapiens
cagccagcgcaggccctggtgg

SEQ ID NO: 5999298 - DNA, 19 bp, Homo sapiens
cagccagcgcctccctcca

SEQ ID NO: 5999299 - DNA, 22 bp, Homo sapiens
cagccagcgcctccctccaccc

SEQ ID NO: 5999300 - DNA, 19 bp, Homo sapiens
cagccagcggcatatactt

SEQ ID NO: 5999301 - DNA, 18 bp, Homo sapiens
cagccagcgtcccttggt

SEQ ID NO: 5999302 - DNA, 21 bp, Homo sapiens
cagccagcgtcccttggtgag

SEQ ID NO: 5999303 - DNA, 12 bp, Homo sapiens
cagccagctcct

SEQ ID NO: 5999304 - DNA, 14 bp, Homo sapiens
cagccagctcctgg

SEQ ID NO: 5999305 - DNA, 20 bp, Homo sapiens
cagccagctcctgggcagct

SEQ ID NO: 5999306 - DNA, 15 bp, Homo sapiens
cagccagctcctggt

SEQ ID NO: 5999307 - DNA, 14 bp, Homo sapiens
cagccagctccttt

SEQ ID NO: 5999308 - DNA, 15 bp, Homo sapiens
cagccagctgcaggg

SEQ ID NO: 5999309 - DNA, 20 bp, Homo sapiens
cagccagctgcagggcacgg

SEQ ID NO: 5999310 - DNA, 22 bp, Homo sapiens
cagccagctgcccacaagccat

SEQ ID NO: 5999311 - DNA, 15 bp, Homo sapiens
cagccagctgcccta

SEQ ID NO: 5999312 - DNA, 13 bp, Homo sapiens
cagccaggacccg

SEQ ID NO: 5999313 - DNA, 20 bp, Homo sapiens
cagccaggacccgcctgctc

SEQ ID NO: 5999314 - DNA, 15 bp, Homo sapiens
cagccaggactcctt

SEQ ID NO: 5999315 - DNA, 15 bp, Homo sapiens
cagccaggagagctt

SEQ ID NO: 5999316 - DNA, 23 bp, Homo sapiens
cagccaggagagcttagggtctc

SEQ ID NO: 5999317 - DNA, 22 bp, Homo sapiens
cagccaggagcagatggacagc

SEQ ID NO: 5999318 - DNA, 14 bp, Homo sapiens
cagccaggagctgg

SEQ ID NO: 5999319 - DNA, 12 bp, Homo sapiens
cagccaggaggg

SEQ ID NO: 5999320 - DNA, 20 bp, Homo sapiens
cagccaggcaagaaagcttc

SEQ ID NO: 5999321 - DNA, 21 bp, Homo sapiens
cagccaggcagaggttttaat

SEQ ID NO: 5999322 - DNA, 13 bp, Homo sapiens
cagccaggccaca

SEQ ID NO: 5999323 - DNA, 12 bp, Homo sapiens
cagccaggccca

SEQ ID NO: 5999324 - DNA, 17 bp, Homo sapiens
cagccaggcccagccga

SEQ ID NO: 5999325 - DNA, 21 bp, Homo sapiens
caccccgaagggagcatctgt

SEQ ID NO: 5999326 - DNA, 17 bp, Homo sapiens
caccccgaggccctgca

SEQ ID NO: 5999327 - DNA, 13 bp, Homo sapiens
caccccgccagcc

SEQ ID NO: 5999328 - DNA, 15 bp, Homo sapiens
caccccgcccctgca

SEQ ID NO: 5999329 - DNA, 14 bp, Homo sapiens
caccccgccggagg

SEQ ID NO: 5999330 - DNA, 19 bp, Homo sapiens
caccccgccggaggaaggt

SEQ ID NO: 5999331 - DNA, 14 bp, Homo sapiens
caccccgccgttcc

SEQ ID NO: 5999332 - DNA, 16 bp, Homo sapiens
caccccgccgttccct

SEQ ID NO: 5999333 - DNA, 19 bp, Homo sapiens
caccccgcctgccctccca

SEQ ID NO: 5999334 - DNA, 15 bp, Homo sapiens
caccccgcctgcctc

SEQ ID NO: 5999335 - DNA, 18 bp, Homo sapiens
caccccgcctgcctcctg

SEQ ID NO: 5999336 - DNA, 14 bp, Homo sapiens
caccccgccttggc

SEQ ID NO: 5999337 - DNA, 14 bp, Homo sapiens
caccccgctctgca

SEQ ID NO: 5999338 - DNA, 14 bp, Homo sapiens
caccccgctctggc

SEQ ID NO: 5999339 - DNA, 14 bp, Homo sapiens
caccccgctgcctg

SEQ ID NO: 5999340 - DNA, 17 bp, Homo sapiens
caccccgctgcctggcg

SEQ ID NO: 5999341 - DNA, 15 bp, Homo sapiens
caccccggcaggccc

SEQ ID NO: 5999342 - DNA, 12 bp, Homo sapiens
caccccggcctc

SEQ ID NO: 5999343 - DNA, 19 bp, Homo sapiens
caccccggcctcagggcgc

SEQ ID NO: 5999344 - DNA, 22 bp, Homo sapiens
caccccggctccccctgccagc

SEQ ID NO: 5999345 - DNA, 15 bp, Homo sapiens
caccccgtctgcccc

SEQ ID NO: 5999346 - DNA, 22 bp, Homo sapiens
caccccgtctggggttcagccc

SEQ ID NO: 5999347 - DNA, 15 bp, Homo sapiens
caccccgtgcccctg

SEQ ID NO: 5999348 - DNA, 15 bp, Homo sapiens
caccccgttgttgtc

SEQ ID NO: 5999349 - DNA, 15 bp, Homo sapiens
cacccctaaagagat

SEQ ID NO: 5999350 - DNA, 15 bp, Homo sapiens
cacccctaagtgccc

SEQ ID NO: 5999351 - DNA, 13 bp, Homo sapiens
cacccctacacac

SEQ ID NO: 5999352 - DNA, 20 bp, Homo sapiens
cacccctacagcctgcacac

SEQ ID NO: 5999353 - DNA, 19 bp, Homo sapiens
cacccctagccaccagtgt

SEQ ID NO: 5999354 - DNA, 17 bp, Homo sapiens
cacccctagccctggtt

SEQ ID NO: 5999355 - DNA, 16 bp, Homo sapiens
cacccctcactcccca

SEQ ID NO: 5999356 - DNA, 19 bp, Homo sapiens
cacccctcactccccaggg

SEQ ID NO: 5999357 - DNA, 20 bp, Homo sapiens
cacccctcagcgctccctgt

SEQ ID NO: 5999358 - DNA, 13 bp, Homo sapiens
cacccctccagga

SEQ ID NO: 5999359 - DNA, 14 bp, Homo sapiens
cacccctccccact

SEQ ID NO: 5999360 - DNA, 18 bp, Homo sapiens
cacccctcccctgggact

SEQ ID NO: 5999361 - DNA, 15 bp, Homo sapiens
cacccctccctttct

SEQ ID NO: 5999362 - DNA, 12 bp, Homo sapiens
cacccctcctcc

SEQ ID NO: 5999363 - DNA, 13 bp, Homo sapiens
cacccctcctcct

SEQ ID NO: 5999364 - DNA, 14 bp, Homo sapiens
cacccctcctcctt

SEQ ID NO: 5999365 - DNA, 18 bp, Homo sapiens
cacccctcctccttgctg

SEQ ID NO: 5999366 - DNA, 14 bp, Homo sapiens
cacccctcctctag

SEQ ID NO: 5999367 - DNA, 21 bp, Homo sapiens
cacccctcctctagctctggt

SEQ ID NO: 5999368 - DNA, 21 bp, Homo sapiens
cacccctcctgggcccaggca

SEQ ID NO: 5999369 - DNA, 12 bp, Homo sapiens
cacccctccttc

SEQ ID NO: 5999370 - DNA, 14 bp, Homo sapiens
cacccctccttccc

SEQ ID NO: 5999371 - DNA, 19 bp, Homo sapiens
cacccctccttccctggtc

SEQ ID NO: 5999372 - DNA, 20 bp, Homo sapiens
cacccctccttccctggtcc

SEQ ID NO: 5999373 - DNA, 14 bp, Homo sapiens
cacccctccttcct

SEQ ID NO: 5999374 - DNA, 21 bp, Homo sapiens
cacccctctgcccctgcagct

SEQ ID NO: 5999375 - DNA, 13 bp, Homo sapiens
cacccctcttccc

SEQ ID NO: 5999376 - DNA, 16 bp, Homo sapiens
cacccctcttccccct

SEQ ID NO: 5999377 - DNA, 12 bp, Homo sapiens
cacccctcttct

SEQ ID NO: 5999378 - DNA, 18 bp, Homo sapiens
cacccctcttctgctcct

SEQ ID NO: 5999379 - DNA, 19 bp, Homo sapiens
cacccctgcacacacctgc

SEQ ID NO: 5999380 - DNA, 15 bp, Homo sapiens
cacccctgccactca

SEQ ID NO: 5999381 - DNA, 18 bp, Homo sapiens
cacccctgccactcaccc

SEQ ID NO: 5999382 - DNA, 11 bp, Homo sapiens
cacccctgccc

SEQ ID NO: 5999383 - DNA, 13 bp, Homo sapiens
cacccctgcccct

SEQ ID NO: 5999384 - DNA, 14 bp, Homo sapiens
cacccctgcccctg

SEQ ID NO: 5999385 - DNA, 16 bp, Homo sapiens
cacccctgccctggga

SEQ ID NO: 5999386 - DNA, 11 bp, Homo sapiens
cacccctgcct

SEQ ID NO: 5999387 - DNA, 14 bp, Homo sapiens
cacccctgcctcca

SEQ ID NO: 5999388 - DNA, 15 bp, Homo sapiens
cacccctgcctccac

SEQ ID NO: 5999389 - DNA, 20 bp, Homo sapiens
cacccctgcctccaccctct

SEQ ID NO: 5999390 - DNA, 16 bp, Homo sapiens
cacccctgcctcctgc

SEQ ID NO: 5999391 - DNA, 18 bp, Homo sapiens
cacccctgcctcctgcct

SEQ ID NO: 5999392 - DNA, 20 bp, Homo sapiens
cacccctgcctcctgcctcc

SEQ ID NO: 5999393 - DNA, 18 bp, Homo sapiens
cacccctggaagagccca

SEQ ID NO: 5999394 - DNA, 19 bp, Homo sapiens
cacccctggaagagcccag

SEQ ID NO: 5999395 - DNA, 22 bp, Homo sapiens
cacccctggctaccttgtggga

SEQ ID NO: 5999396 - DNA, 12 bp, Homo sapiens
cacccctgggca

SEQ ID NO: 5999397 - DNA, 22 bp, Homo sapiens
cacccctgggccagcggggctg

SEQ ID NO: 5999398 - DNA, 23 bp, Homo sapiens
cacccctggggctgagtctccag

SEQ ID NO: 5999399 - DNA, 20 bp, Homo sapiens
cacccctggtggctgcaggc

SEQ ID NO: 5999400 - DNA, 22 bp, Homo sapiens
cacccctggtgtccctgcctgg

SEQ ID NO: 5999401 - DNA, 11 bp, Homo sapiens
cacccctgtac

SEQ ID NO: 5999402 - DNA, 19 bp, Homo sapiens
cacccctgtacccagccac

SEQ ID NO: 5999403 - DNA, 16 bp, Homo sapiens
cacccctgtccagatt

SEQ ID NO: 5999404 - DNA, 17 bp, Homo sapiens
cacccctgtcctcactg

SEQ ID NO: 5999405 - DNA, 23 bp, Homo sapiens
cacccctgtcctcactgctccct

SEQ ID NO: 5999406 - DNA, 12 bp, Homo sapiens
cacccctgtgcg

SEQ ID NO: 5999407 - DNA, 17 bp, Homo sapiens
cacccctgtgctccgtg

SEQ ID NO: 5999408 - DNA, 19 bp, Homo sapiens
caccccttatccaggactc

SEQ ID NO: 5999409 - DNA, 14 bp, Homo sapiens
caccccttccatgt

SEQ ID NO: 5999410 - DNA, 16 bp, Homo sapiens
caccccttccatgtgg

SEQ ID NO: 5999411 - DNA, 11 bp, Homo sapiens
caccccttccc

SEQ ID NO: 5999412 - DNA, 14 bp, Homo sapiens
caccccttccccac

SEQ ID NO: 5999413 - DNA, 18 bp, Homo sapiens
caccccttccccactgcc

SEQ ID NO: 5999414 - DNA, 14 bp, Homo sapiens
caccccttccctat

SEQ ID NO: 5999415 - DNA, 11 bp, Homo sapiens
caccccttcct

SEQ ID NO: 5999416 - DNA, 12 bp, Homo sapiens
caccccttcctc

SEQ ID NO: 5999417 - DNA, 17 bp, Homo sapiens
caccccttcctcagcct

SEQ ID NO: 5999418 - DNA, 19 bp, Homo sapiens
caccccttcctcagcctgg

SEQ ID NO: 5999419 - DNA, 13 bp, Homo sapiens
caccccttcctcc

SEQ ID NO: 5999420 - DNA, 15 bp, Homo sapiens
caccccttcctgtct

SEQ ID NO: 5999421 - DNA, 21 bp, Homo sapiens
caccccttcgacatgctgcca

SEQ ID NO: 5999422 - DNA, 18 bp, Homo sapiens
caccccttctctcctccc

SEQ ID NO: 5999423 - DNA, 21 bp, Homo sapiens
caccccttctctcctccccaa

SEQ ID NO: 5999424 - DNA, 18 bp, Homo sapiens
caccccttgaagcctttt

SEQ ID NO: 5999425 - DNA, 13 bp, Homo sapiens
caccccttgccca

SEQ ID NO: 5999426 - DNA, 15 bp, Homo sapiens
caccccttgtttctg

SEQ ID NO: 5999427 - DNA, 18 bp, Homo sapiens
cacccctttcctccccat

SEQ ID NO: 5999428 - DNA, 22 bp, Homo sapiens
cacccctttcctccccatacac

SEQ ID NO: 5999429 - DNA, 23 bp, Homo sapiens
cacccctttcctccccatacaca

SEQ ID NO: 5999430 - DNA, 22 bp, Homo sapiens
cacccctttctagttcaatgcc

SEQ ID NO: 5999431 - DNA, 16 bp, Homo sapiens
cacccctttctgtccc

SEQ ID NO: 5999432 - DNA, 21 bp, Homo sapiens
cacccgaagcgcttctgcacc

SEQ ID NO: 5999433 - DNA, 18 bp, Homo sapiens
cacccgaagtcctgtcac

SEQ ID NO: 5999434 - DNA, 20 bp, Homo sapiens
cacccgacaccagccctgct

SEQ ID NO: 5999435 - DNA, 13 bp, Homo sapiens
cacccgaccacac

SEQ ID NO: 5999436 - DNA, 20 bp, Homo sapiens
cacccgacctctgactgatg

SEQ ID NO: 5999437 - DNA, 14 bp, Homo sapiens
cacccgacctggct

SEQ ID NO: 5999438 - DNA, 19 bp, Homo sapiens
cacccgacctggctgcccc

SEQ ID NO: 5999439 - DNA, 14 bp, Homo sapiens
cacccgactccagt

SEQ ID NO: 5999440 - DNA, 22 bp, Homo sapiens
cacccgaggggggccccgggac

SEQ ID NO: 5999441 - DNA, 18 bp, Homo sapiens
cacccgagttcctctggg

SEQ ID NO: 5999442 - DNA, 15 bp, Homo sapiens
cacccgatgctgctt

SEQ ID NO: 5999443 - DNA, 16 bp, Homo sapiens
cacccgcccacccgcc

SEQ ID NO: 5999444 - DNA, 20 bp, Homo sapiens
cacccgcccacccgccttgt

SEQ ID NO: 5999445 - DNA, 14 bp, Homo sapiens
cacccgccccagag

SEQ ID NO: 5999446 - DNA, 21 bp, Homo sapiens
cacccgccccgcgcaccccac

SEQ ID NO: 5999447 - DNA, 16 bp, Homo sapiens
cacccgcccctggact

SEQ ID NO: 5999448 - DNA, 14 bp, Homo sapiens
cacccgcccgcccc

SEQ ID NO: 5999449 - DNA, 17 bp, Homo sapiens
cacccgcccgcccccgc

SEQ ID NO: 5999450 - DNA, 18 bp, Homo sapiens
cacccgcccgcccccgcc

SEQ ID NO: 5999451 - DNA, 20 bp, Homo sapiens
cacccgccctgcccttccct

SEQ ID NO: 5999452 - DNA, 22 bp, Homo sapiens
cacccgccgcctcccacggcac

SEQ ID NO: 5999453 - DNA, 14 bp, Homo sapiens
cacccgcctctccc

SEQ ID NO: 5999454 - DNA, 13 bp, Homo sapiens
cacccgcctgcag

SEQ ID NO: 5999455 - DNA, 18 bp, Homo sapiens
cacccgccttggcctccc

SEQ ID NO: 5999456 - DNA, 13 bp, Homo sapiens
cacccgccttgtg

SEQ ID NO: 5999457 - DNA, 16 bp, Homo sapiens
cacccgccttttataa

SEQ ID NO: 5999458 - DNA, 14 bp, Homo sapiens
cacccgctgcccct

SEQ ID NO: 5999459 - DNA, 12 bp, Homo sapiens
cacccggaaaga

SEQ ID NO: 5999460 - DNA, 21 bp, Homo sapiens
cacccggatagaggacacgga

SEQ ID NO: 5999461 - DNA, 15 bp, Homo sapiens
cacccggatctccag

SEQ ID NO: 5999462 - DNA, 16 bp, Homo sapiens
cacccggatctccagg

SEQ ID NO: 5999463 - DNA, 19 bp, Homo sapiens
cacccggatctccaggccc

SEQ ID NO: 5999464 - DNA, 21 bp, Homo sapiens
cacccggatctccaggcccag

SEQ ID NO: 5999465 - DNA, 17 bp, Homo sapiens
cacccggcaaggggcgc

SEQ ID NO: 5999466 - DNA, 21 bp, Homo sapiens
cacccggcattctctgcccac

SEQ ID NO: 5999467 - DNA, 12 bp, Homo sapiens
cacccggcccct

SEQ ID NO: 5999468 - DNA, 18 bp, Homo sapiens
cacccggcccctgctggt

SEQ ID NO: 5999469 - DNA, 21 bp, Homo sapiens
cacccggcccctgctggttca

SEQ ID NO: 5999470 - DNA, 15 bp, Homo sapiens
cacccggctccccct

SEQ ID NO: 5999471 - DNA, 23 bp, Homo sapiens
cacccgggctcagggaccacagc

SEQ ID NO: 5999472 - DNA, 15 bp, Homo sapiens
cacccgggctgcctg

SEQ ID NO: 5999473 - DNA, 19 bp, Homo sapiens
cacccgggggagcccagtg

SEQ ID NO: 5999474 - DNA, 23 bp, Homo sapiens
cacccgtacccccgtggtctttg

SEQ ID NO: 5999475 - DNA, 16 bp, Homo sapiens
cacccgtaggcagcct

SEQ ID NO: 5999476 - DNA, 15 bp, Homo sapiens
cacccgtcctccctc

SEQ ID NO: 5999477 - DNA, 19 bp, Homo sapiens
cacccgtcctccctcagcc

SEQ ID NO: 5999478 - DNA, 20 bp, Homo sapiens
cacccgtcttcaatctctgt

SEQ ID NO: 5999479 - DNA, 20 bp, Homo sapiens
cacccgtcttggggctcgcc

SEQ ID NO: 5999480 - DNA, 18 bp, Homo sapiens
cacccgtgagcgcctgtg

SEQ ID NO: 5999481 - DNA, 18 bp, Homo sapiens
cacccgtgccacgcgctc

SEQ ID NO: 5999482 - DNA, 23 bp, Homo sapiens
cacccgtgccacgcgctctgcat

SEQ ID NO: 5999483 - DNA, 17 bp, Homo sapiens
cacccgtggagatggga

SEQ ID NO: 5999484 - DNA, 18 bp, Homo sapiens
cacccgtggggtgctgcc

SEQ ID NO: 5999485 - DNA, 17 bp, Homo sapiens
cacccgtggtggctcaa

SEQ ID NO: 5999486 - DNA, 17 bp, Homo sapiens
cacccgtgttctcctcc

SEQ ID NO: 5999487 - DNA, 16 bp, Homo sapiens
cacccgttaatttaaa

SEQ ID NO: 5999488 - DNA, 18 bp, Homo sapiens
cacccgttctgctggcct

SEQ ID NO: 5999489 - DNA, 19 bp, Homo sapiens
cacccgtttccaagcctgg

SEQ ID NO: 5999490 - DNA, 22 bp, Homo sapiens
cacccgtttccaagcctgggcc

SEQ ID NO: 5999491 - DNA, 15 bp, Homo sapiens
caccctaaaatgaca

SEQ ID NO: 5999492 - DNA, 18 bp, Homo sapiens
caccctaaagcaggctga

SEQ ID NO: 5999493 - DNA, 17 bp, Homo sapiens
caccctaactcttgctc

SEQ ID NO: 5999494 - DNA, 19 bp, Homo sapiens
caccctaactcttgctcac

SEQ ID NO: 5999495 - DNA, 18 bp, Homo sapiens
caccctaactgagctgcc

SEQ ID NO: 5999496 - DNA, 21 bp, Homo sapiens
caccctaactgagctgccagt

SEQ ID NO: 5999497 - DNA, 20 bp, Homo sapiens
caccctaagggcagccctcc

SEQ ID NO: 5999498 - DNA, 20 bp, Homo sapiens
caccctaatgtggcagctgt

SEQ ID NO: 5999499 - DNA, 22 bp, Homo sapiens
caccctacaagttgatcatgca

SEQ ID NO: 5999500 - DNA, 15 bp, Homo sapiens
caccctaccagctcc

SEQ ID NO: 5999501 - DNA, 19 bp, Homo sapiens
caccctaccagctcctcca

SEQ ID NO: 5999502 - DNA, 12 bp, Homo sapiens
caccctacctgt

SEQ ID NO: 5999503 - DNA, 13 bp, Homo sapiens
caccctaccttcc

SEQ ID NO: 5999504 - DNA, 17 bp, Homo sapiens
caccctaccttccccag

SEQ ID NO: 5999505 - DNA, 17 bp, Homo sapiens
caccctaggcagcctgc

SEQ ID NO: 5999506 - DNA, 15 bp, Homo sapiens
cagccaggcccaggc

SEQ ID NO: 5999507 - DNA, 18 bp, Homo sapiens
cagccaggcccaggccag

SEQ ID NO: 5999508 - DNA, 19 bp, Homo sapiens
cagccaggcccaggccagc

SEQ ID NO: 5999509 - DNA, 22 bp, Homo sapiens
cagccaggcccaggccagcccc

SEQ ID NO: 5999510 - DNA, 14 bp, Homo sapiens
cagccaggcgggct

SEQ ID NO: 5999511 - DNA, 23 bp, Homo sapiens
cagccaggctatggttgccaccc

SEQ ID NO: 5999512 - DNA, 24 bp, Homo sapiens
cagccaggctcctacctgtctgct

SEQ ID NO: 5999513 - DNA, 15 bp, Homo sapiens
cagccaggctctgtg

SEQ ID NO: 5999514 - DNA, 16 bp, Homo sapiens
cagccaggctctgtgc

SEQ ID NO: 5999515 - DNA, 22 bp, Homo sapiens
cagccaggctctgtgctgaccc

SEQ ID NO: 5999516 - DNA, 23 bp, Homo sapiens
cagccaggctgctaacctggaaa

SEQ ID NO: 5999517 - DNA, 12 bp, Homo sapiens
cagccagggacc

SEQ ID NO: 5999518 - DNA, 20 bp, Homo sapiens
cagccagggagagcccagga

SEQ ID NO: 5999519 - DNA, 21 bp, Homo sapiens
cagccagggagcccggggcag

SEQ ID NO: 5999520 - DNA, 19 bp, Homo sapiens
cagccagggagcttgccac

SEQ ID NO: 5999521 - DNA, 11 bp, Homo sapiens
cagccagggcc

SEQ ID NO: 5999522 - DNA, 15 bp, Homo sapiens
cagccagggccaggg

SEQ ID NO: 5999523 - DNA, 16 bp, Homo sapiens
cagccagggcctgcga

SEQ ID NO: 5999524 - DNA, 21 bp, Homo sapiens
cagccagggcctgcgagggca

SEQ ID NO: 5999525 - DNA, 22 bp, Homo sapiens
cagccagggcctgcgagggcag

SEQ ID NO: 5999526 - DNA, 16 bp, Homo sapiens
cagccagggctcaatc

SEQ ID NO: 5999527 - DNA, 13 bp, Homo sapiens
cagccagggctgg

SEQ ID NO: 5999528 - DNA, 15 bp, Homo sapiens
cagccagggctgggg

SEQ ID NO: 5999529 - DNA, 17 bp, Homo sapiens
cagccaggggagcagag

SEQ ID NO: 5999530 - DNA, 23 bp, Homo sapiens
cagccaggggagcagaggggcag

SEQ ID NO: 5999531 - DNA, 22 bp, Homo sapiens
cagccaggggtccagcacagcc

SEQ ID NO: 5999532 - DNA, 12 bp, Homo sapiens
cagccaggtctg

SEQ ID NO: 5999533 - DNA, 20 bp, Homo sapiens
cagccaggtctgactccaaa

SEQ ID NO: 5999534 - DNA, 15 bp, Homo sapiens
cagccaggtgccttg

SEQ ID NO: 5999535 - DNA, 19 bp, Homo sapiens
cagccaggtgctgtgacac

SEQ ID NO: 5999536 - DNA, 16 bp, Homo sapiens
cagccaggtggcacct

SEQ ID NO: 5999537 - DNA, 18 bp, Homo sapiens
cagccaggtggcacctgc

SEQ ID NO: 5999538 - DNA, 19 bp, Homo sapiens
cagccaggtggcacctgca

SEQ ID NO: 5999539 - DNA, 20 bp, Homo sapiens
cagccaggtggcacctgcag

SEQ ID NO: 5999540 - DNA, 22 bp, Homo sapiens
cagccagtaaatgggggtgcat

SEQ ID NO: 5999541 - DNA, 23 bp, Homo sapiens
cagccagtaaggcagctctgtcg

SEQ ID NO: 5999542 - DNA, 16 bp, Homo sapiens
cagccagtcaggcagg

SEQ ID NO: 5999543 - DNA, 22 bp, Homo sapiens
cagccagtcccgtttcatttag

SEQ ID NO: 5999544 - DNA, 21 bp, Homo sapiens
cagccagtctcagagaccagc

SEQ ID NO: 5999545 - DNA, 22 bp, Homo sapiens
cagccagtctcagagaccagca

SEQ ID NO: 5999546 - DNA, 19 bp, Homo sapiens
cagccagtcttgcctaggc

SEQ ID NO: 5999547 - DNA, 21 bp, Homo sapiens
cagccagtgacctgaggaagc

SEQ ID NO: 5999548 - DNA, 18 bp, Homo sapiens
cagccagtgccctgagcc

SEQ ID NO: 5999549 - DNA, 17 bp, Homo sapiens
cagccagtggcacagga

SEQ ID NO: 5999550 - DNA, 18 bp, Homo sapiens
cagccagtgtgaccggcg

SEQ ID NO: 5999551 - DNA, 20 bp, Homo sapiens
cagccagttggtggggccag

SEQ ID NO: 5999552 - DNA, 17 bp, Homo sapiens
cagccagtttagagaaa

SEQ ID NO: 5999553 - DNA, 22 bp, Homo sapiens
cagccataaaagcattgtctct

SEQ ID NO: 5999554 - DNA, 20 bp, Homo sapiens
cagccatacttatctctctg

SEQ ID NO: 5999555 - DNA, 21 bp, Homo sapiens
cagccatacttccagcgaaat

SEQ ID NO: 5999556 - DNA, 18 bp, Homo sapiens
cagccataggccctttca

SEQ ID NO: 5999557 - DNA, 20 bp, Homo sapiens
cagccataggccctttcagt

SEQ ID NO: 5999558 - DNA, 13 bp, Homo sapiens
cagccatcaaaat

SEQ ID NO: 5999559 - DNA, 20 bp, Homo sapiens
cagccatcacaaggggaacg

SEQ ID NO: 5999560 - DNA, 19 bp, Homo sapiens
cagccatcaccttagacca

SEQ ID NO: 5999561 - DNA, 18 bp, Homo sapiens
cagccatcataggaaggg

SEQ ID NO: 5999562 - DNA, 18 bp, Homo sapiens
cagccatcccgcttagcc

SEQ ID NO: 5999563 - DNA, 16 bp, Homo sapiens
cagccatcggaagaga

SEQ ID NO: 5999564 - DNA, 15 bp, Homo sapiens
cagccatcgtcctgg

SEQ ID NO: 5999565 - DNA, 16 bp, Homo sapiens
cagccatctgcccagg

SEQ ID NO: 5999566 - DNA, 23 bp, Homo sapiens
cagccatgagaacaaaacctctt

SEQ ID NO: 5999567 - DNA, 18 bp, Homo sapiens
cagccatgaggagttgct

SEQ ID NO: 5999568 - DNA, 22 bp, Homo sapiens
cagccatgaggagttgctgttt

SEQ ID NO: 5999569 - DNA, 16 bp, Homo sapiens
cagccatgccagctgg

SEQ ID NO: 5999570 - DNA, 17 bp, Homo sapiens
cagccatgccagctggc

SEQ ID NO: 5999571 - DNA, 21 bp, Homo sapiens
cagccatgccagctggccttt

SEQ ID NO: 5999572 - DNA, 17 bp, Homo sapiens
cagccatgcccacgccc

SEQ ID NO: 5999573 - DNA, 15 bp, Homo sapiens
cagccatgcccagga

SEQ ID NO: 5999574 - DNA, 11 bp, Homo sapiens
cagccatgcct

SEQ ID NO: 5999575 - DNA, 17 bp, Homo sapiens
cagccatgcctcatgcc

SEQ ID NO: 5999576 - DNA, 23 bp, Homo sapiens
cagccatgcgcgcgctctctctc

SEQ ID NO: 5999577 - DNA, 14 bp, Homo sapiens
cagccatgggccct

SEQ ID NO: 5999578 - DNA, 19 bp, Homo sapiens
cagccatgtacagacagag

SEQ ID NO: 5999579 - DNA, 15 bp, Homo sapiens
cagccatgtccaagt

SEQ ID NO: 5999580 - DNA, 12 bp, Homo sapiens
cagccattaaaa

SEQ ID NO: 5999581 - DNA, 16 bp, Homo sapiens
cagccattaaaataaa

SEQ ID NO: 5999582 - DNA, 21 bp, Homo sapiens
cagccattaaaataaaacaag

SEQ ID NO: 5999583 - DNA, 23 bp, Homo sapiens
cagccattacccagctaaataat

SEQ ID NO: 5999584 - DNA, 15 bp, Homo sapiens
cagccattcacaaca

SEQ ID NO: 5999585 - DNA, 19 bp, Homo sapiens
cagccattcactgccccca

SEQ ID NO: 5999586 - DNA, 20 bp, Homo sapiens
cagccattcatctgggctgg

SEQ ID NO: 5999587 - DNA, 20 bp, Homo sapiens
cagccattcctgttctcttt

SEQ ID NO: 5999588 - DNA, 16 bp, Homo sapiens
cagccattctctaccc

SEQ ID NO: 5999589 - DNA, 21 bp, Homo sapiens
cagccattctctacccatcct

SEQ ID NO: 5999590 - DNA, 14 bp, Homo sapiens
cagccattcttcag

SEQ ID NO: 5999591 - DNA, 16 bp, Homo sapiens
cagccattcttcaggt

SEQ ID NO: 5999592 - DNA, 17 bp, Homo sapiens
cagccattcttcaggtc

SEQ ID NO: 5999593 - DNA, 21 bp, Homo sapiens
cagccattgcacccagcccag

SEQ ID NO: 5999594 - DNA, 22 bp, Homo sapiens
cagccattgcacccagcccaga

SEQ ID NO: 5999595 - DNA, 23 bp, Homo sapiens
cagccattgcggccccaggaggg

SEQ ID NO: 5999596 - DNA, 20 bp, Homo sapiens
cagccattggctatttaaaa

SEQ ID NO: 5999597 - DNA, 18 bp, Homo sapiens
cagccattgtaatttgaa

SEQ ID NO: 5999598 - DNA, 22 bp, Homo sapiens
cagccatttccccctcctcaga

SEQ ID NO: 5999599 - DNA, 14 bp, Homo sapiens
cagccattttccaa

SEQ ID NO: 5999600 - DNA, 21 bp, Homo sapiens
cagccatttttcaatttttct

SEQ ID NO: 5999601 - DNA, 18 bp, Homo sapiens
cagccatttttcagtagc

SEQ ID NO: 5999602 - DNA, 23 bp, Homo sapiens
cagccatttttcagtagcaggac

SEQ ID NO: 5999603 - DNA, 19 bp, Homo sapiens
cagcccaaaacccagggca

SEQ ID NO: 5999604 - DNA, 20 bp, Homo sapiens
cagcccaaaacccagggcaa

SEQ ID NO: 5999605 - DNA, 21 bp, Homo sapiens
cagcccaaaccaccagaagcc

SEQ ID NO: 5999606 - DNA, 22 bp, Homo sapiens
cagcccaaacctgggaaggcca

SEQ ID NO: 5999607 - DNA, 23 bp, Homo sapiens
cagcccaaacctgggaaggccag

SEQ ID NO: 5999608 - DNA, 17 bp, Homo sapiens
cagcccaaagaaggaaa

SEQ ID NO: 5999609 - DNA, 21 bp, Homo sapiens
cagcccaaagctgcaggtgcc

SEQ ID NO: 5999610 - DNA, 22 bp, Homo sapiens
cagcccaaagctggagccaatg

SEQ ID NO: 5999611 - DNA, 21 bp, Homo sapiens
cagcccaaaggggacaggcct

SEQ ID NO: 5999612 - DNA, 13 bp, Homo sapiens
cagcccaacagca

SEQ ID NO: 5999613 - DNA, 14 bp, Homo sapiens
cagcccaacagcac

SEQ ID NO: 5999614 - DNA, 16 bp, Homo sapiens
cagcccaacagcactt

SEQ ID NO: 5999615 - DNA, 17 bp, Homo sapiens
cagcccaacagcacttt

SEQ ID NO: 5999616 - DNA, 13 bp, Homo sapiens
cagcccaaccagg

SEQ ID NO: 5999617 - DNA, 14 bp, Homo sapiens
cagcccaaccagga

SEQ ID NO: 5999618 - DNA, 18 bp, Homo sapiens
cagcccaaccaggagggg

SEQ ID NO: 5999619 - DNA, 21 bp, Homo sapiens
cagcccaaccgggaaaggcat

SEQ ID NO: 5999620 - DNA, 15 bp, Homo sapiens
cagcccaagcagagt

SEQ ID NO: 5999621 - DNA, 13 bp, Homo sapiens
cagcccaaggaca

SEQ ID NO: 5999622 - DNA, 19 bp, Homo sapiens
cagcccaagtgaggcagcc

SEQ ID NO: 5999623 - DNA, 10 bp, Homo sapiens
cagcccaata

SEQ ID NO: 5999624 - DNA, 14 bp, Homo sapiens
cagcccaataaagg

SEQ ID NO: 5999625 - DNA, 17 bp, Homo sapiens
cagcccaatccaggtac

SEQ ID NO: 5999626 - DNA, 11 bp, Homo sapiens
cagcccacacc

SEQ ID NO: 5999627 - DNA, 17 bp, Homo sapiens
cagcccacacccctcca

SEQ ID NO: 5999628 - DNA, 16 bp, Homo sapiens
cagcccacagagcctg

SEQ ID NO: 5999629 - DNA, 12 bp, Homo sapiens
cagcccacagtg

SEQ ID NO: 5999630 - DNA, 17 bp, Homo sapiens
cagcccacagtgctcag

SEQ ID NO: 5999631 - DNA, 15 bp, Homo sapiens
cagcccaccaccctg

SEQ ID NO: 5999632 - DNA, 18 bp, Homo sapiens
cagcccaccaccctggca

SEQ ID NO: 5999633 - DNA, 13 bp, Homo sapiens
cagcccaccagga

SEQ ID NO: 5999634 - DNA, 16 bp, Homo sapiens
cagcccacccccctca

SEQ ID NO: 5999635 - DNA, 17 bp, Homo sapiens
cagcccacccccctcat

SEQ ID NO: 5999636 - DNA, 23 bp, Homo sapiens
cagcccaccccctttgactctgg

SEQ ID NO: 5999637 - DNA, 11 bp, Homo sapiens
cagcccaccct

SEQ ID NO: 5999638 - DNA, 17 bp, Homo sapiens
cagcccaccctcctgtc

SEQ ID NO: 5999639 - DNA, 21 bp, Homo sapiens
cagcccaccctcctgtcttcc

SEQ ID NO: 5999640 - DNA, 22 bp, Homo sapiens
cagcccaccctcctgtcttccc

SEQ ID NO: 5999641 - DNA, 16 bp, Homo sapiens
cagcccaccctctgtg

SEQ ID NO: 5999642 - DNA, 15 bp, Homo sapiens
cagcccacctgcacc

SEQ ID NO: 5999643 - DNA, 15 bp, Homo sapiens
cagcccacctgctcc

SEQ ID NO: 5999644 - DNA, 16 bp, Homo sapiens
cagcccacctgctccc

SEQ ID NO: 5999645 - DNA, 18 bp, Homo sapiens
cagcccacctgctcccag

SEQ ID NO: 5999646 - DNA, 15 bp, Homo sapiens
cagcccacctgctgc

SEQ ID NO: 5999647 - DNA, 23 bp, Homo sapiens
cagcccacctgctgcccgtgagg

SEQ ID NO: 5999648 - DNA, 22 bp, Homo sapiens
cagcccacgctgactacagggc

SEQ ID NO: 5999649 - DNA, 17 bp, Homo sapiens
cagcccacgtcacgtgt

SEQ ID NO: 5999650 - DNA, 15 bp, Homo sapiens
cagcccacgtcctgt

SEQ ID NO: 5999651 - DNA, 19 bp, Homo sapiens
cagcccacgtcctgtcagt

SEQ ID NO: 5999652 - DNA, 21 bp, Homo sapiens
cagcccactgcaccgcctcag

SEQ ID NO: 5999653 - DNA, 12 bp, Homo sapiens
cagcccactggg

SEQ ID NO: 5999654 - DNA, 14 bp, Homo sapiens
cagcccactgggcc

SEQ ID NO: 5999655 - DNA, 15 bp, Homo sapiens
cagcccactgggccc

SEQ ID NO: 5999656 - DNA, 20 bp, Homo sapiens
cagcccactgggccctgggg

SEQ ID NO: 5999657 - DNA, 21 bp, Homo sapiens
cagcccagaacgggcctcccc

SEQ ID NO: 5999658 - DNA, 17 bp, Homo sapiens
cagcccagaaggccaga

SEQ ID NO: 5999659 - DNA, 17 bp, Homo sapiens
cagcccagaagtgcaga

SEQ ID NO: 5999660 - DNA, 20 bp, Homo sapiens
cagcccagaagtgcagaact

SEQ ID NO: 5999661 - DNA, 11 bp, Homo sapiens
cagcccagaga

SEQ ID NO: 5999662 - DNA, 21 bp, Homo sapiens
cagcccagagacatacttgaa

SEQ ID NO: 5999663 - DNA, 14 bp, Homo sapiens
cagcccagagactt

SEQ ID NO: 5999664 - DNA, 21 bp, Homo sapiens
cagcccagagactttgtagat

SEQ ID NO: 5999665 - DNA, 12 bp, Homo sapiens
cagcccagagag

SEQ ID NO: 5999666 - DNA, 19 bp, Homo sapiens
cagcccagagccacctgga

SEQ ID NO: 5999667 - DNA, 13 bp, Homo sapiens
cagcccagagccc

SEQ ID NO: 5999668 - DNA, 14 bp, Homo sapiens
cagcccagagcctg

SEQ ID NO: 5999669 - DNA, 20 bp, Homo sapiens
cagcccagatggctccctgg

SEQ ID NO: 5999670 - DNA, 17 bp, Homo sapiens
cagcccagcaagaagga

SEQ ID NO: 5999671 - DNA, 14 bp, Homo sapiens
cagcccagcacagg

SEQ ID NO: 5999672 - DNA, 23 bp, Homo sapiens
cagcccagcacatagcttgccta

SEQ ID NO: 5999673 - DNA, 24 bp, Homo sapiens
cagcccagcaccccttcctcgtgg

SEQ ID NO: 5999674 - DNA, 15 bp, Homo sapiens
cagcccagcacctgc

SEQ ID NO: 5999675 - DNA, 19 bp, Homo sapiens
cagcccagcacctgctccc

SEQ ID NO: 5999676 - DNA, 20 bp, Homo sapiens
cagcccagcacctgctccca

SEQ ID NO: 5999677 - DNA, 13 bp, Homo sapiens
cagcccagccagg

SEQ ID NO: 5999678 - DNA, 14 bp, Homo sapiens
cagcccagccaggc

SEQ ID NO: 5999679 - DNA, 11 bp, Homo sapiens
cagcccagccc

SEQ ID NO: 5999680 - DNA, 15 bp, Homo sapiens
cagcccagcccagct

SEQ ID NO: 5999681 - DNA, 20 bp, Homo sapiens
cagcccagcccgcccactgg

SEQ ID NO: 5999682 - DNA, 12 bp, Homo sapiens
cagcccagccta

SEQ ID NO: 5999683 - DNA, 17 bp, Homo sapiens
caccctagtcccttccc

SEQ ID NO: 5999684 - DNA, 16 bp, Homo sapiens
caccctagtttccctg

SEQ ID NO: 5999685 - DNA, 18 bp, Homo sapiens
caccctcaaaccctgtgg

SEQ ID NO: 5999686 - DNA, 19 bp, Homo sapiens
caccctcaataaatgttgc

SEQ ID NO: 5999687 - DNA, 23 bp, Homo sapiens
caccctcacacacacagctgggc

SEQ ID NO: 5999688 - DNA, 17 bp, Homo sapiens
caccctcaccaggatga

SEQ ID NO: 5999689 - DNA, 12 bp, Homo sapiens
caccctcaccca

SEQ ID NO: 5999690 - DNA, 20 bp, Homo sapiens
caccctcacccactctggtg

SEQ ID NO: 5999691 - DNA, 15 bp, Homo sapiens
caccctcactctgcc

SEQ ID NO: 5999692 - DNA, 16 bp, Homo sapiens
caccctcactctgcca

SEQ ID NO: 5999693 - DNA, 18 bp, Homo sapiens
caccctcactctgccagg

SEQ ID NO: 5999694 - DNA, 19 bp, Homo sapiens
caccctcactctgccaggg

SEQ ID NO: 5999695 - DNA, 22 bp, Homo sapiens
caccctcactctgccagggcag

SEQ ID NO: 5999696 - DNA, 21 bp, Homo sapiens
caccctcactggctctcctgg

SEQ ID NO: 5999697 - DNA, 16 bp, Homo sapiens
caccctcagcacccct

SEQ ID NO: 5999698 - DNA, 19 bp, Homo sapiens
caccctcagcaccccttcc

SEQ ID NO: 5999699 - DNA, 22 bp, Homo sapiens
caccctcagcaccccttccatg

SEQ ID NO: 5999700 - DNA, 14 bp, Homo sapiens
caccctcagctggc

SEQ ID NO: 5999701 - DNA, 12 bp, Homo sapiens
caccctcaggtg

SEQ ID NO: 5999702 - DNA, 21 bp, Homo sapiens
caccctcaggtgcctccaatt

SEQ ID NO: 5999703 - DNA, 22 bp, Homo sapiens
caccctcataccatctgctgcc

SEQ ID NO: 5999704 - DNA, 13 bp, Homo sapiens
caccctcatgaaa

SEQ ID NO: 5999705 - DNA, 21 bp, Homo sapiens
caccctcatgctgtgtgactc

SEQ ID NO: 5999706 - DNA, 17 bp, Homo sapiens
caccctcattctactga

SEQ ID NO: 5999707 - DNA, 19 bp, Homo sapiens
caccctcatttctgccagc

SEQ ID NO: 5999708 - DNA, 14 bp, Homo sapiens
caccctccacagga

SEQ ID NO: 5999709 - DNA, 23 bp, Homo sapiens
caccctccacaggagccgcagag

SEQ ID NO: 5999710 - DNA, 17 bp, Homo sapiens
caccctccaccgagcca

SEQ ID NO: 5999711 - DNA, 13 bp, Homo sapiens
caccctccactct

SEQ ID NO: 5999712 - DNA, 17 bp, Homo sapiens
caccctccactctgagg

SEQ ID NO: 5999713 - DNA, 18 bp, Homo sapiens
caccctccatgctcctca

SEQ ID NO: 5999714 - DNA, 20 bp, Homo sapiens
caccctcccaagtagctggg

SEQ ID NO: 5999715 - DNA, 18 bp, Homo sapiens
caccctcccaccatgcgc

SEQ ID NO: 5999716 - DNA, 14 bp, Homo sapiens
caccctcccagctc

SEQ ID NO: 5999717 - DNA, 15 bp, Homo sapiens
caccctcccagctct

SEQ ID NO: 5999718 - DNA, 23 bp, Homo sapiens
caccctcccatgagactgccctg

SEQ ID NO: 5999719 - DNA, 18 bp, Homo sapiens
caccctcccctatgctgg

SEQ ID NO: 5999720 - DNA, 17 bp, Homo sapiens
caccctcccctctcctg

SEQ ID NO: 5999721 - DNA, 18 bp, Homo sapiens
caccctcccctctcctga

SEQ ID NO: 5999722 - DNA, 15 bp, Homo sapiens
caccctcccctctct

SEQ ID NO: 5999723 - DNA, 16 bp, Homo sapiens
caccctcccctctctt

SEQ ID NO: 5999724 - DNA, 14 bp, Homo sapiens
caccctcccctctt

SEQ ID NO: 5999725 - DNA, 20 bp, Homo sapiens
caccctcccctgtcttctct

SEQ ID NO: 5999726 - DNA, 20 bp, Homo sapiens
caccctccccttcccagggc

SEQ ID NO: 5999727 - DNA, 14 bp, Homo sapiens
caccctccctagag

SEQ ID NO: 5999728 - DNA, 14 bp, Homo sapiens
caccctccctagct

SEQ ID NO: 5999729 - DNA, 17 bp, Homo sapiens
caccctccctagctctg

SEQ ID NO: 5999730 - DNA, 23 bp, Homo sapiens
caccctccctagctctgaaatca

SEQ ID NO: 5999731 - DNA, 21 bp, Homo sapiens
caccctccctgactggcctgg

SEQ ID NO: 5999732 - DNA, 16 bp, Homo sapiens
caccctccctggagtg

SEQ ID NO: 5999733 - DNA, 19 bp, Homo sapiens
caccctccggccagcgagt

SEQ ID NO: 5999734 - DNA, 22 bp, Homo sapiens
caccctcctagcctgctctgcc

SEQ ID NO: 5999735 - DNA, 22 bp, Homo sapiens
caccctcctccctccaagcctg

SEQ ID NO: 5999736 - DNA, 15 bp, Homo sapiens
caccctcctcctctt

SEQ ID NO: 5999737 - DNA, 16 bp, Homo sapiens
caccctcctctagcca

SEQ ID NO: 5999738 - DNA, 14 bp, Homo sapiens
caccctcctcttgg

SEQ ID NO: 5999739 - DNA, 16 bp, Homo sapiens
caccctcctgagcctc

SEQ ID NO: 5999740 - DNA, 13 bp, Homo sapiens
caccctcctgccc

SEQ ID NO: 5999741 - DNA, 17 bp, Homo sapiens
caccctcctgccccaca

SEQ ID NO: 5999742 - DNA, 20 bp, Homo sapiens
caccctcctgccccacactc

SEQ ID NO: 5999743 - DNA, 22 bp, Homo sapiens
caccctcctggcctcagactgc

SEQ ID NO: 5999744 - DNA, 19 bp, Homo sapiens
caccctcctgtcttcccag

SEQ ID NO: 5999745 - DNA, 11 bp, Homo sapiens
caccctccttc

SEQ ID NO: 5999746 - DNA, 22 bp, Homo sapiens
caccctccttcccactcttctc

SEQ ID NO: 5999747 - DNA, 14 bp, Homo sapiens
caccctccttcccg

SEQ ID NO: 5999748 - DNA, 16 bp, Homo sapiens
caccctcgaagcgcgc

SEQ ID NO: 5999749 - DNA, 16 bp, Homo sapiens
caccctcgctgccacc

SEQ ID NO: 5999750 - DNA, 18 bp, Homo sapiens
caccctcgtggacacctg

SEQ ID NO: 5999751 - DNA, 21 bp, Homo sapiens
caccctctccacacccagcct

SEQ ID NO: 5999752 - DNA, 23 bp, Homo sapiens
caccctctccacacccagcctgt

SEQ ID NO: 5999753 - DNA, 18 bp, Homo sapiens
caccctctccatgcccaa

SEQ ID NO: 5999754 - DNA, 15 bp, Homo sapiens
caccctctcccagga

SEQ ID NO: 5999755 - DNA, 16 bp, Homo sapiens
caccctctcccaggac

SEQ ID NO: 5999756 - DNA, 14 bp, Homo sapiens
caccctctcttggt

SEQ ID NO: 5999757 - DNA, 12 bp, Homo sapiens
caccctctgagc

SEQ ID NO: 5999758 - DNA, 13 bp, Homo sapiens
caccctctgagct

SEQ ID NO: 5999759 - DNA, 13 bp, Homo sapiens
caccctctgcagg

SEQ ID NO: 5999760 - DNA, 15 bp, Homo sapiens
caccctctgcagggc

SEQ ID NO: 5999761 - DNA, 18 bp, Homo sapiens
caccctctgcagggcagc

SEQ ID NO: 5999762 - DNA, 16 bp, Homo sapiens
caccctctgccccaga

SEQ ID NO: 5999763 - DNA, 19 bp, Homo sapiens
caccctctgccccagaaca

SEQ ID NO: 5999764 - DNA, 12 bp, Homo sapiens
caccctctgccg

SEQ ID NO: 5999765 - DNA, 23 bp, Homo sapiens
caccctctgctatgtctgtgatg

SEQ ID NO: 5999766 - DNA, 14 bp, Homo sapiens
caccctctgggggt

SEQ ID NO: 5999767 - DNA, 19 bp, Homo sapiens
caccctctgggggtcctct

SEQ ID NO: 5999768 - DNA, 16 bp, Homo sapiens
caccctctggtccttc

SEQ ID NO: 5999769 - DNA, 15 bp, Homo sapiens
caccctctgtcccca

SEQ ID NO: 5999770 - DNA, 21 bp, Homo sapiens
caccctctgtccttcccccag

SEQ ID NO: 5999771 - DNA, 13 bp, Homo sapiens
caccctctgtgct

SEQ ID NO: 5999772 - DNA, 22 bp, Homo sapiens
caccctctgttagtgccgcaat

SEQ ID NO: 5999773 - DNA, 14 bp, Homo sapiens
caccctcttcctgt

SEQ ID NO: 5999774 - DNA, 15 bp, Homo sapiens
caccctcttcctgtg

SEQ ID NO: 5999775 - DNA, 23 bp, Homo sapiens
caccctgaatggttccatgcctg

SEQ ID NO: 5999776 - DNA, 20 bp, Homo sapiens
caccctgaattcattgtctc

SEQ ID NO: 5999777 - DNA, 12 bp, Homo sapiens
caccctgagccc

SEQ ID NO: 5999778 - DNA, 18 bp, Homo sapiens
caccctgagccccttcct

SEQ ID NO: 5999779 - DNA, 13 bp, Homo sapiens
caccctgagcctg

SEQ ID NO: 5999780 - DNA, 15 bp, Homo sapiens
caccctgagcctgac

SEQ ID NO: 5999781 - DNA, 14 bp, Homo sapiens
caccctgagctcgg

SEQ ID NO: 5999782 - DNA, 10 bp, Homo sapiens
caccctgagg

SEQ ID NO: 5999783 - DNA, 21 bp, Homo sapiens
caccctgaggagtctgaggtc

SEQ ID NO: 5999784 - DNA, 22 bp, Homo sapiens
caccctgaggagtctgaggtcc

SEQ ID NO: 5999785 - DNA, 15 bp, Homo sapiens
caccctgaggagtga

SEQ ID NO: 5999786 - DNA, 17 bp, Homo sapiens
caccctgaggtcaggga

SEQ ID NO: 5999787 - DNA, 17 bp, Homo sapiens
caccctgatttcttgct

SEQ ID NO: 5999788 - DNA, 14 bp, Homo sapiens
caccctgcacctgc

SEQ ID NO: 5999789 - DNA, 14 bp, Homo sapiens
caccctgcagagca

SEQ ID NO: 5999790 - DNA, 17 bp, Homo sapiens
caccctgcagagcacac

SEQ ID NO: 5999791 - DNA, 19 bp, Homo sapiens
caccctgcagagctatggt

SEQ ID NO: 5999792 - DNA, 16 bp, Homo sapiens
caccctgcagccagga

SEQ ID NO: 5999793 - DNA, 15 bp, Homo sapiens
caccctgcaggcagg

SEQ ID NO: 5999794 - DNA, 20 bp, Homo sapiens
caccctgcaggcaggcagac

SEQ ID NO: 5999795 - DNA, 12 bp, Homo sapiens
caccctgccacc

SEQ ID NO: 5999796 - DNA, 15 bp, Homo sapiens
caccctgccaccctc

SEQ ID NO: 5999797 - DNA, 14 bp, Homo sapiens
caccctgccatgga

SEQ ID NO: 5999798 - DNA, 10 bp, Homo sapiens
caccctgccc

SEQ ID NO: 5999799 - DNA, 14 bp, Homo sapiens
caccctgcccactc

SEQ ID NO: 5999800 - DNA, 21 bp, Homo sapiens
caccctgcccagtctggaaga

SEQ ID NO: 5999801 - DNA, 22 bp, Homo sapiens
caccctgccccccctaagagac

SEQ ID NO: 5999802 - DNA, 14 bp, Homo sapiens
caccctgcccctaa

SEQ ID NO: 5999803 - DNA, 15 bp, Homo sapiens
caccctgcccctgca

SEQ ID NO: 5999804 - DNA, 16 bp, Homo sapiens
caccctgcccctgcaa

SEQ ID NO: 5999805 - DNA, 18 bp, Homo sapiens
caccctgcccctgcaaag

SEQ ID NO: 5999806 - DNA, 17 bp, Homo sapiens
caccctgccctcatggg

SEQ ID NO: 5999807 - DNA, 13 bp, Homo sapiens
caccctgccctgg

SEQ ID NO: 5999808 - DNA, 15 bp, Homo sapiens
caccctgccctggcc

SEQ ID NO: 5999809 - DNA, 20 bp, Homo sapiens
caccctgcctctacccaacc

SEQ ID NO: 5999810 - DNA, 14 bp, Homo sapiens
caccctgcctgcac

SEQ ID NO: 5999811 - DNA, 16 bp, Homo sapiens
caccctgcctgctgtg

SEQ ID NO: 5999812 - DNA, 22 bp, Homo sapiens
caccctgcctgctgtggagccc

SEQ ID NO: 5999813 - DNA, 15 bp, Homo sapiens
caccctgcctgtgga

SEQ ID NO: 5999814 - DNA, 15 bp, Homo sapiens
caccctgcgcctcca

SEQ ID NO: 5999815 - DNA, 22 bp, Homo sapiens
caccctgcgggccagggtcctg

SEQ ID NO: 5999816 - DNA, 12 bp, Homo sapiens
caccctgctgca

SEQ ID NO: 5999817 - DNA, 12 bp, Homo sapiens
caccctgcttct

SEQ ID NO: 5999818 - DNA, 22 bp, Homo sapiens
caccctgcttctgctgcctgtt

SEQ ID NO: 5999819 - DNA, 17 bp, Homo sapiens
caccctgcttggcccag

SEQ ID NO: 5999820 - DNA, 18 bp, Homo sapiens
caccctgcttggcccagg

SEQ ID NO: 5999821 - DNA, 22 bp, Homo sapiens
caccctggaaccgggaagggtg

SEQ ID NO: 5999822 - DNA, 20 bp, Homo sapiens
caccctggagagtgcacatg

SEQ ID NO: 5999823 - DNA, 11 bp, Homo sapiens
caccctggagg

SEQ ID NO: 5999824 - DNA, 21 bp, Homo sapiens
caccctggaggatttcatctc

SEQ ID NO: 5999825 - DNA, 15 bp, Homo sapiens
caccctggaggctct

SEQ ID NO: 5999826 - DNA, 19 bp, Homo sapiens
caccctggatgctgttgag

SEQ ID NO: 5999827 - DNA, 14 bp, Homo sapiens
caccctggccacca

SEQ ID NO: 5999828 - DNA, 17 bp, Homo sapiens
caccctggccaccaccc

SEQ ID NO: 5999829 - DNA, 11 bp, Homo sapiens
caccctggccc

SEQ ID NO: 5999830 - DNA, 12 bp, Homo sapiens
caccctggcccc

SEQ ID NO: 5999831 - DNA, 19 bp, Homo sapiens
caccctggcccgcccctcg

SEQ ID NO: 5999832 - DNA, 22 bp, Homo sapiens
caccctggccgagtccaagctg

SEQ ID NO: 5999833 - DNA, 11 bp, Homo sapiens
caccctggcct

SEQ ID NO: 5999834 - DNA, 15 bp, Homo sapiens
caccctggctgggat

SEQ ID NO: 5999835 - DNA, 16 bp, Homo sapiens
caccctgggagacaga

SEQ ID NO: 5999836 - DNA, 16 bp, Homo sapiens
caccctgggagccagt

SEQ ID NO: 5999837 - DNA, 22 bp, Homo sapiens
caccctgggatgggccacccac

SEQ ID NO: 5999838 - DNA, 22 bp, Homo sapiens
caccctgggcaatgcagtgcag

SEQ ID NO: 5999839 - DNA, 15 bp, Homo sapiens
caccctgggccacgc

SEQ ID NO: 5999840 - DNA, 21 bp, Homo sapiens
caccctgggccctgggctgga

SEQ ID NO: 5999841 - DNA, 12 bp, Homo sapiens
caccctgggctc

SEQ ID NO: 5999842 - DNA, 13 bp, Homo sapiens
caccctgggctcc

SEQ ID NO: 5999843 - DNA, 19 bp, Homo sapiens
caccctgggctccacacag

SEQ ID NO: 5999844 - DNA, 20 bp, Homo sapiens
caccctgggctccacacagc

SEQ ID NO: 5999845 - DNA, 21 bp, Homo sapiens
caccctgggctctgggagcag

SEQ ID NO: 5999846 - DNA, 16 bp, Homo sapiens
caccctggggaccccc

SEQ ID NO: 5999847 - DNA, 14 bp, Homo sapiens
caccctggggctgc

SEQ ID NO: 5999848 - DNA, 14 bp, Homo sapiens
caccctgggtgcca

SEQ ID NO: 5999849 - DNA, 19 bp, Homo sapiens
caccctgggtttggcccct

SEQ ID NO: 5999850 - DNA, 16 bp, Homo sapiens
caccctggtctgtgga

SEQ ID NO: 5999851 - DNA, 23 bp, Homo sapiens
caccctgtactgttctgtgtctt

SEQ ID NO: 5999852 - DNA, 17 bp, Homo sapiens
caccctgtcaagttaac

SEQ ID NO: 5999853 - DNA, 23 bp, Homo sapiens
caccctgtcagacgttggtccca

SEQ ID NO: 5999854 - DNA, 14 bp, Homo sapiens
caccctgtcccagg

SEQ ID NO: 5999855 - DNA, 21 bp, Homo sapiens
caccctgtcccaggcagcgcc

SEQ ID NO: 5999856 - DNA, 16 bp, Homo sapiens
caccctgtcccccagc

SEQ ID NO: 5999857 - DNA, 16 bp, Homo sapiens
caccctgtcctgcaca

SEQ ID NO: 5999858 - DNA, 23 bp, Homo sapiens
caccctgtcctgcacaccctggg

SEQ ID NO: 5999859 - DNA, 14 bp, Homo sapiens
caccctgtcttcct

SEQ ID NO: 5999860 - DNA, 19 bp, Homo sapiens
caccctgtcttcctctgca

SEQ ID NO: 5999861 - DNA, 21 bp, Homo sapiens
caccctgtcttcctctgcaag

SEQ ID NO: 5999862 - DNA, 14 bp, Homo sapiens
caccctgtcttctt

SEQ ID NO: 5999863 - DNA, 12 bp, Homo sapiens
cagcccagcctc

SEQ ID NO: 5999864 - DNA, 22 bp, Homo sapiens
cagcccagcctctgtccctctt

SEQ ID NO: 5999865 - DNA, 13 bp, Homo sapiens
cagcccagcctgc

SEQ ID NO: 5999866 - DNA, 14 bp, Homo sapiens
cagcccagcctgcc

SEQ ID NO: 5999867 - DNA, 20 bp, Homo sapiens
cagcccagctccactcaggg

SEQ ID NO: 5999868 - DNA, 21 bp, Homo sapiens
cagcccagctccactcagggc

SEQ ID NO: 5999869 - DNA, 22 bp, Homo sapiens
cagcccagctccactcagggct

SEQ ID NO: 5999870 - DNA, 11 bp, Homo sapiens
cagcccagctg

SEQ ID NO: 5999871 - DNA, 17 bp, Homo sapiens
cagcccagctggccacc

SEQ ID NO: 5999872 - DNA, 17 bp, Homo sapiens
cagcccagctggccgga

SEQ ID NO: 5999873 - DNA, 22 bp, Homo sapiens
cagcccagctggccggaaggag

SEQ ID NO: 5999874 - DNA, 15 bp, Homo sapiens
cagcccagcttcctg

SEQ ID NO: 5999875 - DNA, 21 bp, Homo sapiens
cagcccaggaaaaactggaag

SEQ ID NO: 5999876 - DNA, 21 bp, Homo sapiens
cagcccaggagtttgaggctg

SEQ ID NO: 5999877 - DNA, 20 bp, Homo sapiens
cagcccaggatactggcaca

SEQ ID NO: 5999878 - DNA, 22 bp, Homo sapiens
cagcccaggatactggcacaga

SEQ ID NO: 5999879 - DNA, 12 bp, Homo sapiens
cagcccaggcct

SEQ ID NO: 5999880 - DNA, 19 bp, Homo sapiens
cagcccagggcctgcatgg

SEQ ID NO: 5999881 - DNA, 19 bp, Homo sapiens
cagcccagggctcctgcac

SEQ ID NO: 5999882 - DNA, 18 bp, Homo sapiens
cagcccagggttccccca

SEQ ID NO: 5999883 - DNA, 19 bp, Homo sapiens
cagcccagggttcccccag

SEQ ID NO: 5999884 - DNA, 15 bp, Homo sapiens
cagcccaggtcctcc

SEQ ID NO: 5999885 - DNA, 15 bp, Homo sapiens
cagcccaggtctcct

SEQ ID NO: 5999886 - DNA, 17 bp, Homo sapiens
cagcccagttcccgtga

SEQ ID NO: 5999887 - DNA, 11 bp, Homo sapiens
cagcccatcca

SEQ ID NO: 5999888 - DNA, 18 bp, Homo sapiens
cagcccatccattaggcc

SEQ ID NO: 5999889 - DNA, 15 bp, Homo sapiens
cagcccatcccctgc

SEQ ID NO: 5999890 - DNA, 18 bp, Homo sapiens
cagcccatcccctgcctc

SEQ ID NO: 5999891 - DNA, 20 bp, Homo sapiens
cagcccatcccctgcctcta

SEQ ID NO: 5999892 - DNA, 17 bp, Homo sapiens
cagcccatctcggagca

SEQ ID NO: 5999893 - DNA, 16 bp, Homo sapiens
cagcccatcttgcctc

SEQ ID NO: 5999894 - DNA, 18 bp, Homo sapiens
cagcccatcttgcctcca

SEQ ID NO: 5999895 - DNA, 16 bp, Homo sapiens
cagcccatgcccacct

SEQ ID NO: 5999896 - DNA, 24 bp, Homo sapiens
cagcccatgcccacctgcccatca

SEQ ID NO: 5999897 - DNA, 12 bp, Homo sapiens
cagcccatgctg

SEQ ID NO: 5999898 - DNA, 14 bp, Homo sapiens
cagcccatgctggc

SEQ ID NO: 5999899 - DNA, 17 bp, Homo sapiens
cagcccatgctggctgg

SEQ ID NO: 5999900 - DNA, 18 bp, Homo sapiens
cagcccatgctggctggg

SEQ ID NO: 5999901 - DNA, 21 bp, Homo sapiens
cagcccatgctggctggggcc

SEQ ID NO: 5999902 - DNA, 19 bp, Homo sapiens
cagcccatggcccccaata

SEQ ID NO: 5999903 - DNA, 17 bp, Homo sapiens
cagcccattcccaaggg

SEQ ID NO: 5999904 - DNA, 22 bp, Homo sapiens
cagcccattcccaagggagact

SEQ ID NO: 5999905 - DNA, 12 bp, Homo sapiens
cagcccatttct

SEQ ID NO: 5999906 - DNA, 14 bp, Homo sapiens
cagccccaaaccag

SEQ ID NO: 5999907 - DNA, 17 bp, Homo sapiens
cagccccaaaccagggt

SEQ ID NO: 5999908 - DNA, 16 bp, Homo sapiens
cagccccaacctccca

SEQ ID NO: 5999909 - DNA, 17 bp, Homo sapiens
cagccccaactccaggg

SEQ ID NO: 5999910 - DNA, 21 bp, Homo sapiens
cagccccaactccaggggcac

SEQ ID NO: 5999911 - DNA, 13 bp, Homo sapiens
cagccccaagggc

SEQ ID NO: 5999912 - DNA, 16 bp, Homo sapiens
cagccccaagggctgg

SEQ ID NO: 5999913 - DNA, 15 bp, Homo sapiens
cagccccaaggggtg

SEQ ID NO: 5999914 - DNA, 17 bp, Homo sapiens
cagccccaaggggtggc

SEQ ID NO: 5999915 - DNA, 20 bp, Homo sapiens
cagccccaaggggtggccgt

SEQ ID NO: 5999916 - DNA, 18 bp, Homo sapiens
cagccccacagcacccag

SEQ ID NO: 5999917 - DNA, 21 bp, Homo sapiens
cagccccacagcacccaggct

SEQ ID NO: 5999918 - DNA, 24 bp, Homo sapiens
cagccccacagcacccaggctcca

SEQ ID NO: 5999919 - DNA, 14 bp, Homo sapiens
cagccccacccagg

SEQ ID NO: 5999920 - DNA, 15 bp, Homo sapiens
cagccccacccagga

SEQ ID NO: 5999921 - DNA, 21 bp, Homo sapiens
cagccccacccaggagggagg

SEQ ID NO: 5999922 - DNA, 18 bp, Homo sapiens
cagccccaccccagggca

SEQ ID NO: 5999923 - DNA, 20 bp, Homo sapiens
cagccccaccccagggcagc

SEQ ID NO: 5999924 - DNA, 12 bp, Homo sapiens
cagccccaccct

SEQ ID NO: 5999925 - DNA, 18 bp, Homo sapiens
cagccccaccctggccta

SEQ ID NO: 5999926 - DNA, 14 bp, Homo sapiens
cagccccaccctgt

SEQ ID NO: 5999927 - DNA, 17 bp, Homo sapiens
cagccccaccctgtttt

SEQ ID NO: 5999928 - DNA, 14 bp, Homo sapiens
cagccccactgaca

SEQ ID NO: 5999929 - DNA, 19 bp, Homo sapiens
cagccccactgacacccag

SEQ ID NO: 5999930 - DNA, 23 bp, Homo sapiens
cagccccagacaacagcccaggc

SEQ ID NO: 5999931 - DNA, 13 bp, Homo sapiens
cagccccagagag

SEQ ID NO: 5999932 - DNA, 12 bp, Homo sapiens
cagccccagcaa

SEQ ID NO: 5999933 - DNA, 12 bp, Homo sapiens
cagccccagccc

SEQ ID NO: 5999934 - DNA, 14 bp, Homo sapiens
cagccccagcccag

SEQ ID NO: 5999935 - DNA, 15 bp, Homo sapiens
cagccccagcccagc

SEQ ID NO: 5999936 - DNA, 21 bp, Homo sapiens
cagccccagcccagcccagct

SEQ ID NO: 5999937 - DNA, 13 bp, Homo sapiens
cagccccagcctg

SEQ ID NO: 5999938 - DNA, 18 bp, Homo sapiens
cagccccagcctgctagc

SEQ ID NO: 5999939 - DNA, 12 bp, Homo sapiens
cagccccaggag

SEQ ID NO: 5999940 - DNA, 12 bp, Homo sapiens
cagccccagggc

SEQ ID NO: 5999941 - DNA, 14 bp, Homo sapiens
cagccccagggccc

SEQ ID NO: 5999942 - DNA, 21 bp, Homo sapiens
cagccccagggccctgctcag

SEQ ID NO: 5999943 - DNA, 22 bp, Homo sapiens
cagccccagggccctgctcagg

SEQ ID NO: 5999944 - DNA, 17 bp, Homo sapiens
cagccccagtcttcctt

SEQ ID NO: 5999945 - DNA, 13 bp, Homo sapiens
cagccccagtgcc

SEQ ID NO: 5999946 - DNA, 14 bp, Homo sapiens
cagccccagtgccc

SEQ ID NO: 5999947 - DNA, 17 bp, Homo sapiens
cagccccagtgcccaca

SEQ ID NO: 5999948 - DNA, 17 bp, Homo sapiens
cagccccatcagaacct

SEQ ID NO: 5999949 - DNA, 22 bp, Homo sapiens
cagccccatcagaacctgagct

SEQ ID NO: 5999950 - DNA, 11 bp, Homo sapiens
cagccccatcc

SEQ ID NO: 5999951 - DNA, 14 bp, Homo sapiens
cagccccatccctg

SEQ ID NO: 5999952 - DNA, 15 bp, Homo sapiens
cagccccatccctgt

SEQ ID NO: 5999953 - DNA, 18 bp, Homo sapiens
cagccccatccctgtcct

SEQ ID NO: 5999954 - DNA, 19 bp, Homo sapiens
cagccccatccctgtcctc

SEQ ID NO: 5999955 - DNA, 22 bp, Homo sapiens
cagccccatcctctgtacagag

SEQ ID NO: 5999956 - DNA, 15 bp, Homo sapiens
cagccccatccttcc

SEQ ID NO: 5999957 - DNA, 17 bp, Homo sapiens
cagccccattctgcctg

SEQ ID NO: 5999958 - DNA, 18 bp, Homo sapiens
cagccccattctgcctgc

SEQ ID NO: 5999959 - DNA, 19 bp, Homo sapiens
cagcccccaaagagctgtg

SEQ ID NO: 5999960 - DNA, 13 bp, Homo sapiens
cagcccccacagc

SEQ ID NO: 5999961 - DNA, 22 bp, Homo sapiens
cagcccccacagccctggaata

SEQ ID NO: 5999962 - DNA, 19 bp, Homo sapiens
cagcccccacagtgctgtc

SEQ ID NO: 5999963 - DNA, 12 bp, Homo sapiens
cagcccccaccc

SEQ ID NO: 5999964 - DNA, 15 bp, Homo sapiens
cagcccccacccccg

SEQ ID NO: 5999965 - DNA, 13 bp, Homo sapiens
cagcccccacgcc

SEQ ID NO: 5999966 - DNA, 13 bp, Homo sapiens
cagcccccactga

SEQ ID NO: 5999967 - DNA, 15 bp, Homo sapiens
cagcccccactgacc

SEQ ID NO: 5999968 - DNA, 17 bp, Homo sapiens
cagcccccactgcaccc

SEQ ID NO: 5999969 - DNA, 14 bp, Homo sapiens
cagcccccagcctt

SEQ ID NO: 5999970 - DNA, 18 bp, Homo sapiens
cagcccccagctcccacc

SEQ ID NO: 5999971 - DNA, 20 bp, Homo sapiens
cagcccccaggatctgggtt

SEQ ID NO: 5999972 - DNA, 12 bp, Homo sapiens
cagcccccaggc

SEQ ID NO: 5999973 - DNA, 16 bp, Homo sapiens
cagcccccaggccagg

SEQ ID NO: 5999974 - DNA, 17 bp, Homo sapiens
cagcccccaggccaggt

SEQ ID NO: 5999975 - DNA, 15 bp, Homo sapiens
cagcccccagggccc

SEQ ID NO: 5999976 - DNA, 16 bp, Homo sapiens
cagcccccagggcccc

SEQ ID NO: 5999977 - DNA, 14 bp, Homo sapiens
cagcccccatgggc

SEQ ID NO: 5999978 - DNA, 17 bp, Homo sapiens
cagcccccatgggctcc

SEQ ID NO: 5999979 - DNA, 13 bp, Homo sapiens
cagccccccaccc

SEQ ID NO: 5999980 - DNA, 20 bp, Homo sapiens
cagccccccacgcttctgga

SEQ ID NO: 5999981 - DNA, 22 bp, Homo sapiens
cagccccccaggctgcccagag

SEQ ID NO: 5999982 - DNA, 15 bp, Homo sapiens
cagcccccccaccca

SEQ ID NO: 5999983 - DNA, 19 bp, Homo sapiens
cagcccccccacccacccc

SEQ ID NO: 5999984 - DNA, 20 bp, Homo sapiens
cagcccccccacccaccccc

SEQ ID NO: 5999985 - DNA, 18 bp, Homo sapiens
cagcccccccctcaaggg

SEQ ID NO: 5999986 - DNA, 19 bp, Homo sapiens
cagcccccccctcaagggg

SEQ ID NO: 5999987 - DNA, 13 bp, Homo sapiens
cagccccccttgc

SEQ ID NO: 5999988 - DNA, 15 bp, Homo sapiens
cagcccccgccccag

SEQ ID NO: 5999989 - DNA, 19 bp, Homo sapiens
cagcccccgccccagagtg

SEQ ID NO: 5999990 - DNA, 21 bp, Homo sapiens
cagcccccgcgccctccctcc

SEQ ID NO: 5999991 - DNA, 17 bp, Homo sapiens
cagcccccgggacaccg

SEQ ID NO: 5999992 - DNA, 20 bp, Homo sapiens
cagcccccgggacaccgtgg

SEQ ID NO: 5999993 - DNA, 22 bp, Homo sapiens
cagcccccgggacaccgtgggg

SEQ ID NO: 5999994 - DNA, 21 bp, Homo sapiens
cagcccccggttggagcctgc

SEQ ID NO: 5999995 - DNA, 21 bp, Homo sapiens
cagccccctatagtcatgggg

SEQ ID NO: 5999996 - DNA, 24 bp, Homo sapiens
cagccccctccacaccagtggcct

SEQ ID NO: 5999997 - DNA, 14 bp, Homo sapiens
cagccccctccagc

SEQ ID NO: 5999998 - DNA, 15 bp, Homo sapiens
cagccccctccagct

SEQ ID NO: 5999999 - DNA, 16 bp, Homo sapiens
cagccccctccagctc

SEQ ID NO: 6000000 - DNA, 17 bp, Homo sapiens
cagccccctccagctca

SEQ ID NO: 6000001 - DNA, 19 bp, Homo sapiens
cagccccctcccaccgctg

SEQ ID NO: 6000002 - DNA, 23 bp, Homo sapiens
cagccccctcccaccgctgcctc

SEQ ID NO: 6000003 - DNA, 13 bp, Homo sapiens
cagccccctccct

SEQ ID NO: 6000004 - DNA, 14 bp, Homo sapiens
cagccccctcctga

SEQ ID NO: 6000005 - DNA, 17 bp, Homo sapiens
cagccccctcctgaccc

SEQ ID NO: 6000006 - DNA, 21 bp, Homo sapiens
cagccccctcctgaccccacc

SEQ ID NO: 6000007 - DNA, 14 bp, Homo sapiens
cagccccctgacca

SEQ ID NO: 6000008 - DNA, 21 bp, Homo sapiens
cagccccctgaccactcagag

SEQ ID NO: 6000009 - DNA, 14 bp, Homo sapiens
cagccccctgcttc

SEQ ID NO: 6000010 - DNA, 21 bp, Homo sapiens
cagccccctgcttctcccgcc

SEQ ID NO: 6000011 - DNA, 14 bp, Homo sapiens
cagccccctggcat

SEQ ID NO: 6000012 - DNA, 13 bp, Homo sapiens
cagccccctggcc

SEQ ID NO: 6000013 - DNA, 13 bp, Homo sapiens
cagccccctggtc

SEQ ID NO: 6000014 - DNA, 14 bp, Homo sapiens
cagccccctgtggc

SEQ ID NO: 6000015 - DNA, 20 bp, Homo sapiens
cagcccccttgccctccgcc

SEQ ID NO: 6000016 - DNA, 21 bp, Homo sapiens
cagcccccttgccctccgcct

SEQ ID NO: 6000017 - DNA, 19 bp, Homo sapiens
cagccccgacccctgtcca

SEQ ID NO: 6000018 - DNA, 18 bp, Homo sapiens
cagccccgactccagcca

SEQ ID NO: 6000019 - DNA, 19 bp, Homo sapiens
cagccccgactccagccag

SEQ ID NO: 6000020 - DNA, 15 bp, Homo sapiens
cagccccgacttcct

SEQ ID NO: 6000021 - DNA, 17 bp, Homo sapiens
cagccccgacttcctga

SEQ ID NO: 6000022 - DNA, 18 bp, Homo sapiens
cagccccgacttcctgac

SEQ ID NO: 6000023 - DNA, 16 bp, Homo sapiens
cagccccgagctgtcc

SEQ ID NO: 6000024 - DNA, 22 bp, Homo sapiens
cagccccgatgattcttaacac

SEQ ID NO: 6000025 - DNA, 17 bp, Homo sapiens
cagccccgccccgttgt

SEQ ID NO: 6000026 - DNA, 16 bp, Homo sapiens
cagccccgccctctgc

SEQ ID NO: 6000027 - DNA, 15 bp, Homo sapiens
cagccccgcctgtca

SEQ ID NO: 6000028 - DNA, 16 bp, Homo sapiens
cagccccgcctgtcac

SEQ ID NO: 6000029 - DNA, 18 bp, Homo sapiens
cagccccgcctgtcacaa

SEQ ID NO: 6000030 - DNA, 19 bp, Homo sapiens
cagccccgcgaccacccct

SEQ ID NO: 6000031 - DNA, 20 bp, Homo sapiens
cagccccgcgaccacccctg

SEQ ID NO: 6000032 - DNA, 21 bp, Homo sapiens
cagccccgcgaccacccctgt

SEQ ID NO: 6000033 - DNA, 15 bp, Homo sapiens
cagccccgctcaggc

SEQ ID NO: 6000034 - DNA, 16 bp, Homo sapiens
cagccccgctcaggcc

SEQ ID NO: 6000035 - DNA, 22 bp, Homo sapiens
cagccccgctcaggcctaggag

SEQ ID NO: 6000036 - DNA, 15 bp, Homo sapiens
cagccccgctcccac

SEQ ID NO: 6000037 - DNA, 20 bp, Homo sapiens
cagccccgctcctcccctct

SEQ ID NO: 6000038 - DNA, 19 bp, Homo sapiens
cagccccggcaagccacag

SEQ ID NO: 6000039 - DNA, 22 bp, Homo sapiens
cagccccggccactccctgcca

SEQ ID NO: 6000040 - DNA, 16 bp, Homo sapiens
cagccccggccctggg

SEQ ID NO: 6000041 - DNA, 17 bp, Homo sapiens
cagccccggccctgggc

SEQ ID NO: 6000042 - DNA, 21 bp, Homo sapiens
cagccccgggcggagccttcc

SEQ ID NO: 6000043 - DNA, 19 bp, Homo sapiens
caccctgtgaccctctcac

SEQ ID NO: 6000044 - DNA, 20 bp, Homo sapiens
caccctgtgaccctctcact

SEQ ID NO: 6000045 - DNA, 12 bp, Homo sapiens
caccctgtgatg

SEQ ID NO: 6000046 - DNA, 15 bp, Homo sapiens
caccctgtgatgggg

SEQ ID NO: 6000047 - DNA, 17 bp, Homo sapiens
caccctgtgcccctttt

SEQ ID NO: 6000048 - DNA, 12 bp, Homo sapiens
caccctgtggca

SEQ ID NO: 6000049 - DNA, 14 bp, Homo sapiens
caccctgtggctca

SEQ ID NO: 6000050 - DNA, 17 bp, Homo sapiens
caccctgtggctcacag

SEQ ID NO: 6000051 - DNA, 19 bp, Homo sapiens
caccctgtgggaccgcctg

SEQ ID NO: 6000052 - DNA, 22 bp, Homo sapiens
caccctgtgggaccgcctggcc

SEQ ID NO: 6000053 - DNA, 17 bp, Homo sapiens
caccctgtgggtgtctc

SEQ ID NO: 6000054 - DNA, 18 bp, Homo sapiens
caccctgtggtcttcctc

SEQ ID NO: 6000055 - DNA, 14 bp, Homo sapiens
caccctgttcctgc

SEQ ID NO: 6000056 - DNA, 15 bp, Homo sapiens
caccctgttcctgct

SEQ ID NO: 6000057 - DNA, 14 bp, Homo sapiens
cacccttacttcct

SEQ ID NO: 6000058 - DNA, 14 bp, Homo sapiens
cacccttcagaccc

SEQ ID NO: 6000059 - DNA, 18 bp, Homo sapiens
cacccttccacagctggc

SEQ ID NO: 6000060 - DNA, 21 bp, Homo sapiens
cacccttccacagctggcctg

SEQ ID NO: 6000061 - DNA, 22 bp, Homo sapiens
cacccttccacagctggcctgg

SEQ ID NO: 6000062 - DNA, 13 bp, Homo sapiens
cacccttccatca

SEQ ID NO: 6000063 - DNA, 18 bp, Homo sapiens
cacccttcccggcccccg

SEQ ID NO: 6000064 - DNA, 16 bp, Homo sapiens
cacccttccctcttcc

SEQ ID NO: 6000065 - DNA, 16 bp, Homo sapiens
cacccttccctgcctc

SEQ ID NO: 6000066 - DNA, 17 bp, Homo sapiens
cacccttccgacaggag

SEQ ID NO: 6000067 - DNA, 13 bp, Homo sapiens
cacccttcctggc

SEQ ID NO: 6000068 - DNA, 15 bp, Homo sapiens
cacccttcctggccc

SEQ ID NO: 6000069 - DNA, 16 bp, Homo sapiens
cacccttcctggccca

SEQ ID NO: 6000070 - DNA, 18 bp, Homo sapiens
cacccttcctggcccagg

SEQ ID NO: 6000071 - DNA, 19 bp, Homo sapiens
cacccttcctggcccaggc

SEQ ID NO: 6000072 - DNA, 13 bp, Homo sapiens
cacccttccttct

SEQ ID NO: 6000073 - DNA, 18 bp, Homo sapiens
cacccttctcccactctc

SEQ ID NO: 6000074 - DNA, 19 bp, Homo sapiens
cacccttctcccactctcc

SEQ ID NO: 6000075 - DNA, 21 bp, Homo sapiens
cacccttctcccactctccta

SEQ ID NO: 6000076 - DNA, 18 bp, Homo sapiens
cacccttctttcctcttc

SEQ ID NO: 6000077 - DNA, 21 bp, Homo sapiens
cacccttctttcctcttcccc

SEQ ID NO: 6000078 - DNA, 13 bp, Homo sapiens
cacccttcttttc

SEQ ID NO: 6000079 - DNA, 19 bp, Homo sapiens
cacccttgaaaactctcag

SEQ ID NO: 6000080 - DNA, 19 bp, Homo sapiens
cacccttgccatcccaagc

SEQ ID NO: 6000081 - DNA, 12 bp, Homo sapiens
cacccttgccca

SEQ ID NO: 6000082 - DNA, 19 bp, Homo sapiens
cacccttggacaagacaaa

SEQ ID NO: 6000083 - DNA, 13 bp, Homo sapiens
cacccttggactt

SEQ ID NO: 6000084 - DNA, 14 bp, Homo sapiens
cacccttggacttg

SEQ ID NO: 6000085 - DNA, 20 bp, Homo sapiens
cacccttggaggctgtcttc

SEQ ID NO: 6000086 - DNA, 22 bp, Homo sapiens
cacccttggaggctgtcttctc

SEQ ID NO: 6000087 - DNA, 18 bp, Homo sapiens
cacccttggcctgtctca

SEQ ID NO: 6000088 - DNA, 21 bp, Homo sapiens
cacccttggcctgtctcatcc

SEQ ID NO: 6000089 - DNA, 15 bp, Homo sapiens
cacccttgggcagag

SEQ ID NO: 6000090 - DNA, 18 bp, Homo sapiens
cacccttggtctcatgcc

SEQ ID NO: 6000091 - DNA, 22 bp, Homo sapiens
cacccttggtctcatgccccgc

SEQ ID NO: 6000092 - DNA, 18 bp, Homo sapiens
cacccttggttcctaact

SEQ ID NO: 6000093 - DNA, 13 bp, Homo sapiens
cacccttgttcca

SEQ ID NO: 6000094 - DNA, 22 bp, Homo sapiens
caccctttacattttgtgcagt

SEQ ID NO: 6000095 - DNA, 16 bp, Homo sapiens
caccctttccaggaat

SEQ ID NO: 6000096 - DNA, 18 bp, Homo sapiens
caccctttctgccaggga

SEQ ID NO: 6000097 - DNA, 19 bp, Homo sapiens
caccctttctgccagggat

SEQ ID NO: 6000098 - DNA, 19 bp, Homo sapiens
caccctttcttgacaaaac

SEQ ID NO: 6000099 - DNA, 23 bp, Homo sapiens
caccctttggagaccaggcctca

SEQ ID NO: 6000100 - DNA, 15 bp, Homo sapiens
cacccttttccagct

SEQ ID NO: 6000101 - DNA, 17 bp, Homo sapiens
cacccttttccagctgg

SEQ ID NO: 6000102 - DNA, 21 bp, Homo sapiens
caccgaaaacgtggctgcttc

SEQ ID NO: 6000103 - DNA, 19 bp, Homo sapiens
caccgaagagccctgagct

SEQ ID NO: 6000104 - DNA, 16 bp, Homo sapiens
caccgaagaggaagca

SEQ ID NO: 6000105 - DNA, 21 bp, Homo sapiens
caccgaagcccagagggtctg

SEQ ID NO: 6000106 - DNA, 17 bp, Homo sapiens
caccgaatatattactg

SEQ ID NO: 6000107 - DNA, 18 bp, Homo sapiens
caccgaatatattactga

SEQ ID NO: 6000108 - DNA, 12 bp, Homo sapiens
caccgaccaact

SEQ ID NO: 6000109 - DNA, 17 bp, Homo sapiens
caccgaccccctttcta

SEQ ID NO: 6000110 - DNA, 16 bp, Homo sapiens
caccgaccccgggccg

SEQ ID NO: 6000111 - DNA, 23 bp, Homo sapiens
caccgacccgacactctcacccc

SEQ ID NO: 6000112 - DNA, 15 bp, Homo sapiens
caccgacccgaggcc

SEQ ID NO: 6000113 - DNA, 19 bp, Homo sapiens
caccgacccgaggcccaga

SEQ ID NO: 6000114 - DNA, 15 bp, Homo sapiens
caccgacccttcctg

SEQ ID NO: 6000115 - DNA, 15 bp, Homo sapiens
caccgactagccagg

SEQ ID NO: 6000116 - DNA, 16 bp, Homo sapiens
caccgactcacctgcg

SEQ ID NO: 6000117 - DNA, 12 bp, Homo sapiens
caccgactgccc

SEQ ID NO: 6000118 - DNA, 13 bp, Homo sapiens
caccgactgccca

SEQ ID NO: 6000119 - DNA, 19 bp, Homo sapiens
caccgactgcccagccact

SEQ ID NO: 6000120 - DNA, 20 bp, Homo sapiens
caccgactgcccagccactc

SEQ ID NO: 6000121 - DNA, 22 bp, Homo sapiens
caccgacttcaatttcccaccc

SEQ ID NO: 6000122 - DNA, 15 bp, Homo sapiens
caccgagactcagcc

SEQ ID NO: 6000123 - DNA, 16 bp, Homo sapiens
caccgagactcagcct

SEQ ID NO: 6000124 - DNA, 19 bp, Homo sapiens
caccgagactcagcctctg

SEQ ID NO: 6000125 - DNA, 22 bp, Homo sapiens
caccgagactcagcctctgctg

SEQ ID NO: 6000126 - DNA, 22 bp, Homo sapiens
caccgagaggaaaaaggcttct

SEQ ID NO: 6000127 - DNA, 18 bp, Homo sapiens
caccgagagtagccgaga

SEQ ID NO: 6000128 - DNA, 21 bp, Homo sapiens
caccgagagtagccgagagcc

SEQ ID NO: 6000129 - DNA, 22 bp, Homo sapiens
caccgagcgggtgcaagcactc

SEQ ID NO: 6000130 - DNA, 19 bp, Homo sapiens
caccgagctctgtgggaaa

SEQ ID NO: 6000131 - DNA, 16 bp, Homo sapiens
caccgaggagccccag

SEQ ID NO: 6000132 - DNA, 14 bp, Homo sapiens
caccgaggccagcg

SEQ ID NO: 6000133 - DNA, 22 bp, Homo sapiens
caccgagtgatttccatctctg

SEQ ID NO: 6000134 - DNA, 13 bp, Homo sapiens
caccgcagaagga

SEQ ID NO: 6000135 - DNA, 14 bp, Homo sapiens
caccgcagaaggaa

SEQ ID NO: 6000136 - DNA, 12 bp, Homo sapiens
caccgcagacag

SEQ ID NO: 6000137 - DNA, 14 bp, Homo sapiens
caccgcagacagga

SEQ ID NO: 6000138 - DNA, 18 bp, Homo sapiens
caccgcagacaggaccag

SEQ ID NO: 6000139 - DNA, 21 bp, Homo sapiens
caccgcagacaggaccaggga

SEQ ID NO: 6000140 - DNA, 16 bp, Homo sapiens
caccgcagcctgtcag

SEQ ID NO: 6000141 - DNA, 20 bp, Homo sapiens
caccgcagcctgtcagccaa

SEQ ID NO: 6000142 - DNA, 15 bp, Homo sapiens
caccgcagcgtcccc

SEQ ID NO: 6000143 - DNA, 16 bp, Homo sapiens
caccgcagcgtccccc

SEQ ID NO: 6000144 - DNA, 20 bp, Homo sapiens
caccgcagctgctgccactc

SEQ ID NO: 6000145 - DNA, 21 bp, Homo sapiens
caccgcagctgctgccactct

SEQ ID NO: 6000146 - DNA, 22 bp, Homo sapiens
caccgcagctgctgccactctg

SEQ ID NO: 6000147 - DNA, 20 bp, Homo sapiens
caccgcaggggactgtctca

SEQ ID NO: 6000148 - DNA, 12 bp, Homo sapiens
caccgcaggtgc

SEQ ID NO: 6000149 - DNA, 19 bp, Homo sapiens
caccgcagtcgtcgcacag

SEQ ID NO: 6000150 - DNA, 17 bp, Homo sapiens
caccgcatatgcatgcc

SEQ ID NO: 6000151 - DNA, 14 bp, Homo sapiens
caccgcatgccccc

SEQ ID NO: 6000152 - DNA, 15 bp, Homo sapiens
caccgcatgccccct

SEQ ID NO: 6000153 - DNA, 21 bp, Homo sapiens
caccgcattagagctcgaaat

SEQ ID NO: 6000154 - DNA, 15 bp, Homo sapiens
caccgcattccaggg

SEQ ID NO: 6000155 - DNA, 18 bp, Homo sapiens
caccgcattccaggggct

SEQ ID NO: 6000156 - DNA, 19 bp, Homo sapiens
caccgcattccaggggctg

SEQ ID NO: 6000157 - DNA, 18 bp, Homo sapiens
caccgccaccccactgag

SEQ ID NO: 6000158 - DNA, 15 bp, Homo sapiens
caccgccagaggaca

SEQ ID NO: 6000159 - DNA, 17 bp, Homo sapiens
caccgccagaggacaag

SEQ ID NO: 6000160 - DNA, 17 bp, Homo sapiens
caccgccagagtgtcct

SEQ ID NO: 6000161 - DNA, 12 bp, Homo sapiens
caccgccatgca

SEQ ID NO: 6000162 - DNA, 13 bp, Homo sapiens
caccgccatgcat

SEQ ID NO: 6000163 - DNA, 22 bp, Homo sapiens
caccgccatggcttccaaggtg

SEQ ID NO: 6000164 - DNA, 15 bp, Homo sapiens
caccgcccaaccccc

SEQ ID NO: 6000165 - DNA, 13 bp, Homo sapiens
caccgcccactct

SEQ ID NO: 6000166 - DNA, 14 bp, Homo sapiens
caccgcccactctc

SEQ ID NO: 6000167 - DNA, 20 bp, Homo sapiens
caccgcccactctccacctc

SEQ ID NO: 6000168 - DNA, 21 bp, Homo sapiens
caccgcccctggacaggcttc

SEQ ID NO: 6000169 - DNA, 13 bp, Homo sapiens
caccgcccgtctg

SEQ ID NO: 6000170 - DNA, 15 bp, Homo sapiens
caccgcccgtctgtg

SEQ ID NO: 6000171 - DNA, 17 bp, Homo sapiens
caccgccctcctcgctg

SEQ ID NO: 6000172 - DNA, 21 bp, Homo sapiens
caccgccctcctcgctgtgcc

SEQ ID NO: 6000173 - DNA, 22 bp, Homo sapiens
caccgccctcctcgctgtgcca

SEQ ID NO: 6000174 - DNA, 23 bp, Homo sapiens
caccgccctcctcgctgtgccac

SEQ ID NO: 6000175 - DNA, 21 bp, Homo sapiens
caccgccgagttaaagaggag

SEQ ID NO: 6000176 - DNA, 14 bp, Homo sapiens
caccgccgcagaag

SEQ ID NO: 6000177 - DNA, 15 bp, Homo sapiens
caccgccgcagaagc

SEQ ID NO: 6000178 - DNA, 18 bp, Homo sapiens
caccgccgcagaagcagc

SEQ ID NO: 6000179 - DNA, 20 bp, Homo sapiens
caccgccgcagaagcagccc

SEQ ID NO: 6000180 - DNA, 20 bp, Homo sapiens
caccgcctgaaggcacagct

SEQ ID NO: 6000181 - DNA, 20 bp, Homo sapiens
caccgcctgcccccagcgtg

SEQ ID NO: 6000182 - DNA, 15 bp, Homo sapiens
caccgcctgccctcc

SEQ ID NO: 6000183 - DNA, 15 bp, Homo sapiens
caccgccttgcccag

SEQ ID NO: 6000184 - DNA, 17 bp, Homo sapiens
caccgccttgcccagcc

SEQ ID NO: 6000185 - DNA, 15 bp, Homo sapiens
caccgcgaggcctat

SEQ ID NO: 6000186 - DNA, 17 bp, Homo sapiens
caccgcgcccctctgcg

SEQ ID NO: 6000187 - DNA, 18 bp, Homo sapiens
caccgcggacgtgctggc

SEQ ID NO: 6000188 - DNA, 14 bp, Homo sapiens
caccgcggcgcctc

SEQ ID NO: 6000189 - DNA, 19 bp, Homo sapiens
caccgcgggtgtgggaaag

SEQ ID NO: 6000190 - DNA, 15 bp, Homo sapiens
caccgctcagtatta

SEQ ID NO: 6000191 - DNA, 12 bp, Homo sapiens
caccgctcagtg

SEQ ID NO: 6000192 - DNA, 20 bp, Homo sapiens
caccgctcagtgtcagcggg

SEQ ID NO: 6000193 - DNA, 17 bp, Homo sapiens
caccgctgccagcacag

SEQ ID NO: 6000194 - DNA, 13 bp, Homo sapiens
caccgctgcctaa

SEQ ID NO: 6000195 - DNA, 19 bp, Homo sapiens
caccgctgcctaagtggct

SEQ ID NO: 6000196 - DNA, 12 bp, Homo sapiens
caccgctgcctc

SEQ ID NO: 6000197 - DNA, 16 bp, Homo sapiens
caccgctgccttttgc

SEQ ID NO: 6000198 - DNA, 21 bp, Homo sapiens
caccgctgccttttgctgctg

SEQ ID NO: 6000199 - DNA, 19 bp, Homo sapiens
caccgctgctccacgcgct

SEQ ID NO: 6000200 - DNA, 12 bp, Homo sapiens
caccgctggtcc

SEQ ID NO: 6000201 - DNA, 16 bp, Homo sapiens
caccgctggttggaaa

SEQ ID NO: 6000202 - DNA, 23 bp, Homo sapiens
caccgcttccggctcctgtgctt

SEQ ID NO: 6000203 - DNA, 19 bp, Homo sapiens
caccgcttttgttctcgca

SEQ ID NO: 6000204 - DNA, 15 bp, Homo sapiens
caccggaactgggct

SEQ ID NO: 6000205 - DNA, 17 bp, Homo sapiens
caccggaactgggctgg

SEQ ID NO: 6000206 - DNA, 17 bp, Homo sapiens
caccggaccagcctggc

SEQ ID NO: 6000207 - DNA, 17 bp, Homo sapiens
caccggagtatgtgcag

SEQ ID NO: 6000208 - DNA, 18 bp, Homo sapiens
caccggagtatgtgcagt

SEQ ID NO: 6000209 - DNA, 15 bp, Homo sapiens
caccggatcctgggt

SEQ ID NO: 6000210 - DNA, 15 bp, Homo sapiens
caccggcactgtgca

SEQ ID NO: 6000211 - DNA, 13 bp, Homo sapiens
caccggcatgctg

SEQ ID NO: 6000212 - DNA, 22 bp, Homo sapiens
caccggcatgctggcctgtggc

SEQ ID NO: 6000213 - DNA, 18 bp, Homo sapiens
caccggccgatggagaca

SEQ ID NO: 6000214 - DNA, 16 bp, Homo sapiens
caccggcctggctgca

SEQ ID NO: 6000215 - DNA, 20 bp, Homo sapiens
caccggcctgtgggtctctg

SEQ ID NO: 6000216 - DNA, 16 bp, Homo sapiens
caccggcgctgcaggt

SEQ ID NO: 6000217 - DNA, 21 bp, Homo sapiens
caccggctctcacctggccct

SEQ ID NO: 6000218 - DNA, 18 bp, Homo sapiens
caccggctggcctggccc

SEQ ID NO: 6000219 - DNA, 19 bp, Homo sapiens
caccgggacagacctggac

SEQ ID NO: 6000220 - DNA, 22 bp, Homo sapiens
caccgggaccccctcaccatcc

SEQ ID NO: 6000221 - DNA, 13 bp, Homo sapiens
caccgggagcctc

SEQ ID NO: 6000222 - DNA, 18 bp, Homo sapiens
cagccccggtggctgggc

SEQ ID NO: 6000223 - DNA, 16 bp, Homo sapiens
cagccccgtcccagag

SEQ ID NO: 6000224 - DNA, 18 bp, Homo sapiens
cagccccgtcccagaggc

SEQ ID NO: 6000225 - DNA, 19 bp, Homo sapiens
cagccccgtcccagaggcc

SEQ ID NO: 6000226 - DNA, 20 bp, Homo sapiens
cagccccgtcccagaggccg

SEQ ID NO: 6000227 - DNA, 16 bp, Homo sapiens
cagccccgtctgccca

SEQ ID NO: 6000228 - DNA, 18 bp, Homo sapiens
cagccccgtctgcccacc

SEQ ID NO: 6000229 - DNA, 15 bp, Homo sapiens
cagccccgtgccagg

SEQ ID NO: 6000230 - DNA, 19 bp, Homo sapiens
cagcccctaagtgcaaaca

SEQ ID NO: 6000231 - DNA, 18 bp, Homo sapiens
cagcccctacccctgccc

SEQ ID NO: 6000232 - DNA, 19 bp, Homo sapiens
cagcccctacccctgccct

SEQ ID NO: 6000233 - DNA, 14 bp, Homo sapiens
cagcccctactgct

SEQ ID NO: 6000234 - DNA, 16 bp, Homo sapiens
cagcccctactgctgt

SEQ ID NO: 6000235 - DNA, 20 bp, Homo sapiens
cagcccctactgctgtgaac

SEQ ID NO: 6000236 - DNA, 20 bp, Homo sapiens
cagcccctagatgaagaaag

SEQ ID NO: 6000237 - DNA, 13 bp, Homo sapiens
cagcccctagccc

SEQ ID NO: 6000238 - DNA, 15 bp, Homo sapiens
cagcccctagcccag

SEQ ID NO: 6000239 - DNA, 16 bp, Homo sapiens
cagcccctagcccagg

SEQ ID NO: 6000240 - DNA, 17 bp, Homo sapiens
cagcccctagcccagga

SEQ ID NO: 6000241 - DNA, 22 bp, Homo sapiens
cagcccctagcccaggagagag

SEQ ID NO: 6000242 - DNA, 16 bp, Homo sapiens
cagcccctcaaaggga

SEQ ID NO: 6000243 - DNA, 19 bp, Homo sapiens
cagcccctcatcagccttt

SEQ ID NO: 6000244 - DNA, 23 bp, Homo sapiens
cagcccctcatcagccttttcag

SEQ ID NO: 6000245 - DNA, 11 bp, Homo sapiens
cagcccctccc

SEQ ID NO: 6000246 - DNA, 13 bp, Homo sapiens
cagcccctcccag

SEQ ID NO: 6000247 - DNA, 13 bp, Homo sapiens
cagcccctcccca

SEQ ID NO: 6000248 - DNA, 14 bp, Homo sapiens
cagcccctccccag

SEQ ID NO: 6000249 - DNA, 19 bp, Homo sapiens
cagcccctccccagactct

SEQ ID NO: 6000250 - DNA, 14 bp, Homo sapiens
cagcccctccccca

SEQ ID NO: 6000251 - DNA, 19 bp, Homo sapiens
cagcccctccccgcctcct

SEQ ID NO: 6000252 - DNA, 20 bp, Homo sapiens
cagcccctccccgcctcctc

SEQ ID NO: 6000253 - DNA, 22 bp, Homo sapiens
cagcccctcctccccttcctgc

SEQ ID NO: 6000254 - DNA, 21 bp, Homo sapiens
cagcccctcctccctcaaacc

SEQ ID NO: 6000255 - DNA, 19 bp, Homo sapiens
cagcccctcctccctcaga

SEQ ID NO: 6000256 - DNA, 22 bp, Homo sapiens
cagcccctcctccctcaggccc

SEQ ID NO: 6000257 - DNA, 14 bp, Homo sapiens
cagcccctcctctg

SEQ ID NO: 6000258 - DNA, 20 bp, Homo sapiens
cagcccctcctctgccacct

SEQ ID NO: 6000259 - DNA, 22 bp, Homo sapiens
cagcccctcctctgccacctcc

SEQ ID NO: 6000260 - DNA, 12 bp, Homo sapiens
cagcccctcgag

SEQ ID NO: 6000261 - DNA, 18 bp, Homo sapiens
cagcccctcgaggcctac

SEQ ID NO: 6000262 - DNA, 20 bp, Homo sapiens
cagcccctcgaggcctacag

SEQ ID NO: 6000263 - DNA, 22 bp, Homo sapiens
cagcccctcgaggcctacagag

SEQ ID NO: 6000264 - DNA, 21 bp, Homo sapiens
cagcccctctcccctctctgc

SEQ ID NO: 6000265 - DNA, 16 bp, Homo sapiens
cagcccctctggtcgc

SEQ ID NO: 6000266 - DNA, 15 bp, Homo sapiens
cagcccctcttccct

SEQ ID NO: 6000267 - DNA, 14 bp, Homo sapiens
cagcccctgagagc

SEQ ID NO: 6000268 - DNA, 20 bp, Homo sapiens
cagcccctgatcctgtgaag

SEQ ID NO: 6000269 - DNA, 18 bp, Homo sapiens
cagcccctgatctctgac

SEQ ID NO: 6000270 - DNA, 22 bp, Homo sapiens
cagcccctgatctctgacctct

SEQ ID NO: 6000271 - DNA, 14 bp, Homo sapiens
cagcccctgcagat

SEQ ID NO: 6000272 - DNA, 17 bp, Homo sapiens
cagcccctgcagattct

SEQ ID NO: 6000273 - DNA, 22 bp, Homo sapiens
cagcccctgcagattctgagca

SEQ ID NO: 6000274 - DNA, 22 bp, Homo sapiens
cagcccctgccccagcccaagt

SEQ ID NO: 6000275 - DNA, 14 bp, Homo sapiens
cagcccctgcccct

SEQ ID NO: 6000276 - DNA, 15 bp, Homo sapiens
cagcccctgcctggg

SEQ ID NO: 6000277 - DNA, 16 bp, Homo sapiens
cagcccctgcctgggt

SEQ ID NO: 6000278 - DNA, 14 bp, Homo sapiens
cagcccctgctgct

SEQ ID NO: 6000279 - DNA, 23 bp, Homo sapiens
cagcccctgctgctcctcggcca

SEQ ID NO: 6000280 - DNA, 13 bp, Homo sapiens
cagcccctgctgg

SEQ ID NO: 6000281 - DNA, 23 bp, Homo sapiens
cagcccctgctggctggtgcctg

SEQ ID NO: 6000282 - DNA, 14 bp, Homo sapiens
cagcccctggaccc

SEQ ID NO: 6000283 - DNA, 15 bp, Homo sapiens
cagcccctggagcct

SEQ ID NO: 6000284 - DNA, 17 bp, Homo sapiens
cagcccctggagcctca

SEQ ID NO: 6000285 - DNA, 20 bp, Homo sapiens
cagcccctggagcctcagaa

SEQ ID NO: 6000286 - DNA, 20 bp, Homo sapiens
cagcccctggagctcctgct

SEQ ID NO: 6000287 - DNA, 14 bp, Homo sapiens
cagcccctggatgc

SEQ ID NO: 6000288 - DNA, 18 bp, Homo sapiens
cagcccctggatgcagcc

SEQ ID NO: 6000289 - DNA, 13 bp, Homo sapiens
cagcccctggcac

SEQ ID NO: 6000290 - DNA, 12 bp, Homo sapiens
cagcccctggga

SEQ ID NO: 6000291 - DNA, 17 bp, Homo sapiens
cagcccctgggaacagg

SEQ ID NO: 6000292 - DNA, 22 bp, Homo sapiens
cagcccctgggaacaggcccca

SEQ ID NO: 6000293 - DNA, 14 bp, Homo sapiens
cagcccctggggcc

SEQ ID NO: 6000294 - DNA, 20 bp, Homo sapiens
cagcccctggggcccagccc

SEQ ID NO: 6000295 - DNA, 19 bp, Homo sapiens
cagcccctggtactccccc

SEQ ID NO: 6000296 - DNA, 13 bp, Homo sapiens
cagcccctgtccc

SEQ ID NO: 6000297 - DNA, 14 bp, Homo sapiens
cagcccctgtccca

SEQ ID NO: 6000298 - DNA, 21 bp, Homo sapiens
cagcccctgttctggcagagt

SEQ ID NO: 6000299 - DNA, 21 bp, Homo sapiens
cagccccttagacagaggccc

SEQ ID NO: 6000300 - DNA, 19 bp, Homo sapiens
cagccccttcccctgggaa

SEQ ID NO: 6000301 - DNA, 13 bp, Homo sapiens
cagccccttcccg

SEQ ID NO: 6000302 - DNA, 13 bp, Homo sapiens
cagccccttcctg

SEQ ID NO: 6000303 - DNA, 18 bp, Homo sapiens
cagccccttcctgggtat

SEQ ID NO: 6000304 - DNA, 16 bp, Homo sapiens
cagccccttctcagaa

SEQ ID NO: 6000305 - DNA, 13 bp, Homo sapiens
cagccccttctcc

SEQ ID NO: 6000306 - DNA, 20 bp, Homo sapiens
cagccccttctcccagcaca

SEQ ID NO: 6000307 - DNA, 14 bp, Homo sapiens
cagccccttctggc

SEQ ID NO: 6000308 - DNA, 17 bp, Homo sapiens
cagccccttgagaaacc

SEQ ID NO: 6000309 - DNA, 18 bp, Homo sapiens
cagccccttgagaaacct

SEQ ID NO: 6000310 - DNA, 13 bp, Homo sapiens
cagcccctttccc

SEQ ID NO: 6000311 - DNA, 15 bp, Homo sapiens
cagcccctttccctt

SEQ ID NO: 6000312 - DNA, 23 bp, Homo sapiens
cagcccctttcccttgtagctcc

SEQ ID NO: 6000313 - DNA, 16 bp, Homo sapiens
cagcccctttgcctct

SEQ ID NO: 6000314 - DNA, 16 bp, Homo sapiens
cagccccttttctctg

SEQ ID NO: 6000315 - DNA, 18 bp, Homo sapiens
cagccccttttctctgct

SEQ ID NO: 6000316 - DNA, 13 bp, Homo sapiens
cagcccgaacacc

SEQ ID NO: 6000317 - DNA, 17 bp, Homo sapiens
cagcccgaagcccagtt

SEQ ID NO: 6000318 - DNA, 15 bp, Homo sapiens
cagcccgaatgcctg

SEQ ID NO: 6000319 - DNA, 19 bp, Homo sapiens
cagcccgacaatgtcgagt

SEQ ID NO: 6000320 - DNA, 22 bp, Homo sapiens
cagcccgagtggtctcctctca

SEQ ID NO: 6000321 - DNA, 23 bp, Homo sapiens
cagcccgagtggtctcctctcag

SEQ ID NO: 6000322 - DNA, 17 bp, Homo sapiens
cagcccgatcctcccct

SEQ ID NO: 6000323 - DNA, 16 bp, Homo sapiens
cagcccgatgtccctg

SEQ ID NO: 6000324 - DNA, 18 bp, Homo sapiens
cagcccgatgtccctgtc

SEQ ID NO: 6000325 - DNA, 15 bp, Homo sapiens
cagcccgcacacctg

SEQ ID NO: 6000326 - DNA, 16 bp, Homo sapiens
cagcccgcacacctgc

SEQ ID NO: 6000327 - DNA, 22 bp, Homo sapiens
cagcccgcatcagctgctcaga

SEQ ID NO: 6000328 - DNA, 15 bp, Homo sapiens
cagcccgcatgcagc

SEQ ID NO: 6000329 - DNA, 21 bp, Homo sapiens
cagcccgcatgcagcagcttg

SEQ ID NO: 6000330 - DNA, 13 bp, Homo sapiens
cagcccgcctgcc

SEQ ID NO: 6000331 - DNA, 17 bp, Homo sapiens
cagcccgcggcctggac

SEQ ID NO: 6000332 - DNA, 17 bp, Homo sapiens
cagcccgctaggctcgc

SEQ ID NO: 6000333 - DNA, 17 bp, Homo sapiens
cagcccgctctctggct

SEQ ID NO: 6000334 - DNA, 16 bp, Homo sapiens
cagcccgctgagtgga

SEQ ID NO: 6000335 - DNA, 12 bp, Homo sapiens
cagcccgcttgg

SEQ ID NO: 6000336 - DNA, 17 bp, Homo sapiens
cagcccgcttggccacc

SEQ ID NO: 6000337 - DNA, 22 bp, Homo sapiens
cagcccggacctctggagtgcc

SEQ ID NO: 6000338 - DNA, 18 bp, Homo sapiens
cagcccggaccttggcag

SEQ ID NO: 6000339 - DNA, 20 bp, Homo sapiens
cagcccggcctgctcccagc

SEQ ID NO: 6000340 - DNA, 22 bp, Homo sapiens
cagcccggcggggaccttggtc

SEQ ID NO: 6000341 - DNA, 23 bp, Homo sapiens
cagcccggcggggaccttggtct

SEQ ID NO: 6000342 - DNA, 18 bp, Homo sapiens
cagcccggctcggcccag

SEQ ID NO: 6000343 - DNA, 13 bp, Homo sapiens
cagcccggctgct

SEQ ID NO: 6000344 - DNA, 16 bp, Homo sapiens
cagcccggctgctgct

SEQ ID NO: 6000345 - DNA, 14 bp, Homo sapiens
cagcccggctggtt

SEQ ID NO: 6000346 - DNA, 19 bp, Homo sapiens
cagcccggctggttttgta

SEQ ID NO: 6000347 - DNA, 22 bp, Homo sapiens
cagcccggctggttttgtaaga

SEQ ID NO: 6000348 - DNA, 14 bp, Homo sapiens
cagcccgggacagg

SEQ ID NO: 6000349 - DNA, 15 bp, Homo sapiens
cagcccgggagccta

SEQ ID NO: 6000350 - DNA, 16 bp, Homo sapiens
cagcccgggagcctag

SEQ ID NO: 6000351 - DNA, 17 bp, Homo sapiens
cagcccgggagctttga

SEQ ID NO: 6000352 - DNA, 18 bp, Homo sapiens
cagcccgggagctttgag

SEQ ID NO: 6000353 - DNA, 15 bp, Homo sapiens
cagcccgggctctgc

SEQ ID NO: 6000354 - DNA, 16 bp, Homo sapiens
cagcccgggctctgcc

SEQ ID NO: 6000355 - DNA, 18 bp, Homo sapiens
cagcccgggctctgcctc

SEQ ID NO: 6000356 - DNA, 15 bp, Homo sapiens
cagcccggggaggaa

SEQ ID NO: 6000357 - DNA, 19 bp, Homo sapiens
cagcccggggcaggtgcag

SEQ ID NO: 6000358 - DNA, 21 bp, Homo sapiens
cagcccgggtgtgcctgccct

SEQ ID NO: 6000359 - DNA, 22 bp, Homo sapiens
cagcccgggtgtgcctgccctg

SEQ ID NO: 6000360 - DNA, 20 bp, Homo sapiens
cagcccggtgtgaggagggg

SEQ ID NO: 6000361 - DNA, 22 bp, Homo sapiens
cagcccgtgaagcagtgcctcg

SEQ ID NO: 6000362 - DNA, 19 bp, Homo sapiens
cagcccgtgatcccctgct

SEQ ID NO: 6000363 - DNA, 17 bp, Homo sapiens
cagcccgtgcaccctgg

SEQ ID NO: 6000364 - DNA, 17 bp, Homo sapiens
cagcccgtgtggcccct

SEQ ID NO: 6000365 - DNA, 19 bp, Homo sapiens
cagccctaaggatctctca

SEQ ID NO: 6000366 - DNA, 23 bp, Homo sapiens
cagccctaagtggctgccttctt

SEQ ID NO: 6000367 - DNA, 18 bp, Homo sapiens
cagccctacatcttcagc

SEQ ID NO: 6000368 - DNA, 21 bp, Homo sapiens
cagccctaccttaaggaaagt

SEQ ID NO: 6000369 - DNA, 12 bp, Homo sapiens
cagccctagagc

SEQ ID NO: 6000370 - DNA, 21 bp, Homo sapiens
cagccctagaggcgagccagg

SEQ ID NO: 6000371 - DNA, 15 bp, Homo sapiens
cagccctagcggctg

SEQ ID NO: 6000372 - DNA, 22 bp, Homo sapiens
cagccctagctgtcccatgggg

SEQ ID NO: 6000373 - DNA, 18 bp, Homo sapiens
cagccctagggtggagag

SEQ ID NO: 6000374 - DNA, 23 bp, Homo sapiens
cagccctagtatgaaagctgggg

SEQ ID NO: 6000375 - DNA, 19 bp, Homo sapiens
cagccctagtgggagccca

SEQ ID NO: 6000376 - DNA, 13 bp, Homo sapiens
cagccctcaacag

SEQ ID NO: 6000377 - DNA, 22 bp, Homo sapiens
cagccctcaacaggcccaggga

SEQ ID NO: 6000378 - DNA, 19 bp, Homo sapiens
cagccctcacacaccctgt

SEQ ID NO: 6000379 - DNA, 20 bp, Homo sapiens
cagccctcacctctgaggac

SEQ ID NO: 6000380 - DNA, 12 bp, Homo sapiens
cagccctcaggc

SEQ ID NO: 6000381 - DNA, 13 bp, Homo sapiens
cagccctcaggcc

SEQ ID NO: 6000382 - DNA, 15 bp, Homo sapiens
cagccctcaggccag

SEQ ID NO: 6000383 - DNA, 17 bp, Homo sapiens
cagccctcaggccagtg

SEQ ID NO: 6000384 - DNA, 23 bp, Homo sapiens
cagccctcaggccagtgccagga

SEQ ID NO: 6000385 - DNA, 18 bp, Homo sapiens
cagccctcattggctctt

SEQ ID NO: 6000386 - DNA, 12 bp, Homo sapiens
cagccctccaga

SEQ ID NO: 6000387 - DNA, 15 bp, Homo sapiens
cagccctccagagca

SEQ ID NO: 6000388 - DNA, 18 bp, Homo sapiens
cagccctccagagcagga

SEQ ID NO: 6000389 - DNA, 22 bp, Homo sapiens
cagccctccatctaaactgccc

SEQ ID NO: 6000390 - DNA, 12 bp, Homo sapiens
cagccctcccag

SEQ ID NO: 6000391 - DNA, 13 bp, Homo sapiens
cagccctcccagc

SEQ ID NO: 6000392 - DNA, 15 bp, Homo sapiens
cagccctcccagctg

SEQ ID NO: 6000393 - DNA, 18 bp, Homo sapiens
cagccctccccacctgct

SEQ ID NO: 6000394 - DNA, 20 bp, Homo sapiens
cagccctcccgccccttccc

SEQ ID NO: 6000395 - DNA, 18 bp, Homo sapiens
cagccctccctgtcctcc

SEQ ID NO: 6000396 - DNA, 21 bp, Homo sapiens
cagccctccctgtcctcctcg

SEQ ID NO: 6000397 - DNA, 21 bp, Homo sapiens
cagccctccgaccctcatggc

SEQ ID NO: 6000398 - DNA, 20 bp, Homo sapiens
cagccctccgccagccctgt

SEQ ID NO: 6000399 - DNA, 16 bp, Homo sapiens
cagccctcctcacccc

SEQ ID NO: 6000400 - DNA, 19 bp, Homo sapiens
caccgggagcctccccctc

SEQ ID NO: 6000401 - DNA, 15 bp, Homo sapiens
caccgggcactcaga

SEQ ID NO: 6000402 - DNA, 13 bp, Homo sapiens
caccgggcagggc

SEQ ID NO: 6000403 - DNA, 14 bp, Homo sapiens
caccgggcagggcc

SEQ ID NO: 6000404 - DNA, 20 bp, Homo sapiens
caccgggcatgtctgcctgg

SEQ ID NO: 6000405 - DNA, 22 bp, Homo sapiens
caccgggcgcatgcctcccagg

SEQ ID NO: 6000406 - DNA, 22 bp, Homo sapiens
caccgggctccatgcctctgga

SEQ ID NO: 6000407 - DNA, 12 bp, Homo sapiens
caccgggctgca

SEQ ID NO: 6000408 - DNA, 13 bp, Homo sapiens
caccgggctgcag

SEQ ID NO: 6000409 - DNA, 16 bp, Homo sapiens
caccgggctggctgct

SEQ ID NO: 6000410 - DNA, 21 bp, Homo sapiens
caccggggcactggctgctct

SEQ ID NO: 6000411 - DNA, 15 bp, Homo sapiens
caccggggcctcgga

SEQ ID NO: 6000412 - DNA, 20 bp, Homo sapiens
caccgggttctgcagcggca

SEQ ID NO: 6000413 - DNA, 15 bp, Homo sapiens
caccggtcagtgcct

SEQ ID NO: 6000414 - DNA, 16 bp, Homo sapiens
caccggtcagtgcctt

SEQ ID NO: 6000415 - DNA, 18 bp, Homo sapiens
caccggtcagtgcctttt

SEQ ID NO: 6000416 - DNA, 15 bp, Homo sapiens
caccggtccagctgg

SEQ ID NO: 6000417 - DNA, 16 bp, Homo sapiens
caccggtccagctggc

SEQ ID NO: 6000418 - DNA, 18 bp, Homo sapiens
caccggtccagctggcct

SEQ ID NO: 6000419 - DNA, 23 bp, Homo sapiens
caccggtgccaaacccagcccct

SEQ ID NO: 6000420 - DNA, 15 bp, Homo sapiens
caccggttgcttctg

SEQ ID NO: 6000421 - DNA, 17 bp, Homo sapiens
caccggttgcttctggg

SEQ ID NO: 6000422 - DNA, 21 bp, Homo sapiens
caccggttgcttctgggaagg

SEQ ID NO: 6000423 - DNA, 23 bp, Homo sapiens
caccgtagggcctgactccttct

SEQ ID NO: 6000424 - DNA, 19 bp, Homo sapiens
caccgtagtaacacataaa

SEQ ID NO: 6000425 - DNA, 17 bp, Homo sapiens
caccgtattagccagga

SEQ ID NO: 6000426 - DNA, 19 bp, Homo sapiens
caccgtcatggcttaatgt

SEQ ID NO: 6000427 - DNA, 15 bp, Homo sapiens
caccgtccaggcccc

SEQ ID NO: 6000428 - DNA, 16 bp, Homo sapiens
caccgtcccagggctc

SEQ ID NO: 6000429 - DNA, 13 bp, Homo sapiens
caccgtcccgcac

SEQ ID NO: 6000430 - DNA, 19 bp, Homo sapiens
caccgtcccgcacagtgga

SEQ ID NO: 6000431 - DNA, 22 bp, Homo sapiens
caccgtcccgccagtgcagatc

SEQ ID NO: 6000432 - DNA, 16 bp, Homo sapiens
caccgtccctctcccc

SEQ ID NO: 6000433 - DNA, 16 bp, Homo sapiens
caccgtccctctgcag

SEQ ID NO: 6000434 - DNA, 17 bp, Homo sapiens
caccgtccctctgcaga

SEQ ID NO: 6000435 - DNA, 18 bp, Homo sapiens
caccgtccgccctgctcc

SEQ ID NO: 6000436 - DNA, 17 bp, Homo sapiens
caccgtcctgtcagctc

SEQ ID NO: 6000437 - DNA, 21 bp, Homo sapiens
caccgtcctgtcagctccttg

SEQ ID NO: 6000438 - DNA, 16 bp, Homo sapiens
caccgtctcggccctg

SEQ ID NO: 6000439 - DNA, 18 bp, Homo sapiens
caccgtgatggagaggac

SEQ ID NO: 6000440 - DNA, 14 bp, Homo sapiens
caccgtgcagagct

SEQ ID NO: 6000441 - DNA, 23 bp, Homo sapiens
caccgtgcagagctgcacttggc

SEQ ID NO: 6000442 - DNA, 22 bp, Homo sapiens
caccgtgccaaccccacccagc

SEQ ID NO: 6000443 - DNA, 12 bp, Homo sapiens
caccgtgctgtc

SEQ ID NO: 6000444 - DNA, 21 bp, Homo sapiens
caccgtgctgtcttctggtct

SEQ ID NO: 6000445 - DNA, 22 bp, Homo sapiens
caccgtgctgtcttctggtctg

SEQ ID NO: 6000446 - DNA, 23 bp, Homo sapiens
caccgtgctgtcttctggtctgt

SEQ ID NO: 6000447 - DNA, 19 bp, Homo sapiens
caccgtggaccttcctgcc

SEQ ID NO: 6000448 - DNA, 22 bp, Homo sapiens
caccgtggcagcttgctgggct

SEQ ID NO: 6000449 - DNA, 14 bp, Homo sapiens
caccgtggggaagg

SEQ ID NO: 6000450 - DNA, 20 bp, Homo sapiens
caccgtggtgtgaggccccc

SEQ ID NO: 6000451 - DNA, 16 bp, Homo sapiens
caccgtgtaaaccaaa

SEQ ID NO: 6000452 - DNA, 20 bp, Homo sapiens
caccgtgtcaagctgctctg

SEQ ID NO: 6000453 - DNA, 17 bp, Homo sapiens
caccgttcaagcgccag

SEQ ID NO: 6000454 - DNA, 14 bp, Homo sapiens
caccgttcattcag

SEQ ID NO: 6000455 - DNA, 20 bp, Homo sapiens
caccgttcgtacgcccagga

SEQ ID NO: 6000456 - DNA, 19 bp, Homo sapiens
caccgttgtctcatgccag

SEQ ID NO: 6000457 - DNA, 20 bp, Homo sapiens
caccgtttagaaaaaacaat

SEQ ID NO: 6000458 - DNA, 23 bp, Homo sapiens
cacctaaaaccagttttgctgct

SEQ ID NO: 6000459 - DNA, 18 bp, Homo sapiens
cacctaaaccctctgtga

SEQ ID NO: 6000460 - DNA, 13 bp, Homo sapiens
cacctaaagaaaa

SEQ ID NO: 6000461 - DNA, 17 bp, Homo sapiens
cacctaaagcagccagc

SEQ ID NO: 6000462 - DNA, 20 bp, Homo sapiens
cacctaaagggaagccctga

SEQ ID NO: 6000463 - DNA, 15 bp, Homo sapiens
cacctaaccccaggg

SEQ ID NO: 6000464 - DNA, 14 bp, Homo sapiens
cacctaaccctctg

SEQ ID NO: 6000465 - DNA, 15 bp, Homo sapiens
cacctaaccctctgt

SEQ ID NO: 6000466 - DNA, 16 bp, Homo sapiens
cacctaaccctctgtc

SEQ ID NO: 6000467 - DNA, 12 bp, Homo sapiens
cacctaactctt

SEQ ID NO: 6000468 - DNA, 15 bp, Homo sapiens
cacctaactcttctt

SEQ ID NO: 6000469 - DNA, 24 bp, Homo sapiens
cacctaagcaatcactgggcccag

SEQ ID NO: 6000470 - DNA, 19 bp, Homo sapiens
cacctaagcacttctagaa

SEQ ID NO: 6000471 - DNA, 20 bp, Homo sapiens
cacctaagggctaaggcctc

SEQ ID NO: 6000472 - DNA, 17 bp, Homo sapiens
cacctaagtctctgtga

SEQ ID NO: 6000473 - DNA, 11 bp, Homo sapiens
cacctaagtga

SEQ ID NO: 6000474 - DNA, 19 bp, Homo sapiens
cacctaatcaggctgaggt

SEQ ID NO: 6000475 - DNA, 19 bp, Homo sapiens
cacctaatggttgtacata

SEQ ID NO: 6000476 - DNA, 14 bp, Homo sapiens
cacctaatgtttat

SEQ ID NO: 6000477 - DNA, 20 bp, Homo sapiens
cacctaatgtttatgagcca

SEQ ID NO: 6000478 - DNA, 15 bp, Homo sapiens
cacctacacaggagt

SEQ ID NO: 6000479 - DNA, 16 bp, Homo sapiens
cacctacacaggagtc

SEQ ID NO: 6000480 - DNA, 18 bp, Homo sapiens
cacctacacccctgtgct

SEQ ID NO: 6000481 - DNA, 13 bp, Homo sapiens
cacctacagcagc

SEQ ID NO: 6000482 - DNA, 14 bp, Homo sapiens
cacctacagcagca

SEQ ID NO: 6000483 - DNA, 14 bp, Homo sapiens
cacctacaggactg

SEQ ID NO: 6000484 - DNA, 16 bp, Homo sapiens
cacctacaggactggg

SEQ ID NO: 6000485 - DNA, 17 bp, Homo sapiens
cacctacaggactgggc

SEQ ID NO: 6000486 - DNA, 16 bp, Homo sapiens
cacctacatccccagg

SEQ ID NO: 6000487 - DNA, 20 bp, Homo sapiens
cacctaccaccacgcccggc

SEQ ID NO: 6000488 - DNA, 16 bp, Homo sapiens
cacctaccatgctgct

SEQ ID NO: 6000489 - DNA, 12 bp, Homo sapiens
cacctacccagc

SEQ ID NO: 6000490 - DNA, 15 bp, Homo sapiens
cacctacccagctga

SEQ ID NO: 6000491 - DNA, 18 bp, Homo sapiens
cacctaccgagttcaagt

SEQ ID NO: 6000492 - DNA, 18 bp, Homo sapiens
cacctaccttcaaagctg

SEQ ID NO: 6000493 - DNA, 18 bp, Homo sapiens
cacctactcacacaggca

SEQ ID NO: 6000494 - DNA, 12 bp, Homo sapiens
cacctactgagt

SEQ ID NO: 6000495 - DNA, 16 bp, Homo sapiens
cacctacttagatatt

SEQ ID NO: 6000496 - DNA, 19 bp, Homo sapiens
cacctacttagatatttca

SEQ ID NO: 6000497 - DNA, 18 bp, Homo sapiens
cacctagaagtctccctg

SEQ ID NO: 6000498 - DNA, 20 bp, Homo sapiens
cacctagaagtctccctgca

SEQ ID NO: 6000499 - DNA, 16 bp, Homo sapiens
cacctagaattggctg

SEQ ID NO: 6000500 - DNA, 23 bp, Homo sapiens
cacctagagcttttttataacaa

SEQ ID NO: 6000501 - DNA, 13 bp, Homo sapiens
cacctagatcaga

SEQ ID NO: 6000502 - DNA, 17 bp, Homo sapiens
cacctagcagcctcaaa

SEQ ID NO: 6000503 - DNA, 21 bp, Homo sapiens
cacctagcatgtgtaattttt

SEQ ID NO: 6000504 - DNA, 18 bp, Homo sapiens
cacctagctgaatgtttt

SEQ ID NO: 6000505 - DNA, 22 bp, Homo sapiens
cacctagctttttgcagataac

SEQ ID NO: 6000506 - DNA, 16 bp, Homo sapiens
cacctaggccactcct

SEQ ID NO: 6000507 - DNA, 18 bp, Homo sapiens
cacctagtaagtgcctgc

SEQ ID NO: 6000508 - DNA, 15 bp, Homo sapiens
cacctagtccagtga

SEQ ID NO: 6000509 - DNA, 20 bp, Homo sapiens
cacctagtgccccagactga

SEQ ID NO: 6000510 - DNA, 14 bp, Homo sapiens
cacctagtggctgt

SEQ ID NO: 6000511 - DNA, 18 bp, Homo sapiens
cacctagtggctgtccag

SEQ ID NO: 6000512 - DNA, 19 bp, Homo sapiens
cacctagtggctgtccagt

SEQ ID NO: 6000513 - DNA, 16 bp, Homo sapiens
cacctataaaacaggt

SEQ ID NO: 6000514 - DNA, 19 bp, Homo sapiens
cacctataaaacaggtcaa

SEQ ID NO: 6000515 - DNA, 21 bp, Homo sapiens
cacctataaaattatgaaaat

SEQ ID NO: 6000516 - DNA, 12 bp, Homo sapiens
cacctataaata

SEQ ID NO: 6000517 - DNA, 18 bp, Homo sapiens
cacctatccctaacaggc

SEQ ID NO: 6000518 - DNA, 15 bp, Homo sapiens
cacctatgaaagcaa

SEQ ID NO: 6000519 - DNA, 21 bp, Homo sapiens
cacctatgagatggccatgct

SEQ ID NO: 6000520 - DNA, 22 bp, Homo sapiens
cacctatgagatggccatgctc

SEQ ID NO: 6000521 - DNA, 14 bp, Homo sapiens
cacctatgccagtg

SEQ ID NO: 6000522 - DNA, 22 bp, Homo sapiens
cacctatggcccagccactgca

SEQ ID NO: 6000523 - DNA, 12 bp, Homo sapiens
cacctatgtgcc

SEQ ID NO: 6000524 - DNA, 14 bp, Homo sapiens
cacctatgtgccaa

SEQ ID NO: 6000525 - DNA, 16 bp, Homo sapiens
cacctatgttattttg

SEQ ID NO: 6000526 - DNA, 17 bp, Homo sapiens
cacctatgttattttgt

SEQ ID NO: 6000527 - DNA, 21 bp, Homo sapiens
cacctattatcccagctgcct

SEQ ID NO: 6000528 - DNA, 16 bp, Homo sapiens
cacctcaaatcttcta

SEQ ID NO: 6000529 - DNA, 23 bp, Homo sapiens
cacctcaagaagaagaggggcat

SEQ ID NO: 6000530 - DNA, 23 bp, Homo sapiens
cacctcaaggtcatcaaacattt

SEQ ID NO: 6000531 - DNA, 23 bp, Homo sapiens
cacctcaagtgcaaggaccaaag

SEQ ID NO: 6000532 - DNA, 15 bp, Homo sapiens
cacctcacaactcct

SEQ ID NO: 6000533 - DNA, 21 bp, Homo sapiens
cacctcacagaaatgagatca

SEQ ID NO: 6000534 - DNA, 14 bp, Homo sapiens
cacctcaccccact

SEQ ID NO: 6000535 - DNA, 18 bp, Homo sapiens
cacctcaccccgttacag

SEQ ID NO: 6000536 - DNA, 13 bp, Homo sapiens
cacctcaccctct

SEQ ID NO: 6000537 - DNA, 15 bp, Homo sapiens
cacctcaccctctcc

SEQ ID NO: 6000538 - DNA, 16 bp, Homo sapiens
cacctcacgctctgga

SEQ ID NO: 6000539 - DNA, 22 bp, Homo sapiens
cacctcactagctccccaatcc

SEQ ID NO: 6000540 - DNA, 13 bp, Homo sapiens
cacctcactcagc

SEQ ID NO: 6000541 - DNA, 19 bp, Homo sapiens
cacctcactcagcaccact

SEQ ID NO: 6000542 - DNA, 21 bp, Homo sapiens
cacctcactcagcaccactca

SEQ ID NO: 6000543 - DNA, 15 bp, Homo sapiens
cacctcactcctgtt

SEQ ID NO: 6000544 - DNA, 17 bp, Homo sapiens
cacctcagaaagtcacc

SEQ ID NO: 6000545 - DNA, 20 bp, Homo sapiens
cacctcagaaagtcaccagg

SEQ ID NO: 6000546 - DNA, 13 bp, Homo sapiens
cacctcagacaat

SEQ ID NO: 6000547 - DNA, 16 bp, Homo sapiens
cacctcagagcagggc

SEQ ID NO: 6000548 - DNA, 18 bp, Homo sapiens
cacctcagagcagggcca

SEQ ID NO: 6000549 - DNA, 12 bp, Homo sapiens
cacctcagagcc

SEQ ID NO: 6000550 - DNA, 19 bp, Homo sapiens
cacctcagagtatggagct

SEQ ID NO: 6000551 - DNA, 20 bp, Homo sapiens
cacctcagagtggagttgaa

SEQ ID NO: 6000552 - DNA, 17 bp, Homo sapiens
cacctcagatggcagct

SEQ ID NO: 6000553 - DNA, 13 bp, Homo sapiens
cacctcagcccca

SEQ ID NO: 6000554 - DNA, 11 bp, Homo sapiens
cacctcagcct

SEQ ID NO: 6000555 - DNA, 15 bp, Homo sapiens
cacctcagcctccca

SEQ ID NO: 6000556 - DNA, 17 bp, Homo sapiens
cacctcagcctgcacag

SEQ ID NO: 6000557 - DNA, 16 bp, Homo sapiens
cacctcagcctggaga

SEQ ID NO: 6000558 - DNA, 23 bp, Homo sapiens
cacctcagcctggagaggcctgg

SEQ ID NO: 6000559 - DNA, 13 bp, Homo sapiens
cacctcagccttg

SEQ ID NO: 6000560 - DNA, 15 bp, Homo sapiens
cacctcagctgcctc

SEQ ID NO: 6000561 - DNA, 15 bp, Homo sapiens
cacctcaggccaggt

SEQ ID NO: 6000562 - DNA, 16 bp, Homo sapiens
cacctcagtgggaaga

SEQ ID NO: 6000563 - DNA, 22 bp, Homo sapiens
cacctcagttcccttggcctca

SEQ ID NO: 6000564 - DNA, 16 bp, Homo sapiens
cacctcatcactggac

SEQ ID NO: 6000565 - DNA, 17 bp, Homo sapiens
cacctcatcactggact

SEQ ID NO: 6000566 - DNA, 18 bp, Homo sapiens
cacctcatcactggactg

SEQ ID NO: 6000567 - DNA, 23 bp, Homo sapiens
cacctcatcactggactgcatgg

SEQ ID NO: 6000568 - DNA, 13 bp, Homo sapiens
cacctcatgagtc

SEQ ID NO: 6000569 - DNA, 14 bp, Homo sapiens
cacctcatgcctgg

SEQ ID NO: 6000570 - DNA, 16 bp, Homo sapiens
cacctcatgcctggcc

SEQ ID NO: 6000571 - DNA, 23 bp, Homo sapiens
cacctcatgcctggcccccctcc

SEQ ID NO: 6000572 - DNA, 21 bp, Homo sapiens
cacctcatggactccaggatc

SEQ ID NO: 6000573 - DNA, 19 bp, Homo sapiens
cacctcatggattgccaca

SEQ ID NO: 6000574 - DNA, 20 bp, Homo sapiens
cacctcatggattgccacag

SEQ ID NO: 6000575 - DNA, 21 bp, Homo sapiens
cacctcatggattgccacagc

SEQ ID NO: 6000576 - DNA, 22 bp, Homo sapiens
cacctcatggattgccacagct

SEQ ID NO: 6000577 - DNA, 18 bp, Homo sapiens
cacctccaatgctgcctg

SEQ ID NO: 6000578 - DNA, 13 bp, Homo sapiens
cacctccacaccc

SEQ ID NO: 6000579 - DNA, 12 bp, Homo sapiens
cagccctcctta

SEQ ID NO: 6000580 - DNA, 18 bp, Homo sapiens
cagccctccttcagggga

SEQ ID NO: 6000581 - DNA, 18 bp, Homo sapiens
cagccctcggcgctccgg

SEQ ID NO: 6000582 - DNA, 13 bp, Homo sapiens
cagccctcgggcc

SEQ ID NO: 6000583 - DNA, 13 bp, Homo sapiens
cagccctctccac

SEQ ID NO: 6000584 - DNA, 14 bp, Homo sapiens
cagccctctccacc

SEQ ID NO: 6000585 - DNA, 18 bp, Homo sapiens
cagccctctccacccaga

SEQ ID NO: 6000586 - DNA, 20 bp, Homo sapiens
cagccctctctctcactccc

SEQ ID NO: 6000587 - DNA, 19 bp, Homo sapiens
cagccctctgtggccagga

SEQ ID NO: 6000588 - DNA, 22 bp, Homo sapiens
cagccctctgtggccaggagcc

SEQ ID NO: 6000589 - DNA, 13 bp, Homo sapiens
cagccctgaaacg

SEQ ID NO: 6000590 - DNA, 23 bp, Homo sapiens
cagccctgaaacgagaagtgccc

SEQ ID NO: 6000591 - DNA, 18 bp, Homo sapiens
cagccctgagaaagccct

SEQ ID NO: 6000592 - DNA, 16 bp, Homo sapiens
cagccctgagccatgg

SEQ ID NO: 6000593 - DNA, 17 bp, Homo sapiens
cagccctgagccatggc

SEQ ID NO: 6000594 - DNA, 22 bp, Homo sapiens
cagccctgagccatggcggccc

SEQ ID NO: 6000595 - DNA, 13 bp, Homo sapiens
cagccctgagctg

SEQ ID NO: 6000596 - DNA, 11 bp, Homo sapiens
cagccctgagg

SEQ ID NO: 6000597 - DNA, 23 bp, Homo sapiens
cagccctgaggacagatgcctcc

SEQ ID NO: 6000598 - DNA, 16 bp, Homo sapiens
cagccctgaggggtgg

SEQ ID NO: 6000599 - DNA, 12 bp, Homo sapiens
cagccctgaggt

SEQ ID NO: 6000600 - DNA, 22 bp, Homo sapiens
cagccctgagtggtcactggtc

SEQ ID NO: 6000601 - DNA, 22 bp, Homo sapiens
cagccctgagtgtcccaagccg

SEQ ID NO: 6000602 - DNA, 23 bp, Homo sapiens
cagccctgagttggcatcacctg

SEQ ID NO: 6000603 - DNA, 22 bp, Homo sapiens
cagccctgattgtgccagtgca

SEQ ID NO: 6000604 - DNA, 13 bp, Homo sapiens
cagccctgcacca

SEQ ID NO: 6000605 - DNA, 17 bp, Homo sapiens
cagccctgcaccatgct

SEQ ID NO: 6000606 - DNA, 17 bp, Homo sapiens
cagccctgcacgcccag

SEQ ID NO: 6000607 - DNA, 16 bp, Homo sapiens
cagccctgcagagggc

SEQ ID NO: 6000608 - DNA, 18 bp, Homo sapiens
cagccctgcagagggcac

SEQ ID NO: 6000609 - DNA, 20 bp, Homo sapiens
cagccctgcagagggcacag

SEQ ID NO: 6000610 - DNA, 21 bp, Homo sapiens
cagccctgccaggaggctgcg

SEQ ID NO: 6000611 - DNA, 12 bp, Homo sapiens
cagccctgccca

SEQ ID NO: 6000612 - DNA, 13 bp, Homo sapiens
cagccctgccctt

SEQ ID NO: 6000613 - DNA, 13 bp, Homo sapiens
cagccctgcctgg

SEQ ID NO: 6000614 - DNA, 17 bp, Homo sapiens
cagccctgcctggagga

SEQ ID NO: 6000615 - DNA, 22 bp, Homo sapiens
cagccctgctagacgcaccgcc

SEQ ID NO: 6000616 - DNA, 21 bp, Homo sapiens
cagccctgctcattcctcacg

SEQ ID NO: 6000617 - DNA, 15 bp, Homo sapiens
cagccctgctccctg

SEQ ID NO: 6000618 - DNA, 20 bp, Homo sapiens
cagccctgctccctgcctcc

SEQ ID NO: 6000619 - DNA, 20 bp, Homo sapiens
cagccctgctgctgcctgcc

SEQ ID NO: 6000620 - DNA, 15 bp, Homo sapiens
cagccctgctgcttc

SEQ ID NO: 6000621 - DNA, 12 bp, Homo sapiens
cagccctgctgg

SEQ ID NO: 6000622 - DNA, 13 bp, Homo sapiens
cagccctgctggg

SEQ ID NO: 6000623 - DNA, 20 bp, Homo sapiens
cagccctgctggggatcccc

SEQ ID NO: 6000624 - DNA, 23 bp, Homo sapiens
cagccctgctttgggctgccctg

SEQ ID NO: 6000625 - DNA, 15 bp, Homo sapiens
cagccctggcccacc

SEQ ID NO: 6000626 - DNA, 22 bp, Homo sapiens
cagccctggcccagagctggaa

SEQ ID NO: 6000627 - DNA, 15 bp, Homo sapiens
cagccctggcccagg

SEQ ID NO: 6000628 - DNA, 16 bp, Homo sapiens
cagccctggcccaggt

SEQ ID NO: 6000629 - DNA, 18 bp, Homo sapiens
cagccctggcccatcatg

SEQ ID NO: 6000630 - DNA, 14 bp, Homo sapiens
cagccctggcccct

SEQ ID NO: 6000631 - DNA, 17 bp, Homo sapiens
cagccctggcctggctg

SEQ ID NO: 6000632 - DNA, 12 bp, Homo sapiens
cagccctggctc

SEQ ID NO: 6000633 - DNA, 15 bp, Homo sapiens
cagccctggctctgc

SEQ ID NO: 6000634 - DNA, 20 bp, Homo sapiens
cagccctggctgaaggactg

SEQ ID NO: 6000635 - DNA, 12 bp, Homo sapiens
cagccctgggaa

SEQ ID NO: 6000636 - DNA, 11 bp, Homo sapiens
cagccctgggc

SEQ ID NO: 6000637 - DNA, 12 bp, Homo sapiens
cagccctgggca

SEQ ID NO: 6000638 - DNA, 20 bp, Homo sapiens
cagccctgggcaaggaagct

SEQ ID NO: 6000639 - DNA, 15 bp, Homo sapiens
cagccctgggcacat

SEQ ID NO: 6000640 - DNA, 13 bp, Homo sapiens
cagccctgggccc

SEQ ID NO: 6000641 - DNA, 18 bp, Homo sapiens
cagccctgggccccacca

SEQ ID NO: 6000642 - DNA, 14 bp, Homo sapiens
cagccctgggcctg

SEQ ID NO: 6000643 - DNA, 13 bp, Homo sapiens
cagccctggggct

SEQ ID NO: 6000644 - DNA, 18 bp, Homo sapiens
cagccctggggctgggcc

SEQ ID NO: 6000645 - DNA, 19 bp, Homo sapiens
cagccctggggctgggccc

SEQ ID NO: 6000646 - DNA, 23 bp, Homo sapiens
cagccctgggggattcctgagct

SEQ ID NO: 6000647 - DNA, 19 bp, Homo sapiens
cagccctggtctcagcagc

SEQ ID NO: 6000648 - DNA, 19 bp, Homo sapiens
cagccctggttctccatcc

SEQ ID NO: 6000649 - DNA, 21 bp, Homo sapiens
cagccctggttctccatcccc

SEQ ID NO: 6000650 - DNA, 22 bp, Homo sapiens
cagccctggttctccatcccca

SEQ ID NO: 6000651 - DNA, 21 bp, Homo sapiens
cagccctgtcagtgcagcccg

SEQ ID NO: 6000652 - DNA, 22 bp, Homo sapiens
cagccctgtcccctgaaaaact

SEQ ID NO: 6000653 - DNA, 13 bp, Homo sapiens
cagccctgtcctg

SEQ ID NO: 6000654 - DNA, 16 bp, Homo sapiens
cagccctgtcttccta

SEQ ID NO: 6000655 - DNA, 13 bp, Homo sapiens
cagccctgtgtct

SEQ ID NO: 6000656 - DNA, 14 bp, Homo sapiens
cagccctgtgtctg

SEQ ID NO: 6000657 - DNA, 15 bp, Homo sapiens
cagccctgtgtctgt

SEQ ID NO: 6000658 - DNA, 18 bp, Homo sapiens
cagccctgtgtctgtcac

SEQ ID NO: 6000659 - DNA, 22 bp, Homo sapiens
cagccctgtgtctgtcacaggc

SEQ ID NO: 6000660 - DNA, 19 bp, Homo sapiens
cagccctgttccgcctcac

SEQ ID NO: 6000661 - DNA, 21 bp, Homo sapiens
cagccctgttccgcctcactg

SEQ ID NO: 6000662 - DNA, 22 bp, Homo sapiens
cagccctgttccgcctcactgg

SEQ ID NO: 6000663 - DNA, 17 bp, Homo sapiens
cagcccttagcacagag

SEQ ID NO: 6000664 - DNA, 13 bp, Homo sapiens
cagcccttagcag

SEQ ID NO: 6000665 - DNA, 16 bp, Homo sapiens
cagcccttagcaggga

SEQ ID NO: 6000666 - DNA, 13 bp, Homo sapiens
cagcccttcagac

SEQ ID NO: 6000667 - DNA, 12 bp, Homo sapiens
cagcccttcatg

SEQ ID NO: 6000668 - DNA, 17 bp, Homo sapiens
cagcccttcatgggtgg

SEQ ID NO: 6000669 - DNA, 14 bp, Homo sapiens
cagcccttcccagg

SEQ ID NO: 6000670 - DNA, 16 bp, Homo sapiens
cagcccttcccaggcc

SEQ ID NO: 6000671 - DNA, 18 bp, Homo sapiens
cagcccttccccatcctg

SEQ ID NO: 6000672 - DNA, 15 bp, Homo sapiens
cagcccttccctggc

SEQ ID NO: 6000673 - DNA, 11 bp, Homo sapiens
cagcccttcct

SEQ ID NO: 6000674 - DNA, 22 bp, Homo sapiens
cagcccttcctccctgtctctg

SEQ ID NO: 6000675 - DNA, 15 bp, Homo sapiens
cagcccttcctcctg

SEQ ID NO: 6000676 - DNA, 14 bp, Homo sapiens
cagcccttcctctc

SEQ ID NO: 6000677 - DNA, 15 bp, Homo sapiens
cagcccttcctctca

SEQ ID NO: 6000678 - DNA, 18 bp, Homo sapiens
cagcccttcctctcactc

SEQ ID NO: 6000679 - DNA, 19 bp, Homo sapiens
cagcccttcctctcactcc

SEQ ID NO: 6000680 - DNA, 22 bp, Homo sapiens
cagcccttcctctcactcctgc

SEQ ID NO: 6000681 - DNA, 19 bp, Homo sapiens
cagcccttcctctgctccc

SEQ ID NO: 6000682 - DNA, 13 bp, Homo sapiens
cagcccttccttg

SEQ ID NO: 6000683 - DNA, 16 bp, Homo sapiens
cagcccttccttgggg

SEQ ID NO: 6000684 - DNA, 17 bp, Homo sapiens
cagcccttccttgggga

SEQ ID NO: 6000685 - DNA, 12 bp, Homo sapiens
cagcccttctgc

SEQ ID NO: 6000686 - DNA, 15 bp, Homo sapiens
cagcccttctgcctt

SEQ ID NO: 6000687 - DNA, 18 bp, Homo sapiens
cagcccttctgcctttct

SEQ ID NO: 6000688 - DNA, 15 bp, Homo sapiens
cagcccttctttcca

SEQ ID NO: 6000689 - DNA, 20 bp, Homo sapiens
cagcccttgagctccccaaa

SEQ ID NO: 6000690 - DNA, 13 bp, Homo sapiens
cagcccttgggca

SEQ ID NO: 6000691 - DNA, 14 bp, Homo sapiens
cagcccttgggcag

SEQ ID NO: 6000692 - DNA, 20 bp, Homo sapiens
cagcccttgggggtcctcct

SEQ ID NO: 6000693 - DNA, 13 bp, Homo sapiens
cagccctttccag

SEQ ID NO: 6000694 - DNA, 15 bp, Homo sapiens
cagccctttccaggg

SEQ ID NO: 6000695 - DNA, 17 bp, Homo sapiens
cagccctttccagggca

SEQ ID NO: 6000696 - DNA, 22 bp, Homo sapiens
cagccctttgcaggcccagcag

SEQ ID NO: 6000697 - DNA, 18 bp, Homo sapiens
cagccctttggcttcaag

SEQ ID NO: 6000698 - DNA, 20 bp, Homo sapiens
cagccctttgggaggctgag

SEQ ID NO: 6000699 - DNA, 14 bp, Homo sapiens
cagcccttttgtct

SEQ ID NO: 6000700 - DNA, 16 bp, Homo sapiens
cagcccttttgtctct

SEQ ID NO: 6000701 - DNA, 20 bp, Homo sapiens
cagccgaattgtggtgtctt

SEQ ID NO: 6000702 - DNA, 14 bp, Homo sapiens
cagccgaccccctc

SEQ ID NO: 6000703 - DNA, 19 bp, Homo sapiens
cagccgagatagccaaggc

SEQ ID NO: 6000704 - DNA, 18 bp, Homo sapiens
cagccgagcaggaggcct

SEQ ID NO: 6000705 - DNA, 23 bp, Homo sapiens
cagccgagcaggaggcctaggag

SEQ ID NO: 6000706 - DNA, 15 bp, Homo sapiens
cagccgagccccagg

SEQ ID NO: 6000707 - DNA, 17 bp, Homo sapiens
cagccgagccccaggag

SEQ ID NO: 6000708 - DNA, 12 bp, Homo sapiens
cagccgagccgg

SEQ ID NO: 6000709 - DNA, 14 bp, Homo sapiens
cagccgagccgggc

SEQ ID NO: 6000710 - DNA, 17 bp, Homo sapiens
cagccgagccgggcctg

SEQ ID NO: 6000711 - DNA, 19 bp, Homo sapiens
cagccgagccgggcctggg

SEQ ID NO: 6000712 - DNA, 14 bp, Homo sapiens
cagccgaggcctgg

SEQ ID NO: 6000713 - DNA, 17 bp, Homo sapiens
cagccgaggcctggcca

SEQ ID NO: 6000714 - DNA, 21 bp, Homo sapiens
cagccgaggcctggccaatgc

SEQ ID NO: 6000715 - DNA, 17 bp, Homo sapiens
cagccgaggtccctgct

SEQ ID NO: 6000716 - DNA, 19 bp, Homo sapiens
cagccgaggtccctgctgc

SEQ ID NO: 6000717 - DNA, 18 bp, Homo sapiens
cagccgattcacctgagc

SEQ ID NO: 6000718 - DNA, 19 bp, Homo sapiens
cagccgattcacctgagca

SEQ ID NO: 6000719 - DNA, 16 bp, Homo sapiens
cagccgcaaggatcct

SEQ ID NO: 6000720 - DNA, 18 bp, Homo sapiens
cagccgcaatctggctcc

SEQ ID NO: 6000721 - DNA, 19 bp, Homo sapiens
cagccgcaatctggctcct

SEQ ID NO: 6000722 - DNA, 14 bp, Homo sapiens
cagccgcagagaaa

SEQ ID NO: 6000723 - DNA, 17 bp, Homo sapiens
cagccgcagagaaatgc

SEQ ID NO: 6000724 - DNA, 21 bp, Homo sapiens
cagccgcagagaaatgcccca

SEQ ID NO: 6000725 - DNA, 22 bp, Homo sapiens
cagccgcagagaaatgccccag

SEQ ID NO: 6000726 - DNA, 23 bp, Homo sapiens
cagccgcagagaaatgccccagt

SEQ ID NO: 6000727 - DNA, 16 bp, Homo sapiens
cagccgcagcctccct

SEQ ID NO: 6000728 - DNA, 17 bp, Homo sapiens
cagccgcattggtgact

SEQ ID NO: 6000729 - DNA, 18 bp, Homo sapiens
cagccgcattggtgactc

SEQ ID NO: 6000730 - DNA, 13 bp, Homo sapiens
cagccgccacatc

SEQ ID NO: 6000731 - DNA, 23 bp, Homo sapiens
cagccgccacatccccgctggct

SEQ ID NO: 6000732 - DNA, 15 bp, Homo sapiens
cagccgccagctggg

SEQ ID NO: 6000733 - DNA, 22 bp, Homo sapiens
cagccgcccagatcatgccgcc

SEQ ID NO: 6000734 - DNA, 13 bp, Homo sapiens
cagccgccctggg

SEQ ID NO: 6000735 - DNA, 14 bp, Homo sapiens
cagccgccggctgt

SEQ ID NO: 6000736 - DNA, 18 bp, Homo sapiens
cagccgccgggcaggcct

SEQ ID NO: 6000737 - DNA, 18 bp, Homo sapiens
cagccgccttaagctgat

SEQ ID NO: 6000738 - DNA, 19 bp, Homo sapiens
cagccgccttaagctgatc

SEQ ID NO: 6000739 - DNA, 14 bp, Homo sapiens
cagccgccttccct

SEQ ID NO: 6000740 - DNA, 14 bp, Homo sapiens
cagccgccttcctt

SEQ ID NO: 6000741 - DNA, 17 bp, Homo sapiens
cagccgctaggagagac

SEQ ID NO: 6000742 - DNA, 13 bp, Homo sapiens
cagccgctccaga

SEQ ID NO: 6000743 - DNA, 14 bp, Homo sapiens
cagccgctccagag

SEQ ID NO: 6000744 - DNA, 12 bp, Homo sapiens
cagccgctcctg

SEQ ID NO: 6000745 - DNA, 16 bp, Homo sapiens
cagccgctcctgtctg

SEQ ID NO: 6000746 - DNA, 19 bp, Homo sapiens
cagccgctcctgtctgcca

SEQ ID NO: 6000747 - DNA, 21 bp, Homo sapiens
cagccgctcctgtctgccagc

SEQ ID NO: 6000748 - DNA, 22 bp, Homo sapiens
cagccgctcctgtctgccagcc

SEQ ID NO: 6000749 - DNA, 19 bp, Homo sapiens
cagccgctcggaggcccca

SEQ ID NO: 6000750 - DNA, 19 bp, Homo sapiens
cagccgctgagcgaggaga

SEQ ID NO: 6000751 - DNA, 13 bp, Homo sapiens
cagccgctgcagg

SEQ ID NO: 6000752 - DNA, 20 bp, Homo sapiens
cagccgctgcagggctccca

SEQ ID NO: 6000753 - DNA, 13 bp, Homo sapiens
cagccgctgcccg

SEQ ID NO: 6000754 - DNA, 22 bp, Homo sapiens
cagccgctgcccggcgccctct

SEQ ID NO: 6000755 - DNA, 21 bp, Homo sapiens
cagccgcttggcgatgccagc

SEQ ID NO: 6000756 - DNA, 23 bp, Homo sapiens
cagccgcttggcgatgccagcca

SEQ ID NO: 6000757 - DNA, 23 bp, Homo sapiens
cagccggacacaagcggccctga

SEQ ID NO: 6000758 - DNA, 21 bp, Homo sapiens
cagccggagtcactgcctgga

SEQ ID NO: 6000759 - DNA, 14 bp, Homo sapiens
cacctccacaccca

SEQ ID NO: 6000760 - DNA, 20 bp, Homo sapiens
cacctccacagttcagtggc

SEQ ID NO: 6000761 - DNA, 20 bp, Homo sapiens
cacctccaccacatctgcca

SEQ ID NO: 6000762 - DNA, 21 bp, Homo sapiens
cacctccacccccaagaaacc

SEQ ID NO: 6000763 - DNA, 21 bp, Homo sapiens
cacctccacccccgccacggc

SEQ ID NO: 6000764 - DNA, 12 bp, Homo sapiens
cacctccacccg

SEQ ID NO: 6000765 - DNA, 14 bp, Homo sapiens
cacctccacccgtc

SEQ ID NO: 6000766 - DNA, 13 bp, Homo sapiens
cacctccacctgt

SEQ ID NO: 6000767 - DNA, 14 bp, Homo sapiens
cacctccacctgtg

SEQ ID NO: 6000768 - DNA, 16 bp, Homo sapiens
cacctccacctgtgag

SEQ ID NO: 6000769 - DNA, 17 bp, Homo sapiens
cacctccactcagcact

SEQ ID NO: 6000770 - DNA, 18 bp, Homo sapiens
cacctccactcagcactc

SEQ ID NO: 6000771 - DNA, 14 bp, Homo sapiens
cacctccactccca

SEQ ID NO: 6000772 - DNA, 13 bp, Homo sapiens
cacctccagccca

SEQ ID NO: 6000773 - DNA, 16 bp, Homo sapiens
cacctccagcccggga

SEQ ID NO: 6000774 - DNA, 17 bp, Homo sapiens
cacctccagcccgggag

SEQ ID NO: 6000775 - DNA, 18 bp, Homo sapiens
cacctccagcccgggagc

SEQ ID NO: 6000776 - DNA, 20 bp, Homo sapiens
cacctccagcccgggagcct

SEQ ID NO: 6000777 - DNA, 21 bp, Homo sapiens
cacctccagcccgggagccta

SEQ ID NO: 6000778 - DNA, 14 bp, Homo sapiens
cacctccagcctct

SEQ ID NO: 6000779 - DNA, 14 bp, Homo sapiens
cacctccagcctga

SEQ ID NO: 6000780 - DNA, 13 bp, Homo sapiens
cacctccaggcag

SEQ ID NO: 6000781 - DNA, 14 bp, Homo sapiens
cacctccaggcagg

SEQ ID NO: 6000782 - DNA, 19 bp, Homo sapiens
cacctccaggcaggccagg

SEQ ID NO: 6000783 - DNA, 13 bp, Homo sapiens
cacctccaggcct

SEQ ID NO: 6000784 - DNA, 14 bp, Homo sapiens
cacctccaggcctg

SEQ ID NO: 6000785 - DNA, 22 bp, Homo sapiens
cacctccagtccccctatcctt

SEQ ID NO: 6000786 - DNA, 12 bp, Homo sapiens
cacctccatatc

SEQ ID NO: 6000787 - DNA, 20 bp, Homo sapiens
cacctccatccccctctgtc

SEQ ID NO: 6000788 - DNA, 22 bp, Homo sapiens
cacctccatccccctctgtctg

SEQ ID NO: 6000789 - DNA, 13 bp, Homo sapiens
cacctccatgtca

SEQ ID NO: 6000790 - DNA, 17 bp, Homo sapiens
cacctccatgtcatccg

SEQ ID NO: 6000791 - DNA, 17 bp, Homo sapiens
cacctcccaaaggctgt

SEQ ID NO: 6000792 - DNA, 21 bp, Homo sapiens
cacctcccaaggactttccag

SEQ ID NO: 6000793 - DNA, 18 bp, Homo sapiens
cacctcccaccccactcc

SEQ ID NO: 6000794 - DNA, 19 bp, Homo sapiens
cacctcccaccccactcca

SEQ ID NO: 6000795 - DNA, 21 bp, Homo sapiens
cacctcccaccccactccagc

SEQ ID NO: 6000796 - DNA, 22 bp, Homo sapiens
cacctcccaccccactccagcc

SEQ ID NO: 6000797 - DNA, 14 bp, Homo sapiens
cacctcccaccctg

SEQ ID NO: 6000798 - DNA, 19 bp, Homo sapiens
cacctcccactcctgctgc

SEQ ID NO: 6000799 - DNA, 13 bp, Homo sapiens
cacctcccagccc

SEQ ID NO: 6000800 - DNA, 14 bp, Homo sapiens
cacctcccagcccc

SEQ ID NO: 6000801 - DNA, 12 bp, Homo sapiens
cacctcccaggg

SEQ ID NO: 6000802 - DNA, 15 bp, Homo sapiens
cacctcccagggcta

SEQ ID NO: 6000803 - DNA, 16 bp, Homo sapiens
cacctcccagggctac

SEQ ID NO: 6000804 - DNA, 15 bp, Homo sapiens
cacctcccaggggct

SEQ ID NO: 6000805 - DNA, 11 bp, Homo sapiens
cacctcccatc

SEQ ID NO: 6000806 - DNA, 18 bp, Homo sapiens
cacctcccatttctgttg

SEQ ID NO: 6000807 - DNA, 9 bp, Homo sapiens
cacctcccc

SEQ ID NO: 6000808 - DNA, 14 bp, Homo sapiens
cacctccccacaca

SEQ ID NO: 6000809 - DNA, 19 bp, Homo sapiens
cacctccccacacacaggc

SEQ ID NO: 6000810 - DNA, 21 bp, Homo sapiens
cacctccccacacacaggcct

SEQ ID NO: 6000811 - DNA, 14 bp, Homo sapiens
cacctccccacgcc

SEQ ID NO: 6000812 - DNA, 12 bp, Homo sapiens
cacctccccact

SEQ ID NO: 6000813 - DNA, 22 bp, Homo sapiens
cacctccccagacagggctcca

SEQ ID NO: 6000814 - DNA, 16 bp, Homo sapiens
cacctccccagcattc

SEQ ID NO: 6000815 - DNA, 14 bp, Homo sapiens
cacctccccagcct

SEQ ID NO: 6000816 - DNA, 20 bp, Homo sapiens
cacctcccccaaaccctgct

SEQ ID NO: 6000817 - DNA, 23 bp, Homo sapiens
cacctccccccactgcaggcccc

SEQ ID NO: 6000818 - DNA, 14 bp, Homo sapiens
cacctccccctacc

SEQ ID NO: 6000819 - DNA, 17 bp, Homo sapiens
cacctccccctacccat

SEQ ID NO: 6000820 - DNA, 14 bp, Homo sapiens
cacctccccctccc

SEQ ID NO: 6000821 - DNA, 13 bp, Homo sapiens
cacctccccctgc

SEQ ID NO: 6000822 - DNA, 21 bp, Homo sapiens
cacctccccctgcgccccgca

SEQ ID NO: 6000823 - DNA, 22 bp, Homo sapiens
cacctcccccttcccctaccca

SEQ ID NO: 6000824 - DNA, 21 bp, Homo sapiens
cacctccccctttcacactgg

SEQ ID NO: 6000825 - DNA, 19 bp, Homo sapiens
cacctccccgctctccctg

SEQ ID NO: 6000826 - DNA, 22 bp, Homo sapiens
cacctccccgctctccctgtca

SEQ ID NO: 6000827 - DNA, 18 bp, Homo sapiens
cacctcccctatccaccc

SEQ ID NO: 6000828 - DNA, 14 bp, Homo sapiens
cacctccccttgcc

SEQ ID NO: 6000829 - DNA, 20 bp, Homo sapiens
cacctccccttgccagctgc

SEQ ID NO: 6000830 - DNA, 22 bp, Homo sapiens
cacctccccttgccagctgctg

SEQ ID NO: 6000831 - DNA, 14 bp, Homo sapiens
cacctccccttggg

SEQ ID NO: 6000832 - DNA, 17 bp, Homo sapiens
cacctcccgaagccacc

SEQ ID NO: 6000833 - DNA, 14 bp, Homo sapiens
cacctcccgccctc

SEQ ID NO: 6000834 - DNA, 23 bp, Homo sapiens
cacctcccgccctcacctgcaga

SEQ ID NO: 6000835 - DNA, 23 bp, Homo sapiens
cacctcccggtgtatgcagtggt

SEQ ID NO: 6000836 - DNA, 21 bp, Homo sapiens
cacctccctatactgcttgga

SEQ ID NO: 6000837 - DNA, 10 bp, Homo sapiens
cacctccctc

SEQ ID NO: 6000838 - DNA, 14 bp, Homo sapiens
cacctccctcccca

SEQ ID NO: 6000839 - DNA, 15 bp, Homo sapiens
cacctccctccccag

SEQ ID NO: 6000840 - DNA, 16 bp, Homo sapiens
cacctccctccccagc

SEQ ID NO: 6000841 - DNA, 16 bp, Homo sapiens
cacctccctcccggca

SEQ ID NO: 6000842 - DNA, 13 bp, Homo sapiens
cacctccctctgc

SEQ ID NO: 6000843 - DNA, 14 bp, Homo sapiens
cacctccctgaccc

SEQ ID NO: 6000844 - DNA, 14 bp, Homo sapiens
cacctccctgcaat

SEQ ID NO: 6000845 - DNA, 18 bp, Homo sapiens
cacctccctgcagctttg

SEQ ID NO: 6000846 - DNA, 16 bp, Homo sapiens
cacctccctgcccagg

SEQ ID NO: 6000847 - DNA, 22 bp, Homo sapiens
cacctccctgcgcccttgaggg

SEQ ID NO: 6000848 - DNA, 23 bp, Homo sapiens
cacctccctgctcagtgcttggg

SEQ ID NO: 6000849 - DNA, 22 bp, Homo sapiens
cacctcccttcccacctactgc

SEQ ID NO: 6000850 - DNA, 15 bp, Homo sapiens
cacctcccttccctc

SEQ ID NO: 6000851 - DNA, 17 bp, Homo sapiens
cacctcccttccctccc

SEQ ID NO: 6000852 - DNA, 22 bp, Homo sapiens
cacctcccttccctccctgagg

SEQ ID NO: 6000853 - DNA, 19 bp, Homo sapiens
cacctccgagacagtccag

SEQ ID NO: 6000854 - DNA, 21 bp, Homo sapiens
cacctccgagaggcagccaga

SEQ ID NO: 6000855 - DNA, 12 bp, Homo sapiens
cacctccgccag

SEQ ID NO: 6000856 - DNA, 15 bp, Homo sapiens
cacctccgccagacc

SEQ ID NO: 6000857 - DNA, 16 bp, Homo sapiens
cacctccgcttgccag

SEQ ID NO: 6000858 - DNA, 13 bp, Homo sapiens
cacctccggctgc

SEQ ID NO: 6000859 - DNA, 19 bp, Homo sapiens
cacctccgggactgacctt

SEQ ID NO: 6000860 - DNA, 23 bp, Homo sapiens
cacctccgttgcggctgtgctcc

SEQ ID NO: 6000861 - DNA, 16 bp, Homo sapiens
cacctcctaaaacaac

SEQ ID NO: 6000862 - DNA, 17 bp, Homo sapiens
cacctcctaaaaggccc

SEQ ID NO: 6000863 - DNA, 18 bp, Homo sapiens
cacctcctaaaaggccca

SEQ ID NO: 6000864 - DNA, 22 bp, Homo sapiens
cacctcctaaaaggcccagaga

SEQ ID NO: 6000865 - DNA, 12 bp, Homo sapiens
cacctcctaccc

SEQ ID NO: 6000866 - DNA, 20 bp, Homo sapiens
cacctcctaccccttcctgt

SEQ ID NO: 6000867 - DNA, 17 bp, Homo sapiens
cacctcctaccctccca

SEQ ID NO: 6000868 - DNA, 22 bp, Homo sapiens
cacctcctagcaagacctgttg

SEQ ID NO: 6000869 - DNA, 14 bp, Homo sapiens
cacctcctcagcct

SEQ ID NO: 6000870 - DNA, 16 bp, Homo sapiens
cacctcctcagcctga

SEQ ID NO: 6000871 - DNA, 13 bp, Homo sapiens
cacctcctccaag

SEQ ID NO: 6000872 - DNA, 14 bp, Homo sapiens
cacctcctccaaga

SEQ ID NO: 6000873 - DNA, 21 bp, Homo sapiens
cacctcctccaagaagccctc

SEQ ID NO: 6000874 - DNA, 13 bp, Homo sapiens
cacctcctccact

SEQ ID NO: 6000875 - DNA, 14 bp, Homo sapiens
cacctcctccactc

SEQ ID NO: 6000876 - DNA, 17 bp, Homo sapiens
cacctcctccactcact

SEQ ID NO: 6000877 - DNA, 23 bp, Homo sapiens
cacctcctccactcactccagcc

SEQ ID NO: 6000878 - DNA, 12 bp, Homo sapiens
cacctcctccag

SEQ ID NO: 6000879 - DNA, 12 bp, Homo sapiens
cacctcctccat

SEQ ID NO: 6000880 - DNA, 11 bp, Homo sapiens
cacctcctccc

SEQ ID NO: 6000881 - DNA, 15 bp, Homo sapiens
cacctcctccccctg

SEQ ID NO: 6000882 - DNA, 13 bp, Homo sapiens
cacctcctccgtg

SEQ ID NO: 6000883 - DNA, 23 bp, Homo sapiens
cacctcctccgtgggcagctcct

SEQ ID NO: 6000884 - DNA, 12 bp, Homo sapiens
cacctcctcctg

SEQ ID NO: 6000885 - DNA, 16 bp, Homo sapiens
cacctcctcctgctgc

SEQ ID NO: 6000886 - DNA, 20 bp, Homo sapiens
cacctcctcgaacccactcc

SEQ ID NO: 6000887 - DNA, 21 bp, Homo sapiens
cacctcctcgaacccactccg

SEQ ID NO: 6000888 - DNA, 22 bp, Homo sapiens
cacctcctcggctggctgtcca

SEQ ID NO: 6000889 - DNA, 15 bp, Homo sapiens
cacctcctctctgct

SEQ ID NO: 6000890 - DNA, 16 bp, Homo sapiens
cacctcctctcttgga

SEQ ID NO: 6000891 - DNA, 21 bp, Homo sapiens
cacctcctctgccagcaggaa

SEQ ID NO: 6000892 - DNA, 22 bp, Homo sapiens
cacctcctctgccagcaggaat

SEQ ID NO: 6000893 - DNA, 23 bp, Homo sapiens
cacctcctctgccagcaggaata

SEQ ID NO: 6000894 - DNA, 19 bp, Homo sapiens
cacctcctgacacccttct

SEQ ID NO: 6000895 - DNA, 13 bp, Homo sapiens
cacctcctgcctc

SEQ ID NO: 6000896 - DNA, 15 bp, Homo sapiens
cacctcctgcctcag

SEQ ID NO: 6000897 - DNA, 14 bp, Homo sapiens
cacctcctgcctcg

SEQ ID NO: 6000898 - DNA, 14 bp, Homo sapiens
cacctcctgctggg

SEQ ID NO: 6000899 - DNA, 18 bp, Homo sapiens
cacctccttccccagctc

SEQ ID NO: 6000900 - DNA, 20 bp, Homo sapiens
cacctccttccccagctccc

SEQ ID NO: 6000901 - DNA, 17 bp, Homo sapiens
cacctccttccctctct

SEQ ID NO: 6000902 - DNA, 22 bp, Homo sapiens
cacctccttccctctctggaga

SEQ ID NO: 6000903 - DNA, 12 bp, Homo sapiens
cacctccttctc

SEQ ID NO: 6000904 - DNA, 22 bp, Homo sapiens
cacctccttctgcagtcagact

SEQ ID NO: 6000905 - DNA, 22 bp, Homo sapiens
cacctccttgtcactttattac

SEQ ID NO: 6000906 - DNA, 19 bp, Homo sapiens
cacctcgcaggttcaagca

SEQ ID NO: 6000907 - DNA, 20 bp, Homo sapiens
cacctcgcccttcagcccac

SEQ ID NO: 6000908 - DNA, 22 bp, Homo sapiens
cacctcgctcccctctggaatc

SEQ ID NO: 6000909 - DNA, 13 bp, Homo sapiens
cacctcggaggga

SEQ ID NO: 6000910 - DNA, 13 bp, Homo sapiens
cacctcggcacac

SEQ ID NO: 6000911 - DNA, 15 bp, Homo sapiens
cacctcggcacacac

SEQ ID NO: 6000912 - DNA, 18 bp, Homo sapiens
cacctcggccctccctgc

SEQ ID NO: 6000913 - DNA, 13 bp, Homo sapiens
cacctcggcctcc

SEQ ID NO: 6000914 - DNA, 15 bp, Homo sapiens
cacctcggcctccta

SEQ ID NO: 6000915 - DNA, 21 bp, Homo sapiens
cacctcggggacaccagagct

SEQ ID NO: 6000916 - DNA, 14 bp, Homo sapiens
cacctcgtctccct

SEQ ID NO: 6000917 - DNA, 18 bp, Homo sapiens
cacctcgtctccctggtg

SEQ ID NO: 6000918 - DNA, 19 bp, Homo sapiens
cacctctaatagaggcagt

SEQ ID NO: 6000919 - DNA, 16 bp, Homo sapiens
cacctctacccaaacc

SEQ ID NO: 6000920 - DNA, 22 bp, Homo sapiens
cacctctacccaaaccctaggt

SEQ ID NO: 6000921 - DNA, 15 bp, Homo sapiens
cacctctactgtctc

SEQ ID NO: 6000922 - DNA, 21 bp, Homo sapiens
cacctctactgtctcctccct

SEQ ID NO: 6000923 - DNA, 15 bp, Homo sapiens
cacctctagtgctac

SEQ ID NO: 6000924 - DNA, 22 bp, Homo sapiens
cacctctatcccggctttggtg

SEQ ID NO: 6000925 - DNA, 22 bp, Homo sapiens
cacctctattcttgggaaacac

SEQ ID NO: 6000926 - DNA, 13 bp, Homo sapiens
cacctctcagagc

SEQ ID NO: 6000927 - DNA, 19 bp, Homo sapiens
cacctctcagagcaagcct

SEQ ID NO: 6000928 - DNA, 12 bp, Homo sapiens
cacctctcagct

SEQ ID NO: 6000929 - DNA, 14 bp, Homo sapiens
cacctctcagctgc

SEQ ID NO: 6000930 - DNA, 15 bp, Homo sapiens
cacctctcatcagcc

SEQ ID NO: 6000931 - DNA, 15 bp, Homo sapiens
cacctctccaagggc

SEQ ID NO: 6000932 - DNA, 22 bp, Homo sapiens
cacctctccaagggcttctgca

SEQ ID NO: 6000933 - DNA, 23 bp, Homo sapiens
cacctctccaagtctctctgtga

SEQ ID NO: 6000934 - DNA, 14 bp, Homo sapiens
cacctctccaggtg

SEQ ID NO: 6000935 - DNA, 14 bp, Homo sapiens
cacctctccctcaa

SEQ ID NO: 6000936 - DNA, 16 bp, Homo sapiens
cacctctccctgcatc

SEQ ID NO: 6000937 - DNA, 14 bp, Homo sapiens
cacctctcccttgg

SEQ ID NO: 6000938 - DNA, 12 bp, Homo sapiens
cacctctcctgc

SEQ ID NO: 6000939 - DNA, 23 bp, Homo sapiens
cacctctctaagttatgtacgta

SEQ ID NO: 6000940 - DNA, 22 bp, Homo sapiens
cagccggagtcactgcctggag

SEQ ID NO: 6000941 - DNA, 17 bp, Homo sapiens
cagccggatcttggaga

SEQ ID NO: 6000942 - DNA, 16 bp, Homo sapiens
cagccggccaatggaa

SEQ ID NO: 6000943 - DNA, 19 bp, Homo sapiens
cagccggcctctctggcct

SEQ ID NO: 6000944 - DNA, 20 bp, Homo sapiens
cagccggcgtggcaaatata

SEQ ID NO: 6000945 - DNA, 13 bp, Homo sapiens
cagccgggcacag

SEQ ID NO: 6000946 - DNA, 12 bp, Homo sapiens
cagccgggccct

SEQ ID NO: 6000947 - DNA, 18 bp, Homo sapiens
cagccggggagctgaggg

SEQ ID NO: 6000948 - DNA, 17 bp, Homo sapiens
cagccggggcctgccta

SEQ ID NO: 6000949 - DNA, 18 bp, Homo sapiens
cagccggggcctgcctag

SEQ ID NO: 6000950 - DNA, 17 bp, Homo sapiens
cagccggggcgagtggc

SEQ ID NO: 6000951 - DNA, 17 bp, Homo sapiens
cagccgggtacctcagt

SEQ ID NO: 6000952 - DNA, 18 bp, Homo sapiens
cagccgggtacctcagtt

SEQ ID NO: 6000953 - DNA, 15 bp, Homo sapiens
cagccggtacctggg

SEQ ID NO: 6000954 - DNA, 15 bp, Homo sapiens
cagccggtgcctggc

SEQ ID NO: 6000955 - DNA, 23 bp, Homo sapiens
cagccggttctgctagagcagac

SEQ ID NO: 6000956 - DNA, 19 bp, Homo sapiens
cagccgtaatggggactct

SEQ ID NO: 6000957 - DNA, 19 bp, Homo sapiens
cagccgtagggtggcactg

SEQ ID NO: 6000958 - DNA, 16 bp, Homo sapiens
cagccgtattttacat

SEQ ID NO: 6000959 - DNA, 18 bp, Homo sapiens
cagccgtcacccctgcct

SEQ ID NO: 6000960 - DNA, 14 bp, Homo sapiens
cagccgtcagccat

SEQ ID NO: 6000961 - DNA, 14 bp, Homo sapiens
cagccgtcccaggc

SEQ ID NO: 6000962 - DNA, 15 bp, Homo sapiens
cagccgtcccaggcc

SEQ ID NO: 6000963 - DNA, 23 bp, Homo sapiens
cagccgtcccgcgttcaagactt

SEQ ID NO: 6000964 - DNA, 22 bp, Homo sapiens
cagccgtgagccgccgcgcctg

SEQ ID NO: 6000965 - DNA, 16 bp, Homo sapiens
cagccgtgatgctcag

SEQ ID NO: 6000966 - DNA, 17 bp, Homo sapiens
cagccgtgatgctcagg

SEQ ID NO: 6000967 - DNA, 15 bp, Homo sapiens
cagccgtgcactccc

SEQ ID NO: 6000968 - DNA, 13 bp, Homo sapiens
cagccgtgggccc

SEQ ID NO: 6000969 - DNA, 14 bp, Homo sapiens
cagccgtgggcccg

SEQ ID NO: 6000970 - DNA, 23 bp, Homo sapiens
cagccgtggtccaaccaggagct

SEQ ID NO: 6000971 - DNA, 21 bp, Homo sapiens
cagccgtgtaaccatggaccc

SEQ ID NO: 6000972 - DNA, 23 bp, Homo sapiens
cagccgtttgttctacatggctt

SEQ ID NO: 6000973 - DNA, 19 bp, Homo sapiens
cagcctaagaaacactcat

SEQ ID NO: 6000974 - DNA, 15 bp, Homo sapiens
cagcctaagaagaag

SEQ ID NO: 6000975 - DNA, 19 bp, Homo sapiens
cagcctaagaagaaggcca

SEQ ID NO: 6000976 - DNA, 17 bp, Homo sapiens
cagcctaagaagctctg

SEQ ID NO: 6000977 - DNA, 23 bp, Homo sapiens
cagcctaagaagctctggcccca

SEQ ID NO: 6000978 - DNA, 16 bp, Homo sapiens
cagcctaatcaagtca

SEQ ID NO: 6000979 - DNA, 16 bp, Homo sapiens
cagcctaatcccgtgc

SEQ ID NO: 6000980 - DNA, 21 bp, Homo sapiens
cagcctacactattctagcag

SEQ ID NO: 6000981 - DNA, 16 bp, Homo sapiens
cagcctacaggcctca

SEQ ID NO: 6000982 - DNA, 18 bp, Homo sapiens
cagcctacccctcctgcg

SEQ ID NO: 6000983 - DNA, 22 bp, Homo sapiens
cagcctaccgctggccctgccg

SEQ ID NO: 6000984 - DNA, 20 bp, Homo sapiens
cagcctactccgctcactga

SEQ ID NO: 6000985 - DNA, 19 bp, Homo sapiens
cagcctagcacagcagctt

SEQ ID NO: 6000986 - DNA, 18 bp, Homo sapiens
cagcctagccgacctcag

SEQ ID NO: 6000987 - DNA, 20 bp, Homo sapiens
cagcctagccgacctcagcc

SEQ ID NO: 6000988 - DNA, 15 bp, Homo sapiens
cagcctaggacgcca

SEQ ID NO: 6000989 - DNA, 19 bp, Homo sapiens
cagcctaggggtcagggac

SEQ ID NO: 6000990 - DNA, 15 bp, Homo sapiens
cagcctaggtggagg

SEQ ID NO: 6000991 - DNA, 16 bp, Homo sapiens
cagcctagttgatcag

SEQ ID NO: 6000992 - DNA, 15 bp, Homo sapiens
cagcctatcaggtgc

SEQ ID NO: 6000993 - DNA, 13 bp, Homo sapiens
cagcctatgagca

SEQ ID NO: 6000994 - DNA, 19 bp, Homo sapiens
cagcctatgagcatcctga

SEQ ID NO: 6000995 - DNA, 14 bp, Homo sapiens
cagcctatgggggc

SEQ ID NO: 6000996 - DNA, 17 bp, Homo sapiens
cagcctatgggggctct

SEQ ID NO: 6000997 - DNA, 19 bp, Homo sapiens
cagcctcaaatccaggacc

SEQ ID NO: 6000998 - DNA, 17 bp, Homo sapiens
cagcctcaacctccctg

SEQ ID NO: 6000999 - DNA, 20 bp, Homo sapiens
cagcctcaacctccctggct

SEQ ID NO: 6001000 - DNA, 22 bp, Homo sapiens
cagcctcaacctccctggctca

SEQ ID NO: 6001001 - DNA, 18 bp, Homo sapiens
cagcctcaacctcctggg

SEQ ID NO: 6001002 - DNA, 19 bp, Homo sapiens
cagcctcaacctcctgggt

SEQ ID NO: 6001003 - DNA, 17 bp, Homo sapiens
cagcctcaaggccctcg

SEQ ID NO: 6001004 - DNA, 21 bp, Homo sapiens
cagcctcaaggccctcggagc

SEQ ID NO: 6001005 - DNA, 18 bp, Homo sapiens
cagcctcaataagccttg

SEQ ID NO: 6001006 - DNA, 16 bp, Homo sapiens
cagcctcacagatgct

SEQ ID NO: 6001007 - DNA, 19 bp, Homo sapiens
cagcctcacagatgctggc

SEQ ID NO: 6001008 - DNA, 14 bp, Homo sapiens
cagcctcacccctg

SEQ ID NO: 6001009 - DNA, 15 bp, Homo sapiens
cagcctcacccctgc

SEQ ID NO: 6001010 - DNA, 18 bp, Homo sapiens
cagcctcacccctgcagg

SEQ ID NO: 6001011 - DNA, 18 bp, Homo sapiens
cagcctcacccctgcccc

SEQ ID NO: 6001012 - DNA, 15 bp, Homo sapiens
cagcctcacccttgc

SEQ ID NO: 6001013 - DNA, 16 bp, Homo sapiens
cagcctcacccttgcg

SEQ ID NO: 6001014 - DNA, 16 bp, Homo sapiens
cagcctcacttccttt

SEQ ID NO: 6001015 - DNA, 20 bp, Homo sapiens
cagcctcacttcctttgccc

SEQ ID NO: 6001016 - DNA, 22 bp, Homo sapiens
cagcctcacttcctttgccctt

SEQ ID NO: 6001017 - DNA, 14 bp, Homo sapiens
cagcctcagaagcc

SEQ ID NO: 6001018 - DNA, 12 bp, Homo sapiens
cagcctcagaga

SEQ ID NO: 6001019 - DNA, 21 bp, Homo sapiens
cagcctcagagacatcagccc

SEQ ID NO: 6001020 - DNA, 16 bp, Homo sapiens
cagcctcagaggcccc

SEQ ID NO: 6001021 - DNA, 14 bp, Homo sapiens
cagcctcagagtgg

SEQ ID NO: 6001022 - DNA, 14 bp, Homo sapiens
cagcctcagcccaa

SEQ ID NO: 6001023 - DNA, 17 bp, Homo sapiens
cagcctcagcgcggccc

SEQ ID NO: 6001024 - DNA, 14 bp, Homo sapiens
cagcctcagctcag

SEQ ID NO: 6001025 - DNA, 18 bp, Homo sapiens
cagcctcagctcagcctc

SEQ ID NO: 6001026 - DNA, 16 bp, Homo sapiens
cagcctcaggactggg

SEQ ID NO: 6001027 - DNA, 17 bp, Homo sapiens
cagcctcaggactggga

SEQ ID NO: 6001028 - DNA, 20 bp, Homo sapiens
cagcctcaggactgggagcc

SEQ ID NO: 6001029 - DNA, 14 bp, Homo sapiens
cagcctcagggctt

SEQ ID NO: 6001030 - DNA, 15 bp, Homo sapiens
cagcctcagggcttc

SEQ ID NO: 6001031 - DNA, 17 bp, Homo sapiens
cagcctcagggcttcct

SEQ ID NO: 6001032 - DNA, 21 bp, Homo sapiens
cagcctcagtcctcccctcac

SEQ ID NO: 6001033 - DNA, 12 bp, Homo sapiens
cagcctcagtgc

SEQ ID NO: 6001034 - DNA, 18 bp, Homo sapiens
cagcctcagtgcagcccc

SEQ ID NO: 6001035 - DNA, 19 bp, Homo sapiens
cagcctcagtgccacttga

SEQ ID NO: 6001036 - DNA, 19 bp, Homo sapiens
cagcctcatactcctgggc

SEQ ID NO: 6001037 - DNA, 15 bp, Homo sapiens
cagcctcatcctgag

SEQ ID NO: 6001038 - DNA, 19 bp, Homo sapiens
cagcctcattcactgtcct

SEQ ID NO: 6001039 - DNA, 17 bp, Homo sapiens
cagcctcattctgaggc

SEQ ID NO: 6001040 - DNA, 21 bp, Homo sapiens
cagcctcattgtgccaagcct

SEQ ID NO: 6001041 - DNA, 21 bp, Homo sapiens
cagcctccaaagtggagctgg

SEQ ID NO: 6001042 - DNA, 20 bp, Homo sapiens
cagcctccaacacaaggctc

SEQ ID NO: 6001043 - DNA, 16 bp, Homo sapiens
cagcctccaactccag

SEQ ID NO: 6001044 - DNA, 12 bp, Homo sapiens
cagcctccaaga

SEQ ID NO: 6001045 - DNA, 14 bp, Homo sapiens
cagcctccaagaaa

SEQ ID NO: 6001046 - DNA, 17 bp, Homo sapiens
cagcctccaatgcattg

SEQ ID NO: 6001047 - DNA, 19 bp, Homo sapiens
cagcctccaatgcattggc

SEQ ID NO: 6001048 - DNA, 16 bp, Homo sapiens
cagcctccactccctg

SEQ ID NO: 6001049 - DNA, 18 bp, Homo sapiens
cagcctccactccctgtc

SEQ ID NO: 6001050 - DNA, 21 bp, Homo sapiens
cagcctccactccctgtctga

SEQ ID NO: 6001051 - DNA, 14 bp, Homo sapiens
cagcctccagagaa

SEQ ID NO: 6001052 - DNA, 21 bp, Homo sapiens
cagcctccagagaagccccgc

SEQ ID NO: 6001053 - DNA, 13 bp, Homo sapiens
cagcctccagcct

SEQ ID NO: 6001054 - DNA, 14 bp, Homo sapiens
cagcctccagcctc

SEQ ID NO: 6001055 - DNA, 16 bp, Homo sapiens
cagcctccagcctctg

SEQ ID NO: 6001056 - DNA, 17 bp, Homo sapiens
cagcctccagcctctgt

SEQ ID NO: 6001057 - DNA, 13 bp, Homo sapiens
cagcctccaggca

SEQ ID NO: 6001058 - DNA, 14 bp, Homo sapiens
cagcctccagggca

SEQ ID NO: 6001059 - DNA, 14 bp, Homo sapiens
cagcctccagggcc

SEQ ID NO: 6001060 - DNA, 15 bp, Homo sapiens
cagcctccagggccc

SEQ ID NO: 6001061 - DNA, 14 bp, Homo sapiens
cagcctccagtctg

SEQ ID NO: 6001062 - DNA, 15 bp, Homo sapiens
cagcctccagtctgc

SEQ ID NO: 6001063 - DNA, 16 bp, Homo sapiens
cagcctccagtctgct

SEQ ID NO: 6001064 - DNA, 15 bp, Homo sapiens
cagcctccagtgctg

SEQ ID NO: 6001065 - DNA, 18 bp, Homo sapiens
cagcctccatcctacccc

SEQ ID NO: 6001066 - DNA, 15 bp, Homo sapiens
cagcctcccaaagtg

SEQ ID NO: 6001067 - DNA, 21 bp, Homo sapiens
cagcctcccaaagtgctgaga

SEQ ID NO: 6001068 - DNA, 19 bp, Homo sapiens
cagcctcccaaagtgctgg

SEQ ID NO: 6001069 - DNA, 21 bp, Homo sapiens
cagcctcccaaagtgctggga

SEQ ID NO: 6001070 - DNA, 20 bp, Homo sapiens
cagcctcccaaccccagggc

SEQ ID NO: 6001071 - DNA, 18 bp, Homo sapiens
cagcctcccaagtagctg

SEQ ID NO: 6001072 - DNA, 20 bp, Homo sapiens
cagcctcccaagtagctggg

SEQ ID NO: 6001073 - DNA, 18 bp, Homo sapiens
cagcctcccacccccatc

SEQ ID NO: 6001074 - DNA, 19 bp, Homo sapiens
cagcctcccagagtgctag

SEQ ID NO: 6001075 - DNA, 19 bp, Homo sapiens
cagcctcccatagctggga

SEQ ID NO: 6001076 - DNA, 14 bp, Homo sapiens
cagcctcccatcca

SEQ ID NO: 6001077 - DNA, 12 bp, Homo sapiens
cagcctccccac

SEQ ID NO: 6001078 - DNA, 13 bp, Homo sapiens
cagcctccccaca

SEQ ID NO: 6001079 - DNA, 21 bp, Homo sapiens
cagcctccccaccccagtggg

SEQ ID NO: 6001080 - DNA, 22 bp, Homo sapiens
cagcctccccaccccagtggga

SEQ ID NO: 6001081 - DNA, 17 bp, Homo sapiens
cagcctcccccaggctg

SEQ ID NO: 6001082 - DNA, 18 bp, Homo sapiens
cagcctcccccaggctgc

SEQ ID NO: 6001083 - DNA, 12 bp, Homo sapiens
cagcctcccccc

SEQ ID NO: 6001084 - DNA, 16 bp, Homo sapiens
cagcctccccccgctg

SEQ ID NO: 6001085 - DNA, 22 bp, Homo sapiens
cagcctccccccgctggggagc

SEQ ID NO: 6001086 - DNA, 14 bp, Homo sapiens
cagcctcccctccc

SEQ ID NO: 6001087 - DNA, 18 bp, Homo sapiens
cagcctcccctcccctgg

SEQ ID NO: 6001088 - DNA, 19 bp, Homo sapiens
cagcctcccctgccagggc

SEQ ID NO: 6001089 - DNA, 12 bp, Homo sapiens
cagcctcccctt

SEQ ID NO: 6001090 - DNA, 13 bp, Homo sapiens
cagcctccccttc

SEQ ID NO: 6001091 - DNA, 14 bp, Homo sapiens
cagcctccccttct

SEQ ID NO: 6001092 - DNA, 12 bp, Homo sapiens
cagcctcccgag

SEQ ID NO: 6001093 - DNA, 22 bp, Homo sapiens
cagcctcccgagtagctgggac

SEQ ID NO: 6001094 - DNA, 23 bp, Homo sapiens
cagcctcccgagtagctgggact

SEQ ID NO: 6001095 - DNA, 11 bp, Homo sapiens
cagcctccctc

SEQ ID NO: 6001096 - DNA, 16 bp, Homo sapiens
cagcctccctcagccc

SEQ ID NO: 6001097 - DNA, 22 bp, Homo sapiens
cagcctccctcagcccccagga

SEQ ID NO: 6001098 - DNA, 13 bp, Homo sapiens
cagcctccctctg

SEQ ID NO: 6001099 - DNA, 14 bp, Homo sapiens
cagcctccctctga

SEQ ID NO: 6001100 - DNA, 21 bp, Homo sapiens
cagcctccctctgacctgcag

SEQ ID NO: 6001101 - DNA, 22 bp, Homo sapiens
cagcctccctctgacctgcagg

SEQ ID NO: 6001102 - DNA, 14 bp, Homo sapiens
cagcctccctgaag

SEQ ID NO: 6001103 - DNA, 17 bp, Homo sapiens
cagcctccctgaagcct

SEQ ID NO: 6001104 - DNA, 20 bp, Homo sapiens
cagcctccctgacgtctgcc

SEQ ID NO: 6001105 - DNA, 21 bp, Homo sapiens
cagcctccctgacgtctgcca

SEQ ID NO: 6001106 - DNA, 23 bp, Homo sapiens
cagcctccctgacgtctgccacc

SEQ ID NO: 6001107 - DNA, 17 bp, Homo sapiens
cagcctccctgagcctg

SEQ ID NO: 6001108 - DNA, 19 bp, Homo sapiens
cagcctccctgagcctgca

SEQ ID NO: 6001109 - DNA, 14 bp, Homo sapiens
cagcctccctgtca

SEQ ID NO: 6001110 - DNA, 15 bp, Homo sapiens
cagcctccctgtcac

SEQ ID NO: 6001111 - DNA, 21 bp, Homo sapiens
cagcctccctgtcggcctggt

SEQ ID NO: 6001112 - DNA, 15 bp, Homo sapiens
cagcctccctgtctc

SEQ ID NO: 6001113 - DNA, 23 bp, Homo sapiens
cagcctccctgtctccagctgcc

SEQ ID NO: 6001114 - DNA, 16 bp, Homo sapiens
cagcctcccttccatg

SEQ ID NO: 6001115 - DNA, 22 bp, Homo sapiens
cagcctcccttccatgccccag

SEQ ID NO: 6001116 - DNA, 14 bp, Homo sapiens
cagcctccctttgc

SEQ ID NO: 6001117 - DNA, 18 bp, Homo sapiens
cagcctccgcctcccggg

SEQ ID NO: 6001118 - DNA, 16 bp, Homo sapiens
cagcctccgcttccct

SEQ ID NO: 6001119 - DNA, 17 bp, Homo sapiens
cacctctctcactcctt

SEQ ID NO: 6001120 - DNA, 20 bp, Homo sapiens
cacctctctcagagcatctg

SEQ ID NO: 6001121 - DNA, 14 bp, Homo sapiens
cacctctctcccca

SEQ ID NO: 6001122 - DNA, 16 bp, Homo sapiens
cacctctctcctttgc

SEQ ID NO: 6001123 - DNA, 14 bp, Homo sapiens
cacctctctggctt

SEQ ID NO: 6001124 - DNA, 12 bp, Homo sapiens
cacctctcttca

SEQ ID NO: 6001125 - DNA, 22 bp, Homo sapiens
cacctctcttttcctctctgtc

SEQ ID NO: 6001126 - DNA, 12 bp, Homo sapiens
cacctctgagga

SEQ ID NO: 6001127 - DNA, 18 bp, Homo sapiens
cacctctgaggactctgg

SEQ ID NO: 6001128 - DNA, 19 bp, Homo sapiens
cacctctgatagactttgt

SEQ ID NO: 6001129 - DNA, 20 bp, Homo sapiens
cacctctgatagactttgtg

SEQ ID NO: 6001130 - DNA, 12 bp, Homo sapiens
cacctctgccac

SEQ ID NO: 6001131 - DNA, 17 bp, Homo sapiens
cacctctgccccttggg

SEQ ID NO: 6001132 - DNA, 13 bp, Homo sapiens
cacctctgccctt

SEQ ID NO: 6001133 - DNA, 16 bp, Homo sapiens
cacctctgcccttccc

SEQ ID NO: 6001134 - DNA, 12 bp, Homo sapiens
cacctctgcctc

SEQ ID NO: 6001135 - DNA, 22 bp, Homo sapiens
cacctctgctactcaagtagca

SEQ ID NO: 6001136 - DNA, 11 bp, Homo sapiens
cacctctgctc

SEQ ID NO: 6001137 - DNA, 19 bp, Homo sapiens
cacctctgctgcccacggc

SEQ ID NO: 6001138 - DNA, 18 bp, Homo sapiens
cacctctggactggctag

SEQ ID NO: 6001139 - DNA, 18 bp, Homo sapiens
cacctctggccaaatatg

SEQ ID NO: 6001140 - DNA, 21 bp, Homo sapiens
cacctctggccaaatatgcac

SEQ ID NO: 6001141 - DNA, 22 bp, Homo sapiens
cacctctggccaaatatgcact

SEQ ID NO: 6001142 - DNA, 23 bp, Homo sapiens
cacctctggccaaatatgcactt

SEQ ID NO: 6001143 - DNA, 17 bp, Homo sapiens
cacctctgggaccccag

SEQ ID NO: 6001144 - DNA, 19 bp, Homo sapiens
cacctctgggaccccagct

SEQ ID NO: 6001145 - DNA, 16 bp, Homo sapiens
cacctctgggccctgc

SEQ ID NO: 6001146 - DNA, 19 bp, Homo sapiens
cacctctgggccctgcagg

SEQ ID NO: 6001147 - DNA, 14 bp, Homo sapiens
cacctctgggggga

SEQ ID NO: 6001148 - DNA, 21 bp, Homo sapiens
cacctctgggtccttggctcc

SEQ ID NO: 6001149 - DNA, 12 bp, Homo sapiens
cacctctggtcc

SEQ ID NO: 6001150 - DNA, 17 bp, Homo sapiens
cacctctggtccacact

SEQ ID NO: 6001151 - DNA, 24 bp, Homo sapiens
cacctctggtggctcctcctagga

SEQ ID NO: 6001152 - DNA, 14 bp, Homo sapiens
cacctctgtaattt

SEQ ID NO: 6001153 - DNA, 15 bp, Homo sapiens
cacctctgtgacctc

SEQ ID NO: 6001154 - DNA, 19 bp, Homo sapiens
cacctctgtgacctcaggc

SEQ ID NO: 6001155 - DNA, 22 bp, Homo sapiens
cacctctgtgacctcaggcact

SEQ ID NO: 6001156 - DNA, 13 bp, Homo sapiens
cacctctgtgctg

SEQ ID NO: 6001157 - DNA, 13 bp, Homo sapiens
cacctctgtggca

SEQ ID NO: 6001158 - DNA, 22 bp, Homo sapiens
cacctcttaaagaaaacccacc

SEQ ID NO: 6001159 - DNA, 12 bp, Homo sapiens
cacctcttccga

SEQ ID NO: 6001160 - DNA, 13 bp, Homo sapiens
cacctcttcctct

SEQ ID NO: 6001161 - DNA, 15 bp, Homo sapiens
cacctcttcctctgg

SEQ ID NO: 6001162 - DNA, 16 bp, Homo sapiens
cacctcttcctctggt

SEQ ID NO: 6001163 - DNA, 13 bp, Homo sapiens
cacctcttccttc

SEQ ID NO: 6001164 - DNA, 16 bp, Homo sapiens
cacctcttctgccagc

SEQ ID NO: 6001165 - DNA, 16 bp, Homo sapiens
cacctcttctgcgtgc

SEQ ID NO: 6001166 - DNA, 23 bp, Homo sapiens
cacctcttgggcatgctcagccc

SEQ ID NO: 6001167 - DNA, 17 bp, Homo sapiens
cacctcttgtttctggg

SEQ ID NO: 6001168 - DNA, 23 bp, Homo sapiens
cacctcttgtttctgggtccctg

SEQ ID NO: 6001169 - DNA, 22 bp, Homo sapiens
cacctctttaaaaactcactta

SEQ ID NO: 6001170 - DNA, 17 bp, Homo sapiens
cacctctttctacagcc

SEQ ID NO: 6001171 - DNA, 17 bp, Homo sapiens
cacctctttgctccctg

SEQ ID NO: 6001172 - DNA, 13 bp, Homo sapiens
cacctctttgtca

SEQ ID NO: 6001173 - DNA, 14 bp, Homo sapiens
cacctcttttccta

SEQ ID NO: 6001174 - DNA, 14 bp, Homo sapiens
cacctgaaacactg

SEQ ID NO: 6001175 - DNA, 17 bp, Homo sapiens
cacctgaaacactggac

SEQ ID NO: 6001176 - DNA, 20 bp, Homo sapiens
cacctgaaacactggacctg

SEQ ID NO: 6001177 - DNA, 14 bp, Homo sapiens
cacctgaaagcctg

SEQ ID NO: 6001178 - DNA, 16 bp, Homo sapiens
cacctgaaagcctgtc

SEQ ID NO: 6001179 - DNA, 14 bp, Homo sapiens
cacctgaaatgcct

SEQ ID NO: 6001180 - DNA, 16 bp, Homo sapiens
cacctgaaccactgtg

SEQ ID NO: 6001181 - DNA, 17 bp, Homo sapiens
cacctgaaccactgtgg

SEQ ID NO: 6001182 - DNA, 15 bp, Homo sapiens
cacctgaaccccaga

SEQ ID NO: 6001183 - DNA, 19 bp, Homo sapiens
cacctgaaccccatgggct

SEQ ID NO: 6001184 - DNA, 23 bp, Homo sapiens
cacctgaaccccatgggcttgga

SEQ ID NO: 6001185 - DNA, 13 bp, Homo sapiens
cacctgaactgaa

SEQ ID NO: 6001186 - DNA, 15 bp, Homo sapiens
cacctgaagactcat

SEQ ID NO: 6001187 - DNA, 23 bp, Homo sapiens
cacctgaagggtggatgtgctgg

SEQ ID NO: 6001188 - DNA, 15 bp, Homo sapiens
cacctgaataaggga

SEQ ID NO: 6001189 - DNA, 18 bp, Homo sapiens
cacctgaatcagctggac

SEQ ID NO: 6001190 - DNA, 19 bp, Homo sapiens
cacctgaatcagctggaca

SEQ ID NO: 6001191 - DNA, 17 bp, Homo sapiens
cacctgacaacttctga

SEQ ID NO: 6001192 - DNA, 18 bp, Homo sapiens
cacctgacaatggcagct

SEQ ID NO: 6001193 - DNA, 16 bp, Homo sapiens
cacctgacacaccagg

SEQ ID NO: 6001194 - DNA, 19 bp, Homo sapiens
cacctgacagcccctccct

SEQ ID NO: 6001195 - DNA, 23 bp, Homo sapiens
cacctgaccaggggccctacctg

SEQ ID NO: 6001196 - DNA, 18 bp, Homo sapiens
cacctgaccgctgcccag

SEQ ID NO: 6001197 - DNA, 19 bp, Homo sapiens
cacctgaccgctgcccagg

SEQ ID NO: 6001198 - DNA, 22 bp, Homo sapiens
cacctgacctctgaagagctga

SEQ ID NO: 6001199 - DNA, 20 bp, Homo sapiens
cacctgacctcttgctgcca

SEQ ID NO: 6001200 - DNA, 23 bp, Homo sapiens
cacctgactctgaaatctgaaga

SEQ ID NO: 6001201 - DNA, 20 bp, Homo sapiens
cacctgacttggctggggag

SEQ ID NO: 6001202 - DNA, 11 bp, Homo sapiens
cacctgagacc

SEQ ID NO: 6001203 - DNA, 19 bp, Homo sapiens
cacctgagcaggacctctg

SEQ ID NO: 6001204 - DNA, 14 bp, Homo sapiens
cacctgagctggtg

SEQ ID NO: 6001205 - DNA, 16 bp, Homo sapiens
cacctgagctttggac

SEQ ID NO: 6001206 - DNA, 11 bp, Homo sapiens
cacctgaggaa

SEQ ID NO: 6001207 - DNA, 15 bp, Homo sapiens
cacctgaggcaggag

SEQ ID NO: 6001208 - DNA, 11 bp, Homo sapiens
cacctgaggtc

SEQ ID NO: 6001209 - DNA, 12 bp, Homo sapiens
cacctgaggtca

SEQ ID NO: 6001210 - DNA, 17 bp, Homo sapiens
cacctgaggtgggccca

SEQ ID NO: 6001211 - DNA, 24 bp, Homo sapiens
cacctgaggtgggcccaggaccag

SEQ ID NO: 6001212 - DNA, 14 bp, Homo sapiens
cacctgatctggcc

SEQ ID NO: 6001213 - DNA, 21 bp, Homo sapiens
cacctgatctggcccaagctg

SEQ ID NO: 6001214 - DNA, 11 bp, Homo sapiens
cacctgatgtg

SEQ ID NO: 6001215 - DNA, 15 bp, Homo sapiens
cacctgatgtgtaca

SEQ ID NO: 6001216 - DNA, 17 bp, Homo sapiens
cacctgattcaactaaa

SEQ ID NO: 6001217 - DNA, 13 bp, Homo sapiens
cacctgcaagccc

SEQ ID NO: 6001218 - DNA, 16 bp, Homo sapiens
cacctgcaagccccag

SEQ ID NO: 6001219 - DNA, 22 bp, Homo sapiens
cacctgcaagccccagggcctg

SEQ ID NO: 6001220 - DNA, 18 bp, Homo sapiens
cacctgcaatcccagcac

SEQ ID NO: 6001221 - DNA, 20 bp, Homo sapiens
cacctgcaatcccagcacct

SEQ ID NO: 6001222 - DNA, 15 bp, Homo sapiens
cacctgcacacccct

SEQ ID NO: 6001223 - DNA, 15 bp, Homo sapiens
cacctgcacactcca

SEQ ID NO: 6001224 - DNA, 19 bp, Homo sapiens
cacctgcacactccatctc

SEQ ID NO: 6001225 - DNA, 21 bp, Homo sapiens
cacctgcacactccatctcct

SEQ ID NO: 6001226 - DNA, 16 bp, Homo sapiens
cacctgcacagggccc

SEQ ID NO: 6001227 - DNA, 19 bp, Homo sapiens
cacctgcacagggccctct

SEQ ID NO: 6001228 - DNA, 13 bp, Homo sapiens
cacctgcacccag

SEQ ID NO: 6001229 - DNA, 11 bp, Homo sapiens
cacctgcacct

SEQ ID NO: 6001230 - DNA, 13 bp, Homo sapiens
cacctgcacctcc

SEQ ID NO: 6001231 - DNA, 17 bp, Homo sapiens
cacctgcacctcccccc

SEQ ID NO: 6001232 - DNA, 15 bp, Homo sapiens
cacctgcactaacag

SEQ ID NO: 6001233 - DNA, 16 bp, Homo sapiens
cacctgcactaacaga

SEQ ID NO: 6001234 - DNA, 14 bp, Homo sapiens
cacctgcagagaaa

SEQ ID NO: 6001235 - DNA, 23 bp, Homo sapiens
cacctgcagattctaggacctgt

SEQ ID NO: 6001236 - DNA, 15 bp, Homo sapiens
cacctgcagattctg

SEQ ID NO: 6001237 - DNA, 23 bp, Homo sapiens
cacctgcagccaagcaaatgcct

SEQ ID NO: 6001238 - DNA, 14 bp, Homo sapiens
cacctgcagcccca

SEQ ID NO: 6001239 - DNA, 21 bp, Homo sapiens
cacctgcagccccaggcctcc

SEQ ID NO: 6001240 - DNA, 15 bp, Homo sapiens
cacctgcagcggctg

SEQ ID NO: 6001241 - DNA, 21 bp, Homo sapiens
cacctgcagcggctgccctct

SEQ ID NO: 6001242 - DNA, 12 bp, Homo sapiens
cacctgcagctc

SEQ ID NO: 6001243 - DNA, 14 bp, Homo sapiens
cacctgcaggctta

SEQ ID NO: 6001244 - DNA, 22 bp, Homo sapiens
cacctgcaggttgggccatact

SEQ ID NO: 6001245 - DNA, 13 bp, Homo sapiens
cacctgcagtgcc

SEQ ID NO: 6001246 - DNA, 18 bp, Homo sapiens
cacctgcagtgccagctc

SEQ ID NO: 6001247 - DNA, 17 bp, Homo sapiens
cacctgcatcagcctct

SEQ ID NO: 6001248 - DNA, 22 bp, Homo sapiens
cacctgcatcagcctctggcca

SEQ ID NO: 6001249 - DNA, 15 bp, Homo sapiens
cacctgcattcttcc

SEQ ID NO: 6001250 - DNA, 19 bp, Homo sapiens
cacctgccaattctacatg

SEQ ID NO: 6001251 - DNA, 12 bp, Homo sapiens
cacctgccacca

SEQ ID NO: 6001252 - DNA, 15 bp, Homo sapiens
cacctgccaccacac

SEQ ID NO: 6001253 - DNA, 22 bp, Homo sapiens
cacctgccacccccttccctgg

SEQ ID NO: 6001254 - DNA, 20 bp, Homo sapiens
cacctgccaccctgggcctg

SEQ ID NO: 6001255 - DNA, 23 bp, Homo sapiens
cacctgccactaggctgggtgcc

SEQ ID NO: 6001256 - DNA, 17 bp, Homo sapiens
cacctgccagaggatgc

SEQ ID NO: 6001257 - DNA, 16 bp, Homo sapiens
cacctgccagcctggc

SEQ ID NO: 6001258 - DNA, 22 bp, Homo sapiens
cacctgccagcctggcttctgg

SEQ ID NO: 6001259 - DNA, 11 bp, Homo sapiens
cacctgccagg

SEQ ID NO: 6001260 - DNA, 12 bp, Homo sapiens
cacctgccaggc

SEQ ID NO: 6001261 - DNA, 15 bp, Homo sapiens
cacctgccaggctgc

SEQ ID NO: 6001262 - DNA, 17 bp, Homo sapiens
cacctgccaggctgcag

SEQ ID NO: 6001263 - DNA, 21 bp, Homo sapiens
cacctgccaggctgcagggac

SEQ ID NO: 6001264 - DNA, 14 bp, Homo sapiens
cacctgccagggac

SEQ ID NO: 6001265 - DNA, 14 bp, Homo sapiens
cacctgccagggcc

SEQ ID NO: 6001266 - DNA, 13 bp, Homo sapiens
cacctgcccaacc

SEQ ID NO: 6001267 - DNA, 16 bp, Homo sapiens
cacctgcccagctccc

SEQ ID NO: 6001268 - DNA, 12 bp, Homo sapiens
cacctgcccagt

SEQ ID NO: 6001269 - DNA, 22 bp, Homo sapiens
cacctgcccatcacagggttgg

SEQ ID NO: 6001270 - DNA, 22 bp, Homo sapiens
cacctgccccaggctcaggctg

SEQ ID NO: 6001271 - DNA, 19 bp, Homo sapiens
cacctgcccccacagctcc

SEQ ID NO: 6001272 - DNA, 23 bp, Homo sapiens
cacctgcccccacagctccttgc

SEQ ID NO: 6001273 - DNA, 24 bp, Homo sapiens
cacctgcccccacagctccttgca

SEQ ID NO: 6001274 - DNA, 14 bp, Homo sapiens
cacctgccccctgg

SEQ ID NO: 6001275 - DNA, 17 bp, Homo sapiens
cacctgcccccttctcc

SEQ ID NO: 6001276 - DNA, 16 bp, Homo sapiens
cacctgcccctcaact

SEQ ID NO: 6001277 - DNA, 21 bp, Homo sapiens
cacctgcccctcaactctcct

SEQ ID NO: 6001278 - DNA, 14 bp, Homo sapiens
cacctgcccctctg

SEQ ID NO: 6001279 - DNA, 15 bp, Homo sapiens
cacctgcccctctgt

SEQ ID NO: 6001280 - DNA, 16 bp, Homo sapiens
cacctgcccctctgtt

SEQ ID NO: 6001281 - DNA, 22 bp, Homo sapiens
cacctgcccctctgttctctcc

SEQ ID NO: 6001282 - DNA, 21 bp, Homo sapiens
cacctgcccggcccaggagcg

SEQ ID NO: 6001283 - DNA, 13 bp, Homo sapiens
cacctgccctacc

SEQ ID NO: 6001284 - DNA, 20 bp, Homo sapiens
cacctgccctacctgcccca

SEQ ID NO: 6001285 - DNA, 12 bp, Homo sapiens
cacctgccctgc

SEQ ID NO: 6001286 - DNA, 23 bp, Homo sapiens
cacctgccctgccctgccacctg

SEQ ID NO: 6001287 - DNA, 19 bp, Homo sapiens
cacctgccctgcctgcatc

SEQ ID NO: 6001288 - DNA, 18 bp, Homo sapiens
cacctgccctgtgcatgt

SEQ ID NO: 6001289 - DNA, 13 bp, Homo sapiens
cacctgccctttt

SEQ ID NO: 6001290 - DNA, 22 bp, Homo sapiens
cacctgcccttttttctgcctc

SEQ ID NO: 6001291 - DNA, 17 bp, Homo sapiens
cacctgccgcatgctcc

SEQ ID NO: 6001292 - DNA, 14 bp, Homo sapiens
cacctgccgccctg

SEQ ID NO: 6001293 - DNA, 14 bp, Homo sapiens
cacctgccgctgct

SEQ ID NO: 6001294 - DNA, 18 bp, Homo sapiens
cacctgccgctgcttgag

SEQ ID NO: 6001295 - DNA, 18 bp, Homo sapiens
cacctgccggctctgggc

SEQ ID NO: 6001296 - DNA, 19 bp, Homo sapiens
cacctgccgtaagttactg

SEQ ID NO: 6001297 - DNA, 17 bp, Homo sapiens
cacctgcctatccatcc

SEQ ID NO: 6001298 - DNA, 20 bp, Homo sapiens
cacctgcctatccatcctgc

SEQ ID NO: 6001299 - DNA, 20 bp, Homo sapiens
cagcctccggatgacacaaa

SEQ ID NO: 6001300 - DNA, 17 bp, Homo sapiens
cagcctccgtcatccat

SEQ ID NO: 6001301 - DNA, 12 bp, Homo sapiens
cagcctcctagg

SEQ ID NO: 6001302 - DNA, 16 bp, Homo sapiens
cagcctcctaggctcc

SEQ ID NO: 6001303 - DNA, 15 bp, Homo sapiens
cagcctcctcccacc

SEQ ID NO: 6001304 - DNA, 12 bp, Homo sapiens
cagcctcctctg

SEQ ID NO: 6001305 - DNA, 23 bp, Homo sapiens
cagcctcctctggacggcaggct

SEQ ID NO: 6001306 - DNA, 11 bp, Homo sapiens
cagcctcctga

SEQ ID NO: 6001307 - DNA, 12 bp, Homo sapiens
cagcctcctgag

SEQ ID NO: 6001308 - DNA, 16 bp, Homo sapiens
cagcctcctgagcctg

SEQ ID NO: 6001309 - DNA, 19 bp, Homo sapiens
cagcctcctgagggctcca

SEQ ID NO: 6001310 - DNA, 15 bp, Homo sapiens
cagcctcctgagtag

SEQ ID NO: 6001311 - DNA, 13 bp, Homo sapiens
cagcctcctgggt

SEQ ID NO: 6001312 - DNA, 19 bp, Homo sapiens
cagcctcctgtctcgccag

SEQ ID NO: 6001313 - DNA, 18 bp, Homo sapiens
cagcctccttgctgaccc

SEQ ID NO: 6001314 - DNA, 22 bp, Homo sapiens
cagcctccttgctgaccccagg

SEQ ID NO: 6001315 - DNA, 17 bp, Homo sapiens
cagcctcgaactcctgg

SEQ ID NO: 6001316 - DNA, 20 bp, Homo sapiens
cagcctcgaactcctgggct

SEQ ID NO: 6001317 - DNA, 24 bp, Homo sapiens
cagcctcgacctccctggcttgag

SEQ ID NO: 6001318 - DNA, 17 bp, Homo sapiens
cagcctcgcacaggccc

SEQ ID NO: 6001319 - DNA, 22 bp, Homo sapiens
cagcctcgcaggcctccctgcc

SEQ ID NO: 6001320 - DNA, 20 bp, Homo sapiens
cagcctcgcccctggcagag

SEQ ID NO: 6001321 - DNA, 17 bp, Homo sapiens
cagcctcgcctgtcacc

SEQ ID NO: 6001322 - DNA, 19 bp, Homo sapiens
cagcctcgcgggtgtcaca

SEQ ID NO: 6001323 - DNA, 17 bp, Homo sapiens
cagcctcggcctaggtc

SEQ ID NO: 6001324 - DNA, 19 bp, Homo sapiens
cagcctcggggatggggag

SEQ ID NO: 6001325 - DNA, 21 bp, Homo sapiens
cagcctcggggatggggaggg

SEQ ID NO: 6001326 - DNA, 22 bp, Homo sapiens
cagcctcgtggagctcgcccct

SEQ ID NO: 6001327 - DNA, 20 bp, Homo sapiens
cagcctcgttaggacaaggc

SEQ ID NO: 6001328 - DNA, 19 bp, Homo sapiens
cagcctcgttggagagcag

SEQ ID NO: 6001329 - DNA, 15 bp, Homo sapiens
cagcctctagggacc

SEQ ID NO: 6001330 - DNA, 20 bp, Homo sapiens
cagcctctagggacccctcc

SEQ ID NO: 6001331 - DNA, 21 bp, Homo sapiens
cagcctctagggacccctcct

SEQ ID NO: 6001332 - DNA, 20 bp, Homo sapiens
cagcctctcaagtagctggg

SEQ ID NO: 6001333 - DNA, 21 bp, Homo sapiens
cagcctctcagtgccctccag

SEQ ID NO: 6001334 - DNA, 20 bp, Homo sapiens
cagcctctccccaggtccag

SEQ ID NO: 6001335 - DNA, 19 bp, Homo sapiens
cagcctctcccctgattac

SEQ ID NO: 6001336 - DNA, 13 bp, Homo sapiens
cagcctctcccgg

SEQ ID NO: 6001337 - DNA, 16 bp, Homo sapiens
cagcctctcccggctg

SEQ ID NO: 6001338 - DNA, 18 bp, Homo sapiens
cagcctctccgactctgc

SEQ ID NO: 6001339 - DNA, 17 bp, Homo sapiens
cagcctctcctccttgg

SEQ ID NO: 6001340 - DNA, 23 bp, Homo sapiens
cagcctctctcccagtctaccca

SEQ ID NO: 6001341 - DNA, 12 bp, Homo sapiens
cagcctctctgc

SEQ ID NO: 6001342 - DNA, 13 bp, Homo sapiens
cagcctctctggc

SEQ ID NO: 6001343 - DNA, 18 bp, Homo sapiens
cagcctctctggctcagc

SEQ ID NO: 6001344 - DNA, 20 bp, Homo sapiens
cagcctctgaagttggacag

SEQ ID NO: 6001345 - DNA, 21 bp, Homo sapiens
cagcctctgaagttggacagc

SEQ ID NO: 6001346 - DNA, 16 bp, Homo sapiens
cagcctctgacccctc

SEQ ID NO: 6001347 - DNA, 17 bp, Homo sapiens
cagcctctgacccctcc

SEQ ID NO: 6001348 - DNA, 18 bp, Homo sapiens
cagcctctgacccctcct

SEQ ID NO: 6001349 - DNA, 14 bp, Homo sapiens
cagcctctgactca

SEQ ID NO: 6001350 - DNA, 11 bp, Homo sapiens
cagcctctgat

SEQ ID NO: 6001351 - DNA, 15 bp, Homo sapiens
cagcctctgatctgt

SEQ ID NO: 6001352 - DNA, 13 bp, Homo sapiens
cagcctctgcaac

SEQ ID NO: 6001353 - DNA, 14 bp, Homo sapiens
cagcctctgcaact

SEQ ID NO: 6001354 - DNA, 13 bp, Homo sapiens
cagcctctgccac

SEQ ID NO: 6001355 - DNA, 15 bp, Homo sapiens
cagcctctgccaggc

SEQ ID NO: 6001356 - DNA, 16 bp, Homo sapiens
cagcctctgccccacc

SEQ ID NO: 6001357 - DNA, 22 bp, Homo sapiens
cagcctctgccccacccatcag

SEQ ID NO: 6001358 - DNA, 12 bp, Homo sapiens
cagcctctgccg

SEQ ID NO: 6001359 - DNA, 14 bp, Homo sapiens
cagcctctgccgct

SEQ ID NO: 6001360 - DNA, 15 bp, Homo sapiens
cagcctctgccgctg

SEQ ID NO: 6001361 - DNA, 19 bp, Homo sapiens
cagcctctgccgctgccat

SEQ ID NO: 6001362 - DNA, 18 bp, Homo sapiens
cagcctctgcctcccagg

SEQ ID NO: 6001363 - DNA, 17 bp, Homo sapiens
cagcctctggacagcca

SEQ ID NO: 6001364 - DNA, 20 bp, Homo sapiens
cagcctctggacagccagtg

SEQ ID NO: 6001365 - DNA, 21 bp, Homo sapiens
cagcctctggacagccagtga

SEQ ID NO: 6001366 - DNA, 14 bp, Homo sapiens
cagcctctggctcc

SEQ ID NO: 6001367 - DNA, 22 bp, Homo sapiens
cagcctctgggccaagactcct

SEQ ID NO: 6001368 - DNA, 21 bp, Homo sapiens
cagcctctgggcccacatccg

SEQ ID NO: 6001369 - DNA, 12 bp, Homo sapiens
cagcctctgggg

SEQ ID NO: 6001370 - DNA, 21 bp, Homo sapiens
cagcctctggggcagagcttg

SEQ ID NO: 6001371 - DNA, 18 bp, Homo sapiens
cagcctctgtcaggcctt

SEQ ID NO: 6001372 - DNA, 23 bp, Homo sapiens
cagcctctgtccctctttgcctg

SEQ ID NO: 6001373 - DNA, 17 bp, Homo sapiens
cagcctcttaccttccc

SEQ ID NO: 6001374 - DNA, 20 bp, Homo sapiens
cagcctcttcagccccttct

SEQ ID NO: 6001375 - DNA, 13 bp, Homo sapiens
cagcctcttccat

SEQ ID NO: 6001376 - DNA, 14 bp, Homo sapiens
cagcctcttcctcc

SEQ ID NO: 6001377 - DNA, 17 bp, Homo sapiens
cagcctcttctgtccca

SEQ ID NO: 6001378 - DNA, 11 bp, Homo sapiens
cagcctcttgc

SEQ ID NO: 6001379 - DNA, 23 bp, Homo sapiens
cagcctcttgcccgtcggccctg

SEQ ID NO: 6001380 - DNA, 17 bp, Homo sapiens
cagcctcttgctcagag

SEQ ID NO: 6001381 - DNA, 15 bp, Homo sapiens
cagcctctttccctt

SEQ ID NO: 6001382 - DNA, 18 bp, Homo sapiens
cagcctctttcccttcca

SEQ ID NO: 6001383 - DNA, 20 bp, Homo sapiens
cagcctctttcccttccagt

SEQ ID NO: 6001384 - DNA, 23 bp, Homo sapiens
cagcctgaaagatacaggggatc

SEQ ID NO: 6001385 - DNA, 20 bp, Homo sapiens
cagcctgaaccccagggctg

SEQ ID NO: 6001386 - DNA, 18 bp, Homo sapiens
cagcctgaagatcagagc

SEQ ID NO: 6001387 - DNA, 22 bp, Homo sapiens
cagcctgaagatcagagctgca

SEQ ID NO: 6001388 - DNA, 13 bp, Homo sapiens
cagcctgaagcct

SEQ ID NO: 6001389 - DNA, 16 bp, Homo sapiens
cagcctgaagcctgga

SEQ ID NO: 6001390 - DNA, 15 bp, Homo sapiens
cagcctgaatcattt

SEQ ID NO: 6001391 - DNA, 18 bp, Homo sapiens
cagcctgacaacagcctg

SEQ ID NO: 6001392 - DNA, 20 bp, Homo sapiens
cagcctgacaacagcctgag

SEQ ID NO: 6001393 - DNA, 23 bp, Homo sapiens
cagcctgacaacagcctgagaaa

SEQ ID NO: 6001394 - DNA, 13 bp, Homo sapiens
cagcctgacctga

SEQ ID NO: 6001395 - DNA, 16 bp, Homo sapiens
cagcctgacctgagac

SEQ ID NO: 6001396 - DNA, 17 bp, Homo sapiens
cagcctgacctgagact

SEQ ID NO: 6001397 - DNA, 16 bp, Homo sapiens
cagcctgactagaact

SEQ ID NO: 6001398 - DNA, 19 bp, Homo sapiens
cagcctgactagaactcct

SEQ ID NO: 6001399 - DNA, 12 bp, Homo sapiens
cagcctgagaat

SEQ ID NO: 6001400 - DNA, 13 bp, Homo sapiens
cagcctgagagtc

SEQ ID NO: 6001401 - DNA, 22 bp, Homo sapiens
cagcctgagcaagacgccctct

SEQ ID NO: 6001402 - DNA, 12 bp, Homo sapiens
cagcctgagcca

SEQ ID NO: 6001403 - DNA, 14 bp, Homo sapiens
cagcctgagccaca

SEQ ID NO: 6001404 - DNA, 15 bp, Homo sapiens
cagcctgagctccac

SEQ ID NO: 6001405 - DNA, 16 bp, Homo sapiens
cagcctgagctccacc

SEQ ID NO: 6001406 - DNA, 17 bp, Homo sapiens
cagcctgagctccaccc

SEQ ID NO: 6001407 - DNA, 21 bp, Homo sapiens
cagcctgagctccaccctccc

SEQ ID NO: 6001408 - DNA, 19 bp, Homo sapiens
cagcctgaggtgcccactc

SEQ ID NO: 6001409 - DNA, 20 bp, Homo sapiens
cagcctgaggtgcccactcc

SEQ ID NO: 6001410 - DNA, 10 bp, Homo sapiens
cagcctgagt

SEQ ID NO: 6001411 - DNA, 15 bp, Homo sapiens
cagcctgagtctcct

SEQ ID NO: 6001412 - DNA, 15 bp, Homo sapiens
cagcctgagtgacag

SEQ ID NO: 6001413 - DNA, 21 bp, Homo sapiens
cagcctgatcaggcttcctgg

SEQ ID NO: 6001414 - DNA, 16 bp, Homo sapiens
cagcctgatggccaag

SEQ ID NO: 6001415 - DNA, 11 bp, Homo sapiens
cagcctgcaca

SEQ ID NO: 6001416 - DNA, 17 bp, Homo sapiens
cagcctgcacacacctg

SEQ ID NO: 6001417 - DNA, 21 bp, Homo sapiens
cagcctgcacacacctgcctg

SEQ ID NO: 6001418 - DNA, 23 bp, Homo sapiens
cagcctgcacacacctgcctgca

SEQ ID NO: 6001419 - DNA, 15 bp, Homo sapiens
cagcctgcacccctc

SEQ ID NO: 6001420 - DNA, 20 bp, Homo sapiens
cagcctgcacctgccccgtg

SEQ ID NO: 6001421 - DNA, 21 bp, Homo sapiens
cagcctgcccaagcccaggcc

SEQ ID NO: 6001422 - DNA, 23 bp, Homo sapiens
cagcctgcccaagcccaggccac

SEQ ID NO: 6001423 - DNA, 14 bp, Homo sapiens
cagcctgcccacct

SEQ ID NO: 6001424 - DNA, 18 bp, Homo sapiens
cagcctgcccacctctcc

SEQ ID NO: 6001425 - DNA, 20 bp, Homo sapiens
cagcctgcccacctctccct

SEQ ID NO: 6001426 - DNA, 13 bp, Homo sapiens
cagcctgccccct

SEQ ID NO: 6001427 - DNA, 14 bp, Homo sapiens
cagcctgccctcca

SEQ ID NO: 6001428 - DNA, 17 bp, Homo sapiens
cagcctgccctcttcat

SEQ ID NO: 6001429 - DNA, 16 bp, Homo sapiens
cagcctgcctctgcca

SEQ ID NO: 6001430 - DNA, 19 bp, Homo sapiens
cagcctgcctctgccacag

SEQ ID NO: 6001431 - DNA, 12 bp, Homo sapiens
cagcctgcctga

SEQ ID NO: 6001432 - DNA, 15 bp, Homo sapiens
cagcctgcctgaaga

SEQ ID NO: 6001433 - DNA, 16 bp, Homo sapiens
cagcctgcctgaagag

SEQ ID NO: 6001434 - DNA, 14 bp, Homo sapiens
cagcctgcctggag

SEQ ID NO: 6001435 - DNA, 15 bp, Homo sapiens
cagcctgcctggcag

SEQ ID NO: 6001436 - DNA, 21 bp, Homo sapiens
cagcctgccttgcccactcct

SEQ ID NO: 6001437 - DNA, 15 bp, Homo sapiens
cagcctgcgcctgct

SEQ ID NO: 6001438 - DNA, 17 bp, Homo sapiens
cagcctgcgcctgctgc

SEQ ID NO: 6001439 - DNA, 22 bp, Homo sapiens
cagcctgcgcctgctgcatgcc

SEQ ID NO: 6001440 - DNA, 20 bp, Homo sapiens
cagcctgcgctcggcaggaa

SEQ ID NO: 6001441 - DNA, 22 bp, Homo sapiens
cagcctgcgctcggcaggaagg

SEQ ID NO: 6001442 - DNA, 24 bp, Homo sapiens
cagcctgcgctcggcaggaaggag

SEQ ID NO: 6001443 - DNA, 18 bp, Homo sapiens
cagcctgcgggaagctga

SEQ ID NO: 6001444 - DNA, 23 bp, Homo sapiens
cagcctgcgggaagctgaccttt

SEQ ID NO: 6001445 - DNA, 13 bp, Homo sapiens
cagcctgctagct

SEQ ID NO: 6001446 - DNA, 23 bp, Homo sapiens
cagcctgctagctagctcaacta

SEQ ID NO: 6001447 - DNA, 16 bp, Homo sapiens
cagcctgctccagctg

SEQ ID NO: 6001448 - DNA, 17 bp, Homo sapiens
cagcctgctccagctgt

SEQ ID NO: 6001449 - DNA, 20 bp, Homo sapiens
cagcctgctccagctgttca

SEQ ID NO: 6001450 - DNA, 21 bp, Homo sapiens
cagcctgctccttcccaggag

SEQ ID NO: 6001451 - DNA, 23 bp, Homo sapiens
cagcctgctctagtgggacagcc

SEQ ID NO: 6001452 - DNA, 13 bp, Homo sapiens
cagcctgctctcc

SEQ ID NO: 6001453 - DNA, 14 bp, Homo sapiens
cagcctgctctccc

SEQ ID NO: 6001454 - DNA, 13 bp, Homo sapiens
cagcctgctgaca

SEQ ID NO: 6001455 - DNA, 14 bp, Homo sapiens
cagcctgctgctct

SEQ ID NO: 6001456 - DNA, 16 bp, Homo sapiens
cagcctgctggcaggg

SEQ ID NO: 6001457 - DNA, 19 bp, Homo sapiens
cagcctgctggcagggcca

SEQ ID NO: 6001458 - DNA, 20 bp, Homo sapiens
cagcctgctggcagggccag

SEQ ID NO: 6001459 - DNA, 22 bp, Homo sapiens
cagcctgctggcagggccaggg

SEQ ID NO: 6001460 - DNA, 13 bp, Homo sapiens
cagcctgctgggg

SEQ ID NO: 6001461 - DNA, 15 bp, Homo sapiens
cagcctgctggggct

SEQ ID NO: 6001462 - DNA, 13 bp, Homo sapiens
cagcctgcttccc

SEQ ID NO: 6001463 - DNA, 14 bp, Homo sapiens
cagcctgcttccca

SEQ ID NO: 6001464 - DNA, 20 bp, Homo sapiens
cagcctgctttcctgcagca

SEQ ID NO: 6001465 - DNA, 13 bp, Homo sapiens
cagcctgctttgg

SEQ ID NO: 6001466 - DNA, 19 bp, Homo sapiens
cagcctggaaacctgtctg

SEQ ID NO: 6001467 - DNA, 20 bp, Homo sapiens
cagcctggaaacctgtctga

SEQ ID NO: 6001468 - DNA, 17 bp, Homo sapiens
cagcctggaccactcct

SEQ ID NO: 6001469 - DNA, 16 bp, Homo sapiens
cagcctggacccccag

SEQ ID NO: 6001470 - DNA, 18 bp, Homo sapiens
cagcctggacccccagct

SEQ ID NO: 6001471 - DNA, 17 bp, Homo sapiens
cagcctggagacttcct

SEQ ID NO: 6001472 - DNA, 16 bp, Homo sapiens
cagcctggagaggcct

SEQ ID NO: 6001473 - DNA, 21 bp, Homo sapiens
cagcctggagaggcctggggt

SEQ ID NO: 6001474 - DNA, 14 bp, Homo sapiens
cagcctggagccct

SEQ ID NO: 6001475 - DNA, 14 bp, Homo sapiens
cagcctggagccgt

SEQ ID NO: 6001476 - DNA, 22 bp, Homo sapiens
cagcctggagcggagcttgcct

SEQ ID NO: 6001477 - DNA, 13 bp, Homo sapiens
cagcctggaggcc

SEQ ID NO: 6001478 - DNA, 14 bp, Homo sapiens
cacctgcctcagct

SEQ ID NO: 6001479 - DNA, 18 bp, Homo sapiens
cacctgcctcagctacct

SEQ ID NO: 6001480 - DNA, 16 bp, Homo sapiens
cacctgcctccaccag

SEQ ID NO: 6001481 - DNA, 17 bp, Homo sapiens
cacctgcctccaccagc

SEQ ID NO: 6001482 - DNA, 17 bp, Homo sapiens
cacctgcctccagccgc

SEQ ID NO: 6001483 - DNA, 14 bp, Homo sapiens
cacctgcctcctcg

SEQ ID NO: 6001484 - DNA, 18 bp, Homo sapiens
cacctgcctcggcctccc

SEQ ID NO: 6001485 - DNA, 21 bp, Homo sapiens
cacctgcctcggcctcccaaa

SEQ ID NO: 6001486 - DNA, 23 bp, Homo sapiens
cacctgcctcggcctcccaaagt

SEQ ID NO: 6001487 - DNA, 20 bp, Homo sapiens
cacctgcctctgaactgctg

SEQ ID NO: 6001488 - DNA, 21 bp, Homo sapiens
cacctgcctctgaccccagca

SEQ ID NO: 6001489 - DNA, 11 bp, Homo sapiens
cacctgcctga

SEQ ID NO: 6001490 - DNA, 15 bp, Homo sapiens
cacctgcctgcagag

SEQ ID NO: 6001491 - DNA, 15 bp, Homo sapiens
cacctgcctgccgct

SEQ ID NO: 6001492 - DNA, 16 bp, Homo sapiens
cacctgcctgcgtctt

SEQ ID NO: 6001493 - DNA, 13 bp, Homo sapiens
cacctgcctggcc

SEQ ID NO: 6001494 - DNA, 16 bp, Homo sapiens
cacctgcctggccggc

SEQ ID NO: 6001495 - DNA, 20 bp, Homo sapiens
cacctgcctggccggccagc

SEQ ID NO: 6001496 - DNA, 18 bp, Homo sapiens
cacctgcctggtgcattg

SEQ ID NO: 6001497 - DNA, 17 bp, Homo sapiens
cacctgcctgttgggcc

SEQ ID NO: 6001498 - DNA, 19 bp, Homo sapiens
cacctgcctgttgggccag

SEQ ID NO: 6001499 - DNA, 18 bp, Homo sapiens
cacctgccttggcctccc

SEQ ID NO: 6001500 - DNA, 18 bp, Homo sapiens
cacctgcgcaagtgcctg

SEQ ID NO: 6001501 - DNA, 20 bp, Homo sapiens
cacctgcgcaagtgcctggg

SEQ ID NO: 6001502 - DNA, 14 bp, Homo sapiens
cacctgcgcacagg

SEQ ID NO: 6001503 - DNA, 22 bp, Homo sapiens
cacctgcgcacaggtgggagga

SEQ ID NO: 6001504 - DNA, 17 bp, Homo sapiens
cacctgcgcagggccct

SEQ ID NO: 6001505 - DNA, 19 bp, Homo sapiens
cacctgcgcttctgctgga

SEQ ID NO: 6001506 - DNA, 21 bp, Homo sapiens
cacctgcgcttctgctggagg

SEQ ID NO: 6001507 - DNA, 21 bp, Homo sapiens
cacctgcggccgccccccgcc

SEQ ID NO: 6001508 - DNA, 16 bp, Homo sapiens
cacctgcggtgctatc

SEQ ID NO: 6001509 - DNA, 23 bp, Homo sapiens
cacctgctagtcgcccctcagag

SEQ ID NO: 6001510 - DNA, 13 bp, Homo sapiens
cacctgctcacag

SEQ ID NO: 6001511 - DNA, 14 bp, Homo sapiens
cacctgctcacagg

SEQ ID NO: 6001512 - DNA, 22 bp, Homo sapiens
cacctgctcacagggatgctgg

SEQ ID NO: 6001513 - DNA, 14 bp, Homo sapiens
cacctgctccagaa

SEQ ID NO: 6001514 - DNA, 12 bp, Homo sapiens
cacctgctccca

SEQ ID NO: 6001515 - DNA, 15 bp, Homo sapiens
cacctgctcccaggc

SEQ ID NO: 6001516 - DNA, 17 bp, Homo sapiens
cacctgctcccaggccc

SEQ ID NO: 6001517 - DNA, 21 bp, Homo sapiens
cacctgctcccagtcctgcct

SEQ ID NO: 6001518 - DNA, 16 bp, Homo sapiens
cacctgctcttcccag

SEQ ID NO: 6001519 - DNA, 22 bp, Homo sapiens
cacctgctgagagacccaagga

SEQ ID NO: 6001520 - DNA, 23 bp, Homo sapiens
cacctgctgagggggctctttcc

SEQ ID NO: 6001521 - DNA, 20 bp, Homo sapiens
cacctgctgcccgtgaggag

SEQ ID NO: 6001522 - DNA, 11 bp, Homo sapiens
cacctgctgcg

SEQ ID NO: 6001523 - DNA, 15 bp, Homo sapiens
cacctgctgcgtccc

SEQ ID NO: 6001524 - DNA, 20 bp, Homo sapiens
cacctgctgcgtccccactc

SEQ ID NO: 6001525 - DNA, 21 bp, Homo sapiens
cacctgctgcgtccccactcc

SEQ ID NO: 6001526 - DNA, 13 bp, Homo sapiens
cacctgctggaaa

SEQ ID NO: 6001527 - DNA, 15 bp, Homo sapiens
cacctgctggagtga

SEQ ID NO: 6001528 - DNA, 22 bp, Homo sapiens
cacctgctggcccctcacctgg

SEQ ID NO: 6001529 - DNA, 21 bp, Homo sapiens
cacctgctggttgttgccagg

SEQ ID NO: 6001530 - DNA, 22 bp, Homo sapiens
cacctgcttgtgttgggcccca

SEQ ID NO: 6001531 - DNA, 18 bp, Homo sapiens
cacctggaaactgctcag

SEQ ID NO: 6001532 - DNA, 15 bp, Homo sapiens
cacctggaaagccag

SEQ ID NO: 6001533 - DNA, 22 bp, Homo sapiens
cacctggaagccctctctggct

SEQ ID NO: 6001534 - DNA, 14 bp, Homo sapiens
cacctggaatcaga

SEQ ID NO: 6001535 - DNA, 23 bp, Homo sapiens
cacctggaattttcagtcatctc

SEQ ID NO: 6001536 - DNA, 16 bp, Homo sapiens
cacctggacacacact

SEQ ID NO: 6001537 - DNA, 19 bp, Homo sapiens
cacctggacacacactcac

SEQ ID NO: 6001538 - DNA, 13 bp, Homo sapiens
cacctggacatgt

SEQ ID NO: 6001539 - DNA, 17 bp, Homo sapiens
cacctggaccccctgcc

SEQ ID NO: 6001540 - DNA, 18 bp, Homo sapiens
cacctggaccccctgccc

SEQ ID NO: 6001541 - DNA, 16 bp, Homo sapiens
cacctggacccctgca

SEQ ID NO: 6001542 - DNA, 18 bp, Homo sapiens
cacctggacccctgcatt

SEQ ID NO: 6001543 - DNA, 23 bp, Homo sapiens
cacctggactgagccaaggaggc

SEQ ID NO: 6001544 - DNA, 16 bp, Homo sapiens
cacctggagcccacag

SEQ ID NO: 6001545 - DNA, 15 bp, Homo sapiens
cacctggagcccgct

SEQ ID NO: 6001546 - DNA, 19 bp, Homo sapiens
cacctggaggcaagaggga

SEQ ID NO: 6001547 - DNA, 19 bp, Homo sapiens
cacctggaggggcaccagg

SEQ ID NO: 6001548 - DNA, 19 bp, Homo sapiens
cacctggatctatccctgc

SEQ ID NO: 6001549 - DNA, 14 bp, Homo sapiens
cacctggcacacca

SEQ ID NO: 6001550 - DNA, 18 bp, Homo sapiens
cacctggcactgctgtgc

SEQ ID NO: 6001551 - DNA, 18 bp, Homo sapiens
cacctggcagggctcaca

SEQ ID NO: 6001552 - DNA, 11 bp, Homo sapiens
cacctggccac

SEQ ID NO: 6001553 - DNA, 13 bp, Homo sapiens
cacctggccacct

SEQ ID NO: 6001554 - DNA, 14 bp, Homo sapiens
cacctggccacctg

SEQ ID NO: 6001555 - DNA, 17 bp, Homo sapiens
cacctggccacctgagg

SEQ ID NO: 6001556 - DNA, 14 bp, Homo sapiens
cacctggccccatg

SEQ ID NO: 6001557 - DNA, 20 bp, Homo sapiens
cacctggccccatgtctctc

SEQ ID NO: 6001558 - DNA, 16 bp, Homo sapiens
cacctggccctggggc

SEQ ID NO: 6001559 - DNA, 22 bp, Homo sapiens
cacctggccgggtcaccctgtg

SEQ ID NO: 6001560 - DNA, 13 bp, Homo sapiens
cacctggcctctg

SEQ ID NO: 6001561 - DNA, 14 bp, Homo sapiens
cacctggcctctgc

SEQ ID NO: 6001562 - DNA, 13 bp, Homo sapiens
cacctggcctgcc

SEQ ID NO: 6001563 - DNA, 15 bp, Homo sapiens
cacctggcctgccac

SEQ ID NO: 6001564 - DNA, 23 bp, Homo sapiens
cacctggcctgccaccctcctgc

SEQ ID NO: 6001565 - DNA, 15 bp, Homo sapiens
cacctggcctgctgg

SEQ ID NO: 6001566 - DNA, 16 bp, Homo sapiens
cacctggcctgctggg

SEQ ID NO: 6001567 - DNA, 18 bp, Homo sapiens
cacctggcctgctgggaa

SEQ ID NO: 6001568 - DNA, 17 bp, Homo sapiens
cacctggcctgggccac

SEQ ID NO: 6001569 - DNA, 20 bp, Homo sapiens
cacctggcctgggccacacc

SEQ ID NO: 6001570 - DNA, 13 bp, Homo sapiens
cacctggccttaa

SEQ ID NO: 6001571 - DNA, 17 bp, Homo sapiens
cacctggctctcacctc

SEQ ID NO: 6001572 - DNA, 20 bp, Homo sapiens
cacctggctgagcagttccc

SEQ ID NO: 6001573 - DNA, 22 bp, Homo sapiens
cacctggctgagcagttcccct

SEQ ID NO: 6001574 - DNA, 19 bp, Homo sapiens
cacctggctgaggttcctc

SEQ ID NO: 6001575 - DNA, 13 bp, Homo sapiens
cacctggctgcca

SEQ ID NO: 6001576 - DNA, 15 bp, Homo sapiens
cacctggctgccaac

SEQ ID NO: 6001577 - DNA, 23 bp, Homo sapiens
cacctggcttcatacagaaggca

SEQ ID NO: 6001578 - DNA, 15 bp, Homo sapiens
cacctggcttcccag

SEQ ID NO: 6001579 - DNA, 14 bp, Homo sapiens
cacctggcttgttt

SEQ ID NO: 6001580 - DNA, 22 bp, Homo sapiens
cacctggcttgtttattttgtg

SEQ ID NO: 6001581 - DNA, 15 bp, Homo sapiens
cacctgggaacacag

SEQ ID NO: 6001582 - DNA, 23 bp, Homo sapiens
cacctgggaacacagttctgggc

SEQ ID NO: 6001583 - DNA, 21 bp, Homo sapiens
cacctgggacagggagcagcc

SEQ ID NO: 6001584 - DNA, 20 bp, Homo sapiens
cacctgggattacaagcatg

SEQ ID NO: 6001585 - DNA, 16 bp, Homo sapiens
cacctgggcagctcct

SEQ ID NO: 6001586 - DNA, 18 bp, Homo sapiens
cacctgggcagctcctcc

SEQ ID NO: 6001587 - DNA, 20 bp, Homo sapiens
cacctgggcagctcctccct

SEQ ID NO: 6001588 - DNA, 17 bp, Homo sapiens
cacctgggccaaggact

SEQ ID NO: 6001589 - DNA, 15 bp, Homo sapiens
cacctgggccccact

SEQ ID NO: 6001590 - DNA, 17 bp, Homo sapiens
cacctgggccctggggc

SEQ ID NO: 6001591 - DNA, 21 bp, Homo sapiens
cacctgggccctggggcctgt

SEQ ID NO: 6001592 - DNA, 23 bp, Homo sapiens
cacctgggccctggggcctgtac

SEQ ID NO: 6001593 - DNA, 18 bp, Homo sapiens
cacctgggccgggctgta

SEQ ID NO: 6001594 - DNA, 18 bp, Homo sapiens
cacctgggcctcccatag

SEQ ID NO: 6001595 - DNA, 15 bp, Homo sapiens
cacctgggcctttcc

SEQ ID NO: 6001596 - DNA, 19 bp, Homo sapiens
cacctggggcagtcacctg

SEQ ID NO: 6001597 - DNA, 18 bp, Homo sapiens
cacctgggggggttgggc

SEQ ID NO: 6001598 - DNA, 10 bp, Homo sapiens
cacctggggt

SEQ ID NO: 6001599 - DNA, 18 bp, Homo sapiens
cacctggggtctctctcc

SEQ ID NO: 6001600 - DNA, 18 bp, Homo sapiens
cacctgggtctttatgca

SEQ ID NO: 6001601 - DNA, 21 bp, Homo sapiens
cacctgggtgtgctccaggct

SEQ ID NO: 6001602 - DNA, 23 bp, Homo sapiens
cacctgggtgtgctccaggcttc

SEQ ID NO: 6001603 - DNA, 17 bp, Homo sapiens
cacctgggttccccacc

SEQ ID NO: 6001604 - DNA, 20 bp, Homo sapiens
cacctggtactccctctcag

SEQ ID NO: 6001605 - DNA, 13 bp, Homo sapiens
cacctggtactga

SEQ ID NO: 6001606 - DNA, 20 bp, Homo sapiens
cacctggtactgacccagga

SEQ ID NO: 6001607 - DNA, 19 bp, Homo sapiens
cacctggtattatttttct

SEQ ID NO: 6001608 - DNA, 21 bp, Homo sapiens
cacctggtcctccgcctactg

SEQ ID NO: 6001609 - DNA, 16 bp, Homo sapiens
cacctggtgcgggcct

SEQ ID NO: 6001610 - DNA, 21 bp, Homo sapiens
cacctggtgcgggcctggccc

SEQ ID NO: 6001611 - DNA, 16 bp, Homo sapiens
cacctggtggccctgc

SEQ ID NO: 6001612 - DNA, 22 bp, Homo sapiens
cacctggtgggtggtgtcctga

SEQ ID NO: 6001613 - DNA, 11 bp, Homo sapiens
cacctggttgc

SEQ ID NO: 6001614 - DNA, 15 bp, Homo sapiens
cacctgtaaaacttt

SEQ ID NO: 6001615 - DNA, 23 bp, Homo sapiens
cacctgtaaaactttattttata

SEQ ID NO: 6001616 - DNA, 16 bp, Homo sapiens
cacctgtaaacctgag

SEQ ID NO: 6001617 - DNA, 16 bp, Homo sapiens
cacctgtaatcccagc

SEQ ID NO: 6001618 - DNA, 20 bp, Homo sapiens
cacctgtaatgtgcgaggga

SEQ ID NO: 6001619 - DNA, 11 bp, Homo sapiens
cacctgtacag

SEQ ID NO: 6001620 - DNA, 12 bp, Homo sapiens
cacctgtacatt

SEQ ID NO: 6001621 - DNA, 18 bp, Homo sapiens
cacctgtactcttccgaa

SEQ ID NO: 6001622 - DNA, 16 bp, Homo sapiens
cacctgtactggagag

SEQ ID NO: 6001623 - DNA, 18 bp, Homo sapiens
cacctgtagcacttactg

SEQ ID NO: 6001624 - DNA, 22 bp, Homo sapiens
cacctgtagcacttactggtag

SEQ ID NO: 6001625 - DNA, 22 bp, Homo sapiens
cacctgtagccatctgcacaca

SEQ ID NO: 6001626 - DNA, 18 bp, Homo sapiens
cacctgtaggatattgga

SEQ ID NO: 6001627 - DNA, 13 bp, Homo sapiens
cacctgtagtccc

SEQ ID NO: 6001628 - DNA, 14 bp, Homo sapiens
cacctgtagtccca

SEQ ID NO: 6001629 - DNA, 15 bp, Homo sapiens
cacctgtagtcccag

SEQ ID NO: 6001630 - DNA, 16 bp, Homo sapiens
cacctgtagtcccagc

SEQ ID NO: 6001631 - DNA, 19 bp, Homo sapiens
cacctgtagtcccagctac

SEQ ID NO: 6001632 - DNA, 13 bp, Homo sapiens
cacctgtcaaaca

SEQ ID NO: 6001633 - DNA, 20 bp, Homo sapiens
cacctgtcaaacaaagccag

SEQ ID NO: 6001634 - DNA, 14 bp, Homo sapiens
cacctgtcaggcct

SEQ ID NO: 6001635 - DNA, 15 bp, Homo sapiens
cacctgtcccacctc

SEQ ID NO: 6001636 - DNA, 14 bp, Homo sapiens
cacctgtcccagaa

SEQ ID NO: 6001637 - DNA, 15 bp, Homo sapiens
cacctgtcccagaaa

SEQ ID NO: 6001638 - DNA, 20 bp, Homo sapiens
cacctgtccggcccagtgcc

SEQ ID NO: 6001639 - DNA, 21 bp, Homo sapiens
cacctgtccggcccagtgcca

SEQ ID NO: 6001640 - DNA, 15 bp, Homo sapiens
cacctgtccttctca

SEQ ID NO: 6001641 - DNA, 23 bp, Homo sapiens
cacctgtccttctcaggctggca

SEQ ID NO: 6001642 - DNA, 15 bp, Homo sapiens
cacctgtcgcccagt

SEQ ID NO: 6001643 - DNA, 17 bp, Homo sapiens
cacctgtcgcccagtgc

SEQ ID NO: 6001644 - DNA, 23 bp, Homo sapiens
cacctgtcggtggctgcctttga

SEQ ID NO: 6001645 - DNA, 19 bp, Homo sapiens
cacctgtctcagcctccca

SEQ ID NO: 6001646 - DNA, 20 bp, Homo sapiens
cacctgtctcatagcctcga

SEQ ID NO: 6001647 - DNA, 11 bp, Homo sapiens
cacctgtctgc

SEQ ID NO: 6001648 - DNA, 14 bp, Homo sapiens
cacctgtctgctcc

SEQ ID NO: 6001649 - DNA, 11 bp, Homo sapiens
cacctgtctgt

SEQ ID NO: 6001650 - DNA, 22 bp, Homo sapiens
cacctgtctgtctgtctgtccc

SEQ ID NO: 6001651 - DNA, 16 bp, Homo sapiens
cacctgtctgtgcaga

SEQ ID NO: 6001652 - DNA, 18 bp, Homo sapiens
cacctgtcttgaataaga

SEQ ID NO: 6001653 - DNA, 20 bp, Homo sapiens
cacctgtcttgcctttttca

SEQ ID NO: 6001654 - DNA, 13 bp, Homo sapiens
cacctgtgacaaa

SEQ ID NO: 6001655 - DNA, 14 bp, Homo sapiens
cacctgtgacaaag

SEQ ID NO: 6001656 - DNA, 16 bp, Homo sapiens
cacctgtgagaaagga

SEQ ID NO: 6001657 - DNA, 19 bp, Homo sapiens
cagcctggatccctgccct

SEQ ID NO: 6001658 - DNA, 12 bp, Homo sapiens
cagcctggatgc

SEQ ID NO: 6001659 - DNA, 10 bp, Homo sapiens
cagcctggca

SEQ ID NO: 6001660 - DNA, 19 bp, Homo sapiens
cagcctggcatctgtgcgt

SEQ ID NO: 6001661 - DNA, 20 bp, Homo sapiens
cagcctggccaacatgctga

SEQ ID NO: 6001662 - DNA, 19 bp, Homo sapiens
cagcctggccacgcagcca

SEQ ID NO: 6001663 - DNA, 20 bp, Homo sapiens
cagcctggccacgcagccag

SEQ ID NO: 6001664 - DNA, 21 bp, Homo sapiens
cagcctggccacgcagccagg

SEQ ID NO: 6001665 - DNA, 22 bp, Homo sapiens
cagcctggccacgcagccagga

SEQ ID NO: 6001666 - DNA, 18 bp, Homo sapiens
cagcctggccagacaaga

SEQ ID NO: 6001667 - DNA, 20 bp, Homo sapiens
cagcctggccagacacaggc

SEQ ID NO: 6001668 - DNA, 12 bp, Homo sapiens
cagcctggccca

SEQ ID NO: 6001669 - DNA, 14 bp, Homo sapiens
cagcctggcccagc

SEQ ID NO: 6001670 - DNA, 17 bp, Homo sapiens
cagcctggcccagctcc

SEQ ID NO: 6001671 - DNA, 18 bp, Homo sapiens
cagcctggcccagctccc

SEQ ID NO: 6001672 - DNA, 20 bp, Homo sapiens
cagcctggcccagctccccc

SEQ ID NO: 6001673 - DNA, 12 bp, Homo sapiens
cagcctggcccc

SEQ ID NO: 6001674 - DNA, 15 bp, Homo sapiens
cagcctggccccaaa

SEQ ID NO: 6001675 - DNA, 11 bp, Homo sapiens
cagcctggcct

SEQ ID NO: 6001676 - DNA, 14 bp, Homo sapiens
cagcctggcctcct

SEQ ID NO: 6001677 - DNA, 12 bp, Homo sapiens
cagcctggcctg

SEQ ID NO: 6001678 - DNA, 15 bp, Homo sapiens
cagcctggcggggca

SEQ ID NO: 6001679 - DNA, 20 bp, Homo sapiens
cagcctggcggggcaggagg

SEQ ID NO: 6001680 - DNA, 21 bp, Homo sapiens
cagcctggcggggcaggaggc

SEQ ID NO: 6001681 - DNA, 23 bp, Homo sapiens
cagcctggctcccacaggcagct

SEQ ID NO: 6001682 - DNA, 15 bp, Homo sapiens
cagcctggctcccct

SEQ ID NO: 6001683 - DNA, 17 bp, Homo sapiens
cagcctggctcccctgg

SEQ ID NO: 6001684 - DNA, 18 bp, Homo sapiens
cagcctggctcccctggg

SEQ ID NO: 6001685 - DNA, 15 bp, Homo sapiens
cagcctggctgggct

SEQ ID NO: 6001686 - DNA, 20 bp, Homo sapiens
cagcctggctggtcctccca

SEQ ID NO: 6001687 - DNA, 15 bp, Homo sapiens
cagcctggcttctgg

SEQ ID NO: 6001688 - DNA, 17 bp, Homo sapiens
cagcctggcttctggag

SEQ ID NO: 6001689 - DNA, 21 bp, Homo sapiens
cagcctggcttctggagccct

SEQ ID NO: 6001690 - DNA, 20 bp, Homo sapiens
cagcctgggaaagcccctgc

SEQ ID NO: 6001691 - DNA, 11 bp, Homo sapiens
cagcctgggac

SEQ ID NO: 6001692 - DNA, 23 bp, Homo sapiens
cagcctgggacagtttatcatga

SEQ ID NO: 6001693 - DNA, 18 bp, Homo sapiens
cagcctgggactcccagt

SEQ ID NO: 6001694 - DNA, 16 bp, Homo sapiens
cagcctgggagcccag

SEQ ID NO: 6001695 - DNA, 19 bp, Homo sapiens
cagcctgggagcccagagg

SEQ ID NO: 6001696 - DNA, 16 bp, Homo sapiens
cagcctgggaggcaca

SEQ ID NO: 6001697 - DNA, 17 bp, Homo sapiens
cagcctgggaggcacag

SEQ ID NO: 6001698 - DNA, 21 bp, Homo sapiens
cagcctgggataggggcagag

SEQ ID NO: 6001699 - DNA, 17 bp, Homo sapiens
cagcctgggcagccagg

SEQ ID NO: 6001700 - DNA, 19 bp, Homo sapiens
cagcctgggcagccaggct

SEQ ID NO: 6001701 - DNA, 18 bp, Homo sapiens
cagcctgggcccatctcc

SEQ ID NO: 6001702 - DNA, 14 bp, Homo sapiens
cagcctgggcccct

SEQ ID NO: 6001703 - DNA, 18 bp, Homo sapiens
cagcctgggcccctcagc

SEQ ID NO: 6001704 - DNA, 20 bp, Homo sapiens
cagcctgggcccctcagcca

SEQ ID NO: 6001705 - DNA, 21 bp, Homo sapiens
cagcctgggcccctcagccac

SEQ ID NO: 6001706 - DNA, 24 bp, Homo sapiens
cagcctgggcccctcagccaccct

SEQ ID NO: 6001707 - DNA, 23 bp, Homo sapiens
cagcctgggcctatggagagccc

SEQ ID NO: 6001708 - DNA, 18 bp, Homo sapiens
cagcctgggcgacaaaaa

SEQ ID NO: 6001709 - DNA, 19 bp, Homo sapiens
cagcctgggcgacagagca

SEQ ID NO: 6001710 - DNA, 14 bp, Homo sapiens
cagcctgggcgctg

SEQ ID NO: 6001711 - DNA, 19 bp, Homo sapiens
cagcctgggcgctggtcct

SEQ ID NO: 6001712 - DNA, 20 bp, Homo sapiens
cagcctgggcgctggtcctt

SEQ ID NO: 6001713 - DNA, 19 bp, Homo sapiens
cagcctgggctccctcttg

SEQ ID NO: 6001714 - DNA, 17 bp, Homo sapiens
cagcctgggctcctctg

SEQ ID NO: 6001715 - DNA, 18 bp, Homo sapiens
cagcctggggaccccact

SEQ ID NO: 6001716 - DNA, 19 bp, Homo sapiens
cagcctggggcctggcagg

SEQ ID NO: 6001717 - DNA, 20 bp, Homo sapiens
cagcctggggcggtgtgtgt

SEQ ID NO: 6001718 - DNA, 14 bp, Homo sapiens
cagcctggggctct

SEQ ID NO: 6001719 - DNA, 15 bp, Homo sapiens
cagcctggggctctc

SEQ ID NO: 6001720 - DNA, 18 bp, Homo sapiens
cagcctggggctctctga

SEQ ID NO: 6001721 - DNA, 22 bp, Homo sapiens
cagcctggggctctctgacccg

SEQ ID NO: 6001722 - DNA, 17 bp, Homo sapiens
cagcctggggctggcct

SEQ ID NO: 6001723 - DNA, 15 bp, Homo sapiens
cagcctgggggccag

SEQ ID NO: 6001724 - DNA, 17 bp, Homo sapiens
cagcctgggggccagtg

SEQ ID NO: 6001725 - DNA, 20 bp, Homo sapiens
cagcctgggggggccgctct

SEQ ID NO: 6001726 - DNA, 19 bp, Homo sapiens
cagcctggggtctggagtt

SEQ ID NO: 6001727 - DNA, 18 bp, Homo sapiens
cagcctggggtgatagaa

SEQ ID NO: 6001728 - DNA, 12 bp, Homo sapiens
cagcctgggtct

SEQ ID NO: 6001729 - DNA, 18 bp, Homo sapiens
cagcctgggtgacagagc

SEQ ID NO: 6001730 - DNA, 19 bp, Homo sapiens
cagcctgggtgacagagca

SEQ ID NO: 6001731 - DNA, 19 bp, Homo sapiens
cagcctggtccatgcaggg

SEQ ID NO: 6001732 - DNA, 18 bp, Homo sapiens
cagcctggtggcccagct

SEQ ID NO: 6001733 - DNA, 16 bp, Homo sapiens
cagcctggtgggcctc

SEQ ID NO: 6001734 - DNA, 18 bp, Homo sapiens
cagcctggtgggcctcct

SEQ ID NO: 6001735 - DNA, 14 bp, Homo sapiens
cagcctggttccct

SEQ ID NO: 6001736 - DNA, 18 bp, Homo sapiens
cagcctggttccctcttt

SEQ ID NO: 6001737 - DNA, 19 bp, Homo sapiens
cagcctggttccctctttc

SEQ ID NO: 6001738 - DNA, 22 bp, Homo sapiens
cagcctggttccctctttcctg

SEQ ID NO: 6001739 - DNA, 16 bp, Homo sapiens
cagcctggttttcaca

SEQ ID NO: 6001740 - DNA, 15 bp, Homo sapiens
cagcctggttttcgt

SEQ ID NO: 6001741 - DNA, 16 bp, Homo sapiens
cagcctggttttcgtc

SEQ ID NO: 6001742 - DNA, 16 bp, Homo sapiens
cagcctgtaccttgct

SEQ ID NO: 6001743 - DNA, 21 bp, Homo sapiens
cagcctgtaccttgctgtggg

SEQ ID NO: 6001744 - DNA, 22 bp, Homo sapiens
cagcctgtcagatccaggagct

SEQ ID NO: 6001745 - DNA, 23 bp, Homo sapiens
cagcctgtcagatccaggagctc

SEQ ID NO: 6001746 - DNA, 18 bp, Homo sapiens
cagcctgtcccactggct

SEQ ID NO: 6001747 - DNA, 20 bp, Homo sapiens
cagcctgtcccactggctcc

SEQ ID NO: 6001748 - DNA, 19 bp, Homo sapiens
cagcctgtcccatggacac

SEQ ID NO: 6001749 - DNA, 17 bp, Homo sapiens
cagcctgtccctgaaag

SEQ ID NO: 6001750 - DNA, 12 bp, Homo sapiens
cagcctgtcctg

SEQ ID NO: 6001751 - DNA, 15 bp, Homo sapiens
cagcctgtcctgggc

SEQ ID NO: 6001752 - DNA, 19 bp, Homo sapiens
cagcctgtcctgggctggt

SEQ ID NO: 6001753 - DNA, 14 bp, Homo sapiens
cagcctgtcctggt

SEQ ID NO: 6001754 - DNA, 22 bp, Homo sapiens
cagcctgtcctggtacagcagg

SEQ ID NO: 6001755 - DNA, 17 bp, Homo sapiens
cagcctgtcggccacac

SEQ ID NO: 6001756 - DNA, 22 bp, Homo sapiens
cagcctgtcggccacaccccag

SEQ ID NO: 6001757 - DNA, 17 bp, Homo sapiens
cagcctgtctcgggctg

SEQ ID NO: 6001758 - DNA, 15 bp, Homo sapiens
cagcctgtcttcaga

SEQ ID NO: 6001759 - DNA, 20 bp, Homo sapiens
cagcctgtcttgtcaggtgg

SEQ ID NO: 6001760 - DNA, 18 bp, Homo sapiens
cagcctgtgaactgccag

SEQ ID NO: 6001761 - DNA, 14 bp, Homo sapiens
cagcctgtgctgcc

SEQ ID NO: 6001762 - DNA, 16 bp, Homo sapiens
cagcctgtgctgcccg

SEQ ID NO: 6001763 - DNA, 18 bp, Homo sapiens
cagcctgtgctgtggcat

SEQ ID NO: 6001764 - DNA, 23 bp, Homo sapiens
cagcctgtgctgtggcatagaca

SEQ ID NO: 6001765 - DNA, 11 bp, Homo sapiens
cagcctgtggc

SEQ ID NO: 6001766 - DNA, 12 bp, Homo sapiens
cagcctgtggca

SEQ ID NO: 6001767 - DNA, 12 bp, Homo sapiens
cagcctgtggcc

SEQ ID NO: 6001768 - DNA, 15 bp, Homo sapiens
cagcctgtggcctca

SEQ ID NO: 6001769 - DNA, 20 bp, Homo sapiens
cagcctgtggcggtgcctgg

SEQ ID NO: 6001770 - DNA, 20 bp, Homo sapiens
cagcctgtggcttggagtgg

SEQ ID NO: 6001771 - DNA, 23 bp, Homo sapiens
cagcctgtggcttggagtggcca

SEQ ID NO: 6001772 - DNA, 19 bp, Homo sapiens
cagcctgtgggagaaggga

SEQ ID NO: 6001773 - DNA, 15 bp, Homo sapiens
cagcctgtgggtcct

SEQ ID NO: 6001774 - DNA, 20 bp, Homo sapiens
cagcctgtggttacagtgca

SEQ ID NO: 6001775 - DNA, 16 bp, Homo sapiens
cagcctgtgtgcagtg

SEQ ID NO: 6001776 - DNA, 16 bp, Homo sapiens
cagcctgttccagaag

SEQ ID NO: 6001777 - DNA, 21 bp, Homo sapiens
cagcctgttccttcctgcaga

SEQ ID NO: 6001778 - DNA, 22 bp, Homo sapiens
cagcctgttccttcctgcagac

SEQ ID NO: 6001779 - DNA, 16 bp, Homo sapiens
cagcctgttggacccg

SEQ ID NO: 6001780 - DNA, 17 bp, Homo sapiens
cagcctgtttagccaag

SEQ ID NO: 6001781 - DNA, 19 bp, Homo sapiens
cagccttaaggccctcatt

SEQ ID NO: 6001782 - DNA, 17 bp, Homo sapiens
cagccttaccttggggc

SEQ ID NO: 6001783 - DNA, 13 bp, Homo sapiens
cagccttagagct

SEQ ID NO: 6001784 - DNA, 16 bp, Homo sapiens
cagccttagagctctt

SEQ ID NO: 6001785 - DNA, 19 bp, Homo sapiens
cagccttagctctcccaac

SEQ ID NO: 6001786 - DNA, 16 bp, Homo sapiens
cagccttatgtggaag

SEQ ID NO: 6001787 - DNA, 18 bp, Homo sapiens
cagccttatgtgttacat

SEQ ID NO: 6001788 - DNA, 18 bp, Homo sapiens
cagccttcaagaatcaga

SEQ ID NO: 6001789 - DNA, 17 bp, Homo sapiens
cagccttcactggagac

SEQ ID NO: 6001790 - DNA, 23 bp, Homo sapiens
cagccttcagacagagaggactg

SEQ ID NO: 6001791 - DNA, 23 bp, Homo sapiens
cagccttcagcagcagctcacac

SEQ ID NO: 6001792 - DNA, 18 bp, Homo sapiens
cagccttcatcagaactc

SEQ ID NO: 6001793 - DNA, 19 bp, Homo sapiens
cagccttccacctccaaga

SEQ ID NO: 6001794 - DNA, 14 bp, Homo sapiens
cagccttccagtgg

SEQ ID NO: 6001795 - DNA, 22 bp, Homo sapiens
cagccttccagtggcttctccc

SEQ ID NO: 6001796 - DNA, 16 bp, Homo sapiens
cagccttccccagctc

SEQ ID NO: 6001797 - DNA, 18 bp, Homo sapiens
cagccttccccagctcca

SEQ ID NO: 6001798 - DNA, 14 bp, Homo sapiens
cagccttccctctg

SEQ ID NO: 6001799 - DNA, 15 bp, Homo sapiens
cagccttccctctgc

SEQ ID NO: 6001800 - DNA, 18 bp, Homo sapiens
cagccttccctctgcatt

SEQ ID NO: 6001801 - DNA, 19 bp, Homo sapiens
cagccttccgggaactgga

SEQ ID NO: 6001802 - DNA, 14 bp, Homo sapiens
cagccttcctctgc

SEQ ID NO: 6001803 - DNA, 19 bp, Homo sapiens
cagccttcctctgcagctg

SEQ ID NO: 6001804 - DNA, 16 bp, Homo sapiens
cagccttcctgggtgt

SEQ ID NO: 6001805 - DNA, 20 bp, Homo sapiens
cagccttccttctgctccca

SEQ ID NO: 6001806 - DNA, 16 bp, Homo sapiens
cagccttcgtgtggct

SEQ ID NO: 6001807 - DNA, 22 bp, Homo sapiens
cagccttctccatatctccatg

SEQ ID NO: 6001808 - DNA, 14 bp, Homo sapiens
cagccttctcctgt

SEQ ID NO: 6001809 - DNA, 16 bp, Homo sapiens
cagccttctctctctg

SEQ ID NO: 6001810 - DNA, 18 bp, Homo sapiens
cagccttctctctctggt

SEQ ID NO: 6001811 - DNA, 18 bp, Homo sapiens
cagccttcttccatccca

SEQ ID NO: 6001812 - DNA, 19 bp, Homo sapiens
cagccttctttttctggac

SEQ ID NO: 6001813 - DNA, 21 bp, Homo sapiens
cagccttctttttctggactc

SEQ ID NO: 6001814 - DNA, 19 bp, Homo sapiens
cagccttgaactcctggcc

SEQ ID NO: 6001815 - DNA, 22 bp, Homo sapiens
cagccttgaactcctggcctca

SEQ ID NO: 6001816 - DNA, 15 bp, Homo sapiens
cagccttgagccctg

SEQ ID NO: 6001817 - DNA, 17 bp, Homo sapiens
cagccttgatcagtgac

SEQ ID NO: 6001818 - DNA, 19 bp, Homo sapiens
cagccttgcacacccactg

SEQ ID NO: 6001819 - DNA, 20 bp, Homo sapiens
cagccttgcacacccactgc

SEQ ID NO: 6001820 - DNA, 22 bp, Homo sapiens
cagccttgcacacccactgccc

SEQ ID NO: 6001821 - DNA, 20 bp, Homo sapiens
cagccttgcagcggctcctg

SEQ ID NO: 6001822 - DNA, 15 bp, Homo sapiens
cagccttgccagaga

SEQ ID NO: 6001823 - DNA, 13 bp, Homo sapiens
cagccttgcccag

SEQ ID NO: 6001824 - DNA, 13 bp, Homo sapiens
cagccttgcgctg

SEQ ID NO: 6001825 - DNA, 21 bp, Homo sapiens
cagccttgcgctgtcccaggc

SEQ ID NO: 6001826 - DNA, 19 bp, Homo sapiens
cagccttgctacttgaagg

SEQ ID NO: 6001827 - DNA, 12 bp, Homo sapiens
cagccttgctct

SEQ ID NO: 6001828 - DNA, 14 bp, Homo sapiens
cagccttgctctct

SEQ ID NO: 6001829 - DNA, 18 bp, Homo sapiens
cagccttgctctcttcaa

SEQ ID NO: 6001830 - DNA, 21 bp, Homo sapiens
cagccttgctctcttcaataa

SEQ ID NO: 6001831 - DNA, 18 bp, Homo sapiens
cagccttgctgctctgcg

SEQ ID NO: 6001832 - DNA, 20 bp, Homo sapiens
cagccttgctgctctgcgtg

SEQ ID NO: 6001833 - DNA, 11 bp, Homo sapiens
cagccttggaa

SEQ ID NO: 6001834 - DNA, 16 bp, Homo sapiens
cagccttggatactcc

SEQ ID NO: 6001835 - DNA, 13 bp, Homo sapiens
cacctgtgagacc

SEQ ID NO: 6001836 - DNA, 15 bp, Homo sapiens
cacctgtgcacccca

SEQ ID NO: 6001837 - DNA, 17 bp, Homo sapiens
cacctgtgcaccccatg

SEQ ID NO: 6001838 - DNA, 17 bp, Homo sapiens
cacctgtgccctcacca

SEQ ID NO: 6001839 - DNA, 15 bp, Homo sapiens
cacctgtgctgctgc

SEQ ID NO: 6001840 - DNA, 21 bp, Homo sapiens
cacctgtgctgctgcaccaac

SEQ ID NO: 6001841 - DNA, 20 bp, Homo sapiens
cacctgtgctggagccctgt

SEQ ID NO: 6001842 - DNA, 19 bp, Homo sapiens
cacctgtgcttggaaccag

SEQ ID NO: 6001843 - DNA, 20 bp, Homo sapiens
cacctgtgcttggaaccagt

SEQ ID NO: 6001844 - DNA, 22 bp, Homo sapiens
cacctgtggaacataaaaagga

SEQ ID NO: 6001845 - DNA, 10 bp, Homo sapiens
cacctgtggc

SEQ ID NO: 6001846 - DNA, 20 bp, Homo sapiens
cacctgtggccagagcacct

SEQ ID NO: 6001847 - DNA, 18 bp, Homo sapiens
cacctgtggcctctcagt

SEQ ID NO: 6001848 - DNA, 17 bp, Homo sapiens
cacctgtgtgttctttt

SEQ ID NO: 6001849 - DNA, 15 bp, Homo sapiens
cacctgttaaaatgt

SEQ ID NO: 6001850 - DNA, 22 bp, Homo sapiens
cacctgttaaaatgtacactgg

SEQ ID NO: 6001851 - DNA, 23 bp, Homo sapiens
cacctgttcacagaaaaagcatg

SEQ ID NO: 6001852 - DNA, 21 bp, Homo sapiens
cacctgttgcacctcaggcag

SEQ ID NO: 6001853 - DNA, 16 bp, Homo sapiens
cacctgttgcttacaa

SEQ ID NO: 6001854 - DNA, 15 bp, Homo sapiens
cacctgttgtcctga

SEQ ID NO: 6001855 - DNA, 17 bp, Homo sapiens
cacctgttgtgtgcctg

SEQ ID NO: 6001856 - DNA, 17 bp, Homo sapiens
cacctgtttctggaaga

SEQ ID NO: 6001857 - DNA, 21 bp, Homo sapiens
cacctgtttctggaagactgc

SEQ ID NO: 6001858 - DNA, 23 bp, Homo sapiens
cacctgtttctggaagactgctc

SEQ ID NO: 6001859 - DNA, 13 bp, Homo sapiens
caccttaaaacat

SEQ ID NO: 6001860 - DNA, 23 bp, Homo sapiens
caccttaaaggtcaaggaaggaa

SEQ ID NO: 6001861 - DNA, 16 bp, Homo sapiens
caccttaaattaaaca

SEQ ID NO: 6001862 - DNA, 17 bp, Homo sapiens
caccttaactcagccag

SEQ ID NO: 6001863 - DNA, 18 bp, Homo sapiens
caccttaactgtgctcag

SEQ ID NO: 6001864 - DNA, 21 bp, Homo sapiens
caccttaatattattggggtt

SEQ ID NO: 6001865 - DNA, 16 bp, Homo sapiens
caccttacaaagccag

SEQ ID NO: 6001866 - DNA, 21 bp, Homo sapiens
caccttacaaagccagctctg

SEQ ID NO: 6001867 - DNA, 13 bp, Homo sapiens
caccttacattcc

SEQ ID NO: 6001868 - DNA, 15 bp, Homo sapiens
caccttactttccca

SEQ ID NO: 6001869 - DNA, 14 bp, Homo sapiens
caccttagacagtc

SEQ ID NO: 6001870 - DNA, 16 bp, Homo sapiens
caccttagacagtccc

SEQ ID NO: 6001871 - DNA, 18 bp, Homo sapiens
caccttagaccaccaagc

SEQ ID NO: 6001872 - DNA, 13 bp, Homo sapiens
caccttagagaag

SEQ ID NO: 6001873 - DNA, 16 bp, Homo sapiens
caccttagagaagcta

SEQ ID NO: 6001874 - DNA, 14 bp, Homo sapiens
caccttagtacttt

SEQ ID NO: 6001875 - DNA, 15 bp, Homo sapiens
caccttagtggcttt

SEQ ID NO: 6001876 - DNA, 18 bp, Homo sapiens
caccttatatttctgtgt

SEQ ID NO: 6001877 - DNA, 21 bp, Homo sapiens
caccttcaatgacttctaatt

SEQ ID NO: 6001878 - DNA, 19 bp, Homo sapiens
caccttcaattcctgggcc

SEQ ID NO: 6001879 - DNA, 17 bp, Homo sapiens
caccttcactctccagg

SEQ ID NO: 6001880 - DNA, 14 bp, Homo sapiens
caccttcatattgg

SEQ ID NO: 6001881 - DNA, 21 bp, Homo sapiens
caccttcatttaactctttga

SEQ ID NO: 6001882 - DNA, 22 bp, Homo sapiens
caccttcattttgaggggagga

SEQ ID NO: 6001883 - DNA, 10 bp, Homo sapiens
caccttccaa

SEQ ID NO: 6001884 - DNA, 13 bp, Homo sapiens
caccttccaagga

SEQ ID NO: 6001885 - DNA, 16 bp, Homo sapiens
caccttccagcccggg

SEQ ID NO: 6001886 - DNA, 14 bp, Homo sapiens
caccttccagctcc

SEQ ID NO: 6001887 - DNA, 18 bp, Homo sapiens
caccttccagctcctgta

SEQ ID NO: 6001888 - DNA, 18 bp, Homo sapiens
caccttccattttccccc

SEQ ID NO: 6001889 - DNA, 16 bp, Homo sapiens
caccttcccacccctt

SEQ ID NO: 6001890 - DNA, 12 bp, Homo sapiens
caccttcccagc

SEQ ID NO: 6001891 - DNA, 13 bp, Homo sapiens
caccttcccagct

SEQ ID NO: 6001892 - DNA, 15 bp, Homo sapiens
caccttcccagctct

SEQ ID NO: 6001893 - DNA, 11 bp, Homo sapiens
caccttcccca

SEQ ID NO: 6001894 - DNA, 20 bp, Homo sapiens
caccttccccagactcagct

SEQ ID NO: 6001895 - DNA, 21 bp, Homo sapiens
caccttccccagactcagctc

SEQ ID NO: 6001896 - DNA, 13 bp, Homo sapiens
caccttcccccaa

SEQ ID NO: 6001897 - DNA, 14 bp, Homo sapiens
caccttcccccttt

SEQ ID NO: 6001898 - DNA, 10 bp, Homo sapiens
caccttccct

SEQ ID NO: 6001899 - DNA, 16 bp, Homo sapiens
caccttccctctttct

SEQ ID NO: 6001900 - DNA, 15 bp, Homo sapiens
caccttcccttcctc

SEQ ID NO: 6001901 - DNA, 13 bp, Homo sapiens
caccttcccttct

SEQ ID NO: 6001902 - DNA, 14 bp, Homo sapiens
caccttcccttgcc

SEQ ID NO: 6001903 - DNA, 17 bp, Homo sapiens
caccttcccttgccact

SEQ ID NO: 6001904 - DNA, 18 bp, Homo sapiens
caccttcccttgccactt

SEQ ID NO: 6001905 - DNA, 19 bp, Homo sapiens
caccttcccttgccacttt

SEQ ID NO: 6001906 - DNA, 18 bp, Homo sapiens
caccttccgttccccgct

SEQ ID NO: 6001907 - DNA, 13 bp, Homo sapiens
caccttcctcact

SEQ ID NO: 6001908 - DNA, 13 bp, Homo sapiens
caccttcctgccc

SEQ ID NO: 6001909 - DNA, 20 bp, Homo sapiens
caccttcctgggcagcccag

SEQ ID NO: 6001910 - DNA, 23 bp, Homo sapiens
caccttcctgggcagcccagaga

SEQ ID NO: 6001911 - DNA, 17 bp, Homo sapiens
caccttccttgcgacca

SEQ ID NO: 6001912 - DNA, 20 bp, Homo sapiens
caccttccttgcgaccacca

SEQ ID NO: 6001913 - DNA, 23 bp, Homo sapiens
caccttcgggcagtcctgtgtga

SEQ ID NO: 6001914 - DNA, 21 bp, Homo sapiens
caccttcgtttactatgcctg

SEQ ID NO: 6001915 - DNA, 18 bp, Homo sapiens
caccttctgacgcagcct

SEQ ID NO: 6001916 - DNA, 18 bp, Homo sapiens
caccttctgagtattctc

SEQ ID NO: 6001917 - DNA, 13 bp, Homo sapiens
caccttctgccaa

SEQ ID NO: 6001918 - DNA, 20 bp, Homo sapiens
caccttctgtccccagccct

SEQ ID NO: 6001919 - DNA, 21 bp, Homo sapiens
caccttctgtccccagccctg

SEQ ID NO: 6001920 - DNA, 15 bp, Homo sapiens
caccttctgtgcatc

SEQ ID NO: 6001921 - DNA, 20 bp, Homo sapiens
caccttcttattatatatat

SEQ ID NO: 6001922 - DNA, 16 bp, Homo sapiens
caccttcttggcttct

SEQ ID NO: 6001923 - DNA, 17 bp, Homo sapiens
caccttcttgggactgc

SEQ ID NO: 6001924 - DNA, 15 bp, Homo sapiens
caccttctttctgga

SEQ ID NO: 6001925 - DNA, 18 bp, Homo sapiens
caccttgaacaccacgct

SEQ ID NO: 6001926 - DNA, 13 bp, Homo sapiens
caccttgacaggg

SEQ ID NO: 6001927 - DNA, 22 bp, Homo sapiens
caccttgaccaaaatcagcttt

SEQ ID NO: 6001928 - DNA, 19 bp, Homo sapiens
caccttgacgtttcttctt

SEQ ID NO: 6001929 - DNA, 23 bp, Homo sapiens
caccttgattggaaaataatatc

SEQ ID NO: 6001930 - DNA, 14 bp, Homo sapiens
caccttgattttct

SEQ ID NO: 6001931 - DNA, 15 bp, Homo sapiens
caccttgattttctt

SEQ ID NO: 6001932 - DNA, 18 bp, Homo sapiens
caccttgcaacacacaga

SEQ ID NO: 6001933 - DNA, 22 bp, Homo sapiens
caccttgcagctctccccttct

SEQ ID NO: 6001934 - DNA, 23 bp, Homo sapiens
caccttgccacccattcttcccg

SEQ ID NO: 6001935 - DNA, 18 bp, Homo sapiens
caccttgccagggcaggg

SEQ ID NO: 6001936 - DNA, 22 bp, Homo sapiens
caccttgccagggcagggtctg

SEQ ID NO: 6001937 - DNA, 13 bp, Homo sapiens
caccttgccttgc

SEQ ID NO: 6001938 - DNA, 12 bp, Homo sapiens
caccttgctctt

SEQ ID NO: 6001939 - DNA, 16 bp, Homo sapiens
caccttgctcttcttt

SEQ ID NO: 6001940 - DNA, 12 bp, Homo sapiens
caccttggaagg

SEQ ID NO: 6001941 - DNA, 16 bp, Homo sapiens
caccttggacatcctc

SEQ ID NO: 6001942 - DNA, 18 bp, Homo sapiens
caccttggacatcctcct

SEQ ID NO: 6001943 - DNA, 14 bp, Homo sapiens
caccttggaccctg

SEQ ID NO: 6001944 - DNA, 15 bp, Homo sapiens
caccttggaccctgg

SEQ ID NO: 6001945 - DNA, 18 bp, Homo sapiens
caccttggactcctccca

SEQ ID NO: 6001946 - DNA, 22 bp, Homo sapiens
caccttggactcctcccacaat

SEQ ID NO: 6001947 - DNA, 14 bp, Homo sapiens
caccttggagcatt

SEQ ID NO: 6001948 - DNA, 16 bp, Homo sapiens
caccttggagcattta

SEQ ID NO: 6001949 - DNA, 15 bp, Homo sapiens
caccttggagcctga

SEQ ID NO: 6001950 - DNA, 15 bp, Homo sapiens
caccttggaggagga

SEQ ID NO: 6001951 - DNA, 23 bp, Homo sapiens
caccttggaggccttccctggcc

SEQ ID NO: 6001952 - DNA, 14 bp, Homo sapiens
caccttggcccagg

SEQ ID NO: 6001953 - DNA, 15 bp, Homo sapiens
caccttggcccagga

SEQ ID NO: 6001954 - DNA, 17 bp, Homo sapiens
caccttggcccaggagc

SEQ ID NO: 6001955 - DNA, 22 bp, Homo sapiens
caccttggcccaggagctctgc

SEQ ID NO: 6001956 - DNA, 23 bp, Homo sapiens
caccttggcccaggagctctgcg

SEQ ID NO: 6001957 - DNA, 11 bp, Homo sapiens
caccttggcct

SEQ ID NO: 6001958 - DNA, 15 bp, Homo sapiens
caccttggcctccca

SEQ ID NO: 6001959 - DNA, 14 bp, Homo sapiens
caccttggccttct

SEQ ID NO: 6001960 - DNA, 20 bp, Homo sapiens
caccttggctctgccagtgg

SEQ ID NO: 6001961 - DNA, 14 bp, Homo sapiens
caccttggctgcag

SEQ ID NO: 6001962 - DNA, 15 bp, Homo sapiens
caccttggctgcagg

SEQ ID NO: 6001963 - DNA, 16 bp, Homo sapiens
caccttggctgggaag

SEQ ID NO: 6001964 - DNA, 20 bp, Homo sapiens
caccttgggcacgggagagc

SEQ ID NO: 6001965 - DNA, 22 bp, Homo sapiens
caccttgggctgggggactggg

SEQ ID NO: 6001966 - DNA, 23 bp, Homo sapiens
caccttgtacagaaccagcactc

SEQ ID NO: 6001967 - DNA, 23 bp, Homo sapiens
caccttgtcatgtaccatcaata

SEQ ID NO: 6001968 - DNA, 22 bp, Homo sapiens
caccttgtctgctaaataaaca

SEQ ID NO: 6001969 - DNA, 15 bp, Homo sapiens
caccttgtgcctggg

SEQ ID NO: 6001970 - DNA, 18 bp, Homo sapiens
caccttgtgcctggggtg

SEQ ID NO: 6001971 - DNA, 14 bp, Homo sapiens
cacctttaaaaagc

SEQ ID NO: 6001972 - DNA, 16 bp, Homo sapiens
cacctttaacacagac

SEQ ID NO: 6001973 - DNA, 14 bp, Homo sapiens
cacctttaagtcct

SEQ ID NO: 6001974 - DNA, 14 bp, Homo sapiens
cacctttactttag

SEQ ID NO: 6001975 - DNA, 19 bp, Homo sapiens
cacctttagaacaggagac

SEQ ID NO: 6001976 - DNA, 14 bp, Homo sapiens
cacctttaggttct

SEQ ID NO: 6001977 - DNA, 18 bp, Homo sapiens
cacctttatctcaagata

SEQ ID NO: 6001978 - DNA, 15 bp, Homo sapiens
cacctttatgtttta

SEQ ID NO: 6001979 - DNA, 17 bp, Homo sapiens
cacctttattaaaatct

SEQ ID NO: 6001980 - DNA, 14 bp, Homo sapiens
cacctttattctgg

SEQ ID NO: 6001981 - DNA, 14 bp, Homo sapiens
cacctttcagccca

SEQ ID NO: 6001982 - DNA, 22 bp, Homo sapiens
cacctttcataatctttgcttt

SEQ ID NO: 6001983 - DNA, 14 bp, Homo sapiens
cacctttccgtgcc

SEQ ID NO: 6001984 - DNA, 10 bp, Homo sapiens
cacctttcct

SEQ ID NO: 6001985 - DNA, 13 bp, Homo sapiens
cacctttcctctc

SEQ ID NO: 6001986 - DNA, 12 bp, Homo sapiens
cacctttctagt

SEQ ID NO: 6001987 - DNA, 13 bp, Homo sapiens
cacctttctagtt

SEQ ID NO: 6001988 - DNA, 16 bp, Homo sapiens
cacctttctcctttgt

SEQ ID NO: 6001989 - DNA, 19 bp, Homo sapiens
cacctttctcgctggaatc

SEQ ID NO: 6001990 - DNA, 16 bp, Homo sapiens
cacctttctctgagaa

SEQ ID NO: 6001991 - DNA, 17 bp, Homo sapiens
cacctttctgaatggaa

SEQ ID NO: 6001992 - DNA, 15 bp, Homo sapiens
cacctttctgggctt

SEQ ID NO: 6001993 - DNA, 23 bp, Homo sapiens
cacctttctgggctttctcctgg

SEQ ID NO: 6001994 - DNA, 19 bp, Homo sapiens
cacctttcttcttgtgtct

SEQ ID NO: 6001995 - DNA, 16 bp, Homo sapiens
cacctttgaattacag

SEQ ID NO: 6001996 - DNA, 14 bp, Homo sapiens
cacctttgagagag

SEQ ID NO: 6001997 - DNA, 19 bp, Homo sapiens
cacctttggaaagctctga

SEQ ID NO: 6001998 - DNA, 20 bp, Homo sapiens
cacctttgggatcagcctcc

SEQ ID NO: 6001999 - DNA, 13 bp, Homo sapiens
cacctttggtgca

SEQ ID NO: 6002000 - DNA, 22 bp, Homo sapiens
cacctttgtaaatacacaattc

SEQ ID NO: 6002001 - DNA, 19 bp, Homo sapiens
cacctttgtaagacatttg

SEQ ID NO: 6002002 - DNA, 20 bp, Homo sapiens
cacctttgtaagacatttgt

SEQ ID NO: 6002003 - DNA, 21 bp, Homo sapiens
cacctttgtaagacatttgta

SEQ ID NO: 6002004 - DNA, 14 bp, Homo sapiens
cacctttgtcccca

SEQ ID NO: 6002005 - DNA, 15 bp, Homo sapiens
cacctttgtccccac

SEQ ID NO: 6002006 - DNA, 19 bp, Homo sapiens
cacctttgtctggatgcac

SEQ ID NO: 6002007 - DNA, 13 bp, Homo sapiens
cacctttgtgtat

SEQ ID NO: 6002008 - DNA, 14 bp, Homo sapiens
cacctttgtgtatt

SEQ ID NO: 6002009 - DNA, 21 bp, Homo sapiens
cacctttgtttagaacactgg

SEQ ID NO: 6002010 - DNA, 19 bp, Homo sapiens
cacctttgttttgcactga

SEQ ID NO: 6002011 - DNA, 20 bp, Homo sapiens
cacctttgttttttgttgga

SEQ ID NO: 6002012 - DNA, 11 bp, Homo sapiens
caccttttaaa

SEQ ID NO: 6002013 - DNA, 18 bp, Homo sapiens
caccttttaagttaatga

SEQ ID NO: 6002014 - DNA, 14 bp, Homo sapiens
caccttttctgtgg

SEQ ID NO: 6002015 - DNA, 17 bp, Homo sapiens
caccttttcttgcctga

SEQ ID NO: 6002016 - DNA, 24 bp, Homo sapiens
cagccttggatactccatggggtg

SEQ ID NO: 6002017 - DNA, 23 bp, Homo sapiens
cagccttgggggggctgcctttg

SEQ ID NO: 6002018 - DNA, 17 bp, Homo sapiens
cagccttggtgccacca

SEQ ID NO: 6002019 - DNA, 22 bp, Homo sapiens
cagccttggtgggggagcctct

SEQ ID NO: 6002020 - DNA, 15 bp, Homo sapiens
cagccttggttcctg

SEQ ID NO: 6002021 - DNA, 20 bp, Homo sapiens
cagccttgtaaataaccaca

SEQ ID NO: 6002022 - DNA, 21 bp, Homo sapiens
cagccttgttcctcagcaccc

SEQ ID NO: 6002023 - DNA, 14 bp, Homo sapiens
cagccttgtttctg

SEQ ID NO: 6002024 - DNA, 18 bp, Homo sapiens
cagcctttaggtctttag

SEQ ID NO: 6002025 - DNA, 19 bp, Homo sapiens
cagcctttaggtctttagt

SEQ ID NO: 6002026 - DNA, 19 bp, Homo sapiens
cagcctttatcaagagact

SEQ ID NO: 6002027 - DNA, 23 bp, Homo sapiens
cagcctttcgttctgctgaccaa

SEQ ID NO: 6002028 - DNA, 21 bp, Homo sapiens
cagcctttctgtatcaagccc

SEQ ID NO: 6002029 - DNA, 22 bp, Homo sapiens
cagcctttctgtatcaagcccc

SEQ ID NO: 6002030 - DNA, 13 bp, Homo sapiens
cagcctttctgtg

SEQ ID NO: 6002031 - DNA, 12 bp, Homo sapiens
cagcctttcttc

SEQ ID NO: 6002032 - DNA, 13 bp, Homo sapiens
cagcctttcttcc

SEQ ID NO: 6002033 - DNA, 19 bp, Homo sapiens
cagcctttgatcaggtggg

SEQ ID NO: 6002034 - DNA, 23 bp, Homo sapiens
cagcctttgatcaggtggggagt

SEQ ID NO: 6002035 - DNA, 14 bp, Homo sapiens
cagcctttgctccc

SEQ ID NO: 6002036 - DNA, 18 bp, Homo sapiens
cagcctttggccttggct

SEQ ID NO: 6002037 - DNA, 16 bp, Homo sapiens
cagcctttgggtcctg

SEQ ID NO: 6002038 - DNA, 15 bp, Homo sapiens
cagcctttgtcaata

SEQ ID NO: 6002039 - DNA, 11 bp, Homo sapiens
cagcctttgtt

SEQ ID NO: 6002040 - DNA, 22 bp, Homo sapiens
cagcctttgttaaccttaaata

SEQ ID NO: 6002041 - DNA, 18 bp, Homo sapiens
cagcctttgttccccact

SEQ ID NO: 6002042 - DNA, 22 bp, Homo sapiens
cagcctttgttccccactggag

SEQ ID NO: 6002043 - DNA, 15 bp, Homo sapiens
cagccttttctggtc

SEQ ID NO: 6002044 - DNA, 15 bp, Homo sapiens
cagcgaacagcctta

SEQ ID NO: 6002045 - DNA, 21 bp, Homo sapiens
cagcgaagccttaactttaaa

SEQ ID NO: 6002046 - DNA, 22 bp, Homo sapiens
cagcgaagtagcttgctccctg

SEQ ID NO: 6002047 - DNA, 20 bp, Homo sapiens
cagcgaagtctcatgggaag

SEQ ID NO: 6002048 - DNA, 18 bp, Homo sapiens
cagcgacagaaaacctca

SEQ ID NO: 6002049 - DNA, 24 bp, Homo sapiens
cagcgacagaaaacctcaagggct

SEQ ID NO: 6002050 - DNA, 21 bp, Homo sapiens
cagcgaccacccctgcctcca

SEQ ID NO: 6002051 - DNA, 14 bp, Homo sapiens
cagcgacccttggt

SEQ ID NO: 6002052 - DNA, 17 bp, Homo sapiens
cagcgaccgccccctcc

SEQ ID NO: 6002053 - DNA, 20 bp, Homo sapiens
cagcgacctcaagtgtcctg

SEQ ID NO: 6002054 - DNA, 21 bp, Homo sapiens
cagcgacctcaagtgtcctga

SEQ ID NO: 6002055 - DNA, 18 bp, Homo sapiens
cagcgacctctctgcctc

SEQ ID NO: 6002056 - DNA, 18 bp, Homo sapiens
cagcgaccttcctcatcc

SEQ ID NO: 6002057 - DNA, 17 bp, Homo sapiens
cagcgactccgttggcc

SEQ ID NO: 6002058 - DNA, 21 bp, Homo sapiens
cagcgactccgttggccactc

SEQ ID NO: 6002059 - DNA, 14 bp, Homo sapiens
cagcgactggatgc

SEQ ID NO: 6002060 - DNA, 22 bp, Homo sapiens
cagcgagagagtttcaaaagca

SEQ ID NO: 6002061 - DNA, 20 bp, Homo sapiens
cagcgagaggcagagaaaga

SEQ ID NO: 6002062 - DNA, 14 bp, Homo sapiens
cagcgagaggcagc

SEQ ID NO: 6002063 - DNA, 12 bp, Homo sapiens
cagcgagaggga

SEQ ID NO: 6002064 - DNA, 13 bp, Homo sapiens
cagcgagagggag

SEQ ID NO: 6002065 - DNA, 16 bp, Homo sapiens
cagcgagccacaggaa

SEQ ID NO: 6002066 - DNA, 17 bp, Homo sapiens
cagcgagccacaggaac

SEQ ID NO: 6002067 - DNA, 16 bp, Homo sapiens
cagcgagccctggtgg

SEQ ID NO: 6002068 - DNA, 19 bp, Homo sapiens
cagcgagccctggtggcag

SEQ ID NO: 6002069 - DNA, 14 bp, Homo sapiens
cagcgagcctgcta

SEQ ID NO: 6002070 - DNA, 17 bp, Homo sapiens
cagcgagcctgtgcctt

SEQ ID NO: 6002071 - DNA, 21 bp, Homo sapiens
cagcgagcgcccagctcctga

SEQ ID NO: 6002072 - DNA, 18 bp, Homo sapiens
cagcgaggaggctccaga

SEQ ID NO: 6002073 - DNA, 23 bp, Homo sapiens
cagcgaggcgaggctgcctctgg

SEQ ID NO: 6002074 - DNA, 24 bp, Homo sapiens
cagcgaggcgaggctgcctctggg

SEQ ID NO: 6002075 - DNA, 21 bp, Homo sapiens
cagcgaggtgggagaggcctc

SEQ ID NO: 6002076 - DNA, 21 bp, Homo sapiens
cagcgagtaccccagccactc

SEQ ID NO: 6002077 - DNA, 20 bp, Homo sapiens
cagcgatctctccactgtgc

SEQ ID NO: 6002078 - DNA, 22 bp, Homo sapiens
cagcgatggcaggcctgaccca

SEQ ID NO: 6002079 - DNA, 18 bp, Homo sapiens
cagcgatggtgctgccca

SEQ ID NO: 6002080 - DNA, 20 bp, Homo sapiens
cagcgatggtgctgcccagg

SEQ ID NO: 6002081 - DNA, 18 bp, Homo sapiens
cagcgattattgatcaaa

SEQ ID NO: 6002082 - DNA, 16 bp, Homo sapiens
cagcgattcctgccaa

SEQ ID NO: 6002083 - DNA, 20 bp, Homo sapiens
cagcgattcctgccaagtag

SEQ ID NO: 6002084 - DNA, 19 bp, Homo sapiens
cagcgcaggccctggtgga

SEQ ID NO: 6002085 - DNA, 12 bp, Homo sapiens
cagcgcagggct

SEQ ID NO: 6002086 - DNA, 13 bp, Homo sapiens
cagcgcagggctg

SEQ ID NO: 6002087 - DNA, 14 bp, Homo sapiens
cagcgcatgtgtgc

SEQ ID NO: 6002088 - DNA, 22 bp, Homo sapiens
cagcgcatgtgtgcatgtgctg

SEQ ID NO: 6002089 - DNA, 13 bp, Homo sapiens
cagcgcattgttt

SEQ ID NO: 6002090 - DNA, 23 bp, Homo sapiens
cagcgccaaaacaagccaaagag

SEQ ID NO: 6002091 - DNA, 21 bp, Homo sapiens
cagcgccaaatgttcatcctc

SEQ ID NO: 6002092 - DNA, 16 bp, Homo sapiens
cagcgccaagcaacct

SEQ ID NO: 6002093 - DNA, 19 bp, Homo sapiens
cagcgccaagcaacctggg

SEQ ID NO: 6002094 - DNA, 21 bp, Homo sapiens
cagcgccaagtaaacagggta

SEQ ID NO: 6002095 - DNA, 14 bp, Homo sapiens
cagcgccaagtggc

SEQ ID NO: 6002096 - DNA, 20 bp, Homo sapiens
cagcgccaggctgaccacag

SEQ ID NO: 6002097 - DNA, 22 bp, Homo sapiens
cagcgccaggctgaccacagca

SEQ ID NO: 6002098 - DNA, 12 bp, Homo sapiens
cagcgccagggc

SEQ ID NO: 6002099 - DNA, 21 bp, Homo sapiens
cagcgccagggctcagatggg

SEQ ID NO: 6002100 - DNA, 18 bp, Homo sapiens
cagcgccatgtgtgtcag

SEQ ID NO: 6002101 - DNA, 22 bp, Homo sapiens
cagcgccatgtgtgtcagccca

SEQ ID NO: 6002102 - DNA, 20 bp, Homo sapiens
cagcgcccagcctggcccca

SEQ ID NO: 6002103 - DNA, 15 bp, Homo sapiens
cagcgcccaggcctg

SEQ ID NO: 6002104 - DNA, 12 bp, Homo sapiens
cagcgccccacc

SEQ ID NO: 6002105 - DNA, 15 bp, Homo sapiens
cagcgcccccactcc

SEQ ID NO: 6002106 - DNA, 19 bp, Homo sapiens
cagcgcccccactcctcct

SEQ ID NO: 6002107 - DNA, 12 bp, Homo sapiens
cagcgcccccag

SEQ ID NO: 6002108 - DNA, 19 bp, Homo sapiens
cagcgcccccaggcctgcc

SEQ ID NO: 6002109 - DNA, 21 bp, Homo sapiens
cagcgcccccaggcctgccct

SEQ ID NO: 6002110 - DNA, 17 bp, Homo sapiens
cagcgcccccatctgtc

SEQ ID NO: 6002111 - DNA, 19 bp, Homo sapiens
cagcgcccccatctgtctt

SEQ ID NO: 6002112 - DNA, 14 bp, Homo sapiens
cagcgcccctcagc

SEQ ID NO: 6002113 - DNA, 14 bp, Homo sapiens
cagcgcccctgctg

SEQ ID NO: 6002114 - DNA, 18 bp, Homo sapiens
cagcgcccctgctgtctt

SEQ ID NO: 6002115 - DNA, 16 bp, Homo sapiens
cagcgcccgaggccag

SEQ ID NO: 6002116 - DNA, 21 bp, Homo sapiens
cagcgcccggtgctctgtgtc

SEQ ID NO: 6002117 - DNA, 22 bp, Homo sapiens
cagcgccctggagtcccctggg

SEQ ID NO: 6002118 - DNA, 15 bp, Homo sapiens
cagcgcccttcctct

SEQ ID NO: 6002119 - DNA, 22 bp, Homo sapiens
cagcgcctagtggggtctccct

SEQ ID NO: 6002120 - DNA, 20 bp, Homo sapiens
cagcgcctccaccctgccct

SEQ ID NO: 6002121 - DNA, 15 bp, Homo sapiens
cagcgcctcccgccg

SEQ ID NO: 6002122 - DNA, 16 bp, Homo sapiens
cagcgcctccctccac

SEQ ID NO: 6002123 - DNA, 18 bp, Homo sapiens
cagcgcctccctccaccc

SEQ ID NO: 6002124 - DNA, 20 bp, Homo sapiens
cagcgcctccctccacccca

SEQ ID NO: 6002125 - DNA, 21 bp, Homo sapiens
cagcgcctccctccaccccag

SEQ ID NO: 6002126 - DNA, 22 bp, Homo sapiens
cagcgcctccctccaccccagg

SEQ ID NO: 6002127 - DNA, 23 bp, Homo sapiens
cagcgcctccctccaccccagga

SEQ ID NO: 6002128 - DNA, 12 bp, Homo sapiens
cagcgcctcctg

SEQ ID NO: 6002129 - DNA, 21 bp, Homo sapiens
cagcgcctcgccccagccaag

SEQ ID NO: 6002130 - DNA, 22 bp, Homo sapiens
cagcgcctgccctccctggggt

SEQ ID NO: 6002131 - DNA, 19 bp, Homo sapiens
cagcgcctggcctacccag

SEQ ID NO: 6002132 - DNA, 12 bp, Homo sapiens
cagcgcctgtcc

SEQ ID NO: 6002133 - DNA, 14 bp, Homo sapiens
cagcgcctgtcccc

SEQ ID NO: 6002134 - DNA, 22 bp, Homo sapiens
cagcgcctgtgctgaggactcc

SEQ ID NO: 6002135 - DNA, 12 bp, Homo sapiens
cagcgcctttcc

SEQ ID NO: 6002136 - DNA, 13 bp, Homo sapiens
cagcgcgcaggcc

SEQ ID NO: 6002137 - DNA, 12 bp, Homo sapiens
cagcgcggccag

SEQ ID NO: 6002138 - DNA, 14 bp, Homo sapiens
cagcgcggctcccg

SEQ ID NO: 6002139 - DNA, 20 bp, Homo sapiens
cagcgcggcttggccgccat

SEQ ID NO: 6002140 - DNA, 19 bp, Homo sapiens
cagcgcgggcggaggcggc

SEQ ID NO: 6002141 - DNA, 16 bp, Homo sapiens
cagcgcggtcctgact

SEQ ID NO: 6002142 - DNA, 18 bp, Homo sapiens
cagcgcggtcctgactcc

SEQ ID NO: 6002143 - DNA, 15 bp, Homo sapiens
cagcgcgtgcacagc

SEQ ID NO: 6002144 - DNA, 21 bp, Homo sapiens
cagcgcgtgcacagcgcgggc

SEQ ID NO: 6002145 - DNA, 20 bp, Homo sapiens
cagcgctccctgtcgcctgc

SEQ ID NO: 6002146 - DNA, 15 bp, Homo sapiens
cagcgctcctcctgt

SEQ ID NO: 6002147 - DNA, 22 bp, Homo sapiens
cagcgctcgatggacctcagca

SEQ ID NO: 6002148 - DNA, 12 bp, Homo sapiens
cagcgctcgcca

SEQ ID NO: 6002149 - DNA, 15 bp, Homo sapiens
cagcgctcgccacgc

SEQ ID NO: 6002150 - DNA, 19 bp, Homo sapiens
cagcgctcgccacgctcag

SEQ ID NO: 6002151 - DNA, 13 bp, Homo sapiens
cagcgctctcctg

SEQ ID NO: 6002152 - DNA, 20 bp, Homo sapiens
cagcgctctgcctcaccgct

SEQ ID NO: 6002153 - DNA, 18 bp, Homo sapiens
cagcgctctggtgctgca

SEQ ID NO: 6002154 - DNA, 22 bp, Homo sapiens
cagcgctgagcatggggcgctc

SEQ ID NO: 6002155 - DNA, 14 bp, Homo sapiens
cagcgctgcccaca

SEQ ID NO: 6002156 - DNA, 18 bp, Homo sapiens
cagcgctgggccccaagg

SEQ ID NO: 6002157 - DNA, 21 bp, Homo sapiens
cagcgctggtcgtcacctggg

SEQ ID NO: 6002158 - DNA, 19 bp, Homo sapiens
cagcggaagggactctggg

SEQ ID NO: 6002159 - DNA, 20 bp, Homo sapiens
cagcggaagggactctgggc

SEQ ID NO: 6002160 - DNA, 15 bp, Homo sapiens
cagcggaggagacca

SEQ ID NO: 6002161 - DNA, 21 bp, Homo sapiens
cagcggaggagaccagctcag

SEQ ID NO: 6002162 - DNA, 22 bp, Homo sapiens
cagcggaggtgtggagccgagg

SEQ ID NO: 6002163 - DNA, 18 bp, Homo sapiens
cagcggattgctctggag

SEQ ID NO: 6002164 - DNA, 20 bp, Homo sapiens
cagcggattgctctggagca

SEQ ID NO: 6002165 - DNA, 22 bp, Homo sapiens
cagcggattgctctggagcagc

SEQ ID NO: 6002166 - DNA, 23 bp, Homo sapiens
cagcggattgctctggagcagcc

SEQ ID NO: 6002167 - DNA, 19 bp, Homo sapiens
cagcggcaggaccgccatg

SEQ ID NO: 6002168 - DNA, 18 bp, Homo sapiens
cagcggcccaagagcccg

SEQ ID NO: 6002169 - DNA, 18 bp, Homo sapiens
cagcggccccgcacccct

SEQ ID NO: 6002170 - DNA, 22 bp, Homo sapiens
cagcggccccgcacccctcctc

SEQ ID NO: 6002171 - DNA, 18 bp, Homo sapiens
cagcggccccgcggagcc

SEQ ID NO: 6002172 - DNA, 21 bp, Homo sapiens
cagcggccccgcggagccccc

SEQ ID NO: 6002173 - DNA, 15 bp, Homo sapiens
cagcggcccctccca

SEQ ID NO: 6002174 - DNA, 15 bp, Homo sapiens
cagcggcccctgcat

SEQ ID NO: 6002175 - DNA, 16 bp, Homo sapiens
cagcggcccctgcatc

SEQ ID NO: 6002176 - DNA, 22 bp, Homo sapiens
cagcggcccggcccacgcagag

SEQ ID NO: 6002177 - DNA, 23 bp, Homo sapiens
cagcggcccggcccacgcagagc

SEQ ID NO: 6002178 - DNA, 14 bp, Homo sapiens
cagcggccctccca

SEQ ID NO: 6002179 - DNA, 14 bp, Homo sapiens
cagcggcctcaggg

SEQ ID NO: 6002180 - DNA, 15 bp, Homo sapiens
cagcggcctcagggt

SEQ ID NO: 6002181 - DNA, 16 bp, Homo sapiens
cagcggcctcagggtc

SEQ ID NO: 6002182 - DNA, 12 bp, Homo sapiens
cagcggcctggg

SEQ ID NO: 6002183 - DNA, 13 bp, Homo sapiens
cagcggcctgggg

SEQ ID NO: 6002184 - DNA, 15 bp, Homo sapiens
cagcggccttgaaga

SEQ ID NO: 6002185 - DNA, 23 bp, Homo sapiens
cagcggccttgaagacagagcaa

SEQ ID NO: 6002186 - DNA, 14 bp, Homo sapiens
cagcggctcccctc

SEQ ID NO: 6002187 - DNA, 16 bp, Homo sapiens
cagcggctcccctctg

SEQ ID NO: 6002188 - DNA, 21 bp, Homo sapiens
cagcggctcccctctgcttct

SEQ ID NO: 6002189 - DNA, 12 bp, Homo sapiens
cagcggctgcct

SEQ ID NO: 6002190 - DNA, 13 bp, Homo sapiens
cagcggctgcctc

SEQ ID NO: 6002191 - DNA, 14 bp, Homo sapiens
cagcggcttagcca

SEQ ID NO: 6002192 - DNA, 18 bp, Homo sapiens
cagcgggagacctgtgct

SEQ ID NO: 6002193 - DNA, 15 bp, Homo sapiens
cagcgggagtctcct

SEQ ID NO: 6002194 - DNA, 20 bp, Homo sapiens
cagcgggcaaagagctcccg

SEQ ID NO: 6002195 - DNA, 20 bp, Homo sapiens
cagcgggcacagggcaccag

SEQ ID NO: 6002196 - DNA, 14 bp, Homo sapiens
cagcgggcagatgg

SEQ ID NO: 6002197 - DNA, 16 bp, Homo sapiens
cagcgggccaggcccg

SEQ ID NO: 6002198 - DNA, 18 bp, Homo sapiens
cagcgggcgcgggacagg

SEQ ID NO: 6002199 - DNA, 15 bp, Homo sapiens
cagcggggacagctc

SEQ ID NO: 6002200 - DNA, 16 bp, Homo sapiens
cagcggggacagctcc

SEQ ID NO: 6002201 - DNA, 17 bp, Homo sapiens
cagcggggacagctcct

SEQ ID NO: 6002202 - DNA, 20 bp, Homo sapiens
cagcggggcctggcgggatg

SEQ ID NO: 6002203 - DNA, 13 bp, Homo sapiens
cagcggggctggc

SEQ ID NO: 6002204 - DNA, 15 bp, Homo sapiens
cagcggggctggcca

SEQ ID NO: 6002205 - DNA, 23 bp, Homo sapiens
cagcgggggcggcccagcctctg

SEQ ID NO: 6002206 - DNA, 22 bp, Homo sapiens
cagcggggtggggggggagaga

SEQ ID NO: 6002207 - DNA, 22 bp, Homo sapiens
cagcgggtctcctcccagcggc

SEQ ID NO: 6002208 - DNA, 20 bp, Homo sapiens
cagcggtccaacgccgcctt

SEQ ID NO: 6002209 - DNA, 15 bp, Homo sapiens
cagcggtcccagggg

SEQ ID NO: 6002210 - DNA, 21 bp, Homo sapiens
cagcggtggaaggagcctgcg

SEQ ID NO: 6002211 - DNA, 23 bp, Homo sapiens
cagcggtggaaggagcctgcggc

SEQ ID NO: 6002212 - DNA, 19 bp, Homo sapiens
cagcggtgggacctaggga

SEQ ID NO: 6002213 - DNA, 22 bp, Homo sapiens
cagcggtgggacctagggaggc

SEQ ID NO: 6002214 - DNA, 15 bp, Homo sapiens
cagcggttcctgtgc

SEQ ID NO: 6002215 - DNA, 18 bp, Homo sapiens
cagcggttcctgtgcaga

SEQ ID NO: 6002216 - DNA, 18 bp, Homo sapiens
cagcggttgtaaatacaa

SEQ ID NO: 6002217 - DNA, 19 bp, Homo sapiens
cagcggttgtaaatacaat

SEQ ID NO: 6002218 - DNA, 21 bp, Homo sapiens
cagcggttgtaaatacaattc

SEQ ID NO: 6002219 - DNA, 19 bp, Homo sapiens
cagcggtttccacttgtgg

SEQ ID NO: 6002220 - DNA, 23 bp, Homo sapiens
cagcgtatatataagaaagacat

SEQ ID NO: 6002221 - DNA, 19 bp, Homo sapiens
cagcgtcactccagtgctc

SEQ ID NO: 6002222 - DNA, 13 bp, Homo sapiens
cagcgtcaggcct

SEQ ID NO: 6002223 - DNA, 15 bp, Homo sapiens
cagcgtcccagggta

SEQ ID NO: 6002224 - DNA, 15 bp, Homo sapiens
cagcgtccctggcgc

SEQ ID NO: 6002225 - DNA, 16 bp, Homo sapiens
cagcgtcccttggtga

SEQ ID NO: 6002226 - DNA, 14 bp, Homo sapiens
cagcgtcctcagca

SEQ ID NO: 6002227 - DNA, 15 bp, Homo sapiens
cagcgtcctcagcac

SEQ ID NO: 6002228 - DNA, 18 bp, Homo sapiens
cagcgtcctcctctgtga

SEQ ID NO: 6002229 - DNA, 23 bp, Homo sapiens
cagcgtcctcgttcaaaacattc

SEQ ID NO: 6002230 - DNA, 14 bp, Homo sapiens
cagcgtcctgtcca

SEQ ID NO: 6002231 - DNA, 18 bp, Homo sapiens
cagcgtcggtctgtgccc

SEQ ID NO: 6002232 - DNA, 14 bp, Homo sapiens
cagcgtctccccat

SEQ ID NO: 6002233 - DNA, 16 bp, Homo sapiens
cagcgtctccccatgc

SEQ ID NO: 6002234 - DNA, 17 bp, Homo sapiens
cagcgtctccccatgct

SEQ ID NO: 6002235 - DNA, 20 bp, Homo sapiens
cagcgtctgagcggccgcct

SEQ ID NO: 6002236 - DNA, 21 bp, Homo sapiens
cagcgtctgagcggccgcctg

SEQ ID NO: 6002237 - DNA, 19 bp, Homo sapiens
cagcgtctgcagggtgacg

SEQ ID NO: 6002238 - DNA, 13 bp, Homo sapiens
cagcgtctgctca

SEQ ID NO: 6002239 - DNA, 13 bp, Homo sapiens
cagcgtctgctgt

SEQ ID NO: 6002240 - DNA, 23 bp, Homo sapiens
cagcgtctttttaacctcagaaa

SEQ ID NO: 6002241 - DNA, 16 bp, Homo sapiens
cagcgtgcacatctgc

SEQ ID NO: 6002242 - DNA, 17 bp, Homo sapiens
cagcgtgccgagccagc

SEQ ID NO: 6002243 - DNA, 23 bp, Homo sapiens
cagcgtggaggggtaggggctgg

SEQ ID NO: 6002244 - DNA, 13 bp, Homo sapiens
cagcgtggcccag

SEQ ID NO: 6002245 - DNA, 16 bp, Homo sapiens
cagcgtggcccaggcc

SEQ ID NO: 6002246 - DNA, 23 bp, Homo sapiens
cagcgtggcccaggccgggaaga

SEQ ID NO: 6002247 - DNA, 14 bp, Homo sapiens
cagcgtgggctctg

SEQ ID NO: 6002248 - DNA, 13 bp, Homo sapiens
cagcgtgggggtg

SEQ ID NO: 6002249 - DNA, 22 bp, Homo sapiens
cagcgtggtttttatgtgtatt

SEQ ID NO: 6002250 - DNA, 20 bp, Homo sapiens
cagcgtgtggagcagagctc

SEQ ID NO: 6002251 - DNA, 12 bp, Homo sapiens
cagcgtgtgtat

SEQ ID NO: 6002252 - DNA, 14 bp, Homo sapiens
cagcgttaacacaa

SEQ ID NO: 6002253 - DNA, 21 bp, Homo sapiens
cagcgttaacacaaaatccat

SEQ ID NO: 6002254 - DNA, 14 bp, Homo sapiens
cagcgttagggctg

SEQ ID NO: 6002255 - DNA, 15 bp, Homo sapiens
cagcgttagggctgc

SEQ ID NO: 6002256 - DNA, 17 bp, Homo sapiens
cagcgttagggctgctt

SEQ ID NO: 6002257 - DNA, 16 bp, Homo sapiens
cagcgttcccttctcc

SEQ ID NO: 6002258 - DNA, 20 bp, Homo sapiens
cagcgttcccttctccccct

SEQ ID NO: 6002259 - DNA, 17 bp, Homo sapiens
cagcgttgcatgtcgtg

SEQ ID NO: 6002260 - DNA, 23 bp, Homo sapiens
cagcgttgggtttgctcatgtaa

SEQ ID NO: 6002261 - DNA, 12 bp, Homo sapiens
cagcgtttacat

SEQ ID NO: 6002262 - DNA, 16 bp, Homo sapiens
cagcgtttacatattt

SEQ ID NO: 6002263 - DNA, 22 bp, Homo sapiens
cagcgtttagtttctagaggcc

SEQ ID NO: 6002264 - DNA, 24 bp, Homo sapiens
cagcgtttagtttctagaggcctc

SEQ ID NO: 6002265 - DNA, 17 bp, Homo sapiens
cagcgtttattgtagta

SEQ ID NO: 6002266 - DNA, 19 bp, Homo sapiens
cagcgtttctatgacacat

SEQ ID NO: 6002267 - DNA, 15 bp, Homo sapiens
cagcgtttctccacc

SEQ ID NO: 6002268 - DNA, 22 bp, Homo sapiens
cagctaaaccaaggactgagca

SEQ ID NO: 6002269 - DNA, 12 bp, Homo sapiens
cagctaaagcaa

SEQ ID NO: 6002270 - DNA, 15 bp, Homo sapiens
cagctaaagcagtcc

SEQ ID NO: 6002271 - DNA, 18 bp, Homo sapiens
cagctaaagcccaacctc

SEQ ID NO: 6002272 - DNA, 16 bp, Homo sapiens
cagctaaatgtaactt

SEQ ID NO: 6002273 - DNA, 15 bp, Homo sapiens
cagctaaatttggag

SEQ ID NO: 6002274 - DNA, 16 bp, Homo sapiens
cagctaacaaactaga

SEQ ID NO: 6002275 - DNA, 14 bp, Homo sapiens
cagctaacaataaa

SEQ ID NO: 6002276 - DNA, 21 bp, Homo sapiens
cagctaactccgagagcagtg

SEQ ID NO: 6002277 - DNA, 12 bp, Homo sapiens
cagctaagaaaa

SEQ ID NO: 6002278 - DNA, 16 bp, Homo sapiens
cagctaagaacctgga

SEQ ID NO: 6002279 - DNA, 18 bp, Homo sapiens
cagctaagaacctggaac

SEQ ID NO: 6002280 - DNA, 22 bp, Homo sapiens
cagctaagatagaaagctggac

SEQ ID NO: 6002281 - DNA, 13 bp, Homo sapiens
cagctaagcaata

SEQ ID NO: 6002282 - DNA, 15 bp, Homo sapiens
cagctaagcctgatg

SEQ ID NO: 6002283 - DNA, 18 bp, Homo sapiens
cagctaagctcaaatgta

SEQ ID NO: 6002284 - DNA, 21 bp, Homo sapiens
cagctaagctcaaatgtatat

SEQ ID NO: 6002285 - DNA, 18 bp, Homo sapiens
cagctaagggaagacatt

SEQ ID NO: 6002286 - DNA, 17 bp, Homo sapiens
cagctaaggggcaggaa

SEQ ID NO: 6002287 - DNA, 19 bp, Homo sapiens
cagctaaggggcaggaatc

SEQ ID NO: 6002288 - DNA, 21 bp, Homo sapiens
cagctaataaaagtcagagct

SEQ ID NO: 6002289 - DNA, 22 bp, Homo sapiens
cagctaataaaagtcagagctc

SEQ ID NO: 6002290 - DNA, 17 bp, Homo sapiens
cagctaatctgtagggc

SEQ ID NO: 6002291 - DNA, 21 bp, Homo sapiens
cagctaatctttaatataata

SEQ ID NO: 6002292 - DNA, 14 bp, Homo sapiens
cagctaattctact

SEQ ID NO: 6002293 - DNA, 16 bp, Homo sapiens
cagctaattgagacca

SEQ ID NO: 6002294 - DNA, 14 bp, Homo sapiens
cagctaatttgtga

SEQ ID NO: 6002295 - DNA, 15 bp, Homo sapiens
cagctaatttgtgaa

SEQ ID NO: 6002296 - DNA, 16 bp, Homo sapiens
cagctaatttgtgaaa

SEQ ID NO: 6002297 - DNA, 19 bp, Homo sapiens
cagctaatttgtgaaagtg

SEQ ID NO: 6002298 - DNA, 18 bp, Homo sapiens
cagctaatttttgtatgt

SEQ ID NO: 6002299 - DNA, 13 bp, Homo sapiens
cagctacaacagc

SEQ ID NO: 6002300 - DNA, 14 bp, Homo sapiens
cagctacacctgag

SEQ ID NO: 6002301 - DNA, 15 bp, Homo sapiens
cagctacaggcttga

SEQ ID NO: 6002302 - DNA, 15 bp, Homo sapiens
cagctacatgaagtt

SEQ ID NO: 6002303 - DNA, 15 bp, Homo sapiens
cagctacatgggagg

SEQ ID NO: 6002304 - DNA, 13 bp, Homo sapiens
cagctacattcct

SEQ ID NO: 6002305 - DNA, 20 bp, Homo sapiens
cagctacattcctcagctgc

SEQ ID NO: 6002306 - DNA, 22 bp, Homo sapiens
cagctaccacgggtctgccatg

SEQ ID NO: 6002307 - DNA, 18 bp, Homo sapiens
cagctaccaggtgttcta

SEQ ID NO: 6002308 - DNA, 14 bp, Homo sapiens
cagctacccaggag

SEQ ID NO: 6002309 - DNA, 21 bp, Homo sapiens
cagctacccaggaggctgagg

SEQ ID NO: 6002310 - DNA, 23 bp, Homo sapiens
cagctacccaggaggctgaggca

SEQ ID NO: 6002311 - DNA, 17 bp, Homo sapiens
cagctacccctgcagct

SEQ ID NO: 6002312 - DNA, 16 bp, Homo sapiens
cagctaccctcagcct

SEQ ID NO: 6002313 - DNA, 20 bp, Homo sapiens
cagctactaacctggagaca

SEQ ID NO: 6002314 - DNA, 19 bp, Homo sapiens
cagctactaaggtgctagg

SEQ ID NO: 6002315 - DNA, 20 bp, Homo sapiens
cagctactaaggtgctagga

SEQ ID NO: 6002316 - DNA, 17 bp, Homo sapiens
cagctactaatgatgtt

SEQ ID NO: 6002317 - DNA, 16 bp, Homo sapiens
cagctactcaactgga

SEQ ID NO: 6002318 - DNA, 21 bp, Homo sapiens
cagctactcagaagcctgagg

SEQ ID NO: 6002319 - DNA, 21 bp, Homo sapiens
cagctactcagatctgcactc

SEQ ID NO: 6002320 - DNA, 14 bp, Homo sapiens
cagctactcgggag

SEQ ID NO: 6002321 - DNA, 23 bp, Homo sapiens
cagctactctccccacgagggct

SEQ ID NO: 6002322 - DNA, 14 bp, Homo sapiens
cagctactctgtcc

SEQ ID NO: 6002323 - DNA, 21 bp, Homo sapiens
cagctactctgtccaggccac

SEQ ID NO: 6002324 - DNA, 19 bp, Homo sapiens
cagctactgaaccagccac

SEQ ID NO: 6002325 - DNA, 16 bp, Homo sapiens
cagctactgatttttg

SEQ ID NO: 6002326 - DNA, 15 bp, Homo sapiens
cagctactggaatgg

SEQ ID NO: 6002327 - DNA, 20 bp, Homo sapiens
cagctactggggaggctgag

SEQ ID NO: 6002328 - DNA, 23 bp, Homo sapiens
cagctactggggaggctgaggca

SEQ ID NO: 6002329 - DNA, 13 bp, Homo sapiens
cagctactgtaac

SEQ ID NO: 6002330 - DNA, 21 bp, Homo sapiens
cagctactgtaacttttttaa

SEQ ID NO: 6002331 - DNA, 17 bp, Homo sapiens
cagctacttaagagaaa

SEQ ID NO: 6002332 - DNA, 15 bp, Homo sapiens
cagctacttcctcct

SEQ ID NO: 6002333 - DNA, 21 bp, Homo sapiens
cagctacttcctcctccccac

SEQ ID NO: 6002334 - DNA, 15 bp, Homo sapiens
cagctacttgggaag

SEQ ID NO: 6002335 - DNA, 17 bp, Homo sapiens
cagctacttgggagcct

SEQ ID NO: 6002336 - DNA, 20 bp, Homo sapiens
cagctacttgggagcctgag

SEQ ID NO: 6002337 - DNA, 17 bp, Homo sapiens
cagctacttggtttgtg

SEQ ID NO: 6002338 - DNA, 15 bp, Homo sapiens
cagctactttccatt

SEQ ID NO: 6002339 - DNA, 18 bp, Homo sapiens
cagctactttccatttgg

SEQ ID NO: 6002340 - DNA, 22 bp, Homo sapiens
cagctagaaaacacaaaatctt

SEQ ID NO: 6002341 - DNA, 14 bp, Homo sapiens
cagctagaaagaga

SEQ ID NO: 6002342 - DNA, 16 bp, Homo sapiens
cagctagaaagagaaa

SEQ ID NO: 6002343 - DNA, 23 bp, Homo sapiens
cagctagaaagagaaaaagccct

SEQ ID NO: 6002344 - DNA, 23 bp, Homo sapiens
cagctagacaatgatttggccag

SEQ ID NO: 6002345 - DNA, 18 bp, Homo sapiens
cagctagactggagtgag

SEQ ID NO: 6002346 - DNA, 13 bp, Homo sapiens
cagctagagcttc

SEQ ID NO: 6002347 - DNA, 22 bp, Homo sapiens
cagctagagcttccactgtcag

SEQ ID NO: 6002348 - DNA, 21 bp, Homo sapiens
cagctagcaaaagaagtaaca

SEQ ID NO: 6002349 - DNA, 19 bp, Homo sapiens
cagctagccaactcctcct

SEQ ID NO: 6002350 - DNA, 21 bp, Homo sapiens
cagctaggaacaaatcttcct

SEQ ID NO: 6002351 - DNA, 15 bp, Homo sapiens
cagctaggaagcaag

SEQ ID NO: 6002352 - DNA, 21 bp, Homo sapiens
cagctaggaagcaagatcgct

SEQ ID NO: 6002353 - DNA, 12 bp, Homo sapiens
cagctaggactg

SEQ ID NO: 6002354 - DNA, 13 bp, Homo sapiens
cagctaggcaggg

SEQ ID NO: 6002355 - DNA, 16 bp, Homo sapiens
cagctaggcagggagg

SEQ ID NO: 6002356 - DNA, 21 bp, Homo sapiens
cagctaggctgagatgcacca

SEQ ID NO: 6002357 - DNA, 21 bp, Homo sapiens
cagctagggggcgttatttat

SEQ ID NO: 6002358 - DNA, 20 bp, Homo sapiens
cagctagtgaagaccagagc

SEQ ID NO: 6002359 - DNA, 21 bp, Homo sapiens
cagctagtgaagaccagagca

SEQ ID NO: 6002360 - DNA, 18 bp, Homo sapiens
cagctagtgacccacatg

SEQ ID NO: 6002361 - DNA, 20 bp, Homo sapiens
cagctagtgccaaataattg

SEQ ID NO: 6002362 - DNA, 18 bp, Homo sapiens
cagctatacctcattcac

SEQ ID NO: 6002363 - DNA, 15 bp, Homo sapiens
cagctatacctgcac

SEQ ID NO: 6002364 - DNA, 23 bp, Homo sapiens
cagctatacctgcacgttcataa

SEQ ID NO: 6002365 - DNA, 21 bp, Homo sapiens
cagctatatactatttatata

SEQ ID NO: 6002366 - DNA, 13 bp, Homo sapiens
cagctatatttga

SEQ ID NO: 6002367 - DNA, 21 bp, Homo sapiens
cagctatatttgattatgtat

SEQ ID NO: 6002368 - DNA, 17 bp, Homo sapiens
cagctatccagtgactt

SEQ ID NO: 6002369 - DNA, 15 bp, Homo sapiens
caccttttgtattta

SEQ ID NO: 6002370 - DNA, 16 bp, Homo sapiens
caccttttgtttttcc

SEQ ID NO: 6002371 - DNA, 12 bp, Homo sapiens
cacctttttgca

SEQ ID NO: 6002372 - DNA, 14 bp, Homo sapiens
caccttttttccta

SEQ ID NO: 6002373 - DNA, 20 bp, Homo sapiens
cacgaaactggaataagcct

SEQ ID NO: 6002374 - DNA, 20 bp, Homo sapiens
cacgaaacttgttattgtga

SEQ ID NO: 6002375 - DNA, 21 bp, Homo sapiens
cacgaaacttgttattgtgaa

SEQ ID NO: 6002376 - DNA, 22 bp, Homo sapiens
cacgaaagagagagaaacaaac

SEQ ID NO: 6002377 - DNA, 11 bp, Homo sapiens
cacgaaagcac

SEQ ID NO: 6002378 - DNA, 15 bp, Homo sapiens
cacgaaatgttattt

SEQ ID NO: 6002379 - DNA, 18 bp, Homo sapiens
cacgaacccacctgctga

SEQ ID NO: 6002380 - DNA, 16 bp, Homo sapiens
cacgaaccctgccagg

SEQ ID NO: 6002381 - DNA, 15 bp, Homo sapiens
cacgaactgttcaca

SEQ ID NO: 6002382 - DNA, 19 bp, Homo sapiens
cacgaactttagctgcatc

SEQ ID NO: 6002383 - DNA, 14 bp, Homo sapiens
cacgaagaaataga

SEQ ID NO: 6002384 - DNA, 12 bp, Homo sapiens
cacgaagcaatt

SEQ ID NO: 6002385 - DNA, 12 bp, Homo sapiens
cacgaagcctta

SEQ ID NO: 6002386 - DNA, 21 bp, Homo sapiens
cacgaaggtaaaaagtatttt

SEQ ID NO: 6002387 - DNA, 16 bp, Homo sapiens
cacgaatagacatcaa

SEQ ID NO: 6002388 - DNA, 22 bp, Homo sapiens
cacgaatattgctgatggtgca

SEQ ID NO: 6002389 - DNA, 13 bp, Homo sapiens
cacgaccagcccc

SEQ ID NO: 6002390 - DNA, 23 bp, Homo sapiens
cacgaccagccccttcctgggta

SEQ ID NO: 6002391 - DNA, 18 bp, Homo sapiens
cacgaccggggccagcac

SEQ ID NO: 6002392 - DNA, 16 bp, Homo sapiens
cacgacgtcagcctct

SEQ ID NO: 6002393 - DNA, 17 bp, Homo sapiens
cacgactgcccggcagg

SEQ ID NO: 6002394 - DNA, 16 bp, Homo sapiens
cacgactgcgggagcc

SEQ ID NO: 6002395 - DNA, 22 bp, Homo sapiens
cacgactgcgggagccagactg

SEQ ID NO: 6002396 - DNA, 17 bp, Homo sapiens
cacgactggccagggcc

SEQ ID NO: 6002397 - DNA, 17 bp, Homo sapiens
cacgactggtcaccttg

SEQ ID NO: 6002398 - DNA, 20 bp, Homo sapiens
cacgactggtcaccttgcac

SEQ ID NO: 6002399 - DNA, 22 bp, Homo sapiens
cacgactggtcaccttgcactc

SEQ ID NO: 6002400 - DNA, 16 bp, Homo sapiens
cacgactgtctccatg

SEQ ID NO: 6002401 - DNA, 17 bp, Homo sapiens
cacgagacccatttcct

SEQ ID NO: 6002402 - DNA, 13 bp, Homo sapiens
cacgagagcccgg

SEQ ID NO: 6002403 - DNA, 15 bp, Homo sapiens
cacgagagcgcagca

SEQ ID NO: 6002404 - DNA, 17 bp, Homo sapiens
cacgagatcttccttcc

SEQ ID NO: 6002405 - DNA, 17 bp, Homo sapiens
cacgagcaaacccagag

SEQ ID NO: 6002406 - DNA, 23 bp, Homo sapiens
cacgagcaaagtgaagacactgg

SEQ ID NO: 6002407 - DNA, 13 bp, Homo sapiens
cacgagcacaatg

SEQ ID NO: 6002408 - DNA, 19 bp, Homo sapiens
cacgagcaggctactgtca

SEQ ID NO: 6002409 - DNA, 22 bp, Homo sapiens
cacgaggaatctgtgggtctgg

SEQ ID NO: 6002410 - DNA, 23 bp, Homo sapiens
cacgaggaatctgtgggtctggg

SEQ ID NO: 6002411 - DNA, 20 bp, Homo sapiens
cacgaggagcagcagcgctc

SEQ ID NO: 6002412 - DNA, 13 bp, Homo sapiens
cacgaggagcttc

SEQ ID NO: 6002413 - DNA, 18 bp, Homo sapiens
cacgaggcctcaggtcgg

SEQ ID NO: 6002414 - DNA, 14 bp, Homo sapiens
cacgaggctgcccc

SEQ ID NO: 6002415 - DNA, 16 bp, Homo sapiens
cacgaggctgccccca

SEQ ID NO: 6002416 - DNA, 22 bp, Homo sapiens
cacgagggctggctggcctcac

SEQ ID NO: 6002417 - DNA, 22 bp, Homo sapiens
cacgaggggacccatgggggct

SEQ ID NO: 6002418 - DNA, 15 bp, Homo sapiens
cacgaggggggccag

SEQ ID NO: 6002419 - DNA, 16 bp, Homo sapiens
cacgaggggggccagg

SEQ ID NO: 6002420 - DNA, 21 bp, Homo sapiens
cacgagggtctcccctcctgc

SEQ ID NO: 6002421 - DNA, 21 bp, Homo sapiens
cacgaggtggtagctctgagc

SEQ ID NO: 6002422 - DNA, 22 bp, Homo sapiens
cacgaggttaaagaagctgcat

SEQ ID NO: 6002423 - DNA, 17 bp, Homo sapiens
cacgagtcacctgcaag

SEQ ID NO: 6002424 - DNA, 23 bp, Homo sapiens
cacgagtttggatgttgtaaata

SEQ ID NO: 6002425 - DNA, 14 bp, Homo sapiens
cacgatcccctccc

SEQ ID NO: 6002426 - DNA, 13 bp, Homo sapiens
cacgatctcagct

SEQ ID NO: 6002427 - DNA, 15 bp, Homo sapiens
cacgatctcagctca

SEQ ID NO: 6002428 - DNA, 15 bp, Homo sapiens
cacgatcttgtaaga

SEQ ID NO: 6002429 - DNA, 23 bp, Homo sapiens
cacgatgatatctatatatgtat

SEQ ID NO: 6002430 - DNA, 17 bp, Homo sapiens
cacgatgcatttaataa

SEQ ID NO: 6002431 - DNA, 20 bp, Homo sapiens
cacgatgcatttaataaaga

SEQ ID NO: 6002432 - DNA, 15 bp, Homo sapiens
cacgatgcctttgag

SEQ ID NO: 6002433 - DNA, 17 bp, Homo sapiens
cacgatgtggccctggc

SEQ ID NO: 6002434 - DNA, 22 bp, Homo sapiens
cacgatgtggccctggcctgct

SEQ ID NO: 6002435 - DNA, 15 bp, Homo sapiens
cacgattagctttat

SEQ ID NO: 6002436 - DNA, 15 bp, Homo sapiens
cacgattcatttttg

SEQ ID NO: 6002437 - DNA, 16 bp, Homo sapiens
cacgattggagaatac

SEQ ID NO: 6002438 - DNA, 19 bp, Homo sapiens
cacgattggagaatacttt

SEQ ID NO: 6002439 - DNA, 13 bp, Homo sapiens
cacgattggccac

SEQ ID NO: 6002440 - DNA, 16 bp, Homo sapiens
cacgattggccacctg

SEQ ID NO: 6002441 - DNA, 17 bp, Homo sapiens
cacgattggccacctgt

SEQ ID NO: 6002442 - DNA, 19 bp, Homo sapiens
cacgatttagatttaatga

SEQ ID NO: 6002443 - DNA, 12 bp, Homo sapiens
cacgatttctgt

SEQ ID NO: 6002444 - DNA, 14 bp, Homo sapiens
cacgatttctgttt

SEQ ID NO: 6002445 - DNA, 21 bp, Homo sapiens
cacgatttgcaggattccctt

SEQ ID NO: 6002446 - DNA, 13 bp, Homo sapiens
cacgatttgtctt

SEQ ID NO: 6002447 - DNA, 18 bp, Homo sapiens
cacgattttcaagattct

SEQ ID NO: 6002448 - DNA, 21 bp, Homo sapiens
cacgcaaaccaacctttctga

SEQ ID NO: 6002449 - DNA, 15 bp, Homo sapiens
cacgcaacccttgct

SEQ ID NO: 6002450 - DNA, 15 bp, Homo sapiens
cacgcaagcctcagc

SEQ ID NO: 6002451 - DNA, 17 bp, Homo sapiens
cacgcaaggctgtgctc

SEQ ID NO: 6002452 - DNA, 18 bp, Homo sapiens
cacgcaagggcatcaggc

SEQ ID NO: 6002453 - DNA, 13 bp, Homo sapiens
cacgcaagtgcca

SEQ ID NO: 6002454 - DNA, 13 bp, Homo sapiens
cacgcacaaacac

SEQ ID NO: 6002455 - DNA, 15 bp, Homo sapiens
cacgcacaaacacac

SEQ ID NO: 6002456 - DNA, 18 bp, Homo sapiens
cacgcacaaacacacaca

SEQ ID NO: 6002457 - DNA, 23 bp, Homo sapiens
cacgcacaaacacacacactatg

SEQ ID NO: 6002458 - DNA, 15 bp, Homo sapiens
cacgcacacacacac

SEQ ID NO: 6002459 - DNA, 15 bp, Homo sapiens
cacgcacacacacat

SEQ ID NO: 6002460 - DNA, 22 bp, Homo sapiens
cacgcacatgccaatgcacgca

SEQ ID NO: 6002461 - DNA, 22 bp, Homo sapiens
cacgcaccaccgcgcctacctt

SEQ ID NO: 6002462 - DNA, 14 bp, Homo sapiens
cacgcaccactgct

SEQ ID NO: 6002463 - DNA, 16 bp, Homo sapiens
cacgcaccactgcttc

SEQ ID NO: 6002464 - DNA, 18 bp, Homo sapiens
cacgcaccactgcttccc

SEQ ID NO: 6002465 - DNA, 14 bp, Homo sapiens
cacgcacccacacc

SEQ ID NO: 6002466 - DNA, 20 bp, Homo sapiens
cacgcacccgtatctgccct

SEQ ID NO: 6002467 - DNA, 18 bp, Homo sapiens
cacgcacctccacgccac

SEQ ID NO: 6002468 - DNA, 14 bp, Homo sapiens
cacgcacctcccat

SEQ ID NO: 6002469 - DNA, 19 bp, Homo sapiens
cacgcacctcccatcctaa

SEQ ID NO: 6002470 - DNA, 12 bp, Homo sapiens
cacgcacctgcc

SEQ ID NO: 6002471 - DNA, 12 bp, Homo sapiens
cacgcacctgta

SEQ ID NO: 6002472 - DNA, 13 bp, Homo sapiens
cacgcacctgtag

SEQ ID NO: 6002473 - DNA, 19 bp, Homo sapiens
cacgcacctgtagtcccag

SEQ ID NO: 6002474 - DNA, 21 bp, Homo sapiens
cacgcacgacgtcagcctctt

SEQ ID NO: 6002475 - DNA, 22 bp, Homo sapiens
cacgcacgacgtcagcctctta

SEQ ID NO: 6002476 - DNA, 15 bp, Homo sapiens
cacgcacgcacacac

SEQ ID NO: 6002477 - DNA, 17 bp, Homo sapiens
cacgcacgcacacacac

SEQ ID NO: 6002478 - DNA, 13 bp, Homo sapiens
cacgcacggcagc

SEQ ID NO: 6002479 - DNA, 15 bp, Homo sapiens
cacgcacggcttcct

SEQ ID NO: 6002480 - DNA, 18 bp, Homo sapiens
cacgcacggcttcctata

SEQ ID NO: 6002481 - DNA, 14 bp, Homo sapiens
cacgcactgggcca

SEQ ID NO: 6002482 - DNA, 23 bp, Homo sapiens
cacgcactgggttgcgggacaga

SEQ ID NO: 6002483 - DNA, 14 bp, Homo sapiens
cacgcactggtgcc

SEQ ID NO: 6002484 - DNA, 15 bp, Homo sapiens
cacgcactggtgcca

SEQ ID NO: 6002485 - DNA, 15 bp, Homo sapiens
cacgcacttcctctc

SEQ ID NO: 6002486 - DNA, 19 bp, Homo sapiens
cacgcacttctggggccag

SEQ ID NO: 6002487 - DNA, 22 bp, Homo sapiens
cacgcacttctggggccagccc

SEQ ID NO: 6002488 - DNA, 15 bp, Homo sapiens
cacgcacttgcctgt

SEQ ID NO: 6002489 - DNA, 17 bp, Homo sapiens
cacgcacttgcctgttg

SEQ ID NO: 6002490 - DNA, 19 bp, Homo sapiens
cacgcacttgcctgttggc

SEQ ID NO: 6002491 - DNA, 20 bp, Homo sapiens
cacgcacttgcctgttggct

SEQ ID NO: 6002492 - DNA, 16 bp, Homo sapiens
cacgcagacacacaca

SEQ ID NO: 6002493 - DNA, 16 bp, Homo sapiens
cacgcagagccccgga

SEQ ID NO: 6002494 - DNA, 20 bp, Homo sapiens
cacgcagagccccggagcac

SEQ ID NO: 6002495 - DNA, 21 bp, Homo sapiens
cacgcagaggacgcacgctcg

SEQ ID NO: 6002496 - DNA, 15 bp, Homo sapiens
cacgcagccaggaca

SEQ ID NO: 6002497 - DNA, 15 bp, Homo sapiens
cacgcagccgccgcc

SEQ ID NO: 6002498 - DNA, 17 bp, Homo sapiens
cacgcagctggcagaga

SEQ ID NO: 6002499 - DNA, 13 bp, Homo sapiens
cacgcaggaactc

SEQ ID NO: 6002500 - DNA, 19 bp, Homo sapiens
cacgcaggaactcccagca

SEQ ID NO: 6002501 - DNA, 13 bp, Homo sapiens
cacgcaggaccag

SEQ ID NO: 6002502 - DNA, 15 bp, Homo sapiens
cacgcaggacccagg

SEQ ID NO: 6002503 - DNA, 12 bp, Homo sapiens
cacgcaggagca

SEQ ID NO: 6002504 - DNA, 16 bp, Homo sapiens
cacgcaggcacagcag

SEQ ID NO: 6002505 - DNA, 16 bp, Homo sapiens
cacgcaggcggccagg

SEQ ID NO: 6002506 - DNA, 12 bp, Homo sapiens
cacgcagggcca

SEQ ID NO: 6002507 - DNA, 19 bp, Homo sapiens
cacgcaggggctctgagcc

SEQ ID NO: 6002508 - DNA, 20 bp, Homo sapiens
cacgcaggggctctgagccc

SEQ ID NO: 6002509 - DNA, 15 bp, Homo sapiens
cacgcatacacacat

SEQ ID NO: 6002510 - DNA, 14 bp, Homo sapiens
cacgcatacttgga

SEQ ID NO: 6002511 - DNA, 20 bp, Homo sapiens
cacgcatgatggagctgatc

SEQ ID NO: 6002512 - DNA, 20 bp, Homo sapiens
cacgcatgcctcagccagcc

SEQ ID NO: 6002513 - DNA, 20 bp, Homo sapiens
cacgcatgggcattgcagcc

SEQ ID NO: 6002514 - DNA, 23 bp, Homo sapiens
cacgcatgggcattgcagccttg

SEQ ID NO: 6002515 - DNA, 22 bp, Homo sapiens
cacgcatgtccctccaaggctg

SEQ ID NO: 6002516 - DNA, 18 bp, Homo sapiens
cacgccaaccccagcagt

SEQ ID NO: 6002517 - DNA, 20 bp, Homo sapiens
cacgccaagtggaagccact

SEQ ID NO: 6002518 - DNA, 11 bp, Homo sapiens
cacgccacagc

SEQ ID NO: 6002519 - DNA, 22 bp, Homo sapiens
cacgccacccccgcccccaccg

SEQ ID NO: 6002520 - DNA, 14 bp, Homo sapiens
cacgccactgcact

SEQ ID NO: 6002521 - DNA, 13 bp, Homo sapiens
cacgccactgcct

SEQ ID NO: 6002522 - DNA, 14 bp, Homo sapiens
cacgccactgcctc

SEQ ID NO: 6002523 - DNA, 16 bp, Homo sapiens
cacgccagattctttc

SEQ ID NO: 6002524 - DNA, 22 bp, Homo sapiens
cacgccagattctttcctgagg

SEQ ID NO: 6002525 - DNA, 23 bp, Homo sapiens
cacgccagattctttcctgaggc

SEQ ID NO: 6002526 - DNA, 18 bp, Homo sapiens
cacgccagctcctctctg

SEQ ID NO: 6002527 - DNA, 22 bp, Homo sapiens
cacgccagctcctctctgaagc

SEQ ID NO: 6002528 - DNA, 13 bp, Homo sapiens
cacgccagctggc

SEQ ID NO: 6002529 - DNA, 15 bp, Homo sapiens
cacgccagctggccc

SEQ ID NO: 6002530 - DNA, 16 bp, Homo sapiens
cacgccagctggccca

SEQ ID NO: 6002531 - DNA, 15 bp, Homo sapiens
cacgccaggccagca

SEQ ID NO: 6002532 - DNA, 18 bp, Homo sapiens
cacgccattctcctgcct

SEQ ID NO: 6002533 - DNA, 22 bp, Homo sapiens
cacgccattctcctgcctcagc

SEQ ID NO: 6002534 - DNA, 23 bp, Homo sapiens
cacgccattctcctgcctcagcc

SEQ ID NO: 6002535 - DNA, 19 bp, Homo sapiens
cacgccattgtactccagc

SEQ ID NO: 6002536 - DNA, 18 bp, Homo sapiens
cacgcccaccagccttgc

SEQ ID NO: 6002537 - DNA, 13 bp, Homo sapiens
cacgcccagcctc

SEQ ID NO: 6002538 - DNA, 15 bp, Homo sapiens
cacgcccatgtgtga

SEQ ID NO: 6002539 - DNA, 23 bp, Homo sapiens
cacgcccatgtgtgagtgtgtgc

SEQ ID NO: 6002540 - DNA, 18 bp, Homo sapiens
cacgcccccactggtgac

SEQ ID NO: 6002541 - DNA, 14 bp, Homo sapiens
cacgcccccatgca

SEQ ID NO: 6002542 - DNA, 21 bp, Homo sapiens
cacgccccggtcccccagagc

SEQ ID NO: 6002543 - DNA, 16 bp, Homo sapiens
cacgccccgtgtctgg

SEQ ID NO: 6002544 - DNA, 15 bp, Homo sapiens
cacgcccctgcctga

SEQ ID NO: 6002545 - DNA, 16 bp, Homo sapiens
cacgcccgactagcag

SEQ ID NO: 6002546 - DNA, 21 bp, Homo sapiens
cacgcccggggtggccacagc

SEQ ID NO: 6002547 - DNA, 14 bp, Homo sapiens
cacgcccgtcctgc

SEQ ID NO: 6002548 - DNA, 15 bp, Homo sapiens
cacgcccgtcctgcc

SEQ ID NO: 6002549 - DNA, 19 bp, Homo sapiens
cagctatctagatagctga

SEQ ID NO: 6002550 - DNA, 20 bp, Homo sapiens
cagctatctgcctgacaggc

SEQ ID NO: 6002551 - DNA, 23 bp, Homo sapiens
cagctatctggtcaacctcctgg

SEQ ID NO: 6002552 - DNA, 14 bp, Homo sapiens
cagctatctgtcat

SEQ ID NO: 6002553 - DNA, 13 bp, Homo sapiens
cagctatgcaaaa

SEQ ID NO: 6002554 - DNA, 22 bp, Homo sapiens
cagctatggacaatttaccaca

SEQ ID NO: 6002555 - DNA, 17 bp, Homo sapiens
cagctatggccccaggg

SEQ ID NO: 6002556 - DNA, 20 bp, Homo sapiens
cagctatgggagccccaggg

SEQ ID NO: 6002557 - DNA, 21 bp, Homo sapiens
cagctatgggagccccagggt

SEQ ID NO: 6002558 - DNA, 19 bp, Homo sapiens
cagctattaccacacttgg

SEQ ID NO: 6002559 - DNA, 14 bp, Homo sapiens
cagctattcacaca

SEQ ID NO: 6002560 - DNA, 15 bp, Homo sapiens
cagctattcacacac

SEQ ID NO: 6002561 - DNA, 16 bp, Homo sapiens
cagctattcacacaca

SEQ ID NO: 6002562 - DNA, 20 bp, Homo sapiens
cagctattcccttctgatct

SEQ ID NO: 6002563 - DNA, 16 bp, Homo sapiens
cagctatttcagcctc

SEQ ID NO: 6002564 - DNA, 20 bp, Homo sapiens
cagctatttcagcctcctgt

SEQ ID NO: 6002565 - DNA, 23 bp, Homo sapiens
cagctatttggcaggctgaggca

SEQ ID NO: 6002566 - DNA, 14 bp, Homo sapiens
cagctattttctga

SEQ ID NO: 6002567 - DNA, 15 bp, Homo sapiens
cagctattttctgac

SEQ ID NO: 6002568 - DNA, 17 bp, Homo sapiens
cagctattttctgacca

SEQ ID NO: 6002569 - DNA, 13 bp, Homo sapiens
cagctatttttat

SEQ ID NO: 6002570 - DNA, 18 bp, Homo sapiens
cagctcaacctaccctgg

SEQ ID NO: 6002571 - DNA, 13 bp, Homo sapiens
cagctcaagtctt

SEQ ID NO: 6002572 - DNA, 16 bp, Homo sapiens
cagctcacaagcccag

SEQ ID NO: 6002573 - DNA, 18 bp, Homo sapiens
cagctcacaccctacctt

SEQ ID NO: 6002574 - DNA, 21 bp, Homo sapiens
cagctcacaccctaccttccc

SEQ ID NO: 6002575 - DNA, 24 bp, Homo sapiens
cagctcacaccctaccttccccag

SEQ ID NO: 6002576 - DNA, 15 bp, Homo sapiens
cagctcacccctggg

SEQ ID NO: 6002577 - DNA, 17 bp, Homo sapiens
cagctcacccctgggca

SEQ ID NO: 6002578 - DNA, 20 bp, Homo sapiens
cagctcacccctgggcaggc

SEQ ID NO: 6002579 - DNA, 13 bp, Homo sapiens
cagctcacctctc

SEQ ID NO: 6002580 - DNA, 17 bp, Homo sapiens
cagctcacctctccctt

SEQ ID NO: 6002581 - DNA, 17 bp, Homo sapiens
cagctcacgtcacactt

SEQ ID NO: 6002582 - DNA, 12 bp, Homo sapiens
cagctcactgca

SEQ ID NO: 6002583 - DNA, 13 bp, Homo sapiens
cagctcactgcaa

SEQ ID NO: 6002584 - DNA, 14 bp, Homo sapiens
cagctcactgcagc

SEQ ID NO: 6002585 - DNA, 16 bp, Homo sapiens
cagctcactgcagcct

SEQ ID NO: 6002586 - DNA, 17 bp, Homo sapiens
cagctcactgcagcctc

SEQ ID NO: 6002587 - DNA, 18 bp, Homo sapiens
cagctcactgcagcctcg

SEQ ID NO: 6002588 - DNA, 16 bp, Homo sapiens
cagctcactgctgctg

SEQ ID NO: 6002589 - DNA, 22 bp, Homo sapiens
cagctcactgctgctgcctctg

SEQ ID NO: 6002590 - DNA, 14 bp, Homo sapiens
cagctcactgtgac

SEQ ID NO: 6002591 - DNA, 16 bp, Homo sapiens
cagctcactttttcat

SEQ ID NO: 6002592 - DNA, 22 bp, Homo sapiens
cagctcactttttcatagtcat

SEQ ID NO: 6002593 - DNA, 13 bp, Homo sapiens
cagctcagaacca

SEQ ID NO: 6002594 - DNA, 13 bp, Homo sapiens
cagctcagaaccc

SEQ ID NO: 6002595 - DNA, 15 bp, Homo sapiens
cagctcagaacccag

SEQ ID NO: 6002596 - DNA, 18 bp, Homo sapiens
cagctcagaacccagggc

SEQ ID NO: 6002597 - DNA, 21 bp, Homo sapiens
cagctcagaacccagggctct

SEQ ID NO: 6002598 - DNA, 16 bp, Homo sapiens
cagctcagagatgaaa

SEQ ID NO: 6002599 - DNA, 22 bp, Homo sapiens
cagctcagagccccgccccacc

SEQ ID NO: 6002600 - DNA, 12 bp, Homo sapiens
cagctcagcact

SEQ ID NO: 6002601 - DNA, 20 bp, Homo sapiens
cagctcagcagttcacttcc

SEQ ID NO: 6002602 - DNA, 21 bp, Homo sapiens
cagctcagcagttcacttcct

SEQ ID NO: 6002603 - DNA, 23 bp, Homo sapiens
cagctcagcagttcacttcctag

SEQ ID NO: 6002604 - DNA, 22 bp, Homo sapiens
cagctcagccaccactcagtgc

SEQ ID NO: 6002605 - DNA, 20 bp, Homo sapiens
cagctcagccccggccactc

SEQ ID NO: 6002606 - DNA, 14 bp, Homo sapiens
cagctcagccctgg

SEQ ID NO: 6002607 - DNA, 23 bp, Homo sapiens
cagctcagccctggcctggctgg

SEQ ID NO: 6002608 - DNA, 17 bp, Homo sapiens
cagctcagcctcccccc

SEQ ID NO: 6002609 - DNA, 14 bp, Homo sapiens
cagctcagctgccc

SEQ ID NO: 6002610 - DNA, 16 bp, Homo sapiens
cagctcagctgcccat

SEQ ID NO: 6002611 - DNA, 19 bp, Homo sapiens
cagctcagctgcccatccc

SEQ ID NO: 6002612 - DNA, 12 bp, Homo sapiens
cagctcagctgg

SEQ ID NO: 6002613 - DNA, 15 bp, Homo sapiens
cagctcagctgggcc

SEQ ID NO: 6002614 - DNA, 19 bp, Homo sapiens
cagctcaggaattccctgg

SEQ ID NO: 6002615 - DNA, 21 bp, Homo sapiens
cagctcaggcacacttcttct

SEQ ID NO: 6002616 - DNA, 16 bp, Homo sapiens
cagctcaggcagctcg

SEQ ID NO: 6002617 - DNA, 20 bp, Homo sapiens
cagctcaggcgcagccctag

SEQ ID NO: 6002618 - DNA, 14 bp, Homo sapiens
cagctcaggggcag

SEQ ID NO: 6002619 - DNA, 21 bp, Homo sapiens
cagctcaggtgacaaccatta

SEQ ID NO: 6002620 - DNA, 16 bp, Homo sapiens
cagctcaggtgactgg

SEQ ID NO: 6002621 - DNA, 21 bp, Homo sapiens
cagctcagtcccacagcccct

SEQ ID NO: 6002622 - DNA, 20 bp, Homo sapiens
cagctcagtctcagccttgt

SEQ ID NO: 6002623 - DNA, 13 bp, Homo sapiens
cagctcagtgttt

SEQ ID NO: 6002624 - DNA, 15 bp, Homo sapiens
cagctcataaatgaa

SEQ ID NO: 6002625 - DNA, 13 bp, Homo sapiens
cagctcatagaat

SEQ ID NO: 6002626 - DNA, 23 bp, Homo sapiens
cagctcatatgctgacagctctt

SEQ ID NO: 6002627 - DNA, 21 bp, Homo sapiens
cagctcatccatgcctcagaa

SEQ ID NO: 6002628 - DNA, 17 bp, Homo sapiens
cagctcatctccaagga

SEQ ID NO: 6002629 - DNA, 16 bp, Homo sapiens
cagctcatctgccaaa

SEQ ID NO: 6002630 - DNA, 12 bp, Homo sapiens
cagctcatcttc

SEQ ID NO: 6002631 - DNA, 23 bp, Homo sapiens
cagctcatgtaggtgagcctggg

SEQ ID NO: 6002632 - DNA, 14 bp, Homo sapiens
cagctcatgtgtac

SEQ ID NO: 6002633 - DNA, 22 bp, Homo sapiens
cagctcattataatgtcattaa

SEQ ID NO: 6002634 - DNA, 14 bp, Homo sapiens
cagctcattatgaa

SEQ ID NO: 6002635 - DNA, 16 bp, Homo sapiens
cagctcattatgaaaa

SEQ ID NO: 6002636 - DNA, 17 bp, Homo sapiens
cagctcattatgaaaaa

SEQ ID NO: 6002637 - DNA, 18 bp, Homo sapiens
cagctcattatgaaaaac

SEQ ID NO: 6002638 - DNA, 20 bp, Homo sapiens
cagctcattatgaaaaacat

SEQ ID NO: 6002639 - DNA, 21 bp, Homo sapiens
cagctcattatgaaaaacatc

SEQ ID NO: 6002640 - DNA, 13 bp, Homo sapiens
cagctcattcatt

SEQ ID NO: 6002641 - DNA, 18 bp, Homo sapiens
cagctcatttaatcccag

SEQ ID NO: 6002642 - DNA, 20 bp, Homo sapiens
cagctcatttaatcccagga

SEQ ID NO: 6002643 - DNA, 16 bp, Homo sapiens
cagctcatttcagttt

SEQ ID NO: 6002644 - DNA, 17 bp, Homo sapiens
cagctccaacctgcaaa

SEQ ID NO: 6002645 - DNA, 22 bp, Homo sapiens
cagctccaacctggaggctgga

SEQ ID NO: 6002646 - DNA, 20 bp, Homo sapiens
cagctccacacattccagcc

SEQ ID NO: 6002647 - DNA, 22 bp, Homo sapiens
cagctccacacattccagccag

SEQ ID NO: 6002648 - DNA, 13 bp, Homo sapiens
cagctccacacgc

SEQ ID NO: 6002649 - DNA, 14 bp, Homo sapiens
cagctccacacgcc

SEQ ID NO: 6002650 - DNA, 15 bp, Homo sapiens
cagctccacacgccc

SEQ ID NO: 6002651 - DNA, 13 bp, Homo sapiens
cagctccacaggg

SEQ ID NO: 6002652 - DNA, 15 bp, Homo sapiens
cagctccaccactgt

SEQ ID NO: 6002653 - DNA, 20 bp, Homo sapiens
cagctccaccactgtgcact

SEQ ID NO: 6002654 - DNA, 21 bp, Homo sapiens
cagctccaccactgtgcactt

SEQ ID NO: 6002655 - DNA, 13 bp, Homo sapiens
cagctccaccctg

SEQ ID NO: 6002656 - DNA, 15 bp, Homo sapiens
cagctccaccctggc

SEQ ID NO: 6002657 - DNA, 14 bp, Homo sapiens
cagctccactcagg

SEQ ID NO: 6002658 - DNA, 15 bp, Homo sapiens
cagctccactcaggg

SEQ ID NO: 6002659 - DNA, 16 bp, Homo sapiens
cagctccactcagggc

SEQ ID NO: 6002660 - DNA, 17 bp, Homo sapiens
cagctccagcccccggg

SEQ ID NO: 6002661 - DNA, 20 bp, Homo sapiens
cagctccagcccctttccaa

SEQ ID NO: 6002662 - DNA, 17 bp, Homo sapiens
cagctccagctcaccag

SEQ ID NO: 6002663 - DNA, 12 bp, Homo sapiens
cagctccaggca

SEQ ID NO: 6002664 - DNA, 13 bp, Homo sapiens
cagctccaggcag

SEQ ID NO: 6002665 - DNA, 14 bp, Homo sapiens
cagctccagggcca

SEQ ID NO: 6002666 - DNA, 16 bp, Homo sapiens
cagctccaggggccct

SEQ ID NO: 6002667 - DNA, 19 bp, Homo sapiens
cagctccaggggcccttgg

SEQ ID NO: 6002668 - DNA, 21 bp, Homo sapiens
cagctccaggtggctctgagg

SEQ ID NO: 6002669 - DNA, 10 bp, Homo sapiens
cagctccagt

SEQ ID NO: 6002670 - DNA, 16 bp, Homo sapiens
cagctccagtgccgct

SEQ ID NO: 6002671 - DNA, 20 bp, Homo sapiens
cagctcccaacagaggcctc

SEQ ID NO: 6002672 - DNA, 17 bp, Homo sapiens
cagctcccaacgagcct

SEQ ID NO: 6002673 - DNA, 21 bp, Homo sapiens
cagctcccaacgagcctcctc

SEQ ID NO: 6002674 - DNA, 11 bp, Homo sapiens
cagctcccaca

SEQ ID NO: 6002675 - DNA, 17 bp, Homo sapiens
cagctcccacaagcctc

SEQ ID NO: 6002676 - DNA, 14 bp, Homo sapiens
cagctcccacccca

SEQ ID NO: 6002677 - DNA, 22 bp, Homo sapiens
cagctcccaccccacccccttc

SEQ ID NO: 6002678 - DNA, 15 bp, Homo sapiens
cagctcccagggtgg

SEQ ID NO: 6002679 - DNA, 19 bp, Homo sapiens
cagctcccatagcgctggc

SEQ ID NO: 6002680 - DNA, 20 bp, Homo sapiens
cagctcccatttctactctt

SEQ ID NO: 6002681 - DNA, 12 bp, Homo sapiens
cagctccccaag

SEQ ID NO: 6002682 - DNA, 13 bp, Homo sapiens
cagctccccaaga

SEQ ID NO: 6002683 - DNA, 11 bp, Homo sapiens
cagctccccag

SEQ ID NO: 6002684 - DNA, 20 bp, Homo sapiens
cagctccccagcccacctgc

SEQ ID NO: 6002685 - DNA, 12 bp, Homo sapiens
cagctccccagg

SEQ ID NO: 6002686 - DNA, 19 bp, Homo sapiens
cagctccccaggagctcag

SEQ ID NO: 6002687 - DNA, 20 bp, Homo sapiens
cagctccccaggagctcagg

SEQ ID NO: 6002688 - DNA, 13 bp, Homo sapiens
cagctcccccagg

SEQ ID NO: 6002689 - DNA, 16 bp, Homo sapiens
cagctcccccaggctg

SEQ ID NO: 6002690 - DNA, 22 bp, Homo sapiens
cagctcccccgacggtgggcat

SEQ ID NO: 6002691 - DNA, 15 bp, Homo sapiens
cagctccccctccct

SEQ ID NO: 6002692 - DNA, 18 bp, Homo sapiens
cagctccccctccctccc

SEQ ID NO: 6002693 - DNA, 14 bp, Homo sapiens
cagctccccctgtc

SEQ ID NO: 6002694 - DNA, 19 bp, Homo sapiens
cagctccccctgtcccctc

SEQ ID NO: 6002695 - DNA, 21 bp, Homo sapiens
cagctccccctgtcccctcag

SEQ ID NO: 6002696 - DNA, 16 bp, Homo sapiens
cagctccccggcactg

SEQ ID NO: 6002697 - DNA, 14 bp, Homo sapiens
cagctcccctagac

SEQ ID NO: 6002698 - DNA, 12 bp, Homo sapiens
cagctcccctct

SEQ ID NO: 6002699 - DNA, 13 bp, Homo sapiens
cagctcccctctt

SEQ ID NO: 6002700 - DNA, 11 bp, Homo sapiens
cagctccctcc

SEQ ID NO: 6002701 - DNA, 13 bp, Homo sapiens
cagctccctcccc

SEQ ID NO: 6002702 - DNA, 14 bp, Homo sapiens
cagctccctcccct

SEQ ID NO: 6002703 - DNA, 15 bp, Homo sapiens
cagctccctcccctg

SEQ ID NO: 6002704 - DNA, 17 bp, Homo sapiens
cagctccctcccctgct

SEQ ID NO: 6002705 - DNA, 13 bp, Homo sapiens
cagctccctcctc

SEQ ID NO: 6002706 - DNA, 16 bp, Homo sapiens
cagctccctcctcagg

SEQ ID NO: 6002707 - DNA, 16 bp, Homo sapiens
cagctccctctgcctg

SEQ ID NO: 6002708 - DNA, 14 bp, Homo sapiens
cagctccctgaccc

SEQ ID NO: 6002709 - DNA, 22 bp, Homo sapiens
cagctccctgaccccctgtcct

SEQ ID NO: 6002710 - DNA, 11 bp, Homo sapiens
cagctccctgc

SEQ ID NO: 6002711 - DNA, 14 bp, Homo sapiens
cagctccctgccaa

SEQ ID NO: 6002712 - DNA, 19 bp, Homo sapiens
cagctccctgcctgtttcc

SEQ ID NO: 6002713 - DNA, 14 bp, Homo sapiens
cagctccctgtgcc

SEQ ID NO: 6002714 - DNA, 19 bp, Homo sapiens
cagctccctgtgcccccag

SEQ ID NO: 6002715 - DNA, 20 bp, Homo sapiens
cagctccctgtgcccccagg

SEQ ID NO: 6002716 - DNA, 20 bp, Homo sapiens
cagctcccttcccctgcctg

SEQ ID NO: 6002717 - DNA, 15 bp, Homo sapiens
cagctcccttctctg

SEQ ID NO: 6002718 - DNA, 20 bp, Homo sapiens
cagctccctttctcaggagc

SEQ ID NO: 6002719 - DNA, 22 bp, Homo sapiens
cagctccctttctcaggagctt

SEQ ID NO: 6002720 - DNA, 13 bp, Homo sapiens
cagctccgacctc

SEQ ID NO: 6002721 - DNA, 17 bp, Homo sapiens
cagctccgacctctctc

SEQ ID NO: 6002722 - DNA, 21 bp, Homo sapiens
cagctccgagctgtaggagag

SEQ ID NO: 6002723 - DNA, 19 bp, Homo sapiens
cagctccgcctggcaccca

SEQ ID NO: 6002724 - DNA, 22 bp, Homo sapiens
cagctccggagggggtcctcct

SEQ ID NO: 6002725 - DNA, 16 bp, Homo sapiens
cagctccggcctgtcc

SEQ ID NO: 6002726 - DNA, 15 bp, Homo sapiens
cagctccgtcatctg

SEQ ID NO: 6002727 - DNA, 13 bp, Homo sapiens
cagctcctaaccc

SEQ ID NO: 6002728 - DNA, 20 bp, Homo sapiens
cagctcctacctctgtgcca

SEQ ID NO: 6002729 - DNA, 19 bp, Homo sapiens
cagctcctcatccagggct

SEQ ID NO: 6002730 - DNA, 20 bp, Homo sapiens
cacgcccgtcctgcctgtgg

SEQ ID NO: 6002731 - DNA, 18 bp, Homo sapiens
cacgccctactccactgc

SEQ ID NO: 6002732 - DNA, 23 bp, Homo sapiens
cacgccctactccactgccctgg

SEQ ID NO: 6002733 - DNA, 20 bp, Homo sapiens
cacgccctcattacggctcc

SEQ ID NO: 6002734 - DNA, 14 bp, Homo sapiens
cacgccctccctct

SEQ ID NO: 6002735 - DNA, 22 bp, Homo sapiens
cacgccctccctgctagcacag

SEQ ID NO: 6002736 - DNA, 24 bp, Homo sapiens
cacgccctccctgctagcacagag

SEQ ID NO: 6002737 - DNA, 20 bp, Homo sapiens
cacgccctcctccctccgct

SEQ ID NO: 6002738 - DNA, 21 bp, Homo sapiens
cacgccctcctccctccgcta

SEQ ID NO: 6002739 - DNA, 20 bp, Homo sapiens
cacgccctgcctactctttg

SEQ ID NO: 6002740 - DNA, 21 bp, Homo sapiens
cacgcccttcaatgctgcagg

SEQ ID NO: 6002741 - DNA, 20 bp, Homo sapiens
cacgcccttggagccttcca

SEQ ID NO: 6002742 - DNA, 17 bp, Homo sapiens
cacgccgatataagcca

SEQ ID NO: 6002743 - DNA, 19 bp, Homo sapiens
cacgccgatataagccata

SEQ ID NO: 6002744 - DNA, 13 bp, Homo sapiens
cacgccggccaca

SEQ ID NO: 6002745 - DNA, 21 bp, Homo sapiens
cacgccgggaaccaagcagga

SEQ ID NO: 6002746 - DNA, 22 bp, Homo sapiens
cacgccgggagaagccaccttc

SEQ ID NO: 6002747 - DNA, 17 bp, Homo sapiens
cacgcctataatcccag

SEQ ID NO: 6002748 - DNA, 19 bp, Homo sapiens
cacgcctatgatcccagca

SEQ ID NO: 6002749 - DNA, 21 bp, Homo sapiens
cacgcctatgatcccagcact

SEQ ID NO: 6002750 - DNA, 14 bp, Homo sapiens
cacgcctcaccagc

SEQ ID NO: 6002751 - DNA, 11 bp, Homo sapiens
cacgcctccat

SEQ ID NO: 6002752 - DNA, 18 bp, Homo sapiens
cacgcctccatccacaca

SEQ ID NO: 6002753 - DNA, 18 bp, Homo sapiens
cacgcctcccactggggt

SEQ ID NO: 6002754 - DNA, 16 bp, Homo sapiens
cacgcctcctggccag

SEQ ID NO: 6002755 - DNA, 18 bp, Homo sapiens
cacgcctcctggccagac

SEQ ID NO: 6002756 - DNA, 15 bp, Homo sapiens
cacgcctctccccac

SEQ ID NO: 6002757 - DNA, 19 bp, Homo sapiens
cacgcctctccccaccttc

SEQ ID NO: 6002758 - DNA, 12 bp, Homo sapiens
cacgcctgaaac

SEQ ID NO: 6002759 - DNA, 14 bp, Homo sapiens
cacgcctgcccagc

SEQ ID NO: 6002760 - DNA, 17 bp, Homo sapiens
cacgcctgcccagcctc

SEQ ID NO: 6002761 - DNA, 13 bp, Homo sapiens
cacgcctggaagg

SEQ ID NO: 6002762 - DNA, 17 bp, Homo sapiens
cacgcctgtaatcccag

SEQ ID NO: 6002763 - DNA, 19 bp, Homo sapiens
cacgcctgtaatcctagca

SEQ ID NO: 6002764 - DNA, 20 bp, Homo sapiens
cacgcctgtaatcctagcac

SEQ ID NO: 6002765 - DNA, 14 bp, Homo sapiens
cacgccttcatgcc

SEQ ID NO: 6002766 - DNA, 15 bp, Homo sapiens
cacgccttcatgcca

SEQ ID NO: 6002767 - DNA, 19 bp, Homo sapiens
cacgcgcccccctcccaga

SEQ ID NO: 6002768 - DNA, 21 bp, Homo sapiens
cacgcgcccccctcccagagg

SEQ ID NO: 6002769 - DNA, 15 bp, Homo sapiens
cacgcgcgcacacac

SEQ ID NO: 6002770 - DNA, 20 bp, Homo sapiens
cacgcggatgctactactgc

SEQ ID NO: 6002771 - DNA, 18 bp, Homo sapiens
cacgcggcagcacctctg

SEQ ID NO: 6002772 - DNA, 15 bp, Homo sapiens
cacgcgtgcacacac

SEQ ID NO: 6002773 - DNA, 23 bp, Homo sapiens
cacgcgtgcacacaccagagccc

SEQ ID NO: 6002774 - DNA, 16 bp, Homo sapiens
cacgcgttctgggagc

SEQ ID NO: 6002775 - DNA, 16 bp, Homo sapiens
cacgctagggctggct

SEQ ID NO: 6002776 - DNA, 22 bp, Homo sapiens
cacgctcaatgcccagtaaaat

SEQ ID NO: 6002777 - DNA, 21 bp, Homo sapiens
cacgctcatgtcctgtcctgg

SEQ ID NO: 6002778 - DNA, 19 bp, Homo sapiens
cacgctccagctgccccgg

SEQ ID NO: 6002779 - DNA, 15 bp, Homo sapiens
cacgctccccgcctg

SEQ ID NO: 6002780 - DNA, 16 bp, Homo sapiens
cacgctccccgcctgt

SEQ ID NO: 6002781 - DNA, 18 bp, Homo sapiens
cacgctccccgcctgttc

SEQ ID NO: 6002782 - DNA, 20 bp, Homo sapiens
cacgctccccgcctgttccc

SEQ ID NO: 6002783 - DNA, 14 bp, Homo sapiens
cacgctcccctcca

SEQ ID NO: 6002784 - DNA, 17 bp, Homo sapiens
cacgctcctctgttcag

SEQ ID NO: 6002785 - DNA, 12 bp, Homo sapiens
cacgctcctgcc

SEQ ID NO: 6002786 - DNA, 14 bp, Homo sapiens
cacgctccttcctc

SEQ ID NO: 6002787 - DNA, 15 bp, Homo sapiens
cacgctcctttctga

SEQ ID NO: 6002788 - DNA, 22 bp, Homo sapiens
cacgctcgcgggcagcgggcca

SEQ ID NO: 6002789 - DNA, 18 bp, Homo sapiens
cacgctcgctgccatcac

SEQ ID NO: 6002790 - DNA, 19 bp, Homo sapiens
cacgctctctccaggcagg

SEQ ID NO: 6002791 - DNA, 14 bp, Homo sapiens
cacgctctggacat

SEQ ID NO: 6002792 - DNA, 15 bp, Homo sapiens
cacgctctggtgcag

SEQ ID NO: 6002793 - DNA, 22 bp, Homo sapiens
cacgctcttgaggaagcccagg

SEQ ID NO: 6002794 - DNA, 23 bp, Homo sapiens
cacgctcttgaggaagcccaggc

SEQ ID NO: 6002795 - DNA, 14 bp, Homo sapiens
cacgctgacagcct

SEQ ID NO: 6002796 - DNA, 15 bp, Homo sapiens
cacgctgacagcctc

SEQ ID NO: 6002797 - DNA, 20 bp, Homo sapiens
cacgctgacagcctcctagg

SEQ ID NO: 6002798 - DNA, 18 bp, Homo sapiens
cacgctgcccaggctctg

SEQ ID NO: 6002799 - DNA, 19 bp, Homo sapiens
cacgctgcccaggctctgc

SEQ ID NO: 6002800 - DNA, 17 bp, Homo sapiens
cacgctgcccaggggct

SEQ ID NO: 6002801 - DNA, 15 bp, Homo sapiens
cacgctgcctgccaa

SEQ ID NO: 6002802 - DNA, 15 bp, Homo sapiens
cacgctgcctggtct

SEQ ID NO: 6002803 - DNA, 16 bp, Homo sapiens
cacgctggagctgtgt

SEQ ID NO: 6002804 - DNA, 16 bp, Homo sapiens
cacgctggagtgcagt

SEQ ID NO: 6002805 - DNA, 19 bp, Homo sapiens
cacgctggggaagaattta

SEQ ID NO: 6002806 - DNA, 18 bp, Homo sapiens
cacgctgggtcctaatta

SEQ ID NO: 6002807 - DNA, 13 bp, Homo sapiens
cacgctgtcctct

SEQ ID NO: 6002808 - DNA, 18 bp, Homo sapiens
cacgctgtcctctcgagc

SEQ ID NO: 6002809 - DNA, 13 bp, Homo sapiens
cacgctgtctcca

SEQ ID NO: 6002810 - DNA, 15 bp, Homo sapiens
cacgctgtctccaga

SEQ ID NO: 6002811 - DNA, 19 bp, Homo sapiens
cacgctgtctccagacccc

SEQ ID NO: 6002812 - DNA, 18 bp, Homo sapiens
cacgctgtgggcaggtgg

SEQ ID NO: 6002813 - DNA, 13 bp, Homo sapiens
cacgctgttctaa

SEQ ID NO: 6002814 - DNA, 23 bp, Homo sapiens
cacgctgttgacatcagcctgct

SEQ ID NO: 6002815 - DNA, 14 bp, Homo sapiens
cacgcttctgagca

SEQ ID NO: 6002816 - DNA, 22 bp, Homo sapiens
cacgcttgacaggacagcatgg

SEQ ID NO: 6002817 - DNA, 17 bp, Homo sapiens
cacgctttctagctgtt

SEQ ID NO: 6002818 - DNA, 15 bp, Homo sapiens
cacgctttgctgcta

SEQ ID NO: 6002819 - DNA, 14 bp, Homo sapiens
cacgctttttgact

SEQ ID NO: 6002820 - DNA, 13 bp, Homo sapiens
cacggaaacagaa

SEQ ID NO: 6002821 - DNA, 24 bp, Homo sapiens
cacggaaacatacagaggatgcct

SEQ ID NO: 6002822 - DNA, 21 bp, Homo sapiens
cacggaaccgtagactaggaa

SEQ ID NO: 6002823 - DNA, 22 bp, Homo sapiens
cacggaagagccttgcggaagg

SEQ ID NO: 6002824 - DNA, 17 bp, Homo sapiens
cacggaaggcgggctga

SEQ ID NO: 6002825 - DNA, 21 bp, Homo sapiens
cacggaaggcgggctgaggag

SEQ ID NO: 6002826 - DNA, 14 bp, Homo sapiens
cacggaagttttca

SEQ ID NO: 6002827 - DNA, 14 bp, Homo sapiens
cacggaatggggaa

SEQ ID NO: 6002828 - DNA, 15 bp, Homo sapiens
cacggacaggaagca

SEQ ID NO: 6002829 - DNA, 19 bp, Homo sapiens
cacggacaggaagcacagc

SEQ ID NO: 6002830 - DNA, 20 bp, Homo sapiens
cacggaccaaagggagtctg

SEQ ID NO: 6002831 - DNA, 21 bp, Homo sapiens
cacggaccaaagggagtctgc

SEQ ID NO: 6002832 - DNA, 21 bp, Homo sapiens
cacggacccattcatactaaa

SEQ ID NO: 6002833 - DNA, 13 bp, Homo sapiens
cacggaccctgtg

SEQ ID NO: 6002834 - DNA, 19 bp, Homo sapiens
cacggaccgcatcctccag

SEQ ID NO: 6002835 - DNA, 19 bp, Homo sapiens
cacggacgctggctcccca

SEQ ID NO: 6002836 - DNA, 18 bp, Homo sapiens
cacggacgtttccatcag

SEQ ID NO: 6002837 - DNA, 14 bp, Homo sapiens
cacggactcccggg

SEQ ID NO: 6002838 - DNA, 17 bp, Homo sapiens
cacggactgaggtgcct

SEQ ID NO: 6002839 - DNA, 18 bp, Homo sapiens
cacggactgaggtgcctg

SEQ ID NO: 6002840 - DNA, 13 bp, Homo sapiens
cacggagacagag

SEQ ID NO: 6002841 - DNA, 17 bp, Homo sapiens
cacggagacagaggaaa

SEQ ID NO: 6002842 - DNA, 22 bp, Homo sapiens
cacggagagaaggcccatacct

SEQ ID NO: 6002843 - DNA, 20 bp, Homo sapiens
cacggagatatgaagagcaa

SEQ ID NO: 6002844 - DNA, 17 bp, Homo sapiens
cacggagccactcctct

SEQ ID NO: 6002845 - DNA, 19 bp, Homo sapiens
cacggagccactcctctga

SEQ ID NO: 6002846 - DNA, 13 bp, Homo sapiens
cacggagccctcc

SEQ ID NO: 6002847 - DNA, 20 bp, Homo sapiens
cacggaggagggatgctgct

SEQ ID NO: 6002848 - DNA, 23 bp, Homo sapiens
cacggaggcatcctacccttttc

SEQ ID NO: 6002849 - DNA, 19 bp, Homo sapiens
cacggaggcctcgagcaga

SEQ ID NO: 6002850 - DNA, 22 bp, Homo sapiens
cacggaggcctcgagcagagag

SEQ ID NO: 6002851 - DNA, 14 bp, Homo sapiens
cacggagggaggca

SEQ ID NO: 6002852 - DNA, 15 bp, Homo sapiens
cacggagggaggcac

SEQ ID NO: 6002853 - DNA, 18 bp, Homo sapiens
cacggagggaggcaccat

SEQ ID NO: 6002854 - DNA, 20 bp, Homo sapiens
cacggagggtgacgggggtg

SEQ ID NO: 6002855 - DNA, 20 bp, Homo sapiens
cacggagtttccatttggat

SEQ ID NO: 6002856 - DNA, 20 bp, Homo sapiens
cacggatccatgtagcagga

SEQ ID NO: 6002857 - DNA, 18 bp, Homo sapiens
cacggatctgagaatctt

SEQ ID NO: 6002858 - DNA, 17 bp, Homo sapiens
cacggatgcgtgggcag

SEQ ID NO: 6002859 - DNA, 20 bp, Homo sapiens
cacggatgcgtgggcagagg

SEQ ID NO: 6002860 - DNA, 15 bp, Homo sapiens
cacggcaacccctgc

SEQ ID NO: 6002861 - DNA, 17 bp, Homo sapiens
cacggcaacccctgcag

SEQ ID NO: 6002862 - DNA, 11 bp, Homo sapiens
cacggcacaga

SEQ ID NO: 6002863 - DNA, 21 bp, Homo sapiens
cacggcacctgggccctgggg

SEQ ID NO: 6002864 - DNA, 22 bp, Homo sapiens
cacggcacctgggccctggggc

SEQ ID NO: 6002865 - DNA, 13 bp, Homo sapiens
cacggcagccacc

SEQ ID NO: 6002866 - DNA, 15 bp, Homo sapiens
cacggcagccaccct

SEQ ID NO: 6002867 - DNA, 17 bp, Homo sapiens
cacggcagccaccctgc

SEQ ID NO: 6002868 - DNA, 23 bp, Homo sapiens
cacggcatcgcatccgtcctggg

SEQ ID NO: 6002869 - DNA, 13 bp, Homo sapiens
cacggcattatga

SEQ ID NO: 6002870 - DNA, 15 bp, Homo sapiens
cacggccaacaaagc

SEQ ID NO: 6002871 - DNA, 17 bp, Homo sapiens
cacggccacacagctgc

SEQ ID NO: 6002872 - DNA, 13 bp, Homo sapiens
cacggccacccac

SEQ ID NO: 6002873 - DNA, 14 bp, Homo sapiens
cacggccacgtcat

SEQ ID NO: 6002874 - DNA, 14 bp, Homo sapiens
cacggccactgcag

SEQ ID NO: 6002875 - DNA, 22 bp, Homo sapiens
cacggccagctgcatctactca

SEQ ID NO: 6002876 - DNA, 13 bp, Homo sapiens
cacggccaggcag

SEQ ID NO: 6002877 - DNA, 14 bp, Homo sapiens
cacggccaggcaga

SEQ ID NO: 6002878 - DNA, 12 bp, Homo sapiens
cacggccaggcc

SEQ ID NO: 6002879 - DNA, 15 bp, Homo sapiens
cacggccaggccaga

SEQ ID NO: 6002880 - DNA, 18 bp, Homo sapiens
cacggccatgagggctgg

SEQ ID NO: 6002881 - DNA, 17 bp, Homo sapiens
cacggcccagggagggt

SEQ ID NO: 6002882 - DNA, 16 bp, Homo sapiens
cacggcccggcccctc

SEQ ID NO: 6002883 - DNA, 17 bp, Homo sapiens
cacggcccggcccctca

SEQ ID NO: 6002884 - DNA, 13 bp, Homo sapiens
cacggccctcctg

SEQ ID NO: 6002885 - DNA, 22 bp, Homo sapiens
cacggccctcctgggaacctcc

SEQ ID NO: 6002886 - DNA, 21 bp, Homo sapiens
cacggccctccttcttttcct

SEQ ID NO: 6002887 - DNA, 13 bp, Homo sapiens
cacggccctgccc

SEQ ID NO: 6002888 - DNA, 15 bp, Homo sapiens
cacggccctgcccca

SEQ ID NO: 6002889 - DNA, 16 bp, Homo sapiens
cacggccctgccccat

SEQ ID NO: 6002890 - DNA, 17 bp, Homo sapiens
cacggccctgccccatc

SEQ ID NO: 6002891 - DNA, 16 bp, Homo sapiens
cacggccgctccaggg

SEQ ID NO: 6002892 - DNA, 23 bp, Homo sapiens
cacggccgtccctgacttcccag

SEQ ID NO: 6002893 - DNA, 14 bp, Homo sapiens
cacggcctcctttc

SEQ ID NO: 6002894 - DNA, 23 bp, Homo sapiens
cacggcctgcccagtcgacccca

SEQ ID NO: 6002895 - DNA, 13 bp, Homo sapiens
cacggcctggcat

SEQ ID NO: 6002896 - DNA, 15 bp, Homo sapiens
cacggcctggcatgc

SEQ ID NO: 6002897 - DNA, 16 bp, Homo sapiens
cacggcctggctggtg

SEQ ID NO: 6002898 - DNA, 13 bp, Homo sapiens
cacggcctgggag

SEQ ID NO: 6002899 - DNA, 12 bp, Homo sapiens
cacggcctttct

SEQ ID NO: 6002900 - DNA, 20 bp, Homo sapiens
cacggcctttctagcctggc

SEQ ID NO: 6002901 - DNA, 22 bp, Homo sapiens
cacggcgggatcctccacagag

SEQ ID NO: 6002902 - DNA, 15 bp, Homo sapiens
cacggcgttgtacct

SEQ ID NO: 6002903 - DNA, 16 bp, Homo sapiens
cacggctaagaggctg

SEQ ID NO: 6002904 - DNA, 14 bp, Homo sapiens
cacggctcactgca

SEQ ID NO: 6002905 - DNA, 17 bp, Homo sapiens
cacggctcactgcagcc

SEQ ID NO: 6002906 - DNA, 14 bp, Homo sapiens
cacggctcccccag

SEQ ID NO: 6002907 - DNA, 16 bp, Homo sapiens
cacggctcccccaggc

SEQ ID NO: 6002908 - DNA, 20 bp, Homo sapiens
cacggctcctcgagatccca

SEQ ID NO: 6002909 - DNA, 20 bp, Homo sapiens
cagctcctccatgcctgacc

SEQ ID NO: 6002910 - DNA, 13 bp, Homo sapiens
cagctcctcccct

SEQ ID NO: 6002911 - DNA, 15 bp, Homo sapiens
cagctcctcccctgc

SEQ ID NO: 6002912 - DNA, 17 bp, Homo sapiens
cagctcctcccctgccg

SEQ ID NO: 6002913 - DNA, 19 bp, Homo sapiens
cagctcctcccctgccgcc

SEQ ID NO: 6002914 - DNA, 23 bp, Homo sapiens
cagctcctcccctgccgcctccc

SEQ ID NO: 6002915 - DNA, 18 bp, Homo sapiens
cagctcctccctgtgccc

SEQ ID NO: 6002916 - DNA, 21 bp, Homo sapiens
cagctcctccctgtgccccca

SEQ ID NO: 6002917 - DNA, 19 bp, Homo sapiens
cagctcctccgtgcttcct

SEQ ID NO: 6002918 - DNA, 22 bp, Homo sapiens
cagctcctccgtgcttcctcag

SEQ ID NO: 6002919 - DNA, 20 bp, Homo sapiens
cagctcctcgggtggggcct

SEQ ID NO: 6002920 - DNA, 14 bp, Homo sapiens
cagctcctctaggg

SEQ ID NO: 6002921 - DNA, 18 bp, Homo sapiens
cagctcctctaggggcag

SEQ ID NO: 6002922 - DNA, 19 bp, Homo sapiens
cagctcctctaggggcagc

SEQ ID NO: 6002923 - DNA, 18 bp, Homo sapiens
cagctcctctccagacac

SEQ ID NO: 6002924 - DNA, 14 bp, Homo sapiens
cagctcctctcctt

SEQ ID NO: 6002925 - DNA, 18 bp, Homo sapiens
cagctcctctccttgggc

SEQ ID NO: 6002926 - DNA, 19 bp, Homo sapiens
cagctcctctccttgggct

SEQ ID NO: 6002927 - DNA, 13 bp, Homo sapiens
cagctcctctctg

SEQ ID NO: 6002928 - DNA, 12 bp, Homo sapiens
cagctcctctga

SEQ ID NO: 6002929 - DNA, 15 bp, Homo sapiens
cagctcctctgagcc

SEQ ID NO: 6002930 - DNA, 15 bp, Homo sapiens
cagctcctctgtctc

SEQ ID NO: 6002931 - DNA, 10 bp, Homo sapiens
cagctcctga

SEQ ID NO: 6002932 - DNA, 13 bp, Homo sapiens
cagctcctgaata

SEQ ID NO: 6002933 - DNA, 14 bp, Homo sapiens
cagctcctgaccaa

SEQ ID NO: 6002934 - DNA, 20 bp, Homo sapiens
cagctcctgaccagttgcag

SEQ ID NO: 6002935 - DNA, 13 bp, Homo sapiens
cagctcctgacct

SEQ ID NO: 6002936 - DNA, 17 bp, Homo sapiens
cagctcctgaccttggg

SEQ ID NO: 6002937 - DNA, 13 bp, Homo sapiens
cagctcctgccag

SEQ ID NO: 6002938 - DNA, 15 bp, Homo sapiens
cagctcctggaccag

SEQ ID NO: 6002939 - DNA, 17 bp, Homo sapiens
cagctcctgggcagctt

SEQ ID NO: 6002940 - DNA, 19 bp, Homo sapiens
cagctcctgggcagcttga

SEQ ID NO: 6002941 - DNA, 13 bp, Homo sapiens
cagctcctgtttg

SEQ ID NO: 6002942 - DNA, 12 bp, Homo sapiens
cagctccttccc

SEQ ID NO: 6002943 - DNA, 12 bp, Homo sapiens
cagctccttggc

SEQ ID NO: 6002944 - DNA, 22 bp, Homo sapiens
cagctccttgggaggaagcaga

SEQ ID NO: 6002945 - DNA, 23 bp, Homo sapiens
cagctccttggggcagggcctgg

SEQ ID NO: 6002946 - DNA, 16 bp, Homo sapiens
cagctcctttcccttt

SEQ ID NO: 6002947 - DNA, 21 bp, Homo sapiens
cagctcctttcccttttccat

SEQ ID NO: 6002948 - DNA, 18 bp, Homo sapiens
cagctcctttctcctgtg

SEQ ID NO: 6002949 - DNA, 17 bp, Homo sapiens
cagctccttttccgttc

SEQ ID NO: 6002950 - DNA, 16 bp, Homo sapiens
cagctccttttctgtg

SEQ ID NO: 6002951 - DNA, 21 bp, Homo sapiens
cagctccttttgtccccaggg

SEQ ID NO: 6002952 - DNA, 22 bp, Homo sapiens
cagctcgagcatgccctgagct

SEQ ID NO: 6002953 - DNA, 13 bp, Homo sapiens
cagctcgaggccc

SEQ ID NO: 6002954 - DNA, 19 bp, Homo sapiens
cagctcgcacccccctgtt

SEQ ID NO: 6002955 - DNA, 16 bp, Homo sapiens
cagctcgctgcccagg

SEQ ID NO: 6002956 - DNA, 15 bp, Homo sapiens
cagctcggctcagct

SEQ ID NO: 6002957 - DNA, 15 bp, Homo sapiens
cagctcgtgggctgg

SEQ ID NO: 6002958 - DNA, 22 bp, Homo sapiens
cagctcgtttttcagcaccccc

SEQ ID NO: 6002959 - DNA, 22 bp, Homo sapiens
cagctctaaaacatagactgaa

SEQ ID NO: 6002960 - DNA, 12 bp, Homo sapiens
cagctctaaagc

SEQ ID NO: 6002961 - DNA, 18 bp, Homo sapiens
cagctctaagcagccagg

SEQ ID NO: 6002962 - DNA, 16 bp, Homo sapiens
cagctctacattctgc

SEQ ID NO: 6002963 - DNA, 21 bp, Homo sapiens
cagctctacattctgctctgc

SEQ ID NO: 6002964 - DNA, 20 bp, Homo sapiens
cagctctagacaaccctgca

SEQ ID NO: 6002965 - DNA, 16 bp, Homo sapiens
cagctctagcctctgg

SEQ ID NO: 6002966 - DNA, 19 bp, Homo sapiens
cagctctagcctctggact

SEQ ID NO: 6002967 - DNA, 17 bp, Homo sapiens
cagctctaggctgttct

SEQ ID NO: 6002968 - DNA, 18 bp, Homo sapiens
cagctctaggctgttctg

SEQ ID NO: 6002969 - DNA, 18 bp, Homo sapiens
cagctctaggcttcaggc

SEQ ID NO: 6002970 - DNA, 14 bp, Homo sapiens
cagctctatgtcaa

SEQ ID NO: 6002971 - DNA, 22 bp, Homo sapiens
cagctctatgtgggaaaaaaga

SEQ ID NO: 6002972 - DNA, 19 bp, Homo sapiens
cagctctcatgctgcccct

SEQ ID NO: 6002973 - DNA, 23 bp, Homo sapiens
cagctctcatgctgcccctgcct

SEQ ID NO: 6002974 - DNA, 17 bp, Homo sapiens
cagctctcccatggagc

SEQ ID NO: 6002975 - DNA, 19 bp, Homo sapiens
cagctctcccatggagccc

SEQ ID NO: 6002976 - DNA, 14 bp, Homo sapiens
cagctctccccagg

SEQ ID NO: 6002977 - DNA, 21 bp, Homo sapiens
cagctctcccctgcgcaggcc

SEQ ID NO: 6002978 - DNA, 12 bp, Homo sapiens
cagctctccctc

SEQ ID NO: 6002979 - DNA, 17 bp, Homo sapiens
cagctctccctctggcc

SEQ ID NO: 6002980 - DNA, 19 bp, Homo sapiens
cagctctccctctggccct

SEQ ID NO: 6002981 - DNA, 23 bp, Homo sapiens
cagctctccctctggccctgcct

SEQ ID NO: 6002982 - DNA, 18 bp, Homo sapiens
cagctctccgccaatttc

SEQ ID NO: 6002983 - DNA, 21 bp, Homo sapiens
cagctctcctccagccctggg

SEQ ID NO: 6002984 - DNA, 17 bp, Homo sapiens
cagctctctctcctgga

SEQ ID NO: 6002985 - DNA, 17 bp, Homo sapiens
cagctctctgccctgtg

SEQ ID NO: 6002986 - DNA, 16 bp, Homo sapiens
cagctctctgtataaa

SEQ ID NO: 6002987 - DNA, 18 bp, Homo sapiens
cagctctctgtataaaca

SEQ ID NO: 6002988 - DNA, 20 bp, Homo sapiens
cagctctgacattctgattc

SEQ ID NO: 6002989 - DNA, 21 bp, Homo sapiens
cagctctgacattctgattcg

SEQ ID NO: 6002990 - DNA, 15 bp, Homo sapiens
cagctctgaccctga

SEQ ID NO: 6002991 - DNA, 11 bp, Homo sapiens
cagctctgact

SEQ ID NO: 6002992 - DNA, 13 bp, Homo sapiens
cagctctgagaca

SEQ ID NO: 6002993 - DNA, 23 bp, Homo sapiens
cagctctgagacccttttctcag

SEQ ID NO: 6002994 - DNA, 13 bp, Homo sapiens
cagctctgagatc

SEQ ID NO: 6002995 - DNA, 20 bp, Homo sapiens
cagctctgagcagacagggc

SEQ ID NO: 6002996 - DNA, 14 bp, Homo sapiens
cagctctgagccag

SEQ ID NO: 6002997 - DNA, 16 bp, Homo sapiens
cagctctgagccagat

SEQ ID NO: 6002998 - DNA, 14 bp, Homo sapiens
cagctctgagggga

SEQ ID NO: 6002999 - DNA, 17 bp, Homo sapiens
cagctctgaggggaggg

SEQ ID NO: 6003000 - DNA, 20 bp, Homo sapiens
cagctctgcatactcattag

SEQ ID NO: 6003001 - DNA, 12 bp, Homo sapiens
cagctctgcccc

SEQ ID NO: 6003002 - DNA, 13 bp, Homo sapiens
cagctctgccccc

SEQ ID NO: 6003003 - DNA, 14 bp, Homo sapiens
cagctctgcccccg

SEQ ID NO: 6003004 - DNA, 20 bp, Homo sapiens
cagctctgcccccgcgggtt

SEQ ID NO: 6003005 - DNA, 12 bp, Homo sapiens
cagctctgcctt

SEQ ID NO: 6003006 - DNA, 19 bp, Homo sapiens
cagctctgccttgcactgt

SEQ ID NO: 6003007 - DNA, 13 bp, Homo sapiens
cagctctgctgga

SEQ ID NO: 6003008 - DNA, 15 bp, Homo sapiens
cagctctgctggaag

SEQ ID NO: 6003009 - DNA, 16 bp, Homo sapiens
cagctctgctggaaga

SEQ ID NO: 6003010 - DNA, 22 bp, Homo sapiens
cagctctgcttgccgaaactgg

SEQ ID NO: 6003011 - DNA, 23 bp, Homo sapiens
cagctctgcttgccgaaactgga

SEQ ID NO: 6003012 - DNA, 21 bp, Homo sapiens
cagctctggacagccccaccc

SEQ ID NO: 6003013 - DNA, 23 bp, Homo sapiens
cagctctggacagccccaccctg

SEQ ID NO: 6003014 - DNA, 16 bp, Homo sapiens
cagctctggagaacag

SEQ ID NO: 6003015 - DNA, 17 bp, Homo sapiens
cagctctggagaacagt

SEQ ID NO: 6003016 - DNA, 18 bp, Homo sapiens
cagctctggaggggaggg

SEQ ID NO: 6003017 - DNA, 16 bp, Homo sapiens
cagctctggagggggt

SEQ ID NO: 6003018 - DNA, 16 bp, Homo sapiens
cagctctggatgaagg

SEQ ID NO: 6003019 - DNA, 14 bp, Homo sapiens
cagctctggcatgg

SEQ ID NO: 6003020 - DNA, 12 bp, Homo sapiens
cagctctggctc

SEQ ID NO: 6003021 - DNA, 19 bp, Homo sapiens
cagctctggctcagggccc

SEQ ID NO: 6003022 - DNA, 16 bp, Homo sapiens
cagctctggctctgcc

SEQ ID NO: 6003023 - DNA, 17 bp, Homo sapiens
cagctctgggaactgaa

SEQ ID NO: 6003024 - DNA, 12 bp, Homo sapiens
cagctctgggcc

SEQ ID NO: 6003025 - DNA, 22 bp, Homo sapiens
cagctctgggccattctccaca

SEQ ID NO: 6003026 - DNA, 13 bp, Homo sapiens
cagctctgggcct

SEQ ID NO: 6003027 - DNA, 14 bp, Homo sapiens
cagctctgggcctc

SEQ ID NO: 6003028 - DNA, 16 bp, Homo sapiens
cagctctgggcctctt

SEQ ID NO: 6003029 - DNA, 15 bp, Homo sapiens
cagctctggggcaga

SEQ ID NO: 6003030 - DNA, 18 bp, Homo sapiens
cagctctggggcagagga

SEQ ID NO: 6003031 - DNA, 20 bp, Homo sapiens
cagctctggggcagaggaag

SEQ ID NO: 6003032 - DNA, 22 bp, Homo sapiens
cagctctggggcagaggaagcc

SEQ ID NO: 6003033 - DNA, 23 bp, Homo sapiens
cagctctgggggactccttcctt

SEQ ID NO: 6003034 - DNA, 13 bp, Homo sapiens
cagctctggtcca

SEQ ID NO: 6003035 - DNA, 17 bp, Homo sapiens
cagctctggtccataga

SEQ ID NO: 6003036 - DNA, 23 bp, Homo sapiens
cagctctggtccatagagagcaa

SEQ ID NO: 6003037 - DNA, 19 bp, Homo sapiens
cagctctgtcaccctggcc

SEQ ID NO: 6003038 - DNA, 17 bp, Homo sapiens
cagctctgtcctcttgg

SEQ ID NO: 6003039 - DNA, 14 bp, Homo sapiens
cagctctgtctgct

SEQ ID NO: 6003040 - DNA, 19 bp, Homo sapiens
cagctctgtctgctcaatg

SEQ ID NO: 6003041 - DNA, 16 bp, Homo sapiens
cagctctgtggcctgt

SEQ ID NO: 6003042 - DNA, 19 bp, Homo sapiens
cagctctgtggcctgtgtc

SEQ ID NO: 6003043 - DNA, 23 bp, Homo sapiens
cagctctgtggcctgtgtccagc

SEQ ID NO: 6003044 - DNA, 14 bp, Homo sapiens
cagctctgtgggcc

SEQ ID NO: 6003045 - DNA, 22 bp, Homo sapiens
cagctctgttcttcctcagcca

SEQ ID NO: 6003046 - DNA, 14 bp, Homo sapiens
cagctctgttgaat

SEQ ID NO: 6003047 - DNA, 20 bp, Homo sapiens
cagctcttaaaaagacactt

SEQ ID NO: 6003048 - DNA, 10 bp, Homo sapiens
cagctcttat

SEQ ID NO: 6003049 - DNA, 21 bp, Homo sapiens
cagctcttatattgccatttc

SEQ ID NO: 6003050 - DNA, 16 bp, Homo sapiens
cagctcttcactcagc

SEQ ID NO: 6003051 - DNA, 17 bp, Homo sapiens
cagctcttcactcagcc

SEQ ID NO: 6003052 - DNA, 23 bp, Homo sapiens
cagctcttcactcagccacaccc

SEQ ID NO: 6003053 - DNA, 12 bp, Homo sapiens
cagctcttcatt

SEQ ID NO: 6003054 - DNA, 12 bp, Homo sapiens
cagctcttcctg

SEQ ID NO: 6003055 - DNA, 23 bp, Homo sapiens
cagctcttcctggacaggccagg

SEQ ID NO: 6003056 - DNA, 13 bp, Homo sapiens
cagctcttctcca

SEQ ID NO: 6003057 - DNA, 15 bp, Homo sapiens
cagctcttctccagg

SEQ ID NO: 6003058 - DNA, 18 bp, Homo sapiens
cagctcttctccccaggt

SEQ ID NO: 6003059 - DNA, 17 bp, Homo sapiens
cagctcttctcttccta

SEQ ID NO: 6003060 - DNA, 23 bp, Homo sapiens
cagctcttctgccggccctgggg

SEQ ID NO: 6003061 - DNA, 12 bp, Homo sapiens
cagctcttctgg

SEQ ID NO: 6003062 - DNA, 14 bp, Homo sapiens
cagctcttctggag

SEQ ID NO: 6003063 - DNA, 17 bp, Homo sapiens
cagctcttctgggcaga

SEQ ID NO: 6003064 - DNA, 20 bp, Homo sapiens
cagctcttgatttgggtgga

SEQ ID NO: 6003065 - DNA, 16 bp, Homo sapiens
cagctcttgcccttcc

SEQ ID NO: 6003066 - DNA, 19 bp, Homo sapiens
cagctcttgcccttccctg

SEQ ID NO: 6003067 - DNA, 21 bp, Homo sapiens
cagctcttgcccttccctgtc

SEQ ID NO: 6003068 - DNA, 23 bp, Homo sapiens
cagctcttgcccttccctgtccc

SEQ ID NO: 6003069 - DNA, 23 bp, Homo sapiens
cagctcttgctaatcagtgtctc

SEQ ID NO: 6003070 - DNA, 19 bp, Homo sapiens
cagctcttggcattttcct

SEQ ID NO: 6003071 - DNA, 22 bp, Homo sapiens
cagctcttggcccctgtgtgag

SEQ ID NO: 6003072 - DNA, 16 bp, Homo sapiens
cagctcttggtgggcc

SEQ ID NO: 6003073 - DNA, 21 bp, Homo sapiens
cagctcttggtgggcccaggg

SEQ ID NO: 6003074 - DNA, 23 bp, Homo sapiens
cagctcttggtgggcccagggac

SEQ ID NO: 6003075 - DNA, 11 bp, Homo sapiens
cagctcttgtt

SEQ ID NO: 6003076 - DNA, 15 bp, Homo sapiens
cagctctttccaaat

SEQ ID NO: 6003077 - DNA, 18 bp, Homo sapiens
cagctctttccaaattaa

SEQ ID NO: 6003078 - DNA, 23 bp, Homo sapiens
cagctctttccaaattaaaacaa

SEQ ID NO: 6003079 - DNA, 21 bp, Homo sapiens
cagctctttggtgccagctgt

SEQ ID NO: 6003080 - DNA, 14 bp, Homo sapiens
cagctgaaaacccg

SEQ ID NO: 6003081 - DNA, 17 bp, Homo sapiens
cagctgaaagaggagga

SEQ ID NO: 6003082 - DNA, 19 bp, Homo sapiens
cagctgaaatatgctggct

SEQ ID NO: 6003083 - DNA, 21 bp, Homo sapiens
cagctgaaatatgctggctgg

SEQ ID NO: 6003084 - DNA, 22 bp, Homo sapiens
cagctgaaattcaccaagaaca

SEQ ID NO: 6003085 - DNA, 16 bp, Homo sapiens
cagctgaaattgaaaa

SEQ ID NO: 6003086 - DNA, 17 bp, Homo sapiens
cagctgaacacaagcaa

SEQ ID NO: 6003087 - DNA, 21 bp, Homo sapiens
cagctgaagccagctccctga

SEQ ID NO: 6003088 - DNA, 14 bp, Homo sapiens
cacggctctggggt

SEQ ID NO: 6003089 - DNA, 17 bp, Homo sapiens
cacggctctgtccccag

SEQ ID NO: 6003090 - DNA, 18 bp, Homo sapiens
cacggctctgtccccagc

SEQ ID NO: 6003091 - DNA, 21 bp, Homo sapiens
cacggctctgtccccagcctg

SEQ ID NO: 6003092 - DNA, 19 bp, Homo sapiens
cacggctctgtgcccggtg

SEQ ID NO: 6003093 - DNA, 15 bp, Homo sapiens
cacggctgagccttc

SEQ ID NO: 6003094 - DNA, 12 bp, Homo sapiens
cacggctgcacc

SEQ ID NO: 6003095 - DNA, 22 bp, Homo sapiens
cacggctgcacctgcagggagc

SEQ ID NO: 6003096 - DNA, 12 bp, Homo sapiens
cacggctgctga

SEQ ID NO: 6003097 - DNA, 18 bp, Homo sapiens
cacggctggtcactctgc

SEQ ID NO: 6003098 - DNA, 23 bp, Homo sapiens
cacggcttcctataacttcttcc

SEQ ID NO: 6003099 - DNA, 16 bp, Homo sapiens
cacgggaatcacaggt

SEQ ID NO: 6003100 - DNA, 18 bp, Homo sapiens
cacgggacggaagtgctt

SEQ ID NO: 6003101 - DNA, 13 bp, Homo sapiens
cacgggagagcgc

SEQ ID NO: 6003102 - DNA, 16 bp, Homo sapiens
cacgggagagcgccac

SEQ ID NO: 6003103 - DNA, 19 bp, Homo sapiens
cacgggagagcgccacccg

SEQ ID NO: 6003104 - DNA, 15 bp, Homo sapiens
cacgggagatttctt

SEQ ID NO: 6003105 - DNA, 22 bp, Homo sapiens
cacgggatgcgtgggaggcaga

SEQ ID NO: 6003106 - DNA, 14 bp, Homo sapiens
cacgggcccgctca

SEQ ID NO: 6003107 - DNA, 13 bp, Homo sapiens
cacgggcctcagt

SEQ ID NO: 6003108 - DNA, 23 bp, Homo sapiens
cacgggcctctgcttgccagcca

SEQ ID NO: 6003109 - DNA, 14 bp, Homo sapiens
cacgggcctgtcca

SEQ ID NO: 6003110 - DNA, 18 bp, Homo sapiens
cacgggcgagctttctct

SEQ ID NO: 6003111 - DNA, 15 bp, Homo sapiens
cacgggcggtcctgc

SEQ ID NO: 6003112 - DNA, 16 bp, Homo sapiens
cacgggcggtcctgca

SEQ ID NO: 6003113 - DNA, 22 bp, Homo sapiens
cacgggctgcgccgtctgctcg

SEQ ID NO: 6003114 - DNA, 19 bp, Homo sapiens
cacggggaccactgggccc

SEQ ID NO: 6003115 - DNA, 20 bp, Homo sapiens
cacggggaccactgggcccc

SEQ ID NO: 6003116 - DNA, 20 bp, Homo sapiens
cacggggatcatctctgtga

SEQ ID NO: 6003117 - DNA, 16 bp, Homo sapiens
cacggggcacccagcc

SEQ ID NO: 6003118 - DNA, 18 bp, Homo sapiens
cacggggctcactctggc

SEQ ID NO: 6003119 - DNA, 22 bp, Homo sapiens
cacgggggctgtggctctgggt

SEQ ID NO: 6003120 - DNA, 17 bp, Homo sapiens
cacggggtcgggggagg

SEQ ID NO: 6003121 - DNA, 23 bp, Homo sapiens
cacggggtcgggggaggagcacc

SEQ ID NO: 6003122 - DNA, 21 bp, Homo sapiens
cacggggttccctcctagctc

SEQ ID NO: 6003123 - DNA, 22 bp, Homo sapiens
cacggggttccctcctagctct

SEQ ID NO: 6003124 - DNA, 22 bp, Homo sapiens
cacggggttggctgttccagac

SEQ ID NO: 6003125 - DNA, 22 bp, Homo sapiens
cacgggtggggaaaggaggtgg

SEQ ID NO: 6003126 - DNA, 18 bp, Homo sapiens
cacggtaaccatgatgga

SEQ ID NO: 6003127 - DNA, 15 bp, Homo sapiens
cacggtagtgcctga

SEQ ID NO: 6003128 - DNA, 17 bp, Homo sapiens
cacggtcacacggccac

SEQ ID NO: 6003129 - DNA, 14 bp, Homo sapiens
cacggtccgcggcc

SEQ ID NO: 6003130 - DNA, 22 bp, Homo sapiens
cacggtcggggcatctggcctg

SEQ ID NO: 6003131 - DNA, 14 bp, Homo sapiens
cacggtctggaggc

SEQ ID NO: 6003132 - DNA, 15 bp, Homo sapiens
cacggtgaaacccca

SEQ ID NO: 6003133 - DNA, 16 bp, Homo sapiens
cacggtgaaaccccat

SEQ ID NO: 6003134 - DNA, 20 bp, Homo sapiens
cacggtgaatggctttgtat

SEQ ID NO: 6003135 - DNA, 19 bp, Homo sapiens
cacggtgacacaggtcagg

SEQ ID NO: 6003136 - DNA, 20 bp, Homo sapiens
cacggtgactctgtccagct

SEQ ID NO: 6003137 - DNA, 20 bp, Homo sapiens
cacggtgcccaaacaccagt

SEQ ID NO: 6003138 - DNA, 15 bp, Homo sapiens
cacggtgcctttttt

SEQ ID NO: 6003139 - DNA, 12 bp, Homo sapiens
cacggtgtccac

SEQ ID NO: 6003140 - DNA, 23 bp, Homo sapiens
cacggtgtccaccatccccagct

SEQ ID NO: 6003141 - DNA, 15 bp, Homo sapiens
cacggtgtggggggt

SEQ ID NO: 6003142 - DNA, 13 bp, Homo sapiens
cacggttcaatgg

SEQ ID NO: 6003143 - DNA, 16 bp, Homo sapiens
cacggttgcctgaggt

SEQ ID NO: 6003144 - DNA, 22 bp, Homo sapiens
cacggttgctaaattataaaat

SEQ ID NO: 6003145 - DNA, 19 bp, Homo sapiens
cacggtttaactgtcccag

SEQ ID NO: 6003146 - DNA, 22 bp, Homo sapiens
cacggtttatcctcttggtgtc

SEQ ID NO: 6003147 - DNA, 17 bp, Homo sapiens
cacgtaaggtctcattt

SEQ ID NO: 6003148 - DNA, 16 bp, Homo sapiens
cacgtaatcctcctga

SEQ ID NO: 6003149 - DNA, 19 bp, Homo sapiens
cacgtaatgaaacttggat

SEQ ID NO: 6003150 - DNA, 21 bp, Homo sapiens
cacgtacacaccacgtcctgg

SEQ ID NO: 6003151 - DNA, 15 bp, Homo sapiens
cacgtaccaagccac

SEQ ID NO: 6003152 - DNA, 23 bp, Homo sapiens
cacgtaccaagccaccgcagctg

SEQ ID NO: 6003153 - DNA, 16 bp, Homo sapiens
cacgtacccaggtctg

SEQ ID NO: 6003154 - DNA, 16 bp, Homo sapiens
cacgtacttaaatgaa

SEQ ID NO: 6003155 - DNA, 13 bp, Homo sapiens
cacgtagactgat

SEQ ID NO: 6003156 - DNA, 17 bp, Homo sapiens
cacgtagggggcagggg

SEQ ID NO: 6003157 - DNA, 18 bp, Homo sapiens
cacgtagggggcaggggc

SEQ ID NO: 6003158 - DNA, 20 bp, Homo sapiens
cacgtagggggcaggggcag

SEQ ID NO: 6003159 - DNA, 17 bp, Homo sapiens
cacgtagtagggtcagg

SEQ ID NO: 6003160 - DNA, 19 bp, Homo sapiens
cacgtagtagggtcaggcc

SEQ ID NO: 6003161 - DNA, 23 bp, Homo sapiens
cacgtagtagggtcaggccacgg

SEQ ID NO: 6003162 - DNA, 24 bp, Homo sapiens
cacgtagtttgcattccagcgtct

SEQ ID NO: 6003163 - DNA, 14 bp, Homo sapiens
cacgtattgctgtg

SEQ ID NO: 6003164 - DNA, 19 bp, Homo sapiens
cacgtatttatatttggaa

SEQ ID NO: 6003165 - DNA, 22 bp, Homo sapiens
cacgtatttatatttggaaaga

SEQ ID NO: 6003166 - DNA, 15 bp, Homo sapiens
cacgtcaccctcctg

SEQ ID NO: 6003167 - DNA, 17 bp, Homo sapiens
cacgtcaccctcctgag

SEQ ID NO: 6003168 - DNA, 23 bp, Homo sapiens
cacgtcaccctcctgagcctcac

SEQ ID NO: 6003169 - DNA, 18 bp, Homo sapiens
cacgtcaggcctggcctc

SEQ ID NO: 6003170 - DNA, 15 bp, Homo sapiens
cacgtcagtgccatc

SEQ ID NO: 6003171 - DNA, 17 bp, Homo sapiens
cacgtcatctagtttta

SEQ ID NO: 6003172 - DNA, 14 bp, Homo sapiens
cacgtcatgggagg

SEQ ID NO: 6003173 - DNA, 17 bp, Homo sapiens
cacgtcatgtttcttca

SEQ ID NO: 6003174 - DNA, 22 bp, Homo sapiens
cacgtccacgcggccacctcac

SEQ ID NO: 6003175 - DNA, 19 bp, Homo sapiens
cacgtccactcccaagcca

SEQ ID NO: 6003176 - DNA, 16 bp, Homo sapiens
cacgtccagaattttt

SEQ ID NO: 6003177 - DNA, 13 bp, Homo sapiens
cacgtccaggtcc

SEQ ID NO: 6003178 - DNA, 21 bp, Homo sapiens
cacgtcccaccccacctcttg

SEQ ID NO: 6003179 - DNA, 17 bp, Homo sapiens
cacgtcccgctgcctcc

SEQ ID NO: 6003180 - DNA, 14 bp, Homo sapiens
cacgtcccgggcac

SEQ ID NO: 6003181 - DNA, 19 bp, Homo sapiens
cacgtcccgggcactgtca

SEQ ID NO: 6003182 - DNA, 12 bp, Homo sapiens
cacgtcctccac

SEQ ID NO: 6003183 - DNA, 16 bp, Homo sapiens
cacgtcctcgctcccg

SEQ ID NO: 6003184 - DNA, 13 bp, Homo sapiens
cacgtcctgggtg

SEQ ID NO: 6003185 - DNA, 23 bp, Homo sapiens
cacgtcctgtcagtgccgccgcc

SEQ ID NO: 6003186 - DNA, 14 bp, Homo sapiens
cacgtcctttcctg

SEQ ID NO: 6003187 - DNA, 21 bp, Homo sapiens
cacgtcgggcttccctggcct

SEQ ID NO: 6003188 - DNA, 14 bp, Homo sapiens
cacgtctcctgctg

SEQ ID NO: 6003189 - DNA, 15 bp, Homo sapiens
cacgtctcctgctgc

SEQ ID NO: 6003190 - DNA, 14 bp, Homo sapiens
cacgtctctctgcc

SEQ ID NO: 6003191 - DNA, 15 bp, Homo sapiens
cacgtctctctgcct

SEQ ID NO: 6003192 - DNA, 17 bp, Homo sapiens
cacgtctctctgcctgc

SEQ ID NO: 6003193 - DNA, 21 bp, Homo sapiens
cacgtctctctgcctgctggg

SEQ ID NO: 6003194 - DNA, 14 bp, Homo sapiens
cacgtctgacaaat

SEQ ID NO: 6003195 - DNA, 16 bp, Homo sapiens
cacgtctgaccctctc

SEQ ID NO: 6003196 - DNA, 12 bp, Homo sapiens
cacgtctgccag

SEQ ID NO: 6003197 - DNA, 22 bp, Homo sapiens
cacgtctgccaggcccatctca

SEQ ID NO: 6003198 - DNA, 15 bp, Homo sapiens
cacgtctggaccccg

SEQ ID NO: 6003199 - DNA, 12 bp, Homo sapiens
cacgtctggcca

SEQ ID NO: 6003200 - DNA, 17 bp, Homo sapiens
cacgtctggctccctgc

SEQ ID NO: 6003201 - DNA, 13 bp, Homo sapiens
cacgtctgtcctc

SEQ ID NO: 6003202 - DNA, 14 bp, Homo sapiens
cacgtctgtcttca

SEQ ID NO: 6003203 - DNA, 15 bp, Homo sapiens
cacgtctgtgctctg

SEQ ID NO: 6003204 - DNA, 16 bp, Homo sapiens
cacgtcttccttctgc

SEQ ID NO: 6003205 - DNA, 18 bp, Homo sapiens
cacgtcttccttctgcct

SEQ ID NO: 6003206 - DNA, 19 bp, Homo sapiens
cacgtcttcttgctgcagc

SEQ ID NO: 6003207 - DNA, 18 bp, Homo sapiens
cacgtcttggtgcctttt

SEQ ID NO: 6003208 - DNA, 16 bp, Homo sapiens
cacgtctttcctgcta

SEQ ID NO: 6003209 - DNA, 13 bp, Homo sapiens
cacgtgacagccg

SEQ ID NO: 6003210 - DNA, 18 bp, Homo sapiens
cacgtgacagtgcctggg

SEQ ID NO: 6003211 - DNA, 14 bp, Homo sapiens
cacgtgaccagccc

SEQ ID NO: 6003212 - DNA, 17 bp, Homo sapiens
cacgtgaccagccccgt

SEQ ID NO: 6003213 - DNA, 15 bp, Homo sapiens
cacgtgaccctgtgc

SEQ ID NO: 6003214 - DNA, 17 bp, Homo sapiens
cacgtgaccctgtgccc

SEQ ID NO: 6003215 - DNA, 20 bp, Homo sapiens
cacgtgagaatccctggcaa

SEQ ID NO: 6003216 - DNA, 14 bp, Homo sapiens
cacgtgcaaggact

SEQ ID NO: 6003217 - DNA, 15 bp, Homo sapiens
cacgtgcacacacct

SEQ ID NO: 6003218 - DNA, 18 bp, Homo sapiens
cacgtgcacacacctgca

SEQ ID NO: 6003219 - DNA, 20 bp, Homo sapiens
cacgtgcacacacctgcaca

SEQ ID NO: 6003220 - DNA, 14 bp, Homo sapiens
cacgtgcacagctt

SEQ ID NO: 6003221 - DNA, 15 bp, Homo sapiens
cacgtgcagcacctg

SEQ ID NO: 6003222 - DNA, 21 bp, Homo sapiens
cacgtgcagcagcaacacaat

SEQ ID NO: 6003223 - DNA, 21 bp, Homo sapiens
cacgtgcaggacagctcttga

SEQ ID NO: 6003224 - DNA, 14 bp, Homo sapiens
cacgtgccaggccc

SEQ ID NO: 6003225 - DNA, 15 bp, Homo sapiens
cacgtgccaggcccg

SEQ ID NO: 6003226 - DNA, 20 bp, Homo sapiens
cacgtgccattgtctttcct

SEQ ID NO: 6003227 - DNA, 17 bp, Homo sapiens
cacgtgccttaggaata

SEQ ID NO: 6003228 - DNA, 21 bp, Homo sapiens
cacgtgcgtgtgagtgtgtgt

SEQ ID NO: 6003229 - DNA, 18 bp, Homo sapiens
cacgtgctcgcagcctgg

SEQ ID NO: 6003230 - DNA, 14 bp, Homo sapiens
cacgtgctggagag

SEQ ID NO: 6003231 - DNA, 17 bp, Homo sapiens
cacgtggactctgtgct

SEQ ID NO: 6003232 - DNA, 18 bp, Homo sapiens
cacgtggactctgtgctc

SEQ ID NO: 6003233 - DNA, 20 bp, Homo sapiens
cacgtggcatgtggcctgtg

SEQ ID NO: 6003234 - DNA, 22 bp, Homo sapiens
cacgtggcatgtggcctgtggc

SEQ ID NO: 6003235 - DNA, 13 bp, Homo sapiens
cacgtggccagga

SEQ ID NO: 6003236 - DNA, 12 bp, Homo sapiens
cacgtggcctct

SEQ ID NO: 6003237 - DNA, 17 bp, Homo sapiens
cacgtggcctctctctc

SEQ ID NO: 6003238 - DNA, 18 bp, Homo sapiens
cacgtggcctcttgagca

SEQ ID NO: 6003239 - DNA, 20 bp, Homo sapiens
cacgtggcctcttgagcagt

SEQ ID NO: 6003240 - DNA, 23 bp, Homo sapiens
cacgtggcctcttgagcagtggc

SEQ ID NO: 6003241 - DNA, 21 bp, Homo sapiens
cacgtggcttctgatgaatct

SEQ ID NO: 6003242 - DNA, 16 bp, Homo sapiens
cacgtgggctcatatg

SEQ ID NO: 6003243 - DNA, 15 bp, Homo sapiens
cacgtggtcactgtg

SEQ ID NO: 6003244 - DNA, 16 bp, Homo sapiens
cacgtggtcactgtgc

SEQ ID NO: 6003245 - DNA, 17 bp, Homo sapiens
cacgtggtcactgtgca

SEQ ID NO: 6003246 - DNA, 17 bp, Homo sapiens
cacgtggtgtccctgcg

SEQ ID NO: 6003247 - DNA, 17 bp, Homo sapiens
cacgtgtactggctcct

SEQ ID NO: 6003248 - DNA, 23 bp, Homo sapiens
cacgtgtatagtatctgtatata

SEQ ID NO: 6003249 - DNA, 15 bp, Homo sapiens
cacgtgtgcagactg

SEQ ID NO: 6003250 - DNA, 20 bp, Homo sapiens
cacgtgtgcagactgtggct

SEQ ID NO: 6003251 - DNA, 12 bp, Homo sapiens
cacgtgtggcct

SEQ ID NO: 6003252 - DNA, 19 bp, Homo sapiens
cacgtgtggcctgttcttc

SEQ ID NO: 6003253 - DNA, 13 bp, Homo sapiens
cacgtgtgtatga

SEQ ID NO: 6003254 - DNA, 15 bp, Homo sapiens
cacgtgtgtttttct

SEQ ID NO: 6003255 - DNA, 13 bp, Homo sapiens
cacgttcacccct

SEQ ID NO: 6003256 - DNA, 18 bp, Homo sapiens
cacgttccacagttgcca

SEQ ID NO: 6003257 - DNA, 19 bp, Homo sapiens
cacgttccttactgcagaa

SEQ ID NO: 6003258 - DNA, 20 bp, Homo sapiens
cacgttctatattgtgccaa

SEQ ID NO: 6003259 - DNA, 18 bp, Homo sapiens
cacgttctcacacccacc

SEQ ID NO: 6003260 - DNA, 19 bp, Homo sapiens
cacgttctcacacccaccg

SEQ ID NO: 6003261 - DNA, 13 bp, Homo sapiens
cacgttgacccaa

SEQ ID NO: 6003262 - DNA, 15 bp, Homo sapiens
cacgttgctgaaggt

SEQ ID NO: 6003263 - DNA, 22 bp, Homo sapiens
cacgttgctggtggtttttcag

SEQ ID NO: 6003264 - DNA, 23 bp, Homo sapiens
cacgttggggagctggcggcggc

SEQ ID NO: 6003265 - DNA, 17 bp, Homo sapiens
cacgttggggtgattta

SEQ ID NO: 6003266 - DNA, 20 bp, Homo sapiens
cacgttggggtgatttaatc

SEQ ID NO: 6003267 - DNA, 16 bp, Homo sapiens
cagctgaagcctggac

SEQ ID NO: 6003268 - DNA, 21 bp, Homo sapiens
cagctgaagcctggacgcagc

SEQ ID NO: 6003269 - DNA, 14 bp, Homo sapiens
cagctgaaggcagt

SEQ ID NO: 6003270 - DNA, 17 bp, Homo sapiens
cagctgaaggcagtggc

SEQ ID NO: 6003271 - DNA, 22 bp, Homo sapiens
cagctgaagtcaaaatatgtaa

SEQ ID NO: 6003272 - DNA, 23 bp, Homo sapiens
cagctgaagttgcagatgttaga

SEQ ID NO: 6003273 - DNA, 17 bp, Homo sapiens
cagctgaataacctgca

SEQ ID NO: 6003274 - DNA, 20 bp, Homo sapiens
cagctgaataacctgcacag

SEQ ID NO: 6003275 - DNA, 21 bp, Homo sapiens
cagctgaataacctgcacagg

SEQ ID NO: 6003276 - DNA, 23 bp, Homo sapiens
cagctgaataacctgcacaggct

SEQ ID NO: 6003277 - DNA, 16 bp, Homo sapiens
cagctgaattatctat

SEQ ID NO: 6003278 - DNA, 19 bp, Homo sapiens
cagctgacacataatttga

SEQ ID NO: 6003279 - DNA, 21 bp, Homo sapiens
cagctgacacataatttgaat

SEQ ID NO: 6003280 - DNA, 15 bp, Homo sapiens
cagctgacagataca

SEQ ID NO: 6003281 - DNA, 22 bp, Homo sapiens
cagctgacagatacatagatgg

SEQ ID NO: 6003282 - DNA, 15 bp, Homo sapiens
cagctgacagccaca

SEQ ID NO: 6003283 - DNA, 14 bp, Homo sapiens
cagctgacagtcct

SEQ ID NO: 6003284 - DNA, 15 bp, Homo sapiens
cagctgacagtcctc

SEQ ID NO: 6003285 - DNA, 21 bp, Homo sapiens
cagctgacagtcctctccacc

SEQ ID NO: 6003286 - DNA, 15 bp, Homo sapiens
cagctgacatggagt

SEQ ID NO: 6003287 - DNA, 22 bp, Homo sapiens
cagctgaccagaagtggcagga

SEQ ID NO: 6003288 - DNA, 14 bp, Homo sapiens
cagctgaccccctc

SEQ ID NO: 6003289 - DNA, 21 bp, Homo sapiens
cagctgacccggcctctctgc

SEQ ID NO: 6003290 - DNA, 17 bp, Homo sapiens
cagctgacctctgttgt

SEQ ID NO: 6003291 - DNA, 16 bp, Homo sapiens
cagctgactgtggccc

SEQ ID NO: 6003292 - DNA, 19 bp, Homo sapiens
cagctgactgtggccccct

SEQ ID NO: 6003293 - DNA, 21 bp, Homo sapiens
cagctgacttttctgtccgag

SEQ ID NO: 6003294 - DNA, 17 bp, Homo sapiens
cagctgagaccagggtc

SEQ ID NO: 6003295 - DNA, 21 bp, Homo sapiens
cagctgagagacttttaatca

SEQ ID NO: 6003296 - DNA, 22 bp, Homo sapiens
cagctgagcacattctggctca

SEQ ID NO: 6003297 - DNA, 22 bp, Homo sapiens
cagctgagcacttagcaggcac

SEQ ID NO: 6003298 - DNA, 15 bp, Homo sapiens
cagctgagcagggcc

SEQ ID NO: 6003299 - DNA, 16 bp, Homo sapiens
cagctgagcagggccg

SEQ ID NO: 6003300 - DNA, 23 bp, Homo sapiens
cagctgagcatggagacagcagt

SEQ ID NO: 6003301 - DNA, 11 bp, Homo sapiens
cagctgagccc

SEQ ID NO: 6003302 - DNA, 16 bp, Homo sapiens
cagctgagccctgggg

SEQ ID NO: 6003303 - DNA, 14 bp, Homo sapiens
cagctgagcctgag

SEQ ID NO: 6003304 - DNA, 20 bp, Homo sapiens
cagctgagcttgagctcccc

SEQ ID NO: 6003305 - DNA, 21 bp, Homo sapiens
cagctgagcttgagctcccct

SEQ ID NO: 6003306 - DNA, 20 bp, Homo sapiens
cagctgaggacacaccccac

SEQ ID NO: 6003307 - DNA, 22 bp, Homo sapiens
cagctgaggaccctcagcccca

SEQ ID NO: 6003308 - DNA, 17 bp, Homo sapiens
cagctgaggccccaggg

SEQ ID NO: 6003309 - DNA, 23 bp, Homo sapiens
cagctgaggctgggggagagccg

SEQ ID NO: 6003310 - DNA, 18 bp, Homo sapiens
cagctgagttatgatgta

SEQ ID NO: 6003311 - DNA, 15 bp, Homo sapiens
cagctgatacaaatt

SEQ ID NO: 6003312 - DNA, 19 bp, Homo sapiens
cagctgatattatggcaag

SEQ ID NO: 6003313 - DNA, 19 bp, Homo sapiens
cagctgatctaaggacccc

SEQ ID NO: 6003314 - DNA, 13 bp, Homo sapiens
cagctgatgactc

SEQ ID NO: 6003315 - DNA, 15 bp, Homo sapiens
cagctgatgactcaa

SEQ ID NO: 6003316 - DNA, 16 bp, Homo sapiens
cagctgatgctgtact

SEQ ID NO: 6003317 - DNA, 17 bp, Homo sapiens
cagctgattttaacaat

SEQ ID NO: 6003318 - DNA, 22 bp, Homo sapiens
cagctgattttgtcactgtctt

SEQ ID NO: 6003319 - DNA, 11 bp, Homo sapiens
cagctgcaaag

SEQ ID NO: 6003320 - DNA, 15 bp, Homo sapiens
cagctgcaaagtgtt

SEQ ID NO: 6003321 - DNA, 14 bp, Homo sapiens
cagctgcaagccag

SEQ ID NO: 6003322 - DNA, 17 bp, Homo sapiens
cagctgcaagccaggga

SEQ ID NO: 6003323 - DNA, 18 bp, Homo sapiens
cagctgcaagccagggat

SEQ ID NO: 6003324 - DNA, 16 bp, Homo sapiens
cagctgcaagggagtt

SEQ ID NO: 6003325 - DNA, 19 bp, Homo sapiens
cagctgcaaggtactctgg

SEQ ID NO: 6003326 - DNA, 14 bp, Homo sapiens
cagctgcacattcc

SEQ ID NO: 6003327 - DNA, 15 bp, Homo sapiens
cagctgcacattcct

SEQ ID NO: 6003328 - DNA, 19 bp, Homo sapiens
cagctgcaccagagcaacc

SEQ ID NO: 6003329 - DNA, 20 bp, Homo sapiens
cagctgcaccccagcgtcag

SEQ ID NO: 6003330 - DNA, 14 bp, Homo sapiens
cagctgcacccctt

SEQ ID NO: 6003331 - DNA, 16 bp, Homo sapiens
cagctgcaccccttcc

SEQ ID NO: 6003332 - DNA, 17 bp, Homo sapiens
cagctgcaccccttcct

SEQ ID NO: 6003333 - DNA, 20 bp, Homo sapiens
cagctgcaccccttcctggg

SEQ ID NO: 6003334 - DNA, 21 bp, Homo sapiens
cagctgcacctgccagcctgg

SEQ ID NO: 6003335 - DNA, 20 bp, Homo sapiens
cagctgcagaccatgccaga

SEQ ID NO: 6003336 - DNA, 15 bp, Homo sapiens
cagctgcagagacag

SEQ ID NO: 6003337 - DNA, 19 bp, Homo sapiens
cagctgcagatgccacacc

SEQ ID NO: 6003338 - DNA, 15 bp, Homo sapiens
cagctgcagctgatc

SEQ ID NO: 6003339 - DNA, 22 bp, Homo sapiens
cagctgcagctgatccatagga

SEQ ID NO: 6003340 - DNA, 15 bp, Homo sapiens
cagctgcagctgggc

SEQ ID NO: 6003341 - DNA, 16 bp, Homo sapiens
cagctgcagctgggct

SEQ ID NO: 6003342 - DNA, 12 bp, Homo sapiens
cagctgcagggc

SEQ ID NO: 6003343 - DNA, 17 bp, Homo sapiens
cagctgcaggggcctct

SEQ ID NO: 6003344 - DNA, 13 bp, Homo sapiens
cagctgcaggtgc

SEQ ID NO: 6003345 - DNA, 17 bp, Homo sapiens
cagctgcaggtgcccat

SEQ ID NO: 6003346 - DNA, 17 bp, Homo sapiens
cagctgcagtcaacagt

SEQ ID NO: 6003347 - DNA, 19 bp, Homo sapiens
cagctgcagtcaacagttc

SEQ ID NO: 6003348 - DNA, 21 bp, Homo sapiens
cagctgcagttagcacagagg

SEQ ID NO: 6003349 - DNA, 16 bp, Homo sapiens
cagctgcattccgcag

SEQ ID NO: 6003350 - DNA, 23 bp, Homo sapiens
cagctgcatttcacatgccttgc

SEQ ID NO: 6003351 - DNA, 13 bp, Homo sapiens
cagctgccagaga

SEQ ID NO: 6003352 - DNA, 11 bp, Homo sapiens
cagctgccagg

SEQ ID NO: 6003353 - DNA, 12 bp, Homo sapiens
cagctgccaggc

SEQ ID NO: 6003354 - DNA, 16 bp, Homo sapiens
cagctgccaggcggcc

SEQ ID NO: 6003355 - DNA, 18 bp, Homo sapiens
cagctgccaggcggccct

SEQ ID NO: 6003356 - DNA, 14 bp, Homo sapiens
cagctgcccagaca

SEQ ID NO: 6003357 - DNA, 15 bp, Homo sapiens
cagctgcccagacac

SEQ ID NO: 6003358 - DNA, 16 bp, Homo sapiens
cagctgcccagacaca

SEQ ID NO: 6003359 - DNA, 20 bp, Homo sapiens
cagctgcccagacacatggg

SEQ ID NO: 6003360 - DNA, 16 bp, Homo sapiens
cagctgcccatcccag

SEQ ID NO: 6003361 - DNA, 10 bp, Homo sapiens
cagctgcccc

SEQ ID NO: 6003362 - DNA, 16 bp, Homo sapiens
cagctgcccccagagc

SEQ ID NO: 6003363 - DNA, 18 bp, Homo sapiens
cagctgcccccagagcca

SEQ ID NO: 6003364 - DNA, 22 bp, Homo sapiens
cagctgccccggcccctccccc

SEQ ID NO: 6003365 - DNA, 13 bp, Homo sapiens
cagctgccccggg

SEQ ID NO: 6003366 - DNA, 22 bp, Homo sapiens
cagctgccccgggatgcgaggc

SEQ ID NO: 6003367 - DNA, 12 bp, Homo sapiens
cagctgcccctc

SEQ ID NO: 6003368 - DNA, 18 bp, Homo sapiens
cagctgcccctccctcag

SEQ ID NO: 6003369 - DNA, 16 bp, Homo sapiens
cagctgcccctccctg

SEQ ID NO: 6003370 - DNA, 18 bp, Homo sapiens
cagctgcccctcctggag

SEQ ID NO: 6003371 - DNA, 19 bp, Homo sapiens
cagctgccctagctgaccc

SEQ ID NO: 6003372 - DNA, 15 bp, Homo sapiens
cagctgccctatggg

SEQ ID NO: 6003373 - DNA, 12 bp, Homo sapiens
cagctgccctgc

SEQ ID NO: 6003374 - DNA, 13 bp, Homo sapiens
cagctgccctgct

SEQ ID NO: 6003375 - DNA, 16 bp, Homo sapiens
cagctgccctgctgcc

SEQ ID NO: 6003376 - DNA, 22 bp, Homo sapiens
cagctgccctgctgccacagca

SEQ ID NO: 6003377 - DNA, 15 bp, Homo sapiens
cagctgccctggctg

SEQ ID NO: 6003378 - DNA, 21 bp, Homo sapiens
cagctgcccttccgcagtgtg

SEQ ID NO: 6003379 - DNA, 18 bp, Homo sapiens
cagctgcccttgcagggt

SEQ ID NO: 6003380 - DNA, 18 bp, Homo sapiens
cagctgccgaccagagcc

SEQ ID NO: 6003381 - DNA, 16 bp, Homo sapiens
cagctgccgcaccagc

SEQ ID NO: 6003382 - DNA, 14 bp, Homo sapiens
cagctgcctaccta

SEQ ID NO: 6003383 - DNA, 23 bp, Homo sapiens
cagctgcctaggattcacacccc

SEQ ID NO: 6003384 - DNA, 10 bp, Homo sapiens
cagctgcctc

SEQ ID NO: 6003385 - DNA, 17 bp, Homo sapiens
cagctgcctcccctcct

SEQ ID NO: 6003386 - DNA, 21 bp, Homo sapiens
cagctgcctcccctcctctgc

SEQ ID NO: 6003387 - DNA, 15 bp, Homo sapiens
cagctgcctccgggc

SEQ ID NO: 6003388 - DNA, 21 bp, Homo sapiens
cagctgcctcctgcgccctgt

SEQ ID NO: 6003389 - DNA, 15 bp, Homo sapiens
cagctgcctctgctc

SEQ ID NO: 6003390 - DNA, 20 bp, Homo sapiens
cagctgcctctgctccctct

SEQ ID NO: 6003391 - DNA, 20 bp, Homo sapiens
cagctgcctgaaacagccat

SEQ ID NO: 6003392 - DNA, 15 bp, Homo sapiens
cagctgcctggccat

SEQ ID NO: 6003393 - DNA, 14 bp, Homo sapiens
cagctgcctgggat

SEQ ID NO: 6003394 - DNA, 14 bp, Homo sapiens
cagctgcctggggc

SEQ ID NO: 6003395 - DNA, 16 bp, Homo sapiens
cagctgcctggggccc

SEQ ID NO: 6003396 - DNA, 19 bp, Homo sapiens
cagctgcctggggcccaag

SEQ ID NO: 6003397 - DNA, 18 bp, Homo sapiens
cagctgcctgtgcctgcc

SEQ ID NO: 6003398 - DNA, 21 bp, Homo sapiens
cagctgccttagcttcaggaa

SEQ ID NO: 6003399 - DNA, 13 bp, Homo sapiens
cagctgccttcct

SEQ ID NO: 6003400 - DNA, 20 bp, Homo sapiens
cagctgcctttcgtgatctt

SEQ ID NO: 6003401 - DNA, 17 bp, Homo sapiens
cagctgcgcttgctttt

SEQ ID NO: 6003402 - DNA, 19 bp, Homo sapiens
cagctgcggcatccctgtg

SEQ ID NO: 6003403 - DNA, 18 bp, Homo sapiens
cagctgcggccaggcctg

SEQ ID NO: 6003404 - DNA, 22 bp, Homo sapiens
cagctgcggccaggcctgcggg

SEQ ID NO: 6003405 - DNA, 14 bp, Homo sapiens
cagctgcgggtctg

SEQ ID NO: 6003406 - DNA, 24 bp, Homo sapiens
cagctgcggtccacccaggagccc

SEQ ID NO: 6003407 - DNA, 17 bp, Homo sapiens
cagctgctcagaattca

SEQ ID NO: 6003408 - DNA, 19 bp, Homo sapiens
cagctgctcagaattcatc

SEQ ID NO: 6003409 - DNA, 16 bp, Homo sapiens
cagctgctcagagcca

SEQ ID NO: 6003410 - DNA, 14 bp, Homo sapiens
cagctgctcccaca

SEQ ID NO: 6003411 - DNA, 14 bp, Homo sapiens
cagctgctccccag

SEQ ID NO: 6003412 - DNA, 20 bp, Homo sapiens
cagctgctccccaggccacc

SEQ ID NO: 6003413 - DNA, 15 bp, Homo sapiens
cagctgctcccctcc

SEQ ID NO: 6003414 - DNA, 17 bp, Homo sapiens
cagctgctcccctccct

SEQ ID NO: 6003415 - DNA, 20 bp, Homo sapiens
cagctgctcccctgccacgc

SEQ ID NO: 6003416 - DNA, 23 bp, Homo sapiens
cagctgctccgaggacccaggaa

SEQ ID NO: 6003417 - DNA, 18 bp, Homo sapiens
cagctgctcctagaggga

SEQ ID NO: 6003418 - DNA, 17 bp, Homo sapiens
cagctgctcctcgcagt

SEQ ID NO: 6003419 - DNA, 19 bp, Homo sapiens
cagctgctctaagcccagg

SEQ ID NO: 6003420 - DNA, 22 bp, Homo sapiens
cagctgctctaagcccaggatc

SEQ ID NO: 6003421 - DNA, 23 bp, Homo sapiens
cagctgctctaagcccaggatct

SEQ ID NO: 6003422 - DNA, 11 bp, Homo sapiens
cagctgctctg

SEQ ID NO: 6003423 - DNA, 15 bp, Homo sapiens
cagctgctctgccca

SEQ ID NO: 6003424 - DNA, 16 bp, Homo sapiens
cagctgctctgcccag

SEQ ID NO: 6003425 - DNA, 18 bp, Homo sapiens
cagctgctctgcccagag

SEQ ID NO: 6003426 - DNA, 19 bp, Homo sapiens
cagctgctctgcccagagc

SEQ ID NO: 6003427 - DNA, 22 bp, Homo sapiens
cagctgctctgcccagagctgg

SEQ ID NO: 6003428 - DNA, 16 bp, Homo sapiens
cagctgctcttagtgc

SEQ ID NO: 6003429 - DNA, 20 bp, Homo sapiens
cagctgctgaaacaacaaat

SEQ ID NO: 6003430 - DNA, 15 bp, Homo sapiens
cagctgctgaagagg

SEQ ID NO: 6003431 - DNA, 21 bp, Homo sapiens
cagctgctgaagttctgagcc

SEQ ID NO: 6003432 - DNA, 20 bp, Homo sapiens
cagctgctgactggcagggc

SEQ ID NO: 6003433 - DNA, 17 bp, Homo sapiens
cagctgctgagccgcag

SEQ ID NO: 6003434 - DNA, 20 bp, Homo sapiens
cagctgctgagccgcagaga

SEQ ID NO: 6003435 - DNA, 13 bp, Homo sapiens
cagctgctgaggc

SEQ ID NO: 6003436 - DNA, 14 bp, Homo sapiens
cagctgctgaggcg

SEQ ID NO: 6003437 - DNA, 12 bp, Homo sapiens
cagctgctgcca

SEQ ID NO: 6003438 - DNA, 13 bp, Homo sapiens
cagctgctgccac

SEQ ID NO: 6003439 - DNA, 14 bp, Homo sapiens
cagctgctgctgga

SEQ ID NO: 6003440 - DNA, 14 bp, Homo sapiens
cagctgctggagaa

SEQ ID NO: 6003441 - DNA, 14 bp, Homo sapiens
cagctgctggatga

SEQ ID NO: 6003442 - DNA, 18 bp, Homo sapiens
cagctgctggatgacttg

SEQ ID NO: 6003443 - DNA, 14 bp, Homo sapiens
cagctgctggatgt

SEQ ID NO: 6003444 - DNA, 14 bp, Homo sapiens
cagctgctggccag

SEQ ID NO: 6003445 - DNA, 15 bp, Homo sapiens
cagctgctggccagg

SEQ ID NO: 6003446 - DNA, 13 bp, Homo sapiens
cacgttgtccctg

SEQ ID NO: 6003447 - DNA, 12 bp, Homo sapiens
cacgtttagaaa

SEQ ID NO: 6003448 - DNA, 19 bp, Homo sapiens
cacgtttagtaactgtttt

SEQ ID NO: 6003449 - DNA, 23 bp, Homo sapiens
cacgtttctaaaggctacctttg

SEQ ID NO: 6003450 - DNA, 18 bp, Homo sapiens
cacgtttgtgagaagaaa

SEQ ID NO: 6003451 - DNA, 13 bp, Homo sapiens
cacgttttaagga

SEQ ID NO: 6003452 - DNA, 14 bp, Homo sapiens
cacgttttaaggac

SEQ ID NO: 6003453 - DNA, 16 bp, Homo sapiens
cacgttttaaggactg

SEQ ID NO: 6003454 - DNA, 18 bp, Homo sapiens
cacgttttcatctctagg

SEQ ID NO: 6003455 - DNA, 22 bp, Homo sapiens
cacgttttgcctcatgaacact

SEQ ID NO: 6003456 - DNA, 15 bp, Homo sapiens
cacgttttgttttgt

SEQ ID NO: 6003457 - DNA, 16 bp, Homo sapiens
cacgtttttacatact

SEQ ID NO: 6003458 - DNA, 22 bp, Homo sapiens
cacgtttttacatacttttgca

SEQ ID NO: 6003459 - DNA, 13 bp, Homo sapiens
cactaaaaagtgg

SEQ ID NO: 6003460 - DNA, 19 bp, Homo sapiens
cactaaaacacacaggtgc

SEQ ID NO: 6003461 - DNA, 16 bp, Homo sapiens
cactaaaacattgtct

SEQ ID NO: 6003462 - DNA, 12 bp, Homo sapiens
cactaaaagcat

SEQ ID NO: 6003463 - DNA, 15 bp, Homo sapiens
cactaaaagcatgaa

SEQ ID NO: 6003464 - DNA, 17 bp, Homo sapiens
cactaaaagcatgaatt

SEQ ID NO: 6003465 - DNA, 18 bp, Homo sapiens
cactaaaagcatgaattg

SEQ ID NO: 6003466 - DNA, 15 bp, Homo sapiens
cactaaaagtctcca

SEQ ID NO: 6003467 - DNA, 14 bp, Homo sapiens
cactaaaagtgatg

SEQ ID NO: 6003468 - DNA, 21 bp, Homo sapiens
cactaaaagtgatgtgattta

SEQ ID NO: 6003469 - DNA, 15 bp, Homo sapiens
cactaaaatccaccc

SEQ ID NO: 6003470 - DNA, 19 bp, Homo sapiens
cactaaaatgaggatccag

SEQ ID NO: 6003471 - DNA, 23 bp, Homo sapiens
cactaaaatgaggatccagggca

SEQ ID NO: 6003472 - DNA, 17 bp, Homo sapiens
cactaaaatgtttaatt

SEQ ID NO: 6003473 - DNA, 15 bp, Homo sapiens
cactaaaattccact

SEQ ID NO: 6003474 - DNA, 21 bp, Homo sapiens
cactaaaattccactcatgcc

SEQ ID NO: 6003475 - DNA, 14 bp, Homo sapiens
cactaaaattttag

SEQ ID NO: 6003476 - DNA, 13 bp, Homo sapiens
cactaaacaaaga

SEQ ID NO: 6003477 - DNA, 16 bp, Homo sapiens
cactaaacaagaaatc

SEQ ID NO: 6003478 - DNA, 24 bp, Homo sapiens
cactaaaccacttctctgctgcct

SEQ ID NO: 6003479 - DNA, 16 bp, Homo sapiens
cactaaactctgaata

SEQ ID NO: 6003480 - DNA, 22 bp, Homo sapiens
cactaaactctgaataagcact

SEQ ID NO: 6003481 - DNA, 16 bp, Homo sapiens
cactaaactctggggc

SEQ ID NO: 6003482 - DNA, 22 bp, Homo sapiens
cactaaactttacccaaaaact

SEQ ID NO: 6003483 - DNA, 14 bp, Homo sapiens
cactaaactttatt

SEQ ID NO: 6003484 - DNA, 16 bp, Homo sapiens
cactaaagactgggtt

SEQ ID NO: 6003485 - DNA, 13 bp, Homo sapiens
cactaaagcagtg

SEQ ID NO: 6003486 - DNA, 18 bp, Homo sapiens
cactaaagccagcctgac

SEQ ID NO: 6003487 - DNA, 15 bp, Homo sapiens
cactaaagcttcaga

SEQ ID NO: 6003488 - DNA, 22 bp, Homo sapiens
cactaaagtagggaagttttat

SEQ ID NO: 6003489 - DNA, 15 bp, Homo sapiens
cactaaagtatgtaa

SEQ ID NO: 6003490 - DNA, 13 bp, Homo sapiens
cactaaataaact

SEQ ID NO: 6003491 - DNA, 16 bp, Homo sapiens
cactaaatcagagaca

SEQ ID NO: 6003492 - DNA, 21 bp, Homo sapiens
cactaaatctccaagacctgg

SEQ ID NO: 6003493 - DNA, 15 bp, Homo sapiens
cactaaatgagctcc

SEQ ID NO: 6003494 - DNA, 18 bp, Homo sapiens
cactaaatgagctcctgc

SEQ ID NO: 6003495 - DNA, 12 bp, Homo sapiens
cactaaatgctg

SEQ ID NO: 6003496 - DNA, 20 bp, Homo sapiens
cactaaatgttaaagatgta

SEQ ID NO: 6003497 - DNA, 19 bp, Homo sapiens
cactaaattattagcattt

SEQ ID NO: 6003498 - DNA, 14 bp, Homo sapiens
cactaacaaaattt

SEQ ID NO: 6003499 - DNA, 21 bp, Homo sapiens
cactaacaaaatttgaataat

SEQ ID NO: 6003500 - DNA, 19 bp, Homo sapiens
cactaacactttagttata

SEQ ID NO: 6003501 - DNA, 21 bp, Homo sapiens
cactaacatttcccccgagct

SEQ ID NO: 6003502 - DNA, 23 bp, Homo sapiens
cactaaccaagctgagtttccta

SEQ ID NO: 6003503 - DNA, 23 bp, Homo sapiens
cactaaccaatgcctttttagat

SEQ ID NO: 6003504 - DNA, 14 bp, Homo sapiens
cactaaccatcccc

SEQ ID NO: 6003505 - DNA, 16 bp, Homo sapiens
cactaaccatccccaa

SEQ ID NO: 6003506 - DNA, 14 bp, Homo sapiens
cactaacctgaccg

SEQ ID NO: 6003507 - DNA, 23 bp, Homo sapiens
cactaaccttgcctggtacagta

SEQ ID NO: 6003508 - DNA, 14 bp, Homo sapiens
cactaactcaccag

SEQ ID NO: 6003509 - DNA, 14 bp, Homo sapiens
cactaagaaagaaa

SEQ ID NO: 6003510 - DNA, 18 bp, Homo sapiens
cactaagaaagaaaggaa

SEQ ID NO: 6003511 - DNA, 17 bp, Homo sapiens
cactaagaacacctgca

SEQ ID NO: 6003512 - DNA, 15 bp, Homo sapiens
cactaagagggcaga

SEQ ID NO: 6003513 - DNA, 15 bp, Homo sapiens
cactaagcagaggag

SEQ ID NO: 6003514 - DNA, 16 bp, Homo sapiens
cactaagcagaggagg

SEQ ID NO: 6003515 - DNA, 14 bp, Homo sapiens
cactaagctctctg

SEQ ID NO: 6003516 - DNA, 15 bp, Homo sapiens
cactaagctctctgg

SEQ ID NO: 6003517 - DNA, 19 bp, Homo sapiens
cactaagctctctgggcct

SEQ ID NO: 6003518 - DNA, 15 bp, Homo sapiens
cactaaggacttaaa

SEQ ID NO: 6003519 - DNA, 23 bp, Homo sapiens
cactaaggggcccggccagccat

SEQ ID NO: 6003520 - DNA, 16 bp, Homo sapiens
cactaaggtggacagc

SEQ ID NO: 6003521 - DNA, 22 bp, Homo sapiens
cactaagtagaataaagaaaaa

SEQ ID NO: 6003522 - DNA, 18 bp, Homo sapiens
cactaagtcatggtcctg

SEQ ID NO: 6003523 - DNA, 20 bp, Homo sapiens
cactaagtcatggtcctggc

SEQ ID NO: 6003524 - DNA, 22 bp, Homo sapiens
cactaagtcatggtcctggctg

SEQ ID NO: 6003525 - DNA, 21 bp, Homo sapiens
cactaagtctcttttttacaa

SEQ ID NO: 6003526 - DNA, 14 bp, Homo sapiens
cactaagttatagt

SEQ ID NO: 6003527 - DNA, 21 bp, Homo sapiens
cactaatactggttatcctgt

SEQ ID NO: 6003528 - DNA, 18 bp, Homo sapiens
cactaatattcagtcctg

SEQ ID NO: 6003529 - DNA, 22 bp, Homo sapiens
cactaatgatgttagtaacttt

SEQ ID NO: 6003530 - DNA, 22 bp, Homo sapiens
cactaatggccaagtgtacatt

SEQ ID NO: 6003531 - DNA, 17 bp, Homo sapiens
cactaatgggaagacca

SEQ ID NO: 6003532 - DNA, 21 bp, Homo sapiens
cactaatgtgttatgagaaat

SEQ ID NO: 6003533 - DNA, 13 bp, Homo sapiens
cactaattcctta

SEQ ID NO: 6003534 - DNA, 14 bp, Homo sapiens
cactaattccttaa

SEQ ID NO: 6003535 - DNA, 17 bp, Homo sapiens
cactaattggtactttt

SEQ ID NO: 6003536 - DNA, 16 bp, Homo sapiens
cactaattgtccacag

SEQ ID NO: 6003537 - DNA, 17 bp, Homo sapiens
cactaatttgatgttta

SEQ ID NO: 6003538 - DNA, 13 bp, Homo sapiens
cactaattttgtt

SEQ ID NO: 6003539 - DNA, 16 bp, Homo sapiens
cactaattttgtttta

SEQ ID NO: 6003540 - DNA, 15 bp, Homo sapiens
cactaatttttgtat

SEQ ID NO: 6003541 - DNA, 18 bp, Homo sapiens
cactaatttttgtattat

SEQ ID NO: 6003542 - DNA, 20 bp, Homo sapiens
cactaatttttgtattattt

SEQ ID NO: 6003543 - DNA, 14 bp, Homo sapiens
cactacaacattag

SEQ ID NO: 6003544 - DNA, 18 bp, Homo sapiens
cactacaacattagaata

SEQ ID NO: 6003545 - DNA, 23 bp, Homo sapiens
cactacaacctccaccttccagg

SEQ ID NO: 6003546 - DNA, 17 bp, Homo sapiens
cactacaagtttataag

SEQ ID NO: 6003547 - DNA, 16 bp, Homo sapiens
cactacacatttgaaa

SEQ ID NO: 6003548 - DNA, 13 bp, Homo sapiens
cactacaccacac

SEQ ID NO: 6003549 - DNA, 16 bp, Homo sapiens
cactacaccacacaca

SEQ ID NO: 6003550 - DNA, 23 bp, Homo sapiens
cactacaccacacacaacagcca

SEQ ID NO: 6003551 - DNA, 17 bp, Homo sapiens
cactacacccagcaata

SEQ ID NO: 6003552 - DNA, 21 bp, Homo sapiens
cactacacccagcaatagaga

SEQ ID NO: 6003553 - DNA, 22 bp, Homo sapiens
cactacaggaggaatgcaccac

SEQ ID NO: 6003554 - DNA, 21 bp, Homo sapiens
cactacaggtgaaggctctca

SEQ ID NO: 6003555 - DNA, 15 bp, Homo sapiens
cactacatctggctt

SEQ ID NO: 6003556 - DNA, 21 bp, Homo sapiens
cactacatgcagcccatgccc

SEQ ID NO: 6003557 - DNA, 19 bp, Homo sapiens
cactacatgggccagccct

SEQ ID NO: 6003558 - DNA, 16 bp, Homo sapiens
cactacattctgttaa

SEQ ID NO: 6003559 - DNA, 21 bp, Homo sapiens
cactacattctgttaatcatt

SEQ ID NO: 6003560 - DNA, 16 bp, Homo sapiens
cactaccaaaagacat

SEQ ID NO: 6003561 - DNA, 18 bp, Homo sapiens
cactaccagccagcctca

SEQ ID NO: 6003562 - DNA, 23 bp, Homo sapiens
cactaccagcgtatatataagaa

SEQ ID NO: 6003563 - DNA, 22 bp, Homo sapiens
cactacccatcggtgtccattt

SEQ ID NO: 6003564 - DNA, 16 bp, Homo sapiens
cactaccccacaccag

SEQ ID NO: 6003565 - DNA, 17 bp, Homo sapiens
cactaccccacaccagc

SEQ ID NO: 6003566 - DNA, 17 bp, Homo sapiens
cactaccccatatacac

SEQ ID NO: 6003567 - DNA, 20 bp, Homo sapiens
cactaccccatatacacctg

SEQ ID NO: 6003568 - DNA, 21 bp, Homo sapiens
cactaccccatatacacctgg

SEQ ID NO: 6003569 - DNA, 22 bp, Homo sapiens
cactaccccgactatccctgca

SEQ ID NO: 6003570 - DNA, 15 bp, Homo sapiens
cactaccccttgatt

SEQ ID NO: 6003571 - DNA, 22 bp, Homo sapiens
cactaccctgagatctgcacag

SEQ ID NO: 6003572 - DNA, 20 bp, Homo sapiens
cactacccttctcctttcct

SEQ ID NO: 6003573 - DNA, 23 bp, Homo sapiens
cactacccttctcctttccttcc

SEQ ID NO: 6003574 - DNA, 20 bp, Homo sapiens
cactacctcctcagggatgg

SEQ ID NO: 6003575 - DNA, 19 bp, Homo sapiens
cactacctttatagctctc

SEQ ID NO: 6003576 - DNA, 18 bp, Homo sapiens
cactacgcactggacagc

SEQ ID NO: 6003577 - DNA, 21 bp, Homo sapiens
cactacgcactggacagcatc

SEQ ID NO: 6003578 - DNA, 20 bp, Homo sapiens
cactacgtgttcacaggctg

SEQ ID NO: 6003579 - DNA, 18 bp, Homo sapiens
cactactaaaagtttaga

SEQ ID NO: 6003580 - DNA, 16 bp, Homo sapiens
cactactacagaaatt

SEQ ID NO: 6003581 - DNA, 14 bp, Homo sapiens
cactactacatctg

SEQ ID NO: 6003582 - DNA, 18 bp, Homo sapiens
cactactacatctgtgat

SEQ ID NO: 6003583 - DNA, 12 bp, Homo sapiens
cactactacctc

SEQ ID NO: 6003584 - DNA, 19 bp, Homo sapiens
cactactcaatactacctc

SEQ ID NO: 6003585 - DNA, 17 bp, Homo sapiens
cactactcacagtctct

SEQ ID NO: 6003586 - DNA, 23 bp, Homo sapiens
cactactcgagcccacccagcat

SEQ ID NO: 6003587 - DNA, 15 bp, Homo sapiens
cactactcttacatg

SEQ ID NO: 6003588 - DNA, 20 bp, Homo sapiens
cactactcttacatgtataa

SEQ ID NO: 6003589 - DNA, 21 bp, Homo sapiens
cactactgctaccacaactat

SEQ ID NO: 6003590 - DNA, 19 bp, Homo sapiens
cactactgtactccagcca

SEQ ID NO: 6003591 - DNA, 20 bp, Homo sapiens
cactagaaaagctgatcata

SEQ ID NO: 6003592 - DNA, 15 bp, Homo sapiens
cactagaactctcca

SEQ ID NO: 6003593 - DNA, 19 bp, Homo sapiens
cactagaagaaaagcccat

SEQ ID NO: 6003594 - DNA, 16 bp, Homo sapiens
cactagaagtcctgct

SEQ ID NO: 6003595 - DNA, 16 bp, Homo sapiens
cactagaatgagaaat

SEQ ID NO: 6003596 - DNA, 13 bp, Homo sapiens
cactagaatggat

SEQ ID NO: 6003597 - DNA, 14 bp, Homo sapiens
cactagacaaaact

SEQ ID NO: 6003598 - DNA, 14 bp, Homo sapiens
cactagacaagcca

SEQ ID NO: 6003599 - DNA, 23 bp, Homo sapiens
cactagagctgagagtctgaaag

SEQ ID NO: 6003600 - DNA, 15 bp, Homo sapiens
cactagaggccaggg

SEQ ID NO: 6003601 - DNA, 16 bp, Homo sapiens
cactagagtgctctga

SEQ ID NO: 6003602 - DNA, 19 bp, Homo sapiens
cactagatgccaatgacat

SEQ ID NO: 6003603 - DNA, 22 bp, Homo sapiens
cactagcatagaatagcgacag

SEQ ID NO: 6003604 - DNA, 16 bp, Homo sapiens
cactagccaaacctca

SEQ ID NO: 6003605 - DNA, 22 bp, Homo sapiens
cactagccaacccaactgactt

SEQ ID NO: 6003606 - DNA, 19 bp, Homo sapiens
cactagccatgctttatgt

SEQ ID NO: 6003607 - DNA, 19 bp, Homo sapiens
cactagcccaatgaaatga

SEQ ID NO: 6003608 - DNA, 23 bp, Homo sapiens
cactagcccaatgaaatgaatta

SEQ ID NO: 6003609 - DNA, 21 bp, Homo sapiens
cactagccctctttctctctg

SEQ ID NO: 6003610 - DNA, 22 bp, Homo sapiens
cactagccctctttctctctgt

SEQ ID NO: 6003611 - DNA, 23 bp, Homo sapiens
cactagccctctttctctctgtg

SEQ ID NO: 6003612 - DNA, 15 bp, Homo sapiens
cactagcctcagggg

SEQ ID NO: 6003613 - DNA, 18 bp, Homo sapiens
cactagcctccctctcct

SEQ ID NO: 6003614 - DNA, 14 bp, Homo sapiens
cactagcctctcca

SEQ ID NO: 6003615 - DNA, 16 bp, Homo sapiens
cactagcctctccagg

SEQ ID NO: 6003616 - DNA, 21 bp, Homo sapiens
cactagcctctccaggaatgc

SEQ ID NO: 6003617 - DNA, 16 bp, Homo sapiens
cactagcctgtgatta

SEQ ID NO: 6003618 - DNA, 18 bp, Homo sapiens
cactagcctttggctctg

SEQ ID NO: 6003619 - DNA, 20 bp, Homo sapiens
cactagcctttggctctgga

SEQ ID NO: 6003620 - DNA, 22 bp, Homo sapiens
cactagcctttggctctggaga

SEQ ID NO: 6003621 - DNA, 18 bp, Homo sapiens
cactagctaagcaagcca

SEQ ID NO: 6003622 - DNA, 19 bp, Homo sapiens
cactagctaagcaagccag

SEQ ID NO: 6003623 - DNA, 16 bp, Homo sapiens
cagctgctggccaggg

SEQ ID NO: 6003624 - DNA, 16 bp, Homo sapiens
cagctgctggctgtga

SEQ ID NO: 6003625 - DNA, 18 bp, Homo sapiens
cagctgctggctgtgaca

SEQ ID NO: 6003626 - DNA, 17 bp, Homo sapiens
cagctgctgggacccac

SEQ ID NO: 6003627 - DNA, 22 bp, Homo sapiens
cagctgctgggacccacctccc

SEQ ID NO: 6003628 - DNA, 12 bp, Homo sapiens
cagctgctgtct

SEQ ID NO: 6003629 - DNA, 17 bp, Homo sapiens
cagctgctgtctgagta

SEQ ID NO: 6003630 - DNA, 14 bp, Homo sapiens
cagctgctgtcttc

SEQ ID NO: 6003631 - DNA, 14 bp, Homo sapiens
cagctgctgtgccc

SEQ ID NO: 6003632 - DNA, 16 bp, Homo sapiens
cagctgctgtgcccca

SEQ ID NO: 6003633 - DNA, 12 bp, Homo sapiens
cagctgctgtgg

SEQ ID NO: 6003634 - DNA, 22 bp, Homo sapiens
cagctgctgttctcaggacagc

SEQ ID NO: 6003635 - DNA, 9 bp, Homo sapiens
cagctgctt

SEQ ID NO: 6003636 - DNA, 21 bp, Homo sapiens
cagctgcttccccaggctgcc

SEQ ID NO: 6003637 - DNA, 14 bp, Homo sapiens
cagctgcttctccc

SEQ ID NO: 6003638 - DNA, 16 bp, Homo sapiens
cagctgcttctccccc

SEQ ID NO: 6003639 - DNA, 12 bp, Homo sapiens
cagctgcttctg

SEQ ID NO: 6003640 - DNA, 17 bp, Homo sapiens
cagctgcttctgcccac

SEQ ID NO: 6003641 - DNA, 22 bp, Homo sapiens
cagctgcttctgcccaccccgc

SEQ ID NO: 6003642 - DNA, 20 bp, Homo sapiens
cagctgcttctgctgcctag

SEQ ID NO: 6003643 - DNA, 13 bp, Homo sapiens
cagctgcttctgt

SEQ ID NO: 6003644 - DNA, 15 bp, Homo sapiens
cagctgcttgggctt

SEQ ID NO: 6003645 - DNA, 18 bp, Homo sapiens
cagctgcttgggcttcat

SEQ ID NO: 6003646 - DNA, 23 bp, Homo sapiens
cagctgcttgtcctgctctcttc

SEQ ID NO: 6003647 - DNA, 14 bp, Homo sapiens
cagctgcttgtgtc

SEQ ID NO: 6003648 - DNA, 16 bp, Homo sapiens
cagctgcttgtgtccc

SEQ ID NO: 6003649 - DNA, 23 bp, Homo sapiens
cagctgcttgtgtccctcctggg

SEQ ID NO: 6003650 - DNA, 19 bp, Homo sapiens
cagctgcttgttgtcaagt

SEQ ID NO: 6003651 - DNA, 14 bp, Homo sapiens
cagctgctttgagc

SEQ ID NO: 6003652 - DNA, 21 bp, Homo sapiens
cagctgctttgagctacagga

SEQ ID NO: 6003653 - DNA, 22 bp, Homo sapiens
cagctgcttttgtctatgggac

SEQ ID NO: 6003654 - DNA, 14 bp, Homo sapiens
cagctgctttttgt

SEQ ID NO: 6003655 - DNA, 20 bp, Homo sapiens
cagctggaagtctacctgct

SEQ ID NO: 6003656 - DNA, 22 bp, Homo sapiens
cagctggaagtctacctgctgg

SEQ ID NO: 6003657 - DNA, 16 bp, Homo sapiens
cagctggacaccccct

SEQ ID NO: 6003658 - DNA, 16 bp, Homo sapiens
cagctggacagagggg

SEQ ID NO: 6003659 - DNA, 22 bp, Homo sapiens
cagctggacatactgctggagt

SEQ ID NO: 6003660 - DNA, 12 bp, Homo sapiens
cagctggaccat

SEQ ID NO: 6003661 - DNA, 19 bp, Homo sapiens
cagctggaccatctctgta

SEQ ID NO: 6003662 - DNA, 17 bp, Homo sapiens
cagctggactctgcatc

SEQ ID NO: 6003663 - DNA, 16 bp, Homo sapiens
cagctggactgcattg

SEQ ID NO: 6003664 - DNA, 15 bp, Homo sapiens
cagctggacttattt

SEQ ID NO: 6003665 - DNA, 20 bp, Homo sapiens
cagctggagaaatggcatca

SEQ ID NO: 6003666 - DNA, 21 bp, Homo sapiens
cagctggaggaatacatttta

SEQ ID NO: 6003667 - DNA, 15 bp, Homo sapiens
cagctggaggcaggg

SEQ ID NO: 6003668 - DNA, 22 bp, Homo sapiens
cagctggatggggcggcctgca

SEQ ID NO: 6003669 - DNA, 19 bp, Homo sapiens
cagctggattgggttatga

SEQ ID NO: 6003670 - DNA, 16 bp, Homo sapiens
cagctggcactgacag

SEQ ID NO: 6003671 - DNA, 22 bp, Homo sapiens
cagctggcactgacagcctggg

SEQ ID NO: 6003672 - DNA, 13 bp, Homo sapiens
cagctggcagagt

SEQ ID NO: 6003673 - DNA, 23 bp, Homo sapiens
cagctggcagcgcctcccgccgc

SEQ ID NO: 6003674 - DNA, 15 bp, Homo sapiens
cagctggcaggagag

SEQ ID NO: 6003675 - DNA, 22 bp, Homo sapiens
cagctggcaggagagagccttg

SEQ ID NO: 6003676 - DNA, 18 bp, Homo sapiens
cagctggccagatttcct

SEQ ID NO: 6003677 - DNA, 19 bp, Homo sapiens
cagctggccagatttcctc

SEQ ID NO: 6003678 - DNA, 12 bp, Homo sapiens
cagctggcccac

SEQ ID NO: 6003679 - DNA, 13 bp, Homo sapiens
cagctggcccact

SEQ ID NO: 6003680 - DNA, 15 bp, Homo sapiens
cagctggcccccagc

SEQ ID NO: 6003681 - DNA, 18 bp, Homo sapiens
cagctggcccccagccct

SEQ ID NO: 6003682 - DNA, 19 bp, Homo sapiens
cagctggcccgtgacagac

SEQ ID NO: 6003683 - DNA, 19 bp, Homo sapiens
cagctggccggaaggagac

SEQ ID NO: 6003684 - DNA, 19 bp, Homo sapiens
cagctggccgggagcctga

SEQ ID NO: 6003685 - DNA, 22 bp, Homo sapiens
cagctggcctaatcactctgag

SEQ ID NO: 6003686 - DNA, 15 bp, Homo sapiens
cagctggcctctaga

SEQ ID NO: 6003687 - DNA, 20 bp, Homo sapiens
cagctggcctctagaacacc

SEQ ID NO: 6003688 - DNA, 23 bp, Homo sapiens
cagctggcctctagaacacccac

SEQ ID NO: 6003689 - DNA, 16 bp, Homo sapiens
cagctggcctggacag

SEQ ID NO: 6003690 - DNA, 23 bp, Homo sapiens
cagctggcctggggtccctctga

SEQ ID NO: 6003691 - DNA, 21 bp, Homo sapiens
cagctggcgcgtgtgtggcct

SEQ ID NO: 6003692 - DNA, 16 bp, Homo sapiens
cagctggcggaacctg

SEQ ID NO: 6003693 - DNA, 22 bp, Homo sapiens
cagctggcggaacctggctgcg

SEQ ID NO: 6003694 - DNA, 16 bp, Homo sapiens
cagctggcggaggctg

SEQ ID NO: 6003695 - DNA, 17 bp, Homo sapiens
cagctggcggaggctgc

SEQ ID NO: 6003696 - DNA, 18 bp, Homo sapiens
cagctggctatctactac

SEQ ID NO: 6003697 - DNA, 16 bp, Homo sapiens
cagctggctctacttc

SEQ ID NO: 6003698 - DNA, 18 bp, Homo sapiens
cagctggctctacttccc

SEQ ID NO: 6003699 - DNA, 18 bp, Homo sapiens
cagctggctctccacctt

SEQ ID NO: 6003700 - DNA, 20 bp, Homo sapiens
cagctggctctccaccttgt

SEQ ID NO: 6003701 - DNA, 22 bp, Homo sapiens
cagctggctctgaatgtagcca

SEQ ID NO: 6003702 - DNA, 20 bp, Homo sapiens
cagctggctctgacaagatg

SEQ ID NO: 6003703 - DNA, 16 bp, Homo sapiens
cagctggctctgcagc

SEQ ID NO: 6003704 - DNA, 17 bp, Homo sapiens
cagctggctctgcagca

SEQ ID NO: 6003705 - DNA, 19 bp, Homo sapiens
cagctggctctgcagcaca

SEQ ID NO: 6003706 - DNA, 21 bp, Homo sapiens
cagctggctgctgacaggatg

SEQ ID NO: 6003707 - DNA, 11 bp, Homo sapiens
cagctggctgg

SEQ ID NO: 6003708 - DNA, 15 bp, Homo sapiens
cagctggctgggcct

SEQ ID NO: 6003709 - DNA, 19 bp, Homo sapiens
cagctggctgggccttcac

SEQ ID NO: 6003710 - DNA, 13 bp, Homo sapiens
cagctggctgtat

SEQ ID NO: 6003711 - DNA, 17 bp, Homo sapiens
cagctgggaagcccttt

SEQ ID NO: 6003712 - DNA, 11 bp, Homo sapiens
cagctgggacc

SEQ ID NO: 6003713 - DNA, 18 bp, Homo sapiens
cagctgggacccctccca

SEQ ID NO: 6003714 - DNA, 23 bp, Homo sapiens
cagctgggacccctcccaacctc

SEQ ID NO: 6003715 - DNA, 14 bp, Homo sapiens
cagctgggacctaa

SEQ ID NO: 6003716 - DNA, 18 bp, Homo sapiens
cagctgggacctaatgct

SEQ ID NO: 6003717 - DNA, 15 bp, Homo sapiens
cagctgggagaaggg

SEQ ID NO: 6003718 - DNA, 13 bp, Homo sapiens
cagctgggagcac

SEQ ID NO: 6003719 - DNA, 14 bp, Homo sapiens
cagctgggagccag

SEQ ID NO: 6003720 - DNA, 20 bp, Homo sapiens
cagctgggagccagtgtgcc

SEQ ID NO: 6003721 - DNA, 12 bp, Homo sapiens
cagctgggaggc

SEQ ID NO: 6003722 - DNA, 19 bp, Homo sapiens
cagctgggatctgactgca

SEQ ID NO: 6003723 - DNA, 23 bp, Homo sapiens
cagctgggatttgaaccaggcct

SEQ ID NO: 6003724 - DNA, 11 bp, Homo sapiens
cagctgggcaa

SEQ ID NO: 6003725 - DNA, 14 bp, Homo sapiens
cagctgggcaaagc

SEQ ID NO: 6003726 - DNA, 12 bp, Homo sapiens
cagctgggccca

SEQ ID NO: 6003727 - DNA, 17 bp, Homo sapiens
cagctgggcccaaccct

SEQ ID NO: 6003728 - DNA, 15 bp, Homo sapiens
cagctgggcccacag

SEQ ID NO: 6003729 - DNA, 16 bp, Homo sapiens
cagctgggcccacagc

SEQ ID NO: 6003730 - DNA, 13 bp, Homo sapiens
cagctgggcccag

SEQ ID NO: 6003731 - DNA, 19 bp, Homo sapiens
cagctgggccccacctact

SEQ ID NO: 6003732 - DNA, 17 bp, Homo sapiens
cagctgggccccatgct

SEQ ID NO: 6003733 - DNA, 19 bp, Homo sapiens
cagctgggccggccagcct

SEQ ID NO: 6003734 - DNA, 20 bp, Homo sapiens
cagctgggccggccagcctt

SEQ ID NO: 6003735 - DNA, 23 bp, Homo sapiens
cagctgggccgggacccagggcc

SEQ ID NO: 6003736 - DNA, 16 bp, Homo sapiens
cagctgggctctgcaa

SEQ ID NO: 6003737 - DNA, 17 bp, Homo sapiens
cagctgggctgttggct

SEQ ID NO: 6003738 - DNA, 20 bp, Homo sapiens
cagctgggctgttggctggg

SEQ ID NO: 6003739 - DNA, 14 bp, Homo sapiens
cagctgggcttggc

SEQ ID NO: 6003740 - DNA, 21 bp, Homo sapiens
cagctgggcttggcctggaga

SEQ ID NO: 6003741 - DNA, 23 bp, Homo sapiens
cagctggggagatgggggcttct

SEQ ID NO: 6003742 - DNA, 14 bp, Homo sapiens
cagctggggagcag

SEQ ID NO: 6003743 - DNA, 21 bp, Homo sapiens
cagctggggccagaggctggg

SEQ ID NO: 6003744 - DNA, 21 bp, Homo sapiens
cagctggggccaggctgggtc

SEQ ID NO: 6003745 - DNA, 15 bp, Homo sapiens
cagctggggcccctc

SEQ ID NO: 6003746 - DNA, 19 bp, Homo sapiens
cagctggggcccctcggct

SEQ ID NO: 6003747 - DNA, 23 bp, Homo sapiens
cagctggggccggttttcctcag

SEQ ID NO: 6003748 - DNA, 19 bp, Homo sapiens
cagctggggcgtggggagg

SEQ ID NO: 6003749 - DNA, 18 bp, Homo sapiens
cagctggggggcaggggg

SEQ ID NO: 6003750 - DNA, 18 bp, Homo sapiens
cagctggggggctgtcct

SEQ ID NO: 6003751 - DNA, 14 bp, Homo sapiens
cagctggggtgcag

SEQ ID NO: 6003752 - DNA, 15 bp, Homo sapiens
cagctggggtgcagg

SEQ ID NO: 6003753 - DNA, 17 bp, Homo sapiens
cagctggggtgcaggga

SEQ ID NO: 6003754 - DNA, 18 bp, Homo sapiens
cagctggggtgcagggat

SEQ ID NO: 6003755 - DNA, 15 bp, Homo sapiens
cagctgggtcaggca

SEQ ID NO: 6003756 - DNA, 20 bp, Homo sapiens
cagctgggtgccccagggac

SEQ ID NO: 6003757 - DNA, 21 bp, Homo sapiens
cagctgggtggcactgccatg

SEQ ID NO: 6003758 - DNA, 19 bp, Homo sapiens
cagctgggttggtatggag

SEQ ID NO: 6003759 - DNA, 18 bp, Homo sapiens
cagctggtcaacctgctc

SEQ ID NO: 6003760 - DNA, 13 bp, Homo sapiens
cagctggtcctcc

SEQ ID NO: 6003761 - DNA, 23 bp, Homo sapiens
cagctggtgccaaatagccccag

SEQ ID NO: 6003762 - DNA, 24 bp, Homo sapiens
cagctggtgccaaatagccccaga

SEQ ID NO: 6003763 - DNA, 18 bp, Homo sapiens
cagctggtgccccacctg

SEQ ID NO: 6003764 - DNA, 21 bp, Homo sapiens
cagctggtgccccacctgcct

SEQ ID NO: 6003765 - DNA, 14 bp, Homo sapiens
cagctggtgccccc

SEQ ID NO: 6003766 - DNA, 15 bp, Homo sapiens
cagctggtgccccca

SEQ ID NO: 6003767 - DNA, 16 bp, Homo sapiens
cagctggtgcccccag

SEQ ID NO: 6003768 - DNA, 17 bp, Homo sapiens
cagctggtgcccccaga

SEQ ID NO: 6003769 - DNA, 18 bp, Homo sapiens
cagctggtgctgcaagga

SEQ ID NO: 6003770 - DNA, 20 bp, Homo sapiens
cagctggtgctgcaaggaag

SEQ ID NO: 6003771 - DNA, 19 bp, Homo sapiens
cagctggtggatggtgact

SEQ ID NO: 6003772 - DNA, 11 bp, Homo sapiens
cagctggtggc

SEQ ID NO: 6003773 - DNA, 22 bp, Homo sapiens
cagctggtgggaagcgtctgtc

SEQ ID NO: 6003774 - DNA, 21 bp, Homo sapiens
cagctggtgtagctacagaga

SEQ ID NO: 6003775 - DNA, 20 bp, Homo sapiens
cagctggtgtcactctgcct

SEQ ID NO: 6003776 - DNA, 23 bp, Homo sapiens
cagctggtgtcactctgcctcta

SEQ ID NO: 6003777 - DNA, 11 bp, Homo sapiens
cagctggtgtg

SEQ ID NO: 6003778 - DNA, 19 bp, Homo sapiens
cagctggttactcagggtt

SEQ ID NO: 6003779 - DNA, 18 bp, Homo sapiens
cagctggttatccaaatc

SEQ ID NO: 6003780 - DNA, 16 bp, Homo sapiens
cagctggttcgtggtt

SEQ ID NO: 6003781 - DNA, 20 bp, Homo sapiens
cagctgtaacacagctgaga

SEQ ID NO: 6003782 - DNA, 21 bp, Homo sapiens
cagctgtaccggccactgcaa

SEQ ID NO: 6003783 - DNA, 16 bp, Homo sapiens
cagctgtactgagttc

SEQ ID NO: 6003784 - DNA, 12 bp, Homo sapiens
cagctgtagcca

SEQ ID NO: 6003785 - DNA, 18 bp, Homo sapiens
cagctgtagccatggctc

SEQ ID NO: 6003786 - DNA, 23 bp, Homo sapiens
cagctgtagccatggctcaggca

SEQ ID NO: 6003787 - DNA, 17 bp, Homo sapiens
cagctgtagctcccgag

SEQ ID NO: 6003788 - DNA, 18 bp, Homo sapiens
cagctgtagtcatatctg

SEQ ID NO: 6003789 - DNA, 16 bp, Homo sapiens
cagctgtatatatttt

SEQ ID NO: 6003790 - DNA, 18 bp, Homo sapiens
cagctgtatatatttttc

SEQ ID NO: 6003791 - DNA, 16 bp, Homo sapiens
cagctgtatgaggaga

SEQ ID NO: 6003792 - DNA, 19 bp, Homo sapiens
cagctgtatgattcccagc

SEQ ID NO: 6003793 - DNA, 20 bp, Homo sapiens
cagctgtatgattcccagcc

SEQ ID NO: 6003794 - DNA, 14 bp, Homo sapiens
cagctgtcaccact

SEQ ID NO: 6003795 - DNA, 15 bp, Homo sapiens
cagctgtcaccacta

SEQ ID NO: 6003796 - DNA, 14 bp, Homo sapiens
cagctgtcacctgc

SEQ ID NO: 6003797 - DNA, 16 bp, Homo sapiens
cagctgtcacctgctc

SEQ ID NO: 6003798 - DNA, 16 bp, Homo sapiens
cagctgtcattcagga

SEQ ID NO: 6003799 - DNA, 14 bp, Homo sapiens
cagctgtcccccca

SEQ ID NO: 6003800 - DNA, 15 bp, Homo sapiens
cagctgtccccccac

SEQ ID NO: 6003801 - DNA, 21 bp, Homo sapiens
cactagctaagcaagccagga

SEQ ID NO: 6003802 - DNA, 16 bp, Homo sapiens
cactagctagatgctt

SEQ ID NO: 6003803 - DNA, 12 bp, Homo sapiens
cactagctcttg

SEQ ID NO: 6003804 - DNA, 17 bp, Homo sapiens
cactagctgtctcagga

SEQ ID NO: 6003805 - DNA, 21 bp, Homo sapiens
cactaggaatttttttcagta

SEQ ID NO: 6003806 - DNA, 16 bp, Homo sapiens
cactaggactcagaaa

SEQ ID NO: 6003807 - DNA, 14 bp, Homo sapiens
cactaggagactgg

SEQ ID NO: 6003808 - DNA, 21 bp, Homo sapiens
cactaggataggaactgggcc

SEQ ID NO: 6003809 - DNA, 22 bp, Homo sapiens
cactaggataggaactgggcct

SEQ ID NO: 6003810 - DNA, 19 bp, Homo sapiens
cactaggcacccagctgcc

SEQ ID NO: 6003811 - DNA, 13 bp, Homo sapiens
cactaggcaggta

SEQ ID NO: 6003812 - DNA, 14 bp, Homo sapiens
cactaggcccagac

SEQ ID NO: 6003813 - DNA, 20 bp, Homo sapiens
cactaggcccccacttgcct

SEQ ID NO: 6003814 - DNA, 17 bp, Homo sapiens
cactaggcctgaaatga

SEQ ID NO: 6003815 - DNA, 13 bp, Homo sapiens
cactaggctgggt

SEQ ID NO: 6003816 - DNA, 14 bp, Homo sapiens
cactaggctgggtg

SEQ ID NO: 6003817 - DNA, 14 bp, Homo sapiens
cactaggcttctgg

SEQ ID NO: 6003818 - DNA, 22 bp, Homo sapiens
cactagggaaaggtaaatacaa

SEQ ID NO: 6003819 - DNA, 12 bp, Homo sapiens
cactagggaatc

SEQ ID NO: 6003820 - DNA, 12 bp, Homo sapiens
cactagggctga

SEQ ID NO: 6003821 - DNA, 21 bp, Homo sapiens
cactagggctgaggggcctgc

SEQ ID NO: 6003822 - DNA, 16 bp, Homo sapiens
cactaggtaacttatt

SEQ ID NO: 6003823 - DNA, 16 bp, Homo sapiens
cactaggtgcccagtc

SEQ ID NO: 6003824 - DNA, 16 bp, Homo sapiens
cactagtaaaggagga

SEQ ID NO: 6003825 - DNA, 21 bp, Homo sapiens
cactagtaagtaattatgcac

SEQ ID NO: 6003826 - DNA, 14 bp, Homo sapiens
cactagtagagcaa

SEQ ID NO: 6003827 - DNA, 23 bp, Homo sapiens
cactagtagagcaaagacttaat

SEQ ID NO: 6003828 - DNA, 21 bp, Homo sapiens
cactagtgaccccttccctgt

SEQ ID NO: 6003829 - DNA, 15 bp, Homo sapiens
cactagtgcaaatca

SEQ ID NO: 6003830 - DNA, 23 bp, Homo sapiens
cactagtgcaattccaagaaaat

SEQ ID NO: 6003831 - DNA, 18 bp, Homo sapiens
cactagttgtcagcttct

SEQ ID NO: 6003832 - DNA, 17 bp, Homo sapiens
cactagttttgtgccag

SEQ ID NO: 6003833 - DNA, 12 bp, Homo sapiens
cactataaatgg

SEQ ID NO: 6003834 - DNA, 19 bp, Homo sapiens
cactataaatggtgttttt

SEQ ID NO: 6003835 - DNA, 22 bp, Homo sapiens
cactataaccatcagttactgg

SEQ ID NO: 6003836 - DNA, 17 bp, Homo sapiens
cactataaggctgaggg

SEQ ID NO: 6003837 - DNA, 18 bp, Homo sapiens
cactataaggctgagggc

SEQ ID NO: 6003838 - DNA, 14 bp, Homo sapiens
cactataatgtaag

SEQ ID NO: 6003839 - DNA, 15 bp, Homo sapiens
cactatacaaacaaa

SEQ ID NO: 6003840 - DNA, 23 bp, Homo sapiens
cactatactctaaaatggacatt

SEQ ID NO: 6003841 - DNA, 13 bp, Homo sapiens
cactatagtgtaa

SEQ ID NO: 6003842 - DNA, 15 bp, Homo sapiens
cactatagtgtaata

SEQ ID NO: 6003843 - DNA, 17 bp, Homo sapiens
cactatagtttaaaaca

SEQ ID NO: 6003844 - DNA, 23 bp, Homo sapiens
cactatagtttaatactcagagg

SEQ ID NO: 6003845 - DNA, 13 bp, Homo sapiens
cactatataaata

SEQ ID NO: 6003846 - DNA, 15 bp, Homo sapiens
cactatataaataag

SEQ ID NO: 6003847 - DNA, 17 bp, Homo sapiens
cactatatcttcccatt

SEQ ID NO: 6003848 - DNA, 11 bp, Homo sapiens
cactatattta

SEQ ID NO: 6003849 - DNA, 14 bp, Homo sapiens
cactatatttgtat

SEQ ID NO: 6003850 - DNA, 23 bp, Homo sapiens
cactatatttgtatatattttat

SEQ ID NO: 6003851 - DNA, 12 bp, Homo sapiens
cactatcaattt

SEQ ID NO: 6003852 - DNA, 13 bp, Homo sapiens
cactatccatgca

SEQ ID NO: 6003853 - DNA, 16 bp, Homo sapiens
cactatccatgcacca

SEQ ID NO: 6003854 - DNA, 17 bp, Homo sapiens
cactatctgggtgcatg

SEQ ID NO: 6003855 - DNA, 14 bp, Homo sapiens
cactatcttcttca

SEQ ID NO: 6003856 - DNA, 18 bp, Homo sapiens
cactatcttcttcaaata

SEQ ID NO: 6003857 - DNA, 22 bp, Homo sapiens
cactatctttcaggaaattttt

SEQ ID NO: 6003858 - DNA, 17 bp, Homo sapiens
cactatctttctgataa

SEQ ID NO: 6003859 - DNA, 21 bp, Homo sapiens
cactatgaagatgtttcaaaa

SEQ ID NO: 6003860 - DNA, 15 bp, Homo sapiens
cactatgattttcta

SEQ ID NO: 6003861 - DNA, 13 bp, Homo sapiens
cactatgcacaga

SEQ ID NO: 6003862 - DNA, 16 bp, Homo sapiens
cactatgcacagagcc

SEQ ID NO: 6003863 - DNA, 17 bp, Homo sapiens
cactatgcacagagccc

SEQ ID NO: 6003864 - DNA, 15 bp, Homo sapiens
cactatgctttcctt

SEQ ID NO: 6003865 - DNA, 23 bp, Homo sapiens
cactatgggtggggcactccttt

SEQ ID NO: 6003866 - DNA, 20 bp, Homo sapiens
cactatggtatgctggccag

SEQ ID NO: 6003867 - DNA, 15 bp, Homo sapiens
cactatgtgtgttgt

SEQ ID NO: 6003868 - DNA, 21 bp, Homo sapiens
cactatgtgtgttgtttccat

SEQ ID NO: 6003869 - DNA, 15 bp, Homo sapiens
cactatgttgcccag

SEQ ID NO: 6003870 - DNA, 18 bp, Homo sapiens
cactatgttgcccaggca

SEQ ID NO: 6003871 - DNA, 21 bp, Homo sapiens
cactatgttgcccaggcaggt

SEQ ID NO: 6003872 - DNA, 13 bp, Homo sapiens
cactattagagaa

SEQ ID NO: 6003873 - DNA, 21 bp, Homo sapiens
cactattcagaacttgtaact

SEQ ID NO: 6003874 - DNA, 13 bp, Homo sapiens
cactattcatcaa

SEQ ID NO: 6003875 - DNA, 21 bp, Homo sapiens
cactattcatcaatgaagatt

SEQ ID NO: 6003876 - DNA, 16 bp, Homo sapiens
cactattcttaagcac

SEQ ID NO: 6003877 - DNA, 17 bp, Homo sapiens
cactattcttaagcact

SEQ ID NO: 6003878 - DNA, 18 bp, Homo sapiens
cactattcttaagcactt

SEQ ID NO: 6003879 - DNA, 19 bp, Homo sapiens
cactattcttaagcacttt

SEQ ID NO: 6003880 - DNA, 15 bp, Homo sapiens
cactattgcattgtt

SEQ ID NO: 6003881 - DNA, 21 bp, Homo sapiens
cactattgtgaatatttggaa

SEQ ID NO: 6003882 - DNA, 13 bp, Homo sapiens
cactatttaaact

SEQ ID NO: 6003883 - DNA, 19 bp, Homo sapiens
cactatttatctgtgcaaa

SEQ ID NO: 6003884 - DNA, 18 bp, Homo sapiens
cactatttatttacaaat

SEQ ID NO: 6003885 - DNA, 14 bp, Homo sapiens
cactatttccaaaa

SEQ ID NO: 6003886 - DNA, 17 bp, Homo sapiens
cactatttgcagaggct

SEQ ID NO: 6003887 - DNA, 15 bp, Homo sapiens
cactattttatattt

SEQ ID NO: 6003888 - DNA, 14 bp, Homo sapiens
cactattttatgca

SEQ ID NO: 6003889 - DNA, 12 bp, Homo sapiens
cactattttcag

SEQ ID NO: 6003890 - DNA, 21 bp, Homo sapiens
cactattttcagaatctgaat

SEQ ID NO: 6003891 - DNA, 23 bp, Homo sapiens
cactatttttatttatatttttg

SEQ ID NO: 6003892 - DNA, 21 bp, Homo sapiens
cactcaaaaaggtgtgtcaaa

SEQ ID NO: 6003893 - DNA, 22 bp, Homo sapiens
cactcaaaaaggtgtgtcaaag

SEQ ID NO: 6003894 - DNA, 15 bp, Homo sapiens
cactcaaaagacaaa

SEQ ID NO: 6003895 - DNA, 18 bp, Homo sapiens
cactcaaaagacaaacat

SEQ ID NO: 6003896 - DNA, 20 bp, Homo sapiens
cactcaaaagctgggcaggt

SEQ ID NO: 6003897 - DNA, 14 bp, Homo sapiens
cactcaaaatatgt

SEQ ID NO: 6003898 - DNA, 15 bp, Homo sapiens
cactcaaagagggtg

SEQ ID NO: 6003899 - DNA, 23 bp, Homo sapiens
cactcaaagagggtgagggcctt

SEQ ID NO: 6003900 - DNA, 17 bp, Homo sapiens
cactcaaatcttaagaa

SEQ ID NO: 6003901 - DNA, 18 bp, Homo sapiens
cactcaaatcttaagaaa

SEQ ID NO: 6003902 - DNA, 16 bp, Homo sapiens
cactcaaatgaatttg

SEQ ID NO: 6003903 - DNA, 17 bp, Homo sapiens
cactcaaatgaatttgc

SEQ ID NO: 6003904 - DNA, 16 bp, Homo sapiens
cactcaaattaatctt

SEQ ID NO: 6003905 - DNA, 19 bp, Homo sapiens
cactcaaattaatctttct

SEQ ID NO: 6003906 - DNA, 14 bp, Homo sapiens
cactcaacatgagt

SEQ ID NO: 6003907 - DNA, 17 bp, Homo sapiens
cactcaaccaacctccc

SEQ ID NO: 6003908 - DNA, 18 bp, Homo sapiens
cactcaaccataacactt

SEQ ID NO: 6003909 - DNA, 18 bp, Homo sapiens
cactcaaccatgacctca

SEQ ID NO: 6003910 - DNA, 19 bp, Homo sapiens
cactcaactctgagcccat

SEQ ID NO: 6003911 - DNA, 20 bp, Homo sapiens
cactcaactctgagcccata

SEQ ID NO: 6003912 - DNA, 17 bp, Homo sapiens
cactcaagcaacaagcc

SEQ ID NO: 6003913 - DNA, 16 bp, Homo sapiens
cactcaagcactgata

SEQ ID NO: 6003914 - DNA, 19 bp, Homo sapiens
cactcaagccagtgttgct

SEQ ID NO: 6003915 - DNA, 13 bp, Homo sapiens
cactcaagcctga

SEQ ID NO: 6003916 - DNA, 14 bp, Homo sapiens
cactcaagcctgag

SEQ ID NO: 6003917 - DNA, 18 bp, Homo sapiens
cactcaaggacaggagcc

SEQ ID NO: 6003918 - DNA, 20 bp, Homo sapiens
cactcaaggacaggagcctg

SEQ ID NO: 6003919 - DNA, 17 bp, Homo sapiens
cactcaaggcggtgctt

SEQ ID NO: 6003920 - DNA, 17 bp, Homo sapiens
cactcaatatgtgattt

SEQ ID NO: 6003921 - DNA, 22 bp, Homo sapiens
cactcaatgcagccagacctat

SEQ ID NO: 6003922 - DNA, 16 bp, Homo sapiens
cactcaatgggagaat

SEQ ID NO: 6003923 - DNA, 17 bp, Homo sapiens
cactcacaacagctgcc

SEQ ID NO: 6003924 - DNA, 19 bp, Homo sapiens
cactcacaatcatcttctc

SEQ ID NO: 6003925 - DNA, 16 bp, Homo sapiens
cactcacacagccagg

SEQ ID NO: 6003926 - DNA, 23 bp, Homo sapiens
cactcacacagccaggtgccttg

SEQ ID NO: 6003927 - DNA, 21 bp, Homo sapiens
cactcacacaggacccccttc

SEQ ID NO: 6003928 - DNA, 18 bp, Homo sapiens
cactcacagagacacagg

SEQ ID NO: 6003929 - DNA, 22 bp, Homo sapiens
cactcacagagtcaaggcctgc

SEQ ID NO: 6003930 - DNA, 23 bp, Homo sapiens
cactcacagagtcaaggcctgct

SEQ ID NO: 6003931 - DNA, 17 bp, Homo sapiens
cactcacagggagctgg

SEQ ID NO: 6003932 - DNA, 13 bp, Homo sapiens
cactcacattttc

SEQ ID NO: 6003933 - DNA, 21 bp, Homo sapiens
cactcaccacaagctgagcag

SEQ ID NO: 6003934 - DNA, 12 bp, Homo sapiens
cactcaccagcc

SEQ ID NO: 6003935 - DNA, 18 bp, Homo sapiens
cactcaccagccctagct

SEQ ID NO: 6003936 - DNA, 15 bp, Homo sapiens
cactcaccagggtcc

SEQ ID NO: 6003937 - DNA, 24 bp, Homo sapiens
cactcaccagggtccgcaccagct

SEQ ID NO: 6003938 - DNA, 15 bp, Homo sapiens
cactcaccagtccta

SEQ ID NO: 6003939 - DNA, 17 bp, Homo sapiens
cactcaccagtggcctt

SEQ ID NO: 6003940 - DNA, 18 bp, Homo sapiens
cactcaccagtggccttt

SEQ ID NO: 6003941 - DNA, 17 bp, Homo sapiens
cactcaccccagcctca

SEQ ID NO: 6003942 - DNA, 15 bp, Homo sapiens
cactcacccttcctg

SEQ ID NO: 6003943 - DNA, 16 bp, Homo sapiens
cactcacccttcctgg

SEQ ID NO: 6003944 - DNA, 21 bp, Homo sapiens
cactcacccttcctggcccag

SEQ ID NO: 6003945 - DNA, 17 bp, Homo sapiens
cactcacctttctccac

SEQ ID NO: 6003946 - DNA, 16 bp, Homo sapiens
cactcactaggccccc

SEQ ID NO: 6003947 - DNA, 23 bp, Homo sapiens
cactcactccaagaccaccaggg

SEQ ID NO: 6003948 - DNA, 13 bp, Homo sapiens
cactcactccagc

SEQ ID NO: 6003949 - DNA, 15 bp, Homo sapiens
cactcactccagccc

SEQ ID NO: 6003950 - DNA, 14 bp, Homo sapiens
cactcactccccac

SEQ ID NO: 6003951 - DNA, 21 bp, Homo sapiens
cactcactgaagcccagacct

SEQ ID NO: 6003952 - DNA, 17 bp, Homo sapiens
cactcactgaggccatc

SEQ ID NO: 6003953 - DNA, 13 bp, Homo sapiens
cactcactgcatt

SEQ ID NO: 6003954 - DNA, 11 bp, Homo sapiens
cactcactgtt

SEQ ID NO: 6003955 - DNA, 14 bp, Homo sapiens
cactcactgtttat

SEQ ID NO: 6003956 - DNA, 24 bp, Homo sapiens
cactcagaaaagacgcaccagccc

SEQ ID NO: 6003957 - DNA, 16 bp, Homo sapiens
cactcagaaaattccc

SEQ ID NO: 6003958 - DNA, 22 bp, Homo sapiens
cactcagaaaattccctggggt

SEQ ID NO: 6003959 - DNA, 19 bp, Homo sapiens
cactcagaactctccaggg

SEQ ID NO: 6003960 - DNA, 17 bp, Homo sapiens
cactcagaagacactga

SEQ ID NO: 6003961 - DNA, 18 bp, Homo sapiens
cactcagaagacactgat

SEQ ID NO: 6003962 - DNA, 16 bp, Homo sapiens
cactcagaagcctggg

SEQ ID NO: 6003963 - DNA, 17 bp, Homo sapiens
cactcagaagcctgggg

SEQ ID NO: 6003964 - DNA, 13 bp, Homo sapiens
cactcagaattat

SEQ ID NO: 6003965 - DNA, 12 bp, Homo sapiens
cactcagagcag

SEQ ID NO: 6003966 - DNA, 15 bp, Homo sapiens
cactcagaggccccc

SEQ ID NO: 6003967 - DNA, 18 bp, Homo sapiens
cactcagatcctcctcat

SEQ ID NO: 6003968 - DNA, 16 bp, Homo sapiens
cactcagcaccactca

SEQ ID NO: 6003969 - DNA, 14 bp, Homo sapiens
cactcagcactctg

SEQ ID NO: 6003970 - DNA, 16 bp, Homo sapiens
cactcagcactctgga

SEQ ID NO: 6003971 - DNA, 13 bp, Homo sapiens
cactcagccacaa

SEQ ID NO: 6003972 - DNA, 12 bp, Homo sapiens
cactcagccacg

SEQ ID NO: 6003973 - DNA, 17 bp, Homo sapiens
cactcagccacgaccag

SEQ ID NO: 6003974 - DNA, 21 bp, Homo sapiens
cactcagccacgaccagcccc

SEQ ID NO: 6003975 - DNA, 16 bp, Homo sapiens
cactcagccactgtca

SEQ ID NO: 6003976 - DNA, 18 bp, Homo sapiens
cactcagccactgtcaca

SEQ ID NO: 6003977 - DNA, 19 bp, Homo sapiens
cactcagccactgtcacag

SEQ ID NO: 6003978 - DNA, 16 bp, Homo sapiens
cactcagcccctaccc

SEQ ID NO: 6003979 - DNA, 18 bp, Homo sapiens
cactcagcccctaggagt

SEQ ID NO: 6003980 - DNA, 22 bp, Homo sapiens
cactcagcccctaggagtatat

SEQ ID NO: 6003981 - DNA, 16 bp, Homo sapiens
cagctgtccccccact

SEQ ID NO: 6003982 - DNA, 21 bp, Homo sapiens
cagctgtcccctctccctggg

SEQ ID NO: 6003983 - DNA, 21 bp, Homo sapiens
cagctgtccctgcccttcttc

SEQ ID NO: 6003984 - DNA, 14 bp, Homo sapiens
cagctgtccctgtc

SEQ ID NO: 6003985 - DNA, 16 bp, Homo sapiens
cagctgtccctgtcac

SEQ ID NO: 6003986 - DNA, 16 bp, Homo sapiens
cagctgtcctgtgatg

SEQ ID NO: 6003987 - DNA, 17 bp, Homo sapiens
cagctgtcgggggccac

SEQ ID NO: 6003988 - DNA, 12 bp, Homo sapiens
cagctgtctcta

SEQ ID NO: 6003989 - DNA, 14 bp, Homo sapiens
cagctgtctgccag

SEQ ID NO: 6003990 - DNA, 16 bp, Homo sapiens
cagctgtctgccaggc

SEQ ID NO: 6003991 - DNA, 19 bp, Homo sapiens
cagctgtctgtcatctgct

SEQ ID NO: 6003992 - DNA, 14 bp, Homo sapiens
cagctgtctgtggc

SEQ ID NO: 6003993 - DNA, 18 bp, Homo sapiens
cagctgtcttttggagga

SEQ ID NO: 6003994 - DNA, 19 bp, Homo sapiens
cagctgtgactgagggcct

SEQ ID NO: 6003995 - DNA, 17 bp, Homo sapiens
cagctgtgagaagtcac

SEQ ID NO: 6003996 - DNA, 18 bp, Homo sapiens
cagctgtgagccatgcct

SEQ ID NO: 6003997 - DNA, 23 bp, Homo sapiens
cagctgtgagccatgcctccctg

SEQ ID NO: 6003998 - DNA, 13 bp, Homo sapiens
cagctgtgagcct

SEQ ID NO: 6003999 - DNA, 16 bp, Homo sapiens
cagctgtgagccttgg

SEQ ID NO: 6004000 - DNA, 14 bp, Homo sapiens
cagctgtgagcttt

SEQ ID NO: 6004001 - DNA, 10 bp, Homo sapiens
cagctgtgat

SEQ ID NO: 6004002 - DNA, 17 bp, Homo sapiens
cagctgtgcagcacgtc

SEQ ID NO: 6004003 - DNA, 15 bp, Homo sapiens
cagctgtgcccctcc

SEQ ID NO: 6004004 - DNA, 20 bp, Homo sapiens
cagctgtgccgggaggcagc

SEQ ID NO: 6004005 - DNA, 11 bp, Homo sapiens
cagctgtgctc

SEQ ID NO: 6004006 - DNA, 16 bp, Homo sapiens
cagctgtgctccacac

SEQ ID NO: 6004007 - DNA, 22 bp, Homo sapiens
cagctgtgctccacactcagaa

SEQ ID NO: 6004008 - DNA, 20 bp, Homo sapiens
cagctgtgctctggacaggc

SEQ ID NO: 6004009 - DNA, 15 bp, Homo sapiens
cagctgtgctgcacc

SEQ ID NO: 6004010 - DNA, 15 bp, Homo sapiens
cagctgtgctgggag

SEQ ID NO: 6004011 - DNA, 21 bp, Homo sapiens
cagctgtgctttttgcaaaag

SEQ ID NO: 6004012 - DNA, 16 bp, Homo sapiens
cagctgtggcagagtt

SEQ ID NO: 6004013 - DNA, 17 bp, Homo sapiens
cagctgtggcagagtta

SEQ ID NO: 6004014 - DNA, 19 bp, Homo sapiens
cagctgtggcagagttaca

SEQ ID NO: 6004015 - DNA, 18 bp, Homo sapiens
cagctgtgggcggctcct

SEQ ID NO: 6004016 - DNA, 21 bp, Homo sapiens
cagctgtggggaacacagcta

SEQ ID NO: 6004017 - DNA, 22 bp, Homo sapiens
cagctgtggggaacacagctac

SEQ ID NO: 6004018 - DNA, 22 bp, Homo sapiens
cagctgtggtacaaatgtgata

SEQ ID NO: 6004019 - DNA, 15 bp, Homo sapiens
cagctgtggtcccac

SEQ ID NO: 6004020 - DNA, 16 bp, Homo sapiens
cagctgtggtcccacc

SEQ ID NO: 6004021 - DNA, 22 bp, Homo sapiens
cagctgtgtccaaaaccgccag

SEQ ID NO: 6004022 - DNA, 11 bp, Homo sapiens
cagctgtgtct

SEQ ID NO: 6004023 - DNA, 15 bp, Homo sapiens
cagctgtgtctgagc

SEQ ID NO: 6004024 - DNA, 16 bp, Homo sapiens
cagctgtgtctgagcc

SEQ ID NO: 6004025 - DNA, 21 bp, Homo sapiens
cagctgtgtctgagcccaacc

SEQ ID NO: 6004026 - DNA, 22 bp, Homo sapiens
cagctgtgtctgccaaacacat

SEQ ID NO: 6004027 - DNA, 23 bp, Homo sapiens
cagctgtgtgacatttggagagg

SEQ ID NO: 6004028 - DNA, 17 bp, Homo sapiens
cagctgtgtgggctgca

SEQ ID NO: 6004029 - DNA, 13 bp, Homo sapiens
cagctgtgtgttt

SEQ ID NO: 6004030 - DNA, 15 bp, Homo sapiens
cagctgttcagctgg

SEQ ID NO: 6004031 - DNA, 19 bp, Homo sapiens
cagctgttcagctggttga

SEQ ID NO: 6004032 - DNA, 14 bp, Homo sapiens
cagctgttgactct

SEQ ID NO: 6004033 - DNA, 23 bp, Homo sapiens
cagctgttgcagatgaaatgttc

SEQ ID NO: 6004034 - DNA, 16 bp, Homo sapiens
cagctgttgcaggcag

SEQ ID NO: 6004035 - DNA, 14 bp, Homo sapiens
cagctgttgtctct

SEQ ID NO: 6004036 - DNA, 19 bp, Homo sapiens
cagctgttgtctcttctcc

SEQ ID NO: 6004037 - DNA, 17 bp, Homo sapiens
cagctgtttctcatgaa

SEQ ID NO: 6004038 - DNA, 13 bp, Homo sapiens
cagctgtttgaaa

SEQ ID NO: 6004039 - DNA, 14 bp, Homo sapiens
cagctgtttgaaat

SEQ ID NO: 6004040 - DNA, 21 bp, Homo sapiens
cagctgtttgaaatgtttaat

SEQ ID NO: 6004041 - DNA, 23 bp, Homo sapiens
cagctgtttgaaatgtttaataa

SEQ ID NO: 6004042 - DNA, 15 bp, Homo sapiens
cagctgttttcaaag

SEQ ID NO: 6004043 - DNA, 16 bp, Homo sapiens
cagctgttttcaaagc

SEQ ID NO: 6004044 - DNA, 18 bp, Homo sapiens
cagctgttttcaaagccc

SEQ ID NO: 6004045 - DNA, 21 bp, Homo sapiens
cagctgttttcaaagcccccg

SEQ ID NO: 6004046 - DNA, 22 bp, Homo sapiens
cagctgtttttaggctgttcct

SEQ ID NO: 6004047 - DNA, 13 bp, Homo sapiens
cagcttaaaccca

SEQ ID NO: 6004048 - DNA, 16 bp, Homo sapiens
cagcttaaatcctagc

SEQ ID NO: 6004049 - DNA, 16 bp, Homo sapiens
cagcttaacaatgcaa

SEQ ID NO: 6004050 - DNA, 14 bp, Homo sapiens
cagcttaataagta

SEQ ID NO: 6004051 - DNA, 20 bp, Homo sapiens
cagcttaattctccttccca

SEQ ID NO: 6004052 - DNA, 22 bp, Homo sapiens
cagcttaattctccttcccaga

SEQ ID NO: 6004053 - DNA, 13 bp, Homo sapiens
cagcttacaggag

SEQ ID NO: 6004054 - DNA, 15 bp, Homo sapiens
cagcttacaggagcc

SEQ ID NO: 6004055 - DNA, 17 bp, Homo sapiens
cagcttacaggagccag

SEQ ID NO: 6004056 - DNA, 23 bp, Homo sapiens
cagcttagaagttcgaaaactca

SEQ ID NO: 6004057 - DNA, 16 bp, Homo sapiens
cagcttagagttcttc

SEQ ID NO: 6004058 - DNA, 18 bp, Homo sapiens
cagcttagagttggccat

SEQ ID NO: 6004059 - DNA, 19 bp, Homo sapiens
cagcttagatttcatagtt

SEQ ID NO: 6004060 - DNA, 14 bp, Homo sapiens
cagcttagggccct

SEQ ID NO: 6004061 - DNA, 17 bp, Homo sapiens
cagcttagggccctgga

SEQ ID NO: 6004062 - DNA, 14 bp, Homo sapiens
cagcttataatgaa

SEQ ID NO: 6004063 - DNA, 18 bp, Homo sapiens
cagcttataatgggctct

SEQ ID NO: 6004064 - DNA, 19 bp, Homo sapiens
cagcttatacgaaataatt

SEQ ID NO: 6004065 - DNA, 15 bp, Homo sapiens
cagcttatctctttt

SEQ ID NO: 6004066 - DNA, 23 bp, Homo sapiens
cagcttatctcttttatatttgt

SEQ ID NO: 6004067 - DNA, 13 bp, Homo sapiens
cagcttcaaataa

SEQ ID NO: 6004068 - DNA, 17 bp, Homo sapiens
cagcttcaagtgccttt

SEQ ID NO: 6004069 - DNA, 13 bp, Homo sapiens
cagcttcaccaga

SEQ ID NO: 6004070 - DNA, 14 bp, Homo sapiens
cagcttcacccacc

SEQ ID NO: 6004071 - DNA, 21 bp, Homo sapiens
cagcttcacccaccaggccag

SEQ ID NO: 6004072 - DNA, 16 bp, Homo sapiens
cagcttcaccctgtca

SEQ ID NO: 6004073 - DNA, 16 bp, Homo sapiens
cagcttcagaaagagc

SEQ ID NO: 6004074 - DNA, 23 bp, Homo sapiens
cagcttcagaaagagctcaaaat

SEQ ID NO: 6004075 - DNA, 13 bp, Homo sapiens
cagcttcagctca

SEQ ID NO: 6004076 - DNA, 14 bp, Homo sapiens
cagcttcaggcacc

SEQ ID NO: 6004077 - DNA, 15 bp, Homo sapiens
cagcttcaggcacca

SEQ ID NO: 6004078 - DNA, 18 bp, Homo sapiens
cagcttcaggcaccagca

SEQ ID NO: 6004079 - DNA, 21 bp, Homo sapiens
cagcttcaggcaccagcatcc

SEQ ID NO: 6004080 - DNA, 14 bp, Homo sapiens
cagcttcaggtgac

SEQ ID NO: 6004081 - DNA, 18 bp, Homo sapiens
cagcttcaggtgagccaa

SEQ ID NO: 6004082 - DNA, 19 bp, Homo sapiens
cagcttcatcaatttttat

SEQ ID NO: 6004083 - DNA, 18 bp, Homo sapiens
cagcttcatgcctttgta

SEQ ID NO: 6004084 - DNA, 21 bp, Homo sapiens
cagcttcatgcctttgtaagt

SEQ ID NO: 6004085 - DNA, 10 bp, Homo sapiens
cagcttcatt

SEQ ID NO: 6004086 - DNA, 20 bp, Homo sapiens
cagcttcattatctgagttg

SEQ ID NO: 6004087 - DNA, 15 bp, Homo sapiens
cagcttcattatgca

SEQ ID NO: 6004088 - DNA, 17 bp, Homo sapiens
cagcttcatttccgtga

SEQ ID NO: 6004089 - DNA, 21 bp, Homo sapiens
cagcttcatttccgtgaaggg

SEQ ID NO: 6004090 - DNA, 23 bp, Homo sapiens
cagcttcatttccgtgaagggca

SEQ ID NO: 6004091 - DNA, 15 bp, Homo sapiens
cagcttcatttcctg

SEQ ID NO: 6004092 - DNA, 19 bp, Homo sapiens
cagcttcatttcctgtgtc

SEQ ID NO: 6004093 - DNA, 17 bp, Homo sapiens
cagcttccaaagcctag

SEQ ID NO: 6004094 - DNA, 13 bp, Homo sapiens
cagcttccagatg

SEQ ID NO: 6004095 - DNA, 20 bp, Homo sapiens
cagcttccagatgatccttg

SEQ ID NO: 6004096 - DNA, 17 bp, Homo sapiens
cagcttccagcaggagg

SEQ ID NO: 6004097 - DNA, 12 bp, Homo sapiens
cagcttcccagc

SEQ ID NO: 6004098 - DNA, 19 bp, Homo sapiens
cagcttcccagccatgccc

SEQ ID NO: 6004099 - DNA, 22 bp, Homo sapiens
cagcttccccaggagctctctg

SEQ ID NO: 6004100 - DNA, 23 bp, Homo sapiens
cagcttccccaggagctctctgc

SEQ ID NO: 6004101 - DNA, 22 bp, Homo sapiens
cagcttcccctctctcctcctg

SEQ ID NO: 6004102 - DNA, 23 bp, Homo sapiens
cagcttcccctctctcctcctgc

SEQ ID NO: 6004103 - DNA, 19 bp, Homo sapiens
cagcttcctacccacacct

SEQ ID NO: 6004104 - DNA, 21 bp, Homo sapiens
cagcttcctcacacccctgtc

SEQ ID NO: 6004105 - DNA, 13 bp, Homo sapiens
cagcttcctgagt

SEQ ID NO: 6004106 - DNA, 16 bp, Homo sapiens
cagcttcctgtgcaga

SEQ ID NO: 6004107 - DNA, 16 bp, Homo sapiens
cagcttccttcagaga

SEQ ID NO: 6004108 - DNA, 19 bp, Homo sapiens
cagcttccttcagagagca

SEQ ID NO: 6004109 - DNA, 17 bp, Homo sapiens
cagcttccttctgggac

SEQ ID NO: 6004110 - DNA, 20 bp, Homo sapiens
cagcttcctttcctgtgtgt

SEQ ID NO: 6004111 - DNA, 15 bp, Homo sapiens
cagcttcgaggacag

SEQ ID NO: 6004112 - DNA, 17 bp, Homo sapiens
cagcttcgaggacagga

SEQ ID NO: 6004113 - DNA, 22 bp, Homo sapiens
cagcttcgaggacaggaaaggc

SEQ ID NO: 6004114 - DNA, 20 bp, Homo sapiens
cagcttcggagggcccctgc

SEQ ID NO: 6004115 - DNA, 12 bp, Homo sapiens
cagcttcggggc

SEQ ID NO: 6004116 - DNA, 17 bp, Homo sapiens
cagcttcggtgtgcaga

SEQ ID NO: 6004117 - DNA, 17 bp, Homo sapiens
cagcttcgtgcctgggt

SEQ ID NO: 6004118 - DNA, 12 bp, Homo sapiens
cagcttctaaga

SEQ ID NO: 6004119 - DNA, 18 bp, Homo sapiens
cagcttctcatcctgcag

SEQ ID NO: 6004120 - DNA, 17 bp, Homo sapiens
cagcttctccaagcatc

SEQ ID NO: 6004121 - DNA, 17 bp, Homo sapiens
cagcttctcctgcgccc

SEQ ID NO: 6004122 - DNA, 15 bp, Homo sapiens
cagcttctcctgtgt

SEQ ID NO: 6004123 - DNA, 17 bp, Homo sapiens
cagcttctctctccagg

SEQ ID NO: 6004124 - DNA, 18 bp, Homo sapiens
cagcttctctctccctgt

SEQ ID NO: 6004125 - DNA, 24 bp, Homo sapiens
cagcttctctctccctgtcacaca

SEQ ID NO: 6004126 - DNA, 14 bp, Homo sapiens
cagcttctctgcag

SEQ ID NO: 6004127 - DNA, 16 bp, Homo sapiens
cagcttctctgcagta

SEQ ID NO: 6004128 - DNA, 22 bp, Homo sapiens
cagcttctctgctagatttcta

SEQ ID NO: 6004129 - DNA, 18 bp, Homo sapiens
cagcttctgccacttccc

SEQ ID NO: 6004130 - DNA, 14 bp, Homo sapiens
cagcttctgccccc

SEQ ID NO: 6004131 - DNA, 20 bp, Homo sapiens
cagcttctgccccctgcaga

SEQ ID NO: 6004132 - DNA, 14 bp, Homo sapiens
cagcttctgctggg

SEQ ID NO: 6004133 - DNA, 22 bp, Homo sapiens
cagcttctggtactctcctaga

SEQ ID NO: 6004134 - DNA, 23 bp, Homo sapiens
cagcttctggtactctcctagag

SEQ ID NO: 6004135 - DNA, 16 bp, Homo sapiens
cagcttcttgcttgta

SEQ ID NO: 6004136 - DNA, 16 bp, Homo sapiens
cagcttcttgggctga

SEQ ID NO: 6004137 - DNA, 12 bp, Homo sapiens
cagcttcttttg

SEQ ID NO: 6004138 - DNA, 14 bp, Homo sapiens
cagcttgaacctgc

SEQ ID NO: 6004139 - DNA, 18 bp, Homo sapiens
cagcttgaacctgcttcc

SEQ ID NO: 6004140 - DNA, 19 bp, Homo sapiens
cagcttgacattatgtttt

SEQ ID NO: 6004141 - DNA, 19 bp, Homo sapiens
cagcttgaccgtgaggcca

SEQ ID NO: 6004142 - DNA, 20 bp, Homo sapiens
cagcttgaccgtgaggccag

SEQ ID NO: 6004143 - DNA, 16 bp, Homo sapiens
cagcttgacctgaggc

SEQ ID NO: 6004144 - DNA, 20 bp, Homo sapiens
cagcttgacctgaggctgtg

SEQ ID NO: 6004145 - DNA, 22 bp, Homo sapiens
cagcttgacctgaggctgtggt

SEQ ID NO: 6004146 - DNA, 15 bp, Homo sapiens
cagcttgactgcttt

SEQ ID NO: 6004147 - DNA, 16 bp, Homo sapiens
cagcttgactgctttt

SEQ ID NO: 6004148 - DNA, 16 bp, Homo sapiens
cagcttgagcctgtca

SEQ ID NO: 6004149 - DNA, 22 bp, Homo sapiens
cagcttgcagtccgttgctgaa

SEQ ID NO: 6004150 - DNA, 17 bp, Homo sapiens
cagcttgccagatgctg

SEQ ID NO: 6004151 - DNA, 21 bp, Homo sapiens
cagcttgccagatgctgcaga

SEQ ID NO: 6004152 - DNA, 12 bp, Homo sapiens
cagcttgccccg

SEQ ID NO: 6004153 - DNA, 13 bp, Homo sapiens
cagcttgccccgg

SEQ ID NO: 6004154 - DNA, 22 bp, Homo sapiens
cagcttgctcagatagatctgt

SEQ ID NO: 6004155 - DNA, 15 bp, Homo sapiens
cagcttgctcttcag

SEQ ID NO: 6004156 - DNA, 14 bp, Homo sapiens
cagcttgctgaggg

SEQ ID NO: 6004157 - DNA, 15 bp, Homo sapiens
cagcttgctgagggg

SEQ ID NO: 6004158 - DNA, 21 bp, Homo sapiens
cagcttgctgaggggcaggga

SEQ ID NO: 6004159 - DNA, 14 bp, Homo sapiens
cagcttgctgcacc

SEQ ID NO: 6004160 - DNA, 17 bp, Homo sapiens
cactcagccccttcccg

SEQ ID NO: 6004161 - DNA, 17 bp, Homo sapiens
cactcagctatacctca

SEQ ID NO: 6004162 - DNA, 15 bp, Homo sapiens
cactcagctggactg

SEQ ID NO: 6004163 - DNA, 18 bp, Homo sapiens
cactcagctgtcctgcag

SEQ ID NO: 6004164 - DNA, 22 bp, Homo sapiens
cactcagctgtcctgcagcaaa

SEQ ID NO: 6004165 - DNA, 12 bp, Homo sapiens
cactcagctgtt

SEQ ID NO: 6004166 - DNA, 21 bp, Homo sapiens
cactcagctgttcagattgga

SEQ ID NO: 6004167 - DNA, 15 bp, Homo sapiens
cactcaggaaccctg

SEQ ID NO: 6004168 - DNA, 16 bp, Homo sapiens
cactcaggaaccctgg

SEQ ID NO: 6004169 - DNA, 18 bp, Homo sapiens
cactcaggagcacagcca

SEQ ID NO: 6004170 - DNA, 19 bp, Homo sapiens
cactcaggagcacagccat

SEQ ID NO: 6004171 - DNA, 19 bp, Homo sapiens
cactcaggaggctgaggca

SEQ ID NO: 6004172 - DNA, 20 bp, Homo sapiens
cactcaggaggctgaggcag

SEQ ID NO: 6004173 - DNA, 15 bp, Homo sapiens
cactcaggattggga

SEQ ID NO: 6004174 - DNA, 17 bp, Homo sapiens
cactcaggccacagtgg

SEQ ID NO: 6004175 - DNA, 17 bp, Homo sapiens
cactcaggcctctgcag

SEQ ID NO: 6004176 - DNA, 21 bp, Homo sapiens
cactcaggcctctgcagaagc

SEQ ID NO: 6004177 - DNA, 14 bp, Homo sapiens
cactcaggcctgtg

SEQ ID NO: 6004178 - DNA, 15 bp, Homo sapiens
cactcaggcctgtgc

SEQ ID NO: 6004179 - DNA, 19 bp, Homo sapiens
cactcagggcagctgcctg

SEQ ID NO: 6004180 - DNA, 21 bp, Homo sapiens
cactcagggcagctgcctggc

SEQ ID NO: 6004181 - DNA, 13 bp, Homo sapiens
cactcagggctgc

SEQ ID NO: 6004182 - DNA, 22 bp, Homo sapiens
cactcagggctggcccggggag

SEQ ID NO: 6004183 - DNA, 14 bp, Homo sapiens
cactcagggctggg

SEQ ID NO: 6004184 - DNA, 16 bp, Homo sapiens
cactcagggctggggc

SEQ ID NO: 6004185 - DNA, 15 bp, Homo sapiens
cactcaggggacccc

SEQ ID NO: 6004186 - DNA, 15 bp, Homo sapiens
cactcaggtgcacac

SEQ ID NO: 6004187 - DNA, 17 bp, Homo sapiens
cactcaggttcttcagg

SEQ ID NO: 6004188 - DNA, 14 bp, Homo sapiens
cactcagtaggtct

SEQ ID NO: 6004189 - DNA, 23 bp, Homo sapiens
cactcagtaggtctgaaggcctc

SEQ ID NO: 6004190 - DNA, 15 bp, Homo sapiens
cactcagtccactgt

SEQ ID NO: 6004191 - DNA, 16 bp, Homo sapiens
cactcagtccatagca

SEQ ID NO: 6004192 - DNA, 17 bp, Homo sapiens
cactcagtcccccacca

SEQ ID NO: 6004193 - DNA, 23 bp, Homo sapiens
cactcagtcccccaccacactga

SEQ ID NO: 6004194 - DNA, 14 bp, Homo sapiens
cactcagtctcttc

SEQ ID NO: 6004195 - DNA, 18 bp, Homo sapiens
cactcagtgagcctcctg

SEQ ID NO: 6004196 - DNA, 19 bp, Homo sapiens
cactcagtgagcctcctgt

SEQ ID NO: 6004197 - DNA, 21 bp, Homo sapiens
cactcagtgagcctcctgtgc

SEQ ID NO: 6004198 - DNA, 23 bp, Homo sapiens
cactcagtgagcctcctgtgcct

SEQ ID NO: 6004199 - DNA, 19 bp, Homo sapiens
cactcagtgcagcaatata

SEQ ID NO: 6004200 - DNA, 14 bp, Homo sapiens
cactcagtgcctcc

SEQ ID NO: 6004201 - DNA, 15 bp, Homo sapiens
cactcagtgcctcca

SEQ ID NO: 6004202 - DNA, 19 bp, Homo sapiens
cactcagtgcctccacatg

SEQ ID NO: 6004203 - DNA, 22 bp, Homo sapiens
cactcagtgcctccacatgctg

SEQ ID NO: 6004204 - DNA, 19 bp, Homo sapiens
cactcagtgtggactggga

SEQ ID NO: 6004205 - DNA, 22 bp, Homo sapiens
cactcagtgtggactgggaagc

SEQ ID NO: 6004206 - DNA, 16 bp, Homo sapiens
cactcagttgcagggt

SEQ ID NO: 6004207 - DNA, 17 bp, Homo sapiens
cactcatactgtcatat

SEQ ID NO: 6004208 - DNA, 20 bp, Homo sapiens
cactcatcaatggggccagt

SEQ ID NO: 6004209 - DNA, 16 bp, Homo sapiens
cactcatcccctcact

SEQ ID NO: 6004210 - DNA, 13 bp, Homo sapiens
cactcatgacggc

SEQ ID NO: 6004211 - DNA, 22 bp, Homo sapiens
cactcatgcaaactgctttatt

SEQ ID NO: 6004212 - DNA, 17 bp, Homo sapiens
cactcatgcattgtcct

SEQ ID NO: 6004213 - DNA, 15 bp, Homo sapiens
cactcatgcggccca

SEQ ID NO: 6004214 - DNA, 13 bp, Homo sapiens
cactcatgctgaa

SEQ ID NO: 6004215 - DNA, 22 bp, Homo sapiens
cactcatgttgttcccacacac

SEQ ID NO: 6004216 - DNA, 20 bp, Homo sapiens
cactcattccttcactcatc

SEQ ID NO: 6004217 - DNA, 17 bp, Homo sapiens
cactcattgaaatgtaa

SEQ ID NO: 6004218 - DNA, 15 bp, Homo sapiens
cactcattgacatga

SEQ ID NO: 6004219 - DNA, 16 bp, Homo sapiens
cactcattgctgagcc

SEQ ID NO: 6004220 - DNA, 23 bp, Homo sapiens
cactcattgctgagcctctgctc

SEQ ID NO: 6004221 - DNA, 22 bp, Homo sapiens
cactcatttatttccatattaa

SEQ ID NO: 6004222 - DNA, 13 bp, Homo sapiens
cactcatttcatc

SEQ ID NO: 6004223 - DNA, 15 bp, Homo sapiens
cactccaaaaacagc

SEQ ID NO: 6004224 - DNA, 23 bp, Homo sapiens
cactccaacctaacctgtgtctg

SEQ ID NO: 6004225 - DNA, 21 bp, Homo sapiens
cactccaagcccagcccatgg

SEQ ID NO: 6004226 - DNA, 17 bp, Homo sapiens
cactccaagccccctgg

SEQ ID NO: 6004227 - DNA, 22 bp, Homo sapiens
cactccaagtgccccaccactc

SEQ ID NO: 6004228 - DNA, 23 bp, Homo sapiens
cactccaataggtgctgagtgta

SEQ ID NO: 6004229 - DNA, 15 bp, Homo sapiens
cactccaattaagga

SEQ ID NO: 6004230 - DNA, 18 bp, Homo sapiens
cactccaattaaggattt

SEQ ID NO: 6004231 - DNA, 22 bp, Homo sapiens
cactccaattaaggattttatg

SEQ ID NO: 6004232 - DNA, 15 bp, Homo sapiens
cactccacaaatgat

SEQ ID NO: 6004233 - DNA, 18 bp, Homo sapiens
cactccacaccagtaata

SEQ ID NO: 6004234 - DNA, 10 bp, Homo sapiens
cactccacca

SEQ ID NO: 6004235 - DNA, 19 bp, Homo sapiens
cactccaccacccaaaagt

SEQ ID NO: 6004236 - DNA, 12 bp, Homo sapiens
cactccaccatc

SEQ ID NO: 6004237 - DNA, 15 bp, Homo sapiens
cactccaccatcact

SEQ ID NO: 6004238 - DNA, 13 bp, Homo sapiens
cactccaccatcc

SEQ ID NO: 6004239 - DNA, 17 bp, Homo sapiens
cactccaccctccacct

SEQ ID NO: 6004240 - DNA, 21 bp, Homo sapiens
cactccaccctccaccttcca

SEQ ID NO: 6004241 - DNA, 19 bp, Homo sapiens
cactccaccctgttagttt

SEQ ID NO: 6004242 - DNA, 18 bp, Homo sapiens
cactccacgcagctggca

SEQ ID NO: 6004243 - DNA, 23 bp, Homo sapiens
cactccactactctcttcctcca

SEQ ID NO: 6004244 - DNA, 14 bp, Homo sapiens
cactccactcccct

SEQ ID NO: 6004245 - DNA, 17 bp, Homo sapiens
cactccactcccctcat

SEQ ID NO: 6004246 - DNA, 13 bp, Homo sapiens
cactccactctga

SEQ ID NO: 6004247 - DNA, 14 bp, Homo sapiens
cactccactctgat

SEQ ID NO: 6004248 - DNA, 13 bp, Homo sapiens
cactccacttgga

SEQ ID NO: 6004249 - DNA, 16 bp, Homo sapiens
cactccagacccctgg

SEQ ID NO: 6004250 - DNA, 21 bp, Homo sapiens
cactccagcagataaggccga

SEQ ID NO: 6004251 - DNA, 12 bp, Homo sapiens
cactccagcctg

SEQ ID NO: 6004252 - DNA, 21 bp, Homo sapiens
cactccagcctgagcaacaga

SEQ ID NO: 6004253 - DNA, 13 bp, Homo sapiens
cactccagcctgg

SEQ ID NO: 6004254 - DNA, 21 bp, Homo sapiens
cactccagcctgggcgacaga

SEQ ID NO: 6004255 - DNA, 15 bp, Homo sapiens
cactccagcctgggg

SEQ ID NO: 6004256 - DNA, 16 bp, Homo sapiens
cactccagcctgggga

SEQ ID NO: 6004257 - DNA, 19 bp, Homo sapiens
cactccagcctggggaccc

SEQ ID NO: 6004258 - DNA, 22 bp, Homo sapiens
cactccagcctggggtgataga

SEQ ID NO: 6004259 - DNA, 15 bp, Homo sapiens
cactccagcctgggt

SEQ ID NO: 6004260 - DNA, 21 bp, Homo sapiens
cactccagcctgggtgacaga

SEQ ID NO: 6004261 - DNA, 13 bp, Homo sapiens
cactccagctgac

SEQ ID NO: 6004262 - DNA, 20 bp, Homo sapiens
cactccaggaaggggctgga

SEQ ID NO: 6004263 - DNA, 11 bp, Homo sapiens
cactccaggcc

SEQ ID NO: 6004264 - DNA, 21 bp, Homo sapiens
cactccaggccctgccccctc

SEQ ID NO: 6004265 - DNA, 21 bp, Homo sapiens
cactccagggacacacagcct

SEQ ID NO: 6004266 - DNA, 17 bp, Homo sapiens
cactccaggtgtggacc

SEQ ID NO: 6004267 - DNA, 16 bp, Homo sapiens
cactccagtcaacaga

SEQ ID NO: 6004268 - DNA, 16 bp, Homo sapiens
cactccagtcctgcca

SEQ ID NO: 6004269 - DNA, 21 bp, Homo sapiens
cactccagtgagacagctctg

SEQ ID NO: 6004270 - DNA, 12 bp, Homo sapiens
cactccagtgct

SEQ ID NO: 6004271 - DNA, 23 bp, Homo sapiens
cactccagtgctcagctgtggct

SEQ ID NO: 6004272 - DNA, 13 bp, Homo sapiens
cactccagtggca

SEQ ID NO: 6004273 - DNA, 16 bp, Homo sapiens
cactccagttgcagac

SEQ ID NO: 6004274 - DNA, 23 bp, Homo sapiens
cactccataaaaagaaagctaat

SEQ ID NO: 6004275 - DNA, 16 bp, Homo sapiens
cactccatcactgaga

SEQ ID NO: 6004276 - DNA, 22 bp, Homo sapiens
cactccatgcttagtcactgcc

SEQ ID NO: 6004277 - DNA, 23 bp, Homo sapiens
cactccatgcttagtcactgcct

SEQ ID NO: 6004278 - DNA, 23 bp, Homo sapiens
cactccatggccaccccgtgcca

SEQ ID NO: 6004279 - DNA, 19 bp, Homo sapiens
cactccattattcctctca

SEQ ID NO: 6004280 - DNA, 21 bp, Homo sapiens
cactccattggatcttttact

SEQ ID NO: 6004281 - DNA, 17 bp, Homo sapiens
cactccatttcccactt

SEQ ID NO: 6004282 - DNA, 16 bp, Homo sapiens
cactcccacctcaccc

SEQ ID NO: 6004283 - DNA, 16 bp, Homo sapiens
cactcccagcagctca

SEQ ID NO: 6004284 - DNA, 19 bp, Homo sapiens
cactcccagcagctcaacc

SEQ ID NO: 6004285 - DNA, 15 bp, Homo sapiens
cactcccaggcagcc

SEQ ID NO: 6004286 - DNA, 14 bp, Homo sapiens
cactcccagggaca

SEQ ID NO: 6004287 - DNA, 13 bp, Homo sapiens
cactcccagtgct

SEQ ID NO: 6004288 - DNA, 14 bp, Homo sapiens
cactcccataagct

SEQ ID NO: 6004289 - DNA, 12 bp, Homo sapiens
cactcccatccc

SEQ ID NO: 6004290 - DNA, 15 bp, Homo sapiens
cactcccatcccttc

SEQ ID NO: 6004291 - DNA, 13 bp, Homo sapiens
cactcccatggct

SEQ ID NO: 6004292 - DNA, 18 bp, Homo sapiens
cactcccatggctctggg

SEQ ID NO: 6004293 - DNA, 15 bp, Homo sapiens
cactccccaaccccc

SEQ ID NO: 6004294 - DNA, 21 bp, Homo sapiens
cactccccaacccctctccag

SEQ ID NO: 6004295 - DNA, 13 bp, Homo sapiens
cactccccaagga

SEQ ID NO: 6004296 - DNA, 10 bp, Homo sapiens
cactccccac

SEQ ID NO: 6004297 - DNA, 17 bp, Homo sapiens
cactccccactccccca

SEQ ID NO: 6004298 - DNA, 13 bp, Homo sapiens
cactccccacttc

SEQ ID NO: 6004299 - DNA, 20 bp, Homo sapiens
cactccccacttcactttct

SEQ ID NO: 6004300 - DNA, 15 bp, Homo sapiens
cactccccagagctg

SEQ ID NO: 6004301 - DNA, 19 bp, Homo sapiens
cactccccagagctgtgcc

SEQ ID NO: 6004302 - DNA, 23 bp, Homo sapiens
cactccccagagctgtgccagca

SEQ ID NO: 6004303 - DNA, 14 bp, Homo sapiens
cactccccagccag

SEQ ID NO: 6004304 - DNA, 16 bp, Homo sapiens
cactccccagccagcc

SEQ ID NO: 6004305 - DNA, 21 bp, Homo sapiens
cactccccagccagcctggct

SEQ ID NO: 6004306 - DNA, 16 bp, Homo sapiens
cactccccagccccag

SEQ ID NO: 6004307 - DNA, 17 bp, Homo sapiens
cactccccagccccagc

SEQ ID NO: 6004308 - DNA, 15 bp, Homo sapiens
cactccccagcctgg

SEQ ID NO: 6004309 - DNA, 21 bp, Homo sapiens
cactccccagggagctctggg

SEQ ID NO: 6004310 - DNA, 23 bp, Homo sapiens
cactccccagggagctctgggga

SEQ ID NO: 6004311 - DNA, 19 bp, Homo sapiens
cactccccatgccacgttc

SEQ ID NO: 6004312 - DNA, 22 bp, Homo sapiens
cactcccccacccatggggagg

SEQ ID NO: 6004313 - DNA, 15 bp, Homo sapiens
cactcccccacctga

SEQ ID NO: 6004314 - DNA, 15 bp, Homo sapiens
cactcccccaggagc

SEQ ID NO: 6004315 - DNA, 16 bp, Homo sapiens
cactcccccaggagca

SEQ ID NO: 6004316 - DNA, 22 bp, Homo sapiens
cactcccccaggagcagctggc

SEQ ID NO: 6004317 - DNA, 14 bp, Homo sapiens
cactcccccaggat

SEQ ID NO: 6004318 - DNA, 22 bp, Homo sapiens
cactcccccctccattcccacc

SEQ ID NO: 6004319 - DNA, 22 bp, Homo sapiens
cactccccctaaacccctgtcc

SEQ ID NO: 6004320 - DNA, 14 bp, Homo sapiens
cactcccctcacac

SEQ ID NO: 6004321 - DNA, 16 bp, Homo sapiens
cactcccctccactct

SEQ ID NO: 6004322 - DNA, 21 bp, Homo sapiens
cactcccctctcctccccttc

SEQ ID NO: 6004323 - DNA, 13 bp, Homo sapiens
cactcccctgctg

SEQ ID NO: 6004324 - DNA, 18 bp, Homo sapiens
cactccccttgccttccc

SEQ ID NO: 6004325 - DNA, 16 bp, Homo sapiens
cactcccgaccttagc

SEQ ID NO: 6004326 - DNA, 14 bp, Homo sapiens
cactcccgcctcag

SEQ ID NO: 6004327 - DNA, 21 bp, Homo sapiens
cactcccgcctcagggccagg

SEQ ID NO: 6004328 - DNA, 23 bp, Homo sapiens
cactcccgcctcagggccaggcc

SEQ ID NO: 6004329 - DNA, 19 bp, Homo sapiens
cactcccgctgcacacaga

SEQ ID NO: 6004330 - DNA, 24 bp, Homo sapiens
cactcccgctgcacacagacggcc

SEQ ID NO: 6004331 - DNA, 13 bp, Homo sapiens
cactcccggccta

SEQ ID NO: 6004332 - DNA, 15 bp, Homo sapiens
cactcccggcctagg

SEQ ID NO: 6004333 - DNA, 16 bp, Homo sapiens
cactcccgggatgggt

SEQ ID NO: 6004334 - DNA, 22 bp, Homo sapiens
cactccctaaccaaatgctgtc

SEQ ID NO: 6004335 - DNA, 20 bp, Homo sapiens
cactccctaagtccactcta

SEQ ID NO: 6004336 - DNA, 15 bp, Homo sapiens
cactccctaggccca

SEQ ID NO: 6004337 - DNA, 20 bp, Homo sapiens
cactccctaggcccaagtct

SEQ ID NO: 6004338 - DNA, 21 bp, Homo sapiens
aaagtgggttattctggagtt

SEQ ID NO: 6004339 - DNA, 19 bp, Homo sapiens
aaagtggtaaatactgtga

SEQ ID NO: 6004340 - DNA, 20 bp, Homo sapiens
aaagtggtatagaaatgctg

SEQ ID NO: 6004341 - DNA, 17 bp, Homo sapiens
aaagtggtctctgctgg

SEQ ID NO: 6004342 - DNA, 22 bp, Homo sapiens
aaagtggtgctcagttgtagaa

SEQ ID NO: 6004343 - DNA, 19 bp, Homo sapiens
aaagtggtggcaaaagaca

SEQ ID NO: 6004344 - DNA, 20 bp, Homo sapiens
aaagtggtggcaaaagacat

SEQ ID NO: 6004345 - DNA, 14 bp, Homo sapiens
aaagtggttgttag

SEQ ID NO: 6004346 - DNA, 16 bp, Homo sapiens
aaagtgtaaaatagaa

SEQ ID NO: 6004347 - DNA, 11 bp, Homo sapiens
aaagtgtaaag

SEQ ID NO: 6004348 - DNA, 16 bp, Homo sapiens
aaagtgtaaagcattc

SEQ ID NO: 6004349 - DNA, 18 bp, Homo sapiens
aaagtgtaaagcattcca

SEQ ID NO: 6004350 - DNA, 14 bp, Homo sapiens
aaagtgtacaattt

SEQ ID NO: 6004351 - DNA, 23 bp, Homo sapiens
aaagtgtattagatgtggttttt

SEQ ID NO: 6004352 - DNA, 14 bp, Homo sapiens
aaagtgtattataa

SEQ ID NO: 6004353 - DNA, 18 bp, Homo sapiens
aaagtgtattataacagt

SEQ ID NO: 6004354 - DNA, 22 bp, Homo sapiens
aaagtgtatttggaaataaagt

SEQ ID NO: 6004355 - DNA, 16 bp, Homo sapiens
aaagtgtattttataa

SEQ ID NO: 6004356 - DNA, 21 bp, Homo sapiens
aaagtgtattttataaaatta

SEQ ID NO: 6004357 - DNA, 22 bp, Homo sapiens
aaagtgtatttttttactaata

SEQ ID NO: 6004358 - DNA, 23 bp, Homo sapiens
aaagtgtcagaaggagctacaaa

SEQ ID NO: 6004359 - DNA, 14 bp, Homo sapiens
aaagtgtcatcaat

SEQ ID NO: 6004360 - DNA, 19 bp, Homo sapiens
aaagtgtgagctcttccct

SEQ ID NO: 6004361 - DNA, 20 bp, Homo sapiens
aaagtgtgagctcttccctt

SEQ ID NO: 6004362 - DNA, 19 bp, Homo sapiens
aaagtgtgtatatattttg

SEQ ID NO: 6004363 - DNA, 20 bp, Homo sapiens
aaagtgtgtatatattttgt

SEQ ID NO: 6004364 - DNA, 21 bp, Homo sapiens
aaagtgtgtatatattttgtg

SEQ ID NO: 6004365 - DNA, 23 bp, Homo sapiens
aaagtgtgtatatattttgtgtg

SEQ ID NO: 6004366 - DNA, 12 bp, Homo sapiens
aaagtgtgtatt

SEQ ID NO: 6004367 - DNA, 23 bp, Homo sapiens
aaagtgtgtattaaaaaaaacaa

SEQ ID NO: 6004368 - DNA, 14 bp, Homo sapiens
aaagtgtgttgttg

SEQ ID NO: 6004369 - DNA, 20 bp, Homo sapiens
aaagtgtgttgttgctttag

SEQ ID NO: 6004370 - DNA, 21 bp, Homo sapiens
aaagtgttattatttggcatg

SEQ ID NO: 6004371 - DNA, 19 bp, Homo sapiens
aaagtgttattttgtataa

SEQ ID NO: 6004372 - DNA, 12 bp, Homo sapiens
aaagtgttcatt

SEQ ID NO: 6004373 - DNA, 22 bp, Homo sapiens
aaagtgttcattgcacaatata

SEQ ID NO: 6004374 - DNA, 20 bp, Homo sapiens
aaagtgttctgttacaaaat

SEQ ID NO: 6004375 - DNA, 15 bp, Homo sapiens
aaagtgttgtcttat

SEQ ID NO: 6004376 - DNA, 18 bp, Homo sapiens
aaagtgttgtgttcctgg

SEQ ID NO: 6004377 - DNA, 22 bp, Homo sapiens
aaagtgttgtgttcctggctga

SEQ ID NO: 6004378 - DNA, 23 bp, Homo sapiens
aaagtgttgtgttcctggctgat

SEQ ID NO: 6004379 - DNA, 12 bp, Homo sapiens
aaagtgtttagc

SEQ ID NO: 6004380 - DNA, 13 bp, Homo sapiens
aaagtgtttagct

SEQ ID NO: 6004381 - DNA, 15 bp, Homo sapiens
aaagtgtttcagcta

SEQ ID NO: 6004382 - DNA, 13 bp, Homo sapiens
aaagtgttttatt

SEQ ID NO: 6004383 - DNA, 16 bp, Homo sapiens
aaagtgttttcagagc

SEQ ID NO: 6004384 - DNA, 17 bp, Homo sapiens
aaagtgttttctctgaa

SEQ ID NO: 6004385 - DNA, 21 bp, Homo sapiens
aaagtgttttctctgaacaca

SEQ ID NO: 6004386 - DNA, 23 bp, Homo sapiens
aaagtgttttgccctatatacct

SEQ ID NO: 6004387 - DNA, 15 bp, Homo sapiens
aaagtgttttgtacc

SEQ ID NO: 6004388 - DNA, 15 bp, Homo sapiens
aaagtgtttttacat

SEQ ID NO: 6004389 - DNA, 13 bp, Homo sapiens
aaagttaaaaaaa

SEQ ID NO: 6004390 - DNA, 12 bp, Homo sapiens
aaagttaaaaag

SEQ ID NO: 6004391 - DNA, 11 bp, Homo sapiens
aaagttaaaag

SEQ ID NO: 6004392 - DNA, 20 bp, Homo sapiens
aaagttaaactacttgtaaa

SEQ ID NO: 6004393 - DNA, 15 bp, Homo sapiens
aaagttaaatgtgtg

SEQ ID NO: 6004394 - DNA, 22 bp, Homo sapiens
aaagttaacaggcaaacatttt

SEQ ID NO: 6004395 - DNA, 12 bp, Homo sapiens
aaagttaacatt

SEQ ID NO: 6004396 - DNA, 13 bp, Homo sapiens
aaagttaacatta

SEQ ID NO: 6004397 - DNA, 15 bp, Homo sapiens
aaagttaacattagg

SEQ ID NO: 6004398 - DNA, 14 bp, Homo sapiens
aaagttaactctta

SEQ ID NO: 6004399 - DNA, 15 bp, Homo sapiens
aaagttaagaatctt

SEQ ID NO: 6004400 - DNA, 13 bp, Homo sapiens
aaagttaagttga

SEQ ID NO: 6004401 - DNA, 20 bp, Homo sapiens
aaagttaattcacctatgtt

SEQ ID NO: 6004402 - DNA, 19 bp, Homo sapiens
aaagttactggctctttgt

SEQ ID NO: 6004403 - DNA, 22 bp, Homo sapiens
aaagttactggctctttgtgtg

SEQ ID NO: 6004404 - DNA, 14 bp, Homo sapiens
aaagttagctgagc

SEQ ID NO: 6004405 - DNA, 22 bp, Homo sapiens
aaagttagggcatttttcttgg

SEQ ID NO: 6004406 - DNA, 22 bp, Homo sapiens
aaagttagttcagtagcttatc

SEQ ID NO: 6004407 - DNA, 21 bp, Homo sapiens
aaagttataataactgaactg

SEQ ID NO: 6004408 - DNA, 22 bp, Homo sapiens
aaagttatatttcagatgtaat

SEQ ID NO: 6004409 - DNA, 14 bp, Homo sapiens
aaagttatgtattt

SEQ ID NO: 6004410 - DNA, 20 bp, Homo sapiens
aaagttattcttgtcatttt

SEQ ID NO: 6004411 - DNA, 20 bp, Homo sapiens
aaagttattgataagttcat

SEQ ID NO: 6004412 - DNA, 20 bp, Homo sapiens
aaagttattgtgttgcctta

SEQ ID NO: 6004413 - DNA, 20 bp, Homo sapiens
aaagttatttccctttagct

SEQ ID NO: 6004414 - DNA, 13 bp, Homo sapiens
aaagttattttgt

SEQ ID NO: 6004415 - DNA, 18 bp, Homo sapiens
aaagttatttttaaaaac

SEQ ID NO: 6004416 - DNA, 19 bp, Homo sapiens
aaagttcaacttatttcat

SEQ ID NO: 6004417 - DNA, 15 bp, Homo sapiens
aaagttcagagtttt

SEQ ID NO: 6004418 - DNA, 16 bp, Homo sapiens
aaagttcagagttttc

SEQ ID NO: 6004419 - DNA, 17 bp, Homo sapiens
aaagttcagatgtttca

SEQ ID NO: 6004420 - DNA, 14 bp, Homo sapiens
aaagttcagccaga

SEQ ID NO: 6004421 - DNA, 21 bp, Homo sapiens
aaagttccaagagtctaaaga

SEQ ID NO: 6004422 - DNA, 22 bp, Homo sapiens
aaagttccaagagtctaaagat

SEQ ID NO: 6004423 - DNA, 13 bp, Homo sapiens
aaagttccagttt

SEQ ID NO: 6004424 - DNA, 22 bp, Homo sapiens
aaagttcctctcccttcccttc

SEQ ID NO: 6004425 - DNA, 17 bp, Homo sapiens
aaagttctaagattctg

SEQ ID NO: 6004426 - DNA, 19 bp, Homo sapiens
aaagttctattatctgggt

SEQ ID NO: 6004427 - DNA, 14 bp, Homo sapiens
aaagttctcagagc

SEQ ID NO: 6004428 - DNA, 21 bp, Homo sapiens
aaagttctgtactcaaatgta

SEQ ID NO: 6004429 - DNA, 12 bp, Homo sapiens
aaagttctgtgt

SEQ ID NO: 6004430 - DNA, 19 bp, Homo sapiens
aaagttctgtgtaaacaga

SEQ ID NO: 6004431 - DNA, 21 bp, Homo sapiens
aaagttctgtgtaaacagaag

SEQ ID NO: 6004432 - DNA, 16 bp, Homo sapiens
aaagttcttattttag

SEQ ID NO: 6004433 - DNA, 12 bp, Homo sapiens
aaagttgaaatt

SEQ ID NO: 6004434 - DNA, 19 bp, Homo sapiens
aaagttgaaccattatact

SEQ ID NO: 6004435 - DNA, 22 bp, Homo sapiens
aaagttgaaccattatacttta

SEQ ID NO: 6004436 - DNA, 13 bp, Homo sapiens
aaagttgaatatt

SEQ ID NO: 6004437 - DNA, 22 bp, Homo sapiens
aaagttgaatttattggctttt

SEQ ID NO: 6004438 - DNA, 19 bp, Homo sapiens
aaagttgacacctgagaaa

SEQ ID NO: 6004439 - DNA, 16 bp, Homo sapiens
aaagttgacatttaac

SEQ ID NO: 6004440 - DNA, 17 bp, Homo sapiens
aaagttgagagacagta

SEQ ID NO: 6004441 - DNA, 20 bp, Homo sapiens
aaagttgagggaaagagctt

SEQ ID NO: 6004442 - DNA, 21 bp, Homo sapiens
aaagttgcaaggcaaatgttt

SEQ ID NO: 6004443 - DNA, 12 bp, Homo sapiens
aaagttgcacat

SEQ ID NO: 6004444 - DNA, 18 bp, Homo sapiens
aaagttgcacggctgctg

SEQ ID NO: 6004445 - DNA, 19 bp, Homo sapiens
aaagttgcagctgttttgt

SEQ ID NO: 6004446 - DNA, 18 bp, Homo sapiens
aaagttgccattattcta

SEQ ID NO: 6004447 - DNA, 20 bp, Homo sapiens
aaagttgccattattctatg

SEQ ID NO: 6004448 - DNA, 16 bp, Homo sapiens
aaagttgcctaaatcc

SEQ ID NO: 6004449 - DNA, 20 bp, Homo sapiens
aaagttgctaactgggaaga

SEQ ID NO: 6004450 - DNA, 22 bp, Homo sapiens
aaagttgctatttgaacttttt

SEQ ID NO: 6004451 - DNA, 12 bp, Homo sapiens
aaagttgctttt

SEQ ID NO: 6004452 - DNA, 20 bp, Homo sapiens
aaagttggaaggatctgctg

SEQ ID NO: 6004453 - DNA, 16 bp, Homo sapiens
aaagttggccatgtat

SEQ ID NO: 6004454 - DNA, 21 bp, Homo sapiens
aaagttggccatgtattatga

SEQ ID NO: 6004455 - DNA, 19 bp, Homo sapiens
aaagttggggcccagtcct

SEQ ID NO: 6004456 - DNA, 21 bp, Homo sapiens
aaagttggtgccaagcttctt

SEQ ID NO: 6004457 - DNA, 16 bp, Homo sapiens
aaagttggttggataa

SEQ ID NO: 6004458 - DNA, 23 bp, Homo sapiens
aaagttgtaacaaatacagatga

SEQ ID NO: 6004459 - DNA, 21 bp, Homo sapiens
aaagttgtaatagagaatatt

SEQ ID NO: 6004460 - DNA, 15 bp, Homo sapiens
aaagttgtacatgat

SEQ ID NO: 6004461 - DNA, 17 bp, Homo sapiens
aaagttgtacatgataa

SEQ ID NO: 6004462 - DNA, 13 bp, Homo sapiens
aaagttgtactgc

SEQ ID NO: 6004463 - DNA, 21 bp, Homo sapiens
aaagttgtactgcatcttagt

SEQ ID NO: 6004464 - DNA, 18 bp, Homo sapiens
aaagttgtatgatctgtg

SEQ ID NO: 6004465 - DNA, 19 bp, Homo sapiens
aaagttgtatgatctgtgc

SEQ ID NO: 6004466 - DNA, 12 bp, Homo sapiens
aaagttgtattt

SEQ ID NO: 6004467 - DNA, 14 bp, Homo sapiens
aaagttgtcttaaa

SEQ ID NO: 6004468 - DNA, 23 bp, Homo sapiens
aaagttgtgcatgtatgtataca

SEQ ID NO: 6004469 - DNA, 18 bp, Homo sapiens
aaagttgtgccaaactat

SEQ ID NO: 6004470 - DNA, 13 bp, Homo sapiens
aaagttgttgcat

SEQ ID NO: 6004471 - DNA, 14 bp, Homo sapiens
aaagttgttgcatt

SEQ ID NO: 6004472 - DNA, 16 bp, Homo sapiens
aaagttgttgcattcc

SEQ ID NO: 6004473 - DNA, 13 bp, Homo sapiens
aaagttgttgtaa

SEQ ID NO: 6004474 - DNA, 18 bp, Homo sapiens
aaagttgtttataaaaac

SEQ ID NO: 6004475 - DNA, 20 bp, Homo sapiens
aaagttgttttatcttttaa

SEQ ID NO: 6004476 - DNA, 15 bp, Homo sapiens
aaagtttaaaaaata

SEQ ID NO: 6004477 - DNA, 16 bp, Homo sapiens
aaagtttaaaaaatac

SEQ ID NO: 6004478 - DNA, 20 bp, Homo sapiens
aaagtttaaaacagaagcct

SEQ ID NO: 6004479 - DNA, 13 bp, Homo sapiens
aaagtttaaatac

SEQ ID NO: 6004480 - DNA, 12 bp, Homo sapiens
aaagtttaaatg

SEQ ID NO: 6004481 - DNA, 21 bp, Homo sapiens
aaagtttaaatgtattttaca

SEQ ID NO: 6004482 - DNA, 21 bp, Homo sapiens
aaagtttaacctaaataatta

SEQ ID NO: 6004483 - DNA, 12 bp, Homo sapiens
aaagtttaatat

SEQ ID NO: 6004484 - DNA, 14 bp, Homo sapiens
aaagtttaatatta

SEQ ID NO: 6004485 - DNA, 20 bp, Homo sapiens
aaagtttaatattaaagcca

SEQ ID NO: 6004486 - DNA, 22 bp, Homo sapiens
aaagtttaatattaaagccatg

SEQ ID NO: 6004487 - DNA, 21 bp, Homo sapiens
aaagtttacaacttgattttt

SEQ ID NO: 6004488 - DNA, 15 bp, Homo sapiens
aaagtttacagtaaa

SEQ ID NO: 6004489 - DNA, 22 bp, Homo sapiens
aaagtttacagtaaataaattg

SEQ ID NO: 6004490 - DNA, 19 bp, Homo sapiens
aaagtttacattgtcctgt

SEQ ID NO: 6004491 - DNA, 19 bp, Homo sapiens
aaagtttagcccctgaaag

SEQ ID NO: 6004492 - DNA, 18 bp, Homo sapiens
aaagtttataaaagtgaa

SEQ ID NO: 6004493 - DNA, 16 bp, Homo sapiens
aaagtttatcagatat

SEQ ID NO: 6004494 - DNA, 19 bp, Homo sapiens
aaagtttatcagatatttt

SEQ ID NO: 6004495 - DNA, 19 bp, Homo sapiens
aaagtttcaatttgtttcc

SEQ ID NO: 6004496 - DNA, 21 bp, Homo sapiens
aaagtttcacaacagatttct

SEQ ID NO: 6004497 - DNA, 23 bp, Homo sapiens
aaagtttcacaggtcaataaact

SEQ ID NO: 6004498 - DNA, 20 bp, Homo sapiens
aaagtttcacctgtattgaa

SEQ ID NO: 6004499 - DNA, 12 bp, Homo sapiens
aaagtttcagaa

SEQ ID NO: 6004500 - DNA, 11 bp, Homo sapiens
aaagtttcatg

SEQ ID NO: 6004501 - DNA, 13 bp, Homo sapiens
aaagtttccatat

SEQ ID NO: 6004502 - DNA, 18 bp, Homo sapiens
aaagtttccttattttca

SEQ ID NO: 6004503 - DNA, 21 bp, Homo sapiens
aaagtttctatttagttattt

SEQ ID NO: 6004504 - DNA, 13 bp, Homo sapiens
aaagtttctcaga

SEQ ID NO: 6004505 - DNA, 17 bp, Homo sapiens
aaagtttctcagatcct

SEQ ID NO: 6004506 - DNA, 23 bp, Homo sapiens
aaagtttctcttttcaaaacatt

SEQ ID NO: 6004507 - DNA, 14 bp, Homo sapiens
aaagtttgatcttc

SEQ ID NO: 6004508 - DNA, 18 bp, Homo sapiens
aaagtttgccaggaggaa

SEQ ID NO: 6004509 - DNA, 22 bp, Homo sapiens
aaagtttgccctggatgtcata

SEQ ID NO: 6004510 - DNA, 14 bp, Homo sapiens
aaagtttgtagcat

SEQ ID NO: 6004511 - DNA, 14 bp, Homo sapiens
aaagtttgtccttt

SEQ ID NO: 6004512 - DNA, 13 bp, Homo sapiens
aaagtttgtgtgt

SEQ ID NO: 6004513 - DNA, 17 bp, Homo sapiens
aaagtttgttactttga

SEQ ID NO: 6004514 - DNA, 11 bp, Homo sapiens
aaagtttgttg

SEQ ID NO: 6004515 - DNA, 13 bp, Homo sapiens
aaagttttacaat

SEQ ID NO: 6004516 - DNA, 13 bp, Homo sapiens
cactccctcacaa

SEQ ID NO: 6004517 - DNA, 15 bp, Homo sapiens
cactccctccagcac

SEQ ID NO: 6004518 - DNA, 14 bp, Homo sapiens
cactccctccatca

SEQ ID NO: 6004519 - DNA, 14 bp, Homo sapiens
cactccctcccaga

SEQ ID NO: 6004520 - DNA, 11 bp, Homo sapiens
cactccctgcc

SEQ ID NO: 6004521 - DNA, 12 bp, Homo sapiens
cactccctgcca

SEQ ID NO: 6004522 - DNA, 13 bp, Homo sapiens
cactccctgccaa

SEQ ID NO: 6004523 - DNA, 14 bp, Homo sapiens
cactccctgccaac

SEQ ID NO: 6004524 - DNA, 13 bp, Homo sapiens
cactccctgccac

SEQ ID NO: 6004525 - DNA, 14 bp, Homo sapiens
cactccctgctcca

SEQ ID NO: 6004526 - DNA, 17 bp, Homo sapiens
cactccctgctccacga

SEQ ID NO: 6004527 - DNA, 17 bp, Homo sapiens
cactccctgcttgcagg

SEQ ID NO: 6004528 - DNA, 18 bp, Homo sapiens
cactccctggccttgccc

SEQ ID NO: 6004529 - DNA, 20 bp, Homo sapiens
cactccctgtccatccccag

SEQ ID NO: 6004530 - DNA, 19 bp, Homo sapiens
cactcccttctacctgcca

SEQ ID NO: 6004531 - DNA, 15 bp, Homo sapiens
cactcccttctcctt

SEQ ID NO: 6004532 - DNA, 23 bp, Homo sapiens
cactcccttgaagttgtggagga

SEQ ID NO: 6004533 - DNA, 13 bp, Homo sapiens
cactcccttgggc

SEQ ID NO: 6004534 - DNA, 14 bp, Homo sapiens
cactccctttccaa

SEQ ID NO: 6004535 - DNA, 20 bp, Homo sapiens
cactccctttcccctcttcc

SEQ ID NO: 6004536 - DNA, 18 bp, Homo sapiens
cactccctttgtggactt

SEQ ID NO: 6004537 - DNA, 20 bp, Homo sapiens
cactccctttgtggacttta

SEQ ID NO: 6004538 - DNA, 14 bp, Homo sapiens
cactccgactcccc

SEQ ID NO: 6004539 - DNA, 15 bp, Homo sapiens
cactccgactccccc

SEQ ID NO: 6004540 - DNA, 17 bp, Homo sapiens
cactccgactccccctc

SEQ ID NO: 6004541 - DNA, 19 bp, Homo sapiens
cactccgccagccacagga

SEQ ID NO: 6004542 - DNA, 20 bp, Homo sapiens
cactccgcgccgatgccacc

SEQ ID NO: 6004543 - DNA, 22 bp, Homo sapiens
cactccggattccggccctggc

SEQ ID NO: 6004544 - DNA, 17 bp, Homo sapiens
cactccggccctccaga

SEQ ID NO: 6004545 - DNA, 20 bp, Homo sapiens
cactccggccctccagagcc

SEQ ID NO: 6004546 - DNA, 21 bp, Homo sapiens
cactccggccctccagagccc

SEQ ID NO: 6004547 - DNA, 20 bp, Homo sapiens
cactccggcctgatgacaga

SEQ ID NO: 6004548 - DNA, 15 bp, Homo sapiens
cactccggtcagccc

SEQ ID NO: 6004549 - DNA, 17 bp, Homo sapiens
cactccggtgtgcctgc

SEQ ID NO: 6004550 - DNA, 21 bp, Homo sapiens
cactccggtgtgcctgcagcc

SEQ ID NO: 6004551 - DNA, 16 bp, Homo sapiens
cactcctaatcaagag

SEQ ID NO: 6004552 - DNA, 22 bp, Homo sapiens
cactcctagagaacgcagccct

SEQ ID NO: 6004553 - DNA, 14 bp, Homo sapiens
cactcctaggagag

SEQ ID NO: 6004554 - DNA, 16 bp, Homo sapiens
cactcctaggagagcc

SEQ ID NO: 6004555 - DNA, 22 bp, Homo sapiens
cactcctaggagagccaacctc

SEQ ID NO: 6004556 - DNA, 23 bp, Homo sapiens
cactcctatccccaggccaggtc

SEQ ID NO: 6004557 - DNA, 17 bp, Homo sapiens
cactcctatggtcacag

SEQ ID NO: 6004558 - DNA, 18 bp, Homo sapiens
cactcctcaactgatgat

SEQ ID NO: 6004559 - DNA, 17 bp, Homo sapiens
cactcctcactgcccca

SEQ ID NO: 6004560 - DNA, 16 bp, Homo sapiens
cactcctcagggcagc

SEQ ID NO: 6004561 - DNA, 22 bp, Homo sapiens
cactcctcagtaaaagtcttct

SEQ ID NO: 6004562 - DNA, 13 bp, Homo sapiens
cactcctcatagc

SEQ ID NO: 6004563 - DNA, 12 bp, Homo sapiens
cactcctccctc

SEQ ID NO: 6004564 - DNA, 14 bp, Homo sapiens
cactcctccctccg

SEQ ID NO: 6004565 - DNA, 13 bp, Homo sapiens
cactcctcctagc

SEQ ID NO: 6004566 - DNA, 19 bp, Homo sapiens
cactcctcctcactaaaaa

SEQ ID NO: 6004567 - DNA, 14 bp, Homo sapiens
cactcctcctccag

SEQ ID NO: 6004568 - DNA, 17 bp, Homo sapiens
cactcctcctccagccc

SEQ ID NO: 6004569 - DNA, 13 bp, Homo sapiens
cactcctcctcct

SEQ ID NO: 6004570 - DNA, 14 bp, Homo sapiens
cactcctcctcctt

SEQ ID NO: 6004571 - DNA, 16 bp, Homo sapiens
cactcctcctcctttc

SEQ ID NO: 6004572 - DNA, 12 bp, Homo sapiens
cactcctcctcg

SEQ ID NO: 6004573 - DNA, 17 bp, Homo sapiens
cactcctcggcaggcat

SEQ ID NO: 6004574 - DNA, 15 bp, Homo sapiens
cactcctctcccttg

SEQ ID NO: 6004575 - DNA, 20 bp, Homo sapiens
cactcctctctagggcagaa

SEQ ID NO: 6004576 - DNA, 12 bp, Homo sapiens
cactcctctgac

SEQ ID NO: 6004577 - DNA, 20 bp, Homo sapiens
cactcctctgactcagggct

SEQ ID NO: 6004578 - DNA, 17 bp, Homo sapiens
cactcctctgtctctgc

SEQ ID NO: 6004579 - DNA, 11 bp, Homo sapiens
cactcctgaat

SEQ ID NO: 6004580 - DNA, 22 bp, Homo sapiens
cactcctgagacccctggcctc

SEQ ID NO: 6004581 - DNA, 11 bp, Homo sapiens
cactcctgatt

SEQ ID NO: 6004582 - DNA, 14 bp, Homo sapiens
cactcctgccaagg

SEQ ID NO: 6004583 - DNA, 12 bp, Homo sapiens
cactcctgccag

SEQ ID NO: 6004584 - DNA, 14 bp, Homo sapiens
cactcctgccagcc

SEQ ID NO: 6004585 - DNA, 16 bp, Homo sapiens
cactcctgccagcccg

SEQ ID NO: 6004586 - DNA, 15 bp, Homo sapiens
cactcctgctctgct

SEQ ID NO: 6004587 - DNA, 11 bp, Homo sapiens
cactcctgctg

SEQ ID NO: 6004588 - DNA, 12 bp, Homo sapiens
cactcctgctgc

SEQ ID NO: 6004589 - DNA, 16 bp, Homo sapiens
cactcctgctgtaaat

SEQ ID NO: 6004590 - DNA, 21 bp, Homo sapiens
cactcctgcttaatcttcaaa

SEQ ID NO: 6004591 - DNA, 14 bp, Homo sapiens
cactcctgcttctc

SEQ ID NO: 6004592 - DNA, 20 bp, Homo sapiens
cactcctgcttctctcagcc

SEQ ID NO: 6004593 - DNA, 20 bp, Homo sapiens
cactcctgggctctgaacac

SEQ ID NO: 6004594 - DNA, 22 bp, Homo sapiens
cactcctgggctctgaacacac

SEQ ID NO: 6004595 - DNA, 11 bp, Homo sapiens
cactcctgggg

SEQ ID NO: 6004596 - DNA, 18 bp, Homo sapiens
cactcctgtcagcccctc

SEQ ID NO: 6004597 - DNA, 12 bp, Homo sapiens
cactcctgtccc

SEQ ID NO: 6004598 - DNA, 18 bp, Homo sapiens
cactcctgtcccgccttc

SEQ ID NO: 6004599 - DNA, 19 bp, Homo sapiens
cactcctgtccctgtagct

SEQ ID NO: 6004600 - DNA, 20 bp, Homo sapiens
cactccttcatgtttggaaa

SEQ ID NO: 6004601 - DNA, 22 bp, Homo sapiens
cactccttccatctcttccttc

SEQ ID NO: 6004602 - DNA, 23 bp, Homo sapiens
cactccttccatctcttccttca

SEQ ID NO: 6004603 - DNA, 12 bp, Homo sapiens
cactccttccca

SEQ ID NO: 6004604 - DNA, 18 bp, Homo sapiens
cactccttccccttgtcc

SEQ ID NO: 6004605 - DNA, 21 bp, Homo sapiens
cactccttccccttgtccctg

SEQ ID NO: 6004606 - DNA, 12 bp, Homo sapiens
cactccttcctg

SEQ ID NO: 6004607 - DNA, 13 bp, Homo sapiens
cactccttcctgc

SEQ ID NO: 6004608 - DNA, 24 bp, Homo sapiens
cactccttcctgccacctgctgct

SEQ ID NO: 6004609 - DNA, 21 bp, Homo sapiens
cactccttcctgccccaactc

SEQ ID NO: 6004610 - DNA, 12 bp, Homo sapiens
cactccttcctt

SEQ ID NO: 6004611 - DNA, 20 bp, Homo sapiens
cactccttccttcaggactc

SEQ ID NO: 6004612 - DNA, 17 bp, Homo sapiens
cactccttctctcactg

SEQ ID NO: 6004613 - DNA, 15 bp, Homo sapiens
cactccttgcatcaa

SEQ ID NO: 6004614 - DNA, 14 bp, Homo sapiens
cactccttgtcccc

SEQ ID NO: 6004615 - DNA, 15 bp, Homo sapiens
cactccttttaaaga

SEQ ID NO: 6004616 - DNA, 15 bp, Homo sapiens
cactcgaatcattga

SEQ ID NO: 6004617 - DNA, 21 bp, Homo sapiens
cactcgacccagaatggagcc

SEQ ID NO: 6004618 - DNA, 17 bp, Homo sapiens
cactcgaggcctgcaaa

SEQ ID NO: 6004619 - DNA, 22 bp, Homo sapiens
cactcgattgttgtaaactgtt

SEQ ID NO: 6004620 - DNA, 16 bp, Homo sapiens
cactcgcattgacaca

SEQ ID NO: 6004621 - DNA, 24 bp, Homo sapiens
cactcgccatttcctcacgtgcag

SEQ ID NO: 6004622 - DNA, 16 bp, Homo sapiens
cactcgcccgcccact

SEQ ID NO: 6004623 - DNA, 23 bp, Homo sapiens
cactcgcccgcccactgtcctgg

SEQ ID NO: 6004624 - DNA, 21 bp, Homo sapiens
cactcgcctactaagtaccct

SEQ ID NO: 6004625 - DNA, 16 bp, Homo sapiens
cactcgccttcttaga

SEQ ID NO: 6004626 - DNA, 20 bp, Homo sapiens
cactcgctagcagtggcagg

SEQ ID NO: 6004627 - DNA, 21 bp, Homo sapiens
cactcgctagcagtggcaggc

SEQ ID NO: 6004628 - DNA, 19 bp, Homo sapiens
cactcgctgtgattttaag

SEQ ID NO: 6004629 - DNA, 17 bp, Homo sapiens
cactcgctgttatcaaa

SEQ ID NO: 6004630 - DNA, 19 bp, Homo sapiens
cactcgctgttatcaaata

SEQ ID NO: 6004631 - DNA, 20 bp, Homo sapiens
cactcgcttcccccatagcc

SEQ ID NO: 6004632 - DNA, 22 bp, Homo sapiens
cactcggatggaccaacctgct

SEQ ID NO: 6004633 - DNA, 21 bp, Homo sapiens
cactcgggggtggagtgagac

SEQ ID NO: 6004634 - DNA, 23 bp, Homo sapiens
cactcgggggtggagtgagactg

SEQ ID NO: 6004635 - DNA, 16 bp, Homo sapiens
cactcggggtccctgg

SEQ ID NO: 6004636 - DNA, 19 bp, Homo sapiens
cactcggggtccctggagg

SEQ ID NO: 6004637 - DNA, 21 bp, Homo sapiens
cactcggggtccctggagggc

SEQ ID NO: 6004638 - DNA, 20 bp, Homo sapiens
cactcgggtttctctgtggc

SEQ ID NO: 6004639 - DNA, 15 bp, Homo sapiens
cactcgtaggggatg

SEQ ID NO: 6004640 - DNA, 19 bp, Homo sapiens
cactcgtcaccccagccct

SEQ ID NO: 6004641 - DNA, 21 bp, Homo sapiens
cactcgtcaccccagccctcg

SEQ ID NO: 6004642 - DNA, 21 bp, Homo sapiens
cactcgtccaagggacagccc

SEQ ID NO: 6004643 - DNA, 17 bp, Homo sapiens
cactcgtgcatccctga

SEQ ID NO: 6004644 - DNA, 16 bp, Homo sapiens
cactcgtgtgtttcta

SEQ ID NO: 6004645 - DNA, 17 bp, Homo sapiens
cactctaaaaatagaat

SEQ ID NO: 6004646 - DNA, 18 bp, Homo sapiens
cactctaaaaggttcagg

SEQ ID NO: 6004647 - DNA, 19 bp, Homo sapiens
cactctaaaaggttcaggg

SEQ ID NO: 6004648 - DNA, 16 bp, Homo sapiens
cactctaaataaattt

SEQ ID NO: 6004649 - DNA, 13 bp, Homo sapiens
cactctaagatgt

SEQ ID NO: 6004650 - DNA, 16 bp, Homo sapiens
cactctaagtcatgta

SEQ ID NO: 6004651 - DNA, 16 bp, Homo sapiens
cactctaattagagaa

SEQ ID NO: 6004652 - DNA, 17 bp, Homo sapiens
cactctaccctatacaa

SEQ ID NO: 6004653 - DNA, 16 bp, Homo sapiens
cactctaccctcccac

SEQ ID NO: 6004654 - DNA, 11 bp, Homo sapiens
cactctacctc

SEQ ID NO: 6004655 - DNA, 12 bp, Homo sapiens
cactctacctcc

SEQ ID NO: 6004656 - DNA, 14 bp, Homo sapiens
cactctacctcctt

SEQ ID NO: 6004657 - DNA, 18 bp, Homo sapiens
cactctacctccttagct

SEQ ID NO: 6004658 - DNA, 16 bp, Homo sapiens
cactctactgccccag

SEQ ID NO: 6004659 - DNA, 12 bp, Homo sapiens
cactctagaaaa

SEQ ID NO: 6004660 - DNA, 14 bp, Homo sapiens
cactctagcctggc

SEQ ID NO: 6004661 - DNA, 22 bp, Homo sapiens
cactctaggggtcaggctccat

SEQ ID NO: 6004662 - DNA, 18 bp, Homo sapiens
cactctagtcaatgacat

SEQ ID NO: 6004663 - DNA, 20 bp, Homo sapiens
cactctagtgacttcctggt

SEQ ID NO: 6004664 - DNA, 13 bp, Homo sapiens
cactctagttcta

SEQ ID NO: 6004665 - DNA, 17 bp, Homo sapiens
cactctatatgtagtgc

SEQ ID NO: 6004666 - DNA, 13 bp, Homo sapiens
cactctatgagtt

SEQ ID NO: 6004667 - DNA, 18 bp, Homo sapiens
cactctatgagttggact

SEQ ID NO: 6004668 - DNA, 13 bp, Homo sapiens
cactctcaccccc

SEQ ID NO: 6004669 - DNA, 22 bp, Homo sapiens
cactctcaccccccgacctggc

SEQ ID NO: 6004670 - DNA, 14 bp, Homo sapiens
cactctcactccac

SEQ ID NO: 6004671 - DNA, 14 bp, Homo sapiens
cactctcagagact

SEQ ID NO: 6004672 - DNA, 13 bp, Homo sapiens
cactctcagaggc

SEQ ID NO: 6004673 - DNA, 15 bp, Homo sapiens
cactctcagaggccc

SEQ ID NO: 6004674 - DNA, 23 bp, Homo sapiens
cactctcaggaccaccctgccaa

SEQ ID NO: 6004675 - DNA, 12 bp, Homo sapiens
cactctcaggag

SEQ ID NO: 6004676 - DNA, 18 bp, Homo sapiens
cactctcatgtccccttc

SEQ ID NO: 6004677 - DNA, 19 bp, Homo sapiens
cactctcatgtccccttcc

SEQ ID NO: 6004678 - DNA, 21 bp, Homo sapiens
cactctcatgtccccttcctg

SEQ ID NO: 6004679 - DNA, 19 bp, Homo sapiens
cactctccaccctggctgg

SEQ ID NO: 6004680 - DNA, 15 bp, Homo sapiens
cactctccacctcac

SEQ ID NO: 6004681 - DNA, 12 bp, Homo sapiens
cactctccagca

SEQ ID NO: 6004682 - DNA, 14 bp, Homo sapiens
cactctccagcagt

SEQ ID NO: 6004683 - DNA, 14 bp, Homo sapiens
cactctccattaga

SEQ ID NO: 6004684 - DNA, 12 bp, Homo sapiens
cactctcccaga

SEQ ID NO: 6004685 - DNA, 21 bp, Homo sapiens
cactctcccagaggctcctgg

SEQ ID NO: 6004686 - DNA, 15 bp, Homo sapiens
cactctccccacact

SEQ ID NO: 6004687 - DNA, 18 bp, Homo sapiens
cactctccccgctcaggg

SEQ ID NO: 6004688 - DNA, 13 bp, Homo sapiens
cactctcccctcc

SEQ ID NO: 6004689 - DNA, 21 bp, Homo sapiens
cactctcccctccctcttcct

SEQ ID NO: 6004690 - DNA, 22 bp, Homo sapiens
cactctccgaagtctgatccct

SEQ ID NO: 6004691 - DNA, 22 bp, Homo sapiens
cactctcctcccctccctcaga

SEQ ID NO: 6004692 - DNA, 13 bp, Homo sapiens
cactctcctgggc

SEQ ID NO: 6004693 - DNA, 17 bp, Homo sapiens
cactctccttgcagttc

SEQ ID NO: 6004694 - DNA, 23 bp, Homo sapiens
cactctcggggcccttggggcct

SEQ ID NO: 6004695 - DNA, 18 bp, Homo sapiens
cactctctcacccaccag

SEQ ID NO: 6004696 - DNA, 20 bp, Homo sapiens
cactctctgaagatgatcat

SEQ ID NO: 6004697 - DNA, 23 bp, Homo sapiens
cactctctgaagatgatcatttg

SEQ ID NO: 6004698 - DNA, 14 bp, Homo sapiens
cactctctgcagcc

SEQ ID NO: 6004699 - DNA, 20 bp, Homo sapiens
cactctctgcagcccagcct

SEQ ID NO: 6004700 - DNA, 13 bp, Homo sapiens
cactctctgctgg

SEQ ID NO: 6004701 - DNA, 14 bp, Homo sapiens
cactctctgctggc

SEQ ID NO: 6004702 - DNA, 15 bp, Homo sapiens
cactctctgctggca

SEQ ID NO: 6004703 - DNA, 15 bp, Homo sapiens
cactctctgggactc

SEQ ID NO: 6004704 - DNA, 19 bp, Homo sapiens
cactctctgggactctcct

SEQ ID NO: 6004705 - DNA, 15 bp, Homo sapiens
cactctcttcctttc

SEQ ID NO: 6004706 - DNA, 13 bp, Homo sapiens
cactctcttctcc

SEQ ID NO: 6004707 - DNA, 21 bp, Homo sapiens
cactctgaagtcccttcctgt

SEQ ID NO: 6004708 - DNA, 15 bp, Homo sapiens
cactctgacagtatt

SEQ ID NO: 6004709 - DNA, 19 bp, Homo sapiens
cactctgactggcacagtc

SEQ ID NO: 6004710 - DNA, 13 bp, Homo sapiens
cactctgaggtct

SEQ ID NO: 6004711 - DNA, 23 bp, Homo sapiens
cactctgagtcacaggtgtggga

SEQ ID NO: 6004712 - DNA, 16 bp, Homo sapiens
cactctgagtgtttta

SEQ ID NO: 6004713 - DNA, 21 bp, Homo sapiens
cactctgattcacctcttcct

SEQ ID NO: 6004714 - DNA, 18 bp, Homo sapiens
cactctgcagactgctag

SEQ ID NO: 6004715 - DNA, 20 bp, Homo sapiens
cactctgccagcaaagagga

SEQ ID NO: 6004716 - DNA, 11 bp, Homo sapiens
cactctgcccc

SEQ ID NO: 6004717 - DNA, 13 bp, Homo sapiens
cactctgccctct

SEQ ID NO: 6004718 - DNA, 14 bp, Homo sapiens
cactctgccctctg

SEQ ID NO: 6004719 - DNA, 18 bp, Homo sapiens
cactctgccctctgctgc

SEQ ID NO: 6004720 - DNA, 19 bp, Homo sapiens
cactctgccctctgctgct

SEQ ID NO: 6004721 - DNA, 22 bp, Homo sapiens
cactctgccctctgctgctgcc

SEQ ID NO: 6004722 - DNA, 20 bp, Homo sapiens
cactctgcctctaaggccaa

SEQ ID NO: 6004723 - DNA, 21 bp, Homo sapiens
cactctgcctctaaggccaag

SEQ ID NO: 6004724 - DNA, 17 bp, Homo sapiens
cactctgcctctgcctg

SEQ ID NO: 6004725 - DNA, 19 bp, Homo sapiens
cactctgcctctgcctgca

SEQ ID NO: 6004726 - DNA, 14 bp, Homo sapiens
cactctgcctgcct

SEQ ID NO: 6004727 - DNA, 17 bp, Homo sapiens
cactctgctcagggccg

SEQ ID NO: 6004728 - DNA, 15 bp, Homo sapiens
cactctgctcgcctt

SEQ ID NO: 6004729 - DNA, 18 bp, Homo sapiens
cactctgctcgccttagc

SEQ ID NO: 6004730 - DNA, 21 bp, Homo sapiens
cactctgctctgcccttgttc

SEQ ID NO: 6004731 - DNA, 17 bp, Homo sapiens
cactctgctgaggccag

SEQ ID NO: 6004732 - DNA, 11 bp, Homo sapiens
cactctgctgc

SEQ ID NO: 6004733 - DNA, 12 bp, Homo sapiens
cactctgctgcc

SEQ ID NO: 6004734 - DNA, 12 bp, Homo sapiens
cactctgcttct

SEQ ID NO: 6004735 - DNA, 13 bp, Homo sapiens
cactctgcttctc

SEQ ID NO: 6004736 - DNA, 14 bp, Homo sapiens
cactctgcttctct

SEQ ID NO: 6004737 - DNA, 15 bp, Homo sapiens
cactctgcttctctg

SEQ ID NO: 6004738 - DNA, 18 bp, Homo sapiens
cactctgcttctctgact

SEQ ID NO: 6004739 - DNA, 21 bp, Homo sapiens
cactctgcttctctgacttct

SEQ ID NO: 6004740 - DNA, 19 bp, Homo sapiens
cactctgctttgactgagc

SEQ ID NO: 6004741 - DNA, 18 bp, Homo sapiens
cactctggattcagcctt

SEQ ID NO: 6004742 - DNA, 12 bp, Homo sapiens
cactctggcagc

SEQ ID NO: 6004743 - DNA, 14 bp, Homo sapiens
cactctggcagcca

SEQ ID NO: 6004744 - DNA, 18 bp, Homo sapiens
cactctggcagccacact

SEQ ID NO: 6004745 - DNA, 17 bp, Homo sapiens
cactctggcagcctcag

SEQ ID NO: 6004746 - DNA, 15 bp, Homo sapiens
cactctggcagctca

SEQ ID NO: 6004747 - DNA, 17 bp, Homo sapiens
cactctggcagctcaga

SEQ ID NO: 6004748 - DNA, 19 bp, Homo sapiens
cactctggcagctcagaga

SEQ ID NO: 6004749 - DNA, 20 bp, Homo sapiens
cactctggcagctcagagag

SEQ ID NO: 6004750 - DNA, 19 bp, Homo sapiens
cactctggctggtttggaa

SEQ ID NO: 6004751 - DNA, 19 bp, Homo sapiens
cactctgggcaaagcccct

SEQ ID NO: 6004752 - DNA, 23 bp, Homo sapiens
cactctgggcaaagcccctcaca

SEQ ID NO: 6004753 - DNA, 12 bp, Homo sapiens
cactctgggcac

SEQ ID NO: 6004754 - DNA, 21 bp, Homo sapiens
cactctgggcacaagcagggc

SEQ ID NO: 6004755 - DNA, 15 bp, Homo sapiens
cactctgggctccag

SEQ ID NO: 6004756 - DNA, 22 bp, Homo sapiens
cactctggggacccgctggggg

SEQ ID NO: 6004757 - DNA, 14 bp, Homo sapiens
cactctggggtggg

SEQ ID NO: 6004758 - DNA, 20 bp, Homo sapiens
cactctggtggccacttcat

SEQ ID NO: 6004759 - DNA, 13 bp, Homo sapiens
cactctgtaaaat

SEQ ID NO: 6004760 - DNA, 20 bp, Homo sapiens
cactctgtaattgcaaaaaa

SEQ ID NO: 6004761 - DNA, 19 bp, Homo sapiens
cactctgtagtcaaaaaag

SEQ ID NO: 6004762 - DNA, 15 bp, Homo sapiens
cactctgtatctatg

SEQ ID NO: 6004763 - DNA, 22 bp, Homo sapiens
cactctgtattgaaaatggctt

SEQ ID NO: 6004764 - DNA, 19 bp, Homo sapiens
cactctgtcacccaggctg

SEQ ID NO: 6004765 - DNA, 12 bp, Homo sapiens
cactctgtcagc

SEQ ID NO: 6004766 - DNA, 17 bp, Homo sapiens
cactctgtcagccagcc

SEQ ID NO: 6004767 - DNA, 21 bp, Homo sapiens
cactctgtcagccagccgccc

SEQ ID NO: 6004768 - DNA, 12 bp, Homo sapiens
cactctgtccct

SEQ ID NO: 6004769 - DNA, 20 bp, Homo sapiens
cactctgtccctgtccttcc

SEQ ID NO: 6004770 - DNA, 18 bp, Homo sapiens
cactctgtcgagcctggg

SEQ ID NO: 6004771 - DNA, 20 bp, Homo sapiens
cactctgtcgcccagtctgg

SEQ ID NO: 6004772 - DNA, 12 bp, Homo sapiens
cactctgtgccc

SEQ ID NO: 6004773 - DNA, 14 bp, Homo sapiens
cactctgtgcccat

SEQ ID NO: 6004774 - DNA, 16 bp, Homo sapiens
cactctgtgcccatgg

SEQ ID NO: 6004775 - DNA, 18 bp, Homo sapiens
cactctgtgcccatgggc

SEQ ID NO: 6004776 - DNA, 21 bp, Homo sapiens
cactctgtgcccatgggcact

SEQ ID NO: 6004777 - DNA, 16 bp, Homo sapiens
cactctgtggccagcc

SEQ ID NO: 6004778 - DNA, 20 bp, Homo sapiens
cactctgtggccagcctggc

SEQ ID NO: 6004779 - DNA, 20 bp, Homo sapiens
cactctgttatttagactca

SEQ ID NO: 6004780 - DNA, 18 bp, Homo sapiens
cactctgttcattcctcc

SEQ ID NO: 6004781 - DNA, 22 bp, Homo sapiens
cactctgttcattcctccaggt

SEQ ID NO: 6004782 - DNA, 16 bp, Homo sapiens
cactctgttcccctcc

SEQ ID NO: 6004783 - DNA, 17 bp, Homo sapiens
cactctgttcccctccc

SEQ ID NO: 6004784 - DNA, 20 bp, Homo sapiens
cactctgttcccctccccct

SEQ ID NO: 6004785 - DNA, 18 bp, Homo sapiens
cactctgttgcccaggct

SEQ ID NO: 6004786 - DNA, 22 bp, Homo sapiens
cactctgttgcccaggctggag

SEQ ID NO: 6004787 - DNA, 23 bp, Homo sapiens
cactctgtttgctcacccaggac

SEQ ID NO: 6004788 - DNA, 19 bp, Homo sapiens
cactcttaggcactttggg

SEQ ID NO: 6004789 - DNA, 15 bp, Homo sapiens
cactcttatgaaatg

SEQ ID NO: 6004790 - DNA, 16 bp, Homo sapiens
cactcttatgaaatgg

SEQ ID NO: 6004791 - DNA, 19 bp, Homo sapiens
cactcttatgctgtaccca

SEQ ID NO: 6004792 - DNA, 21 bp, Homo sapiens
cactcttatgctgtacccagt

SEQ ID NO: 6004793 - DNA, 14 bp, Homo sapiens
cactcttcacttga

SEQ ID NO: 6004794 - DNA, 17 bp, Homo sapiens
cactcttcagtgactcc

SEQ ID NO: 6004795 - DNA, 21 bp, Homo sapiens
cactcttcagtgactcctgct

SEQ ID NO: 6004796 - DNA, 11 bp, Homo sapiens
cactcttccag

SEQ ID NO: 6004797 - DNA, 21 bp, Homo sapiens
cactcttccagaatcccaaga

SEQ ID NO: 6004798 - DNA, 22 bp, Homo sapiens
cactcttcctcatcctgcttct

SEQ ID NO: 6004799 - DNA, 13 bp, Homo sapiens
cactcttctctcc

SEQ ID NO: 6004800 - DNA, 18 bp, Homo sapiens
cactcttctctcctttct

SEQ ID NO: 6004801 - DNA, 21 bp, Homo sapiens
cactcttctctcctttctccc

SEQ ID NO: 6004802 - DNA, 15 bp, Homo sapiens
cactcttctcttgag

SEQ ID NO: 6004803 - DNA, 17 bp, Homo sapiens
cactcttctcttgagca

SEQ ID NO: 6004804 - DNA, 15 bp, Homo sapiens
cactcttctgtaaat

SEQ ID NO: 6004805 - DNA, 16 bp, Homo sapiens
cactcttcttgagcag

SEQ ID NO: 6004806 - DNA, 22 bp, Homo sapiens
cactcttctttaagccatagac

SEQ ID NO: 6004807 - DNA, 17 bp, Homo sapiens
cactcttgaactgggcg

SEQ ID NO: 6004808 - DNA, 14 bp, Homo sapiens
cactcttgaagagg

SEQ ID NO: 6004809 - DNA, 20 bp, Homo sapiens
cactcttgatctctcttgtc

SEQ ID NO: 6004810 - DNA, 15 bp, Homo sapiens
cactcttggagcctg

SEQ ID NO: 6004811 - DNA, 23 bp, Homo sapiens
cactcttggagcctgcagagctg

SEQ ID NO: 6004812 - DNA, 15 bp, Homo sapiens
cactcttggggacca

SEQ ID NO: 6004813 - DNA, 22 bp, Homo sapiens
cactcttggtccctggaagctt

SEQ ID NO: 6004814 - DNA, 17 bp, Homo sapiens
cactcttgtcacccagg

SEQ ID NO: 6004815 - DNA, 23 bp, Homo sapiens
cactcttgtcacccaggctggag

SEQ ID NO: 6004816 - DNA, 17 bp, Homo sapiens
cactcttgttcccacac

SEQ ID NO: 6004817 - DNA, 14 bp, Homo sapiens
cactcttgtttctc

SEQ ID NO: 6004818 - DNA, 21 bp, Homo sapiens
cactcttgtttctcccgtgct

SEQ ID NO: 6004819 - DNA, 15 bp, Homo sapiens
cactctttctttcaa

SEQ ID NO: 6004820 - DNA, 22 bp, Homo sapiens
cactctttgctacaataaatgc

SEQ ID NO: 6004821 - DNA, 15 bp, Homo sapiens
cactctttgtaagag

SEQ ID NO: 6004822 - DNA, 14 bp, Homo sapiens
cactcttttataca

SEQ ID NO: 6004823 - DNA, 15 bp, Homo sapiens
cactcttttgcttta

SEQ ID NO: 6004824 - DNA, 14 bp, Homo sapiens
cactgaaaaacaac

SEQ ID NO: 6004825 - DNA, 23 bp, Homo sapiens
cactgaaaaatctaagtgatata

SEQ ID NO: 6004826 - DNA, 14 bp, Homo sapiens
cactgaaaaattat

SEQ ID NO: 6004827 - DNA, 12 bp, Homo sapiens
cactgaaaacat

SEQ ID NO: 6004828 - DNA, 18 bp, Homo sapiens
cactgaaaacatctggaa

SEQ ID NO: 6004829 - DNA, 13 bp, Homo sapiens
cactgaaaactat

SEQ ID NO: 6004830 - DNA, 22 bp, Homo sapiens
cactgaaaagctttcctgacaa

SEQ ID NO: 6004831 - DNA, 21 bp, Homo sapiens
cactgaaaaggttcttcatcc

SEQ ID NO: 6004832 - DNA, 18 bp, Homo sapiens
cactgaaaatagtgttcc

SEQ ID NO: 6004833 - DNA, 16 bp, Homo sapiens
cactgaaaccaaaaca

SEQ ID NO: 6004834 - DNA, 14 bp, Homo sapiens
cactgaaacctctg

SEQ ID NO: 6004835 - DNA, 16 bp, Homo sapiens
cactgaaacctctgcc

SEQ ID NO: 6004836 - DNA, 16 bp, Homo sapiens
cactgaaacctctgtt

SEQ ID NO: 6004837 - DNA, 19 bp, Homo sapiens
cactgaaacctctgttctc

SEQ ID NO: 6004838 - DNA, 23 bp, Homo sapiens
cactgaaacctctgttctcatga

SEQ ID NO: 6004839 - DNA, 19 bp, Homo sapiens
cactgaaacgtattcagag

SEQ ID NO: 6004840 - DNA, 13 bp, Homo sapiens
cactgaaaggaaa

SEQ ID NO: 6004841 - DNA, 13 bp, Homo sapiens
cactgaaagtttt

SEQ ID NO: 6004842 - DNA, 16 bp, Homo sapiens
cactgaaagttttgta

SEQ ID NO: 6004843 - DNA, 21 bp, Homo sapiens
cactgaaagttttgtaaaaga

SEQ ID NO: 6004844 - DNA, 16 bp, Homo sapiens
cactgaaatatgtgaa

SEQ ID NO: 6004845 - DNA, 21 bp, Homo sapiens
cactgaaatgccttactttgt

SEQ ID NO: 6004846 - DNA, 11 bp, Homo sapiens
cactgaacagg

SEQ ID NO: 6004847 - DNA, 22 bp, Homo sapiens
cactgaacaggctggggccttt

SEQ ID NO: 6004848 - DNA, 14 bp, Homo sapiens
cactgaaccactgc

SEQ ID NO: 6004849 - DNA, 18 bp, Homo sapiens
cactgaaccactgcttct

SEQ ID NO: 6004850 - DNA, 19 bp, Homo sapiens
cactgaaccgctacaagag

SEQ ID NO: 6004851 - DNA, 20 bp, Homo sapiens
cactgaacctgggaaagaga

SEQ ID NO: 6004852 - DNA, 22 bp, Homo sapiens
cactgaaccttaggctttgtat

SEQ ID NO: 6004853 - DNA, 22 bp, Homo sapiens
cactgaaccttgttgatgccag

SEQ ID NO: 6004854 - DNA, 14 bp, Homo sapiens
cactgaactccacc

SEQ ID NO: 6004855 - DNA, 20 bp, Homo sapiens
cactgaactttgctgagcct

SEQ ID NO: 6004856 - DNA, 14 bp, Homo sapiens
cactgaacttttca

SEQ ID NO: 6004857 - DNA, 19 bp, Homo sapiens
cactgaagaaaccttcaga

SEQ ID NO: 6004858 - DNA, 11 bp, Homo sapiens
cactgaagacg

SEQ ID NO: 6004859 - DNA, 13 bp, Homo sapiens
cactgaagagctc

SEQ ID NO: 6004860 - DNA, 12 bp, Homo sapiens
cactgaagagga

SEQ ID NO: 6004861 - DNA, 13 bp, Homo sapiens
cactgaagaggag

SEQ ID NO: 6004862 - DNA, 15 bp, Homo sapiens
cactgaagaggagga

SEQ ID NO: 6004863 - DNA, 16 bp, Homo sapiens
cactgaagaggaggag

SEQ ID NO: 6004864 - DNA, 15 bp, Homo sapiens
cactgaagcccagac

SEQ ID NO: 6004865 - DNA, 17 bp, Homo sapiens
cactgaagcccagacct

SEQ ID NO: 6004866 - DNA, 17 bp, Homo sapiens
cactgaagcctgcgttg

SEQ ID NO: 6004867 - DNA, 18 bp, Homo sapiens
cactgaaggattaatgaa

SEQ ID NO: 6004868 - DNA, 19 bp, Homo sapiens
cactgaaggattaatgaaa

SEQ ID NO: 6004869 - DNA, 14 bp, Homo sapiens
cactgaaggcaaat

SEQ ID NO: 6004870 - DNA, 21 bp, Homo sapiens
cactgaaggctttcagggcct

SEQ ID NO: 6004871 - DNA, 19 bp, Homo sapiens
cactgaagtgaatacatgg

SEQ ID NO: 6004872 - DNA, 20 bp, Homo sapiens
cactgaagtgaatacatggt

SEQ ID NO: 6004873 - DNA, 13 bp, Homo sapiens
cactgaagtgatt

SEQ ID NO: 6004874 - DNA, 17 bp, Homo sapiens
cactgaagtgattgaaa

SEQ ID NO: 6004875 - DNA, 22 bp, Homo sapiens
cactgaagtgcttgcagatcat

SEQ ID NO: 6004876 - DNA, 15 bp, Homo sapiens
cagcttgctgtcact

SEQ ID NO: 6004877 - DNA, 18 bp, Homo sapiens
cagcttggacatcagtgt

SEQ ID NO: 6004878 - DNA, 17 bp, Homo sapiens
cagcttggccctttcct

SEQ ID NO: 6004879 - DNA, 22 bp, Homo sapiens
cagcttggctcacaaggcccag

SEQ ID NO: 6004880 - DNA, 14 bp, Homo sapiens
cagcttggctgagc

SEQ ID NO: 6004881 - DNA, 16 bp, Homo sapiens
cagcttggctgagccc

SEQ ID NO: 6004882 - DNA, 20 bp, Homo sapiens
cagcttggctgagccccctc

SEQ ID NO: 6004883 - DNA, 17 bp, Homo sapiens
cagcttgggcagatctc

SEQ ID NO: 6004884 - DNA, 18 bp, Homo sapiens
cagcttgggcccagctgg

SEQ ID NO: 6004885 - DNA, 19 bp, Homo sapiens
cagcttgggcccagctggg

SEQ ID NO: 6004886 - DNA, 20 bp, Homo sapiens
cagcttgggcccagctgggc

SEQ ID NO: 6004887 - DNA, 14 bp, Homo sapiens
cagcttgggctggc

SEQ ID NO: 6004888 - DNA, 22 bp, Homo sapiens
cagcttgggcttcttcctcctc

SEQ ID NO: 6004889 - DNA, 18 bp, Homo sapiens
cagcttggggcagccatt

SEQ ID NO: 6004890 - DNA, 19 bp, Homo sapiens
cagcttggggcagccattg

SEQ ID NO: 6004891 - DNA, 14 bp, Homo sapiens
cagcttgggtcagg

SEQ ID NO: 6004892 - DNA, 19 bp, Homo sapiens
cagcttgggtcaggttctt

SEQ ID NO: 6004893 - DNA, 16 bp, Homo sapiens
cagcttggttcctgcc

SEQ ID NO: 6004894 - DNA, 17 bp, Homo sapiens
cagcttggttcctgccc

SEQ ID NO: 6004895 - DNA, 21 bp, Homo sapiens
cagcttgtaaatagctcaggt

SEQ ID NO: 6004896 - DNA, 12 bp, Homo sapiens
cagcttgtagcc

SEQ ID NO: 6004897 - DNA, 15 bp, Homo sapiens
cagcttgtagccagc

SEQ ID NO: 6004898 - DNA, 16 bp, Homo sapiens
cagcttgtaggagctg

SEQ ID NO: 6004899 - DNA, 23 bp, Homo sapiens
cagcttgtatgcaatggattttc

SEQ ID NO: 6004900 - DNA, 19 bp, Homo sapiens
cagcttgtctcttgcctgc

SEQ ID NO: 6004901 - DNA, 21 bp, Homo sapiens
cagcttgtctcttgcctgcca

SEQ ID NO: 6004902 - DNA, 23 bp, Homo sapiens
cagcttgtctcttgcctgccact

SEQ ID NO: 6004903 - DNA, 14 bp, Homo sapiens
cagcttgtgcacaa

SEQ ID NO: 6004904 - DNA, 18 bp, Homo sapiens
cagcttgtgctgagcctg

SEQ ID NO: 6004905 - DNA, 21 bp, Homo sapiens
cagcttgtggcaagtgaattt

SEQ ID NO: 6004906 - DNA, 20 bp, Homo sapiens
cagcttgtgtgcaaaagcag

SEQ ID NO: 6004907 - DNA, 19 bp, Homo sapiens
cagcttgttctgggctcag

SEQ ID NO: 6004908 - DNA, 21 bp, Homo sapiens
cagcttgttgtcccaatgaaa

SEQ ID NO: 6004909 - DNA, 13 bp, Homo sapiens
cagcttgtttaca

SEQ ID NO: 6004910 - DNA, 13 bp, Homo sapiens
cagcttgtttcta

SEQ ID NO: 6004911 - DNA, 21 bp, Homo sapiens
cagcttgttttggactttgtt

SEQ ID NO: 6004912 - DNA, 22 bp, Homo sapiens
cagctttaaaaaattaatctgg

SEQ ID NO: 6004913 - DNA, 17 bp, Homo sapiens
cagctttaaaaagaaaa

SEQ ID NO: 6004914 - DNA, 15 bp, Homo sapiens
cagctttaaacaaat

SEQ ID NO: 6004915 - DNA, 19 bp, Homo sapiens
cagctttaaactcagggac

SEQ ID NO: 6004916 - DNA, 22 bp, Homo sapiens
cagctttaaactcagggacaga

SEQ ID NO: 6004917 - DNA, 18 bp, Homo sapiens
cagctttacacacacaga

SEQ ID NO: 6004918 - DNA, 17 bp, Homo sapiens
cagctttactgtggctg

SEQ ID NO: 6004919 - DNA, 19 bp, Homo sapiens
cagctttactgtggctgtc

SEQ ID NO: 6004920 - DNA, 19 bp, Homo sapiens
cagctttataacaaatgtg

SEQ ID NO: 6004921 - DNA, 17 bp, Homo sapiens
cagctttataataaact

SEQ ID NO: 6004922 - DNA, 13 bp, Homo sapiens
cagctttatgttc

SEQ ID NO: 6004923 - DNA, 17 bp, Homo sapiens
cagctttcaaagcattt

SEQ ID NO: 6004924 - DNA, 17 bp, Homo sapiens
cagctttcaaaggacaa

SEQ ID NO: 6004925 - DNA, 13 bp, Homo sapiens
cagctttcagagc

SEQ ID NO: 6004926 - DNA, 15 bp, Homo sapiens
cagctttcagagcca

SEQ ID NO: 6004927 - DNA, 19 bp, Homo sapiens
cagctttcagggccatggt

SEQ ID NO: 6004928 - DNA, 23 bp, Homo sapiens
cagctttccatctgaggaccaga

SEQ ID NO: 6004929 - DNA, 13 bp, Homo sapiens
cagctttcccagg

SEQ ID NO: 6004930 - DNA, 23 bp, Homo sapiens
cagctttccccatgtctcgactc

SEQ ID NO: 6004931 - DNA, 23 bp, Homo sapiens
cagctttccctccccagagttct

SEQ ID NO: 6004932 - DNA, 13 bp, Homo sapiens
cagctttccctgc

SEQ ID NO: 6004933 - DNA, 14 bp, Homo sapiens
cagctttccctggc

SEQ ID NO: 6004934 - DNA, 20 bp, Homo sapiens
cagctttccctggctcaggg

SEQ ID NO: 6004935 - DNA, 14 bp, Homo sapiens
cagctttcctgggt

SEQ ID NO: 6004936 - DNA, 20 bp, Homo sapiens
cagctttccttctgcccttc

SEQ ID NO: 6004937 - DNA, 15 bp, Homo sapiens
cagctttctaatgtt

SEQ ID NO: 6004938 - DNA, 16 bp, Homo sapiens
cagctttctcgcgccc

SEQ ID NO: 6004939 - DNA, 21 bp, Homo sapiens
cagctttcttgctcccttcag

SEQ ID NO: 6004940 - DNA, 23 bp, Homo sapiens
cagctttgactttatctcctgct

SEQ ID NO: 6004941 - DNA, 16 bp, Homo sapiens
cagctttgagaagcct

SEQ ID NO: 6004942 - DNA, 20 bp, Homo sapiens
cagctttgagaagccttcag

SEQ ID NO: 6004943 - DNA, 13 bp, Homo sapiens
cagctttgaggaa

SEQ ID NO: 6004944 - DNA, 17 bp, Homo sapiens
cagctttgatccctgac

SEQ ID NO: 6004945 - DNA, 20 bp, Homo sapiens
cagctttgatccctgacatc

SEQ ID NO: 6004946 - DNA, 13 bp, Homo sapiens
cagctttgcaccc

SEQ ID NO: 6004947 - DNA, 12 bp, Homo sapiens
cagctttgccct

SEQ ID NO: 6004948 - DNA, 16 bp, Homo sapiens
cagctttgccttccac

SEQ ID NO: 6004949 - DNA, 18 bp, Homo sapiens
cagctttgccttccacgc

SEQ ID NO: 6004950 - DNA, 22 bp, Homo sapiens
cagctttgctaccaaagcacct

SEQ ID NO: 6004951 - DNA, 22 bp, Homo sapiens
cagctttgggatctatatacat

SEQ ID NO: 6004952 - DNA, 11 bp, Homo sapiens
cagctttgtcc

SEQ ID NO: 6004953 - DNA, 19 bp, Homo sapiens
cagctttgtctccaaagaa

SEQ ID NO: 6004954 - DNA, 14 bp, Homo sapiens
cagctttgtttctg

SEQ ID NO: 6004955 - DNA, 21 bp, Homo sapiens
cagctttgtttgttgtcagct

SEQ ID NO: 6004956 - DNA, 17 bp, Homo sapiens
cagcttttaataaaatt

SEQ ID NO: 6004957 - DNA, 14 bp, Homo sapiens
cagcttttactgtt

SEQ ID NO: 6004958 - DNA, 22 bp, Homo sapiens
cagcttttagtacccacctgag

SEQ ID NO: 6004959 - DNA, 23 bp, Homo sapiens
cagcttttagtacccacctgagc

SEQ ID NO: 6004960 - DNA, 16 bp, Homo sapiens
cagcttttatggatga

SEQ ID NO: 6004961 - DNA, 20 bp, Homo sapiens
cagcttttatggatgattaa

SEQ ID NO: 6004962 - DNA, 15 bp, Homo sapiens
cagcttttcattgct

SEQ ID NO: 6004963 - DNA, 20 bp, Homo sapiens
cagcttttcccaaaagccca

SEQ ID NO: 6004964 - DNA, 16 bp, Homo sapiens
cagcttttcctccctt

SEQ ID NO: 6004965 - DNA, 15 bp, Homo sapiens
cagcttttctgatgg

SEQ ID NO: 6004966 - DNA, 13 bp, Homo sapiens
cagcttttcttga

SEQ ID NO: 6004967 - DNA, 15 bp, Homo sapiens
cagcttttcttgata

SEQ ID NO: 6004968 - DNA, 17 bp, Homo sapiens
cagcttttctttttctg

SEQ ID NO: 6004969 - DNA, 12 bp, Homo sapiens
cagcttttgcaa

SEQ ID NO: 6004970 - DNA, 23 bp, Homo sapiens
cagcttttggattggacaaaatg

SEQ ID NO: 6004971 - DNA, 22 bp, Homo sapiens
cagcttttgtatagaaaattct

SEQ ID NO: 6004972 - DNA, 16 bp, Homo sapiens
cagcttttgttctaga

SEQ ID NO: 6004973 - DNA, 17 bp, Homo sapiens
cagcttttgttctagac

SEQ ID NO: 6004974 - DNA, 18 bp, Homo sapiens
cagcttttgttctagact

SEQ ID NO: 6004975 - DNA, 14 bp, Homo sapiens
cagctttttgtatt

SEQ ID NO: 6004976 - DNA, 16 bp, Homo sapiens
cagctttttgtctttt

SEQ ID NO: 6004977 - DNA, 14 bp, Homo sapiens
cagcttttttcctg

SEQ ID NO: 6004978 - DNA, 21 bp, Homo sapiens
cagcttttttttcagccattc

SEQ ID NO: 6004979 - DNA, 19 bp, Homo sapiens
cagcttttttttcccccct

SEQ ID NO: 6004980 - DNA, 23 bp, Homo sapiens
caggaaaaaaaattctgttgttc

SEQ ID NO: 6004981 - DNA, 15 bp, Homo sapiens
caggaaaaaaacttt

SEQ ID NO: 6004982 - DNA, 18 bp, Homo sapiens
caggaaaaaaacttttat

SEQ ID NO: 6004983 - DNA, 19 bp, Homo sapiens
caggaaaaaataaaaagag

SEQ ID NO: 6004984 - DNA, 17 bp, Homo sapiens
caggaaaaaccaacagg

SEQ ID NO: 6004985 - DNA, 19 bp, Homo sapiens
caggaaaaatgaggaatcc

SEQ ID NO: 6004986 - DNA, 22 bp, Homo sapiens
caggaaaacaaatcactgtatt

SEQ ID NO: 6004987 - DNA, 16 bp, Homo sapiens
caggaaaacacccagg

SEQ ID NO: 6004988 - DNA, 23 bp, Homo sapiens
caggaaaacgggaccggccaggc

SEQ ID NO: 6004989 - DNA, 15 bp, Homo sapiens
caggaaaactgtttt

SEQ ID NO: 6004990 - DNA, 14 bp, Homo sapiens
caggaaaagcacaa

SEQ ID NO: 6004991 - DNA, 16 bp, Homo sapiens
caggaaaagctgctga

SEQ ID NO: 6004992 - DNA, 18 bp, Homo sapiens
caggaaaagctgctgaca

SEQ ID NO: 6004993 - DNA, 15 bp, Homo sapiens
caggaaaaggcctgg

SEQ ID NO: 6004994 - DNA, 21 bp, Homo sapiens
caggaaaaggcctggggtgac

SEQ ID NO: 6004995 - DNA, 17 bp, Homo sapiens
caggaaaaggctgcagc

SEQ ID NO: 6004996 - DNA, 12 bp, Homo sapiens
caggaaaataac

SEQ ID NO: 6004997 - DNA, 17 bp, Homo sapiens
caggaaaatcctctggc

SEQ ID NO: 6004998 - DNA, 13 bp, Homo sapiens
caggaaaatgtat

SEQ ID NO: 6004999 - DNA, 21 bp, Homo sapiens
caggaaaatgtatccagagga

SEQ ID NO: 6005000 - DNA, 17 bp, Homo sapiens
caggaaaatgtattgat

SEQ ID NO: 6005001 - DNA, 17 bp, Homo sapiens
caggaaaattgaatgca

SEQ ID NO: 6005002 - DNA, 16 bp, Homo sapiens
caggaaacaagggaag

SEQ ID NO: 6005003 - DNA, 22 bp, Homo sapiens
caggaaacaagggaaggggcct

SEQ ID NO: 6005004 - DNA, 22 bp, Homo sapiens
caggaaacaaggggtctgagga

SEQ ID NO: 6005005 - DNA, 19 bp, Homo sapiens
caggaaacatatttaagaa

SEQ ID NO: 6005006 - DNA, 13 bp, Homo sapiens
caggaaaccgagt

SEQ ID NO: 6005007 - DNA, 19 bp, Homo sapiens
caggaaactccacatctgc

SEQ ID NO: 6005008 - DNA, 13 bp, Homo sapiens
caggaaagaatag

SEQ ID NO: 6005009 - DNA, 20 bp, Homo sapiens
caggaaagagaacttccaga

SEQ ID NO: 6005010 - DNA, 17 bp, Homo sapiens
caggaaagagattagaa

SEQ ID NO: 6005011 - DNA, 19 bp, Homo sapiens
caggaaagagattagaaca

SEQ ID NO: 6005012 - DNA, 21 bp, Homo sapiens
caggaaagagcagtcagagtc

SEQ ID NO: 6005013 - DNA, 17 bp, Homo sapiens
caggaaagagctaggaa

SEQ ID NO: 6005014 - DNA, 16 bp, Homo sapiens
caggaaagagggagca

SEQ ID NO: 6005015 - DNA, 17 bp, Homo sapiens
caggaaagagggagcag

SEQ ID NO: 6005016 - DNA, 21 bp, Homo sapiens
caggaaagagggagcaggtgc

SEQ ID NO: 6005017 - DNA, 22 bp, Homo sapiens
caggaaagagggagcaggtgcc

SEQ ID NO: 6005018 - DNA, 17 bp, Homo sapiens
caggaaagatcccaagt

SEQ ID NO: 6005019 - DNA, 16 bp, Homo sapiens
caggaaagccacatct

SEQ ID NO: 6005020 - DNA, 19 bp, Homo sapiens
caggaaagcgcctccaacc

SEQ ID NO: 6005021 - DNA, 17 bp, Homo sapiens
caggaaagcgtttggaa

SEQ ID NO: 6005022 - DNA, 19 bp, Homo sapiens
caggaaagctcagctactg

SEQ ID NO: 6005023 - DNA, 15 bp, Homo sapiens
caggaaaggaagatg

SEQ ID NO: 6005024 - DNA, 15 bp, Homo sapiens
caggaaaggaatcat

SEQ ID NO: 6005025 - DNA, 17 bp, Homo sapiens
caggaaaggctccagga

SEQ ID NO: 6005026 - DNA, 21 bp, Homo sapiens
caggaaagggaaggccccaca

SEQ ID NO: 6005027 - DNA, 21 bp, Homo sapiens
caggaaagtggcacctgtctg

SEQ ID NO: 6005028 - DNA, 22 bp, Homo sapiens
caggaaagtggcacctgtctgc

SEQ ID NO: 6005029 - DNA, 18 bp, Homo sapiens
caggaaagttcagagttt

SEQ ID NO: 6005030 - DNA, 21 bp, Homo sapiens
caggaaatcaaatatgcaaag

SEQ ID NO: 6005031 - DNA, 21 bp, Homo sapiens
caggaaatgaaaatgtcttgt

SEQ ID NO: 6005032 - DNA, 15 bp, Homo sapiens
caggaaatgagagat

SEQ ID NO: 6005033 - DNA, 20 bp, Homo sapiens
caggaaatgctgacccatgg

SEQ ID NO: 6005034 - DNA, 17 bp, Homo sapiens
caggaaattgcaaagaa

SEQ ID NO: 6005035 - DNA, 14 bp, Homo sapiens
caggaacaaacagg

SEQ ID NO: 6005036 - DNA, 22 bp, Homo sapiens
caggaacaacatttacaactca

SEQ ID NO: 6005037 - DNA, 16 bp, Homo sapiens
caggaacacatgcaca

SEQ ID NO: 6005038 - DNA, 17 bp, Homo sapiens
caggaacacatgcacac

SEQ ID NO: 6005039 - DNA, 18 bp, Homo sapiens
caggaacacatgcacaca

SEQ ID NO: 6005040 - DNA, 16 bp, Homo sapiens
caggaacacccagccc

SEQ ID NO: 6005041 - DNA, 18 bp, Homo sapiens
caggaacacccagcccca

SEQ ID NO: 6005042 - DNA, 19 bp, Homo sapiens
caggaacacccagccccag

SEQ ID NO: 6005043 - DNA, 13 bp, Homo sapiens
caggaacagaaca

SEQ ID NO: 6005044 - DNA, 12 bp, Homo sapiens
caggaacagaag

SEQ ID NO: 6005045 - DNA, 23 bp, Homo sapiens
caggaacagagactctggaagcc

SEQ ID NO: 6005046 - DNA, 22 bp, Homo sapiens
caggaacagggaccagctcccc

SEQ ID NO: 6005047 - DNA, 23 bp, Homo sapiens
caggaacagggaccagctccccg

SEQ ID NO: 6005048 - DNA, 19 bp, Homo sapiens
caggaacagtggctgggtg

SEQ ID NO: 6005049 - DNA, 20 bp, Homo sapiens
caggaacagtggctgggtgg

SEQ ID NO: 6005050 - DNA, 15 bp, Homo sapiens
caggaacatacagac

SEQ ID NO: 6005051 - DNA, 21 bp, Homo sapiens
caggaaccaaaaaaccccagc

SEQ ID NO: 6005052 - DNA, 19 bp, Homo sapiens
caggaaccacaccacatct

SEQ ID NO: 6005053 - DNA, 22 bp, Homo sapiens
cactgaagttaacagagacaga

SEQ ID NO: 6005054 - DNA, 15 bp, Homo sapiens
cactgaagtttgata

SEQ ID NO: 6005055 - DNA, 18 bp, Homo sapiens
cactgaagtttttgaaat

SEQ ID NO: 6005056 - DNA, 20 bp, Homo sapiens
cactgaagtttttgaaatac

SEQ ID NO: 6005057 - DNA, 22 bp, Homo sapiens
cactgaagtttttgaaatacct

SEQ ID NO: 6005058 - DNA, 13 bp, Homo sapiens
cactgaataaata

SEQ ID NO: 6005059 - DNA, 22 bp, Homo sapiens
cactgaataatggaattatgta

SEQ ID NO: 6005060 - DNA, 19 bp, Homo sapiens
cactgaatatataaacact

SEQ ID NO: 6005061 - DNA, 17 bp, Homo sapiens
cactgaatatcaactct

SEQ ID NO: 6005062 - DNA, 12 bp, Homo sapiens
cactgaatctaa

SEQ ID NO: 6005063 - DNA, 17 bp, Homo sapiens
cactgaatctgtacaga

SEQ ID NO: 6005064 - DNA, 20 bp, Homo sapiens
cactgaatctgtacagagcc

SEQ ID NO: 6005065 - DNA, 21 bp, Homo sapiens
cactgaatgcctcaatgtgac

SEQ ID NO: 6005066 - DNA, 14 bp, Homo sapiens
cactgaatggaaat

SEQ ID NO: 6005067 - DNA, 15 bp, Homo sapiens
cactgaattaatcat

SEQ ID NO: 6005068 - DNA, 15 bp, Homo sapiens
cactgaattcactcc

SEQ ID NO: 6005069 - DNA, 17 bp, Homo sapiens
cactgaattcactccag

SEQ ID NO: 6005070 - DNA, 20 bp, Homo sapiens
cactgaattgacatgaccct

SEQ ID NO: 6005071 - DNA, 23 bp, Homo sapiens
cactgaatttcaaacatttgtca

SEQ ID NO: 6005072 - DNA, 19 bp, Homo sapiens
cactgacaaacgtccccag

SEQ ID NO: 6005073 - DNA, 19 bp, Homo sapiens
cactgacaacgaaagtaaa

SEQ ID NO: 6005074 - DNA, 19 bp, Homo sapiens
cactgacacaaaaagtaga

SEQ ID NO: 6005075 - DNA, 19 bp, Homo sapiens
cactgacacaaaagaagaa

SEQ ID NO: 6005076 - DNA, 14 bp, Homo sapiens
cactgacacaaagg

SEQ ID NO: 6005077 - DNA, 15 bp, Homo sapiens
cactgacaccctggt

SEQ ID NO: 6005078 - DNA, 14 bp, Homo sapiens
cactgacacctttg

SEQ ID NO: 6005079 - DNA, 22 bp, Homo sapiens
cactgacacctttgcaggcatg

SEQ ID NO: 6005080 - DNA, 13 bp, Homo sapiens
cactgacactggt

SEQ ID NO: 6005081 - DNA, 13 bp, Homo sapiens
cactgacagattt

SEQ ID NO: 6005082 - DNA, 13 bp, Homo sapiens
cactgacagcctc

SEQ ID NO: 6005083 - DNA, 14 bp, Homo sapiens
cactgacagcctcc

SEQ ID NO: 6005084 - DNA, 15 bp, Homo sapiens
cactgacagcctcca

SEQ ID NO: 6005085 - DNA, 14 bp, Homo sapiens
cactgacagcctgg

SEQ ID NO: 6005086 - DNA, 16 bp, Homo sapiens
cactgacagcctgggg

SEQ ID NO: 6005087 - DNA, 17 bp, Homo sapiens
cactgacagcctggggg

SEQ ID NO: 6005088 - DNA, 20 bp, Homo sapiens
cactgacagcctgggggggc

SEQ ID NO: 6005089 - DNA, 13 bp, Homo sapiens
cactgacagcctt

SEQ ID NO: 6005090 - DNA, 23 bp, Homo sapiens
cactgacattgttggccaaagcc

SEQ ID NO: 6005091 - DNA, 19 bp, Homo sapiens
cactgacatttcacttcct

SEQ ID NO: 6005092 - DNA, 15 bp, Homo sapiens
cactgaccacacatt

SEQ ID NO: 6005093 - DNA, 15 bp, Homo sapiens
cactgaccacactgt

SEQ ID NO: 6005094 - DNA, 14 bp, Homo sapiens
cactgaccagaact

SEQ ID NO: 6005095 - DNA, 16 bp, Homo sapiens
cactgaccagcggctg

SEQ ID NO: 6005096 - DNA, 17 bp, Homo sapiens
cactgaccagcggctgc

SEQ ID NO: 6005097 - DNA, 13 bp, Homo sapiens
cactgaccaggcc

SEQ ID NO: 6005098 - DNA, 15 bp, Homo sapiens
cactgaccaggccca

SEQ ID NO: 6005099 - DNA, 17 bp, Homo sapiens
cactgaccatccactct

SEQ ID NO: 6005100 - DNA, 20 bp, Homo sapiens
cactgacccaactgatcctg

SEQ ID NO: 6005101 - DNA, 23 bp, Homo sapiens
cactgacccaactgatcctgctc

SEQ ID NO: 6005102 - DNA, 22 bp, Homo sapiens
cactgacccacagcctctgcct

SEQ ID NO: 6005103 - DNA, 13 bp, Homo sapiens
cactgacccacct

SEQ ID NO: 6005104 - DNA, 16 bp, Homo sapiens
cactgacccacctgcg

SEQ ID NO: 6005105 - DNA, 19 bp, Homo sapiens
cactgaccctaactgcaga

SEQ ID NO: 6005106 - DNA, 14 bp, Homo sapiens
cactgacccttcca

SEQ ID NO: 6005107 - DNA, 16 bp, Homo sapiens
cactgacccttccaga

SEQ ID NO: 6005108 - DNA, 18 bp, Homo sapiens
cactgacccttccagaca

SEQ ID NO: 6005109 - DNA, 12 bp, Homo sapiens
cactgacctcac

SEQ ID NO: 6005110 - DNA, 13 bp, Homo sapiens
cactgacctcacc

SEQ ID NO: 6005111 - DNA, 23 bp, Homo sapiens
cactgacctcaccggcatgctgg

SEQ ID NO: 6005112 - DNA, 14 bp, Homo sapiens
cactgacctgccca

SEQ ID NO: 6005113 - DNA, 18 bp, Homo sapiens
cactgacctgcccatgtc

SEQ ID NO: 6005114 - DNA, 19 bp, Homo sapiens
cactgacctggaagagctg

SEQ ID NO: 6005115 - DNA, 22 bp, Homo sapiens
cactgacctggaagagctgggt

SEQ ID NO: 6005116 - DNA, 15 bp, Homo sapiens
cactgacgtttctgg

SEQ ID NO: 6005117 - DNA, 15 bp, Homo sapiens
cactgactactggct

SEQ ID NO: 6005118 - DNA, 17 bp, Homo sapiens
cactgactagagtgatg

SEQ ID NO: 6005119 - DNA, 20 bp, Homo sapiens
cactgactataccaactggg

SEQ ID NO: 6005120 - DNA, 12 bp, Homo sapiens
cactgactctgg

SEQ ID NO: 6005121 - DNA, 13 bp, Homo sapiens
cactgactctgga

SEQ ID NO: 6005122 - DNA, 20 bp, Homo sapiens
cactgactgaactgtaatgt

SEQ ID NO: 6005123 - DNA, 22 bp, Homo sapiens
cactgacttaggtttcaggaag

SEQ ID NO: 6005124 - DNA, 14 bp, Homo sapiens
cactgacttctaag

SEQ ID NO: 6005125 - DNA, 15 bp, Homo sapiens
cactgacttgctgtg

SEQ ID NO: 6005126 - DNA, 16 bp, Homo sapiens
cactgacttgctgtgt

SEQ ID NO: 6005127 - DNA, 20 bp, Homo sapiens
cactgagaagatggcactgt

SEQ ID NO: 6005128 - DNA, 24 bp, Homo sapiens
cactgagaagatggcactgtccag

SEQ ID NO: 6005129 - DNA, 17 bp, Homo sapiens
cactgagaagattgtga

SEQ ID NO: 6005130 - DNA, 19 bp, Homo sapiens
cactgagaagattgtgaat

SEQ ID NO: 6005131 - DNA, 17 bp, Homo sapiens
cactgagaaggccccag

SEQ ID NO: 6005132 - DNA, 17 bp, Homo sapiens
cactgagaatgatagta

SEQ ID NO: 6005133 - DNA, 16 bp, Homo sapiens
cactgagaatgtaaga

SEQ ID NO: 6005134 - DNA, 12 bp, Homo sapiens
cactgagacagc

SEQ ID NO: 6005135 - DNA, 14 bp, Homo sapiens
cactgagacagccc

SEQ ID NO: 6005136 - DNA, 17 bp, Homo sapiens
cactgagacagcccggg

SEQ ID NO: 6005137 - DNA, 18 bp, Homo sapiens
cactgagaccttcaggcc

SEQ ID NO: 6005138 - DNA, 22 bp, Homo sapiens
cactgagactagattctcacct

SEQ ID NO: 6005139 - DNA, 16 bp, Homo sapiens
cactgagactttcccc

SEQ ID NO: 6005140 - DNA, 18 bp, Homo sapiens
cactgagactttcccctc

SEQ ID NO: 6005141 - DNA, 20 bp, Homo sapiens
cactgagactttcccctctc

SEQ ID NO: 6005142 - DNA, 17 bp, Homo sapiens
cactgagagctgctcct

SEQ ID NO: 6005143 - DNA, 20 bp, Homo sapiens
cactgagagggcaaggaagt

SEQ ID NO: 6005144 - DNA, 19 bp, Homo sapiens
cactgagatccagagaggc

SEQ ID NO: 6005145 - DNA, 19 bp, Homo sapiens
cactgagatttaaatgcaa

SEQ ID NO: 6005146 - DNA, 14 bp, Homo sapiens
cactgagcacagtc

SEQ ID NO: 6005147 - DNA, 15 bp, Homo sapiens
cactgagcactgttt

SEQ ID NO: 6005148 - DNA, 17 bp, Homo sapiens
cactgagcactgttttc

SEQ ID NO: 6005149 - DNA, 18 bp, Homo sapiens
cactgagcactgttttct

SEQ ID NO: 6005150 - DNA, 19 bp, Homo sapiens
cactgagcactgttttcta

SEQ ID NO: 6005151 - DNA, 13 bp, Homo sapiens
cactgagcagagt

SEQ ID NO: 6005152 - DNA, 12 bp, Homo sapiens
cactgagcaggg

SEQ ID NO: 6005153 - DNA, 19 bp, Homo sapiens
cactgagcatcacaataaa

SEQ ID NO: 6005154 - DNA, 21 bp, Homo sapiens
cactgagcatcactagtgaca

SEQ ID NO: 6005155 - DNA, 22 bp, Homo sapiens
cactgagcatcactagtgacaa

SEQ ID NO: 6005156 - DNA, 12 bp, Homo sapiens
cactgagccagt

SEQ ID NO: 6005157 - DNA, 15 bp, Homo sapiens
cactgagccatcatt

SEQ ID NO: 6005158 - DNA, 13 bp, Homo sapiens
cactgagcccttg

SEQ ID NO: 6005159 - DNA, 20 bp, Homo sapiens
cactgagcccttgcacaggc

SEQ ID NO: 6005160 - DNA, 22 bp, Homo sapiens
cactgagcccttgcacaggcca

SEQ ID NO: 6005161 - DNA, 12 bp, Homo sapiens
cactgagcctgg

SEQ ID NO: 6005162 - DNA, 16 bp, Homo sapiens
cactgagcgcctgcag

SEQ ID NO: 6005163 - DNA, 21 bp, Homo sapiens
cactgagctcacatgggactg

SEQ ID NO: 6005164 - DNA, 17 bp, Homo sapiens
cactgagctccatgtgc

SEQ ID NO: 6005165 - DNA, 15 bp, Homo sapiens
cactgagctgtcatg

SEQ ID NO: 6005166 - DNA, 14 bp, Homo sapiens
cactgagcttctga

SEQ ID NO: 6005167 - DNA, 15 bp, Homo sapiens
cactgagcttctgag

SEQ ID NO: 6005168 - DNA, 14 bp, Homo sapiens
cactgaggaagaac

SEQ ID NO: 6005169 - DNA, 11 bp, Homo sapiens
cactgaggaga

SEQ ID NO: 6005170 - DNA, 15 bp, Homo sapiens
cactgaggatgtgag

SEQ ID NO: 6005171 - DNA, 20 bp, Homo sapiens
cactgaggatgtgagcctga

SEQ ID NO: 6005172 - DNA, 13 bp, Homo sapiens
cactgaggcagcc

SEQ ID NO: 6005173 - DNA, 19 bp, Homo sapiens
cactgaggcagccttgggg

SEQ ID NO: 6005174 - DNA, 16 bp, Homo sapiens
cactgaggcagggaag

SEQ ID NO: 6005175 - DNA, 12 bp, Homo sapiens
cactgaggccat

SEQ ID NO: 6005176 - DNA, 18 bp, Homo sapiens
cactgaggccatcagggc

SEQ ID NO: 6005177 - DNA, 16 bp, Homo sapiens
cactgaggcctgagac

SEQ ID NO: 6005178 - DNA, 20 bp, Homo sapiens
cactgaggcttaggcctctc

SEQ ID NO: 6005179 - DNA, 21 bp, Homo sapiens
cactgaggcttaggcctctct

SEQ ID NO: 6005180 - DNA, 13 bp, Homo sapiens
cactgagggccac

SEQ ID NO: 6005181 - DNA, 14 bp, Homo sapiens
cactgagggccaca

SEQ ID NO: 6005182 - DNA, 13 bp, Homo sapiens
cactgaggggcca

SEQ ID NO: 6005183 - DNA, 15 bp, Homo sapiens
cactgaggggccagg

SEQ ID NO: 6005184 - DNA, 17 bp, Homo sapiens
cactgaggtccacagac

SEQ ID NO: 6005185 - DNA, 15 bp, Homo sapiens
cactgagtacaaatg

SEQ ID NO: 6005186 - DNA, 19 bp, Homo sapiens
cactgagtacaaatgtgtg

SEQ ID NO: 6005187 - DNA, 20 bp, Homo sapiens
cactgagtctcattcctctg

SEQ ID NO: 6005188 - DNA, 15 bp, Homo sapiens
cactgagtctttctt

SEQ ID NO: 6005189 - DNA, 16 bp, Homo sapiens
cactgagtgaaatatt

SEQ ID NO: 6005190 - DNA, 12 bp, Homo sapiens
cactgagttcta

SEQ ID NO: 6005191 - DNA, 16 bp, Homo sapiens
cactgagttgcacata

SEQ ID NO: 6005192 - DNA, 14 bp, Homo sapiens
cactgagtttgaac

SEQ ID NO: 6005193 - DNA, 19 bp, Homo sapiens
cactgatacataaaaatta

SEQ ID NO: 6005194 - DNA, 14 bp, Homo sapiens
cactgatagtcctt

SEQ ID NO: 6005195 - DNA, 21 bp, Homo sapiens
cactgatagttgccttttctt

SEQ ID NO: 6005196 - DNA, 15 bp, Homo sapiens
cactgatattcagaa

SEQ ID NO: 6005197 - DNA, 22 bp, Homo sapiens
cactgatattttacctcttatt

SEQ ID NO: 6005198 - DNA, 20 bp, Homo sapiens
cactgatcaccatgtaaggt

SEQ ID NO: 6005199 - DNA, 13 bp, Homo sapiens
cactgatcaccca

SEQ ID NO: 6005200 - DNA, 17 bp, Homo sapiens
cactgatgaactagtga

SEQ ID NO: 6005201 - DNA, 20 bp, Homo sapiens
cactgatgagtttcactgta

SEQ ID NO: 6005202 - DNA, 17 bp, Homo sapiens
cactgatgctgttctct

SEQ ID NO: 6005203 - DNA, 19 bp, Homo sapiens
cactgatggacaaggaggt

SEQ ID NO: 6005204 - DNA, 21 bp, Homo sapiens
cactgatggctcaagacaagg

SEQ ID NO: 6005205 - DNA, 15 bp, Homo sapiens
cactgatgggaataa

SEQ ID NO: 6005206 - DNA, 21 bp, Homo sapiens
cactgatgggaataaaagtat

SEQ ID NO: 6005207 - DNA, 15 bp, Homo sapiens
cactgatgggctggg

SEQ ID NO: 6005208 - DNA, 21 bp, Homo sapiens
cactgatgggctggggcaggg

SEQ ID NO: 6005209 - DNA, 21 bp, Homo sapiens
cactgatgggtcctgctgctc

SEQ ID NO: 6005210 - DNA, 22 bp, Homo sapiens
cactgatgggtcctgctgctcg

SEQ ID NO: 6005211 - DNA, 18 bp, Homo sapiens
cactgatgtccctccttt

SEQ ID NO: 6005212 - DNA, 19 bp, Homo sapiens
cactgatgtccctcctttt

SEQ ID NO: 6005213 - DNA, 19 bp, Homo sapiens
cactgatgttgtgttttta

SEQ ID NO: 6005214 - DNA, 22 bp, Homo sapiens
cactgattatagtactgacaga

SEQ ID NO: 6005215 - DNA, 17 bp, Homo sapiens
cactgattccctctccc

SEQ ID NO: 6005216 - DNA, 20 bp, Homo sapiens
cactgattccctctcccacc

SEQ ID NO: 6005217 - DNA, 22 bp, Homo sapiens
cactgattccctctcccaccca

SEQ ID NO: 6005218 - DNA, 15 bp, Homo sapiens
cactgcaaaatgtct

SEQ ID NO: 6005219 - DNA, 16 bp, Homo sapiens
cactgcaaacacacct

SEQ ID NO: 6005220 - DNA, 18 bp, Homo sapiens
cactgcaaacacaccttg

SEQ ID NO: 6005221 - DNA, 17 bp, Homo sapiens
cactgcaaaccctgctg

SEQ ID NO: 6005222 - DNA, 20 bp, Homo sapiens
cactgcaaaccgccacctcc

SEQ ID NO: 6005223 - DNA, 19 bp, Homo sapiens
cactgcaaataaagccttt

SEQ ID NO: 6005224 - DNA, 17 bp, Homo sapiens
cactgcaacccatgagc

SEQ ID NO: 6005225 - DNA, 19 bp, Homo sapiens
cactgcaacctcacctccc

SEQ ID NO: 6005226 - DNA, 14 bp, Homo sapiens
cactgcaacctcca

SEQ ID NO: 6005227 - DNA, 16 bp, Homo sapiens
cactgcaacctccacc

SEQ ID NO: 6005228 - DNA, 17 bp, Homo sapiens
cactgcaacctccacct

SEQ ID NO: 6005229 - DNA, 20 bp, Homo sapiens
cactgcaacctccacctccc

SEQ ID NO: 6005230 - DNA, 16 bp, Homo sapiens
cactgcaacctctgcc

SEQ ID NO: 6005231 - DNA, 18 bp, Homo sapiens
cactgcaacctctgcctc

SEQ ID NO: 6005232 - DNA, 22 bp, Homo sapiens
cactgcaacttccgcctcctgt

SEQ ID NO: 6005233 - DNA, 14 bp, Homo sapiens
caggaaccagggcc

SEQ ID NO: 6005234 - DNA, 20 bp, Homo sapiens
caggaaccagggcctccctg

SEQ ID NO: 6005235 - DNA, 15 bp, Homo sapiens
caggaacccaccctc

SEQ ID NO: 6005236 - DNA, 14 bp, Homo sapiens
caggaacccagcca

SEQ ID NO: 6005237 - DNA, 15 bp, Homo sapiens
caggaacccagccag

SEQ ID NO: 6005238 - DNA, 19 bp, Homo sapiens
caggaacccatcactgtgt

SEQ ID NO: 6005239 - DNA, 16 bp, Homo sapiens
caggaaccctggagac

SEQ ID NO: 6005240 - DNA, 15 bp, Homo sapiens
caggaaccgaggcag

SEQ ID NO: 6005241 - DNA, 17 bp, Homo sapiens
caggaaccgaggcaggg

SEQ ID NO: 6005242 - DNA, 16 bp, Homo sapiens
caggaaccggagggtg

SEQ ID NO: 6005243 - DNA, 21 bp, Homo sapiens
caggaacctcgagtactgtgg

SEQ ID NO: 6005244 - DNA, 15 bp, Homo sapiens
caggaacctggacca

SEQ ID NO: 6005245 - DNA, 19 bp, Homo sapiens
caggaacctggaccaaagc

SEQ ID NO: 6005246 - DNA, 20 bp, Homo sapiens
caggaacctgtactgggtta

SEQ ID NO: 6005247 - DNA, 21 bp, Homo sapiens
caggaacctgtcctaaggaac

SEQ ID NO: 6005248 - DNA, 13 bp, Homo sapiens
caggaacgagcac

SEQ ID NO: 6005249 - DNA, 15 bp, Homo sapiens
caggaacgagcactg

SEQ ID NO: 6005250 - DNA, 16 bp, Homo sapiens
caggaacgagcactgg

SEQ ID NO: 6005251 - DNA, 20 bp, Homo sapiens
caggaacgagcactggccag

SEQ ID NO: 6005252 - DNA, 21 bp, Homo sapiens
caggaacgagcactggccaga

SEQ ID NO: 6005253 - DNA, 16 bp, Homo sapiens
caggaacggccctgca

SEQ ID NO: 6005254 - DNA, 15 bp, Homo sapiens
caggaacgtttagct

SEQ ID NO: 6005255 - DNA, 19 bp, Homo sapiens
caggaactagactgcctgg

SEQ ID NO: 6005256 - DNA, 20 bp, Homo sapiens
caggaactagattataagcc

SEQ ID NO: 6005257 - DNA, 21 bp, Homo sapiens
caggaactagattataagcct

SEQ ID NO: 6005258 - DNA, 20 bp, Homo sapiens
caggaactatgggagcctca

SEQ ID NO: 6005259 - DNA, 14 bp, Homo sapiens
caggaactcccagc

SEQ ID NO: 6005260 - DNA, 15 bp, Homo sapiens
caggaactcccagca

SEQ ID NO: 6005261 - DNA, 22 bp, Homo sapiens
caggaactctggacccctgggc

SEQ ID NO: 6005262 - DNA, 21 bp, Homo sapiens
caggaactctgtgtgagagag

SEQ ID NO: 6005263 - DNA, 23 bp, Homo sapiens
caggaactctgtgtgagagagag

SEQ ID NO: 6005264 - DNA, 12 bp, Homo sapiens
caggaactgaaa

SEQ ID NO: 6005265 - DNA, 13 bp, Homo sapiens
caggaactgcctg

SEQ ID NO: 6005266 - DNA, 15 bp, Homo sapiens
caggaactggctcct

SEQ ID NO: 6005267 - DNA, 12 bp, Homo sapiens
caggaactgggc

SEQ ID NO: 6005268 - DNA, 15 bp, Homo sapiens
caggaactgggctgg

SEQ ID NO: 6005269 - DNA, 18 bp, Homo sapiens
caggaactgggctgggcc

SEQ ID NO: 6005270 - DNA, 22 bp, Homo sapiens
caggaactggggctttgccttg

SEQ ID NO: 6005271 - DNA, 15 bp, Homo sapiens
caggaacttctagct

SEQ ID NO: 6005272 - DNA, 20 bp, Homo sapiens
caggaacttctagctcattt

SEQ ID NO: 6005273 - DNA, 13 bp, Homo sapiens
caggaagaaaccc

SEQ ID NO: 6005274 - DNA, 20 bp, Homo sapiens
caggaagaaaccccaagcag

SEQ ID NO: 6005275 - DNA, 23 bp, Homo sapiens
caggaagaaaccccaagcagcat

SEQ ID NO: 6005276 - DNA, 20 bp, Homo sapiens
caggaagaaacttttttatt

SEQ ID NO: 6005277 - DNA, 22 bp, Homo sapiens
caggaagaaacttttttatttt

SEQ ID NO: 6005278 - DNA, 22 bp, Homo sapiens
caggaagaaatcacagaatcat

SEQ ID NO: 6005279 - DNA, 22 bp, Homo sapiens
caggaagaatgggctgcagaag

SEQ ID NO: 6005280 - DNA, 16 bp, Homo sapiens
caggaagaccacatgc

SEQ ID NO: 6005281 - DNA, 19 bp, Homo sapiens
caggaagacccaacacatg

SEQ ID NO: 6005282 - DNA, 16 bp, Homo sapiens
caggaagactggagac

SEQ ID NO: 6005283 - DNA, 19 bp, Homo sapiens
caggaagactttgtgactg

SEQ ID NO: 6005284 - DNA, 15 bp, Homo sapiens
caggaagagaaggag

SEQ ID NO: 6005285 - DNA, 17 bp, Homo sapiens
caggaagagatgctcta

SEQ ID NO: 6005286 - DNA, 12 bp, Homo sapiens
caggaagaggcc

SEQ ID NO: 6005287 - DNA, 15 bp, Homo sapiens
caggaagaggcccac

SEQ ID NO: 6005288 - DNA, 18 bp, Homo sapiens
caggaagaggtaattttt

SEQ ID NO: 6005289 - DNA, 19 bp, Homo sapiens
caggaagaggtaatttttc

SEQ ID NO: 6005290 - DNA, 19 bp, Homo sapiens
caggaagatcccccagaaa

SEQ ID NO: 6005291 - DNA, 15 bp, Homo sapiens
caggaagatgggagg

SEQ ID NO: 6005292 - DNA, 18 bp, Homo sapiens
caggaagatgggaggtgg

SEQ ID NO: 6005293 - DNA, 19 bp, Homo sapiens
caggaagcaaggccagccc

SEQ ID NO: 6005294 - DNA, 13 bp, Homo sapiens
caggaagcacagc

SEQ ID NO: 6005295 - DNA, 14 bp, Homo sapiens
caggaagcacagca

SEQ ID NO: 6005296 - DNA, 14 bp, Homo sapiens
caggaagcacaggc

SEQ ID NO: 6005297 - DNA, 17 bp, Homo sapiens
caggaagcacaggccag

SEQ ID NO: 6005298 - DNA, 16 bp, Homo sapiens
caggaagcacaggtcc

SEQ ID NO: 6005299 - DNA, 17 bp, Homo sapiens
caggaagcaccccatgc

SEQ ID NO: 6005300 - DNA, 12 bp, Homo sapiens
caggaagcaggg

SEQ ID NO: 6005301 - DNA, 17 bp, Homo sapiens
caggaagccagagcccc

SEQ ID NO: 6005302 - DNA, 18 bp, Homo sapiens
caggaagccagcaggctc

SEQ ID NO: 6005303 - DNA, 22 bp, Homo sapiens
caggaagccagcaggctctcag

SEQ ID NO: 6005304 - DNA, 12 bp, Homo sapiens
caggaagccagg

SEQ ID NO: 6005305 - DNA, 18 bp, Homo sapiens
caggaagccaggctgagt

SEQ ID NO: 6005306 - DNA, 15 bp, Homo sapiens
caggaagcccacact

SEQ ID NO: 6005307 - DNA, 15 bp, Homo sapiens
caggaagcccactgc

SEQ ID NO: 6005308 - DNA, 20 bp, Homo sapiens
caggaagcccactgcctcct

SEQ ID NO: 6005309 - DNA, 23 bp, Homo sapiens
caggaagcccactgcctcctccc

SEQ ID NO: 6005310 - DNA, 24 bp, Homo sapiens
caggaagccccgctcaggtagcca

SEQ ID NO: 6005311 - DNA, 15 bp, Homo sapiens
caggaagccgtcctg

SEQ ID NO: 6005312 - DNA, 18 bp, Homo sapiens
caggaagccgtcctggcg

SEQ ID NO: 6005313 - DNA, 15 bp, Homo sapiens
caggaagcctcaagt

SEQ ID NO: 6005314 - DNA, 22 bp, Homo sapiens
caggaagcctcctgctgagtgg

SEQ ID NO: 6005315 - DNA, 15 bp, Homo sapiens
caggaagcctgtggt

SEQ ID NO: 6005316 - DNA, 15 bp, Homo sapiens
caggaagcgagcaga

SEQ ID NO: 6005317 - DNA, 18 bp, Homo sapiens
caggaagcgagcagaggc

SEQ ID NO: 6005318 - DNA, 19 bp, Homo sapiens
caggaagcgagcagaggct

SEQ ID NO: 6005319 - DNA, 19 bp, Homo sapiens
caggaagctcagggcctgg

SEQ ID NO: 6005320 - DNA, 21 bp, Homo sapiens
caggaagctcagggcctggct

SEQ ID NO: 6005321 - DNA, 19 bp, Homo sapiens
caggaagctctcttaaaat

SEQ ID NO: 6005322 - DNA, 15 bp, Homo sapiens
caggaagctgctccg

SEQ ID NO: 6005323 - DNA, 18 bp, Homo sapiens
caggaagctgctccgtgc

SEQ ID NO: 6005324 - DNA, 14 bp, Homo sapiens
caggaagctggcag

SEQ ID NO: 6005325 - DNA, 21 bp, Homo sapiens
caggaagctttggtgagaacc

SEQ ID NO: 6005326 - DNA, 19 bp, Homo sapiens
caggaagctttttgtatta

SEQ ID NO: 6005327 - DNA, 13 bp, Homo sapiens
caggaaggaaaac

SEQ ID NO: 6005328 - DNA, 23 bp, Homo sapiens
caggaaggaaacaacattttctt

SEQ ID NO: 6005329 - DNA, 14 bp, Homo sapiens
caggaaggaaacag

SEQ ID NO: 6005330 - DNA, 15 bp, Homo sapiens
caggaaggaagagca

SEQ ID NO: 6005331 - DNA, 19 bp, Homo sapiens
caggaaggaagagcaagct

SEQ ID NO: 6005332 - DNA, 14 bp, Homo sapiens
caggaaggaagcac

SEQ ID NO: 6005333 - DNA, 18 bp, Homo sapiens
caggaaggacaggaagct

SEQ ID NO: 6005334 - DNA, 14 bp, Homo sapiens
caggaaggacatgg

SEQ ID NO: 6005335 - DNA, 15 bp, Homo sapiens
caggaaggaccccac

SEQ ID NO: 6005336 - DNA, 19 bp, Homo sapiens
caggaaggactatgaaaag

SEQ ID NO: 6005337 - DNA, 13 bp, Homo sapiens
caggaaggagcgg

SEQ ID NO: 6005338 - DNA, 16 bp, Homo sapiens
caggaaggagcggcgc

SEQ ID NO: 6005339 - DNA, 22 bp, Homo sapiens
caggaaggagcggcgccctgga

SEQ ID NO: 6005340 - DNA, 12 bp, Homo sapiens
caggaaggagct

SEQ ID NO: 6005341 - DNA, 14 bp, Homo sapiens
caggaaggagctgc

SEQ ID NO: 6005342 - DNA, 15 bp, Homo sapiens
caggaaggagctgcc

SEQ ID NO: 6005343 - DNA, 18 bp, Homo sapiens
caggaaggagctgcctgg

SEQ ID NO: 6005344 - DNA, 21 bp, Homo sapiens
caggaaggagctgcctggacc

SEQ ID NO: 6005345 - DNA, 23 bp, Homo sapiens
caggaaggaggagccgaccggga

SEQ ID NO: 6005346 - DNA, 18 bp, Homo sapiens
caggaaggatgagcattt

SEQ ID NO: 6005347 - DNA, 12 bp, Homo sapiens
caggaaggcagc

SEQ ID NO: 6005348 - DNA, 15 bp, Homo sapiens
caggaaggcagctgc

SEQ ID NO: 6005349 - DNA, 16 bp, Homo sapiens
caggaaggcagctgct

SEQ ID NO: 6005350 - DNA, 18 bp, Homo sapiens
caggaaggcagctgctct

SEQ ID NO: 6005351 - DNA, 14 bp, Homo sapiens
caggaaggcaggag

SEQ ID NO: 6005352 - DNA, 13 bp, Homo sapiens
caggaaggcctgg

SEQ ID NO: 6005353 - DNA, 15 bp, Homo sapiens
caggaaggcctgggt

SEQ ID NO: 6005354 - DNA, 15 bp, Homo sapiens
caggaaggcggcagg

SEQ ID NO: 6005355 - DNA, 22 bp, Homo sapiens
caggaaggcttgttgtgctttt

SEQ ID NO: 6005356 - DNA, 22 bp, Homo sapiens
caggaagggaaagcgggcagcc

SEQ ID NO: 6005357 - DNA, 13 bp, Homo sapiens
caggaagggaagc

SEQ ID NO: 6005358 - DNA, 19 bp, Homo sapiens
caggaagggagggagctga

SEQ ID NO: 6005359 - DNA, 21 bp, Homo sapiens
caggaagggagggagctgagg

SEQ ID NO: 6005360 - DNA, 23 bp, Homo sapiens
caggaagggagggagctgaggcc

SEQ ID NO: 6005361 - DNA, 24 bp, Homo sapiens
caggaagggagggagctgaggcct

SEQ ID NO: 6005362 - DNA, 21 bp, Homo sapiens
caggaagggagtgaggggctg

SEQ ID NO: 6005363 - DNA, 22 bp, Homo sapiens
caggaagggcctacagcccatt

SEQ ID NO: 6005364 - DNA, 23 bp, Homo sapiens
caggaaggggctggactggctgt

SEQ ID NO: 6005365 - DNA, 21 bp, Homo sapiens
caggaaggtaaaaacccagcg

SEQ ID NO: 6005366 - DNA, 22 bp, Homo sapiens
caggaaggtaaaaacccagcgg

SEQ ID NO: 6005367 - DNA, 17 bp, Homo sapiens
caggaaggtagcccagc

SEQ ID NO: 6005368 - DNA, 21 bp, Homo sapiens
caggaaggtagcccagcactg

SEQ ID NO: 6005369 - DNA, 18 bp, Homo sapiens
caggaaggtatcacacac

SEQ ID NO: 6005370 - DNA, 16 bp, Homo sapiens
caggaaggtctcatgc

SEQ ID NO: 6005371 - DNA, 20 bp, Homo sapiens
caggaaggtctcatgcctga

SEQ ID NO: 6005372 - DNA, 22 bp, Homo sapiens
caggaaggtctcatgcctgaga

SEQ ID NO: 6005373 - DNA, 16 bp, Homo sapiens
caggaaggtgcctggc

SEQ ID NO: 6005374 - DNA, 18 bp, Homo sapiens
caggaaggtgcctggcca

SEQ ID NO: 6005375 - DNA, 16 bp, Homo sapiens
caggaagtaaaataaa

SEQ ID NO: 6005376 - DNA, 22 bp, Homo sapiens
caggaagtaattttcttctcat

SEQ ID NO: 6005377 - DNA, 23 bp, Homo sapiens
caggaagtaattttcttctcatt

SEQ ID NO: 6005378 - DNA, 18 bp, Homo sapiens
caggaagtactggagaaa

SEQ ID NO: 6005379 - DNA, 15 bp, Homo sapiens
caggaagtacttcca

SEQ ID NO: 6005380 - DNA, 16 bp, Homo sapiens
caggaagtagaggagg

SEQ ID NO: 6005381 - DNA, 16 bp, Homo sapiens
caggaagtagcacagg

SEQ ID NO: 6005382 - DNA, 17 bp, Homo sapiens
caggaagtagcacaggc

SEQ ID NO: 6005383 - DNA, 20 bp, Homo sapiens
caggaagtagcacaggctga

SEQ ID NO: 6005384 - DNA, 21 bp, Homo sapiens
caggaagtcaggagccagcag

SEQ ID NO: 6005385 - DNA, 23 bp, Homo sapiens
caggaagtcaggagccagcaggg

SEQ ID NO: 6005386 - DNA, 20 bp, Homo sapiens
caggaagtcagtcacgtttc

SEQ ID NO: 6005387 - DNA, 15 bp, Homo sapiens
caggaagtccagctc

SEQ ID NO: 6005388 - DNA, 20 bp, Homo sapiens
caggaagtccctgagaagcc

SEQ ID NO: 6005389 - DNA, 21 bp, Homo sapiens
caggaagtccctgagaagcct

SEQ ID NO: 6005390 - DNA, 21 bp, Homo sapiens
caggaagtcccttgccatcct

SEQ ID NO: 6005391 - DNA, 21 bp, Homo sapiens
caggaagtccttatctagctg

SEQ ID NO: 6005392 - DNA, 21 bp, Homo sapiens
caggaagtgcttattctctca

SEQ ID NO: 6005393 - DNA, 17 bp, Homo sapiens
caggaagtggctcagac

SEQ ID NO: 6005394 - DNA, 22 bp, Homo sapiens
caggaagtgtttatgaggaaac

SEQ ID NO: 6005395 - DNA, 17 bp, Homo sapiens
caggaagtttggagcct

SEQ ID NO: 6005396 - DNA, 12 bp, Homo sapiens
caggaataaggc

SEQ ID NO: 6005397 - DNA, 15 bp, Homo sapiens
caggaatagatgtgg

SEQ ID NO: 6005398 - DNA, 14 bp, Homo sapiens
caggaatataaata

SEQ ID NO: 6005399 - DNA, 19 bp, Homo sapiens
caggaatatctgttcccag

SEQ ID NO: 6005400 - DNA, 21 bp, Homo sapiens
caggaatatgcatcccacagc

SEQ ID NO: 6005401 - DNA, 22 bp, Homo sapiens
caggaatatgcatcccacagcc

SEQ ID NO: 6005402 - DNA, 18 bp, Homo sapiens
caggaatcaaaaattgaa

SEQ ID NO: 6005403 - DNA, 15 bp, Homo sapiens
caggaatcacccctc

SEQ ID NO: 6005404 - DNA, 17 bp, Homo sapiens
caggaatcacccctctg

SEQ ID NO: 6005405 - DNA, 21 bp, Homo sapiens
caggaatcacccctctgcccc

SEQ ID NO: 6005406 - DNA, 22 bp, Homo sapiens
caggaatcacccctctgcccct

SEQ ID NO: 6005407 - DNA, 21 bp, Homo sapiens
caggaatcagtttaaaagcac

SEQ ID NO: 6005408 - DNA, 20 bp, Homo sapiens
caggaatcccggctccagag

SEQ ID NO: 6005409 - DNA, 22 bp, Homo sapiens
caggaatcccggctccagagca

SEQ ID NO: 6005410 - DNA, 21 bp, Homo sapiens
caggaatcctacgctatgtag

SEQ ID NO: 6005411 - DNA, 18 bp, Homo sapiens
caggaatccttactgata

SEQ ID NO: 6005412 - DNA, 17 bp, Homo sapiens
caggaatctcagagaca

SEQ ID NO: 6005413 - DNA, 19 bp, Homo sapiens
caggaatctgtatatattt

SEQ ID NO: 6005414 - DNA, 14 bp, Homo sapiens
caggaatcttaagg

SEQ ID NO: 6005415 - DNA, 12 bp, Homo sapiens
caggaatgaaaa

SEQ ID NO: 6005416 - DNA, 13 bp, Homo sapiens
caggaatgaaaac

SEQ ID NO: 6005417 - DNA, 16 bp, Homo sapiens
caggaatgaagaactg

SEQ ID NO: 6005418 - DNA, 16 bp, Homo sapiens
caggaatgaccctttt

SEQ ID NO: 6005419 - DNA, 15 bp, Homo sapiens
caggaatgagtcaat

SEQ ID NO: 6005420 - DNA, 19 bp, Homo sapiens
caggaatgcggttgggagg

SEQ ID NO: 6005421 - DNA, 23 bp, Homo sapiens
caggaatgcggttgggaggcagg

SEQ ID NO: 6005422 - DNA, 17 bp, Homo sapiens
caggaatggagcctgca

SEQ ID NO: 6005423 - DNA, 23 bp, Homo sapiens
caggaatggagcctgcacggtga

SEQ ID NO: 6005424 - DNA, 14 bp, Homo sapiens
caggaatggctgca

SEQ ID NO: 6005425 - DNA, 13 bp, Homo sapiens
caggaatgggctg

SEQ ID NO: 6005426 - DNA, 19 bp, Homo sapiens
caggaatggggggcgggcc

SEQ ID NO: 6005427 - DNA, 23 bp, Homo sapiens
caggaatggggggcgggccaggg

SEQ ID NO: 6005428 - DNA, 16 bp, Homo sapiens
caggaatgggggtcag

SEQ ID NO: 6005429 - DNA, 15 bp, Homo sapiens
caggaatggtgcttt

SEQ ID NO: 6005430 - DNA, 15 bp, Homo sapiens
caggaatgtctggag

SEQ ID NO: 6005431 - DNA, 19 bp, Homo sapiens
caggaatgtctggagtggt

SEQ ID NO: 6005432 - DNA, 17 bp, Homo sapiens
caggaatgtgtggcaga

SEQ ID NO: 6005433 - DNA, 16 bp, Homo sapiens
caggaatgtgtggcct

SEQ ID NO: 6005434 - DNA, 21 bp, Homo sapiens
caggaatgtgtggcctgcaca

SEQ ID NO: 6005435 - DNA, 22 bp, Homo sapiens
caggaattagagaagctgaaag

SEQ ID NO: 6005436 - DNA, 12 bp, Homo sapiens
caggaattcagt

SEQ ID NO: 6005437 - DNA, 16 bp, Homo sapiens
caggaattcagtgcct

SEQ ID NO: 6005438 - DNA, 19 bp, Homo sapiens
caggaattcagtgccttca

SEQ ID NO: 6005439 - DNA, 13 bp, Homo sapiens
caggcaccctcag

SEQ ID NO: 6005440 - DNA, 20 bp, Homo sapiens
caggcaccctcagggagcct

SEQ ID NO: 6005441 - DNA, 13 bp, Homo sapiens
caggcaccgagaa

SEQ ID NO: 6005442 - DNA, 12 bp, Homo sapiens
caggcaccgcca

SEQ ID NO: 6005443 - DNA, 12 bp, Homo sapiens
caggcaccgcct

SEQ ID NO: 6005444 - DNA, 13 bp, Homo sapiens
caggcaccgcctg

SEQ ID NO: 6005445 - DNA, 20 bp, Homo sapiens
caggcaccgcctgcccccag

SEQ ID NO: 6005446 - DNA, 23 bp, Homo sapiens
caggcaccgggctggctgcttgc

SEQ ID NO: 6005447 - DNA, 15 bp, Homo sapiens
caggcacctcacaga

SEQ ID NO: 6005448 - DNA, 14 bp, Homo sapiens
caggcacctcttcc

SEQ ID NO: 6005449 - DNA, 15 bp, Homo sapiens
caggcacctcttcct

SEQ ID NO: 6005450 - DNA, 17 bp, Homo sapiens
caggcacctggcctgct

SEQ ID NO: 6005451 - DNA, 14 bp, Homo sapiens
caggcacctgggct

SEQ ID NO: 6005452 - DNA, 19 bp, Homo sapiens
caggcaccttcttggcgct

SEQ ID NO: 6005453 - DNA, 16 bp, Homo sapiens
caggcacgaacccacc

SEQ ID NO: 6005454 - DNA, 19 bp, Homo sapiens
caggcacgaacccacctgc

SEQ ID NO: 6005455 - DNA, 16 bp, Homo sapiens
caggcacggaggctcg

SEQ ID NO: 6005456 - DNA, 22 bp, Homo sapiens
caggcacgtctcctgctgcgtg

SEQ ID NO: 6005457 - DNA, 18 bp, Homo sapiens
caggcactctcatcaccc

SEQ ID NO: 6005458 - DNA, 19 bp, Homo sapiens
caggcactctcctgtctga

SEQ ID NO: 6005459 - DNA, 20 bp, Homo sapiens
caggcactgagaatgatagt

SEQ ID NO: 6005460 - DNA, 21 bp, Homo sapiens
caggcactgcaaaccgccacc

SEQ ID NO: 6005461 - DNA, 19 bp, Homo sapiens
caggcactgcccttttcag

SEQ ID NO: 6005462 - DNA, 16 bp, Homo sapiens
caggcactgccttctc

SEQ ID NO: 6005463 - DNA, 20 bp, Homo sapiens
caggcactgcgccacctgct

SEQ ID NO: 6005464 - DNA, 22 bp, Homo sapiens
caggcactgcgccacctgcttc

SEQ ID NO: 6005465 - DNA, 23 bp, Homo sapiens
caggcactgctgcccagcctcca

SEQ ID NO: 6005466 - DNA, 18 bp, Homo sapiens
caggcactggctgaactt

SEQ ID NO: 6005467 - DNA, 21 bp, Homo sapiens
caggcacttaagcacaagcag

SEQ ID NO: 6005468 - DNA, 12 bp, Homo sapiens
caggcacttggc

SEQ ID NO: 6005469 - DNA, 15 bp, Homo sapiens
caggcactttagaaa

SEQ ID NO: 6005470 - DNA, 14 bp, Homo sapiens
caggcagaaaactg

SEQ ID NO: 6005471 - DNA, 24 bp, Homo sapiens
caggcagaaaactggcagtgcacc

SEQ ID NO: 6005472 - DNA, 15 bp, Homo sapiens
caggcagaaagagtt

SEQ ID NO: 6005473 - DNA, 20 bp, Homo sapiens
caggcagaaatagttgtctg

SEQ ID NO: 6005474 - DNA, 19 bp, Homo sapiens
caggcagaaccggtcccag

SEQ ID NO: 6005475 - DNA, 22 bp, Homo sapiens
caggcagaaccggtcccagcct

SEQ ID NO: 6005476 - DNA, 14 bp, Homo sapiens
caggcagaagaatc

SEQ ID NO: 6005477 - DNA, 12 bp, Homo sapiens
caggcagaatca

SEQ ID NO: 6005478 - DNA, 15 bp, Homo sapiens
caggcagaatggctg

SEQ ID NO: 6005479 - DNA, 19 bp, Homo sapiens
caggcagaatggctgcacg

SEQ ID NO: 6005480 - DNA, 17 bp, Homo sapiens
caggcagacaaccttgt

SEQ ID NO: 6005481 - DNA, 15 bp, Homo sapiens
caggcagacacatgc

SEQ ID NO: 6005482 - DNA, 16 bp, Homo sapiens
caggcagagaacagaa

SEQ ID NO: 6005483 - DNA, 18 bp, Homo sapiens
caggcagagaagtggagt

SEQ ID NO: 6005484 - DNA, 14 bp, Homo sapiens
caggcagagaatca

SEQ ID NO: 6005485 - DNA, 21 bp, Homo sapiens
caggcagagagcgaccagcag

SEQ ID NO: 6005486 - DNA, 21 bp, Homo sapiens
caggcagagagtacagactgc

SEQ ID NO: 6005487 - DNA, 13 bp, Homo sapiens
caggcagagcggg

SEQ ID NO: 6005488 - DNA, 16 bp, Homo sapiens
caggcagagcggggag

SEQ ID NO: 6005489 - DNA, 19 bp, Homo sapiens
caggcagagcggggaggtg

SEQ ID NO: 6005490 - DNA, 22 bp, Homo sapiens
caggcagagctcagcacagcct

SEQ ID NO: 6005491 - DNA, 13 bp, Homo sapiens
caggcagagctga

SEQ ID NO: 6005492 - DNA, 21 bp, Homo sapiens
caggcagagctgagggccctg

SEQ ID NO: 6005493 - DNA, 22 bp, Homo sapiens
caggcagagctgagggccctgt

SEQ ID NO: 6005494 - DNA, 17 bp, Homo sapiens
caggcagagctggagcc

SEQ ID NO: 6005495 - DNA, 12 bp, Homo sapiens
caggcagaggag

SEQ ID NO: 6005496 - DNA, 14 bp, Homo sapiens
caggcagaggatgt

SEQ ID NO: 6005497 - DNA, 20 bp, Homo sapiens
caggcagaggcccaggctgc

SEQ ID NO: 6005498 - DNA, 17 bp, Homo sapiens
caggcagaggttttaat

SEQ ID NO: 6005499 - DNA, 20 bp, Homo sapiens
caggcagagtggcgtggcct

SEQ ID NO: 6005500 - DNA, 22 bp, Homo sapiens
caggcagagtggcgtggcctcc

SEQ ID NO: 6005501 - DNA, 15 bp, Homo sapiens
caggcagagttctgt

SEQ ID NO: 6005502 - DNA, 18 bp, Homo sapiens
caggcagagttctgtggc

SEQ ID NO: 6005503 - DNA, 17 bp, Homo sapiens
caggcagataactgctg

SEQ ID NO: 6005504 - DNA, 16 bp, Homo sapiens
caggcagatcacctga

SEQ ID NO: 6005505 - DNA, 13 bp, Homo sapiens
caggcagatccag

SEQ ID NO: 6005506 - DNA, 18 bp, Homo sapiens
caggcagatcctctggac

SEQ ID NO: 6005507 - DNA, 16 bp, Homo sapiens
caggcagatctgtgcc

SEQ ID NO: 6005508 - DNA, 21 bp, Homo sapiens
caggcagatctgtgccccatg

SEQ ID NO: 6005509 - DNA, 22 bp, Homo sapiens
caggcagatctgtgccccatgc

SEQ ID NO: 6005510 - DNA, 21 bp, Homo sapiens
caggcagatttactgtcccag

SEQ ID NO: 6005511 - DNA, 22 bp, Homo sapiens
caggcagatttactgtcccagg

SEQ ID NO: 6005512 - DNA, 22 bp, Homo sapiens
caggcagcaaggtcatggtctg

SEQ ID NO: 6005513 - DNA, 13 bp, Homo sapiens
caggcagcaccac

SEQ ID NO: 6005514 - DNA, 17 bp, Homo sapiens
caggcagcagacacatg

SEQ ID NO: 6005515 - DNA, 12 bp, Homo sapiens
caggcagcagag

SEQ ID NO: 6005516 - DNA, 23 bp, Homo sapiens
caggcagcagagacttgggacat

SEQ ID NO: 6005517 - DNA, 16 bp, Homo sapiens
caggcagcaggggctg

SEQ ID NO: 6005518 - DNA, 15 bp, Homo sapiens
caggcagccaccagt

SEQ ID NO: 6005519 - DNA, 18 bp, Homo sapiens
caggcagccaccagtgga

SEQ ID NO: 6005520 - DNA, 14 bp, Homo sapiens
caggcagccaggcc

SEQ ID NO: 6005521 - DNA, 19 bp, Homo sapiens
caggcagccagtgccctga

SEQ ID NO: 6005522 - DNA, 14 bp, Homo sapiens
caggcagcccagca

SEQ ID NO: 6005523 - DNA, 16 bp, Homo sapiens
caggcagcccagcagt

SEQ ID NO: 6005524 - DNA, 12 bp, Homo sapiens
caggcagcccta

SEQ ID NO: 6005525 - DNA, 11 bp, Homo sapiens
caggcagcctc

SEQ ID NO: 6005526 - DNA, 15 bp, Homo sapiens
caggcagcctcaagg

SEQ ID NO: 6005527 - DNA, 14 bp, Homo sapiens
caggcagcctcctt

SEQ ID NO: 6005528 - DNA, 15 bp, Homo sapiens
caggcagcctccttt

SEQ ID NO: 6005529 - DNA, 17 bp, Homo sapiens
caggcagcctcctttgt

SEQ ID NO: 6005530 - DNA, 14 bp, Homo sapiens
caggcagcctctgg

SEQ ID NO: 6005531 - DNA, 15 bp, Homo sapiens
caggcagcctctggg

SEQ ID NO: 6005532 - DNA, 19 bp, Homo sapiens
caggcagcctctggggggt

SEQ ID NO: 6005533 - DNA, 17 bp, Homo sapiens
caggcagcctctgtcag

SEQ ID NO: 6005534 - DNA, 21 bp, Homo sapiens
caggcagcctctgtcaggcct

SEQ ID NO: 6005535 - DNA, 14 bp, Homo sapiens
caggcagcctgcag

SEQ ID NO: 6005536 - DNA, 18 bp, Homo sapiens
caggcagcctgtgggtcc

SEQ ID NO: 6005537 - DNA, 19 bp, Homo sapiens
caggcagcctgtgggtcct

SEQ ID NO: 6005538 - DNA, 13 bp, Homo sapiens
caggcagccttga

SEQ ID NO: 6005539 - DNA, 21 bp, Homo sapiens
caggcagcgatggtctcagaa

SEQ ID NO: 6005540 - DNA, 17 bp, Homo sapiens
caggcagcgcagggctg

SEQ ID NO: 6005541 - DNA, 13 bp, Homo sapiens
caggcagcgccaa

SEQ ID NO: 6005542 - DNA, 15 bp, Homo sapiens
caggcagcgccaagc

SEQ ID NO: 6005543 - DNA, 20 bp, Homo sapiens
caggcagcgccaagtgcgtg

SEQ ID NO: 6005544 - DNA, 13 bp, Homo sapiens
caggcagcgccac

SEQ ID NO: 6005545 - DNA, 20 bp, Homo sapiens
caggcagcgccactgtccgc

SEQ ID NO: 6005546 - DNA, 15 bp, Homo sapiens
caggcagcgcctgtc

SEQ ID NO: 6005547 - DNA, 18 bp, Homo sapiens
caggcagcgcctgtcccc

SEQ ID NO: 6005548 - DNA, 21 bp, Homo sapiens
caggcagcgcctgtcccctca

SEQ ID NO: 6005549 - DNA, 17 bp, Homo sapiens
caggcagctaggcaggg

SEQ ID NO: 6005550 - DNA, 16 bp, Homo sapiens
caggcagctatttcag

SEQ ID NO: 6005551 - DNA, 22 bp, Homo sapiens
caggcagctatttcagcctcct

SEQ ID NO: 6005552 - DNA, 23 bp, Homo sapiens
caggcagctatttcagcctcctg

SEQ ID NO: 6005553 - DNA, 10 bp, Homo sapiens
caggcagctc

SEQ ID NO: 6005554 - DNA, 16 bp, Homo sapiens
caggcagctccagctg

SEQ ID NO: 6005555 - DNA, 15 bp, Homo sapiens
caggcagctccctcc

SEQ ID NO: 6005556 - DNA, 18 bp, Homo sapiens
caggcagctccctcctgc

SEQ ID NO: 6005557 - DNA, 15 bp, Homo sapiens
caggcagctgaaatt

SEQ ID NO: 6005558 - DNA, 15 bp, Homo sapiens
caggcagctggatga

SEQ ID NO: 6005559 - DNA, 22 bp, Homo sapiens
caggcagctgtcactgctgctt

SEQ ID NO: 6005560 - DNA, 20 bp, Homo sapiens
caggcagcttctactcctgc

SEQ ID NO: 6005561 - DNA, 18 bp, Homo sapiens
caggcagctttctagaag

SEQ ID NO: 6005562 - DNA, 13 bp, Homo sapiens
caggcaggaacaa

SEQ ID NO: 6005563 - DNA, 13 bp, Homo sapiens
caggcaggaagag

SEQ ID NO: 6005564 - DNA, 14 bp, Homo sapiens
caggcaggaagaga

SEQ ID NO: 6005565 - DNA, 17 bp, Homo sapiens
caggcaggaagagagag

SEQ ID NO: 6005566 - DNA, 20 bp, Homo sapiens
caggcaggaaggctgagagg

SEQ ID NO: 6005567 - DNA, 12 bp, Homo sapiens
caggcaggaagt

SEQ ID NO: 6005568 - DNA, 12 bp, Homo sapiens
caggcaggagca

SEQ ID NO: 6005569 - DNA, 17 bp, Homo sapiens
caggcaggaggatcact

SEQ ID NO: 6005570 - DNA, 18 bp, Homo sapiens
caggcaggcactgtggcc

SEQ ID NO: 6005571 - DNA, 16 bp, Homo sapiens
caggcaggcagcctga

SEQ ID NO: 6005572 - DNA, 19 bp, Homo sapiens
caggcaggccagatggccc

SEQ ID NO: 6005573 - DNA, 15 bp, Homo sapiens
caggcaggccaggct

SEQ ID NO: 6005574 - DNA, 18 bp, Homo sapiens
caggcaggccaggctgcc

SEQ ID NO: 6005575 - DNA, 19 bp, Homo sapiens
caggcaggcccagcctctg

SEQ ID NO: 6005576 - DNA, 15 bp, Homo sapiens
caggcaggcggctcc

SEQ ID NO: 6005577 - DNA, 24 bp, Homo sapiens
caggcaggcggctcctcctcaccc

SEQ ID NO: 6005578 - DNA, 20 bp, Homo sapiens
caggcaggctaaggcgtgga

SEQ ID NO: 6005579 - DNA, 16 bp, Homo sapiens
caggcaggctcccagg

SEQ ID NO: 6005580 - DNA, 18 bp, Homo sapiens
caggcaggctcccaggga

SEQ ID NO: 6005581 - DNA, 14 bp, Homo sapiens
caggcaggctgggg

SEQ ID NO: 6005582 - DNA, 19 bp, Homo sapiens
caggcaggctgtgcgctga

SEQ ID NO: 6005583 - DNA, 16 bp, Homo sapiens
caggcagggagaaggg

SEQ ID NO: 6005584 - DNA, 16 bp, Homo sapiens
caggcagggagagagt

SEQ ID NO: 6005585 - DNA, 22 bp, Homo sapiens
caggcagggagtgtctgcagtc

SEQ ID NO: 6005586 - DNA, 18 bp, Homo sapiens
caggcagggcaaaggtca

SEQ ID NO: 6005587 - DNA, 20 bp, Homo sapiens
caggcagggccaacccttct

SEQ ID NO: 6005588 - DNA, 12 bp, Homo sapiens
caggcagggcct

SEQ ID NO: 6005589 - DNA, 16 bp, Homo sapiens
caggcagggcctggct

SEQ ID NO: 6005590 - DNA, 19 bp, Homo sapiens
caggcagggcctggctcca

SEQ ID NO: 6005591 - DNA, 20 bp, Homo sapiens
caggcagggcctggctccag

SEQ ID NO: 6005592 - DNA, 16 bp, Homo sapiens
caggcagggctctcct

SEQ ID NO: 6005593 - DNA, 20 bp, Homo sapiens
caggcagggctctcctggct

SEQ ID NO: 6005594 - DNA, 17 bp, Homo sapiens
caggcagggctgactct

SEQ ID NO: 6005595 - DNA, 13 bp, Homo sapiens
caggcagggctgc

SEQ ID NO: 6005596 - DNA, 16 bp, Homo sapiens
caggcagggctgcaga

SEQ ID NO: 6005597 - DNA, 22 bp, Homo sapiens
caggcagggctgcagagggaga

SEQ ID NO: 6005598 - DNA, 22 bp, Homo sapiens
caggcagggctgggccaggtct

SEQ ID NO: 6005599 - DNA, 23 bp, Homo sapiens
caggcagggctgggccaggtctc

SEQ ID NO: 6005600 - DNA, 21 bp, Homo sapiens
cactgtcactgccgacatccc

SEQ ID NO: 6005601 - DNA, 19 bp, Homo sapiens
cactgtcactttgctctgg

SEQ ID NO: 6005602 - DNA, 14 bp, Homo sapiens
cactgtcagagctg

SEQ ID NO: 6005603 - DNA, 17 bp, Homo sapiens
cactgtcagagctgttg

SEQ ID NO: 6005604 - DNA, 22 bp, Homo sapiens
cactgtcagagctgttggcctc

SEQ ID NO: 6005605 - DNA, 14 bp, Homo sapiens
cactgtcagccctc

SEQ ID NO: 6005606 - DNA, 14 bp, Homo sapiens
cactgtcagtccca

SEQ ID NO: 6005607 - DNA, 20 bp, Homo sapiens
cactgtcagtcccactgcac

SEQ ID NO: 6005608 - DNA, 22 bp, Homo sapiens
cactgtcagtcccactgcaccc

SEQ ID NO: 6005609 - DNA, 17 bp, Homo sapiens
cactgtcatcaatgttc

SEQ ID NO: 6005610 - DNA, 14 bp, Homo sapiens
cactgtcatgccca

SEQ ID NO: 6005611 - DNA, 17 bp, Homo sapiens
cactgtcatgcccagct

SEQ ID NO: 6005612 - DNA, 20 bp, Homo sapiens
cactgtcatgcccagcttgg

SEQ ID NO: 6005613 - DNA, 16 bp, Homo sapiens
cactgtcatgcttcat

SEQ ID NO: 6005614 - DNA, 14 bp, Homo sapiens
cactgtccagggcc

SEQ ID NO: 6005615 - DNA, 22 bp, Homo sapiens
cactgtcccagtagccaaggcc

SEQ ID NO: 6005616 - DNA, 19 bp, Homo sapiens
cactgtccccctacccacc

SEQ ID NO: 6005617 - DNA, 19 bp, Homo sapiens
cactgtcccggagctcagg

SEQ ID NO: 6005618 - DNA, 13 bp, Homo sapiens
cactgtccctacc

SEQ ID NO: 6005619 - DNA, 20 bp, Homo sapiens
cactgtccctaccactgagc

SEQ ID NO: 6005620 - DNA, 13 bp, Homo sapiens
cactgtccctcct

SEQ ID NO: 6005621 - DNA, 20 bp, Homo sapiens
cactgtccctcctggtgtca

SEQ ID NO: 6005622 - DNA, 13 bp, Homo sapiens
cactgtccctctt

SEQ ID NO: 6005623 - DNA, 15 bp, Homo sapiens
cactgtccctgtcct

SEQ ID NO: 6005624 - DNA, 16 bp, Homo sapiens
cactgtccctgtcctt

SEQ ID NO: 6005625 - DNA, 17 bp, Homo sapiens
cactgtccgcctctgcc

SEQ ID NO: 6005626 - DNA, 15 bp, Homo sapiens
cactgtccgctgtct

SEQ ID NO: 6005627 - DNA, 16 bp, Homo sapiens
cactgtcctattatat

SEQ ID NO: 6005628 - DNA, 18 bp, Homo sapiens
cactgtcctccaagccag

SEQ ID NO: 6005629 - DNA, 22 bp, Homo sapiens
cactgtcctccacacaagggaa

SEQ ID NO: 6005630 - DNA, 11 bp, Homo sapiens
cactgtcctgg

SEQ ID NO: 6005631 - DNA, 15 bp, Homo sapiens
cactgtcctggctgc

SEQ ID NO: 6005632 - DNA, 19 bp, Homo sapiens
cactgtcctgggcgccctg

SEQ ID NO: 6005633 - DNA, 21 bp, Homo sapiens
cactgtcctgggcgccctgga

SEQ ID NO: 6005634 - DNA, 22 bp, Homo sapiens
cactgtccttgaacccaacagt

SEQ ID NO: 6005635 - DNA, 22 bp, Homo sapiens
cactgtctcaactactcagctc

SEQ ID NO: 6005636 - DNA, 19 bp, Homo sapiens
cactgtctctaccaaaaaa

SEQ ID NO: 6005637 - DNA, 11 bp, Homo sapiens
cactgtctgag

SEQ ID NO: 6005638 - DNA, 13 bp, Homo sapiens
cactgtctgagag

SEQ ID NO: 6005639 - DNA, 23 bp, Homo sapiens
cactgtctgagagtttagttgta

SEQ ID NO: 6005640 - DNA, 13 bp, Homo sapiens
cactgtctgctgc

SEQ ID NO: 6005641 - DNA, 14 bp, Homo sapiens
cactgtctgctgcc

SEQ ID NO: 6005642 - DNA, 24 bp, Homo sapiens
cactgtctggggccccatcagctg

SEQ ID NO: 6005643 - DNA, 21 bp, Homo sapiens
cactgtctgtacctaaagcaa

SEQ ID NO: 6005644 - DNA, 13 bp, Homo sapiens
cactgtctgtccc

SEQ ID NO: 6005645 - DNA, 18 bp, Homo sapiens
cactgtctgtctggtcca

SEQ ID NO: 6005646 - DNA, 21 bp, Homo sapiens
cactgtcttatggattcattt

SEQ ID NO: 6005647 - DNA, 14 bp, Homo sapiens
cactgtcttgaaga

SEQ ID NO: 6005648 - DNA, 14 bp, Homo sapiens
cactgtcttgcagt

SEQ ID NO: 6005649 - DNA, 18 bp, Homo sapiens
cactgtcttgcctgccag

SEQ ID NO: 6005650 - DNA, 19 bp, Homo sapiens
cactgtctttaattctgta

SEQ ID NO: 6005651 - DNA, 13 bp, Homo sapiens
cactgtctttcct

SEQ ID NO: 6005652 - DNA, 13 bp, Homo sapiens
cactgtgaaattt

SEQ ID NO: 6005653 - DNA, 23 bp, Homo sapiens
cactgtgaactattttgaagaaa

SEQ ID NO: 6005654 - DNA, 13 bp, Homo sapiens
cactgtgaagaga

SEQ ID NO: 6005655 - DNA, 13 bp, Homo sapiens
cactgtgaaggac

SEQ ID NO: 6005656 - DNA, 22 bp, Homo sapiens
cactgtgacaatgactaagcca

SEQ ID NO: 6005657 - DNA, 12 bp, Homo sapiens
cactgtgacaca

SEQ ID NO: 6005658 - DNA, 13 bp, Homo sapiens
cactgtgacacac

SEQ ID NO: 6005659 - DNA, 22 bp, Homo sapiens
cactgtgacacactacaccaca

SEQ ID NO: 6005660 - DNA, 14 bp, Homo sapiens
cactgtgaccccca

SEQ ID NO: 6005661 - DNA, 20 bp, Homo sapiens
cactgtgacccccagctccg

SEQ ID NO: 6005662 - DNA, 16 bp, Homo sapiens
cactgtgacctgctcc

SEQ ID NO: 6005663 - DNA, 21 bp, Homo sapiens
cactgtgacctgctcctgccc

SEQ ID NO: 6005664 - DNA, 23 bp, Homo sapiens
cactgtgacctgctcctgcccac

SEQ ID NO: 6005665 - DNA, 17 bp, Homo sapiens
cactgtgagagttgtct

SEQ ID NO: 6005666 - DNA, 20 bp, Homo sapiens
cactgtgagagttgtctctg

SEQ ID NO: 6005667 - DNA, 22 bp, Homo sapiens
cactgtgagagttgtctctgtt

SEQ ID NO: 6005668 - DNA, 20 bp, Homo sapiens
cactgtgaggggaaggcctt

SEQ ID NO: 6005669 - DNA, 16 bp, Homo sapiens
cactgtgatgttggga

SEQ ID NO: 6005670 - DNA, 19 bp, Homo sapiens
cactgtgattttgccctcc

SEQ ID NO: 6005671 - DNA, 15 bp, Homo sapiens
cactgtgcacaccca

SEQ ID NO: 6005672 - DNA, 16 bp, Homo sapiens
cactgtgcactctact

SEQ ID NO: 6005673 - DNA, 17 bp, Homo sapiens
cactgtgcactgccctg

SEQ ID NO: 6005674 - DNA, 18 bp, Homo sapiens
cactgtgcacttagccat

SEQ ID NO: 6005675 - DNA, 16 bp, Homo sapiens
cactgtgcagacccag

SEQ ID NO: 6005676 - DNA, 17 bp, Homo sapiens
cactgtgcagacccagt

SEQ ID NO: 6005677 - DNA, 19 bp, Homo sapiens
cactgtgcagccggggagc

SEQ ID NO: 6005678 - DNA, 14 bp, Homo sapiens
cactgtgcaggccc

SEQ ID NO: 6005679 - DNA, 15 bp, Homo sapiens
cactgtgcaggccca

SEQ ID NO: 6005680 - DNA, 16 bp, Homo sapiens
cactgtgcaggcccag

SEQ ID NO: 6005681 - DNA, 19 bp, Homo sapiens
cactgtgcaggcccaggca

SEQ ID NO: 6005682 - DNA, 23 bp, Homo sapiens
cactgtgcaggcccaggcaggcc

SEQ ID NO: 6005683 - DNA, 13 bp, Homo sapiens
cactgtgcaggtg

SEQ ID NO: 6005684 - DNA, 23 bp, Homo sapiens
cactgtgcccagcagtttcccag

SEQ ID NO: 6005685 - DNA, 13 bp, Homo sapiens
cactgtgccctgg

SEQ ID NO: 6005686 - DNA, 14 bp, Homo sapiens
cactgtgccctggt

SEQ ID NO: 6005687 - DNA, 15 bp, Homo sapiens
cactgtgccctggtg

SEQ ID NO: 6005688 - DNA, 10 bp, Homo sapiens
cactgtgcct

SEQ ID NO: 6005689 - DNA, 13 bp, Homo sapiens
cactgtgcctcag

SEQ ID NO: 6005690 - DNA, 17 bp, Homo sapiens
cactgtgcctcagagac

SEQ ID NO: 6005691 - DNA, 21 bp, Homo sapiens
cactgtgcctcagagaccagg

SEQ ID NO: 6005692 - DNA, 21 bp, Homo sapiens
cactgtgcctttgcaaatcag

SEQ ID NO: 6005693 - DNA, 19 bp, Homo sapiens
cactgtgcgtcttggtgta

SEQ ID NO: 6005694 - DNA, 14 bp, Homo sapiens
cactgtgctcagcc

SEQ ID NO: 6005695 - DNA, 16 bp, Homo sapiens
cactgtgctcagggct

SEQ ID NO: 6005696 - DNA, 16 bp, Homo sapiens
cactgtgctccaacct

SEQ ID NO: 6005697 - DNA, 22 bp, Homo sapiens
cactgtgctcctaaaggcagca

SEQ ID NO: 6005698 - DNA, 17 bp, Homo sapiens
cactgtgctgagtctga

SEQ ID NO: 6005699 - DNA, 17 bp, Homo sapiens
cactgtgctgttgttat

SEQ ID NO: 6005700 - DNA, 19 bp, Homo sapiens
cactgtgctgttgttatga

SEQ ID NO: 6005701 - DNA, 20 bp, Homo sapiens
cactgtgcttaatttaaata

SEQ ID NO: 6005702 - DNA, 17 bp, Homo sapiens
cactgtgcttacagtga

SEQ ID NO: 6005703 - DNA, 18 bp, Homo sapiens
cactgtgcttacagtgac

SEQ ID NO: 6005704 - DNA, 17 bp, Homo sapiens
cactgtgcttcgagcca

SEQ ID NO: 6005705 - DNA, 12 bp, Homo sapiens
cactgtgcttgc

SEQ ID NO: 6005706 - DNA, 14 bp, Homo sapiens
cactgtgcttgctc

SEQ ID NO: 6005707 - DNA, 15 bp, Homo sapiens
cactgtgcttggcca

SEQ ID NO: 6005708 - DNA, 14 bp, Homo sapiens
cactgtgctttcag

SEQ ID NO: 6005709 - DNA, 22 bp, Homo sapiens
cactgtgctttctattgtacag

SEQ ID NO: 6005710 - DNA, 15 bp, Homo sapiens
cactgtggaactgcc

SEQ ID NO: 6005711 - DNA, 19 bp, Homo sapiens
cactgtggaactgccacct

SEQ ID NO: 6005712 - DNA, 21 bp, Homo sapiens
cactgtggaaggcctccctct

SEQ ID NO: 6005713 - DNA, 18 bp, Homo sapiens
cactgtggaagtccctca

SEQ ID NO: 6005714 - DNA, 22 bp, Homo sapiens
cactgtggaagtccctcagagg

SEQ ID NO: 6005715 - DNA, 13 bp, Homo sapiens
cactgtggacttg

SEQ ID NO: 6005716 - DNA, 24 bp, Homo sapiens
cactgtggacttggtcaccagctc

SEQ ID NO: 6005717 - DNA, 15 bp, Homo sapiens
cactgtggcactgcc

SEQ ID NO: 6005718 - DNA, 16 bp, Homo sapiens
cactgtggcactgcca

SEQ ID NO: 6005719 - DNA, 18 bp, Homo sapiens
cactgtggcactgccacc

SEQ ID NO: 6005720 - DNA, 20 bp, Homo sapiens
cactgtggcactgccaccag

SEQ ID NO: 6005721 - DNA, 16 bp, Homo sapiens
cactgtggcactggcc

SEQ ID NO: 6005722 - DNA, 19 bp, Homo sapiens
cactgtggcagcaggaggg

SEQ ID NO: 6005723 - DNA, 21 bp, Homo sapiens
cactgtggccacagccccctt

SEQ ID NO: 6005724 - DNA, 12 bp, Homo sapiens
cactgtggccag

SEQ ID NO: 6005725 - DNA, 22 bp, Homo sapiens
cactgtggccagagctggaagg

SEQ ID NO: 6005726 - DNA, 15 bp, Homo sapiens
cactgtggccaggcc

SEQ ID NO: 6005727 - DNA, 20 bp, Homo sapiens
cactgtggccttctcagcct

SEQ ID NO: 6005728 - DNA, 19 bp, Homo sapiens
cactgtggggcaagcctga

SEQ ID NO: 6005729 - DNA, 21 bp, Homo sapiens
cactgtggggcaagcctgagt

SEQ ID NO: 6005730 - DNA, 23 bp, Homo sapiens
cactgtggggcacttgatattta

SEQ ID NO: 6005731 - DNA, 21 bp, Homo sapiens
cactgtgggggctggtcctga

SEQ ID NO: 6005732 - DNA, 24 bp, Homo sapiens
cactgtgggtagacacacatgaag

SEQ ID NO: 6005733 - DNA, 18 bp, Homo sapiens
cactgtggtaaatgccac

SEQ ID NO: 6005734 - DNA, 15 bp, Homo sapiens
cactgtggtcaggcc

SEQ ID NO: 6005735 - DNA, 19 bp, Homo sapiens
cactgtggtcaggcccagc

SEQ ID NO: 6005736 - DNA, 21 bp, Homo sapiens
cactgtggtcaggcccagcct

SEQ ID NO: 6005737 - DNA, 18 bp, Homo sapiens
cactgtggtcgtcaactt

SEQ ID NO: 6005738 - DNA, 23 bp, Homo sapiens
cactgtggtcgtcaactttcctc

SEQ ID NO: 6005739 - DNA, 15 bp, Homo sapiens
cactgtggtttcaga

SEQ ID NO: 6005740 - DNA, 14 bp, Homo sapiens
cactgtggttttga

SEQ ID NO: 6005741 - DNA, 22 bp, Homo sapiens
cactgtgtaagaagctgtgaat

SEQ ID NO: 6005742 - DNA, 12 bp, Homo sapiens
cactgtgtaagc

SEQ ID NO: 6005743 - DNA, 14 bp, Homo sapiens
cactgtgtacacct

SEQ ID NO: 6005744 - DNA, 16 bp, Homo sapiens
cactgtgtactggagc

SEQ ID NO: 6005745 - DNA, 18 bp, Homo sapiens
cactgtgtactggagcct

SEQ ID NO: 6005746 - DNA, 17 bp, Homo sapiens
cactgtgtatatttgat

SEQ ID NO: 6005747 - DNA, 18 bp, Homo sapiens
cactgtgtatatttgatt

SEQ ID NO: 6005748 - DNA, 14 bp, Homo sapiens
cactgtgtattgtt

SEQ ID NO: 6005749 - DNA, 20 bp, Homo sapiens
cactgtgtcacccagactgg

SEQ ID NO: 6005750 - DNA, 12 bp, Homo sapiens
cactgtgtccca

SEQ ID NO: 6005751 - DNA, 13 bp, Homo sapiens
cactgtgtcccag

SEQ ID NO: 6005752 - DNA, 15 bp, Homo sapiens
cactgtgtcccagtg

SEQ ID NO: 6005753 - DNA, 12 bp, Homo sapiens
cactgtgtcctg

SEQ ID NO: 6005754 - DNA, 14 bp, Homo sapiens
cactgtgtctctat

SEQ ID NO: 6005755 - DNA, 23 bp, Homo sapiens
cactgtgtgaggctgtgtctctg

SEQ ID NO: 6005756 - DNA, 15 bp, Homo sapiens
cactgtgtgctgact

SEQ ID NO: 6005757 - DNA, 21 bp, Homo sapiens
cactgtgtgctgactgaacat

SEQ ID NO: 6005758 - DNA, 22 bp, Homo sapiens
cactgtgtgctgactgaacatt

SEQ ID NO: 6005759 - DNA, 23 bp, Homo sapiens
cactgtgtgttgacactgttttc

SEQ ID NO: 6005760 - DNA, 20 bp, Homo sapiens
cactgtgttggccaggctgg

SEQ ID NO: 6005761 - DNA, 21 bp, Homo sapiens
cactgtgttggccaggctggt

SEQ ID NO: 6005762 - DNA, 13 bp, Homo sapiens
cactgtgtttagt

SEQ ID NO: 6005763 - DNA, 20 bp, Homo sapiens
cactgtgtttctgtgctcca

SEQ ID NO: 6005764 - DNA, 22 bp, Homo sapiens
cactgttaaaataaagcttaca

SEQ ID NO: 6005765 - DNA, 16 bp, Homo sapiens
cactgttaagaataga

SEQ ID NO: 6005766 - DNA, 22 bp, Homo sapiens
cactgttaatacacagtacttt

SEQ ID NO: 6005767 - DNA, 22 bp, Homo sapiens
cactgttaatcatgggttcctc

SEQ ID NO: 6005768 - DNA, 15 bp, Homo sapiens
cactgttagaacact

SEQ ID NO: 6005769 - DNA, 19 bp, Homo sapiens
cactgttagaacactattt

SEQ ID NO: 6005770 - DNA, 21 bp, Homo sapiens
cactgttagaacactattttc

SEQ ID NO: 6005771 - DNA, 12 bp, Homo sapiens
cactgttataaa

SEQ ID NO: 6005772 - DNA, 14 bp, Homo sapiens
cactgttataaatt

SEQ ID NO: 6005773 - DNA, 19 bp, Homo sapiens
cactgttataaattttgta

SEQ ID NO: 6005774 - DNA, 24 bp, Homo sapiens
cactgttataaattttgtacattt

SEQ ID NO: 6005775 - DNA, 15 bp, Homo sapiens
cactgttatcaaaac

SEQ ID NO: 6005776 - DNA, 21 bp, Homo sapiens
cactgttatcattttttcctg

SEQ ID NO: 6005777 - DNA, 19 bp, Homo sapiens
cactgttattttcagcatg

SEQ ID NO: 6005778 - DNA, 13 bp, Homo sapiens
caggcaggggcat

SEQ ID NO: 6005779 - DNA, 16 bp, Homo sapiens
caggcaggggcatctg

SEQ ID NO: 6005780 - DNA, 18 bp, Homo sapiens
caggcaggggccctgcag

SEQ ID NO: 6005781 - DNA, 21 bp, Homo sapiens
caggcaggggccctgcagctc

SEQ ID NO: 6005782 - DNA, 22 bp, Homo sapiens
caggcaggggccctgcagctct

SEQ ID NO: 6005783 - DNA, 16 bp, Homo sapiens
caggcaggggcctcca

SEQ ID NO: 6005784 - DNA, 19 bp, Homo sapiens
caggcaggggcttggctgc

SEQ ID NO: 6005785 - DNA, 21 bp, Homo sapiens
caggcaggggtgagagcaccc

SEQ ID NO: 6005786 - DNA, 13 bp, Homo sapiens
caggcaggggtgg

SEQ ID NO: 6005787 - DNA, 20 bp, Homo sapiens
caggcaggtagccaggggga

SEQ ID NO: 6005788 - DNA, 16 bp, Homo sapiens
caggcaggtctgcaag

SEQ ID NO: 6005789 - DNA, 20 bp, Homo sapiens
caggcaggtctgcaagggcc

SEQ ID NO: 6005790 - DNA, 13 bp, Homo sapiens
caggcaggtcttg

SEQ ID NO: 6005791 - DNA, 22 bp, Homo sapiens
caggcaggtcttgaactcctgg

SEQ ID NO: 6005792 - DNA, 23 bp, Homo sapiens
caggcaggtcttgaactcctggc

SEQ ID NO: 6005793 - DNA, 15 bp, Homo sapiens
caggcaggtgcaggg

SEQ ID NO: 6005794 - DNA, 23 bp, Homo sapiens
caggcaggtgtgaacatggggga

SEQ ID NO: 6005795 - DNA, 15 bp, Homo sapiens
caggcagtagcagct

SEQ ID NO: 6005796 - DNA, 18 bp, Homo sapiens
caggcagtagcagctgtg

SEQ ID NO: 6005797 - DNA, 16 bp, Homo sapiens
caggcagtcgggggct

SEQ ID NO: 6005798 - DNA, 18 bp, Homo sapiens
caggcagtcgggggctgg

SEQ ID NO: 6005799 - DNA, 21 bp, Homo sapiens
caggcagtctttgctcagtgg

SEQ ID NO: 6005800 - DNA, 15 bp, Homo sapiens
caggcagtgcatgtg

SEQ ID NO: 6005801 - DNA, 15 bp, Homo sapiens
caggcagtggcccag

SEQ ID NO: 6005802 - DNA, 22 bp, Homo sapiens
caggcagtgtcttaaggagact

SEQ ID NO: 6005803 - DNA, 15 bp, Homo sapiens
caggcagttctagaa

SEQ ID NO: 6005804 - DNA, 17 bp, Homo sapiens
caggcagttggccagag

SEQ ID NO: 6005805 - DNA, 20 bp, Homo sapiens
caggcagtttcagagatgga

SEQ ID NO: 6005806 - DNA, 22 bp, Homo sapiens
caggcagttttgaaatgaaaat

SEQ ID NO: 6005807 - DNA, 23 bp, Homo sapiens
caggcagttttgaaatgaaaatc

SEQ ID NO: 6005808 - DNA, 17 bp, Homo sapiens
caggcatagaggcttct

SEQ ID NO: 6005809 - DNA, 15 bp, Homo sapiens
caggcataggcctgg

SEQ ID NO: 6005810 - DNA, 14 bp, Homo sapiens
caggcatcacagct

SEQ ID NO: 6005811 - DNA, 19 bp, Homo sapiens
caggcatcactgattccct

SEQ ID NO: 6005812 - DNA, 12 bp, Homo sapiens
caggcatcagga

SEQ ID NO: 6005813 - DNA, 17 bp, Homo sapiens
caggcatcccatccctt

SEQ ID NO: 6005814 - DNA, 20 bp, Homo sapiens
caggcatcggggagccggga

SEQ ID NO: 6005815 - DNA, 21 bp, Homo sapiens
caggcatcggggagccgggag

SEQ ID NO: 6005816 - DNA, 15 bp, Homo sapiens
caggcatctacacag

SEQ ID NO: 6005817 - DNA, 23 bp, Homo sapiens
caggcatctacacagcctggact

SEQ ID NO: 6005818 - DNA, 13 bp, Homo sapiens
caggcatctcctt

SEQ ID NO: 6005819 - DNA, 14 bp, Homo sapiens
caggcatctccttg

SEQ ID NO: 6005820 - DNA, 16 bp, Homo sapiens
caggcatctccttggg

SEQ ID NO: 6005821 - DNA, 15 bp, Homo sapiens
caggcatctgatttg

SEQ ID NO: 6005822 - DNA, 18 bp, Homo sapiens
caggcatctgtaagaagt

SEQ ID NO: 6005823 - DNA, 22 bp, Homo sapiens
caggcatctgtaagaagtagag

SEQ ID NO: 6005824 - DNA, 20 bp, Homo sapiens
caggcatctgttagcagagt

SEQ ID NO: 6005825 - DNA, 22 bp, Homo sapiens
caggcatctgttagcagagtct

SEQ ID NO: 6005826 - DNA, 20 bp, Homo sapiens
caggcatgaaattcttccta

SEQ ID NO: 6005827 - DNA, 18 bp, Homo sapiens
caggcatgaatcactgtg

SEQ ID NO: 6005828 - DNA, 19 bp, Homo sapiens
caggcatgaccctggagcc

SEQ ID NO: 6005829 - DNA, 19 bp, Homo sapiens
caggcatgagccactgcac

SEQ ID NO: 6005830 - DNA, 20 bp, Homo sapiens
caggcatgagccactgcacc

SEQ ID NO: 6005831 - DNA, 17 bp, Homo sapiens
caggcatgcaccagtgc

SEQ ID NO: 6005832 - DNA, 18 bp, Homo sapiens
caggcatgcaccagtgcc

SEQ ID NO: 6005833 - DNA, 17 bp, Homo sapiens
caggcatgcagctgcct

SEQ ID NO: 6005834 - DNA, 20 bp, Homo sapiens
caggcatgcagctgcctggg

SEQ ID NO: 6005835 - DNA, 14 bp, Homo sapiens
caggcatgcctgtg

SEQ ID NO: 6005836 - DNA, 15 bp, Homo sapiens
caggcatgcctgtgt

SEQ ID NO: 6005837 - DNA, 14 bp, Homo sapiens
caggcatggaaaga

SEQ ID NO: 6005838 - DNA, 20 bp, Homo sapiens
caggcatggcccagcctgga

SEQ ID NO: 6005839 - DNA, 14 bp, Homo sapiens
caggcatggccctg

SEQ ID NO: 6005840 - DNA, 15 bp, Homo sapiens
caggcatggccctgg

SEQ ID NO: 6005841 - DNA, 16 bp, Homo sapiens
caggcatggccctggg

SEQ ID NO: 6005842 - DNA, 17 bp, Homo sapiens
caggcatggccctgggc

SEQ ID NO: 6005843 - DNA, 18 bp, Homo sapiens
caggcatggccctgggcg

SEQ ID NO: 6005844 - DNA, 17 bp, Homo sapiens
caggcatggctcagagc

SEQ ID NO: 6005845 - DNA, 17 bp, Homo sapiens
caggcatggctggtgcc

SEQ ID NO: 6005846 - DNA, 18 bp, Homo sapiens
caggcatggctggtgcct

SEQ ID NO: 6005847 - DNA, 20 bp, Homo sapiens
caggcatggtagctcatgcc

SEQ ID NO: 6005848 - DNA, 22 bp, Homo sapiens
caggcatggtcccttaaggcac

SEQ ID NO: 6005849 - DNA, 18 bp, Homo sapiens
caggcatgtgtctggccc

SEQ ID NO: 6005850 - DNA, 20 bp, Homo sapiens
caggcatgtgtctggcccta

SEQ ID NO: 6005851 - DNA, 19 bp, Homo sapiens
caggcatgttctctgagga

SEQ ID NO: 6005852 - DNA, 22 bp, Homo sapiens
caggcatgttggactctgagct

SEQ ID NO: 6005853 - DNA, 23 bp, Homo sapiens
caggcatgttggactctgagctc

SEQ ID NO: 6005854 - DNA, 20 bp, Homo sapiens
caggcattccccaggaggcc

SEQ ID NO: 6005855 - DNA, 21 bp, Homo sapiens
caggcattccccaggaggcca

SEQ ID NO: 6005856 - DNA, 23 bp, Homo sapiens
caggcattccccaggaggccagc

SEQ ID NO: 6005857 - DNA, 24 bp, Homo sapiens
caggcattccccaggaggccagcc

SEQ ID NO: 6005858 - DNA, 14 bp, Homo sapiens
caggcattgcacta

SEQ ID NO: 6005859 - DNA, 20 bp, Homo sapiens
caggcattgcactaaaagtg

SEQ ID NO: 6005860 - DNA, 22 bp, Homo sapiens
caggcattgctttgccctggag

SEQ ID NO: 6005861 - DNA, 17 bp, Homo sapiens
caggcatttagccctca

SEQ ID NO: 6005862 - DNA, 17 bp, Homo sapiens
caggcatttcctgggtg

SEQ ID NO: 6005863 - DNA, 18 bp, Homo sapiens
caggcatttgactgaaga

SEQ ID NO: 6005864 - DNA, 21 bp, Homo sapiens
caggcatttgactgaagatgc

SEQ ID NO: 6005865 - DNA, 23 bp, Homo sapiens
caggcatttgctaaggcagctga

SEQ ID NO: 6005866 - DNA, 23 bp, Homo sapiens
caggccaaactcacctgcccctc

SEQ ID NO: 6005867 - DNA, 15 bp, Homo sapiens
caggccaaagcccca

SEQ ID NO: 6005868 - DNA, 19 bp, Homo sapiens
caggccaaaggggacctgg

SEQ ID NO: 6005869 - DNA, 21 bp, Homo sapiens
caggccaaaggggacctggaa

SEQ ID NO: 6005870 - DNA, 22 bp, Homo sapiens
caggccaaaggggacctggaag

SEQ ID NO: 6005871 - DNA, 17 bp, Homo sapiens
caggccaagaaacgtct

SEQ ID NO: 6005872 - DNA, 18 bp, Homo sapiens
caggccaagcccaataca

SEQ ID NO: 6005873 - DNA, 15 bp, Homo sapiens
caggccaaggtctga

SEQ ID NO: 6005874 - DNA, 19 bp, Homo sapiens
caggccaaggtctgagcca

SEQ ID NO: 6005875 - DNA, 18 bp, Homo sapiens
caggccaagttaaaggct

SEQ ID NO: 6005876 - DNA, 21 bp, Homo sapiens
caggccacacgctgcccaggc

SEQ ID NO: 6005877 - DNA, 22 bp, Homo sapiens
caggccacacgctgcccaggct

SEQ ID NO: 6005878 - DNA, 19 bp, Homo sapiens
caggccacagccagcctgt

SEQ ID NO: 6005879 - DNA, 16 bp, Homo sapiens
caggccacagccgcct

SEQ ID NO: 6005880 - DNA, 23 bp, Homo sapiens
caggccacagtggggctgcaggc

SEQ ID NO: 6005881 - DNA, 14 bp, Homo sapiens
caggccacccactg

SEQ ID NO: 6005882 - DNA, 16 bp, Homo sapiens
caggccacccactgtg

SEQ ID NO: 6005883 - DNA, 19 bp, Homo sapiens
caggccacccactgtgggg

SEQ ID NO: 6005884 - DNA, 18 bp, Homo sapiens
caggccacccccacctcc

SEQ ID NO: 6005885 - DNA, 17 bp, Homo sapiens
caggccacccccatgga

SEQ ID NO: 6005886 - DNA, 18 bp, Homo sapiens
caggccaccccgctgatg

SEQ ID NO: 6005887 - DNA, 19 bp, Homo sapiens
caggccaccccgctgatgg

SEQ ID NO: 6005888 - DNA, 11 bp, Homo sapiens
caggccacctc

SEQ ID NO: 6005889 - DNA, 19 bp, Homo sapiens
caggccacctgcccccttc

SEQ ID NO: 6005890 - DNA, 21 bp, Homo sapiens
caggccacctgcccccttctc

SEQ ID NO: 6005891 - DNA, 17 bp, Homo sapiens
caggccacctggctctc

SEQ ID NO: 6005892 - DNA, 21 bp, Homo sapiens
caggccacctggctctcacct

SEQ ID NO: 6005893 - DNA, 19 bp, Homo sapiens
caggccactctcagagact

SEQ ID NO: 6005894 - DNA, 15 bp, Homo sapiens
caggccactgacctc

SEQ ID NO: 6005895 - DNA, 24 bp, Homo sapiens
caggccactgggccctgagccaga

SEQ ID NO: 6005896 - DNA, 17 bp, Homo sapiens
caggccactgtggccag

SEQ ID NO: 6005897 - DNA, 19 bp, Homo sapiens
caggccactgtggccagag

SEQ ID NO: 6005898 - DNA, 23 bp, Homo sapiens
caggccactgtggccagagctgg

SEQ ID NO: 6005899 - DNA, 12 bp, Homo sapiens
caggccagaaaa

SEQ ID NO: 6005900 - DNA, 14 bp, Homo sapiens
caggccagagaaag

SEQ ID NO: 6005901 - DNA, 22 bp, Homo sapiens
caggccagagcaaacagaaaaa

SEQ ID NO: 6005902 - DNA, 23 bp, Homo sapiens
caggccagagggagtgacagagg

SEQ ID NO: 6005903 - DNA, 16 bp, Homo sapiens
caggccagagtgcagt

SEQ ID NO: 6005904 - DNA, 17 bp, Homo sapiens
caggccagatggcccct

SEQ ID NO: 6005905 - DNA, 23 bp, Homo sapiens
caggccagatggcccctccactg

SEQ ID NO: 6005906 - DNA, 19 bp, Homo sapiens
caggccagcaggcgggctc

SEQ ID NO: 6005907 - DNA, 12 bp, Homo sapiens
caggccagccca

SEQ ID NO: 6005908 - DNA, 13 bp, Homo sapiens
caggccagcccag

SEQ ID NO: 6005909 - DNA, 14 bp, Homo sapiens
caggccagcccagc

SEQ ID NO: 6005910 - DNA, 16 bp, Homo sapiens
caggccagcccagcca

SEQ ID NO: 6005911 - DNA, 17 bp, Homo sapiens
caggccagcccagccag

SEQ ID NO: 6005912 - DNA, 17 bp, Homo sapiens
caggccagcccccccac

SEQ ID NO: 6005913 - DNA, 21 bp, Homo sapiens
caggccagcccccccacccac

SEQ ID NO: 6005914 - DNA, 13 bp, Homo sapiens
caggccagcccgg

SEQ ID NO: 6005915 - DNA, 13 bp, Homo sapiens
caggccagcctcc

SEQ ID NO: 6005916 - DNA, 16 bp, Homo sapiens
caggccagcctccgag

SEQ ID NO: 6005917 - DNA, 15 bp, Homo sapiens
caggccagccttggc

SEQ ID NO: 6005918 - DNA, 18 bp, Homo sapiens
caggccagctccttttct

SEQ ID NO: 6005919 - DNA, 15 bp, Homo sapiens
caggccagctgcctc

SEQ ID NO: 6005920 - DNA, 13 bp, Homo sapiens
caggccagctgcg

SEQ ID NO: 6005921 - DNA, 16 bp, Homo sapiens
caggccagctgcggcc

SEQ ID NO: 6005922 - DNA, 20 bp, Homo sapiens
caggccagctgcggccaggc

SEQ ID NO: 6005923 - DNA, 23 bp, Homo sapiens
caggccagctgcttgggcttcat

SEQ ID NO: 6005924 - DNA, 13 bp, Homo sapiens
caggccagctgtg

SEQ ID NO: 6005925 - DNA, 23 bp, Homo sapiens
caggccaggaccaagggcagagg

SEQ ID NO: 6005926 - DNA, 14 bp, Homo sapiens
caggccaggaccac

SEQ ID NO: 6005927 - DNA, 21 bp, Homo sapiens
caggccaggaccacacagtcc

SEQ ID NO: 6005928 - DNA, 15 bp, Homo sapiens
caggccaggactctg

SEQ ID NO: 6005929 - DNA, 16 bp, Homo sapiens
caggccaggactctgc

SEQ ID NO: 6005930 - DNA, 17 bp, Homo sapiens
caggccaggactctgca

SEQ ID NO: 6005931 - DNA, 19 bp, Homo sapiens
caggccaggactctgcagc

SEQ ID NO: 6005932 - DNA, 20 bp, Homo sapiens
caggccaggactctgcagcc

SEQ ID NO: 6005933 - DNA, 15 bp, Homo sapiens
caggccaggccagct

SEQ ID NO: 6005934 - DNA, 16 bp, Homo sapiens
caggccaggccagctt

SEQ ID NO: 6005935 - DNA, 12 bp, Homo sapiens
caggccaggccc

SEQ ID NO: 6005936 - DNA, 17 bp, Homo sapiens
caggccaggccctctgc

SEQ ID NO: 6005937 - DNA, 12 bp, Homo sapiens
caggccagggct

SEQ ID NO: 6005938 - DNA, 14 bp, Homo sapiens
caggccagggctcc

SEQ ID NO: 6005939 - DNA, 13 bp, Homo sapiens
caggccagggctg

SEQ ID NO: 6005940 - DNA, 14 bp, Homo sapiens
caggccagggctgg

SEQ ID NO: 6005941 - DNA, 21 bp, Homo sapiens
caggccagggctgggtcacag

SEQ ID NO: 6005942 - DNA, 13 bp, Homo sapiens
caggccaggggag

SEQ ID NO: 6005943 - DNA, 18 bp, Homo sapiens
caggccaggtgaggtcca

SEQ ID NO: 6005944 - DNA, 15 bp, Homo sapiens
caggccaggtgcagt

SEQ ID NO: 6005945 - DNA, 18 bp, Homo sapiens
caggccaggtgcccagga

SEQ ID NO: 6005946 - DNA, 15 bp, Homo sapiens
caggccaggtgggcg

SEQ ID NO: 6005947 - DNA, 16 bp, Homo sapiens
caggccagtaagggaa

SEQ ID NO: 6005948 - DNA, 18 bp, Homo sapiens
caggccagtcagacgcca

SEQ ID NO: 6005949 - DNA, 18 bp, Homo sapiens
caggccagtcccacggct

SEQ ID NO: 6005950 - DNA, 19 bp, Homo sapiens
caggccagtcccacggctc

SEQ ID NO: 6005951 - DNA, 20 bp, Homo sapiens
caggccagtcccacggctct

SEQ ID NO: 6005952 - DNA, 21 bp, Homo sapiens
caggccagtcccacggctctg

SEQ ID NO: 6005953 - DNA, 22 bp, Homo sapiens
caggccagtcccacggctctgt

SEQ ID NO: 6005954 - DNA, 17 bp, Homo sapiens
caggccagtgccaggac

SEQ ID NO: 6005955 - DNA, 20 bp, Homo sapiens
cactgttcaaacctctgccg

SEQ ID NO: 6005956 - DNA, 17 bp, Homo sapiens
cactgttcatgctggcg

SEQ ID NO: 6005957 - DNA, 21 bp, Homo sapiens
cactgttccagtgtctataaa

SEQ ID NO: 6005958 - DNA, 14 bp, Homo sapiens
cactgttccctctg

SEQ ID NO: 6005959 - DNA, 20 bp, Homo sapiens
cactgttccctctgctcctg

SEQ ID NO: 6005960 - DNA, 23 bp, Homo sapiens
cactgttctattcatctcaagga

SEQ ID NO: 6005961 - DNA, 13 bp, Homo sapiens
cactgttctctgc

SEQ ID NO: 6005962 - DNA, 19 bp, Homo sapiens
cactgttctgaaagtgact

SEQ ID NO: 6005963 - DNA, 14 bp, Homo sapiens
cactgttctgttca

SEQ ID NO: 6005964 - DNA, 16 bp, Homo sapiens
cactgttctgttctca

SEQ ID NO: 6005965 - DNA, 18 bp, Homo sapiens
cactgttgaaaattattt

SEQ ID NO: 6005966 - DNA, 21 bp, Homo sapiens
cactgttgaaaattattttaa

SEQ ID NO: 6005967 - DNA, 17 bp, Homo sapiens
cactgttgaatgcctgt

SEQ ID NO: 6005968 - DNA, 22 bp, Homo sapiens
cactgttgagttggacacactg

SEQ ID NO: 6005969 - DNA, 13 bp, Homo sapiens
cactgttgataaa

SEQ ID NO: 6005970 - DNA, 17 bp, Homo sapiens
cactgttgataaaaact

SEQ ID NO: 6005971 - DNA, 15 bp, Homo sapiens
cactgttgatgtatc

SEQ ID NO: 6005972 - DNA, 16 bp, Homo sapiens
cactgttgatgtatct

SEQ ID NO: 6005973 - DNA, 17 bp, Homo sapiens
cactgttgatgtatctg

SEQ ID NO: 6005974 - DNA, 21 bp, Homo sapiens
cactgttgcagtggcctggcc

SEQ ID NO: 6005975 - DNA, 14 bp, Homo sapiens
cactgttgcccagg

SEQ ID NO: 6005976 - DNA, 18 bp, Homo sapiens
cactgttgcccaggctgg

SEQ ID NO: 6005977 - DNA, 21 bp, Homo sapiens
cactgttgctgactactactc

SEQ ID NO: 6005978 - DNA, 22 bp, Homo sapiens
cactgttggcacttataggtaa

SEQ ID NO: 6005979 - DNA, 21 bp, Homo sapiens
cactgttggggagaagaaaca

SEQ ID NO: 6005980 - DNA, 17 bp, Homo sapiens
cactgttgggtgggtgg

SEQ ID NO: 6005981 - DNA, 23 bp, Homo sapiens
cactgttgggtgggtgggccctg

SEQ ID NO: 6005982 - DNA, 20 bp, Homo sapiens
cactgttgtcatttccaaat

SEQ ID NO: 6005983 - DNA, 15 bp, Homo sapiens
cactgttgtgaatca

SEQ ID NO: 6005984 - DNA, 19 bp, Homo sapiens
cactgtttaactgggagtg

SEQ ID NO: 6005985 - DNA, 21 bp, Homo sapiens
cactgtttaagtactgtttac

SEQ ID NO: 6005986 - DNA, 20 bp, Homo sapiens
cactgtttagaacacacaca

SEQ ID NO: 6005987 - DNA, 12 bp, Homo sapiens
cactgtttagat

SEQ ID NO: 6005988 - DNA, 23 bp, Homo sapiens
cactgtttatggaaataccagga

SEQ ID NO: 6005989 - DNA, 17 bp, Homo sapiens
cactgtttcatgagccc

SEQ ID NO: 6005990 - DNA, 14 bp, Homo sapiens
cactgtttccatgt

SEQ ID NO: 6005991 - DNA, 14 bp, Homo sapiens
cactgtttcctgat

SEQ ID NO: 6005992 - DNA, 12 bp, Homo sapiens
cactgtttctct

SEQ ID NO: 6005993 - DNA, 18 bp, Homo sapiens
cactgtttctcttgagct

SEQ ID NO: 6005994 - DNA, 20 bp, Homo sapiens
cactgtttctcttgagctgg

SEQ ID NO: 6005995 - DNA, 17 bp, Homo sapiens
cactgtttcttgcttgt

SEQ ID NO: 6005996 - DNA, 19 bp, Homo sapiens
cactgtttcttgcttgtac

SEQ ID NO: 6005997 - DNA, 24 bp, Homo sapiens
cactgtttcttgcttgtacctctg

SEQ ID NO: 6005998 - DNA, 17 bp, Homo sapiens
cactgtttggcctttct

SEQ ID NO: 6005999 - DNA, 22 bp, Homo sapiens
cactgtttgtttacaaaatcag

SEQ ID NO: 6006000 - DNA, 15 bp, Homo sapiens
cactgtttgttttta

SEQ ID NO: 6006001 - DNA, 18 bp, Homo sapiens
cactgtttgtttttattt

SEQ ID NO: 6006002 - DNA, 19 bp, Homo sapiens
cactgttttataattagtc

SEQ ID NO: 6006003 - DNA, 14 bp, Homo sapiens
cactgttttctagt

SEQ ID NO: 6006004 - DNA, 14 bp, Homo sapiens
cactgtttttagac

SEQ ID NO: 6006005 - DNA, 21 bp, Homo sapiens
cactgtttttagacaccttca

SEQ ID NO: 6006006 - DNA, 15 bp, Homo sapiens
cactgtttttcatac

SEQ ID NO: 6006007 - DNA, 13 bp, Homo sapiens
cactgtttttcca

SEQ ID NO: 6006008 - DNA, 14 bp, Homo sapiens
cactgtttttccat

SEQ ID NO: 6006009 - DNA, 14 bp, Homo sapiens
cacttaaaaaatgt

SEQ ID NO: 6006010 - DNA, 16 bp, Homo sapiens
cacttaaaaaatgtcc

SEQ ID NO: 6006011 - DNA, 12 bp, Homo sapiens
cacttaaaaaga

SEQ ID NO: 6006012 - DNA, 15 bp, Homo sapiens
cacttaaaaatggtt

SEQ ID NO: 6006013 - DNA, 15 bp, Homo sapiens
cacttaaaattgtaa

SEQ ID NO: 6006014 - DNA, 17 bp, Homo sapiens
cacttaaacaatgtcct

SEQ ID NO: 6006015 - DNA, 16 bp, Homo sapiens
cacttaaacagaagca

SEQ ID NO: 6006016 - DNA, 16 bp, Homo sapiens
cacttaaactttgtca

SEQ ID NO: 6006017 - DNA, 17 bp, Homo sapiens
cacttaaagaagtattt

SEQ ID NO: 6006018 - DNA, 12 bp, Homo sapiens
cacttaacaaac

SEQ ID NO: 6006019 - DNA, 22 bp, Homo sapiens
cacttaacaagctcccaggccg

SEQ ID NO: 6006020 - DNA, 13 bp, Homo sapiens
cacttaacagatg

SEQ ID NO: 6006021 - DNA, 14 bp, Homo sapiens
cacttaacctgctt

SEQ ID NO: 6006022 - DNA, 13 bp, Homo sapiens
cacttaagagaat

SEQ ID NO: 6006023 - DNA, 17 bp, Homo sapiens
cacttaaggcactctgt

SEQ ID NO: 6006024 - DNA, 16 bp, Homo sapiens
cacttaagtcttcctt

SEQ ID NO: 6006025 - DNA, 17 bp, Homo sapiens
cacttaagtgcactttt

SEQ ID NO: 6006026 - DNA, 13 bp, Homo sapiens
cacttaagttctt

SEQ ID NO: 6006027 - DNA, 16 bp, Homo sapiens
cacttaagtttttcca

SEQ ID NO: 6006028 - DNA, 11 bp, Homo sapiens
cacttaatatt

SEQ ID NO: 6006029 - DNA, 13 bp, Homo sapiens
cacttaatattag

SEQ ID NO: 6006030 - DNA, 11 bp, Homo sapiens
cacttaatctg

SEQ ID NO: 6006031 - DNA, 21 bp, Homo sapiens
cacttaatcttctctcttgat

SEQ ID NO: 6006032 - DNA, 12 bp, Homo sapiens
cacttaatgtat

SEQ ID NO: 6006033 - DNA, 19 bp, Homo sapiens
cacttaattctcattatga

SEQ ID NO: 6006034 - DNA, 14 bp, Homo sapiens
cacttaattctgtt

SEQ ID NO: 6006035 - DNA, 15 bp, Homo sapiens
cacttaattctgttc

SEQ ID NO: 6006036 - DNA, 23 bp, Homo sapiens
cacttaattgctttcctgcctcc

SEQ ID NO: 6006037 - DNA, 18 bp, Homo sapiens
cacttaatttgaaatcta

SEQ ID NO: 6006038 - DNA, 14 bp, Homo sapiens
cacttaatttgtaa

SEQ ID NO: 6006039 - DNA, 17 bp, Homo sapiens
cacttaatttgtaaact

SEQ ID NO: 6006040 - DNA, 20 bp, Homo sapiens
cacttacaagtaatgaattt

SEQ ID NO: 6006041 - DNA, 18 bp, Homo sapiens
cacttacactttatgcac

SEQ ID NO: 6006042 - DNA, 23 bp, Homo sapiens
cacttacagaaccaattcacttt

SEQ ID NO: 6006043 - DNA, 23 bp, Homo sapiens
cacttacagataggccttcttgt

SEQ ID NO: 6006044 - DNA, 14 bp, Homo sapiens
cacttacatttaca

SEQ ID NO: 6006045 - DNA, 13 bp, Homo sapiens
cacttacattttt

SEQ ID NO: 6006046 - DNA, 15 bp, Homo sapiens
cacttacatttttgt

SEQ ID NO: 6006047 - DNA, 21 bp, Homo sapiens
cacttaccgccctgcgggcca

SEQ ID NO: 6006048 - DNA, 18 bp, Homo sapiens
cacttacctagatttaca

SEQ ID NO: 6006049 - DNA, 16 bp, Homo sapiens
cacttaccttcaataa

SEQ ID NO: 6006050 - DNA, 17 bp, Homo sapiens
cacttaccttcaataaa

SEQ ID NO: 6006051 - DNA, 19 bp, Homo sapiens
cacttaccttcaataaagt

SEQ ID NO: 6006052 - DNA, 21 bp, Homo sapiens
cacttaccttcaataaagtat

SEQ ID NO: 6006053 - DNA, 22 bp, Homo sapiens
cacttaccttcaataaagtatc

SEQ ID NO: 6006054 - DNA, 15 bp, Homo sapiens
cacttacgtaaaaca

SEQ ID NO: 6006055 - DNA, 21 bp, Homo sapiens
cacttactatccatttcttca

SEQ ID NO: 6006056 - DNA, 15 bp, Homo sapiens
cacttactggtagga

SEQ ID NO: 6006057 - DNA, 18 bp, Homo sapiens
cacttactgttgtcctat

SEQ ID NO: 6006058 - DNA, 19 bp, Homo sapiens
cacttacttgatgattttt

SEQ ID NO: 6006059 - DNA, 23 bp, Homo sapiens
cacttagaatactacagcataaa

SEQ ID NO: 6006060 - DNA, 21 bp, Homo sapiens
cacttagacactttacctctt

SEQ ID NO: 6006061 - DNA, 14 bp, Homo sapiens
cacttagatttaaa

SEQ ID NO: 6006062 - DNA, 22 bp, Homo sapiens
cacttagccgcaccctgcacct

SEQ ID NO: 6006063 - DNA, 19 bp, Homo sapiens
cacttagccgtccatggca

SEQ ID NO: 6006064 - DNA, 16 bp, Homo sapiens
cacttagcctctttct

SEQ ID NO: 6006065 - DNA, 17 bp, Homo sapiens
cacttagcgaacccttt

SEQ ID NO: 6006066 - DNA, 15 bp, Homo sapiens
cacttaggctttgta

SEQ ID NO: 6006067 - DNA, 21 bp, Homo sapiens
cacttagggataacactgtct

SEQ ID NO: 6006068 - DNA, 18 bp, Homo sapiens
cacttagtaggtcctcaa

SEQ ID NO: 6006069 - DNA, 17 bp, Homo sapiens
cacttagtccactctga

SEQ ID NO: 6006070 - DNA, 15 bp, Homo sapiens
cacttagtgatcatt

SEQ ID NO: 6006071 - DNA, 23 bp, Homo sapiens
cacttataaggtgttttctgtgt

SEQ ID NO: 6006072 - DNA, 22 bp, Homo sapiens
cacttatatgttctaattaata

SEQ ID NO: 6006073 - DNA, 16 bp, Homo sapiens
cacttatattttatga

SEQ ID NO: 6006074 - DNA, 23 bp, Homo sapiens
cacttatattttatgaacattgt

SEQ ID NO: 6006075 - DNA, 16 bp, Homo sapiens
cacttatctcgaattt

SEQ ID NO: 6006076 - DNA, 15 bp, Homo sapiens
cacttatctgatact

SEQ ID NO: 6006077 - DNA, 17 bp, Homo sapiens
cacttatctgatcagaa

SEQ ID NO: 6006078 - DNA, 15 bp, Homo sapiens
cacttatcttctgga

SEQ ID NO: 6006079 - DNA, 18 bp, Homo sapiens
cacttatcttctggatta

SEQ ID NO: 6006080 - DNA, 12 bp, Homo sapiens
cacttatgattt

SEQ ID NO: 6006081 - DNA, 13 bp, Homo sapiens
cacttatgctgct

SEQ ID NO: 6006082 - DNA, 17 bp, Homo sapiens
cacttatgctgctgtga

SEQ ID NO: 6006083 - DNA, 12 bp, Homo sapiens
cacttatggtaa

SEQ ID NO: 6006084 - DNA, 12 bp, Homo sapiens
cacttatgtact

SEQ ID NO: 6006085 - DNA, 21 bp, Homo sapiens
cacttatgtagacaaaactta

SEQ ID NO: 6006086 - DNA, 19 bp, Homo sapiens
cacttatgttatacaatac

SEQ ID NO: 6006087 - DNA, 22 bp, Homo sapiens
cacttattatgaggctattaaa

SEQ ID NO: 6006088 - DNA, 12 bp, Homo sapiens
cacttattatta

SEQ ID NO: 6006089 - DNA, 19 bp, Homo sapiens
cacttattccctcatcctt

SEQ ID NO: 6006090 - DNA, 21 bp, Homo sapiens
cacttattccctcatcctttc

SEQ ID NO: 6006091 - DNA, 16 bp, Homo sapiens
cacttattgaatatat

SEQ ID NO: 6006092 - DNA, 17 bp, Homo sapiens
cacttattgaatatatg

SEQ ID NO: 6006093 - DNA, 14 bp, Homo sapiens
cacttattgctttg

SEQ ID NO: 6006094 - DNA, 15 bp, Homo sapiens
cacttattgctttga

SEQ ID NO: 6006095 - DNA, 21 bp, Homo sapiens
cacttattggaactctgcttg

SEQ ID NO: 6006096 - DNA, 23 bp, Homo sapiens
cacttatttatgaattgtctaaa

SEQ ID NO: 6006097 - DNA, 22 bp, Homo sapiens
cacttatttattgggatgtgag

SEQ ID NO: 6006098 - DNA, 14 bp, Homo sapiens
cacttatttcataa

SEQ ID NO: 6006099 - DNA, 20 bp, Homo sapiens
cacttatttgtcaaaataaa

SEQ ID NO: 6006100 - DNA, 18 bp, Homo sapiens
cacttattttctgaattc

SEQ ID NO: 6006101 - DNA, 11 bp, Homo sapiens
cacttcaaact

SEQ ID NO: 6006102 - DNA, 12 bp, Homo sapiens
cacttcaaacta

SEQ ID NO: 6006103 - DNA, 14 bp, Homo sapiens
cacttcaaactact

SEQ ID NO: 6006104 - DNA, 21 bp, Homo sapiens
cacttcaaagaagctgtcttg

SEQ ID NO: 6006105 - DNA, 17 bp, Homo sapiens
cacttcaaataattaaa

SEQ ID NO: 6006106 - DNA, 14 bp, Homo sapiens
cacttcaaatcaga

SEQ ID NO: 6006107 - DNA, 17 bp, Homo sapiens
cacttcaacccccagct

SEQ ID NO: 6006108 - DNA, 18 bp, Homo sapiens
cacttcaaggtgacagaa

SEQ ID NO: 6006109 - DNA, 21 bp, Homo sapiens
cacttcaagtgaccaccagga

SEQ ID NO: 6006110 - DNA, 22 bp, Homo sapiens
cacttcaatgtgtcatttccgg

SEQ ID NO: 6006111 - DNA, 13 bp, Homo sapiens
cacttcacagagt

SEQ ID NO: 6006112 - DNA, 15 bp, Homo sapiens
cacttcacagctgga

SEQ ID NO: 6006113 - DNA, 15 bp, Homo sapiens
cacttcacccccaac

SEQ ID NO: 6006114 - DNA, 14 bp, Homo sapiens
cacttcaccctgga

SEQ ID NO: 6006115 - DNA, 19 bp, Homo sapiens
cacttcacgcccttggcca

SEQ ID NO: 6006116 - DNA, 18 bp, Homo sapiens
cacttcactccagcctgg

SEQ ID NO: 6006117 - DNA, 15 bp, Homo sapiens
cacttcactgtgagg

SEQ ID NO: 6006118 - DNA, 15 bp, Homo sapiens
cacttcactgtgctg

SEQ ID NO: 6006119 - DNA, 17 bp, Homo sapiens
cacttcactttcttcaa

SEQ ID NO: 6006120 - DNA, 21 bp, Homo sapiens
cacttcagacacaggaaaaat

SEQ ID NO: 6006121 - DNA, 22 bp, Homo sapiens
cacttcagacacaggaaaaata

SEQ ID NO: 6006122 - DNA, 17 bp, Homo sapiens
cacttcagagagctggt

SEQ ID NO: 6006123 - DNA, 18 bp, Homo sapiens
cacttcagagagctggta

SEQ ID NO: 6006124 - DNA, 16 bp, Homo sapiens
cacttcagatctgagg

SEQ ID NO: 6006125 - DNA, 21 bp, Homo sapiens
cacttcagctgacttttctgt

SEQ ID NO: 6006126 - DNA, 15 bp, Homo sapiens
cacttcaggctcttc

SEQ ID NO: 6006127 - DNA, 23 bp, Homo sapiens
cacttcaggctcttctcctttca

SEQ ID NO: 6006128 - DNA, 21 bp, Homo sapiens
cacttcagggcagattttagt

SEQ ID NO: 6006129 - DNA, 23 bp, Homo sapiens
cacttcagggcagattttagttt

SEQ ID NO: 6006130 - DNA, 22 bp, Homo sapiens
cacttcagggttctcctctccc

SEQ ID NO: 6006131 - DNA, 20 bp, Homo sapiens
cacttcaggtatacctcact

SEQ ID NO: 6006132 - DNA, 18 bp, Homo sapiens
cacttcaggtcaggagtt

SEQ ID NO: 6006133 - DNA, 17 bp, Homo sapiens
cacttcagttgtggcct

SEQ ID NO: 6006134 - DNA, 19 bp, Homo sapiens
caggccagtgccaggacag

SEQ ID NO: 6006135 - DNA, 21 bp, Homo sapiens
caggccagtgccaggacagct

SEQ ID NO: 6006136 - DNA, 19 bp, Homo sapiens
caggccagtgggcctggta

SEQ ID NO: 6006137 - DNA, 12 bp, Homo sapiens
caggccagtgtc

SEQ ID NO: 6006138 - DNA, 15 bp, Homo sapiens
caggccagtgtctgg

SEQ ID NO: 6006139 - DNA, 15 bp, Homo sapiens
caggccataccaggt

SEQ ID NO: 6006140 - DNA, 19 bp, Homo sapiens
caggccatcaccacagctg

SEQ ID NO: 6006141 - DNA, 20 bp, Homo sapiens
caggccatcaccacagctgc

SEQ ID NO: 6006142 - DNA, 15 bp, Homo sapiens
caggccatcttccag

SEQ ID NO: 6006143 - DNA, 19 bp, Homo sapiens
caggccatcttccaggtgg

SEQ ID NO: 6006144 - DNA, 12 bp, Homo sapiens
caggccatggcc

SEQ ID NO: 6006145 - DNA, 17 bp, Homo sapiens
caggccatgtgagccac

SEQ ID NO: 6006146 - DNA, 16 bp, Homo sapiens
caggccatgtggcctg

SEQ ID NO: 6006147 - DNA, 17 bp, Homo sapiens
caggccattatgcctgg

SEQ ID NO: 6006148 - DNA, 20 bp, Homo sapiens
caggccattgtgaaccaatg

SEQ ID NO: 6006149 - DNA, 22 bp, Homo sapiens
caggcccaactgtgagcaagga

SEQ ID NO: 6006150 - DNA, 16 bp, Homo sapiens
caggcccaaggagggt

SEQ ID NO: 6006151 - DNA, 16 bp, Homo sapiens
caggcccaaggctccc

SEQ ID NO: 6006152 - DNA, 19 bp, Homo sapiens
caggcccaatgctgctttt

SEQ ID NO: 6006153 - DNA, 10 bp, Homo sapiens
caggcccacc

SEQ ID NO: 6006154 - DNA, 14 bp, Homo sapiens
caggcccaccctgc

SEQ ID NO: 6006155 - DNA, 23 bp, Homo sapiens
caggcccaccggatgctgtgcct

SEQ ID NO: 6006156 - DNA, 24 bp, Homo sapiens
caggcccaccggatgctgtgcctg

SEQ ID NO: 6006157 - DNA, 12 bp, Homo sapiens
caggcccaccta

SEQ ID NO: 6006158 - DNA, 16 bp, Homo sapiens
caggcccacgaggagc

SEQ ID NO: 6006159 - DNA, 21 bp, Homo sapiens
caggcccacgaggagcagcag

SEQ ID NO: 6006160 - DNA, 13 bp, Homo sapiens
caggcccactcag

SEQ ID NO: 6006161 - DNA, 15 bp, Homo sapiens
caggcccactcccca

SEQ ID NO: 6006162 - DNA, 15 bp, Homo sapiens
caggcccactgtgcc

SEQ ID NO: 6006163 - DNA, 16 bp, Homo sapiens
caggcccactgtgcct

SEQ ID NO: 6006164 - DNA, 19 bp, Homo sapiens
caggcccactgtgcctcag

SEQ ID NO: 6006165 - DNA, 17 bp, Homo sapiens
caggcccagcatgcagg

SEQ ID NO: 6006166 - DNA, 13 bp, Homo sapiens
caggcccagccag

SEQ ID NO: 6006167 - DNA, 13 bp, Homo sapiens
caggcccagccct

SEQ ID NO: 6006168 - DNA, 14 bp, Homo sapiens
caggcccagccctc

SEQ ID NO: 6006169 - DNA, 16 bp, Homo sapiens
caggcccagccgaccc

SEQ ID NO: 6006170 - DNA, 21 bp, Homo sapiens
caggcccagccgaccccctct

SEQ ID NO: 6006171 - DNA, 14 bp, Homo sapiens
caggcccagcctct

SEQ ID NO: 6006172 - DNA, 18 bp, Homo sapiens
caggcccagcctctctgg

SEQ ID NO: 6006173 - DNA, 13 bp, Homo sapiens
caggcccagcctg

SEQ ID NO: 6006174 - DNA, 14 bp, Homo sapiens
caggcccagcgcgg

SEQ ID NO: 6006175 - DNA, 23 bp, Homo sapiens
caggcccagctttccctgccagg

SEQ ID NO: 6006176 - DNA, 22 bp, Homo sapiens
caggcccaggaaggcggcaggc

SEQ ID NO: 6006177 - DNA, 16 bp, Homo sapiens
caggcccaggcagagc

SEQ ID NO: 6006178 - DNA, 18 bp, Homo sapiens
caggcccaggcaggccca

SEQ ID NO: 6006179 - DNA, 12 bp, Homo sapiens
caggcccaggcc

SEQ ID NO: 6006180 - DNA, 18 bp, Homo sapiens
caggcccaggcctcacca

SEQ ID NO: 6006181 - DNA, 15 bp, Homo sapiens
caggcccagggaggg

SEQ ID NO: 6006182 - DNA, 20 bp, Homo sapiens
caggcccatctcaggtgcca

SEQ ID NO: 6006183 - DNA, 22 bp, Homo sapiens
caggcccatctcaggtgccact

SEQ ID NO: 6006184 - DNA, 18 bp, Homo sapiens
caggcccatgccctccgt

SEQ ID NO: 6006185 - DNA, 23 bp, Homo sapiens
caggcccatgctatgagttttct

SEQ ID NO: 6006186 - DNA, 23 bp, Homo sapiens
caggccccaaaaccacagccctg

SEQ ID NO: 6006187 - DNA, 22 bp, Homo sapiens
caggccccaccaagagggtgga

SEQ ID NO: 6006188 - DNA, 13 bp, Homo sapiens
caggccccacccc

SEQ ID NO: 6006189 - DNA, 15 bp, Homo sapiens
caggccccaccggcc

SEQ ID NO: 6006190 - DNA, 17 bp, Homo sapiens
caggccccaccggccag

SEQ ID NO: 6006191 - DNA, 20 bp, Homo sapiens
caggccccaccggccaggcc

SEQ ID NO: 6006192 - DNA, 15 bp, Homo sapiens
caggccccacgccct

SEQ ID NO: 6006193 - DNA, 17 bp, Homo sapiens
caggccccactccttcc

SEQ ID NO: 6006194 - DNA, 15 bp, Homo sapiens
caggccccagccaag

SEQ ID NO: 6006195 - DNA, 18 bp, Homo sapiens
caggccccagccaagtgc

SEQ ID NO: 6006196 - DNA, 15 bp, Homo sapiens
caggccccagcctcc

SEQ ID NO: 6006197 - DNA, 14 bp, Homo sapiens
caggccccaggcct

SEQ ID NO: 6006198 - DNA, 16 bp, Homo sapiens
caggccccaggctgga

SEQ ID NO: 6006199 - DNA, 18 bp, Homo sapiens
caggccccatcagcatcc

SEQ ID NO: 6006200 - DNA, 21 bp, Homo sapiens
caggccccatcagcatcccac

SEQ ID NO: 6006201 - DNA, 19 bp, Homo sapiens
caggccccatgacctccag

SEQ ID NO: 6006202 - DNA, 20 bp, Homo sapiens
caggccccatgacctccagc

SEQ ID NO: 6006203 - DNA, 22 bp, Homo sapiens
caggcccccaacccctcctccc

SEQ ID NO: 6006204 - DNA, 23 bp, Homo sapiens
caggcccccaacccctcctccct

SEQ ID NO: 6006205 - DNA, 13 bp, Homo sapiens
caggcccccaagc

SEQ ID NO: 6006206 - DNA, 19 bp, Homo sapiens
caggcccccaagcctgcag

SEQ ID NO: 6006207 - DNA, 18 bp, Homo sapiens
caggcccccaccacacat

SEQ ID NO: 6006208 - DNA, 23 bp, Homo sapiens
caggcccccaccacacatcccag

SEQ ID NO: 6006209 - DNA, 18 bp, Homo sapiens
caggcccccacctggctc

SEQ ID NO: 6006210 - DNA, 21 bp, Homo sapiens
caggcccccagaacccctggc

SEQ ID NO: 6006211 - DNA, 17 bp, Homo sapiens
caggcccccagcccctc

SEQ ID NO: 6006212 - DNA, 19 bp, Homo sapiens
caggcccccagcccctcct

SEQ ID NO: 6006213 - DNA, 19 bp, Homo sapiens
caggcccccaggtgccagt

SEQ ID NO: 6006214 - DNA, 16 bp, Homo sapiens
caggccccccgcagca

SEQ ID NO: 6006215 - DNA, 21 bp, Homo sapiens
caggcccccgccttggcctgt

SEQ ID NO: 6006216 - DNA, 23 bp, Homo sapiens
caggcccccgctggctcctccag

SEQ ID NO: 6006217 - DNA, 19 bp, Homo sapiens
caggcccccggctttcctc

SEQ ID NO: 6006218 - DNA, 21 bp, Homo sapiens
caggcccccggctttcctccg

SEQ ID NO: 6006219 - DNA, 21 bp, Homo sapiens
caggcccccggggaggggcca

SEQ ID NO: 6006220 - DNA, 21 bp, Homo sapiens
caggccccgaggacccagacc

SEQ ID NO: 6006221 - DNA, 23 bp, Homo sapiens
caggccccgaggacccagaccca

SEQ ID NO: 6006222 - DNA, 16 bp, Homo sapiens
caggccccgccccctc

SEQ ID NO: 6006223 - DNA, 18 bp, Homo sapiens
caggccccgcttgtccag

SEQ ID NO: 6006224 - DNA, 15 bp, Homo sapiens
caggccccgggcttc

SEQ ID NO: 6006225 - DNA, 18 bp, Homo sapiens
caggccccgggcttccct

SEQ ID NO: 6006226 - DNA, 21 bp, Homo sapiens
caggccccgtgaggcaatggg

SEQ ID NO: 6006227 - DNA, 14 bp, Homo sapiens
caggcccctccctc

SEQ ID NO: 6006228 - DNA, 14 bp, Homo sapiens
caggcccctctcct

SEQ ID NO: 6006229 - DNA, 13 bp, Homo sapiens
caggcccctgcca

SEQ ID NO: 6006230 - DNA, 19 bp, Homo sapiens
caggcccctgccaccctgg

SEQ ID NO: 6006231 - DNA, 15 bp, Homo sapiens
caggcccctgggttt

SEQ ID NO: 6006232 - DNA, 14 bp, Homo sapiens
caggcccctttgga

SEQ ID NO: 6006233 - DNA, 21 bp, Homo sapiens
caggcccctttggacctgcag

SEQ ID NO: 6006234 - DNA, 19 bp, Homo sapiens
caggcccgagcgcctgcgt

SEQ ID NO: 6006235 - DNA, 24 bp, Homo sapiens
caggcccgcaccccggcctcaggg

SEQ ID NO: 6006236 - DNA, 14 bp, Homo sapiens
caggcccgcttgct

SEQ ID NO: 6006237 - DNA, 21 bp, Homo sapiens
caggcccggatgcagaggcct

SEQ ID NO: 6006238 - DNA, 19 bp, Homo sapiens
caggcccggctccaggctc

SEQ ID NO: 6006239 - DNA, 21 bp, Homo sapiens
caggcccggctccaggctcct

SEQ ID NO: 6006240 - DNA, 15 bp, Homo sapiens
caggcccggggctgg

SEQ ID NO: 6006241 - DNA, 16 bp, Homo sapiens
caggcccggggctggc

SEQ ID NO: 6006242 - DNA, 23 bp, Homo sapiens
caggcccggggggaccaggatga

SEQ ID NO: 6006243 - DNA, 18 bp, Homo sapiens
caggcccgtcggagctgc

SEQ ID NO: 6006244 - DNA, 21 bp, Homo sapiens
caggcccgtcggagctgcctg

SEQ ID NO: 6006245 - DNA, 23 bp, Homo sapiens
caggcccgtcggagctgcctgca

SEQ ID NO: 6006246 - DNA, 21 bp, Homo sapiens
caggcccgtgggcgcaaaggt

SEQ ID NO: 6006247 - DNA, 19 bp, Homo sapiens
caggccctaagatgccttg

SEQ ID NO: 6006248 - DNA, 17 bp, Homo sapiens
caggccctagaccctcc

SEQ ID NO: 6006249 - DNA, 21 bp, Homo sapiens
caggccctagaccctccccca

SEQ ID NO: 6006250 - DNA, 12 bp, Homo sapiens
caggccctccag

SEQ ID NO: 6006251 - DNA, 14 bp, Homo sapiens
caggccctccagtg

SEQ ID NO: 6006252 - DNA, 17 bp, Homo sapiens
caggccctccatgggct

SEQ ID NO: 6006253 - DNA, 18 bp, Homo sapiens
caggccctccatgggcta

SEQ ID NO: 6006254 - DNA, 13 bp, Homo sapiens
caggccctcccac

SEQ ID NO: 6006255 - DNA, 15 bp, Homo sapiens
caggccctcccacca

SEQ ID NO: 6006256 - DNA, 21 bp, Homo sapiens
caggccctccctctactcttc

SEQ ID NO: 6006257 - DNA, 22 bp, Homo sapiens
caggccctccctctactcttcc

SEQ ID NO: 6006258 - DNA, 23 bp, Homo sapiens
caggccctccctctactcttcct

SEQ ID NO: 6006259 - DNA, 20 bp, Homo sapiens
caggccctccctgactccct

SEQ ID NO: 6006260 - DNA, 23 bp, Homo sapiens
caggccctccctgactccctgtg

SEQ ID NO: 6006261 - DNA, 14 bp, Homo sapiens
caggccctccctgt

SEQ ID NO: 6006262 - DNA, 15 bp, Homo sapiens
caggccctccctgtc

SEQ ID NO: 6006263 - DNA, 22 bp, Homo sapiens
caggccctccctgtctccaggg

SEQ ID NO: 6006264 - DNA, 22 bp, Homo sapiens
caggccctccctgttccccaga

SEQ ID NO: 6006265 - DNA, 14 bp, Homo sapiens
caggccctcctctc

SEQ ID NO: 6006266 - DNA, 14 bp, Homo sapiens
caggccctcctgct

SEQ ID NO: 6006267 - DNA, 13 bp, Homo sapiens
caggccctctgcc

SEQ ID NO: 6006268 - DNA, 15 bp, Homo sapiens
caggccctctgccca

SEQ ID NO: 6006269 - DNA, 19 bp, Homo sapiens
caggccctctgcccactcc

SEQ ID NO: 6006270 - DNA, 20 bp, Homo sapiens
caggccctctgcccactccc

SEQ ID NO: 6006271 - DNA, 22 bp, Homo sapiens
caggccctctgcccactccctg

SEQ ID NO: 6006272 - DNA, 20 bp, Homo sapiens
caggccctctgcctgcactc

SEQ ID NO: 6006273 - DNA, 21 bp, Homo sapiens
caggccctctgcctgcactcc

SEQ ID NO: 6006274 - DNA, 14 bp, Homo sapiens
caggccctgactcc

SEQ ID NO: 6006275 - DNA, 15 bp, Homo sapiens
caggccctgactcct

SEQ ID NO: 6006276 - DNA, 19 bp, Homo sapiens
caggccctgactcctctgg

SEQ ID NO: 6006277 - DNA, 14 bp, Homo sapiens
caggccctgcactg

SEQ ID NO: 6006278 - DNA, 15 bp, Homo sapiens
caggccctgcactgt

SEQ ID NO: 6006279 - DNA, 17 bp, Homo sapiens
caggccctgcactgtcc

SEQ ID NO: 6006280 - DNA, 22 bp, Homo sapiens
caggccctgcactgtcctgctc

SEQ ID NO: 6006281 - DNA, 23 bp, Homo sapiens
caggccctgcactgtcctgctcc

SEQ ID NO: 6006282 - DNA, 13 bp, Homo sapiens
caggccctgcagt

SEQ ID NO: 6006283 - DNA, 17 bp, Homo sapiens
caggccctgcagtgttc

SEQ ID NO: 6006284 - DNA, 17 bp, Homo sapiens
caggccctgccagagca

SEQ ID NO: 6006285 - DNA, 18 bp, Homo sapiens
caggccctgccagagcag

SEQ ID NO: 6006286 - DNA, 19 bp, Homo sapiens
caggccctgccagagcagg

SEQ ID NO: 6006287 - DNA, 23 bp, Homo sapiens
caggccctgccagtggggaagga

SEQ ID NO: 6006288 - DNA, 22 bp, Homo sapiens
caggccctgccattggcctctt

SEQ ID NO: 6006289 - DNA, 15 bp, Homo sapiens
caggccctgcccagc

SEQ ID NO: 6006290 - DNA, 14 bp, Homo sapiens
caggccctgccccc

SEQ ID NO: 6006291 - DNA, 22 bp, Homo sapiens
caggccctgccccctcccactc

SEQ ID NO: 6006292 - DNA, 23 bp, Homo sapiens
caggccctgccccctcccactct

SEQ ID NO: 6006293 - DNA, 14 bp, Homo sapiens
caggccctgctcct

SEQ ID NO: 6006294 - DNA, 15 bp, Homo sapiens
caggccctgctcctg

SEQ ID NO: 6006295 - DNA, 19 bp, Homo sapiens
caggccctgctcctgcagc

SEQ ID NO: 6006296 - DNA, 22 bp, Homo sapiens
caggccctgctcctgcagcatg

SEQ ID NO: 6006297 - DNA, 12 bp, Homo sapiens
caggccctggag

SEQ ID NO: 6006298 - DNA, 14 bp, Homo sapiens
caggccctggaggg

SEQ ID NO: 6006299 - DNA, 19 bp, Homo sapiens
caggccctggagggcagag

SEQ ID NO: 6006300 - DNA, 22 bp, Homo sapiens
caggccctggagggcagagaca

SEQ ID NO: 6006301 - DNA, 20 bp, Homo sapiens
caggccctgggcctccacct

SEQ ID NO: 6006302 - DNA, 14 bp, Homo sapiens
caggccctgggtct

SEQ ID NO: 6006303 - DNA, 15 bp, Homo sapiens
caggcccttcctctc

SEQ ID NO: 6006304 - DNA, 21 bp, Homo sapiens
caggcccttggggttccccca

SEQ ID NO: 6006305 - DNA, 20 bp, Homo sapiens
caggcccttggtagagctgg

SEQ ID NO: 6006306 - DNA, 17 bp, Homo sapiens
caggccctttcctcagg

SEQ ID NO: 6006307 - DNA, 20 bp, Homo sapiens
caggccctttgaagcctcag

SEQ ID NO: 6006308 - DNA, 22 bp, Homo sapiens
caggccctttgaagcctcagct

SEQ ID NO: 6006309 - DNA, 15 bp, Homo sapiens
caggccgacagtcgg

SEQ ID NO: 6006310 - DNA, 19 bp, Homo sapiens
caggccgacagtcggtgac

SEQ ID NO: 6006311 - DNA, 19 bp, Homo sapiens
cacttcagttgtggcctca

SEQ ID NO: 6006312 - DNA, 15 bp, Homo sapiens
cacttcataatccag

SEQ ID NO: 6006313 - DNA, 18 bp, Homo sapiens
cacttcatggaccaagaa

SEQ ID NO: 6006314 - DNA, 19 bp, Homo sapiens
cacttcatggaccaagaat

SEQ ID NO: 6006315 - DNA, 19 bp, Homo sapiens
cacttcatgtaaagtgtca

SEQ ID NO: 6006316 - DNA, 11 bp, Homo sapiens
cacttcatgtc

SEQ ID NO: 6006317 - DNA, 16 bp, Homo sapiens
cacttcattccagcag

SEQ ID NO: 6006318 - DNA, 19 bp, Homo sapiens
cacttcattccagcagctg

SEQ ID NO: 6006319 - DNA, 19 bp, Homo sapiens
cacttcattgtaaatcact

SEQ ID NO: 6006320 - DNA, 12 bp, Homo sapiens
cacttcattttc

SEQ ID NO: 6006321 - DNA, 21 bp, Homo sapiens
cacttcatttttattaaacag

SEQ ID NO: 6006322 - DNA, 19 bp, Homo sapiens
cacttccaaaattcttatt

SEQ ID NO: 6006323 - DNA, 15 bp, Homo sapiens
cacttccaccagcct

SEQ ID NO: 6006324 - DNA, 20 bp, Homo sapiens
cacttccacctccagcctct

SEQ ID NO: 6006325 - DNA, 12 bp, Homo sapiens
cacttccagggg

SEQ ID NO: 6006326 - DNA, 14 bp, Homo sapiens
cacttccaggggaa

SEQ ID NO: 6006327 - DNA, 20 bp, Homo sapiens
cacttccaggtctgcctggt

SEQ ID NO: 6006328 - DNA, 20 bp, Homo sapiens
cacttccataatctggactc

SEQ ID NO: 6006329 - DNA, 18 bp, Homo sapiens
cacttccatacagctcta

SEQ ID NO: 6006330 - DNA, 11 bp, Homo sapiens
cacttccattg

SEQ ID NO: 6006331 - DNA, 21 bp, Homo sapiens
cacttcccaggatctgctcca

SEQ ID NO: 6006332 - DNA, 17 bp, Homo sapiens
cacttcccatttactct

SEQ ID NO: 6006333 - DNA, 21 bp, Homo sapiens
cacttcccatttactcttgag

SEQ ID NO: 6006334 - DNA, 16 bp, Homo sapiens
cacttcccatttgtgt

SEQ ID NO: 6006335 - DNA, 10 bp, Homo sapiens
cacttcccct

SEQ ID NO: 6006336 - DNA, 12 bp, Homo sapiens
cacttcccctcc

SEQ ID NO: 6006337 - DNA, 15 bp, Homo sapiens
cacttccccttgtct

SEQ ID NO: 6006338 - DNA, 19 bp, Homo sapiens
cacttccccttgtctccct

SEQ ID NO: 6006339 - DNA, 20 bp, Homo sapiens
cacttccccttgtctccctg

SEQ ID NO: 6006340 - DNA, 21 bp, Homo sapiens
cacttccccttgtctccctgg

SEQ ID NO: 6006341 - DNA, 19 bp, Homo sapiens
cacttccctcatctctcct

SEQ ID NO: 6006342 - DNA, 15 bp, Homo sapiens
cacttccctctgttt

SEQ ID NO: 6006343 - DNA, 17 bp, Homo sapiens
cacttccctctgtttct

SEQ ID NO: 6006344 - DNA, 10 bp, Homo sapiens
cacttccctg

SEQ ID NO: 6006345 - DNA, 13 bp, Homo sapiens
cacttccctgctg

SEQ ID NO: 6006346 - DNA, 19 bp, Homo sapiens
cacttccctggcggcccca

SEQ ID NO: 6006347 - DNA, 14 bp, Homo sapiens
cacttccctgggcc

SEQ ID NO: 6006348 - DNA, 17 bp, Homo sapiens
cacttcctacaagagca

SEQ ID NO: 6006349 - DNA, 18 bp, Homo sapiens
cacttcctcatcatgaaa

SEQ ID NO: 6006350 - DNA, 16 bp, Homo sapiens
cacttcctccacagtc

SEQ ID NO: 6006351 - DNA, 21 bp, Homo sapiens
cacttcctccagaagcctcct

SEQ ID NO: 6006352 - DNA, 12 bp, Homo sapiens
cacttcctcccc

SEQ ID NO: 6006353 - DNA, 11 bp, Homo sapiens
cacttcctcct

SEQ ID NO: 6006354 - DNA, 14 bp, Homo sapiens
cacttcctcctacc

SEQ ID NO: 6006355 - DNA, 16 bp, Homo sapiens
cacttcctcctacctg

SEQ ID NO: 6006356 - DNA, 21 bp, Homo sapiens
cacttcctctcgcggccctca

SEQ ID NO: 6006357 - DNA, 14 bp, Homo sapiens
cacttcctgaggcc

SEQ ID NO: 6006358 - DNA, 11 bp, Homo sapiens
cacttcctgcc

SEQ ID NO: 6006359 - DNA, 20 bp, Homo sapiens
cacttcctgccccaactgca

SEQ ID NO: 6006360 - DNA, 14 bp, Homo sapiens
cacttcctgcctaa

SEQ ID NO: 6006361 - DNA, 14 bp, Homo sapiens
cacttcctgtcctt

SEQ ID NO: 6006362 - DNA, 12 bp, Homo sapiens
cacttccttaac

SEQ ID NO: 6006363 - DNA, 16 bp, Homo sapiens
cacttccttaacagct

SEQ ID NO: 6006364 - DNA, 19 bp, Homo sapiens
cacttccttaacagctgta

SEQ ID NO: 6006365 - DNA, 22 bp, Homo sapiens
cacttccttaacagctgtatta

SEQ ID NO: 6006366 - DNA, 12 bp, Homo sapiens
cacttcctttcc

SEQ ID NO: 6006367 - DNA, 20 bp, Homo sapiens
cacttcctttcctactgtcc

SEQ ID NO: 6006368 - DNA, 15 bp, Homo sapiens
cacttcctttgtgtt

SEQ ID NO: 6006369 - DNA, 18 bp, Homo sapiens
cacttcctttgtgtttat

SEQ ID NO: 6006370 - DNA, 15 bp, Homo sapiens
cacttccttttaact

SEQ ID NO: 6006371 - DNA, 17 bp, Homo sapiens
cacttcgcacacaccca

SEQ ID NO: 6006372 - DNA, 22 bp, Homo sapiens
cacttcggataattttcatttt

SEQ ID NO: 6006373 - DNA, 17 bp, Homo sapiens
cacttcggccagagctg

SEQ ID NO: 6006374 - DNA, 23 bp, Homo sapiens
cacttcggccaggtcacacgacc

SEQ ID NO: 6006375 - DNA, 20 bp, Homo sapiens
cacttctaaattaatggtaa

SEQ ID NO: 6006376 - DNA, 23 bp, Homo sapiens
cacttctaagttgagtatattat

SEQ ID NO: 6006377 - DNA, 17 bp, Homo sapiens
cacttctagatctcagc

SEQ ID NO: 6006378 - DNA, 18 bp, Homo sapiens
cacttctagtggtctcac

SEQ ID NO: 6006379 - DNA, 21 bp, Homo sapiens
cacttctagtggtctcacctg

SEQ ID NO: 6006380 - DNA, 22 bp, Homo sapiens
cacttctagtggtctcacctgg

SEQ ID NO: 6006381 - DNA, 19 bp, Homo sapiens
cacttctatatatacaatg

SEQ ID NO: 6006382 - DNA, 13 bp, Homo sapiens
cacttctatgcaa

SEQ ID NO: 6006383 - DNA, 12 bp, Homo sapiens
cacttctattta

SEQ ID NO: 6006384 - DNA, 19 bp, Homo sapiens
cacttctatttatttatta

SEQ ID NO: 6006385 - DNA, 15 bp, Homo sapiens
cacttctcaggacac

SEQ ID NO: 6006386 - DNA, 16 bp, Homo sapiens
cacttctcatcacaca

SEQ ID NO: 6006387 - DNA, 17 bp, Homo sapiens
cacttctcatcacacac

SEQ ID NO: 6006388 - DNA, 18 bp, Homo sapiens
cacttctcatcacacaca

SEQ ID NO: 6006389 - DNA, 19 bp, Homo sapiens
cacttctcatcacacacat

SEQ ID NO: 6006390 - DNA, 23 bp, Homo sapiens
cacttctcatcatattgtatgta

SEQ ID NO: 6006391 - DNA, 15 bp, Homo sapiens
cacttctccatgctg

SEQ ID NO: 6006392 - DNA, 12 bp, Homo sapiens
cacttctccccg

SEQ ID NO: 6006393 - DNA, 13 bp, Homo sapiens
cacttctccttaa

SEQ ID NO: 6006394 - DNA, 18 bp, Homo sapiens
cacttctccttaaccccc

SEQ ID NO: 6006395 - DNA, 16 bp, Homo sapiens
cacttctctactctgg

SEQ ID NO: 6006396 - DNA, 12 bp, Homo sapiens
cacttctctaga

SEQ ID NO: 6006397 - DNA, 13 bp, Homo sapiens
cacttctctccag

SEQ ID NO: 6006398 - DNA, 14 bp, Homo sapiens
cacttctctgggtc

SEQ ID NO: 6006399 - DNA, 23 bp, Homo sapiens
cacttctgaccttgctgccacaa

SEQ ID NO: 6006400 - DNA, 13 bp, Homo sapiens
cacttctgccaga

SEQ ID NO: 6006401 - DNA, 14 bp, Homo sapiens
cacttctgccttga

SEQ ID NO: 6006402 - DNA, 18 bp, Homo sapiens
cacttctgcgggctccct

SEQ ID NO: 6006403 - DNA, 22 bp, Homo sapiens
cacttctgcgggctccctcctc

SEQ ID NO: 6006404 - DNA, 20 bp, Homo sapiens
cacttctggcctccagcctt

SEQ ID NO: 6006405 - DNA, 17 bp, Homo sapiens
cacttctggctcacagg

SEQ ID NO: 6006406 - DNA, 23 bp, Homo sapiens
cacttctggcttcagcccccacc

SEQ ID NO: 6006407 - DNA, 12 bp, Homo sapiens
cacttctgggaa

SEQ ID NO: 6006408 - DNA, 16 bp, Homo sapiens
cacttctggggccagc

SEQ ID NO: 6006409 - DNA, 17 bp, Homo sapiens
cacttctggggccagcc

SEQ ID NO: 6006410 - DNA, 18 bp, Homo sapiens
cacttctggggccagccc

SEQ ID NO: 6006411 - DNA, 19 bp, Homo sapiens
cacttctgggtggggcagt

SEQ ID NO: 6006412 - DNA, 15 bp, Homo sapiens
cacttctggtataat

SEQ ID NO: 6006413 - DNA, 21 bp, Homo sapiens
cacttctggtataattgtgta

SEQ ID NO: 6006414 - DNA, 13 bp, Homo sapiens
cacttctggtccc

SEQ ID NO: 6006415 - DNA, 14 bp, Homo sapiens
cacttctgtccata

SEQ ID NO: 6006416 - DNA, 16 bp, Homo sapiens
cacttctgtcctgtga

SEQ ID NO: 6006417 - DNA, 18 bp, Homo sapiens
cacttctgtcctgtgagg

SEQ ID NO: 6006418 - DNA, 14 bp, Homo sapiens
cacttctgtctcct

SEQ ID NO: 6006419 - DNA, 22 bp, Homo sapiens
cacttctgtgagacccccacac

SEQ ID NO: 6006420 - DNA, 12 bp, Homo sapiens
cacttctgtggg

SEQ ID NO: 6006421 - DNA, 17 bp, Homo sapiens
cacttctgtgggcatgg

SEQ ID NO: 6006422 - DNA, 18 bp, Homo sapiens
cacttctgtgggcatggc

SEQ ID NO: 6006423 - DNA, 16 bp, Homo sapiens
cacttctgtgtagaca

SEQ ID NO: 6006424 - DNA, 12 bp, Homo sapiens
cacttctgttat

SEQ ID NO: 6006425 - DNA, 18 bp, Homo sapiens
cacttcttaaaggcctgg

SEQ ID NO: 6006426 - DNA, 21 bp, Homo sapiens
cacttcttaaaggcctggaac

SEQ ID NO: 6006427 - DNA, 12 bp, Homo sapiens
cacttcttcacc

SEQ ID NO: 6006428 - DNA, 19 bp, Homo sapiens
cacttcttcacctcttcca

SEQ ID NO: 6006429 - DNA, 13 bp, Homo sapiens
cacttcttccttt

SEQ ID NO: 6006430 - DNA, 15 bp, Homo sapiens
cacttcttcctttct

SEQ ID NO: 6006431 - DNA, 16 bp, Homo sapiens
cacttcttcctttctc

SEQ ID NO: 6006432 - DNA, 14 bp, Homo sapiens
cacttcttctgtcc

SEQ ID NO: 6006433 - DNA, 15 bp, Homo sapiens
cacttcttctgtcca

SEQ ID NO: 6006434 - DNA, 16 bp, Homo sapiens
cacttcttctgtccaa

SEQ ID NO: 6006435 - DNA, 19 bp, Homo sapiens
cacttcttgaaacagcctg

SEQ ID NO: 6006436 - DNA, 21 bp, Homo sapiens
cacttcttgaaacagcctggg

SEQ ID NO: 6006437 - DNA, 17 bp, Homo sapiens
cacttcttggttcctgg

SEQ ID NO: 6006438 - DNA, 18 bp, Homo sapiens
cacttcttgttccccact

SEQ ID NO: 6006439 - DNA, 19 bp, Homo sapiens
cacttctttatactctctt

SEQ ID NO: 6006440 - DNA, 20 bp, Homo sapiens
cacttctttatactctcttc

SEQ ID NO: 6006441 - DNA, 17 bp, Homo sapiens
cacttctttcccttcct

SEQ ID NO: 6006442 - DNA, 19 bp, Homo sapiens
cacttctttcccttcctcc

SEQ ID NO: 6006443 - DNA, 23 bp, Homo sapiens
cacttgaaagattttattgtata

SEQ ID NO: 6006444 - DNA, 15 bp, Homo sapiens
cacttgaagccaaac

SEQ ID NO: 6006445 - DNA, 19 bp, Homo sapiens
cacttgaagcctaaatttg

SEQ ID NO: 6006446 - DNA, 16 bp, Homo sapiens
cacttgaatcagtttt

SEQ ID NO: 6006447 - DNA, 22 bp, Homo sapiens
cacttgaatcagtttttaaaat

SEQ ID NO: 6006448 - DNA, 17 bp, Homo sapiens
cacttgaatccattgaa

SEQ ID NO: 6006449 - DNA, 14 bp, Homo sapiens
cacttgacaccaac

SEQ ID NO: 6006450 - DNA, 22 bp, Homo sapiens
cacttgacaccaaccagacagc

SEQ ID NO: 6006451 - DNA, 15 bp, Homo sapiens
cacttgacattcctt

SEQ ID NO: 6006452 - DNA, 19 bp, Homo sapiens
cacttgaccgggagacaga

SEQ ID NO: 6006453 - DNA, 13 bp, Homo sapiens
cacttgacctgag

SEQ ID NO: 6006454 - DNA, 14 bp, Homo sapiens
cacttgacctgaga

SEQ ID NO: 6006455 - DNA, 16 bp, Homo sapiens
cacttgaccttctgtc

SEQ ID NO: 6006456 - DNA, 17 bp, Homo sapiens
cacttgagaattaccct

SEQ ID NO: 6006457 - DNA, 20 bp, Homo sapiens
cacttgagaattaccctttt

SEQ ID NO: 6006458 - DNA, 13 bp, Homo sapiens
cacttgagaggat

SEQ ID NO: 6006459 - DNA, 12 bp, Homo sapiens
cacttgagctgt

SEQ ID NO: 6006460 - DNA, 14 bp, Homo sapiens
cacttgaggcctga

SEQ ID NO: 6006461 - DNA, 16 bp, Homo sapiens
cacttgaggcctgatc

SEQ ID NO: 6006462 - DNA, 20 bp, Homo sapiens
cacttgaggcctgatctgcc

SEQ ID NO: 6006463 - DNA, 23 bp, Homo sapiens
cacttgagtggaggtttatagtt

SEQ ID NO: 6006464 - DNA, 15 bp, Homo sapiens
cacttgatgtctgag

SEQ ID NO: 6006465 - DNA, 16 bp, Homo sapiens
cacttgatgtgccatt

SEQ ID NO: 6006466 - DNA, 19 bp, Homo sapiens
cacttgatgtttcctggaa

SEQ ID NO: 6006467 - DNA, 23 bp, Homo sapiens
cacttgatgtttcctggaagcag

SEQ ID NO: 6006468 - DNA, 14 bp, Homo sapiens
cacttgattcataa

SEQ ID NO: 6006469 - DNA, 15 bp, Homo sapiens
cacttgattcataaa

SEQ ID NO: 6006470 - DNA, 17 bp, Homo sapiens
cacttgattcatctctg

SEQ ID NO: 6006471 - DNA, 19 bp, Homo sapiens
cacttgattcatctctggt

SEQ ID NO: 6006472 - DNA, 20 bp, Homo sapiens
cacttgattcatctctggtt

SEQ ID NO: 6006473 - DNA, 17 bp, Homo sapiens
cacttgcaaatgaatgc

SEQ ID NO: 6006474 - DNA, 24 bp, Homo sapiens
cacttgcagactctacagaggcca

SEQ ID NO: 6006475 - DNA, 14 bp, Homo sapiens
cacttgcagaggag

SEQ ID NO: 6006476 - DNA, 19 bp, Homo sapiens
cacttgcagaggagcccag

SEQ ID NO: 6006477 - DNA, 20 bp, Homo sapiens
cacttgcaggggtccctgct

SEQ ID NO: 6006478 - DNA, 12 bp, Homo sapiens
cacttgcatgtc

SEQ ID NO: 6006479 - DNA, 14 bp, Homo sapiens
cacttgccacatgg

SEQ ID NO: 6006480 - DNA, 15 bp, Homo sapiens
cacttgccagggctc

SEQ ID NO: 6006481 - DNA, 23 bp, Homo sapiens
cacttgccattgccaggagatgg

SEQ ID NO: 6006482 - DNA, 14 bp, Homo sapiens
cacttgcccacacc

SEQ ID NO: 6006483 - DNA, 13 bp, Homo sapiens
cacttgccctgct

SEQ ID NO: 6006484 - DNA, 14 bp, Homo sapiens
cacttgccctgctc

SEQ ID NO: 6006485 - DNA, 12 bp, Homo sapiens
cacttgccctgt

SEQ ID NO: 6006486 - DNA, 13 bp, Homo sapiens
cacttgccctgtg

SEQ ID NO: 6006487 - DNA, 14 bp, Homo sapiens
cacttgccctgtgt

SEQ ID NO: 6006488 - DNA, 18 bp, Homo sapiens
cacttgccctgtgttctt

SEQ ID NO: 6006489 - DNA, 23 bp, Homo sapiens
cacttgccctgtgttctttcccc

SEQ ID NO: 6006490 - DNA, 22 bp, Homo sapiens
cacttgccgcgtcgccctccca

SEQ ID NO: 6006491 - DNA, 14 bp, Homo sapiens
cacttgcctcttcc

SEQ ID NO: 6006492 - DNA, 13 bp, Homo sapiens
caggccgagagcc

SEQ ID NO: 6006493 - DNA, 14 bp, Homo sapiens
caggccgaggcagg

SEQ ID NO: 6006494 - DNA, 21 bp, Homo sapiens
caggccgcaccatttctgtca

SEQ ID NO: 6006495 - DNA, 14 bp, Homo sapiens
caggccgcagctct

SEQ ID NO: 6006496 - DNA, 13 bp, Homo sapiens
caggccgcatggc

SEQ ID NO: 6006497 - DNA, 14 bp, Homo sapiens
caggccgcatggcc

SEQ ID NO: 6006498 - DNA, 18 bp, Homo sapiens
caggccgcatggcccctc

SEQ ID NO: 6006499 - DNA, 16 bp, Homo sapiens
caggccgccccagcct

SEQ ID NO: 6006500 - DNA, 14 bp, Homo sapiens
caggccgccctgcg

SEQ ID NO: 6006501 - DNA, 13 bp, Homo sapiens
caggccgcgccca

SEQ ID NO: 6006502 - DNA, 14 bp, Homo sapiens
caggccgcgcccag

SEQ ID NO: 6006503 - DNA, 15 bp, Homo sapiens
caggccgcgcccagc

SEQ ID NO: 6006504 - DNA, 14 bp, Homo sapiens
caggccggaaccac

SEQ ID NO: 6006505 - DNA, 20 bp, Homo sapiens
caggccggcagccccagcct

SEQ ID NO: 6006506 - DNA, 15 bp, Homo sapiens
caggccggccagcct

SEQ ID NO: 6006507 - DNA, 15 bp, Homo sapiens
caggccggcccagat

SEQ ID NO: 6006508 - DNA, 19 bp, Homo sapiens
caggccggcgagccctgtg

SEQ ID NO: 6006509 - DNA, 13 bp, Homo sapiens
caggccgggaaaa

SEQ ID NO: 6006510 - DNA, 17 bp, Homo sapiens
caggccgggaagagcca

SEQ ID NO: 6006511 - DNA, 21 bp, Homo sapiens
caggccgggaagagccacctg

SEQ ID NO: 6006512 - DNA, 22 bp, Homo sapiens
caggccgggaagagccacctgg

SEQ ID NO: 6006513 - DNA, 23 bp, Homo sapiens
caggccgggaagagccacctggc

SEQ ID NO: 6006514 - DNA, 16 bp, Homo sapiens
caggccgggcacagtg

SEQ ID NO: 6006515 - DNA, 17 bp, Homo sapiens
caggccgggcagagcac

SEQ ID NO: 6006516 - DNA, 13 bp, Homo sapiens
caggccgggcctg

SEQ ID NO: 6006517 - DNA, 22 bp, Homo sapiens
caggccgggcttgggccctgca

SEQ ID NO: 6006518 - DNA, 19 bp, Homo sapiens
caggccgggctttccagaa

SEQ ID NO: 6006519 - DNA, 20 bp, Homo sapiens
caggccggggtggagcatgg

SEQ ID NO: 6006520 - DNA, 18 bp, Homo sapiens
caggccgtcctcccgggc

SEQ ID NO: 6006521 - DNA, 19 bp, Homo sapiens
caggccgtggctgcccaca

SEQ ID NO: 6006522 - DNA, 18 bp, Homo sapiens
caggccgttccccttggc

SEQ ID NO: 6006523 - DNA, 20 bp, Homo sapiens
caggccgttccccttggctt

SEQ ID NO: 6006524 - DNA, 18 bp, Homo sapiens
caggcctacagaaattga

SEQ ID NO: 6006525 - DNA, 20 bp, Homo sapiens
caggcctagaggcctgactg

SEQ ID NO: 6006526 - DNA, 17 bp, Homo sapiens
caggcctaggacctcag

SEQ ID NO: 6006527 - DNA, 20 bp, Homo sapiens
caggcctaggacctcaggcg

SEQ ID NO: 6006528 - DNA, 13 bp, Homo sapiens
caggcctatttca

SEQ ID NO: 6006529 - DNA, 16 bp, Homo sapiens
caggcctatttcatca

SEQ ID NO: 6006530 - DNA, 12 bp, Homo sapiens
caggcctcaagc

SEQ ID NO: 6006531 - DNA, 23 bp, Homo sapiens
caggcctcaagcgtggaggggta

SEQ ID NO: 6006532 - DNA, 15 bp, Homo sapiens
caggcctcaccacct

SEQ ID NO: 6006533 - DNA, 21 bp, Homo sapiens
caggcctcacccctcccctgg

SEQ ID NO: 6006534 - DNA, 17 bp, Homo sapiens
caggcctcacctcccag

SEQ ID NO: 6006535 - DNA, 19 bp, Homo sapiens
caggcctcacctcccaggg

SEQ ID NO: 6006536 - DNA, 17 bp, Homo sapiens
caggcctcacctctacc

SEQ ID NO: 6006537 - DNA, 22 bp, Homo sapiens
caggcctcacctctacccaaac

SEQ ID NO: 6006538 - DNA, 17 bp, Homo sapiens
caggcctcacctggctt

SEQ ID NO: 6006539 - DNA, 18 bp, Homo sapiens
caggcctcacctggcttc

SEQ ID NO: 6006540 - DNA, 22 bp, Homo sapiens
caggcctcacctggcttcccag

SEQ ID NO: 6006541 - DNA, 22 bp, Homo sapiens
caggcctcactggctcatgccc

SEQ ID NO: 6006542 - DNA, 13 bp, Homo sapiens
caggcctcaggga

SEQ ID NO: 6006543 - DNA, 23 bp, Homo sapiens
caggcctcagggaccaaggagat

SEQ ID NO: 6006544 - DNA, 20 bp, Homo sapiens
caggcctccaacgcccctgt

SEQ ID NO: 6006545 - DNA, 22 bp, Homo sapiens
caggcctccaacgcccctgtgg

SEQ ID NO: 6006546 - DNA, 13 bp, Homo sapiens
caggcctccagaa

SEQ ID NO: 6006547 - DNA, 15 bp, Homo sapiens
caggcctccagaacc

SEQ ID NO: 6006548 - DNA, 13 bp, Homo sapiens
caggcctccagcc

SEQ ID NO: 6006549 - DNA, 17 bp, Homo sapiens
caggcctccagcctctc

SEQ ID NO: 6006550 - DNA, 14 bp, Homo sapiens
caggcctccagctc

SEQ ID NO: 6006551 - DNA, 15 bp, Homo sapiens
caggcctccagctca

SEQ ID NO: 6006552 - DNA, 16 bp, Homo sapiens
caggcctccagctcag

SEQ ID NO: 6006553 - DNA, 17 bp, Homo sapiens
caggcctcccaagctga

SEQ ID NO: 6006554 - DNA, 22 bp, Homo sapiens
caggcctcccgcatgctgcctg

SEQ ID NO: 6006555 - DNA, 15 bp, Homo sapiens
caggcctccctcggg

SEQ ID NO: 6006556 - DNA, 15 bp, Homo sapiens
caggcctccctctct

SEQ ID NO: 6006557 - DNA, 16 bp, Homo sapiens
caggcctccctctctc

SEQ ID NO: 6006558 - DNA, 14 bp, Homo sapiens
caggcctccctgca

SEQ ID NO: 6006559 - DNA, 17 bp, Homo sapiens
caggcctccctgccagt

SEQ ID NO: 6006560 - DNA, 15 bp, Homo sapiens
caggcctcctagggg

SEQ ID NO: 6006561 - DNA, 17 bp, Homo sapiens
caggcctcctaggggaa

SEQ ID NO: 6006562 - DNA, 22 bp, Homo sapiens
caggcctcgcacttgcagagga

SEQ ID NO: 6006563 - DNA, 23 bp, Homo sapiens
caggcctcgcacttgcagaggag

SEQ ID NO: 6006564 - DNA, 14 bp, Homo sapiens
caggcctcgcctgc

SEQ ID NO: 6006565 - DNA, 20 bp, Homo sapiens
caggcctcgcctgccctcct

SEQ ID NO: 6006566 - DNA, 22 bp, Homo sapiens
caggcctcgcctgccctcctct

SEQ ID NO: 6006567 - DNA, 20 bp, Homo sapiens
caggcctctagttccagaag

SEQ ID NO: 6006568 - DNA, 17 bp, Homo sapiens
caggcctctccatttgc

SEQ ID NO: 6006569 - DNA, 20 bp, Homo sapiens
caggcctctcggtgctccat

SEQ ID NO: 6006570 - DNA, 17 bp, Homo sapiens
caggcctctctctgctc

SEQ ID NO: 6006571 - DNA, 20 bp, Homo sapiens
caggcctctcttttccccgc

SEQ ID NO: 6006572 - DNA, 15 bp, Homo sapiens
caggcctctgagccc

SEQ ID NO: 6006573 - DNA, 13 bp, Homo sapiens
caggcctctgagg

SEQ ID NO: 6006574 - DNA, 18 bp, Homo sapiens
caggcctctgaggagccc

SEQ ID NO: 6006575 - DNA, 19 bp, Homo sapiens
caggcctctgaggagccca

SEQ ID NO: 6006576 - DNA, 22 bp, Homo sapiens
caggcctctgaggagcccacgg

SEQ ID NO: 6006577 - DNA, 13 bp, Homo sapiens
caggcctctgcag

SEQ ID NO: 6006578 - DNA, 16 bp, Homo sapiens
caggcctctgcagaag

SEQ ID NO: 6006579 - DNA, 13 bp, Homo sapiens
caggcctctgcct

SEQ ID NO: 6006580 - DNA, 21 bp, Homo sapiens
caggcctctgcctgctgggga

SEQ ID NO: 6006581 - DNA, 22 bp, Homo sapiens
caggcctctgctctccgacctc

SEQ ID NO: 6006582 - DNA, 17 bp, Homo sapiens
caggcctctgctggctc

SEQ ID NO: 6006583 - DNA, 20 bp, Homo sapiens
caggcctctgggacccacag

SEQ ID NO: 6006584 - DNA, 18 bp, Homo sapiens
caggcctctggttgcctc

SEQ ID NO: 6006585 - DNA, 20 bp, Homo sapiens
caggcctctggttgcctccc

SEQ ID NO: 6006586 - DNA, 12 bp, Homo sapiens
caggcctctgtg

SEQ ID NO: 6006587 - DNA, 18 bp, Homo sapiens
caggcctcttggcagtca

SEQ ID NO: 6006588 - DNA, 15 bp, Homo sapiens
caggcctgaaagagg

SEQ ID NO: 6006589 - DNA, 22 bp, Homo sapiens
caggcctgaaagaggctgaggc

SEQ ID NO: 6006590 - DNA, 12 bp, Homo sapiens
caggcctgaccc

SEQ ID NO: 6006591 - DNA, 13 bp, Homo sapiens
caggcctgaccca

SEQ ID NO: 6006592 - DNA, 16 bp, Homo sapiens
caggcctgacccacgg

SEQ ID NO: 6006593 - DNA, 16 bp, Homo sapiens
caggcctgagaatgag

SEQ ID NO: 6006594 - DNA, 21 bp, Homo sapiens
caggcctgagaatgagtggga

SEQ ID NO: 6006595 - DNA, 14 bp, Homo sapiens
caggcctgagattt

SEQ ID NO: 6006596 - DNA, 18 bp, Homo sapiens
caggcctgagatttcatc

SEQ ID NO: 6006597 - DNA, 13 bp, Homo sapiens
caggcctgagctg

SEQ ID NO: 6006598 - DNA, 15 bp, Homo sapiens
caggcctgaggctgc

SEQ ID NO: 6006599 - DNA, 16 bp, Homo sapiens
caggcctgaggctgct

SEQ ID NO: 6006600 - DNA, 17 bp, Homo sapiens
caggcctgaggctgctg

SEQ ID NO: 6006601 - DNA, 18 bp, Homo sapiens
caggcctgatcttgcctg

SEQ ID NO: 6006602 - DNA, 22 bp, Homo sapiens
caggcctgattcactggcctgg

SEQ ID NO: 6006603 - DNA, 12 bp, Homo sapiens
caggcctgcagc

SEQ ID NO: 6006604 - DNA, 22 bp, Homo sapiens
caggcctgcagcaggagtggtg

SEQ ID NO: 6006605 - DNA, 16 bp, Homo sapiens
caggcctgcagcccct

SEQ ID NO: 6006606 - DNA, 20 bp, Homo sapiens
caggcctgcagcccctaagt

SEQ ID NO: 6006607 - DNA, 13 bp, Homo sapiens
caggcctgccaat

SEQ ID NO: 6006608 - DNA, 15 bp, Homo sapiens
caggcctgccaatgc

SEQ ID NO: 6006609 - DNA, 20 bp, Homo sapiens
caggcctgccaatgccacag

SEQ ID NO: 6006610 - DNA, 16 bp, Homo sapiens
caggcctgccctcacg

SEQ ID NO: 6006611 - DNA, 12 bp, Homo sapiens
caggcctgcctc

SEQ ID NO: 6006612 - DNA, 14 bp, Homo sapiens
caggcctgcctccc

SEQ ID NO: 6006613 - DNA, 16 bp, Homo sapiens
caggcctgcctcccac

SEQ ID NO: 6006614 - DNA, 18 bp, Homo sapiens
caggcctgcgggcccctg

SEQ ID NO: 6006615 - DNA, 21 bp, Homo sapiens
caggcctgcgggcccctggtg

SEQ ID NO: 6006616 - DNA, 13 bp, Homo sapiens
caggcctgctggc

SEQ ID NO: 6006617 - DNA, 12 bp, Homo sapiens
caggcctggacg

SEQ ID NO: 6006618 - DNA, 14 bp, Homo sapiens
caggcctggacggg

SEQ ID NO: 6006619 - DNA, 19 bp, Homo sapiens
caggcctggacgggccctc

SEQ ID NO: 6006620 - DNA, 11 bp, Homo sapiens
caggcctggcc

SEQ ID NO: 6006621 - DNA, 13 bp, Homo sapiens
caggcctggccca

SEQ ID NO: 6006622 - DNA, 17 bp, Homo sapiens
caggcctggcccagcca

SEQ ID NO: 6006623 - DNA, 22 bp, Homo sapiens
caggcctggcccagccagcagg

SEQ ID NO: 6006624 - DNA, 12 bp, Homo sapiens
caggcctggcct

SEQ ID NO: 6006625 - DNA, 13 bp, Homo sapiens
caggcctggcctc

SEQ ID NO: 6006626 - DNA, 14 bp, Homo sapiens
caggcctggcctca

SEQ ID NO: 6006627 - DNA, 17 bp, Homo sapiens
caggcctggcctcatct

SEQ ID NO: 6006628 - DNA, 23 bp, Homo sapiens
caggcctggcctcgcctgccttt

SEQ ID NO: 6006629 - DNA, 17 bp, Homo sapiens
caggcctggcctctggg

SEQ ID NO: 6006630 - DNA, 18 bp, Homo sapiens
caggcctggcctctgggc

SEQ ID NO: 6006631 - DNA, 15 bp, Homo sapiens
caggcctggctcccc

SEQ ID NO: 6006632 - DNA, 16 bp, Homo sapiens
caggcctggctccccg

SEQ ID NO: 6006633 - DNA, 21 bp, Homo sapiens
caggcctggctggaggagcag

SEQ ID NO: 6006634 - DNA, 18 bp, Homo sapiens
caggcctgggacccagct

SEQ ID NO: 6006635 - DNA, 24 bp, Homo sapiens
caggcctgggacccagctactctg

SEQ ID NO: 6006636 - DNA, 13 bp, Homo sapiens
caggcctgggcag

SEQ ID NO: 6006637 - DNA, 22 bp, Homo sapiens
caggcctgggggctgggcagag

SEQ ID NO: 6006638 - DNA, 22 bp, Homo sapiens
caggcctgggtcacgctcaagg

SEQ ID NO: 6006639 - DNA, 14 bp, Homo sapiens
caggcctgggtctg

SEQ ID NO: 6006640 - DNA, 21 bp, Homo sapiens
caggcctggtggagggggagg

SEQ ID NO: 6006641 - DNA, 17 bp, Homo sapiens
caggcctgtatgaggct

SEQ ID NO: 6006642 - DNA, 19 bp, Homo sapiens
caggcctgtatgaggcttt

SEQ ID NO: 6006643 - DNA, 19 bp, Homo sapiens
caggcctgtcatgattggc

SEQ ID NO: 6006644 - DNA, 15 bp, Homo sapiens
caggcctgtccaaca

SEQ ID NO: 6006645 - DNA, 21 bp, Homo sapiens
caggcctgtccaccctgccaa

SEQ ID NO: 6006646 - DNA, 14 bp, Homo sapiens
caggcctgtccctg

SEQ ID NO: 6006647 - DNA, 16 bp, Homo sapiens
caggcctgtccctggg

SEQ ID NO: 6006648 - DNA, 15 bp, Homo sapiens
caggcctgtgcccac

SEQ ID NO: 6006649 - DNA, 17 bp, Homo sapiens
caggcctgtgcccactc

SEQ ID NO: 6006650 - DNA, 21 bp, Homo sapiens
caggcctgtgcccactcccta

SEQ ID NO: 6006651 - DNA, 16 bp, Homo sapiens
caggcctgtgtagctg

SEQ ID NO: 6006652 - DNA, 23 bp, Homo sapiens
caggcctgtgtagctgtgacctg

SEQ ID NO: 6006653 - DNA, 15 bp, Homo sapiens
caggcctgttccctg

SEQ ID NO: 6006654 - DNA, 13 bp, Homo sapiens
caggcctgttgct

SEQ ID NO: 6006655 - DNA, 23 bp, Homo sapiens
caggcctgttgctatagagccta

SEQ ID NO: 6006656 - DNA, 18 bp, Homo sapiens
caggccttacatctggct

SEQ ID NO: 6006657 - DNA, 20 bp, Homo sapiens
caggccttagtacggctgct

SEQ ID NO: 6006658 - DNA, 23 bp, Homo sapiens
caggccttagtacggctgctgca

SEQ ID NO: 6006659 - DNA, 24 bp, Homo sapiens
caggccttagtacggctgctgcac

SEQ ID NO: 6006660 - DNA, 21 bp, Homo sapiens
caggccttatctgaaaggcca

SEQ ID NO: 6006661 - DNA, 22 bp, Homo sapiens
caggccttatctgaaaggccag

SEQ ID NO: 6006662 - DNA, 19 bp, Homo sapiens
caggccttcctcctctcaa

SEQ ID NO: 6006663 - DNA, 22 bp, Homo sapiens
caggccttctgatttcaaggtc

SEQ ID NO: 6006664 - DNA, 17 bp, Homo sapiens
caggccttctgtggggc

SEQ ID NO: 6006665 - DNA, 17 bp, Homo sapiens
caggccttgctgactct

SEQ ID NO: 6006666 - DNA, 20 bp, Homo sapiens
caggccttgctggggtccag

SEQ ID NO: 6006667 - DNA, 16 bp, Homo sapiens
caggcctttcaggaag

SEQ ID NO: 6006668 - DNA, 16 bp, Homo sapiens
caggcctttgagctca

SEQ ID NO: 6006669 - DNA, 17 bp, Homo sapiens
caggcctttgagctcag

SEQ ID NO: 6006670 - DNA, 18 bp, Homo sapiens
caggcctttggaggggaa

SEQ ID NO: 6006671 - DNA, 18 bp, Homo sapiens
caggcctttttgagccaa

SEQ ID NO: 6006672 - DNA, 20 bp, Homo sapiens
caggcgacaaaatctcctgg

SEQ ID NO: 6006673 - DNA, 16 bp, Homo sapiens
caggcgaccgggcctc

SEQ ID NO: 6006674 - DNA, 15 bp, Homo sapiens
caggcgactggaggc

SEQ ID NO: 6006675 - DNA, 23 bp, Homo sapiens
caggcgactggaggcaggactcc

SEQ ID NO: 6006676 - DNA, 13 bp, Homo sapiens
caggcgagcctga

SEQ ID NO: 6006677 - DNA, 17 bp, Homo sapiens
caggcgagcctgactct

SEQ ID NO: 6006678 - DNA, 18 bp, Homo sapiens
caggcgagcctgactctg

SEQ ID NO: 6006679 - DNA, 15 bp, Homo sapiens
caggcgaggcctgga

SEQ ID NO: 6006680 - DNA, 19 bp, Homo sapiens
caggcgatccacctgtctc

SEQ ID NO: 6006681 - DNA, 20 bp, Homo sapiens
caggcgatccacctgtctca

SEQ ID NO: 6006682 - DNA, 20 bp, Homo sapiens
caggcgatccccgcttcccc

SEQ ID NO: 6006683 - DNA, 23 bp, Homo sapiens
caggcgcaagggaggcccagcgc

SEQ ID NO: 6006684 - DNA, 14 bp, Homo sapiens
caggcgcacaccac

SEQ ID NO: 6006685 - DNA, 15 bp, Homo sapiens
caggcgcagaggtcc

SEQ ID NO: 6006686 - DNA, 20 bp, Homo sapiens
caggcgcagaggtcccagcc

SEQ ID NO: 6006687 - DNA, 15 bp, Homo sapiens
caggcgcagccctag

SEQ ID NO: 6006688 - DNA, 13 bp, Homo sapiens
caggcgcatgtct

SEQ ID NO: 6006689 - DNA, 13 bp, Homo sapiens
caggcgccgcctc

SEQ ID NO: 6006690 - DNA, 16 bp, Homo sapiens
caggcgccgcctcgcc

SEQ ID NO: 6006691 - DNA, 20 bp, Homo sapiens
caggcgcctggcacatttca

SEQ ID NO: 6006692 - DNA, 13 bp, Homo sapiens
caggcgcgcaccg

SEQ ID NO: 6006693 - DNA, 14 bp, Homo sapiens
caggcgcgcaccgc

SEQ ID NO: 6006694 - DNA, 15 bp, Homo sapiens
caggcgcgcaccgcc

SEQ ID NO: 6006695 - DNA, 22 bp, Homo sapiens
caggcgcgcaccgcccaacccc

SEQ ID NO: 6006696 - DNA, 23 bp, Homo sapiens
caggcgcgcaccgcccaaccccc

SEQ ID NO: 6006697 - DNA, 21 bp, Homo sapiens
caggcgcggtggctcacgcct

SEQ ID NO: 6006698 - DNA, 14 bp, Homo sapiens
caggcgctccaggc

SEQ ID NO: 6006699 - DNA, 17 bp, Homo sapiens
caggcgctgagtatgga

SEQ ID NO: 6006700 - DNA, 17 bp, Homo sapiens
caggcgctggacagagg

SEQ ID NO: 6006701 - DNA, 23 bp, Homo sapiens
caggcgctggacagaggggcagg

SEQ ID NO: 6006702 - DNA, 18 bp, Homo sapiens
caggcgctgggggctgga

SEQ ID NO: 6006703 - DNA, 15 bp, Homo sapiens
caggcgctgtgctat

SEQ ID NO: 6006704 - DNA, 15 bp, Homo sapiens
caggcggaggggctt

SEQ ID NO: 6006705 - DNA, 19 bp, Homo sapiens
caggcggaggggcttggag

SEQ ID NO: 6006706 - DNA, 21 bp, Homo sapiens
caggcggaggggcttggagca

SEQ ID NO: 6006707 - DNA, 23 bp, Homo sapiens
caggcggaggggcttggagcaga

SEQ ID NO: 6006708 - DNA, 15 bp, Homo sapiens
caggcggccagggcg

SEQ ID NO: 6006709 - DNA, 13 bp, Homo sapiens
caggcggccctca

SEQ ID NO: 6006710 - DNA, 17 bp, Homo sapiens
caggcggccctggggag

SEQ ID NO: 6006711 - DNA, 18 bp, Homo sapiens
caggcggctcctcctcac

SEQ ID NO: 6006712 - DNA, 19 bp, Homo sapiens
caggcgggacagtgctgca

SEQ ID NO: 6006713 - DNA, 19 bp, Homo sapiens
caggcgggagatggacccc

SEQ ID NO: 6006714 - DNA, 15 bp, Homo sapiens
caggcgggcaagtca

SEQ ID NO: 6006715 - DNA, 18 bp, Homo sapiens
caggcgggcccagaccgg

SEQ ID NO: 6006716 - DNA, 18 bp, Homo sapiens
caggcgggccggggcagg

SEQ ID NO: 6006717 - DNA, 14 bp, Homo sapiens
caggcgggcgagcc

SEQ ID NO: 6006718 - DNA, 16 bp, Homo sapiens
caggcgggctcctttg

SEQ ID NO: 6006719 - DNA, 18 bp, Homo sapiens
caggcgggctcggaggct

SEQ ID NO: 6006720 - DNA, 13 bp, Homo sapiens
caggcggggagga

SEQ ID NO: 6006721 - DNA, 22 bp, Homo sapiens
caggcggggaggaggagctgcc

SEQ ID NO: 6006722 - DNA, 19 bp, Homo sapiens
caggcggggcgccccaaga

SEQ ID NO: 6006723 - DNA, 23 bp, Homo sapiens
caggcggggcgccccaagagccc

SEQ ID NO: 6006724 - DNA, 21 bp, Homo sapiens
caggcggggggggcgcctgga

SEQ ID NO: 6006725 - DNA, 24 bp, Homo sapiens
caggcggggggttgtctcagccga

SEQ ID NO: 6006726 - DNA, 18 bp, Homo sapiens
caggcggggtgctgtggt

SEQ ID NO: 6006727 - DNA, 15 bp, Homo sapiens
caggcggtatccaga

SEQ ID NO: 6006728 - DNA, 17 bp, Homo sapiens
caggcggtatccagagg

SEQ ID NO: 6006729 - DNA, 19 bp, Homo sapiens
caggcggtatccagaggtg

SEQ ID NO: 6006730 - DNA, 18 bp, Homo sapiens
caggcggtccccatcccc

SEQ ID NO: 6006731 - DNA, 23 bp, Homo sapiens
caggcggtccccatccccaccag

SEQ ID NO: 6006732 - DNA, 21 bp, Homo sapiens
caggcggtgggcacccaccct

SEQ ID NO: 6006733 - DNA, 22 bp, Homo sapiens
caggcgtagatcaccagaataa

SEQ ID NO: 6006734 - DNA, 16 bp, Homo sapiens
caggcgtctgccacca

SEQ ID NO: 6006735 - DNA, 19 bp, Homo sapiens
caggcgtgactcagcagcc

SEQ ID NO: 6006736 - DNA, 16 bp, Homo sapiens
caggcgtgagccacca

SEQ ID NO: 6006737 - DNA, 15 bp, Homo sapiens
caggcgtgagccact

SEQ ID NO: 6006738 - DNA, 15 bp, Homo sapiens
caggcgtgtggcagc

SEQ ID NO: 6006739 - DNA, 22 bp, Homo sapiens
caggcgtgtggcagccacacgc

SEQ ID NO: 6006740 - DNA, 16 bp, Homo sapiens
caggcgttctcagcct

SEQ ID NO: 6006741 - DNA, 15 bp, Homo sapiens
caggcgttggtgcca

SEQ ID NO: 6006742 - DNA, 20 bp, Homo sapiens
caggcgttggtgccacttct

SEQ ID NO: 6006743 - DNA, 17 bp, Homo sapiens
caggctaagaccctgtg

SEQ ID NO: 6006744 - DNA, 16 bp, Homo sapiens
caggctaatacaggaa

SEQ ID NO: 6006745 - DNA, 22 bp, Homo sapiens
caggctaatttttttgtatttt

SEQ ID NO: 6006746 - DNA, 13 bp, Homo sapiens
caggctacactga

SEQ ID NO: 6006747 - DNA, 20 bp, Homo sapiens
caggctacactgacactggt

SEQ ID NO: 6006748 - DNA, 21 bp, Homo sapiens
caggctacaggtgccccacct

SEQ ID NO: 6006749 - DNA, 17 bp, Homo sapiens
caggctacagttgatat

SEQ ID NO: 6006750 - DNA, 18 bp, Homo sapiens
caggctacagttgatatt

SEQ ID NO: 6006751 - DNA, 15 bp, Homo sapiens
caggctaccccttca

SEQ ID NO: 6006752 - DNA, 14 bp, Homo sapiens
caggctactagaat

SEQ ID NO: 6006753 - DNA, 16 bp, Homo sapiens
caggctagactaggag

SEQ ID NO: 6006754 - DNA, 18 bp, Homo sapiens
caggctagatccccggtg

SEQ ID NO: 6006755 - DNA, 16 bp, Homo sapiens
caggctagccctgccc

SEQ ID NO: 6006756 - DNA, 18 bp, Homo sapiens
caggctagctggagcctg

SEQ ID NO: 6006757 - DNA, 14 bp, Homo sapiens
caggctaggccagc

SEQ ID NO: 6006758 - DNA, 17 bp, Homo sapiens
caggctaggccagcagg

SEQ ID NO: 6006759 - DNA, 20 bp, Homo sapiens
caggctaggccagcaggggc

SEQ ID NO: 6006760 - DNA, 19 bp, Homo sapiens
caggctatcatatatactg

SEQ ID NO: 6006761 - DNA, 23 bp, Homo sapiens
caggctatggttgccaccccaac

SEQ ID NO: 6006762 - DNA, 13 bp, Homo sapiens
caggctattattt

SEQ ID NO: 6006763 - DNA, 15 bp, Homo sapiens
caggctcacaactgt

SEQ ID NO: 6006764 - DNA, 20 bp, Homo sapiens
caggctcactcacagagtca

SEQ ID NO: 6006765 - DNA, 14 bp, Homo sapiens
caggctcactgcca

SEQ ID NO: 6006766 - DNA, 15 bp, Homo sapiens
caggctcagactctg

SEQ ID NO: 6006767 - DNA, 11 bp, Homo sapiens
caggctcagag

SEQ ID NO: 6006768 - DNA, 18 bp, Homo sapiens
caggctcagcatgcagaa

SEQ ID NO: 6006769 - DNA, 13 bp, Homo sapiens
caggctcaggaga

SEQ ID NO: 6006770 - DNA, 15 bp, Homo sapiens
caggctcaggagaag

SEQ ID NO: 6006771 - DNA, 14 bp, Homo sapiens
caggctcaggcagg

SEQ ID NO: 6006772 - DNA, 19 bp, Homo sapiens
caggctcaggcaggggcct

SEQ ID NO: 6006773 - DNA, 18 bp, Homo sapiens
caggctcaggctgcccag

SEQ ID NO: 6006774 - DNA, 22 bp, Homo sapiens
caggctcatgccatcatgccca

SEQ ID NO: 6006775 - DNA, 14 bp, Homo sapiens
caggctccaagagg

SEQ ID NO: 6006776 - DNA, 16 bp, Homo sapiens
caggctccaagaggct

SEQ ID NO: 6006777 - DNA, 17 bp, Homo sapiens
caggctccaagaggctg

SEQ ID NO: 6006778 - DNA, 15 bp, Homo sapiens
caggctccagcacat

SEQ ID NO: 6006779 - DNA, 16 bp, Homo sapiens
caggctccagcacatc

SEQ ID NO: 6006780 - DNA, 18 bp, Homo sapiens
caggctccaggctgactg

SEQ ID NO: 6006781 - DNA, 13 bp, Homo sapiens
caggctccatgca

SEQ ID NO: 6006782 - DNA, 17 bp, Homo sapiens
caggctccatgcacctc

SEQ ID NO: 6006783 - DNA, 18 bp, Homo sapiens
caggctccatgcacctcc

SEQ ID NO: 6006784 - DNA, 15 bp, Homo sapiens
caggctcccaggagc

SEQ ID NO: 6006785 - DNA, 23 bp, Homo sapiens
caggctcccaggagcctgcccag

SEQ ID NO: 6006786 - DNA, 16 bp, Homo sapiens
caggctcccagggaca

SEQ ID NO: 6006787 - DNA, 12 bp, Homo sapiens
caggctccccag

SEQ ID NO: 6006788 - DNA, 13 bp, Homo sapiens
caggctccccaga

SEQ ID NO: 6006789 - DNA, 18 bp, Homo sapiens
caggctccccagaactgg

SEQ ID NO: 6006790 - DNA, 23 bp, Homo sapiens
caggctccccagaactggctggg

SEQ ID NO: 6006791 - DNA, 14 bp, Homo sapiens
caggctcccctgag

SEQ ID NO: 6006792 - DNA, 16 bp, Homo sapiens
caggctcccctgagga

SEQ ID NO: 6006793 - DNA, 16 bp, Homo sapiens
caggctcccctgcccg

SEQ ID NO: 6006794 - DNA, 17 bp, Homo sapiens
caggctcccctgcccgc

SEQ ID NO: 6006795 - DNA, 13 bp, Homo sapiens
caggctcccctgg

SEQ ID NO: 6006796 - DNA, 16 bp, Homo sapiens
caggctcccctggtct

SEQ ID NO: 6006797 - DNA, 18 bp, Homo sapiens
caggctcccgaccccatc

SEQ ID NO: 6006798 - DNA, 20 bp, Homo sapiens
caggctccctccctcccaga

SEQ ID NO: 6006799 - DNA, 12 bp, Homo sapiens
caggctccctga

SEQ ID NO: 6006800 - DNA, 18 bp, Homo sapiens
caggctccctgaccaccc

SEQ ID NO: 6006801 - DNA, 20 bp, Homo sapiens
caggctccctttctcttctt

SEQ ID NO: 6006802 - DNA, 18 bp, Homo sapiens
caggctcctaaagagaca

SEQ ID NO: 6006803 - DNA, 23 bp, Homo sapiens
caggctcctacctgtctgctgcc

SEQ ID NO: 6006804 - DNA, 14 bp, Homo sapiens
caggctcctcagcc

SEQ ID NO: 6006805 - DNA, 21 bp, Homo sapiens
caggctcctccctccctctgc

SEQ ID NO: 6006806 - DNA, 16 bp, Homo sapiens
caggctcctgccacca

SEQ ID NO: 6006807 - DNA, 15 bp, Homo sapiens
caggctcctgtgata

SEQ ID NO: 6006808 - DNA, 13 bp, Homo sapiens
caggctccttcct

SEQ ID NO: 6006809 - DNA, 19 bp, Homo sapiens
caggctcctttagcgccca

SEQ ID NO: 6006810 - DNA, 20 bp, Homo sapiens
caggctcctttagcgcccag

SEQ ID NO: 6006811 - DNA, 16 bp, Homo sapiens
caggctcgccaaggcc

SEQ ID NO: 6006812 - DNA, 17 bp, Homo sapiens
caggctcgccaaggcct

SEQ ID NO: 6006813 - DNA, 15 bp, Homo sapiens
caggctcggcctgcc

SEQ ID NO: 6006814 - DNA, 14 bp, Homo sapiens
caggctcgtcagcc

SEQ ID NO: 6006815 - DNA, 21 bp, Homo sapiens
caggctcgtcagccacctggg

SEQ ID NO: 6006816 - DNA, 15 bp, Homo sapiens
caggctctagagaga

SEQ ID NO: 6006817 - DNA, 16 bp, Homo sapiens
caggctctagagagag

SEQ ID NO: 6006818 - DNA, 20 bp, Homo sapiens
caggctctagagagagggag

SEQ ID NO: 6006819 - DNA, 12 bp, Homo sapiens
caggctctcagg

SEQ ID NO: 6006820 - DNA, 13 bp, Homo sapiens
caggctctcaggc

SEQ ID NO: 6006821 - DNA, 19 bp, Homo sapiens
caggctctcaggccagctg

SEQ ID NO: 6006822 - DNA, 12 bp, Homo sapiens
caggctctccct

SEQ ID NO: 6006823 - DNA, 14 bp, Homo sapiens
caggctctccctct

SEQ ID NO: 6006824 - DNA, 12 bp, Homo sapiens
caggctctcctg

SEQ ID NO: 6006825 - DNA, 14 bp, Homo sapiens
caggctctcctggc

SEQ ID NO: 6006826 - DNA, 15 bp, Homo sapiens
caggctctcctggct

SEQ ID NO: 6006827 - DNA, 16 bp, Homo sapiens
caggctctctgggctg

SEQ ID NO: 6006828 - DNA, 12 bp, Homo sapiens
caggctctgaga

SEQ ID NO: 6006829 - DNA, 13 bp, Homo sapiens
caggctctgagat

SEQ ID NO: 6006830 - DNA, 11 bp, Homo sapiens
caggctctgca

SEQ ID NO: 6006831 - DNA, 12 bp, Homo sapiens
caggctctgcac

SEQ ID NO: 6006832 - DNA, 12 bp, Homo sapiens
caggctctgccc

SEQ ID NO: 6006833 - DNA, 15 bp, Homo sapiens
caggctctgcccagg

SEQ ID NO: 6006834 - DNA, 21 bp, Homo sapiens
caggctctgccctgccctagc

SEQ ID NO: 6006835 - DNA, 16 bp, Homo sapiens
caggctctgcctggag

SEQ ID NO: 6006836 - DNA, 13 bp, Homo sapiens
caggctctggccc

SEQ ID NO: 6006837 - DNA, 12 bp, Homo sapiens
caggctctgggc

SEQ ID NO: 6006838 - DNA, 13 bp, Homo sapiens
caggctctgggct

SEQ ID NO: 6006839 - DNA, 15 bp, Homo sapiens
caggctctgggctca

SEQ ID NO: 6006840 - DNA, 16 bp, Homo sapiens
caggctctgggctcag

SEQ ID NO: 6006841 - DNA, 21 bp, Homo sapiens
caggctctgggctcagggctg

SEQ ID NO: 6006842 - DNA, 22 bp, Homo sapiens
caggctctgggctcagggctgg

SEQ ID NO: 6006843 - DNA, 23 bp, Homo sapiens
caggctctgggctcagggctgga

SEQ ID NO: 6006844 - DNA, 15 bp, Homo sapiens
caggctctgtgctga

SEQ ID NO: 6006845 - DNA, 15 bp, Homo sapiens
caggctctgttcctc

SEQ ID NO: 6006846 - DNA, 21 bp, Homo sapiens
caggctcttagcagcttccag

SEQ ID NO: 6006847 - DNA, 18 bp, Homo sapiens
caggctcttcctggacct

SEQ ID NO: 6006848 - DNA, 21 bp, Homo sapiens
caggctcttcctggacctgag

SEQ ID NO: 6006849 - DNA, 12 bp, Homo sapiens
caggctcttctt

SEQ ID NO: 6006850 - DNA, 17 bp, Homo sapiens
caggctcttctttccca

SEQ ID NO: 6006851 - DNA, 18 bp, Homo sapiens
caggctcttctttcccaa

SEQ ID NO: 6006852 - DNA, 12 bp, Homo sapiens
cacttgcctgga

SEQ ID NO: 6006853 - DNA, 14 bp, Homo sapiens
cacttgcctggaat

SEQ ID NO: 6006854 - DNA, 23 bp, Homo sapiens
cacttgcctggaataaaatataa

SEQ ID NO: 6006855 - DNA, 14 bp, Homo sapiens
cacttgcctggggc

SEQ ID NO: 6006856 - DNA, 13 bp, Homo sapiens
cacttgcctgggt

SEQ ID NO: 6006857 - DNA, 15 bp, Homo sapiens
cacttgcctgtcacc

SEQ ID NO: 6006858 - DNA, 16 bp, Homo sapiens
cacttgcctgtcaccc

SEQ ID NO: 6006859 - DNA, 19 bp, Homo sapiens
cacttgcctgttggctgct

SEQ ID NO: 6006860 - DNA, 20 bp, Homo sapiens
cacttgcctgttggctgctg

SEQ ID NO: 6006861 - DNA, 12 bp, Homo sapiens
cacttgccttag

SEQ ID NO: 6006862 - DNA, 16 bp, Homo sapiens
cacttgcgtcctgcag

SEQ ID NO: 6006863 - DNA, 17 bp, Homo sapiens
cacttgcgtcctgcaga

SEQ ID NO: 6006864 - DNA, 20 bp, Homo sapiens
cacttgctcagacgagacac

SEQ ID NO: 6006865 - DNA, 15 bp, Homo sapiens
cacttgctgagtgaa

SEQ ID NO: 6006866 - DNA, 14 bp, Homo sapiens
cacttgctggggct

SEQ ID NO: 6006867 - DNA, 15 bp, Homo sapiens
cacttgctggggctc

SEQ ID NO: 6006868 - DNA, 14 bp, Homo sapiens
cacttggaaaggtt

SEQ ID NO: 6006869 - DNA, 18 bp, Homo sapiens
cacttggactcttgctct

SEQ ID NO: 6006870 - DNA, 23 bp, Homo sapiens
cacttggagatctttgcttcctt

SEQ ID NO: 6006871 - DNA, 12 bp, Homo sapiens
cacttggagccc

SEQ ID NO: 6006872 - DNA, 23 bp, Homo sapiens
cacttggagcgtttttgctggct

SEQ ID NO: 6006873 - DNA, 14 bp, Homo sapiens
cacttggcagcctt

SEQ ID NO: 6006874 - DNA, 15 bp, Homo sapiens
cacttggcatacaaa

SEQ ID NO: 6006875 - DNA, 17 bp, Homo sapiens
cacttggcatacaaaat

SEQ ID NO: 6006876 - DNA, 15 bp, Homo sapiens
cacttggccagtttt

SEQ ID NO: 6006877 - DNA, 14 bp, Homo sapiens
cacttggcctcagc

SEQ ID NO: 6006878 - DNA, 19 bp, Homo sapiens
cacttggcctcagctggct

SEQ ID NO: 6006879 - DNA, 17 bp, Homo sapiens
cacttggcctcatgctg

SEQ ID NO: 6006880 - DNA, 19 bp, Homo sapiens
cacttggctgtctgaccag

SEQ ID NO: 6006881 - DNA, 22 bp, Homo sapiens
cacttggctgtctgaccagaga

SEQ ID NO: 6006882 - DNA, 19 bp, Homo sapiens
cacttgggagctgctgggc

SEQ ID NO: 6006883 - DNA, 20 bp, Homo sapiens
cacttgggagctgctgggct

SEQ ID NO: 6006884 - DNA, 20 bp, Homo sapiens
cacttgggcacggaaatgca

SEQ ID NO: 6006885 - DNA, 17 bp, Homo sapiens
cacttgggctctctcta

SEQ ID NO: 6006886 - DNA, 20 bp, Homo sapiens
cacttgggctctctctagct

SEQ ID NO: 6006887 - DNA, 20 bp, Homo sapiens
cacttgggctggcacccact

SEQ ID NO: 6006888 - DNA, 20 bp, Homo sapiens
cacttgggggctcagcaagg

SEQ ID NO: 6006889 - DNA, 15 bp, Homo sapiens
cacttgggtctctgg

SEQ ID NO: 6006890 - DNA, 19 bp, Homo sapiens
cacttggtaattgtactaa

SEQ ID NO: 6006891 - DNA, 15 bp, Homo sapiens
cacttggtctgtgag

SEQ ID NO: 6006892 - DNA, 20 bp, Homo sapiens
cacttggtgatatgtcctat

SEQ ID NO: 6006893 - DNA, 14 bp, Homo sapiens
cacttggtgctgct

SEQ ID NO: 6006894 - DNA, 15 bp, Homo sapiens
cacttggtgctggga

SEQ ID NO: 6006895 - DNA, 17 bp, Homo sapiens
cacttggttagacgcct

SEQ ID NO: 6006896 - DNA, 21 bp, Homo sapiens
cacttggttgggtcctcacat

SEQ ID NO: 6006897 - DNA, 12 bp, Homo sapiens
cacttgtaaata

SEQ ID NO: 6006898 - DNA, 16 bp, Homo sapiens
cacttgtaaataaata

SEQ ID NO: 6006899 - DNA, 20 bp, Homo sapiens
cacttgtaactcaccgtgct

SEQ ID NO: 6006900 - DNA, 14 bp, Homo sapiens
cacttgtaattaga

SEQ ID NO: 6006901 - DNA, 14 bp, Homo sapiens
cacttgtacaatta

SEQ ID NO: 6006902 - DNA, 14 bp, Homo sapiens
cacttgtagatttg

SEQ ID NO: 6006903 - DNA, 23 bp, Homo sapiens
cacttgtaggataagtgaaatgg

SEQ ID NO: 6006904 - DNA, 20 bp, Homo sapiens
cacttgtaggtttctctgcc

SEQ ID NO: 6006905 - DNA, 19 bp, Homo sapiens
cacttgtataaatgtatat

SEQ ID NO: 6006906 - DNA, 16 bp, Homo sapiens
cacttgtatatacgca

SEQ ID NO: 6006907 - DNA, 19 bp, Homo sapiens
cacttgtatcctctggttc

SEQ ID NO: 6006908 - DNA, 10 bp, Homo sapiens
cacttgtatt

SEQ ID NO: 6006909 - DNA, 16 bp, Homo sapiens
cacttgtattgacttt

SEQ ID NO: 6006910 - DNA, 17 bp, Homo sapiens
cacttgtattgacttta

SEQ ID NO: 6006911 - DNA, 11 bp, Homo sapiens
cacttgtattt

SEQ ID NO: 6006912 - DNA, 14 bp, Homo sapiens
cacttgtatttaat

SEQ ID NO: 6006913 - DNA, 14 bp, Homo sapiens
cacttgtcaaagaa

SEQ ID NO: 6006914 - DNA, 14 bp, Homo sapiens
cacttgtccagctg

SEQ ID NO: 6006915 - DNA, 16 bp, Homo sapiens
cacttgtccatgtgaa

SEQ ID NO: 6006916 - DNA, 20 bp, Homo sapiens
cacttgtccccaaatccgaa

SEQ ID NO: 6006917 - DNA, 17 bp, Homo sapiens
cacttgtcctcttgcca

SEQ ID NO: 6006918 - DNA, 20 bp, Homo sapiens
cacttgtcctcttgccagct

SEQ ID NO: 6006919 - DNA, 21 bp, Homo sapiens
cacttgtcctcttgccagctc

SEQ ID NO: 6006920 - DNA, 22 bp, Homo sapiens
cacttgtccttagcctggacct

SEQ ID NO: 6006921 - DNA, 12 bp, Homo sapiens
cacttgtctcag

SEQ ID NO: 6006922 - DNA, 22 bp, Homo sapiens
cacttgtctcattttaatgtaa

SEQ ID NO: 6006923 - DNA, 12 bp, Homo sapiens
cacttgtctcct

SEQ ID NO: 6006924 - DNA, 12 bp, Homo sapiens
cacttgtgaata

SEQ ID NO: 6006925 - DNA, 14 bp, Homo sapiens
cacttgtgactttt

SEQ ID NO: 6006926 - DNA, 17 bp, Homo sapiens
cacttgtgccagcccgg

SEQ ID NO: 6006927 - DNA, 18 bp, Homo sapiens
cacttgtgctttgctctt

SEQ ID NO: 6006928 - DNA, 17 bp, Homo sapiens
cacttgtggaatatgtt

SEQ ID NO: 6006929 - DNA, 20 bp, Homo sapiens
cacttgtggaatatgttacc

SEQ ID NO: 6006930 - DNA, 14 bp, Homo sapiens
cacttgtgggcttc

SEQ ID NO: 6006931 - DNA, 22 bp, Homo sapiens
cacttgtgggtttttgttttgt

SEQ ID NO: 6006932 - DNA, 22 bp, Homo sapiens
cacttgtgtgtgtacctgtggc

SEQ ID NO: 6006933 - DNA, 23 bp, Homo sapiens
cacttgtgtgtgtacctgtggct

SEQ ID NO: 6006934 - DNA, 16 bp, Homo sapiens
cacttgttatattata

SEQ ID NO: 6006935 - DNA, 20 bp, Homo sapiens
cacttgttcaacagtttctc

SEQ ID NO: 6006936 - DNA, 22 bp, Homo sapiens
cacttgttcaacagtttctcaa

SEQ ID NO: 6006937 - DNA, 18 bp, Homo sapiens
cacttgttcattctgtga

SEQ ID NO: 6006938 - DNA, 15 bp, Homo sapiens
cacttgttccagctc

SEQ ID NO: 6006939 - DNA, 17 bp, Homo sapiens
cacttgttccagctctt

SEQ ID NO: 6006940 - DNA, 15 bp, Homo sapiens
cacttgttccttctg

SEQ ID NO: 6006941 - DNA, 22 bp, Homo sapiens
cacttgttccttctgcttctcc

SEQ ID NO: 6006942 - DNA, 13 bp, Homo sapiens
cacttgtttcttg

SEQ ID NO: 6006943 - DNA, 16 bp, Homo sapiens
cacttgtttgcactgt

SEQ ID NO: 6006944 - DNA, 17 bp, Homo sapiens
cacttgtttgcactgtg

SEQ ID NO: 6006945 - DNA, 20 bp, Homo sapiens
cacttgttttctttgtttct

SEQ ID NO: 6006946 - DNA, 22 bp, Homo sapiens
cactttaaaaaattttttgatt

SEQ ID NO: 6006947 - DNA, 13 bp, Homo sapiens
cactttaaacctg

SEQ ID NO: 6006948 - DNA, 16 bp, Homo sapiens
cactttaaagaggctg

SEQ ID NO: 6006949 - DNA, 15 bp, Homo sapiens
cactttaaagtcttt

SEQ ID NO: 6006950 - DNA, 16 bp, Homo sapiens
cactttaaccctctct

SEQ ID NO: 6006951 - DNA, 18 bp, Homo sapiens
cactttaagagagaaatc

SEQ ID NO: 6006952 - DNA, 17 bp, Homo sapiens
cactttaataataaaaa

SEQ ID NO: 6006953 - DNA, 12 bp, Homo sapiens
cactttaatgat

SEQ ID NO: 6006954 - DNA, 20 bp, Homo sapiens
cactttaatggcctggaggg

SEQ ID NO: 6006955 - DNA, 22 bp, Homo sapiens
cactttaattctcatgtgatcc

SEQ ID NO: 6006956 - DNA, 14 bp, Homo sapiens
cactttaattgaag

SEQ ID NO: 6006957 - DNA, 14 bp, Homo sapiens
cactttaatttaga

SEQ ID NO: 6006958 - DNA, 21 bp, Homo sapiens
cactttacaatgttcatccca

SEQ ID NO: 6006959 - DNA, 17 bp, Homo sapiens
cactttacagatgagga

SEQ ID NO: 6006960 - DNA, 16 bp, Homo sapiens
cactttacattcttgc

SEQ ID NO: 6006961 - DNA, 17 bp, Homo sapiens
cactttacccacctaga

SEQ ID NO: 6006962 - DNA, 13 bp, Homo sapiens
cactttacctctt

SEQ ID NO: 6006963 - DNA, 20 bp, Homo sapiens
cactttacctgcaggctcca

SEQ ID NO: 6006964 - DNA, 21 bp, Homo sapiens
cactttactttcaagtaatat

SEQ ID NO: 6006965 - DNA, 17 bp, Homo sapiens
cactttagaaagccagc

SEQ ID NO: 6006966 - DNA, 16 bp, Homo sapiens
cactttagacattttt

SEQ ID NO: 6006967 - DNA, 21 bp, Homo sapiens
cactttagaggcttgatcatg

SEQ ID NO: 6006968 - DNA, 18 bp, Homo sapiens
cactttagagtgactaaa

SEQ ID NO: 6006969 - DNA, 15 bp, Homo sapiens
cactttagatgctga

SEQ ID NO: 6006970 - DNA, 23 bp, Homo sapiens
cactttagggctgtaaaatgcat

SEQ ID NO: 6006971 - DNA, 19 bp, Homo sapiens
cactttagtgattgctttt

SEQ ID NO: 6006972 - DNA, 19 bp, Homo sapiens
cactttatggtaagtagca

SEQ ID NO: 6006973 - DNA, 16 bp, Homo sapiens
cactttattctcctcc

SEQ ID NO: 6006974 - DNA, 22 bp, Homo sapiens
cactttattgtagaaaaaccca

SEQ ID NO: 6006975 - DNA, 15 bp, Homo sapiens
cactttatttacttc

SEQ ID NO: 6006976 - DNA, 21 bp, Homo sapiens
cactttcaagaatcagacagc

SEQ ID NO: 6006977 - DNA, 17 bp, Homo sapiens
cactttcacatagatgt

SEQ ID NO: 6006978 - DNA, 13 bp, Homo sapiens
cactttcagctgt

SEQ ID NO: 6006979 - DNA, 16 bp, Homo sapiens
cactttcagctgtctt

SEQ ID NO: 6006980 - DNA, 17 bp, Homo sapiens
cactttcagctgtcttt

SEQ ID NO: 6006981 - DNA, 15 bp, Homo sapiens
cactttcatgcagtg

SEQ ID NO: 6006982 - DNA, 22 bp, Homo sapiens
cactttcatgcagtgctctttg

SEQ ID NO: 6006983 - DNA, 14 bp, Homo sapiens
cactttcattgcca

SEQ ID NO: 6006984 - DNA, 17 bp, Homo sapiens
cactttcattgccagtg

SEQ ID NO: 6006985 - DNA, 21 bp, Homo sapiens
cactttcattgccagtgtctt

SEQ ID NO: 6006986 - DNA, 12 bp, Homo sapiens
cactttcatttt

SEQ ID NO: 6006987 - DNA, 14 bp, Homo sapiens
cactttcatttttg

SEQ ID NO: 6006988 - DNA, 20 bp, Homo sapiens
cactttccaatgccacagac

SEQ ID NO: 6006989 - DNA, 21 bp, Homo sapiens
cactttccaatgccacagaca

SEQ ID NO: 6006990 - DNA, 12 bp, Homo sapiens
cactttccactt

SEQ ID NO: 6006991 - DNA, 13 bp, Homo sapiens
cactttccacttc

SEQ ID NO: 6006992 - DNA, 17 bp, Homo sapiens
cactttccacttccaga

SEQ ID NO: 6006993 - DNA, 19 bp, Homo sapiens
cactttccatctctgcctg

SEQ ID NO: 6006994 - DNA, 13 bp, Homo sapiens
cactttcccacac

SEQ ID NO: 6006995 - DNA, 17 bp, Homo sapiens
cactttcccacactgtg

SEQ ID NO: 6006996 - DNA, 18 bp, Homo sapiens
cactttcccacactgtga

SEQ ID NO: 6006997 - DNA, 14 bp, Homo sapiens
cactttccctagaa

SEQ ID NO: 6006998 - DNA, 15 bp, Homo sapiens
cactttcctcctggc

SEQ ID NO: 6006999 - DNA, 14 bp, Homo sapiens
cactttcctctctc

SEQ ID NO: 6007000 - DNA, 13 bp, Homo sapiens
cactttcctgagc

SEQ ID NO: 6007001 - DNA, 14 bp, Homo sapiens
cactttcctgagct

SEQ ID NO: 6007002 - DNA, 18 bp, Homo sapiens
cactttcctggataaaaa

SEQ ID NO: 6007003 - DNA, 19 bp, Homo sapiens
cactttcctttcaataaag

SEQ ID NO: 6007004 - DNA, 21 bp, Homo sapiens
cactttccttttcttgtctct

SEQ ID NO: 6007005 - DNA, 23 bp, Homo sapiens
cactttccttttcttgtctctga

SEQ ID NO: 6007006 - DNA, 14 bp, Homo sapiens
cactttcgcctcct

SEQ ID NO: 6007007 - DNA, 19 bp, Homo sapiens
cactttcgcctcctccagc

SEQ ID NO: 6007008 - DNA, 20 bp, Homo sapiens
cactttcgcctcctccagct

SEQ ID NO: 6007009 - DNA, 24 bp, Homo sapiens
cactttcgcctcctccagctcctg

SEQ ID NO: 6007010 - DNA, 18 bp, Homo sapiens
cactttctaatgtttctg

SEQ ID NO: 6007011 - DNA, 19 bp, Homo sapiens
cactttctacaatgtgaac

SEQ ID NO: 6007012 - DNA, 18 bp, Homo sapiens
cactttctagccagagga

SEQ ID NO: 6007013 - DNA, 22 bp, Homo sapiens
cactttctagccagaggagaga

SEQ ID NO: 6007014 - DNA, 19 bp, Homo sapiens
cactttctcaggcttctca

SEQ ID NO: 6007015 - DNA, 11 bp, Homo sapiens
cactttctctt

SEQ ID NO: 6007016 - DNA, 13 bp, Homo sapiens
cactttctgctgg

SEQ ID NO: 6007017 - DNA, 14 bp, Homo sapiens
cactttctggcaaa

SEQ ID NO: 6007018 - DNA, 17 bp, Homo sapiens
cactttcttcaaagcca

SEQ ID NO: 6007019 - DNA, 19 bp, Homo sapiens
cactttctttttttacgta

SEQ ID NO: 6007020 - DNA, 20 bp, Homo sapiens
cactttgaaaagttggaagg

SEQ ID NO: 6007021 - DNA, 21 bp, Homo sapiens
cactttgaaaagttggaagga

SEQ ID NO: 6007022 - DNA, 12 bp, Homo sapiens
cactttgaaata

SEQ ID NO: 6007023 - DNA, 21 bp, Homo sapiens
cactttgaactcctcaagggc

SEQ ID NO: 6007024 - DNA, 14 bp, Homo sapiens
cactttgaagggca

SEQ ID NO: 6007025 - DNA, 22 bp, Homo sapiens
cactttgaaggtaataaataca

SEQ ID NO: 6007026 - DNA, 23 bp, Homo sapiens
cactttgacacaaggtgtaacta

SEQ ID NO: 6007027 - DNA, 21 bp, Homo sapiens
cactttgagcatttttaaggg

SEQ ID NO: 6007028 - DNA, 20 bp, Homo sapiens
cactttgatgtcatgtgttc

SEQ ID NO: 6007029 - DNA, 23 bp, Homo sapiens
cactttgatgtcatgtgttccct

SEQ ID NO: 6007030 - DNA, 17 bp, Homo sapiens
cactttgcacagctctc

SEQ ID NO: 6007031 - DNA, 15 bp, Homo sapiens
caggctgaaaacaat

SEQ ID NO: 6007032 - DNA, 19 bp, Homo sapiens
caggctgaaatatccaccc

SEQ ID NO: 6007033 - DNA, 17 bp, Homo sapiens
caggctgaagagaggga

SEQ ID NO: 6007034 - DNA, 20 bp, Homo sapiens
caggctgaagagagggacag

SEQ ID NO: 6007035 - DNA, 13 bp, Homo sapiens
caggctgaagagt

SEQ ID NO: 6007036 - DNA, 14 bp, Homo sapiens
caggctgacatctg

SEQ ID NO: 6007037 - DNA, 14 bp, Homo sapiens
caggctgactggca

SEQ ID NO: 6007038 - DNA, 14 bp, Homo sapiens
caggctgagaactc

SEQ ID NO: 6007039 - DNA, 21 bp, Homo sapiens
caggctgagacacagcccaga

SEQ ID NO: 6007040 - DNA, 12 bp, Homo sapiens
caggctgagagc

SEQ ID NO: 6007041 - DNA, 15 bp, Homo sapiens
caggctgagagccag

SEQ ID NO: 6007042 - DNA, 19 bp, Homo sapiens
caggctgagagccagatgc

SEQ ID NO: 6007043 - DNA, 20 bp, Homo sapiens
caggctgagccactctcttc

SEQ ID NO: 6007044 - DNA, 18 bp, Homo sapiens
caggctgagccatgagga

SEQ ID NO: 6007045 - DNA, 16 bp, Homo sapiens
caggctgagcccagcc

SEQ ID NO: 6007046 - DNA, 20 bp, Homo sapiens
caggctgagccgatctggtc

SEQ ID NO: 6007047 - DNA, 22 bp, Homo sapiens
caggctgagccgatctggtctc

SEQ ID NO: 6007048 - DNA, 17 bp, Homo sapiens
caggctgagcctcagtc

SEQ ID NO: 6007049 - DNA, 23 bp, Homo sapiens
caggctgagggaggcagaaaggg

SEQ ID NO: 6007050 - DNA, 11 bp, Homo sapiens
caggctgaggt

SEQ ID NO: 6007051 - DNA, 20 bp, Homo sapiens
caggctgaggtggggaagga

SEQ ID NO: 6007052 - DNA, 22 bp, Homo sapiens
caggctgagtccagagcttgtg

SEQ ID NO: 6007053 - DNA, 16 bp, Homo sapiens
caggctgagtgagcca

SEQ ID NO: 6007054 - DNA, 20 bp, Homo sapiens
caggctgagtgcactggcag

SEQ ID NO: 6007055 - DNA, 14 bp, Homo sapiens
caggctgagtgcag

SEQ ID NO: 6007056 - DNA, 20 bp, Homo sapiens
caggctgatgccgtgcgggc

SEQ ID NO: 6007057 - DNA, 20 bp, Homo sapiens
caggctgcaagctgcaggga

SEQ ID NO: 6007058 - DNA, 15 bp, Homo sapiens
caggctgcacagcat

SEQ ID NO: 6007059 - DNA, 18 bp, Homo sapiens
caggctgcacctctggct

SEQ ID NO: 6007060 - DNA, 15 bp, Homo sapiens
caggctgcactgcag

SEQ ID NO: 6007061 - DNA, 21 bp, Homo sapiens
caggctgcactgcagtgatgg

SEQ ID NO: 6007062 - DNA, 12 bp, Homo sapiens
caggctgcagag

SEQ ID NO: 6007063 - DNA, 18 bp, Homo sapiens
caggctgcagagcccggc

SEQ ID NO: 6007064 - DNA, 20 bp, Homo sapiens
caggctgcagaggcacctca

SEQ ID NO: 6007065 - DNA, 13 bp, Homo sapiens
caggctgcagcag

SEQ ID NO: 6007066 - DNA, 19 bp, Homo sapiens
caggctgcagcaggcagag

SEQ ID NO: 6007067 - DNA, 17 bp, Homo sapiens
caggctgcagctggaca

SEQ ID NO: 6007068 - DNA, 15 bp, Homo sapiens
caggctgcaggaggg

SEQ ID NO: 6007069 - DNA, 17 bp, Homo sapiens
caggctgcaggagggca

SEQ ID NO: 6007070 - DNA, 13 bp, Homo sapiens
caggctgcaggga

SEQ ID NO: 6007071 - DNA, 13 bp, Homo sapiens
caggctgcagtgc

SEQ ID NO: 6007072 - DNA, 16 bp, Homo sapiens
caggctgcatagaagg

SEQ ID NO: 6007073 - DNA, 18 bp, Homo sapiens
caggctgcatagaaggag

SEQ ID NO: 6007074 - DNA, 21 bp, Homo sapiens
caggctgccaaggccagagtg

SEQ ID NO: 6007075 - DNA, 15 bp, Homo sapiens
caggctgccagagaa

SEQ ID NO: 6007076 - DNA, 19 bp, Homo sapiens
caggctgccagtgcctggg

SEQ ID NO: 6007077 - DNA, 19 bp, Homo sapiens
caggctgcccactctgggg

SEQ ID NO: 6007078 - DNA, 16 bp, Homo sapiens
caggctgcccagagct

SEQ ID NO: 6007079 - DNA, 17 bp, Homo sapiens
caggctgcccagagctg

SEQ ID NO: 6007080 - DNA, 22 bp, Homo sapiens
caggctgccgctgctctcccag

SEQ ID NO: 6007081 - DNA, 16 bp, Homo sapiens
caggctgcctcccttg

SEQ ID NO: 6007082 - DNA, 12 bp, Homo sapiens
caggctgcctcg

SEQ ID NO: 6007083 - DNA, 19 bp, Homo sapiens
caggctgcctcggactcca

SEQ ID NO: 6007084 - DNA, 20 bp, Homo sapiens
caggctgcctcggactccat

SEQ ID NO: 6007085 - DNA, 13 bp, Homo sapiens
caggctgcctgag

SEQ ID NO: 6007086 - DNA, 15 bp, Homo sapiens
caggctgcgcctgcc

SEQ ID NO: 6007087 - DNA, 17 bp, Homo sapiens
caggctgcgcctgcccg

SEQ ID NO: 6007088 - DNA, 20 bp, Homo sapiens
caggctgcgcctgcccgccc

SEQ ID NO: 6007089 - DNA, 23 bp, Homo sapiens
caggctgcgcctgcccgcccgcc

SEQ ID NO: 6007090 - DNA, 23 bp, Homo sapiens
caggctgctaatattaaaccttt

SEQ ID NO: 6007091 - DNA, 17 bp, Homo sapiens
caggctgctcagggctg

SEQ ID NO: 6007092 - DNA, 22 bp, Homo sapiens
caggctgctctcaaacccctga

SEQ ID NO: 6007093 - DNA, 12 bp, Homo sapiens
caggctgctgga

SEQ ID NO: 6007094 - DNA, 19 bp, Homo sapiens
caggctgctggagtgcagt

SEQ ID NO: 6007095 - DNA, 13 bp, Homo sapiens
caggctgctggcg

SEQ ID NO: 6007096 - DNA, 21 bp, Homo sapiens
caggctgctggcgcctctgca

SEQ ID NO: 6007097 - DNA, 21 bp, Homo sapiens
caggctgctggggcctcagac

SEQ ID NO: 6007098 - DNA, 23 bp, Homo sapiens
caggctgctggggcctcagacga

SEQ ID NO: 6007099 - DNA, 17 bp, Homo sapiens
caggctggaatgaggga

SEQ ID NO: 6007100 - DNA, 19 bp, Homo sapiens
caggctggaatgagggagg

SEQ ID NO: 6007101 - DNA, 21 bp, Homo sapiens
caggctggaatgagggaggcg

SEQ ID NO: 6007102 - DNA, 18 bp, Homo sapiens
caggctggaatgcagtgg

SEQ ID NO: 6007103 - DNA, 20 bp, Homo sapiens
caggctggaggtaaggcctt

SEQ ID NO: 6007104 - DNA, 15 bp, Homo sapiens
caggctggagtacag

SEQ ID NO: 6007105 - DNA, 20 bp, Homo sapiens
caggctggagtgaagtggtg

SEQ ID NO: 6007106 - DNA, 14 bp, Homo sapiens
caggctggagtgca

SEQ ID NO: 6007107 - DNA, 18 bp, Homo sapiens
caggctggagtgcagtga

SEQ ID NO: 6007108 - DNA, 13 bp, Homo sapiens
caggctggagtgt

SEQ ID NO: 6007109 - DNA, 17 bp, Homo sapiens
caggctggagtgtagtg

SEQ ID NO: 6007110 - DNA, 20 bp, Homo sapiens
caggctggagtgtagtggcg

SEQ ID NO: 6007111 - DNA, 16 bp, Homo sapiens
caggctggatgctggg

SEQ ID NO: 6007112 - DNA, 20 bp, Homo sapiens
caggctggcaccgccttctc

SEQ ID NO: 6007113 - DNA, 15 bp, Homo sapiens
caggctggcagctct

SEQ ID NO: 6007114 - DNA, 18 bp, Homo sapiens
caggctggcagctctcca

SEQ ID NO: 6007115 - DNA, 11 bp, Homo sapiens
caggctggcca

SEQ ID NO: 6007116 - DNA, 12 bp, Homo sapiens
caggctggccag

SEQ ID NO: 6007117 - DNA, 18 bp, Homo sapiens
caggctggccagccccac

SEQ ID NO: 6007118 - DNA, 19 bp, Homo sapiens
caggctggccagccgctct

SEQ ID NO: 6007119 - DNA, 21 bp, Homo sapiens
caggctggccagtgctgccca

SEQ ID NO: 6007120 - DNA, 16 bp, Homo sapiens
caggctggcccccacc

SEQ ID NO: 6007121 - DNA, 15 bp, Homo sapiens
caggctggccctgcc

SEQ ID NO: 6007122 - DNA, 13 bp, Homo sapiens
caggctggcgcag

SEQ ID NO: 6007123 - DNA, 15 bp, Homo sapiens
caggctggcgcagcc

SEQ ID NO: 6007124 - DNA, 18 bp, Homo sapiens
caggctggcgcagccaag

SEQ ID NO: 6007125 - DNA, 20 bp, Homo sapiens
caggctgggacggaccagca

SEQ ID NO: 6007126 - DNA, 15 bp, Homo sapiens
caggctgggagagcc

SEQ ID NO: 6007127 - DNA, 18 bp, Homo sapiens
caggctgggagagccttc

SEQ ID NO: 6007128 - DNA, 19 bp, Homo sapiens
caggctgggagagccttcc

SEQ ID NO: 6007129 - DNA, 12 bp, Homo sapiens
caggctgggagg

SEQ ID NO: 6007130 - DNA, 14 bp, Homo sapiens
caggctgggaggct

SEQ ID NO: 6007131 - DNA, 18 bp, Homo sapiens
caggctgggcaaggaggc

SEQ ID NO: 6007132 - DNA, 16 bp, Homo sapiens
caggctgggcacggct

SEQ ID NO: 6007133 - DNA, 17 bp, Homo sapiens
caggctgggcagcccca

SEQ ID NO: 6007134 - DNA, 18 bp, Homo sapiens
caggctgggcagccccag

SEQ ID NO: 6007135 - DNA, 11 bp, Homo sapiens
caggctgggcc

SEQ ID NO: 6007136 - DNA, 12 bp, Homo sapiens
caggctgggcca

SEQ ID NO: 6007137 - DNA, 17 bp, Homo sapiens
caggctgggccatgtcc

SEQ ID NO: 6007138 - DNA, 21 bp, Homo sapiens
caggctgggccgcaagggcct

SEQ ID NO: 6007139 - DNA, 12 bp, Homo sapiens
caggctgggctg

SEQ ID NO: 6007140 - DNA, 14 bp, Homo sapiens
caggctgggctgag

SEQ ID NO: 6007141 - DNA, 22 bp, Homo sapiens
caggctgggctgagccaaagcc

SEQ ID NO: 6007142 - DNA, 14 bp, Homo sapiens
caggctgggctggg

SEQ ID NO: 6007143 - DNA, 16 bp, Homo sapiens
caggctgggctgggca

SEQ ID NO: 6007144 - DNA, 17 bp, Homo sapiens
caggctgggctgggcac

SEQ ID NO: 6007145 - DNA, 19 bp, Homo sapiens
caggctgggctgggcactg

SEQ ID NO: 6007146 - DNA, 23 bp, Homo sapiens
caggctgggcttcagtggcagct

SEQ ID NO: 6007147 - DNA, 16 bp, Homo sapiens
caggctggggaggcca

SEQ ID NO: 6007148 - DNA, 20 bp, Homo sapiens
caggctggggaggccagtgt

SEQ ID NO: 6007149 - DNA, 14 bp, Homo sapiens
caggctggggaggt

SEQ ID NO: 6007150 - DNA, 19 bp, Homo sapiens
caggctggggaggtgctgg

SEQ ID NO: 6007151 - DNA, 21 bp, Homo sapiens
caggctggggaggtgctgggg

SEQ ID NO: 6007152 - DNA, 18 bp, Homo sapiens
caggctggggccagggga

SEQ ID NO: 6007153 - DNA, 16 bp, Homo sapiens
caggctggggcctggc

SEQ ID NO: 6007154 - DNA, 18 bp, Homo sapiens
caggctggggcctggcct

SEQ ID NO: 6007155 - DNA, 15 bp, Homo sapiens
caggctggggccttt

SEQ ID NO: 6007156 - DNA, 18 bp, Homo sapiens
caggctggggctgacctt

SEQ ID NO: 6007157 - DNA, 17 bp, Homo sapiens
caggctgggtcaaaaga

SEQ ID NO: 6007158 - DNA, 22 bp, Homo sapiens
caggctgggtcaaaagagccct

SEQ ID NO: 6007159 - DNA, 23 bp, Homo sapiens
caggctgggtcaaaagagccctg

SEQ ID NO: 6007160 - DNA, 21 bp, Homo sapiens
caggctgggttgtcactgaga

SEQ ID NO: 6007161 - DNA, 23 bp, Homo sapiens
caggctggtatttatctgcaagg

SEQ ID NO: 6007162 - DNA, 17 bp, Homo sapiens
caggctggtctaaaact

SEQ ID NO: 6007163 - DNA, 12 bp, Homo sapiens
caggctggtctc

SEQ ID NO: 6007164 - DNA, 13 bp, Homo sapiens
caggctggtctca

SEQ ID NO: 6007165 - DNA, 19 bp, Homo sapiens
caggctggtctcaaactct

SEQ ID NO: 6007166 - DNA, 22 bp, Homo sapiens
caggctggtctcgaactcctga

SEQ ID NO: 6007167 - DNA, 15 bp, Homo sapiens
caggctggtcttgaa

SEQ ID NO: 6007168 - DNA, 16 bp, Homo sapiens
caggctggtcttgaac

SEQ ID NO: 6007169 - DNA, 20 bp, Homo sapiens
caggctggtcttgaactcct

SEQ ID NO: 6007170 - DNA, 22 bp, Homo sapiens
caggctggtcttgaactcttgg

SEQ ID NO: 6007171 - DNA, 21 bp, Homo sapiens
caggctggtcttgaagtcctg

SEQ ID NO: 6007172 - DNA, 18 bp, Homo sapiens
caggctggtcttgaattc

SEQ ID NO: 6007173 - DNA, 15 bp, Homo sapiens
caggctggtgggagg

SEQ ID NO: 6007174 - DNA, 18 bp, Homo sapiens
caggctggttcttgggct

SEQ ID NO: 6007175 - DNA, 16 bp, Homo sapiens
caggctgtaaggcatg

SEQ ID NO: 6007176 - DNA, 15 bp, Homo sapiens
caggctgtcagcgcc

SEQ ID NO: 6007177 - DNA, 14 bp, Homo sapiens
caggctgtcccaag

SEQ ID NO: 6007178 - DNA, 23 bp, Homo sapiens
caggctgtcccaagctcccaaga

SEQ ID NO: 6007179 - DNA, 13 bp, Homo sapiens
caggctgtcctta

SEQ ID NO: 6007180 - DNA, 22 bp, Homo sapiens
caggctgtgactcttctctcaa

SEQ ID NO: 6007181 - DNA, 14 bp, Homo sapiens
caggctgtgagttt

SEQ ID NO: 6007182 - DNA, 22 bp, Homo sapiens
caggctgtgggtagatgtgcaa

SEQ ID NO: 6007183 - DNA, 17 bp, Homo sapiens
caggctgttattatgaa

SEQ ID NO: 6007184 - DNA, 18 bp, Homo sapiens
caggctgttattatgaag

SEQ ID NO: 6007185 - DNA, 14 bp, Homo sapiens
caggctgttccatg

SEQ ID NO: 6007186 - DNA, 13 bp, Homo sapiens
caggctgttctcc

SEQ ID NO: 6007187 - DNA, 17 bp, Homo sapiens
caggctgttctgcactg

SEQ ID NO: 6007188 - DNA, 22 bp, Homo sapiens
caggctgttctgcactgaaaag

SEQ ID NO: 6007189 - DNA, 20 bp, Homo sapiens
caggctgttggcgtgtccca

SEQ ID NO: 6007190 - DNA, 16 bp, Homo sapiens
caggcttaataaaaat

SEQ ID NO: 6007191 - DNA, 20 bp, Homo sapiens
caggcttagtcactgagaca

SEQ ID NO: 6007192 - DNA, 19 bp, Homo sapiens
caggcttcacagtctggtg

SEQ ID NO: 6007193 - DNA, 15 bp, Homo sapiens
caggcttcaccctga

SEQ ID NO: 6007194 - DNA, 17 bp, Homo sapiens
caggcttccacacttct

SEQ ID NO: 6007195 - DNA, 14 bp, Homo sapiens
caggcttccccctt

SEQ ID NO: 6007196 - DNA, 17 bp, Homo sapiens
caggcttcccccttgat

SEQ ID NO: 6007197 - DNA, 14 bp, Homo sapiens
caggcttcccctcc

SEQ ID NO: 6007198 - DNA, 16 bp, Homo sapiens
caggcttccgcgccca

SEQ ID NO: 6007199 - DNA, 21 bp, Homo sapiens
caggcttccgcgcccagcgct

SEQ ID NO: 6007200 - DNA, 15 bp, Homo sapiens
caggcttcctgccct

SEQ ID NO: 6007201 - DNA, 18 bp, Homo sapiens
caggcttcctgccctagc

SEQ ID NO: 6007202 - DNA, 16 bp, Homo sapiens
caggcttcctggtgag

SEQ ID NO: 6007203 - DNA, 22 bp, Homo sapiens
caggcttcctggtgagaactga

SEQ ID NO: 6007204 - DNA, 17 bp, Homo sapiens
caggcttcgtctcagaa

SEQ ID NO: 6007205 - DNA, 20 bp, Homo sapiens
caggcttcgtctcagaaggc

SEQ ID NO: 6007206 - DNA, 12 bp, Homo sapiens
caggcttctccc

SEQ ID NO: 6007207 - DNA, 16 bp, Homo sapiens
caggcttctgagcagc

SEQ ID NO: 6007208 - DNA, 21 bp, Homo sapiens
caggcttctgagcagcgagcc

SEQ ID NO: 6007209 - DNA, 19 bp, Homo sapiens
caggcttctgtcaatttca

SEQ ID NO: 6007210 - DNA, 19 bp, Homo sapiens
cactttgcacgacgccctc

SEQ ID NO: 6007211 - DNA, 23 bp, Homo sapiens
cactttgcacgacgccctctccc

SEQ ID NO: 6007212 - DNA, 19 bp, Homo sapiens
cactttgcactgatatatc

SEQ ID NO: 6007213 - DNA, 22 bp, Homo sapiens
cactttgcactgatatatcatg

SEQ ID NO: 6007214 - DNA, 22 bp, Homo sapiens
cactttgccccagttacaaaaa

SEQ ID NO: 6007215 - DNA, 13 bp, Homo sapiens
cactttgcctcct

SEQ ID NO: 6007216 - DNA, 17 bp, Homo sapiens
cactttgcctcctgtgt

SEQ ID NO: 6007217 - DNA, 21 bp, Homo sapiens
cactttgctctcaattaaagt

SEQ ID NO: 6007218 - DNA, 20 bp, Homo sapiens
cactttgcttaagatgctaa

SEQ ID NO: 6007219 - DNA, 13 bp, Homo sapiens
cactttggccaca

SEQ ID NO: 6007220 - DNA, 13 bp, Homo sapiens
cactttggcttct

SEQ ID NO: 6007221 - DNA, 20 bp, Homo sapiens
cactttggcttctcctgtga

SEQ ID NO: 6007222 - DNA, 21 bp, Homo sapiens
cactttggcttctcctgtgac

SEQ ID NO: 6007223 - DNA, 17 bp, Homo sapiens
cactttgggacttggga

SEQ ID NO: 6007224 - DNA, 16 bp, Homo sapiens
cactttgggaggccaa

SEQ ID NO: 6007225 - DNA, 19 bp, Homo sapiens
cactttgggaggccaagga

SEQ ID NO: 6007226 - DNA, 19 bp, Homo sapiens
cactttggggaactcaaag

SEQ ID NO: 6007227 - DNA, 22 bp, Homo sapiens
cactttggtttatgcggtgctg

SEQ ID NO: 6007228 - DNA, 14 bp, Homo sapiens
cactttggttttgg

SEQ ID NO: 6007229 - DNA, 17 bp, Homo sapiens
cactttgtaaataaaaa

SEQ ID NO: 6007230 - DNA, 15 bp, Homo sapiens
cactttgtaattttt

SEQ ID NO: 6007231 - DNA, 20 bp, Homo sapiens
cactttgtctgtacatactg

SEQ ID NO: 6007232 - DNA, 14 bp, Homo sapiens
cactttgtgaatta

SEQ ID NO: 6007233 - DNA, 18 bp, Homo sapiens
cactttgttctttaggag

SEQ ID NO: 6007234 - DNA, 21 bp, Homo sapiens
cactttgttggcccttccagt

SEQ ID NO: 6007235 - DNA, 22 bp, Homo sapiens
cactttgtttcatattctcaga

SEQ ID NO: 6007236 - DNA, 13 bp, Homo sapiens
cacttttaaaact

SEQ ID NO: 6007237 - DNA, 16 bp, Homo sapiens
cacttttaaaataaat

SEQ ID NO: 6007238 - DNA, 23 bp, Homo sapiens
cacttttaaaataaattctctcc

SEQ ID NO: 6007239 - DNA, 17 bp, Homo sapiens
cacttttaatgaacaaa

SEQ ID NO: 6007240 - DNA, 21 bp, Homo sapiens
cacttttatatttgaaaaaat

SEQ ID NO: 6007241 - DNA, 19 bp, Homo sapiens
cacttttattgtataatta

SEQ ID NO: 6007242 - DNA, 15 bp, Homo sapiens
cacttttatttcctg

SEQ ID NO: 6007243 - DNA, 17 bp, Homo sapiens
cacttttatttcctgta

SEQ ID NO: 6007244 - DNA, 17 bp, Homo sapiens
cacttttcaatttgtca

SEQ ID NO: 6007245 - DNA, 12 bp, Homo sapiens
cacttttcacct

SEQ ID NO: 6007246 - DNA, 15 bp, Homo sapiens
cacttttcatatcat

SEQ ID NO: 6007247 - DNA, 17 bp, Homo sapiens
cacttttcattgcaaag

SEQ ID NO: 6007248 - DNA, 17 bp, Homo sapiens
cacttttccagtatttt

SEQ ID NO: 6007249 - DNA, 15 bp, Homo sapiens
cacttttcccactcc

SEQ ID NO: 6007250 - DNA, 13 bp, Homo sapiens
cacttttcctttt

SEQ ID NO: 6007251 - DNA, 14 bp, Homo sapiens
cacttttccttttc

SEQ ID NO: 6007252 - DNA, 12 bp, Homo sapiens
cacttttctagt

SEQ ID NO: 6007253 - DNA, 14 bp, Homo sapiens
cacttttctagtta

SEQ ID NO: 6007254 - DNA, 23 bp, Homo sapiens
cacttttctttttaaatgtgctt

SEQ ID NO: 6007255 - DNA, 22 bp, Homo sapiens
cacttttgaagtcttccctcag

SEQ ID NO: 6007256 - DNA, 23 bp, Homo sapiens
cacttttgaagtcttccctcaga

SEQ ID NO: 6007257 - DNA, 18 bp, Homo sapiens
cacttttgatgaaataaa

SEQ ID NO: 6007258 - DNA, 12 bp, Homo sapiens
cacttttgcaca

SEQ ID NO: 6007259 - DNA, 18 bp, Homo sapiens
cacttttgcacatatatt

SEQ ID NO: 6007260 - DNA, 12 bp, Homo sapiens
cacttttgccag

SEQ ID NO: 6007261 - DNA, 18 bp, Homo sapiens
cacttttgctaaaaagaa

SEQ ID NO: 6007262 - DNA, 21 bp, Homo sapiens
cacttttggaaggtgactttt

SEQ ID NO: 6007263 - DNA, 22 bp, Homo sapiens
cacttttgggaggtccaggcag

SEQ ID NO: 6007264 - DNA, 18 bp, Homo sapiens
cacttttgttctgcttta

SEQ ID NO: 6007265 - DNA, 19 bp, Homo sapiens
cacttttgttgcccaggct

SEQ ID NO: 6007266 - DNA, 19 bp, Homo sapiens
cactttttattagataacg

SEQ ID NO: 6007267 - DNA, 13 bp, Homo sapiens
cactttttcacat

SEQ ID NO: 6007268 - DNA, 14 bp, Homo sapiens
cactttttcccctg

SEQ ID NO: 6007269 - DNA, 19 bp, Homo sapiens
cactttttcgtgtggatct

SEQ ID NO: 6007270 - DNA, 14 bp, Homo sapiens
cactttttctggtc

SEQ ID NO: 6007271 - DNA, 16 bp, Homo sapiens
cactttttgaactaag

SEQ ID NO: 6007272 - DNA, 15 bp, Homo sapiens
cactttttgcagctt

SEQ ID NO: 6007273 - DNA, 20 bp, Homo sapiens
cactttttggctgacttcat

SEQ ID NO: 6007274 - DNA, 15 bp, Homo sapiens
cactttttggtaata

SEQ ID NO: 6007275 - DNA, 19 bp, Homo sapiens
cactttttgtattttttcc

SEQ ID NO: 6007276 - DNA, 22 bp, Homo sapiens
cactttttgtattttttcctta

SEQ ID NO: 6007277 - DNA, 14 bp, Homo sapiens
cacttttttaaata

SEQ ID NO: 6007278 - DNA, 18 bp, Homo sapiens
cacttttttacaactcca

SEQ ID NO: 6007279 - DNA, 14 bp, Homo sapiens
cacttttttataaa

SEQ ID NO: 6007280 - DNA, 23 bp, Homo sapiens
cacttttttatgaagaaaaagta

SEQ ID NO: 6007281 - DNA, 14 bp, Homo sapiens
cacttttttccaca

SEQ ID NO: 6007282 - DNA, 23 bp, Homo sapiens
cacttttttgtttgaatgttaga

SEQ ID NO: 6007283 - DNA, 23 bp, Homo sapiens
cactttttttttccaaaaaaata

SEQ ID NO: 6007284 - DNA, 19 bp, Homo sapiens
cactttttttttttttccc

SEQ ID NO: 6007285 - DNA, 20 bp, Homo sapiens
cactttttttttttttcccc

SEQ ID NO: 6007286 - DNA, 19 bp, Homo sapiens
cagaaaaaaaaatgtttta

SEQ ID NO: 6007287 - DNA, 22 bp, Homo sapiens
cagaaaaaaaagtgtctcaaag

SEQ ID NO: 6007288 - DNA, 11 bp, Homo sapiens
cagaaaaaagg

SEQ ID NO: 6007289 - DNA, 19 bp, Homo sapiens
cagaaaaaatgtctgtaaa

SEQ ID NO: 6007290 - DNA, 19 bp, Homo sapiens
cagaaaaaatgtgaagtct

SEQ ID NO: 6007291 - DNA, 13 bp, Homo sapiens
cagaaaaacaatc

SEQ ID NO: 6007292 - DNA, 22 bp, Homo sapiens
cagaaaaacaatggtaacattt

SEQ ID NO: 6007293 - DNA, 13 bp, Homo sapiens
cagaaaaaccaga

SEQ ID NO: 6007294 - DNA, 19 bp, Homo sapiens
cagaaaaacgtgttgcctt

SEQ ID NO: 6007295 - DNA, 19 bp, Homo sapiens
cagaaaaactctgggaaat

SEQ ID NO: 6007296 - DNA, 13 bp, Homo sapiens
cagaaaaagaaaa

SEQ ID NO: 6007297 - DNA, 13 bp, Homo sapiens
cagaaaaagaaga

SEQ ID NO: 6007298 - DNA, 17 bp, Homo sapiens
cagaaaaagagcttccc

SEQ ID NO: 6007299 - DNA, 13 bp, Homo sapiens
cagaaaaagcatg

SEQ ID NO: 6007300 - DNA, 21 bp, Homo sapiens
cagaaaaagcatgatgggaaa

SEQ ID NO: 6007301 - DNA, 15 bp, Homo sapiens
cagaaaaaggcagtg

SEQ ID NO: 6007302 - DNA, 22 bp, Homo sapiens
cagaaaaataaatgtcactgcc

SEQ ID NO: 6007303 - DNA, 21 bp, Homo sapiens
cagaaaaataacttcaagcaa

SEQ ID NO: 6007304 - DNA, 14 bp, Homo sapiens
cagaaaaatatata

SEQ ID NO: 6007305 - DNA, 17 bp, Homo sapiens
cagaaaaatgaaaagca

SEQ ID NO: 6007306 - DNA, 18 bp, Homo sapiens
cagaaaaatgaaaagcaa

SEQ ID NO: 6007307 - DNA, 20 bp, Homo sapiens
cagaaaaatgaaatttaagc

SEQ ID NO: 6007308 - DNA, 21 bp, Homo sapiens
cagaaaaatgaaatttaagca

SEQ ID NO: 6007309 - DNA, 20 bp, Homo sapiens
cagaaaacaaaagagagaat

SEQ ID NO: 6007310 - DNA, 19 bp, Homo sapiens
cagaaaacaacaaaagaat

SEQ ID NO: 6007311 - DNA, 20 bp, Homo sapiens
cagaaaacaacttggcattt

SEQ ID NO: 6007312 - DNA, 18 bp, Homo sapiens
cagaaaacaattgttctg

SEQ ID NO: 6007313 - DNA, 10 bp, Homo sapiens
cagaaaacag

SEQ ID NO: 6007314 - DNA, 12 bp, Homo sapiens
cagaaaacagaa

SEQ ID NO: 6007315 - DNA, 17 bp, Homo sapiens
cagaaaacagaaaaaaa

SEQ ID NO: 6007316 - DNA, 16 bp, Homo sapiens
cagaaaacagggtctg

SEQ ID NO: 6007317 - DNA, 23 bp, Homo sapiens
cagaaaacatgtttaaatagcct

SEQ ID NO: 6007318 - DNA, 12 bp, Homo sapiens
cagaaaacattg

SEQ ID NO: 6007319 - DNA, 14 bp, Homo sapiens
cagaaaacattgtt

SEQ ID NO: 6007320 - DNA, 16 bp, Homo sapiens
cagaaaacattgttcc

SEQ ID NO: 6007321 - DNA, 18 bp, Homo sapiens
cagaaaacattgttccag

SEQ ID NO: 6007322 - DNA, 11 bp, Homo sapiens
cagaaaaccac

SEQ ID NO: 6007323 - DNA, 11 bp, Homo sapiens
cagaaaaccca

SEQ ID NO: 6007324 - DNA, 21 bp, Homo sapiens
cagaaaaccctggtaagtaat

SEQ ID NO: 6007325 - DNA, 19 bp, Homo sapiens
cagaaaacggttaaaactg

SEQ ID NO: 6007326 - DNA, 20 bp, Homo sapiens
cagaaaacggttaaaactgt

SEQ ID NO: 6007327 - DNA, 15 bp, Homo sapiens
cagaaaactggcagt

SEQ ID NO: 6007328 - DNA, 15 bp, Homo sapiens
cagaaaagaaaacca

SEQ ID NO: 6007329 - DNA, 17 bp, Homo sapiens
cagaaaagaaagctgct

SEQ ID NO: 6007330 - DNA, 17 bp, Homo sapiens
cagaaaagaagtgaagt

SEQ ID NO: 6007331 - DNA, 11 bp, Homo sapiens
cagaaaagaga

SEQ ID NO: 6007332 - DNA, 23 bp, Homo sapiens
cagaaaagccttttaatctcttt

SEQ ID NO: 6007333 - DNA, 12 bp, Homo sapiens
cagaaaagctat

SEQ ID NO: 6007334 - DNA, 15 bp, Homo sapiens
cagaaaagctcagag

SEQ ID NO: 6007335 - DNA, 18 bp, Homo sapiens
cagaaaaggcagccagat

SEQ ID NO: 6007336 - DNA, 12 bp, Homo sapiens
cagaaaagtaga

SEQ ID NO: 6007337 - DNA, 16 bp, Homo sapiens
cagaaaagtgcctgag

SEQ ID NO: 6007338 - DNA, 18 bp, Homo sapiens
cagaaaataaaatattca

SEQ ID NO: 6007339 - DNA, 22 bp, Homo sapiens
cagaaaataatctggtgttctt

SEQ ID NO: 6007340 - DNA, 17 bp, Homo sapiens
cagaaaataccttagct

SEQ ID NO: 6007341 - DNA, 19 bp, Homo sapiens
cagaaaatagggtggacag

SEQ ID NO: 6007342 - DNA, 20 bp, Homo sapiens
cagaaaatagggtggacaga

SEQ ID NO: 6007343 - DNA, 17 bp, Homo sapiens
cagaaaatataaatgca

SEQ ID NO: 6007344 - DNA, 16 bp, Homo sapiens
cagaaaatatactgta

SEQ ID NO: 6007345 - DNA, 19 bp, Homo sapiens
cagaaaatatccctcctgt

SEQ ID NO: 6007346 - DNA, 21 bp, Homo sapiens
cagaaaatatgatatatatgt

SEQ ID NO: 6007347 - DNA, 14 bp, Homo sapiens
cagaaaatatgtat

SEQ ID NO: 6007348 - DNA, 19 bp, Homo sapiens
cagaaaatattatgtgttt

SEQ ID NO: 6007349 - DNA, 16 bp, Homo sapiens
cagaaaatatttaata

SEQ ID NO: 6007350 - DNA, 14 bp, Homo sapiens
cagaaaatgaaaaa

SEQ ID NO: 6007351 - DNA, 13 bp, Homo sapiens
cagaaaatgaatg

SEQ ID NO: 6007352 - DNA, 11 bp, Homo sapiens
cagaaaatgag

SEQ ID NO: 6007353 - DNA, 21 bp, Homo sapiens
cagaaaatgagtttgtctatg

SEQ ID NO: 6007354 - DNA, 23 bp, Homo sapiens
cagaaaattaaactacagaatat

SEQ ID NO: 6007355 - DNA, 15 bp, Homo sapiens
cagaaaattctgtgc

SEQ ID NO: 6007356 - DNA, 17 bp, Homo sapiens
cagaaaattctgtgcct

SEQ ID NO: 6007357 - DNA, 23 bp, Homo sapiens
cagaaaattctgtgccttgtttt

SEQ ID NO: 6007358 - DNA, 24 bp, Homo sapiens
cagaaaatttctcaatctatgtga

SEQ ID NO: 6007359 - DNA, 14 bp, Homo sapiens
cagaaaatttgcaa

SEQ ID NO: 6007360 - DNA, 18 bp, Homo sapiens
cagaaacaaaaacactaa

SEQ ID NO: 6007361 - DNA, 11 bp, Homo sapiens
cagaaacacaa

SEQ ID NO: 6007362 - DNA, 19 bp, Homo sapiens
cagaaacacccacaggcat

SEQ ID NO: 6007363 - DNA, 17 bp, Homo sapiens
cagaaacacccctctgt

SEQ ID NO: 6007364 - DNA, 20 bp, Homo sapiens
cagaaacacctagatcagaa

SEQ ID NO: 6007365 - DNA, 19 bp, Homo sapiens
cagaaacacggagtttcca

SEQ ID NO: 6007366 - DNA, 17 bp, Homo sapiens
cagaaacactgcctttt

SEQ ID NO: 6007367 - DNA, 18 bp, Homo sapiens
cagaaacactgccttttt

SEQ ID NO: 6007368 - DNA, 14 bp, Homo sapiens
cagaaacagcatat

SEQ ID NO: 6007369 - DNA, 14 bp, Homo sapiens
cagaaacagctgct

SEQ ID NO: 6007370 - DNA, 17 bp, Homo sapiens
cagaaacagctgcttct

SEQ ID NO: 6007371 - DNA, 22 bp, Homo sapiens
cagaaacagctgcttctccccc

SEQ ID NO: 6007372 - DNA, 13 bp, Homo sapiens
cagaaacagggca

SEQ ID NO: 6007373 - DNA, 14 bp, Homo sapiens
cagaaacagggcag

SEQ ID NO: 6007374 - DNA, 16 bp, Homo sapiens
cagaaacagggcagca

SEQ ID NO: 6007375 - DNA, 22 bp, Homo sapiens
cagaaacaggtgcatctgggga

SEQ ID NO: 6007376 - DNA, 15 bp, Homo sapiens
cagaaacagtgagtt

SEQ ID NO: 6007377 - DNA, 14 bp, Homo sapiens
cagaaacagtggga

SEQ ID NO: 6007378 - DNA, 23 bp, Homo sapiens
cagaaacatcagttactctgaag

SEQ ID NO: 6007379 - DNA, 19 bp, Homo sapiens
cagaaacatgccagaagga

SEQ ID NO: 6007380 - DNA, 21 bp, Homo sapiens
cagaaaccaaactaggagatg

SEQ ID NO: 6007381 - DNA, 14 bp, Homo sapiens
cagaaaccaagaga

SEQ ID NO: 6007382 - DNA, 21 bp, Homo sapiens
cagaaaccacagtcttcccag

SEQ ID NO: 6007383 - DNA, 21 bp, Homo sapiens
cagaaaccattgttcagaaga

SEQ ID NO: 6007384 - DNA, 20 bp, Homo sapiens
cagaaaccccacttccattg

SEQ ID NO: 6007385 - DNA, 17 bp, Homo sapiens
cagaaacccccaggagg

SEQ ID NO: 6007386 - DNA, 22 bp, Homo sapiens
cagaaacccccaggaggagaga

SEQ ID NO: 6007387 - DNA, 20 bp, Homo sapiens
cagaaacccggcttcctgtg

SEQ ID NO: 6007388 - DNA, 16 bp, Homo sapiens
cagaaaccctgagcag

SEQ ID NO: 6007389 - DNA, 13 bp, Homo sapiens
caggcttgagttt

SEQ ID NO: 6007390 - DNA, 17 bp, Homo sapiens
caggcttgcattaaaag

SEQ ID NO: 6007391 - DNA, 14 bp, Homo sapiens
caggcttgcctcaa

SEQ ID NO: 6007392 - DNA, 15 bp, Homo sapiens
caggcttgcctgcag

SEQ ID NO: 6007393 - DNA, 16 bp, Homo sapiens
caggcttgcctgcagg

SEQ ID NO: 6007394 - DNA, 14 bp, Homo sapiens
caggcttgcctggg

SEQ ID NO: 6007395 - DNA, 18 bp, Homo sapiens
caggcttggatggaacat

SEQ ID NO: 6007396 - DNA, 13 bp, Homo sapiens
caggcttggcgga

SEQ ID NO: 6007397 - DNA, 21 bp, Homo sapiens
caggcttggggatgcccttct

SEQ ID NO: 6007398 - DNA, 23 bp, Homo sapiens
caggcttgggggttttcaatgtg

SEQ ID NO: 6007399 - DNA, 24 bp, Homo sapiens
caggcttgggggttttcaatgtga

SEQ ID NO: 6007400 - DNA, 18 bp, Homo sapiens
caggcttgtcactagcag

SEQ ID NO: 6007401 - DNA, 23 bp, Homo sapiens
caggcttgtcactagcagctgca

SEQ ID NO: 6007402 - DNA, 13 bp, Homo sapiens
caggcttgtggca

SEQ ID NO: 6007403 - DNA, 21 bp, Homo sapiens
caggctttgggaacactggcc

SEQ ID NO: 6007404 - DNA, 12 bp, Homo sapiens
caggctttgtga

SEQ ID NO: 6007405 - DNA, 21 bp, Homo sapiens
caggctttgtgagagaggacc

SEQ ID NO: 6007406 - DNA, 19 bp, Homo sapiens
caggcttttccaggaagat

SEQ ID NO: 6007407 - DNA, 20 bp, Homo sapiens
caggcttttctcaggagctt

SEQ ID NO: 6007408 - DNA, 21 bp, Homo sapiens
caggcttttttccagactcta

SEQ ID NO: 6007409 - DNA, 17 bp, Homo sapiens
cagggaaaaaaagaaaa

SEQ ID NO: 6007410 - DNA, 18 bp, Homo sapiens
cagggaaaacacagatgt

SEQ ID NO: 6007411 - DNA, 18 bp, Homo sapiens
cagggaaaataggcagga

SEQ ID NO: 6007412 - DNA, 14 bp, Homo sapiens
cagggaaaatatag

SEQ ID NO: 6007413 - DNA, 15 bp, Homo sapiens
cagggaaacagcctc

SEQ ID NO: 6007414 - DNA, 12 bp, Homo sapiens
cagggaaagcat

SEQ ID NO: 6007415 - DNA, 15 bp, Homo sapiens
cagggaaaggccagt

SEQ ID NO: 6007416 - DNA, 21 bp, Homo sapiens
cagggaaagggatggtcaggc

SEQ ID NO: 6007417 - DNA, 18 bp, Homo sapiens
cagggaaatactgtattg

SEQ ID NO: 6007418 - DNA, 15 bp, Homo sapiens
cagggaaatggaggg

SEQ ID NO: 6007419 - DNA, 16 bp, Homo sapiens
cagggaaatgtatgtg

SEQ ID NO: 6007420 - DNA, 13 bp, Homo sapiens
cagggaaattaat

SEQ ID NO: 6007421 - DNA, 19 bp, Homo sapiens
cagggaacagccccagggt

SEQ ID NO: 6007422 - DNA, 17 bp, Homo sapiens
cagggaacatatttaag

SEQ ID NO: 6007423 - DNA, 20 bp, Homo sapiens
cagggaacatatttaaggaa

SEQ ID NO: 6007424 - DNA, 18 bp, Homo sapiens
cagggaacattggagctg

SEQ ID NO: 6007425 - DNA, 20 bp, Homo sapiens
cagggaacattggagctgac

SEQ ID NO: 6007426 - DNA, 14 bp, Homo sapiens
cagggaaccagagc

SEQ ID NO: 6007427 - DNA, 22 bp, Homo sapiens
cagggaaccgttattataattg

SEQ ID NO: 6007428 - DNA, 23 bp, Homo sapiens
cagggaaccgttattataattgt

SEQ ID NO: 6007429 - DNA, 15 bp, Homo sapiens
cagggaactggcctg

SEQ ID NO: 6007430 - DNA, 20 bp, Homo sapiens
cagggaactgggaagatgct

SEQ ID NO: 6007431 - DNA, 14 bp, Homo sapiens
cagggaagaaatca

SEQ ID NO: 6007432 - DNA, 16 bp, Homo sapiens
cagggaagacagagca

SEQ ID NO: 6007433 - DNA, 17 bp, Homo sapiens
cagggaagacagagcag

SEQ ID NO: 6007434 - DNA, 18 bp, Homo sapiens
cagggaagacagagcagg

SEQ ID NO: 6007435 - DNA, 22 bp, Homo sapiens
cagggaagagcagaacggagcc

SEQ ID NO: 6007436 - DNA, 20 bp, Homo sapiens
cagggaagagggcagtacct

SEQ ID NO: 6007437 - DNA, 23 bp, Homo sapiens
cagggaagaggggtgcagaggct

SEQ ID NO: 6007438 - DNA, 13 bp, Homo sapiens
cagggaagcaggc

SEQ ID NO: 6007439 - DNA, 14 bp, Homo sapiens
cagggaagcaggca

SEQ ID NO: 6007440 - DNA, 15 bp, Homo sapiens
cagggaagcaggcag

SEQ ID NO: 6007441 - DNA, 17 bp, Homo sapiens
cagggaagcaggcagag

SEQ ID NO: 6007442 - DNA, 14 bp, Homo sapiens
cagggaagcccagc

SEQ ID NO: 6007443 - DNA, 16 bp, Homo sapiens
cagggaagcccagctc

SEQ ID NO: 6007444 - DNA, 21 bp, Homo sapiens
cagggaagcccagctccaggg

SEQ ID NO: 6007445 - DNA, 23 bp, Homo sapiens
cagggaagcccagctccagggcc

SEQ ID NO: 6007446 - DNA, 22 bp, Homo sapiens
cagggaagcgtcgccccagtgg

SEQ ID NO: 6007447 - DNA, 20 bp, Homo sapiens
cagggaagctacaggttaca

SEQ ID NO: 6007448 - DNA, 13 bp, Homo sapiens
cagggaagctggc

SEQ ID NO: 6007449 - DNA, 14 bp, Homo sapiens
cagggaagctttca

SEQ ID NO: 6007450 - DNA, 14 bp, Homo sapiens
cagggaaggacagg

SEQ ID NO: 6007451 - DNA, 15 bp, Homo sapiens
cagggaaggacagga

SEQ ID NO: 6007452 - DNA, 21 bp, Homo sapiens
cagggaaggacaggaccctca

SEQ ID NO: 6007453 - DNA, 23 bp, Homo sapiens
cagggaaggacttggagagaatc

SEQ ID NO: 6007454 - DNA, 20 bp, Homo sapiens
cagggaaggaggagcctgtc

SEQ ID NO: 6007455 - DNA, 21 bp, Homo sapiens
cagggaaggaggagcctgtcc

SEQ ID NO: 6007456 - DNA, 22 bp, Homo sapiens
cagggaaggaggagcctgtcct

SEQ ID NO: 6007457 - DNA, 18 bp, Homo sapiens
cagggaaggcaggcaggg

SEQ ID NO: 6007458 - DNA, 22 bp, Homo sapiens
cagggaaggcaggcagggctct

SEQ ID NO: 6007459 - DNA, 21 bp, Homo sapiens
cagggaaggctaagcatggcc

SEQ ID NO: 6007460 - DNA, 16 bp, Homo sapiens
cagggaagggtgcctg

SEQ ID NO: 6007461 - DNA, 18 bp, Homo sapiens
cagggaagggtgcctggc

SEQ ID NO: 6007462 - DNA, 23 bp, Homo sapiens
cagggaagggtgcctggctgggc

SEQ ID NO: 6007463 - DNA, 16 bp, Homo sapiens
cagggaaggtgctgaa

SEQ ID NO: 6007464 - DNA, 18 bp, Homo sapiens
cagggaaggtggccacag

SEQ ID NO: 6007465 - DNA, 18 bp, Homo sapiens
cagggaaggtggggccct

SEQ ID NO: 6007466 - DNA, 16 bp, Homo sapiens
cagggaagtccccagg

SEQ ID NO: 6007467 - DNA, 23 bp, Homo sapiens
cagggaagtcgcttttggtgcct

SEQ ID NO: 6007468 - DNA, 21 bp, Homo sapiens
cagggaagtcttacttaaaaa

SEQ ID NO: 6007469 - DNA, 22 bp, Homo sapiens
cagggaagtcttacttaaaaaa

SEQ ID NO: 6007470 - DNA, 17 bp, Homo sapiens
cagggaagtgctctgat

SEQ ID NO: 6007471 - DNA, 22 bp, Homo sapiens
cagggaagtttcgtatgcactc

SEQ ID NO: 6007472 - DNA, 21 bp, Homo sapiens
cagggaatactatacagccat

SEQ ID NO: 6007473 - DNA, 16 bp, Homo sapiens
cagggaatagtgggat

SEQ ID NO: 6007474 - DNA, 15 bp, Homo sapiens
cagggaatatatatt

SEQ ID NO: 6007475 - DNA, 21 bp, Homo sapiens
cagggaatcagggaccagctt

SEQ ID NO: 6007476 - DNA, 23 bp, Homo sapiens
cagggaatccaagcctccacagc

SEQ ID NO: 6007477 - DNA, 17 bp, Homo sapiens
cagggaatgcagcagga

SEQ ID NO: 6007478 - DNA, 16 bp, Homo sapiens
cagggaatgcctggag

SEQ ID NO: 6007479 - DNA, 17 bp, Homo sapiens
cagggaatgcctggagg

SEQ ID NO: 6007480 - DNA, 20 bp, Homo sapiens
cagggaatgcctggagggta

SEQ ID NO: 6007481 - DNA, 16 bp, Homo sapiens
cagggaatggccacaa

SEQ ID NO: 6007482 - DNA, 21 bp, Homo sapiens
cagggaatggccacaaacctg

SEQ ID NO: 6007483 - DNA, 22 bp, Homo sapiens
cagggaattcttacagccaagt

SEQ ID NO: 6007484 - DNA, 17 bp, Homo sapiens
cagggaattgggggggt

SEQ ID NO: 6007485 - DNA, 23 bp, Homo sapiens
cagggaatttcaggaactagaga

SEQ ID NO: 6007486 - DNA, 15 bp, Homo sapiens
cagggacaagtcttt

SEQ ID NO: 6007487 - DNA, 15 bp, Homo sapiens
cagggacacacagcc

SEQ ID NO: 6007488 - DNA, 23 bp, Homo sapiens
cagggacacctcgcccttcagcc

SEQ ID NO: 6007489 - DNA, 11 bp, Homo sapiens
cagggacagaa

SEQ ID NO: 6007490 - DNA, 21 bp, Homo sapiens
cagggacagaaaccaaggccc

SEQ ID NO: 6007491 - DNA, 17 bp, Homo sapiens
cagggacagagacacct

SEQ ID NO: 6007492 - DNA, 21 bp, Homo sapiens
cagggacagagacacctgcac

SEQ ID NO: 6007493 - DNA, 22 bp, Homo sapiens
cagggacagagacacctgcacc

SEQ ID NO: 6007494 - DNA, 16 bp, Homo sapiens
cagggacagagatgga

SEQ ID NO: 6007495 - DNA, 13 bp, Homo sapiens
cagggacagagcc

SEQ ID NO: 6007496 - DNA, 13 bp, Homo sapiens
cagggacagaggc

SEQ ID NO: 6007497 - DNA, 20 bp, Homo sapiens
cagggacagaggccaaggac

SEQ ID NO: 6007498 - DNA, 22 bp, Homo sapiens
cagggacagaggccaaggactg

SEQ ID NO: 6007499 - DNA, 18 bp, Homo sapiens
cagggacagaggccccag

SEQ ID NO: 6007500 - DNA, 13 bp, Homo sapiens
cagggacagaggg

SEQ ID NO: 6007501 - DNA, 13 bp, Homo sapiens
cagggacaggaga

SEQ ID NO: 6007502 - DNA, 18 bp, Homo sapiens
cagggacaggataagagg

SEQ ID NO: 6007503 - DNA, 14 bp, Homo sapiens
cagggacagggccc

SEQ ID NO: 6007504 - DNA, 17 bp, Homo sapiens
cagggacagttgggtgt

SEQ ID NO: 6007505 - DNA, 21 bp, Homo sapiens
cagggacagttgggtgtgaga

SEQ ID NO: 6007506 - DNA, 19 bp, Homo sapiens
cagggacatgccctgtgtg

SEQ ID NO: 6007507 - DNA, 22 bp, Homo sapiens
cagggacatgccctgtgtggct

SEQ ID NO: 6007508 - DNA, 18 bp, Homo sapiens
cagggacattgcagagtg

SEQ ID NO: 6007509 - DNA, 13 bp, Homo sapiens
cagggaccaagat

SEQ ID NO: 6007510 - DNA, 22 bp, Homo sapiens
cagggaccaagatgtcaagctg

SEQ ID NO: 6007511 - DNA, 15 bp, Homo sapiens
cagggaccaaggacc

SEQ ID NO: 6007512 - DNA, 18 bp, Homo sapiens
cagggaccaaggacccct

SEQ ID NO: 6007513 - DNA, 14 bp, Homo sapiens
cagggaccaaggag

SEQ ID NO: 6007514 - DNA, 15 bp, Homo sapiens
cagggaccaaggaga

SEQ ID NO: 6007515 - DNA, 19 bp, Homo sapiens
cagggaccaaggagatggg

SEQ ID NO: 6007516 - DNA, 14 bp, Homo sapiens
cagggaccacagca

SEQ ID NO: 6007517 - DNA, 18 bp, Homo sapiens
cagggaccacatccaccc

SEQ ID NO: 6007518 - DNA, 20 bp, Homo sapiens
cagggaccacatccacccca

SEQ ID NO: 6007519 - DNA, 22 bp, Homo sapiens
cagggaccactgggtgagagag

SEQ ID NO: 6007520 - DNA, 15 bp, Homo sapiens
cagggaccagcacct

SEQ ID NO: 6007521 - DNA, 19 bp, Homo sapiens
cagggaccagcccagcctg

SEQ ID NO: 6007522 - DNA, 19 bp, Homo sapiens
cagggaccagctccccggg

SEQ ID NO: 6007523 - DNA, 14 bp, Homo sapiens
cagggaccagggcc

SEQ ID NO: 6007524 - DNA, 14 bp, Homo sapiens
cagggaccatggct

SEQ ID NO: 6007525 - DNA, 16 bp, Homo sapiens
cagggacccaaagcag

SEQ ID NO: 6007526 - DNA, 22 bp, Homo sapiens
cagggacccacttcacacacag

SEQ ID NO: 6007527 - DNA, 17 bp, Homo sapiens
cagggacccccgaggcc

SEQ ID NO: 6007528 - DNA, 21 bp, Homo sapiens
cagggacccccgaggcccccc

SEQ ID NO: 6007529 - DNA, 20 bp, Homo sapiens
cagggacccggggtctcctg

SEQ ID NO: 6007530 - DNA, 16 bp, Homo sapiens
cagggaccgggcgcag

SEQ ID NO: 6007531 - DNA, 19 bp, Homo sapiens
cagggaccggtgctgcagg

SEQ ID NO: 6007532 - DNA, 15 bp, Homo sapiens
cagggacctaaaggg

SEQ ID NO: 6007533 - DNA, 21 bp, Homo sapiens
cagggacctaaagggactacc

SEQ ID NO: 6007534 - DNA, 21 bp, Homo sapiens
cagggacctcaggggcacctc

SEQ ID NO: 6007535 - DNA, 15 bp, Homo sapiens
cagggacctgagagc

SEQ ID NO: 6007536 - DNA, 13 bp, Homo sapiens
cagggacctgctg

SEQ ID NO: 6007537 - DNA, 15 bp, Homo sapiens
cagggacctgctgct

SEQ ID NO: 6007538 - DNA, 23 bp, Homo sapiens
cagggacgaagaagagccacagt

SEQ ID NO: 6007539 - DNA, 16 bp, Homo sapiens
cagggacggggactgg

SEQ ID NO: 6007540 - DNA, 11 bp, Homo sapiens
cagggacgtga

SEQ ID NO: 6007541 - DNA, 18 bp, Homo sapiens
cagggactcaggccagtc

SEQ ID NO: 6007542 - DNA, 21 bp, Homo sapiens
cagggactcatctttccctcc

SEQ ID NO: 6007543 - DNA, 22 bp, Homo sapiens
cagggactcatctttccctcct

SEQ ID NO: 6007544 - DNA, 23 bp, Homo sapiens
cagggactcatctttccctcctt

SEQ ID NO: 6007545 - DNA, 15 bp, Homo sapiens
cagggactcggccca

SEQ ID NO: 6007546 - DNA, 20 bp, Homo sapiens
cagggactcggcccagggcc

SEQ ID NO: 6007547 - DNA, 23 bp, Homo sapiens
cagggactgaaaacctctcctca

SEQ ID NO: 6007548 - DNA, 16 bp, Homo sapiens
cagggactgtacctgt

SEQ ID NO: 6007549 - DNA, 18 bp, Homo sapiens
cagggactgtacctgtag

SEQ ID NO: 6007550 - DNA, 14 bp, Homo sapiens
cagggacttgaagt

SEQ ID NO: 6007551 - DNA, 20 bp, Homo sapiens
cagggacttgtttagagagc

SEQ ID NO: 6007552 - DNA, 22 bp, Homo sapiens
cagggacttgtttagagagcct

SEQ ID NO: 6007553 - DNA, 12 bp, Homo sapiens
cagggagaagct

SEQ ID NO: 6007554 - DNA, 15 bp, Homo sapiens
cagggagaagtagct

SEQ ID NO: 6007555 - DNA, 14 bp, Homo sapiens
cagggagaatgttg

SEQ ID NO: 6007556 - DNA, 18 bp, Homo sapiens
cagggagacatctgcacc

SEQ ID NO: 6007557 - DNA, 12 bp, Homo sapiens
cagggagaccag

SEQ ID NO: 6007558 - DNA, 14 bp, Homo sapiens
cagggagaccctgg

SEQ ID NO: 6007559 - DNA, 16 bp, Homo sapiens
cagggagaccctggga

SEQ ID NO: 6007560 - DNA, 14 bp, Homo sapiens
cagggagagcccag

SEQ ID NO: 6007561 - DNA, 15 bp, Homo sapiens
cagggagagcccagg

SEQ ID NO: 6007562 - DNA, 14 bp, Homo sapiens
cagggagagcgcct

SEQ ID NO: 6007563 - DNA, 18 bp, Homo sapiens
cagggagagcgcctcttc

SEQ ID NO: 6007564 - DNA, 21 bp, Homo sapiens
cagggagagcgcctcttcctc

SEQ ID NO: 6007565 - DNA, 12 bp, Homo sapiens
cagggagagctg

SEQ ID NO: 6007566 - DNA, 17 bp, Homo sapiens
cagaaaccctggtctcc

SEQ ID NO: 6007567 - DNA, 22 bp, Homo sapiens
cagaaacctatctcagggaggg

SEQ ID NO: 6007568 - DNA, 23 bp, Homo sapiens
cagaaacctatctcagggaggga

SEQ ID NO: 6007569 - DNA, 16 bp, Homo sapiens
cagaaaccttttattt

SEQ ID NO: 6007570 - DNA, 23 bp, Homo sapiens
cagaaacgagatcgggaagcaga

SEQ ID NO: 6007571 - DNA, 22 bp, Homo sapiens
cagaaacgcagattgggctggc

SEQ ID NO: 6007572 - DNA, 17 bp, Homo sapiens
cagaaacgccacatccc

SEQ ID NO: 6007573 - DNA, 17 bp, Homo sapiens
cagaaactcctgtttct

SEQ ID NO: 6007574 - DNA, 23 bp, Homo sapiens
cagaaactcctgtttctccttag

SEQ ID NO: 6007575 - DNA, 18 bp, Homo sapiens
cagaaactgaaccaacag

SEQ ID NO: 6007576 - DNA, 19 bp, Homo sapiens
cagaaactgaactggccgc

SEQ ID NO: 6007577 - DNA, 12 bp, Homo sapiens
cagaaactgatg

SEQ ID NO: 6007578 - DNA, 19 bp, Homo sapiens
cagaaactgttcccacctg

SEQ ID NO: 6007579 - DNA, 16 bp, Homo sapiens
cagaaacttgaactcc

SEQ ID NO: 6007580 - DNA, 16 bp, Homo sapiens
cagaaacttgttcttc

SEQ ID NO: 6007581 - DNA, 18 bp, Homo sapiens
cagaaacttgttcttcca

SEQ ID NO: 6007582 - DNA, 14 bp, Homo sapiens
cagaaagagacaca

SEQ ID NO: 6007583 - DNA, 15 bp, Homo sapiens
cagaaagagagaacc

SEQ ID NO: 6007584 - DNA, 22 bp, Homo sapiens
cagaaagaggaataaaatgatt

SEQ ID NO: 6007585 - DNA, 14 bp, Homo sapiens
cagaaagaggtctc

SEQ ID NO: 6007586 - DNA, 18 bp, Homo sapiens
cagaaagatacagacatt

SEQ ID NO: 6007587 - DNA, 19 bp, Homo sapiens
cagaaagatggatgtgctt

SEQ ID NO: 6007588 - DNA, 21 bp, Homo sapiens
cagaaagatggatgtgctttg

SEQ ID NO: 6007589 - DNA, 20 bp, Homo sapiens
cagaaagatttgatgggcca

SEQ ID NO: 6007590 - DNA, 17 bp, Homo sapiens
cagaaagatttggaaaa

SEQ ID NO: 6007591 - DNA, 18 bp, Homo sapiens
cagaaagcaaggactgcc

SEQ ID NO: 6007592 - DNA, 19 bp, Homo sapiens
cagaaagcagaacagtgat

SEQ ID NO: 6007593 - DNA, 19 bp, Homo sapiens
cagaaagcaggagcagctg

SEQ ID NO: 6007594 - DNA, 20 bp, Homo sapiens
cagaaagcaggagcagctgt

SEQ ID NO: 6007595 - DNA, 22 bp, Homo sapiens
cagaaagcatctattcccaaag

SEQ ID NO: 6007596 - DNA, 13 bp, Homo sapiens
cagaaagccaaca

SEQ ID NO: 6007597 - DNA, 15 bp, Homo sapiens
cagaaagccaggagc

SEQ ID NO: 6007598 - DNA, 16 bp, Homo sapiens
cagaaagccaggagca

SEQ ID NO: 6007599 - DNA, 18 bp, Homo sapiens
cagaaagccaggagcagc

SEQ ID NO: 6007600 - DNA, 19 bp, Homo sapiens
cagaaagccccaagcaatt

SEQ ID NO: 6007601 - DNA, 23 bp, Homo sapiens
cagaaagccccacccaggccagg

SEQ ID NO: 6007602 - DNA, 21 bp, Homo sapiens
cagaaagcctccgctgggctt

SEQ ID NO: 6007603 - DNA, 22 bp, Homo sapiens
cagaaagcctcctgccccctgc

SEQ ID NO: 6007604 - DNA, 19 bp, Homo sapiens
cagaaagcctctctctccc

SEQ ID NO: 6007605 - DNA, 17 bp, Homo sapiens
cagaaagccttccatta

SEQ ID NO: 6007606 - DNA, 21 bp, Homo sapiens
cagaaagctagatatgcctta

SEQ ID NO: 6007607 - DNA, 21 bp, Homo sapiens
cagaaagctgaggaacaggtt

SEQ ID NO: 6007608 - DNA, 15 bp, Homo sapiens
cagaaagctgccaga

SEQ ID NO: 6007609 - DNA, 14 bp, Homo sapiens
cagaaagctgcctg

SEQ ID NO: 6007610 - DNA, 13 bp, Homo sapiens
cagaaagcttcat

SEQ ID NO: 6007611 - DNA, 20 bp, Homo sapiens
cagaaagcttcatccacagc

SEQ ID NO: 6007612 - DNA, 16 bp, Homo sapiens
cagaaaggaaaaacaa

SEQ ID NO: 6007613 - DNA, 17 bp, Homo sapiens
cagaaaggaaaaacaaa

SEQ ID NO: 6007614 - DNA, 19 bp, Homo sapiens
cagaaaggaaaaacaaact

SEQ ID NO: 6007615 - DNA, 22 bp, Homo sapiens
cagaaaggaaaagattcctgtc

SEQ ID NO: 6007616 - DNA, 20 bp, Homo sapiens
cagaaaggactcctcctttt

SEQ ID NO: 6007617 - DNA, 23 bp, Homo sapiens
cagaaagggcagcttcagtctct

SEQ ID NO: 6007618 - DNA, 24 bp, Homo sapiens
cagaaagggcagcttcagtctctg

SEQ ID NO: 6007619 - DNA, 22 bp, Homo sapiens
cagaaaggtgattccaggagga

SEQ ID NO: 6007620 - DNA, 15 bp, Homo sapiens
cagaaaggttctgcc

SEQ ID NO: 6007621 - DNA, 16 bp, Homo sapiens
cagaaaggttctgccc

SEQ ID NO: 6007622 - DNA, 22 bp, Homo sapiens
cagaaagtaatttcttctcaaa

SEQ ID NO: 6007623 - DNA, 15 bp, Homo sapiens
cagaaagtgcctgac

SEQ ID NO: 6007624 - DNA, 16 bp, Homo sapiens
cagaaagtgcctgaca

SEQ ID NO: 6007625 - DNA, 17 bp, Homo sapiens
cagaaagtgcctttcag

SEQ ID NO: 6007626 - DNA, 18 bp, Homo sapiens
cagaaagtgcctttcagg

SEQ ID NO: 6007627 - DNA, 22 bp, Homo sapiens
cagaaagtgcctttcaggatct

SEQ ID NO: 6007628 - DNA, 23 bp, Homo sapiens
cagaaagtggtgctcagttgtag

SEQ ID NO: 6007629 - DNA, 14 bp, Homo sapiens
cagaaagtgtaaat

SEQ ID NO: 6007630 - DNA, 21 bp, Homo sapiens
cagaaagtgtgtgtgttctgt

SEQ ID NO: 6007631 - DNA, 22 bp, Homo sapiens
cagaaagtgtgtgtgttctgta

SEQ ID NO: 6007632 - DNA, 21 bp, Homo sapiens
cagaaataaaatgaaatgtct

SEQ ID NO: 6007633 - DNA, 13 bp, Homo sapiens
cagaaataaatca

SEQ ID NO: 6007634 - DNA, 16 bp, Homo sapiens
cagaaataaatcacag

SEQ ID NO: 6007635 - DNA, 18 bp, Homo sapiens
cagaaataaatcacagat

SEQ ID NO: 6007636 - DNA, 22 bp, Homo sapiens
cagaaataaatcacagatgcat

SEQ ID NO: 6007637 - DNA, 11 bp, Homo sapiens
cagaaatacaa

SEQ ID NO: 6007638 - DNA, 18 bp, Homo sapiens
cagaaatacaaaaaatta

SEQ ID NO: 6007639 - DNA, 19 bp, Homo sapiens
cagaaatacagataaatga

SEQ ID NO: 6007640 - DNA, 21 bp, Homo sapiens
cagaaatacagtcttccacaa

SEQ ID NO: 6007641 - DNA, 13 bp, Homo sapiens
cagaaatacctgt

SEQ ID NO: 6007642 - DNA, 22 bp, Homo sapiens
cagaaatactataacatatgta

SEQ ID NO: 6007643 - DNA, 14 bp, Homo sapiens
cagaaatagacaaa

SEQ ID NO: 6007644 - DNA, 16 bp, Homo sapiens
cagaaatagacaaaaa

SEQ ID NO: 6007645 - DNA, 20 bp, Homo sapiens
cagaaatagacaaaaagtat

SEQ ID NO: 6007646 - DNA, 15 bp, Homo sapiens
cagaaataggaagat

SEQ ID NO: 6007647 - DNA, 18 bp, Homo sapiens
cagaaatagttgtctgtg

SEQ ID NO: 6007648 - DNA, 20 bp, Homo sapiens
cagaaatagttgtctgtgct

SEQ ID NO: 6007649 - DNA, 21 bp, Homo sapiens
cagaaatataacacatttttt

SEQ ID NO: 6007650 - DNA, 22 bp, Homo sapiens
cagaaatatatatacatatgta

SEQ ID NO: 6007651 - DNA, 22 bp, Homo sapiens
cagaaatatttgtgacaaaaaa

SEQ ID NO: 6007652 - DNA, 20 bp, Homo sapiens
cagaaatcacagtcaatgga

SEQ ID NO: 6007653 - DNA, 12 bp, Homo sapiens
cagaaatcactg

SEQ ID NO: 6007654 - DNA, 13 bp, Homo sapiens
cagaaatcactgt

SEQ ID NO: 6007655 - DNA, 15 bp, Homo sapiens
cagaaatcactgtga

SEQ ID NO: 6007656 - DNA, 17 bp, Homo sapiens
cagaaatcactgtgaaa

SEQ ID NO: 6007657 - DNA, 15 bp, Homo sapiens
cagaaatcagaggag

SEQ ID NO: 6007658 - DNA, 19 bp, Homo sapiens
cagaaatcaggtgttttaa

SEQ ID NO: 6007659 - DNA, 23 bp, Homo sapiens
cagaaatcccagttcatgttgct

SEQ ID NO: 6007660 - DNA, 22 bp, Homo sapiens
cagaaatcctttcataaagcac

SEQ ID NO: 6007661 - DNA, 16 bp, Homo sapiens
cagaaatcgagagtgt

SEQ ID NO: 6007662 - DNA, 17 bp, Homo sapiens
cagaaatcgagagtgtg

SEQ ID NO: 6007663 - DNA, 22 bp, Homo sapiens
cagaaatctgaaaaatggccat

SEQ ID NO: 6007664 - DNA, 21 bp, Homo sapiens
cagaaatgaaacagaccctca

SEQ ID NO: 6007665 - DNA, 21 bp, Homo sapiens
cagaaatgacaacaaggccct

SEQ ID NO: 6007666 - DNA, 20 bp, Homo sapiens
cagaaatgaggccatggact

SEQ ID NO: 6007667 - DNA, 16 bp, Homo sapiens
cagaaatgattcaggg

SEQ ID NO: 6007668 - DNA, 17 bp, Homo sapiens
cagaaatgattcagggt

SEQ ID NO: 6007669 - DNA, 13 bp, Homo sapiens
cagaaatgcaaaa

SEQ ID NO: 6007670 - DNA, 23 bp, Homo sapiens
cagaaatgcccccattctcccag

SEQ ID NO: 6007671 - DNA, 22 bp, Homo sapiens
cagaaatgccgctgtgtccccg

SEQ ID NO: 6007672 - DNA, 14 bp, Homo sapiens
cagaaatgctctga

SEQ ID NO: 6007673 - DNA, 16 bp, Homo sapiens
cagaaatgctgcctgc

SEQ ID NO: 6007674 - DNA, 19 bp, Homo sapiens
cagaaatgctgcctgcctg

SEQ ID NO: 6007675 - DNA, 20 bp, Homo sapiens
cagaaatgctgcctgcctgt

SEQ ID NO: 6007676 - DNA, 21 bp, Homo sapiens
cagaaatgctgcctgcctgtc

SEQ ID NO: 6007677 - DNA, 23 bp, Homo sapiens
cagaaatgctgcctgcctgtctg

SEQ ID NO: 6007678 - DNA, 14 bp, Homo sapiens
cagaaatgctgctg

SEQ ID NO: 6007679 - DNA, 16 bp, Homo sapiens
cagaaatgctgctggc

SEQ ID NO: 6007680 - DNA, 19 bp, Homo sapiens
cagaaatgctgctggccaa

SEQ ID NO: 6007681 - DNA, 15 bp, Homo sapiens
cagaaatggaaagca

SEQ ID NO: 6007682 - DNA, 21 bp, Homo sapiens
cagaaatggacaaagaaaacg

SEQ ID NO: 6007683 - DNA, 14 bp, Homo sapiens
cagaaatgggcagt

SEQ ID NO: 6007684 - DNA, 16 bp, Homo sapiens
cagaaatgtaaatgtt

SEQ ID NO: 6007685 - DNA, 16 bp, Homo sapiens
cagaaatgtccctttc

SEQ ID NO: 6007686 - DNA, 19 bp, Homo sapiens
cagaaatgtttctgtgtca

SEQ ID NO: 6007687 - DNA, 22 bp, Homo sapiens
cagaaattaaaatattatttga

SEQ ID NO: 6007688 - DNA, 16 bp, Homo sapiens
cagaaattagccgggc

SEQ ID NO: 6007689 - DNA, 14 bp, Homo sapiens
cagaaattattggt

SEQ ID NO: 6007690 - DNA, 20 bp, Homo sapiens
cagaaattcaatttggattt

SEQ ID NO: 6007691 - DNA, 20 bp, Homo sapiens
cagaaattccaactcctgat

SEQ ID NO: 6007692 - DNA, 14 bp, Homo sapiens
cagaaattccttcc

SEQ ID NO: 6007693 - DNA, 17 bp, Homo sapiens
cagaaattctggcccag

SEQ ID NO: 6007694 - DNA, 21 bp, Homo sapiens
cagaaattctggcccagccaa

SEQ ID NO: 6007695 - DNA, 14 bp, Homo sapiens
cagaaattgaaagc

SEQ ID NO: 6007696 - DNA, 21 bp, Homo sapiens
cagaaattggaacagaatgtt

SEQ ID NO: 6007697 - DNA, 21 bp, Homo sapiens
cagaaattggtaccttgcaca

SEQ ID NO: 6007698 - DNA, 12 bp, Homo sapiens
cagaaattgtat

SEQ ID NO: 6007699 - DNA, 14 bp, Homo sapiens
cagaaattgtatat

SEQ ID NO: 6007700 - DNA, 19 bp, Homo sapiens
cagaaattgtatattgtaa

SEQ ID NO: 6007701 - DNA, 22 bp, Homo sapiens
cagaaattgtatattgtaattt

SEQ ID NO: 6007702 - DNA, 23 bp, Homo sapiens
cagaaattttgaagtcagagaga

SEQ ID NO: 6007703 - DNA, 19 bp, Homo sapiens
cagaaatttttatttttct

SEQ ID NO: 6007704 - DNA, 14 bp, Homo sapiens
cagaacaaaacttc

SEQ ID NO: 6007705 - DNA, 20 bp, Homo sapiens
cagaacaaaccccgaaacag

SEQ ID NO: 6007706 - DNA, 12 bp, Homo sapiens
cagaacaaatga

SEQ ID NO: 6007707 - DNA, 20 bp, Homo sapiens
cagaacaaatgtgtttttct

SEQ ID NO: 6007708 - DNA, 21 bp, Homo sapiens
cagaacaaatgtgtttttcta

SEQ ID NO: 6007709 - DNA, 15 bp, Homo sapiens
cagaacaacaacaaa

SEQ ID NO: 6007710 - DNA, 15 bp, Homo sapiens
cagaacaacaactat

SEQ ID NO: 6007711 - DNA, 16 bp, Homo sapiens
cagaacaacccaccat

SEQ ID NO: 6007712 - DNA, 21 bp, Homo sapiens
cagaacaaggttccctctgag

SEQ ID NO: 6007713 - DNA, 18 bp, Homo sapiens
cagaacacactccatcag

SEQ ID NO: 6007714 - DNA, 22 bp, Homo sapiens
cagaacaccaagtaaatctatc

SEQ ID NO: 6007715 - DNA, 21 bp, Homo sapiens
cagaacacccctaatgagggt

SEQ ID NO: 6007716 - DNA, 13 bp, Homo sapiens
cagaacacctggc

SEQ ID NO: 6007717 - DNA, 18 bp, Homo sapiens
cagaacacctggccgggt

SEQ ID NO: 6007718 - DNA, 18 bp, Homo sapiens
cagaacacgataaaccat

SEQ ID NO: 6007719 - DNA, 22 bp, Homo sapiens
cagaacactttgctaggagata

SEQ ID NO: 6007720 - DNA, 11 bp, Homo sapiens
cagaacagagg

SEQ ID NO: 6007721 - DNA, 17 bp, Homo sapiens
cagaacagagggccaga

SEQ ID NO: 6007722 - DNA, 12 bp, Homo sapiens
cagaacagcaga

SEQ ID NO: 6007723 - DNA, 17 bp, Homo sapiens
cagaacagccgctcctg

SEQ ID NO: 6007724 - DNA, 12 bp, Homo sapiens
cagaacagctga

SEQ ID NO: 6007725 - DNA, 12 bp, Homo sapiens
cagaacagctgt

SEQ ID NO: 6007726 - DNA, 24 bp, Homo sapiens
cagaacagcttcaggttatcgaaa

SEQ ID NO: 6007727 - DNA, 14 bp, Homo sapiens
cagaacagcttcat

SEQ ID NO: 6007728 - DNA, 17 bp, Homo sapiens
cagaacaggaggtgtga

SEQ ID NO: 6007729 - DNA, 20 bp, Homo sapiens
cagaacaggaggtgtgaatg

SEQ ID NO: 6007730 - DNA, 13 bp, Homo sapiens
cagaacagggtca

SEQ ID NO: 6007731 - DNA, 24 bp, Homo sapiens
cagaacaggtgttggtgacaattg

SEQ ID NO: 6007732 - DNA, 18 bp, Homo sapiens
cagaacagtaaagttaaa

SEQ ID NO: 6007733 - DNA, 15 bp, Homo sapiens
cagaacagtatcttt

SEQ ID NO: 6007734 - DNA, 18 bp, Homo sapiens
cagaacagtatgaatttg

SEQ ID NO: 6007735 - DNA, 19 bp, Homo sapiens
cagaacagtctctggaaga

SEQ ID NO: 6007736 - DNA, 11 bp, Homo sapiens
cagaacagtga

SEQ ID NO: 6007737 - DNA, 15 bp, Homo sapiens
cagaacagtgaaagg

SEQ ID NO: 6007738 - DNA, 15 bp, Homo sapiens
cagaacagtgtttga

SEQ ID NO: 6007739 - DNA, 20 bp, Homo sapiens
cagaacagtgtttgattttt

SEQ ID NO: 6007740 - DNA, 14 bp, Homo sapiens
cagaacatacactg

SEQ ID NO: 6007741 - DNA, 15 bp, Homo sapiens
cagaacatactgatt

SEQ ID NO: 6007742 - DNA, 17 bp, Homo sapiens
cagggagaggccatgat

SEQ ID NO: 6007743 - DNA, 13 bp, Homo sapiens
cagggagaggcct

SEQ ID NO: 6007744 - DNA, 23 bp, Homo sapiens
cagggagaggcctcggctgtctc

SEQ ID NO: 6007745 - DNA, 17 bp, Homo sapiens
cagggagaggctgtgtc

SEQ ID NO: 6007746 - DNA, 21 bp, Homo sapiens
cagggagaggctgtgtccctg

SEQ ID NO: 6007747 - DNA, 17 bp, Homo sapiens
cagggagagggggctgg

SEQ ID NO: 6007748 - DNA, 22 bp, Homo sapiens
cagggagagttggggaaggcaa

SEQ ID NO: 6007749 - DNA, 16 bp, Homo sapiens
cagggagatgtctaga

SEQ ID NO: 6007750 - DNA, 21 bp, Homo sapiens
cagggagcaccacggccagaa

SEQ ID NO: 6007751 - DNA, 17 bp, Homo sapiens
cagggagcacctgtctg

SEQ ID NO: 6007752 - DNA, 18 bp, Homo sapiens
cagggagcacctgtctgg

SEQ ID NO: 6007753 - DNA, 12 bp, Homo sapiens
cagggagcactg

SEQ ID NO: 6007754 - DNA, 23 bp, Homo sapiens
cagggagccacacagagatgtcc

SEQ ID NO: 6007755 - DNA, 22 bp, Homo sapiens
cagggagcccctaggaaagcag

SEQ ID NO: 6007756 - DNA, 13 bp, Homo sapiens
cagggagccctgg

SEQ ID NO: 6007757 - DNA, 15 bp, Homo sapiens
cagggagccctgggg

SEQ ID NO: 6007758 - DNA, 23 bp, Homo sapiens
cagggagcctccccatctgtcca

SEQ ID NO: 6007759 - DNA, 15 bp, Homo sapiens
cagggagcctcctgc

SEQ ID NO: 6007760 - DNA, 18 bp, Homo sapiens
cagggagcctcctgccca

SEQ ID NO: 6007761 - DNA, 22 bp, Homo sapiens
cagggagcctttggttctggcc

SEQ ID NO: 6007762 - DNA, 19 bp, Homo sapiens
cagggagcggaaagcagct

SEQ ID NO: 6007763 - DNA, 17 bp, Homo sapiens
cagggagcggccggcca

SEQ ID NO: 6007764 - DNA, 15 bp, Homo sapiens
cagggagctctgggg

SEQ ID NO: 6007765 - DNA, 16 bp, Homo sapiens
cagggagctctgggga

SEQ ID NO: 6007766 - DNA, 19 bp, Homo sapiens
cagggagctctggggacag

SEQ ID NO: 6007767 - DNA, 14 bp, Homo sapiens
cagggagctgatgt

SEQ ID NO: 6007768 - DNA, 15 bp, Homo sapiens
cagggagctgggccc

SEQ ID NO: 6007769 - DNA, 14 bp, Homo sapiens
cagggagctgggga

SEQ ID NO: 6007770 - DNA, 19 bp, Homo sapiens
cagggagcttcctggctct

SEQ ID NO: 6007771 - DNA, 17 bp, Homo sapiens
cagggaggaaaagtgca

SEQ ID NO: 6007772 - DNA, 18 bp, Homo sapiens
cagggaggacgctctctg

SEQ ID NO: 6007773 - DNA, 19 bp, Homo sapiens
cagggaggacgctctctgg

SEQ ID NO: 6007774 - DNA, 22 bp, Homo sapiens
cagggaggagaggggaagggcc

SEQ ID NO: 6007775 - DNA, 12 bp, Homo sapiens
cagggaggagcc

SEQ ID NO: 6007776 - DNA, 14 bp, Homo sapiens
cagggaggagcccc

SEQ ID NO: 6007777 - DNA, 21 bp, Homo sapiens
cagggaggagccccagtggtg

SEQ ID NO: 6007778 - DNA, 15 bp, Homo sapiens
cagggaggaggcaga

SEQ ID NO: 6007779 - DNA, 21 bp, Homo sapiens
cagggaggaggcagagaagaa

SEQ ID NO: 6007780 - DNA, 19 bp, Homo sapiens
cagggaggaggtggcagcc

SEQ ID NO: 6007781 - DNA, 22 bp, Homo sapiens
cagggaggaggtggcagccctg

SEQ ID NO: 6007782 - DNA, 17 bp, Homo sapiens
cagggaggatgccacag

SEQ ID NO: 6007783 - DNA, 18 bp, Homo sapiens
cagggaggatgccacagc

SEQ ID NO: 6007784 - DNA, 21 bp, Homo sapiens
cagggaggatgccacagcccc

SEQ ID NO: 6007785 - DNA, 22 bp, Homo sapiens
cagggaggcaacactgctgtcc

SEQ ID NO: 6007786 - DNA, 13 bp, Homo sapiens
cagggaggcacca

SEQ ID NO: 6007787 - DNA, 20 bp, Homo sapiens
cagggaggcagagcgggagg

SEQ ID NO: 6007788 - DNA, 16 bp, Homo sapiens
cagggaggcagccgcc

SEQ ID NO: 6007789 - DNA, 14 bp, Homo sapiens
cagggaggcagcgt

SEQ ID NO: 6007790 - DNA, 15 bp, Homo sapiens
cagggaggccacgtc

SEQ ID NO: 6007791 - DNA, 17 bp, Homo sapiens
cagggaggccctgtgcc

SEQ ID NO: 6007792 - DNA, 12 bp, Homo sapiens
cagggaggccga

SEQ ID NO: 6007793 - DNA, 15 bp, Homo sapiens
cagggaggccgaagc

SEQ ID NO: 6007794 - DNA, 21 bp, Homo sapiens
cagggaggcgatgccagcctt

SEQ ID NO: 6007795 - DNA, 16 bp, Homo sapiens
cagggaggcgcaggga

SEQ ID NO: 6007796 - DNA, 21 bp, Homo sapiens
cagggaggcgcagggacatgg

SEQ ID NO: 6007797 - DNA, 15 bp, Homo sapiens
cagggaggctcccgg

SEQ ID NO: 6007798 - DNA, 23 bp, Homo sapiens
cagggaggctcccggggcctgga

SEQ ID NO: 6007799 - DNA, 21 bp, Homo sapiens
cagggagggaaacccggggaa

SEQ ID NO: 6007800 - DNA, 14 bp, Homo sapiens
cagggagggaaggg

SEQ ID NO: 6007801 - DNA, 17 bp, Homo sapiens
cagggagggaaggggat

SEQ ID NO: 6007802 - DNA, 16 bp, Homo sapiens
cagggagggaagtgtg

SEQ ID NO: 6007803 - DNA, 12 bp, Homo sapiens
cagggagggctt

SEQ ID NO: 6007804 - DNA, 16 bp, Homo sapiens
cagggagggcttctgc

SEQ ID NO: 6007805 - DNA, 13 bp, Homo sapiens
cagggaggggact

SEQ ID NO: 6007806 - DNA, 14 bp, Homo sapiens
cagggaggggaggc

SEQ ID NO: 6007807 - DNA, 16 bp, Homo sapiens
cagggaggggaggcag

SEQ ID NO: 6007808 - DNA, 22 bp, Homo sapiens
cagggaggggccggccctgtgt

SEQ ID NO: 6007809 - DNA, 20 bp, Homo sapiens
cagggaggggccggctggcc

SEQ ID NO: 6007810 - DNA, 12 bp, Homo sapiens
cagggaggggct

SEQ ID NO: 6007811 - DNA, 20 bp, Homo sapiens
cagggaggggctgagtctgg

SEQ ID NO: 6007812 - DNA, 15 bp, Homo sapiens
cagggaggggctggg

SEQ ID NO: 6007813 - DNA, 16 bp, Homo sapiens
cagggaggggctgggg

SEQ ID NO: 6007814 - DNA, 16 bp, Homo sapiens
cagggagggggctggg

SEQ ID NO: 6007815 - DNA, 17 bp, Homo sapiens
cagggagggggctggga

SEQ ID NO: 6007816 - DNA, 18 bp, Homo sapiens
cagggagggggctgggaa

SEQ ID NO: 6007817 - DNA, 14 bp, Homo sapiens
cagggaggtggaag

SEQ ID NO: 6007818 - DNA, 14 bp, Homo sapiens
cagggaggtggcag

SEQ ID NO: 6007819 - DNA, 17 bp, Homo sapiens
cagggaggtggcaggga

SEQ ID NO: 6007820 - DNA, 14 bp, Homo sapiens
cagggaggtggctg

SEQ ID NO: 6007821 - DNA, 23 bp, Homo sapiens
cagggagtcccctccccggccct

SEQ ID NO: 6007822 - DNA, 16 bp, Homo sapiens
cagggagtgagcagct

SEQ ID NO: 6007823 - DNA, 19 bp, Homo sapiens
cagggagtgagcagctact

SEQ ID NO: 6007824 - DNA, 20 bp, Homo sapiens
cagggagtgagcagctactg

SEQ ID NO: 6007825 - DNA, 21 bp, Homo sapiens
cagggagtgagcagctactgt

SEQ ID NO: 6007826 - DNA, 22 bp, Homo sapiens
cagggagtgagcagctactgta

SEQ ID NO: 6007827 - DNA, 16 bp, Homo sapiens
cagggagtgctggctc

SEQ ID NO: 6007828 - DNA, 17 bp, Homo sapiens
cagggagtgctggctca

SEQ ID NO: 6007829 - DNA, 20 bp, Homo sapiens
cagggagtggggaggagaga

SEQ ID NO: 6007830 - DNA, 22 bp, Homo sapiens
cagggagtggggaggagagagg

SEQ ID NO: 6007831 - DNA, 19 bp, Homo sapiens
cagggataataacagcacc

SEQ ID NO: 6007832 - DNA, 23 bp, Homo sapiens
cagggataataacagcaccccat

SEQ ID NO: 6007833 - DNA, 14 bp, Homo sapiens
cagggatattgcct

SEQ ID NO: 6007834 - DNA, 19 bp, Homo sapiens
cagggatcacagaccacag

SEQ ID NO: 6007835 - DNA, 20 bp, Homo sapiens
cagggatccagggacacttt

SEQ ID NO: 6007836 - DNA, 20 bp, Homo sapiens
cagggatcctctctccaggc

SEQ ID NO: 6007837 - DNA, 15 bp, Homo sapiens
cagggatcttctccc

SEQ ID NO: 6007838 - DNA, 19 bp, Homo sapiens
cagggatcttgcattccca

SEQ ID NO: 6007839 - DNA, 19 bp, Homo sapiens
cagggatgagcatggagct

SEQ ID NO: 6007840 - DNA, 20 bp, Homo sapiens
cagggatgagcatggagctg

SEQ ID NO: 6007841 - DNA, 22 bp, Homo sapiens
cagggatgagcatggagctggc

SEQ ID NO: 6007842 - DNA, 18 bp, Homo sapiens
cagggatgattcccaccc

SEQ ID NO: 6007843 - DNA, 13 bp, Homo sapiens
cagggatgccctg

SEQ ID NO: 6007844 - DNA, 14 bp, Homo sapiens
cagggatgccctgg

SEQ ID NO: 6007845 - DNA, 20 bp, Homo sapiens
cagggatgccctggaggtgg

SEQ ID NO: 6007846 - DNA, 22 bp, Homo sapiens
cagggatgccctggaggtggct

SEQ ID NO: 6007847 - DNA, 22 bp, Homo sapiens
cagggatgctgggctgggccct

SEQ ID NO: 6007848 - DNA, 16 bp, Homo sapiens
cagggatggagggaag

SEQ ID NO: 6007849 - DNA, 21 bp, Homo sapiens
cagggatggagggaagacctg

SEQ ID NO: 6007850 - DNA, 19 bp, Homo sapiens
cagggatggccgttggcca

SEQ ID NO: 6007851 - DNA, 23 bp, Homo sapiens
cagggatgggaggtatgggctgg

SEQ ID NO: 6007852 - DNA, 21 bp, Homo sapiens
cagggatgggcagcccaacag

SEQ ID NO: 6007853 - DNA, 18 bp, Homo sapiens
cagggatggggccacagc

SEQ ID NO: 6007854 - DNA, 13 bp, Homo sapiens
cagggatggggga

SEQ ID NO: 6007855 - DNA, 18 bp, Homo sapiens
cagggatgggggtggctg

SEQ ID NO: 6007856 - DNA, 19 bp, Homo sapiens
cagggatgggggtggctgg

SEQ ID NO: 6007857 - DNA, 16 bp, Homo sapiens
cagggatggtgttcaa

SEQ ID NO: 6007858 - DNA, 21 bp, Homo sapiens
cagggatgtagattaaggtga

SEQ ID NO: 6007859 - DNA, 22 bp, Homo sapiens
cagggatgtgggttccacagac

SEQ ID NO: 6007860 - DNA, 17 bp, Homo sapiens
cagggattaacctctgc

SEQ ID NO: 6007861 - DNA, 18 bp, Homo sapiens
cagggattaacctctgca

SEQ ID NO: 6007862 - DNA, 12 bp, Homo sapiens
cagggattacag

SEQ ID NO: 6007863 - DNA, 18 bp, Homo sapiens
cagggattccctgtcccc

SEQ ID NO: 6007864 - DNA, 18 bp, Homo sapiens
cagggattgattttaaaa

SEQ ID NO: 6007865 - DNA, 21 bp, Homo sapiens
cagggattgattttaaaatgt

SEQ ID NO: 6007866 - DNA, 18 bp, Homo sapiens
cagggattgtttctgttt

SEQ ID NO: 6007867 - DNA, 14 bp, Homo sapiens
cagggatttgagga

SEQ ID NO: 6007868 - DNA, 16 bp, Homo sapiens
cagggatttgcctcac

SEQ ID NO: 6007869 - DNA, 17 bp, Homo sapiens
cagggatttgcctcacc

SEQ ID NO: 6007870 - DNA, 20 bp, Homo sapiens
cagggatttgcctcaccttg

SEQ ID NO: 6007871 - DNA, 21 bp, Homo sapiens
cagggatttgcctcaccttgg

SEQ ID NO: 6007872 - DNA, 20 bp, Homo sapiens
cagggatttgtccttgggga

SEQ ID NO: 6007873 - DNA, 21 bp, Homo sapiens
cagggcaaaagggcagctgtg

SEQ ID NO: 6007874 - DNA, 22 bp, Homo sapiens
cagggcaaaagggcagctgtga

SEQ ID NO: 6007875 - DNA, 15 bp, Homo sapiens
cagggcaaaatattc

SEQ ID NO: 6007876 - DNA, 22 bp, Homo sapiens
cagggcaaagccaggtccctct

SEQ ID NO: 6007877 - DNA, 23 bp, Homo sapiens
cagggcaaagccaggtccctctc

SEQ ID NO: 6007878 - DNA, 14 bp, Homo sapiens
cagggcaaatgaca

SEQ ID NO: 6007879 - DNA, 21 bp, Homo sapiens
cagggcaaatgacatgcactg

SEQ ID NO: 6007880 - DNA, 22 bp, Homo sapiens
cagggcaacataataagacttt

SEQ ID NO: 6007881 - DNA, 15 bp, Homo sapiens
cagggcaagctccgc

SEQ ID NO: 6007882 - DNA, 20 bp, Homo sapiens
cagggcaatcttgtccacag

SEQ ID NO: 6007883 - DNA, 18 bp, Homo sapiens
cagggcaatgatgaatga

SEQ ID NO: 6007884 - DNA, 14 bp, Homo sapiens
cagggcaatgccat

SEQ ID NO: 6007885 - DNA, 19 bp, Homo sapiens
cagggcaatgccatcagcc

SEQ ID NO: 6007886 - DNA, 24 bp, Homo sapiens
cagggcaatgccatcagcccctgg

SEQ ID NO: 6007887 - DNA, 11 bp, Homo sapiens
cagggcacaga

SEQ ID NO: 6007888 - DNA, 14 bp, Homo sapiens
cagggcacagaagg

SEQ ID NO: 6007889 - DNA, 19 bp, Homo sapiens
cagggcacagaaggctggg

SEQ ID NO: 6007890 - DNA, 13 bp, Homo sapiens
cagggcacaggag

SEQ ID NO: 6007891 - DNA, 18 bp, Homo sapiens
cagggcacaggagctacc

SEQ ID NO: 6007892 - DNA, 19 bp, Homo sapiens
cagggcacaggagctacct

SEQ ID NO: 6007893 - DNA, 21 bp, Homo sapiens
cagggcacaggagctacctgt

SEQ ID NO: 6007894 - DNA, 14 bp, Homo sapiens
cagggcacagggcc

SEQ ID NO: 6007895 - DNA, 16 bp, Homo sapiens
cagggcacagggcctg

SEQ ID NO: 6007896 - DNA, 17 bp, Homo sapiens
cagggcacagggcctgg

SEQ ID NO: 6007897 - DNA, 18 bp, Homo sapiens
cagggcaccagaggccga

SEQ ID NO: 6007898 - DNA, 22 bp, Homo sapiens
cagggcaccatccagctcccca

SEQ ID NO: 6007899 - DNA, 23 bp, Homo sapiens
cagggcaccatccagctccccag

SEQ ID NO: 6007900 - DNA, 21 bp, Homo sapiens
cagggcaccctgtggccctgg

SEQ ID NO: 6007901 - DNA, 16 bp, Homo sapiens
cagggcacgcaggacc

SEQ ID NO: 6007902 - DNA, 12 bp, Homo sapiens
cagggcacgtgg

SEQ ID NO: 6007903 - DNA, 11 bp, Homo sapiens
cagggcactgc

SEQ ID NO: 6007904 - DNA, 16 bp, Homo sapiens
cagggcactgccagcc

SEQ ID NO: 6007905 - DNA, 17 bp, Homo sapiens
cagggcactgccagccc

SEQ ID NO: 6007906 - DNA, 15 bp, Homo sapiens
cagggcactgctgct

SEQ ID NO: 6007907 - DNA, 18 bp, Homo sapiens
cagggcactgtctgcgtg

SEQ ID NO: 6007908 - DNA, 14 bp, Homo sapiens
cagggcagacagcc

SEQ ID NO: 6007909 - DNA, 13 bp, Homo sapiens
cagggcagagcag

SEQ ID NO: 6007910 - DNA, 19 bp, Homo sapiens
cagggcagaggaatgtagg

SEQ ID NO: 6007911 - DNA, 12 bp, Homo sapiens
cagggcagaggg

SEQ ID NO: 6007912 - DNA, 22 bp, Homo sapiens
cagggcagattttagttttatt

SEQ ID NO: 6007913 - DNA, 15 bp, Homo sapiens
cagggcagcaaggga

SEQ ID NO: 6007914 - DNA, 18 bp, Homo sapiens
cagggcagcaagggacct

SEQ ID NO: 6007915 - DNA, 15 bp, Homo sapiens
cagggcagcagatct

SEQ ID NO: 6007916 - DNA, 14 bp, Homo sapiens
cagggcagcaggcc

SEQ ID NO: 6007917 - DNA, 17 bp, Homo sapiens
cagggcagcaggccaga

SEQ ID NO: 6007918 - DNA, 18 bp, Homo sapiens
cagggcagcaggccagag

SEQ ID NO: 6007919 - DNA, 18 bp, Homo sapiens
cagaacatactgttctca

SEQ ID NO: 6007920 - DNA, 19 bp, Homo sapiens
cagaacatagacagaagaa

SEQ ID NO: 6007921 - DNA, 21 bp, Homo sapiens
cagaacatagacagaagaaac

SEQ ID NO: 6007922 - DNA, 16 bp, Homo sapiens
cagaacatcctccaat

SEQ ID NO: 6007923 - DNA, 14 bp, Homo sapiens
cagaacatgctgga

SEQ ID NO: 6007924 - DNA, 20 bp, Homo sapiens
cagaacatgtgggaggaaga

SEQ ID NO: 6007925 - DNA, 22 bp, Homo sapiens
cagaacattcagctctggagaa

SEQ ID NO: 6007926 - DNA, 16 bp, Homo sapiens
cagaacattgccttcc

SEQ ID NO: 6007927 - DNA, 23 bp, Homo sapiens
cagaacattgccttcctcgtgca

SEQ ID NO: 6007928 - DNA, 17 bp, Homo sapiens
cagaacatttctcatgt

SEQ ID NO: 6007929 - DNA, 18 bp, Homo sapiens
cagaacatttctcatgtg

SEQ ID NO: 6007930 - DNA, 19 bp, Homo sapiens
cagaacatttctcatgtgc

SEQ ID NO: 6007931 - DNA, 20 bp, Homo sapiens
cagaacatttctcatgtgct

SEQ ID NO: 6007932 - DNA, 16 bp, Homo sapiens
cagaaccaaagctcaa

SEQ ID NO: 6007933 - DNA, 20 bp, Homo sapiens
cagaaccaacgggtctgtgg

SEQ ID NO: 6007934 - DNA, 15 bp, Homo sapiens
cagaaccacactgtt

SEQ ID NO: 6007935 - DNA, 13 bp, Homo sapiens
cagaaccacagat

SEQ ID NO: 6007936 - DNA, 12 bp, Homo sapiens
cagaaccacagg

SEQ ID NO: 6007937 - DNA, 14 bp, Homo sapiens
cagaaccagagggt

SEQ ID NO: 6007938 - DNA, 16 bp, Homo sapiens
cagaaccagcactccc

SEQ ID NO: 6007939 - DNA, 21 bp, Homo sapiens
cagaaccagcactcccagggc

SEQ ID NO: 6007940 - DNA, 10 bp, Homo sapiens
cagaaccagg

SEQ ID NO: 6007941 - DNA, 22 bp, Homo sapiens
cagaaccagtccctctgagtga

SEQ ID NO: 6007942 - DNA, 20 bp, Homo sapiens
cagaaccagtgtctgaacca

SEQ ID NO: 6007943 - DNA, 18 bp, Homo sapiens
cagaaccattcactggca

SEQ ID NO: 6007944 - DNA, 19 bp, Homo sapiens
cagaaccatttcacccaga

SEQ ID NO: 6007945 - DNA, 15 bp, Homo sapiens
cagaacccacagtag

SEQ ID NO: 6007946 - DNA, 13 bp, Homo sapiens
cagaacccagggc

SEQ ID NO: 6007947 - DNA, 14 bp, Homo sapiens
cagaacccagggct

SEQ ID NO: 6007948 - DNA, 18 bp, Homo sapiens
cagaacccagggctctgc

SEQ ID NO: 6007949 - DNA, 20 bp, Homo sapiens
cagaacccagggctctgccc

SEQ ID NO: 6007950 - DNA, 16 bp, Homo sapiens
cagaaccccaactccc

SEQ ID NO: 6007951 - DNA, 17 bp, Homo sapiens
cagaaccctatccagtg

SEQ ID NO: 6007952 - DNA, 22 bp, Homo sapiens
cagaaccctggtgaggaagctc

SEQ ID NO: 6007953 - DNA, 14 bp, Homo sapiens
cagaacccttggct

SEQ ID NO: 6007954 - DNA, 19 bp, Homo sapiens
cagaaccggagagccagct

SEQ ID NO: 6007955 - DNA, 18 bp, Homo sapiens
cagaaccggtcccagcct

SEQ ID NO: 6007956 - DNA, 23 bp, Homo sapiens
cagaaccggtcccagcctgggct

SEQ ID NO: 6007957 - DNA, 17 bp, Homo sapiens
cagaacctcaattgaca

SEQ ID NO: 6007958 - DNA, 17 bp, Homo sapiens
cagaacctctaagtgct

SEQ ID NO: 6007959 - DNA, 19 bp, Homo sapiens
cagaacctctaagtgctgc

SEQ ID NO: 6007960 - DNA, 21 bp, Homo sapiens
cagaacctctaagtgctgctg

SEQ ID NO: 6007961 - DNA, 23 bp, Homo sapiens
cagaacctctaagtgctgctgtg

SEQ ID NO: 6007962 - DNA, 13 bp, Homo sapiens
cagaacctgcaca

SEQ ID NO: 6007963 - DNA, 18 bp, Homo sapiens
cagaacctgcacacagga

SEQ ID NO: 6007964 - DNA, 22 bp, Homo sapiens
cagaacctgcacacaggacagc

SEQ ID NO: 6007965 - DNA, 21 bp, Homo sapiens
cagaacctggagggctagaac

SEQ ID NO: 6007966 - DNA, 13 bp, Homo sapiens
cagaacctggtgg

SEQ ID NO: 6007967 - DNA, 23 bp, Homo sapiens
cagaaccttactggcactgtggc

SEQ ID NO: 6007968 - DNA, 20 bp, Homo sapiens
cagaaccttcaacccagtgg

SEQ ID NO: 6007969 - DNA, 13 bp, Homo sapiens
cagaaccttcccg

SEQ ID NO: 6007970 - DNA, 21 bp, Homo sapiens
cagaacctttggacaagagga

SEQ ID NO: 6007971 - DNA, 22 bp, Homo sapiens
cagaacctttggacaagaggaa

SEQ ID NO: 6007972 - DNA, 15 bp, Homo sapiens
cagaacctttgtcaa

SEQ ID NO: 6007973 - DNA, 19 bp, Homo sapiens
cagaacctttgtcaacttc

SEQ ID NO: 6007974 - DNA, 21 bp, Homo sapiens
cagaacgaaccttggcctggg

SEQ ID NO: 6007975 - DNA, 18 bp, Homo sapiens
cagaacgcaccccactgg

SEQ ID NO: 6007976 - DNA, 22 bp, Homo sapiens
cagaacgcaccccactgggaga

SEQ ID NO: 6007977 - DNA, 18 bp, Homo sapiens
cagaacgggttctcccat

SEQ ID NO: 6007978 - DNA, 15 bp, Homo sapiens
cagaacgtatttagc

SEQ ID NO: 6007979 - DNA, 16 bp, Homo sapiens
cagaacgtctctcacc

SEQ ID NO: 6007980 - DNA, 15 bp, Homo sapiens
cagaacgtggctctg

SEQ ID NO: 6007981 - DNA, 22 bp, Homo sapiens
cagaacgtggtttgcctgaggc

SEQ ID NO: 6007982 - DNA, 14 bp, Homo sapiens
cagaactaaatgtt

SEQ ID NO: 6007983 - DNA, 18 bp, Homo sapiens
cagaactaaatgttctat

SEQ ID NO: 6007984 - DNA, 22 bp, Homo sapiens
cagaactaaatttttcatagaa

SEQ ID NO: 6007985 - DNA, 15 bp, Homo sapiens
cagaactacatattt

SEQ ID NO: 6007986 - DNA, 16 bp, Homo sapiens
cagaactaccaaaatg

SEQ ID NO: 6007987 - DNA, 19 bp, Homo sapiens
cagaactaccacctgacat

SEQ ID NO: 6007988 - DNA, 16 bp, Homo sapiens
cagaactaccaggtgg

SEQ ID NO: 6007989 - DNA, 19 bp, Homo sapiens
cagaactagaatttgatta

SEQ ID NO: 6007990 - DNA, 22 bp, Homo sapiens
cagaactaggagtcttcactgc

SEQ ID NO: 6007991 - DNA, 21 bp, Homo sapiens
cagaactattctgggggcccg

SEQ ID NO: 6007992 - DNA, 20 bp, Homo sapiens
cagaactcaaatggggccag

SEQ ID NO: 6007993 - DNA, 13 bp, Homo sapiens
cagaactcccttc

SEQ ID NO: 6007994 - DNA, 14 bp, Homo sapiens
cagaactcctacct

SEQ ID NO: 6007995 - DNA, 15 bp, Homo sapiens
cagaactcctacctg

SEQ ID NO: 6007996 - DNA, 16 bp, Homo sapiens
cagaactcctgtgtgt

SEQ ID NO: 6007997 - DNA, 20 bp, Homo sapiens
cagaactcctgtgtgtggaa

SEQ ID NO: 6007998 - DNA, 16 bp, Homo sapiens
cagaactcctttctaa

SEQ ID NO: 6007999 - DNA, 15 bp, Homo sapiens
cagaactcgatgcac

SEQ ID NO: 6008000 - DNA, 23 bp, Homo sapiens
cagaactcgatgcactgacctgc

SEQ ID NO: 6008001 - DNA, 14 bp, Homo sapiens
cagaactctcagac

SEQ ID NO: 6008002 - DNA, 15 bp, Homo sapiens
cagaactctctgtct

SEQ ID NO: 6008003 - DNA, 18 bp, Homo sapiens
cagaactctgcctgccct

SEQ ID NO: 6008004 - DNA, 13 bp, Homo sapiens
cagaactctgtgt

SEQ ID NO: 6008005 - DNA, 15 bp, Homo sapiens
cagaactctttcaaa

SEQ ID NO: 6008006 - DNA, 13 bp, Homo sapiens
cagaactgaaata

SEQ ID NO: 6008007 - DNA, 15 bp, Homo sapiens
cagaactgaaataaa

SEQ ID NO: 6008008 - DNA, 21 bp, Homo sapiens
cagaactgaaccggctttacc

SEQ ID NO: 6008009 - DNA, 18 bp, Homo sapiens
cagaactgaacgtcctgc

SEQ ID NO: 6008010 - DNA, 19 bp, Homo sapiens
cagaactgaagccacttgg

SEQ ID NO: 6008011 - DNA, 21 bp, Homo sapiens
cagaactgaagccacttggcc

SEQ ID NO: 6008012 - DNA, 20 bp, Homo sapiens
cagaactgagctcctctggg

SEQ ID NO: 6008013 - DNA, 20 bp, Homo sapiens
cagaactgaggtcactgggt

SEQ ID NO: 6008014 - DNA, 13 bp, Homo sapiens
cagaactgcacaa

SEQ ID NO: 6008015 - DNA, 19 bp, Homo sapiens
cagaactgcagtcactgca

SEQ ID NO: 6008016 - DNA, 14 bp, Homo sapiens
cagaactgccatta

SEQ ID NO: 6008017 - DNA, 12 bp, Homo sapiens
cagaactgcccc

SEQ ID NO: 6008018 - DNA, 13 bp, Homo sapiens
cagaactgccccc

SEQ ID NO: 6008019 - DNA, 14 bp, Homo sapiens
cagaactgccccca

SEQ ID NO: 6008020 - DNA, 18 bp, Homo sapiens
cagaactgcccccactgt

SEQ ID NO: 6008021 - DNA, 12 bp, Homo sapiens
cagaactgccct

SEQ ID NO: 6008022 - DNA, 14 bp, Homo sapiens
cagaactgcccttg

SEQ ID NO: 6008023 - DNA, 18 bp, Homo sapiens
cagaactgcccttgctgc

SEQ ID NO: 6008024 - DNA, 17 bp, Homo sapiens
cagaactgctaaatact

SEQ ID NO: 6008025 - DNA, 23 bp, Homo sapiens
cagaactgctaaatactgtacat

SEQ ID NO: 6008026 - DNA, 16 bp, Homo sapiens
cagaactgctaccatg

SEQ ID NO: 6008027 - DNA, 19 bp, Homo sapiens
cagaactgctaccatgaag

SEQ ID NO: 6008028 - DNA, 23 bp, Homo sapiens
cagaactgctaccatgaagtgaa

SEQ ID NO: 6008029 - DNA, 16 bp, Homo sapiens
cagaactgctggggct

SEQ ID NO: 6008030 - DNA, 17 bp, Homo sapiens
cagaactgctggggctg

SEQ ID NO: 6008031 - DNA, 17 bp, Homo sapiens
cagaactgcttactagc

SEQ ID NO: 6008032 - DNA, 13 bp, Homo sapiens
cagaactgcttta

SEQ ID NO: 6008033 - DNA, 21 bp, Homo sapiens
cagaactggacgcccagctga

SEQ ID NO: 6008034 - DNA, 22 bp, Homo sapiens
cagaactggcaggagcctcgtg

SEQ ID NO: 6008035 - DNA, 16 bp, Homo sapiens
cagaactggctgggcc

SEQ ID NO: 6008036 - DNA, 20 bp, Homo sapiens
cagaactggctgggcccctg

SEQ ID NO: 6008037 - DNA, 22 bp, Homo sapiens
cagaactggctgggcccctggg

SEQ ID NO: 6008038 - DNA, 21 bp, Homo sapiens
cagaactgggaaaacagtgaa

SEQ ID NO: 6008039 - DNA, 21 bp, Homo sapiens
cagaactgtcccatccccagg

SEQ ID NO: 6008040 - DNA, 15 bp, Homo sapiens
cagaactgtcttagt

SEQ ID NO: 6008041 - DNA, 18 bp, Homo sapiens
cagaacttagcaatttcc

SEQ ID NO: 6008042 - DNA, 17 bp, Homo sapiens
cagaacttcacagtgac

SEQ ID NO: 6008043 - DNA, 13 bp, Homo sapiens
cagaacttcagaa

SEQ ID NO: 6008044 - DNA, 16 bp, Homo sapiens
cagaacttcagaaaga

SEQ ID NO: 6008045 - DNA, 15 bp, Homo sapiens
cagaacttcatctgc

SEQ ID NO: 6008046 - DNA, 17 bp, Homo sapiens
cagaacttcatctgcca

SEQ ID NO: 6008047 - DNA, 21 bp, Homo sapiens
cagaacttccctccatccacc

SEQ ID NO: 6008048 - DNA, 9 bp, Homo sapiens
cagaacttg

SEQ ID NO: 6008049 - DNA, 19 bp, Homo sapiens
cagaacttgaagcctgctc

SEQ ID NO: 6008050 - DNA, 20 bp, Homo sapiens
cagaacttgaagcctgctcc

SEQ ID NO: 6008051 - DNA, 22 bp, Homo sapiens
cagaacttgaagcctgctcctt

SEQ ID NO: 6008052 - DNA, 17 bp, Homo sapiens
cagaacttgctgctgtc

SEQ ID NO: 6008053 - DNA, 17 bp, Homo sapiens
cagaacttgtaactaaa

SEQ ID NO: 6008054 - DNA, 15 bp, Homo sapiens
cagaactttttcctc

SEQ ID NO: 6008055 - DNA, 24 bp, Homo sapiens
cagaagaaaaagaagctgaggaag

SEQ ID NO: 6008056 - DNA, 15 bp, Homo sapiens
cagaagaaaaagttg

SEQ ID NO: 6008057 - DNA, 21 bp, Homo sapiens
cagaagaaaaagttgcagtct

SEQ ID NO: 6008058 - DNA, 22 bp, Homo sapiens
cagaagaaaaagttgcagtctc

SEQ ID NO: 6008059 - DNA, 22 bp, Homo sapiens
cagaagaaaaggaaatgaacat

SEQ ID NO: 6008060 - DNA, 13 bp, Homo sapiens
cagaagaaaatag

SEQ ID NO: 6008061 - DNA, 16 bp, Homo sapiens
cagaagaaaggaacat

SEQ ID NO: 6008062 - DNA, 17 bp, Homo sapiens
cagaagaaaggccaagg

SEQ ID NO: 6008063 - DNA, 22 bp, Homo sapiens
cagaagaaataattgtgtcatg

SEQ ID NO: 6008064 - DNA, 17 bp, Homo sapiens
cagaagaagacagcaaa

SEQ ID NO: 6008065 - DNA, 18 bp, Homo sapiens
cagaagaagagaagctgc

SEQ ID NO: 6008066 - DNA, 19 bp, Homo sapiens
cagaagaagagaagctgct

SEQ ID NO: 6008067 - DNA, 16 bp, Homo sapiens
cagaagaagatgctgt

SEQ ID NO: 6008068 - DNA, 14 bp, Homo sapiens
cagaagaagtggga

SEQ ID NO: 6008069 - DNA, 20 bp, Homo sapiens
cagaagaagtgggagcagct

SEQ ID NO: 6008070 - DNA, 22 bp, Homo sapiens
cagaagaagtgggagcagcttc

SEQ ID NO: 6008071 - DNA, 16 bp, Homo sapiens
cagaagaatattcagg

SEQ ID NO: 6008072 - DNA, 20 bp, Homo sapiens
cagaagaatattcaggactt

SEQ ID NO: 6008073 - DNA, 20 bp, Homo sapiens
cagaagaattgaacccagga

SEQ ID NO: 6008074 - DNA, 12 bp, Homo sapiens
cagaagacaagg

SEQ ID NO: 6008075 - DNA, 21 bp, Homo sapiens
cagaagacaccagagcagatg

SEQ ID NO: 6008076 - DNA, 13 bp, Homo sapiens
cagaagacactaa

SEQ ID NO: 6008077 - DNA, 13 bp, Homo sapiens
cagaagaccccac

SEQ ID NO: 6008078 - DNA, 14 bp, Homo sapiens
cagaagaccccact

SEQ ID NO: 6008079 - DNA, 21 bp, Homo sapiens
cagaagacgggaggggaggca

SEQ ID NO: 6008080 - DNA, 22 bp, Homo sapiens
cagaagacgggaggggaggcat

SEQ ID NO: 6008081 - DNA, 18 bp, Homo sapiens
cagaagactagaggccag

SEQ ID NO: 6008082 - DNA, 19 bp, Homo sapiens
cagaagactagaggccagg

SEQ ID NO: 6008083 - DNA, 24 bp, Homo sapiens
cagaagactagaggccagggcagc

SEQ ID NO: 6008084 - DNA, 19 bp, Homo sapiens
cagaagactatttaccagg

SEQ ID NO: 6008085 - DNA, 16 bp, Homo sapiens
cagaagactcctaggc

SEQ ID NO: 6008086 - DNA, 17 bp, Homo sapiens
cagaagactcctaggcc

SEQ ID NO: 6008087 - DNA, 19 bp, Homo sapiens
cagaagactcctaggccct

SEQ ID NO: 6008088 - DNA, 20 bp, Homo sapiens
cagaagactcctaggccctt

SEQ ID NO: 6008089 - DNA, 15 bp, Homo sapiens
cagaagactctccac

SEQ ID NO: 6008090 - DNA, 20 bp, Homo sapiens
cagaagactctccactgacc

SEQ ID NO: 6008091 - DNA, 20 bp, Homo sapiens
cagaagacttcaatattaaa

SEQ ID NO: 6008092 - DNA, 19 bp, Homo sapiens
cagaagagaaaccatcctc

SEQ ID NO: 6008093 - DNA, 16 bp, Homo sapiens
cagaagagaaagtaca

SEQ ID NO: 6008094 - DNA, 20 bp, Homo sapiens
cagaagagaaatacagctgg

SEQ ID NO: 6008095 - DNA, 19 bp, Homo sapiens
cagaagagactgatccaaa

SEQ ID NO: 6008096 - DNA, 15 bp, Homo sapiens
cagggcagcagtggg

SEQ ID NO: 6008097 - DNA, 20 bp, Homo sapiens
cagggcagcagtggggtgaa

SEQ ID NO: 6008098 - DNA, 16 bp, Homo sapiens
cagggcagccagggag

SEQ ID NO: 6008099 - DNA, 23 bp, Homo sapiens
cagggcagccagggagagcccag

SEQ ID NO: 6008100 - DNA, 16 bp, Homo sapiens
cagggcagcccctgca

SEQ ID NO: 6008101 - DNA, 17 bp, Homo sapiens
cagggcagcccctgcag

SEQ ID NO: 6008102 - DNA, 13 bp, Homo sapiens
cagggcagcctcg

SEQ ID NO: 6008103 - DNA, 22 bp, Homo sapiens
cagggcagcctcgcggtcttgg

SEQ ID NO: 6008104 - DNA, 22 bp, Homo sapiens
cagggcagcctcgttaggacaa

SEQ ID NO: 6008105 - DNA, 17 bp, Homo sapiens
cagggcagcctggatcc

SEQ ID NO: 6008106 - DNA, 19 bp, Homo sapiens
cagggcagcctgtgggaga

SEQ ID NO: 6008107 - DNA, 13 bp, Homo sapiens
cagggcagcgcca

SEQ ID NO: 6008108 - DNA, 17 bp, Homo sapiens
cagggcagcggctccac

SEQ ID NO: 6008109 - DNA, 18 bp, Homo sapiens
cagggcagcggtcttctc

SEQ ID NO: 6008110 - DNA, 13 bp, Homo sapiens
cagggcagctgcc

SEQ ID NO: 6008111 - DNA, 15 bp, Homo sapiens
cagggcagctgcctg

SEQ ID NO: 6008112 - DNA, 17 bp, Homo sapiens
cagggcagctgcctggc

SEQ ID NO: 6008113 - DNA, 16 bp, Homo sapiens
cagggcagctgggccc

SEQ ID NO: 6008114 - DNA, 17 bp, Homo sapiens
cagggcaggaaggggaa

SEQ ID NO: 6008115 - DNA, 13 bp, Homo sapiens
cagggcaggagct

SEQ ID NO: 6008116 - DNA, 16 bp, Homo sapiens
cagggcaggagctgct

SEQ ID NO: 6008117 - DNA, 16 bp, Homo sapiens
cagggcaggcagagct

SEQ ID NO: 6008118 - DNA, 19 bp, Homo sapiens
cagggcaggccttgctggg

SEQ ID NO: 6008119 - DNA, 17 bp, Homo sapiens
cagggcagggcagcctg

SEQ ID NO: 6008120 - DNA, 12 bp, Homo sapiens
cagggcagggcc

SEQ ID NO: 6008121 - DNA, 15 bp, Homo sapiens
cagggcagggccacc

SEQ ID NO: 6008122 - DNA, 13 bp, Homo sapiens
cagggcagggccc

SEQ ID NO: 6008123 - DNA, 18 bp, Homo sapiens
cagggcagggcgagctgc

SEQ ID NO: 6008124 - DNA, 15 bp, Homo sapiens
cagggcagggctctg

SEQ ID NO: 6008125 - DNA, 17 bp, Homo sapiens
cagggcagggctctgat

SEQ ID NO: 6008126 - DNA, 21 bp, Homo sapiens
cagggcagggtagtgcagggc

SEQ ID NO: 6008127 - DNA, 14 bp, Homo sapiens
cagggcagggtctg

SEQ ID NO: 6008128 - DNA, 22 bp, Homo sapiens
cagggcagggtgggcagcctat

SEQ ID NO: 6008129 - DNA, 23 bp, Homo sapiens
cagggcagggtgggcagcctatg

SEQ ID NO: 6008130 - DNA, 21 bp, Homo sapiens
cagggcagtcattggctgtct

SEQ ID NO: 6008131 - DNA, 13 bp, Homo sapiens
cagggcagtgaca

SEQ ID NO: 6008132 - DNA, 21 bp, Homo sapiens
cagggcagtggccaagcctgc

SEQ ID NO: 6008133 - DNA, 18 bp, Homo sapiens
cagggcataggaagaaaa

SEQ ID NO: 6008134 - DNA, 23 bp, Homo sapiens
cagggcataggaagaaaatgtca

SEQ ID NO: 6008135 - DNA, 19 bp, Homo sapiens
cagggcatattaaaggctt

SEQ ID NO: 6008136 - DNA, 19 bp, Homo sapiens
cagggcatccgcagcccag

SEQ ID NO: 6008137 - DNA, 20 bp, Homo sapiens
cagggcatccgcagcccagg

SEQ ID NO: 6008138 - DNA, 16 bp, Homo sapiens
cagggcatctccagga

SEQ ID NO: 6008139 - DNA, 17 bp, Homo sapiens
cagggcatctccaggaa

SEQ ID NO: 6008140 - DNA, 18 bp, Homo sapiens
cagggcatctctgggctg

SEQ ID NO: 6008141 - DNA, 20 bp, Homo sapiens
cagggcatctctgggctgga

SEQ ID NO: 6008142 - DNA, 19 bp, Homo sapiens
cagggcatcttgctggcta

SEQ ID NO: 6008143 - DNA, 15 bp, Homo sapiens
cagggcatgaaatga

SEQ ID NO: 6008144 - DNA, 20 bp, Homo sapiens
cagggcatgggattaaagag

SEQ ID NO: 6008145 - DNA, 20 bp, Homo sapiens
cagggcattcgggccacagg

SEQ ID NO: 6008146 - DNA, 15 bp, Homo sapiens
cagggcattgctcag

SEQ ID NO: 6008147 - DNA, 18 bp, Homo sapiens
cagggcattgctcagccc

SEQ ID NO: 6008148 - DNA, 17 bp, Homo sapiens
cagggccaaagcacagc

SEQ ID NO: 6008149 - DNA, 22 bp, Homo sapiens
cagggccaaagcacagctgggc

SEQ ID NO: 6008150 - DNA, 23 bp, Homo sapiens
cagggccaaagcacagctgggca

SEQ ID NO: 6008151 - DNA, 17 bp, Homo sapiens
cagggccaacttgaggg

SEQ ID NO: 6008152 - DNA, 19 bp, Homo sapiens
cagggccaacttgagggcc

SEQ ID NO: 6008153 - DNA, 22 bp, Homo sapiens
cagggccaacttgagggcccag

SEQ ID NO: 6008154 - DNA, 15 bp, Homo sapiens
cagggccaagccggc

SEQ ID NO: 6008155 - DNA, 20 bp, Homo sapiens
cagggccaagccggcccaac

SEQ ID NO: 6008156 - DNA, 16 bp, Homo sapiens
cagggccaccccactc

SEQ ID NO: 6008157 - DNA, 17 bp, Homo sapiens
cagggccaccccactct

SEQ ID NO: 6008158 - DNA, 18 bp, Homo sapiens
cagggccaccccactcta

SEQ ID NO: 6008159 - DNA, 18 bp, Homo sapiens
cagggccacctgcaggac

SEQ ID NO: 6008160 - DNA, 21 bp, Homo sapiens
cagggccacctgcaggaccct

SEQ ID NO: 6008161 - DNA, 23 bp, Homo sapiens
cagggccacgctccagctgcccc

SEQ ID NO: 6008162 - DNA, 16 bp, Homo sapiens
cagggccactcaacag

SEQ ID NO: 6008163 - DNA, 13 bp, Homo sapiens
cagggccactccc

SEQ ID NO: 6008164 - DNA, 15 bp, Homo sapiens
cagggccacttttga

SEQ ID NO: 6008165 - DNA, 19 bp, Homo sapiens
cagggccagaaggagggca

SEQ ID NO: 6008166 - DNA, 20 bp, Homo sapiens
cagggccagaaggagggcag

SEQ ID NO: 6008167 - DNA, 16 bp, Homo sapiens
cagggccagactggaa

SEQ ID NO: 6008168 - DNA, 12 bp, Homo sapiens
cagggccagagc

SEQ ID NO: 6008169 - DNA, 13 bp, Homo sapiens
cagggccagaggg

SEQ ID NO: 6008170 - DNA, 14 bp, Homo sapiens
cagggccagaggga

SEQ ID NO: 6008171 - DNA, 16 bp, Homo sapiens
cagggccagcaggcag

SEQ ID NO: 6008172 - DNA, 22 bp, Homo sapiens
cagggccagcaggcagcgcctg

SEQ ID NO: 6008173 - DNA, 14 bp, Homo sapiens
cagggccagcctct

SEQ ID NO: 6008174 - DNA, 13 bp, Homo sapiens
cagggccaggact

SEQ ID NO: 6008175 - DNA, 13 bp, Homo sapiens
cagggccaggcct

SEQ ID NO: 6008176 - DNA, 16 bp, Homo sapiens
cagggccaggcctctg

SEQ ID NO: 6008177 - DNA, 17 bp, Homo sapiens
cagggccaggcctctgc

SEQ ID NO: 6008178 - DNA, 11 bp, Homo sapiens
cagggccaggg

SEQ ID NO: 6008179 - DNA, 14 bp, Homo sapiens
cagggccagggcaa

SEQ ID NO: 6008180 - DNA, 18 bp, Homo sapiens
cagggccagggcaatgcc

SEQ ID NO: 6008181 - DNA, 22 bp, Homo sapiens
cagggccaggtcctcacagcag

SEQ ID NO: 6008182 - DNA, 23 bp, Homo sapiens
cagggccaggtcctcacagcagt

SEQ ID NO: 6008183 - DNA, 20 bp, Homo sapiens
cagggccaggtgcagacctt

SEQ ID NO: 6008184 - DNA, 14 bp, Homo sapiens
cagggccagtggga

SEQ ID NO: 6008185 - DNA, 15 bp, Homo sapiens
cagggccatccactg

SEQ ID NO: 6008186 - DNA, 16 bp, Homo sapiens
cagggccatccactgt

SEQ ID NO: 6008187 - DNA, 19 bp, Homo sapiens
cagggccatccactgtgac

SEQ ID NO: 6008188 - DNA, 17 bp, Homo sapiens
cagggccatgcagacct

SEQ ID NO: 6008189 - DNA, 18 bp, Homo sapiens
cagggccatgcagacctc

SEQ ID NO: 6008190 - DNA, 16 bp, Homo sapiens
cagggccatgcctgcc

SEQ ID NO: 6008191 - DNA, 14 bp, Homo sapiens
cagggccatgctga

SEQ ID NO: 6008192 - DNA, 18 bp, Homo sapiens
cagggccatgctgaggcc

SEQ ID NO: 6008193 - DNA, 22 bp, Homo sapiens
cagggccatgctgaggcctggg

SEQ ID NO: 6008194 - DNA, 17 bp, Homo sapiens
cagggccatgtcagaca

SEQ ID NO: 6008195 - DNA, 17 bp, Homo sapiens
cagggcccaaataacag

SEQ ID NO: 6008196 - DNA, 18 bp, Homo sapiens
cagggcccaagtccctgt

SEQ ID NO: 6008197 - DNA, 21 bp, Homo sapiens
cagggcccacccccaggaagg

SEQ ID NO: 6008198 - DNA, 14 bp, Homo sapiens
cagggcccacctcc

SEQ ID NO: 6008199 - DNA, 20 bp, Homo sapiens
cagggcccacctcctccagc

SEQ ID NO: 6008200 - DNA, 15 bp, Homo sapiens
cagggcccaccttgg

SEQ ID NO: 6008201 - DNA, 17 bp, Homo sapiens
cagggcccaccttggac

SEQ ID NO: 6008202 - DNA, 23 bp, Homo sapiens
cagggcccaccttggaccctggt

SEQ ID NO: 6008203 - DNA, 14 bp, Homo sapiens
cagggcccacgtgt

SEQ ID NO: 6008204 - DNA, 12 bp, Homo sapiens
cagggcccagag

SEQ ID NO: 6008205 - DNA, 13 bp, Homo sapiens
cagggcccagagc

SEQ ID NO: 6008206 - DNA, 15 bp, Homo sapiens
cagggcccagagccc

SEQ ID NO: 6008207 - DNA, 18 bp, Homo sapiens
cagggcccagagcccttg

SEQ ID NO: 6008208 - DNA, 19 bp, Homo sapiens
cagggcccagcggtccctg

SEQ ID NO: 6008209 - DNA, 16 bp, Homo sapiens
cagggcccaggcctgg

SEQ ID NO: 6008210 - DNA, 15 bp, Homo sapiens
cagggcccagggagg

SEQ ID NO: 6008211 - DNA, 16 bp, Homo sapiens
cagggcccagggaggt

SEQ ID NO: 6008212 - DNA, 19 bp, Homo sapiens
cagggcccagggaggtggc

SEQ ID NO: 6008213 - DNA, 21 bp, Homo sapiens
cagggcccagggaggtggcag

SEQ ID NO: 6008214 - DNA, 14 bp, Homo sapiens
cagggcccaggtga

SEQ ID NO: 6008215 - DNA, 21 bp, Homo sapiens
cagggccccagaaggcaggga

SEQ ID NO: 6008216 - DNA, 20 bp, Homo sapiens
cagggcccccaataaaccag

SEQ ID NO: 6008217 - DNA, 15 bp, Homo sapiens
cagggcccccacagg

SEQ ID NO: 6008218 - DNA, 16 bp, Homo sapiens
cagggcccccatctca

SEQ ID NO: 6008219 - DNA, 15 bp, Homo sapiens
cagggcccccatgca

SEQ ID NO: 6008220 - DNA, 17 bp, Homo sapiens
cagggcccccatgcagg

SEQ ID NO: 6008221 - DNA, 17 bp, Homo sapiens
cagggccccccaactgt

SEQ ID NO: 6008222 - DNA, 16 bp, Homo sapiens
cagggcccccggccac

SEQ ID NO: 6008223 - DNA, 18 bp, Homo sapiens
cagggcccctcaccctgc

SEQ ID NO: 6008224 - DNA, 22 bp, Homo sapiens
cagggcccctcaccctgcctta

SEQ ID NO: 6008225 - DNA, 19 bp, Homo sapiens
cagggcccctccctctgcc

SEQ ID NO: 6008226 - DNA, 15 bp, Homo sapiens
cagggcccctctccc

SEQ ID NO: 6008227 - DNA, 19 bp, Homo sapiens
cagggcccctgaagtgacc

SEQ ID NO: 6008228 - DNA, 18 bp, Homo sapiens
cagggcccctgaccctcc

SEQ ID NO: 6008229 - DNA, 16 bp, Homo sapiens
cagggcccctggatct

SEQ ID NO: 6008230 - DNA, 19 bp, Homo sapiens
cagggcccgagcgcgtgcc

SEQ ID NO: 6008231 - DNA, 20 bp, Homo sapiens
cagggcccgcagtgctggga

SEQ ID NO: 6008232 - DNA, 21 bp, Homo sapiens
cagggcccgcagtgctgggac

SEQ ID NO: 6008233 - DNA, 19 bp, Homo sapiens
cagggcccgggcacccaca

SEQ ID NO: 6008234 - DNA, 12 bp, Homo sapiens
cagggccctccc

SEQ ID NO: 6008235 - DNA, 14 bp, Homo sapiens
cagggccctcccag

SEQ ID NO: 6008236 - DNA, 15 bp, Homo sapiens
cagggccctgagctc

SEQ ID NO: 6008237 - DNA, 21 bp, Homo sapiens
cagggccctgagctcggtgga

SEQ ID NO: 6008238 - DNA, 16 bp, Homo sapiens
cagggccctgccccag

SEQ ID NO: 6008239 - DNA, 18 bp, Homo sapiens
cagggccctgccccaggc

SEQ ID NO: 6008240 - DNA, 20 bp, Homo sapiens
cagggccctgccccaggcct

SEQ ID NO: 6008241 - DNA, 21 bp, Homo sapiens
cagggccctgccccaggcctg

SEQ ID NO: 6008242 - DNA, 23 bp, Homo sapiens
cagggccctgccccaggcctgga

SEQ ID NO: 6008243 - DNA, 12 bp, Homo sapiens
cagggccctgct

SEQ ID NO: 6008244 - DNA, 20 bp, Homo sapiens
cagggccctgctcaggcctc

SEQ ID NO: 6008245 - DNA, 21 bp, Homo sapiens
cagggccctgctcaggcctca

SEQ ID NO: 6008246 - DNA, 13 bp, Homo sapiens
cagggccctggag

SEQ ID NO: 6008247 - DNA, 14 bp, Homo sapiens
cagggccctggagc

SEQ ID NO: 6008248 - DNA, 15 bp, Homo sapiens
cagggccctgggcag

SEQ ID NO: 6008249 - DNA, 17 bp, Homo sapiens
cagggccctgggcaggg

SEQ ID NO: 6008250 - DNA, 22 bp, Homo sapiens
cagggccctggggtctctgagc

SEQ ID NO: 6008251 - DNA, 12 bp, Homo sapiens
cagggccctgtg

SEQ ID NO: 6008252 - DNA, 16 bp, Homo sapiens
cagggccctgtggctc

SEQ ID NO: 6008253 - DNA, 24 bp, Homo sapiens
cagggccctgtggctccaggagca

SEQ ID NO: 6008254 - DNA, 21 bp, Homo sapiens
cagggcccttggggctggggg

SEQ ID NO: 6008255 - DNA, 14 bp, Homo sapiens
cagggccgaggagg

SEQ ID NO: 6008256 - DNA, 16 bp, Homo sapiens
cagggccgcagggcgc

SEQ ID NO: 6008257 - DNA, 17 bp, Homo sapiens
cagggccgcagggcgct

SEQ ID NO: 6008258 - DNA, 19 bp, Homo sapiens
cagggccgcccgggcccag

SEQ ID NO: 6008259 - DNA, 22 bp, Homo sapiens
cagggccgcccgggcccagagg

SEQ ID NO: 6008260 - DNA, 16 bp, Homo sapiens
cagggccgcgagaggc

SEQ ID NO: 6008261 - DNA, 16 bp, Homo sapiens
cagggccgctcgatgc

SEQ ID NO: 6008262 - DNA, 20 bp, Homo sapiens
cagggccgcttctcctgcag

SEQ ID NO: 6008263 - DNA, 15 bp, Homo sapiens
cagggccgggcaggg

SEQ ID NO: 6008264 - DNA, 21 bp, Homo sapiens
cagggccgggcagggggacag

SEQ ID NO: 6008265 - DNA, 12 bp, Homo sapiens
cagggccgggga

SEQ ID NO: 6008266 - DNA, 22 bp, Homo sapiens
cagggccggggaactggccaag

SEQ ID NO: 6008267 - DNA, 24 bp, Homo sapiens
cagggccggggaactggccaagct

SEQ ID NO: 6008268 - DNA, 19 bp, Homo sapiens
cagggccgtcaaggaaagg

SEQ ID NO: 6008269 - DNA, 23 bp, Homo sapiens
cagggcctactgccacccgcttc

SEQ ID NO: 6008270 - DNA, 13 bp, Homo sapiens
cagggcctagagg

SEQ ID NO: 6008271 - DNA, 16 bp, Homo sapiens
cagggcctcacacggt

SEQ ID NO: 6008272 - DNA, 23 bp, Homo sapiens
cagggcctccagccctctcactg

SEQ ID NO: 6008273 - DNA, 13 bp, Homo sapiens
cagggcctccagg

SEQ ID NO: 6008274 - DNA, 21 bp, Homo sapiens
cagaagagagtggggcctgcc

SEQ ID NO: 6008275 - DNA, 16 bp, Homo sapiens
cagaagagggggaggg

SEQ ID NO: 6008276 - DNA, 22 bp, Homo sapiens
cagaagaggttgggcttccatg

SEQ ID NO: 6008277 - DNA, 17 bp, Homo sapiens
cagaagagtcaaagtag

SEQ ID NO: 6008278 - DNA, 18 bp, Homo sapiens
cagaagagtttcttaact

SEQ ID NO: 6008279 - DNA, 20 bp, Homo sapiens
cagaagagtttcttaactta

SEQ ID NO: 6008280 - DNA, 15 bp, Homo sapiens
cagaagataacttga

SEQ ID NO: 6008281 - DNA, 23 bp, Homo sapiens
cagaagatagagattcccctgga

SEQ ID NO: 6008282 - DNA, 18 bp, Homo sapiens
cagaagatcccctcagga

SEQ ID NO: 6008283 - DNA, 19 bp, Homo sapiens
cagaagatcccctcaggac

SEQ ID NO: 6008284 - DNA, 23 bp, Homo sapiens
cagaagatcccctcaggactgca

SEQ ID NO: 6008285 - DNA, 19 bp, Homo sapiens
cagaagatgccagcttctc

SEQ ID NO: 6008286 - DNA, 20 bp, Homo sapiens
cagaagatgccagcttctct

SEQ ID NO: 6008287 - DNA, 14 bp, Homo sapiens
cagaagatgccctc

SEQ ID NO: 6008288 - DNA, 16 bp, Homo sapiens
cagaagatgccctcca

SEQ ID NO: 6008289 - DNA, 15 bp, Homo sapiens
cagaagatggtgaag

SEQ ID NO: 6008290 - DNA, 13 bp, Homo sapiens
cagaagatgtatt

SEQ ID NO: 6008291 - DNA, 21 bp, Homo sapiens
cagaagatgtattcagagcca

SEQ ID NO: 6008292 - DNA, 17 bp, Homo sapiens
cagaagatgtttaaaaa

SEQ ID NO: 6008293 - DNA, 21 bp, Homo sapiens
cagaagattgcgtagctctca

SEQ ID NO: 6008294 - DNA, 11 bp, Homo sapiens
cagaagcagag

SEQ ID NO: 6008295 - DNA, 14 bp, Homo sapiens
cagaagcagaggct

SEQ ID NO: 6008296 - DNA, 23 bp, Homo sapiens
cagaagcagcccctcgaggccta

SEQ ID NO: 6008297 - DNA, 13 bp, Homo sapiens
cagaagcagctct

SEQ ID NO: 6008298 - DNA, 11 bp, Homo sapiens
cagaagcaggc

SEQ ID NO: 6008299 - DNA, 13 bp, Homo sapiens
cagaagcaggcag

SEQ ID NO: 6008300 - DNA, 14 bp, Homo sapiens
cagaagcaggcagg

SEQ ID NO: 6008301 - DNA, 21 bp, Homo sapiens
cagaagcagggtaccctttgg

SEQ ID NO: 6008302 - DNA, 18 bp, Homo sapiens
cagaagcatattttgctg

SEQ ID NO: 6008303 - DNA, 14 bp, Homo sapiens
cagaagcatttgta

SEQ ID NO: 6008304 - DNA, 15 bp, Homo sapiens
cagaagcatttgtat

SEQ ID NO: 6008305 - DNA, 17 bp, Homo sapiens
cagaagcatttgtattt

SEQ ID NO: 6008306 - DNA, 19 bp, Homo sapiens
cagaagcatttgtattttg

SEQ ID NO: 6008307 - DNA, 14 bp, Homo sapiens
cagaagccaaattt

SEQ ID NO: 6008308 - DNA, 22 bp, Homo sapiens
cagaagccaagctccctggagc

SEQ ID NO: 6008309 - DNA, 17 bp, Homo sapiens
cagaagccaagggaaga

SEQ ID NO: 6008310 - DNA, 17 bp, Homo sapiens
cagaagccaggagcaaa

SEQ ID NO: 6008311 - DNA, 13 bp, Homo sapiens
cagaagccagtct

SEQ ID NO: 6008312 - DNA, 18 bp, Homo sapiens
cagaagccagtctgcgtc

SEQ ID NO: 6008313 - DNA, 14 bp, Homo sapiens
cagaagcccagaat

SEQ ID NO: 6008314 - DNA, 18 bp, Homo sapiens
cagaagcccatgtcttct

SEQ ID NO: 6008315 - DNA, 20 bp, Homo sapiens
cagaagcccatgtcttctgc

SEQ ID NO: 6008316 - DNA, 20 bp, Homo sapiens
cagaagccccacagcctggc

SEQ ID NO: 6008317 - DNA, 17 bp, Homo sapiens
cagaagcctattgtaaa

SEQ ID NO: 6008318 - DNA, 22 bp, Homo sapiens
cagaagcctattgtaaatacaa

SEQ ID NO: 6008319 - DNA, 19 bp, Homo sapiens
cagaagcctccaagcacag

SEQ ID NO: 6008320 - DNA, 22 bp, Homo sapiens
cagaagcctccaagcctgcctc

SEQ ID NO: 6008321 - DNA, 23 bp, Homo sapiens
cagaagcctccttacattaaaaa

SEQ ID NO: 6008322 - DNA, 13 bp, Homo sapiens
cagaagcctgatc

SEQ ID NO: 6008323 - DNA, 18 bp, Homo sapiens
cagaagcctgatgctgac

SEQ ID NO: 6008324 - DNA, 18 bp, Homo sapiens
cagaagcctggactctgc

SEQ ID NO: 6008325 - DNA, 24 bp, Homo sapiens
cagaagcctgggggcctggctggc

SEQ ID NO: 6008326 - DNA, 14 bp, Homo sapiens
cagaagccttcttg

SEQ ID NO: 6008327 - DNA, 18 bp, Homo sapiens
cagaagccttcttgctgc

SEQ ID NO: 6008328 - DNA, 21 bp, Homo sapiens
cagaagccttcttgctgccca

SEQ ID NO: 6008329 - DNA, 23 bp, Homo sapiens
cagaagccttcttgctgcccaca

SEQ ID NO: 6008330 - DNA, 16 bp, Homo sapiens
cagaagcggcctgtgc

SEQ ID NO: 6008331 - DNA, 15 bp, Homo sapiens
cagaagcgtctccct

SEQ ID NO: 6008332 - DNA, 16 bp, Homo sapiens
cagaagcgtctccctt

SEQ ID NO: 6008333 - DNA, 17 bp, Homo sapiens
cagaagcgtctcccttg

SEQ ID NO: 6008334 - DNA, 14 bp, Homo sapiens
cagaagctatttca

SEQ ID NO: 6008335 - DNA, 17 bp, Homo sapiens
cagaagctatttcattt

SEQ ID NO: 6008336 - DNA, 23 bp, Homo sapiens
cagaagctatttcatttgctgtt

SEQ ID NO: 6008337 - DNA, 19 bp, Homo sapiens
cagaagctcaaggctgcag

SEQ ID NO: 6008338 - DNA, 19 bp, Homo sapiens
cagaagctcccccagcaaa

SEQ ID NO: 6008339 - DNA, 15 bp, Homo sapiens
cagaagctctcgatg

SEQ ID NO: 6008340 - DNA, 22 bp, Homo sapiens
cagaagctcttactctttccta

SEQ ID NO: 6008341 - DNA, 16 bp, Homo sapiens
cagaagctgagcacca

SEQ ID NO: 6008342 - DNA, 21 bp, Homo sapiens
cagaagctgagcaccagggga

SEQ ID NO: 6008343 - DNA, 16 bp, Homo sapiens
cagaagcttctgccca

SEQ ID NO: 6008344 - DNA, 17 bp, Homo sapiens
cagaagcttggaggagg

SEQ ID NO: 6008345 - DNA, 20 bp, Homo sapiens
cagaagcttggaggagggtt

SEQ ID NO: 6008346 - DNA, 15 bp, Homo sapiens
cagaagcttgtatta

SEQ ID NO: 6008347 - DNA, 22 bp, Homo sapiens
cagaagcttgtggggtacatgg

SEQ ID NO: 6008348 - DNA, 19 bp, Homo sapiens
cagaaggaaaagagtaatg

SEQ ID NO: 6008349 - DNA, 17 bp, Homo sapiens
cagaaggaaagaagggg

SEQ ID NO: 6008350 - DNA, 16 bp, Homo sapiens
cagaaggaaatgatgg

SEQ ID NO: 6008351 - DNA, 17 bp, Homo sapiens
cagaaggaaatgatgga

SEQ ID NO: 6008352 - DNA, 16 bp, Homo sapiens
cagaaggaagacttca

SEQ ID NO: 6008353 - DNA, 20 bp, Homo sapiens
cagaaggaagcaaaatccct

SEQ ID NO: 6008354 - DNA, 18 bp, Homo sapiens
cagaaggaagccctctca

SEQ ID NO: 6008355 - DNA, 20 bp, Homo sapiens
cagaaggaagccctctcaga

SEQ ID NO: 6008356 - DNA, 12 bp, Homo sapiens
cagaaggaagga

SEQ ID NO: 6008357 - DNA, 23 bp, Homo sapiens
cagaaggaaggagccagctccca

SEQ ID NO: 6008358 - DNA, 15 bp, Homo sapiens
cagaaggaaggcagg

SEQ ID NO: 6008359 - DNA, 21 bp, Homo sapiens
cagaaggaagggcatccttct

SEQ ID NO: 6008360 - DNA, 12 bp, Homo sapiens
cagaaggaaggt

SEQ ID NO: 6008361 - DNA, 14 bp, Homo sapiens
cagaaggaatctgt

SEQ ID NO: 6008362 - DNA, 21 bp, Homo sapiens
cagaaggaatggtgcgtggct

SEQ ID NO: 6008363 - DNA, 18 bp, Homo sapiens
cagaaggacggcaggagt

SEQ ID NO: 6008364 - DNA, 16 bp, Homo sapiens
cagaaggactggtgcg

SEQ ID NO: 6008365 - DNA, 14 bp, Homo sapiens
cagaaggagaagga

SEQ ID NO: 6008366 - DNA, 22 bp, Homo sapiens
cagaaggagaaggctggagaag

SEQ ID NO: 6008367 - DNA, 13 bp, Homo sapiens
cagaaggagacag

SEQ ID NO: 6008368 - DNA, 19 bp, Homo sapiens
cagaaggagagtgagtgcc

SEQ ID NO: 6008369 - DNA, 23 bp, Homo sapiens
cagaaggagcaggccctgggcct

SEQ ID NO: 6008370 - DNA, 14 bp, Homo sapiens
cagaaggaggaagg

SEQ ID NO: 6008371 - DNA, 14 bp, Homo sapiens
cagaaggaggagga

SEQ ID NO: 6008372 - DNA, 15 bp, Homo sapiens
cagaaggagggcaga

SEQ ID NO: 6008373 - DNA, 21 bp, Homo sapiens
cagaaggagggcagagccatg

SEQ ID NO: 6008374 - DNA, 13 bp, Homo sapiens
cagaaggaggggg

SEQ ID NO: 6008375 - DNA, 14 bp, Homo sapiens
cagaaggatttctt

SEQ ID NO: 6008376 - DNA, 18 bp, Homo sapiens
cagaaggcaaagtttcca

SEQ ID NO: 6008377 - DNA, 22 bp, Homo sapiens
cagaaggcaagatcagattaaa

SEQ ID NO: 6008378 - DNA, 21 bp, Homo sapiens
cagaaggcaaggccctgccct

SEQ ID NO: 6008379 - DNA, 22 bp, Homo sapiens
cagaaggcaaggccctgccctg

SEQ ID NO: 6008380 - DNA, 11 bp, Homo sapiens
cagaaggcaat

SEQ ID NO: 6008381 - DNA, 23 bp, Homo sapiens
cagaaggcatatcagtctctgag

SEQ ID NO: 6008382 - DNA, 13 bp, Homo sapiens
cagaaggccaaga

SEQ ID NO: 6008383 - DNA, 18 bp, Homo sapiens
cagaaggccaagaatcaa

SEQ ID NO: 6008384 - DNA, 18 bp, Homo sapiens
cagaaggccaagaggctg

SEQ ID NO: 6008385 - DNA, 21 bp, Homo sapiens
cagaaggccacaggccactgc

SEQ ID NO: 6008386 - DNA, 22 bp, Homo sapiens
cagaaggccagaaaaggcagcc

SEQ ID NO: 6008387 - DNA, 16 bp, Homo sapiens
cagaaggccagccgcc

SEQ ID NO: 6008388 - DNA, 17 bp, Homo sapiens
cagaaggccccagagag

SEQ ID NO: 6008389 - DNA, 22 bp, Homo sapiens
cagaaggccgatggggaaggag

SEQ ID NO: 6008390 - DNA, 14 bp, Homo sapiens
cagaaggccttgaa

SEQ ID NO: 6008391 - DNA, 14 bp, Homo sapiens
cagaaggctcctgc

SEQ ID NO: 6008392 - DNA, 17 bp, Homo sapiens
cagaaggctcctgcccc

SEQ ID NO: 6008393 - DNA, 21 bp, Homo sapiens
cagaaggctctatctgctggg

SEQ ID NO: 6008394 - DNA, 12 bp, Homo sapiens
cagaaggctggg

SEQ ID NO: 6008395 - DNA, 18 bp, Homo sapiens
cagaaggctggggccagt

SEQ ID NO: 6008396 - DNA, 14 bp, Homo sapiens
cagaaggctgggtc

SEQ ID NO: 6008397 - DNA, 19 bp, Homo sapiens
cagaaggctgggtccaggg

SEQ ID NO: 6008398 - DNA, 20 bp, Homo sapiens
cagaaggctgggtccagggg

SEQ ID NO: 6008399 - DNA, 13 bp, Homo sapiens
cagaaggctttgg

SEQ ID NO: 6008400 - DNA, 13 bp, Homo sapiens
cagaagggaaaca

SEQ ID NO: 6008401 - DNA, 17 bp, Homo sapiens
cagaagggaattgctca

SEQ ID NO: 6008402 - DNA, 20 bp, Homo sapiens
cagaagggagctagccagag

SEQ ID NO: 6008403 - DNA, 13 bp, Homo sapiens
cagaagggagggc

SEQ ID NO: 6008404 - DNA, 19 bp, Homo sapiens
cagaagggagggcagagct

SEQ ID NO: 6008405 - DNA, 22 bp, Homo sapiens
cagaagggagggcagagctggt

SEQ ID NO: 6008406 - DNA, 17 bp, Homo sapiens
cagaagggagttgctca

SEQ ID NO: 6008407 - DNA, 19 bp, Homo sapiens
cagaagggagttgctcact

SEQ ID NO: 6008408 - DNA, 22 bp, Homo sapiens
cagaagggctctttctctctgc

SEQ ID NO: 6008409 - DNA, 13 bp, Homo sapiens
cagaagggcttca

SEQ ID NO: 6008410 - DNA, 19 bp, Homo sapiens
cagaaggggaatgtgtcct

SEQ ID NO: 6008411 - DNA, 16 bp, Homo sapiens
cagaaggggactgcca

SEQ ID NO: 6008412 - DNA, 16 bp, Homo sapiens
cagaaggggagctttt

SEQ ID NO: 6008413 - DNA, 21 bp, Homo sapiens
cagaaggggatggtgttgtca

SEQ ID NO: 6008414 - DNA, 14 bp, Homo sapiens
cagaagggggtggt

SEQ ID NO: 6008415 - DNA, 21 bp, Homo sapiens
cagaagggggtggtgtctcca

SEQ ID NO: 6008416 - DNA, 15 bp, Homo sapiens
cagaaggtattcctt

SEQ ID NO: 6008417 - DNA, 15 bp, Homo sapiens
cagaaggtctgtttt

SEQ ID NO: 6008418 - DNA, 15 bp, Homo sapiens
cagaaggtgaacttt

SEQ ID NO: 6008419 - DNA, 15 bp, Homo sapiens
cagaaggtgtgtcct

SEQ ID NO: 6008420 - DNA, 17 bp, Homo sapiens
cagaaggtgtgtccttg

SEQ ID NO: 6008421 - DNA, 23 bp, Homo sapiens
cagaaggtgtgtccttgaactga

SEQ ID NO: 6008422 - DNA, 15 bp, Homo sapiens
cagaagtaactccca

SEQ ID NO: 6008423 - DNA, 23 bp, Homo sapiens
cagaagtaacttattttgtacta

SEQ ID NO: 6008424 - DNA, 15 bp, Homo sapiens
cagaagtaagcctca

SEQ ID NO: 6008425 - DNA, 16 bp, Homo sapiens
cagaagtaagcctcat

SEQ ID NO: 6008426 - DNA, 16 bp, Homo sapiens
cagaagtaccagacta

SEQ ID NO: 6008427 - DNA, 20 bp, Homo sapiens
cagaagtaccagactagatg

SEQ ID NO: 6008428 - DNA, 16 bp, Homo sapiens
cagaagtaggaaggaa

SEQ ID NO: 6008429 - DNA, 21 bp, Homo sapiens
cagaagtaggaaggaaaaaat

SEQ ID NO: 6008430 - DNA, 18 bp, Homo sapiens
cagaagtaggggaagaat

SEQ ID NO: 6008431 - DNA, 22 bp, Homo sapiens
cagaagtaggggaagaataatt

SEQ ID NO: 6008432 - DNA, 13 bp, Homo sapiens
cagaagtattctt

SEQ ID NO: 6008433 - DNA, 18 bp, Homo sapiens
cagaagtattcttttcaa

SEQ ID NO: 6008434 - DNA, 16 bp, Homo sapiens
cagaagtcaagcccag

SEQ ID NO: 6008435 - DNA, 17 bp, Homo sapiens
cagaagtcaaggcttag

SEQ ID NO: 6008436 - DNA, 15 bp, Homo sapiens
cagaagtcaataggc

SEQ ID NO: 6008437 - DNA, 20 bp, Homo sapiens
cagaagtcactcaattgttt

SEQ ID NO: 6008438 - DNA, 14 bp, Homo sapiens
cagaagtcatcttg

SEQ ID NO: 6008439 - DNA, 17 bp, Homo sapiens
cagaagtcatgaagccc

SEQ ID NO: 6008440 - DNA, 20 bp, Homo sapiens
cagaagtccacaggacgcac

SEQ ID NO: 6008441 - DNA, 16 bp, Homo sapiens
cagaagtccctaggag

SEQ ID NO: 6008442 - DNA, 20 bp, Homo sapiens
cagaagtccctaggagggaa

SEQ ID NO: 6008443 - DNA, 14 bp, Homo sapiens
cagaagtccctgtt

SEQ ID NO: 6008444 - DNA, 22 bp, Homo sapiens
cagaagtcctccctcctgcagg

SEQ ID NO: 6008445 - DNA, 18 bp, Homo sapiens
cagaagtccttaagcaga

SEQ ID NO: 6008446 - DNA, 14 bp, Homo sapiens
cagaagtctcctca

SEQ ID NO: 6008447 - DNA, 17 bp, Homo sapiens
cagaagtgaaaaagact

SEQ ID NO: 6008448 - DNA, 18 bp, Homo sapiens
cagaagtgaatgggaaag

SEQ ID NO: 6008449 - DNA, 20 bp, Homo sapiens
cagaagtgagctttgctgct

SEQ ID NO: 6008450 - DNA, 22 bp, Homo sapiens
cagaagtgaggatgagacccag

SEQ ID NO: 6008451 - DNA, 12 bp, Homo sapiens
cagaagtgattt

SEQ ID NO: 6008452 - DNA, 22 bp, Homo sapiens
cagggcctccctgttcacggtg

SEQ ID NO: 6008453 - DNA, 16 bp, Homo sapiens
cagggcctcctggggg

SEQ ID NO: 6008454 - DNA, 12 bp, Homo sapiens
cagggcctctgc

SEQ ID NO: 6008455 - DNA, 13 bp, Homo sapiens
cagggcctctgcg

SEQ ID NO: 6008456 - DNA, 17 bp, Homo sapiens
cagggcctctggcttcc

SEQ ID NO: 6008457 - DNA, 16 bp, Homo sapiens
cagggcctctgtcaat

SEQ ID NO: 6008458 - DNA, 13 bp, Homo sapiens
cagggcctctgtg

SEQ ID NO: 6008459 - DNA, 16 bp, Homo sapiens
cagggcctctgtgcag

SEQ ID NO: 6008460 - DNA, 20 bp, Homo sapiens
cagggcctctgtgcagacag

SEQ ID NO: 6008461 - DNA, 22 bp, Homo sapiens
cagggcctgacagtgtgggaca

SEQ ID NO: 6008462 - DNA, 17 bp, Homo sapiens
cagggcctgacttgagc

SEQ ID NO: 6008463 - DNA, 21 bp, Homo sapiens
cagggcctgacttgagccact

SEQ ID NO: 6008464 - DNA, 16 bp, Homo sapiens
cagggcctgagcagct

SEQ ID NO: 6008465 - DNA, 18 bp, Homo sapiens
cagggcctgagcagctgg

SEQ ID NO: 6008466 - DNA, 16 bp, Homo sapiens
cagggcctgagcctgg

SEQ ID NO: 6008467 - DNA, 21 bp, Homo sapiens
cagggcctgagcctggccagc

SEQ ID NO: 6008468 - DNA, 23 bp, Homo sapiens
cagggcctgagtgacctccttct

SEQ ID NO: 6008469 - DNA, 19 bp, Homo sapiens
cagggcctgccccctgggg

SEQ ID NO: 6008470 - DNA, 13 bp, Homo sapiens
cagggcctgcgga

SEQ ID NO: 6008471 - DNA, 21 bp, Homo sapiens
cagggcctgcttccccttcct

SEQ ID NO: 6008472 - DNA, 12 bp, Homo sapiens
cagggcctggaa

SEQ ID NO: 6008473 - DNA, 17 bp, Homo sapiens
cagggcctggaagacag

SEQ ID NO: 6008474 - DNA, 17 bp, Homo sapiens
cagggcctggagcccca

SEQ ID NO: 6008475 - DNA, 18 bp, Homo sapiens
cagggcctggagccccat

SEQ ID NO: 6008476 - DNA, 21 bp, Homo sapiens
cagggcctggcaggccagtgt

SEQ ID NO: 6008477 - DNA, 13 bp, Homo sapiens
cagggcctggcat

SEQ ID NO: 6008478 - DNA, 14 bp, Homo sapiens
cagggcctggccca

SEQ ID NO: 6008479 - DNA, 17 bp, Homo sapiens
cagggcctggcccatgt

SEQ ID NO: 6008480 - DNA, 17 bp, Homo sapiens
cagggcctggcctggtc

SEQ ID NO: 6008481 - DNA, 21 bp, Homo sapiens
cagggcctggccttgtcccca

SEQ ID NO: 6008482 - DNA, 19 bp, Homo sapiens
cagggcctggctccagtct

SEQ ID NO: 6008483 - DNA, 13 bp, Homo sapiens
cagggcctgggcc

SEQ ID NO: 6008484 - DNA, 15 bp, Homo sapiens
cagggcctggggcct

SEQ ID NO: 6008485 - DNA, 17 bp, Homo sapiens
cagggcctggggcctga

SEQ ID NO: 6008486 - DNA, 13 bp, Homo sapiens
cagggcctggggg

SEQ ID NO: 6008487 - DNA, 19 bp, Homo sapiens
cagggcctgggggcagtga

SEQ ID NO: 6008488 - DNA, 21 bp, Homo sapiens
cagggcctggtgtgaggctgg

SEQ ID NO: 6008489 - DNA, 22 bp, Homo sapiens
cagggcctggtgtgaggctggg

SEQ ID NO: 6008490 - DNA, 18 bp, Homo sapiens
cagggcctggttgaagaa

SEQ ID NO: 6008491 - DNA, 19 bp, Homo sapiens
cagggcctggttgaagaag

SEQ ID NO: 6008492 - DNA, 13 bp, Homo sapiens
cagggcctgtctc

SEQ ID NO: 6008493 - DNA, 15 bp, Homo sapiens
cagggccttaaaatt

SEQ ID NO: 6008494 - DNA, 16 bp, Homo sapiens
cagggccttctgcctg

SEQ ID NO: 6008495 - DNA, 15 bp, Homo sapiens
cagggccttgacaag

SEQ ID NO: 6008496 - DNA, 15 bp, Homo sapiens
cagggccttgctaat

SEQ ID NO: 6008497 - DNA, 15 bp, Homo sapiens
cagggcctttctcct

SEQ ID NO: 6008498 - DNA, 19 bp, Homo sapiens
cagggcctttctcctcccc

SEQ ID NO: 6008499 - DNA, 20 bp, Homo sapiens
cagggccttttctggcaccg

SEQ ID NO: 6008500 - DNA, 16 bp, Homo sapiens
cagggcgagctgcagg

SEQ ID NO: 6008501 - DNA, 17 bp, Homo sapiens
cagggcgcaggggaggg

SEQ ID NO: 6008502 - DNA, 21 bp, Homo sapiens
cagggcgccaagtctggcacc

SEQ ID NO: 6008503 - DNA, 16 bp, Homo sapiens
cagggcgctcagacgg

SEQ ID NO: 6008504 - DNA, 20 bp, Homo sapiens
cagggcgctcagacggcggc

SEQ ID NO: 6008505 - DNA, 22 bp, Homo sapiens
cagggcgctcagacggcggcca

SEQ ID NO: 6008506 - DNA, 23 bp, Homo sapiens
cagggcgctcagacggcggccag

SEQ ID NO: 6008507 - DNA, 13 bp, Homo sapiens
cagggcgctccgg

SEQ ID NO: 6008508 - DNA, 14 bp, Homo sapiens
cagggcgctccggc

SEQ ID NO: 6008509 - DNA, 23 bp, Homo sapiens
cagggcgctccggcagaggcagg

SEQ ID NO: 6008510 - DNA, 16 bp, Homo sapiens
cagggcggccagggac

SEQ ID NO: 6008511 - DNA, 19 bp, Homo sapiens
cagggcggccagggaccca

SEQ ID NO: 6008512 - DNA, 16 bp, Homo sapiens
cagggcggcctcccag

SEQ ID NO: 6008513 - DNA, 15 bp, Homo sapiens
cagggcggctgccga

SEQ ID NO: 6008514 - DNA, 18 bp, Homo sapiens
cagggcgggccaggagaa

SEQ ID NO: 6008515 - DNA, 16 bp, Homo sapiens
cagggcggggctggcc

SEQ ID NO: 6008516 - DNA, 17 bp, Homo sapiens
cagggcggggctggcca

SEQ ID NO: 6008517 - DNA, 19 bp, Homo sapiens
cagggcgggggggggggcg

SEQ ID NO: 6008518 - DNA, 13 bp, Homo sapiens
cagggcgtcctct

SEQ ID NO: 6008519 - DNA, 14 bp, Homo sapiens
cagggcgtcctctc

SEQ ID NO: 6008520 - DNA, 22 bp, Homo sapiens
cagggctaaagtcatccagtga

SEQ ID NO: 6008521 - DNA, 19 bp, Homo sapiens
cagggctacacagaccctg

SEQ ID NO: 6008522 - DNA, 17 bp, Homo sapiens
cagggctaccctccccc

SEQ ID NO: 6008523 - DNA, 18 bp, Homo sapiens
cagggctaccctgagctg

SEQ ID NO: 6008524 - DNA, 23 bp, Homo sapiens
cagggctaccctgagctgaggca

SEQ ID NO: 6008525 - DNA, 14 bp, Homo sapiens
cagggctagtgact

SEQ ID NO: 6008526 - DNA, 15 bp, Homo sapiens
cagggctagtgactt

SEQ ID NO: 6008527 - DNA, 18 bp, Homo sapiens
cagggctcacactcctgg

SEQ ID NO: 6008528 - DNA, 20 bp, Homo sapiens
cagggctcacactcctgggc

SEQ ID NO: 6008529 - DNA, 21 bp, Homo sapiens
cagggctcacactcctgggct

SEQ ID NO: 6008530 - DNA, 20 bp, Homo sapiens
cagggctcacagggcaggcc

SEQ ID NO: 6008531 - DNA, 22 bp, Homo sapiens
cagggctcacagggcaggcctt

SEQ ID NO: 6008532 - DNA, 19 bp, Homo sapiens
cagggctcacgtgggaacc

SEQ ID NO: 6008533 - DNA, 19 bp, Homo sapiens
cagggctcagagtgaccct

SEQ ID NO: 6008534 - DNA, 21 bp, Homo sapiens
cagggctcagagtgaccctca

SEQ ID NO: 6008535 - DNA, 12 bp, Homo sapiens
cagggctcagcg

SEQ ID NO: 6008536 - DNA, 15 bp, Homo sapiens
cagggctcagctcct

SEQ ID NO: 6008537 - DNA, 16 bp, Homo sapiens
cagggctcagctcctt

SEQ ID NO: 6008538 - DNA, 12 bp, Homo sapiens
cagggctcagga

SEQ ID NO: 6008539 - DNA, 18 bp, Homo sapiens
cagggctcagtcttttga

SEQ ID NO: 6008540 - DNA, 22 bp, Homo sapiens
cagggctcatttttgcacttat

SEQ ID NO: 6008541 - DNA, 22 bp, Homo sapiens
cagggctccacgggggcctagt

SEQ ID NO: 6008542 - DNA, 22 bp, Homo sapiens
cagggctccagcccctcttgga

SEQ ID NO: 6008543 - DNA, 15 bp, Homo sapiens
cagggctccagcctg

SEQ ID NO: 6008544 - DNA, 16 bp, Homo sapiens
cagggctccagcctgt

SEQ ID NO: 6008545 - DNA, 17 bp, Homo sapiens
cagggctccagcctgtc

SEQ ID NO: 6008546 - DNA, 17 bp, Homo sapiens
cagggctccaggagcct

SEQ ID NO: 6008547 - DNA, 19 bp, Homo sapiens
cagggctccaggagcctca

SEQ ID NO: 6008548 - DNA, 15 bp, Homo sapiens
cagggctcccacaga

SEQ ID NO: 6008549 - DNA, 12 bp, Homo sapiens
cagggctcccgg

SEQ ID NO: 6008550 - DNA, 14 bp, Homo sapiens
cagggctccctcct

SEQ ID NO: 6008551 - DNA, 16 bp, Homo sapiens
cagggctccctcctgg

SEQ ID NO: 6008552 - DNA, 20 bp, Homo sapiens
cagggctccctcctggagca

SEQ ID NO: 6008553 - DNA, 12 bp, Homo sapiens
cagggctccctt

SEQ ID NO: 6008554 - DNA, 14 bp, Homo sapiens
cagggctcctccca

SEQ ID NO: 6008555 - DNA, 18 bp, Homo sapiens
cagggctcctcccagctt

SEQ ID NO: 6008556 - DNA, 16 bp, Homo sapiens
cagggctcctgaagga

SEQ ID NO: 6008557 - DNA, 14 bp, Homo sapiens
cagggctcctgcac

SEQ ID NO: 6008558 - DNA, 22 bp, Homo sapiens
cagggctcctgccttctgtcct

SEQ ID NO: 6008559 - DNA, 17 bp, Homo sapiens
cagggctcctgtggcag

SEQ ID NO: 6008560 - DNA, 22 bp, Homo sapiens
cagggctcctgtggcagctgcc

SEQ ID NO: 6008561 - DNA, 12 bp, Homo sapiens
cagggctctccc

SEQ ID NO: 6008562 - DNA, 11 bp, Homo sapiens
cagggctctct

SEQ ID NO: 6008563 - DNA, 12 bp, Homo sapiens
cagggctctgac

SEQ ID NO: 6008564 - DNA, 16 bp, Homo sapiens
cagggctctgcagcac

SEQ ID NO: 6008565 - DNA, 17 bp, Homo sapiens
cagggctctgcaggcca

SEQ ID NO: 6008566 - DNA, 13 bp, Homo sapiens
cagggctctgccc

SEQ ID NO: 6008567 - DNA, 21 bp, Homo sapiens
cagggctctgccccagaggcc

SEQ ID NO: 6008568 - DNA, 17 bp, Homo sapiens
cagggctctgccccagt

SEQ ID NO: 6008569 - DNA, 19 bp, Homo sapiens
cagggctctggcaggtggc

SEQ ID NO: 6008570 - DNA, 21 bp, Homo sapiens
cagggctctggcaggtggcca

SEQ ID NO: 6008571 - DNA, 15 bp, Homo sapiens
cagggctctgggggc

SEQ ID NO: 6008572 - DNA, 19 bp, Homo sapiens
cagggctctgggggcagat

SEQ ID NO: 6008573 - DNA, 15 bp, Homo sapiens
cagggctctgtaagt

SEQ ID NO: 6008574 - DNA, 18 bp, Homo sapiens
cagggctctttgatggac

SEQ ID NO: 6008575 - DNA, 18 bp, Homo sapiens
cagggctgaggcctctca

SEQ ID NO: 6008576 - DNA, 21 bp, Homo sapiens
cagggctgatagagtgatttt

SEQ ID NO: 6008577 - DNA, 23 bp, Homo sapiens
cagggctgcaaaactggaagcac

SEQ ID NO: 6008578 - DNA, 21 bp, Homo sapiens
cagggctgccactaacctgta

SEQ ID NO: 6008579 - DNA, 15 bp, Homo sapiens
cagggctgcccctgt

SEQ ID NO: 6008580 - DNA, 15 bp, Homo sapiens
cagggctgccctgag

SEQ ID NO: 6008581 - DNA, 17 bp, Homo sapiens
cagggctgccctgagaa

SEQ ID NO: 6008582 - DNA, 18 bp, Homo sapiens
cagggctgctagacggag

SEQ ID NO: 6008583 - DNA, 22 bp, Homo sapiens
cagggctgctctttccacttgc

SEQ ID NO: 6008584 - DNA, 21 bp, Homo sapiens
cagggctgctgggggcaactg

SEQ ID NO: 6008585 - DNA, 16 bp, Homo sapiens
cagggctggactgagg

SEQ ID NO: 6008586 - DNA, 20 bp, Homo sapiens
cagggctggactgaggcctg

SEQ ID NO: 6008587 - DNA, 12 bp, Homo sapiens
cagggctggaga

SEQ ID NO: 6008588 - DNA, 13 bp, Homo sapiens
cagggctggagaa

SEQ ID NO: 6008589 - DNA, 19 bp, Homo sapiens
cagggctggagcctggggt

SEQ ID NO: 6008590 - DNA, 20 bp, Homo sapiens
cagggctggagtgcgctctt

SEQ ID NO: 6008591 - DNA, 12 bp, Homo sapiens
cagggctggatg

SEQ ID NO: 6008592 - DNA, 18 bp, Homo sapiens
cagggctggatggacaga

SEQ ID NO: 6008593 - DNA, 20 bp, Homo sapiens
cagggctggattggcaggtg

SEQ ID NO: 6008594 - DNA, 13 bp, Homo sapiens
cagggctggcacg

SEQ ID NO: 6008595 - DNA, 12 bp, Homo sapiens
cagggctggccc

SEQ ID NO: 6008596 - DNA, 14 bp, Homo sapiens
cagggctggcccag

SEQ ID NO: 6008597 - DNA, 15 bp, Homo sapiens
cagggctggcccagc

SEQ ID NO: 6008598 - DNA, 17 bp, Homo sapiens
cagggctggcccagccc

SEQ ID NO: 6008599 - DNA, 19 bp, Homo sapiens
cagggctggcccagccctg

SEQ ID NO: 6008600 - DNA, 19 bp, Homo sapiens
cagggctggccccagggca

SEQ ID NO: 6008601 - DNA, 13 bp, Homo sapiens
cagggctggcccg

SEQ ID NO: 6008602 - DNA, 17 bp, Homo sapiens
cagggctggccctaggc

SEQ ID NO: 6008603 - DNA, 20 bp, Homo sapiens
cagggctggccctaggcact

SEQ ID NO: 6008604 - DNA, 18 bp, Homo sapiens
cagggctggctcctgatc

SEQ ID NO: 6008605 - DNA, 17 bp, Homo sapiens
cagggctggctctgcac

SEQ ID NO: 6008606 - DNA, 13 bp, Homo sapiens
cagggctgggagg

SEQ ID NO: 6008607 - DNA, 12 bp, Homo sapiens
cagggctgggca

SEQ ID NO: 6008608 - DNA, 22 bp, Homo sapiens
cagggctgggcaggtcctgggg

SEQ ID NO: 6008609 - DNA, 16 bp, Homo sapiens
cagggctgggcgcctc

SEQ ID NO: 6008610 - DNA, 21 bp, Homo sapiens
cagggctgggcgcctctgtcc

SEQ ID NO: 6008611 - DNA, 21 bp, Homo sapiens
cagggctgggctctgtcttcc

SEQ ID NO: 6008612 - DNA, 22 bp, Homo sapiens
cagggctgggctctgtcttcct

SEQ ID NO: 6008613 - DNA, 15 bp, Homo sapiens
cagggctggggacag

SEQ ID NO: 6008614 - DNA, 20 bp, Homo sapiens
cagggctggggacagagggt

SEQ ID NO: 6008615 - DNA, 16 bp, Homo sapiens
cagggctggggccaag

SEQ ID NO: 6008616 - DNA, 17 bp, Homo sapiens
cagggctggggccaaga

SEQ ID NO: 6008617 - DNA, 12 bp, Homo sapiens
cagggctggggt

SEQ ID NO: 6008618 - DNA, 18 bp, Homo sapiens
cagggctggggtgagcct

SEQ ID NO: 6008619 - DNA, 17 bp, Homo sapiens
cagggctggggttgcca

SEQ ID NO: 6008620 - DNA, 18 bp, Homo sapiens
cagggctggggttgccag

SEQ ID NO: 6008621 - DNA, 23 bp, Homo sapiens
cagggctggggttgccagaggcc

SEQ ID NO: 6008622 - DNA, 11 bp, Homo sapiens
cagggctgggt

SEQ ID NO: 6008623 - DNA, 16 bp, Homo sapiens
cagggctgggtcacag

SEQ ID NO: 6008624 - DNA, 19 bp, Homo sapiens
cagggctgggtcacaggaa

SEQ ID NO: 6008625 - DNA, 20 bp, Homo sapiens
cagggctgggtcacaggaag

SEQ ID NO: 6008626 - DNA, 16 bp, Homo sapiens
cagggctgggtcaggg

SEQ ID NO: 6008627 - DNA, 13 bp, Homo sapiens
cagggctggtttg

SEQ ID NO: 6008628 - DNA, 14 bp, Homo sapiens
cagggctggtttgt

SEQ ID NO: 6008629 - DNA, 14 bp, Homo sapiens
cagggctgtcccag

SEQ ID NO: 6008630 - DNA, 17 bp, Homo sapiens
cagggctgtcccagccc

SEQ ID NO: 6008631 - DNA, 17 bp, Homo sapiens
cagggctgtgtcccaga

SEQ ID NO: 6008632 - DNA, 15 bp, Homo sapiens
cagaagtgatttagt

SEQ ID NO: 6008633 - DNA, 14 bp, Homo sapiens
cagaagtgcatctg

SEQ ID NO: 6008634 - DNA, 13 bp, Homo sapiens
cagaagtgcatga

SEQ ID NO: 6008635 - DNA, 19 bp, Homo sapiens
cagaagtgccacttaagga

SEQ ID NO: 6008636 - DNA, 18 bp, Homo sapiens
cagaagtgcccttcctgc

SEQ ID NO: 6008637 - DNA, 13 bp, Homo sapiens
cagaagtgctctt

SEQ ID NO: 6008638 - DNA, 13 bp, Homo sapiens
cagaagtggagct

SEQ ID NO: 6008639 - DNA, 16 bp, Homo sapiens
cagaagtggagctggg

SEQ ID NO: 6008640 - DNA, 15 bp, Homo sapiens
cagaagtggcaggag

SEQ ID NO: 6008641 - DNA, 18 bp, Homo sapiens
cagaagtggcaggaggac

SEQ ID NO: 6008642 - DNA, 22 bp, Homo sapiens
cagaagtggggctctgggaggg

SEQ ID NO: 6008643 - DNA, 18 bp, Homo sapiens
cagaagtgtcaccctgtg

SEQ ID NO: 6008644 - DNA, 19 bp, Homo sapiens
cagaagtgtcaccctgtgg

SEQ ID NO: 6008645 - DNA, 13 bp, Homo sapiens
cagaagtgtgact

SEQ ID NO: 6008646 - DNA, 17 bp, Homo sapiens
cagaagtgtgactggct

SEQ ID NO: 6008647 - DNA, 13 bp, Homo sapiens
cagaagtgtgatt

SEQ ID NO: 6008648 - DNA, 22 bp, Homo sapiens
cagaagtgtgattgggaataaa

SEQ ID NO: 6008649 - DNA, 23 bp, Homo sapiens
cagaagtgtttcagattttttaa

SEQ ID NO: 6008650 - DNA, 14 bp, Homo sapiens
cagaagttaacatc

SEQ ID NO: 6008651 - DNA, 23 bp, Homo sapiens
cagaagttgttagtgatttgcta

SEQ ID NO: 6008652 - DNA, 14 bp, Homo sapiens
cagaagtttaaata

SEQ ID NO: 6008653 - DNA, 16 bp, Homo sapiens
cagaagtttaaatatt

SEQ ID NO: 6008654 - DNA, 23 bp, Homo sapiens
cagaagtttaaatctttgttaaa

SEQ ID NO: 6008655 - DNA, 13 bp, Homo sapiens
cagaagtttctac

SEQ ID NO: 6008656 - DNA, 19 bp, Homo sapiens
cagaagtttctcagctccc

SEQ ID NO: 6008657 - DNA, 16 bp, Homo sapiens
cagaagtttctgccgc

SEQ ID NO: 6008658 - DNA, 23 bp, Homo sapiens
cagaagtttctgccgcagccctg

SEQ ID NO: 6008659 - DNA, 20 bp, Homo sapiens
cagaagtttgagatcagcct

SEQ ID NO: 6008660 - DNA, 22 bp, Homo sapiens
cagaagtttgagatcagcctgg

SEQ ID NO: 6008661 - DNA, 16 bp, Homo sapiens
cagaagtttgcactat

SEQ ID NO: 6008662 - DNA, 18 bp, Homo sapiens
cagaagtttgcactatct

SEQ ID NO: 6008663 - DNA, 21 bp, Homo sapiens
cagaagttttaacttccagtg

SEQ ID NO: 6008664 - DNA, 12 bp, Homo sapiens
cagaataaaata

SEQ ID NO: 6008665 - DNA, 12 bp, Homo sapiens
cagaataaaatt

SEQ ID NO: 6008666 - DNA, 21 bp, Homo sapiens
cagaataaactggcagctcag

SEQ ID NO: 6008667 - DNA, 11 bp, Homo sapiens
cagaataaagc

SEQ ID NO: 6008668 - DNA, 15 bp, Homo sapiens
cagaataaagcaatt

SEQ ID NO: 6008669 - DNA, 19 bp, Homo sapiens
cagaataaagcaattttcc

SEQ ID NO: 6008670 - DNA, 13 bp, Homo sapiens
cagaataaagcag

SEQ ID NO: 6008671 - DNA, 17 bp, Homo sapiens
cagaataaagcagcctg

SEQ ID NO: 6008672 - DNA, 18 bp, Homo sapiens
cagaataaagttgtattt

SEQ ID NO: 6008673 - DNA, 22 bp, Homo sapiens
cagaataaagttgtatttcaaa

SEQ ID NO: 6008674 - DNA, 17 bp, Homo sapiens
cagaataaatccttggg

SEQ ID NO: 6008675 - DNA, 18 bp, Homo sapiens
cagaataaggcaggcatt

SEQ ID NO: 6008676 - DNA, 14 bp, Homo sapiens
cagaataagtgctg

SEQ ID NO: 6008677 - DNA, 21 bp, Homo sapiens
cagaataagtgctgtttgaga

SEQ ID NO: 6008678 - DNA, 17 bp, Homo sapiens
cagaataagttattgca

SEQ ID NO: 6008679 - DNA, 23 bp, Homo sapiens
cagaataagttattgcagtttat

SEQ ID NO: 6008680 - DNA, 14 bp, Homo sapiens
cagaataatccagt

SEQ ID NO: 6008681 - DNA, 17 bp, Homo sapiens
cagaataatcctgtttt

SEQ ID NO: 6008682 - DNA, 19 bp, Homo sapiens
cagaataatcctgttttac

SEQ ID NO: 6008683 - DNA, 11 bp, Homo sapiens
cagaataatgg

SEQ ID NO: 6008684 - DNA, 18 bp, Homo sapiens
cagaataatggaaacatt

SEQ ID NO: 6008685 - DNA, 19 bp, Homo sapiens
cagaataatggaaacatta

SEQ ID NO: 6008686 - DNA, 23 bp, Homo sapiens
cagaataatggaaacattacagt

SEQ ID NO: 6008687 - DNA, 16 bp, Homo sapiens
cagaatacaagccact

SEQ ID NO: 6008688 - DNA, 13 bp, Homo sapiens
cagaatacaattc

SEQ ID NO: 6008689 - DNA, 23 bp, Homo sapiens
cagaatacagtaagctgctctat

SEQ ID NO: 6008690 - DNA, 16 bp, Homo sapiens
cagaatacggaagagc

SEQ ID NO: 6008691 - DNA, 22 bp, Homo sapiens
cagaatacggaagagcaggtga

SEQ ID NO: 6008692 - DNA, 21 bp, Homo sapiens
cagaatactgggttcttagtt

SEQ ID NO: 6008693 - DNA, 14 bp, Homo sapiens
cagaatactggtct

SEQ ID NO: 6008694 - DNA, 19 bp, Homo sapiens
cagaatacttgactcattt

SEQ ID NO: 6008695 - DNA, 21 bp, Homo sapiens
cagaatagatctgatggtgag

SEQ ID NO: 6008696 - DNA, 20 bp, Homo sapiens
cagaatagttattctctaag

SEQ ID NO: 6008697 - DNA, 22 bp, Homo sapiens
cagaatagttattctctaagag

SEQ ID NO: 6008698 - DNA, 15 bp, Homo sapiens
cagaatagtttacac

SEQ ID NO: 6008699 - DNA, 17 bp, Homo sapiens
cagaatagtttacacac

SEQ ID NO: 6008700 - DNA, 13 bp, Homo sapiens
cagaatatacaca

SEQ ID NO: 6008701 - DNA, 14 bp, Homo sapiens
cagaatatacacat

SEQ ID NO: 6008702 - DNA, 20 bp, Homo sapiens
cagaatatacacattttgta

SEQ ID NO: 6008703 - DNA, 22 bp, Homo sapiens
cagaatatacacattttgtaaa

SEQ ID NO: 6008704 - DNA, 23 bp, Homo sapiens
cagaatatacacattttgtaaat

SEQ ID NO: 6008705 - DNA, 15 bp, Homo sapiens
cagaatatcacagaa

SEQ ID NO: 6008706 - DNA, 17 bp, Homo sapiens
cagaatatcacagaaaa

SEQ ID NO: 6008707 - DNA, 12 bp, Homo sapiens
cagaatatctgg

SEQ ID NO: 6008708 - DNA, 14 bp, Homo sapiens
cagaatatgtttca

SEQ ID NO: 6008709 - DNA, 15 bp, Homo sapiens
cagaatatgtttcaa

SEQ ID NO: 6008710 - DNA, 20 bp, Homo sapiens
cagaatattaaatattataa

SEQ ID NO: 6008711 - DNA, 13 bp, Homo sapiens
cagaatattagcc

SEQ ID NO: 6008712 - DNA, 20 bp, Homo sapiens
cagaatattctgtaaaccta

SEQ ID NO: 6008713 - DNA, 13 bp, Homo sapiens
cagaatatttcta

SEQ ID NO: 6008714 - DNA, 14 bp, Homo sapiens
cagaatattttcaa

SEQ ID NO: 6008715 - DNA, 22 bp, Homo sapiens
cagaatatttttatatttcctt

SEQ ID NO: 6008716 - DNA, 18 bp, Homo sapiens
cagaatcaaatctgagcc

SEQ ID NO: 6008717 - DNA, 19 bp, Homo sapiens
cagaatcaaatctgagcct

SEQ ID NO: 6008718 - DNA, 13 bp, Homo sapiens
cagaatcagtgtt

SEQ ID NO: 6008719 - DNA, 18 bp, Homo sapiens
cagaatcataattttcaa

SEQ ID NO: 6008720 - DNA, 16 bp, Homo sapiens
cagaatcatatgattc

SEQ ID NO: 6008721 - DNA, 24 bp, Homo sapiens
cagaatcatcatatcataggtaca

SEQ ID NO: 6008722 - DNA, 15 bp, Homo sapiens
cagaatcattgctta

SEQ ID NO: 6008723 - DNA, 15 bp, Homo sapiens
cagaatccaaagatc

SEQ ID NO: 6008724 - DNA, 21 bp, Homo sapiens
cagaatccataaatgtgttcc

SEQ ID NO: 6008725 - DNA, 13 bp, Homo sapiens
cagaatcccagcc

SEQ ID NO: 6008726 - DNA, 18 bp, Homo sapiens
cagaatcccagccggcca

SEQ ID NO: 6008727 - DNA, 23 bp, Homo sapiens
cagaatcctcagttggaatcatt

SEQ ID NO: 6008728 - DNA, 16 bp, Homo sapiens
cagaatcctggccctc

SEQ ID NO: 6008729 - DNA, 15 bp, Homo sapiens
cagaatcctgggccc

SEQ ID NO: 6008730 - DNA, 16 bp, Homo sapiens
cagaatcctgggcccc

SEQ ID NO: 6008731 - DNA, 19 bp, Homo sapiens
cagaatcctgggcccccag

SEQ ID NO: 6008732 - DNA, 23 bp, Homo sapiens
cagaatccttggctgaattaaaa

SEQ ID NO: 6008733 - DNA, 15 bp, Homo sapiens
cagaatctaaagcca

SEQ ID NO: 6008734 - DNA, 18 bp, Homo sapiens
cagaatctacccaaagga

SEQ ID NO: 6008735 - DNA, 16 bp, Homo sapiens
cagaatctagagcaaa

SEQ ID NO: 6008736 - DNA, 18 bp, Homo sapiens
cagaatctcaaataacta

SEQ ID NO: 6008737 - DNA, 13 bp, Homo sapiens
cagaatctcatta

SEQ ID NO: 6008738 - DNA, 16 bp, Homo sapiens
cagaatctcattactg

SEQ ID NO: 6008739 - DNA, 18 bp, Homo sapiens
cagaatctcattactgct

SEQ ID NO: 6008740 - DNA, 17 bp, Homo sapiens
cagaatctcgcagtgtt

SEQ ID NO: 6008741 - DNA, 15 bp, Homo sapiens
cagaatctgaatgta

SEQ ID NO: 6008742 - DNA, 13 bp, Homo sapiens
cagaatctgctgt

SEQ ID NO: 6008743 - DNA, 14 bp, Homo sapiens
cagaatctgctgtt

SEQ ID NO: 6008744 - DNA, 20 bp, Homo sapiens
cagaatctgctgttgccata

SEQ ID NO: 6008745 - DNA, 16 bp, Homo sapiens
cagaatctgtatgatt

SEQ ID NO: 6008746 - DNA, 16 bp, Homo sapiens
cagaatcttgactttc

SEQ ID NO: 6008747 - DNA, 13 bp, Homo sapiens
cagaatgaaaaat

SEQ ID NO: 6008748 - DNA, 17 bp, Homo sapiens
cagaatgaaaaatgaaa

SEQ ID NO: 6008749 - DNA, 19 bp, Homo sapiens
cagaatgaaaaatgaaaga

SEQ ID NO: 6008750 - DNA, 22 bp, Homo sapiens
cagaatgaaaaatgaaagatga

SEQ ID NO: 6008751 - DNA, 13 bp, Homo sapiens
cagaatgaaaact

SEQ ID NO: 6008752 - DNA, 16 bp, Homo sapiens
cagaatgaagacctaa

SEQ ID NO: 6008753 - DNA, 11 bp, Homo sapiens
cagaatgaatc

SEQ ID NO: 6008754 - DNA, 18 bp, Homo sapiens
cagaatgactctggaacc

SEQ ID NO: 6008755 - DNA, 21 bp, Homo sapiens
cagaatgagacatccagcaga

SEQ ID NO: 6008756 - DNA, 17 bp, Homo sapiens
cagaatgagcagtccct

SEQ ID NO: 6008757 - DNA, 18 bp, Homo sapiens
cagaatgaggaataataa

SEQ ID NO: 6008758 - DNA, 15 bp, Homo sapiens
cagaatgaggcacat

SEQ ID NO: 6008759 - DNA, 21 bp, Homo sapiens
cagaatgcaaccaagtcacac

SEQ ID NO: 6008760 - DNA, 16 bp, Homo sapiens
cagaatgcattaaaaa

SEQ ID NO: 6008761 - DNA, 17 bp, Homo sapiens
cagaatgctatttcact

SEQ ID NO: 6008762 - DNA, 11 bp, Homo sapiens
cagaatgctgt

SEQ ID NO: 6008763 - DNA, 18 bp, Homo sapiens
cagaatgctgtacatcta

SEQ ID NO: 6008764 - DNA, 15 bp, Homo sapiens
cagaatggaggcagg

SEQ ID NO: 6008765 - DNA, 12 bp, Homo sapiens
cagaatggatat

SEQ ID NO: 6008766 - DNA, 22 bp, Homo sapiens
cagaatggatttgttaaactag

SEQ ID NO: 6008767 - DNA, 19 bp, Homo sapiens
cagaatggcagtcctggag

SEQ ID NO: 6008768 - DNA, 19 bp, Homo sapiens
cagaatgggccactgtagg

SEQ ID NO: 6008769 - DNA, 19 bp, Homo sapiens
cagaatgggggtatcctgt

SEQ ID NO: 6008770 - DNA, 22 bp, Homo sapiens
cagaatgggggtatcctgtgca

SEQ ID NO: 6008771 - DNA, 19 bp, Homo sapiens
cagaatggtgatcactcca

SEQ ID NO: 6008772 - DNA, 15 bp, Homo sapiens
cagaatgtaaaaaag

SEQ ID NO: 6008773 - DNA, 13 bp, Homo sapiens
cagaatgtaagtg

SEQ ID NO: 6008774 - DNA, 18 bp, Homo sapiens
cagaatgtaagtgggccc

SEQ ID NO: 6008775 - DNA, 23 bp, Homo sapiens
cagaatgtaagtgggcccacccg

SEQ ID NO: 6008776 - DNA, 14 bp, Homo sapiens
cagaatgtatatta

SEQ ID NO: 6008777 - DNA, 13 bp, Homo sapiens
cagaatgtatctg

SEQ ID NO: 6008778 - DNA, 13 bp, Homo sapiens
cagaatgtcagat

SEQ ID NO: 6008779 - DNA, 17 bp, Homo sapiens
cagaatgtgaaaaagga

SEQ ID NO: 6008780 - DNA, 14 bp, Homo sapiens
cagaatgtgatttc

SEQ ID NO: 6008781 - DNA, 13 bp, Homo sapiens
cagaatgtgctgc

SEQ ID NO: 6008782 - DNA, 14 bp, Homo sapiens
cagaatgtgctgcc

SEQ ID NO: 6008783 - DNA, 14 bp, Homo sapiens
cagaatgtgttctt

SEQ ID NO: 6008784 - DNA, 19 bp, Homo sapiens
cagaatgttaatttatttt

SEQ ID NO: 6008785 - DNA, 16 bp, Homo sapiens
cagaatgttgattaca

SEQ ID NO: 6008786 - DNA, 19 bp, Homo sapiens
cagaatgttgtacttgaaa

SEQ ID NO: 6008787 - DNA, 23 bp, Homo sapiens
cagaatgttgtgttggtatttac

SEQ ID NO: 6008788 - DNA, 17 bp, Homo sapiens
cagaatgtttcctgtgg

SEQ ID NO: 6008789 - DNA, 22 bp, Homo sapiens
cagaatgtttcctgtggaaata

SEQ ID NO: 6008790 - DNA, 15 bp, Homo sapiens
cagaattaaactttt

SEQ ID NO: 6008791 - DNA, 19 bp, Homo sapiens
cagaattaaacttttaatt

SEQ ID NO: 6008792 - DNA, 15 bp, Homo sapiens
cagaattaactccat

SEQ ID NO: 6008793 - DNA, 15 bp, Homo sapiens
cagaattaagcagaa

SEQ ID NO: 6008794 - DNA, 23 bp, Homo sapiens
cagaattaagcagaacactgcag

SEQ ID NO: 6008795 - DNA, 18 bp, Homo sapiens
cagaattacccttcctca

SEQ ID NO: 6008796 - DNA, 19 bp, Homo sapiens
cagaattacccttcctcat

SEQ ID NO: 6008797 - DNA, 20 bp, Homo sapiens
cagaattagatggcttattt

SEQ ID NO: 6008798 - DNA, 22 bp, Homo sapiens
cagaattagatggcttattttt

SEQ ID NO: 6008799 - DNA, 15 bp, Homo sapiens
cagaattatttttaa

SEQ ID NO: 6008800 - DNA, 15 bp, Homo sapiens
cagaattcaaaagtg

SEQ ID NO: 6008801 - DNA, 16 bp, Homo sapiens
cagaattcaaaagtga

SEQ ID NO: 6008802 - DNA, 19 bp, Homo sapiens
cagaattcaacagttacct

SEQ ID NO: 6008803 - DNA, 14 bp, Homo sapiens
cagaattcactgtc

SEQ ID NO: 6008804 - DNA, 21 bp, Homo sapiens
cagaattcggtgtgctgccaa

SEQ ID NO: 6008805 - DNA, 23 bp, Homo sapiens
cagaattcggtgtgctgccaact

SEQ ID NO: 6008806 - DNA, 16 bp, Homo sapiens
cagaattctcccagcg

SEQ ID NO: 6008807 - DNA, 15 bp, Homo sapiens
cagaattctctagtt

SEQ ID NO: 6008808 - DNA, 14 bp, Homo sapiens
cagaattctgctac

SEQ ID NO: 6008809 - DNA, 21 bp, Homo sapiens
cagaattctgctacctcactg

SEQ ID NO: 6008810 - DNA, 17 bp, Homo sapiens
cagaattgaagaaaatc

SEQ ID NO: 6008811 - DNA, 17 bp, Homo sapiens
cagaattgactgcagtt

SEQ ID NO: 6008812 - DNA, 21 bp, Homo sapiens
cagggctgttccctccaggca

SEQ ID NO: 6008813 - DNA, 21 bp, Homo sapiens
cagggcttacctgtacactga

SEQ ID NO: 6008814 - DNA, 23 bp, Homo sapiens
cagggcttacctgtacactgact

SEQ ID NO: 6008815 - DNA, 20 bp, Homo sapiens
cagggcttacggccctggcc

SEQ ID NO: 6008816 - DNA, 17 bp, Homo sapiens
cagggcttccccatcag

SEQ ID NO: 6008817 - DNA, 18 bp, Homo sapiens
cagggcttccccatcagc

SEQ ID NO: 6008818 - DNA, 20 bp, Homo sapiens
cagggcttccccatcagctc

SEQ ID NO: 6008819 - DNA, 12 bp, Homo sapiens
cagggcttcctt

SEQ ID NO: 6008820 - DNA, 15 bp, Homo sapiens
cagggcttctcctgc

SEQ ID NO: 6008821 - DNA, 18 bp, Homo sapiens
cagggcttgctcctgcca

SEQ ID NO: 6008822 - DNA, 14 bp, Homo sapiens
cagggctttaaaat

SEQ ID NO: 6008823 - DNA, 22 bp, Homo sapiens
cagggctttaaacatgattatc

SEQ ID NO: 6008824 - DNA, 14 bp, Homo sapiens
caggggaaaagagg

SEQ ID NO: 6008825 - DNA, 18 bp, Homo sapiens
caggggaaagatgagctt

SEQ ID NO: 6008826 - DNA, 17 bp, Homo sapiens
caggggaacactgggga

SEQ ID NO: 6008827 - DNA, 14 bp, Homo sapiens
caggggaacctgcc

SEQ ID NO: 6008828 - DNA, 18 bp, Homo sapiens
caggggaagaccaaagtt

SEQ ID NO: 6008829 - DNA, 14 bp, Homo sapiens
caggggaagctgct

SEQ ID NO: 6008830 - DNA, 19 bp, Homo sapiens
caggggaaggaaataacat

SEQ ID NO: 6008831 - DNA, 20 bp, Homo sapiens
caggggaaggaaggagggca

SEQ ID NO: 6008832 - DNA, 17 bp, Homo sapiens
caggggaaggccctgag

SEQ ID NO: 6008833 - DNA, 18 bp, Homo sapiens
caggggaaggccctgagg

SEQ ID NO: 6008834 - DNA, 12 bp, Homo sapiens
caggggaagggc

SEQ ID NO: 6008835 - DNA, 17 bp, Homo sapiens
caggggaatattttatt

SEQ ID NO: 6008836 - DNA, 17 bp, Homo sapiens
caggggaattccctccc

SEQ ID NO: 6008837 - DNA, 23 bp, Homo sapiens
caggggaattccctccccctcct

SEQ ID NO: 6008838 - DNA, 18 bp, Homo sapiens
caggggacactggcccca

SEQ ID NO: 6008839 - DNA, 11 bp, Homo sapiens
caggggacagg

SEQ ID NO: 6008840 - DNA, 15 bp, Homo sapiens
caggggaccacacct

SEQ ID NO: 6008841 - DNA, 19 bp, Homo sapiens
caggggacctggagctgcc

SEQ ID NO: 6008842 - DNA, 22 bp, Homo sapiens
caggggacctggagctgccagc

SEQ ID NO: 6008843 - DNA, 18 bp, Homo sapiens
caggggactcagccctga

SEQ ID NO: 6008844 - DNA, 21 bp, Homo sapiens
caggggactcagccctgaggt

SEQ ID NO: 6008845 - DNA, 13 bp, Homo sapiens
caggggactgggc

SEQ ID NO: 6008846 - DNA, 14 bp, Homo sapiens
caggggactgtctc

SEQ ID NO: 6008847 - DNA, 11 bp, Homo sapiens
caggggagaaa

SEQ ID NO: 6008848 - DNA, 16 bp, Homo sapiens
caggggagaaagagga

SEQ ID NO: 6008849 - DNA, 22 bp, Homo sapiens
caggggagaagctgaagccccc

SEQ ID NO: 6008850 - DNA, 22 bp, Homo sapiens
caggggagaatgcagcccacca

SEQ ID NO: 6008851 - DNA, 21 bp, Homo sapiens
caggggagacaggagcctagc

SEQ ID NO: 6008852 - DNA, 14 bp, Homo sapiens
caggggagacttag

SEQ ID NO: 6008853 - DNA, 19 bp, Homo sapiens
caggggagacttaggccag

SEQ ID NO: 6008854 - DNA, 20 bp, Homo sapiens
caggggagagggtctggaga

SEQ ID NO: 6008855 - DNA, 17 bp, Homo sapiens
caggggagatggggagg

SEQ ID NO: 6008856 - DNA, 18 bp, Homo sapiens
caggggagatggggagga

SEQ ID NO: 6008857 - DNA, 22 bp, Homo sapiens
caggggagcagaggggcagagg

SEQ ID NO: 6008858 - DNA, 15 bp, Homo sapiens
caggggagccagctg

SEQ ID NO: 6008859 - DNA, 18 bp, Homo sapiens
caggggagccagctgctt

SEQ ID NO: 6008860 - DNA, 13 bp, Homo sapiens
caggggagccagg

SEQ ID NO: 6008861 - DNA, 14 bp, Homo sapiens
caggggagccaggg

SEQ ID NO: 6008862 - DNA, 17 bp, Homo sapiens
caggggagccagggtag

SEQ ID NO: 6008863 - DNA, 13 bp, Homo sapiens
caggggagccctc

SEQ ID NO: 6008864 - DNA, 17 bp, Homo sapiens
caggggagccctgattt

SEQ ID NO: 6008865 - DNA, 16 bp, Homo sapiens
caggggagcttgggac

SEQ ID NO: 6008866 - DNA, 22 bp, Homo sapiens
caggggaggcacaaagggcagg

SEQ ID NO: 6008867 - DNA, 20 bp, Homo sapiens
caggggaggccaagttgtca

SEQ ID NO: 6008868 - DNA, 16 bp, Homo sapiens
caggggaggccatctg

SEQ ID NO: 6008869 - DNA, 16 bp, Homo sapiens
caggggaggctgagac

SEQ ID NO: 6008870 - DNA, 22 bp, Homo sapiens
caggggagggtcagccagggcc

SEQ ID NO: 6008871 - DNA, 14 bp, Homo sapiens
caggggagtctgct

SEQ ID NO: 6008872 - DNA, 17 bp, Homo sapiens
caggggagtctgcttgt

SEQ ID NO: 6008873 - DNA, 23 bp, Homo sapiens
caggggatacaggcccctgggtt

SEQ ID NO: 6008874 - DNA, 18 bp, Homo sapiens
caggggatactgaaaaat

SEQ ID NO: 6008875 - DNA, 13 bp, Homo sapiens
caggggatcaaag

SEQ ID NO: 6008876 - DNA, 14 bp, Homo sapiens
caggggatcaaagt

SEQ ID NO: 6008877 - DNA, 21 bp, Homo sapiens
caggggatccagctcaaggga

SEQ ID NO: 6008878 - DNA, 20 bp, Homo sapiens
caggggatgcccagaagagt

SEQ ID NO: 6008879 - DNA, 16 bp, Homo sapiens
caggggatggcgtggt

SEQ ID NO: 6008880 - DNA, 23 bp, Homo sapiens
caggggatgtttacctggtgctc

SEQ ID NO: 6008881 - DNA, 20 bp, Homo sapiens
caggggatttcaccactcaa

SEQ ID NO: 6008882 - DNA, 14 bp, Homo sapiens
caggggattttatt

SEQ ID NO: 6008883 - DNA, 20 bp, Homo sapiens
caggggcaaagaactgcccc

SEQ ID NO: 6008884 - DNA, 12 bp, Homo sapiens
caggggcacact

SEQ ID NO: 6008885 - DNA, 19 bp, Homo sapiens
caggggcacagacctctcc

SEQ ID NO: 6008886 - DNA, 18 bp, Homo sapiens
caggggcacctccggctg

SEQ ID NO: 6008887 - DNA, 23 bp, Homo sapiens
caggggcacctccggctgcctag

SEQ ID NO: 6008888 - DNA, 14 bp, Homo sapiens
caggggcagaagga

SEQ ID NO: 6008889 - DNA, 19 bp, Homo sapiens
caggggcagaaggaggaag

SEQ ID NO: 6008890 - DNA, 13 bp, Homo sapiens
caggggcagcaag

SEQ ID NO: 6008891 - DNA, 14 bp, Homo sapiens
caggggcagcaagg

SEQ ID NO: 6008892 - DNA, 17 bp, Homo sapiens
caggggcagcaaggcct

SEQ ID NO: 6008893 - DNA, 19 bp, Homo sapiens
caggggcagcaaggccttg

SEQ ID NO: 6008894 - DNA, 15 bp, Homo sapiens
caggggcagccacac

SEQ ID NO: 6008895 - DNA, 17 bp, Homo sapiens
caggggcagccacacca

SEQ ID NO: 6008896 - DNA, 11 bp, Homo sapiens
caggggcagga

SEQ ID NO: 6008897 - DNA, 14 bp, Homo sapiens
caggggcaggagga

SEQ ID NO: 6008898 - DNA, 14 bp, Homo sapiens
caggggcaggcaca

SEQ ID NO: 6008899 - DNA, 17 bp, Homo sapiens
caggggcaggcacagca

SEQ ID NO: 6008900 - DNA, 14 bp, Homo sapiens
caggggcaggcagc

SEQ ID NO: 6008901 - DNA, 19 bp, Homo sapiens
caggggcaggcagctaggc

SEQ ID NO: 6008902 - DNA, 16 bp, Homo sapiens
caggggcaggcagggc

SEQ ID NO: 6008903 - DNA, 13 bp, Homo sapiens
caggggcaggcct

SEQ ID NO: 6008904 - DNA, 16 bp, Homo sapiens
caggggcaggcctggg

SEQ ID NO: 6008905 - DNA, 13 bp, Homo sapiens
caggggcaggcgc

SEQ ID NO: 6008906 - DNA, 21 bp, Homo sapiens
caggggcaggcgcagaggtcc

SEQ ID NO: 6008907 - DNA, 13 bp, Homo sapiens
caggggcaggtgg

SEQ ID NO: 6008908 - DNA, 15 bp, Homo sapiens
caggggcagtggcct

SEQ ID NO: 6008909 - DNA, 17 bp, Homo sapiens
caggggcagtggcctgg

SEQ ID NO: 6008910 - DNA, 17 bp, Homo sapiens
caggggcatctgtctgt

SEQ ID NO: 6008911 - DNA, 18 bp, Homo sapiens
caggggcatctgtctgtc

SEQ ID NO: 6008912 - DNA, 22 bp, Homo sapiens
caggggcatctgtctgtctgtg

SEQ ID NO: 6008913 - DNA, 15 bp, Homo sapiens
caggggccagagagc

SEQ ID NO: 6008914 - DNA, 18 bp, Homo sapiens
caggggccagagagcagg

SEQ ID NO: 6008915 - DNA, 17 bp, Homo sapiens
caggggccaggagtggg

SEQ ID NO: 6008916 - DNA, 17 bp, Homo sapiens
caggggccatgccccac

SEQ ID NO: 6008917 - DNA, 19 bp, Homo sapiens
caggggccatgccccaccc

SEQ ID NO: 6008918 - DNA, 16 bp, Homo sapiens
caggggcccacaggga

SEQ ID NO: 6008919 - DNA, 24 bp, Homo sapiens
caggggcccaccctctgcccaggg

SEQ ID NO: 6008920 - DNA, 15 bp, Homo sapiens
caggggcccaggctc

SEQ ID NO: 6008921 - DNA, 12 bp, Homo sapiens
caggggccccag

SEQ ID NO: 6008922 - DNA, 15 bp, Homo sapiens
caggggccccagatc

SEQ ID NO: 6008923 - DNA, 19 bp, Homo sapiens
caggggccccagatctgcc

SEQ ID NO: 6008924 - DNA, 21 bp, Homo sapiens
caggggccccagatctgcctg

SEQ ID NO: 6008925 - DNA, 22 bp, Homo sapiens
caggggccccagatctgcctgg

SEQ ID NO: 6008926 - DNA, 17 bp, Homo sapiens
caggggcccctccagct

SEQ ID NO: 6008927 - DNA, 19 bp, Homo sapiens
caggggcccctccagcttg

SEQ ID NO: 6008928 - DNA, 20 bp, Homo sapiens
caggggcccctccagcttgt

SEQ ID NO: 6008929 - DNA, 22 bp, Homo sapiens
caggggcccctcctctgtgctc

SEQ ID NO: 6008930 - DNA, 13 bp, Homo sapiens
caggggcccctgg

SEQ ID NO: 6008931 - DNA, 16 bp, Homo sapiens
caggggcccctgggga

SEQ ID NO: 6008932 - DNA, 22 bp, Homo sapiens
caggggcccgcgatgtggaact

SEQ ID NO: 6008933 - DNA, 15 bp, Homo sapiens
caggggccctacctg

SEQ ID NO: 6008934 - DNA, 16 bp, Homo sapiens
caggggccctacctgg

SEQ ID NO: 6008935 - DNA, 16 bp, Homo sapiens
caggggccctgagcca

SEQ ID NO: 6008936 - DNA, 17 bp, Homo sapiens
caggggccctgcagctc

SEQ ID NO: 6008937 - DNA, 18 bp, Homo sapiens
caggggccctgcagctct

SEQ ID NO: 6008938 - DNA, 19 bp, Homo sapiens
caggggccctgcagctctc

SEQ ID NO: 6008939 - DNA, 15 bp, Homo sapiens
caggggccctggagc

SEQ ID NO: 6008940 - DNA, 20 bp, Homo sapiens
caggggccctggagcagcca

SEQ ID NO: 6008941 - DNA, 16 bp, Homo sapiens
caggggccctgtacag

SEQ ID NO: 6008942 - DNA, 19 bp, Homo sapiens
caggggccgcttcgccatg

SEQ ID NO: 6008943 - DNA, 21 bp, Homo sapiens
caggggcctcaggtcctactg

SEQ ID NO: 6008944 - DNA, 14 bp, Homo sapiens
caggggcctgcaga

SEQ ID NO: 6008945 - DNA, 14 bp, Homo sapiens
caggggcctggagg

SEQ ID NO: 6008946 - DNA, 14 bp, Homo sapiens
caggggcctgggcc

SEQ ID NO: 6008947 - DNA, 15 bp, Homo sapiens
caggggcctgggccg

SEQ ID NO: 6008948 - DNA, 15 bp, Homo sapiens
caggggcgctggctg

SEQ ID NO: 6008949 - DNA, 18 bp, Homo sapiens
caggggcgggcggaggga

SEQ ID NO: 6008950 - DNA, 14 bp, Homo sapiens
caggggcggggcag

SEQ ID NO: 6008951 - DNA, 15 bp, Homo sapiens
caggggcggggcagg

SEQ ID NO: 6008952 - DNA, 17 bp, Homo sapiens
caggggcggggcaggaa

SEQ ID NO: 6008953 - DNA, 18 bp, Homo sapiens
caggggcggggcaggaat

SEQ ID NO: 6008954 - DNA, 23 bp, Homo sapiens
caggggctatcccttctcagaaa

SEQ ID NO: 6008955 - DNA, 13 bp, Homo sapiens
caggggctcagga

SEQ ID NO: 6008956 - DNA, 19 bp, Homo sapiens
caggggctccacctgttca

SEQ ID NO: 6008957 - DNA, 17 bp, Homo sapiens
caggggctccagcacct

SEQ ID NO: 6008958 - DNA, 18 bp, Homo sapiens
caggggctccatgccagc

SEQ ID NO: 6008959 - DNA, 17 bp, Homo sapiens
caggggctccctacatt

SEQ ID NO: 6008960 - DNA, 14 bp, Homo sapiens
caggggctccctcc

SEQ ID NO: 6008961 - DNA, 12 bp, Homo sapiens
caggggctcctg

SEQ ID NO: 6008962 - DNA, 11 bp, Homo sapiens
caggggctctg

SEQ ID NO: 6008963 - DNA, 17 bp, Homo sapiens
caggggctctgagcccg

SEQ ID NO: 6008964 - DNA, 13 bp, Homo sapiens
caggggctctgga

SEQ ID NO: 6008965 - DNA, 14 bp, Homo sapiens
caggggctctggag

SEQ ID NO: 6008966 - DNA, 15 bp, Homo sapiens
caggggctctggaga

SEQ ID NO: 6008967 - DNA, 23 bp, Homo sapiens
caggggctctgtggcaaaaagag

SEQ ID NO: 6008968 - DNA, 17 bp, Homo sapiens
caggggctgcagccccc

SEQ ID NO: 6008969 - DNA, 18 bp, Homo sapiens
caggggctgcagccccct

SEQ ID NO: 6008970 - DNA, 21 bp, Homo sapiens
caggggctgcagccccctgct

SEQ ID NO: 6008971 - DNA, 14 bp, Homo sapiens
caggggctgcatcc

SEQ ID NO: 6008972 - DNA, 21 bp, Homo sapiens
caggggctgcatcctcagccc

SEQ ID NO: 6008973 - DNA, 12 bp, Homo sapiens
caggggctgccc

SEQ ID NO: 6008974 - DNA, 18 bp, Homo sapiens
caggggctgcccgctccc

SEQ ID NO: 6008975 - DNA, 16 bp, Homo sapiens
caggggctgctcatca

SEQ ID NO: 6008976 - DNA, 20 bp, Homo sapiens
caggggctgctcatcaccca

SEQ ID NO: 6008977 - DNA, 15 bp, Homo sapiens
caggggctgctgcct

SEQ ID NO: 6008978 - DNA, 13 bp, Homo sapiens
caggggctgctgg

SEQ ID NO: 6008979 - DNA, 14 bp, Homo sapiens
caggggctggaggg

SEQ ID NO: 6008980 - DNA, 12 bp, Homo sapiens
caggggctggct

SEQ ID NO: 6008981 - DNA, 19 bp, Homo sapiens
caggggctggcttcaggag

SEQ ID NO: 6008982 - DNA, 18 bp, Homo sapiens
caggggctgggcatccca

SEQ ID NO: 6008983 - DNA, 21 bp, Homo sapiens
caggggctgggcatcccagct

SEQ ID NO: 6008984 - DNA, 20 bp, Homo sapiens
caggggctgggctccctgat

SEQ ID NO: 6008985 - DNA, 15 bp, Homo sapiens
caggggctggtgggc

SEQ ID NO: 6008986 - DNA, 18 bp, Homo sapiens
caggggctgtcccggagg

SEQ ID NO: 6008987 - DNA, 17 bp, Homo sapiens
caggggcttcctggtgc

SEQ ID NO: 6008988 - DNA, 18 bp, Homo sapiens
caggggcttctccccctc

SEQ ID NO: 6008989 - DNA, 21 bp, Homo sapiens
caggggcttctccccctcagc

SEQ ID NO: 6008990 - DNA, 13 bp, Homo sapiens
caggggcttgact

SEQ ID NO: 6008991 - DNA, 14 bp, Homo sapiens
caggggcttgagaa

SEQ ID NO: 6008992 - DNA, 20 bp, Homo sapiens
cagaattgctaggtaaagag

SEQ ID NO: 6008993 - DNA, 21 bp, Homo sapiens
cagaattgcttgaacccagga

SEQ ID NO: 6008994 - DNA, 23 bp, Homo sapiens
cagaattgcttgaacccaggagg

SEQ ID NO: 6008995 - DNA, 23 bp, Homo sapiens
cagaattggcataatttgtctta

SEQ ID NO: 6008996 - DNA, 22 bp, Homo sapiens
cagaattgggcccttagaatgt

SEQ ID NO: 6008997 - DNA, 23 bp, Homo sapiens
cagaattgggcccttagaatgtg

SEQ ID NO: 6008998 - DNA, 20 bp, Homo sapiens
cagaattgtatctcatactg

SEQ ID NO: 6008999 - DNA, 17 bp, Homo sapiens
cagaattgttctttttc

SEQ ID NO: 6009000 - DNA, 16 bp, Homo sapiens
cagaatttagactgaa

SEQ ID NO: 6009001 - DNA, 19 bp, Homo sapiens
cagaatttattagtttaaa

SEQ ID NO: 6009002 - DNA, 22 bp, Homo sapiens
cagaatttattagtttaaaatg

SEQ ID NO: 6009003 - DNA, 18 bp, Homo sapiens
cagaatttcccaaagcag

SEQ ID NO: 6009004 - DNA, 20 bp, Homo sapiens
cagaatttcccaaagcagtg

SEQ ID NO: 6009005 - DNA, 21 bp, Homo sapiens
cagaatttgagaaccttggac

SEQ ID NO: 6009006 - DNA, 21 bp, Homo sapiens
cagaatttgtatgtattttca

SEQ ID NO: 6009007 - DNA, 20 bp, Homo sapiens
cagaatttgtgaatatattt

SEQ ID NO: 6009008 - DNA, 13 bp, Homo sapiens
cagaattttaatg

SEQ ID NO: 6009009 - DNA, 15 bp, Homo sapiens
cagaattttaggaac

SEQ ID NO: 6009010 - DNA, 21 bp, Homo sapiens
cagaattttatactttcccta

SEQ ID NO: 6009011 - DNA, 22 bp, Homo sapiens
cagaattttatgtgactgcttt

SEQ ID NO: 6009012 - DNA, 17 bp, Homo sapiens
cagaattttggaaaaat

SEQ ID NO: 6009013 - DNA, 18 bp, Homo sapiens
cagaattttggaaaaatg

SEQ ID NO: 6009014 - DNA, 13 bp, Homo sapiens
cagaattttgtat

SEQ ID NO: 6009015 - DNA, 17 bp, Homo sapiens
cagaatttttaactgta

SEQ ID NO: 6009016 - DNA, 22 bp, Homo sapiens
cagaattttttgagtaattcta

SEQ ID NO: 6009017 - DNA, 20 bp, Homo sapiens
cagacaaaaacagcctcaca

SEQ ID NO: 6009018 - DNA, 15 bp, Homo sapiens
cagacaaaaagaaca

SEQ ID NO: 6009019 - DNA, 20 bp, Homo sapiens
cagacaaaaagaacaaaaaa

SEQ ID NO: 6009020 - DNA, 12 bp, Homo sapiens
cagacaaaacaa

SEQ ID NO: 6009021 - DNA, 21 bp, Homo sapiens
cagacaaaacaatccccatca

SEQ ID NO: 6009022 - DNA, 14 bp, Homo sapiens
cagacaaaatgaaa

SEQ ID NO: 6009023 - DNA, 20 bp, Homo sapiens
cagacaaaatgaaagaaaat

SEQ ID NO: 6009024 - DNA, 14 bp, Homo sapiens
cagacaaagccctg

SEQ ID NO: 6009025 - DNA, 15 bp, Homo sapiens
cagacaaagccctgt

SEQ ID NO: 6009026 - DNA, 21 bp, Homo sapiens
cagacaaagtaattcctctca

SEQ ID NO: 6009027 - DNA, 13 bp, Homo sapiens
cagacaaatgaaa

SEQ ID NO: 6009028 - DNA, 22 bp, Homo sapiens
cagacaaatgtggttacacact

SEQ ID NO: 6009029 - DNA, 18 bp, Homo sapiens
cagacaaattcattccct

SEQ ID NO: 6009030 - DNA, 16 bp, Homo sapiens
cagacaacaccttcct

SEQ ID NO: 6009031 - DNA, 17 bp, Homo sapiens
cagacaacacgttacta

SEQ ID NO: 6009032 - DNA, 16 bp, Homo sapiens
cagacaacagaagtca

SEQ ID NO: 6009033 - DNA, 22 bp, Homo sapiens
cagacaacagaagtcatgaagc

SEQ ID NO: 6009034 - DNA, 15 bp, Homo sapiens
cagacaaccaaaaca

SEQ ID NO: 6009035 - DNA, 16 bp, Homo sapiens
cagacaaccaaaacat

SEQ ID NO: 6009036 - DNA, 18 bp, Homo sapiens
cagacaacgggcccatgg

SEQ ID NO: 6009037 - DNA, 20 bp, Homo sapiens
cagacaacgggcccatggcc

SEQ ID NO: 6009038 - DNA, 18 bp, Homo sapiens
cagacaagacagagggga

SEQ ID NO: 6009039 - DNA, 19 bp, Homo sapiens
cagacaagacagaggggag

SEQ ID NO: 6009040 - DNA, 20 bp, Homo sapiens
cagacaagacagaggggagc

SEQ ID NO: 6009041 - DNA, 15 bp, Homo sapiens
cagacaagagctgct

SEQ ID NO: 6009042 - DNA, 18 bp, Homo sapiens
cagacaagcaacccaaac

SEQ ID NO: 6009043 - DNA, 17 bp, Homo sapiens
cagacaagcactatttt

SEQ ID NO: 6009044 - DNA, 15 bp, Homo sapiens
cagacaagcagccct

SEQ ID NO: 6009045 - DNA, 15 bp, Homo sapiens
cagacaagctgttga

SEQ ID NO: 6009046 - DNA, 17 bp, Homo sapiens
cagacaaggaaataccc

SEQ ID NO: 6009047 - DNA, 16 bp, Homo sapiens
cagacaaggagagcgg

SEQ ID NO: 6009048 - DNA, 18 bp, Homo sapiens
cagacaaggcaggcctga

SEQ ID NO: 6009049 - DNA, 16 bp, Homo sapiens
cagacaaggtagccct

SEQ ID NO: 6009050 - DNA, 17 bp, Homo sapiens
cagacaaggtgcctgtt

SEQ ID NO: 6009051 - DNA, 22 bp, Homo sapiens
cagacaagtctggcacttcctt

SEQ ID NO: 6009052 - DNA, 22 bp, Homo sapiens
cagacaagtggctaagtgtcca

SEQ ID NO: 6009053 - DNA, 23 bp, Homo sapiens
cagacaataaaccctcagagcct

SEQ ID NO: 6009054 - DNA, 14 bp, Homo sapiens
cagacaatccactc

SEQ ID NO: 6009055 - DNA, 20 bp, Homo sapiens
cagacaatccactctcagga

SEQ ID NO: 6009056 - DNA, 14 bp, Homo sapiens
cagacaatcttctg

SEQ ID NO: 6009057 - DNA, 15 bp, Homo sapiens
cagacaattccattc

SEQ ID NO: 6009058 - DNA, 19 bp, Homo sapiens
cagacaattctaatggtaa

SEQ ID NO: 6009059 - DNA, 21 bp, Homo sapiens
cagacacaaagagacaaagct

SEQ ID NO: 6009060 - DNA, 16 bp, Homo sapiens
cagacacaatatgtat

SEQ ID NO: 6009061 - DNA, 11 bp, Homo sapiens
cagacacacac

SEQ ID NO: 6009062 - DNA, 16 bp, Homo sapiens
cagacacacacacgca

SEQ ID NO: 6009063 - DNA, 18 bp, Homo sapiens
cagacacacacacgcacg

SEQ ID NO: 6009064 - DNA, 20 bp, Homo sapiens
cagacacacacatatataca

SEQ ID NO: 6009065 - DNA, 14 bp, Homo sapiens
cagacacacactgg

SEQ ID NO: 6009066 - DNA, 15 bp, Homo sapiens
cagacacacatgacg

SEQ ID NO: 6009067 - DNA, 21 bp, Homo sapiens
cagacacacatgggcagccca

SEQ ID NO: 6009068 - DNA, 16 bp, Homo sapiens
cagacacaccgcggcc

SEQ ID NO: 6009069 - DNA, 21 bp, Homo sapiens
cagacacaccgcggccaggca

SEQ ID NO: 6009070 - DNA, 18 bp, Homo sapiens
cagacacacgcacacaca

SEQ ID NO: 6009071 - DNA, 15 bp, Homo sapiens
cagacacagagacat

SEQ ID NO: 6009072 - DNA, 12 bp, Homo sapiens
cagacacagctc

SEQ ID NO: 6009073 - DNA, 14 bp, Homo sapiens
cagacacagctctt

SEQ ID NO: 6009074 - DNA, 15 bp, Homo sapiens
cagacacagctcttc

SEQ ID NO: 6009075 - DNA, 21 bp, Homo sapiens
cagacacagctcttccagggc

SEQ ID NO: 6009076 - DNA, 15 bp, Homo sapiens
cagacacaggaaaaa

SEQ ID NO: 6009077 - DNA, 19 bp, Homo sapiens
cagacacaggaaaaataaa

SEQ ID NO: 6009078 - DNA, 15 bp, Homo sapiens
cagacacaggcccgg

SEQ ID NO: 6009079 - DNA, 18 bp, Homo sapiens
cagacacaggcccggctc

SEQ ID NO: 6009080 - DNA, 20 bp, Homo sapiens
cagacacagggacttgaagt

SEQ ID NO: 6009081 - DNA, 22 bp, Homo sapiens
cagacacagggacttgaagttg

SEQ ID NO: 6009082 - DNA, 22 bp, Homo sapiens
cagacacattctcctgtgcccc

SEQ ID NO: 6009083 - DNA, 11 bp, Homo sapiens
cagacaccaca

SEQ ID NO: 6009084 - DNA, 14 bp, Homo sapiens
cagacaccacagcc

SEQ ID NO: 6009085 - DNA, 15 bp, Homo sapiens
cagacaccacagcct

SEQ ID NO: 6009086 - DNA, 20 bp, Homo sapiens
cagacaccacagcctcccct

SEQ ID NO: 6009087 - DNA, 21 bp, Homo sapiens
cagacaccacagcctcccctt

SEQ ID NO: 6009088 - DNA, 16 bp, Homo sapiens
cagacaccatcaccac

SEQ ID NO: 6009089 - DNA, 12 bp, Homo sapiens
cagacacccagg

SEQ ID NO: 6009090 - DNA, 17 bp, Homo sapiens
cagacacccaggactta

SEQ ID NO: 6009091 - DNA, 21 bp, Homo sapiens
cagacaccctcaacctcttct

SEQ ID NO: 6009092 - DNA, 16 bp, Homo sapiens
cagacaccctccactc

SEQ ID NO: 6009093 - DNA, 22 bp, Homo sapiens
cagacaccctccactctgaggt

SEQ ID NO: 6009094 - DNA, 15 bp, Homo sapiens
cagacacccttggag

SEQ ID NO: 6009095 - DNA, 13 bp, Homo sapiens
cagacacctgtgc

SEQ ID NO: 6009096 - DNA, 22 bp, Homo sapiens
cagacaccttgacagggcacac

SEQ ID NO: 6009097 - DNA, 19 bp, Homo sapiens
cagacacgctcgcgggcag

SEQ ID NO: 6009098 - DNA, 22 bp, Homo sapiens
cagacacggatctgagaatctt

SEQ ID NO: 6009099 - DNA, 11 bp, Homo sapiens
cagacactaag

SEQ ID NO: 6009100 - DNA, 17 bp, Homo sapiens
cagacactcaagagccc

SEQ ID NO: 6009101 - DNA, 20 bp, Homo sapiens
cagacactccagtttgccca

SEQ ID NO: 6009102 - DNA, 13 bp, Homo sapiens
cagacactcctgg

SEQ ID NO: 6009103 - DNA, 14 bp, Homo sapiens
cagacactcctggg

SEQ ID NO: 6009104 - DNA, 14 bp, Homo sapiens
cagacactctgctc

SEQ ID NO: 6009105 - DNA, 20 bp, Homo sapiens
cagacactctgctctgccct

SEQ ID NO: 6009106 - DNA, 14 bp, Homo sapiens
cagacactctggct

SEQ ID NO: 6009107 - DNA, 21 bp, Homo sapiens
cagacactgaccatccactct

SEQ ID NO: 6009108 - DNA, 20 bp, Homo sapiens
cagacactgagcttctgaga

SEQ ID NO: 6009109 - DNA, 21 bp, Homo sapiens
cagacactgagcttctgagac

SEQ ID NO: 6009110 - DNA, 14 bp, Homo sapiens
cagacactgccttg

SEQ ID NO: 6009111 - DNA, 24 bp, Homo sapiens
cagacactgcgccccgcctgacct

SEQ ID NO: 6009112 - DNA, 22 bp, Homo sapiens
cagacactggtttgaagaatgt

SEQ ID NO: 6009113 - DNA, 15 bp, Homo sapiens
cagacactgttgcaa

SEQ ID NO: 6009114 - DNA, 18 bp, Homo sapiens
cagacacttaactcaatt

SEQ ID NO: 6009115 - DNA, 13 bp, Homo sapiens
cagacacttattt

SEQ ID NO: 6009116 - DNA, 20 bp, Homo sapiens
cagacacttatttattggga

SEQ ID NO: 6009117 - DNA, 19 bp, Homo sapiens
cagacactttggaagtttg

SEQ ID NO: 6009118 - DNA, 22 bp, Homo sapiens
cagacacttttcaaaagaagac

SEQ ID NO: 6009119 - DNA, 21 bp, Homo sapiens
cagacacttttttgagtggat

SEQ ID NO: 6009120 - DNA, 23 bp, Homo sapiens
cagacagaacttgaatgtgtcag

SEQ ID NO: 6009121 - DNA, 23 bp, Homo sapiens
cagacagaagtcactcaattgtt

SEQ ID NO: 6009122 - DNA, 17 bp, Homo sapiens
cagacagaagtctcctc

SEQ ID NO: 6009123 - DNA, 14 bp, Homo sapiens
cagacagacagacg

SEQ ID NO: 6009124 - DNA, 17 bp, Homo sapiens
cagacagaccttcacag

SEQ ID NO: 6009125 - DNA, 21 bp, Homo sapiens
cagacagagaatatgtctgct

SEQ ID NO: 6009126 - DNA, 14 bp, Homo sapiens
cagacagagacttt

SEQ ID NO: 6009127 - DNA, 16 bp, Homo sapiens
cagacagagactttaa

SEQ ID NO: 6009128 - DNA, 16 bp, Homo sapiens
cagacagagccaggag

SEQ ID NO: 6009129 - DNA, 16 bp, Homo sapiens
cagacagaggcagggc

SEQ ID NO: 6009130 - DNA, 12 bp, Homo sapiens
cagacagagtgg

SEQ ID NO: 6009131 - DNA, 13 bp, Homo sapiens
cagacagagtgga

SEQ ID NO: 6009132 - DNA, 14 bp, Homo sapiens
cagacagagtggat

SEQ ID NO: 6009133 - DNA, 21 bp, Homo sapiens
cagacagcaacggggaggcca

SEQ ID NO: 6009134 - DNA, 15 bp, Homo sapiens
cagacagcaagggct

SEQ ID NO: 6009135 - DNA, 22 bp, Homo sapiens
cagacagcaaggtgtggaggct

SEQ ID NO: 6009136 - DNA, 13 bp, Homo sapiens
cagacagcagctc

SEQ ID NO: 6009137 - DNA, 15 bp, Homo sapiens
cagacagcagctcag

SEQ ID NO: 6009138 - DNA, 16 bp, Homo sapiens
cagacagcagctcagg

SEQ ID NO: 6009139 - DNA, 14 bp, Homo sapiens
cagacagcagctgg

SEQ ID NO: 6009140 - DNA, 13 bp, Homo sapiens
cagacagccaggt

SEQ ID NO: 6009141 - DNA, 14 bp, Homo sapiens
cagacagccctcca

SEQ ID NO: 6009142 - DNA, 19 bp, Homo sapiens
cagacagccgtttgttcta

SEQ ID NO: 6009143 - DNA, 13 bp, Homo sapiens
cagacagcctgta

SEQ ID NO: 6009144 - DNA, 14 bp, Homo sapiens
cagacagcctgtat

SEQ ID NO: 6009145 - DNA, 14 bp, Homo sapiens
cagacagctgcctg

SEQ ID NO: 6009146 - DNA, 15 bp, Homo sapiens
cagacagctgcctgg

SEQ ID NO: 6009147 - DNA, 18 bp, Homo sapiens
cagacagctgcctgggat

SEQ ID NO: 6009148 - DNA, 14 bp, Homo sapiens
cagacagctgctca

SEQ ID NO: 6009149 - DNA, 15 bp, Homo sapiens
cagacagctgctcag

SEQ ID NO: 6009150 - DNA, 17 bp, Homo sapiens
cagacagcttacaggag

SEQ ID NO: 6009151 - DNA, 20 bp, Homo sapiens
cagacagcttacaggagcca

SEQ ID NO: 6009152 - DNA, 13 bp, Homo sapiens
cagacagcttgac

SEQ ID NO: 6009153 - DNA, 19 bp, Homo sapiens
cagacagcttgactgcttt

SEQ ID NO: 6009154 - DNA, 13 bp, Homo sapiens
cagacaggaagga

SEQ ID NO: 6009155 - DNA, 18 bp, Homo sapiens
cagacaggaaggaagcac

SEQ ID NO: 6009156 - DNA, 22 bp, Homo sapiens
cagacaggaatttagaaaaagt

SEQ ID NO: 6009157 - DNA, 16 bp, Homo sapiens
cagacaggaccaggga

SEQ ID NO: 6009158 - DNA, 23 bp, Homo sapiens
cagacaggacccctgcagttccc

SEQ ID NO: 6009159 - DNA, 21 bp, Homo sapiens
cagacaggagaaatgcatcca

SEQ ID NO: 6009160 - DNA, 18 bp, Homo sapiens
cagacaggcaaataaaag

SEQ ID NO: 6009161 - DNA, 20 bp, Homo sapiens
cagacaggcaagcacctcct

SEQ ID NO: 6009162 - DNA, 22 bp, Homo sapiens
cagacaggcaagcacctcctgc

SEQ ID NO: 6009163 - DNA, 21 bp, Homo sapiens
cagacaggccatgtgagccac

SEQ ID NO: 6009164 - DNA, 18 bp, Homo sapiens
cagacaggctcttagcag

SEQ ID NO: 6009165 - DNA, 22 bp, Homo sapiens
cagacaggctcttagcagcttc

SEQ ID NO: 6009166 - DNA, 18 bp, Homo sapiens
cagacaggctggcattct

SEQ ID NO: 6009167 - DNA, 22 bp, Homo sapiens
cagacagggaattaggccccca

SEQ ID NO: 6009168 - DNA, 12 bp, Homo sapiens
cagacagggaga

SEQ ID NO: 6009169 - DNA, 16 bp, Homo sapiens
cagacagggagaagtt

SEQ ID NO: 6009170 - DNA, 15 bp, Homo sapiens
caggggcttgagaag

SEQ ID NO: 6009171 - DNA, 16 bp, Homo sapiens
caggggcttggatttc

SEQ ID NO: 6009172 - DNA, 17 bp, Homo sapiens
caggggctttggaagct

SEQ ID NO: 6009173 - DNA, 14 bp, Homo sapiens
caggggctttgggc

SEQ ID NO: 6009174 - DNA, 15 bp, Homo sapiens
caggggctttgggcc

SEQ ID NO: 6009175 - DNA, 16 bp, Homo sapiens
caggggctttgggccc

SEQ ID NO: 6009176 - DNA, 17 bp, Homo sapiens
caggggctttgggccca

SEQ ID NO: 6009177 - DNA, 19 bp, Homo sapiens
caggggctttgggcccaag

SEQ ID NO: 6009178 - DNA, 22 bp, Homo sapiens
caggggctttgggcccaagaac

SEQ ID NO: 6009179 - DNA, 15 bp, Homo sapiens
cagggggaagaagca

SEQ ID NO: 6009180 - DNA, 19 bp, Homo sapiens
cagggggaaggtggggtcc

SEQ ID NO: 6009181 - DNA, 17 bp, Homo sapiens
cagggggacctaggctc

SEQ ID NO: 6009182 - DNA, 20 bp, Homo sapiens
cagggggacctaggctcctc

SEQ ID NO: 6009183 - DNA, 17 bp, Homo sapiens
cagggggagaaggaaga

SEQ ID NO: 6009184 - DNA, 16 bp, Homo sapiens
cagggggagaatgggt

SEQ ID NO: 6009185 - DNA, 18 bp, Homo sapiens
cagggggagctgggcctg

SEQ ID NO: 6009186 - DNA, 21 bp, Homo sapiens
cagggggatatgggtcctctg

SEQ ID NO: 6009187 - DNA, 19 bp, Homo sapiens
cagggggattctgagcagt

SEQ ID NO: 6009188 - DNA, 11 bp, Homo sapiens
cagggggccag

SEQ ID NO: 6009189 - DNA, 15 bp, Homo sapiens
cagggggccagctgg

SEQ ID NO: 6009190 - DNA, 16 bp, Homo sapiens
cagggggccaggtgca

SEQ ID NO: 6009191 - DNA, 22 bp, Homo sapiens
cagggggccagtccctgaggca

SEQ ID NO: 6009192 - DNA, 20 bp, Homo sapiens
cagggggccccgccagggct

SEQ ID NO: 6009193 - DNA, 14 bp, Homo sapiens
cagggggccctgcc

SEQ ID NO: 6009194 - DNA, 17 bp, Homo sapiens
cagggggccctgcccca

SEQ ID NO: 6009195 - DNA, 17 bp, Homo sapiens
cagggggcctgcaggcc

SEQ ID NO: 6009196 - DNA, 20 bp, Homo sapiens
cagggggcctgcaggcccca

SEQ ID NO: 6009197 - DNA, 22 bp, Homo sapiens
cagggggcctttaaagacttaa

SEQ ID NO: 6009198 - DNA, 16 bp, Homo sapiens
cagggggctgaaactt

SEQ ID NO: 6009199 - DNA, 20 bp, Homo sapiens
cagggggctgctgctgggct

SEQ ID NO: 6009200 - DNA, 17 bp, Homo sapiens
caggggggctgtgccaa

SEQ ID NO: 6009201 - DNA, 20 bp, Homo sapiens
cagggggggaaatgcattta

SEQ ID NO: 6009202 - DNA, 18 bp, Homo sapiens
caggggggtgaggagctg

SEQ ID NO: 6009203 - DNA, 22 bp, Homo sapiens
caggggggttgggttccagaca

SEQ ID NO: 6009204 - DNA, 20 bp, Homo sapiens
caggggggttgtgaggcctg

SEQ ID NO: 6009205 - DNA, 14 bp, Homo sapiens
cagggggtaggaga

SEQ ID NO: 6009206 - DNA, 21 bp, Homo sapiens
cagggggtaggagagcactgc

SEQ ID NO: 6009207 - DNA, 22 bp, Homo sapiens
cagggggtaggagagcactgcc

SEQ ID NO: 6009208 - DNA, 19 bp, Homo sapiens
cagggggtatgcagagctt

SEQ ID NO: 6009209 - DNA, 13 bp, Homo sapiens
cagggggtctggc

SEQ ID NO: 6009210 - DNA, 17 bp, Homo sapiens
cagggggtctggctggt

SEQ ID NO: 6009211 - DNA, 21 bp, Homo sapiens
cagggggtggagagaccagcc

SEQ ID NO: 6009212 - DNA, 23 bp, Homo sapiens
cagggggttctgggacccactcc

SEQ ID NO: 6009213 - DNA, 16 bp, Homo sapiens
caggggtacacagagc

SEQ ID NO: 6009214 - DNA, 21 bp, Homo sapiens
caggggtacacagagctaagg

SEQ ID NO: 6009215 - DNA, 23 bp, Homo sapiens
caggggtacacagagctaaggcc

SEQ ID NO: 6009216 - DNA, 14 bp, Homo sapiens
caggggtcacctcc

SEQ ID NO: 6009217 - DNA, 14 bp, Homo sapiens
caggggtcaccttg

SEQ ID NO: 6009218 - DNA, 16 bp, Homo sapiens
caggggtcactgaggc

SEQ ID NO: 6009219 - DNA, 23 bp, Homo sapiens
caggggtcactgaggcctgagac

SEQ ID NO: 6009220 - DNA, 13 bp, Homo sapiens
caggggtcagtgc

SEQ ID NO: 6009221 - DNA, 21 bp, Homo sapiens
caggggtcagtgcagcagagg

SEQ ID NO: 6009222 - DNA, 14 bp, Homo sapiens
caggggtccaggcc

SEQ ID NO: 6009223 - DNA, 18 bp, Homo sapiens
caggggtcccagccaccc

SEQ ID NO: 6009224 - DNA, 14 bp, Homo sapiens
caggggtccctgct

SEQ ID NO: 6009225 - DNA, 14 bp, Homo sapiens
caggggtcctgcag

SEQ ID NO: 6009226 - DNA, 16 bp, Homo sapiens
caggggtcctgcaggt

SEQ ID NO: 6009227 - DNA, 18 bp, Homo sapiens
caggggtcctgcaggtcc

SEQ ID NO: 6009228 - DNA, 23 bp, Homo sapiens
caggggtcgcgatgatgggctgg

SEQ ID NO: 6009229 - DNA, 21 bp, Homo sapiens
caggggtctccctgagcctgc

SEQ ID NO: 6009230 - DNA, 17 bp, Homo sapiens
caggggtctcgggggtg

SEQ ID NO: 6009231 - DNA, 14 bp, Homo sapiens
caggggtctgagcc

SEQ ID NO: 6009232 - DNA, 15 bp, Homo sapiens
caggggtctgagcca

SEQ ID NO: 6009233 - DNA, 21 bp, Homo sapiens
caggggtgagagcacccactg

SEQ ID NO: 6009234 - DNA, 16 bp, Homo sapiens
caggggtgagccccgc

SEQ ID NO: 6009235 - DNA, 21 bp, Homo sapiens
caggggtgcacagtccacagc

SEQ ID NO: 6009236 - DNA, 13 bp, Homo sapiens
caggggtgccccc

SEQ ID NO: 6009237 - DNA, 12 bp, Homo sapiens
caggggtgctgg

SEQ ID NO: 6009238 - DNA, 14 bp, Homo sapiens
caggggtgctgggg

SEQ ID NO: 6009239 - DNA, 18 bp, Homo sapiens
caggggtgctggggcaga

SEQ ID NO: 6009240 - DNA, 19 bp, Homo sapiens
caggggtgctggggcagag

SEQ ID NO: 6009241 - DNA, 21 bp, Homo sapiens
caggggtgctggggcagagtg

SEQ ID NO: 6009242 - DNA, 22 bp, Homo sapiens
caggggtgctggggcagagtgg

SEQ ID NO: 6009243 - DNA, 23 bp, Homo sapiens
caggggtgctggggcagagtgga

SEQ ID NO: 6009244 - DNA, 23 bp, Homo sapiens
caggggtgctgtggacatgtggg

SEQ ID NO: 6009245 - DNA, 13 bp, Homo sapiens
caggggtggagaa

SEQ ID NO: 6009246 - DNA, 18 bp, Homo sapiens
caggggtggaggagagcc

SEQ ID NO: 6009247 - DNA, 19 bp, Homo sapiens
caggggtggagtttctgac

SEQ ID NO: 6009248 - DNA, 16 bp, Homo sapiens
caggggtgggagagcc

SEQ ID NO: 6009249 - DNA, 13 bp, Homo sapiens
caggggtgggagg

SEQ ID NO: 6009250 - DNA, 16 bp, Homo sapiens
caggggtggggcccat

SEQ ID NO: 6009251 - DNA, 16 bp, Homo sapiens
caggggtggggggtgc

SEQ ID NO: 6009252 - DNA, 20 bp, Homo sapiens
caggggtgggggtggaggct

SEQ ID NO: 6009253 - DNA, 18 bp, Homo sapiens
caggggtgtcccagtccc

SEQ ID NO: 6009254 - DNA, 21 bp, Homo sapiens
caggggtgtcccagtcccagc

SEQ ID NO: 6009255 - DNA, 14 bp, Homo sapiens
caggggtgtcctga

SEQ ID NO: 6009256 - DNA, 20 bp, Homo sapiens
caggggttatgtggaagtgt

SEQ ID NO: 6009257 - DNA, 17 bp, Homo sapiens
caggggttccagcttcc

SEQ ID NO: 6009258 - DNA, 12 bp, Homo sapiens
caggggttcctt

SEQ ID NO: 6009259 - DNA, 23 bp, Homo sapiens
caggggttctgagaagcgctgcc

SEQ ID NO: 6009260 - DNA, 19 bp, Homo sapiens
caggggttcttgagccagc

SEQ ID NO: 6009261 - DNA, 20 bp, Homo sapiens
caggggtttgcttacagtga

SEQ ID NO: 6009262 - DNA, 23 bp, Homo sapiens
caggggtttgcttacagtgatgc

SEQ ID NO: 6009263 - DNA, 14 bp, Homo sapiens
cagggtaaattatt

SEQ ID NO: 6009264 - DNA, 21 bp, Homo sapiens
cagggtaactgtgctgaatgc

SEQ ID NO: 6009265 - DNA, 18 bp, Homo sapiens
cagggtacactcttctcc

SEQ ID NO: 6009266 - DNA, 17 bp, Homo sapiens
cagggtacctcaagccc

SEQ ID NO: 6009267 - DNA, 23 bp, Homo sapiens
cagggtagaattgtttggcaatg

SEQ ID NO: 6009268 - DNA, 22 bp, Homo sapiens
cagggtagacttggagctgtcc

SEQ ID NO: 6009269 - DNA, 14 bp, Homo sapiens
cagggtagagagga

SEQ ID NO: 6009270 - DNA, 18 bp, Homo sapiens
cagggtagagcaaaggag

SEQ ID NO: 6009271 - DNA, 19 bp, Homo sapiens
cagggtagagcaaaggaga

SEQ ID NO: 6009272 - DNA, 18 bp, Homo sapiens
cagggtagatttctcttg

SEQ ID NO: 6009273 - DNA, 21 bp, Homo sapiens
cagggtagcagcagaggcagg

SEQ ID NO: 6009274 - DNA, 13 bp, Homo sapiens
cagggtagcaggt

SEQ ID NO: 6009275 - DNA, 13 bp, Homo sapiens
cagggtaggaaag

SEQ ID NO: 6009276 - DNA, 14 bp, Homo sapiens
cagggtaggaaagg

SEQ ID NO: 6009277 - DNA, 15 bp, Homo sapiens
cagggtaggaaaggg

SEQ ID NO: 6009278 - DNA, 22 bp, Homo sapiens
cagggtaggggagggtggggca

SEQ ID NO: 6009279 - DNA, 17 bp, Homo sapiens
cagggtcaaactacatt

SEQ ID NO: 6009280 - DNA, 17 bp, Homo sapiens
cagggtcaaagacagaa

SEQ ID NO: 6009281 - DNA, 20 bp, Homo sapiens
cagggtcaaagacagaatgg

SEQ ID NO: 6009282 - DNA, 23 bp, Homo sapiens
cagggtcaaagtgttttctctga

SEQ ID NO: 6009283 - DNA, 21 bp, Homo sapiens
cagggtcactgaaccactgct

SEQ ID NO: 6009284 - DNA, 14 bp, Homo sapiens
cagggtcaggagag

SEQ ID NO: 6009285 - DNA, 17 bp, Homo sapiens
cagggtcagtggaagcc

SEQ ID NO: 6009286 - DNA, 17 bp, Homo sapiens
cagggtcagtgtatcta

SEQ ID NO: 6009287 - DNA, 14 bp, Homo sapiens
cagggtccacagct

SEQ ID NO: 6009288 - DNA, 20 bp, Homo sapiens
cagggtccacagctggaaag

SEQ ID NO: 6009289 - DNA, 14 bp, Homo sapiens
cagggtccagaccc

SEQ ID NO: 6009290 - DNA, 17 bp, Homo sapiens
cagggtccagccctccg

SEQ ID NO: 6009291 - DNA, 20 bp, Homo sapiens
cagggtccaggagagcctgg

SEQ ID NO: 6009292 - DNA, 17 bp, Homo sapiens
cagggtcccacagccac

SEQ ID NO: 6009293 - DNA, 15 bp, Homo sapiens
cagggtcccaccccc

SEQ ID NO: 6009294 - DNA, 12 bp, Homo sapiens
cagggtcccagc

SEQ ID NO: 6009295 - DNA, 21 bp, Homo sapiens
cagggtcccagcctggccacc

SEQ ID NO: 6009296 - DNA, 13 bp, Homo sapiens
cagggtcccagga

SEQ ID NO: 6009297 - DNA, 21 bp, Homo sapiens
cagggtcccatttctcactga

SEQ ID NO: 6009298 - DNA, 21 bp, Homo sapiens
cagggtccccgagtgcctagg

SEQ ID NO: 6009299 - DNA, 12 bp, Homo sapiens
cagggtcccctc

SEQ ID NO: 6009300 - DNA, 14 bp, Homo sapiens
cagggtcccctccc

SEQ ID NO: 6009301 - DNA, 17 bp, Homo sapiens
cagggtcccctccccag

SEQ ID NO: 6009302 - DNA, 19 bp, Homo sapiens
cagggtcccctccccagct

SEQ ID NO: 6009303 - DNA, 13 bp, Homo sapiens
cagggtcccctgc

SEQ ID NO: 6009304 - DNA, 17 bp, Homo sapiens
cagggtcccctgccacc

SEQ ID NO: 6009305 - DNA, 15 bp, Homo sapiens
cagggtccctcagga

SEQ ID NO: 6009306 - DNA, 15 bp, Homo sapiens
cagggtccctctgtg

SEQ ID NO: 6009307 - DNA, 13 bp, Homo sapiens
cagggtccctgct

SEQ ID NO: 6009308 - DNA, 16 bp, Homo sapiens
cagggtccctggatca

SEQ ID NO: 6009309 - DNA, 17 bp, Homo sapiens
cagggtccgcaccagct

SEQ ID NO: 6009310 - DNA, 19 bp, Homo sapiens
cagggtccgcaccagctgc

SEQ ID NO: 6009311 - DNA, 18 bp, Homo sapiens
cagggtcctccggggctc

SEQ ID NO: 6009312 - DNA, 23 bp, Homo sapiens
cagggtcctctagcccactccct

SEQ ID NO: 6009313 - DNA, 12 bp, Homo sapiens
cagggtcctctc

SEQ ID NO: 6009314 - DNA, 19 bp, Homo sapiens
cagggtcctctcttccaca

SEQ ID NO: 6009315 - DNA, 21 bp, Homo sapiens
cagggtcctctcttccacagt

SEQ ID NO: 6009316 - DNA, 12 bp, Homo sapiens
cagggtcctgag

SEQ ID NO: 6009317 - DNA, 15 bp, Homo sapiens
cagggtcctgagtgg

SEQ ID NO: 6009318 - DNA, 23 bp, Homo sapiens
cagggtcctgccctccggaggag

SEQ ID NO: 6009319 - DNA, 20 bp, Homo sapiens
cagggtcctgctatttccca

SEQ ID NO: 6009320 - DNA, 21 bp, Homo sapiens
cagggtcctgggggctgctgc

SEQ ID NO: 6009321 - DNA, 22 bp, Homo sapiens
cagggtcctgggggctgctgca

SEQ ID NO: 6009322 - DNA, 15 bp, Homo sapiens
cagggtcctgtgcct

SEQ ID NO: 6009323 - DNA, 21 bp, Homo sapiens
cagggtccttttgacactgct

SEQ ID NO: 6009324 - DNA, 15 bp, Homo sapiens
cagggtctaaagaga

SEQ ID NO: 6009325 - DNA, 21 bp, Homo sapiens
cagggtctaaagagaacaaga

SEQ ID NO: 6009326 - DNA, 24 bp, Homo sapiens
cagggtctaaggagcgctagtgcc

SEQ ID NO: 6009327 - DNA, 23 bp, Homo sapiens
cagggtctcactatgttgcccag

SEQ ID NO: 6009328 - DNA, 15 bp, Homo sapiens
cagggtctcactctg

SEQ ID NO: 6009329 - DNA, 16 bp, Homo sapiens
cagggtctcactctgt

SEQ ID NO: 6009330 - DNA, 17 bp, Homo sapiens
cagggtctcactctgtc

SEQ ID NO: 6009331 - DNA, 18 bp, Homo sapiens
cagggtctcactctgttg

SEQ ID NO: 6009332 - DNA, 17 bp, Homo sapiens
cagggtctcactgtgtt

SEQ ID NO: 6009333 - DNA, 19 bp, Homo sapiens
cagggtctccagaaagccc

SEQ ID NO: 6009334 - DNA, 13 bp, Homo sapiens
cagggtctcccta

SEQ ID NO: 6009335 - DNA, 17 bp, Homo sapiens
cagggtctccttccttc

SEQ ID NO: 6009336 - DNA, 15 bp, Homo sapiens
cagggtctcgtcagg

SEQ ID NO: 6009337 - DNA, 19 bp, Homo sapiens
cagggtctctagtgctgtg

SEQ ID NO: 6009338 - DNA, 23 bp, Homo sapiens
cagggtctctagtgctgtgaaaa

SEQ ID NO: 6009339 - DNA, 18 bp, Homo sapiens
cagggtctctcagggatg

SEQ ID NO: 6009340 - DNA, 17 bp, Homo sapiens
cagggtctctgctccag

SEQ ID NO: 6009341 - DNA, 18 bp, Homo sapiens
cagggtctctgctccagc

SEQ ID NO: 6009342 - DNA, 19 bp, Homo sapiens
cagggtctctgctccagca

SEQ ID NO: 6009343 - DNA, 16 bp, Homo sapiens
cagggtctcttccttc

SEQ ID NO: 6009344 - DNA, 13 bp, Homo sapiens
cagggtctgctct

SEQ ID NO: 6009345 - DNA, 13 bp, Homo sapiens
cagggtctggcag

SEQ ID NO: 6009346 - DNA, 21 bp, Homo sapiens
cagggtctggcagagcctctg

SEQ ID NO: 6009347 - DNA, 14 bp, Homo sapiens
cagggtctgggaca

SEQ ID NO: 6009348 - DNA, 19 bp, Homo sapiens
cagacagggctccagcctg

SEQ ID NO: 6009349 - DNA, 21 bp, Homo sapiens
cagacagggctccagcctgtc

SEQ ID NO: 6009350 - DNA, 23 bp, Homo sapiens
cagacagggtgggcttcctgccc

SEQ ID NO: 6009351 - DNA, 16 bp, Homo sapiens
cagacagggtggggct

SEQ ID NO: 6009352 - DNA, 18 bp, Homo sapiens
cagacaggtggaaaaact

SEQ ID NO: 6009353 - DNA, 16 bp, Homo sapiens
cagacagtcaaggaga

SEQ ID NO: 6009354 - DNA, 14 bp, Homo sapiens
cagacagtctgtta

SEQ ID NO: 6009355 - DNA, 19 bp, Homo sapiens
cagacagtgttttctggga

SEQ ID NO: 6009356 - DNA, 18 bp, Homo sapiens
cagacagtgttttgcaca

SEQ ID NO: 6009357 - DNA, 14 bp, Homo sapiens
cagacataaagcca

SEQ ID NO: 6009358 - DNA, 15 bp, Homo sapiens
cagacatacagctgc

SEQ ID NO: 6009359 - DNA, 17 bp, Homo sapiens
cagacatacagctgcct

SEQ ID NO: 6009360 - DNA, 17 bp, Homo sapiens
cagacatacgaaacaca

SEQ ID NO: 6009361 - DNA, 19 bp, Homo sapiens
cagacatacgaaacacaaa

SEQ ID NO: 6009362 - DNA, 19 bp, Homo sapiens
cagacatagaattaacaca

SEQ ID NO: 6009363 - DNA, 13 bp, Homo sapiens
cagacatatttaa

SEQ ID NO: 6009364 - DNA, 17 bp, Homo sapiens
cagacatatttaactgg

SEQ ID NO: 6009365 - DNA, 20 bp, Homo sapiens
cagacatcaagtgccagatg

SEQ ID NO: 6009366 - DNA, 23 bp, Homo sapiens
cagacatcaccctttgccttagc

SEQ ID NO: 6009367 - DNA, 22 bp, Homo sapiens
cagacatcatgttacttaaaaa

SEQ ID NO: 6009368 - DNA, 23 bp, Homo sapiens
cagacatccatgtttgtaaaact

SEQ ID NO: 6009369 - DNA, 12 bp, Homo sapiens
cagacatcctgt

SEQ ID NO: 6009370 - DNA, 19 bp, Homo sapiens
cagacatctccagtgtgcc

SEQ ID NO: 6009371 - DNA, 17 bp, Homo sapiens
cagacatctctggagcc

SEQ ID NO: 6009372 - DNA, 20 bp, Homo sapiens
cagacatctgaggttttatt

SEQ ID NO: 6009373 - DNA, 14 bp, Homo sapiens
cagacatgccttgg

SEQ ID NO: 6009374 - DNA, 23 bp, Homo sapiens
cagacatgccttggtgccggtca

SEQ ID NO: 6009375 - DNA, 12 bp, Homo sapiens
cagacatggacc

SEQ ID NO: 6009376 - DNA, 20 bp, Homo sapiens
cagacatggagatgtaaaat

SEQ ID NO: 6009377 - DNA, 22 bp, Homo sapiens
cagacatggtggggtctcctca

SEQ ID NO: 6009378 - DNA, 16 bp, Homo sapiens
cagacatggtgtctca

SEQ ID NO: 6009379 - DNA, 19 bp, Homo sapiens
cagacatggtgtctcacac

SEQ ID NO: 6009380 - DNA, 18 bp, Homo sapiens
cagacatgttttccgtga

SEQ ID NO: 6009381 - DNA, 16 bp, Homo sapiens
cagacattatgtaaaa

SEQ ID NO: 6009382 - DNA, 21 bp, Homo sapiens
cagacattatgtaaaagaaag

SEQ ID NO: 6009383 - DNA, 19 bp, Homo sapiens
cagacattcacctgtatat

SEQ ID NO: 6009384 - DNA, 14 bp, Homo sapiens
cagacattctcaaa

SEQ ID NO: 6009385 - DNA, 19 bp, Homo sapiens
cagacattctcaaagcctc

SEQ ID NO: 6009386 - DNA, 21 bp, Homo sapiens
cagacattctgccaggccccc

SEQ ID NO: 6009387 - DNA, 14 bp, Homo sapiens
cagacattgtattt

SEQ ID NO: 6009388 - DNA, 11 bp, Homo sapiens
cagacattgtc

SEQ ID NO: 6009389 - DNA, 16 bp, Homo sapiens
cagacatttacatgtt

SEQ ID NO: 6009390 - DNA, 15 bp, Homo sapiens
cagacatttatcttt

SEQ ID NO: 6009391 - DNA, 20 bp, Homo sapiens
cagacatttatctttgtatt

SEQ ID NO: 6009392 - DNA, 24 bp, Homo sapiens
cagacatttatctttgtattcttc

SEQ ID NO: 6009393 - DNA, 13 bp, Homo sapiens
cagacatttatgt

SEQ ID NO: 6009394 - DNA, 17 bp, Homo sapiens
cagacatttctttggaa

SEQ ID NO: 6009395 - DNA, 20 bp, Homo sapiens
cagacatttctttggaaaac

SEQ ID NO: 6009396 - DNA, 23 bp, Homo sapiens
cagacattttcctcacacccacc

SEQ ID NO: 6009397 - DNA, 15 bp, Homo sapiens
cagacattttctttt

SEQ ID NO: 6009398 - DNA, 17 bp, Homo sapiens
cagacatttttttccct

SEQ ID NO: 6009399 - DNA, 17 bp, Homo sapiens
cagaccaaccctgggac

SEQ ID NO: 6009400 - DNA, 18 bp, Homo sapiens
cagaccaaccctgggacc

SEQ ID NO: 6009401 - DNA, 23 bp, Homo sapiens
cagaccaacgttactcagggctc

SEQ ID NO: 6009402 - DNA, 15 bp, Homo sapiens
cagaccaactctctc

SEQ ID NO: 6009403 - DNA, 15 bp, Homo sapiens
cagaccaaggcaggg

SEQ ID NO: 6009404 - DNA, 20 bp, Homo sapiens
cagaccaaggcgagtttccc

SEQ ID NO: 6009405 - DNA, 12 bp, Homo sapiens
cagaccacagga

SEQ ID NO: 6009406 - DNA, 20 bp, Homo sapiens
cagaccacatctttatctgt

SEQ ID NO: 6009407 - DNA, 17 bp, Homo sapiens
cagaccaccagccgccc

SEQ ID NO: 6009408 - DNA, 23 bp, Homo sapiens
cagaccaccagccgccccagccc

SEQ ID NO: 6009409 - DNA, 13 bp, Homo sapiens
cagaccaccccgc

SEQ ID NO: 6009410 - DNA, 22 bp, Homo sapiens
cagaccaccccgcctgccctca

SEQ ID NO: 6009411 - DNA, 12 bp, Homo sapiens
cagaccacctgc

SEQ ID NO: 6009412 - DNA, 13 bp, Homo sapiens
cagaccacctgcc

SEQ ID NO: 6009413 - DNA, 17 bp, Homo sapiens
cagaccacctgccagcc

SEQ ID NO: 6009414 - DNA, 19 bp, Homo sapiens
cagaccacctgccagccat

SEQ ID NO: 6009415 - DNA, 16 bp, Homo sapiens
cagaccacctgcttct

SEQ ID NO: 6009416 - DNA, 24 bp, Homo sapiens
cagaccacgcccgtcctgcctgtg

SEQ ID NO: 6009417 - DNA, 13 bp, Homo sapiens
cagaccactgtct

SEQ ID NO: 6009418 - DNA, 17 bp, Homo sapiens
cagaccacttgccacgc

SEQ ID NO: 6009419 - DNA, 17 bp, Homo sapiens
cagaccagagctctgga

SEQ ID NO: 6009420 - DNA, 16 bp, Homo sapiens
cagaccagagctgtct

SEQ ID NO: 6009421 - DNA, 17 bp, Homo sapiens
cagaccagagctgtctg

SEQ ID NO: 6009422 - DNA, 15 bp, Homo sapiens
cagaccagattaaac

SEQ ID NO: 6009423 - DNA, 21 bp, Homo sapiens
cagaccagcagcaatctgtct

SEQ ID NO: 6009424 - DNA, 16 bp, Homo sapiens
cagaccagccctgcag

SEQ ID NO: 6009425 - DNA, 13 bp, Homo sapiens
cagaccagctctt

SEQ ID NO: 6009426 - DNA, 20 bp, Homo sapiens
cagaccaggaaaggcttggc

SEQ ID NO: 6009427 - DNA, 17 bp, Homo sapiens
cagaccaggaaggaaga

SEQ ID NO: 6009428 - DNA, 14 bp, Homo sapiens
cagaccagtagtga

SEQ ID NO: 6009429 - DNA, 16 bp, Homo sapiens
cagaccagtagtgacc

SEQ ID NO: 6009430 - DNA, 17 bp, Homo sapiens
cagaccattgtctcaga

SEQ ID NO: 6009431 - DNA, 18 bp, Homo sapiens
cagaccattgtcttccaa

SEQ ID NO: 6009432 - DNA, 21 bp, Homo sapiens
cagaccattgtcttccaaccc

SEQ ID NO: 6009433 - DNA, 16 bp, Homo sapiens
cagacccaacccatgc

SEQ ID NO: 6009434 - DNA, 16 bp, Homo sapiens
cagacccacacatgtt

SEQ ID NO: 6009435 - DNA, 10 bp, Homo sapiens
cagacccaga

SEQ ID NO: 6009436 - DNA, 16 bp, Homo sapiens
cagacccagagaagga

SEQ ID NO: 6009437 - DNA, 16 bp, Homo sapiens
cagacccagaggccct

SEQ ID NO: 6009438 - DNA, 16 bp, Homo sapiens
cagacccagaggtcca

SEQ ID NO: 6009439 - DNA, 21 bp, Homo sapiens
cagacccagaggtccaggtcc

SEQ ID NO: 6009440 - DNA, 21 bp, Homo sapiens
cagacccagcccgcggcctgg

SEQ ID NO: 6009441 - DNA, 16 bp, Homo sapiens
cagacccagcggtcca

SEQ ID NO: 6009442 - DNA, 21 bp, Homo sapiens
cagacccagcggtccaatgcc

SEQ ID NO: 6009443 - DNA, 20 bp, Homo sapiens
cagacccagcttagagttct

SEQ ID NO: 6009444 - DNA, 14 bp, Homo sapiens
cagacccaggagtc

SEQ ID NO: 6009445 - DNA, 18 bp, Homo sapiens
cagacccaggagtccagc

SEQ ID NO: 6009446 - DNA, 16 bp, Homo sapiens
cagacccagggcagtg

SEQ ID NO: 6009447 - DNA, 18 bp, Homo sapiens
cagacccaggggtccagg

SEQ ID NO: 6009448 - DNA, 22 bp, Homo sapiens
cagacccaggggtccaggcccc

SEQ ID NO: 6009449 - DNA, 12 bp, Homo sapiens
cagacccaggtc

SEQ ID NO: 6009450 - DNA, 17 bp, Homo sapiens
cagacccaggtcttcca

SEQ ID NO: 6009451 - DNA, 20 bp, Homo sapiens
cagacccaggtcttccagac

SEQ ID NO: 6009452 - DNA, 22 bp, Homo sapiens
cagacccaggtcttccagacct

SEQ ID NO: 6009453 - DNA, 13 bp, Homo sapiens
cagacccagtgag

SEQ ID NO: 6009454 - DNA, 12 bp, Homo sapiens
cagacccagtgg

SEQ ID NO: 6009455 - DNA, 19 bp, Homo sapiens
cagacccataaaccacctc

SEQ ID NO: 6009456 - DNA, 17 bp, Homo sapiens
cagacccatgtgctggg

SEQ ID NO: 6009457 - DNA, 12 bp, Homo sapiens
cagaccccagcg

SEQ ID NO: 6009458 - DNA, 13 bp, Homo sapiens
cagaccccaggct

SEQ ID NO: 6009459 - DNA, 21 bp, Homo sapiens
cagaccccatccagccagggg

SEQ ID NO: 6009460 - DNA, 19 bp, Homo sapiens
cagacccccaccccttccc

SEQ ID NO: 6009461 - DNA, 21 bp, Homo sapiens
cagacccccaccccttcccca

SEQ ID NO: 6009462 - DNA, 14 bp, Homo sapiens
cagacccccactct

SEQ ID NO: 6009463 - DNA, 16 bp, Homo sapiens
cagacccccactctca

SEQ ID NO: 6009464 - DNA, 13 bp, Homo sapiens
cagacccccagca

SEQ ID NO: 6009465 - DNA, 22 bp, Homo sapiens
cagaccccccagcccctcctcc

SEQ ID NO: 6009466 - DNA, 16 bp, Homo sapiens
cagaccccctcagcct

SEQ ID NO: 6009467 - DNA, 19 bp, Homo sapiens
cagacccccttgcccaggc

SEQ ID NO: 6009468 - DNA, 18 bp, Homo sapiens
cagaccccgcagcacgcc

SEQ ID NO: 6009469 - DNA, 16 bp, Homo sapiens
cagaccccgtggctct

SEQ ID NO: 6009470 - DNA, 17 bp, Homo sapiens
cagacccctctggccag

SEQ ID NO: 6009471 - DNA, 20 bp, Homo sapiens
cagacccctctggccaggat

SEQ ID NO: 6009472 - DNA, 21 bp, Homo sapiens
cagacccctctggccaggatg

SEQ ID NO: 6009473 - DNA, 19 bp, Homo sapiens
cagacccctgcctggactt

SEQ ID NO: 6009474 - DNA, 16 bp, Homo sapiens
cagacccctggctttt

SEQ ID NO: 6009475 - DNA, 16 bp, Homo sapiens
cagacccctgggagct

SEQ ID NO: 6009476 - DNA, 19 bp, Homo sapiens
cagacccctgggagcttcc

SEQ ID NO: 6009477 - DNA, 22 bp, Homo sapiens
cagacccctttgagagacgcca

SEQ ID NO: 6009478 - DNA, 15 bp, Homo sapiens
cagaccctaccccac

SEQ ID NO: 6009479 - DNA, 17 bp, Homo sapiens
cagaccctaccccacca

SEQ ID NO: 6009480 - DNA, 13 bp, Homo sapiens
cagaccctccttc

SEQ ID NO: 6009481 - DNA, 20 bp, Homo sapiens
cagaccctccttccccaccc

SEQ ID NO: 6009482 - DNA, 23 bp, Homo sapiens
cagaccctccttccccaccccat

SEQ ID NO: 6009483 - DNA, 15 bp, Homo sapiens
cagaccctgccaggg

SEQ ID NO: 6009484 - DNA, 12 bp, Homo sapiens
cagaccctgccc

SEQ ID NO: 6009485 - DNA, 13 bp, Homo sapiens
cagaccctgccca

SEQ ID NO: 6009486 - DNA, 16 bp, Homo sapiens
cagaccctgcccaccc

SEQ ID NO: 6009487 - DNA, 19 bp, Homo sapiens
cagaccctgcccaccccat

SEQ ID NO: 6009488 - DNA, 13 bp, Homo sapiens
cagaccctgccct

SEQ ID NO: 6009489 - DNA, 21 bp, Homo sapiens
cagaccctgccctgtgggccc

SEQ ID NO: 6009490 - DNA, 22 bp, Homo sapiens
cagaccctgccctgtgggcccc

SEQ ID NO: 6009491 - DNA, 15 bp, Homo sapiens
cagaccctgcccttg

SEQ ID NO: 6009492 - DNA, 18 bp, Homo sapiens
cagaccctgcctgagccc

SEQ ID NO: 6009493 - DNA, 19 bp, Homo sapiens
cagaccctgcctgagccca

SEQ ID NO: 6009494 - DNA, 18 bp, Homo sapiens
cagaccctggaggcccca

SEQ ID NO: 6009495 - DNA, 19 bp, Homo sapiens
cagaccctggaggccccaa

SEQ ID NO: 6009496 - DNA, 17 bp, Homo sapiens
cagacccttcttgcctg

SEQ ID NO: 6009497 - DNA, 17 bp, Homo sapiens
cagacccttgaagatgt

SEQ ID NO: 6009498 - DNA, 22 bp, Homo sapiens
cagacccttgaagatgtagctt

SEQ ID NO: 6009499 - DNA, 15 bp, Homo sapiens
cagaccgcagagagg

SEQ ID NO: 6009500 - DNA, 20 bp, Homo sapiens
cagaccggccgcatgtctgc

SEQ ID NO: 6009501 - DNA, 21 bp, Homo sapiens
cagaccggccgcatgtctgca

SEQ ID NO: 6009502 - DNA, 15 bp, Homo sapiens
cagaccgggggccag

SEQ ID NO: 6009503 - DNA, 23 bp, Homo sapiens
cagaccggggttcaagccatggc

SEQ ID NO: 6009504 - DNA, 22 bp, Homo sapiens
cagacctaagccctgccccggg

SEQ ID NO: 6009505 - DNA, 16 bp, Homo sapiens
cagacctaatatcatt

SEQ ID NO: 6009506 - DNA, 15 bp, Homo sapiens
cagacctaatgctcc

SEQ ID NO: 6009507 - DNA, 16 bp, Homo sapiens
cagacctaatgctcct

SEQ ID NO: 6009508 - DNA, 19 bp, Homo sapiens
cagacctagaaatgtagca

SEQ ID NO: 6009509 - DNA, 24 bp, Homo sapiens
cagacctagaaatgtagcagcagc

SEQ ID NO: 6009510 - DNA, 19 bp, Homo sapiens
cagacctagacctgggcca

SEQ ID NO: 6009511 - DNA, 23 bp, Homo sapiens
cagacctagacctgggccaaaag

SEQ ID NO: 6009512 - DNA, 16 bp, Homo sapiens
cagacctagcaggctg

SEQ ID NO: 6009513 - DNA, 17 bp, Homo sapiens
cagacctagcaggctgt

SEQ ID NO: 6009514 - DNA, 16 bp, Homo sapiens
cagacctcacctccat

SEQ ID NO: 6009515 - DNA, 13 bp, Homo sapiens
cagacctcactgt

SEQ ID NO: 6009516 - DNA, 15 bp, Homo sapiens
cagacctcagagatg

SEQ ID NO: 6009517 - DNA, 16 bp, Homo sapiens
cagacctcatgcccag

SEQ ID NO: 6009518 - DNA, 21 bp, Homo sapiens
cagacctccaggtccctaagc

SEQ ID NO: 6009519 - DNA, 16 bp, Homo sapiens
cagacctccccagccc

SEQ ID NO: 6009520 - DNA, 22 bp, Homo sapiens
cagacctccccagcccctagcc

SEQ ID NO: 6009521 - DNA, 21 bp, Homo sapiens
cagacctcccctcttcctgga

SEQ ID NO: 6009522 - DNA, 16 bp, Homo sapiens
cagacctcgagtttct

SEQ ID NO: 6009523 - DNA, 14 bp, Homo sapiens
cagacctctcccac

SEQ ID NO: 6009524 - DNA, 16 bp, Homo sapiens
cagacctctcccaccc

SEQ ID NO: 6009525 - DNA, 15 bp, Homo sapiens
cagacctctgcttgg

SEQ ID NO: 6009526 - DNA, 21 bp, Homo sapiens
cagggtctgggctgggcacct

SEQ ID NO: 6009527 - DNA, 23 bp, Homo sapiens
cagggtctgggctgggcacctga

SEQ ID NO: 6009528 - DNA, 20 bp, Homo sapiens
cagggtctgtgtgaatgtgg

SEQ ID NO: 6009529 - DNA, 23 bp, Homo sapiens
cagggtctgtgtgaatgtgggca

SEQ ID NO: 6009530 - DNA, 16 bp, Homo sapiens
cagggtcttacctctc

SEQ ID NO: 6009531 - DNA, 13 bp, Homo sapiens
cagggtcttccct

SEQ ID NO: 6009532 - DNA, 23 bp, Homo sapiens
cagggtcttgctctgtcccccag

SEQ ID NO: 6009533 - DNA, 23 bp, Homo sapiens
cagggtcttgctttctttgacct

SEQ ID NO: 6009534 - DNA, 14 bp, Homo sapiens
cagggtcttggctg

SEQ ID NO: 6009535 - DNA, 23 bp, Homo sapiens
cagggtcttgggctactggcagc

SEQ ID NO: 6009536 - DNA, 17 bp, Homo sapiens
cagggtcttttcatctg

SEQ ID NO: 6009537 - DNA, 15 bp, Homo sapiens
cagggtcttttttca

SEQ ID NO: 6009538 - DNA, 17 bp, Homo sapiens
cagggtgaagcaccagg

SEQ ID NO: 6009539 - DNA, 19 bp, Homo sapiens
cagggtgaagcaccaggga

SEQ ID NO: 6009540 - DNA, 23 bp, Homo sapiens
cagggtgaagcaccagggagagg

SEQ ID NO: 6009541 - DNA, 22 bp, Homo sapiens
cagggtgacaaggcctgcttga

SEQ ID NO: 6009542 - DNA, 11 bp, Homo sapiens
cagggtgacat

SEQ ID NO: 6009543 - DNA, 19 bp, Homo sapiens
cagggtgacccctcatctg

SEQ ID NO: 6009544 - DNA, 14 bp, Homo sapiens
cagggtgacctgct

SEQ ID NO: 6009545 - DNA, 20 bp, Homo sapiens
cagggtgacgcctgagacag

SEQ ID NO: 6009546 - DNA, 21 bp, Homo sapiens
cagggtgacgcctgagacagc

SEQ ID NO: 6009547 - DNA, 19 bp, Homo sapiens
cagggtgagaacgtgccca

SEQ ID NO: 6009548 - DNA, 14 bp, Homo sapiens
cagggtgagagctg

SEQ ID NO: 6009549 - DNA, 17 bp, Homo sapiens
cagggtgagcactctgg

SEQ ID NO: 6009550 - DNA, 21 bp, Homo sapiens
cagggtgagcactctggggtg

SEQ ID NO: 6009551 - DNA, 15 bp, Homo sapiens
cagggtgagcagggc

SEQ ID NO: 6009552 - DNA, 19 bp, Homo sapiens
cagggtgagcagggccctc

SEQ ID NO: 6009553 - DNA, 21 bp, Homo sapiens
cagggtgagcagggccctcag

SEQ ID NO: 6009554 - DNA, 18 bp, Homo sapiens
cagggtgatgccaggttc

SEQ ID NO: 6009555 - DNA, 11 bp, Homo sapiens
cagggtgcagg

SEQ ID NO: 6009556 - DNA, 15 bp, Homo sapiens
cagggtgcaggagag

SEQ ID NO: 6009557 - DNA, 17 bp, Homo sapiens
cagggtgcaggagcgcc

SEQ ID NO: 6009558 - DNA, 23 bp, Homo sapiens
cagggtgcaggcgcgcaccgccc

SEQ ID NO: 6009559 - DNA, 20 bp, Homo sapiens
cagggtgcagtatcatgccc

SEQ ID NO: 6009560 - DNA, 14 bp, Homo sapiens
cagggtgcagtgtg

SEQ ID NO: 6009561 - DNA, 14 bp, Homo sapiens
cagggtgcatggct

SEQ ID NO: 6009562 - DNA, 23 bp, Homo sapiens
cagggtgcttagttggctttgcc

SEQ ID NO: 6009563 - DNA, 16 bp, Homo sapiens
cagggtggaccaggcc

SEQ ID NO: 6009564 - DNA, 19 bp, Homo sapiens
cagggtggaccaggcctgg

SEQ ID NO: 6009565 - DNA, 17 bp, Homo sapiens
cagggtggacttcagtg

SEQ ID NO: 6009566 - DNA, 15 bp, Homo sapiens
cagggtggagctgag

SEQ ID NO: 6009567 - DNA, 18 bp, Homo sapiens
cagggtggagtgcagtgg

SEQ ID NO: 6009568 - DNA, 12 bp, Homo sapiens
cagggtggcagc

SEQ ID NO: 6009569 - DNA, 14 bp, Homo sapiens
cagggtggccacac

SEQ ID NO: 6009570 - DNA, 16 bp, Homo sapiens
cagggtggccacacag

SEQ ID NO: 6009571 - DNA, 19 bp, Homo sapiens
cagggtggccacacaggca

SEQ ID NO: 6009572 - DNA, 22 bp, Homo sapiens
cagggtggccccctgtgccagc

SEQ ID NO: 6009573 - DNA, 21 bp, Homo sapiens
cagggtggcgtccactcggct

SEQ ID NO: 6009574 - DNA, 12 bp, Homo sapiens
cagggtgggaag

SEQ ID NO: 6009575 - DNA, 17 bp, Homo sapiens
cagggtgggaagagaag

SEQ ID NO: 6009576 - DNA, 18 bp, Homo sapiens
cagggtgggaagagaaga

SEQ ID NO: 6009577 - DNA, 17 bp, Homo sapiens
cagggtgggatggagga

SEQ ID NO: 6009578 - DNA, 15 bp, Homo sapiens
cagggtgggccactc

SEQ ID NO: 6009579 - DNA, 17 bp, Homo sapiens
cagggtgggccactctc

SEQ ID NO: 6009580 - DNA, 19 bp, Homo sapiens
cagggtgggccactctccc

SEQ ID NO: 6009581 - DNA, 20 bp, Homo sapiens
cagggtgggccactctcccc

SEQ ID NO: 6009582 - DNA, 23 bp, Homo sapiens
cagggtgggccactctcccctcc

SEQ ID NO: 6009583 - DNA, 20 bp, Homo sapiens
cagggtgggcctcggcccct

SEQ ID NO: 6009584 - DNA, 23 bp, Homo sapiens
cagggtgggcctcggcccctccc

SEQ ID NO: 6009585 - DNA, 13 bp, Homo sapiens
cagggtgggctgg

SEQ ID NO: 6009586 - DNA, 16 bp, Homo sapiens
cagggtgggctgggga

SEQ ID NO: 6009587 - DNA, 18 bp, Homo sapiens
cagggtgggcttcctgcc

SEQ ID NO: 6009588 - DNA, 19 bp, Homo sapiens
cagggtgggcttcctgccc

SEQ ID NO: 6009589 - DNA, 16 bp, Homo sapiens
cagggtggggcttaga

SEQ ID NO: 6009590 - DNA, 11 bp, Homo sapiens
cagggtggggg

SEQ ID NO: 6009591 - DNA, 15 bp, Homo sapiens
cagggtggggggcca

SEQ ID NO: 6009592 - DNA, 16 bp, Homo sapiens
cagggtggggggccat

SEQ ID NO: 6009593 - DNA, 20 bp, Homo sapiens
cagggtggggggtgacagtg

SEQ ID NO: 6009594 - DNA, 17 bp, Homo sapiens
cagggtggggtctggga

SEQ ID NO: 6009595 - DNA, 20 bp, Homo sapiens
cagggtggggtctgggaggg

SEQ ID NO: 6009596 - DNA, 22 bp, Homo sapiens
cagggtgggtgagctctcaggc

SEQ ID NO: 6009597 - DNA, 23 bp, Homo sapiens
cagggtgggtgagctctcaggcc

SEQ ID NO: 6009598 - DNA, 20 bp, Homo sapiens
cagggtggtcttcaagcctg

SEQ ID NO: 6009599 - DNA, 22 bp, Homo sapiens
cagggtggtcttcaagcctggc

SEQ ID NO: 6009600 - DNA, 18 bp, Homo sapiens
cagggtggtgctgggact

SEQ ID NO: 6009601 - DNA, 17 bp, Homo sapiens
cagggtggtggcacatt

SEQ ID NO: 6009602 - DNA, 23 bp, Homo sapiens
cagggtggtggtgcacacctgta

SEQ ID NO: 6009603 - DNA, 15 bp, Homo sapiens
cagggtgtcctgagg

SEQ ID NO: 6009604 - DNA, 16 bp, Homo sapiens
cagggtgtcctgaggt

SEQ ID NO: 6009605 - DNA, 15 bp, Homo sapiens
cagggtgtctgtcag

SEQ ID NO: 6009606 - DNA, 23 bp, Homo sapiens
cagggtgtgactcgggagctgca

SEQ ID NO: 6009607 - DNA, 20 bp, Homo sapiens
cagggtgtgagcgccacatc

SEQ ID NO: 6009608 - DNA, 15 bp, Homo sapiens
cagggtgtgaggcca

SEQ ID NO: 6009609 - DNA, 16 bp, Homo sapiens
cagggtgtggggccat

SEQ ID NO: 6009610 - DNA, 17 bp, Homo sapiens
cagggtgtggggccatg

SEQ ID NO: 6009611 - DNA, 23 bp, Homo sapiens
cagggtgttacaaggcacttgtc

SEQ ID NO: 6009612 - DNA, 15 bp, Homo sapiens
cagggtgttggaaga

SEQ ID NO: 6009613 - DNA, 20 bp, Homo sapiens
cagggtgttgtcagcatctt

SEQ ID NO: 6009614 - DNA, 21 bp, Homo sapiens
cagggttaaactgcaggagca

SEQ ID NO: 6009615 - DNA, 22 bp, Homo sapiens
cagggttaaagaaaggcagaga

SEQ ID NO: 6009616 - DNA, 15 bp, Homo sapiens
cagggttcatctgtc

SEQ ID NO: 6009617 - DNA, 17 bp, Homo sapiens
cagggttcatctgtcca

SEQ ID NO: 6009618 - DNA, 14 bp, Homo sapiens
cagggttccagaca

SEQ ID NO: 6009619 - DNA, 20 bp, Homo sapiens
cagggttccagacagggtgg

SEQ ID NO: 6009620 - DNA, 23 bp, Homo sapiens
cagggttccagacagggtggggc

SEQ ID NO: 6009621 - DNA, 18 bp, Homo sapiens
cagggttcccccagccct

SEQ ID NO: 6009622 - DNA, 20 bp, Homo sapiens
cagggttcccccagccctgt

SEQ ID NO: 6009623 - DNA, 21 bp, Homo sapiens
cagggttcccccagccctgtg

SEQ ID NO: 6009624 - DNA, 15 bp, Homo sapiens
cagggttctcctctc

SEQ ID NO: 6009625 - DNA, 15 bp, Homo sapiens
cagggttctgagtca

SEQ ID NO: 6009626 - DNA, 15 bp, Homo sapiens
cagggttctgtattg

SEQ ID NO: 6009627 - DNA, 13 bp, Homo sapiens
cagggttggaaag

SEQ ID NO: 6009628 - DNA, 20 bp, Homo sapiens
cagggttggcaccttccccc

SEQ ID NO: 6009629 - DNA, 12 bp, Homo sapiens
cagggttggccc

SEQ ID NO: 6009630 - DNA, 15 bp, Homo sapiens
cagggttgggcccag

SEQ ID NO: 6009631 - DNA, 14 bp, Homo sapiens
cagggttgtgcttt

SEQ ID NO: 6009632 - DNA, 14 bp, Homo sapiens
cagggtttaataga

SEQ ID NO: 6009633 - DNA, 15 bp, Homo sapiens
cagggtttcaccatg

SEQ ID NO: 6009634 - DNA, 16 bp, Homo sapiens
cagggtttcggaaatc

SEQ ID NO: 6009635 - DNA, 22 bp, Homo sapiens
cagggtttctctgcagatgtgc

SEQ ID NO: 6009636 - DNA, 14 bp, Homo sapiens
cagggtttgagcac

SEQ ID NO: 6009637 - DNA, 21 bp, Homo sapiens
cagggtttgagcacaatctgt

SEQ ID NO: 6009638 - DNA, 21 bp, Homo sapiens
cagggtttggctgtgtctaaa

SEQ ID NO: 6009639 - DNA, 17 bp, Homo sapiens
cagggttttaactttgt

SEQ ID NO: 6009640 - DNA, 22 bp, Homo sapiens
cagggttttagagagcagtggc

SEQ ID NO: 6009641 - DNA, 16 bp, Homo sapiens
cagggttttatctctg

SEQ ID NO: 6009642 - DNA, 21 bp, Homo sapiens
cagggttttgccatgttgccc

SEQ ID NO: 6009643 - DNA, 16 bp, Homo sapiens
cagggttttttcattt

SEQ ID NO: 6009644 - DNA, 16 bp, Homo sapiens
cagggttttttggcct

SEQ ID NO: 6009645 - DNA, 23 bp, Homo sapiens
caggtaaactgatgctttcagat

SEQ ID NO: 6009646 - DNA, 23 bp, Homo sapiens
caggtaaatgggcagtgcctcct

SEQ ID NO: 6009647 - DNA, 17 bp, Homo sapiens
caggtaacaggcagata

SEQ ID NO: 6009648 - DNA, 18 bp, Homo sapiens
caggtaacattataaatg

SEQ ID NO: 6009649 - DNA, 19 bp, Homo sapiens
caggtaactaattggaagg

SEQ ID NO: 6009650 - DNA, 22 bp, Homo sapiens
caggtaagatgttaatctccca

SEQ ID NO: 6009651 - DNA, 23 bp, Homo sapiens
caggtaagatgttaatctcccag

SEQ ID NO: 6009652 - DNA, 15 bp, Homo sapiens
caggtaagtggcagg

SEQ ID NO: 6009653 - DNA, 18 bp, Homo sapiens
caggtaagtggcaggacc

SEQ ID NO: 6009654 - DNA, 14 bp, Homo sapiens
caggtaatatacct

SEQ ID NO: 6009655 - DNA, 18 bp, Homo sapiens
caggtaatatacctggtt

SEQ ID NO: 6009656 - DNA, 17 bp, Homo sapiens
caggtaatcgacctgcc

SEQ ID NO: 6009657 - DNA, 15 bp, Homo sapiens
caggtaatgagggac

SEQ ID NO: 6009658 - DNA, 17 bp, Homo sapiens
caggtacacctccccct

SEQ ID NO: 6009659 - DNA, 21 bp, Homo sapiens
caggtacagaaaacatgttta

SEQ ID NO: 6009660 - DNA, 23 bp, Homo sapiens
caggtacagcaacaggaatctca

SEQ ID NO: 6009661 - DNA, 18 bp, Homo sapiens
caggtacaggagaggcag

SEQ ID NO: 6009662 - DNA, 16 bp, Homo sapiens
caggtacatttctgat

SEQ ID NO: 6009663 - DNA, 18 bp, Homo sapiens
caggtaccagctgcgctt

SEQ ID NO: 6009664 - DNA, 21 bp, Homo sapiens
caggtaccagctgcgcttgct

SEQ ID NO: 6009665 - DNA, 20 bp, Homo sapiens
caggtaccccagctctgctt

SEQ ID NO: 6009666 - DNA, 13 bp, Homo sapiens
caggtaccgtgct

SEQ ID NO: 6009667 - DNA, 18 bp, Homo sapiens
caggtaccttctcacctg

SEQ ID NO: 6009668 - DNA, 16 bp, Homo sapiens
caggtacgcacagaca

SEQ ID NO: 6009669 - DNA, 17 bp, Homo sapiens
caggtacgcacagacag

SEQ ID NO: 6009670 - DNA, 18 bp, Homo sapiens
caggtacgcacagacagg

SEQ ID NO: 6009671 - DNA, 16 bp, Homo sapiens
caggtacggagaagaa

SEQ ID NO: 6009672 - DNA, 16 bp, Homo sapiens
caggtactatgcagat

SEQ ID NO: 6009673 - DNA, 17 bp, Homo sapiens
caggtactcctgccagg

SEQ ID NO: 6009674 - DNA, 18 bp, Homo sapiens
caggtactcctgccaggg

SEQ ID NO: 6009675 - DNA, 20 bp, Homo sapiens
caggtactgagttcttactt

SEQ ID NO: 6009676 - DNA, 13 bp, Homo sapiens
caggtactgcatt

SEQ ID NO: 6009677 - DNA, 17 bp, Homo sapiens
caggtacttcctcctga

SEQ ID NO: 6009678 - DNA, 21 bp, Homo sapiens
caggtacttgtaaattattaa

SEQ ID NO: 6009679 - DNA, 13 bp, Homo sapiens
caggtactttgtc

SEQ ID NO: 6009680 - DNA, 23 bp, Homo sapiens
caggtactttgtctaagaaacat

SEQ ID NO: 6009681 - DNA, 19 bp, Homo sapiens
caggtagaacgccagggac

SEQ ID NO: 6009682 - DNA, 23 bp, Homo sapiens
caggtagaattatctaatttata

SEQ ID NO: 6009683 - DNA, 19 bp, Homo sapiens
caggtagaccaggtgctca

SEQ ID NO: 6009684 - DNA, 19 bp, Homo sapiens
caggtagacctgtctcctg

SEQ ID NO: 6009685 - DNA, 18 bp, Homo sapiens
caggtagaggtgcatgcc

SEQ ID NO: 6009686 - DNA, 20 bp, Homo sapiens
caggtagatcgcttgagccc

SEQ ID NO: 6009687 - DNA, 21 bp, Homo sapiens
caggtagatcgcttgagccca

SEQ ID NO: 6009688 - DNA, 22 bp, Homo sapiens
caggtagatcgcttgagcccag

SEQ ID NO: 6009689 - DNA, 23 bp, Homo sapiens
caggtagatcgcttgagcccagg

SEQ ID NO: 6009690 - DNA, 21 bp, Homo sapiens
caggtagcacagattttgaat

SEQ ID NO: 6009691 - DNA, 14 bp, Homo sapiens
caggtagcagcaaa

SEQ ID NO: 6009692 - DNA, 16 bp, Homo sapiens
caggtagcagcaaata

SEQ ID NO: 6009693 - DNA, 23 bp, Homo sapiens
caggtagcagcaaatagcaaatg

SEQ ID NO: 6009694 - DNA, 15 bp, Homo sapiens
caggtagcctgctgg

SEQ ID NO: 6009695 - DNA, 15 bp, Homo sapiens
caggtagctgcccct

SEQ ID NO: 6009696 - DNA, 16 bp, Homo sapiens
caggtagctgcccctg

SEQ ID NO: 6009697 - DNA, 18 bp, Homo sapiens
caggtagctgcccctggc

SEQ ID NO: 6009698 - DNA, 13 bp, Homo sapiens
caggtaggaatat

SEQ ID NO: 6009699 - DNA, 23 bp, Homo sapiens
caggtaggaatattatatttgga

SEQ ID NO: 6009700 - DNA, 14 bp, Homo sapiens
caggtaggaggcaa

SEQ ID NO: 6009701 - DNA, 21 bp, Homo sapiens
caggtaggatgaacacaggca

SEQ ID NO: 6009702 - DNA, 12 bp, Homo sapiens
cagacctgagct

SEQ ID NO: 6009703 - DNA, 17 bp, Homo sapiens
cagacctgatcctggag

SEQ ID NO: 6009704 - DNA, 23 bp, Homo sapiens
cagacctgatcctggaggcccag

SEQ ID NO: 6009705 - DNA, 13 bp, Homo sapiens
cagacctgcatgg

SEQ ID NO: 6009706 - DNA, 16 bp, Homo sapiens
cagacctgcccctccc

SEQ ID NO: 6009707 - DNA, 17 bp, Homo sapiens
cagacctgcccctccct

SEQ ID NO: 6009708 - DNA, 13 bp, Homo sapiens
cagacctgcctgt

SEQ ID NO: 6009709 - DNA, 15 bp, Homo sapiens
cagacctgctctgga

SEQ ID NO: 6009710 - DNA, 21 bp, Homo sapiens
cagacctgcttcctgaaataa

SEQ ID NO: 6009711 - DNA, 13 bp, Homo sapiens
cagacctgctttt

SEQ ID NO: 6009712 - DNA, 21 bp, Homo sapiens
cagacctgctttttgaaatga

SEQ ID NO: 6009713 - DNA, 18 bp, Homo sapiens
cagacctggaatgtaagt

SEQ ID NO: 6009714 - DNA, 11 bp, Homo sapiens
cagacctggag

SEQ ID NO: 6009715 - DNA, 16 bp, Homo sapiens
cagacctggagcccct

SEQ ID NO: 6009716 - DNA, 18 bp, Homo sapiens
cagacctggagcccctgg

SEQ ID NO: 6009717 - DNA, 19 bp, Homo sapiens
cagacctggagcccctggg

SEQ ID NO: 6009718 - DNA, 20 bp, Homo sapiens
cagacctggagcccctgggt

SEQ ID NO: 6009719 - DNA, 15 bp, Homo sapiens
cagacctggagcttc

SEQ ID NO: 6009720 - DNA, 12 bp, Homo sapiens
cagacctggcct

SEQ ID NO: 6009721 - DNA, 13 bp, Homo sapiens
cagacctggcctc

SEQ ID NO: 6009722 - DNA, 15 bp, Homo sapiens
cagacctggcctctg

SEQ ID NO: 6009723 - DNA, 17 bp, Homo sapiens
cagacctggcctctgcc

SEQ ID NO: 6009724 - DNA, 11 bp, Homo sapiens
cagacctggct

SEQ ID NO: 6009725 - DNA, 21 bp, Homo sapiens
cagacctggctctcagaggaa

SEQ ID NO: 6009726 - DNA, 19 bp, Homo sapiens
cagacctggctgggcctgg

SEQ ID NO: 6009727 - DNA, 16 bp, Homo sapiens
cagacctgggacttta

SEQ ID NO: 6009728 - DNA, 15 bp, Homo sapiens
cagacctgggccctg

SEQ ID NO: 6009729 - DNA, 16 bp, Homo sapiens
cagacctgggccctgg

SEQ ID NO: 6009730 - DNA, 19 bp, Homo sapiens
cagacctgggccctggttc

SEQ ID NO: 6009731 - DNA, 21 bp, Homo sapiens
cagacctgtcaccctgcagga

SEQ ID NO: 6009732 - DNA, 17 bp, Homo sapiens
cagacctgtcctcctgg

SEQ ID NO: 6009733 - DNA, 19 bp, Homo sapiens
cagacctgtcgtctctccc

SEQ ID NO: 6009734 - DNA, 23 bp, Homo sapiens
cagacctgtcttccaaggagacc

SEQ ID NO: 6009735 - DNA, 20 bp, Homo sapiens
cagaccttaagacactgtga

SEQ ID NO: 6009736 - DNA, 17 bp, Homo sapiens
cagaccttcacagatgc

SEQ ID NO: 6009737 - DNA, 18 bp, Homo sapiens
cagaccttcacagatgcc

SEQ ID NO: 6009738 - DNA, 23 bp, Homo sapiens
cagaccttcacagatgcctactt

SEQ ID NO: 6009739 - DNA, 20 bp, Homo sapiens
cagaccttgcaatcacaaaa

SEQ ID NO: 6009740 - DNA, 18 bp, Homo sapiens
cagaccttgggggaagac

SEQ ID NO: 6009741 - DNA, 13 bp, Homo sapiens
cagacctttactg

SEQ ID NO: 6009742 - DNA, 14 bp, Homo sapiens
cagacctttactga

SEQ ID NO: 6009743 - DNA, 15 bp, Homo sapiens
cagacctttgaggat

SEQ ID NO: 6009744 - DNA, 14 bp, Homo sapiens
cagacgactagccc

SEQ ID NO: 6009745 - DNA, 14 bp, Homo sapiens
cagacgagacaaca

SEQ ID NO: 6009746 - DNA, 17 bp, Homo sapiens
cagacgagacaacagca

SEQ ID NO: 6009747 - DNA, 18 bp, Homo sapiens
cagacgagacaacagcac

SEQ ID NO: 6009748 - DNA, 23 bp, Homo sapiens
cagacgagacaacagcacacagg

SEQ ID NO: 6009749 - DNA, 13 bp, Homo sapiens
cagacgagacacc

SEQ ID NO: 6009750 - DNA, 21 bp, Homo sapiens
cagacgagacaccctaactct

SEQ ID NO: 6009751 - DNA, 14 bp, Homo sapiens
cagacgcagcagct

SEQ ID NO: 6009752 - DNA, 17 bp, Homo sapiens
cagacgcagcagctggg

SEQ ID NO: 6009753 - DNA, 14 bp, Homo sapiens
cagacgccacagtc

SEQ ID NO: 6009754 - DNA, 20 bp, Homo sapiens
cagacgccaggcaccacagc

SEQ ID NO: 6009755 - DNA, 14 bp, Homo sapiens
cagacgcccagatt

SEQ ID NO: 6009756 - DNA, 23 bp, Homo sapiens
cagacgcctggctgctgatcgcc

SEQ ID NO: 6009757 - DNA, 20 bp, Homo sapiens
cagacgcggaaaccgggtgg

SEQ ID NO: 6009758 - DNA, 21 bp, Homo sapiens
cagacgctcattcagcatctg

SEQ ID NO: 6009759 - DNA, 17 bp, Homo sapiens
cagacgctgccgctgcc

SEQ ID NO: 6009760 - DNA, 18 bp, Homo sapiens
cagacgctgctgtcacaa

SEQ ID NO: 6009761 - DNA, 19 bp, Homo sapiens
cagacggaagggtaaacaa

SEQ ID NO: 6009762 - DNA, 22 bp, Homo sapiens
cagacggaagggtaaacaatat

SEQ ID NO: 6009763 - DNA, 21 bp, Homo sapiens
cagacggacgggacagcggcc

SEQ ID NO: 6009764 - DNA, 16 bp, Homo sapiens
cagacggagctgcgct

SEQ ID NO: 6009765 - DNA, 15 bp, Homo sapiens
cagacggaggaagcc

SEQ ID NO: 6009766 - DNA, 20 bp, Homo sapiens
cagacggaggactggaactg

SEQ ID NO: 6009767 - DNA, 12 bp, Homo sapiens
cagacggcggcc

SEQ ID NO: 6009768 - DNA, 23 bp, Homo sapiens
cagacgggaatgcctaggtccct

SEQ ID NO: 6009769 - DNA, 18 bp, Homo sapiens
cagacgggcacacagact

SEQ ID NO: 6009770 - DNA, 13 bp, Homo sapiens
cagacgggcacag

SEQ ID NO: 6009771 - DNA, 14 bp, Homo sapiens
cagacgggcacaga

SEQ ID NO: 6009772 - DNA, 18 bp, Homo sapiens
cagacgggcacagacacg

SEQ ID NO: 6009773 - DNA, 13 bp, Homo sapiens
cagacggggggct

SEQ ID NO: 6009774 - DNA, 14 bp, Homo sapiens
cagacggggggctg

SEQ ID NO: 6009775 - DNA, 14 bp, Homo sapiens
cagacggtctgtgt

SEQ ID NO: 6009776 - DNA, 13 bp, Homo sapiens
cagacggtgacgc

SEQ ID NO: 6009777 - DNA, 17 bp, Homo sapiens
cagacggttcaccagcc

SEQ ID NO: 6009778 - DNA, 15 bp, Homo sapiens
cagacgtctggccct

SEQ ID NO: 6009779 - DNA, 23 bp, Homo sapiens
cagacgtctgtcaggggcttgga

SEQ ID NO: 6009780 - DNA, 19 bp, Homo sapiens
cagacgtggtgcttctcac

SEQ ID NO: 6009781 - DNA, 21 bp, Homo sapiens
cagacgtggtggctcacacct

SEQ ID NO: 6009782 - DNA, 14 bp, Homo sapiens
cagacgtgtgacct

SEQ ID NO: 6009783 - DNA, 18 bp, Homo sapiens
cagacgtgtgacctccat

SEQ ID NO: 6009784 - DNA, 18 bp, Homo sapiens
cagacgttgcctgagaag

SEQ ID NO: 6009785 - DNA, 16 bp, Homo sapiens
cagacgttggtcccaa

SEQ ID NO: 6009786 - DNA, 15 bp, Homo sapiens
cagactaagccagca

SEQ ID NO: 6009787 - DNA, 18 bp, Homo sapiens
cagactaagccagcaccg

SEQ ID NO: 6009788 - DNA, 16 bp, Homo sapiens
cagactacagccagaa

SEQ ID NO: 6009789 - DNA, 21 bp, Homo sapiens
cagactacagctggggtgcag

SEQ ID NO: 6009790 - DNA, 19 bp, Homo sapiens
cagactactattttctttt

SEQ ID NO: 6009791 - DNA, 23 bp, Homo sapiens
cagactagaattctagtgctgct

SEQ ID NO: 6009792 - DNA, 20 bp, Homo sapiens
cagactagacaccttctgtg

SEQ ID NO: 6009793 - DNA, 23 bp, Homo sapiens
cagactagatggacctgcctgca

SEQ ID NO: 6009794 - DNA, 15 bp, Homo sapiens
cagactagatgtagt

SEQ ID NO: 6009795 - DNA, 19 bp, Homo sapiens
cagactagatgtagtattt

SEQ ID NO: 6009796 - DNA, 22 bp, Homo sapiens
cagactatccattttacacttg

SEQ ID NO: 6009797 - DNA, 22 bp, Homo sapiens
cagactcaaatgctcagaccag

SEQ ID NO: 6009798 - DNA, 17 bp, Homo sapiens
cagactcaagagaaact

SEQ ID NO: 6009799 - DNA, 20 bp, Homo sapiens
cagactcaagtacccattct

SEQ ID NO: 6009800 - DNA, 18 bp, Homo sapiens
cagactcaatgtgctctg

SEQ ID NO: 6009801 - DNA, 19 bp, Homo sapiens
cagactcacaacctgaacc

SEQ ID NO: 6009802 - DNA, 18 bp, Homo sapiens
cagactcactgggaagct

SEQ ID NO: 6009803 - DNA, 14 bp, Homo sapiens
cagactcagacatt

SEQ ID NO: 6009804 - DNA, 15 bp, Homo sapiens
cagactcagagctct

SEQ ID NO: 6009805 - DNA, 16 bp, Homo sapiens
cagactcagagctctc

SEQ ID NO: 6009806 - DNA, 20 bp, Homo sapiens
cagactcagagctctctcta

SEQ ID NO: 6009807 - DNA, 18 bp, Homo sapiens
cagactcagaggtccagg

SEQ ID NO: 6009808 - DNA, 12 bp, Homo sapiens
cagactcagcag

SEQ ID NO: 6009809 - DNA, 17 bp, Homo sapiens
cagactcagcagagtga

SEQ ID NO: 6009810 - DNA, 15 bp, Homo sapiens
cagactcagctccag

SEQ ID NO: 6009811 - DNA, 23 bp, Homo sapiens
cagactcagctgctatacttatc

SEQ ID NO: 6009812 - DNA, 17 bp, Homo sapiens
cagactcaggttccaga

SEQ ID NO: 6009813 - DNA, 14 bp, Homo sapiens
cagactcagttttt

SEQ ID NO: 6009814 - DNA, 20 bp, Homo sapiens
cagactcagttttttgtaac

SEQ ID NO: 6009815 - DNA, 19 bp, Homo sapiens
cagactcatacagaaggtg

SEQ ID NO: 6009816 - DNA, 20 bp, Homo sapiens
cagactcatacagaaggtgg

SEQ ID NO: 6009817 - DNA, 13 bp, Homo sapiens
cagactcatcctg

SEQ ID NO: 6009818 - DNA, 19 bp, Homo sapiens
cagactccaatggggccag

SEQ ID NO: 6009819 - DNA, 12 bp, Homo sapiens
cagactccaggc

SEQ ID NO: 6009820 - DNA, 15 bp, Homo sapiens
cagactccaggcccc

SEQ ID NO: 6009821 - DNA, 13 bp, Homo sapiens
cagactccatctc

SEQ ID NO: 6009822 - DNA, 14 bp, Homo sapiens
cagactccatctct

SEQ ID NO: 6009823 - DNA, 17 bp, Homo sapiens
cagactccatctcttct

SEQ ID NO: 6009824 - DNA, 13 bp, Homo sapiens
cagactcctggct

SEQ ID NO: 6009825 - DNA, 16 bp, Homo sapiens
cagactcctggcttca

SEQ ID NO: 6009826 - DNA, 21 bp, Homo sapiens
cagactcctgtgcaactttcc

SEQ ID NO: 6009827 - DNA, 16 bp, Homo sapiens
cagactcgagagggct

SEQ ID NO: 6009828 - DNA, 20 bp, Homo sapiens
cagactcgagagggctgagc

SEQ ID NO: 6009829 - DNA, 19 bp, Homo sapiens
cagactcgatgcaagtgtt

SEQ ID NO: 6009830 - DNA, 23 bp, Homo sapiens
cagactcgatgcaagtgtttctg

SEQ ID NO: 6009831 - DNA, 21 bp, Homo sapiens
cagactcgttctcgtgaccca

SEQ ID NO: 6009832 - DNA, 18 bp, Homo sapiens
cagactctaagaaagaac

SEQ ID NO: 6009833 - DNA, 17 bp, Homo sapiens
cagactctacagaggcc

SEQ ID NO: 6009834 - DNA, 17 bp, Homo sapiens
cagactctcagcccaga

SEQ ID NO: 6009835 - DNA, 16 bp, Homo sapiens
cagactctgcctcctg

SEQ ID NO: 6009836 - DNA, 18 bp, Homo sapiens
cagactctgcctcctggt

SEQ ID NO: 6009837 - DNA, 21 bp, Homo sapiens
cagactctgggtccctcggag

SEQ ID NO: 6009838 - DNA, 16 bp, Homo sapiens
cagactcttccaccag

SEQ ID NO: 6009839 - DNA, 17 bp, Homo sapiens
cagactcttccaccaga

SEQ ID NO: 6009840 - DNA, 21 bp, Homo sapiens
cagactcttccaccagagcag

SEQ ID NO: 6009841 - DNA, 23 bp, Homo sapiens
cagactctttaataaattgctta

SEQ ID NO: 6009842 - DNA, 18 bp, Homo sapiens
cagactctttcttcacta

SEQ ID NO: 6009843 - DNA, 17 bp, Homo sapiens
cagactgaaccagagct

SEQ ID NO: 6009844 - DNA, 18 bp, Homo sapiens
cagactgaaccagagctg

SEQ ID NO: 6009845 - DNA, 19 bp, Homo sapiens
cagactgaaccagagctgg

SEQ ID NO: 6009846 - DNA, 19 bp, Homo sapiens
cagactgaactcgcaggga

SEQ ID NO: 6009847 - DNA, 23 bp, Homo sapiens
cagactgacagtttacagacgct

SEQ ID NO: 6009848 - DNA, 15 bp, Homo sapiens
cagactgaccccaga

SEQ ID NO: 6009849 - DNA, 13 bp, Homo sapiens
cagactgaccttg

SEQ ID NO: 6009850 - DNA, 16 bp, Homo sapiens
cagactgagctctcca

SEQ ID NO: 6009851 - DNA, 20 bp, Homo sapiens
cagactgagctctccaggcc

SEQ ID NO: 6009852 - DNA, 21 bp, Homo sapiens
cagactgagctctccaggcca

SEQ ID NO: 6009853 - DNA, 22 bp, Homo sapiens
cagactgagctctccaggccag

SEQ ID NO: 6009854 - DNA, 14 bp, Homo sapiens
cagactgatagaca

SEQ ID NO: 6009855 - DNA, 18 bp, Homo sapiens
cagactgatagacaccat

SEQ ID NO: 6009856 - DNA, 16 bp, Homo sapiens
cagactgatcaggacc

SEQ ID NO: 6009857 - DNA, 15 bp, Homo sapiens
cagactgcacccagg

SEQ ID NO: 6009858 - DNA, 17 bp, Homo sapiens
cagactgcacccaggag

SEQ ID NO: 6009859 - DNA, 18 bp, Homo sapiens
cagactgcacccaggagg

SEQ ID NO: 6009860 - DNA, 21 bp, Homo sapiens
cagactgcaggttggacccca

SEQ ID NO: 6009861 - DNA, 18 bp, Homo sapiens
cagactgcatgtagttgg

SEQ ID NO: 6009862 - DNA, 15 bp, Homo sapiens
cagactgccccagcc

SEQ ID NO: 6009863 - DNA, 21 bp, Homo sapiens
cagactgcctgtctgcttgca

SEQ ID NO: 6009864 - DNA, 17 bp, Homo sapiens
cagactgccttatatta

SEQ ID NO: 6009865 - DNA, 12 bp, Homo sapiens
cagactgcggag

SEQ ID NO: 6009866 - DNA, 13 bp, Homo sapiens
cagactgcggagc

SEQ ID NO: 6009867 - DNA, 19 bp, Homo sapiens
cagactgcggagcagcctc

SEQ ID NO: 6009868 - DNA, 13 bp, Homo sapiens
cagactgctagtg

SEQ ID NO: 6009869 - DNA, 15 bp, Homo sapiens
cagactgctgggact

SEQ ID NO: 6009870 - DNA, 15 bp, Homo sapiens
cagactgctgtctta

SEQ ID NO: 6009871 - DNA, 21 bp, Homo sapiens
cagactgcttcattgggaagt

SEQ ID NO: 6009872 - DNA, 15 bp, Homo sapiens
cagactgcttggcca

SEQ ID NO: 6009873 - DNA, 14 bp, Homo sapiens
cagactgctttaaa

SEQ ID NO: 6009874 - DNA, 12 bp, Homo sapiens
cagactggaaga

SEQ ID NO: 6009875 - DNA, 16 bp, Homo sapiens
cagactggaagcacag

SEQ ID NO: 6009876 - DNA, 23 bp, Homo sapiens
cagactggagaaaacccctccca

SEQ ID NO: 6009877 - DNA, 11 bp, Homo sapiens
cagactggagg

SEQ ID NO: 6009878 - DNA, 12 bp, Homo sapiens
cagactggaggg

SEQ ID NO: 6009879 - DNA, 12 bp, Homo sapiens
cagactggaggt

SEQ ID NO: 6009880 - DNA, 15 bp, Homo sapiens
cagactggaggtcga

SEQ ID NO: 6009881 - DNA, 13 bp, Homo sapiens
caggtaggccctt

SEQ ID NO: 6009882 - DNA, 23 bp, Homo sapiens
caggtaggcccttgtcctgccag

SEQ ID NO: 6009883 - DNA, 19 bp, Homo sapiens
caggtagggagctaaggaa

SEQ ID NO: 6009884 - DNA, 15 bp, Homo sapiens
caggtaggggcacag

SEQ ID NO: 6009885 - DNA, 21 bp, Homo sapiens
caggtaggggcacagtgaatg

SEQ ID NO: 6009886 - DNA, 18 bp, Homo sapiens
caggtaggggcccctctc

SEQ ID NO: 6009887 - DNA, 19 bp, Homo sapiens
caggtaggggcccctctca

SEQ ID NO: 6009888 - DNA, 22 bp, Homo sapiens
caggtaggggcccctctcagcc

SEQ ID NO: 6009889 - DNA, 16 bp, Homo sapiens
caggtagtactgggaa

SEQ ID NO: 6009890 - DNA, 20 bp, Homo sapiens
caggtagtattacaccaccg

SEQ ID NO: 6009891 - DNA, 22 bp, Homo sapiens
caggtagtgttgagacccaggc

SEQ ID NO: 6009892 - DNA, 21 bp, Homo sapiens
caggtagttggaactttctgt

SEQ ID NO: 6009893 - DNA, 16 bp, Homo sapiens
caggtagtttgtacca

SEQ ID NO: 6009894 - DNA, 17 bp, Homo sapiens
caggtagtttgtaccat

SEQ ID NO: 6009895 - DNA, 15 bp, Homo sapiens
caggtatacctcact

SEQ ID NO: 6009896 - DNA, 17 bp, Homo sapiens
caggtatagactcctga

SEQ ID NO: 6009897 - DNA, 15 bp, Homo sapiens
caggtatatactttg

SEQ ID NO: 6009898 - DNA, 20 bp, Homo sapiens
caggtatcaggcacaggcag

SEQ ID NO: 6009899 - DNA, 14 bp, Homo sapiens
caggtatcctgggg

SEQ ID NO: 6009900 - DNA, 16 bp, Homo sapiens
caggtatcctggggga

SEQ ID NO: 6009901 - DNA, 19 bp, Homo sapiens
caggtatcctgggggaaga

SEQ ID NO: 6009902 - DNA, 21 bp, Homo sapiens
caggtatcctgggggaagagg

SEQ ID NO: 6009903 - DNA, 18 bp, Homo sapiens
caggtatctccaggattg

SEQ ID NO: 6009904 - DNA, 20 bp, Homo sapiens
caggtattaaaggttaaatt

SEQ ID NO: 6009905 - DNA, 18 bp, Homo sapiens
caggtattattatcttta

SEQ ID NO: 6009906 - DNA, 17 bp, Homo sapiens
caggtatttagaagcag

SEQ ID NO: 6009907 - DNA, 23 bp, Homo sapiens
caggtatttcagaaggagaaggc

SEQ ID NO: 6009908 - DNA, 11 bp, Homo sapiens
caggtattttg

SEQ ID NO: 6009909 - DNA, 20 bp, Homo sapiens
caggtatttttttaaatcaa

SEQ ID NO: 6009910 - DNA, 23 bp, Homo sapiens
caggtatttttttaaatcaagga

SEQ ID NO: 6009911 - DNA, 14 bp, Homo sapiens
caggtcaacagaat

SEQ ID NO: 6009912 - DNA, 15 bp, Homo sapiens
caggtcaacagaatg

SEQ ID NO: 6009913 - DNA, 22 bp, Homo sapiens
caggtcaacagaatgaaaaatg

SEQ ID NO: 6009914 - DNA, 15 bp, Homo sapiens
caggtcaacatctaa

SEQ ID NO: 6009915 - DNA, 13 bp, Homo sapiens
caggtcaataaac

SEQ ID NO: 6009916 - DNA, 21 bp, Homo sapiens
caggtcaataaacttagagga

SEQ ID NO: 6009917 - DNA, 23 bp, Homo sapiens
caggtcaataaacttagaggaaa

SEQ ID NO: 6009918 - DNA, 23 bp, Homo sapiens
caggtcaatacagtacaggcagc

SEQ ID NO: 6009919 - DNA, 17 bp, Homo sapiens
caggtcacacgaggggc

SEQ ID NO: 6009920 - DNA, 14 bp, Homo sapiens
caggtcaccaagca

SEQ ID NO: 6009921 - DNA, 16 bp, Homo sapiens
caggtcaccagcctga

SEQ ID NO: 6009922 - DNA, 21 bp, Homo sapiens
caggtcaccagcctgactgca

SEQ ID NO: 6009923 - DNA, 17 bp, Homo sapiens
caggtcaccattatgct

SEQ ID NO: 6009924 - DNA, 17 bp, Homo sapiens
caggtcaccgcgaggcc

SEQ ID NO: 6009925 - DNA, 20 bp, Homo sapiens
caggtcaccgggagggctgc

SEQ ID NO: 6009926 - DNA, 15 bp, Homo sapiens
caggtcactgtcact

SEQ ID NO: 6009927 - DNA, 18 bp, Homo sapiens
caggtcactgtcactgcc

SEQ ID NO: 6009928 - DNA, 14 bp, Homo sapiens
caggtcagagccca

SEQ ID NO: 6009929 - DNA, 15 bp, Homo sapiens
caggtcagagcccag

SEQ ID NO: 6009930 - DNA, 16 bp, Homo sapiens
caggtcagagcccagg

SEQ ID NO: 6009931 - DNA, 16 bp, Homo sapiens
caggtcagccctgtgt

SEQ ID NO: 6009932 - DNA, 23 bp, Homo sapiens
caggtcagcctcctctccctagt

SEQ ID NO: 6009933 - DNA, 15 bp, Homo sapiens
caggtcagcctggaa

SEQ ID NO: 6009934 - DNA, 16 bp, Homo sapiens
caggtcagctgggagc

SEQ ID NO: 6009935 - DNA, 20 bp, Homo sapiens
caggtcagctgggagccagt

SEQ ID NO: 6009936 - DNA, 18 bp, Homo sapiens
caggtcagctgttacttt

SEQ ID NO: 6009937 - DNA, 20 bp, Homo sapiens
caggtcaggaccaggaccca

SEQ ID NO: 6009938 - DNA, 15 bp, Homo sapiens
caggtcagggacttg

SEQ ID NO: 6009939 - DNA, 16 bp, Homo sapiens
caggtcagggacttgg

SEQ ID NO: 6009940 - DNA, 12 bp, Homo sapiens
caggtcagggct

SEQ ID NO: 6009941 - DNA, 13 bp, Homo sapiens
caggtcagggcta

SEQ ID NO: 6009942 - DNA, 14 bp, Homo sapiens
caggtcagggctca

SEQ ID NO: 6009943 - DNA, 17 bp, Homo sapiens
caggtcagggctcagag

SEQ ID NO: 6009944 - DNA, 19 bp, Homo sapiens
caggtcaggggctccctac

SEQ ID NO: 6009945 - DNA, 17 bp, Homo sapiens
caggtcaggggtgacac

SEQ ID NO: 6009946 - DNA, 20 bp, Homo sapiens
caggtcaggggtgacacaga

SEQ ID NO: 6009947 - DNA, 16 bp, Homo sapiens
caggtcagggtgagga

SEQ ID NO: 6009948 - DNA, 19 bp, Homo sapiens
caggtcagttgtaataaat

SEQ ID NO: 6009949 - DNA, 13 bp, Homo sapiens
caggtcatgcagt

SEQ ID NO: 6009950 - DNA, 19 bp, Homo sapiens
caggtcatggagcagcccc

SEQ ID NO: 6009951 - DNA, 20 bp, Homo sapiens
caggtcatggagcagccccc

SEQ ID NO: 6009952 - DNA, 21 bp, Homo sapiens
caggtccaaattcaccttccc

SEQ ID NO: 6009953 - DNA, 14 bp, Homo sapiens
caggtccaatgagc

SEQ ID NO: 6009954 - DNA, 18 bp, Homo sapiens
caggtccaatgagctttc

SEQ ID NO: 6009955 - DNA, 15 bp, Homo sapiens
caggtccagatgtgc

SEQ ID NO: 6009956 - DNA, 13 bp, Homo sapiens
caggtccagctct

SEQ ID NO: 6009957 - DNA, 16 bp, Homo sapiens
caggtccagctctgga

SEQ ID NO: 6009958 - DNA, 17 bp, Homo sapiens
caggtccagctctggag

SEQ ID NO: 6009959 - DNA, 19 bp, Homo sapiens
caggtccagctctggaggg

SEQ ID NO: 6009960 - DNA, 23 bp, Homo sapiens
caggtccagctctggaggggagg

SEQ ID NO: 6009961 - DNA, 18 bp, Homo sapiens
caggtccagctttactgt

SEQ ID NO: 6009962 - DNA, 19 bp, Homo sapiens
caggtccaggccagtgggc

SEQ ID NO: 6009963 - DNA, 13 bp, Homo sapiens
caggtccaggctg

SEQ ID NO: 6009964 - DNA, 14 bp, Homo sapiens
caggtccattctgt

SEQ ID NO: 6009965 - DNA, 21 bp, Homo sapiens
caggtcccaaatggccctggg

SEQ ID NO: 6009966 - DNA, 19 bp, Homo sapiens
caggtcccacctccagccc

SEQ ID NO: 6009967 - DNA, 14 bp, Homo sapiens
caggtcccacgcca

SEQ ID NO: 6009968 - DNA, 18 bp, Homo sapiens
caggtcccacgccaggcc

SEQ ID NO: 6009969 - DNA, 19 bp, Homo sapiens
caggtcccacgtctggcca

SEQ ID NO: 6009970 - DNA, 18 bp, Homo sapiens
caggtcccagcccctcct

SEQ ID NO: 6009971 - DNA, 19 bp, Homo sapiens
caggtcccagcccctcctc

SEQ ID NO: 6009972 - DNA, 21 bp, Homo sapiens
caggtcccagcccctcctccc

SEQ ID NO: 6009973 - DNA, 20 bp, Homo sapiens
caggtcccagccccttttcc

SEQ ID NO: 6009974 - DNA, 13 bp, Homo sapiens
caggtcccagcga

SEQ ID NO: 6009975 - DNA, 14 bp, Homo sapiens
caggtcccagcgag

SEQ ID NO: 6009976 - DNA, 15 bp, Homo sapiens
caggtcccagcgagc

SEQ ID NO: 6009977 - DNA, 20 bp, Homo sapiens
caggtcccagcgagccacag

SEQ ID NO: 6009978 - DNA, 21 bp, Homo sapiens
caggtcccagcgagccacagg

SEQ ID NO: 6009979 - DNA, 20 bp, Homo sapiens
caggtcccagtgccattggc

SEQ ID NO: 6009980 - DNA, 12 bp, Homo sapiens
caggtcccagtt

SEQ ID NO: 6009981 - DNA, 20 bp, Homo sapiens
caggtcccagttgctgtcac

SEQ ID NO: 6009982 - DNA, 15 bp, Homo sapiens
caggtccccaaactt

SEQ ID NO: 6009983 - DNA, 18 bp, Homo sapiens
caggtccccagctttggc

SEQ ID NO: 6009984 - DNA, 17 bp, Homo sapiens
caggtccccatggcttg

SEQ ID NO: 6009985 - DNA, 17 bp, Homo sapiens
caggtcccccgactgcc

SEQ ID NO: 6009986 - DNA, 22 bp, Homo sapiens
caggtcccccgactgcctgtct

SEQ ID NO: 6009987 - DNA, 15 bp, Homo sapiens
caggtccccctgcag

SEQ ID NO: 6009988 - DNA, 18 bp, Homo sapiens
caggtccccctgcagcta

SEQ ID NO: 6009989 - DNA, 12 bp, Homo sapiens
caggtcccctca

SEQ ID NO: 6009990 - DNA, 15 bp, Homo sapiens
caggtcccctgccct

SEQ ID NO: 6009991 - DNA, 18 bp, Homo sapiens
caggtcccctgccctgag

SEQ ID NO: 6009992 - DNA, 18 bp, Homo sapiens
caggtcccctttcagaga

SEQ ID NO: 6009993 - DNA, 18 bp, Homo sapiens
caggtcccgagccccctg

SEQ ID NO: 6009994 - DNA, 18 bp, Homo sapiens
caggtccctaataaagct

SEQ ID NO: 6009995 - DNA, 19 bp, Homo sapiens
caggtccctggaccagcct

SEQ ID NO: 6009996 - DNA, 17 bp, Homo sapiens
caggtccggaggggttg

SEQ ID NO: 6009997 - DNA, 16 bp, Homo sapiens
caggtccggggaggag

SEQ ID NO: 6009998 - DNA, 13 bp, Homo sapiens
caggtccgtgggc

SEQ ID NO: 6009999 - DNA, 22 bp, Homo sapiens
caggtccgtttccttacacatt

SEQ ID NO: 6010000 - DNA, 22 bp, Homo sapiens
caggtcctactggggaaacttc

SEQ ID NO: 6010001 - DNA, 13 bp, Homo sapiens
caggtcctcacag

SEQ ID NO: 6010002 - DNA, 16 bp, Homo sapiens
caggtcctcacagcag

SEQ ID NO: 6010003 - DNA, 20 bp, Homo sapiens
caggtcctcagagaatttct

SEQ ID NO: 6010004 - DNA, 20 bp, Homo sapiens
caggtcctccatcacccctg

SEQ ID NO: 6010005 - DNA, 14 bp, Homo sapiens
caggtcctccctgc

SEQ ID NO: 6010006 - DNA, 21 bp, Homo sapiens
caggtcctctgatacccagag

SEQ ID NO: 6010007 - DNA, 21 bp, Homo sapiens
caggtcctgcagtctggctga

SEQ ID NO: 6010008 - DNA, 18 bp, Homo sapiens
caggtcctgcccatgtgt

SEQ ID NO: 6010009 - DNA, 21 bp, Homo sapiens
caggtcctgcccatgtgtccc

SEQ ID NO: 6010010 - DNA, 22 bp, Homo sapiens
caggtcctgcccatgtgtcccc

SEQ ID NO: 6010011 - DNA, 12 bp, Homo sapiens
caggtcctgctc

SEQ ID NO: 6010012 - DNA, 13 bp, Homo sapiens
caggtcctgctca

SEQ ID NO: 6010013 - DNA, 20 bp, Homo sapiens
caggtcctgctccgctgcct

SEQ ID NO: 6010014 - DNA, 12 bp, Homo sapiens
caggtcctgggg

SEQ ID NO: 6010015 - DNA, 14 bp, Homo sapiens
caggtcctggggag

SEQ ID NO: 6010016 - DNA, 19 bp, Homo sapiens
caggtcctggggaggctga

SEQ ID NO: 6010017 - DNA, 13 bp, Homo sapiens
caggtcctggtgg

SEQ ID NO: 6010018 - DNA, 19 bp, Homo sapiens
caggtcctggtggggcagc

SEQ ID NO: 6010019 - DNA, 17 bp, Homo sapiens
caggtcctggtgggtca

SEQ ID NO: 6010020 - DNA, 18 bp, Homo sapiens
caggtccttcccagattt

SEQ ID NO: 6010021 - DNA, 22 bp, Homo sapiens
caggtccttcctttaggtctgg

SEQ ID NO: 6010022 - DNA, 18 bp, Homo sapiens
caggtcctttccttctcg

SEQ ID NO: 6010023 - DNA, 23 bp, Homo sapiens
caggtcctttccttctcgtcttc

SEQ ID NO: 6010024 - DNA, 14 bp, Homo sapiens
caggtcgagctgtg

SEQ ID NO: 6010025 - DNA, 16 bp, Homo sapiens
caggtcgagctgtgct

SEQ ID NO: 6010026 - DNA, 13 bp, Homo sapiens
caggtcgcccacc

SEQ ID NO: 6010027 - DNA, 14 bp, Homo sapiens
caggtcgggcagtg

SEQ ID NO: 6010028 - DNA, 22 bp, Homo sapiens
caggtcgggctcagctctggct

SEQ ID NO: 6010029 - DNA, 20 bp, Homo sapiens
caggtcgggctgccagccca

SEQ ID NO: 6010030 - DNA, 23 bp, Homo sapiens
caggtcgggctgccagcccagct

SEQ ID NO: 6010031 - DNA, 13 bp, Homo sapiens
caggtctacagtg

SEQ ID NO: 6010032 - DNA, 18 bp, Homo sapiens
caggtctagaaggccagg

SEQ ID NO: 6010033 - DNA, 17 bp, Homo sapiens
caggtctagactttctc

SEQ ID NO: 6010034 - DNA, 19 bp, Homo sapiens
caggtctcaaggttctcat

SEQ ID NO: 6010035 - DNA, 16 bp, Homo sapiens
caggtctcactgcttt

SEQ ID NO: 6010036 - DNA, 17 bp, Homo sapiens
caggtctcattgcttct

SEQ ID NO: 6010037 - DNA, 15 bp, Homo sapiens
caggtctccacctgc

SEQ ID NO: 6010038 - DNA, 16 bp, Homo sapiens
caggtctccacctgca

SEQ ID NO: 6010039 - DNA, 17 bp, Homo sapiens
caggtctccacctgcac

SEQ ID NO: 6010040 - DNA, 20 bp, Homo sapiens
caggtctccatgaagaagct

SEQ ID NO: 6010041 - DNA, 19 bp, Homo sapiens
caggtctcctccaccgcca

SEQ ID NO: 6010042 - DNA, 15 bp, Homo sapiens
caggtctcctcttaa

SEQ ID NO: 6010043 - DNA, 17 bp, Homo sapiens
caggtctcctcttaaaa

SEQ ID NO: 6010044 - DNA, 15 bp, Homo sapiens
caggtctcctgggaa

SEQ ID NO: 6010045 - DNA, 14 bp, Homo sapiens
caggtctctccact

SEQ ID NO: 6010046 - DNA, 13 bp, Homo sapiens
caggtctctgaga

SEQ ID NO: 6010047 - DNA, 15 bp, Homo sapiens
caggtctctgagaca

SEQ ID NO: 6010048 - DNA, 14 bp, Homo sapiens
caggtctctggcag

SEQ ID NO: 6010049 - DNA, 15 bp, Homo sapiens
caggtctctggcaga

SEQ ID NO: 6010050 - DNA, 17 bp, Homo sapiens
caggtctctggcagaga

SEQ ID NO: 6010051 - DNA, 21 bp, Homo sapiens
caggtctctggcagagaagga

SEQ ID NO: 6010052 - DNA, 16 bp, Homo sapiens
caggtctgatctgggt

SEQ ID NO: 6010053 - DNA, 17 bp, Homo sapiens
caggtctgatctgggtt

SEQ ID NO: 6010054 - DNA, 13 bp, Homo sapiens
caggtctgatgcc

SEQ ID NO: 6010055 - DNA, 16 bp, Homo sapiens
caggtctgatgccaaa

SEQ ID NO: 6010056 - DNA, 15 bp, Homo sapiens
caggtctgcaagggc

SEQ ID NO: 6010057 - DNA, 14 bp, Homo sapiens
caggtctgcaggcc

SEQ ID NO: 6010058 - DNA, 15 bp, Homo sapiens
caggtctgcaggcca

SEQ ID NO: 6010059 - DNA, 17 bp, Homo sapiens
caggtctgcaggccacc

SEQ ID NO: 6010060 - DNA, 14 bp, Homo sapiens
cagactggcaataa

SEQ ID NO: 6010061 - DNA, 18 bp, Homo sapiens
cagactggcacagttttc

SEQ ID NO: 6010062 - DNA, 18 bp, Homo sapiens
cagactggccgggcaggc

SEQ ID NO: 6010063 - DNA, 20 bp, Homo sapiens
cagactggccgggcaggcgt

SEQ ID NO: 6010064 - DNA, 16 bp, Homo sapiens
cagactggcctgagga

SEQ ID NO: 6010065 - DNA, 23 bp, Homo sapiens
cagactggcggagaaggagagga

SEQ ID NO: 6010066 - DNA, 13 bp, Homo sapiens
cagactggctgca

SEQ ID NO: 6010067 - DNA, 15 bp, Homo sapiens
cagactggctgcaca

SEQ ID NO: 6010068 - DNA, 19 bp, Homo sapiens
cagactggctgcacagccc

SEQ ID NO: 6010069 - DNA, 20 bp, Homo sapiens
cagactggctgcacagccca

SEQ ID NO: 6010070 - DNA, 16 bp, Homo sapiens
cagactgggcactggg

SEQ ID NO: 6010071 - DNA, 12 bp, Homo sapiens
cagactgggccc

SEQ ID NO: 6010072 - DNA, 20 bp, Homo sapiens
cagactgggcccaggcaggt

SEQ ID NO: 6010073 - DNA, 14 bp, Homo sapiens
cagactggggcatc

SEQ ID NO: 6010074 - DNA, 22 bp, Homo sapiens
cagactggggcatcctgtgcca

SEQ ID NO: 6010075 - DNA, 15 bp, Homo sapiens
cagactgggtttcta

SEQ ID NO: 6010076 - DNA, 15 bp, Homo sapiens
cagactggtgagcag

SEQ ID NO: 6010077 - DNA, 17 bp, Homo sapiens
cagactggtgagcagac

SEQ ID NO: 6010078 - DNA, 15 bp, Homo sapiens
cagactggtgttaat

SEQ ID NO: 6010079 - DNA, 16 bp, Homo sapiens
cagactggtgttaatg

SEQ ID NO: 6010080 - DNA, 17 bp, Homo sapiens
cagactggtgttaatga

SEQ ID NO: 6010081 - DNA, 19 bp, Homo sapiens
cagactgtagcttctcttg

SEQ ID NO: 6010082 - DNA, 14 bp, Homo sapiens
cagactgtccaggg

SEQ ID NO: 6010083 - DNA, 23 bp, Homo sapiens
cagactgtccagggaaacagcct

SEQ ID NO: 6010084 - DNA, 11 bp, Homo sapiens
cagactgtctc

SEQ ID NO: 6010085 - DNA, 17 bp, Homo sapiens
cagactgtgaacttgac

SEQ ID NO: 6010086 - DNA, 21 bp, Homo sapiens
cagactgtgaacttgactggg

SEQ ID NO: 6010087 - DNA, 14 bp, Homo sapiens
cagactgtgcaata

SEQ ID NO: 6010088 - DNA, 12 bp, Homo sapiens
cagactgtgtaa

SEQ ID NO: 6010089 - DNA, 12 bp, Homo sapiens
cagactgtgtat

SEQ ID NO: 6010090 - DNA, 23 bp, Homo sapiens
cagactgtgtattcattgaagtc

SEQ ID NO: 6010091 - DNA, 22 bp, Homo sapiens
cagactgtgtttaactgctgca

SEQ ID NO: 6010092 - DNA, 18 bp, Homo sapiens
cagactgttgtccctgca

SEQ ID NO: 6010093 - DNA, 14 bp, Homo sapiens
cagactgttttact

SEQ ID NO: 6010094 - DNA, 19 bp, Homo sapiens
cagacttaaagttgtcctc

SEQ ID NO: 6010095 - DNA, 23 bp, Homo sapiens
cagacttagtttttataaaatgg

SEQ ID NO: 6010096 - DNA, 21 bp, Homo sapiens
cagacttcaaaaggaatgaac

SEQ ID NO: 6010097 - DNA, 22 bp, Homo sapiens
cagacttcacacagcacctcct

SEQ ID NO: 6010098 - DNA, 15 bp, Homo sapiens
cagacttcacagcgt

SEQ ID NO: 6010099 - DNA, 16 bp, Homo sapiens
cagacttcacagcgtc

SEQ ID NO: 6010100 - DNA, 20 bp, Homo sapiens
cagacttcacagcgtctgct

SEQ ID NO: 6010101 - DNA, 21 bp, Homo sapiens
cagacttcacagcgtctgctc

SEQ ID NO: 6010102 - DNA, 22 bp, Homo sapiens
cagacttcacagcgtctgctca

SEQ ID NO: 6010103 - DNA, 22 bp, Homo sapiens
cagacttccaaatcctggaagg

SEQ ID NO: 6010104 - DNA, 23 bp, Homo sapiens
cagacttccaaatcctggaagga

SEQ ID NO: 6010105 - DNA, 22 bp, Homo sapiens
cagacttccaccatgtgcatca

SEQ ID NO: 6010106 - DNA, 15 bp, Homo sapiens
cagacttcccagcta

SEQ ID NO: 6010107 - DNA, 21 bp, Homo sapiens
cagacttccctgaatgtattg

SEQ ID NO: 6010108 - DNA, 18 bp, Homo sapiens
cagacttcgctattccca

SEQ ID NO: 6010109 - DNA, 21 bp, Homo sapiens
cagacttcgctattcccaggc

SEQ ID NO: 6010110 - DNA, 23 bp, Homo sapiens
cagacttcgctattcccaggcag

SEQ ID NO: 6010111 - DNA, 16 bp, Homo sapiens
cagacttctaaaataa

SEQ ID NO: 6010112 - DNA, 20 bp, Homo sapiens
cagacttctaaaataaatgt

SEQ ID NO: 6010113 - DNA, 13 bp, Homo sapiens
cagacttctccag

SEQ ID NO: 6010114 - DNA, 15 bp, Homo sapiens
cagacttctccagac

SEQ ID NO: 6010115 - DNA, 20 bp, Homo sapiens
cagacttctcttattcttta

SEQ ID NO: 6010116 - DNA, 16 bp, Homo sapiens
cagacttctctttctt

SEQ ID NO: 6010117 - DNA, 14 bp, Homo sapiens
cagacttctggaag

SEQ ID NO: 6010118 - DNA, 20 bp, Homo sapiens
cagacttctggaaggctggc

SEQ ID NO: 6010119 - DNA, 20 bp, Homo sapiens
cagacttcttaaaaggagct

SEQ ID NO: 6010120 - DNA, 13 bp, Homo sapiens
cagacttgcactg

SEQ ID NO: 6010121 - DNA, 14 bp, Homo sapiens
cagacttgcactga

SEQ ID NO: 6010122 - DNA, 17 bp, Homo sapiens
cagacttgcactgaagc

SEQ ID NO: 6010123 - DNA, 20 bp, Homo sapiens
cagacttgccaggctccctt

SEQ ID NO: 6010124 - DNA, 17 bp, Homo sapiens
cagacttgcccaggtca

SEQ ID NO: 6010125 - DNA, 16 bp, Homo sapiens
cagacttgcggccaca

SEQ ID NO: 6010126 - DNA, 18 bp, Homo sapiens
cagacttgcggccacagc

SEQ ID NO: 6010127 - DNA, 22 bp, Homo sapiens
cagacttgcggccacagcacta

SEQ ID NO: 6010128 - DNA, 14 bp, Homo sapiens
cagacttgcttcct

SEQ ID NO: 6010129 - DNA, 15 bp, Homo sapiens
cagacttgcttcctg

SEQ ID NO: 6010130 - DNA, 17 bp, Homo sapiens
cagacttgcttcctgca

SEQ ID NO: 6010131 - DNA, 22 bp, Homo sapiens
cagacttggcctccagctgttc

SEQ ID NO: 6010132 - DNA, 23 bp, Homo sapiens
cagacttgggcccaggctcaaat

SEQ ID NO: 6010133 - DNA, 16 bp, Homo sapiens
cagacttgtatattct

SEQ ID NO: 6010134 - DNA, 17 bp, Homo sapiens
cagacttgtatattcta

SEQ ID NO: 6010135 - DNA, 16 bp, Homo sapiens
cagacttgtttcctgt

SEQ ID NO: 6010136 - DNA, 18 bp, Homo sapiens
cagacttgtttcctgtgc

SEQ ID NO: 6010137 - DNA, 17 bp, Homo sapiens
cagactttagtgccctg

SEQ ID NO: 6010138 - DNA, 21 bp, Homo sapiens
cagactttagtgccctgcccc

SEQ ID NO: 6010139 - DNA, 21 bp, Homo sapiens
cagactttctacacctgttgc

SEQ ID NO: 6010140 - DNA, 16 bp, Homo sapiens
cagactttctttttct

SEQ ID NO: 6010141 - DNA, 19 bp, Homo sapiens
cagactttggaaaatgcat

SEQ ID NO: 6010142 - DNA, 23 bp, Homo sapiens
cagactttggaaaatgcattgta

SEQ ID NO: 6010143 - DNA, 19 bp, Homo sapiens
cagactttggacagtggcc

SEQ ID NO: 6010144 - DNA, 21 bp, Homo sapiens
cagactttgtgttcatttcat

SEQ ID NO: 6010145 - DNA, 13 bp, Homo sapiens
cagacttttcaga

SEQ ID NO: 6010146 - DNA, 13 bp, Homo sapiens
cagacttttctct

SEQ ID NO: 6010147 - DNA, 20 bp, Homo sapiens
cagacttttgcttacctttt

SEQ ID NO: 6010148 - DNA, 17 bp, Homo sapiens
cagagaaaaagggaggg

SEQ ID NO: 6010149 - DNA, 18 bp, Homo sapiens
cagagaaaaagggagggg

SEQ ID NO: 6010150 - DNA, 23 bp, Homo sapiens
cagagaaaaatgctccccacagc

SEQ ID NO: 6010151 - DNA, 13 bp, Homo sapiens
cagagaaaacaca

SEQ ID NO: 6010152 - DNA, 22 bp, Homo sapiens
cagagaaaacactttcctggat

SEQ ID NO: 6010153 - DNA, 24 bp, Homo sapiens
cagagaaaacactttcctggataa

SEQ ID NO: 6010154 - DNA, 16 bp, Homo sapiens
cagagaaaacttgcct

SEQ ID NO: 6010155 - DNA, 17 bp, Homo sapiens
cagagaaaacttgcctt

SEQ ID NO: 6010156 - DNA, 20 bp, Homo sapiens
cagagaaaacttgcctttca

SEQ ID NO: 6010157 - DNA, 16 bp, Homo sapiens
cagagaaaagcttgga

SEQ ID NO: 6010158 - DNA, 20 bp, Homo sapiens
cagagaaaatgagaaaggac

SEQ ID NO: 6010159 - DNA, 22 bp, Homo sapiens
cagagaaaatgagaaaggacag

SEQ ID NO: 6010160 - DNA, 22 bp, Homo sapiens
cagagaaaccagcttccttcag

SEQ ID NO: 6010161 - DNA, 20 bp, Homo sapiens
cagagaaacttaagcaaagg

SEQ ID NO: 6010162 - DNA, 11 bp, Homo sapiens
cagagaaagaa

SEQ ID NO: 6010163 - DNA, 14 bp, Homo sapiens
cagagaaagaaaag

SEQ ID NO: 6010164 - DNA, 17 bp, Homo sapiens
cagagaaagaaaaggca

SEQ ID NO: 6010165 - DNA, 19 bp, Homo sapiens
cagagaaagaaaaggcaaa

SEQ ID NO: 6010166 - DNA, 23 bp, Homo sapiens
cagagaaagaaaaggcaaaagac

SEQ ID NO: 6010167 - DNA, 22 bp, Homo sapiens
cagagaaagaaagggaaactgg

SEQ ID NO: 6010168 - DNA, 21 bp, Homo sapiens
cagagaaagaagagacaggag

SEQ ID NO: 6010169 - DNA, 15 bp, Homo sapiens
cagagaaagaggaag

SEQ ID NO: 6010170 - DNA, 15 bp, Homo sapiens
cagagaaagcaaagg

SEQ ID NO: 6010171 - DNA, 19 bp, Homo sapiens
cagagaaagcaaaggtgca

SEQ ID NO: 6010172 - DNA, 24 bp, Homo sapiens
cagagaaagcaaaggtgcactcca

SEQ ID NO: 6010173 - DNA, 15 bp, Homo sapiens
cagagaaagcacaat

SEQ ID NO: 6010174 - DNA, 15 bp, Homo sapiens
cagagaaagcgcaga

SEQ ID NO: 6010175 - DNA, 15 bp, Homo sapiens
cagagaaagggacaa

SEQ ID NO: 6010176 - DNA, 17 bp, Homo sapiens
cagagaaatgccccagt

SEQ ID NO: 6010177 - DNA, 20 bp, Homo sapiens
cagagaaatgtgaagggtgg

SEQ ID NO: 6010178 - DNA, 22 bp, Homo sapiens
cagagaaatgtgaagggtgggg

SEQ ID NO: 6010179 - DNA, 17 bp, Homo sapiens
cagagaacagaactgga

SEQ ID NO: 6010180 - DNA, 18 bp, Homo sapiens
cagagaacagaactggag

SEQ ID NO: 6010181 - DNA, 23 bp, Homo sapiens
cagagaacagaactggaggcagt

SEQ ID NO: 6010182 - DNA, 11 bp, Homo sapiens
cagagaacagc

SEQ ID NO: 6010183 - DNA, 17 bp, Homo sapiens
cagagaacagctcccct

SEQ ID NO: 6010184 - DNA, 22 bp, Homo sapiens
cagagaacccagcccacccccg

SEQ ID NO: 6010185 - DNA, 22 bp, Homo sapiens
cagagaaccccccgcaatgtgc

SEQ ID NO: 6010186 - DNA, 14 bp, Homo sapiens
cagagaacctgagt

SEQ ID NO: 6010187 - DNA, 17 bp, Homo sapiens
cagagaacctgtgggct

SEQ ID NO: 6010188 - DNA, 20 bp, Homo sapiens
cagagaactaacactatttt

SEQ ID NO: 6010189 - DNA, 23 bp, Homo sapiens
cagagaactgatgcgacttgttt

SEQ ID NO: 6010190 - DNA, 18 bp, Homo sapiens
cagagaactgcagacctc

SEQ ID NO: 6010191 - DNA, 20 bp, Homo sapiens
cagagaactgcagacctcac

SEQ ID NO: 6010192 - DNA, 20 bp, Homo sapiens
cagagaactgtctttcattt

SEQ ID NO: 6010193 - DNA, 13 bp, Homo sapiens
cagagaagaaaac

SEQ ID NO: 6010194 - DNA, 14 bp, Homo sapiens
cagagaagaaagaa

SEQ ID NO: 6010195 - DNA, 22 bp, Homo sapiens
cagagaagagaccaagcttgtt

SEQ ID NO: 6010196 - DNA, 23 bp, Homo sapiens
cagagaagagagtattgggtaga

SEQ ID NO: 6010197 - DNA, 15 bp, Homo sapiens
cagagaagataatgt

SEQ ID NO: 6010198 - DNA, 19 bp, Homo sapiens
cagagaagataatgttctt

SEQ ID NO: 6010199 - DNA, 17 bp, Homo sapiens
cagagaagcatcctcca

SEQ ID NO: 6010200 - DNA, 21 bp, Homo sapiens
cagagaagcatcctccacatc

SEQ ID NO: 6010201 - DNA, 11 bp, Homo sapiens
cagagaagcca

SEQ ID NO: 6010202 - DNA, 20 bp, Homo sapiens
cagagaagccaaaagattgg

SEQ ID NO: 6010203 - DNA, 13 bp, Homo sapiens
cagagaagccagc

SEQ ID NO: 6010204 - DNA, 14 bp, Homo sapiens
cagagaagccagct

SEQ ID NO: 6010205 - DNA, 19 bp, Homo sapiens
cagagaagccagcttgttt

SEQ ID NO: 6010206 - DNA, 20 bp, Homo sapiens
cagagaagccagcttgttta

SEQ ID NO: 6010207 - DNA, 21 bp, Homo sapiens
cagagaagccagcttgtttac

SEQ ID NO: 6010208 - DNA, 12 bp, Homo sapiens
cagagaagccat

SEQ ID NO: 6010209 - DNA, 13 bp, Homo sapiens
cagagaagccatc

SEQ ID NO: 6010210 - DNA, 19 bp, Homo sapiens
cagagaagccatcacctca

SEQ ID NO: 6010211 - DNA, 16 bp, Homo sapiens
cagagaagccttcaag

SEQ ID NO: 6010212 - DNA, 17 bp, Homo sapiens
cagagaagccttcaagc

SEQ ID NO: 6010213 - DNA, 18 bp, Homo sapiens
cagagaagccttcaagct

SEQ ID NO: 6010214 - DNA, 21 bp, Homo sapiens
cagagaagccttcaagctctg

SEQ ID NO: 6010215 - DNA, 19 bp, Homo sapiens
cagagaagcggatttccag

SEQ ID NO: 6010216 - DNA, 23 bp, Homo sapiens
cagagaagctataaattcctctt

SEQ ID NO: 6010217 - DNA, 13 bp, Homo sapiens
cagagaagctggg

SEQ ID NO: 6010218 - DNA, 20 bp, Homo sapiens
cagagaaggacggtgccaag

SEQ ID NO: 6010219 - DNA, 11 bp, Homo sapiens
cagagaaggat

SEQ ID NO: 6010220 - DNA, 14 bp, Homo sapiens
cagagaaggcagga

SEQ ID NO: 6010221 - DNA, 22 bp, Homo sapiens
cagagaaggcctcttgtgctca

SEQ ID NO: 6010222 - DNA, 12 bp, Homo sapiens
cagagaaggcta

SEQ ID NO: 6010223 - DNA, 13 bp, Homo sapiens
cagagaaggcttc

SEQ ID NO: 6010224 - DNA, 19 bp, Homo sapiens
cagagaaggcttcctccag

SEQ ID NO: 6010225 - DNA, 11 bp, Homo sapiens
cagagaagggc

SEQ ID NO: 6010226 - DNA, 13 bp, Homo sapiens
cagagaagggcag

SEQ ID NO: 6010227 - DNA, 18 bp, Homo sapiens
cagagaagtcacagggca

SEQ ID NO: 6010228 - DNA, 18 bp, Homo sapiens
cagagaagtctggtcaga

SEQ ID NO: 6010229 - DNA, 21 bp, Homo sapiens
cagagaagtctggtcagagcc

SEQ ID NO: 6010230 - DNA, 22 bp, Homo sapiens
cagagaagtctggtcagagcca

SEQ ID NO: 6010231 - DNA, 13 bp, Homo sapiens
cagagaagtgaca

SEQ ID NO: 6010232 - DNA, 15 bp, Homo sapiens
cagagaagtgacagg

SEQ ID NO: 6010233 - DNA, 16 bp, Homo sapiens
cagagaagtgacaggg

SEQ ID NO: 6010234 - DNA, 17 bp, Homo sapiens
cagagaagtgacaggga

SEQ ID NO: 6010235 - DNA, 19 bp, Homo sapiens
cagagaagtgacagggaag

SEQ ID NO: 6010236 - DNA, 21 bp, Homo sapiens
cagagaagtgacagggaagct

SEQ ID NO: 6010237 - DNA, 14 bp, Homo sapiens
caggtctggcgcca

SEQ ID NO: 6010238 - DNA, 16 bp, Homo sapiens
caggtctgggtggggc

SEQ ID NO: 6010239 - DNA, 19 bp, Homo sapiens
caggtctgtaactgcccag

SEQ ID NO: 6010240 - DNA, 20 bp, Homo sapiens
caggtctgtaactgcccagc

SEQ ID NO: 6010241 - DNA, 17 bp, Homo sapiens
caggtctgtatgtcatg

SEQ ID NO: 6010242 - DNA, 20 bp, Homo sapiens
caggtcttaatcagttagat

SEQ ID NO: 6010243 - DNA, 16 bp, Homo sapiens
caggtcttcactgccc

SEQ ID NO: 6010244 - DNA, 18 bp, Homo sapiens
caggtcttcactgcccag

SEQ ID NO: 6010245 - DNA, 20 bp, Homo sapiens
caggtcttcactgcccaggg

SEQ ID NO: 6010246 - DNA, 15 bp, Homo sapiens
caggtcttccagacc

SEQ ID NO: 6010247 - DNA, 20 bp, Homo sapiens
caggtcttgaactcctggcc

SEQ ID NO: 6010248 - DNA, 23 bp, Homo sapiens
caggtcttgactcatggcagctg

SEQ ID NO: 6010249 - DNA, 14 bp, Homo sapiens
caggtcttgcccaa

SEQ ID NO: 6010250 - DNA, 19 bp, Homo sapiens
caggtcttgttcaagcagc

SEQ ID NO: 6010251 - DNA, 13 bp, Homo sapiens
caggtctttccta

SEQ ID NO: 6010252 - DNA, 14 bp, Homo sapiens
caggtctttcctaa

SEQ ID NO: 6010253 - DNA, 21 bp, Homo sapiens
caggtctttcctaaggctgca

SEQ ID NO: 6010254 - DNA, 13 bp, Homo sapiens
caggtctttgaaa

SEQ ID NO: 6010255 - DNA, 13 bp, Homo sapiens
caggtcttttctt

SEQ ID NO: 6010256 - DNA, 18 bp, Homo sapiens
caggtgaaagtttttctg

SEQ ID NO: 6010257 - DNA, 19 bp, Homo sapiens
caggtgaaagtttttctga

SEQ ID NO: 6010258 - DNA, 14 bp, Homo sapiens
caggtgaacttttt

SEQ ID NO: 6010259 - DNA, 14 bp, Homo sapiens
caggtgaaggaggc

SEQ ID NO: 6010260 - DNA, 19 bp, Homo sapiens
caggtgaaggaggctccag

SEQ ID NO: 6010261 - DNA, 18 bp, Homo sapiens
caggtgacacgcttctga

SEQ ID NO: 6010262 - DNA, 19 bp, Homo sapiens
caggtgacacgcttctgag

SEQ ID NO: 6010263 - DNA, 21 bp, Homo sapiens
caggtgacacgcttctgagca

SEQ ID NO: 6010264 - DNA, 14 bp, Homo sapiens
caggtgacagatca

SEQ ID NO: 6010265 - DNA, 21 bp, Homo sapiens
caggtgacagtgaggtcctgg

SEQ ID NO: 6010266 - DNA, 16 bp, Homo sapiens
caggtgacagtggctg

SEQ ID NO: 6010267 - DNA, 22 bp, Homo sapiens
caggtgacagtggctgctctgg

SEQ ID NO: 6010268 - DNA, 17 bp, Homo sapiens
caggtgaccttctggga

SEQ ID NO: 6010269 - DNA, 18 bp, Homo sapiens
caggtgaccttctgggaa

SEQ ID NO: 6010270 - DNA, 22 bp, Homo sapiens
caggtgacgatttagctgtggc

SEQ ID NO: 6010271 - DNA, 23 bp, Homo sapiens
caggtgacggactcagactcctg

SEQ ID NO: 6010272 - DNA, 19 bp, Homo sapiens
caggtgactgtctggggag

SEQ ID NO: 6010273 - DNA, 21 bp, Homo sapiens
caggtgacttctagcagagac

SEQ ID NO: 6010274 - DNA, 17 bp, Homo sapiens
caggtgagaacccagag

SEQ ID NO: 6010275 - DNA, 17 bp, Homo sapiens
caggtgagcagacagga

SEQ ID NO: 6010276 - DNA, 16 bp, Homo sapiens
caggtgagcaggcagg

SEQ ID NO: 6010277 - DNA, 20 bp, Homo sapiens
caggtgagcaggcagggctg

SEQ ID NO: 6010278 - DNA, 18 bp, Homo sapiens
caggtgagctctgaccct

SEQ ID NO: 6010279 - DNA, 20 bp, Homo sapiens
caggtgaggaatttgaagct

SEQ ID NO: 6010280 - DNA, 17 bp, Homo sapiens
caggtgagggaaggaga

SEQ ID NO: 6010281 - DNA, 14 bp, Homo sapiens
caggtgaggggcag

SEQ ID NO: 6010282 - DNA, 15 bp, Homo sapiens
caggtgaggggcagg

SEQ ID NO: 6010283 - DNA, 21 bp, Homo sapiens
caggtgaggtctgttcctttt

SEQ ID NO: 6010284 - DNA, 21 bp, Homo sapiens
caggtgagtgtgagggcagca

SEQ ID NO: 6010285 - DNA, 14 bp, Homo sapiens
caggtgatccaccc

SEQ ID NO: 6010286 - DNA, 16 bp, Homo sapiens
caggtgatccacccac

SEQ ID NO: 6010287 - DNA, 20 bp, Homo sapiens
caggtgatccacccacctgg

SEQ ID NO: 6010288 - DNA, 15 bp, Homo sapiens
caggtgatccacctg

SEQ ID NO: 6010289 - DNA, 16 bp, Homo sapiens
caggtgatccacctgc

SEQ ID NO: 6010290 - DNA, 23 bp, Homo sapiens
caggtgatcccccaaacagcatg

SEQ ID NO: 6010291 - DNA, 16 bp, Homo sapiens
caggtgatctcctgtg

SEQ ID NO: 6010292 - DNA, 21 bp, Homo sapiens
caggtgatctcctgtggctca

SEQ ID NO: 6010293 - DNA, 23 bp, Homo sapiens
caggtgatctgctgcagagcagt

SEQ ID NO: 6010294 - DNA, 17 bp, Homo sapiens
caggtgatgctctggct

SEQ ID NO: 6010295 - DNA, 23 bp, Homo sapiens
caggtgatgtctggtcaactggc

SEQ ID NO: 6010296 - DNA, 24 bp, Homo sapiens
caggtgcaacactcaagtctattg

SEQ ID NO: 6010297 - DNA, 18 bp, Homo sapiens
caggtgcaaccagggagc

SEQ ID NO: 6010298 - DNA, 13 bp, Homo sapiens
caggtgcaagaga

SEQ ID NO: 6010299 - DNA, 18 bp, Homo sapiens
caggtgcacaagctccaa

SEQ ID NO: 6010300 - DNA, 19 bp, Homo sapiens
caggtgcacaagctccaag

SEQ ID NO: 6010301 - DNA, 15 bp, Homo sapiens
caggtgcacacatca

SEQ ID NO: 6010302 - DNA, 22 bp, Homo sapiens
caggtgcacacatcaccaggtg

SEQ ID NO: 6010303 - DNA, 24 bp, Homo sapiens
caggtgcacacatcaccaggtgca

SEQ ID NO: 6010304 - DNA, 21 bp, Homo sapiens
caggtgcagaccttgggggaa

SEQ ID NO: 6010305 - DNA, 16 bp, Homo sapiens
caggtgcagaggtacc

SEQ ID NO: 6010306 - DNA, 15 bp, Homo sapiens
caggtgcagccccag

SEQ ID NO: 6010307 - DNA, 16 bp, Homo sapiens
caggtgcagccccagg

SEQ ID NO: 6010308 - DNA, 18 bp, Homo sapiens
caggtgcagccccagggc

SEQ ID NO: 6010309 - DNA, 23 bp, Homo sapiens
caggtgcagccccagggcctgcg

SEQ ID NO: 6010310 - DNA, 23 bp, Homo sapiens
caggtgcagcccccactgccttt

SEQ ID NO: 6010311 - DNA, 21 bp, Homo sapiens
caggtgcagcccttcctccct

SEQ ID NO: 6010312 - DNA, 14 bp, Homo sapiens
caggtgcagggaag

SEQ ID NO: 6010313 - DNA, 22 bp, Homo sapiens
caggtgcagggaagtgcagagc

SEQ ID NO: 6010314 - DNA, 17 bp, Homo sapiens
caggtgccaatgactaa

SEQ ID NO: 6010315 - DNA, 16 bp, Homo sapiens
caggtgccaccaataa

SEQ ID NO: 6010316 - DNA, 21 bp, Homo sapiens
caggtgccactccctgagctt

SEQ ID NO: 6010317 - DNA, 13 bp, Homo sapiens
caggtgccaggaa

SEQ ID NO: 6010318 - DNA, 16 bp, Homo sapiens
caggtgccaggaactc

SEQ ID NO: 6010319 - DNA, 20 bp, Homo sapiens
caggtgccagggcccacccc

SEQ ID NO: 6010320 - DNA, 17 bp, Homo sapiens
caggtgccatgcctgct

SEQ ID NO: 6010321 - DNA, 22 bp, Homo sapiens
caggtgcccattagcaacgcct

SEQ ID NO: 6010322 - DNA, 13 bp, Homo sapiens
caggtgccccacc

SEQ ID NO: 6010323 - DNA, 13 bp, Homo sapiens
caggtgcccctct

SEQ ID NO: 6010324 - DNA, 16 bp, Homo sapiens
caggtgcccctctctc

SEQ ID NO: 6010325 - DNA, 14 bp, Homo sapiens
caggtgcccgccac

SEQ ID NO: 6010326 - DNA, 16 bp, Homo sapiens
caggtgccgccagctg

SEQ ID NO: 6010327 - DNA, 17 bp, Homo sapiens
caggtgccgccagctgc

SEQ ID NO: 6010328 - DNA, 19 bp, Homo sapiens
caggtgcctaacctgggac

SEQ ID NO: 6010329 - DNA, 15 bp, Homo sapiens
caggtgcctccaggt

SEQ ID NO: 6010330 - DNA, 18 bp, Homo sapiens
caggtgcctccaggtgtg

SEQ ID NO: 6010331 - DNA, 21 bp, Homo sapiens
caggtgcctccaggtgtgcac

SEQ ID NO: 6010332 - DNA, 19 bp, Homo sapiens
caggtgcctcccagccctg

SEQ ID NO: 6010333 - DNA, 15 bp, Homo sapiens
caggtgcctggacat

SEQ ID NO: 6010334 - DNA, 16 bp, Homo sapiens
caggtgcctggccctt

SEQ ID NO: 6010335 - DNA, 21 bp, Homo sapiens
caggtgcctggcccttggctt

SEQ ID NO: 6010336 - DNA, 13 bp, Homo sapiens
caggtgcctggct

SEQ ID NO: 6010337 - DNA, 15 bp, Homo sapiens
caggtgcctggcttg

SEQ ID NO: 6010338 - DNA, 23 bp, Homo sapiens
caggtgccttacatcttttctaa

SEQ ID NO: 6010339 - DNA, 13 bp, Homo sapiens
caggtgccttgga

SEQ ID NO: 6010340 - DNA, 17 bp, Homo sapiens
caggtgcctttcaaatt

SEQ ID NO: 6010341 - DNA, 19 bp, Homo sapiens
caggtgcggcctgggggga

SEQ ID NO: 6010342 - DNA, 14 bp, Homo sapiens
caggtgcgggacca

SEQ ID NO: 6010343 - DNA, 15 bp, Homo sapiens
caggtgctagaagcc

SEQ ID NO: 6010344 - DNA, 20 bp, Homo sapiens
caggtgctagggtgcctgct

SEQ ID NO: 6010345 - DNA, 21 bp, Homo sapiens
caggtgctcaataaacacttg

SEQ ID NO: 6010346 - DNA, 14 bp, Homo sapiens
caggtgctcaatgg

SEQ ID NO: 6010347 - DNA, 20 bp, Homo sapiens
caggtgctcagcccaggcac

SEQ ID NO: 6010348 - DNA, 15 bp, Homo sapiens
caggtgctcattgta

SEQ ID NO: 6010349 - DNA, 23 bp, Homo sapiens
caggtgctgacttcatctcccac

SEQ ID NO: 6010350 - DNA, 12 bp, Homo sapiens
caggtgctgcct

SEQ ID NO: 6010351 - DNA, 22 bp, Homo sapiens
caggtgctgctaccctccctgc

SEQ ID NO: 6010352 - DNA, 15 bp, Homo sapiens
caggtgctggagcac

SEQ ID NO: 6010353 - DNA, 13 bp, Homo sapiens
caggtgctggagg

SEQ ID NO: 6010354 - DNA, 14 bp, Homo sapiens
caggtgctggaggc

SEQ ID NO: 6010355 - DNA, 14 bp, Homo sapiens
caggtgctggccca

SEQ ID NO: 6010356 - DNA, 17 bp, Homo sapiens
caggtgctggcccagca

SEQ ID NO: 6010357 - DNA, 21 bp, Homo sapiens
caggtgctggcccagcatgga

SEQ ID NO: 6010358 - DNA, 13 bp, Homo sapiens
caggtgctgggct

SEQ ID NO: 6010359 - DNA, 14 bp, Homo sapiens
caggtgctgggctg

SEQ ID NO: 6010360 - DNA, 18 bp, Homo sapiens
caggtgctgggctggact

SEQ ID NO: 6010361 - DNA, 17 bp, Homo sapiens
caggtgctggggcctgg

SEQ ID NO: 6010362 - DNA, 15 bp, Homo sapiens
caggtgctggtcccg

SEQ ID NO: 6010363 - DNA, 15 bp, Homo sapiens
caggtgctgtgacac

SEQ ID NO: 6010364 - DNA, 13 bp, Homo sapiens
caggtgcttttgg

SEQ ID NO: 6010365 - DNA, 15 bp, Homo sapiens
caggtgcttttggca

SEQ ID NO: 6010366 - DNA, 19 bp, Homo sapiens
caggtgcttttggcagaga

SEQ ID NO: 6010367 - DNA, 22 bp, Homo sapiens
caggtgcttttggcagagacca

SEQ ID NO: 6010368 - DNA, 21 bp, Homo sapiens
caggtggaaaaactgagacag

SEQ ID NO: 6010369 - DNA, 15 bp, Homo sapiens
caggtggaacaggag

SEQ ID NO: 6010370 - DNA, 22 bp, Homo sapiens
caggtggaacaggaggaactgg

SEQ ID NO: 6010371 - DNA, 18 bp, Homo sapiens
caggtggaaggcagacag

SEQ ID NO: 6010372 - DNA, 19 bp, Homo sapiens
caggtggacgctgcagacc

SEQ ID NO: 6010373 - DNA, 17 bp, Homo sapiens
caggtggactctgggat

SEQ ID NO: 6010374 - DNA, 18 bp, Homo sapiens
caggtggactgactgtgt

SEQ ID NO: 6010375 - DNA, 18 bp, Homo sapiens
caggtggaggcgagccag

SEQ ID NO: 6010376 - DNA, 21 bp, Homo sapiens
caggtggaggcgagccagatt

SEQ ID NO: 6010377 - DNA, 17 bp, Homo sapiens
caggtggagggcacagc

SEQ ID NO: 6010378 - DNA, 19 bp, Homo sapiens
caggtggagggcacagccc

SEQ ID NO: 6010379 - DNA, 22 bp, Homo sapiens
caggtggaggtgccaggaagct

SEQ ID NO: 6010380 - DNA, 20 bp, Homo sapiens
caggtggaggtggcatcccc

SEQ ID NO: 6010381 - DNA, 12 bp, Homo sapiens
caggtggatcac

SEQ ID NO: 6010382 - DNA, 18 bp, Homo sapiens
caggtggatcacctgacg

SEQ ID NO: 6010383 - DNA, 17 bp, Homo sapiens
caggtggatctccttga

SEQ ID NO: 6010384 - DNA, 18 bp, Homo sapiens
caggtggatctccttgag

SEQ ID NO: 6010385 - DNA, 16 bp, Homo sapiens
caggtggatgaggaga

SEQ ID NO: 6010386 - DNA, 17 bp, Homo sapiens
caggtggatgaggagac

SEQ ID NO: 6010387 - DNA, 13 bp, Homo sapiens
caggtggcacctg

SEQ ID NO: 6010388 - DNA, 18 bp, Homo sapiens
caggtggcacctgcagcg

SEQ ID NO: 6010389 - DNA, 17 bp, Homo sapiens
caggtggcaggaccagg

SEQ ID NO: 6010390 - DNA, 18 bp, Homo sapiens
caggtggcatttgcaggt

SEQ ID NO: 6010391 - DNA, 18 bp, Homo sapiens
caggtggccaagttcctc

SEQ ID NO: 6010392 - DNA, 20 bp, Homo sapiens
caggtggccaagttcctcta

SEQ ID NO: 6010393 - DNA, 12 bp, Homo sapiens
caggtggccaga

SEQ ID NO: 6010394 - DNA, 17 bp, Homo sapiens
caggtggccagggctcc

SEQ ID NO: 6010395 - DNA, 13 bp, Homo sapiens
caggtggccatca

SEQ ID NO: 6010396 - DNA, 18 bp, Homo sapiens
caggtggccatcacagcc

SEQ ID NO: 6010397 - DNA, 21 bp, Homo sapiens
caggtggccgcccctgaggct

SEQ ID NO: 6010398 - DNA, 17 bp, Homo sapiens
caggtggcctccctcca

SEQ ID NO: 6010399 - DNA, 14 bp, Homo sapiens
caggtggcctcctg

SEQ ID NO: 6010400 - DNA, 16 bp, Homo sapiens
caggtggcctcctggc

SEQ ID NO: 6010401 - DNA, 22 bp, Homo sapiens
caggtggcctcctggcccgccc

SEQ ID NO: 6010402 - DNA, 22 bp, Homo sapiens
caggtggctctgaggtgcctgt

SEQ ID NO: 6010403 - DNA, 15 bp, Homo sapiens
caggtggctgaccca

SEQ ID NO: 6010404 - DNA, 13 bp, Homo sapiens
caggtgggagaga

SEQ ID NO: 6010405 - DNA, 21 bp, Homo sapiens
caggtgggaggaaagggcctg

SEQ ID NO: 6010406 - DNA, 10 bp, Homo sapiens
caggtgggca

SEQ ID NO: 6010407 - DNA, 14 bp, Homo sapiens
caggtgggcctggc

SEQ ID NO: 6010408 - DNA, 22 bp, Homo sapiens
caggtgggcctggcggcctgtg

SEQ ID NO: 6010409 - DNA, 22 bp, Homo sapiens
caggtgggcgggcagcacagca

SEQ ID NO: 6010410 - DNA, 14 bp, Homo sapiens
caggtgggcggtgt

SEQ ID NO: 6010411 - DNA, 19 bp, Homo sapiens
caggtgggcggtgtgtctt

SEQ ID NO: 6010412 - DNA, 12 bp, Homo sapiens
caggtgggctgg

SEQ ID NO: 6010413 - DNA, 22 bp, Homo sapiens
caggtgggctggacttctacct

SEQ ID NO: 6010414 - DNA, 16 bp, Homo sapiens
caggtgggctgggccc

SEQ ID NO: 6010415 - DNA, 18 bp, Homo sapiens
cagagaagtggagtgact

SEQ ID NO: 6010416 - DNA, 17 bp, Homo sapiens
cagagaagtttgtagcc

SEQ ID NO: 6010417 - DNA, 18 bp, Homo sapiens
cagagaagtttgtagcca

SEQ ID NO: 6010418 - DNA, 20 bp, Homo sapiens
cagagaagtttgtagccagg

SEQ ID NO: 6010419 - DNA, 21 bp, Homo sapiens
cagagaagtttgtagccaggt

SEQ ID NO: 6010420 - DNA, 11 bp, Homo sapiens
cagagaatata

SEQ ID NO: 6010421 - DNA, 22 bp, Homo sapiens
cagagaatataacatgaaatga

SEQ ID NO: 6010422 - DNA, 20 bp, Homo sapiens
cagagaatatgtctgctcct

SEQ ID NO: 6010423 - DNA, 15 bp, Homo sapiens
cagagaatcaaagat

SEQ ID NO: 6010424 - DNA, 14 bp, Homo sapiens
cagagaatctcttg

SEQ ID NO: 6010425 - DNA, 21 bp, Homo sapiens
cagagaatgaaagggcccaga

SEQ ID NO: 6010426 - DNA, 16 bp, Homo sapiens
cagagaatgcacctct

SEQ ID NO: 6010427 - DNA, 21 bp, Homo sapiens
cagagaatggctgggtcaggg

SEQ ID NO: 6010428 - DNA, 14 bp, Homo sapiens
cagagaattactat

SEQ ID NO: 6010429 - DNA, 22 bp, Homo sapiens
cagagacaagaaaggcagacac

SEQ ID NO: 6010430 - DNA, 16 bp, Homo sapiens
cagagacaaggagggc

SEQ ID NO: 6010431 - DNA, 18 bp, Homo sapiens
cagagacaataaaacatt

SEQ ID NO: 6010432 - DNA, 15 bp, Homo sapiens
cagagacacaagcct

SEQ ID NO: 6010433 - DNA, 16 bp, Homo sapiens
cagagacaccaaactg

SEQ ID NO: 6010434 - DNA, 20 bp, Homo sapiens
cagagacacctgcacctccc

SEQ ID NO: 6010435 - DNA, 14 bp, Homo sapiens
cagagacactgagc

SEQ ID NO: 6010436 - DNA, 15 bp, Homo sapiens
cagagacactttgtc

SEQ ID NO: 6010437 - DNA, 23 bp, Homo sapiens
cagagacagaccccttggctttt

SEQ ID NO: 6010438 - DNA, 16 bp, Homo sapiens
cagagacagagaggac

SEQ ID NO: 6010439 - DNA, 12 bp, Homo sapiens
cagagacagata

SEQ ID NO: 6010440 - DNA, 21 bp, Homo sapiens
cagagacagctgatacttcat

SEQ ID NO: 6010441 - DNA, 14 bp, Homo sapiens
cagagacaggaaaa

SEQ ID NO: 6010442 - DNA, 15 bp, Homo sapiens
cagagacaggaaaat

SEQ ID NO: 6010443 - DNA, 21 bp, Homo sapiens
cagagacaggaaaatcctctg

SEQ ID NO: 6010444 - DNA, 23 bp, Homo sapiens
cagagacaggaaaatcctctggc

SEQ ID NO: 6010445 - DNA, 16 bp, Homo sapiens
cagagacaggaaagaa

SEQ ID NO: 6010446 - DNA, 22 bp, Homo sapiens
cagagacagggaaaggtcagcc

SEQ ID NO: 6010447 - DNA, 18 bp, Homo sapiens
cagagacaggtggcctag

SEQ ID NO: 6010448 - DNA, 19 bp, Homo sapiens
cagagacatacttgaaggg

SEQ ID NO: 6010449 - DNA, 20 bp, Homo sapiens
cagagacatacttgaagggc

SEQ ID NO: 6010450 - DNA, 23 bp, Homo sapiens
cagagacatacttgaagggccag

SEQ ID NO: 6010451 - DNA, 14 bp, Homo sapiens
cagagacatgcaga

SEQ ID NO: 6010452 - DNA, 18 bp, Homo sapiens
cagagacatgggcctccc

SEQ ID NO: 6010453 - DNA, 17 bp, Homo sapiens
cagagaccaaacaagga

SEQ ID NO: 6010454 - DNA, 12 bp, Homo sapiens
cagagaccaaat

SEQ ID NO: 6010455 - DNA, 13 bp, Homo sapiens
cagagaccaaata

SEQ ID NO: 6010456 - DNA, 20 bp, Homo sapiens
cagagaccaccgcgcccctc

SEQ ID NO: 6010457 - DNA, 14 bp, Homo sapiens
cagagaccagcact

SEQ ID NO: 6010458 - DNA, 15 bp, Homo sapiens
cagagaccaggccct

SEQ ID NO: 6010459 - DNA, 18 bp, Homo sapiens
cagagaccaggctgtgtc

SEQ ID NO: 6010460 - DNA, 12 bp, Homo sapiens
cagagaccaggg

SEQ ID NO: 6010461 - DNA, 15 bp, Homo sapiens
cagagaccagggctc

SEQ ID NO: 6010462 - DNA, 19 bp, Homo sapiens
cagagaccataagagaaac

SEQ ID NO: 6010463 - DNA, 14 bp, Homo sapiens
cagagaccatccct

SEQ ID NO: 6010464 - DNA, 20 bp, Homo sapiens
cagagaccatccctgaaggc

SEQ ID NO: 6010465 - DNA, 15 bp, Homo sapiens
cagagacccagcgga

SEQ ID NO: 6010466 - DNA, 15 bp, Homo sapiens
cagagaccccaggat

SEQ ID NO: 6010467 - DNA, 17 bp, Homo sapiens
cagagaccccaggatcc

SEQ ID NO: 6010468 - DNA, 19 bp, Homo sapiens
cagagaccctctgccacca

SEQ ID NO: 6010469 - DNA, 17 bp, Homo sapiens
cagagaccgtgagcgcc

SEQ ID NO: 6010470 - DNA, 12 bp, Homo sapiens
cagagacctcca

SEQ ID NO: 6010471 - DNA, 17 bp, Homo sapiens
cagagacctgaggcaga

SEQ ID NO: 6010472 - DNA, 15 bp, Homo sapiens
cagagacctgctcca

SEQ ID NO: 6010473 - DNA, 17 bp, Homo sapiens
cagagacctgctccaga

SEQ ID NO: 6010474 - DNA, 19 bp, Homo sapiens
cagagacctgctccagatc

SEQ ID NO: 6010475 - DNA, 21 bp, Homo sapiens
cagagacctgctccagatcct

SEQ ID NO: 6010476 - DNA, 21 bp, Homo sapiens
cagagacctttgcccacacac

SEQ ID NO: 6010477 - DNA, 20 bp, Homo sapiens
cagagaccttttctctccca

SEQ ID NO: 6010478 - DNA, 17 bp, Homo sapiens
cagagacgcaagggaga

SEQ ID NO: 6010479 - DNA, 13 bp, Homo sapiens
cagagacgcagga

SEQ ID NO: 6010480 - DNA, 18 bp, Homo sapiens
cagagacgcaggaatgga

SEQ ID NO: 6010481 - DNA, 23 bp, Homo sapiens
cagagacggcagaaaacagagcc

SEQ ID NO: 6010482 - DNA, 17 bp, Homo sapiens
cagagacggcagcccca

SEQ ID NO: 6010483 - DNA, 22 bp, Homo sapiens
cagagacggcagccccatcctt

SEQ ID NO: 6010484 - DNA, 10 bp, Homo sapiens
cagagactca

SEQ ID NO: 6010485 - DNA, 23 bp, Homo sapiens
cagagactcagcgctcctcctgt

SEQ ID NO: 6010486 - DNA, 22 bp, Homo sapiens
cagagactcagggccccagcac

SEQ ID NO: 6010487 - DNA, 18 bp, Homo sapiens
cagagactcccaggagtt

SEQ ID NO: 6010488 - DNA, 13 bp, Homo sapiens
cagagactcctgc

SEQ ID NO: 6010489 - DNA, 18 bp, Homo sapiens
cagagactcctgcaggca

SEQ ID NO: 6010490 - DNA, 20 bp, Homo sapiens
cagagactcctgcaggcagc

SEQ ID NO: 6010491 - DNA, 13 bp, Homo sapiens
cagagactctgga

SEQ ID NO: 6010492 - DNA, 22 bp, Homo sapiens
cagagactctggaagcccccca

SEQ ID NO: 6010493 - DNA, 14 bp, Homo sapiens
cagagactgcaagc

SEQ ID NO: 6010494 - DNA, 21 bp, Homo sapiens
cagagactgcaagctgcttgc

SEQ ID NO: 6010495 - DNA, 13 bp, Homo sapiens
cagagactgccca

SEQ ID NO: 6010496 - DNA, 16 bp, Homo sapiens
cagagactgcccaccc

SEQ ID NO: 6010497 - DNA, 17 bp, Homo sapiens
cagagactgcccaccct

SEQ ID NO: 6010498 - DNA, 22 bp, Homo sapiens
cagagactgcccaccctgggcc

SEQ ID NO: 6010499 - DNA, 23 bp, Homo sapiens
cagagactgcccaccctgggcct

SEQ ID NO: 6010500 - DNA, 24 bp, Homo sapiens
cagagactgcccaccctgggcctc

SEQ ID NO: 6010501 - DNA, 18 bp, Homo sapiens
cagagactgcccttctca

SEQ ID NO: 6010502 - DNA, 16 bp, Homo sapiens
cagagactggcagcca

SEQ ID NO: 6010503 - DNA, 19 bp, Homo sapiens
cagagactggcagccaggg

SEQ ID NO: 6010504 - DNA, 21 bp, Homo sapiens
cagagactggcagccagggag

SEQ ID NO: 6010505 - DNA, 20 bp, Homo sapiens
cagagactggggcctggact

SEQ ID NO: 6010506 - DNA, 19 bp, Homo sapiens
cagagactgtttgaatgtt

SEQ ID NO: 6010507 - DNA, 16 bp, Homo sapiens
cagagacttagaagca

SEQ ID NO: 6010508 - DNA, 21 bp, Homo sapiens
cagagacttctaggaggatgc

SEQ ID NO: 6010509 - DNA, 20 bp, Homo sapiens
cagagacttgggacattgcc

SEQ ID NO: 6010510 - DNA, 18 bp, Homo sapiens
cagagacttggggaccag

SEQ ID NO: 6010511 - DNA, 19 bp, Homo sapiens
cagagacttggggaccaga

SEQ ID NO: 6010512 - DNA, 17 bp, Homo sapiens
cagagactttagggggt

SEQ ID NO: 6010513 - DNA, 12 bp, Homo sapiens
cagagagaaaaa

SEQ ID NO: 6010514 - DNA, 16 bp, Homo sapiens
cagagagaaaaagaga

SEQ ID NO: 6010515 - DNA, 20 bp, Homo sapiens
cagagagaaaaagagagagc

SEQ ID NO: 6010516 - DNA, 15 bp, Homo sapiens
cagagagaaaaagat

SEQ ID NO: 6010517 - DNA, 20 bp, Homo sapiens
cagagagaaataagtgccct

SEQ ID NO: 6010518 - DNA, 20 bp, Homo sapiens
cagagagaaatcaggcctga

SEQ ID NO: 6010519 - DNA, 11 bp, Homo sapiens
cagagagaacc

SEQ ID NO: 6010520 - DNA, 17 bp, Homo sapiens
cagagagaaccaggagg

SEQ ID NO: 6010521 - DNA, 15 bp, Homo sapiens
cagagagaagagccc

SEQ ID NO: 6010522 - DNA, 17 bp, Homo sapiens
cagagagaagagcccca

SEQ ID NO: 6010523 - DNA, 18 bp, Homo sapiens
cagagagaagagccccac

SEQ ID NO: 6010524 - DNA, 23 bp, Homo sapiens
cagagagaagagccccactctca

SEQ ID NO: 6010525 - DNA, 12 bp, Homo sapiens
cagagagaagcc

SEQ ID NO: 6010526 - DNA, 16 bp, Homo sapiens
cagagagaatgagagc

SEQ ID NO: 6010527 - DNA, 16 bp, Homo sapiens
cagagagaatggcttt

SEQ ID NO: 6010528 - DNA, 14 bp, Homo sapiens
cagagagacagacc

SEQ ID NO: 6010529 - DNA, 20 bp, Homo sapiens
cagagagacccgggaaggaa

SEQ ID NO: 6010530 - DNA, 14 bp, Homo sapiens
cagagagaccctgc

SEQ ID NO: 6010531 - DNA, 15 bp, Homo sapiens
cagagagaccctgca

SEQ ID NO: 6010532 - DNA, 17 bp, Homo sapiens
cagagagaccctgcaag

SEQ ID NO: 6010533 - DNA, 16 bp, Homo sapiens
cagagagaccctgcca

SEQ ID NO: 6010534 - DNA, 12 bp, Homo sapiens
cagagagaccga

SEQ ID NO: 6010535 - DNA, 19 bp, Homo sapiens
cagagagacctcatcctgc

SEQ ID NO: 6010536 - DNA, 20 bp, Homo sapiens
cagagagagaagtgcccctg

SEQ ID NO: 6010537 - DNA, 22 bp, Homo sapiens
cagagagagaagtgcccctgct

SEQ ID NO: 6010538 - DNA, 23 bp, Homo sapiens
cagagagagaagtgcccctgctg

SEQ ID NO: 6010539 - DNA, 16 bp, Homo sapiens
cagagagagacagaga

SEQ ID NO: 6010540 - DNA, 13 bp, Homo sapiens
cagagagagagaa

SEQ ID NO: 6010541 - DNA, 14 bp, Homo sapiens
cagagagagagaga

SEQ ID NO: 6010542 - DNA, 19 bp, Homo sapiens
cagagagagagagagagaa

SEQ ID NO: 6010543 - DNA, 10 bp, Homo sapiens
cagagagagc

SEQ ID NO: 6010544 - DNA, 21 bp, Homo sapiens
cagagagaggcgtcctggtga

SEQ ID NO: 6010545 - DNA, 21 bp, Homo sapiens
cagagagaggggcctgcaggt

SEQ ID NO: 6010546 - DNA, 19 bp, Homo sapiens
cagagagcaaacataggaa

SEQ ID NO: 6010547 - DNA, 21 bp, Homo sapiens
cagagagcaaaggagaaatct

SEQ ID NO: 6010548 - DNA, 16 bp, Homo sapiens
cagagagcacagtgat

SEQ ID NO: 6010549 - DNA, 12 bp, Homo sapiens
cagagagcaggc

SEQ ID NO: 6010550 - DNA, 16 bp, Homo sapiens
cagagagcaggggagc

SEQ ID NO: 6010551 - DNA, 23 bp, Homo sapiens
cagagagcaggggagcttgggac

SEQ ID NO: 6010552 - DNA, 14 bp, Homo sapiens
cagagagcagtgct

SEQ ID NO: 6010553 - DNA, 17 bp, Homo sapiens
cagagagccaaatctga

SEQ ID NO: 6010554 - DNA, 19 bp, Homo sapiens
cagagagccattttgtgaa

SEQ ID NO: 6010555 - DNA, 20 bp, Homo sapiens
cagagagccattttgtgaat

SEQ ID NO: 6010556 - DNA, 20 bp, Homo sapiens
cagagagcctagaacatccc

SEQ ID NO: 6010557 - DNA, 19 bp, Homo sapiens
cagagagcgaccagcaggc

SEQ ID NO: 6010558 - DNA, 21 bp, Homo sapiens
cagagagcggtctcaggctgg

SEQ ID NO: 6010559 - DNA, 13 bp, Homo sapiens
cagagagctggta

SEQ ID NO: 6010560 - DNA, 20 bp, Homo sapiens
cagagagcttaaattgtcat

SEQ ID NO: 6010561 - DNA, 21 bp, Homo sapiens
cagagaggaaattctccactg

SEQ ID NO: 6010562 - DNA, 18 bp, Homo sapiens
cagagaggacaaaataaa

SEQ ID NO: 6010563 - DNA, 21 bp, Homo sapiens
cagagaggacaaaataaagtg

SEQ ID NO: 6010564 - DNA, 16 bp, Homo sapiens
cagagaggacgtgggc

SEQ ID NO: 6010565 - DNA, 21 bp, Homo sapiens
cagagaggacgtgggcggcag

SEQ ID NO: 6010566 - DNA, 20 bp, Homo sapiens
cagagaggactgtagggagg

SEQ ID NO: 6010567 - DNA, 16 bp, Homo sapiens
cagagaggagcacctg

SEQ ID NO: 6010568 - DNA, 21 bp, Homo sapiens
cagagaggagcacctgaaccc

SEQ ID NO: 6010569 - DNA, 11 bp, Homo sapiens
cagagaggagt

SEQ ID NO: 6010570 - DNA, 18 bp, Homo sapiens
cagagaggatacatttaa

SEQ ID NO: 6010571 - DNA, 19 bp, Homo sapiens
cagagaggatacatttaat

SEQ ID NO: 6010572 - DNA, 20 bp, Homo sapiens
cagagaggcactcagtgagc

SEQ ID NO: 6010573 - DNA, 16 bp, Homo sapiens
cagagaggccaggtgc

SEQ ID NO: 6010574 - DNA, 24 bp, Homo sapiens
cagagaggctggatgacttgctca

SEQ ID NO: 6010575 - DNA, 12 bp, Homo sapiens
cagagagggaaa

SEQ ID NO: 6010576 - DNA, 13 bp, Homo sapiens
cagagagggaaga

SEQ ID NO: 6010577 - DNA, 23 bp, Homo sapiens
cagagagggaagctgaggcccat

SEQ ID NO: 6010578 - DNA, 24 bp, Homo sapiens
cagagagggaagctgaggcccatg

SEQ ID NO: 6010579 - DNA, 21 bp, Homo sapiens
cagagagggacacatgcccct

SEQ ID NO: 6010580 - DNA, 22 bp, Homo sapiens
cagagagggacacatgcccctc

SEQ ID NO: 6010581 - DNA, 23 bp, Homo sapiens
cagagagggacacatgcccctcc

SEQ ID NO: 6010582 - DNA, 20 bp, Homo sapiens
cagagagggagaaaggagga

SEQ ID NO: 6010583 - DNA, 21 bp, Homo sapiens
cagagagggagagcagagaaa

SEQ ID NO: 6010584 - DNA, 12 bp, Homo sapiens
cagagagggcag

SEQ ID NO: 6010585 - DNA, 13 bp, Homo sapiens
cagagagggcagg

SEQ ID NO: 6010586 - DNA, 15 bp, Homo sapiens
cagagagggcaggca

SEQ ID NO: 6010587 - DNA, 18 bp, Homo sapiens
cagagagggcaggcatga

SEQ ID NO: 6010588 - DNA, 15 bp, Homo sapiens
cagagagggcccagc

SEQ ID NO: 6010589 - DNA, 16 bp, Homo sapiens
cagagagggcccagct

SEQ ID NO: 6010590 - DNA, 18 bp, Homo sapiens
cagagagggcccagctgt

SEQ ID NO: 6010591 - DNA, 22 bp, Homo sapiens
cagagagggcccagctgtagcc

SEQ ID NO: 6010592 - DNA, 21 bp, Homo sapiens
caggtgggctgggcccaccca

SEQ ID NO: 6010593 - DNA, 15 bp, Homo sapiens
caggtggggactggg

SEQ ID NO: 6010594 - DNA, 23 bp, Homo sapiens
caggtggggagtcagggacccct

SEQ ID NO: 6010595 - DNA, 15 bp, Homo sapiens
caggtggggcagctt

SEQ ID NO: 6010596 - DNA, 17 bp, Homo sapiens
caggtggggcagcttga

SEQ ID NO: 6010597 - DNA, 17 bp, Homo sapiens
caggtggggcctcagcc

SEQ ID NO: 6010598 - DNA, 18 bp, Homo sapiens
caggtggggcctcagcct

SEQ ID NO: 6010599 - DNA, 21 bp, Homo sapiens
caggtggggcctcagcctggg

SEQ ID NO: 6010600 - DNA, 22 bp, Homo sapiens
caggtggggcctcagcctgggg

SEQ ID NO: 6010601 - DNA, 21 bp, Homo sapiens
caggtgggggttgctgtataa

SEQ ID NO: 6010602 - DNA, 21 bp, Homo sapiens
caggtggggtcactctggcag

SEQ ID NO: 6010603 - DNA, 17 bp, Homo sapiens
caggtggggtgaggcag

SEQ ID NO: 6010604 - DNA, 22 bp, Homo sapiens
caggtggggtgaggcagtgggt

SEQ ID NO: 6010605 - DNA, 21 bp, Homo sapiens
caggtggggttttcacttcct

SEQ ID NO: 6010606 - DNA, 13 bp, Homo sapiens
caggtgggtcccg

SEQ ID NO: 6010607 - DNA, 19 bp, Homo sapiens
caggtgggtgctgccctgt

SEQ ID NO: 6010608 - DNA, 15 bp, Homo sapiens
caggtggtgaatttt

SEQ ID NO: 6010609 - DNA, 14 bp, Homo sapiens
caggtggtggaggg

SEQ ID NO: 6010610 - DNA, 15 bp, Homo sapiens
caggtggtggagggg

SEQ ID NO: 6010611 - DNA, 22 bp, Homo sapiens
caggtggtggcactgagccccc

SEQ ID NO: 6010612 - DNA, 16 bp, Homo sapiens
caggtggtgtcactgt

SEQ ID NO: 6010613 - DNA, 17 bp, Homo sapiens
caggtggtgtccttctt

SEQ ID NO: 6010614 - DNA, 21 bp, Homo sapiens
caggtggtgtccttcttcctc

SEQ ID NO: 6010615 - DNA, 21 bp, Homo sapiens
caggtggttaccaggcactgg

SEQ ID NO: 6010616 - DNA, 13 bp, Homo sapiens
caggtggttttta

SEQ ID NO: 6010617 - DNA, 22 bp, Homo sapiens
caggtgtaagccatcacacctg

SEQ ID NO: 6010618 - DNA, 21 bp, Homo sapiens
caggtgtactatggctgtatt

SEQ ID NO: 6010619 - DNA, 19 bp, Homo sapiens
caggtgtagctgagctgtg

SEQ ID NO: 6010620 - DNA, 19 bp, Homo sapiens
caggtgtataaatgtacat

SEQ ID NO: 6010621 - DNA, 15 bp, Homo sapiens
caggtgtcaggcccg

SEQ ID NO: 6010622 - DNA, 21 bp, Homo sapiens
caggtgtcatatatggggggc

SEQ ID NO: 6010623 - DNA, 16 bp, Homo sapiens
caggtgtcatggactg

SEQ ID NO: 6010624 - DNA, 21 bp, Homo sapiens
caggtgtccccagcccactgg

SEQ ID NO: 6010625 - DNA, 11 bp, Homo sapiens
caggtgtccct

SEQ ID NO: 6010626 - DNA, 19 bp, Homo sapiens
caggtgtccctgcacttgc

SEQ ID NO: 6010627 - DNA, 15 bp, Homo sapiens
caggtgtcctgactg

SEQ ID NO: 6010628 - DNA, 19 bp, Homo sapiens
caggtgtcctttcccctct

SEQ ID NO: 6010629 - DNA, 13 bp, Homo sapiens
caggtgtctgaca

SEQ ID NO: 6010630 - DNA, 16 bp, Homo sapiens
caggtgtctgcctaga

SEQ ID NO: 6010631 - DNA, 23 bp, Homo sapiens
caggtgtgaaccaccacacccag

SEQ ID NO: 6010632 - DNA, 23 bp, Homo sapiens
caggtgtgaccctgagggctcct

SEQ ID NO: 6010633 - DNA, 20 bp, Homo sapiens
caggtgtgagccacagcact

SEQ ID NO: 6010634 - DNA, 18 bp, Homo sapiens
caggtgtgagccaccacg

SEQ ID NO: 6010635 - DNA, 17 bp, Homo sapiens
caggtgtgagccactgc

SEQ ID NO: 6010636 - DNA, 18 bp, Homo sapiens
caggtgtgagccactgca

SEQ ID NO: 6010637 - DNA, 20 bp, Homo sapiens
caggtgtgagtcaccaagcc

SEQ ID NO: 6010638 - DNA, 21 bp, Homo sapiens
caggtgtgagtcaccaagccc

SEQ ID NO: 6010639 - DNA, 22 bp, Homo sapiens
caggtgtgagtcaccaagccca

SEQ ID NO: 6010640 - DNA, 13 bp, Homo sapiens
caggtgtgcacag

SEQ ID NO: 6010641 - DNA, 16 bp, Homo sapiens
caggtgtgcacagaaa

SEQ ID NO: 6010642 - DNA, 17 bp, Homo sapiens
caggtgtgcacagaaaa

SEQ ID NO: 6010643 - DNA, 20 bp, Homo sapiens
caggtgtgcccctccaagtc

SEQ ID NO: 6010644 - DNA, 16 bp, Homo sapiens
caggtgtgcctgtgct

SEQ ID NO: 6010645 - DNA, 18 bp, Homo sapiens
caggtgtgcctgtgctcc

SEQ ID NO: 6010646 - DNA, 19 bp, Homo sapiens
caggtgtgggatctgggga

SEQ ID NO: 6010647 - DNA, 20 bp, Homo sapiens
caggtgtgggatctggggag

SEQ ID NO: 6010648 - DNA, 16 bp, Homo sapiens
caggtgtgggctccca

SEQ ID NO: 6010649 - DNA, 20 bp, Homo sapiens
caggtgtgggctcccacgcc

SEQ ID NO: 6010650 - DNA, 22 bp, Homo sapiens
caggtgtgggctcccacgccct

SEQ ID NO: 6010651 - DNA, 20 bp, Homo sapiens
caggtgtggggacacagcag

SEQ ID NO: 6010652 - DNA, 13 bp, Homo sapiens
caggtgtggtggc

SEQ ID NO: 6010653 - DNA, 16 bp, Homo sapiens
caggtgtggtggctca

SEQ ID NO: 6010654 - DNA, 22 bp, Homo sapiens
caggtgtgtgtgaactgggcac

SEQ ID NO: 6010655 - DNA, 14 bp, Homo sapiens
caggtgttcctcct

SEQ ID NO: 6010656 - DNA, 12 bp, Homo sapiens
caggtgttcttc

SEQ ID NO: 6010657 - DNA, 14 bp, Homo sapiens
caggtgttgccatt

SEQ ID NO: 6010658 - DNA, 20 bp, Homo sapiens
caggtgttgccatttctctg

SEQ ID NO: 6010659 - DNA, 23 bp, Homo sapiens
caggtgttgccatttctctgctt

SEQ ID NO: 6010660 - DNA, 18 bp, Homo sapiens
caggtgttggaagccagg

SEQ ID NO: 6010661 - DNA, 15 bp, Homo sapiens
caggtgtttggcacc

SEQ ID NO: 6010662 - DNA, 19 bp, Homo sapiens
caggtgtttgtggggctgg

SEQ ID NO: 6010663 - DNA, 17 bp, Homo sapiens
caggtgttttcaagcac

SEQ ID NO: 6010664 - DNA, 14 bp, Homo sapiens
caggtgtttttcca

SEQ ID NO: 6010665 - DNA, 14 bp, Homo sapiens
caggttaaatatat

SEQ ID NO: 6010666 - DNA, 19 bp, Homo sapiens
caggttaaatatataaaca

SEQ ID NO: 6010667 - DNA, 14 bp, Homo sapiens
caggttaaatgttt

SEQ ID NO: 6010668 - DNA, 15 bp, Homo sapiens
caggttaaatgtttt

SEQ ID NO: 6010669 - DNA, 20 bp, Homo sapiens
caggttaaatgttttgtaaa

SEQ ID NO: 6010670 - DNA, 13 bp, Homo sapiens
caggttaacctgc

SEQ ID NO: 6010671 - DNA, 19 bp, Homo sapiens
caggttacaacagatttgt

SEQ ID NO: 6010672 - DNA, 22 bp, Homo sapiens
caggttacaacagatttgtgaa

SEQ ID NO: 6010673 - DNA, 23 bp, Homo sapiens
caggttaccttggcgtgtgtccc

SEQ ID NO: 6010674 - DNA, 18 bp, Homo sapiens
caggttactaccctcacc

SEQ ID NO: 6010675 - DNA, 23 bp, Homo sapiens
caggttagaacctagaagggcta

SEQ ID NO: 6010676 - DNA, 13 bp, Homo sapiens
caggttagaagaa

SEQ ID NO: 6010677 - DNA, 14 bp, Homo sapiens
caggttagaagaac

SEQ ID NO: 6010678 - DNA, 21 bp, Homo sapiens
caggttagagacagtatgtat

SEQ ID NO: 6010679 - DNA, 20 bp, Homo sapiens
caggttagcctttgccctgt

SEQ ID NO: 6010680 - DNA, 22 bp, Homo sapiens
caggttaggcagtataaagaat

SEQ ID NO: 6010681 - DNA, 23 bp, Homo sapiens
caggttaggcagtataaagaata

SEQ ID NO: 6010682 - DNA, 22 bp, Homo sapiens
caggttagggtgtgtgccacac

SEQ ID NO: 6010683 - DNA, 16 bp, Homo sapiens
caggttataacagtgt

SEQ ID NO: 6010684 - DNA, 16 bp, Homo sapiens
caggttatctgggcat

SEQ ID NO: 6010685 - DNA, 16 bp, Homo sapiens
caggttatgcctcatg

SEQ ID NO: 6010686 - DNA, 16 bp, Homo sapiens
caggttattttagttt

SEQ ID NO: 6010687 - DNA, 19 bp, Homo sapiens
caggttcaacccacagcta

SEQ ID NO: 6010688 - DNA, 20 bp, Homo sapiens
caggttcaaggctacaacaa

SEQ ID NO: 6010689 - DNA, 16 bp, Homo sapiens
caggttcacactcaga

SEQ ID NO: 6010690 - DNA, 17 bp, Homo sapiens
caggttcacactcagaa

SEQ ID NO: 6010691 - DNA, 22 bp, Homo sapiens
caggttcacttaaaagctggct

SEQ ID NO: 6010692 - DNA, 22 bp, Homo sapiens
caggttcagtgcggcccctcgg

SEQ ID NO: 6010693 - DNA, 12 bp, Homo sapiens
caggttccagaa

SEQ ID NO: 6010694 - DNA, 13 bp, Homo sapiens
caggttccagaac

SEQ ID NO: 6010695 - DNA, 23 bp, Homo sapiens
caggttccagaacagccctcggc

SEQ ID NO: 6010696 - DNA, 14 bp, Homo sapiens
caggttccatcccg

SEQ ID NO: 6010697 - DNA, 15 bp, Homo sapiens
caggttcccagcagc

SEQ ID NO: 6010698 - DNA, 16 bp, Homo sapiens
caggttccctcccaga

SEQ ID NO: 6010699 - DNA, 18 bp, Homo sapiens
caggttccctgccacact

SEQ ID NO: 6010700 - DNA, 12 bp, Homo sapiens
caggttcctaag

SEQ ID NO: 6010701 - DNA, 12 bp, Homo sapiens
caggttcctcct

SEQ ID NO: 6010702 - DNA, 16 bp, Homo sapiens
caggttcctcctaggc

SEQ ID NO: 6010703 - DNA, 21 bp, Homo sapiens
caggttcctcctaggcgctca

SEQ ID NO: 6010704 - DNA, 14 bp, Homo sapiens
caggttcctggggc

SEQ ID NO: 6010705 - DNA, 17 bp, Homo sapiens
caggttcctggggccgc

SEQ ID NO: 6010706 - DNA, 20 bp, Homo sapiens
caggttcctgtactactgcc

SEQ ID NO: 6010707 - DNA, 13 bp, Homo sapiens
caggttcctgtgg

SEQ ID NO: 6010708 - DNA, 20 bp, Homo sapiens
caggttccttttaagtggac

SEQ ID NO: 6010709 - DNA, 15 bp, Homo sapiens
caggttctatttgga

SEQ ID NO: 6010710 - DNA, 15 bp, Homo sapiens
caggttctattttct

SEQ ID NO: 6010711 - DNA, 20 bp, Homo sapiens
caggttctccgttagctcct

SEQ ID NO: 6010712 - DNA, 22 bp, Homo sapiens
caggttctccgttagctcctgt

SEQ ID NO: 6010713 - DNA, 23 bp, Homo sapiens
caggttctccgttagctcctgtg

SEQ ID NO: 6010714 - DNA, 14 bp, Homo sapiens
caggttctgaaaga

SEQ ID NO: 6010715 - DNA, 21 bp, Homo sapiens
caggttctggttagctcagcc

SEQ ID NO: 6010716 - DNA, 16 bp, Homo sapiens
caggttcttgcctttc

SEQ ID NO: 6010717 - DNA, 15 bp, Homo sapiens
caggttgaccgggac

SEQ ID NO: 6010718 - DNA, 15 bp, Homo sapiens
caggttgaggctaaa

SEQ ID NO: 6010719 - DNA, 20 bp, Homo sapiens
caggttgaggggctcctgga

SEQ ID NO: 6010720 - DNA, 22 bp, Homo sapiens
caggttgaggtgcgctcacctc

SEQ ID NO: 6010721 - DNA, 22 bp, Homo sapiens
caggttgcctcaacagcaggag

SEQ ID NO: 6010722 - DNA, 17 bp, Homo sapiens
caggttgctggttgctg

SEQ ID NO: 6010723 - DNA, 15 bp, Homo sapiens
caggttgctttgccc

SEQ ID NO: 6010724 - DNA, 17 bp, Homo sapiens
caggttgctttgccctg

SEQ ID NO: 6010725 - DNA, 14 bp, Homo sapiens
caggttggaaaaga

SEQ ID NO: 6010726 - DNA, 16 bp, Homo sapiens
caggttggaaaagaaa

SEQ ID NO: 6010727 - DNA, 23 bp, Homo sapiens
caggttggaaggggccttgctga

SEQ ID NO: 6010728 - DNA, 13 bp, Homo sapiens
caggttggacccc

SEQ ID NO: 6010729 - DNA, 14 bp, Homo sapiens
caggttggacccca

SEQ ID NO: 6010730 - DNA, 17 bp, Homo sapiens
caggttggaccccagag

SEQ ID NO: 6010731 - DNA, 22 bp, Homo sapiens
caggttggatgggagtgggcac

SEQ ID NO: 6010732 - DNA, 17 bp, Homo sapiens
caggttggctctgccag

SEQ ID NO: 6010733 - DNA, 18 bp, Homo sapiens
caggttggcttttttccc

SEQ ID NO: 6010734 - DNA, 21 bp, Homo sapiens
caggttgggaacatgctggaa

SEQ ID NO: 6010735 - DNA, 21 bp, Homo sapiens
caggttggggagacttggggc

SEQ ID NO: 6010736 - DNA, 20 bp, Homo sapiens
caggttgtctgtagagaatg

SEQ ID NO: 6010737 - DNA, 12 bp, Homo sapiens
caggtttaacat

SEQ ID NO: 6010738 - DNA, 17 bp, Homo sapiens
caggtttaacatttgcc

SEQ ID NO: 6010739 - DNA, 22 bp, Homo sapiens
caggtttaaggctgaggctgcc

SEQ ID NO: 6010740 - DNA, 17 bp, Homo sapiens
caggtttagttgactaa

SEQ ID NO: 6010741 - DNA, 19 bp, Homo sapiens
caggtttcactattcctat

SEQ ID NO: 6010742 - DNA, 22 bp, Homo sapiens
caggtttgatgcctgtgaagaa

SEQ ID NO: 6010743 - DNA, 19 bp, Homo sapiens
caggtttgcacctaagtgt

SEQ ID NO: 6010744 - DNA, 14 bp, Homo sapiens
caggtttgctgtgt

SEQ ID NO: 6010745 - DNA, 18 bp, Homo sapiens
caggtttgggacccctgg

SEQ ID NO: 6010746 - DNA, 21 bp, Homo sapiens
caggtttggggagggggaaga

SEQ ID NO: 6010747 - DNA, 20 bp, Homo sapiens
caggtttggtttttttgtac

SEQ ID NO: 6010748 - DNA, 18 bp, Homo sapiens
caggtttgtcctggtcat

SEQ ID NO: 6010749 - DNA, 14 bp, Homo sapiens
caggtttgttacat

SEQ ID NO: 6010750 - DNA, 16 bp, Homo sapiens
caggtttgtttcttga

SEQ ID NO: 6010751 - DNA, 17 bp, Homo sapiens
caggtttgtttcttgat

SEQ ID NO: 6010752 - DNA, 17 bp, Homo sapiens
caggttttaaaagcctt

SEQ ID NO: 6010753 - DNA, 21 bp, Homo sapiens
caggttttatgagacttccta

SEQ ID NO: 6010754 - DNA, 16 bp, Homo sapiens
caggttttcctgaaga

SEQ ID NO: 6010755 - DNA, 19 bp, Homo sapiens
caggttttctgggtgtcca

SEQ ID NO: 6010756 - DNA, 19 bp, Homo sapiens
caggttttcttttaagaat

SEQ ID NO: 6010757 - DNA, 23 bp, Homo sapiens
caggttttgttttttttcagcca

SEQ ID NO: 6010758 - DNA, 18 bp, Homo sapiens
caggtttttcaattaaac

SEQ ID NO: 6010759 - DNA, 11 bp, Homo sapiens
caggtttttcc

SEQ ID NO: 6010760 - DNA, 13 bp, Homo sapiens
caggtttttcctt

SEQ ID NO: 6010761 - DNA, 23 bp, Homo sapiens
caggtttttggtctgacccactg

SEQ ID NO: 6010762 - DNA, 19 bp, Homo sapiens
cagtaaaaaaaaaaaatgg

SEQ ID NO: 6010763 - DNA, 20 bp, Homo sapiens
cagtaaaaaatggtgtttta

SEQ ID NO: 6010764 - DNA, 22 bp, Homo sapiens
cagtaaaaacttgtactatgtt

SEQ ID NO: 6010765 - DNA, 15 bp, Homo sapiens
cagtaaaacacattt

SEQ ID NO: 6010766 - DNA, 17 bp, Homo sapiens
cagtaaaacaggctgct

SEQ ID NO: 6010767 - DNA, 18 bp, Homo sapiens
cagtaaaacaggctgctt

SEQ ID NO: 6010768 - DNA, 23 bp, Homo sapiens
cagagagggcccagctgtagcca

SEQ ID NO: 6010769 - DNA, 19 bp, Homo sapiens
cagagaggggacatttccc

SEQ ID NO: 6010770 - DNA, 20 bp, Homo sapiens
cagagaggggacatttccct

SEQ ID NO: 6010771 - DNA, 23 bp, Homo sapiens
cagagaggggacatttccctcct

SEQ ID NO: 6010772 - DNA, 19 bp, Homo sapiens
cagagaggggaggtgggag

SEQ ID NO: 6010773 - DNA, 15 bp, Homo sapiens
cagagagggggccac

SEQ ID NO: 6010774 - DNA, 17 bp, Homo sapiens
cagagagggtgacaaga

SEQ ID NO: 6010775 - DNA, 22 bp, Homo sapiens
cagagagggtgggagtgggccc

SEQ ID NO: 6010776 - DNA, 22 bp, Homo sapiens
cagagagggtggtgacctctgc

SEQ ID NO: 6010777 - DNA, 16 bp, Homo sapiens
cagagaggtagcactc

SEQ ID NO: 6010778 - DNA, 21 bp, Homo sapiens
cagagaggtagcactctcaga

SEQ ID NO: 6010779 - DNA, 18 bp, Homo sapiens
cagagaggtggagaactg

SEQ ID NO: 6010780 - DNA, 21 bp, Homo sapiens
cagagaggtggagaactggga

SEQ ID NO: 6010781 - DNA, 16 bp, Homo sapiens
cagagaggttaacaga

SEQ ID NO: 6010782 - DNA, 20 bp, Homo sapiens
cagagaggttaaggtgggta

SEQ ID NO: 6010783 - DNA, 15 bp, Homo sapiens
cagagaggttgtgaa

SEQ ID NO: 6010784 - DNA, 22 bp, Homo sapiens
cagagaggtttcgatatttatt

SEQ ID NO: 6010785 - DNA, 23 bp, Homo sapiens
cagagaggtttgcagtcccaagc

SEQ ID NO: 6010786 - DNA, 19 bp, Homo sapiens
cagagagtacactgtgtct

SEQ ID NO: 6010787 - DNA, 20 bp, Homo sapiens
cagagagtacactgtgtctc

SEQ ID NO: 6010788 - DNA, 21 bp, Homo sapiens
cagagagtacagactgcagac

SEQ ID NO: 6010789 - DNA, 16 bp, Homo sapiens
cagagagtccaattta

SEQ ID NO: 6010790 - DNA, 12 bp, Homo sapiens
cagagagtccca

SEQ ID NO: 6010791 - DNA, 20 bp, Homo sapiens
cagagagtcccactgcctca

SEQ ID NO: 6010792 - DNA, 15 bp, Homo sapiens
cagagagtcctgtgc

SEQ ID NO: 6010793 - DNA, 23 bp, Homo sapiens
cagagagtgagagacattaactc

SEQ ID NO: 6010794 - DNA, 16 bp, Homo sapiens
cagagataaagacctt

SEQ ID NO: 6010795 - DNA, 22 bp, Homo sapiens
cagagataaataaaagatagca

SEQ ID NO: 6010796 - DNA, 15 bp, Homo sapiens
cagagataaatgttt

SEQ ID NO: 6010797 - DNA, 20 bp, Homo sapiens
cagagatataataagcccaa

SEQ ID NO: 6010798 - DNA, 16 bp, Homo sapiens
cagagatatacaaata

SEQ ID NO: 6010799 - DNA, 16 bp, Homo sapiens
cagagatcagaattga

SEQ ID NO: 6010800 - DNA, 16 bp, Homo sapiens
cagagatcaggatcag

SEQ ID NO: 6010801 - DNA, 21 bp, Homo sapiens
cagagatcaggatcagctttg

SEQ ID NO: 6010802 - DNA, 15 bp, Homo sapiens
cagagatcataaaga

SEQ ID NO: 6010803 - DNA, 18 bp, Homo sapiens
cagagatcataaagagca

SEQ ID NO: 6010804 - DNA, 21 bp, Homo sapiens
cagagatcctacttctctgag

SEQ ID NO: 6010805 - DNA, 19 bp, Homo sapiens
cagagatcgacagacagcc

SEQ ID NO: 6010806 - DNA, 22 bp, Homo sapiens
cagagatcgacagacagccagg

SEQ ID NO: 6010807 - DNA, 15 bp, Homo sapiens
cagagatctgggagg

SEQ ID NO: 6010808 - DNA, 19 bp, Homo sapiens
cagagatgcatgcgcaggc

SEQ ID NO: 6010809 - DNA, 22 bp, Homo sapiens
cagagatgcatgcgcaggctca

SEQ ID NO: 6010810 - DNA, 18 bp, Homo sapiens
cagagatgccagcccttc

SEQ ID NO: 6010811 - DNA, 14 bp, Homo sapiens
cagagatgcctcca

SEQ ID NO: 6010812 - DNA, 23 bp, Homo sapiens
cagagatgcctgatttcattcct

SEQ ID NO: 6010813 - DNA, 19 bp, Homo sapiens
cagagatggacagagaact

SEQ ID NO: 6010814 - DNA, 20 bp, Homo sapiens
cagagatggagaaatagact

SEQ ID NO: 6010815 - DNA, 18 bp, Homo sapiens
cagagatggcagagccat

SEQ ID NO: 6010816 - DNA, 17 bp, Homo sapiens
cagagatggctccttgg

SEQ ID NO: 6010817 - DNA, 14 bp, Homo sapiens
cagagatgggaaaa

SEQ ID NO: 6010818 - DNA, 22 bp, Homo sapiens
cagagatggtaatctacagctc

SEQ ID NO: 6010819 - DNA, 14 bp, Homo sapiens
cagagatgtaccat

SEQ ID NO: 6010820 - DNA, 15 bp, Homo sapiens
cagagatgtattatg

SEQ ID NO: 6010821 - DNA, 20 bp, Homo sapiens
cagagatgtgcccccacccc

SEQ ID NO: 6010822 - DNA, 16 bp, Homo sapiens
cagagattagcctgta

SEQ ID NO: 6010823 - DNA, 21 bp, Homo sapiens
cagagattctggatctcctgc

SEQ ID NO: 6010824 - DNA, 23 bp, Homo sapiens
cagagattctggatctcctgctg

SEQ ID NO: 6010825 - DNA, 17 bp, Homo sapiens
cagagattgaactccaa

SEQ ID NO: 6010826 - DNA, 19 bp, Homo sapiens
cagagattgaactccaaga

SEQ ID NO: 6010827 - DNA, 16 bp, Homo sapiens
cagagattgcttctca

SEQ ID NO: 6010828 - DNA, 21 bp, Homo sapiens
cagagattggaatgggcagct

SEQ ID NO: 6010829 - DNA, 23 bp, Homo sapiens
cagagattggaatgggcagctca

SEQ ID NO: 6010830 - DNA, 20 bp, Homo sapiens
cagagattgggggggcttgg

SEQ ID NO: 6010831 - DNA, 21 bp, Homo sapiens
cagagattgggggggcttggg

SEQ ID NO: 6010832 - DNA, 16 bp, Homo sapiens
cagagatttctcattg

SEQ ID NO: 6010833 - DNA, 17 bp, Homo sapiens
cagagatttgagaacca

SEQ ID NO: 6010834 - DNA, 19 bp, Homo sapiens
cagagattttcatctatta

SEQ ID NO: 6010835 - DNA, 17 bp, Homo sapiens
cagagcaaacagaaaaa

SEQ ID NO: 6010836 - DNA, 16 bp, Homo sapiens
cagagcaaagggccag

SEQ ID NO: 6010837 - DNA, 18 bp, Homo sapiens
cagagcaagaccctgcct

SEQ ID NO: 6010838 - DNA, 19 bp, Homo sapiens
cagagcaagactccatctc

SEQ ID NO: 6010839 - DNA, 21 bp, Homo sapiens
cagagcaagactctgtctcaa

SEQ ID NO: 6010840 - DNA, 12 bp, Homo sapiens
cagagcaagcct

SEQ ID NO: 6010841 - DNA, 23 bp, Homo sapiens
cagagcaagcgaaagagcaaagt

SEQ ID NO: 6010842 - DNA, 19 bp, Homo sapiens
cagagcaagcttttttatt

SEQ ID NO: 6010843 - DNA, 18 bp, Homo sapiens
cagagcaagtctgcaggt

SEQ ID NO: 6010844 - DNA, 14 bp, Homo sapiens
cagagcaagtgaga

SEQ ID NO: 6010845 - DNA, 20 bp, Homo sapiens
cagagcaagtgagaccctgt

SEQ ID NO: 6010846 - DNA, 12 bp, Homo sapiens
cagagcaataac

SEQ ID NO: 6010847 - DNA, 15 bp, Homo sapiens
cagagcaataacact

SEQ ID NO: 6010848 - DNA, 19 bp, Homo sapiens
cagagcaatgactgtgctc

SEQ ID NO: 6010849 - DNA, 21 bp, Homo sapiens
cagagcaattccaggctgagc

SEQ ID NO: 6010850 - DNA, 23 bp, Homo sapiens
cagagcaattccaggctgagcca

SEQ ID NO: 6010851 - DNA, 20 bp, Homo sapiens
cagagcaatttacaagagct

SEQ ID NO: 6010852 - DNA, 19 bp, Homo sapiens
cagagcacaagaaggccag

SEQ ID NO: 6010853 - DNA, 22 bp, Homo sapiens
cagagcacaagaaggccagccc

SEQ ID NO: 6010854 - DNA, 15 bp, Homo sapiens
cagagcacacaggta

SEQ ID NO: 6010855 - DNA, 23 bp, Homo sapiens
cagagcacacaggtacagcaaca

SEQ ID NO: 6010856 - DNA, 20 bp, Homo sapiens
cagagcacacttatttatga

SEQ ID NO: 6010857 - DNA, 18 bp, Homo sapiens
cagagcacagcagcccct

SEQ ID NO: 6010858 - DNA, 12 bp, Homo sapiens
cagagcacagcc

SEQ ID NO: 6010859 - DNA, 14 bp, Homo sapiens
cagagcacagccaa

SEQ ID NO: 6010860 - DNA, 18 bp, Homo sapiens
cagagcacagccaatctc

SEQ ID NO: 6010861 - DNA, 14 bp, Homo sapiens
cagagcacagccca

SEQ ID NO: 6010862 - DNA, 13 bp, Homo sapiens
cagagcacaggag

SEQ ID NO: 6010863 - DNA, 13 bp, Homo sapiens
cagagcaccccct

SEQ ID NO: 6010864 - DNA, 19 bp, Homo sapiens
cagagcacctcaggaccct

SEQ ID NO: 6010865 - DNA, 16 bp, Homo sapiens
cagagcacctgctgtc

SEQ ID NO: 6010866 - DNA, 16 bp, Homo sapiens
cagagcaccttagaca

SEQ ID NO: 6010867 - DNA, 19 bp, Homo sapiens
cagagcaccttagacagtc

SEQ ID NO: 6010868 - DNA, 21 bp, Homo sapiens
cagagcaccttagacagtccc

SEQ ID NO: 6010869 - DNA, 23 bp, Homo sapiens
cagagcaccttagacagtccctg

SEQ ID NO: 6010870 - DNA, 22 bp, Homo sapiens
cagagcacctttgcacaggatg

SEQ ID NO: 6010871 - DNA, 12 bp, Homo sapiens
cagagcacgcct

SEQ ID NO: 6010872 - DNA, 13 bp, Homo sapiens
cagagcactgctc

SEQ ID NO: 6010873 - DNA, 13 bp, Homo sapiens
cagagcactgtat

SEQ ID NO: 6010874 - DNA, 21 bp, Homo sapiens
cagagcactttaaaaacaggc

SEQ ID NO: 6010875 - DNA, 13 bp, Homo sapiens
cagagcagacagg

SEQ ID NO: 6010876 - DNA, 15 bp, Homo sapiens
cagagcagagaccat

SEQ ID NO: 6010877 - DNA, 18 bp, Homo sapiens
cagagcagagaccatccc

SEQ ID NO: 6010878 - DNA, 13 bp, Homo sapiens
cagagcagagagc

SEQ ID NO: 6010879 - DNA, 13 bp, Homo sapiens
cagagcagatgca

SEQ ID NO: 6010880 - DNA, 15 bp, Homo sapiens
cagagcagatgcaga

SEQ ID NO: 6010881 - DNA, 19 bp, Homo sapiens
cagagcagatgcagagagc

SEQ ID NO: 6010882 - DNA, 20 bp, Homo sapiens
cagagcagatgcagagagcc

SEQ ID NO: 6010883 - DNA, 13 bp, Homo sapiens
cagagcagatggc

SEQ ID NO: 6010884 - DNA, 14 bp, Homo sapiens
cagagcagatggca

SEQ ID NO: 6010885 - DNA, 18 bp, Homo sapiens
cagagcagcacaaagaaa

SEQ ID NO: 6010886 - DNA, 14 bp, Homo sapiens
cagagcagcactgg

SEQ ID NO: 6010887 - DNA, 15 bp, Homo sapiens
cagagcagcactggg

SEQ ID NO: 6010888 - DNA, 16 bp, Homo sapiens
cagagcagcagcacct

SEQ ID NO: 6010889 - DNA, 20 bp, Homo sapiens
cagagcagcagtgaaaacaa

SEQ ID NO: 6010890 - DNA, 19 bp, Homo sapiens
cagagcagcctctgtcctg

SEQ ID NO: 6010891 - DNA, 22 bp, Homo sapiens
cagagcagcctctgtcctggct

SEQ ID NO: 6010892 - DNA, 22 bp, Homo sapiens
cagagcagctaactccgagagc

SEQ ID NO: 6010893 - DNA, 13 bp, Homo sapiens
cagagcagctagc

SEQ ID NO: 6010894 - DNA, 20 bp, Homo sapiens
cagagcagctccaccactgt

SEQ ID NO: 6010895 - DNA, 15 bp, Homo sapiens
cagagcagctcccca

SEQ ID NO: 6010896 - DNA, 17 bp, Homo sapiens
cagagcagctccccagg

SEQ ID NO: 6010897 - DNA, 18 bp, Homo sapiens
cagagcaggaaatgagag

SEQ ID NO: 6010898 - DNA, 17 bp, Homo sapiens
cagagcaggaaggacag

SEQ ID NO: 6010899 - DNA, 12 bp, Homo sapiens
cagagcaggacc

SEQ ID NO: 6010900 - DNA, 21 bp, Homo sapiens
cagagcaggagcccctggggc

SEQ ID NO: 6010901 - DNA, 12 bp, Homo sapiens
cagagcaggagg

SEQ ID NO: 6010902 - DNA, 14 bp, Homo sapiens
cagagcaggaggcc

SEQ ID NO: 6010903 - DNA, 21 bp, Homo sapiens
cagagcaggccacgctcaggc

SEQ ID NO: 6010904 - DNA, 22 bp, Homo sapiens
cagagcaggccacgctcaggcc

SEQ ID NO: 6010905 - DNA, 13 bp, Homo sapiens
cagagcaggctca

SEQ ID NO: 6010906 - DNA, 12 bp, Homo sapiens
cagagcaggctt

SEQ ID NO: 6010907 - DNA, 20 bp, Homo sapiens
cagagcaggctttgtgagag

SEQ ID NO: 6010908 - DNA, 23 bp, Homo sapiens
cagagcaggctttgtgagagagg

SEQ ID NO: 6010909 - DNA, 15 bp, Homo sapiens
cagagcaggggcagg

SEQ ID NO: 6010910 - DNA, 15 bp, Homo sapiens
cagagcaggggccag

SEQ ID NO: 6010911 - DNA, 16 bp, Homo sapiens
cagagcaggggctcca

SEQ ID NO: 6010912 - DNA, 17 bp, Homo sapiens
cagagcaggggctccag

SEQ ID NO: 6010913 - DNA, 16 bp, Homo sapiens
cagagcaggggctgct

SEQ ID NO: 6010914 - DNA, 18 bp, Homo sapiens
cagagcaggggctgctgg

SEQ ID NO: 6010915 - DNA, 20 bp, Homo sapiens
cagagcaggggctgctgggg

SEQ ID NO: 6010916 - DNA, 22 bp, Homo sapiens
cagagcaggggctgctgggggc

SEQ ID NO: 6010917 - DNA, 23 bp, Homo sapiens
cagagcaggggtccttggtgtga

SEQ ID NO: 6010918 - DNA, 19 bp, Homo sapiens
cagagcagggtctctctaa

SEQ ID NO: 6010919 - DNA, 16 bp, Homo sapiens
cagagcaggtctgcag

SEQ ID NO: 6010920 - DNA, 20 bp, Homo sapiens
cagagcaggtctgcaggcca

SEQ ID NO: 6010921 - DNA, 22 bp, Homo sapiens
cagagcaggtctgcaggccacc

SEQ ID NO: 6010922 - DNA, 23 bp, Homo sapiens
cagagcaggtctgcaggccacca

SEQ ID NO: 6010923 - DNA, 15 bp, Homo sapiens
cagagcagtgggcct

SEQ ID NO: 6010924 - DNA, 17 bp, Homo sapiens
cagagcagtgggcctgg

SEQ ID NO: 6010925 - DNA, 14 bp, Homo sapiens
cagagcagttcaag

SEQ ID NO: 6010926 - DNA, 18 bp, Homo sapiens
cagagcataaaacctaaa

SEQ ID NO: 6010927 - DNA, 17 bp, Homo sapiens
cagagcatcccacagga

SEQ ID NO: 6010928 - DNA, 17 bp, Homo sapiens
cagagcatctgccccag

SEQ ID NO: 6010929 - DNA, 18 bp, Homo sapiens
cagagcatctgccccagg

SEQ ID NO: 6010930 - DNA, 20 bp, Homo sapiens
cagagcatctgccccaggta

SEQ ID NO: 6010931 - DNA, 22 bp, Homo sapiens
cagagcatctgccccaggtaca

SEQ ID NO: 6010932 - DNA, 17 bp, Homo sapiens
cagagcatgatgggagg

SEQ ID NO: 6010933 - DNA, 22 bp, Homo sapiens
cagagcatgatgggaggtgtgc

SEQ ID NO: 6010934 - DNA, 15 bp, Homo sapiens
cagagcatgtgtcag

SEQ ID NO: 6010935 - DNA, 21 bp, Homo sapiens
cagagcattccagtcaggctc

SEQ ID NO: 6010936 - DNA, 14 bp, Homo sapiens
cagagcattgtgca

SEQ ID NO: 6010937 - DNA, 15 bp, Homo sapiens
cagagcatttaagga

SEQ ID NO: 6010938 - DNA, 13 bp, Homo sapiens
cagagcatttgat

SEQ ID NO: 6010939 - DNA, 17 bp, Homo sapiens
cagagccaacctggact

SEQ ID NO: 6010940 - DNA, 18 bp, Homo sapiens
cagagccaacctggactt

SEQ ID NO: 6010941 - DNA, 22 bp, Homo sapiens
cagagccaacctggacttcctg

SEQ ID NO: 6010942 - DNA, 18 bp, Homo sapiens
cagagccaagcactgctc

SEQ ID NO: 6010943 - DNA, 21 bp, Homo sapiens
cagagccaagccttaaactgt

SEQ ID NO: 6010944 - DNA, 18 bp, Homo sapiens
cagtaaaagataaccttt

SEQ ID NO: 6010945 - DNA, 16 bp, Homo sapiens
cagtaaaataaaaaac

SEQ ID NO: 6010946 - DNA, 20 bp, Homo sapiens
cagtaaaatagctgagggaa

SEQ ID NO: 6010947 - DNA, 17 bp, Homo sapiens
cagtaaaattatactgt

SEQ ID NO: 6010948 - DNA, 11 bp, Homo sapiens
cagtaaaattg

SEQ ID NO: 6010949 - DNA, 16 bp, Homo sapiens
cagtaaaattgccata

SEQ ID NO: 6010950 - DNA, 21 bp, Homo sapiens
cagtaaaattgccatattgca

SEQ ID NO: 6010951 - DNA, 16 bp, Homo sapiens
cagtaaaatttcagga

SEQ ID NO: 6010952 - DNA, 18 bp, Homo sapiens
cagtaaaatttcaggatt

SEQ ID NO: 6010953 - DNA, 16 bp, Homo sapiens
cagtaaacatttgtaa

SEQ ID NO: 6010954 - DNA, 18 bp, Homo sapiens
cagtaaacatttgtaaaa

SEQ ID NO: 6010955 - DNA, 17 bp, Homo sapiens
cagtaaacttagagttt

SEQ ID NO: 6010956 - DNA, 18 bp, Homo sapiens
cagtaaagaaagcagaat

SEQ ID NO: 6010957 - DNA, 14 bp, Homo sapiens
cagtaaagagaaac

SEQ ID NO: 6010958 - DNA, 18 bp, Homo sapiens
cagtaaagagaaactttg

SEQ ID NO: 6010959 - DNA, 18 bp, Homo sapiens
cagtaaagtatagaaata

SEQ ID NO: 6010960 - DNA, 22 bp, Homo sapiens
cagtaaagtggttctctgcctt

SEQ ID NO: 6010961 - DNA, 23 bp, Homo sapiens
cagtaaagtggttctctgccttt

SEQ ID NO: 6010962 - DNA, 15 bp, Homo sapiens
cagtaaagtttaaaa

SEQ ID NO: 6010963 - DNA, 20 bp, Homo sapiens
cagtaaagtttaaaaaatac

SEQ ID NO: 6010964 - DNA, 21 bp, Homo sapiens
cagtaaagtttaaaaaataca

SEQ ID NO: 6010965 - DNA, 19 bp, Homo sapiens
cagtaaataaattgtttga

SEQ ID NO: 6010966 - DNA, 24 bp, Homo sapiens
cagtaaataaattgtttgaccatg

SEQ ID NO: 6010967 - DNA, 22 bp, Homo sapiens
cagtaaataactggaaaacaga

SEQ ID NO: 6010968 - DNA, 17 bp, Homo sapiens
cagtaaatacactgtga

SEQ ID NO: 6010969 - DNA, 19 bp, Homo sapiens
cagtaaatacactgtgaag

SEQ ID NO: 6010970 - DNA, 19 bp, Homo sapiens
cagtaaatacttgcagttg

SEQ ID NO: 6010971 - DNA, 20 bp, Homo sapiens
cagtaaatacttgcagttgt

SEQ ID NO: 6010972 - DNA, 13 bp, Homo sapiens
cagtaaatccaca

SEQ ID NO: 6010973 - DNA, 21 bp, Homo sapiens
cagtaaatgaactgattttta

SEQ ID NO: 6010974 - DNA, 19 bp, Homo sapiens
cagtaaatgggggtgcatt

SEQ ID NO: 6010975 - DNA, 20 bp, Homo sapiens
cagtaaatgggggtgcattt

SEQ ID NO: 6010976 - DNA, 14 bp, Homo sapiens
cagtaaatttgcta

SEQ ID NO: 6010977 - DNA, 22 bp, Homo sapiens
cagtaacaaaattgacagcttt

SEQ ID NO: 6010978 - DNA, 13 bp, Homo sapiens
cagtaacacaatt

SEQ ID NO: 6010979 - DNA, 13 bp, Homo sapiens
cagtaacacaggc

SEQ ID NO: 6010980 - DNA, 14 bp, Homo sapiens
cagtaacacatctt

SEQ ID NO: 6010981 - DNA, 13 bp, Homo sapiens
cagtaacactggc

SEQ ID NO: 6010982 - DNA, 17 bp, Homo sapiens
cagtaacactggccttc

SEQ ID NO: 6010983 - DNA, 18 bp, Homo sapiens
cagtaacagggccttgct

SEQ ID NO: 6010984 - DNA, 20 bp, Homo sapiens
cagtaacagggccttgctaa

SEQ ID NO: 6010985 - DNA, 20 bp, Homo sapiens
cagtaacataactgcttctt

SEQ ID NO: 6010986 - DNA, 22 bp, Homo sapiens
cagtaaccaaaacagcatagta

SEQ ID NO: 6010987 - DNA, 18 bp, Homo sapiens
cagtaacgcaggggaaac

SEQ ID NO: 6010988 - DNA, 21 bp, Homo sapiens
cagtaacgggtcgtaatgact

SEQ ID NO: 6010989 - DNA, 14 bp, Homo sapiens
cagtaactaatttt

SEQ ID NO: 6010990 - DNA, 14 bp, Homo sapiens
cagtaactgtcagg

SEQ ID NO: 6010991 - DNA, 20 bp, Homo sapiens
cagtaactgtccctgctttc

SEQ ID NO: 6010992 - DNA, 14 bp, Homo sapiens
cagtaactgtgctg

SEQ ID NO: 6010993 - DNA, 20 bp, Homo sapiens
cagtaactttatgtgtaaat

SEQ ID NO: 6010994 - DNA, 21 bp, Homo sapiens
cagtaacttttttgtgtatgt

SEQ ID NO: 6010995 - DNA, 16 bp, Homo sapiens
cagtaagaccggaagc

SEQ ID NO: 6010996 - DNA, 23 bp, Homo sapiens
cagtaagaccggaagctcctggt

SEQ ID NO: 6010997 - DNA, 20 bp, Homo sapiens
cagtaagctggtttacagat

SEQ ID NO: 6010998 - DNA, 23 bp, Homo sapiens
cagtaagctggtttacagatgtt

SEQ ID NO: 6010999 - DNA, 12 bp, Homo sapiens
cagtaaggcagc

SEQ ID NO: 6011000 - DNA, 21 bp, Homo sapiens
cagtaagggcgtggctctggg

SEQ ID NO: 6011001 - DNA, 24 bp, Homo sapiens
cagtaagtagcaaccctgtgatac

SEQ ID NO: 6011002 - DNA, 18 bp, Homo sapiens
cagtaagtataacaaact

SEQ ID NO: 6011003 - DNA, 19 bp, Homo sapiens
cagtaagtataacaaacta

SEQ ID NO: 6011004 - DNA, 14 bp, Homo sapiens
cagtaagtcttttt

SEQ ID NO: 6011005 - DNA, 13 bp, Homo sapiens
cagtaagttccta

SEQ ID NO: 6011006 - DNA, 22 bp, Homo sapiens
cagtaagtttcccctctggctt

SEQ ID NO: 6011007 - DNA, 23 bp, Homo sapiens
cagtaataaaaagccaccacaca

SEQ ID NO: 6011008 - DNA, 12 bp, Homo sapiens
cagtaataactc

SEQ ID NO: 6011009 - DNA, 17 bp, Homo sapiens
cagtaatagcactgcca

SEQ ID NO: 6011010 - DNA, 12 bp, Homo sapiens
cagtaatagctg

SEQ ID NO: 6011011 - DNA, 17 bp, Homo sapiens
cagtaatagctgaacct

SEQ ID NO: 6011012 - DNA, 17 bp, Homo sapiens
cagtaatcccagtgact

SEQ ID NO: 6011013 - DNA, 18 bp, Homo sapiens
cagtaatcccagtgactt

SEQ ID NO: 6011014 - DNA, 13 bp, Homo sapiens
cagtaatcctgta

SEQ ID NO: 6011015 - DNA, 15 bp, Homo sapiens
cagtaatctgtcagt

SEQ ID NO: 6011016 - DNA, 16 bp, Homo sapiens
cagtaatctgtcagtg

SEQ ID NO: 6011017 - DNA, 14 bp, Homo sapiens
cagtaatctttata

SEQ ID NO: 6011018 - DNA, 15 bp, Homo sapiens
cagtaatgaaatgtt

SEQ ID NO: 6011019 - DNA, 16 bp, Homo sapiens
cagtaatgactctctg

SEQ ID NO: 6011020 - DNA, 22 bp, Homo sapiens
cagtaatgagttaaataaaaca

SEQ ID NO: 6011021 - DNA, 22 bp, Homo sapiens
cagtaatgctaaatgtgtaata

SEQ ID NO: 6011022 - DNA, 21 bp, Homo sapiens
cagtaatggggtgagctcaca

SEQ ID NO: 6011023 - DNA, 14 bp, Homo sapiens
cagtaatgtagaaa

SEQ ID NO: 6011024 - DNA, 16 bp, Homo sapiens
cagtaattacaaatta

SEQ ID NO: 6011025 - DNA, 21 bp, Homo sapiens
cagtaattactttcagaatgt

SEQ ID NO: 6011026 - DNA, 14 bp, Homo sapiens
cagtaattatgaga

SEQ ID NO: 6011027 - DNA, 23 bp, Homo sapiens
cagtaattcccatctgctttatt

SEQ ID NO: 6011028 - DNA, 21 bp, Homo sapiens
cagtaattggtccgatctttg

SEQ ID NO: 6011029 - DNA, 14 bp, Homo sapiens
cagtaattgtgaaa

SEQ ID NO: 6011030 - DNA, 18 bp, Homo sapiens
cagtaattgtgtttacat

SEQ ID NO: 6011031 - DNA, 20 bp, Homo sapiens
cagtaattgtgtttacattt

SEQ ID NO: 6011032 - DNA, 14 bp, Homo sapiens
cagtaatttagaaa

SEQ ID NO: 6011033 - DNA, 22 bp, Homo sapiens
cagtacaataaataaaagaaag

SEQ ID NO: 6011034 - DNA, 14 bp, Homo sapiens
cagtacaataatgt

SEQ ID NO: 6011035 - DNA, 15 bp, Homo sapiens
cagtacaataatgta

SEQ ID NO: 6011036 - DNA, 21 bp, Homo sapiens
cagtacaataatgtactcaca

SEQ ID NO: 6011037 - DNA, 22 bp, Homo sapiens
cagtacaataatgtactcacat

SEQ ID NO: 6011038 - DNA, 13 bp, Homo sapiens
cagtacaattctt

SEQ ID NO: 6011039 - DNA, 21 bp, Homo sapiens
cagtacaattctttgttgctt

SEQ ID NO: 6011040 - DNA, 23 bp, Homo sapiens
cagtacaattctttgttgcttaa

SEQ ID NO: 6011041 - DNA, 12 bp, Homo sapiens
cagtacacacaa

SEQ ID NO: 6011042 - DNA, 13 bp, Homo sapiens
cagtacagaattg

SEQ ID NO: 6011043 - DNA, 14 bp, Homo sapiens
cagtacaggcagca

SEQ ID NO: 6011044 - DNA, 16 bp, Homo sapiens
cagtacaggggtgctg

SEQ ID NO: 6011045 - DNA, 18 bp, Homo sapiens
cagtacagtattctttta

SEQ ID NO: 6011046 - DNA, 16 bp, Homo sapiens
cagtacagtggttcta

SEQ ID NO: 6011047 - DNA, 19 bp, Homo sapiens
cagtacatacgtctgccag

SEQ ID NO: 6011048 - DNA, 14 bp, Homo sapiens
cagtacatcttgtg

SEQ ID NO: 6011049 - DNA, 22 bp, Homo sapiens
cagtacatcttgtgcatgcaaa

SEQ ID NO: 6011050 - DNA, 16 bp, Homo sapiens
cagtacatttaattga

SEQ ID NO: 6011051 - DNA, 12 bp, Homo sapiens
cagtaccaaaga

SEQ ID NO: 6011052 - DNA, 18 bp, Homo sapiens
cagtaccataatcttaga

SEQ ID NO: 6011053 - DNA, 15 bp, Homo sapiens
cagtaccatcccact

SEQ ID NO: 6011054 - DNA, 14 bp, Homo sapiens
cagtaccatctgaa

SEQ ID NO: 6011055 - DNA, 14 bp, Homo sapiens
cagtacccacctga

SEQ ID NO: 6011056 - DNA, 15 bp, Homo sapiens
cagtacccacctgag

SEQ ID NO: 6011057 - DNA, 22 bp, Homo sapiens
cagtacccctggtaaaccaagc

SEQ ID NO: 6011058 - DNA, 16 bp, Homo sapiens
cagtaccctccattgg

SEQ ID NO: 6011059 - DNA, 14 bp, Homo sapiens
cagtaccctctcag

SEQ ID NO: 6011060 - DNA, 22 bp, Homo sapiens
cagtaccctctcagctccaggt

SEQ ID NO: 6011061 - DNA, 24 bp, Homo sapiens
cagtaccctctcagctccaggtgg

SEQ ID NO: 6011062 - DNA, 16 bp, Homo sapiens
cagtaccctggttgtg

SEQ ID NO: 6011063 - DNA, 23 bp, Homo sapiens
cagtacctatgacttttttaaac

SEQ ID NO: 6011064 - DNA, 23 bp, Homo sapiens
cagtacctgagggtctgtaggtt

SEQ ID NO: 6011065 - DNA, 13 bp, Homo sapiens
cagtacctgggaa

SEQ ID NO: 6011066 - DNA, 23 bp, Homo sapiens
cagtaccttcaaactagggccaa

SEQ ID NO: 6011067 - DNA, 17 bp, Homo sapiens
cagtaccttgttgcaga

SEQ ID NO: 6011068 - DNA, 22 bp, Homo sapiens
cagtacgatcaagttgttgact

SEQ ID NO: 6011069 - DNA, 18 bp, Homo sapiens
cagtacgtcccgctgctg

SEQ ID NO: 6011070 - DNA, 14 bp, Homo sapiens
cagtactaaaatta

SEQ ID NO: 6011071 - DNA, 15 bp, Homo sapiens
cagtactaaaattaa

SEQ ID NO: 6011072 - DNA, 16 bp, Homo sapiens
cagtactaaggtgact

SEQ ID NO: 6011073 - DNA, 22 bp, Homo sapiens
cagtactaaggtgactttctga

SEQ ID NO: 6011074 - DNA, 15 bp, Homo sapiens
cagtactcaaattca

SEQ ID NO: 6011075 - DNA, 17 bp, Homo sapiens
cagtactgactttctga

SEQ ID NO: 6011076 - DNA, 15 bp, Homo sapiens
cagtactgaggtggt

SEQ ID NO: 6011077 - DNA, 20 bp, Homo sapiens
cagtactggttactttcaaa

SEQ ID NO: 6011078 - DNA, 22 bp, Homo sapiens
cagtactggttactttcaaaat

SEQ ID NO: 6011079 - DNA, 15 bp, Homo sapiens
cagtacttcagcaag

SEQ ID NO: 6011080 - DNA, 16 bp, Homo sapiens
cagtacttcagcaaga

SEQ ID NO: 6011081 - DNA, 20 bp, Homo sapiens
cagtacttcagcaagagaga

SEQ ID NO: 6011082 - DNA, 13 bp, Homo sapiens
cagtacttctaag

SEQ ID NO: 6011083 - DNA, 20 bp, Homo sapiens
cagtacttgagggaccaata

SEQ ID NO: 6011084 - DNA, 21 bp, Homo sapiens
cagtacttgagggaccaatat

SEQ ID NO: 6011085 - DNA, 19 bp, Homo sapiens
cagtacttgctcaataaag

SEQ ID NO: 6011086 - DNA, 23 bp, Homo sapiens
cagtacttgtgaaacacagctgt

SEQ ID NO: 6011087 - DNA, 22 bp, Homo sapiens
cagtactttataaccaaagcaa

SEQ ID NO: 6011088 - DNA, 16 bp, Homo sapiens
cagtactttattgtac

SEQ ID NO: 6011089 - DNA, 18 bp, Homo sapiens
cagtactttggaaagcca

SEQ ID NO: 6011090 - DNA, 21 bp, Homo sapiens
cagtactttggaaagccaagg

SEQ ID NO: 6011091 - DNA, 20 bp, Homo sapiens
cagtacttttgttgtatggg

SEQ ID NO: 6011092 - DNA, 13 bp, Homo sapiens
cagtagaaaatat

SEQ ID NO: 6011093 - DNA, 13 bp, Homo sapiens
cagtagaaagagt

SEQ ID NO: 6011094 - DNA, 18 bp, Homo sapiens
cagtagaaataatatgca

SEQ ID NO: 6011095 - DNA, 19 bp, Homo sapiens
cagtagaaataatatgcat

SEQ ID NO: 6011096 - DNA, 14 bp, Homo sapiens
cagtagaactgtct

SEQ ID NO: 6011097 - DNA, 15 bp, Homo sapiens
cagtagaactgtctg

SEQ ID NO: 6011098 - DNA, 16 bp, Homo sapiens
cagtagaattttagtc

SEQ ID NO: 6011099 - DNA, 17 bp, Homo sapiens
cagtagaattttagtcc

SEQ ID NO: 6011100 - DNA, 22 bp, Homo sapiens
cagtagactcatcttttgaaac

SEQ ID NO: 6011101 - DNA, 12 bp, Homo sapiens
cagtagactgtg

SEQ ID NO: 6011102 - DNA, 17 bp, Homo sapiens
cagtagagccagcttgg

SEQ ID NO: 6011103 - DNA, 24 bp, Homo sapiens
cagtagagtagggtagaaggaaag

SEQ ID NO: 6011104 - DNA, 16 bp, Homo sapiens
cagtagagtcatctcc

SEQ ID NO: 6011105 - DNA, 17 bp, Homo sapiens
cagtagagtcatctcca

SEQ ID NO: 6011106 - DNA, 20 bp, Homo sapiens
cagtagatcattttttgtct

SEQ ID NO: 6011107 - DNA, 21 bp, Homo sapiens
cagtagatcattttttgtcta

SEQ ID NO: 6011108 - DNA, 22 bp, Homo sapiens
cagtagatggtacgatgcatcc

SEQ ID NO: 6011109 - DNA, 15 bp, Homo sapiens
cagtagattgcagaa

SEQ ID NO: 6011110 - DNA, 14 bp, Homo sapiens
cagtagattttctt

SEQ ID NO: 6011111 - DNA, 23 bp, Homo sapiens
cagtagcacaagttatttaaatc

SEQ ID NO: 6011112 - DNA, 21 bp, Homo sapiens
cagtagcaggacctgccaaga

SEQ ID NO: 6011113 - DNA, 14 bp, Homo sapiens
cagtagcaggcccg

SEQ ID NO: 6011114 - DNA, 21 bp, Homo sapiens
cagtagcatactgatgagaca

SEQ ID NO: 6011115 - DNA, 16 bp, Homo sapiens
cagtagcatctcagtg

SEQ ID NO: 6011116 - DNA, 20 bp, Homo sapiens
cagtagccaaacaccacttt

SEQ ID NO: 6011117 - DNA, 21 bp, Homo sapiens
cagtagccaaacaccactttg

SEQ ID NO: 6011118 - DNA, 19 bp, Homo sapiens
cagtagccaagttatattg

SEQ ID NO: 6011119 - DNA, 18 bp, Homo sapiens
cagtagccagtatctatt

SEQ ID NO: 6011120 - DNA, 20 bp, Homo sapiens
cagtagccattttgtaactg

SEQ ID NO: 6011121 - DNA, 14 bp, Homo sapiens
cagagccaagctgg

SEQ ID NO: 6011122 - DNA, 18 bp, Homo sapiens
cagagccaagctggggca

SEQ ID NO: 6011123 - DNA, 13 bp, Homo sapiens
cagagccaaggcc

SEQ ID NO: 6011124 - DNA, 15 bp, Homo sapiens
cagagccaaggccac

SEQ ID NO: 6011125 - DNA, 21 bp, Homo sapiens
cagagccaaggggcttcaggt

SEQ ID NO: 6011126 - DNA, 22 bp, Homo sapiens
cagagccacagggtctgcctcc

SEQ ID NO: 6011127 - DNA, 23 bp, Homo sapiens
cagagccacagggtctgcctcca

SEQ ID NO: 6011128 - DNA, 12 bp, Homo sapiens
cagagccacagt

SEQ ID NO: 6011129 - DNA, 16 bp, Homo sapiens
cagagccaccagggca

SEQ ID NO: 6011130 - DNA, 22 bp, Homo sapiens
cagagccactctatgagttgga

SEQ ID NO: 6011131 - DNA, 13 bp, Homo sapiens
cagagccagaggc

SEQ ID NO: 6011132 - DNA, 21 bp, Homo sapiens
cagagccagatgcaggacagg

SEQ ID NO: 6011133 - DNA, 15 bp, Homo sapiens
cagagccagcctggg

SEQ ID NO: 6011134 - DNA, 16 bp, Homo sapiens
cagagccagcctggga

SEQ ID NO: 6011135 - DNA, 16 bp, Homo sapiens
cagagccagcggctcc

SEQ ID NO: 6011136 - DNA, 14 bp, Homo sapiens
cagagccaggaaga

SEQ ID NO: 6011137 - DNA, 23 bp, Homo sapiens
cagagccaggagaagctcagctg

SEQ ID NO: 6011138 - DNA, 11 bp, Homo sapiens
cagagccaggc

SEQ ID NO: 6011139 - DNA, 18 bp, Homo sapiens
cagagccagggcagggcg

SEQ ID NO: 6011140 - DNA, 13 bp, Homo sapiens
cagagccagggct

SEQ ID NO: 6011141 - DNA, 14 bp, Homo sapiens
cagagccagggctg

SEQ ID NO: 6011142 - DNA, 23 bp, Homo sapiens
cagagccaggggggtgaggagct

SEQ ID NO: 6011143 - DNA, 11 bp, Homo sapiens
cagagccagtg

SEQ ID NO: 6011144 - DNA, 14 bp, Homo sapiens
cagagccagtgaag

SEQ ID NO: 6011145 - DNA, 22 bp, Homo sapiens
cagagccatccaccctgaggag

SEQ ID NO: 6011146 - DNA, 17 bp, Homo sapiens
cagagccatgctgggaa

SEQ ID NO: 6011147 - DNA, 13 bp, Homo sapiens
cagagccatgggc

SEQ ID NO: 6011148 - DNA, 16 bp, Homo sapiens
cagagccatgggcctg

SEQ ID NO: 6011149 - DNA, 18 bp, Homo sapiens
cagagccatgggcctggg

SEQ ID NO: 6011150 - DNA, 21 bp, Homo sapiens
cagagccatgggcctgggcct

SEQ ID NO: 6011151 - DNA, 21 bp, Homo sapiens
cagagccatgtcttctccctg

SEQ ID NO: 6011152 - DNA, 17 bp, Homo sapiens
cagagcccaagtgccat

SEQ ID NO: 6011153 - DNA, 20 bp, Homo sapiens
cagagcccaagtgccatccc

SEQ ID NO: 6011154 - DNA, 12 bp, Homo sapiens
cagagcccaatg

SEQ ID NO: 6011155 - DNA, 14 bp, Homo sapiens
cagagcccaccagc

SEQ ID NO: 6011156 - DNA, 18 bp, Homo sapiens
cagagcccaccagccagc

SEQ ID NO: 6011157 - DNA, 22 bp, Homo sapiens
cagagcccaccagccagccctg

SEQ ID NO: 6011158 - DNA, 15 bp, Homo sapiens
cagagcccaccttgg

SEQ ID NO: 6011159 - DNA, 20 bp, Homo sapiens
cagagcccacgcccccactg

SEQ ID NO: 6011160 - DNA, 23 bp, Homo sapiens
cagagcccacgcccccactggtg

SEQ ID NO: 6011161 - DNA, 18 bp, Homo sapiens
cagagcccactccatctg

SEQ ID NO: 6011162 - DNA, 14 bp, Homo sapiens
cagagcccagctct

SEQ ID NO: 6011163 - DNA, 15 bp, Homo sapiens
cagagcccagctctt

SEQ ID NO: 6011164 - DNA, 12 bp, Homo sapiens
cagagcccagga

SEQ ID NO: 6011165 - DNA, 14 bp, Homo sapiens
cagagcccaggaat

SEQ ID NO: 6011166 - DNA, 22 bp, Homo sapiens
cagagcccagggaagacacatg

SEQ ID NO: 6011167 - DNA, 14 bp, Homo sapiens
cagagccccaagca

SEQ ID NO: 6011168 - DNA, 19 bp, Homo sapiens
cagagccccaagcaggacg

SEQ ID NO: 6011169 - DNA, 13 bp, Homo sapiens
cagagccccacac

SEQ ID NO: 6011170 - DNA, 16 bp, Homo sapiens
cagagccccacacgga

SEQ ID NO: 6011171 - DNA, 23 bp, Homo sapiens
cagagccccacacggaggcatct

SEQ ID NO: 6011172 - DNA, 14 bp, Homo sapiens
cagagccccacgct

SEQ ID NO: 6011173 - DNA, 14 bp, Homo sapiens
cagagccccactcc

SEQ ID NO: 6011174 - DNA, 23 bp, Homo sapiens
cagagccccactcccggccaggc

SEQ ID NO: 6011175 - DNA, 15 bp, Homo sapiens
cagagcccccaagcc

SEQ ID NO: 6011176 - DNA, 19 bp, Homo sapiens
cagagcccccaagcctctg

SEQ ID NO: 6011177 - DNA, 20 bp, Homo sapiens
cagagcccccaaggactctg

SEQ ID NO: 6011178 - DNA, 21 bp, Homo sapiens
cagagcccccaaggactctgg

SEQ ID NO: 6011179 - DNA, 16 bp, Homo sapiens
cagagcccccagccct

SEQ ID NO: 6011180 - DNA, 18 bp, Homo sapiens
cagagcccgcccacctgg

SEQ ID NO: 6011181 - DNA, 15 bp, Homo sapiens
cagagcccggagctc

SEQ ID NO: 6011182 - DNA, 23 bp, Homo sapiens
cagagcccggccccacctccctg

SEQ ID NO: 6011183 - DNA, 19 bp, Homo sapiens
cagagcccgtcagcgtggg

SEQ ID NO: 6011184 - DNA, 22 bp, Homo sapiens
cagagccctatctatgtcctgg

SEQ ID NO: 6011185 - DNA, 21 bp, Homo sapiens
cagagccctcaactattctgt

SEQ ID NO: 6011186 - DNA, 18 bp, Homo sapiens
cagagccctccaggcctg

SEQ ID NO: 6011187 - DNA, 10 bp, Homo sapiens
cagagccctg

SEQ ID NO: 6011188 - DNA, 21 bp, Homo sapiens
cagagccctgaggggctgggc

SEQ ID NO: 6011189 - DNA, 22 bp, Homo sapiens
cagagccctgaggggctgggct

SEQ ID NO: 6011190 - DNA, 11 bp, Homo sapiens
cagagccctgc

SEQ ID NO: 6011191 - DNA, 16 bp, Homo sapiens
cagagccctgcagtca

SEQ ID NO: 6011192 - DNA, 14 bp, Homo sapiens
cagagccctgccct

SEQ ID NO: 6011193 - DNA, 15 bp, Homo sapiens
cagagccctgccctg

SEQ ID NO: 6011194 - DNA, 17 bp, Homo sapiens
cagagccctgctccctc

SEQ ID NO: 6011195 - DNA, 22 bp, Homo sapiens
cagagccctggaccttgggcct

SEQ ID NO: 6011196 - DNA, 15 bp, Homo sapiens
cagagcccttcactg

SEQ ID NO: 6011197 - DNA, 17 bp, Homo sapiens
cagagcccttcactgcc

SEQ ID NO: 6011198 - DNA, 17 bp, Homo sapiens
cagagcccttttgctat

SEQ ID NO: 6011199 - DNA, 17 bp, Homo sapiens
cagagccgcaaatcaac

SEQ ID NO: 6011200 - DNA, 21 bp, Homo sapiens
cagagccgcaccctggctgga

SEQ ID NO: 6011201 - DNA, 15 bp, Homo sapiens
cagagccggcatcct

SEQ ID NO: 6011202 - DNA, 14 bp, Homo sapiens
cagagccgggagga

SEQ ID NO: 6011203 - DNA, 23 bp, Homo sapiens
cagagccgggaggaaaaggcccc

SEQ ID NO: 6011204 - DNA, 21 bp, Homo sapiens
cagagccgtaaaaactgaagt

SEQ ID NO: 6011205 - DNA, 19 bp, Homo sapiens
cagagccgtggtcctttgg

SEQ ID NO: 6011206 - DNA, 20 bp, Homo sapiens
cagagccgtggtcctttggg

SEQ ID NO: 6011207 - DNA, 15 bp, Homo sapiens
cagagccgttcctgg

SEQ ID NO: 6011208 - DNA, 20 bp, Homo sapiens
cagagccgttcctgggactg

SEQ ID NO: 6011209 - DNA, 16 bp, Homo sapiens
cagagcctaccttcac

SEQ ID NO: 6011210 - DNA, 13 bp, Homo sapiens
cagagcctagcca

SEQ ID NO: 6011211 - DNA, 15 bp, Homo sapiens
cagagcctagccacc

SEQ ID NO: 6011212 - DNA, 18 bp, Homo sapiens
cagagcctagccacctcc

SEQ ID NO: 6011213 - DNA, 22 bp, Homo sapiens
cagagcctagccacctcccacc

SEQ ID NO: 6011214 - DNA, 23 bp, Homo sapiens
cagagcctagccacctcccaccc

SEQ ID NO: 6011215 - DNA, 13 bp, Homo sapiens
cagagcctcagct

SEQ ID NO: 6011216 - DNA, 23 bp, Homo sapiens
cagagcctcccaaggagaacaaa

SEQ ID NO: 6011217 - DNA, 13 bp, Homo sapiens
cagagcctccctc

SEQ ID NO: 6011218 - DNA, 13 bp, Homo sapiens
cagagcctctgag

SEQ ID NO: 6011219 - DNA, 19 bp, Homo sapiens
cagagcctctgagatgatg

SEQ ID NO: 6011220 - DNA, 12 bp, Homo sapiens
cagagcctctgg

SEQ ID NO: 6011221 - DNA, 14 bp, Homo sapiens
cagagcctctggcc

SEQ ID NO: 6011222 - DNA, 17 bp, Homo sapiens
cagagcctctggcccct

SEQ ID NO: 6011223 - DNA, 21 bp, Homo sapiens
cagagcctctggcccctcacc

SEQ ID NO: 6011224 - DNA, 14 bp, Homo sapiens
cagagcctgaattt

SEQ ID NO: 6011225 - DNA, 17 bp, Homo sapiens
cagagcctgacctgaga

SEQ ID NO: 6011226 - DNA, 18 bp, Homo sapiens
cagagcctgacctgagag

SEQ ID NO: 6011227 - DNA, 12 bp, Homo sapiens
cagagcctgcag

SEQ ID NO: 6011228 - DNA, 21 bp, Homo sapiens
cagagcctgcagggtgacctg

SEQ ID NO: 6011229 - DNA, 14 bp, Homo sapiens
cagagcctgcagtt

SEQ ID NO: 6011230 - DNA, 12 bp, Homo sapiens
cagagcctgcct

SEQ ID NO: 6011231 - DNA, 13 bp, Homo sapiens
cagagcctgccta

SEQ ID NO: 6011232 - DNA, 16 bp, Homo sapiens
cagagcctgcctaacc

SEQ ID NO: 6011233 - DNA, 14 bp, Homo sapiens
cagagcctgcctca

SEQ ID NO: 6011234 - DNA, 20 bp, Homo sapiens
cagagcctgcctcagctgct

SEQ ID NO: 6011235 - DNA, 13 bp, Homo sapiens
cagagcctggccc

SEQ ID NO: 6011236 - DNA, 12 bp, Homo sapiens
cagagcctgggc

SEQ ID NO: 6011237 - DNA, 13 bp, Homo sapiens
cagagcctggggc

SEQ ID NO: 6011238 - DNA, 16 bp, Homo sapiens
cagagcctggggctct

SEQ ID NO: 6011239 - DNA, 13 bp, Homo sapiens
cagagcctggggt

SEQ ID NO: 6011240 - DNA, 15 bp, Homo sapiens
cagagcctgttttaa

SEQ ID NO: 6011241 - DNA, 18 bp, Homo sapiens
cagagcctgttttaaaaa

SEQ ID NO: 6011242 - DNA, 20 bp, Homo sapiens
cagagcctgttttaaaaaat

SEQ ID NO: 6011243 - DNA, 20 bp, Homo sapiens
cagagccttcaagtgccaaa

SEQ ID NO: 6011244 - DNA, 14 bp, Homo sapiens
cagagccttcacaa

SEQ ID NO: 6011245 - DNA, 21 bp, Homo sapiens
cagagccttcacaaccagcca

SEQ ID NO: 6011246 - DNA, 22 bp, Homo sapiens
cagagccttcacaaccagccac

SEQ ID NO: 6011247 - DNA, 17 bp, Homo sapiens
cagagccttccatgacc

SEQ ID NO: 6011248 - DNA, 20 bp, Homo sapiens
cagagccttccatgacctcc

SEQ ID NO: 6011249 - DNA, 16 bp, Homo sapiens
cagagccttctcagaa

SEQ ID NO: 6011250 - DNA, 18 bp, Homo sapiens
cagagccttctcagaagc

SEQ ID NO: 6011251 - DNA, 20 bp, Homo sapiens
cagagccttctcctgcctac

SEQ ID NO: 6011252 - DNA, 21 bp, Homo sapiens
cagagccttctcctgcctaca

SEQ ID NO: 6011253 - DNA, 19 bp, Homo sapiens
cagagccttggaggacact

SEQ ID NO: 6011254 - DNA, 16 bp, Homo sapiens
cagagcctttggatga

SEQ ID NO: 6011255 - DNA, 20 bp, Homo sapiens
cagagcctttggatgaccag

SEQ ID NO: 6011256 - DNA, 21 bp, Homo sapiens
cagagcctttttacctggcct

SEQ ID NO: 6011257 - DNA, 23 bp, Homo sapiens
cagagcctttttacctggcctag

SEQ ID NO: 6011258 - DNA, 21 bp, Homo sapiens
cagagcgaagacccggccagg

SEQ ID NO: 6011259 - DNA, 20 bp, Homo sapiens
cagagcgagactccgtctca

SEQ ID NO: 6011260 - DNA, 19 bp, Homo sapiens
cagagcgagactctgtctc

SEQ ID NO: 6011261 - DNA, 20 bp, Homo sapiens
cagagcgagagtctgtctca

SEQ ID NO: 6011262 - DNA, 20 bp, Homo sapiens
cagagcgagattccgtctca

SEQ ID NO: 6011263 - DNA, 22 bp, Homo sapiens
cagagcgataatacactattat

SEQ ID NO: 6011264 - DNA, 17 bp, Homo sapiens
cagagcgatgtgttctt

SEQ ID NO: 6011265 - DNA, 13 bp, Homo sapiens
cagagcgcacagg

SEQ ID NO: 6011266 - DNA, 14 bp, Homo sapiens
cagagcgcagcccc

SEQ ID NO: 6011267 - DNA, 15 bp, Homo sapiens
cagagcgcagccccc

SEQ ID NO: 6011268 - DNA, 15 bp, Homo sapiens
cagagcgccaggaag

SEQ ID NO: 6011269 - DNA, 16 bp, Homo sapiens
cagagcgccaggaagc

SEQ ID NO: 6011270 - DNA, 15 bp, Homo sapiens
cagagcgcccctccc

SEQ ID NO: 6011271 - DNA, 19 bp, Homo sapiens
cagagcgcccctccctagt

SEQ ID NO: 6011272 - DNA, 21 bp, Homo sapiens
cagagcgccgtgagttctcag

SEQ ID NO: 6011273 - DNA, 22 bp, Homo sapiens
cagagcgccgtgagttctcagg

SEQ ID NO: 6011274 - DNA, 19 bp, Homo sapiens
cagagcgcgcccctagccg

SEQ ID NO: 6011275 - DNA, 14 bp, Homo sapiens
cagagcgggaggga

SEQ ID NO: 6011276 - DNA, 16 bp, Homo sapiens
cagagcgggagggagt

SEQ ID NO: 6011277 - DNA, 13 bp, Homo sapiens
cagagcgggcctc

SEQ ID NO: 6011278 - DNA, 18 bp, Homo sapiens
cagagcgggcctcttccc

SEQ ID NO: 6011279 - DNA, 22 bp, Homo sapiens
cagagcgggcctcttccctcag

SEQ ID NO: 6011280 - DNA, 23 bp, Homo sapiens
cagagcgggctcgaagaaaataa

SEQ ID NO: 6011281 - DNA, 14 bp, Homo sapiens
cagagcggggaggt

SEQ ID NO: 6011282 - DNA, 15 bp, Homo sapiens
cagagcggggaggtg

SEQ ID NO: 6011283 - DNA, 19 bp, Homo sapiens
cagagcggggtcccctctg

SEQ ID NO: 6011284 - DNA, 20 bp, Homo sapiens
cagagcggggtcccctctgt

SEQ ID NO: 6011285 - DNA, 19 bp, Homo sapiens
cagagcgggtaaagtgcaa

SEQ ID NO: 6011286 - DNA, 19 bp, Homo sapiens
cagagcgtccttccccctg

SEQ ID NO: 6011287 - DNA, 15 bp, Homo sapiens
cagagcgtgagctga

SEQ ID NO: 6011288 - DNA, 19 bp, Homo sapiens
cagagcgtgagctgagcag

SEQ ID NO: 6011289 - DNA, 18 bp, Homo sapiens
cagagctaaactccttcc

SEQ ID NO: 6011290 - DNA, 18 bp, Homo sapiens
cagagctaaactctcgag

SEQ ID NO: 6011291 - DNA, 20 bp, Homo sapiens
cagagctaaggccaatgggc

SEQ ID NO: 6011292 - DNA, 21 bp, Homo sapiens
cagagctaagggtgggtgctc

SEQ ID NO: 6011293 - DNA, 17 bp, Homo sapiens
cagagctacacagggga

SEQ ID NO: 6011294 - DNA, 20 bp, Homo sapiens
cagagctacccgcagagttc

SEQ ID NO: 6011295 - DNA, 20 bp, Homo sapiens
cagagctactgagacttgga

SEQ ID NO: 6011296 - DNA, 20 bp, Homo sapiens
cagagctagggctgctgctt

SEQ ID NO: 6011297 - DNA, 23 bp, Homo sapiens
cagagctagggctgctgcttctg

SEQ ID NO: 6011298 - DNA, 13 bp, Homo sapiens
cagagctcagagg

SEQ ID NO: 6011299 - DNA, 14 bp, Homo sapiens
cagagctccacaga

SEQ ID NO: 6011300 - DNA, 18 bp, Homo sapiens
cagtagcccagagtgagc

SEQ ID NO: 6011301 - DNA, 21 bp, Homo sapiens
cagtagccccaatatggtggc

SEQ ID NO: 6011302 - DNA, 18 bp, Homo sapiens
cagtagccccatcacatt

SEQ ID NO: 6011303 - DNA, 21 bp, Homo sapiens
cagtagcctcctcctgggctc

SEQ ID NO: 6011304 - DNA, 13 bp, Homo sapiens
cagtagctgctac

SEQ ID NO: 6011305 - DNA, 14 bp, Homo sapiens
cagtagctgggacc

SEQ ID NO: 6011306 - DNA, 16 bp, Homo sapiens
cagtagcttaaataaa

SEQ ID NO: 6011307 - DNA, 18 bp, Homo sapiens
cagtagcttaaataaatt

SEQ ID NO: 6011308 - DNA, 13 bp, Homo sapiens
cagtagcttccca

SEQ ID NO: 6011309 - DNA, 21 bp, Homo sapiens
cagtagcttcccaaaaacagc

SEQ ID NO: 6011310 - DNA, 19 bp, Homo sapiens
cagtagcttgaaattgatt

SEQ ID NO: 6011311 - DNA, 19 bp, Homo sapiens
cagtaggaaatcaggcagt

SEQ ID NO: 6011312 - DNA, 21 bp, Homo sapiens
cagtaggaaattgattttgaa

SEQ ID NO: 6011313 - DNA, 22 bp, Homo sapiens
cagtaggaaattgattttgaaa

SEQ ID NO: 6011314 - DNA, 17 bp, Homo sapiens
cagtaggaacaagctgg

SEQ ID NO: 6011315 - DNA, 23 bp, Homo sapiens
cagtaggacaaggtgcaggcagg

SEQ ID NO: 6011316 - DNA, 13 bp, Homo sapiens
cagtaggaccagg

SEQ ID NO: 6011317 - DNA, 16 bp, Homo sapiens
cagtaggaccaggcca

SEQ ID NO: 6011318 - DNA, 22 bp, Homo sapiens
cagtaggagacacgacagcaca

SEQ ID NO: 6011319 - DNA, 12 bp, Homo sapiens
cagtaggagagg

SEQ ID NO: 6011320 - DNA, 16 bp, Homo sapiens
cagtaggagcaagaga

SEQ ID NO: 6011321 - DNA, 12 bp, Homo sapiens
cagtaggagccc

SEQ ID NO: 6011322 - DNA, 15 bp, Homo sapiens
cagtaggagcccagc

SEQ ID NO: 6011323 - DNA, 17 bp, Homo sapiens
cagtaggataagccact

SEQ ID NO: 6011324 - DNA, 19 bp, Homo sapiens
cagtaggatattggcattt

SEQ ID NO: 6011325 - DNA, 18 bp, Homo sapiens
cagtaggatgtggaacct

SEQ ID NO: 6011326 - DNA, 13 bp, Homo sapiens
cagtaggccggtg

SEQ ID NO: 6011327 - DNA, 18 bp, Homo sapiens
cagtaggcttttaccatt

SEQ ID NO: 6011328 - DNA, 19 bp, Homo sapiens
cagtaggggcttataataa

SEQ ID NO: 6011329 - DNA, 14 bp, Homo sapiens
cagtagggggaggg

SEQ ID NO: 6011330 - DNA, 22 bp, Homo sapiens
cagtaggtaatgattatgtgtc

SEQ ID NO: 6011331 - DNA, 16 bp, Homo sapiens
cagtaggtccaagggc

SEQ ID NO: 6011332 - DNA, 20 bp, Homo sapiens
cagtaggtcccggccagctc

SEQ ID NO: 6011333 - DNA, 21 bp, Homo sapiens
cagtaggtcccggccagctct

SEQ ID NO: 6011334 - DNA, 22 bp, Homo sapiens
cagtaggtctgaaggcctccat

SEQ ID NO: 6011335 - DNA, 20 bp, Homo sapiens
cagtaggttatttagcttgg

SEQ ID NO: 6011336 - DNA, 22 bp, Homo sapiens
cagtaggttatttagcttggga

SEQ ID NO: 6011337 - DNA, 14 bp, Homo sapiens
cagtagtaccaaat

SEQ ID NO: 6011338 - DNA, 21 bp, Homo sapiens
cagtagtaccttgttttgcca

SEQ ID NO: 6011339 - DNA, 19 bp, Homo sapiens
cagtagtagtatggcactt

SEQ ID NO: 6011340 - DNA, 22 bp, Homo sapiens
cagtagtataatgtatgaattt

SEQ ID NO: 6011341 - DNA, 21 bp, Homo sapiens
cagtagtcacaaactgatcta

SEQ ID NO: 6011342 - DNA, 17 bp, Homo sapiens
cagtagtcacctctggg

SEQ ID NO: 6011343 - DNA, 17 bp, Homo sapiens
cagtagtctctgtgctt

SEQ ID NO: 6011344 - DNA, 12 bp, Homo sapiens
cagtagtgatag

SEQ ID NO: 6011345 - DNA, 23 bp, Homo sapiens
cagtagtgccaaaaggccccttc

SEQ ID NO: 6011346 - DNA, 14 bp, Homo sapiens
cagtagtgtacatt

SEQ ID NO: 6011347 - DNA, 15 bp, Homo sapiens
cagtagtgtacatta

SEQ ID NO: 6011348 - DNA, 14 bp, Homo sapiens
cagtagttcacata

SEQ ID NO: 6011349 - DNA, 17 bp, Homo sapiens
cagtagttcactttaat

SEQ ID NO: 6011350 - DNA, 22 bp, Homo sapiens
cagtagtttgagaccagcctgg

SEQ ID NO: 6011351 - DNA, 19 bp, Homo sapiens
cagtagtttgcatttcaga

SEQ ID NO: 6011352 - DNA, 21 bp, Homo sapiens
cagtagtttgcatttcagaaa

SEQ ID NO: 6011353 - DNA, 15 bp, Homo sapiens
cagtagttttcaaaa

SEQ ID NO: 6011354 - DNA, 16 bp, Homo sapiens
cagtataaaagacaaa

SEQ ID NO: 6011355 - DNA, 22 bp, Homo sapiens
cagtataaaattacagtggatt

SEQ ID NO: 6011356 - DNA, 17 bp, Homo sapiens
cagtataaagaatagga

SEQ ID NO: 6011357 - DNA, 18 bp, Homo sapiens
cagtataaagaataggac

SEQ ID NO: 6011358 - DNA, 20 bp, Homo sapiens
cagtataaattacatgcatg

SEQ ID NO: 6011359 - DNA, 20 bp, Homo sapiens
cagtataacctgtctatact

SEQ ID NO: 6011360 - DNA, 14 bp, Homo sapiens
cagtataattaaca

SEQ ID NO: 6011361 - DNA, 12 bp, Homo sapiens
cagtataattct

SEQ ID NO: 6011362 - DNA, 23 bp, Homo sapiens
cagtataattgagttttcagtgg

SEQ ID NO: 6011363 - DNA, 17 bp, Homo sapiens
cagtatacaagataagc

SEQ ID NO: 6011364 - DNA, 18 bp, Homo sapiens
cagtatacctcatttttc

SEQ ID NO: 6011365 - DNA, 20 bp, Homo sapiens
cagtatacctcatttttcat

SEQ ID NO: 6011366 - DNA, 21 bp, Homo sapiens
cagtatacctcatttttcata

SEQ ID NO: 6011367 - DNA, 14 bp, Homo sapiens
cagtatagataaat

SEQ ID NO: 6011368 - DNA, 18 bp, Homo sapiens
cagtatagataaatccaa

SEQ ID NO: 6011369 - DNA, 22 bp, Homo sapiens
cagtatagcattgaacatttct

SEQ ID NO: 6011370 - DNA, 23 bp, Homo sapiens
cagtatagtttaaaaatctgcca

SEQ ID NO: 6011371 - DNA, 18 bp, Homo sapiens
cagtatataagctgttta

SEQ ID NO: 6011372 - DNA, 15 bp, Homo sapiens
cagtatataagcttt

SEQ ID NO: 6011373 - DNA, 21 bp, Homo sapiens
cagtatataataactttattg

SEQ ID NO: 6011374 - DNA, 23 bp, Homo sapiens
cagtatatgttaatttgtgtgtt

SEQ ID NO: 6011375 - DNA, 15 bp, Homo sapiens
cagtatattcttgta

SEQ ID NO: 6011376 - DNA, 17 bp, Homo sapiens
cagtatattcttgtaaa

SEQ ID NO: 6011377 - DNA, 22 bp, Homo sapiens
cagtatatttatagtcacaaga

SEQ ID NO: 6011378 - DNA, 14 bp, Homo sapiens
cagtatatttctga

SEQ ID NO: 6011379 - DNA, 17 bp, Homo sapiens
cagtatattttatttca

SEQ ID NO: 6011380 - DNA, 19 bp, Homo sapiens
cagtatattttatttcaat

SEQ ID NO: 6011381 - DNA, 22 bp, Homo sapiens
cagtatattttatttcaatgta

SEQ ID NO: 6011382 - DNA, 18 bp, Homo sapiens
cagtatattttctgtatt

SEQ ID NO: 6011383 - DNA, 13 bp, Homo sapiens
cagtatcaaggct

SEQ ID NO: 6011384 - DNA, 18 bp, Homo sapiens
cagtatcaaggctgcctg

SEQ ID NO: 6011385 - DNA, 16 bp, Homo sapiens
cagtatcacagatgta

SEQ ID NO: 6011386 - DNA, 19 bp, Homo sapiens
cagtatcatgccctgtgca

SEQ ID NO: 6011387 - DNA, 24 bp, Homo sapiens
cagtatccatgctcttgaccttgt

SEQ ID NO: 6011388 - DNA, 13 bp, Homo sapiens
cagtatcccacat

SEQ ID NO: 6011389 - DNA, 15 bp, Homo sapiens
cagtatcccacatcc

SEQ ID NO: 6011390 - DNA, 16 bp, Homo sapiens
cagtatcccacatcca

SEQ ID NO: 6011391 - DNA, 23 bp, Homo sapiens
cagtatcctgctggttcactcta

SEQ ID NO: 6011392 - DNA, 20 bp, Homo sapiens
cagtatcggcactgtacaaa

SEQ ID NO: 6011393 - DNA, 18 bp, Homo sapiens
cagtatctatatatgtgt

SEQ ID NO: 6011394 - DNA, 20 bp, Homo sapiens
cagtatctatatatgtgtat

SEQ ID NO: 6011395 - DNA, 21 bp, Homo sapiens
cagtatctatatatgtgtatg

SEQ ID NO: 6011396 - DNA, 13 bp, Homo sapiens
cagtatctcttac

SEQ ID NO: 6011397 - DNA, 16 bp, Homo sapiens
cagtatctcttcagtc

SEQ ID NO: 6011398 - DNA, 17 bp, Homo sapiens
cagtatctcttcagtct

SEQ ID NO: 6011399 - DNA, 19 bp, Homo sapiens
cagtatctcttcagtctct

SEQ ID NO: 6011400 - DNA, 15 bp, Homo sapiens
cagtatctcttgctg

SEQ ID NO: 6011401 - DNA, 14 bp, Homo sapiens
cagtatctgctgtt

SEQ ID NO: 6011402 - DNA, 20 bp, Homo sapiens
cagtatctgctgttcttcag

SEQ ID NO: 6011403 - DNA, 19 bp, Homo sapiens
cagtatcttagagtttaca

SEQ ID NO: 6011404 - DNA, 21 bp, Homo sapiens
cagtatcttagagtttacagt

SEQ ID NO: 6011405 - DNA, 12 bp, Homo sapiens
cagtatcttcaa

SEQ ID NO: 6011406 - DNA, 14 bp, Homo sapiens
cagtatcttcaaaa

SEQ ID NO: 6011407 - DNA, 22 bp, Homo sapiens
cagtatcttcaaaaatacagaa

SEQ ID NO: 6011408 - DNA, 13 bp, Homo sapiens
cagtatgacagag

SEQ ID NO: 6011409 - DNA, 23 bp, Homo sapiens
cagtatgagaagaaaaatggaaa

SEQ ID NO: 6011410 - DNA, 21 bp, Homo sapiens
cagtatgagtcaatgtgcagt

SEQ ID NO: 6011411 - DNA, 23 bp, Homo sapiens
cagtatgagtcaatgtgcagtgt

SEQ ID NO: 6011412 - DNA, 18 bp, Homo sapiens
cagtatgatatcatgctt

SEQ ID NO: 6011413 - DNA, 17 bp, Homo sapiens
cagtatgatgaaaataa

SEQ ID NO: 6011414 - DNA, 18 bp, Homo sapiens
cagtatgatgaaaataat

SEQ ID NO: 6011415 - DNA, 20 bp, Homo sapiens
cagtatgatgaaaataattt

SEQ ID NO: 6011416 - DNA, 23 bp, Homo sapiens
cagtatgatgaaaataattttcc

SEQ ID NO: 6011417 - DNA, 22 bp, Homo sapiens
cagtatgcaaagcaatctttta

SEQ ID NO: 6011418 - DNA, 14 bp, Homo sapiens
cagtatggccagac

SEQ ID NO: 6011419 - DNA, 19 bp, Homo sapiens
cagtatgggaaccccaaat

SEQ ID NO: 6011420 - DNA, 21 bp, Homo sapiens
cagtatgggggttgtaaattg

SEQ ID NO: 6011421 - DNA, 21 bp, Homo sapiens
cagtatgggttagggaaaaca

SEQ ID NO: 6011422 - DNA, 23 bp, Homo sapiens
cagtatgggttagggaaaacatt

SEQ ID NO: 6011423 - DNA, 16 bp, Homo sapiens
cagtatggtacatttt

SEQ ID NO: 6011424 - DNA, 17 bp, Homo sapiens
cagtatggtacattttt

SEQ ID NO: 6011425 - DNA, 21 bp, Homo sapiens
cagtatggtctaacactggca

SEQ ID NO: 6011426 - DNA, 19 bp, Homo sapiens
cagtatggtgctaatgtgt

SEQ ID NO: 6011427 - DNA, 21 bp, Homo sapiens
cagtatgtccccataagacaa

SEQ ID NO: 6011428 - DNA, 11 bp, Homo sapiens
cagtatgtgtc

SEQ ID NO: 6011429 - DNA, 20 bp, Homo sapiens
cagtatgtgtcaactgagag

SEQ ID NO: 6011430 - DNA, 22 bp, Homo sapiens
cagtatgtgtcaactgagagtc

SEQ ID NO: 6011431 - DNA, 13 bp, Homo sapiens
cagtatgtgtcta

SEQ ID NO: 6011432 - DNA, 14 bp, Homo sapiens
cagtatgtgtctag

SEQ ID NO: 6011433 - DNA, 21 bp, Homo sapiens
cagtatgttccaaaccctcct

SEQ ID NO: 6011434 - DNA, 13 bp, Homo sapiens
cagtatgttgtca

SEQ ID NO: 6011435 - DNA, 13 bp, Homo sapiens
cagtatgttttaa

SEQ ID NO: 6011436 - DNA, 15 bp, Homo sapiens
cagtatgttttaaca

SEQ ID NO: 6011437 - DNA, 15 bp, Homo sapiens
cagtatgttttacac

SEQ ID NO: 6011438 - DNA, 20 bp, Homo sapiens
cagtatgttttacactgtac

SEQ ID NO: 6011439 - DNA, 20 bp, Homo sapiens
cagtattaaactctcctttg

SEQ ID NO: 6011440 - DNA, 20 bp, Homo sapiens
cagtattaaaggggggaggg

SEQ ID NO: 6011441 - DNA, 13 bp, Homo sapiens
cagtattaacact

SEQ ID NO: 6011442 - DNA, 20 bp, Homo sapiens
cagtattaagggtaggatgt

SEQ ID NO: 6011443 - DNA, 16 bp, Homo sapiens
cagtattactttctgc

SEQ ID NO: 6011444 - DNA, 20 bp, Homo sapiens
cagtattatagatataaata

SEQ ID NO: 6011445 - DNA, 19 bp, Homo sapiens
cagtattatctaaatgaat

SEQ ID NO: 6011446 - DNA, 19 bp, Homo sapiens
cagtattatgcatatataa

SEQ ID NO: 6011447 - DNA, 22 bp, Homo sapiens
cagtattatgcatatataagtt

SEQ ID NO: 6011448 - DNA, 23 bp, Homo sapiens
cagtattatttagtaaaattatc

SEQ ID NO: 6011449 - DNA, 18 bp, Homo sapiens
cagtattatttgtatgta

SEQ ID NO: 6011450 - DNA, 16 bp, Homo sapiens
cagtattcagagtctc

SEQ ID NO: 6011451 - DNA, 18 bp, Homo sapiens
cagtattccatgggatgt

SEQ ID NO: 6011452 - DNA, 14 bp, Homo sapiens
cagtattctgacat

SEQ ID NO: 6011453 - DNA, 15 bp, Homo sapiens
cagtattctgacatg

SEQ ID NO: 6011454 - DNA, 17 bp, Homo sapiens
cagtattctgacatgta

SEQ ID NO: 6011455 - DNA, 21 bp, Homo sapiens
cagtattctgacatgtaagaa

SEQ ID NO: 6011456 - DNA, 13 bp, Homo sapiens
cagtattctgtag

SEQ ID NO: 6011457 - DNA, 18 bp, Homo sapiens
cagtattctgtagccaac

SEQ ID NO: 6011458 - DNA, 19 bp, Homo sapiens
cagtattctgtagccaact

SEQ ID NO: 6011459 - DNA, 13 bp, Homo sapiens
cagtattcttgtc

SEQ ID NO: 6011460 - DNA, 16 bp, Homo sapiens
cagtattcttgtcaaa

SEQ ID NO: 6011461 - DNA, 19 bp, Homo sapiens
cagtattcttgtcaaaaaa

SEQ ID NO: 6011462 - DNA, 23 bp, Homo sapiens
cagtattgaaaaattatcagtta

SEQ ID NO: 6011463 - DNA, 15 bp, Homo sapiens
cagtattgaaaactt

SEQ ID NO: 6011464 - DNA, 17 bp, Homo sapiens
cagtattgaaaacttca

SEQ ID NO: 6011465 - DNA, 19 bp, Homo sapiens
cagtattgaaaacttcaaa

SEQ ID NO: 6011466 - DNA, 14 bp, Homo sapiens
cagtattgaagcat

SEQ ID NO: 6011467 - DNA, 16 bp, Homo sapiens
cagtattgaagcattt

SEQ ID NO: 6011468 - DNA, 15 bp, Homo sapiens
cagtattgacactga

SEQ ID NO: 6011469 - DNA, 13 bp, Homo sapiens
cagtattgagaca

SEQ ID NO: 6011470 - DNA, 17 bp, Homo sapiens
cagtattgagacactgt

SEQ ID NO: 6011471 - DNA, 20 bp, Homo sapiens
cagtattgagacactgtcaa

SEQ ID NO: 6011472 - DNA, 21 bp, Homo sapiens
cagtattgcaataaaaaatat

SEQ ID NO: 6011473 - DNA, 19 bp, Homo sapiens
cagtattgccacaatgcct

SEQ ID NO: 6011474 - DNA, 17 bp, Homo sapiens
cagtattgccacctctg

SEQ ID NO: 6011475 - DNA, 14 bp, Homo sapiens
cagtattgggcagg

SEQ ID NO: 6011476 - DNA, 15 bp, Homo sapiens
cagagctcccaggac

SEQ ID NO: 6011477 - DNA, 22 bp, Homo sapiens
cagagctcccccgtggtgcctg

SEQ ID NO: 6011478 - DNA, 15 bp, Homo sapiens
cagagctcccttcct

SEQ ID NO: 6011479 - DNA, 16 bp, Homo sapiens
cagagctccgatgccc

SEQ ID NO: 6011480 - DNA, 23 bp, Homo sapiens
cagagctcctccttgtcttggca

SEQ ID NO: 6011481 - DNA, 13 bp, Homo sapiens
cagagctctacag

SEQ ID NO: 6011482 - DNA, 17 bp, Homo sapiens
cagagctctccagctcc

SEQ ID NO: 6011483 - DNA, 22 bp, Homo sapiens
cagagctctcccctcctgctgg

SEQ ID NO: 6011484 - DNA, 17 bp, Homo sapiens
cagagctctcgaggaaa

SEQ ID NO: 6011485 - DNA, 15 bp, Homo sapiens
cagagctctgaccca

SEQ ID NO: 6011486 - DNA, 17 bp, Homo sapiens
cagagctctgacccaca

SEQ ID NO: 6011487 - DNA, 14 bp, Homo sapiens
cagagctgaacctt

SEQ ID NO: 6011488 - DNA, 16 bp, Homo sapiens
cagagctgaagagttg

SEQ ID NO: 6011489 - DNA, 14 bp, Homo sapiens
cagagctgacacag

SEQ ID NO: 6011490 - DNA, 15 bp, Homo sapiens
cagagctgacacagg

SEQ ID NO: 6011491 - DNA, 19 bp, Homo sapiens
cagagctgacacaggatga

SEQ ID NO: 6011492 - DNA, 15 bp, Homo sapiens
cagagctgaggcttt

SEQ ID NO: 6011493 - DNA, 22 bp, Homo sapiens
cagagctgagtcggctgggcag

SEQ ID NO: 6011494 - DNA, 13 bp, Homo sapiens
cagagctgcacag

SEQ ID NO: 6011495 - DNA, 14 bp, Homo sapiens
cagagctgcacagg

SEQ ID NO: 6011496 - DNA, 18 bp, Homo sapiens
cagagctgcacttggcct

SEQ ID NO: 6011497 - DNA, 17 bp, Homo sapiens
cagagctgcagccagtc

SEQ ID NO: 6011498 - DNA, 18 bp, Homo sapiens
cagagctgccctctcctg

SEQ ID NO: 6011499 - DNA, 19 bp, Homo sapiens
cagagctgccctctcctgg

SEQ ID NO: 6011500 - DNA, 11 bp, Homo sapiens
cagagctgcct

SEQ ID NO: 6011501 - DNA, 13 bp, Homo sapiens
cagagctgcctcc

SEQ ID NO: 6011502 - DNA, 14 bp, Homo sapiens
cagagctgcctccc

SEQ ID NO: 6011503 - DNA, 13 bp, Homo sapiens
cagagctgcgggc

SEQ ID NO: 6011504 - DNA, 16 bp, Homo sapiens
cagagctgcgggctgg

SEQ ID NO: 6011505 - DNA, 22 bp, Homo sapiens
cagagctgcggtgtctccctgc

SEQ ID NO: 6011506 - DNA, 19 bp, Homo sapiens
cagagctgctattaaatta

SEQ ID NO: 6011507 - DNA, 20 bp, Homo sapiens
cagagctgctgagcaggaac

SEQ ID NO: 6011508 - DNA, 19 bp, Homo sapiens
cagagctgcttctgtctgg

SEQ ID NO: 6011509 - DNA, 16 bp, Homo sapiens
cagagctggaaggcag

SEQ ID NO: 6011510 - DNA, 19 bp, Homo sapiens
cagagctggaaggcagggc

SEQ ID NO: 6011511 - DNA, 20 bp, Homo sapiens
cagagctggaaggcagggca

SEQ ID NO: 6011512 - DNA, 12 bp, Homo sapiens
cagagctggaca

SEQ ID NO: 6011513 - DNA, 16 bp, Homo sapiens
cagagctggaccagtg

SEQ ID NO: 6011514 - DNA, 17 bp, Homo sapiens
cagagctggcagcctcc

SEQ ID NO: 6011515 - DNA, 19 bp, Homo sapiens
cagagctggcagcctccag

SEQ ID NO: 6011516 - DNA, 22 bp, Homo sapiens
cagagctggcagcctccagtgg

SEQ ID NO: 6011517 - DNA, 21 bp, Homo sapiens
cagagctggcatctatctggt

SEQ ID NO: 6011518 - DNA, 14 bp, Homo sapiens
cagagctggccagg

SEQ ID NO: 6011519 - DNA, 15 bp, Homo sapiens
cagagctggcctccc

SEQ ID NO: 6011520 - DNA, 17 bp, Homo sapiens
cagagctggcctccccc

SEQ ID NO: 6011521 - DNA, 18 bp, Homo sapiens
cagagctggcgctcagca

SEQ ID NO: 6011522 - DNA, 14 bp, Homo sapiens
cagagctggctgtc

SEQ ID NO: 6011523 - DNA, 15 bp, Homo sapiens
cagagctggctgtct

SEQ ID NO: 6011524 - DNA, 14 bp, Homo sapiens
cagagctggggctg

SEQ ID NO: 6011525 - DNA, 22 bp, Homo sapiens
cagagctggggctgccagcctg

SEQ ID NO: 6011526 - DNA, 12 bp, Homo sapiens
cagagctggggg

SEQ ID NO: 6011527 - DNA, 17 bp, Homo sapiens
cagagctgggtggggac

SEQ ID NO: 6011528 - DNA, 13 bp, Homo sapiens
cagagctggtgcg

SEQ ID NO: 6011529 - DNA, 18 bp, Homo sapiens
cagagctggtgcggctgg

SEQ ID NO: 6011530 - DNA, 20 bp, Homo sapiens
cagagctgtcctcctggcac

SEQ ID NO: 6011531 - DNA, 19 bp, Homo sapiens
cagagctgtctggtgatca

SEQ ID NO: 6011532 - DNA, 11 bp, Homo sapiens
cagagctgtgc

SEQ ID NO: 6011533 - DNA, 14 bp, Homo sapiens
cagagctgtgccag

SEQ ID NO: 6011534 - DNA, 18 bp, Homo sapiens
cagagctgtgccagcagg

SEQ ID NO: 6011535 - DNA, 13 bp, Homo sapiens
cagagctgtgcct

SEQ ID NO: 6011536 - DNA, 19 bp, Homo sapiens
cagagctgtgcctgctcag

SEQ ID NO: 6011537 - DNA, 12 bp, Homo sapiens
cagagctgtgga

SEQ ID NO: 6011538 - DNA, 13 bp, Homo sapiens
cagagctgttata

SEQ ID NO: 6011539 - DNA, 20 bp, Homo sapiens
cagagctgttggcctcgcct

SEQ ID NO: 6011540 - DNA, 22 bp, Homo sapiens
cagagctgttggcctcgcctgg

SEQ ID NO: 6011541 - DNA, 21 bp, Homo sapiens
cagagctgtttatggcctcag

SEQ ID NO: 6011542 - DNA, 17 bp, Homo sapiens
cagagcttattggccac

SEQ ID NO: 6011543 - DNA, 19 bp, Homo sapiens
cagagcttattggccactg

SEQ ID NO: 6011544 - DNA, 19 bp, Homo sapiens
cagagcttcagggctgggc

SEQ ID NO: 6011545 - DNA, 13 bp, Homo sapiens
cagagcttcccag

SEQ ID NO: 6011546 - DNA, 13 bp, Homo sapiens
cagagcttccctg

SEQ ID NO: 6011547 - DNA, 18 bp, Homo sapiens
cagagcttccctgactca

SEQ ID NO: 6011548 - DNA, 15 bp, Homo sapiens
cagagcttcctgggg

SEQ ID NO: 6011549 - DNA, 16 bp, Homo sapiens
cagagcttcctgggga

SEQ ID NO: 6011550 - DNA, 20 bp, Homo sapiens
cagagcttcctggggaccaa

SEQ ID NO: 6011551 - DNA, 22 bp, Homo sapiens
cagagcttcctggggaccaaga

SEQ ID NO: 6011552 - DNA, 23 bp, Homo sapiens
cagagcttcctggggaccaagat

SEQ ID NO: 6011553 - DNA, 20 bp, Homo sapiens
cagagcttcttccaggtgcc

SEQ ID NO: 6011554 - DNA, 23 bp, Homo sapiens
cagagcttgtgctcctcttgatt

SEQ ID NO: 6011555 - DNA, 18 bp, Homo sapiens
cagagcttgttgtctcca

SEQ ID NO: 6011556 - DNA, 18 bp, Homo sapiens
cagagctttaaaagtatc

SEQ ID NO: 6011557 - DNA, 20 bp, Homo sapiens
cagagctttaaaagtatctt

SEQ ID NO: 6011558 - DNA, 23 bp, Homo sapiens
cagagctttaaaagtatctttaa

SEQ ID NO: 6011559 - DNA, 17 bp, Homo sapiens
cagagctttggtctgtg

SEQ ID NO: 6011560 - DNA, 20 bp, Homo sapiens
cagagctttggtctgtgtgt

SEQ ID NO: 6011561 - DNA, 12 bp, Homo sapiens
cagagctttgtc

SEQ ID NO: 6011562 - DNA, 13 bp, Homo sapiens
cagagcttttcag

SEQ ID NO: 6011563 - DNA, 21 bp, Homo sapiens
cagagcttttcgaactgtgct

SEQ ID NO: 6011564 - DNA, 23 bp, Homo sapiens
cagagcttttcgaactgtgctcc

SEQ ID NO: 6011565 - DNA, 24 bp, Homo sapiens
cagagcttttcgaactgtgctccc

SEQ ID NO: 6011566 - DNA, 24 bp, Homo sapiens
cagaggaaaaacagaggatgctga

SEQ ID NO: 6011567 - DNA, 12 bp, Homo sapiens
cagaggaaaaag

SEQ ID NO: 6011568 - DNA, 21 bp, Homo sapiens
cagaggaaaaagaaaaacatt

SEQ ID NO: 6011569 - DNA, 23 bp, Homo sapiens
cagaggaaaaatgggagccagga

SEQ ID NO: 6011570 - DNA, 17 bp, Homo sapiens
cagaggaaagcaaagga

SEQ ID NO: 6011571 - DNA, 21 bp, Homo sapiens
cagaggaacaagcatgtctct

SEQ ID NO: 6011572 - DNA, 17 bp, Homo sapiens
cagaggaacccccacca

SEQ ID NO: 6011573 - DNA, 19 bp, Homo sapiens
cagaggaacccccaccaga

SEQ ID NO: 6011574 - DNA, 16 bp, Homo sapiens
cagaggaagaaaatga

SEQ ID NO: 6011575 - DNA, 12 bp, Homo sapiens
cagaggaagagc

SEQ ID NO: 6011576 - DNA, 19 bp, Homo sapiens
cagaggaagggaggcctga

SEQ ID NO: 6011577 - DNA, 20 bp, Homo sapiens
cagaggaagggaggcctgag

SEQ ID NO: 6011578 - DNA, 22 bp, Homo sapiens
cagaggaagggaggcctgaggg

SEQ ID NO: 6011579 - DNA, 19 bp, Homo sapiens
cagaggaaggggccagagg

SEQ ID NO: 6011580 - DNA, 20 bp, Homo sapiens
cagaggaaggggccagaggc

SEQ ID NO: 6011581 - DNA, 23 bp, Homo sapiens
cagaggaatcactcttgtggatg

SEQ ID NO: 6011582 - DNA, 20 bp, Homo sapiens
cagaggaatcctggcagccc

SEQ ID NO: 6011583 - DNA, 23 bp, Homo sapiens
cagaggaatcctggcagcccaga

SEQ ID NO: 6011584 - DNA, 19 bp, Homo sapiens
cagaggaatgtagggcctg

SEQ ID NO: 6011585 - DNA, 22 bp, Homo sapiens
cagaggaattgattgtcagcca

SEQ ID NO: 6011586 - DNA, 23 bp, Homo sapiens
cagaggaatttggctgcttctac

SEQ ID NO: 6011587 - DNA, 22 bp, Homo sapiens
cagaggacacctgtactggaga

SEQ ID NO: 6011588 - DNA, 14 bp, Homo sapiens
cagaggacagagct

SEQ ID NO: 6011589 - DNA, 15 bp, Homo sapiens
cagaggacagtctgg

SEQ ID NO: 6011590 - DNA, 16 bp, Homo sapiens
cagaggacccacctgg

SEQ ID NO: 6011591 - DNA, 14 bp, Homo sapiens
cagaggaccccagg

SEQ ID NO: 6011592 - DNA, 15 bp, Homo sapiens
cagaggaccccaggg

SEQ ID NO: 6011593 - DNA, 18 bp, Homo sapiens
cagaggaccccagggtgg

SEQ ID NO: 6011594 - DNA, 22 bp, Homo sapiens
cagaggacccttacgtgagaaa

SEQ ID NO: 6011595 - DNA, 17 bp, Homo sapiens
cagaggacctgtattta

SEQ ID NO: 6011596 - DNA, 22 bp, Homo sapiens
cagaggacgcacgctcgctgcc

SEQ ID NO: 6011597 - DNA, 22 bp, Homo sapiens
cagaggactcacttgcccacac

SEQ ID NO: 6011598 - DNA, 21 bp, Homo sapiens
cagaggactcccaaccctggc

SEQ ID NO: 6011599 - DNA, 22 bp, Homo sapiens
cagaggactcccaaccctggct

SEQ ID NO: 6011600 - DNA, 13 bp, Homo sapiens
cagaggactctgc

SEQ ID NO: 6011601 - DNA, 20 bp, Homo sapiens
cagaggagaaagtggaaaat

SEQ ID NO: 6011602 - DNA, 15 bp, Homo sapiens
cagaggagaagacaa

SEQ ID NO: 6011603 - DNA, 20 bp, Homo sapiens
cagaggagagatagcctgtg

SEQ ID NO: 6011604 - DNA, 21 bp, Homo sapiens
cagaggagagatagcctgtgg

SEQ ID NO: 6011605 - DNA, 23 bp, Homo sapiens
cagaggagagatagcctgtggcc

SEQ ID NO: 6011606 - DNA, 20 bp, Homo sapiens
cagaggagaggagacagaca

SEQ ID NO: 6011607 - DNA, 22 bp, Homo sapiens
cagaggagagtcccagagcagg

SEQ ID NO: 6011608 - DNA, 23 bp, Homo sapiens
cagaggagagtcccagagcagga

SEQ ID NO: 6011609 - DNA, 21 bp, Homo sapiens
cagaggagagtggcctgggtc

SEQ ID NO: 6011610 - DNA, 23 bp, Homo sapiens
cagaggagcaaattgaggttcag

SEQ ID NO: 6011611 - DNA, 19 bp, Homo sapiens
cagaggagcagaccagcac

SEQ ID NO: 6011612 - DNA, 18 bp, Homo sapiens
cagaggagcatcagctgt

SEQ ID NO: 6011613 - DNA, 18 bp, Homo sapiens
cagaggagccaccagttc

SEQ ID NO: 6011614 - DNA, 20 bp, Homo sapiens
cagaggagccacctgggctg

SEQ ID NO: 6011615 - DNA, 23 bp, Homo sapiens
cagaggagccacctgggctggga

SEQ ID NO: 6011616 - DNA, 15 bp, Homo sapiens
cagaggagcccagtg

SEQ ID NO: 6011617 - DNA, 17 bp, Homo sapiens
cagaggagcccagtggg

SEQ ID NO: 6011618 - DNA, 14 bp, Homo sapiens
cagaggagcctttt

SEQ ID NO: 6011619 - DNA, 15 bp, Homo sapiens
cagaggagcgcaggc

SEQ ID NO: 6011620 - DNA, 18 bp, Homo sapiens
cagaggagcgcaggcagc

SEQ ID NO: 6011621 - DNA, 13 bp, Homo sapiens
cagaggagctcta

SEQ ID NO: 6011622 - DNA, 15 bp, Homo sapiens
cagaggagcttttct

SEQ ID NO: 6011623 - DNA, 21 bp, Homo sapiens
cagaggaggcagaataagaaa

SEQ ID NO: 6011624 - DNA, 14 bp, Homo sapiens
cagaggagggcaga

SEQ ID NO: 6011625 - DNA, 15 bp, Homo sapiens
cagaggaggtgcccg

SEQ ID NO: 6011626 - DNA, 21 bp, Homo sapiens
cagaggaggtgcccgggcagg

SEQ ID NO: 6011627 - DNA, 16 bp, Homo sapiens
cagaggagtgcagcct

SEQ ID NO: 6011628 - DNA, 21 bp, Homo sapiens
cagaggatgagctctacccag

SEQ ID NO: 6011629 - DNA, 23 bp, Homo sapiens
cagaggatgagctctacccaggg

SEQ ID NO: 6011630 - DNA, 22 bp, Homo sapiens
cagaggatgaggtgggctgaag

SEQ ID NO: 6011631 - DNA, 20 bp, Homo sapiens
cagaggatgccttttctgtg

SEQ ID NO: 6011632 - DNA, 23 bp, Homo sapiens
cagaggatgccttttctgtgatt

SEQ ID NO: 6011633 - DNA, 22 bp, Homo sapiens
cagaggatgctctttcccagga

SEQ ID NO: 6011634 - DNA, 13 bp, Homo sapiens
cagaggatgctga

SEQ ID NO: 6011635 - DNA, 13 bp, Homo sapiens
cagaggatggcca

SEQ ID NO: 6011636 - DNA, 14 bp, Homo sapiens
cagaggatggcttc

SEQ ID NO: 6011637 - DNA, 22 bp, Homo sapiens
cagaggcaaggatggtggggcc

SEQ ID NO: 6011638 - DNA, 21 bp, Homo sapiens
cagaggcacagccggggcctg

SEQ ID NO: 6011639 - DNA, 18 bp, Homo sapiens
cagaggcagaaccctggt

SEQ ID NO: 6011640 - DNA, 13 bp, Homo sapiens
cagaggcagaggt

SEQ ID NO: 6011641 - DNA, 23 bp, Homo sapiens
cagaggcagcaccaccacacagt

SEQ ID NO: 6011642 - DNA, 18 bp, Homo sapiens
cagaggcagcaggagcca

SEQ ID NO: 6011643 - DNA, 12 bp, Homo sapiens
cagaggcagccc

SEQ ID NO: 6011644 - DNA, 18 bp, Homo sapiens
cagaggcagccccattct

SEQ ID NO: 6011645 - DNA, 23 bp, Homo sapiens
cagaggcagccccattctgcctg

SEQ ID NO: 6011646 - DNA, 19 bp, Homo sapiens
cagaggcagctaaggggca

SEQ ID NO: 6011647 - DNA, 16 bp, Homo sapiens
cagaggcagctgtgtg

SEQ ID NO: 6011648 - DNA, 17 bp, Homo sapiens
cagaggcagctgtgtgg

SEQ ID NO: 6011649 - DNA, 21 bp, Homo sapiens
cagaggcaggaccagaaggca

SEQ ID NO: 6011650 - DNA, 14 bp, Homo sapiens
cagaggcaggctgg

SEQ ID NO: 6011651 - DNA, 12 bp, Homo sapiens
cagaggcagggc

SEQ ID NO: 6011652 - DNA, 19 bp, Homo sapiens
cagtattgggcaggaggaa

SEQ ID NO: 6011653 - DNA, 12 bp, Homo sapiens
cagtattgtaca

SEQ ID NO: 6011654 - DNA, 14 bp, Homo sapiens
cagtattgtgtaaa

SEQ ID NO: 6011655 - DNA, 18 bp, Homo sapiens
cagtattgttcttgtaaa

SEQ ID NO: 6011656 - DNA, 23 bp, Homo sapiens
cagtattgttcttgtaaaactgt

SEQ ID NO: 6011657 - DNA, 12 bp, Homo sapiens
cagtatttaagc

SEQ ID NO: 6011658 - DNA, 15 bp, Homo sapiens
cagtatttaatgaaa

SEQ ID NO: 6011659 - DNA, 18 bp, Homo sapiens
cagtatttaccttccttt

SEQ ID NO: 6011660 - DNA, 23 bp, Homo sapiens
cagtatttaccttcctttgtctt

SEQ ID NO: 6011661 - DNA, 17 bp, Homo sapiens
cagtatttagaagccaa

SEQ ID NO: 6011662 - DNA, 14 bp, Homo sapiens
cagtatttattggt

SEQ ID NO: 6011663 - DNA, 15 bp, Homo sapiens
cagtatttattgttc

SEQ ID NO: 6011664 - DNA, 18 bp, Homo sapiens
cagtatttattgttccca

SEQ ID NO: 6011665 - DNA, 19 bp, Homo sapiens
cagtatttattgttcccac

SEQ ID NO: 6011666 - DNA, 16 bp, Homo sapiens
cagtatttattttgta

SEQ ID NO: 6011667 - DNA, 18 bp, Homo sapiens
cagtatttattttgtaat

SEQ ID NO: 6011668 - DNA, 20 bp, Homo sapiens
cagtatttattttttcaaaa

SEQ ID NO: 6011669 - DNA, 14 bp, Homo sapiens
cagtatttcaactg

SEQ ID NO: 6011670 - DNA, 17 bp, Homo sapiens
cagtatttcaactgctg

SEQ ID NO: 6011671 - DNA, 19 bp, Homo sapiens
cagtatttcaactgctgta

SEQ ID NO: 6011672 - DNA, 21 bp, Homo sapiens
cagtatttcaactgctgtaaa

SEQ ID NO: 6011673 - DNA, 15 bp, Homo sapiens
cagtatttcattgcc

SEQ ID NO: 6011674 - DNA, 20 bp, Homo sapiens
cagtatttctcttttattct

SEQ ID NO: 6011675 - DNA, 14 bp, Homo sapiens
cagtatttgtaatt

SEQ ID NO: 6011676 - DNA, 15 bp, Homo sapiens
cagtatttgtacaaa

SEQ ID NO: 6011677 - DNA, 20 bp, Homo sapiens
cagtattttaaatgaagtga

SEQ ID NO: 6011678 - DNA, 12 bp, Homo sapiens
cagtattttatt

SEQ ID NO: 6011679 - DNA, 15 bp, Homo sapiens
cagtattttattaaa

SEQ ID NO: 6011680 - DNA, 19 bp, Homo sapiens
cagtattttattaaagcaa

SEQ ID NO: 6011681 - DNA, 23 bp, Homo sapiens
cagtattttcccaatagcacttt

SEQ ID NO: 6011682 - DNA, 14 bp, Homo sapiens
cagtattttctgtt

SEQ ID NO: 6011683 - DNA, 18 bp, Homo sapiens
cagtattttctgttttta

SEQ ID NO: 6011684 - DNA, 22 bp, Homo sapiens
cagtattttcttcccaaatcaa

SEQ ID NO: 6011685 - DNA, 17 bp, Homo sapiens
cagtattttggagaaat

SEQ ID NO: 6011686 - DNA, 19 bp, Homo sapiens
cagtattttggagaaatta

SEQ ID NO: 6011687 - DNA, 14 bp, Homo sapiens
cagtattttgtgtc

SEQ ID NO: 6011688 - DNA, 13 bp, Homo sapiens
cagtatttttaaa

SEQ ID NO: 6011689 - DNA, 17 bp, Homo sapiens
cagtatttttaaaggca

SEQ ID NO: 6011690 - DNA, 14 bp, Homo sapiens
cagtatttttatac

SEQ ID NO: 6011691 - DNA, 18 bp, Homo sapiens
cagtatttttcagatata

SEQ ID NO: 6011692 - DNA, 22 bp, Homo sapiens
cagtatttttgttgtgttctgt

SEQ ID NO: 6011693 - DNA, 15 bp, Homo sapiens
cagtcaaaacagaga

SEQ ID NO: 6011694 - DNA, 21 bp, Homo sapiens
cagtcaaaggaacgccttccc

SEQ ID NO: 6011695 - DNA, 16 bp, Homo sapiens
cagtcaacagattcag

SEQ ID NO: 6011696 - DNA, 16 bp, Homo sapiens
cagtcaacctgggcaa

SEQ ID NO: 6011697 - DNA, 21 bp, Homo sapiens
cagtcaacctgggcaaagcct

SEQ ID NO: 6011698 - DNA, 22 bp, Homo sapiens
cagtcaacctgggcaaagccta

SEQ ID NO: 6011699 - DNA, 20 bp, Homo sapiens
cagtcaagacggatccacag

SEQ ID NO: 6011700 - DNA, 17 bp, Homo sapiens
cagtcaaggagtggctt

SEQ ID NO: 6011701 - DNA, 19 bp, Homo sapiens
cagtcaagttccctcctgc

SEQ ID NO: 6011702 - DNA, 20 bp, Homo sapiens
cagtcaagttccctcctgca

SEQ ID NO: 6011703 - DNA, 19 bp, Homo sapiens
cagtcaagttccgtctcct

SEQ ID NO: 6011704 - DNA, 13 bp, Homo sapiens
cagtcaagttgtg

SEQ ID NO: 6011705 - DNA, 15 bp, Homo sapiens
cagtcaatgcattgt

SEQ ID NO: 6011706 - DNA, 21 bp, Homo sapiens
cagtcaatggaagaaatggct

SEQ ID NO: 6011707 - DNA, 17 bp, Homo sapiens
cagtcacaaaccagcct

SEQ ID NO: 6011708 - DNA, 18 bp, Homo sapiens
cagtcacaaaccagcctg

SEQ ID NO: 6011709 - DNA, 21 bp, Homo sapiens
cagtcacaaaccagcctgggg

SEQ ID NO: 6011710 - DNA, 17 bp, Homo sapiens
cagtcacaacagagtga

SEQ ID NO: 6011711 - DNA, 17 bp, Homo sapiens
cagtcacactgctggga

SEQ ID NO: 6011712 - DNA, 18 bp, Homo sapiens
cagtcacactgttactcc

SEQ ID NO: 6011713 - DNA, 23 bp, Homo sapiens
cagtcacactgttactccacagc

SEQ ID NO: 6011714 - DNA, 16 bp, Homo sapiens
cagtcacagccacccc

SEQ ID NO: 6011715 - DNA, 14 bp, Homo sapiens
cagtcacaggccca

SEQ ID NO: 6011716 - DNA, 18 bp, Homo sapiens
cagtcacaggcccaggaa

SEQ ID NO: 6011717 - DNA, 17 bp, Homo sapiens
cagtcacatgacctgat

SEQ ID NO: 6011718 - DNA, 14 bp, Homo sapiens
cagtcacattgcca

SEQ ID NO: 6011719 - DNA, 23 bp, Homo sapiens
cagtcaccaagtgtattgtaatg

SEQ ID NO: 6011720 - DNA, 23 bp, Homo sapiens
cagtcaccaccacccgaaatgcc

SEQ ID NO: 6011721 - DNA, 16 bp, Homo sapiens
cagtcaccacccagcc

SEQ ID NO: 6011722 - DNA, 22 bp, Homo sapiens
cagtcaccacccagcccttcct

SEQ ID NO: 6011723 - DNA, 17 bp, Homo sapiens
cagtcacccactgtcag

SEQ ID NO: 6011724 - DNA, 17 bp, Homo sapiens
cagtcaccccaggactc

SEQ ID NO: 6011725 - DNA, 19 bp, Homo sapiens
cagtcacccccacttccca

SEQ ID NO: 6011726 - DNA, 17 bp, Homo sapiens
cagtcaccccggccacc

SEQ ID NO: 6011727 - DNA, 18 bp, Homo sapiens
cagtcacccctccctccc

SEQ ID NO: 6011728 - DNA, 16 bp, Homo sapiens
cagtcacccctgtctg

SEQ ID NO: 6011729 - DNA, 13 bp, Homo sapiens
cagtcaccctgtg

SEQ ID NO: 6011730 - DNA, 16 bp, Homo sapiens
cagtcacccttctggg

SEQ ID NO: 6011731 - DNA, 14 bp, Homo sapiens
cagtcacctcacaa

SEQ ID NO: 6011732 - DNA, 18 bp, Homo sapiens
cagtcacctcctgctcct

SEQ ID NO: 6011733 - DNA, 22 bp, Homo sapiens
cagtcacctcgtctccctggtg

SEQ ID NO: 6011734 - DNA, 17 bp, Homo sapiens
cagtcacctgcccagat

SEQ ID NO: 6011735 - DNA, 14 bp, Homo sapiens
cagtcaccttctgg

SEQ ID NO: 6011736 - DNA, 17 bp, Homo sapiens
cagtcaccttctgggca

SEQ ID NO: 6011737 - DNA, 22 bp, Homo sapiens
cagtcacgtgaggcccctgtgc

SEQ ID NO: 6011738 - DNA, 21 bp, Homo sapiens
cagtcactccctctgccttca

SEQ ID NO: 6011739 - DNA, 13 bp, Homo sapiens
cagtcactcctct

SEQ ID NO: 6011740 - DNA, 19 bp, Homo sapiens
cagtcactcctctctaggg

SEQ ID NO: 6011741 - DNA, 12 bp, Homo sapiens
cagtcactgctc

SEQ ID NO: 6011742 - DNA, 14 bp, Homo sapiens
cagtcactgctgca

SEQ ID NO: 6011743 - DNA, 16 bp, Homo sapiens
cagtcactgctgcaag

SEQ ID NO: 6011744 - DNA, 17 bp, Homo sapiens
cagtcactgctgcaagg

SEQ ID NO: 6011745 - DNA, 22 bp, Homo sapiens
cagtcactggcccaaccagaac

SEQ ID NO: 6011746 - DNA, 23 bp, Homo sapiens
cagtcacttgggagctgctgggc

SEQ ID NO: 6011747 - DNA, 20 bp, Homo sapiens
cagtcactttttcccctgca

SEQ ID NO: 6011748 - DNA, 19 bp, Homo sapiens
cagtcagaaaactttaaaa

SEQ ID NO: 6011749 - DNA, 16 bp, Homo sapiens
cagtcagaagatcttt

SEQ ID NO: 6011750 - DNA, 21 bp, Homo sapiens
cagtcagaagatctttcttaa

SEQ ID NO: 6011751 - DNA, 19 bp, Homo sapiens
cagtcagaagttctgggtg

SEQ ID NO: 6011752 - DNA, 17 bp, Homo sapiens
cagtcagacgccaggca

SEQ ID NO: 6011753 - DNA, 22 bp, Homo sapiens
cagtcagagtccagtgctctgc

SEQ ID NO: 6011754 - DNA, 20 bp, Homo sapiens
cagtcagatttccagtctcc

SEQ ID NO: 6011755 - DNA, 15 bp, Homo sapiens
cagtcagcacagaga

SEQ ID NO: 6011756 - DNA, 19 bp, Homo sapiens
cagtcagcacagagagcgg

SEQ ID NO: 6011757 - DNA, 12 bp, Homo sapiens
cagtcagcagtc

SEQ ID NO: 6011758 - DNA, 15 bp, Homo sapiens
cagtcagcagtcatg

SEQ ID NO: 6011759 - DNA, 21 bp, Homo sapiens
cagtcagcatgcttcccagag

SEQ ID NO: 6011760 - DNA, 21 bp, Homo sapiens
cagtcagccagcttggtggtt

SEQ ID NO: 6011761 - DNA, 15 bp, Homo sapiens
cagtcagcccagtgg

SEQ ID NO: 6011762 - DNA, 12 bp, Homo sapiens
cagtcagcctct

SEQ ID NO: 6011763 - DNA, 14 bp, Homo sapiens
cagtcagcctctct

SEQ ID NO: 6011764 - DNA, 17 bp, Homo sapiens
cagtcagcctctctccc

SEQ ID NO: 6011765 - DNA, 21 bp, Homo sapiens
cagtcagcggagaggacccca

SEQ ID NO: 6011766 - DNA, 18 bp, Homo sapiens
cagtcagctcttcatctg

SEQ ID NO: 6011767 - DNA, 15 bp, Homo sapiens
cagtcaggaaagaga

SEQ ID NO: 6011768 - DNA, 18 bp, Homo sapiens
cagtcaggaaagagaact

SEQ ID NO: 6011769 - DNA, 22 bp, Homo sapiens
cagtcaggaagcctcctgctga

SEQ ID NO: 6011770 - DNA, 19 bp, Homo sapiens
cagtcaggatgaggccccg

SEQ ID NO: 6011771 - DNA, 17 bp, Homo sapiens
cagtcagggacagcagc

SEQ ID NO: 6011772 - DNA, 21 bp, Homo sapiens
cagtcagggacagcagcctcc

SEQ ID NO: 6011773 - DNA, 22 bp, Homo sapiens
cagtcagggcggggctggccag

SEQ ID NO: 6011774 - DNA, 22 bp, Homo sapiens
cagtcaggggtcaggtgtcagg

SEQ ID NO: 6011775 - DNA, 21 bp, Homo sapiens
cagtcaggtagttgcaattga

SEQ ID NO: 6011776 - DNA, 16 bp, Homo sapiens
cagtcagtaattgcca

SEQ ID NO: 6011777 - DNA, 19 bp, Homo sapiens
cagtcagtgctggagaaat

SEQ ID NO: 6011778 - DNA, 23 bp, Homo sapiens
cagtcagtgctggagaaatcttg

SEQ ID NO: 6011779 - DNA, 18 bp, Homo sapiens
cagtcagttcccggagca

SEQ ID NO: 6011780 - DNA, 15 bp, Homo sapiens
cagtcataactaaat

SEQ ID NO: 6011781 - DNA, 23 bp, Homo sapiens
cagtcatacctgctcctcatctg

SEQ ID NO: 6011782 - DNA, 12 bp, Homo sapiens
cagtcatatttc

SEQ ID NO: 6011783 - DNA, 21 bp, Homo sapiens
cagtcatcaacaatgattaat

SEQ ID NO: 6011784 - DNA, 14 bp, Homo sapiens
cagtcatcaggtgt

SEQ ID NO: 6011785 - DNA, 14 bp, Homo sapiens
cagtcatcatcagg

SEQ ID NO: 6011786 - DNA, 15 bp, Homo sapiens
cagtcatcatcaggg

SEQ ID NO: 6011787 - DNA, 18 bp, Homo sapiens
cagtcatcatcagggcct

SEQ ID NO: 6011788 - DNA, 19 bp, Homo sapiens
cagtcatcatcagggcctg

SEQ ID NO: 6011789 - DNA, 15 bp, Homo sapiens
cagtcatcatctctt

SEQ ID NO: 6011790 - DNA, 14 bp, Homo sapiens
cagtcatcatttat

SEQ ID NO: 6011791 - DNA, 22 bp, Homo sapiens
cagtcatccaggcttacctgct

SEQ ID NO: 6011792 - DNA, 14 bp, Homo sapiens
cagtcatcctgccc

SEQ ID NO: 6011793 - DNA, 17 bp, Homo sapiens
cagtcatcctgccctgc

SEQ ID NO: 6011794 - DNA, 21 bp, Homo sapiens
cagtcatcctgccctgcagca

SEQ ID NO: 6011795 - DNA, 22 bp, Homo sapiens
cagtcatcgtaggtgatttgaa

SEQ ID NO: 6011796 - DNA, 16 bp, Homo sapiens
cagtcatctgtaagag

SEQ ID NO: 6011797 - DNA, 18 bp, Homo sapiens
cagtcatcttgaccaagc

SEQ ID NO: 6011798 - DNA, 16 bp, Homo sapiens
cagtcatgacagatga

SEQ ID NO: 6011799 - DNA, 23 bp, Homo sapiens
cagtcatgagaattacagaaaat

SEQ ID NO: 6011800 - DNA, 21 bp, Homo sapiens
cagtcatgaggaaagacacag

SEQ ID NO: 6011801 - DNA, 12 bp, Homo sapiens
cagtcatgcact

SEQ ID NO: 6011802 - DNA, 16 bp, Homo sapiens
cagtcatgcactcaca

SEQ ID NO: 6011803 - DNA, 16 bp, Homo sapiens
cagtcatgcataaata

SEQ ID NO: 6011804 - DNA, 20 bp, Homo sapiens
cagtcatgcgtccactttcc

SEQ ID NO: 6011805 - DNA, 24 bp, Homo sapiens
cagtcatggcaccaaagccaccag

SEQ ID NO: 6011806 - DNA, 21 bp, Homo sapiens
cagtcatggtactaccccagc

SEQ ID NO: 6011807 - DNA, 15 bp, Homo sapiens
cagtcatggtggcac

SEQ ID NO: 6011808 - DNA, 13 bp, Homo sapiens
cagtcattatgag

SEQ ID NO: 6011809 - DNA, 18 bp, Homo sapiens
cagtcattatttaaagca

SEQ ID NO: 6011810 - DNA, 23 bp, Homo sapiens
cagtcattctaggatgtggagct

SEQ ID NO: 6011811 - DNA, 17 bp, Homo sapiens
cagtcattggctgtctc

SEQ ID NO: 6011812 - DNA, 21 bp, Homo sapiens
cagtcattgggttttatcagt

SEQ ID NO: 6011813 - DNA, 11 bp, Homo sapiens
cagtcatttaa

SEQ ID NO: 6011814 - DNA, 21 bp, Homo sapiens
cagtcatttttcagacctttt

SEQ ID NO: 6011815 - DNA, 21 bp, Homo sapiens
cagtcatttttgtttctacct

SEQ ID NO: 6011816 - DNA, 17 bp, Homo sapiens
cagtccaaatgtcctcc

SEQ ID NO: 6011817 - DNA, 11 bp, Homo sapiens
cagtccacagc

SEQ ID NO: 6011818 - DNA, 14 bp, Homo sapiens
cagtccacaggggc

SEQ ID NO: 6011819 - DNA, 17 bp, Homo sapiens
cagtccacaggggccac

SEQ ID NO: 6011820 - DNA, 15 bp, Homo sapiens
cagtccactggggag

SEQ ID NO: 6011821 - DNA, 22 bp, Homo sapiens
cagtccactggggagtgctgga

SEQ ID NO: 6011822 - DNA, 21 bp, Homo sapiens
cagtccactgttgagccccag

SEQ ID NO: 6011823 - DNA, 18 bp, Homo sapiens
cagtccacttctgacagc

SEQ ID NO: 6011824 - DNA, 19 bp, Homo sapiens
cagtccagaataagtgctg

SEQ ID NO: 6011825 - DNA, 20 bp, Homo sapiens
cagtccagaataagtgctgt

SEQ ID NO: 6011826 - DNA, 16 bp, Homo sapiens
cagtccagacccaagt

SEQ ID NO: 6011827 - DNA, 17 bp, Homo sapiens
cagtccagacccaagtc

SEQ ID NO: 6011828 - DNA, 10 bp, Homo sapiens
cagtccagag

SEQ ID NO: 6011829 - DNA, 16 bp, Homo sapiens
cagaggcagggcagca

SEQ ID NO: 6011830 - DNA, 18 bp, Homo sapiens
cagaggcagtggcagcaa

SEQ ID NO: 6011831 - DNA, 19 bp, Homo sapiens
cagaggcattggaggatgg

SEQ ID NO: 6011832 - DNA, 20 bp, Homo sapiens
cagaggcattggaggatggg

SEQ ID NO: 6011833 - DNA, 13 bp, Homo sapiens
cagaggcatttga

SEQ ID NO: 6011834 - DNA, 17 bp, Homo sapiens
cagaggccaacactgtg

SEQ ID NO: 6011835 - DNA, 16 bp, Homo sapiens
cagaggccaaggactg

SEQ ID NO: 6011836 - DNA, 14 bp, Homo sapiens
cagaggccagaccc

SEQ ID NO: 6011837 - DNA, 15 bp, Homo sapiens
cagaggccagaccca

SEQ ID NO: 6011838 - DNA, 19 bp, Homo sapiens
cagaggccatgggcctcct

SEQ ID NO: 6011839 - DNA, 14 bp, Homo sapiens
cagaggcccaggct

SEQ ID NO: 6011840 - DNA, 18 bp, Homo sapiens
cagaggcccaggctgccg

SEQ ID NO: 6011841 - DNA, 14 bp, Homo sapiens
cagaggccccacct

SEQ ID NO: 6011842 - DNA, 14 bp, Homo sapiens
cagaggccccagcc

SEQ ID NO: 6011843 - DNA, 17 bp, Homo sapiens
cagaggccccagcctcc

SEQ ID NO: 6011844 - DNA, 23 bp, Homo sapiens
cagaggcccccagcccagggctc

SEQ ID NO: 6011845 - DNA, 17 bp, Homo sapiens
cagaggcccccagtggg

SEQ ID NO: 6011846 - DNA, 16 bp, Homo sapiens
cagaggccccttgctg

SEQ ID NO: 6011847 - DNA, 19 bp, Homo sapiens
cagaggccccttgctgctg

SEQ ID NO: 6011848 - DNA, 23 bp, Homo sapiens
cagaggccccttgctgctggctc

SEQ ID NO: 6011849 - DNA, 22 bp, Homo sapiens
cagaggccctaggcgggatggg

SEQ ID NO: 6011850 - DNA, 12 bp, Homo sapiens
cagaggccctca

SEQ ID NO: 6011851 - DNA, 21 bp, Homo sapiens
cagaggccctcaagtctttct

SEQ ID NO: 6011852 - DNA, 19 bp, Homo sapiens
cagaggccctcgctgccag

SEQ ID NO: 6011853 - DNA, 20 bp, Homo sapiens
cagaggccctcgctgccagc

SEQ ID NO: 6011854 - DNA, 23 bp, Homo sapiens
cagaggccctgaagcctccgtgg

SEQ ID NO: 6011855 - DNA, 12 bp, Homo sapiens
cagaggccctgc

SEQ ID NO: 6011856 - DNA, 15 bp, Homo sapiens
cagaggccctgcccc

SEQ ID NO: 6011857 - DNA, 14 bp, Homo sapiens
cagaggccctggag

SEQ ID NO: 6011858 - DNA, 22 bp, Homo sapiens
cagaggccgaaggtgcctcaga

SEQ ID NO: 6011859 - DNA, 23 bp, Homo sapiens
cagaggccgaaggtgcctcagac

SEQ ID NO: 6011860 - DNA, 21 bp, Homo sapiens
cagaggccgcgcgtccagctg

SEQ ID NO: 6011861 - DNA, 16 bp, Homo sapiens
cagaggccgctctggg

SEQ ID NO: 6011862 - DNA, 23 bp, Homo sapiens
cagaggccgctgcccctgagttc

SEQ ID NO: 6011863 - DNA, 17 bp, Homo sapiens
cagaggccggggtccag

SEQ ID NO: 6011864 - DNA, 22 bp, Homo sapiens
cagaggccggggtccaggcccg

SEQ ID NO: 6011865 - DNA, 16 bp, Homo sapiens
cagaggcctcctgtgg

SEQ ID NO: 6011866 - DNA, 12 bp, Homo sapiens
cagaggcctctt

SEQ ID NO: 6011867 - DNA, 14 bp, Homo sapiens
cagaggcctgcagg

SEQ ID NO: 6011868 - DNA, 18 bp, Homo sapiens
cagaggcctgcagggcct

SEQ ID NO: 6011869 - DNA, 22 bp, Homo sapiens
cagaggcctggcatcttctgga

SEQ ID NO: 6011870 - DNA, 23 bp, Homo sapiens
cagaggcctgggggacccctggc

SEQ ID NO: 6011871 - DNA, 13 bp, Homo sapiens
cagaggcctggtg

SEQ ID NO: 6011872 - DNA, 18 bp, Homo sapiens
cagaggcctggtgccctg

SEQ ID NO: 6011873 - DNA, 20 bp, Homo sapiens
cagaggcctggtgccctggc

SEQ ID NO: 6011874 - DNA, 21 bp, Homo sapiens
cagaggcctgttttggggctt

SEQ ID NO: 6011875 - DNA, 15 bp, Homo sapiens
cagaggccttgctgt

SEQ ID NO: 6011876 - DNA, 21 bp, Homo sapiens
cagaggccttgctgtggagct

SEQ ID NO: 6011877 - DNA, 18 bp, Homo sapiens
cagaggcggaaaccttgc

SEQ ID NO: 6011878 - DNA, 21 bp, Homo sapiens
cagaggcggaaaccttgcagc

SEQ ID NO: 6011879 - DNA, 14 bp, Homo sapiens
cagaggcggctctg

SEQ ID NO: 6011880 - DNA, 16 bp, Homo sapiens
cagaggcggctctggt

SEQ ID NO: 6011881 - DNA, 20 bp, Homo sapiens
cagaggcgtactacccagct

SEQ ID NO: 6011882 - DNA, 21 bp, Homo sapiens
cagaggcgtactacccagctc

SEQ ID NO: 6011883 - DNA, 24 bp, Homo sapiens
cagaggcgtactacccagctctgt

SEQ ID NO: 6011884 - DNA, 15 bp, Homo sapiens
cagaggcgtcccgca

SEQ ID NO: 6011885 - DNA, 22 bp, Homo sapiens
cagaggcgtcccgcacctgtct

SEQ ID NO: 6011886 - DNA, 20 bp, Homo sapiens
cagaggctactcttgactta

SEQ ID NO: 6011887 - DNA, 21 bp, Homo sapiens
cagaggctcagattgtaatat

SEQ ID NO: 6011888 - DNA, 14 bp, Homo sapiens
cagaggctgagccc

SEQ ID NO: 6011889 - DNA, 22 bp, Homo sapiens
cagaggctgagttttctctttg

SEQ ID NO: 6011890 - DNA, 12 bp, Homo sapiens
cagaggctgcag

SEQ ID NO: 6011891 - DNA, 17 bp, Homo sapiens
cagaggctgcaggactt

SEQ ID NO: 6011892 - DNA, 13 bp, Homo sapiens
cagaggctggagg

SEQ ID NO: 6011893 - DNA, 21 bp, Homo sapiens
cagaggctggaggcagggcct

SEQ ID NO: 6011894 - DNA, 20 bp, Homo sapiens
cagaggctggcaccatggtg

SEQ ID NO: 6011895 - DNA, 14 bp, Homo sapiens
cagaggctggcctc

SEQ ID NO: 6011896 - DNA, 17 bp, Homo sapiens
cagaggctggcctcaga

SEQ ID NO: 6011897 - DNA, 13 bp, Homo sapiens
cagaggctgggag

SEQ ID NO: 6011898 - DNA, 15 bp, Homo sapiens
cagaggctgggagca

SEQ ID NO: 6011899 - DNA, 16 bp, Homo sapiens
cagaggctgggagcat

SEQ ID NO: 6011900 - DNA, 12 bp, Homo sapiens
cagaggctgggt

SEQ ID NO: 6011901 - DNA, 17 bp, Homo sapiens
cagaggctgtggctggt

SEQ ID NO: 6011902 - DNA, 17 bp, Homo sapiens
cagaggctgtggtcaga

SEQ ID NO: 6011903 - DNA, 20 bp, Homo sapiens
cagaggctgtggtcagagag

SEQ ID NO: 6011904 - DNA, 23 bp, Homo sapiens
cagaggcttccgtgtcctctccc

SEQ ID NO: 6011905 - DNA, 17 bp, Homo sapiens
cagaggcttttccagtg

SEQ ID NO: 6011906 - DNA, 19 bp, Homo sapiens
cagagggaaaggctgaaca

SEQ ID NO: 6011907 - DNA, 13 bp, Homo sapiens
cagagggaagcca

SEQ ID NO: 6011908 - DNA, 19 bp, Homo sapiens
cagagggaagccagtcagg

SEQ ID NO: 6011909 - DNA, 23 bp, Homo sapiens
cagagggaagccagtcagggccc

SEQ ID NO: 6011910 - DNA, 18 bp, Homo sapiens
cagagggaagccatgtgg

SEQ ID NO: 6011911 - DNA, 18 bp, Homo sapiens
cagagggaatgttccctg

SEQ ID NO: 6011912 - DNA, 23 bp, Homo sapiens
cagagggaatgttccctgcaccc

SEQ ID NO: 6011913 - DNA, 21 bp, Homo sapiens
cagagggacaaccagaaggcc

SEQ ID NO: 6011914 - DNA, 23 bp, Homo sapiens
cagagggacaaccagaaggccct

SEQ ID NO: 6011915 - DNA, 16 bp, Homo sapiens
cagagggacagtgggc

SEQ ID NO: 6011916 - DNA, 22 bp, Homo sapiens
cagagggacagtgggctatgcc

SEQ ID NO: 6011917 - DNA, 23 bp, Homo sapiens
cagagggacagtgggctatgcca

SEQ ID NO: 6011918 - DNA, 20 bp, Homo sapiens
cagagggaccaaattgcttc

SEQ ID NO: 6011919 - DNA, 23 bp, Homo sapiens
cagagggaccaaattgcttctag

SEQ ID NO: 6011920 - DNA, 12 bp, Homo sapiens
cagagggaccag

SEQ ID NO: 6011921 - DNA, 18 bp, Homo sapiens
cagagggactggacagcc

SEQ ID NO: 6011922 - DNA, 17 bp, Homo sapiens
cagagggactgtcagct

SEQ ID NO: 6011923 - DNA, 20 bp, Homo sapiens
cagagggactgtcagctgag

SEQ ID NO: 6011924 - DNA, 18 bp, Homo sapiens
cagagggagacggccctg

SEQ ID NO: 6011925 - DNA, 13 bp, Homo sapiens
cagagggagcagg

SEQ ID NO: 6011926 - DNA, 17 bp, Homo sapiens
cagagggagctggaacc

SEQ ID NO: 6011927 - DNA, 16 bp, Homo sapiens
cagagggagtgacaga

SEQ ID NO: 6011928 - DNA, 21 bp, Homo sapiens
cagagggagtgacagaggcag

SEQ ID NO: 6011929 - DNA, 23 bp, Homo sapiens
cagagggagtgacagaggcagcc

SEQ ID NO: 6011930 - DNA, 12 bp, Homo sapiens
cagagggagttt

SEQ ID NO: 6011931 - DNA, 18 bp, Homo sapiens
cagagggatctaggtctt

SEQ ID NO: 6011932 - DNA, 24 bp, Homo sapiens
cagagggcacatgaacagcttgcc

SEQ ID NO: 6011933 - DNA, 16 bp, Homo sapiens
cagagggcagaggctg

SEQ ID NO: 6011934 - DNA, 17 bp, Homo sapiens
cagagggcagaggctgg

SEQ ID NO: 6011935 - DNA, 18 bp, Homo sapiens
cagagggcagaggctgga

SEQ ID NO: 6011936 - DNA, 12 bp, Homo sapiens
cagagggcagtc

SEQ ID NO: 6011937 - DNA, 19 bp, Homo sapiens
cagagggccaagagagaca

SEQ ID NO: 6011938 - DNA, 13 bp, Homo sapiens
cagagggccagag

SEQ ID NO: 6011939 - DNA, 16 bp, Homo sapiens
cagagggccagagcta

SEQ ID NO: 6011940 - DNA, 17 bp, Homo sapiens
cagagggccagagctag

SEQ ID NO: 6011941 - DNA, 16 bp, Homo sapiens
cagagggccagcaggc

SEQ ID NO: 6011942 - DNA, 15 bp, Homo sapiens
cagagggcccctcac

SEQ ID NO: 6011943 - DNA, 22 bp, Homo sapiens
cagagggcgccaccaccacctg

SEQ ID NO: 6011944 - DNA, 16 bp, Homo sapiens
cagagggcgctcctgt

SEQ ID NO: 6011945 - DNA, 14 bp, Homo sapiens
cagagggctaggga

SEQ ID NO: 6011946 - DNA, 10 bp, Homo sapiens
cagagggctg

SEQ ID NO: 6011947 - DNA, 12 bp, Homo sapiens
cagagggctgga

SEQ ID NO: 6011948 - DNA, 17 bp, Homo sapiens
cagagggctggaggccc

SEQ ID NO: 6011949 - DNA, 20 bp, Homo sapiens
cagagggctggaggcccagg

SEQ ID NO: 6011950 - DNA, 19 bp, Homo sapiens
cagagggctttcagcgccc

SEQ ID NO: 6011951 - DNA, 15 bp, Homo sapiens
cagaggggaatgagg

SEQ ID NO: 6011952 - DNA, 12 bp, Homo sapiens
cagaggggacag

SEQ ID NO: 6011953 - DNA, 21 bp, Homo sapiens
cagaggggacagagttcaggg

SEQ ID NO: 6011954 - DNA, 20 bp, Homo sapiens
cagaggggacgctgaggaag

SEQ ID NO: 6011955 - DNA, 14 bp, Homo sapiens
cagaggggactctg

SEQ ID NO: 6011956 - DNA, 17 bp, Homo sapiens
cagaggggactctgacc

SEQ ID NO: 6011957 - DNA, 16 bp, Homo sapiens
cagaggggactctggg

SEQ ID NO: 6011958 - DNA, 17 bp, Homo sapiens
cagaggggactctgggc

SEQ ID NO: 6011959 - DNA, 16 bp, Homo sapiens
cagaggggagaggaag

SEQ ID NO: 6011960 - DNA, 11 bp, Homo sapiens
cagaggggagc

SEQ ID NO: 6011961 - DNA, 12 bp, Homo sapiens
cagaggggagca

SEQ ID NO: 6011962 - DNA, 21 bp, Homo sapiens
cagaggggagcagcggctctg

SEQ ID NO: 6011963 - DNA, 19 bp, Homo sapiens
cagaggggatggggataga

SEQ ID NO: 6011964 - DNA, 14 bp, Homo sapiens
cagaggggcagatg

SEQ ID NO: 6011965 - DNA, 15 bp, Homo sapiens
cagaggggcagccgc

SEQ ID NO: 6011966 - DNA, 16 bp, Homo sapiens
cagaggggcagccgct

SEQ ID NO: 6011967 - DNA, 12 bp, Homo sapiens
cagaggggcagg

SEQ ID NO: 6011968 - DNA, 18 bp, Homo sapiens
cagaggggcaggccctgc

SEQ ID NO: 6011969 - DNA, 18 bp, Homo sapiens
cagaggggccaggcccag

SEQ ID NO: 6011970 - DNA, 19 bp, Homo sapiens
cagaggggccaggcccagg

SEQ ID NO: 6011971 - DNA, 20 bp, Homo sapiens
cagaggggccaggcccaggc

SEQ ID NO: 6011972 - DNA, 14 bp, Homo sapiens
cagaggggcctgcc

SEQ ID NO: 6011973 - DNA, 17 bp, Homo sapiens
cagaggggcggggccag

SEQ ID NO: 6011974 - DNA, 21 bp, Homo sapiens
cagaggggcggggccaggatg

SEQ ID NO: 6011975 - DNA, 18 bp, Homo sapiens
cagaggggctttctggag

SEQ ID NO: 6011976 - DNA, 23 bp, Homo sapiens
cagagggggccagagggactttg

SEQ ID NO: 6011977 - DNA, 23 bp, Homo sapiens
cagagggggcgtgcctgccaagc

SEQ ID NO: 6011978 - DNA, 16 bp, Homo sapiens
cagagggggtggcctc

SEQ ID NO: 6011979 - DNA, 18 bp, Homo sapiens
cagagggggtggcctccc

SEQ ID NO: 6011980 - DNA, 23 bp, Homo sapiens
cagagggggtggcctcccaactc

SEQ ID NO: 6011981 - DNA, 15 bp, Homo sapiens
cagaggggtaggcag

SEQ ID NO: 6011982 - DNA, 19 bp, Homo sapiens
cagagggtcccattgtgca

SEQ ID NO: 6011983 - DNA, 17 bp, Homo sapiens
cagagggtctgggggca

SEQ ID NO: 6011984 - DNA, 19 bp, Homo sapiens
cagagggtgggaggggcca

SEQ ID NO: 6011985 - DNA, 15 bp, Homo sapiens
cagagggtgtggctt

SEQ ID NO: 6011986 - DNA, 19 bp, Homo sapiens
cagagggtgtggctttcca

SEQ ID NO: 6011987 - DNA, 17 bp, Homo sapiens
cagagggtttggaccac

SEQ ID NO: 6011988 - DNA, 13 bp, Homo sapiens
cagaggtaaaaaa

SEQ ID NO: 6011989 - DNA, 14 bp, Homo sapiens
cagaggtaaaaaaa

SEQ ID NO: 6011990 - DNA, 16 bp, Homo sapiens
cagaggtaaaaaaaag

SEQ ID NO: 6011991 - DNA, 20 bp, Homo sapiens
cagaggtaaaaaaaagaagt

SEQ ID NO: 6011992 - DNA, 14 bp, Homo sapiens
cagaggtaccctgg

SEQ ID NO: 6011993 - DNA, 18 bp, Homo sapiens
cagaggtagggctgccac

SEQ ID NO: 6011994 - DNA, 23 bp, Homo sapiens
cagaggtatcctctttttgctcc

SEQ ID NO: 6011995 - DNA, 13 bp, Homo sapiens
cagaggtcacttc

SEQ ID NO: 6011996 - DNA, 15 bp, Homo sapiens
cagaggtccacaaca

SEQ ID NO: 6011997 - DNA, 15 bp, Homo sapiens
cagaggtccagccca

SEQ ID NO: 6011998 - DNA, 17 bp, Homo sapiens
cagaggtccagcccatc

SEQ ID NO: 6011999 - DNA, 14 bp, Homo sapiens
cagaggtccaggtc

SEQ ID NO: 6012000 - DNA, 15 bp, Homo sapiens
cagaggtccaggtcc

SEQ ID NO: 6012001 - DNA, 22 bp, Homo sapiens
cagaggtccaggtcccagcccc

SEQ ID NO: 6012002 - DNA, 15 bp, Homo sapiens
cagaggtcccagccc

SEQ ID NO: 6012003 - DNA, 19 bp, Homo sapiens
cagaggtcccagccccagg

SEQ ID NO: 6012004 - DNA, 13 bp, Homo sapiens
cagaggtcccctg

SEQ ID NO: 6012005 - DNA, 19 bp, Homo sapiens
cagaggtcgcagctaccct

SEQ ID NO: 6012006 - DNA, 11 bp, Homo sapiens
cagaggtctcc

SEQ ID NO: 6012007 - DNA, 16 bp, Homo sapiens
cagtccagatgccttc

SEQ ID NO: 6012008 - DNA, 20 bp, Homo sapiens
cagtccagatgccttcctgt

SEQ ID NO: 6012009 - DNA, 16 bp, Homo sapiens
cagtccagcaaataaa

SEQ ID NO: 6012010 - DNA, 14 bp, Homo sapiens
cagtccagcctgga

SEQ ID NO: 6012011 - DNA, 20 bp, Homo sapiens
cagtccagtcaagaaaagaa

SEQ ID NO: 6012012 - DNA, 20 bp, Homo sapiens
cagtccagtcctatctgggc

SEQ ID NO: 6012013 - DNA, 15 bp, Homo sapiens
cagtccagtgagaaa

SEQ ID NO: 6012014 - DNA, 19 bp, Homo sapiens
cagtccagtgtcacctctc

SEQ ID NO: 6012015 - DNA, 23 bp, Homo sapiens
cagtccagtgtcacctctctcag

SEQ ID NO: 6012016 - DNA, 15 bp, Homo sapiens
cagtccatgctccag

SEQ ID NO: 6012017 - DNA, 23 bp, Homo sapiens
cagtccatgctccagggtcaggc

SEQ ID NO: 6012018 - DNA, 18 bp, Homo sapiens
cagtccatttatatatga

SEQ ID NO: 6012019 - DNA, 21 bp, Homo sapiens
cagtcccaagcggtgtctctc

SEQ ID NO: 6012020 - DNA, 15 bp, Homo sapiens
cagtcccacaccgct

SEQ ID NO: 6012021 - DNA, 13 bp, Homo sapiens
cagtcccacactg

SEQ ID NO: 6012022 - DNA, 17 bp, Homo sapiens
cagtcccacactgtgca

SEQ ID NO: 6012023 - DNA, 24 bp, Homo sapiens
cagtcccacactgtgcagacccag

SEQ ID NO: 6012024 - DNA, 16 bp, Homo sapiens
cagtcccacagcccct

SEQ ID NO: 6012025 - DNA, 15 bp, Homo sapiens
cagtcccaccctgct

SEQ ID NO: 6012026 - DNA, 19 bp, Homo sapiens
cagtcccaccctgctgctg

SEQ ID NO: 6012027 - DNA, 13 bp, Homo sapiens
cagtcccacggct

SEQ ID NO: 6012028 - DNA, 22 bp, Homo sapiens
cagtcccactaaggtgaccaga

SEQ ID NO: 6012029 - DNA, 14 bp, Homo sapiens
cagtcccagagcag

SEQ ID NO: 6012030 - DNA, 15 bp, Homo sapiens
cagtcccagcagcca

SEQ ID NO: 6012031 - DNA, 18 bp, Homo sapiens
cagtcccagcagccagcc

SEQ ID NO: 6012032 - DNA, 12 bp, Homo sapiens
cagtcccagcct

SEQ ID NO: 6012033 - DNA, 13 bp, Homo sapiens
cagtcccagcctc

SEQ ID NO: 6012034 - DNA, 22 bp, Homo sapiens
cagtcccagcctctggggcaga

SEQ ID NO: 6012035 - DNA, 13 bp, Homo sapiens
cagtcccaggggc

SEQ ID NO: 6012036 - DNA, 18 bp, Homo sapiens
cagtcccaggtttagtga

SEQ ID NO: 6012037 - DNA, 22 bp, Homo sapiens
cagtcccagtattctcagagca

SEQ ID NO: 6012038 - DNA, 19 bp, Homo sapiens
cagtcccattcctccactc

SEQ ID NO: 6012039 - DNA, 21 bp, Homo sapiens
cagtcccattcctccactctg

SEQ ID NO: 6012040 - DNA, 19 bp, Homo sapiens
cagtccccaacctgcactc

SEQ ID NO: 6012041 - DNA, 13 bp, Homo sapiens
cagtccccacccc

SEQ ID NO: 6012042 - DNA, 18 bp, Homo sapiens
cagtccccacccctgccc

SEQ ID NO: 6012043 - DNA, 20 bp, Homo sapiens
cagtccccacccctgccccc

SEQ ID NO: 6012044 - DNA, 15 bp, Homo sapiens
cagtccccagaactc

SEQ ID NO: 6012045 - DNA, 20 bp, Homo sapiens
cagtccccagaactctgcct

SEQ ID NO: 6012046 - DNA, 21 bp, Homo sapiens
cagtccccagaactctgcctg

SEQ ID NO: 6012047 - DNA, 12 bp, Homo sapiens
cagtccccagcc

SEQ ID NO: 6012048 - DNA, 17 bp, Homo sapiens
cagtccccagcccttct

SEQ ID NO: 6012049 - DNA, 19 bp, Homo sapiens
cagtccccagcccttctgc

SEQ ID NO: 6012050 - DNA, 13 bp, Homo sapiens
cagtcccccaccc

SEQ ID NO: 6012051 - DNA, 18 bp, Homo sapiens
cagtcccccacccacctc

SEQ ID NO: 6012052 - DNA, 19 bp, Homo sapiens
cagtcccccacccacctcc

SEQ ID NO: 6012053 - DNA, 23 bp, Homo sapiens
cagtcccccacccacctcctgcg

SEQ ID NO: 6012054 - DNA, 14 bp, Homo sapiens
cagtccccccaccc

SEQ ID NO: 6012055 - DNA, 19 bp, Homo sapiens
cagtccccctatccttggc

SEQ ID NO: 6012056 - DNA, 14 bp, Homo sapiens
cagtccccctgtgc

SEQ ID NO: 6012057 - DNA, 12 bp, Homo sapiens
cagtccccgagg

SEQ ID NO: 6012058 - DNA, 13 bp, Homo sapiens
cagtccccgagga

SEQ ID NO: 6012059 - DNA, 15 bp, Homo sapiens
cagtcccctcccatc

SEQ ID NO: 6012060 - DNA, 17 bp, Homo sapiens
cagtcccctcccatctg

SEQ ID NO: 6012061 - DNA, 14 bp, Homo sapiens
cagtcccctctctc

SEQ ID NO: 6012062 - DNA, 15 bp, Homo sapiens
cagtcccgcgtgcaa

SEQ ID NO: 6012063 - DNA, 14 bp, Homo sapiens
cagtcccgtggagg

SEQ ID NO: 6012064 - DNA, 17 bp, Homo sapiens
cagtcccgtggagggta

SEQ ID NO: 6012065 - DNA, 15 bp, Homo sapiens
cagtccctatgtatt

SEQ ID NO: 6012066 - DNA, 16 bp, Homo sapiens
cagtccctccctcctg

SEQ ID NO: 6012067 - DNA, 14 bp, Homo sapiens
cagtccctcctgtt

SEQ ID NO: 6012068 - DNA, 19 bp, Homo sapiens
cagtccctctggaaagaaa

SEQ ID NO: 6012069 - DNA, 22 bp, Homo sapiens
cagtccctcttctggtttccct

SEQ ID NO: 6012070 - DNA, 20 bp, Homo sapiens
cagtccctgaggcaggtccc

SEQ ID NO: 6012071 - DNA, 14 bp, Homo sapiens
cagtccctgctggg

SEQ ID NO: 6012072 - DNA, 12 bp, Homo sapiens
cagtccctgctt

SEQ ID NO: 6012073 - DNA, 16 bp, Homo sapiens
cagtcccttgctgaca

SEQ ID NO: 6012074 - DNA, 16 bp, Homo sapiens
cagtccctttaaagaa

SEQ ID NO: 6012075 - DNA, 21 bp, Homo sapiens
cagtccgccccgtgctcctct

SEQ ID NO: 6012076 - DNA, 21 bp, Homo sapiens
cagtccgcctggccggctcca

SEQ ID NO: 6012077 - DNA, 16 bp, Homo sapiens
cagtccggtgccttcc

SEQ ID NO: 6012078 - DNA, 19 bp, Homo sapiens
cagtccggtgccttccacc

SEQ ID NO: 6012079 - DNA, 17 bp, Homo sapiens
cagtccgtccaccacct

SEQ ID NO: 6012080 - DNA, 20 bp, Homo sapiens
cagtccgtgtggatccaatg

SEQ ID NO: 6012081 - DNA, 16 bp, Homo sapiens
cagtccgttgctgaaa

SEQ ID NO: 6012082 - DNA, 20 bp, Homo sapiens
cagtcctactcaagcgggtg

SEQ ID NO: 6012083 - DNA, 17 bp, Homo sapiens
cagtcctagaatgtttc

SEQ ID NO: 6012084 - DNA, 23 bp, Homo sapiens
cagtcctagagctcctgtcccta

SEQ ID NO: 6012085 - DNA, 18 bp, Homo sapiens
cagtcctagctcttacac

SEQ ID NO: 6012086 - DNA, 18 bp, Homo sapiens
cagtcctagctgcacagg

SEQ ID NO: 6012087 - DNA, 19 bp, Homo sapiens
cagtcctaggcccctgccc

SEQ ID NO: 6012088 - DNA, 21 bp, Homo sapiens
cagtcctatctgggcttcctg

SEQ ID NO: 6012089 - DNA, 16 bp, Homo sapiens
cagtcctatgtacaga

SEQ ID NO: 6012090 - DNA, 24 bp, Homo sapiens
cagtcctcacacacggaggccaga

SEQ ID NO: 6012091 - DNA, 14 bp, Homo sapiens
cagtcctcaggcag

SEQ ID NO: 6012092 - DNA, 15 bp, Homo sapiens
cagtcctccatccac

SEQ ID NO: 6012093 - DNA, 14 bp, Homo sapiens
cagtcctcccatct

SEQ ID NO: 6012094 - DNA, 15 bp, Homo sapiens
cagtcctcccctcac

SEQ ID NO: 6012095 - DNA, 21 bp, Homo sapiens
cagtcctcccctcacagcctc

SEQ ID NO: 6012096 - DNA, 15 bp, Homo sapiens
cagtcctcctgggag

SEQ ID NO: 6012097 - DNA, 18 bp, Homo sapiens
cagtcctcggcagctccg

SEQ ID NO: 6012098 - DNA, 22 bp, Homo sapiens
cagtcctctccacctagtggct

SEQ ID NO: 6012099 - DNA, 16 bp, Homo sapiens
cagtcctgaagcagca

SEQ ID NO: 6012100 - DNA, 19 bp, Homo sapiens
cagtcctgagtgggtgttg

SEQ ID NO: 6012101 - DNA, 18 bp, Homo sapiens
cagtcctgccaccaccct

SEQ ID NO: 6012102 - DNA, 11 bp, Homo sapiens
cagtcctgcct

SEQ ID NO: 6012103 - DNA, 13 bp, Homo sapiens
cagtcctgcctga

SEQ ID NO: 6012104 - DNA, 14 bp, Homo sapiens
cagtcctgcctgaa

SEQ ID NO: 6012105 - DNA, 16 bp, Homo sapiens
cagtcctgcctgaaca

SEQ ID NO: 6012106 - DNA, 14 bp, Homo sapiens
cagtcctgcctggc

SEQ ID NO: 6012107 - DNA, 13 bp, Homo sapiens
cagtcctgctcca

SEQ ID NO: 6012108 - DNA, 15 bp, Homo sapiens
cagtcctgctccaga

SEQ ID NO: 6012109 - DNA, 16 bp, Homo sapiens
cagtcctgctccagaa

SEQ ID NO: 6012110 - DNA, 18 bp, Homo sapiens
cagtcctgctctctaccc

SEQ ID NO: 6012111 - DNA, 23 bp, Homo sapiens
cagtcctgctctctacccagccc

SEQ ID NO: 6012112 - DNA, 12 bp, Homo sapiens
cagtcctgctgc

SEQ ID NO: 6012113 - DNA, 14 bp, Homo sapiens
cagtcctgctgcct

SEQ ID NO: 6012114 - DNA, 14 bp, Homo sapiens
cagtcctgctggcc

SEQ ID NO: 6012115 - DNA, 18 bp, Homo sapiens
cagtcctgctggcctgct

SEQ ID NO: 6012116 - DNA, 20 bp, Homo sapiens
cagtcctgctggcctgctct

SEQ ID NO: 6012117 - DNA, 11 bp, Homo sapiens
cagtcctggaa

SEQ ID NO: 6012118 - DNA, 17 bp, Homo sapiens
cagtcctggaagccagc

SEQ ID NO: 6012119 - DNA, 14 bp, Homo sapiens
cagtcctggaggca

SEQ ID NO: 6012120 - DNA, 21 bp, Homo sapiens
cagtcctggaggcagggggtg

SEQ ID NO: 6012121 - DNA, 14 bp, Homo sapiens
cagtcctggccccc

SEQ ID NO: 6012122 - DNA, 19 bp, Homo sapiens
cagtcctggcctggcttct

SEQ ID NO: 6012123 - DNA, 12 bp, Homo sapiens
cagtcctgggag

SEQ ID NO: 6012124 - DNA, 21 bp, Homo sapiens
cagtcctgggagaacctcagg

SEQ ID NO: 6012125 - DNA, 21 bp, Homo sapiens
cagtcctggggaggtctgagt

SEQ ID NO: 6012126 - DNA, 13 bp, Homo sapiens
cagtcctggtcct

SEQ ID NO: 6012127 - DNA, 14 bp, Homo sapiens
cagtcctggtcctg

SEQ ID NO: 6012128 - DNA, 17 bp, Homo sapiens
cagtcctggtcctggct

SEQ ID NO: 6012129 - DNA, 20 bp, Homo sapiens
cagtcctggtctgctcagga

SEQ ID NO: 6012130 - DNA, 18 bp, Homo sapiens
cagtcctggttcagtggg

SEQ ID NO: 6012131 - DNA, 20 bp, Homo sapiens
cagtcctggttgtctgaacc

SEQ ID NO: 6012132 - DNA, 13 bp, Homo sapiens
cagtcctgttcaa

SEQ ID NO: 6012133 - DNA, 14 bp, Homo sapiens
cagtcctgttcaaa

SEQ ID NO: 6012134 - DNA, 16 bp, Homo sapiens
cagtcctgttcaaatt

SEQ ID NO: 6012135 - DNA, 15 bp, Homo sapiens
cagtccttaccagca

SEQ ID NO: 6012136 - DNA, 20 bp, Homo sapiens
cagtccttactcccccacca

SEQ ID NO: 6012137 - DNA, 19 bp, Homo sapiens
cagtccttattatcccagc

SEQ ID NO: 6012138 - DNA, 12 bp, Homo sapiens
cagtccttccac

SEQ ID NO: 6012139 - DNA, 19 bp, Homo sapiens
cagtccttccacacttcca

SEQ ID NO: 6012140 - DNA, 16 bp, Homo sapiens
cagtccttggcctgct

SEQ ID NO: 6012141 - DNA, 19 bp, Homo sapiens
cagtccttggcctgctaag

SEQ ID NO: 6012142 - DNA, 22 bp, Homo sapiens
cagtcctttcccaccattcctg

SEQ ID NO: 6012143 - DNA, 23 bp, Homo sapiens
cagtcctttcccaccattcctgc

SEQ ID NO: 6012144 - DNA, 13 bp, Homo sapiens
cagtcctttgttg

SEQ ID NO: 6012145 - DNA, 21 bp, Homo sapiens
cagtccttttactacagctat

SEQ ID NO: 6012146 - DNA, 16 bp, Homo sapiens
cagtcgagccctgcag

SEQ ID NO: 6012147 - DNA, 20 bp, Homo sapiens
cagtcgagccctgcagccaa

SEQ ID NO: 6012148 - DNA, 16 bp, Homo sapiens
cagtcgatagagctgt

SEQ ID NO: 6012149 - DNA, 13 bp, Homo sapiens
cagtcgcacacac

SEQ ID NO: 6012150 - DNA, 21 bp, Homo sapiens
cagtcgcaggatccgctgcca

SEQ ID NO: 6012151 - DNA, 22 bp, Homo sapiens
cagtcgcaggatccgctgccac

SEQ ID NO: 6012152 - DNA, 19 bp, Homo sapiens
cagtcgccctctgtgccta

SEQ ID NO: 6012153 - DNA, 16 bp, Homo sapiens
cagtcgccctgttctt

SEQ ID NO: 6012154 - DNA, 14 bp, Homo sapiens
cagtcgcctgcctg

SEQ ID NO: 6012155 - DNA, 15 bp, Homo sapiens
cagtcgcctgcctgc

SEQ ID NO: 6012156 - DNA, 16 bp, Homo sapiens
cagtcgcctgcctgca

SEQ ID NO: 6012157 - DNA, 17 bp, Homo sapiens
cagtcgcctgcctgcag

SEQ ID NO: 6012158 - DNA, 21 bp, Homo sapiens
cagtcgcctgcctgcagcagg

SEQ ID NO: 6012159 - DNA, 21 bp, Homo sapiens
cagtcgcctttcagcaggcag

SEQ ID NO: 6012160 - DNA, 15 bp, Homo sapiens
cagtcgcgctgcctg

SEQ ID NO: 6012161 - DNA, 19 bp, Homo sapiens
cagtcgctcagtctgttca

SEQ ID NO: 6012162 - DNA, 20 bp, Homo sapiens
cagtcgctcagtctgttcac

SEQ ID NO: 6012163 - DNA, 21 bp, Homo sapiens
cagtcgctgcagggagcacca

SEQ ID NO: 6012164 - DNA, 20 bp, Homo sapiens
cagtcgcttgccaaagcaga

SEQ ID NO: 6012165 - DNA, 21 bp, Homo sapiens
cagtcgcttgccaaagcagat

SEQ ID NO: 6012166 - DNA, 17 bp, Homo sapiens
cagtcggagcctcactc

SEQ ID NO: 6012167 - DNA, 18 bp, Homo sapiens
cagtcgggagagccaggc

SEQ ID NO: 6012168 - DNA, 15 bp, Homo sapiens
cagtcggggcaggcc

SEQ ID NO: 6012169 - DNA, 13 bp, Homo sapiens
cagtcgggggctg

SEQ ID NO: 6012170 - DNA, 19 bp, Homo sapiens
cagtcgggggctggcctag

SEQ ID NO: 6012171 - DNA, 23 bp, Homo sapiens
cagtcgtaaaagagataataaga

SEQ ID NO: 6012172 - DNA, 15 bp, Homo sapiens
cagtcgtcagcctcc

SEQ ID NO: 6012173 - DNA, 17 bp, Homo sapiens
cagtcgtcagcctccct

SEQ ID NO: 6012174 - DNA, 18 bp, Homo sapiens
cagtcgtcagcctccctg

SEQ ID NO: 6012175 - DNA, 19 bp, Homo sapiens
cagtcgtcagcctccctga

SEQ ID NO: 6012176 - DNA, 17 bp, Homo sapiens
cagtcgtccgctcagcc

SEQ ID NO: 6012177 - DNA, 19 bp, Homo sapiens
cagtcgtccgctcagccaa

SEQ ID NO: 6012178 - DNA, 18 bp, Homo sapiens
cagtcgtcgcacagtctc

SEQ ID NO: 6012179 - DNA, 21 bp, Homo sapiens
cagtcgtggctttggcagtgt

SEQ ID NO: 6012180 - DNA, 20 bp, Homo sapiens
cagtcgtgtaattggcccaa

SEQ ID NO: 6012181 - DNA, 22 bp, Homo sapiens
cagtcgttttagtgtctgacct

SEQ ID NO: 6012182 - DNA, 23 bp, Homo sapiens
cagtcgttttagtgtctgaccta

SEQ ID NO: 6012183 - DNA, 16 bp, Homo sapiens
cagtctaaattttcta

SEQ ID NO: 6012184 - DNA, 19 bp, Homo sapiens
cagtctaagtaagtgtctg

SEQ ID NO: 6012185 - DNA, 22 bp, Homo sapiens
cagtctaagtaagtgtctgtga

SEQ ID NO: 6012186 - DNA, 20 bp, Homo sapiens
cagaggtctctgccggctct

SEQ ID NO: 6012187 - DNA, 23 bp, Homo sapiens
cagaggtctctgccggctctttc

SEQ ID NO: 6012188 - DNA, 14 bp, Homo sapiens
cagaggtctgtgct

SEQ ID NO: 6012189 - DNA, 15 bp, Homo sapiens
cagaggtctgtgctg

SEQ ID NO: 6012190 - DNA, 22 bp, Homo sapiens
cagaggtgaaattccagatgag

SEQ ID NO: 6012191 - DNA, 15 bp, Homo sapiens
cagaggtgacagtgg

SEQ ID NO: 6012192 - DNA, 21 bp, Homo sapiens
cagaggtgacccaatgctcct

SEQ ID NO: 6012193 - DNA, 19 bp, Homo sapiens
cagaggtgagaactcagaa

SEQ ID NO: 6012194 - DNA, 23 bp, Homo sapiens
cagaggtgagaactcagaagaga

SEQ ID NO: 6012195 - DNA, 19 bp, Homo sapiens
cagaggtgagggaggcctg

SEQ ID NO: 6012196 - DNA, 14 bp, Homo sapiens
cagaggtgcaagac

SEQ ID NO: 6012197 - DNA, 19 bp, Homo sapiens
cagaggtgcaagacctagt

SEQ ID NO: 6012198 - DNA, 17 bp, Homo sapiens
cagaggtgctaaattgt

SEQ ID NO: 6012199 - DNA, 14 bp, Homo sapiens
cagaggtgcttcac

SEQ ID NO: 6012200 - DNA, 22 bp, Homo sapiens
cagaggtggagccaagtggtcc

SEQ ID NO: 6012201 - DNA, 16 bp, Homo sapiens
cagaggtggaggtggg

SEQ ID NO: 6012202 - DNA, 23 bp, Homo sapiens
cagaggtggatactggggggcag

SEQ ID NO: 6012203 - DNA, 20 bp, Homo sapiens
cagaggtggatgttatgaac

SEQ ID NO: 6012204 - DNA, 22 bp, Homo sapiens
cagaggtggatgttatgaacag

SEQ ID NO: 6012205 - DNA, 13 bp, Homo sapiens
cagaggtggcagg

SEQ ID NO: 6012206 - DNA, 14 bp, Homo sapiens
cagaggtggccaga

SEQ ID NO: 6012207 - DNA, 19 bp, Homo sapiens
cagaggtggccctcccagg

SEQ ID NO: 6012208 - DNA, 14 bp, Homo sapiens
cagaggtggccctt

SEQ ID NO: 6012209 - DNA, 17 bp, Homo sapiens
cagaggtgggcaggtgg

SEQ ID NO: 6012210 - DNA, 20 bp, Homo sapiens
cagaggtgggcaggtggtgg

SEQ ID NO: 6012211 - DNA, 19 bp, Homo sapiens
cagaggtggggaagagagc

SEQ ID NO: 6012212 - DNA, 20 bp, Homo sapiens
cagaggtggggaagagagcc

SEQ ID NO: 6012213 - DNA, 22 bp, Homo sapiens
cagaggtggggaagagagcctg

SEQ ID NO: 6012214 - DNA, 18 bp, Homo sapiens
cagaggtggggtgctggg

SEQ ID NO: 6012215 - DNA, 21 bp, Homo sapiens
cagaggtggggtgctggggct

SEQ ID NO: 6012216 - DNA, 20 bp, Homo sapiens
cagaggtggtctggtgccac

SEQ ID NO: 6012217 - DNA, 23 bp, Homo sapiens
cagaggtgtacactaacatttcc

SEQ ID NO: 6012218 - DNA, 20 bp, Homo sapiens
cagaggtgtcatccacaggc

SEQ ID NO: 6012219 - DNA, 17 bp, Homo sapiens
cagaggttatctgcctg

SEQ ID NO: 6012220 - DNA, 22 bp, Homo sapiens
cagaggttatctgcctggcctg

SEQ ID NO: 6012221 - DNA, 18 bp, Homo sapiens
cagaggttatctgtccca

SEQ ID NO: 6012222 - DNA, 21 bp, Homo sapiens
cagaggttgcagtgagctgag

SEQ ID NO: 6012223 - DNA, 17 bp, Homo sapiens
cagaggttgcagtgtgg

SEQ ID NO: 6012224 - DNA, 20 bp, Homo sapiens
cagaggttgtagtgagccaa

SEQ ID NO: 6012225 - DNA, 21 bp, Homo sapiens
cagaggttgtagtgagccaag

SEQ ID NO: 6012226 - DNA, 20 bp, Homo sapiens
cagaggttgtggtgagccga

SEQ ID NO: 6012227 - DNA, 16 bp, Homo sapiens
cagaggtttaaatgta

SEQ ID NO: 6012228 - DNA, 16 bp, Homo sapiens
cagaggtttcttgaat

SEQ ID NO: 6012229 - DNA, 17 bp, Homo sapiens
cagaggtttgaaggaga

SEQ ID NO: 6012230 - DNA, 18 bp, Homo sapiens
cagaggtttgcttcctca

SEQ ID NO: 6012231 - DNA, 17 bp, Homo sapiens
cagagtaaattgctctg

SEQ ID NO: 6012232 - DNA, 23 bp, Homo sapiens
cagagtaaattgctctgttccca

SEQ ID NO: 6012233 - DNA, 16 bp, Homo sapiens
cagagtaacaggatca

SEQ ID NO: 6012234 - DNA, 15 bp, Homo sapiens
cagagtaagacattg

SEQ ID NO: 6012235 - DNA, 17 bp, Homo sapiens
cagagtaagctgctttt

SEQ ID NO: 6012236 - DNA, 21 bp, Homo sapiens
cagagtaatccaagcaaatgt

SEQ ID NO: 6012237 - DNA, 20 bp, Homo sapiens
cagagtacaaaatagttgta

SEQ ID NO: 6012238 - DNA, 24 bp, Homo sapiens
cagagtacgtcctgcctggcactt

SEQ ID NO: 6012239 - DNA, 21 bp, Homo sapiens
cagagtagccatgaggaggca

SEQ ID NO: 6012240 - DNA, 21 bp, Homo sapiens
cagagtagcccaggtcactgt

SEQ ID NO: 6012241 - DNA, 22 bp, Homo sapiens
cagagtaggctattcctgagag

SEQ ID NO: 6012242 - DNA, 15 bp, Homo sapiens
cagagtaggtgggta

SEQ ID NO: 6012243 - DNA, 22 bp, Homo sapiens
cagagtaggtgggtaggagccc

SEQ ID NO: 6012244 - DNA, 15 bp, Homo sapiens
cagagtaggtgggtc

SEQ ID NO: 6012245 - DNA, 21 bp, Homo sapiens
cagagtaggtgggtcttggat

SEQ ID NO: 6012246 - DNA, 17 bp, Homo sapiens
cagagtagttttggttt

SEQ ID NO: 6012247 - DNA, 15 bp, Homo sapiens
cagagtataattttg

SEQ ID NO: 6012248 - DNA, 16 bp, Homo sapiens
cagagtatacaagtgt

SEQ ID NO: 6012249 - DNA, 21 bp, Homo sapiens
cagagtatacaagtgtttcta

SEQ ID NO: 6012250 - DNA, 15 bp, Homo sapiens
cagagtataggatgg

SEQ ID NO: 6012251 - DNA, 18 bp, Homo sapiens
cagagtatatatgtacag

SEQ ID NO: 6012252 - DNA, 13 bp, Homo sapiens
cagagtatcttta

SEQ ID NO: 6012253 - DNA, 13 bp, Homo sapiens
cagagtatgaaca

SEQ ID NO: 6012254 - DNA, 14 bp, Homo sapiens
cagagtatggagct

SEQ ID NO: 6012255 - DNA, 22 bp, Homo sapiens
cagagtatgtccgatggtatct

SEQ ID NO: 6012256 - DNA, 19 bp, Homo sapiens
cagagtattgggattacag

SEQ ID NO: 6012257 - DNA, 13 bp, Homo sapiens
cagagtatttctg

SEQ ID NO: 6012258 - DNA, 14 bp, Homo sapiens
cagagtatttctgg

SEQ ID NO: 6012259 - DNA, 22 bp, Homo sapiens
cagagtcaacaaattaaataaa

SEQ ID NO: 6012260 - DNA, 18 bp, Homo sapiens
cagagtcaaggcctgctc

SEQ ID NO: 6012261 - DNA, 19 bp, Homo sapiens
cagagtcaaggcctgctcc

SEQ ID NO: 6012262 - DNA, 23 bp, Homo sapiens
cagagtcagaggagaagagacat

SEQ ID NO: 6012263 - DNA, 17 bp, Homo sapiens
cagagtcaggaagagat

SEQ ID NO: 6012264 - DNA, 12 bp, Homo sapiens
cagagtcattgt

SEQ ID NO: 6012265 - DNA, 20 bp, Homo sapiens
cagagtcatttatgagcaga

SEQ ID NO: 6012266 - DNA, 21 bp, Homo sapiens
cagagtcatttatgagcagaa

SEQ ID NO: 6012267 - DNA, 15 bp, Homo sapiens
cagagtccactgtgg

SEQ ID NO: 6012268 - DNA, 14 bp, Homo sapiens
cagagtccagtgct

SEQ ID NO: 6012269 - DNA, 15 bp, Homo sapiens
cagagtccagtgctc

SEQ ID NO: 6012270 - DNA, 13 bp, Homo sapiens
cagagtcccaggc

SEQ ID NO: 6012271 - DNA, 14 bp, Homo sapiens
cagagtccccccac

SEQ ID NO: 6012272 - DNA, 15 bp, Homo sapiens
cagagtccccccact

SEQ ID NO: 6012273 - DNA, 15 bp, Homo sapiens
cagagtccctcccat

SEQ ID NO: 6012274 - DNA, 17 bp, Homo sapiens
cagagtccggaggcagc

SEQ ID NO: 6012275 - DNA, 12 bp, Homo sapiens
cagagtccggga

SEQ ID NO: 6012276 - DNA, 13 bp, Homo sapiens
cagagtcctgccg

SEQ ID NO: 6012277 - DNA, 14 bp, Homo sapiens
cagagtcctgcctt

SEQ ID NO: 6012278 - DNA, 13 bp, Homo sapiens
cagagtcctggag

SEQ ID NO: 6012279 - DNA, 16 bp, Homo sapiens
cagagtcctggccctt

SEQ ID NO: 6012280 - DNA, 23 bp, Homo sapiens
cagagtcgcttttgccttttcaa

SEQ ID NO: 6012281 - DNA, 19 bp, Homo sapiens
cagagtcgttggagactga

SEQ ID NO: 6012282 - DNA, 14 bp, Homo sapiens
cagagtctaggcaa

SEQ ID NO: 6012283 - DNA, 20 bp, Homo sapiens
cagagtctcactgttgccca

SEQ ID NO: 6012284 - DNA, 13 bp, Homo sapiens
cagagtctcgctc

SEQ ID NO: 6012285 - DNA, 14 bp, Homo sapiens
cagagtctcgctct

SEQ ID NO: 6012286 - DNA, 16 bp, Homo sapiens
cagagtctgggcctct

SEQ ID NO: 6012287 - DNA, 20 bp, Homo sapiens
cagagtctgggcctctgact

SEQ ID NO: 6012288 - DNA, 12 bp, Homo sapiens
cagagtctgtct

SEQ ID NO: 6012289 - DNA, 22 bp, Homo sapiens
cagagtcttgctctgtctccca

SEQ ID NO: 6012290 - DNA, 14 bp, Homo sapiens
cagagtgaaataaa

SEQ ID NO: 6012291 - DNA, 18 bp, Homo sapiens
cagagtgaaataaaatgc

SEQ ID NO: 6012292 - DNA, 13 bp, Homo sapiens
cagagtgaagagt

SEQ ID NO: 6012293 - DNA, 15 bp, Homo sapiens
cagagtgaagagtga

SEQ ID NO: 6012294 - DNA, 14 bp, Homo sapiens
cagagtgaatttca

SEQ ID NO: 6012295 - DNA, 23 bp, Homo sapiens
cagagtgaatttcagtataaaga

SEQ ID NO: 6012296 - DNA, 20 bp, Homo sapiens
cagagtgacatccaggagga

SEQ ID NO: 6012297 - DNA, 15 bp, Homo sapiens
cagagtgaccctcag

SEQ ID NO: 6012298 - DNA, 17 bp, Homo sapiens
cagagtgaccctcagct

SEQ ID NO: 6012299 - DNA, 21 bp, Homo sapiens
cagagtgaccctcagctgtca

SEQ ID NO: 6012300 - DNA, 20 bp, Homo sapiens
cagagtgagaccctgtctca

SEQ ID NO: 6012301 - DNA, 20 bp, Homo sapiens
cagagtgagaccctgtctct

SEQ ID NO: 6012302 - DNA, 16 bp, Homo sapiens
cagagtgagactccat

SEQ ID NO: 6012303 - DNA, 16 bp, Homo sapiens
cagagtgagactctgt

SEQ ID NO: 6012304 - DNA, 19 bp, Homo sapiens
cagagtgagactctgtctc

SEQ ID NO: 6012305 - DNA, 20 bp, Homo sapiens
cagagtgagactctgtctca

SEQ ID NO: 6012306 - DNA, 17 bp, Homo sapiens
cagagtgaggatgtgtt

SEQ ID NO: 6012307 - DNA, 21 bp, Homo sapiens
cagagtgagggggtaaagcag

SEQ ID NO: 6012308 - DNA, 19 bp, Homo sapiens
cagagtgagtgtaggggtg

SEQ ID NO: 6012309 - DNA, 23 bp, Homo sapiens
cagagtgattcgggggctgacct

SEQ ID NO: 6012310 - DNA, 14 bp, Homo sapiens
cagagtgattctag

SEQ ID NO: 6012311 - DNA, 16 bp, Homo sapiens
cagagtgatttgtaaa

SEQ ID NO: 6012312 - DNA, 22 bp, Homo sapiens
cagagtgatttgtaaaacagtg

SEQ ID NO: 6012313 - DNA, 18 bp, Homo sapiens
cagagtgcaagaagtctg

SEQ ID NO: 6012314 - DNA, 14 bp, Homo sapiens
cagagtgccactgc

SEQ ID NO: 6012315 - DNA, 13 bp, Homo sapiens
cagagtgcccaga

SEQ ID NO: 6012316 - DNA, 16 bp, Homo sapiens
cagagtgccccacctg

SEQ ID NO: 6012317 - DNA, 23 bp, Homo sapiens
cagagtgccccacctgccactag

SEQ ID NO: 6012318 - DNA, 16 bp, Homo sapiens
cagagtgccctggggc

SEQ ID NO: 6012319 - DNA, 19 bp, Homo sapiens
cagagtgccctggggcatc

SEQ ID NO: 6012320 - DNA, 23 bp, Homo sapiens
cagagtgctgaggccagggctga

SEQ ID NO: 6012321 - DNA, 22 bp, Homo sapiens
cagagtgctggactgttccagg

SEQ ID NO: 6012322 - DNA, 21 bp, Homo sapiens
cagagtgctgtcgggaccaca

SEQ ID NO: 6012323 - DNA, 21 bp, Homo sapiens
cagagtgctttaccaattgaa

SEQ ID NO: 6012324 - DNA, 15 bp, Homo sapiens
cagagtgcttttctg

SEQ ID NO: 6012325 - DNA, 20 bp, Homo sapiens
cagagtggaaactcagccgt

SEQ ID NO: 6012326 - DNA, 14 bp, Homo sapiens
cagagtggaaattc

SEQ ID NO: 6012327 - DNA, 14 bp, Homo sapiens
cagagtggaatgct

SEQ ID NO: 6012328 - DNA, 21 bp, Homo sapiens
cagagtggactcttccctctc

SEQ ID NO: 6012329 - DNA, 15 bp, Homo sapiens
cagagtggactgcat

SEQ ID NO: 6012330 - DNA, 14 bp, Homo sapiens
cagagtggagccca

SEQ ID NO: 6012331 - DNA, 15 bp, Homo sapiens
cagagtggagcccag

SEQ ID NO: 6012332 - DNA, 18 bp, Homo sapiens
cagagtggagcccagggt

SEQ ID NO: 6012333 - DNA, 16 bp, Homo sapiens
cagagtggagccctca

SEQ ID NO: 6012334 - DNA, 19 bp, Homo sapiens
cagagtggagtctgagtct

SEQ ID NO: 6012335 - DNA, 19 bp, Homo sapiens
cagagtggccacggcccag

SEQ ID NO: 6012336 - DNA, 22 bp, Homo sapiens
cagagtggccacggcccaggga

SEQ ID NO: 6012337 - DNA, 12 bp, Homo sapiens
cagagtggccca

SEQ ID NO: 6012338 - DNA, 13 bp, Homo sapiens
cagagtggcctgg

SEQ ID NO: 6012339 - DNA, 17 bp, Homo sapiens
cagagtggcctggccag

SEQ ID NO: 6012340 - DNA, 19 bp, Homo sapiens
cagagtggcgtgagctgcc

SEQ ID NO: 6012341 - DNA, 17 bp, Homo sapiens
cagagtggcgtggcctc

SEQ ID NO: 6012342 - DNA, 11 bp, Homo sapiens
cagagtggctc

SEQ ID NO: 6012343 - DNA, 22 bp, Homo sapiens
cagagtggctcactggctggga

SEQ ID NO: 6012344 - DNA, 15 bp, Homo sapiens
cagagtgggacttgg

SEQ ID NO: 6012345 - DNA, 22 bp, Homo sapiens
cagagtgggctccaagcacaaa

SEQ ID NO: 6012346 - DNA, 14 bp, Homo sapiens
cagagtgggctgcc

SEQ ID NO: 6012347 - DNA, 15 bp, Homo sapiens
cagagtgggctgcct

SEQ ID NO: 6012348 - DNA, 20 bp, Homo sapiens
cagagtgggctgcctgggga

SEQ ID NO: 6012349 - DNA, 22 bp, Homo sapiens
cagagtggtctttctggagagg

SEQ ID NO: 6012350 - DNA, 16 bp, Homo sapiens
cagagtggtttccaat

SEQ ID NO: 6012351 - DNA, 20 bp, Homo sapiens
cagagtggtttccaatgtgt

SEQ ID NO: 6012352 - DNA, 15 bp, Homo sapiens
cagagtgtagggggc

SEQ ID NO: 6012353 - DNA, 20 bp, Homo sapiens
cagagtgtatgcatacaaat

SEQ ID NO: 6012354 - DNA, 13 bp, Homo sapiens
cagagtgtcctgc

SEQ ID NO: 6012355 - DNA, 19 bp, Homo sapiens
cagagtgtcctgctacctt

SEQ ID NO: 6012356 - DNA, 18 bp, Homo sapiens
cagagtgtggactctggt

SEQ ID NO: 6012357 - DNA, 22 bp, Homo sapiens
cagagtgtttaattgtactcaa

SEQ ID NO: 6012358 - DNA, 17 bp, Homo sapiens
cagagtgttttgaccag

SEQ ID NO: 6012359 - DNA, 21 bp, Homo sapiens
cagagttaaaatgtttactgt

SEQ ID NO: 6012360 - DNA, 14 bp, Homo sapiens
cagagttacagttc

SEQ ID NO: 6012361 - DNA, 12 bp, Homo sapiens
cagagttcacag

SEQ ID NO: 6012362 - DNA, 14 bp, Homo sapiens
cagagttcacagga

SEQ ID NO: 6012363 - DNA, 23 bp, Homo sapiens
cagtctacccacctcagcctcct

SEQ ID NO: 6012364 - DNA, 15 bp, Homo sapiens
cagtctacccagaga

SEQ ID NO: 6012365 - DNA, 16 bp, Homo sapiens
cagtctaccctgtcct

SEQ ID NO: 6012366 - DNA, 23 bp, Homo sapiens
cagtctacgttctccagcccaca

SEQ ID NO: 6012367 - DNA, 22 bp, Homo sapiens
cagtctagattagaagtgtttt

SEQ ID NO: 6012368 - DNA, 22 bp, Homo sapiens
cagtctaggaatggagtctccc

SEQ ID NO: 6012369 - DNA, 19 bp, Homo sapiens
cagtctagtacttattaca

SEQ ID NO: 6012370 - DNA, 20 bp, Homo sapiens
cagtctagtccgtcctggca

SEQ ID NO: 6012371 - DNA, 21 bp, Homo sapiens
cagtctagtccgtcctggcac

SEQ ID NO: 6012372 - DNA, 19 bp, Homo sapiens
cagtctagtgaagatgttg

SEQ ID NO: 6012373 - DNA, 13 bp, Homo sapiens
cagtctagttcct

SEQ ID NO: 6012374 - DNA, 15 bp, Homo sapiens
cagtctatcattgtt

SEQ ID NO: 6012375 - DNA, 15 bp, Homo sapiens
cagtctatccacaga

SEQ ID NO: 6012376 - DNA, 22 bp, Homo sapiens
cagtctatccacagagagtccc

SEQ ID NO: 6012377 - DNA, 15 bp, Homo sapiens
cagtctatgctgtgt

SEQ ID NO: 6012378 - DNA, 15 bp, Homo sapiens
cagtctatttccact

SEQ ID NO: 6012379 - DNA, 19 bp, Homo sapiens
cagtctcaagcactaaaaa

SEQ ID NO: 6012380 - DNA, 13 bp, Homo sapiens
cagtctcaatttt

SEQ ID NO: 6012381 - DNA, 14 bp, Homo sapiens
cagtctcaattttg

SEQ ID NO: 6012382 - DNA, 10 bp, Homo sapiens
cagtctcaca

SEQ ID NO: 6012383 - DNA, 13 bp, Homo sapiens
cagtctcacaata

SEQ ID NO: 6012384 - DNA, 20 bp, Homo sapiens
cagtctcacatttctcaaca

SEQ ID NO: 6012385 - DNA, 13 bp, Homo sapiens
cagtctcacccac

SEQ ID NO: 6012386 - DNA, 11 bp, Homo sapiens
cagtctcagaa

SEQ ID NO: 6012387 - DNA, 21 bp, Homo sapiens
cagtctcagaatgtcattttg

SEQ ID NO: 6012388 - DNA, 18 bp, Homo sapiens
cagtctcagagaccagca

SEQ ID NO: 6012389 - DNA, 23 bp, Homo sapiens
cagtctcagagaccagcactcag

SEQ ID NO: 6012390 - DNA, 14 bp, Homo sapiens
cagtctcaggagca

SEQ ID NO: 6012391 - DNA, 19 bp, Homo sapiens
cagtctcaggagcatgggg

SEQ ID NO: 6012392 - DNA, 15 bp, Homo sapiens
cagtctcagtccaga

SEQ ID NO: 6012393 - DNA, 17 bp, Homo sapiens
cagtctcagtccagatg

SEQ ID NO: 6012394 - DNA, 16 bp, Homo sapiens
cagtctcatcctccca

SEQ ID NO: 6012395 - DNA, 14 bp, Homo sapiens
cagtctcatctcct

SEQ ID NO: 6012396 - DNA, 17 bp, Homo sapiens
cagtctcatctcctgac

SEQ ID NO: 6012397 - DNA, 19 bp, Homo sapiens
cagtctcatctcctgaccc

SEQ ID NO: 6012398 - DNA, 17 bp, Homo sapiens
cagtctcattgtcacct

SEQ ID NO: 6012399 - DNA, 17 bp, Homo sapiens
cagtctccaccaggaac

SEQ ID NO: 6012400 - DNA, 23 bp, Homo sapiens
cagtctccccactccaccctgtt

SEQ ID NO: 6012401 - DNA, 14 bp, Homo sapiens
cagtctccccttcc

SEQ ID NO: 6012402 - DNA, 18 bp, Homo sapiens
cagtctccccttcctggc

SEQ ID NO: 6012403 - DNA, 14 bp, Homo sapiens
cagtctccctccct

SEQ ID NO: 6012404 - DNA, 21 bp, Homo sapiens
cagtctccgctcccgcagcgg

SEQ ID NO: 6012405 - DNA, 17 bp, Homo sapiens
cagtctccggcctctcc

SEQ ID NO: 6012406 - DNA, 21 bp, Homo sapiens
cagtctccggcctctccagcc

SEQ ID NO: 6012407 - DNA, 22 bp, Homo sapiens
cagtctccggcctctccagcct

SEQ ID NO: 6012408 - DNA, 19 bp, Homo sapiens
cagtctcctatacccagca

SEQ ID NO: 6012409 - DNA, 23 bp, Homo sapiens
cagtctcctatacccagcagagg

SEQ ID NO: 6012410 - DNA, 15 bp, Homo sapiens
cagtctcctcactct

SEQ ID NO: 6012411 - DNA, 20 bp, Homo sapiens
cagtctcctcactctgtccc

SEQ ID NO: 6012412 - DNA, 13 bp, Homo sapiens
cagtctcctctcc

SEQ ID NO: 6012413 - DNA, 14 bp, Homo sapiens
cagtctcctctcca

SEQ ID NO: 6012414 - DNA, 13 bp, Homo sapiens
cagtctcctcttt

SEQ ID NO: 6012415 - DNA, 16 bp, Homo sapiens
cagtctcctctttaaa

SEQ ID NO: 6012416 - DNA, 17 bp, Homo sapiens
cagtctcctctttaaaa

SEQ ID NO: 6012417 - DNA, 20 bp, Homo sapiens
cagtctcctctttaaaacaa

SEQ ID NO: 6012418 - DNA, 22 bp, Homo sapiens
cagtctcctctttaaaacaaaa

SEQ ID NO: 6012419 - DNA, 15 bp, Homo sapiens
cagtctcctgacatt

SEQ ID NO: 6012420 - DNA, 16 bp, Homo sapiens
cagtctccttcagcac

SEQ ID NO: 6012421 - DNA, 18 bp, Homo sapiens
cagtctccttcagcacgg

SEQ ID NO: 6012422 - DNA, 13 bp, Homo sapiens
cagtctcgtctct

SEQ ID NO: 6012423 - DNA, 17 bp, Homo sapiens
cagtctctataccaata

SEQ ID NO: 6012424 - DNA, 23 bp, Homo sapiens
cagtctctataccaataaagtga

SEQ ID NO: 6012425 - DNA, 23 bp, Homo sapiens
cagtctctatttgatttgcaaca

SEQ ID NO: 6012426 - DNA, 17 bp, Homo sapiens
cagtctctccctggggt

SEQ ID NO: 6012427 - DNA, 16 bp, Homo sapiens
cagtctctctctccct

SEQ ID NO: 6012428 - DNA, 14 bp, Homo sapiens
cagtctctcttaaa

SEQ ID NO: 6012429 - DNA, 17 bp, Homo sapiens
cagtctctcttaaagtt

SEQ ID NO: 6012430 - DNA, 17 bp, Homo sapiens
cagtctctcttctctcc

SEQ ID NO: 6012431 - DNA, 22 bp, Homo sapiens
cagtctctcttctctccagctg

SEQ ID NO: 6012432 - DNA, 18 bp, Homo sapiens
cagtctctgctccacctt

SEQ ID NO: 6012433 - DNA, 23 bp, Homo sapiens
cagtctctgctccacctttcagc

SEQ ID NO: 6012434 - DNA, 14 bp, Homo sapiens
cagtctctggaaaa

SEQ ID NO: 6012435 - DNA, 21 bp, Homo sapiens
cagtctctggaaaagctgggg

SEQ ID NO: 6012436 - DNA, 14 bp, Homo sapiens
cagtctctgtcgtg

SEQ ID NO: 6012437 - DNA, 17 bp, Homo sapiens
cagtctctgttgtaaat

SEQ ID NO: 6012438 - DNA, 18 bp, Homo sapiens
cagtctcttagaatttgt

SEQ ID NO: 6012439 - DNA, 19 bp, Homo sapiens
cagtctcttagaatttgtt

SEQ ID NO: 6012440 - DNA, 12 bp, Homo sapiens
cagtctcttcca

SEQ ID NO: 6012441 - DNA, 20 bp, Homo sapiens
cagtctctttaatcttcagt

SEQ ID NO: 6012442 - DNA, 18 bp, Homo sapiens
cagtctctttattttact

SEQ ID NO: 6012443 - DNA, 17 bp, Homo sapiens
cagtctctttcttcctt

SEQ ID NO: 6012444 - DNA, 18 bp, Homo sapiens
cagtctctttcttccttt

SEQ ID NO: 6012445 - DNA, 19 bp, Homo sapiens
cagtctgaacccttgtgct

SEQ ID NO: 6012446 - DNA, 21 bp, Homo sapiens
cagtctgaagcgtagtagtgg

SEQ ID NO: 6012447 - DNA, 16 bp, Homo sapiens
cagtctgaatgctgcc

SEQ ID NO: 6012448 - DNA, 20 bp, Homo sapiens
cagtctgaatgctgccacaa

SEQ ID NO: 6012449 - DNA, 13 bp, Homo sapiens
cagtctgagtcat

SEQ ID NO: 6012450 - DNA, 21 bp, Homo sapiens
cagtctgattataccatgtgt

SEQ ID NO: 6012451 - DNA, 19 bp, Homo sapiens
cagtctgattcccaagctc

SEQ ID NO: 6012452 - DNA, 19 bp, Homo sapiens
cagtctgcagctattcaca

SEQ ID NO: 6012453 - DNA, 19 bp, Homo sapiens
cagtctgccatatcaccac

SEQ ID NO: 6012454 - DNA, 17 bp, Homo sapiens
cagtctgctcctcttgt

SEQ ID NO: 6012455 - DNA, 13 bp, Homo sapiens
cagtctgctctgc

SEQ ID NO: 6012456 - DNA, 15 bp, Homo sapiens
cagtctgctctgctg

SEQ ID NO: 6012457 - DNA, 14 bp, Homo sapiens
cagtctgctgccct

SEQ ID NO: 6012458 - DNA, 15 bp, Homo sapiens
cagtctgcttagaaa

SEQ ID NO: 6012459 - DNA, 21 bp, Homo sapiens
cagtctggaagaagaggagga

SEQ ID NO: 6012460 - DNA, 15 bp, Homo sapiens
cagtctggagaaggt

SEQ ID NO: 6012461 - DNA, 12 bp, Homo sapiens
cagtctggaggg

SEQ ID NO: 6012462 - DNA, 13 bp, Homo sapiens
cagtctggagggg

SEQ ID NO: 6012463 - DNA, 20 bp, Homo sapiens
cagtctggaggtcccagaca

SEQ ID NO: 6012464 - DNA, 23 bp, Homo sapiens
cagtctggcagttgctaaatttg

SEQ ID NO: 6012465 - DNA, 18 bp, Homo sapiens
cagtctggctgagccctg

SEQ ID NO: 6012466 - DNA, 17 bp, Homo sapiens
cagtctggtttatataa

SEQ ID NO: 6012467 - DNA, 16 bp, Homo sapiens
cagtctgtattttcca

SEQ ID NO: 6012468 - DNA, 12 bp, Homo sapiens
cagtctgtcatg

SEQ ID NO: 6012469 - DNA, 13 bp, Homo sapiens
cagtctgtccacg

SEQ ID NO: 6012470 - DNA, 17 bp, Homo sapiens
cagtctgtctactgtgg

SEQ ID NO: 6012471 - DNA, 14 bp, Homo sapiens
cagtctgtcttctg

SEQ ID NO: 6012472 - DNA, 23 bp, Homo sapiens
cagtctgtcttctgtatataaat

SEQ ID NO: 6012473 - DNA, 14 bp, Homo sapiens
cagtctgtgggagc

SEQ ID NO: 6012474 - DNA, 20 bp, Homo sapiens
cagtctgtgtttgaccttca

SEQ ID NO: 6012475 - DNA, 21 bp, Homo sapiens
cagtctgttatgcactgtggt

SEQ ID NO: 6012476 - DNA, 24 bp, Homo sapiens
cagtctgttatgcactgtggtttc

SEQ ID NO: 6012477 - DNA, 20 bp, Homo sapiens
cagtctgttcactgcattca

SEQ ID NO: 6012478 - DNA, 15 bp, Homo sapiens
cagtctgttcagagg

SEQ ID NO: 6012479 - DNA, 17 bp, Homo sapiens
cagtctgttcagaggca

SEQ ID NO: 6012480 - DNA, 16 bp, Homo sapiens
cagtcttactctgtct

SEQ ID NO: 6012481 - DNA, 20 bp, Homo sapiens
cagtcttactctgtctccca

SEQ ID NO: 6012482 - DNA, 23 bp, Homo sapiens
cagtcttatagcaagactgttag

SEQ ID NO: 6012483 - DNA, 19 bp, Homo sapiens
cagtcttatcaactggttg

SEQ ID NO: 6012484 - DNA, 16 bp, Homo sapiens
cagtcttatgcttcca

SEQ ID NO: 6012485 - DNA, 18 bp, Homo sapiens
cagtcttatgcttccaga

SEQ ID NO: 6012486 - DNA, 20 bp, Homo sapiens
cagtcttatgcttccagaaa

SEQ ID NO: 6012487 - DNA, 19 bp, Homo sapiens
cagtcttcacttgcactgg

SEQ ID NO: 6012488 - DNA, 18 bp, Homo sapiens
cagtcttccacaaagaaa

SEQ ID NO: 6012489 - DNA, 21 bp, Homo sapiens
cagtcttccacaaagaaaatt

SEQ ID NO: 6012490 - DNA, 15 bp, Homo sapiens
cagtcttccagaaag

SEQ ID NO: 6012491 - DNA, 17 bp, Homo sapiens
cagtcttccatttgcaa

SEQ ID NO: 6012492 - DNA, 18 bp, Homo sapiens
cagtcttccatttgcaag

SEQ ID NO: 6012493 - DNA, 21 bp, Homo sapiens
cagtcttccatttgcaaggga

SEQ ID NO: 6012494 - DNA, 13 bp, Homo sapiens
cagtcttcccagc

SEQ ID NO: 6012495 - DNA, 19 bp, Homo sapiens
cagtcttcctcttagcctc

SEQ ID NO: 6012496 - DNA, 18 bp, Homo sapiens
cagtcttcctgacacttt

SEQ ID NO: 6012497 - DNA, 21 bp, Homo sapiens
cagtcttcctgacactttaat

SEQ ID NO: 6012498 - DNA, 17 bp, Homo sapiens
cagtcttccttgtggaa

SEQ ID NO: 6012499 - DNA, 16 bp, Homo sapiens
cagtcttctcatgaat

SEQ ID NO: 6012500 - DNA, 13 bp, Homo sapiens
cagtcttctccct

SEQ ID NO: 6012501 - DNA, 14 bp, Homo sapiens
cagtcttctccctg

SEQ ID NO: 6012502 - DNA, 16 bp, Homo sapiens
cagtcttctctctggc

SEQ ID NO: 6012503 - DNA, 18 bp, Homo sapiens
cagtcttctctctggctc

SEQ ID NO: 6012504 - DNA, 20 bp, Homo sapiens
cagtcttctctctggctcag

SEQ ID NO: 6012505 - DNA, 21 bp, Homo sapiens
cagtcttctctctggctcagg

SEQ ID NO: 6012506 - DNA, 22 bp, Homo sapiens
cagtcttctctctggctcaggt

SEQ ID NO: 6012507 - DNA, 14 bp, Homo sapiens
cagtcttctgactg

SEQ ID NO: 6012508 - DNA, 15 bp, Homo sapiens
cagtcttctgactgt

SEQ ID NO: 6012509 - DNA, 12 bp, Homo sapiens
cagtcttctgga

SEQ ID NO: 6012510 - DNA, 15 bp, Homo sapiens
cagtcttctgggctg

SEQ ID NO: 6012511 - DNA, 17 bp, Homo sapiens
cagtcttgagtgggccc

SEQ ID NO: 6012512 - DNA, 23 bp, Homo sapiens
cagtcttgagtgggccccctctc

SEQ ID NO: 6012513 - DNA, 14 bp, Homo sapiens
cagtcttgcctagg

SEQ ID NO: 6012514 - DNA, 16 bp, Homo sapiens
cagtcttgcctaggcc

SEQ ID NO: 6012515 - DNA, 17 bp, Homo sapiens
cagtcttgcctaggcca

SEQ ID NO: 6012516 - DNA, 11 bp, Homo sapiens
cagtcttgctc

SEQ ID NO: 6012517 - DNA, 16 bp, Homo sapiens
cagtcttggctcactg

SEQ ID NO: 6012518 - DNA, 21 bp, Homo sapiens
cagtcttggtaaaacattact

SEQ ID NO: 6012519 - DNA, 11 bp, Homo sapiens
cagtcttggtg

SEQ ID NO: 6012520 - DNA, 19 bp, Homo sapiens
cagtcttgtactgtgacct

SEQ ID NO: 6012521 - DNA, 17 bp, Homo sapiens
cagtcttgtattaagtt

SEQ ID NO: 6012522 - DNA, 19 bp, Homo sapiens
cagtctttaaaggcccagc

SEQ ID NO: 6012523 - DNA, 21 bp, Homo sapiens
cagtctttaaaggcccagccc

SEQ ID NO: 6012524 - DNA, 22 bp, Homo sapiens
cagtctttaaaggcccagcccc

SEQ ID NO: 6012525 - DNA, 14 bp, Homo sapiens
cagtctttattttt

SEQ ID NO: 6012526 - DNA, 18 bp, Homo sapiens
cagtctttatttttttcc

SEQ ID NO: 6012527 - DNA, 22 bp, Homo sapiens
cagtctttatttttttcccatg

SEQ ID NO: 6012528 - DNA, 18 bp, Homo sapiens
cagtctttcatgtgtgcc

SEQ ID NO: 6012529 - DNA, 14 bp, Homo sapiens
cagtctttccccca

SEQ ID NO: 6012530 - DNA, 18 bp, Homo sapiens
cagtctttcccccaggaa

SEQ ID NO: 6012531 - DNA, 13 bp, Homo sapiens
cagtctttcttca

SEQ ID NO: 6012532 - DNA, 14 bp, Homo sapiens
cagtctttcttgaa

SEQ ID NO: 6012533 - DNA, 18 bp, Homo sapiens
cagtctttcttgaaattg

SEQ ID NO: 6012534 - DNA, 19 bp, Homo sapiens
cagtctttgaactgcagca

SEQ ID NO: 6012535 - DNA, 22 bp, Homo sapiens
cagtctttgaactgcagcaatc

SEQ ID NO: 6012536 - DNA, 14 bp, Homo sapiens
cagtctttgctcag

SEQ ID NO: 6012537 - DNA, 16 bp, Homo sapiens
cagtctttgctcagtg

SEQ ID NO: 6012538 - DNA, 17 bp, Homo sapiens
cagtctttgctcagtgt

SEQ ID NO: 6012539 - DNA, 19 bp, Homo sapiens
cagtcttttctctgaaaag

SEQ ID NO: 6012540 - DNA, 23 bp, Homo sapiens
cagtcttttgaggtaagtggaat

SEQ ID NO: 6012541 - DNA, 16 bp, Homo sapiens
cagagttcacaggagg

SEQ ID NO: 6012542 - DNA, 18 bp, Homo sapiens
cagagttcagacttcgct

SEQ ID NO: 6012543 - DNA, 14 bp, Homo sapiens
cagagttcagggag

SEQ ID NO: 6012544 - DNA, 20 bp, Homo sapiens
cagagttcagggaggggctg

SEQ ID NO: 6012545 - DNA, 21 bp, Homo sapiens
cagagttcagggaggggctga

SEQ ID NO: 6012546 - DNA, 16 bp, Homo sapiens
cagagttccccatgca

SEQ ID NO: 6012547 - DNA, 18 bp, Homo sapiens
cagagttccccatgcaga

SEQ ID NO: 6012548 - DNA, 14 bp, Homo sapiens
cagagttccccgct

SEQ ID NO: 6012549 - DNA, 15 bp, Homo sapiens
cagagttctgctcta

SEQ ID NO: 6012550 - DNA, 15 bp, Homo sapiens
cagagttctgtgaag

SEQ ID NO: 6012551 - DNA, 13 bp, Homo sapiens
cagagttctgtgg

SEQ ID NO: 6012552 - DNA, 14 bp, Homo sapiens
cagagttctgtggc

SEQ ID NO: 6012553 - DNA, 16 bp, Homo sapiens
cagagttctgtggcgc

SEQ ID NO: 6012554 - DNA, 12 bp, Homo sapiens
cagagttctttg

SEQ ID NO: 6012555 - DNA, 14 bp, Homo sapiens
cagagttctttgca

SEQ ID NO: 6012556 - DNA, 16 bp, Homo sapiens
cagagttctttgcaag

SEQ ID NO: 6012557 - DNA, 14 bp, Homo sapiens
cagagttgaagaca

SEQ ID NO: 6012558 - DNA, 16 bp, Homo sapiens
cagagttgaagacaga

SEQ ID NO: 6012559 - DNA, 19 bp, Homo sapiens
cagagttgaagacagagct

SEQ ID NO: 6012560 - DNA, 20 bp, Homo sapiens
cagagttgacatgagattta

SEQ ID NO: 6012561 - DNA, 20 bp, Homo sapiens
cagagttgctgcaaacctga

SEQ ID NO: 6012562 - DNA, 16 bp, Homo sapiens
cagagttgctgtgccg

SEQ ID NO: 6012563 - DNA, 16 bp, Homo sapiens
cagagttgggatgcgg

SEQ ID NO: 6012564 - DNA, 22 bp, Homo sapiens
cagagttgggatgcggggcaga

SEQ ID NO: 6012565 - DNA, 14 bp, Homo sapiens
cagagttgggggct

SEQ ID NO: 6012566 - DNA, 12 bp, Homo sapiens
cagagttgtaaa

SEQ ID NO: 6012567 - DNA, 14 bp, Homo sapiens
cagagttgtaaata

SEQ ID NO: 6012568 - DNA, 19 bp, Homo sapiens
cagagttgtaaatatataa

SEQ ID NO: 6012569 - DNA, 23 bp, Homo sapiens
cagagttgtaaatatataaatat

SEQ ID NO: 6012570 - DNA, 14 bp, Homo sapiens
cagagttgttctca

SEQ ID NO: 6012571 - DNA, 17 bp, Homo sapiens
cagagttgttctcaggg

SEQ ID NO: 6012572 - DNA, 21 bp, Homo sapiens
cagagttgttgtttgccaagc

SEQ ID NO: 6012573 - DNA, 16 bp, Homo sapiens
cagagtttacattcta

SEQ ID NO: 6012574 - DNA, 17 bp, Homo sapiens
cagagtttacattctaa

SEQ ID NO: 6012575 - DNA, 23 bp, Homo sapiens
cagagtttacattctaatttgca

SEQ ID NO: 6012576 - DNA, 23 bp, Homo sapiens
cagagtttagaggaaaaaaatga

SEQ ID NO: 6012577 - DNA, 17 bp, Homo sapiens
cagagtttcaccatgtt

SEQ ID NO: 6012578 - DNA, 23 bp, Homo sapiens
cagagtttgatatgggctttctc

SEQ ID NO: 6012579 - DNA, 14 bp, Homo sapiens
cagagtttgcctcc

SEQ ID NO: 6012580 - DNA, 16 bp, Homo sapiens
cagagtttgccttcct

SEQ ID NO: 6012581 - DNA, 22 bp, Homo sapiens
cagagtttgccttcctttctcc

SEQ ID NO: 6012582 - DNA, 12 bp, Homo sapiens
cagagtttgtgt

SEQ ID NO: 6012583 - DNA, 19 bp, Homo sapiens
cagagtttgtgtgttgtct

SEQ ID NO: 6012584 - DNA, 17 bp, Homo sapiens
cagagttttcattaaat

SEQ ID NO: 6012585 - DNA, 22 bp, Homo sapiens
cagagttttggtttttgaacta

SEQ ID NO: 6012586 - DNA, 13 bp, Homo sapiens
cagagtttttaaa

SEQ ID NO: 6012587 - DNA, 20 bp, Homo sapiens
cagagtttttaaagccttct

SEQ ID NO: 6012588 - DNA, 23 bp, Homo sapiens
cagagtttttaaagccttctgga

SEQ ID NO: 6012589 - DNA, 19 bp, Homo sapiens
cagagttttttaaacaaat

SEQ ID NO: 6012590 - DNA, 23 bp, Homo sapiens
cagagttttttaaacaaatgagt

SEQ ID NO: 6012591 - DNA, 22 bp, Homo sapiens
cagataaaaacaatatatgtaa

SEQ ID NO: 6012592 - DNA, 13 bp, Homo sapiens
cagataaaatatt

SEQ ID NO: 6012593 - DNA, 16 bp, Homo sapiens
cagataaaattataga

SEQ ID NO: 6012594 - DNA, 21 bp, Homo sapiens
cagataaaattatagatggga

SEQ ID NO: 6012595 - DNA, 14 bp, Homo sapiens
cagataaacagtag

SEQ ID NO: 6012596 - DNA, 19 bp, Homo sapiens
cagataaactgatgtttga

SEQ ID NO: 6012597 - DNA, 21 bp, Homo sapiens
cagataaagacagctgacaga

SEQ ID NO: 6012598 - DNA, 22 bp, Homo sapiens
cagataaaggttcatgcaaact

SEQ ID NO: 6012599 - DNA, 18 bp, Homo sapiens
cagataaatagaactatc

SEQ ID NO: 6012600 - DNA, 14 bp, Homo sapiens
cagataaatcatgg

SEQ ID NO: 6012601 - DNA, 18 bp, Homo sapiens
cagataaatcatgggcat

SEQ ID NO: 6012602 - DNA, 21 bp, Homo sapiens
cagataaatgattcaaaaagt

SEQ ID NO: 6012603 - DNA, 15 bp, Homo sapiens
cagataacctaataa

SEQ ID NO: 6012604 - DNA, 18 bp, Homo sapiens
cagataacctaataattg

SEQ ID NO: 6012605 - DNA, 19 bp, Homo sapiens
cagataactgaaaattatt

SEQ ID NO: 6012606 - DNA, 14 bp, Homo sapiens
cagataactgagga

SEQ ID NO: 6012607 - DNA, 14 bp, Homo sapiens
cagataactgctgt

SEQ ID NO: 6012608 - DNA, 16 bp, Homo sapiens
cagataacttctttag

SEQ ID NO: 6012609 - DNA, 21 bp, Homo sapiens
cagataacttttttgagtcat

SEQ ID NO: 6012610 - DNA, 23 bp, Homo sapiens
cagataacttttttgagtcattg

SEQ ID NO: 6012611 - DNA, 20 bp, Homo sapiens
cagataagcaagagagatgt

SEQ ID NO: 6012612 - DNA, 17 bp, Homo sapiens
cagataagcctgaaaca

SEQ ID NO: 6012613 - DNA, 14 bp, Homo sapiens
cagataaggaaact

SEQ ID NO: 6012614 - DNA, 23 bp, Homo sapiens
cagataaggaaactgaggcccag

SEQ ID NO: 6012615 - DNA, 23 bp, Homo sapiens
cagataaggccgagcccacacca

SEQ ID NO: 6012616 - DNA, 20 bp, Homo sapiens
cagataaggtaaaatgccat

SEQ ID NO: 6012617 - DNA, 18 bp, Homo sapiens
cagataagttggagcagg

SEQ ID NO: 6012618 - DNA, 15 bp, Homo sapiens
cagataatcagcctc

SEQ ID NO: 6012619 - DNA, 23 bp, Homo sapiens
cagataatgcccagacatttttt

SEQ ID NO: 6012620 - DNA, 20 bp, Homo sapiens
cagataatgcttttactaag

SEQ ID NO: 6012621 - DNA, 16 bp, Homo sapiens
cagataatggtaattt

SEQ ID NO: 6012622 - DNA, 16 bp, Homo sapiens
cagataattcatttgt

SEQ ID NO: 6012623 - DNA, 19 bp, Homo sapiens
cagataattcatttgtatt

SEQ ID NO: 6012624 - DNA, 20 bp, Homo sapiens
cagatacacaagtgagggct

SEQ ID NO: 6012625 - DNA, 22 bp, Homo sapiens
cagatacagccccaaaccaggg

SEQ ID NO: 6012626 - DNA, 21 bp, Homo sapiens
cagatacaggaaaagctgctg

SEQ ID NO: 6012627 - DNA, 23 bp, Homo sapiens
cagatacaggaaaagctgctgac

SEQ ID NO: 6012628 - DNA, 18 bp, Homo sapiens
cagatacatacatagaga

SEQ ID NO: 6012629 - DNA, 17 bp, Homo sapiens
cagatacatatgagtgt

SEQ ID NO: 6012630 - DNA, 12 bp, Homo sapiens
cagatacatcac

SEQ ID NO: 6012631 - DNA, 19 bp, Homo sapiens
cagatacatcactgcttga

SEQ ID NO: 6012632 - DNA, 16 bp, Homo sapiens
cagatacccagtggaa

SEQ ID NO: 6012633 - DNA, 15 bp, Homo sapiens
cagatacctcaccct

SEQ ID NO: 6012634 - DNA, 22 bp, Homo sapiens
cagatacctcatcatccacccg

SEQ ID NO: 6012635 - DNA, 14 bp, Homo sapiens
cagatacctgtgag

SEQ ID NO: 6012636 - DNA, 18 bp, Homo sapiens
cagataccttatcttaca

SEQ ID NO: 6012637 - DNA, 22 bp, Homo sapiens
cagataccttatcttacaatat

SEQ ID NO: 6012638 - DNA, 21 bp, Homo sapiens
cagatacgggggctgtgactc

SEQ ID NO: 6012639 - DNA, 20 bp, Homo sapiens
cagatactcatcatatacaa

SEQ ID NO: 6012640 - DNA, 13 bp, Homo sapiens
cagatactggatt

SEQ ID NO: 6012641 - DNA, 14 bp, Homo sapiens
cagatactggattg

SEQ ID NO: 6012642 - DNA, 13 bp, Homo sapiens
cagatactgtgag

SEQ ID NO: 6012643 - DNA, 15 bp, Homo sapiens
cagatacttcagctt

SEQ ID NO: 6012644 - DNA, 14 bp, Homo sapiens
cagatagaaagcat

SEQ ID NO: 6012645 - DNA, 15 bp, Homo sapiens
cagatagaaagcatt

SEQ ID NO: 6012646 - DNA, 18 bp, Homo sapiens
cagatagaatttggccca

SEQ ID NO: 6012647 - DNA, 21 bp, Homo sapiens
cagatagaatttggcccagag

SEQ ID NO: 6012648 - DNA, 22 bp, Homo sapiens
cagatagaatttggcccagaga

SEQ ID NO: 6012649 - DNA, 16 bp, Homo sapiens
cagatagacagtgctg

SEQ ID NO: 6012650 - DNA, 20 bp, Homo sapiens
cagatagacagtgctgccct

SEQ ID NO: 6012651 - DNA, 13 bp, Homo sapiens
cagatagagctgg

SEQ ID NO: 6012652 - DNA, 15 bp, Homo sapiens
cagatagcaggagga

SEQ ID NO: 6012653 - DNA, 16 bp, Homo sapiens
cagatagccagacaca

SEQ ID NO: 6012654 - DNA, 16 bp, Homo sapiens
cagatagcccaggagc

SEQ ID NO: 6012655 - DNA, 14 bp, Homo sapiens
cagatagcctaggg

SEQ ID NO: 6012656 - DNA, 22 bp, Homo sapiens
cagatagctcaatactctctga

SEQ ID NO: 6012657 - DNA, 18 bp, Homo sapiens
cagataggccttcttgtg

SEQ ID NO: 6012658 - DNA, 22 bp, Homo sapiens
cagatagtatacacatcataaa

SEQ ID NO: 6012659 - DNA, 18 bp, Homo sapiens
cagatagtgtagctgagg

SEQ ID NO: 6012660 - DNA, 23 bp, Homo sapiens
cagatataaatactgacaatgta

SEQ ID NO: 6012661 - DNA, 15 bp, Homo sapiens
cagatataactgtct

SEQ ID NO: 6012662 - DNA, 18 bp, Homo sapiens
cagatataactgtcttgt

SEQ ID NO: 6012663 - DNA, 20 bp, Homo sapiens
cagatataactgtcttgttt

SEQ ID NO: 6012664 - DNA, 21 bp, Homo sapiens
cagatatagatcctgagctca

SEQ ID NO: 6012665 - DNA, 22 bp, Homo sapiens
cagatatagcattaataaaact

SEQ ID NO: 6012666 - DNA, 19 bp, Homo sapiens
cagatatatacacacagtg

SEQ ID NO: 6012667 - DNA, 23 bp, Homo sapiens
cagatatatttaagccttataaa

SEQ ID NO: 6012668 - DNA, 16 bp, Homo sapiens
cagatatatttttcac

SEQ ID NO: 6012669 - DNA, 18 bp, Homo sapiens
cagatatatttttcacag

SEQ ID NO: 6012670 - DNA, 13 bp, Homo sapiens
cagatatcaaaat

SEQ ID NO: 6012671 - DNA, 16 bp, Homo sapiens
cagatatcaaaattct

SEQ ID NO: 6012672 - DNA, 17 bp, Homo sapiens
cagatatcaaaattcta

SEQ ID NO: 6012673 - DNA, 23 bp, Homo sapiens
cagatatcaaaattctagctgta

SEQ ID NO: 6012674 - DNA, 24 bp, Homo sapiens
cagatatcaaaattctagctgtat

SEQ ID NO: 6012675 - DNA, 20 bp, Homo sapiens
cagatatcatactgattttt

SEQ ID NO: 6012676 - DNA, 22 bp, Homo sapiens
cagatatcatactgatttttaa

SEQ ID NO: 6012677 - DNA, 17 bp, Homo sapiens
cagatatccaaacaaga

SEQ ID NO: 6012678 - DNA, 15 bp, Homo sapiens
cagatatctgcatgt

SEQ ID NO: 6012679 - DNA, 22 bp, Homo sapiens
cagatatctttttcattattgt

SEQ ID NO: 6012680 - DNA, 15 bp, Homo sapiens
cagatatgattcaaa

SEQ ID NO: 6012681 - DNA, 19 bp, Homo sapiens
cagatatgattcaaatgtc

SEQ ID NO: 6012682 - DNA, 14 bp, Homo sapiens
cagatatggaaaca

SEQ ID NO: 6012683 - DNA, 22 bp, Homo sapiens
cagatatgggactgattctgtg

SEQ ID NO: 6012684 - DNA, 20 bp, Homo sapiens
cagatatgtattacttttct

SEQ ID NO: 6012685 - DNA, 20 bp, Homo sapiens
cagatattacagcttatttt

SEQ ID NO: 6012686 - DNA, 13 bp, Homo sapiens
cagatattccaga

SEQ ID NO: 6012687 - DNA, 20 bp, Homo sapiens
cagatattctctagtcattt

SEQ ID NO: 6012688 - DNA, 18 bp, Homo sapiens
cagatattgttataaata

SEQ ID NO: 6012689 - DNA, 14 bp, Homo sapiens
cagatatttaaatt

SEQ ID NO: 6012690 - DNA, 21 bp, Homo sapiens
cagatatttaaatttagtgct

SEQ ID NO: 6012691 - DNA, 15 bp, Homo sapiens
cagatatttagctct

SEQ ID NO: 6012692 - DNA, 11 bp, Homo sapiens
cagatatttat

SEQ ID NO: 6012693 - DNA, 20 bp, Homo sapiens
cagatatttatatttttatt

SEQ ID NO: 6012694 - DNA, 14 bp, Homo sapiens
cagatatttatgta

SEQ ID NO: 6012695 - DNA, 12 bp, Homo sapiens
cagatatttctt

SEQ ID NO: 6012696 - DNA, 15 bp, Homo sapiens
cagatatttgtcatg

SEQ ID NO: 6012697 - DNA, 14 bp, Homo sapiens
cagatcaagagttt

SEQ ID NO: 6012698 - DNA, 18 bp, Homo sapiens
cagatcaagcctgcctca

SEQ ID NO: 6012699 - DNA, 18 bp, Homo sapiens
cagatcaatggcgcagtg

SEQ ID NO: 6012700 - DNA, 21 bp, Homo sapiens
cagatcaccagcccggcctgc

SEQ ID NO: 6012701 - DNA, 14 bp, Homo sapiens
cagatcacgaggtc

SEQ ID NO: 6012702 - DNA, 18 bp, Homo sapiens
cagatcactgaatttata

SEQ ID NO: 6012703 - DNA, 19 bp, Homo sapiens
cagatcactgaatttataa

SEQ ID NO: 6012704 - DNA, 16 bp, Homo sapiens
cagatcactgccacac

SEQ ID NO: 6012705 - DNA, 21 bp, Homo sapiens
cagatcagactctccttcagg

SEQ ID NO: 6012706 - DNA, 20 bp, Homo sapiens
cagatcagctcctaaccctt

SEQ ID NO: 6012707 - DNA, 18 bp, Homo sapiens
cagatcaggaaccagggc

SEQ ID NO: 6012708 - DNA, 20 bp, Homo sapiens
cagatcaggcagtgtttaaa

SEQ ID NO: 6012709 - DNA, 18 bp, Homo sapiens
cagatcaggccttctttg

SEQ ID NO: 6012710 - DNA, 16 bp, Homo sapiens
cagatcagtaaagaac

SEQ ID NO: 6012711 - DNA, 16 bp, Homo sapiens
cagatcagtgtaccat

SEQ ID NO: 6012712 - DNA, 15 bp, Homo sapiens
cagatcatccagaag

SEQ ID NO: 6012713 - DNA, 20 bp, Homo sapiens
cagatcatctggggacctgg

SEQ ID NO: 6012714 - DNA, 14 bp, Homo sapiens
cagatcatggcagg

SEQ ID NO: 6012715 - DNA, 19 bp, Homo sapiens
cagatcatgggtcaagaga

SEQ ID NO: 6012716 - DNA, 22 bp, Homo sapiens
cagatccaaggccgcggcccag

SEQ ID NO: 6012717 - DNA, 20 bp, Homo sapiens
cagatccaccctatccctgt

SEQ ID NO: 6012718 - DNA, 15 bp, Homo sapiens
cagtcttttgctgtg

SEQ ID NO: 6012719 - DNA, 16 bp, Homo sapiens
cagtctttttctgttg

SEQ ID NO: 6012720 - DNA, 22 bp, Homo sapiens
cagtctttttggtgagggtaac

SEQ ID NO: 6012721 - DNA, 21 bp, Homo sapiens
cagtgaaaacaagtgctggca

SEQ ID NO: 6012722 - DNA, 17 bp, Homo sapiens
cagtgaaaagattttat

SEQ ID NO: 6012723 - DNA, 15 bp, Homo sapiens
cagtgaaaatgtaag

SEQ ID NO: 6012724 - DNA, 18 bp, Homo sapiens
cagtgaaacaaatttaca

SEQ ID NO: 6012725 - DNA, 14 bp, Homo sapiens
cagtgaaacacttg

SEQ ID NO: 6012726 - DNA, 19 bp, Homo sapiens
cagtgaaacgcaattttac

SEQ ID NO: 6012727 - DNA, 15 bp, Homo sapiens
cagtgaaaggcctgc

SEQ ID NO: 6012728 - DNA, 16 bp, Homo sapiens
cagtgaaatcatatta

SEQ ID NO: 6012729 - DNA, 19 bp, Homo sapiens
cagtgaaatcatattaatt

SEQ ID NO: 6012730 - DNA, 22 bp, Homo sapiens
cagtgaaattttggtgaatgtg

SEQ ID NO: 6012731 - DNA, 18 bp, Homo sapiens
cagtgaacaaatgtctta

SEQ ID NO: 6012732 - DNA, 19 bp, Homo sapiens
cagtgaacacactcagcag

SEQ ID NO: 6012733 - DNA, 13 bp, Homo sapiens
cagtgaacagctt

SEQ ID NO: 6012734 - DNA, 16 bp, Homo sapiens
cagtgaacagcttcac

SEQ ID NO: 6012735 - DNA, 14 bp, Homo sapiens
cagtgaacataact

SEQ ID NO: 6012736 - DNA, 21 bp, Homo sapiens
cagtgaacatactaattctat

SEQ ID NO: 6012737 - DNA, 14 bp, Homo sapiens
cagtgaacattccc

SEQ ID NO: 6012738 - DNA, 20 bp, Homo sapiens
cagtgaaccaaagagactgg

SEQ ID NO: 6012739 - DNA, 21 bp, Homo sapiens
cagtgaaccaaagagactgga

SEQ ID NO: 6012740 - DNA, 21 bp, Homo sapiens
cagtgaactaatttggttttt

SEQ ID NO: 6012741 - DNA, 15 bp, Homo sapiens
cagtgaactgagact

SEQ ID NO: 6012742 - DNA, 17 bp, Homo sapiens
cagtgaacttggctttc

SEQ ID NO: 6012743 - DNA, 18 bp, Homo sapiens
cagtgaacttgtctggct

SEQ ID NO: 6012744 - DNA, 14 bp, Homo sapiens
cagtgaagacagaa

SEQ ID NO: 6012745 - DNA, 18 bp, Homo sapiens
cagtgaagagtaagtttt

SEQ ID NO: 6012746 - DNA, 16 bp, Homo sapiens
cagtgaagatgtgtaa

SEQ ID NO: 6012747 - DNA, 21 bp, Homo sapiens
cagtgaagatgtgtaaataag

SEQ ID NO: 6012748 - DNA, 14 bp, Homo sapiens
cagtgaagatgttt

SEQ ID NO: 6012749 - DNA, 17 bp, Homo sapiens
cagtgaagatgtttact

SEQ ID NO: 6012750 - DNA, 17 bp, Homo sapiens
cagtgaagcagcactgt

SEQ ID NO: 6012751 - DNA, 18 bp, Homo sapiens
cagtgaaggcccatgaag

SEQ ID NO: 6012752 - DNA, 16 bp, Homo sapiens
cagtgaagggttttgt

SEQ ID NO: 6012753 - DNA, 24 bp, Homo sapiens
cagtgaaggtctttgttatgacag

SEQ ID NO: 6012754 - DNA, 19 bp, Homo sapiens
cagtgaagtagcctcttgt

SEQ ID NO: 6012755 - DNA, 21 bp, Homo sapiens
cagtgaagtgttctgctgaga

SEQ ID NO: 6012756 - DNA, 14 bp, Homo sapiens
cagtgaataaaagg

SEQ ID NO: 6012757 - DNA, 23 bp, Homo sapiens
cagtgaataaatattttaggaaa

SEQ ID NO: 6012758 - DNA, 15 bp, Homo sapiens
cagtgaatatttttg

SEQ ID NO: 6012759 - DNA, 20 bp, Homo sapiens
cagtgaatatttttgtattt

SEQ ID NO: 6012760 - DNA, 16 bp, Homo sapiens
cagtgaatctgtttca

SEQ ID NO: 6012761 - DNA, 20 bp, Homo sapiens
cagtgaatgattcagtgtta

SEQ ID NO: 6012762 - DNA, 14 bp, Homo sapiens
cagtgaattgtctt

SEQ ID NO: 6012763 - DNA, 16 bp, Homo sapiens
cagtgaattgtctttt

SEQ ID NO: 6012764 - DNA, 20 bp, Homo sapiens
cagtgaattgtgtaggagag

SEQ ID NO: 6012765 - DNA, 15 bp, Homo sapiens
cagtgaatttaagca

SEQ ID NO: 6012766 - DNA, 22 bp, Homo sapiens
cagtgaatttctgatttcactc

SEQ ID NO: 6012767 - DNA, 21 bp, Homo sapiens
cagtgaatttgcactgtttaa

SEQ ID NO: 6012768 - DNA, 14 bp, Homo sapiens
cagtgaatttgtcc

SEQ ID NO: 6012769 - DNA, 15 bp, Homo sapiens
cagtgaatttgtcca

SEQ ID NO: 6012770 - DNA, 22 bp, Homo sapiens
cagtgaatttgtccattgtaaa

SEQ ID NO: 6012771 - DNA, 17 bp, Homo sapiens
cagtgaatttttgcaat

SEQ ID NO: 6012772 - DNA, 20 bp, Homo sapiens
cagtgaatttttgcaataat

SEQ ID NO: 6012773 - DNA, 21 bp, Homo sapiens
cagtgaatttttgcaataatg

SEQ ID NO: 6012774 - DNA, 17 bp, Homo sapiens
cagtgacaaaaggctcg

SEQ ID NO: 6012775 - DNA, 22 bp, Homo sapiens
cagtgacaaagactcctctggg

SEQ ID NO: 6012776 - DNA, 13 bp, Homo sapiens
cagtgacaacatc

SEQ ID NO: 6012777 - DNA, 15 bp, Homo sapiens
cagtgacaagtggag

SEQ ID NO: 6012778 - DNA, 16 bp, Homo sapiens
cagtgacacaatctca

SEQ ID NO: 6012779 - DNA, 18 bp, Homo sapiens
cagtgacacccagaggga

SEQ ID NO: 6012780 - DNA, 23 bp, Homo sapiens
cagtgacacgtctcgccaagcag

SEQ ID NO: 6012781 - DNA, 23 bp, Homo sapiens
cagtgacacttcagagagctggt

SEQ ID NO: 6012782 - DNA, 18 bp, Homo sapiens
cagtgacagagttcacta

SEQ ID NO: 6012783 - DNA, 15 bp, Homo sapiens
cagtgacagtcactt

SEQ ID NO: 6012784 - DNA, 19 bp, Homo sapiens
cagtgacatcaaagcctgg

SEQ ID NO: 6012785 - DNA, 12 bp, Homo sapiens
cagtgaccaagg

SEQ ID NO: 6012786 - DNA, 18 bp, Homo sapiens
cagtgaccctggagctag

SEQ ID NO: 6012787 - DNA, 20 bp, Homo sapiens
cagtgaccctggagctaggg

SEQ ID NO: 6012788 - DNA, 24 bp, Homo sapiens
cagtgacccttcccaatcagcact

SEQ ID NO: 6012789 - DNA, 17 bp, Homo sapiens
cagtgaccgcttccccg

SEQ ID NO: 6012790 - DNA, 13 bp, Homo sapiens
cagtgacctgacc

SEQ ID NO: 6012791 - DNA, 16 bp, Homo sapiens
cagtgacctgaggaag

SEQ ID NO: 6012792 - DNA, 17 bp, Homo sapiens
cagtgacctgaggaagc

SEQ ID NO: 6012793 - DNA, 22 bp, Homo sapiens
cagtgacctgccctacatatct

SEQ ID NO: 6012794 - DNA, 13 bp, Homo sapiens
cagtgaccttttc

SEQ ID NO: 6012795 - DNA, 18 bp, Homo sapiens
cagtgaccttttcttcat

SEQ ID NO: 6012796 - DNA, 22 bp, Homo sapiens
cagtgacgtgcacctgtactca

SEQ ID NO: 6012797 - DNA, 12 bp, Homo sapiens
cagtgactaatt

SEQ ID NO: 6012798 - DNA, 15 bp, Homo sapiens
cagtgactaattttg

SEQ ID NO: 6012799 - DNA, 17 bp, Homo sapiens
cagtgactcatgctgga

SEQ ID NO: 6012800 - DNA, 10 bp, Homo sapiens
cagtgactcc

SEQ ID NO: 6012801 - DNA, 14 bp, Homo sapiens
cagtgactccaggg

SEQ ID NO: 6012802 - DNA, 16 bp, Homo sapiens
cagtgactccagggtg

SEQ ID NO: 6012803 - DNA, 22 bp, Homo sapiens
cagtgactccccagcccagcac

SEQ ID NO: 6012804 - DNA, 17 bp, Homo sapiens
cagtgactccctgggag

SEQ ID NO: 6012805 - DNA, 17 bp, Homo sapiens
cagtgactcctgctggt

SEQ ID NO: 6012806 - DNA, 20 bp, Homo sapiens
cagtgactcctgctggtacc

SEQ ID NO: 6012807 - DNA, 20 bp, Homo sapiens
cagtgactcgggctcctgtg

SEQ ID NO: 6012808 - DNA, 23 bp, Homo sapiens
cagtgactcgggctcctgtgccc

SEQ ID NO: 6012809 - DNA, 18 bp, Homo sapiens
cagtgactgaaaccattt

SEQ ID NO: 6012810 - DNA, 12 bp, Homo sapiens
cagtgactggca

SEQ ID NO: 6012811 - DNA, 17 bp, Homo sapiens
cagtgactggcaggtgc

SEQ ID NO: 6012812 - DNA, 16 bp, Homo sapiens
cagtgactgggccctg

SEQ ID NO: 6012813 - DNA, 21 bp, Homo sapiens
cagtgactgggccctgtccag

SEQ ID NO: 6012814 - DNA, 17 bp, Homo sapiens
cagtgactgtagttact

SEQ ID NO: 6012815 - DNA, 22 bp, Homo sapiens
cagtgactgtcgtgtttacaaa

SEQ ID NO: 6012816 - DNA, 19 bp, Homo sapiens
cagtgactgttgtagcatt

SEQ ID NO: 6012817 - DNA, 18 bp, Homo sapiens
cagtgacttaggaggctg

SEQ ID NO: 6012818 - DNA, 13 bp, Homo sapiens
cagtgacttattt

SEQ ID NO: 6012819 - DNA, 17 bp, Homo sapiens
cagtgacttatttgtag

SEQ ID NO: 6012820 - DNA, 19 bp, Homo sapiens
cagtgacttctgaatcctt

SEQ ID NO: 6012821 - DNA, 13 bp, Homo sapiens
cagtgacttctgg

SEQ ID NO: 6012822 - DNA, 15 bp, Homo sapiens
cagtgacttctggct

SEQ ID NO: 6012823 - DNA, 17 bp, Homo sapiens
cagtgacttctggctta

SEQ ID NO: 6012824 - DNA, 16 bp, Homo sapiens
cagtgacttgttctga

SEQ ID NO: 6012825 - DNA, 14 bp, Homo sapiens
cagtgactttgtat

SEQ ID NO: 6012826 - DNA, 16 bp, Homo sapiens
cagtgactttgtatag

SEQ ID NO: 6012827 - DNA, 19 bp, Homo sapiens
cagtgactttttctgagct

SEQ ID NO: 6012828 - DNA, 20 bp, Homo sapiens
cagtgactttttctgagctt

SEQ ID NO: 6012829 - DNA, 23 bp, Homo sapiens
cagtgagaaattacaggttcctt

SEQ ID NO: 6012830 - DNA, 21 bp, Homo sapiens
cagtgagaactctctccctgg

SEQ ID NO: 6012831 - DNA, 19 bp, Homo sapiens
cagtgagaagggcctgctc

SEQ ID NO: 6012832 - DNA, 20 bp, Homo sapiens
cagtgagaagggcctgctct

SEQ ID NO: 6012833 - DNA, 22 bp, Homo sapiens
cagtgagaagggcctgctctgc

SEQ ID NO: 6012834 - DNA, 23 bp, Homo sapiens
cagtgagaagggcctgctctgct

SEQ ID NO: 6012835 - DNA, 14 bp, Homo sapiens
cagtgagacacaga

SEQ ID NO: 6012836 - DNA, 18 bp, Homo sapiens
cagtgagacacagagtgg

SEQ ID NO: 6012837 - DNA, 19 bp, Homo sapiens
cagtgagacagtctggaaa

SEQ ID NO: 6012838 - DNA, 17 bp, Homo sapiens
cagtgagactgccccac

SEQ ID NO: 6012839 - DNA, 13 bp, Homo sapiens
cagtgagagcaga

SEQ ID NO: 6012840 - DNA, 14 bp, Homo sapiens
cagtgagaggggag

SEQ ID NO: 6012841 - DNA, 15 bp, Homo sapiens
cagtgagaggggagg

SEQ ID NO: 6012842 - DNA, 18 bp, Homo sapiens
cagtgagagtactcactt

SEQ ID NO: 6012843 - DNA, 20 bp, Homo sapiens
cagtgagagtactcactttt

SEQ ID NO: 6012844 - DNA, 16 bp, Homo sapiens
cagtgagagtgaggcc

SEQ ID NO: 6012845 - DNA, 14 bp, Homo sapiens
cagtgagatagaat

SEQ ID NO: 6012846 - DNA, 20 bp, Homo sapiens
cagtgagattacagaggaag

SEQ ID NO: 6012847 - DNA, 16 bp, Homo sapiens
cagtgagcactcccaa

SEQ ID NO: 6012848 - DNA, 17 bp, Homo sapiens
cagtgagcagagatcac

SEQ ID NO: 6012849 - DNA, 20 bp, Homo sapiens
cagtgagcagggtggggtct

SEQ ID NO: 6012850 - DNA, 22 bp, Homo sapiens
cagtgagcagggtggggtctgg

SEQ ID NO: 6012851 - DNA, 13 bp, Homo sapiens
cagtgagcagtgt

SEQ ID NO: 6012852 - DNA, 15 bp, Homo sapiens
cagtgagcagtgttg

SEQ ID NO: 6012853 - DNA, 23 bp, Homo sapiens
cagtgagccaagatcgcgccact

SEQ ID NO: 6012854 - DNA, 22 bp, Homo sapiens
cagtgagccagaaattgattaa

SEQ ID NO: 6012855 - DNA, 13 bp, Homo sapiens
cagtgagcccctc

SEQ ID NO: 6012856 - DNA, 15 bp, Homo sapiens
cagtgagcccctccc

SEQ ID NO: 6012857 - DNA, 21 bp, Homo sapiens
cagtgagcccctccccagcca

SEQ ID NO: 6012858 - DNA, 16 bp, Homo sapiens
cagtgagccctgctct

SEQ ID NO: 6012859 - DNA, 17 bp, Homo sapiens
cagtgagccctgctctt

SEQ ID NO: 6012860 - DNA, 18 bp, Homo sapiens
cagtgagccgagattgca

SEQ ID NO: 6012861 - DNA, 24 bp, Homo sapiens
cagtgagccgagattgcaccactg

SEQ ID NO: 6012862 - DNA, 15 bp, Homo sapiens
cagtgagcctcctgt

SEQ ID NO: 6012863 - DNA, 16 bp, Homo sapiens
cagtgagcctcctgtg

SEQ ID NO: 6012864 - DNA, 22 bp, Homo sapiens
cagtgagcctcctgtgcctggc

SEQ ID NO: 6012865 - DNA, 23 bp, Homo sapiens
cagtgagcctcctgtgcctggcc

SEQ ID NO: 6012866 - DNA, 15 bp, Homo sapiens
cagtgagcctctgcg

SEQ ID NO: 6012867 - DNA, 18 bp, Homo sapiens
cagtgagcctctgcgcct

SEQ ID NO: 6012868 - DNA, 14 bp, Homo sapiens
cagtgagctggaga

SEQ ID NO: 6012869 - DNA, 15 bp, Homo sapiens
cagtgagctgtgatt

SEQ ID NO: 6012870 - DNA, 13 bp, Homo sapiens
cagtgaggacctc

SEQ ID NO: 6012871 - DNA, 13 bp, Homo sapiens
cagtgaggactct

SEQ ID NO: 6012872 - DNA, 21 bp, Homo sapiens
cagtgaggagggatgtgggta

SEQ ID NO: 6012873 - DNA, 14 bp, Homo sapiens
cagtgaggatgaca

SEQ ID NO: 6012874 - DNA, 16 bp, Homo sapiens
cagtgaggcatctctc

SEQ ID NO: 6012875 - DNA, 17 bp, Homo sapiens
cagtgaggctctgccct

SEQ ID NO: 6012876 - DNA, 14 bp, Homo sapiens
cagtgagggctggg

SEQ ID NO: 6012877 - DNA, 14 bp, Homo sapiens
cagtgaggggccct

SEQ ID NO: 6012878 - DNA, 16 bp, Homo sapiens
cagtgagggtcttctt

SEQ ID NO: 6012879 - DNA, 15 bp, Homo sapiens
cagtgaggtcctggg

SEQ ID NO: 6012880 - DNA, 12 bp, Homo sapiens
cagtgaggtgag

SEQ ID NO: 6012881 - DNA, 15 bp, Homo sapiens
cagtgaggtgcccag

SEQ ID NO: 6012882 - DNA, 19 bp, Homo sapiens
cagtgagtcctcctcttcc

SEQ ID NO: 6012883 - DNA, 20 bp, Homo sapiens
cagtgagtcgaggacaggga

SEQ ID NO: 6012884 - DNA, 19 bp, Homo sapiens
cagtgagtgaatcaggcaa

SEQ ID NO: 6012885 - DNA, 15 bp, Homo sapiens
cagtgagtgagcctg

SEQ ID NO: 6012886 - DNA, 17 bp, Homo sapiens
cagtgagtgccatgctt

SEQ ID NO: 6012887 - DNA, 18 bp, Homo sapiens
cagtgagtgccatgcttt

SEQ ID NO: 6012888 - DNA, 19 bp, Homo sapiens
cagtgagtgtaaataattt

SEQ ID NO: 6012889 - DNA, 23 bp, Homo sapiens
cagtgagttacagcgagaggcag

SEQ ID NO: 6012890 - DNA, 14 bp, Homo sapiens
cagtgataagtata

SEQ ID NO: 6012891 - DNA, 18 bp, Homo sapiens
cagtgataatgccccaag

SEQ ID NO: 6012892 - DNA, 17 bp, Homo sapiens
cagtgataatgttcatt

SEQ ID NO: 6012893 - DNA, 18 bp, Homo sapiens
cagtgataatgttcattt

SEQ ID NO: 6012894 - DNA, 19 bp, Homo sapiens
cagtgataggcccaaggtc

SEQ ID NO: 6012895 - DNA, 23 bp, Homo sapiens
cagtgatatatttctatgtgtat

SEQ ID NO: 6012896 - DNA, 19 bp, Homo sapiens
cagatccacctgcacaaac

SEQ ID NO: 6012897 - DNA, 20 bp, Homo sapiens
cagatccacctgcacaaaca

SEQ ID NO: 6012898 - DNA, 15 bp, Homo sapiens
cagatccagactgta

SEQ ID NO: 6012899 - DNA, 22 bp, Homo sapiens
cagatccagactgtaagatgtt

SEQ ID NO: 6012900 - DNA, 13 bp, Homo sapiens
cagatccagcctg

SEQ ID NO: 6012901 - DNA, 17 bp, Homo sapiens
cagatccagcctggggt

SEQ ID NO: 6012902 - DNA, 18 bp, Homo sapiens
cagatccaggaacacatg

SEQ ID NO: 6012903 - DNA, 20 bp, Homo sapiens
cagatccaggaacacatgca

SEQ ID NO: 6012904 - DNA, 13 bp, Homo sapiens
cagatccaggact

SEQ ID NO: 6012905 - DNA, 17 bp, Homo sapiens
cagatccaggagctcca

SEQ ID NO: 6012906 - DNA, 18 bp, Homo sapiens
cagatccaggagctccag

SEQ ID NO: 6012907 - DNA, 19 bp, Homo sapiens
cagatccaggagctccagt

SEQ ID NO: 6012908 - DNA, 20 bp, Homo sapiens
cagatccaggagctccagtg

SEQ ID NO: 6012909 - DNA, 14 bp, Homo sapiens
cagatccaggcagg

SEQ ID NO: 6012910 - DNA, 21 bp, Homo sapiens
cagatccatccttttgcttca

SEQ ID NO: 6012911 - DNA, 13 bp, Homo sapiens
cagatcccaagag

SEQ ID NO: 6012912 - DNA, 18 bp, Homo sapiens
cagatcccagggtacact

SEQ ID NO: 6012913 - DNA, 14 bp, Homo sapiens
cagatccccaagcc

SEQ ID NO: 6012914 - DNA, 15 bp, Homo sapiens
cagatccccaagcct

SEQ ID NO: 6012915 - DNA, 14 bp, Homo sapiens
cagatccccagccc

SEQ ID NO: 6012916 - DNA, 16 bp, Homo sapiens
cagatccccagggcag

SEQ ID NO: 6012917 - DNA, 19 bp, Homo sapiens
cagatccctcggtcagcac

SEQ ID NO: 6012918 - DNA, 19 bp, Homo sapiens
cagatccgcatgtgtctgt

SEQ ID NO: 6012919 - DNA, 14 bp, Homo sapiens
cagatcctccattt

SEQ ID NO: 6012920 - DNA, 20 bp, Homo sapiens
cagatcctccatttttgttg

SEQ ID NO: 6012921 - DNA, 22 bp, Homo sapiens
cagatcctccgcggaggcccct

SEQ ID NO: 6012922 - DNA, 13 bp, Homo sapiens
cagatcctcctca

SEQ ID NO: 6012923 - DNA, 20 bp, Homo sapiens
cagatcctctttccccactg

SEQ ID NO: 6012924 - DNA, 16 bp, Homo sapiens
cagatcctgctgccgc

SEQ ID NO: 6012925 - DNA, 12 bp, Homo sapiens
cagatcctggaa

SEQ ID NO: 6012926 - DNA, 18 bp, Homo sapiens
cagatccttccaaactct

SEQ ID NO: 6012927 - DNA, 14 bp, Homo sapiens
cagatccttgtttc

SEQ ID NO: 6012928 - DNA, 16 bp, Homo sapiens
cagatccttgtttcaa

SEQ ID NO: 6012929 - DNA, 19 bp, Homo sapiens
cagatccttgtttcaaaca

SEQ ID NO: 6012930 - DNA, 22 bp, Homo sapiens
cagatccttttccatcccactc

SEQ ID NO: 6012931 - DNA, 13 bp, Homo sapiens
cagatcctttttc

SEQ ID NO: 6012932 - DNA, 19 bp, Homo sapiens
cagatcctttttccatcat

SEQ ID NO: 6012933 - DNA, 18 bp, Homo sapiens
cagatcgctcccttggct

SEQ ID NO: 6012934 - DNA, 18 bp, Homo sapiens
cagatcggatctgttgca

SEQ ID NO: 6012935 - DNA, 17 bp, Homo sapiens
cagatcggccacagggc

SEQ ID NO: 6012936 - DNA, 14 bp, Homo sapiens
cagatcgtacttga

SEQ ID NO: 6012937 - DNA, 16 bp, Homo sapiens
cagatcgtattaatta

SEQ ID NO: 6012938 - DNA, 17 bp, Homo sapiens
cagatcgtattaattat

SEQ ID NO: 6012939 - DNA, 21 bp, Homo sapiens
cagatcgtattaattatctga

SEQ ID NO: 6012940 - DNA, 16 bp, Homo sapiens
cagatcgtgccgtgga

SEQ ID NO: 6012941 - DNA, 14 bp, Homo sapiens
cagatcgttcattg

SEQ ID NO: 6012942 - DNA, 18 bp, Homo sapiens
cagatcgttcattgcctt

SEQ ID NO: 6012943 - DNA, 21 bp, Homo sapiens
cagatctagtcaatcaagtct

SEQ ID NO: 6012944 - DNA, 15 bp, Homo sapiens
cagatctagttctct

SEQ ID NO: 6012945 - DNA, 22 bp, Homo sapiens
cagatctagttctcttctcctg

SEQ ID NO: 6012946 - DNA, 20 bp, Homo sapiens
cagatctatagcagagtcct

SEQ ID NO: 6012947 - DNA, 23 bp, Homo sapiens
cagatctattgtttgttgcacta

SEQ ID NO: 6012948 - DNA, 15 bp, Homo sapiens
cagatctcatagatg

SEQ ID NO: 6012949 - DNA, 15 bp, Homo sapiens
cagatctcatgagaa

SEQ ID NO: 6012950 - DNA, 22 bp, Homo sapiens
cagatctcatggaaactggcca

SEQ ID NO: 6012951 - DNA, 14 bp, Homo sapiens
cagatctccaaagc

SEQ ID NO: 6012952 - DNA, 19 bp, Homo sapiens
cagatctcttgttcgcaca

SEQ ID NO: 6012953 - DNA, 23 bp, Homo sapiens
cagatctcttgttcgcacaatct

SEQ ID NO: 6012954 - DNA, 22 bp, Homo sapiens
cagatctgaagtagtgtgagtg

SEQ ID NO: 6012955 - DNA, 22 bp, Homo sapiens
cagatctgacatgattccttcc

SEQ ID NO: 6012956 - DNA, 17 bp, Homo sapiens
cagatctgatcaagagt

SEQ ID NO: 6012957 - DNA, 13 bp, Homo sapiens
cagatctgcactc

SEQ ID NO: 6012958 - DNA, 14 bp, Homo sapiens
cagatctgcctaag

SEQ ID NO: 6012959 - DNA, 18 bp, Homo sapiens
cagatctgcctgggcctg

SEQ ID NO: 6012960 - DNA, 15 bp, Homo sapiens
cagatctggaacctc

SEQ ID NO: 6012961 - DNA, 16 bp, Homo sapiens
cagatctggaatgtga

SEQ ID NO: 6012962 - DNA, 23 bp, Homo sapiens
cagatctggggcagcaccctata

SEQ ID NO: 6012963 - DNA, 18 bp, Homo sapiens
cagatctggtcccttgca

SEQ ID NO: 6012964 - DNA, 14 bp, Homo sapiens
cagatctgtcctgg

SEQ ID NO: 6012965 - DNA, 15 bp, Homo sapiens
cagatctgtcctggg

SEQ ID NO: 6012966 - DNA, 15 bp, Homo sapiens
cagatctgtctccaa

SEQ ID NO: 6012967 - DNA, 16 bp, Homo sapiens
cagatctgtctccaag

SEQ ID NO: 6012968 - DNA, 13 bp, Homo sapiens
cagatctgtctga

SEQ ID NO: 6012969 - DNA, 13 bp, Homo sapiens
cagatctgtgccc

SEQ ID NO: 6012970 - DNA, 13 bp, Homo sapiens
cagatctgtgcct

SEQ ID NO: 6012971 - DNA, 13 bp, Homo sapiens
cagatctgttttg

SEQ ID NO: 6012972 - DNA, 14 bp, Homo sapiens
cagatcttacaagt

SEQ ID NO: 6012973 - DNA, 13 bp, Homo sapiens
cagatcttgacag

SEQ ID NO: 6012974 - DNA, 12 bp, Homo sapiens
cagatcttgagc

SEQ ID NO: 6012975 - DNA, 19 bp, Homo sapiens
cagatcttgcctccagaga

SEQ ID NO: 6012976 - DNA, 13 bp, Homo sapiens
cagatcttggaat

SEQ ID NO: 6012977 - DNA, 18 bp, Homo sapiens
cagatcttggactcatga

SEQ ID NO: 6012978 - DNA, 22 bp, Homo sapiens
cagatcttggactcatgaggag

SEQ ID NO: 6012979 - DNA, 14 bp, Homo sapiens
cagatcttgttctt

SEQ ID NO: 6012980 - DNA, 23 bp, Homo sapiens
cagatctttaaatacagtcaact

SEQ ID NO: 6012981 - DNA, 15 bp, Homo sapiens
cagatctttcagaaa

SEQ ID NO: 6012982 - DNA, 17 bp, Homo sapiens
cagatctttcagaaata

SEQ ID NO: 6012983 - DNA, 12 bp, Homo sapiens
cagatctttctc

SEQ ID NO: 6012984 - DNA, 13 bp, Homo sapiens
cagatctttctct

SEQ ID NO: 6012985 - DNA, 16 bp, Homo sapiens
cagatctttctcttcc

SEQ ID NO: 6012986 - DNA, 13 bp, Homo sapiens
cagatcttttctt

SEQ ID NO: 6012987 - DNA, 15 bp, Homo sapiens
cagatgaaaagctac

SEQ ID NO: 6012988 - DNA, 17 bp, Homo sapiens
cagatgaaaataaaata

SEQ ID NO: 6012989 - DNA, 18 bp, Homo sapiens
cagatgaaaataaaataa

SEQ ID NO: 6012990 - DNA, 17 bp, Homo sapiens
cagatgaaaatttgaga

SEQ ID NO: 6012991 - DNA, 18 bp, Homo sapiens
cagatgaaaggagacaat

SEQ ID NO: 6012992 - DNA, 13 bp, Homo sapiens
cagatgaacattt

SEQ ID NO: 6012993 - DNA, 15 bp, Homo sapiens
cagatgaacatttca

SEQ ID NO: 6012994 - DNA, 19 bp, Homo sapiens
cagatgaactgactgaagg

SEQ ID NO: 6012995 - DNA, 23 bp, Homo sapiens
cagatgaatgtatttatttggga

SEQ ID NO: 6012996 - DNA, 20 bp, Homo sapiens
cagatgacaaaaaggtgcag

SEQ ID NO: 6012997 - DNA, 23 bp, Homo sapiens
cagatgacaaattatatttgaaa

SEQ ID NO: 6012998 - DNA, 23 bp, Homo sapiens
cagatgacaagaaaggctgctgt

SEQ ID NO: 6012999 - DNA, 16 bp, Homo sapiens
cagatgacacataaat

SEQ ID NO: 6013000 - DNA, 18 bp, Homo sapiens
cagatgacacataaatct

SEQ ID NO: 6013001 - DNA, 19 bp, Homo sapiens
cagatgacacataaatctg

SEQ ID NO: 6013002 - DNA, 21 bp, Homo sapiens
cagatgacacgcgctctccac

SEQ ID NO: 6013003 - DNA, 22 bp, Homo sapiens
cagatgacacgcgctctccacc

SEQ ID NO: 6013004 - DNA, 15 bp, Homo sapiens
cagatgacagggagc

SEQ ID NO: 6013005 - DNA, 18 bp, Homo sapiens
cagatgaccaaagtccct

SEQ ID NO: 6013006 - DNA, 17 bp, Homo sapiens
cagatgaccataatttt

SEQ ID NO: 6013007 - DNA, 21 bp, Homo sapiens
cagatgaccccagaaactgaa

SEQ ID NO: 6013008 - DNA, 16 bp, Homo sapiens
cagatgacccctgccc

SEQ ID NO: 6013009 - DNA, 14 bp, Homo sapiens
cagatgactagaaa

SEQ ID NO: 6013010 - DNA, 22 bp, Homo sapiens
cagatgagattccctctcctcc

SEQ ID NO: 6013011 - DNA, 23 bp, Homo sapiens
cagatgagcaaggacattgcccc

SEQ ID NO: 6013012 - DNA, 23 bp, Homo sapiens
cagatgagcagtcacactgttac

SEQ ID NO: 6013013 - DNA, 19 bp, Homo sapiens
cagatgaggaaacaggcct

SEQ ID NO: 6013014 - DNA, 19 bp, Homo sapiens
cagatgaggagcagctggg

SEQ ID NO: 6013015 - DNA, 22 bp, Homo sapiens
cagatgaggatccgaaacggca

SEQ ID NO: 6013016 - DNA, 13 bp, Homo sapiens
cagatgaggccct

SEQ ID NO: 6013017 - DNA, 14 bp, Homo sapiens
cagatgagggctgg

SEQ ID NO: 6013018 - DNA, 16 bp, Homo sapiens
cagatgagggctggct

SEQ ID NO: 6013019 - DNA, 17 bp, Homo sapiens
cagatgaggggccactg

SEQ ID NO: 6013020 - DNA, 14 bp, Homo sapiens
cagatgatccatga

SEQ ID NO: 6013021 - DNA, 19 bp, Homo sapiens
cagatgatccttgcacaga

SEQ ID NO: 6013022 - DNA, 18 bp, Homo sapiens
cagatgatctctccacgg

SEQ ID NO: 6013023 - DNA, 13 bp, Homo sapiens
cagatgatgccag

SEQ ID NO: 6013024 - DNA, 18 bp, Homo sapiens
cagatgatgctttggaag

SEQ ID NO: 6013025 - DNA, 19 bp, Homo sapiens
cagatgatgctttggaaga

SEQ ID NO: 6013026 - DNA, 17 bp, Homo sapiens
cagatgatggggtcagc

SEQ ID NO: 6013027 - DNA, 20 bp, Homo sapiens
cagatgatggggtcagcagg

SEQ ID NO: 6013028 - DNA, 22 bp, Homo sapiens
cagatgatggggtcagcaggcc

SEQ ID NO: 6013029 - DNA, 17 bp, Homo sapiens
cagatgatgtaaaaata

SEQ ID NO: 6013030 - DNA, 17 bp, Homo sapiens
cagatgattcaaatatc

SEQ ID NO: 6013031 - DNA, 16 bp, Homo sapiens
cagatgatttcccccc

SEQ ID NO: 6013032 - DNA, 16 bp, Homo sapiens
cagatgcaaagaggca

SEQ ID NO: 6013033 - DNA, 17 bp, Homo sapiens
cagatgcaaagaggcaa

SEQ ID NO: 6013034 - DNA, 13 bp, Homo sapiens
cagatgcaacctc

SEQ ID NO: 6013035 - DNA, 14 bp, Homo sapiens
cagatgcaatgact

SEQ ID NO: 6013036 - DNA, 17 bp, Homo sapiens
cagatgcacatgttgga

SEQ ID NO: 6013037 - DNA, 22 bp, Homo sapiens
cagatgcaccagcccttagcag

SEQ ID NO: 6013038 - DNA, 18 bp, Homo sapiens
cagatgcagagagccatt

SEQ ID NO: 6013039 - DNA, 13 bp, Homo sapiens
cagatgcaggaca

SEQ ID NO: 6013040 - DNA, 15 bp, Homo sapiens
cagatgcaggacagg

SEQ ID NO: 6013041 - DNA, 20 bp, Homo sapiens
cagatgcaggacaggaggcg

SEQ ID NO: 6013042 - DNA, 23 bp, Homo sapiens
cagatgcaggacaggaggcggcc

SEQ ID NO: 6013043 - DNA, 14 bp, Homo sapiens
cagatgcagggcag

SEQ ID NO: 6013044 - DNA, 17 bp, Homo sapiens
cagatgcagggctgcag

SEQ ID NO: 6013045 - DNA, 15 bp, Homo sapiens
cagatgcagttttca

SEQ ID NO: 6013046 - DNA, 22 bp, Homo sapiens
cagatgcatatagacacacata

SEQ ID NO: 6013047 - DNA, 21 bp, Homo sapiens
cagatgccaacttcccacacg

SEQ ID NO: 6013048 - DNA, 18 bp, Homo sapiens
cagatgccaccctagcca

SEQ ID NO: 6013049 - DNA, 14 bp, Homo sapiens
cagatgccagagca

SEQ ID NO: 6013050 - DNA, 20 bp, Homo sapiens
cagatgccatggcctgtgct

SEQ ID NO: 6013051 - DNA, 22 bp, Homo sapiens
cagatgcccagagggcccaggc

SEQ ID NO: 6013052 - DNA, 19 bp, Homo sapiens
cagatgcccgagggagggg

SEQ ID NO: 6013053 - DNA, 11 bp, Homo sapiens
cagatgccctt

SEQ ID NO: 6013054 - DNA, 14 bp, Homo sapiens
cagatgcccttgct

SEQ ID NO: 6013055 - DNA, 15 bp, Homo sapiens
cagatgcccttgctg

SEQ ID NO: 6013056 - DNA, 15 bp, Homo sapiens
cagatgccggagccc

SEQ ID NO: 6013057 - DNA, 18 bp, Homo sapiens
cagatgccggagccccaa

SEQ ID NO: 6013058 - DNA, 16 bp, Homo sapiens
cagatgcctacttttg

SEQ ID NO: 6013059 - DNA, 20 bp, Homo sapiens
cagatgcctacttttggcct

SEQ ID NO: 6013060 - DNA, 22 bp, Homo sapiens
cagatgcctccaccccccagaa

SEQ ID NO: 6013061 - DNA, 20 bp, Homo sapiens
cagatgcctccccaagactg

SEQ ID NO: 6013062 - DNA, 17 bp, Homo sapiens
cagatgcctccttcctc

SEQ ID NO: 6013063 - DNA, 15 bp, Homo sapiens
cagatgcctgcttga

SEQ ID NO: 6013064 - DNA, 22 bp, Homo sapiens
cagatgcctgcttgataatata

SEQ ID NO: 6013065 - DNA, 12 bp, Homo sapiens
cagatgcctggg

SEQ ID NO: 6013066 - DNA, 14 bp, Homo sapiens
cagatgcctggtga

SEQ ID NO: 6013067 - DNA, 18 bp, Homo sapiens
cagatgcctggtgagcag

SEQ ID NO: 6013068 - DNA, 19 bp, Homo sapiens
cagatgcctggtgagcagg

SEQ ID NO: 6013069 - DNA, 14 bp, Homo sapiens
cagatgccttctag

SEQ ID NO: 6013070 - DNA, 16 bp, Homo sapiens
cagatgccttctagat

SEQ ID NO: 6013071 - DNA, 18 bp, Homo sapiens
cagatgcggggacaggct

SEQ ID NO: 6013072 - DNA, 20 bp, Homo sapiens
cagatgcggggacaggctgg

SEQ ID NO: 6013073 - DNA, 20 bp, Homo sapiens
cagatgcgtcccaagatgtt

SEQ ID NO: 6013074 - DNA, 21 bp, Homo sapiens
cagatgcgtcccaagatgttg

SEQ ID NO: 6013075 - DNA, 18 bp, Homo sapiens
cagtgatatctttctcat

SEQ ID NO: 6013076 - DNA, 15 bp, Homo sapiens
cagtgatatggcaga

SEQ ID NO: 6013077 - DNA, 18 bp, Homo sapiens
cagtgatatggcagaaga

SEQ ID NO: 6013078 - DNA, 22 bp, Homo sapiens
cagtgatatggcagaagacacc

SEQ ID NO: 6013079 - DNA, 22 bp, Homo sapiens
cagtgatatgtaaattaaatga

SEQ ID NO: 6013080 - DNA, 14 bp, Homo sapiens
cagtgatattcttt

SEQ ID NO: 6013081 - DNA, 15 bp, Homo sapiens
cagtgatattctttg

SEQ ID NO: 6013082 - DNA, 22 bp, Homo sapiens
cagtgatcctcaaacacacaaa

SEQ ID NO: 6013083 - DNA, 16 bp, Homo sapiens
cagtgatctccatatg

SEQ ID NO: 6013084 - DNA, 21 bp, Homo sapiens
cagtgatctccatatgttaca

SEQ ID NO: 6013085 - DNA, 19 bp, Homo sapiens
cagtgatgacttgctgtcc

SEQ ID NO: 6013086 - DNA, 14 bp, Homo sapiens
cagtgatgatgcat

SEQ ID NO: 6013087 - DNA, 17 bp, Homo sapiens
cagtgatgatgttttga

SEQ ID NO: 6013088 - DNA, 18 bp, Homo sapiens
cagtgatgatgttttgat

SEQ ID NO: 6013089 - DNA, 14 bp, Homo sapiens
cagtgatgccgggc

SEQ ID NO: 6013090 - DNA, 18 bp, Homo sapiens
cagtgatgccgggcgcca

SEQ ID NO: 6013091 - DNA, 20 bp, Homo sapiens
cagtgatgccgggcgccagg

SEQ ID NO: 6013092 - DNA, 18 bp, Homo sapiens
cagtgatgctggatgctc

SEQ ID NO: 6013093 - DNA, 22 bp, Homo sapiens
cagtgatgcttttagttttaaa

SEQ ID NO: 6013094 - DNA, 23 bp, Homo sapiens
cagtgatggcgcgggaggcacca

SEQ ID NO: 6013095 - DNA, 21 bp, Homo sapiens
cagtgatgggagtaagagcaa

SEQ ID NO: 6013096 - DNA, 23 bp, Homo sapiens
cagtgatgtaccatgaaacaaag

SEQ ID NO: 6013097 - DNA, 19 bp, Homo sapiens
cagtgatgtatacatctta

SEQ ID NO: 6013098 - DNA, 21 bp, Homo sapiens
cagtgatgtgctggagctggc

SEQ ID NO: 6013099 - DNA, 23 bp, Homo sapiens
cagtgattaaggtctctctttgg

SEQ ID NO: 6013100 - DNA, 14 bp, Homo sapiens
cagtgattagcctc

SEQ ID NO: 6013101 - DNA, 18 bp, Homo sapiens
cagtgattatttttccag

SEQ ID NO: 6013102 - DNA, 19 bp, Homo sapiens
cagtgattcgagctatatt

SEQ ID NO: 6013103 - DNA, 23 bp, Homo sapiens
cagtgattgaagtatctgtacct

SEQ ID NO: 6013104 - DNA, 16 bp, Homo sapiens
cagtgatttacatgct

SEQ ID NO: 6013105 - DNA, 19 bp, Homo sapiens
cagtgatttacatgctgat

SEQ ID NO: 6013106 - DNA, 11 bp, Homo sapiens
cagtgatttcc

SEQ ID NO: 6013107 - DNA, 22 bp, Homo sapiens
cagtgatttttagtaaccttta

SEQ ID NO: 6013108 - DNA, 17 bp, Homo sapiens
cagtgatttttatccaa

SEQ ID NO: 6013109 - DNA, 18 bp, Homo sapiens
cagtgatttttcccccca

SEQ ID NO: 6013110 - DNA, 22 bp, Homo sapiens
cagtgatttttttcttgtaatt

SEQ ID NO: 6013111 - DNA, 14 bp, Homo sapiens
cagtgcaaaatgtc

SEQ ID NO: 6013112 - DNA, 15 bp, Homo sapiens
cagtgcaaaccactt

SEQ ID NO: 6013113 - DNA, 17 bp, Homo sapiens
cagtgcaaaccacttct

SEQ ID NO: 6013114 - DNA, 14 bp, Homo sapiens
cagtgcaacaaaat

SEQ ID NO: 6013115 - DNA, 14 bp, Homo sapiens
cagtgcaacactgg

SEQ ID NO: 6013116 - DNA, 16 bp, Homo sapiens
cagtgcaacctctgct

SEQ ID NO: 6013117 - DNA, 23 bp, Homo sapiens
cagtgcaagagactctggcctcc

SEQ ID NO: 6013118 - DNA, 24 bp, Homo sapiens
cagtgcaagagactctggcctcca

SEQ ID NO: 6013119 - DNA, 20 bp, Homo sapiens
cagtgcaagagactttgtca

SEQ ID NO: 6013120 - DNA, 18 bp, Homo sapiens
cagtgcaatctgtccaga

SEQ ID NO: 6013121 - DNA, 20 bp, Homo sapiens
cagtgcaatctgtccagaca

SEQ ID NO: 6013122 - DNA, 18 bp, Homo sapiens
cagtgcacacggatgcac

SEQ ID NO: 6013123 - DNA, 12 bp, Homo sapiens
cagtgcacatga

SEQ ID NO: 6013124 - DNA, 14 bp, Homo sapiens
cagtgcacatgaac

SEQ ID NO: 6013125 - DNA, 19 bp, Homo sapiens
cagtgcacatttggaattg

SEQ ID NO: 6013126 - DNA, 22 bp, Homo sapiens
cagtgcacctgtggcctctcag

SEQ ID NO: 6013127 - DNA, 22 bp, Homo sapiens
cagtgcactaaccccagctgcc

SEQ ID NO: 6013128 - DNA, 15 bp, Homo sapiens
cagtgcactcagagc

SEQ ID NO: 6013129 - DNA, 13 bp, Homo sapiens
cagtgcactccgg

SEQ ID NO: 6013130 - DNA, 14 bp, Homo sapiens
cagtgcactgaaag

SEQ ID NO: 6013131 - DNA, 17 bp, Homo sapiens
cagtgcagaaatgaaat

SEQ ID NO: 6013132 - DNA, 15 bp, Homo sapiens
cagtgcagaatgtaa

SEQ ID NO: 6013133 - DNA, 12 bp, Homo sapiens
cagtgcagacag

SEQ ID NO: 6013134 - DNA, 20 bp, Homo sapiens
cagtgcagcaaccagagcac

SEQ ID NO: 6013135 - DNA, 15 bp, Homo sapiens
cagtgcagcagagga

SEQ ID NO: 6013136 - DNA, 22 bp, Homo sapiens
cagtgcagcatatacaataatg

SEQ ID NO: 6013137 - DNA, 13 bp, Homo sapiens
cagtgcagccact

SEQ ID NO: 6013138 - DNA, 16 bp, Homo sapiens
cagtgcagccactggc

SEQ ID NO: 6013139 - DNA, 16 bp, Homo sapiens
cagtgcagcccgtgtg

SEQ ID NO: 6013140 - DNA, 14 bp, Homo sapiens
cagtgcaggctggc

SEQ ID NO: 6013141 - DNA, 17 bp, Homo sapiens
cagtgcaggctggccag

SEQ ID NO: 6013142 - DNA, 18 bp, Homo sapiens
cagtgcagggacagcctg

SEQ ID NO: 6013143 - DNA, 19 bp, Homo sapiens
cagtgcagggacagcctgc

SEQ ID NO: 6013144 - DNA, 20 bp, Homo sapiens
cagtgcagggcaaaatattc

SEQ ID NO: 6013145 - DNA, 13 bp, Homo sapiens
cagtgcagggctg

SEQ ID NO: 6013146 - DNA, 17 bp, Homo sapiens
cagtgcagtagtgccaa

SEQ ID NO: 6013147 - DNA, 18 bp, Homo sapiens
cagtgcagtccatttcct

SEQ ID NO: 6013148 - DNA, 19 bp, Homo sapiens
cagtgcagtccatttccta

SEQ ID NO: 6013149 - DNA, 22 bp, Homo sapiens
cagtgcagtgatacatgtactc

SEQ ID NO: 6013150 - DNA, 22 bp, Homo sapiens
cagtgcagtttctaagcatgta

SEQ ID NO: 6013151 - DNA, 14 bp, Homo sapiens
cagtgcatattcct

SEQ ID NO: 6013152 - DNA, 18 bp, Homo sapiens
cagtgcatattcctttct

SEQ ID NO: 6013153 - DNA, 10 bp, Homo sapiens
cagtgcatca

SEQ ID NO: 6013154 - DNA, 18 bp, Homo sapiens
cagtgcatcacatctgca

SEQ ID NO: 6013155 - DNA, 21 bp, Homo sapiens
cagtgcatcattactgttcca

SEQ ID NO: 6013156 - DNA, 22 bp, Homo sapiens
cagtgcatccccacgacccctg

SEQ ID NO: 6013157 - DNA, 23 bp, Homo sapiens
cagtgcatccccacgacccctgc

SEQ ID NO: 6013158 - DNA, 14 bp, Homo sapiens
cagtgcatccttca

SEQ ID NO: 6013159 - DNA, 16 bp, Homo sapiens
cagtgcatctcagccc

SEQ ID NO: 6013160 - DNA, 22 bp, Homo sapiens
cagtgcatgacgtttaaggcca

SEQ ID NO: 6013161 - DNA, 13 bp, Homo sapiens
cagtgcatgcatg

SEQ ID NO: 6013162 - DNA, 13 bp, Homo sapiens
cagtgcatgccag

SEQ ID NO: 6013163 - DNA, 13 bp, Homo sapiens
cagtgcatgctgt

SEQ ID NO: 6013164 - DNA, 19 bp, Homo sapiens
cagtgcatgctgtccctta

SEQ ID NO: 6013165 - DNA, 18 bp, Homo sapiens
cagtgcatggggaggcac

SEQ ID NO: 6013166 - DNA, 14 bp, Homo sapiens
cagtgcatggtggc

SEQ ID NO: 6013167 - DNA, 18 bp, Homo sapiens
cagtgcatggtggccaga

SEQ ID NO: 6013168 - DNA, 20 bp, Homo sapiens
cagtgcatgtgaagcatgct

SEQ ID NO: 6013169 - DNA, 18 bp, Homo sapiens
cagtgcatgtgcatgcat

SEQ ID NO: 6013170 - DNA, 17 bp, Homo sapiens
cagtgcattatgtacac

SEQ ID NO: 6013171 - DNA, 22 bp, Homo sapiens
cagtgcattttcaacattgatt

SEQ ID NO: 6013172 - DNA, 18 bp, Homo sapiens
cagtgcattttgtttctg

SEQ ID NO: 6013173 - DNA, 21 bp, Homo sapiens
cagtgcattttgtttctgtat

SEQ ID NO: 6013174 - DNA, 15 bp, Homo sapiens
cagtgccaaacttgg

SEQ ID NO: 6013175 - DNA, 19 bp, Homo sapiens
cagtgccaaatgctggggc

SEQ ID NO: 6013176 - DNA, 17 bp, Homo sapiens
cagtgccaactcctcac

SEQ ID NO: 6013177 - DNA, 20 bp, Homo sapiens
cagtgccaactgtggctggt

SEQ ID NO: 6013178 - DNA, 15 bp, Homo sapiens
cagtgccaagcacag

SEQ ID NO: 6013179 - DNA, 19 bp, Homo sapiens
cagtgccaagcacagtgcc

SEQ ID NO: 6013180 - DNA, 19 bp, Homo sapiens
cagtgccacagcctgctgg

SEQ ID NO: 6013181 - DNA, 21 bp, Homo sapiens
cagtgccacagcctgctggca

SEQ ID NO: 6013182 - DNA, 22 bp, Homo sapiens
cagtgccacagcctgctggcag

SEQ ID NO: 6013183 - DNA, 24 bp, Homo sapiens
cagtgccacagcctgctggcaggg

SEQ ID NO: 6013184 - DNA, 13 bp, Homo sapiens
cagtgccaccaag

SEQ ID NO: 6013185 - DNA, 22 bp, Homo sapiens
cagtgccaccaagctcacacct

SEQ ID NO: 6013186 - DNA, 12 bp, Homo sapiens
cagtgccaccca

SEQ ID NO: 6013187 - DNA, 14 bp, Homo sapiens
cagtgccacctatg

SEQ ID NO: 6013188 - DNA, 21 bp, Homo sapiens
cagtgccacctatgcctgtgg

SEQ ID NO: 6013189 - DNA, 14 bp, Homo sapiens
cagtgccactgccc

SEQ ID NO: 6013190 - DNA, 23 bp, Homo sapiens
cagtgccagcaagtccttaggct

SEQ ID NO: 6013191 - DNA, 17 bp, Homo sapiens
cagtgccagcaatgaca

SEQ ID NO: 6013192 - DNA, 23 bp, Homo sapiens
cagtgccagcccctgctggctgg

SEQ ID NO: 6013193 - DNA, 16 bp, Homo sapiens
cagtgccagctccagt

SEQ ID NO: 6013194 - DNA, 15 bp, Homo sapiens
cagtgccagctccct

SEQ ID NO: 6013195 - DNA, 17 bp, Homo sapiens
cagtgccagctggtgaa

SEQ ID NO: 6013196 - DNA, 14 bp, Homo sapiens
cagtgccaggacag

SEQ ID NO: 6013197 - DNA, 15 bp, Homo sapiens
cagtgccaggacagc

SEQ ID NO: 6013198 - DNA, 16 bp, Homo sapiens
cagtgccaggacagct

SEQ ID NO: 6013199 - DNA, 19 bp, Homo sapiens
cagtgccaggacagctggc

SEQ ID NO: 6013200 - DNA, 23 bp, Homo sapiens
cagtgccaggacagctggctgct

SEQ ID NO: 6013201 - DNA, 12 bp, Homo sapiens
cagtgccagggt

SEQ ID NO: 6013202 - DNA, 22 bp, Homo sapiens
cagtgccagggtgggctgggga

SEQ ID NO: 6013203 - DNA, 13 bp, Homo sapiens
cagtgccatcccc

SEQ ID NO: 6013204 - DNA, 18 bp, Homo sapiens
cagtgccatccccacctt

SEQ ID NO: 6013205 - DNA, 22 bp, Homo sapiens
cagtgccattgtctttatatga

SEQ ID NO: 6013206 - DNA, 12 bp, Homo sapiens
cagtgcccacag

SEQ ID NO: 6013207 - DNA, 11 bp, Homo sapiens
cagtgcccacc

SEQ ID NO: 6013208 - DNA, 16 bp, Homo sapiens
cagtgcccaccaacat

SEQ ID NO: 6013209 - DNA, 21 bp, Homo sapiens
cagtgcccaccaacatcccat

SEQ ID NO: 6013210 - DNA, 14 bp, Homo sapiens
cagtgcccaccgcc

SEQ ID NO: 6013211 - DNA, 11 bp, Homo sapiens
cagtgcccagg

SEQ ID NO: 6013212 - DNA, 19 bp, Homo sapiens
cagtgcccattcctcacct

SEQ ID NO: 6013213 - DNA, 16 bp, Homo sapiens
cagtgccccagggagt

SEQ ID NO: 6013214 - DNA, 18 bp, Homo sapiens
cagtgccccagggagtcc

SEQ ID NO: 6013215 - DNA, 15 bp, Homo sapiens
cagtgccccagtggt

SEQ ID NO: 6013216 - DNA, 21 bp, Homo sapiens
cagtgcccccactgaccagaa

SEQ ID NO: 6013217 - DNA, 19 bp, Homo sapiens
cagtgcccggtgcagggcc

SEQ ID NO: 6013218 - DNA, 20 bp, Homo sapiens
cagtgcccggtgcagggcct

SEQ ID NO: 6013219 - DNA, 21 bp, Homo sapiens
cagtgcccggtgcagggcctg

SEQ ID NO: 6013220 - DNA, 22 bp, Homo sapiens
cagtgcccgttttaccaataaa

SEQ ID NO: 6013221 - DNA, 17 bp, Homo sapiens
cagtgccctcattttat

SEQ ID NO: 6013222 - DNA, 22 bp, Homo sapiens
cagtgccctctcccctcagcct

SEQ ID NO: 6013223 - DNA, 21 bp, Homo sapiens
cagtgccctctggacagcttg

SEQ ID NO: 6013224 - DNA, 13 bp, Homo sapiens
cagtgccctgagc

SEQ ID NO: 6013225 - DNA, 15 bp, Homo sapiens
cagtgccctgagcca

SEQ ID NO: 6013226 - DNA, 15 bp, Homo sapiens
cagtgccctgatccc

SEQ ID NO: 6013227 - DNA, 12 bp, Homo sapiens
cagtgcccttgg

SEQ ID NO: 6013228 - DNA, 11 bp, Homo sapiens
cagtgcccttt

SEQ ID NO: 6013229 - DNA, 15 bp, Homo sapiens
cagtgccgagaagga

SEQ ID NO: 6013230 - DNA, 17 bp, Homo sapiens
cagtgccgaggacatgc

SEQ ID NO: 6013231 - DNA, 17 bp, Homo sapiens
cagtgccgccgcctcgc

SEQ ID NO: 6013232 - DNA, 20 bp, Homo sapiens
cagtgccgccgcctcgccca

SEQ ID NO: 6013233 - DNA, 16 bp, Homo sapiens
cagtgccgctcctgct

SEQ ID NO: 6013234 - DNA, 23 bp, Homo sapiens
cagtgcctacatcccgggcctca

SEQ ID NO: 6013235 - DNA, 15 bp, Homo sapiens
cagtgcctattgata

SEQ ID NO: 6013236 - DNA, 15 bp, Homo sapiens
cagtgcctcaccttc

SEQ ID NO: 6013237 - DNA, 17 bp, Homo sapiens
cagtgcctcaccttcca

SEQ ID NO: 6013238 - DNA, 22 bp, Homo sapiens
cagtgcctcaccttccaacact

SEQ ID NO: 6013239 - DNA, 23 bp, Homo sapiens
cagtgcctccacatgctgcctgg

SEQ ID NO: 6013240 - DNA, 16 bp, Homo sapiens
cagtgcctcctggccg

SEQ ID NO: 6013241 - DNA, 14 bp, Homo sapiens
cagtgcctcgaggc

SEQ ID NO: 6013242 - DNA, 12 bp, Homo sapiens
cagtgcctctcc

SEQ ID NO: 6013243 - DNA, 20 bp, Homo sapiens
cagtgcctctccctgctgct

SEQ ID NO: 6013244 - DNA, 21 bp, Homo sapiens
cagtgcctctccctgctgctc

SEQ ID NO: 6013245 - DNA, 22 bp, Homo sapiens
cagtgcctctccctgctgctcc

SEQ ID NO: 6013246 - DNA, 20 bp, Homo sapiens
cagtgcctcttccagtgaac

SEQ ID NO: 6013247 - DNA, 22 bp, Homo sapiens
cagtgcctcttccagtgaacat

SEQ ID NO: 6013248 - DNA, 18 bp, Homo sapiens
cagtgcctcttgtctgag

SEQ ID NO: 6013249 - DNA, 22 bp, Homo sapiens
cagtgcctgcacatcatgagcc

SEQ ID NO: 6013250 - DNA, 23 bp, Homo sapiens
cagtgcctgccactctctgggac

SEQ ID NO: 6013251 - DNA, 24 bp, Homo sapiens
cagtgcctgccactctctgggact

SEQ ID NO: 6013252 - DNA, 14 bp, Homo sapiens
cagatgcgtgccca

SEQ ID NO: 6013253 - DNA, 20 bp, Homo sapiens
cagatgcgttcgcctctggc

SEQ ID NO: 6013254 - DNA, 22 bp, Homo sapiens
cagatgcgttcgcctctggccc

SEQ ID NO: 6013255 - DNA, 16 bp, Homo sapiens
cagatgctaataaact

SEQ ID NO: 6013256 - DNA, 20 bp, Homo sapiens
cagatgctagagcctctgcc

SEQ ID NO: 6013257 - DNA, 20 bp, Homo sapiens
cagatgctatcacagactct

SEQ ID NO: 6013258 - DNA, 19 bp, Homo sapiens
cagatgctcattgctttct

SEQ ID NO: 6013259 - DNA, 14 bp, Homo sapiens
cagatgctccaaga

SEQ ID NO: 6013260 - DNA, 15 bp, Homo sapiens
cagatgctccaagat

SEQ ID NO: 6013261 - DNA, 22 bp, Homo sapiens
cagatgctccaagattctagat

SEQ ID NO: 6013262 - DNA, 23 bp, Homo sapiens
cagatgctccaagattctagatg

SEQ ID NO: 6013263 - DNA, 13 bp, Homo sapiens
cagatgctcttgg

SEQ ID NO: 6013264 - DNA, 15 bp, Homo sapiens
cagatgctgagccat

SEQ ID NO: 6013265 - DNA, 16 bp, Homo sapiens
cagatgctgagccata

SEQ ID NO: 6013266 - DNA, 17 bp, Homo sapiens
cagatgctgatgttcag

SEQ ID NO: 6013267 - DNA, 13 bp, Homo sapiens
cagatgctggcct

SEQ ID NO: 6013268 - DNA, 12 bp, Homo sapiens
cagatgctgggc

SEQ ID NO: 6013269 - DNA, 19 bp, Homo sapiens
cagatgctggtcatcctgg

SEQ ID NO: 6013270 - DNA, 20 bp, Homo sapiens
cagatgctgtcactggcaga

SEQ ID NO: 6013271 - DNA, 22 bp, Homo sapiens
cagatgctgtcactggcagagc

SEQ ID NO: 6013272 - DNA, 14 bp, Homo sapiens
cagatgctgtgtaa

SEQ ID NO: 6013273 - DNA, 18 bp, Homo sapiens
cagatgctgttgtgaagc

SEQ ID NO: 6013274 - DNA, 19 bp, Homo sapiens
cagatgctttgcccaggct

SEQ ID NO: 6013275 - DNA, 21 bp, Homo sapiens
cagatgctttgcccaggcttc

SEQ ID NO: 6013276 - DNA, 14 bp, Homo sapiens
cagatgcttttctg

SEQ ID NO: 6013277 - DNA, 17 bp, Homo sapiens
cagatgcttttgctaat

SEQ ID NO: 6013278 - DNA, 20 bp, Homo sapiens
cagatgcttttgtgagaaag

SEQ ID NO: 6013279 - DNA, 18 bp, Homo sapiens
cagatggaaaaactgagg

SEQ ID NO: 6013280 - DNA, 19 bp, Homo sapiens
cagatggaaaattcatttt

SEQ ID NO: 6013281 - DNA, 21 bp, Homo sapiens
cagatggaaagacgtttttgt

SEQ ID NO: 6013282 - DNA, 19 bp, Homo sapiens
cagatggaaccgcaggaag

SEQ ID NO: 6013283 - DNA, 18 bp, Homo sapiens
cagatggaagaagtttta

SEQ ID NO: 6013284 - DNA, 16 bp, Homo sapiens
cagatggaccaaaaga

SEQ ID NO: 6013285 - DNA, 15 bp, Homo sapiens
cagatggacgcaggc

SEQ ID NO: 6013286 - DNA, 19 bp, Homo sapiens
cagatggacgcaggccctg

SEQ ID NO: 6013287 - DNA, 14 bp, Homo sapiens
cagatggactggga

SEQ ID NO: 6013288 - DNA, 16 bp, Homo sapiens
cagatggactgggagg

SEQ ID NO: 6013289 - DNA, 17 bp, Homo sapiens
cagatggactgggagga

SEQ ID NO: 6013290 - DNA, 15 bp, Homo sapiens
cagatggacttgaaa

SEQ ID NO: 6013291 - DNA, 16 bp, Homo sapiens
cagatggaggtgccat

SEQ ID NO: 6013292 - DNA, 23 bp, Homo sapiens
cagatggaggttctcagagccaa

SEQ ID NO: 6013293 - DNA, 19 bp, Homo sapiens
cagatggatccacgtgctc

SEQ ID NO: 6013294 - DNA, 14 bp, Homo sapiens
cagatggcacctgt

SEQ ID NO: 6013295 - DNA, 15 bp, Homo sapiens
cagatggcacctgtg

SEQ ID NO: 6013296 - DNA, 17 bp, Homo sapiens
cagatggcacctgtggc

SEQ ID NO: 6013297 - DNA, 20 bp, Homo sapiens
cagatggcacctgtggccag

SEQ ID NO: 6013298 - DNA, 12 bp, Homo sapiens
cagatggcactt

SEQ ID NO: 6013299 - DNA, 13 bp, Homo sapiens
cagatggcagctt

SEQ ID NO: 6013300 - DNA, 15 bp, Homo sapiens
cagatggcagggctg

SEQ ID NO: 6013301 - DNA, 18 bp, Homo sapiens
cagatggccactgctctt

SEQ ID NO: 6013302 - DNA, 22 bp, Homo sapiens
cagatggccactgctcttgtga

SEQ ID NO: 6013303 - DNA, 20 bp, Homo sapiens
cagatggcccaagggatggc

SEQ ID NO: 6013304 - DNA, 21 bp, Homo sapiens
cagatggcccaagggatggca

SEQ ID NO: 6013305 - DNA, 18 bp, Homo sapiens
cagatggcccccagctgg

SEQ ID NO: 6013306 - DNA, 22 bp, Homo sapiens
cagatggcccctccactgggga

SEQ ID NO: 6013307 - DNA, 12 bp, Homo sapiens
cagatggctccc

SEQ ID NO: 6013308 - DNA, 21 bp, Homo sapiens
cagatggctccctgggctggc

SEQ ID NO: 6013309 - DNA, 13 bp, Homo sapiens
cagatggctcttt

SEQ ID NO: 6013310 - DNA, 13 bp, Homo sapiens
cagatggctgtga

SEQ ID NO: 6013311 - DNA, 18 bp, Homo sapiens
cagatggcttcggagggc

SEQ ID NO: 6013312 - DNA, 20 bp, Homo sapiens
cagatggcttcggagggccg

SEQ ID NO: 6013313 - DNA, 20 bp, Homo sapiens
cagatgggaacagtaaagaa

SEQ ID NO: 6013314 - DNA, 13 bp, Homo sapiens
cagatgggacaag

SEQ ID NO: 6013315 - DNA, 15 bp, Homo sapiens
cagatgggacttaac

SEQ ID NO: 6013316 - DNA, 20 bp, Homo sapiens
cagatgggcaaaccctggtg

SEQ ID NO: 6013317 - DNA, 23 bp, Homo sapiens
cagatgggcaaaccctggtgctt

SEQ ID NO: 6013318 - DNA, 23 bp, Homo sapiens
cagatgggcatatgtgtcagtgg

SEQ ID NO: 6013319 - DNA, 20 bp, Homo sapiens
cagatgggccacggctgagc

SEQ ID NO: 6013320 - DNA, 23 bp, Homo sapiens
cagatgggccacggctgagcctt

SEQ ID NO: 6013321 - DNA, 16 bp, Homo sapiens
cagatgggcctgtgtg

SEQ ID NO: 6013322 - DNA, 14 bp, Homo sapiens
cagatgggggaaag

SEQ ID NO: 6013323 - DNA, 15 bp, Homo sapiens
cagatgggggactga

SEQ ID NO: 6013324 - DNA, 20 bp, Homo sapiens
cagatggggtctgtgactgg

SEQ ID NO: 6013325 - DNA, 21 bp, Homo sapiens
cagatggggtctgtgactgga

SEQ ID NO: 6013326 - DNA, 20 bp, Homo sapiens
cagatggggtcttgctatgt

SEQ ID NO: 6013327 - DNA, 23 bp, Homo sapiens
cagatgggtgcttggaggaagga

SEQ ID NO: 6013328 - DNA, 14 bp, Homo sapiens
cagatggtagagag

SEQ ID NO: 6013329 - DNA, 15 bp, Homo sapiens
cagatggtcacacag

SEQ ID NO: 6013330 - DNA, 20 bp, Homo sapiens
cagatggtgtcctgcatgta

SEQ ID NO: 6013331 - DNA, 14 bp, Homo sapiens
cagatggttgtgta

SEQ ID NO: 6013332 - DNA, 14 bp, Homo sapiens
cagatggtttccta

SEQ ID NO: 6013333 - DNA, 12 bp, Homo sapiens
cagatgtaaatc

SEQ ID NO: 6013334 - DNA, 22 bp, Homo sapiens
cagatgtaaatcgggaaggatg

SEQ ID NO: 6013335 - DNA, 14 bp, Homo sapiens
cagatgtaatgttt

SEQ ID NO: 6013336 - DNA, 15 bp, Homo sapiens
cagatgtaatgtttt

SEQ ID NO: 6013337 - DNA, 16 bp, Homo sapiens
cagatgtaatgttttc

SEQ ID NO: 6013338 - DNA, 23 bp, Homo sapiens
cagatgtaatgttttctttgcaa

SEQ ID NO: 6013339 - DNA, 20 bp, Homo sapiens
cagatgtaattatgttttca

SEQ ID NO: 6013340 - DNA, 20 bp, Homo sapiens
cagatgtacacccacccaca

SEQ ID NO: 6013341 - DNA, 18 bp, Homo sapiens
cagatgtagatataaata

SEQ ID NO: 6013342 - DNA, 17 bp, Homo sapiens
cagatgtaggagggact

SEQ ID NO: 6013343 - DNA, 18 bp, Homo sapiens
cagatgtaggagggactg

SEQ ID NO: 6013344 - DNA, 13 bp, Homo sapiens
cagatgtatcatg

SEQ ID NO: 6013345 - DNA, 19 bp, Homo sapiens
cagatgtattgactgtacc

SEQ ID NO: 6013346 - DNA, 16 bp, Homo sapiens
cagatgtcagcttccc

SEQ ID NO: 6013347 - DNA, 18 bp, Homo sapiens
cagatgtcccccactgct

SEQ ID NO: 6013348 - DNA, 12 bp, Homo sapiens
cagatgtccctg

SEQ ID NO: 6013349 - DNA, 14 bp, Homo sapiens
cagatgtccctgaa

SEQ ID NO: 6013350 - DNA, 20 bp, Homo sapiens
cagatgtccctgaagtcttg

SEQ ID NO: 6013351 - DNA, 22 bp, Homo sapiens
cagatgtccctgaagtcttgca

SEQ ID NO: 6013352 - DNA, 22 bp, Homo sapiens
cagatgtcctaatggtgatgca

SEQ ID NO: 6013353 - DNA, 22 bp, Homo sapiens
cagatgtcgctgggtcctctgc

SEQ ID NO: 6013354 - DNA, 16 bp, Homo sapiens
cagatgtctaaaagat

SEQ ID NO: 6013355 - DNA, 22 bp, Homo sapiens
cagatgtctaaaagattcttta

SEQ ID NO: 6013356 - DNA, 14 bp, Homo sapiens
cagatgtctctggg

SEQ ID NO: 6013357 - DNA, 15 bp, Homo sapiens
cagatgtctctgggg

SEQ ID NO: 6013358 - DNA, 18 bp, Homo sapiens
cagatgtctgggaaagca

SEQ ID NO: 6013359 - DNA, 14 bp, Homo sapiens
cagatgtcttccct

SEQ ID NO: 6013360 - DNA, 12 bp, Homo sapiens
cagatgtcttct

SEQ ID NO: 6013361 - DNA, 15 bp, Homo sapiens
cagatgtgagccacc

SEQ ID NO: 6013362 - DNA, 16 bp, Homo sapiens
cagatgtgagccaccg

SEQ ID NO: 6013363 - DNA, 19 bp, Homo sapiens
cagatgtgcaataatttgt

SEQ ID NO: 6013364 - DNA, 20 bp, Homo sapiens
cagatgtgcaataatttgta

SEQ ID NO: 6013365 - DNA, 15 bp, Homo sapiens
cagatgtgcccagag

SEQ ID NO: 6013366 - DNA, 16 bp, Homo sapiens
cagatgtgcccagagt

SEQ ID NO: 6013367 - DNA, 20 bp, Homo sapiens
cagatgtgctataatctgtt

SEQ ID NO: 6013368 - DNA, 22 bp, Homo sapiens
cagatgtggacatgcacccgca

SEQ ID NO: 6013369 - DNA, 16 bp, Homo sapiens
cagatgtggagccagg

SEQ ID NO: 6013370 - DNA, 23 bp, Homo sapiens
cagatgtggctactgacatatct

SEQ ID NO: 6013371 - DNA, 22 bp, Homo sapiens
cagatgtgggccaccattgcaa

SEQ ID NO: 6013372 - DNA, 23 bp, Homo sapiens
cagatgtgggccaccattgcaac

SEQ ID NO: 6013373 - DNA, 15 bp, Homo sapiens
cagatgtgggctcag

SEQ ID NO: 6013374 - DNA, 15 bp, Homo sapiens
cagatgtggggctga

SEQ ID NO: 6013375 - DNA, 18 bp, Homo sapiens
cagatgtggggctgagct

SEQ ID NO: 6013376 - DNA, 19 bp, Homo sapiens
cagatgtggggctgagctg

SEQ ID NO: 6013377 - DNA, 18 bp, Homo sapiens
cagatgtgtcccccccag

SEQ ID NO: 6013378 - DNA, 20 bp, Homo sapiens
cagatgtgtcccccccaggc

SEQ ID NO: 6013379 - DNA, 16 bp, Homo sapiens
cagatgttaaaataaa

SEQ ID NO: 6013380 - DNA, 20 bp, Homo sapiens
cagatgttaaaataaatggt

SEQ ID NO: 6013381 - DNA, 21 bp, Homo sapiens
cagatgttaaaataaatggtt

SEQ ID NO: 6013382 - DNA, 15 bp, Homo sapiens
cagatgttatttttg

SEQ ID NO: 6013383 - DNA, 22 bp, Homo sapiens
cagatgttatttttgtattttt

SEQ ID NO: 6013384 - DNA, 17 bp, Homo sapiens
cagatgttcccccatct

SEQ ID NO: 6013385 - DNA, 23 bp, Homo sapiens
cagatgttgaatgcccacaggca

SEQ ID NO: 6013386 - DNA, 13 bp, Homo sapiens
cagatgttgcttt

SEQ ID NO: 6013387 - DNA, 15 bp, Homo sapiens
cagatgttgggagga

SEQ ID NO: 6013388 - DNA, 23 bp, Homo sapiens
cagatgttgggaggatacagagg

SEQ ID NO: 6013389 - DNA, 20 bp, Homo sapiens
cagatgttgttcctggctag

SEQ ID NO: 6013390 - DNA, 15 bp, Homo sapiens
cagatgtttaaaaca

SEQ ID NO: 6013391 - DNA, 17 bp, Homo sapiens
cagatgtttaaaacacc

SEQ ID NO: 6013392 - DNA, 21 bp, Homo sapiens
cagatgtttccaagatgtccc

SEQ ID NO: 6013393 - DNA, 14 bp, Homo sapiens
cagatgtttccaga

SEQ ID NO: 6013394 - DNA, 15 bp, Homo sapiens
cagatgtttccagac

SEQ ID NO: 6013395 - DNA, 19 bp, Homo sapiens
cagatgtttcttttgtatg

SEQ ID NO: 6013396 - DNA, 22 bp, Homo sapiens
cagatgttttacgtctgggaga

SEQ ID NO: 6013397 - DNA, 18 bp, Homo sapiens
cagatgttttatttatga

SEQ ID NO: 6013398 - DNA, 12 bp, Homo sapiens
cagattaaaaaa

SEQ ID NO: 6013399 - DNA, 13 bp, Homo sapiens
cagattaaaaaaa

SEQ ID NO: 6013400 - DNA, 13 bp, Homo sapiens
cagattaaaaaca

SEQ ID NO: 6013401 - DNA, 23 bp, Homo sapiens
cagattaaaagcacaagcgtgtt

SEQ ID NO: 6013402 - DNA, 22 bp, Homo sapiens
cagattaaattacagcttttat

SEQ ID NO: 6013403 - DNA, 13 bp, Homo sapiens
cagattacaataa

SEQ ID NO: 6013404 - DNA, 14 bp, Homo sapiens
cagattacaataaa

SEQ ID NO: 6013405 - DNA, 19 bp, Homo sapiens
cagattacaataaatcctt

SEQ ID NO: 6013406 - DNA, 16 bp, Homo sapiens
cagattaggcctggag

SEQ ID NO: 6013407 - DNA, 19 bp, Homo sapiens
cagattaggtttgtcccag

SEQ ID NO: 6013408 - DNA, 15 bp, Homo sapiens
cagattatcacatta

SEQ ID NO: 6013409 - DNA, 22 bp, Homo sapiens
cagattatctatttgtgtgtgt

SEQ ID NO: 6013410 - DNA, 18 bp, Homo sapiens
cagattatggaagttttc

SEQ ID NO: 6013411 - DNA, 14 bp, Homo sapiens
cagattatgttcct

SEQ ID NO: 6013412 - DNA, 17 bp, Homo sapiens
cagattatgttcctgct

SEQ ID NO: 6013413 - DNA, 18 bp, Homo sapiens
cagattatgttcctgctg

SEQ ID NO: 6013414 - DNA, 19 bp, Homo sapiens
cagattatgttcctgctgt

SEQ ID NO: 6013415 - DNA, 14 bp, Homo sapiens
cagattattttcta

SEQ ID NO: 6013416 - DNA, 23 bp, Homo sapiens
cagattattttctatatttggat

SEQ ID NO: 6013417 - DNA, 11 bp, Homo sapiens
cagattcaaag

SEQ ID NO: 6013418 - DNA, 23 bp, Homo sapiens
cagattcaataatgagagctcag

SEQ ID NO: 6013419 - DNA, 13 bp, Homo sapiens
cagattcaatttt

SEQ ID NO: 6013420 - DNA, 22 bp, Homo sapiens
cagattcacctccattaaccaa

SEQ ID NO: 6013421 - DNA, 12 bp, Homo sapiens
cagattcacctt

SEQ ID NO: 6013422 - DNA, 14 bp, Homo sapiens
cagattcacttctg

SEQ ID NO: 6013423 - DNA, 23 bp, Homo sapiens
cagattcactttgtttatgcata

SEQ ID NO: 6013424 - DNA, 17 bp, Homo sapiens
cagattcagaaatgagg

SEQ ID NO: 6013425 - DNA, 21 bp, Homo sapiens
cagattcagaaatgaggccat

SEQ ID NO: 6013426 - DNA, 15 bp, Homo sapiens
cagattcagtcttgc

SEQ ID NO: 6013427 - DNA, 15 bp, Homo sapiens
cagattcataaagta

SEQ ID NO: 6013428 - DNA, 18 bp, Homo sapiens
cagattccacacaaaatg

SEQ ID NO: 6013429 - DNA, 20 bp, Homo sapiens
cagattcccagaccttaaga

SEQ ID NO: 6013430 - DNA, 20 bp, Homo sapiens
cagtgcctgggaatgtatta

SEQ ID NO: 6013431 - DNA, 19 bp, Homo sapiens
cagtgcctggtgttctgaa

SEQ ID NO: 6013432 - DNA, 20 bp, Homo sapiens
cagtgcctggtgttctgaag

SEQ ID NO: 6013433 - DNA, 20 bp, Homo sapiens
cagtgccttacctcctgccc

SEQ ID NO: 6013434 - DNA, 21 bp, Homo sapiens
cagtgccttacctcctgccca

SEQ ID NO: 6013435 - DNA, 11 bp, Homo sapiens
cagtgccttat

SEQ ID NO: 6013436 - DNA, 21 bp, Homo sapiens
cagtgccttatggaacactct

SEQ ID NO: 6013437 - DNA, 23 bp, Homo sapiens
cagtgccttatggaacactctga

SEQ ID NO: 6013438 - DNA, 18 bp, Homo sapiens
cagtgccttcaataaatg

SEQ ID NO: 6013439 - DNA, 14 bp, Homo sapiens
cagtgccttccata

SEQ ID NO: 6013440 - DNA, 17 bp, Homo sapiens
cagtgccttccataatt

SEQ ID NO: 6013441 - DNA, 13 bp, Homo sapiens
cagtgccttcctc

SEQ ID NO: 6013442 - DNA, 13 bp, Homo sapiens
cagtgccttctct

SEQ ID NO: 6013443 - DNA, 21 bp, Homo sapiens
cagtgccttctctcagctccc

SEQ ID NO: 6013444 - DNA, 24 bp, Homo sapiens
cagtgccttctctcagctcccagg

SEQ ID NO: 6013445 - DNA, 16 bp, Homo sapiens
cagtgccttggagcag

SEQ ID NO: 6013446 - DNA, 14 bp, Homo sapiens
cagtgccttgggga

SEQ ID NO: 6013447 - DNA, 17 bp, Homo sapiens
cagtgcctttccccatt

SEQ ID NO: 6013448 - DNA, 15 bp, Homo sapiens
cagtgcggctgccag

SEQ ID NO: 6013449 - DNA, 17 bp, Homo sapiens
cagtgcggttcctcatc

SEQ ID NO: 6013450 - DNA, 12 bp, Homo sapiens
cagtgcgttgca

SEQ ID NO: 6013451 - DNA, 14 bp, Homo sapiens
cagtgctaaaaatg

SEQ ID NO: 6013452 - DNA, 20 bp, Homo sapiens
cagtgctaaaaatgggactt

SEQ ID NO: 6013453 - DNA, 17 bp, Homo sapiens
cagtgctaagctgccct

SEQ ID NO: 6013454 - DNA, 17 bp, Homo sapiens
cagtgctacattttgtg

SEQ ID NO: 6013455 - DNA, 15 bp, Homo sapiens
cagtgctactgaaag

SEQ ID NO: 6013456 - DNA, 14 bp, Homo sapiens
cagtgctagaaaat

SEQ ID NO: 6013457 - DNA, 21 bp, Homo sapiens
cagtgctaggataaaccaatc

SEQ ID NO: 6013458 - DNA, 19 bp, Homo sapiens
cagtgctagtgagctgggc

SEQ ID NO: 6013459 - DNA, 23 bp, Homo sapiens
cagtgctattttgtgcccactgt

SEQ ID NO: 6013460 - DNA, 14 bp, Homo sapiens
cagtgctcacacaa

SEQ ID NO: 6013461 - DNA, 16 bp, Homo sapiens
cagtgctcaccagccc

SEQ ID NO: 6013462 - DNA, 17 bp, Homo sapiens
cagtgctcaccagccct

SEQ ID NO: 6013463 - DNA, 22 bp, Homo sapiens
cagtgctcaccagccctgcagc

SEQ ID NO: 6013464 - DNA, 17 bp, Homo sapiens
cagtgctcacccacacc

SEQ ID NO: 6013465 - DNA, 14 bp, Homo sapiens
cagtgctcagctgt

SEQ ID NO: 6013466 - DNA, 16 bp, Homo sapiens
cagtgctcagctgtgg

SEQ ID NO: 6013467 - DNA, 20 bp, Homo sapiens
cagtgctcagctgtggctgg

SEQ ID NO: 6013468 - DNA, 17 bp, Homo sapiens
cagtgctcagttgtact

SEQ ID NO: 6013469 - DNA, 14 bp, Homo sapiens
cagtgctccctcac

SEQ ID NO: 6013470 - DNA, 12 bp, Homo sapiens
cagtgctcctgg

SEQ ID NO: 6013471 - DNA, 16 bp, Homo sapiens
cagtgctcctggaaac

SEQ ID NO: 6013472 - DNA, 16 bp, Homo sapiens
cagtgctcctggccct

SEQ ID NO: 6013473 - DNA, 19 bp, Homo sapiens
cagtgctcgctgttgctga

SEQ ID NO: 6013474 - DNA, 12 bp, Homo sapiens
cagtgctcggca

SEQ ID NO: 6013475 - DNA, 15 bp, Homo sapiens
cagtgctctctccac

SEQ ID NO: 6013476 - DNA, 12 bp, Homo sapiens
cagtgctctgcc

SEQ ID NO: 6013477 - DNA, 16 bp, Homo sapiens
cagtgctctgcctcag

SEQ ID NO: 6013478 - DNA, 18 bp, Homo sapiens
cagtgctctgcctcagac

SEQ ID NO: 6013479 - DNA, 23 bp, Homo sapiens
cagtgctctgcctctaactccct

SEQ ID NO: 6013480 - DNA, 13 bp, Homo sapiens
cagtgctgaaggg

SEQ ID NO: 6013481 - DNA, 19 bp, Homo sapiens
cagtgctgaccccaggaag

SEQ ID NO: 6013482 - DNA, 19 bp, Homo sapiens
cagtgctgatgtagcatgc

SEQ ID NO: 6013483 - DNA, 18 bp, Homo sapiens
cagtgctgattcagcctg

SEQ ID NO: 6013484 - DNA, 19 bp, Homo sapiens
cagtgctgcagctccctgg

SEQ ID NO: 6013485 - DNA, 13 bp, Homo sapiens
cagtgctgcatgc

SEQ ID NO: 6013486 - DNA, 18 bp, Homo sapiens
cagtgctgcccatgagca

SEQ ID NO: 6013487 - DNA, 20 bp, Homo sapiens
cagtgctgcccatgagcaag

SEQ ID NO: 6013488 - DNA, 19 bp, Homo sapiens
cagtgctgccccttgcaag

SEQ ID NO: 6013489 - DNA, 23 bp, Homo sapiens
cagtgctgccccttgcaagccat

SEQ ID NO: 6013490 - DNA, 14 bp, Homo sapiens
cagtgctgccctgc

SEQ ID NO: 6013491 - DNA, 15 bp, Homo sapiens
cagtgctgcctgtcc

SEQ ID NO: 6013492 - DNA, 22 bp, Homo sapiens
cagtgctgcgagatcgctggca

SEQ ID NO: 6013493 - DNA, 22 bp, Homo sapiens
cagtgctgctgaactaatttct

SEQ ID NO: 6013494 - DNA, 14 bp, Homo sapiens
cagtgctgcttctc

SEQ ID NO: 6013495 - DNA, 18 bp, Homo sapiens
cagtgctgcttctcttgg

SEQ ID NO: 6013496 - DNA, 19 bp, Homo sapiens
cagtgctgcttctcttggg

SEQ ID NO: 6013497 - DNA, 16 bp, Homo sapiens
cagtgctgcttcttgc

SEQ ID NO: 6013498 - DNA, 12 bp, Homo sapiens
cagtgctggaag

SEQ ID NO: 6013499 - DNA, 17 bp, Homo sapiens
cagtgctggagaaatct

SEQ ID NO: 6013500 - DNA, 15 bp, Homo sapiens
cagtgctggctgctg

SEQ ID NO: 6013501 - DNA, 18 bp, Homo sapiens
cagtgctggctgctggcc

SEQ ID NO: 6013502 - DNA, 23 bp, Homo sapiens
cagtgctggctgctggcccacag

SEQ ID NO: 6013503 - DNA, 13 bp, Homo sapiens
cagtgctgggccc

SEQ ID NO: 6013504 - DNA, 14 bp, Homo sapiens
cagtgctgggccca

SEQ ID NO: 6013505 - DNA, 17 bp, Homo sapiens
cagtgctgggcccagcc

SEQ ID NO: 6013506 - DNA, 22 bp, Homo sapiens
cagtgctggtggccctcaggcc

SEQ ID NO: 6013507 - DNA, 20 bp, Homo sapiens
cagtgctgtaatcggctccc

SEQ ID NO: 6013508 - DNA, 19 bp, Homo sapiens
cagtgctgtccatgcttct

SEQ ID NO: 6013509 - DNA, 22 bp, Homo sapiens
cagtgctgtctgatctgtgctt

SEQ ID NO: 6013510 - DNA, 13 bp, Homo sapiens
cagtgctgtctgg

SEQ ID NO: 6013511 - DNA, 12 bp, Homo sapiens
cagtgctgtgct

SEQ ID NO: 6013512 - DNA, 16 bp, Homo sapiens
cagtgctgtgctgtgc

SEQ ID NO: 6013513 - DNA, 15 bp, Homo sapiens
cagtgctgtggcctg

SEQ ID NO: 6013514 - DNA, 18 bp, Homo sapiens
cagtgctgtggcctgggc

SEQ ID NO: 6013515 - DNA, 16 bp, Homo sapiens
cagtgctgttgaagat

SEQ ID NO: 6013516 - DNA, 16 bp, Homo sapiens
cagtgcttagcaaaaa

SEQ ID NO: 6013517 - DNA, 16 bp, Homo sapiens
cagtgcttcagcctga

SEQ ID NO: 6013518 - DNA, 17 bp, Homo sapiens
cagtgcttcagcctgag

SEQ ID NO: 6013519 - DNA, 14 bp, Homo sapiens
cagtgcttccacag

SEQ ID NO: 6013520 - DNA, 17 bp, Homo sapiens
cagtgcttgcatcctat

SEQ ID NO: 6013521 - DNA, 12 bp, Homo sapiens
cagtgcttggcc

SEQ ID NO: 6013522 - DNA, 23 bp, Homo sapiens
cagtgcttggctgccccacaggc

SEQ ID NO: 6013523 - DNA, 17 bp, Homo sapiens
cagtgctttatccacat

SEQ ID NO: 6013524 - DNA, 17 bp, Homo sapiens
cagtgctttgcccttga

SEQ ID NO: 6013525 - DNA, 15 bp, Homo sapiens
cagtgctttgttgat

SEQ ID NO: 6013526 - DNA, 19 bp, Homo sapiens
cagtgcttttcactacttt

SEQ ID NO: 6013527 - DNA, 12 bp, Homo sapiens
cagtgctttttc

SEQ ID NO: 6013528 - DNA, 13 bp, Homo sapiens
cagtggaagaaac

SEQ ID NO: 6013529 - DNA, 18 bp, Homo sapiens
cagtggaagagctgctgt

SEQ ID NO: 6013530 - DNA, 22 bp, Homo sapiens
cagtggaagagctgctgtattt

SEQ ID NO: 6013531 - DNA, 21 bp, Homo sapiens
cagtggaattccaacttgaag

SEQ ID NO: 6013532 - DNA, 23 bp, Homo sapiens
cagtggaattccaacttgaagga

SEQ ID NO: 6013533 - DNA, 13 bp, Homo sapiens
cagtggacaccag

SEQ ID NO: 6013534 - DNA, 18 bp, Homo sapiens
cagtggacactcagacca

SEQ ID NO: 6013535 - DNA, 18 bp, Homo sapiens
cagtggacagagggagaa

SEQ ID NO: 6013536 - DNA, 21 bp, Homo sapiens
cagtggacagtgctgttgaag

SEQ ID NO: 6013537 - DNA, 22 bp, Homo sapiens
cagtggacatcgtaggcagcca

SEQ ID NO: 6013538 - DNA, 15 bp, Homo sapiens
cagtggaccctgtgg

SEQ ID NO: 6013539 - DNA, 21 bp, Homo sapiens
cagtggaccgaaatctgtatt

SEQ ID NO: 6013540 - DNA, 20 bp, Homo sapiens
cagtggacctagcctggatg

SEQ ID NO: 6013541 - DNA, 12 bp, Homo sapiens
cagtggacggag

SEQ ID NO: 6013542 - DNA, 17 bp, Homo sapiens
cagtggacggagagcct

SEQ ID NO: 6013543 - DNA, 20 bp, Homo sapiens
cagtggactcagaaagccaa

SEQ ID NO: 6013544 - DNA, 20 bp, Homo sapiens
cagtggactcagcagtgacc

SEQ ID NO: 6013545 - DNA, 17 bp, Homo sapiens
cagtggactttccaccc

SEQ ID NO: 6013546 - DNA, 20 bp, Homo sapiens
cagtggactttccaccccct

SEQ ID NO: 6013547 - DNA, 22 bp, Homo sapiens
cagtggactttccaccccctcc

SEQ ID NO: 6013548 - DNA, 15 bp, Homo sapiens
cagtggagaaatatt

SEQ ID NO: 6013549 - DNA, 13 bp, Homo sapiens
cagtggagaatta

SEQ ID NO: 6013550 - DNA, 11 bp, Homo sapiens
cagtggagagg

SEQ ID NO: 6013551 - DNA, 13 bp, Homo sapiens
cagtggagagggc

SEQ ID NO: 6013552 - DNA, 21 bp, Homo sapiens
cagtggagatcaggagtgaca

SEQ ID NO: 6013553 - DNA, 17 bp, Homo sapiens
cagtggagcagaaggca

SEQ ID NO: 6013554 - DNA, 13 bp, Homo sapiens
cagtggagcccag

SEQ ID NO: 6013555 - DNA, 17 bp, Homo sapiens
cagtggagcctgccgcc

SEQ ID NO: 6013556 - DNA, 20 bp, Homo sapiens
cagtggagcctgccgccccc

SEQ ID NO: 6013557 - DNA, 23 bp, Homo sapiens
cagtggagcctgccgcccccgcc

SEQ ID NO: 6013558 - DNA, 16 bp, Homo sapiens
cagtggagctgaattt

SEQ ID NO: 6013559 - DNA, 22 bp, Homo sapiens
cagtggagctgaattttctgga

SEQ ID NO: 6013560 - DNA, 19 bp, Homo sapiens
cagtggagctggtctgcca

SEQ ID NO: 6013561 - DNA, 15 bp, Homo sapiens
cagtggaggaagagg

SEQ ID NO: 6013562 - DNA, 15 bp, Homo sapiens
cagtggaggctgctg

SEQ ID NO: 6013563 - DNA, 15 bp, Homo sapiens
cagtggaggctggca

SEQ ID NO: 6013564 - DNA, 16 bp, Homo sapiens
cagtggagggagactg

SEQ ID NO: 6013565 - DNA, 18 bp, Homo sapiens
cagtggagggagactgac

SEQ ID NO: 6013566 - DNA, 19 bp, Homo sapiens
cagtggagggagactgacc

SEQ ID NO: 6013567 - DNA, 20 bp, Homo sapiens
cagtggagggagactgaccc

SEQ ID NO: 6013568 - DNA, 21 bp, Homo sapiens
cagtggagggagactgaccca

SEQ ID NO: 6013569 - DNA, 14 bp, Homo sapiens
cagtggagggggca

SEQ ID NO: 6013570 - DNA, 21 bp, Homo sapiens
cagtggatatgacccacactg

SEQ ID NO: 6013571 - DNA, 17 bp, Homo sapiens
cagtggatcacaaagtg

SEQ ID NO: 6013572 - DNA, 21 bp, Homo sapiens
cagtggatcacacacatggaa

SEQ ID NO: 6013573 - DNA, 18 bp, Homo sapiens
cagtggatcatgaaaagt

SEQ ID NO: 6013574 - DNA, 15 bp, Homo sapiens
cagtggatcttcaga

SEQ ID NO: 6013575 - DNA, 18 bp, Homo sapiens
cagtggatcttcagaact

SEQ ID NO: 6013576 - DNA, 14 bp, Homo sapiens
cagtggattaatta

SEQ ID NO: 6013577 - DNA, 17 bp, Homo sapiens
cagtggattgtttatac

SEQ ID NO: 6013578 - DNA, 17 bp, Homo sapiens
cagtggcaaaatattat

SEQ ID NO: 6013579 - DNA, 21 bp, Homo sapiens
cagtggcaaaatattatgtta

SEQ ID NO: 6013580 - DNA, 15 bp, Homo sapiens
cagtggcactaaaat

SEQ ID NO: 6013581 - DNA, 19 bp, Homo sapiens
cagtggcactcaacatgag

SEQ ID NO: 6013582 - DNA, 16 bp, Homo sapiens
cagtggcactgaagtg

SEQ ID NO: 6013583 - DNA, 13 bp, Homo sapiens
cagtggcagagaa

SEQ ID NO: 6013584 - DNA, 14 bp, Homo sapiens
cagtggcagagaat

SEQ ID NO: 6013585 - DNA, 12 bp, Homo sapiens
cagtggcagcaa

SEQ ID NO: 6013586 - DNA, 19 bp, Homo sapiens
cagtggcagcaaaggaaga

SEQ ID NO: 6013587 - DNA, 14 bp, Homo sapiens
cagtggcaggcaga

SEQ ID NO: 6013588 - DNA, 13 bp, Homo sapiens
cagtggcagggca

SEQ ID NO: 6013589 - DNA, 14 bp, Homo sapiens
cagtggcagggcac

SEQ ID NO: 6013590 - DNA, 14 bp, Homo sapiens
cagtggcagggctc

SEQ ID NO: 6013591 - DNA, 15 bp, Homo sapiens
cagtggcagggctca

SEQ ID NO: 6013592 - DNA, 15 bp, Homo sapiens
cagtggcaggggagc

SEQ ID NO: 6013593 - DNA, 21 bp, Homo sapiens
cagtggcatcatctcagctca

SEQ ID NO: 6013594 - DNA, 15 bp, Homo sapiens
cagtggcatggctcc

SEQ ID NO: 6013595 - DNA, 17 bp, Homo sapiens
cagtggcatggctccag

SEQ ID NO: 6013596 - DNA, 22 bp, Homo sapiens
cagtggccaagatcacagtggc

SEQ ID NO: 6013597 - DNA, 22 bp, Homo sapiens
cagtggccacgttcagggaggg

SEQ ID NO: 6013598 - DNA, 23 bp, Homo sapiens
cagtggccacgttcagggagggg

SEQ ID NO: 6013599 - DNA, 17 bp, Homo sapiens
cagtggccatcatcctc

SEQ ID NO: 6013600 - DNA, 20 bp, Homo sapiens
cagtggccccatccagcatg

SEQ ID NO: 6013601 - DNA, 22 bp, Homo sapiens
cagtggccccatccagcatgtg

SEQ ID NO: 6013602 - DNA, 20 bp, Homo sapiens
cagtggcccccactcacagg

SEQ ID NO: 6013603 - DNA, 20 bp, Homo sapiens
cagtggcccccgggcctgca

SEQ ID NO: 6013604 - DNA, 23 bp, Homo sapiens
cagtggccgaaccccccactccc

SEQ ID NO: 6013605 - DNA, 19 bp, Homo sapiens
cagtggccgcaagcgcagg

SEQ ID NO: 6013606 - DNA, 18 bp, Homo sapiens
cagtggccgggctgggga

SEQ ID NO: 6013607 - DNA, 22 bp, Homo sapiens
cagtggccggttgccactctcc

SEQ ID NO: 6013608 - DNA, 22 bp, Homo sapiens
cagtggcctacaaatcagtaat

SEQ ID NO: 6013609 - DNA, 18 bp, Homo sapiens
cagattcccaggccaggg

SEQ ID NO: 6013610 - DNA, 19 bp, Homo sapiens
cagattcccaggccagggc

SEQ ID NO: 6013611 - DNA, 20 bp, Homo sapiens
cagattcccaggccagggct

SEQ ID NO: 6013612 - DNA, 21 bp, Homo sapiens
cagattcccaggccagggctg

SEQ ID NO: 6013613 - DNA, 22 bp, Homo sapiens
cagattcccaggccagggctgg

SEQ ID NO: 6013614 - DNA, 18 bp, Homo sapiens
cagattcctatgatggat

SEQ ID NO: 6013615 - DNA, 16 bp, Homo sapiens
cagattcctgggcctg

SEQ ID NO: 6013616 - DNA, 21 bp, Homo sapiens
cagattcctgggcctgtcccc

SEQ ID NO: 6013617 - DNA, 14 bp, Homo sapiens
cagattcctttccc

SEQ ID NO: 6013618 - DNA, 20 bp, Homo sapiens
cagattcctttggccactgt

SEQ ID NO: 6013619 - DNA, 19 bp, Homo sapiens
cagattctagcacatcatg

SEQ ID NO: 6013620 - DNA, 15 bp, Homo sapiens
cagattctatattat

SEQ ID NO: 6013621 - DNA, 22 bp, Homo sapiens
cagattctatattattatatat

SEQ ID NO: 6013622 - DNA, 18 bp, Homo sapiens
cagattctatcctcatct

SEQ ID NO: 6013623 - DNA, 14 bp, Homo sapiens
cagattctcttgaa

SEQ ID NO: 6013624 - DNA, 15 bp, Homo sapiens
cagattctgatgcat

SEQ ID NO: 6013625 - DNA, 23 bp, Homo sapiens
cagattctgatttttttgttgtt

SEQ ID NO: 6013626 - DNA, 13 bp, Homo sapiens
cagattctgtgag

SEQ ID NO: 6013627 - DNA, 11 bp, Homo sapiens
cagattcttcc

SEQ ID NO: 6013628 - DNA, 19 bp, Homo sapiens
cagattcttgctgtgaccc

SEQ ID NO: 6013629 - DNA, 15 bp, Homo sapiens
cagattctttcctga

SEQ ID NO: 6013630 - DNA, 17 bp, Homo sapiens
cagattctttcctgagg

SEQ ID NO: 6013631 - DNA, 12 bp, Homo sapiens
cagattctttta

SEQ ID NO: 6013632 - DNA, 18 bp, Homo sapiens
cagattcttttatgtgat

SEQ ID NO: 6013633 - DNA, 15 bp, Homo sapiens
cagattgaaaagtgt

SEQ ID NO: 6013634 - DNA, 13 bp, Homo sapiens
cagattgaactta

SEQ ID NO: 6013635 - DNA, 18 bp, Homo sapiens
cagattgacagcatatag

SEQ ID NO: 6013636 - DNA, 21 bp, Homo sapiens
cagattgaggtaataatgaca

SEQ ID NO: 6013637 - DNA, 20 bp, Homo sapiens
cagattgataagtaatgaaa

SEQ ID NO: 6013638 - DNA, 17 bp, Homo sapiens
cagattgcaacaggctg

SEQ ID NO: 6013639 - DNA, 19 bp, Homo sapiens
cagattgcaacaggctggg

SEQ ID NO: 6013640 - DNA, 20 bp, Homo sapiens
cagattgcaacaggctgggc

SEQ ID NO: 6013641 - DNA, 20 bp, Homo sapiens
cagattgcatgtgactctga

SEQ ID NO: 6013642 - DNA, 21 bp, Homo sapiens
cagattgcatgtgactctgaa

SEQ ID NO: 6013643 - DNA, 12 bp, Homo sapiens
cagattgcccca

SEQ ID NO: 6013644 - DNA, 13 bp, Homo sapiens
cagattgcctcct

SEQ ID NO: 6013645 - DNA, 14 bp, Homo sapiens
cagattgcctcctt

SEQ ID NO: 6013646 - DNA, 16 bp, Homo sapiens
cagattgcctgtttct

SEQ ID NO: 6013647 - DNA, 14 bp, Homo sapiens
cagattgctctgcc

SEQ ID NO: 6013648 - DNA, 15 bp, Homo sapiens
cagattgctctgccc

SEQ ID NO: 6013649 - DNA, 23 bp, Homo sapiens
cagattgctgaatcccatcaggc

SEQ ID NO: 6013650 - DNA, 22 bp, Homo sapiens
cagattggaaggagacacagat

SEQ ID NO: 6013651 - DNA, 12 bp, Homo sapiens
cagattggattt

SEQ ID NO: 6013652 - DNA, 21 bp, Homo sapiens
cagattggattttatgttgac

SEQ ID NO: 6013653 - DNA, 22 bp, Homo sapiens
cagattgggcggggcttctctt

SEQ ID NO: 6013654 - DNA, 21 bp, Homo sapiens
cagattggggctagtttaaga

SEQ ID NO: 6013655 - DNA, 20 bp, Homo sapiens
cagattggttcatgcctggg

SEQ ID NO: 6013656 - DNA, 13 bp, Homo sapiens
cagattgtatctg

SEQ ID NO: 6013657 - DNA, 15 bp, Homo sapiens
cagattgtcttaatt

SEQ ID NO: 6013658 - DNA, 16 bp, Homo sapiens
cagattgtgccactgc

SEQ ID NO: 6013659 - DNA, 13 bp, Homo sapiens
cagattgtggggt

SEQ ID NO: 6013660 - DNA, 23 bp, Homo sapiens
cagattgttaggagtggttctca

SEQ ID NO: 6013661 - DNA, 13 bp, Homo sapiens
cagattgtttcct

SEQ ID NO: 6013662 - DNA, 23 bp, Homo sapiens
cagattgttttttcctaaggaaa

SEQ ID NO: 6013663 - DNA, 21 bp, Homo sapiens
cagatttaacctgttatttct

SEQ ID NO: 6013664 - DNA, 20 bp, Homo sapiens
cagatttaagatatgtaaca

SEQ ID NO: 6013665 - DNA, 20 bp, Homo sapiens
cagatttaagccttgacaca

SEQ ID NO: 6013666 - DNA, 23 bp, Homo sapiens
cagatttaagccttgacacactg

SEQ ID NO: 6013667 - DNA, 13 bp, Homo sapiens
cagatttacactg

SEQ ID NO: 6013668 - DNA, 17 bp, Homo sapiens
cagatttacactgggag

SEQ ID NO: 6013669 - DNA, 21 bp, Homo sapiens
cagatttactccactatggaa

SEQ ID NO: 6013670 - DNA, 16 bp, Homo sapiens
cagatttactgtccca

SEQ ID NO: 6013671 - DNA, 21 bp, Homo sapiens
cagatttactgtcccaggagc

SEQ ID NO: 6013672 - DNA, 22 bp, Homo sapiens
cagatttactgtcccaggagca

SEQ ID NO: 6013673 - DNA, 17 bp, Homo sapiens
cagatttagtgaaagct

SEQ ID NO: 6013674 - DNA, 12 bp, Homo sapiens
cagatttattta

SEQ ID NO: 6013675 - DNA, 23 bp, Homo sapiens
cagatttatttactcttgctgga

SEQ ID NO: 6013676 - DNA, 13 bp, Homo sapiens
cagatttatttgt

SEQ ID NO: 6013677 - DNA, 16 bp, Homo sapiens
cagatttccaaaagta

SEQ ID NO: 6013678 - DNA, 19 bp, Homo sapiens
cagatttccaaaagtacta

SEQ ID NO: 6013679 - DNA, 16 bp, Homo sapiens
cagatttccagtctcc

SEQ ID NO: 6013680 - DNA, 24 bp, Homo sapiens
cagatttccagtctccaccaggaa

SEQ ID NO: 6013681 - DNA, 17 bp, Homo sapiens
cagatttcctgtgtggg

SEQ ID NO: 6013682 - DNA, 17 bp, Homo sapiens
cagatttctaagttaaa

SEQ ID NO: 6013683 - DNA, 14 bp, Homo sapiens
cagatttctggttg

SEQ ID NO: 6013684 - DNA, 19 bp, Homo sapiens
cagatttgaactcttcaat

SEQ ID NO: 6013685 - DNA, 15 bp, Homo sapiens
cagatttgaggctgg

SEQ ID NO: 6013686 - DNA, 21 bp, Homo sapiens
cagatttgatatttgcattga

SEQ ID NO: 6013687 - DNA, 12 bp, Homo sapiens
cagatttgcaac

SEQ ID NO: 6013688 - DNA, 20 bp, Homo sapiens
cagatttgcacaaaaagata

SEQ ID NO: 6013689 - DNA, 18 bp, Homo sapiens
cagatttgggctggaaca

SEQ ID NO: 6013690 - DNA, 19 bp, Homo sapiens
cagatttggtgatggaaaa

SEQ ID NO: 6013691 - DNA, 20 bp, Homo sapiens
cagatttggtgatggaaaaa

SEQ ID NO: 6013692 - DNA, 15 bp, Homo sapiens
cagatttgtgaactc

SEQ ID NO: 6013693 - DNA, 23 bp, Homo sapiens
cagatttgtggggacctcagcct

SEQ ID NO: 6013694 - DNA, 13 bp, Homo sapiens
cagattttaaaaa

SEQ ID NO: 6013695 - DNA, 15 bp, Homo sapiens
cagattttaaaaagg

SEQ ID NO: 6013696 - DNA, 22 bp, Homo sapiens
cagattttaagggggaaaactg

SEQ ID NO: 6013697 - DNA, 16 bp, Homo sapiens
cagattttaattgtca

SEQ ID NO: 6013698 - DNA, 23 bp, Homo sapiens
cagattttaattttgaataaata

SEQ ID NO: 6013699 - DNA, 14 bp, Homo sapiens
cagattttacaaaa

SEQ ID NO: 6013700 - DNA, 15 bp, Homo sapiens
cagattttacagagc

SEQ ID NO: 6013701 - DNA, 23 bp, Homo sapiens
cagattttactgtctatggattt

SEQ ID NO: 6013702 - DNA, 12 bp, Homo sapiens
cagattttagtt

SEQ ID NO: 6013703 - DNA, 13 bp, Homo sapiens
cagattttagttt

SEQ ID NO: 6013704 - DNA, 15 bp, Homo sapiens
cagattttagtttta

SEQ ID NO: 6013705 - DNA, 22 bp, Homo sapiens
cagattttagttttattttcta

SEQ ID NO: 6013706 - DNA, 21 bp, Homo sapiens
cagattttatattttctattt

SEQ ID NO: 6013707 - DNA, 13 bp, Homo sapiens
cagattttattat

SEQ ID NO: 6013708 - DNA, 21 bp, Homo sapiens
cagattttattatgtaaatcc

SEQ ID NO: 6013709 - DNA, 22 bp, Homo sapiens
cagattttattatgtaaatccc

SEQ ID NO: 6013710 - DNA, 21 bp, Homo sapiens
cagattttatttatatcttta

SEQ ID NO: 6013711 - DNA, 15 bp, Homo sapiens
cagattttatttgta

SEQ ID NO: 6013712 - DNA, 17 bp, Homo sapiens
cagattttcctaaggcc

SEQ ID NO: 6013713 - DNA, 14 bp, Homo sapiens
cagattttcctgaa

SEQ ID NO: 6013714 - DNA, 14 bp, Homo sapiens
cagattttctcctg

SEQ ID NO: 6013715 - DNA, 13 bp, Homo sapiens
cagattttgataa

SEQ ID NO: 6013716 - DNA, 15 bp, Homo sapiens
cagattttgataact

SEQ ID NO: 6013717 - DNA, 16 bp, Homo sapiens
cagattttgatagcaa

SEQ ID NO: 6013718 - DNA, 19 bp, Homo sapiens
cagattttgatagcaaagc

SEQ ID NO: 6013719 - DNA, 20 bp, Homo sapiens
cagattttgatagcaaagcg

SEQ ID NO: 6013720 - DNA, 23 bp, Homo sapiens
cagattttgctgtatatttgtga

SEQ ID NO: 6013721 - DNA, 17 bp, Homo sapiens
cagattttggccatgaa

SEQ ID NO: 6013722 - DNA, 20 bp, Homo sapiens
cagattttggggttgtgttg

SEQ ID NO: 6013723 - DNA, 17 bp, Homo sapiens
cagatttttaaagtttt

SEQ ID NO: 6013724 - DNA, 16 bp, Homo sapiens
cagatttttacacatg

SEQ ID NO: 6013725 - DNA, 23 bp, Homo sapiens
cagatttttatattagttgcttt

SEQ ID NO: 6013726 - DNA, 22 bp, Homo sapiens
cagatttttatcttaattgcaa

SEQ ID NO: 6013727 - DNA, 17 bp, Homo sapiens
cagatttttatttatga

SEQ ID NO: 6013728 - DNA, 19 bp, Homo sapiens
cagatttttgggctccact

SEQ ID NO: 6013729 - DNA, 16 bp, Homo sapiens
cagattttttaaaatt

SEQ ID NO: 6013730 - DNA, 19 bp, Homo sapiens
cagatttttttgtaagggg

SEQ ID NO: 6013731 - DNA, 16 bp, Homo sapiens
cagcaaaaactgtggg

SEQ ID NO: 6013732 - DNA, 13 bp, Homo sapiens
cagcaaaaagcaa

SEQ ID NO: 6013733 - DNA, 14 bp, Homo sapiens
cagcaaaaatataa

SEQ ID NO: 6013734 - DNA, 18 bp, Homo sapiens
cagcaaaaatataaaata

SEQ ID NO: 6013735 - DNA, 12 bp, Homo sapiens
cagcaaaaccat

SEQ ID NO: 6013736 - DNA, 15 bp, Homo sapiens
cagcaaaactccatc

SEQ ID NO: 6013737 - DNA, 13 bp, Homo sapiens
cagcaaaagacca

SEQ ID NO: 6013738 - DNA, 10 bp, Homo sapiens
cagcaaaagt

SEQ ID NO: 6013739 - DNA, 18 bp, Homo sapiens
cagcaaaataataaaata

SEQ ID NO: 6013740 - DNA, 18 bp, Homo sapiens
cagcaaaatatatgtttg

SEQ ID NO: 6013741 - DNA, 19 bp, Homo sapiens
cagcaaaatccttacttcc

SEQ ID NO: 6013742 - DNA, 14 bp, Homo sapiens
cagcaaacaaataa

SEQ ID NO: 6013743 - DNA, 18 bp, Homo sapiens
cagcaaacacaataagag

SEQ ID NO: 6013744 - DNA, 16 bp, Homo sapiens
cagcaaacacagtcac

SEQ ID NO: 6013745 - DNA, 15 bp, Homo sapiens
cagcaaacactccac

SEQ ID NO: 6013746 - DNA, 21 bp, Homo sapiens
cagcaaacactccaccctcca

SEQ ID NO: 6013747 - DNA, 15 bp, Homo sapiens
cagcaaaccaagaga

SEQ ID NO: 6013748 - DNA, 23 bp, Homo sapiens
cagcaaaccaagagattgctaat

SEQ ID NO: 6013749 - DNA, 16 bp, Homo sapiens
cagcaaaccaggactc

SEQ ID NO: 6013750 - DNA, 12 bp, Homo sapiens
cagcaaaccatt

SEQ ID NO: 6013751 - DNA, 18 bp, Homo sapiens
cagcaaacccaaagatgt

SEQ ID NO: 6013752 - DNA, 16 bp, Homo sapiens
cagcaaaccggggcct

SEQ ID NO: 6013753 - DNA, 18 bp, Homo sapiens
cagcaaacctctcctcat

SEQ ID NO: 6013754 - DNA, 20 bp, Homo sapiens
cagcaaactcttttcccact

SEQ ID NO: 6013755 - DNA, 21 bp, Homo sapiens
cagcaaagagaatgtatttcc

SEQ ID NO: 6013756 - DNA, 20 bp, Homo sapiens
cagcaaagaggactcgcttg

SEQ ID NO: 6013757 - DNA, 13 bp, Homo sapiens
cagcaaagcagca

SEQ ID NO: 6013758 - DNA, 14 bp, Homo sapiens
cagcaaagcagcag

SEQ ID NO: 6013759 - DNA, 14 bp, Homo sapiens
cagcaaagcagctg

SEQ ID NO: 6013760 - DNA, 16 bp, Homo sapiens
cagcaaagccatattc

SEQ ID NO: 6013761 - DNA, 17 bp, Homo sapiens
cagcaaagccatattct

SEQ ID NO: 6013762 - DNA, 12 bp, Homo sapiens
cagcaaagcccc

SEQ ID NO: 6013763 - DNA, 13 bp, Homo sapiens
cagcaaagcccca

SEQ ID NO: 6013764 - DNA, 14 bp, Homo sapiens
cagcaaagccccat

SEQ ID NO: 6013765 - DNA, 14 bp, Homo sapiens
cagcaaagccccca

SEQ ID NO: 6013766 - DNA, 22 bp, Homo sapiens
cagcaaagcccccagagcccag

SEQ ID NO: 6013767 - DNA, 15 bp, Homo sapiens
cagcaaagcctccag

SEQ ID NO: 6013768 - DNA, 20 bp, Homo sapiens
cagcaaagcctccagcatct

SEQ ID NO: 6013769 - DNA, 15 bp, Homo sapiens
cagcaaagcttggtg

SEQ ID NO: 6013770 - DNA, 20 bp, Homo sapiens
cagcaaagcttggtgtcttg

SEQ ID NO: 6013771 - DNA, 15 bp, Homo sapiens
cagcaaaggaagact

SEQ ID NO: 6013772 - DNA, 18 bp, Homo sapiens
cagcaaaggtcttgaata

SEQ ID NO: 6013773 - DNA, 18 bp, Homo sapiens
cagcaaataaaacagtga

SEQ ID NO: 6013774 - DNA, 18 bp, Homo sapiens
cagcaaataaagcagtca

SEQ ID NO: 6013775 - DNA, 21 bp, Homo sapiens
cagcaaataaagcagtcatga

SEQ ID NO: 6013776 - DNA, 14 bp, Homo sapiens
cagcaaataaatac

SEQ ID NO: 6013777 - DNA, 12 bp, Homo sapiens
cagcaaatatat

SEQ ID NO: 6013778 - DNA, 13 bp, Homo sapiens
cagcaaatatatg

SEQ ID NO: 6013779 - DNA, 18 bp, Homo sapiens
cagcaaatcctttgtgaa

SEQ ID NO: 6013780 - DNA, 19 bp, Homo sapiens
cagcaaatgaaagactctt

SEQ ID NO: 6013781 - DNA, 22 bp, Homo sapiens
cagcaaatgcaaaaactctttg

SEQ ID NO: 6013782 - DNA, 18 bp, Homo sapiens
cagcaaatgccactctgg

SEQ ID NO: 6013783 - DNA, 19 bp, Homo sapiens
cagcaaattcttgaataaa

SEQ ID NO: 6013784 - DNA, 19 bp, Homo sapiens
cagcaacaaaatcatggct

SEQ ID NO: 6013785 - DNA, 13 bp, Homo sapiens
cagcaacaaagca

SEQ ID NO: 6013786 - DNA, 19 bp, Homo sapiens
cagcaacaaccatctcatc

SEQ ID NO: 6013787 - DNA, 23 bp, Homo sapiens
cagcaacacaaagcttttgcata

SEQ ID NO: 6013788 - DNA, 16 bp, Homo sapiens
cagtggcctcaaccct

SEQ ID NO: 6013789 - DNA, 21 bp, Homo sapiens
cagtggcctcaaccctccctc

SEQ ID NO: 6013790 - DNA, 14 bp, Homo sapiens
cagtggcctcttga

SEQ ID NO: 6013791 - DNA, 22 bp, Homo sapiens
cagtggcctgatctctgctccc

SEQ ID NO: 6013792 - DNA, 12 bp, Homo sapiens
cagtggcctgga

SEQ ID NO: 6013793 - DNA, 13 bp, Homo sapiens
cagtggcctggat

SEQ ID NO: 6013794 - DNA, 22 bp, Homo sapiens
cagtggcctggatgcacagtgc

SEQ ID NO: 6013795 - DNA, 23 bp, Homo sapiens
cagtggcctggatgcacagtgcc

SEQ ID NO: 6013796 - DNA, 16 bp, Homo sapiens
cagtggcctggcttgt

SEQ ID NO: 6013797 - DNA, 11 bp, Homo sapiens
cagtggcctta

SEQ ID NO: 6013798 - DNA, 18 bp, Homo sapiens
cagtggccttccccagca

SEQ ID NO: 6013799 - DNA, 14 bp, Homo sapiens
cagtggcctttcag

SEQ ID NO: 6013800 - DNA, 14 bp, Homo sapiens
cagtggcgagagga

SEQ ID NO: 6013801 - DNA, 15 bp, Homo sapiens
cagtggcgagaggag

SEQ ID NO: 6013802 - DNA, 17 bp, Homo sapiens
cagtggcgagaggagag

SEQ ID NO: 6013803 - DNA, 19 bp, Homo sapiens
cagtggcgagaggagagga

SEQ ID NO: 6013804 - DNA, 20 bp, Homo sapiens
cagtggcgagaggagaggaa

SEQ ID NO: 6013805 - DNA, 17 bp, Homo sapiens
cagtggcgggcccactc

SEQ ID NO: 6013806 - DNA, 20 bp, Homo sapiens
cagtggcgggtgatggccag

SEQ ID NO: 6013807 - DNA, 21 bp, Homo sapiens
cagtggcgggtgatggccagc

SEQ ID NO: 6013808 - DNA, 20 bp, Homo sapiens
cagtggctcgctccctgtag

SEQ ID NO: 6013809 - DNA, 16 bp, Homo sapiens
cagtggctctcagagc

SEQ ID NO: 6013810 - DNA, 19 bp, Homo sapiens
cagtggctctcagagcagc

SEQ ID NO: 6013811 - DNA, 13 bp, Homo sapiens
cagtggctgctct

SEQ ID NO: 6013812 - DNA, 15 bp, Homo sapiens
cagtggctgctctgg

SEQ ID NO: 6013813 - DNA, 17 bp, Homo sapiens
cagtggctgctctggga

SEQ ID NO: 6013814 - DNA, 14 bp, Homo sapiens
cagtggctgctgcc

SEQ ID NO: 6013815 - DNA, 18 bp, Homo sapiens
cagtggctgctgcccagg

SEQ ID NO: 6013816 - DNA, 19 bp, Homo sapiens
cagtggctggaattaaaac

SEQ ID NO: 6013817 - DNA, 21 bp, Homo sapiens
cagtggctggaattaaaacaa

SEQ ID NO: 6013818 - DNA, 13 bp, Homo sapiens
cagtggctggggg

SEQ ID NO: 6013819 - DNA, 22 bp, Homo sapiens
cagtggctgggggactgctttc

SEQ ID NO: 6013820 - DNA, 20 bp, Homo sapiens
cagtggctggtccagggcta

SEQ ID NO: 6013821 - DNA, 15 bp, Homo sapiens
cagtggctggtgccc

SEQ ID NO: 6013822 - DNA, 17 bp, Homo sapiens
cagtggctgtgaaggag

SEQ ID NO: 6013823 - DNA, 17 bp, Homo sapiens
cagtggcttagctgcca

SEQ ID NO: 6013824 - DNA, 15 bp, Homo sapiens
cagtggcttcccagc

SEQ ID NO: 6013825 - DNA, 18 bp, Homo sapiens
cagtggcttcccagctct

SEQ ID NO: 6013826 - DNA, 18 bp, Homo sapiens
cagtggcttggagcagag

SEQ ID NO: 6013827 - DNA, 20 bp, Homo sapiens
cagtggcttttgccccagaa

SEQ ID NO: 6013828 - DNA, 14 bp, Homo sapiens
cagtgggaaatatt

SEQ ID NO: 6013829 - DNA, 21 bp, Homo sapiens
cagtgggaacgtgactgcccc

SEQ ID NO: 6013830 - DNA, 17 bp, Homo sapiens
cagtgggaactctgaca

SEQ ID NO: 6013831 - DNA, 18 bp, Homo sapiens
cagtgggaatgcagtggg

SEQ ID NO: 6013832 - DNA, 17 bp, Homo sapiens
cagtgggaatgttcttt

SEQ ID NO: 6013833 - DNA, 18 bp, Homo sapiens
cagtgggaattgcagcat

SEQ ID NO: 6013834 - DNA, 20 bp, Homo sapiens
cagtgggacaaaccagagca

SEQ ID NO: 6013835 - DNA, 13 bp, Homo sapiens
cagtgggacagag

SEQ ID NO: 6013836 - DNA, 17 bp, Homo sapiens
cagtgggaccacatgcc

SEQ ID NO: 6013837 - DNA, 13 bp, Homo sapiens
cagtgggagaaaa

SEQ ID NO: 6013838 - DNA, 15 bp, Homo sapiens
cagtgggagccctga

SEQ ID NO: 6013839 - DNA, 16 bp, Homo sapiens
cagtgggagccctgac

SEQ ID NO: 6013840 - DNA, 22 bp, Homo sapiens
cagtgggagccctgaccttggc

SEQ ID NO: 6013841 - DNA, 18 bp, Homo sapiens
cagtgggagctgcctgtt

SEQ ID NO: 6013842 - DNA, 20 bp, Homo sapiens
cagtgggagctgcctgttca

SEQ ID NO: 6013843 - DNA, 12 bp, Homo sapiens
cagtgggaggca

SEQ ID NO: 6013844 - DNA, 13 bp, Homo sapiens
cagtgggaggcgc

SEQ ID NO: 6013845 - DNA, 18 bp, Homo sapiens
cagtgggaggggcaggct

SEQ ID NO: 6013846 - DNA, 19 bp, Homo sapiens
cagtgggaggggcaggctg

SEQ ID NO: 6013847 - DNA, 21 bp, Homo sapiens
cagtgggaggggcaggctgac

SEQ ID NO: 6013848 - DNA, 13 bp, Homo sapiens
cagtgggatggga

SEQ ID NO: 6013849 - DNA, 18 bp, Homo sapiens
cagtgggatgggacaggg

SEQ ID NO: 6013850 - DNA, 16 bp, Homo sapiens
cagtgggatgggctct

SEQ ID NO: 6013851 - DNA, 22 bp, Homo sapiens
cagtgggattatcgagcatgtt

SEQ ID NO: 6013852 - DNA, 15 bp, Homo sapiens
cagtgggcaggaggc

SEQ ID NO: 6013853 - DNA, 23 bp, Homo sapiens
cagtgggcaggaggccccaggct

SEQ ID NO: 6013854 - DNA, 13 bp, Homo sapiens
cagtgggcaggtg

SEQ ID NO: 6013855 - DNA, 15 bp, Homo sapiens
cagtgggcaggtggc

SEQ ID NO: 6013856 - DNA, 17 bp, Homo sapiens
cagtgggcaggtggccg

SEQ ID NO: 6013857 - DNA, 14 bp, Homo sapiens
cagtgggcccggag

SEQ ID NO: 6013858 - DNA, 20 bp, Homo sapiens
cagtgggcctgctgaggcct

SEQ ID NO: 6013859 - DNA, 15 bp, Homo sapiens
cagtgggcctggcca

SEQ ID NO: 6013860 - DNA, 21 bp, Homo sapiens
cagtgggcctggccagcaggt

SEQ ID NO: 6013861 - DNA, 18 bp, Homo sapiens
cagtgggcggcttccctg

SEQ ID NO: 6013862 - DNA, 16 bp, Homo sapiens
cagtgggctccctggc

SEQ ID NO: 6013863 - DNA, 17 bp, Homo sapiens
cagtgggctccctggcc

SEQ ID NO: 6013864 - DNA, 15 bp, Homo sapiens
cagtgggctcctggc

SEQ ID NO: 6013865 - DNA, 15 bp, Homo sapiens
cagtgggctgatgct

SEQ ID NO: 6013866 - DNA, 13 bp, Homo sapiens
cagtgggctgcac

SEQ ID NO: 6013867 - DNA, 18 bp, Homo sapiens
cagtgggctgtttctgct

SEQ ID NO: 6013868 - DNA, 21 bp, Homo sapiens
cagtggggaactgagggcaag

SEQ ID NO: 6013869 - DNA, 14 bp, Homo sapiens
cagtggggaatgaa

SEQ ID NO: 6013870 - DNA, 16 bp, Homo sapiens
cagtggggacagggag

SEQ ID NO: 6013871 - DNA, 15 bp, Homo sapiens
cagtggggcagtcat

SEQ ID NO: 6013872 - DNA, 14 bp, Homo sapiens
cagtggggcccatg

SEQ ID NO: 6013873 - DNA, 21 bp, Homo sapiens
cagtggggcccatggccccag

SEQ ID NO: 6013874 - DNA, 22 bp, Homo sapiens
cagtggggcccatggccccagc

SEQ ID NO: 6013875 - DNA, 21 bp, Homo sapiens
cagtggggcctgaggctcctt

SEQ ID NO: 6013876 - DNA, 19 bp, Homo sapiens
cagtggggctctctgagtc

SEQ ID NO: 6013877 - DNA, 20 bp, Homo sapiens
cagtggggctctctgagtcc

SEQ ID NO: 6013878 - DNA, 20 bp, Homo sapiens
cagtggggctggaagcagaa

SEQ ID NO: 6013879 - DNA, 21 bp, Homo sapiens
cagtggggctggaagcagaaa

SEQ ID NO: 6013880 - DNA, 17 bp, Homo sapiens
cagtggggctggcatca

SEQ ID NO: 6013881 - DNA, 21 bp, Homo sapiens
cagtggggtcaagctgagctg

SEQ ID NO: 6013882 - DNA, 23 bp, Homo sapiens
cagtggggtcaagctgagctggc

SEQ ID NO: 6013883 - DNA, 22 bp, Homo sapiens
cagtggggtgaaattttcttaa

SEQ ID NO: 6013884 - DNA, 23 bp, Homo sapiens
cagtggggtttcgcagcctgagt

SEQ ID NO: 6013885 - DNA, 19 bp, Homo sapiens
cagtggggtttttttgtct

SEQ ID NO: 6013886 - DNA, 20 bp, Homo sapiens
cagtggggtttttttgtctt

SEQ ID NO: 6013887 - DNA, 15 bp, Homo sapiens
cagtgggtaaaatta

SEQ ID NO: 6013888 - DNA, 23 bp, Homo sapiens
cagtgggtagtgaattggcttcc

SEQ ID NO: 6013889 - DNA, 15 bp, Homo sapiens
cagtgggtcccactt

SEQ ID NO: 6013890 - DNA, 18 bp, Homo sapiens
cagtgggtcccacttccc

SEQ ID NO: 6013891 - DNA, 22 bp, Homo sapiens
cagtgggtcccacttcccctcc

SEQ ID NO: 6013892 - DNA, 22 bp, Homo sapiens
cagtgggtgatgcttttgctgc

SEQ ID NO: 6013893 - DNA, 23 bp, Homo sapiens
cagtgggtgatgcttttgctgct

SEQ ID NO: 6013894 - DNA, 13 bp, Homo sapiens
cagtgggtggcac

SEQ ID NO: 6013895 - DNA, 22 bp, Homo sapiens
cagtgggtggcacctcctgaga

SEQ ID NO: 6013896 - DNA, 20 bp, Homo sapiens
cagtgggtgggagctccttt

SEQ ID NO: 6013897 - DNA, 16 bp, Homo sapiens
cagtgggttaattttg

SEQ ID NO: 6013898 - DNA, 17 bp, Homo sapiens
cagtggtaccagctcac

SEQ ID NO: 6013899 - DNA, 19 bp, Homo sapiens
cagtggtagctctggctta

SEQ ID NO: 6013900 - DNA, 20 bp, Homo sapiens
cagtggtatgatcacggctc

SEQ ID NO: 6013901 - DNA, 17 bp, Homo sapiens
cagtggtcagcaggtgt

SEQ ID NO: 6013902 - DNA, 19 bp, Homo sapiens
cagtggtcatgctcagcct

SEQ ID NO: 6013903 - DNA, 17 bp, Homo sapiens
cagtggtccagggtcca

SEQ ID NO: 6013904 - DNA, 19 bp, Homo sapiens
cagtggtccagggtccagc

SEQ ID NO: 6013905 - DNA, 23 bp, Homo sapiens
cagtggtccagggtccagccctc

SEQ ID NO: 6013906 - DNA, 15 bp, Homo sapiens
cagtggtgaaatctt

SEQ ID NO: 6013907 - DNA, 19 bp, Homo sapiens
cagtggtgaaatcttgttt

SEQ ID NO: 6013908 - DNA, 14 bp, Homo sapiens
cagtggtgaagaaa

SEQ ID NO: 6013909 - DNA, 17 bp, Homo sapiens
cagtggtgaagaaaact

SEQ ID NO: 6013910 - DNA, 23 bp, Homo sapiens
cagtggtgaagaaaactccttta

SEQ ID NO: 6013911 - DNA, 14 bp, Homo sapiens
cagtggtgatgcct

SEQ ID NO: 6013912 - DNA, 14 bp, Homo sapiens
cagtggtgattacc

SEQ ID NO: 6013913 - DNA, 14 bp, Homo sapiens
cagtggtgccatca

SEQ ID NO: 6013914 - DNA, 19 bp, Homo sapiens
cagtggtgcgatctcggct

SEQ ID NO: 6013915 - DNA, 14 bp, Homo sapiens
cagtggtgcgggcc

SEQ ID NO: 6013916 - DNA, 19 bp, Homo sapiens
cagtggtggagctggacct

SEQ ID NO: 6013917 - DNA, 15 bp, Homo sapiens
cagtggtggaggtgg

SEQ ID NO: 6013918 - DNA, 16 bp, Homo sapiens
cagtggtggaggtggg

SEQ ID NO: 6013919 - DNA, 14 bp, Homo sapiens
cagtggtggcaggg

SEQ ID NO: 6013920 - DNA, 18 bp, Homo sapiens
cagtggtggttttctgtt

SEQ ID NO: 6013921 - DNA, 19 bp, Homo sapiens
cagtggtggttttctgttc

SEQ ID NO: 6013922 - DNA, 21 bp, Homo sapiens
cagtggtgtgctctgggctca

SEQ ID NO: 6013923 - DNA, 16 bp, Homo sapiens
cagtggtgtgtgaagt

SEQ ID NO: 6013924 - DNA, 23 bp, Homo sapiens
cagtggtgtgtgaagtttggaga

SEQ ID NO: 6013925 - DNA, 20 bp, Homo sapiens
cagtggtgtgtggtgtcgtc

SEQ ID NO: 6013926 - DNA, 23 bp, Homo sapiens
cagtggtgttacattttcttgtc

SEQ ID NO: 6013927 - DNA, 14 bp, Homo sapiens
cagtggttatttag

SEQ ID NO: 6013928 - DNA, 14 bp, Homo sapiens
cagtggttcaatac

SEQ ID NO: 6013929 - DNA, 22 bp, Homo sapiens
cagtggttcaatacctgtttag

SEQ ID NO: 6013930 - DNA, 14 bp, Homo sapiens
cagtggttgcctgg

SEQ ID NO: 6013931 - DNA, 15 bp, Homo sapiens
cagtggttgcctggg

SEQ ID NO: 6013932 - DNA, 13 bp, Homo sapiens
cagtggttgctgt

SEQ ID NO: 6013933 - DNA, 20 bp, Homo sapiens
cagtggtttctacttcccct

SEQ ID NO: 6013934 - DNA, 22 bp, Homo sapiens
cagtggtttctacttcccctgg

SEQ ID NO: 6013935 - DNA, 15 bp, Homo sapiens
cagtggttttatact

SEQ ID NO: 6013936 - DNA, 19 bp, Homo sapiens
cagtgtaaagaataaatga

SEQ ID NO: 6013937 - DNA, 15 bp, Homo sapiens
cagtgtaaagtgtgt

SEQ ID NO: 6013938 - DNA, 17 bp, Homo sapiens
cagtgtaaatagttact

SEQ ID NO: 6013939 - DNA, 19 bp, Homo sapiens
cagtgtaaatagttactcc

SEQ ID NO: 6013940 - DNA, 20 bp, Homo sapiens
cagtgtaaatcccagactga

SEQ ID NO: 6013941 - DNA, 22 bp, Homo sapiens
cagtgtaaatcccagactgaca

SEQ ID NO: 6013942 - DNA, 18 bp, Homo sapiens
cagtgtaactggctgctc

SEQ ID NO: 6013943 - DNA, 12 bp, Homo sapiens
cagtgtaatttc

SEQ ID NO: 6013944 - DNA, 14 bp, Homo sapiens
cagtgtaatttctt

SEQ ID NO: 6013945 - DNA, 16 bp, Homo sapiens
cagtgtaatttctttg

SEQ ID NO: 6013946 - DNA, 20 bp, Homo sapiens
cagtgtaatttctttgcctg

SEQ ID NO: 6013947 - DNA, 20 bp, Homo sapiens
cagtgtacaaaactgtaaat

SEQ ID NO: 6013948 - DNA, 16 bp, Homo sapiens
cagtgtacacgtctgg

SEQ ID NO: 6013949 - DNA, 21 bp, Homo sapiens
cagtgtacacgtctggacccc

SEQ ID NO: 6013950 - DNA, 21 bp, Homo sapiens
cagtgtacaggtcacccatca

SEQ ID NO: 6013951 - DNA, 19 bp, Homo sapiens
cagtgtacatagtgtaatg

SEQ ID NO: 6013952 - DNA, 17 bp, Homo sapiens
cagtgtaccattaaaat

SEQ ID NO: 6013953 - DNA, 20 bp, Homo sapiens
cagtgtacccacgctgggta

SEQ ID NO: 6013954 - DNA, 16 bp, Homo sapiens
cagtgtacccccgccc

SEQ ID NO: 6013955 - DNA, 17 bp, Homo sapiens
cagtgtacccccgccca

SEQ ID NO: 6013956 - DNA, 19 bp, Homo sapiens
cagtgtacccccgcccagg

SEQ ID NO: 6013957 - DNA, 20 bp, Homo sapiens
cagtgtacccccgcccaggc

SEQ ID NO: 6013958 - DNA, 23 bp, Homo sapiens
cagtgtactctgagtcctcattg

SEQ ID NO: 6013959 - DNA, 13 bp, Homo sapiens
cagtgtactgctt

SEQ ID NO: 6013960 - DNA, 15 bp, Homo sapiens
cagtgtactgctttc

SEQ ID NO: 6013961 - DNA, 16 bp, Homo sapiens
cagtgtactgctttca

SEQ ID NO: 6013962 - DNA, 21 bp, Homo sapiens
cagtgtactgctttcaactta

SEQ ID NO: 6013963 - DNA, 22 bp, Homo sapiens
cagtgtactgctttcaacttaa

SEQ ID NO: 6013964 - DNA, 11 bp, Homo sapiens
cagtgtagaca

SEQ ID NO: 6013965 - DNA, 16 bp, Homo sapiens
cagcaacacaagctgg

SEQ ID NO: 6013966 - DNA, 17 bp, Homo sapiens
cagcaacacaagctgga

SEQ ID NO: 6013967 - DNA, 14 bp, Homo sapiens
cagcaacacaatgt

SEQ ID NO: 6013968 - DNA, 13 bp, Homo sapiens
cagcaacacagag

SEQ ID NO: 6013969 - DNA, 16 bp, Homo sapiens
cagcaacacccaagtc

SEQ ID NO: 6013970 - DNA, 14 bp, Homo sapiens
cagcaacacgtcat

SEQ ID NO: 6013971 - DNA, 21 bp, Homo sapiens
cagcaacacgtcattgtgtaa

SEQ ID NO: 6013972 - DNA, 14 bp, Homo sapiens
cagcaacactccgg

SEQ ID NO: 6013973 - DNA, 23 bp, Homo sapiens
cagcaacactccggtcagcccct

SEQ ID NO: 6013974 - DNA, 13 bp, Homo sapiens
cagcaacagaaaa

SEQ ID NO: 6013975 - DNA, 14 bp, Homo sapiens
cagcaacagcctac

SEQ ID NO: 6013976 - DNA, 19 bp, Homo sapiens
cagcaacaggaatctcaga

SEQ ID NO: 6013977 - DNA, 18 bp, Homo sapiens
cagcaacatctcgagccc

SEQ ID NO: 6013978 - DNA, 16 bp, Homo sapiens
cagcaaccagaagtta

SEQ ID NO: 6013979 - DNA, 18 bp, Homo sapiens
cagcaaccattcatcttt

SEQ ID NO: 6013980 - DNA, 16 bp, Homo sapiens
cagcaaccccaggctg

SEQ ID NO: 6013981 - DNA, 20 bp, Homo sapiens
cagcaaccctacagtatata

SEQ ID NO: 6013982 - DNA, 21 bp, Homo sapiens
cagcaacctgtaactcacatt

SEQ ID NO: 6013983 - DNA, 18 bp, Homo sapiens
cagcaacgatcacaaatg

SEQ ID NO: 6013984 - DNA, 19 bp, Homo sapiens
cagcaacgatcacaaatga

SEQ ID NO: 6013985 - DNA, 23 bp, Homo sapiens
cagcaacgcaggcccccaggtgc

SEQ ID NO: 6013986 - DNA, 17 bp, Homo sapiens
cagcaacgcttgtagaa

SEQ ID NO: 6013987 - DNA, 20 bp, Homo sapiens
cagcaacggcacagctaatt

SEQ ID NO: 6013988 - DNA, 20 bp, Homo sapiens
cagcaacggggaggccaagt

SEQ ID NO: 6013989 - DNA, 10 bp, Homo sapiens
cagcaactcc

SEQ ID NO: 6013990 - DNA, 15 bp, Homo sapiens
cagcaactcccacga

SEQ ID NO: 6013991 - DNA, 17 bp, Homo sapiens
cagcaactgaagacaat

SEQ ID NO: 6013992 - DNA, 14 bp, Homo sapiens
cagcaactgaataa

SEQ ID NO: 6013993 - DNA, 15 bp, Homo sapiens
cagcaactgaataaa

SEQ ID NO: 6013994 - DNA, 13 bp, Homo sapiens
cagcaactgacct

SEQ ID NO: 6013995 - DNA, 22 bp, Homo sapiens
cagcaacttgtctttttctgga

SEQ ID NO: 6013996 - DNA, 17 bp, Homo sapiens
cagcaagaaaaaaaaat

SEQ ID NO: 6013997 - DNA, 21 bp, Homo sapiens
cagcaagaaaaaaaaatgcca

SEQ ID NO: 6013998 - DNA, 12 bp, Homo sapiens
cagcaagaagca

SEQ ID NO: 6013999 - DNA, 16 bp, Homo sapiens
cagcaagaagggagtt

SEQ ID NO: 6014000 - DNA, 13 bp, Homo sapiens
cagcaagacctca

SEQ ID NO: 6014001 - DNA, 23 bp, Homo sapiens
cagcaagacctcatctgtggagc

SEQ ID NO: 6014002 - DNA, 15 bp, Homo sapiens
cagcaagacctcgtc

SEQ ID NO: 6014003 - DNA, 20 bp, Homo sapiens
cagcaagacttctctttgcc

SEQ ID NO: 6014004 - DNA, 21 bp, Homo sapiens
cagcaagactttataattcct

SEQ ID NO: 6014005 - DNA, 16 bp, Homo sapiens
cagcaagagcacaaga

SEQ ID NO: 6014006 - DNA, 19 bp, Homo sapiens
cagcaagaggaggacagaa

SEQ ID NO: 6014007 - DNA, 21 bp, Homo sapiens
cagcaagagggaacaaaactg

SEQ ID NO: 6014008 - DNA, 20 bp, Homo sapiens
cagcaagagtaagcagtgtt

SEQ ID NO: 6014009 - DNA, 15 bp, Homo sapiens
cagcaagatgtttct

SEQ ID NO: 6014010 - DNA, 19 bp, Homo sapiens
cagcaagccctacagagct

SEQ ID NO: 6014011 - DNA, 20 bp, Homo sapiens
cagcaagccgaatagctgat

SEQ ID NO: 6014012 - DNA, 21 bp, Homo sapiens
cagcaagctgcccagccctgg

SEQ ID NO: 6014013 - DNA, 16 bp, Homo sapiens
cagcaagcttgtagct

SEQ ID NO: 6014014 - DNA, 21 bp, Homo sapiens
cagcaaggaccagtgagacag

SEQ ID NO: 6014015 - DNA, 17 bp, Homo sapiens
cagcaaggagatttaca

SEQ ID NO: 6014016 - DNA, 18 bp, Homo sapiens
cagcaaggaggctggctg

SEQ ID NO: 6014017 - DNA, 16 bp, Homo sapiens
cagcaaggccacctct

SEQ ID NO: 6014018 - DNA, 23 bp, Homo sapiens
cagcaaggccacctcttcctggc

SEQ ID NO: 6014019 - DNA, 14 bp, Homo sapiens
cagcaaggcccgag

SEQ ID NO: 6014020 - DNA, 16 bp, Homo sapiens
cagcaaggcccgagca

SEQ ID NO: 6014021 - DNA, 23 bp, Homo sapiens
cagcaaggcccgagcagctgagc

SEQ ID NO: 6014022 - DNA, 16 bp, Homo sapiens
cagcaaggccctgctg

SEQ ID NO: 6014023 - DNA, 18 bp, Homo sapiens
cagcaaggccctgctgcc

SEQ ID NO: 6014024 - DNA, 19 bp, Homo sapiens
cagcaaggcgctaacttgc

SEQ ID NO: 6014025 - DNA, 15 bp, Homo sapiens
cagcaaggctgctgc

SEQ ID NO: 6014026 - DNA, 15 bp, Homo sapiens
cagcaagggacctgc

SEQ ID NO: 6014027 - DNA, 16 bp, Homo sapiens
cagcaaggtgtgaatg

SEQ ID NO: 6014028 - DNA, 15 bp, Homo sapiens
cagcaaggtgtggag

SEQ ID NO: 6014029 - DNA, 22 bp, Homo sapiens
cagcaaggtgtggaggctcctg

SEQ ID NO: 6014030 - DNA, 24 bp, Homo sapiens
cagcaaggtgtggaggctcctgtg

SEQ ID NO: 6014031 - DNA, 22 bp, Homo sapiens
cagcaagtacagagattctatg

SEQ ID NO: 6014032 - DNA, 23 bp, Homo sapiens
cagcaagtacagcggctcccctc

SEQ ID NO: 6014033 - DNA, 17 bp, Homo sapiens
cagcaagtagagcagag

SEQ ID NO: 6014034 - DNA, 22 bp, Homo sapiens
cagcaagtcccagacaaggaga

SEQ ID NO: 6014035 - DNA, 14 bp, Homo sapiens
cagcaagtctcttt

SEQ ID NO: 6014036 - DNA, 12 bp, Homo sapiens
cagcaagtgaga

SEQ ID NO: 6014037 - DNA, 14 bp, Homo sapiens
cagcaagtgagagc

SEQ ID NO: 6014038 - DNA, 21 bp, Homo sapiens
cagcaagtgagagctgggtgt

SEQ ID NO: 6014039 - DNA, 15 bp, Homo sapiens
cagcaagtgagcaga

SEQ ID NO: 6014040 - DNA, 13 bp, Homo sapiens
cagcaagtgccca

SEQ ID NO: 6014041 - DNA, 17 bp, Homo sapiens
cagcaagtgcccagtgg

SEQ ID NO: 6014042 - DNA, 23 bp, Homo sapiens
cagcaagtgctgagtctgtgaat

SEQ ID NO: 6014043 - DNA, 22 bp, Homo sapiens
cagcaagtggtcctagaggccc

SEQ ID NO: 6014044 - DNA, 16 bp, Homo sapiens
cagcaagtgtacagta

SEQ ID NO: 6014045 - DNA, 15 bp, Homo sapiens
cagcaagttcataca

SEQ ID NO: 6014046 - DNA, 16 bp, Homo sapiens
cagcaagtttataaaa

SEQ ID NO: 6014047 - DNA, 13 bp, Homo sapiens
cagcaataaagca

SEQ ID NO: 6014048 - DNA, 19 bp, Homo sapiens
cagcaataagaaatgaaca

SEQ ID NO: 6014049 - DNA, 19 bp, Homo sapiens
cagcaatactcatcagagc

SEQ ID NO: 6014050 - DNA, 17 bp, Homo sapiens
cagcaatagagacggga

SEQ ID NO: 6014051 - DNA, 17 bp, Homo sapiens
cagcaatagggtgcagt

SEQ ID NO: 6014052 - DNA, 15 bp, Homo sapiens
cagcaatatgtaaat

SEQ ID NO: 6014053 - DNA, 15 bp, Homo sapiens
cagcaatattctgat

SEQ ID NO: 6014054 - DNA, 21 bp, Homo sapiens
cagcaatcgcatcccggctga

SEQ ID NO: 6014055 - DNA, 20 bp, Homo sapiens
cagcaatctccatgtgtact

SEQ ID NO: 6014056 - DNA, 15 bp, Homo sapiens
cagcaatctgtcttt

SEQ ID NO: 6014057 - DNA, 19 bp, Homo sapiens
cagcaatgacatctcaggg

SEQ ID NO: 6014058 - DNA, 20 bp, Homo sapiens
cagcaatgacatctcagggg

SEQ ID NO: 6014059 - DNA, 18 bp, Homo sapiens
cagcaatgatgtccagaa

SEQ ID NO: 6014060 - DNA, 20 bp, Homo sapiens
cagcaatgatgtccagaaga

SEQ ID NO: 6014061 - DNA, 20 bp, Homo sapiens
cagcaattaaagacatttaa

SEQ ID NO: 6014062 - DNA, 21 bp, Homo sapiens
cagcaattaataatgtttata

SEQ ID NO: 6014063 - DNA, 23 bp, Homo sapiens
cagcaattactcactaaagggct

SEQ ID NO: 6014064 - DNA, 15 bp, Homo sapiens
cagcaattctcctgc

SEQ ID NO: 6014065 - DNA, 17 bp, Homo sapiens
cagcaattctcctgcct

SEQ ID NO: 6014066 - DNA, 15 bp, Homo sapiens
cagcaattctctttc

SEQ ID NO: 6014067 - DNA, 15 bp, Homo sapiens
cagcaattgtagaca

SEQ ID NO: 6014068 - DNA, 15 bp, Homo sapiens
cagcaatttaaatgt

SEQ ID NO: 6014069 - DNA, 16 bp, Homo sapiens
cagcaatttaaatgtt

SEQ ID NO: 6014070 - DNA, 15 bp, Homo sapiens
cagcacaaaaggcag

SEQ ID NO: 6014071 - DNA, 16 bp, Homo sapiens
cagcacaaacacaagg

SEQ ID NO: 6014072 - DNA, 20 bp, Homo sapiens
cagcacaaattagttatata

SEQ ID NO: 6014073 - DNA, 17 bp, Homo sapiens
cagcacaactcagtctg

SEQ ID NO: 6014074 - DNA, 21 bp, Homo sapiens
cagcacaactcagtctgtggg

SEQ ID NO: 6014075 - DNA, 19 bp, Homo sapiens
cagcacaaggaaataaaat

SEQ ID NO: 6014076 - DNA, 13 bp, Homo sapiens
cagcacaaggcca

SEQ ID NO: 6014077 - DNA, 22 bp, Homo sapiens
cagcacaagggcacattgccca

SEQ ID NO: 6014078 - DNA, 19 bp, Homo sapiens
cagcacaaggtggcagcaa

SEQ ID NO: 6014079 - DNA, 22 bp, Homo sapiens
cagcacaaggtggcagcaagca

SEQ ID NO: 6014080 - DNA, 18 bp, Homo sapiens
cagcacaattctgtccct

SEQ ID NO: 6014081 - DNA, 20 bp, Homo sapiens
cagcacacacaaacctactg

SEQ ID NO: 6014082 - DNA, 13 bp, Homo sapiens
cagcacacacagt

SEQ ID NO: 6014083 - DNA, 20 bp, Homo sapiens
cagcacacacttacagagca

SEQ ID NO: 6014084 - DNA, 20 bp, Homo sapiens
cagcacacacttcacaaagc

SEQ ID NO: 6014085 - DNA, 13 bp, Homo sapiens
cagcacacaggca

SEQ ID NO: 6014086 - DNA, 15 bp, Homo sapiens
cagcacacaggcagc

SEQ ID NO: 6014087 - DNA, 22 bp, Homo sapiens
cagcacacaggcagccagccgt

SEQ ID NO: 6014088 - DNA, 16 bp, Homo sapiens
cagcacacattgtgtt

SEQ ID NO: 6014089 - DNA, 17 bp, Homo sapiens
cagcacacattgtgtta

SEQ ID NO: 6014090 - DNA, 18 bp, Homo sapiens
cagcacaccaagtggctg

SEQ ID NO: 6014091 - DNA, 23 bp, Homo sapiens
cagcacaccaagtggctgggtgc

SEQ ID NO: 6014092 - DNA, 17 bp, Homo sapiens
cagcacaccagccgctg

SEQ ID NO: 6014093 - DNA, 22 bp, Homo sapiens
cagcacaccccaagggacaacc

SEQ ID NO: 6014094 - DNA, 14 bp, Homo sapiens
cagcacacctcagc

SEQ ID NO: 6014095 - DNA, 17 bp, Homo sapiens
cagcacactgtgaaaat

SEQ ID NO: 6014096 - DNA, 21 bp, Homo sapiens
cagcacagaaggaatctgtgc

SEQ ID NO: 6014097 - DNA, 15 bp, Homo sapiens
cagcacagaatgagt

SEQ ID NO: 6014098 - DNA, 12 bp, Homo sapiens
cagcacagagag

SEQ ID NO: 6014099 - DNA, 15 bp, Homo sapiens
cagcacagagagcgg

SEQ ID NO: 6014100 - DNA, 12 bp, Homo sapiens
cagcacagagcg

SEQ ID NO: 6014101 - DNA, 22 bp, Homo sapiens
cagcacagagtcgctggcatgt

SEQ ID NO: 6014102 - DNA, 16 bp, Homo sapiens
cagcacagatgtgaag

SEQ ID NO: 6014103 - DNA, 14 bp, Homo sapiens
cagcacagccacct

SEQ ID NO: 6014104 - DNA, 16 bp, Homo sapiens
cagcacagccacctcc

SEQ ID NO: 6014105 - DNA, 18 bp, Homo sapiens
cagcacagccacctccgc

SEQ ID NO: 6014106 - DNA, 13 bp, Homo sapiens
cagcacagcccag

SEQ ID NO: 6014107 - DNA, 14 bp, Homo sapiens
cagcacagcccagg

SEQ ID NO: 6014108 - DNA, 17 bp, Homo sapiens
cagcacagcccagggcc

SEQ ID NO: 6014109 - DNA, 14 bp, Homo sapiens
cagcacagcctcac

SEQ ID NO: 6014110 - DNA, 18 bp, Homo sapiens
cagcacagctactcagat

SEQ ID NO: 6014111 - DNA, 15 bp, Homo sapiens
cagcacagctccctg

SEQ ID NO: 6014112 - DNA, 16 bp, Homo sapiens
cagcacagctccctgc

SEQ ID NO: 6014113 - DNA, 15 bp, Homo sapiens
cagcacagctcctcc

SEQ ID NO: 6014114 - DNA, 12 bp, Homo sapiens
cagcacagctga

SEQ ID NO: 6014115 - DNA, 22 bp, Homo sapiens
cagcacagcttagatttcatag

SEQ ID NO: 6014116 - DNA, 13 bp, Homo sapiens
cagcacagcttga

SEQ ID NO: 6014117 - DNA, 21 bp, Homo sapiens
cagcacagcttgacctgaggc

SEQ ID NO: 6014118 - DNA, 23 bp, Homo sapiens
cagcacaggagagcacccacagc

SEQ ID NO: 6014119 - DNA, 16 bp, Homo sapiens
cagcacaggagggcgg

SEQ ID NO: 6014120 - DNA, 19 bp, Homo sapiens
cagcacaggcagccccacg

SEQ ID NO: 6014121 - DNA, 21 bp, Homo sapiens
cagcacaggcagccccacgga

SEQ ID NO: 6014122 - DNA, 13 bp, Homo sapiens
cagcacagggcag

SEQ ID NO: 6014123 - DNA, 16 bp, Homo sapiens
cagcacaggggcccca

SEQ ID NO: 6014124 - DNA, 18 bp, Homo sapiens
cagcacaggggccccaga

SEQ ID NO: 6014125 - DNA, 22 bp, Homo sapiens
cagcacaggggccccagatctg

SEQ ID NO: 6014126 - DNA, 14 bp, Homo sapiens
cagcacatattttc

SEQ ID NO: 6014127 - DNA, 19 bp, Homo sapiens
cagcacatgcactactgaa

SEQ ID NO: 6014128 - DNA, 15 bp, Homo sapiens
cagcacatgctggcc

SEQ ID NO: 6014129 - DNA, 20 bp, Homo sapiens
cagcacatgctggccagcct

SEQ ID NO: 6014130 - DNA, 14 bp, Homo sapiens
cagcacatggccat

SEQ ID NO: 6014131 - DNA, 23 bp, Homo sapiens
cagcacatggccatagaggccca

SEQ ID NO: 6014132 - DNA, 20 bp, Homo sapiens
cagcacattcgggaccaata

SEQ ID NO: 6014133 - DNA, 18 bp, Homo sapiens
cagcacattgccctgagg

SEQ ID NO: 6014134 - DNA, 22 bp, Homo sapiens
cagcacattgccctgaggggcc

SEQ ID NO: 6014135 - DNA, 23 bp, Homo sapiens
cagcacatttcctctctatcttt

SEQ ID NO: 6014136 - DNA, 17 bp, Homo sapiens
cagcacatttgttaatg

SEQ ID NO: 6014137 - DNA, 22 bp, Homo sapiens
cagcaccaagagcagctgggaa

SEQ ID NO: 6014138 - DNA, 23 bp, Homo sapiens
cagcaccacactgggtgcgtctc

SEQ ID NO: 6014139 - DNA, 13 bp, Homo sapiens
cagcaccacagcc

SEQ ID NO: 6014140 - DNA, 19 bp, Homo sapiens
cagcaccacattgcctcat

SEQ ID NO: 6014141 - DNA, 15 bp, Homo sapiens
cagcaccaccacaca

SEQ ID NO: 6014142 - DNA, 22 bp, Homo sapiens
cagcaccaccaggtctcccggg

SEQ ID NO: 6014143 - DNA, 17 bp, Homo sapiens
cagtgtagacacaggtc

SEQ ID NO: 6014144 - DNA, 18 bp, Homo sapiens
cagtgtagacacaggtca

SEQ ID NO: 6014145 - DNA, 21 bp, Homo sapiens
cagtgtagccccaagaaggct

SEQ ID NO: 6014146 - DNA, 22 bp, Homo sapiens
cagtgtagccccaagaaggctg

SEQ ID NO: 6014147 - DNA, 19 bp, Homo sapiens
cagtgtagcgggaggaagc

SEQ ID NO: 6014148 - DNA, 18 bp, Homo sapiens
cagtgtagtgcttttaaa

SEQ ID NO: 6014149 - DNA, 22 bp, Homo sapiens
cagtgtatatttttggtggtgg

SEQ ID NO: 6014150 - DNA, 20 bp, Homo sapiens
cagtgtatcaggtcagggac

SEQ ID NO: 6014151 - DNA, 19 bp, Homo sapiens
cagtgtatggggcagcttc

SEQ ID NO: 6014152 - DNA, 18 bp, Homo sapiens
cagtgtatggggctgcag

SEQ ID NO: 6014153 - DNA, 15 bp, Homo sapiens
cagtgtatttaatgt

SEQ ID NO: 6014154 - DNA, 14 bp, Homo sapiens
cagtgtatttggaa

SEQ ID NO: 6014155 - DNA, 20 bp, Homo sapiens
cagtgtatttttgtaaaaaa

SEQ ID NO: 6014156 - DNA, 18 bp, Homo sapiens
cagtgtcaaataaacact

SEQ ID NO: 6014157 - DNA, 19 bp, Homo sapiens
cagtgtcaagttgtgcttg

SEQ ID NO: 6014158 - DNA, 14 bp, Homo sapiens
cagtgtcacctctc

SEQ ID NO: 6014159 - DNA, 17 bp, Homo sapiens
cagtgtcacctctctca

SEQ ID NO: 6014160 - DNA, 22 bp, Homo sapiens
cagtgtcacctctctcagagca

SEQ ID NO: 6014161 - DNA, 23 bp, Homo sapiens
cagtgtcacctctctcagagcat

SEQ ID NO: 6014162 - DNA, 14 bp, Homo sapiens
cagtgtcactggtc

SEQ ID NO: 6014163 - DNA, 17 bp, Homo sapiens
cagtgtcacttgactct

SEQ ID NO: 6014164 - DNA, 13 bp, Homo sapiens
cagtgtcagagtc

SEQ ID NO: 6014165 - DNA, 18 bp, Homo sapiens
cagtgtcagcgggtgacg

SEQ ID NO: 6014166 - DNA, 12 bp, Homo sapiens
cagtgtcatttg

SEQ ID NO: 6014167 - DNA, 21 bp, Homo sapiens
cagtgtcattttattttttcc

SEQ ID NO: 6014168 - DNA, 14 bp, Homo sapiens
cagtgtcattttga

SEQ ID NO: 6014169 - DNA, 17 bp, Homo sapiens
cagtgtccaaagcaggg

SEQ ID NO: 6014170 - DNA, 23 bp, Homo sapiens
cagtgtccacgtttttggaaaat

SEQ ID NO: 6014171 - DNA, 18 bp, Homo sapiens
cagtgtcccaccttgacc

SEQ ID NO: 6014172 - DNA, 14 bp, Homo sapiens
cagtgtcccaggca

SEQ ID NO: 6014173 - DNA, 15 bp, Homo sapiens
cagtgtcccaggcag

SEQ ID NO: 6014174 - DNA, 13 bp, Homo sapiens
cagtgtccccagg

SEQ ID NO: 6014175 - DNA, 14 bp, Homo sapiens
cagtgtccccaggg

SEQ ID NO: 6014176 - DNA, 13 bp, Homo sapiens
cagtgtcccctgc

SEQ ID NO: 6014177 - DNA, 14 bp, Homo sapiens
cagtgtcccgggcc

SEQ ID NO: 6014178 - DNA, 13 bp, Homo sapiens
cagtgtcctcagg

SEQ ID NO: 6014179 - DNA, 18 bp, Homo sapiens
cagtgtcctcttgctcaa

SEQ ID NO: 6014180 - DNA, 19 bp, Homo sapiens
cagtgtcctcttgctcaaa

SEQ ID NO: 6014181 - DNA, 15 bp, Homo sapiens
cagtgtcctgagctc

SEQ ID NO: 6014182 - DNA, 16 bp, Homo sapiens
cagtgtcctgagctca

SEQ ID NO: 6014183 - DNA, 18 bp, Homo sapiens
cagtgtcctgagctcagc

SEQ ID NO: 6014184 - DNA, 19 bp, Homo sapiens
cagtgtcctgagctcagcg

SEQ ID NO: 6014185 - DNA, 22 bp, Homo sapiens
cagtgtcctgagctcagcgtgg

SEQ ID NO: 6014186 - DNA, 21 bp, Homo sapiens
cagtgtcctgtgctttctgca

SEQ ID NO: 6014187 - DNA, 16 bp, Homo sapiens
cagtgtccttagaaca

SEQ ID NO: 6014188 - DNA, 14 bp, Homo sapiens
cagtgtcctttcca

SEQ ID NO: 6014189 - DNA, 20 bp, Homo sapiens
cagtgtcgccgtccctctgc

SEQ ID NO: 6014190 - DNA, 20 bp, Homo sapiens
cagtgtcgtgtctgctgttg

SEQ ID NO: 6014191 - DNA, 21 bp, Homo sapiens
cagtgtctaggcactgagcag

SEQ ID NO: 6014192 - DNA, 18 bp, Homo sapiens
cagtgtctcacactggcg

SEQ ID NO: 6014193 - DNA, 11 bp, Homo sapiens
cagtgtctctg

SEQ ID NO: 6014194 - DNA, 17 bp, Homo sapiens
cagtgtctggctgcaga

SEQ ID NO: 6014195 - DNA, 14 bp, Homo sapiens
cagtgtctgggctg

SEQ ID NO: 6014196 - DNA, 15 bp, Homo sapiens
cagtgtctgggctga

SEQ ID NO: 6014197 - DNA, 19 bp, Homo sapiens
cagtgtctgtaaaagagcc

SEQ ID NO: 6014198 - DNA, 13 bp, Homo sapiens
cagtgtctgtccc

SEQ ID NO: 6014199 - DNA, 14 bp, Homo sapiens
cagtgtctgtcccg

SEQ ID NO: 6014200 - DNA, 16 bp, Homo sapiens
cagtgtctgtgccatg

SEQ ID NO: 6014201 - DNA, 16 bp, Homo sapiens
cagtgtctgtgtgtgt

SEQ ID NO: 6014202 - DNA, 17 bp, Homo sapiens
cagtgtcttcctgtggg

SEQ ID NO: 6014203 - DNA, 14 bp, Homo sapiens
cagtgtcttgtaac

SEQ ID NO: 6014204 - DNA, 22 bp, Homo sapiens
cagtgtctttcggaatttttaa

SEQ ID NO: 6014205 - DNA, 16 bp, Homo sapiens
cagtgtctttctagcc

SEQ ID NO: 6014206 - DNA, 21 bp, Homo sapiens
cagtgtctttttttgtatagt

SEQ ID NO: 6014207 - DNA, 23 bp, Homo sapiens
cagtgtctttttttgtatagtta

SEQ ID NO: 6014208 - DNA, 20 bp, Homo sapiens
cagtgtgaagacactgtgca

SEQ ID NO: 6014209 - DNA, 13 bp, Homo sapiens
cagtgtgaagtta

SEQ ID NO: 6014210 - DNA, 17 bp, Homo sapiens
cagtgtgaagttagaat

SEQ ID NO: 6014211 - DNA, 21 bp, Homo sapiens
cagtgtgaagttagaattcct

SEQ ID NO: 6014212 - DNA, 19 bp, Homo sapiens
cagtgtgaatagcctggcc

SEQ ID NO: 6014213 - DNA, 21 bp, Homo sapiens
cagtgtgacagaaaaaaaaat

SEQ ID NO: 6014214 - DNA, 19 bp, Homo sapiens
cagtgtgagatactgtgta

SEQ ID NO: 6014215 - DNA, 14 bp, Homo sapiens
cagtgtgagatttc

SEQ ID NO: 6014216 - DNA, 17 bp, Homo sapiens
cagtgtgagggaaagag

SEQ ID NO: 6014217 - DNA, 15 bp, Homo sapiens
cagtgtgagggtgca

SEQ ID NO: 6014218 - DNA, 12 bp, Homo sapiens
cagtgtgatttt

SEQ ID NO: 6014219 - DNA, 20 bp, Homo sapiens
cagtgtgcacccctccccat

SEQ ID NO: 6014220 - DNA, 19 bp, Homo sapiens
cagtgtgcacgcctgcagg

SEQ ID NO: 6014221 - DNA, 14 bp, Homo sapiens
cagtgtgccaccct

SEQ ID NO: 6014222 - DNA, 18 bp, Homo sapiens
cagtgtgccaccctctgc

SEQ ID NO: 6014223 - DNA, 20 bp, Homo sapiens
cagtgtgccagtttaaaaag

SEQ ID NO: 6014224 - DNA, 20 bp, Homo sapiens
cagtgtgcccaaaagccatg

SEQ ID NO: 6014225 - DNA, 15 bp, Homo sapiens
cagtgtgccccccat

SEQ ID NO: 6014226 - DNA, 21 bp, Homo sapiens
cagtgtgctaacctcactgcc

SEQ ID NO: 6014227 - DNA, 22 bp, Homo sapiens
cagtgtgctaacctcactgcct

SEQ ID NO: 6014228 - DNA, 20 bp, Homo sapiens
cagtgtgcttacctgttgtc

SEQ ID NO: 6014229 - DNA, 13 bp, Homo sapiens
cagtgtggactct

SEQ ID NO: 6014230 - DNA, 19 bp, Homo sapiens
cagtgtggactctggactg

SEQ ID NO: 6014231 - DNA, 18 bp, Homo sapiens
cagtgtggagaccctgcc

SEQ ID NO: 6014232 - DNA, 14 bp, Homo sapiens
cagtgtggagaggg

SEQ ID NO: 6014233 - DNA, 18 bp, Homo sapiens
cagtgtggaggccactgt

SEQ ID NO: 6014234 - DNA, 23 bp, Homo sapiens
cagtgtggagttcaccttggaag

SEQ ID NO: 6014235 - DNA, 15 bp, Homo sapiens
cagtgtggccaggct

SEQ ID NO: 6014236 - DNA, 16 bp, Homo sapiens
cagtgtggccaggctg

SEQ ID NO: 6014237 - DNA, 14 bp, Homo sapiens
cagtgtggccccag

SEQ ID NO: 6014238 - DNA, 11 bp, Homo sapiens
cagtgtggcct

SEQ ID NO: 6014239 - DNA, 18 bp, Homo sapiens
cagtgtggcctcttggct

SEQ ID NO: 6014240 - DNA, 18 bp, Homo sapiens
cagtgtggcttaaacatt

SEQ ID NO: 6014241 - DNA, 21 bp, Homo sapiens
cagtgtgggaatgcggcaaga

SEQ ID NO: 6014242 - DNA, 15 bp, Homo sapiens
cagtgtgggacaggc

SEQ ID NO: 6014243 - DNA, 16 bp, Homo sapiens
cagtgtgggacaggct

SEQ ID NO: 6014244 - DNA, 18 bp, Homo sapiens
cagtgtgggacaggctct

SEQ ID NO: 6014245 - DNA, 19 bp, Homo sapiens
cagtgtgggacaggctctt

SEQ ID NO: 6014246 - DNA, 22 bp, Homo sapiens
cagtgtgggacaggctcttctt

SEQ ID NO: 6014247 - DNA, 15 bp, Homo sapiens
cagtgtggggagggc

SEQ ID NO: 6014248 - DNA, 22 bp, Homo sapiens
cagtgtggggataaagacagag

SEQ ID NO: 6014249 - DNA, 16 bp, Homo sapiens
cagtgtggggcagccg

SEQ ID NO: 6014250 - DNA, 15 bp, Homo sapiens
cagtgtggtgggagg

SEQ ID NO: 6014251 - DNA, 16 bp, Homo sapiens
cagtgtggtgggaggg

SEQ ID NO: 6014252 - DNA, 12 bp, Homo sapiens
cagtgtgtaaac

SEQ ID NO: 6014253 - DNA, 13 bp, Homo sapiens
cagtgtgtaaagt

SEQ ID NO: 6014254 - DNA, 13 bp, Homo sapiens
cagtgtgtaaata

SEQ ID NO: 6014255 - DNA, 15 bp, Homo sapiens
cagtgtgtagtttgt

SEQ ID NO: 6014256 - DNA, 19 bp, Homo sapiens
cagtgtgtcacactgagct

SEQ ID NO: 6014257 - DNA, 19 bp, Homo sapiens
cagtgtgtcagtttttcct

SEQ ID NO: 6014258 - DNA, 18 bp, Homo sapiens
cagtgtgtccatcatatt

SEQ ID NO: 6014259 - DNA, 19 bp, Homo sapiens
cagtgtgtccttggggcac

SEQ ID NO: 6014260 - DNA, 22 bp, Homo sapiens
cagtgtgtccttggggcacagt

SEQ ID NO: 6014261 - DNA, 14 bp, Homo sapiens
cagtgtgtctcctg

SEQ ID NO: 6014262 - DNA, 16 bp, Homo sapiens
cagtgtgtctcctgca

SEQ ID NO: 6014263 - DNA, 14 bp, Homo sapiens
cagtgtgtgctcag

SEQ ID NO: 6014264 - DNA, 14 bp, Homo sapiens
cagtgtgtggggga

SEQ ID NO: 6014265 - DNA, 21 bp, Homo sapiens
cagtgtgtggtcaacatttct

SEQ ID NO: 6014266 - DNA, 11 bp, Homo sapiens
cagtgtgtgtg

SEQ ID NO: 6014267 - DNA, 22 bp, Homo sapiens
cagtgtgtgtgtgtggtccatg

SEQ ID NO: 6014268 - DNA, 23 bp, Homo sapiens
cagtgtgtgtgtgtggtccatgc

SEQ ID NO: 6014269 - DNA, 15 bp, Homo sapiens
cagtgtgttgacttc

SEQ ID NO: 6014270 - DNA, 17 bp, Homo sapiens
cagtgttaaagtggtct

SEQ ID NO: 6014271 - DNA, 18 bp, Homo sapiens
cagtgttaaagtggtctg

SEQ ID NO: 6014272 - DNA, 15 bp, Homo sapiens
cagtgttaaatgaaa

SEQ ID NO: 6014273 - DNA, 18 bp, Homo sapiens
cagtgttaaatgaaattg

SEQ ID NO: 6014274 - DNA, 19 bp, Homo sapiens
cagtgttaaatgtgatgaa

SEQ ID NO: 6014275 - DNA, 15 bp, Homo sapiens
cagtgttaaattcat

SEQ ID NO: 6014276 - DNA, 15 bp, Homo sapiens
cagtgttaagtgaca

SEQ ID NO: 6014277 - DNA, 21 bp, Homo sapiens
cagtgttaagtgtttgaaaac

SEQ ID NO: 6014278 - DNA, 15 bp, Homo sapiens
cagtgttaataaatg

SEQ ID NO: 6014279 - DNA, 16 bp, Homo sapiens
cagtgttaataaatgg

SEQ ID NO: 6014280 - DNA, 23 bp, Homo sapiens
cagtgttacaatcagtgtgaatg

SEQ ID NO: 6014281 - DNA, 14 bp, Homo sapiens
cagtgttacctgtg

SEQ ID NO: 6014282 - DNA, 19 bp, Homo sapiens
cagtgttacctgtgtgctt

SEQ ID NO: 6014283 - DNA, 20 bp, Homo sapiens
cagtgttacttttaattcct

SEQ ID NO: 6014284 - DNA, 14 bp, Homo sapiens
cagtgttagagaaa

SEQ ID NO: 6014285 - DNA, 13 bp, Homo sapiens
cagtgttagctta

SEQ ID NO: 6014286 - DNA, 18 bp, Homo sapiens
cagtgttaggcctggcac

SEQ ID NO: 6014287 - DNA, 21 bp, Homo sapiens
cagtgttaggcctggcacagt

SEQ ID NO: 6014288 - DNA, 19 bp, Homo sapiens
cagtgttagggaagggcct

SEQ ID NO: 6014289 - DNA, 16 bp, Homo sapiens
cagtgttagtgctggt

SEQ ID NO: 6014290 - DNA, 23 bp, Homo sapiens
cagtgttagtgctggtcagagag

SEQ ID NO: 6014291 - DNA, 21 bp, Homo sapiens
cagtgttagtgggaagagctg

SEQ ID NO: 6014292 - DNA, 23 bp, Homo sapiens
cagtgttagtgggaagagctggg

SEQ ID NO: 6014293 - DNA, 16 bp, Homo sapiens
cagtgttataaaatct

SEQ ID NO: 6014294 - DNA, 20 bp, Homo sapiens
cagtgttatttattccccag

SEQ ID NO: 6014295 - DNA, 15 bp, Homo sapiens
cagtgttcaaattct

SEQ ID NO: 6014296 - DNA, 22 bp, Homo sapiens
cagtgttcaaattctgattatt

SEQ ID NO: 6014297 - DNA, 21 bp, Homo sapiens
cagtgttcagcatagagctat

SEQ ID NO: 6014298 - DNA, 14 bp, Homo sapiens
cagtgttccccatc

SEQ ID NO: 6014299 - DNA, 20 bp, Homo sapiens
cagtgttcctcaccaataac

SEQ ID NO: 6014300 - DNA, 17 bp, Homo sapiens
cagtgttcctgaagctg

SEQ ID NO: 6014301 - DNA, 22 bp, Homo sapiens
cagtgttcctgaagctgctgtg

SEQ ID NO: 6014302 - DNA, 23 bp, Homo sapiens
cagtgttcctgaagctgctgtgt

SEQ ID NO: 6014303 - DNA, 16 bp, Homo sapiens
cagtgttcgcttggct

SEQ ID NO: 6014304 - DNA, 17 bp, Homo sapiens
cagtgttctatgaacaa

SEQ ID NO: 6014305 - DNA, 13 bp, Homo sapiens
cagtgttctattt

SEQ ID NO: 6014306 - DNA, 16 bp, Homo sapiens
cagtgttctcacagtg

SEQ ID NO: 6014307 - DNA, 13 bp, Homo sapiens
cagtgttctgagc

SEQ ID NO: 6014308 - DNA, 22 bp, Homo sapiens
cagtgttctgagcccccacctg

SEQ ID NO: 6014309 - DNA, 13 bp, Homo sapiens
cagtgttctgttt

SEQ ID NO: 6014310 - DNA, 13 bp, Homo sapiens
cagtgttcttctc

SEQ ID NO: 6014311 - DNA, 21 bp, Homo sapiens
cagtgttgaaattggaaagga

SEQ ID NO: 6014312 - DNA, 12 bp, Homo sapiens
cagtgttgacat

SEQ ID NO: 6014313 - DNA, 13 bp, Homo sapiens
cagtgttgacata

SEQ ID NO: 6014314 - DNA, 20 bp, Homo sapiens
cagtgttgacatagcctttg

SEQ ID NO: 6014315 - DNA, 23 bp, Homo sapiens
cagtgttgacatagcctttgtgc

SEQ ID NO: 6014316 - DNA, 20 bp, Homo sapiens
cagtgttgattctagatgat

SEQ ID NO: 6014317 - DNA, 21 bp, Homo sapiens
cagtgttgcctcctcccatcc

SEQ ID NO: 6014318 - DNA, 17 bp, Homo sapiens
cagtgttgcctcttgca

SEQ ID NO: 6014319 - DNA, 17 bp, Homo sapiens
cagtgttgcgtttttcc

SEQ ID NO: 6014320 - DNA, 20 bp, Homo sapiens
cagtgttggctgtgtgacag

SEQ ID NO: 6014321 - DNA, 22 bp, Homo sapiens
cagtgttggctgtgtgacagaa

SEQ ID NO: 6014322 - DNA, 13 bp, Homo sapiens
cagcaccacccta

SEQ ID NO: 6014323 - DNA, 19 bp, Homo sapiens
cagcaccaccctccttccc

SEQ ID NO: 6014324 - DNA, 21 bp, Homo sapiens
cagcaccacctacacaggagt

SEQ ID NO: 6014325 - DNA, 22 bp, Homo sapiens
cagcaccacctacacaggagtc

SEQ ID NO: 6014326 - DNA, 15 bp, Homo sapiens
cagcaccactgctga

SEQ ID NO: 6014327 - DNA, 15 bp, Homo sapiens
cagcacccaaagggt

SEQ ID NO: 6014328 - DNA, 13 bp, Homo sapiens
cagcacccactac

SEQ ID NO: 6014329 - DNA, 15 bp, Homo sapiens
cagcacccactacca

SEQ ID NO: 6014330 - DNA, 14 bp, Homo sapiens
cagcacccactcag

SEQ ID NO: 6014331 - DNA, 16 bp, Homo sapiens
cagcacccactcagcc

SEQ ID NO: 6014332 - DNA, 17 bp, Homo sapiens
cagcacccactcagcca

SEQ ID NO: 6014333 - DNA, 18 bp, Homo sapiens
cagcacccagcaactcca

SEQ ID NO: 6014334 - DNA, 12 bp, Homo sapiens
cagcacccaggc

SEQ ID NO: 6014335 - DNA, 13 bp, Homo sapiens
cagcacccaggct

SEQ ID NO: 6014336 - DNA, 16 bp, Homo sapiens
cagcacccaggctcca

SEQ ID NO: 6014337 - DNA, 21 bp, Homo sapiens
cagcacccagtcctctgcctc

SEQ ID NO: 6014338 - DNA, 20 bp, Homo sapiens
cagcacccatgccccactct

SEQ ID NO: 6014339 - DNA, 12 bp, Homo sapiens
cagcaccccagt

SEQ ID NO: 6014340 - DNA, 12 bp, Homo sapiens
cagcacccctcc

SEQ ID NO: 6014341 - DNA, 16 bp, Homo sapiens
cagcacccctgtctct

SEQ ID NO: 6014342 - DNA, 16 bp, Homo sapiens
cagcaccccttccatg

SEQ ID NO: 6014343 - DNA, 19 bp, Homo sapiens
cagcaccccttccatgtgg

SEQ ID NO: 6014344 - DNA, 17 bp, Homo sapiens
cagcaccctataaatca

SEQ ID NO: 6014345 - DNA, 19 bp, Homo sapiens
cagcaccctcccccgcagc

SEQ ID NO: 6014346 - DNA, 17 bp, Homo sapiens
cagcaccctctcctggg

SEQ ID NO: 6014347 - DNA, 19 bp, Homo sapiens
cagcaccctctcctggggg

SEQ ID NO: 6014348 - DNA, 23 bp, Homo sapiens
cagcaccctctcctgggggtggc

SEQ ID NO: 6014349 - DNA, 16 bp, Homo sapiens
cagcaccctgcagagc

SEQ ID NO: 6014350 - DNA, 14 bp, Homo sapiens
cagcaccctgggtg

SEQ ID NO: 6014351 - DNA, 22 bp, Homo sapiens
cagcacccttctcggagaccca

SEQ ID NO: 6014352 - DNA, 13 bp, Homo sapiens
cagcaccgcctct

SEQ ID NO: 6014353 - DNA, 15 bp, Homo sapiens
cagcaccgcctcttc

SEQ ID NO: 6014354 - DNA, 18 bp, Homo sapiens
cagcaccggaccagcctg

SEQ ID NO: 6014355 - DNA, 15 bp, Homo sapiens
cagcaccgtgccaac

SEQ ID NO: 6014356 - DNA, 15 bp, Homo sapiens
cagcacctcagcctg

SEQ ID NO: 6014357 - DNA, 17 bp, Homo sapiens
cagcacctcagcctgca

SEQ ID NO: 6014358 - DNA, 18 bp, Homo sapiens
cagcacctccaggcctgt

SEQ ID NO: 6014359 - DNA, 13 bp, Homo sapiens
cagcacctccggg

SEQ ID NO: 6014360 - DNA, 13 bp, Homo sapiens
cagcacctcctcc

SEQ ID NO: 6014361 - DNA, 15 bp, Homo sapiens
cagcacctcctccgt

SEQ ID NO: 6014362 - DNA, 21 bp, Homo sapiens
cagcacctcctctctgctggg

SEQ ID NO: 6014363 - DNA, 14 bp, Homo sapiens
cagcacctgccagg

SEQ ID NO: 6014364 - DNA, 13 bp, Homo sapiens
cagcacctgccct

SEQ ID NO: 6014365 - DNA, 15 bp, Homo sapiens
cagcacctgcctcct

SEQ ID NO: 6014366 - DNA, 15 bp, Homo sapiens
cagcacctgctccca

SEQ ID NO: 6014367 - DNA, 12 bp, Homo sapiens
cagcacctggca

SEQ ID NO: 6014368 - DNA, 17 bp, Homo sapiens
cagcaccttctttctgg

SEQ ID NO: 6014369 - DNA, 15 bp, Homo sapiens
cagcaccttgcagat

SEQ ID NO: 6014370 - DNA, 19 bp, Homo sapiens
cagcaccttggcccaggag

SEQ ID NO: 6014371 - DNA, 20 bp, Homo sapiens
cagcaccttggcccaggagc

SEQ ID NO: 6014372 - DNA, 22 bp, Homo sapiens
cagcaccttggcccaggagctc

SEQ ID NO: 6014373 - DNA, 16 bp, Homo sapiens
cagcaccttgtgcctg

SEQ ID NO: 6014374 - DNA, 18 bp, Homo sapiens
cagcaccttgtgcctggg

SEQ ID NO: 6014375 - DNA, 15 bp, Homo sapiens
cagcacctttctagc

SEQ ID NO: 6014376 - DNA, 16 bp, Homo sapiens
cagcacctttctctga

SEQ ID NO: 6014377 - DNA, 14 bp, Homo sapiens
cagcacgagcctgg

SEQ ID NO: 6014378 - DNA, 15 bp, Homo sapiens
cagcacgagcctggg

SEQ ID NO: 6014379 - DNA, 13 bp, Homo sapiens
cagcacgcaggcg

SEQ ID NO: 6014380 - DNA, 17 bp, Homo sapiens
cagcacgcatgtccctc

SEQ ID NO: 6014381 - DNA, 21 bp, Homo sapiens
cagcacgcatgtccctccaag

SEQ ID NO: 6014382 - DNA, 14 bp, Homo sapiens
cagcacgccaaccc

SEQ ID NO: 6014383 - DNA, 13 bp, Homo sapiens
cagcacgcctctc

SEQ ID NO: 6014384 - DNA, 14 bp, Homo sapiens
cagcacgcctctcc

SEQ ID NO: 6014385 - DNA, 22 bp, Homo sapiens
cagcacgcctctccccaccttc

SEQ ID NO: 6014386 - DNA, 15 bp, Homo sapiens
cagcacggacaataa

SEQ ID NO: 6014387 - DNA, 23 bp, Homo sapiens
cagcacggcgtggtgtgtccctg

SEQ ID NO: 6014388 - DNA, 18 bp, Homo sapiens
cagcacgggggccaagga

SEQ ID NO: 6014389 - DNA, 16 bp, Homo sapiens
cagcacgtctcagaga

SEQ ID NO: 6014390 - DNA, 17 bp, Homo sapiens
cagcacgtgtggcctgt

SEQ ID NO: 6014391 - DNA, 18 bp, Homo sapiens
cagcacgttctccagact

SEQ ID NO: 6014392 - DNA, 10 bp, Homo sapiens
cagcactaac

SEQ ID NO: 6014393 - DNA, 21 bp, Homo sapiens
cagcactaattagtgtccaac

SEQ ID NO: 6014394 - DNA, 15 bp, Homo sapiens
cagcactactgggtg

SEQ ID NO: 6014395 - DNA, 19 bp, Homo sapiens
cagcactactgggtgtcat

SEQ ID NO: 6014396 - DNA, 15 bp, Homo sapiens
cagcactacttactt

SEQ ID NO: 6014397 - DNA, 16 bp, Homo sapiens
cagcactagagtcacc

SEQ ID NO: 6014398 - DNA, 21 bp, Homo sapiens
cagcactagccaaacctcacc

SEQ ID NO: 6014399 - DNA, 20 bp, Homo sapiens
cagcactatgacattttggg

SEQ ID NO: 6014400 - DNA, 12 bp, Homo sapiens
cagcactcccag

SEQ ID NO: 6014401 - DNA, 20 bp, Homo sapiens
cagcactcccagggcccgag

SEQ ID NO: 6014402 - DNA, 21 bp, Homo sapiens
cagcactcccagggcccgagc

SEQ ID NO: 6014403 - DNA, 18 bp, Homo sapiens
cagcactccccagagctg

SEQ ID NO: 6014404 - DNA, 23 bp, Homo sapiens
cagcactccccagagctgtgcca

SEQ ID NO: 6014405 - DNA, 17 bp, Homo sapiens
cagcactccccttgcct

SEQ ID NO: 6014406 - DNA, 20 bp, Homo sapiens
cagcactcccgctgcacaca

SEQ ID NO: 6014407 - DNA, 21 bp, Homo sapiens
cagcactcccgctgcacacag

SEQ ID NO: 6014408 - DNA, 18 bp, Homo sapiens
cagcactcctctgtctct

SEQ ID NO: 6014409 - DNA, 19 bp, Homo sapiens
cagcactcctctgtctctg

SEQ ID NO: 6014410 - DNA, 22 bp, Homo sapiens
cagcactcgctagcagtggcag

SEQ ID NO: 6014411 - DNA, 13 bp, Homo sapiens
cagcactctggac

SEQ ID NO: 6014412 - DNA, 16 bp, Homo sapiens
cagcactctggactcc

SEQ ID NO: 6014413 - DNA, 19 bp, Homo sapiens
cagcactctggactccacg

SEQ ID NO: 6014414 - DNA, 22 bp, Homo sapiens
cagcactgaccccgacctcaga

SEQ ID NO: 6014415 - DNA, 17 bp, Homo sapiens
cagcactgactggaagg

SEQ ID NO: 6014416 - DNA, 13 bp, Homo sapiens
cagcactgaggaa

SEQ ID NO: 6014417 - DNA, 16 bp, Homo sapiens
cagcactgcccatccc

SEQ ID NO: 6014418 - DNA, 19 bp, Homo sapiens
cagcactgcccatcccacc

SEQ ID NO: 6014419 - DNA, 21 bp, Homo sapiens
cagcactgcccatcccacccc

SEQ ID NO: 6014420 - DNA, 12 bp, Homo sapiens
cagcactgcctg

SEQ ID NO: 6014421 - DNA, 14 bp, Homo sapiens
cagcactgcctgct

SEQ ID NO: 6014422 - DNA, 16 bp, Homo sapiens
cagcactgctgcctca

SEQ ID NO: 6014423 - DNA, 19 bp, Homo sapiens
cagcactgctgcctcagct

SEQ ID NO: 6014424 - DNA, 18 bp, Homo sapiens
cagcactgcttgaggaaa

SEQ ID NO: 6014425 - DNA, 19 bp, Homo sapiens
cagcactggaaccacctgg

SEQ ID NO: 6014426 - DNA, 21 bp, Homo sapiens
cagcactggaggggcccaccc

SEQ ID NO: 6014427 - DNA, 21 bp, Homo sapiens
cagcactggattgtagaactt

SEQ ID NO: 6014428 - DNA, 16 bp, Homo sapiens
cagcactggctctctc

SEQ ID NO: 6014429 - DNA, 19 bp, Homo sapiens
cagcactggctctctccag

SEQ ID NO: 6014430 - DNA, 21 bp, Homo sapiens
cagcactgggaagctggagtg

SEQ ID NO: 6014431 - DNA, 22 bp, Homo sapiens
cagcactgggaagctggagtgc

SEQ ID NO: 6014432 - DNA, 22 bp, Homo sapiens
cagcactggtgaactgagctgg

SEQ ID NO: 6014433 - DNA, 14 bp, Homo sapiens
cagcactgtccctt

SEQ ID NO: 6014434 - DNA, 12 bp, Homo sapiens
cagcactgtgaa

SEQ ID NO: 6014435 - DNA, 14 bp, Homo sapiens
cagcactgtggaca

SEQ ID NO: 6014436 - DNA, 16 bp, Homo sapiens
cagcactgtttgaaga

SEQ ID NO: 6014437 - DNA, 18 bp, Homo sapiens
cagcacttcaaagaagct

SEQ ID NO: 6014438 - DNA, 23 bp, Homo sapiens
cagcacttgggggttcaggcccg

SEQ ID NO: 6014439 - DNA, 17 bp, Homo sapiens
cagcacttgtccagctg

SEQ ID NO: 6014440 - DNA, 14 bp, Homo sapiens
cagcacttgtctca

SEQ ID NO: 6014441 - DNA, 20 bp, Homo sapiens
cagcacttgtctcattttaa

SEQ ID NO: 6014442 - DNA, 17 bp, Homo sapiens
cagcactttaaccctct

SEQ ID NO: 6014443 - DNA, 18 bp, Homo sapiens
cagcactttaaccctctc

SEQ ID NO: 6014444 - DNA, 19 bp, Homo sapiens
cagcactttaaccctctct

SEQ ID NO: 6014445 - DNA, 20 bp, Homo sapiens
cagcactttaaccctctctt

SEQ ID NO: 6014446 - DNA, 23 bp, Homo sapiens
cagcactttaaccctctcttccc

SEQ ID NO: 6014447 - DNA, 19 bp, Homo sapiens
cagcactttaccagaggca

SEQ ID NO: 6014448 - DNA, 15 bp, Homo sapiens
cagcactttcccatg

SEQ ID NO: 6014449 - DNA, 20 bp, Homo sapiens
cagcactttgggagaccaag

SEQ ID NO: 6014450 - DNA, 15 bp, Homo sapiens
cagcactttgggagg

SEQ ID NO: 6014451 - DNA, 18 bp, Homo sapiens
cagcactttgggaggcca

SEQ ID NO: 6014452 - DNA, 19 bp, Homo sapiens
cagcactttgggaggccga

SEQ ID NO: 6014453 - DNA, 22 bp, Homo sapiens
cagcactttgggaggcctaggc

SEQ ID NO: 6014454 - DNA, 17 bp, Homo sapiens
cagcactttgggaggct

SEQ ID NO: 6014455 - DNA, 22 bp, Homo sapiens
cagcactttgggaggctgaggc

SEQ ID NO: 6014456 - DNA, 23 bp, Homo sapiens
cagcactttgggaggctgaggcg

SEQ ID NO: 6014457 - DNA, 22 bp, Homo sapiens
cagcactttgggaggctgaggt

SEQ ID NO: 6014458 - DNA, 15 bp, Homo sapiens
cagcactttggtttt

SEQ ID NO: 6014459 - DNA, 11 bp, Homo sapiens
cagcagaaaag

SEQ ID NO: 6014460 - DNA, 14 bp, Homo sapiens
cagcagaaaagtgc

SEQ ID NO: 6014461 - DNA, 22 bp, Homo sapiens
cagcagaaaagtgcttagaaag

SEQ ID NO: 6014462 - DNA, 12 bp, Homo sapiens
cagcagaaacac

SEQ ID NO: 6014463 - DNA, 14 bp, Homo sapiens
cagcagaaacacac

SEQ ID NO: 6014464 - DNA, 15 bp, Homo sapiens
cagcagaaagactgg

SEQ ID NO: 6014465 - DNA, 21 bp, Homo sapiens
cagcagaaatgcccccattct

SEQ ID NO: 6014466 - DNA, 17 bp, Homo sapiens
cagcagaaatgccttac

SEQ ID NO: 6014467 - DNA, 12 bp, Homo sapiens
cagcagaacagc

SEQ ID NO: 6014468 - DNA, 19 bp, Homo sapiens
cagcagaacagccattttt

SEQ ID NO: 6014469 - DNA, 21 bp, Homo sapiens
cagcagaacctgcacacagga

SEQ ID NO: 6014470 - DNA, 24 bp, Homo sapiens
cagcagaacctgcacacaggacag

SEQ ID NO: 6014471 - DNA, 15 bp, Homo sapiens
cagcagaagacaaaa

SEQ ID NO: 6014472 - DNA, 15 bp, Homo sapiens
cagcagaagagggag

SEQ ID NO: 6014473 - DNA, 17 bp, Homo sapiens
cagcagaaggccttgcc

SEQ ID NO: 6014474 - DNA, 17 bp, Homo sapiens
cagcagaatgaagacct

SEQ ID NO: 6014475 - DNA, 15 bp, Homo sapiens
cagcagaatggaggc

SEQ ID NO: 6014476 - DNA, 18 bp, Homo sapiens
cagcagaatggaggcagg

SEQ ID NO: 6014477 - DNA, 21 bp, Homo sapiens
cagcagaatggtgatcactcc

SEQ ID NO: 6014478 - DNA, 12 bp, Homo sapiens
cagcagacacat

SEQ ID NO: 6014479 - DNA, 14 bp, Homo sapiens
cagcagacagagcc

SEQ ID NO: 6014480 - DNA, 15 bp, Homo sapiens
cagcagacagagcca

SEQ ID NO: 6014481 - DNA, 21 bp, Homo sapiens
cagcagacagagccaggagaa

SEQ ID NO: 6014482 - DNA, 16 bp, Homo sapiens
cagcagacatccacac

SEQ ID NO: 6014483 - DNA, 17 bp, Homo sapiens
cagcagactcagctctg

SEQ ID NO: 6014484 - DNA, 11 bp, Homo sapiens
cagcagactga

SEQ ID NO: 6014485 - DNA, 21 bp, Homo sapiens
cagcagactggtttgcagtga

SEQ ID NO: 6014486 - DNA, 15 bp, Homo sapiens
cagcagactgtgttt

SEQ ID NO: 6014487 - DNA, 19 bp, Homo sapiens
cagcagagacttgggacat

SEQ ID NO: 6014488 - DNA, 15 bp, Homo sapiens
cagcagagagagaga

SEQ ID NO: 6014489 - DNA, 16 bp, Homo sapiens
cagcagagagccctgg

SEQ ID NO: 6014490 - DNA, 17 bp, Homo sapiens
cagcagagatggagaaa

SEQ ID NO: 6014491 - DNA, 13 bp, Homo sapiens
cagcagagcacct

SEQ ID NO: 6014492 - DNA, 12 bp, Homo sapiens
cagcagagcatt

SEQ ID NO: 6014493 - DNA, 16 bp, Homo sapiens
cagcagagccagggca

SEQ ID NO: 6014494 - DNA, 16 bp, Homo sapiens
cagcagagccatctgc

SEQ ID NO: 6014495 - DNA, 16 bp, Homo sapiens
cagcagagcccaccag

SEQ ID NO: 6014496 - DNA, 20 bp, Homo sapiens
cagcagagcccaccagccag

SEQ ID NO: 6014497 - DNA, 22 bp, Homo sapiens
cagcagagcccaccagccagcc

SEQ ID NO: 6014498 - DNA, 23 bp, Homo sapiens
cagcagagcggggtcccctctgt

SEQ ID NO: 6014499 - DNA, 14 bp, Homo sapiens
cagcagaggacagt

SEQ ID NO: 6014500 - DNA, 22 bp, Homo sapiens
cagcagaggacagtctggagaa

SEQ ID NO: 6014501 - DNA, 15 bp, Homo sapiens
cagcagaggcactgg

SEQ ID NO: 6014502 - DNA, 20 bp, Homo sapiens
cagtgttgtcaccagatctg

SEQ ID NO: 6014503 - DNA, 14 bp, Homo sapiens
cagtgttgtctcat

SEQ ID NO: 6014504 - DNA, 14 bp, Homo sapiens
cagtgttgtgcccc

SEQ ID NO: 6014505 - DNA, 20 bp, Homo sapiens
cagtgttgtggatttaacag

SEQ ID NO: 6014506 - DNA, 22 bp, Homo sapiens
cagtgttgtggatttaacagaa

SEQ ID NO: 6014507 - DNA, 15 bp, Homo sapiens
cagtgttgtttgtaa

SEQ ID NO: 6014508 - DNA, 23 bp, Homo sapiens
cagtgttgtttgtaaataagaga

SEQ ID NO: 6014509 - DNA, 14 bp, Homo sapiens
cagtgtttaaaact

SEQ ID NO: 6014510 - DNA, 15 bp, Homo sapiens
cagtgtttactttaa

SEQ ID NO: 6014511 - DNA, 22 bp, Homo sapiens
cagtgtttagaagagcctgact

SEQ ID NO: 6014512 - DNA, 18 bp, Homo sapiens
cagtgtttatcctttcat

SEQ ID NO: 6014513 - DNA, 11 bp, Homo sapiens
cagtgtttatg

SEQ ID NO: 6014514 - DNA, 18 bp, Homo sapiens
cagtgtttcaattctgta

SEQ ID NO: 6014515 - DNA, 20 bp, Homo sapiens
cagtgtttcccataattttc

SEQ ID NO: 6014516 - DNA, 21 bp, Homo sapiens
cagtgtttcccataattttct

SEQ ID NO: 6014517 - DNA, 20 bp, Homo sapiens
cagtgtttcgtcatgttggc

SEQ ID NO: 6014518 - DNA, 14 bp, Homo sapiens
cagtgtttctgggg

SEQ ID NO: 6014519 - DNA, 16 bp, Homo sapiens
cagtgtttggtgacat

SEQ ID NO: 6014520 - DNA, 12 bp, Homo sapiens
cagtgtttgtat

SEQ ID NO: 6014521 - DNA, 16 bp, Homo sapiens
cagtgttttaggagca

SEQ ID NO: 6014522 - DNA, 20 bp, Homo sapiens
cagtgttttaggagcatgag

SEQ ID NO: 6014523 - DNA, 23 bp, Homo sapiens
cagtgttttcagaagaaataaat

SEQ ID NO: 6014524 - DNA, 19 bp, Homo sapiens
cagtgttttcattttagac

SEQ ID NO: 6014525 - DNA, 16 bp, Homo sapiens
cagtgttttcttgtgt

SEQ ID NO: 6014526 - DNA, 15 bp, Homo sapiens
cagtgttttctttga

SEQ ID NO: 6014527 - DNA, 13 bp, Homo sapiens
cagtgttttgcat

SEQ ID NO: 6014528 - DNA, 16 bp, Homo sapiens
cagtgtttttattgct

SEQ ID NO: 6014529 - DNA, 21 bp, Homo sapiens
cagtgtttttgaaacccacag

SEQ ID NO: 6014530 - DNA, 23 bp, Homo sapiens
cagtgtttttgaaacccacagtt

SEQ ID NO: 6014531 - DNA, 21 bp, Homo sapiens
cagtgttttttaggaaaagca

SEQ ID NO: 6014532 - DNA, 24 bp, Homo sapiens
cagtgttttttcactttagctatg

SEQ ID NO: 6014533 - DNA, 16 bp, Homo sapiens
cagttaaaaaaaattt

SEQ ID NO: 6014534 - DNA, 18 bp, Homo sapiens
cagttaaaatcacatttt

SEQ ID NO: 6014535 - DNA, 15 bp, Homo sapiens
cagttaaacttgcaa

SEQ ID NO: 6014536 - DNA, 13 bp, Homo sapiens
cagttaaagccac

SEQ ID NO: 6014537 - DNA, 22 bp, Homo sapiens
cagttaaagtagatcacctcct

SEQ ID NO: 6014538 - DNA, 12 bp, Homo sapiens
cagttaaatatg

SEQ ID NO: 6014539 - DNA, 17 bp, Homo sapiens
cagttaaatatgatttg

SEQ ID NO: 6014540 - DNA, 15 bp, Homo sapiens
cagttaacaggatat

SEQ ID NO: 6014541 - DNA, 23 bp, Homo sapiens
cagttaacgtcacccaaaagcac

SEQ ID NO: 6014542 - DNA, 22 bp, Homo sapiens
cagttaactttcagaagagatg

SEQ ID NO: 6014543 - DNA, 14 bp, Homo sapiens
cagttaagaaaaaa

SEQ ID NO: 6014544 - DNA, 16 bp, Homo sapiens
cagttaagaaaaaaat

SEQ ID NO: 6014545 - DNA, 15 bp, Homo sapiens
cagttaagaaatttc

SEQ ID NO: 6014546 - DNA, 16 bp, Homo sapiens
cagttaagaaatttca

SEQ ID NO: 6014547 - DNA, 16 bp, Homo sapiens
cagttaagaagccctg

SEQ ID NO: 6014548 - DNA, 13 bp, Homo sapiens
cagttaagagaaa

SEQ ID NO: 6014549 - DNA, 17 bp, Homo sapiens
cagttaagcctttggaa

SEQ ID NO: 6014550 - DNA, 23 bp, Homo sapiens
cagttaaggaagatcctgaagca

SEQ ID NO: 6014551 - DNA, 21 bp, Homo sapiens
cagttaatcctcacacctact

SEQ ID NO: 6014552 - DNA, 12 bp, Homo sapiens
cagttaatcttg

SEQ ID NO: 6014553 - DNA, 15 bp, Homo sapiens
cagttaatcttgctt

SEQ ID NO: 6014554 - DNA, 13 bp, Homo sapiens
cagttaattcttg

SEQ ID NO: 6014555 - DNA, 22 bp, Homo sapiens
cagttacaaaaatagtagaaca

SEQ ID NO: 6014556 - DNA, 18 bp, Homo sapiens
cagttacaaattataatg

SEQ ID NO: 6014557 - DNA, 15 bp, Homo sapiens
cagttacacaggaac

SEQ ID NO: 6014558 - DNA, 21 bp, Homo sapiens
cagttacacaggaaccctaaa

SEQ ID NO: 6014559 - DNA, 14 bp, Homo sapiens
cagttacagaaagt

SEQ ID NO: 6014560 - DNA, 22 bp, Homo sapiens
cagttaccacacatctatgata

SEQ ID NO: 6014561 - DNA, 22 bp, Homo sapiens
cagttaccacagcaactgacct

SEQ ID NO: 6014562 - DNA, 23 bp, Homo sapiens
cagttaccattaaaccatctccc

SEQ ID NO: 6014563 - DNA, 23 bp, Homo sapiens
cagttaccccgatccgtttgcaa

SEQ ID NO: 6014564 - DNA, 16 bp, Homo sapiens
cagttacctttgctgt

SEQ ID NO: 6014565 - DNA, 17 bp, Homo sapiens
cagttacctttgctgtc

SEQ ID NO: 6014566 - DNA, 22 bp, Homo sapiens
cagttactatagtggtgagatg

SEQ ID NO: 6014567 - DNA, 14 bp, Homo sapiens
cagttactcagccc

SEQ ID NO: 6014568 - DNA, 16 bp, Homo sapiens
cagttactcagccctg

SEQ ID NO: 6014569 - DNA, 19 bp, Homo sapiens
cagttactcaggaggctga

SEQ ID NO: 6014570 - DNA, 21 bp, Homo sapiens
cagttactccctacactgatg

SEQ ID NO: 6014571 - DNA, 23 bp, Homo sapiens
cagttactgtgaatgttccccac

SEQ ID NO: 6014572 - DNA, 15 bp, Homo sapiens
cagttactgttcatg

SEQ ID NO: 6014573 - DNA, 21 bp, Homo sapiens
cagttacttaagattcagttt

SEQ ID NO: 6014574 - DNA, 17 bp, Homo sapiens
cagttacttaatgacca

SEQ ID NO: 6014575 - DNA, 21 bp, Homo sapiens
cagttacttaatgaccatgtt

SEQ ID NO: 6014576 - DNA, 14 bp, Homo sapiens
cagttacttacaca

SEQ ID NO: 6014577 - DNA, 16 bp, Homo sapiens
cagttacttacctgca

SEQ ID NO: 6014578 - DNA, 14 bp, Homo sapiens
cagttacttccttc

SEQ ID NO: 6014579 - DNA, 15 bp, Homo sapiens
cagttacttgtgttc

SEQ ID NO: 6014580 - DNA, 20 bp, Homo sapiens
cagttacttttttagtaaca

SEQ ID NO: 6014581 - DNA, 21 bp, Homo sapiens
cagttagaaggaggttctaat

SEQ ID NO: 6014582 - DNA, 17 bp, Homo sapiens
cagttagagcagcctcg

SEQ ID NO: 6014583 - DNA, 21 bp, Homo sapiens
cagttagagcagcctcgtgga

SEQ ID NO: 6014584 - DNA, 13 bp, Homo sapiens
cagttagcacaga

SEQ ID NO: 6014585 - DNA, 15 bp, Homo sapiens
cagttagcagggatg

SEQ ID NO: 6014586 - DNA, 16 bp, Homo sapiens
cagttagccactgctg

SEQ ID NO: 6014587 - DNA, 17 bp, Homo sapiens
cagttagcccggccaag

SEQ ID NO: 6014588 - DNA, 18 bp, Homo sapiens
cagttagcccggccaagg

SEQ ID NO: 6014589 - DNA, 22 bp, Homo sapiens
cagttaggtgctgaatgaagct

SEQ ID NO: 6014590 - DNA, 19 bp, Homo sapiens
cagttagttagaattggaa

SEQ ID NO: 6014591 - DNA, 19 bp, Homo sapiens
cagttataaaattaaaagt

SEQ ID NO: 6014592 - DNA, 16 bp, Homo sapiens
cagttataaagaaaga

SEQ ID NO: 6014593 - DNA, 20 bp, Homo sapiens
cagttataacagatgtgaaa

SEQ ID NO: 6014594 - DNA, 17 bp, Homo sapiens
cagttataagcgtattt

SEQ ID NO: 6014595 - DNA, 14 bp, Homo sapiens
cagttataattatt

SEQ ID NO: 6014596 - DNA, 13 bp, Homo sapiens
cagttataatttc

SEQ ID NO: 6014597 - DNA, 20 bp, Homo sapiens
cagttataatttcaattttt

SEQ ID NO: 6014598 - DNA, 19 bp, Homo sapiens
cagttatacagttataaaa

SEQ ID NO: 6014599 - DNA, 14 bp, Homo sapiens
cagttatatgatat

SEQ ID NO: 6014600 - DNA, 20 bp, Homo sapiens
cagttatatgatattcttta

SEQ ID NO: 6014601 - DNA, 19 bp, Homo sapiens
cagttatattctttaaatt

SEQ ID NO: 6014602 - DNA, 12 bp, Homo sapiens
cagttatatttt

SEQ ID NO: 6014603 - DNA, 18 bp, Homo sapiens
cagttatattttgcagtt

SEQ ID NO: 6014604 - DNA, 20 bp, Homo sapiens
cagttatcctgcaagggaca

SEQ ID NO: 6014605 - DNA, 13 bp, Homo sapiens
cagttatcctttg

SEQ ID NO: 6014606 - DNA, 16 bp, Homo sapiens
cagttatcctttgtga

SEQ ID NO: 6014607 - DNA, 23 bp, Homo sapiens
cagttatcctttgtgagcctatg

SEQ ID NO: 6014608 - DNA, 19 bp, Homo sapiens
cagttatctgtttgttact

SEQ ID NO: 6014609 - DNA, 19 bp, Homo sapiens
cagttatggctataggtgc

SEQ ID NO: 6014610 - DNA, 18 bp, Homo sapiens
cagttatgtgaatgatct

SEQ ID NO: 6014611 - DNA, 15 bp, Homo sapiens
cagttattacatgta

SEQ ID NO: 6014612 - DNA, 22 bp, Homo sapiens
cagttattagaacttagttttg

SEQ ID NO: 6014613 - DNA, 21 bp, Homo sapiens
cagttattatatttacaaatg

SEQ ID NO: 6014614 - DNA, 16 bp, Homo sapiens
cagttattcagattga

SEQ ID NO: 6014615 - DNA, 18 bp, Homo sapiens
cagttattggtggaatct

SEQ ID NO: 6014616 - DNA, 20 bp, Homo sapiens
cagttattgtccctggcttc

SEQ ID NO: 6014617 - DNA, 14 bp, Homo sapiens
cagttatttctgtt

SEQ ID NO: 6014618 - DNA, 23 bp, Homo sapiens
cagttatttctgtttcctattta

SEQ ID NO: 6014619 - DNA, 10 bp, Homo sapiens
cagttatttt

SEQ ID NO: 6014620 - DNA, 14 bp, Homo sapiens
cagttattttgata

SEQ ID NO: 6014621 - DNA, 12 bp, Homo sapiens
cagttattttgg

SEQ ID NO: 6014622 - DNA, 19 bp, Homo sapiens
cagttattttggatatatt

SEQ ID NO: 6014623 - DNA, 21 bp, Homo sapiens
cagttattttggatatattat

SEQ ID NO: 6014624 - DNA, 22 bp, Homo sapiens
cagttattttggatatattatt

SEQ ID NO: 6014625 - DNA, 15 bp, Homo sapiens
cagttcaaagcagga

SEQ ID NO: 6014626 - DNA, 13 bp, Homo sapiens
cagttcaaagtca

SEQ ID NO: 6014627 - DNA, 15 bp, Homo sapiens
cagttcaaagtcatg

SEQ ID NO: 6014628 - DNA, 15 bp, Homo sapiens
cagttcaaagtgtat

SEQ ID NO: 6014629 - DNA, 17 bp, Homo sapiens
cagttcaaagtgtatat

SEQ ID NO: 6014630 - DNA, 18 bp, Homo sapiens
cagttcaaagtgtatatt

SEQ ID NO: 6014631 - DNA, 23 bp, Homo sapiens
cagttcaacctggtggcaccaga

SEQ ID NO: 6014632 - DNA, 15 bp, Homo sapiens
cagttcaactttcag

SEQ ID NO: 6014633 - DNA, 14 bp, Homo sapiens
cagttcaatcaaac

SEQ ID NO: 6014634 - DNA, 21 bp, Homo sapiens
cagttcaatcaaactttcagc

SEQ ID NO: 6014635 - DNA, 19 bp, Homo sapiens
cagttcacaaaaaaatgtt

SEQ ID NO: 6014636 - DNA, 14 bp, Homo sapiens
cagttcacaccctg

SEQ ID NO: 6014637 - DNA, 20 bp, Homo sapiens
cagttcacaccctgcaaggc

SEQ ID NO: 6014638 - DNA, 20 bp, Homo sapiens
cagttcacagaggtctttca

SEQ ID NO: 6014639 - DNA, 14 bp, Homo sapiens
cagttcagaaaaaa

SEQ ID NO: 6014640 - DNA, 23 bp, Homo sapiens
cagttcagaatcacttctgagaa

SEQ ID NO: 6014641 - DNA, 15 bp, Homo sapiens
cagttcagagatcag

SEQ ID NO: 6014642 - DNA, 19 bp, Homo sapiens
cagttcagagatcaggatc

SEQ ID NO: 6014643 - DNA, 15 bp, Homo sapiens
cagttcagagctgcc

SEQ ID NO: 6014644 - DNA, 21 bp, Homo sapiens
cagttcagagctgccctctcc

SEQ ID NO: 6014645 - DNA, 22 bp, Homo sapiens
cagttcagagctgccctctcct

SEQ ID NO: 6014646 - DNA, 17 bp, Homo sapiens
cagttcaggagtcccaa

SEQ ID NO: 6014647 - DNA, 20 bp, Homo sapiens
cagttcaggagtcccaagga

SEQ ID NO: 6014648 - DNA, 15 bp, Homo sapiens
cagttcagtacctgg

SEQ ID NO: 6014649 - DNA, 19 bp, Homo sapiens
cagttcagtacctggagga

SEQ ID NO: 6014650 - DNA, 18 bp, Homo sapiens
cagttcagtggcagggct

SEQ ID NO: 6014651 - DNA, 19 bp, Homo sapiens
cagttcagtggcagggctc

SEQ ID NO: 6014652 - DNA, 20 bp, Homo sapiens
cagttcagtggcagggctca

SEQ ID NO: 6014653 - DNA, 14 bp, Homo sapiens
cagttcataaacaa

SEQ ID NO: 6014654 - DNA, 15 bp, Homo sapiens
cagttcataaacaac

SEQ ID NO: 6014655 - DNA, 15 bp, Homo sapiens
cagttcataaatttg

SEQ ID NO: 6014656 - DNA, 15 bp, Homo sapiens
cagttcataatatat

SEQ ID NO: 6014657 - DNA, 19 bp, Homo sapiens
cagttcataatatatggaa

SEQ ID NO: 6014658 - DNA, 14 bp, Homo sapiens
cagttcataattca

SEQ ID NO: 6014659 - DNA, 16 bp, Homo sapiens
cagttcataattcacc

SEQ ID NO: 6014660 - DNA, 16 bp, Homo sapiens
cagttcatactgaatg

SEQ ID NO: 6014661 - DNA, 13 bp, Homo sapiens
cagttcatcccaa

SEQ ID NO: 6014662 - DNA, 21 bp, Homo sapiens
cagttcatccgcactgtaaat

SEQ ID NO: 6014663 - DNA, 21 bp, Homo sapiens
cagttcatctatggcagtcca

SEQ ID NO: 6014664 - DNA, 18 bp, Homo sapiens
cagttcatctctgctgaa

SEQ ID NO: 6014665 - DNA, 21 bp, Homo sapiens
cagttcatctctgctgaacat

SEQ ID NO: 6014666 - DNA, 12 bp, Homo sapiens
cagttcatcttt

SEQ ID NO: 6014667 - DNA, 16 bp, Homo sapiens
cagttcatgtctgaaa

SEQ ID NO: 6014668 - DNA, 17 bp, Homo sapiens
cagttcatgtctgaaac

SEQ ID NO: 6014669 - DNA, 22 bp, Homo sapiens
cagttcatgtctgaaacagaga

SEQ ID NO: 6014670 - DNA, 18 bp, Homo sapiens
cagttcatgtttgcttca

SEQ ID NO: 6014671 - DNA, 15 bp, Homo sapiens
cagttcattattttg

SEQ ID NO: 6014672 - DNA, 21 bp, Homo sapiens
cagttcattcgctttgtctgt

SEQ ID NO: 6014673 - DNA, 15 bp, Homo sapiens
cagttcattctacca

SEQ ID NO: 6014674 - DNA, 20 bp, Homo sapiens
cagttcattctaccaagctg

SEQ ID NO: 6014675 - DNA, 23 bp, Homo sapiens
cagttcattctaccaagctgtca

SEQ ID NO: 6014676 - DNA, 22 bp, Homo sapiens
cagttcattgacctcatcatta

SEQ ID NO: 6014677 - DNA, 18 bp, Homo sapiens
cagttcattgcactttga

SEQ ID NO: 6014678 - DNA, 12 bp, Homo sapiens
cagttccaagaa

SEQ ID NO: 6014679 - DNA, 17 bp, Homo sapiens
cagttccaatacttcat

SEQ ID NO: 6014680 - DNA, 16 bp, Homo sapiens
cagcagaggcactggg

SEQ ID NO: 6014681 - DNA, 16 bp, Homo sapiens
cagcagaggcaggacc

SEQ ID NO: 6014682 - DNA, 23 bp, Homo sapiens
cagcagaggcaggaccagaaggc

SEQ ID NO: 6014683 - DNA, 16 bp, Homo sapiens
cagcagaggcaggctg

SEQ ID NO: 6014684 - DNA, 14 bp, Homo sapiens
cagcagaggcagtg

SEQ ID NO: 6014685 - DNA, 19 bp, Homo sapiens
cagcagaggcagtggccac

SEQ ID NO: 6014686 - DNA, 23 bp, Homo sapiens
cagcagagggggagtagccaagc

SEQ ID NO: 6014687 - DNA, 14 bp, Homo sapiens
cagcagaggtgaga

SEQ ID NO: 6014688 - DNA, 20 bp, Homo sapiens
cagcagaggtgagaactcag

SEQ ID NO: 6014689 - DNA, 21 bp, Homo sapiens
cagcagaggtttgctgacagg

SEQ ID NO: 6014690 - DNA, 9 bp, Homo sapiens
cagcagagt

SEQ ID NO: 6014691 - DNA, 23 bp, Homo sapiens
cagcagagtgagcaagggggccc

SEQ ID NO: 6014692 - DNA, 11 bp, Homo sapiens
cagcagagtgc

SEQ ID NO: 6014693 - DNA, 15 bp, Homo sapiens
cagcagagttgtctt

SEQ ID NO: 6014694 - DNA, 15 bp, Homo sapiens
cagcagataaggccg

SEQ ID NO: 6014695 - DNA, 17 bp, Homo sapiens
cagcagatccacctgca

SEQ ID NO: 6014696 - DNA, 16 bp, Homo sapiens
cagcagatcccagctc

SEQ ID NO: 6014697 - DNA, 14 bp, Homo sapiens
cagcagatgctgtt

SEQ ID NO: 6014698 - DNA, 22 bp, Homo sapiens
cagcagatgctgttgtgaagct

SEQ ID NO: 6014699 - DNA, 22 bp, Homo sapiens
cagcagattccacaggacacga

SEQ ID NO: 6014700 - DNA, 17 bp, Homo sapiens
cagcagcaacctgttca

SEQ ID NO: 6014701 - DNA, 14 bp, Homo sapiens
cagcagcaagaaaa

SEQ ID NO: 6014702 - DNA, 18 bp, Homo sapiens
cagcagcaatctgtcttt

SEQ ID NO: 6014703 - DNA, 13 bp, Homo sapiens
cagcagcacaatt

SEQ ID NO: 6014704 - DNA, 21 bp, Homo sapiens
cagcagcacaattctgtccct

SEQ ID NO: 6014705 - DNA, 21 bp, Homo sapiens
cagcagcacacctcagcccca

SEQ ID NO: 6014706 - DNA, 18 bp, Homo sapiens
cagcagcaccaaccacag

SEQ ID NO: 6014707 - DNA, 16 bp, Homo sapiens
cagcagcacccaccca

SEQ ID NO: 6014708 - DNA, 17 bp, Homo sapiens
cagcagcacctttctct

SEQ ID NO: 6014709 - DNA, 22 bp, Homo sapiens
cagcagcactcccgctgcacac

SEQ ID NO: 6014710 - DNA, 16 bp, Homo sapiens
cagcagcactgcagat

SEQ ID NO: 6014711 - DNA, 19 bp, Homo sapiens
cagcagcacttagacctgc

SEQ ID NO: 6014712 - DNA, 16 bp, Homo sapiens
cagcagcagagaacca

SEQ ID NO: 6014713 - DNA, 14 bp, Homo sapiens
cagcagcagcactt

SEQ ID NO: 6014714 - DNA, 14 bp, Homo sapiens
cagcagcagcaggt

SEQ ID NO: 6014715 - DNA, 15 bp, Homo sapiens
cagcagcagcccaag

SEQ ID NO: 6014716 - DNA, 16 bp, Homo sapiens
cagcagcagcctgcac

SEQ ID NO: 6014717 - DNA, 13 bp, Homo sapiens
cagcagcagctca

SEQ ID NO: 6014718 - DNA, 14 bp, Homo sapiens
cagcagcagctcaa

SEQ ID NO: 6014719 - DNA, 23 bp, Homo sapiens
cagcagcaggatgggctgagcta

SEQ ID NO: 6014720 - DNA, 12 bp, Homo sapiens
cagcagcaggtg

SEQ ID NO: 6014721 - DNA, 18 bp, Homo sapiens
cagcagcatcccagcctt

SEQ ID NO: 6014722 - DNA, 13 bp, Homo sapiens
cagcagcattttt

SEQ ID NO: 6014723 - DNA, 16 bp, Homo sapiens
cagcagccactgcaca

SEQ ID NO: 6014724 - DNA, 12 bp, Homo sapiens
cagcagccagca

SEQ ID NO: 6014725 - DNA, 14 bp, Homo sapiens
cagcagccagcacc

SEQ ID NO: 6014726 - DNA, 12 bp, Homo sapiens
cagcagccagcc

SEQ ID NO: 6014727 - DNA, 14 bp, Homo sapiens
cagcagccagccaa

SEQ ID NO: 6014728 - DNA, 21 bp, Homo sapiens
cagcagccagccctgcctgga

SEQ ID NO: 6014729 - DNA, 15 bp, Homo sapiens
cagcagccagctctc

SEQ ID NO: 6014730 - DNA, 18 bp, Homo sapiens
cagcagccagctctcagc

SEQ ID NO: 6014731 - DNA, 21 bp, Homo sapiens
cagcagccagctctcagccaa

SEQ ID NO: 6014732 - DNA, 16 bp, Homo sapiens
cagcagccagggaccc

SEQ ID NO: 6014733 - DNA, 11 bp, Homo sapiens
cagcagccagt

SEQ ID NO: 6014734 - DNA, 20 bp, Homo sapiens
cagcagccagtctcagagac

SEQ ID NO: 6014735 - DNA, 23 bp, Homo sapiens
cagcagccagtctcagagaccag

SEQ ID NO: 6014736 - DNA, 22 bp, Homo sapiens
cagcagccatcataggaaggga

SEQ ID NO: 6014737 - DNA, 19 bp, Homo sapiens
cagcagcccaagcttccct

SEQ ID NO: 6014738 - DNA, 23 bp, Homo sapiens
cagcagcccatggcctctggcca

SEQ ID NO: 6014739 - DNA, 16 bp, Homo sapiens
cagcagccccacacca

SEQ ID NO: 6014740 - DNA, 18 bp, Homo sapiens
cagcagccccacaccagg

SEQ ID NO: 6014741 - DNA, 17 bp, Homo sapiens
cagcagccccaggagaa

SEQ ID NO: 6014742 - DNA, 13 bp, Homo sapiens
cagcagcccccag

SEQ ID NO: 6014743 - DNA, 18 bp, Homo sapiens
cagcagccccccagcact

SEQ ID NO: 6014744 - DNA, 16 bp, Homo sapiens
cagcagccccccttgc

SEQ ID NO: 6014745 - DNA, 23 bp, Homo sapiens
cagcagccccccttgccccacct

SEQ ID NO: 6014746 - DNA, 19 bp, Homo sapiens
cagcagccccgtctgccca

SEQ ID NO: 6014747 - DNA, 22 bp, Homo sapiens
cagcagccccgtctgcccacca

SEQ ID NO: 6014748 - DNA, 16 bp, Homo sapiens
cagcagcccctgagag

SEQ ID NO: 6014749 - DNA, 16 bp, Homo sapiens
cagcagccctaaggat

SEQ ID NO: 6014750 - DNA, 24 bp, Homo sapiens
cagcagccctaaggatctctcagg

SEQ ID NO: 6014751 - DNA, 17 bp, Homo sapiens
cagcagccctcctcacc

SEQ ID NO: 6014752 - DNA, 22 bp, Homo sapiens
cagcagccggaatagagcctcg

SEQ ID NO: 6014753 - DNA, 18 bp, Homo sapiens
cagcagcctcgcacaggc

SEQ ID NO: 6014754 - DNA, 20 bp, Homo sapiens
cagcagcctcgcacaggccc

SEQ ID NO: 6014755 - DNA, 21 bp, Homo sapiens
cagcagcctcgcccctggcag

SEQ ID NO: 6014756 - DNA, 22 bp, Homo sapiens
cagcagcctcgcccctggcaga

SEQ ID NO: 6014757 - DNA, 23 bp, Homo sapiens
cagcagcctctgaagttggacag

SEQ ID NO: 6014758 - DNA, 18 bp, Homo sapiens
cagcagcctgcacctgcc

SEQ ID NO: 6014759 - DNA, 19 bp, Homo sapiens
cagcagcctgcacctgccc

SEQ ID NO: 6014760 - DNA, 20 bp, Homo sapiens
cagcagcctgcacctgcccc

SEQ ID NO: 6014761 - DNA, 21 bp, Homo sapiens
cagcagcctgcacctgccccg

SEQ ID NO: 6014762 - DNA, 14 bp, Homo sapiens
cagcagcctgccag

SEQ ID NO: 6014763 - DNA, 15 bp, Homo sapiens
cagcagcctgccagc

SEQ ID NO: 6014764 - DNA, 20 bp, Homo sapiens
cagcagcctgcgctcggcag

SEQ ID NO: 6014765 - DNA, 15 bp, Homo sapiens
cagcagcctgcttcc

SEQ ID NO: 6014766 - DNA, 14 bp, Homo sapiens
cagcagcctggacc

SEQ ID NO: 6014767 - DNA, 14 bp, Homo sapiens
cagcagcctgtgag

SEQ ID NO: 6014768 - DNA, 16 bp, Homo sapiens
cagcagccttccagtg

SEQ ID NO: 6014769 - DNA, 17 bp, Homo sapiens
cagcagcctttaatgca

SEQ ID NO: 6014770 - DNA, 21 bp, Homo sapiens
cagcagcgaccacccctgcct

SEQ ID NO: 6014771 - DNA, 21 bp, Homo sapiens
cagcagcgagcaaatcctggc

SEQ ID NO: 6014772 - DNA, 19 bp, Homo sapiens
cagcagcgcagccgagccc

SEQ ID NO: 6014773 - DNA, 17 bp, Homo sapiens
cagcagcgcgcaggcct

SEQ ID NO: 6014774 - DNA, 18 bp, Homo sapiens
cagcagcgcgcaggcctg

SEQ ID NO: 6014775 - DNA, 19 bp, Homo sapiens
cagcagcgctcggcccgga

SEQ ID NO: 6014776 - DNA, 17 bp, Homo sapiens
cagcagcggaaccgccc

SEQ ID NO: 6014777 - DNA, 16 bp, Homo sapiens
cagcagcggcccagat

SEQ ID NO: 6014778 - DNA, 16 bp, Homo sapiens
cagcagcggtggcctc

SEQ ID NO: 6014779 - DNA, 19 bp, Homo sapiens
cagcagctagaaagagaaa

SEQ ID NO: 6014780 - DNA, 19 bp, Homo sapiens
cagcagctaggactgagga

SEQ ID NO: 6014781 - DNA, 23 bp, Homo sapiens
cagcagctaggactgaggagtgg

SEQ ID NO: 6014782 - DNA, 14 bp, Homo sapiens
cagcagctcaacct

SEQ ID NO: 6014783 - DNA, 13 bp, Homo sapiens
cagcagctcagcc

SEQ ID NO: 6014784 - DNA, 11 bp, Homo sapiens
cagcagctcat

SEQ ID NO: 6014785 - DNA, 17 bp, Homo sapiens
cagcagctccaacctgg

SEQ ID NO: 6014786 - DNA, 20 bp, Homo sapiens
cagcagctccgcctggcacc

SEQ ID NO: 6014787 - DNA, 11 bp, Homo sapiens
cagcagctctg

SEQ ID NO: 6014788 - DNA, 16 bp, Homo sapiens
cagcagctctgagaca

SEQ ID NO: 6014789 - DNA, 15 bp, Homo sapiens
cagcagctctgagcc

SEQ ID NO: 6014790 - DNA, 18 bp, Homo sapiens
cagcagctctgagccaga

SEQ ID NO: 6014791 - DNA, 20 bp, Homo sapiens
cagcagctctgagccagatt

SEQ ID NO: 6014792 - DNA, 13 bp, Homo sapiens
cagcagctctggc

SEQ ID NO: 6014793 - DNA, 19 bp, Homo sapiens
cagcagctctggctctgcc

SEQ ID NO: 6014794 - DNA, 18 bp, Homo sapiens
cagcagctgaacagccaa

SEQ ID NO: 6014795 - DNA, 12 bp, Homo sapiens
cagcagctgcag

SEQ ID NO: 6014796 - DNA, 13 bp, Homo sapiens
cagcagctgcagg

SEQ ID NO: 6014797 - DNA, 15 bp, Homo sapiens
cagcagctgcctctg

SEQ ID NO: 6014798 - DNA, 11 bp, Homo sapiens
cagcagctgcg

SEQ ID NO: 6014799 - DNA, 13 bp, Homo sapiens
cagcagctggact

SEQ ID NO: 6014800 - DNA, 14 bp, Homo sapiens
cagcagctgggacc

SEQ ID NO: 6014801 - DNA, 19 bp, Homo sapiens
cagcagctgggacccctcc

SEQ ID NO: 6014802 - DNA, 22 bp, Homo sapiens
cagcagctgggacccctcccaa

SEQ ID NO: 6014803 - DNA, 20 bp, Homo sapiens
cagcagctgggccggccagc

SEQ ID NO: 6014804 - DNA, 21 bp, Homo sapiens
cagcagctgggccggccagcc

SEQ ID NO: 6014805 - DNA, 21 bp, Homo sapiens
cagcagctggtgccccacctg

SEQ ID NO: 6014806 - DNA, 22 bp, Homo sapiens
cagcagctggtgccccacctgc

SEQ ID NO: 6014807 - DNA, 14 bp, Homo sapiens
cagcagcttctcca

SEQ ID NO: 6014808 - DNA, 15 bp, Homo sapiens
cagcagcttgctgca

SEQ ID NO: 6014809 - DNA, 13 bp, Homo sapiens
cagcagcttggct

SEQ ID NO: 6014810 - DNA, 14 bp, Homo sapiens
cagcagcttggctg

SEQ ID NO: 6014811 - DNA, 17 bp, Homo sapiens
cagcagcttttaataca

SEQ ID NO: 6014812 - DNA, 22 bp, Homo sapiens
cagcaggaacctgtactgggtt

SEQ ID NO: 6014813 - DNA, 14 bp, Homo sapiens
cagcaggaagccag

SEQ ID NO: 6014814 - DNA, 15 bp, Homo sapiens
cagcaggaagccagg

SEQ ID NO: 6014815 - DNA, 12 bp, Homo sapiens
cagcaggaaggc

SEQ ID NO: 6014816 - DNA, 13 bp, Homo sapiens
cagcaggaagggt

SEQ ID NO: 6014817 - DNA, 21 bp, Homo sapiens
cagcaggagaagttaagaatt

SEQ ID NO: 6014818 - DNA, 11 bp, Homo sapiens
cagcaggagag

SEQ ID NO: 6014819 - DNA, 19 bp, Homo sapiens
cagcaggagagactgagca

SEQ ID NO: 6014820 - DNA, 15 bp, Homo sapiens
cagcaggaggcaagc

SEQ ID NO: 6014821 - DNA, 17 bp, Homo sapiens
cagcaggaggcacagca

SEQ ID NO: 6014822 - DNA, 18 bp, Homo sapiens
cagcaggaggccaggccg

SEQ ID NO: 6014823 - DNA, 17 bp, Homo sapiens
cagcaggaggctagcaa

SEQ ID NO: 6014824 - DNA, 19 bp, Homo sapiens
cagcaggaggctttctggg

SEQ ID NO: 6014825 - DNA, 23 bp, Homo sapiens
cagcaggaggctttctgggctct

SEQ ID NO: 6014826 - DNA, 11 bp, Homo sapiens
cagcaggaggg

SEQ ID NO: 6014827 - DNA, 19 bp, Homo sapiens
cagcaggagggacagtctc

SEQ ID NO: 6014828 - DNA, 22 bp, Homo sapiens
cagcaggagggacagtctcacc

SEQ ID NO: 6014829 - DNA, 20 bp, Homo sapiens
cagcaggagggactctgtct

SEQ ID NO: 6014830 - DNA, 15 bp, Homo sapiens
cagcaggagggggga

SEQ ID NO: 6014831 - DNA, 17 bp, Homo sapiens
cagcaggatagagtggg

SEQ ID NO: 6014832 - DNA, 15 bp, Homo sapiens
cagcaggatgccctg

SEQ ID NO: 6014833 - DNA, 19 bp, Homo sapiens
cagcaggatgctaatggaa

SEQ ID NO: 6014834 - DNA, 21 bp, Homo sapiens
cagcaggcactgaagctgcgg

SEQ ID NO: 6014835 - DNA, 11 bp, Homo sapiens
cagcaggcaga

SEQ ID NO: 6014836 - DNA, 12 bp, Homo sapiens
cagcaggcagag

SEQ ID NO: 6014837 - DNA, 15 bp, Homo sapiens
cagcaggcagaggag

SEQ ID NO: 6014838 - DNA, 20 bp, Homo sapiens
cagcaggcaggcactgtggc

SEQ ID NO: 6014839 - DNA, 16 bp, Homo sapiens
cagcaggcatggcttc

SEQ ID NO: 6014840 - DNA, 23 bp, Homo sapiens
cagcaggcatttgctaaggcagc

SEQ ID NO: 6014841 - DNA, 15 bp, Homo sapiens
cagcaggccaaacat

SEQ ID NO: 6014842 - DNA, 14 bp, Homo sapiens
cagcaggccagaga

SEQ ID NO: 6014843 - DNA, 15 bp, Homo sapiens
cagcaggccagagaa

SEQ ID NO: 6014844 - DNA, 18 bp, Homo sapiens
cagcaggcccacctacct

SEQ ID NO: 6014845 - DNA, 15 bp, Homo sapiens
cagcaggcccagcat

SEQ ID NO: 6014846 - DNA, 16 bp, Homo sapiens
cagcaggcccagcatg

SEQ ID NO: 6014847 - DNA, 16 bp, Homo sapiens
cagcaggcctctggga

SEQ ID NO: 6014848 - DNA, 18 bp, Homo sapiens
cagcaggcctctgggacc

SEQ ID NO: 6014849 - DNA, 19 bp, Homo sapiens
cagcaggcgggctcctttg

SEQ ID NO: 6014850 - DNA, 16 bp, Homo sapiens
cagcaggctagacaga

SEQ ID NO: 6014851 - DNA, 14 bp, Homo sapiens
cagcaggctcaggc

SEQ ID NO: 6014852 - DNA, 15 bp, Homo sapiens
cagcaggctcaggca

SEQ ID NO: 6014853 - DNA, 14 bp, Homo sapiens
cagcaggctcctca

SEQ ID NO: 6014854 - DNA, 15 bp, Homo sapiens
cagcaggctcctcag

SEQ ID NO: 6014855 - DNA, 16 bp, Homo sapiens
cagcaggctcctcagc

SEQ ID NO: 6014856 - DNA, 21 bp, Homo sapiens
cagcaggctcctggctgtgcc

SEQ ID NO: 6014857 - DNA, 22 bp, Homo sapiens
cagcaggctcctggctgtgccc

SEQ ID NO: 6014858 - DNA, 12 bp, Homo sapiens
cagcaggctctc

SEQ ID NO: 6014859 - DNA, 16 bp, Homo sapiens
cagcaggctctcaggc

SEQ ID NO: 6014860 - DNA, 16 bp, Homo sapiens
cagttccacaattttg

SEQ ID NO: 6014861 - DNA, 20 bp, Homo sapiens
cagttccacaattttgtctc

SEQ ID NO: 6014862 - DNA, 22 bp, Homo sapiens
cagttccacaattttgtctcta

SEQ ID NO: 6014863 - DNA, 15 bp, Homo sapiens
cagttccacagcagt

SEQ ID NO: 6014864 - DNA, 14 bp, Homo sapiens
cagttccagctttt

SEQ ID NO: 6014865 - DNA, 16 bp, Homo sapiens
cagttccattcaactg

SEQ ID NO: 6014866 - DNA, 20 bp, Homo sapiens
cagttccattcaactggaac

SEQ ID NO: 6014867 - DNA, 22 bp, Homo sapiens
cagttccatttatgctggttaa

SEQ ID NO: 6014868 - DNA, 15 bp, Homo sapiens
cagttcccagaatca

SEQ ID NO: 6014869 - DNA, 16 bp, Homo sapiens
cagttcccagaatcaa

SEQ ID NO: 6014870 - DNA, 17 bp, Homo sapiens
cagttcccagctccccc

SEQ ID NO: 6014871 - DNA, 18 bp, Homo sapiens
cagttcccagctcccccc

SEQ ID NO: 6014872 - DNA, 17 bp, Homo sapiens
cagttcccccaacctca

SEQ ID NO: 6014873 - DNA, 15 bp, Homo sapiens
cagttcccccagtac

SEQ ID NO: 6014874 - DNA, 17 bp, Homo sapiens
cagttcccctggaagca

SEQ ID NO: 6014875 - DNA, 17 bp, Homo sapiens
cagttcccggagcacag

SEQ ID NO: 6014876 - DNA, 19 bp, Homo sapiens
cagttcccgtgacgaggct

SEQ ID NO: 6014877 - DNA, 18 bp, Homo sapiens
cagttccctcagccctca

SEQ ID NO: 6014878 - DNA, 20 bp, Homo sapiens
cagttccctggacagagcta

SEQ ID NO: 6014879 - DNA, 18 bp, Homo sapiens
cagttcccttggcctcag

SEQ ID NO: 6014880 - DNA, 21 bp, Homo sapiens
cagttccctttgcttgtcttc

SEQ ID NO: 6014881 - DNA, 18 bp, Homo sapiens
cagttccgatttcccagg

SEQ ID NO: 6014882 - DNA, 17 bp, Homo sapiens
cagttcctcaccatcat

SEQ ID NO: 6014883 - DNA, 15 bp, Homo sapiens
cagttcctctttgca

SEQ ID NO: 6014884 - DNA, 21 bp, Homo sapiens
cagttcctgcagcagagcctg

SEQ ID NO: 6014885 - DNA, 12 bp, Homo sapiens
cagttcctggca

SEQ ID NO: 6014886 - DNA, 14 bp, Homo sapiens
cagttcctgtccca

SEQ ID NO: 6014887 - DNA, 12 bp, Homo sapiens
cagttccttgca

SEQ ID NO: 6014888 - DNA, 21 bp, Homo sapiens
cagttcctttgatctcgctgt

SEQ ID NO: 6014889 - DNA, 22 bp, Homo sapiens
cagttcgaccaaactcagttca

SEQ ID NO: 6014890 - DNA, 18 bp, Homo sapiens
cagttcgcagccaccctg

SEQ ID NO: 6014891 - DNA, 22 bp, Homo sapiens
cagttcgggaacccccttcccc

SEQ ID NO: 6014892 - DNA, 14 bp, Homo sapiens
cagttcgtgtttga

SEQ ID NO: 6014893 - DNA, 24 bp, Homo sapiens
cagttcgtgtttgattccattcca

SEQ ID NO: 6014894 - DNA, 22 bp, Homo sapiens
cagttcgttggtagagccctca

SEQ ID NO: 6014895 - DNA, 23 bp, Homo sapiens
cagttcgttggtagagccctcag

SEQ ID NO: 6014896 - DNA, 15 bp, Homo sapiens
cagttctaacctcct

SEQ ID NO: 6014897 - DNA, 20 bp, Homo sapiens
cagttctacaagcatatttg

SEQ ID NO: 6014898 - DNA, 17 bp, Homo sapiens
cagttctactcaggctg

SEQ ID NO: 6014899 - DNA, 18 bp, Homo sapiens
cagttctagtttgcattc

SEQ ID NO: 6014900 - DNA, 15 bp, Homo sapiens
cagttctatttgcta

SEQ ID NO: 6014901 - DNA, 14 bp, Homo sapiens
cagttctcactcct

SEQ ID NO: 6014902 - DNA, 15 bp, Homo sapiens
cagttctcccaggga

SEQ ID NO: 6014903 - DNA, 17 bp, Homo sapiens
cagttctcccagggagt

SEQ ID NO: 6014904 - DNA, 19 bp, Homo sapiens
cagttctccgtaacagtgt

SEQ ID NO: 6014905 - DNA, 21 bp, Homo sapiens
cagttctctactccctcttgt

SEQ ID NO: 6014906 - DNA, 17 bp, Homo sapiens
cagttctctcccttcct

SEQ ID NO: 6014907 - DNA, 17 bp, Homo sapiens
cagttctctgccaaagc

SEQ ID NO: 6014908 - DNA, 12 bp, Homo sapiens
cagttctctggg

SEQ ID NO: 6014909 - DNA, 18 bp, Homo sapiens
cagttctctgtggaagca

SEQ ID NO: 6014910 - DNA, 14 bp, Homo sapiens
cagttctgaaagct

SEQ ID NO: 6014911 - DNA, 15 bp, Homo sapiens
cagttctgaataact

SEQ ID NO: 6014912 - DNA, 20 bp, Homo sapiens
cagttctgaataacttgaag

SEQ ID NO: 6014913 - DNA, 15 bp, Homo sapiens
cagttctgatgctta

SEQ ID NO: 6014914 - DNA, 18 bp, Homo sapiens
cagttctgcaaatagaaa

SEQ ID NO: 6014915 - DNA, 13 bp, Homo sapiens
cagttctgctcct

SEQ ID NO: 6014916 - DNA, 14 bp, Homo sapiens
cagttctgctcctc

SEQ ID NO: 6014917 - DNA, 18 bp, Homo sapiens
cagttctgctcctctcca

SEQ ID NO: 6014918 - DNA, 21 bp, Homo sapiens
cagttctgctcctctccaggc

SEQ ID NO: 6014919 - DNA, 22 bp, Homo sapiens
cagttctggatggtgtgccttc

SEQ ID NO: 6014920 - DNA, 13 bp, Homo sapiens
cagttctggggcc

SEQ ID NO: 6014921 - DNA, 20 bp, Homo sapiens
cagttctgtggtttcatgtt

SEQ ID NO: 6014922 - DNA, 15 bp, Homo sapiens
cagttctgtgtacat

SEQ ID NO: 6014923 - DNA, 14 bp, Homo sapiens
cagttctgtgtcct

SEQ ID NO: 6014924 - DNA, 17 bp, Homo sapiens
cagttctgtgtcctcgc

SEQ ID NO: 6014925 - DNA, 21 bp, Homo sapiens
cagttctgtgtggtgcattcc

SEQ ID NO: 6014926 - DNA, 23 bp, Homo sapiens
cagttctgtgtggtgcattcctg

SEQ ID NO: 6014927 - DNA, 17 bp, Homo sapiens
cagttcttaagacttct

SEQ ID NO: 6014928 - DNA, 20 bp, Homo sapiens
cagttcttcatttggaggaa

SEQ ID NO: 6014929 - DNA, 21 bp, Homo sapiens
cagttcttcccccttcacata

SEQ ID NO: 6014930 - DNA, 13 bp, Homo sapiens
cagttcttcctgc

SEQ ID NO: 6014931 - DNA, 15 bp, Homo sapiens
cagttcttcctgcaa

SEQ ID NO: 6014932 - DNA, 17 bp, Homo sapiens
cagttcttcgggaagag

SEQ ID NO: 6014933 - DNA, 14 bp, Homo sapiens
cagttcttgcaata

SEQ ID NO: 6014934 - DNA, 12 bp, Homo sapiens
cagttcttggac

SEQ ID NO: 6014935 - DNA, 19 bp, Homo sapiens
cagttcttggcctgctagc

SEQ ID NO: 6014936 - DNA, 16 bp, Homo sapiens
cagttcttggtgactg

SEQ ID NO: 6014937 - DNA, 21 bp, Homo sapiens
cagttcttggtgctctgtgtt

SEQ ID NO: 6014938 - DNA, 15 bp, Homo sapiens
cagttcttgtgtggt

SEQ ID NO: 6014939 - DNA, 16 bp, Homo sapiens
cagttcttgtgtggtt

SEQ ID NO: 6014940 - DNA, 21 bp, Homo sapiens
cagttctttaagaagatcttt

SEQ ID NO: 6014941 - DNA, 12 bp, Homo sapiens
cagttctttact

SEQ ID NO: 6014942 - DNA, 14 bp, Homo sapiens
cagttctttcctct

SEQ ID NO: 6014943 - DNA, 17 bp, Homo sapiens
cagttctttcctctttc

SEQ ID NO: 6014944 - DNA, 22 bp, Homo sapiens
cagttctttgggccagacatgc

SEQ ID NO: 6014945 - DNA, 18 bp, Homo sapiens
cagttgaaaaacagctga

SEQ ID NO: 6014946 - DNA, 18 bp, Homo sapiens
cagttgaaaacttgtaat

SEQ ID NO: 6014947 - DNA, 18 bp, Homo sapiens
cagttgaaaagactccaa

SEQ ID NO: 6014948 - DNA, 22 bp, Homo sapiens
cagttgaacactagtctgtgta

SEQ ID NO: 6014949 - DNA, 17 bp, Homo sapiens
cagttgaacagaactgc

SEQ ID NO: 6014950 - DNA, 14 bp, Homo sapiens
cagttgaacagact

SEQ ID NO: 6014951 - DNA, 14 bp, Homo sapiens
cagttgaacagagg

SEQ ID NO: 6014952 - DNA, 15 bp, Homo sapiens
cagttgaactgcagg

SEQ ID NO: 6014953 - DNA, 20 bp, Homo sapiens
cagttgaagaaaaaatggca

SEQ ID NO: 6014954 - DNA, 22 bp, Homo sapiens
cagttgaagaaaaaatggcaag

SEQ ID NO: 6014955 - DNA, 23 bp, Homo sapiens
cagttgaagaagagaaaatttga

SEQ ID NO: 6014956 - DNA, 21 bp, Homo sapiens
cagttgaatttatggaatcta

SEQ ID NO: 6014957 - DNA, 15 bp, Homo sapiens
cagttgaccctattt

SEQ ID NO: 6014958 - DNA, 15 bp, Homo sapiens
cagttgactggcttt

SEQ ID NO: 6014959 - DNA, 19 bp, Homo sapiens
cagttgactggctttcctc

SEQ ID NO: 6014960 - DNA, 14 bp, Homo sapiens
cagttgactttctc

SEQ ID NO: 6014961 - DNA, 15 bp, Homo sapiens
cagttgactttctcc

SEQ ID NO: 6014962 - DNA, 19 bp, Homo sapiens
cagttgagaggacactccc

SEQ ID NO: 6014963 - DNA, 15 bp, Homo sapiens
cagttgagctcaggt

SEQ ID NO: 6014964 - DNA, 15 bp, Homo sapiens
cagttgagtgaaatt

SEQ ID NO: 6014965 - DNA, 22 bp, Homo sapiens
cagttgagtttcttctaaagag

SEQ ID NO: 6014966 - DNA, 21 bp, Homo sapiens
cagttgatataaaactctggg

SEQ ID NO: 6014967 - DNA, 20 bp, Homo sapiens
cagttgatatttaaaagatc

SEQ ID NO: 6014968 - DNA, 16 bp, Homo sapiens
cagttgatctgctctg

SEQ ID NO: 6014969 - DNA, 15 bp, Homo sapiens
cagttgatggagccc

SEQ ID NO: 6014970 - DNA, 17 bp, Homo sapiens
cagttgatggagcccca

SEQ ID NO: 6014971 - DNA, 19 bp, Homo sapiens
cagttgatggagccccagg

SEQ ID NO: 6014972 - DNA, 23 bp, Homo sapiens
cagttgatggagccccagggttt

SEQ ID NO: 6014973 - DNA, 16 bp, Homo sapiens
cagttgatgtgtcttt

SEQ ID NO: 6014974 - DNA, 17 bp, Homo sapiens
cagttgatgtgtctttt

SEQ ID NO: 6014975 - DNA, 18 bp, Homo sapiens
cagttgattaagttaata

SEQ ID NO: 6014976 - DNA, 22 bp, Homo sapiens
cagttgattagcagttgaggcc

SEQ ID NO: 6014977 - DNA, 23 bp, Homo sapiens
cagttgattatttcaactaatgt

SEQ ID NO: 6014978 - DNA, 13 bp, Homo sapiens
cagttgatttttc

SEQ ID NO: 6014979 - DNA, 13 bp, Homo sapiens
cagttgcaataaa

SEQ ID NO: 6014980 - DNA, 17 bp, Homo sapiens
cagttgcaataaaatag

SEQ ID NO: 6014981 - DNA, 22 bp, Homo sapiens
cagttgcaataaaatagtattg

SEQ ID NO: 6014982 - DNA, 18 bp, Homo sapiens
cagttgcaatgatcagac

SEQ ID NO: 6014983 - DNA, 15 bp, Homo sapiens
cagttgcagaaaatg

SEQ ID NO: 6014984 - DNA, 16 bp, Homo sapiens
cagttgcagaaaatga

SEQ ID NO: 6014985 - DNA, 18 bp, Homo sapiens
cagttgcagaaaatgaac

SEQ ID NO: 6014986 - DNA, 11 bp, Homo sapiens
cagttgcagcc

SEQ ID NO: 6014987 - DNA, 20 bp, Homo sapiens
cagttgcagcccttgtgatg

SEQ ID NO: 6014988 - DNA, 14 bp, Homo sapiens
cagttgcaggagcg

SEQ ID NO: 6014989 - DNA, 14 bp, Homo sapiens
cagttgcagtcact

SEQ ID NO: 6014990 - DNA, 16 bp, Homo sapiens
cagttgcatgtagtaa

SEQ ID NO: 6014991 - DNA, 19 bp, Homo sapiens
cagttgcatgtagtaacac

SEQ ID NO: 6014992 - DNA, 23 bp, Homo sapiens
cagttgcatgtagtaacactaat

SEQ ID NO: 6014993 - DNA, 12 bp, Homo sapiens
cagttgccacat

SEQ ID NO: 6014994 - DNA, 12 bp, Homo sapiens
cagttgccacca

SEQ ID NO: 6014995 - DNA, 15 bp, Homo sapiens
cagttgccaccacct

SEQ ID NO: 6014996 - DNA, 18 bp, Homo sapiens
cagttgccaccacctctg

SEQ ID NO: 6014997 - DNA, 22 bp, Homo sapiens
cagttgccaccacctctgtggc

SEQ ID NO: 6014998 - DNA, 14 bp, Homo sapiens
cagttgcccagagc

SEQ ID NO: 6014999 - DNA, 18 bp, Homo sapiens
cagttgcccagatgaact

SEQ ID NO: 6015000 - DNA, 18 bp, Homo sapiens
cagttgcccagcctcttt

SEQ ID NO: 6015001 - DNA, 21 bp, Homo sapiens
cagttgcccagcctctttccc

SEQ ID NO: 6015002 - DNA, 12 bp, Homo sapiens
cagttgccctag

SEQ ID NO: 6015003 - DNA, 19 bp, Homo sapiens
cagttgccgtctaggattg

SEQ ID NO: 6015004 - DNA, 17 bp, Homo sapiens
cagttgcgcgttctgaa

SEQ ID NO: 6015005 - DNA, 21 bp, Homo sapiens
cagttgctaaacactgcgctt

SEQ ID NO: 6015006 - DNA, 11 bp, Homo sapiens
cagttgctcat

SEQ ID NO: 6015007 - DNA, 22 bp, Homo sapiens
cagttgctcattgtagagcaca

SEQ ID NO: 6015008 - DNA, 17 bp, Homo sapiens
cagttgctggtaaaatg

SEQ ID NO: 6015009 - DNA, 12 bp, Homo sapiens
cagttgctgtga

SEQ ID NO: 6015010 - DNA, 14 bp, Homo sapiens
cagttgctgtggac

SEQ ID NO: 6015011 - DNA, 18 bp, Homo sapiens
cagttggaaatccatcca

SEQ ID NO: 6015012 - DNA, 20 bp, Homo sapiens
cagttggactttttaaaaat

SEQ ID NO: 6015013 - DNA, 18 bp, Homo sapiens
cagttggagaaaatgaag

SEQ ID NO: 6015014 - DNA, 17 bp, Homo sapiens
cagttggagctccagcc

SEQ ID NO: 6015015 - DNA, 19 bp, Homo sapiens
cagttggaggagactgggc

SEQ ID NO: 6015016 - DNA, 22 bp, Homo sapiens
cagttggagtttgtgtctgttg

SEQ ID NO: 6015017 - DNA, 17 bp, Homo sapiens
cagttggatctctggtt

SEQ ID NO: 6015018 - DNA, 17 bp, Homo sapiens
cagttggcactgtaagg

SEQ ID NO: 6015019 - DNA, 18 bp, Homo sapiens
cagttggcactgtaaggt

SEQ ID NO: 6015020 - DNA, 18 bp, Homo sapiens
cagttggcacttctgcca

SEQ ID NO: 6015021 - DNA, 14 bp, Homo sapiens
cagttggcagacag

SEQ ID NO: 6015022 - DNA, 13 bp, Homo sapiens
cagttggcagaga

SEQ ID NO: 6015023 - DNA, 21 bp, Homo sapiens
cagttggcagagaaggcctct

SEQ ID NO: 6015024 - DNA, 22 bp, Homo sapiens
cagttggcagagaaggcctctt

SEQ ID NO: 6015025 - DNA, 15 bp, Homo sapiens
cagttggcctcagca

SEQ ID NO: 6015026 - DNA, 17 bp, Homo sapiens
cagttggcctcagcaga

SEQ ID NO: 6015027 - DNA, 18 bp, Homo sapiens
cagttggcctcagcagaa

SEQ ID NO: 6015028 - DNA, 15 bp, Homo sapiens
cagttggcctgtgct

SEQ ID NO: 6015029 - DNA, 22 bp, Homo sapiens
cagttggcctgtgcttggaggc

SEQ ID NO: 6015030 - DNA, 16 bp, Homo sapiens
cagttggccttcagaa

SEQ ID NO: 6015031 - DNA, 14 bp, Homo sapiens
cagttggctacgtt

SEQ ID NO: 6015032 - DNA, 20 bp, Homo sapiens
cagttggcttctgtgcctga

SEQ ID NO: 6015033 - DNA, 18 bp, Homo sapiens
cagttgggaagtctcagc

SEQ ID NO: 6015034 - DNA, 21 bp, Homo sapiens
cagttgggagcactggagtgc

SEQ ID NO: 6015035 - DNA, 12 bp, Homo sapiens
cagttgggcccc

SEQ ID NO: 6015036 - DNA, 13 bp, Homo sapiens
cagttggggccct

SEQ ID NO: 6015037 - DNA, 20 bp, Homo sapiens
cagttggggccctcttgcca

SEQ ID NO: 6015038 - DNA, 23 bp, Homo sapiens
cagttggggccctcttgccagcc

SEQ ID NO: 6015039 - DNA, 22 bp, Homo sapiens
cagcaggctctcaggccagctg

SEQ ID NO: 6015040 - DNA, 14 bp, Homo sapiens
cagcaggctgccag

SEQ ID NO: 6015041 - DNA, 15 bp, Homo sapiens
cagcaggctgccagt

SEQ ID NO: 6015042 - DNA, 22 bp, Homo sapiens
cagcagggaaaatgcagcaggg

SEQ ID NO: 6015043 - DNA, 19 bp, Homo sapiens
cagcagggaacaaaactcc

SEQ ID NO: 6015044 - DNA, 17 bp, Homo sapiens
cagcagggaagctcttt

SEQ ID NO: 6015045 - DNA, 17 bp, Homo sapiens
cagcagggaaggcccaa

SEQ ID NO: 6015046 - DNA, 17 bp, Homo sapiens
cagcagggaagggatga

SEQ ID NO: 6015047 - DNA, 21 bp, Homo sapiens
cagcagggaccgggcgcagcc

SEQ ID NO: 6015048 - DNA, 22 bp, Homo sapiens
cagcagggactgtaaacacaga

SEQ ID NO: 6015049 - DNA, 17 bp, Homo sapiens
cagcagggcctcaaagt

SEQ ID NO: 6015050 - DNA, 20 bp, Homo sapiens
cagcagggccttctgcctgc

SEQ ID NO: 6015051 - DNA, 18 bp, Homo sapiens
cagcagggcgggccagga

SEQ ID NO: 6015052 - DNA, 20 bp, Homo sapiens
cagcagggcgggccaggaga

SEQ ID NO: 6015053 - DNA, 11 bp, Homo sapiens
cagcagggcta

SEQ ID NO: 6015054 - DNA, 18 bp, Homo sapiens
cagcagggctgctgtgaa

SEQ ID NO: 6015055 - DNA, 20 bp, Homo sapiens
cagcagggctggtcacctcc

SEQ ID NO: 6015056 - DNA, 14 bp, Homo sapiens
cagcaggggaaaga

SEQ ID NO: 6015057 - DNA, 15 bp, Homo sapiens
cagcaggggaaagat

SEQ ID NO: 6015058 - DNA, 22 bp, Homo sapiens
cagcaggggaaagattatattt

SEQ ID NO: 6015059 - DNA, 16 bp, Homo sapiens
cagcaggggagccctg

SEQ ID NO: 6015060 - DNA, 18 bp, Homo sapiens
cagcaggggccaagcagg

SEQ ID NO: 6015061 - DNA, 20 bp, Homo sapiens
cagcaggggccaagcaggca

SEQ ID NO: 6015062 - DNA, 17 bp, Homo sapiens
cagcaggggggctgtgc

SEQ ID NO: 6015063 - DNA, 19 bp, Homo sapiens
cagcaggggggctgtgcca

SEQ ID NO: 6015064 - DNA, 15 bp, Homo sapiens
cagcaggggggttgg

SEQ ID NO: 6015065 - DNA, 16 bp, Homo sapiens
cagcaggggggttggg

SEQ ID NO: 6015066 - DNA, 23 bp, Homo sapiens
cagcaggggtgggaggctcccag

SEQ ID NO: 6015067 - DNA, 17 bp, Homo sapiens
cagcagggtagagagga

SEQ ID NO: 6015068 - DNA, 17 bp, Homo sapiens
cagcagggtcttgctgt

SEQ ID NO: 6015069 - DNA, 21 bp, Homo sapiens
cagcagggtcttttcatctgg

SEQ ID NO: 6015070 - DNA, 19 bp, Homo sapiens
cagcagggtttgagcacaa

SEQ ID NO: 6015071 - DNA, 17 bp, Homo sapiens
cagcaggtcacactggg

SEQ ID NO: 6015072 - DNA, 23 bp, Homo sapiens
cagcaggtgattggaccaggcca

SEQ ID NO: 6015073 - DNA, 16 bp, Homo sapiens
cagcaggtgcaagaga

SEQ ID NO: 6015074 - DNA, 20 bp, Homo sapiens
cagcaggtgcaagagacaga

SEQ ID NO: 6015075 - DNA, 22 bp, Homo sapiens
cagcaggtgcaagagacagagc

SEQ ID NO: 6015076 - DNA, 20 bp, Homo sapiens
cagcaggtgtgaccctgagg

SEQ ID NO: 6015077 - DNA, 16 bp, Homo sapiens
cagcaggtgtggtggc

SEQ ID NO: 6015078 - DNA, 21 bp, Homo sapiens
cagcaggtgtggtggctcatg

SEQ ID NO: 6015079 - DNA, 23 bp, Homo sapiens
cagcaggtgtggtggctcatggc

SEQ ID NO: 6015080 - DNA, 18 bp, Homo sapiens
cagcaggttctctcctgt

SEQ ID NO: 6015081 - DNA, 21 bp, Homo sapiens
cagcaggttctctcctgtgag

SEQ ID NO: 6015082 - DNA, 24 bp, Homo sapiens
cagcaggttgtgtgtgtgtgcagt

SEQ ID NO: 6015083 - DNA, 16 bp, Homo sapiens
cagcagtaccatccca

SEQ ID NO: 6015084 - DNA, 21 bp, Homo sapiens
cagcagtacgtggcttcagag

SEQ ID NO: 6015085 - DNA, 16 bp, Homo sapiens
cagcagtacttgctca

SEQ ID NO: 6015086 - DNA, 18 bp, Homo sapiens
cagcagtacttgctcaat

SEQ ID NO: 6015087 - DNA, 21 bp, Homo sapiens
cagcagtacttgctcaataaa

SEQ ID NO: 6015088 - DNA, 22 bp, Homo sapiens
cagcagtacttgctcaataaag

SEQ ID NO: 6015089 - DNA, 13 bp, Homo sapiens
cagcagtagacat

SEQ ID NO: 6015090 - DNA, 17 bp, Homo sapiens
cagcagtatgaatgatg

SEQ ID NO: 6015091 - DNA, 18 bp, Homo sapiens
cagcagtcacaggcccag

SEQ ID NO: 6015092 - DNA, 15 bp, Homo sapiens
cagcagtcacaggtc

SEQ ID NO: 6015093 - DNA, 22 bp, Homo sapiens
cagcagtcgcccaagcagacag

SEQ ID NO: 6015094 - DNA, 23 bp, Homo sapiens
cagcagtctaaattttctaaata

SEQ ID NO: 6015095 - DNA, 19 bp, Homo sapiens
cagcagtctccgctcccgc

SEQ ID NO: 6015096 - DNA, 13 bp, Homo sapiens
cagcagtctctgc

SEQ ID NO: 6015097 - DNA, 17 bp, Homo sapiens
cagcagtgaaaacaagt

SEQ ID NO: 6015098 - DNA, 11 bp, Homo sapiens
cagcagtgaag

SEQ ID NO: 6015099 - DNA, 14 bp, Homo sapiens
cagcagtgaccaca

SEQ ID NO: 6015100 - DNA, 19 bp, Homo sapiens
cagcagtgagagttcctct

SEQ ID NO: 6015101 - DNA, 19 bp, Homo sapiens
cagcagtgatctcagggca

SEQ ID NO: 6015102 - DNA, 20 bp, Homo sapiens
cagcagtgatctcagggcag

SEQ ID NO: 6015103 - DNA, 18 bp, Homo sapiens
cagcagtgctgggcccag

SEQ ID NO: 6015104 - DNA, 19 bp, Homo sapiens
cagcagtgctgggcccagc

SEQ ID NO: 6015105 - DNA, 20 bp, Homo sapiens
cagcagtgctgggcccagcc

SEQ ID NO: 6015106 - DNA, 21 bp, Homo sapiens
cagcagtgctgggcccagccg

SEQ ID NO: 6015107 - DNA, 16 bp, Homo sapiens
cagcagtggcaggacc

SEQ ID NO: 6015108 - DNA, 19 bp, Homo sapiens
cagcagtgtccagagaccc

SEQ ID NO: 6015109 - DNA, 14 bp, Homo sapiens
cagcagtgtcccct

SEQ ID NO: 6015110 - DNA, 15 bp, Homo sapiens
cagcagtgtcccctg

SEQ ID NO: 6015111 - DNA, 18 bp, Homo sapiens
cagcagtgtcccctgccc

SEQ ID NO: 6015112 - DNA, 20 bp, Homo sapiens
cagcagtgtgaatagcctgg

SEQ ID NO: 6015113 - DNA, 22 bp, Homo sapiens
cagcagtgtgaatagcctggcc

SEQ ID NO: 6015114 - DNA, 12 bp, Homo sapiens
cagcagtgttcc

SEQ ID NO: 6015115 - DNA, 19 bp, Homo sapiens
cagcagtgttctcacagtg

SEQ ID NO: 6015116 - DNA, 21 bp, Homo sapiens
cagcagtgttctcacagtgtg

SEQ ID NO: 6015117 - DNA, 18 bp, Homo sapiens
cagcagtgttctgggtga

SEQ ID NO: 6015118 - DNA, 18 bp, Homo sapiens
cagcagtgttgctcagct

SEQ ID NO: 6015119 - DNA, 23 bp, Homo sapiens
cagcagttcacaaaaaaatgttc

SEQ ID NO: 6015120 - DNA, 18 bp, Homo sapiens
cagcagttcagagctgcc

SEQ ID NO: 6015121 - DNA, 21 bp, Homo sapiens
cagcagttcagagctgccctc

SEQ ID NO: 6015122 - DNA, 23 bp, Homo sapiens
cagcagttccggattggcttgtg

SEQ ID NO: 6015123 - DNA, 15 bp, Homo sapiens
cagcagttctctgcc

SEQ ID NO: 6015124 - DNA, 16 bp, Homo sapiens
cagcagttctctgcca

SEQ ID NO: 6015125 - DNA, 13 bp, Homo sapiens
cagcagttctgtt

SEQ ID NO: 6015126 - DNA, 17 bp, Homo sapiens
cagcagttgaaaagact

SEQ ID NO: 6015127 - DNA, 22 bp, Homo sapiens
cagcagttgaaaagactccaaa

SEQ ID NO: 6015128 - DNA, 12 bp, Homo sapiens
cagcagttgagg

SEQ ID NO: 6015129 - DNA, 21 bp, Homo sapiens
cagcagttgctagcaacaact

SEQ ID NO: 6015130 - DNA, 23 bp, Homo sapiens
cagcagttgctggtaaaatgaag

SEQ ID NO: 6015131 - DNA, 23 bp, Homo sapiens
cagcagtttcaccatctttgagg

SEQ ID NO: 6015132 - DNA, 19 bp, Homo sapiens
cagcagtttccagagagtg

SEQ ID NO: 6015133 - DNA, 20 bp, Homo sapiens
cagcagtttccagagagtgg

SEQ ID NO: 6015134 - DNA, 13 bp, Homo sapiens
cagcagtttctga

SEQ ID NO: 6015135 - DNA, 17 bp, Homo sapiens
cagcagtttgggaggtc

SEQ ID NO: 6015136 - DNA, 15 bp, Homo sapiens
cagcataaaggcctt

SEQ ID NO: 6015137 - DNA, 18 bp, Homo sapiens
cagcataaaggccttttt

SEQ ID NO: 6015138 - DNA, 17 bp, Homo sapiens
cagcataagggagcgta

SEQ ID NO: 6015139 - DNA, 15 bp, Homo sapiens
cagcataattcggaa

SEQ ID NO: 6015140 - DNA, 18 bp, Homo sapiens
cagcatacataactgaag

SEQ ID NO: 6015141 - DNA, 19 bp, Homo sapiens
cagcatacattttctggtg

SEQ ID NO: 6015142 - DNA, 17 bp, Homo sapiens
cagcataccagttcttg

SEQ ID NO: 6015143 - DNA, 13 bp, Homo sapiens
cagcatacctcaa

SEQ ID NO: 6015144 - DNA, 16 bp, Homo sapiens
cagcatacctgctggt

SEQ ID NO: 6015145 - DNA, 14 bp, Homo sapiens
cagcatacttcaaa

SEQ ID NO: 6015146 - DNA, 21 bp, Homo sapiens
cagcatacttcaaaactgttt

SEQ ID NO: 6015147 - DNA, 17 bp, Homo sapiens
cagcatagaacaggacc

SEQ ID NO: 6015148 - DNA, 23 bp, Homo sapiens
cagcatagaacaggacctctgct

SEQ ID NO: 6015149 - DNA, 19 bp, Homo sapiens
cagcatagcaagacacatc

SEQ ID NO: 6015150 - DNA, 16 bp, Homo sapiens
cagcatagcctgcctg

SEQ ID NO: 6015151 - DNA, 17 bp, Homo sapiens
cagcataggggggaggg

SEQ ID NO: 6015152 - DNA, 18 bp, Homo sapiens
cagcataggggggagggt

SEQ ID NO: 6015153 - DNA, 22 bp, Homo sapiens
cagcataggtatgcttactatg

SEQ ID NO: 6015154 - DNA, 17 bp, Homo sapiens
cagcatagttctgcaat

SEQ ID NO: 6015155 - DNA, 19 bp, Homo sapiens
cagcatagttctgcaataa

SEQ ID NO: 6015156 - DNA, 11 bp, Homo sapiens
cagcatatata

SEQ ID NO: 6015157 - DNA, 19 bp, Homo sapiens
cagcatatcgtttaatttt

SEQ ID NO: 6015158 - DNA, 18 bp, Homo sapiens
cagcatattcaggaagct

SEQ ID NO: 6015159 - DNA, 23 bp, Homo sapiens
cagcatattcaggaagctcaggg

SEQ ID NO: 6015160 - DNA, 16 bp, Homo sapiens
cagcatcaaaatacaa

SEQ ID NO: 6015161 - DNA, 21 bp, Homo sapiens
cagcatcaaacatgaaaacat

SEQ ID NO: 6015162 - DNA, 18 bp, Homo sapiens
cagcatcaacctaggagc

SEQ ID NO: 6015163 - DNA, 20 bp, Homo sapiens
cagcatcaacctaggagcag

SEQ ID NO: 6015164 - DNA, 19 bp, Homo sapiens
cagcatcacctgcctgtta

SEQ ID NO: 6015165 - DNA, 20 bp, Homo sapiens
cagcatcactccccaaggaa

SEQ ID NO: 6015166 - DNA, 13 bp, Homo sapiens
cagcatcactgat

SEQ ID NO: 6015167 - DNA, 16 bp, Homo sapiens
cagcatcactgatggg

SEQ ID NO: 6015168 - DNA, 19 bp, Homo sapiens
cagcatcactgatgggaat

SEQ ID NO: 6015169 - DNA, 12 bp, Homo sapiens
cagcatcactgg

SEQ ID NO: 6015170 - DNA, 16 bp, Homo sapiens
cagcatcagaaatcct

SEQ ID NO: 6015171 - DNA, 14 bp, Homo sapiens
cagcatcagctcaa

SEQ ID NO: 6015172 - DNA, 14 bp, Homo sapiens
cagcatcattcagc

SEQ ID NO: 6015173 - DNA, 15 bp, Homo sapiens
cagcatcattcagca

SEQ ID NO: 6015174 - DNA, 17 bp, Homo sapiens
cagcatcattcagcaaa

SEQ ID NO: 6015175 - DNA, 22 bp, Homo sapiens
cagcatcattttgcattcaaat

SEQ ID NO: 6015176 - DNA, 17 bp, Homo sapiens
cagcatccaccccaccc

SEQ ID NO: 6015177 - DNA, 22 bp, Homo sapiens
cagcatccaccttggctctgcc

SEQ ID NO: 6015178 - DNA, 17 bp, Homo sapiens
cagcatcccagcctcag

SEQ ID NO: 6015179 - DNA, 18 bp, Homo sapiens
cagcatcccagcctcaga

SEQ ID NO: 6015180 - DNA, 15 bp, Homo sapiens
cagcatcccagcctt

SEQ ID NO: 6015181 - DNA, 20 bp, Homo sapiens
cagcatccccttgaactctt

SEQ ID NO: 6015182 - DNA, 15 bp, Homo sapiens
cagcatcccttccca

SEQ ID NO: 6015183 - DNA, 16 bp, Homo sapiens
cagcatcccttcccac

SEQ ID NO: 6015184 - DNA, 21 bp, Homo sapiens
cagcatcccttcccacatgcc

SEQ ID NO: 6015185 - DNA, 23 bp, Homo sapiens
cagcatcccttcccacatgcctg

SEQ ID NO: 6015186 - DNA, 22 bp, Homo sapiens
cagcatcccttgaccaggcctg

SEQ ID NO: 6015187 - DNA, 17 bp, Homo sapiens
cagcatcctccaaaact

SEQ ID NO: 6015188 - DNA, 21 bp, Homo sapiens
cagcatcctggaaatttgtgt

SEQ ID NO: 6015189 - DNA, 16 bp, Homo sapiens
cagcatcctggcaccc

SEQ ID NO: 6015190 - DNA, 23 bp, Homo sapiens
cagcatccttttctgcagagggg

SEQ ID NO: 6015191 - DNA, 19 bp, Homo sapiens
cagcatcgcactctggcag

SEQ ID NO: 6015192 - DNA, 18 bp, Homo sapiens
cagcatcgggagcaccca

SEQ ID NO: 6015193 - DNA, 18 bp, Homo sapiens
cagcatcgggggcctgca

SEQ ID NO: 6015194 - DNA, 19 bp, Homo sapiens
cagcatcgggggcctgcaa

SEQ ID NO: 6015195 - DNA, 20 bp, Homo sapiens
cagcatcgggggcctgcaaa

SEQ ID NO: 6015196 - DNA, 18 bp, Homo sapiens
cagcatcgtgtgggtccc

SEQ ID NO: 6015197 - DNA, 18 bp, Homo sapiens
cagcatctactctaggca

SEQ ID NO: 6015198 - DNA, 18 bp, Homo sapiens
cagcatctcagagtccag

SEQ ID NO: 6015199 - DNA, 14 bp, Homo sapiens
cagcatctcagctc

SEQ ID NO: 6015200 - DNA, 18 bp, Homo sapiens
cagcatctccaagcagct

SEQ ID NO: 6015201 - DNA, 13 bp, Homo sapiens
cagcatctgacca

SEQ ID NO: 6015202 - DNA, 16 bp, Homo sapiens
cagcatctgaccatct

SEQ ID NO: 6015203 - DNA, 17 bp, Homo sapiens
cagcatctgaccatctg

SEQ ID NO: 6015204 - DNA, 22 bp, Homo sapiens
cagcatctgaccatctgtgact

SEQ ID NO: 6015205 - DNA, 12 bp, Homo sapiens
cagcatctgatt

SEQ ID NO: 6015206 - DNA, 19 bp, Homo sapiens
cagcatctgcctctattca

SEQ ID NO: 6015207 - DNA, 16 bp, Homo sapiens
cagcatctgctccatc

SEQ ID NO: 6015208 - DNA, 14 bp, Homo sapiens
cagcatctggaaga

SEQ ID NO: 6015209 - DNA, 24 bp, Homo sapiens
cagcatctggaagagctaggcagg

SEQ ID NO: 6015210 - DNA, 20 bp, Homo sapiens
cagcatctggctgtctagaa

SEQ ID NO: 6015211 - DNA, 15 bp, Homo sapiens
cagcatctgggcctt

SEQ ID NO: 6015212 - DNA, 21 bp, Homo sapiens
cagcatcttaccttcatatgc

SEQ ID NO: 6015213 - DNA, 13 bp, Homo sapiens
cagcatcttctca

SEQ ID NO: 6015214 - DNA, 14 bp, Homo sapiens
cagcatctttcacc

SEQ ID NO: 6015215 - DNA, 19 bp, Homo sapiens
cagttggggcggcccacgc

SEQ ID NO: 6015216 - DNA, 17 bp, Homo sapiens
cagttgggtgagaacaa

SEQ ID NO: 6015217 - DNA, 18 bp, Homo sapiens
cagttgggtggatgcctg

SEQ ID NO: 6015218 - DNA, 19 bp, Homo sapiens
cagttgggtggatgcctgg

SEQ ID NO: 6015219 - DNA, 15 bp, Homo sapiens
cagttgggtgtgaga

SEQ ID NO: 6015220 - DNA, 14 bp, Homo sapiens
cagttggtaacttt

SEQ ID NO: 6015221 - DNA, 20 bp, Homo sapiens
cagttggtcccccttccatg

SEQ ID NO: 6015222 - DNA, 20 bp, Homo sapiens
cagttggtctttaaccactt

SEQ ID NO: 6015223 - DNA, 21 bp, Homo sapiens
cagttggtgactgggaaagtt

SEQ ID NO: 6015224 - DNA, 14 bp, Homo sapiens
cagttggtgatttt

SEQ ID NO: 6015225 - DNA, 16 bp, Homo sapiens
cagttggtgtgttttt

SEQ ID NO: 6015226 - DNA, 17 bp, Homo sapiens
cagttggttgtgtcttt

SEQ ID NO: 6015227 - DNA, 23 bp, Homo sapiens
cagttgtaaaattgttagtaaac

SEQ ID NO: 6015228 - DNA, 17 bp, Homo sapiens
cagttgtaccactgcta

SEQ ID NO: 6015229 - DNA, 15 bp, Homo sapiens
cagttgtagaatgta

SEQ ID NO: 6015230 - DNA, 21 bp, Homo sapiens
cagttgtagaatgtattgtac

SEQ ID NO: 6015231 - DNA, 14 bp, Homo sapiens
cagttgtatcctct

SEQ ID NO: 6015232 - DNA, 14 bp, Homo sapiens
cagttgtatttaac

SEQ ID NO: 6015233 - DNA, 16 bp, Homo sapiens
cagttgtcagttgtga

SEQ ID NO: 6015234 - DNA, 22 bp, Homo sapiens
cagttgtctaaaggatgagatt

SEQ ID NO: 6015235 - DNA, 24 bp, Homo sapiens
cagttgtctaaaggatgagatttt

SEQ ID NO: 6015236 - DNA, 20 bp, Homo sapiens
cagttgtctattctgagcct

SEQ ID NO: 6015237 - DNA, 21 bp, Homo sapiens
cagttgtctattctgagcctt

SEQ ID NO: 6015238 - DNA, 23 bp, Homo sapiens
cagttgtctattctgagccttga

SEQ ID NO: 6015239 - DNA, 13 bp, Homo sapiens
cagttgtctctga

SEQ ID NO: 6015240 - DNA, 17 bp, Homo sapiens
cagttgtctctgatgca

SEQ ID NO: 6015241 - DNA, 21 bp, Homo sapiens
cagttgtctctgatgcagctt

SEQ ID NO: 6015242 - DNA, 22 bp, Homo sapiens
cagttgtgaaagcaccatcatc

SEQ ID NO: 6015243 - DNA, 20 bp, Homo sapiens
cagttgtgaatacattcttt

SEQ ID NO: 6015244 - DNA, 20 bp, Homo sapiens
cagttgtgataatagcattt

SEQ ID NO: 6015245 - DNA, 16 bp, Homo sapiens
cagttgtgatttctgt

SEQ ID NO: 6015246 - DNA, 22 bp, Homo sapiens
cagttgtggtgtgagtatcaga

SEQ ID NO: 6015247 - DNA, 15 bp, Homo sapiens
cagttgtgtcataaa

SEQ ID NO: 6015248 - DNA, 16 bp, Homo sapiens
cagttgtgtggcccag

SEQ ID NO: 6015249 - DNA, 19 bp, Homo sapiens
cagttgtgtggcccagcac

SEQ ID NO: 6015250 - DNA, 17 bp, Homo sapiens
cagttgtgttagcctct

SEQ ID NO: 6015251 - DNA, 23 bp, Homo sapiens
cagttgtgttcatgctgaatcca

SEQ ID NO: 6015252 - DNA, 22 bp, Homo sapiens
cagttgtgtttgttgctggctt

SEQ ID NO: 6015253 - DNA, 17 bp, Homo sapiens
cagttgttagtgtgtct

SEQ ID NO: 6015254 - DNA, 18 bp, Homo sapiens
cagttgttagtgtgtctt

SEQ ID NO: 6015255 - DNA, 21 bp, Homo sapiens
cagttgttatattcattcttt

SEQ ID NO: 6015256 - DNA, 14 bp, Homo sapiens
cagttgttatttag

SEQ ID NO: 6015257 - DNA, 14 bp, Homo sapiens
cagttgttatttat

SEQ ID NO: 6015258 - DNA, 19 bp, Homo sapiens
cagttgttatttattgaaa

SEQ ID NO: 6015259 - DNA, 21 bp, Homo sapiens
cagttgttctttagaggcttt

SEQ ID NO: 6015260 - DNA, 13 bp, Homo sapiens
cagttgttctttt

SEQ ID NO: 6015261 - DNA, 20 bp, Homo sapiens
cagttgttggcctccggcct

SEQ ID NO: 6015262 - DNA, 16 bp, Homo sapiens
cagtttaaaaaaattg

SEQ ID NO: 6015263 - DNA, 18 bp, Homo sapiens
cagtttaaaaaaattggt

SEQ ID NO: 6015264 - DNA, 13 bp, Homo sapiens
cagtttaaaaaat

SEQ ID NO: 6015265 - DNA, 23 bp, Homo sapiens
cagtttaaaaaataacttcattg

SEQ ID NO: 6015266 - DNA, 17 bp, Homo sapiens
cagtttaaaaagatgaa

SEQ ID NO: 6015267 - DNA, 14 bp, Homo sapiens
cagtttaaaagcac

SEQ ID NO: 6015268 - DNA, 12 bp, Homo sapiens
cagtttaaagca

SEQ ID NO: 6015269 - DNA, 23 bp, Homo sapiens
cagtttaaaggggtcccatcagt

SEQ ID NO: 6015270 - DNA, 19 bp, Homo sapiens
cagtttaacagaaaaatga

SEQ ID NO: 6015271 - DNA, 19 bp, Homo sapiens
cagtttaagacaccaaata

SEQ ID NO: 6015272 - DNA, 15 bp, Homo sapiens
cagtttaagagtttt

SEQ ID NO: 6015273 - DNA, 20 bp, Homo sapiens
cagtttaagattttaagtat

SEQ ID NO: 6015274 - DNA, 19 bp, Homo sapiens
cagtttaatattccaatac

SEQ ID NO: 6015275 - DNA, 16 bp, Homo sapiens
cagtttaatccttcta

SEQ ID NO: 6015276 - DNA, 21 bp, Homo sapiens
cagtttaatccttctagtttc

SEQ ID NO: 6015277 - DNA, 13 bp, Homo sapiens
cagtttaatgaag

SEQ ID NO: 6015278 - DNA, 19 bp, Homo sapiens
cagtttaatgaagatctaa

SEQ ID NO: 6015279 - DNA, 23 bp, Homo sapiens
cagtttacaggaaagatgcattt

SEQ ID NO: 6015280 - DNA, 13 bp, Homo sapiens
cagtttacagtat

SEQ ID NO: 6015281 - DNA, 22 bp, Homo sapiens
cagtttagaacctacaaaagct

SEQ ID NO: 6015282 - DNA, 19 bp, Homo sapiens
cagtttagatttcaagaaa

SEQ ID NO: 6015283 - DNA, 16 bp, Homo sapiens
cagtttaggccttggc

SEQ ID NO: 6015284 - DNA, 20 bp, Homo sapiens
cagtttaggccttggcttga

SEQ ID NO: 6015285 - DNA, 13 bp, Homo sapiens
cagtttagtgctt

SEQ ID NO: 6015286 - DNA, 21 bp, Homo sapiens
cagtttataaagccaagaatt

SEQ ID NO: 6015287 - DNA, 11 bp, Homo sapiens
cagtttataca

SEQ ID NO: 6015288 - DNA, 12 bp, Homo sapiens
cagtttatacag

SEQ ID NO: 6015289 - DNA, 21 bp, Homo sapiens
cagtttatatatatgctactt

SEQ ID NO: 6015290 - DNA, 19 bp, Homo sapiens
cagtttatatttaactctc

SEQ ID NO: 6015291 - DNA, 16 bp, Homo sapiens
cagtttatcatgaagc

SEQ ID NO: 6015292 - DNA, 18 bp, Homo sapiens
cagtttatcatgaagcct

SEQ ID NO: 6015293 - DNA, 19 bp, Homo sapiens
cagtttatcattcaagtgt

SEQ ID NO: 6015294 - DNA, 18 bp, Homo sapiens
cagtttatcctgacatat

SEQ ID NO: 6015295 - DNA, 19 bp, Homo sapiens
cagtttatggatatgctgc

SEQ ID NO: 6015296 - DNA, 21 bp, Homo sapiens
cagtttatggatatgctgctt

SEQ ID NO: 6015297 - DNA, 15 bp, Homo sapiens
cagtttatgtttgtg

SEQ ID NO: 6015298 - DNA, 13 bp, Homo sapiens
cagtttatgtttt

SEQ ID NO: 6015299 - DNA, 16 bp, Homo sapiens
cagtttattaaatctg

SEQ ID NO: 6015300 - DNA, 21 bp, Homo sapiens
cagtttattaaatctgaattt

SEQ ID NO: 6015301 - DNA, 14 bp, Homo sapiens
cagtttattccaga

SEQ ID NO: 6015302 - DNA, 22 bp, Homo sapiens
cagtttattccagagctgccag

SEQ ID NO: 6015303 - DNA, 13 bp, Homo sapiens
cagtttattctgt

SEQ ID NO: 6015304 - DNA, 17 bp, Homo sapiens
cagtttattgatattca

SEQ ID NO: 6015305 - DNA, 20 bp, Homo sapiens
cagtttatttccactatttt

SEQ ID NO: 6015306 - DNA, 18 bp, Homo sapiens
cagtttatttgaaccaat

SEQ ID NO: 6015307 - DNA, 14 bp, Homo sapiens
cagtttatttgttg

SEQ ID NO: 6015308 - DNA, 12 bp, Homo sapiens
cagtttcaataa

SEQ ID NO: 6015309 - DNA, 19 bp, Homo sapiens
cagtttcacaagtgagccc

SEQ ID NO: 6015310 - DNA, 17 bp, Homo sapiens
cagtttcacagaaaata

SEQ ID NO: 6015311 - DNA, 13 bp, Homo sapiens
cagtttcagaagc

SEQ ID NO: 6015312 - DNA, 22 bp, Homo sapiens
cagtttcagagagtcaatgtca

SEQ ID NO: 6015313 - DNA, 13 bp, Homo sapiens
cagtttcagataa

SEQ ID NO: 6015314 - DNA, 23 bp, Homo sapiens
cagtttcataaaaggagaaccag

SEQ ID NO: 6015315 - DNA, 15 bp, Homo sapiens
cagtttcattattct

SEQ ID NO: 6015316 - DNA, 19 bp, Homo sapiens
cagtttcattcaacacatt

SEQ ID NO: 6015317 - DNA, 20 bp, Homo sapiens
cagtttccagagagtggaga

SEQ ID NO: 6015318 - DNA, 14 bp, Homo sapiens
cagtttccatgaaa

SEQ ID NO: 6015319 - DNA, 12 bp, Homo sapiens
cagtttcccaga

SEQ ID NO: 6015320 - DNA, 13 bp, Homo sapiens
cagtttcccatgc

SEQ ID NO: 6015321 - DNA, 19 bp, Homo sapiens
cagtttccctatctgcaaa

SEQ ID NO: 6015322 - DNA, 23 bp, Homo sapiens
cagtttccctatctgcaaaatgg

SEQ ID NO: 6015323 - DNA, 20 bp, Homo sapiens
cagtttccgaatctctttcc

SEQ ID NO: 6015324 - DNA, 15 bp, Homo sapiens
cagtttcctcagtga

SEQ ID NO: 6015325 - DNA, 14 bp, Homo sapiens
cagtttcctggaaa

SEQ ID NO: 6015326 - DNA, 19 bp, Homo sapiens
cagtttctcaagtttaaag

SEQ ID NO: 6015327 - DNA, 16 bp, Homo sapiens
cagtttctccatcagc

SEQ ID NO: 6015328 - DNA, 20 bp, Homo sapiens
cagtttctcttaagctgccc

SEQ ID NO: 6015329 - DNA, 10 bp, Homo sapiens
cagtttctga

SEQ ID NO: 6015330 - DNA, 21 bp, Homo sapiens
cagtttctgacaattaacata

SEQ ID NO: 6015331 - DNA, 13 bp, Homo sapiens
cagtttctgcctg

SEQ ID NO: 6015332 - DNA, 14 bp, Homo sapiens
cagtttctgcctgg

SEQ ID NO: 6015333 - DNA, 18 bp, Homo sapiens
cagtttctgcctgggcaa

SEQ ID NO: 6015334 - DNA, 19 bp, Homo sapiens
cagtttctgtcctgctggt

SEQ ID NO: 6015335 - DNA, 15 bp, Homo sapiens
cagtttctgttgttt

SEQ ID NO: 6015336 - DNA, 12 bp, Homo sapiens
cagtttcttaaa

SEQ ID NO: 6015337 - DNA, 15 bp, Homo sapiens
cagtttcttagcttt

SEQ ID NO: 6015338 - DNA, 21 bp, Homo sapiens
cagtttcttcatgcattactt

SEQ ID NO: 6015339 - DNA, 13 bp, Homo sapiens
cagtttcttctta

SEQ ID NO: 6015340 - DNA, 20 bp, Homo sapiens
cagtttcttcttacacttct

SEQ ID NO: 6015341 - DNA, 23 bp, Homo sapiens
cagtttcttgcttggaagccagg

SEQ ID NO: 6015342 - DNA, 13 bp, Homo sapiens
cagtttgaaataa

SEQ ID NO: 6015343 - DNA, 20 bp, Homo sapiens
cagtttgaaattctgaattt

SEQ ID NO: 6015344 - DNA, 14 bp, Homo sapiens
cagtttgacttttt

SEQ ID NO: 6015345 - DNA, 18 bp, Homo sapiens
cagtttgagacaggagac

SEQ ID NO: 6015346 - DNA, 21 bp, Homo sapiens
cagtttgagaccagcctgggc

SEQ ID NO: 6015347 - DNA, 21 bp, Homo sapiens
cagtttgaggattagtttaga

SEQ ID NO: 6015348 - DNA, 16 bp, Homo sapiens
cagtttgatattttga

SEQ ID NO: 6015349 - DNA, 12 bp, Homo sapiens
cagtttgatcaa

SEQ ID NO: 6015350 - DNA, 13 bp, Homo sapiens
cagtttgatgctg

SEQ ID NO: 6015351 - DNA, 22 bp, Homo sapiens
cagtttgcaatcttatgttgat

SEQ ID NO: 6015352 - DNA, 12 bp, Homo sapiens
cagtttgcagag

SEQ ID NO: 6015353 - DNA, 19 bp, Homo sapiens
cagtttgcatgattcttct

SEQ ID NO: 6015354 - DNA, 15 bp, Homo sapiens
cagtttgcctctgca

SEQ ID NO: 6015355 - DNA, 17 bp, Homo sapiens
cagtttgcctctgcacg

SEQ ID NO: 6015356 - DNA, 15 bp, Homo sapiens
cagtttgctatttgc

SEQ ID NO: 6015357 - DNA, 20 bp, Homo sapiens
cagtttgctatttgctttag

SEQ ID NO: 6015358 - DNA, 19 bp, Homo sapiens
cagtttgctgtactagaga

SEQ ID NO: 6015359 - DNA, 14 bp, Homo sapiens
cagtttgctttgcc

SEQ ID NO: 6015360 - DNA, 21 bp, Homo sapiens
cagtttgctttgtatgcactt

SEQ ID NO: 6015361 - DNA, 19 bp, Homo sapiens
cagtttggaagtgttaact

SEQ ID NO: 6015362 - DNA, 17 bp, Homo sapiens
cagtttggcaaactctc

SEQ ID NO: 6015363 - DNA, 16 bp, Homo sapiens
cagtttggccctggag

SEQ ID NO: 6015364 - DNA, 14 bp, Homo sapiens
cagtttggctgtaa

SEQ ID NO: 6015365 - DNA, 17 bp, Homo sapiens
cagtttggctgtaattt

SEQ ID NO: 6015366 - DNA, 12 bp, Homo sapiens
cagtttgggaag

SEQ ID NO: 6015367 - DNA, 14 bp, Homo sapiens
cagtttgggaaggt

SEQ ID NO: 6015368 - DNA, 23 bp, Homo sapiens
cagtttgggagacatggaccagc

SEQ ID NO: 6015369 - DNA, 15 bp, Homo sapiens
cagtttggggcaggg

SEQ ID NO: 6015370 - DNA, 12 bp, Homo sapiens
cagtttggggtg

SEQ ID NO: 6015371 - DNA, 19 bp, Homo sapiens
cagtttggtatgaaacaaa

SEQ ID NO: 6015372 - DNA, 22 bp, Homo sapiens
cagtttggtatgaaacaaatat

SEQ ID NO: 6015373 - DNA, 15 bp, Homo sapiens
cagtttggtgtcaac

SEQ ID NO: 6015374 - DNA, 15 bp, Homo sapiens
cagtttggtttatat

SEQ ID NO: 6015375 - DNA, 12 bp, Homo sapiens
cagtttggtttt

SEQ ID NO: 6015376 - DNA, 14 bp, Homo sapiens
cagtttgtaaatgt

SEQ ID NO: 6015377 - DNA, 23 bp, Homo sapiens
cagtttgtaaatgttatttctgc

SEQ ID NO: 6015378 - DNA, 23 bp, Homo sapiens
cagtttgtaacttgggctgtaaa

SEQ ID NO: 6015379 - DNA, 16 bp, Homo sapiens
cagtttgtcacatgaa

SEQ ID NO: 6015380 - DNA, 19 bp, Homo sapiens
cagtttgtctctttgcaac

SEQ ID NO: 6015381 - DNA, 12 bp, Homo sapiens
cagtttgtgaag

SEQ ID NO: 6015382 - DNA, 21 bp, Homo sapiens
cagtttgtgtgtcttaattat

SEQ ID NO: 6015383 - DNA, 21 bp, Homo sapiens
cagtttgtgttttaaaaaaac

SEQ ID NO: 6015384 - DNA, 21 bp, Homo sapiens
cagtttgttagtatgaggcat

SEQ ID NO: 6015385 - DNA, 15 bp, Homo sapiens
cagtttgttggaaag

SEQ ID NO: 6015386 - DNA, 13 bp, Homo sapiens
cagtttgtttcct

SEQ ID NO: 6015387 - DNA, 15 bp, Homo sapiens
cagttttaaaaatga

SEQ ID NO: 6015388 - DNA, 18 bp, Homo sapiens
cagttttaaaaatgaaga

SEQ ID NO: 6015389 - DNA, 12 bp, Homo sapiens
cagttttaaaga

SEQ ID NO: 6015390 - DNA, 14 bp, Homo sapiens
cagttttaactgtg

SEQ ID NO: 6015391 - DNA, 15 bp, Homo sapiens
cagttttaactgtgg

SEQ ID NO: 6015392 - DNA, 16 bp, Homo sapiens
cagttttaactgtgga

SEQ ID NO: 6015393 - DNA, 20 bp, Homo sapiens
cagttttaactgtggatatt

SEQ ID NO: 6015394 - DNA, 22 bp, Homo sapiens
cagcatcttttccatcctgagg

SEQ ID NO: 6015395 - DNA, 12 bp, Homo sapiens
cagcatgaaaat

SEQ ID NO: 6015396 - DNA, 19 bp, Homo sapiens
cagcatgaattccaactca

SEQ ID NO: 6015397 - DNA, 17 bp, Homo sapiens
cagcatgaatttgtaat

SEQ ID NO: 6015398 - DNA, 14 bp, Homo sapiens
cagcatgacaaaaa

SEQ ID NO: 6015399 - DNA, 17 bp, Homo sapiens
cagcatgacaaaaataa

SEQ ID NO: 6015400 - DNA, 19 bp, Homo sapiens
cagcatgacaaaagtgaca

SEQ ID NO: 6015401 - DNA, 21 bp, Homo sapiens
cagcatgacctgtgaccagca

SEQ ID NO: 6015402 - DNA, 22 bp, Homo sapiens
cagcatgactatgtatttttct

SEQ ID NO: 6015403 - DNA, 20 bp, Homo sapiens
cagcatgagactttctgctg

SEQ ID NO: 6015404 - DNA, 21 bp, Homo sapiens
cagcatgagactttctgctgg

SEQ ID NO: 6015405 - DNA, 15 bp, Homo sapiens
cagcatgaggacaga

SEQ ID NO: 6015406 - DNA, 16 bp, Homo sapiens
cagcatgcaatacata

SEQ ID NO: 6015407 - DNA, 12 bp, Homo sapiens
cagcatgcattt

SEQ ID NO: 6015408 - DNA, 22 bp, Homo sapiens
cagcatgcatttagcatgagtt

SEQ ID NO: 6015409 - DNA, 16 bp, Homo sapiens
cagcatgccccttggc

SEQ ID NO: 6015410 - DNA, 20 bp, Homo sapiens
cagcatgccccttggctgga

SEQ ID NO: 6015411 - DNA, 14 bp, Homo sapiens
cagcatgcttccca

SEQ ID NO: 6015412 - DNA, 15 bp, Homo sapiens
cagcatgcttcccag

SEQ ID NO: 6015413 - DNA, 17 bp, Homo sapiens
cagcatgcttcccagag

SEQ ID NO: 6015414 - DNA, 13 bp, Homo sapiens
cagcatggaaaaa

SEQ ID NO: 6015415 - DNA, 12 bp, Homo sapiens
cagcatggaatc

SEQ ID NO: 6015416 - DNA, 21 bp, Homo sapiens
cagcatggaatctgatgaaaa

SEQ ID NO: 6015417 - DNA, 14 bp, Homo sapiens
cagcatggagagag

SEQ ID NO: 6015418 - DNA, 13 bp, Homo sapiens
cagcatggaggaa

SEQ ID NO: 6015419 - DNA, 18 bp, Homo sapiens
cagcatggcactccctcc

SEQ ID NO: 6015420 - DNA, 19 bp, Homo sapiens
cagcatggcactccctcca

SEQ ID NO: 6015421 - DNA, 20 bp, Homo sapiens
cagcatggcactccctccag

SEQ ID NO: 6015422 - DNA, 21 bp, Homo sapiens
cagcatggcactccctccagc

SEQ ID NO: 6015423 - DNA, 23 bp, Homo sapiens
cagcatggggtttttattatttt

SEQ ID NO: 6015424 - DNA, 22 bp, Homo sapiens
cagcatgggtccttgatgccag

SEQ ID NO: 6015425 - DNA, 19 bp, Homo sapiens
cagcatggtagtggcaaag

SEQ ID NO: 6015426 - DNA, 18 bp, Homo sapiens
cagcatgtatagttgctt

SEQ ID NO: 6015427 - DNA, 19 bp, Homo sapiens
cagcatgtatagttgcttt

SEQ ID NO: 6015428 - DNA, 22 bp, Homo sapiens
cagcatgtccaacatggtaatt

SEQ ID NO: 6015429 - DNA, 15 bp, Homo sapiens
cagcatgtctactgc

SEQ ID NO: 6015430 - DNA, 18 bp, Homo sapiens
cagcatgtctattcagct

SEQ ID NO: 6015431 - DNA, 11 bp, Homo sapiens
cagcatgtgtg

SEQ ID NO: 6015432 - DNA, 15 bp, Homo sapiens
cagcatgtgtgtgtc

SEQ ID NO: 6015433 - DNA, 17 bp, Homo sapiens
cagcatgtgtgtgtctc

SEQ ID NO: 6015434 - DNA, 20 bp, Homo sapiens
cagcatgtgttaatcttaat

SEQ ID NO: 6015435 - DNA, 13 bp, Homo sapiens
cagcatgttttct

SEQ ID NO: 6015436 - DNA, 20 bp, Homo sapiens
cagcatgttttctgctttaa

SEQ ID NO: 6015437 - DNA, 19 bp, Homo sapiens
cagcattaaaattttacct

SEQ ID NO: 6015438 - DNA, 18 bp, Homo sapiens
cagcattacaaattgctt

SEQ ID NO: 6015439 - DNA, 23 bp, Homo sapiens
cagcattacgatcccccaagtgt

SEQ ID NO: 6015440 - DNA, 18 bp, Homo sapiens
cagcattactaaggcagg

SEQ ID NO: 6015441 - DNA, 23 bp, Homo sapiens
cagcattagagaaatgaattata

SEQ ID NO: 6015442 - DNA, 21 bp, Homo sapiens
cagcattagatagtcatgctg

SEQ ID NO: 6015443 - DNA, 17 bp, Homo sapiens
cagcattcagcacacac

SEQ ID NO: 6015444 - DNA, 19 bp, Homo sapiens
cagcattcagcacacccca

SEQ ID NO: 6015445 - DNA, 15 bp, Homo sapiens
cagcattcatgccga

SEQ ID NO: 6015446 - DNA, 21 bp, Homo sapiens
cagcattcatttgttttttca

SEQ ID NO: 6015447 - DNA, 21 bp, Homo sapiens
cagcattccagacttcaaaaa

SEQ ID NO: 6015448 - DNA, 19 bp, Homo sapiens
cagcattccagctctgccc

SEQ ID NO: 6015449 - DNA, 12 bp, Homo sapiens
cagcattcccag

SEQ ID NO: 6015450 - DNA, 13 bp, Homo sapiens
cagcattcccagg

SEQ ID NO: 6015451 - DNA, 18 bp, Homo sapiens
cagcattcccagggacct

SEQ ID NO: 6015452 - DNA, 14 bp, Homo sapiens
cagcattcccaggt

SEQ ID NO: 6015453 - DNA, 23 bp, Homo sapiens
cagcattcccaggtaggccaagg

SEQ ID NO: 6015454 - DNA, 15 bp, Homo sapiens
cagcattctcactcc

SEQ ID NO: 6015455 - DNA, 19 bp, Homo sapiens
cagcattctcaggcaccag

SEQ ID NO: 6015456 - DNA, 15 bp, Homo sapiens
cagcattctggaggg

SEQ ID NO: 6015457 - DNA, 18 bp, Homo sapiens
cagcattcttagcctgtg

SEQ ID NO: 6015458 - DNA, 21 bp, Homo sapiens
cagcattcttagcctgtggca

SEQ ID NO: 6015459 - DNA, 21 bp, Homo sapiens
cagcattcttgtcacaataaa

SEQ ID NO: 6015460 - DNA, 18 bp, Homo sapiens
cagcattgatatttgtgc

SEQ ID NO: 6015461 - DNA, 22 bp, Homo sapiens
cagcattgccataccattccca

SEQ ID NO: 6015462 - DNA, 16 bp, Homo sapiens
cagcattgctggttct

SEQ ID NO: 6015463 - DNA, 14 bp, Homo sapiens
cagcattgctttct

SEQ ID NO: 6015464 - DNA, 23 bp, Homo sapiens
cagcattggcctggccagaccag

SEQ ID NO: 6015465 - DNA, 17 bp, Homo sapiens
cagcattgtaattatgt

SEQ ID NO: 6015466 - DNA, 10 bp, Homo sapiens
cagcattgtc

SEQ ID NO: 6015467 - DNA, 17 bp, Homo sapiens
cagcattgtctttgctg

SEQ ID NO: 6015468 - DNA, 18 bp, Homo sapiens
cagcattgtctttgctgt

SEQ ID NO: 6015469 - DNA, 22 bp, Homo sapiens
cagcattgtctttgctgtactc

SEQ ID NO: 6015470 - DNA, 14 bp, Homo sapiens
cagcattgtgtgga

SEQ ID NO: 6015471 - DNA, 23 bp, Homo sapiens
cagcattgtgtggaatttgaggt

SEQ ID NO: 6015472 - DNA, 23 bp, Homo sapiens
cagcattgttgagctgtcatcaa

SEQ ID NO: 6015473 - DNA, 19 bp, Homo sapiens
cagcattgtttcaaaatag

SEQ ID NO: 6015474 - DNA, 22 bp, Homo sapiens
cagcatttactatgcacaacag

SEQ ID NO: 6015475 - DNA, 23 bp, Homo sapiens
cagcatttccacaccaagcagca

SEQ ID NO: 6015476 - DNA, 20 bp, Homo sapiens
cagcatttccttccagccca

SEQ ID NO: 6015477 - DNA, 12 bp, Homo sapiens
cagcatttgata

SEQ ID NO: 6015478 - DNA, 15 bp, Homo sapiens
cagcatttgataatg

SEQ ID NO: 6015479 - DNA, 19 bp, Homo sapiens
cagcatttgatgatagcag

SEQ ID NO: 6015480 - DNA, 15 bp, Homo sapiens
cagcatttgccaagt

SEQ ID NO: 6015481 - DNA, 17 bp, Homo sapiens
cagcatttgccaagtct

SEQ ID NO: 6015482 - DNA, 18 bp, Homo sapiens
cagcatttggcagcacgc

SEQ ID NO: 6015483 - DNA, 15 bp, Homo sapiens
cagcatttgtccacc

SEQ ID NO: 6015484 - DNA, 22 bp, Homo sapiens
cagcatttgtgtgttacaatgt

SEQ ID NO: 6015485 - DNA, 18 bp, Homo sapiens
cagcatttgttctttgcc

SEQ ID NO: 6015486 - DNA, 22 bp, Homo sapiens
cagcattttaaggttctcagac

SEQ ID NO: 6015487 - DNA, 19 bp, Homo sapiens
cagcattttcacattttgc

SEQ ID NO: 6015488 - DNA, 20 bp, Homo sapiens
cagcattttcatatccaaga

SEQ ID NO: 6015489 - DNA, 23 bp, Homo sapiens
cagcattttcctctgctttgaaa

SEQ ID NO: 6015490 - DNA, 15 bp, Homo sapiens
cagcattttcttaga

SEQ ID NO: 6015491 - DNA, 22 bp, Homo sapiens
cagcattttgagaggctgaggc

SEQ ID NO: 6015492 - DNA, 14 bp, Homo sapiens
cagcatttttaatt

SEQ ID NO: 6015493 - DNA, 22 bp, Homo sapiens
cagcatttttaattttcacaaa

SEQ ID NO: 6015494 - DNA, 20 bp, Homo sapiens
cagcattttttatcaggcag

SEQ ID NO: 6015495 - DNA, 22 bp, Homo sapiens
cagcattttttatcaggcagga

SEQ ID NO: 6015496 - DNA, 16 bp, Homo sapiens
cagccaaacacacaga

SEQ ID NO: 6015497 - DNA, 18 bp, Homo sapiens
cagccaaacacacagaag

SEQ ID NO: 6015498 - DNA, 23 bp, Homo sapiens
cagccaaacacacagaaggggac

SEQ ID NO: 6015499 - DNA, 17 bp, Homo sapiens
cagccaaacccatgagg

SEQ ID NO: 6015500 - DNA, 15 bp, Homo sapiens
cagccaaaccctgtc

SEQ ID NO: 6015501 - DNA, 17 bp, Homo sapiens
cagccaaaccctgtctg

SEQ ID NO: 6015502 - DNA, 19 bp, Homo sapiens
cagccaaacctttcctgta

SEQ ID NO: 6015503 - DNA, 16 bp, Homo sapiens
cagccaaacgggagct

SEQ ID NO: 6015504 - DNA, 20 bp, Homo sapiens
cagccaaacgggagcttttg

SEQ ID NO: 6015505 - DNA, 22 bp, Homo sapiens
cagccaaactgctggggctgca

SEQ ID NO: 6015506 - DNA, 22 bp, Homo sapiens
cagccaaagaaactcagaagag

SEQ ID NO: 6015507 - DNA, 18 bp, Homo sapiens
cagccaaaggggagccag

SEQ ID NO: 6015508 - DNA, 11 bp, Homo sapiens
cagccaaagtc

SEQ ID NO: 6015509 - DNA, 16 bp, Homo sapiens
cagccaaatccatcct

SEQ ID NO: 6015510 - DNA, 18 bp, Homo sapiens
cagccaaattgcagaaga

SEQ ID NO: 6015511 - DNA, 19 bp, Homo sapiens
cagccaaattgcagaagaa

SEQ ID NO: 6015512 - DNA, 22 bp, Homo sapiens
cagccaaatttaaaactgttgg

SEQ ID NO: 6015513 - DNA, 23 bp, Homo sapiens
cagccaacacgcacctgcctcag

SEQ ID NO: 6015514 - DNA, 20 bp, Homo sapiens
cagccaacagctacaacagc

SEQ ID NO: 6015515 - DNA, 23 bp, Homo sapiens
cagccaacagctacaacagcctc

SEQ ID NO: 6015516 - DNA, 22 bp, Homo sapiens
cagccaacaggtggcaggacca

SEQ ID NO: 6015517 - DNA, 23 bp, Homo sapiens
cagccaacaggtggcaggaccag

SEQ ID NO: 6015518 - DNA, 16 bp, Homo sapiens
cagccaacattgcctt

SEQ ID NO: 6015519 - DNA, 12 bp, Homo sapiens
cagccaacccct

SEQ ID NO: 6015520 - DNA, 21 bp, Homo sapiens
cagccaacccctgtggagccc

SEQ ID NO: 6015521 - DNA, 21 bp, Homo sapiens
cagccaacgagtaatttattg

SEQ ID NO: 6015522 - DNA, 14 bp, Homo sapiens
cagccaactagccc

SEQ ID NO: 6015523 - DNA, 19 bp, Homo sapiens
cagccaactagcccctggg

SEQ ID NO: 6015524 - DNA, 18 bp, Homo sapiens
cagccaactatggcctgt

SEQ ID NO: 6015525 - DNA, 13 bp, Homo sapiens
cagccaactcatt

SEQ ID NO: 6015526 - DNA, 13 bp, Homo sapiens
cagccaagagcca

SEQ ID NO: 6015527 - DNA, 18 bp, Homo sapiens
cagccaagagccatctga

SEQ ID NO: 6015528 - DNA, 13 bp, Homo sapiens
cagccaagagctc

SEQ ID NO: 6015529 - DNA, 20 bp, Homo sapiens
cagccaagattttcctcttg

SEQ ID NO: 6015530 - DNA, 22 bp, Homo sapiens
cagccaagcaaatgcctgccaa

SEQ ID NO: 6015531 - DNA, 14 bp, Homo sapiens
cagccaagcacagt

SEQ ID NO: 6015532 - DNA, 17 bp, Homo sapiens
cagccaagcacagtggt

SEQ ID NO: 6015533 - DNA, 23 bp, Homo sapiens
cagccaagcacagtggtggcagg

SEQ ID NO: 6015534 - DNA, 15 bp, Homo sapiens
cagccaagcacctcc

SEQ ID NO: 6015535 - DNA, 14 bp, Homo sapiens
cagccaagctctgc

SEQ ID NO: 6015536 - DNA, 16 bp, Homo sapiens
cagccaagctggcaca

SEQ ID NO: 6015537 - DNA, 11 bp, Homo sapiens
cagccaaggaa

SEQ ID NO: 6015538 - DNA, 18 bp, Homo sapiens
cagccaaggaatgtgtcc

SEQ ID NO: 6015539 - DNA, 16 bp, Homo sapiens
cagccaaggccgccag

SEQ ID NO: 6015540 - DNA, 20 bp, Homo sapiens
cagccaagggatgaaagaga

SEQ ID NO: 6015541 - DNA, 16 bp, Homo sapiens
cagccaagggtcctca

SEQ ID NO: 6015542 - DNA, 22 bp, Homo sapiens
cagccaaggtgctaaaaggaat

SEQ ID NO: 6015543 - DNA, 22 bp, Homo sapiens
cagccaagtcggttagtggaag

SEQ ID NO: 6015544 - DNA, 14 bp, Homo sapiens
cagccaagtgtgac

SEQ ID NO: 6015545 - DNA, 14 bp, Homo sapiens
cagccaatctggac

SEQ ID NO: 6015546 - DNA, 12 bp, Homo sapiens
cagccaatttca

SEQ ID NO: 6015547 - DNA, 16 bp, Homo sapiens
cagccaatttgtctcc

SEQ ID NO: 6015548 - DNA, 17 bp, Homo sapiens
cagccaatttgtctcct

SEQ ID NO: 6015549 - DNA, 21 bp, Homo sapiens
cagccacaaagccccccagct

SEQ ID NO: 6015550 - DNA, 22 bp, Homo sapiens
cagccacaaagccccccagctc

SEQ ID NO: 6015551 - DNA, 9 bp, Homo sapiens
cagccacac

SEQ ID NO: 6015552 - DNA, 14 bp, Homo sapiens
cagccacacacaca

SEQ ID NO: 6015553 - DNA, 16 bp, Homo sapiens
cagccacacacacaga

SEQ ID NO: 6015554 - DNA, 20 bp, Homo sapiens
cagccacacacacagaaaat

SEQ ID NO: 6015555 - DNA, 22 bp, Homo sapiens
cagccacacacacagaaaatat

SEQ ID NO: 6015556 - DNA, 16 bp, Homo sapiens
cagccacaccactgcc

SEQ ID NO: 6015557 - DNA, 16 bp, Homo sapiens
cagccacaccgctggc

SEQ ID NO: 6015558 - DNA, 17 bp, Homo sapiens
cagccacaccgctggct

SEQ ID NO: 6015559 - DNA, 18 bp, Homo sapiens
cagccacaccgctggctc

SEQ ID NO: 6015560 - DNA, 23 bp, Homo sapiens
cagccacaccgtggcagcttgct

SEQ ID NO: 6015561 - DNA, 21 bp, Homo sapiens
cagccacacctaggtctgaga

SEQ ID NO: 6015562 - DNA, 14 bp, Homo sapiens
cagccacacctgga

SEQ ID NO: 6015563 - DNA, 21 bp, Homo sapiens
cagccacacctggactgaccc

SEQ ID NO: 6015564 - DNA, 17 bp, Homo sapiens
cagccacacctgtcagc

SEQ ID NO: 6015565 - DNA, 17 bp, Homo sapiens
cagccacacgcaggcgg

SEQ ID NO: 6015566 - DNA, 18 bp, Homo sapiens
cagccacacgcaggcggc

SEQ ID NO: 6015567 - DNA, 19 bp, Homo sapiens
cagccacacgcgaccctcg

SEQ ID NO: 6015568 - DNA, 21 bp, Homo sapiens
cagccacactgggcctggagc

SEQ ID NO: 6015569 - DNA, 16 bp, Homo sapiens
cagccacacttctcag

SEQ ID NO: 6015570 - DNA, 22 bp, Homo sapiens
cagttttaactgtggatattgt

SEQ ID NO: 6015571 - DNA, 21 bp, Homo sapiens
cagttttacgcaacactaaat

SEQ ID NO: 6015572 - DNA, 15 bp, Homo sapiens
cagttttactctgct

SEQ ID NO: 6015573 - DNA, 13 bp, Homo sapiens
cagttttactgca

SEQ ID NO: 6015574 - DNA, 17 bp, Homo sapiens
cagttttactgcatttt

SEQ ID NO: 6015575 - DNA, 18 bp, Homo sapiens
cagttttactgcattttc

SEQ ID NO: 6015576 - DNA, 14 bp, Homo sapiens
cagttttagcagca

SEQ ID NO: 6015577 - DNA, 20 bp, Homo sapiens
cagttttagttggtgctgat

SEQ ID NO: 6015578 - DNA, 18 bp, Homo sapiens
cagttttatccacagaaa

SEQ ID NO: 6015579 - DNA, 17 bp, Homo sapiens
cagttttatccataatg

SEQ ID NO: 6015580 - DNA, 16 bp, Homo sapiens
cagttttatgccccat

SEQ ID NO: 6015581 - DNA, 18 bp, Homo sapiens
cagttttatgctcttttt

SEQ ID NO: 6015582 - DNA, 17 bp, Homo sapiens
cagttttcacagaggcg

SEQ ID NO: 6015583 - DNA, 14 bp, Homo sapiens
cagttttcagaaaa

SEQ ID NO: 6015584 - DNA, 15 bp, Homo sapiens
cagttttccaggagg

SEQ ID NO: 6015585 - DNA, 15 bp, Homo sapiens
cagttttcccacttt

SEQ ID NO: 6015586 - DNA, 16 bp, Homo sapiens
cagttttcccctggcc

SEQ ID NO: 6015587 - DNA, 20 bp, Homo sapiens
cagttttcccctggcctcag

SEQ ID NO: 6015588 - DNA, 11 bp, Homo sapiens
cagttttcctt

SEQ ID NO: 6015589 - DNA, 19 bp, Homo sapiens
cagttttcggaaacactga

SEQ ID NO: 6015590 - DNA, 19 bp, Homo sapiens
cagttttctgagaaagact

SEQ ID NO: 6015591 - DNA, 20 bp, Homo sapiens
cagttttctgagaaagacta

SEQ ID NO: 6015592 - DNA, 18 bp, Homo sapiens
cagttttctgttcagctt

SEQ ID NO: 6015593 - DNA, 15 bp, Homo sapiens
cagttttctttatga

SEQ ID NO: 6015594 - DNA, 13 bp, Homo sapiens
cagttttgataca

SEQ ID NO: 6015595 - DNA, 15 bp, Homo sapiens
cagttttgctgctat

SEQ ID NO: 6015596 - DNA, 19 bp, Homo sapiens
cagttttggtgtgtaactt

SEQ ID NO: 6015597 - DNA, 18 bp, Homo sapiens
cagttttggttgctttaa

SEQ ID NO: 6015598 - DNA, 15 bp, Homo sapiens
cagttttgtaaatgt

SEQ ID NO: 6015599 - DNA, 14 bp, Homo sapiens
cagttttgtgtaca

SEQ ID NO: 6015600 - DNA, 20 bp, Homo sapiens
cagttttgtgtgctttacta

SEQ ID NO: 6015601 - DNA, 13 bp, Homo sapiens
cagttttgttttg

SEQ ID NO: 6015602 - DNA, 13 bp, Homo sapiens
cagtttttaaaat

SEQ ID NO: 6015603 - DNA, 21 bp, Homo sapiens
cagtttttaaaattggccttt

SEQ ID NO: 6015604 - DNA, 14 bp, Homo sapiens
cagtttttaagcta

SEQ ID NO: 6015605 - DNA, 12 bp, Homo sapiens
cagtttttaatt

SEQ ID NO: 6015606 - DNA, 13 bp, Homo sapiens
cagtttttattaa

SEQ ID NO: 6015607 - DNA, 15 bp, Homo sapiens
cagtttttattgctt

SEQ ID NO: 6015608 - DNA, 13 bp, Homo sapiens
cagtttttcactt

SEQ ID NO: 6015609 - DNA, 23 bp, Homo sapiens
cagtttttcataagatattttat

SEQ ID NO: 6015610 - DNA, 19 bp, Homo sapiens
cagtttttcatttgttttg

SEQ ID NO: 6015611 - DNA, 13 bp, Homo sapiens
cagtttttccccc

SEQ ID NO: 6015612 - DNA, 11 bp, Homo sapiens
cagtttttcct

SEQ ID NO: 6015613 - DNA, 12 bp, Homo sapiens
cagtttttcctc

SEQ ID NO: 6015614 - DNA, 16 bp, Homo sapiens
cagtttttctgtattt

SEQ ID NO: 6015615 - DNA, 18 bp, Homo sapiens
cagtttttctgtatttta

SEQ ID NO: 6015616 - DNA, 14 bp, Homo sapiens
cagtttttgaaaga

SEQ ID NO: 6015617 - DNA, 16 bp, Homo sapiens
cagtttttgacattta

SEQ ID NO: 6015618 - DNA, 22 bp, Homo sapiens
cagtttttgacatttatattaa

SEQ ID NO: 6015619 - DNA, 20 bp, Homo sapiens
cagtttttgtttttgcatga

SEQ ID NO: 6015620 - DNA, 22 bp, Homo sapiens
cagtttttgtttttgcatgaaa

SEQ ID NO: 6015621 - DNA, 15 bp, Homo sapiens
cagttttttggaaga

SEQ ID NO: 6015622 - DNA, 15 bp, Homo sapiens
cagttttttgtaact

SEQ ID NO: 6015623 - DNA, 21 bp, Homo sapiens
cagttttttttttcttgtcta

SEQ ID NO: 6015624 - DNA, 20 bp, Homo sapiens
cataaaaaaattagtcaggt

SEQ ID NO: 6015625 - DNA, 12 bp, Homo sapiens
cataaaaaataa

SEQ ID NO: 6015626 - DNA, 20 bp, Homo sapiens
cataaaaacaactttatacc

SEQ ID NO: 6015627 - DNA, 23 bp, Homo sapiens
cataaaaagaggatgatttcaga

SEQ ID NO: 6015628 - DNA, 14 bp, Homo sapiens
cataaaaagcagaa

SEQ ID NO: 6015629 - DNA, 23 bp, Homo sapiens
cataaaaagcctgcaatttcata

SEQ ID NO: 6015630 - DNA, 13 bp, Homo sapiens
cataaaaagctga

SEQ ID NO: 6015631 - DNA, 14 bp, Homo sapiens
cataaaaagttaaa

SEQ ID NO: 6015632 - DNA, 18 bp, Homo sapiens
cataaaaagttaaaaaaa

SEQ ID NO: 6015633 - DNA, 13 bp, Homo sapiens
cataaaaataacc

SEQ ID NO: 6015634 - DNA, 16 bp, Homo sapiens
cataaaaataaccaaa

SEQ ID NO: 6015635 - DNA, 21 bp, Homo sapiens
cataaaaataaccaaaaaatg

SEQ ID NO: 6015636 - DNA, 21 bp, Homo sapiens
cataaaaattagccaagtgtg

SEQ ID NO: 6015637 - DNA, 22 bp, Homo sapiens
cataaaacaaaaccaagccttg

SEQ ID NO: 6015638 - DNA, 20 bp, Homo sapiens
cataaaacacccttgaaaat

SEQ ID NO: 6015639 - DNA, 13 bp, Homo sapiens
cataaaacagaat

SEQ ID NO: 6015640 - DNA, 12 bp, Homo sapiens
cataaaacttta

SEQ ID NO: 6015641 - DNA, 13 bp, Homo sapiens
cataaaactttaa

SEQ ID NO: 6015642 - DNA, 14 bp, Homo sapiens
cataaaactttaaa

SEQ ID NO: 6015643 - DNA, 19 bp, Homo sapiens
cataaaactttaaaaggca

SEQ ID NO: 6015644 - DNA, 16 bp, Homo sapiens
cataaaagaaataaac

SEQ ID NO: 6015645 - DNA, 16 bp, Homo sapiens
cataaaagaagtttca

SEQ ID NO: 6015646 - DNA, 19 bp, Homo sapiens
cataaaagaatatttagaa

SEQ ID NO: 6015647 - DNA, 21 bp, Homo sapiens
cataaaagatcaccttgtatt

SEQ ID NO: 6015648 - DNA, 16 bp, Homo sapiens
cataaaagcattgtct

SEQ ID NO: 6015649 - DNA, 17 bp, Homo sapiens
cataaaagccccagctt

SEQ ID NO: 6015650 - DNA, 21 bp, Homo sapiens
cataaaagggtcaaacctgta

SEQ ID NO: 6015651 - DNA, 21 bp, Homo sapiens
cataaaaggtgacccttctgt

SEQ ID NO: 6015652 - DNA, 19 bp, Homo sapiens
cataaaagtgattcttttt

SEQ ID NO: 6015653 - DNA, 17 bp, Homo sapiens
cataaaagtgctacttg

SEQ ID NO: 6015654 - DNA, 9 bp, Homo sapiens
cataaaata

SEQ ID NO: 6015655 - DNA, 21 bp, Homo sapiens
cataaaatagaataattcttt

SEQ ID NO: 6015656 - DNA, 12 bp, Homo sapiens
cataaaatatac

SEQ ID NO: 6015657 - DNA, 20 bp, Homo sapiens
cataaaatatacaaacatgt

SEQ ID NO: 6015658 - DNA, 22 bp, Homo sapiens
cataaaatcaaaacaagtgaaa

SEQ ID NO: 6015659 - DNA, 21 bp, Homo sapiens
cataaaatccaatattgtaat

SEQ ID NO: 6015660 - DNA, 17 bp, Homo sapiens
cataaaatcgctttcaa

SEQ ID NO: 6015661 - DNA, 15 bp, Homo sapiens
cataaaatctcacgc

SEQ ID NO: 6015662 - DNA, 12 bp, Homo sapiens
cataaaatctgt

SEQ ID NO: 6015663 - DNA, 17 bp, Homo sapiens
cataaaatgctatttta

SEQ ID NO: 6015664 - DNA, 18 bp, Homo sapiens
cataaaatgctattttaa

SEQ ID NO: 6015665 - DNA, 17 bp, Homo sapiens
cataaaattgcagtttc

SEQ ID NO: 6015666 - DNA, 16 bp, Homo sapiens
cataaaattggattac

SEQ ID NO: 6015667 - DNA, 20 bp, Homo sapiens
cataaaattggattacagta

SEQ ID NO: 6015668 - DNA, 16 bp, Homo sapiens
cataaaatttacattt

SEQ ID NO: 6015669 - DNA, 12 bp, Homo sapiens
cataaacaaaga

SEQ ID NO: 6015670 - DNA, 14 bp, Homo sapiens
cataaacaaagaca

SEQ ID NO: 6015671 - DNA, 16 bp, Homo sapiens
cataaacaaagacatt

SEQ ID NO: 6015672 - DNA, 20 bp, Homo sapiens
cataaacaagaccacgtttc

SEQ ID NO: 6015673 - DNA, 21 bp, Homo sapiens
cataaacaattcatgcctttc

SEQ ID NO: 6015674 - DNA, 12 bp, Homo sapiens
cataaacacatt

SEQ ID NO: 6015675 - DNA, 14 bp, Homo sapiens
cataaacacatttc

SEQ ID NO: 6015676 - DNA, 21 bp, Homo sapiens
cataaacacttctccttaacc

SEQ ID NO: 6015677 - DNA, 20 bp, Homo sapiens
cataaacagcacacctgtgt

SEQ ID NO: 6015678 - DNA, 23 bp, Homo sapiens
cataaacagcacacctgtgtcca

SEQ ID NO: 6015679 - DNA, 11 bp, Homo sapiens
cataaacatca

SEQ ID NO: 6015680 - DNA, 15 bp, Homo sapiens
cataaacatttgcca

SEQ ID NO: 6015681 - DNA, 22 bp, Homo sapiens
cataaacatttgccaaaaattc

SEQ ID NO: 6015682 - DNA, 20 bp, Homo sapiens
cataaaccatttttgttact

SEQ ID NO: 6015683 - DNA, 21 bp, Homo sapiens
cataaacccagttgccatctg

SEQ ID NO: 6015684 - DNA, 18 bp, Homo sapiens
cataaacccatctgtaat

SEQ ID NO: 6015685 - DNA, 14 bp, Homo sapiens
cataaaccttaagt

SEQ ID NO: 6015686 - DNA, 20 bp, Homo sapiens
cataaaccttaagtaagcaa

SEQ ID NO: 6015687 - DNA, 17 bp, Homo sapiens
cataaacggttcctggt

SEQ ID NO: 6015688 - DNA, 15 bp, Homo sapiens
cataaactaaaaact

SEQ ID NO: 6015689 - DNA, 18 bp, Homo sapiens
cataaactgtacaaatga

SEQ ID NO: 6015690 - DNA, 14 bp, Homo sapiens
cataaactgtgtgc

SEQ ID NO: 6015691 - DNA, 18 bp, Homo sapiens
cataaactttataaattc

SEQ ID NO: 6015692 - DNA, 21 bp, Homo sapiens
cataaagaagcaataaagaag

SEQ ID NO: 6015693 - DNA, 22 bp, Homo sapiens
cataaagaatttgtcacaggaa

SEQ ID NO: 6015694 - DNA, 19 bp, Homo sapiens
cataaagacaatcactgcc

SEQ ID NO: 6015695 - DNA, 21 bp, Homo sapiens
cataaagactgtgctgagaag

SEQ ID NO: 6015696 - DNA, 13 bp, Homo sapiens
cataaagcaaata

SEQ ID NO: 6015697 - DNA, 15 bp, Homo sapiens
cataaagcaccagca

SEQ ID NO: 6015698 - DNA, 16 bp, Homo sapiens
cataaagcaggcagaa

SEQ ID NO: 6015699 - DNA, 22 bp, Homo sapiens
cataaagccatgtttcctcttt

SEQ ID NO: 6015700 - DNA, 21 bp, Homo sapiens
cataaagccttggatgtatat

SEQ ID NO: 6015701 - DNA, 13 bp, Homo sapiens
cataaagccttta

SEQ ID NO: 6015702 - DNA, 21 bp, Homo sapiens
cataaagcctttaaaaccagt

SEQ ID NO: 6015703 - DNA, 17 bp, Homo sapiens
cataaagctcaaatgaa

SEQ ID NO: 6015704 - DNA, 20 bp, Homo sapiens
cataaagctcaaatgaaatg

SEQ ID NO: 6015705 - DNA, 23 bp, Homo sapiens
cataaaggataaacttttagaaa

SEQ ID NO: 6015706 - DNA, 16 bp, Homo sapiens
cataaaggatatttca

SEQ ID NO: 6015707 - DNA, 19 bp, Homo sapiens
cataaaggatatttcaaat

SEQ ID NO: 6015708 - DNA, 15 bp, Homo sapiens
cataaagggttgaaa

SEQ ID NO: 6015709 - DNA, 23 bp, Homo sapiens
cataaaggtggtatgtgtgtgta

SEQ ID NO: 6015710 - DNA, 15 bp, Homo sapiens
cataaagtaaatgct

SEQ ID NO: 6015711 - DNA, 14 bp, Homo sapiens
cataaagtaataac

SEQ ID NO: 6015712 - DNA, 18 bp, Homo sapiens
cataaagtacaaatgaag

SEQ ID NO: 6015713 - DNA, 16 bp, Homo sapiens
cataaagtatgccttc

SEQ ID NO: 6015714 - DNA, 11 bp, Homo sapiens
cataaagtcag

SEQ ID NO: 6015715 - DNA, 17 bp, Homo sapiens
cataaagtcatcaaagt

SEQ ID NO: 6015716 - DNA, 17 bp, Homo sapiens
cataaagtctgagaaat

SEQ ID NO: 6015717 - DNA, 18 bp, Homo sapiens
cataaagtctgagaaata

SEQ ID NO: 6015718 - DNA, 19 bp, Homo sapiens
cataaagtctgagaaatag

SEQ ID NO: 6015719 - DNA, 17 bp, Homo sapiens
cataaagtgagaaaact

SEQ ID NO: 6015720 - DNA, 14 bp, Homo sapiens
cataaagtgtaatt

SEQ ID NO: 6015721 - DNA, 20 bp, Homo sapiens
cataaagttctctgtaatta

SEQ ID NO: 6015722 - DNA, 14 bp, Homo sapiens
cataaagttgtatt

SEQ ID NO: 6015723 - DNA, 16 bp, Homo sapiens
cataaataaaactgaa

SEQ ID NO: 6015724 - DNA, 13 bp, Homo sapiens
cataaataaaaga

SEQ ID NO: 6015725 - DNA, 15 bp, Homo sapiens
cataaataaaagtac

SEQ ID NO: 6015726 - DNA, 18 bp, Homo sapiens
cataaataaaagtacagt

SEQ ID NO: 6015727 - DNA, 14 bp, Homo sapiens
cataaataaaatga

SEQ ID NO: 6015728 - DNA, 15 bp, Homo sapiens
cataaataaagtttc

SEQ ID NO: 6015729 - DNA, 19 bp, Homo sapiens
cataaatacaaaaatgaat

SEQ ID NO: 6015730 - DNA, 15 bp, Homo sapiens
cataaatagagtgtt

SEQ ID NO: 6015731 - DNA, 23 bp, Homo sapiens
cataaatagtaaataatgattca

SEQ ID NO: 6015732 - DNA, 17 bp, Homo sapiens
cataaatagtagaaaaa

SEQ ID NO: 6015733 - DNA, 20 bp, Homo sapiens
cataaatcaatggttcaagt

SEQ ID NO: 6015734 - DNA, 21 bp, Homo sapiens
cataaatcaattcatgtttaa

SEQ ID NO: 6015735 - DNA, 18 bp, Homo sapiens
cataaatctgaagtggtt

SEQ ID NO: 6015736 - DNA, 18 bp, Homo sapiens
cataaatctgtgaacttg

SEQ ID NO: 6015737 - DNA, 13 bp, Homo sapiens
cataaatgaagca

SEQ ID NO: 6015738 - DNA, 15 bp, Homo sapiens
cataaatgcagccca

SEQ ID NO: 6015739 - DNA, 21 bp, Homo sapiens
cataaatgcagcccatttctc

SEQ ID NO: 6015740 - DNA, 19 bp, Homo sapiens
cataaatgcataatttatg

SEQ ID NO: 6015741 - DNA, 20 bp, Homo sapiens
cataaatgcataatttatgg

SEQ ID NO: 6015742 - DNA, 23 bp, Homo sapiens
cataaatgcccagcacaattcat

SEQ ID NO: 6015743 - DNA, 22 bp, Homo sapiens
cataaatgtcacaataaaacaa

SEQ ID NO: 6015744 - DNA, 16 bp, Homo sapiens
cataaatgtgttcctg

SEQ ID NO: 6015745 - DNA, 14 bp, Homo sapiens
cataaatgttcact

SEQ ID NO: 6015746 - DNA, 15 bp, Homo sapiens
cataaattaaaatgt

SEQ ID NO: 6015747 - DNA, 12 bp, Homo sapiens
cataaattacag

SEQ ID NO: 6015748 - DNA, 14 bp, Homo sapiens
cataaattactgtt

SEQ ID NO: 6015749 - DNA, 11 bp, Homo sapiens
cataaattatt

SEQ ID NO: 6015750 - DNA, 17 bp, Homo sapiens
cagccacacttctcagg

SEQ ID NO: 6015751 - DNA, 19 bp, Homo sapiens
cagccacacttctcaggac

SEQ ID NO: 6015752 - DNA, 13 bp, Homo sapiens
cagccacagagca

SEQ ID NO: 6015753 - DNA, 14 bp, Homo sapiens
cagccacaggacca

SEQ ID NO: 6015754 - DNA, 12 bp, Homo sapiens
cagccacaggcc

SEQ ID NO: 6015755 - DNA, 14 bp, Homo sapiens
cagccacagggagc

SEQ ID NO: 6015756 - DNA, 23 bp, Homo sapiens
cagccacagtacatatgtaattc

SEQ ID NO: 6015757 - DNA, 21 bp, Homo sapiens
cagccacagtgttatgctctg

SEQ ID NO: 6015758 - DNA, 23 bp, Homo sapiens
cagccacagtttcctcatctgtc

SEQ ID NO: 6015759 - DNA, 13 bp, Homo sapiens
cagccacatcccc

SEQ ID NO: 6015760 - DNA, 15 bp, Homo sapiens
cagccacatgggaaa

SEQ ID NO: 6015761 - DNA, 14 bp, Homo sapiens
cagccacattcctg

SEQ ID NO: 6015762 - DNA, 16 bp, Homo sapiens
cagccaccaccactgt

SEQ ID NO: 6015763 - DNA, 20 bp, Homo sapiens
cagccaccaccctcaggtgc

SEQ ID NO: 6015764 - DNA, 23 bp, Homo sapiens
cagccaccaccctcaggtgcctc

SEQ ID NO: 6015765 - DNA, 14 bp, Homo sapiens
cagccaccacctgg

SEQ ID NO: 6015766 - DNA, 15 bp, Homo sapiens
cagccacccagccag

SEQ ID NO: 6015767 - DNA, 18 bp, Homo sapiens
cagccaccccatgctggc

SEQ ID NO: 6015768 - DNA, 19 bp, Homo sapiens
cagccaccccatgctggcc

SEQ ID NO: 6015769 - DNA, 20 bp, Homo sapiens
cagccaccccatgctggcct

SEQ ID NO: 6015770 - DNA, 15 bp, Homo sapiens
cagccacccctcaga

SEQ ID NO: 6015771 - DNA, 13 bp, Homo sapiens
cagccacccctcc

SEQ ID NO: 6015772 - DNA, 18 bp, Homo sapiens
cagccacccctgccactc

SEQ ID NO: 6015773 - DNA, 19 bp, Homo sapiens
cagccacccggatctccag

SEQ ID NO: 6015774 - DNA, 12 bp, Homo sapiens
cagccaccctca

SEQ ID NO: 6015775 - DNA, 13 bp, Homo sapiens
cagccaccctcac

SEQ ID NO: 6015776 - DNA, 15 bp, Homo sapiens
cagccaccctgagga

SEQ ID NO: 6015777 - DNA, 19 bp, Homo sapiens
cagccaccctgaggagtct

SEQ ID NO: 6015778 - DNA, 22 bp, Homo sapiens
cagccaccctgaggagtctgag

SEQ ID NO: 6015779 - DNA, 14 bp, Homo sapiens
cagccaccctgagt

SEQ ID NO: 6015780 - DNA, 13 bp, Homo sapiens
cagccaccctgcc

SEQ ID NO: 6015781 - DNA, 14 bp, Homo sapiens
cagccaccctgcca

SEQ ID NO: 6015782 - DNA, 18 bp, Homo sapiens
cagccaccctgccatgga

SEQ ID NO: 6015783 - DNA, 21 bp, Homo sapiens
cagccaccgaagccgcctgtg

SEQ ID NO: 6015784 - DNA, 22 bp, Homo sapiens
cagccaccgtttcttcctgcca

SEQ ID NO: 6015785 - DNA, 21 bp, Homo sapiens
cagccacctccacccccaaga

SEQ ID NO: 6015786 - DNA, 12 bp, Homo sapiens
cagccacctccg

SEQ ID NO: 6015787 - DNA, 16 bp, Homo sapiens
cagccacctccgccag

SEQ ID NO: 6015788 - DNA, 16 bp, Homo sapiens
cagccacctctctttt

SEQ ID NO: 6015789 - DNA, 13 bp, Homo sapiens
cagccaccttcct

SEQ ID NO: 6015790 - DNA, 22 bp, Homo sapiens
cagccaccttcctgactgggaa

SEQ ID NO: 6015791 - DNA, 18 bp, Homo sapiens
cagccacgaccagcccct

SEQ ID NO: 6015792 - DNA, 22 bp, Homo sapiens
cagccacgaccagccccttcct

SEQ ID NO: 6015793 - DNA, 15 bp, Homo sapiens
cagccacgaggtggt

SEQ ID NO: 6015794 - DNA, 17 bp, Homo sapiens
cagccacgattggagaa

SEQ ID NO: 6015795 - DNA, 16 bp, Homo sapiens
cagccacgcagggcca

SEQ ID NO: 6015796 - DNA, 23 bp, Homo sapiens
cagccacgcagggccatccactg

SEQ ID NO: 6015797 - DNA, 16 bp, Homo sapiens
cagccacgcctctctc

SEQ ID NO: 6015798 - DNA, 20 bp, Homo sapiens
cagccacgcctctctcagcc

SEQ ID NO: 6015799 - DNA, 16 bp, Homo sapiens
cagccacggagggagg

SEQ ID NO: 6015800 - DNA, 23 bp, Homo sapiens
cagccacggagggaggcaccatg

SEQ ID NO: 6015801 - DNA, 14 bp, Homo sapiens
cagccacggccccg

SEQ ID NO: 6015802 - DNA, 22 bp, Homo sapiens
cagccacgggcacaagacccct

SEQ ID NO: 6015803 - DNA, 14 bp, Homo sapiens
cagccactccaagc

SEQ ID NO: 6015804 - DNA, 14 bp, Homo sapiens
cagccactccccag

SEQ ID NO: 6015805 - DNA, 20 bp, Homo sapiens
cagccactccccagccagcc

SEQ ID NO: 6015806 - DNA, 16 bp, Homo sapiens
cagccactccccggca

SEQ ID NO: 6015807 - DNA, 23 bp, Homo sapiens
cagccactcgggaggctgagaca

SEQ ID NO: 6015808 - DNA, 13 bp, Homo sapiens
cagccactgattc

SEQ ID NO: 6015809 - DNA, 22 bp, Homo sapiens
cagccactggaggggtcatcct

SEQ ID NO: 6015810 - DNA, 16 bp, Homo sapiens
cagccacttaggacaa

SEQ ID NO: 6015811 - DNA, 19 bp, Homo sapiens
cagccacttggcctcacta

SEQ ID NO: 6015812 - DNA, 20 bp, Homo sapiens
cagccagaaagcactacaat

SEQ ID NO: 6015813 - DNA, 12 bp, Homo sapiens
cagccagaaagg

SEQ ID NO: 6015814 - DNA, 13 bp, Homo sapiens
cagccagaaagga

SEQ ID NO: 6015815 - DNA, 22 bp, Homo sapiens
cagccagaacgtggctctgctg

SEQ ID NO: 6015816 - DNA, 12 bp, Homo sapiens
cagccagaagcc

SEQ ID NO: 6015817 - DNA, 17 bp, Homo sapiens
cagccagaagcctctgc

SEQ ID NO: 6015818 - DNA, 16 bp, Homo sapiens
cagccagaccagcagg

SEQ ID NO: 6015819 - DNA, 22 bp, Homo sapiens
cagccagacctattcctcctgg

SEQ ID NO: 6015820 - DNA, 15 bp, Homo sapiens
cagccagactggcac

SEQ ID NO: 6015821 - DNA, 16 bp, Homo sapiens
cagccagagctgggtg

SEQ ID NO: 6015822 - DNA, 24 bp, Homo sapiens
cagccagagctgtgcctgctcagc

SEQ ID NO: 6015823 - DNA, 20 bp, Homo sapiens
cagccagaggaaccagcact

SEQ ID NO: 6015824 - DNA, 18 bp, Homo sapiens
cagccagaggagggcaga

SEQ ID NO: 6015825 - DNA, 21 bp, Homo sapiens
cagccagaggagggcagaggg

SEQ ID NO: 6015826 - DNA, 18 bp, Homo sapiens
cagccagaggtggagcca

SEQ ID NO: 6015827 - DNA, 19 bp, Homo sapiens
cagccagagttcctgcgga

SEQ ID NO: 6015828 - DNA, 17 bp, Homo sapiens
cagccagatccccaggg

SEQ ID NO: 6015829 - DNA, 19 bp, Homo sapiens
cagccagatccccagggca

SEQ ID NO: 6015830 - DNA, 22 bp, Homo sapiens
cagccagatccccagggcagcc

SEQ ID NO: 6015831 - DNA, 13 bp, Homo sapiens
cagccagcaatga

SEQ ID NO: 6015832 - DNA, 22 bp, Homo sapiens
cagccagcaatgatgtccagaa

SEQ ID NO: 6015833 - DNA, 15 bp, Homo sapiens
cagccagcaccacct

SEQ ID NO: 6015834 - DNA, 15 bp, Homo sapiens
cagccagcacccacc

SEQ ID NO: 6015835 - DNA, 16 bp, Homo sapiens
cagccagcacctggca

SEQ ID NO: 6015836 - DNA, 12 bp, Homo sapiens
cagccagcagag

SEQ ID NO: 6015837 - DNA, 15 bp, Homo sapiens
cagccagcagagggg

SEQ ID NO: 6015838 - DNA, 11 bp, Homo sapiens
cagccagcagc

SEQ ID NO: 6015839 - DNA, 13 bp, Homo sapiens
cagccagcagcag

SEQ ID NO: 6015840 - DNA, 14 bp, Homo sapiens
cagccagcagccag

SEQ ID NO: 6015841 - DNA, 19 bp, Homo sapiens
cagccagcagccagctctc

SEQ ID NO: 6015842 - DNA, 23 bp, Homo sapiens
cagccagcaggttctctcctgtg

SEQ ID NO: 6015843 - DNA, 23 bp, Homo sapiens
cagccagcagttcagagctgccc

SEQ ID NO: 6015844 - DNA, 14 bp, Homo sapiens
cagccagccaggaa

SEQ ID NO: 6015845 - DNA, 13 bp, Homo sapiens
cagccagccagtc

SEQ ID NO: 6015846 - DNA, 17 bp, Homo sapiens
cagccagccagtcttgc

SEQ ID NO: 6015847 - DNA, 14 bp, Homo sapiens
cagccagcccagcc

SEQ ID NO: 6015848 - DNA, 20 bp, Homo sapiens
cagccagcccagcccagctg

SEQ ID NO: 6015849 - DNA, 21 bp, Homo sapiens
cagccagcccagctccactca

SEQ ID NO: 6015850 - DNA, 13 bp, Homo sapiens
cagccagccctgc

SEQ ID NO: 6015851 - DNA, 15 bp, Homo sapiens
cagccagccctgcct

SEQ ID NO: 6015852 - DNA, 19 bp, Homo sapiens
cagccagccctggaggctg

SEQ ID NO: 6015853 - DNA, 12 bp, Homo sapiens
cagccagccctt

SEQ ID NO: 6015854 - DNA, 20 bp, Homo sapiens
cagccagcccttcccaggcc

SEQ ID NO: 6015855 - DNA, 23 bp, Homo sapiens
cagccagcccttcccaggccagc

SEQ ID NO: 6015856 - DNA, 14 bp, Homo sapiens
cagccagccgccct

SEQ ID NO: 6015857 - DNA, 17 bp, Homo sapiens
cagccagccgccctggg

SEQ ID NO: 6015858 - DNA, 19 bp, Homo sapiens
cagccagccgccctgggct

SEQ ID NO: 6015859 - DNA, 23 bp, Homo sapiens
cagccagccgccctgggctgtct

SEQ ID NO: 6015860 - DNA, 18 bp, Homo sapiens
cagccagccgtggccaga

SEQ ID NO: 6015861 - DNA, 22 bp, Homo sapiens
cagccagcctcagaaggcccca

SEQ ID NO: 6015862 - DNA, 19 bp, Homo sapiens
cagccagcctcgcccatcc

SEQ ID NO: 6015863 - DNA, 13 bp, Homo sapiens
cagccagcctggc

SEQ ID NO: 6015864 - DNA, 14 bp, Homo sapiens
cagccagcctggct

SEQ ID NO: 6015865 - DNA, 16 bp, Homo sapiens
cagccagcctggctgg

SEQ ID NO: 6015866 - DNA, 16 bp, Homo sapiens
cagccagcgcctccct

SEQ ID NO: 6015867 - DNA, 18 bp, Homo sapiens
cagccagcgcctccctcc

SEQ ID NO: 6015868 - DNA, 19 bp, Homo sapiens
cagccagcgtcggtctgtg

SEQ ID NO: 6015869 - DNA, 22 bp, Homo sapiens
cagccagcgtcggtctgtgccc

SEQ ID NO: 6015870 - DNA, 15 bp, Homo sapiens
cagccagctacaggc

SEQ ID NO: 6015871 - DNA, 15 bp, Homo sapiens
cagccagctcctggg

SEQ ID NO: 6015872 - DNA, 12 bp, Homo sapiens
cagccagctctc

SEQ ID NO: 6015873 - DNA, 12 bp, Homo sapiens
cagccagctgca

SEQ ID NO: 6015874 - DNA, 14 bp, Homo sapiens
cagccagctgcagg

SEQ ID NO: 6015875 - DNA, 16 bp, Homo sapiens
cagccagctgcagggc

SEQ ID NO: 6015876 - DNA, 23 bp, Homo sapiens
cagccagctgcagggcacgggga

SEQ ID NO: 6015877 - DNA, 18 bp, Homo sapiens
cagccaggaactggctcc

SEQ ID NO: 6015878 - DNA, 22 bp, Homo sapiens
cagccaggaactggctcctttg

SEQ ID NO: 6015879 - DNA, 20 bp, Homo sapiens
cagccaggacaccgggcagg

SEQ ID NO: 6015880 - DNA, 22 bp, Homo sapiens
cagccaggacagtcagctctct

SEQ ID NO: 6015881 - DNA, 11 bp, Homo sapiens
cagccaggacc

SEQ ID NO: 6015882 - DNA, 17 bp, Homo sapiens
cagccaggacccgcctg

SEQ ID NO: 6015883 - DNA, 21 bp, Homo sapiens
cagccaggacccgcctgctcc

SEQ ID NO: 6015884 - DNA, 17 bp, Homo sapiens
cagccaggagaaggtca

SEQ ID NO: 6015885 - DNA, 22 bp, Homo sapiens
cagccaggagaaggtcagcgag

SEQ ID NO: 6015886 - DNA, 18 bp, Homo sapiens
cagccaggagagcttagg

SEQ ID NO: 6015887 - DNA, 12 bp, Homo sapiens
cagccaggagct

SEQ ID NO: 6015888 - DNA, 22 bp, Homo sapiens
cagccaggagctgggcagaagg

SEQ ID NO: 6015889 - DNA, 18 bp, Homo sapiens
cagccaggagctgtcacc

SEQ ID NO: 6015890 - DNA, 11 bp, Homo sapiens
cagccaggagg

SEQ ID NO: 6015891 - DNA, 14 bp, Homo sapiens
cagccaggaggaga

SEQ ID NO: 6015892 - DNA, 13 bp, Homo sapiens
cagccaggaggga

SEQ ID NO: 6015893 - DNA, 21 bp, Homo sapiens
cagccaggagtgcccccggga

SEQ ID NO: 6015894 - DNA, 15 bp, Homo sapiens
cagccaggagtgggt

SEQ ID NO: 6015895 - DNA, 12 bp, Homo sapiens
cagccaggccac

SEQ ID NO: 6015896 - DNA, 14 bp, Homo sapiens
cagccaggcccagg

SEQ ID NO: 6015897 - DNA, 16 bp, Homo sapiens
cagccaggcccaggcc

SEQ ID NO: 6015898 - DNA, 20 bp, Homo sapiens
cagccaggcccaggccagcc

SEQ ID NO: 6015899 - DNA, 13 bp, Homo sapiens
cagccaggcctcg

SEQ ID NO: 6015900 - DNA, 18 bp, Homo sapiens
cagccaggcctcgcctgc

SEQ ID NO: 6015901 - DNA, 24 bp, Homo sapiens
cagccaggcctcgcctgccctcct

SEQ ID NO: 6015902 - DNA, 12 bp, Homo sapiens
cagccaggcggg

SEQ ID NO: 6015903 - DNA, 18 bp, Homo sapiens
cagccaggcgggctcaag

SEQ ID NO: 6015904 - DNA, 19 bp, Homo sapiens
cagccaggcgggctcaagg

SEQ ID NO: 6015905 - DNA, 13 bp, Homo sapiens
cagccaggctcct

SEQ ID NO: 6015906 - DNA, 23 bp, Homo sapiens
cagccaggctctgtgctgaccct

SEQ ID NO: 6015907 - DNA, 19 bp, Homo sapiens
cagccaggctgcacagcat

SEQ ID NO: 6015908 - DNA, 16 bp, Homo sapiens
cagccaggctgccaag

SEQ ID NO: 6015909 - DNA, 22 bp, Homo sapiens
cagccagggaaagactggcaag

SEQ ID NO: 6015910 - DNA, 23 bp, Homo sapiens
cagccagggaaagactggcaaga

SEQ ID NO: 6015911 - DNA, 14 bp, Homo sapiens
cagccagggaaggc

SEQ ID NO: 6015912 - DNA, 14 bp, Homo sapiens
cagccagggacccc

SEQ ID NO: 6015913 - DNA, 14 bp, Homo sapiens
cagccagggagagc

SEQ ID NO: 6015914 - DNA, 15 bp, Homo sapiens
cagccagggagagcc

SEQ ID NO: 6015915 - DNA, 17 bp, Homo sapiens
cagccagggagagccca

SEQ ID NO: 6015916 - DNA, 19 bp, Homo sapiens
cagccagggagagcccagg

SEQ ID NO: 6015917 - DNA, 24 bp, Homo sapiens
cagccagggagagcccaggagctc

SEQ ID NO: 6015918 - DNA, 12 bp, Homo sapiens
cagccagggagc

SEQ ID NO: 6015919 - DNA, 12 bp, Homo sapiens
cagccagggcca

SEQ ID NO: 6015920 - DNA, 13 bp, Homo sapiens
cagccagggctgc

SEQ ID NO: 6015921 - DNA, 14 bp, Homo sapiens
cagccagggctggg

SEQ ID NO: 6015922 - DNA, 16 bp, Homo sapiens
cagccagggctggggt

SEQ ID NO: 6015923 - DNA, 18 bp, Homo sapiens
cagccagggctggggttg

SEQ ID NO: 6015924 - DNA, 15 bp, Homo sapiens
cagccaggggagcag

SEQ ID NO: 6015925 - DNA, 17 bp, Homo sapiens
cagccaggggctgctca

SEQ ID NO: 6015926 - DNA, 21 bp, Homo sapiens
cagccaggggctgctcatcac

SEQ ID NO: 6015927 - DNA, 13 bp, Homo sapiens
cagccaggtgcat

SEQ ID NO: 6015928 - DNA, 14 bp, Homo sapiens
cagccaggtgcctt

SEQ ID NO: 6015929 - DNA, 16 bp, Homo sapiens
cagccaggtgccttgg

SEQ ID NO: 6015930 - DNA, 12 bp, Homo sapiens
cataaattattt

SEQ ID NO: 6015931 - DNA, 14 bp, Homo sapiens
cataaattatttct

SEQ ID NO: 6015932 - DNA, 17 bp, Homo sapiens
cataaattatttgatta

SEQ ID NO: 6015933 - DNA, 20 bp, Homo sapiens
cataaattccagaggactct

SEQ ID NO: 6015934 - DNA, 19 bp, Homo sapiens
cataaattggcctctgtat

SEQ ID NO: 6015935 - DNA, 12 bp, Homo sapiens
cataaattggct

SEQ ID NO: 6015936 - DNA, 21 bp, Homo sapiens
cataaattggctcctttccca

SEQ ID NO: 6015937 - DNA, 22 bp, Homo sapiens
cataaattggctcctttcccac

SEQ ID NO: 6015938 - DNA, 14 bp, Homo sapiens
cataaattgtaatt

SEQ ID NO: 6015939 - DNA, 16 bp, Homo sapiens
cataaattgtaatttg

SEQ ID NO: 6015940 - DNA, 15 bp, Homo sapiens
cataaatttaatgta

SEQ ID NO: 6015941 - DNA, 19 bp, Homo sapiens
cataaatttagtattttgt

SEQ ID NO: 6015942 - DNA, 17 bp, Homo sapiens
cataaatttattatatt

SEQ ID NO: 6015943 - DNA, 22 bp, Homo sapiens
cataaatttccacccaatttcc

SEQ ID NO: 6015944 - DNA, 13 bp, Homo sapiens
cataaatttgtaa

SEQ ID NO: 6015945 - DNA, 18 bp, Homo sapiens
cataaatttgtaatatat

SEQ ID NO: 6015946 - DNA, 17 bp, Homo sapiens
cataaattttaattcaa

SEQ ID NO: 6015947 - DNA, 21 bp, Homo sapiens
cataaattttaattcaagaaa

SEQ ID NO: 6015948 - DNA, 12 bp, Homo sapiens
cataaatttttt

SEQ ID NO: 6015949 - DNA, 13 bp, Homo sapiens
cataacaatgtat

SEQ ID NO: 6015950 - DNA, 17 bp, Homo sapiens
cataacaattcctctac

SEQ ID NO: 6015951 - DNA, 21 bp, Homo sapiens
cataacaccgtcccagggctc

SEQ ID NO: 6015952 - DNA, 19 bp, Homo sapiens
cataacagattatgtatta

SEQ ID NO: 6015953 - DNA, 15 bp, Homo sapiens
cataacagcgtttat

SEQ ID NO: 6015954 - DNA, 22 bp, Homo sapiens
cataacaggcattgcactaaaa

SEQ ID NO: 6015955 - DNA, 13 bp, Homo sapiens
cataacagtgcag

SEQ ID NO: 6015956 - DNA, 16 bp, Homo sapiens
cataacagtgcagggc

SEQ ID NO: 6015957 - DNA, 19 bp, Homo sapiens
cataacagtgccattgtct

SEQ ID NO: 6015958 - DNA, 20 bp, Homo sapiens
cataacatagtttttcatca

SEQ ID NO: 6015959 - DNA, 15 bp, Homo sapiens
cataacatccagagc

SEQ ID NO: 6015960 - DNA, 14 bp, Homo sapiens
cataacatctttga

SEQ ID NO: 6015961 - DNA, 20 bp, Homo sapiens
cataacatctttgaaaagaa

SEQ ID NO: 6015962 - DNA, 15 bp, Homo sapiens
cataaccaacaatat

SEQ ID NO: 6015963 - DNA, 23 bp, Homo sapiens
cataaccccaggcatcccatccc

SEQ ID NO: 6015964 - DNA, 17 bp, Homo sapiens
cataaccgcacagacat

SEQ ID NO: 6015965 - DNA, 19 bp, Homo sapiens
cataacctctatatcttta

SEQ ID NO: 6015966 - DNA, 12 bp, Homo sapiens
cataacctgtct

SEQ ID NO: 6015967 - DNA, 23 bp, Homo sapiens
cataacctgtctcacctggactt

SEQ ID NO: 6015968 - DNA, 20 bp, Homo sapiens
cataaccttaaaaaggacta

SEQ ID NO: 6015969 - DNA, 22 bp, Homo sapiens
cataacggaaaaataattgcca

SEQ ID NO: 6015970 - DNA, 16 bp, Homo sapiens
cataacgtttttcctt

SEQ ID NO: 6015971 - DNA, 16 bp, Homo sapiens
cataactaaaattaag

SEQ ID NO: 6015972 - DNA, 20 bp, Homo sapiens
cataactaaaattaagtata

SEQ ID NO: 6015973 - DNA, 14 bp, Homo sapiens
cataactaaatttg

SEQ ID NO: 6015974 - DNA, 20 bp, Homo sapiens
cataactaaatttgatactt

SEQ ID NO: 6015975 - DNA, 21 bp, Homo sapiens
cataactaaatttgatactta

SEQ ID NO: 6015976 - DNA, 19 bp, Homo sapiens
cataactagagtatgtgta

SEQ ID NO: 6015977 - DNA, 20 bp, Homo sapiens
cataactagagtatgtgtat

SEQ ID NO: 6015978 - DNA, 23 bp, Homo sapiens
cataactcacacccctgccccca

SEQ ID NO: 6015979 - DNA, 16 bp, Homo sapiens
cataactcctgtccct

SEQ ID NO: 6015980 - DNA, 17 bp, Homo sapiens
cataactcctgtccctt

SEQ ID NO: 6015981 - DNA, 18 bp, Homo sapiens
cataactctgtaaaaaca

SEQ ID NO: 6015982 - DNA, 11 bp, Homo sapiens
cataactgaaa

SEQ ID NO: 6015983 - DNA, 21 bp, Homo sapiens
cataactgacaaatcaagttt

SEQ ID NO: 6015984 - DNA, 13 bp, Homo sapiens
cataactgatcta

SEQ ID NO: 6015985 - DNA, 16 bp, Homo sapiens
cataactgatctattt

SEQ ID NO: 6015986 - DNA, 14 bp, Homo sapiens
cataactgcttctt

SEQ ID NO: 6015987 - DNA, 17 bp, Homo sapiens
cataactggattttgaa

SEQ ID NO: 6015988 - DNA, 19 bp, Homo sapiens
cataacttattgctgattt

SEQ ID NO: 6015989 - DNA, 21 bp, Homo sapiens
cataacttattgctgatttta

SEQ ID NO: 6015990 - DNA, 22 bp, Homo sapiens
cataacttattgctgattttaa

SEQ ID NO: 6015991 - DNA, 15 bp, Homo sapiens
cataacttcagtgca

SEQ ID NO: 6015992 - DNA, 19 bp, Homo sapiens
cataacttctcatgtatat

SEQ ID NO: 6015993 - DNA, 14 bp, Homo sapiens
cataacttgtttgt

SEQ ID NO: 6015994 - DNA, 18 bp, Homo sapiens
cataactttatgaagtgc

SEQ ID NO: 6015995 - DNA, 12 bp, Homo sapiens
cataagaaaaag

SEQ ID NO: 6015996 - DNA, 13 bp, Homo sapiens
cataagacaaaca

SEQ ID NO: 6015997 - DNA, 15 bp, Homo sapiens
cataagacagagaag

SEQ ID NO: 6015998 - DNA, 12 bp, Homo sapiens
cataagaccaat

SEQ ID NO: 6015999 - DNA, 20 bp, Homo sapiens
cataagaccataacagccaa

SEQ ID NO: 6016000 - DNA, 17 bp, Homo sapiens
cataagaccgtgtccca

SEQ ID NO: 6016001 - DNA, 18 bp, Homo sapiens
cataagagaaacctgcca

SEQ ID NO: 6016002 - DNA, 19 bp, Homo sapiens
cataagagaaacctgccaa

SEQ ID NO: 6016003 - DNA, 15 bp, Homo sapiens
cataagagaaatggt

SEQ ID NO: 6016004 - DNA, 18 bp, Homo sapiens
cataagagagatgagaaa

SEQ ID NO: 6016005 - DNA, 13 bp, Homo sapiens
cataagaggttct

SEQ ID NO: 6016006 - DNA, 19 bp, Homo sapiens
cataagatattctttacaa

SEQ ID NO: 6016007 - DNA, 12 bp, Homo sapiens
cataagattaaa

SEQ ID NO: 6016008 - DNA, 20 bp, Homo sapiens
cataagcacagaaatctgaa

SEQ ID NO: 6016009 - DNA, 22 bp, Homo sapiens
cataagcattgctcaagaggaa

SEQ ID NO: 6016010 - DNA, 14 bp, Homo sapiens
cataagccctgaga

SEQ ID NO: 6016011 - DNA, 21 bp, Homo sapiens
cataagccctgagactcccgc

SEQ ID NO: 6016012 - DNA, 13 bp, Homo sapiens
cataagcctcagg

SEQ ID NO: 6016013 - DNA, 18 bp, Homo sapiens
cataagcctcaggcctgg

SEQ ID NO: 6016014 - DNA, 21 bp, Homo sapiens
cataagcctccatttagttct

SEQ ID NO: 6016015 - DNA, 16 bp, Homo sapiens
cataagctaagcctta

SEQ ID NO: 6016016 - DNA, 22 bp, Homo sapiens
cataagctatcacctagcagcc

SEQ ID NO: 6016017 - DNA, 17 bp, Homo sapiens
cataagctatttttcta

SEQ ID NO: 6016018 - DNA, 18 bp, Homo sapiens
cataagctatttttctaa

SEQ ID NO: 6016019 - DNA, 14 bp, Homo sapiens
cataagcttctcaa

SEQ ID NO: 6016020 - DNA, 17 bp, Homo sapiens
cataaggaaactgggtt

SEQ ID NO: 6016021 - DNA, 17 bp, Homo sapiens
cataaggacgtgtgtaa

SEQ ID NO: 6016022 - DNA, 14 bp, Homo sapiens
cataaggagaatgt

SEQ ID NO: 6016023 - DNA, 23 bp, Homo sapiens
cataaggatacacttatttgtca

SEQ ID NO: 6016024 - DNA, 17 bp, Homo sapiens
cataaggccagaaactc

SEQ ID NO: 6016025 - DNA, 22 bp, Homo sapiens
cataaggccagaaactcctttt

SEQ ID NO: 6016026 - DNA, 15 bp, Homo sapiens
cataaggcctgccct

SEQ ID NO: 6016027 - DNA, 21 bp, Homo sapiens
cataaggcctgccctcccatg

SEQ ID NO: 6016028 - DNA, 19 bp, Homo sapiens
cataaggcttcaaaatgtt

SEQ ID NO: 6016029 - DNA, 21 bp, Homo sapiens
cataaggtcttattcttgtgc

SEQ ID NO: 6016030 - DNA, 20 bp, Homo sapiens
cataaggtgctatctgttca

SEQ ID NO: 6016031 - DNA, 11 bp, Homo sapiens
cataaggtttt

SEQ ID NO: 6016032 - DNA, 17 bp, Homo sapiens
cataaggttttattcat

SEQ ID NO: 6016033 - DNA, 17 bp, Homo sapiens
cataaggtttttatgca

SEQ ID NO: 6016034 - DNA, 19 bp, Homo sapiens
cataagtaaacaacatatt

SEQ ID NO: 6016035 - DNA, 23 bp, Homo sapiens
cataagtaaatgtcttcatgttg

SEQ ID NO: 6016036 - DNA, 23 bp, Homo sapiens
cataagtaacttttaaaatttgt

SEQ ID NO: 6016037 - DNA, 18 bp, Homo sapiens
cataagtaattcaagaaa

SEQ ID NO: 6016038 - DNA, 17 bp, Homo sapiens
cataagtgacaccaata

SEQ ID NO: 6016039 - DNA, 21 bp, Homo sapiens
cataagtgacaccaataaatg

SEQ ID NO: 6016040 - DNA, 16 bp, Homo sapiens
cataagtggacccagc

SEQ ID NO: 6016041 - DNA, 18 bp, Homo sapiens
cataagtggttttcttca

SEQ ID NO: 6016042 - DNA, 11 bp, Homo sapiens
cataagttgca

SEQ ID NO: 6016043 - DNA, 18 bp, Homo sapiens
cataagttggaccagagg

SEQ ID NO: 6016044 - DNA, 23 bp, Homo sapiens
cataagttggaccagaggaagcc

SEQ ID NO: 6016045 - DNA, 19 bp, Homo sapiens
cataagtttaactttaaaa

SEQ ID NO: 6016046 - DNA, 21 bp, Homo sapiens
cataagtttaactttaaaact

SEQ ID NO: 6016047 - DNA, 13 bp, Homo sapiens
cataagttttctc

SEQ ID NO: 6016048 - DNA, 16 bp, Homo sapiens
cataagttttctcttt

SEQ ID NO: 6016049 - DNA, 22 bp, Homo sapiens
cataataaaaaggcaatcacat

SEQ ID NO: 6016050 - DNA, 15 bp, Homo sapiens
cataataaaaggcat

SEQ ID NO: 6016051 - DNA, 14 bp, Homo sapiens
cataataaaagtga

SEQ ID NO: 6016052 - DNA, 13 bp, Homo sapiens
cataataaacctt

SEQ ID NO: 6016053 - DNA, 20 bp, Homo sapiens
cataataaacgatgttgtga

SEQ ID NO: 6016054 - DNA, 21 bp, Homo sapiens
cataataaacgatgttgtgat

SEQ ID NO: 6016055 - DNA, 23 bp, Homo sapiens
cataataaacgatgttgtgatgt

SEQ ID NO: 6016056 - DNA, 12 bp, Homo sapiens
cataataaagca

SEQ ID NO: 6016057 - DNA, 18 bp, Homo sapiens
cataataaagcaatctga

SEQ ID NO: 6016058 - DNA, 20 bp, Homo sapiens
cataataaaggttgtgaatg

SEQ ID NO: 6016059 - DNA, 18 bp, Homo sapiens
cataataaatagacactt

SEQ ID NO: 6016060 - DNA, 20 bp, Homo sapiens
cataataaatagacacttga

SEQ ID NO: 6016061 - DNA, 16 bp, Homo sapiens
cataataaatcacaca

SEQ ID NO: 6016062 - DNA, 15 bp, Homo sapiens
cataataaattttct

SEQ ID NO: 6016063 - DNA, 18 bp, Homo sapiens
cataataaccctgccagt

SEQ ID NO: 6016064 - DNA, 18 bp, Homo sapiens
cataataataatttgcac

SEQ ID NO: 6016065 - DNA, 14 bp, Homo sapiens
cataatacaaaagg

SEQ ID NO: 6016066 - DNA, 20 bp, Homo sapiens
cataatacacttgccctgct

SEQ ID NO: 6016067 - DNA, 21 bp, Homo sapiens
cataatacacttgccctgctc

SEQ ID NO: 6016068 - DNA, 20 bp, Homo sapiens
cataatacattccatcacag

SEQ ID NO: 6016069 - DNA, 14 bp, Homo sapiens
cataataccctttt

SEQ ID NO: 6016070 - DNA, 18 bp, Homo sapiens
cataatactaatttattg

SEQ ID NO: 6016071 - DNA, 16 bp, Homo sapiens
cataatactgaaccac

SEQ ID NO: 6016072 - DNA, 19 bp, Homo sapiens
cataatagaatttcctaat

SEQ ID NO: 6016073 - DNA, 13 bp, Homo sapiens
cataatataagaa

SEQ ID NO: 6016074 - DNA, 17 bp, Homo sapiens
cataatatagcttaaaa

SEQ ID NO: 6016075 - DNA, 15 bp, Homo sapiens
cataatatattgtgt

SEQ ID NO: 6016076 - DNA, 17 bp, Homo sapiens
cataatatattgtgttt

SEQ ID NO: 6016077 - DNA, 19 bp, Homo sapiens
cataatatattgtgtttta

SEQ ID NO: 6016078 - DNA, 20 bp, Homo sapiens
cataatatcttgaagaatat

SEQ ID NO: 6016079 - DNA, 14 bp, Homo sapiens
cataatatgaagcc

SEQ ID NO: 6016080 - DNA, 14 bp, Homo sapiens
cataatatgcatat

SEQ ID NO: 6016081 - DNA, 16 bp, Homo sapiens
cataatatgcatatat

SEQ ID NO: 6016082 - DNA, 20 bp, Homo sapiens
cataatatgcatatatatgt

SEQ ID NO: 6016083 - DNA, 18 bp, Homo sapiens
cataatatttgaacaaaa

SEQ ID NO: 6016084 - DNA, 14 bp, Homo sapiens
cataatcaaagcta

SEQ ID NO: 6016085 - DNA, 15 bp, Homo sapiens
cataatcactctaat

SEQ ID NO: 6016086 - DNA, 19 bp, Homo sapiens
cataatcagtaaatagtgt

SEQ ID NO: 6016087 - DNA, 19 bp, Homo sapiens
cataatcagtatatttggt

SEQ ID NO: 6016088 - DNA, 20 bp, Homo sapiens
cataatcagtatatttggtt

SEQ ID NO: 6016089 - DNA, 22 bp, Homo sapiens
cataatcagtatatttggtttc

SEQ ID NO: 6016090 - DNA, 21 bp, Homo sapiens
cataatcatccttttttaaaa

SEQ ID NO: 6016091 - DNA, 16 bp, Homo sapiens
cataatcatgtaaatg

SEQ ID NO: 6016092 - DNA, 20 bp, Homo sapiens
cataatcatgtaaatgctca

SEQ ID NO: 6016093 - DNA, 15 bp, Homo sapiens
cataatcattacctt

SEQ ID NO: 6016094 - DNA, 18 bp, Homo sapiens
cataatccagtaaaataa

SEQ ID NO: 6016095 - DNA, 19 bp, Homo sapiens
cataatcctagccccgaga

SEQ ID NO: 6016096 - DNA, 15 bp, Homo sapiens
cataatccttctgca

SEQ ID NO: 6016097 - DNA, 20 bp, Homo sapiens
cataatctaccaacgaaaga

SEQ ID NO: 6016098 - DNA, 21 bp, Homo sapiens
cataatctagtttacagaaaa

SEQ ID NO: 6016099 - DNA, 16 bp, Homo sapiens
cataatctcattcaaa

SEQ ID NO: 6016100 - DNA, 23 bp, Homo sapiens
cataatctggactcctctgtcca

SEQ ID NO: 6016101 - DNA, 18 bp, Homo sapiens
cataatctgtacaatgaa

SEQ ID NO: 6016102 - DNA, 15 bp, Homo sapiens
cataatcttctgcct

SEQ ID NO: 6016103 - DNA, 22 bp, Homo sapiens
cataatcttctgccttctcatg

SEQ ID NO: 6016104 - DNA, 21 bp, Homo sapiens
cataatgaaccgtttacagtg

SEQ ID NO: 6016105 - DNA, 13 bp, Homo sapiens
cataatgaataaa

SEQ ID NO: 6016106 - DNA, 14 bp, Homo sapiens
cataatgagatgtg

SEQ ID NO: 6016107 - DNA, 23 bp, Homo sapiens
cataatgagtaatgcagacattt

SEQ ID NO: 6016108 - DNA, 17 bp, Homo sapiens
cagccaggtggcacctg

SEQ ID NO: 6016109 - DNA, 23 bp, Homo sapiens
cagccaggttagcctttgccctg

SEQ ID NO: 6016110 - DNA, 13 bp, Homo sapiens
cagccagtaaatg

SEQ ID NO: 6016111 - DNA, 17 bp, Homo sapiens
cagccagtctcagatgc

SEQ ID NO: 6016112 - DNA, 21 bp, Homo sapiens
cagccagtgccctgagccagg

SEQ ID NO: 6016113 - DNA, 12 bp, Homo sapiens
cagccagtggcc

SEQ ID NO: 6016114 - DNA, 16 bp, Homo sapiens
cagccagtggccgaac

SEQ ID NO: 6016115 - DNA, 22 bp, Homo sapiens
cagccagtggccgaacccccca

SEQ ID NO: 6016116 - DNA, 15 bp, Homo sapiens
cagccataaaagcat

SEQ ID NO: 6016117 - DNA, 21 bp, Homo sapiens
cagccataaaagcattgtctc

SEQ ID NO: 6016118 - DNA, 18 bp, Homo sapiens
cagccatagacctacaga

SEQ ID NO: 6016119 - DNA, 23 bp, Homo sapiens
cagccatagacctacagacctgg

SEQ ID NO: 6016120 - DNA, 21 bp, Homo sapiens
cagccatagcttgattgctca

SEQ ID NO: 6016121 - DNA, 22 bp, Homo sapiens
cagccatagtttgggtattttt

SEQ ID NO: 6016122 - DNA, 16 bp, Homo sapiens
cagccatcaaaatgct

SEQ ID NO: 6016123 - DNA, 17 bp, Homo sapiens
cagccatcaaaatgctt

SEQ ID NO: 6016124 - DNA, 16 bp, Homo sapiens
cagccatcacaagggg

SEQ ID NO: 6016125 - DNA, 21 bp, Homo sapiens
cagccatcaccttagaccacc

SEQ ID NO: 6016126 - DNA, 19 bp, Homo sapiens
cagccatcataggaaggga

SEQ ID NO: 6016127 - DNA, 15 bp, Homo sapiens
cagccatcctccctc

SEQ ID NO: 6016128 - DNA, 17 bp, Homo sapiens
cagccatcggaagagag

SEQ ID NO: 6016129 - DNA, 18 bp, Homo sapiens
cagccatcggaagagagg

SEQ ID NO: 6016130 - DNA, 16 bp, Homo sapiens
cagccatcgtcctggg

SEQ ID NO: 6016131 - DNA, 17 bp, Homo sapiens
cagccatcgtcctggga

SEQ ID NO: 6016132 - DNA, 19 bp, Homo sapiens
cagccatctcatgagggga

SEQ ID NO: 6016133 - DNA, 15 bp, Homo sapiens
cagccatctgcccag

SEQ ID NO: 6016134 - DNA, 19 bp, Homo sapiens
cagccatctgcccaggggt

SEQ ID NO: 6016135 - DNA, 18 bp, Homo sapiens
cagccatgccagctggcc

SEQ ID NO: 6016136 - DNA, 20 bp, Homo sapiens
cagccatgccagctggcctt

SEQ ID NO: 6016137 - DNA, 20 bp, Homo sapiens
cagccatgcccacgcccctc

SEQ ID NO: 6016138 - DNA, 14 bp, Homo sapiens
cagccatgcccagg

SEQ ID NO: 6016139 - DNA, 17 bp, Homo sapiens
cagccatgcccaggacg

SEQ ID NO: 6016140 - DNA, 21 bp, Homo sapiens
cagccatgcccaggacgtcct

SEQ ID NO: 6016141 - DNA, 12 bp, Homo sapiens
cagccatgcctc

SEQ ID NO: 6016142 - DNA, 18 bp, Homo sapiens
cagccatgcctcatgcca

SEQ ID NO: 6016143 - DNA, 19 bp, Homo sapiens
cagccatgcctcatgccac

SEQ ID NO: 6016144 - DNA, 21 bp, Homo sapiens
cagccatgcgcgcgctctctc

SEQ ID NO: 6016145 - DNA, 14 bp, Homo sapiens
cagccatgcgtggc

SEQ ID NO: 6016146 - DNA, 13 bp, Homo sapiens
cagccatggccct

SEQ ID NO: 6016147 - DNA, 17 bp, Homo sapiens
cagccatgggaacctca

SEQ ID NO: 6016148 - DNA, 12 bp, Homo sapiens
cagccatggtga

SEQ ID NO: 6016149 - DNA, 14 bp, Homo sapiens
cagccatgtacaga

SEQ ID NO: 6016150 - DNA, 17 bp, Homo sapiens
cagccatgtctgcattt

SEQ ID NO: 6016151 - DNA, 17 bp, Homo sapiens
cagccatgtgctgcgtg

SEQ ID NO: 6016152 - DNA, 13 bp, Homo sapiens
cagccatgtttgg

SEQ ID NO: 6016153 - DNA, 14 bp, Homo sapiens
cagccattaaaata

SEQ ID NO: 6016154 - DNA, 20 bp, Homo sapiens
cagccattaaaataaaacaa

SEQ ID NO: 6016155 - DNA, 22 bp, Homo sapiens
cagccattaaaataaaacaagc

SEQ ID NO: 6016156 - DNA, 23 bp, Homo sapiens
cagccattaaaataaaacaagcc

SEQ ID NO: 6016157 - DNA, 20 bp, Homo sapiens
cagccattcacaacacaatc

SEQ ID NO: 6016158 - DNA, 21 bp, Homo sapiens
cagccattcacaacacaatca

SEQ ID NO: 6016159 - DNA, 15 bp, Homo sapiens
cagccattcatctgg

SEQ ID NO: 6016160 - DNA, 19 bp, Homo sapiens
cagccattcatctgggctg

SEQ ID NO: 6016161 - DNA, 13 bp, Homo sapiens
cagccattcctgt

SEQ ID NO: 6016162 - DNA, 19 bp, Homo sapiens
cagccattcctgttctctt

SEQ ID NO: 6016163 - DNA, 17 bp, Homo sapiens
cagccattctctaccca

SEQ ID NO: 6016164 - DNA, 17 bp, Homo sapiens
cagccattgcacccagc

SEQ ID NO: 6016165 - DNA, 18 bp, Homo sapiens
cagccattgcggccccag

SEQ ID NO: 6016166 - DNA, 22 bp, Homo sapiens
cagccattgcggccccaggagg

SEQ ID NO: 6016167 - DNA, 22 bp, Homo sapiens
cagccatttattttttaaaaag

SEQ ID NO: 6016168 - DNA, 18 bp, Homo sapiens
cagccatttccccctcct

SEQ ID NO: 6016169 - DNA, 21 bp, Homo sapiens
cagccatttccccctcctcag

SEQ ID NO: 6016170 - DNA, 13 bp, Homo sapiens
cagccattttcca

SEQ ID NO: 6016171 - DNA, 13 bp, Homo sapiens
cagccatttttaa

SEQ ID NO: 6016172 - DNA, 19 bp, Homo sapiens
cagccatttttagattggt

SEQ ID NO: 6016173 - DNA, 16 bp, Homo sapiens
cagcccaaaatttgat

SEQ ID NO: 6016174 - DNA, 16 bp, Homo sapiens
cagcccaaaccaccag

SEQ ID NO: 6016175 - DNA, 19 bp, Homo sapiens
cagcccaaacctgggaagg

SEQ ID NO: 6016176 - DNA, 16 bp, Homo sapiens
cagcccaaaccttggg

SEQ ID NO: 6016177 - DNA, 20 bp, Homo sapiens
cagcccaaaggggacaggcc

SEQ ID NO: 6016178 - DNA, 16 bp, Homo sapiens
cagcccaaattctcct

SEQ ID NO: 6016179 - DNA, 17 bp, Homo sapiens
cagcccaacagaaggaa

SEQ ID NO: 6016180 - DNA, 15 bp, Homo sapiens
cagcccaaccaggag

SEQ ID NO: 6016181 - DNA, 23 bp, Homo sapiens
cagcccaaccaggaggggtctgc

SEQ ID NO: 6016182 - DNA, 16 bp, Homo sapiens
cagcccaacccactgt

SEQ ID NO: 6016183 - DNA, 19 bp, Homo sapiens
cagcccaacccggcccaac

SEQ ID NO: 6016184 - DNA, 17 bp, Homo sapiens
cagcccaacttccagag

SEQ ID NO: 6016185 - DNA, 21 bp, Homo sapiens
cagcccaagaggactgagact

SEQ ID NO: 6016186 - DNA, 14 bp, Homo sapiens
cagcccaagattct

SEQ ID NO: 6016187 - DNA, 17 bp, Homo sapiens
cagcccaaggacagttc

SEQ ID NO: 6016188 - DNA, 22 bp, Homo sapiens
cagcccaagggcggggctatgc

SEQ ID NO: 6016189 - DNA, 18 bp, Homo sapiens
cagcccaagtgaggcagc

SEQ ID NO: 6016190 - DNA, 22 bp, Homo sapiens
cagcccaagtgaggcagccgag

SEQ ID NO: 6016191 - DNA, 23 bp, Homo sapiens
cagcccaagtgaggcagccgagg

SEQ ID NO: 6016192 - DNA, 12 bp, Homo sapiens
cagcccaataaa

SEQ ID NO: 6016193 - DNA, 16 bp, Homo sapiens
cagcccaatccctgat

SEQ ID NO: 6016194 - DNA, 17 bp, Homo sapiens
cagcccaatccctgatc

SEQ ID NO: 6016195 - DNA, 23 bp, Homo sapiens
cagcccacacccctccaaagccc

SEQ ID NO: 6016196 - DNA, 13 bp, Homo sapiens
cagcccacagagc

SEQ ID NO: 6016197 - DNA, 14 bp, Homo sapiens
cagcccacagagcc

SEQ ID NO: 6016198 - DNA, 17 bp, Homo sapiens
cagcccacagagcctga

SEQ ID NO: 6016199 - DNA, 20 bp, Homo sapiens
cagcccacagaggacagtgc

SEQ ID NO: 6016200 - DNA, 19 bp, Homo sapiens
cagcccacagtgctcagtt

SEQ ID NO: 6016201 - DNA, 24 bp, Homo sapiens
cagcccacattggattcatcagca

SEQ ID NO: 6016202 - DNA, 17 bp, Homo sapiens
cagcccaccaccctggc

SEQ ID NO: 6016203 - DNA, 17 bp, Homo sapiens
cagcccaccagccacct

SEQ ID NO: 6016204 - DNA, 16 bp, Homo sapiens
cagcccaccaggagca

SEQ ID NO: 6016205 - DNA, 14 bp, Homo sapiens
cagcccacccccct

SEQ ID NO: 6016206 - DNA, 22 bp, Homo sapiens
cagcccaccccctttgactctg

SEQ ID NO: 6016207 - DNA, 18 bp, Homo sapiens
cagcccaccctcctgtct

SEQ ID NO: 6016208 - DNA, 15 bp, Homo sapiens
cagcccaccctctgt

SEQ ID NO: 6016209 - DNA, 13 bp, Homo sapiens
cagcccaccctgc

SEQ ID NO: 6016210 - DNA, 15 bp, Homo sapiens
cagcccaccctgccc

SEQ ID NO: 6016211 - DNA, 14 bp, Homo sapiens
cagcccaccctgct

SEQ ID NO: 6016212 - DNA, 16 bp, Homo sapiens
cagcccaccctgctgc

SEQ ID NO: 6016213 - DNA, 18 bp, Homo sapiens
cagcccaccctgctgctg

SEQ ID NO: 6016214 - DNA, 13 bp, Homo sapiens
cagcccacctgca

SEQ ID NO: 6016215 - DNA, 14 bp, Homo sapiens
cagcccacctgcac

SEQ ID NO: 6016216 - DNA, 19 bp, Homo sapiens
cagcccacctgcacccagg

SEQ ID NO: 6016217 - DNA, 13 bp, Homo sapiens
cagcccacctgct

SEQ ID NO: 6016218 - DNA, 20 bp, Homo sapiens
cagcccacctgctcccaggc

SEQ ID NO: 6016219 - DNA, 19 bp, Homo sapiens
cagcccacggtctggaggc

SEQ ID NO: 6016220 - DNA, 18 bp, Homo sapiens
cagcccacgtcctgtcag

SEQ ID NO: 6016221 - DNA, 14 bp, Homo sapiens
cagcccactgagaa

SEQ ID NO: 6016222 - DNA, 18 bp, Homo sapiens
cagcccactgcaccgcct

SEQ ID NO: 6016223 - DNA, 22 bp, Homo sapiens
cagcccactgggccctggggct

SEQ ID NO: 6016224 - DNA, 15 bp, Homo sapiens
cagcccacttctgcc

SEQ ID NO: 6016225 - DNA, 18 bp, Homo sapiens
cagcccacttctgccata

SEQ ID NO: 6016226 - DNA, 14 bp, Homo sapiens
cagcccagaaggcc

SEQ ID NO: 6016227 - DNA, 13 bp, Homo sapiens
cagcccagacagc

SEQ ID NO: 6016228 - DNA, 22 bp, Homo sapiens
cagcccagagacatacttgaag

SEQ ID NO: 6016229 - DNA, 14 bp, Homo sapiens
cagcccagagactg

SEQ ID NO: 6016230 - DNA, 20 bp, Homo sapiens
cagcccagagagaccctgcc

SEQ ID NO: 6016231 - DNA, 21 bp, Homo sapiens
cagcccagagagaccctgcca

SEQ ID NO: 6016232 - DNA, 22 bp, Homo sapiens
cagcccagagagaccctgccaa

SEQ ID NO: 6016233 - DNA, 16 bp, Homo sapiens
cagcccagagcccggt

SEQ ID NO: 6016234 - DNA, 15 bp, Homo sapiens
cagcccagagcctgg

SEQ ID NO: 6016235 - DNA, 21 bp, Homo sapiens
cagcccagatggctccctggg

SEQ ID NO: 6016236 - DNA, 19 bp, Homo sapiens
cagcccagattcccctgtg

SEQ ID NO: 6016237 - DNA, 15 bp, Homo sapiens
cagcccagcaagaag

SEQ ID NO: 6016238 - DNA, 13 bp, Homo sapiens
cagcccagcaccc

SEQ ID NO: 6016239 - DNA, 15 bp, Homo sapiens
cagcccagcacccct

SEQ ID NO: 6016240 - DNA, 14 bp, Homo sapiens
cagcccagcacctg

SEQ ID NO: 6016241 - DNA, 21 bp, Homo sapiens
cagcccagcacctgctcccag

SEQ ID NO: 6016242 - DNA, 15 bp, Homo sapiens
cagcccagccagcgt

SEQ ID NO: 6016243 - DNA, 15 bp, Homo sapiens
cagcccagcctagcc

SEQ ID NO: 6016244 - DNA, 16 bp, Homo sapiens
cagcccagcctagccc

SEQ ID NO: 6016245 - DNA, 14 bp, Homo sapiens
cagcccagcctctg

SEQ ID NO: 6016246 - DNA, 15 bp, Homo sapiens
cagcccagcctctgt

SEQ ID NO: 6016247 - DNA, 12 bp, Homo sapiens
cagcccagcctg

SEQ ID NO: 6016248 - DNA, 14 bp, Homo sapiens
cagcccagcctgca

SEQ ID NO: 6016249 - DNA, 15 bp, Homo sapiens
cagcccagcctgcat

SEQ ID NO: 6016250 - DNA, 15 bp, Homo sapiens
cagcccagcctgccc

SEQ ID NO: 6016251 - DNA, 20 bp, Homo sapiens
cagcccagcctgccccctat

SEQ ID NO: 6016252 - DNA, 11 bp, Homo sapiens
cagcccagctc

SEQ ID NO: 6016253 - DNA, 13 bp, Homo sapiens
cagcccagctcag

SEQ ID NO: 6016254 - DNA, 13 bp, Homo sapiens
cagcccagctcca

SEQ ID NO: 6016255 - DNA, 19 bp, Homo sapiens
cagcccagctgctctgccc

SEQ ID NO: 6016256 - DNA, 21 bp, Homo sapiens
cagcccagctgctctgcccag

SEQ ID NO: 6016257 - DNA, 12 bp, Homo sapiens
cagcccagctgg

SEQ ID NO: 6016258 - DNA, 15 bp, Homo sapiens
cagcccagctggcca

SEQ ID NO: 6016259 - DNA, 16 bp, Homo sapiens
cagcccagctggccac

SEQ ID NO: 6016260 - DNA, 18 bp, Homo sapiens
cagcccagctggccggaa

SEQ ID NO: 6016261 - DNA, 21 bp, Homo sapiens
cagcccagctggccggaagga

SEQ ID NO: 6016262 - DNA, 11 bp, Homo sapiens
cagcccagctt

SEQ ID NO: 6016263 - DNA, 23 bp, Homo sapiens
cagcccagcttggccctttcctt

SEQ ID NO: 6016264 - DNA, 23 bp, Homo sapiens
cagcccaggaagtctcatctggg

SEQ ID NO: 6016265 - DNA, 14 bp, Homo sapiens
cagcccaggaggca

SEQ ID NO: 6016266 - DNA, 11 bp, Homo sapiens
cagcccaggat

SEQ ID NO: 6016267 - DNA, 18 bp, Homo sapiens
cagcccaggcatctcctt

SEQ ID NO: 6016268 - DNA, 13 bp, Homo sapiens
cagcccaggcctc

SEQ ID NO: 6016269 - DNA, 20 bp, Homo sapiens
cagcccaggcctccagctca

SEQ ID NO: 6016270 - DNA, 15 bp, Homo sapiens
cagcccaggcctggt

SEQ ID NO: 6016271 - DNA, 22 bp, Homo sapiens
cagcccaggcctggtggagggg

SEQ ID NO: 6016272 - DNA, 12 bp, Homo sapiens
cagcccaggctt

SEQ ID NO: 6016273 - DNA, 12 bp, Homo sapiens
cagcccagggca

SEQ ID NO: 6016274 - DNA, 16 bp, Homo sapiens
cagcccagggcacttc

SEQ ID NO: 6016275 - DNA, 14 bp, Homo sapiens
cagcccagggccta

SEQ ID NO: 6016276 - DNA, 11 bp, Homo sapiens
cagcccagggt

SEQ ID NO: 6016277 - DNA, 17 bp, Homo sapiens
cagcccaggtctcctgg

SEQ ID NO: 6016278 - DNA, 16 bp, Homo sapiens
cagcccatcacctcta

SEQ ID NO: 6016279 - DNA, 19 bp, Homo sapiens
cagcccatccatagtaact

SEQ ID NO: 6016280 - DNA, 23 bp, Homo sapiens
cagcccatccatagtaactgaca

SEQ ID NO: 6016281 - DNA, 21 bp, Homo sapiens
cagcccatccattaggccagc

SEQ ID NO: 6016282 - DNA, 16 bp, Homo sapiens
cagcccatcccctgcc

SEQ ID NO: 6016283 - DNA, 16 bp, Homo sapiens
cagcccatctgcctgt

SEQ ID NO: 6016284 - DNA, 19 bp, Homo sapiens
cagcccatgcccacctgcc

SEQ ID NO: 6016285 - DNA, 15 bp, Homo sapiens
cagcccatgctggct

SEQ ID NO: 6016286 - DNA, 16 bp, Homo sapiens
cagcccatgctggctg

SEQ ID NO: 6016287 - DNA, 19 bp, Homo sapiens
cagcccatgctggctgggg

SEQ ID NO: 6016288 - DNA, 18 bp, Homo sapiens
cataatgataaaataaat

SEQ ID NO: 6016289 - DNA, 16 bp, Homo sapiens
cataatgatactgaat

SEQ ID NO: 6016290 - DNA, 11 bp, Homo sapiens
cataatgcaat

SEQ ID NO: 6016291 - DNA, 16 bp, Homo sapiens
cataatgcaatcaaaa

SEQ ID NO: 6016292 - DNA, 22 bp, Homo sapiens
cataatgcaattagatagaaaa

SEQ ID NO: 6016293 - DNA, 21 bp, Homo sapiens
cataatgcactggggtaccac

SEQ ID NO: 6016294 - DNA, 18 bp, Homo sapiens
cataatgcagaagtattc

SEQ ID NO: 6016295 - DNA, 19 bp, Homo sapiens
cataatgcagaagtattct

SEQ ID NO: 6016296 - DNA, 12 bp, Homo sapiens
cataatgccact

SEQ ID NO: 6016297 - DNA, 17 bp, Homo sapiens
cataatgcgtgcatacc

SEQ ID NO: 6016298 - DNA, 21 bp, Homo sapiens
cataatgcgtgcataccactt

SEQ ID NO: 6016299 - DNA, 21 bp, Homo sapiens
cataatgctaatttaaagaga

SEQ ID NO: 6016300 - DNA, 16 bp, Homo sapiens
cataatgctactgtct

SEQ ID NO: 6016301 - DNA, 21 bp, Homo sapiens
cataatgctcccatctcctga

SEQ ID NO: 6016302 - DNA, 13 bp, Homo sapiens
cataatgcttctt

SEQ ID NO: 6016303 - DNA, 16 bp, Homo sapiens
cataatgctttggaaa

SEQ ID NO: 6016304 - DNA, 20 bp, Homo sapiens
cataatgctttggaaaaatg

SEQ ID NO: 6016305 - DNA, 23 bp, Homo sapiens
cataatgctttggaaaaatgggt

SEQ ID NO: 6016306 - DNA, 19 bp, Homo sapiens
cataatgggccactgaaat

SEQ ID NO: 6016307 - DNA, 19 bp, Homo sapiens
cataatggggattaattag

SEQ ID NO: 6016308 - DNA, 21 bp, Homo sapiens
cataatggtactcccaaactg

SEQ ID NO: 6016309 - DNA, 16 bp, Homo sapiens
cataatggttgtgaaa

SEQ ID NO: 6016310 - DNA, 18 bp, Homo sapiens
cataatggttgtgaaatg

SEQ ID NO: 6016311 - DNA, 14 bp, Homo sapiens
cataatgtaactga

SEQ ID NO: 6016312 - DNA, 15 bp, Homo sapiens
cataatgtataaaga

SEQ ID NO: 6016313 - DNA, 19 bp, Homo sapiens
cataatgtgaagtgttaat

SEQ ID NO: 6016314 - DNA, 23 bp, Homo sapiens
cataatgtgagatggttcccaat

SEQ ID NO: 6016315 - DNA, 18 bp, Homo sapiens
cataatgttaagctttat

SEQ ID NO: 6016316 - DNA, 18 bp, Homo sapiens
cataatgttagtagcact

SEQ ID NO: 6016317 - DNA, 20 bp, Homo sapiens
cataatgttagtagcactga

SEQ ID NO: 6016318 - DNA, 18 bp, Homo sapiens
cataatgtttctggattt

SEQ ID NO: 6016319 - DNA, 22 bp, Homo sapiens
cataatgtttctggatttcata

SEQ ID NO: 6016320 - DNA, 19 bp, Homo sapiens
cataatgtttttcctttct

SEQ ID NO: 6016321 - DNA, 14 bp, Homo sapiens
cataattaaagtgt

SEQ ID NO: 6016322 - DNA, 17 bp, Homo sapiens
cataattaaattttaat

SEQ ID NO: 6016323 - DNA, 18 bp, Homo sapiens
cataattaaattttaatg

SEQ ID NO: 6016324 - DNA, 13 bp, Homo sapiens
cataattaacact

SEQ ID NO: 6016325 - DNA, 16 bp, Homo sapiens
cataattacattccta

SEQ ID NO: 6016326 - DNA, 17 bp, Homo sapiens
cataattacattcctaa

SEQ ID NO: 6016327 - DNA, 20 bp, Homo sapiens
cataattacattcctaacta

SEQ ID NO: 6016328 - DNA, 16 bp, Homo sapiens
cataattagaacaata

SEQ ID NO: 6016329 - DNA, 16 bp, Homo sapiens
cataattagatccatt

SEQ ID NO: 6016330 - DNA, 14 bp, Homo sapiens
cataattatgaaaa

SEQ ID NO: 6016331 - DNA, 16 bp, Homo sapiens
cataattatgaaaact

SEQ ID NO: 6016332 - DNA, 22 bp, Homo sapiens
cataattatgaaaactcatgat

SEQ ID NO: 6016333 - DNA, 14 bp, Homo sapiens
cataattatgacag

SEQ ID NO: 6016334 - DNA, 19 bp, Homo sapiens
cataattatgacagttata

SEQ ID NO: 6016335 - DNA, 21 bp, Homo sapiens
cataattcacacattaataaa

SEQ ID NO: 6016336 - DNA, 21 bp, Homo sapiens
cataattcactctgagtgttt

SEQ ID NO: 6016337 - DNA, 20 bp, Homo sapiens
cataattcagaactaaattt

SEQ ID NO: 6016338 - DNA, 18 bp, Homo sapiens
cataattcagcacttaac

SEQ ID NO: 6016339 - DNA, 20 bp, Homo sapiens
cataattcatttaagaacaa

SEQ ID NO: 6016340 - DNA, 18 bp, Homo sapiens
cataattctaagactaat

SEQ ID NO: 6016341 - DNA, 22 bp, Homo sapiens
cataattctgaagttatatttc

SEQ ID NO: 6016342 - DNA, 21 bp, Homo sapiens
cataattctgttactttgcta

SEQ ID NO: 6016343 - DNA, 13 bp, Homo sapiens
cataattcttatt

SEQ ID NO: 6016344 - DNA, 14 bp, Homo sapiens
cataattcttatta

SEQ ID NO: 6016345 - DNA, 18 bp, Homo sapiens
cataattcttgtatatta

SEQ ID NO: 6016346 - DNA, 14 bp, Homo sapiens
cataattgattaaa

SEQ ID NO: 6016347 - DNA, 15 bp, Homo sapiens
cataattgattaaaa

SEQ ID NO: 6016348 - DNA, 16 bp, Homo sapiens
cataattgattaaaat

SEQ ID NO: 6016349 - DNA, 18 bp, Homo sapiens
cataattgattaaaatct

SEQ ID NO: 6016350 - DNA, 20 bp, Homo sapiens
cataattgattaaaatctct

SEQ ID NO: 6016351 - DNA, 13 bp, Homo sapiens
cataattgcatga

SEQ ID NO: 6016352 - DNA, 12 bp, Homo sapiens
cataattgcatt

SEQ ID NO: 6016353 - DNA, 21 bp, Homo sapiens
cataattgcctacatttatca

SEQ ID NO: 6016354 - DNA, 14 bp, Homo sapiens
cataattgctttgc

SEQ ID NO: 6016355 - DNA, 18 bp, Homo sapiens
cataattgtgagttaatt

SEQ ID NO: 6016356 - DNA, 21 bp, Homo sapiens
cataattgtgagttaatttga

SEQ ID NO: 6016357 - DNA, 18 bp, Homo sapiens
cataatttaaaaatatat

SEQ ID NO: 6016358 - DNA, 19 bp, Homo sapiens
cataatttagttgtttcta

SEQ ID NO: 6016359 - DNA, 13 bp, Homo sapiens
cataatttataca

SEQ ID NO: 6016360 - DNA, 13 bp, Homo sapiens
cataatttcagct

SEQ ID NO: 6016361 - DNA, 18 bp, Homo sapiens
cataatttcagttctagt

SEQ ID NO: 6016362 - DNA, 12 bp, Homo sapiens
cataatttctgt

SEQ ID NO: 6016363 - DNA, 15 bp, Homo sapiens
cataatttggaggga

SEQ ID NO: 6016364 - DNA, 14 bp, Homo sapiens
cataatttgtctta

SEQ ID NO: 6016365 - DNA, 21 bp, Homo sapiens
cataattttagtaatttccta

SEQ ID NO: 6016366 - DNA, 23 bp, Homo sapiens
cataattttagtaatttcctaga

SEQ ID NO: 6016367 - DNA, 20 bp, Homo sapiens
cataattttcaaaagaaaac

SEQ ID NO: 6016368 - DNA, 13 bp, Homo sapiens
cataattttcaag

SEQ ID NO: 6016369 - DNA, 18 bp, Homo sapiens
cataattttcaagagaag

SEQ ID NO: 6016370 - DNA, 20 bp, Homo sapiens
cataattttctaatttcaag

SEQ ID NO: 6016371 - DNA, 12 bp, Homo sapiens
cataattttgca

SEQ ID NO: 6016372 - DNA, 13 bp, Homo sapiens
cataattttgcaa

SEQ ID NO: 6016373 - DNA, 13 bp, Homo sapiens
cataattttgcat

SEQ ID NO: 6016374 - DNA, 20 bp, Homo sapiens
cataattttgcatactgaaa

SEQ ID NO: 6016375 - DNA, 22 bp, Homo sapiens
cataattttgcatactgaaaat

SEQ ID NO: 6016376 - DNA, 20 bp, Homo sapiens
cataattttgtgttgtacaa

SEQ ID NO: 6016377 - DNA, 12 bp, Homo sapiens
cataatttttaa

SEQ ID NO: 6016378 - DNA, 16 bp, Homo sapiens
cataatttttgtacat

SEQ ID NO: 6016379 - DNA, 12 bp, Homo sapiens
catacaaaaaaa

SEQ ID NO: 6016380 - DNA, 22 bp, Homo sapiens
catacaaaaatatattaaaaat

SEQ ID NO: 6016381 - DNA, 16 bp, Homo sapiens
catacaaaataaatgg

SEQ ID NO: 6016382 - DNA, 21 bp, Homo sapiens
catacaaacaagcatataaaa

SEQ ID NO: 6016383 - DNA, 14 bp, Homo sapiens
catacaaatactat

SEQ ID NO: 6016384 - DNA, 15 bp, Homo sapiens
catacaaatctcact

SEQ ID NO: 6016385 - DNA, 19 bp, Homo sapiens
catacaaatctcactgtat

SEQ ID NO: 6016386 - DNA, 15 bp, Homo sapiens
catacaacacaaaga

SEQ ID NO: 6016387 - DNA, 16 bp, Homo sapiens
catacaacctgagcct

SEQ ID NO: 6016388 - DNA, 16 bp, Homo sapiens
catacaagaaaatgta

SEQ ID NO: 6016389 - DNA, 17 bp, Homo sapiens
catacaagaaaatgtat

SEQ ID NO: 6016390 - DNA, 22 bp, Homo sapiens
catacaagaaaatgtatccaag

SEQ ID NO: 6016391 - DNA, 16 bp, Homo sapiens
catacaagcaacagca

SEQ ID NO: 6016392 - DNA, 17 bp, Homo sapiens
catacaagccatttact

SEQ ID NO: 6016393 - DNA, 22 bp, Homo sapiens
catacaaggacattcactgctg

SEQ ID NO: 6016394 - DNA, 13 bp, Homo sapiens
catacaaggccca

SEQ ID NO: 6016395 - DNA, 22 bp, Homo sapiens
catacaagtcatggtcacagta

SEQ ID NO: 6016396 - DNA, 13 bp, Homo sapiens
catacaataaaag

SEQ ID NO: 6016397 - DNA, 21 bp, Homo sapiens
catacaataaaagagctttat

SEQ ID NO: 6016398 - DNA, 22 bp, Homo sapiens
catacaataaaagagctttatc

SEQ ID NO: 6016399 - DNA, 17 bp, Homo sapiens
catacaatgtatgtaca

SEQ ID NO: 6016400 - DNA, 19 bp, Homo sapiens
catacaatgtatgtacaat

SEQ ID NO: 6016401 - DNA, 15 bp, Homo sapiens
catacaatttgcact

SEQ ID NO: 6016402 - DNA, 22 bp, Homo sapiens
catacaatttgcactgttactt

SEQ ID NO: 6016403 - DNA, 13 bp, Homo sapiens
catacacaacgta

SEQ ID NO: 6016404 - DNA, 18 bp, Homo sapiens
catacacaactgttcccg

SEQ ID NO: 6016405 - DNA, 17 bp, Homo sapiens
catacacacacaaacca

SEQ ID NO: 6016406 - DNA, 13 bp, Homo sapiens
catacacacacac

SEQ ID NO: 6016407 - DNA, 16 bp, Homo sapiens
catacacacacacaca

SEQ ID NO: 6016408 - DNA, 21 bp, Homo sapiens
catacacacacacacacagcc

SEQ ID NO: 6016409 - DNA, 17 bp, Homo sapiens
catacacacatacatac

SEQ ID NO: 6016410 - DNA, 19 bp, Homo sapiens
catacacacatgccctcct

SEQ ID NO: 6016411 - DNA, 13 bp, Homo sapiens
catacacacgctg

SEQ ID NO: 6016412 - DNA, 22 bp, Homo sapiens
catacaccagaagacaaacaat

SEQ ID NO: 6016413 - DNA, 13 bp, Homo sapiens
catacaccagcat

SEQ ID NO: 6016414 - DNA, 21 bp, Homo sapiens
catacaccccctcttctgagc

SEQ ID NO: 6016415 - DNA, 22 bp, Homo sapiens
catacaccccctcttctgagca

SEQ ID NO: 6016416 - DNA, 17 bp, Homo sapiens
catacacgaaagagaga

SEQ ID NO: 6016417 - DNA, 19 bp, Homo sapiens
catacactaaccaaatctc

SEQ ID NO: 6016418 - DNA, 17 bp, Homo sapiens
catacactcaaacaatc

SEQ ID NO: 6016419 - DNA, 21 bp, Homo sapiens
catacactgtatgttatagaa

SEQ ID NO: 6016420 - DNA, 21 bp, Homo sapiens
catacacttgtataaatgtat

SEQ ID NO: 6016421 - DNA, 16 bp, Homo sapiens
catacagaaagaagca

SEQ ID NO: 6016422 - DNA, 23 bp, Homo sapiens
catacagaattactgtaactgat

SEQ ID NO: 6016423 - DNA, 13 bp, Homo sapiens
catacagagaagt

SEQ ID NO: 6016424 - DNA, 17 bp, Homo sapiens
catacagagaagtcaca

SEQ ID NO: 6016425 - DNA, 19 bp, Homo sapiens
catacagagctctctgagg

SEQ ID NO: 6016426 - DNA, 19 bp, Homo sapiens
catacagaggatgcctttt

SEQ ID NO: 6016427 - DNA, 23 bp, Homo sapiens
catacagaggatgccttttctgt

SEQ ID NO: 6016428 - DNA, 14 bp, Homo sapiens
catacagcctctac

SEQ ID NO: 6016429 - DNA, 13 bp, Homo sapiens
catacagctgcct

SEQ ID NO: 6016430 - DNA, 21 bp, Homo sapiens
catacaggatttgaactcaga

SEQ ID NO: 6016431 - DNA, 16 bp, Homo sapiens
catacagggatggtgt

SEQ ID NO: 6016432 - DNA, 19 bp, Homo sapiens
catacagggatggtgttca

SEQ ID NO: 6016433 - DNA, 14 bp, Homo sapiens
catacaggggaggg

SEQ ID NO: 6016434 - DNA, 23 bp, Homo sapiens
catacaggggaggggcgcacccc

SEQ ID NO: 6016435 - DNA, 18 bp, Homo sapiens
catacagggtctcttcct

SEQ ID NO: 6016436 - DNA, 20 bp, Homo sapiens
catacagggtctcttccttc

SEQ ID NO: 6016437 - DNA, 13 bp, Homo sapiens
catacaggtgctc

SEQ ID NO: 6016438 - DNA, 16 bp, Homo sapiens
catacagtttgcactt

SEQ ID NO: 6016439 - DNA, 20 bp, Homo sapiens
catacagttttatgctcttt

SEQ ID NO: 6016440 - DNA, 21 bp, Homo sapiens
catacagttttatgctctttt

SEQ ID NO: 6016441 - DNA, 22 bp, Homo sapiens
catacagttttatgctcttttt

SEQ ID NO: 6016442 - DNA, 12 bp, Homo sapiens
catacagttttc

SEQ ID NO: 6016443 - DNA, 15 bp, Homo sapiens
catacagttttcatt

SEQ ID NO: 6016444 - DNA, 23 bp, Homo sapiens
catacagttttcattgattatat

SEQ ID NO: 6016445 - DNA, 14 bp, Homo sapiens
catacataaaagaa

SEQ ID NO: 6016446 - DNA, 15 bp, Homo sapiens
catacataaaagaaa

SEQ ID NO: 6016447 - DNA, 23 bp, Homo sapiens
catacataatgtttttcctttct

SEQ ID NO: 6016448 - DNA, 17 bp, Homo sapiens
catacatacacatacat

SEQ ID NO: 6016449 - DNA, 18 bp, Homo sapiens
catacatacacatacata

SEQ ID NO: 6016450 - DNA, 17 bp, Homo sapiens
catacatacatacatat

SEQ ID NO: 6016451 - DNA, 15 bp, Homo sapiens
catacatacatatat

SEQ ID NO: 6016452 - DNA, 16 bp, Homo sapiens
catacatacatatata

SEQ ID NO: 6016453 - DNA, 19 bp, Homo sapiens
catacatagacatttcaaa

SEQ ID NO: 6016454 - DNA, 23 bp, Homo sapiens
catacatagacatttcaaaatta

SEQ ID NO: 6016455 - DNA, 13 bp, Homo sapiens
catacatatatat

SEQ ID NO: 6016456 - DNA, 22 bp, Homo sapiens
catacatatatatatttgtaac

SEQ ID NO: 6016457 - DNA, 20 bp, Homo sapiens
catacatatatatctgataa

SEQ ID NO: 6016458 - DNA, 22 bp, Homo sapiens
catacatatgtagaaacattta

SEQ ID NO: 6016459 - DNA, 12 bp, Homo sapiens
catacatatttt

SEQ ID NO: 6016460 - DNA, 18 bp, Homo sapiens
catacatgaataaaaata

SEQ ID NO: 6016461 - DNA, 15 bp, Homo sapiens
catacattgtacgaa

SEQ ID NO: 6016462 - DNA, 12 bp, Homo sapiens
catacatttaaa

SEQ ID NO: 6016463 - DNA, 14 bp, Homo sapiens
catacattttctaa

SEQ ID NO: 6016464 - DNA, 17 bp, Homo sapiens
cataccaacacgagcag

SEQ ID NO: 6016465 - DNA, 20 bp, Homo sapiens
cataccaactcaactttttt

SEQ ID NO: 6016466 - DNA, 22 bp, Homo sapiens
cagcccatgctggctggggccg

SEQ ID NO: 6016467 - DNA, 13 bp, Homo sapiens
cagcccatggaga

SEQ ID NO: 6016468 - DNA, 21 bp, Homo sapiens
cagcccatggagattgacctg

SEQ ID NO: 6016469 - DNA, 16 bp, Homo sapiens
cagcccatggaggcag

SEQ ID NO: 6016470 - DNA, 17 bp, Homo sapiens
cagcccatggaggcaga

SEQ ID NO: 6016471 - DNA, 22 bp, Homo sapiens
cagcccatggaggcagatgccc

SEQ ID NO: 6016472 - DNA, 23 bp, Homo sapiens
cagcccatggcccccaataaagg

SEQ ID NO: 6016473 - DNA, 23 bp, Homo sapiens
cagcccattctctctcctgtcca

SEQ ID NO: 6016474 - DNA, 14 bp, Homo sapiens
cagcccattgctgc

SEQ ID NO: 6016475 - DNA, 18 bp, Homo sapiens
cagcccattggccgagct

SEQ ID NO: 6016476 - DNA, 17 bp, Homo sapiens
cagcccatttgggctct

SEQ ID NO: 6016477 - DNA, 22 bp, Homo sapiens
cagccccaaaactctcctctgc

SEQ ID NO: 6016478 - DNA, 18 bp, Homo sapiens
cagccccaaaccagggtg

SEQ ID NO: 6016479 - DNA, 21 bp, Homo sapiens
cagccccaagctgggccgagg

SEQ ID NO: 6016480 - DNA, 17 bp, Homo sapiens
cagccccaagcttctga

SEQ ID NO: 6016481 - DNA, 15 bp, Homo sapiens
cagccccaagggctg

SEQ ID NO: 6016482 - DNA, 13 bp, Homo sapiens
cagccccaagggg

SEQ ID NO: 6016483 - DNA, 16 bp, Homo sapiens
cagccccaaggggtgg

SEQ ID NO: 6016484 - DNA, 16 bp, Homo sapiens
cagccccaatccagag

SEQ ID NO: 6016485 - DNA, 17 bp, Homo sapiens
cagccccaatccagaga

SEQ ID NO: 6016486 - DNA, 14 bp, Homo sapiens
cagccccacacagc

SEQ ID NO: 6016487 - DNA, 15 bp, Homo sapiens
cagccccacacagct

SEQ ID NO: 6016488 - DNA, 12 bp, Homo sapiens
cagccccacacc

SEQ ID NO: 6016489 - DNA, 16 bp, Homo sapiens
cagccccacaccaggg

SEQ ID NO: 6016490 - DNA, 12 bp, Homo sapiens
cagccccacagc

SEQ ID NO: 6016491 - DNA, 13 bp, Homo sapiens
cagccccacagca

SEQ ID NO: 6016492 - DNA, 14 bp, Homo sapiens
cagccccacagcac

SEQ ID NO: 6016493 - DNA, 19 bp, Homo sapiens
cagccccacagcacccagg

SEQ ID NO: 6016494 - DNA, 20 bp, Homo sapiens
cagccccacagcacccaggc

SEQ ID NO: 6016495 - DNA, 22 bp, Homo sapiens
cagccccacagcacccaggctc

SEQ ID NO: 6016496 - DNA, 15 bp, Homo sapiens
cagccccacagtccc

SEQ ID NO: 6016497 - DNA, 11 bp, Homo sapiens
cagccccaccc

SEQ ID NO: 6016498 - DNA, 13 bp, Homo sapiens
cagccccacccag

SEQ ID NO: 6016499 - DNA, 16 bp, Homo sapiens
cagccccacccaggag

SEQ ID NO: 6016500 - DNA, 23 bp, Homo sapiens
cagccccaccccaccctgcccct

SEQ ID NO: 6016501 - DNA, 14 bp, Homo sapiens
cagccccaccccag

SEQ ID NO: 6016502 - DNA, 18 bp, Homo sapiens
cagccccacccccagcca

SEQ ID NO: 6016503 - DNA, 20 bp, Homo sapiens
cagccccacccccagccagg

SEQ ID NO: 6016504 - DNA, 21 bp, Homo sapiens
cagccccacccctaagtgccc

SEQ ID NO: 6016505 - DNA, 15 bp, Homo sapiens
cagccccaccctggc

SEQ ID NO: 6016506 - DNA, 15 bp, Homo sapiens
cagccccacccttgt

SEQ ID NO: 6016507 - DNA, 18 bp, Homo sapiens
cagccccactcctctgct

SEQ ID NO: 6016508 - DNA, 21 bp, Homo sapiens
cagccccactcctctgctgac

SEQ ID NO: 6016509 - DNA, 12 bp, Homo sapiens
cagccccactgc

SEQ ID NO: 6016510 - DNA, 14 bp, Homo sapiens
cagccccactgcca

SEQ ID NO: 6016511 - DNA, 18 bp, Homo sapiens
cagccccacttcaccccc

SEQ ID NO: 6016512 - DNA, 19 bp, Homo sapiens
cagccccacttcaccccca

SEQ ID NO: 6016513 - DNA, 17 bp, Homo sapiens
cagccccacttctgggt

SEQ ID NO: 6016514 - DNA, 21 bp, Homo sapiens
cagccccagacaacagcccag

SEQ ID NO: 6016515 - DNA, 15 bp, Homo sapiens
cagccccagacctgc

SEQ ID NO: 6016516 - DNA, 14 bp, Homo sapiens
cagccccagagaga

SEQ ID NO: 6016517 - DNA, 15 bp, Homo sapiens
cagccccagcccaga

SEQ ID NO: 6016518 - DNA, 14 bp, Homo sapiens
cagccccagcctgc

SEQ ID NO: 6016519 - DNA, 16 bp, Homo sapiens
cagccccagcctgcta

SEQ ID NO: 6016520 - DNA, 13 bp, Homo sapiens
cagccccaggaga

SEQ ID NO: 6016521 - DNA, 13 bp, Homo sapiens
cagccccaggcct

SEQ ID NO: 6016522 - DNA, 14 bp, Homo sapiens
cagccccaggcctc

SEQ ID NO: 6016523 - DNA, 15 bp, Homo sapiens
cagccccaggcctgg

SEQ ID NO: 6016524 - DNA, 17 bp, Homo sapiens
cagccccaggcctggcc

SEQ ID NO: 6016525 - DNA, 13 bp, Homo sapiens
cagccccagggcc

SEQ ID NO: 6016526 - DNA, 12 bp, Homo sapiens
cagccccagggg

SEQ ID NO: 6016527 - DNA, 16 bp, Homo sapiens
cagccccagtgcccac

SEQ ID NO: 6016528 - DNA, 15 bp, Homo sapiens
cagccccatagaaaa

SEQ ID NO: 6016529 - DNA, 16 bp, Homo sapiens
cagccccatagaaaac

SEQ ID NO: 6016530 - DNA, 19 bp, Homo sapiens
cagccccatagaaaacaat

SEQ ID NO: 6016531 - DNA, 12 bp, Homo sapiens
cagccccatccc

SEQ ID NO: 6016532 - DNA, 22 bp, Homo sapiens
cagccccatcccaaacccttca

SEQ ID NO: 6016533 - DNA, 14 bp, Homo sapiens
cagccccatcctct

SEQ ID NO: 6016534 - DNA, 21 bp, Homo sapiens
cagccccatccttcccgcagc

SEQ ID NO: 6016535 - DNA, 22 bp, Homo sapiens
cagccccatcgccccaactcca

SEQ ID NO: 6016536 - DNA, 18 bp, Homo sapiens
cagccccatcttggtcct

SEQ ID NO: 6016537 - DNA, 13 bp, Homo sapiens
cagccccattctg

SEQ ID NO: 6016538 - DNA, 14 bp, Homo sapiens
cagccccattctgc

SEQ ID NO: 6016539 - DNA, 19 bp, Homo sapiens
cagccccattctgcctgcc

SEQ ID NO: 6016540 - DNA, 20 bp, Homo sapiens
cagccccattctgcctgccc

SEQ ID NO: 6016541 - DNA, 23 bp, Homo sapiens
cagccccattctgcctgcccagg

SEQ ID NO: 6016542 - DNA, 21 bp, Homo sapiens
cagcccccaaagagctgtggc

SEQ ID NO: 6016543 - DNA, 22 bp, Homo sapiens
cagcccccaaagagctgtggct

SEQ ID NO: 6016544 - DNA, 12 bp, Homo sapiens
cagcccccacag

SEQ ID NO: 6016545 - DNA, 17 bp, Homo sapiens
cagcccccacagccctg

SEQ ID NO: 6016546 - DNA, 18 bp, Homo sapiens
cagcccccacagccctgg

SEQ ID NO: 6016547 - DNA, 19 bp, Homo sapiens
cagcccccacagccctgga

SEQ ID NO: 6016548 - DNA, 17 bp, Homo sapiens
cagcccccacagtgctg

SEQ ID NO: 6016549 - DNA, 13 bp, Homo sapiens
cagcccccaccag

SEQ ID NO: 6016550 - DNA, 13 bp, Homo sapiens
cagcccccacccc

SEQ ID NO: 6016551 - DNA, 14 bp, Homo sapiens
cagcccccaccccc

SEQ ID NO: 6016552 - DNA, 12 bp, Homo sapiens
cagcccccacgc

SEQ ID NO: 6016553 - DNA, 19 bp, Homo sapiens
cagcccccactgacctgcc

SEQ ID NO: 6016554 - DNA, 19 bp, Homo sapiens
cagcccccagctcccacct

SEQ ID NO: 6016555 - DNA, 21 bp, Homo sapiens
cagcccccagctcccacctcc

SEQ ID NO: 6016556 - DNA, 19 bp, Homo sapiens
cagcccccaggatctgggt

SEQ ID NO: 6016557 - DNA, 14 bp, Homo sapiens
cagcccccaggcca

SEQ ID NO: 6016558 - DNA, 12 bp, Homo sapiens
cagcccccaggg

SEQ ID NO: 6016559 - DNA, 14 bp, Homo sapiens
cagccccccagtgt

SEQ ID NO: 6016560 - DNA, 18 bp, Homo sapiens
cagcccccccacccaccc

SEQ ID NO: 6016561 - DNA, 22 bp, Homo sapiens
cagccccccttgccccacctcc

SEQ ID NO: 6016562 - DNA, 16 bp, Homo sapiens
cagcccccgccccaga

SEQ ID NO: 6016563 - DNA, 18 bp, Homo sapiens
cagcccccgccccagagt

SEQ ID NO: 6016564 - DNA, 23 bp, Homo sapiens
cagcccccgccccagagtggccc

SEQ ID NO: 6016565 - DNA, 15 bp, Homo sapiens
cagcccccgcgccct

SEQ ID NO: 6016566 - DNA, 12 bp, Homo sapiens
cagccccctcca

SEQ ID NO: 6016567 - DNA, 15 bp, Homo sapiens
cagccccctccacac

SEQ ID NO: 6016568 - DNA, 14 bp, Homo sapiens
cagccccctcctgg

SEQ ID NO: 6016569 - DNA, 22 bp, Homo sapiens
cagccccctcctggtgccacct

SEQ ID NO: 6016570 - DNA, 12 bp, Homo sapiens
cagccccctgac

SEQ ID NO: 6016571 - DNA, 13 bp, Homo sapiens
cagccccctgacc

SEQ ID NO: 6016572 - DNA, 16 bp, Homo sapiens
cagccccctgcttcag

SEQ ID NO: 6016573 - DNA, 22 bp, Homo sapiens
cagccccctgcttctcccgcca

SEQ ID NO: 6016574 - DNA, 14 bp, Homo sapiens
cagccccctggatg

SEQ ID NO: 6016575 - DNA, 22 bp, Homo sapiens
cagccccctggatgggcattgg

SEQ ID NO: 6016576 - DNA, 16 bp, Homo sapiens
cagccccctggcccct

SEQ ID NO: 6016577 - DNA, 14 bp, Homo sapiens
cagcccccttgccc

SEQ ID NO: 6016578 - DNA, 19 bp, Homo sapiens
cagcccccttgccctccgc

SEQ ID NO: 6016579 - DNA, 23 bp, Homo sapiens
cagcccccttgccctccgcctgg

SEQ ID NO: 6016580 - DNA, 15 bp, Homo sapiens
cagccccctttgggc

SEQ ID NO: 6016581 - DNA, 19 bp, Homo sapiens
cagccccctttgggcccag

SEQ ID NO: 6016582 - DNA, 21 bp, Homo sapiens
cagccccctttgggcccaggg

SEQ ID NO: 6016583 - DNA, 15 bp, Homo sapiens
cagccccgactccag

SEQ ID NO: 6016584 - DNA, 22 bp, Homo sapiens
cagccccgacttcctgactctc

SEQ ID NO: 6016585 - DNA, 21 bp, Homo sapiens
cagccccgcctgtcacaataa

SEQ ID NO: 6016586 - DNA, 17 bp, Homo sapiens
cagccccgcgaccaccc

SEQ ID NO: 6016587 - DNA, 21 bp, Homo sapiens
cagccccgcgaccatgtggcc

SEQ ID NO: 6016588 - DNA, 16 bp, Homo sapiens
cagccccgcgcctcct

SEQ ID NO: 6016589 - DNA, 23 bp, Homo sapiens
cagccccgcggatcaaccaggca

SEQ ID NO: 6016590 - DNA, 15 bp, Homo sapiens
cagccccgctcccag

SEQ ID NO: 6016591 - DNA, 14 bp, Homo sapiens
cagccccggccacc

SEQ ID NO: 6016592 - DNA, 19 bp, Homo sapiens
cagccccggccactccctg

SEQ ID NO: 6016593 - DNA, 14 bp, Homo sapiens
cagccccgggcctg

SEQ ID NO: 6016594 - DNA, 17 bp, Homo sapiens
cagccccgggcctgcct

SEQ ID NO: 6016595 - DNA, 19 bp, Homo sapiens
cagccccgggcctgcctct

SEQ ID NO: 6016596 - DNA, 13 bp, Homo sapiens
cagccccggggcc

SEQ ID NO: 6016597 - DNA, 15 bp, Homo sapiens
cagccccgtcccaga

SEQ ID NO: 6016598 - DNA, 17 bp, Homo sapiens
cagccccgtctgcccac

SEQ ID NO: 6016599 - DNA, 19 bp, Homo sapiens
cagccccgtctgcccacca

SEQ ID NO: 6016600 - DNA, 20 bp, Homo sapiens
cagccccgtctgcccaccat

SEQ ID NO: 6016601 - DNA, 16 bp, Homo sapiens
cagccccgtgccagga

SEQ ID NO: 6016602 - DNA, 22 bp, Homo sapiens
cagccccgttttggggacgtga

SEQ ID NO: 6016603 - DNA, 15 bp, Homo sapiens
cagcccctaagcccc

SEQ ID NO: 6016604 - DNA, 13 bp, Homo sapiens
cagcccctacccc

SEQ ID NO: 6016605 - DNA, 23 bp, Homo sapiens
cagcccctaccttgagaccctct

SEQ ID NO: 6016606 - DNA, 20 bp, Homo sapiens
cagcccctagaaacccaagc

SEQ ID NO: 6016607 - DNA, 23 bp, Homo sapiens
cagcccctagcagagcgtctggc

SEQ ID NO: 6016608 - DNA, 20 bp, Homo sapiens
cagcccctatagcactgagc

SEQ ID NO: 6016609 - DNA, 20 bp, Homo sapiens
cagcccctcaaccctccgtt

SEQ ID NO: 6016610 - DNA, 23 bp, Homo sapiens
cagcccctcaaccctccgttcct

SEQ ID NO: 6016611 - DNA, 13 bp, Homo sapiens
cagcccctccacg

SEQ ID NO: 6016612 - DNA, 14 bp, Homo sapiens
cagcccctccagtc

SEQ ID NO: 6016613 - DNA, 17 bp, Homo sapiens
cagcccctccatctgta

SEQ ID NO: 6016614 - DNA, 22 bp, Homo sapiens
cagcccctcccaccacagcagg

SEQ ID NO: 6016615 - DNA, 15 bp, Homo sapiens
cagcccctcccagat

SEQ ID NO: 6016616 - DNA, 17 bp, Homo sapiens
cagcccctcccagccta

SEQ ID NO: 6016617 - DNA, 17 bp, Homo sapiens
cagcccctccccagact

SEQ ID NO: 6016618 - DNA, 13 bp, Homo sapiens
cagcccctccccg

SEQ ID NO: 6016619 - DNA, 16 bp, Homo sapiens
cagcccctccccgcct

SEQ ID NO: 6016620 - DNA, 18 bp, Homo sapiens
cagcccctccctcctctg

SEQ ID NO: 6016621 - DNA, 13 bp, Homo sapiens
cagcccctcctcc

SEQ ID NO: 6016622 - DNA, 21 bp, Homo sapiens
cagcccctcctccccttcctg

SEQ ID NO: 6016623 - DNA, 21 bp, Homo sapiens
cagcccctcctccctcagacc

SEQ ID NO: 6016624 - DNA, 23 bp, Homo sapiens
cagcccctcctccctcagaccca

SEQ ID NO: 6016625 - DNA, 19 bp, Homo sapiens
cagcccctcctccctcagg

SEQ ID NO: 6016626 - DNA, 20 bp, Homo sapiens
cagcccctcctccctcaggc

SEQ ID NO: 6016627 - DNA, 23 bp, Homo sapiens
cagcccctcctccctcaggccca

SEQ ID NO: 6016628 - DNA, 13 bp, Homo sapiens
cagcccctcctct

SEQ ID NO: 6016629 - DNA, 15 bp, Homo sapiens
cagcccctcctctgc

SEQ ID NO: 6016630 - DNA, 16 bp, Homo sapiens
cagcccctcctctgcc

SEQ ID NO: 6016631 - DNA, 18 bp, Homo sapiens
cagcccctctggtcgctc

SEQ ID NO: 6016632 - DNA, 21 bp, Homo sapiens
cagcccctctggtcgctcctg

SEQ ID NO: 6016633 - DNA, 11 bp, Homo sapiens
cagcccctctt

SEQ ID NO: 6016634 - DNA, 22 bp, Homo sapiens
cagcccctcttcccttcctcca

SEQ ID NO: 6016635 - DNA, 15 bp, Homo sapiens
cagcccctcttgccc

SEQ ID NO: 6016636 - DNA, 22 bp, Homo sapiens
cagcccctcttgccccccaccc

SEQ ID NO: 6016637 - DNA, 23 bp, Homo sapiens
cagcccctcttgccccccacccc

SEQ ID NO: 6016638 - DNA, 21 bp, Homo sapiens
cagcccctcttggagaagtct

SEQ ID NO: 6016639 - DNA, 23 bp, Homo sapiens
cagcccctcttggagaagtctca

SEQ ID NO: 6016640 - DNA, 24 bp, Homo sapiens
cagcccctcttggagaagtctcag

SEQ ID NO: 6016641 - DNA, 14 bp, Homo sapiens
cagcccctgatcct

SEQ ID NO: 6016642 - DNA, 21 bp, Homo sapiens
cagcccctgatcctgtgaagt

SEQ ID NO: 6016643 - DNA, 14 bp, Homo sapiens
cagcccctgatctc

SEQ ID NO: 6016644 - DNA, 19 bp, Homo sapiens
cagcccctgatctctgacc

SEQ ID NO: 6016645 - DNA, 14 bp, Homo sapiens
cataccaatgaaaa

SEQ ID NO: 6016646 - DNA, 22 bp, Homo sapiens
cataccagagtctggagctgag

SEQ ID NO: 6016647 - DNA, 22 bp, Homo sapiens
cataccagctcgcacccccctg

SEQ ID NO: 6016648 - DNA, 23 bp, Homo sapiens
cataccagctcgcacccccctgt

SEQ ID NO: 6016649 - DNA, 20 bp, Homo sapiens
cataccaggcaacctcccat

SEQ ID NO: 6016650 - DNA, 21 bp, Homo sapiens
cataccaggcaacctcccatc

SEQ ID NO: 6016651 - DNA, 23 bp, Homo sapiens
cataccaggcaacctcccatccc

SEQ ID NO: 6016652 - DNA, 22 bp, Homo sapiens
cataccaggccgccccagcctc

SEQ ID NO: 6016653 - DNA, 11 bp, Homo sapiens
cataccaggtg

SEQ ID NO: 6016654 - DNA, 12 bp, Homo sapiens
cataccagtcag

SEQ ID NO: 6016655 - DNA, 17 bp, Homo sapiens
cataccagttcttgcaa

SEQ ID NO: 6016656 - DNA, 21 bp, Homo sapiens
cataccatgtggatgcagcac

SEQ ID NO: 6016657 - DNA, 22 bp, Homo sapiens
catacccacacattccagggct

SEQ ID NO: 6016658 - DNA, 14 bp, Homo sapiens
catacccaccccca

SEQ ID NO: 6016659 - DNA, 22 bp, Homo sapiens
catacccacccttacttcctgg

SEQ ID NO: 6016660 - DNA, 12 bp, Homo sapiens
catacccatctg

SEQ ID NO: 6016661 - DNA, 16 bp, Homo sapiens
cataccccactgggca

SEQ ID NO: 6016662 - DNA, 17 bp, Homo sapiens
cataccccactgggcac

SEQ ID NO: 6016663 - DNA, 22 bp, Homo sapiens
cataccccactgggcacacgca

SEQ ID NO: 6016664 - DNA, 16 bp, Homo sapiens
cataccccagaaatta

SEQ ID NO: 6016665 - DNA, 13 bp, Homo sapiens
cataccccctccc

SEQ ID NO: 6016666 - DNA, 17 bp, Homo sapiens
cataccccctgccccag

SEQ ID NO: 6016667 - DNA, 19 bp, Homo sapiens
cataccccctgccccagag

SEQ ID NO: 6016668 - DNA, 20 bp, Homo sapiens
cataccccctgccccagaga

SEQ ID NO: 6016669 - DNA, 15 bp, Homo sapiens
catacccctgcctgg

SEQ ID NO: 6016670 - DNA, 17 bp, Homo sapiens
catacccctgcctgggt

SEQ ID NO: 6016671 - DNA, 18 bp, Homo sapiens
catacccctgcctgggtt

SEQ ID NO: 6016672 - DNA, 23 bp, Homo sapiens
catacccctgcctgggttttcta

SEQ ID NO: 6016673 - DNA, 18 bp, Homo sapiens
cataccccttacaaatga

SEQ ID NO: 6016674 - DNA, 16 bp, Homo sapiens
cataccccttattgct

SEQ ID NO: 6016675 - DNA, 19 bp, Homo sapiens
cataccccttattgctgcc

SEQ ID NO: 6016676 - DNA, 20 bp, Homo sapiens
cataccccttattgctgcca

SEQ ID NO: 6016677 - DNA, 22 bp, Homo sapiens
cataccccttattgctgccaaa

SEQ ID NO: 6016678 - DNA, 15 bp, Homo sapiens
catacccgtgacagt

SEQ ID NO: 6016679 - DNA, 17 bp, Homo sapiens
cataccctctacctgga

SEQ ID NO: 6016680 - DNA, 20 bp, Homo sapiens
catacccttctttaaatcaa

SEQ ID NO: 6016681 - DNA, 18 bp, Homo sapiens
cataccctttatctctgt

SEQ ID NO: 6016682 - DNA, 20 bp, Homo sapiens
cataccgaccatcgtccagc

SEQ ID NO: 6016683 - DNA, 22 bp, Homo sapiens
cataccgaccatcgtccagccc

SEQ ID NO: 6016684 - DNA, 17 bp, Homo sapiens
cataccgcctcgtgcca

SEQ ID NO: 6016685 - DNA, 19 bp, Homo sapiens
cataccgctggggaacaga

SEQ ID NO: 6016686 - DNA, 21 bp, Homo sapiens
cataccgctggggaacagagc

SEQ ID NO: 6016687 - DNA, 15 bp, Homo sapiens
catacctacatgtat

SEQ ID NO: 6016688 - DNA, 17 bp, Homo sapiens
catacctctgaccaaca

SEQ ID NO: 6016689 - DNA, 18 bp, Homo sapiens
catacctgctggtgcaga

SEQ ID NO: 6016690 - DNA, 13 bp, Homo sapiens
catacctgtctca

SEQ ID NO: 6016691 - DNA, 13 bp, Homo sapiens
cataccttccttc

SEQ ID NO: 6016692 - DNA, 14 bp, Homo sapiens
cataccttccttcc

SEQ ID NO: 6016693 - DNA, 15 bp, Homo sapiens
cataccttccttccc

SEQ ID NO: 6016694 - DNA, 12 bp, Homo sapiens
cataccttctcc

SEQ ID NO: 6016695 - DNA, 19 bp, Homo sapiens
cataccttctggttgcttc

SEQ ID NO: 6016696 - DNA, 17 bp, Homo sapiens
cataccttggccagcaa

SEQ ID NO: 6016697 - DNA, 21 bp, Homo sapiens
catacctttcacagcttttat

SEQ ID NO: 6016698 - DNA, 14 bp, Homo sapiens
catacctttccagg

SEQ ID NO: 6016699 - DNA, 16 bp, Homo sapiens
catacctttccagggt

SEQ ID NO: 6016700 - DNA, 22 bp, Homo sapiens
catacctttccagggtcaaagt

SEQ ID NO: 6016701 - DNA, 21 bp, Homo sapiens
catacctttttcttaaaaaaa

SEQ ID NO: 6016702 - DNA, 16 bp, Homo sapiens
catacgaaacacaaac

SEQ ID NO: 6016703 - DNA, 21 bp, Homo sapiens
catacgcaaaaacttccttta

SEQ ID NO: 6016704 - DNA, 16 bp, Homo sapiens
catacgcaattgtata

SEQ ID NO: 6016705 - DNA, 16 bp, Homo sapiens
catacgcatcccatct

SEQ ID NO: 6016706 - DNA, 23 bp, Homo sapiens
catacgcattaagggcctgctgg

SEQ ID NO: 6016707 - DNA, 13 bp, Homo sapiens
catacgcggagga

SEQ ID NO: 6016708 - DNA, 15 bp, Homo sapiens
catacgcggaggagt

SEQ ID NO: 6016709 - DNA, 16 bp, Homo sapiens
catacggggtggctga

SEQ ID NO: 6016710 - DNA, 15 bp, Homo sapiens
catacgtaaaaatct

SEQ ID NO: 6016711 - DNA, 15 bp, Homo sapiens
catacgtacacattt

SEQ ID NO: 6016712 - DNA, 20 bp, Homo sapiens
catacgtattgttaaatgat

SEQ ID NO: 6016713 - DNA, 13 bp, Homo sapiens
catacgtccacca

SEQ ID NO: 6016714 - DNA, 13 bp, Homo sapiens
catacgtctgcca

SEQ ID NO: 6016715 - DNA, 14 bp, Homo sapiens
catacgtgcacagg

SEQ ID NO: 6016716 - DNA, 17 bp, Homo sapiens
catacgtgcccatttca

SEQ ID NO: 6016717 - DNA, 16 bp, Homo sapiens
catacgtgttctatag

SEQ ID NO: 6016718 - DNA, 22 bp, Homo sapiens
catacgttgatagtttacaaac

SEQ ID NO: 6016719 - DNA, 17 bp, Homo sapiens
catacgtttaaaataaa

SEQ ID NO: 6016720 - DNA, 13 bp, Homo sapiens
catactaataaat

SEQ ID NO: 6016721 - DNA, 15 bp, Homo sapiens
catactaatgaagta

SEQ ID NO: 6016722 - DNA, 22 bp, Homo sapiens
catactaatgaagtattacatg

SEQ ID NO: 6016723 - DNA, 21 bp, Homo sapiens
catactaatgatgagcattta

SEQ ID NO: 6016724 - DNA, 13 bp, Homo sapiens
catactacccttt

SEQ ID NO: 6016725 - DNA, 17 bp, Homo sapiens
catactaccctttgctg

SEQ ID NO: 6016726 - DNA, 17 bp, Homo sapiens
catactacctagaagta

SEQ ID NO: 6016727 - DNA, 19 bp, Homo sapiens
catactacctagaagtaag

SEQ ID NO: 6016728 - DNA, 18 bp, Homo sapiens
catactactgaaacagat

SEQ ID NO: 6016729 - DNA, 17 bp, Homo sapiens
catactaggtgcctttt

SEQ ID NO: 6016730 - DNA, 21 bp, Homo sapiens
catactatagattctttatta

SEQ ID NO: 6016731 - DNA, 18 bp, Homo sapiens
catactatgaaatatgta

SEQ ID NO: 6016732 - DNA, 18 bp, Homo sapiens
catactattaaacatgct

SEQ ID NO: 6016733 - DNA, 14 bp, Homo sapiens
catactcaaatggt

SEQ ID NO: 6016734 - DNA, 24 bp, Homo sapiens
catactcaaatggtgtcatggctg

SEQ ID NO: 6016735 - DNA, 18 bp, Homo sapiens
catactcaagctgtctct

SEQ ID NO: 6016736 - DNA, 19 bp, Homo sapiens
catactcaatgttactatc

SEQ ID NO: 6016737 - DNA, 15 bp, Homo sapiens
catactcagcctgct

SEQ ID NO: 6016738 - DNA, 18 bp, Homo sapiens
catactcatttctaaaag

SEQ ID NO: 6016739 - DNA, 12 bp, Homo sapiens
catactcatttg

SEQ ID NO: 6016740 - DNA, 19 bp, Homo sapiens
catactccgtgaggctgct

SEQ ID NO: 6016741 - DNA, 20 bp, Homo sapiens
catactccgtgaggctgctg

SEQ ID NO: 6016742 - DNA, 22 bp, Homo sapiens
catactccgtgaggctgctgcc

SEQ ID NO: 6016743 - DNA, 22 bp, Homo sapiens
catactcctctccttcaaagaa

SEQ ID NO: 6016744 - DNA, 20 bp, Homo sapiens
catactccttttggctgggg

SEQ ID NO: 6016745 - DNA, 12 bp, Homo sapiens
catactctccag

SEQ ID NO: 6016746 - DNA, 11 bp, Homo sapiens
catactctgct

SEQ ID NO: 6016747 - DNA, 16 bp, Homo sapiens
catactctgtctccct

SEQ ID NO: 6016748 - DNA, 22 bp, Homo sapiens
catactctgtgtaatctctgat

SEQ ID NO: 6016749 - DNA, 12 bp, Homo sapiens
catactctgttg

SEQ ID NO: 6016750 - DNA, 18 bp, Homo sapiens
catactctgttgcctcct

SEQ ID NO: 6016751 - DNA, 14 bp, Homo sapiens
catactcttaagtg

SEQ ID NO: 6016752 - DNA, 14 bp, Homo sapiens
catactcttctaaa

SEQ ID NO: 6016753 - DNA, 15 bp, Homo sapiens
catactcttctaaaa

SEQ ID NO: 6016754 - DNA, 18 bp, Homo sapiens
catactgaaaaaatgctg

SEQ ID NO: 6016755 - DNA, 23 bp, Homo sapiens
catactgaaaaaatgctgagcca

SEQ ID NO: 6016756 - DNA, 19 bp, Homo sapiens
catactgagccaagtataa

SEQ ID NO: 6016757 - DNA, 22 bp, Homo sapiens
catactgagccaagtataattt

SEQ ID NO: 6016758 - DNA, 13 bp, Homo sapiens
catactgagcctg

SEQ ID NO: 6016759 - DNA, 16 bp, Homo sapiens
catactgatgagacaa

SEQ ID NO: 6016760 - DNA, 15 bp, Homo sapiens
catactgattgggag

SEQ ID NO: 6016761 - DNA, 17 bp, Homo sapiens
catactgattgggaggt

SEQ ID NO: 6016762 - DNA, 20 bp, Homo sapiens
catactgattgggaggtgcg

SEQ ID NO: 6016763 - DNA, 23 bp, Homo sapiens
catactgccgaagaattgtcttg

SEQ ID NO: 6016764 - DNA, 20 bp, Homo sapiens
catactgccttgtttaatgt

SEQ ID NO: 6016765 - DNA, 18 bp, Homo sapiens
catactgcgtccaccctg

SEQ ID NO: 6016766 - DNA, 20 bp, Homo sapiens
catactgcgtccaccctgag

SEQ ID NO: 6016767 - DNA, 22 bp, Homo sapiens
catactgcgtccaccctgagct

SEQ ID NO: 6016768 - DNA, 12 bp, Homo sapiens
catactgctgga

SEQ ID NO: 6016769 - DNA, 11 bp, Homo sapiens
catactgctgt

SEQ ID NO: 6016770 - DNA, 13 bp, Homo sapiens
catactggcagga

SEQ ID NO: 6016771 - DNA, 12 bp, Homo sapiens
catactggcctc

SEQ ID NO: 6016772 - DNA, 13 bp, Homo sapiens
catactggcctcg

SEQ ID NO: 6016773 - DNA, 21 bp, Homo sapiens
catactggcctcgcctggcct

SEQ ID NO: 6016774 - DNA, 22 bp, Homo sapiens
catactggcctcgcctggcctg

SEQ ID NO: 6016775 - DNA, 15 bp, Homo sapiens
catactggcctctgt

SEQ ID NO: 6016776 - DNA, 13 bp, Homo sapiens
catactggcctgg

SEQ ID NO: 6016777 - DNA, 22 bp, Homo sapiens
catactggcctggactgttttc

SEQ ID NO: 6016778 - DNA, 21 bp, Homo sapiens
catactgtagacactctgaca

SEQ ID NO: 6016779 - DNA, 18 bp, Homo sapiens
catactgtatttttacta

SEQ ID NO: 6016780 - DNA, 18 bp, Homo sapiens
catactgtctctggagtg

SEQ ID NO: 6016781 - DNA, 24 bp, Homo sapiens
catactgtgcaggcctgtccctgg

SEQ ID NO: 6016782 - DNA, 19 bp, Homo sapiens
catactgtgctggagccac

SEQ ID NO: 6016783 - DNA, 12 bp, Homo sapiens
catactgtgtat

SEQ ID NO: 6016784 - DNA, 14 bp, Homo sapiens
catactgtgtatgt

SEQ ID NO: 6016785 - DNA, 18 bp, Homo sapiens
catactgtgtatgtttta

SEQ ID NO: 6016786 - DNA, 21 bp, Homo sapiens
catactgttgatacaaaccac

SEQ ID NO: 6016787 - DNA, 16 bp, Homo sapiens
catacttacatttcag

SEQ ID NO: 6016788 - DNA, 20 bp, Homo sapiens
catacttatctctctgtgct

SEQ ID NO: 6016789 - DNA, 22 bp, Homo sapiens
catacttatctctctgtgctgt

SEQ ID NO: 6016790 - DNA, 16 bp, Homo sapiens
catacttcaaaaatgt

SEQ ID NO: 6016791 - DNA, 14 bp, Homo sapiens
catacttcaaaagt

SEQ ID NO: 6016792 - DNA, 19 bp, Homo sapiens
catacttcaaaagtatttt

SEQ ID NO: 6016793 - DNA, 23 bp, Homo sapiens
catacttcatcgcagtggactgt

SEQ ID NO: 6016794 - DNA, 15 bp, Homo sapiens
catacttcctgggat

SEQ ID NO: 6016795 - DNA, 16 bp, Homo sapiens
catacttcctgggatg

SEQ ID NO: 6016796 - DNA, 16 bp, Homo sapiens
catacttctctcagat

SEQ ID NO: 6016797 - DNA, 23 bp, Homo sapiens
catacttgaacgttttctaattg

SEQ ID NO: 6016798 - DNA, 13 bp, Homo sapiens
catacttgaaggg

SEQ ID NO: 6016799 - DNA, 22 bp, Homo sapiens
catacttgaagggccagagcca

SEQ ID NO: 6016800 - DNA, 21 bp, Homo sapiens
catacttggctgcttcctgtg

SEQ ID NO: 6016801 - DNA, 15 bp, Homo sapiens
catacttgttctgta

SEQ ID NO: 6016802 - DNA, 19 bp, Homo sapiens
catactttacagtaaaatt

SEQ ID NO: 6016803 - DNA, 16 bp, Homo sapiens
catactttatatatgt

SEQ ID NO: 6016804 - DNA, 14 bp, Homo sapiens
catactttcatcct

SEQ ID NO: 6016805 - DNA, 17 bp, Homo sapiens
catactttccaacatta

SEQ ID NO: 6016806 - DNA, 22 bp, Homo sapiens
catactttccaacattatcctg

SEQ ID NO: 6016807 - DNA, 14 bp, Homo sapiens
catactttcctgta

SEQ ID NO: 6016808 - DNA, 14 bp, Homo sapiens
catactttgacaag

SEQ ID NO: 6016809 - DNA, 23 bp, Homo sapiens
catactttgacaaggaaaatcta

SEQ ID NO: 6016810 - DNA, 12 bp, Homo sapiens
catactttggat

SEQ ID NO: 6016811 - DNA, 22 bp, Homo sapiens
catactttgtaaataggatttt

SEQ ID NO: 6016812 - DNA, 17 bp, Homo sapiens
catactttgtattttga

SEQ ID NO: 6016813 - DNA, 18 bp, Homo sapiens
catactttgtattttgat

SEQ ID NO: 6016814 - DNA, 14 bp, Homo sapiens
catactttgtctga

SEQ ID NO: 6016815 - DNA, 16 bp, Homo sapiens
catactttgtctgaaa

SEQ ID NO: 6016816 - DNA, 18 bp, Homo sapiens
catactttgtctgaaaaa

SEQ ID NO: 6016817 - DNA, 17 bp, Homo sapiens
catacttttgagagggg

SEQ ID NO: 6016818 - DNA, 23 bp, Homo sapiens
catacttttgatatgattgtaac

SEQ ID NO: 6016819 - DNA, 12 bp, Homo sapiens
catactttttgg

SEQ ID NO: 6016820 - DNA, 18 bp, Homo sapiens
catactttttgggtttat

SEQ ID NO: 6016821 - DNA, 13 bp, Homo sapiens
catagaaaaatga

SEQ ID NO: 6016822 - DNA, 21 bp, Homo sapiens
catagaaaacaatctgcccac

SEQ ID NO: 6016823 - DNA, 23 bp, Homo sapiens
cagcccctgatctctgacctctg

SEQ ID NO: 6016824 - DNA, 13 bp, Homo sapiens
cagcccctgcaga

SEQ ID NO: 6016825 - DNA, 11 bp, Homo sapiens
cagcccctgcc

SEQ ID NO: 6016826 - DNA, 12 bp, Homo sapiens
cagcccctgccc

SEQ ID NO: 6016827 - DNA, 19 bp, Homo sapiens
cagcccctgccccagccca

SEQ ID NO: 6016828 - DNA, 14 bp, Homo sapiens
cagcccctgcctgg

SEQ ID NO: 6016829 - DNA, 13 bp, Homo sapiens
cagcccctgcggc

SEQ ID NO: 6016830 - DNA, 15 bp, Homo sapiens
cagcccctgctgctc

SEQ ID NO: 6016831 - DNA, 14 bp, Homo sapiens
cagcccctgctgga

SEQ ID NO: 6016832 - DNA, 17 bp, Homo sapiens
cagcccctgctggacca

SEQ ID NO: 6016833 - DNA, 20 bp, Homo sapiens
cagcccctggacccctgggg

SEQ ID NO: 6016834 - DNA, 12 bp, Homo sapiens
cagcccctggag

SEQ ID NO: 6016835 - DNA, 14 bp, Homo sapiens
cagcccctggagcc

SEQ ID NO: 6016836 - DNA, 19 bp, Homo sapiens
cagcccctggagctcctgc

SEQ ID NO: 6016837 - DNA, 13 bp, Homo sapiens
cagcccctggatg

SEQ ID NO: 6016838 - DNA, 22 bp, Homo sapiens
cagcccctggatgcagcctcac

SEQ ID NO: 6016839 - DNA, 20 bp, Homo sapiens
cagcccctggcactgcaggt

SEQ ID NO: 6016840 - DNA, 13 bp, Homo sapiens
cagcccctggccc

SEQ ID NO: 6016841 - DNA, 21 bp, Homo sapiens
cagcccctggccccaggacct

SEQ ID NO: 6016842 - DNA, 16 bp, Homo sapiens
cagcccctgggccctt

SEQ ID NO: 6016843 - DNA, 22 bp, Homo sapiens
cagcccctgggcccttgtgctc

SEQ ID NO: 6016844 - DNA, 17 bp, Homo sapiens
cagcccctggggcccag

SEQ ID NO: 6016845 - DNA, 19 bp, Homo sapiens
cagcccctggggcccagcc

SEQ ID NO: 6016846 - DNA, 20 bp, Homo sapiens
cagcccctgttctggcagag

SEQ ID NO: 6016847 - DNA, 18 bp, Homo sapiens
cagcccctgttttctgct

SEQ ID NO: 6016848 - DNA, 17 bp, Homo sapiens
cagccccttagacagag

SEQ ID NO: 6016849 - DNA, 18 bp, Homo sapiens
cagccccttcccctggga

SEQ ID NO: 6016850 - DNA, 20 bp, Homo sapiens
cagccccttcccctgggaac

SEQ ID NO: 6016851 - DNA, 14 bp, Homo sapiens
cagccccttcccgg

SEQ ID NO: 6016852 - DNA, 17 bp, Homo sapiens
cagccccttcctgggta

SEQ ID NO: 6016853 - DNA, 15 bp, Homo sapiens
cagccccttctcaga

SEQ ID NO: 6016854 - DNA, 20 bp, Homo sapiens
cagccccttctcagaatcta

SEQ ID NO: 6016855 - DNA, 15 bp, Homo sapiens
cagccccttctcccc

SEQ ID NO: 6016856 - DNA, 23 bp, Homo sapiens
cagccccttctgacccatgctgc

SEQ ID NO: 6016857 - DNA, 13 bp, Homo sapiens
cagccccttctgg

SEQ ID NO: 6016858 - DNA, 18 bp, Homo sapiens
cagccccttctggccggt

SEQ ID NO: 6016859 - DNA, 14 bp, Homo sapiens
cagcccgaagccca

SEQ ID NO: 6016860 - DNA, 16 bp, Homo sapiens
cagcccgaagcccagt

SEQ ID NO: 6016861 - DNA, 16 bp, Homo sapiens
cagcccgacagtgcca

SEQ ID NO: 6016862 - DNA, 20 bp, Homo sapiens
cagcccgacagtgccatccc

SEQ ID NO: 6016863 - DNA, 19 bp, Homo sapiens
cagcccgaccaacatggag

SEQ ID NO: 6016864 - DNA, 22 bp, Homo sapiens
cagcccgagccccttggggagc

SEQ ID NO: 6016865 - DNA, 24 bp, Homo sapiens
cagcccgagtggtctcctctcagc

SEQ ID NO: 6016866 - DNA, 19 bp, Homo sapiens
cagcccgatcctcccctgg

SEQ ID NO: 6016867 - DNA, 22 bp, Homo sapiens
cagcccgatcctcccctggact

SEQ ID NO: 6016868 - DNA, 20 bp, Homo sapiens
cagcccgatgtccctgtccc

SEQ ID NO: 6016869 - DNA, 18 bp, Homo sapiens
cagcccgcaactctccag

SEQ ID NO: 6016870 - DNA, 19 bp, Homo sapiens
cagcccgcaactctccagc

SEQ ID NO: 6016871 - DNA, 14 bp, Homo sapiens
cagcccgcacacct

SEQ ID NO: 6016872 - DNA, 15 bp, Homo sapiens
cagcccgcagaggtg

SEQ ID NO: 6016873 - DNA, 19 bp, Homo sapiens
cagcccgcccactgggtaa

SEQ ID NO: 6016874 - DNA, 19 bp, Homo sapiens
cagcccgcctgccgtgcat

SEQ ID NO: 6016875 - DNA, 23 bp, Homo sapiens
cagcccgcctgccgtgcatggct

SEQ ID NO: 6016876 - DNA, 14 bp, Homo sapiens
cagcccgcggcctg

SEQ ID NO: 6016877 - DNA, 16 bp, Homo sapiens
cagcccgcggcctgga

SEQ ID NO: 6016878 - DNA, 15 bp, Homo sapiens
cagcccgcttggcca

SEQ ID NO: 6016879 - DNA, 18 bp, Homo sapiens
cagcccggacctctggag

SEQ ID NO: 6016880 - DNA, 21 bp, Homo sapiens
cagcccggcctgctcccagca

SEQ ID NO: 6016881 - DNA, 15 bp, Homo sapiens
cagcccggcgccacc

SEQ ID NO: 6016882 - DNA, 21 bp, Homo sapiens
cagcccggcgccaccatcctg

SEQ ID NO: 6016883 - DNA, 15 bp, Homo sapiens
cagcccggctcccac

SEQ ID NO: 6016884 - DNA, 17 bp, Homo sapiens
cagcccggctgctgctt

SEQ ID NO: 6016885 - DNA, 13 bp, Homo sapiens
cagcccggctggt

SEQ ID NO: 6016886 - DNA, 19 bp, Homo sapiens
cagcccgggagcctaggac

SEQ ID NO: 6016887 - DNA, 20 bp, Homo sapiens
cagcccgggagcctaggacc

SEQ ID NO: 6016888 - DNA, 16 bp, Homo sapiens
cagcccgggatcctga

SEQ ID NO: 6016889 - DNA, 17 bp, Homo sapiens
cagcccgggctctgcct

SEQ ID NO: 6016890 - DNA, 21 bp, Homo sapiens
cagcccgggctctgcctccca

SEQ ID NO: 6016891 - DNA, 14 bp, Homo sapiens
cagcccggggagga

SEQ ID NO: 6016892 - DNA, 17 bp, Homo sapiens
cagcccgtcctcctcta

SEQ ID NO: 6016893 - DNA, 18 bp, Homo sapiens
cagcccgtgatcccctgc

SEQ ID NO: 6016894 - DNA, 15 bp, Homo sapiens
cagcccgtgtggccc

SEQ ID NO: 6016895 - DNA, 20 bp, Homo sapiens
cagcccgtgtggccccttca

SEQ ID NO: 6016896 - DNA, 14 bp, Homo sapiens
cagccctaaacatc

SEQ ID NO: 6016897 - DNA, 16 bp, Homo sapiens
cagccctaaacatcat

SEQ ID NO: 6016898 - DNA, 18 bp, Homo sapiens
cagccctaaggatctctc

SEQ ID NO: 6016899 - DNA, 22 bp, Homo sapiens
cagccctaaggatctctcagga

SEQ ID NO: 6016900 - DNA, 21 bp, Homo sapiens
cagccctacatcttcagctcc

SEQ ID NO: 6016901 - DNA, 22 bp, Homo sapiens
cagccctacatcttcagctccc

SEQ ID NO: 6016902 - DNA, 23 bp, Homo sapiens
cagccctagagcctgcctggagc

SEQ ID NO: 6016903 - DNA, 17 bp, Homo sapiens
cagccctagccctcagc

SEQ ID NO: 6016904 - DNA, 23 bp, Homo sapiens
cagccctagcggctgctccttca

SEQ ID NO: 6016905 - DNA, 15 bp, Homo sapiens
cagccctagctgtcc

SEQ ID NO: 6016906 - DNA, 19 bp, Homo sapiens
cagccctagctgtcccatg

SEQ ID NO: 6016907 - DNA, 16 bp, Homo sapiens
cagccctaggctaccc

SEQ ID NO: 6016908 - DNA, 17 bp, Homo sapiens
cagccctaggctaccct

SEQ ID NO: 6016909 - DNA, 23 bp, Homo sapiens
cagccctaggctacccttgccaa

SEQ ID NO: 6016910 - DNA, 22 bp, Homo sapiens
cagccctagtatgaaagctggg

SEQ ID NO: 6016911 - DNA, 24 bp, Homo sapiens
cagccctagtgggagcccagcaca

SEQ ID NO: 6016912 - DNA, 14 bp, Homo sapiens
cagccctatggatg

SEQ ID NO: 6016913 - DNA, 15 bp, Homo sapiens
cagccctatggatgt

SEQ ID NO: 6016914 - DNA, 18 bp, Homo sapiens
cagccctcaattgtgaaa

SEQ ID NO: 6016915 - DNA, 18 bp, Homo sapiens
cagccctcacctctgagg

SEQ ID NO: 6016916 - DNA, 16 bp, Homo sapiens
cagccctcagaagaaa

SEQ ID NO: 6016917 - DNA, 14 bp, Homo sapiens
cagccctcaggcca

SEQ ID NO: 6016918 - DNA, 16 bp, Homo sapiens
cagccctcaggccagt

SEQ ID NO: 6016919 - DNA, 19 bp, Homo sapiens
cagccctcaggccagtgcc

SEQ ID NO: 6016920 - DNA, 22 bp, Homo sapiens
cagccctcaggccagtgccagg

SEQ ID NO: 6016921 - DNA, 19 bp, Homo sapiens
cagccctcattaaactaat

SEQ ID NO: 6016922 - DNA, 13 bp, Homo sapiens
cagccctccactt

SEQ ID NO: 6016923 - DNA, 13 bp, Homo sapiens
cagccctccagag

SEQ ID NO: 6016924 - DNA, 17 bp, Homo sapiens
cagccctccatggcctg

SEQ ID NO: 6016925 - DNA, 23 bp, Homo sapiens
cagccctcccagcagtggcttgc

SEQ ID NO: 6016926 - DNA, 17 bp, Homo sapiens
cagccctcccagctggt

SEQ ID NO: 6016927 - DNA, 19 bp, Homo sapiens
cagccctcccagctggtgt

SEQ ID NO: 6016928 - DNA, 15 bp, Homo sapiens
cagccctccccacct

SEQ ID NO: 6016929 - DNA, 19 bp, Homo sapiens
cagccctccccacctgctc

SEQ ID NO: 6016930 - DNA, 13 bp, Homo sapiens
cagccctccctgc

SEQ ID NO: 6016931 - DNA, 15 bp, Homo sapiens
cagccctccctgccc

SEQ ID NO: 6016932 - DNA, 16 bp, Homo sapiens
cagccctccctgcccc

SEQ ID NO: 6016933 - DNA, 18 bp, Homo sapiens
cagccctccctgcccctc

SEQ ID NO: 6016934 - DNA, 22 bp, Homo sapiens
cagccctccctgcccctccctt

SEQ ID NO: 6016935 - DNA, 20 bp, Homo sapiens
cagccctccctgtcctcctc

SEQ ID NO: 6016936 - DNA, 23 bp, Homo sapiens
cagccctccgccagccctgttcc

SEQ ID NO: 6016937 - DNA, 13 bp, Homo sapiens
cagccctcctcac

SEQ ID NO: 6016938 - DNA, 14 bp, Homo sapiens
cagccctcctcacc

SEQ ID NO: 6016939 - DNA, 22 bp, Homo sapiens
cagccctcctcaccccgtctgg

SEQ ID NO: 6016940 - DNA, 16 bp, Homo sapiens
cagccctccttcaggg

SEQ ID NO: 6016941 - DNA, 15 bp, Homo sapiens
cagccctcgcctctg

SEQ ID NO: 6016942 - DNA, 14 bp, Homo sapiens
cagccctcggcctc

SEQ ID NO: 6016943 - DNA, 15 bp, Homo sapiens
cagccctctccaccc

SEQ ID NO: 6016944 - DNA, 21 bp, Homo sapiens
cagccctctccacccagaggt

SEQ ID NO: 6016945 - DNA, 22 bp, Homo sapiens
cagccctctccacccagaggtc

SEQ ID NO: 6016946 - DNA, 11 bp, Homo sapiens
cagccctctgc

SEQ ID NO: 6016947 - DNA, 14 bp, Homo sapiens
cagccctctgcctc

SEQ ID NO: 6016948 - DNA, 16 bp, Homo sapiens
cagccctctgcctcct

SEQ ID NO: 6016949 - DNA, 19 bp, Homo sapiens
cagccctctgcctcctccc

SEQ ID NO: 6016950 - DNA, 13 bp, Homo sapiens
cagccctctgtgg

SEQ ID NO: 6016951 - DNA, 21 bp, Homo sapiens
cagccctctgtggccaggagc

SEQ ID NO: 6016952 - DNA, 18 bp, Homo sapiens
cagccctcttgcccgcac

SEQ ID NO: 6016953 - DNA, 12 bp, Homo sapiens
cagccctgaaac

SEQ ID NO: 6016954 - DNA, 19 bp, Homo sapiens
cagccctgagaaagccctg

SEQ ID NO: 6016955 - DNA, 23 bp, Homo sapiens
cagccctgagctagtgtcacctg

SEQ ID NO: 6016956 - DNA, 17 bp, Homo sapiens
cagccctgagctggcct

SEQ ID NO: 6016957 - DNA, 23 bp, Homo sapiens
cagccctgagctggcgtcacctg

SEQ ID NO: 6016958 - DNA, 11 bp, Homo sapiens
cagccctgagt

SEQ ID NO: 6016959 - DNA, 12 bp, Homo sapiens
cagccctgagtg

SEQ ID NO: 6016960 - DNA, 13 bp, Homo sapiens
cagccctgagtgg

SEQ ID NO: 6016961 - DNA, 17 bp, Homo sapiens
cagccctgagtggtcac

SEQ ID NO: 6016962 - DNA, 18 bp, Homo sapiens
cagccctgagtggtcact

SEQ ID NO: 6016963 - DNA, 17 bp, Homo sapiens
cagccctgattgtgcca

SEQ ID NO: 6016964 - DNA, 21 bp, Homo sapiens
cagccctgattgtgccagtgc

SEQ ID NO: 6016965 - DNA, 23 bp, Homo sapiens
cagccctgcaccatgctgctggg

SEQ ID NO: 6016966 - DNA, 14 bp, Homo sapiens
cagccctgcagagg

SEQ ID NO: 6016967 - DNA, 15 bp, Homo sapiens
cagccctgcccaccc

SEQ ID NO: 6016968 - DNA, 23 bp, Homo sapiens
cagccctgccccacacctcctct

SEQ ID NO: 6016969 - DNA, 21 bp, Homo sapiens
cagccctgcctggaggacctg

SEQ ID NO: 6016970 - DNA, 12 bp, Homo sapiens
cagccctgctag

SEQ ID NO: 6016971 - DNA, 13 bp, Homo sapiens
cagccctgctccc

SEQ ID NO: 6016972 - DNA, 22 bp, Homo sapiens
cagccctgctccctgcctcctg

SEQ ID NO: 6016973 - DNA, 23 bp, Homo sapiens
cagccctgctccctgcctcctgc

SEQ ID NO: 6016974 - DNA, 19 bp, Homo sapiens
cagccctgctgcttcctaa

SEQ ID NO: 6016975 - DNA, 20 bp, Homo sapiens
cagccctgctggccgcctca

SEQ ID NO: 6016976 - DNA, 21 bp, Homo sapiens
cagccctgctggccgcctcac

SEQ ID NO: 6016977 - DNA, 23 bp, Homo sapiens
cagccctgctggccgcctcaccc

SEQ ID NO: 6016978 - DNA, 20 bp, Homo sapiens
cagccctgctttgggctgcc

SEQ ID NO: 6016979 - DNA, 12 bp, Homo sapiens
cagccctggagg

SEQ ID NO: 6016980 - DNA, 14 bp, Homo sapiens
cagccctggaggct

SEQ ID NO: 6016981 - DNA, 20 bp, Homo sapiens
cagccctggaggctggatgg

SEQ ID NO: 6016982 - DNA, 21 bp, Homo sapiens
cagccctggaggctggatggc

SEQ ID NO: 6016983 - DNA, 18 bp, Homo sapiens
cagccctggaggtgccag

SEQ ID NO: 6016984 - DNA, 14 bp, Homo sapiens
cagccctggagtca

SEQ ID NO: 6016985 - DNA, 20 bp, Homo sapiens
cagccctggagtcatgccaa

SEQ ID NO: 6016986 - DNA, 13 bp, Homo sapiens
cagccctggatgg

SEQ ID NO: 6016987 - DNA, 17 bp, Homo sapiens
cagccctggatggtggc

SEQ ID NO: 6016988 - DNA, 21 bp, Homo sapiens
cagccctggcaaatgcctgac

SEQ ID NO: 6016989 - DNA, 21 bp, Homo sapiens
cagccctggcagggggcatgc

SEQ ID NO: 6016990 - DNA, 21 bp, Homo sapiens
cagccctggcccaccccccag

SEQ ID NO: 6016991 - DNA, 17 bp, Homo sapiens
cagccctggcccaggtg

SEQ ID NO: 6016992 - DNA, 13 bp, Homo sapiens
cagccctggcccc

SEQ ID NO: 6016993 - DNA, 22 bp, Homo sapiens
cagccctggcccccatcagccc

SEQ ID NO: 6016994 - DNA, 15 bp, Homo sapiens
cagccctggcccctg

SEQ ID NO: 6016995 - DNA, 18 bp, Homo sapiens
cagccctggcccctgtgg

SEQ ID NO: 6016996 - DNA, 19 bp, Homo sapiens
cagccctggcccctgtggg

SEQ ID NO: 6016997 - DNA, 14 bp, Homo sapiens
cagccctggccctg

SEQ ID NO: 6016998 - DNA, 15 bp, Homo sapiens
cagccctggccctgc

SEQ ID NO: 6016999 - DNA, 19 bp, Homo sapiens
cagccctggccctgcccag

SEQ ID NO: 6017000 - DNA, 20 bp, Homo sapiens
cagccctggccctgcccagc

SEQ ID NO: 6017001 - DNA, 24 bp, Homo sapiens
catagaaaacttgacatgtagctt

SEQ ID NO: 6017002 - DNA, 17 bp, Homo sapiens
catagaaacatgacact

SEQ ID NO: 6017003 - DNA, 19 bp, Homo sapiens
catagaaacatgacactga

SEQ ID NO: 6017004 - DNA, 20 bp, Homo sapiens
catagaaacatgacactgac

SEQ ID NO: 6017005 - DNA, 20 bp, Homo sapiens
catagaaactgtctagcact

SEQ ID NO: 6017006 - DNA, 16 bp, Homo sapiens
catagaaatacctcat

SEQ ID NO: 6017007 - DNA, 20 bp, Homo sapiens
catagaaatggaaattttgc

SEQ ID NO: 6017008 - DNA, 23 bp, Homo sapiens
catagaaatgtaacttttgtaag

SEQ ID NO: 6017009 - DNA, 19 bp, Homo sapiens
catagaaattgcctccagt

SEQ ID NO: 6017010 - DNA, 21 bp, Homo sapiens
catagaacaggacctctgctt

SEQ ID NO: 6017011 - DNA, 20 bp, Homo sapiens
catagaactgggtaaatgca

SEQ ID NO: 6017012 - DNA, 21 bp, Homo sapiens
catagaactgtcccacaaaat

SEQ ID NO: 6017013 - DNA, 18 bp, Homo sapiens
catagaaggaagtgtgtt

SEQ ID NO: 6017014 - DNA, 16 bp, Homo sapiens
catagaaggcaggtga

SEQ ID NO: 6017015 - DNA, 12 bp, Homo sapiens
catagaataaca

SEQ ID NO: 6017016 - DNA, 20 bp, Homo sapiens
catagaataacaactgctgg

SEQ ID NO: 6017017 - DNA, 15 bp, Homo sapiens
catagaatagcatgt

SEQ ID NO: 6017018 - DNA, 14 bp, Homo sapiens
catagaatctgtga

SEQ ID NO: 6017019 - DNA, 22 bp, Homo sapiens
catagaattgcaatctataata

SEQ ID NO: 6017020 - DNA, 14 bp, Homo sapiens
catagaattttgag

SEQ ID NO: 6017021 - DNA, 15 bp, Homo sapiens
catagacaaaggcct

SEQ ID NO: 6017022 - DNA, 21 bp, Homo sapiens
catagacaaaggccttaacaa

SEQ ID NO: 6017023 - DNA, 12 bp, Homo sapiens
catagacacagt

SEQ ID NO: 6017024 - DNA, 22 bp, Homo sapiens
catagacacagtattgacttct

SEQ ID NO: 6017025 - DNA, 19 bp, Homo sapiens
catagacagaagaaacaag

SEQ ID NO: 6017026 - DNA, 16 bp, Homo sapiens
catagacagatgtgga

SEQ ID NO: 6017027 - DNA, 22 bp, Homo sapiens
catagacagccctgggggagcc

SEQ ID NO: 6017028 - DNA, 14 bp, Homo sapiens
catagacatgaaag

SEQ ID NO: 6017029 - DNA, 21 bp, Homo sapiens
catagacccatctggaggctc

SEQ ID NO: 6017030 - DNA, 21 bp, Homo sapiens
catagaccctctttcttgttt

SEQ ID NO: 6017031 - DNA, 14 bp, Homo sapiens
catagaccctgagg

SEQ ID NO: 6017032 - DNA, 15 bp, Homo sapiens
catagaccctgaggc

SEQ ID NO: 6017033 - DNA, 18 bp, Homo sapiens
catagacctacagacctg

SEQ ID NO: 6017034 - DNA, 20 bp, Homo sapiens
catagacctacagacctggc

SEQ ID NO: 6017035 - DNA, 22 bp, Homo sapiens
catagacctacagacctggctc

SEQ ID NO: 6017036 - DNA, 16 bp, Homo sapiens
catagactagagaaac

SEQ ID NO: 6017037 - DNA, 17 bp, Homo sapiens
catagactagagaaacc

SEQ ID NO: 6017038 - DNA, 17 bp, Homo sapiens
catagactgaagattta

SEQ ID NO: 6017039 - DNA, 20 bp, Homo sapiens
catagactgaggtataaaga

SEQ ID NO: 6017040 - DNA, 22 bp, Homo sapiens
catagactgaggtataaagaca

SEQ ID NO: 6017041 - DNA, 23 bp, Homo sapiens
catagactgaggtataaagacaa

SEQ ID NO: 6017042 - DNA, 16 bp, Homo sapiens
catagacttaggcatt

SEQ ID NO: 6017043 - DNA, 24 bp, Homo sapiens
catagacttaggcattaacatgtt

SEQ ID NO: 6017044 - DNA, 21 bp, Homo sapiens
catagactttatgcaataaat

SEQ ID NO: 6017045 - DNA, 22 bp, Homo sapiens
catagagaacaaagtaaaagta

SEQ ID NO: 6017046 - DNA, 17 bp, Homo sapiens
catagagaactgtcacc

SEQ ID NO: 6017047 - DNA, 15 bp, Homo sapiens
catagagaatacaca

SEQ ID NO: 6017048 - DNA, 17 bp, Homo sapiens
catagagatcatccttt

SEQ ID NO: 6017049 - DNA, 11 bp, Homo sapiens
catagagcaat

SEQ ID NO: 6017050 - DNA, 13 bp, Homo sapiens
catagagcaatta

SEQ ID NO: 6017051 - DNA, 20 bp, Homo sapiens
catagagcaattaaactgtg

SEQ ID NO: 6017052 - DNA, 14 bp, Homo sapiens
catagagccctggc

SEQ ID NO: 6017053 - DNA, 16 bp, Homo sapiens
catagagccctggcca

SEQ ID NO: 6017054 - DNA, 22 bp, Homo sapiens
catagagccctggccagccctt

SEQ ID NO: 6017055 - DNA, 20 bp, Homo sapiens
catagagccgggtgtcccca

SEQ ID NO: 6017056 - DNA, 15 bp, Homo sapiens
catagagctatatat

SEQ ID NO: 6017057 - DNA, 16 bp, Homo sapiens
catagagctctatttc

SEQ ID NO: 6017058 - DNA, 22 bp, Homo sapiens
catagagctttttaatagcact

SEQ ID NO: 6017059 - DNA, 18 bp, Homo sapiens
catagaggcccaggcacc

SEQ ID NO: 6017060 - DNA, 20 bp, Homo sapiens
catagagggagaggaagcac

SEQ ID NO: 6017061 - DNA, 17 bp, Homo sapiens
catagaggtgagggaag

SEQ ID NO: 6017062 - DNA, 21 bp, Homo sapiens
catagaggtgagggaagcctg

SEQ ID NO: 6017063 - DNA, 17 bp, Homo sapiens
catagaggttttgtatt

SEQ ID NO: 6017064 - DNA, 23 bp, Homo sapiens
catagagtgagaagaaagaaact

SEQ ID NO: 6017065 - DNA, 17 bp, Homo sapiens
catagagttctggatgt

SEQ ID NO: 6017066 - DNA, 15 bp, Homo sapiens
catagagtttaacac

SEQ ID NO: 6017067 - DNA, 18 bp, Homo sapiens
catagagtttaacacaag

SEQ ID NO: 6017068 - DNA, 14 bp, Homo sapiens
catagataaagctg

SEQ ID NO: 6017069 - DNA, 16 bp, Homo sapiens
catagataatattgtt

SEQ ID NO: 6017070 - DNA, 17 bp, Homo sapiens
catagataatattgttt

SEQ ID NO: 6017071 - DNA, 24 bp, Homo sapiens
catagataatattgtttggtaaat

SEQ ID NO: 6017072 - DNA, 12 bp, Homo sapiens
catagataccat

SEQ ID NO: 6017073 - DNA, 13 bp, Homo sapiens
catagatagtgct

SEQ ID NO: 6017074 - DNA, 19 bp, Homo sapiens
catagatagtgctttattt

SEQ ID NO: 6017075 - DNA, 20 bp, Homo sapiens
catagatatctatattttta

SEQ ID NO: 6017076 - DNA, 14 bp, Homo sapiens
catagatattggaa

SEQ ID NO: 6017077 - DNA, 16 bp, Homo sapiens
catagatattggaaga

SEQ ID NO: 6017078 - DNA, 18 bp, Homo sapiens
catagatattggaagaga

SEQ ID NO: 6017079 - DNA, 22 bp, Homo sapiens
catagatcagccattaaaataa

SEQ ID NO: 6017080 - DNA, 13 bp, Homo sapiens
catagatcttctg

SEQ ID NO: 6017081 - DNA, 15 bp, Homo sapiens
catagatgcaggtga

SEQ ID NO: 6017082 - DNA, 13 bp, Homo sapiens
catagatgcctgg

SEQ ID NO: 6017083 - DNA, 15 bp, Homo sapiens
catagatgcctgggc

SEQ ID NO: 6017084 - DNA, 16 bp, Homo sapiens
catagatgcctgggcc

SEQ ID NO: 6017085 - DNA, 11 bp, Homo sapiens
catagatgcta

SEQ ID NO: 6017086 - DNA, 15 bp, Homo sapiens
catagatggaccagt

SEQ ID NO: 6017087 - DNA, 20 bp, Homo sapiens
catagatggaccagtagaca

SEQ ID NO: 6017088 - DNA, 23 bp, Homo sapiens
catagatggaccagtagacaact

SEQ ID NO: 6017089 - DNA, 16 bp, Homo sapiens
catagatgttttggta

SEQ ID NO: 6017090 - DNA, 18 bp, Homo sapiens
catagatgttttggtaga

SEQ ID NO: 6017091 - DNA, 20 bp, Homo sapiens
catagattaatggcactgat

SEQ ID NO: 6017092 - DNA, 17 bp, Homo sapiens
catagattattataaac

SEQ ID NO: 6017093 - DNA, 23 bp, Homo sapiens
catagattattataaactataaa

SEQ ID NO: 6017094 - DNA, 14 bp, Homo sapiens
catagattcacctg

SEQ ID NO: 6017095 - DNA, 20 bp, Homo sapiens
catagattcacctgtaaaac

SEQ ID NO: 6017096 - DNA, 21 bp, Homo sapiens
catagattcacctgtaaaact

SEQ ID NO: 6017097 - DNA, 18 bp, Homo sapiens
catagattccctgagcag

SEQ ID NO: 6017098 - DNA, 15 bp, Homo sapiens
catagatttatttta

SEQ ID NO: 6017099 - DNA, 16 bp, Homo sapiens
catagatttatttttc

SEQ ID NO: 6017100 - DNA, 20 bp, Homo sapiens
catagatttatttttcagtt

SEQ ID NO: 6017101 - DNA, 23 bp, Homo sapiens
catagatttatttttcagttcca

SEQ ID NO: 6017102 - DNA, 22 bp, Homo sapiens
catagatttgaagatctgattt

SEQ ID NO: 6017103 - DNA, 16 bp, Homo sapiens
catagcaacaggaaaa

SEQ ID NO: 6017104 - DNA, 15 bp, Homo sapiens
catagcaagacacat

SEQ ID NO: 6017105 - DNA, 23 bp, Homo sapiens
catagcaagattgcttaaaatag

SEQ ID NO: 6017106 - DNA, 16 bp, Homo sapiens
catagcaatacttgga

SEQ ID NO: 6017107 - DNA, 19 bp, Homo sapiens
catagcacaagataaattg

SEQ ID NO: 6017108 - DNA, 22 bp, Homo sapiens
catagcacctaacaacattgta

SEQ ID NO: 6017109 - DNA, 22 bp, Homo sapiens
catagcacgaatctgttaccag

SEQ ID NO: 6017110 - DNA, 13 bp, Homo sapiens
catagcactgcag

SEQ ID NO: 6017111 - DNA, 23 bp, Homo sapiens
catagcagactttcccaaatgta

SEQ ID NO: 6017112 - DNA, 22 bp, Homo sapiens
catagcagagaatgaaagggcc

SEQ ID NO: 6017113 - DNA, 12 bp, Homo sapiens
catagcagctgc

SEQ ID NO: 6017114 - DNA, 22 bp, Homo sapiens
catagcataatatgaagccttt

SEQ ID NO: 6017115 - DNA, 16 bp, Homo sapiens
catagcatagccagca

SEQ ID NO: 6017116 - DNA, 16 bp, Homo sapiens
catagcataggctggg

SEQ ID NO: 6017117 - DNA, 17 bp, Homo sapiens
catagcataggctgggg

SEQ ID NO: 6017118 - DNA, 17 bp, Homo sapiens
catagcatgcttccttt

SEQ ID NO: 6017119 - DNA, 18 bp, Homo sapiens
catagcatgcttcctttc

SEQ ID NO: 6017120 - DNA, 20 bp, Homo sapiens
catagcatgcttcctttctc

SEQ ID NO: 6017121 - DNA, 23 bp, Homo sapiens
catagcattaactaatctattgg

SEQ ID NO: 6017122 - DNA, 15 bp, Homo sapiens
catagccaaacagga

SEQ ID NO: 6017123 - DNA, 15 bp, Homo sapiens
catagccaaagccag

SEQ ID NO: 6017124 - DNA, 11 bp, Homo sapiens
catagccatac

SEQ ID NO: 6017125 - DNA, 19 bp, Homo sapiens
catagccattcatttacaa

SEQ ID NO: 6017126 - DNA, 11 bp, Homo sapiens
catagcccagt

SEQ ID NO: 6017127 - DNA, 15 bp, Homo sapiens
catagccccaggccc

SEQ ID NO: 6017128 - DNA, 18 bp, Homo sapiens
catagccccaggcccgcc

SEQ ID NO: 6017129 - DNA, 19 bp, Homo sapiens
catagccctcaccctgggg

SEQ ID NO: 6017130 - DNA, 18 bp, Homo sapiens
catagccctcctgagcac

SEQ ID NO: 6017131 - DNA, 20 bp, Homo sapiens
catagccctggtgctcctgc

SEQ ID NO: 6017132 - DNA, 20 bp, Homo sapiens
catagccgattctctgcccg

SEQ ID NO: 6017133 - DNA, 18 bp, Homo sapiens
catagcctaatccctggg

SEQ ID NO: 6017134 - DNA, 13 bp, Homo sapiens
catagcctatatt

SEQ ID NO: 6017135 - DNA, 17 bp, Homo sapiens
catagcctatgatgata

SEQ ID NO: 6017136 - DNA, 17 bp, Homo sapiens
catagcctccacggaga

SEQ ID NO: 6017137 - DNA, 21 bp, Homo sapiens
catagcctccacggagagccc

SEQ ID NO: 6017138 - DNA, 17 bp, Homo sapiens
catagcctgcctgatcc

SEQ ID NO: 6017139 - DNA, 22 bp, Homo sapiens
catagccttatgagttagcttt

SEQ ID NO: 6017140 - DNA, 14 bp, Homo sapiens
catagcctttgtgc

SEQ ID NO: 6017141 - DNA, 15 bp, Homo sapiens
catagcgccgtgctg

SEQ ID NO: 6017142 - DNA, 18 bp, Homo sapiens
catagcgccgtgctgtaa

SEQ ID NO: 6017143 - DNA, 20 bp, Homo sapiens
catagcgccgtgctgtaaat

SEQ ID NO: 6017144 - DNA, 21 bp, Homo sapiens
catagcgccgtgctgtaaata

SEQ ID NO: 6017145 - DNA, 23 bp, Homo sapiens
catagcgccgtgctgtaaataag

SEQ ID NO: 6017146 - DNA, 16 bp, Homo sapiens
catagcgctgctctta

SEQ ID NO: 6017147 - DNA, 17 bp, Homo sapiens
catagcgctggctcagg

SEQ ID NO: 6017148 - DNA, 14 bp, Homo sapiens
catagcgtcctgcc

SEQ ID NO: 6017149 - DNA, 16 bp, Homo sapiens
catagcgtcctgccct

SEQ ID NO: 6017150 - DNA, 17 bp, Homo sapiens
catagcgtcctgccctg

SEQ ID NO: 6017151 - DNA, 19 bp, Homo sapiens
catagctacatcagtttga

SEQ ID NO: 6017152 - DNA, 21 bp, Homo sapiens
catagctacccaaaagagaaa

SEQ ID NO: 6017153 - DNA, 19 bp, Homo sapiens
catagctagttatgtgaga

SEQ ID NO: 6017154 - DNA, 20 bp, Homo sapiens
catagctagttatgtgagaa

SEQ ID NO: 6017155 - DNA, 16 bp, Homo sapiens
catagctatcaagtgt

SEQ ID NO: 6017156 - DNA, 15 bp, Homo sapiens
catagctattttcct

SEQ ID NO: 6017157 - DNA, 21 bp, Homo sapiens
catagctcaataaaagaatct

SEQ ID NO: 6017158 - DNA, 18 bp, Homo sapiens
catagctcctctccctca

SEQ ID NO: 6017159 - DNA, 14 bp, Homo sapiens
catagctcctgctc

SEQ ID NO: 6017160 - DNA, 18 bp, Homo sapiens
catagctccttctctctt

SEQ ID NO: 6017161 - DNA, 16 bp, Homo sapiens
catagctccttggagc

SEQ ID NO: 6017162 - DNA, 21 bp, Homo sapiens
catagctccttggagcaggca

SEQ ID NO: 6017163 - DNA, 13 bp, Homo sapiens
catagctctattt

SEQ ID NO: 6017164 - DNA, 21 bp, Homo sapiens
catagctctcatgtatttaaa

SEQ ID NO: 6017165 - DNA, 12 bp, Homo sapiens
catagctctcct

SEQ ID NO: 6017166 - DNA, 13 bp, Homo sapiens
catagctctcctt

SEQ ID NO: 6017167 - DNA, 12 bp, Homo sapiens
catagctctggg

SEQ ID NO: 6017168 - DNA, 20 bp, Homo sapiens
catagctctggggtgggcag

SEQ ID NO: 6017169 - DNA, 14 bp, Homo sapiens
catagctgggaaac

SEQ ID NO: 6017170 - DNA, 15 bp, Homo sapiens
catagctgtatattt

SEQ ID NO: 6017171 - DNA, 14 bp, Homo sapiens
catagctgtctaga

SEQ ID NO: 6017172 - DNA, 15 bp, Homo sapiens
catagctgtctagag

SEQ ID NO: 6017173 - DNA, 17 bp, Homo sapiens
catagcttaagaagtat

SEQ ID NO: 6017174 - DNA, 20 bp, Homo sapiens
catagcttattattgaagga

SEQ ID NO: 6017175 - DNA, 21 bp, Homo sapiens
catagcttgataaagggccaa

SEQ ID NO: 6017176 - DNA, 19 bp, Homo sapiens
catagctttagagaagcca

SEQ ID NO: 6017177 - DNA, 22 bp, Homo sapiens
catagctttagagaagccataa

SEQ ID NO: 6017178 - DNA, 18 bp, Homo sapiens
cataggaaaagtacattt

SEQ ID NO: 6017179 - DNA, 19 bp, Homo sapiens
cataggaaaagtacattta

SEQ ID NO: 6017180 - DNA, 22 bp, Homo sapiens
cataggaaaagtacatttaata

SEQ ID NO: 6017181 - DNA, 15 bp, Homo sapiens
cataggaacatgtag

SEQ ID NO: 6017182 - DNA, 20 bp, Homo sapiens
cataggaagacataaaactt

SEQ ID NO: 6017183 - DNA, 23 bp, Homo sapiens
cataggaagtggctggtctggag

SEQ ID NO: 6017184 - DNA, 14 bp, Homo sapiens
cataggaataaaat

SEQ ID NO: 6017185 - DNA, 23 bp, Homo sapiens
cataggaatatgactcaggagcc

SEQ ID NO: 6017186 - DNA, 20 bp, Homo sapiens
cataggacatactgcatgta

SEQ ID NO: 6017187 - DNA, 20 bp, Homo sapiens
cataggacctgcatccttcc

SEQ ID NO: 6017188 - DNA, 18 bp, Homo sapiens
cataggacctttccacca

SEQ ID NO: 6017189 - DNA, 20 bp, Homo sapiens
cataggactaccgcaggccc

SEQ ID NO: 6017190 - DNA, 23 bp, Homo sapiens
cataggactcaaagtttcagaga

SEQ ID NO: 6017191 - DNA, 17 bp, Homo sapiens
cataggagtttggagga

SEQ ID NO: 6017192 - DNA, 22 bp, Homo sapiens
cataggattaagttcgaggtgg

SEQ ID NO: 6017193 - DNA, 16 bp, Homo sapiens
cataggcaagaggagt

SEQ ID NO: 6017194 - DNA, 14 bp, Homo sapiens
cataggcagagccc

SEQ ID NO: 6017195 - DNA, 19 bp, Homo sapiens
cataggccaaggcccaact

SEQ ID NO: 6017196 - DNA, 15 bp, Homo sapiens
cataggcccacacac

SEQ ID NO: 6017197 - DNA, 18 bp, Homo sapiens
cataggcccacacacagg

SEQ ID NO: 6017198 - DNA, 20 bp, Homo sapiens
cataggcccagccagggtgt

SEQ ID NO: 6017199 - DNA, 22 bp, Homo sapiens
cataggcccaggatatttctga

SEQ ID NO: 6017200 - DNA, 18 bp, Homo sapiens
cataggcctgggtgctgg

SEQ ID NO: 6017201 - DNA, 19 bp, Homo sapiens
cataggctcactctttccc

SEQ ID NO: 6017202 - DNA, 17 bp, Homo sapiens
cataggctccttcctgt

SEQ ID NO: 6017203 - DNA, 15 bp, Homo sapiens
cataggctgacacca

SEQ ID NO: 6017204 - DNA, 19 bp, Homo sapiens
cataggctgcccaatctga

SEQ ID NO: 6017205 - DNA, 19 bp, Homo sapiens
cataggctggtggccttgg

SEQ ID NO: 6017206 - DNA, 16 bp, Homo sapiens
cataggcttatataca

SEQ ID NO: 6017207 - DNA, 18 bp, Homo sapiens
catagggattgtccctgt

SEQ ID NO: 6017208 - DNA, 20 bp, Homo sapiens
cataggggggagggtctttt

SEQ ID NO: 6017209 - DNA, 17 bp, Homo sapiens
catagggtctcttcagg

SEQ ID NO: 6017210 - DNA, 22 bp, Homo sapiens
catagggtctgcagcctgctgg

SEQ ID NO: 6017211 - DNA, 23 bp, Homo sapiens
catagggtctgcagcctgctggg

SEQ ID NO: 6017212 - DNA, 15 bp, Homo sapiens
cataggtaagctgtg

SEQ ID NO: 6017213 - DNA, 18 bp, Homo sapiens
cataggtaagctgtgcct

SEQ ID NO: 6017214 - DNA, 20 bp, Homo sapiens
cataggtaagctgtgccttc

SEQ ID NO: 6017215 - DNA, 16 bp, Homo sapiens
cataggtaggtatctt

SEQ ID NO: 6017216 - DNA, 21 bp, Homo sapiens
cataggtcactggctctccaa

SEQ ID NO: 6017217 - DNA, 16 bp, Homo sapiens
cataggtcataaagca

SEQ ID NO: 6017218 - DNA, 16 bp, Homo sapiens
cataggtccctgacat

SEQ ID NO: 6017219 - DNA, 23 bp, Homo sapiens
cataggtctaaataggatcctgg

SEQ ID NO: 6017220 - DNA, 16 bp, Homo sapiens
cataggtctgtatggc

SEQ ID NO: 6017221 - DNA, 18 bp, Homo sapiens
cataggtgatccatgtaa

SEQ ID NO: 6017222 - DNA, 20 bp, Homo sapiens
cataggtgatccatgtaact

SEQ ID NO: 6017223 - DNA, 16 bp, Homo sapiens
cataggtgatctcatt

SEQ ID NO: 6017224 - DNA, 15 bp, Homo sapiens
cataggttactacct

SEQ ID NO: 6017225 - DNA, 22 bp, Homo sapiens
cataggttcacaccattttgtt

SEQ ID NO: 6017226 - DNA, 16 bp, Homo sapiens
cataggtttctctccc

SEQ ID NO: 6017227 - DNA, 19 bp, Homo sapiens
cataggtttctctccctcc

SEQ ID NO: 6017228 - DNA, 20 bp, Homo sapiens
catagtaaatgtagttcata

SEQ ID NO: 6017229 - DNA, 20 bp, Homo sapiens
catagtaacgtgttactgga

SEQ ID NO: 6017230 - DNA, 22 bp, Homo sapiens
catagtaacttcttatggaatt

SEQ ID NO: 6017231 - DNA, 20 bp, Homo sapiens
catagtaagaccccatctct

SEQ ID NO: 6017232 - DNA, 21 bp, Homo sapiens
catagtaattcttaagtcttt

SEQ ID NO: 6017233 - DNA, 21 bp, Homo sapiens
catagtactctttgtagcaaa

SEQ ID NO: 6017234 - DNA, 23 bp, Homo sapiens
catagtactggcacaaaaacaca

SEQ ID NO: 6017235 - DNA, 20 bp, Homo sapiens
catagtagaactttataaaa

SEQ ID NO: 6017236 - DNA, 17 bp, Homo sapiens
catagtaggcactaaat

SEQ ID NO: 6017237 - DNA, 20 bp, Homo sapiens
catagtaggcactaaataca

SEQ ID NO: 6017238 - DNA, 13 bp, Homo sapiens
catagtagttttt

SEQ ID NO: 6017239 - DNA, 15 bp, Homo sapiens
catagtataacttta

SEQ ID NO: 6017240 - DNA, 17 bp, Homo sapiens
catagtatattaaaaat

SEQ ID NO: 6017241 - DNA, 19 bp, Homo sapiens
catagtcaatcaaacaggg

SEQ ID NO: 6017242 - DNA, 14 bp, Homo sapiens
catagtcaatgatg

SEQ ID NO: 6017243 - DNA, 21 bp, Homo sapiens
catagtcattctgcctgccct

SEQ ID NO: 6017244 - DNA, 15 bp, Homo sapiens
catagtccccagagc

SEQ ID NO: 6017245 - DNA, 13 bp, Homo sapiens
catagtcctcagg

SEQ ID NO: 6017246 - DNA, 15 bp, Homo sapiens
catagtcctgttact

SEQ ID NO: 6017247 - DNA, 22 bp, Homo sapiens
catagtccttttatctccttgt

SEQ ID NO: 6017248 - DNA, 23 bp, Homo sapiens
catagtcgggatgtcagcagaca

SEQ ID NO: 6017249 - DNA, 20 bp, Homo sapiens
catagtctgaagtgaagtac

SEQ ID NO: 6017250 - DNA, 22 bp, Homo sapiens
catagtcttgaaatgaaaggga

SEQ ID NO: 6017251 - DNA, 23 bp, Homo sapiens
catagtcttgaaatgaaagggaa

SEQ ID NO: 6017252 - DNA, 14 bp, Homo sapiens
catagtgaacacag

SEQ ID NO: 6017253 - DNA, 22 bp, Homo sapiens
catagtgaccggctgcttttcc

SEQ ID NO: 6017254 - DNA, 20 bp, Homo sapiens
catagtgagacccctgtctc

SEQ ID NO: 6017255 - DNA, 18 bp, Homo sapiens
catagtgatggttcccct

SEQ ID NO: 6017256 - DNA, 16 bp, Homo sapiens
catagtgcaaaactgt

SEQ ID NO: 6017257 - DNA, 19 bp, Homo sapiens
catagtgcaaaactgtgtc

SEQ ID NO: 6017258 - DNA, 19 bp, Homo sapiens
catagtgcattgtttctgt

SEQ ID NO: 6017259 - DNA, 14 bp, Homo sapiens
catagtgccttttt

SEQ ID NO: 6017260 - DNA, 19 bp, Homo sapiens
catagtgctaacatgaaga

SEQ ID NO: 6017261 - DNA, 20 bp, Homo sapiens
catagtgctaacatgaagac

SEQ ID NO: 6017262 - DNA, 11 bp, Homo sapiens
catagtgctgg

SEQ ID NO: 6017263 - DNA, 14 bp, Homo sapiens
catagtggatggac

SEQ ID NO: 6017264 - DNA, 20 bp, Homo sapiens
catagtggatggacagatgg

SEQ ID NO: 6017265 - DNA, 21 bp, Homo sapiens
catagtggatggacagatgga

SEQ ID NO: 6017266 - DNA, 22 bp, Homo sapiens
catagtggcttaaaacaacact

SEQ ID NO: 6017267 - DNA, 16 bp, Homo sapiens
catagtggtcatttgg

SEQ ID NO: 6017268 - DNA, 18 bp, Homo sapiens
catagtgtcaagaaggaa

SEQ ID NO: 6017269 - DNA, 13 bp, Homo sapiens
catagtgtcctgc

SEQ ID NO: 6017270 - DNA, 18 bp, Homo sapiens
catagtgtcctgcccacc

SEQ ID NO: 6017271 - DNA, 16 bp, Homo sapiens
catagttaaaaaagaa

SEQ ID NO: 6017272 - DNA, 19 bp, Homo sapiens
catagttactgtaaaatgc

SEQ ID NO: 6017273 - DNA, 21 bp, Homo sapiens
catagttactgtaaaatgcaa

SEQ ID NO: 6017274 - DNA, 14 bp, Homo sapiens
catagttactgtgt

SEQ ID NO: 6017275 - DNA, 18 bp, Homo sapiens
catagttactgtgtaaac

SEQ ID NO: 6017276 - DNA, 18 bp, Homo sapiens
catagttatttttctctt

SEQ ID NO: 6017277 - DNA, 12 bp, Homo sapiens
catagttcagaa

SEQ ID NO: 6017278 - DNA, 18 bp, Homo sapiens
catagttctgaggtccct

SEQ ID NO: 6017279 - DNA, 17 bp, Homo sapiens
catagttctgtaataaa

SEQ ID NO: 6017280 - DNA, 14 bp, Homo sapiens
catagttctgttaa

SEQ ID NO: 6017281 - DNA, 15 bp, Homo sapiens
catagttctgttaaa

SEQ ID NO: 6017282 - DNA, 18 bp, Homo sapiens
catagttctgttaaatat

SEQ ID NO: 6017283 - DNA, 16 bp, Homo sapiens
catagttctttttagt

SEQ ID NO: 6017284 - DNA, 13 bp, Homo sapiens
catagttgaaaaa

SEQ ID NO: 6017285 - DNA, 23 bp, Homo sapiens
catagttgaaaaaagaagtttgg

SEQ ID NO: 6017286 - DNA, 14 bp, Homo sapiens
catagttgcaaaat

SEQ ID NO: 6017287 - DNA, 20 bp, Homo sapiens
catagttgtagacaaagtac

SEQ ID NO: 6017288 - DNA, 16 bp, Homo sapiens
catagtttctgtaatt

SEQ ID NO: 6017289 - DNA, 21 bp, Homo sapiens
catagtttgaattcatgcctc

SEQ ID NO: 6017290 - DNA, 22 bp, Homo sapiens
catagtttgctttgtttaagca

SEQ ID NO: 6017291 - DNA, 16 bp, Homo sapiens
catagtttggcatttg

SEQ ID NO: 6017292 - DNA, 21 bp, Homo sapiens
catagtttgggtatttttggt

SEQ ID NO: 6017293 - DNA, 14 bp, Homo sapiens
catagttttaaact

SEQ ID NO: 6017294 - DNA, 18 bp, Homo sapiens
catagttttaaactcatt

SEQ ID NO: 6017295 - DNA, 13 bp, Homo sapiens
catagttttcacc

SEQ ID NO: 6017296 - DNA, 20 bp, Homo sapiens
catagttttgatgactggca

SEQ ID NO: 6017297 - DNA, 15 bp, Homo sapiens
catataaaaacaata

SEQ ID NO: 6017298 - DNA, 20 bp, Homo sapiens
catataaaaacaatatattt

SEQ ID NO: 6017299 - DNA, 20 bp, Homo sapiens
catataaaaggtgagctcag

SEQ ID NO: 6017300 - DNA, 21 bp, Homo sapiens
catataaaataatgcaaagaa

SEQ ID NO: 6017301 - DNA, 15 bp, Homo sapiens
catataaaatatatt

SEQ ID NO: 6017302 - DNA, 19 bp, Homo sapiens
catataaaatatatttatg

SEQ ID NO: 6017303 - DNA, 19 bp, Homo sapiens
catataaaatgctgatatt

SEQ ID NO: 6017304 - DNA, 18 bp, Homo sapiens
catataaaatggcaacaa

SEQ ID NO: 6017305 - DNA, 15 bp, Homo sapiens
catataaacctgatg

SEQ ID NO: 6017306 - DNA, 14 bp, Homo sapiens
catataaaggttat

SEQ ID NO: 6017307 - DNA, 21 bp, Homo sapiens
catataaaggttatgaaacat

SEQ ID NO: 6017308 - DNA, 12 bp, Homo sapiens
catataaagtat

SEQ ID NO: 6017309 - DNA, 16 bp, Homo sapiens
catataaatagaatgt

SEQ ID NO: 6017310 - DNA, 17 bp, Homo sapiens
catataaatagaatgta

SEQ ID NO: 6017311 - DNA, 20 bp, Homo sapiens
catataaatagaatgtaaat

SEQ ID NO: 6017312 - DNA, 21 bp, Homo sapiens
catataaatagaatgtaaatg

SEQ ID NO: 6017313 - DNA, 22 bp, Homo sapiens
catataaatagaatgtaaatgt

SEQ ID NO: 6017314 - DNA, 20 bp, Homo sapiens
catataaatgaatctggtgt

SEQ ID NO: 6017315 - DNA, 17 bp, Homo sapiens
catataaatggaatcac

SEQ ID NO: 6017316 - DNA, 11 bp, Homo sapiens
catataaatgt

SEQ ID NO: 6017317 - DNA, 20 bp, Homo sapiens
catataaatgtttatattgt

SEQ ID NO: 6017318 - DNA, 15 bp, Homo sapiens
catataaattaatac

SEQ ID NO: 6017319 - DNA, 20 bp, Homo sapiens
catataaattaatacataag

SEQ ID NO: 6017320 - DNA, 22 bp, Homo sapiens
catataaattaatacataagtt

SEQ ID NO: 6017321 - DNA, 14 bp, Homo sapiens
catataaattcccc

SEQ ID NO: 6017322 - DNA, 17 bp, Homo sapiens
catataaattgtcttaa

SEQ ID NO: 6017323 - DNA, 23 bp, Homo sapiens
catataactggagtaataaaaca

SEQ ID NO: 6017324 - DNA, 13 bp, Homo sapiens
catataactgtga

SEQ ID NO: 6017325 - DNA, 11 bp, Homo sapiens
catataagaca

SEQ ID NO: 6017326 - DNA, 23 bp, Homo sapiens
catataagattcatatttacttc

SEQ ID NO: 6017327 - DNA, 18 bp, Homo sapiens
catataagcaagacagtg

SEQ ID NO: 6017328 - DNA, 22 bp, Homo sapiens
catataagttgagaaggtgcct

SEQ ID NO: 6017329 - DNA, 23 bp, Homo sapiens
catataagttgagaaggtgcctg

SEQ ID NO: 6017330 - DNA, 15 bp, Homo sapiens
catataagtttgaag

SEQ ID NO: 6017331 - DNA, 19 bp, Homo sapiens
catataatatatgttttaa

SEQ ID NO: 6017332 - DNA, 17 bp, Homo sapiens
catataatgttgttatt

SEQ ID NO: 6017333 - DNA, 15 bp, Homo sapiens
catatacaaaagcaa

SEQ ID NO: 6017334 - DNA, 13 bp, Homo sapiens
catatacacaaag

SEQ ID NO: 6017335 - DNA, 15 bp, Homo sapiens
catatacacacacac

SEQ ID NO: 6017336 - DNA, 23 bp, Homo sapiens
catatacacgaatagacatcaaa

SEQ ID NO: 6017337 - DNA, 14 bp, Homo sapiens
catatacagaaaaa

SEQ ID NO: 6017338 - DNA, 16 bp, Homo sapiens
catatacagcaggatg

SEQ ID NO: 6017339 - DNA, 17 bp, Homo sapiens
catatacagctcagaag

SEQ ID NO: 6017340 - DNA, 19 bp, Homo sapiens
catatacatctagcacagc

SEQ ID NO: 6017341 - DNA, 20 bp, Homo sapiens
catatacattatttctgtat

SEQ ID NO: 6017342 - DNA, 17 bp, Homo sapiens
catatacctataatgtg

SEQ ID NO: 6017343 - DNA, 20 bp, Homo sapiens
catatacctataatgtgtgt

SEQ ID NO: 6017344 - DNA, 15 bp, Homo sapiens
catatactataattg

SEQ ID NO: 6017345 - DNA, 18 bp, Homo sapiens
catatactgttcttcatt

SEQ ID NO: 6017346 - DNA, 21 bp, Homo sapiens
catatactgttcttcatttta

SEQ ID NO: 6017347 - DNA, 22 bp, Homo sapiens
catatactttaatgttttaact

SEQ ID NO: 6017348 - DNA, 16 bp, Homo sapiens
catatagacacacata

SEQ ID NO: 6017349 - DNA, 18 bp, Homo sapiens
catatagacacacataca

SEQ ID NO: 6017350 - DNA, 17 bp, Homo sapiens
catatagaccaattgaa

SEQ ID NO: 6017351 - DNA, 21 bp, Homo sapiens
catatagaccaattgaagcat

SEQ ID NO: 6017352 - DNA, 23 bp, Homo sapiens
catatagaccaattgaagcatga

SEQ ID NO: 6017353 - DNA, 15 bp, Homo sapiens
catatagattttatt

SEQ ID NO: 6017354 - DNA, 15 bp, Homo sapiens
cagccctggcctggc

SEQ ID NO: 6017355 - DNA, 13 bp, Homo sapiens
cagccctggctga

SEQ ID NO: 6017356 - DNA, 15 bp, Homo sapiens
cagccctggctgaag

SEQ ID NO: 6017357 - DNA, 12 bp, Homo sapiens
cagccctgggcc

SEQ ID NO: 6017358 - DNA, 17 bp, Homo sapiens
cagccctgggccccacc

SEQ ID NO: 6017359 - DNA, 19 bp, Homo sapiens
cagccctgggccccaccac

SEQ ID NO: 6017360 - DNA, 21 bp, Homo sapiens
cagccctgggccccaccacct

SEQ ID NO: 6017361 - DNA, 16 bp, Homo sapiens
cagccctgggcctggg

SEQ ID NO: 6017362 - DNA, 18 bp, Homo sapiens
cagccctgggcttggctc

SEQ ID NO: 6017363 - DNA, 20 bp, Homo sapiens
cagccctgggcttggctctt

SEQ ID NO: 6017364 - DNA, 22 bp, Homo sapiens
cagccctgggcttggctcttgg

SEQ ID NO: 6017365 - DNA, 14 bp, Homo sapiens
cagccctggggctg

SEQ ID NO: 6017366 - DNA, 13 bp, Homo sapiens
cagccctggggga

SEQ ID NO: 6017367 - DNA, 21 bp, Homo sapiens
cagccctgggggattcctgag

SEQ ID NO: 6017368 - DNA, 19 bp, Homo sapiens
cagccctgggggccagctg

SEQ ID NO: 6017369 - DNA, 16 bp, Homo sapiens
cagccctggtctcagc

SEQ ID NO: 6017370 - DNA, 18 bp, Homo sapiens
cagccctggtctcagcag

SEQ ID NO: 6017371 - DNA, 15 bp, Homo sapiens
cagccctggtggcca

SEQ ID NO: 6017372 - DNA, 21 bp, Homo sapiens
cagccctggtggccaagcctg

SEQ ID NO: 6017373 - DNA, 23 bp, Homo sapiens
cagccctggtggccaagcctgcc

SEQ ID NO: 6017374 - DNA, 18 bp, Homo sapiens
cagccctgtcagcatgaa

SEQ ID NO: 6017375 - DNA, 13 bp, Homo sapiens
cagccctgttctg

SEQ ID NO: 6017376 - DNA, 16 bp, Homo sapiens
cagcccttagcacaga

SEQ ID NO: 6017377 - DNA, 15 bp, Homo sapiens
cagcccttagcaggg

SEQ ID NO: 6017378 - DNA, 21 bp, Homo sapiens
cagcccttagcagggaaacag

SEQ ID NO: 6017379 - DNA, 22 bp, Homo sapiens
cagcccttcagacgagatcctg

SEQ ID NO: 6017380 - DNA, 17 bp, Homo sapiens
cagcccttcaggaagca

SEQ ID NO: 6017381 - DNA, 13 bp, Homo sapiens
cagcccttcatgg

SEQ ID NO: 6017382 - DNA, 10 bp, Homo sapiens
cagcccttcc

SEQ ID NO: 6017383 - DNA, 16 bp, Homo sapiens
cagcccttccaaactc

SEQ ID NO: 6017384 - DNA, 15 bp, Homo sapiens
cagcccttcccaggc

SEQ ID NO: 6017385 - DNA, 17 bp, Homo sapiens
cagcccttcccaggcca

SEQ ID NO: 6017386 - DNA, 18 bp, Homo sapiens
cagcccttcccaggccag

SEQ ID NO: 6017387 - DNA, 19 bp, Homo sapiens
cagcccttcccaggccagc

SEQ ID NO: 6017388 - DNA, 12 bp, Homo sapiens
cagcccttccct

SEQ ID NO: 6017389 - DNA, 15 bp, Homo sapiens
cagcccttccctgct

SEQ ID NO: 6017390 - DNA, 16 bp, Homo sapiens
cagcccttccctggcc

SEQ ID NO: 6017391 - DNA, 16 bp, Homo sapiens
cagcccttcctcctga

SEQ ID NO: 6017392 - DNA, 13 bp, Homo sapiens
cagcccttcctct

SEQ ID NO: 6017393 - DNA, 16 bp, Homo sapiens
cagcccttcctctcac

SEQ ID NO: 6017394 - DNA, 23 bp, Homo sapiens
cagcccttcctctcactcctgcc

SEQ ID NO: 6017395 - DNA, 16 bp, Homo sapiens
cagcccttcctctgct

SEQ ID NO: 6017396 - DNA, 23 bp, Homo sapiens
cagcccttccttgggcgtctccc

SEQ ID NO: 6017397 - DNA, 18 bp, Homo sapiens
cagcccttccttggggaa

SEQ ID NO: 6017398 - DNA, 20 bp, Homo sapiens
cagcccttgagggagaactt

SEQ ID NO: 6017399 - DNA, 16 bp, Homo sapiens
cagcccttgctctacc

SEQ ID NO: 6017400 - DNA, 17 bp, Homo sapiens
cagcccttgctctacct

SEQ ID NO: 6017401 - DNA, 12 bp, Homo sapiens
cagcccttgctt

SEQ ID NO: 6017402 - DNA, 14 bp, Homo sapiens
cagcccttgcttgt

SEQ ID NO: 6017403 - DNA, 13 bp, Homo sapiens
cagcccttggcca

SEQ ID NO: 6017404 - DNA, 13 bp, Homo sapiens
cagcccttggctt

SEQ ID NO: 6017405 - DNA, 19 bp, Homo sapiens
cagcccttggcttgtgtta

SEQ ID NO: 6017406 - DNA, 20 bp, Homo sapiens
cagcccttgtgtgtgccctg

SEQ ID NO: 6017407 - DNA, 21 bp, Homo sapiens
cagcccttgtgtgtgccctgg

SEQ ID NO: 6017408 - DNA, 22 bp, Homo sapiens
cagcccttgtgtgtgccctggg

SEQ ID NO: 6017409 - DNA, 23 bp, Homo sapiens
cagcccttgtgtgtgccctgggc

SEQ ID NO: 6017410 - DNA, 17 bp, Homo sapiens
cagccctttgcaggccc

SEQ ID NO: 6017411 - DNA, 22 bp, Homo sapiens
cagccctttgctctgatttcct

SEQ ID NO: 6017412 - DNA, 13 bp, Homo sapiens
cagccctttggct

SEQ ID NO: 6017413 - DNA, 17 bp, Homo sapiens
cagccctttggcttcaa

SEQ ID NO: 6017414 - DNA, 16 bp, Homo sapiens
cagccgaagctgcagg

SEQ ID NO: 6017415 - DNA, 22 bp, Homo sapiens
cagccgaccccctctccctgca

SEQ ID NO: 6017416 - DNA, 14 bp, Homo sapiens
cagccgaccctcct

SEQ ID NO: 6017417 - DNA, 16 bp, Homo sapiens
cagccgaccctcctgg

SEQ ID NO: 6017418 - DNA, 19 bp, Homo sapiens
cagccgaccctcctggcct

SEQ ID NO: 6017419 - DNA, 13 bp, Homo sapiens
cagccgactcagc

SEQ ID NO: 6017420 - DNA, 17 bp, Homo sapiens
cagccgagcaggaggcc

SEQ ID NO: 6017421 - DNA, 19 bp, Homo sapiens
cagccgagcaggaggccta

SEQ ID NO: 6017422 - DNA, 21 bp, Homo sapiens
cagccgagcaggaggcctagg

SEQ ID NO: 6017423 - DNA, 19 bp, Homo sapiens
cagccgagcccaggggagg

SEQ ID NO: 6017424 - DNA, 14 bp, Homo sapiens
cagccgagccccag

SEQ ID NO: 6017425 - DNA, 21 bp, Homo sapiens
cagccgagcgagaaccaggct

SEQ ID NO: 6017426 - DNA, 14 bp, Homo sapiens
cagccgagctcgtg

SEQ ID NO: 6017427 - DNA, 16 bp, Homo sapiens
cagccgaggcctggcc

SEQ ID NO: 6017428 - DNA, 20 bp, Homo sapiens
cagccgattcctccagccct

SEQ ID NO: 6017429 - DNA, 22 bp, Homo sapiens
cagccgcaaatccataccccct

SEQ ID NO: 6017430 - DNA, 15 bp, Homo sapiens
cagccgcagagaaat

SEQ ID NO: 6017431 - DNA, 13 bp, Homo sapiens
cagccgccagctg

SEQ ID NO: 6017432 - DNA, 18 bp, Homo sapiens
cagccgccatcagcccaa

SEQ ID NO: 6017433 - DNA, 23 bp, Homo sapiens
cagccgccatgctcctggcccac

SEQ ID NO: 6017434 - DNA, 17 bp, Homo sapiens
cagccgccattgccacc

SEQ ID NO: 6017435 - DNA, 18 bp, Homo sapiens
cagccgccattgccacca

SEQ ID NO: 6017436 - DNA, 19 bp, Homo sapiens
cagccgccattgccaccag

SEQ ID NO: 6017437 - DNA, 21 bp, Homo sapiens
cagccgccattgccaccagga

SEQ ID NO: 6017438 - DNA, 23 bp, Homo sapiens
cagccgccattgccaccaggaga

SEQ ID NO: 6017439 - DNA, 17 bp, Homo sapiens
cagccgccggctgtgca

SEQ ID NO: 6017440 - DNA, 23 bp, Homo sapiens
cagccgcctcccttatgcaggac

SEQ ID NO: 6017441 - DNA, 15 bp, Homo sapiens
cagccgcctttgggt

SEQ ID NO: 6017442 - DNA, 14 bp, Homo sapiens
cagccgcgctctgc

SEQ ID NO: 6017443 - DNA, 21 bp, Homo sapiens
cagccgcgctctgcccctccg

SEQ ID NO: 6017444 - DNA, 23 bp, Homo sapiens
cagccgcgggccaggaggctgcc

SEQ ID NO: 6017445 - DNA, 14 bp, Homo sapiens
cagccgctcctgtc

SEQ ID NO: 6017446 - DNA, 23 bp, Homo sapiens
cagccgctcctgtctgccagcca

SEQ ID NO: 6017447 - DNA, 21 bp, Homo sapiens
cagccgctcggaggccccaaa

SEQ ID NO: 6017448 - DNA, 16 bp, Homo sapiens
cagccgctctcctgcc

SEQ ID NO: 6017449 - DNA, 20 bp, Homo sapiens
cagccgctgagcgaggagat

SEQ ID NO: 6017450 - DNA, 14 bp, Homo sapiens
cagccgcttctgac

SEQ ID NO: 6017451 - DNA, 11 bp, Homo sapiens
cagccgcttgg

SEQ ID NO: 6017452 - DNA, 12 bp, Homo sapiens
cagccgcttggc

SEQ ID NO: 6017453 - DNA, 21 bp, Homo sapiens
cagccggaatagagcctcgtc

SEQ ID NO: 6017454 - DNA, 22 bp, Homo sapiens
cagccggacacaagcggccctg

SEQ ID NO: 6017455 - DNA, 24 bp, Homo sapiens
cagccggagcagttggcctgtgct

SEQ ID NO: 6017456 - DNA, 14 bp, Homo sapiens
cagccggaggagga

SEQ ID NO: 6017457 - DNA, 17 bp, Homo sapiens
cagccggaggaggagat

SEQ ID NO: 6017458 - DNA, 16 bp, Homo sapiens
cagccggatcttggag

SEQ ID NO: 6017459 - DNA, 19 bp, Homo sapiens
cagccggatcttggagaca

SEQ ID NO: 6017460 - DNA, 22 bp, Homo sapiens
cagccggatcttggagacaatt

SEQ ID NO: 6017461 - DNA, 14 bp, Homo sapiens
cagccggcctctct

SEQ ID NO: 6017462 - DNA, 15 bp, Homo sapiens
cagccggcctctctg

SEQ ID NO: 6017463 - DNA, 18 bp, Homo sapiens
cagccggcctctctggcc

SEQ ID NO: 6017464 - DNA, 20 bp, Homo sapiens
cagccggcctctctggcctc

SEQ ID NO: 6017465 - DNA, 24 bp, Homo sapiens
cagccggcctctctggcctcccac

SEQ ID NO: 6017466 - DNA, 17 bp, Homo sapiens
cagccgggagcttggct

SEQ ID NO: 6017467 - DNA, 18 bp, Homo sapiens
cagccgggcacagtggcg

SEQ ID NO: 6017468 - DNA, 15 bp, Homo sapiens
cagccgggccctgag

SEQ ID NO: 6017469 - DNA, 17 bp, Homo sapiens
cagccggggaagacttg

SEQ ID NO: 6017470 - DNA, 19 bp, Homo sapiens
cagccggggagctgagggg

SEQ ID NO: 6017471 - DNA, 23 bp, Homo sapiens
cagccggggagctgaggggcagg

SEQ ID NO: 6017472 - DNA, 20 bp, Homo sapiens
cagccggggcctgcctagca

SEQ ID NO: 6017473 - DNA, 15 bp, Homo sapiens
cagccggggcgagtg

SEQ ID NO: 6017474 - DNA, 20 bp, Homo sapiens
cagccggggcgagtggcacg

SEQ ID NO: 6017475 - DNA, 15 bp, Homo sapiens
cagccgggggctggc

SEQ ID NO: 6017476 - DNA, 14 bp, Homo sapiens
cagccggggtgggg

SEQ ID NO: 6017477 - DNA, 23 bp, Homo sapiens
cagccggggtggggtgcctgagc

SEQ ID NO: 6017478 - DNA, 19 bp, Homo sapiens
cagccggtacctgggaagg

SEQ ID NO: 6017479 - DNA, 13 bp, Homo sapiens
cagccggtgcctg

SEQ ID NO: 6017480 - DNA, 21 bp, Homo sapiens
cagccgtagggtggcactggg

SEQ ID NO: 6017481 - DNA, 22 bp, Homo sapiens
cagccgtagggtggcactggga

SEQ ID NO: 6017482 - DNA, 14 bp, Homo sapiens
cagccgtattttac

SEQ ID NO: 6017483 - DNA, 15 bp, Homo sapiens
cagccgtattttaca

SEQ ID NO: 6017484 - DNA, 16 bp, Homo sapiens
cagccgtcagccatca

SEQ ID NO: 6017485 - DNA, 20 bp, Homo sapiens
cagccgtcagccatcagcca

SEQ ID NO: 6017486 - DNA, 22 bp, Homo sapiens
cagccgtcccaaccctgcccag

SEQ ID NO: 6017487 - DNA, 20 bp, Homo sapiens
cagccgtcccgcgttcaaga

SEQ ID NO: 6017488 - DNA, 22 bp, Homo sapiens
cagccgtcccgcgttcaagact

SEQ ID NO: 6017489 - DNA, 16 bp, Homo sapiens
cagccgtcgtctccct

SEQ ID NO: 6017490 - DNA, 14 bp, Homo sapiens
cagccgtgagcatg

SEQ ID NO: 6017491 - DNA, 17 bp, Homo sapiens
cagccgtgagcatgttt

SEQ ID NO: 6017492 - DNA, 17 bp, Homo sapiens
cagccgtgcaggactct

SEQ ID NO: 6017493 - DNA, 16 bp, Homo sapiens
cagccgtgccttcagc

SEQ ID NO: 6017494 - DNA, 18 bp, Homo sapiens
cagccgtgccttcagctc

SEQ ID NO: 6017495 - DNA, 20 bp, Homo sapiens
cagccgtgccttcagctcta

SEQ ID NO: 6017496 - DNA, 15 bp, Homo sapiens
cagccgtgggcccca

SEQ ID NO: 6017497 - DNA, 15 bp, Homo sapiens
cagccgttttcctca

SEQ ID NO: 6017498 - DNA, 21 bp, Homo sapiens
cagcctaaagtacagcctgga

SEQ ID NO: 6017499 - DNA, 22 bp, Homo sapiens
cagcctaacccccagcccctcc

SEQ ID NO: 6017500 - DNA, 13 bp, Homo sapiens
cagcctaagaaga

SEQ ID NO: 6017501 - DNA, 17 bp, Homo sapiens
cagcctaagaagaaggc

SEQ ID NO: 6017502 - DNA, 16 bp, Homo sapiens
cagcctaagatgaaga

SEQ ID NO: 6017503 - DNA, 17 bp, Homo sapiens
cagcctaagggagacag

SEQ ID NO: 6017504 - DNA, 18 bp, Homo sapiens
cagcctaagggagacagg

SEQ ID NO: 6017505 - DNA, 20 bp, Homo sapiens
cagcctaagggagacaggcc

SEQ ID NO: 6017506 - DNA, 22 bp, Homo sapiens
cagcctaagggagacaggcctt

SEQ ID NO: 6017507 - DNA, 21 bp, Homo sapiens
cagcctaatgagagtgcactg

SEQ ID NO: 6017508 - DNA, 15 bp, Homo sapiens
cagcctacactgcca

SEQ ID NO: 6017509 - DNA, 16 bp, Homo sapiens
cagcctacactgccag

SEQ ID NO: 6017510 - DNA, 20 bp, Homo sapiens
cagcctacactgccagccgc

SEQ ID NO: 6017511 - DNA, 20 bp, Homo sapiens
cagcctacagcagtgtggtc

SEQ ID NO: 6017512 - DNA, 19 bp, Homo sapiens
cagcctacccctcctgcgc

SEQ ID NO: 6017513 - DNA, 17 bp, Homo sapiens
cagcctacccttcctgc

SEQ ID NO: 6017514 - DNA, 19 bp, Homo sapiens
cagcctacccttcctgcat

SEQ ID NO: 6017515 - DNA, 14 bp, Homo sapiens
cagcctacctctcc

SEQ ID NO: 6017516 - DNA, 15 bp, Homo sapiens
cagcctacctctcca

SEQ ID NO: 6017517 - DNA, 20 bp, Homo sapiens
cagcctactagggacctggg

SEQ ID NO: 6017518 - DNA, 15 bp, Homo sapiens
cagcctactgagtag

SEQ ID NO: 6017519 - DNA, 17 bp, Homo sapiens
cagcctagcacagcagc

SEQ ID NO: 6017520 - DNA, 11 bp, Homo sapiens
cagcctagccc

SEQ ID NO: 6017521 - DNA, 19 bp, Homo sapiens
cagcctagcccttgtccct

SEQ ID NO: 6017522 - DNA, 21 bp, Homo sapiens
cagcctagcccttgtcccttt

SEQ ID NO: 6017523 - DNA, 19 bp, Homo sapiens
cagcctagcctatgtctgg

SEQ ID NO: 6017524 - DNA, 21 bp, Homo sapiens
cagcctagcctatgtctggca

SEQ ID NO: 6017525 - DNA, 22 bp, Homo sapiens
cagcctagcctatgtctggcag

SEQ ID NO: 6017526 - DNA, 23 bp, Homo sapiens
cagcctagcctatgtctggcaga

SEQ ID NO: 6017527 - DNA, 19 bp, Homo sapiens
cagcctagcctggctctgc

SEQ ID NO: 6017528 - DNA, 16 bp, Homo sapiens
cagcctaggcttggct

SEQ ID NO: 6017529 - DNA, 18 bp, Homo sapiens
cagcctagggcagacaat

SEQ ID NO: 6017530 - DNA, 18 bp, Homo sapiens
cagcctaggggtcaggga

SEQ ID NO: 6017531 - DNA, 18 bp, Homo sapiens
catatagcaaaactttta

SEQ ID NO: 6017532 - DNA, 21 bp, Homo sapiens
catatagcaaaacttttaaac

SEQ ID NO: 6017533 - DNA, 20 bp, Homo sapiens
catatagccctttccccact

SEQ ID NO: 6017534 - DNA, 18 bp, Homo sapiens
catatagctcgagcaaaa

SEQ ID NO: 6017535 - DNA, 19 bp, Homo sapiens
catatagctcgagcaaaat

SEQ ID NO: 6017536 - DNA, 23 bp, Homo sapiens
catataggggcaaaaatttgaca

SEQ ID NO: 6017537 - DNA, 15 bp, Homo sapiens
catatagtctattca

SEQ ID NO: 6017538 - DNA, 15 bp, Homo sapiens
catatagttaaactg

SEQ ID NO: 6017539 - DNA, 17 bp, Homo sapiens
catatagttaaactgag

SEQ ID NO: 6017540 - DNA, 20 bp, Homo sapiens
catatagtttttgcagggtt

SEQ ID NO: 6017541 - DNA, 13 bp, Homo sapiens
catatataaaagt

SEQ ID NO: 6017542 - DNA, 14 bp, Homo sapiens
catatataaattat

SEQ ID NO: 6017543 - DNA, 20 bp, Homo sapiens
catatataaattattacttt

SEQ ID NO: 6017544 - DNA, 13 bp, Homo sapiens
catatataacaat

SEQ ID NO: 6017545 - DNA, 22 bp, Homo sapiens
catatataagactgctgcagtc

SEQ ID NO: 6017546 - DNA, 17 bp, Homo sapiens
catatataatcaaaata

SEQ ID NO: 6017547 - DNA, 16 bp, Homo sapiens
catatatacaggcata

SEQ ID NO: 6017548 - DNA, 22 bp, Homo sapiens
catatatagacagctttgactg

SEQ ID NO: 6017549 - DNA, 14 bp, Homo sapiens
catatatataaaat

SEQ ID NO: 6017550 - DNA, 17 bp, Homo sapiens
catatatataaaataca

SEQ ID NO: 6017551 - DNA, 14 bp, Homo sapiens
catatatatactat

SEQ ID NO: 6017552 - DNA, 18 bp, Homo sapiens
catatatatagttatgca

SEQ ID NO: 6017553 - DNA, 22 bp, Homo sapiens
catatatatagttatgcataca

SEQ ID NO: 6017554 - DNA, 20 bp, Homo sapiens
catatatatatacacataca

SEQ ID NO: 6017555 - DNA, 22 bp, Homo sapiens
catatatatatacacatacata

SEQ ID NO: 6017556 - DNA, 23 bp, Homo sapiens
catatatatatacacatacatac

SEQ ID NO: 6017557 - DNA, 16 bp, Homo sapiens
catatatatatataac

SEQ ID NO: 6017558 - DNA, 17 bp, Homo sapiens
catatatatatgtgtgt

SEQ ID NO: 6017559 - DNA, 15 bp, Homo sapiens
catatatatatttgt

SEQ ID NO: 6017560 - DNA, 17 bp, Homo sapiens
catatatatctatctta

SEQ ID NO: 6017561 - DNA, 12 bp, Homo sapiens
catatatatctg

SEQ ID NO: 6017562 - DNA, 23 bp, Homo sapiens
catatatatctgagttgtgcctc

SEQ ID NO: 6017563 - DNA, 13 bp, Homo sapiens
catatatatgtat

SEQ ID NO: 6017564 - DNA, 16 bp, Homo sapiens
catatatattacaagg

SEQ ID NO: 6017565 - DNA, 18 bp, Homo sapiens
catatatattttttgctt

SEQ ID NO: 6017566 - DNA, 19 bp, Homo sapiens
catatatcataaaggatat

SEQ ID NO: 6017567 - DNA, 14 bp, Homo sapiens
catatatctacaca

SEQ ID NO: 6017568 - DNA, 13 bp, Homo sapiens
catatatcttatg

SEQ ID NO: 6017569 - DNA, 18 bp, Homo sapiens
catatatgaccagaagcc

SEQ ID NO: 6017570 - DNA, 19 bp, Homo sapiens
catatatgaccagaagcct

SEQ ID NO: 6017571 - DNA, 19 bp, Homo sapiens
catatatgctactagaaaa

SEQ ID NO: 6017572 - DNA, 18 bp, Homo sapiens
catatatgctgtatttct

SEQ ID NO: 6017573 - DNA, 19 bp, Homo sapiens
catatatgctgtatttctt

SEQ ID NO: 6017574 - DNA, 20 bp, Homo sapiens
catatatgctgtatttcttt

SEQ ID NO: 6017575 - DNA, 18 bp, Homo sapiens
catatatgcttttttgca

SEQ ID NO: 6017576 - DNA, 19 bp, Homo sapiens
catatatgcttttttgcaa

SEQ ID NO: 6017577 - DNA, 21 bp, Homo sapiens
catatatgcttttttgcaata

SEQ ID NO: 6017578 - DNA, 19 bp, Homo sapiens
catatatgtataatatata

SEQ ID NO: 6017579 - DNA, 20 bp, Homo sapiens
catatatgtataatatatat

SEQ ID NO: 6017580 - DNA, 14 bp, Homo sapiens
catatatgtatata

SEQ ID NO: 6017581 - DNA, 21 bp, Homo sapiens
catatatgtatatgtatatct

SEQ ID NO: 6017582 - DNA, 15 bp, Homo sapiens
catatatgtctcttt

SEQ ID NO: 6017583 - DNA, 21 bp, Homo sapiens
catatatgtgtccatttcctt

SEQ ID NO: 6017584 - DNA, 18 bp, Homo sapiens
catatattaccccttcat

SEQ ID NO: 6017585 - DNA, 21 bp, Homo sapiens
catatattataagatttttag

SEQ ID NO: 6017586 - DNA, 19 bp, Homo sapiens
catatattatatatagaaa

SEQ ID NO: 6017587 - DNA, 20 bp, Homo sapiens
catatattatatatagaaaa

SEQ ID NO: 6017588 - DNA, 19 bp, Homo sapiens
catatattatcaaaattct

SEQ ID NO: 6017589 - DNA, 17 bp, Homo sapiens
catatattcatgtaata

SEQ ID NO: 6017590 - DNA, 20 bp, Homo sapiens
catatattcatgtaataaat

SEQ ID NO: 6017591 - DNA, 14 bp, Homo sapiens
catatattgaggtt

SEQ ID NO: 6017592 - DNA, 19 bp, Homo sapiens
catatattgaggttcattg

SEQ ID NO: 6017593 - DNA, 16 bp, Homo sapiens
catatattgcatttct

SEQ ID NO: 6017594 - DNA, 13 bp, Homo sapiens
catatattgcttt

SEQ ID NO: 6017595 - DNA, 21 bp, Homo sapiens
catatattggcactgctaaaa

SEQ ID NO: 6017596 - DNA, 19 bp, Homo sapiens
catatattgtgtggtttcc

SEQ ID NO: 6017597 - DNA, 20 bp, Homo sapiens
catatatttaacaatgacaa

SEQ ID NO: 6017598 - DNA, 22 bp, Homo sapiens
catatatttaacaatgacaaga

SEQ ID NO: 6017599 - DNA, 13 bp, Homo sapiens
catatatttatga

SEQ ID NO: 6017600 - DNA, 21 bp, Homo sapiens
catatatttcacactggagtg

SEQ ID NO: 6017601 - DNA, 21 bp, Homo sapiens
catatatttgcagtatgaact

SEQ ID NO: 6017602 - DNA, 15 bp, Homo sapiens
catatattttttaaa

SEQ ID NO: 6017603 - DNA, 16 bp, Homo sapiens
catatattttttagaa

SEQ ID NO: 6017604 - DNA, 20 bp, Homo sapiens
catatcaaaagttgatttct

SEQ ID NO: 6017605 - DNA, 14 bp, Homo sapiens
catatcaacttaat

SEQ ID NO: 6017606 - DNA, 14 bp, Homo sapiens
catatcacacacat

SEQ ID NO: 6017607 - DNA, 15 bp, Homo sapiens
catatcactgaagga

SEQ ID NO: 6017608 - DNA, 13 bp, Homo sapiens
catatcagaaaag

SEQ ID NO: 6017609 - DNA, 19 bp, Homo sapiens
catatcagaaaagtagaat

SEQ ID NO: 6017610 - DNA, 17 bp, Homo sapiens
catatcagacctctgat

SEQ ID NO: 6017611 - DNA, 16 bp, Homo sapiens
catatcagacttcacc

SEQ ID NO: 6017612 - DNA, 22 bp, Homo sapiens
catatcagacttcaccaaatat

SEQ ID NO: 6017613 - DNA, 13 bp, Homo sapiens
catatcagctctg

SEQ ID NO: 6017614 - DNA, 17 bp, Homo sapiens
catatcagctctgcata

SEQ ID NO: 6017615 - DNA, 18 bp, Homo sapiens
catatcagctctgcataa

SEQ ID NO: 6017616 - DNA, 18 bp, Homo sapiens
catatcatataaaatttc

SEQ ID NO: 6017617 - DNA, 21 bp, Homo sapiens
catatcatataaaatttcagg

SEQ ID NO: 6017618 - DNA, 14 bp, Homo sapiens
catatcatccacac

SEQ ID NO: 6017619 - DNA, 14 bp, Homo sapiens
catatcatgctttg

SEQ ID NO: 6017620 - DNA, 14 bp, Homo sapiens
catatcatggtaat

SEQ ID NO: 6017621 - DNA, 15 bp, Homo sapiens
catatcatgtacagt

SEQ ID NO: 6017622 - DNA, 15 bp, Homo sapiens
catatcattcagaat

SEQ ID NO: 6017623 - DNA, 14 bp, Homo sapiens
catatcatttctta

SEQ ID NO: 6017624 - DNA, 15 bp, Homo sapiens
catatcatttgtgaa

SEQ ID NO: 6017625 - DNA, 14 bp, Homo sapiens
catatccaagtttg

SEQ ID NO: 6017626 - DNA, 18 bp, Homo sapiens
catatccataaaattgga

SEQ ID NO: 6017627 - DNA, 21 bp, Homo sapiens
catatccataaaattggatta

SEQ ID NO: 6017628 - DNA, 15 bp, Homo sapiens
catatcccatcctta

SEQ ID NO: 6017629 - DNA, 18 bp, Homo sapiens
catatcccctatttaaca

SEQ ID NO: 6017630 - DNA, 18 bp, Homo sapiens
catatcccctctcccccc

SEQ ID NO: 6017631 - DNA, 12 bp, Homo sapiens
catatcccggga

SEQ ID NO: 6017632 - DNA, 13 bp, Homo sapiens
catatccctgccc

SEQ ID NO: 6017633 - DNA, 19 bp, Homo sapiens
catatccctgcccagcctg

SEQ ID NO: 6017634 - DNA, 21 bp, Homo sapiens
catatccctgcccagcctgtg

SEQ ID NO: 6017635 - DNA, 18 bp, Homo sapiens
catatccctggttgcctc

SEQ ID NO: 6017636 - DNA, 17 bp, Homo sapiens
catatcccttccagatg

SEQ ID NO: 6017637 - DNA, 18 bp, Homo sapiens
catatccgggtgctcaat

SEQ ID NO: 6017638 - DNA, 19 bp, Homo sapiens
catatccgggtgctcaata

SEQ ID NO: 6017639 - DNA, 19 bp, Homo sapiens
catatcctcagatatattt

SEQ ID NO: 6017640 - DNA, 21 bp, Homo sapiens
catatcctccgccctttttgt

SEQ ID NO: 6017641 - DNA, 12 bp, Homo sapiens
catatcctgcct

SEQ ID NO: 6017642 - DNA, 15 bp, Homo sapiens
catatcctggtgtct

SEQ ID NO: 6017643 - DNA, 18 bp, Homo sapiens
catatcctttggtcctgg

SEQ ID NO: 6017644 - DNA, 22 bp, Homo sapiens
catatcctttggtcctggtgct

SEQ ID NO: 6017645 - DNA, 18 bp, Homo sapiens
catatcgctgacttcatg

SEQ ID NO: 6017646 - DNA, 15 bp, Homo sapiens
catatctaaagtcat

SEQ ID NO: 6017647 - DNA, 11 bp, Homo sapiens
catatctaacc

SEQ ID NO: 6017648 - DNA, 16 bp, Homo sapiens
catatctaactttgta

SEQ ID NO: 6017649 - DNA, 14 bp, Homo sapiens
catatctacagata

SEQ ID NO: 6017650 - DNA, 16 bp, Homo sapiens
catatctagatttcta

SEQ ID NO: 6017651 - DNA, 21 bp, Homo sapiens
catatctagtatgaaattata

SEQ ID NO: 6017652 - DNA, 14 bp, Homo sapiens
catatctagtcaat

SEQ ID NO: 6017653 - DNA, 13 bp, Homo sapiens
catatctatcaga

SEQ ID NO: 6017654 - DNA, 17 bp, Homo sapiens
catatctatcagagtat

SEQ ID NO: 6017655 - DNA, 21 bp, Homo sapiens
catatctccatggccctgtcc

SEQ ID NO: 6017656 - DNA, 14 bp, Homo sapiens
catatctccttccc

SEQ ID NO: 6017657 - DNA, 20 bp, Homo sapiens
catatctcctttaatgacat

SEQ ID NO: 6017658 - DNA, 12 bp, Homo sapiens
catatctctccc

SEQ ID NO: 6017659 - DNA, 14 bp, Homo sapiens
catatctctgccat

SEQ ID NO: 6017660 - DNA, 21 bp, Homo sapiens
catatctctgccgtctctcct

SEQ ID NO: 6017661 - DNA, 20 bp, Homo sapiens
catatctggtatatgtcatt

SEQ ID NO: 6017662 - DNA, 21 bp, Homo sapiens
catatctggtatatgtcatta

SEQ ID NO: 6017663 - DNA, 20 bp, Homo sapiens
catatctgtgcaatggaata

SEQ ID NO: 6017664 - DNA, 17 bp, Homo sapiens
catatctgtgtgcccta

SEQ ID NO: 6017665 - DNA, 21 bp, Homo sapiens
catatctgttcaacctcagta

SEQ ID NO: 6017666 - DNA, 16 bp, Homo sapiens
catatctgtttattct

SEQ ID NO: 6017667 - DNA, 23 bp, Homo sapiens
catatcttaaagaaacagctttc

SEQ ID NO: 6017668 - DNA, 14 bp, Homo sapiens
catatcttacagcc

SEQ ID NO: 6017669 - DNA, 19 bp, Homo sapiens
catatcttctatatctgaa

SEQ ID NO: 6017670 - DNA, 20 bp, Homo sapiens
catatcttgcgaatccaagc

SEQ ID NO: 6017671 - DNA, 23 bp, Homo sapiens
catatcttgcgaatccaagctcc

SEQ ID NO: 6017672 - DNA, 16 bp, Homo sapiens
catatcttgttagatt

SEQ ID NO: 6017673 - DNA, 14 bp, Homo sapiens
catatctttatctt

SEQ ID NO: 6017674 - DNA, 15 bp, Homo sapiens
catatctttattaat

SEQ ID NO: 6017675 - DNA, 21 bp, Homo sapiens
catatctttgagttcaacctt

SEQ ID NO: 6017676 - DNA, 11 bp, Homo sapiens
catatgaaaaa

SEQ ID NO: 6017677 - DNA, 20 bp, Homo sapiens
catatgaaaggtgccatgga

SEQ ID NO: 6017678 - DNA, 21 bp, Homo sapiens
catatgaaaggtgccatggaa

SEQ ID NO: 6017679 - DNA, 15 bp, Homo sapiens
catatgaaatataaa

SEQ ID NO: 6017680 - DNA, 17 bp, Homo sapiens
catatgaaatataaatt

SEQ ID NO: 6017681 - DNA, 18 bp, Homo sapiens
catatgaaatataaatta

SEQ ID NO: 6017682 - DNA, 17 bp, Homo sapiens
catatgaaatttaatat

SEQ ID NO: 6017683 - DNA, 19 bp, Homo sapiens
catatgaacgcacaacatg

SEQ ID NO: 6017684 - DNA, 24 bp, Homo sapiens
catatgaacgcacaacatgcacat

SEQ ID NO: 6017685 - DNA, 14 bp, Homo sapiens
catatgaactttca

SEQ ID NO: 6017686 - DNA, 18 bp, Homo sapiens
catatgaatgcagcactg

SEQ ID NO: 6017687 - DNA, 17 bp, Homo sapiens
catatgaattgctgtct

SEQ ID NO: 6017688 - DNA, 19 bp, Homo sapiens
catatgaattgctgtctag

SEQ ID NO: 6017689 - DNA, 17 bp, Homo sapiens
catatgaattgtacaga

SEQ ID NO: 6017690 - DNA, 19 bp, Homo sapiens
catatgacaaatgtttcta

SEQ ID NO: 6017691 - DNA, 17 bp, Homo sapiens
catatgacaatttcaaa

SEQ ID NO: 6017692 - DNA, 21 bp, Homo sapiens
catatgacaatttcaaaatgc

SEQ ID NO: 6017693 - DNA, 23 bp, Homo sapiens
catatgacaatttcaaaatgcat

SEQ ID NO: 6017694 - DNA, 18 bp, Homo sapiens
catatgacatgccaccct

SEQ ID NO: 6017695 - DNA, 18 bp, Homo sapiens
catatgaccattgaaaaa

SEQ ID NO: 6017696 - DNA, 19 bp, Homo sapiens
catatgaccattgaaaaag

SEQ ID NO: 6017697 - DNA, 22 bp, Homo sapiens
catatgaccattgagtccctgc

SEQ ID NO: 6017698 - DNA, 23 bp, Homo sapiens
catatgaccattgagtccctgct

SEQ ID NO: 6017699 - DNA, 18 bp, Homo sapiens
catatgacctcatgcatc

SEQ ID NO: 6017700 - DNA, 15 bp, Homo sapiens
catatgacttgatct

SEQ ID NO: 6017701 - DNA, 23 bp, Homo sapiens
catatgagcctgccctcactccc

SEQ ID NO: 6017702 - DNA, 13 bp, Homo sapiens
catatgaggatgc

SEQ ID NO: 6017703 - DNA, 15 bp, Homo sapiens
catatgaggggaccc

SEQ ID NO: 6017704 - DNA, 16 bp, Homo sapiens
catatgaggggaccca

SEQ ID NO: 6017705 - DNA, 17 bp, Homo sapiens
catatgaggggacccag

SEQ ID NO: 6017706 - DNA, 19 bp, Homo sapiens
catatgagtgtggaagccg

SEQ ID NO: 6017707 - DNA, 22 bp, Homo sapiens
catatgattgaaaagaagaaag

SEQ ID NO: 6017708 - DNA, 20 bp, Homo sapiens
catatgattgtatttgtgta

SEQ ID NO: 6017709 - DNA, 17 bp, Homo sapiens
cagcctagtaggagctg

SEQ ID NO: 6017710 - DNA, 23 bp, Homo sapiens
cagcctagttatcaaggggatga

SEQ ID NO: 6017711 - DNA, 18 bp, Homo sapiens
cagcctattattttttta

SEQ ID NO: 6017712 - DNA, 23 bp, Homo sapiens
cagcctcaaaaacgccctcaaga

SEQ ID NO: 6017713 - DNA, 21 bp, Homo sapiens
cagcctcaaatccaggaccct

SEQ ID NO: 6017714 - DNA, 20 bp, Homo sapiens
cagcctcaataagccttgtc

SEQ ID NO: 6017715 - DNA, 17 bp, Homo sapiens
cagcctcacagatgctg

SEQ ID NO: 6017716 - DNA, 21 bp, Homo sapiens
cagcctcacagatgctggcct

SEQ ID NO: 6017717 - DNA, 23 bp, Homo sapiens
cagcctcacagatgctggcctct

SEQ ID NO: 6017718 - DNA, 15 bp, Homo sapiens
cagcctcacagtcct

SEQ ID NO: 6017719 - DNA, 12 bp, Homo sapiens
cagcctcacccc

SEQ ID NO: 6017720 - DNA, 21 bp, Homo sapiens
cagcctcacgcccccaggaat

SEQ ID NO: 6017721 - DNA, 22 bp, Homo sapiens
cagcctcactccatttcccact

SEQ ID NO: 6017722 - DNA, 13 bp, Homo sapiens
cagcctcacttgg

SEQ ID NO: 6017723 - DNA, 18 bp, Homo sapiens
cagcctcagaagccttct

SEQ ID NO: 6017724 - DNA, 22 bp, Homo sapiens
cagcctcagaagccttcttgct

SEQ ID NO: 6017725 - DNA, 23 bp, Homo sapiens
cagcctcagaagccttcttgctg

SEQ ID NO: 6017726 - DNA, 19 bp, Homo sapiens
cagcctcagaaggccccag

SEQ ID NO: 6017727 - DNA, 22 bp, Homo sapiens
cagcctcagaaggccccagaga

SEQ ID NO: 6017728 - DNA, 17 bp, Homo sapiens
cagcctcagaggagctc

SEQ ID NO: 6017729 - DNA, 20 bp, Homo sapiens
cagcctcagaggccccttgc

SEQ ID NO: 6017730 - DNA, 15 bp, Homo sapiens
cagcctcagcccaac

SEQ ID NO: 6017731 - DNA, 16 bp, Homo sapiens
cagcctcagcccaact

SEQ ID NO: 6017732 - DNA, 12 bp, Homo sapiens
cagcctcagctc

SEQ ID NO: 6017733 - DNA, 15 bp, Homo sapiens
cagcctcagctcagc

SEQ ID NO: 6017734 - DNA, 17 bp, Homo sapiens
cagcctcagctcagcct

SEQ ID NO: 6017735 - DNA, 14 bp, Homo sapiens
cagcctcaggactg

SEQ ID NO: 6017736 - DNA, 18 bp, Homo sapiens
cagcctcaggactgggag

SEQ ID NO: 6017737 - DNA, 19 bp, Homo sapiens
cagcctcaggactgggagc

SEQ ID NO: 6017738 - DNA, 15 bp, Homo sapiens
cagcctcagtcctcc

SEQ ID NO: 6017739 - DNA, 19 bp, Homo sapiens
cagcctcagtcctcccctc

SEQ ID NO: 6017740 - DNA, 17 bp, Homo sapiens
cagcctcagtgccactt

SEQ ID NO: 6017741 - DNA, 17 bp, Homo sapiens
cagcctcatactcctgg

SEQ ID NO: 6017742 - DNA, 22 bp, Homo sapiens
cagcctcatactcctgggctca

SEQ ID NO: 6017743 - DNA, 22 bp, Homo sapiens
cagcctcatcctccccaggacc

SEQ ID NO: 6017744 - DNA, 16 bp, Homo sapiens
cagcctcatcctgaga

SEQ ID NO: 6017745 - DNA, 17 bp, Homo sapiens
cagcctcatgactttat

SEQ ID NO: 6017746 - DNA, 18 bp, Homo sapiens
cagcctcattcagcatgg

SEQ ID NO: 6017747 - DNA, 16 bp, Homo sapiens
cagcctcattgtgcca

SEQ ID NO: 6017748 - DNA, 12 bp, Homo sapiens
cagcctccaaag

SEQ ID NO: 6017749 - DNA, 15 bp, Homo sapiens
cagcctccaaagtgg

SEQ ID NO: 6017750 - DNA, 22 bp, Homo sapiens
cagcctccaacacaaggctcca

SEQ ID NO: 6017751 - DNA, 21 bp, Homo sapiens
cagcctccaactccagctgag

SEQ ID NO: 6017752 - DNA, 17 bp, Homo sapiens
cagcctccaagaaactt

SEQ ID NO: 6017753 - DNA, 14 bp, Homo sapiens
cagcctccaagctc

SEQ ID NO: 6017754 - DNA, 12 bp, Homo sapiens
cagcctccaatg

SEQ ID NO: 6017755 - DNA, 22 bp, Homo sapiens
cagcctccaatgcattggcctc

SEQ ID NO: 6017756 - DNA, 24 bp, Homo sapiens
cagcctccaatgcattggcctctg

SEQ ID NO: 6017757 - DNA, 12 bp, Homo sapiens
cagcctccactc

SEQ ID NO: 6017758 - DNA, 19 bp, Homo sapiens
cagcctccactgtgtccag

SEQ ID NO: 6017759 - DNA, 14 bp, Homo sapiens
cagcctccacttcc

SEQ ID NO: 6017760 - DNA, 20 bp, Homo sapiens
cagcctccagagaagccccg

SEQ ID NO: 6017761 - DNA, 22 bp, Homo sapiens
cagcctccagagaagccccgca

SEQ ID NO: 6017762 - DNA, 20 bp, Homo sapiens
cagcctccagagccagcctg

SEQ ID NO: 6017763 - DNA, 21 bp, Homo sapiens
cagcctccagagccagcctgg

SEQ ID NO: 6017764 - DNA, 23 bp, Homo sapiens
cagcctccagagccagcctggga

SEQ ID NO: 6017765 - DNA, 12 bp, Homo sapiens
cagcctccagcc

SEQ ID NO: 6017766 - DNA, 13 bp, Homo sapiens
cagcctccagtct

SEQ ID NO: 6017767 - DNA, 20 bp, Homo sapiens
cagcctccagtctgctctca

SEQ ID NO: 6017768 - DNA, 13 bp, Homo sapiens
cagcctccagtgc

SEQ ID NO: 6017769 - DNA, 17 bp, Homo sapiens
cagcctccagtgctggc

SEQ ID NO: 6017770 - DNA, 20 bp, Homo sapiens
cagcctccagtgctggctgc

SEQ ID NO: 6017771 - DNA, 21 bp, Homo sapiens
cagcctccagtgctggctgct

SEQ ID NO: 6017772 - DNA, 22 bp, Homo sapiens
cagcctccagtgctggctgctg

SEQ ID NO: 6017773 - DNA, 21 bp, Homo sapiens
cagcctccatcctaccccctg

SEQ ID NO: 6017774 - DNA, 15 bp, Homo sapiens
cagcctccatgctgc

SEQ ID NO: 6017775 - DNA, 17 bp, Homo sapiens
cagcctccatgctgcct

SEQ ID NO: 6017776 - DNA, 13 bp, Homo sapiens
cagcctcccaaag

SEQ ID NO: 6017777 - DNA, 14 bp, Homo sapiens
cagcctcccaaccc

SEQ ID NO: 6017778 - DNA, 18 bp, Homo sapiens
cagcctcccaaccccagg

SEQ ID NO: 6017779 - DNA, 14 bp, Homo sapiens
cagcctcccaagta

SEQ ID NO: 6017780 - DNA, 19 bp, Homo sapiens
cagcctcccaagtagctgg

SEQ ID NO: 6017781 - DNA, 12 bp, Homo sapiens
cagcctcccaca

SEQ ID NO: 6017782 - DNA, 13 bp, Homo sapiens
cagcctcccacag

SEQ ID NO: 6017783 - DNA, 14 bp, Homo sapiens
cagcctcccacccc

SEQ ID NO: 6017784 - DNA, 16 bp, Homo sapiens
cagcctcccaccccca

SEQ ID NO: 6017785 - DNA, 20 bp, Homo sapiens
cagcctcccatagctgggac

SEQ ID NO: 6017786 - DNA, 23 bp, Homo sapiens
cagcctcccatccagggccccca

SEQ ID NO: 6017787 - DNA, 21 bp, Homo sapiens
cagcctccccagtagctggga

SEQ ID NO: 6017788 - DNA, 14 bp, Homo sapiens
cagcctcccccaca

SEQ ID NO: 6017789 - DNA, 14 bp, Homo sapiens
cagcctcccccagg

SEQ ID NO: 6017790 - DNA, 15 bp, Homo sapiens
cagcctcccccaggc

SEQ ID NO: 6017791 - DNA, 21 bp, Homo sapiens
cagcctcccccaggctgcgcc

SEQ ID NO: 6017792 - DNA, 22 bp, Homo sapiens
cagcctcccccaggctgcgcct

SEQ ID NO: 6017793 - DNA, 20 bp, Homo sapiens
cagcctccccccgctgggga

SEQ ID NO: 6017794 - DNA, 12 bp, Homo sapiens
cagcctcccccg

SEQ ID NO: 6017795 - DNA, 16 bp, Homo sapiens
cagcctccccctgctg

SEQ ID NO: 6017796 - DNA, 23 bp, Homo sapiens
cagcctccccctgtcccctctat

SEQ ID NO: 6017797 - DNA, 13 bp, Homo sapiens
cagcctcccctcc

SEQ ID NO: 6017798 - DNA, 19 bp, Homo sapiens
cagcctcccctcccctggg

SEQ ID NO: 6017799 - DNA, 22 bp, Homo sapiens
cagcctcccctcccctggggac

SEQ ID NO: 6017800 - DNA, 16 bp, Homo sapiens
cagcctcccctgccag

SEQ ID NO: 6017801 - DNA, 17 bp, Homo sapiens
cagcctcccctgccagg

SEQ ID NO: 6017802 - DNA, 18 bp, Homo sapiens
cagcctcccctgccaggg

SEQ ID NO: 6017803 - DNA, 17 bp, Homo sapiens
cagcctccccttcccag

SEQ ID NO: 6017804 - DNA, 18 bp, Homo sapiens
cagcctccccttcccaga

SEQ ID NO: 6017805 - DNA, 19 bp, Homo sapiens
cagcctccccttcttcccg

SEQ ID NO: 6017806 - DNA, 20 bp, Homo sapiens
cagcctcccgagtagctggg

SEQ ID NO: 6017807 - DNA, 19 bp, Homo sapiens
cagcctccctagtagctgg

SEQ ID NO: 6017808 - DNA, 12 bp, Homo sapiens
cagcctccctca

SEQ ID NO: 6017809 - DNA, 17 bp, Homo sapiens
cagcctccctcagcccc

SEQ ID NO: 6017810 - DNA, 23 bp, Homo sapiens
cagcctccctctgacctgcaggc

SEQ ID NO: 6017811 - DNA, 12 bp, Homo sapiens
cagcctccctga

SEQ ID NO: 6017812 - DNA, 22 bp, Homo sapiens
cagcctccctgacgtctgccac

SEQ ID NO: 6017813 - DNA, 14 bp, Homo sapiens
cagcctccctgagc

SEQ ID NO: 6017814 - DNA, 21 bp, Homo sapiens
cagcctccctgagcctgcatt

SEQ ID NO: 6017815 - DNA, 12 bp, Homo sapiens
cagcctccctgt

SEQ ID NO: 6017816 - DNA, 16 bp, Homo sapiens
cagcctccctgtcact

SEQ ID NO: 6017817 - DNA, 17 bp, Homo sapiens
cagcctccctgtcactc

SEQ ID NO: 6017818 - DNA, 16 bp, Homo sapiens
cagcctccctgtctcc

SEQ ID NO: 6017819 - DNA, 20 bp, Homo sapiens
cagcctccctgtctccagct

SEQ ID NO: 6017820 - DNA, 21 bp, Homo sapiens
cagcctccctgtctccagctg

SEQ ID NO: 6017821 - DNA, 22 bp, Homo sapiens
cagcctccctgtctccagctgc

SEQ ID NO: 6017822 - DNA, 20 bp, Homo sapiens
cagcctccctttgccagcca

SEQ ID NO: 6017823 - DNA, 20 bp, Homo sapiens
cagcctccgagagggagaga

SEQ ID NO: 6017824 - DNA, 18 bp, Homo sapiens
cagcctccgccaagatct

SEQ ID NO: 6017825 - DNA, 20 bp, Homo sapiens
cagcctccgccaagatctac

SEQ ID NO: 6017826 - DNA, 20 bp, Homo sapiens
cagcctccgcctcccgggtt

SEQ ID NO: 6017827 - DNA, 17 bp, Homo sapiens
cagcctccgcggactgg

SEQ ID NO: 6017828 - DNA, 18 bp, Homo sapiens
cagcctccgcttccctgg

SEQ ID NO: 6017829 - DNA, 18 bp, Homo sapiens
cagcctccgtatttcaga

SEQ ID NO: 6017830 - DNA, 21 bp, Homo sapiens
cagcctccgtcatccatgccc

SEQ ID NO: 6017831 - DNA, 18 bp, Homo sapiens
cagcctcctaggctccct

SEQ ID NO: 6017832 - DNA, 23 bp, Homo sapiens
cagcctcctcatctgggggagtg

SEQ ID NO: 6017833 - DNA, 15 bp, Homo sapiens
cagcctcctcctgac

SEQ ID NO: 6017834 - DNA, 14 bp, Homo sapiens
cagcctcctctgga

SEQ ID NO: 6017835 - DNA, 21 bp, Homo sapiens
cagcctcctctggacggcagg

SEQ ID NO: 6017836 - DNA, 23 bp, Homo sapiens
cagcctcctctgtctgcccttca

SEQ ID NO: 6017837 - DNA, 13 bp, Homo sapiens
cagcctcctgagt

SEQ ID NO: 6017838 - DNA, 20 bp, Homo sapiens
cagcctcctgagtagctgga

SEQ ID NO: 6017839 - DNA, 12 bp, Homo sapiens
cagcctcctggg

SEQ ID NO: 6017840 - DNA, 16 bp, Homo sapiens
cagcctcctgggggat

SEQ ID NO: 6017841 - DNA, 20 bp, Homo sapiens
cagcctcctgtctcgccaga

SEQ ID NO: 6017842 - DNA, 16 bp, Homo sapiens
cagcctcctgtttgca

SEQ ID NO: 6017843 - DNA, 19 bp, Homo sapiens
cagcctcctgtttgcaggc

SEQ ID NO: 6017844 - DNA, 16 bp, Homo sapiens
cagcctcctgtttggt

SEQ ID NO: 6017845 - DNA, 11 bp, Homo sapiens
cagcctccttg

SEQ ID NO: 6017846 - DNA, 18 bp, Homo sapiens
cagcctccttgcctggaa

SEQ ID NO: 6017847 - DNA, 16 bp, Homo sapiens
cagcctcctttgtgtg

SEQ ID NO: 6017848 - DNA, 18 bp, Homo sapiens
cagcctcgaactcctggg

SEQ ID NO: 6017849 - DNA, 22 bp, Homo sapiens
cagcctcgaactcctgggctca

SEQ ID NO: 6017850 - DNA, 22 bp, Homo sapiens
cagcctcgacctccctggcttg

SEQ ID NO: 6017851 - DNA, 23 bp, Homo sapiens
cagcctcgacctccctggcttga

SEQ ID NO: 6017852 - DNA, 16 bp, Homo sapiens
cagcctcgaggctggt

SEQ ID NO: 6017853 - DNA, 15 bp, Homo sapiens
cagcctcgcacaggc

SEQ ID NO: 6017854 - DNA, 18 bp, Homo sapiens
cagcctcgcacaggccct

SEQ ID NO: 6017855 - DNA, 16 bp, Homo sapiens
cagcctcgcatgccag

SEQ ID NO: 6017856 - DNA, 15 bp, Homo sapiens
cagcctcgcctgtca

SEQ ID NO: 6017857 - DNA, 16 bp, Homo sapiens
cagcctcgcctgtcac

SEQ ID NO: 6017858 - DNA, 22 bp, Homo sapiens
cagcctcgttaggacaaggctg

SEQ ID NO: 6017859 - DNA, 16 bp, Homo sapiens
cagcctcgttggagag

SEQ ID NO: 6017860 - DNA, 18 bp, Homo sapiens
cagcctcgttggagagca

SEQ ID NO: 6017861 - DNA, 23 bp, Homo sapiens
cagcctctaactcctgggctcaa

SEQ ID NO: 6017862 - DNA, 19 bp, Homo sapiens
cagcctctcaaatagctgg

SEQ ID NO: 6017863 - DNA, 15 bp, Homo sapiens
cagcctctcagtgcc

SEQ ID NO: 6017864 - DNA, 22 bp, Homo sapiens
cagcctctcagtgccctccagc

SEQ ID NO: 6017865 - DNA, 13 bp, Homo sapiens
cagcctctccaag

SEQ ID NO: 6017866 - DNA, 24 bp, Homo sapiens
cagcctctccactcatgtgactct

SEQ ID NO: 6017867 - DNA, 23 bp, Homo sapiens
cagcctctccaggcaccatctcc

SEQ ID NO: 6017868 - DNA, 20 bp, Homo sapiens
cagcctctccccgctctgga

SEQ ID NO: 6017869 - DNA, 17 bp, Homo sapiens
cagcctctcccctgatt

SEQ ID NO: 6017870 - DNA, 15 bp, Homo sapiens
cagcctctcccggct

SEQ ID NO: 6017871 - DNA, 15 bp, Homo sapiens
cagcctctctcccag

SEQ ID NO: 6017872 - DNA, 18 bp, Homo sapiens
cagcctctctcccagtct

SEQ ID NO: 6017873 - DNA, 22 bp, Homo sapiens
cagcctctctcccagtctaccc

SEQ ID NO: 6017874 - DNA, 16 bp, Homo sapiens
cagcctctctcttttc

SEQ ID NO: 6017875 - DNA, 15 bp, Homo sapiens
cagcctctctgctat

SEQ ID NO: 6017876 - DNA, 12 bp, Homo sapiens
cagcctctctgg

SEQ ID NO: 6017877 - DNA, 21 bp, Homo sapiens
cagcctctcttcctatcccat

SEQ ID NO: 6017878 - DNA, 13 bp, Homo sapiens
cagcctctgaccc

SEQ ID NO: 6017879 - DNA, 19 bp, Homo sapiens
cagcctctgacccctcctc

SEQ ID NO: 6017880 - DNA, 14 bp, Homo sapiens
cagcctctgagtcc

SEQ ID NO: 6017881 - DNA, 17 bp, Homo sapiens
cagcctctgatctgtgc

SEQ ID NO: 6017882 - DNA, 17 bp, Homo sapiens
cagcctctgcaactgca

SEQ ID NO: 6017883 - DNA, 20 bp, Homo sapiens
cagcctctgcaactgcaaga

SEQ ID NO: 6017884 - DNA, 21 bp, Homo sapiens
cagcctctgcaactgcaagaa

SEQ ID NO: 6017885 - DNA, 20 bp, Homo sapiens
cagcctctgcaagattttaa

SEQ ID NO: 6017886 - DNA, 23 bp, Homo sapiens
catatgattgtgcacatacttga

SEQ ID NO: 6017887 - DNA, 14 bp, Homo sapiens
catatgatttacat

SEQ ID NO: 6017888 - DNA, 21 bp, Homo sapiens
catatgatttcactagaaaag

SEQ ID NO: 6017889 - DNA, 22 bp, Homo sapiens
catatgcaaacagccctaaata

SEQ ID NO: 6017890 - DNA, 16 bp, Homo sapiens
catatgcaccttgtgt

SEQ ID NO: 6017891 - DNA, 20 bp, Homo sapiens
catatgcaccttgtgtctgt

SEQ ID NO: 6017892 - DNA, 23 bp, Homo sapiens
catatgcaccttgtgtctgtaca

SEQ ID NO: 6017893 - DNA, 20 bp, Homo sapiens
catatgcagccaaccaagat

SEQ ID NO: 6017894 - DNA, 18 bp, Homo sapiens
catatgcagtgttctaca

SEQ ID NO: 6017895 - DNA, 15 bp, Homo sapiens
catatgcatgccagg

SEQ ID NO: 6017896 - DNA, 19 bp, Homo sapiens
catatgcatgccaggctgg

SEQ ID NO: 6017897 - DNA, 20 bp, Homo sapiens
catatgcatgccaggctggg

SEQ ID NO: 6017898 - DNA, 13 bp, Homo sapiens
catatgccacccc

SEQ ID NO: 6017899 - DNA, 23 bp, Homo sapiens
catatgcccacatttagtctctt

SEQ ID NO: 6017900 - DNA, 17 bp, Homo sapiens
catatgcctacagccct

SEQ ID NO: 6017901 - DNA, 20 bp, Homo sapiens
catatgcctgggcagaagga

SEQ ID NO: 6017902 - DNA, 22 bp, Homo sapiens
catatgcctgggcagaaggaag

SEQ ID NO: 6017903 - DNA, 21 bp, Homo sapiens
catatgctacacatatgtgct

SEQ ID NO: 6017904 - DNA, 21 bp, Homo sapiens
catatgctaccaccagctgtg

SEQ ID NO: 6017905 - DNA, 21 bp, Homo sapiens
catatgctccaggatctttga

SEQ ID NO: 6017906 - DNA, 13 bp, Homo sapiens
catatgctctgct

SEQ ID NO: 6017907 - DNA, 13 bp, Homo sapiens
catatgcttctga

SEQ ID NO: 6017908 - DNA, 15 bp, Homo sapiens
catatgcttctgatg

SEQ ID NO: 6017909 - DNA, 22 bp, Homo sapiens
catatggaaatcctgttactta

SEQ ID NO: 6017910 - DNA, 16 bp, Homo sapiens
catatggacactgtga

SEQ ID NO: 6017911 - DNA, 15 bp, Homo sapiens
catatggactctgca

SEQ ID NO: 6017912 - DNA, 20 bp, Homo sapiens
catatggagaacatgtttta

SEQ ID NO: 6017913 - DNA, 15 bp, Homo sapiens
catatggagctcatg

SEQ ID NO: 6017914 - DNA, 16 bp, Homo sapiens
catatggaggactgtg

SEQ ID NO: 6017915 - DNA, 15 bp, Homo sapiens
catatggaggcctga

SEQ ID NO: 6017916 - DNA, 16 bp, Homo sapiens
catatggagtgcctgt

SEQ ID NO: 6017917 - DNA, 20 bp, Homo sapiens
catatggagtgcctgtacaa

SEQ ID NO: 6017918 - DNA, 11 bp, Homo sapiens
catatggatgt

SEQ ID NO: 6017919 - DNA, 23 bp, Homo sapiens
catatggattttctattgttact

SEQ ID NO: 6017920 - DNA, 20 bp, Homo sapiens
catatgggatattcccaagc

SEQ ID NO: 6017921 - DNA, 19 bp, Homo sapiens
catatggggtgtttgttcc

SEQ ID NO: 6017922 - DNA, 21 bp, Homo sapiens
catatgggtgggattttgcaa

SEQ ID NO: 6017923 - DNA, 17 bp, Homo sapiens
catatggtaggaccctc

SEQ ID NO: 6017924 - DNA, 20 bp, Homo sapiens
catatggtctccattttaca

SEQ ID NO: 6017925 - DNA, 14 bp, Homo sapiens
catatgtaaaataa

SEQ ID NO: 6017926 - DNA, 17 bp, Homo sapiens
catatgtaaaatattgt

SEQ ID NO: 6017927 - DNA, 13 bp, Homo sapiens
catatgtaaacat

SEQ ID NO: 6017928 - DNA, 19 bp, Homo sapiens
catatgtacataaattgca

SEQ ID NO: 6017929 - DNA, 19 bp, Homo sapiens
catatgtagaaacatttag

SEQ ID NO: 6017930 - DNA, 20 bp, Homo sapiens
catatgtagaaacatttaga

SEQ ID NO: 6017931 - DNA, 21 bp, Homo sapiens
catatgtagactatatacatg

SEQ ID NO: 6017932 - DNA, 23 bp, Homo sapiens
catatgtagactatatacatgtg

SEQ ID NO: 6017933 - DNA, 12 bp, Homo sapiens
catatgtagata

SEQ ID NO: 6017934 - DNA, 18 bp, Homo sapiens
catatgtagcattaaata

SEQ ID NO: 6017935 - DNA, 19 bp, Homo sapiens
catatgtagcattaaatat

SEQ ID NO: 6017936 - DNA, 20 bp, Homo sapiens
catatgtagcattaaatata

SEQ ID NO: 6017937 - DNA, 22 bp, Homo sapiens
catatgtagcattaaatataaa

SEQ ID NO: 6017938 - DNA, 15 bp, Homo sapiens
catatgtaggaaaat

SEQ ID NO: 6017939 - DNA, 17 bp, Homo sapiens
catatgtaggaaaattt

SEQ ID NO: 6017940 - DNA, 20 bp, Homo sapiens
catatgtatctaaatgaaaa

SEQ ID NO: 6017941 - DNA, 18 bp, Homo sapiens
catatgtatgtgtgagtg

SEQ ID NO: 6017942 - DNA, 23 bp, Homo sapiens
catatgtatgtgtgagtgtatgt

SEQ ID NO: 6017943 - DNA, 18 bp, Homo sapiens
catatgtccccactggca

SEQ ID NO: 6017944 - DNA, 15 bp, Homo sapiens
catatgtctgcttct

SEQ ID NO: 6017945 - DNA, 15 bp, Homo sapiens
catatgtctgtcttt

SEQ ID NO: 6017946 - DNA, 11 bp, Homo sapiens
catatgtctta

SEQ ID NO: 6017947 - DNA, 22 bp, Homo sapiens
catatgtcttactactttaaat

SEQ ID NO: 6017948 - DNA, 22 bp, Homo sapiens
catatgtgatctgtcttgtaat

SEQ ID NO: 6017949 - DNA, 18 bp, Homo sapiens
catatgtgctatggagag

SEQ ID NO: 6017950 - DNA, 23 bp, Homo sapiens
catatgttaaagcttatttttat

SEQ ID NO: 6017951 - DNA, 13 bp, Homo sapiens
catatgttaagca

SEQ ID NO: 6017952 - DNA, 23 bp, Homo sapiens
catatgttccatgcctggccctt

SEQ ID NO: 6017953 - DNA, 16 bp, Homo sapiens
catatgttgaatactt

SEQ ID NO: 6017954 - DNA, 18 bp, Homo sapiens
catatgttgaatactttt

SEQ ID NO: 6017955 - DNA, 15 bp, Homo sapiens
catatgttgctcagt

SEQ ID NO: 6017956 - DNA, 18 bp, Homo sapiens
catatgtttattcaaaat

SEQ ID NO: 6017957 - DNA, 20 bp, Homo sapiens
catatgtttattcaaaatat

SEQ ID NO: 6017958 - DNA, 22 bp, Homo sapiens
catatgtttattcaaaatattt

SEQ ID NO: 6017959 - DNA, 16 bp, Homo sapiens
catatgtttccccatc

SEQ ID NO: 6017960 - DNA, 22 bp, Homo sapiens
catatgttttccacataaattt

SEQ ID NO: 6017961 - DNA, 14 bp, Homo sapiens
catattaaaaatat

SEQ ID NO: 6017962 - DNA, 13 bp, Homo sapiens
catattaaaatca

SEQ ID NO: 6017963 - DNA, 22 bp, Homo sapiens
catattaaaattacagatgtga

SEQ ID NO: 6017964 - DNA, 14 bp, Homo sapiens
catattaaacttct

SEQ ID NO: 6017965 - DNA, 19 bp, Homo sapiens
catattaaagaaagtcata

SEQ ID NO: 6017966 - DNA, 19 bp, Homo sapiens
catattaagaatgatctga

SEQ ID NO: 6017967 - DNA, 14 bp, Homo sapiens
catattaagacagt

SEQ ID NO: 6017968 - DNA, 15 bp, Homo sapiens
catattaagacagtg

SEQ ID NO: 6017969 - DNA, 16 bp, Homo sapiens
catattaagacagtgt

SEQ ID NO: 6017970 - DNA, 21 bp, Homo sapiens
catattaagtaagtctcaagg

SEQ ID NO: 6017971 - DNA, 20 bp, Homo sapiens
catattaatataagtttctt

SEQ ID NO: 6017972 - DNA, 21 bp, Homo sapiens
catattaatataagtttcttt

SEQ ID NO: 6017973 - DNA, 21 bp, Homo sapiens
catattaatgcgatttcttcc

SEQ ID NO: 6017974 - DNA, 19 bp, Homo sapiens
catattacaatatttgtgt

SEQ ID NO: 6017975 - DNA, 17 bp, Homo sapiens
catattaccacagacat

SEQ ID NO: 6017976 - DNA, 20 bp, Homo sapiens
catattaccacagacatact

SEQ ID NO: 6017977 - DNA, 21 bp, Homo sapiens
catattaccacagacatacta

SEQ ID NO: 6017978 - DNA, 22 bp, Homo sapiens
catattaccacagacatactaa

SEQ ID NO: 6017979 - DNA, 17 bp, Homo sapiens
catattacgttgtttct

SEQ ID NO: 6017980 - DNA, 17 bp, Homo sapiens
catattactccacacct

SEQ ID NO: 6017981 - DNA, 22 bp, Homo sapiens
catattactgtacatgggacta

SEQ ID NO: 6017982 - DNA, 12 bp, Homo sapiens
catattagaaaa

SEQ ID NO: 6017983 - DNA, 15 bp, Homo sapiens
catattagaaaactt

SEQ ID NO: 6017984 - DNA, 19 bp, Homo sapiens
catattagaaaactttgtt

SEQ ID NO: 6017985 - DNA, 18 bp, Homo sapiens
catattagacttctgttt

SEQ ID NO: 6017986 - DNA, 22 bp, Homo sapiens
catattagacttctgttttcaa

SEQ ID NO: 6017987 - DNA, 20 bp, Homo sapiens
catattagaggggaaaagct

SEQ ID NO: 6017988 - DNA, 20 bp, Homo sapiens
catattaggaaaatatgggt

SEQ ID NO: 6017989 - DNA, 15 bp, Homo sapiens
catattagtgtcatc

SEQ ID NO: 6017990 - DNA, 22 bp, Homo sapiens
catattataaaggataaagaag

SEQ ID NO: 6017991 - DNA, 12 bp, Homo sapiens
catattataaat

SEQ ID NO: 6017992 - DNA, 16 bp, Homo sapiens
catattataaataaat

SEQ ID NO: 6017993 - DNA, 20 bp, Homo sapiens
catattataaataaatgcca

SEQ ID NO: 6017994 - DNA, 21 bp, Homo sapiens
catattataaataaatgccaa

SEQ ID NO: 6017995 - DNA, 14 bp, Homo sapiens
catattatatcaga

SEQ ID NO: 6017996 - DNA, 21 bp, Homo sapiens
catattatcatcctataaaga

SEQ ID NO: 6017997 - DNA, 23 bp, Homo sapiens
catattatcatcctataaagaaa

SEQ ID NO: 6017998 - DNA, 13 bp, Homo sapiens
catattattcttc

SEQ ID NO: 6017999 - DNA, 16 bp, Homo sapiens
catattattttagtgt

SEQ ID NO: 6018000 - DNA, 17 bp, Homo sapiens
catattattttctgggt

SEQ ID NO: 6018001 - DNA, 21 bp, Homo sapiens
catattcaaagcagcagccac

SEQ ID NO: 6018002 - DNA, 16 bp, Homo sapiens
catattcaacacactg

SEQ ID NO: 6018003 - DNA, 22 bp, Homo sapiens
catattcaggaagctcagggcc

SEQ ID NO: 6018004 - DNA, 14 bp, Homo sapiens
catattcatcagca

SEQ ID NO: 6018005 - DNA, 19 bp, Homo sapiens
catattcatggttgttttt

SEQ ID NO: 6018006 - DNA, 23 bp, Homo sapiens
catattcatgtaaacaaaattta

SEQ ID NO: 6018007 - DNA, 19 bp, Homo sapiens
catattccctgcacacaca

SEQ ID NO: 6018008 - DNA, 17 bp, Homo sapiens
catattcctgcagcctg

SEQ ID NO: 6018009 - DNA, 21 bp, Homo sapiens
catattcctgcagcctggagg

SEQ ID NO: 6018010 - DNA, 16 bp, Homo sapiens
catattctaaaagtaa

SEQ ID NO: 6018011 - DNA, 16 bp, Homo sapiens
catattctaaattcac

SEQ ID NO: 6018012 - DNA, 21 bp, Homo sapiens
catattctattgtattatttg

SEQ ID NO: 6018013 - DNA, 18 bp, Homo sapiens
catattctattgtttact

SEQ ID NO: 6018014 - DNA, 16 bp, Homo sapiens
catattctgttggaag

SEQ ID NO: 6018015 - DNA, 20 bp, Homo sapiens
catattcttttctgcaaaat

SEQ ID NO: 6018016 - DNA, 20 bp, Homo sapiens
catattcttttgatcacatt

SEQ ID NO: 6018017 - DNA, 16 bp, Homo sapiens
catattgaatgtttcc

SEQ ID NO: 6018018 - DNA, 18 bp, Homo sapiens
catattgagaataattat

SEQ ID NO: 6018019 - DNA, 22 bp, Homo sapiens
catattgagatcagcattcaaa

SEQ ID NO: 6018020 - DNA, 20 bp, Homo sapiens
catattgaggggcaactcca

SEQ ID NO: 6018021 - DNA, 16 bp, Homo sapiens
catattgataataaaa

SEQ ID NO: 6018022 - DNA, 19 bp, Homo sapiens
catattgatctttttatca

SEQ ID NO: 6018023 - DNA, 13 bp, Homo sapiens
catattgatgaaa

SEQ ID NO: 6018024 - DNA, 14 bp, Homo sapiens
catattgcacatgt

SEQ ID NO: 6018025 - DNA, 16 bp, Homo sapiens
catattgcacatgtct

SEQ ID NO: 6018026 - DNA, 20 bp, Homo sapiens
catattgcaggagacatttt

SEQ ID NO: 6018027 - DNA, 19 bp, Homo sapiens
catattgcatactattaaa

SEQ ID NO: 6018028 - DNA, 16 bp, Homo sapiens
catattgccatgtgtg

SEQ ID NO: 6018029 - DNA, 21 bp, Homo sapiens
catattgctcttaaaaatctt

SEQ ID NO: 6018030 - DNA, 22 bp, Homo sapiens
catattgctcttaaaaatcttg

SEQ ID NO: 6018031 - DNA, 20 bp, Homo sapiens
catattggaaaggtcattgt

SEQ ID NO: 6018032 - DNA, 20 bp, Homo sapiens
catattggatctgcttgctg

SEQ ID NO: 6018033 - DNA, 20 bp, Homo sapiens
catattggattgcgcctttg

SEQ ID NO: 6018034 - DNA, 17 bp, Homo sapiens
catattggcatggattt

SEQ ID NO: 6018035 - DNA, 16 bp, Homo sapiens
catattgtaaaacagg

SEQ ID NO: 6018036 - DNA, 18 bp, Homo sapiens
catattgtaatctatgtt

SEQ ID NO: 6018037 - DNA, 20 bp, Homo sapiens
catattgtaatctatgttta

SEQ ID NO: 6018038 - DNA, 21 bp, Homo sapiens
catattgtaatctatgtttat

SEQ ID NO: 6018039 - DNA, 11 bp, Homo sapiens
catattgtaca

SEQ ID NO: 6018040 - DNA, 15 bp, Homo sapiens
catattgtacacttt

SEQ ID NO: 6018041 - DNA, 20 bp, Homo sapiens
catattgtaccccctcattt

SEQ ID NO: 6018042 - DNA, 14 bp, Homo sapiens
catattgtatgtaa

SEQ ID NO: 6018043 - DNA, 15 bp, Homo sapiens
catattgtatgtaag

SEQ ID NO: 6018044 - DNA, 18 bp, Homo sapiens
catattgtgattctgcct

SEQ ID NO: 6018045 - DNA, 15 bp, Homo sapiens
catattgtgatttta

SEQ ID NO: 6018046 - DNA, 19 bp, Homo sapiens
catattgttagggtcagcc

SEQ ID NO: 6018047 - DNA, 13 bp, Homo sapiens
catattgttgaaa

SEQ ID NO: 6018048 - DNA, 15 bp, Homo sapiens
catatttaacaaaat

SEQ ID NO: 6018049 - DNA, 16 bp, Homo sapiens
catatttaacaaaatt

SEQ ID NO: 6018050 - DNA, 11 bp, Homo sapiens
catatttaaga

SEQ ID NO: 6018051 - DNA, 10 bp, Homo sapiens
catatttaat

SEQ ID NO: 6018052 - DNA, 21 bp, Homo sapiens
catatttaatgttttaaatgt

SEQ ID NO: 6018053 - DNA, 15 bp, Homo sapiens
catatttaatttgaa

SEQ ID NO: 6018054 - DNA, 17 bp, Homo sapiens
catatttacctcagcct

SEQ ID NO: 6018055 - DNA, 17 bp, Homo sapiens
catatttactaccttat

SEQ ID NO: 6018056 - DNA, 13 bp, Homo sapiens
catatttactctt

SEQ ID NO: 6018057 - DNA, 16 bp, Homo sapiens
catatttacttcttat

SEQ ID NO: 6018058 - DNA, 11 bp, Homo sapiens
catatttagct

SEQ ID NO: 6018059 - DNA, 13 bp, Homo sapiens
catatttagctgt

SEQ ID NO: 6018060 - DNA, 18 bp, Homo sapiens
catatttagctgttttgg

SEQ ID NO: 6018061 - DNA, 12 bp, Homo sapiens
catatttataaa

SEQ ID NO: 6018062 - DNA, 22 bp, Homo sapiens
catatttatagcaatccatgtt

SEQ ID NO: 6018063 - DNA, 23 bp, Homo sapiens
cagcctctgcactcccacgcctg

SEQ ID NO: 6018064 - DNA, 21 bp, Homo sapiens
cagcctctgcagtccgtgggc

SEQ ID NO: 6018065 - DNA, 14 bp, Homo sapiens
cagcctctgcccca

SEQ ID NO: 6018066 - DNA, 14 bp, Homo sapiens
cagcctctgctgga

SEQ ID NO: 6018067 - DNA, 13 bp, Homo sapiens
cagcctctggaca

SEQ ID NO: 6018068 - DNA, 18 bp, Homo sapiens
cagcctctggacagccag

SEQ ID NO: 6018069 - DNA, 13 bp, Homo sapiens
cagcctctggcat

SEQ ID NO: 6018070 - DNA, 13 bp, Homo sapiens
cagcctctggcca

SEQ ID NO: 6018071 - DNA, 16 bp, Homo sapiens
cagcctctggccagac

SEQ ID NO: 6018072 - DNA, 18 bp, Homo sapiens
cagcctctggctccacac

SEQ ID NO: 6018073 - DNA, 23 bp, Homo sapiens
cagcctctggctccacacctcca

SEQ ID NO: 6018074 - DNA, 11 bp, Homo sapiens
cagcctctggg

SEQ ID NO: 6018075 - DNA, 13 bp, Homo sapiens
cagcctctgggcc

SEQ ID NO: 6018076 - DNA, 15 bp, Homo sapiens
cagcctctggggcag

SEQ ID NO: 6018077 - DNA, 18 bp, Homo sapiens
cagcctctggggcagagc

SEQ ID NO: 6018078 - DNA, 13 bp, Homo sapiens
cagcctctggggg

SEQ ID NO: 6018079 - DNA, 22 bp, Homo sapiens
cagcctctggggggtggccagg

SEQ ID NO: 6018080 - DNA, 18 bp, Homo sapiens
cagcctctggtcctacca

SEQ ID NO: 6018081 - DNA, 22 bp, Homo sapiens
cagcctctgtcctggctgtgca

SEQ ID NO: 6018082 - DNA, 12 bp, Homo sapiens
cagcctctgtga

SEQ ID NO: 6018083 - DNA, 11 bp, Homo sapiens
cagcctcttaa

SEQ ID NO: 6018084 - DNA, 20 bp, Homo sapiens
cagcctcttaaagctgcctg

SEQ ID NO: 6018085 - DNA, 18 bp, Homo sapiens
cagcctcttaccttcccg

SEQ ID NO: 6018086 - DNA, 13 bp, Homo sapiens
cagcctcttactt

SEQ ID NO: 6018087 - DNA, 20 bp, Homo sapiens
cagcctcttctgtcccaagt

SEQ ID NO: 6018088 - DNA, 15 bp, Homo sapiens
cagcctcttgcccgt

SEQ ID NO: 6018089 - DNA, 12 bp, Homo sapiens
cagcctctttcc

SEQ ID NO: 6018090 - DNA, 18 bp, Homo sapiens
cagcctgaaagatacagg

SEQ ID NO: 6018091 - DNA, 20 bp, Homo sapiens
cagcctgaagatcagagctg

SEQ ID NO: 6018092 - DNA, 14 bp, Homo sapiens
cagcctgaagcctg

SEQ ID NO: 6018093 - DNA, 20 bp, Homo sapiens
cagcctgaagcctggattcc

SEQ ID NO: 6018094 - DNA, 15 bp, Homo sapiens
cagcctgaataaacc

SEQ ID NO: 6018095 - DNA, 17 bp, Homo sapiens
cagcctgacaacagcct

SEQ ID NO: 6018096 - DNA, 19 bp, Homo sapiens
cagcctgacaacagcctga

SEQ ID NO: 6018097 - DNA, 22 bp, Homo sapiens
cagcctgacaacagcctgagaa

SEQ ID NO: 6018098 - DNA, 19 bp, Homo sapiens
cagcctgacctgagactgt

SEQ ID NO: 6018099 - DNA, 17 bp, Homo sapiens
cagcctgacgcctactg

SEQ ID NO: 6018100 - DNA, 19 bp, Homo sapiens
cagcctgacgcctactggg

SEQ ID NO: 6018101 - DNA, 22 bp, Homo sapiens
cagcctgacgcctactggggca

SEQ ID NO: 6018102 - DNA, 15 bp, Homo sapiens
cagcctgactagaac

SEQ ID NO: 6018103 - DNA, 22 bp, Homo sapiens
cagcctgactagaccccaccct

SEQ ID NO: 6018104 - DNA, 23 bp, Homo sapiens
cagcctgagaatgacctgccctg

SEQ ID NO: 6018105 - DNA, 18 bp, Homo sapiens
cagcctgagagctggccc

SEQ ID NO: 6018106 - DNA, 12 bp, Homo sapiens
cagcctgagccg

SEQ ID NO: 6018107 - DNA, 19 bp, Homo sapiens
cagcctgagcgacagtgag

SEQ ID NO: 6018108 - DNA, 23 bp, Homo sapiens
cagcctgagcgacagtgagactc

SEQ ID NO: 6018109 - DNA, 18 bp, Homo sapiens
cagcctgagcggaggctc

SEQ ID NO: 6018110 - DNA, 11 bp, Homo sapiens
cagcctgagct

SEQ ID NO: 6018111 - DNA, 18 bp, Homo sapiens
cagcctgagctccaccct

SEQ ID NO: 6018112 - DNA, 20 bp, Homo sapiens
cagcctgagctccaccctcc

SEQ ID NO: 6018113 - DNA, 14 bp, Homo sapiens
cagcctgaggtgcc

SEQ ID NO: 6018114 - DNA, 15 bp, Homo sapiens
cagcctgaggtgccc

SEQ ID NO: 6018115 - DNA, 23 bp, Homo sapiens
cagcctgaggtgcccactccgcc

SEQ ID NO: 6018116 - DNA, 16 bp, Homo sapiens
cagcctgagtctcctg

SEQ ID NO: 6018117 - DNA, 20 bp, Homo sapiens
cagcctgagtctcctgtgcc

SEQ ID NO: 6018118 - DNA, 22 bp, Homo sapiens
cagcctgagtctcctgtgccca

SEQ ID NO: 6018119 - DNA, 20 bp, Homo sapiens
cagcctgagtgacagagcga

SEQ ID NO: 6018120 - DNA, 16 bp, Homo sapiens
cagcctgattcggggc

SEQ ID NO: 6018121 - DNA, 11 bp, Homo sapiens
cagcctgattg

SEQ ID NO: 6018122 - DNA, 13 bp, Homo sapiens
cagcctgcacaca

SEQ ID NO: 6018123 - DNA, 18 bp, Homo sapiens
cagcctgcacacacctgc

SEQ ID NO: 6018124 - DNA, 22 bp, Homo sapiens
cagcctgcacacacctgcctgc

SEQ ID NO: 6018125 - DNA, 15 bp, Homo sapiens
cagcctgcacagtgg

SEQ ID NO: 6018126 - DNA, 23 bp, Homo sapiens
cagcctgcacttgggggctcagc

SEQ ID NO: 6018127 - DNA, 17 bp, Homo sapiens
cagcctgccactcaggc

SEQ ID NO: 6018128 - DNA, 12 bp, Homo sapiens
cagcctgccagc

SEQ ID NO: 6018129 - DNA, 18 bp, Homo sapiens
cagcctgccaggccctcc

SEQ ID NO: 6018130 - DNA, 19 bp, Homo sapiens
cagcctgccaggccctcca

SEQ ID NO: 6018131 - DNA, 20 bp, Homo sapiens
cagcctgccaggccctccag

SEQ ID NO: 6018132 - DNA, 17 bp, Homo sapiens
cagcctgcccacctctc

SEQ ID NO: 6018133 - DNA, 14 bp, Homo sapiens
cagcctgccccagc

SEQ ID NO: 6018134 - DNA, 22 bp, Homo sapiens
cagcctgccccagcctgcccca

SEQ ID NO: 6018135 - DNA, 23 bp, Homo sapiens
cagcctgccccctatcttgtcct

SEQ ID NO: 6018136 - DNA, 18 bp, Homo sapiens
cagcctgcctgaagagag

SEQ ID NO: 6018137 - DNA, 21 bp, Homo sapiens
cagcctgcctgaagagaggaa

SEQ ID NO: 6018138 - DNA, 12 bp, Homo sapiens
cagcctgcctgg

SEQ ID NO: 6018139 - DNA, 15 bp, Homo sapiens
cagcctgcctgggag

SEQ ID NO: 6018140 - DNA, 13 bp, Homo sapiens
cagcctgcctgtc

SEQ ID NO: 6018141 - DNA, 16 bp, Homo sapiens
cagcctgcgcctgctg

SEQ ID NO: 6018142 - DNA, 23 bp, Homo sapiens
cagcctgcgcctgctgcatgccc

SEQ ID NO: 6018143 - DNA, 17 bp, Homo sapiens
cagcctgcgggaagctg

SEQ ID NO: 6018144 - DNA, 21 bp, Homo sapiens
cagcctgcgggaagctgacct

SEQ ID NO: 6018145 - DNA, 14 bp, Homo sapiens
cagcctgcgtggct

SEQ ID NO: 6018146 - DNA, 15 bp, Homo sapiens
cagcctgcgtggctg

SEQ ID NO: 6018147 - DNA, 17 bp, Homo sapiens
cagcctgcgtggctgac

SEQ ID NO: 6018148 - DNA, 18 bp, Homo sapiens
cagcctgcgtggctgacc

SEQ ID NO: 6018149 - DNA, 21 bp, Homo sapiens
cagcctgcgtggctgaccccc

SEQ ID NO: 6018150 - DNA, 23 bp, Homo sapiens
cagcctgcgtggctgacccccct

SEQ ID NO: 6018151 - DNA, 9 bp, Homo sapiens
cagcctgct

SEQ ID NO: 6018152 - DNA, 21 bp, Homo sapiens
cagcctgctctagtgggacag

SEQ ID NO: 6018153 - DNA, 15 bp, Homo sapiens
cagcctgctctccct

SEQ ID NO: 6018154 - DNA, 10 bp, Homo sapiens
cagcctgctg

SEQ ID NO: 6018155 - DNA, 12 bp, Homo sapiens
cagcctgctgac

SEQ ID NO: 6018156 - DNA, 14 bp, Homo sapiens
cagcctgctgacag

SEQ ID NO: 6018157 - DNA, 20 bp, Homo sapiens
cagcctgctgacagacacta

SEQ ID NO: 6018158 - DNA, 15 bp, Homo sapiens
cagcctgctgagagc

SEQ ID NO: 6018159 - DNA, 15 bp, Homo sapiens
cagcctgctgcccag

SEQ ID NO: 6018160 - DNA, 17 bp, Homo sapiens
cagcctgctggcagggc

SEQ ID NO: 6018161 - DNA, 18 bp, Homo sapiens
cagcctgctggcagggcc

SEQ ID NO: 6018162 - DNA, 21 bp, Homo sapiens
cagcctgctggcagggccagg

SEQ ID NO: 6018163 - DNA, 12 bp, Homo sapiens
cagcctgcttcc

SEQ ID NO: 6018164 - DNA, 15 bp, Homo sapiens
cagcctgcttcccac

SEQ ID NO: 6018165 - DNA, 16 bp, Homo sapiens
cagcctgcttcccaca

SEQ ID NO: 6018166 - DNA, 18 bp, Homo sapiens
cagcctgcttcccacaac

SEQ ID NO: 6018167 - DNA, 18 bp, Homo sapiens
cagcctgcttcttcccca

SEQ ID NO: 6018168 - DNA, 16 bp, Homo sapiens
cagcctggacatagag

SEQ ID NO: 6018169 - DNA, 23 bp, Homo sapiens
cagcctggaccactcctcatagc

SEQ ID NO: 6018170 - DNA, 13 bp, Homo sapiens
cagcctggacccc

SEQ ID NO: 6018171 - DNA, 22 bp, Homo sapiens
cagcctggactttggttctctc

SEQ ID NO: 6018172 - DNA, 11 bp, Homo sapiens
cagcctggagc

SEQ ID NO: 6018173 - DNA, 16 bp, Homo sapiens
cagcctggagccgtgg

SEQ ID NO: 6018174 - DNA, 21 bp, Homo sapiens
cagcctggatgccatccaagt

SEQ ID NO: 6018175 - DNA, 20 bp, Homo sapiens
cagcctggcacagggcagtg

SEQ ID NO: 6018176 - DNA, 21 bp, Homo sapiens
cagcctggcacagggcagtgg

SEQ ID NO: 6018177 - DNA, 13 bp, Homo sapiens
cagcctggcatca

SEQ ID NO: 6018178 - DNA, 15 bp, Homo sapiens
cagcctggcatctgt

SEQ ID NO: 6018179 - DNA, 17 bp, Homo sapiens
cagcctggcatctgtgc

SEQ ID NO: 6018180 - DNA, 22 bp, Homo sapiens
cagcctggcatctgtgcgtgtg

SEQ ID NO: 6018181 - DNA, 19 bp, Homo sapiens
cagcctggccaacatggca

SEQ ID NO: 6018182 - DNA, 16 bp, Homo sapiens
cagcctggccaccagc

SEQ ID NO: 6018183 - DNA, 14 bp, Homo sapiens
cagcctggccagac

SEQ ID NO: 6018184 - DNA, 15 bp, Homo sapiens
cagcctggccatccc

SEQ ID NO: 6018185 - DNA, 20 bp, Homo sapiens
cagcctggcccaccccaccc

SEQ ID NO: 6018186 - DNA, 13 bp, Homo sapiens
cagcctggcccca

SEQ ID NO: 6018187 - DNA, 19 bp, Homo sapiens
cagcctggccccaaatgtt

SEQ ID NO: 6018188 - DNA, 17 bp, Homo sapiens
cagcctggccccaagca

SEQ ID NO: 6018189 - DNA, 15 bp, Homo sapiens
cagcctggcctcccc

SEQ ID NO: 6018190 - DNA, 15 bp, Homo sapiens
cagcctggcctcctg

SEQ ID NO: 6018191 - DNA, 20 bp, Homo sapiens
cagcctggcctcctgcctct

SEQ ID NO: 6018192 - DNA, 23 bp, Homo sapiens
cagcctggcctgcccgtgccctg

SEQ ID NO: 6018193 - DNA, 14 bp, Homo sapiens
cagcctggcctgtg

SEQ ID NO: 6018194 - DNA, 22 bp, Homo sapiens
cagcctggcggggcaggaggcc

SEQ ID NO: 6018195 - DNA, 13 bp, Homo sapiens
cagcctggctccc

SEQ ID NO: 6018196 - DNA, 22 bp, Homo sapiens
cagcctggctctgccccctccc

SEQ ID NO: 6018197 - DNA, 14 bp, Homo sapiens
cagcctggctggga

SEQ ID NO: 6018198 - DNA, 20 bp, Homo sapiens
cagcctggctgggactggga

SEQ ID NO: 6018199 - DNA, 21 bp, Homo sapiens
cagcctggctggtcctcccat

SEQ ID NO: 6018200 - DNA, 20 bp, Homo sapiens
cagcctggcttctggagccc

SEQ ID NO: 6018201 - DNA, 13 bp, Homo sapiens
cagcctgggacac

SEQ ID NO: 6018202 - DNA, 18 bp, Homo sapiens
cagcctgggacacacaca

SEQ ID NO: 6018203 - DNA, 20 bp, Homo sapiens
cagcctgggaccagggcata

SEQ ID NO: 6018204 - DNA, 17 bp, Homo sapiens
cagcctgggactcccag

SEQ ID NO: 6018205 - DNA, 13 bp, Homo sapiens
cagcctgggagcc

SEQ ID NO: 6018206 - DNA, 18 bp, Homo sapiens
cagcctgggagcccagag

SEQ ID NO: 6018207 - DNA, 20 bp, Homo sapiens
cagcctgggagcccagaggg

SEQ ID NO: 6018208 - DNA, 12 bp, Homo sapiens
cagcctgggcaa

SEQ ID NO: 6018209 - DNA, 18 bp, Homo sapiens
cagcctgggcaacaaagt

SEQ ID NO: 6018210 - DNA, 20 bp, Homo sapiens
cagcctgggcaacaagagca

SEQ ID NO: 6018211 - DNA, 16 bp, Homo sapiens
cagcctgggcaacata

SEQ ID NO: 6018212 - DNA, 16 bp, Homo sapiens
cagcctgggcaatgtg

SEQ ID NO: 6018213 - DNA, 20 bp, Homo sapiens
cagcctgggcagcatagcaa

SEQ ID NO: 6018214 - DNA, 18 bp, Homo sapiens
cagcctgggcagccaggc

SEQ ID NO: 6018215 - DNA, 12 bp, Homo sapiens
cagcctgggcca

SEQ ID NO: 6018216 - DNA, 15 bp, Homo sapiens
cagcctgggccccag

SEQ ID NO: 6018217 - DNA, 16 bp, Homo sapiens
cagcctgggccccagc

SEQ ID NO: 6018218 - DNA, 17 bp, Homo sapiens
cagcctgggcccctcag

SEQ ID NO: 6018219 - DNA, 12 bp, Homo sapiens
cagcctgggcct

SEQ ID NO: 6018220 - DNA, 17 bp, Homo sapiens
cagcctgggcctatgga

SEQ ID NO: 6018221 - DNA, 19 bp, Homo sapiens
cagcctgggcgacaaaaac

SEQ ID NO: 6018222 - DNA, 15 bp, Homo sapiens
cagcctgggcgacag

SEQ ID NO: 6018223 - DNA, 17 bp, Homo sapiens
cagcctgggcgacagag

SEQ ID NO: 6018224 - DNA, 15 bp, Homo sapiens
cagcctgggcgctgg

SEQ ID NO: 6018225 - DNA, 15 bp, Homo sapiens
cagcctggggacccc

SEQ ID NO: 6018226 - DNA, 17 bp, Homo sapiens
cagcctggggaccccac

SEQ ID NO: 6018227 - DNA, 20 bp, Homo sapiens
cagcctggggaccccacttc

SEQ ID NO: 6018228 - DNA, 15 bp, Homo sapiens
cagcctggggcctgg

SEQ ID NO: 6018229 - DNA, 17 bp, Homo sapiens
cagcctggggcctggca

SEQ ID NO: 6018230 - DNA, 18 bp, Homo sapiens
cagcctggggcctggcag

SEQ ID NO: 6018231 - DNA, 22 bp, Homo sapiens
cagcctggggcctggcagggag

SEQ ID NO: 6018232 - DNA, 14 bp, Homo sapiens
cagcctggggcctt

SEQ ID NO: 6018233 - DNA, 16 bp, Homo sapiens
cagcctggggccttcc

SEQ ID NO: 6018234 - DNA, 17 bp, Homo sapiens
cagcctggggcggtgtg

SEQ ID NO: 6018235 - DNA, 16 bp, Homo sapiens
cagcctggggctccct

SEQ ID NO: 6018236 - DNA, 22 bp, Homo sapiens
cagcctggggctccctctctgg

SEQ ID NO: 6018237 - DNA, 17 bp, Homo sapiens
cagcctggggctctctg

SEQ ID NO: 6018238 - DNA, 16 bp, Homo sapiens
cagcctgggggacaga

SEQ ID NO: 6018239 - DNA, 20 bp, Homo sapiens
cagcctgggggctgggagga

SEQ ID NO: 6018240 - DNA, 23 bp, Homo sapiens
cagcctgggggctgggaggatcc

SEQ ID NO: 6018241 - DNA, 20 bp, Homo sapiens
cagcctggggtgatagaaca

SEQ ID NO: 6018242 - DNA, 15 bp, Homo sapiens
cagcctgggtcacag

SEQ ID NO: 6018243 - DNA, 21 bp, Homo sapiens
catatttatattgtatattct

SEQ ID NO: 6018244 - DNA, 23 bp, Homo sapiens
catatttatattgtatattctgg

SEQ ID NO: 6018245 - DNA, 12 bp, Homo sapiens
catatttatcca

SEQ ID NO: 6018246 - DNA, 20 bp, Homo sapiens
catatttattgcattgctgg

SEQ ID NO: 6018247 - DNA, 14 bp, Homo sapiens
catatttatttcag

SEQ ID NO: 6018248 - DNA, 18 bp, Homo sapiens
catatttattttcttttg

SEQ ID NO: 6018249 - DNA, 15 bp, Homo sapiens
catatttcattttaa

SEQ ID NO: 6018250 - DNA, 17 bp, Homo sapiens
catatttcattttaaca

SEQ ID NO: 6018251 - DNA, 22 bp, Homo sapiens
catatttcccatgatttcatgt

SEQ ID NO: 6018252 - DNA, 21 bp, Homo sapiens
catatttccccttggacactt

SEQ ID NO: 6018253 - DNA, 12 bp, Homo sapiens
catatttctgta

SEQ ID NO: 6018254 - DNA, 13 bp, Homo sapiens
catatttctgtat

SEQ ID NO: 6018255 - DNA, 20 bp, Homo sapiens
catatttctgtatatttgtc

SEQ ID NO: 6018256 - DNA, 21 bp, Homo sapiens
catatttcttgagtaatttaa

SEQ ID NO: 6018257 - DNA, 13 bp, Homo sapiens
catatttgaaaac

SEQ ID NO: 6018258 - DNA, 19 bp, Homo sapiens
catatttgaattggcctga

SEQ ID NO: 6018259 - DNA, 19 bp, Homo sapiens
catatttgactctttcaaa

SEQ ID NO: 6018260 - DNA, 15 bp, Homo sapiens
catatttgagactag

SEQ ID NO: 6018261 - DNA, 15 bp, Homo sapiens
catatttgatttcta

SEQ ID NO: 6018262 - DNA, 16 bp, Homo sapiens
catatttgatttctaa

SEQ ID NO: 6018263 - DNA, 18 bp, Homo sapiens
catatttgatttctaatt

SEQ ID NO: 6018264 - DNA, 21 bp, Homo sapiens
catatttgatttctaattgta

SEQ ID NO: 6018265 - DNA, 22 bp, Homo sapiens
catatttgatttctaattgtaa

SEQ ID NO: 6018266 - DNA, 13 bp, Homo sapiens
catatttgcacta

SEQ ID NO: 6018267 - DNA, 17 bp, Homo sapiens
catatttgccaataaag

SEQ ID NO: 6018268 - DNA, 12 bp, Homo sapiens
catatttgctaa

SEQ ID NO: 6018269 - DNA, 12 bp, Homo sapiens
catatttggaag

SEQ ID NO: 6018270 - DNA, 13 bp, Homo sapiens
catatttgtaaaa

SEQ ID NO: 6018271 - DNA, 21 bp, Homo sapiens
catatttgtactttctgttaa

SEQ ID NO: 6018272 - DNA, 16 bp, Homo sapiens
catatttgtatgtttt

SEQ ID NO: 6018273 - DNA, 17 bp, Homo sapiens
catatttgtatgttttt

SEQ ID NO: 6018274 - DNA, 19 bp, Homo sapiens
catatttgtgccgtaatta

SEQ ID NO: 6018275 - DNA, 21 bp, Homo sapiens
catatttgttaaatatttaca

SEQ ID NO: 6018276 - DNA, 23 bp, Homo sapiens
catatttgtttatggtaaaaaat

SEQ ID NO: 6018277 - DNA, 21 bp, Homo sapiens
catattttaaaaaatcaaaag

SEQ ID NO: 6018278 - DNA, 16 bp, Homo sapiens
catattttatagaact

SEQ ID NO: 6018279 - DNA, 23 bp, Homo sapiens
catattttattactgtttattac

SEQ ID NO: 6018280 - DNA, 17 bp, Homo sapiens
catattttattctttta

SEQ ID NO: 6018281 - DNA, 21 bp, Homo sapiens
catattttattgtattttgat

SEQ ID NO: 6018282 - DNA, 13 bp, Homo sapiens
catattttcacag

SEQ ID NO: 6018283 - DNA, 16 bp, Homo sapiens
catattttcctttaga

SEQ ID NO: 6018284 - DNA, 17 bp, Homo sapiens
catattttcttactttt

SEQ ID NO: 6018285 - DNA, 19 bp, Homo sapiens
catattttcttacttttat

SEQ ID NO: 6018286 - DNA, 13 bp, Homo sapiens
catattttgtata

SEQ ID NO: 6018287 - DNA, 23 bp, Homo sapiens
catattttgttatagttcatagt

SEQ ID NO: 6018288 - DNA, 13 bp, Homo sapiens
catatttttacaa

SEQ ID NO: 6018289 - DNA, 17 bp, Homo sapiens
catatttttagatacag

SEQ ID NO: 6018290 - DNA, 14 bp, Homo sapiens
catatttttatact

SEQ ID NO: 6018291 - DNA, 15 bp, Homo sapiens
catatttttatactt

SEQ ID NO: 6018292 - DNA, 23 bp, Homo sapiens
catatttttatactttattgaaa

SEQ ID NO: 6018293 - DNA, 14 bp, Homo sapiens
catatttttcaaaa

SEQ ID NO: 6018294 - DNA, 18 bp, Homo sapiens
catatttttcacatatct

SEQ ID NO: 6018295 - DNA, 14 bp, Homo sapiens
catatttttgtaaa

SEQ ID NO: 6018296 - DNA, 13 bp, Homo sapiens
catattttttgta

SEQ ID NO: 6018297 - DNA, 15 bp, Homo sapiens
catatttttttcctt

SEQ ID NO: 6018298 - DNA, 18 bp, Homo sapiens
catatttttttctgtaaa

SEQ ID NO: 6018299 - DNA, 21 bp, Homo sapiens
catcaaaaaaggcagttacca

SEQ ID NO: 6018300 - DNA, 12 bp, Homo sapiens
catcaaaaagag

SEQ ID NO: 6018301 - DNA, 16 bp, Homo sapiens
catcaaaaagagtctt

SEQ ID NO: 6018302 - DNA, 16 bp, Homo sapiens
catcaaaagacaattc

SEQ ID NO: 6018303 - DNA, 21 bp, Homo sapiens
catcaaaatatttcagtgaat

SEQ ID NO: 6018304 - DNA, 15 bp, Homo sapiens
catcaaaatcatgga

SEQ ID NO: 6018305 - DNA, 19 bp, Homo sapiens
catcaaaatgagtcaggca

SEQ ID NO: 6018306 - DNA, 15 bp, Homo sapiens
catcaaaatgctttt

SEQ ID NO: 6018307 - DNA, 18 bp, Homo sapiens
catcaaacaaatcatttt

SEQ ID NO: 6018308 - DNA, 12 bp, Homo sapiens
catcaaacatga

SEQ ID NO: 6018309 - DNA, 18 bp, Homo sapiens
catcaaacatgaaaacat

SEQ ID NO: 6018310 - DNA, 19 bp, Homo sapiens
catcaaagactccgagaag

SEQ ID NO: 6018311 - DNA, 20 bp, Homo sapiens
catcaaagatgagaagccaa

SEQ ID NO: 6018312 - DNA, 22 bp, Homo sapiens
catcaaagtggggtacagtaaa

SEQ ID NO: 6018313 - DNA, 19 bp, Homo sapiens
catcaaagtggtaaatact

SEQ ID NO: 6018314 - DNA, 15 bp, Homo sapiens
catcaaagtgtttaa

SEQ ID NO: 6018315 - DNA, 16 bp, Homo sapiens
catcaaagtgtttaat

SEQ ID NO: 6018316 - DNA, 16 bp, Homo sapiens
catcaaataaaccttg

SEQ ID NO: 6018317 - DNA, 13 bp, Homo sapiens
catcaaataaatt

SEQ ID NO: 6018318 - DNA, 16 bp, Homo sapiens
catcaaataaatttct

SEQ ID NO: 6018319 - DNA, 15 bp, Homo sapiens
catcaaataatacat

SEQ ID NO: 6018320 - DNA, 19 bp, Homo sapiens
catcaaataatacatcttt

SEQ ID NO: 6018321 - DNA, 13 bp, Homo sapiens
catcaaatgcatg

SEQ ID NO: 6018322 - DNA, 17 bp, Homo sapiens
catcaaatggaagacac

SEQ ID NO: 6018323 - DNA, 19 bp, Homo sapiens
catcaaatggaagacacat

SEQ ID NO: 6018324 - DNA, 15 bp, Homo sapiens
catcaacaaaaattg

SEQ ID NO: 6018325 - DNA, 22 bp, Homo sapiens
catcaacaatgattaatcagct

SEQ ID NO: 6018326 - DNA, 14 bp, Homo sapiens
catcaacatcttgg

SEQ ID NO: 6018327 - DNA, 23 bp, Homo sapiens
catcaacatggcaattgcactca

SEQ ID NO: 6018328 - DNA, 16 bp, Homo sapiens
catcaacattccaggg

SEQ ID NO: 6018329 - DNA, 16 bp, Homo sapiens
catcaaccaccatgga

SEQ ID NO: 6018330 - DNA, 15 bp, Homo sapiens
catcaaccaggaaga

SEQ ID NO: 6018331 - DNA, 13 bp, Homo sapiens
catcaacctagga

SEQ ID NO: 6018332 - DNA, 22 bp, Homo sapiens
catcaacctaggagcagtgggc

SEQ ID NO: 6018333 - DNA, 22 bp, Homo sapiens
catcaactaaagttgtacttta

SEQ ID NO: 6018334 - DNA, 23 bp, Homo sapiens
catcaactaaagttgtactttaa

SEQ ID NO: 6018335 - DNA, 12 bp, Homo sapiens
catcaactgaat

SEQ ID NO: 6018336 - DNA, 16 bp, Homo sapiens
catcaacttaaagtga

SEQ ID NO: 6018337 - DNA, 13 bp, Homo sapiens
catcaagaaaaca

SEQ ID NO: 6018338 - DNA, 22 bp, Homo sapiens
catcaagaaacattcagaccag

SEQ ID NO: 6018339 - DNA, 19 bp, Homo sapiens
catcaagaactattgtgtt

SEQ ID NO: 6018340 - DNA, 18 bp, Homo sapiens
catcaagaatgaggatat

SEQ ID NO: 6018341 - DNA, 18 bp, Homo sapiens
catcaagactatctacaa

SEQ ID NO: 6018342 - DNA, 22 bp, Homo sapiens
catcaagactatctacaaaaat

SEQ ID NO: 6018343 - DNA, 15 bp, Homo sapiens
catcaagactggaag

SEQ ID NO: 6018344 - DNA, 16 bp, Homo sapiens
catcaagactggaagg

SEQ ID NO: 6018345 - DNA, 22 bp, Homo sapiens
catcaagactttgctaaagaca

SEQ ID NO: 6018346 - DNA, 16 bp, Homo sapiens
catcaagatacacttg

SEQ ID NO: 6018347 - DNA, 18 bp, Homo sapiens
catcaagatacacttgta

SEQ ID NO: 6018348 - DNA, 21 bp, Homo sapiens
catcaagcacagaaggaggag

SEQ ID NO: 6018349 - DNA, 18 bp, Homo sapiens
catcaagcaggaattatg

SEQ ID NO: 6018350 - DNA, 20 bp, Homo sapiens
catcaaggacacgggcctgt

SEQ ID NO: 6018351 - DNA, 21 bp, Homo sapiens
catcaaggacacgggcctgtc

SEQ ID NO: 6018352 - DNA, 16 bp, Homo sapiens
catcaaggcactgcct

SEQ ID NO: 6018353 - DNA, 14 bp, Homo sapiens
catcaagtccatct

SEQ ID NO: 6018354 - DNA, 13 bp, Homo sapiens
catcaagtgtaat

SEQ ID NO: 6018355 - DNA, 14 bp, Homo sapiens
catcaagtgtaatt

SEQ ID NO: 6018356 - DNA, 17 bp, Homo sapiens
catcaagttctccccag

SEQ ID NO: 6018357 - DNA, 19 bp, Homo sapiens
catcaataaatgctctatt

SEQ ID NO: 6018358 - DNA, 19 bp, Homo sapiens
catcaataggcaaaagtgt

SEQ ID NO: 6018359 - DNA, 23 bp, Homo sapiens
catcaatagtgtcctatgcaata

SEQ ID NO: 6018360 - DNA, 19 bp, Homo sapiens
catcaatattgtcattcct

SEQ ID NO: 6018361 - DNA, 14 bp, Homo sapiens
catcaatcattgta

SEQ ID NO: 6018362 - DNA, 15 bp, Homo sapiens
catcaatcattgtac

SEQ ID NO: 6018363 - DNA, 16 bp, Homo sapiens
catcaatcattgtaca

SEQ ID NO: 6018364 - DNA, 20 bp, Homo sapiens
catcaatcattgtacagttt

SEQ ID NO: 6018365 - DNA, 12 bp, Homo sapiens
catcaatcttgt

SEQ ID NO: 6018366 - DNA, 19 bp, Homo sapiens
catcaatcttgttactgct

SEQ ID NO: 6018367 - DNA, 22 bp, Homo sapiens
catcaatgataatgctaatttt

SEQ ID NO: 6018368 - DNA, 13 bp, Homo sapiens
catcaatgcagtt

SEQ ID NO: 6018369 - DNA, 13 bp, Homo sapiens
catcaatggcttt

SEQ ID NO: 6018370 - DNA, 23 bp, Homo sapiens
catcaatggctttgtacttgtga

SEQ ID NO: 6018371 - DNA, 20 bp, Homo sapiens
catcaatgggattttctagt

SEQ ID NO: 6018372 - DNA, 17 bp, Homo sapiens
catcaatgtgacattta

SEQ ID NO: 6018373 - DNA, 17 bp, Homo sapiens
catcaattaattgattc

SEQ ID NO: 6018374 - DNA, 16 bp, Homo sapiens
catcaattctctatca

SEQ ID NO: 6018375 - DNA, 18 bp, Homo sapiens
catcaattgggttttgat

SEQ ID NO: 6018376 - DNA, 15 bp, Homo sapiens
catcaatttaaaaag

SEQ ID NO: 6018377 - DNA, 16 bp, Homo sapiens
catcaatttgtaattt

SEQ ID NO: 6018378 - DNA, 22 bp, Homo sapiens
catcaatttgtaattttagtat

SEQ ID NO: 6018379 - DNA, 18 bp, Homo sapiens
catcaattttaacatttg

SEQ ID NO: 6018380 - DNA, 18 bp, Homo sapiens
catcaatttttatacata

SEQ ID NO: 6018381 - DNA, 21 bp, Homo sapiens
catcaatttttatacatatca

SEQ ID NO: 6018382 - DNA, 15 bp, Homo sapiens
catcacaaatggcta

SEQ ID NO: 6018383 - DNA, 14 bp, Homo sapiens
catcacaagaacac

SEQ ID NO: 6018384 - DNA, 11 bp, Homo sapiens
catcacacaca

SEQ ID NO: 6018385 - DNA, 12 bp, Homo sapiens
catcacacacat

SEQ ID NO: 6018386 - DNA, 20 bp, Homo sapiens
catcacacacatggaaaccc

SEQ ID NO: 6018387 - DNA, 15 bp, Homo sapiens
catcacacctgccct

SEQ ID NO: 6018388 - DNA, 23 bp, Homo sapiens
catcacactcaaggacaggagcc

SEQ ID NO: 6018389 - DNA, 19 bp, Homo sapiens
catcacactgggtggtggc

SEQ ID NO: 6018390 - DNA, 14 bp, Homo sapiens
catcacacttatat

SEQ ID NO: 6018391 - DNA, 17 bp, Homo sapiens
catcacagaccccagct

SEQ ID NO: 6018392 - DNA, 13 bp, Homo sapiens
catcacagcagaa

SEQ ID NO: 6018393 - DNA, 17 bp, Homo sapiens
catcacagcagaatgaa

SEQ ID NO: 6018394 - DNA, 18 bp, Homo sapiens
catcacagcagaatgaag

SEQ ID NO: 6018395 - DNA, 14 bp, Homo sapiens
catcacagcagcct

SEQ ID NO: 6018396 - DNA, 15 bp, Homo sapiens
catcacagcatgtgc

SEQ ID NO: 6018397 - DNA, 17 bp, Homo sapiens
catcacagcccagcccg

SEQ ID NO: 6018398 - DNA, 13 bp, Homo sapiens
catcacagcttgt

SEQ ID NO: 6018399 - DNA, 20 bp, Homo sapiens
catcacaggatgccagcccc

SEQ ID NO: 6018400 - DNA, 14 bp, Homo sapiens
catcacagggtggg

SEQ ID NO: 6018401 - DNA, 22 bp, Homo sapiens
catcacagggttgggcccagat

SEQ ID NO: 6018402 - DNA, 17 bp, Homo sapiens
catcacagtgggaagaa

SEQ ID NO: 6018403 - DNA, 17 bp, Homo sapiens
catcacatctgcacact

SEQ ID NO: 6018404 - DNA, 21 bp, Homo sapiens
catcacatctgcacactctct

SEQ ID NO: 6018405 - DNA, 24 bp, Homo sapiens
catcacatggcatgttttgtcatt

SEQ ID NO: 6018406 - DNA, 22 bp, Homo sapiens
catcacattccagtctgaagtg

SEQ ID NO: 6018407 - DNA, 11 bp, Homo sapiens
catcacattta

SEQ ID NO: 6018408 - DNA, 13 bp, Homo sapiens
catcaccagagtc

SEQ ID NO: 6018409 - DNA, 13 bp, Homo sapiens
catcaccaggtgc

SEQ ID NO: 6018410 - DNA, 21 bp, Homo sapiens
catcaccaggtgcatctgcag

SEQ ID NO: 6018411 - DNA, 22 bp, Homo sapiens
catcaccaggtgcatctgcagg

SEQ ID NO: 6018412 - DNA, 14 bp, Homo sapiens
catcaccagtgcca

SEQ ID NO: 6018413 - DNA, 22 bp, Homo sapiens
catcaccagtgccacgtcatga

SEQ ID NO: 6018414 - DNA, 14 bp, Homo sapiens
catcaccatgcatg

SEQ ID NO: 6018415 - DNA, 20 bp, Homo sapiens
catcaccatttcttggcatt

SEQ ID NO: 6018416 - DNA, 14 bp, Homo sapiens
catcaccatttggt

SEQ ID NO: 6018417 - DNA, 13 bp, Homo sapiens
catcacccaagcc

SEQ ID NO: 6018418 - DNA, 18 bp, Homo sapiens
catcacccaggctggagt

SEQ ID NO: 6018419 - DNA, 15 bp, Homo sapiens
catcacccagtcctg

SEQ ID NO: 6018420 - DNA, 18 bp, Homo sapiens
catcacccagtcctggcc

SEQ ID NO: 6018421 - DNA, 19 bp, Homo sapiens
catcacccagtcctggcca

SEQ ID NO: 6018422 - DNA, 20 bp, Homo sapiens
cagcctgggtcacagagtga

SEQ ID NO: 6018423 - DNA, 22 bp, Homo sapiens
cagcctgggtgacagagcaaga

SEQ ID NO: 6018424 - DNA, 18 bp, Homo sapiens
cagcctggtagaattggg

SEQ ID NO: 6018425 - DNA, 20 bp, Homo sapiens
cagcctggtcaacatggtga

SEQ ID NO: 6018426 - DNA, 23 bp, Homo sapiens
cagcctggtccatgcagggggct

SEQ ID NO: 6018427 - DNA, 17 bp, Homo sapiens
cagcctggtggcccagc

SEQ ID NO: 6018428 - DNA, 15 bp, Homo sapiens
cagcctggtgggcct

SEQ ID NO: 6018429 - DNA, 17 bp, Homo sapiens
cagcctggtgggcctcc

SEQ ID NO: 6018430 - DNA, 15 bp, Homo sapiens
cagcctggttccctc

SEQ ID NO: 6018431 - DNA, 17 bp, Homo sapiens
cagcctggttccctctt

SEQ ID NO: 6018432 - DNA, 20 bp, Homo sapiens
cagcctggttccctctttcc

SEQ ID NO: 6018433 - DNA, 16 bp, Homo sapiens
cagcctggttggcagc

SEQ ID NO: 6018434 - DNA, 16 bp, Homo sapiens
cagcctggtttctggg

SEQ ID NO: 6018435 - DNA, 20 bp, Homo sapiens
cagcctgtagctcccctgct

SEQ ID NO: 6018436 - DNA, 15 bp, Homo sapiens
cagcctgtatgtggt

SEQ ID NO: 6018437 - DNA, 17 bp, Homo sapiens
cagcctgtcagatccag

SEQ ID NO: 6018438 - DNA, 19 bp, Homo sapiens
cagcctgtcccactggctc

SEQ ID NO: 6018439 - DNA, 22 bp, Homo sapiens
cagcctgtcccactggctcctc

SEQ ID NO: 6018440 - DNA, 22 bp, Homo sapiens
cagcctgtcccatggacactcc

SEQ ID NO: 6018441 - DNA, 19 bp, Homo sapiens
cagcctgtcggccacaccc

SEQ ID NO: 6018442 - DNA, 20 bp, Homo sapiens
cagcctgtcgtgtccagcct

SEQ ID NO: 6018443 - DNA, 18 bp, Homo sapiens
cagcctgtctcgggctga

SEQ ID NO: 6018444 - DNA, 15 bp, Homo sapiens
cagcctgtctcttcc

SEQ ID NO: 6018445 - DNA, 16 bp, Homo sapiens
cagcctgtctcttcca

SEQ ID NO: 6018446 - DNA, 23 bp, Homo sapiens
cagcctgtcttcagatcctgctg

SEQ ID NO: 6018447 - DNA, 21 bp, Homo sapiens
cagcctgtgagggagtgcaga

SEQ ID NO: 6018448 - DNA, 19 bp, Homo sapiens
cagcctgtgcctgcctttg

SEQ ID NO: 6018449 - DNA, 12 bp, Homo sapiens
cagcctgtgctg

SEQ ID NO: 6018450 - DNA, 16 bp, Homo sapiens
cagcctgtgctgtggc

SEQ ID NO: 6018451 - DNA, 21 bp, Homo sapiens
cagcctgtggcatctttgcct

SEQ ID NO: 6018452 - DNA, 16 bp, Homo sapiens
cagcctgtggcctcag

SEQ ID NO: 6018453 - DNA, 12 bp, Homo sapiens
cagcctgtggcg

SEQ ID NO: 6018454 - DNA, 18 bp, Homo sapiens
cagcctgtggcggtgcct

SEQ ID NO: 6018455 - DNA, 19 bp, Homo sapiens
cagcctgtggcggtgcctg

SEQ ID NO: 6018456 - DNA, 22 bp, Homo sapiens
cagcctgtggcggtgcctgggt

SEQ ID NO: 6018457 - DNA, 19 bp, Homo sapiens
cagcctgtggttacagtgc

SEQ ID NO: 6018458 - DNA, 14 bp, Homo sapiens
cagcctgtgtcttt

SEQ ID NO: 6018459 - DNA, 23 bp, Homo sapiens
cagcctgtgtgcagtggagctgg

SEQ ID NO: 6018460 - DNA, 23 bp, Homo sapiens
cagcctgtttctatcctgtttaa

SEQ ID NO: 6018461 - DNA, 20 bp, Homo sapiens
cagcctgtttgggaggctgg

SEQ ID NO: 6018462 - DNA, 16 bp, Homo sapiens
cagccttagcatcccc

SEQ ID NO: 6018463 - DNA, 21 bp, Homo sapiens
cagccttagcatcccctgtga

SEQ ID NO: 6018464 - DNA, 21 bp, Homo sapiens
cagccttagctctcccaactc

SEQ ID NO: 6018465 - DNA, 18 bp, Homo sapiens
cagccttagctgccagtg

SEQ ID NO: 6018466 - DNA, 15 bp, Homo sapiens
cagccttatgtgtta

SEQ ID NO: 6018467 - DNA, 20 bp, Homo sapiens
cagccttcaatcaacatctc

SEQ ID NO: 6018468 - DNA, 21 bp, Homo sapiens
cagccttcaatcaacatctct

SEQ ID NO: 6018469 - DNA, 22 bp, Homo sapiens
cagccttcaatcaacatctctt

SEQ ID NO: 6018470 - DNA, 18 bp, Homo sapiens
cagccttcacttttctga

SEQ ID NO: 6018471 - DNA, 18 bp, Homo sapiens
cagccttcagcagcagct

SEQ ID NO: 6018472 - DNA, 20 bp, Homo sapiens
cagccttcagcagcagctca

SEQ ID NO: 6018473 - DNA, 24 bp, Homo sapiens
cagccttcataggcggtcatgtgt

SEQ ID NO: 6018474 - DNA, 23 bp, Homo sapiens
cagccttcatcagaactcttcct

SEQ ID NO: 6018475 - DNA, 18 bp, Homo sapiens
cagccttccacctccaag

SEQ ID NO: 6018476 - DNA, 14 bp, Homo sapiens
cagccttccccctc

SEQ ID NO: 6018477 - DNA, 20 bp, Homo sapiens
cagccttccccctcccaggg

SEQ ID NO: 6018478 - DNA, 21 bp, Homo sapiens
cagccttccccctcccagggc

SEQ ID NO: 6018479 - DNA, 16 bp, Homo sapiens
cagccttccccttgcc

SEQ ID NO: 6018480 - DNA, 21 bp, Homo sapiens
cagccttcccttcttttcctg

SEQ ID NO: 6018481 - DNA, 15 bp, Homo sapiens
cagccttcctctgca

SEQ ID NO: 6018482 - DNA, 18 bp, Homo sapiens
cagccttcctctgcagct

SEQ ID NO: 6018483 - DNA, 20 bp, Homo sapiens
cagccttcctctgcagctga

SEQ ID NO: 6018484 - DNA, 18 bp, Homo sapiens
cagccttcgtgtggctcc

SEQ ID NO: 6018485 - DNA, 22 bp, Homo sapiens
cagccttcgtgtggctcctggt

SEQ ID NO: 6018486 - DNA, 23 bp, Homo sapiens
cagccttcgtgtggctcctggta

SEQ ID NO: 6018487 - DNA, 23 bp, Homo sapiens
cagccttctccatatctccatgg

SEQ ID NO: 6018488 - DNA, 18 bp, Homo sapiens
cagccttctcctcccaag

SEQ ID NO: 6018489 - DNA, 15 bp, Homo sapiens
cagccttctcctgtc

SEQ ID NO: 6018490 - DNA, 17 bp, Homo sapiens
cagccttctctctctgg

SEQ ID NO: 6018491 - DNA, 21 bp, Homo sapiens
cagccttctttgcttgcctct

SEQ ID NO: 6018492 - DNA, 18 bp, Homo sapiens
cagccttctttttctgga

SEQ ID NO: 6018493 - DNA, 21 bp, Homo sapiens
cagccttgaactcctggcctc

SEQ ID NO: 6018494 - DNA, 18 bp, Homo sapiens
cagccttgaactctgggc

SEQ ID NO: 6018495 - DNA, 22 bp, Homo sapiens
cagccttgaccattctccacct

SEQ ID NO: 6018496 - DNA, 24 bp, Homo sapiens
cagccttgaccattctccacctgc

SEQ ID NO: 6018497 - DNA, 18 bp, Homo sapiens
cagccttgactatgtcta

SEQ ID NO: 6018498 - DNA, 18 bp, Homo sapiens
cagccttgagccctggct

SEQ ID NO: 6018499 - DNA, 11 bp, Homo sapiens
cagccttgcac

SEQ ID NO: 6018500 - DNA, 14 bp, Homo sapiens
cagccttgcacacc

SEQ ID NO: 6018501 - DNA, 18 bp, Homo sapiens
cagccttgcacacccact

SEQ ID NO: 6018502 - DNA, 21 bp, Homo sapiens
cagccttgcacacccactgcc

SEQ ID NO: 6018503 - DNA, 23 bp, Homo sapiens
cagccttgcacacccactgcccc

SEQ ID NO: 6018504 - DNA, 22 bp, Homo sapiens
cagccttgcactgtgggggctg

SEQ ID NO: 6018505 - DNA, 21 bp, Homo sapiens
cagccttgcagcggctcctgc

SEQ ID NO: 6018506 - DNA, 22 bp, Homo sapiens
cagccttgcagcggctcctgca

SEQ ID NO: 6018507 - DNA, 16 bp, Homo sapiens
cagccttgccagagat

SEQ ID NO: 6018508 - DNA, 16 bp, Homo sapiens
cagccttgcccattct

SEQ ID NO: 6018509 - DNA, 17 bp, Homo sapiens
cagccttgcgctgtccc

SEQ ID NO: 6018510 - DNA, 22 bp, Homo sapiens
cagccttgcgctgtcccaggca

SEQ ID NO: 6018511 - DNA, 21 bp, Homo sapiens
cagccttgctacttgaaggta

SEQ ID NO: 6018512 - DNA, 23 bp, Homo sapiens
cagccttgctacttgaaggtaca

SEQ ID NO: 6018513 - DNA, 11 bp, Homo sapiens
cagccttgctc

SEQ ID NO: 6018514 - DNA, 20 bp, Homo sapiens
cagccttgctctcttcaata

SEQ ID NO: 6018515 - DNA, 23 bp, Homo sapiens
cagccttgctctcttcaataaac

SEQ ID NO: 6018516 - DNA, 17 bp, Homo sapiens
cagccttgctgctctgc

SEQ ID NO: 6018517 - DNA, 14 bp, Homo sapiens
cagccttggaagca

SEQ ID NO: 6018518 - DNA, 13 bp, Homo sapiens
cagccttggctcc

SEQ ID NO: 6018519 - DNA, 14 bp, Homo sapiens
cagccttgggcctt

SEQ ID NO: 6018520 - DNA, 18 bp, Homo sapiens
cagccttgggcctttcag

SEQ ID NO: 6018521 - DNA, 12 bp, Homo sapiens
cagccttgggga

SEQ ID NO: 6018522 - DNA, 15 bp, Homo sapiens
cagccttgggggggc

SEQ ID NO: 6018523 - DNA, 18 bp, Homo sapiens
cagccttgggggggctgc

SEQ ID NO: 6018524 - DNA, 20 bp, Homo sapiens
cagccttgggggggctgcct

SEQ ID NO: 6018525 - DNA, 20 bp, Homo sapiens
cagccttggtgggggagcct

SEQ ID NO: 6018526 - DNA, 23 bp, Homo sapiens
cagccttggtgggggagcctctg

SEQ ID NO: 6018527 - DNA, 13 bp, Homo sapiens
cagcctttaagat

SEQ ID NO: 6018528 - DNA, 22 bp, Homo sapiens
cagcctttcacaggactctgca

SEQ ID NO: 6018529 - DNA, 15 bp, Homo sapiens
cagcctttccagcct

SEQ ID NO: 6018530 - DNA, 16 bp, Homo sapiens
cagcctttccagcctc

SEQ ID NO: 6018531 - DNA, 17 bp, Homo sapiens
cagcctttcgttctgct

SEQ ID NO: 6018532 - DNA, 22 bp, Homo sapiens
cagcctttctaaggctcagccc

SEQ ID NO: 6018533 - DNA, 18 bp, Homo sapiens
cagcctttctcccaggcc

SEQ ID NO: 6018534 - DNA, 20 bp, Homo sapiens
cagcctttctcccaggccag

SEQ ID NO: 6018535 - DNA, 20 bp, Homo sapiens
cagcctttctgaggacacca

SEQ ID NO: 6018536 - DNA, 23 bp, Homo sapiens
cagcctttctgtatcaagcccct

SEQ ID NO: 6018537 - DNA, 22 bp, Homo sapiens
cagcctttgatcaggtggggag

SEQ ID NO: 6018538 - DNA, 24 bp, Homo sapiens
cagcctttgcccaaaactgtcatc

SEQ ID NO: 6018539 - DNA, 16 bp, Homo sapiens
cagcctttgcgctctg

SEQ ID NO: 6018540 - DNA, 19 bp, Homo sapiens
cagcctttgcgctctgggt

SEQ ID NO: 6018541 - DNA, 18 bp, Homo sapiens
cagcctttgctccctccc

SEQ ID NO: 6018542 - DNA, 21 bp, Homo sapiens
cagcctttgggtcctgggcag

SEQ ID NO: 6018543 - DNA, 15 bp, Homo sapiens
cagcctttgttaacc

SEQ ID NO: 6018544 - DNA, 15 bp, Homo sapiens
cagcctttgttcccc

SEQ ID NO: 6018545 - DNA, 16 bp, Homo sapiens
cagcctttgttcccca

SEQ ID NO: 6018546 - DNA, 20 bp, Homo sapiens
cagcctttgttccccactgg

SEQ ID NO: 6018547 - DNA, 23 bp, Homo sapiens
cagcctttgttccccactggagc

SEQ ID NO: 6018548 - DNA, 15 bp, Homo sapiens
cagccttttcagcag

SEQ ID NO: 6018549 - DNA, 18 bp, Homo sapiens
cagccttttctggtccct

SEQ ID NO: 6018550 - DNA, 22 bp, Homo sapiens
cagccttttctggtccctcttc

SEQ ID NO: 6018551 - DNA, 23 bp, Homo sapiens
cagccttttgagagtaatttggg

SEQ ID NO: 6018552 - DNA, 19 bp, Homo sapiens
cagcctttttcaccatggc

SEQ ID NO: 6018553 - DNA, 21 bp, Homo sapiens
cagcctttttctggccttgac

SEQ ID NO: 6018554 - DNA, 18 bp, Homo sapiens
cagcgaaatggtaccaag

SEQ ID NO: 6018555 - DNA, 15 bp, Homo sapiens
cagcgaactctcaga

SEQ ID NO: 6018556 - DNA, 16 bp, Homo sapiens
cagcgaactctcagaa

SEQ ID NO: 6018557 - DNA, 21 bp, Homo sapiens
cagcgaactctcagaaataaa

SEQ ID NO: 6018558 - DNA, 22 bp, Homo sapiens
cagcgaactctcagaaataaat

SEQ ID NO: 6018559 - DNA, 14 bp, Homo sapiens
cagcgaagggagtg

SEQ ID NO: 6018560 - DNA, 16 bp, Homo sapiens
cagcgaagtagcttgc

SEQ ID NO: 6018561 - DNA, 18 bp, Homo sapiens
cagcgaagtagcttgctc

SEQ ID NO: 6018562 - DNA, 19 bp, Homo sapiens
cagcgaagtagcttgctcc

SEQ ID NO: 6018563 - DNA, 21 bp, Homo sapiens
cagcgaagtctcatgggaagc

SEQ ID NO: 6018564 - DNA, 22 bp, Homo sapiens
cagcgaagtctcatgggaagca

SEQ ID NO: 6018565 - DNA, 18 bp, Homo sapiens
cagcgaattcagaaagag

SEQ ID NO: 6018566 - DNA, 13 bp, Homo sapiens
cagcgacagcctg

SEQ ID NO: 6018567 - DNA, 19 bp, Homo sapiens
cagcgacatagcccatccc

SEQ ID NO: 6018568 - DNA, 16 bp, Homo sapiens
cagcgaccacccctgc

SEQ ID NO: 6018569 - DNA, 14 bp, Homo sapiens
cagcgaccccagga

SEQ ID NO: 6018570 - DNA, 13 bp, Homo sapiens
cagcgacccttgg

SEQ ID NO: 6018571 - DNA, 21 bp, Homo sapiens
cagcgacctctctgcctctct

SEQ ID NO: 6018572 - DNA, 18 bp, Homo sapiens
cagcgacgcggcccgcgg

SEQ ID NO: 6018573 - DNA, 18 bp, Homo sapiens
cagcgacgctcccctgag

SEQ ID NO: 6018574 - DNA, 15 bp, Homo sapiens
cagcgactggatgct

SEQ ID NO: 6018575 - DNA, 15 bp, Homo sapiens
cagcgagaaggagtg

SEQ ID NO: 6018576 - DNA, 23 bp, Homo sapiens
cagcgagacccttgcattagaaa

SEQ ID NO: 6018577 - DNA, 18 bp, Homo sapiens
cagcgagaggcagagaaa

SEQ ID NO: 6018578 - DNA, 21 bp, Homo sapiens
cagcgagataccccacctccc

SEQ ID NO: 6018579 - DNA, 15 bp, Homo sapiens
cagcgagcaccctca

SEQ ID NO: 6018580 - DNA, 13 bp, Homo sapiens
cagcgagccacag

SEQ ID NO: 6018581 - DNA, 13 bp, Homo sapiens
cagcgagccctgg

SEQ ID NO: 6018582 - DNA, 20 bp, Homo sapiens
cagcgagccctggtggcagt

SEQ ID NO: 6018583 - DNA, 13 bp, Homo sapiens
cagcgagcctgtg

SEQ ID NO: 6018584 - DNA, 22 bp, Homo sapiens
cagcgagcctgtgccttcctcc

SEQ ID NO: 6018585 - DNA, 20 bp, Homo sapiens
cagcgagcgcccagctcctg

SEQ ID NO: 6018586 - DNA, 22 bp, Homo sapiens
cagcgaggcgaggctgcctctg

SEQ ID NO: 6018587 - DNA, 15 bp, Homo sapiens
cagcgaggctgggct

SEQ ID NO: 6018588 - DNA, 15 bp, Homo sapiens
cagcgagggcagctg

SEQ ID NO: 6018589 - DNA, 16 bp, Homo sapiens
cagcgagggcagctgc

SEQ ID NO: 6018590 - DNA, 17 bp, Homo sapiens
cagcgagggcagctgct

SEQ ID NO: 6018591 - DNA, 18 bp, Homo sapiens
cagcgagggcagctgcta

SEQ ID NO: 6018592 - DNA, 12 bp, Homo sapiens
cagcgagtctgg

SEQ ID NO: 6018593 - DNA, 18 bp, Homo sapiens
cagcgataagctttcaat

SEQ ID NO: 6018594 - DNA, 18 bp, Homo sapiens
cagcgatataattttatt

SEQ ID NO: 6018595 - DNA, 16 bp, Homo sapiens
cagcgatggcaggcct

SEQ ID NO: 6018596 - DNA, 14 bp, Homo sapiens
catcacccctggtg

SEQ ID NO: 6018597 - DNA, 19 bp, Homo sapiens
catcacccctggtggctgc

SEQ ID NO: 6018598 - DNA, 14 bp, Homo sapiens
catcaccctcttcc

SEQ ID NO: 6018599 - DNA, 20 bp, Homo sapiens
catcacccttaccatgtgcc

SEQ ID NO: 6018600 - DNA, 16 bp, Homo sapiens
catcaccctttgcctt

SEQ ID NO: 6018601 - DNA, 21 bp, Homo sapiens
catcaccctttgccttagcag

SEQ ID NO: 6018602 - DNA, 18 bp, Homo sapiens
catcaccgattcttcctt

SEQ ID NO: 6018603 - DNA, 20 bp, Homo sapiens
catcaccgattcttccttgc

SEQ ID NO: 6018604 - DNA, 23 bp, Homo sapiens
catcaccgattcttccttgccac

SEQ ID NO: 6018605 - DNA, 11 bp, Homo sapiens
catcacctcac

SEQ ID NO: 6018606 - DNA, 23 bp, Homo sapiens
catcacctcaccaaggatcggac

SEQ ID NO: 6018607 - DNA, 17 bp, Homo sapiens
catcacctcagatggca

SEQ ID NO: 6018608 - DNA, 15 bp, Homo sapiens
catcacctcaggcca

SEQ ID NO: 6018609 - DNA, 13 bp, Homo sapiens
catcacctctgta

SEQ ID NO: 6018610 - DNA, 14 bp, Homo sapiens
catcacctctttgc

SEQ ID NO: 6018611 - DNA, 18 bp, Homo sapiens
catcacctgaaacactgg

SEQ ID NO: 6018612 - DNA, 21 bp, Homo sapiens
catcacctgaaacactggacc

SEQ ID NO: 6018613 - DNA, 22 bp, Homo sapiens
catcacctgaaacactggacct

SEQ ID NO: 6018614 - DNA, 14 bp, Homo sapiens
catcacctgcctgt

SEQ ID NO: 6018615 - DNA, 22 bp, Homo sapiens
catcaccttagaccaccaagcc

SEQ ID NO: 6018616 - DNA, 16 bp, Homo sapiens
catcaccttaggcagg

SEQ ID NO: 6018617 - DNA, 18 bp, Homo sapiens
catcaccttaggcaggga

SEQ ID NO: 6018618 - DNA, 20 bp, Homo sapiens
catcaccttaggcagggaag

SEQ ID NO: 6018619 - DNA, 21 bp, Homo sapiens
catcacctttttgacttttcc

SEQ ID NO: 6018620 - DNA, 22 bp, Homo sapiens
catcacctttttgacttttcca

SEQ ID NO: 6018621 - DNA, 23 bp, Homo sapiens
catcacggatggtgcatgggctc

SEQ ID NO: 6018622 - DNA, 23 bp, Homo sapiens
catcacgtaccccactgggccag

SEQ ID NO: 6018623 - DNA, 22 bp, Homo sapiens
catcactaaaccgataatgcat

SEQ ID NO: 6018624 - DNA, 15 bp, Homo sapiens
catcactacaaaaag

SEQ ID NO: 6018625 - DNA, 15 bp, Homo sapiens
catcactagtggcaa

SEQ ID NO: 6018626 - DNA, 18 bp, Homo sapiens
catcactatcaattttaa

SEQ ID NO: 6018627 - DNA, 21 bp, Homo sapiens
catcactatccatgcaccaaa

SEQ ID NO: 6018628 - DNA, 19 bp, Homo sapiens
catcactattcaaggatga

SEQ ID NO: 6018629 - DNA, 23 bp, Homo sapiens
catcactattgggcccccaggtc

SEQ ID NO: 6018630 - DNA, 17 bp, Homo sapiens
catcactcactcactcc

SEQ ID NO: 6018631 - DNA, 13 bp, Homo sapiens
catcactcagccc

SEQ ID NO: 6018632 - DNA, 18 bp, Homo sapiens
catcactcatggaacact

SEQ ID NO: 6018633 - DNA, 22 bp, Homo sapiens
catcactccctctccctcccta

SEQ ID NO: 6018634 - DNA, 20 bp, Homo sapiens
catcactcgcaggaccaagg

SEQ ID NO: 6018635 - DNA, 20 bp, Homo sapiens
catcactctaggttttacag

SEQ ID NO: 6018636 - DNA, 16 bp, Homo sapiens
catcactcttttaaga

SEQ ID NO: 6018637 - DNA, 17 bp, Homo sapiens
catcactgagtggcttg

SEQ ID NO: 6018638 - DNA, 17 bp, Homo sapiens
catcactgattccctct

SEQ ID NO: 6018639 - DNA, 18 bp, Homo sapiens
catcactgccttggcccc

SEQ ID NO: 6018640 - DNA, 17 bp, Homo sapiens
catcactgctgtccctc

SEQ ID NO: 6018641 - DNA, 18 bp, Homo sapiens
catcactgctgtccctcc

SEQ ID NO: 6018642 - DNA, 18 bp, Homo sapiens
catcactggactgcatgg

SEQ ID NO: 6018643 - DNA, 23 bp, Homo sapiens
catcactggtccaggtcttcagt

SEQ ID NO: 6018644 - DNA, 14 bp, Homo sapiens
catcactgtaaaga

SEQ ID NO: 6018645 - DNA, 13 bp, Homo sapiens
catcactgtggct

SEQ ID NO: 6018646 - DNA, 17 bp, Homo sapiens
catcactgtggctgtct

SEQ ID NO: 6018647 - DNA, 12 bp, Homo sapiens
catcactgtgtc

SEQ ID NO: 6018648 - DNA, 15 bp, Homo sapiens
catcactgtgtctca

SEQ ID NO: 6018649 - DNA, 14 bp, Homo sapiens
catcacttaaaaca

SEQ ID NO: 6018650 - DNA, 15 bp, Homo sapiens
catcacttcttccac

SEQ ID NO: 6018651 - DNA, 19 bp, Homo sapiens
catcacttcttccactgtg

SEQ ID NO: 6018652 - DNA, 23 bp, Homo sapiens
catcacttgaatcctagggcctg

SEQ ID NO: 6018653 - DNA, 18 bp, Homo sapiens
catcactttgtgaattaa

SEQ ID NO: 6018654 - DNA, 22 bp, Homo sapiens
catcagaaaacagggtccagga

SEQ ID NO: 6018655 - DNA, 23 bp, Homo sapiens
catcagaaaacagggtccaggaa

SEQ ID NO: 6018656 - DNA, 18 bp, Homo sapiens
catcagaaaataaaatat

SEQ ID NO: 6018657 - DNA, 22 bp, Homo sapiens
catcagaaaataaaatattcac

SEQ ID NO: 6018658 - DNA, 23 bp, Homo sapiens
catcagaaactgaattctggaca

SEQ ID NO: 6018659 - DNA, 20 bp, Homo sapiens
catcagaaaggaaaaacaaa

SEQ ID NO: 6018660 - DNA, 17 bp, Homo sapiens
catcagaaagggagggc

SEQ ID NO: 6018661 - DNA, 24 bp, Homo sapiens
catcagaaagggagggctctgagg

SEQ ID NO: 6018662 - DNA, 14 bp, Homo sapiens
catcagaaattttc

SEQ ID NO: 6018663 - DNA, 14 bp, Homo sapiens
catcagaacagctg

SEQ ID NO: 6018664 - DNA, 17 bp, Homo sapiens
catcagaacagctgttg

SEQ ID NO: 6018665 - DNA, 15 bp, Homo sapiens
catcagaactgaaat

SEQ ID NO: 6018666 - DNA, 21 bp, Homo sapiens
catcagaagtaactcccactc

SEQ ID NO: 6018667 - DNA, 14 bp, Homo sapiens
catcagaagtttgc

SEQ ID NO: 6018668 - DNA, 14 bp, Homo sapiens
catcagacagatgg

SEQ ID NO: 6018669 - DNA, 15 bp, Homo sapiens
catcagacattataa

SEQ ID NO: 6018670 - DNA, 22 bp, Homo sapiens
catcagacctgtcttccaagga

SEQ ID NO: 6018671 - DNA, 18 bp, Homo sapiens
catcagactctagaaaaa

SEQ ID NO: 6018672 - DNA, 21 bp, Homo sapiens
catcagagatgggaaaaccat

SEQ ID NO: 6018673 - DNA, 23 bp, Homo sapiens
catcagagatgggaaaaccattg

SEQ ID NO: 6018674 - DNA, 17 bp, Homo sapiens
catcagaggggagcagc

SEQ ID NO: 6018675 - DNA, 16 bp, Homo sapiens
catcagataacaactg

SEQ ID NO: 6018676 - DNA, 17 bp, Homo sapiens
catcagatatgcttact

SEQ ID NO: 6018677 - DNA, 18 bp, Homo sapiens
catcagattctgtgagac

SEQ ID NO: 6018678 - DNA, 13 bp, Homo sapiens
catcagatttctt

SEQ ID NO: 6018679 - DNA, 14 bp, Homo sapiens
catcagcaagacaa

SEQ ID NO: 6018680 - DNA, 13 bp, Homo sapiens
catcagcactgcc

SEQ ID NO: 6018681 - DNA, 22 bp, Homo sapiens
catcagcactttaccagaggca

SEQ ID NO: 6018682 - DNA, 11 bp, Homo sapiens
catcagcagga

SEQ ID NO: 6018683 - DNA, 13 bp, Homo sapiens
catcagcagtgat

SEQ ID NO: 6018684 - DNA, 23 bp, Homo sapiens
catcagcagtgattgaagtatct

SEQ ID NO: 6018685 - DNA, 17 bp, Homo sapiens
catcagcatacctttat

SEQ ID NO: 6018686 - DNA, 18 bp, Homo sapiens
catcagcatacctttatt

SEQ ID NO: 6018687 - DNA, 20 bp, Homo sapiens
catcagcatgttttctgctt

SEQ ID NO: 6018688 - DNA, 14 bp, Homo sapiens
catcagccagctgc

SEQ ID NO: 6018689 - DNA, 18 bp, Homo sapiens
catcagcccaatccctga

SEQ ID NO: 6018690 - DNA, 13 bp, Homo sapiens
catcagcccaggt

SEQ ID NO: 6018691 - DNA, 16 bp, Homo sapiens
catcagccccacagga

SEQ ID NO: 6018692 - DNA, 12 bp, Homo sapiens
catcagcccctg

SEQ ID NO: 6018693 - DNA, 17 bp, Homo sapiens
catcagcccctgctgct

SEQ ID NO: 6018694 - DNA, 13 bp, Homo sapiens
catcagcccctgg

SEQ ID NO: 6018695 - DNA, 19 bp, Homo sapiens
catcagcccctgggaacag

SEQ ID NO: 6018696 - DNA, 12 bp, Homo sapiens
catcagccctgc

SEQ ID NO: 6018697 - DNA, 14 bp, Homo sapiens
catcagccctgcta

SEQ ID NO: 6018698 - DNA, 13 bp, Homo sapiens
catcagcctgctt

SEQ ID NO: 6018699 - DNA, 15 bp, Homo sapiens
catcagcgtggcagt

SEQ ID NO: 6018700 - DNA, 14 bp, Homo sapiens
catcagctccagct

SEQ ID NO: 6018701 - DNA, 17 bp, Homo sapiens
catcagctcccaacgag

SEQ ID NO: 6018702 - DNA, 14 bp, Homo sapiens
catcagctctctgc

SEQ ID NO: 6018703 - DNA, 19 bp, Homo sapiens
catcagctctctgcaaaga

SEQ ID NO: 6018704 - DNA, 11 bp, Homo sapiens
catcagctctg

SEQ ID NO: 6018705 - DNA, 18 bp, Homo sapiens
catcagctctgccttgca

SEQ ID NO: 6018706 - DNA, 14 bp, Homo sapiens
catcagctgaattc

SEQ ID NO: 6018707 - DNA, 19 bp, Homo sapiens
catcagctgtaagaagaga

SEQ ID NO: 6018708 - DNA, 23 bp, Homo sapiens
catcagctttataataaactgtt

SEQ ID NO: 6018709 - DNA, 13 bp, Homo sapiens
catcagctttccc

SEQ ID NO: 6018710 - DNA, 14 bp, Homo sapiens
catcagctttccct

SEQ ID NO: 6018711 - DNA, 18 bp, Homo sapiens
catcagctttccctggct

SEQ ID NO: 6018712 - DNA, 22 bp, Homo sapiens
catcagctttccctggctcagg

SEQ ID NO: 6018713 - DNA, 18 bp, Homo sapiens
catcaggaagcctgtggt

SEQ ID NO: 6018714 - DNA, 15 bp, Homo sapiens
catcaggactttccc

SEQ ID NO: 6018715 - DNA, 13 bp, Homo sapiens
catcaggatgaac

SEQ ID NO: 6018716 - DNA, 19 bp, Homo sapiens
catcaggatgaacccagga

SEQ ID NO: 6018717 - DNA, 14 bp, Homo sapiens
catcaggcactggt

SEQ ID NO: 6018718 - DNA, 16 bp, Homo sapiens
catcaggcactggtgg

SEQ ID NO: 6018719 - DNA, 14 bp, Homo sapiens
catcaggccaggcc

SEQ ID NO: 6018720 - DNA, 21 bp, Homo sapiens
catcaggccaggccctctgcc

SEQ ID NO: 6018721 - DNA, 22 bp, Homo sapiens
catcaggccaggccctctgccc

SEQ ID NO: 6018722 - DNA, 22 bp, Homo sapiens
catcaggccgggtgcagtggct

SEQ ID NO: 6018723 - DNA, 17 bp, Homo sapiens
catcaggctgttattat

SEQ ID NO: 6018724 - DNA, 20 bp, Homo sapiens
catcaggctgttattatgaa

SEQ ID NO: 6018725 - DNA, 17 bp, Homo sapiens
catcaggcttggaatga

SEQ ID NO: 6018726 - DNA, 18 bp, Homo sapiens
catcagggacaggatgac

SEQ ID NO: 6018727 - DNA, 11 bp, Homo sapiens
catcagggagt

SEQ ID NO: 6018728 - DNA, 16 bp, Homo sapiens
catcagggatctcaga

SEQ ID NO: 6018729 - DNA, 16 bp, Homo sapiens
catcagggccctgccc

SEQ ID NO: 6018730 - DNA, 19 bp, Homo sapiens
catcagggccctgccccag

SEQ ID NO: 6018731 - DNA, 12 bp, Homo sapiens
catcagggcctg

SEQ ID NO: 6018732 - DNA, 15 bp, Homo sapiens
catcagggcctgggg

SEQ ID NO: 6018733 - DNA, 16 bp, Homo sapiens
catcagggcctggggc

SEQ ID NO: 6018734 - DNA, 21 bp, Homo sapiens
catcagggcctggggcctgag

SEQ ID NO: 6018735 - DNA, 22 bp, Homo sapiens
catcagggcctggggcctgaga

SEQ ID NO: 6018736 - DNA, 23 bp, Homo sapiens
catcagggcctggggcctgagag

SEQ ID NO: 6018737 - DNA, 20 bp, Homo sapiens
catcagggcggcctcccagg

SEQ ID NO: 6018738 - DNA, 21 bp, Homo sapiens
catcagggggaagaagcagag

SEQ ID NO: 6018739 - DNA, 19 bp, Homo sapiens
catcagggtaggctggagt

SEQ ID NO: 6018740 - DNA, 15 bp, Homo sapiens
catcaggtagctgtc

SEQ ID NO: 6018741 - DNA, 21 bp, Homo sapiens
catcaggtcaccgcgaggcct

SEQ ID NO: 6018742 - DNA, 19 bp, Homo sapiens
catcaggtcccccccaggt

SEQ ID NO: 6018743 - DNA, 13 bp, Homo sapiens
catcaggtgatcc

SEQ ID NO: 6018744 - DNA, 16 bp, Homo sapiens
catcaggtgtgctcag

SEQ ID NO: 6018745 - DNA, 23 bp, Homo sapiens
catcaggttaggcagtataaaga

SEQ ID NO: 6018746 - DNA, 17 bp, Homo sapiens
catcaggttccatcccg

SEQ ID NO: 6018747 - DNA, 16 bp, Homo sapiens
catcagtacttttctc

SEQ ID NO: 6018748 - DNA, 20 bp, Homo sapiens
catcagtattgaagcatttt

SEQ ID NO: 6018749 - DNA, 14 bp, Homo sapiens
catcagtcaacaga

SEQ ID NO: 6018750 - DNA, 17 bp, Homo sapiens
catcagtcaacagagag

SEQ ID NO: 6018751 - DNA, 23 bp, Homo sapiens
catcagtcaacagagaggggcag

SEQ ID NO: 6018752 - DNA, 22 bp, Homo sapiens
catcagtccacccccattgtga

SEQ ID NO: 6018753 - DNA, 17 bp, Homo sapiens
catcagtccctatgtat

SEQ ID NO: 6018754 - DNA, 14 bp, Homo sapiens
catcagtgacagac

SEQ ID NO: 6018755 - DNA, 16 bp, Homo sapiens
catcagtgacagactg

SEQ ID NO: 6018756 - DNA, 23 bp, Homo sapiens
catcagtgaggagggatgtgggt

SEQ ID NO: 6018757 - DNA, 12 bp, Homo sapiens
catcagtgccaa

SEQ ID NO: 6018758 - DNA, 15 bp, Homo sapiens
catcagtgccagccc

SEQ ID NO: 6018759 - DNA, 14 bp, Homo sapiens
catcagtggagtcc

SEQ ID NO: 6018760 - DNA, 17 bp, Homo sapiens
catcagtggagtccaga

SEQ ID NO: 6018761 - DNA, 21 bp, Homo sapiens
catcagtggatggcaggaggt

SEQ ID NO: 6018762 - DNA, 22 bp, Homo sapiens
catcagtgtacccccgcccagg

SEQ ID NO: 6018763 - DNA, 24 bp, Homo sapiens
catcagtgtacccccgcccaggct

SEQ ID NO: 6018764 - DNA, 20 bp, Homo sapiens
catcagtgtcattttctgtt

SEQ ID NO: 6018765 - DNA, 23 bp, Homo sapiens
catcagtgtctgtttcagaatct

SEQ ID NO: 6018766 - DNA, 17 bp, Homo sapiens
catcagtgttaaaaaat

SEQ ID NO: 6018767 - DNA, 18 bp, Homo sapiens
catcagtgttaaaaaatt

SEQ ID NO: 6018768 - DNA, 13 bp, Homo sapiens
catcagtgtttgt

SEQ ID NO: 6018769 - DNA, 23 bp, Homo sapiens
catcagttactggtttcagttga

SEQ ID NO: 6018770 - DNA, 15 bp, Homo sapiens
catcagttagagctg

SEQ ID NO: 6018771 - DNA, 20 bp, Homo sapiens
catcagttagagctgacaca

SEQ ID NO: 6018772 - DNA, 15 bp, Homo sapiens
catcagttattcatt

SEQ ID NO: 6018773 - DNA, 15 bp, Homo sapiens
catcagttcccccag

SEQ ID NO: 6018774 - DNA, 18 bp, Homo sapiens
cagcgatggcaggcctga

SEQ ID NO: 6018775 - DNA, 18 bp, Homo sapiens
cagcgatgtatgcagcta

SEQ ID NO: 6018776 - DNA, 20 bp, Homo sapiens
cagcgattattgatcaaaat

SEQ ID NO: 6018777 - DNA, 22 bp, Homo sapiens
cagcgattattgatcaaaatca

SEQ ID NO: 6018778 - DNA, 23 bp, Homo sapiens
cagcgattccctctcccaggccc

SEQ ID NO: 6018779 - DNA, 13 bp, Homo sapiens
cagcgcacagctg

SEQ ID NO: 6018780 - DNA, 15 bp, Homo sapiens
cagcgcacagctgct

SEQ ID NO: 6018781 - DNA, 13 bp, Homo sapiens
cagcgcagagtag

SEQ ID NO: 6018782 - DNA, 23 bp, Homo sapiens
cagcgcagagtagctgcttcctg

SEQ ID NO: 6018783 - DNA, 17 bp, Homo sapiens
cagcgcagccgccgggc

SEQ ID NO: 6018784 - DNA, 15 bp, Homo sapiens
cagcgcaggctgcag

SEQ ID NO: 6018785 - DNA, 19 bp, Homo sapiens
cagcgcaggctgcagagcc

SEQ ID NO: 6018786 - DNA, 22 bp, Homo sapiens
cagcgcaggctgcagagcccgg

SEQ ID NO: 6018787 - DNA, 14 bp, Homo sapiens
cagcgcagggctgg

SEQ ID NO: 6018788 - DNA, 24 bp, Homo sapiens
cagcgccaagtaaacagggtacct

SEQ ID NO: 6018789 - DNA, 24 bp, Homo sapiens
cagcgccaagtgcgtgccgtgtga

SEQ ID NO: 6018790 - DNA, 17 bp, Homo sapiens
cagcgccaagtggccac

SEQ ID NO: 6018791 - DNA, 16 bp, Homo sapiens
cagcgccacctggaag

SEQ ID NO: 6018792 - DNA, 14 bp, Homo sapiens
cagcgccagcctca

SEQ ID NO: 6018793 - DNA, 14 bp, Homo sapiens
cagcgccagcctgt

SEQ ID NO: 6018794 - DNA, 18 bp, Homo sapiens
cagcgccaggctgaccac

SEQ ID NO: 6018795 - DNA, 21 bp, Homo sapiens
cagcgccaggctgaccacagc

SEQ ID NO: 6018796 - DNA, 19 bp, Homo sapiens
cagcgccagggcccaggcc

SEQ ID NO: 6018797 - DNA, 16 bp, Homo sapiens
cagcgccagggctcag

SEQ ID NO: 6018798 - DNA, 14 bp, Homo sapiens
cagcgccatcctga

SEQ ID NO: 6018799 - DNA, 18 bp, Homo sapiens
cagcgcccaggcctgctg

SEQ ID NO: 6018800 - DNA, 19 bp, Homo sapiens
cagcgcccaggcctgctgg

SEQ ID NO: 6018801 - DNA, 20 bp, Homo sapiens
cagcgcccaggcctgctggc

SEQ ID NO: 6018802 - DNA, 14 bp, Homo sapiens
cagcgccccaccac

SEQ ID NO: 6018803 - DNA, 17 bp, Homo sapiens
cagcgcccccactcctc

SEQ ID NO: 6018804 - DNA, 20 bp, Homo sapiens
cagcgcccccactcctcctc

SEQ ID NO: 6018805 - DNA, 16 bp, Homo sapiens
cagcgcccccagagcc

SEQ ID NO: 6018806 - DNA, 14 bp, Homo sapiens
cagcgcccccaggc

SEQ ID NO: 6018807 - DNA, 20 bp, Homo sapiens
cagcgcccctcagcctctgc

SEQ ID NO: 6018808 - DNA, 21 bp, Homo sapiens
cagcgcccctcagcctctgcc

SEQ ID NO: 6018809 - DNA, 23 bp, Homo sapiens
cagcgcccctcagcctctgccac

SEQ ID NO: 6018810 - DNA, 18 bp, Homo sapiens
cagcgcccctctgcaccc

SEQ ID NO: 6018811 - DNA, 15 bp, Homo sapiens
cagcgcccctgctgt

SEQ ID NO: 6018812 - DNA, 16 bp, Homo sapiens
cagcgcccctgctgtc

SEQ ID NO: 6018813 - DNA, 23 bp, Homo sapiens
cagcgcccgaggccagggccgcc

SEQ ID NO: 6018814 - DNA, 21 bp, Homo sapiens
cagcgccctggagtcccctgg

SEQ ID NO: 6018815 - DNA, 12 bp, Homo sapiens
cagcgcccttcc

SEQ ID NO: 6018816 - DNA, 14 bp, Homo sapiens
cagcgcccttcctc

SEQ ID NO: 6018817 - DNA, 18 bp, Homo sapiens
cagcgcccttcctctcca

SEQ ID NO: 6018818 - DNA, 20 bp, Homo sapiens
cagcgcccttcctctccacc

SEQ ID NO: 6018819 - DNA, 20 bp, Homo sapiens
cagcgcctcaagggtagggt

SEQ ID NO: 6018820 - DNA, 13 bp, Homo sapiens
cagcgcctccacc

SEQ ID NO: 6018821 - DNA, 15 bp, Homo sapiens
cagcgcctccaccct

SEQ ID NO: 6018822 - DNA, 17 bp, Homo sapiens
cagcgcctccaccctgc

SEQ ID NO: 6018823 - DNA, 21 bp, Homo sapiens
cagcgcctccaccctgccctg

SEQ ID NO: 6018824 - DNA, 24 bp, Homo sapiens
cagcgcctccaccctgccctgctg

SEQ ID NO: 6018825 - DNA, 13 bp, Homo sapiens
cagcgcctcccgc

SEQ ID NO: 6018826 - DNA, 14 bp, Homo sapiens
cagcgcctcccgcc

SEQ ID NO: 6018827 - DNA, 13 bp, Homo sapiens
cagcgcctccctt

SEQ ID NO: 6018828 - DNA, 13 bp, Homo sapiens
cagcgcctcctgg

SEQ ID NO: 6018829 - DNA, 23 bp, Homo sapiens
cagcgcctcctggacctgaaggc

SEQ ID NO: 6018830 - DNA, 16 bp, Homo sapiens
cagcgcctcgccccag

SEQ ID NO: 6018831 - DNA, 22 bp, Homo sapiens
cagcgcctcgccccagccaagc

SEQ ID NO: 6018832 - DNA, 20 bp, Homo sapiens
cagcgcctgccctccctggg

SEQ ID NO: 6018833 - DNA, 13 bp, Homo sapiens
cagcgcctgtccc

SEQ ID NO: 6018834 - DNA, 18 bp, Homo sapiens
cagcgcctgtcccctcac

SEQ ID NO: 6018835 - DNA, 13 bp, Homo sapiens
cagcgcctttccc

SEQ ID NO: 6018836 - DNA, 17 bp, Homo sapiens
cagcgcgcaacgctctg

SEQ ID NO: 6018837 - DNA, 23 bp, Homo sapiens
cagcgcggacatcccctgctggc

SEQ ID NO: 6018838 - DNA, 17 bp, Homo sapiens
cagcgcggccagcgtcc

SEQ ID NO: 6018839 - DNA, 17 bp, Homo sapiens
cagcgcggccctcccga

SEQ ID NO: 6018840 - DNA, 23 bp, Homo sapiens
cagcgcggcttggccgccatccg

SEQ ID NO: 6018841 - DNA, 15 bp, Homo sapiens
cagcgctccctgtcg

SEQ ID NO: 6018842 - DNA, 23 bp, Homo sapiens
cagcgctcgatggacctcagcaa

SEQ ID NO: 6018843 - DNA, 16 bp, Homo sapiens
cagcgctcgccacgct

SEQ ID NO: 6018844 - DNA, 13 bp, Homo sapiens
cagcgctcgctga

SEQ ID NO: 6018845 - DNA, 16 bp, Homo sapiens
cagcgctcggcccgga

SEQ ID NO: 6018846 - DNA, 12 bp, Homo sapiens
cagcgctctgta

SEQ ID NO: 6018847 - DNA, 14 bp, Homo sapiens
cagcgctgaacaga

SEQ ID NO: 6018848 - DNA, 17 bp, Homo sapiens
cagcgctgagcatgggg

SEQ ID NO: 6018849 - DNA, 12 bp, Homo sapiens
cagcgctgccca

SEQ ID NO: 6018850 - DNA, 16 bp, Homo sapiens
cagcgctgcccacacc

SEQ ID NO: 6018851 - DNA, 16 bp, Homo sapiens
cagcgctggctccagg

SEQ ID NO: 6018852 - DNA, 22 bp, Homo sapiens
cagcgctgtatttacagacaca

SEQ ID NO: 6018853 - DNA, 21 bp, Homo sapiens
cagcgctgtcaggattgcgag

SEQ ID NO: 6018854 - DNA, 22 bp, Homo sapiens
cagcgcttagaaacatgttcct

SEQ ID NO: 6018855 - DNA, 16 bp, Homo sapiens
cagcgcttgaagcctg

SEQ ID NO: 6018856 - DNA, 16 bp, Homo sapiens
cagcgctttgggaggc

SEQ ID NO: 6018857 - DNA, 22 bp, Homo sapiens
cagcgctttgggaggccgaggc

SEQ ID NO: 6018858 - DNA, 17 bp, Homo sapiens
cagcggaaacaggtgtg

SEQ ID NO: 6018859 - DNA, 15 bp, Homo sapiens
cagcggagaggaccc

SEQ ID NO: 6018860 - DNA, 19 bp, Homo sapiens
cagcggaggagaccagctc

SEQ ID NO: 6018861 - DNA, 17 bp, Homo sapiens
cagcggagtctgtcctg

SEQ ID NO: 6018862 - DNA, 15 bp, Homo sapiens
cagcggattgctctg

SEQ ID NO: 6018863 - DNA, 21 bp, Homo sapiens
cagcggattgctctggagcag

SEQ ID NO: 6018864 - DNA, 22 bp, Homo sapiens
cagcggcagagcaattccaggc

SEQ ID NO: 6018865 - DNA, 22 bp, Homo sapiens
cagcggcagatgggcctgtgtg

SEQ ID NO: 6018866 - DNA, 15 bp, Homo sapiens
cagcggcagcagcag

SEQ ID NO: 6018867 - DNA, 20 bp, Homo sapiens
cagcggcagtgggcctgctg

SEQ ID NO: 6018868 - DNA, 22 bp, Homo sapiens
cagcggcatatacttgtttttg

SEQ ID NO: 6018869 - DNA, 14 bp, Homo sapiens
cagcggcatcaggc

SEQ ID NO: 6018870 - DNA, 17 bp, Homo sapiens
cagcggcccaagagccc

SEQ ID NO: 6018871 - DNA, 15 bp, Homo sapiens
cagcggcccagattg

SEQ ID NO: 6018872 - DNA, 14 bp, Homo sapiens
cagcggccccccgc

SEQ ID NO: 6018873 - DNA, 23 bp, Homo sapiens
cagcggccccgcacccctcctcc

SEQ ID NO: 6018874 - DNA, 19 bp, Homo sapiens
cagcggccccgcggagccc

SEQ ID NO: 6018875 - DNA, 20 bp, Homo sapiens
cagcggccccgcggagcccc

SEQ ID NO: 6018876 - DNA, 13 bp, Homo sapiens
cagcggcccctcc

SEQ ID NO: 6018877 - DNA, 16 bp, Homo sapiens
cagcggcccctcccac

SEQ ID NO: 6018878 - DNA, 17 bp, Homo sapiens
cagcggcccctcccaca

SEQ ID NO: 6018879 - DNA, 18 bp, Homo sapiens
cagcggcccctcccacac

SEQ ID NO: 6018880 - DNA, 14 bp, Homo sapiens
cagcggcccctgca

SEQ ID NO: 6018881 - DNA, 20 bp, Homo sapiens
cagcggcccctgcatcccct

SEQ ID NO: 6018882 - DNA, 20 bp, Homo sapiens
cagcggcccggcccacgcag

SEQ ID NO: 6018883 - DNA, 17 bp, Homo sapiens
cagcggccctcccaggc

SEQ ID NO: 6018884 - DNA, 14 bp, Homo sapiens
cagcggccctgtca

SEQ ID NO: 6018885 - DNA, 21 bp, Homo sapiens
cagcggccttgaagacagagc

SEQ ID NO: 6018886 - DNA, 14 bp, Homo sapiens
cagcggctccaact

SEQ ID NO: 6018887 - DNA, 17 bp, Homo sapiens
cagcggctccaactcct

SEQ ID NO: 6018888 - DNA, 12 bp, Homo sapiens
cagcggctcctg

SEQ ID NO: 6018889 - DNA, 13 bp, Homo sapiens
cagcggctctggt

SEQ ID NO: 6018890 - DNA, 15 bp, Homo sapiens
cagcggctcttcctg

SEQ ID NO: 6018891 - DNA, 14 bp, Homo sapiens
cagcggctgcctcc

SEQ ID NO: 6018892 - DNA, 16 bp, Homo sapiens
cagcggctggacttgg

SEQ ID NO: 6018893 - DNA, 14 bp, Homo sapiens
cagcggctgggtgg

SEQ ID NO: 6018894 - DNA, 17 bp, Homo sapiens
cagcggctggtgcaggg

SEQ ID NO: 6018895 - DNA, 20 bp, Homo sapiens
cagcggctggtgcagggcct

SEQ ID NO: 6018896 - DNA, 23 bp, Homo sapiens
cagcgggaatggcagctgccacg

SEQ ID NO: 6018897 - DNA, 19 bp, Homo sapiens
cagcgggagacctgtgcta

SEQ ID NO: 6018898 - DNA, 17 bp, Homo sapiens
cagcgggagccagtggt

SEQ ID NO: 6018899 - DNA, 18 bp, Homo sapiens
cagcgggagcctccctgc

SEQ ID NO: 6018900 - DNA, 20 bp, Homo sapiens
cagcgggagcctccctgcct

SEQ ID NO: 6018901 - DNA, 14 bp, Homo sapiens
cagcgggagtctcc

SEQ ID NO: 6018902 - DNA, 17 bp, Homo sapiens
cagcgggagtctcctca

SEQ ID NO: 6018903 - DNA, 12 bp, Homo sapiens
cagcgggcacag

SEQ ID NO: 6018904 - DNA, 17 bp, Homo sapiens
cagcgggcacagggcac

SEQ ID NO: 6018905 - DNA, 16 bp, Homo sapiens
cagcgggcagatgggc

SEQ ID NO: 6018906 - DNA, 20 bp, Homo sapiens
cagcgggcaggttctgcctg

SEQ ID NO: 6018907 - DNA, 12 bp, Homo sapiens
cagcgggccagg

SEQ ID NO: 6018908 - DNA, 13 bp, Homo sapiens
cagcgggccaggc

SEQ ID NO: 6018909 - DNA, 19 bp, Homo sapiens
cagcgggccaggcccgcac

SEQ ID NO: 6018910 - DNA, 14 bp, Homo sapiens
cagcgggcggaggg

SEQ ID NO: 6018911 - DNA, 22 bp, Homo sapiens
cagcgggctggcgggccttttt

SEQ ID NO: 6018912 - DNA, 16 bp, Homo sapiens
cagcgggctgtgcccg

SEQ ID NO: 6018913 - DNA, 18 bp, Homo sapiens
cagcggggacagctcctt

SEQ ID NO: 6018914 - DNA, 16 bp, Homo sapiens
cagcggggaggggagg

SEQ ID NO: 6018915 - DNA, 23 bp, Homo sapiens
cagcggggcctggcgggatgggc

SEQ ID NO: 6018916 - DNA, 19 bp, Homo sapiens
cagcggggcgaagcccagg

SEQ ID NO: 6018917 - DNA, 15 bp, Homo sapiens
cagcggggcttctgg

SEQ ID NO: 6018918 - DNA, 16 bp, Homo sapiens
cagcgggggccttgaa

SEQ ID NO: 6018919 - DNA, 18 bp, Homo sapiens
cagcgggggccttgaaga

SEQ ID NO: 6018920 - DNA, 15 bp, Homo sapiens
cagcgggtaaaaaga

SEQ ID NO: 6018921 - DNA, 16 bp, Homo sapiens
cagcgggtaaaaagag

SEQ ID NO: 6018922 - DNA, 20 bp, Homo sapiens
cagcggtccctgcagaagcc

SEQ ID NO: 6018923 - DNA, 12 bp, Homo sapiens
cagcggtgcagc

SEQ ID NO: 6018924 - DNA, 18 bp, Homo sapiens
cagcggtgccaacctctt

SEQ ID NO: 6018925 - DNA, 17 bp, Homo sapiens
cagcggtggaaggagcc

SEQ ID NO: 6018926 - DNA, 15 bp, Homo sapiens
cagcggtgggaagga

SEQ ID NO: 6018927 - DNA, 16 bp, Homo sapiens
cagcggtgggaaggaa

SEQ ID NO: 6018928 - DNA, 18 bp, Homo sapiens
cagcggtgtggaccgagg

SEQ ID NO: 6018929 - DNA, 21 bp, Homo sapiens
cagcggttcctgtgcagatgc

SEQ ID NO: 6018930 - DNA, 15 bp, Homo sapiens
cagcggttgaggaga

SEQ ID NO: 6018931 - DNA, 20 bp, Homo sapiens
cagcggttgccttttttatc

SEQ ID NO: 6018932 - DNA, 21 bp, Homo sapiens
cagcggtttccacttgtgggc

SEQ ID NO: 6018933 - DNA, 15 bp, Homo sapiens
cagcggtttcctggt

SEQ ID NO: 6018934 - DNA, 16 bp, Homo sapiens
cagcggtttcctggtg

SEQ ID NO: 6018935 - DNA, 15 bp, Homo sapiens
cagcgtaaaatggtg

SEQ ID NO: 6018936 - DNA, 15 bp, Homo sapiens
cagcgtactcatcat

SEQ ID NO: 6018937 - DNA, 17 bp, Homo sapiens
cagcgtagcctctccgg

SEQ ID NO: 6018938 - DNA, 21 bp, Homo sapiens
cagcgtatatataagaaagac

SEQ ID NO: 6018939 - DNA, 21 bp, Homo sapiens
cagcgtcagctgctccctggc

SEQ ID NO: 6018940 - DNA, 16 bp, Homo sapiens
cagcgtcaggcctacc

SEQ ID NO: 6018941 - DNA, 13 bp, Homo sapiens
cagcgtccctggc

SEQ ID NO: 6018942 - DNA, 14 bp, Homo sapiens
cagcgtccctggcg

SEQ ID NO: 6018943 - DNA, 22 bp, Homo sapiens
cagcgtccggggtggtggacag

SEQ ID NO: 6018944 - DNA, 19 bp, Homo sapiens
cagcgtcctcagcacccca

SEQ ID NO: 6018945 - DNA, 20 bp, Homo sapiens
cagcgtcctcagcaccccac

SEQ ID NO: 6018946 - DNA, 16 bp, Homo sapiens
cagcgtcctcctctgt

SEQ ID NO: 6018947 - DNA, 21 bp, Homo sapiens
cagcgtcctcgttcaaaacat

SEQ ID NO: 6018948 - DNA, 20 bp, Homo sapiens
cagcgtcctgggctcaaatg

SEQ ID NO: 6018949 - DNA, 22 bp, Homo sapiens
cagcgtctccccatgctgggct

SEQ ID NO: 6018950 - DNA, 16 bp, Homo sapiens
cagcgtctgagcggcc

SEQ ID NO: 6018951 - DNA, 19 bp, Homo sapiens
cagcgtctgagcggccgcc

SEQ ID NO: 6018952 - DNA, 12 bp, Homo sapiens
catcagtttgtt

SEQ ID NO: 6018953 - DNA, 19 bp, Homo sapiens
catcagttttgtttactca

SEQ ID NO: 6018954 - DNA, 12 bp, Homo sapiens
catcataaaata

SEQ ID NO: 6018955 - DNA, 20 bp, Homo sapiens
catcataaaataaagtatat

SEQ ID NO: 6018956 - DNA, 15 bp, Homo sapiens
catcataaaattttt

SEQ ID NO: 6018957 - DNA, 24 bp, Homo sapiens
catcataactggcttctgcttgtc

SEQ ID NO: 6018958 - DNA, 20 bp, Homo sapiens
catcataaggagttggtgta

SEQ ID NO: 6018959 - DNA, 21 bp, Homo sapiens
catcatacgcatggtcctgga

SEQ ID NO: 6018960 - DNA, 13 bp, Homo sapiens
catcatagaaact

SEQ ID NO: 6018961 - DNA, 22 bp, Homo sapiens
catcatagaggatgatgtaatt

SEQ ID NO: 6018962 - DNA, 23 bp, Homo sapiens
catcatagaggatgatgtaatta

SEQ ID NO: 6018963 - DNA, 22 bp, Homo sapiens
catcataggaagggaccaaggc

SEQ ID NO: 6018964 - DNA, 22 bp, Homo sapiens
catcataggctgacaccaagaa

SEQ ID NO: 6018965 - DNA, 23 bp, Homo sapiens
catcataggtaaggttttcaagg

SEQ ID NO: 6018966 - DNA, 22 bp, Homo sapiens
catcatataaaaagcagcagag

SEQ ID NO: 6018967 - DNA, 18 bp, Homo sapiens
catcatatacaaatgttt

SEQ ID NO: 6018968 - DNA, 16 bp, Homo sapiens
catcatatcccctgtg

SEQ ID NO: 6018969 - DNA, 20 bp, Homo sapiens
catcatatcccctgtgccct

SEQ ID NO: 6018970 - DNA, 16 bp, Homo sapiens
catcatatgacatgcc

SEQ ID NO: 6018971 - DNA, 22 bp, Homo sapiens
catcatatgacatgccaccctc

SEQ ID NO: 6018972 - DNA, 13 bp, Homo sapiens
catcatatgcctg

SEQ ID NO: 6018973 - DNA, 21 bp, Homo sapiens
catcatatgttagatacacaa

SEQ ID NO: 6018974 - DNA, 22 bp, Homo sapiens
catcatattaaaaatatacaag

SEQ ID NO: 6018975 - DNA, 14 bp, Homo sapiens
catcatattataca

SEQ ID NO: 6018976 - DNA, 16 bp, Homo sapiens
catcatattgtatgta

SEQ ID NO: 6018977 - DNA, 21 bp, Homo sapiens
catcatcaccgattcttcctt

SEQ ID NO: 6018978 - DNA, 13 bp, Homo sapiens
catcatcactgta

SEQ ID NO: 6018979 - DNA, 16 bp, Homo sapiens
catcatcactgtaaag

SEQ ID NO: 6018980 - DNA, 14 bp, Homo sapiens
catcatcacttttt

SEQ ID NO: 6018981 - DNA, 20 bp, Homo sapiens
catcatcagacttgcggcca

SEQ ID NO: 6018982 - DNA, 21 bp, Homo sapiens
catcatcaggcttggaatgaa

SEQ ID NO: 6018983 - DNA, 15 bp, Homo sapiens
catcatcagggcctg

SEQ ID NO: 6018984 - DNA, 12 bp, Homo sapiens
catcatccaccc

SEQ ID NO: 6018985 - DNA, 22 bp, Homo sapiens
catcatccacccgctgcccctc

SEQ ID NO: 6018986 - DNA, 17 bp, Homo sapiens
catcatccattctctct

SEQ ID NO: 6018987 - DNA, 19 bp, Homo sapiens
catcatccattctctctgc

SEQ ID NO: 6018988 - DNA, 15 bp, Homo sapiens
catcatcccagctgc

SEQ ID NO: 6018989 - DNA, 11 bp, Homo sapiens
catcatccctt

SEQ ID NO: 6018990 - DNA, 20 bp, Homo sapiens
catcatcctcccgccaggag

SEQ ID NO: 6018991 - DNA, 21 bp, Homo sapiens
catcatcctcccgccaggagc

SEQ ID NO: 6018992 - DNA, 23 bp, Homo sapiens
catcatcctcccgccaggagctt

SEQ ID NO: 6018993 - DNA, 14 bp, Homo sapiens
catcatcctctggc

SEQ ID NO: 6018994 - DNA, 15 bp, Homo sapiens
catcatcctctggct

SEQ ID NO: 6018995 - DNA, 21 bp, Homo sapiens
catcatcctttgttctgagca

SEQ ID NO: 6018996 - DNA, 14 bp, Homo sapiens
catcatctccaaac

SEQ ID NO: 6018997 - DNA, 13 bp, Homo sapiens
catcatctcctgc

SEQ ID NO: 6018998 - DNA, 13 bp, Homo sapiens
catcatctctgcc

SEQ ID NO: 6018999 - DNA, 17 bp, Homo sapiens
catcatctctgcctttg

SEQ ID NO: 6019000 - DNA, 14 bp, Homo sapiens
catcatctcttcct

SEQ ID NO: 6019001 - DNA, 22 bp, Homo sapiens
catcatctcttgataaaggaga

SEQ ID NO: 6019002 - DNA, 13 bp, Homo sapiens
catcatctctttt

SEQ ID NO: 6019003 - DNA, 21 bp, Homo sapiens
catcatctcttttcccactcc

SEQ ID NO: 6019004 - DNA, 23 bp, Homo sapiens
catcatctgggaacttgtcacag

SEQ ID NO: 6019005 - DNA, 13 bp, Homo sapiens
catcatctgtaga

SEQ ID NO: 6019006 - DNA, 18 bp, Homo sapiens
catcatctgtagatacta

SEQ ID NO: 6019007 - DNA, 21 bp, Homo sapiens
catcatctgtttgtaatcatt

SEQ ID NO: 6019008 - DNA, 17 bp, Homo sapiens
catcatctttatctcct

SEQ ID NO: 6019009 - DNA, 19 bp, Homo sapiens
catcatctttatctcctgg

SEQ ID NO: 6019010 - DNA, 16 bp, Homo sapiens
catcatgaactggctt

SEQ ID NO: 6019011 - DNA, 23 bp, Homo sapiens
catcatgacactcgtataagcat

SEQ ID NO: 6019012 - DNA, 20 bp, Homo sapiens
catcatgaggaaagcagttg

SEQ ID NO: 6019013 - DNA, 23 bp, Homo sapiens
catcatgaggccggatgaaactt

SEQ ID NO: 6019014 - DNA, 14 bp, Homo sapiens
catcatgagttctg

SEQ ID NO: 6019015 - DNA, 17 bp, Homo sapiens
catcatgagttctgctg

SEQ ID NO: 6019016 - DNA, 19 bp, Homo sapiens
catcatgattaagatgatt

SEQ ID NO: 6019017 - DNA, 16 bp, Homo sapiens
catcatgcatcttact

SEQ ID NO: 6019018 - DNA, 17 bp, Homo sapiens
catcatgccctctctcg

SEQ ID NO: 6019019 - DNA, 15 bp, Homo sapiens
catcatgcctctgag

SEQ ID NO: 6019020 - DNA, 16 bp, Homo sapiens
catcatgcctctgagg

SEQ ID NO: 6019021 - DNA, 17 bp, Homo sapiens
catcatgcctctgaggc

SEQ ID NO: 6019022 - DNA, 20 bp, Homo sapiens
catcatgcctctgaggccag

SEQ ID NO: 6019023 - DNA, 20 bp, Homo sapiens
catcatgccttgataaatat

SEQ ID NO: 6019024 - DNA, 21 bp, Homo sapiens
catcatgctggaacctgcaaa

SEQ ID NO: 6019025 - DNA, 22 bp, Homo sapiens
catcatgctggaacctgcaaaa

SEQ ID NO: 6019026 - DNA, 13 bp, Homo sapiens
catcatggccagc

SEQ ID NO: 6019027 - DNA, 17 bp, Homo sapiens
catcatggctgcttgat

SEQ ID NO: 6019028 - DNA, 18 bp, Homo sapiens
catcatgtaccaagtgct

SEQ ID NO: 6019029 - DNA, 12 bp, Homo sapiens
catcatgtagaa

SEQ ID NO: 6019030 - DNA, 15 bp, Homo sapiens
catcatgtagaatat

SEQ ID NO: 6019031 - DNA, 15 bp, Homo sapiens
catcatgtctattgt

SEQ ID NO: 6019032 - DNA, 13 bp, Homo sapiens
catcatgtctggc

SEQ ID NO: 6019033 - DNA, 17 bp, Homo sapiens
catcatgtgcctggaaa

SEQ ID NO: 6019034 - DNA, 17 bp, Homo sapiens
catcatgttacttgaga

SEQ ID NO: 6019035 - DNA, 16 bp, Homo sapiens
catcatgttattttat

SEQ ID NO: 6019036 - DNA, 23 bp, Homo sapiens
catcatgtttcagtgaagatgct

SEQ ID NO: 6019037 - DNA, 14 bp, Homo sapiens
catcattaagaata

SEQ ID NO: 6019038 - DNA, 17 bp, Homo sapiens
catcattaataagtgaa

SEQ ID NO: 6019039 - DNA, 18 bp, Homo sapiens
catcattaataagtgaag

SEQ ID NO: 6019040 - DNA, 17 bp, Homo sapiens
catcattacccttccct

SEQ ID NO: 6019041 - DNA, 22 bp, Homo sapiens
catcattacccttccctgcact

SEQ ID NO: 6019042 - DNA, 20 bp, Homo sapiens
catcattactgttccagatt

SEQ ID NO: 6019043 - DNA, 10 bp, Homo sapiens
catcattaga

SEQ ID NO: 6019044 - DNA, 17 bp, Homo sapiens
catcattataaacgtga

SEQ ID NO: 6019045 - DNA, 14 bp, Homo sapiens
catcattattgtag

SEQ ID NO: 6019046 - DNA, 14 bp, Homo sapiens
catcattatttatg

SEQ ID NO: 6019047 - DNA, 17 bp, Homo sapiens
catcattcacttcactg

SEQ ID NO: 6019048 - DNA, 18 bp, Homo sapiens
catcattcacttcactgt

SEQ ID NO: 6019049 - DNA, 21 bp, Homo sapiens
catcattcagcaaatgccttt

SEQ ID NO: 6019050 - DNA, 12 bp, Homo sapiens
catcattcatga

SEQ ID NO: 6019051 - DNA, 19 bp, Homo sapiens
catcattcattcactgtat

SEQ ID NO: 6019052 - DNA, 14 bp, Homo sapiens
catcattccctctc

SEQ ID NO: 6019053 - DNA, 23 bp, Homo sapiens
catcattccctctcatctcaggt

SEQ ID NO: 6019054 - DNA, 12 bp, Homo sapiens
catcattccctt

SEQ ID NO: 6019055 - DNA, 17 bp, Homo sapiens
catcattccttgagaaa

SEQ ID NO: 6019056 - DNA, 22 bp, Homo sapiens
catcattccttgagaaaaacaa

SEQ ID NO: 6019057 - DNA, 15 bp, Homo sapiens
catcattccttttta

SEQ ID NO: 6019058 - DNA, 20 bp, Homo sapiens
catcattcctttttatttat

SEQ ID NO: 6019059 - DNA, 14 bp, Homo sapiens
catcattctctgtc

SEQ ID NO: 6019060 - DNA, 17 bp, Homo sapiens
catcattctctgtctca

SEQ ID NO: 6019061 - DNA, 22 bp, Homo sapiens
catcattctctgtctcatccat

SEQ ID NO: 6019062 - DNA, 13 bp, Homo sapiens
catcattctgtgt

SEQ ID NO: 6019063 - DNA, 13 bp, Homo sapiens
catcattgatgat

SEQ ID NO: 6019064 - DNA, 15 bp, Homo sapiens
catcattgcacctgc

SEQ ID NO: 6019065 - DNA, 17 bp, Homo sapiens
catcattgcacctgcag

SEQ ID NO: 6019066 - DNA, 22 bp, Homo sapiens
catcattgggccagttccttct

SEQ ID NO: 6019067 - DNA, 13 bp, Homo sapiens
catcattgtatat

SEQ ID NO: 6019068 - DNA, 16 bp, Homo sapiens
catcattgtattaacg

SEQ ID NO: 6019069 - DNA, 18 bp, Homo sapiens
catcattgtccccatgca

SEQ ID NO: 6019070 - DNA, 21 bp, Homo sapiens
catcattgtccccatgcaaca

SEQ ID NO: 6019071 - DNA, 22 bp, Homo sapiens
catcatttaaaaaaaaagaatt

SEQ ID NO: 6019072 - DNA, 12 bp, Homo sapiens
catcatttaact

SEQ ID NO: 6019073 - DNA, 22 bp, Homo sapiens
catcatttaactgaactgtgaa

SEQ ID NO: 6019074 - DNA, 12 bp, Homo sapiens
catcatttcaag

SEQ ID NO: 6019075 - DNA, 14 bp, Homo sapiens
catcatttcaagaa

SEQ ID NO: 6019076 - DNA, 16 bp, Homo sapiens
catcatttcagccaaa

SEQ ID NO: 6019077 - DNA, 21 bp, Homo sapiens
catcatttcagccaaagtcct

SEQ ID NO: 6019078 - DNA, 14 bp, Homo sapiens
catcatttcaggag

SEQ ID NO: 6019079 - DNA, 14 bp, Homo sapiens
catcatttcctggg

SEQ ID NO: 6019080 - DNA, 12 bp, Homo sapiens
catcatttctgt

SEQ ID NO: 6019081 - DNA, 16 bp, Homo sapiens
catcatttgtattatg

SEQ ID NO: 6019082 - DNA, 12 bp, Homo sapiens
catcattttaca

SEQ ID NO: 6019083 - DNA, 22 bp, Homo sapiens
catcattttcacctccatttct

SEQ ID NO: 6019084 - DNA, 16 bp, Homo sapiens
catcattttgcattca

SEQ ID NO: 6019085 - DNA, 18 bp, Homo sapiens
catcattttgcattcaaa

SEQ ID NO: 6019086 - DNA, 22 bp, Homo sapiens
catccaaaagcaggaacccatc

SEQ ID NO: 6019087 - DNA, 17 bp, Homo sapiens
catccaaacctacctta

SEQ ID NO: 6019088 - DNA, 19 bp, Homo sapiens
catccaaactcagaaggct

SEQ ID NO: 6019089 - DNA, 12 bp, Homo sapiens
catccaaagatt

SEQ ID NO: 6019090 - DNA, 15 bp, Homo sapiens
catccaaagcagaca

SEQ ID NO: 6019091 - DNA, 14 bp, Homo sapiens
catccaaagttgcc

SEQ ID NO: 6019092 - DNA, 18 bp, Homo sapiens
catccaaataagaaacct

SEQ ID NO: 6019093 - DNA, 13 bp, Homo sapiens
catccaaatctag

SEQ ID NO: 6019094 - DNA, 16 bp, Homo sapiens
catccaacaagaagaa

SEQ ID NO: 6019095 - DNA, 19 bp, Homo sapiens
catccaacaagaagaaata

SEQ ID NO: 6019096 - DNA, 17 bp, Homo sapiens
catccaaccactgtaca

SEQ ID NO: 6019097 - DNA, 14 bp, Homo sapiens
catccaactccagc

SEQ ID NO: 6019098 - DNA, 15 bp, Homo sapiens
catccaactcctcta

SEQ ID NO: 6019099 - DNA, 15 bp, Homo sapiens
catccaactgagaaa

SEQ ID NO: 6019100 - DNA, 15 bp, Homo sapiens
catccaactggaaat

SEQ ID NO: 6019101 - DNA, 22 bp, Homo sapiens
catccaactggaaattccagga

SEQ ID NO: 6019102 - DNA, 15 bp, Homo sapiens
catccaagccagagt

SEQ ID NO: 6019103 - DNA, 21 bp, Homo sapiens
catccaaggagaaacagagac

SEQ ID NO: 6019104 - DNA, 21 bp, Homo sapiens
catccaaggccaggttctccg

SEQ ID NO: 6019105 - DNA, 16 bp, Homo sapiens
catccaagtctttctt

SEQ ID NO: 6019106 - DNA, 15 bp, Homo sapiens
catccaagtggcata

SEQ ID NO: 6019107 - DNA, 13 bp, Homo sapiens
catccaatcctca

SEQ ID NO: 6019108 - DNA, 14 bp, Homo sapiens
catccaatcctcac

SEQ ID NO: 6019109 - DNA, 17 bp, Homo sapiens
catccaatcctcactgg

SEQ ID NO: 6019110 - DNA, 18 bp, Homo sapiens
catccaatcctcactggg

SEQ ID NO: 6019111 - DNA, 19 bp, Homo sapiens
catccaatcctcactgggt

SEQ ID NO: 6019112 - DNA, 16 bp, Homo sapiens
catccaatctgctcag

SEQ ID NO: 6019113 - DNA, 22 bp, Homo sapiens
catccaatgtgaagttcatctt

SEQ ID NO: 6019114 - DNA, 23 bp, Homo sapiens
catccacaaatgcagttttagaa

SEQ ID NO: 6019115 - DNA, 19 bp, Homo sapiens
catccacacaacaccagga

SEQ ID NO: 6019116 - DNA, 15 bp, Homo sapiens
catccacacacagca

SEQ ID NO: 6019117 - DNA, 18 bp, Homo sapiens
catccacacacgcaggaa

SEQ ID NO: 6019118 - DNA, 16 bp, Homo sapiens
catccacaccctctcc

SEQ ID NO: 6019119 - DNA, 17 bp, Homo sapiens
catccacacttaagccc

SEQ ID NO: 6019120 - DNA, 14 bp, Homo sapiens
catccacatgcaca

SEQ ID NO: 6019121 - DNA, 17 bp, Homo sapiens
catccacatgctctgca

SEQ ID NO: 6019122 - DNA, 14 bp, Homo sapiens
catccacattttaa

SEQ ID NO: 6019123 - DNA, 17 bp, Homo sapiens
catccacccagtgctgc

SEQ ID NO: 6019124 - DNA, 20 bp, Homo sapiens
catccacccagtgctgccat

SEQ ID NO: 6019125 - DNA, 22 bp, Homo sapiens
catccacccagtgctgccatgc

SEQ ID NO: 6019126 - DNA, 23 bp, Homo sapiens
catccacccagtgctgccatgcc

SEQ ID NO: 6019127 - DNA, 22 bp, Homo sapiens
catccacccatgtttattaaga

SEQ ID NO: 6019128 - DNA, 11 bp, Homo sapiens
catccacccca

SEQ ID NO: 6019129 - DNA, 14 bp, Homo sapiens
catccaccccatcc

SEQ ID NO: 6019130 - DNA, 12 bp, Homo sapiens
catccacccgct

SEQ ID NO: 6019131 - DNA, 12 bp, Homo sapiens
cagcgtctgcag

SEQ ID NO: 6019132 - DNA, 15 bp, Homo sapiens
cagcgtctgcagggt

SEQ ID NO: 6019133 - DNA, 16 bp, Homo sapiens
cagcgtctgcagggtg

SEQ ID NO: 6019134 - DNA, 14 bp, Homo sapiens
cagcgtctgctcat

SEQ ID NO: 6019135 - DNA, 22 bp, Homo sapiens
cagcgtctgctcataggacctg

SEQ ID NO: 6019136 - DNA, 14 bp, Homo sapiens
cagcgtctgctgtt

SEQ ID NO: 6019137 - DNA, 17 bp, Homo sapiens
cagcgtgacaatatact

SEQ ID NO: 6019138 - DNA, 23 bp, Homo sapiens
cagcgtgccgagccagcaagagg

SEQ ID NO: 6019139 - DNA, 15 bp, Homo sapiens
cagcgtgctttaaaa

SEQ ID NO: 6019140 - DNA, 22 bp, Homo sapiens
cagcgtggaggggtaggggctg

SEQ ID NO: 6019141 - DNA, 13 bp, Homo sapiens
cagcgtggccttg

SEQ ID NO: 6019142 - DNA, 22 bp, Homo sapiens
cagcgtgggaactcactttccc

SEQ ID NO: 6019143 - DNA, 16 bp, Homo sapiens
cagcgtgggctctgcc

SEQ ID NO: 6019144 - DNA, 18 bp, Homo sapiens
cagcgtgggctctgccaa

SEQ ID NO: 6019145 - DNA, 15 bp, Homo sapiens
cagcgtgtggagcag

SEQ ID NO: 6019146 - DNA, 22 bp, Homo sapiens
cagcgtgtggagcagagctctc

SEQ ID NO: 6019147 - DNA, 13 bp, Homo sapiens
cagcgtgtgtatc

SEQ ID NO: 6019148 - DNA, 14 bp, Homo sapiens
cagcgtgtgtatcc

SEQ ID NO: 6019149 - DNA, 15 bp, Homo sapiens
cagcgtgtgtatccg

SEQ ID NO: 6019150 - DNA, 18 bp, Homo sapiens
cagcgttaacacaaaatc

SEQ ID NO: 6019151 - DNA, 13 bp, Homo sapiens
cagcgttcatgtt

SEQ ID NO: 6019152 - DNA, 18 bp, Homo sapiens
cagcgttcttcaggagat

SEQ ID NO: 6019153 - DNA, 14 bp, Homo sapiens
cagcgttgcatgtc

SEQ ID NO: 6019154 - DNA, 21 bp, Homo sapiens
cagcgtttagtttctagaggc

SEQ ID NO: 6019155 - DNA, 14 bp, Homo sapiens
cagcgtttattgta

SEQ ID NO: 6019156 - DNA, 15 bp, Homo sapiens
cagcgttttgcaagg

SEQ ID NO: 6019157 - DNA, 19 bp, Homo sapiens
cagcgtttttacctaggca

SEQ ID NO: 6019158 - DNA, 20 bp, Homo sapiens
cagctaaacaccaacccctg

SEQ ID NO: 6019159 - DNA, 22 bp, Homo sapiens
cagctaaagaagtttgaacatt

SEQ ID NO: 6019160 - DNA, 22 bp, Homo sapiens
cagctaaagcccaacctcctga

SEQ ID NO: 6019161 - DNA, 19 bp, Homo sapiens
cagctaaatcatttgagat

SEQ ID NO: 6019162 - DNA, 15 bp, Homo sapiens
cagctaaatgcaggg

SEQ ID NO: 6019163 - DNA, 15 bp, Homo sapiens
cagctaacaagtagc

SEQ ID NO: 6019164 - DNA, 15 bp, Homo sapiens
cagctaacaataaag

SEQ ID NO: 6019165 - DNA, 15 bp, Homo sapiens
cagctaacacacagc

SEQ ID NO: 6019166 - DNA, 16 bp, Homo sapiens
cagctaacacacagct

SEQ ID NO: 6019167 - DNA, 20 bp, Homo sapiens
cagctaacacacagctccca

SEQ ID NO: 6019168 - DNA, 15 bp, Homo sapiens
cagctaacatggaag

SEQ ID NO: 6019169 - DNA, 19 bp, Homo sapiens
cagctaacatggaagtact

SEQ ID NO: 6019170 - DNA, 22 bp, Homo sapiens
cagctaaccacttcgcacacac

SEQ ID NO: 6019171 - DNA, 17 bp, Homo sapiens
cagctaactccgagagc

SEQ ID NO: 6019172 - DNA, 19 bp, Homo sapiens
cagctaactccgagagcag

SEQ ID NO: 6019173 - DNA, 17 bp, Homo sapiens
cagctaactgtggagaa

SEQ ID NO: 6019174 - DNA, 21 bp, Homo sapiens
cagctaagatagaaagctgga

SEQ ID NO: 6019175 - DNA, 23 bp, Homo sapiens
cagctaagatagaaagctggact

SEQ ID NO: 6019176 - DNA, 19 bp, Homo sapiens
cagctaagcctgatgatgg

SEQ ID NO: 6019177 - DNA, 19 bp, Homo sapiens
cagctaaggacatttccca

SEQ ID NO: 6019178 - DNA, 19 bp, Homo sapiens
cagctaagggaagacattt

SEQ ID NO: 6019179 - DNA, 23 bp, Homo sapiens
cagctaagggaagacatttcttt

SEQ ID NO: 6019180 - DNA, 21 bp, Homo sapiens
cagctaaggggtggggctgcg

SEQ ID NO: 6019181 - DNA, 17 bp, Homo sapiens
cagctaataaaagtcag

SEQ ID NO: 6019182 - DNA, 19 bp, Homo sapiens
cagctaataaaagtcagag

SEQ ID NO: 6019183 - DNA, 20 bp, Homo sapiens
cagctaataaaagtcagagc

SEQ ID NO: 6019184 - DNA, 24 bp, Homo sapiens
cagctaataaaagtcagagctcag

SEQ ID NO: 6019185 - DNA, 14 bp, Homo sapiens
cagctaataaacca

SEQ ID NO: 6019186 - DNA, 19 bp, Homo sapiens
cagctaatcagcattctca

SEQ ID NO: 6019187 - DNA, 15 bp, Homo sapiens
cagctaatgggacac

SEQ ID NO: 6019188 - DNA, 16 bp, Homo sapiens
cagctaatgggacact

SEQ ID NO: 6019189 - DNA, 22 bp, Homo sapiens
cagctaattcaggtcattttgt

SEQ ID NO: 6019190 - DNA, 19 bp, Homo sapiens
cagctaattggacttttat

SEQ ID NO: 6019191 - DNA, 17 bp, Homo sapiens
cagctaatttgtgaaag

SEQ ID NO: 6019192 - DNA, 18 bp, Homo sapiens
cagctaatttgtgaaagt

SEQ ID NO: 6019193 - DNA, 22 bp, Homo sapiens
cagctaatttttgtatttttag

SEQ ID NO: 6019194 - DNA, 17 bp, Homo sapiens
cagctacaaacttttaa

SEQ ID NO: 6019195 - DNA, 17 bp, Homo sapiens
cagctacaacagcctca

SEQ ID NO: 6019196 - DNA, 13 bp, Homo sapiens
cagctacaaccct

SEQ ID NO: 6019197 - DNA, 18 bp, Homo sapiens
cagctacaaccctaccct

SEQ ID NO: 6019198 - DNA, 21 bp, Homo sapiens
cagctacaaccctaccctggc

SEQ ID NO: 6019199 - DNA, 20 bp, Homo sapiens
cagctacagctttcttgctc

SEQ ID NO: 6019200 - DNA, 15 bp, Homo sapiens
cagctacaggagaga

SEQ ID NO: 6019201 - DNA, 16 bp, Homo sapiens
cagctacatgaagttg

SEQ ID NO: 6019202 - DNA, 12 bp, Homo sapiens
cagctacattcc

SEQ ID NO: 6019203 - DNA, 15 bp, Homo sapiens
cagctacattcctca

SEQ ID NO: 6019204 - DNA, 17 bp, Homo sapiens
cagctacattcctcagc

SEQ ID NO: 6019205 - DNA, 18 bp, Homo sapiens
cagctacattcctcagct

SEQ ID NO: 6019206 - DNA, 19 bp, Homo sapiens
cagctacattcctcagctg

SEQ ID NO: 6019207 - DNA, 15 bp, Homo sapiens
cagctaccatgacaa

SEQ ID NO: 6019208 - DNA, 18 bp, Homo sapiens
cagctacccactatcctt

SEQ ID NO: 6019209 - DNA, 18 bp, Homo sapiens
cagctacccctgcagctg

SEQ ID NO: 6019210 - DNA, 23 bp, Homo sapiens
cagctaccccttctttgcagggc

SEQ ID NO: 6019211 - DNA, 16 bp, Homo sapiens
cagctaccccttgtgg

SEQ ID NO: 6019212 - DNA, 17 bp, Homo sapiens
cagctaccctcagcctc

SEQ ID NO: 6019213 - DNA, 24 bp, Homo sapiens
cagctaccctttttctccagctgg

SEQ ID NO: 6019214 - DNA, 21 bp, Homo sapiens
cagctacctcaaccaatgcca

SEQ ID NO: 6019215 - DNA, 14 bp, Homo sapiens
cagctacctgagac

SEQ ID NO: 6019216 - DNA, 15 bp, Homo sapiens
cagctacctgagacg

SEQ ID NO: 6019217 - DNA, 21 bp, Homo sapiens
cagctactaacctggagacag

SEQ ID NO: 6019218 - DNA, 19 bp, Homo sapiens
cagctactaatgatgtttt

SEQ ID NO: 6019219 - DNA, 18 bp, Homo sapiens
cagctactagggaggctg

SEQ ID NO: 6019220 - DNA, 19 bp, Homo sapiens
cagctactagggaggctga

SEQ ID NO: 6019221 - DNA, 16 bp, Homo sapiens
cagctactataaatat

SEQ ID NO: 6019222 - DNA, 20 bp, Homo sapiens
cagctactcaagaggctgag

SEQ ID NO: 6019223 - DNA, 14 bp, Homo sapiens
cagctactcagaag

SEQ ID NO: 6019224 - DNA, 15 bp, Homo sapiens
cagctactcagaagc

SEQ ID NO: 6019225 - DNA, 22 bp, Homo sapiens
cagctactcagaagcctgaggc

SEQ ID NO: 6019226 - DNA, 13 bp, Homo sapiens
cagctactcagat

SEQ ID NO: 6019227 - DNA, 15 bp, Homo sapiens
cagctactcagatct

SEQ ID NO: 6019228 - DNA, 12 bp, Homo sapiens
cagctactcagg

SEQ ID NO: 6019229 - DNA, 13 bp, Homo sapiens
cagctactcagga

SEQ ID NO: 6019230 - DNA, 14 bp, Homo sapiens
cagctactcaggag

SEQ ID NO: 6019231 - DNA, 17 bp, Homo sapiens
cagctactcaggaggct

SEQ ID NO: 6019232 - DNA, 19 bp, Homo sapiens
cagctactcaggaggctga

SEQ ID NO: 6019233 - DNA, 18 bp, Homo sapiens
cagctactcatgaggctg

SEQ ID NO: 6019234 - DNA, 17 bp, Homo sapiens
cagctactcgggaggct

SEQ ID NO: 6019235 - DNA, 20 bp, Homo sapiens
cagctactcgggaggctgag

SEQ ID NO: 6019236 - DNA, 24 bp, Homo sapiens
cagctactcgggaggctgaggcag

SEQ ID NO: 6019237 - DNA, 15 bp, Homo sapiens
cagctactctcccca

SEQ ID NO: 6019238 - DNA, 21 bp, Homo sapiens
cagctactctgatccctctgg

SEQ ID NO: 6019239 - DNA, 16 bp, Homo sapiens
cagctactctgtccag

SEQ ID NO: 6019240 - DNA, 18 bp, Homo sapiens
cagctactctgtccaggc

SEQ ID NO: 6019241 - DNA, 23 bp, Homo sapiens
cagctactctgtccaggccactg

SEQ ID NO: 6019242 - DNA, 19 bp, Homo sapiens
cagctactgatttttgtga

SEQ ID NO: 6019243 - DNA, 13 bp, Homo sapiens
cagctactggaat

SEQ ID NO: 6019244 - DNA, 14 bp, Homo sapiens
cagctactggaatg

SEQ ID NO: 6019245 - DNA, 19 bp, Homo sapiens
cagctactggggaggctga

SEQ ID NO: 6019246 - DNA, 12 bp, Homo sapiens
cagctactgtaa

SEQ ID NO: 6019247 - DNA, 14 bp, Homo sapiens
cagctactgtaact

SEQ ID NO: 6019248 - DNA, 20 bp, Homo sapiens
cagctacttaagagaaatgg

SEQ ID NO: 6019249 - DNA, 22 bp, Homo sapiens
cagctacttagctggccaagga

SEQ ID NO: 6019250 - DNA, 17 bp, Homo sapiens
cagctacttcctcctcc

SEQ ID NO: 6019251 - DNA, 17 bp, Homo sapiens
cagctacttctgggaaa

SEQ ID NO: 6019252 - DNA, 16 bp, Homo sapiens
cagctacttggaaggc

SEQ ID NO: 6019253 - DNA, 18 bp, Homo sapiens
cagctacttgggagcctg

SEQ ID NO: 6019254 - DNA, 21 bp, Homo sapiens
cagctacttgggagcctgagg

SEQ ID NO: 6019255 - DNA, 22 bp, Homo sapiens
cagctacttgggagcctgaggc

SEQ ID NO: 6019256 - DNA, 19 bp, Homo sapiens
cagctacttgggaggctga

SEQ ID NO: 6019257 - DNA, 20 bp, Homo sapiens
cagctagaaagtggcagagc

SEQ ID NO: 6019258 - DNA, 22 bp, Homo sapiens
cagctagaaagtggcagagcca

SEQ ID NO: 6019259 - DNA, 18 bp, Homo sapiens
cagctagaagatccacat

SEQ ID NO: 6019260 - DNA, 16 bp, Homo sapiens
cagctagactggagtg

SEQ ID NO: 6019261 - DNA, 13 bp, Homo sapiens
cagctagctctgc

SEQ ID NO: 6019262 - DNA, 12 bp, Homo sapiens
cagctagctgct

SEQ ID NO: 6019263 - DNA, 18 bp, Homo sapiens
cagctaggaacaaatctt

SEQ ID NO: 6019264 - DNA, 20 bp, Homo sapiens
cagctaggaagagcaggact

SEQ ID NO: 6019265 - DNA, 21 bp, Homo sapiens
cagctaggaagagcaggactc

SEQ ID NO: 6019266 - DNA, 12 bp, Homo sapiens
cagctaggaagc

SEQ ID NO: 6019267 - DNA, 14 bp, Homo sapiens
cagctaggactgag

SEQ ID NO: 6019268 - DNA, 16 bp, Homo sapiens
cagctaggactgagga

SEQ ID NO: 6019269 - DNA, 17 bp, Homo sapiens
cagctaggactgaggag

SEQ ID NO: 6019270 - DNA, 17 bp, Homo sapiens
cagctaggcagggaggg

SEQ ID NO: 6019271 - DNA, 14 bp, Homo sapiens
cagctaggcatgcc

SEQ ID NO: 6019272 - DNA, 19 bp, Homo sapiens
cagctaggctgagatgcac

SEQ ID NO: 6019273 - DNA, 20 bp, Homo sapiens
cagctaggctgagatgcacc

SEQ ID NO: 6019274 - DNA, 18 bp, Homo sapiens
cagctaggttaataggag

SEQ ID NO: 6019275 - DNA, 20 bp, Homo sapiens
cagctagtcctagtgaacct

SEQ ID NO: 6019276 - DNA, 19 bp, Homo sapiens
cagctagtgaagaccagag

SEQ ID NO: 6019277 - DNA, 15 bp, Homo sapiens
cagctagtgacccac

SEQ ID NO: 6019278 - DNA, 19 bp, Homo sapiens
cagctagtgacccacatgc

SEQ ID NO: 6019279 - DNA, 21 bp, Homo sapiens
cagctagtgacccacatgcca

SEQ ID NO: 6019280 - DNA, 15 bp, Homo sapiens
cagctagtgccaaat

SEQ ID NO: 6019281 - DNA, 12 bp, Homo sapiens
cagctagtgcct

SEQ ID NO: 6019282 - DNA, 21 bp, Homo sapiens
cagctagtggtggcttctcca

SEQ ID NO: 6019283 - DNA, 16 bp, Homo sapiens
cagctagttaataatt

SEQ ID NO: 6019284 - DNA, 19 bp, Homo sapiens
cagctagtttttgtatttt

SEQ ID NO: 6019285 - DNA, 20 bp, Homo sapiens
cagctataacagtagggatg

SEQ ID NO: 6019286 - DNA, 16 bp, Homo sapiens
cagctataattctgtt

SEQ ID NO: 6019287 - DNA, 19 bp, Homo sapiens
cagctatacctgtgcctcg

SEQ ID NO: 6019288 - DNA, 21 bp, Homo sapiens
cagctatacctgtgcctcggc

SEQ ID NO: 6019289 - DNA, 23 bp, Homo sapiens
cagctatacctgtgcctcggctt

SEQ ID NO: 6019290 - DNA, 15 bp, Homo sapiens
cagctatatatttcc

SEQ ID NO: 6019291 - DNA, 21 bp, Homo sapiens
cagctatgcgcaatgtggcat

SEQ ID NO: 6019292 - DNA, 21 bp, Homo sapiens
cagctatggccccagggttga

SEQ ID NO: 6019293 - DNA, 18 bp, Homo sapiens
cagctatgggagccccag

SEQ ID NO: 6019294 - DNA, 22 bp, Homo sapiens
cagctatgggagccccagggtc

SEQ ID NO: 6019295 - DNA, 21 bp, Homo sapiens
cagctatgttatattgaaaaa

SEQ ID NO: 6019296 - DNA, 16 bp, Homo sapiens
cagctattaccacact

SEQ ID NO: 6019297 - DNA, 23 bp, Homo sapiens
cagctattcaggaggctgaggca

SEQ ID NO: 6019298 - DNA, 22 bp, Homo sapiens
cagctattcccttctgatcttg

SEQ ID NO: 6019299 - DNA, 13 bp, Homo sapiens
cagctatttaagg

SEQ ID NO: 6019300 - DNA, 23 bp, Homo sapiens
cagctattttaagccatctcaga

SEQ ID NO: 6019301 - DNA, 16 bp, Homo sapiens
cagctattttagtaac

SEQ ID NO: 6019302 - DNA, 19 bp, Homo sapiens
cagctattttctgaccaaa

SEQ ID NO: 6019303 - DNA, 20 bp, Homo sapiens
cagctattttctgaccaaaa

SEQ ID NO: 6019304 - DNA, 14 bp, Homo sapiens
cagctattttgtga

SEQ ID NO: 6019305 - DNA, 15 bp, Homo sapiens
cagctattttgtgaa

SEQ ID NO: 6019306 - DNA, 16 bp, Homo sapiens
cagctatttttactag

SEQ ID NO: 6019307 - DNA, 18 bp, Homo sapiens
cagctatttttactagaa

SEQ ID NO: 6019308 - DNA, 17 bp, Homo sapiens
catccacccgctgcccc

SEQ ID NO: 6019309 - DNA, 19 bp, Homo sapiens
catccacccgggggagccc

SEQ ID NO: 6019310 - DNA, 15 bp, Homo sapiens
catccaccctgagga

SEQ ID NO: 6019311 - DNA, 17 bp, Homo sapiens
catccaccctgaggagt

SEQ ID NO: 6019312 - DNA, 14 bp, Homo sapiens
catccaccgccacc

SEQ ID NO: 6019313 - DNA, 19 bp, Homo sapiens
catccaccgccaccccact

SEQ ID NO: 6019314 - DNA, 22 bp, Homo sapiens
catccaccgccaccccactgag

SEQ ID NO: 6019315 - DNA, 18 bp, Homo sapiens
catccacctatccaccac

SEQ ID NO: 6019316 - DNA, 17 bp, Homo sapiens
catccacctcatcactg

SEQ ID NO: 6019317 - DNA, 21 bp, Homo sapiens
catccacctcatcactggact

SEQ ID NO: 6019318 - DNA, 15 bp, Homo sapiens
catccacctccttct

SEQ ID NO: 6019319 - DNA, 15 bp, Homo sapiens
catccaccttccctt

SEQ ID NO: 6019320 - DNA, 16 bp, Homo sapiens
catccaccttcctgcc

SEQ ID NO: 6019321 - DNA, 21 bp, Homo sapiens
catccaccttcctgcccaggg

SEQ ID NO: 6019322 - DNA, 16 bp, Homo sapiens
catccaccttggctct

SEQ ID NO: 6019323 - DNA, 22 bp, Homo sapiens
catccacgcacacatggacaca

SEQ ID NO: 6019324 - DNA, 13 bp, Homo sapiens
catccacgtggcc

SEQ ID NO: 6019325 - DNA, 18 bp, Homo sapiens
catccacgtggcctctct

SEQ ID NO: 6019326 - DNA, 14 bp, Homo sapiens
catccactgtgcca

SEQ ID NO: 6019327 - DNA, 17 bp, Homo sapiens
catccactgtgccatgt

SEQ ID NO: 6019328 - DNA, 12 bp, Homo sapiens
catccacttaag

SEQ ID NO: 6019329 - DNA, 18 bp, Homo sapiens
catccacttacatatatt

SEQ ID NO: 6019330 - DNA, 23 bp, Homo sapiens
catccagaactgctaccttccta

SEQ ID NO: 6019331 - DNA, 20 bp, Homo sapiens
catccagaagtgtattcata

SEQ ID NO: 6019332 - DNA, 16 bp, Homo sapiens
catccagacatcatga

SEQ ID NO: 6019333 - DNA, 15 bp, Homo sapiens
catccagacctggct

SEQ ID NO: 6019334 - DNA, 16 bp, Homo sapiens
catccagagaccaaat

SEQ ID NO: 6019335 - DNA, 17 bp, Homo sapiens
catccagagaccaaata

SEQ ID NO: 6019336 - DNA, 19 bp, Homo sapiens
catccagagaccaaataat

SEQ ID NO: 6019337 - DNA, 21 bp, Homo sapiens
catccagagtccctgcctgga

SEQ ID NO: 6019338 - DNA, 17 bp, Homo sapiens
catccagattgggtgcc

SEQ ID NO: 6019339 - DNA, 13 bp, Homo sapiens
catccagcaagaa

SEQ ID NO: 6019340 - DNA, 15 bp, Homo sapiens
catccagcagtctct

SEQ ID NO: 6019341 - DNA, 21 bp, Homo sapiens
catccagcagtctctgccttg

SEQ ID NO: 6019342 - DNA, 14 bp, Homo sapiens
catccagcagtgtt

SEQ ID NO: 6019343 - DNA, 20 bp, Homo sapiens
catccagcatgtgtgtgtct

SEQ ID NO: 6019344 - DNA, 21 bp, Homo sapiens
catccagcatgtgtgtgtctc

SEQ ID NO: 6019345 - DNA, 22 bp, Homo sapiens
catccagcatgtgtgtgtctct

SEQ ID NO: 6019346 - DNA, 16 bp, Homo sapiens
catccagccagacccc

SEQ ID NO: 6019347 - DNA, 11 bp, Homo sapiens
catccagcctc

SEQ ID NO: 6019348 - DNA, 15 bp, Homo sapiens
catccagcctccagg

SEQ ID NO: 6019349 - DNA, 17 bp, Homo sapiens
catccagcctccagggc

SEQ ID NO: 6019350 - DNA, 14 bp, Homo sapiens
catccagcctgtgt

SEQ ID NO: 6019351 - DNA, 15 bp, Homo sapiens
catccagcctgtgtg

SEQ ID NO: 6019352 - DNA, 16 bp, Homo sapiens
catccagcctgtgtgt

SEQ ID NO: 6019353 - DNA, 18 bp, Homo sapiens
catccagcgagagagttt

SEQ ID NO: 6019354 - DNA, 20 bp, Homo sapiens
catccagcgagagagtttca

SEQ ID NO: 6019355 - DNA, 23 bp, Homo sapiens
catccagctacttagctggccaa

SEQ ID NO: 6019356 - DNA, 15 bp, Homo sapiens
catccagctcactca

SEQ ID NO: 6019357 - DNA, 13 bp, Homo sapiens
catccagctcctc

SEQ ID NO: 6019358 - DNA, 15 bp, Homo sapiens
catccagctctatgt

SEQ ID NO: 6019359 - DNA, 19 bp, Homo sapiens
catccagctctatgtggga

SEQ ID NO: 6019360 - DNA, 17 bp, Homo sapiens
catccagctgcccctcc

SEQ ID NO: 6019361 - DNA, 12 bp, Homo sapiens
catccaggcagt

SEQ ID NO: 6019362 - DNA, 16 bp, Homo sapiens
catccaggccagggct

SEQ ID NO: 6019363 - DNA, 15 bp, Homo sapiens
catccaggctggcca

SEQ ID NO: 6019364 - DNA, 16 bp, Homo sapiens
catccagggctgccag

SEQ ID NO: 6019365 - DNA, 15 bp, Homo sapiens
catccagggtctggc

SEQ ID NO: 6019366 - DNA, 16 bp, Homo sapiens
catccagggtctggca

SEQ ID NO: 6019367 - DNA, 20 bp, Homo sapiens
catccagggtctggcagagc

SEQ ID NO: 6019368 - DNA, 15 bp, Homo sapiens
catccaggttcagct

SEQ ID NO: 6019369 - DNA, 19 bp, Homo sapiens
catccagtgacaaaccatc

SEQ ID NO: 6019370 - DNA, 23 bp, Homo sapiens
catccagtggggtctcagtccag

SEQ ID NO: 6019371 - DNA, 21 bp, Homo sapiens
catccagtgtgagatactgtg

SEQ ID NO: 6019372 - DNA, 22 bp, Homo sapiens
catccagtgtgagatactgtgt

SEQ ID NO: 6019373 - DNA, 23 bp, Homo sapiens
catccagtgtgagatactgtgta

SEQ ID NO: 6019374 - DNA, 18 bp, Homo sapiens
catccagttgcaataaaa

SEQ ID NO: 6019375 - DNA, 21 bp, Homo sapiens
catccagtttgttctccgggt

SEQ ID NO: 6019376 - DNA, 16 bp, Homo sapiens
catccataaagaagca

SEQ ID NO: 6019377 - DNA, 17 bp, Homo sapiens
catccataaagaagcaa

SEQ ID NO: 6019378 - DNA, 21 bp, Homo sapiens
catccataaagcaagctcaac

SEQ ID NO: 6019379 - DNA, 15 bp, Homo sapiens
catccatagacacag

SEQ ID NO: 6019380 - DNA, 19 bp, Homo sapiens
catccatagacacagtatt

SEQ ID NO: 6019381 - DNA, 16 bp, Homo sapiens
catccatagtagtatg

SEQ ID NO: 6019382 - DNA, 21 bp, Homo sapiens
catccatatttctttttcttg

SEQ ID NO: 6019383 - DNA, 16 bp, Homo sapiens
catccatcaatacctg

SEQ ID NO: 6019384 - DNA, 14 bp, Homo sapiens
catccatcatcatg

SEQ ID NO: 6019385 - DNA, 15 bp, Homo sapiens
catccatcatctgct

SEQ ID NO: 6019386 - DNA, 12 bp, Homo sapiens
catccatcccta

SEQ ID NO: 6019387 - DNA, 21 bp, Homo sapiens
catccatccctagaagagcac

SEQ ID NO: 6019388 - DNA, 20 bp, Homo sapiens
catccatccctccattcatc

SEQ ID NO: 6019389 - DNA, 14 bp, Homo sapiens
catccatcctgagc

SEQ ID NO: 6019390 - DNA, 14 bp, Homo sapiens
catccatccttcca

SEQ ID NO: 6019391 - DNA, 22 bp, Homo sapiens
catccatctccagggagcaaga

SEQ ID NO: 6019392 - DNA, 18 bp, Homo sapiens
catccatctgtccgtcca

SEQ ID NO: 6019393 - DNA, 23 bp, Homo sapiens
catccatctgtccgtccagagcc

SEQ ID NO: 6019394 - DNA, 19 bp, Homo sapiens
catccatcttccctaccct

SEQ ID NO: 6019395 - DNA, 14 bp, Homo sapiens
catccatgcacttt

SEQ ID NO: 6019396 - DNA, 15 bp, Homo sapiens
catccatggccagca

SEQ ID NO: 6019397 - DNA, 21 bp, Homo sapiens
catccatggccagcagcacct

SEQ ID NO: 6019398 - DNA, 22 bp, Homo sapiens
catccatggccgggcttggtgg

SEQ ID NO: 6019399 - DNA, 22 bp, Homo sapiens
catccatggggtctctcacaga

SEQ ID NO: 6019400 - DNA, 17 bp, Homo sapiens
catccatgtacttccct

SEQ ID NO: 6019401 - DNA, 18 bp, Homo sapiens
catccatgtccaaccccc

SEQ ID NO: 6019402 - DNA, 16 bp, Homo sapiens
catccatgtcctatgt

SEQ ID NO: 6019403 - DNA, 16 bp, Homo sapiens
catccatgtgtggact

SEQ ID NO: 6019404 - DNA, 14 bp, Homo sapiens
catccatgtgttcc

SEQ ID NO: 6019405 - DNA, 16 bp, Homo sapiens
catccatgtgttccaa

SEQ ID NO: 6019406 - DNA, 19 bp, Homo sapiens
catccatgtttgtaaaact

SEQ ID NO: 6019407 - DNA, 13 bp, Homo sapiens
catccattaatta

SEQ ID NO: 6019408 - DNA, 13 bp, Homo sapiens
catccattaggcc

SEQ ID NO: 6019409 - DNA, 17 bp, Homo sapiens
catccattaggccagca

SEQ ID NO: 6019410 - DNA, 14 bp, Homo sapiens
catccattccagag

SEQ ID NO: 6019411 - DNA, 11 bp, Homo sapiens
catccattcct

SEQ ID NO: 6019412 - DNA, 16 bp, Homo sapiens
catccattcctcaggg

SEQ ID NO: 6019413 - DNA, 18 bp, Homo sapiens
catccattcctcagggac

SEQ ID NO: 6019414 - DNA, 21 bp, Homo sapiens
catccattctcacaggtccca

SEQ ID NO: 6019415 - DNA, 13 bp, Homo sapiens
catccattctccc

SEQ ID NO: 6019416 - DNA, 18 bp, Homo sapiens
catccattctcctcagtg

SEQ ID NO: 6019417 - DNA, 16 bp, Homo sapiens
catccattctctctgc

SEQ ID NO: 6019418 - DNA, 17 bp, Homo sapiens
catccatttactgacac

SEQ ID NO: 6019419 - DNA, 18 bp, Homo sapiens
catccatttactgacact

SEQ ID NO: 6019420 - DNA, 20 bp, Homo sapiens
catccatttcatctatttct

SEQ ID NO: 6019421 - DNA, 15 bp, Homo sapiens
catccatttctttta

SEQ ID NO: 6019422 - DNA, 18 bp, Homo sapiens
catccatttgaacacatt

SEQ ID NO: 6019423 - DNA, 14 bp, Homo sapiens
catcccaaacttta

SEQ ID NO: 6019424 - DNA, 15 bp, Homo sapiens
catcccaaaggatga

SEQ ID NO: 6019425 - DNA, 16 bp, Homo sapiens
catcccaacagcccag

SEQ ID NO: 6019426 - DNA, 17 bp, Homo sapiens
catcccaacagcccagc

SEQ ID NO: 6019427 - DNA, 18 bp, Homo sapiens
catcccaaccagtgccaa

SEQ ID NO: 6019428 - DNA, 22 bp, Homo sapiens
catcccaaccagtgccaaggac

SEQ ID NO: 6019429 - DNA, 15 bp, Homo sapiens
catcccaagcccagt

SEQ ID NO: 6019430 - DNA, 17 bp, Homo sapiens
catcccaagcccagtga

SEQ ID NO: 6019431 - DNA, 22 bp, Homo sapiens
catcccaataaagtcctcttcc

SEQ ID NO: 6019432 - DNA, 15 bp, Homo sapiens
catcccacaagtggt

SEQ ID NO: 6019433 - DNA, 12 bp, Homo sapiens
catcccacagcc

SEQ ID NO: 6019434 - DNA, 14 bp, Homo sapiens
catcccacagccag

SEQ ID NO: 6019435 - DNA, 15 bp, Homo sapiens
catcccaccagcccc

SEQ ID NO: 6019436 - DNA, 16 bp, Homo sapiens
catcccaccccatcct

SEQ ID NO: 6019437 - DNA, 17 bp, Homo sapiens
catcccacgttctgtta

SEQ ID NO: 6019438 - DNA, 13 bp, Homo sapiens
catcccactagca

SEQ ID NO: 6019439 - DNA, 23 bp, Homo sapiens
catcccactcacaacagctgcct

SEQ ID NO: 6019440 - DNA, 16 bp, Homo sapiens
catcccactgctgact

SEQ ID NO: 6019441 - DNA, 18 bp, Homo sapiens
catcccacttagccgcac

SEQ ID NO: 6019442 - DNA, 19 bp, Homo sapiens
catcccacttcctttccta

SEQ ID NO: 6019443 - DNA, 22 bp, Homo sapiens
catcccacttcctttcctactg

SEQ ID NO: 6019444 - DNA, 11 bp, Homo sapiens
catcccagagg

SEQ ID NO: 6019445 - DNA, 12 bp, Homo sapiens
catcccagcacc

SEQ ID NO: 6019446 - DNA, 20 bp, Homo sapiens
catcccagcacctgcctcct

SEQ ID NO: 6019447 - DNA, 18 bp, Homo sapiens
catcccagcagcccaagc

SEQ ID NO: 6019448 - DNA, 21 bp, Homo sapiens
catcccagcccaatccaggta

SEQ ID NO: 6019449 - DNA, 14 bp, Homo sapiens
catcccagccccaa

SEQ ID NO: 6019450 - DNA, 20 bp, Homo sapiens
catcccagccccaattttct

SEQ ID NO: 6019451 - DNA, 18 bp, Homo sapiens
catcccagcctcagaagc

SEQ ID NO: 6019452 - DNA, 22 bp, Homo sapiens
catcccagcctcagaagccttc

SEQ ID NO: 6019453 - DNA, 23 bp, Homo sapiens
catcccagcctcagaagccttct

SEQ ID NO: 6019454 - DNA, 14 bp, Homo sapiens
catcccagcctggg

SEQ ID NO: 6019455 - DNA, 17 bp, Homo sapiens
catcccagcctgtggtt

SEQ ID NO: 6019456 - DNA, 12 bp, Homo sapiens
catcccagcctt

SEQ ID NO: 6019457 - DNA, 14 bp, Homo sapiens
catcccagccttga

SEQ ID NO: 6019458 - DNA, 13 bp, Homo sapiens
catcccagcggct

SEQ ID NO: 6019459 - DNA, 11 bp, Homo sapiens
catcccagctt

SEQ ID NO: 6019460 - DNA, 15 bp, Homo sapiens
catcccagcttgccc

SEQ ID NO: 6019461 - DNA, 21 bp, Homo sapiens
catcccaggacaccacaccca

SEQ ID NO: 6019462 - DNA, 20 bp, Homo sapiens
catcccaggatgctgggtgg

SEQ ID NO: 6019463 - DNA, 19 bp, Homo sapiens
catcccaggcttcaccctg

SEQ ID NO: 6019464 - DNA, 14 bp, Homo sapiens
catcccaggggacc

SEQ ID NO: 6019465 - DNA, 19 bp, Homo sapiens
catcccaggggaccacacc

SEQ ID NO: 6019466 - DNA, 15 bp, Homo sapiens
catcccagggtccca

SEQ ID NO: 6019467 - DNA, 18 bp, Homo sapiens
catcccagggtcccaccc

SEQ ID NO: 6019468 - DNA, 21 bp, Homo sapiens
catcccagggtcccaccccca

SEQ ID NO: 6019469 - DNA, 20 bp, Homo sapiens
catcccagtagtgtttggaa

SEQ ID NO: 6019470 - DNA, 21 bp, Homo sapiens
catcccagtagtgtttggaat

SEQ ID NO: 6019471 - DNA, 14 bp, Homo sapiens
catcccagtccctc

SEQ ID NO: 6019472 - DNA, 17 bp, Homo sapiens
catcccagtccctcgcc

SEQ ID NO: 6019473 - DNA, 20 bp, Homo sapiens
catcccagtggcctcaaccc

SEQ ID NO: 6019474 - DNA, 13 bp, Homo sapiens
catcccatcccat

SEQ ID NO: 6019475 - DNA, 14 bp, Homo sapiens
catcccatcccatc

SEQ ID NO: 6019476 - DNA, 16 bp, Homo sapiens
catcccatcccatccc

SEQ ID NO: 6019477 - DNA, 12 bp, Homo sapiens
catcccatccct

SEQ ID NO: 6019478 - DNA, 21 bp, Homo sapiens
catcccatctaagctgcagct

SEQ ID NO: 6019479 - DNA, 15 bp, Homo sapiens
catcccatctctccc

SEQ ID NO: 6019480 - DNA, 16 bp, Homo sapiens
catcccatctctccca

SEQ ID NO: 6019481 - DNA, 23 bp, Homo sapiens
catcccatctctcccacttcctc

SEQ ID NO: 6019482 - DNA, 18 bp, Homo sapiens
catcccatgatgtagtgc

SEQ ID NO: 6019483 - DNA, 15 bp, Homo sapiens
catcccattgccctg

SEQ ID NO: 6019484 - DNA, 16 bp, Homo sapiens
catcccattgccctgg

SEQ ID NO: 6019485 - DNA, 22 bp, Homo sapiens
catcccattgctagcaggattg

SEQ ID NO: 6019486 - DNA, 19 bp, Homo sapiens
catccccacaatctggctt

SEQ ID NO: 6019487 - DNA, 14 bp, Homo sapiens
catccccaccagct

SEQ ID NO: 6019488 - DNA, 16 bp, Homo sapiens
cagctcaaagagtaaa

SEQ ID NO: 6019489 - DNA, 16 bp, Homo sapiens
cagctcaactcacagc

SEQ ID NO: 6019490 - DNA, 19 bp, Homo sapiens
cagctcaactcacagcttc

SEQ ID NO: 6019491 - DNA, 21 bp, Homo sapiens
cagctcaactcgggggcgcct

SEQ ID NO: 6019492 - DNA, 22 bp, Homo sapiens
cagctcaactcgggggcgcctg

SEQ ID NO: 6019493 - DNA, 23 bp, Homo sapiens
cagctcaactcgggggcgcctgg

SEQ ID NO: 6019494 - DNA, 20 bp, Homo sapiens
cagctcaaggaaaggcctga

SEQ ID NO: 6019495 - DNA, 22 bp, Homo sapiens
cagctcaagggaccctgggtgg

SEQ ID NO: 6019496 - DNA, 15 bp, Homo sapiens
cagctcaagggctgg

SEQ ID NO: 6019497 - DNA, 16 bp, Homo sapiens
cagctcaagggctggc

SEQ ID NO: 6019498 - DNA, 19 bp, Homo sapiens
cagctcaagtcttccctga

SEQ ID NO: 6019499 - DNA, 22 bp, Homo sapiens
cagctcaagtcttccctgatca

SEQ ID NO: 6019500 - DNA, 17 bp, Homo sapiens
cagctcacaagcccagg

SEQ ID NO: 6019501 - DNA, 22 bp, Homo sapiens
cagctcacaccctaccttcccc

SEQ ID NO: 6019502 - DNA, 23 bp, Homo sapiens
cagctcacaccctaccttcccca

SEQ ID NO: 6019503 - DNA, 13 bp, Homo sapiens
cagctcacagtgc

SEQ ID NO: 6019504 - DNA, 20 bp, Homo sapiens
cagctcacagtgctgtgtgc

SEQ ID NO: 6019505 - DNA, 13 bp, Homo sapiens
cagctcaccagcc

SEQ ID NO: 6019506 - DNA, 14 bp, Homo sapiens
cagctcaccagccc

SEQ ID NO: 6019507 - DNA, 15 bp, Homo sapiens
cagctcaccagcccc

SEQ ID NO: 6019508 - DNA, 16 bp, Homo sapiens
cagctcaccagcccca

SEQ ID NO: 6019509 - DNA, 18 bp, Homo sapiens
cagctcaccccccacact

SEQ ID NO: 6019510 - DNA, 13 bp, Homo sapiens
cagctcacccctg

SEQ ID NO: 6019511 - DNA, 14 bp, Homo sapiens
cagctcacccctgg

SEQ ID NO: 6019512 - DNA, 16 bp, Homo sapiens
cagctcacctctccct

SEQ ID NO: 6019513 - DNA, 20 bp, Homo sapiens
cagctcacctctcccttgga

SEQ ID NO: 6019514 - DNA, 16 bp, Homo sapiens
cagctcacctctgaag

SEQ ID NO: 6019515 - DNA, 19 bp, Homo sapiens
cagctcacctctgaaggca

SEQ ID NO: 6019516 - DNA, 13 bp, Homo sapiens
cagctcacgcttc

SEQ ID NO: 6019517 - DNA, 16 bp, Homo sapiens
cagctcacggcagcct

SEQ ID NO: 6019518 - DNA, 19 bp, Homo sapiens
cagctcacggcagcctcaa

SEQ ID NO: 6019519 - DNA, 20 bp, Homo sapiens
cagctcacgtaatgcattgc

SEQ ID NO: 6019520 - DNA, 14 bp, Homo sapiens
cagctcactccctg

SEQ ID NO: 6019521 - DNA, 15 bp, Homo sapiens
cagctcactccctgg

SEQ ID NO: 6019522 - DNA, 15 bp, Homo sapiens
cagctcactgcaacc

SEQ ID NO: 6019523 - DNA, 15 bp, Homo sapiens
cagctcactgcagcc

SEQ ID NO: 6019524 - DNA, 19 bp, Homo sapiens
cagctcagaacccagggct

SEQ ID NO: 6019525 - DNA, 12 bp, Homo sapiens
cagctcagagag

SEQ ID NO: 6019526 - DNA, 19 bp, Homo sapiens
cagctcagagagggtggga

SEQ ID NO: 6019527 - DNA, 16 bp, Homo sapiens
cagctcagagccccgc

SEQ ID NO: 6019528 - DNA, 21 bp, Homo sapiens
cagctcagcactgcctgctcc

SEQ ID NO: 6019529 - DNA, 17 bp, Homo sapiens
cagctcagcattgtgta

SEQ ID NO: 6019530 - DNA, 21 bp, Homo sapiens
cagctcagccaccactcagtg

SEQ ID NO: 6019531 - DNA, 15 bp, Homo sapiens
cagctcagccagtgg

SEQ ID NO: 6019532 - DNA, 17 bp, Homo sapiens
cagctcagccccggcca

SEQ ID NO: 6019533 - DNA, 21 bp, Homo sapiens
cagctcagccctggcctggct

SEQ ID NO: 6019534 - DNA, 12 bp, Homo sapiens
cagctcagcctc

SEQ ID NO: 6019535 - DNA, 22 bp, Homo sapiens
cagctcagcctccccctgctgc

SEQ ID NO: 6019536 - DNA, 23 bp, Homo sapiens
cagctcagcctccccctgctgct

SEQ ID NO: 6019537 - DNA, 13 bp, Homo sapiens
cagctcagcgcca

SEQ ID NO: 6019538 - DNA, 18 bp, Homo sapiens
cagctcagcgccagcctg

SEQ ID NO: 6019539 - DNA, 12 bp, Homo sapiens
cagctcagctgc

SEQ ID NO: 6019540 - DNA, 13 bp, Homo sapiens
cagctcagcttcc

SEQ ID NO: 6019541 - DNA, 10 bp, Homo sapiens
cagctcagga

SEQ ID NO: 6019542 - DNA, 22 bp, Homo sapiens
cagctcaggacagatgccacac

SEQ ID NO: 6019543 - DNA, 12 bp, Homo sapiens
cagctcaggaga

SEQ ID NO: 6019544 - DNA, 13 bp, Homo sapiens
cagctcaggatct

SEQ ID NO: 6019545 - DNA, 14 bp, Homo sapiens
cagctcaggcagct

SEQ ID NO: 6019546 - DNA, 15 bp, Homo sapiens
cagctcaggcgcagc

SEQ ID NO: 6019547 - DNA, 17 bp, Homo sapiens
cagctcaggcgcagccc

SEQ ID NO: 6019548 - DNA, 22 bp, Homo sapiens
cagctcaggctactgccactca

SEQ ID NO: 6019549 - DNA, 19 bp, Homo sapiens
cagctcaggggacactggc

SEQ ID NO: 6019550 - DNA, 13 bp, Homo sapiens
cagctcaggtgac

SEQ ID NO: 6019551 - DNA, 14 bp, Homo sapiens
cagctcagtcccac

SEQ ID NO: 6019552 - DNA, 17 bp, Homo sapiens
cagctcagtcccacagc

SEQ ID NO: 6019553 - DNA, 19 bp, Homo sapiens
cagctcagtcccacagccc

SEQ ID NO: 6019554 - DNA, 13 bp, Homo sapiens
cagctcagtgcca

SEQ ID NO: 6019555 - DNA, 17 bp, Homo sapiens
cagctcataaaatggaa

SEQ ID NO: 6019556 - DNA, 23 bp, Homo sapiens
cagctcatagtgaacacagcaga

SEQ ID NO: 6019557 - DNA, 22 bp, Homo sapiens
cagctcatcttttcctgcttag

SEQ ID NO: 6019558 - DNA, 17 bp, Homo sapiens
cagctcatgcccccttt

SEQ ID NO: 6019559 - DNA, 20 bp, Homo sapiens
cagctcatgtaggtgagcct

SEQ ID NO: 6019560 - DNA, 22 bp, Homo sapiens
cagctcatgtaggtgagcctgg

SEQ ID NO: 6019561 - DNA, 14 bp, Homo sapiens
cagctcattaaact

SEQ ID NO: 6019562 - DNA, 17 bp, Homo sapiens
cagctccaacagcttga

SEQ ID NO: 6019563 - DNA, 14 bp, Homo sapiens
cagctccaacctgc

SEQ ID NO: 6019564 - DNA, 23 bp, Homo sapiens
cagctccaacctgcaaagatctg

SEQ ID NO: 6019565 - DNA, 16 bp, Homo sapiens
cagctccaacctggag

SEQ ID NO: 6019566 - DNA, 18 bp, Homo sapiens
cagctccaagacctgttg

SEQ ID NO: 6019567 - DNA, 20 bp, Homo sapiens
cagctccaagacctgttggt

SEQ ID NO: 6019568 - DNA, 18 bp, Homo sapiens
cagctccacacattccag

SEQ ID NO: 6019569 - DNA, 17 bp, Homo sapiens
cagctccacacgccccg

SEQ ID NO: 6019570 - DNA, 16 bp, Homo sapiens
cagctccacagggtgg

SEQ ID NO: 6019571 - DNA, 19 bp, Homo sapiens
cagctccactcagggctgg

SEQ ID NO: 6019572 - DNA, 19 bp, Homo sapiens
cagctccagaataccttct

SEQ ID NO: 6019573 - DNA, 22 bp, Homo sapiens
cagctccagatgtttctcattt

SEQ ID NO: 6019574 - DNA, 15 bp, Homo sapiens
cagctccagctcacc

SEQ ID NO: 6019575 - DNA, 20 bp, Homo sapiens
cagctccagctcaccagccc

SEQ ID NO: 6019576 - DNA, 13 bp, Homo sapiens
cagctccaggaca

SEQ ID NO: 6019577 - DNA, 14 bp, Homo sapiens
cagctccaggacac

SEQ ID NO: 6019578 - DNA, 11 bp, Homo sapiens
cagctccaggc

SEQ ID NO: 6019579 - DNA, 15 bp, Homo sapiens
cagctccaggcagga

SEQ ID NO: 6019580 - DNA, 14 bp, Homo sapiens
cagctccaggccca

SEQ ID NO: 6019581 - DNA, 15 bp, Homo sapiens
cagctccaggcccac

SEQ ID NO: 6019582 - DNA, 16 bp, Homo sapiens
cagctccaggcccacc

SEQ ID NO: 6019583 - DNA, 17 bp, Homo sapiens
cagctccaggcccaccg

SEQ ID NO: 6019584 - DNA, 20 bp, Homo sapiens
cagctccagggaatccaagc

SEQ ID NO: 6019585 - DNA, 14 bp, Homo sapiens
cagctccaggggcc

SEQ ID NO: 6019586 - DNA, 20 bp, Homo sapiens
cagctccaggggcccttggg

SEQ ID NO: 6019587 - DNA, 17 bp, Homo sapiens
cagctccaggtggctct

SEQ ID NO: 6019588 - DNA, 21 bp, Homo sapiens
cagctccagtgccgctcctgc

SEQ ID NO: 6019589 - DNA, 19 bp, Homo sapiens
cagctccatcctcttgact

SEQ ID NO: 6019590 - DNA, 20 bp, Homo sapiens
cagctccatgttctcccaaa

SEQ ID NO: 6019591 - DNA, 14 bp, Homo sapiens
cagctccattttct

SEQ ID NO: 6019592 - DNA, 16 bp, Homo sapiens
cagctcccaacagagg

SEQ ID NO: 6019593 - DNA, 21 bp, Homo sapiens
cagctcccaacagaggcctcc

SEQ ID NO: 6019594 - DNA, 23 bp, Homo sapiens
cagctcccaacgagcctcctcag

SEQ ID NO: 6019595 - DNA, 19 bp, Homo sapiens
cagctcccacaagcctctg

SEQ ID NO: 6019596 - DNA, 12 bp, Homo sapiens
cagctcccacac

SEQ ID NO: 6019597 - DNA, 12 bp, Homo sapiens
cagctcccaccc

SEQ ID NO: 6019598 - DNA, 19 bp, Homo sapiens
cagctcccaccccaccccc

SEQ ID NO: 6019599 - DNA, 13 bp, Homo sapiens
cagctcccactcc

SEQ ID NO: 6019600 - DNA, 20 bp, Homo sapiens
cagctcccactccctttcca

SEQ ID NO: 6019601 - DNA, 18 bp, Homo sapiens
cagctcccaggaccacag

SEQ ID NO: 6019602 - DNA, 24 bp, Homo sapiens
cagctcccaggaccacaggctcag

SEQ ID NO: 6019603 - DNA, 12 bp, Homo sapiens
cagctcccaggc

SEQ ID NO: 6019604 - DNA, 13 bp, Homo sapiens
cagctcccaggcc

SEQ ID NO: 6019605 - DNA, 17 bp, Homo sapiens
cagctcccatagcgctg

SEQ ID NO: 6019606 - DNA, 19 bp, Homo sapiens
cagctcccatttctactct

SEQ ID NO: 6019607 - DNA, 15 bp, Homo sapiens
cagctccccagagtc

SEQ ID NO: 6019608 - DNA, 16 bp, Homo sapiens
cagctccccagcccac

SEQ ID NO: 6019609 - DNA, 13 bp, Homo sapiens
cagctccccagga

SEQ ID NO: 6019610 - DNA, 14 bp, Homo sapiens
cagctccccaggac

SEQ ID NO: 6019611 - DNA, 23 bp, Homo sapiens
cagctccccaggactcaccctca

SEQ ID NO: 6019612 - DNA, 16 bp, Homo sapiens
cagctcccccagctcc

SEQ ID NO: 6019613 - DNA, 15 bp, Homo sapiens
cagctcccccaggca

SEQ ID NO: 6019614 - DNA, 16 bp, Homo sapiens
cagctcccccaggcag

SEQ ID NO: 6019615 - DNA, 17 bp, Homo sapiens
cagctcccccaggcaga

SEQ ID NO: 6019616 - DNA, 18 bp, Homo sapiens
cagctcccccaggcagaa

SEQ ID NO: 6019617 - DNA, 15 bp, Homo sapiens
cagctcccccaggct

SEQ ID NO: 6019618 - DNA, 17 bp, Homo sapiens
cagctcccccaggctgt

SEQ ID NO: 6019619 - DNA, 21 bp, Homo sapiens
cagctcccccaggctgttctc

SEQ ID NO: 6019620 - DNA, 13 bp, Homo sapiens
cagctccccccgc

SEQ ID NO: 6019621 - DNA, 17 bp, Homo sapiens
cagctccccccgcccac

SEQ ID NO: 6019622 - DNA, 15 bp, Homo sapiens
cagctccccctgtcc

SEQ ID NO: 6019623 - DNA, 16 bp, Homo sapiens
cagctccccctgtccc

SEQ ID NO: 6019624 - DNA, 15 bp, Homo sapiens
cagctcccccttgcc

SEQ ID NO: 6019625 - DNA, 19 bp, Homo sapiens
cagctcccccttgcccgcc

SEQ ID NO: 6019626 - DNA, 20 bp, Homo sapiens
cagctcccccttgcccgcca

SEQ ID NO: 6019627 - DNA, 18 bp, Homo sapiens
cagctccccggcactgca

SEQ ID NO: 6019628 - DNA, 17 bp, Homo sapiens
cagctccccgggggcca

SEQ ID NO: 6019629 - DNA, 18 bp, Homo sapiens
cagctccccgggggccaa

SEQ ID NO: 6019630 - DNA, 16 bp, Homo sapiens
cagctcccctcggaga

SEQ ID NO: 6019631 - DNA, 17 bp, Homo sapiens
cagctcccctcggagaa

SEQ ID NO: 6019632 - DNA, 20 bp, Homo sapiens
cagctcccctcggagaagag

SEQ ID NO: 6019633 - DNA, 15 bp, Homo sapiens
cagctcccctctttt

SEQ ID NO: 6019634 - DNA, 13 bp, Homo sapiens
cagctccctagac

SEQ ID NO: 6019635 - DNA, 14 bp, Homo sapiens
cagctccctagact

SEQ ID NO: 6019636 - DNA, 23 bp, Homo sapiens
cagctccctagactgcatcccgt

SEQ ID NO: 6019637 - DNA, 20 bp, Homo sapiens
cagctccctaggagaccaag

SEQ ID NO: 6019638 - DNA, 20 bp, Homo sapiens
cagctccctcccctgctcag

SEQ ID NO: 6019639 - DNA, 21 bp, Homo sapiens
cagctccctcctgcacacaga

SEQ ID NO: 6019640 - DNA, 23 bp, Homo sapiens
cagctccctcgtcttcagctgca

SEQ ID NO: 6019641 - DNA, 15 bp, Homo sapiens
cagctccctgacccc

SEQ ID NO: 6019642 - DNA, 14 bp, Homo sapiens
cagctccctgcacc

SEQ ID NO: 6019643 - DNA, 15 bp, Homo sapiens
cagctccctgcaccg

SEQ ID NO: 6019644 - DNA, 19 bp, Homo sapiens
cagctccctgccaaactga

SEQ ID NO: 6019645 - DNA, 16 bp, Homo sapiens
cagctccctgcctgtt

SEQ ID NO: 6019646 - DNA, 15 bp, Homo sapiens
cagctccctggaaag

SEQ ID NO: 6019647 - DNA, 20 bp, Homo sapiens
cagctccctggcttctgtgg

SEQ ID NO: 6019648 - DNA, 22 bp, Homo sapiens
cagctccctgtgcccccagggt

SEQ ID NO: 6019649 - DNA, 14 bp, Homo sapiens
cagctcccttccct

SEQ ID NO: 6019650 - DNA, 17 bp, Homo sapiens
cagctcccttcccttga

SEQ ID NO: 6019651 - DNA, 12 bp, Homo sapiens
cagctcccttct

SEQ ID NO: 6019652 - DNA, 14 bp, Homo sapiens
cagctcccttctct

SEQ ID NO: 6019653 - DNA, 22 bp, Homo sapiens
cagctcccttgggaaggacaca

SEQ ID NO: 6019654 - DNA, 23 bp, Homo sapiens
cagctcccttgggaaggacacag

SEQ ID NO: 6019655 - DNA, 16 bp, Homo sapiens
cagctccctttctcag

SEQ ID NO: 6019656 - DNA, 21 bp, Homo sapiens
cagctccctttctcaggagct

SEQ ID NO: 6019657 - DNA, 18 bp, Homo sapiens
cagctccgacctctctca

SEQ ID NO: 6019658 - DNA, 18 bp, Homo sapiens
cagctccgagctgtagga

SEQ ID NO: 6019659 - DNA, 15 bp, Homo sapiens
cagctccgcctggca

SEQ ID NO: 6019660 - DNA, 17 bp, Homo sapiens
cagctccgcctggcacc

SEQ ID NO: 6019661 - DNA, 23 bp, Homo sapiens
cagctccgcctggcacccactcc

SEQ ID NO: 6019662 - DNA, 20 bp, Homo sapiens
cagctccgcgctcggggctg

SEQ ID NO: 6019663 - DNA, 19 bp, Homo sapiens
cagctccggaaggacacag

SEQ ID NO: 6019664 - DNA, 21 bp, Homo sapiens
cagctccggaaggacacagtc

SEQ ID NO: 6019665 - DNA, 23 bp, Homo sapiens
cagctccggagggggtcctcctc

SEQ ID NO: 6019666 - DNA, 16 bp, Homo sapiens
cagctccgggatcagc

SEQ ID NO: 6019667 - DNA, 16 bp, Homo sapiens
catccccaccagctcg

SEQ ID NO: 6019668 - DNA, 17 bp, Homo sapiens
catccccaccagctcgt

SEQ ID NO: 6019669 - DNA, 24 bp, Homo sapiens
catccccaccctcccctctcctga

SEQ ID NO: 6019670 - DNA, 11 bp, Homo sapiens
catccccacct

SEQ ID NO: 6019671 - DNA, 15 bp, Homo sapiens
catccccaccttcca

SEQ ID NO: 6019672 - DNA, 22 bp, Homo sapiens
catccccacgtggacaagaaag

SEQ ID NO: 6019673 - DNA, 14 bp, Homo sapiens
catccccactcacg

SEQ ID NO: 6019674 - DNA, 13 bp, Homo sapiens
catccccagagcc

SEQ ID NO: 6019675 - DNA, 15 bp, Homo sapiens
catccccagagccca

SEQ ID NO: 6019676 - DNA, 16 bp, Homo sapiens
catccccagagcccag

SEQ ID NO: 6019677 - DNA, 18 bp, Homo sapiens
catccccagagcccagct

SEQ ID NO: 6019678 - DNA, 20 bp, Homo sapiens
catccccagagcccagctct

SEQ ID NO: 6019679 - DNA, 14 bp, Homo sapiens
catccccaggtctc

SEQ ID NO: 6019680 - DNA, 21 bp, Homo sapiens
catccccaggtctctccactg

SEQ ID NO: 6019681 - DNA, 18 bp, Homo sapiens
catccccagtgccagctg

SEQ ID NO: 6019682 - DNA, 12 bp, Homo sapiens
catccccatccc

SEQ ID NO: 6019683 - DNA, 17 bp, Homo sapiens
catccccatcggccctg

SEQ ID NO: 6019684 - DNA, 12 bp, Homo sapiens
catcccccaaag

SEQ ID NO: 6019685 - DNA, 14 bp, Homo sapiens
catcccccaaagtt

SEQ ID NO: 6019686 - DNA, 21 bp, Homo sapiens
catcccccacctactctcagg

SEQ ID NO: 6019687 - DNA, 12 bp, Homo sapiens
catcccccctca

SEQ ID NO: 6019688 - DNA, 13 bp, Homo sapiens
catcccccctcac

SEQ ID NO: 6019689 - DNA, 16 bp, Homo sapiens
catcccccctgctcag

SEQ ID NO: 6019690 - DNA, 18 bp, Homo sapiens
catcccccctgctgccca

SEQ ID NO: 6019691 - DNA, 18 bp, Homo sapiens
catccccctcctctccct

SEQ ID NO: 6019692 - DNA, 20 bp, Homo sapiens
catccccctccttgccgctg

SEQ ID NO: 6019693 - DNA, 20 bp, Homo sapiens
catccccctctgtctgccct

SEQ ID NO: 6019694 - DNA, 12 bp, Homo sapiens
catccccctgcc

SEQ ID NO: 6019695 - DNA, 22 bp, Homo sapiens
catcccccttcttcctcccctc

SEQ ID NO: 6019696 - DNA, 20 bp, Homo sapiens
catcccctcaacaccctgct

SEQ ID NO: 6019697 - DNA, 17 bp, Homo sapiens
catcccctccctgcctg

SEQ ID NO: 6019698 - DNA, 20 bp, Homo sapiens
catcccctccctgcctgctc

SEQ ID NO: 6019699 - DNA, 16 bp, Homo sapiens
catcccctcctagcac

SEQ ID NO: 6019700 - DNA, 15 bp, Homo sapiens
catcccctgcctcca

SEQ ID NO: 6019701 - DNA, 15 bp, Homo sapiens
catcccctgcctcta

SEQ ID NO: 6019702 - DNA, 18 bp, Homo sapiens
catccccttagaggacct

SEQ ID NO: 6019703 - DNA, 12 bp, Homo sapiens
catccccttcca

SEQ ID NO: 6019704 - DNA, 15 bp, Homo sapiens
catccccttccccca

SEQ ID NO: 6019705 - DNA, 21 bp, Homo sapiens
catccccttcccccatcccta

SEQ ID NO: 6019706 - DNA, 22 bp, Homo sapiens
catccccttcccccatccctac

SEQ ID NO: 6019707 - DNA, 22 bp, Homo sapiens
catccccttgaggtctcagccc

SEQ ID NO: 6019708 - DNA, 12 bp, Homo sapiens
catcccctttcc

SEQ ID NO: 6019709 - DNA, 19 bp, Homo sapiens
catcccgcgcgcccttcct

SEQ ID NO: 6019710 - DNA, 22 bp, Homo sapiens
catcccgctggtgcctcccggg

SEQ ID NO: 6019711 - DNA, 18 bp, Homo sapiens
catcccgcttagcctgcc

SEQ ID NO: 6019712 - DNA, 20 bp, Homo sapiens
catcccgcttagcctgcctc

SEQ ID NO: 6019713 - DNA, 22 bp, Homo sapiens
catcccgcttagcctgcctcac

SEQ ID NO: 6019714 - DNA, 16 bp, Homo sapiens
catcccggaggaaatc

SEQ ID NO: 6019715 - DNA, 17 bp, Homo sapiens
catcccggaggaaatct

SEQ ID NO: 6019716 - DNA, 18 bp, Homo sapiens
catcccggaggaaatctg

SEQ ID NO: 6019717 - DNA, 21 bp, Homo sapiens
catcccgggacgcagcaggag

SEQ ID NO: 6019718 - DNA, 23 bp, Homo sapiens
catcccgggcctcagtgccccat

SEQ ID NO: 6019719 - DNA, 19 bp, Homo sapiens
catcccgtatcacagtgtt

SEQ ID NO: 6019720 - DNA, 20 bp, Homo sapiens
catcccgtgcaaaacatgct

SEQ ID NO: 6019721 - DNA, 14 bp, Homo sapiens
catcccgtgttctc

SEQ ID NO: 6019722 - DNA, 17 bp, Homo sapiens
catcccgtttccctcca

SEQ ID NO: 6019723 - DNA, 18 bp, Homo sapiens
catccctaagaattccca

SEQ ID NO: 6019724 - DNA, 13 bp, Homo sapiens
catccctaccact

SEQ ID NO: 6019725 - DNA, 14 bp, Homo sapiens
catccctaccactg

SEQ ID NO: 6019726 - DNA, 12 bp, Homo sapiens
catccctacccc

SEQ ID NO: 6019727 - DNA, 22 bp, Homo sapiens
catccctaccccctaagagcca

SEQ ID NO: 6019728 - DNA, 13 bp, Homo sapiens
catccctcaactg

SEQ ID NO: 6019729 - DNA, 15 bp, Homo sapiens
catccctcaactgag

SEQ ID NO: 6019730 - DNA, 19 bp, Homo sapiens
catccctcatctagtcttg

SEQ ID NO: 6019731 - DNA, 23 bp, Homo sapiens
catccctccaccccagtccccgg

SEQ ID NO: 6019732 - DNA, 14 bp, Homo sapiens
catccctccattca

SEQ ID NO: 6019733 - DNA, 18 bp, Homo sapiens
catccctcccccagcaga

SEQ ID NO: 6019734 - DNA, 14 bp, Homo sapiens
catccctccctcca

SEQ ID NO: 6019735 - DNA, 23 bp, Homo sapiens
catccctccctcccgtccttccc

SEQ ID NO: 6019736 - DNA, 15 bp, Homo sapiens
catccctcctgcttt

SEQ ID NO: 6019737 - DNA, 14 bp, Homo sapiens
catccctcctggta

SEQ ID NO: 6019738 - DNA, 15 bp, Homo sapiens
catccctccttgcct

SEQ ID NO: 6019739 - DNA, 13 bp, Homo sapiens
catccctgaaggc

SEQ ID NO: 6019740 - DNA, 17 bp, Homo sapiens
catccctgaaggccccg

SEQ ID NO: 6019741 - DNA, 22 bp, Homo sapiens
catccctgaaggccccgcccag

SEQ ID NO: 6019742 - DNA, 16 bp, Homo sapiens
catccctgactggcca

SEQ ID NO: 6019743 - DNA, 13 bp, Homo sapiens
catccctgcagag

SEQ ID NO: 6019744 - DNA, 12 bp, Homo sapiens
catccctgccaa

SEQ ID NO: 6019745 - DNA, 12 bp, Homo sapiens
catccctgccac

SEQ ID NO: 6019746 - DNA, 13 bp, Homo sapiens
catccctgccaca

SEQ ID NO: 6019747 - DNA, 23 bp, Homo sapiens
catccctgccacatacaggtgct

SEQ ID NO: 6019748 - DNA, 18 bp, Homo sapiens
catccctgcctggaggct

SEQ ID NO: 6019749 - DNA, 14 bp, Homo sapiens
catccctgcctggt

SEQ ID NO: 6019750 - DNA, 12 bp, Homo sapiens
catccctgctct

SEQ ID NO: 6019751 - DNA, 19 bp, Homo sapiens
catccctgcttatttttaa

SEQ ID NO: 6019752 - DNA, 18 bp, Homo sapiens
catccctgcttctggcgc

SEQ ID NO: 6019753 - DNA, 19 bp, Homo sapiens
catccctgcttgcccgctc

SEQ ID NO: 6019754 - DNA, 22 bp, Homo sapiens
catccctgcttgcccgctccca

SEQ ID NO: 6019755 - DNA, 23 bp, Homo sapiens
catccctgcttgcccgctcccac

SEQ ID NO: 6019756 - DNA, 13 bp, Homo sapiens
catccctggagca

SEQ ID NO: 6019757 - DNA, 19 bp, Homo sapiens
catccctggagcaggagcc

SEQ ID NO: 6019758 - DNA, 22 bp, Homo sapiens
catccctggagcaggagccccg

SEQ ID NO: 6019759 - DNA, 10 bp, Homo sapiens
catccctggc

SEQ ID NO: 6019760 - DNA, 20 bp, Homo sapiens
catccctggccccctccctg

SEQ ID NO: 6019761 - DNA, 12 bp, Homo sapiens
catccctggctg

SEQ ID NO: 6019762 - DNA, 17 bp, Homo sapiens
catccctggctgacctg

SEQ ID NO: 6019763 - DNA, 18 bp, Homo sapiens
catccctggctgacctgc

SEQ ID NO: 6019764 - DNA, 20 bp, Homo sapiens
catccctggctgacctgctg

SEQ ID NO: 6019765 - DNA, 12 bp, Homo sapiens
catccctgggcc

SEQ ID NO: 6019766 - DNA, 19 bp, Homo sapiens
catccctgggcccctccac

SEQ ID NO: 6019767 - DNA, 15 bp, Homo sapiens
catccctgggcctgc

SEQ ID NO: 6019768 - DNA, 16 bp, Homo sapiens
catccctgggcctgct

SEQ ID NO: 6019769 - DNA, 18 bp, Homo sapiens
catccctgggcctgctgc

SEQ ID NO: 6019770 - DNA, 19 bp, Homo sapiens
catccctggtgaaagagta

SEQ ID NO: 6019771 - DNA, 13 bp, Homo sapiens
catccctgtcctc

SEQ ID NO: 6019772 - DNA, 12 bp, Homo sapiens
catccctgtgag

SEQ ID NO: 6019773 - DNA, 12 bp, Homo sapiens
catccctgtggt

SEQ ID NO: 6019774 - DNA, 20 bp, Homo sapiens
catccctgtgtccactgaga

SEQ ID NO: 6019775 - DNA, 22 bp, Homo sapiens
catcccttcaaccccacttcct

SEQ ID NO: 6019776 - DNA, 13 bp, Homo sapiens
catcccttcccca

SEQ ID NO: 6019777 - DNA, 16 bp, Homo sapiens
catcccttccctgtcc

SEQ ID NO: 6019778 - DNA, 21 bp, Homo sapiens
catcccttccctgtccacctc

SEQ ID NO: 6019779 - DNA, 14 bp, Homo sapiens
catcccttcctccc

SEQ ID NO: 6019780 - DNA, 16 bp, Homo sapiens
catcccttcctcccca

SEQ ID NO: 6019781 - DNA, 22 bp, Homo sapiens
catcccttcctcctctcctgga

SEQ ID NO: 6019782 - DNA, 13 bp, Homo sapiens
catcccttcctgg

SEQ ID NO: 6019783 - DNA, 20 bp, Homo sapiens
catcccttcctggaaacagc

SEQ ID NO: 6019784 - DNA, 22 bp, Homo sapiens
catcccttcctggaaacagcat

SEQ ID NO: 6019785 - DNA, 19 bp, Homo sapiens
catcccttcggagccaaca

SEQ ID NO: 6019786 - DNA, 20 bp, Homo sapiens
catcccttgaccaggcctgg

SEQ ID NO: 6019787 - DNA, 17 bp, Homo sapiens
catcccttggcccctct

SEQ ID NO: 6019788 - DNA, 18 bp, Homo sapiens
catcccttggcccctctc

SEQ ID NO: 6019789 - DNA, 19 bp, Homo sapiens
catcccttggcccctctct

SEQ ID NO: 6019790 - DNA, 19 bp, Homo sapiens
catccctttctaagcagga

SEQ ID NO: 6019791 - DNA, 14 bp, Homo sapiens
catcccttttcctg

SEQ ID NO: 6019792 - DNA, 18 bp, Homo sapiens
catcccttttcctttctg

SEQ ID NO: 6019793 - DNA, 22 bp, Homo sapiens
catcccttttcctttctggccc

SEQ ID NO: 6019794 - DNA, 20 bp, Homo sapiens
catccgaagatggtggccac

SEQ ID NO: 6019795 - DNA, 15 bp, Homo sapiens
catccgactgcccct

SEQ ID NO: 6019796 - DNA, 16 bp, Homo sapiens
catccgactgcccctg

SEQ ID NO: 6019797 - DNA, 13 bp, Homo sapiens
catccgaggcagg

SEQ ID NO: 6019798 - DNA, 15 bp, Homo sapiens
catccgaggcagggt

SEQ ID NO: 6019799 - DNA, 23 bp, Homo sapiens
catccgaggcagggtcaggagag

SEQ ID NO: 6019800 - DNA, 19 bp, Homo sapiens
catccgcagactgcttggc

SEQ ID NO: 6019801 - DNA, 22 bp, Homo sapiens
catccgcagactgcttggccag

SEQ ID NO: 6019802 - DNA, 13 bp, Homo sapiens
catccgcagccca

SEQ ID NO: 6019803 - DNA, 14 bp, Homo sapiens
catccgcagcccag

SEQ ID NO: 6019804 - DNA, 15 bp, Homo sapiens
catccgcagcccagg

SEQ ID NO: 6019805 - DNA, 14 bp, Homo sapiens
catccgccagggcc

SEQ ID NO: 6019806 - DNA, 22 bp, Homo sapiens
catccgcctctgagccaggagc

SEQ ID NO: 6019807 - DNA, 14 bp, Homo sapiens
catccgcctggccc

SEQ ID NO: 6019808 - DNA, 16 bp, Homo sapiens
catccgccttttgtat

SEQ ID NO: 6019809 - DNA, 20 bp, Homo sapiens
catccggagaattgcctcta

SEQ ID NO: 6019810 - DNA, 23 bp, Homo sapiens
catccggcatgagggctgagatg

SEQ ID NO: 6019811 - DNA, 14 bp, Homo sapiens
catccggctcctgt

SEQ ID NO: 6019812 - DNA, 15 bp, Homo sapiens
catccgggacgcttc

SEQ ID NO: 6019813 - DNA, 16 bp, Homo sapiens
catccgggacgcttcc

SEQ ID NO: 6019814 - DNA, 19 bp, Homo sapiens
catccgggacgcttccaga

SEQ ID NO: 6019815 - DNA, 24 bp, Homo sapiens
catccgggacgcttccagaccacc

SEQ ID NO: 6019816 - DNA, 16 bp, Homo sapiens
catccgtagttccctg

SEQ ID NO: 6019817 - DNA, 17 bp, Homo sapiens
catccgtagttccctga

SEQ ID NO: 6019818 - DNA, 21 bp, Homo sapiens
catccgtagttccctgaaaac

SEQ ID NO: 6019819 - DNA, 19 bp, Homo sapiens
catccgtcattgctgctgc

SEQ ID NO: 6019820 - DNA, 15 bp, Homo sapiens
catccgtcccacatc

SEQ ID NO: 6019821 - DNA, 19 bp, Homo sapiens
catccgtcccacatcaggg

SEQ ID NO: 6019822 - DNA, 13 bp, Homo sapiens
catccgtcctggg

SEQ ID NO: 6019823 - DNA, 21 bp, Homo sapiens
catccgtctgtctgtcgccct

SEQ ID NO: 6019824 - DNA, 23 bp, Homo sapiens
catccgtgagcagtgtgtctcct

SEQ ID NO: 6019825 - DNA, 17 bp, Homo sapiens
catccgtgcctcttttt

SEQ ID NO: 6019826 - DNA, 23 bp, Homo sapiens
catccgttgtgactctaggcttc

SEQ ID NO: 6019827 - DNA, 13 bp, Homo sapiens
catccgtttttta

SEQ ID NO: 6019828 - DNA, 16 bp, Homo sapiens
catcctaaaagccacc

SEQ ID NO: 6019829 - DNA, 14 bp, Homo sapiens
catcctaactccat

SEQ ID NO: 6019830 - DNA, 21 bp, Homo sapiens
catcctaactccatgtctctg

SEQ ID NO: 6019831 - DNA, 16 bp, Homo sapiens
catcctaagaaatatg

SEQ ID NO: 6019832 - DNA, 17 bp, Homo sapiens
catcctaagaaatatgt

SEQ ID NO: 6019833 - DNA, 18 bp, Homo sapiens
catcctaaggttcttgct

SEQ ID NO: 6019834 - DNA, 19 bp, Homo sapiens
catcctaagtgggaagtga

SEQ ID NO: 6019835 - DNA, 15 bp, Homo sapiens
catcctaccaatgca

SEQ ID NO: 6019836 - DNA, 21 bp, Homo sapiens
catcctaccacaatgcagtgc

SEQ ID NO: 6019837 - DNA, 14 bp, Homo sapiens
catcctacccagcg

SEQ ID NO: 6019838 - DNA, 16 bp, Homo sapiens
catcctacccagcgtg

SEQ ID NO: 6019839 - DNA, 18 bp, Homo sapiens
catcctaccccctgtgcc

SEQ ID NO: 6019840 - DNA, 19 bp, Homo sapiens
catcctaccccctgtgcct

SEQ ID NO: 6019841 - DNA, 15 bp, Homo sapiens
catcctaccctcggg

SEQ ID NO: 6019842 - DNA, 14 bp, Homo sapiens
catcctactcctac

SEQ ID NO: 6019843 - DNA, 21 bp, Homo sapiens
catcctactcctacctggtca

SEQ ID NO: 6019844 - DNA, 17 bp, Homo sapiens
catcctagccccaccca

SEQ ID NO: 6019845 - DNA, 23 bp, Homo sapiens
catcctagccccacccagaggtg

SEQ ID NO: 6019846 - DNA, 20 bp, Homo sapiens
cagctccgtgtttctctaag

SEQ ID NO: 6019847 - DNA, 19 bp, Homo sapiens
cagctccgtttctaccacc

SEQ ID NO: 6019848 - DNA, 19 bp, Homo sapiens
cagctcctaacccttatca

SEQ ID NO: 6019849 - DNA, 14 bp, Homo sapiens
cagctcctcaccca

SEQ ID NO: 6019850 - DNA, 15 bp, Homo sapiens
cagctcctcacccag

SEQ ID NO: 6019851 - DNA, 13 bp, Homo sapiens
cagctcctcagcg

SEQ ID NO: 6019852 - DNA, 14 bp, Homo sapiens
cagctcctccagcc

SEQ ID NO: 6019853 - DNA, 17 bp, Homo sapiens
cagctcctccatgcctg

SEQ ID NO: 6019854 - DNA, 14 bp, Homo sapiens
cagctcctcccaca

SEQ ID NO: 6019855 - DNA, 14 bp, Homo sapiens
cagctcctcccctg

SEQ ID NO: 6019856 - DNA, 18 bp, Homo sapiens
cagctcctcccctgccgc

SEQ ID NO: 6019857 - DNA, 22 bp, Homo sapiens
cagctcctcccctgccgcctcc

SEQ ID NO: 6019858 - DNA, 13 bp, Homo sapiens
cagctcctccctg

SEQ ID NO: 6019859 - DNA, 21 bp, Homo sapiens
cagctcctcctcttggagctg

SEQ ID NO: 6019860 - DNA, 21 bp, Homo sapiens
cagctcctcgggtggggcctg

SEQ ID NO: 6019861 - DNA, 17 bp, Homo sapiens
cagctcctctaggggca

SEQ ID NO: 6019862 - DNA, 13 bp, Homo sapiens
cagctcctctcca

SEQ ID NO: 6019863 - DNA, 22 bp, Homo sapiens
cagctcctctccagacacagag

SEQ ID NO: 6019864 - DNA, 22 bp, Homo sapiens
cagctcctctccttgggctcct

SEQ ID NO: 6019865 - DNA, 23 bp, Homo sapiens
cagctcctctccttgggctcctg

SEQ ID NO: 6019866 - DNA, 14 bp, Homo sapiens
cagctcctctctga

SEQ ID NO: 6019867 - DNA, 13 bp, Homo sapiens
cagctcctctgag

SEQ ID NO: 6019868 - DNA, 14 bp, Homo sapiens
cagctcctctgagc

SEQ ID NO: 6019869 - DNA, 18 bp, Homo sapiens
cagctcctctgagccata

SEQ ID NO: 6019870 - DNA, 12 bp, Homo sapiens
cagctcctctta

SEQ ID NO: 6019871 - DNA, 21 bp, Homo sapiens
cagctcctcttcctgcctctc

SEQ ID NO: 6019872 - DNA, 14 bp, Homo sapiens
cagctcctgaataa

SEQ ID NO: 6019873 - DNA, 15 bp, Homo sapiens
cagctcctgaataaa

SEQ ID NO: 6019874 - DNA, 15 bp, Homo sapiens
cagctcctgaccaaa

SEQ ID NO: 6019875 - DNA, 15 bp, Homo sapiens
cagctcctgaccagt

SEQ ID NO: 6019876 - DNA, 19 bp, Homo sapiens
cagctcctgagtagctggg

SEQ ID NO: 6019877 - DNA, 21 bp, Homo sapiens
cagctcctgagtagctgggcc

SEQ ID NO: 6019878 - DNA, 12 bp, Homo sapiens
cagctcctgcca

SEQ ID NO: 6019879 - DNA, 11 bp, Homo sapiens
cagctcctgga

SEQ ID NO: 6019880 - DNA, 14 bp, Homo sapiens
cagctccttcctgg

SEQ ID NO: 6019881 - DNA, 16 bp, Homo sapiens
cagctccttcctggag

SEQ ID NO: 6019882 - DNA, 17 bp, Homo sapiens
cagctccttctgtccta

SEQ ID NO: 6019883 - DNA, 13 bp, Homo sapiens
cagctccttggct

SEQ ID NO: 6019884 - DNA, 16 bp, Homo sapiens
cagctccttggctgca

SEQ ID NO: 6019885 - DNA, 19 bp, Homo sapiens
cagctccttggctgcagcc

SEQ ID NO: 6019886 - DNA, 20 bp, Homo sapiens
cagctccttggctgcagcca

SEQ ID NO: 6019887 - DNA, 22 bp, Homo sapiens
cagctccttggctgcagccatc

SEQ ID NO: 6019888 - DNA, 18 bp, Homo sapiens
cagctccttgggaggaag

SEQ ID NO: 6019889 - DNA, 23 bp, Homo sapiens
cagctccttgggaggaagcagaa

SEQ ID NO: 6019890 - DNA, 21 bp, Homo sapiens
cagctccttggggcagggcct

SEQ ID NO: 6019891 - DNA, 18 bp, Homo sapiens
cagctccttggttccctc

SEQ ID NO: 6019892 - DNA, 13 bp, Homo sapiens
cagctccttgtga

SEQ ID NO: 6019893 - DNA, 11 bp, Homo sapiens
cagctcctttc

SEQ ID NO: 6019894 - DNA, 17 bp, Homo sapiens
cagctcctttccctgga

SEQ ID NO: 6019895 - DNA, 16 bp, Homo sapiens
cagctcctttctcctg

SEQ ID NO: 6019896 - DNA, 22 bp, Homo sapiens
cagctcctttctcctgtgaatg

SEQ ID NO: 6019897 - DNA, 23 bp, Homo sapiens
cagctcctttctgtcctggagct

SEQ ID NO: 6019898 - DNA, 16 bp, Homo sapiens
cagctccttttccaga

SEQ ID NO: 6019899 - DNA, 14 bp, Homo sapiens
cagctccttttctg

SEQ ID NO: 6019900 - DNA, 20 bp, Homo sapiens
cagctccttttgtccccagg

SEQ ID NO: 6019901 - DNA, 14 bp, Homo sapiens
cagctcgatccaaa

SEQ ID NO: 6019902 - DNA, 14 bp, Homo sapiens
cagctcgctgccca

SEQ ID NO: 6019903 - DNA, 18 bp, Homo sapiens
cagctcgctggctttctc

SEQ ID NO: 6019904 - DNA, 13 bp, Homo sapiens
cagctcggggagc

SEQ ID NO: 6019905 - DNA, 22 bp, Homo sapiens
cagctcggttaagtacccgagg

SEQ ID NO: 6019906 - DNA, 20 bp, Homo sapiens
cagctcgtttttcagcaccc

SEQ ID NO: 6019907 - DNA, 21 bp, Homo sapiens
cagctcgtttttcagcacccc

SEQ ID NO: 6019908 - DNA, 23 bp, Homo sapiens
cagctcgtttttcagcaccccca

SEQ ID NO: 6019909 - DNA, 21 bp, Homo sapiens
cagctctaaagcagagatgta

SEQ ID NO: 6019910 - DNA, 21 bp, Homo sapiens
cagctctaagcagccaggagg

SEQ ID NO: 6019911 - DNA, 18 bp, Homo sapiens
cagctctaagtctcaact

SEQ ID NO: 6019912 - DNA, 18 bp, Homo sapiens
cagctctacattctgctc

SEQ ID NO: 6019913 - DNA, 19 bp, Homo sapiens
cagctctacattctgctct

SEQ ID NO: 6019914 - DNA, 19 bp, Homo sapiens
cagctctaccctgcatggc

SEQ ID NO: 6019915 - DNA, 17 bp, Homo sapiens
cagctctacgtcccaca

SEQ ID NO: 6019916 - DNA, 15 bp, Homo sapiens
cagctctagcctctg

SEQ ID NO: 6019917 - DNA, 18 bp, Homo sapiens
cagctctagcctctggac

SEQ ID NO: 6019918 - DNA, 17 bp, Homo sapiens
cagctctagctttgcag

SEQ ID NO: 6019919 - DNA, 22 bp, Homo sapiens
cagctctaggctgttctgtagc

SEQ ID NO: 6019920 - DNA, 23 bp, Homo sapiens
cagctctatgtgggaaaaaagaa

SEQ ID NO: 6019921 - DNA, 14 bp, Homo sapiens
cagctctcactggc

SEQ ID NO: 6019922 - DNA, 12 bp, Homo sapiens
cagctctcagcc

SEQ ID NO: 6019923 - DNA, 20 bp, Homo sapiens
cagctctcagttacaagtgc

SEQ ID NO: 6019924 - DNA, 17 bp, Homo sapiens
cagctctcatctgaggc

SEQ ID NO: 6019925 - DNA, 18 bp, Homo sapiens
cagctctcatctgaggca

SEQ ID NO: 6019926 - DNA, 14 bp, Homo sapiens
cagctctcccacat

SEQ ID NO: 6019927 - DNA, 15 bp, Homo sapiens
cagctctcccatgga

SEQ ID NO: 6019928 - DNA, 21 bp, Homo sapiens
cagctctccccaggcatttgc

SEQ ID NO: 6019929 - DNA, 16 bp, Homo sapiens
cagctctcccctgcgc

SEQ ID NO: 6019930 - DNA, 14 bp, Homo sapiens
cagctctccctctg

SEQ ID NO: 6019931 - DNA, 20 bp, Homo sapiens
cagctctccctctggccctg

SEQ ID NO: 6019932 - DNA, 17 bp, Homo sapiens
cagctctcctggctccc

SEQ ID NO: 6019933 - DNA, 14 bp, Homo sapiens
cagctctcgttctc

SEQ ID NO: 6019934 - DNA, 17 bp, Homo sapiens
cagctctcgttctcctt

SEQ ID NO: 6019935 - DNA, 18 bp, Homo sapiens
cagctctcgttctccttc

SEQ ID NO: 6019936 - DNA, 21 bp, Homo sapiens
cagctctcgttctccttcccc

SEQ ID NO: 6019937 - DNA, 16 bp, Homo sapiens
cagctctctctacccg

SEQ ID NO: 6019938 - DNA, 13 bp, Homo sapiens
cagctctctctcc

SEQ ID NO: 6019939 - DNA, 16 bp, Homo sapiens
cagctctctctcctgg

SEQ ID NO: 6019940 - DNA, 15 bp, Homo sapiens
cagctctctgcagaa

SEQ ID NO: 6019941 - DNA, 14 bp, Homo sapiens
cagctctctgccct

SEQ ID NO: 6019942 - DNA, 15 bp, Homo sapiens
cagctctctgccctg

SEQ ID NO: 6019943 - DNA, 13 bp, Homo sapiens
cagctctctggga

SEQ ID NO: 6019944 - DNA, 13 bp, Homo sapiens
cagctctctgtat

SEQ ID NO: 6019945 - DNA, 19 bp, Homo sapiens
cagctctgaaaccagtgtt

SEQ ID NO: 6019946 - DNA, 14 bp, Homo sapiens
cagctctgacatcc

SEQ ID NO: 6019947 - DNA, 15 bp, Homo sapiens
cagctctgacatccc

SEQ ID NO: 6019948 - DNA, 19 bp, Homo sapiens
cagctctgacatcccttcc

SEQ ID NO: 6019949 - DNA, 20 bp, Homo sapiens
cagctctgacatcccttcct

SEQ ID NO: 6019950 - DNA, 19 bp, Homo sapiens
cagctctgagatcctggag

SEQ ID NO: 6019951 - DNA, 17 bp, Homo sapiens
cagctctgagccagatt

SEQ ID NO: 6019952 - DNA, 15 bp, Homo sapiens
cagctctgaggggag

SEQ ID NO: 6019953 - DNA, 16 bp, Homo sapiens
cagctctgaggggagg

SEQ ID NO: 6019954 - DNA, 17 bp, Homo sapiens
cagctctgatctgaggc

SEQ ID NO: 6019955 - DNA, 16 bp, Homo sapiens
cagctctgcaagaatt

SEQ ID NO: 6019956 - DNA, 15 bp, Homo sapiens
cagctctgcccccgc

SEQ ID NO: 6019957 - DNA, 22 bp, Homo sapiens
cagctctgcccccgcgggttct

SEQ ID NO: 6019958 - DNA, 19 bp, Homo sapiens
cagctctgccgtctctgga

SEQ ID NO: 6019959 - DNA, 20 bp, Homo sapiens
cagctctgccgtctctggag

SEQ ID NO: 6019960 - DNA, 13 bp, Homo sapiens
cagctctgccttc

SEQ ID NO: 6019961 - DNA, 13 bp, Homo sapiens
cagctctgccttg

SEQ ID NO: 6019962 - DNA, 16 bp, Homo sapiens
cagctctgccttgcac

SEQ ID NO: 6019963 - DNA, 12 bp, Homo sapiens
cagctctgctgg

SEQ ID NO: 6019964 - DNA, 15 bp, Homo sapiens
cagctctggagaaca

SEQ ID NO: 6019965 - DNA, 14 bp, Homo sapiens
cagctctggagggg

SEQ ID NO: 6019966 - DNA, 12 bp, Homo sapiens
cagctctggagt

SEQ ID NO: 6019967 - DNA, 14 bp, Homo sapiens
cagctctggcacag

SEQ ID NO: 6019968 - DNA, 13 bp, Homo sapiens
cagctctggctca

SEQ ID NO: 6019969 - DNA, 20 bp, Homo sapiens
cagctctggctcacagactg

SEQ ID NO: 6019970 - DNA, 22 bp, Homo sapiens
cagctctggctcagggcccacc

SEQ ID NO: 6019971 - DNA, 14 bp, Homo sapiens
cagctctggcttcc

SEQ ID NO: 6019972 - DNA, 15 bp, Homo sapiens
cagctctgggagagg

SEQ ID NO: 6019973 - DNA, 19 bp, Homo sapiens
cagctctgggccattctcc

SEQ ID NO: 6019974 - DNA, 23 bp, Homo sapiens
cagctctgggccattctccacag

SEQ ID NO: 6019975 - DNA, 14 bp, Homo sapiens
cagctctggggcag

SEQ ID NO: 6019976 - DNA, 17 bp, Homo sapiens
cagctctggggcagagg

SEQ ID NO: 6019977 - DNA, 13 bp, Homo sapiens
cagctctggggta

SEQ ID NO: 6019978 - DNA, 16 bp, Homo sapiens
cagctctggtccatag

SEQ ID NO: 6019979 - DNA, 23 bp, Homo sapiens
cagctctgtcaccctggccacca

SEQ ID NO: 6019980 - DNA, 23 bp, Homo sapiens
cagctctgtcctcttggccatcc

SEQ ID NO: 6019981 - DNA, 16 bp, Homo sapiens
cagctctgtcctggga

SEQ ID NO: 6019982 - DNA, 12 bp, Homo sapiens
cagctctgtctg

SEQ ID NO: 6019983 - DNA, 13 bp, Homo sapiens
cagctctgtgcca

SEQ ID NO: 6019984 - DNA, 14 bp, Homo sapiens
cagctctgtggcct

SEQ ID NO: 6019985 - DNA, 17 bp, Homo sapiens
cagctctgtggcctgtg

SEQ ID NO: 6019986 - DNA, 24 bp, Homo sapiens
cagctctgtggcctgtgtccagca

SEQ ID NO: 6019987 - DNA, 16 bp, Homo sapiens
cagctctgtgggccct

SEQ ID NO: 6019988 - DNA, 21 bp, Homo sapiens
cagctctgttcttcctcagcc

SEQ ID NO: 6019989 - DNA, 15 bp, Homo sapiens
cagctcttagctggt

SEQ ID NO: 6019990 - DNA, 20 bp, Homo sapiens
cagctcttcactcagccaca

SEQ ID NO: 6019991 - DNA, 13 bp, Homo sapiens
cagctcttcatct

SEQ ID NO: 6019992 - DNA, 18 bp, Homo sapiens
cagctcttcatctgccca

SEQ ID NO: 6019993 - DNA, 21 bp, Homo sapiens
cagctcttcattccattgact

SEQ ID NO: 6019994 - DNA, 11 bp, Homo sapiens
cagctcttcca

SEQ ID NO: 6019995 - DNA, 20 bp, Homo sapiens
cagctcttcccctttcctgg

SEQ ID NO: 6019996 - DNA, 19 bp, Homo sapiens
cagctcttcctagctggag

SEQ ID NO: 6019997 - DNA, 13 bp, Homo sapiens
cagctcttcctgg

SEQ ID NO: 6019998 - DNA, 21 bp, Homo sapiens
cagctcttctcagtgtctgaa

SEQ ID NO: 6019999 - DNA, 16 bp, Homo sapiens
cagctcttctccaggc

SEQ ID NO: 6020000 - DNA, 18 bp, Homo sapiens
cagctcttctccaggctg

SEQ ID NO: 6020001 - DNA, 19 bp, Homo sapiens
cagctcttctccaggctgt

SEQ ID NO: 6020002 - DNA, 15 bp, Homo sapiens
cagctcttctcttcc

SEQ ID NO: 6020003 - DNA, 16 bp, Homo sapiens
cagctcttctggagtt

SEQ ID NO: 6020004 - DNA, 13 bp, Homo sapiens
cagctcttctggg

SEQ ID NO: 6020005 - DNA, 15 bp, Homo sapiens
cagctcttctgggca

SEQ ID NO: 6020006 - DNA, 12 bp, Homo sapiens
cagctcttcttg

SEQ ID NO: 6020007 - DNA, 15 bp, Homo sapiens
cagctcttcttgaaa

SEQ ID NO: 6020008 - DNA, 20 bp, Homo sapiens
cagctcttgctaatcagtgt

SEQ ID NO: 6020009 - DNA, 22 bp, Homo sapiens
cagctcttgctaatcagtgtct

SEQ ID NO: 6020010 - DNA, 24 bp, Homo sapiens
cagctcttgctaatcagtgtctca

SEQ ID NO: 6020011 - DNA, 16 bp, Homo sapiens
cagctcttggcccctg

SEQ ID NO: 6020012 - DNA, 18 bp, Homo sapiens
cagctcttggctccactg

SEQ ID NO: 6020013 - DNA, 19 bp, Homo sapiens
cagctctttccaaattaaa

SEQ ID NO: 6020014 - DNA, 18 bp, Homo sapiens
cagctctttcctccttcc

SEQ ID NO: 6020015 - DNA, 19 bp, Homo sapiens
cagctctttcctccttcca

SEQ ID NO: 6020016 - DNA, 22 bp, Homo sapiens
cagctctttcctccttccatgg

SEQ ID NO: 6020017 - DNA, 22 bp, Homo sapiens
cagctctttgaaatagtctgtg

SEQ ID NO: 6020018 - DNA, 16 bp, Homo sapiens
cagctgaaaagtaaat

SEQ ID NO: 6020019 - DNA, 13 bp, Homo sapiens
cagctgaaagagg

SEQ ID NO: 6020020 - DNA, 15 bp, Homo sapiens
cagctgaaatactga

SEQ ID NO: 6020021 - DNA, 13 bp, Homo sapiens
cagctgaaattga

SEQ ID NO: 6020022 - DNA, 21 bp, Homo sapiens
cagctgaaattgggtggagga

SEQ ID NO: 6020023 - DNA, 20 bp, Homo sapiens
cagctgaagccagctccctg

SEQ ID NO: 6020024 - DNA, 15 bp, Homo sapiens
cagctgaaggcagtg

SEQ ID NO: 6020025 - DNA, 18 bp, Homo sapiens
cagctgaaggcagtggca

SEQ ID NO: 6020026 - DNA, 15 bp, Homo sapiens
catcctaggaaccag

SEQ ID NO: 6020027 - DNA, 17 bp, Homo sapiens
catcctaggctgacacc

SEQ ID NO: 6020028 - DNA, 20 bp, Homo sapiens
catcctagtctctatcatta

SEQ ID NO: 6020029 - DNA, 15 bp, Homo sapiens
catcctagtgggcac

SEQ ID NO: 6020030 - DNA, 11 bp, Homo sapiens
catcctataag

SEQ ID NO: 6020031 - DNA, 18 bp, Homo sapiens
catcctatcgatctggaa

SEQ ID NO: 6020032 - DNA, 21 bp, Homo sapiens
catcctatcgatctggaaaga

SEQ ID NO: 6020033 - DNA, 14 bp, Homo sapiens
catcctatgcttaa

SEQ ID NO: 6020034 - DNA, 20 bp, Homo sapiens
catcctattacttttcatct

SEQ ID NO: 6020035 - DNA, 15 bp, Homo sapiens
catcctcaaaagaaa

SEQ ID NO: 6020036 - DNA, 19 bp, Homo sapiens
catcctcaaacactgcagg

SEQ ID NO: 6020037 - DNA, 22 bp, Homo sapiens
catcctcaaacactgcaggcat

SEQ ID NO: 6020038 - DNA, 15 bp, Homo sapiens
catcctcagatgctc

SEQ ID NO: 6020039 - DNA, 11 bp, Homo sapiens
catcctcagca

SEQ ID NO: 6020040 - DNA, 11 bp, Homo sapiens
catcctcagcc

SEQ ID NO: 6020041 - DNA, 18 bp, Homo sapiens
catcctcagccccagggc

SEQ ID NO: 6020042 - DNA, 21 bp, Homo sapiens
catcctcagccccagggccct

SEQ ID NO: 6020043 - DNA, 22 bp, Homo sapiens
catcctcagccccagggccctg

SEQ ID NO: 6020044 - DNA, 23 bp, Homo sapiens
catcctcagccccagggccctgc

SEQ ID NO: 6020045 - DNA, 16 bp, Homo sapiens
catcctcatacccacc

SEQ ID NO: 6020046 - DNA, 13 bp, Homo sapiens
catcctcatccct

SEQ ID NO: 6020047 - DNA, 17 bp, Homo sapiens
catcctcatccctgact

SEQ ID NO: 6020048 - DNA, 12 bp, Homo sapiens
catcctcatggc

SEQ ID NO: 6020049 - DNA, 20 bp, Homo sapiens
catcctcatggcccatcagg

SEQ ID NO: 6020050 - DNA, 17 bp, Homo sapiens
catcctcattgcctcct

SEQ ID NO: 6020051 - DNA, 14 bp, Homo sapiens
catcctccaagaat

SEQ ID NO: 6020052 - DNA, 18 bp, Homo sapiens
catcctccaattccacag

SEQ ID NO: 6020053 - DNA, 12 bp, Homo sapiens
catcctccacat

SEQ ID NO: 6020054 - DNA, 17 bp, Homo sapiens
catcctccacatcctgt

SEQ ID NO: 6020055 - DNA, 18 bp, Homo sapiens
catcctccacatcctgtg

SEQ ID NO: 6020056 - DNA, 19 bp, Homo sapiens
catcctccacatcctgtgt

SEQ ID NO: 6020057 - DNA, 21 bp, Homo sapiens
catcctccacatcctgtgtca

SEQ ID NO: 6020058 - DNA, 20 bp, Homo sapiens
catcctccacgttctgctca

SEQ ID NO: 6020059 - DNA, 23 bp, Homo sapiens
catcctccagagaaacccaggga

SEQ ID NO: 6020060 - DNA, 12 bp, Homo sapiens
catcctccagcc

SEQ ID NO: 6020061 - DNA, 14 bp, Homo sapiens
catcctccagccct

SEQ ID NO: 6020062 - DNA, 15 bp, Homo sapiens
catcctccagccctg

SEQ ID NO: 6020063 - DNA, 13 bp, Homo sapiens
catcctccagggg

SEQ ID NO: 6020064 - DNA, 20 bp, Homo sapiens
catcctccagggggcctgca

SEQ ID NO: 6020065 - DNA, 18 bp, Homo sapiens
catcctcccaagtaggtg

SEQ ID NO: 6020066 - DNA, 15 bp, Homo sapiens
catcctccccaccag

SEQ ID NO: 6020067 - DNA, 17 bp, Homo sapiens
catcctccccaccagag

SEQ ID NO: 6020068 - DNA, 13 bp, Homo sapiens
catcctccccttc

SEQ ID NO: 6020069 - DNA, 18 bp, Homo sapiens
catcctcccgccaggagc

SEQ ID NO: 6020070 - DNA, 23 bp, Homo sapiens
catcctccctcccccagccacca

SEQ ID NO: 6020071 - DNA, 22 bp, Homo sapiens
catcctccctgaccctgctcct

SEQ ID NO: 6020072 - DNA, 19 bp, Homo sapiens
catcctccctgttccccac

SEQ ID NO: 6020073 - DNA, 23 bp, Homo sapiens
catcctccctgttccccacaggt

SEQ ID NO: 6020074 - DNA, 19 bp, Homo sapiens
catcctccgtccagccgcc

SEQ ID NO: 6020075 - DNA, 19 bp, Homo sapiens
catcctcctcagatcttct

SEQ ID NO: 6020076 - DNA, 21 bp, Homo sapiens
catcctcctcagcccccaggc

SEQ ID NO: 6020077 - DNA, 13 bp, Homo sapiens
catcctcctccca

SEQ ID NO: 6020078 - DNA, 16 bp, Homo sapiens
catcctcctcccaact

SEQ ID NO: 6020079 - DNA, 20 bp, Homo sapiens
catcctcctcccacccggct

SEQ ID NO: 6020080 - DNA, 18 bp, Homo sapiens
catcctcctccttcctag

SEQ ID NO: 6020081 - DNA, 15 bp, Homo sapiens
catcctcctctccat

SEQ ID NO: 6020082 - DNA, 18 bp, Homo sapiens
catcctcctctccatgca

SEQ ID NO: 6020083 - DNA, 13 bp, Homo sapiens
catcctcctgccc

SEQ ID NO: 6020084 - DNA, 19 bp, Homo sapiens
catcctcctgcccccaccc

SEQ ID NO: 6020085 - DNA, 22 bp, Homo sapiens
catcctcctgcccccaccccag

SEQ ID NO: 6020086 - DNA, 17 bp, Homo sapiens
catcctcctggacccag

SEQ ID NO: 6020087 - DNA, 13 bp, Homo sapiens
catcctcctttca

SEQ ID NO: 6020088 - DNA, 16 bp, Homo sapiens
catcctctgactccac

SEQ ID NO: 6020089 - DNA, 17 bp, Homo sapiens
catcctctggagccagc

SEQ ID NO: 6020090 - DNA, 19 bp, Homo sapiens
catcctctggagccagccg

SEQ ID NO: 6020091 - DNA, 18 bp, Homo sapiens
catcctctgtacagagcc

SEQ ID NO: 6020092 - DNA, 21 bp, Homo sapiens
catcctctgtacagagcccac

SEQ ID NO: 6020093 - DNA, 17 bp, Homo sapiens
catcctcttatatgtgc

SEQ ID NO: 6020094 - DNA, 18 bp, Homo sapiens
catcctcttctgcttagg

SEQ ID NO: 6020095 - DNA, 19 bp, Homo sapiens
catcctcttgactcttcta

SEQ ID NO: 6020096 - DNA, 13 bp, Homo sapiens
catcctctttctc

SEQ ID NO: 6020097 - DNA, 21 bp, Homo sapiens
catcctctttctcttttctag

SEQ ID NO: 6020098 - DNA, 14 bp, Homo sapiens
catcctcttttaat

SEQ ID NO: 6020099 - DNA, 16 bp, Homo sapiens
catcctgaaagccagc

SEQ ID NO: 6020100 - DNA, 22 bp, Homo sapiens
catcctgaaagccagcaaagcc

SEQ ID NO: 6020101 - DNA, 16 bp, Homo sapiens
catcctgaacagcatg

SEQ ID NO: 6020102 - DNA, 19 bp, Homo sapiens
catcctgaccaagactgag

SEQ ID NO: 6020103 - DNA, 22 bp, Homo sapiens
catcctgaccaagactgagcca

SEQ ID NO: 6020104 - DNA, 13 bp, Homo sapiens
catcctgacctgc

SEQ ID NO: 6020105 - DNA, 22 bp, Homo sapiens
catcctgactctgccccctgct

SEQ ID NO: 6020106 - DNA, 11 bp, Homo sapiens
catcctgactt

SEQ ID NO: 6020107 - DNA, 22 bp, Homo sapiens
catcctgagagacctgccctct

SEQ ID NO: 6020108 - DNA, 12 bp, Homo sapiens
catcctgagccc

SEQ ID NO: 6020109 - DNA, 14 bp, Homo sapiens
catcctgagccccg

SEQ ID NO: 6020110 - DNA, 13 bp, Homo sapiens
catcctgaggcca

SEQ ID NO: 6020111 - DNA, 19 bp, Homo sapiens
catcctgaggctccacttg

SEQ ID NO: 6020112 - DNA, 16 bp, Homo sapiens
catcctgaggtgcctc

SEQ ID NO: 6020113 - DNA, 18 bp, Homo sapiens
catcctgaggtgcctccc

SEQ ID NO: 6020114 - DNA, 19 bp, Homo sapiens
catcctgaggtgcctccca

SEQ ID NO: 6020115 - DNA, 14 bp, Homo sapiens
catcctgattattg

SEQ ID NO: 6020116 - DNA, 19 bp, Homo sapiens
catcctgattattgaatgt

SEQ ID NO: 6020117 - DNA, 20 bp, Homo sapiens
catcctgcaaaggcccttgt

SEQ ID NO: 6020118 - DNA, 14 bp, Homo sapiens
catcctgcaaggtg

SEQ ID NO: 6020119 - DNA, 22 bp, Homo sapiens
catcctgcaaggtgaaacgact

SEQ ID NO: 6020120 - DNA, 22 bp, Homo sapiens
catcctgccagccccacacagc

SEQ ID NO: 6020121 - DNA, 13 bp, Homo sapiens
catcctgccagga

SEQ ID NO: 6020122 - DNA, 17 bp, Homo sapiens
catcctgccatcctcaa

SEQ ID NO: 6020123 - DNA, 11 bp, Homo sapiens
catcctgcctg

SEQ ID NO: 6020124 - DNA, 16 bp, Homo sapiens
catcctgcctgggtgg

SEQ ID NO: 6020125 - DNA, 20 bp, Homo sapiens
catcctgccttagagccagg

SEQ ID NO: 6020126 - DNA, 22 bp, Homo sapiens
catcctgccttagagccaggca

SEQ ID NO: 6020127 - DNA, 23 bp, Homo sapiens
catcctgcggaaggaattcagga

SEQ ID NO: 6020128 - DNA, 19 bp, Homo sapiens
catcctgctacactcatcc

SEQ ID NO: 6020129 - DNA, 22 bp, Homo sapiens
catcctgctagcacctccccag

SEQ ID NO: 6020130 - DNA, 12 bp, Homo sapiens
catcctgctctt

SEQ ID NO: 6020131 - DNA, 15 bp, Homo sapiens
catcctgctgggccc

SEQ ID NO: 6020132 - DNA, 13 bp, Homo sapiens
catcctgcttcct

SEQ ID NO: 6020133 - DNA, 21 bp, Homo sapiens
catcctgcttcctgaaagctg

SEQ ID NO: 6020134 - DNA, 13 bp, Homo sapiens
catcctgcttctc

SEQ ID NO: 6020135 - DNA, 12 bp, Homo sapiens
catcctggaata

SEQ ID NO: 6020136 - DNA, 23 bp, Homo sapiens
catcctggatgaaagagccagac

SEQ ID NO: 6020137 - DNA, 17 bp, Homo sapiens
catcctggcacgcccta

SEQ ID NO: 6020138 - DNA, 21 bp, Homo sapiens
catcctggcacgccctactcc

SEQ ID NO: 6020139 - DNA, 14 bp, Homo sapiens
catcctggcccatc

SEQ ID NO: 6020140 - DNA, 14 bp, Homo sapiens
catcctggcccctc

SEQ ID NO: 6020141 - DNA, 17 bp, Homo sapiens
catcctggcccctccag

SEQ ID NO: 6020142 - DNA, 14 bp, Homo sapiens
catcctggcctcct

SEQ ID NO: 6020143 - DNA, 18 bp, Homo sapiens
catcctggcctggcacat

SEQ ID NO: 6020144 - DNA, 13 bp, Homo sapiens
catcctggctgcg

SEQ ID NO: 6020145 - DNA, 14 bp, Homo sapiens
catcctggctggct

SEQ ID NO: 6020146 - DNA, 16 bp, Homo sapiens
catcctggctggctgt

SEQ ID NO: 6020147 - DNA, 20 bp, Homo sapiens
catcctggctggctgtgtcc

SEQ ID NO: 6020148 - DNA, 17 bp, Homo sapiens
catcctggcttgcctcc

SEQ ID NO: 6020149 - DNA, 11 bp, Homo sapiens
catcctgggca

SEQ ID NO: 6020150 - DNA, 23 bp, Homo sapiens
catcctgggcagcttgggctggc

SEQ ID NO: 6020151 - DNA, 15 bp, Homo sapiens
catcctggggcagca

SEQ ID NO: 6020152 - DNA, 18 bp, Homo sapiens
catcctggggcagcactc

SEQ ID NO: 6020153 - DNA, 18 bp, Homo sapiens
catcctggggttgccctg

SEQ ID NO: 6020154 - DNA, 16 bp, Homo sapiens
catcctgtacaagtgc

SEQ ID NO: 6020155 - DNA, 16 bp, Homo sapiens
catcctgtcatctgag

SEQ ID NO: 6020156 - DNA, 15 bp, Homo sapiens
catcctgtcccacca

SEQ ID NO: 6020157 - DNA, 18 bp, Homo sapiens
catcctgtcccaccatgc

SEQ ID NO: 6020158 - DNA, 20 bp, Homo sapiens
catcctgtcccaccatgcag

SEQ ID NO: 6020159 - DNA, 12 bp, Homo sapiens
catcctgtgtca

SEQ ID NO: 6020160 - DNA, 12 bp, Homo sapiens
catcctgtgtcc

SEQ ID NO: 6020161 - DNA, 17 bp, Homo sapiens
catcctgtgtcccctga

SEQ ID NO: 6020162 - DNA, 21 bp, Homo sapiens
catcctgtgtcccctgacctg

SEQ ID NO: 6020163 - DNA, 17 bp, Homo sapiens
catcctgtgtggggagg

SEQ ID NO: 6020164 - DNA, 19 bp, Homo sapiens
catcctgttggctgctgcc

SEQ ID NO: 6020165 - DNA, 23 bp, Homo sapiens
catcctgtttgtatgaaattata

SEQ ID NO: 6020166 - DNA, 22 bp, Homo sapiens
catcctgtttttccttttgttt

SEQ ID NO: 6020167 - DNA, 16 bp, Homo sapiens
catccttaactgtcca

SEQ ID NO: 6020168 - DNA, 16 bp, Homo sapiens
catccttacaatgtaa

SEQ ID NO: 6020169 - DNA, 22 bp, Homo sapiens
catccttatccttcatctttta

SEQ ID NO: 6020170 - DNA, 21 bp, Homo sapiens
catccttcaccagagcccatg

SEQ ID NO: 6020171 - DNA, 23 bp, Homo sapiens
catccttcatctggattccagag

SEQ ID NO: 6020172 - DNA, 16 bp, Homo sapiens
catccttccaacatat

SEQ ID NO: 6020173 - DNA, 14 bp, Homo sapiens
catccttccatcca

SEQ ID NO: 6020174 - DNA, 15 bp, Homo sapiens
catccttccatccat

SEQ ID NO: 6020175 - DNA, 19 bp, Homo sapiens
catccttccatcctgagga

SEQ ID NO: 6020176 - DNA, 20 bp, Homo sapiens
catccttcccaagaagagag

SEQ ID NO: 6020177 - DNA, 14 bp, Homo sapiens
catccttcccatga

SEQ ID NO: 6020178 - DNA, 14 bp, Homo sapiens
catccttcccgcag

SEQ ID NO: 6020179 - DNA, 14 bp, Homo sapiens
catccttccctcat

SEQ ID NO: 6020180 - DNA, 17 bp, Homo sapiens
catccttccgccaatct

SEQ ID NO: 6020181 - DNA, 13 bp, Homo sapiens
catccttcctata

SEQ ID NO: 6020182 - DNA, 13 bp, Homo sapiens
catccttcctggg

SEQ ID NO: 6020183 - DNA, 14 bp, Homo sapiens
catccttcctgggg

SEQ ID NO: 6020184 - DNA, 14 bp, Homo sapiens
catccttctcccca

SEQ ID NO: 6020185 - DNA, 22 bp, Homo sapiens
catccttcttggcttcctggcg

SEQ ID NO: 6020186 - DNA, 16 bp, Homo sapiens
catccttgaactgtca

SEQ ID NO: 6020187 - DNA, 23 bp, Homo sapiens
catccttgactttgaactaatga

SEQ ID NO: 6020188 - DNA, 18 bp, Homo sapiens
catccttgattacttcca

SEQ ID NO: 6020189 - DNA, 16 bp, Homo sapiens
catccttgctgcagct

SEQ ID NO: 6020190 - DNA, 19 bp, Homo sapiens
catccttggactgagaaat

SEQ ID NO: 6020191 - DNA, 17 bp, Homo sapiens
catccttggcctggcgc

SEQ ID NO: 6020192 - DNA, 22 bp, Homo sapiens
catccttggtgctcttgctttt

SEQ ID NO: 6020193 - DNA, 14 bp, Homo sapiens
catccttgtaatac

SEQ ID NO: 6020194 - DNA, 22 bp, Homo sapiens
catcctttagggttctgcctct

SEQ ID NO: 6020195 - DNA, 21 bp, Homo sapiens
catcctttcacttctttccct

SEQ ID NO: 6020196 - DNA, 14 bp, Homo sapiens
catcctttccagca

SEQ ID NO: 6020197 - DNA, 17 bp, Homo sapiens
catcctttccctctccc

SEQ ID NO: 6020198 - DNA, 18 bp, Homo sapiens
catcctttccctctccca

SEQ ID NO: 6020199 - DNA, 16 bp, Homo sapiens
catcctttgcactgtc

SEQ ID NO: 6020200 - DNA, 16 bp, Homo sapiens
catcctttgcagggca

SEQ ID NO: 6020201 - DNA, 17 bp, Homo sapiens
catcctttgcagggcag

SEQ ID NO: 6020202 - DNA, 18 bp, Homo sapiens
catcctttgcagggcagc

SEQ ID NO: 6020203 - DNA, 13 bp, Homo sapiens
catcctttgcatt

SEQ ID NO: 6020204 - DNA, 15 bp, Homo sapiens
catcctttgcatttc

SEQ ID NO: 6020205 - DNA, 15 bp, Homo sapiens
catcctttgttctga

SEQ ID NO: 6020206 - DNA, 19 bp, Homo sapiens
cagctgaaggcagtggcag

SEQ ID NO: 6020207 - DNA, 20 bp, Homo sapiens
cagctgaagtcaaaatatgt

SEQ ID NO: 6020208 - DNA, 19 bp, Homo sapiens
cagctgaagtctctttttc

SEQ ID NO: 6020209 - DNA, 19 bp, Homo sapiens
cagctgaataacctgcaca

SEQ ID NO: 6020210 - DNA, 22 bp, Homo sapiens
cagctgaataacctgcacaggc

SEQ ID NO: 6020211 - DNA, 19 bp, Homo sapiens
cagctgaatagagggagta

SEQ ID NO: 6020212 - DNA, 20 bp, Homo sapiens
cagctgaatgcctcctgtgg

SEQ ID NO: 6020213 - DNA, 23 bp, Homo sapiens
cagctgaatgcctcctgtgggga

SEQ ID NO: 6020214 - DNA, 20 bp, Homo sapiens
cagctgacacataatttgaa

SEQ ID NO: 6020215 - DNA, 11 bp, Homo sapiens
cagctgacagc

SEQ ID NO: 6020216 - DNA, 16 bp, Homo sapiens
cagctgacagccacac

SEQ ID NO: 6020217 - DNA, 20 bp, Homo sapiens
cagctgacagccacaccgtg

SEQ ID NO: 6020218 - DNA, 18 bp, Homo sapiens
cagctgacagtcctctcc

SEQ ID NO: 6020219 - DNA, 14 bp, Homo sapiens
cagctgacatcttg

SEQ ID NO: 6020220 - DNA, 21 bp, Homo sapiens
cagctgacatcttgaatcctt

SEQ ID NO: 6020221 - DNA, 14 bp, Homo sapiens
cagctgacccggcc

SEQ ID NO: 6020222 - DNA, 23 bp, Homo sapiens
cagctgacccggcctctctgccc

SEQ ID NO: 6020223 - DNA, 20 bp, Homo sapiens
cagctgaccgggtcacacaa

SEQ ID NO: 6020224 - DNA, 18 bp, Homo sapiens
cagctgacctctgttgtc

SEQ ID NO: 6020225 - DNA, 16 bp, Homo sapiens
cagctgacctttgtca

SEQ ID NO: 6020226 - DNA, 13 bp, Homo sapiens
cagctgactaaac

SEQ ID NO: 6020227 - DNA, 18 bp, Homo sapiens
cagctgactaaacttttt

SEQ ID NO: 6020228 - DNA, 17 bp, Homo sapiens
cagctgactgaatgcag

SEQ ID NO: 6020229 - DNA, 24 bp, Homo sapiens
cagctgactgaatgcagaacggtt

SEQ ID NO: 6020230 - DNA, 13 bp, Homo sapiens
cagctgactgtgg

SEQ ID NO: 6020231 - DNA, 20 bp, Homo sapiens
cagctgactgtggccccctc

SEQ ID NO: 6020232 - DNA, 23 bp, Homo sapiens
cagctgacttggttctgaagcca

SEQ ID NO: 6020233 - DNA, 22 bp, Homo sapiens
cagctgagaaaatgagtgacta

SEQ ID NO: 6020234 - DNA, 16 bp, Homo sapiens
cagctgagagccctgc

SEQ ID NO: 6020235 - DNA, 20 bp, Homo sapiens
cagctgagagccctgctgtg

SEQ ID NO: 6020236 - DNA, 21 bp, Homo sapiens
cagctgagagccctgctgtgg

SEQ ID NO: 6020237 - DNA, 11 bp, Homo sapiens
cagctgagcac

SEQ ID NO: 6020238 - DNA, 14 bp, Homo sapiens
cagctgagccctgg

SEQ ID NO: 6020239 - DNA, 19 bp, Homo sapiens
cagctgagccctggggact

SEQ ID NO: 6020240 - DNA, 16 bp, Homo sapiens
cagctgagccttctga

SEQ ID NO: 6020241 - DNA, 16 bp, Homo sapiens
cagctgagcgccagga

SEQ ID NO: 6020242 - DNA, 15 bp, Homo sapiens
cagctgagctggcct

SEQ ID NO: 6020243 - DNA, 14 bp, Homo sapiens
cagctgagcttgag

SEQ ID NO: 6020244 - DNA, 19 bp, Homo sapiens
cagctgaggacacacccca

SEQ ID NO: 6020245 - DNA, 16 bp, Homo sapiens
cagctgaggccccagg

SEQ ID NO: 6020246 - DNA, 13 bp, Homo sapiens
cagctgagtgaga

SEQ ID NO: 6020247 - DNA, 17 bp, Homo sapiens
cagctgagtgagtggga

SEQ ID NO: 6020248 - DNA, 14 bp, Homo sapiens
cagctgagttatga

SEQ ID NO: 6020249 - DNA, 23 bp, Homo sapiens
cagctgatacaaattgcagactg

SEQ ID NO: 6020250 - DNA, 16 bp, Homo sapiens
cagctgatccatagga

SEQ ID NO: 6020251 - DNA, 23 bp, Homo sapiens
cagctgatccttcaactctgtga

SEQ ID NO: 6020252 - DNA, 21 bp, Homo sapiens
cagctgatgactcaagattcc

SEQ ID NO: 6020253 - DNA, 17 bp, Homo sapiens
cagctgatgcctccttg

SEQ ID NO: 6020254 - DNA, 21 bp, Homo sapiens
cagctgatgcctccttggcca

SEQ ID NO: 6020255 - DNA, 20 bp, Homo sapiens
cagctgattcagcagtgcct

SEQ ID NO: 6020256 - DNA, 15 bp, Homo sapiens
cagctgattttaaca

SEQ ID NO: 6020257 - DNA, 21 bp, Homo sapiens
cagctgattttaacaataact

SEQ ID NO: 6020258 - DNA, 15 bp, Homo sapiens
cagctgattttgtca

SEQ ID NO: 6020259 - DNA, 12 bp, Homo sapiens
cagctgcaaagt

SEQ ID NO: 6020260 - DNA, 13 bp, Homo sapiens
cagctgcaaagtg

SEQ ID NO: 6020261 - DNA, 20 bp, Homo sapiens
cagctgcacattcctggccc

SEQ ID NO: 6020262 - DNA, 16 bp, Homo sapiens
cagctgcaccagcagg

SEQ ID NO: 6020263 - DNA, 12 bp, Homo sapiens
cagctgcacccc

SEQ ID NO: 6020264 - DNA, 18 bp, Homo sapiens
cagctgcacctgccagcc

SEQ ID NO: 6020265 - DNA, 22 bp, Homo sapiens
cagctgcacctgccagcctggc

SEQ ID NO: 6020266 - DNA, 12 bp, Homo sapiens
cagctgcactga

SEQ ID NO: 6020267 - DNA, 13 bp, Homo sapiens
cagctgcagacca

SEQ ID NO: 6020268 - DNA, 14 bp, Homo sapiens
cagctgcagcccat

SEQ ID NO: 6020269 - DNA, 13 bp, Homo sapiens
cagctgcagcctg

SEQ ID NO: 6020270 - DNA, 13 bp, Homo sapiens
cagctgcagctgg

SEQ ID NO: 6020271 - DNA, 15 bp, Homo sapiens
cagctgcaggaatca

SEQ ID NO: 6020272 - DNA, 12 bp, Homo sapiens
cagctgcaggcc

SEQ ID NO: 6020273 - DNA, 13 bp, Homo sapiens
cagctgcagggca

SEQ ID NO: 6020274 - DNA, 14 bp, Homo sapiens
cagctgcagggcac

SEQ ID NO: 6020275 - DNA, 17 bp, Homo sapiens
cagctgcagggcacggg

SEQ ID NO: 6020276 - DNA, 15 bp, Homo sapiens
cagctgcagtcaaca

SEQ ID NO: 6020277 - DNA, 19 bp, Homo sapiens
cagctgcagttagcacaga

SEQ ID NO: 6020278 - DNA, 23 bp, Homo sapiens
cagctgcagttagcacagaggat

SEQ ID NO: 6020279 - DNA, 12 bp, Homo sapiens
cagctgcagttg

SEQ ID NO: 6020280 - DNA, 21 bp, Homo sapiens
cagctgcagttgaagagcctg

SEQ ID NO: 6020281 - DNA, 16 bp, Homo sapiens
cagctgcatctgtctg

SEQ ID NO: 6020282 - DNA, 18 bp, Homo sapiens
cagctgcatggagcctgg

SEQ ID NO: 6020283 - DNA, 14 bp, Homo sapiens
cagctgcatggcac

SEQ ID NO: 6020284 - DNA, 15 bp, Homo sapiens
cagctgcatggcaca

SEQ ID NO: 6020285 - DNA, 12 bp, Homo sapiens
cagctgccaagc

SEQ ID NO: 6020286 - DNA, 13 bp, Homo sapiens
cagctgccaagca

SEQ ID NO: 6020287 - DNA, 21 bp, Homo sapiens
cagctgccaagcactcgagac

SEQ ID NO: 6020288 - DNA, 22 bp, Homo sapiens
cagctgccaagcactcgagacc

SEQ ID NO: 6020289 - DNA, 14 bp, Homo sapiens
cagctgccaagtgc

SEQ ID NO: 6020290 - DNA, 17 bp, Homo sapiens
cagctgccaggcggccc

SEQ ID NO: 6020291 - DNA, 20 bp, Homo sapiens
cagctgccaggcggccctgg

SEQ ID NO: 6020292 - DNA, 21 bp, Homo sapiens
cagctgccaggcggccctggg

SEQ ID NO: 6020293 - DNA, 13 bp, Homo sapiens
cagctgccaggga

SEQ ID NO: 6020294 - DNA, 20 bp, Homo sapiens
cagctgccagggaagacaga

SEQ ID NO: 6020295 - DNA, 11 bp, Homo sapiens
cagctgccagt

SEQ ID NO: 6020296 - DNA, 17 bp, Homo sapiens
cagctgccagtgtgtta

SEQ ID NO: 6020297 - DNA, 12 bp, Homo sapiens
cagctgcccaga

SEQ ID NO: 6020298 - DNA, 20 bp, Homo sapiens
cagctgccccaatgtgacct

SEQ ID NO: 6020299 - DNA, 17 bp, Homo sapiens
cagctgcccccagagcc

SEQ ID NO: 6020300 - DNA, 12 bp, Homo sapiens
cagctgccccgg

SEQ ID NO: 6020301 - DNA, 19 bp, Homo sapiens
cagctgccccggcccctcc

SEQ ID NO: 6020302 - DNA, 15 bp, Homo sapiens
cagctgcccctccct

SEQ ID NO: 6020303 - DNA, 16 bp, Homo sapiens
cagctgcccctccctc

SEQ ID NO: 6020304 - DNA, 11 bp, Homo sapiens
cagctgcccta

SEQ ID NO: 6020305 - DNA, 20 bp, Homo sapiens
cagctgccctagctgacccc

SEQ ID NO: 6020306 - DNA, 14 bp, Homo sapiens
cagctgccctgctg

SEQ ID NO: 6020307 - DNA, 19 bp, Homo sapiens
cagctgccctgctgccaca

SEQ ID NO: 6020308 - DNA, 14 bp, Homo sapiens
cagctgcccttgca

SEQ ID NO: 6020309 - DNA, 11 bp, Homo sapiens
cagctgcctag

SEQ ID NO: 6020310 - DNA, 16 bp, Homo sapiens
cagctgcctcccctcc

SEQ ID NO: 6020311 - DNA, 22 bp, Homo sapiens
cagctgcctcccctcctctgct

SEQ ID NO: 6020312 - DNA, 23 bp, Homo sapiens
cagctgcctcccctcctctgctt

SEQ ID NO: 6020313 - DNA, 12 bp, Homo sapiens
cagctgcctccg

SEQ ID NO: 6020314 - DNA, 17 bp, Homo sapiens
cagctgcctccgggcct

SEQ ID NO: 6020315 - DNA, 22 bp, Homo sapiens
cagctgcctccgggcctcggcc

SEQ ID NO: 6020316 - DNA, 18 bp, Homo sapiens
cagctgcctctgctccct

SEQ ID NO: 6020317 - DNA, 13 bp, Homo sapiens
cagctgcctcttc

SEQ ID NO: 6020318 - DNA, 19 bp, Homo sapiens
cagctgcctcttccctctt

SEQ ID NO: 6020319 - DNA, 21 bp, Homo sapiens
cagctgcctctttgctgcttt

SEQ ID NO: 6020320 - DNA, 12 bp, Homo sapiens
cagctgcctgca

SEQ ID NO: 6020321 - DNA, 22 bp, Homo sapiens
cagctgcctggaagagcagccc

SEQ ID NO: 6020322 - DNA, 13 bp, Homo sapiens
cagctgcctggag

SEQ ID NO: 6020323 - DNA, 16 bp, Homo sapiens
cagctgcctggagagg

SEQ ID NO: 6020324 - DNA, 18 bp, Homo sapiens
cagctgcctggagagggt

SEQ ID NO: 6020325 - DNA, 17 bp, Homo sapiens
cagctgcctggccatgc

SEQ ID NO: 6020326 - DNA, 18 bp, Homo sapiens
cagctgcctgggatccct

SEQ ID NO: 6020327 - DNA, 14 bp, Homo sapiens
cagctgcctgggcc

SEQ ID NO: 6020328 - DNA, 13 bp, Homo sapiens
cagctgcctgggg

SEQ ID NO: 6020329 - DNA, 14 bp, Homo sapiens
cagctgcctgtgcc

SEQ ID NO: 6020330 - DNA, 19 bp, Homo sapiens
cagctgcctgtgcctgcca

SEQ ID NO: 6020331 - DNA, 16 bp, Homo sapiens
cagctgccttagcttc

SEQ ID NO: 6020332 - DNA, 22 bp, Homo sapiens
cagctgccttagcttcaggaac

SEQ ID NO: 6020333 - DNA, 23 bp, Homo sapiens
cagctgccttagcttcaggaacc

SEQ ID NO: 6020334 - DNA, 15 bp, Homo sapiens
cagctgccttcctgg

SEQ ID NO: 6020335 - DNA, 23 bp, Homo sapiens
cagctgccttttaagaggtctta

SEQ ID NO: 6020336 - DNA, 17 bp, Homo sapiens
cagctgcgcccccttct

SEQ ID NO: 6020337 - DNA, 21 bp, Homo sapiens
cagctgcggcagcccctccca

SEQ ID NO: 6020338 - DNA, 15 bp, Homo sapiens
cagctgcggccaggc

SEQ ID NO: 6020339 - DNA, 18 bp, Homo sapiens
cagctgcggtccacccag

SEQ ID NO: 6020340 - DNA, 19 bp, Homo sapiens
cagctgcggtccacccagg

SEQ ID NO: 6020341 - DNA, 20 bp, Homo sapiens
cagctgcggtccacccagga

SEQ ID NO: 6020342 - DNA, 22 bp, Homo sapiens
cagctgcggtccacccaggagc

SEQ ID NO: 6020343 - DNA, 14 bp, Homo sapiens
cagctgctacaaga

SEQ ID NO: 6020344 - DNA, 17 bp, Homo sapiens
cagctgctactactcct

SEQ ID NO: 6020345 - DNA, 16 bp, Homo sapiens
cagctgctatccccat

SEQ ID NO: 6020346 - DNA, 22 bp, Homo sapiens
cagctgctatttattttcctaa

SEQ ID NO: 6020347 - DNA, 21 bp, Homo sapiens
cagctgctcaataaagtacaa

SEQ ID NO: 6020348 - DNA, 15 bp, Homo sapiens
cagctgctcagatcc

SEQ ID NO: 6020349 - DNA, 16 bp, Homo sapiens
cagctgctcccacact

SEQ ID NO: 6020350 - DNA, 13 bp, Homo sapiens
cagctgctcccct

SEQ ID NO: 6020351 - DNA, 16 bp, Homo sapiens
cagctgctcccctccc

SEQ ID NO: 6020352 - DNA, 18 bp, Homo sapiens
cagctgctcccctccctc

SEQ ID NO: 6020353 - DNA, 21 bp, Homo sapiens
cagctgctcccctccctcctc

SEQ ID NO: 6020354 - DNA, 18 bp, Homo sapiens
cagctgctcccctgccac

SEQ ID NO: 6020355 - DNA, 14 bp, Homo sapiens
cagctgctcctaga

SEQ ID NO: 6020356 - DNA, 15 bp, Homo sapiens
cagctgctcctcgca

SEQ ID NO: 6020357 - DNA, 16 bp, Homo sapiens
cagctgctctaagccc

SEQ ID NO: 6020358 - DNA, 17 bp, Homo sapiens
cagctgctctaagccca

SEQ ID NO: 6020359 - DNA, 13 bp, Homo sapiens
cagctgctctgcc

SEQ ID NO: 6020360 - DNA, 20 bp, Homo sapiens
cagctgctctgcccagagct

SEQ ID NO: 6020361 - DNA, 21 bp, Homo sapiens
cagctgctctgcccagagctg

SEQ ID NO: 6020362 - DNA, 23 bp, Homo sapiens
cagctgctctgcccagagctggg

SEQ ID NO: 6020363 - DNA, 17 bp, Homo sapiens
cagctgctctgcccctt

SEQ ID NO: 6020364 - DNA, 21 bp, Homo sapiens
cagctgctgaaacaacaaata

SEQ ID NO: 6020365 - DNA, 17 bp, Homo sapiens
cagctgctgaagaggca

SEQ ID NO: 6020366 - DNA, 20 bp, Homo sapiens
cagctgctgaagttctgagc

SEQ ID NO: 6020367 - DNA, 19 bp, Homo sapiens
cagctgctgagatcctgga

SEQ ID NO: 6020368 - DNA, 21 bp, Homo sapiens
cagctgctgagatcctggact

SEQ ID NO: 6020369 - DNA, 21 bp, Homo sapiens
cagctgctgccactctgctgc

SEQ ID NO: 6020370 - DNA, 11 bp, Homo sapiens
cagctgctgct

SEQ ID NO: 6020371 - DNA, 15 bp, Homo sapiens
cagctgctggagaat

SEQ ID NO: 6020372 - DNA, 23 bp, Homo sapiens
cagctgctggagactcctaggca

SEQ ID NO: 6020373 - DNA, 13 bp, Homo sapiens
cagctgctggcca

SEQ ID NO: 6020374 - DNA, 11 bp, Homo sapiens
cagctgctggg

SEQ ID NO: 6020375 - DNA, 12 bp, Homo sapiens
cagctgctggga

SEQ ID NO: 6020376 - DNA, 14 bp, Homo sapiens
cagctgctgtcagg

SEQ ID NO: 6020377 - DNA, 13 bp, Homo sapiens
cagctgctgtctg

SEQ ID NO: 6020378 - DNA, 23 bp, Homo sapiens
cagctgctgtctgagtagtggcc

SEQ ID NO: 6020379 - DNA, 13 bp, Homo sapiens
cagctgctgtctt

SEQ ID NO: 6020380 - DNA, 15 bp, Homo sapiens
cagctgctgtgcccc

SEQ ID NO: 6020381 - DNA, 17 bp, Homo sapiens
cagctgctgtgctgggt

SEQ ID NO: 6020382 - DNA, 14 bp, Homo sapiens
cagctgctgttctc

SEQ ID NO: 6020383 - DNA, 12 bp, Homo sapiens
cagctgcttctc

SEQ ID NO: 6020384 - DNA, 15 bp, Homo sapiens
cagctgcttctccca

SEQ ID NO: 6020385 - DNA, 19 bp, Homo sapiens
cagctgcttctccccccat

SEQ ID NO: 6020386 - DNA, 19 bp, Homo sapiens
catcctttgttctgagcat

SEQ ID NO: 6020387 - DNA, 18 bp, Homo sapiens
catccttttctcctatct

SEQ ID NO: 6020388 - DNA, 15 bp, Homo sapiens
catccttttgcttca

SEQ ID NO: 6020389 - DNA, 21 bp, Homo sapiens
catccttttgcttcatctgga

SEQ ID NO: 6020390 - DNA, 15 bp, Homo sapiens
catccttttttctct

SEQ ID NO: 6020391 - DNA, 15 bp, Homo sapiens
catcgaacaaactga

SEQ ID NO: 6020392 - DNA, 17 bp, Homo sapiens
catcgaagggattgtgt

SEQ ID NO: 6020393 - DNA, 18 bp, Homo sapiens
catcgaagggattgtgta

SEQ ID NO: 6020394 - DNA, 15 bp, Homo sapiens
catcgaatgtgtaca

SEQ ID NO: 6020395 - DNA, 18 bp, Homo sapiens
catcgacccccaagggac

SEQ ID NO: 6020396 - DNA, 17 bp, Homo sapiens
catcgagatggagctac

SEQ ID NO: 6020397 - DNA, 19 bp, Homo sapiens
catcgaggtatgtttatat

SEQ ID NO: 6020398 - DNA, 18 bp, Homo sapiens
catcgatatgtatatcat

SEQ ID NO: 6020399 - DNA, 21 bp, Homo sapiens
catcgattcaaactgctccaa

SEQ ID NO: 6020400 - DNA, 15 bp, Homo sapiens
catcgatttgtatta

SEQ ID NO: 6020401 - DNA, 23 bp, Homo sapiens
catcgcacactggggccccgggt

SEQ ID NO: 6020402 - DNA, 18 bp, Homo sapiens
catcgcacagtttaccca

SEQ ID NO: 6020403 - DNA, 18 bp, Homo sapiens
catcgcaccattctgact

SEQ ID NO: 6020404 - DNA, 19 bp, Homo sapiens
catcgcaccattctgactc

SEQ ID NO: 6020405 - DNA, 18 bp, Homo sapiens
catcgcagcttcctgtct

SEQ ID NO: 6020406 - DNA, 21 bp, Homo sapiens
catcgcaggagtctctgccac

SEQ ID NO: 6020407 - DNA, 17 bp, Homo sapiens
catcgcatcctcttcca

SEQ ID NO: 6020408 - DNA, 21 bp, Homo sapiens
catcgccaactaagcgaggca

SEQ ID NO: 6020409 - DNA, 19 bp, Homo sapiens
catcgccaaggactgactg

SEQ ID NO: 6020410 - DNA, 22 bp, Homo sapiens
catcgccaaggactgactgaga

SEQ ID NO: 6020411 - DNA, 16 bp, Homo sapiens
catcgccagctgatga

SEQ ID NO: 6020412 - DNA, 18 bp, Homo sapiens
catcgccatcttcttccc

SEQ ID NO: 6020413 - DNA, 12 bp, Homo sapiens
catcgcctctgt

SEQ ID NO: 6020414 - DNA, 16 bp, Homo sapiens
catcgctcgtgtgttc

SEQ ID NO: 6020415 - DNA, 14 bp, Homo sapiens
catcgctggaaaac

SEQ ID NO: 6020416 - DNA, 15 bp, Homo sapiens
catcgctggcccctt

SEQ ID NO: 6020417 - DNA, 17 bp, Homo sapiens
catcgctgttctgggca

SEQ ID NO: 6020418 - DNA, 15 bp, Homo sapiens
catcggaaaaataat

SEQ ID NO: 6020419 - DNA, 20 bp, Homo sapiens
catcggacaagacccccagc

SEQ ID NO: 6020420 - DNA, 21 bp, Homo sapiens
catcggacaagacccccagca

SEQ ID NO: 6020421 - DNA, 19 bp, Homo sapiens
catcggaggctgggcccct

SEQ ID NO: 6020422 - DNA, 21 bp, Homo sapiens
catcggaggctgggcccctgg

SEQ ID NO: 6020423 - DNA, 22 bp, Homo sapiens
catcggaggctgggcccctggg

SEQ ID NO: 6020424 - DNA, 20 bp, Homo sapiens
catcggcagctgaaccctgc

SEQ ID NO: 6020425 - DNA, 13 bp, Homo sapiens
catcggccctgtc

SEQ ID NO: 6020426 - DNA, 14 bp, Homo sapiens
catcggccctgtcc

SEQ ID NO: 6020427 - DNA, 16 bp, Homo sapiens
catcggccctgtcccc

SEQ ID NO: 6020428 - DNA, 13 bp, Homo sapiens
catcgggaaagaa

SEQ ID NO: 6020429 - DNA, 20 bp, Homo sapiens
catcgggagcacccagagca

SEQ ID NO: 6020430 - DNA, 17 bp, Homo sapiens
catcgggctcaccttaa

SEQ ID NO: 6020431 - DNA, 13 bp, Homo sapiens
catcgggctgagg

SEQ ID NO: 6020432 - DNA, 14 bp, Homo sapiens
catcgggggcctgc

SEQ ID NO: 6020433 - DNA, 21 bp, Homo sapiens
catcggtgaaactaacagata

SEQ ID NO: 6020434 - DNA, 18 bp, Homo sapiens
catcggtgtccatttata

SEQ ID NO: 6020435 - DNA, 15 bp, Homo sapiens
catcggttcaggagg

SEQ ID NO: 6020436 - DNA, 19 bp, Homo sapiens
catcggttcaggaggagac

SEQ ID NO: 6020437 - DNA, 21 bp, Homo sapiens
catcgtaggcagccacggccc

SEQ ID NO: 6020438 - DNA, 15 bp, Homo sapiens
catcgtaggtgattt

SEQ ID NO: 6020439 - DNA, 22 bp, Homo sapiens
catcgtattaaaaaacaattaa

SEQ ID NO: 6020440 - DNA, 23 bp, Homo sapiens
catcgtattaaaaaacaattaac

SEQ ID NO: 6020441 - DNA, 16 bp, Homo sapiens
catcgtcatttgctgt

SEQ ID NO: 6020442 - DNA, 14 bp, Homo sapiens
catcgtccagccct

SEQ ID NO: 6020443 - DNA, 23 bp, Homo sapiens
catcgtcctgggactcggagact

SEQ ID NO: 6020444 - DNA, 16 bp, Homo sapiens
catcgtccttcctctc

SEQ ID NO: 6020445 - DNA, 17 bp, Homo sapiens
catcgtcttcttggcca

SEQ ID NO: 6020446 - DNA, 20 bp, Homo sapiens
catcgtgaaaccctgtctct

SEQ ID NO: 6020447 - DNA, 20 bp, Homo sapiens
catcgtgacccttcagggcc

SEQ ID NO: 6020448 - DNA, 19 bp, Homo sapiens
catcgtgatcactgagcca

SEQ ID NO: 6020449 - DNA, 17 bp, Homo sapiens
catcgtggtatgtgaat

SEQ ID NO: 6020450 - DNA, 23 bp, Homo sapiens
catcgtgtctggcgttgtgggga

SEQ ID NO: 6020451 - DNA, 17 bp, Homo sapiens
catcgttctaaaatcaa

SEQ ID NO: 6020452 - DNA, 15 bp, Homo sapiens
catcgttgcccccat

SEQ ID NO: 6020453 - DNA, 15 bp, Homo sapiens
catcgttgttattaa

SEQ ID NO: 6020454 - DNA, 20 bp, Homo sapiens
catcgttttctttgctgtgc

SEQ ID NO: 6020455 - DNA, 23 bp, Homo sapiens
catcgttttctttgctgtgccaa

SEQ ID NO: 6020456 - DNA, 18 bp, Homo sapiens
catctaaaaatatacatg

SEQ ID NO: 6020457 - DNA, 19 bp, Homo sapiens
catctaaacacaacaataa

SEQ ID NO: 6020458 - DNA, 12 bp, Homo sapiens
catctaaaccac

SEQ ID NO: 6020459 - DNA, 12 bp, Homo sapiens
catctaaacttt

SEQ ID NO: 6020460 - DNA, 14 bp, Homo sapiens
catctaaactttaa

SEQ ID NO: 6020461 - DNA, 17 bp, Homo sapiens
catctaaactttaatat

SEQ ID NO: 6020462 - DNA, 12 bp, Homo sapiens
catctaaagctt

SEQ ID NO: 6020463 - DNA, 13 bp, Homo sapiens
catctaaagcttt

SEQ ID NO: 6020464 - DNA, 19 bp, Homo sapiens
catctaaagctttatcttt

SEQ ID NO: 6020465 - DNA, 23 bp, Homo sapiens
catctaaagctttatctttgtgt

SEQ ID NO: 6020466 - DNA, 12 bp, Homo sapiens
catctaaataaa

SEQ ID NO: 6020467 - DNA, 20 bp, Homo sapiens
catctaaattctgataattt

SEQ ID NO: 6020468 - DNA, 18 bp, Homo sapiens
catctaacaggaaaagag

SEQ ID NO: 6020469 - DNA, 14 bp, Homo sapiens
catctaaccaaaaa

SEQ ID NO: 6020470 - DNA, 22 bp, Homo sapiens
catctaactgatgagtaaactg

SEQ ID NO: 6020471 - DNA, 23 bp, Homo sapiens
catctaagaccacgaaaaaaggc

SEQ ID NO: 6020472 - DNA, 18 bp, Homo sapiens
catctaagcctgttgaga

SEQ ID NO: 6020473 - DNA, 21 bp, Homo sapiens
catctaagctgcagcttcctg

SEQ ID NO: 6020474 - DNA, 20 bp, Homo sapiens
catctaagttataagactct

SEQ ID NO: 6020475 - DNA, 18 bp, Homo sapiens
catctaatgcttgtttat

SEQ ID NO: 6020476 - DNA, 14 bp, Homo sapiens
catctaatgtatta

SEQ ID NO: 6020477 - DNA, 21 bp, Homo sapiens
catctaatgtctcttcctctg

SEQ ID NO: 6020478 - DNA, 13 bp, Homo sapiens
catctaattaaat

SEQ ID NO: 6020479 - DNA, 20 bp, Homo sapiens
catctaattcaagattacaa

SEQ ID NO: 6020480 - DNA, 21 bp, Homo sapiens
catctaattctctgtggaatg

SEQ ID NO: 6020481 - DNA, 13 bp, Homo sapiens
catctaattctga

SEQ ID NO: 6020482 - DNA, 16 bp, Homo sapiens
catctaattcttattt

SEQ ID NO: 6020483 - DNA, 20 bp, Homo sapiens
catctaattcttatttttaa

SEQ ID NO: 6020484 - DNA, 16 bp, Homo sapiens
catctacaaaacatta

SEQ ID NO: 6020485 - DNA, 16 bp, Homo sapiens
catctacaagcatttg

SEQ ID NO: 6020486 - DNA, 19 bp, Homo sapiens
catctacaatcagttgact

SEQ ID NO: 6020487 - DNA, 16 bp, Homo sapiens
catctacacagcctgg

SEQ ID NO: 6020488 - DNA, 17 bp, Homo sapiens
catctacacagcctgga

SEQ ID NO: 6020489 - DNA, 21 bp, Homo sapiens
catctacatgccatgcctatg

SEQ ID NO: 6020490 - DNA, 20 bp, Homo sapiens
catctacctagatttaatat

SEQ ID NO: 6020491 - DNA, 16 bp, Homo sapiens
catctaccttttctct

SEQ ID NO: 6020492 - DNA, 20 bp, Homo sapiens
catctaccttttctggcaaa

SEQ ID NO: 6020493 - DNA, 13 bp, Homo sapiens
catctacgaagcc

SEQ ID NO: 6020494 - DNA, 14 bp, Homo sapiens
catctacgaagcca

SEQ ID NO: 6020495 - DNA, 16 bp, Homo sapiens
catctacgaagccaca

SEQ ID NO: 6020496 - DNA, 20 bp, Homo sapiens
catctactctggaccaagga

SEQ ID NO: 6020497 - DNA, 23 bp, Homo sapiens
catctactctggaccaaggagca

SEQ ID NO: 6020498 - DNA, 17 bp, Homo sapiens
catctactcttttgaag

SEQ ID NO: 6020499 - DNA, 21 bp, Homo sapiens
catctactcttttgaagtgtt

SEQ ID NO: 6020500 - DNA, 18 bp, Homo sapiens
catctactgaatgacctc

SEQ ID NO: 6020501 - DNA, 15 bp, Homo sapiens
catctacttaataaa

SEQ ID NO: 6020502 - DNA, 22 bp, Homo sapiens
catctacttttttatccacctc

SEQ ID NO: 6020503 - DNA, 15 bp, Homo sapiens
catctagaattcact

SEQ ID NO: 6020504 - DNA, 23 bp, Homo sapiens
catctagagattttcttggcagt

SEQ ID NO: 6020505 - DNA, 19 bp, Homo sapiens
catctagagcttgatgcca

SEQ ID NO: 6020506 - DNA, 21 bp, Homo sapiens
catctagaggcttccttcatt

SEQ ID NO: 6020507 - DNA, 22 bp, Homo sapiens
catctagaggcttccttcattt

SEQ ID NO: 6020508 - DNA, 14 bp, Homo sapiens
catctagcaaatgt

SEQ ID NO: 6020509 - DNA, 17 bp, Homo sapiens
catctagcagctggcct

SEQ ID NO: 6020510 - DNA, 18 bp, Homo sapiens
catctagcagctggccta

SEQ ID NO: 6020511 - DNA, 16 bp, Homo sapiens
catctagcagtaaata

SEQ ID NO: 6020512 - DNA, 19 bp, Homo sapiens
catctagcagtaaatactt

SEQ ID NO: 6020513 - DNA, 22 bp, Homo sapiens
catctagcagtaaatacttgca

SEQ ID NO: 6020514 - DNA, 13 bp, Homo sapiens
catctagccagcc

SEQ ID NO: 6020515 - DNA, 22 bp, Homo sapiens
catctagccagcccctcttccc

SEQ ID NO: 6020516 - DNA, 17 bp, Homo sapiens
catctagcctaaagtat

SEQ ID NO: 6020517 - DNA, 22 bp, Homo sapiens
catctaggagcaaggtgagaaa

SEQ ID NO: 6020518 - DNA, 20 bp, Homo sapiens
catctaggggagccttgatt

SEQ ID NO: 6020519 - DNA, 12 bp, Homo sapiens
catctaggtcct

SEQ ID NO: 6020520 - DNA, 22 bp, Homo sapiens
catctagtcttgacctctccag

SEQ ID NO: 6020521 - DNA, 23 bp, Homo sapiens
catctagtcttgacctctccagc

SEQ ID NO: 6020522 - DNA, 21 bp, Homo sapiens
catctagttcccctgtttatt

SEQ ID NO: 6020523 - DNA, 13 bp, Homo sapiens
catctagttttaa

SEQ ID NO: 6020524 - DNA, 14 bp, Homo sapiens
catctataaattgt

SEQ ID NO: 6020525 - DNA, 20 bp, Homo sapiens
catctatcactgcattatct

SEQ ID NO: 6020526 - DNA, 19 bp, Homo sapiens
catctatccacactgtcaa

SEQ ID NO: 6020527 - DNA, 13 bp, Homo sapiens
catctatctagtt

SEQ ID NO: 6020528 - DNA, 16 bp, Homo sapiens
catctatctcaatcct

SEQ ID NO: 6020529 - DNA, 14 bp, Homo sapiens
catctatctgtgct

SEQ ID NO: 6020530 - DNA, 16 bp, Homo sapiens
catctatggagggcag

SEQ ID NO: 6020531 - DNA, 21 bp, Homo sapiens
catctatggcagtccagccag

SEQ ID NO: 6020532 - DNA, 20 bp, Homo sapiens
catctatgggagagtgtcaa

SEQ ID NO: 6020533 - DNA, 13 bp, Homo sapiens
catctatgtcata

SEQ ID NO: 6020534 - DNA, 20 bp, Homo sapiens
catctatgtgtatgttgact

SEQ ID NO: 6020535 - DNA, 18 bp, Homo sapiens
catctattataaaaccat

SEQ ID NO: 6020536 - DNA, 13 bp, Homo sapiens
catctattctctc

SEQ ID NO: 6020537 - DNA, 20 bp, Homo sapiens
catctattctctccaaaaat

SEQ ID NO: 6020538 - DNA, 19 bp, Homo sapiens
catctattgcagagactca

SEQ ID NO: 6020539 - DNA, 14 bp, Homo sapiens
catctatttctgag

SEQ ID NO: 6020540 - DNA, 15 bp, Homo sapiens
catctatttctgaga

SEQ ID NO: 6020541 - DNA, 13 bp, Homo sapiens
catctattttgat

SEQ ID NO: 6020542 - DNA, 14 bp, Homo sapiens
catctattttgatg

SEQ ID NO: 6020543 - DNA, 19 bp, Homo sapiens
catctattttgatgcagca

SEQ ID NO: 6020544 - DNA, 22 bp, Homo sapiens
catctattttgatgcagcattt

SEQ ID NO: 6020545 - DNA, 23 bp, Homo sapiens
catctattttgatgcagcatttg

SEQ ID NO: 6020546 - DNA, 16 bp, Homo sapiens
catctattttggattg

SEQ ID NO: 6020547 - DNA, 13 bp, Homo sapiens
catctcaaaaaaa

SEQ ID NO: 6020548 - DNA, 15 bp, Homo sapiens
catctcaaaaaaaca

SEQ ID NO: 6020549 - DNA, 16 bp, Homo sapiens
catctcaaaaaaacaa

SEQ ID NO: 6020550 - DNA, 14 bp, Homo sapiens
catctcaaaacaaa

SEQ ID NO: 6020551 - DNA, 19 bp, Homo sapiens
catctcaaaacagagggct

SEQ ID NO: 6020552 - DNA, 14 bp, Homo sapiens
catctcaaaattat

SEQ ID NO: 6020553 - DNA, 19 bp, Homo sapiens
catctcaacaggcctcagg

SEQ ID NO: 6020554 - DNA, 20 bp, Homo sapiens
catctcaacaggcctcaggg

SEQ ID NO: 6020555 - DNA, 21 bp, Homo sapiens
catctcaacaggcctcagggc

SEQ ID NO: 6020556 - DNA, 15 bp, Homo sapiens
catctcaacctacct

SEQ ID NO: 6020557 - DNA, 16 bp, Homo sapiens
catctcaacctacctc

SEQ ID NO: 6020558 - DNA, 20 bp, Homo sapiens
catctcaagatgtttatctg

SEQ ID NO: 6020559 - DNA, 21 bp, Homo sapiens
catctcaatggcatgggtggg

SEQ ID NO: 6020560 - DNA, 18 bp, Homo sapiens
catctcaattttttcaaa

SEQ ID NO: 6020561 - DNA, 22 bp, Homo sapiens
catctcaattttttcaaatgaa

SEQ ID NO: 6020562 - DNA, 13 bp, Homo sapiens
catctcacagcta

SEQ ID NO: 6020563 - DNA, 20 bp, Homo sapiens
cagctgcttctccccccatc

SEQ ID NO: 6020564 - DNA, 14 bp, Homo sapiens
cagctgcttctgcc

SEQ ID NO: 6020565 - DNA, 18 bp, Homo sapiens
cagctgcttctgcccacc

SEQ ID NO: 6020566 - DNA, 17 bp, Homo sapiens
cagctgcttctgctgcc

SEQ ID NO: 6020567 - DNA, 22 bp, Homo sapiens
cagctgcttgacctagctcttt

SEQ ID NO: 6020568 - DNA, 16 bp, Homo sapiens
cagctgcttgggcttc

SEQ ID NO: 6020569 - DNA, 19 bp, Homo sapiens
cagctgcttgggcttcatc

SEQ ID NO: 6020570 - DNA, 22 bp, Homo sapiens
cagctgcttgggcttcatcctc

SEQ ID NO: 6020571 - DNA, 16 bp, Homo sapiens
cagctgctttacttaa

SEQ ID NO: 6020572 - DNA, 15 bp, Homo sapiens
cagctgctttcttct

SEQ ID NO: 6020573 - DNA, 20 bp, Homo sapiens
cagctgctttgagctacagg

SEQ ID NO: 6020574 - DNA, 16 bp, Homo sapiens
cagctgctttgttacc

SEQ ID NO: 6020575 - DNA, 22 bp, Homo sapiens
cagctgctttgttaccttaaaa

SEQ ID NO: 6020576 - DNA, 23 bp, Homo sapiens
cagctgcttttgtctatgggact

SEQ ID NO: 6020577 - DNA, 18 bp, Homo sapiens
cagctggaaacttctgta

SEQ ID NO: 6020578 - DNA, 19 bp, Homo sapiens
cagctggaaacttctgtaa

SEQ ID NO: 6020579 - DNA, 20 bp, Homo sapiens
cagctggaaacttctgtaag

SEQ ID NO: 6020580 - DNA, 21 bp, Homo sapiens
cagctggaaagttgggcccct

SEQ ID NO: 6020581 - DNA, 21 bp, Homo sapiens
cagctggaagtctacctgctg

SEQ ID NO: 6020582 - DNA, 16 bp, Homo sapiens
cagctggaatgtgcca

SEQ ID NO: 6020583 - DNA, 20 bp, Homo sapiens
cagctggaatgtgccacaga

SEQ ID NO: 6020584 - DNA, 22 bp, Homo sapiens
cagctggaatgtgccacagagg

SEQ ID NO: 6020585 - DNA, 17 bp, Homo sapiens
cagctggaattatgctg

SEQ ID NO: 6020586 - DNA, 19 bp, Homo sapiens
cagctggaattgctgctct

SEQ ID NO: 6020587 - DNA, 21 bp, Homo sapiens
cagctggaattgctgctctct

SEQ ID NO: 6020588 - DNA, 21 bp, Homo sapiens
cagctggaatttaaggaggga

SEQ ID NO: 6020589 - DNA, 14 bp, Homo sapiens
cagctggacacccc

SEQ ID NO: 6020590 - DNA, 20 bp, Homo sapiens
cagctggacatactgctgga

SEQ ID NO: 6020591 - DNA, 21 bp, Homo sapiens
cagctggacccatttgccagg

SEQ ID NO: 6020592 - DNA, 16 bp, Homo sapiens
cagctggaccctgacc

SEQ ID NO: 6020593 - DNA, 18 bp, Homo sapiens
cagctggactctgcatcc

SEQ ID NO: 6020594 - DNA, 12 bp, Homo sapiens
cagctggactgc

SEQ ID NO: 6020595 - DNA, 19 bp, Homo sapiens
cagctggactgcattgaag

SEQ ID NO: 6020596 - DNA, 17 bp, Homo sapiens
cagctggactgctgctg

SEQ ID NO: 6020597 - DNA, 22 bp, Homo sapiens
cagctggaggaatacattttat

SEQ ID NO: 6020598 - DNA, 23 bp, Homo sapiens
cagctggagtggggtttgctttt

SEQ ID NO: 6020599 - DNA, 15 bp, Homo sapiens
cagctggatctgctt

SEQ ID NO: 6020600 - DNA, 21 bp, Homo sapiens
cagctggatgagacttccaaa

SEQ ID NO: 6020601 - DNA, 13 bp, Homo sapiens
cagctggcactga

SEQ ID NO: 6020602 - DNA, 21 bp, Homo sapiens
cagctggcactgacagcctgg

SEQ ID NO: 6020603 - DNA, 14 bp, Homo sapiens
cagctggcagcgcc

SEQ ID NO: 6020604 - DNA, 14 bp, Homo sapiens
cagctggcaggaga

SEQ ID NO: 6020605 - DNA, 15 bp, Homo sapiens
cagctggccacctag

SEQ ID NO: 6020606 - DNA, 20 bp, Homo sapiens
cagctggcccactgctggct

SEQ ID NO: 6020607 - DNA, 21 bp, Homo sapiens
cagctggcccactgctggctg

SEQ ID NO: 6020608 - DNA, 14 bp, Homo sapiens
cagctggcccccag

SEQ ID NO: 6020609 - DNA, 20 bp, Homo sapiens
cagctggcccccagccctgg

SEQ ID NO: 6020610 - DNA, 10 bp, Homo sapiens
cagctggcct

SEQ ID NO: 6020611 - DNA, 14 bp, Homo sapiens
cagctggcctctag

SEQ ID NO: 6020612 - DNA, 12 bp, Homo sapiens
cagctggcctgg

SEQ ID NO: 6020613 - DNA, 17 bp, Homo sapiens
cagctggcctggacagt

SEQ ID NO: 6020614 - DNA, 21 bp, Homo sapiens
cagctggcctggcccccagct

SEQ ID NO: 6020615 - DNA, 14 bp, Homo sapiens
cagctggcctgggg

SEQ ID NO: 6020616 - DNA, 20 bp, Homo sapiens
cagctggcctggtttcctcg

SEQ ID NO: 6020617 - DNA, 16 bp, Homo sapiens
cagctggcctttgtaa

SEQ ID NO: 6020618 - DNA, 19 bp, Homo sapiens
cagctggcggaacctggct

SEQ ID NO: 6020619 - DNA, 18 bp, Homo sapiens
cagctggcggaggctgct

SEQ ID NO: 6020620 - DNA, 18 bp, Homo sapiens
cagctggctagcattcct

SEQ ID NO: 6020621 - DNA, 14 bp, Homo sapiens
cagctggctctcca

SEQ ID NO: 6020622 - DNA, 16 bp, Homo sapiens
cagctggctctccacc

SEQ ID NO: 6020623 - DNA, 22 bp, Homo sapiens
cagctggctctgacaagatggt

SEQ ID NO: 6020624 - DNA, 15 bp, Homo sapiens
cagctggctctgcag

SEQ ID NO: 6020625 - DNA, 11 bp, Homo sapiens
cagctggctgc

SEQ ID NO: 6020626 - DNA, 12 bp, Homo sapiens
cagctggctgct

SEQ ID NO: 6020627 - DNA, 16 bp, Homo sapiens
cagctggctgctgaca

SEQ ID NO: 6020628 - DNA, 19 bp, Homo sapiens
cagctggctgctgacagga

SEQ ID NO: 6020629 - DNA, 22 bp, Homo sapiens
cagctggctgggtcgcccctcc

SEQ ID NO: 6020630 - DNA, 19 bp, Homo sapiens
cagctgggaagaacatgct

SEQ ID NO: 6020631 - DNA, 16 bp, Homo sapiens
cagctgggacccctcc

SEQ ID NO: 6020632 - DNA, 17 bp, Homo sapiens
cagctgggacctaatgc

SEQ ID NO: 6020633 - DNA, 20 bp, Homo sapiens
cagctgggacctaatgctgg

SEQ ID NO: 6020634 - DNA, 22 bp, Homo sapiens
cagctgggacctaatgctggcc

SEQ ID NO: 6020635 - DNA, 18 bp, Homo sapiens
cagctgggactacaggcg

SEQ ID NO: 6020636 - DNA, 15 bp, Homo sapiens
cagctgggagccagt

SEQ ID NO: 6020637 - DNA, 15 bp, Homo sapiens
cagctgggagcctgg

SEQ ID NO: 6020638 - DNA, 13 bp, Homo sapiens
cagctgggaggca

SEQ ID NO: 6020639 - DNA, 22 bp, Homo sapiens
cagctgggaggcaagaggggtg

SEQ ID NO: 6020640 - DNA, 23 bp, Homo sapiens
cagctgggatcacatgtggactt

SEQ ID NO: 6020641 - DNA, 15 bp, Homo sapiens
cagctgggcaaagcc

SEQ ID NO: 6020642 - DNA, 16 bp, Homo sapiens
cagctgggcaaagcca

SEQ ID NO: 6020643 - DNA, 19 bp, Homo sapiens
cagctgggcagtgccagcc

SEQ ID NO: 6020644 - DNA, 16 bp, Homo sapiens
cagctgggcatgccat

SEQ ID NO: 6020645 - DNA, 20 bp, Homo sapiens
cagctgggccactcctcttc

SEQ ID NO: 6020646 - DNA, 22 bp, Homo sapiens
cagctgggccactcctcttcac

SEQ ID NO: 6020647 - DNA, 15 bp, Homo sapiens
cagctgggcccaacc

SEQ ID NO: 6020648 - DNA, 14 bp, Homo sapiens
cagctgggcccaca

SEQ ID NO: 6020649 - DNA, 17 bp, Homo sapiens
cagctgggcccacagcc

SEQ ID NO: 6020650 - DNA, 21 bp, Homo sapiens
cagctgggcccacagccccca

SEQ ID NO: 6020651 - DNA, 23 bp, Homo sapiens
cagctgggcccacagcccccacc

SEQ ID NO: 6020652 - DNA, 13 bp, Homo sapiens
cagctgggcccca

SEQ ID NO: 6020653 - DNA, 22 bp, Homo sapiens
cagctgggccccatgctctgcc

SEQ ID NO: 6020654 - DNA, 17 bp, Homo sapiens
cagctgggccggccagc

SEQ ID NO: 6020655 - DNA, 19 bp, Homo sapiens
cagctgggctagaggctga

SEQ ID NO: 6020656 - DNA, 24 bp, Homo sapiens
cagctgggctagaggctgagcacc

SEQ ID NO: 6020657 - DNA, 16 bp, Homo sapiens
cagctgggctctgcca

SEQ ID NO: 6020658 - DNA, 14 bp, Homo sapiens
cagctgggctgtgg

SEQ ID NO: 6020659 - DNA, 19 bp, Homo sapiens
cagctgggcttggcctgga

SEQ ID NO: 6020660 - DNA, 22 bp, Homo sapiens
cagctgggcttggcctggagag

SEQ ID NO: 6020661 - DNA, 17 bp, Homo sapiens
cagctggggagatgggg

SEQ ID NO: 6020662 - DNA, 17 bp, Homo sapiens
cagctggggagcagctg

SEQ ID NO: 6020663 - DNA, 17 bp, Homo sapiens
cagctggggccagaggc

SEQ ID NO: 6020664 - DNA, 18 bp, Homo sapiens
cagctggggcccctcggc

SEQ ID NO: 6020665 - DNA, 18 bp, Homo sapiens
cagctggggcgtggggag

SEQ ID NO: 6020666 - DNA, 20 bp, Homo sapiens
cagctggggcgtggggaggg

SEQ ID NO: 6020667 - DNA, 13 bp, Homo sapiens
cagctggggctgt

SEQ ID NO: 6020668 - DNA, 20 bp, Homo sapiens
cagctggggggctgtcctga

SEQ ID NO: 6020669 - DNA, 16 bp, Homo sapiens
cagctggggtcctgtc

SEQ ID NO: 6020670 - DNA, 22 bp, Homo sapiens
cagctggggtggggacctcagg

SEQ ID NO: 6020671 - DNA, 14 bp, Homo sapiens
cagctgggtcaggc

SEQ ID NO: 6020672 - DNA, 18 bp, Homo sapiens
cagctgggtcaggcaggg

SEQ ID NO: 6020673 - DNA, 11 bp, Homo sapiens
cagctgggtgg

SEQ ID NO: 6020674 - DNA, 17 bp, Homo sapiens
cagctgggtggcactgc

SEQ ID NO: 6020675 - DNA, 22 bp, Homo sapiens
cagctgggtggcactgccatgc

SEQ ID NO: 6020676 - DNA, 16 bp, Homo sapiens
cagctgggttggaaaa

SEQ ID NO: 6020677 - DNA, 17 bp, Homo sapiens
cagctgggttggaaaac

SEQ ID NO: 6020678 - DNA, 20 bp, Homo sapiens
cagctggtactgatgttcac

SEQ ID NO: 6020679 - DNA, 22 bp, Homo sapiens
cagctggtagctgggggcgcag

SEQ ID NO: 6020680 - DNA, 15 bp, Homo sapiens
cagctggtatattgt

SEQ ID NO: 6020681 - DNA, 16 bp, Homo sapiens
cagctggtcctgacca

SEQ ID NO: 6020682 - DNA, 17 bp, Homo sapiens
cagctggtcctgaccag

SEQ ID NO: 6020683 - DNA, 18 bp, Homo sapiens
cagctggtcctgaccagg

SEQ ID NO: 6020684 - DNA, 21 bp, Homo sapiens
cagctggtcctgaccaggatg

SEQ ID NO: 6020685 - DNA, 15 bp, Homo sapiens
cagctggtcctgtgg

SEQ ID NO: 6020686 - DNA, 16 bp, Homo sapiens
cagctggtcctgtgga

SEQ ID NO: 6020687 - DNA, 21 bp, Homo sapiens
cagctggtcctgtggatggga

SEQ ID NO: 6020688 - DNA, 22 bp, Homo sapiens
cagctggtcttttctcctactc

SEQ ID NO: 6020689 - DNA, 19 bp, Homo sapiens
cagctggtgcaaattcaga

SEQ ID NO: 6020690 - DNA, 16 bp, Homo sapiens
cagctggtgccccacc

SEQ ID NO: 6020691 - DNA, 20 bp, Homo sapiens
cagctggtgccccacctgcc

SEQ ID NO: 6020692 - DNA, 18 bp, Homo sapiens
cagctggtgcccccagac

SEQ ID NO: 6020693 - DNA, 23 bp, Homo sapiens
cagctggtgcccccagacagctg

SEQ ID NO: 6020694 - DNA, 19 bp, Homo sapiens
cagctggtgccctgctttc

SEQ ID NO: 6020695 - DNA, 20 bp, Homo sapiens
cagctggtgccctgctttca

SEQ ID NO: 6020696 - DNA, 11 bp, Homo sapiens
cagctggtgga

SEQ ID NO: 6020697 - DNA, 15 bp, Homo sapiens
cagctggtggatggt

SEQ ID NO: 6020698 - DNA, 18 bp, Homo sapiens
cagctggtggatggtgac

SEQ ID NO: 6020699 - DNA, 22 bp, Homo sapiens
cagctggtggatggtgactttt

SEQ ID NO: 6020700 - DNA, 21 bp, Homo sapiens
cagctggtggccctgtgcctg

SEQ ID NO: 6020701 - DNA, 23 bp, Homo sapiens
cagctggtggccctgtgcctggg

SEQ ID NO: 6020702 - DNA, 20 bp, Homo sapiens
cagctggtgggaagcgtctg

SEQ ID NO: 6020703 - DNA, 20 bp, Homo sapiens
cagctggtgtagctacagag

SEQ ID NO: 6020704 - DNA, 22 bp, Homo sapiens
cagctggtgtagctacagagaa

SEQ ID NO: 6020705 - DNA, 21 bp, Homo sapiens
cagctggtgtcactctgcctc

SEQ ID NO: 6020706 - DNA, 17 bp, Homo sapiens
cagctggttactcaggg

SEQ ID NO: 6020707 - DNA, 21 bp, Homo sapiens
cagctggttactcagggttca

SEQ ID NO: 6020708 - DNA, 17 bp, Homo sapiens
cagctggttcagtactg

SEQ ID NO: 6020709 - DNA, 18 bp, Homo sapiens
cagctggttgaggtttca

SEQ ID NO: 6020710 - DNA, 22 bp, Homo sapiens
cagctggttgggggcaccatct

SEQ ID NO: 6020711 - DNA, 19 bp, Homo sapiens
cagctgtaagaagagactg

SEQ ID NO: 6020712 - DNA, 21 bp, Homo sapiens
cagctgtaagaagagactggg

SEQ ID NO: 6020713 - DNA, 22 bp, Homo sapiens
cagctgtaagaagagactggga

SEQ ID NO: 6020714 - DNA, 14 bp, Homo sapiens
cagctgtacaaatc

SEQ ID NO: 6020715 - DNA, 22 bp, Homo sapiens
cagctgtactgagttctcatcc

SEQ ID NO: 6020716 - DNA, 14 bp, Homo sapiens
cagctgtagaaagg

SEQ ID NO: 6020717 - DNA, 15 bp, Homo sapiens
cagctgtagaaaggt

SEQ ID NO: 6020718 - DNA, 14 bp, Homo sapiens
cagctgtagccatg

SEQ ID NO: 6020719 - DNA, 16 bp, Homo sapiens
cagctgtagccatggc

SEQ ID NO: 6020720 - DNA, 14 bp, Homo sapiens
cagctgtatagctg

SEQ ID NO: 6020721 - DNA, 23 bp, Homo sapiens
cagctgtatttatataagtctgt

SEQ ID NO: 6020722 - DNA, 23 bp, Homo sapiens
cagctgtattttggctttctccc

SEQ ID NO: 6020723 - DNA, 16 bp, Homo sapiens
cagctgtcaaggctca

SEQ ID NO: 6020724 - DNA, 18 bp, Homo sapiens
cagctgtcacctgctcac

SEQ ID NO: 6020725 - DNA, 23 bp, Homo sapiens
cagctgtcacctgctcacaggga

SEQ ID NO: 6020726 - DNA, 15 bp, Homo sapiens
cagctgtcagcctgg

SEQ ID NO: 6020727 - DNA, 20 bp, Homo sapiens
cagctgtcatggaaaagccc

SEQ ID NO: 6020728 - DNA, 22 bp, Homo sapiens
cagctgtcatggaaaagcccag

SEQ ID NO: 6020729 - DNA, 17 bp, Homo sapiens
cagctgtccccccactc

SEQ ID NO: 6020730 - DNA, 17 bp, Homo sapiens
cagctgtcccctctccc

SEQ ID NO: 6020731 - DNA, 20 bp, Homo sapiens
cagctgtcccctctccctgg

SEQ ID NO: 6020732 - DNA, 18 bp, Homo sapiens
cagctgtcctccctccac

SEQ ID NO: 6020733 - DNA, 16 bp, Homo sapiens
cagctgtcctcttctg

SEQ ID NO: 6020734 - DNA, 12 bp, Homo sapiens
cagctgtcctga

SEQ ID NO: 6020735 - DNA, 21 bp, Homo sapiens
cagctgtcctgaaccgactga

SEQ ID NO: 6020736 - DNA, 16 bp, Homo sapiens
cagctgtcctgcagca

SEQ ID NO: 6020737 - DNA, 20 bp, Homo sapiens
cagctgtcctgtgatgtcag

SEQ ID NO: 6020738 - DNA, 22 bp, Homo sapiens
cagctgtcgggggccactgtgt

SEQ ID NO: 6020739 - DNA, 13 bp, Homo sapiens
catctcacctccg

SEQ ID NO: 6020740 - DNA, 18 bp, Homo sapiens
catctcacctcctgctgg

SEQ ID NO: 6020741 - DNA, 20 bp, Homo sapiens
catctcacctctaggcctca

SEQ ID NO: 6020742 - DNA, 20 bp, Homo sapiens
catctcagacctttactgat

SEQ ID NO: 6020743 - DNA, 13 bp, Homo sapiens
catctcagagtcc

SEQ ID NO: 6020744 - DNA, 13 bp, Homo sapiens
catctcagattct

SEQ ID NO: 6020745 - DNA, 14 bp, Homo sapiens
catctcagcctcct

SEQ ID NO: 6020746 - DNA, 21 bp, Homo sapiens
catctcagcctcctgagcctg

SEQ ID NO: 6020747 - DNA, 14 bp, Homo sapiens
catctcagcttttg

SEQ ID NO: 6020748 - DNA, 22 bp, Homo sapiens
catctcaggaaaatctgtgatt

SEQ ID NO: 6020749 - DNA, 20 bp, Homo sapiens
catctcaggacacttccgta

SEQ ID NO: 6020750 - DNA, 22 bp, Homo sapiens
catctcaggagatggagggctt

SEQ ID NO: 6020751 - DNA, 23 bp, Homo sapiens
catctcaggagatggagggcttg

SEQ ID NO: 6020752 - DNA, 18 bp, Homo sapiens
catctcaggagatttcat

SEQ ID NO: 6020753 - DNA, 14 bp, Homo sapiens
catctcaggccacc

SEQ ID NO: 6020754 - DNA, 20 bp, Homo sapiens
catctcaggccacctgcccc

SEQ ID NO: 6020755 - DNA, 22 bp, Homo sapiens
catctcaggccacctgccccct

SEQ ID NO: 6020756 - DNA, 20 bp, Homo sapiens
catctcagggaactgaccct

SEQ ID NO: 6020757 - DNA, 22 bp, Homo sapiens
catctcagggaactgaccctca

SEQ ID NO: 6020758 - DNA, 15 bp, Homo sapiens
catctcaggggccag

SEQ ID NO: 6020759 - DNA, 13 bp, Homo sapiens
catctcagggtcc

SEQ ID NO: 6020760 - DNA, 12 bp, Homo sapiens
catctcaggtgc

SEQ ID NO: 6020761 - DNA, 15 bp, Homo sapiens
catctcaggtgccac

SEQ ID NO: 6020762 - DNA, 21 bp, Homo sapiens
catctcaggtggcatttgcag

SEQ ID NO: 6020763 - DNA, 17 bp, Homo sapiens
catctcagtcctcaaag

SEQ ID NO: 6020764 - DNA, 22 bp, Homo sapiens
catctcagtgaagaatacttct

SEQ ID NO: 6020765 - DNA, 20 bp, Homo sapiens
catctcagttcactgcaact

SEQ ID NO: 6020766 - DNA, 21 bp, Homo sapiens
catctcatcatgtctattgtc

SEQ ID NO: 6020767 - DNA, 12 bp, Homo sapiens
catctcatcctg

SEQ ID NO: 6020768 - DNA, 21 bp, Homo sapiens
catctcatcgtcctagaaagc

SEQ ID NO: 6020769 - DNA, 23 bp, Homo sapiens
catctcatgaggggagaggagac

SEQ ID NO: 6020770 - DNA, 12 bp, Homo sapiens
catctcatgctc

SEQ ID NO: 6020771 - DNA, 22 bp, Homo sapiens
catctcattcaaaccccaccct

SEQ ID NO: 6020772 - DNA, 17 bp, Homo sapiens
catctcattgaggacaa

SEQ ID NO: 6020773 - DNA, 15 bp, Homo sapiens
catctcattgtagag

SEQ ID NO: 6020774 - DNA, 20 bp, Homo sapiens
catctcattgtagagcttgg

SEQ ID NO: 6020775 - DNA, 18 bp, Homo sapiens
catctcatttaagggaaa

SEQ ID NO: 6020776 - DNA, 19 bp, Homo sapiens
catctcatttaagggaaaa

SEQ ID NO: 6020777 - DNA, 21 bp, Homo sapiens
catctcatttaagggaaaaat

SEQ ID NO: 6020778 - DNA, 14 bp, Homo sapiens
catctccaagaatg

SEQ ID NO: 6020779 - DNA, 18 bp, Homo sapiens
catctccaagataagcct

SEQ ID NO: 6020780 - DNA, 20 bp, Homo sapiens
catctccaagataagcctga

SEQ ID NO: 6020781 - DNA, 18 bp, Homo sapiens
catctccaaggatcctct

SEQ ID NO: 6020782 - DNA, 17 bp, Homo sapiens
catctccacaaatagtc

SEQ ID NO: 6020783 - DNA, 19 bp, Homo sapiens
catctccacaggagagact

SEQ ID NO: 6020784 - DNA, 16 bp, Homo sapiens
catctccacccccagc

SEQ ID NO: 6020785 - DNA, 16 bp, Homo sapiens
catctccaccctgagc

SEQ ID NO: 6020786 - DNA, 18 bp, Homo sapiens
catctccaccctgagcct

SEQ ID NO: 6020787 - DNA, 20 bp, Homo sapiens
catctccagaaaaatgaaaa

SEQ ID NO: 6020788 - DNA, 22 bp, Homo sapiens
catctccagcatcctgcttcct

SEQ ID NO: 6020789 - DNA, 21 bp, Homo sapiens
catctccagcattctcagcca

SEQ ID NO: 6020790 - DNA, 22 bp, Homo sapiens
catctccagcattctcagccac

SEQ ID NO: 6020791 - DNA, 20 bp, Homo sapiens
catctccagggagcaagaca

SEQ ID NO: 6020792 - DNA, 22 bp, Homo sapiens
catctccagggagtcccctccc

SEQ ID NO: 6020793 - DNA, 17 bp, Homo sapiens
catctccatcttgaagg

SEQ ID NO: 6020794 - DNA, 12 bp, Homo sapiens
catctccatgct

SEQ ID NO: 6020795 - DNA, 13 bp, Homo sapiens
catctccatgctc

SEQ ID NO: 6020796 - DNA, 13 bp, Homo sapiens
catctccatgggg

SEQ ID NO: 6020797 - DNA, 13 bp, Homo sapiens
catctccatttca

SEQ ID NO: 6020798 - DNA, 18 bp, Homo sapiens
catctccatttcacacag

SEQ ID NO: 6020799 - DNA, 19 bp, Homo sapiens
catctccatttcacgggca

SEQ ID NO: 6020800 - DNA, 21 bp, Homo sapiens
catctcccacctagcagcacc

SEQ ID NO: 6020801 - DNA, 19 bp, Homo sapiens
catctcccagatcctggaa

SEQ ID NO: 6020802 - DNA, 18 bp, Homo sapiens
catctcccaggccccagg

SEQ ID NO: 6020803 - DNA, 14 bp, Homo sapiens
catctcccatgtgt

SEQ ID NO: 6020804 - DNA, 20 bp, Homo sapiens
catctcccccatagcaccct

SEQ ID NO: 6020805 - DNA, 21 bp, Homo sapiens
catctcccctagctcaccagg

SEQ ID NO: 6020806 - DNA, 14 bp, Homo sapiens
catctcccctcagc

SEQ ID NO: 6020807 - DNA, 15 bp, Homo sapiens
catctcccctttgct

SEQ ID NO: 6020808 - DNA, 24 bp, Homo sapiens
catctccctcgaacccacactgca

SEQ ID NO: 6020809 - DNA, 16 bp, Homo sapiens
catctccctgaccttc

SEQ ID NO: 6020810 - DNA, 14 bp, Homo sapiens
catctccctgccat

SEQ ID NO: 6020811 - DNA, 15 bp, Homo sapiens
catctccctgccatc

SEQ ID NO: 6020812 - DNA, 17 bp, Homo sapiens
catctccctgccatccc

SEQ ID NO: 6020813 - DNA, 22 bp, Homo sapiens
catctccctgccatccccctct

SEQ ID NO: 6020814 - DNA, 15 bp, Homo sapiens
catctccctgcctgg

SEQ ID NO: 6020815 - DNA, 15 bp, Homo sapiens
catctccctggtgct

SEQ ID NO: 6020816 - DNA, 15 bp, Homo sapiens
catctcccttcatta

SEQ ID NO: 6020817 - DNA, 22 bp, Homo sapiens
catctcccttcattagctgctc

SEQ ID NO: 6020818 - DNA, 16 bp, Homo sapiens
catctcccttccacct

SEQ ID NO: 6020819 - DNA, 17 bp, Homo sapiens
catctcccttccacctc

SEQ ID NO: 6020820 - DNA, 17 bp, Homo sapiens
catctcccttttccatg

SEQ ID NO: 6020821 - DNA, 12 bp, Homo sapiens
catctccgcctc

SEQ ID NO: 6020822 - DNA, 16 bp, Homo sapiens
catctccgcctccaca

SEQ ID NO: 6020823 - DNA, 20 bp, Homo sapiens
catctccgcctccacactga

SEQ ID NO: 6020824 - DNA, 18 bp, Homo sapiens
catctcctataatctgtc

SEQ ID NO: 6020825 - DNA, 20 bp, Homo sapiens
catctcctataatctgtcaa

SEQ ID NO: 6020826 - DNA, 21 bp, Homo sapiens
catctcctataatctgtcaaa

SEQ ID NO: 6020827 - DNA, 15 bp, Homo sapiens
catctcctctatcac

SEQ ID NO: 6020828 - DNA, 11 bp, Homo sapiens
catctcctctc

SEQ ID NO: 6020829 - DNA, 12 bp, Homo sapiens
catctcctgagt

SEQ ID NO: 6020830 - DNA, 23 bp, Homo sapiens
catctcctggctaagcctctgct

SEQ ID NO: 6020831 - DNA, 14 bp, Homo sapiens
catctcctgtcctg

SEQ ID NO: 6020832 - DNA, 15 bp, Homo sapiens
catctcctgtgcatg

SEQ ID NO: 6020833 - DNA, 23 bp, Homo sapiens
catctccttacagtcactaatat

SEQ ID NO: 6020834 - DNA, 17 bp, Homo sapiens
catctccttcccccagc

SEQ ID NO: 6020835 - DNA, 18 bp, Homo sapiens
catctccttcccccagcc

SEQ ID NO: 6020836 - DNA, 23 bp, Homo sapiens
catctccttcccccagcccaata

SEQ ID NO: 6020837 - DNA, 15 bp, Homo sapiens
catctcctttgcaga

SEQ ID NO: 6020838 - DNA, 20 bp, Homo sapiens
catctcggagcatcccggag

SEQ ID NO: 6020839 - DNA, 23 bp, Homo sapiens
catctcggatcatatggagctca

SEQ ID NO: 6020840 - DNA, 15 bp, Homo sapiens
catctcggggctgct

SEQ ID NO: 6020841 - DNA, 20 bp, Homo sapiens
catctcggttctgcgccact

SEQ ID NO: 6020842 - DNA, 22 bp, Homo sapiens
catctcggttctgcgccacttc

SEQ ID NO: 6020843 - DNA, 16 bp, Homo sapiens
catctcgtatggattt

SEQ ID NO: 6020844 - DNA, 18 bp, Homo sapiens
catctctaacagctcagg

SEQ ID NO: 6020845 - DNA, 23 bp, Homo sapiens
catctctaacagctcaggatctc

SEQ ID NO: 6020846 - DNA, 16 bp, Homo sapiens
catctctacaaaaagc

SEQ ID NO: 6020847 - DNA, 14 bp, Homo sapiens
catctctattaaaa

SEQ ID NO: 6020848 - DNA, 15 bp, Homo sapiens
catctctcaaactta

SEQ ID NO: 6020849 - DNA, 14 bp, Homo sapiens
catctctccagaga

SEQ ID NO: 6020850 - DNA, 17 bp, Homo sapiens
catctctccagagagca

SEQ ID NO: 6020851 - DNA, 20 bp, Homo sapiens
catctctccagagagcaaac

SEQ ID NO: 6020852 - DNA, 15 bp, Homo sapiens
catctctccctcccc

SEQ ID NO: 6020853 - DNA, 23 bp, Homo sapiens
catctctccctcccctgccattt

SEQ ID NO: 6020854 - DNA, 20 bp, Homo sapiens
catctctcccttacccatct

SEQ ID NO: 6020855 - DNA, 16 bp, Homo sapiens
catctctctacctcca

SEQ ID NO: 6020856 - DNA, 11 bp, Homo sapiens
catctctctcc

SEQ ID NO: 6020857 - DNA, 18 bp, Homo sapiens
catctctctcttgcctga

SEQ ID NO: 6020858 - DNA, 13 bp, Homo sapiens
catctctctgccc

SEQ ID NO: 6020859 - DNA, 15 bp, Homo sapiens
catctctctgcccaa

SEQ ID NO: 6020860 - DNA, 21 bp, Homo sapiens
catctctctgccccacataat

SEQ ID NO: 6020861 - DNA, 15 bp, Homo sapiens
catctctctggccct

SEQ ID NO: 6020862 - DNA, 13 bp, Homo sapiens
catctctctggct

SEQ ID NO: 6020863 - DNA, 14 bp, Homo sapiens
catctctctggctt

SEQ ID NO: 6020864 - DNA, 14 bp, Homo sapiens
catctctctttaat

SEQ ID NO: 6020865 - DNA, 13 bp, Homo sapiens
catctctgaaaac

SEQ ID NO: 6020866 - DNA, 21 bp, Homo sapiens
catctctgaaaacaagagact

SEQ ID NO: 6020867 - DNA, 18 bp, Homo sapiens
catctctgaaaattctgg

SEQ ID NO: 6020868 - DNA, 23 bp, Homo sapiens
catctctgaactggtagaaaaac

SEQ ID NO: 6020869 - DNA, 12 bp, Homo sapiens
catctctgaagg

SEQ ID NO: 6020870 - DNA, 13 bp, Homo sapiens
catctctgaccag

SEQ ID NO: 6020871 - DNA, 14 bp, Homo sapiens
catctctgaccaga

SEQ ID NO: 6020872 - DNA, 13 bp, Homo sapiens
catctctgacttt

SEQ ID NO: 6020873 - DNA, 10 bp, Homo sapiens
catctctgag

SEQ ID NO: 6020874 - DNA, 22 bp, Homo sapiens
catctctgcagctcaaagatgt

SEQ ID NO: 6020875 - DNA, 22 bp, Homo sapiens
catctctgcagtttttcccaag

SEQ ID NO: 6020876 - DNA, 15 bp, Homo sapiens
catctctgcctgaca

SEQ ID NO: 6020877 - DNA, 22 bp, Homo sapiens
catctctgcctgacaaggccag

SEQ ID NO: 6020878 - DNA, 15 bp, Homo sapiens
catctctgcctgtca

SEQ ID NO: 6020879 - DNA, 11 bp, Homo sapiens
catctctgctg

SEQ ID NO: 6020880 - DNA, 15 bp, Homo sapiens
catctctgctgaaca

SEQ ID NO: 6020881 - DNA, 18 bp, Homo sapiens
catctctgctgcttctgg

SEQ ID NO: 6020882 - DNA, 20 bp, Homo sapiens
catctctgctgcttctgggc

SEQ ID NO: 6020883 - DNA, 13 bp, Homo sapiens
catctctgcttga

SEQ ID NO: 6020884 - DNA, 20 bp, Homo sapiens
catctctgcttgagtcaggt

SEQ ID NO: 6020885 - DNA, 12 bp, Homo sapiens
catctctggaag

SEQ ID NO: 6020886 - DNA, 20 bp, Homo sapiens
catctctggaaggggcagcc

SEQ ID NO: 6020887 - DNA, 18 bp, Homo sapiens
catctctggagccagaga

SEQ ID NO: 6020888 - DNA, 14 bp, Homo sapiens
catctctgggctgg

SEQ ID NO: 6020889 - DNA, 19 bp, Homo sapiens
catctctgggctggatgag

SEQ ID NO: 6020890 - DNA, 22 bp, Homo sapiens
catctctgtagatacaggggca

SEQ ID NO: 6020891 - DNA, 16 bp, Homo sapiens
catctctgtcagtgtg

SEQ ID NO: 6020892 - DNA, 18 bp, Homo sapiens
catctctgtcagtgtgaa

SEQ ID NO: 6020893 - DNA, 13 bp, Homo sapiens
catctctgtccca

SEQ ID NO: 6020894 - DNA, 19 bp, Homo sapiens
catctctgtcccattccct

SEQ ID NO: 6020895 - DNA, 20 bp, Homo sapiens
catctctgtcccattccctg

SEQ ID NO: 6020896 - DNA, 23 bp, Homo sapiens
catctctgtcccattccctggga

SEQ ID NO: 6020897 - DNA, 13 bp, Homo sapiens
catctctgtctgg

SEQ ID NO: 6020898 - DNA, 16 bp, Homo sapiens
catctctgtctggggc

SEQ ID NO: 6020899 - DNA, 23 bp, Homo sapiens
catctcttacgcccaacccttcc

SEQ ID NO: 6020900 - DNA, 20 bp, Homo sapiens
catctcttaggtgagacagt

SEQ ID NO: 6020901 - DNA, 10 bp, Homo sapiens
catctcttca

SEQ ID NO: 6020902 - DNA, 13 bp, Homo sapiens
catctcttcaggt

SEQ ID NO: 6020903 - DNA, 12 bp, Homo sapiens
catctcttcccc

SEQ ID NO: 6020904 - DNA, 16 bp, Homo sapiens
catctcttccccagag

SEQ ID NO: 6020905 - DNA, 18 bp, Homo sapiens
catctcttcctttccttt

SEQ ID NO: 6020906 - DNA, 20 bp, Homo sapiens
catctcttgataaaggagag

SEQ ID NO: 6020907 - DNA, 22 bp, Homo sapiens
catctcttgtaaatacatgtcc

SEQ ID NO: 6020908 - DNA, 16 bp, Homo sapiens
catctcttgtttaaat

SEQ ID NO: 6020909 - DNA, 17 bp, Homo sapiens
catctctttaaaaacaa

SEQ ID NO: 6020910 - DNA, 14 bp, Homo sapiens
catctctttagaga

SEQ ID NO: 6020911 - DNA, 12 bp, Homo sapiens
catctctttcat

SEQ ID NO: 6020912 - DNA, 13 bp, Homo sapiens
catctctttgaat

SEQ ID NO: 6020913 - DNA, 15 bp, Homo sapiens
catctctttgtcctg

SEQ ID NO: 6020914 - DNA, 16 bp, Homo sapiens
catctcttttcccact

SEQ ID NO: 6020915 - DNA, 18 bp, Homo sapiens
catctcttttcccactcc

SEQ ID NO: 6020916 - DNA, 21 bp, Homo sapiens
catctcttttcccactccctt

SEQ ID NO: 6020917 - DNA, 14 bp, Homo sapiens
catctgaaaacaat

SEQ ID NO: 6020918 - DNA, 14 bp, Homo sapiens
catctgaaaagaaa

SEQ ID NO: 6020919 - DNA, 15 bp, Homo sapiens
catctgaaaagaaat

SEQ ID NO: 6020920 - DNA, 13 bp, Homo sapiens
catctgaaaagca

SEQ ID NO: 6020921 - DNA, 13 bp, Homo sapiens
catctgaaatcta

SEQ ID NO: 6020922 - DNA, 15 bp, Homo sapiens
catctgaagagcaga

SEQ ID NO: 6020923 - DNA, 19 bp, Homo sapiens
catctgaaggggcaaattc

SEQ ID NO: 6020924 - DNA, 22 bp, Homo sapiens
catctgaaggggcaaattcttt

SEQ ID NO: 6020925 - DNA, 16 bp, Homo sapiens
catctgaatctccttg

SEQ ID NO: 6020926 - DNA, 19 bp, Homo sapiens
catctgaatgaaaataact

SEQ ID NO: 6020927 - DNA, 21 bp, Homo sapiens
catctgaatgaaaataactga

SEQ ID NO: 6020928 - DNA, 19 bp, Homo sapiens
catctgaatttgccctggg

SEQ ID NO: 6020929 - DNA, 23 bp, Homo sapiens
catctgaatttgccctgggaaac

SEQ ID NO: 6020930 - DNA, 18 bp, Homo sapiens
catctgacaaattcaaaa

SEQ ID NO: 6020931 - DNA, 19 bp, Homo sapiens
catctgacaaattcaaaag

SEQ ID NO: 6020932 - DNA, 14 bp, Homo sapiens
catctgacacaaaa

SEQ ID NO: 6020933 - DNA, 15 bp, Homo sapiens
catctgaccacgtgc

SEQ ID NO: 6020934 - DNA, 15 bp, Homo sapiens
catctgaccagcagc

SEQ ID NO: 6020935 - DNA, 21 bp, Homo sapiens
catctgaccagcagcgccttt

SEQ ID NO: 6020936 - DNA, 14 bp, Homo sapiens
catctgaccatctg

SEQ ID NO: 6020937 - DNA, 16 bp, Homo sapiens
catctgaccatctgtg

SEQ ID NO: 6020938 - DNA, 13 bp, Homo sapiens
catctgaccccaa

SEQ ID NO: 6020939 - DNA, 17 bp, Homo sapiens
catctgacctctacctt

SEQ ID NO: 6020940 - DNA, 13 bp, Homo sapiens
catctgaccttca

SEQ ID NO: 6020941 - DNA, 18 bp, Homo sapiens
catctgaccttcaccttg

SEQ ID NO: 6020942 - DNA, 19 bp, Homo sapiens
catctgaccttcaccttgg

SEQ ID NO: 6020943 - DNA, 20 bp, Homo sapiens
catctgactgccaagccaga

SEQ ID NO: 6020944 - DNA, 20 bp, Homo sapiens
catctgagaaggccctgtgc

SEQ ID NO: 6020945 - DNA, 20 bp, Homo sapiens
catctgagagaggctaaaat

SEQ ID NO: 6020946 - DNA, 18 bp, Homo sapiens
catctgagcaagagctgg

SEQ ID NO: 6020947 - DNA, 15 bp, Homo sapiens
catctgagccagcac

SEQ ID NO: 6020948 - DNA, 12 bp, Homo sapiens
catctgaggaaa

SEQ ID NO: 6020949 - DNA, 18 bp, Homo sapiens
catctgaggaaaatggaa

SEQ ID NO: 6020950 - DNA, 17 bp, Homo sapiens
catctgaggagtccaaa

SEQ ID NO: 6020951 - DNA, 23 bp, Homo sapiens
catctgaggtcctgtgatcttat

SEQ ID NO: 6020952 - DNA, 15 bp, Homo sapiens
catctgagtcctgga

SEQ ID NO: 6020953 - DNA, 17 bp, Homo sapiens
catctgataatttcaca

SEQ ID NO: 6020954 - DNA, 22 bp, Homo sapiens
catctgatatctatagtagaca

SEQ ID NO: 6020955 - DNA, 20 bp, Homo sapiens
catctgatcacttcatgttt

SEQ ID NO: 6020956 - DNA, 19 bp, Homo sapiens
catctgatgccttcatctg

SEQ ID NO: 6020957 - DNA, 19 bp, Homo sapiens
catctgattgagtcagtgt

SEQ ID NO: 6020958 - DNA, 13 bp, Homo sapiens
catctgatttgca

SEQ ID NO: 6020959 - DNA, 19 bp, Homo sapiens
catctgatttgcatattca

SEQ ID NO: 6020960 - DNA, 12 bp, Homo sapiens
catctgcaaaag

SEQ ID NO: 6020961 - DNA, 18 bp, Homo sapiens
catctgcaacaaaaagtc

SEQ ID NO: 6020962 - DNA, 19 bp, Homo sapiens
catctgcaacaaaaagtca

SEQ ID NO: 6020963 - DNA, 13 bp, Homo sapiens
catctgcacactc

SEQ ID NO: 6020964 - DNA, 16 bp, Homo sapiens
catctgcacactctct

SEQ ID NO: 6020965 - DNA, 18 bp, Homo sapiens
catctgcacccccctggg

SEQ ID NO: 6020966 - DNA, 17 bp, Homo sapiens
catctgcaccccttctc

SEQ ID NO: 6020967 - DNA, 22 bp, Homo sapiens
catctgcaccccttctctcctc

SEQ ID NO: 6020968 - DNA, 18 bp, Homo sapiens
catctgcaccgacgcctg

SEQ ID NO: 6020969 - DNA, 18 bp, Homo sapiens
catctgcacctaaaccca

SEQ ID NO: 6020970 - DNA, 14 bp, Homo sapiens
catctgcaggcacc

SEQ ID NO: 6020971 - DNA, 20 bp, Homo sapiens
catctgcaggcaccgggctg

SEQ ID NO: 6020972 - DNA, 17 bp, Homo sapiens
catctgcagtgttctgt

SEQ ID NO: 6020973 - DNA, 23 bp, Homo sapiens
catctgcatcactcatggaacac

SEQ ID NO: 6020974 - DNA, 17 bp, Homo sapiens
catctgcattgcccagt

SEQ ID NO: 6020975 - DNA, 15 bp, Homo sapiens
catctgccaaaatgt

SEQ ID NO: 6020976 - DNA, 18 bp, Homo sapiens
catctgccacaaaaatgt

SEQ ID NO: 6020977 - DNA, 12 bp, Homo sapiens
catctgcccagg

SEQ ID NO: 6020978 - DNA, 13 bp, Homo sapiens
catctgcccagga

SEQ ID NO: 6020979 - DNA, 22 bp, Homo sapiens
catctgcccaggacggggccgg

SEQ ID NO: 6020980 - DNA, 23 bp, Homo sapiens
catctgcccaggggtgccccctc

SEQ ID NO: 6020981 - DNA, 15 bp, Homo sapiens
catctgccccaggta

SEQ ID NO: 6020982 - DNA, 22 bp, Homo sapiens
catctgccccaggtacacctcc

SEQ ID NO: 6020983 - DNA, 23 bp, Homo sapiens
catctgccccaggtacacctccc

SEQ ID NO: 6020984 - DNA, 13 bp, Homo sapiens
catctgcccctcc

SEQ ID NO: 6020985 - DNA, 12 bp, Homo sapiens
catctgcccgcc

SEQ ID NO: 6020986 - DNA, 22 bp, Homo sapiens
catctgcccgcctgcccacctg

SEQ ID NO: 6020987 - DNA, 15 bp, Homo sapiens
catctgccgcctggg

SEQ ID NO: 6020988 - DNA, 19 bp, Homo sapiens
catctgcctgaccccttca

SEQ ID NO: 6020989 - DNA, 14 bp, Homo sapiens
catctgcctgcagt

SEQ ID NO: 6020990 - DNA, 17 bp, Homo sapiens
catctgcctgcgctctc

SEQ ID NO: 6020991 - DNA, 14 bp, Homo sapiens
catctgcctggagc

SEQ ID NO: 6020992 - DNA, 21 bp, Homo sapiens
catctgcggggcttctgggtg

SEQ ID NO: 6020993 - DNA, 19 bp, Homo sapiens
catctgcgtgacaataaaa

SEQ ID NO: 6020994 - DNA, 23 bp, Homo sapiens
catctgcgtgacaataaaacatt

SEQ ID NO: 6020995 - DNA, 12 bp, Homo sapiens
catctgctaata

SEQ ID NO: 6020996 - DNA, 16 bp, Homo sapiens
catctgctcctcccat

SEQ ID NO: 6020997 - DNA, 16 bp, Homo sapiens
catctgctccttcctg

SEQ ID NO: 6020998 - DNA, 22 bp, Homo sapiens
catctgctctagattcataaat

SEQ ID NO: 6020999 - DNA, 20 bp, Homo sapiens
catctgctctccttcctgga

SEQ ID NO: 6021000 - DNA, 14 bp, Homo sapiens
catctgctctgaga

SEQ ID NO: 6021001 - DNA, 19 bp, Homo sapiens
catctgctgagctctgacc

SEQ ID NO: 6021002 - DNA, 21 bp, Homo sapiens
catctgctgcacatagcagac

SEQ ID NO: 6021003 - DNA, 13 bp, Homo sapiens
catctgctgcagt

SEQ ID NO: 6021004 - DNA, 21 bp, Homo sapiens
catctgctgcagttaccacag

SEQ ID NO: 6021005 - DNA, 13 bp, Homo sapiens
catctgctgcccc

SEQ ID NO: 6021006 - DNA, 19 bp, Homo sapiens
catctgctggtccgtggga

SEQ ID NO: 6021007 - DNA, 15 bp, Homo sapiens
catctgctgtaataa

SEQ ID NO: 6021008 - DNA, 22 bp, Homo sapiens
catctgcttacaattccctgct

SEQ ID NO: 6021009 - DNA, 16 bp, Homo sapiens
catctgcttcaggccc

SEQ ID NO: 6021010 - DNA, 18 bp, Homo sapiens
catctgcttggttggctg

SEQ ID NO: 6021011 - DNA, 16 bp, Homo sapiens
catctgcttttattaa

SEQ ID NO: 6021012 - DNA, 22 bp, Homo sapiens
catctggaaaataaaaggtcta

SEQ ID NO: 6021013 - DNA, 15 bp, Homo sapiens
catctggaaaggggg

SEQ ID NO: 6021014 - DNA, 22 bp, Homo sapiens
catctggaaagttttctccact

SEQ ID NO: 6021015 - DNA, 20 bp, Homo sapiens
catctggaaatccagctggt

SEQ ID NO: 6021016 - DNA, 21 bp, Homo sapiens
catctggaagatcattttgaa

SEQ ID NO: 6021017 - DNA, 22 bp, Homo sapiens
catctggaagttaaagtgaggc

SEQ ID NO: 6021018 - DNA, 12 bp, Homo sapiens
catctggagagc

SEQ ID NO: 6021019 - DNA, 20 bp, Homo sapiens
catctggagagcccagagtc

SEQ ID NO: 6021020 - DNA, 18 bp, Homo sapiens
catctggaggctcccatg

SEQ ID NO: 6021021 - DNA, 19 bp, Homo sapiens
catctggaggctcccatgg

SEQ ID NO: 6021022 - DNA, 15 bp, Homo sapiens
catctggagttctca

SEQ ID NO: 6021023 - DNA, 16 bp, Homo sapiens
catctggataggagcc

SEQ ID NO: 6021024 - DNA, 18 bp, Homo sapiens
catctggataggagcctg

SEQ ID NO: 6021025 - DNA, 17 bp, Homo sapiens
catctggatgtaaatcc

SEQ ID NO: 6021026 - DNA, 18 bp, Homo sapiens
catctggatgtaaatcct

SEQ ID NO: 6021027 - DNA, 16 bp, Homo sapiens
catctggattccagag

SEQ ID NO: 6021028 - DNA, 20 bp, Homo sapiens
catctggcaacatctttatc

SEQ ID NO: 6021029 - DNA, 19 bp, Homo sapiens
catctggcacgtggccagg

SEQ ID NO: 6021030 - DNA, 21 bp, Homo sapiens
catctggcacgtggccaggag

SEQ ID NO: 6021031 - DNA, 22 bp, Homo sapiens
catctggcacgtggccaggagc

SEQ ID NO: 6021032 - DNA, 23 bp, Homo sapiens
catctggcacgtggccaggagcc

SEQ ID NO: 6021033 - DNA, 18 bp, Homo sapiens
catctggcccaggctggc

SEQ ID NO: 6021034 - DNA, 13 bp, Homo sapiens
catctggccctgc

SEQ ID NO: 6021035 - DNA, 20 bp, Homo sapiens
catctggccctgctgccccc

SEQ ID NO: 6021036 - DNA, 23 bp, Homo sapiens
catctggccgttgatgttggctg

SEQ ID NO: 6021037 - DNA, 18 bp, Homo sapiens
catctggcctatgaccct

SEQ ID NO: 6021038 - DNA, 20 bp, Homo sapiens
catctggcctatgaccctgt

SEQ ID NO: 6021039 - DNA, 21 bp, Homo sapiens
catctggcctatgaccctgtg

SEQ ID NO: 6021040 - DNA, 11 bp, Homo sapiens
catctggcctg

SEQ ID NO: 6021041 - DNA, 14 bp, Homo sapiens
catctggcctggcc

SEQ ID NO: 6021042 - DNA, 17 bp, Homo sapiens
catctggcctggccagt

SEQ ID NO: 6021043 - DNA, 16 bp, Homo sapiens
catctggcctgggggc

SEQ ID NO: 6021044 - DNA, 17 bp, Homo sapiens
catctggcctgggggct

SEQ ID NO: 6021045 - DNA, 15 bp, Homo sapiens
catctggccttacac

SEQ ID NO: 6021046 - DNA, 14 bp, Homo sapiens
catctggcggaggt

SEQ ID NO: 6021047 - DNA, 22 bp, Homo sapiens
catctggcggaggtctctggga

SEQ ID NO: 6021048 - DNA, 14 bp, Homo sapiens
catctggctcagca

SEQ ID NO: 6021049 - DNA, 18 bp, Homo sapiens
catctggctgcacaggct

SEQ ID NO: 6021050 - DNA, 17 bp, Homo sapiens
catctggctgcctttgc

SEQ ID NO: 6021051 - DNA, 17 bp, Homo sapiens
catctggctgtctagaa

SEQ ID NO: 6021052 - DNA, 17 bp, Homo sapiens
catctggcttattttaa

SEQ ID NO: 6021053 - DNA, 19 bp, Homo sapiens
catctggcttattttaatg

SEQ ID NO: 6021054 - DNA, 19 bp, Homo sapiens
catctggctttttctgcca

SEQ ID NO: 6021055 - DNA, 12 bp, Homo sapiens
catctgggaaag

SEQ ID NO: 6021056 - DNA, 21 bp, Homo sapiens
catctgggaacttgtcacaga

SEQ ID NO: 6021057 - DNA, 13 bp, Homo sapiens
catctgggacaaa

SEQ ID NO: 6021058 - DNA, 17 bp, Homo sapiens
catctgggatcatgata

SEQ ID NO: 6021059 - DNA, 18 bp, Homo sapiens
catctgggatcatgatag

SEQ ID NO: 6021060 - DNA, 16 bp, Homo sapiens
catctgggccaccagc

SEQ ID NO: 6021061 - DNA, 22 bp, Homo sapiens
catctgggccaccagctccact

SEQ ID NO: 6021062 - DNA, 11 bp, Homo sapiens
catctgggctc

SEQ ID NO: 6021063 - DNA, 17 bp, Homo sapiens
catctgggctcctccag

SEQ ID NO: 6021064 - DNA, 23 bp, Homo sapiens
catctggggatggagaatgccag

SEQ ID NO: 6021065 - DNA, 13 bp, Homo sapiens
catctggggtggg

SEQ ID NO: 6021066 - DNA, 16 bp, Homo sapiens
catctggggttggcaa

SEQ ID NO: 6021067 - DNA, 22 bp, Homo sapiens
catctggggttggcaacaggac

SEQ ID NO: 6021068 - DNA, 16 bp, Homo sapiens
catctgggtagctgta

SEQ ID NO: 6021069 - DNA, 17 bp, Homo sapiens
catctgggtgccctgaa

SEQ ID NO: 6021070 - DNA, 20 bp, Homo sapiens
catctggtcttccaggcact

SEQ ID NO: 6021071 - DNA, 16 bp, Homo sapiens
catctggtcttgtttc

SEQ ID NO: 6021072 - DNA, 14 bp, Homo sapiens
catctggtgccttt

SEQ ID NO: 6021073 - DNA, 21 bp, Homo sapiens
catctggtgcctttccacaca

SEQ ID NO: 6021074 - DNA, 22 bp, Homo sapiens
catctggttgaactctggtggc

SEQ ID NO: 6021075 - DNA, 14 bp, Homo sapiens
catctggttttctc

SEQ ID NO: 6021076 - DNA, 20 bp, Homo sapiens
catctggtttttaaaagata

SEQ ID NO: 6021077 - DNA, 18 bp, Homo sapiens
catctgtaaaatagtctc

SEQ ID NO: 6021078 - DNA, 12 bp, Homo sapiens
catctgtaaata

SEQ ID NO: 6021079 - DNA, 14 bp, Homo sapiens
catctgtaaatatc

SEQ ID NO: 6021080 - DNA, 16 bp, Homo sapiens
catctgtaagagcttg

SEQ ID NO: 6021081 - DNA, 16 bp, Homo sapiens
catctgtaatatattg

SEQ ID NO: 6021082 - DNA, 18 bp, Homo sapiens
catctgtaatcctagcta

SEQ ID NO: 6021083 - DNA, 15 bp, Homo sapiens
catctgtaccctgct

SEQ ID NO: 6021084 - DNA, 17 bp, Homo sapiens
catctgtacctctgcct

SEQ ID NO: 6021085 - DNA, 15 bp, Homo sapiens
catctgtacttggtc

SEQ ID NO: 6021086 - DNA, 17 bp, Homo sapiens
catctgtacttggtcca

SEQ ID NO: 6021087 - DNA, 24 bp, Homo sapiens
catctgtaggtcactctccagcag

SEQ ID NO: 6021088 - DNA, 19 bp, Homo sapiens
catctgtatatcagctcta

SEQ ID NO: 6021089 - DNA, 21 bp, Homo sapiens
catctgtatttttaaattctg

SEQ ID NO: 6021090 - DNA, 17 bp, Homo sapiens
catctgtcagcttccca

SEQ ID NO: 6021091 - DNA, 12 bp, Homo sapiens
catctgtcatta

SEQ ID NO: 6021092 - DNA, 15 bp, Homo sapiens
catctgtcattatat

SEQ ID NO: 6021093 - DNA, 12 bp, Homo sapiens
catctgtccagc

SEQ ID NO: 6021094 - DNA, 20 bp, Homo sapiens
catctgtccagctggggcca

SEQ ID NO: 6021095 - DNA, 15 bp, Homo sapiens
catctgtccatcctc

SEQ ID NO: 6021096 - DNA, 16 bp, Homo sapiens
catctgtccatcctcc

SEQ ID NO: 6021097 - DNA, 12 bp, Homo sapiens
cagctgtctccc

SEQ ID NO: 6021098 - DNA, 15 bp, Homo sapiens
cagctgtctgccagg

SEQ ID NO: 6021099 - DNA, 15 bp, Homo sapiens
cagctgtctgtcatc

SEQ ID NO: 6021100 - DNA, 16 bp, Homo sapiens
cagctgtctgtggctt

SEQ ID NO: 6021101 - DNA, 14 bp, Homo sapiens
cagctgtgaaggct

SEQ ID NO: 6021102 - DNA, 19 bp, Homo sapiens
cagctgtgagccatgcctc

SEQ ID NO: 6021103 - DNA, 22 bp, Homo sapiens
cagctgtgagccatgcctccct

SEQ ID NO: 6021104 - DNA, 15 bp, Homo sapiens
cagctgtgagccttg

SEQ ID NO: 6021105 - DNA, 17 bp, Homo sapiens
cagctgtgagccttggc

SEQ ID NO: 6021106 - DNA, 23 bp, Homo sapiens
cagctgtgagtgcgtgtgtgtga

SEQ ID NO: 6021107 - DNA, 13 bp, Homo sapiens
cagctgtgcactt

SEQ ID NO: 6021108 - DNA, 16 bp, Homo sapiens
cagctgtgcccctccc

SEQ ID NO: 6021109 - DNA, 21 bp, Homo sapiens
cagctgtgccgggaggcagcc

SEQ ID NO: 6021110 - DNA, 22 bp, Homo sapiens
cagctgtgccgggaggcagcca

SEQ ID NO: 6021111 - DNA, 12 bp, Homo sapiens
cagctgtgcctc

SEQ ID NO: 6021112 - DNA, 13 bp, Homo sapiens
cagctgtgcctcg

SEQ ID NO: 6021113 - DNA, 23 bp, Homo sapiens
cagctgtgcgagaacacaagcca

SEQ ID NO: 6021114 - DNA, 19 bp, Homo sapiens
cagctgtgctctggacagg

SEQ ID NO: 6021115 - DNA, 24 bp, Homo sapiens
cagctgtgctctggacaggcatgt

SEQ ID NO: 6021116 - DNA, 16 bp, Homo sapiens
cagctgtgctgggagg

SEQ ID NO: 6021117 - DNA, 19 bp, Homo sapiens
cagctgtgctgggaggtcc

SEQ ID NO: 6021118 - DNA, 18 bp, Homo sapiens
cagctgtgctgtggagag

SEQ ID NO: 6021119 - DNA, 12 bp, Homo sapiens
cagctgtggcag

SEQ ID NO: 6021120 - DNA, 23 bp, Homo sapiens
cagctgtggcagagttacagttc

SEQ ID NO: 6021121 - DNA, 14 bp, Homo sapiens
cagctgtggctgga

SEQ ID NO: 6021122 - DNA, 22 bp, Homo sapiens
cagctgtgtcccttcctgcttt

SEQ ID NO: 6021123 - DNA, 23 bp, Homo sapiens
cagctgtgtccggcccagttttg

SEQ ID NO: 6021124 - DNA, 15 bp, Homo sapiens
cagctgtgtctgaca

SEQ ID NO: 6021125 - DNA, 14 bp, Homo sapiens
cagctgtgtctgag

SEQ ID NO: 6021126 - DNA, 20 bp, Homo sapiens
cagctgtgtctgagcccaac

SEQ ID NO: 6021127 - DNA, 18 bp, Homo sapiens
cagctgttacctgagata

SEQ ID NO: 6021128 - DNA, 22 bp, Homo sapiens
cagctgttagagtccaacgtgg

SEQ ID NO: 6021129 - DNA, 22 bp, Homo sapiens
cagctgttcaacaagagtaaat

SEQ ID NO: 6021130 - DNA, 20 bp, Homo sapiens
cagctgttcagattggacat

SEQ ID NO: 6021131 - DNA, 15 bp, Homo sapiens
cagctgttccacagg

SEQ ID NO: 6021132 - DNA, 15 bp, Homo sapiens
cagctgttcctgtgt

SEQ ID NO: 6021133 - DNA, 16 bp, Homo sapiens
cagctgttcctgtgtt

SEQ ID NO: 6021134 - DNA, 20 bp, Homo sapiens
cagctgttcttagtgacaca

SEQ ID NO: 6021135 - DNA, 15 bp, Homo sapiens
cagctgttgagaaaa

SEQ ID NO: 6021136 - DNA, 17 bp, Homo sapiens
cagctgttgcaggcagt

SEQ ID NO: 6021137 - DNA, 21 bp, Homo sapiens
cagctgtttaaatgtttttct

SEQ ID NO: 6021138 - DNA, 16 bp, Homo sapiens
cagctgtttaagcctg

SEQ ID NO: 6021139 - DNA, 14 bp, Homo sapiens
cagctgtttcaaag

SEQ ID NO: 6021140 - DNA, 14 bp, Homo sapiens
cagctgtttcctca

SEQ ID NO: 6021141 - DNA, 15 bp, Homo sapiens
cagctgtttcgcatc

SEQ ID NO: 6021142 - DNA, 24 bp, Homo sapiens
cagctgtttcgcatccaccgccac

SEQ ID NO: 6021143 - DNA, 11 bp, Homo sapiens
cagctgtttct

SEQ ID NO: 6021144 - DNA, 14 bp, Homo sapiens
cagctgtttctcat

SEQ ID NO: 6021145 - DNA, 15 bp, Homo sapiens
cagctgtttgtcata

SEQ ID NO: 6021146 - DNA, 12 bp, Homo sapiens
cagctgttttca

SEQ ID NO: 6021147 - DNA, 17 bp, Homo sapiens
cagctgttttcaaagcc

SEQ ID NO: 6021148 - DNA, 16 bp, Homo sapiens
cagctgttttgttgac

SEQ ID NO: 6021149 - DNA, 23 bp, Homo sapiens
cagctgttttgttgacattctga

SEQ ID NO: 6021150 - DNA, 19 bp, Homo sapiens
cagcttaaacccatacaat

SEQ ID NO: 6021151 - DNA, 21 bp, Homo sapiens
cagcttaaacccatacaatgt

SEQ ID NO: 6021152 - DNA, 17 bp, Homo sapiens
cagcttaacaatgcaac

SEQ ID NO: 6021153 - DNA, 18 bp, Homo sapiens
cagcttaagcgttcatat

SEQ ID NO: 6021154 - DNA, 20 bp, Homo sapiens
cagcttaagtataattaata

SEQ ID NO: 6021155 - DNA, 16 bp, Homo sapiens
cagcttaattctcctt

SEQ ID NO: 6021156 - DNA, 18 bp, Homo sapiens
cagcttaattctccttcc

SEQ ID NO: 6021157 - DNA, 18 bp, Homo sapiens
cagcttacacaaatctat

SEQ ID NO: 6021158 - DNA, 16 bp, Homo sapiens
cagcttacaggagcca

SEQ ID NO: 6021159 - DNA, 21 bp, Homo sapiens
cagcttacaggagccagcctg

SEQ ID NO: 6021160 - DNA, 17 bp, Homo sapiens
cagcttagagttcttct

SEQ ID NO: 6021161 - DNA, 14 bp, Homo sapiens
cagcttagatttca

SEQ ID NO: 6021162 - DNA, 17 bp, Homo sapiens
cagcttagatttcatag

SEQ ID NO: 6021163 - DNA, 18 bp, Homo sapiens
cagcttagggccctggag

SEQ ID NO: 6021164 - DNA, 20 bp, Homo sapiens
cagcttagggccctggaggc

SEQ ID NO: 6021165 - DNA, 18 bp, Homo sapiens
cagcttatctcttttata

SEQ ID NO: 6021166 - DNA, 19 bp, Homo sapiens
cagcttatctcttttatat

SEQ ID NO: 6021167 - DNA, 21 bp, Homo sapiens
cagcttatctcttttatattt

SEQ ID NO: 6021168 - DNA, 22 bp, Homo sapiens
cagcttatctcttttatatttg

SEQ ID NO: 6021169 - DNA, 21 bp, Homo sapiens
cagcttatgggatccttgtct

SEQ ID NO: 6021170 - DNA, 23 bp, Homo sapiens
cagcttatggggtattttaagca

SEQ ID NO: 6021171 - DNA, 17 bp, Homo sapiens
cagcttattcacaagac

SEQ ID NO: 6021172 - DNA, 13 bp, Homo sapiens
cagcttattgttt

SEQ ID NO: 6021173 - DNA, 12 bp, Homo sapiens
cagcttcaaaac

SEQ ID NO: 6021174 - DNA, 13 bp, Homo sapiens
cagcttcaaaaca

SEQ ID NO: 6021175 - DNA, 17 bp, Homo sapiens
cagcttcaaaacagaac

SEQ ID NO: 6021176 - DNA, 18 bp, Homo sapiens
cagcttcaacttttctct

SEQ ID NO: 6021177 - DNA, 19 bp, Homo sapiens
cagcttcacccaccaggcc

SEQ ID NO: 6021178 - DNA, 20 bp, Homo sapiens
cagcttcacccaccaggcca

SEQ ID NO: 6021179 - DNA, 22 bp, Homo sapiens
cagcttcacccaccaggccagc

SEQ ID NO: 6021180 - DNA, 23 bp, Homo sapiens
cagcttcacctctgggaccccag

SEQ ID NO: 6021181 - DNA, 22 bp, Homo sapiens
cagcttcacttaaaatcaaatt

SEQ ID NO: 6021182 - DNA, 15 bp, Homo sapiens
cagcttcagccagga

SEQ ID NO: 6021183 - DNA, 16 bp, Homo sapiens
cagcttcaggcaccag

SEQ ID NO: 6021184 - DNA, 22 bp, Homo sapiens
cagcttcaggcaccagcatcca

SEQ ID NO: 6021185 - DNA, 16 bp, Homo sapiens
cagcttcagtctctgc

SEQ ID NO: 6021186 - DNA, 19 bp, Homo sapiens
cagcttcagtctctgcagt

SEQ ID NO: 6021187 - DNA, 14 bp, Homo sapiens
cagcttcatcaatt

SEQ ID NO: 6021188 - DNA, 16 bp, Homo sapiens
cagcttcatcaatttt

SEQ ID NO: 6021189 - DNA, 18 bp, Homo sapiens
cagcttcatcaattttta

SEQ ID NO: 6021190 - DNA, 23 bp, Homo sapiens
cagcttcatcaatttttatacat

SEQ ID NO: 6021191 - DNA, 20 bp, Homo sapiens
cagcttcatgcctttgtaag

SEQ ID NO: 6021192 - DNA, 18 bp, Homo sapiens
cagcttcattatctgagt

SEQ ID NO: 6021193 - DNA, 21 bp, Homo sapiens
cagcttcattatctgagttgc

SEQ ID NO: 6021194 - DNA, 13 bp, Homo sapiens
cagcttcatttgt

SEQ ID NO: 6021195 - DNA, 17 bp, Homo sapiens
cagcttcatttgtgtca

SEQ ID NO: 6021196 - DNA, 12 bp, Homo sapiens
cagcttccaaag

SEQ ID NO: 6021197 - DNA, 13 bp, Homo sapiens
cagcttccagcag

SEQ ID NO: 6021198 - DNA, 15 bp, Homo sapiens
cagcttccagcagga

SEQ ID NO: 6021199 - DNA, 17 bp, Homo sapiens
cagcttcccaacaatac

SEQ ID NO: 6021200 - DNA, 21 bp, Homo sapiens
cagcttcccagccatgcccag

SEQ ID NO: 6021201 - DNA, 17 bp, Homo sapiens
cagcttccccaggagct

SEQ ID NO: 6021202 - DNA, 21 bp, Homo sapiens
cagcttccccaggagctctct

SEQ ID NO: 6021203 - DNA, 21 bp, Homo sapiens
cagcttccccatcgccttctg

SEQ ID NO: 6021204 - DNA, 15 bp, Homo sapiens
cagcttcctcacacc

SEQ ID NO: 6021205 - DNA, 19 bp, Homo sapiens
cagcttcctcacacccctg

SEQ ID NO: 6021206 - DNA, 20 bp, Homo sapiens
cagcttcctcacacccctgt

SEQ ID NO: 6021207 - DNA, 19 bp, Homo sapiens
cagcttcctcttctaccat

SEQ ID NO: 6021208 - DNA, 17 bp, Homo sapiens
cagcttcctgagggcta

SEQ ID NO: 6021209 - DNA, 12 bp, Homo sapiens
cagcttcctgtc

SEQ ID NO: 6021210 - DNA, 20 bp, Homo sapiens
cagcttcctgtctgtttata

SEQ ID NO: 6021211 - DNA, 21 bp, Homo sapiens
cagcttcctgtctgtttatat

SEQ ID NO: 6021212 - DNA, 18 bp, Homo sapiens
cagcttcctgtgcagaag

SEQ ID NO: 6021213 - DNA, 13 bp, Homo sapiens
cagcttccttcag

SEQ ID NO: 6021214 - DNA, 14 bp, Homo sapiens
cagcttccttcaga

SEQ ID NO: 6021215 - DNA, 15 bp, Homo sapiens
cagcttccttcagag

SEQ ID NO: 6021216 - DNA, 21 bp, Homo sapiens
cagcttccttcagagagcagt

SEQ ID NO: 6021217 - DNA, 13 bp, Homo sapiens
cagcttcgaggac

SEQ ID NO: 6021218 - DNA, 18 bp, Homo sapiens
cagcttcgaggacaggaa

SEQ ID NO: 6021219 - DNA, 19 bp, Homo sapiens
cagcttcgtcagctccagc

SEQ ID NO: 6021220 - DNA, 14 bp, Homo sapiens
cagcttcgtgctgg

SEQ ID NO: 6021221 - DNA, 22 bp, Homo sapiens
cagcttcgtttattttcaagaa

SEQ ID NO: 6021222 - DNA, 22 bp, Homo sapiens
cagcttctaattttgtgctctt

SEQ ID NO: 6021223 - DNA, 18 bp, Homo sapiens
cagcttctactcctgcct

SEQ ID NO: 6021224 - DNA, 17 bp, Homo sapiens
cagcttctcagtttctg

SEQ ID NO: 6021225 - DNA, 18 bp, Homo sapiens
cagcttctcagtttctgc

SEQ ID NO: 6021226 - DNA, 21 bp, Homo sapiens
cagcttctcagtttctgcctg

SEQ ID NO: 6021227 - DNA, 19 bp, Homo sapiens
cagcttctcatcctgcagg

SEQ ID NO: 6021228 - DNA, 13 bp, Homo sapiens
cagcttctccagg

SEQ ID NO: 6021229 - DNA, 13 bp, Homo sapiens
cagcttctcctgc

SEQ ID NO: 6021230 - DNA, 16 bp, Homo sapiens
cagcttctcctgcgcc

SEQ ID NO: 6021231 - DNA, 14 bp, Homo sapiens
cagcttctctctcc

SEQ ID NO: 6021232 - DNA, 16 bp, Homo sapiens
cagcttctctctccag

SEQ ID NO: 6021233 - DNA, 23 bp, Homo sapiens
cagcttctctctccctgtcacac

SEQ ID NO: 6021234 - DNA, 13 bp, Homo sapiens
cagcttctctgca

SEQ ID NO: 6021235 - DNA, 15 bp, Homo sapiens
cagcttctctgcagt

SEQ ID NO: 6021236 - DNA, 13 bp, Homo sapiens
cagcttctcttga

SEQ ID NO: 6021237 - DNA, 12 bp, Homo sapiens
cagcttctgcca

SEQ ID NO: 6021238 - DNA, 17 bp, Homo sapiens
cagcttctgccacttcc

SEQ ID NO: 6021239 - DNA, 19 bp, Homo sapiens
cagcttctgccacttccca

SEQ ID NO: 6021240 - DNA, 16 bp, Homo sapiens
cagcttctgccccctg

SEQ ID NO: 6021241 - DNA, 19 bp, Homo sapiens
cagcttctgccccctgcag

SEQ ID NO: 6021242 - DNA, 15 bp, Homo sapiens
cagcttctgctgggc

SEQ ID NO: 6021243 - DNA, 18 bp, Homo sapiens
cagcttctgctgggctgg

SEQ ID NO: 6021244 - DNA, 13 bp, Homo sapiens
cagcttctggagc

SEQ ID NO: 6021245 - DNA, 15 bp, Homo sapiens
cagcttcttcctagg

SEQ ID NO: 6021246 - DNA, 20 bp, Homo sapiens
cagcttcttcctaggtccaa

SEQ ID NO: 6021247 - DNA, 23 bp, Homo sapiens
cagcttcttctgcccctctactg

SEQ ID NO: 6021248 - DNA, 19 bp, Homo sapiens
cagcttcttgcttgtaaaa

SEQ ID NO: 6021249 - DNA, 21 bp, Homo sapiens
cagcttcttgcttgtaaaaat

SEQ ID NO: 6021250 - DNA, 13 bp, Homo sapiens
cagcttcttgggc

SEQ ID NO: 6021251 - DNA, 15 bp, Homo sapiens
cagcttcttgggctg

SEQ ID NO: 6021252 - DNA, 23 bp, Homo sapiens
cagcttctttactactgcaagtt

SEQ ID NO: 6021253 - DNA, 13 bp, Homo sapiens
cagcttctttctc

SEQ ID NO: 6021254 - DNA, 18 bp, Homo sapiens
cagcttctttctcggtgg

SEQ ID NO: 6021255 - DNA, 19 bp, Homo sapiens
cagcttcttttgtctccca

SEQ ID NO: 6021256 - DNA, 17 bp, Homo sapiens
cagcttgaaaactggat

SEQ ID NO: 6021257 - DNA, 12 bp, Homo sapiens
cagcttgaacct

SEQ ID NO: 6021258 - DNA, 15 bp, Homo sapiens
cagcttgaacctgct

SEQ ID NO: 6021259 - DNA, 19 bp, Homo sapiens
cagcttgaatggtttttct

SEQ ID NO: 6021260 - DNA, 23 bp, Homo sapiens
cagcttgaatgtccccattctat

SEQ ID NO: 6021261 - DNA, 20 bp, Homo sapiens
cagcttgacattatgtttta

SEQ ID NO: 6021262 - DNA, 13 bp, Homo sapiens
cagcttgaccaga

SEQ ID NO: 6021263 - DNA, 15 bp, Homo sapiens
cagcttgacctgagg

SEQ ID NO: 6021264 - DNA, 17 bp, Homo sapiens
cagcttgacctgaggct

SEQ ID NO: 6021265 - DNA, 19 bp, Homo sapiens
cagcttgacctgaggctgt

SEQ ID NO: 6021266 - DNA, 22 bp, Homo sapiens
cagcttgagaaggtcactactg

SEQ ID NO: 6021267 - DNA, 14 bp, Homo sapiens
cagcttgagagggc

SEQ ID NO: 6021268 - DNA, 14 bp, Homo sapiens
cagcttgagccggg

SEQ ID NO: 6021269 - DNA, 21 bp, Homo sapiens
cagcttgagccgggcccctgg

SEQ ID NO: 6021270 - DNA, 15 bp, Homo sapiens
cagcttgagcctgtc

SEQ ID NO: 6021271 - DNA, 20 bp, Homo sapiens
cagcttgagggttgggctgg

SEQ ID NO: 6021272 - DNA, 19 bp, Homo sapiens
cagcttgatcaaaggcaca

SEQ ID NO: 6021273 - DNA, 18 bp, Homo sapiens
cagcttgattttcctaat

SEQ ID NO: 6021274 - DNA, 22 bp, Homo sapiens
cagcttgcacacccatcgtctt

SEQ ID NO: 6021275 - DNA, 17 bp, Homo sapiens
catctgtccatcctcct

SEQ ID NO: 6021276 - DNA, 14 bp, Homo sapiens
catctgtccatggc

SEQ ID NO: 6021277 - DNA, 14 bp, Homo sapiens
catctgtcccactg

SEQ ID NO: 6021278 - DNA, 22 bp, Homo sapiens
catctgtcccactgggacacaa

SEQ ID NO: 6021279 - DNA, 16 bp, Homo sapiens
catctgtccctccggg

SEQ ID NO: 6021280 - DNA, 18 bp, Homo sapiens
catctgtccctccgggac

SEQ ID NO: 6021281 - DNA, 18 bp, Homo sapiens
catctgtccgtccagagc

SEQ ID NO: 6021282 - DNA, 11 bp, Homo sapiens
catctgtcctc

SEQ ID NO: 6021283 - DNA, 17 bp, Homo sapiens
catctgtcctcaccctg

SEQ ID NO: 6021284 - DNA, 19 bp, Homo sapiens
catctgtcctcaccctgtg

SEQ ID NO: 6021285 - DNA, 20 bp, Homo sapiens
catctgtcctcaccctgtgg

SEQ ID NO: 6021286 - DNA, 21 bp, Homo sapiens
catctgtcctcaccctgtggg

SEQ ID NO: 6021287 - DNA, 18 bp, Homo sapiens
catctgtctatattttat

SEQ ID NO: 6021288 - DNA, 18 bp, Homo sapiens
catctgtctgctctgcat

SEQ ID NO: 6021289 - DNA, 13 bp, Homo sapiens
catctgtctgtcc

SEQ ID NO: 6021290 - DNA, 23 bp, Homo sapiens
catctgtctgtcctacccgcccg

SEQ ID NO: 6021291 - DNA, 19 bp, Homo sapiens
catctgtctgtctgtgggc

SEQ ID NO: 6021292 - DNA, 17 bp, Homo sapiens
catctgtcttgccagcc

SEQ ID NO: 6021293 - DNA, 19 bp, Homo sapiens
catctgtcttgccagccag

SEQ ID NO: 6021294 - DNA, 22 bp, Homo sapiens
catctgtcttgccagccagaag

SEQ ID NO: 6021295 - DNA, 18 bp, Homo sapiens
catctgtgaaaggaaaga

SEQ ID NO: 6021296 - DNA, 19 bp, Homo sapiens
catctgtgaaaggaaagag

SEQ ID NO: 6021297 - DNA, 17 bp, Homo sapiens
catctgtgactataaag

SEQ ID NO: 6021298 - DNA, 15 bp, Homo sapiens
catctgtgattccct

SEQ ID NO: 6021299 - DNA, 17 bp, Homo sapiens
catctgtgcacactaag

SEQ ID NO: 6021300 - DNA, 19 bp, Homo sapiens
catctgtgcacactaagaa

SEQ ID NO: 6021301 - DNA, 16 bp, Homo sapiens
catctgtgcagggctg

SEQ ID NO: 6021302 - DNA, 17 bp, Homo sapiens
catctgtgcagggctgg

SEQ ID NO: 6021303 - DNA, 19 bp, Homo sapiens
catctgtgcctgtctgtcc

SEQ ID NO: 6021304 - DNA, 13 bp, Homo sapiens
catctgtgcgtgt

SEQ ID NO: 6021305 - DNA, 16 bp, Homo sapiens
catctgtggacaagac

SEQ ID NO: 6021306 - DNA, 17 bp, Homo sapiens
catctgtggactgacct

SEQ ID NO: 6021307 - DNA, 15 bp, Homo sapiens
catctgtggagctgc

SEQ ID NO: 6021308 - DNA, 16 bp, Homo sapiens
catctgtggcctgggg

SEQ ID NO: 6021309 - DNA, 16 bp, Homo sapiens
catctgtggttttcct

SEQ ID NO: 6021310 - DNA, 16 bp, Homo sapiens
catctgtgtctctgga

SEQ ID NO: 6021311 - DNA, 22 bp, Homo sapiens
catctgtgtctctggaacccag

SEQ ID NO: 6021312 - DNA, 15 bp, Homo sapiens
catctgtgtgaaaat

SEQ ID NO: 6021313 - DNA, 16 bp, Homo sapiens
catctgtgtgcgtggc

SEQ ID NO: 6021314 - DNA, 16 bp, Homo sapiens
catctgtgttctatgc

SEQ ID NO: 6021315 - DNA, 18 bp, Homo sapiens
catctgttacacaaagaa

SEQ ID NO: 6021316 - DNA, 23 bp, Homo sapiens
catctgttacattctaagtgtgt

SEQ ID NO: 6021317 - DNA, 15 bp, Homo sapiens
catctgttagcagag

SEQ ID NO: 6021318 - DNA, 16 bp, Homo sapiens
catctgttagcagagt

SEQ ID NO: 6021319 - DNA, 18 bp, Homo sapiens
catctgttagcagagtct

SEQ ID NO: 6021320 - DNA, 22 bp, Homo sapiens
catctgttagcagagtctgtct

SEQ ID NO: 6021321 - DNA, 15 bp, Homo sapiens
catctgttagggcct

SEQ ID NO: 6021322 - DNA, 17 bp, Homo sapiens
catctgttatcctgcta

SEQ ID NO: 6021323 - DNA, 18 bp, Homo sapiens
catctgttctatgcttcc

SEQ ID NO: 6021324 - DNA, 23 bp, Homo sapiens
catctgttctatgcttcctcgtg

SEQ ID NO: 6021325 - DNA, 12 bp, Homo sapiens
catctgttctgg

SEQ ID NO: 6021326 - DNA, 19 bp, Homo sapiens
catctgttgacaatttgcc

SEQ ID NO: 6021327 - DNA, 22 bp, Homo sapiens
catctgttgttctgtggtcaca

SEQ ID NO: 6021328 - DNA, 20 bp, Homo sapiens
catctgttgttttgttttaa

SEQ ID NO: 6021329 - DNA, 21 bp, Homo sapiens
catctgtttcaaactgaattt

SEQ ID NO: 6021330 - DNA, 19 bp, Homo sapiens
catctgtttgaagattata

SEQ ID NO: 6021331 - DNA, 21 bp, Homo sapiens
catctgtttgtagccacaagc

SEQ ID NO: 6021332 - DNA, 11 bp, Homo sapiens
catctgttttt

SEQ ID NO: 6021333 - DNA, 12 bp, Homo sapiens
catcttaaacta

SEQ ID NO: 6021334 - DNA, 22 bp, Homo sapiens
catcttaaatctaaacaaaaaa

SEQ ID NO: 6021335 - DNA, 12 bp, Homo sapiens
catcttaaatga

SEQ ID NO: 6021336 - DNA, 14 bp, Homo sapiens
catcttaacttggc

SEQ ID NO: 6021337 - DNA, 14 bp, Homo sapiens
catcttacctctca

SEQ ID NO: 6021338 - DNA, 15 bp, Homo sapiens
catcttactgaaggt

SEQ ID NO: 6021339 - DNA, 17 bp, Homo sapiens
catcttagacctccaca

SEQ ID NO: 6021340 - DNA, 16 bp, Homo sapiens
catcttagactttgca

SEQ ID NO: 6021341 - DNA, 20 bp, Homo sapiens
catcttagatagatggtact

SEQ ID NO: 6021342 - DNA, 16 bp, Homo sapiens
catcttagctttccac

SEQ ID NO: 6021343 - DNA, 21 bp, Homo sapiens
catcttaggttggcaaaaagg

SEQ ID NO: 6021344 - DNA, 17 bp, Homo sapiens
catcttagttctgtata

SEQ ID NO: 6021345 - DNA, 23 bp, Homo sapiens
catcttagttctgtatataaata

SEQ ID NO: 6021346 - DNA, 21 bp, Homo sapiens
catcttatagcactttgaaat

SEQ ID NO: 6021347 - DNA, 20 bp, Homo sapiens
catcttattcccaattaaaa

SEQ ID NO: 6021348 - DNA, 20 bp, Homo sapiens
catcttatttacttgtagaa

SEQ ID NO: 6021349 - DNA, 14 bp, Homo sapiens
catcttatttattt

SEQ ID NO: 6021350 - DNA, 15 bp, Homo sapiens
catcttcaatatgaa

SEQ ID NO: 6021351 - DNA, 13 bp, Homo sapiens
catcttcacccag

SEQ ID NO: 6021352 - DNA, 17 bp, Homo sapiens
catcttcacccaggcct

SEQ ID NO: 6021353 - DNA, 15 bp, Homo sapiens
catcttcactgcaat

SEQ ID NO: 6021354 - DNA, 14 bp, Homo sapiens
catcttcactggct

SEQ ID NO: 6021355 - DNA, 15 bp, Homo sapiens
catcttcactggctt

SEQ ID NO: 6021356 - DNA, 14 bp, Homo sapiens
catcttcagctccc

SEQ ID NO: 6021357 - DNA, 17 bp, Homo sapiens
catcttcagctcccata

SEQ ID NO: 6021358 - DNA, 19 bp, Homo sapiens
catcttcagtcgtctgtcc

SEQ ID NO: 6021359 - DNA, 22 bp, Homo sapiens
catcttcagttgtctctgatgc

SEQ ID NO: 6021360 - DNA, 14 bp, Homo sapiens
catcttcatataaa

SEQ ID NO: 6021361 - DNA, 15 bp, Homo sapiens
catcttcatataaac

SEQ ID NO: 6021362 - DNA, 22 bp, Homo sapiens
catcttcatcccaacagcccag

SEQ ID NO: 6021363 - DNA, 23 bp, Homo sapiens
catcttccacctcacctctttgt

SEQ ID NO: 6021364 - DNA, 13 bp, Homo sapiens
catcttccacctg

SEQ ID NO: 6021365 - DNA, 20 bp, Homo sapiens
catcttccacctgtgccctc

SEQ ID NO: 6021366 - DNA, 21 bp, Homo sapiens
catcttccacctgtgccctca

SEQ ID NO: 6021367 - DNA, 19 bp, Homo sapiens
catcttccagaagtgtgat

SEQ ID NO: 6021368 - DNA, 16 bp, Homo sapiens
catcttccaggtgggg

SEQ ID NO: 6021369 - DNA, 11 bp, Homo sapiens
catcttccatt

SEQ ID NO: 6021370 - DNA, 21 bp, Homo sapiens
catcttcccagcagggccact

SEQ ID NO: 6021371 - DNA, 15 bp, Homo sapiens
catcttccccagccc

SEQ ID NO: 6021372 - DNA, 17 bp, Homo sapiens
catcttccccagccctc

SEQ ID NO: 6021373 - DNA, 15 bp, Homo sapiens
catcttccctgcccc

SEQ ID NO: 6021374 - DNA, 18 bp, Homo sapiens
catcttccctgcccctgt

SEQ ID NO: 6021375 - DNA, 20 bp, Homo sapiens
catcttccctgcccctgtgc

SEQ ID NO: 6021376 - DNA, 22 bp, Homo sapiens
catcttccctggcgtcctctcc

SEQ ID NO: 6021377 - DNA, 19 bp, Homo sapiens
catcttccctttcctccct

SEQ ID NO: 6021378 - DNA, 13 bp, Homo sapiens
catcttcctgctg

SEQ ID NO: 6021379 - DNA, 15 bp, Homo sapiens
catcttcctgtgtcc

SEQ ID NO: 6021380 - DNA, 16 bp, Homo sapiens
catcttcctgtgtcct

SEQ ID NO: 6021381 - DNA, 17 bp, Homo sapiens
catcttcgtcttcactc

SEQ ID NO: 6021382 - DNA, 19 bp, Homo sapiens
catcttcgtcttcactctt

SEQ ID NO: 6021383 - DNA, 21 bp, Homo sapiens
catcttcgtcttcactcttag

SEQ ID NO: 6021384 - DNA, 21 bp, Homo sapiens
catcttctaaacccaatccaa

SEQ ID NO: 6021385 - DNA, 14 bp, Homo sapiens
catcttctcagctc

SEQ ID NO: 6021386 - DNA, 21 bp, Homo sapiens
catcttctcagctcccatttc

SEQ ID NO: 6021387 - DNA, 22 bp, Homo sapiens
catcttctcattcccatgtgga

SEQ ID NO: 6021388 - DNA, 17 bp, Homo sapiens
catcttctccatctggc

SEQ ID NO: 6021389 - DNA, 13 bp, Homo sapiens
catcttctcccca

SEQ ID NO: 6021390 - DNA, 21 bp, Homo sapiens
catcttctccccacagcctct

SEQ ID NO: 6021391 - DNA, 22 bp, Homo sapiens
catcttctccccacagcctctg

SEQ ID NO: 6021392 - DNA, 18 bp, Homo sapiens
catcttctccccgaggct

SEQ ID NO: 6021393 - DNA, 23 bp, Homo sapiens
catcttctccccgaggctgcccc

SEQ ID NO: 6021394 - DNA, 17 bp, Homo sapiens
catcttctctctttttt

SEQ ID NO: 6021395 - DNA, 14 bp, Homo sapiens
catcttctgaagag

SEQ ID NO: 6021396 - DNA, 12 bp, Homo sapiens
catcttctggag

SEQ ID NO: 6021397 - DNA, 14 bp, Homo sapiens
catcttctggagaa

SEQ ID NO: 6021398 - DNA, 17 bp, Homo sapiens
catcttctgtgaaatat

SEQ ID NO: 6021399 - DNA, 15 bp, Homo sapiens
catcttcttccctta

SEQ ID NO: 6021400 - DNA, 13 bp, Homo sapiens
catcttctttctt

SEQ ID NO: 6021401 - DNA, 22 bp, Homo sapiens
catcttctttttgaaatcagca

SEQ ID NO: 6021402 - DNA, 18 bp, Homo sapiens
catcttgaaaatgccacc

SEQ ID NO: 6021403 - DNA, 22 bp, Homo sapiens
catcttgaagtgatgttgttta

SEQ ID NO: 6021404 - DNA, 17 bp, Homo sapiens
catcttgacatgtaatg

SEQ ID NO: 6021405 - DNA, 16 bp, Homo sapiens
catcttgaccaagcag

SEQ ID NO: 6021406 - DNA, 17 bp, Homo sapiens
catcttgaccaagcagg

SEQ ID NO: 6021407 - DNA, 22 bp, Homo sapiens
catcttgaccaagcaggaagct

SEQ ID NO: 6021408 - DNA, 16 bp, Homo sapiens
catcttgagccacagt

SEQ ID NO: 6021409 - DNA, 21 bp, Homo sapiens
catcttgagccacagtcactg

SEQ ID NO: 6021410 - DNA, 16 bp, Homo sapiens
catcttgagcctgagc

SEQ ID NO: 6021411 - DNA, 19 bp, Homo sapiens
catcttgatctgctcagcc

SEQ ID NO: 6021412 - DNA, 20 bp, Homo sapiens
catcttgatctgctcagccc

SEQ ID NO: 6021413 - DNA, 18 bp, Homo sapiens
catcttgatctttgagcc

SEQ ID NO: 6021414 - DNA, 20 bp, Homo sapiens
catcttgatctttgagccca

SEQ ID NO: 6021415 - DNA, 20 bp, Homo sapiens
catcttgcacggtgacccct

SEQ ID NO: 6021416 - DNA, 19 bp, Homo sapiens
catcttgcagcatttacta

SEQ ID NO: 6021417 - DNA, 22 bp, Homo sapiens
catcttgccaagggtccctgtg

SEQ ID NO: 6021418 - DNA, 13 bp, Homo sapiens
catcttgccagcc

SEQ ID NO: 6021419 - DNA, 18 bp, Homo sapiens
catcttgcccgctcaggc

SEQ ID NO: 6021420 - DNA, 13 bp, Homo sapiens
catcttgcctcca

SEQ ID NO: 6021421 - DNA, 16 bp, Homo sapiens
catcttgcctccaggt

SEQ ID NO: 6021422 - DNA, 23 bp, Homo sapiens
catcttgcctccaggtgcagagg

SEQ ID NO: 6021423 - DNA, 17 bp, Homo sapiens
catcttgctaccagtat

SEQ ID NO: 6021424 - DNA, 14 bp, Homo sapiens
catcttgctctgca

SEQ ID NO: 6021425 - DNA, 16 bp, Homo sapiens
catcttgctctgctga

SEQ ID NO: 6021426 - DNA, 19 bp, Homo sapiens
catcttgctctgctgacag

SEQ ID NO: 6021427 - DNA, 19 bp, Homo sapiens
catcttgctctgtggcctt

SEQ ID NO: 6021428 - DNA, 13 bp, Homo sapiens
catcttgcttccc

SEQ ID NO: 6021429 - DNA, 12 bp, Homo sapiens
catcttgctttt

SEQ ID NO: 6021430 - DNA, 14 bp, Homo sapiens
catcttggcagggt

SEQ ID NO: 6021431 - DNA, 23 bp, Homo sapiens
catcttggccctcctcagctccc

SEQ ID NO: 6021432 - DNA, 16 bp, Homo sapiens
catcttggggacatct

SEQ ID NO: 6021433 - DNA, 12 bp, Homo sapiens
catcttggtaaa

SEQ ID NO: 6021434 - DNA, 14 bp, Homo sapiens
catcttggtaaatt

SEQ ID NO: 6021435 - DNA, 18 bp, Homo sapiens
catcttggtagttctgtg

SEQ ID NO: 6021436 - DNA, 14 bp, Homo sapiens
catcttggtcctgt

SEQ ID NO: 6021437 - DNA, 16 bp, Homo sapiens
catcttggtcctgtca

SEQ ID NO: 6021438 - DNA, 18 bp, Homo sapiens
catcttggtcctgtcacc

SEQ ID NO: 6021439 - DNA, 18 bp, Homo sapiens
catcttgtaaataatgct

SEQ ID NO: 6021440 - DNA, 17 bp, Homo sapiens
catcttgtacaaacttt

SEQ ID NO: 6021441 - DNA, 21 bp, Homo sapiens
catcttgtacaaactttgttt

SEQ ID NO: 6021442 - DNA, 12 bp, Homo sapiens
catcttgtgaaa

SEQ ID NO: 6021443 - DNA, 20 bp, Homo sapiens
catcttgtggggccaggacc

SEQ ID NO: 6021444 - DNA, 21 bp, Homo sapiens
catcttgttggtacctttcta

SEQ ID NO: 6021445 - DNA, 12 bp, Homo sapiens
catcttgtttct

SEQ ID NO: 6021446 - DNA, 20 bp, Homo sapiens
catctttaacagcttacact

SEQ ID NO: 6021447 - DNA, 20 bp, Homo sapiens
catctttaacatagtcctgt

SEQ ID NO: 6021448 - DNA, 10 bp, Homo sapiens
catctttaag

SEQ ID NO: 6021449 - DNA, 22 bp, Homo sapiens
catctttacaaaactacatgag

SEQ ID NO: 6021450 - DNA, 17 bp, Homo sapiens
catctttacgtactgta

SEQ ID NO: 6021451 - DNA, 16 bp, Homo sapiens
catctttagcagtttc

SEQ ID NO: 6021452 - DNA, 18 bp, Homo sapiens
catctttagcagtttcct

SEQ ID NO: 6021453 - DNA, 19 bp, Homo sapiens
catctttagcagtttcctc

SEQ ID NO: 6021454 - DNA, 12 bp, Homo sapiens
cagcttgcattg

SEQ ID NO: 6021455 - DNA, 20 bp, Homo sapiens
cagcttgccagatgctgcag

SEQ ID NO: 6021456 - DNA, 13 bp, Homo sapiens
cagcttgccaggg

SEQ ID NO: 6021457 - DNA, 21 bp, Homo sapiens
cagcttgccagggatgggcag

SEQ ID NO: 6021458 - DNA, 16 bp, Homo sapiens
cagcttgccccggccc

SEQ ID NO: 6021459 - DNA, 15 bp, Homo sapiens
cagcttgcctgtttc

SEQ ID NO: 6021460 - DNA, 14 bp, Homo sapiens
cagcttgcgaataa

SEQ ID NO: 6021461 - DNA, 22 bp, Homo sapiens
cagcttgcgttagaatgaggag

SEQ ID NO: 6021462 - DNA, 14 bp, Homo sapiens
cagcttgctgccct

SEQ ID NO: 6021463 - DNA, 17 bp, Homo sapiens
cagcttgctgccctagg

SEQ ID NO: 6021464 - DNA, 13 bp, Homo sapiens
cagcttgctgggc

SEQ ID NO: 6021465 - DNA, 14 bp, Homo sapiens
cagcttgctgggct

SEQ ID NO: 6021466 - DNA, 21 bp, Homo sapiens
cagcttgctgtcacttcttca

SEQ ID NO: 6021467 - DNA, 20 bp, Homo sapiens
cagcttggacatcagtgttt

SEQ ID NO: 6021468 - DNA, 13 bp, Homo sapiens
cagcttggctcag

SEQ ID NO: 6021469 - DNA, 18 bp, Homo sapiens
cagcttgggagagcccct

SEQ ID NO: 6021470 - DNA, 20 bp, Homo sapiens
cagcttgggcagatctccca

SEQ ID NO: 6021471 - DNA, 14 bp, Homo sapiens
cagcttgggcccag

SEQ ID NO: 6021472 - DNA, 22 bp, Homo sapiens
cagcttgggcccagctgggctc

SEQ ID NO: 6021473 - DNA, 17 bp, Homo sapiens
cagcttgggctggcggg

SEQ ID NO: 6021474 - DNA, 15 bp, Homo sapiens
cagcttgggcttctt

SEQ ID NO: 6021475 - DNA, 23 bp, Homo sapiens
cagcttgggcttcttcctcctcc

SEQ ID NO: 6021476 - DNA, 21 bp, Homo sapiens
cagcttgggtcaggttcttgc

SEQ ID NO: 6021477 - DNA, 24 bp, Homo sapiens
cagcttgggtcaggttcttgcctt

SEQ ID NO: 6021478 - DNA, 20 bp, Homo sapiens
cagcttgggtgataaaataa

SEQ ID NO: 6021479 - DNA, 23 bp, Homo sapiens
cagcttggtattgcagagaagat

SEQ ID NO: 6021480 - DNA, 17 bp, Homo sapiens
cagcttgtagccagccg

SEQ ID NO: 6021481 - DNA, 13 bp, Homo sapiens
cagcttgtccaac

SEQ ID NO: 6021482 - DNA, 23 bp, Homo sapiens
cagcttgtccttgctcctggaac

SEQ ID NO: 6021483 - DNA, 13 bp, Homo sapiens
cagcttgtgagct

SEQ ID NO: 6021484 - DNA, 15 bp, Homo sapiens
cagcttgtgcacaat

SEQ ID NO: 6021485 - DNA, 23 bp, Homo sapiens
cagcttgtgctgagcctgcccag

SEQ ID NO: 6021486 - DNA, 15 bp, Homo sapiens
cagcttgtggagccc

SEQ ID NO: 6021487 - DNA, 18 bp, Homo sapiens
cagcttgtggagccccac

SEQ ID NO: 6021488 - DNA, 21 bp, Homo sapiens
cagcttgtggagccccacact

SEQ ID NO: 6021489 - DNA, 15 bp, Homo sapiens
cagcttgttctagaa

SEQ ID NO: 6021490 - DNA, 14 bp, Homo sapiens
cagcttgtttacat

SEQ ID NO: 6021491 - DNA, 15 bp, Homo sapiens
cagcttgtttacatg

SEQ ID NO: 6021492 - DNA, 16 bp, Homo sapiens
cagcttgttttggact

SEQ ID NO: 6021493 - DNA, 22 bp, Homo sapiens
cagcttgttttggactttgtta

SEQ ID NO: 6021494 - DNA, 23 bp, Homo sapiens
cagcttgttttggactttgttac

SEQ ID NO: 6021495 - DNA, 18 bp, Homo sapiens
cagctttaaactcaggga

SEQ ID NO: 6021496 - DNA, 20 bp, Homo sapiens
cagctttaaactcagggaca

SEQ ID NO: 6021497 - DNA, 15 bp, Homo sapiens
cagctttaaccatta

SEQ ID NO: 6021498 - DNA, 21 bp, Homo sapiens
cagctttaacctgctgggaat

SEQ ID NO: 6021499 - DNA, 15 bp, Homo sapiens
cagctttacatgcaa

SEQ ID NO: 6021500 - DNA, 21 bp, Homo sapiens
cagctttacatgcaatttatt

SEQ ID NO: 6021501 - DNA, 14 bp, Homo sapiens
cagctttactgtgg

SEQ ID NO: 6021502 - DNA, 16 bp, Homo sapiens
cagctttactttaaaa

SEQ ID NO: 6021503 - DNA, 19 bp, Homo sapiens
cagctttataataaactgt

SEQ ID NO: 6021504 - DNA, 14 bp, Homo sapiens
cagctttcaagtgc

SEQ ID NO: 6021505 - DNA, 17 bp, Homo sapiens
cagctttcaagtgcctt

SEQ ID NO: 6021506 - DNA, 19 bp, Homo sapiens
cagctttcagagccagtga

SEQ ID NO: 6021507 - DNA, 16 bp, Homo sapiens
cagctttcagggacag

SEQ ID NO: 6021508 - DNA, 21 bp, Homo sapiens
cagctttcatctttgtggatg

SEQ ID NO: 6021509 - DNA, 16 bp, Homo sapiens
cagctttcatgattag

SEQ ID NO: 6021510 - DNA, 20 bp, Homo sapiens
cagctttcatgattagcaag

SEQ ID NO: 6021511 - DNA, 18 bp, Homo sapiens
cagctttccatctgagga

SEQ ID NO: 6021512 - DNA, 20 bp, Homo sapiens
cagctttccctccccagagt

SEQ ID NO: 6021513 - DNA, 13 bp, Homo sapiens
cagctttccctgg

SEQ ID NO: 6021514 - DNA, 16 bp, Homo sapiens
cagctttccctggctc

SEQ ID NO: 6021515 - DNA, 17 bp, Homo sapiens
cagctttccctggctca

SEQ ID NO: 6021516 - DNA, 21 bp, Homo sapiens
cagctttccctggctcaggga

SEQ ID NO: 6021517 - DNA, 20 bp, Homo sapiens
cagctttcctcaaaaagcag

SEQ ID NO: 6021518 - DNA, 22 bp, Homo sapiens
cagctttcctcaaaaagcagaa

SEQ ID NO: 6021519 - DNA, 13 bp, Homo sapiens
cagctttcctggg

SEQ ID NO: 6021520 - DNA, 16 bp, Homo sapiens
cagctttcctgggtga

SEQ ID NO: 6021521 - DNA, 17 bp, Homo sapiens
cagctttccttctgccc

SEQ ID NO: 6021522 - DNA, 18 bp, Homo sapiens
cagctttctcgcgccctc

SEQ ID NO: 6021523 - DNA, 19 bp, Homo sapiens
cagctttctctttgttctt

SEQ ID NO: 6021524 - DNA, 20 bp, Homo sapiens
cagctttctctttgttcttc

SEQ ID NO: 6021525 - DNA, 15 bp, Homo sapiens
cagctttctgacctt

SEQ ID NO: 6021526 - DNA, 23 bp, Homo sapiens
cagctttctggaaattcttccct

SEQ ID NO: 6021527 - DNA, 13 bp, Homo sapiens
cagctttcttcag

SEQ ID NO: 6021528 - DNA, 22 bp, Homo sapiens
cagctttcttgctcccttcagc

SEQ ID NO: 6021529 - DNA, 13 bp, Homo sapiens
cagctttgacccg

SEQ ID NO: 6021530 - DNA, 19 bp, Homo sapiens
cagctttgagaagccttca

SEQ ID NO: 6021531 - DNA, 12 bp, Homo sapiens
cagctttgagct

SEQ ID NO: 6021532 - DNA, 19 bp, Homo sapiens
cagctttgaggaacatgca

SEQ ID NO: 6021533 - DNA, 12 bp, Homo sapiens
cagctttgcaaa

SEQ ID NO: 6021534 - DNA, 22 bp, Homo sapiens
cagctttgcccaacaccagccc

SEQ ID NO: 6021535 - DNA, 23 bp, Homo sapiens
cagctttgcccaacaccagcccc

SEQ ID NO: 6021536 - DNA, 17 bp, Homo sapiens
cagctttgctattccca

SEQ ID NO: 6021537 - DNA, 18 bp, Homo sapiens
cagctttgggcagttatg

SEQ ID NO: 6021538 - DNA, 23 bp, Homo sapiens
cagctttggggacttccgctccc

SEQ ID NO: 6021539 - DNA, 20 bp, Homo sapiens
cagctttgggtcatttttaa

SEQ ID NO: 6021540 - DNA, 21 bp, Homo sapiens
cagctttgtctccaaagaaga

SEQ ID NO: 6021541 - DNA, 22 bp, Homo sapiens
cagctttgtttttggcatttcg

SEQ ID NO: 6021542 - DNA, 16 bp, Homo sapiens
cagcttttaaccatct

SEQ ID NO: 6021543 - DNA, 13 bp, Homo sapiens
cagcttttaataa

SEQ ID NO: 6021544 - DNA, 14 bp, Homo sapiens
cagcttttaataaa

SEQ ID NO: 6021545 - DNA, 18 bp, Homo sapiens
cagcttttagtacccacc

SEQ ID NO: 6021546 - DNA, 20 bp, Homo sapiens
cagcttttagtacccacctg

SEQ ID NO: 6021547 - DNA, 13 bp, Homo sapiens
cagcttttcaaac

SEQ ID NO: 6021548 - DNA, 20 bp, Homo sapiens
cagcttttcattgctgtgac

SEQ ID NO: 6021549 - DNA, 18 bp, Homo sapiens
cagcttttcccaaaagcc

SEQ ID NO: 6021550 - DNA, 16 bp, Homo sapiens
cagcttttctcaactg

SEQ ID NO: 6021551 - DNA, 21 bp, Homo sapiens
cagcttttctcaactgggtcc

SEQ ID NO: 6021552 - DNA, 15 bp, Homo sapiens
cagcttttctctttt

SEQ ID NO: 6021553 - DNA, 18 bp, Homo sapiens
cagcttttcttgccagct

SEQ ID NO: 6021554 - DNA, 19 bp, Homo sapiens
cagcttttcttgccagctc

SEQ ID NO: 6021555 - DNA, 15 bp, Homo sapiens
cagcttttgatggta

SEQ ID NO: 6021556 - DNA, 19 bp, Homo sapiens
cagctttttaaagtgggtt

SEQ ID NO: 6021557 - DNA, 21 bp, Homo sapiens
cagctttttattccctgccca

SEQ ID NO: 6021558 - DNA, 18 bp, Homo sapiens
cagctttttgtattaaca

SEQ ID NO: 6021559 - DNA, 20 bp, Homo sapiens
cagctttttgtattaacaaa

SEQ ID NO: 6021560 - DNA, 18 bp, Homo sapiens
cagcttttttagaggtga

SEQ ID NO: 6021561 - DNA, 15 bp, Homo sapiens
cagctttttttgtaa

SEQ ID NO: 6021562 - DNA, 21 bp, Homo sapiens
caggaaaaacaaaacaaagaa

SEQ ID NO: 6021563 - DNA, 13 bp, Homo sapiens
caggaaaaagaac

SEQ ID NO: 6021564 - DNA, 14 bp, Homo sapiens
caggaaaaataaac

SEQ ID NO: 6021565 - DNA, 19 bp, Homo sapiens
caggaaaacacccagggaa

SEQ ID NO: 6021566 - DNA, 16 bp, Homo sapiens
caggaaaacctgcaga

SEQ ID NO: 6021567 - DNA, 20 bp, Homo sapiens
caggaaaactccttgttatc

SEQ ID NO: 6021568 - DNA, 23 bp, Homo sapiens
caggaaaactgacagaggagggc

SEQ ID NO: 6021569 - DNA, 17 bp, Homo sapiens
caggaaaactgtttttc

SEQ ID NO: 6021570 - DNA, 15 bp, Homo sapiens
caggaaaagaaaaat

SEQ ID NO: 6021571 - DNA, 21 bp, Homo sapiens
caggaaaagagggagaagaaa

SEQ ID NO: 6021572 - DNA, 17 bp, Homo sapiens
caggaaaagcctctgtg

SEQ ID NO: 6021573 - DNA, 18 bp, Homo sapiens
caggaaaagcctctgtgt

SEQ ID NO: 6021574 - DNA, 15 bp, Homo sapiens
caggaaaagctgctg

SEQ ID NO: 6021575 - DNA, 19 bp, Homo sapiens
caggaaaagctgctgacag

SEQ ID NO: 6021576 - DNA, 13 bp, Homo sapiens
caggaaaaggcct

SEQ ID NO: 6021577 - DNA, 17 bp, Homo sapiens
caggaaaaggcctgggg

SEQ ID NO: 6021578 - DNA, 20 bp, Homo sapiens
caggaaaataaaatatttaa

SEQ ID NO: 6021579 - DNA, 23 bp, Homo sapiens
caggaaaattgtttgaacccagg

SEQ ID NO: 6021580 - DNA, 12 bp, Homo sapiens
caggaaacaaac

SEQ ID NO: 6021581 - DNA, 21 bp, Homo sapiens
caggaaacagactaaaaagaa

SEQ ID NO: 6021582 - DNA, 23 bp, Homo sapiens
caggaaacagttgcatgtagtaa

SEQ ID NO: 6021583 - DNA, 20 bp, Homo sapiens
caggaaaccacaaccttgca

SEQ ID NO: 6021584 - DNA, 23 bp, Homo sapiens
caggaaaccacaaccttgcagta

SEQ ID NO: 6021585 - DNA, 20 bp, Homo sapiens
caggaaacccagtcgccctt

SEQ ID NO: 6021586 - DNA, 16 bp, Homo sapiens
caggaaaccctcttct

SEQ ID NO: 6021587 - DNA, 19 bp, Homo sapiens
caggaaaccctggcttgct

SEQ ID NO: 6021588 - DNA, 23 bp, Homo sapiens
caggaaactccacatctgcctta

SEQ ID NO: 6021589 - DNA, 18 bp, Homo sapiens
caggaaactcctgtgacc

SEQ ID NO: 6021590 - DNA, 21 bp, Homo sapiens
caggaaactcctgtgaccaca

SEQ ID NO: 6021591 - DNA, 16 bp, Homo sapiens
caggaaagagaacttc

SEQ ID NO: 6021592 - DNA, 18 bp, Homo sapiens
caggaaagagcagtcaga

SEQ ID NO: 6021593 - DNA, 23 bp, Homo sapiens
caggaaagagcagtcagagtcca

SEQ ID NO: 6021594 - DNA, 12 bp, Homo sapiens
caggaaagatgt

SEQ ID NO: 6021595 - DNA, 17 bp, Homo sapiens
caggaaagatgtcccac

SEQ ID NO: 6021596 - DNA, 22 bp, Homo sapiens
caggaaagccacacggagaggc

SEQ ID NO: 6021597 - DNA, 17 bp, Homo sapiens
caggaaagccacatctt

SEQ ID NO: 6021598 - DNA, 18 bp, Homo sapiens
caggaaagccacatcttg

SEQ ID NO: 6021599 - DNA, 23 bp, Homo sapiens
caggaaagccacatcttgctctg

SEQ ID NO: 6021600 - DNA, 14 bp, Homo sapiens
caggaaagccaggc

SEQ ID NO: 6021601 - DNA, 15 bp, Homo sapiens
caggaaagccaggcc

SEQ ID NO: 6021602 - DNA, 14 bp, Homo sapiens
caggaaagccctcc

SEQ ID NO: 6021603 - DNA, 17 bp, Homo sapiens
caggaaagccctccccc

SEQ ID NO: 6021604 - DNA, 19 bp, Homo sapiens
caggaaagccctccccctt

SEQ ID NO: 6021605 - DNA, 20 bp, Homo sapiens
caggaaagcgcctccaaccc

SEQ ID NO: 6021606 - DNA, 18 bp, Homo sapiens
caggaaagcgtttggaaa

SEQ ID NO: 6021607 - DNA, 19 bp, Homo sapiens
caggaaaggctccaggagc

SEQ ID NO: 6021608 - DNA, 13 bp, Homo sapiens
caggaaagggcaa

SEQ ID NO: 6021609 - DNA, 23 bp, Homo sapiens
caggaaagtatctctactttcct

SEQ ID NO: 6021610 - DNA, 14 bp, Homo sapiens
caggaaagttcaga

SEQ ID NO: 6021611 - DNA, 16 bp, Homo sapiens
caggaaagttcagagt

SEQ ID NO: 6021612 - DNA, 13 bp, Homo sapiens
caggaaataaagt

SEQ ID NO: 6021613 - DNA, 15 bp, Homo sapiens
caggaaatacagaga

SEQ ID NO: 6021614 - DNA, 21 bp, Homo sapiens
caggaaatagtgttcttttta

SEQ ID NO: 6021615 - DNA, 13 bp, Homo sapiens
caggaaatatata

SEQ ID NO: 6021616 - DNA, 17 bp, Homo sapiens
caggaaatatatatgtg

SEQ ID NO: 6021617 - DNA, 23 bp, Homo sapiens
caggaaatatctgtgaaggactt

SEQ ID NO: 6021618 - DNA, 22 bp, Homo sapiens
caggaaatcaaatatgcaaagc

SEQ ID NO: 6021619 - DNA, 16 bp, Homo sapiens
caggaaatcagagctg

SEQ ID NO: 6021620 - DNA, 20 bp, Homo sapiens
caggaaatgaaaatgtcttg

SEQ ID NO: 6021621 - DNA, 16 bp, Homo sapiens
caggaaatgctgaccc

SEQ ID NO: 6021622 - DNA, 21 bp, Homo sapiens
caggaaattcagcccaccagc

SEQ ID NO: 6021623 - DNA, 16 bp, Homo sapiens
caggaaatttttgcat

SEQ ID NO: 6021624 - DNA, 20 bp, Homo sapiens
caggaaatttttgcatgttt

SEQ ID NO: 6021625 - DNA, 15 bp, Homo sapiens
caggaacaaacaggg

SEQ ID NO: 6021626 - DNA, 21 bp, Homo sapiens
caggaacaagtaatgtattag

SEQ ID NO: 6021627 - DNA, 21 bp, Homo sapiens
caggaacaatcgatggccttg

SEQ ID NO: 6021628 - DNA, 20 bp, Homo sapiens
caggaacacatgcacacaca

SEQ ID NO: 6021629 - DNA, 20 bp, Homo sapiens
caggaacacccagccccagc

SEQ ID NO: 6021630 - DNA, 22 bp, Homo sapiens
catctttagcagtttcctcagt

SEQ ID NO: 6021631 - DNA, 16 bp, Homo sapiens
catctttatcattaaa

SEQ ID NO: 6021632 - DNA, 22 bp, Homo sapiens
catctttatcattaaacatgaa

SEQ ID NO: 6021633 - DNA, 17 bp, Homo sapiens
catctttatctgttctt

SEQ ID NO: 6021634 - DNA, 23 bp, Homo sapiens
catctttcaccaagatgggtggc

SEQ ID NO: 6021635 - DNA, 20 bp, Homo sapiens
catctttcatagttctgtta

SEQ ID NO: 6021636 - DNA, 21 bp, Homo sapiens
catctttcatagttctgttaa

SEQ ID NO: 6021637 - DNA, 22 bp, Homo sapiens
catctttcatcaatcattgtac

SEQ ID NO: 6021638 - DNA, 14 bp, Homo sapiens
catctttccatcca

SEQ ID NO: 6021639 - DNA, 21 bp, Homo sapiens
catctttccatccattacctc

SEQ ID NO: 6021640 - DNA, 17 bp, Homo sapiens
catctttccctccttgg

SEQ ID NO: 6021641 - DNA, 19 bp, Homo sapiens
catctttcctgatggcagg

SEQ ID NO: 6021642 - DNA, 14 bp, Homo sapiens
catctttcctttgc

SEQ ID NO: 6021643 - DNA, 16 bp, Homo sapiens
catctttcctttgctc

SEQ ID NO: 6021644 - DNA, 19 bp, Homo sapiens
catctttctaatctttttc

SEQ ID NO: 6021645 - DNA, 23 bp, Homo sapiens
catctttcttctattttattccc

SEQ ID NO: 6021646 - DNA, 14 bp, Homo sapiens
catctttctttgga

SEQ ID NO: 6021647 - DNA, 15 bp, Homo sapiens
catctttctttttaa

SEQ ID NO: 6021648 - DNA, 11 bp, Homo sapiens
catctttgaaa

SEQ ID NO: 6021649 - DNA, 16 bp, Homo sapiens
catctttgaaaagaaa

SEQ ID NO: 6021650 - DNA, 21 bp, Homo sapiens
catctttgaaattatgtaaat

SEQ ID NO: 6021651 - DNA, 15 bp, Homo sapiens
catctttgatccttc

SEQ ID NO: 6021652 - DNA, 23 bp, Homo sapiens
catctttgatttagagatgataa

SEQ ID NO: 6021653 - DNA, 15 bp, Homo sapiens
catctttgcccttct

SEQ ID NO: 6021654 - DNA, 22 bp, Homo sapiens
catctttgcctcaactccagga

SEQ ID NO: 6021655 - DNA, 14 bp, Homo sapiens
catctttgcctctc
